United States Patent 11,492,591 (UNIVERSAL DONOR STEM CELLS AND RELATED METHODS) - sequence listing, part 10

SEQ ID NO: 299722 - DNA, 20 bp, Artificial
  CRISPR gRNA sequence
atgtcataaatatcattcta

SEQ ID NO: 299723 - DNA, 20 bp, Artificial
  CRISPR gRNA sequence
ttctacagcatcatttttaa

SEQ ID NO: 299724 - DNA, 20 bp, Artificial
  CRISPR gRNA sequence
gcatcatttttaatggctgc

SEQ ID NO: 299725 - DNA, 20 bp, Artificial
  CRISPR gRNA sequence
ctgcaagatattcccttttg

SEQ ID NO: 299726 - DNA, 20 bp, Artificial
  CRISPR gRNA sequence
atttaaccaacctcattttt

SEQ ID NO: 299727 - DNA, 20 bp, Artificial
  CRISPR gRNA sequence
acctcattttttggacactt

SEQ ID NO: 299728 - DNA, 20 bp, Artificial
  CRISPR gRNA sequence
cattttttggacacttgagt

SEQ ID NO: 299729 - DNA, 20 bp, Artificial
  CRISPR gRNA sequence
ggacacttgagttagtccaa

SEQ ID NO: 299730 - DNA, 20 bp, Artificial
  CRISPR gRNA sequence
tctgttataaaaatgtttca

SEQ ID NO: 299731 - DNA, 20 bp, Artificial
  CRISPR gRNA sequence
ctgttataaaaatgtttcat

SEQ ID NO: 299732 - DNA, 20 bp, Artificial
  CRISPR gRNA sequence
tgttataaaaatgtttcatg

SEQ ID NO: 299733 - DNA, 20 bp, Artificial
  CRISPR gRNA sequence
aaaaatgtttcatggggaca

SEQ ID NO: 299734 - DNA, 20 bp, Artificial
  CRISPR gRNA sequence
aatgtttcatggggacaaag

SEQ ID NO: 299735 - DNA, 20 bp, Artificial
  CRISPR gRNA sequence
aataatgccatgcctttttg

SEQ ID NO: 299736 - DNA, 20 bp, Artificial
  CRISPR gRNA sequence
tgccatgcctttttgtagtt

SEQ ID NO: 299737 - DNA, 20 bp, Artificial
  CRISPR gRNA sequence
tgcctttttgtagtttggtc

SEQ ID NO: 299738 - DNA, 20 bp, Artificial
  CRISPR gRNA sequence
ttgtagtttggtctggttct

SEQ ID NO: 299739 - DNA, 20 bp, Artificial
  CRISPR gRNA sequence
gtttggtctggttctaagct

SEQ ID NO: 299740 - DNA, 20 bp, Artificial
  CRISPR gRNA sequence
gtctggttctaagctaagat

SEQ ID NO: 299741 - DNA, 20 bp, Artificial
  CRISPR gRNA sequence
gctaagattggactttatct

SEQ ID NO: 299742 - DNA, 20 bp, Artificial
  CRISPR gRNA sequence
tttatctcagtaattgcctc

SEQ ID NO: 299743 - DNA, 20 bp, Artificial
  CRISPR gRNA sequence
atctcagtaattgcctccag

SEQ ID NO: 299744 - DNA, 20 bp, Artificial
  CRISPR gRNA sequence
taattgcctccagtagtaat

SEQ ID NO: 299745 - DNA, 20 bp, Artificial
  CRISPR gRNA sequence
ccagtagtaattagtttgat

SEQ ID NO: 299746 - DNA, 20 bp, Artificial
  CRISPR gRNA sequence
tttgattggtgctaataatt

SEQ ID NO: 299747 - DNA, 20 bp, Artificial
  CRISPR gRNA sequence
ttgattggtgctaataatta

SEQ ID NO: 299748 - DNA, 20 bp, Artificial
  CRISPR gRNA sequence
gtaaccttctaactcactta

SEQ ID NO: 299749 - DNA, 20 bp, Artificial
  CRISPR gRNA sequence
accttctaactcacttatgg

SEQ ID NO: 299750 - DNA, 20 bp, Artificial
  CRISPR gRNA sequence
tctaactcacttatggtaga

SEQ ID NO: 299751 - DNA, 20 bp, Artificial
  CRISPR gRNA sequence
tcacttatggtagaaagcac

SEQ ID NO: 299752 - DNA, 20 bp, Artificial
  CRISPR gRNA sequence
tatggtagaaagcacaagat

SEQ ID NO: 299753 - DNA, 20 bp, Artificial
  CRISPR gRNA sequence
cacaagatgagtattgcctc

SEQ ID NO: 299754 - DNA, 20 bp, Artificial
  CRISPR gRNA sequence
agatgagtattgcctctggc

SEQ ID NO: 299755 - DNA, 20 bp, Artificial
  CRISPR gRNA sequence
ctggccagcatcttgttttt

SEQ ID NO: 299756 - DNA, 20 bp, Artificial
  CRISPR gRNA sequence
tactgattttaaaatctaac

SEQ ID NO: 299757 - DNA, 20 bp, Artificial
  CRISPR gRNA sequence
tttaaaatctaactagaaaa

SEQ ID NO: 299758 - DNA, 20 bp, Artificial
  CRISPR gRNA sequence
aaatctaactagaaaataga

SEQ ID NO: 299759 - DNA, 20 bp, Artificial
  CRISPR gRNA sequence
agaaaatagatggatgacat

SEQ ID NO: 299760 - DNA, 20 bp, Artificial
  CRISPR gRNA sequence
aaatagatggatgacattag

SEQ ID NO: 299761 - DNA, 20 bp, Artificial
  CRISPR gRNA sequence
tcctgctgtactttaaaaat

SEQ ID NO: 299762 - DNA, 20 bp, Artificial
  CRISPR gRNA sequence
gtactttaaaaataagaaat

SEQ ID NO: 299763 - DNA, 20 bp, Artificial
  CRISPR gRNA sequence
tactttaaaaataagaaatt

SEQ ID NO: 299764 - DNA, 20 bp, Artificial
  CRISPR gRNA sequence
actttaaaaataagaaattg

SEQ ID NO: 299765 - DNA, 20 bp, Artificial
  CRISPR gRNA sequence
tttaaaaataagaaattggg

SEQ ID NO: 299766 - DNA, 20 bp, Artificial
  CRISPR gRNA sequence
aatttaaataaattaacaca

SEQ ID NO: 299767 - DNA, 20 bp, Artificial
  CRISPR gRNA sequence
ataaattaacacaaagcatg

SEQ ID NO: 299768 - DNA, 20 bp, Artificial
  CRISPR gRNA sequence
aattaacacaaagcatgtgg

SEQ ID NO: 299769 - DNA, 20 bp, Artificial
  CRISPR gRNA sequence
ttaacacaaagcatgtggca

SEQ ID NO: 299770 - DNA, 20 bp, Artificial
  CRISPR gRNA sequence
ccattcaaactgccaatgta

SEQ ID NO: 299771 - DNA, 20 bp, Artificial
  CRISPR gRNA sequence
attcaaactgccaatgtatg

SEQ ID NO: 299772 - DNA, 20 bp, Artificial
  CRISPR gRNA sequence
caatgtatggagtgtgctgc

SEQ ID NO: 299773 - DNA, 20 bp, Artificial
  CRISPR gRNA sequence
gcgagatttctatgatataa

SEQ ID NO: 299774 - DNA, 20 bp, Artificial
  CRISPR gRNA sequence
atataaaagtataaaattcc

SEQ ID NO: 299775 - DNA, 20 bp, Artificial
  CRISPR gRNA sequence
aaagtataaaattcctagca

SEQ ID NO: 299776 - DNA, 20 bp, Artificial
  CRISPR gRNA sequence
aaattcctagcacagatgta

SEQ ID NO: 299777 - DNA, 20 bp, Artificial
  CRISPR gRNA sequence
aaagacatatcatgcttgtc

SEQ ID NO: 299778 - DNA, 20 bp, Artificial
  CRISPR gRNA sequence
aagacatatcatgcttgtcc

SEQ ID NO: 299779 - DNA, 20 bp, Artificial
  CRISPR gRNA sequence
tgtccaggctttgacttttc

SEQ ID NO: 299780 - DNA, 20 bp, Artificial
  CRISPR gRNA sequence
gtccaggctttgacttttca

SEQ ID NO: 299781 - DNA, 20 bp, Artificial
  CRISPR gRNA sequence
aggctttgacttttcaaggt

SEQ ID NO: 299782 - DNA, 20 bp, Artificial
  CRISPR gRNA sequence
gctttgacttttcaaggtga

SEQ ID NO: 299783 - DNA, 20 bp, Artificial
  CRISPR gRNA sequence
cttttcaaggtgagagtttt

SEQ ID NO: 299784 - DNA, 20 bp, Artificial
  CRISPR gRNA sequence
acctcattgccatttaaaat

SEQ ID NO: 299785 - DNA, 20 bp, Artificial
  CRISPR gRNA sequence
tttaaaattagtcaaatatg

SEQ ID NO: 299786 - DNA, 20 bp, Artificial
  CRISPR gRNA sequence
aaaattagtcaaatatgaag

SEQ ID NO: 299787 - DNA, 20 bp, Artificial
  CRISPR gRNA sequence
tgaagaagtgacttacatct

SEQ ID NO: 299788 - DNA, 20 bp, Artificial
  CRISPR gRNA sequence
gaagaagtgacttacatctt

SEQ ID NO: 299789 - DNA, 20 bp, Artificial
  CRISPR gRNA sequence
gtgacttacatcttgggaat

SEQ ID NO: 299790 - DNA, 20 bp, Artificial
  CRISPR gRNA sequence
cttgggaataagctgtttgc

SEQ ID NO: 299791 - DNA, 20 bp, Artificial
  CRISPR gRNA sequence
tgctagatttttcttcacat

SEQ ID NO: 299792 - DNA, 20 bp, Artificial
  CRISPR gRNA sequence
tttcttcacattagaatgat

SEQ ID NO: 299793 - DNA, 20 bp, Artificial
  CRISPR gRNA sequence
atcagcttacaaatgaaaca

SEQ ID NO: 299794 - DNA, 20 bp, Artificial
  CRISPR gRNA sequence
agcttacaaatgaaacaaag

SEQ ID NO: 299795 - DNA, 20 bp, Artificial
  CRISPR gRNA sequence
gcttacaaatgaaacaaaga

SEQ ID NO: 299796 - DNA, 20 bp, Artificial
  CRISPR gRNA sequence
cttacaaatgaaacaaagaa

SEQ ID NO: 299797 - DNA, 20 bp, Artificial
  CRISPR gRNA sequence
caaatgaaacaaagaagggt

SEQ ID NO: 299798 - DNA, 20 bp, Artificial
  CRISPR gRNA sequence
aatgaaacaaagaagggttg

SEQ ID NO: 299799 - DNA, 20 bp, Artificial
  CRISPR gRNA sequence
acaaagaagggttggagaaa

SEQ ID NO: 299800 - DNA, 20 bp, Artificial
  CRISPR gRNA sequence
aagggttggagaaaaagatt

SEQ ID NO: 299801 - DNA, 20 bp, Artificial
  CRISPR gRNA sequence
agggttggagaaaaagatta

SEQ ID NO: 299802 - DNA, 20 bp, Artificial
  CRISPR gRNA sequence
aaggatgtttcttcctccat

SEQ ID NO: 299803 - DNA, 20 bp, Artificial
  CRISPR gRNA sequence
aggatgtttcttcctccatg

SEQ ID NO: 299804 - DNA, 20 bp, Artificial
  CRISPR gRNA sequence
ttcttcctccatgaggcaat

SEQ ID NO: 299805 - DNA, 20 bp, Artificial
  CRISPR gRNA sequence
tgaggcaatcagaaaaaaat

SEQ ID NO: 299806 - DNA, 20 bp, Artificial
  CRISPR gRNA sequence
gaggcaatcagaaaaaaatc

SEQ ID NO: 299807 - DNA, 20 bp, Artificial
  CRISPR gRNA sequence
ggcaatcagaaaaaaatcag

SEQ ID NO: 299808 - DNA, 20 bp, Artificial
  CRISPR gRNA sequence
tcagaaaaaaatcaggagac

SEQ ID NO: 299809 - DNA, 20 bp, Artificial
  CRISPR gRNA sequence
aaaaaaatcaggagactaga

SEQ ID NO: 299810 - DNA, 20 bp, Artificial
  CRISPR gRNA sequence
aaaaaatcaggagactagat

SEQ ID NO: 299811 - DNA, 20 bp, Artificial
  CRISPR gRNA sequence
aaaaatcaggagactagata

SEQ ID NO: 299812 - DNA, 20 bp, Artificial
  CRISPR gRNA sequence
aaaatcaggagactagatag

SEQ ID NO: 299813 - DNA, 20 bp, Artificial
  CRISPR gRNA sequence
aatcaggagactagataggg

SEQ ID NO: 299814 - DNA, 20 bp, Artificial
  CRISPR gRNA sequence
gagactagataggggagata

SEQ ID NO: 299815 - DNA, 20 bp, Artificial
  CRISPR gRNA sequence
gactagataggggagataaa

SEQ ID NO: 299816 - DNA, 20 bp, Artificial
  CRISPR gRNA sequence
actagataggggagataaag

SEQ ID NO: 299817 - DNA, 20 bp, Artificial
  CRISPR gRNA sequence
gaggatatgtgtgttcacat

SEQ ID NO: 299818 - DNA, 20 bp, Artificial
  CRISPR gRNA sequence
ggatatgtgtgttcacatga

SEQ ID NO: 299819 - DNA, 20 bp, Artificial
  CRISPR gRNA sequence
tatgtgtgttcacatgagag

SEQ ID NO: 299820 - DNA, 20 bp, Artificial
  CRISPR gRNA sequence
tgtgttcacatgagagaagt

SEQ ID NO: 299821 - DNA, 20 bp, Artificial
  CRISPR gRNA sequence
gttcacatgagagaagttag

SEQ ID NO: 299822 - DNA, 20 bp, Artificial
  CRISPR gRNA sequence
ttcacatgagagaagttaga

SEQ ID NO: 299823 - DNA, 20 bp, Artificial
  CRISPR gRNA sequence
acatgagagaagttagaagg

SEQ ID NO: 299824 - DNA, 20 bp, Artificial
  CRISPR gRNA sequence
aagttagaaggtggttaaat

SEQ ID NO: 299825 - DNA, 20 bp, Artificial
  CRISPR gRNA sequence
aggtggttaaataagctctg

SEQ ID NO: 299826 - DNA, 20 bp, Artificial
  CRISPR gRNA sequence
ggtggttaaataagctctgt

SEQ ID NO: 299827 - DNA, 20 bp, Artificial
  CRISPR gRNA sequence
ttaaataagctctgtaggta

SEQ ID NO: 299828 - DNA, 20 bp, Artificial
  CRISPR gRNA sequence
taagctctgtaggtacagat

SEQ ID NO: 299829 - DNA, 20 bp, Artificial
  CRISPR gRNA sequence
ctctgtaggtacagatgaga

SEQ ID NO: 299830 - DNA, 20 bp, Artificial
  CRISPR gRNA sequence
gtaggtacagatgagatggt

SEQ ID NO: 299831 - DNA, 20 bp, Artificial
  CRISPR gRNA sequence
tacagatgagatggtcagat

SEQ ID NO: 299832 - DNA, 20 bp, Artificial
  CRISPR gRNA sequence
acagatgagatggtcagatt

SEQ ID NO: 299833 - DNA, 20 bp, Artificial
  CRISPR gRNA sequence
tgagatggtcagattgggct

SEQ ID NO: 299834 - DNA, 20 bp, Artificial
  CRISPR gRNA sequence
gatggtcagattgggctgag

SEQ ID NO: 299835 - DNA, 20 bp, Artificial
  CRISPR gRNA sequence
gtggcacatacatgacccct

SEQ ID NO: 299836 - DNA, 20 bp, Artificial
  CRISPR gRNA sequence
tgacccctaagaatgtaatg

SEQ ID NO: 299837 - DNA, 20 bp, Artificial
  CRISPR gRNA sequence
aagaatgtaatgaagaatat

SEQ ID NO: 299838 - DNA, 20 bp, Artificial
  CRISPR gRNA sequence
atgtaatgaagaatattggt

SEQ ID NO: 299839 - DNA, 20 bp, Artificial
  CRISPR gRNA sequence
tgaagaatattggtaagaaa

SEQ ID NO: 299840 - DNA, 20 bp, Artificial
  CRISPR gRNA sequence
gtaagaaaaagttatttatt

SEQ ID NO: 299841 - DNA, 20 bp, Artificial
  CRISPR gRNA sequence
gaaaaagttatttattcaga

SEQ ID NO: 299842 - DNA, 20 bp, Artificial
  CRISPR gRNA sequence
agacagtcatccatgccact

SEQ ID NO: 299843 - DNA, 20 bp, Artificial
  CRISPR gRNA sequence
catgccactgagtttgatca

SEQ ID NO: 299844 - DNA, 20 bp, Artificial
  CRISPR gRNA sequence
tgccactgagtttgatcaaa

SEQ ID NO: 299845 - DNA, 20 bp, Artificial
  CRISPR gRNA sequence
ccactgagtttgatcaaaga

SEQ ID NO: 299846 - DNA, 20 bp, Artificial
  CRISPR gRNA sequence
ctgagtttgatcaaagagag

SEQ ID NO: 299847 - DNA, 20 bp, Artificial
  CRISPR gRNA sequence
gagaagccttgctatcactg

SEQ ID NO: 299848 - DNA, 20 bp, Artificial
  CRISPR gRNA sequence
agaagccttgctatcactgt

SEQ ID NO: 299849 - DNA, 20 bp, Artificial
  CRISPR gRNA sequence
gaagccttgctatcactgta

SEQ ID NO: 299850 - DNA, 20 bp, Artificial
  CRISPR gRNA sequence
agccttgctatcactgtagg

SEQ ID NO: 299851 - DNA, 20 bp, Artificial
  CRISPR gRNA sequence
gccttgctatcactgtaggg

SEQ ID NO: 299852 - DNA, 20 bp, Artificial
  CRISPR gRNA sequence
ccttgctatcactgtaggga

SEQ ID NO: 299853 - DNA, 20 bp, Artificial
  CRISPR gRNA sequence
ttgctatcactgtagggagg

SEQ ID NO: 299854 - DNA, 20 bp, Artificial
  CRISPR gRNA sequence
tgctatcactgtagggaggg

SEQ ID NO: 299855 - DNA, 20 bp, Artificial
  CRISPR gRNA sequence
ctgtagggagggaggtgcaa

SEQ ID NO: 299856 - DNA, 20 bp, Artificial
  CRISPR gRNA sequence
tgtagggagggaggtgcaac

SEQ ID NO: 299857 - DNA, 20 bp, Artificial
  CRISPR gRNA sequence
caggtataactatgccatta

SEQ ID NO: 299858 - DNA, 20 bp, Artificial
  CRISPR gRNA sequence
atatgatatatttgtaaatt

SEQ ID NO: 299859 - DNA, 20 bp, Artificial
  CRISPR gRNA sequence
aaatttggattctgtaactt

SEQ ID NO: 299860 - DNA, 20 bp, Artificial
  CRISPR gRNA sequence
caatatctgccattgctttg

SEQ ID NO: 299861 - DNA, 20 bp, Artificial
  CRISPR gRNA sequence
aatatctgccattgctttgt

SEQ ID NO: 299862 - DNA, 20 bp, Artificial
  CRISPR gRNA sequence
cattgctttgtgggtactcc

SEQ ID NO: 299863 - DNA, 20 bp, Artificial
  CRISPR gRNA sequence
tttgtgggtactcctggcat

SEQ ID NO: 299864 - DNA, 20 bp, Artificial
  CRISPR gRNA sequence
tcctggcattggctatgtga

SEQ ID NO: 299865 - DNA, 20 bp, Artificial
  CRISPR gRNA sequence
cctggcattggctatgtgat

SEQ ID NO: 299866 - DNA, 20 bp, Artificial
  CRISPR gRNA sequence
ggtaaaataatgccccccac

SEQ ID NO: 299867 - DNA, 20 bp, Artificial
  CRISPR gRNA sequence
gacgtccacctcctatactc

SEQ ID NO: 299868 - DNA, 20 bp, Artificial
  CRISPR gRNA sequence
ctgtaatatgttatcttaca

SEQ ID NO: 299869 - DNA, 20 bp, Artificial
  CRISPR gRNA sequence
tatgttatcttacatggcaa

SEQ ID NO: 299870 - DNA, 20 bp, Artificial
  CRISPR gRNA sequence
atgttatcttacatggcaaa

SEQ ID NO: 299871 - DNA, 20 bp, Artificial
  CRISPR gRNA sequence
atggcaaaaggaacttcaca

SEQ ID NO: 299872 - DNA, 20 bp, Artificial
  CRISPR gRNA sequence
tggcaaaaggaacttcacat

SEQ ID NO: 299873 - DNA, 20 bp, Artificial
  CRISPR gRNA sequence
ggaacttcacataggtgatt

SEQ ID NO: 299874 - DNA, 20 bp, Artificial
  CRISPR gRNA sequence
gaacttcacataggtgatta

SEQ ID NO: 299875 - DNA, 20 bp, Artificial
  CRISPR gRNA sequence
acataggtgattaaggcacc

SEQ ID NO: 299876 - DNA, 20 bp, Artificial
  CRISPR gRNA sequence
gtgattaaggcaccaagctt

SEQ ID NO: 299877 - DNA, 20 bp, Artificial
  CRISPR gRNA sequence
ttaaggcaccaagcttgaga

SEQ ID NO: 299878 - DNA, 20 bp, Artificial
  CRISPR gRNA sequence
ggcaccaagcttgagatggt

SEQ ID NO: 299879 - DNA, 20 bp, Artificial
  CRISPR gRNA sequence
ttgagatggtgagattaacc

SEQ ID NO: 299880 - DNA, 20 bp, Artificial
  CRISPR gRNA sequence
tgagattaacctggattatc

SEQ ID NO: 299881 - DNA, 20 bp, Artificial
  CRISPR gRNA sequence
gagattaacctggattatcc

SEQ ID NO: 299882 - DNA, 20 bp, Artificial
  CRISPR gRNA sequence
attaacctggattatccagg

SEQ ID NO: 299883 - DNA, 20 bp, Artificial
  CRISPR gRNA sequence
ttaacctggattatccaggt

SEQ ID NO: 299884 - DNA, 20 bp, Artificial
  CRISPR gRNA sequence
tgggcccaatgtaatcacat

SEQ ID NO: 299885 - DNA, 20 bp, Artificial
  CRISPR gRNA sequence
cccaatgtaatcacatgagt

SEQ ID NO: 299886 - DNA, 20 bp, Artificial
  CRISPR gRNA sequence
caatgtaatcacatgagtca

SEQ ID NO: 299887 - DNA, 20 bp, Artificial
  CRISPR gRNA sequence
atgagtcagagaacctttcc

SEQ ID NO: 299888 - DNA, 20 bp, Artificial
  CRISPR gRNA sequence
gtcagagaacctttcctagc

SEQ ID NO: 299889 - DNA, 20 bp, Artificial
  CRISPR gRNA sequence
tcagagaacctttcctagct

SEQ ID NO: 299890 - DNA, 20 bp, Artificial
  CRISPR gRNA sequence
agaacctttcctagctggga

SEQ ID NO: 299891 - DNA, 20 bp, Artificial
  CRISPR gRNA sequence
aacctttcctagctgggatg

SEQ ID NO: 299892 - DNA, 20 bp, Artificial
  CRISPR gRNA sequence
gctgggatggagaaatgaac

SEQ ID NO: 299893 - DNA, 20 bp, Artificial
  CRISPR gRNA sequence
gggatggagaaatgaactgg

SEQ ID NO: 299894 - DNA, 20 bp, Artificial
  CRISPR gRNA sequence
atggagaaatgaactggaag

SEQ ID NO: 299895 - DNA, 20 bp, Artificial
  CRISPR gRNA sequence
tggagaaatgaactggaaga

SEQ ID NO: 299896 - DNA, 20 bp, Artificial
  CRISPR gRNA sequence
gagaaatgaactggaagaag

SEQ ID NO: 299897 - DNA, 20 bp, Artificial
  CRISPR gRNA sequence
gaaatgaactggaagaagga

SEQ ID NO: 299898 - DNA, 20 bp, Artificial
  CRISPR gRNA sequence
gaaggagagatctgaaactt

SEQ ID NO: 299899 - DNA, 20 bp, Artificial
  CRISPR gRNA sequence
ggagagatctgaaacttgag

SEQ ID NO: 299900 - DNA, 20 bp, Artificial
  CRISPR gRNA sequence
gaaacttgagaagctcaacc

SEQ ID NO: 299901 - DNA, 20 bp, Artificial
  CRISPR gRNA sequence
gaagctcaacccagcatttc

SEQ ID NO: 299902 - DNA, 20 bp, Artificial
  CRISPR gRNA sequence
acccagcatttctagctttg

SEQ ID NO: 299903 - DNA, 20 bp, Artificial
  CRISPR gRNA sequence
agcatttctagctttgaaga

SEQ ID NO: 299904 - DNA, 20 bp, Artificial
  CRISPR gRNA sequence
atttctagctttgaagatgg

SEQ ID NO: 299905 - DNA, 20 bp, Artificial
  CRISPR gRNA sequence
tttctagctttgaagatgga

SEQ ID NO: 299906 - DNA, 20 bp, Artificial
  CRISPR gRNA sequence
tctagctttgaagatggaag

SEQ ID NO: 299907 - DNA, 20 bp, Artificial
  CRISPR gRNA sequence
ctagctttgaagatggaagg

SEQ ID NO: 299908 - DNA, 20 bp, Artificial
  CRISPR gRNA sequence
gctttgaagatggaaggagg

SEQ ID NO: 299909 - DNA, 20 bp, Artificial
  CRISPR gRNA sequence
agatggaaggaggaagccat

SEQ ID NO: 299910 - DNA, 20 bp, Artificial
  CRISPR gRNA sequence
gaaggaggaagccatgagcc

SEQ ID NO: 299911 - DNA, 20 bp, Artificial
  CRISPR gRNA sequence
aaggaggaagccatgagcca

SEQ ID NO: 299912 - DNA, 20 bp, Artificial
  CRISPR gRNA sequence
agccatgagccaaggaatgt

SEQ ID NO: 299913 - DNA, 20 bp, Artificial
  CRISPR gRNA sequence
catgagccaaggaatgtaag

SEQ ID NO: 299914 - DNA, 20 bp, Artificial
  CRISPR gRNA sequence
caaggaatgtaagtagcttc

SEQ ID NO: 299915 - DNA, 20 bp, Artificial
  CRISPR gRNA sequence
ggaatgtaagtagcttctag

SEQ ID NO: 299916 - DNA, 20 bp, Artificial
  CRISPR gRNA sequence
tgtaagtagcttctagaagc

SEQ ID NO: 299917 - DNA, 20 bp, Artificial
  CRISPR gRNA sequence
aagtagcttctagaagctgg

SEQ ID NO: 299918 - DNA, 20 bp, Artificial
  CRISPR gRNA sequence
tagcttctagaagctggaag

SEQ ID NO: 299919 - DNA, 20 bp, Artificial
  CRISPR gRNA sequence
tagaagctggaagtggctct

SEQ ID NO: 299920 - DNA, 20 bp, Artificial
  CRISPR gRNA sequence
tggaagtggctctcagttga

SEQ ID NO: 299921 - DNA, 20 bp, Artificial
  CRISPR gRNA sequence
agtggctctcagttgacagc

SEQ ID NO: 299922 - DNA, 20 bp, Artificial
  CRISPR gRNA sequence
tcagttgacagccagccatt

SEQ ID NO: 299923 - DNA, 20 bp, Artificial
  CRISPR gRNA sequence
cagttgacagccagccatta

SEQ ID NO: 299924 - DNA, 20 bp, Artificial
  CRISPR gRNA sequence
cagccagccattaaggaaat

SEQ ID NO: 299925 - DNA, 20 bp, Artificial
  CRISPR gRNA sequence
agccagccattaaggaaatt

SEQ ID NO: 299926 - DNA, 20 bp, Artificial
  CRISPR gRNA sequence
cattaaggaaattaggatct

SEQ ID NO: 299927 - DNA, 20 bp, Artificial
  CRISPR gRNA sequence
gatctcagttctgcaactat

SEQ ID NO: 299928 - DNA, 20 bp, Artificial
  CRISPR gRNA sequence
atctcagttctgcaactata

SEQ ID NO: 299929 - DNA, 20 bp, Artificial
  CRISPR gRNA sequence
ctcagttctgcaactataag

SEQ ID NO: 299930 - DNA, 20 bp, Artificial
  CRISPR gRNA sequence
ataaggagctgaattctgcc

SEQ ID NO: 299931 - DNA, 20 bp, Artificial
  CRISPR gRNA sequence
aaggagctgaattctgccaa

SEQ ID NO: 299932 - DNA, 20 bp, Artificial
  CRISPR gRNA sequence
attctgccaagagaccaatg

SEQ ID NO: 299933 - DNA, 20 bp, Artificial
  CRISPR gRNA sequence
ccaagagaccaatgtggaaa

SEQ ID NO: 299934 - DNA, 20 bp, Artificial
  CRISPR gRNA sequence
agagaccaatgtggaaacag

SEQ ID NO: 299935 - DNA, 20 bp, Artificial
  CRISPR gRNA sequence
ggaaacagcagatccctcca

SEQ ID NO: 299936 - DNA, 20 bp, Artificial
  CRISPR gRNA sequence
aaacagcagatccctccaca

SEQ ID NO: 299937 - DNA, 20 bp, Artificial
  CRISPR gRNA sequence
agatccctccacagagacac

SEQ ID NO: 299938 - DNA, 20 bp, Artificial
  CRISPR gRNA sequence
gacacaagcttactgataac

SEQ ID NO: 299939 - DNA, 20 bp, Artificial
  CRISPR gRNA sequence
acaagcttactgataactgg

SEQ ID NO: 299940 - DNA, 20 bp, Artificial
  CRISPR gRNA sequence
caagcttactgataactggt

SEQ ID NO: 299941 - DNA, 20 bp, Artificial
  CRISPR gRNA sequence
actggtaggaatttctccaa

SEQ ID NO: 299942 - DNA, 20 bp, Artificial
  CRISPR gRNA sequence
ggtaggaatttctccaaaag

SEQ ID NO: 299943 - DNA, 20 bp, Artificial
  CRISPR gRNA sequence
taggaatttctccaaaagtg

SEQ ID NO: 299944 - DNA, 20 bp, Artificial
  CRISPR gRNA sequence
agtggagcttcctcctactc

SEQ ID NO: 299945 - DNA, 20 bp, Artificial
  CRISPR gRNA sequence
tccagtgttaatccctttct

SEQ ID NO: 299946 - DNA, 20 bp, Artificial
  CRISPR gRNA sequence
cagtgttaatccctttctca

SEQ ID NO: 299947 - DNA, 20 bp, Artificial
  CRISPR gRNA sequence
agtgttaatccctttctcag

SEQ ID NO: 299948 - DNA, 20 bp, Artificial
  CRISPR gRNA sequence
tgttaatccctttctcagag

SEQ ID NO: 299949 - DNA, 20 bp, Artificial
  CRISPR gRNA sequence
aatccctttctcagaggaga

SEQ ID NO: 299950 - DNA, 20 bp, Artificial
  CRISPR gRNA sequence
ggtcctcaaactaactaact

SEQ ID NO: 299951 - DNA, 20 bp, Artificial
  CRISPR gRNA sequence
actaactaacttggcaccaa

SEQ ID NO: 299952 - DNA, 20 bp, Artificial
  CRISPR gRNA sequence
ttggcaccaaaagtcctatc

SEQ ID NO: 299953 - DNA, 20 bp, Artificial
  CRISPR gRNA sequence
tatccagtgttttctcatta

SEQ ID NO: 299954 - DNA, 20 bp, Artificial
  CRISPR gRNA sequence
ctcaactgtatatatttacc

SEQ ID NO: 299955 - DNA, 20 bp, Artificial
  CRISPR gRNA sequence
ctgtatatatttacccagtt

SEQ ID NO: 299956 - DNA, 20 bp, Artificial
  CRISPR gRNA sequence
tgtatatatttacccagttt

SEQ ID NO: 299957 - DNA, 20 bp, Artificial
  CRISPR gRNA sequence
aggctgtttaaatgaataaa

SEQ ID NO: 299958 - DNA, 20 bp, Artificial
  CRISPR gRNA sequence
ggctgtttaaatgaataaaa

SEQ ID NO: 299959 - DNA, 20 bp, Artificial
  CRISPR gRNA sequence
tgaataaaaaggaaatgcca

SEQ ID NO: 299960 - DNA, 20 bp, Artificial
  CRISPR gRNA sequence
aggaaatgccatagttattc

SEQ ID NO: 299961 - DNA, 20 bp, Artificial
  CRISPR gRNA sequence
aatgccatagttattctagc

SEQ ID NO: 299962 - DNA, 20 bp, Artificial
  CRISPR gRNA sequence
tctttttttgttttgtcaaa

SEQ ID NO: 299963 - DNA, 20 bp, Artificial
  CRISPR gRNA sequence
ctttttttgttttgtcaaat

SEQ ID NO: 299964 - DNA, 20 bp, Artificial
  CRISPR gRNA sequence
tttttttgttttgtcaaata

SEQ ID NO: 299965 - DNA, 20 bp, Artificial
  CRISPR gRNA sequence
ttttgttttgtcaaataggg

SEQ ID NO: 299966 - DNA, 20 bp, Artificial
  CRISPR gRNA sequence
ttttgtcaaatagggcagat

SEQ ID NO: 299967 - DNA, 20 bp, Artificial
  CRISPR gRNA sequence
tttgtcaaatagggcagata

SEQ ID NO: 299968 - DNA, 20 bp, Artificial
  CRISPR gRNA sequence
aaatagggcagataaggcat

SEQ ID NO: 299969 - DNA, 20 bp, Artificial
  CRISPR gRNA sequence
aattactgtcttttcccaaa

SEQ ID NO: 299970 - DNA, 20 bp, Artificial
  CRISPR gRNA sequence
ccaaacagaaatcaccctat

SEQ ID NO: 299971 - DNA, 20 bp, Artificial
  CRISPR gRNA sequence
caccctatcagcttacccat

SEQ ID NO: 299972 - DNA, 20 bp, Artificial
  CRISPR gRNA sequence
accctatcagcttacccatt

SEQ ID NO: 299973 - DNA, 20 bp, Artificial
  CRISPR gRNA sequence
cctatcagcttacccattgg

SEQ ID NO: 299974 - DNA, 20 bp, Artificial
  CRISPR gRNA sequence
cattgggagaaaaactaaaa

SEQ ID NO: 299975 - DNA, 20 bp, Artificial
  CRISPR gRNA sequence
tgaaattttacttcctcatt

SEQ ID NO: 299976 - DNA, 20 bp, Artificial
  CRISPR gRNA sequence
gaaattttacttcctcattt

SEQ ID NO: 299977 - DNA, 20 bp, Artificial
  CRISPR gRNA sequence
gaaatctgtatacaatgccc

SEQ ID NO: 299978 - DNA, 20 bp, Artificial
  CRISPR gRNA sequence
atacaatgccctagcaacaa

SEQ ID NO: 299979 - DNA, 20 bp, Artificial
  CRISPR gRNA sequence
cctagcaacaacggttttta

SEQ ID NO: 299980 - DNA, 20 bp, Artificial
  CRISPR gRNA sequence
gtttttacagcttgcctccc

SEQ ID NO: 299981 - DNA, 20 bp, Artificial
  CRISPR gRNA sequence
ttgcctccctagaacaaacc

SEQ ID NO: 299982 - DNA, 20 bp, Artificial
  CRISPR gRNA sequence
tgcctccctagaacaaacct

SEQ ID NO: 299983 - DNA, 20 bp, Artificial
  CRISPR gRNA sequence
cctccctagaacaaacctag

SEQ ID NO: 299984 - DNA, 20 bp, Artificial
  CRISPR gRNA sequence
tagaacaaacctaggagtct

SEQ ID NO: 299985 - DNA, 20 bp, Artificial
  CRISPR gRNA sequence
cctaggagtctcagctgttt

SEQ ID NO: 299986 - DNA, 20 bp, Artificial
  CRISPR gRNA sequence
ctaggagtctcagctgtttc

SEQ ID NO: 299987 - DNA, 20 bp, Artificial
  CRISPR gRNA sequence
gtttcaggaatgatttctta

SEQ ID NO: 299988 - DNA, 20 bp, Artificial
  CRISPR gRNA sequence
tttcaggaatgatttcttaa

SEQ ID NO: 299989 - DNA, 20 bp, Artificial
  CRISPR gRNA sequence
ggaatgatttcttaaaggta

SEQ ID NO: 299990 - DNA, 20 bp, Artificial
  CRISPR gRNA sequence
aggtaaagtgcctttttcaa

SEQ ID NO: 299991 - DNA, 20 bp, Artificial
  CRISPR gRNA sequence
ttttttttttgtgtgtgtgt

SEQ ID NO: 299992 - DNA, 20 bp, Artificial
  CRISPR gRNA sequence
ttttttgtgtgtgtgtgaga

SEQ ID NO: 299993 - DNA, 20 bp, Artificial
  CRISPR gRNA sequence
ttttgtgtgtgtgtgagaca

SEQ ID NO: 299994 - DNA, 20 bp, Artificial
  CRISPR gRNA sequence
acagagcctcactctgtcac

SEQ ID NO: 299995 - DNA, 20 bp, Artificial
  CRISPR gRNA sequence
cagagcctcactctgtcacc

SEQ ID NO: 299996 - DNA, 20 bp, Artificial
  CRISPR gRNA sequence
gcctcactctgtcaccaggc

SEQ ID NO: 299997 - DNA, 20 bp, Artificial
  CRISPR gRNA sequence
ctcactctgtcaccaggctg

SEQ ID NO: 299998 - DNA, 20 bp, Artificial
  CRISPR gRNA sequence
tctgtcaccaggctggagtg

SEQ ID NO: 299999 - DNA, 20 bp, Artificial
  CRISPR gRNA sequence
gtcaccaggctggagtgcag

SEQ ID NO: 300000 - DNA, 20 bp, Artificial
  CRISPR gRNA sequence
ggagtgcagtggcacgatct

SEQ ID NO: 300001 - DNA, 20 bp, Artificial
  CRISPR gRNA sequence
acactgcaacctctgcctcc

SEQ ID NO: 300002 - DNA, 20 bp, Artificial
  CRISPR gRNA sequence
cactgcaacctctgcctccc

SEQ ID NO: 300003 - DNA, 20 bp, Artificial
  CRISPR gRNA sequence
aacctctgcctcccaggttc

SEQ ID NO: 300004 - DNA, 20 bp, Artificial
  CRISPR gRNA sequence
ttcaagcgattctcctgcct

SEQ ID NO: 300005 - DNA, 20 bp, Artificial
  CRISPR gRNA sequence
ttctcctgcctcagcctccc

SEQ ID NO: 300006 - DNA, 20 bp, Artificial
  CRISPR gRNA sequence
tcctgcctcagcctcccaag

SEQ ID NO: 300007 - DNA, 20 bp, Artificial
  CRISPR gRNA sequence
gcctcagcctcccaagtagc

SEQ ID NO: 300008 - DNA, 20 bp, Artificial
  CRISPR gRNA sequence
cctcagcctcccaagtagct

SEQ ID NO: 300009 - DNA, 20 bp, Artificial
  CRISPR gRNA sequence
ctcccaagtagctgggacta

SEQ ID NO: 300010 - DNA, 20 bp, Artificial
  CRISPR gRNA sequence
tcccaagtagctgggactac

SEQ ID NO: 300011 - DNA, 20 bp, Artificial
  CRISPR gRNA sequence
gactacaggcacgtgccacc

SEQ ID NO: 300012 - DNA, 20 bp, Artificial
  CRISPR gRNA sequence
caggcacgtgccaccaagcc

SEQ ID NO: 300013 - DNA, 20 bp, Artificial
  CRISPR gRNA sequence
aggcacgtgccaccaagccc

SEQ ID NO: 300014 - DNA, 20 bp, Artificial
  CRISPR gRNA sequence
ccaggtaatttttgtatttt

SEQ ID NO: 300015 - DNA, 20 bp, Artificial
  CRISPR gRNA sequence
ggtaatttttgtattttcag

SEQ ID NO: 300016 - DNA, 20 bp, Artificial
  CRISPR gRNA sequence
taatttttgtattttcagta

SEQ ID NO: 300017 - DNA, 20 bp, Artificial
  CRISPR gRNA sequence
ttttgtattttcagtagaga

SEQ ID NO: 300018 - DNA, 20 bp, Artificial
  CRISPR gRNA sequence
tttgtattttcagtagagat

SEQ ID NO: 300019 - DNA, 20 bp, Artificial
  CRISPR gRNA sequence
gagatgggttttcaccatgt

SEQ ID NO: 300020 - DNA, 20 bp, Artificial
  CRISPR gRNA sequence
tgggttttcaccatgttggc

SEQ ID NO: 300021 - DNA, 20 bp, Artificial
  CRISPR gRNA sequence
gggttttcaccatgttggcc

SEQ ID NO: 300022 - DNA, 20 bp, Artificial
  CRISPR gRNA sequence
tttcaccatgttggccagga

SEQ ID NO: 300023 - DNA, 20 bp, Artificial
  CRISPR gRNA sequence
gtttttaaccaacatttaaa

SEQ ID NO: 300024 - DNA, 20 bp, Artificial
  CRISPR gRNA sequence
catttaaacagaaatattca

SEQ ID NO: 300025 - DNA, 20 bp, Artificial
  CRISPR gRNA sequence
atttaaacagaaatattcac

SEQ ID NO: 300026 - DNA, 20 bp, Artificial
  CRISPR gRNA sequence
cagaaatattcacaggctta

SEQ ID NO: 300027 - DNA, 20 bp, Artificial
  CRISPR gRNA sequence
ttcacaggcttaaagactga

SEQ ID NO: 300028 - DNA, 20 bp, Artificial
  CRISPR gRNA sequence
caggcttaaagactgaaagt

SEQ ID NO: 300029 - DNA, 20 bp, Artificial
  CRISPR gRNA sequence
cttcaaaatgctgaatttgt

SEQ ID NO: 300030 - DNA, 20 bp, Artificial
  CRISPR gRNA sequence
gaatttgtaagcaaatttaa

SEQ ID NO: 300031 - DNA, 20 bp, Artificial
  CRISPR gRNA sequence
tgtaagcaaatttaaaagtt

SEQ ID NO: 300032 - DNA, 20 bp, Artificial
  CRISPR gRNA sequence
gtctgctttcatttttttga

SEQ ID NO: 300033 - DNA, 20 bp, Artificial
  CRISPR gRNA sequence
tgctttcatttttttgacag

SEQ ID NO: 300034 - DNA, 20 bp, Artificial
  CRISPR gRNA sequence
gacagtggctttttttgata

SEQ ID NO: 300035 - DNA, 20 bp, Artificial
  CRISPR gRNA sequence
atatggtgactattttgtca

SEQ ID NO: 300036 - DNA, 20 bp, Artificial
  CRISPR gRNA sequence
tatggtgactattttgtcat

SEQ ID NO: 300037 - DNA, 20 bp, Artificial
  CRISPR gRNA sequence
ctattttgtcatgggtataa

SEQ ID NO: 300038 - DNA, 20 bp, Artificial
  CRISPR gRNA sequence
tattttgtcatgggtataaa

SEQ ID NO: 300039 - DNA, 20 bp, Artificial
  CRISPR gRNA sequence
attcattttgtgttaatctg

SEQ ID NO: 300040 - DNA, 20 bp, Artificial
  CRISPR gRNA sequence
gaaatactgtattcaactat

SEQ ID NO: 300041 - DNA, 20 bp, Artificial
  CRISPR gRNA sequence
gtacctttttttacatttat

SEQ ID NO: 300042 - DNA, 20 bp, Artificial
  CRISPR gRNA sequence
tttcaaaatttttatttgaa

SEQ ID NO: 300043 - DNA, 20 bp, Artificial
  CRISPR gRNA sequence
tttttatttgaatagttttt

SEQ ID NO: 300044 - DNA, 20 bp, Artificial
  CRISPR gRNA sequence
ttttatttgaatagtttttt

SEQ ID NO: 300045 - DNA, 20 bp, Artificial
  CRISPR gRNA sequence
tgggaactactgaactaaac

SEQ ID NO: 300046 - DNA, 20 bp, Artificial
  CRISPR gRNA sequence
gggaactactgaactaaact

SEQ ID NO: 300047 - DNA, 20 bp, Artificial
  CRISPR gRNA sequence
aactactgaactaaactagg

SEQ ID NO: 300048 - DNA, 20 bp, Artificial
  CRISPR gRNA sequence
gaactaaactaggtggtttt

SEQ ID NO: 300049 - DNA, 20 bp, Artificial
  CRISPR gRNA sequence
ctaggtggtttttggttaca

SEQ ID NO: 300050 - DNA, 20 bp, Artificial
  CRISPR gRNA sequence
tggtttttggttacatggat

SEQ ID NO: 300051 - DNA, 20 bp, Artificial
  CRISPR gRNA sequence
ggttacatggataagttatt

SEQ ID NO: 300052 - DNA, 20 bp, Artificial
  CRISPR gRNA sequence
tacatggataagttatttag

SEQ ID NO: 300053 - DNA, 20 bp, Artificial
  CRISPR gRNA sequence
gttatttagtggtgatttct

SEQ ID NO: 300054 - DNA, 20 bp, Artificial
  CRISPR gRNA sequence
agtggtgatttctgagactt

SEQ ID NO: 300055 - DNA, 20 bp, Artificial
  CRISPR gRNA sequence
tttggtgccacctgtcactc

SEQ ID NO: 300056 - DNA, 20 bp, Artificial
  CRISPR gRNA sequence
ggtgccacctgtcactcgag

SEQ ID NO: 300057 - DNA, 20 bp, Artificial
  CRISPR gRNA sequence
tcgagcagtgtacactgcac

SEQ ID NO: 300058 - DNA, 20 bp, Artificial
  CRISPR gRNA sequence
gtgtacactgcaccagtgtg

SEQ ID NO: 300059 - DNA, 20 bp, Artificial
  CRISPR gRNA sequence
cccctcccactctttcctct

SEQ ID NO: 300060 - DNA, 20 bp, Artificial
  CRISPR gRNA sequence
ctctttcctctgagtcccca

SEQ ID NO: 300061 - DNA, 20 bp, Artificial
  CRISPR gRNA sequence
cttatgtctttgcatcctca

SEQ ID NO: 300062 - DNA, 20 bp, Artificial
  CRISPR gRNA sequence
gtctttgcatcctcatagtt

SEQ ID NO: 300063 - DNA, 20 bp, Artificial
  CRISPR gRNA sequence
atagtttagctcccacttat

SEQ ID NO: 300064 - DNA, 20 bp, Artificial
  CRISPR gRNA sequence
atatttgtttctccattctt

SEQ ID NO: 300065 - DNA, 20 bp, Artificial
  CRISPR gRNA sequence
cattcttgagttacttcact

SEQ ID NO: 300066 - DNA, 20 bp, Artificial
  CRISPR gRNA sequence
agttacttcacttagaataa

SEQ ID NO: 300067 - DNA, 20 bp, Artificial
  CRISPR gRNA sequence
tcacttagaataatggtctc

SEQ ID NO: 300068 - DNA, 20 bp, Artificial
  CRISPR gRNA sequence
aatggtctctggttccatca

SEQ ID NO: 300069 - DNA, 20 bp, Artificial
  CRISPR gRNA sequence
cattattttgtttcttttta

SEQ ID NO: 300070 - DNA, 20 bp, Artificial
  CRISPR gRNA sequence
ttttgtttctttttatggct

SEQ ID NO: 300071 - DNA, 20 bp, Artificial
  CRISPR gRNA sequence
atggctgagtaatattccat

SEQ ID NO: 300072 - DNA, 20 bp, Artificial
  CRISPR gRNA sequence
tggctgagtaatattccatg

SEQ ID NO: 300073 - DNA, 20 bp, Artificial
  CRISPR gRNA sequence
ggctgagtaatattccatga

SEQ ID NO: 300074 - DNA, 20 bp, Artificial
  CRISPR gRNA sequence
acattttccttatccactca

SEQ ID NO: 300075 - DNA, 20 bp, Artificial
  CRISPR gRNA sequence
cattttccttatccactcat

SEQ ID NO: 300076 - DNA, 20 bp, Artificial
  CRISPR gRNA sequence
cttatccactcatgggttga

SEQ ID NO: 300077 - DNA, 20 bp, Artificial
  CRISPR gRNA sequence
ctcatgggttgatggacatt

SEQ ID NO: 300078 - DNA, 20 bp, Artificial
  CRISPR gRNA sequence
tcatgggttgatggacattt

SEQ ID NO: 300079 - DNA, 20 bp, Artificial
  CRISPR gRNA sequence
gggttgatggacatttaggt

SEQ ID NO: 300080 - DNA, 20 bp, Artificial
  CRISPR gRNA sequence
ttaggttggttccttatttt

SEQ ID NO: 300081 - DNA, 20 bp, Artificial
  CRISPR gRNA sequence
tataatgaattattttcctt

SEQ ID NO: 300082 - DNA, 20 bp, Artificial
  CRISPR gRNA sequence
ataatgaattattttccttt

SEQ ID NO: 300083 - DNA, 20 bp, Artificial
  CRISPR gRNA sequence
ttttcctttgggtatatacc

SEQ ID NO: 300084 - DNA, 20 bp, Artificial
  CRISPR gRNA sequence
tcctttgggtatatacccag

SEQ ID NO: 300085 - DNA, 20 bp, Artificial
  CRISPR gRNA sequence
tttgggtatatacccagtag

SEQ ID NO: 300086 - DNA, 20 bp, Artificial
  CRISPR gRNA sequence
ttgggtatatacccagtagt

SEQ ID NO: 300087 - DNA, 20 bp, Artificial
  CRISPR gRNA sequence
agtaggattgctgaattaaa

SEQ ID NO: 300088 - DNA, 20 bp, Artificial
  CRISPR gRNA sequence
aggattgctgaattaaatag

SEQ ID NO: 300089 - DNA, 20 bp, Artificial
  CRISPR gRNA sequence
gattgctgaattaaatagta

SEQ ID NO: 300090 - DNA, 20 bp, Artificial
  CRISPR gRNA sequence
aaatagtagagttctacttt

SEQ ID NO: 300091 - DNA, 20 bp, Artificial
  CRISPR gRNA sequence
agttctacttttagttcttt

SEQ ID NO: 300092 - DNA, 20 bp, Artificial
  CRISPR gRNA sequence
gttctacttttagttcttta

SEQ ID NO: 300093 - DNA, 20 bp, Artificial
  CRISPR gRNA sequence
aatctccatactgttttcca

SEQ ID NO: 300094 - DNA, 20 bp, Artificial
  CRISPR gRNA sequence
gttttccatagtgtttgtac

SEQ ID NO: 300095 - DNA, 20 bp, Artificial
  CRISPR gRNA sequence
gtactagtttacattcccac

SEQ ID NO: 300096 - DNA, 20 bp, Artificial
  CRISPR gRNA sequence
ctagtttacattcccaccag

SEQ ID NO: 300097 - DNA, 20 bp, Artificial
  CRISPR gRNA sequence
attttttgattttttaataa

SEQ ID NO: 300098 - DNA, 20 bp, Artificial
  CRISPR gRNA sequence
tttaataatggccattcttg

SEQ ID NO: 300099 - DNA, 20 bp, Artificial
  CRISPR gRNA sequence
ttaataatggccattcttgc

SEQ ID NO: 300100 - DNA, 20 bp, Artificial
  CRISPR gRNA sequence
aataatggccattcttgcag

SEQ ID NO: 300101 - DNA, 20 bp, Artificial
  CRISPR gRNA sequence
atggccattcttgcaggagt

SEQ ID NO: 300102 - DNA, 20 bp, Artificial
  CRISPR gRNA sequence
tggccattcttgcaggagta

SEQ ID NO: 300103 - DNA, 20 bp, Artificial
  CRISPR gRNA sequence
ccattcttgcaggagtaagg

SEQ ID NO: 300104 - DNA, 20 bp, Artificial
  CRISPR gRNA sequence
aggagtaaggtggtatctca

SEQ ID NO: 300105 - DNA, 20 bp, Artificial
  CRISPR gRNA sequence
agtaaggtggtatctcatgg

SEQ ID NO: 300106 - DNA, 20 bp, Artificial
  CRISPR gRNA sequence
tttaatttgcatttccctga

SEQ ID NO: 300107 - DNA, 20 bp, Artificial
  CRISPR gRNA sequence
atttgcatttccctgatagt

SEQ ID NO: 300108 - DNA, 20 bp, Artificial
  CRISPR gRNA sequence
gaactttttttcatgtttgt

SEQ ID NO: 300109 - DNA, 20 bp, Artificial
  CRISPR gRNA sequence
ccatttgtatattttctttt

SEQ ID NO: 300110 - DNA, 20 bp, Artificial
  CRISPR gRNA sequence
ttataaacaccattattttt

SEQ ID NO: 300111 - DNA, 20 bp, Artificial
  CRISPR gRNA sequence
taaacaccattatttttaag

SEQ ID NO: 300112 - DNA, 20 bp, Artificial
  CRISPR gRNA sequence
aagaagaaactttacaaaaa

SEQ ID NO: 300113 - DNA, 20 bp, Artificial
  CRISPR gRNA sequence
ttacaaaaatagaacataac

SEQ ID NO: 300114 - DNA, 20 bp, Artificial
  CRISPR gRNA sequence
agaacataaccagatttata

SEQ ID NO: 300115 - DNA, 20 bp, Artificial
  CRISPR gRNA sequence
aaccagatttataaagcatc

SEQ ID NO: 300116 - DNA, 20 bp, Artificial
  CRISPR gRNA sequence
accagatttataaagcatct

SEQ ID NO: 300117 - DNA, 20 bp, Artificial
  CRISPR gRNA sequence
ttataaagcatctgggaact

SEQ ID NO: 300118 - DNA, 20 bp, Artificial
  CRISPR gRNA sequence
atctgggaactcagtcaatt

SEQ ID NO: 300119 - DNA, 20 bp, Artificial
  CRISPR gRNA sequence
gaactcagtcaattaagaaa

SEQ ID NO: 300120 - DNA, 20 bp, Artificial
  CRISPR gRNA sequence
agtcaattaagaaatagctc

SEQ ID NO: 300121 - DNA, 20 bp, Artificial
  CRISPR gRNA sequence
actgatgatgcttcacctga

SEQ ID NO: 300122 - DNA, 20 bp, Artificial
  CRISPR gRNA sequence
gatgatgcttcacctgaaag

SEQ ID NO: 300123 - DNA, 20 bp, Artificial
  CRISPR gRNA sequence
atgatgcttcacctgaaaga

SEQ ID NO: 300124 - DNA, 20 bp, Artificial
  CRISPR gRNA sequence
gcttcacctgaaagaaggcc

SEQ ID NO: 300125 - DNA, 20 bp, Artificial
  CRISPR gRNA sequence
ttcacctgaaagaaggcctg

SEQ ID NO: 300126 - DNA, 20 bp, Artificial
  CRISPR gRNA sequence
cacctgaaagaaggcctgga

SEQ ID NO: 300127 - DNA, 20 bp, Artificial
  CRISPR gRNA sequence
gaaagaaggcctggagagaa

SEQ ID NO: 300128 - DNA, 20 bp, Artificial
  CRISPR gRNA sequence
aagaaggcctggagagaaca

SEQ ID NO: 300129 - DNA, 20 bp, Artificial
  CRISPR gRNA sequence
atactgtcttcaaatatctg

SEQ ID NO: 300130 - DNA, 20 bp, Artificial
  CRISPR gRNA sequence
actgtcttcaaatatctgaa

SEQ ID NO: 300131 - DNA, 20 bp, Artificial
  CRISPR gRNA sequence
aaatatctgaagagctacca

SEQ ID NO: 300132 - DNA, 20 bp, Artificial
  CRISPR gRNA sequence
aatatctgaagagctaccat

SEQ ID NO: 300133 - DNA, 20 bp, Artificial
  CRISPR gRNA sequence
aagagctaccatgggatgca

SEQ ID NO: 300134 - DNA, 20 bp, Artificial
  CRISPR gRNA sequence
taccatgggatgcaaagatt

SEQ ID NO: 300135 - DNA, 20 bp, Artificial
  CRISPR gRNA sequence
gatgcaaagattgagcttga

SEQ ID NO: 300136 - DNA, 20 bp, Artificial
  CRISPR gRNA sequence
agcttgatggtatgactctg

SEQ ID NO: 300137 - DNA, 20 bp, Artificial
  CRISPR gRNA sequence
gcttgatggtatgactctga

SEQ ID NO: 300138 - DNA, 20 bp, Artificial
  CRISPR gRNA sequence
cttgatggtatgactctgaa

SEQ ID NO: 300139 - DNA, 20 bp, Artificial
  CRISPR gRNA sequence
gaagggcatctctatgaatg

SEQ ID NO: 300140 - DNA, 20 bp, Artificial
  CRISPR gRNA sequence
aagggcatctctatgaatga

SEQ ID NO: 300141 - DNA, 20 bp, Artificial
  CRISPR gRNA sequence
tctctatgaatgaaggttat

SEQ ID NO: 300142 - DNA, 20 bp, Artificial
  CRISPR gRNA sequence
tctatgaatgaaggttatga

SEQ ID NO: 300143 - DNA, 20 bp, Artificial
  CRISPR gRNA sequence
ctatgaatgaaggttatgag

SEQ ID NO: 300144 - DNA, 20 bp, Artificial
  CRISPR gRNA sequence
tatgaatgaaggttatgaga

SEQ ID NO: 300145 - DNA, 20 bp, Artificial
  CRISPR gRNA sequence
tgaaggttatgagagggtat

SEQ ID NO: 300146 - DNA, 20 bp, Artificial
  CRISPR gRNA sequence
gaaggttatgagagggtata

SEQ ID NO: 300147 - DNA, 20 bp, Artificial
  CRISPR gRNA sequence
atgagagggtataaggaatt

SEQ ID NO: 300148 - DNA, 20 bp, Artificial
  CRISPR gRNA sequence
gagagggtataaggaattaa

SEQ ID NO: 300149 - DNA, 20 bp, Artificial
  CRISPR gRNA sequence
gagggtataaggaattaaga

SEQ ID NO: 300150 - DNA, 20 bp, Artificial
  CRISPR gRNA sequence
gagacttttctaacaattaa

SEQ ID NO: 300151 - DNA, 20 bp, Artificial
  CRISPR gRNA sequence
agacttttctaacaattaaa

SEQ ID NO: 300152 - DNA, 20 bp, Artificial
  CRISPR gRNA sequence
ctaacaattaaaaggtcttt

SEQ ID NO: 300153 - DNA, 20 bp, Artificial
  CRISPR gRNA sequence
taacaattaaaaggtctttt

SEQ ID NO: 300154 - DNA, 20 bp, Artificial
  CRISPR gRNA sequence
aattaaaaggtcttttaggc

SEQ ID NO: 300155 - DNA, 20 bp, Artificial
  CRISPR gRNA sequence
attaaaaggtcttttaggcc

SEQ ID NO: 300156 - DNA, 20 bp, Artificial
  CRISPR gRNA sequence
ttaaaaggtcttttaggcca

SEQ ID NO: 300157 - DNA, 20 bp, Artificial
  CRISPR gRNA sequence
taaaaggtcttttaggccag

SEQ ID NO: 300158 - DNA, 20 bp, Artificial
  CRISPR gRNA sequence
aaggtcttttaggccagggg

SEQ ID NO: 300159 - DNA, 20 bp, Artificial
  CRISPR gRNA sequence
gtcttttaggccaggggtgg

SEQ ID NO: 300160 - DNA, 20 bp, Artificial
  CRISPR gRNA sequence
gtggctcacacctgtaatcc

SEQ ID NO: 300161 - DNA, 20 bp, Artificial
  CRISPR gRNA sequence
acctgtaatcccagcacttt

SEQ ID NO: 300162 - DNA, 20 bp, Artificial
  CRISPR gRNA sequence
ctgtaatcccagcacttttg

SEQ ID NO: 300163 - DNA, 20 bp, Artificial
  CRISPR gRNA sequence
tgtaatcccagcacttttgg

SEQ ID NO: 300164 - DNA, 20 bp, Artificial
  CRISPR gRNA sequence
tcccagcacttttggaggct

SEQ ID NO: 300165 - DNA, 20 bp, Artificial
  CRISPR gRNA sequence
cccagcacttttggaggctg

SEQ ID NO: 300166 - DNA, 20 bp, Artificial
  CRISPR gRNA sequence
agcacttttggaggctgagg

SEQ ID NO: 300167 - DNA, 20 bp, Artificial
  CRISPR gRNA sequence
gcacttttggaggctgaggc

SEQ ID NO: 300168 - DNA, 20 bp, Artificial
  CRISPR gRNA sequence
cttttggaggctgaggcagg

SEQ ID NO: 300169 - DNA, 20 bp, Artificial
  CRISPR gRNA sequence
ctgaggcaggcagatcacct

SEQ ID NO: 300170 - DNA, 20 bp, Artificial
  CRISPR gRNA sequence
gcaggcagatcaccttagat

SEQ ID NO: 300171 - DNA, 20 bp, Artificial
  CRISPR gRNA sequence
caggcagatcaccttagatc

SEQ ID NO: 300172 - DNA, 20 bp, Artificial
  CRISPR gRNA sequence
ggcagatcaccttagatcag

SEQ ID NO: 300173 - DNA, 20 bp, Artificial
  CRISPR gRNA sequence
tcaccttagatcaggagttc

SEQ ID NO: 300174 - DNA, 20 bp, Artificial
  CRISPR gRNA sequence
tcaggagttcgagacccgcc

SEQ ID NO: 300175 - DNA, 20 bp, Artificial
  CRISPR gRNA sequence
cgagacccgcctggccaaca

SEQ ID NO: 300176 - DNA, 20 bp, Artificial
  CRISPR gRNA sequence
tctactaaacatacaaaaat

SEQ ID NO: 300177 - DNA, 20 bp, Artificial
  CRISPR gRNA sequence
ctaaacatacaaaaattagc

SEQ ID NO: 300178 - DNA, 20 bp, Artificial
  CRISPR gRNA sequence
taaacatacaaaaattagct

SEQ ID NO: 300179 - DNA, 20 bp, Artificial
  CRISPR gRNA sequence
atacaaaaattagctgggtg

SEQ ID NO: 300180 - DNA, 20 bp, Artificial
  CRISPR gRNA sequence
caaaaattagctgggtgtgg

SEQ ID NO: 300181 - DNA, 20 bp, Artificial
  CRISPR gRNA sequence
aaattagctgggtgtggtgg

SEQ ID NO: 300182 - DNA, 20 bp, Artificial
  CRISPR gRNA sequence
aattagctgggtgtggtggc

SEQ ID NO: 300183 - DNA, 20 bp, Artificial
  CRISPR gRNA sequence
gtggcaggcacctgtaatcc

SEQ ID NO: 300184 - DNA, 20 bp, Artificial
  CRISPR gRNA sequence
cacctgtaatcccagctact

SEQ ID NO: 300185 - DNA, 20 bp, Artificial
  CRISPR gRNA sequence
acctgtaatcccagctactt

SEQ ID NO: 300186 - DNA, 20 bp, Artificial
  CRISPR gRNA sequence
ctgtaatcccagctacttgg

SEQ ID NO: 300187 - DNA, 20 bp, Artificial
  CRISPR gRNA sequence
tgtaatcccagctacttggg

SEQ ID NO: 300188 - DNA, 20 bp, Artificial
  CRISPR gRNA sequence
tcccagctacttgggaggct

SEQ ID NO: 300189 - DNA, 20 bp, Artificial
  CRISPR gRNA sequence
ccagctacttgggaggctga

SEQ ID NO: 300190 - DNA, 20 bp, Artificial
  CRISPR gRNA sequence
agctacttgggaggctgaga

SEQ ID NO: 300191 - DNA, 20 bp, Artificial
  CRISPR gRNA sequence
gctacttgggaggctgagag

SEQ ID NO: 300192 - DNA, 20 bp, Artificial
  CRISPR gRNA sequence
tacttgggaggctgagagag

SEQ ID NO: 300193 - DNA, 20 bp, Artificial
  CRISPR gRNA sequence
agaggagaatcgcttgaacc

SEQ ID NO: 300194 - DNA, 20 bp, Artificial
  CRISPR gRNA sequence
gaggagaatcgcttgaacct

SEQ ID NO: 300195 - DNA, 20 bp, Artificial
  CRISPR gRNA sequence
ggagaatcgcttgaacctgg

SEQ ID NO: 300196 - DNA, 20 bp, Artificial
  CRISPR gRNA sequence
gagaatcgcttgaacctggg

SEQ ID NO: 300197 - DNA, 20 bp, Artificial
  CRISPR gRNA sequence
aatcgcttgaacctgggagg

SEQ ID NO: 300198 - DNA, 20 bp, Artificial
  CRISPR gRNA sequence
tcgcttgaacctgggaggca

SEQ ID NO: 300199 - DNA, 20 bp, Artificial
  CRISPR gRNA sequence
cgcttgaacctgggaggcag

SEQ ID NO: 300200 - DNA, 20 bp, Artificial
  CRISPR gRNA sequence
aacctgggaggcagaggttg

SEQ ID NO: 300201 - DNA, 20 bp, Artificial
  CRISPR gRNA sequence
tgggaggcagaggttgcagt

SEQ ID NO: 300202 - DNA, 20 bp, Artificial
  CRISPR gRNA sequence
ggcagaggttgcagtgagcc

SEQ ID NO: 300203 - DNA, 20 bp, Artificial
  CRISPR gRNA sequence
aagatcacaccactgcactc

SEQ ID NO: 300204 - DNA, 20 bp, Artificial
  CRISPR gRNA sequence
cacaccactgcactccagcc

SEQ ID NO: 300205 - DNA, 20 bp, Artificial
  CRISPR gRNA sequence
acaccactgcactccagcct

SEQ ID NO: 300206 - DNA, 20 bp, Artificial
  CRISPR gRNA sequence
ctgcactccagcctgggtga

SEQ ID NO: 300207 - DNA, 20 bp, Artificial
  CRISPR gRNA sequence
cactccagcctgggtgacag

SEQ ID NO: 300208 - DNA, 20 bp, Artificial
  CRISPR gRNA sequence
agcctgggtgacagaagatc

SEQ ID NO: 300209 - DNA, 20 bp, Artificial
  CRISPR gRNA sequence
taaataaataaataaataaa

SEQ ID NO: 300210 - DNA, 20 bp, Artificial
  CRISPR gRNA sequence
aaatagtctttaaaattgta

SEQ ID NO: 300211 - DNA, 20 bp, Artificial
  CRISPR gRNA sequence
tagtctttaaaattgtatag

SEQ ID NO: 300212 - DNA, 20 bp, Artificial
  CRISPR gRNA sequence
tctttaaaattgtatagaag

SEQ ID NO: 300213 - DNA, 20 bp, Artificial
  CRISPR gRNA sequence
ttaaaattgtatagaagaag

SEQ ID NO: 300214 - DNA, 20 bp, Artificial
  CRISPR gRNA sequence
gacttctgcttcctccaaca

SEQ ID NO: 300215 - DNA, 20 bp, Artificial
  CRISPR gRNA sequence
acttctgcttcctccaacaa

SEQ ID NO: 300216 - DNA, 20 bp, Artificial
  CRISPR gRNA sequence
caacaaaggattaactgcta

SEQ ID NO: 300217 - DNA, 20 bp, Artificial
  CRISPR gRNA sequence
aacaaaggattaactgctat

SEQ ID NO: 300218 - DNA, 20 bp, Artificial
  CRISPR gRNA sequence
gccctctttccataaacaac

SEQ ID NO: 300219 - DNA, 20 bp, Artificial
  CRISPR gRNA sequence
tctttccataaacaactaga

SEQ ID NO: 300220 - DNA, 20 bp, Artificial
  CRISPR gRNA sequence
ttccataaacaactagaaag

SEQ ID NO: 300221 - DNA, 20 bp, Artificial
  CRISPR gRNA sequence
atatatgaaacaactgtttt

SEQ ID NO: 300222 - DNA, 20 bp, Artificial
  CRISPR gRNA sequence
atatgaaacaactgttttca

SEQ ID NO: 300223 - DNA, 20 bp, Artificial
  CRISPR gRNA sequence
aaacaactgttttcagagat

SEQ ID NO: 300224 - DNA, 20 bp, Artificial
  CRISPR gRNA sequence
tgttttcagagatcggatga

SEQ ID NO: 300225 - DNA, 20 bp, Artificial
  CRISPR gRNA sequence
ttcagagatcggatgacaga

SEQ ID NO: 300226 - DNA, 20 bp, Artificial
  CRISPR gRNA sequence
agagatcggatgacagacag

SEQ ID NO: 300227 - DNA, 20 bp, Artificial
  CRISPR gRNA sequence
tgacagacagcagaaaactg

SEQ ID NO: 300228 - DNA, 20 bp, Artificial
  CRISPR gRNA sequence
agcagaaaactgtagtccct

SEQ ID NO: 300229 - DNA, 20 bp, Artificial
  CRISPR gRNA sequence
aaaactgtagtccctgagtg

SEQ ID NO: 300230 - DNA, 20 bp, Artificial
  CRISPR gRNA sequence
aaactgtagtccctgagtga

SEQ ID NO: 300231 - DNA, 20 bp, Artificial
  CRISPR gRNA sequence
tgtagtccctgagtgaagga

SEQ ID NO: 300232 - DNA, 20 bp, Artificial
  CRISPR gRNA sequence
gagtgaaggaaagaaaaaat

SEQ ID NO: 300233 - DNA, 20 bp, Artificial
  CRISPR gRNA sequence
aaggaaagaaaaaatgagat

SEQ ID NO: 300234 - DNA, 20 bp, Artificial
  CRISPR gRNA sequence
gataagccctatgattgctc

SEQ ID NO: 300235 - DNA, 20 bp, Artificial
  CRISPR gRNA sequence
gattgctctagtttgctgcc

SEQ ID NO: 300236 - DNA, 20 bp, Artificial
  CRISPR gRNA sequence
ttgctctagtttgctgcctg

SEQ ID NO: 300237 - DNA, 20 bp, Artificial
  CRISPR gRNA sequence
tctagtttgctgcctggagc

SEQ ID NO: 300238 - DNA, 20 bp, Artificial
  CRISPR gRNA sequence
tgctgcctggagccagtgtc

SEQ ID NO: 300239 - DNA, 20 bp, Artificial
  CRISPR gRNA sequence
gctgcctggagccagtgtcc

SEQ ID NO: 300240 - DNA, 20 bp, Artificial
  CRISPR gRNA sequence
ccagtgtccaggcccctctg

SEQ ID NO: 300241 - DNA, 20 bp, Artificial
  CRISPR gRNA sequence
cagtgtccaggcccctctga

SEQ ID NO: 300242 - DNA, 20 bp, Artificial
  CRISPR gRNA sequence
tgtccaggcccctctgaagg

SEQ ID NO: 300243 - DNA, 20 bp, Artificial
  CRISPR gRNA sequence
gtccaggcccctctgaaggc

SEQ ID NO: 300244 - DNA, 20 bp, Artificial
  CRISPR gRNA sequence
tccaggcccctctgaaggca

SEQ ID NO: 300245 - DNA, 20 bp, Artificial
  CRISPR gRNA sequence
ccaggcccctctgaaggcag

SEQ ID NO: 300246 - DNA, 20 bp, Artificial
  CRISPR gRNA sequence
aggcccctctgaaggcaggg

SEQ ID NO: 300247 - DNA, 20 bp, Artificial
  CRISPR gRNA sequence
ggggagccctgatactgaac

SEQ ID NO: 300248 - DNA, 20 bp, Artificial
  CRISPR gRNA sequence
gggagccctgatactgaact

SEQ ID NO: 300249 - DNA, 20 bp, Artificial
  CRISPR gRNA sequence
ccctgatactgaactaggaa

SEQ ID NO: 300250 - DNA, 20 bp, Artificial
  CRISPR gRNA sequence
gaactaggaaaagacattgc

SEQ ID NO: 300251 - DNA, 20 bp, Artificial
  CRISPR gRNA sequence
aggaaaagacattgcaagaa

SEQ ID NO: 300252 - DNA, 20 bp, Artificial
  CRISPR gRNA sequence
cgtgaaatgcttaacaaaat

SEQ ID NO: 300253 - DNA, 20 bp, Artificial
  CRISPR gRNA sequence
caaaattagcaactaaaatc

SEQ ID NO: 300254 - DNA, 20 bp, Artificial
  CRISPR gRNA sequence
aaaatctagcaatatgttaa

SEQ ID NO: 300255 - DNA, 20 bp, Artificial
  CRISPR gRNA sequence
aagtataatacatcatgatc

SEQ ID NO: 300256 - DNA, 20 bp, Artificial
  CRISPR gRNA sequence
tataatacatcatgatcaag

SEQ ID NO: 300257 - DNA, 20 bp, Artificial
  CRISPR gRNA sequence
ataatacatcatgatcaagt

SEQ ID NO: 300258 - DNA, 20 bp, Artificial
  CRISPR gRNA sequence
taatacatcatgatcaagtg

SEQ ID NO: 300259 - DNA, 20 bp, Artificial
  CRISPR gRNA sequence
tgatcaagtggggtttattc

SEQ ID NO: 300260 - DNA, 20 bp, Artificial
  CRISPR gRNA sequence
tggggtttattcaagaaaca

SEQ ID NO: 300261 - DNA, 20 bp, Artificial
  CRISPR gRNA sequence
ggggtttattcaagaaacac

SEQ ID NO: 300262 - DNA, 20 bp, Artificial
  CRISPR gRNA sequence
tttattcaagaaacacaggt

SEQ ID NO: 300263 - DNA, 20 bp, Artificial
  CRISPR gRNA sequence
taagctcaacattcaaaaat

SEQ ID NO: 300264 - DNA, 20 bp, Artificial
  CRISPR gRNA sequence
aagctcaacattcaaaaatc

SEQ ID NO: 300265 - DNA, 20 bp, Artificial
  CRISPR gRNA sequence
tactacataaataaactaaa

SEQ ID NO: 300266 - DNA, 20 bp, Artificial
  CRISPR gRNA sequence
aaaacatatgatcatgtcaa

SEQ ID NO: 300267 - DNA, 20 bp, Artificial
  CRISPR gRNA sequence
tatgatcatgtcaatggata

SEQ ID NO: 300268 - DNA, 20 bp, Artificial
  CRISPR gRNA sequence
atgatcatgtcaatggatac

SEQ ID NO: 300269 - DNA, 20 bp, Artificial
  CRISPR gRNA sequence
acaaaattaatacccattca

SEQ ID NO: 300270 - DNA, 20 bp, Artificial
  CRISPR gRNA sequence
tacccattcatagttttaaa

SEQ ID NO: 300271 - DNA, 20 bp, Artificial
  CRISPR gRNA sequence
cattcatagttttaaatgga

SEQ ID NO: 300272 - DNA, 20 bp, Artificial
  CRISPR gRNA sequence
atagttttaaatggaaagaa

SEQ ID NO: 300273 - DNA, 20 bp, Artificial
  CRISPR gRNA sequence
aagaaaagctctcataaaaa

SEQ ID NO: 300274 - DNA, 20 bp, Artificial
  CRISPR gRNA sequence
agaaaagctctcataaaaat

SEQ ID NO: 300275 - DNA, 20 bp, Artificial
  CRISPR gRNA sequence
tctcataaaaataggaatac

SEQ ID NO: 300276 - DNA, 20 bp, Artificial
  CRISPR gRNA sequence
atgacttcctcaacctgaca

SEQ ID NO: 300277 - DNA, 20 bp, Artificial
  CRISPR gRNA sequence
tgacttcctcaacctgacaa

SEQ ID NO: 300278 - DNA, 20 bp, Artificial
  CRISPR gRNA sequence
tctaccaaaaattcttctgt

SEQ ID NO: 300279 - DNA, 20 bp, Artificial
  CRISPR gRNA sequence
gttagcataatatttcatga

SEQ ID NO: 300280 - DNA, 20 bp, Artificial
  CRISPR gRNA sequence
agcataatatttcatgatag

SEQ ID NO: 300281 - DNA, 20 bp, Artificial
  CRISPR gRNA sequence
agactgattgcttttacctt

SEQ ID NO: 300282 - DNA, 20 bp, Artificial
  CRISPR gRNA sequence
tgattgcttttaccttaaga

SEQ ID NO: 300283 - DNA, 20 bp, Artificial
  CRISPR gRNA sequence
ttaccttaagatggcgaatg

SEQ ID NO: 300284 - DNA, 20 bp, Artificial
  CRISPR gRNA sequence
taccttaagatggcgaatgt

SEQ ID NO: 300285 - DNA, 20 bp, Artificial
  CRISPR gRNA sequence
accttaagatggcgaatgtg

SEQ ID NO: 300286 - DNA, 20 bp, Artificial
  CRISPR gRNA sequence
cttaagatggcgaatgtggg

SEQ ID NO: 300287 - DNA, 20 bp, Artificial
  CRISPR gRNA sequence
ttaagatggcgaatgtgggg

SEQ ID NO: 300288 - DNA, 20 bp, Artificial
  CRISPR gRNA sequence
acttttgttccacattgtac

SEQ ID NO: 300289 - DNA, 20 bp, Artificial
  CRISPR gRNA sequence
ttttgttccacattgtactg

SEQ ID NO: 300290 - DNA, 20 bp, Artificial
  CRISPR gRNA sequence
tttgttccacattgtactgg

SEQ ID NO: 300291 - DNA, 20 bp, Artificial
  CRISPR gRNA sequence
ccacattgtactggaggtca

SEQ ID NO: 300292 - DNA, 20 bp, Artificial
  CRISPR gRNA sequence
attgtactggaggtcatagc

SEQ ID NO: 300293 - DNA, 20 bp, Artificial
  CRISPR gRNA sequence
tgtactggaggtcatagcca

SEQ ID NO: 300294 - DNA, 20 bp, Artificial
  CRISPR gRNA sequence
gaggtcatagccagagaaac

SEQ ID NO: 300295 - DNA, 20 bp, Artificial
  CRISPR gRNA sequence
catagccagagaaacaagac

SEQ ID NO: 300296 - DNA, 20 bp, Artificial
  CRISPR gRNA sequence
cagagaaacaagactagaaa

SEQ ID NO: 300297 - DNA, 20 bp, Artificial
  CRISPR gRNA sequence
aagactagaaaaagaaataa

SEQ ID NO: 300298 - DNA, 20 bp, Artificial
  CRISPR gRNA sequence
aaaaagaaataaaagacata

SEQ ID NO: 300299 - DNA, 20 bp, Artificial
  CRISPR gRNA sequence
gaaataaaagacatacagat

SEQ ID NO: 300300 - DNA, 20 bp, Artificial
  CRISPR gRNA sequence
taaaagacatacagattgga

SEQ ID NO: 300301 - DNA, 20 bp, Artificial
  CRISPR gRNA sequence
aaaagacatacagattggaa

SEQ ID NO: 300302 - DNA, 20 bp, Artificial
  CRISPR gRNA sequence
agacatacagattggaaagg

SEQ ID NO: 300303 - DNA, 20 bp, Artificial
  CRISPR gRNA sequence
agtaaaactgtcttttttca

SEQ ID NO: 300304 - DNA, 20 bp, Artificial
  CRISPR gRNA sequence
acagataatgatcatgcttg

SEQ ID NO: 300305 - DNA, 20 bp, Artificial
  CRISPR gRNA sequence
tcatgcttgtagaaaatcct

SEQ ID NO: 300306 - DNA, 20 bp, Artificial
  CRISPR gRNA sequence
catgcttgtagaaaatcctg

SEQ ID NO: 300307 - DNA, 20 bp, Artificial
  CRISPR gRNA sequence
aaaaacctattaaaactgat

SEQ ID NO: 300308 - DNA, 20 bp, Artificial
  CRISPR gRNA sequence
acctattaaaactgataagt

SEQ ID NO: 300309 - DNA, 20 bp, Artificial
  CRISPR gRNA sequence
ttaaaactgataagtgagtg

SEQ ID NO: 300310 - DNA, 20 bp, Artificial
  CRISPR gRNA sequence
actgataagtgagtgtagca

SEQ ID NO: 300311 - DNA, 20 bp, Artificial
  CRISPR gRNA sequence
aagtgagtgtagcaaagaca

SEQ ID NO: 300312 - DNA, 20 bp, Artificial
  CRISPR gRNA sequence
agtgagtgtagcaaagacac

SEQ ID NO: 300313 - DNA, 20 bp, Artificial
  CRISPR gRNA sequence
tagcaaagacacaggataca

SEQ ID NO: 300314 - DNA, 20 bp, Artificial
  CRISPR gRNA sequence
ttatttctatatactaacaa

SEQ ID NO: 300315 - DNA, 20 bp, Artificial
  CRISPR gRNA sequence
tgtacattgaaaaaaattaa

SEQ ID NO: 300316 - DNA, 20 bp, Artificial
  CRISPR gRNA sequence
aaaattaatagcatttataa

SEQ ID NO: 300317 - DNA, 20 bp, Artificial
  CRISPR gRNA sequence
atcaaataatattaaaaact

SEQ ID NO: 300318 - DNA, 20 bp, Artificial
  CRISPR gRNA sequence
ggaaataaatttaacaaaac

SEQ ID NO: 300319 - DNA, 20 bp, Artificial
  CRISPR gRNA sequence
aaatttaacaaaacaagtac

SEQ ID NO: 300320 - DNA, 20 bp, Artificial
  CRISPR gRNA sequence
aatttaacaaaacaagtaca

SEQ ID NO: 300321 - DNA, 20 bp, Artificial
  CRISPR gRNA sequence
aaactatacaatattactac

SEQ ID NO: 300322 - DNA, 20 bp, Artificial
  CRISPR gRNA sequence
actatacaatattactactg

SEQ ID NO: 300323 - DNA, 20 bp, Artificial
  CRISPR gRNA sequence
tattactactggagaaatta

SEQ ID NO: 300324 - DNA, 20 bp, Artificial
  CRISPR gRNA sequence
ttaaagtaaaccaaaataaa

SEQ ID NO: 300325 - DNA, 20 bp, Artificial
  CRISPR gRNA sequence
aaagtaaaccaaaataaatg

SEQ ID NO: 300326 - DNA, 20 bp, Artificial
  CRISPR gRNA sequence
aaccaaaataaatggagaca

SEQ ID NO: 300327 - DNA, 20 bp, Artificial
  CRISPR gRNA sequence
accaaaataaatggagacat

SEQ ID NO: 300328 - DNA, 20 bp, Artificial
  CRISPR gRNA sequence
cataggccatgtttatgaat

SEQ ID NO: 300329 - DNA, 20 bp, Artificial
  CRISPR gRNA sequence
aggccatgtttatgaatcag

SEQ ID NO: 300330 - DNA, 20 bp, Artificial
  CRISPR gRNA sequence
atgtttatgaatcagaagac

SEQ ID NO: 300331 - DNA, 20 bp, Artificial
  CRISPR gRNA sequence
gaatcagaagactagatgtt

SEQ ID NO: 300332 - DNA, 20 bp, Artificial
  CRISPR gRNA sequence
ttaagataaccattctctcc

SEQ ID NO: 300333 - DNA, 20 bp, Artificial
  CRISPR gRNA sequence
attctctccaagttgatcta

SEQ ID NO: 300334 - DNA, 20 bp, Artificial
  CRISPR gRNA sequence
tgtaatcacaatcaaaatcc

SEQ ID NO: 300335 - DNA, 20 bp, Artificial
  CRISPR gRNA sequence
atcacaatcaaaatcctggt

SEQ ID NO: 300336 - DNA, 20 bp, Artificial
  CRISPR gRNA sequence
aatcctggtaagctctctaa

SEQ ID NO: 300337 - DNA, 20 bp, Artificial
  CRISPR gRNA sequence
tactaaaaatcttactcgaa

SEQ ID NO: 300338 - DNA, 20 bp, Artificial
  CRISPR gRNA sequence
aaatcttactcgaaaagtta

SEQ ID NO: 300339 - DNA, 20 bp, Artificial
  CRISPR gRNA sequence
aatcttactcgaaaagttat

SEQ ID NO: 300340 - DNA, 20 bp, Artificial
  CRISPR gRNA sequence
atcttactcgaaaagttata

SEQ ID NO: 300341 - DNA, 20 bp, Artificial
  CRISPR gRNA sequence
aaaagttatagggaaatgca

SEQ ID NO: 300342 - DNA, 20 bp, Artificial
  CRISPR gRNA sequence
ccaaaacaattctgaaaaat

SEQ ID NO: 300343 - DNA, 20 bp, Artificial
  CRISPR gRNA sequence
aattctgaaaaataagaaca

SEQ ID NO: 300344 - DNA, 20 bp, Artificial
  CRISPR gRNA sequence
attctgaaaaataagaacaa

SEQ ID NO: 300345 - DNA, 20 bp, Artificial
  CRISPR gRNA sequence
aaaggttaaaaatacaaaat

SEQ ID NO: 300346 - DNA, 20 bp, Artificial
  CRISPR gRNA sequence
gttaaaaatacaaaattagc

SEQ ID NO: 300347 - DNA, 20 bp, Artificial
  CRISPR gRNA sequence
ttaaaaatacaaaattagcc

SEQ ID NO: 300348 - DNA, 20 bp, Artificial
  CRISPR gRNA sequence
aatacaaaattagccaggca

SEQ ID NO: 300349 - DNA, 20 bp, Artificial
  CRISPR gRNA sequence
acaaaattagccaggcatgg

SEQ ID NO: 300350 - DNA, 20 bp, Artificial
  CRISPR gRNA sequence
gtggcgcatgcctgtaatcc

SEQ ID NO: 300351 - DNA, 20 bp, Artificial
  CRISPR gRNA sequence
gcctgtaatcccagctactc

SEQ ID NO: 300352 - DNA, 20 bp, Artificial
  CRISPR gRNA sequence
ctgtaatcccagctactctg

SEQ ID NO: 300353 - DNA, 20 bp, Artificial
  CRISPR gRNA sequence
tgtaatcccagctactctgg

SEQ ID NO: 300354 - DNA, 20 bp, Artificial
  CRISPR gRNA sequence
tcccagctactctggaggct

SEQ ID NO: 300355 - DNA, 20 bp, Artificial
  CRISPR gRNA sequence
cccagctactctggaggctg

SEQ ID NO: 300356 - DNA, 20 bp, Artificial
  CRISPR gRNA sequence
agctactctggaggctgagg

SEQ ID NO: 300357 - DNA, 20 bp, Artificial
  CRISPR gRNA sequence
gctactctggaggctgaggc

SEQ ID NO: 300358 - DNA, 20 bp, Artificial
  CRISPR gRNA sequence
tactctggaggctgaggcag

SEQ ID NO: 300359 - DNA, 20 bp, Artificial
  CRISPR gRNA sequence
gcaggagaattgcttgaacc

SEQ ID NO: 300360 - DNA, 20 bp, Artificial
  CRISPR gRNA sequence
caggagaattgcttgaaccc

SEQ ID NO: 300361 - DNA, 20 bp, Artificial
  CRISPR gRNA sequence
ggagaattgcttgaacccgg

SEQ ID NO: 300362 - DNA, 20 bp, Artificial
  CRISPR gRNA sequence
gagaattgcttgaacccggg

SEQ ID NO: 300363 - DNA, 20 bp, Artificial
  CRISPR gRNA sequence
aattgcttgaacccgggagg

SEQ ID NO: 300364 - DNA, 20 bp, Artificial
  CRISPR gRNA sequence
ttgcttgaacccgggaggca

SEQ ID NO: 300365 - DNA, 20 bp, Artificial
  CRISPR gRNA sequence
tgcttgaacccgggaggcag

SEQ ID NO: 300366 - DNA, 20 bp, Artificial
  CRISPR gRNA sequence
cgggaggcagaggttgctgt

SEQ ID NO: 300367 - DNA, 20 bp, Artificial
  CRISPR gRNA sequence
ggcagaggttgctgtgagct

SEQ ID NO: 300368 - DNA, 20 bp, Artificial
  CRISPR gRNA sequence
gagatcgtgccattgcactc

SEQ ID NO: 300369 - DNA, 20 bp, Artificial
  CRISPR gRNA sequence
cgtgccattgcactccagcc

SEQ ID NO: 300370 - DNA, 20 bp, Artificial
  CRISPR gRNA sequence
gtgccattgcactccagcct

SEQ ID NO: 300371 - DNA, 20 bp, Artificial
  CRISPR gRNA sequence
tgcactccagcctgggcaac

SEQ ID NO: 300372 - DNA, 20 bp, Artificial
  CRISPR gRNA sequence
cactccagcctgggcaacaa

SEQ ID NO: 300373 - DNA, 20 bp, Artificial
  CRISPR gRNA sequence
aaaaaaaaaaaaaaaaaaaa

SEQ ID NO: 300374 - DNA, 20 bp, Artificial
  CRISPR gRNA sequence
aaaaaaaaaaaaaaagaaca

SEQ ID NO: 300375 - DNA, 20 bp, Artificial
  CRISPR gRNA sequence
aaaaaaaaaaaaaagaacaa

SEQ ID NO: 300376 - DNA, 20 bp, Artificial
  CRISPR gRNA sequence
aaaaaaaaaaagaacaaagg

SEQ ID NO: 300377 - DNA, 20 bp, Artificial
  CRISPR gRNA sequence
atttcaatatttactatata

SEQ ID NO: 300378 - DNA, 20 bp, Artificial
  CRISPR gRNA sequence
actatatatagtaattaata

SEQ ID NO: 300379 - DNA, 20 bp, Artificial
  CRISPR gRNA sequence
taattaatacagtgtgatat

SEQ ID NO: 300380 - DNA, 20 bp, Artificial
  CRISPR gRNA sequence
atacagtgtgatattggtaa

SEQ ID NO: 300381 - DNA, 20 bp, Artificial
  CRISPR gRNA sequence
tacagtgtgatattggtaaa

SEQ ID NO: 300382 - DNA, 20 bp, Artificial
  CRISPR gRNA sequence
gtgtgatattggtaaaagga

SEQ ID NO: 300383 - DNA, 20 bp, Artificial
  CRISPR gRNA sequence
tggtaaaaggacagacatat

SEQ ID NO: 300384 - DNA, 20 bp, Artificial
  CRISPR gRNA sequence
aggacagacatatcagtcaa

SEQ ID NO: 300385 - DNA, 20 bp, Artificial
  CRISPR gRNA sequence
tatcagtcaatggaacaaaa

SEQ ID NO: 300386 - DNA, 20 bp, Artificial
  CRISPR gRNA sequence
tcagtcaatggaacaaaata

SEQ ID NO: 300387 - DNA, 20 bp, Artificial
  CRISPR gRNA sequence
agtcaatggaacaaaataga

SEQ ID NO: 300388 - DNA, 20 bp, Artificial
  CRISPR gRNA sequence
acaaaatagagagtcaaaaa

SEQ ID NO: 300389 - DNA, 20 bp, Artificial
  CRISPR gRNA sequence
atagattcacactgttgaca

SEQ ID NO: 300390 - DNA, 20 bp, Artificial
  CRISPR gRNA sequence
acactgttgacaaagctacc

SEQ ID NO: 300391 - DNA, 20 bp, Artificial
  CRISPR gRNA sequence
cactgttgacaaagctacca

SEQ ID NO: 300392 - DNA, 20 bp, Artificial
  CRISPR gRNA sequence
gctaccaaggtaattccatg

SEQ ID NO: 300393 - DNA, 20 bp, Artificial
  CRISPR gRNA sequence
ccaaggtaattccatgcaga

SEQ ID NO: 300394 - DNA, 20 bp, Artificial
  CRISPR gRNA sequence
caaggtaattccatgcagaa

SEQ ID NO: 300395 - DNA, 20 bp, Artificial
  CRISPR gRNA sequence
gtaattccatgcagaaagga

SEQ ID NO: 300396 - DNA, 20 bp, Artificial
  CRISPR gRNA sequence
aggatagtattttcaacaaa

SEQ ID NO: 300397 - DNA, 20 bp, Artificial
  CRISPR gRNA sequence
gtattttcaacaaatagtgt

SEQ ID NO: 300398 - DNA, 20 bp, Artificial
  CRISPR gRNA sequence
tattttcaacaaatagtgtt

SEQ ID NO: 300399 - DNA, 20 bp, Artificial
  CRISPR gRNA sequence
acaaatagtgttgggacaat

SEQ ID NO: 300400 - DNA, 20 bp, Artificial
  CRISPR gRNA sequence
gggacaattagatatccaca

SEQ ID NO: 300401 - DNA, 20 bp, Artificial
  CRISPR gRNA sequence
attagatatccacatggaaa

SEQ ID NO: 300402 - DNA, 20 bp, Artificial
  CRISPR gRNA sequence
acatggaaaaagtatgaacc

SEQ ID NO: 300403 - DNA, 20 bp, Artificial
  CRISPR gRNA sequence
tatgaacctagacacacaca

SEQ ID NO: 300404 - DNA, 20 bp, Artificial
  CRISPR gRNA sequence
cacaaagtaacttatatatt

SEQ ID NO: 300405 - DNA, 20 bp, Artificial
  CRISPR gRNA sequence
tatattaagaattaaaatga

SEQ ID NO: 300406 - DNA, 20 bp, Artificial
  CRISPR gRNA sequence
atattaagaattaaaatgaa

SEQ ID NO: 300407 - DNA, 20 bp, Artificial
  CRISPR gRNA sequence
taaaatgaaaggacttccaa

SEQ ID NO: 300408 - DNA, 20 bp, Artificial
  CRISPR gRNA sequence
aaaggacttccaaaagaaaa

SEQ ID NO: 300409 - DNA, 20 bp, Artificial
  CRISPR gRNA sequence
aggacttccaaaagaaaaca

SEQ ID NO: 300410 - DNA, 20 bp, Artificial
  CRISPR gRNA sequence
ggacttccaaaagaaaacag

SEQ ID NO: 300411 - DNA, 20 bp, Artificial
  CRISPR gRNA sequence
acttccaaaagaaaacagag

SEQ ID NO: 300412 - DNA, 20 bp, Artificial
  CRISPR gRNA sequence
gagaaaatctttgtaacctt

SEQ ID NO: 300413 - DNA, 20 bp, Artificial
  CRISPR gRNA sequence
aaatctttgtaaccttaagt

SEQ ID NO: 300414 - DNA, 20 bp, Artificial
  CRISPR gRNA sequence
aatctttgtaaccttaagtt

SEQ ID NO: 300415 - DNA, 20 bp, Artificial
  CRISPR gRNA sequence
tttgtaaccttaagttaggc

SEQ ID NO: 300416 - DNA, 20 bp, Artificial
  CRISPR gRNA sequence
ttaagttaggcaagtcttct

SEQ ID NO: 300417 - DNA, 20 bp, Artificial
  CRISPR gRNA sequence
gttaggcaagtcttcttaga

SEQ ID NO: 300418 - DNA, 20 bp, Artificial
  CRISPR gRNA sequence
ttaggcaagtcttcttagat

SEQ ID NO: 300419 - DNA, 20 bp, Artificial
  CRISPR gRNA sequence
aagtcttcttagataggaca

SEQ ID NO: 300420 - DNA, 20 bp, Artificial
  CRISPR gRNA sequence
cttcttagataggacacaga

SEQ ID NO: 300421 - DNA, 20 bp, Artificial
  CRISPR gRNA sequence
agcaaaaaccatatcataaa

SEQ ID NO: 300422 - DNA, 20 bp, Artificial
  CRISPR gRNA sequence
catatcataaaaagataaaa

SEQ ID NO: 300423 - DNA, 20 bp, Artificial
  CRISPR gRNA sequence
taaaatggatgtcatcaata

SEQ ID NO: 300424 - DNA, 20 bp, Artificial
  CRISPR gRNA sequence
gactttgtttaaaaaacgaa

SEQ ID NO: 300425 - DNA, 20 bp, Artificial
  CRISPR gRNA sequence
aaaaacgaaaagtcaaacca

SEQ ID NO: 300426 - DNA, 20 bp, Artificial
  CRISPR gRNA sequence
acgaaaagtcaaaccacaga

SEQ ID NO: 300427 - DNA, 20 bp, Artificial
  CRISPR gRNA sequence
cgaaaagtcaaaccacagac

SEQ ID NO: 300428 - DNA, 20 bp, Artificial
  CRISPR gRNA sequence
gaaaagtcaaaccacagaca

SEQ ID NO: 300429 - DNA, 20 bp, Artificial
  CRISPR gRNA sequence
aaagtcaaaccacagacagg

SEQ ID NO: 300430 - DNA, 20 bp, Artificial
  CRISPR gRNA sequence
tgcaaaatatatatctgata

SEQ ID NO: 300431 - DNA, 20 bp, Artificial
  CRISPR gRNA sequence
gcaaaatatatatctgataa

SEQ ID NO: 300432 - DNA, 20 bp, Artificial
  CRISPR gRNA sequence
tctgataaaggacttgtatc

SEQ ID NO: 300433 - DNA, 20 bp, Artificial
  CRISPR gRNA sequence
aattacatattgctactcat

SEQ ID NO: 300434 - DNA, 20 bp, Artificial
  CRISPR gRNA sequence
acatattgctactcattagt

SEQ ID NO: 300435 - DNA, 20 bp, Artificial
  CRISPR gRNA sequence
tattgctactcattagtaag

SEQ ID NO: 300436 - DNA, 20 bp, Artificial
  CRISPR gRNA sequence
gaagacaatccatttaataa

SEQ ID NO: 300437 - DNA, 20 bp, Artificial
  CRISPR gRNA sequence
aagacaatccatttaataaa

SEQ ID NO: 300438 - DNA, 20 bp, Artificial
  CRISPR gRNA sequence
caatccatttaataaaaggc

SEQ ID NO: 300439 - DNA, 20 bp, Artificial
  CRISPR gRNA sequence
tccatttaataaaaggcaag

SEQ ID NO: 300440 - DNA, 20 bp, Artificial
  CRISPR gRNA sequence
atttaataaaaggcaagaag

SEQ ID NO: 300441 - DNA, 20 bp, Artificial
  CRISPR gRNA sequence
ttaataaaaggcaagaagaa

SEQ ID NO: 300442 - DNA, 20 bp, Artificial
  CRISPR gRNA sequence
gcaagaagaagagacttgaa

SEQ ID NO: 300443 - DNA, 20 bp, Artificial
  CRISPR gRNA sequence
agacttgaacagatacataa

SEQ ID NO: 300444 - DNA, 20 bp, Artificial
  CRISPR gRNA sequence
cttgaacagatacataacag

SEQ ID NO: 300445 - DNA, 20 bp, Artificial
  CRISPR gRNA sequence
gaacagatacataacagaag

SEQ ID NO: 300446 - DNA, 20 bp, Artificial
  CRISPR gRNA sequence
acataacagaagaagatata

SEQ ID NO: 300447 - DNA, 20 bp, Artificial
  CRISPR gRNA sequence
aacagaagaagatatacaga

SEQ ID NO: 300448 - DNA, 20 bp, Artificial
  CRISPR gRNA sequence
aagatatacagatggccgat

SEQ ID NO: 300449 - DNA, 20 bp, Artificial
  CRISPR gRNA sequence
atacagatggccgatgagca

SEQ ID NO: 300450 - DNA, 20 bp, Artificial
  CRISPR gRNA sequence
gagcacagtcacaacatcat

SEQ ID NO: 300451 - DNA, 20 bp, Artificial
  CRISPR gRNA sequence
gtcacaacatcattagtcat

SEQ ID NO: 300452 - DNA, 20 bp, Artificial
  CRISPR gRNA sequence
tcacaacatcattagtcatc

SEQ ID NO: 300453 - DNA, 20 bp, Artificial
  CRISPR gRNA sequence
cacaacatcattagtcatca

SEQ ID NO: 300454 - DNA, 20 bp, Artificial
  CRISPR gRNA sequence
aacatcattagtcatcaggg

SEQ ID NO: 300455 - DNA, 20 bp, Artificial
  CRISPR gRNA sequence
gtacaaattaaaacgataat

SEQ ID NO: 300456 - DNA, 20 bp, Artificial
  CRISPR gRNA sequence
agataccactgcacaccctc

SEQ ID NO: 300457 - DNA, 20 bp, Artificial
  CRISPR gRNA sequence
ccactgcacaccctctagaa

SEQ ID NO: 300458 - DNA, 20 bp, Artificial
  CRISPR gRNA sequence
tctagaatggctaaaattaa

SEQ ID NO: 300459 - DNA, 20 bp, Artificial
  CRISPR gRNA sequence
ctagaatggctaaaattaaa

SEQ ID NO: 300460 - DNA, 20 bp, Artificial
  CRISPR gRNA sequence
taaaaggtctgataaacatc

SEQ ID NO: 300461 - DNA, 20 bp, Artificial
  CRISPR gRNA sequence
gtctgataaacatcaagtgt

SEQ ID NO: 300462 - DNA, 20 bp, Artificial
  CRISPR gRNA sequence
ctgataaacatcaagtgttg

SEQ ID NO: 300463 - DNA, 20 bp, Artificial
  CRISPR gRNA sequence
gataaacatcaagtgttgga

SEQ ID NO: 300464 - DNA, 20 bp, Artificial
  CRISPR gRNA sequence
ataaacatcaagtgttggag

SEQ ID NO: 300465 - DNA, 20 bp, Artificial
  CRISPR gRNA sequence
caagtgttggagaggatatg

SEQ ID NO: 300466 - DNA, 20 bp, Artificial
  CRISPR gRNA sequence
tcatatactgctatacaacc

SEQ ID NO: 300467 - DNA, 20 bp, Artificial
  CRISPR gRNA sequence
gctatacaacccagaaatcc

SEQ ID NO: 300468 - DNA, 20 bp, Artificial
  CRISPR gRNA sequence
aatcctagacatttaccaaa

SEQ ID NO: 300469 - DNA, 20 bp, Artificial
  CRISPR gRNA sequence
aaaaaatttaaaaatatata

SEQ ID NO: 300470 - DNA, 20 bp, Artificial
  CRISPR gRNA sequence
gactcatacacaaatgttca

SEQ ID NO: 300471 - DNA, 20 bp, Artificial
  CRISPR gRNA sequence
tcatacacaaatgttcatag

SEQ ID NO: 300472 - DNA, 20 bp, Artificial
  CRISPR gRNA sequence
ttgcttcataataccaaacc

SEQ ID NO: 300473 - DNA, 20 bp, Artificial
  CRISPR gRNA sequence
ctggcattctaaattttcat

SEQ ID NO: 300474 - DNA, 20 bp, Artificial
  CRISPR gRNA sequence
cattctaaattttcatcagt

SEQ ID NO: 300475 - DNA, 20 bp, Artificial
  CRISPR gRNA sequence
tctaaattttcatcagttgg

SEQ ID NO: 300476 - DNA, 20 bp, Artificial
  CRISPR gRNA sequence
aaattttcatcagttggcgg

SEQ ID NO: 300477 - DNA, 20 bp, Artificial
  CRISPR gRNA sequence
ttatacaatgaaatactgca

SEQ ID NO: 300478 - DNA, 20 bp, Artificial
  CRISPR gRNA sequence
aatgaaatactgcaaagcta

SEQ ID NO: 300479 - DNA, 20 bp, Artificial
  CRISPR gRNA sequence
aaatactgcaaagctataga

SEQ ID NO: 300480 - DNA, 20 bp, Artificial
  CRISPR gRNA sequence
aatactgcaaagctatagaa

SEQ ID NO: 300481 - DNA, 20 bp, Artificial
  CRISPR gRNA sequence
tgcaaagctatagaaaggaa

SEQ ID NO: 300482 - DNA, 20 bp, Artificial
  CRISPR gRNA sequence
atggactactaataatacac

SEQ ID NO: 300483 - DNA, 20 bp, Artificial
  CRISPR gRNA sequence
actaataatacacaagaaca

SEQ ID NO: 300484 - DNA, 20 bp, Artificial
  CRISPR gRNA sequence
agaacatagataaatttcaa

SEQ ID NO: 300485 - DNA, 20 bp, Artificial
  CRISPR gRNA sequence
aatttcaaaagcattatgct

SEQ ID NO: 300486 - DNA, 20 bp, Artificial
  CRISPR gRNA sequence
ttatgctaagtgaaacaatc

SEQ ID NO: 300487 - DNA, 20 bp, Artificial
  CRISPR gRNA sequence
tatgctaagtgaaacaatcc

SEQ ID NO: 300488 - DNA, 20 bp, Artificial
  CRISPR gRNA sequence
aagtgaaacaatccaggcac

SEQ ID NO: 300489 - DNA, 20 bp, Artificial
  CRISPR gRNA sequence
tgaaacaatccaggcacaag

SEQ ID NO: 300490 - DNA, 20 bp, Artificial
  CRISPR gRNA sequence
atttcatgtatatgaaattt

SEQ ID NO: 300491 - DNA, 20 bp, Artificial
  CRISPR gRNA sequence
tgtatatgaaatttgagaaa

SEQ ID NO: 300492 - DNA, 20 bp, Artificial
  CRISPR gRNA sequence
agaaaaagcaaaactatttt

SEQ ID NO: 300493 - DNA, 20 bp, Artificial
  CRISPR gRNA sequence
aaaagcaaaactattttaag

SEQ ID NO: 300494 - DNA, 20 bp, Artificial
  CRISPR gRNA sequence
aactattttaagtagattca

SEQ ID NO: 300495 - DNA, 20 bp, Artificial
  CRISPR gRNA sequence
agtagattcatggttatcca

SEQ ID NO: 300496 - DNA, 20 bp, Artificial
  CRISPR gRNA sequence
gtagattcatggttatccat

SEQ ID NO: 300497 - DNA, 20 bp, Artificial
  CRISPR gRNA sequence
attcatggttatccatggga

SEQ ID NO: 300498 - DNA, 20 bp, Artificial
  CRISPR gRNA sequence
ttcatggttatccatgggat

SEQ ID NO: 300499 - DNA, 20 bp, Artificial
  CRISPR gRNA sequence
tcatggttatccatgggatg

SEQ ID NO: 300500 - DNA, 20 bp, Artificial
  CRISPR gRNA sequence
catggttatccatgggatgg

SEQ ID NO: 300501 - DNA, 20 bp, Artificial
  CRISPR gRNA sequence
gttatccatgggatggggga

SEQ ID NO: 300502 - DNA, 20 bp, Artificial
  CRISPR gRNA sequence
ttatccatgggatgggggaa

SEQ ID NO: 300503 - DNA, 20 bp, Artificial
  CRISPR gRNA sequence
atgggatgggggaaaggaat

SEQ ID NO: 300504 - DNA, 20 bp, Artificial
  CRISPR gRNA sequence
ggggaaaggaatcagctgaa

SEQ ID NO: 300505 - DNA, 20 bp, Artificial
  CRISPR gRNA sequence
agctgaaaagcgaactattt

SEQ ID NO: 300506 - DNA, 20 bp, Artificial
  CRISPR gRNA sequence
aatgttctcgatcttgattg

SEQ ID NO: 300507 - DNA, 20 bp, Artificial
  CRISPR gRNA sequence
gttctcgatcttgattgtgg

SEQ ID NO: 300508 - DNA, 20 bp, Artificial
  CRISPR gRNA sequence
ctcgatcttgattgtggtgg

SEQ ID NO: 300509 - DNA, 20 bp, Artificial
  CRISPR gRNA sequence
aactctaaactgaaaatgat

SEQ ID NO: 300510 - DNA, 20 bp, Artificial
  CRISPR gRNA sequence
actctaaactgaaaatgatt

SEQ ID NO: 300511 - DNA, 20 bp, Artificial
  CRISPR gRNA sequence
ttattaattatacctccata

SEQ ID NO: 300512 - DNA, 20 bp, Artificial
  CRISPR gRNA sequence
ttatttttattttatttcaa

SEQ ID NO: 300513 - DNA, 20 bp, Artificial
  CRISPR gRNA sequence
tattttatttcaatagtttt

SEQ ID NO: 300514 - DNA, 20 bp, Artificial
  CRISPR gRNA sequence
attttatttcaatagttttt

SEQ ID NO: 300515 - DNA, 20 bp, Artificial
  CRISPR gRNA sequence
ttttatttcaatagtttttg

SEQ ID NO: 300516 - DNA, 20 bp, Artificial
  CRISPR gRNA sequence
tttcaatagtttttggggaa

SEQ ID NO: 300517 - DNA, 20 bp, Artificial
  CRISPR gRNA sequence
aatagtttttggggaacaga

SEQ ID NO: 300518 - DNA, 20 bp, Artificial
  CRISPR gRNA sequence
tttggggaacagatggtttt

SEQ ID NO: 300519 - DNA, 20 bp, Artificial
  CRISPR gRNA sequence
acagatggttttcggttaca

SEQ ID NO: 300520 - DNA, 20 bp, Artificial
  CRISPR gRNA sequence
tggttttcggttacatggat

SEQ ID NO: 300521 - DNA, 20 bp, Artificial
  CRISPR gRNA sequence
ggttacatggatgagttctt

SEQ ID NO: 300522 - DNA, 20 bp, Artificial
  CRISPR gRNA sequence
tacatggatgagttctttag

SEQ ID NO: 300523 - DNA, 20 bp, Artificial
  CRISPR gRNA sequence
gttctttagtggtgatttct

SEQ ID NO: 300524 - DNA, 20 bp, Artificial
  CRISPR gRNA sequence
ttttgatgcacctgtcaccc

SEQ ID NO: 300525 - DNA, 20 bp, Artificial
  CRISPR gRNA sequence
tgtccactgtacccaatgtg

SEQ ID NO: 300526 - DNA, 20 bp, Artificial
  CRISPR gRNA sequence
tctctctcactcttcccccc

SEQ ID NO: 300527 - DNA, 20 bp, Artificial
  CRISPR gRNA sequence
actcttccccccaagtaccc

SEQ ID NO: 300528 - DNA, 20 bp, Artificial
  CRISPR gRNA sequence
atatcattcttatgactttg

SEQ ID NO: 300529 - DNA, 20 bp, Artificial
  CRISPR gRNA sequence
atgactttgtggcctcataa

SEQ ID NO: 300530 - DNA, 20 bp, Artificial
  CRISPR gRNA sequence
atacacacatacacacataa

SEQ ID NO: 300531 - DNA, 20 bp, Artificial
  CRISPR gRNA sequence
acacacatacacacataaaa

SEQ ID NO: 300532 - DNA, 20 bp, Artificial
  CRISPR gRNA sequence
cacacataaaagagaacttc

SEQ ID NO: 300533 - DNA, 20 bp, Artificial
  CRISPR gRNA sequence
taaaagagaacttccagtga

SEQ ID NO: 300534 - DNA, 20 bp, Artificial
  CRISPR gRNA sequence
aaaagagaacttccagtgac

SEQ ID NO: 300535 - DNA, 20 bp, Artificial
  CRISPR gRNA sequence
agagaacttccagtgacagg

SEQ ID NO: 300536 - DNA, 20 bp, Artificial
  CRISPR gRNA sequence
tccagtgacaggaagtgttc

SEQ ID NO: 300537 - DNA, 20 bp, Artificial
  CRISPR gRNA sequence
gtgttcaagaatgctctatt

SEQ ID NO: 300538 - DNA, 20 bp, Artificial
  CRISPR gRNA sequence
caagaatgctctatttagta

SEQ ID NO: 300539 - DNA, 20 bp, Artificial
  CRISPR gRNA sequence
aatgctctatttagtaaaga

SEQ ID NO: 300540 - DNA, 20 bp, Artificial
  CRISPR gRNA sequence
agacagaatcacaaaaccat

SEQ ID NO: 300541 - DNA, 20 bp, Artificial
  CRISPR gRNA sequence
acagaatcacaaaaccatca

SEQ ID NO: 300542 - DNA, 20 bp, Artificial
  CRISPR gRNA sequence
cagaatcacaaaaccatcag

SEQ ID NO: 300543 - DNA, 20 bp, Artificial
  CRISPR gRNA sequence
aaaccatcagaggtattgtt

SEQ ID NO: 300544 - DNA, 20 bp, Artificial
  CRISPR gRNA sequence
ccatcagaggtattgttgag

SEQ ID NO: 300545 - DNA, 20 bp, Artificial
  CRISPR gRNA sequence
tattgttgagtggattcttg

SEQ ID NO: 300546 - DNA, 20 bp, Artificial
  CRISPR gRNA sequence
gtggtctataaatacctcca

SEQ ID NO: 300547 - DNA, 20 bp, Artificial
  CRISPR gRNA sequence
taaatacctccatggacacc

SEQ ID NO: 300548 - DNA, 20 bp, Artificial
  CRISPR gRNA sequence
aaatacctccatggacaccc

SEQ ID NO: 300549 - DNA, 20 bp, Artificial
  CRISPR gRNA sequence
acctccatggacacccaggt

SEQ ID NO: 300550 - DNA, 20 bp, Artificial
  CRISPR gRNA sequence
cacccaggttagcaacctgt

SEQ ID NO: 300551 - DNA, 20 bp, Artificial
  CRISPR gRNA sequence
cccaggttagcaacctgttg

SEQ ID NO: 300552 - DNA, 20 bp, Artificial
  CRISPR gRNA sequence
gcaacctgttggagtttacg

SEQ ID NO: 300553 - DNA, 20 bp, Artificial
  CRISPR gRNA sequence
caacctgttggagtttacgt

SEQ ID NO: 300554 - DNA, 20 bp, Artificial
  CRISPR gRNA sequence
ttggagtttacgtgggacaa

SEQ ID NO: 300555 - DNA, 20 bp, Artificial
  CRISPR gRNA sequence
ggacaatagcatcatcacaa

SEQ ID NO: 300556 - DNA, 20 bp, Artificial
  CRISPR gRNA sequence
aatagcatcatcacaacagt

SEQ ID NO: 300557 - DNA, 20 bp, Artificial
  CRISPR gRNA sequence
catcatcacaacagtcagcc

SEQ ID NO: 300558 - DNA, 20 bp, Artificial
  CRISPR gRNA sequence
tcatcacaacagtcagccta

SEQ ID NO: 300559 - DNA, 20 bp, Artificial
  CRISPR gRNA sequence
cctagagaaatttacatccc

SEQ ID NO: 300560 - DNA, 20 bp, Artificial
  CRISPR gRNA sequence
atttacatcccaagttgtgt

SEQ ID NO: 300561 - DNA, 20 bp, Artificial
  CRISPR gRNA sequence
tacatcccaagttgtgtcag

SEQ ID NO: 300562 - DNA, 20 bp, Artificial
  CRISPR gRNA sequence
tcccaagttgtgtcagtagc

SEQ ID NO: 300563 - DNA, 20 bp, Artificial
  CRISPR gRNA sequence
cagtagcaagtccctatcaa

SEQ ID NO: 300564 - DNA, 20 bp, Artificial
  CRISPR gRNA sequence
agtccctatcaatagcaact

SEQ ID NO: 300565 - DNA, 20 bp, Artificial
  CRISPR gRNA sequence
gtccctatcaatagcaactc

SEQ ID NO: 300566 - DNA, 20 bp, Artificial
  CRISPR gRNA sequence
aatagcaactcaggctttgt

SEQ ID NO: 300567 - DNA, 20 bp, Artificial
  CRISPR gRNA sequence
atagcaactcaggctttgtg

SEQ ID NO: 300568 - DNA, 20 bp, Artificial
  CRISPR gRNA sequence
aactcaggctttgtgaggtc

SEQ ID NO: 300569 - DNA, 20 bp, Artificial
  CRISPR gRNA sequence
caggctttgtgaggtctagc

SEQ ID NO: 300570 - DNA, 20 bp, Artificial
  CRISPR gRNA sequence
ctttgtgaggtctagctggc

SEQ ID NO: 300571 - DNA, 20 bp, Artificial
  CRISPR gRNA sequence
ctggctagaaatttcccact

SEQ ID NO: 300572 - DNA, 20 bp, Artificial
  CRISPR gRNA sequence
gcaacattgtgtaatattct

SEQ ID NO: 300573 - DNA, 20 bp, Artificial
  CRISPR gRNA sequence
gtaatattcttagcaccatc

SEQ ID NO: 300574 - DNA, 20 bp, Artificial
  CRISPR gRNA sequence
tattcttagcaccatctggc

SEQ ID NO: 300575 - DNA, 20 bp, Artificial
  CRISPR gRNA sequence
caccatctggctagccgatt

SEQ ID NO: 300576 - DNA, 20 bp, Artificial
  CRISPR gRNA sequence
accatctggctagccgattt

SEQ ID NO: 300577 - DNA, 20 bp, Artificial
  CRISPR gRNA sequence
atttaggcatcaacatcttc

SEQ ID NO: 300578 - DNA, 20 bp, Artificial
  CRISPR gRNA sequence
ctccttataaaccttgcttt

SEQ ID NO: 300579 - DNA, 20 bp, Artificial
  CRISPR gRNA sequence
tataaaccttgctttcagaa

SEQ ID NO: 300580 - DNA, 20 bp, Artificial
  CRISPR gRNA sequence
ataaaccttgctttcagaaa

SEQ ID NO: 300581 - DNA, 20 bp, Artificial
  CRISPR gRNA sequence
ccttgctttcagaaaaggat

SEQ ID NO: 300582 - DNA, 20 bp, Artificial
  CRISPR gRNA sequence
aaatatattacccctcccaa

SEQ ID NO: 300583 - DNA, 20 bp, Artificial
  CRISPR gRNA sequence
cccctcccaatggtattttt

SEQ ID NO: 300584 - DNA, 20 bp, Artificial
  CRISPR gRNA sequence
tcccaatggtattttttggt

SEQ ID NO: 300585 - DNA, 20 bp, Artificial
  CRISPR gRNA sequence
aatggtattttttggttagc

SEQ ID NO: 300586 - DNA, 20 bp, Artificial
  CRISPR gRNA sequence
atggtattttttggttagcc

SEQ ID NO: 300587 - DNA, 20 bp, Artificial
  CRISPR gRNA sequence
tattttttggttagccagga

SEQ ID NO: 300588 - DNA, 20 bp, Artificial
  CRISPR gRNA sequence
ttttttggttagccaggata

SEQ ID NO: 300589 - DNA, 20 bp, Artificial
  CRISPR gRNA sequence
gttagccaggatagagatat

SEQ ID NO: 300590 - DNA, 20 bp, Artificial
  CRISPR gRNA sequence
ataagtgaaaaatctatttc

SEQ ID NO: 300591 - DNA, 20 bp, Artificial
  CRISPR gRNA sequence
gaaaaatctatttccagtgt

SEQ ID NO: 300592 - DNA, 20 bp, Artificial
  CRISPR gRNA sequence
tatttccagtgttagaattt

SEQ ID NO: 300593 - DNA, 20 bp, Artificial
  CRISPR gRNA sequence
atttccagtgttagaattta

SEQ ID NO: 300594 - DNA, 20 bp, Artificial
  CRISPR gRNA sequence
cagtgttagaatttaaggca

SEQ ID NO: 300595 - DNA, 20 bp, Artificial
  CRISPR gRNA sequence
gttagaatttaaggcacagt

SEQ ID NO: 300596 - DNA, 20 bp, Artificial
  CRISPR gRNA sequence
gaatttaaggcacagtgaga

SEQ ID NO: 300597 - DNA, 20 bp, Artificial
  CRISPR gRNA sequence
aatttaaggcacagtgagaa

SEQ ID NO: 300598 - DNA, 20 bp, Artificial
  CRISPR gRNA sequence
atttaaggcacagtgagaaa

SEQ ID NO: 300599 - DNA, 20 bp, Artificial
  CRISPR gRNA sequence
taaggcacagtgagaaaggg

SEQ ID NO: 300600 - DNA, 20 bp, Artificial
  CRISPR gRNA sequence
aaggcacagtgagaaaggga

SEQ ID NO: 300601 - DNA, 20 bp, Artificial
  CRISPR gRNA sequence
ggcatatactttttgaatgc

SEQ ID NO: 300602 - DNA, 20 bp, Artificial
  CRISPR gRNA sequence
cccctgaaattgcatcattt

SEQ ID NO: 300603 - DNA, 20 bp, Artificial
  CRISPR gRNA sequence
aactatctcttccatatata

SEQ ID NO: 300604 - DNA, 20 bp, Artificial
  CRISPR gRNA sequence
agtcacaacaatttctctct

SEQ ID NO: 300605 - DNA, 20 bp, Artificial
  CRISPR gRNA sequence
aacaatttctctctcagtcc

SEQ ID NO: 300606 - DNA, 20 bp, Artificial
  CRISPR gRNA sequence
ctctcagtcccagaactttg

SEQ ID NO: 300607 - DNA, 20 bp, Artificial
  CRISPR gRNA sequence
ttttcaaactttccttcttt

SEQ ID NO: 300608 - DNA, 20 bp, Artificial
  CRISPR gRNA sequence
actttccttcttttggtatc

SEQ ID NO: 300609 - DNA, 20 bp, Artificial
  CRISPR gRNA sequence
ctttccttcttttggtatct

SEQ ID NO: 300610 - DNA, 20 bp, Artificial
  CRISPR gRNA sequence
ttccttcttttggtatctag

SEQ ID NO: 300611 - DNA, 20 bp, Artificial
  CRISPR gRNA sequence
tccttcttttggtatctagg

SEQ ID NO: 300612 - DNA, 20 bp, Artificial
  CRISPR gRNA sequence
ctaggaggaatacatttttg

SEQ ID NO: 300613 - DNA, 20 bp, Artificial
  CRISPR gRNA sequence
acatttttgaagattgttct

SEQ ID NO: 300614 - DNA, 20 bp, Artificial
  CRISPR gRNA sequence
agattgttcttggtgtcttt

SEQ ID NO: 300615 - DNA, 20 bp, Artificial
  CRISPR gRNA sequence
gattgttcttggtgtctttc

SEQ ID NO: 300616 - DNA, 20 bp, Artificial
  CRISPR gRNA sequence
tctttcaggaaccaacacaa

SEQ ID NO: 300617 - DNA, 20 bp, Artificial
  CRISPR gRNA sequence
tttcaggaaccaacacaatg

SEQ ID NO: 300618 - DNA, 20 bp, Artificial
  CRISPR gRNA sequence
tcaggaaccaacacaatgga

SEQ ID NO: 300619 - DNA, 20 bp, Artificial
  CRISPR gRNA sequence
caggaaccaacacaatggag

SEQ ID NO: 300620 - DNA, 20 bp, Artificial
  CRISPR gRNA sequence
aggaaccaacacaatggaga

SEQ ID NO: 300621 - DNA, 20 bp, Artificial
  CRISPR gRNA sequence
aaccaacacaatggagaggg

SEQ ID NO: 300622 - DNA, 20 bp, Artificial
  CRISPR gRNA sequence
ccaacacaatggagagggaa

SEQ ID NO: 300623 - DNA, 20 bp, Artificial
  CRISPR gRNA sequence
aacacaatggagagggaaga

SEQ ID NO: 300624 - DNA, 20 bp, Artificial
  CRISPR gRNA sequence
tggagagggaagagagtgaa

SEQ ID NO: 300625 - DNA, 20 bp, Artificial
  CRISPR gRNA sequence
gggaagagagtgaacagacc

SEQ ID NO: 300626 - DNA, 20 bp, Artificial
  CRISPR gRNA sequence
gagagtgaacagaccaagaa

SEQ ID NO: 300627 - DNA, 20 bp, Artificial
  CRISPR gRNA sequence
agagtgaacagaccaagaaa

SEQ ID NO: 300628 - DNA, 20 bp, Artificial
  CRISPR gRNA sequence
aaaaggtaaatcctgaccct

SEQ ID NO: 300629 - DNA, 20 bp, Artificial
  CRISPR gRNA sequence
cctgaccctgagacattgat

SEQ ID NO: 300630 - DNA, 20 bp, Artificial
  CRISPR gRNA sequence
tgaccctgagacattgatga

SEQ ID NO: 300631 - DNA, 20 bp, Artificial
  CRISPR gRNA sequence
accctgagacattgatgaga

SEQ ID NO: 300632 - DNA, 20 bp, Artificial
  CRISPR gRNA sequence
cctgagacattgatgagaga

SEQ ID NO: 300633 - DNA, 20 bp, Artificial
  CRISPR gRNA sequence
ctgagacattgatgagagag

SEQ ID NO: 300634 - DNA, 20 bp, Artificial
  CRISPR gRNA sequence
tgagagagaggtataatccc

SEQ ID NO: 300635 - DNA, 20 bp, Artificial
  CRISPR gRNA sequence
agagagaggtataatcccca

SEQ ID NO: 300636 - DNA, 20 bp, Artificial
  CRISPR gRNA sequence
cagagtgcctgttacttgaa

SEQ ID NO: 300637 - DNA, 20 bp, Artificial
  CRISPR gRNA sequence
agagtgcctgttacttgaat

SEQ ID NO: 300638 - DNA, 20 bp, Artificial
  CRISPR gRNA sequence
gcttatgcctaacatatgtt

SEQ ID NO: 300639 - DNA, 20 bp, Artificial
  CRISPR gRNA sequence
cctaacatatgttgagacct

SEQ ID NO: 300640 - DNA, 20 bp, Artificial
  CRISPR gRNA sequence
cctcagcaaacctgaactaa

SEQ ID NO: 300641 - DNA, 20 bp, Artificial
  CRISPR gRNA sequence
tcagcaaacctgaactaatg

SEQ ID NO: 300642 - DNA, 20 bp, Artificial
  CRISPR gRNA sequence
agcaaacctgaactaatgga

SEQ ID NO: 300643 - DNA, 20 bp, Artificial
  CRISPR gRNA sequence
gcaaacctgaactaatggag

SEQ ID NO: 300644 - DNA, 20 bp, Artificial
  CRISPR gRNA sequence
caaacctgaactaatggaga

SEQ ID NO: 300645 - DNA, 20 bp, Artificial
  CRISPR gRNA sequence
aacctgaactaatggagagg

SEQ ID NO: 300646 - DNA, 20 bp, Artificial
  CRISPR gRNA sequence
cctgaactaatggagaggga

SEQ ID NO: 300647 - DNA, 20 bp, Artificial
  CRISPR gRNA sequence
ctgaactaatggagagggag

SEQ ID NO: 300648 - DNA, 20 bp, Artificial
  CRISPR gRNA sequence
gagggagaggaaaataaaac

SEQ ID NO: 300649 - DNA, 20 bp, Artificial
  CRISPR gRNA sequence
agaggaaaataaaactagtt

SEQ ID NO: 300650 - DNA, 20 bp, Artificial
  CRISPR gRNA sequence
aaataaaactagttaagaac

SEQ ID NO: 300651 - DNA, 20 bp, Artificial
  CRISPR gRNA sequence
taaaactagttaagaactgg

SEQ ID NO: 300652 - DNA, 20 bp, Artificial
  CRISPR gRNA sequence
ggaagaaaataacctgataa

SEQ ID NO: 300653 - DNA, 20 bp, Artificial
  CRISPR gRNA sequence
aataacctgataatggatga

SEQ ID NO: 300654 - DNA, 20 bp, Artificial
  CRISPR gRNA sequence
ataacctgataatggatgac

SEQ ID NO: 300655 - DNA, 20 bp, Artificial
  CRISPR gRNA sequence
taacctgataatggatgaca

SEQ ID NO: 300656 - DNA, 20 bp, Artificial
  CRISPR gRNA sequence
ggtatccaatgcacaatgcc

SEQ ID NO: 300657 - DNA, 20 bp, Artificial
  CRISPR gRNA sequence
tccaatgcacaatgcccaga

SEQ ID NO: 300658 - DNA, 20 bp, Artificial
  CRISPR gRNA sequence
caatgcccagaaagcatgac

SEQ ID NO: 300659 - DNA, 20 bp, Artificial
  CRISPR gRNA sequence
aagcatgacaagctctgtca

SEQ ID NO: 300660 - DNA, 20 bp, Artificial
  CRISPR gRNA sequence
tgacaagctctgtcatggtc

SEQ ID NO: 300661 - DNA, 20 bp, Artificial
  CRISPR gRNA sequence
gctctgtcatggtcaagtaa

SEQ ID NO: 300662 - DNA, 20 bp, Artificial
  CRISPR gRNA sequence
tcaagtaaaagtcaatacca

SEQ ID NO: 300663 - DNA, 20 bp, Artificial
  CRISPR gRNA sequence
aaagtcaataccaaagactt

SEQ ID NO: 300664 - DNA, 20 bp, Artificial
  CRISPR gRNA sequence
agtcaataccaaagacttca

SEQ ID NO: 300665 - DNA, 20 bp, Artificial
  CRISPR gRNA sequence
gtcaataccaaagacttcag

SEQ ID NO: 300666 - DNA, 20 bp, Artificial
  CRISPR gRNA sequence
aataccaaagacttcagagg

SEQ ID NO: 300667 - DNA, 20 bp, Artificial
  CRISPR gRNA sequence
gacttcagaggtggtgaaca

SEQ ID NO: 300668 - DNA, 20 bp, Artificial
  CRISPR gRNA sequence
acttcagaggtggtgaacat

SEQ ID NO: 300669 - DNA, 20 bp, Artificial
  CRISPR gRNA sequence
gggcttcatcttatctgcca

SEQ ID NO: 300670 - DNA, 20 bp, Artificial
  CRISPR gRNA sequence
cttatctgccacagtaaccc

SEQ ID NO: 300671 - DNA, 20 bp, Artificial
  CRISPR gRNA sequence
gccacagtaaccccagtacc

SEQ ID NO: 300672 - DNA, 20 bp, Artificial
  CRISPR gRNA sequence
agtaaccccagtacctggca

SEQ ID NO: 300673 - DNA, 20 bp, Artificial
  CRISPR gRNA sequence
ccagtacctggcacagtgcc

SEQ ID NO: 300674 - DNA, 20 bp, Artificial
  CRISPR gRNA sequence
acctggcacagtgcctagat

SEQ ID NO: 300675 - DNA, 20 bp, Artificial
  CRISPR gRNA sequence
tggcacagtgcctagattag

SEQ ID NO: 300676 - DNA, 20 bp, Artificial
  CRISPR gRNA sequence
ggcacagtgcctagattagt

SEQ ID NO: 300677 - DNA, 20 bp, Artificial
  CRISPR gRNA sequence
tagtgggcatcctacatgtg

SEQ ID NO: 300678 - DNA, 20 bp, Artificial
  CRISPR gRNA sequence
atgtgtggaatgaataaatg

SEQ ID NO: 300679 - DNA, 20 bp, Artificial
  CRISPR gRNA sequence
tgtggaatgaataaatgaag

SEQ ID NO: 300680 - DNA, 20 bp, Artificial
  CRISPR gRNA sequence
ggaatgaataaatgaagaag

SEQ ID NO: 300681 - DNA, 20 bp, Artificial
  CRISPR gRNA sequence
gaatgaataaatgaagaagt

SEQ ID NO: 300682 - DNA, 20 bp, Artificial
  CRISPR gRNA sequence
aatgaataaatgaagaagtg

SEQ ID NO: 300683 - DNA, 20 bp, Artificial
  CRISPR gRNA sequence
gaatgataacatgtttgctt

SEQ ID NO: 300684 - DNA, 20 bp, Artificial
  CRISPR gRNA sequence
taacatgtttgcttcagcct

SEQ ID NO: 300685 - DNA, 20 bp, Artificial
  CRISPR gRNA sequence
ttgcttcagcctgagcatct

SEQ ID NO: 300686 - DNA, 20 bp, Artificial
  CRISPR gRNA sequence
gagcatcttagtatttgcta

SEQ ID NO: 300687 - DNA, 20 bp, Artificial
  CRISPR gRNA sequence
gtatttgctatggccctgtt

SEQ ID NO: 300688 - DNA, 20 bp, Artificial
  CRISPR gRNA sequence
cacttctttacctcattctt

SEQ ID NO: 300689 - DNA, 20 bp, Artificial
  CRISPR gRNA sequence
cattcttcagatcttgcctc

SEQ ID NO: 300690 - DNA, 20 bp, Artificial
  CRISPR gRNA sequence
tcttcagatcttgcctcaag

SEQ ID NO: 300691 - DNA, 20 bp, Artificial
  CRISPR gRNA sequence
ttaaaaaccctttcccaaac

SEQ ID NO: 300692 - DNA, 20 bp, Artificial
  CRISPR gRNA sequence
tagaaaatgtcaacttgtta

SEQ ID NO: 300693 - DNA, 20 bp, Artificial
  CRISPR gRNA sequence
caacttgttacagtgtcatg

SEQ ID NO: 300694 - DNA, 20 bp, Artificial
  CRISPR gRNA sequence
acagtgtcatgtggatccct

SEQ ID NO: 300695 - DNA, 20 bp, Artificial
  CRISPR gRNA sequence
tggctttttcttaataacac

SEQ ID NO: 300696 - DNA, 20 bp, Artificial
  CRISPR gRNA sequence
tcttattaaactctataaac

SEQ ID NO: 300697 - DNA, 20 bp, Artificial
  CRISPR gRNA sequence
agacttaactaaatcctatg

SEQ ID NO: 300698 - DNA, 20 bp, Artificial
  CRISPR gRNA sequence
acttaactaaatcctatgaa

SEQ ID NO: 300699 - DNA, 20 bp, Artificial
  CRISPR gRNA sequence
taactaaatcctatgaagag

SEQ ID NO: 300700 - DNA, 20 bp, Artificial
  CRISPR gRNA sequence
actaaatcctatgaagagca

SEQ ID NO: 300701 - DNA, 20 bp, Artificial
  CRISPR gRNA sequence
atgaagagcagagaccatac

SEQ ID NO: 300702 - DNA, 20 bp, Artificial
  CRISPR gRNA sequence
gagcagagaccataccagtt

SEQ ID NO: 300703 - DNA, 20 bp, Artificial
  CRISPR gRNA sequence
taagctcatcattgtgctgc

SEQ ID NO: 300704 - DNA, 20 bp, Artificial
  CRISPR gRNA sequence
atcattgtgctgctagcact

SEQ ID NO: 300705 - DNA, 20 bp, Artificial
  CRISPR gRNA sequence
tgtgctgctagcacttagca

SEQ ID NO: 300706 - DNA, 20 bp, Artificial
  CRISPR gRNA sequence
ctagcacttagcatggtgcc

SEQ ID NO: 300707 - DNA, 20 bp, Artificial
  CRISPR gRNA sequence
ttagcatggtgcctggcata

SEQ ID NO: 300708 - DNA, 20 bp, Artificial
  CRISPR gRNA sequence
gcatggtgcctggcatatag

SEQ ID NO: 300709 - DNA, 20 bp, Artificial
  CRISPR gRNA sequence
catggtgcctggcatatagc

SEQ ID NO: 300710 - DNA, 20 bp, Artificial
  CRISPR gRNA sequence
aggttctcaataaatgttga

SEQ ID NO: 300711 - DNA, 20 bp, Artificial
  CRISPR gRNA sequence
gatgcatgatgaatacataa

SEQ ID NO: 300712 - DNA, 20 bp, Artificial
  CRISPR gRNA sequence
gatgaatacataaaagttcg

SEQ ID NO: 300713 - DNA, 20 bp, Artificial
  CRISPR gRNA sequence
acataaaagttcgtggtgat

SEQ ID NO: 300714 - DNA, 20 bp, Artificial
  CRISPR gRNA sequence
atcagtcctttcacaacgtg

SEQ ID NO: 300715 - DNA, 20 bp, Artificial
  CRISPR gRNA sequence
ctttcacaacgtgaagctat

SEQ ID NO: 300716 - DNA, 20 bp, Artificial
  CRISPR gRNA sequence
cacaacgtgaagctatcaga

SEQ ID NO: 300717 - DNA, 20 bp, Artificial
  CRISPR gRNA sequence
tctgtacctctatccctcct

SEQ ID NO: 300718 - DNA, 20 bp, Artificial
  CRISPR gRNA sequence
tctatccctcctgagaaatt

SEQ ID NO: 300719 - DNA, 20 bp, Artificial
  CRISPR gRNA sequence
ctcctgagaaattaagctct

SEQ ID NO: 300720 - DNA, 20 bp, Artificial
  CRISPR gRNA sequence
tcctgagaaattaagctctc

SEQ ID NO: 300721 - DNA, 20 bp, Artificial
  CRISPR gRNA sequence
attaagctctcaggaatatc

SEQ ID NO: 300722 - DNA, 20 bp, Artificial
  CRISPR gRNA sequence
ttaagctctcaggaatatca

SEQ ID NO: 300723 - DNA, 20 bp, Artificial
  CRISPR gRNA sequence
aggctctgactgcataccca

SEQ ID NO: 300724 - DNA, 20 bp, Artificial
  CRISPR gRNA sequence
ggctctgactgcatacccat

SEQ ID NO: 300725 - DNA, 20 bp, Artificial
  CRISPR gRNA sequence
actgcatacccataggatca

SEQ ID NO: 300726 - DNA, 20 bp, Artificial
  CRISPR gRNA sequence
cataggatcaaagcaaccct

SEQ ID NO: 300727 - DNA, 20 bp, Artificial
  CRISPR gRNA sequence
tcaaagcaaccctcagtcac

SEQ ID NO: 300728 - DNA, 20 bp, Artificial
  CRISPR gRNA sequence
gcaaccctcagtcacaagcc

SEQ ID NO: 300729 - DNA, 20 bp, Artificial
  CRISPR gRNA sequence
ctcagtcacaagcctggttt

SEQ ID NO: 300730 - DNA, 20 bp, Artificial
  CRISPR gRNA sequence
cagtcacaagcctggtttca

SEQ ID NO: 300731 - DNA, 20 bp, Artificial
  CRISPR gRNA sequence
cacaagcctggtttcagaga

SEQ ID NO: 300732 - DNA, 20 bp, Artificial
  CRISPR gRNA sequence
acaagcctggtttcagagat

SEQ ID NO: 300733 - DNA, 20 bp, Artificial
  CRISPR gRNA sequence
caagcctggtttcagagata

SEQ ID NO: 300734 - DNA, 20 bp, Artificial
  CRISPR gRNA sequence
agagatagggtcataacccc

SEQ ID NO: 300735 - DNA, 20 bp, Artificial
  CRISPR gRNA sequence
gagatagggtcataaccccc

SEQ ID NO: 300736 - DNA, 20 bp, Artificial
  CRISPR gRNA sequence
agatagggtcataaccccca

SEQ ID NO: 300737 - DNA, 20 bp, Artificial
  CRISPR gRNA sequence
gggtcataacccccagggtg

SEQ ID NO: 300738 - DNA, 20 bp, Artificial
  CRISPR gRNA sequence
gtcataacccccagggtgca

SEQ ID NO: 300739 - DNA, 20 bp, Artificial
  CRISPR gRNA sequence
cccagggtgcagagacaacc

SEQ ID NO: 300740 - DNA, 20 bp, Artificial
  CRISPR gRNA sequence
cagggtgcagagacaaccga

SEQ ID NO: 300741 - DNA, 20 bp, Artificial
  CRISPR gRNA sequence
cagagacaaccgagagtacc

SEQ ID NO: 300742 - DNA, 20 bp, Artificial
  CRISPR gRNA sequence
gagagtacccagcactaatc

SEQ ID NO: 300743 - DNA, 20 bp, Artificial
  CRISPR gRNA sequence
cagcactaatccagatatac

SEQ ID NO: 300744 - DNA, 20 bp, Artificial
  CRISPR gRNA sequence
tataccagccactgtgattc

SEQ ID NO: 300745 - DNA, 20 bp, Artificial
  CRISPR gRNA sequence
agcaacaaaactaataattc

SEQ ID NO: 300746 - DNA, 20 bp, Artificial
  CRISPR gRNA sequence
gcaacaaaactaataattcc

SEQ ID NO: 300747 - DNA, 20 bp, Artificial
  CRISPR gRNA sequence
ctaataattccgggcaccct

SEQ ID NO: 300748 - DNA, 20 bp, Artificial
  CRISPR gRNA sequence
tccgggcacccttggacaat

SEQ ID NO: 300749 - DNA, 20 bp, Artificial
  CRISPR gRNA sequence
ggcacccttggacaatgaga

SEQ ID NO: 300750 - DNA, 20 bp, Artificial
  CRISPR gRNA sequence
gcacccttggacaatgagaa

SEQ ID NO: 300751 - DNA, 20 bp, Artificial
  CRISPR gRNA sequence
cacccttggacaatgagaaa

SEQ ID NO: 300752 - DNA, 20 bp, Artificial
  CRISPR gRNA sequence
cctgcctaccctgtcacact

SEQ ID NO: 300753 - DNA, 20 bp, Artificial
  CRISPR gRNA sequence
taccctgtcacactcagttt

SEQ ID NO: 300754 - DNA, 20 bp, Artificial
  CRISPR gRNA sequence
gtcacactcagtttcagaaa

SEQ ID NO: 300755 - DNA, 20 bp, Artificial
  CRISPR gRNA sequence
actcagtttcagaaatggtc

SEQ ID NO: 300756 - DNA, 20 bp, Artificial
  CRISPR gRNA sequence
cagtttcagaaatggtctgg

SEQ ID NO: 300757 - DNA, 20 bp, Artificial
  CRISPR gRNA sequence
gtttcagaaatggtctggaa

SEQ ID NO: 300758 - DNA, 20 bp, Artificial
  CRISPR gRNA sequence
aaatggtctggaagagcctg

SEQ ID NO: 300759 - DNA, 20 bp, Artificial
  CRISPR gRNA sequence
atggtctggaagagcctgca

SEQ ID NO: 300760 - DNA, 20 bp, Artificial
  CRISPR gRNA sequence
tggtctggaagagcctgcag

SEQ ID NO: 300761 - DNA, 20 bp, Artificial
  CRISPR gRNA sequence
ggtctggaagagcctgcaga

SEQ ID NO: 300762 - DNA, 20 bp, Artificial
  CRISPR gRNA sequence
ctggaagagcctgcagaggg

SEQ ID NO: 300763 - DNA, 20 bp, Artificial
  CRISPR gRNA sequence
tggaagagcctgcagagggc

SEQ ID NO: 300764 - DNA, 20 bp, Artificial
  CRISPR gRNA sequence
aagagcctgcagagggcagg

SEQ ID NO: 300765 - DNA, 20 bp, Artificial
  CRISPR gRNA sequence
agcctgcagagggcaggcag

SEQ ID NO: 300766 - DNA, 20 bp, Artificial
  CRISPR gRNA sequence
cctgcagagggcaggcagca

SEQ ID NO: 300767 - DNA, 20 bp, Artificial
  CRISPR gRNA sequence
gagggcaggcagcagagaac

SEQ ID NO: 300768 - DNA, 20 bp, Artificial
  CRISPR gRNA sequence
ggcaggcagcagagaaccgg

SEQ ID NO: 300769 - DNA, 20 bp, Artificial
  CRISPR gRNA sequence
caggcagcagagaaccggca

SEQ ID NO: 300770 - DNA, 20 bp, Artificial
  CRISPR gRNA sequence
aggcagcagagaaccggcag

SEQ ID NO: 300771 - DNA, 20 bp, Artificial
  CRISPR gRNA sequence
ggcagcagagaaccggcaga

SEQ ID NO: 300772 - DNA, 20 bp, Artificial
  CRISPR gRNA sequence
cagagaaccggcagagggca

SEQ ID NO: 300773 - DNA, 20 bp, Artificial
  CRISPR gRNA sequence
agagaaccggcagagggcat

SEQ ID NO: 300774 - DNA, 20 bp, Artificial
  CRISPR gRNA sequence
gaaccggcagagggcatggg

SEQ ID NO: 300775 - DNA, 20 bp, Artificial
  CRISPR gRNA sequence
aaccggcagagggcatggga

SEQ ID NO: 300776 - DNA, 20 bp, Artificial
  CRISPR gRNA sequence
accggcagagggcatgggaa

SEQ ID NO: 300777 - DNA, 20 bp, Artificial
  CRISPR gRNA sequence
gcagagggcatgggaagggc

SEQ ID NO: 300778 - DNA, 20 bp, Artificial
  CRISPR gRNA sequence
cagagggcatgggaagggcc

SEQ ID NO: 300779 - DNA, 20 bp, Artificial
  CRISPR gRNA sequence
agggcatgggaagggccagg

SEQ ID NO: 300780 - DNA, 20 bp, Artificial
  CRISPR gRNA sequence
ggaagggccaggcagaaata

SEQ ID NO: 300781 - DNA, 20 bp, Artificial
  CRISPR gRNA sequence
gaagggccaggcagaaataa

SEQ ID NO: 300782 - DNA, 20 bp, Artificial
  CRISPR gRNA sequence
aagggccaggcagaaataaa

SEQ ID NO: 300783 - DNA, 20 bp, Artificial
  CRISPR gRNA sequence
ggccaggcagaaataaaggg

SEQ ID NO: 300784 - DNA, 20 bp, Artificial
  CRISPR gRNA sequence
gaaataaagggtagctcttg

SEQ ID NO: 300785 - DNA, 20 bp, Artificial
  CRISPR gRNA sequence
aaagggtagctcttgaagca

SEQ ID NO: 300786 - DNA, 20 bp, Artificial
  CRISPR gRNA sequence
agctcttgaagcatagatga

SEQ ID NO: 300787 - DNA, 20 bp, Artificial
  CRISPR gRNA sequence
ttgaagcatagatgacagtg

SEQ ID NO: 300788 - DNA, 20 bp, Artificial
  CRISPR gRNA sequence
atagatgacagtgtagaccg

SEQ ID NO: 300789 - DNA, 20 bp, Artificial
  CRISPR gRNA sequence
ttctccacctttctcttcaa

SEQ ID NO: 300790 - DNA, 20 bp, Artificial
  CRISPR gRNA sequence
tctcctcattgctgttccaa

SEQ ID NO: 300791 - DNA, 20 bp, Artificial
  CRISPR gRNA sequence
tctgccctatcattgaaatc

SEQ ID NO: 300792 - DNA, 20 bp, Artificial
  CRISPR gRNA sequence
ctatcattgaaatctagaaa

SEQ ID NO: 300793 - DNA, 20 bp, Artificial
  CRISPR gRNA sequence
cattgaaatctagaaaaaga

SEQ ID NO: 300794 - DNA, 20 bp, Artificial
  CRISPR gRNA sequence
tgaaatctagaaaaagaaag

SEQ ID NO: 300795 - DNA, 20 bp, Artificial
  CRISPR gRNA sequence
aatcttttcttctatttctc

SEQ ID NO: 300796 - DNA, 20 bp, Artificial
  CRISPR gRNA sequence
tcttttcttctatttctcca

SEQ ID NO: 300797 - DNA, 20 bp, Artificial
  CRISPR gRNA sequence
gaaaaaatccatatacctga

SEQ ID NO: 300798 - DNA, 20 bp, Artificial
  CRISPR gRNA sequence
tatacctgaaagatctgatg

SEQ ID NO: 300799 - DNA, 20 bp, Artificial
  CRISPR gRNA sequence
ctgaaagatctgatgaagcc

SEQ ID NO: 300800 - DNA, 20 bp, Artificial
  CRISPR gRNA sequence
gaagcccagcgtgtttttaa

SEQ ID NO: 300801 - DNA, 20 bp, Artificial
  CRISPR gRNA sequence
agcgtgtttttaaaagttcg

SEQ ID NO: 300802 - DNA, 20 bp, Artificial
  CRISPR gRNA sequence
aagacatcttcatgcgacaa

SEQ ID NO: 300803 - DNA, 20 bp, Artificial
  CRISPR gRNA sequence
gtgatacatgtttttaatta

SEQ ID NO: 300804 - DNA, 20 bp, Artificial
  CRISPR gRNA sequence
gatacatgtttttaattaaa

SEQ ID NO: 300805 - DNA, 20 bp, Artificial
  CRISPR gRNA sequence
atgtttttaattaaagagta

SEQ ID NO: 300806 - DNA, 20 bp, Artificial
  CRISPR gRNA sequence
ttaaagagtaaagcccatac

SEQ ID NO: 300807 - DNA, 20 bp, Artificial
  CRISPR gRNA sequence
ttttctaccctttcctttgt

SEQ ID NO: 300808 - DNA, 20 bp, Artificial
  CRISPR gRNA sequence
ccctttcctttgtaagttcc

SEQ ID NO: 300809 - DNA, 20 bp, Artificial
  CRISPR gRNA sequence
cctttcctttgtaagttcct

SEQ ID NO: 300810 - DNA, 20 bp, Artificial
  CRISPR gRNA sequence
gcaacctttttgatttcttc

SEQ ID NO: 300811 - DNA, 20 bp, Artificial
  CRISPR gRNA sequence
acctttttgatttcttccag

SEQ ID NO: 300812 - DNA, 20 bp, Artificial
  CRISPR gRNA sequence
cctttttgatttcttccaga

SEQ ID NO: 300813 - DNA, 20 bp, Artificial
  CRISPR gRNA sequence
gatttcttccagaaggcaaa

SEQ ID NO: 300814 - DNA, 20 bp, Artificial
  CRISPR gRNA sequence
aggcaaaaagacattaccat

SEQ ID NO: 300815 - DNA, 20 bp, Artificial
  CRISPR gRNA sequence
aagacattaccatgagtaat

SEQ ID NO: 300816 - DNA, 20 bp, Artificial
  CRISPR gRNA sequence
agacattaccatgagtaata

SEQ ID NO: 300817 - DNA, 20 bp, Artificial
  CRISPR gRNA sequence
gacattaccatgagtaataa

SEQ ID NO: 300818 - DNA, 20 bp, Artificial
  CRISPR gRNA sequence
acattaccatgagtaataag

SEQ ID NO: 300819 - DNA, 20 bp, Artificial
  CRISPR gRNA sequence
cattaccatgagtaataagg

SEQ ID NO: 300820 - DNA, 20 bp, Artificial
  CRISPR gRNA sequence
catgagtaataagggggctc

SEQ ID NO: 300821 - DNA, 20 bp, Artificial
  CRISPR gRNA sequence
atgagtaataagggggctcc

SEQ ID NO: 300822 - DNA, 20 bp, Artificial
  CRISPR gRNA sequence
ggggctccaggactccctct

SEQ ID NO: 300823 - DNA, 20 bp, Artificial
  CRISPR gRNA sequence
gctccaggactccctctaag

SEQ ID NO: 300824 - DNA, 20 bp, Artificial
  CRISPR gRNA sequence
aggactccctctaagtggaa

SEQ ID NO: 300825 - DNA, 20 bp, Artificial
  CRISPR gRNA sequence
gaatagcctccctgtaactc

SEQ ID NO: 300826 - DNA, 20 bp, Artificial
  CRISPR gRNA sequence
ccagctctgctccgtatgcc

SEQ ID NO: 300827 - DNA, 20 bp, Artificial
  CRISPR gRNA sequence
agctctgctccgtatgccaa

SEQ ID NO: 300828 - DNA, 20 bp, Artificial
  CRISPR gRNA sequence
gctctgctccgtatgccaag

SEQ ID NO: 300829 - DNA, 20 bp, Artificial
  CRISPR gRNA sequence
tctgctccgtatgccaagag

SEQ ID NO: 300830 - DNA, 20 bp, Artificial
  CRISPR gRNA sequence
cttactgcttcttttcactt

SEQ ID NO: 300831 - DNA, 20 bp, Artificial
  CRISPR gRNA sequence
tactgcttcttttcacttca

SEQ ID NO: 300832 - DNA, 20 bp, Artificial
  CRISPR gRNA sequence
ttcacttcagagcacactta

SEQ ID NO: 300833 - DNA, 20 bp, Artificial
  CRISPR gRNA sequence
tcacttcagagcacacttat

SEQ ID NO: 300834 - DNA, 20 bp, Artificial
  CRISPR gRNA sequence
tcagagcacacttatgggcc

SEQ ID NO: 300835 - DNA, 20 bp, Artificial
  CRISPR gRNA sequence
gcacacttatgggccaagcc

SEQ ID NO: 300836 - DNA, 20 bp, Artificial
  CRISPR gRNA sequence
atgggccaagcccagcttaa

SEQ ID NO: 300837 - DNA, 20 bp, Artificial
  CRISPR gRNA sequence
cagcttaatggctcatgacc

SEQ ID NO: 300838 - DNA, 20 bp, Artificial
  CRISPR gRNA sequence
catgacctggaaataaaatt

SEQ ID NO: 300839 - DNA, 20 bp, Artificial
  CRISPR gRNA sequence
atgacctggaaataaaattt

SEQ ID NO: 300840 - DNA, 20 bp, Artificial
  CRISPR gRNA sequence
tttaggaccaatacctcctc

SEQ ID NO: 300841 - DNA, 20 bp, Artificial
  CRISPR gRNA sequence
gaccaatacctcctccagat

SEQ ID NO: 300842 - DNA, 20 bp, Artificial
  CRISPR gRNA sequence
agattcttctcttaatttca

SEQ ID NO: 300843 - DNA, 20 bp, Artificial
  CRISPR gRNA sequence
gattgtgttttttttttaaa

SEQ ID NO: 300844 - DNA, 20 bp, Artificial
  CRISPR gRNA sequence
taaatagacctctcaatttc

SEQ ID NO: 300845 - DNA, 20 bp, Artificial
  CRISPR gRNA sequence
aaaactgccttttatctgcc

SEQ ID NO: 300846 - DNA, 20 bp, Artificial
  CRISPR gRNA sequence
ttttatctgcccagaattct

SEQ ID NO: 300847 - DNA, 20 bp, Artificial
  CRISPR gRNA sequence
atctgcccagaattctaagc

SEQ ID NO: 300848 - DNA, 20 bp, Artificial
  CRISPR gRNA sequence
tgactaaacaactacctcct

SEQ ID NO: 300849 - DNA, 20 bp, Artificial
  CRISPR gRNA sequence
aaacaactacctcctcagtc

SEQ ID NO: 300850 - DNA, 20 bp, Artificial
  CRISPR gRNA sequence
aacaactacctcctcagtct

SEQ ID NO: 300851 - DNA, 20 bp, Artificial
  CRISPR gRNA sequence
aactacctcctcagtctggg

SEQ ID NO: 300852 - DNA, 20 bp, Artificial
  CRISPR gRNA sequence
actacctcctcagtctgggt

SEQ ID NO: 300853 - DNA, 20 bp, Artificial
  CRISPR gRNA sequence
cttatgtatttatgacctta

SEQ ID NO: 300854 - DNA, 20 bp, Artificial
  CRISPR gRNA sequence
agtgttaatatcttgaaaca

SEQ ID NO: 300855 - DNA, 20 bp, Artificial
  CRISPR gRNA sequence
tgttaatatcttgaaacata

SEQ ID NO: 300856 - DNA, 20 bp, Artificial
  CRISPR gRNA sequence
tagagatctatgtactgtaa

SEQ ID NO: 300857 - DNA, 20 bp, Artificial
  CRISPR gRNA sequence
atagtgtgattactatgctc

SEQ ID NO: 300858 - DNA, 20 bp, Artificial
  CRISPR gRNA sequence
agtgtgattactatgctcta

SEQ ID NO: 300859 - DNA, 20 bp, Artificial
  CRISPR gRNA sequence
gattactatgctctagagaa

SEQ ID NO: 300860 - DNA, 20 bp, Artificial
  CRISPR gRNA sequence
gagaaaagtctacccctgct

SEQ ID NO: 300861 - DNA, 20 bp, Artificial
  CRISPR gRNA sequence
agaaaagtctacccctgcta

SEQ ID NO: 300862 - DNA, 20 bp, Artificial
  CRISPR gRNA sequence
aaaagtctacccctgctaag

SEQ ID NO: 300863 - DNA, 20 bp, Artificial
  CRISPR gRNA sequence
aggagttctcatccctctgt

SEQ ID NO: 300864 - DNA, 20 bp, Artificial
  CRISPR gRNA sequence
ggagttctcatccctctgtc

SEQ ID NO: 300865 - DNA, 20 bp, Artificial
  CRISPR gRNA sequence
gagttctcatccctctgtca

SEQ ID NO: 300866 - DNA, 20 bp, Artificial
  CRISPR gRNA sequence
tctcatccctctgtcagggt

SEQ ID NO: 300867 - DNA, 20 bp, Artificial
  CRISPR gRNA sequence
atccctctgtcagggtcagt

SEQ ID NO: 300868 - DNA, 20 bp, Artificial
  CRISPR gRNA sequence
tccctctgtcagggtcagta

SEQ ID NO: 300869 - DNA, 20 bp, Artificial
  CRISPR gRNA sequence
gtcagggtcagtaaggaaaa

SEQ ID NO: 300870 - DNA, 20 bp, Artificial
  CRISPR gRNA sequence
agggtcagtaaggaaaacgg

SEQ ID NO: 300871 - DNA, 20 bp, Artificial
  CRISPR gRNA sequence
cagtaaggaaaacggtggcc

SEQ ID NO: 300872 - DNA, 20 bp, Artificial
  CRISPR gRNA sequence
agtaaggaaaacggtggcct

SEQ ID NO: 300873 - DNA, 20 bp, Artificial
  CRISPR gRNA sequence
gtaaggaaaacggtggccta

SEQ ID NO: 300874 - DNA, 20 bp, Artificial
  CRISPR gRNA sequence
gaaaacggtggcctagggta

SEQ ID NO: 300875 - DNA, 20 bp, Artificial
  CRISPR gRNA sequence
aaaacggtggcctagggtac

SEQ ID NO: 300876 - DNA, 20 bp, Artificial
  CRISPR gRNA sequence
cctagggtacaggcaacaat

SEQ ID NO: 300877 - DNA, 20 bp, Artificial
  CRISPR gRNA sequence
agggtacaggcaacaatgag

SEQ ID NO: 300878 - DNA, 20 bp, Artificial
  CRISPR gRNA sequence
tgagcagaccaacctaaatt

SEQ ID NO: 300879 - DNA, 20 bp, Artificial
  CRISPR gRNA sequence
gagcagaccaacctaaattt

SEQ ID NO: 300880 - DNA, 20 bp, Artificial
  CRISPR gRNA sequence
agcagaccaacctaaatttg

SEQ ID NO: 300881 - DNA, 20 bp, Artificial
  CRISPR gRNA sequence
caacctaaatttggggaaat

SEQ ID NO: 300882 - DNA, 20 bp, Artificial
  CRISPR gRNA sequence
aacctaaatttggggaaatt

SEQ ID NO: 300883 - DNA, 20 bp, Artificial
  CRISPR gRNA sequence
cctaaatttggggaaattag

SEQ ID NO: 300884 - DNA, 20 bp, Artificial
  CRISPR gRNA sequence
taaatttggggaaattagga

SEQ ID NO: 300885 - DNA, 20 bp, Artificial
  CRISPR gRNA sequence
aaatttggggaaattaggag

SEQ ID NO: 300886 - DNA, 20 bp, Artificial
  CRISPR gRNA sequence
tttggggaaattaggagagg

SEQ ID NO: 300887 - DNA, 20 bp, Artificial
  CRISPR gRNA sequence
tggggaaattaggagaggca

SEQ ID NO: 300888 - DNA, 20 bp, Artificial
  CRISPR gRNA sequence
gaaattaggagaggcagaga

SEQ ID NO: 300889 - DNA, 20 bp, Artificial
  CRISPR gRNA sequence
ggagaggcagagatagaacc

SEQ ID NO: 300890 - DNA, 20 bp, Artificial
  CRISPR gRNA sequence
agaggcagagatagaacctg

SEQ ID NO: 300891 - DNA, 20 bp, Artificial
  CRISPR gRNA sequence
aacctggagccacttctatc

SEQ ID NO: 300892 - DNA, 20 bp, Artificial
  CRISPR gRNA sequence
acctggagccacttctatct

SEQ ID NO: 300893 - DNA, 20 bp, Artificial
  CRISPR gRNA sequence
tctgggctgttgctaatatt

SEQ ID NO: 300894 - DNA, 20 bp, Artificial
  CRISPR gRNA sequence
ctgggctgttgctaatattg

SEQ ID NO: 300895 - DNA, 20 bp, Artificial
  CRISPR gRNA sequence
gggctgttgctaatattgag

SEQ ID NO: 300896 - DNA, 20 bp, Artificial
  CRISPR gRNA sequence
ggctgttgctaatattgagg

SEQ ID NO: 300897 - DNA, 20 bp, Artificial
  CRISPR gRNA sequence
ggaggcttgccccacccaac

SEQ ID NO: 300898 - DNA, 20 bp, Artificial
  CRISPR gRNA sequence
ttgccccacccaacaagcca

SEQ ID NO: 300899 - DNA, 20 bp, Artificial
  CRISPR gRNA sequence
ccccacccaacaagccatag

SEQ ID NO: 300900 - DNA, 20 bp, Artificial
  CRISPR gRNA sequence
ccacccaacaagccatagtg

SEQ ID NO: 300901 - DNA, 20 bp, Artificial
  CRISPR gRNA sequence
acccaacaagccatagtgga

SEQ ID NO: 300902 - DNA, 20 bp, Artificial
  CRISPR gRNA sequence
agtggagagaactgaataaa

SEQ ID NO: 300903 - DNA, 20 bp, Artificial
  CRISPR gRNA sequence
gtggagagaactgaataaac

SEQ ID NO: 300904 - DNA, 20 bp, Artificial
  CRISPR gRNA sequence
ctgaataaacaggaaaatgc

SEQ ID NO: 300905 - DNA, 20 bp, Artificial
  CRISPR gRNA sequence
gaataaacaggaaaatgcca

SEQ ID NO: 300906 - DNA, 20 bp, Artificial
  CRISPR gRNA sequence
tgtgaaccctgtttctcttg

SEQ ID NO: 300907 - DNA, 20 bp, Artificial
  CRISPR gRNA sequence
gtttctcttgaagaactgac

SEQ ID NO: 300908 - DNA, 20 bp, Artificial
  CRISPR gRNA sequence
ctcttgaagaactgactagt

SEQ ID NO: 300909 - DNA, 20 bp, Artificial
  CRISPR gRNA sequence
tgaagaactgactagtgaga

SEQ ID NO: 300910 - DNA, 20 bp, Artificial
  CRISPR gRNA sequence
aactgactagtgagatggcc

SEQ ID NO: 300911 - DNA, 20 bp, Artificial
  CRISPR gRNA sequence
actgactagtgagatggcct

SEQ ID NO: 300912 - DNA, 20 bp, Artificial
  CRISPR gRNA sequence
ctgactagtgagatggcctg

SEQ ID NO: 300913 - DNA, 20 bp, Artificial
  CRISPR gRNA sequence
actagtgagatggcctgggg

SEQ ID NO: 300914 - DNA, 20 bp, Artificial
  CRISPR gRNA sequence
atggcctggggaagctgtga

SEQ ID NO: 300915 - DNA, 20 bp, Artificial
  CRISPR gRNA sequence
ggaagctgtgaaagaaccaa

SEQ ID NO: 300916 - DNA, 20 bp, Artificial
  CRISPR gRNA sequence
aagctgtgaaagaaccaaaa

SEQ ID NO: 300917 - DNA, 20 bp, Artificial
  CRISPR gRNA sequence
aaagagatcacaatactcaa

SEQ ID NO: 300918 - DNA, 20 bp, Artificial
  CRISPR gRNA sequence
agagatcacaatactcaaaa

SEQ ID NO: 300919 - DNA, 20 bp, Artificial
  CRISPR gRNA sequence
agatcacaatactcaaaaga

SEQ ID NO: 300920 - DNA, 20 bp, Artificial
  CRISPR gRNA sequence
atcacaatactcaaaagaga

SEQ ID NO: 300921 - DNA, 20 bp, Artificial
  CRISPR gRNA sequence
cacaatactcaaaagagaga

SEQ ID NO: 300922 - DNA, 20 bp, Artificial
  CRISPR gRNA sequence
caatactcaaaagagagaga

SEQ ID NO: 300923 - DNA, 20 bp, Artificial
  CRISPR gRNA sequence
atactcaaaagagagagaga

SEQ ID NO: 300924 - DNA, 20 bp, Artificial
  CRISPR gRNA sequence
aaagagagagagagagaaaa

SEQ ID NO: 300925 - DNA, 20 bp, Artificial
  CRISPR gRNA sequence
agagagagagagagaaaaaa

SEQ ID NO: 300926 - DNA, 20 bp, Artificial
  CRISPR gRNA sequence
agagagagagagaaaaaaga

SEQ ID NO: 300927 - DNA, 20 bp, Artificial
  CRISPR gRNA sequence
aaaagagagatcttgatcca

SEQ ID NO: 300928 - DNA, 20 bp, Artificial
  CRISPR gRNA sequence
acagaaatacatgaaatgtc

SEQ ID NO: 300929 - DNA, 20 bp, Artificial
  CRISPR gRNA sequence
ggtctgtccaccccatcaac

SEQ ID NO: 300930 - DNA, 20 bp, Artificial
  CRISPR gRNA sequence
ccatcaacaagtcttgaaac

SEQ ID NO: 300931 - DNA, 20 bp, Artificial
  CRISPR gRNA sequence
acaagtcttgaaacaagcaa

SEQ ID NO: 300932 - DNA, 20 bp, Artificial
  CRISPR gRNA sequence
gtcttgaaacaagcaacaga

SEQ ID NO: 300933 - DNA, 20 bp, Artificial
  CRISPR gRNA sequence
tgaaacaagcaacagatgga

SEQ ID NO: 300934 - DNA, 20 bp, Artificial
  CRISPR gRNA sequence
agatggatagtctgtccaaa

SEQ ID NO: 300935 - DNA, 20 bp, Artificial
  CRISPR gRNA sequence
tagtctgtccaaatggacat

SEQ ID NO: 300936 - DNA, 20 bp, Artificial
  CRISPR gRNA sequence
ctgtccaaatggacataaga

SEQ ID NO: 300937 - DNA, 20 bp, Artificial
  CRISPR gRNA sequence
ccaaatggacataagacaga

SEQ ID NO: 300938 - DNA, 20 bp, Artificial
  CRISPR gRNA sequence
aatggacataagacagacag

SEQ ID NO: 300939 - DNA, 20 bp, Artificial
  CRISPR gRNA sequence
aagacagacagcagtttccc

SEQ ID NO: 300940 - DNA, 20 bp, Artificial
  CRISPR gRNA sequence
acagacagcagtttccctgg

SEQ ID NO: 300941 - DNA, 20 bp, Artificial
  CRISPR gRNA sequence
acagcagtttccctggtggt

SEQ ID NO: 300942 - DNA, 20 bp, Artificial
  CRISPR gRNA sequence
cagcagtttccctggtggtc

SEQ ID NO: 300943 - DNA, 20 bp, Artificial
  CRISPR gRNA sequence
agcagtttccctggtggtca

SEQ ID NO: 300944 - DNA, 20 bp, Artificial
  CRISPR gRNA sequence
cagtttccctggtggtcagg

SEQ ID NO: 300945 - DNA, 20 bp, Artificial
  CRISPR gRNA sequence
agtttccctggtggtcaggg

SEQ ID NO: 300946 - DNA, 20 bp, Artificial
  CRISPR gRNA sequence
gtttccctggtggtcaggga

SEQ ID NO: 300947 - DNA, 20 bp, Artificial
  CRISPR gRNA sequence
tttccctggtggtcagggag

SEQ ID NO: 300948 - DNA, 20 bp, Artificial
  CRISPR gRNA sequence
tggtggtcagggaggggttt

SEQ ID NO: 300949 - DNA, 20 bp, Artificial
  CRISPR gRNA sequence
gaggggttttggtgataccc

SEQ ID NO: 300950 - DNA, 20 bp, Artificial
  CRISPR gRNA sequence
tttggtgatacccaagttat

SEQ ID NO: 300951 - DNA, 20 bp, Artificial
  CRISPR gRNA sequence
ttggtgatacccaagttatt

SEQ ID NO: 300952 - DNA, 20 bp, Artificial
  CRISPR gRNA sequence
ttattgggatgtcatcttcc

SEQ ID NO: 300953 - DNA, 20 bp, Artificial
  CRISPR gRNA sequence
ttgggatgtcatcttcctgg

SEQ ID NO: 300954 - DNA, 20 bp, Artificial
  CRISPR gRNA sequence
ggatgtcatcttcctggaag

SEQ ID NO: 300955 - DNA, 20 bp, Artificial
  CRISPR gRNA sequence
atgtcatcttcctggaagca

SEQ ID NO: 300956 - DNA, 20 bp, Artificial
  CRISPR gRNA sequence
catcttcctggaagcagagc

SEQ ID NO: 300957 - DNA, 20 bp, Artificial
  CRISPR gRNA sequence
atcttcctggaagcagagct

SEQ ID NO: 300958 - DNA, 20 bp, Artificial
  CRISPR gRNA sequence
tcttcctggaagcagagctg

SEQ ID NO: 300959 - DNA, 20 bp, Artificial
  CRISPR gRNA sequence
ttcctggaagcagagctggg

SEQ ID NO: 300960 - DNA, 20 bp, Artificial
  CRISPR gRNA sequence
tcctggaagcagagctgggg

SEQ ID NO: 300961 - DNA, 20 bp, Artificial
  CRISPR gRNA sequence
cctggaagcagagctgggga

SEQ ID NO: 300962 - DNA, 20 bp, Artificial
  CRISPR gRNA sequence
tggaagcagagctggggagg

SEQ ID NO: 300963 - DNA, 20 bp, Artificial
  CRISPR gRNA sequence
gaagcagagctggggaggga

SEQ ID NO: 300964 - DNA, 20 bp, Artificial
  CRISPR gRNA sequence
gagagccatcaccttgataa

SEQ ID NO: 300965 - DNA, 20 bp, Artificial
  CRISPR gRNA sequence
agagccatcaccttgataat

SEQ ID NO: 300966 - DNA, 20 bp, Artificial
  CRISPR gRNA sequence
caccttgataatgggatgaa

SEQ ID NO: 300967 - DNA, 20 bp, Artificial
  CRISPR gRNA sequence
cttgataatgggatgaatgg

SEQ ID NO: 300968 - DNA, 20 bp, Artificial
  CRISPR gRNA sequence
ttgataatgggatgaatgga

SEQ ID NO: 300969 - DNA, 20 bp, Artificial
  CRISPR gRNA sequence
gataatgggatgaatggaag

SEQ ID NO: 300970 - DNA, 20 bp, Artificial
  CRISPR gRNA sequence
ataatgggatgaatggaagg

SEQ ID NO: 300971 - DNA, 20 bp, Artificial
  CRISPR gRNA sequence
gggatgaatggaaggaggct

SEQ ID NO: 300972 - DNA, 20 bp, Artificial
  CRISPR gRNA sequence
ggatgaatggaaggaggctt

SEQ ID NO: 300973 - DNA, 20 bp, Artificial
  CRISPR gRNA sequence
ggcttaggactttccactcc

SEQ ID NO: 300974 - DNA, 20 bp, Artificial
  CRISPR gRNA sequence
aggactttccactcctggct

SEQ ID NO: 300975 - DNA, 20 bp, Artificial
  CRISPR gRNA sequence
gactttccactcctggctga

SEQ ID NO: 300976 - DNA, 20 bp, Artificial
  CRISPR gRNA sequence
ctttccactcctggctgaga

SEQ ID NO: 300977 - DNA, 20 bp, Artificial
  CRISPR gRNA sequence
tttccactcctggctgagag

SEQ ID NO: 300978 - DNA, 20 bp, Artificial
  CRISPR gRNA sequence
ccactcctggctgagagagg

SEQ ID NO: 300979 - DNA, 20 bp, Artificial
  CRISPR gRNA sequence
actcctggctgagagaggaa

SEQ ID NO: 300980 - DNA, 20 bp, Artificial
  CRISPR gRNA sequence
tgagagaggaagagctgcaa

SEQ ID NO: 300981 - DNA, 20 bp, Artificial
  CRISPR gRNA sequence
aggaagagctgcaacggaat

SEQ ID NO: 300982 - DNA, 20 bp, Artificial
  CRISPR gRNA sequence
ggaagagctgcaacggaatt

SEQ ID NO: 300983 - DNA, 20 bp, Artificial
  CRISPR gRNA sequence
agagctgcaacggaattagg

SEQ ID NO: 300984 - DNA, 20 bp, Artificial
  CRISPR gRNA sequence
gcaacggaattaggaagacc

SEQ ID NO: 300985 - DNA, 20 bp, Artificial
  CRISPR gRNA sequence
gaattaggaagaccaagaca

SEQ ID NO: 300986 - DNA, 20 bp, Artificial
  CRISPR gRNA sequence
agaccaagacacagatcacc

SEQ ID NO: 300987 - DNA, 20 bp, Artificial
  CRISPR gRNA sequence
gaccaagacacagatcaccc

SEQ ID NO: 300988 - DNA, 20 bp, Artificial
  CRISPR gRNA sequence
accaagacacagatcacccg

SEQ ID NO: 300989 - DNA, 20 bp, Artificial
  CRISPR gRNA sequence
cagatcacccggggcttact

SEQ ID NO: 300990 - DNA, 20 bp, Artificial
  CRISPR gRNA sequence
cccggggcttacttagccta

SEQ ID NO: 300991 - DNA, 20 bp, Artificial
  CRISPR gRNA sequence
cttagcctacagatgtccta

SEQ ID NO: 300992 - DNA, 20 bp, Artificial
  CRISPR gRNA sequence
ttagcctacagatgtcctac

SEQ ID NO: 300993 - DNA, 20 bp, Artificial
  CRISPR gRNA sequence
acagatgtcctacgggaacg

SEQ ID NO: 300994 - DNA, 20 bp, Artificial
  CRISPR gRNA sequence
cagatgtcctacgggaacgt

SEQ ID NO: 300995 - DNA, 20 bp, Artificial
  CRISPR gRNA sequence
tgtcctacgggaacgtgggc

SEQ ID NO: 300996 - DNA, 20 bp, Artificial
  CRISPR gRNA sequence
tacgggaacgtgggctggcc

SEQ ID NO: 300997 - DNA, 20 bp, Artificial
  CRISPR gRNA sequence
gaacgtgggctggcccagca

SEQ ID NO: 300998 - DNA, 20 bp, Artificial
  CRISPR gRNA sequence
aacgtgggctggcccagcat

SEQ ID NO: 300999 - DNA, 20 bp, Artificial
  CRISPR gRNA sequence
acgtgggctggcccagcata

SEQ ID NO: 301000 - DNA, 20 bp, Artificial
  CRISPR gRNA sequence
gggctggcccagcatagggc

SEQ ID NO: 301001 - DNA, 20 bp, Artificial
  CRISPR gRNA sequence
agcatagggctagcaaattt

SEQ ID NO: 301002 - DNA, 20 bp, Artificial
  CRISPR gRNA sequence
tagggctagcaaatttgagt

SEQ ID NO: 301003 - DNA, 20 bp, Artificial
  CRISPR gRNA sequence
ttggatgattgtttttgctc

SEQ ID NO: 301004 - DNA, 20 bp, Artificial
  CRISPR gRNA sequence
tggatgattgtttttgctca

SEQ ID NO: 301005 - DNA, 20 bp, Artificial
  CRISPR gRNA sequence
ttgtttttgctcaaggcaac

SEQ ID NO: 301006 - DNA, 20 bp, Artificial
  CRISPR gRNA sequence
gtttttgctcaaggcaacca

SEQ ID NO: 301007 - DNA, 20 bp, Artificial
  CRISPR gRNA sequence
tttttgctcaaggcaaccag

SEQ ID NO: 301008 - DNA, 20 bp, Artificial
  CRISPR gRNA sequence
aaccagaggaaacttgcata

SEQ ID NO: 301009 - DNA, 20 bp, Artificial
  CRISPR gRNA sequence
ccagaggaaacttgcataca

SEQ ID NO: 301010 - DNA, 20 bp, Artificial
  CRISPR gRNA sequence
aggaaacttgcatacagaga

SEQ ID NO: 301011 - DNA, 20 bp, Artificial
  CRISPR gRNA sequence
gcatacagagacagatatac

SEQ ID NO: 301012 - DNA, 20 bp, Artificial
  CRISPR gRNA sequence
catacagagacagatatact

SEQ ID NO: 301013 - DNA, 20 bp, Artificial
  CRISPR gRNA sequence
tacagagacagatatactgg

SEQ ID NO: 301014 - DNA, 20 bp, Artificial
  CRISPR gRNA sequence
gagaaatgactttgaaaacc

SEQ ID NO: 301015 - DNA, 20 bp, Artificial
  CRISPR gRNA sequence
gactttgaaaacctggctct

SEQ ID NO: 301016 - DNA, 20 bp, Artificial
  CRISPR gRNA sequence
actttgaaaacctggctcta

SEQ ID NO: 301017 - DNA, 20 bp, Artificial
  CRISPR gRNA sequence
ttgaaaacctggctctaagg

SEQ ID NO: 301018 - DNA, 20 bp, Artificial
  CRISPR gRNA sequence
tgaaaacctggctctaaggt

SEQ ID NO: 301019 - DNA, 20 bp, Artificial
  CRISPR gRNA sequence
ggctctaaggtgggatcact

SEQ ID NO: 301020 - DNA, 20 bp, Artificial
  CRISPR gRNA sequence
gctctaaggtgggatcacta

SEQ ID NO: 301021 - DNA, 20 bp, Artificial
  CRISPR gRNA sequence
ctctaaggtgggatcactaa

SEQ ID NO: 301022 - DNA, 20 bp, Artificial
  CRISPR gRNA sequence
aaggtgggatcactaaggga

SEQ ID NO: 301023 - DNA, 20 bp, Artificial
  CRISPR gRNA sequence
aggtgggatcactaagggat

SEQ ID NO: 301024 - DNA, 20 bp, Artificial
  CRISPR gRNA sequence
ggtgggatcactaagggatg

SEQ ID NO: 301025 - DNA, 20 bp, Artificial
  CRISPR gRNA sequence
gggatcactaagggatgggg

SEQ ID NO: 301026 - DNA, 20 bp, Artificial
  CRISPR gRNA sequence
gcagtctctgcccaaacata

SEQ ID NO: 301027 - DNA, 20 bp, Artificial
  CRISPR gRNA sequence
agtctctgcccaaacataaa

SEQ ID NO: 301028 - DNA, 20 bp, Artificial
  CRISPR gRNA sequence
cccaaacataaagagaactc

SEQ ID NO: 301029 - DNA, 20 bp, Artificial
  CRISPR gRNA sequence
ccaaacataaagagaactct

SEQ ID NO: 301030 - DNA, 20 bp, Artificial
  CRISPR gRNA sequence
caaacataaagagaactctg

SEQ ID NO: 301031 - DNA, 20 bp, Artificial
  CRISPR gRNA sequence
aacataaagagaactctggg

SEQ ID NO: 301032 - DNA, 20 bp, Artificial
  CRISPR gRNA sequence
aagagaactctggggagcct

SEQ ID NO: 301033 - DNA, 20 bp, Artificial
  CRISPR gRNA sequence
tttattttatgtaaaccctc

SEQ ID NO: 301034 - DNA, 20 bp, Artificial
  CRISPR gRNA sequence
ttattttatgtaaaccctca

SEQ ID NO: 301035 - DNA, 20 bp, Artificial
  CRISPR gRNA sequence
tattttatgtaaaccctcaa

SEQ ID NO: 301036 - DNA, 20 bp, Artificial
  CRISPR gRNA sequence
atgtaaaccctcaagggtta

SEQ ID NO: 301037 - DNA, 20 bp, Artificial
  CRISPR gRNA sequence
agggttatagactgccatgc

SEQ ID NO: 301038 - DNA, 20 bp, Artificial
  CRISPR gRNA sequence
tatagactgccatgctagac

SEQ ID NO: 301039 - DNA, 20 bp, Artificial
  CRISPR gRNA sequence
taccctgcccctgccttgat

SEQ ID NO: 301040 - DNA, 20 bp, Artificial
  CRISPR gRNA sequence
ccctgccttgattagactcc

SEQ ID NO: 301041 - DNA, 20 bp, Artificial
  CRISPR gRNA sequence
ttgattagactcctagcacc

SEQ ID NO: 301042 - DNA, 20 bp, Artificial
  CRISPR gRNA sequence
ttagactcctagcacctggc

SEQ ID NO: 301043 - DNA, 20 bp, Artificial
  CRISPR gRNA sequence
agtttctaacatgttttgtg

SEQ ID NO: 301044 - DNA, 20 bp, Artificial
  CRISPR gRNA sequence
ctaacatgttttgtgcagca

SEQ ID NO: 301045 - DNA, 20 bp, Artificial
  CRISPR gRNA sequence
tgcttgttacattcatttaa

SEQ ID NO: 301046 - DNA, 20 bp, Artificial
  CRISPR gRNA sequence
aaagtctacattttctgctt

SEQ ID NO: 301047 - DNA, 20 bp, Artificial
  CRISPR gRNA sequence
acattttctgctttggcttc

SEQ ID NO: 301048 - DNA, 20 bp, Artificial
  CRISPR gRNA sequence
attttctgctttggcttcaa

SEQ ID NO: 301049 - DNA, 20 bp, Artificial
  CRISPR gRNA sequence
agagtactactcaacccttg

SEQ ID NO: 301050 - DNA, 20 bp, Artificial
  CRISPR gRNA sequence
aaagagaaaggaagtacatt

SEQ ID NO: 301051 - DNA, 20 bp, Artificial
  CRISPR gRNA sequence
agagaaaggaagtacattca

SEQ ID NO: 301052 - DNA, 20 bp, Artificial
  CRISPR gRNA sequence
gagaaaggaagtacattcag

SEQ ID NO: 301053 - DNA, 20 bp, Artificial
  CRISPR gRNA sequence
aaggaagtacattcagagga

SEQ ID NO: 301054 - DNA, 20 bp, Artificial
  CRISPR gRNA sequence
ggaagtacattcagaggaca

SEQ ID NO: 301055 - DNA, 20 bp, Artificial
  CRISPR gRNA sequence
agtacattcagaggacagag

SEQ ID NO: 301056 - DNA, 20 bp, Artificial
  CRISPR gRNA sequence
gtacattcagaggacagagc

SEQ ID NO: 301057 - DNA, 20 bp, Artificial
  CRISPR gRNA sequence
tacattcagaggacagagca

SEQ ID NO: 301058 - DNA, 20 bp, Artificial
  CRISPR gRNA sequence
gaggacagagcagggaacat

SEQ ID NO: 301059 - DNA, 20 bp, Artificial
  CRISPR gRNA sequence
agcagggaacatcagaccac

SEQ ID NO: 301060 - DNA, 20 bp, Artificial
  CRISPR gRNA sequence
gcagggaacatcagaccaca

SEQ ID NO: 301061 - DNA, 20 bp, Artificial
  CRISPR gRNA sequence
cagggaacatcagaccacaa

SEQ ID NO: 301062 - DNA, 20 bp, Artificial
  CRISPR gRNA sequence
aacatcagaccacaagggtt

SEQ ID NO: 301063 - DNA, 20 bp, Artificial
  CRISPR gRNA sequence
atcagaccacaagggttgag

SEQ ID NO: 301064 - DNA, 20 bp, Artificial
  CRISPR gRNA sequence
agggttgagtagtactcttg

SEQ ID NO: 301065 - DNA, 20 bp, Artificial
  CRISPR gRNA sequence
gagtagtactcttgaagcca

SEQ ID NO: 301066 - DNA, 20 bp, Artificial
  CRISPR gRNA sequence
tagtactcttgaagccaaag

SEQ ID NO: 301067 - DNA, 20 bp, Artificial
  CRISPR gRNA sequence
tgaagccaaagcagaaaatg

SEQ ID NO: 301068 - DNA, 20 bp, Artificial
  CRISPR gRNA sequence
gacttttaaatgaatgtaac

SEQ ID NO: 301069 - DNA, 20 bp, Artificial
  CRISPR gRNA sequence
ctgtgctgcacaaaacatgt

SEQ ID NO: 301070 - DNA, 20 bp, Artificial
  CRISPR gRNA sequence
gcacaaaacatgttagaaac

SEQ ID NO: 301071 - DNA, 20 bp, Artificial
  CRISPR gRNA sequence
aaaacatgttagaaactagc

SEQ ID NO: 301072 - DNA, 20 bp, Artificial
  CRISPR gRNA sequence
aaacatgttagaaactagcc

SEQ ID NO: 301073 - DNA, 20 bp, Artificial
  CRISPR gRNA sequence
gttagaaactagccaggtgc

SEQ ID NO: 301074 - DNA, 20 bp, Artificial
  CRISPR gRNA sequence
ttagaaactagccaggtgct

SEQ ID NO: 301075 - DNA, 20 bp, Artificial
  CRISPR gRNA sequence
agaaactagccaggtgctag

SEQ ID NO: 301076 - DNA, 20 bp, Artificial
  CRISPR gRNA sequence
caggtgctaggagtctaatc

SEQ ID NO: 301077 - DNA, 20 bp, Artificial
  CRISPR gRNA sequence
aggtgctaggagtctaatca

SEQ ID NO: 301078 - DNA, 20 bp, Artificial
  CRISPR gRNA sequence
tgctaggagtctaatcaagg

SEQ ID NO: 301079 - DNA, 20 bp, Artificial
  CRISPR gRNA sequence
gctaggagtctaatcaaggc

SEQ ID NO: 301080 - DNA, 20 bp, Artificial
  CRISPR gRNA sequence
ctaggagtctaatcaaggca

SEQ ID NO: 301081 - DNA, 20 bp, Artificial
  CRISPR gRNA sequence
taggagtctaatcaaggcag

SEQ ID NO: 301082 - DNA, 20 bp, Artificial
  CRISPR gRNA sequence
gagtctaatcaaggcagggg

SEQ ID NO: 301083 - DNA, 20 bp, Artificial
  CRISPR gRNA sequence
agtctaatcaaggcaggggc

SEQ ID NO: 301084 - DNA, 20 bp, Artificial
  CRISPR gRNA sequence
gtctaatcaaggcaggggca

SEQ ID NO: 301085 - DNA, 20 bp, Artificial
  CRISPR gRNA sequence
gcaggggcagggtaaaaaca

SEQ ID NO: 301086 - DNA, 20 bp, Artificial
  CRISPR gRNA sequence
caggggcagggtaaaaacat

SEQ ID NO: 301087 - DNA, 20 bp, Artificial
  CRISPR gRNA sequence
aaaaacatgggaatattaca

SEQ ID NO: 301088 - DNA, 20 bp, Artificial
  CRISPR gRNA sequence
catgggaatattacatggac

SEQ ID NO: 301089 - DNA, 20 bp, Artificial
  CRISPR gRNA sequence
attacatggacaagcttgtc

SEQ ID NO: 301090 - DNA, 20 bp, Artificial
  CRISPR gRNA sequence
atggacaagcttgtctagca

SEQ ID NO: 301091 - DNA, 20 bp, Artificial
  CRISPR gRNA sequence
gacaagcttgtctagcatgg

SEQ ID NO: 301092 - DNA, 20 bp, Artificial
  CRISPR gRNA sequence
catggcagtctataaccctt

SEQ ID NO: 301093 - DNA, 20 bp, Artificial
  CRISPR gRNA sequence
atggcagtctataacccttg

SEQ ID NO: 301094 - DNA, 20 bp, Artificial
  CRISPR gRNA sequence
tggcagtctataacccttga

SEQ ID NO: 301095 - DNA, 20 bp, Artificial
  CRISPR gRNA sequence
ttgagggtttacataaaata

SEQ ID NO: 301096 - DNA, 20 bp, Artificial
  CRISPR gRNA sequence
tgagggtttacataaaataa

SEQ ID NO: 301097 - DNA, 20 bp, Artificial
  CRISPR gRNA sequence
aaaataaaggaacatttttg

SEQ ID NO: 301098 - DNA, 20 bp, Artificial
  CRISPR gRNA sequence
aaaggaacatttttgtggct

SEQ ID NO: 301099 - DNA, 20 bp, Artificial
  CRISPR gRNA sequence
aaggaacatttttgtggctc

SEQ ID NO: 301100 - DNA, 20 bp, Artificial
  CRISPR gRNA sequence
tttttgtggctcaggctccc

SEQ ID NO: 301101 - DNA, 20 bp, Artificial
  CRISPR gRNA sequence
tttgtggctcaggctcccca

SEQ ID NO: 301102 - DNA, 20 bp, Artificial
  CRISPR gRNA sequence
cccagagttctctttatgtt

SEQ ID NO: 301103 - DNA, 20 bp, Artificial
  CRISPR gRNA sequence
ccagagttctctttatgttt

SEQ ID NO: 301104 - DNA, 20 bp, Artificial
  CRISPR gRNA sequence
gagttctctttatgtttggg

SEQ ID NO: 301105 - DNA, 20 bp, Artificial
  CRISPR gRNA sequence
gttctctttatgtttgggca

SEQ ID NO: 301106 - DNA, 20 bp, Artificial
  CRISPR gRNA sequence
gcagagactgccccatccct

SEQ ID NO: 301107 - DNA, 20 bp, Artificial
  CRISPR gRNA sequence
atcccttagtgatcccacct

SEQ ID NO: 301108 - DNA, 20 bp, Artificial
  CRISPR gRNA sequence
cccttagtgatcccacctta

SEQ ID NO: 301109 - DNA, 20 bp, Artificial
  CRISPR gRNA sequence
tagtgatcccaccttagagc

SEQ ID NO: 301110 - DNA, 20 bp, Artificial
  CRISPR gRNA sequence
agtgatcccaccttagagcc

SEQ ID NO: 301111 - DNA, 20 bp, Artificial
  CRISPR gRNA sequence
accttagagccaggttttca

SEQ ID NO: 301112 - DNA, 20 bp, Artificial
  CRISPR gRNA sequence
gttttcaaagtcatttctcc

SEQ ID NO: 301113 - DNA, 20 bp, Artificial
  CRISPR gRNA sequence
gtatatctgtctctgtatgc

SEQ ID NO: 301114 - DNA, 20 bp, Artificial
  CRISPR gRNA sequence
ctctgtatgcaagtttcctc

SEQ ID NO: 301115 - DNA, 20 bp, Artificial
  CRISPR gRNA sequence
aagtttcctctggttgcctt

SEQ ID NO: 301116 - DNA, 20 bp, Artificial
  CRISPR gRNA sequence
atcatccaactcaaatttgc

SEQ ID NO: 301117 - DNA, 20 bp, Artificial
  CRISPR gRNA sequence
caaatttgctagccctatgc

SEQ ID NO: 301118 - DNA, 20 bp, Artificial
  CRISPR gRNA sequence
aaatttgctagccctatgct

SEQ ID NO: 301119 - DNA, 20 bp, Artificial
  CRISPR gRNA sequence
ttgctagccctatgctgggc

SEQ ID NO: 301120 - DNA, 20 bp, Artificial
  CRISPR gRNA sequence
tgggccagcccacgttcccg

SEQ ID NO: 301121 - DNA, 20 bp, Artificial
  CRISPR gRNA sequence
gggccagcccacgttcccgt

SEQ ID NO: 301122 - DNA, 20 bp, Artificial
  CRISPR gRNA sequence
acgttcccgtaggacatctg

SEQ ID NO: 301123 - DNA, 20 bp, Artificial
  CRISPR gRNA sequence
cgttcccgtaggacatctgt

SEQ ID NO: 301124 - DNA, 20 bp, Artificial
  CRISPR gRNA sequence
ccgtaggacatctgtaggct

SEQ ID NO: 301125 - DNA, 20 bp, Artificial
  CRISPR gRNA sequence
aggacatctgtaggctaagt

SEQ ID NO: 301126 - DNA, 20 bp, Artificial
  CRISPR gRNA sequence
tctgtaggctaagtaagccc

SEQ ID NO: 301127 - DNA, 20 bp, Artificial
  CRISPR gRNA sequence
ctgtaggctaagtaagcccc

SEQ ID NO: 301128 - DNA, 20 bp, Artificial
  CRISPR gRNA sequence
gccccgggtgatctgtgtct

SEQ ID NO: 301129 - DNA, 20 bp, Artificial
  CRISPR gRNA sequence
tggtcttcctaattccgttg

SEQ ID NO: 301130 - DNA, 20 bp, Artificial
  CRISPR gRNA sequence
cgttgcagctcttcctctct

SEQ ID NO: 301131 - DNA, 20 bp, Artificial
  CRISPR gRNA sequence
gcagctcttcctctctcagc

SEQ ID NO: 301132 - DNA, 20 bp, Artificial
  CRISPR gRNA sequence
cagctcttcctctctcagcc

SEQ ID NO: 301133 - DNA, 20 bp, Artificial
  CRISPR gRNA sequence
gctcttcctctctcagccag

SEQ ID NO: 301134 - DNA, 20 bp, Artificial
  CRISPR gRNA sequence
cttcctctctcagccaggag

SEQ ID NO: 301135 - DNA, 20 bp, Artificial
  CRISPR gRNA sequence
ctctctcagccaggagtgga

SEQ ID NO: 301136 - DNA, 20 bp, Artificial
  CRISPR gRNA sequence
agccaggagtggaaagtcct

SEQ ID NO: 301137 - DNA, 20 bp, Artificial
  CRISPR gRNA sequence
cttccattcatcccattatc

SEQ ID NO: 301138 - DNA, 20 bp, Artificial
  CRISPR gRNA sequence
ttccattcatcccattatca

SEQ ID NO: 301139 - DNA, 20 bp, Artificial
  CRISPR gRNA sequence
tcatcccattatcaaggtga

SEQ ID NO: 301140 - DNA, 20 bp, Artificial
  CRISPR gRNA sequence
aggtgatggctctccctccc

SEQ ID NO: 301141 - DNA, 20 bp, Artificial
  CRISPR gRNA sequence
tccctccccagctctgcttc

SEQ ID NO: 301142 - DNA, 20 bp, Artificial
  CRISPR gRNA sequence
ccctccccagctctgcttcc

SEQ ID NO: 301143 - DNA, 20 bp, Artificial
  CRISPR gRNA sequence
tccccagctctgcttccagg

SEQ ID NO: 301144 - DNA, 20 bp, Artificial
  CRISPR gRNA sequence
aagatgacatcccaataact

SEQ ID NO: 301145 - DNA, 20 bp, Artificial
  CRISPR gRNA sequence
agatgacatcccaataactt

SEQ ID NO: 301146 - DNA, 20 bp, Artificial
  CRISPR gRNA sequence
caaaacccctccctgaccac

SEQ ID NO: 301147 - DNA, 20 bp, Artificial
  CRISPR gRNA sequence
aaaacccctccctgaccacc

SEQ ID NO: 301148 - DNA, 20 bp, Artificial
  CRISPR gRNA sequence
aaacccctccctgaccacca

SEQ ID NO: 301149 - DNA, 20 bp, Artificial
  CRISPR gRNA sequence
ctgtctgtcttatgtccatt

SEQ ID NO: 301150 - DNA, 20 bp, Artificial
  CRISPR gRNA sequence
ctgtcttatgtccatttgga

SEQ ID NO: 301151 - DNA, 20 bp, Artificial
  CRISPR gRNA sequence
atccatctgttgcttgtttc

SEQ ID NO: 301152 - DNA, 20 bp, Artificial
  CRISPR gRNA sequence
cttgtttcaagacttgttga

SEQ ID NO: 301153 - DNA, 20 bp, Artificial
  CRISPR gRNA sequence
ttgtttcaagacttgttgat

SEQ ID NO: 301154 - DNA, 20 bp, Artificial
  CRISPR gRNA sequence
tgtttcaagacttgttgatg

SEQ ID NO: 301155 - DNA, 20 bp, Artificial
  CRISPR gRNA sequence
ttcaagacttgttgatgggg

SEQ ID NO: 301156 - DNA, 20 bp, Artificial
  CRISPR gRNA sequence
agacttgttgatggggtgga

SEQ ID NO: 301157 - DNA, 20 bp, Artificial
  CRISPR gRNA sequence
tgttgatggggtggacagac

SEQ ID NO: 301158 - DNA, 20 bp, Artificial
  CRISPR gRNA sequence
agacatttcatgtatttctg

SEQ ID NO: 301159 - DNA, 20 bp, Artificial
  CRISPR gRNA sequence
ttcatgtatttctgtggatc

SEQ ID NO: 301160 - DNA, 20 bp, Artificial
  CRISPR gRNA sequence
tttctctctctctctctttt

SEQ ID NO: 301161 - DNA, 20 bp, Artificial
  CRISPR gRNA sequence
ttgagtattgtgatctcttt

SEQ ID NO: 301162 - DNA, 20 bp, Artificial
  CRISPR gRNA sequence
gatctcttttggttctttca

SEQ ID NO: 301163 - DNA, 20 bp, Artificial
  CRISPR gRNA sequence
tggttctttcacagcttccc

SEQ ID NO: 301164 - DNA, 20 bp, Artificial
  CRISPR gRNA sequence
ggttctttcacagcttcccc

SEQ ID NO: 301165 - DNA, 20 bp, Artificial
  CRISPR gRNA sequence
gcttccccaggccatctcac

SEQ ID NO: 301166 - DNA, 20 bp, Artificial
  CRISPR gRNA sequence
ccccaggccatctcactagt

SEQ ID NO: 301167 - DNA, 20 bp, Artificial
  CRISPR gRNA sequence
atctcactagtcagttcttc

SEQ ID NO: 301168 - DNA, 20 bp, Artificial
  CRISPR gRNA sequence
ctcactagtcagttcttcaa

SEQ ID NO: 301169 - DNA, 20 bp, Artificial
  CRISPR gRNA sequence
agtcagttcttcaagagaaa

SEQ ID NO: 301170 - DNA, 20 bp, Artificial
  CRISPR gRNA sequence
gtcagttcttcaagagaaac

SEQ ID NO: 301171 - DNA, 20 bp, Artificial
  CRISPR gRNA sequence
tcagttcttcaagagaaaca

SEQ ID NO: 301172 - DNA, 20 bp, Artificial
  CRISPR gRNA sequence
tcaagagaaacagggttcac

SEQ ID NO: 301173 - DNA, 20 bp, Artificial
  CRISPR gRNA sequence
gaaacagggttcacaagctc

SEQ ID NO: 301174 - DNA, 20 bp, Artificial
  CRISPR gRNA sequence
ctggcattttcctgtttatt

SEQ ID NO: 301175 - DNA, 20 bp, Artificial
  CRISPR gRNA sequence
ttattcagttctctccacta

SEQ ID NO: 301176 - DNA, 20 bp, Artificial
  CRISPR gRNA sequence
ttctctccactatggcttgt

SEQ ID NO: 301177 - DNA, 20 bp, Artificial
  CRISPR gRNA sequence
tctctccactatggcttgtt

SEQ ID NO: 301178 - DNA, 20 bp, Artificial
  CRISPR gRNA sequence
ctccactatggcttgttggg

SEQ ID NO: 301179 - DNA, 20 bp, Artificial
  CRISPR gRNA sequence
tccactatggcttgttgggt

SEQ ID NO: 301180 - DNA, 20 bp, Artificial
  CRISPR gRNA sequence
ccactatggcttgttgggtg

SEQ ID NO: 301181 - DNA, 20 bp, Artificial
  CRISPR gRNA sequence
tatggcttgttgggtggggc

SEQ ID NO: 301182 - DNA, 20 bp, Artificial
  CRISPR gRNA sequence
ggggcaagcctcctcaatat

SEQ ID NO: 301183 - DNA, 20 bp, Artificial
  CRISPR gRNA sequence
agcctcctcaatattagcaa

SEQ ID NO: 301184 - DNA, 20 bp, Artificial
  CRISPR gRNA sequence
cctcaatattagcaacagcc

SEQ ID NO: 301185 - DNA, 20 bp, Artificial
  CRISPR gRNA sequence
aatattagcaacagcccaga

SEQ ID NO: 301186 - DNA, 20 bp, Artificial
  CRISPR gRNA sequence
attagcaacagcccagatag

SEQ ID NO: 301187 - DNA, 20 bp, Artificial
  CRISPR gRNA sequence
agcaacagcccagatagaag

SEQ ID NO: 301188 - DNA, 20 bp, Artificial
  CRISPR gRNA sequence
agcccagatagaagtggctc

SEQ ID NO: 301189 - DNA, 20 bp, Artificial
  CRISPR gRNA sequence
gcccagatagaagtggctcc

SEQ ID NO: 301190 - DNA, 20 bp, Artificial
  CRISPR gRNA sequence
tctcctaatttccccaaatt

SEQ ID NO: 301191 - DNA, 20 bp, Artificial
  CRISPR gRNA sequence
ctcctaatttccccaaattt

SEQ ID NO: 301192 - DNA, 20 bp, Artificial
  CRISPR gRNA sequence
taatttccccaaatttaggt

SEQ ID NO: 301193 - DNA, 20 bp, Artificial
  CRISPR gRNA sequence
gctcattgttgcctgtaccc

SEQ ID NO: 301194 - DNA, 20 bp, Artificial
  CRISPR gRNA sequence
ctcattgttgcctgtaccct

SEQ ID NO: 301195 - DNA, 20 bp, Artificial
  CRISPR gRNA sequence
gttttccttactgaccctga

SEQ ID NO: 301196 - DNA, 20 bp, Artificial
  CRISPR gRNA sequence
tttccttactgaccctgaca

SEQ ID NO: 301197 - DNA, 20 bp, Artificial
  CRISPR gRNA sequence
ttccttactgaccctgacag

SEQ ID NO: 301198 - DNA, 20 bp, Artificial
  CRISPR gRNA sequence
tccttactgaccctgacaga

SEQ ID NO: 301199 - DNA, 20 bp, Artificial
  CRISPR gRNA sequence
actgaccctgacagagggat

SEQ ID NO: 301200 - DNA, 20 bp, Artificial
  CRISPR gRNA sequence
acagagggatgagaactcct

SEQ ID NO: 301201 - DNA, 20 bp, Artificial
  CRISPR gRNA sequence
gagggatgagaactccttag

SEQ ID NO: 301202 - DNA, 20 bp, Artificial
  CRISPR gRNA sequence
agggatgagaactccttagc

SEQ ID NO: 301203 - DNA, 20 bp, Artificial
  CRISPR gRNA sequence
gggatgagaactccttagca

SEQ ID NO: 301204 - DNA, 20 bp, Artificial
  CRISPR gRNA sequence
ggatgagaactccttagcag

SEQ ID NO: 301205 - DNA, 20 bp, Artificial
  CRISPR gRNA sequence
tgagaactccttagcagggg

SEQ ID NO: 301206 - DNA, 20 bp, Artificial
  CRISPR gRNA sequence
agcaggggtagacttttctc

SEQ ID NO: 301207 - DNA, 20 bp, Artificial
  CRISPR gRNA sequence
caggggtagacttttctcta

SEQ ID NO: 301208 - DNA, 20 bp, Artificial
  CRISPR gRNA sequence
gtagacttttctctagagca

SEQ ID NO: 301209 - DNA, 20 bp, Artificial
  CRISPR gRNA sequence
gcatagtaatcacactatta

SEQ ID NO: 301210 - DNA, 20 bp, Artificial
  CRISPR gRNA sequence
aatcacactattacagtaca

SEQ ID NO: 301211 - DNA, 20 bp, Artificial
  CRISPR gRNA sequence
tacatagatctctatgtttc

SEQ ID NO: 301212 - DNA, 20 bp, Artificial
  CRISPR gRNA sequence
tttcaagatattaacactat

SEQ ID NO: 301213 - DNA, 20 bp, Artificial
  CRISPR gRNA sequence
ttcaagatattaacactata

SEQ ID NO: 301214 - DNA, 20 bp, Artificial
  CRISPR gRNA sequence
ctataaggtcataaatacat

SEQ ID NO: 301215 - DNA, 20 bp, Artificial
  CRISPR gRNA sequence
ataaatacataagtcccacc

SEQ ID NO: 301216 - DNA, 20 bp, Artificial
  CRISPR gRNA sequence
acataagtcccacccagact

SEQ ID NO: 301217 - DNA, 20 bp, Artificial
  CRISPR gRNA sequence
cataagtcccacccagactg

SEQ ID NO: 301218 - DNA, 20 bp, Artificial
  CRISPR gRNA sequence
taagtcccacccagactgag

SEQ ID NO: 301219 - DNA, 20 bp, Artificial
  CRISPR gRNA sequence
aagtcccacccagactgagg

SEQ ID NO: 301220 - DNA, 20 bp, Artificial
  CRISPR gRNA sequence
tcccacccagactgaggagg

SEQ ID NO: 301221 - DNA, 20 bp, Artificial
  CRISPR gRNA sequence
agactgaggaggtagttgtt

SEQ ID NO: 301222 - DNA, 20 bp, Artificial
  CRISPR gRNA sequence
aggaggtagttgtttagtca

SEQ ID NO: 301223 - DNA, 20 bp, Artificial
  CRISPR gRNA sequence
ggaggtagttgtttagtcac

SEQ ID NO: 301224 - DNA, 20 bp, Artificial
  CRISPR gRNA sequence
tcacaggtacacacaaaatt

SEQ ID NO: 301225 - DNA, 20 bp, Artificial
  CRISPR gRNA sequence
caggtacacacaaaattcag

SEQ ID NO: 301226 - DNA, 20 bp, Artificial
  CRISPR gRNA sequence
aggtacacacaaaattcagt

SEQ ID NO: 301227 - DNA, 20 bp, Artificial
  CRISPR gRNA sequence
ggtacacacaaaattcagtg

SEQ ID NO: 301228 - DNA, 20 bp, Artificial
  CRISPR gRNA sequence
cacaaaattcagtggggcac

SEQ ID NO: 301229 - DNA, 20 bp, Artificial
  CRISPR gRNA sequence
aattcagtggggcaccagct

SEQ ID NO: 301230 - DNA, 20 bp, Artificial
  CRISPR gRNA sequence
ggggcaccagcttagaattc

SEQ ID NO: 301231 - DNA, 20 bp, Artificial
  CRISPR gRNA sequence
gggcaccagcttagaattct

SEQ ID NO: 301232 - DNA, 20 bp, Artificial
  CRISPR gRNA sequence
caccagcttagaattctggg

SEQ ID NO: 301233 - DNA, 20 bp, Artificial
  CRISPR gRNA sequence
ttagaattctgggcagataa

SEQ ID NO: 301234 - DNA, 20 bp, Artificial
  CRISPR gRNA sequence
tagaattctgggcagataaa

SEQ ID NO: 301235 - DNA, 20 bp, Artificial
  CRISPR gRNA sequence
aattctgggcagataaaagg

SEQ ID NO: 301236 - DNA, 20 bp, Artificial
  CRISPR gRNA sequence
gcagataaaaggcagttttc

SEQ ID NO: 301237 - DNA, 20 bp, Artificial
  CRISPR gRNA sequence
aaggcagttttccagaaatt

SEQ ID NO: 301238 - DNA, 20 bp, Artificial
  CRISPR gRNA sequence
ggcagttttccagaaattga

SEQ ID NO: 301239 - DNA, 20 bp, Artificial
  CRISPR gRNA sequence
gcagttttccagaaattgag

SEQ ID NO: 301240 - DNA, 20 bp, Artificial
  CRISPR gRNA sequence
aaaacacaatctatgaaatt

SEQ ID NO: 301241 - DNA, 20 bp, Artificial
  CRISPR gRNA sequence
aacacaatctatgaaattaa

SEQ ID NO: 301242 - DNA, 20 bp, Artificial
  CRISPR gRNA sequence
acaatctatgaaattaagag

SEQ ID NO: 301243 - DNA, 20 bp, Artificial
  CRISPR gRNA sequence
attaagagaagaatctgatc

SEQ ID NO: 301244 - DNA, 20 bp, Artificial
  CRISPR gRNA sequence
taagagaagaatctgatctg

SEQ ID NO: 301245 - DNA, 20 bp, Artificial
  CRISPR gRNA sequence
aagagaagaatctgatctgg

SEQ ID NO: 301246 - DNA, 20 bp, Artificial
  CRISPR gRNA sequence
gagaagaatctgatctggag

SEQ ID NO: 301247 - DNA, 20 bp, Artificial
  CRISPR gRNA sequence
agaagaatctgatctggagg

SEQ ID NO: 301248 - DNA, 20 bp, Artificial
  CRISPR gRNA sequence
atctgatctggaggaggtat

SEQ ID NO: 301249 - DNA, 20 bp, Artificial
  CRISPR gRNA sequence
ttggtcctaaattttatttc

SEQ ID NO: 301250 - DNA, 20 bp, Artificial
  CRISPR gRNA sequence
tggtcctaaattttatttcc

SEQ ID NO: 301251 - DNA, 20 bp, Artificial
  CRISPR gRNA sequence
aaattttatttccaggtcat

SEQ ID NO: 301252 - DNA, 20 bp, Artificial
  CRISPR gRNA sequence
tttccaggtcatgagccatt

SEQ ID NO: 301253 - DNA, 20 bp, Artificial
  CRISPR gRNA sequence
caggtcatgagccattaagc

SEQ ID NO: 301254 - DNA, 20 bp, Artificial
  CRISPR gRNA sequence
aggtcatgagccattaagct

SEQ ID NO: 301255 - DNA, 20 bp, Artificial
  CRISPR gRNA sequence
atgagccattaagctgggct

SEQ ID NO: 301256 - DNA, 20 bp, Artificial
  CRISPR gRNA sequence
ttaagctgggcttggcccat

SEQ ID NO: 301257 - DNA, 20 bp, Artificial
  CRISPR gRNA sequence
tggcccataagtgtgctctg

SEQ ID NO: 301258 - DNA, 20 bp, Artificial
  CRISPR gRNA sequence
taagtgtgctctgaagtgaa

SEQ ID NO: 301259 - DNA, 20 bp, Artificial
  CRISPR gRNA sequence
gtgtgctctgaagtgaaaag

SEQ ID NO: 301260 - DNA, 20 bp, Artificial
  CRISPR gRNA sequence
tgctctgaagtgaaaagaag

SEQ ID NO: 301261 - DNA, 20 bp, Artificial
  CRISPR gRNA sequence
ctgaagtgaaaagaagcagt

SEQ ID NO: 301262 - DNA, 20 bp, Artificial
  CRISPR gRNA sequence
gaagtgaaaagaagcagtaa

SEQ ID NO: 301263 - DNA, 20 bp, Artificial
  CRISPR gRNA sequence
aagaagcagtaagagaatta

SEQ ID NO: 301264 - DNA, 20 bp, Artificial
  CRISPR gRNA sequence
agagaattaaagtctcctct

SEQ ID NO: 301265 - DNA, 20 bp, Artificial
  CRISPR gRNA sequence
taaagtctcctcttggcata

SEQ ID NO: 301266 - DNA, 20 bp, Artificial
  CRISPR gRNA sequence
aagtctcctcttggcatacg

SEQ ID NO: 301267 - DNA, 20 bp, Artificial
  CRISPR gRNA sequence
tctcctcttggcatacggag

SEQ ID NO: 301268 - DNA, 20 bp, Artificial
  CRISPR gRNA sequence
tcctcttggcatacggagca

SEQ ID NO: 301269 - DNA, 20 bp, Artificial
  CRISPR gRNA sequence
cttggcatacggagcagagc

SEQ ID NO: 301270 - DNA, 20 bp, Artificial
  CRISPR gRNA sequence
tggcatacggagcagagctg

SEQ ID NO: 301271 - DNA, 20 bp, Artificial
  CRISPR gRNA sequence
acggagcagagctggagtta

SEQ ID NO: 301272 - DNA, 20 bp, Artificial
  CRISPR gRNA sequence
cggagcagagctggagttac

SEQ ID NO: 301273 - DNA, 20 bp, Artificial
  CRISPR gRNA sequence
ggagcagagctggagttaca

SEQ ID NO: 301274 - DNA, 20 bp, Artificial
  CRISPR gRNA sequence
agcagagctggagttacagg

SEQ ID NO: 301275 - DNA, 20 bp, Artificial
  CRISPR gRNA sequence
gcagagctggagttacaggg

SEQ ID NO: 301276 - DNA, 20 bp, Artificial
  CRISPR gRNA sequence
tacagggaggctattccact

SEQ ID NO: 301277 - DNA, 20 bp, Artificial
  CRISPR gRNA sequence
cagggaggctattccactta

SEQ ID NO: 301278 - DNA, 20 bp, Artificial
  CRISPR gRNA sequence
agggaggctattccacttag

SEQ ID NO: 301279 - DNA, 20 bp, Artificial
  CRISPR gRNA sequence
gggaggctattccacttaga

SEQ ID NO: 301280 - DNA, 20 bp, Artificial
  CRISPR gRNA sequence
gaggctattccacttagagg

SEQ ID NO: 301281 - DNA, 20 bp, Artificial
  CRISPR gRNA sequence
attccacttagagggagtcc

SEQ ID NO: 301282 - DNA, 20 bp, Artificial
  CRISPR gRNA sequence
tccacttagagggagtcctg

SEQ ID NO: 301283 - DNA, 20 bp, Artificial
  CRISPR gRNA sequence
tggagcccccttattactca

SEQ ID NO: 301284 - DNA, 20 bp, Artificial
  CRISPR gRNA sequence
ggtaatgtctttttgccttc

SEQ ID NO: 301285 - DNA, 20 bp, Artificial
  CRISPR gRNA sequence
aatgtctttttgccttctgg

SEQ ID NO: 301286 - DNA, 20 bp, Artificial
  CRISPR gRNA sequence
gccttctggaagaaatcaaa

SEQ ID NO: 301287 - DNA, 20 bp, Artificial
  CRISPR gRNA sequence
ccttctggaagaaatcaaaa

SEQ ID NO: 301288 - DNA, 20 bp, Artificial
  CRISPR gRNA sequence
aagaaatcaaaaaggttgcc

SEQ ID NO: 301289 - DNA, 20 bp, Artificial
  CRISPR gRNA sequence
agaaatcaaaaaggttgccc

SEQ ID NO: 301290 - DNA, 20 bp, Artificial
  CRISPR gRNA sequence
aggttgcccaggaacttaca

SEQ ID NO: 301291 - DNA, 20 bp, Artificial
  CRISPR gRNA sequence
ggttgcccaggaacttacaa

SEQ ID NO: 301292 - DNA, 20 bp, Artificial
  CRISPR gRNA sequence
gcccaggaacttacaaagga

SEQ ID NO: 301293 - DNA, 20 bp, Artificial
  CRISPR gRNA sequence
cccaggaacttacaaaggaa

SEQ ID NO: 301294 - DNA, 20 bp, Artificial
  CRISPR gRNA sequence
ccaggaacttacaaaggaaa

SEQ ID NO: 301295 - DNA, 20 bp, Artificial
  CRISPR gRNA sequence
ggaacttacaaaggaaaggg

SEQ ID NO: 301296 - DNA, 20 bp, Artificial
  CRISPR gRNA sequence
agaaaaaatgaatacttgta

SEQ ID NO: 301297 - DNA, 20 bp, Artificial
  CRISPR gRNA sequence
gaaaaaatgaatacttgtat

SEQ ID NO: 301298 - DNA, 20 bp, Artificial
  CRISPR gRNA sequence
tgtatcacttttgtcgcatg

SEQ ID NO: 301299 - DNA, 20 bp, Artificial
  CRISPR gRNA sequence
tcgaacttttaaaaacacgc

SEQ ID NO: 301300 - DNA, 20 bp, Artificial
  CRISPR gRNA sequence
cgaacttttaaaaacacgct

SEQ ID NO: 301301 - DNA, 20 bp, Artificial
  CRISPR gRNA sequence
aaaaacacgctgggcttcat

SEQ ID NO: 301302 - DNA, 20 bp, Artificial
  CRISPR gRNA sequence
ctgggcttcatcagatcttt

SEQ ID NO: 301303 - DNA, 20 bp, Artificial
  CRISPR gRNA sequence
tgggcttcatcagatctttc

SEQ ID NO: 301304 - DNA, 20 bp, Artificial
  CRISPR gRNA sequence
catcagatctttcaggtata

SEQ ID NO: 301305 - DNA, 20 bp, Artificial
  CRISPR gRNA sequence
aggtatatggattttttctc

SEQ ID NO: 301306 - DNA, 20 bp, Artificial
  CRISPR gRNA sequence
gtatatggattttttctctg

SEQ ID NO: 301307 - DNA, 20 bp, Artificial
  CRISPR gRNA sequence
ggattttttctctggagaaa

SEQ ID NO: 301308 - DNA, 20 bp, Artificial
  CRISPR gRNA sequence
ttttttctctggagaaatag

SEQ ID NO: 301309 - DNA, 20 bp, Artificial
  CRISPR gRNA sequence
tctctggagaaatagaagaa

SEQ ID NO: 301310 - DNA, 20 bp, Artificial
  CRISPR gRNA sequence
ggagaaatagaagaaaagat

SEQ ID NO: 301311 - DNA, 20 bp, Artificial
  CRISPR gRNA sequence
gagaaatagaagaaaagatt

SEQ ID NO: 301312 - DNA, 20 bp, Artificial
  CRISPR gRNA sequence
ttaggtgatatttcacattt

SEQ ID NO: 301313 - DNA, 20 bp, Artificial
  CRISPR gRNA sequence
tttgagctactttctttttc

SEQ ID NO: 301314 - DNA, 20 bp, Artificial
  CRISPR gRNA sequence
ctttttctagatttcaatga

SEQ ID NO: 301315 - DNA, 20 bp, Artificial
  CRISPR gRNA sequence
tttttctagatttcaatgat

SEQ ID NO: 301316 - DNA, 20 bp, Artificial
  CRISPR gRNA sequence
ttttctagatttcaatgata

SEQ ID NO: 301317 - DNA, 20 bp, Artificial
  CRISPR gRNA sequence
tctagatttcaatgataggg

SEQ ID NO: 301318 - DNA, 20 bp, Artificial
  CRISPR gRNA sequence
atttcaatgatagggcagaa

SEQ ID NO: 301319 - DNA, 20 bp, Artificial
  CRISPR gRNA sequence
ttcaatgatagggcagaata

SEQ ID NO: 301320 - DNA, 20 bp, Artificial
  CRISPR gRNA sequence
tcaatgatagggcagaatag

SEQ ID NO: 301321 - DNA, 20 bp, Artificial
  CRISPR gRNA sequence
ggcagaatagaggttgccat

SEQ ID NO: 301322 - DNA, 20 bp, Artificial
  CRISPR gRNA sequence
aatagaggttgccattggaa

SEQ ID NO: 301323 - DNA, 20 bp, Artificial
  CRISPR gRNA sequence
gttgccattggaacagcaat

SEQ ID NO: 301324 - DNA, 20 bp, Artificial
  CRISPR gRNA sequence
ttgccattggaacagcaatg

SEQ ID NO: 301325 - DNA, 20 bp, Artificial
  CRISPR gRNA sequence
gccattggaacagcaatgag

SEQ ID NO: 301326 - DNA, 20 bp, Artificial
  CRISPR gRNA sequence
tgaggagaaacaaactattg

SEQ ID NO: 301327 - DNA, 20 bp, Artificial
  CRISPR gRNA sequence
aggagaaacaaactattgaa

SEQ ID NO: 301328 - DNA, 20 bp, Artificial
  CRISPR gRNA sequence
gaaacaaactattgaagaga

SEQ ID NO: 301329 - DNA, 20 bp, Artificial
  CRISPR gRNA sequence
aaacaaactattgaagagaa

SEQ ID NO: 301330 - DNA, 20 bp, Artificial
  CRISPR gRNA sequence
caaactattgaagagaaagg

SEQ ID NO: 301331 - DNA, 20 bp, Artificial
  CRISPR gRNA sequence
aactattgaagagaaaggtg

SEQ ID NO: 301332 - DNA, 20 bp, Artificial
  CRISPR gRNA sequence
attgaagagaaaggtggaga

SEQ ID NO: 301333 - DNA, 20 bp, Artificial
  CRISPR gRNA sequence
aagagaaaggtggagaaagc

SEQ ID NO: 301334 - DNA, 20 bp, Artificial
  CRISPR gRNA sequence
gagaaaggtggagaaagcaa

SEQ ID NO: 301335 - DNA, 20 bp, Artificial
  CRISPR gRNA sequence
aggtggagaaagcaagagaa

SEQ ID NO: 301336 - DNA, 20 bp, Artificial
  CRISPR gRNA sequence
aaagcaagagaaaagaacca

SEQ ID NO: 301337 - DNA, 20 bp, Artificial
  CRISPR gRNA sequence
tacactgtcatctatgcttc

SEQ ID NO: 301338 - DNA, 20 bp, Artificial
  CRISPR gRNA sequence
cactgtcatctatgcttcaa

SEQ ID NO: 301339 - DNA, 20 bp, Artificial
  CRISPR gRNA sequence
agctaccctttatttctgcc

SEQ ID NO: 301340 - DNA, 20 bp, Artificial
  CRISPR gRNA sequence
gcccttcccatgccctctgc

SEQ ID NO: 301341 - DNA, 20 bp, Artificial
  CRISPR gRNA sequence
tctctgctgcctgccctctg

SEQ ID NO: 301342 - DNA, 20 bp, Artificial
  CRISPR gRNA sequence
ctctgctgcctgccctctgc

SEQ ID NO: 301343 - DNA, 20 bp, Artificial
  CRISPR gRNA sequence
ctgccctctgcaggctcttc

SEQ ID NO: 301344 - DNA, 20 bp, Artificial
  CRISPR gRNA sequence
tccagaccatttctgaaact

SEQ ID NO: 301345 - DNA, 20 bp, Artificial
  CRISPR gRNA sequence
atttctgaaactgagtgtga

SEQ ID NO: 301346 - DNA, 20 bp, Artificial
  CRISPR gRNA sequence
tttctgaaactgagtgtgac

SEQ ID NO: 301347 - DNA, 20 bp, Artificial
  CRISPR gRNA sequence
ttctgaaactgagtgtgaca

SEQ ID NO: 301348 - DNA, 20 bp, Artificial
  CRISPR gRNA sequence
tgaaactgagtgtgacaggg

SEQ ID NO: 301349 - DNA, 20 bp, Artificial
  CRISPR gRNA sequence
gaaactgagtgtgacagggt

SEQ ID NO: 301350 - DNA, 20 bp, Artificial
  CRISPR gRNA sequence
actgagtgtgacagggtagg

SEQ ID NO: 301351 - DNA, 20 bp, Artificial
  CRISPR gRNA sequence
ctgagtgtgacagggtaggc

SEQ ID NO: 301352 - DNA, 20 bp, Artificial
  CRISPR gRNA sequence
tgacagggtaggcaggattt

SEQ ID NO: 301353 - DNA, 20 bp, Artificial
  CRISPR gRNA sequence
agcaccctttctcattgtcc

SEQ ID NO: 301354 - DNA, 20 bp, Artificial
  CRISPR gRNA sequence
gcaccctttctcattgtcca

SEQ ID NO: 301355 - DNA, 20 bp, Artificial
  CRISPR gRNA sequence
caccctttctcattgtccaa

SEQ ID NO: 301356 - DNA, 20 bp, Artificial
  CRISPR gRNA sequence
tctcattgtccaagggtgcc

SEQ ID NO: 301357 - DNA, 20 bp, Artificial
  CRISPR gRNA sequence
ccaagggtgcccggaattat

SEQ ID NO: 301358 - DNA, 20 bp, Artificial
  CRISPR gRNA sequence
ggaattattagttttgttgc

SEQ ID NO: 301359 - DNA, 20 bp, Artificial
  CRISPR gRNA sequence
tagttttgttgctagaatca

SEQ ID NO: 301360 - DNA, 20 bp, Artificial
  CRISPR gRNA sequence
ttttgttgctagaatcacag

SEQ ID NO: 301361 - DNA, 20 bp, Artificial
  CRISPR gRNA sequence
gttgctagaatcacagtggc

SEQ ID NO: 301362 - DNA, 20 bp, Artificial
  CRISPR gRNA sequence
atcacagtggctggtatatc

SEQ ID NO: 301363 - DNA, 20 bp, Artificial
  CRISPR gRNA sequence
agtggctggtatatctggat

SEQ ID NO: 301364 - DNA, 20 bp, Artificial
  CRISPR gRNA sequence
tggtatatctggattagtgc

SEQ ID NO: 301365 - DNA, 20 bp, Artificial
  CRISPR gRNA sequence
ggtatatctggattagtgct

SEQ ID NO: 301366 - DNA, 20 bp, Artificial
  CRISPR gRNA sequence
ggattagtgctgggtactct

SEQ ID NO: 301367 - DNA, 20 bp, Artificial
  CRISPR gRNA sequence
tctcggttgtctctgcaccc

SEQ ID NO: 301368 - DNA, 20 bp, Artificial
  CRISPR gRNA sequence
ctcggttgtctctgcaccct

SEQ ID NO: 301369 - DNA, 20 bp, Artificial
  CRISPR gRNA sequence
tcggttgtctctgcaccctg

SEQ ID NO: 301370 - DNA, 20 bp, Artificial
  CRISPR gRNA sequence
cggttgtctctgcaccctgg

SEQ ID NO: 301371 - DNA, 20 bp, Artificial
  CRISPR gRNA sequence
tatgaccctatctctgaaac

SEQ ID NO: 301372 - DNA, 20 bp, Artificial
  CRISPR gRNA sequence
atgaccctatctctgaaacc

SEQ ID NO: 301373 - DNA, 20 bp, Artificial
  CRISPR gRNA sequence
ctgaaaccaggcttgtgact

SEQ ID NO: 301374 - DNA, 20 bp, Artificial
  CRISPR gRNA sequence
tgaaaccaggcttgtgactg

SEQ ID NO: 301375 - DNA, 20 bp, Artificial
  CRISPR gRNA sequence
gaaaccaggcttgtgactga

SEQ ID NO: 301376 - DNA, 20 bp, Artificial
  CRISPR gRNA sequence
tgagggttgctttgatccta

SEQ ID NO: 301377 - DNA, 20 bp, Artificial
  CRISPR gRNA sequence
gagggttgctttgatcctat

SEQ ID NO: 301378 - DNA, 20 bp, Artificial
  CRISPR gRNA sequence
gctttgatcctatgggtatg

SEQ ID NO: 301379 - DNA, 20 bp, Artificial
  CRISPR gRNA sequence
tgatcctatgggtatgcagt

SEQ ID NO: 301380 - DNA, 20 bp, Artificial
  CRISPR gRNA sequence
atcctatgggtatgcagtca

SEQ ID NO: 301381 - DNA, 20 bp, Artificial
  CRISPR gRNA sequence
gtcagagccttgatattcct

SEQ ID NO: 301382 - DNA, 20 bp, Artificial
  CRISPR gRNA sequence
cagagccttgatattcctga

SEQ ID NO: 301383 - DNA, 20 bp, Artificial
  CRISPR gRNA sequence
ttcctgagagcttaatttct

SEQ ID NO: 301384 - DNA, 20 bp, Artificial
  CRISPR gRNA sequence
tcctgagagcttaatttctc

SEQ ID NO: 301385 - DNA, 20 bp, Artificial
  CRISPR gRNA sequence
ctgagagcttaatttctcag

SEQ ID NO: 301386 - DNA, 20 bp, Artificial
  CRISPR gRNA sequence
tgagagcttaatttctcagg

SEQ ID NO: 301387 - DNA, 20 bp, Artificial
  CRISPR gRNA sequence
gagagcttaatttctcagga

SEQ ID NO: 301388 - DNA, 20 bp, Artificial
  CRISPR gRNA sequence
gcttaatttctcaggaggga

SEQ ID NO: 301389 - DNA, 20 bp, Artificial
  CRISPR gRNA sequence
ttaatttctcaggagggata

SEQ ID NO: 301390 - DNA, 20 bp, Artificial
  CRISPR gRNA sequence
taatttctcaggagggatag

SEQ ID NO: 301391 - DNA, 20 bp, Artificial
  CRISPR gRNA sequence
tctcaggagggatagaggta

SEQ ID NO: 301392 - DNA, 20 bp, Artificial
  CRISPR gRNA sequence
tagaggtacagactatctga

SEQ ID NO: 301393 - DNA, 20 bp, Artificial
  CRISPR gRNA sequence
ctgatagcttcacgttgtga

SEQ ID NO: 301394 - DNA, 20 bp, Artificial
  CRISPR gRNA sequence
tgatagcttcacgttgtgaa

SEQ ID NO: 301395 - DNA, 20 bp, Artificial
  CRISPR gRNA sequence
tcattctttcaacatttatt

SEQ ID NO: 301396 - DNA, 20 bp, Artificial
  CRISPR gRNA sequence
attgagaacctgctatatgc

SEQ ID NO: 301397 - DNA, 20 bp, Artificial
  CRISPR gRNA sequence
ttgagaacctgctatatgcc

SEQ ID NO: 301398 - DNA, 20 bp, Artificial
  CRISPR gRNA sequence
tatatgccaggcaccatgct

SEQ ID NO: 301399 - DNA, 20 bp, Artificial
  CRISPR gRNA sequence
ccaggcaccatgctaagtgc

SEQ ID NO: 301400 - DNA, 20 bp, Artificial
  CRISPR gRNA sequence
ggcaccatgctaagtgctag

SEQ ID NO: 301401 - DNA, 20 bp, Artificial
  CRISPR gRNA sequence
agtgctagcagcacaatgat

SEQ ID NO: 301402 - DNA, 20 bp, Artificial
  CRISPR gRNA sequence
agcacaatgatgagcttaac

SEQ ID NO: 301403 - DNA, 20 bp, Artificial
  CRISPR gRNA sequence
aatgatgagcttaactggta

SEQ ID NO: 301404 - DNA, 20 bp, Artificial
  CRISPR gRNA sequence
ggtatggtctctgctcttca

SEQ ID NO: 301405 - DNA, 20 bp, Artificial
  CRISPR gRNA sequence
gtatggtctctgctcttcat

SEQ ID NO: 301406 - DNA, 20 bp, Artificial
  CRISPR gRNA sequence
tctctgctcttcataggatt

SEQ ID NO: 301407 - DNA, 20 bp, Artificial
  CRISPR gRNA sequence
gctcttcataggatttagtt

SEQ ID NO: 301408 - DNA, 20 bp, Artificial
  CRISPR gRNA sequence
tcataggatttagttaagtc

SEQ ID NO: 301409 - DNA, 20 bp, Artificial
  CRISPR gRNA sequence
atttagttaagtctagttta

SEQ ID NO: 301410 - DNA, 20 bp, Artificial
  CRISPR gRNA sequence
ttagttaagtctagtttata

SEQ ID NO: 301411 - DNA, 20 bp, Artificial
  CRISPR gRNA sequence
tctagtttatagagtttaat

SEQ ID NO: 301412 - DNA, 20 bp, Artificial
  CRISPR gRNA sequence
agataattacacaaatatgt

SEQ ID NO: 301413 - DNA, 20 bp, Artificial
  CRISPR gRNA sequence
acaaatatgtaagcataatc

SEQ ID NO: 301414 - DNA, 20 bp, Artificial
  CRISPR gRNA sequence
aagcataatctggtgttatt

SEQ ID NO: 301415 - DNA, 20 bp, Artificial
  CRISPR gRNA sequence
aatctggtgttattaagaaa

SEQ ID NO: 301416 - DNA, 20 bp, Artificial
  CRISPR gRNA sequence
ggtgttattaagaaaaagcc

SEQ ID NO: 301417 - DNA, 20 bp, Artificial
  CRISPR gRNA sequence
gtgttattaagaaaaagcca

SEQ ID NO: 301418 - DNA, 20 bp, Artificial
  CRISPR gRNA sequence
tgttattaagaaaaagccaa

SEQ ID NO: 301419 - DNA, 20 bp, Artificial
  CRISPR gRNA sequence
gatccacatgacactgtaac

SEQ ID NO: 301420 - DNA, 20 bp, Artificial
  CRISPR gRNA sequence
tgtaacaagttgacattttc

SEQ ID NO: 301421 - DNA, 20 bp, Artificial
  CRISPR gRNA sequence
caagttgacattttctagtt

SEQ ID NO: 301422 - DNA, 20 bp, Artificial
  CRISPR gRNA sequence
aagttgacattttctagttt

SEQ ID NO: 301423 - DNA, 20 bp, Artificial
  CRISPR gRNA sequence
tgacattttctagtttggga

SEQ ID NO: 301424 - DNA, 20 bp, Artificial
  CRISPR gRNA sequence
gacattttctagtttgggaa

SEQ ID NO: 301425 - DNA, 20 bp, Artificial
  CRISPR gRNA sequence
acattttctagtttgggaaa

SEQ ID NO: 301426 - DNA, 20 bp, Artificial
  CRISPR gRNA sequence
tagtttgggaaagggttttt

SEQ ID NO: 301427 - DNA, 20 bp, Artificial
  CRISPR gRNA sequence
ttgggaaagggtttttaaga

SEQ ID NO: 301428 - DNA, 20 bp, Artificial
  CRISPR gRNA sequence
tttttaagaaagtgctgctt

SEQ ID NO: 301429 - DNA, 20 bp, Artificial
  CRISPR gRNA sequence
ttttaagaaagtgctgcttg

SEQ ID NO: 301430 - DNA, 20 bp, Artificial
  CRISPR gRNA sequence
aagaaagtgctgcttgaggc

SEQ ID NO: 301431 - DNA, 20 bp, Artificial
  CRISPR gRNA sequence
gctgcttgaggcaagatctg

SEQ ID NO: 301432 - DNA, 20 bp, Artificial
  CRISPR gRNA sequence
tgaggcaagatctgaagaat

SEQ ID NO: 301433 - DNA, 20 bp, Artificial
  CRISPR gRNA sequence
gaggcaagatctgaagaatg

SEQ ID NO: 301434 - DNA, 20 bp, Artificial
  CRISPR gRNA sequence
aagatctgaagaatgaggta

SEQ ID NO: 301435 - DNA, 20 bp, Artificial
  CRISPR gRNA sequence
atctgaagaatgaggtaaag

SEQ ID NO: 301436 - DNA, 20 bp, Artificial
  CRISPR gRNA sequence
tgaagaatgaggtaaagaag

SEQ ID NO: 301437 - DNA, 20 bp, Artificial
  CRISPR gRNA sequence
agaatgaggtaaagaagtgg

SEQ ID NO: 301438 - DNA, 20 bp, Artificial
  CRISPR gRNA sequence
atgaggtaaagaagtggcag

SEQ ID NO: 301439 - DNA, 20 bp, Artificial
  CRISPR gRNA sequence
gtggcagaagaacatctaaa

SEQ ID NO: 301440 - DNA, 20 bp, Artificial
  CRISPR gRNA sequence
tggcagaagaacatctaaac

SEQ ID NO: 301441 - DNA, 20 bp, Artificial
  CRISPR gRNA sequence
ggcagaagaacatctaaaca

SEQ ID NO: 301442 - DNA, 20 bp, Artificial
  CRISPR gRNA sequence
agaacatctaaacagggcca

SEQ ID NO: 301443 - DNA, 20 bp, Artificial
  CRISPR gRNA sequence
acagggccatagcaaatact

SEQ ID NO: 301444 - DNA, 20 bp, Artificial
  CRISPR gRNA sequence
atagcaaatactaagatgct

SEQ ID NO: 301445 - DNA, 20 bp, Artificial
  CRISPR gRNA sequence
tagcaaatactaagatgctc

SEQ ID NO: 301446 - DNA, 20 bp, Artificial
  CRISPR gRNA sequence
atactaagatgctcaggctg

SEQ ID NO: 301447 - DNA, 20 bp, Artificial
  CRISPR gRNA sequence
atttattcattccacacatg

SEQ ID NO: 301448 - DNA, 20 bp, Artificial
  CRISPR gRNA sequence
tttattcattccacacatgt

SEQ ID NO: 301449 - DNA, 20 bp, Artificial
  CRISPR gRNA sequence
atgtaggatgcccactaatc

SEQ ID NO: 301450 - DNA, 20 bp, Artificial
  CRISPR gRNA sequence
tgtaggatgcccactaatct

SEQ ID NO: 301451 - DNA, 20 bp, Artificial
  CRISPR gRNA sequence
cactaatctaggcactgtgc

SEQ ID NO: 301452 - DNA, 20 bp, Artificial
  CRISPR gRNA sequence
actaatctaggcactgtgcc

SEQ ID NO: 301453 - DNA, 20 bp, Artificial
  CRISPR gRNA sequence
ctaggcactgtgccaggtac

SEQ ID NO: 301454 - DNA, 20 bp, Artificial
  CRISPR gRNA sequence
taggcactgtgccaggtact

SEQ ID NO: 301455 - DNA, 20 bp, Artificial
  CRISPR gRNA sequence
aggcactgtgccaggtactg

SEQ ID NO: 301456 - DNA, 20 bp, Artificial
  CRISPR gRNA sequence
gccaggtactggggttactg

SEQ ID NO: 301457 - DNA, 20 bp, Artificial
  CRISPR gRNA sequence
aggtactggggttactgtgg

SEQ ID NO: 301458 - DNA, 20 bp, Artificial
  CRISPR gRNA sequence
ctggggttactgtggcagat

SEQ ID NO: 301459 - DNA, 20 bp, Artificial
  CRISPR gRNA sequence
ttactgtggcagataagatg

SEQ ID NO: 301460 - DNA, 20 bp, Artificial
  CRISPR gRNA sequence
gcccatgttcaccacctctg

SEQ ID NO: 301461 - DNA, 20 bp, Artificial
  CRISPR gRNA sequence
ttcaccacctctgaagtctt

SEQ ID NO: 301462 - DNA, 20 bp, Artificial
  CRISPR gRNA sequence
tgacttttacttgaccatga

SEQ ID NO: 301463 - DNA, 20 bp, Artificial
  CRISPR gRNA sequence
acttttacttgaccatgaca

SEQ ID NO: 301464 - DNA, 20 bp, Artificial
  CRISPR gRNA sequence
acagagcttgtcatgctttc

SEQ ID NO: 301465 - DNA, 20 bp, Artificial
  CRISPR gRNA sequence
cagagcttgtcatgctttct

SEQ ID NO: 301466 - DNA, 20 bp, Artificial
  CRISPR gRNA sequence
gctttctgggcattgtgcat

SEQ ID NO: 301467 - DNA, 20 bp, Artificial
  CRISPR gRNA sequence
gataccctgtcatccattat

SEQ ID NO: 301468 - DNA, 20 bp, Artificial
  CRISPR gRNA sequence
ataccctgtcatccattatc

SEQ ID NO: 301469 - DNA, 20 bp, Artificial
  CRISPR gRNA sequence
attatcaggttattttcttc

SEQ ID NO: 301470 - DNA, 20 bp, Artificial
  CRISPR gRNA sequence
attttcttccagttcttaac

SEQ ID NO: 301471 - DNA, 20 bp, Artificial
  CRISPR gRNA sequence
attttcctctccctctccat

SEQ ID NO: 301472 - DNA, 20 bp, Artificial
  CRISPR gRNA sequence
cctctccctctccattagtt

SEQ ID NO: 301473 - DNA, 20 bp, Artificial
  CRISPR gRNA sequence
ctctccctctccattagttc

SEQ ID NO: 301474 - DNA, 20 bp, Artificial
  CRISPR gRNA sequence
tccattagttcaggtttgct

SEQ ID NO: 301475 - DNA, 20 bp, Artificial
  CRISPR gRNA sequence
ccattagttcaggtttgctg

SEQ ID NO: 301476 - DNA, 20 bp, Artificial
  CRISPR gRNA sequence
gctgaggtctcaacatatgt

SEQ ID NO: 301477 - DNA, 20 bp, Artificial
  CRISPR gRNA sequence
ctgaggtctcaacatatgtt

SEQ ID NO: 301478 - DNA, 20 bp, Artificial
  CRISPR gRNA sequence
tctcaacatatgttaggcat

SEQ ID NO: 301479 - DNA, 20 bp, Artificial
  CRISPR gRNA sequence
tgttaggcataagcctattc

SEQ ID NO: 301480 - DNA, 20 bp, Artificial
  CRISPR gRNA sequence
gcataagcctattcaagtaa

SEQ ID NO: 301481 - DNA, 20 bp, Artificial
  CRISPR gRNA sequence
cataagcctattcaagtaac

SEQ ID NO: 301482 - DNA, 20 bp, Artificial
  CRISPR gRNA sequence
tattcaagtaacaggcactc

SEQ ID NO: 301483 - DNA, 20 bp, Artificial
  CRISPR gRNA sequence
attcaagtaacaggcactct

SEQ ID NO: 301484 - DNA, 20 bp, Artificial
  CRISPR gRNA sequence
ttcaagtaacaggcactctg

SEQ ID NO: 301485 - DNA, 20 bp, Artificial
  CRISPR gRNA sequence
cctctctctcatcaatgtct

SEQ ID NO: 301486 - DNA, 20 bp, Artificial
  CRISPR gRNA sequence
ctctctctcatcaatgtctc

SEQ ID NO: 301487 - DNA, 20 bp, Artificial
  CRISPR gRNA sequence
tctctctcatcaatgtctca

SEQ ID NO: 301488 - DNA, 20 bp, Artificial
  CRISPR gRNA sequence
tctcatcaatgtctcagggt

SEQ ID NO: 301489 - DNA, 20 bp, Artificial
  CRISPR gRNA sequence
ctcatcaatgtctcagggtc

SEQ ID NO: 301490 - DNA, 20 bp, Artificial
  CRISPR gRNA sequence
ggtcaggatttaccttttct

SEQ ID NO: 301491 - DNA, 20 bp, Artificial
  CRISPR gRNA sequence
ctcttccctctccattgtgt

SEQ ID NO: 301492 - DNA, 20 bp, Artificial
  CRISPR gRNA sequence
tccattgtgttggttcctga

SEQ ID NO: 301493 - DNA, 20 bp, Artificial
  CRISPR gRNA sequence
gttggttcctgaaagacacc

SEQ ID NO: 301494 - DNA, 20 bp, Artificial
  CRISPR gRNA sequence
cttcaaaaatgtattcctcc

SEQ ID NO: 301495 - DNA, 20 bp, Artificial
  CRISPR gRNA sequence
gtattcctcctagataccaa

SEQ ID NO: 301496 - DNA, 20 bp, Artificial
  CRISPR gRNA sequence
ttcctcctagataccaaaag

SEQ ID NO: 301497 - DNA, 20 bp, Artificial
  CRISPR gRNA sequence
tcctcctagataccaaaaga

SEQ ID NO: 301498 - DNA, 20 bp, Artificial
  CRISPR gRNA sequence
cctagataccaaaagaagga

SEQ ID NO: 301499 - DNA, 20 bp, Artificial
  CRISPR gRNA sequence
caaaagaaggaaagtttgaa

SEQ ID NO: 301500 - DNA, 20 bp, Artificial
  CRISPR gRNA sequence
aaaagaaggaaagtttgaaa

SEQ ID NO: 301501 - DNA, 20 bp, Artificial
  CRISPR gRNA sequence
gaaagtttgaaaaggcttca

SEQ ID NO: 301502 - DNA, 20 bp, Artificial
  CRISPR gRNA sequence
ttgaaaaggcttcaaagttc

SEQ ID NO: 301503 - DNA, 20 bp, Artificial
  CRISPR gRNA sequence
tgaaaaggcttcaaagttct

SEQ ID NO: 301504 - DNA, 20 bp, Artificial
  CRISPR gRNA sequence
ggcttcaaagttctgggact

SEQ ID NO: 301505 - DNA, 20 bp, Artificial
  CRISPR gRNA sequence
cttcaaagttctgggactga

SEQ ID NO: 301506 - DNA, 20 bp, Artificial
  CRISPR gRNA sequence
tcaaagttctgggactgaga

SEQ ID NO: 301507 - DNA, 20 bp, Artificial
  CRISPR gRNA sequence
aattgttgtgactttatata

SEQ ID NO: 301508 - DNA, 20 bp, Artificial
  CRISPR gRNA sequence
tgttgtgactttatatatgg

SEQ ID NO: 301509 - DNA, 20 bp, Artificial
  CRISPR gRNA sequence
ttgtgactttatatatggaa

SEQ ID NO: 301510 - DNA, 20 bp, Artificial
  CRISPR gRNA sequence
gactttatatatggaagaga

SEQ ID NO: 301511 - DNA, 20 bp, Artificial
  CRISPR gRNA sequence
ttactcaaatgatgcaattt

SEQ ID NO: 301512 - DNA, 20 bp, Artificial
  CRISPR gRNA sequence
tactcaaatgatgcaatttc

SEQ ID NO: 301513 - DNA, 20 bp, Artificial
  CRISPR gRNA sequence
actcaaatgatgcaatttca

SEQ ID NO: 301514 - DNA, 20 bp, Artificial
  CRISPR gRNA sequence
ctcaaatgatgcaatttcag

SEQ ID NO: 301515 - DNA, 20 bp, Artificial
  CRISPR gRNA sequence
tcaaatgatgcaatttcagg

SEQ ID NO: 301516 - DNA, 20 bp, Artificial
  CRISPR gRNA sequence
tgatgcaatttcagggggat

SEQ ID NO: 301517 - DNA, 20 bp, Artificial
  CRISPR gRNA sequence
gatgcaatttcagggggatt

SEQ ID NO: 301518 - DNA, 20 bp, Artificial
  CRISPR gRNA sequence
gcaatttcagggggattggg

SEQ ID NO: 301519 - DNA, 20 bp, Artificial
  CRISPR gRNA sequence
atttcagggggattgggaag

SEQ ID NO: 301520 - DNA, 20 bp, Artificial
  CRISPR gRNA sequence
agaagtttcttgcattcaaa

SEQ ID NO: 301521 - DNA, 20 bp, Artificial
  CRISPR gRNA sequence
tgtgccttaaattctaacac

SEQ ID NO: 301522 - DNA, 20 bp, Artificial
  CRISPR gRNA sequence
ttaaattctaacactggaaa

SEQ ID NO: 301523 - DNA, 20 bp, Artificial
  CRISPR gRNA sequence
tttcacttatatctctatcc

SEQ ID NO: 301524 - DNA, 20 bp, Artificial
  CRISPR gRNA sequence
ggctaaccaaaaaataccat

SEQ ID NO: 301525 - DNA, 20 bp, Artificial
  CRISPR gRNA sequence
gctaaccaaaaaataccatt

SEQ ID NO: 301526 - DNA, 20 bp, Artificial
  CRISPR gRNA sequence
taaccaaaaaataccattgg

SEQ ID NO: 301527 - DNA, 20 bp, Artificial
  CRISPR gRNA sequence
aaccaaaaaataccattggg

SEQ ID NO: 301528 - DNA, 20 bp, Artificial
  CRISPR gRNA sequence
accaaaaaataccattggga

SEQ ID NO: 301529 - DNA, 20 bp, Artificial
  CRISPR gRNA sequence
ccaaaaaataccattgggag

SEQ ID NO: 301530 - DNA, 20 bp, Artificial
  CRISPR gRNA sequence
attgggaggggtaatatatt

SEQ ID NO: 301531 - DNA, 20 bp, Artificial
  CRISPR gRNA sequence
aggggtaatatatttagttt

SEQ ID NO: 301532 - DNA, 20 bp, Artificial
  CRISPR gRNA sequence
tttagcaatcattttgtgat

SEQ ID NO: 301533 - DNA, 20 bp, Artificial
  CRISPR gRNA sequence
agcaatcattttgtgattgg

SEQ ID NO: 301534 - DNA, 20 bp, Artificial
  CRISPR gRNA sequence
caatcattttgtgattggaa

SEQ ID NO: 301535 - DNA, 20 bp, Artificial
  CRISPR gRNA sequence
agtttctaatccttttctga

SEQ ID NO: 301536 - DNA, 20 bp, Artificial
  CRISPR gRNA sequence
tctaatccttttctgaaagc

SEQ ID NO: 301537 - DNA, 20 bp, Artificial
  CRISPR gRNA sequence
ctaatccttttctgaaagca

SEQ ID NO: 301538 - DNA, 20 bp, Artificial
  CRISPR gRNA sequence
tttctgaaagcaaggtttat

SEQ ID NO: 301539 - DNA, 20 bp, Artificial
  CRISPR gRNA sequence
ttctgaaagcaaggtttata

SEQ ID NO: 301540 - DNA, 20 bp, Artificial
  CRISPR gRNA sequence
ctgaaagcaaggtttataag

SEQ ID NO: 301541 - DNA, 20 bp, Artificial
  CRISPR gRNA sequence
tgaaagcaaggtttataagg

SEQ ID NO: 301542 - DNA, 20 bp, Artificial
  CRISPR gRNA sequence
aaagcaaggtttataaggag

SEQ ID NO: 301543 - DNA, 20 bp, Artificial
  CRISPR gRNA sequence
aagcaaggtttataaggagg

SEQ ID NO: 301544 - DNA, 20 bp, Artificial
  CRISPR gRNA sequence
gcaaggtttataaggaggag

SEQ ID NO: 301545 - DNA, 20 bp, Artificial
  CRISPR gRNA sequence
aggtttataaggaggaggag

SEQ ID NO: 301546 - DNA, 20 bp, Artificial
  CRISPR gRNA sequence
tttataaggaggaggagaag

SEQ ID NO: 301547 - DNA, 20 bp, Artificial
  CRISPR gRNA sequence
gaggaggagaagaagtcttg

SEQ ID NO: 301548 - DNA, 20 bp, Artificial
  CRISPR gRNA sequence
gaagatgttgatgcctaaat

SEQ ID NO: 301549 - DNA, 20 bp, Artificial
  CRISPR gRNA sequence
atgttgatgcctaaatcggc

SEQ ID NO: 301550 - DNA, 20 bp, Artificial
  CRISPR gRNA sequence
tgatgcctaaatcggctagc

SEQ ID NO: 301551 - DNA, 20 bp, Artificial
  CRISPR gRNA sequence
gcctaaatcggctagccaga

SEQ ID NO: 301552 - DNA, 20 bp, Artificial
  CRISPR gRNA sequence
tcggctagccagatggtgct

SEQ ID NO: 301553 - DNA, 20 bp, Artificial
  CRISPR gRNA sequence
gaatattacacaatgttgca

SEQ ID NO: 301554 - DNA, 20 bp, Artificial
  CRISPR gRNA sequence
aatattacacaatgttgcat

SEQ ID NO: 301555 - DNA, 20 bp, Artificial
  CRISPR gRNA sequence
ttacacaatgttgcatgggc

SEQ ID NO: 301556 - DNA, 20 bp, Artificial
  CRISPR gRNA sequence
tacacaatgttgcatgggca

SEQ ID NO: 301557 - DNA, 20 bp, Artificial
  CRISPR gRNA sequence
aatgttgcatgggcaaggcc

SEQ ID NO: 301558 - DNA, 20 bp, Artificial
  CRISPR gRNA sequence
gttgcatgggcaaggccaag

SEQ ID NO: 301559 - DNA, 20 bp, Artificial
  CRISPR gRNA sequence
ttgcatgggcaaggccaagt

SEQ ID NO: 301560 - DNA, 20 bp, Artificial
  CRISPR gRNA sequence
aaggccaagtgggaaatttc

SEQ ID NO: 301561 - DNA, 20 bp, Artificial
  CRISPR gRNA sequence
ccaagtgggaaatttctagc

SEQ ID NO: 301562 - DNA, 20 bp, Artificial
  CRISPR gRNA sequence
gtgggaaatttctagccagc

SEQ ID NO: 301563 - DNA, 20 bp, Artificial
  CRISPR gRNA sequence
ctagccagctagacctcaca

SEQ ID NO: 301564 - DNA, 20 bp, Artificial
  CRISPR gRNA sequence
agctagacctcacaaagcct

SEQ ID NO: 301565 - DNA, 20 bp, Artificial
  CRISPR gRNA sequence
aaagcctgagttgctattga

SEQ ID NO: 301566 - DNA, 20 bp, Artificial
  CRISPR gRNA sequence
aagcctgagttgctattgat

SEQ ID NO: 301567 - DNA, 20 bp, Artificial
  CRISPR gRNA sequence
agcctgagttgctattgata

SEQ ID NO: 301568 - DNA, 20 bp, Artificial
  CRISPR gRNA sequence
gacttgctactgacacaact

SEQ ID NO: 301569 - DNA, 20 bp, Artificial
  CRISPR gRNA sequence
acttgctactgacacaactt

SEQ ID NO: 301570 - DNA, 20 bp, Artificial
  CRISPR gRNA sequence
acttgggatgtaaatttctc

SEQ ID NO: 301571 - DNA, 20 bp, Artificial
  CRISPR gRNA sequence
cttgggatgtaaatttctct

SEQ ID NO: 301572 - DNA, 20 bp, Artificial
  CRISPR gRNA sequence
ttgtcccacgtaaactccaa

SEQ ID NO: 301573 - DNA, 20 bp, Artificial
  CRISPR gRNA sequence
tgtcccacgtaaactccaac

SEQ ID NO: 301574 - DNA, 20 bp, Artificial
  CRISPR gRNA sequence
actccaacaggttgctaacc

SEQ ID NO: 301575 - DNA, 20 bp, Artificial
  CRISPR gRNA sequence
ctccaacaggttgctaacct

SEQ ID NO: 301576 - DNA, 20 bp, Artificial
  CRISPR gRNA sequence
gttgctaacctgggtgtcca

SEQ ID NO: 301577 - DNA, 20 bp, Artificial
  CRISPR gRNA sequence
tgctaacctgggtgtccatg

SEQ ID NO: 301578 - DNA, 20 bp, Artificial
  CRISPR gRNA sequence
gctaacctgggtgtccatgg

SEQ ID NO: 301579 - DNA, 20 bp, Artificial
  CRISPR gRNA sequence
ggtgtccatggaggtattta

SEQ ID NO: 301580 - DNA, 20 bp, Artificial
  CRISPR gRNA sequence
tggaggtatttatagaccac

SEQ ID NO: 301581 - DNA, 20 bp, Artificial
  CRISPR gRNA sequence
ccactcaacaatacctctga

SEQ ID NO: 301582 - DNA, 20 bp, Artificial
  CRISPR gRNA sequence
gtgattctgtctttactaaa

SEQ ID NO: 301583 - DNA, 20 bp, Artificial
  CRISPR gRNA sequence
gattctgtctttactaaata

SEQ ID NO: 301584 - DNA, 20 bp, Artificial
  CRISPR gRNA sequence
tcttgaacacttcctgtcac

SEQ ID NO: 301585 - DNA, 20 bp, Artificial
  CRISPR gRNA sequence
tgaacacttcctgtcactgg

SEQ ID NO: 301586 - DNA, 20 bp, Artificial
  CRISPR gRNA sequence
tgtgtgtatttaaaaacaat

SEQ ID NO: 301587 - DNA, 20 bp, Artificial
  CRISPR gRNA sequence
taaaaacaatcagcttttat

SEQ ID NO: 301588 - DNA, 20 bp, Artificial
  CRISPR gRNA sequence
aaaaacaatcagcttttatg

SEQ ID NO: 301589 - DNA, 20 bp, Artificial
  CRISPR gRNA sequence
tcagcttttatgaggccaca

SEQ ID NO: 301590 - DNA, 20 bp, Artificial
  CRISPR gRNA sequence
ttatgaggccacaaagtcat

SEQ ID NO: 301591 - DNA, 20 bp, Artificial
  CRISPR gRNA sequence
aagtcataagaatgatataa

SEQ ID NO: 301592 - DNA, 20 bp, Artificial
  CRISPR gRNA sequence
taagaatgatataatggact

SEQ ID NO: 301593 - DNA, 20 bp, Artificial
  CRISPR gRNA sequence
aagaatgatataatggactt

SEQ ID NO: 301594 - DNA, 20 bp, Artificial
  CRISPR gRNA sequence
atataatggacttgggtact

SEQ ID NO: 301595 - DNA, 20 bp, Artificial
  CRISPR gRNA sequence
tataatggacttgggtactt

SEQ ID NO: 301596 - DNA, 20 bp, Artificial
  CRISPR gRNA sequence
ataatggacttgggtacttg

SEQ ID NO: 301597 - DNA, 20 bp, Artificial
  CRISPR gRNA sequence
taatggacttgggtacttgg

SEQ ID NO: 301598 - DNA, 20 bp, Artificial
  CRISPR gRNA sequence
aatggacttgggtacttggg

SEQ ID NO: 301599 - DNA, 20 bp, Artificial
  CRISPR gRNA sequence
ggacttgggtacttgggggg

SEQ ID NO: 301600 - DNA, 20 bp, Artificial
  CRISPR gRNA sequence
acttgggtacttggggggaa

SEQ ID NO: 301601 - DNA, 20 bp, Artificial
  CRISPR gRNA sequence
gggtacttggggggaagagt

SEQ ID NO: 301602 - DNA, 20 bp, Artificial
  CRISPR gRNA sequence
gtacttggggggaagagtga

SEQ ID NO: 301603 - DNA, 20 bp, Artificial
  CRISPR gRNA sequence
acttggggggaagagtgaga

SEQ ID NO: 301604 - DNA, 20 bp, Artificial
  CRISPR gRNA sequence
ttggggggaagagtgagaga

SEQ ID NO: 301605 - DNA, 20 bp, Artificial
  CRISPR gRNA sequence
tggggggaagagtgagagag

SEQ ID NO: 301606 - DNA, 20 bp, Artificial
  CRISPR gRNA sequence
ggggaagagtgagagagagg

SEQ ID NO: 301607 - DNA, 20 bp, Artificial
  CRISPR gRNA sequence
gagtgagagagaggtggatg

SEQ ID NO: 301608 - DNA, 20 bp, Artificial
  CRISPR gRNA sequence
agtgagagagaggtggatga

SEQ ID NO: 301609 - DNA, 20 bp, Artificial
  CRISPR gRNA sequence
gagaggtggatgaaggataa

SEQ ID NO: 301610 - DNA, 20 bp, Artificial
  CRISPR gRNA sequence
aaggataaaagactacacat

SEQ ID NO: 301611 - DNA, 20 bp, Artificial
  CRISPR gRNA sequence
aggataaaagactacacatt

SEQ ID NO: 301612 - DNA, 20 bp, Artificial
  CRISPR gRNA sequence
aaaagactacacattgggta

SEQ ID NO: 301613 - DNA, 20 bp, Artificial
  CRISPR gRNA sequence
agactacacattgggtacag

SEQ ID NO: 301614 - DNA, 20 bp, Artificial
  CRISPR gRNA sequence
tgggtacagtggacattgct

SEQ ID NO: 301615 - DNA, 20 bp, Artificial
  CRISPR gRNA sequence
gggtacagtggacattgctc

SEQ ID NO: 301616 - DNA, 20 bp, Artificial
  CRISPR gRNA sequence
agtggacattgctcgggtga

SEQ ID NO: 301617 - DNA, 20 bp, Artificial
  CRISPR gRNA sequence
gtggacattgctcgggtgac

SEQ ID NO: 301618 - DNA, 20 bp, Artificial
  CRISPR gRNA sequence
tgacaggtgcatcaaaatct

SEQ ID NO: 301619 - DNA, 20 bp, Artificial
  CRISPR gRNA sequence
aatctcagaaatcaccacta

SEQ ID NO: 301620 - DNA, 20 bp, Artificial
  CRISPR gRNA sequence
ttgaaataaaataaaaataa

SEQ ID NO: 301621 - DNA, 20 bp, Artificial
  CRISPR gRNA sequence
aaataaaagataaaaacaat

SEQ ID NO: 301622 - DNA, 20 bp, Artificial
  CRISPR gRNA sequence
gataaaaacaatcagcttta

SEQ ID NO: 301623 - DNA, 20 bp, Artificial
  CRISPR gRNA sequence
taaaaacaatcagctttatg

SEQ ID NO: 301624 - DNA, 20 bp, Artificial
  CRISPR gRNA sequence
aaaaacaatcagctttatgg

SEQ ID NO: 301625 - DNA, 20 bp, Artificial
  CRISPR gRNA sequence
taataaaacccaatcatttt

SEQ ID NO: 301626 - DNA, 20 bp, Artificial
  CRISPR gRNA sequence
aaacccaatcattttcagtt

SEQ ID NO: 301627 - DNA, 20 bp, Artificial
  CRISPR gRNA sequence
acccaatcattttcagttta

SEQ ID NO: 301628 - DNA, 20 bp, Artificial
  CRISPR gRNA sequence
atcattttcagtttagagtt

SEQ ID NO: 301629 - DNA, 20 bp, Artificial
  CRISPR gRNA sequence
gtgattttaacgaatatata

SEQ ID NO: 301630 - DNA, 20 bp, Artificial
  CRISPR gRNA sequence
acgtaaccaccaccacaatc

SEQ ID NO: 301631 - DNA, 20 bp, Artificial
  CRISPR gRNA sequence
ccaccaccacaatcaagatc

SEQ ID NO: 301632 - DNA, 20 bp, Artificial
  CRISPR gRNA sequence
aagatcgagaacatttttat

SEQ ID NO: 301633 - DNA, 20 bp, Artificial
  CRISPR gRNA sequence
aacatttttataagccaaaa

SEQ ID NO: 301634 - DNA, 20 bp, Artificial
  CRISPR gRNA sequence
agccaaaatagttcgctttt

SEQ ID NO: 301635 - DNA, 20 bp, Artificial
  CRISPR gRNA sequence
gattcctttcccccatccca

SEQ ID NO: 301636 - DNA, 20 bp, Artificial
  CRISPR gRNA sequence
aaccatgaatctacttaaaa

SEQ ID NO: 301637 - DNA, 20 bp, Artificial
  CRISPR gRNA sequence
atgtgtattcttcttgtgcc

SEQ ID NO: 301638 - DNA, 20 bp, Artificial
  CRISPR gRNA sequence
tgtgcctggattgtttcact

SEQ ID NO: 301639 - DNA, 20 bp, Artificial
  CRISPR gRNA sequence
tctatgttcttgtgtattat

SEQ ID NO: 301640 - DNA, 20 bp, Artificial
  CRISPR gRNA sequence
atgttcttgtgtattattag

SEQ ID NO: 301641 - DNA, 20 bp, Artificial
  CRISPR gRNA sequence
tagtagtccattcctttcta

SEQ ID NO: 301642 - DNA, 20 bp, Artificial
  CRISPR gRNA sequence
cattcctttctatagctttg

SEQ ID NO: 301643 - DNA, 20 bp, Artificial
  CRISPR gRNA sequence
accgccaactgatgaaaatt

SEQ ID NO: 301644 - DNA, 20 bp, Artificial
  CRISPR gRNA sequence
ctgatgaaaatttagaatgc

SEQ ID NO: 301645 - DNA, 20 bp, Artificial
  CRISPR gRNA sequence
tgatgaaaatttagaatgcc

SEQ ID NO: 301646 - DNA, 20 bp, Artificial
  CRISPR gRNA sequence
aaaatttagaatgccaggtt

SEQ ID NO: 301647 - DNA, 20 bp, Artificial
  CRISPR gRNA sequence
atgccaggtttggtattatg

SEQ ID NO: 301648 - DNA, 20 bp, Artificial
  CRISPR gRNA sequence
caggtttggtattatgaagc

SEQ ID NO: 301649 - DNA, 20 bp, Artificial
  CRISPR gRNA sequence
tgctatgaacatttgtgtat

SEQ ID NO: 301650 - DNA, 20 bp, Artificial
  CRISPR gRNA sequence
aattttttaaaatttctgtt

SEQ ID NO: 301651 - DNA, 20 bp, Artificial
  CRISPR gRNA sequence
atttctgtttggtaaatgtc

SEQ ID NO: 301652 - DNA, 20 bp, Artificial
  CRISPR gRNA sequence
tttctgtttggtaaatgtct

SEQ ID NO: 301653 - DNA, 20 bp, Artificial
  CRISPR gRNA sequence
tggtaaatgtctaggatttc

SEQ ID NO: 301654 - DNA, 20 bp, Artificial
  CRISPR gRNA sequence
ggtaaatgtctaggatttct

SEQ ID NO: 301655 - DNA, 20 bp, Artificial
  CRISPR gRNA sequence
tctaggatttctgggttgta

SEQ ID NO: 301656 - DNA, 20 bp, Artificial
  CRISPR gRNA sequence
aggatttctgggttgtatag

SEQ ID NO: 301657 - DNA, 20 bp, Artificial
  CRISPR gRNA sequence
tgggttgtatagcagtatat

SEQ ID NO: 301658 - DNA, 20 bp, Artificial
  CRISPR gRNA sequence
ggttgtatagcagtatatga

SEQ ID NO: 301659 - DNA, 20 bp, Artificial
  CRISPR gRNA sequence
atagcagtatatgagagttt

SEQ ID NO: 301660 - DNA, 20 bp, Artificial
  CRISPR gRNA sequence
ctccaacacttgatgtttat

SEQ ID NO: 301661 - DNA, 20 bp, Artificial
  CRISPR gRNA sequence
tttatcagaccttttaattt

SEQ ID NO: 301662 - DNA, 20 bp, Artificial
  CRISPR gRNA sequence
ccttttaattttagccattc

SEQ ID NO: 301663 - DNA, 20 bp, Artificial
  CRISPR gRNA sequence
ttttaattttagccattcta

SEQ ID NO: 301664 - DNA, 20 bp, Artificial
  CRISPR gRNA sequence
tttaattttagccattctag

SEQ ID NO: 301665 - DNA, 20 bp, Artificial
  CRISPR gRNA sequence
ttaattttagccattctaga

SEQ ID NO: 301666 - DNA, 20 bp, Artificial
  CRISPR gRNA sequence
tagccattctagagggtgtg

SEQ ID NO: 301667 - DNA, 20 bp, Artificial
  CRISPR gRNA sequence
ccattctagagggtgtgcag

SEQ ID NO: 301668 - DNA, 20 bp, Artificial
  CRISPR gRNA sequence
gatgttgtgactgtgctcat

SEQ ID NO: 301669 - DNA, 20 bp, Artificial
  CRISPR gRNA sequence
cttctgttatgtatctgttc

SEQ ID NO: 301670 - DNA, 20 bp, Artificial
  CRISPR gRNA sequence
tcttcttgccttttattaaa

SEQ ID NO: 301671 - DNA, 20 bp, Artificial
  CRISPR gRNA sequence
tggattgtcttcttactaat

SEQ ID NO: 301672 - DNA, 20 bp, Artificial
  CRISPR gRNA sequence
attgtcttcttactaatgag

SEQ ID NO: 301673 - DNA, 20 bp, Artificial
  CRISPR gRNA sequence
agcaatatgtaattatatac

SEQ ID NO: 301674 - DNA, 20 bp, Artificial
  CRISPR gRNA sequence
tgtaattatatactggatac

SEQ ID NO: 301675 - DNA, 20 bp, Artificial
  CRISPR gRNA sequence
actggatacaagtcctttat

SEQ ID NO: 301676 - DNA, 20 bp, Artificial
  CRISPR gRNA sequence
aaacgttttctccctgtctg

SEQ ID NO: 301677 - DNA, 20 bp, Artificial
  CRISPR gRNA sequence
gacttttcgttttttaaaca

SEQ ID NO: 301678 - DNA, 20 bp, Artificial
  CRISPR gRNA sequence
tcgttttttaaacaaagtca

SEQ ID NO: 301679 - DNA, 20 bp, Artificial
  CRISPR gRNA sequence
taaacaaagtcaaagaacaa

SEQ ID NO: 301680 - DNA, 20 bp, Artificial
  CRISPR gRNA sequence
cattttatctttttatgata

SEQ ID NO: 301681 - DNA, 20 bp, Artificial
  CRISPR gRNA sequence
ttgctttctgtgtcctatct

SEQ ID NO: 301682 - DNA, 20 bp, Artificial
  CRISPR gRNA sequence
ctttctgtgtcctatctaag

SEQ ID NO: 301683 - DNA, 20 bp, Artificial
  CRISPR gRNA sequence
taagaagacttgcctaactt

SEQ ID NO: 301684 - DNA, 20 bp, Artificial
  CRISPR gRNA sequence
aagaagacttgcctaactta

SEQ ID NO: 301685 - DNA, 20 bp, Artificial
  CRISPR gRNA sequence
ttgcctaacttaaggttaca

SEQ ID NO: 301686 - DNA, 20 bp, Artificial
  CRISPR gRNA sequence
ttttctcctctgttttcttt

SEQ ID NO: 301687 - DNA, 20 bp, Artificial
  CRISPR gRNA sequence
tctcctctgttttcttttgg

SEQ ID NO: 301688 - DNA, 20 bp, Artificial
  CRISPR gRNA sequence
cattttaattcttaatatat

SEQ ID NO: 301689 - DNA, 20 bp, Artificial
  CRISPR gRNA sequence
taagttactttgtgtgtgtc

SEQ ID NO: 301690 - DNA, 20 bp, Artificial
  CRISPR gRNA sequence
aagttactttgtgtgtgtct

SEQ ID NO: 301691 - DNA, 20 bp, Artificial
  CRISPR gRNA sequence
aggttcatactttttccatg

SEQ ID NO: 301692 - DNA, 20 bp, Artificial
  CRISPR gRNA sequence
aaaatactatcctttctgca

SEQ ID NO: 301693 - DNA, 20 bp, Artificial
  CRISPR gRNA sequence
ctttctgcatggaattacct

SEQ ID NO: 301694 - DNA, 20 bp, Artificial
  CRISPR gRNA sequence
tctgcatggaattaccttgg

SEQ ID NO: 301695 - DNA, 20 bp, Artificial
  CRISPR gRNA sequence
taccttggtagctttgtcaa

SEQ ID NO: 301696 - DNA, 20 bp, Artificial
  CRISPR gRNA sequence
actgtattaattactatata

SEQ ID NO: 301697 - DNA, 20 bp, Artificial
  CRISPR gRNA sequence
tatatagtaaatattgaaat

SEQ ID NO: 301698 - DNA, 20 bp, Artificial
  CRISPR gRNA sequence
atatagtaaatattgaaatt

SEQ ID NO: 301699 - DNA, 20 bp, Artificial
  CRISPR gRNA sequence
tagtaaatattgaaattagg

SEQ ID NO: 301700 - DNA, 20 bp, Artificial
  CRISPR gRNA sequence
agtaaatattgaaattaggt

SEQ ID NO: 301701 - DNA, 20 bp, Artificial
  CRISPR gRNA sequence
atattgaaattaggtaggtt

SEQ ID NO: 301702 - DNA, 20 bp, Artificial
  CRISPR gRNA sequence
tttttttttttttttttttt

SEQ ID NO: 301703 - DNA, 20 bp, Artificial
  CRISPR gRNA sequence
ttttttttttttttttttga

SEQ ID NO: 301704 - DNA, 20 bp, Artificial
  CRISPR gRNA sequence
tttttttttttttttttgag

SEQ ID NO: 301705 - DNA, 20 bp, Artificial
  CRISPR gRNA sequence
ttttttttttttttttgaga

SEQ ID NO: 301706 - DNA, 20 bp, Artificial
  CRISPR gRNA sequence
ttttttttttttttgagagg

SEQ ID NO: 301707 - DNA, 20 bp, Artificial
  CRISPR gRNA sequence
ggagtttcactcttgttgcc

SEQ ID NO: 301708 - DNA, 20 bp, Artificial
  CRISPR gRNA sequence
gagtttcactcttgttgccc

SEQ ID NO: 301709 - DNA, 20 bp, Artificial
  CRISPR gRNA sequence
ttcactcttgttgcccaggc

SEQ ID NO: 301710 - DNA, 20 bp, Artificial
  CRISPR gRNA sequence
cactcttgttgcccaggctg

SEQ ID NO: 301711 - DNA, 20 bp, Artificial
  CRISPR gRNA sequence
ttgcccaggctggagtgcaa

SEQ ID NO: 301712 - DNA, 20 bp, Artificial
  CRISPR gRNA sequence
ggagtgcaatggcacgatct

SEQ ID NO: 301713 - DNA, 20 bp, Artificial
  CRISPR gRNA sequence
aatggcacgatctcagctca

SEQ ID NO: 301714 - DNA, 20 bp, Artificial
  CRISPR gRNA sequence
tcacagcaacctctgcctcc

SEQ ID NO: 301715 - DNA, 20 bp, Artificial
  CRISPR gRNA sequence
cacagcaacctctgcctccc

SEQ ID NO: 301716 - DNA, 20 bp, Artificial
  CRISPR gRNA sequence
aacctctgcctcccgggttc

SEQ ID NO: 301717 - DNA, 20 bp, Artificial
  CRISPR gRNA sequence
ttcaagcaattctcctgcct

SEQ ID NO: 301718 - DNA, 20 bp, Artificial
  CRISPR gRNA sequence
aattctcctgcctcagcctc

SEQ ID NO: 301719 - DNA, 20 bp, Artificial
  CRISPR gRNA sequence
ttctcctgcctcagcctcca

SEQ ID NO: 301720 - DNA, 20 bp, Artificial
  CRISPR gRNA sequence
tcctgcctcagcctccagag

SEQ ID NO: 301721 - DNA, 20 bp, Artificial
  CRISPR gRNA sequence
gcctcagcctccagagtagc

SEQ ID NO: 301722 - DNA, 20 bp, Artificial
  CRISPR gRNA sequence
cctcagcctccagagtagct

SEQ ID NO: 301723 - DNA, 20 bp, Artificial
  CRISPR gRNA sequence
ctccagagtagctgggatta

SEQ ID NO: 301724 - DNA, 20 bp, Artificial
  CRISPR gRNA sequence
tccagagtagctgggattac

SEQ ID NO: 301725 - DNA, 20 bp, Artificial
  CRISPR gRNA sequence
caggcatgcgccaccatgcc

SEQ ID NO: 301726 - DNA, 20 bp, Artificial
  CRISPR gRNA sequence
taacctttgttcttattttt

SEQ ID NO: 301727 - DNA, 20 bp, Artificial
  CRISPR gRNA sequence
cttatttttcagaattgttt

SEQ ID NO: 301728 - DNA, 20 bp, Artificial
  CRISPR gRNA sequence
cagaattgttttggcaattg

SEQ ID NO: 301729 - DNA, 20 bp, Artificial
  CRISPR gRNA sequence
gcatttccctataacttttc

SEQ ID NO: 301730 - DNA, 20 bp, Artificial
  CRISPR gRNA sequence
ttccctataacttttcgagt

SEQ ID NO: 301731 - DNA, 20 bp, Artificial
  CRISPR gRNA sequence
aacttttcgagtaagatttt

SEQ ID NO: 301732 - DNA, 20 bp, Artificial
  CRISPR gRNA sequence
gtaagatttttagtatctat

SEQ ID NO: 301733 - DNA, 20 bp, Artificial
  CRISPR gRNA sequence
aagatttttagtatctatta

SEQ ID NO: 301734 - DNA, 20 bp, Artificial
  CRISPR gRNA sequence
gatttttagtatctattaga

SEQ ID NO: 301735 - DNA, 20 bp, Artificial
  CRISPR gRNA sequence
gtatctattagagagcttac

SEQ ID NO: 301736 - DNA, 20 bp, Artificial
  CRISPR gRNA sequence
tatctattagagagcttacc

SEQ ID NO: 301737 - DNA, 20 bp, Artificial
  CRISPR gRNA sequence
ttgtgattacatttaatcca

SEQ ID NO: 301738 - DNA, 20 bp, Artificial
  CRISPR gRNA sequence
atttaatccatagatcaact

SEQ ID NO: 301739 - DNA, 20 bp, Artificial
  CRISPR gRNA sequence
ttaatccatagatcaacttg

SEQ ID NO: 301740 - DNA, 20 bp, Artificial
  CRISPR gRNA sequence
aatccatagatcaacttgga

SEQ ID NO: 301741 - DNA, 20 bp, Artificial
  CRISPR gRNA sequence
atagatcaacttggagagaa

SEQ ID NO: 301742 - DNA, 20 bp, Artificial
  CRISPR gRNA sequence
agaatggttatcttaacatc

SEQ ID NO: 301743 - DNA, 20 bp, Artificial
  CRISPR gRNA sequence
agtcttctgattcataaaca

SEQ ID NO: 301744 - DNA, 20 bp, Artificial
  CRISPR gRNA sequence
gcctatgtctccatttattt

SEQ ID NO: 301745 - DNA, 20 bp, Artificial
  CRISPR gRNA sequence
ttggtttactttaatttctc

SEQ ID NO: 301746 - DNA, 20 bp, Artificial
  CRISPR gRNA sequence
gtttactttaatttctccag

SEQ ID NO: 301747 - DNA, 20 bp, Artificial
  CRISPR gRNA sequence
tctccagtagtaatattgta

SEQ ID NO: 301748 - DNA, 20 bp, Artificial
  CRISPR gRNA sequence
tagtaatattgtatagtttt

SEQ ID NO: 301749 - DNA, 20 bp, Artificial
  CRISPR gRNA sequence
attgtatagttttcagtata

SEQ ID NO: 301750 - DNA, 20 bp, Artificial
  CRISPR gRNA sequence
gttttgttaaatttatttcc

SEQ ID NO: 301751 - DNA, 20 bp, Artificial
  CRISPR gRNA sequence
caatgtacaattgcttttgt

SEQ ID NO: 301752 - DNA, 20 bp, Artificial
  CRISPR gRNA sequence
caattgcttttgttagtata

SEQ ID NO: 301753 - DNA, 20 bp, Artificial
  CRISPR gRNA sequence
tctttgctacactcacttat

SEQ ID NO: 301754 - DNA, 20 bp, Artificial
  CRISPR gRNA sequence
cactcacttatcagttttaa

SEQ ID NO: 301755 - DNA, 20 bp, Artificial
  CRISPR gRNA sequence
actcacttatcagttttaat

SEQ ID NO: 301756 - DNA, 20 bp, Artificial
  CRISPR gRNA sequence
cagttttaataggtttttga

SEQ ID NO: 301757 - DNA, 20 bp, Artificial
  CRISPR gRNA sequence
taggtttttgatagattcct

SEQ ID NO: 301758 - DNA, 20 bp, Artificial
  CRISPR gRNA sequence
aggtttttgatagattcctc

SEQ ID NO: 301759 - DNA, 20 bp, Artificial
  CRISPR gRNA sequence
gattcctcaggattttctac

SEQ ID NO: 301760 - DNA, 20 bp, Artificial
  CRISPR gRNA sequence
atgatcattatctgtgaaaa

SEQ ID NO: 301761 - DNA, 20 bp, Artificial
  CRISPR gRNA sequence
tcattatctgtgaaaaaaga

SEQ ID NO: 301762 - DNA, 20 bp, Artificial
  CRISPR gRNA sequence
atgtcttttatttctttttc

SEQ ID NO: 301763 - DNA, 20 bp, Artificial
  CRISPR gRNA sequence
tttttctagtcttgtttctc

SEQ ID NO: 301764 - DNA, 20 bp, Artificial
  CRISPR gRNA sequence
gtttctctggctatgacctc

SEQ ID NO: 301765 - DNA, 20 bp, Artificial
  CRISPR gRNA sequence
ctatgacctccagtacaatg

SEQ ID NO: 301766 - DNA, 20 bp, Artificial
  CRISPR gRNA sequence
tccagtacaatgtggaacaa

SEQ ID NO: 301767 - DNA, 20 bp, Artificial
  CRISPR gRNA sequence
agtacaatgtggaacaaaag

SEQ ID NO: 301768 - DNA, 20 bp, Artificial
  CRISPR gRNA sequence
tacaatgtggaacaaaagta

SEQ ID NO: 301769 - DNA, 20 bp, Artificial
  CRISPR gRNA sequence
caatgtggaacaaaagtaga

SEQ ID NO: 301770 - DNA, 20 bp, Artificial
  CRISPR gRNA sequence
atgtggaacaaaagtagaga

SEQ ID NO: 301771 - DNA, 20 bp, Artificial
  CRISPR gRNA sequence
tggaacaaaagtagagagag

SEQ ID NO: 301772 - DNA, 20 bp, Artificial
  CRISPR gRNA sequence
ctccccacattcgccatctt

SEQ ID NO: 301773 - DNA, 20 bp, Artificial
  CRISPR gRNA sequence
tccccacattcgccatctta

SEQ ID NO: 301774 - DNA, 20 bp, Artificial
  CRISPR gRNA sequence
cattcgccatcttaaggtaa

SEQ ID NO: 301775 - DNA, 20 bp, Artificial
  CRISPR gRNA sequence
catcttaaggtaaaagcaat

SEQ ID NO: 301776 - DNA, 20 bp, Artificial
  CRISPR gRNA sequence
atcatgaaatattatgctaa

SEQ ID NO: 301777 - DNA, 20 bp, Artificial
  CRISPR gRNA sequence
atgaaatattatgctaacag

SEQ ID NO: 301778 - DNA, 20 bp, Artificial
  CRISPR gRNA sequence
tatgctaacagaagaatttt

SEQ ID NO: 301779 - DNA, 20 bp, Artificial
  CRISPR gRNA sequence
gctaacagaagaatttttgg

SEQ ID NO: 301780 - DNA, 20 bp, Artificial
  CRISPR gRNA sequence
ttttggtagatgtcctttgt

SEQ ID NO: 301781 - DNA, 20 bp, Artificial
  CRISPR gRNA sequence
tttggtagatgtcctttgtc

SEQ ID NO: 301782 - DNA, 20 bp, Artificial
  CRISPR gRNA sequence
tagatgtcctttgtcaggtt

SEQ ID NO: 301783 - DNA, 20 bp, Artificial
  CRISPR gRNA sequence
agatgtcctttgtcaggttg

SEQ ID NO: 301784 - DNA, 20 bp, Artificial
  CRISPR gRNA sequence
tgtcctttgtcaggttgagg

SEQ ID NO: 301785 - DNA, 20 bp, Artificial
  CRISPR gRNA sequence
tcttgtattcctatttttat

SEQ ID NO: 301786 - DNA, 20 bp, Artificial
  CRISPR gRNA sequence
ttgtattcctatttttatga

SEQ ID NO: 301787 - DNA, 20 bp, Artificial
  CRISPR gRNA sequence
tttccatttaaaactatgaa

SEQ ID NO: 301788 - DNA, 20 bp, Artificial
  CRISPR gRNA sequence
ttccatttaaaactatgaat

SEQ ID NO: 301789 - DNA, 20 bp, Artificial
  CRISPR gRNA sequence
atgggtattaattttgtcaa

SEQ ID NO: 301790 - DNA, 20 bp, Artificial
  CRISPR gRNA sequence
atcatatgtttttttctttt

SEQ ID NO: 301791 - DNA, 20 bp, Artificial
  CRISPR gRNA sequence
ttctttttagtttatttatg

SEQ ID NO: 301792 - DNA, 20 bp, Artificial
  CRISPR gRNA sequence
tttagtttatttatgtagta

SEQ ID NO: 301793 - DNA, 20 bp, Artificial
  CRISPR gRNA sequence
ttagtttatttatgtagtaa

SEQ ID NO: 301794 - DNA, 20 bp, Artificial
  CRISPR gRNA sequence
ttgcctgatttttgaatgtt

SEQ ID NO: 301795 - DNA, 20 bp, Artificial
  CRISPR gRNA sequence
ttatacttttaacatattgc

SEQ ID NO: 301796 - DNA, 20 bp, Artificial
  CRISPR gRNA sequence
tttaacatattgctagattt

SEQ ID NO: 301797 - DNA, 20 bp, Artificial
  CRISPR gRNA sequence
ttttagttgctaattttgtt

SEQ ID NO: 301798 - DNA, 20 bp, Artificial
  CRISPR gRNA sequence
aattttgttaagcatttcac

SEQ ID NO: 301799 - DNA, 20 bp, Artificial
  CRISPR gRNA sequence
ttttgttaagcatttcacga

SEQ ID NO: 301800 - DNA, 20 bp, Artificial
  CRISPR gRNA sequence
catttcacgagagatgtttg

SEQ ID NO: 301801 - DNA, 20 bp, Artificial
  CRISPR gRNA sequence
tttcttgcaatgtcttttcc

SEQ ID NO: 301802 - DNA, 20 bp, Artificial
  CRISPR gRNA sequence
tgcaatgtcttttcctagtt

SEQ ID NO: 301803 - DNA, 20 bp, Artificial
  CRISPR gRNA sequence
gtcttttcctagttcagtat

SEQ ID NO: 301804 - DNA, 20 bp, Artificial
  CRISPR gRNA sequence
tcttttcctagttcagtatc

SEQ ID NO: 301805 - DNA, 20 bp, Artificial
  CRISPR gRNA sequence
cttttcctagttcagtatca

SEQ ID NO: 301806 - DNA, 20 bp, Artificial
  CRISPR gRNA sequence
tatcagggctcccctgcctt

SEQ ID NO: 301807 - DNA, 20 bp, Artificial
  CRISPR gRNA sequence
tcagggctcccctgccttca

SEQ ID NO: 301808 - DNA, 20 bp, Artificial
  CRISPR gRNA sequence
cagggctcccctgccttcag

SEQ ID NO: 301809 - DNA, 20 bp, Artificial
  CRISPR gRNA sequence
agggctcccctgccttcaga

SEQ ID NO: 301810 - DNA, 20 bp, Artificial
  CRISPR gRNA sequence
gggctcccctgccttcagag

SEQ ID NO: 301811 - DNA, 20 bp, Artificial
  CRISPR gRNA sequence
cccctgccttcagaggggcc

SEQ ID NO: 301812 - DNA, 20 bp, Artificial
  CRISPR gRNA sequence
cttcagaggggcctggacac

SEQ ID NO: 301813 - DNA, 20 bp, Artificial
  CRISPR gRNA sequence
aggggcctggacactggctc

SEQ ID NO: 301814 - DNA, 20 bp, Artificial
  CRISPR gRNA sequence
ggggcctggacactggctcc

SEQ ID NO: 301815 - DNA, 20 bp, Artificial
  CRISPR gRNA sequence
gcctggacactggctccagg

SEQ ID NO: 301816 - DNA, 20 bp, Artificial
  CRISPR gRNA sequence
actggctccaggcagcaaac

SEQ ID NO: 301817 - DNA, 20 bp, Artificial
  CRISPR gRNA sequence
tggctccaggcagcaaacta

SEQ ID NO: 301818 - DNA, 20 bp, Artificial
  CRISPR gRNA sequence
gcagcaaactagagcaatca

SEQ ID NO: 301819 - DNA, 20 bp, Artificial
  CRISPR gRNA sequence
cagcaaactagagcaatcat

SEQ ID NO: 301820 - DNA, 20 bp, Artificial
  CRISPR gRNA sequence
agcaaactagagcaatcata

SEQ ID NO: 301821 - DNA, 20 bp, Artificial
  CRISPR gRNA sequence
cattttttctttccttcact

SEQ ID NO: 301822 - DNA, 20 bp, Artificial
  CRISPR gRNA sequence
attttttctttccttcactc

SEQ ID NO: 301823 - DNA, 20 bp, Artificial
  CRISPR gRNA sequence
ttttttctttccttcactca

SEQ ID NO: 301824 - DNA, 20 bp, Artificial
  CRISPR gRNA sequence
tttccttcactcagggacta

SEQ ID NO: 301825 - DNA, 20 bp, Artificial
  CRISPR gRNA sequence
tgtcatccgatctctgaaaa

SEQ ID NO: 301826 - DNA, 20 bp, Artificial
  CRISPR gRNA sequence
catatattttgtctgctttc

SEQ ID NO: 301827 - DNA, 20 bp, Artificial
  CRISPR gRNA sequence
gtctgctttctagttgttta

SEQ ID NO: 301828 - DNA, 20 bp, Artificial
  CRISPR gRNA sequence
gctttctagttgtttatgga

SEQ ID NO: 301829 - DNA, 20 bp, Artificial
  CRISPR gRNA sequence
tttctagttgtttatggaaa

SEQ ID NO: 301830 - DNA, 20 bp, Artificial
  CRISPR gRNA sequence
ttctagttgtttatggaaag

SEQ ID NO: 301831 - DNA, 20 bp, Artificial
  CRISPR gRNA sequence
tctagttgtttatggaaaga

SEQ ID NO: 301832 - DNA, 20 bp, Artificial
  CRISPR gRNA sequence
tggaaagagggcaattccta

SEQ ID NO: 301833 - DNA, 20 bp, Artificial
  CRISPR gRNA sequence
aaagagggcaattcctatag

SEQ ID NO: 301834 - DNA, 20 bp, Artificial
  CRISPR gRNA sequence
tatagcagttaatcctttgt

SEQ ID NO: 301835 - DNA, 20 bp, Artificial
  CRISPR gRNA sequence
tagcagttaatcctttgttg

SEQ ID NO: 301836 - DNA, 20 bp, Artificial
  CRISPR gRNA sequence
agcagttaatcctttgttgg

SEQ ID NO: 301837 - DNA, 20 bp, Artificial
  CRISPR gRNA sequence
agttaatcctttgttggagg

SEQ ID NO: 301838 - DNA, 20 bp, Artificial
  CRISPR gRNA sequence
taatcctttgttggaggaag

SEQ ID NO: 301839 - DNA, 20 bp, Artificial
  CRISPR gRNA sequence
tcctttgttggaggaagcag

SEQ ID NO: 301840 - DNA, 20 bp, Artificial
  CRISPR gRNA sequence
acttcttctatacaatttta

SEQ ID NO: 301841 - DNA, 20 bp, Artificial
  CRISPR gRNA sequence
tttatttatttatatttttt

SEQ ID NO: 301842 - DNA, 20 bp, Artificial
  CRISPR gRNA sequence
tttatttatattttttaaga

SEQ ID NO: 301843 - DNA, 20 bp, Artificial
  CRISPR gRNA sequence
aatcttgatcttctgtcacc

SEQ ID NO: 301844 - DNA, 20 bp, Artificial
  CRISPR gRNA sequence
atcttgatcttctgtcaccc

SEQ ID NO: 301845 - DNA, 20 bp, Artificial
  CRISPR gRNA sequence
tgatcttctgtcacccaggc

SEQ ID NO: 301846 - DNA, 20 bp, Artificial
  CRISPR gRNA sequence
atcttctgtcacccaggctg

SEQ ID NO: 301847 - DNA, 20 bp, Artificial
  CRISPR gRNA sequence
ctgtcacccaggctggagtg

SEQ ID NO: 301848 - DNA, 20 bp, Artificial
  CRISPR gRNA sequence
tcacccaggctggagtgcag

SEQ ID NO: 301849 - DNA, 20 bp, Artificial
  CRISPR gRNA sequence
ggagtgcagtggtgtgatct

SEQ ID NO: 301850 - DNA, 20 bp, Artificial
  CRISPR gRNA sequence
tcactgcaacctctgcctcc

SEQ ID NO: 301851 - DNA, 20 bp, Artificial
  CRISPR gRNA sequence
cactgcaacctctgcctccc

SEQ ID NO: 301852 - DNA, 20 bp, Artificial
  CRISPR gRNA sequence
aacctctgcctcccaggttc

SEQ ID NO: 301853 - DNA, 20 bp, Artificial
  CRISPR gRNA sequence
ttcaagcgattctcctctct

SEQ ID NO: 301854 - DNA, 20 bp, Artificial
  CRISPR gRNA sequence
ttctcctctctcagcctccc

SEQ ID NO: 301855 - DNA, 20 bp, Artificial
  CRISPR gRNA sequence
tcctctctcagcctcccaag

SEQ ID NO: 301856 - DNA, 20 bp, Artificial
  CRISPR gRNA sequence
ctctcagcctcccaagtagc

SEQ ID NO: 301857 - DNA, 20 bp, Artificial
  CRISPR gRNA sequence
tctcagcctcccaagtagct

SEQ ID NO: 301858 - DNA, 20 bp, Artificial
  CRISPR gRNA sequence
ctcccaagtagctgggatta

SEQ ID NO: 301859 - DNA, 20 bp, Artificial
  CRISPR gRNA sequence
tcccaagtagctgggattac

SEQ ID NO: 301860 - DNA, 20 bp, Artificial
  CRISPR gRNA sequence
caggtgcctgccaccacacc

SEQ ID NO: 301861 - DNA, 20 bp, Artificial
  CRISPR gRNA sequence
ccagctaatttttgtatgtt

SEQ ID NO: 301862 - DNA, 20 bp, Artificial
  CRISPR gRNA sequence
gctaatttttgtatgtttag

SEQ ID NO: 301863 - DNA, 20 bp, Artificial
  CRISPR gRNA sequence
ttttgtatgtttagtagaaa

SEQ ID NO: 301864 - DNA, 20 bp, Artificial
  CRISPR gRNA sequence
tttgtatgtttagtagaaat

SEQ ID NO: 301865 - DNA, 20 bp, Artificial
  CRISPR gRNA sequence
ttgtatgtttagtagaaatg

SEQ ID NO: 301866 - DNA, 20 bp, Artificial
  CRISPR gRNA sequence
gaaatggggtttcaccatgt

SEQ ID NO: 301867 - DNA, 20 bp, Artificial
  CRISPR gRNA sequence
tggggtttcaccatgttggc

SEQ ID NO: 301868 - DNA, 20 bp, Artificial
  CRISPR gRNA sequence
ggggtttcaccatgttggcc

SEQ ID NO: 301869 - DNA, 20 bp, Artificial
  CRISPR gRNA sequence
gtttcaccatgttggccagg

SEQ ID NO: 301870 - DNA, 20 bp, Artificial
  CRISPR gRNA sequence
tttcaccatgttggccaggc

SEQ ID NO: 301871 - DNA, 20 bp, Artificial
  CRISPR gRNA sequence
gggtctcgaactcctgatct

SEQ ID NO: 301872 - DNA, 20 bp, Artificial
  CRISPR gRNA sequence
ggtctcgaactcctgatcta

SEQ ID NO: 301873 - DNA, 20 bp, Artificial
  CRISPR gRNA sequence
ctaaggtgatctgcctgcct

SEQ ID NO: 301874 - DNA, 20 bp, Artificial
  CRISPR gRNA sequence
ctgcctgcctcagcctccaa

SEQ ID NO: 301875 - DNA, 20 bp, Artificial
  CRISPR gRNA sequence
gcctcagcctccaaaagtgc

SEQ ID NO: 301876 - DNA, 20 bp, Artificial
  CRISPR gRNA sequence
cctcagcctccaaaagtgct

SEQ ID NO: 301877 - DNA, 20 bp, Artificial
  CRISPR gRNA sequence
ctccaaaagtgctgggatta

SEQ ID NO: 301878 - DNA, 20 bp, Artificial
  CRISPR gRNA sequence
tccaaaagtgctgggattac

SEQ ID NO: 301879 - DNA, 20 bp, Artificial
  CRISPR gRNA sequence
agtgctgggattacaggtgt

SEQ ID NO: 301880 - DNA, 20 bp, Artificial
  CRISPR gRNA sequence
caggtgtgagccaccacccc

SEQ ID NO: 301881 - DNA, 20 bp, Artificial
  CRISPR gRNA sequence
agccaccacccctggcctaa

SEQ ID NO: 301882 - DNA, 20 bp, Artificial
  CRISPR gRNA sequence
ctaaaagaccttttaattgt

SEQ ID NO: 301883 - DNA, 20 bp, Artificial
  CRISPR gRNA sequence
agaccttttaattgttagaa

SEQ ID NO: 301884 - DNA, 20 bp, Artificial
  CRISPR gRNA sequence
cctctcataaccttcattca

SEQ ID NO: 301885 - DNA, 20 bp, Artificial
  CRISPR gRNA sequence
tctcataaccttcattcata

SEQ ID NO: 301886 - DNA, 20 bp, Artificial
  CRISPR gRNA sequence
tcattcatagagatgccctt

SEQ ID NO: 301887 - DNA, 20 bp, Artificial
  CRISPR gRNA sequence
attcatagagatgcccttca

SEQ ID NO: 301888 - DNA, 20 bp, Artificial
  CRISPR gRNA sequence
cccttcagagtcataccatc

SEQ ID NO: 301889 - DNA, 20 bp, Artificial
  CRISPR gRNA sequence
agctcaatctttgcatccca

SEQ ID NO: 301890 - DNA, 20 bp, Artificial
  CRISPR gRNA sequence
tcaatctttgcatcccatgg

SEQ ID NO: 301891 - DNA, 20 bp, Artificial
  CRISPR gRNA sequence
tgcatcccatggtagctctt

SEQ ID NO: 301892 - DNA, 20 bp, Artificial
  CRISPR gRNA sequence
ggtagctcttcagatatttg

SEQ ID NO: 301893 - DNA, 20 bp, Artificial
  CRISPR gRNA sequence
gctcttcagatatttgaaga

SEQ ID NO: 301894 - DNA, 20 bp, Artificial
  CRISPR gRNA sequence
gacagtatctctgttctctc

SEQ ID NO: 301895 - DNA, 20 bp, Artificial
  CRISPR gRNA sequence
acagtatctctgttctctcc

SEQ ID NO: 301896 - DNA, 20 bp, Artificial
  CRISPR gRNA sequence
gttctctccaggccttcttt

SEQ ID NO: 301897 - DNA, 20 bp, Artificial
  CRISPR gRNA sequence
ttctctccaggccttctttc

SEQ ID NO: 301898 - DNA, 20 bp, Artificial
  CRISPR gRNA sequence
tccaggccttctttcaggtg

SEQ ID NO: 301899 - DNA, 20 bp, Artificial
  CRISPR gRNA sequence
tctttcaggtgaagcatcat

SEQ ID NO: 301900 - DNA, 20 bp, Artificial
  CRISPR gRNA sequence
tgaagcatcatcagttactt

SEQ ID NO: 301901 - DNA, 20 bp, Artificial
  CRISPR gRNA sequence
gagctatttcttaattgact

SEQ ID NO: 301902 - DNA, 20 bp, Artificial
  CRISPR gRNA sequence
ttcttaattgactgagttcc

SEQ ID NO: 301903 - DNA, 20 bp, Artificial
  CRISPR gRNA sequence
tcccagatgctttataaatc

SEQ ID NO: 301904 - DNA, 20 bp, Artificial
  CRISPR gRNA sequence
ggttatgttctatttttgta

SEQ ID NO: 301905 - DNA, 20 bp, Artificial
  CRISPR gRNA sequence
aagtttcttcttaaaaataa

SEQ ID NO: 301906 - DNA, 20 bp, Artificial
  CRISPR gRNA sequence
ttaaaaataatggtgtttat

SEQ ID NO: 301907 - DNA, 20 bp, Artificial
  CRISPR gRNA sequence
taaaaataatggtgtttata

SEQ ID NO: 301908 - DNA, 20 bp, Artificial
  CRISPR gRNA sequence
ggtgtttataaggacatgaa

SEQ ID NO: 301909 - DNA, 20 bp, Artificial
  CRISPR gRNA sequence
catgaatagacaattctgaa

SEQ ID NO: 301910 - DNA, 20 bp, Artificial
  CRISPR gRNA sequence
ctgaaaagaaaatatacaaa

SEQ ID NO: 301911 - DNA, 20 bp, Artificial
  CRISPR gRNA sequence
tggccaacaaacatgaaaaa

SEQ ID NO: 301912 - DNA, 20 bp, Artificial
  CRISPR gRNA sequence
agttcaatatcactaactat

SEQ ID NO: 301913 - DNA, 20 bp, Artificial
  CRISPR gRNA sequence
gttcaatatcactaactatc

SEQ ID NO: 301914 - DNA, 20 bp, Artificial
  CRISPR gRNA sequence
ttcaatatcactaactatca

SEQ ID NO: 301915 - DNA, 20 bp, Artificial
  CRISPR gRNA sequence
atgcaaattaaaaccaccat

SEQ ID NO: 301916 - DNA, 20 bp, Artificial
  CRISPR gRNA sequence
agataccaccttactcctgc

SEQ ID NO: 301917 - DNA, 20 bp, Artificial
  CRISPR gRNA sequence
ccaccttactcctgcaagaa

SEQ ID NO: 301918 - DNA, 20 bp, Artificial
  CRISPR gRNA sequence
attaaaaaatcaaaaaataa

SEQ ID NO: 301919 - DNA, 20 bp, Artificial
  CRISPR gRNA sequence
aatcaaaaaataatagatgt

SEQ ID NO: 301920 - DNA, 20 bp, Artificial
  CRISPR gRNA sequence
aaaaataatagatgttggca

SEQ ID NO: 301921 - DNA, 20 bp, Artificial
  CRISPR gRNA sequence
aatagatgttggcatggatg

SEQ ID NO: 301922 - DNA, 20 bp, Artificial
  CRISPR gRNA sequence
gttggcatggatgtggtgaa

SEQ ID NO: 301923 - DNA, 20 bp, Artificial
  CRISPR gRNA sequence
ttggcatggatgtggtgaaa

SEQ ID NO: 301924 - DNA, 20 bp, Artificial
  CRISPR gRNA sequence
tggcatggatgtggtgaaaa

SEQ ID NO: 301925 - DNA, 20 bp, Artificial
  CRISPR gRNA sequence
agggaacatgtttacactgc

SEQ ID NO: 301926 - DNA, 20 bp, Artificial
  CRISPR gRNA sequence
gaacatgtttacactgctgg

SEQ ID NO: 301927 - DNA, 20 bp, Artificial
  CRISPR gRNA sequence
aacatgtttacactgctggt

SEQ ID NO: 301928 - DNA, 20 bp, Artificial
  CRISPR gRNA sequence
ctgctggtgggaatgtaaac

SEQ ID NO: 301929 - DNA, 20 bp, Artificial
  CRISPR gRNA sequence
gtaaactagtacaaacacta

SEQ ID NO: 301930 - DNA, 20 bp, Artificial
  CRISPR gRNA sequence
agtacaaacactatggaaaa

SEQ ID NO: 301931 - DNA, 20 bp, Artificial
  CRISPR gRNA sequence
aaacactatggaaaacagta

SEQ ID NO: 301932 - DNA, 20 bp, Artificial
  CRISPR gRNA sequence
acactatggaaaacagtatg

SEQ ID NO: 301933 - DNA, 20 bp, Artificial
  CRISPR gRNA sequence
aacagtatggagattcctta

SEQ ID NO: 301934 - DNA, 20 bp, Artificial
  CRISPR gRNA sequence
gagattccttaaagaactaa

SEQ ID NO: 301935 - DNA, 20 bp, Artificial
  CRISPR gRNA sequence
attccttaaagaactaaaag

SEQ ID NO: 301936 - DNA, 20 bp, Artificial
  CRISPR gRNA sequence
tagaactctactatttaatt

SEQ ID NO: 301937 - DNA, 20 bp, Artificial
  CRISPR gRNA sequence
taattcagcaatcctactac

SEQ ID NO: 301938 - DNA, 20 bp, Artificial
  CRISPR gRNA sequence
aattcagcaatcctactact

SEQ ID NO: 301939 - DNA, 20 bp, Artificial
  CRISPR gRNA sequence
tactactgggtatataccca

SEQ ID NO: 301940 - DNA, 20 bp, Artificial
  CRISPR gRNA sequence
actactgggtatatacccaa

SEQ ID NO: 301941 - DNA, 20 bp, Artificial
  CRISPR gRNA sequence
aaataattcattatatgaaa

SEQ ID NO: 301942 - DNA, 20 bp, Artificial
  CRISPR gRNA sequence
cacatgcacacgcatgttta

SEQ ID NO: 301943 - DNA, 20 bp, Artificial
  CRISPR gRNA sequence
atgcacacgcatgtttatag

SEQ ID NO: 301944 - DNA, 20 bp, Artificial
  CRISPR gRNA sequence
caatttgcaattccaaaaat

SEQ ID NO: 301945 - DNA, 20 bp, Artificial
  CRISPR gRNA sequence
aatttgcaattccaaaaata

SEQ ID NO: 301946 - DNA, 20 bp, Artificial
  CRISPR gRNA sequence
ctaaatgtccatcaacccat

SEQ ID NO: 301947 - DNA, 20 bp, Artificial
  CRISPR gRNA sequence
aatgtccatcaacccatgag

SEQ ID NO: 301948 - DNA, 20 bp, Artificial
  CRISPR gRNA sequence
ccatcaacccatgagtggat

SEQ ID NO: 301949 - DNA, 20 bp, Artificial
  CRISPR gRNA sequence
catcaacccatgagtggata

SEQ ID NO: 301950 - DNA, 20 bp, Artificial
  CRISPR gRNA sequence
atgagtggataaggaaaatg

SEQ ID NO: 301951 - DNA, 20 bp, Artificial
  CRISPR gRNA sequence
aatgtggtaaatatccctca

SEQ ID NO: 301952 - DNA, 20 bp, Artificial
  CRISPR gRNA sequence
atccctcatggaatattact

SEQ ID NO: 301953 - DNA, 20 bp, Artificial
  CRISPR gRNA sequence
gaatattactcagccataaa

SEQ ID NO: 301954 - DNA, 20 bp, Artificial
  CRISPR gRNA sequence
cataaaaagaaacaaaataa

SEQ ID NO: 301955 - DNA, 20 bp, Artificial
  CRISPR gRNA sequence
aaacaaaataatggcatttg

SEQ ID NO: 301956 - DNA, 20 bp, Artificial
  CRISPR gRNA sequence
ggcatttgcagcaactttga

SEQ ID NO: 301957 - DNA, 20 bp, Artificial
  CRISPR gRNA sequence
tgcagcaactttgatggaac

SEQ ID NO: 301958 - DNA, 20 bp, Artificial
  CRISPR gRNA sequence
cagcaactttgatggaacca

SEQ ID NO: 301959 - DNA, 20 bp, Artificial
  CRISPR gRNA sequence
gaaccagagaccattattct

SEQ ID NO: 301960 - DNA, 20 bp, Artificial
  CRISPR gRNA sequence
agagaccattattctaagtg

SEQ ID NO: 301961 - DNA, 20 bp, Artificial
  CRISPR gRNA sequence
tattctaagtgaagtaactc

SEQ ID NO: 301962 - DNA, 20 bp, Artificial
  CRISPR gRNA sequence
taagtgaagtaactcaagaa

SEQ ID NO: 301963 - DNA, 20 bp, Artificial
  CRISPR gRNA sequence
agtgaagtaactcaagaatg

SEQ ID NO: 301964 - DNA, 20 bp, Artificial
  CRISPR gRNA sequence
tattgtatgttttcactgat

SEQ ID NO: 301965 - DNA, 20 bp, Artificial
  CRISPR gRNA sequence
tgtatgttttcactgataag

SEQ ID NO: 301966 - DNA, 20 bp, Artificial
  CRISPR gRNA sequence
gtatgttttcactgataagt

SEQ ID NO: 301967 - DNA, 20 bp, Artificial
  CRISPR gRNA sequence
atgttttcactgataagtgg

SEQ ID NO: 301968 - DNA, 20 bp, Artificial
  CRISPR gRNA sequence
ataagtgggagctaaactat

SEQ ID NO: 301969 - DNA, 20 bp, Artificial
  CRISPR gRNA sequence
taagtgggagctaaactatg

SEQ ID NO: 301970 - DNA, 20 bp, Artificial
  CRISPR gRNA sequence
agctaaactatgaggatgca

SEQ ID NO: 301971 - DNA, 20 bp, Artificial
  CRISPR gRNA sequence
ctatgaggatgcaaagacat

SEQ ID NO: 301972 - DNA, 20 bp, Artificial
  CRISPR gRNA sequence
aagacataagaataatataa

SEQ ID NO: 301973 - DNA, 20 bp, Artificial
  CRISPR gRNA sequence
aagaataatataatggactt

SEQ ID NO: 301974 - DNA, 20 bp, Artificial
  CRISPR gRNA sequence
agaataatataatggacttt

SEQ ID NO: 301975 - DNA, 20 bp, Artificial
  CRISPR gRNA sequence
gaataatataatggactttg

SEQ ID NO: 301976 - DNA, 20 bp, Artificial
  CRISPR gRNA sequence
tataatggactttggggact

SEQ ID NO: 301977 - DNA, 20 bp, Artificial
  CRISPR gRNA sequence
taatggactttggggactca

SEQ ID NO: 301978 - DNA, 20 bp, Artificial
  CRISPR gRNA sequence
aatggactttggggactcag

SEQ ID NO: 301979 - DNA, 20 bp, Artificial
  CRISPR gRNA sequence
gactttggggactcagagga

SEQ ID NO: 301980 - DNA, 20 bp, Artificial
  CRISPR gRNA sequence
ctttggggactcagaggaaa

SEQ ID NO: 301981 - DNA, 20 bp, Artificial
  CRISPR gRNA sequence
tggggactcagaggaaagag

SEQ ID NO: 301982 - DNA, 20 bp, Artificial
  CRISPR gRNA sequence
ggggactcagaggaaagagt

SEQ ID NO: 301983 - DNA, 20 bp, Artificial
  CRISPR gRNA sequence
ggactcagaggaaagagtgg

SEQ ID NO: 301984 - DNA, 20 bp, Artificial
  CRISPR gRNA sequence
gactcagaggaaagagtggg

SEQ ID NO: 301985 - DNA, 20 bp, Artificial
  CRISPR gRNA sequence
actcagaggaaagagtggga

SEQ ID NO: 301986 - DNA, 20 bp, Artificial
  CRISPR gRNA sequence
ctcagaggaaagagtgggag

SEQ ID NO: 301987 - DNA, 20 bp, Artificial
  CRISPR gRNA sequence
gaggaaagagtgggaggggt

SEQ ID NO: 301988 - DNA, 20 bp, Artificial
  CRISPR gRNA sequence
ggaaagagtgggaggggtga

SEQ ID NO: 301989 - DNA, 20 bp, Artificial
  CRISPR gRNA sequence
gtgggaggggtgagagataa

SEQ ID NO: 301990 - DNA, 20 bp, Artificial
  CRISPR gRNA sequence
agagataaaagactacacac

SEQ ID NO: 301991 - DNA, 20 bp, Artificial
  CRISPR gRNA sequence
taaaagactacacactggtg

SEQ ID NO: 301992 - DNA, 20 bp, Artificial
  CRISPR gRNA sequence
tggtgcagtgtacactgctc

SEQ ID NO: 301993 - DNA, 20 bp, Artificial
  CRISPR gRNA sequence
agtgtacactgctcgagtga

SEQ ID NO: 301994 - DNA, 20 bp, Artificial
  CRISPR gRNA sequence
gtgtacactgctcgagtgac

SEQ ID NO: 301995 - DNA, 20 bp, Artificial
  CRISPR gRNA sequence
tacactgctcgagtgacagg

SEQ ID NO: 301996 - DNA, 20 bp, Artificial
  CRISPR gRNA sequence
tcgagtgacaggtggcacca

SEQ ID NO: 301997 - DNA, 20 bp, Artificial
  CRISPR gRNA sequence
gacaggtggcaccaaagtct

SEQ ID NO: 301998 - DNA, 20 bp, Artificial
  CRISPR gRNA sequence
ccatgtaaccaaaaaccacc

SEQ ID NO: 301999 - DNA, 20 bp, Artificial
  CRISPR gRNA sequence
taaccaaaaaccacctagtt

SEQ ID NO: 302000 - DNA, 20 bp, Artificial
  CRISPR gRNA sequence
aaaaaccacctagtttagtt

SEQ ID NO: 302001 - DNA, 20 bp, Artificial
  CRISPR gRNA sequence
aaccacctagtttagttcag

SEQ ID NO: 302002 - DNA, 20 bp, Artificial
  CRISPR gRNA sequence
ttcaaataaaaattttgaaa

SEQ ID NO: 302003 - DNA, 20 bp, Artificial
  CRISPR gRNA sequence
gaatcttataaatgtaaaaa

SEQ ID NO: 302004 - DNA, 20 bp, Artificial
  CRISPR gRNA sequence
aatcttataaatgtaaaaaa

SEQ ID NO: 302005 - DNA, 20 bp, Artificial
  CRISPR gRNA sequence
aatgtaaaaaaaggtactta

SEQ ID NO: 302006 - DNA, 20 bp, Artificial
  CRISPR gRNA sequence
aaggtacttatagttgaata

SEQ ID NO: 302007 - DNA, 20 bp, Artificial
  CRISPR gRNA sequence
tatagttgaatacagtattt

SEQ ID NO: 302008 - DNA, 20 bp, Artificial
  CRISPR gRNA sequence
tacagtatttcagatgtctt

SEQ ID NO: 302009 - DNA, 20 bp, Artificial
  CRISPR gRNA sequence
cttttatacccatgacaaaa

SEQ ID NO: 302010 - DNA, 20 bp, Artificial
  CRISPR gRNA sequence
aatagtcaccatatcaaaaa

SEQ ID NO: 302011 - DNA, 20 bp, Artificial
  CRISPR gRNA sequence
agccactgtcaaaaaaatga

SEQ ID NO: 302012 - DNA, 20 bp, Artificial
  CRISPR gRNA sequence
cactgtcaaaaaaatgaaag

SEQ ID NO: 302013 - DNA, 20 bp, Artificial
  CRISPR gRNA sequence
aaatgaaagcagacaattaa

SEQ ID NO: 302014 - DNA, 20 bp, Artificial
  CRISPR gRNA sequence
aatgaaagcagacaattaaa

SEQ ID NO: 302015 - DNA, 20 bp, Artificial
  CRISPR gRNA sequence
gaaagcagacaattaaaagg

SEQ ID NO: 302016 - DNA, 20 bp, Artificial
  CRISPR gRNA sequence
tttaaatttgcttacaaatt

SEQ ID NO: 302017 - DNA, 20 bp, Artificial
  CRISPR gRNA sequence
cttacaaattcagcattttg

SEQ ID NO: 302018 - DNA, 20 bp, Artificial
  CRISPR gRNA sequence
ttacaaattcagcattttga

SEQ ID NO: 302019 - DNA, 20 bp, Artificial
  CRISPR gRNA sequence
tacaaattcagcattttgaa

SEQ ID NO: 302020 - DNA, 20 bp, Artificial
  CRISPR gRNA sequence
acaaattcagcattttgaag

SEQ ID NO: 302021 - DNA, 20 bp, Artificial
  CRISPR gRNA sequence
gtgatgatatcactaacttt

SEQ ID NO: 302022 - DNA, 20 bp, Artificial
  CRISPR gRNA sequence
atcactaactttcagtcttt

SEQ ID NO: 302023 - DNA, 20 bp, Artificial
  CRISPR gRNA sequence
gaatatttctgtttaaatgt

SEQ ID NO: 302024 - DNA, 20 bp, Artificial
  CRISPR gRNA sequence
gtttaaatgttggttaaaaa

SEQ ID NO: 302025 - DNA, 20 bp, Artificial
  CRISPR gRNA sequence
gttggttaaaaacggatcac

SEQ ID NO: 302026 - DNA, 20 bp, Artificial
  CRISPR gRNA sequence
ttggttaaaaacggatcacg

SEQ ID NO: 302027 - DNA, 20 bp, Artificial
  CRISPR gRNA sequence
taaaaacggatcacgaggtc

SEQ ID NO: 302028 - DNA, 20 bp, Artificial
  CRISPR gRNA sequence
aaaacggatcacgaggtcaa

SEQ ID NO: 302029 - DNA, 20 bp, Artificial
  CRISPR gRNA sequence
gatcacgaggtcaagagatc

SEQ ID NO: 302030 - DNA, 20 bp, Artificial
  CRISPR gRNA sequence
tcaagagatcgagaccatcc

SEQ ID NO: 302031 - DNA, 20 bp, Artificial
  CRISPR gRNA sequence
cgagaccatcctggccaaca

SEQ ID NO: 302032 - DNA, 20 bp, Artificial
  CRISPR gRNA sequence
ctgaaaatacaaaaattacc

SEQ ID NO: 302033 - DNA, 20 bp, Artificial
  CRISPR gRNA sequence
tgaaaatacaaaaattacct

SEQ ID NO: 302034 - DNA, 20 bp, Artificial
  CRISPR gRNA sequence
atacaaaaattacctgggct

SEQ ID NO: 302035 - DNA, 20 bp, Artificial
  CRISPR gRNA sequence
caaaaattacctgggcttgg

SEQ ID NO: 302036 - DNA, 20 bp, Artificial
  CRISPR gRNA sequence
ggcttggtggcacgtgcctg

SEQ ID NO: 302037 - DNA, 20 bp, Artificial
  CRISPR gRNA sequence
gtggcacgtgcctgtagtcc

SEQ ID NO: 302038 - DNA, 20 bp, Artificial
  CRISPR gRNA sequence
tgcctgtagtcccagctact

SEQ ID NO: 302039 - DNA, 20 bp, Artificial
  CRISPR gRNA sequence
gcctgtagtcccagctactt

SEQ ID NO: 302040 - DNA, 20 bp, Artificial
  CRISPR gRNA sequence
ctgtagtcccagctacttgg

SEQ ID NO: 302041 - DNA, 20 bp, Artificial
  CRISPR gRNA sequence
tgtagtcccagctacttggg

SEQ ID NO: 302042 - DNA, 20 bp, Artificial
  CRISPR gRNA sequence
tcccagctacttgggaggct

SEQ ID NO: 302043 - DNA, 20 bp, Artificial
  CRISPR gRNA sequence
cccagctacttgggaggctg

SEQ ID NO: 302044 - DNA, 20 bp, Artificial
  CRISPR gRNA sequence
agctacttgggaggctgagg

SEQ ID NO: 302045 - DNA, 20 bp, Artificial
  CRISPR gRNA sequence
gctacttgggaggctgaggc

SEQ ID NO: 302046 - DNA, 20 bp, Artificial
  CRISPR gRNA sequence
tacttgggaggctgaggcag

SEQ ID NO: 302047 - DNA, 20 bp, Artificial
  CRISPR gRNA sequence
gcaggagaatcgcttgaacc

SEQ ID NO: 302048 - DNA, 20 bp, Artificial
  CRISPR gRNA sequence
caggagaatcgcttgaacct

SEQ ID NO: 302049 - DNA, 20 bp, Artificial
  CRISPR gRNA sequence
ggagaatcgcttgaacctgg

SEQ ID NO: 302050 - DNA, 20 bp, Artificial
  CRISPR gRNA sequence
gagaatcgcttgaacctggg

SEQ ID NO: 302051 - DNA, 20 bp, Artificial
  CRISPR gRNA sequence
aatcgcttgaacctgggagg

SEQ ID NO: 302052 - DNA, 20 bp, Artificial
  CRISPR gRNA sequence
tcgcttgaacctgggaggca

SEQ ID NO: 302053 - DNA, 20 bp, Artificial
  CRISPR gRNA sequence
cgcttgaacctgggaggcag

SEQ ID NO: 302054 - DNA, 20 bp, Artificial
  CRISPR gRNA sequence
aacctgggaggcagaggttg

SEQ ID NO: 302055 - DNA, 20 bp, Artificial
  CRISPR gRNA sequence
ggcagaggttgcagtgtgct

SEQ ID NO: 302056 - DNA, 20 bp, Artificial
  CRISPR gRNA sequence
gagatcgtgccactgcactc

SEQ ID NO: 302057 - DNA, 20 bp, Artificial
  CRISPR gRNA sequence
cgtgccactgcactccagcc

SEQ ID NO: 302058 - DNA, 20 bp, Artificial
  CRISPR gRNA sequence
actgcactccagcctggtga

SEQ ID NO: 302059 - DNA, 20 bp, Artificial
  CRISPR gRNA sequence
tgcactccagcctggtgaca

SEQ ID NO: 302060 - DNA, 20 bp, Artificial
  CRISPR gRNA sequence
ctccagcctggtgacagagt

SEQ ID NO: 302061 - DNA, 20 bp, Artificial
  CRISPR gRNA sequence
tccagcctggtgacagagtg

SEQ ID NO: 302062 - DNA, 20 bp, Artificial
  CRISPR gRNA sequence
aataataatttcttttgaaa

SEQ ID NO: 302063 - DNA, 20 bp, Artificial
  CRISPR gRNA sequence
ataataatttcttttgaaaa

SEQ ID NO: 302064 - DNA, 20 bp, Artificial
  CRISPR gRNA sequence
gaaaaaggcactttaccttt

SEQ ID NO: 302065 - DNA, 20 bp, Artificial
  CRISPR gRNA sequence
ttaagaaatcattcctgaaa

SEQ ID NO: 302066 - DNA, 20 bp, Artificial
  CRISPR gRNA sequence
aaatcattcctgaaacagct

SEQ ID NO: 302067 - DNA, 20 bp, Artificial
  CRISPR gRNA sequence
cctgaaacagctgagactcc

SEQ ID NO: 302068 - DNA, 20 bp, Artificial
  CRISPR gRNA sequence
ctgaaacagctgagactcct

SEQ ID NO: 302069 - DNA, 20 bp, Artificial
  CRISPR gRNA sequence
tgagactcctaggtttgttc

SEQ ID NO: 302070 - DNA, 20 bp, Artificial
  CRISPR gRNA sequence
gagactcctaggtttgttct

SEQ ID NO: 302071 - DNA, 20 bp, Artificial
  CRISPR gRNA sequence
agactcctaggtttgttcta

SEQ ID NO: 302072 - DNA, 20 bp, Artificial
  CRISPR gRNA sequence
actcctaggtttgttctagg

SEQ ID NO: 302073 - DNA, 20 bp, Artificial
  CRISPR gRNA sequence
ctcctaggtttgttctaggg

SEQ ID NO: 302074 - DNA, 20 bp, Artificial
  CRISPR gRNA sequence
taggtttgttctagggaggc

SEQ ID NO: 302075 - DNA, 20 bp, Artificial
  CRISPR gRNA sequence
gctgtaaaaaccgttgttgc

SEQ ID NO: 302076 - DNA, 20 bp, Artificial
  CRISPR gRNA sequence
ctgtaaaaaccgttgttgct

SEQ ID NO: 302077 - DNA, 20 bp, Artificial
  CRISPR gRNA sequence
tgtaaaaaccgttgttgcta

SEQ ID NO: 302078 - DNA, 20 bp, Artificial
  CRISPR gRNA sequence
tgttgctagggcattgtata

SEQ ID NO: 302079 - DNA, 20 bp, Artificial
  CRISPR gRNA sequence
agggcattgtatacagattt

SEQ ID NO: 302080 - DNA, 20 bp, Artificial
  CRISPR gRNA sequence
tatacagatttcagtcacac

SEQ ID NO: 302081 - DNA, 20 bp, Artificial
  CRISPR gRNA sequence
cagtcacacaagacccaaat

SEQ ID NO: 302082 - DNA, 20 bp, Artificial
  CRISPR gRNA sequence
agtcacacaagacccaaatg

SEQ ID NO: 302083 - DNA, 20 bp, Artificial
  CRISPR gRNA sequence
cacacaagacccaaatgagg

SEQ ID NO: 302084 - DNA, 20 bp, Artificial
  CRISPR gRNA sequence
caaatgaggaagtaaaattt

SEQ ID NO: 302085 - DNA, 20 bp, Artificial
  CRISPR gRNA sequence
aaatgaggaagtaaaatttc

SEQ ID NO: 302086 - DNA, 20 bp, Artificial
  CRISPR gRNA sequence
aatgaggaagtaaaatttca

SEQ ID NO: 302087 - DNA, 20 bp, Artificial
  CRISPR gRNA sequence
atgaggaagtaaaatttcag

SEQ ID NO: 302088 - DNA, 20 bp, Artificial
  CRISPR gRNA sequence
tgaggaagtaaaatttcagg

SEQ ID NO: 302089 - DNA, 20 bp, Artificial
  CRISPR gRNA sequence
aggaagtaaaatttcagggg

SEQ ID NO: 302090 - DNA, 20 bp, Artificial
  CRISPR gRNA sequence
aatttcagggggagctattt

SEQ ID NO: 302091 - DNA, 20 bp, Artificial
  CRISPR gRNA sequence
tattttagtttttctcccaa

SEQ ID NO: 302092 - DNA, 20 bp, Artificial
  CRISPR gRNA sequence
attttagtttttctcccaat

SEQ ID NO: 302093 - DNA, 20 bp, Artificial
  CRISPR gRNA sequence
tagtttttctcccaatgggt

SEQ ID NO: 302094 - DNA, 20 bp, Artificial
  CRISPR gRNA sequence
tctcccaatgggtaagctga

SEQ ID NO: 302095 - DNA, 20 bp, Artificial
  CRISPR gRNA sequence
ctcccaatgggtaagctgat

SEQ ID NO: 302096 - DNA, 20 bp, Artificial
  CRISPR gRNA sequence
tcccaatgggtaagctgata

SEQ ID NO: 302097 - DNA, 20 bp, Artificial
  CRISPR gRNA sequence
ctgatagggtgatttctgtt

SEQ ID NO: 302098 - DNA, 20 bp, Artificial
  CRISPR gRNA sequence
tgatagggtgatttctgttt

SEQ ID NO: 302099 - DNA, 20 bp, Artificial
  CRISPR gRNA sequence
gggtgatttctgtttgggaa

SEQ ID NO: 302100 - DNA, 20 bp, Artificial
  CRISPR gRNA sequence
gatttctgtttgggaaaaga

SEQ ID NO: 302101 - DNA, 20 bp, Artificial
  CRISPR gRNA sequence
tgggaaaagacagtaattca

SEQ ID NO: 302102 - DNA, 20 bp, Artificial
  CRISPR gRNA sequence
cctatttgacaaaacaaaaa

SEQ ID NO: 302103 - DNA, 20 bp, Artificial
  CRISPR gRNA sequence
tatttgacaaaacaaaaaaa

SEQ ID NO: 302104 - DNA, 20 bp, Artificial
  CRISPR gRNA sequence
ttgacaaaacaaaaaaagag

SEQ ID NO: 302105 - DNA, 20 bp, Artificial
  CRISPR gRNA sequence
gacaaaacaaaaaaagagaa

SEQ ID NO: 302106 - DNA, 20 bp, Artificial
  CRISPR gRNA sequence
caaaacaaaaaaagagaaga

SEQ ID NO: 302107 - DNA, 20 bp, Artificial
  CRISPR gRNA sequence
caaaaaaagagaagagagat

SEQ ID NO: 302108 - DNA, 20 bp, Artificial
  CRISPR gRNA sequence
agagaagagagattggaaac

SEQ ID NO: 302109 - DNA, 20 bp, Artificial
  CRISPR gRNA sequence
aagagagattggaaactggc

SEQ ID NO: 302110 - DNA, 20 bp, Artificial
  CRISPR gRNA sequence
gaaactggctagaataacta

SEQ ID NO: 302111 - DNA, 20 bp, Artificial
  CRISPR gRNA sequence
ttcctttttattcatttaaa

SEQ ID NO: 302112 - DNA, 20 bp, Artificial
  CRISPR gRNA sequence
ttcatttaaacagcctaaac

SEQ ID NO: 302113 - DNA, 20 bp, Artificial
  CRISPR gRNA sequence
tcatttaaacagcctaaact

SEQ ID NO: 302114 - DNA, 20 bp, Artificial
  CRISPR gRNA sequence
ctaaactgggtaaatatata

SEQ ID NO: 302115 - DNA, 20 bp, Artificial
  CRISPR gRNA sequence
ctgggtaaatatatacagtt

SEQ ID NO: 302116 - DNA, 20 bp, Artificial
  CRISPR gRNA sequence
tgggtaaatatatacagttg

SEQ ID NO: 302117 - DNA, 20 bp, Artificial
  CRISPR gRNA sequence
aaatatatacagttgaggca

SEQ ID NO: 302118 - DNA, 20 bp, Artificial
  CRISPR gRNA sequence
aggcatagaaaaactataat

SEQ ID NO: 302119 - DNA, 20 bp, Artificial
  CRISPR gRNA sequence
aaactataatgagaaaacac

SEQ ID NO: 302120 - DNA, 20 bp, Artificial
  CRISPR gRNA sequence
tataatgagaaaacactgga

SEQ ID NO: 302121 - DNA, 20 bp, Artificial
  CRISPR gRNA sequence
ataatgagaaaacactggat

SEQ ID NO: 302122 - DNA, 20 bp, Artificial
  CRISPR gRNA sequence
aaaacactggataggacttt

SEQ ID NO: 302123 - DNA, 20 bp, Artificial
  CRISPR gRNA sequence
tggataggacttttggtgcc

SEQ ID NO: 302124 - DNA, 20 bp, Artificial
  CRISPR gRNA sequence
taggacttttggtgccaagt

SEQ ID NO: 302125 - DNA, 20 bp, Artificial
  CRISPR gRNA sequence
acttttggtgccaagttagt

SEQ ID NO: 302126 - DNA, 20 bp, Artificial
  CRISPR gRNA sequence
ggtgccaagttagttagttt

SEQ ID NO: 302127 - DNA, 20 bp, Artificial
  CRISPR gRNA sequence
gtgccaagttagttagtttg

SEQ ID NO: 302128 - DNA, 20 bp, Artificial
  CRISPR gRNA sequence
gtttgaggaccgtctcctct

SEQ ID NO: 302129 - DNA, 20 bp, Artificial
  CRISPR gRNA sequence
gaggaccgtctcctctgaga

SEQ ID NO: 302130 - DNA, 20 bp, Artificial
  CRISPR gRNA sequence
aggaccgtctcctctgagaa

SEQ ID NO: 302131 - DNA, 20 bp, Artificial
  CRISPR gRNA sequence
ggaccgtctcctctgagaaa

SEQ ID NO: 302132 - DNA, 20 bp, Artificial
  CRISPR gRNA sequence
tctgagaaagggattaacac

SEQ ID NO: 302133 - DNA, 20 bp, Artificial
  CRISPR gRNA sequence
tgagaaagggattaacactg

SEQ ID NO: 302134 - DNA, 20 bp, Artificial
  CRISPR gRNA sequence
gaaagggattaacactggag

SEQ ID NO: 302135 - DNA, 20 bp, Artificial
  CRISPR gRNA sequence
aaagggattaacactggagt

SEQ ID NO: 302136 - DNA, 20 bp, Artificial
  CRISPR gRNA sequence
agggattaacactggagtag

SEQ ID NO: 302137 - DNA, 20 bp, Artificial
  CRISPR gRNA sequence
gggattaacactggagtagg

SEQ ID NO: 302138 - DNA, 20 bp, Artificial
  CRISPR gRNA sequence
attaacactggagtaggagg

SEQ ID NO: 302139 - DNA, 20 bp, Artificial
  CRISPR gRNA sequence
gtaggaggaagctccacttt

SEQ ID NO: 302140 - DNA, 20 bp, Artificial
  CRISPR gRNA sequence
aggaggaagctccacttttg

SEQ ID NO: 302141 - DNA, 20 bp, Artificial
  CRISPR gRNA sequence
acttttggagaaattcctac

SEQ ID NO: 302142 - DNA, 20 bp, Artificial
  CRISPR gRNA sequence
gagaaattcctaccagttat

SEQ ID NO: 302143 - DNA, 20 bp, Artificial
  CRISPR gRNA sequence
aattcctaccagttatcagt

SEQ ID NO: 302144 - DNA, 20 bp, Artificial
  CRISPR gRNA sequence
tcagtaagcttgtgtctctg

SEQ ID NO: 302145 - DNA, 20 bp, Artificial
  CRISPR gRNA sequence
agtaagcttgtgtctctgtg

SEQ ID NO: 302146 - DNA, 20 bp, Artificial
  CRISPR gRNA sequence
gtaagcttgtgtctctgtgg

SEQ ID NO: 302147 - DNA, 20 bp, Artificial
  CRISPR gRNA sequence
taagcttgtgtctctgtgga

SEQ ID NO: 302148 - DNA, 20 bp, Artificial
  CRISPR gRNA sequence
gggatctgctgtttccacat

SEQ ID NO: 302149 - DNA, 20 bp, Artificial
  CRISPR gRNA sequence
ctgtttccacattggtctct

SEQ ID NO: 302150 - DNA, 20 bp, Artificial
  CRISPR gRNA sequence
tttccacattggtctcttgg

SEQ ID NO: 302151 - DNA, 20 bp, Artificial
  CRISPR gRNA sequence
attggtctcttggcagaatt

SEQ ID NO: 302152 - DNA, 20 bp, Artificial
  CRISPR gRNA sequence
tggcagaattcagctcctta

SEQ ID NO: 302153 - DNA, 20 bp, Artificial
  CRISPR gRNA sequence
aattcagctccttatagttg

SEQ ID NO: 302154 - DNA, 20 bp, Artificial
  CRISPR gRNA sequence
ctccttatagttgcagaact

SEQ ID NO: 302155 - DNA, 20 bp, Artificial
  CRISPR gRNA sequence
tgagatcctaatttccttaa

SEQ ID NO: 302156 - DNA, 20 bp, Artificial
  CRISPR gRNA sequence
atcctaatttccttaatggc

SEQ ID NO: 302157 - DNA, 20 bp, Artificial
  CRISPR gRNA sequence
ttaatggctggctgtcaact

SEQ ID NO: 302158 - DNA, 20 bp, Artificial
  CRISPR gRNA sequence
aatggctggctgtcaactga

SEQ ID NO: 302159 - DNA, 20 bp, Artificial
  CRISPR gRNA sequence
tgtcaactgagagccacttc

SEQ ID NO: 302160 - DNA, 20 bp, Artificial
  CRISPR gRNA sequence
tgagagccacttccagcttc

SEQ ID NO: 302161 - DNA, 20 bp, Artificial
  CRISPR gRNA sequence
gagccacttccagcttctag

SEQ ID NO: 302162 - DNA, 20 bp, Artificial
  CRISPR gRNA sequence
tagaagctacttacattcct

SEQ ID NO: 302163 - DNA, 20 bp, Artificial
  CRISPR gRNA sequence
tacttacattccttggctca

SEQ ID NO: 302164 - DNA, 20 bp, Artificial
  CRISPR gRNA sequence
gcttcctccttccatcttca

SEQ ID NO: 302165 - DNA, 20 bp, Artificial
  CRISPR gRNA sequence
cctccttccatcttcaaagc

SEQ ID NO: 302166 - DNA, 20 bp, Artificial
  CRISPR gRNA sequence
atcttcaaagctagaaatgc

SEQ ID NO: 302167 - DNA, 20 bp, Artificial
  CRISPR gRNA sequence
tcttcaaagctagaaatgct

SEQ ID NO: 302168 - DNA, 20 bp, Artificial
  CRISPR gRNA sequence
aaagctagaaatgctgggtt

SEQ ID NO: 302169 - DNA, 20 bp, Artificial
  CRISPR gRNA sequence
aatgctgggttgagcttctc

SEQ ID NO: 302170 - DNA, 20 bp, Artificial
  CRISPR gRNA sequence
gggttgagcttctcaagttt

SEQ ID NO: 302171 - DNA, 20 bp, Artificial
  CRISPR gRNA sequence
tttcagatctctccttcttc

SEQ ID NO: 302172 - DNA, 20 bp, Artificial
  CRISPR gRNA sequence
tccagttcatttctccatcc

SEQ ID NO: 302173 - DNA, 20 bp, Artificial
  CRISPR gRNA sequence
gttcatttctccatcccagc

SEQ ID NO: 302174 - DNA, 20 bp, Artificial
  CRISPR gRNA sequence
ttcatttctccatcccagct

SEQ ID NO: 302175 - DNA, 20 bp, Artificial
  CRISPR gRNA sequence
tttctccatcccagctagga

SEQ ID NO: 302176 - DNA, 20 bp, Artificial
  CRISPR gRNA sequence
ttctccatcccagctaggaa

SEQ ID NO: 302177 - DNA, 20 bp, Artificial
  CRISPR gRNA sequence
tctgactcatgtgattacat

SEQ ID NO: 302178 - DNA, 20 bp, Artificial
  CRISPR gRNA sequence
ctgactcatgtgattacatt

SEQ ID NO: 302179 - DNA, 20 bp, Artificial
  CRISPR gRNA sequence
gtgattacattgggcccacc

SEQ ID NO: 302180 - DNA, 20 bp, Artificial
  CRISPR gRNA sequence
ttgggcccacctggataatc

SEQ ID NO: 302181 - DNA, 20 bp, Artificial
  CRISPR gRNA sequence
tgggcccacctggataatcc

SEQ ID NO: 302182 - DNA, 20 bp, Artificial
  CRISPR gRNA sequence
caggttaatctcaccatctc

SEQ ID NO: 302183 - DNA, 20 bp, Artificial
  CRISPR gRNA sequence
taatctcaccatctcaagct

SEQ ID NO: 302184 - DNA, 20 bp, Artificial
  CRISPR gRNA sequence
gtgccttaatcacctatgtg

SEQ ID NO: 302185 - DNA, 20 bp, Artificial
  CRISPR gRNA sequence
tgaagttccttttgccatgt

SEQ ID NO: 302186 - DNA, 20 bp, Artificial
  CRISPR gRNA sequence
ccatgtaagataacatatta

SEQ ID NO: 302187 - DNA, 20 bp, Artificial
  CRISPR gRNA sequence
catgtaagataacatattac

SEQ ID NO: 302188 - DNA, 20 bp, Artificial
  CRISPR gRNA sequence
agataacatattacaggttc

SEQ ID NO: 302189 - DNA, 20 bp, Artificial
  CRISPR gRNA sequence
ataacatattacaggttctg

SEQ ID NO: 302190 - DNA, 20 bp, Artificial
  CRISPR gRNA sequence
atattacaggttctggagta

SEQ ID NO: 302191 - DNA, 20 bp, Artificial
  CRISPR gRNA sequence
tattacaggttctggagtat

SEQ ID NO: 302192 - DNA, 20 bp, Artificial
  CRISPR gRNA sequence
ttacaggttctggagtatag

SEQ ID NO: 302193 - DNA, 20 bp, Artificial
  CRISPR gRNA sequence
tacaggttctggagtatagg

SEQ ID NO: 302194 - DNA, 20 bp, Artificial
  CRISPR gRNA sequence
aggttctggagtataggagg

SEQ ID NO: 302195 - DNA, 20 bp, Artificial
  CRISPR gRNA sequence
tataggaggtggacgtcttg

SEQ ID NO: 302196 - DNA, 20 bp, Artificial
  CRISPR gRNA sequence
ataggaggtggacgtcttgt

SEQ ID NO: 302197 - DNA, 20 bp, Artificial
  CRISPR gRNA sequence
taggaggtggacgtcttgtg

SEQ ID NO: 302198 - DNA, 20 bp, Artificial
  CRISPR gRNA sequence
aggaggtggacgtcttgtgg

SEQ ID NO: 302199 - DNA, 20 bp, Artificial
  CRISPR gRNA sequence
ggaggtggacgtcttgtggg

SEQ ID NO: 302200 - DNA, 20 bp, Artificial
  CRISPR gRNA sequence
gcattattttacctatcaca

SEQ ID NO: 302201 - DNA, 20 bp, Artificial
  CRISPR gRNA sequence
acctatcacatagccaatgc

SEQ ID NO: 302202 - DNA, 20 bp, Artificial
  CRISPR gRNA sequence
cctatcacatagccaatgcc

SEQ ID NO: 302203 - DNA, 20 bp, Artificial
  CRISPR gRNA sequence
tatcacatagccaatgccag

SEQ ID NO: 302204 - DNA, 20 bp, Artificial
  CRISPR gRNA sequence
caatgccaggagtacccaca

SEQ ID NO: 302205 - DNA, 20 bp, Artificial
  CRISPR gRNA sequence
caggagtacccacaaagcaa

SEQ ID NO: 302206 - DNA, 20 bp, Artificial
  CRISPR gRNA sequence
gagtacccacaaagcaatgg

SEQ ID NO: 302207 - DNA, 20 bp, Artificial
  CRISPR gRNA sequence
agcaatggcagatattgctg

SEQ ID NO: 302208 - DNA, 20 bp, Artificial
  CRISPR gRNA sequence
ggcagatattgctgaagtta

SEQ ID NO: 302209 - DNA, 20 bp, Artificial
  CRISPR gRNA sequence
caaatatatcatatctataa

SEQ ID NO: 302210 - DNA, 20 bp, Artificial
  CRISPR gRNA sequence
atatcatatctataatggca

SEQ ID NO: 302211 - DNA, 20 bp, Artificial
  CRISPR gRNA sequence
ctgttgcacctccctcccta

SEQ ID NO: 302212 - DNA, 20 bp, Artificial
  CRISPR gRNA sequence
cacctccctccctacagtga

SEQ ID NO: 302213 - DNA, 20 bp, Artificial
  CRISPR gRNA sequence
tccctccctacagtgatagc

SEQ ID NO: 302214 - DNA, 20 bp, Artificial
  CRISPR gRNA sequence
ccctccctacagtgatagca

SEQ ID NO: 302215 - DNA, 20 bp, Artificial
  CRISPR gRNA sequence
cttctctctttgatcaaact

SEQ ID NO: 302216 - DNA, 20 bp, Artificial
  CRISPR gRNA sequence
ctctctttgatcaaactcag

SEQ ID NO: 302217 - DNA, 20 bp, Artificial
  CRISPR gRNA sequence
tttgatcaaactcagtggca

SEQ ID NO: 302218 - DNA, 20 bp, Artificial
  CRISPR gRNA sequence
aatattcttcattacattct

SEQ ID NO: 302219 - DNA, 20 bp, Artificial
  CRISPR gRNA sequence
atattcttcattacattctt

SEQ ID NO: 302220 - DNA, 20 bp, Artificial
  CRISPR gRNA sequence
tattcttcattacattctta

SEQ ID NO: 302221 - DNA, 20 bp, Artificial
  CRISPR gRNA sequence
attcttcattacattcttag

SEQ ID NO: 302222 - DNA, 20 bp, Artificial
  CRISPR gRNA sequence
ggggtcatgtatgtgccact

SEQ ID NO: 302223 - DNA, 20 bp, Artificial
  CRISPR gRNA sequence
gaccatctcatctgtaccta

SEQ ID NO: 302224 - DNA, 20 bp, Artificial
  CRISPR gRNA sequence
ccatctcatctgtacctaca

SEQ ID NO: 302225 - DNA, 20 bp, Artificial
  CRISPR gRNA sequence
tcctctttatctcccctatc

SEQ ID NO: 302226 - DNA, 20 bp, Artificial
  CRISPR gRNA sequence
atttttttctgattgcctca

SEQ ID NO: 302227 - DNA, 20 bp, Artificial
  CRISPR gRNA sequence
ttttttctgattgcctcatg

SEQ ID NO: 302228 - DNA, 20 bp, Artificial
  CRISPR gRNA sequence
tttttctgattgcctcatgg

SEQ ID NO: 302229 - DNA, 20 bp, Artificial
  CRISPR gRNA sequence
ttctgattgcctcatggagg

SEQ ID NO: 302230 - DNA, 20 bp, Artificial
  CRISPR gRNA sequence
cccttctttgtttcatttgt

SEQ ID NO: 302231 - DNA, 20 bp, Artificial
  CRISPR gRNA sequence
aagctgatcattctaatgtg

SEQ ID NO: 302232 - DNA, 20 bp, Artificial
  CRISPR gRNA sequence
ttctaatgtgaagaaaaatc

SEQ ID NO: 302233 - DNA, 20 bp, Artificial
  CRISPR gRNA sequence
gtgaagaaaaatctagcaaa

SEQ ID NO: 302234 - DNA, 20 bp, Artificial
  CRISPR gRNA sequence
ctagcaaacagcttattccc

SEQ ID NO: 302235 - DNA, 20 bp, Artificial
  CRISPR gRNA sequence
acagcttattcccaagatgt

SEQ ID NO: 302236 - DNA, 20 bp, Artificial
  CRISPR gRNA sequence
catatttgactaattttaaa

SEQ ID NO: 302237 - DNA, 20 bp, Artificial
  CRISPR gRNA sequence
gactaattttaaatggcaat

SEQ ID NO: 302238 - DNA, 20 bp, Artificial
  CRISPR gRNA sequence
actaattttaaatggcaatg

SEQ ID NO: 302239 - DNA, 20 bp, Artificial
  CRISPR gRNA sequence
ttaaatggcaatgaggttga

SEQ ID NO: 302240 - DNA, 20 bp, Artificial
  CRISPR gRNA sequence
atggcaatgaggttgaaaga

SEQ ID NO: 302241 - DNA, 20 bp, Artificial
  CRISPR gRNA sequence
aatgaggttgaaagaaagtg

SEQ ID NO: 302242 - DNA, 20 bp, Artificial
  CRISPR gRNA sequence
ctcaaaactctcaccttgaa

SEQ ID NO: 302243 - DNA, 20 bp, Artificial
  CRISPR gRNA sequence
actctcaccttgaaaagtca

SEQ ID NO: 302244 - DNA, 20 bp, Artificial
  CRISPR gRNA sequence
caccttgaaaagtcaaagcc

SEQ ID NO: 302245 - DNA, 20 bp, Artificial
  CRISPR gRNA sequence
tgaaaagtcaaagcctggac

SEQ ID NO: 302246 - DNA, 20 bp, Artificial
  CRISPR gRNA sequence
atatgtctttacatctgtgc

SEQ ID NO: 302247 - DNA, 20 bp, Artificial
  CRISPR gRNA sequence
tatgtctttacatctgtgct

SEQ ID NO: 302248 - DNA, 20 bp, Artificial
  CRISPR gRNA sequence
aattttatacttttatatca

SEQ ID NO: 302249 - DNA, 20 bp, Artificial
  CRISPR gRNA sequence
tttatatcatagaaatctcg

SEQ ID NO: 302250 - DNA, 20 bp, Artificial
  CRISPR gRNA sequence
tcgcagcacactccatacat

SEQ ID NO: 302251 - DNA, 20 bp, Artificial
  CRISPR gRNA sequence
cagcacactccatacattgg

SEQ ID NO: 302252 - DNA, 20 bp, Artificial
  CRISPR gRNA sequence
ccatacattggcagtttgaa

SEQ ID NO: 302253 - DNA, 20 bp, Artificial
  CRISPR gRNA sequence
tccccaatttcttattttta

SEQ ID NO: 302254 - DNA, 20 bp, Artificial
  CRISPR gRNA sequence
aatttcttatttttaaagta

SEQ ID NO: 302255 - DNA, 20 bp, Artificial
  CRISPR gRNA sequence
ttcttatttttaaagtacag

SEQ ID NO: 302256 - DNA, 20 bp, Artificial
  CRISPR gRNA sequence
tcttatttttaaagtacagc

SEQ ID NO: 302257 - DNA, 20 bp, Artificial
  CRISPR gRNA sequence
aatgtcatccatctattttc

SEQ ID NO: 302258 - DNA, 20 bp, Artificial
  CRISPR gRNA sequence
tcatccatctattttctagt

SEQ ID NO: 302259 - DNA, 20 bp, Artificial
  CRISPR gRNA sequence
ttctagttagattttaaaat

SEQ ID NO: 302260 - DNA, 20 bp, Artificial
  CRISPR gRNA sequence
aaatcagtatactgaaaaac

SEQ ID NO: 302261 - DNA, 20 bp, Artificial
  CRISPR gRNA sequence
tatactgaaaaacaagatgc

SEQ ID NO: 302262 - DNA, 20 bp, Artificial
  CRISPR gRNA sequence
ctgaaaaacaagatgctggc

SEQ ID NO: 302263 - DNA, 20 bp, Artificial
  CRISPR gRNA sequence
gaaaaacaagatgctggcca

SEQ ID NO: 302264 - DNA, 20 bp, Artificial
  CRISPR gRNA sequence
aaaaacaagatgctggccag

SEQ ID NO: 302265 - DNA, 20 bp, Artificial
  CRISPR gRNA sequence
catcttgtgctttctaccat

SEQ ID NO: 302266 - DNA, 20 bp, Artificial
  CRISPR gRNA sequence
ttgtgctttctaccataagt

SEQ ID NO: 302267 - DNA, 20 bp, Artificial
  CRISPR gRNA sequence
gctttctaccataagtgagt

SEQ ID NO: 302268 - DNA, 20 bp, Artificial
  CRISPR gRNA sequence
ttctaccataagtgagttag

SEQ ID NO: 302269 - DNA, 20 bp, Artificial
  CRISPR gRNA sequence
tctaccataagtgagttaga

SEQ ID NO: 302270 - DNA, 20 bp, Artificial
  CRISPR gRNA sequence
tagaaggttaccttaattat

SEQ ID NO: 302271 - DNA, 20 bp, Artificial
  CRISPR gRNA sequence
ccaatcaaactaattactac

SEQ ID NO: 302272 - DNA, 20 bp, Artificial
  CRISPR gRNA sequence
aatcaaactaattactactg

SEQ ID NO: 302273 - DNA, 20 bp, Artificial
  CRISPR gRNA sequence
atcaaactaattactactgg

SEQ ID NO: 302274 - DNA, 20 bp, Artificial
  CRISPR gRNA sequence
tactactggaggcaattact

SEQ ID NO: 302275 - DNA, 20 bp, Artificial
  CRISPR gRNA sequence
tggaggcaattactgagata

SEQ ID NO: 302276 - DNA, 20 bp, Artificial
  CRISPR gRNA sequence
actgagataaagtccaatct

SEQ ID NO: 302277 - DNA, 20 bp, Artificial
  CRISPR gRNA sequence
gataaagtccaatcttagct

SEQ ID NO: 302278 - DNA, 20 bp, Artificial
  CRISPR gRNA sequence
gtccaatcttagcttagaac

SEQ ID NO: 302279 - DNA, 20 bp, Artificial
  CRISPR gRNA sequence
gaaccagaccaaactacaaa

SEQ ID NO: 302280 - DNA, 20 bp, Artificial
  CRISPR gRNA sequence
aaccagaccaaactacaaaa

SEQ ID NO: 302281 - DNA, 20 bp, Artificial
  CRISPR gRNA sequence
gaccaaactacaaaaaggca

SEQ ID NO: 302282 - DNA, 20 bp, Artificial
  CRISPR gRNA sequence
aaaggcatggcattattata

SEQ ID NO: 302283 - DNA, 20 bp, Artificial
  CRISPR gRNA sequence
gcatggcattattataaagt

SEQ ID NO: 302284 - DNA, 20 bp, Artificial
  CRISPR gRNA sequence
catggcattattataaagtt

SEQ ID NO: 302285 - DNA, 20 bp, Artificial
  CRISPR gRNA sequence
atggcattattataaagtta

SEQ ID NO: 302286 - DNA, 20 bp, Artificial
  CRISPR gRNA sequence
cccatgaaacatttttataa

SEQ ID NO: 302287 - DNA, 20 bp, Artificial
  CRISPR gRNA sequence
atgaaacatttttataacag

SEQ ID NO: 302288 - DNA, 20 bp, Artificial
  CRISPR gRNA sequence
aacatttttataacagaagt

SEQ ID NO: 302289 - DNA, 20 bp, Artificial
  CRISPR gRNA sequence
atttttataacagaagtcag

SEQ ID NO: 302290 - DNA, 20 bp, Artificial
  CRISPR gRNA sequence
tttttataacagaagtcagt

SEQ ID NO: 302291 - DNA, 20 bp, Artificial
  CRISPR gRNA sequence
ttttataacagaagtcagtg

SEQ ID NO: 302292 - DNA, 20 bp, Artificial
  CRISPR gRNA sequence
ttataacagaagtcagtggg

SEQ ID NO: 302293 - DNA, 20 bp, Artificial
  CRISPR gRNA sequence
tataacagaagtcagtgggg

SEQ ID NO: 302294 - DNA, 20 bp, Artificial
  CRISPR gRNA sequence
ataacagaagtcagtgggga

SEQ ID NO: 302295 - DNA, 20 bp, Artificial
  CRISPR gRNA sequence
gtttataataacaaaactat

SEQ ID NO: 302296 - DNA, 20 bp, Artificial
  CRISPR gRNA sequence
caaaactattggactaactc

SEQ ID NO: 302297 - DNA, 20 bp, Artificial
  CRISPR gRNA sequence
aactcaagtgtccaaaaaat

SEQ ID NO: 302298 - DNA, 20 bp, Artificial
  CRISPR gRNA sequence
actcaagtgtccaaaaaatg

SEQ ID NO: 302299 - DNA, 20 bp, Artificial
  CRISPR gRNA sequence
aagtgtccaaaaaatgaggt

SEQ ID NO: 302300 - DNA, 20 bp, Artificial
  CRISPR gRNA sequence
ttggttaaataaataaatta

SEQ ID NO: 302301 - DNA, 20 bp, Artificial
  CRISPR gRNA sequence
aaattatggtgtatccacaa

SEQ ID NO: 302302 - DNA, 20 bp, Artificial
  CRISPR gRNA sequence
aattatggtgtatccacaaa

SEQ ID NO: 302303 - DNA, 20 bp, Artificial
  CRISPR gRNA sequence
attatggtgtatccacaaaa

SEQ ID NO: 302304 - DNA, 20 bp, Artificial
  CRISPR gRNA sequence
ccacaaaagggaatatcttg

SEQ ID NO: 302305 - DNA, 20 bp, Artificial
  CRISPR gRNA sequence
agccattaaaaatgatgctg

SEQ ID NO: 302306 - DNA, 20 bp, Artificial
  CRISPR gRNA sequence
gaaaattgtcttgctacatt

SEQ ID NO: 302307 - DNA, 20 bp, Artificial
  CRISPR gRNA sequence
tacatttagtataacaaaat

SEQ ID NO: 302308 - DNA, 20 bp, Artificial
  CRISPR gRNA sequence
agtataacaaaattagaaca

SEQ ID NO: 302309 - DNA, 20 bp, Artificial
  CRISPR gRNA sequence
ccttatgataatcctaatta

SEQ ID NO: 302310 - DNA, 20 bp, Artificial
  CRISPR gRNA sequence
cctaattatggaaaacaaca

SEQ ID NO: 302311 - DNA, 20 bp, Artificial
  CRISPR gRNA sequence
aaacaacatagattgataca

SEQ ID NO: 302312 - DNA, 20 bp, Artificial
  CRISPR gRNA sequence
tgatacacagaaaaatctta

SEQ ID NO: 302313 - DNA, 20 bp, Artificial
  CRISPR gRNA sequence
acacagaaaaatcttaaaga

SEQ ID NO: 302314 - DNA, 20 bp, Artificial
  CRISPR gRNA sequence
cacagaaaaatcttaaagat

SEQ ID NO: 302315 - DNA, 20 bp, Artificial
  CRISPR gRNA sequence
gtgtaatcattttttcttat

SEQ ID NO: 302316 - DNA, 20 bp, Artificial
  CRISPR gRNA sequence
taatcattttttcttattag

SEQ ID NO: 302317 - DNA, 20 bp, Artificial
  CRISPR gRNA sequence
atcattttttcttattagtg

SEQ ID NO: 302318 - DNA, 20 bp, Artificial
  CRISPR gRNA sequence
ttttcttattagtggagtta

SEQ ID NO: 302319 - DNA, 20 bp, Artificial
  CRISPR gRNA sequence
gttatagattattttatttt

SEQ ID NO: 302320 - DNA, 20 bp, Artificial
  CRISPR gRNA sequence
atttttggtatatatgataa

SEQ ID NO: 302321 - DNA, 20 bp, Artificial
  CRISPR gRNA sequence
gataatggatatgtattact

SEQ ID NO: 302322 - DNA, 20 bp, Artificial
  CRISPR gRNA sequence
gatatgtattacttagaaat

SEQ ID NO: 302323 - DNA, 20 bp, Artificial
  CRISPR gRNA sequence
tattacttagaaattagtta

SEQ ID NO: 302324 - DNA, 20 bp, Artificial
  CRISPR gRNA sequence
aagttaatattgtttgttat

SEQ ID NO: 302325 - DNA, 20 bp, Artificial
  CRISPR gRNA sequence
tattgtttgttataagtcaa

SEQ ID NO: 302326 - DNA, 20 bp, Artificial
  CRISPR gRNA sequence
attgtttgttataagtcaat

SEQ ID NO: 302327 - DNA, 20 bp, Artificial
  CRISPR gRNA sequence
attcatctaacttatttcat

SEQ ID NO: 302328 - DNA, 20 bp, Artificial
  CRISPR gRNA sequence
aacttatttcataagaaacc

SEQ ID NO: 302329 - DNA, 20 bp, Artificial
  CRISPR gRNA sequence
ataagaaacctagatttttt

SEQ ID NO: 302330 - DNA, 20 bp, Artificial
  CRISPR gRNA sequence
aagaaacctagattttttta

SEQ ID NO: 302331 - DNA, 20 bp, Artificial
  CRISPR gRNA sequence
acctagatttttttagagac

SEQ ID NO: 302332 - DNA, 20 bp, Artificial
  CRISPR gRNA sequence
tagatttttttagagacgag

SEQ ID NO: 302333 - DNA, 20 bp, Artificial
  CRISPR gRNA sequence
agacgagaagctgattcttg

SEQ ID NO: 302334 - DNA, 20 bp, Artificial
  CRISPR gRNA sequence
agctgattcttgtggtcatt

SEQ ID NO: 302335 - DNA, 20 bp, Artificial
  CRISPR gRNA sequence
tatccctgcttaaacaccac

SEQ ID NO: 302336 - DNA, 20 bp, Artificial
  CRISPR gRNA sequence
atccctgcttaaacaccacc

SEQ ID NO: 302337 - DNA, 20 bp, Artificial
  CRISPR gRNA sequence
ggtccacaatctttaacatt

SEQ ID NO: 302338 - DNA, 20 bp, Artificial
  CRISPR gRNA sequence
gtccacaatctttaacattt

SEQ ID NO: 302339 - DNA, 20 bp, Artificial
  CRISPR gRNA sequence
ccacaatctttaacatttag

SEQ ID NO: 302340 - DNA, 20 bp, Artificial
  CRISPR gRNA sequence
caatctttaacatttaggag

SEQ ID NO: 302341 - DNA, 20 bp, Artificial
  CRISPR gRNA sequence
tttactttatgtatatgtca

SEQ ID NO: 302342 - DNA, 20 bp, Artificial
  CRISPR gRNA sequence
tatgtcacagtaacctcatg

SEQ ID NO: 302343 - DNA, 20 bp, Artificial
  CRISPR gRNA sequence
tcacagtaacctcatgaagt

SEQ ID NO: 302344 - DNA, 20 bp, Artificial
  CRISPR gRNA sequence
cacagtaacctcatgaagtg

SEQ ID NO: 302345 - DNA, 20 bp, Artificial
  CRISPR gRNA sequence
agtaacctcatgaagtgagg

SEQ ID NO: 302346 - DNA, 20 bp, Artificial
  CRISPR gRNA sequence
ctcatgaagtgaggtagata

SEQ ID NO: 302347 - DNA, 20 bp, Artificial
  CRISPR gRNA sequence
tgaagtgaggtagataaagc

SEQ ID NO: 302348 - DNA, 20 bp, Artificial
  CRISPR gRNA sequence
tagataaagcaagtaataat

SEQ ID NO: 302349 - DNA, 20 bp, Artificial
  CRISPR gRNA sequence
aagtaataatcagttttccc

SEQ ID NO: 302350 - DNA, 20 bp, Artificial
  CRISPR gRNA sequence
aatcagttttccctggaaac

SEQ ID NO: 302351 - DNA, 20 bp, Artificial
  CRISPR gRNA sequence
cagttttccctggaaaccag

SEQ ID NO: 302352 - DNA, 20 bp, Artificial
  CRISPR gRNA sequence
ccagaagtacatttgtaaac

SEQ ID NO: 302353 - DNA, 20 bp, Artificial
  CRISPR gRNA sequence
agaagtacatttgtaaacca

SEQ ID NO: 302354 - DNA, 20 bp, Artificial
  CRISPR gRNA sequence
gaagtacatttgtaaaccag

SEQ ID NO: 302355 - DNA, 20 bp, Artificial
  CRISPR gRNA sequence
tacatttgtaaaccagaggt

SEQ ID NO: 302356 - DNA, 20 bp, Artificial
  CRISPR gRNA sequence
agaaatgtcgcctttctttg

SEQ ID NO: 302357 - DNA, 20 bp, Artificial
  CRISPR gRNA sequence
gtcgcctttctttgaagtcc

SEQ ID NO: 302358 - DNA, 20 bp, Artificial
  CRISPR gRNA sequence
cgcctttctttgaagtccaa

SEQ ID NO: 302359 - DNA, 20 bp, Artificial
  CRISPR gRNA sequence
ctttctttgaagtccaagag

SEQ ID NO: 302360 - DNA, 20 bp, Artificial
  CRISPR gRNA sequence
gcagcattatctgctactgc

SEQ ID NO: 302361 - DNA, 20 bp, Artificial
  CRISPR gRNA sequence
tctgctactgccagtctgta

SEQ ID NO: 302362 - DNA, 20 bp, Artificial
  CRISPR gRNA sequence
ctgctactgccagtctgtat

SEQ ID NO: 302363 - DNA, 20 bp, Artificial
  CRISPR gRNA sequence
ctgtataggctcaaaactcc

SEQ ID NO: 302364 - DNA, 20 bp, Artificial
  CRISPR gRNA sequence
tgtataggctcaaaactcca

SEQ ID NO: 302365 - DNA, 20 bp, Artificial
  CRISPR gRNA sequence
gtataggctcaaaactccaa

SEQ ID NO: 302366 - DNA, 20 bp, Artificial
  CRISPR gRNA sequence
acaacttcctgactttttgc

SEQ ID NO: 302367 - DNA, 20 bp, Artificial
  CRISPR gRNA sequence
ttcctgactttttgccagtc

SEQ ID NO: 302368 - DNA, 20 bp, Artificial
  CRISPR gRNA sequence
tcctgactttttgccagtct

SEQ ID NO: 302369 - DNA, 20 bp, Artificial
  CRISPR gRNA sequence
actttttgccagtctaggct

SEQ ID NO: 302370 - DNA, 20 bp, Artificial
  CRISPR gRNA sequence
ccagtctaggctcagccaac

SEQ ID NO: 302371 - DNA, 20 bp, Artificial
  CRISPR gRNA sequence
taggctcagccaacaagctc

SEQ ID NO: 302372 - DNA, 20 bp, Artificial
  CRISPR gRNA sequence
gctcagccaacaagctccgg

SEQ ID NO: 302373 - DNA, 20 bp, Artificial
  CRISPR gRNA sequence
ctcagccaacaagctccgga

SEQ ID NO: 302374 - DNA, 20 bp, Artificial
  CRISPR gRNA sequence
agccaacaagctccggaagg

SEQ ID NO: 302375 - DNA, 20 bp, Artificial
  CRISPR gRNA sequence
aacaagctccggaaggcagc

SEQ ID NO: 302376 - DNA, 20 bp, Artificial
  CRISPR gRNA sequence
ccggaaggcagccagccgat

SEQ ID NO: 302377 - DNA, 20 bp, Artificial
  CRISPR gRNA sequence
cggaaggcagccagccgatt

SEQ ID NO: 302378 - DNA, 20 bp, Artificial
  CRISPR gRNA sequence
aaggcagccagccgattggg

SEQ ID NO: 302379 - DNA, 20 bp, Artificial
  CRISPR gRNA sequence
gcagccagccgattgggaag

SEQ ID NO: 302380 - DNA, 20 bp, Artificial
  CRISPR gRNA sequence
cagccagccgattgggaagt

SEQ ID NO: 302381 - DNA, 20 bp, Artificial
  CRISPR gRNA sequence
ccgattgggaagtaggtgca

SEQ ID NO: 302382 - DNA, 20 bp, Artificial
  CRISPR gRNA sequence
gggaagtaggtgcaaagtga

SEQ ID NO: 302383 - DNA, 20 bp, Artificial
  CRISPR gRNA sequence
aggtgcaaagtgacagtctg

SEQ ID NO: 302384 - DNA, 20 bp, Artificial
  CRISPR gRNA sequence
ggtgcaaagtgacagtctgt

SEQ ID NO: 302385 - DNA, 20 bp, Artificial
  CRISPR gRNA sequence
gtgcaaagtgacagtctgtg

SEQ ID NO: 302386 - DNA, 20 bp, Artificial
  CRISPR gRNA sequence
gcaaagtgacagtctgtggg

SEQ ID NO: 302387 - DNA, 20 bp, Artificial
  CRISPR gRNA sequence
caaagtgacagtctgtgggg

SEQ ID NO: 302388 - DNA, 20 bp, Artificial
  CRISPR gRNA sequence
tgacagtctgtggggaggac

SEQ ID NO: 302389 - DNA, 20 bp, Artificial
  CRISPR gRNA sequence
gacagtctgtggggaggaca

SEQ ID NO: 302390 - DNA, 20 bp, Artificial
  CRISPR gRNA sequence
gactcactcaccacatttat

SEQ ID NO: 302391 - DNA, 20 bp, Artificial
  CRISPR gRNA sequence
ctcactcaccacatttataa

SEQ ID NO: 302392 - DNA, 20 bp, Artificial
  CRISPR gRNA sequence
accacatttataagagttgc

SEQ ID NO: 302393 - DNA, 20 bp, Artificial
  CRISPR gRNA sequence
ccacatttataagagttgcg

SEQ ID NO: 302394 - DNA, 20 bp, Artificial
  CRISPR gRNA sequence
ttcttcttcttccatttcca

SEQ ID NO: 302395 - DNA, 20 bp, Artificial
  CRISPR gRNA sequence
ttcttccatttccatagaat

SEQ ID NO: 302396 - DNA, 20 bp, Artificial
  CRISPR gRNA sequence
tccatttccatagaattaga

SEQ ID NO: 302397 - DNA, 20 bp, Artificial
  CRISPR gRNA sequence
atcacacatataataactgt

SEQ ID NO: 302398 - DNA, 20 bp, Artificial
  CRISPR gRNA sequence
acacatataataactgttgg

SEQ ID NO: 302399 - DNA, 20 bp, Artificial
  CRISPR gRNA sequence
tataataactgttggaagta

SEQ ID NO: 302400 - DNA, 20 bp, Artificial
  CRISPR gRNA sequence
tggaagtacagctgtaatcc

SEQ ID NO: 302401 - DNA, 20 bp, Artificial
  CRISPR gRNA sequence
ggaagtacagctgtaatcca

SEQ ID NO: 302402 - DNA, 20 bp, Artificial
  CRISPR gRNA sequence
cagctgtaatccaaggaatg

SEQ ID NO: 302403 - DNA, 20 bp, Artificial
  CRISPR gRNA sequence
gtaatccaaggaatgtggtc

SEQ ID NO: 302404 - DNA, 20 bp, Artificial
  CRISPR gRNA sequence
taatccaaggaatgtggtct

SEQ ID NO: 302405 - DNA, 20 bp, Artificial
  CRISPR gRNA sequence
aatccaaggaatgtggtctg

SEQ ID NO: 302406 - DNA, 20 bp, Artificial
  CRISPR gRNA sequence
atccaaggaatgtggtctgg

SEQ ID NO: 302407 - DNA, 20 bp, Artificial
  CRISPR gRNA sequence
ccaaggaatgtggtctgggg

SEQ ID NO: 302408 - DNA, 20 bp, Artificial
  CRISPR gRNA sequence
caaggaatgtggtctggggg

SEQ ID NO: 302409 - DNA, 20 bp, Artificial
  CRISPR gRNA sequence
aatgtggtctgggggaggct

SEQ ID NO: 302410 - DNA, 20 bp, Artificial
  CRISPR gRNA sequence
atgtggtctgggggaggctg

SEQ ID NO: 302411 - DNA, 20 bp, Artificial
  CRISPR gRNA sequence
tgtggtctgggggaggctga

SEQ ID NO: 302412 - DNA, 20 bp, Artificial
  CRISPR gRNA sequence
gggggaggctgagggtcctc

SEQ ID NO: 302413 - DNA, 20 bp, Artificial
  CRISPR gRNA sequence
aatgaccacaaattttcaat

SEQ ID NO: 302414 - DNA, 20 bp, Artificial
  CRISPR gRNA sequence
accacaaattttcaatcagc

SEQ ID NO: 302415 - DNA, 20 bp, Artificial
  CRISPR gRNA sequence
ccacaaattttcaatcagcc

SEQ ID NO: 302416 - DNA, 20 bp, Artificial
  CRISPR gRNA sequence
acaaattttcaatcagccag

SEQ ID NO: 302417 - DNA, 20 bp, Artificial
  CRISPR gRNA sequence
aaattttcaatcagccagga

SEQ ID NO: 302418 - DNA, 20 bp, Artificial
  CRISPR gRNA sequence
gccaggagagtcatttacaa

SEQ ID NO: 302419 - DNA, 20 bp, Artificial
  CRISPR gRNA sequence
ccaggagagtcatttacaaa

SEQ ID NO: 302420 - DNA, 20 bp, Artificial
  CRISPR gRNA sequence
catttacaaaaggtttctgc

SEQ ID NO: 302421 - DNA, 20 bp, Artificial
  CRISPR gRNA sequence
tcttctctttatttacctgc

SEQ ID NO: 302422 - DNA, 20 bp, Artificial
  CRISPR gRNA sequence
tttacctgccagcctctccc

SEQ ID NO: 302423 - DNA, 20 bp, Artificial
  CRISPR gRNA sequence
ttacctgccagcctctcccc

SEQ ID NO: 302424 - DNA, 20 bp, Artificial
  CRISPR gRNA sequence
tacctgccagcctctcccca

SEQ ID NO: 302425 - DNA, 20 bp, Artificial
  CRISPR gRNA sequence
cagcctctccccagggctct

SEQ ID NO: 302426 - DNA, 20 bp, Artificial
  CRISPR gRNA sequence
agcctctccccagggctcta

SEQ ID NO: 302427 - DNA, 20 bp, Artificial
  CRISPR gRNA sequence
tctccccagggctctaaggc

SEQ ID NO: 302428 - DNA, 20 bp, Artificial
  CRISPR gRNA sequence
tccccagggctctaaggcca

SEQ ID NO: 302429 - DNA, 20 bp, Artificial
  CRISPR gRNA sequence
ccagggctctaaggccagag

SEQ ID NO: 302430 - DNA, 20 bp, Artificial
  CRISPR gRNA sequence
gagaagcctgaaatccacaa

SEQ ID NO: 302431 - DNA, 20 bp, Artificial
  CRISPR gRNA sequence
agaagcctgaaatccacaat

SEQ ID NO: 302432 - DNA, 20 bp, Artificial
  CRISPR gRNA sequence
aagcctgaaatccacaatag

SEQ ID NO: 302433 - DNA, 20 bp, Artificial
  CRISPR gRNA sequence
agcctgaaatccacaatagg

SEQ ID NO: 302434 - DNA, 20 bp, Artificial
  CRISPR gRNA sequence
aaatccacaataggaggcca

SEQ ID NO: 302435 - DNA, 20 bp, Artificial
  CRISPR gRNA sequence
ccacaataggaggccataga

SEQ ID NO: 302436 - DNA, 20 bp, Artificial
  CRISPR gRNA sequence
taggaggccatagaaagtcc

SEQ ID NO: 302437 - DNA, 20 bp, Artificial
  CRISPR gRNA sequence
aggaggccatagaaagtccc

SEQ ID NO: 302438 - DNA, 20 bp, Artificial
  CRISPR gRNA sequence
gccatagaaagtcccaggct

SEQ ID NO: 302439 - DNA, 20 bp, Artificial
  CRISPR gRNA sequence
ccatagaaagtcccaggctc

SEQ ID NO: 302440 - DNA, 20 bp, Artificial
  CRISPR gRNA sequence
catagaaagtcccaggctca

SEQ ID NO: 302441 - DNA, 20 bp, Artificial
  CRISPR gRNA sequence
aagtcccaggctcagggcct

SEQ ID NO: 302442 - DNA, 20 bp, Artificial
  CRISPR gRNA sequence
tcccaggctcagggcctcag

SEQ ID NO: 302443 - DNA, 20 bp, Artificial
  CRISPR gRNA sequence
cagggcctcagcagcgacct

SEQ ID NO: 302444 - DNA, 20 bp, Artificial
  CRISPR gRNA sequence
tcagcagcgacctaagaatc

SEQ ID NO: 302445 - DNA, 20 bp, Artificial
  CRISPR gRNA sequence
aagaatcgagcccatgcctc

SEQ ID NO: 302446 - DNA, 20 bp, Artificial
  CRISPR gRNA sequence
catgcctctggccaaatgcc

SEQ ID NO: 302447 - DNA, 20 bp, Artificial
  CRISPR gRNA sequence
tctggccaaatgcctggact

SEQ ID NO: 302448 - DNA, 20 bp, Artificial
  CRISPR gRNA sequence
actgagctgccatgccttca

SEQ ID NO: 302449 - DNA, 20 bp, Artificial
  CRISPR gRNA sequence
tgagctgccatgccttcatg

SEQ ID NO: 302450 - DNA, 20 bp, Artificial
  CRISPR gRNA sequence
gagctgccatgccttcatgg

SEQ ID NO: 302451 - DNA, 20 bp, Artificial
  CRISPR gRNA sequence
ctgccatgccttcatggagg

SEQ ID NO: 302452 - DNA, 20 bp, Artificial
  CRISPR gRNA sequence
tgccatgccttcatggaggt

SEQ ID NO: 302453 - DNA, 20 bp, Artificial
  CRISPR gRNA sequence
gccatgccttcatggaggtg

SEQ ID NO: 302454 - DNA, 20 bp, Artificial
  CRISPR gRNA sequence
gggataacaccgaccatgat

SEQ ID NO: 302455 - DNA, 20 bp, Artificial
  CRISPR gRNA sequence
ggataacaccgaccatgatc

SEQ ID NO: 302456 - DNA, 20 bp, Artificial
  CRISPR gRNA sequence
taacaccgaccatgatcagg

SEQ ID NO: 302457 - DNA, 20 bp, Artificial
  CRISPR gRNA sequence
caccgaccatgatcaggaag

SEQ ID NO: 302458 - DNA, 20 bp, Artificial
  CRISPR gRNA sequence
ccgaccatgatcaggaagaa

SEQ ID NO: 302459 - DNA, 20 bp, Artificial
  CRISPR gRNA sequence
cgaccatgatcaggaagaag

SEQ ID NO: 302460 - DNA, 20 bp, Artificial
  CRISPR gRNA sequence
gaccatgatcaggaagaaga

SEQ ID NO: 302461 - DNA, 20 bp, Artificial
  CRISPR gRNA sequence
atgatcaggaagaagagggt

SEQ ID NO: 302462 - DNA, 20 bp, Artificial
  CRISPR gRNA sequence
caggaagaagagggtcagcc

SEQ ID NO: 302463 - DNA, 20 bp, Artificial
  CRISPR gRNA sequence
gtcagcctggcccgtgattc

SEQ ID NO: 302464 - DNA, 20 bp, Artificial
  CRISPR gRNA sequence
tggcccgtgattctggaatc

SEQ ID NO: 302465 - DNA, 20 bp, Artificial
  CRISPR gRNA sequence
ggcccgtgattctggaatct

SEQ ID NO: 302466 - DNA, 20 bp, Artificial
  CRISPR gRNA sequence
cgtgattctggaatctgggt

SEQ ID NO: 302467 - DNA, 20 bp, Artificial
  CRISPR gRNA sequence
gtgattctggaatctgggtg

SEQ ID NO: 302468 - DNA, 20 bp, Artificial
  CRISPR gRNA sequence
ctgggtgaggtgtctgtgct

SEQ ID NO: 302469 - DNA, 20 bp, Artificial
  CRISPR gRNA sequence
tgggtgaggtgtctgtgctg

SEQ ID NO: 302470 - DNA, 20 bp, Artificial
  CRISPR gRNA sequence
gtgctgaggctctgcacgtg

SEQ ID NO: 302471 - DNA, 20 bp, Artificial
  CRISPR gRNA sequence
tgctatcctgcccccctctg

SEQ ID NO: 302472 - DNA, 20 bp, Artificial
  CRISPR gRNA sequence
atcctgcccccctctgcagt

SEQ ID NO: 302473 - DNA, 20 bp, Artificial
  CRISPR gRNA sequence
ccccctctgcagtcagttcc

SEQ ID NO: 302474 - DNA, 20 bp, Artificial
  CRISPR gRNA sequence
cccctctgcagtcagttccc

SEQ ID NO: 302475 - DNA, 20 bp, Artificial
  CRISPR gRNA sequence
cagtcagttcccaggccctg

SEQ ID NO: 302476 - DNA, 20 bp, Artificial
  CRISPR gRNA sequence
cttctgtccactataatctc

SEQ ID NO: 302477 - DNA, 20 bp, Artificial
  CRISPR gRNA sequence
atctccagacacctctcact

SEQ ID NO: 302478 - DNA, 20 bp, Artificial
  CRISPR gRNA sequence
acacctctcacttggacaaa

SEQ ID NO: 302479 - DNA, 20 bp, Artificial
  CRISPR gRNA sequence
tctcacttggacaaatggaa

SEQ ID NO: 302480 - DNA, 20 bp, Artificial
  CRISPR gRNA sequence
gacaaatggaacagcttcca

SEQ ID NO: 302481 - DNA, 20 bp, Artificial
  CRISPR gRNA sequence
acaaatggaacagcttccac

SEQ ID NO: 302482 - DNA, 20 bp, Artificial
  CRISPR gRNA sequence
cttccacaggcccctacctc

SEQ ID NO: 302483 - DNA, 20 bp, Artificial
  CRISPR gRNA sequence
ttttcatttgcttgtttgtt

SEQ ID NO: 302484 - DNA, 20 bp, Artificial
  CRISPR gRNA sequence
ttgtttagttttttcctact

SEQ ID NO: 302485 - DNA, 20 bp, Artificial
  CRISPR gRNA sequence
tgtttagttttttcctactg

SEQ ID NO: 302486 - DNA, 20 bp, Artificial
  CRISPR gRNA sequence
gttttttcctactgaggtca

SEQ ID NO: 302487 - DNA, 20 bp, Artificial
  CRISPR gRNA sequence
ttttcctactgaggtcacag

SEQ ID NO: 302488 - DNA, 20 bp, Artificial
  CRISPR gRNA sequence
tttcctactgaggtcacagc

SEQ ID NO: 302489 - DNA, 20 bp, Artificial
  CRISPR gRNA sequence
cacagcaggtttcctctgca

SEQ ID NO: 302490 - DNA, 20 bp, Artificial
  CRISPR gRNA sequence
ggtttcctctgcatggcttt

SEQ ID NO: 302491 - DNA, 20 bp, Artificial
  CRISPR gRNA sequence
ttgatgtttcttcatgcctt

SEQ ID NO: 302492 - DNA, 20 bp, Artificial
  CRISPR gRNA sequence
tgatgtttcttcatgccttg

SEQ ID NO: 302493 - DNA, 20 bp, Artificial
  CRISPR gRNA sequence
ttgaggaaccttcacgcctt

SEQ ID NO: 302494 - DNA, 20 bp, Artificial
  CRISPR gRNA sequence
tgaggaaccttcacgccttc

SEQ ID NO: 302495 - DNA, 20 bp, Artificial
  CRISPR gRNA sequence
caggaactacttccttacat

SEQ ID NO: 302496 - DNA, 20 bp, Artificial
  CRISPR gRNA sequence
ttccttacatgagaactcct

SEQ ID NO: 302497 - DNA, 20 bp, Artificial
  CRISPR gRNA sequence
catgagaactcctaagtttc

SEQ ID NO: 302498 - DNA, 20 bp, Artificial
  CRISPR gRNA sequence
atgagaactcctaagtttct

SEQ ID NO: 302499 - DNA, 20 bp, Artificial
  CRISPR gRNA sequence
tgagaactcctaagtttctg

SEQ ID NO: 302500 - DNA, 20 bp, Artificial
  CRISPR gRNA sequence
agaactcctaagtttctggg

SEQ ID NO: 302501 - DNA, 20 bp, Artificial
  CRISPR gRNA sequence
ctcctaagtttctggggagt

SEQ ID NO: 302502 - DNA, 20 bp, Artificial
  CRISPR gRNA sequence
gtttctggggagttggaaaa

SEQ ID NO: 302503 - DNA, 20 bp, Artificial
  CRISPR gRNA sequence
tttctggggagttggaaaac

SEQ ID NO: 302504 - DNA, 20 bp, Artificial
  CRISPR gRNA sequence
gagttggaaaacaggctttg

SEQ ID NO: 302505 - DNA, 20 bp, Artificial
  CRISPR gRNA sequence
agttggaaaacaggctttgt

SEQ ID NO: 302506 - DNA, 20 bp, Artificial
  CRISPR gRNA sequence
gttggaaaacaggctttgtg

SEQ ID NO: 302507 - DNA, 20 bp, Artificial
  CRISPR gRNA sequence
caggctttgtggggaaaact

SEQ ID NO: 302508 - DNA, 20 bp, Artificial
  CRISPR gRNA sequence
tttgtggggaaaacttagaa

SEQ ID NO: 302509 - DNA, 20 bp, Artificial
  CRISPR gRNA sequence
tgtggggaaaacttagaacg

SEQ ID NO: 302510 - DNA, 20 bp, Artificial
  CRISPR gRNA sequence
gaacggagtcgcccacttta

SEQ ID NO: 302511 - DNA, 20 bp, Artificial
  CRISPR gRNA sequence
gcccactttaaagacatttt

SEQ ID NO: 302512 - DNA, 20 bp, Artificial
  CRISPR gRNA sequence
cccactttaaagacattttt

SEQ ID NO: 302513 - DNA, 20 bp, Artificial
  CRISPR gRNA sequence
tttaaagacatttttgggaa

SEQ ID NO: 302514 - DNA, 20 bp, Artificial
  CRISPR gRNA sequence
gacatttttgggaacagttc

SEQ ID NO: 302515 - DNA, 20 bp, Artificial
  CRISPR gRNA sequence
atttttgggaacagttctgg

SEQ ID NO: 302516 - DNA, 20 bp, Artificial
  CRISPR gRNA sequence
tggtagctaatcccaaattt

SEQ ID NO: 302517 - DNA, 20 bp, Artificial
  CRISPR gRNA sequence
ggtagctaatcccaaatttc

SEQ ID NO: 302518 - DNA, 20 bp, Artificial
  CRISPR gRNA sequence
atcccaaatttcaggaaaat

SEQ ID NO: 302519 - DNA, 20 bp, Artificial
  CRISPR gRNA sequence
tcccaaatttcaggaaaatt

SEQ ID NO: 302520 - DNA, 20 bp, Artificial
  CRISPR gRNA sequence
aatttcaggaaaattaggac

SEQ ID NO: 302521 - DNA, 20 bp, Artificial
  CRISPR gRNA sequence
attaggaccagctgatctat

SEQ ID NO: 302522 - DNA, 20 bp, Artificial
  CRISPR gRNA sequence
gaccagctgatctattagct

SEQ ID NO: 302523 - DNA, 20 bp, Artificial
  CRISPR gRNA sequence
attagcttagctataatttg

SEQ ID NO: 302524 - DNA, 20 bp, Artificial
  CRISPR gRNA sequence
gtagacacatgccctgtttc

SEQ ID NO: 302525 - DNA, 20 bp, Artificial
  CRISPR gRNA sequence
tagacacatgccctgtttct

SEQ ID NO: 302526 - DNA, 20 bp, Artificial
  CRISPR gRNA sequence
tgccctgtttctgggatgtt

SEQ ID NO: 302527 - DNA, 20 bp, Artificial
  CRISPR gRNA sequence
cctgtttctgggatgttaag

SEQ ID NO: 302528 - DNA, 20 bp, Artificial
  CRISPR gRNA sequence
ctgggatgttaagaagttgt

SEQ ID NO: 302529 - DNA, 20 bp, Artificial
  CRISPR gRNA sequence
ttaagaagttgttggcattg

SEQ ID NO: 302530 - DNA, 20 bp, Artificial
  CRISPR gRNA sequence
taagaagttgttggcattgc

SEQ ID NO: 302531 - DNA, 20 bp, Artificial
  CRISPR gRNA sequence
ggccatatttaatccctttt

SEQ ID NO: 302532 - DNA, 20 bp, Artificial
  CRISPR gRNA sequence
aatcccttttgagtctgtcc

SEQ ID NO: 302533 - DNA, 20 bp, Artificial
  CRISPR gRNA sequence
tgtcccagtctattccactt

SEQ ID NO: 302534 - DNA, 20 bp, Artificial
  CRISPR gRNA sequence
ccagtctattccacttgagc

SEQ ID NO: 302535 - DNA, 20 bp, Artificial
  CRISPR gRNA sequence
ctattccacttgagccagtt

SEQ ID NO: 302536 - DNA, 20 bp, Artificial
  CRISPR gRNA sequence
ttgagccagtttggcactcc

SEQ ID NO: 302537 - DNA, 20 bp, Artificial
  CRISPR gRNA sequence
ccagtttggcactcccagta

SEQ ID NO: 302538 - DNA, 20 bp, Artificial
  CRISPR gRNA sequence
cagtttggcactcccagtaa

SEQ ID NO: 302539 - DNA, 20 bp, Artificial
  CRISPR gRNA sequence
agtttggcactcccagtaaa

SEQ ID NO: 302540 - DNA, 20 bp, Artificial
  CRISPR gRNA sequence
gtttggcactcccagtaaag

SEQ ID NO: 302541 - DNA, 20 bp, Artificial
  CRISPR gRNA sequence
tttggcactcccagtaaagg

SEQ ID NO: 302542 - DNA, 20 bp, Artificial
  CRISPR gRNA sequence
gcactcccagtaaagggggt

SEQ ID NO: 302543 - DNA, 20 bp, Artificial
  CRISPR gRNA sequence
cactcccagtaaagggggtt

SEQ ID NO: 302544 - DNA, 20 bp, Artificial
  CRISPR gRNA sequence
actcccagtaaagggggtta

SEQ ID NO: 302545 - DNA, 20 bp, Artificial
  CRISPR gRNA sequence
ctcccagtaaagggggttag

SEQ ID NO: 302546 - DNA, 20 bp, Artificial
  CRISPR gRNA sequence
aggggttatacttactaacg

SEQ ID NO: 302547 - DNA, 20 bp, Artificial
  CRISPR gRNA sequence
gggttatacttactaacgtg

SEQ ID NO: 302548 - DNA, 20 bp, Artificial
  CRISPR gRNA sequence
ggttatacttactaacgtgg

SEQ ID NO: 302549 - DNA, 20 bp, Artificial
  CRISPR gRNA sequence
ctaccttttaacatgcaaaa

SEQ ID NO: 302550 - DNA, 20 bp, Artificial
  CRISPR gRNA sequence
taccttttaacatgcaaaaa

SEQ ID NO: 302551 - DNA, 20 bp, Artificial
  CRISPR gRNA sequence
gcaaaaaaggccccttgact

SEQ ID NO: 302552 - DNA, 20 bp, Artificial
  CRISPR gRNA sequence
caaaaaaggccccttgactc

SEQ ID NO: 302553 - DNA, 20 bp, Artificial
  CRISPR gRNA sequence
aaaaaaggccccttgactca

SEQ ID NO: 302554 - DNA, 20 bp, Artificial
  CRISPR gRNA sequence
ggtctaacctatctctgatc

SEQ ID NO: 302555 - DNA, 20 bp, Artificial
  CRISPR gRNA sequence
acctatctctgatcaagcga

SEQ ID NO: 302556 - DNA, 20 bp, Artificial
  CRISPR gRNA sequence
tctctgatcaagcgatagaa

SEQ ID NO: 302557 - DNA, 20 bp, Artificial
  CRISPR gRNA sequence
ctctgatcaagcgatagaat

SEQ ID NO: 302558 - DNA, 20 bp, Artificial
  CRISPR gRNA sequence
aagcgatagaatgggaaacc

SEQ ID NO: 302559 - DNA, 20 bp, Artificial
  CRISPR gRNA sequence
gcgatagaatgggaaaccca

SEQ ID NO: 302560 - DNA, 20 bp, Artificial
  CRISPR gRNA sequence
gatagaatgggaaacccaga

SEQ ID NO: 302561 - DNA, 20 bp, Artificial
  CRISPR gRNA sequence
atagaatgggaaacccagag

SEQ ID NO: 302562 - DNA, 20 bp, Artificial
  CRISPR gRNA sequence
aatgggaaacccagagaggc

SEQ ID NO: 302563 - DNA, 20 bp, Artificial
  CRISPR gRNA sequence
gaggcaagccccatcttcct

SEQ ID NO: 302564 - DNA, 20 bp, Artificial
  CRISPR gRNA sequence
aggcaagccccatcttcctg

SEQ ID NO: 302565 - DNA, 20 bp, Artificial
  CRISPR gRNA sequence
caagccccatcttcctgagg

SEQ ID NO: 302566 - DNA, 20 bp, Artificial
  CRISPR gRNA sequence
ccccatcttcctgaggcagc

SEQ ID NO: 302567 - DNA, 20 bp, Artificial
  CRISPR gRNA sequence
ccatcttcctgaggcagcta

SEQ ID NO: 302568 - DNA, 20 bp, Artificial
  CRISPR gRNA sequence
ctagagctgaaacatttctg

SEQ ID NO: 302569 - DNA, 20 bp, Artificial
  CRISPR gRNA sequence
agctgaaacatttctgaaga

SEQ ID NO: 302570 - DNA, 20 bp, Artificial
  CRISPR gRNA sequence
gctgaaacatttctgaagat

SEQ ID NO: 302571 - DNA, 20 bp, Artificial
  CRISPR gRNA sequence
ctgaaacatttctgaagatg

SEQ ID NO: 302572 - DNA, 20 bp, Artificial
  CRISPR gRNA sequence
tgaaacatttctgaagatgg

SEQ ID NO: 302573 - DNA, 20 bp, Artificial
  CRISPR gRNA sequence
gaagatgggggtacctgttg

SEQ ID NO: 302574 - DNA, 20 bp, Artificial
  CRISPR gRNA sequence
tgggggtacctgttgaagtt

SEQ ID NO: 302575 - DNA, 20 bp, Artificial
  CRISPR gRNA sequence
gggtacctgttgaagtttgg

SEQ ID NO: 302576 - DNA, 20 bp, Artificial
  CRISPR gRNA sequence
cctgttgaagtttggcagaa

SEQ ID NO: 302577 - DNA, 20 bp, Artificial
  CRISPR gRNA sequence
gttgaagtttggcagaacag

SEQ ID NO: 302578 - DNA, 20 bp, Artificial
  CRISPR gRNA sequence
agtttggcagaacagtagtt

SEQ ID NO: 302579 - DNA, 20 bp, Artificial
  CRISPR gRNA sequence
ttggcagaacagtagttgag

SEQ ID NO: 302580 - DNA, 20 bp, Artificial
  CRISPR gRNA sequence
gcagaacagtagttgagaag

SEQ ID NO: 302581 - DNA, 20 bp, Artificial
  CRISPR gRNA sequence
gaacagtagttgagaagcag

SEQ ID NO: 302582 - DNA, 20 bp, Artificial
  CRISPR gRNA sequence
aacagtagttgagaagcagc

SEQ ID NO: 302583 - DNA, 20 bp, Artificial
  CRISPR gRNA sequence
agtagttgagaagcagcagg

SEQ ID NO: 302584 - DNA, 20 bp, Artificial
  CRISPR gRNA sequence
gtagttgagaagcagcagga

SEQ ID NO: 302585 - DNA, 20 bp, Artificial
  CRISPR gRNA sequence
ttgagaagcagcaggaaggt

SEQ ID NO: 302586 - DNA, 20 bp, Artificial
  CRISPR gRNA sequence
gcaggaaggtgagccatgat

SEQ ID NO: 302587 - DNA, 20 bp, Artificial
  CRISPR gRNA sequence
caggaaggtgagccatgatg

SEQ ID NO: 302588 - DNA, 20 bp, Artificial
  CRISPR gRNA sequence
ggtgagccatgatgaggtta

SEQ ID NO: 302589 - DNA, 20 bp, Artificial
  CRISPR gRNA sequence
gagccatgatgaggttatag

SEQ ID NO: 302590 - DNA, 20 bp, Artificial
  CRISPR gRNA sequence
ccatgatgaggttatagtgg

SEQ ID NO: 302591 - DNA, 20 bp, Artificial
  CRISPR gRNA sequence
gatgaggttatagtggtggc

SEQ ID NO: 302592 - DNA, 20 bp, Artificial
  CRISPR gRNA sequence
ggcaagcccctgttaatttg

SEQ ID NO: 302593 - DNA, 20 bp, Artificial
  CRISPR gRNA sequence
ccctgttaatttgtagacta

SEQ ID NO: 302594 - DNA, 20 bp, Artificial
  CRISPR gRNA sequence
cctgttaatttgtagactat

SEQ ID NO: 302595 - DNA, 20 bp, Artificial
  CRISPR gRNA sequence
tgttaatttgtagactatgg

SEQ ID NO: 302596 - DNA, 20 bp, Artificial
  CRISPR gRNA sequence
gtagactatgggagccgtaa

SEQ ID NO: 302597 - DNA, 20 bp, Artificial
  CRISPR gRNA sequence
agactatgggagccgtaaca

SEQ ID NO: 302598 - DNA, 20 bp, Artificial
  CRISPR gRNA sequence
gactatgggagccgtaacag

SEQ ID NO: 302599 - DNA, 20 bp, Artificial
  CRISPR gRNA sequence
actatgggagccgtaacaga

SEQ ID NO: 302600 - DNA, 20 bp, Artificial
  CRISPR gRNA sequence
ggagccgtaacagagggccc

SEQ ID NO: 302601 - DNA, 20 bp, Artificial
  CRISPR gRNA sequence
gagccgtaacagagggccct

SEQ ID NO: 302602 - DNA, 20 bp, Artificial
  CRISPR gRNA sequence
agccgtaacagagggccctg

SEQ ID NO: 302603 - DNA, 20 bp, Artificial
  CRISPR gRNA sequence
gccctggggcatgtcatata

SEQ ID NO: 302604 - DNA, 20 bp, Artificial
  CRISPR gRNA sequence
tgtcatatatggccatcttg

SEQ ID NO: 302605 - DNA, 20 bp, Artificial
  CRISPR gRNA sequence
atcaaactaattacacattg

SEQ ID NO: 302606 - DNA, 20 bp, Artificial
  CRISPR gRNA sequence
tcaaactaattacacattga

SEQ ID NO: 302607 - DNA, 20 bp, Artificial
  CRISPR gRNA sequence
aaactaattacacattgaag

SEQ ID NO: 302608 - DNA, 20 bp, Artificial
  CRISPR gRNA sequence
aactaattacacattgaagg

SEQ ID NO: 302609 - DNA, 20 bp, Artificial
  CRISPR gRNA sequence
ttgaaggaggtactgaactt

SEQ ID NO: 302610 - DNA, 20 bp, Artificial
  CRISPR gRNA sequence
tgaaggaggtactgaacttc

SEQ ID NO: 302611 - DNA, 20 bp, Artificial
  CRISPR gRNA sequence
gaggtactgaacttcaggca

SEQ ID NO: 302612 - DNA, 20 bp, Artificial
  CRISPR gRNA sequence
actgaacttcaggcatagct

SEQ ID NO: 302613 - DNA, 20 bp, Artificial
  CRISPR gRNA sequence
tgaacttcaggcatagcttg

SEQ ID NO: 302614 - DNA, 20 bp, Artificial
  CRISPR gRNA sequence
aacttcaggcatagcttgga

SEQ ID NO: 302615 - DNA, 20 bp, Artificial
  CRISPR gRNA sequence
acttcaggcatagcttggag

SEQ ID NO: 302616 - DNA, 20 bp, Artificial
  CRISPR gRNA sequence
agcttggagaggcttctatc

SEQ ID NO: 302617 - DNA, 20 bp, Artificial
  CRISPR gRNA sequence
ggagaggcttctatctggcc

SEQ ID NO: 302618 - DNA, 20 bp, Artificial
  CRISPR gRNA sequence
agaggcttctatctggccaa

SEQ ID NO: 302619 - DNA, 20 bp, Artificial
  CRISPR gRNA sequence
aggcttctatctggccaaga

SEQ ID NO: 302620 - DNA, 20 bp, Artificial
  CRISPR gRNA sequence
ggcttctatctggccaagag

SEQ ID NO: 302621 - DNA, 20 bp, Artificial
  CRISPR gRNA sequence
tatctggccaagagaggata

SEQ ID NO: 302622 - DNA, 20 bp, Artificial
  CRISPR gRNA sequence
atctggccaagagaggatac

SEQ ID NO: 302623 - DNA, 20 bp, Artificial
  CRISPR gRNA sequence
ctggccaagagaggatacag

SEQ ID NO: 302624 - DNA, 20 bp, Artificial
  CRISPR gRNA sequence
gccaagagaggatacaggag

SEQ ID NO: 302625 - DNA, 20 bp, Artificial
  CRISPR gRNA sequence
gaggatacaggagaagcaac

SEQ ID NO: 302626 - DNA, 20 bp, Artificial
  CRISPR gRNA sequence
aggatacaggagaagcaact

SEQ ID NO: 302627 - DNA, 20 bp, Artificial
  CRISPR gRNA sequence
tacaggagaagcaactggga

SEQ ID NO: 302628 - DNA, 20 bp, Artificial
  CRISPR gRNA sequence
acaggagaagcaactgggac

SEQ ID NO: 302629 - DNA, 20 bp, Artificial
  CRISPR gRNA sequence
agaagcaactgggacaggac

SEQ ID NO: 302630 - DNA, 20 bp, Artificial
  CRISPR gRNA sequence
gcaactgggacaggacgagt

SEQ ID NO: 302631 - DNA, 20 bp, Artificial
  CRISPR gRNA sequence
gagttggctccaccatttac

SEQ ID NO: 302632 - DNA, 20 bp, Artificial
  CRISPR gRNA sequence
tccaccatttactggattct

SEQ ID NO: 302633 - DNA, 20 bp, Artificial
  CRISPR gRNA sequence
caccatttactggattctca

SEQ ID NO: 302634 - DNA, 20 bp, Artificial
  CRISPR gRNA sequence
accatttactggattctcag

SEQ ID NO: 302635 - DNA, 20 bp, Artificial
  CRISPR gRNA sequence
tactggattctcagaggctg

SEQ ID NO: 302636 - DNA, 20 bp, Artificial
  CRISPR gRNA sequence
cagaggctgaagtgtctgaa

SEQ ID NO: 302637 - DNA, 20 bp, Artificial
  CRISPR gRNA sequence
agaggctgaagtgtctgaat

SEQ ID NO: 302638 - DNA, 20 bp, Artificial
  CRISPR gRNA sequence
ggctgaagtgtctgaatagg

SEQ ID NO: 302639 - DNA, 20 bp, Artificial
  CRISPR gRNA sequence
tgaagtgtctgaataggaag

SEQ ID NO: 302640 - DNA, 20 bp, Artificial
  CRISPR gRNA sequence
gtgtctgaataggaagaagt

SEQ ID NO: 302641 - DNA, 20 bp, Artificial
  CRISPR gRNA sequence
tctgaataggaagaagtcag

SEQ ID NO: 302642 - DNA, 20 bp, Artificial
  CRISPR gRNA sequence
gaataggaagaagtcagtag

SEQ ID NO: 302643 - DNA, 20 bp, Artificial
  CRISPR gRNA sequence
aataggaagaagtcagtagc

SEQ ID NO: 302644 - DNA, 20 bp, Artificial
  CRISPR gRNA sequence
taggaagaagtcagtagcag

SEQ ID NO: 302645 - DNA, 20 bp, Artificial
  CRISPR gRNA sequence
agaagtcagtagcaggagat

SEQ ID NO: 302646 - DNA, 20 bp, Artificial
  CRISPR gRNA sequence
tcagtagcaggagatgagat

SEQ ID NO: 302647 - DNA, 20 bp, Artificial
  CRISPR gRNA sequence
agcaggagatgagattggcc

SEQ ID NO: 302648 - DNA, 20 bp, Artificial
  CRISPR gRNA sequence
atgagattggcccagttgta

SEQ ID NO: 302649 - DNA, 20 bp, Artificial
  CRISPR gRNA sequence
gattggcccagttgtaaagt

SEQ ID NO: 302650 - DNA, 20 bp, Artificial
  CRISPR gRNA sequence
ccagttgtaaagttggttca

SEQ ID NO: 302651 - DNA, 20 bp, Artificial
  CRISPR gRNA sequence
cagttgtaaagttggttcat

SEQ ID NO: 302652 - DNA, 20 bp, Artificial
  CRISPR gRNA sequence
agttgtaaagttggttcatg

SEQ ID NO: 302653 - DNA, 20 bp, Artificial
  CRISPR gRNA sequence
taaagttggttcatggggac

SEQ ID NO: 302654 - DNA, 20 bp, Artificial
  CRISPR gRNA sequence
gttcatggggactggccccg

SEQ ID NO: 302655 - DNA, 20 bp, Artificial
  CRISPR gRNA sequence
ttcatggggactggccccgt

SEQ ID NO: 302656 - DNA, 20 bp, Artificial
  CRISPR gRNA sequence
ctggccccgtgggctgttca

SEQ ID NO: 302657 - DNA, 20 bp, Artificial
  CRISPR gRNA sequence
ccgtgggctgttcacagacc

SEQ ID NO: 302658 - DNA, 20 bp, Artificial
  CRISPR gRNA sequence
ccaagttatatctgaacaac

SEQ ID NO: 302659 - DNA, 20 bp, Artificial
  CRISPR gRNA sequence
atatctgaacaacaagacac

SEQ ID NO: 302660 - DNA, 20 bp, Artificial
  CRISPR gRNA sequence
tatctgaacaacaagacact

SEQ ID NO: 302661 - DNA, 20 bp, Artificial
  CRISPR gRNA sequence
tctgaacaacaagacactgg

SEQ ID NO: 302662 - DNA, 20 bp, Artificial
  CRISPR gRNA sequence
aacaacaagacactgggaga

SEQ ID NO: 302663 - DNA, 20 bp, Artificial
  CRISPR gRNA sequence
acaacaagacactgggagaa

SEQ ID NO: 302664 - DNA, 20 bp, Artificial
  CRISPR gRNA sequence
aacaagacactgggagaaag

SEQ ID NO: 302665 - DNA, 20 bp, Artificial
  CRISPR gRNA sequence
acaagacactgggagaaagg

SEQ ID NO: 302666 - DNA, 20 bp, Artificial
  CRISPR gRNA sequence
ctgggagaaaggaggtgaca

SEQ ID NO: 302667 - DNA, 20 bp, Artificial
  CRISPR gRNA sequence
gagaaaggaggtgacaaagc

SEQ ID NO: 302668 - DNA, 20 bp, Artificial
  CRISPR gRNA sequence
agaaaggaggtgacaaagcc

SEQ ID NO: 302669 - DNA, 20 bp, Artificial
  CRISPR gRNA sequence
gaaaggaggtgacaaagcca

SEQ ID NO: 302670 - DNA, 20 bp, Artificial
  CRISPR gRNA sequence
gaggtgacaaagccagggta

SEQ ID NO: 302671 - DNA, 20 bp, Artificial
  CRISPR gRNA sequence
ggtgacaaagccagggtatg

SEQ ID NO: 302672 - DNA, 20 bp, Artificial
  CRISPR gRNA sequence
acaaagccagggtatggagc

SEQ ID NO: 302673 - DNA, 20 bp, Artificial
  CRISPR gRNA sequence
caaagccagggtatggagca

SEQ ID NO: 302674 - DNA, 20 bp, Artificial
  CRISPR gRNA sequence
aagccagggtatggagcaag

SEQ ID NO: 302675 - DNA, 20 bp, Artificial
  CRISPR gRNA sequence
cagggtatggagcaaggagt

SEQ ID NO: 302676 - DNA, 20 bp, Artificial
  CRISPR gRNA sequence
gtatggagcaaggagttgga

SEQ ID NO: 302677 - DNA, 20 bp, Artificial
  CRISPR gRNA sequence
aggagttggatggatgtcac

SEQ ID NO: 302678 - DNA, 20 bp, Artificial
  CRISPR gRNA sequence
gagttggatggatgtcactg

SEQ ID NO: 302679 - DNA, 20 bp, Artificial
  CRISPR gRNA sequence
agttggatggatgtcactgg

SEQ ID NO: 302680 - DNA, 20 bp, Artificial
  CRISPR gRNA sequence
gttggatggatgtcactgga

SEQ ID NO: 302681 - DNA, 20 bp, Artificial
  CRISPR gRNA sequence
ttggatggatgtcactggag

SEQ ID NO: 302682 - DNA, 20 bp, Artificial
  CRISPR gRNA sequence
tggatggatgtcactggagg

SEQ ID NO: 302683 - DNA, 20 bp, Artificial
  CRISPR gRNA sequence
tggatgtcactggagggggc

SEQ ID NO: 302684 - DNA, 20 bp, Artificial
  CRISPR gRNA sequence
gtcactggagggggcaagcc

SEQ ID NO: 302685 - DNA, 20 bp, Artificial
  CRISPR gRNA sequence
gcaagccaagaaatcaccgc

SEQ ID NO: 302686 - DNA, 20 bp, Artificial
  CRISPR gRNA sequence
aagccaagaaatcaccgctg

SEQ ID NO: 302687 - DNA, 20 bp, Artificial
  CRISPR gRNA sequence
ccaagaaatcaccgctggag

SEQ ID NO: 302688 - DNA, 20 bp, Artificial
  CRISPR gRNA sequence
caagaaatcaccgctggaga

SEQ ID NO: 302689 - DNA, 20 bp, Artificial
  CRISPR gRNA sequence
aagaaatcaccgctggagaa

SEQ ID NO: 302690 - DNA, 20 bp, Artificial
  CRISPR gRNA sequence
agaaatcaccgctggagaag

SEQ ID NO: 302691 - DNA, 20 bp, Artificial
  CRISPR gRNA sequence
tcaccgctggagaaggggtc

SEQ ID NO: 302692 - DNA, 20 bp, Artificial
  CRISPR gRNA sequence
caccgctggagaaggggtca

SEQ ID NO: 302693 - DNA, 20 bp, Artificial
  CRISPR gRNA sequence
gctggagaaggggtcaaggt

SEQ ID NO: 302694 - DNA, 20 bp, Artificial
  CRISPR gRNA sequence
ggagaaggggtcaaggtaag

SEQ ID NO: 302695 - DNA, 20 bp, Artificial
  CRISPR gRNA sequence
gaaggggtcaaggtaagaag

SEQ ID NO: 302696 - DNA, 20 bp, Artificial
  CRISPR gRNA sequence
aaggggtcaaggtaagaaga

SEQ ID NO: 302697 - DNA, 20 bp, Artificial
  CRISPR gRNA sequence
gggtcaaggtaagaagaagg

SEQ ID NO: 302698 - DNA, 20 bp, Artificial
  CRISPR gRNA sequence
aggtaagaagaaggcagatg

SEQ ID NO: 302699 - DNA, 20 bp, Artificial
  CRISPR gRNA sequence
ggtaagaagaaggcagatgt

SEQ ID NO: 302700 - DNA, 20 bp, Artificial
  CRISPR gRNA sequence
agaaggcagatgtgggtgtc

SEQ ID NO: 302701 - DNA, 20 bp, Artificial
  CRISPR gRNA sequence
gaaggcagatgtgggtgtca

SEQ ID NO: 302702 - DNA, 20 bp, Artificial
  CRISPR gRNA sequence
gcagatgtgggtgtcaaggt

SEQ ID NO: 302703 - DNA, 20 bp, Artificial
  CRISPR gRNA sequence
tgtgggtgtcaaggtcagca

SEQ ID NO: 302704 - DNA, 20 bp, Artificial
  CRISPR gRNA sequence
gtgggtgtcaaggtcagcac

SEQ ID NO: 302705 - DNA, 20 bp, Artificial
  CRISPR gRNA sequence
ggtgtcaaggtcagcacagg

SEQ ID NO: 302706 - DNA, 20 bp, Artificial
  CRISPR gRNA sequence
aaggtcagcacaggcagtga

SEQ ID NO: 302707 - DNA, 20 bp, Artificial
  CRISPR gRNA sequence
aggtcagcacaggcagtgat

SEQ ID NO: 302708 - DNA, 20 bp, Artificial
  CRISPR gRNA sequence
cagcacaggcagtgatggga

SEQ ID NO: 302709 - DNA, 20 bp, Artificial
  CRISPR gRNA sequence
agcacaggcagtgatgggac

SEQ ID NO: 302710 - DNA, 20 bp, Artificial
  CRISPR gRNA sequence
gcacaggcagtgatgggaca

SEQ ID NO: 302711 - DNA, 20 bp, Artificial
  CRISPR gRNA sequence
caggcagtgatgggacaggg

SEQ ID NO: 302712 - DNA, 20 bp, Artificial
  CRISPR gRNA sequence
gtgatgggacagggtagatg

SEQ ID NO: 302713 - DNA, 20 bp, Artificial
  CRISPR gRNA sequence
gatgcagaccacctttattc

SEQ ID NO: 302714 - DNA, 20 bp, Artificial
  CRISPR gRNA sequence
atgcagaccacctttattcc

SEQ ID NO: 302715 - DNA, 20 bp, Artificial
  CRISPR gRNA sequence
gcagaccacctttattccag

SEQ ID NO: 302716 - DNA, 20 bp, Artificial
  CRISPR gRNA sequence
cagaccacctttattccagg

SEQ ID NO: 302717 - DNA, 20 bp, Artificial
  CRISPR gRNA sequence
agaccacctttattccagga

SEQ ID NO: 302718 - DNA, 20 bp, Artificial
  CRISPR gRNA sequence
tattccaggagggaatcttg

SEQ ID NO: 302719 - DNA, 20 bp, Artificial
  CRISPR gRNA sequence
aggagggaatcttgcagtta

SEQ ID NO: 302720 - DNA, 20 bp, Artificial
  CRISPR gRNA sequence
ttgcagttacagcttcttaa

SEQ ID NO: 302721 - DNA, 20 bp, Artificial
  CRISPR gRNA sequence
gcagttacagcttcttaaaa

SEQ ID NO: 302722 - DNA, 20 bp, Artificial
  CRISPR gRNA sequence
cagttacagcttcttaaaag

SEQ ID NO: 302723 - DNA, 20 bp, Artificial
  CRISPR gRNA sequence
gttacagcttcttaaaagag

SEQ ID NO: 302724 - DNA, 20 bp, Artificial
  CRISPR gRNA sequence
cttaaaagaggagtcaaata

SEQ ID NO: 302725 - DNA, 20 bp, Artificial
  CRISPR gRNA sequence
aatatagacacatgccctcc

SEQ ID NO: 302726 - DNA, 20 bp, Artificial
  CRISPR gRNA sequence
atatagacacatgccctcct

SEQ ID NO: 302727 - DNA, 20 bp, Artificial
  CRISPR gRNA sequence
gacacatgccctcctgggta

SEQ ID NO: 302728 - DNA, 20 bp, Artificial
  CRISPR gRNA sequence
catgccctcctgggtaaagc

SEQ ID NO: 302729 - DNA, 20 bp, Artificial
  CRISPR gRNA sequence
atgccctcctgggtaaagcc

SEQ ID NO: 302730 - DNA, 20 bp, Artificial
  CRISPR gRNA sequence
aagccaggactttaaaatgt

SEQ ID NO: 302731 - DNA, 20 bp, Artificial
  CRISPR gRNA sequence
agccaggactttaaaatgtc

SEQ ID NO: 302732 - DNA, 20 bp, Artificial
  CRISPR gRNA sequence
ttaaaatgtcaggctcctat

SEQ ID NO: 302733 - DNA, 20 bp, Artificial
  CRISPR gRNA sequence
aaatgtcaggctcctattag

SEQ ID NO: 302734 - DNA, 20 bp, Artificial
  CRISPR gRNA sequence
tcctattagtggctactgct

SEQ ID NO: 302735 - DNA, 20 bp, Artificial
  CRISPR gRNA sequence
ctccactgaacttgtccctg

SEQ ID NO: 302736 - DNA, 20 bp, Artificial
  CRISPR gRNA sequence
aagaatacttgtgaacacac

SEQ ID NO: 302737 - DNA, 20 bp, Artificial
  CRISPR gRNA sequence
acacaagcatttctgcctcc

SEQ ID NO: 302738 - DNA, 20 bp, Artificial
  CRISPR gRNA sequence
cacaagcatttctgcctcca

SEQ ID NO: 302739 - DNA, 20 bp, Artificial
  CRISPR gRNA sequence
catacctcctgcacttacgt

SEQ ID NO: 302740 - DNA, 20 bp, Artificial
  CRISPR gRNA sequence
tcctgcacttacgtcagata

SEQ ID NO: 302741 - DNA, 20 bp, Artificial
  CRISPR gRNA sequence
cagatacagctgatccactg

SEQ ID NO: 302742 - DNA, 20 bp, Artificial
  CRISPR gRNA sequence
ctgtggtcctctcacctgct

SEQ ID NO: 302743 - DNA, 20 bp, Artificial
  CRISPR gRNA sequence
gtcctctcacctgcttagcc

SEQ ID NO: 302744 - DNA, 20 bp, Artificial
  CRISPR gRNA sequence
gatactgtctcaaatttttt

SEQ ID NO: 302745 - DNA, 20 bp, Artificial
  CRISPR gRNA sequence
gtctcaaattttttcagcta

SEQ ID NO: 302746 - DNA, 20 bp, Artificial
  CRISPR gRNA sequence
tcaaattttttcagctacgg

SEQ ID NO: 302747 - DNA, 20 bp, Artificial
  CRISPR gRNA sequence
ttcagctacggaagtcacca

SEQ ID NO: 302748 - DNA, 20 bp, Artificial
  CRISPR gRNA sequence
tacggaagtcaccacagttt

SEQ ID NO: 302749 - DNA, 20 bp, Artificial
  CRISPR gRNA sequence
acggaagtcaccacagtttt

SEQ ID NO: 302750 - DNA, 20 bp, Artificial
  CRISPR gRNA sequence
agttttgggaacctgtcatc

SEQ ID NO: 302751 - DNA, 20 bp, Artificial
  CRISPR gRNA sequence
taatttattttacatgttac

SEQ ID NO: 302752 - DNA, 20 bp, Artificial
  CRISPR gRNA sequence
aatttattttacatgttaca

SEQ ID NO: 302753 - DNA, 20 bp, Artificial
  CRISPR gRNA sequence
ttacaaggtaccccttcctt

SEQ ID NO: 302754 - DNA, 20 bp, Artificial
  CRISPR gRNA sequence
tacaaggtaccccttccttt

SEQ ID NO: 302755 - DNA, 20 bp, Artificial
  CRISPR gRNA sequence
aggaaccattccctgaccct

SEQ ID NO: 302756 - DNA, 20 bp, Artificial
  CRISPR gRNA sequence
ggaaccattccctgaccctc

SEQ ID NO: 302757 - DNA, 20 bp, Artificial
  CRISPR gRNA sequence
gaaccattccctgaccctca

SEQ ID NO: 302758 - DNA, 20 bp, Artificial
  CRISPR gRNA sequence
atgcccataaatctcattac

SEQ ID NO: 302759 - DNA, 20 bp, Artificial
  CRISPR gRNA sequence
agtcacttttattttaaatt

SEQ ID NO: 302760 - DNA, 20 bp, Artificial
  CRISPR gRNA sequence
acttttattttaaatttagt

SEQ ID NO: 302761 - DNA, 20 bp, Artificial
  CRISPR gRNA sequence
aatttagtcagatatttcca

SEQ ID NO: 302762 - DNA, 20 bp, Artificial
  CRISPR gRNA sequence
tatttccatggaataaaatt

SEQ ID NO: 302763 - DNA, 20 bp, Artificial
  CRISPR gRNA sequence
aattcaaccttttaaaaatc

SEQ ID NO: 302764 - DNA, 20 bp, Artificial
  CRISPR gRNA sequence
tttttcatgtgtgcacatta

SEQ ID NO: 302765 - DNA, 20 bp, Artificial
  CRISPR gRNA sequence
ttttcatgtgtgcacattac

SEQ ID NO: 302766 - DNA, 20 bp, Artificial
  CRISPR gRNA sequence
tttcatgtgtgcacattaca

SEQ ID NO: 302767 - DNA, 20 bp, Artificial
  CRISPR gRNA sequence
ttacagggttctgattctat

SEQ ID NO: 302768 - DNA, 20 bp, Artificial
  CRISPR gRNA sequence
cagggttctgattctattgg

SEQ ID NO: 302769 - DNA, 20 bp, Artificial
  CRISPR gRNA sequence
agggttctgattctattgga

SEQ ID NO: 302770 - DNA, 20 bp, Artificial
  CRISPR gRNA sequence
gattctattggaaggtcctc

SEQ ID NO: 302771 - DNA, 20 bp, Artificial
  CRISPR gRNA sequence
attctattggaaggtcctca

SEQ ID NO: 302772 - DNA, 20 bp, Artificial
  CRISPR gRNA sequence
ttctattggaaggtcctcaa

SEQ ID NO: 302773 - DNA, 20 bp, Artificial
  CRISPR gRNA sequence
tattggaaggtcctcaaggg

SEQ ID NO: 302774 - DNA, 20 bp, Artificial
  CRISPR gRNA sequence
ttggaaggtcctcaagggca

SEQ ID NO: 302775 - DNA, 20 bp, Artificial
  CRISPR gRNA sequence
tggaaggtcctcaagggcag

SEQ ID NO: 302776 - DNA, 20 bp, Artificial
  CRISPR gRNA sequence
ggaaggtcctcaagggcaga

SEQ ID NO: 302777 - DNA, 20 bp, Artificial
  CRISPR gRNA sequence
gaaggtcctcaagggcagag

SEQ ID NO: 302778 - DNA, 20 bp, Artificial
  CRISPR gRNA sequence
aaggtcctcaagggcagagg

SEQ ID NO: 302779 - DNA, 20 bp, Artificial
  CRISPR gRNA sequence
gtgaccaataatgtcccaaa

SEQ ID NO: 302780 - DNA, 20 bp, Artificial
  CRISPR gRNA sequence
tgtatgtctgcatgtatgca

SEQ ID NO: 302781 - DNA, 20 bp, Artificial
  CRISPR gRNA sequence
gtgtgtgtgtgtgtgtgtgc

SEQ ID NO: 302782 - DNA, 20 bp, Artificial
  CRISPR gRNA sequence
gcatgtatgtgttgtaatca

SEQ ID NO: 302783 - DNA, 20 bp, Artificial
  CRISPR gRNA sequence
gtatgtgttgtaatcaaaga

SEQ ID NO: 302784 - DNA, 20 bp, Artificial
  CRISPR gRNA sequence
tgtaatcaaagaaagaattc

SEQ ID NO: 302785 - DNA, 20 bp, Artificial
  CRISPR gRNA sequence
tcaaagaaagaattctagcc

SEQ ID NO: 302786 - DNA, 20 bp, Artificial
  CRISPR gRNA sequence
aaagaaagaattctagcctg

SEQ ID NO: 302787 - DNA, 20 bp, Artificial
  CRISPR gRNA sequence
aagaaagaattctagcctgg

SEQ ID NO: 302788 - DNA, 20 bp, Artificial
  CRISPR gRNA sequence
gtatttttaaatcaaaactt

SEQ ID NO: 302789 - DNA, 20 bp, Artificial
  CRISPR gRNA sequence
acttcagaatcctccatcca

SEQ ID NO: 302790 - DNA, 20 bp, Artificial
  CRISPR gRNA sequence
cttcagaatcctccatccaa

SEQ ID NO: 302791 - DNA, 20 bp, Artificial
  CRISPR gRNA sequence
cctccatccaaaggtaaacc

SEQ ID NO: 302792 - DNA, 20 bp, Artificial
  CRISPR gRNA sequence
tccatccaaaggtaaaccaa

SEQ ID NO: 302793 - DNA, 20 bp, Artificial
  CRISPR gRNA sequence
caaaggtaaaccaagagact

SEQ ID NO: 302794 - DNA, 20 bp, Artificial
  CRISPR gRNA sequence
ggtaaaccaagagactgagt

SEQ ID NO: 302795 - DNA, 20 bp, Artificial
  CRISPR gRNA sequence
ccaagagactgagtcagttt

SEQ ID NO: 302796 - DNA, 20 bp, Artificial
  CRISPR gRNA sequence
caagagactgagtcagtttc

SEQ ID NO: 302797 - DNA, 20 bp, Artificial
  CRISPR gRNA sequence
aagagactgagtcagtttca

SEQ ID NO: 302798 - DNA, 20 bp, Artificial
  CRISPR gRNA sequence
tgagtcagtttcagggctaa

SEQ ID NO: 302799 - DNA, 20 bp, Artificial
  CRISPR gRNA sequence
ggctaaaagcatatttcttc

SEQ ID NO: 302800 - DNA, 20 bp, Artificial
  CRISPR gRNA sequence
atatttcttcaagtgcaaca

SEQ ID NO: 302801 - DNA, 20 bp, Artificial
  CRISPR gRNA sequence
tatttcttcaagtgcaacat

SEQ ID NO: 302802 - DNA, 20 bp, Artificial
  CRISPR gRNA sequence
tcaagtgcaacataggctcg

SEQ ID NO: 302803 - DNA, 20 bp, Artificial
  CRISPR gRNA sequence
aacataggctcgtagcctcc

SEQ ID NO: 302804 - DNA, 20 bp, Artificial
  CRISPR gRNA sequence
ctcctggaccctgcatcact

SEQ ID NO: 302805 - DNA, 20 bp, Artificial
  CRISPR gRNA sequence
tcctggaccctgcatcactc

SEQ ID NO: 302806 - DNA, 20 bp, Artificial
  CRISPR gRNA sequence
ctggaccctgcatcactcag

SEQ ID NO: 302807 - DNA, 20 bp, Artificial
  CRISPR gRNA sequence
gaccctgcatcactcaggag

SEQ ID NO: 302808 - DNA, 20 bp, Artificial
  CRISPR gRNA sequence
cctgcatcactcaggagaag

SEQ ID NO: 302809 - DNA, 20 bp, Artificial
  CRISPR gRNA sequence
ctgcatcactcaggagaagc

SEQ ID NO: 302810 - DNA, 20 bp, Artificial
  CRISPR gRNA sequence
gcatcactcaggagaagcag

SEQ ID NO: 302811 - DNA, 20 bp, Artificial
  CRISPR gRNA sequence
agaagcaggagacctccatc

SEQ ID NO: 302812 - DNA, 20 bp, Artificial
  CRISPR gRNA sequence
gaagcaggagacctccatct

SEQ ID NO: 302813 - DNA, 20 bp, Artificial
  CRISPR gRNA sequence
tccatctgggtccttcctaa

SEQ ID NO: 302814 - DNA, 20 bp, Artificial
  CRISPR gRNA sequence
ttcctaacagcgtcataaaa

SEQ ID NO: 302815 - DNA, 20 bp, Artificial
  CRISPR gRNA sequence
aacagcgtcataaaatggcc

SEQ ID NO: 302816 - DNA, 20 bp, Artificial
  CRISPR gRNA sequence
gcgtcataaaatggcccagt

SEQ ID NO: 302817 - DNA, 20 bp, Artificial
  CRISPR gRNA sequence
gtcataaaatggcccagttg

SEQ ID NO: 302818 - DNA, 20 bp, Artificial
  CRISPR gRNA sequence
tcataaaatggcccagttgg

SEQ ID NO: 302819 - DNA, 20 bp, Artificial
  CRISPR gRNA sequence
tggcccagttggaggtttcc

SEQ ID NO: 302820 - DNA, 20 bp, Artificial
  CRISPR gRNA sequence
ccagttggaggtttcctagc

SEQ ID NO: 302821 - DNA, 20 bp, Artificial
  CRISPR gRNA sequence
ttggaggtttcctagcaagt

SEQ ID NO: 302822 - DNA, 20 bp, Artificial
  CRISPR gRNA sequence
tggaggtttcctagcaagtc

SEQ ID NO: 302823 - DNA, 20 bp, Artificial
  CRISPR gRNA sequence
ggaggtttcctagcaagtcg

SEQ ID NO: 302824 - DNA, 20 bp, Artificial
  CRISPR gRNA sequence
tcctagcaagtcggggacat

SEQ ID NO: 302825 - DNA, 20 bp, Artificial
  CRISPR gRNA sequence
gacattggatgatctgcctt

SEQ ID NO: 302826 - DNA, 20 bp, Artificial
  CRISPR gRNA sequence
ttgtgtataatacctgctga

SEQ ID NO: 302827 - DNA, 20 bp, Artificial
  CRISPR gRNA sequence
ataatacctgctgaaagaaa

SEQ ID NO: 302828 - DNA, 20 bp, Artificial
  CRISPR gRNA sequence
cctgctgaaagaaatagtct

SEQ ID NO: 302829 - DNA, 20 bp, Artificial
  CRISPR gRNA sequence
aaagaaatagtcttggaaaa

SEQ ID NO: 302830 - DNA, 20 bp, Artificial
  CRISPR gRNA sequence
ttggaaaacagctttaccta

SEQ ID NO: 302831 - DNA, 20 bp, Artificial
  CRISPR gRNA sequence
ggaaaacagctttacctata

SEQ ID NO: 302832 - DNA, 20 bp, Artificial
  CRISPR gRNA sequence
aacagctttacctatagaga

SEQ ID NO: 302833 - DNA, 20 bp, Artificial
  CRISPR gRNA sequence
acagctttacctatagagaa

SEQ ID NO: 302834 - DNA, 20 bp, Artificial
  CRISPR gRNA sequence
tttacctatagagaaaggtg

SEQ ID NO: 302835 - DNA, 20 bp, Artificial
  CRISPR gRNA sequence
atagagaaaggtgaagataa

SEQ ID NO: 302836 - DNA, 20 bp, Artificial
  CRISPR gRNA sequence
agataaaagccgcgtcttgt

SEQ ID NO: 302837 - DNA, 20 bp, Artificial
  CRISPR gRNA sequence
agccgcgtcttgtcagtttc

SEQ ID NO: 302838 - DNA, 20 bp, Artificial
  CRISPR gRNA sequence
tcttgtcagtttccagaata

SEQ ID NO: 302839 - DNA, 20 bp, Artificial
  CRISPR gRNA sequence
tgtcagtttccagaatacag

SEQ ID NO: 302840 - DNA, 20 bp, Artificial
  CRISPR gRNA sequence
agtttccagaatacagaaga

SEQ ID NO: 302841 - DNA, 20 bp, Artificial
  CRISPR gRNA sequence
ggtcatattgctcgtaacat

SEQ ID NO: 302842 - DNA, 20 bp, Artificial
  CRISPR gRNA sequence
gtcatattgctcgtaacatc

SEQ ID NO: 302843 - DNA, 20 bp, Artificial
  CRISPR gRNA sequence
tcatattgctcgtaacatca

SEQ ID NO: 302844 - DNA, 20 bp, Artificial
  CRISPR gRNA sequence
cgtaacatcagggaatgaaa

SEQ ID NO: 302845 - DNA, 20 bp, Artificial
  CRISPR gRNA sequence
catcagggaatgaaacagac

SEQ ID NO: 302846 - DNA, 20 bp, Artificial
  CRISPR gRNA sequence
gaatgaaacagacaagctga

SEQ ID NO: 302847 - DNA, 20 bp, Artificial
  CRISPR gRNA sequence
aagctgatggaaacgtcgta

SEQ ID NO: 302848 - DNA, 20 bp, Artificial
  CRISPR gRNA sequence
cagttctgtgacattatctt

SEQ ID NO: 302849 - DNA, 20 bp, Artificial
  CRISPR gRNA sequence
cataacaccatcatactcga

SEQ ID NO: 302850 - DNA, 20 bp, Artificial
  CRISPR gRNA sequence
atactcgatagttgaattct

SEQ ID NO: 302851 - DNA, 20 bp, Artificial
  CRISPR gRNA sequence
atagttgaattcttggttct

SEQ ID NO: 302852 - DNA, 20 bp, Artificial
  CRISPR gRNA sequence
tagcaaaacactcatcttct

SEQ ID NO: 302853 - DNA, 20 bp, Artificial
  CRISPR gRNA sequence
agcaaaacactcatcttctt

SEQ ID NO: 302854 - DNA, 20 bp, Artificial
  CRISPR gRNA sequence
acactcatcttcttaggttc

SEQ ID NO: 302855 - DNA, 20 bp, Artificial
  CRISPR gRNA sequence
cactcatcttcttaggttct

SEQ ID NO: 302856 - DNA, 20 bp, Artificial
  CRISPR gRNA sequence
aggttctgggtaaccgtgta

SEQ ID NO: 302857 - DNA, 20 bp, Artificial
  CRISPR gRNA sequence
ctgggtaaccgtgtatagat

SEQ ID NO: 302858 - DNA, 20 bp, Artificial
  CRISPR gRNA sequence
ggtaaccgtgtatagatgag

SEQ ID NO: 302859 - DNA, 20 bp, Artificial
  CRISPR gRNA sequence
gtaaccgtgtatagatgagc

SEQ ID NO: 302860 - DNA, 20 bp, Artificial
  CRISPR gRNA sequence
gtacacattttctgttatat

SEQ ID NO: 302861 - DNA, 20 bp, Artificial
  CRISPR gRNA sequence
ttttctgttatattagaaat

SEQ ID NO: 302862 - DNA, 20 bp, Artificial
  CRISPR gRNA sequence
attagaaattggtactattt

SEQ ID NO: 302863 - DNA, 20 bp, Artificial
  CRISPR gRNA sequence
ttagaaattggtactatttc

SEQ ID NO: 302864 - DNA, 20 bp, Artificial
  CRISPR gRNA sequence
gtactatttcaggttgactg

SEQ ID NO: 302865 - DNA, 20 bp, Artificial
  CRISPR gRNA sequence
tatttcaggttgactgaagt

SEQ ID NO: 302866 - DNA, 20 bp, Artificial
  CRISPR gRNA sequence
ggttgactgaagttagctga

SEQ ID NO: 302867 - DNA, 20 bp, Artificial
  CRISPR gRNA sequence
tgactgaagttagctgaaag

SEQ ID NO: 302868 - DNA, 20 bp, Artificial
  CRISPR gRNA sequence
ctgaagttagctgaaagcag

SEQ ID NO: 302869 - DNA, 20 bp, Artificial
  CRISPR gRNA sequence
gaagttagctgaaagcagaa

SEQ ID NO: 302870 - DNA, 20 bp, Artificial
  CRISPR gRNA sequence
agttagctgaaagcagaaga

SEQ ID NO: 302871 - DNA, 20 bp, Artificial
  CRISPR gRNA sequence
agataaaaaaaaatcaatct

SEQ ID NO: 302872 - DNA, 20 bp, Artificial
  CRISPR gRNA sequence
aaaaaaaatcaatctaagtt

SEQ ID NO: 302873 - DNA, 20 bp, Artificial
  CRISPR gRNA sequence
aatctaagtttagatgtatc

SEQ ID NO: 302874 - DNA, 20 bp, Artificial
  CRISPR gRNA sequence
atctaagtttagatgtatct

SEQ ID NO: 302875 - DNA, 20 bp, Artificial
  CRISPR gRNA sequence
ctaagtttagatgtatctag

SEQ ID NO: 302876 - DNA, 20 bp, Artificial
  CRISPR gRNA sequence
taagtttagatgtatctagg

SEQ ID NO: 302877 - DNA, 20 bp, Artificial
  CRISPR gRNA sequence
aagtttagatgtatctagga

SEQ ID NO: 302878 - DNA, 20 bp, Artificial
  CRISPR gRNA sequence
tagatgtatctaggagggaa

SEQ ID NO: 302879 - DNA, 20 bp, Artificial
  CRISPR gRNA sequence
aggagggaatagcaaataac

SEQ ID NO: 302880 - DNA, 20 bp, Artificial
  CRISPR gRNA sequence
ggagggaatagcaaataact

SEQ ID NO: 302881 - DNA, 20 bp, Artificial
  CRISPR gRNA sequence
aaataactgggtacttgatc

SEQ ID NO: 302882 - DNA, 20 bp, Artificial
  CRISPR gRNA sequence
aataactgggtacttgatct

SEQ ID NO: 302883 - DNA, 20 bp, Artificial
  CRISPR gRNA sequence
ataactgggtacttgatctg

SEQ ID NO: 302884 - DNA, 20 bp, Artificial
  CRISPR gRNA sequence
gtacttgatctggggctcat

SEQ ID NO: 302885 - DNA, 20 bp, Artificial
  CRISPR gRNA sequence
tacttgatctggggctcatt

SEQ ID NO: 302886 - DNA, 20 bp, Artificial
  CRISPR gRNA sequence
acttgatctggggctcattg

SEQ ID NO: 302887 - DNA, 20 bp, Artificial
  CRISPR gRNA sequence
ggggctcattggggcacacc

SEQ ID NO: 302888 - DNA, 20 bp, Artificial
  CRISPR gRNA sequence
gggctcattggggcacacct

SEQ ID NO: 302889 - DNA, 20 bp, Artificial
  CRISPR gRNA sequence
gctcattggggcacacctgg

SEQ ID NO: 302890 - DNA, 20 bp, Artificial
  CRISPR gRNA sequence
tggggcacacctgggagcct

SEQ ID NO: 302891 - DNA, 20 bp, Artificial
  CRISPR gRNA sequence
ggggcacacctgggagcctc

SEQ ID NO: 302892 - DNA, 20 bp, Artificial
  CRISPR gRNA sequence
gggcacacctgggagcctca

SEQ ID NO: 302893 - DNA, 20 bp, Artificial
  CRISPR gRNA sequence
ggtgtctaaaatgtgaccct

SEQ ID NO: 302894 - DNA, 20 bp, Artificial
  CRISPR gRNA sequence
taaaatgtgaccctcagccc

SEQ ID NO: 302895 - DNA, 20 bp, Artificial
  CRISPR gRNA sequence
aaaatgtgaccctcagccca

SEQ ID NO: 302896 - DNA, 20 bp, Artificial
  CRISPR gRNA sequence
tgtgaccctcagcccaaggt

SEQ ID NO: 302897 - DNA, 20 bp, Artificial
  CRISPR gRNA sequence
tcatgtttatttttcaacaa

SEQ ID NO: 302898 - DNA, 20 bp, Artificial
  CRISPR gRNA sequence
atgtttatttttcaacaata

SEQ ID NO: 302899 - DNA, 20 bp, Artificial
  CRISPR gRNA sequence
tttttcaacaatagagtttg

SEQ ID NO: 302900 - DNA, 20 bp, Artificial
  CRISPR gRNA sequence
cttcctgcttatccaaatca

SEQ ID NO: 302901 - DNA, 20 bp, Artificial
  CRISPR gRNA sequence
ttcctgcttatccaaatcaa

SEQ ID NO: 302902 - DNA, 20 bp, Artificial
  CRISPR gRNA sequence
tcctgcttatccaaatcaaa

SEQ ID NO: 302903 - DNA, 20 bp, Artificial
  CRISPR gRNA sequence
cctgcttatccaaatcaaag

SEQ ID NO: 302904 - DNA, 20 bp, Artificial
  CRISPR gRNA sequence
aaatcaaaggggtgctctct

SEQ ID NO: 302905 - DNA, 20 bp, Artificial
  CRISPR gRNA sequence
aaggggtgctctctaagtga

SEQ ID NO: 302906 - DNA, 20 bp, Artificial
  CRISPR gRNA sequence
aggggtgctctctaagtgac

SEQ ID NO: 302907 - DNA, 20 bp, Artificial
  CRISPR gRNA sequence
gggtgctctctaagtgacag

SEQ ID NO: 302908 - DNA, 20 bp, Artificial
  CRISPR gRNA sequence
ggtgctctctaagtgacagg

SEQ ID NO: 302909 - DNA, 20 bp, Artificial
  CRISPR gRNA sequence
gtgctctctaagtgacagga

SEQ ID NO: 302910 - DNA, 20 bp, Artificial
  CRISPR gRNA sequence
gtgacaggagggctgtaatt

SEQ ID NO: 302911 - DNA, 20 bp, Artificial
  CRISPR gRNA sequence
gggctgtaattgagtcacca

SEQ ID NO: 302912 - DNA, 20 bp, Artificial
  CRISPR gRNA sequence
gtcaccaaagatttacaatg

SEQ ID NO: 302913 - DNA, 20 bp, Artificial
  CRISPR gRNA sequence
tacaatgaagccactgtttc

SEQ ID NO: 302914 - DNA, 20 bp, Artificial
  CRISPR gRNA sequence
acaatgaagccactgtttcc

SEQ ID NO: 302915 - DNA, 20 bp, Artificial
  CRISPR gRNA sequence
caatgaagccactgtttcca

SEQ ID NO: 302916 - DNA, 20 bp, Artificial
  CRISPR gRNA sequence
atgaagccactgtttccagg

SEQ ID NO: 302917 - DNA, 20 bp, Artificial
  CRISPR gRNA sequence
aagccactgtttccagggag

SEQ ID NO: 302918 - DNA, 20 bp, Artificial
  CRISPR gRNA sequence
gccactgtttccagggagta

SEQ ID NO: 302919 - DNA, 20 bp, Artificial
  CRISPR gRNA sequence
tttccagggagtagagtctt

SEQ ID NO: 302920 - DNA, 20 bp, Artificial
  CRISPR gRNA sequence
ccagggagtagagtctttgg

SEQ ID NO: 302921 - DNA, 20 bp, Artificial
  CRISPR gRNA sequence
cagggagtagagtctttgga

SEQ ID NO: 302922 - DNA, 20 bp, Artificial
  CRISPR gRNA sequence
gggagtagagtctttggaag

SEQ ID NO: 302923 - DNA, 20 bp, Artificial
  CRISPR gRNA sequence
agtagagtctttggaaggag

SEQ ID NO: 302924 - DNA, 20 bp, Artificial
  CRISPR gRNA sequence
agagtctttggaaggagaag

SEQ ID NO: 302925 - DNA, 20 bp, Artificial
  CRISPR gRNA sequence
aaggagaagtggtctgactc

SEQ ID NO: 302926 - DNA, 20 bp, Artificial
  CRISPR gRNA sequence
aggagaagtggtctgactct

SEQ ID NO: 302927 - DNA, 20 bp, Artificial
  CRISPR gRNA sequence
ggagaagtggtctgactcta

SEQ ID NO: 302928 - DNA, 20 bp, Artificial
  CRISPR gRNA sequence
agtggtctgactctagggcc

SEQ ID NO: 302929 - DNA, 20 bp, Artificial
  CRISPR gRNA sequence
gtggtctgactctagggccc

SEQ ID NO: 302930 - DNA, 20 bp, Artificial
  CRISPR gRNA sequence
tctagggcccaggtgtccca

SEQ ID NO: 302931 - DNA, 20 bp, Artificial
  CRISPR gRNA sequence
ctagggcccaggtgtcccat

SEQ ID NO: 302932 - DNA, 20 bp, Artificial
  CRISPR gRNA sequence
tagggcccaggtgtcccatg

SEQ ID NO: 302933 - DNA, 20 bp, Artificial
  CRISPR gRNA sequence
gtgtcccatggggcacattc

SEQ ID NO: 302934 - DNA, 20 bp, Artificial
  CRISPR gRNA sequence
tggggcacattccagctccc

SEQ ID NO: 302935 - DNA, 20 bp, Artificial
  CRISPR gRNA sequence
acattccagctccccagact

SEQ ID NO: 302936 - DNA, 20 bp, Artificial
  CRISPR gRNA sequence
attccagctccccagactaa

SEQ ID NO: 302937 - DNA, 20 bp, Artificial
  CRISPR gRNA sequence
tccagctccccagactaaga

SEQ ID NO: 302938 - DNA, 20 bp, Artificial
  CRISPR gRNA sequence
agctccccagactaagagag

SEQ ID NO: 302939 - DNA, 20 bp, Artificial
  CRISPR gRNA sequence
gctccccagactaagagagc

SEQ ID NO: 302940 - DNA, 20 bp, Artificial
  CRISPR gRNA sequence
ccccagactaagagagcagg

SEQ ID NO: 302941 - DNA, 20 bp, Artificial
  CRISPR gRNA sequence
cccagactaagagagcagga

SEQ ID NO: 302942 - DNA, 20 bp, Artificial
  CRISPR gRNA sequence
taagagagcaggaaggaatt

SEQ ID NO: 302943 - DNA, 20 bp, Artificial
  CRISPR gRNA sequence
agagcaggaaggaattgagc

SEQ ID NO: 302944 - DNA, 20 bp, Artificial
  CRISPR gRNA sequence
agcaggaaggaattgagctg

SEQ ID NO: 302945 - DNA, 20 bp, Artificial
  CRISPR gRNA sequence
gaattgagctggagtctcac

SEQ ID NO: 302946 - DNA, 20 bp, Artificial
  CRISPR gRNA sequence
aattgagctggagtctcacc

SEQ ID NO: 302947 - DNA, 20 bp, Artificial
  CRISPR gRNA sequence
ggagtctcaccaggaactga

SEQ ID NO: 302948 - DNA, 20 bp, Artificial
  CRISPR gRNA sequence
agtctcaccaggaactgaca

SEQ ID NO: 302949 - DNA, 20 bp, Artificial
  CRISPR gRNA sequence
ccaggaactgacagagttca

SEQ ID NO: 302950 - DNA, 20 bp, Artificial
  CRISPR gRNA sequence
ctgacagagttcatggtgct

SEQ ID NO: 302951 - DNA, 20 bp, Artificial
  CRISPR gRNA sequence
atgccctgcgtcatatcttt

SEQ ID NO: 302952 - DNA, 20 bp, Artificial
  CRISPR gRNA sequence
gtcatatctttcagaaaccc

SEQ ID NO: 302953 - DNA, 20 bp, Artificial
  CRISPR gRNA sequence
atatctttcagaaacccaag

SEQ ID NO: 302954 - DNA, 20 bp, Artificial
  CRISPR gRNA sequence
tatctttcagaaacccaagc

SEQ ID NO: 302955 - DNA, 20 bp, Artificial
  CRISPR gRNA sequence
cagaaacccaagcaggattg

SEQ ID NO: 302956 - DNA, 20 bp, Artificial
  CRISPR gRNA sequence
aacccaagcaggattgtggt

SEQ ID NO: 302957 - DNA, 20 bp, Artificial
  CRISPR gRNA sequence
caagcaggattgtggtaagt

SEQ ID NO: 302958 - DNA, 20 bp, Artificial
  CRISPR gRNA sequence
gcaggattgtggtaagtgag

SEQ ID NO: 302959 - DNA, 20 bp, Artificial
  CRISPR gRNA sequence
caggattgtggtaagtgagt

SEQ ID NO: 302960 - DNA, 20 bp, Artificial
  CRISPR gRNA sequence
gattgtggtaagtgagtggg

SEQ ID NO: 302961 - DNA, 20 bp, Artificial
  CRISPR gRNA sequence
aagtgagtgggtggatattt

SEQ ID NO: 302962 - DNA, 20 bp, Artificial
  CRISPR gRNA sequence
atattttggaattcgaaatt

SEQ ID NO: 302963 - DNA, 20 bp, Artificial
  CRISPR gRNA sequence
aaattcagaacactgatttt

SEQ ID NO: 302964 - DNA, 20 bp, Artificial
  CRISPR gRNA sequence
agaacactgatttttggcat

SEQ ID NO: 302965 - DNA, 20 bp, Artificial
  CRISPR gRNA sequence
gatttttggcatgagcatca

SEQ ID NO: 302966 - DNA, 20 bp, Artificial
  CRISPR gRNA sequence
gtgtcttcataacatactct

SEQ ID NO: 302967 - DNA, 20 bp, Artificial
  CRISPR gRNA sequence
tcttcataacatactctaag

SEQ ID NO: 302968 - DNA, 20 bp, Artificial
  CRISPR gRNA sequence
tcataacatactctaagaag

SEQ ID NO: 302969 - DNA, 20 bp, Artificial
  CRISPR gRNA sequence
cataacatactctaagaaga

SEQ ID NO: 302970 - DNA, 20 bp, Artificial
  CRISPR gRNA sequence
tctaagaagaaggccaaatc

SEQ ID NO: 302971 - DNA, 20 bp, Artificial
  CRISPR gRNA sequence
aaggccaaatccagctattt

SEQ ID NO: 302972 - DNA, 20 bp, Artificial
  CRISPR gRNA sequence
aggccaaatccagctatttt

SEQ ID NO: 302973 - DNA, 20 bp, Artificial
  CRISPR gRNA sequence
ggccaaatccagctatttta

SEQ ID NO: 302974 - DNA, 20 bp, Artificial
  CRISPR gRNA sequence
atacatgatcttaataaaca

SEQ ID NO: 302975 - DNA, 20 bp, Artificial
  CRISPR gRNA sequence
ctttgccattctcacttttc

SEQ ID NO: 302976 - DNA, 20 bp, Artificial
  CRISPR gRNA sequence
ttctcacttttctggctgtt

SEQ ID NO: 302977 - DNA, 20 bp, Artificial
  CRISPR gRNA sequence
tctcacttttctggctgttc

SEQ ID NO: 302978 - DNA, 20 bp, Artificial
  CRISPR gRNA sequence
ttctggctgttcaggatcac

SEQ ID NO: 302979 - DNA, 20 bp, Artificial
  CRISPR gRNA sequence
gctgttcaggatcactggca

SEQ ID NO: 302980 - DNA, 20 bp, Artificial
  CRISPR gRNA sequence
tgttcaggatcactggcatg

SEQ ID NO: 302981 - DNA, 20 bp, Artificial
  CRISPR gRNA sequence
gatcactggcatggagtccc

SEQ ID NO: 302982 - DNA, 20 bp, Artificial
  CRISPR gRNA sequence
ctgtgtcatgtgccttctgt

SEQ ID NO: 302983 - DNA, 20 bp, Artificial
  CRISPR gRNA sequence
aaaaatcccttgttctttta

SEQ ID NO: 302984 - DNA, 20 bp, Artificial
  CRISPR gRNA sequence
ccttgttcttttatagttac

SEQ ID NO: 302985 - DNA, 20 bp, Artificial
  CRISPR gRNA sequence
cttgttcttttatagttact

SEQ ID NO: 302986 - DNA, 20 bp, Artificial
  CRISPR gRNA sequence
gttcttttatagttactagg

SEQ ID NO: 302987 - DNA, 20 bp, Artificial
  CRISPR gRNA sequence
tatagttactaggtagtttg

SEQ ID NO: 302988 - DNA, 20 bp, Artificial
  CRISPR gRNA sequence
atagttactaggtagtttgc

SEQ ID NO: 302989 - DNA, 20 bp, Artificial
  CRISPR gRNA sequence
ctacaaactaatttataatt

SEQ ID NO: 302990 - DNA, 20 bp, Artificial
  CRISPR gRNA sequence
atttagtgtattcttactaa

SEQ ID NO: 302991 - DNA, 20 bp, Artificial
  CRISPR gRNA sequence
tttagtgtattcttactaaa

SEQ ID NO: 302992 - DNA, 20 bp, Artificial
  CRISPR gRNA sequence
catttgcatgtcatctttat

SEQ ID NO: 302993 - DNA, 20 bp, Artificial
  CRISPR gRNA sequence
ctttataagttttgctatat

SEQ ID NO: 302994 - DNA, 20 bp, Artificial
  CRISPR gRNA sequence
gctatatcagtgtactattt

SEQ ID NO: 302995 - DNA, 20 bp, Artificial
  CRISPR gRNA sequence
atatcagtgtactatttgag

SEQ ID NO: 302996 - DNA, 20 bp, Artificial
  CRISPR gRNA sequence
tactatttgagcagtcttct

SEQ ID NO: 302997 - DNA, 20 bp, Artificial
  CRISPR gRNA sequence
ctatttgagcagtcttcttg

SEQ ID NO: 302998 - DNA, 20 bp, Artificial
  CRISPR gRNA sequence
cagtcttcttggagtctatg

SEQ ID NO: 302999 - DNA, 20 bp, Artificial
  CRISPR gRNA sequence
cttggagtctatgtggcctg

SEQ ID NO: 303000 - DNA, 20 bp, Artificial
  CRISPR gRNA sequence
ggagtctatgtggcctgtag

SEQ ID NO: 303001 - DNA, 20 bp, Artificial
  CRISPR gRNA sequence
gagtctatgtggcctgtaga

SEQ ID NO: 303002 - DNA, 20 bp, Artificial
  CRISPR gRNA sequence
gcctgtagaaggtgaattgc

SEQ ID NO: 303003 - DNA, 20 bp, Artificial
  CRISPR gRNA sequence
gtgaattgccagaccgtgtt

SEQ ID NO: 303004 - DNA, 20 bp, Artificial
  CRISPR gRNA sequence
ccgtgtttagcttcattaac

SEQ ID NO: 303005 - DNA, 20 bp, Artificial
  CRISPR gRNA sequence
tgtgaaatcacatgttgcgt

SEQ ID NO: 303006 - DNA, 20 bp, Artificial
  CRISPR gRNA sequence
aaatcacatgttgcgtaagt

SEQ ID NO: 303007 - DNA, 20 bp, Artificial
  CRISPR gRNA sequence
atcacatgttgcgtaagtta

SEQ ID NO: 303008 - DNA, 20 bp, Artificial
  CRISPR gRNA sequence
acattaaaacaaatacaaca

SEQ ID NO: 303009 - DNA, 20 bp, Artificial
  CRISPR gRNA sequence
cccacctaaaacatttccaa

SEQ ID NO: 303010 - DNA, 20 bp, Artificial
  CRISPR gRNA sequence
ctgaccacattttgaaaaca

SEQ ID NO: 303011 - DNA, 20 bp, Artificial
  CRISPR gRNA sequence
acattttgaaaacacggatt

SEQ ID NO: 303012 - DNA, 20 bp, Artificial
  CRISPR gRNA sequence
gaaaacacggatttagcact

SEQ ID NO: 303013 - DNA, 20 bp, Artificial
  CRISPR gRNA sequence
cacttggttaactattccta

SEQ ID NO: 303014 - DNA, 20 bp, Artificial
  CRISPR gRNA sequence
taactattcctaaagccctg

SEQ ID NO: 303015 - DNA, 20 bp, Artificial
  CRISPR gRNA sequence
attcctaaagccctgcagcc

SEQ ID NO: 303016 - DNA, 20 bp, Artificial
  CRISPR gRNA sequence
gcagcctagtttaaatcaca

SEQ ID NO: 303017 - DNA, 20 bp, Artificial
  CRISPR gRNA sequence
cagcctagtttaaatcacac

SEQ ID NO: 303018 - DNA, 20 bp, Artificial
  CRISPR gRNA sequence
agcctagtttaaatcacaca

SEQ ID NO: 303019 - DNA, 20 bp, Artificial
  CRISPR gRNA sequence
tttaaatcacacagggttca

SEQ ID NO: 303020 - DNA, 20 bp, Artificial
  CRISPR gRNA sequence
ttaaatcacacagggttcaa

SEQ ID NO: 303021 - DNA, 20 bp, Artificial
  CRISPR gRNA sequence
taaatcacacagggttcaaa

SEQ ID NO: 303022 - DNA, 20 bp, Artificial
  CRISPR gRNA sequence
aatcacacagggttcaaagg

SEQ ID NO: 303023 - DNA, 20 bp, Artificial
  CRISPR gRNA sequence
cacacagggttcaaagggag

SEQ ID NO: 303024 - DNA, 20 bp, Artificial
  CRISPR gRNA sequence
tttgcttctgttttactcta

SEQ ID NO: 303025 - DNA, 20 bp, Artificial
  CRISPR gRNA sequence
tctgttttactctatggttt

SEQ ID NO: 303026 - DNA, 20 bp, Artificial
  CRISPR gRNA sequence
tttactctatggttttagaa

SEQ ID NO: 303027 - DNA, 20 bp, Artificial
  CRISPR gRNA sequence
ttactctatggttttagaat

SEQ ID NO: 303028 - DNA, 20 bp, Artificial
  CRISPR gRNA sequence
aggtgttgatctgccttttc

SEQ ID NO: 303029 - DNA, 20 bp, Artificial
  CRISPR gRNA sequence
agtttcatcaaaaattaacc

SEQ ID NO: 303030 - DNA, 20 bp, Artificial
  CRISPR gRNA sequence
atcaaaaattaacctggatc

SEQ ID NO: 303031 - DNA, 20 bp, Artificial
  CRISPR gRNA sequence
ggatccagtaataccacacc

SEQ ID NO: 303032 - DNA, 20 bp, Artificial
  CRISPR gRNA sequence
gatccagtaataccacacct

SEQ ID NO: 303033 - DNA, 20 bp, Artificial
  CRISPR gRNA sequence
ccacacctgggtatttcctc

SEQ ID NO: 303034 - DNA, 20 bp, Artificial
  CRISPR gRNA sequence
acacctgggtatttcctcta

SEQ ID NO: 303035 - DNA, 20 bp, Artificial
  CRISPR gRNA sequence
ggtatttcctctagagaact

SEQ ID NO: 303036 - DNA, 20 bp, Artificial
  CRISPR gRNA sequence
aacctgtacatgaacgttta

SEQ ID NO: 303037 - DNA, 20 bp, Artificial
  CRISPR gRNA sequence
ctgtacatgaacgtttacag

SEQ ID NO: 303038 - DNA, 20 bp, Artificial
  CRISPR gRNA sequence
tttacagcagccttattcat

SEQ ID NO: 303039 - DNA, 20 bp, Artificial
  CRISPR gRNA sequence
tacagcagccttattcataa

SEQ ID NO: 303040 - DNA, 20 bp, Artificial
  CRISPR gRNA sequence
tattcataagagccccaaac

SEQ ID NO: 303041 - DNA, 20 bp, Artificial
  CRISPR gRNA sequence
acaacccaatgtcttttact

SEQ ID NO: 303042 - DNA, 20 bp, Artificial
  CRISPR gRNA sequence
atgtcttttactgagttgaa

SEQ ID NO: 303043 - DNA, 20 bp, Artificial
  CRISPR gRNA sequence
ataaacaataaaatgctact

SEQ ID NO: 303044 - DNA, 20 bp, Artificial
  CRISPR gRNA sequence
aaatgctactcagcaataaa

SEQ ID NO: 303045 - DNA, 20 bp, Artificial
  CRISPR gRNA sequence
aatgctactcagcaataaaa

SEQ ID NO: 303046 - DNA, 20 bp, Artificial
  CRISPR gRNA sequence
atgctactcagcaataaaaa

SEQ ID NO: 303047 - DNA, 20 bp, Artificial
  CRISPR gRNA sequence
actcagcaataaaaagggac

SEQ ID NO: 303048 - DNA, 20 bp, Artificial
  CRISPR gRNA sequence
gctcgatatgtgcaacaact

SEQ ID NO: 303049 - DNA, 20 bp, Artificial
  CRISPR gRNA sequence
ctcgatatgtgcaacaactt

SEQ ID NO: 303050 - DNA, 20 bp, Artificial
  CRISPR gRNA sequence
aacaacttgggtgaatctcg

SEQ ID NO: 303051 - DNA, 20 bp, Artificial
  CRISPR gRNA sequence
acaacttgggtgaatctcga

SEQ ID NO: 303052 - DNA, 20 bp, Artificial
  CRISPR gRNA sequence
ctcgaaggcgcgctaaacga

SEQ ID NO: 303053 - DNA, 20 bp, Artificial
  CRISPR gRNA sequence
gaaggcgcgctaaacgaaag

SEQ ID NO: 303054 - DNA, 20 bp, Artificial
  CRISPR gRNA sequence
gcgcgctaaacgaaagaagc

SEQ ID NO: 303055 - DNA, 20 bp, Artificial
  CRISPR gRNA sequence
cgcgctaaacgaaagaagcc

SEQ ID NO: 303056 - DNA, 20 bp, Artificial
  CRISPR gRNA sequence
acgaaagaagccaggcttaa

SEQ ID NO: 303057 - DNA, 20 bp, Artificial
  CRISPR gRNA sequence
cgaaagaagccaggcttaaa

SEQ ID NO: 303058 - DNA, 20 bp, Artificial
  CRISPR gRNA sequence
ttaaaaggttacatactgtg

SEQ ID NO: 303059 - DNA, 20 bp, Artificial
  CRISPR gRNA sequence
acttatgtgacactgtcaaa

SEQ ID NO: 303060 - DNA, 20 bp, Artificial
  CRISPR gRNA sequence
ctgtcaaaaagacaaaacta

SEQ ID NO: 303061 - DNA, 20 bp, Artificial
  CRISPR gRNA sequence
tgtcaaaaagacaaaactat

SEQ ID NO: 303062 - DNA, 20 bp, Artificial
  CRISPR gRNA sequence
aaaactataggatgcccaac

SEQ ID NO: 303063 - DNA, 20 bp, Artificial
  CRISPR gRNA sequence
aaactataggatgcccaaca

SEQ ID NO: 303064 - DNA, 20 bp, Artificial
  CRISPR gRNA sequence
aactataggatgcccaacaa

SEQ ID NO: 303065 - DNA, 20 bp, Artificial
  CRISPR gRNA sequence
ggatgcccaacaagggttat

SEQ ID NO: 303066 - DNA, 20 bp, Artificial
  CRISPR gRNA sequence
cccaacaagggttatgagtg

SEQ ID NO: 303067 - DNA, 20 bp, Artificial
  CRISPR gRNA sequence
acaagggttatgagtgcaga

SEQ ID NO: 303068 - DNA, 20 bp, Artificial
  CRISPR gRNA sequence
caagggttatgagtgcagac

SEQ ID NO: 303069 - DNA, 20 bp, Artificial
  CRISPR gRNA sequence
aagggttatgagtgcagaca

SEQ ID NO: 303070 - DNA, 20 bp, Artificial
  CRISPR gRNA sequence
agacagggtatgactctatg

SEQ ID NO: 303071 - DNA, 20 bp, Artificial
  CRISPR gRNA sequence
gacagggtatgactctatga

SEQ ID NO: 303072 - DNA, 20 bp, Artificial
  CRISPR gRNA sequence
acagggtatgactctatgaa

SEQ ID NO: 303073 - DNA, 20 bp, Artificial
  CRISPR gRNA sequence
ggtatgactctatgaaggga

SEQ ID NO: 303074 - DNA, 20 bp, Artificial
  CRISPR gRNA sequence
actctatgaagggacagcct

SEQ ID NO: 303075 - DNA, 20 bp, Artificial
  CRISPR gRNA sequence
ctctatgaagggacagcctg

SEQ ID NO: 303076 - DNA, 20 bp, Artificial
  CRISPR gRNA sequence
tctatgaagggacagcctga

SEQ ID NO: 303077 - DNA, 20 bp, Artificial
  CRISPR gRNA sequence
gacagcctgagggaaatttt

SEQ ID NO: 303078 - DNA, 20 bp, Artificial
  CRISPR gRNA sequence
acagcctgagggaaattttt

SEQ ID NO: 303079 - DNA, 20 bp, Artificial
  CRISPR gRNA sequence
cagcctgagggaaattttta

SEQ ID NO: 303080 - DNA, 20 bp, Artificial
  CRISPR gRNA sequence
gagggaaatttttagggtga

SEQ ID NO: 303081 - DNA, 20 bp, Artificial
  CRISPR gRNA sequence
tagaaatgctctatgtcctg

SEQ ID NO: 303082 - DNA, 20 bp, Artificial
  CRISPR gRNA sequence
aaatgctctatgtcctgtgg

SEQ ID NO: 303083 - DNA, 20 bp, Artificial
  CRISPR gRNA sequence
gcggttacctaaatctatac

SEQ ID NO: 303084 - DNA, 20 bp, Artificial
  CRISPR gRNA sequence
ctatacaagatctatacaat

SEQ ID NO: 303085 - DNA, 20 bp, Artificial
  CRISPR gRNA sequence
tacaagatctatacaatcag

SEQ ID NO: 303086 - DNA, 20 bp, Artificial
  CRISPR gRNA sequence
gatctatacaatcagtagaa

SEQ ID NO: 303087 - DNA, 20 bp, Artificial
  CRISPR gRNA sequence
aaaataattttactgtgtga

SEQ ID NO: 303088 - DNA, 20 bp, Artificial
  CRISPR gRNA sequence
gatagttttaaaaaaatctg

SEQ ID NO: 303089 - DNA, 20 bp, Artificial
  CRISPR gRNA sequence
agttttaaaaaaatctgtag

SEQ ID NO: 303090 - DNA, 20 bp, Artificial
  CRISPR gRNA sequence
aaaaaatctgtagtggcatt

SEQ ID NO: 303091 - DNA, 20 bp, Artificial
  CRISPR gRNA sequence
aaaaatctgtagtggcattt

SEQ ID NO: 303092 - DNA, 20 bp, Artificial
  CRISPR gRNA sequence
tagtggcatttaggccttcc

SEQ ID NO: 303093 - DNA, 20 bp, Artificial
  CRISPR gRNA sequence
agtggcatttaggccttcca

SEQ ID NO: 303094 - DNA, 20 bp, Artificial
  CRISPR gRNA sequence
aggccttccaaggtctcgtg

SEQ ID NO: 303095 - DNA, 20 bp, Artificial
  CRISPR gRNA sequence
ccttccaaggtctcgtgaag

SEQ ID NO: 303096 - DNA, 20 bp, Artificial
  CRISPR gRNA sequence
ttccaaggtctcgtgaagca

SEQ ID NO: 303097 - DNA, 20 bp, Artificial
  CRISPR gRNA sequence
tccaaggtctcgtgaagcag

SEQ ID NO: 303098 - DNA, 20 bp, Artificial
  CRISPR gRNA sequence
caaggtctcgtgaagcagag

SEQ ID NO: 303099 - DNA, 20 bp, Artificial
  CRISPR gRNA sequence
gtctcgtgaagcagaggagc

SEQ ID NO: 303100 - DNA, 20 bp, Artificial
  CRISPR gRNA sequence
aagcagaggagctggtttgt

SEQ ID NO: 303101 - DNA, 20 bp, Artificial
  CRISPR gRNA sequence
ggagctggtttgtaagtttg

SEQ ID NO: 303102 - DNA, 20 bp, Artificial
  CRISPR gRNA sequence
gagctggtttgtaagtttgt

SEQ ID NO: 303103 - DNA, 20 bp, Artificial
  CRISPR gRNA sequence
agtttgtgggttatgtttgt

SEQ ID NO: 303104 - DNA, 20 bp, Artificial
  CRISPR gRNA sequence
gtttgtgggttatgtttgtt

SEQ ID NO: 303105 - DNA, 20 bp, Artificial
  CRISPR gRNA sequence
tttttttcccttctgtctac

SEQ ID NO: 303106 - DNA, 20 bp, Artificial
  CRISPR gRNA sequence
ttttttcccttctgtctacc

SEQ ID NO: 303107 - DNA, 20 bp, Artificial
  CRISPR gRNA sequence
ccttctgtctaccaggctca

SEQ ID NO: 303108 - DNA, 20 bp, Artificial
  CRISPR gRNA sequence
gtctaccaggctcatggttg

SEQ ID NO: 303109 - DNA, 20 bp, Artificial
  CRISPR gRNA sequence
taccaggctcatggttgtgg

SEQ ID NO: 303110 - DNA, 20 bp, Artificial
  CRISPR gRNA sequence
tgtggcagcaaacaactcat

SEQ ID NO: 303111 - DNA, 20 bp, Artificial
  CRISPR gRNA sequence
caaacaactcataagcaacc

SEQ ID NO: 303112 - DNA, 20 bp, Artificial
  CRISPR gRNA sequence
aacaactcataagcaaccta

SEQ ID NO: 303113 - DNA, 20 bp, Artificial
  CRISPR gRNA sequence
acaactcataagcaacctag

SEQ ID NO: 303114 - DNA, 20 bp, Artificial
  CRISPR gRNA sequence
aactcataagcaacctagag

SEQ ID NO: 303115 - DNA, 20 bp, Artificial
  CRISPR gRNA sequence
actcataagcaacctagagg

SEQ ID NO: 303116 - DNA, 20 bp, Artificial
  CRISPR gRNA sequence
aagcaacctagaggaggctg

SEQ ID NO: 303117 - DNA, 20 bp, Artificial
  CRISPR gRNA sequence
agcaacctagaggaggctga

SEQ ID NO: 303118 - DNA, 20 bp, Artificial
  CRISPR gRNA sequence
gcaacctagaggaggctgaa

SEQ ID NO: 303119 - DNA, 20 bp, Artificial
  CRISPR gRNA sequence
aagggaaaacccaaatgtgt

SEQ ID NO: 303120 - DNA, 20 bp, Artificial
  CRISPR gRNA sequence
gtgtcagctgtccgctttgc

SEQ ID NO: 303121 - DNA, 20 bp, Artificial
  CRISPR gRNA sequence
tgtcagctgtccgctttgct

SEQ ID NO: 303122 - DNA, 20 bp, Artificial
  CRISPR gRNA sequence
tcagctgtccgctttgctag

SEQ ID NO: 303123 - DNA, 20 bp, Artificial
  CRISPR gRNA sequence
gtccgctttgctaggagctc

SEQ ID NO: 303124 - DNA, 20 bp, Artificial
  CRISPR gRNA sequence
tccgctttgctaggagctcc

SEQ ID NO: 303125 - DNA, 20 bp, Artificial
  CRISPR gRNA sequence
tttgctaggagctccaggca

SEQ ID NO: 303126 - DNA, 20 bp, Artificial
  CRISPR gRNA sequence
aggagctccaggcaaagatt

SEQ ID NO: 303127 - DNA, 20 bp, Artificial
  CRISPR gRNA sequence
agctccaggcaaagatttag

SEQ ID NO: 303128 - DNA, 20 bp, Artificial
  CRISPR gRNA sequence
gctccaggcaaagatttagt

SEQ ID NO: 303129 - DNA, 20 bp, Artificial
  CRISPR gRNA sequence
atttagtaggtgaaaaatct

SEQ ID NO: 303130 - DNA, 20 bp, Artificial
  CRISPR gRNA sequence
aggtgaaaaatcttggaccc

SEQ ID NO: 303131 - DNA, 20 bp, Artificial
  CRISPR gRNA sequence
ggtgaaaaatcttggaccca

SEQ ID NO: 303132 - DNA, 20 bp, Artificial
  CRISPR gRNA sequence
cccaaggaaaaaatgaatgt

SEQ ID NO: 303133 - DNA, 20 bp, Artificial
  CRISPR gRNA sequence
aaaatgaatgtaagacatct

SEQ ID NO: 303134 - DNA, 20 bp, Artificial
  CRISPR gRNA sequence
aaatgaatgtaagacatctg

SEQ ID NO: 303135 - DNA, 20 bp, Artificial
  CRISPR gRNA sequence
taagacatctgaggccttta

SEQ ID NO: 303136 - DNA, 20 bp, Artificial
  CRISPR gRNA sequence
tggttatataaactttgtga

SEQ ID NO: 303137 - DNA, 20 bp, Artificial
  CRISPR gRNA sequence
tgtgatggccaaattatcca

SEQ ID NO: 303138 - DNA, 20 bp, Artificial
  CRISPR gRNA sequence
attatccatggtttttacta

SEQ ID NO: 303139 - DNA, 20 bp, Artificial
  CRISPR gRNA sequence
ttatccatggtttttactat

SEQ ID NO: 303140 - DNA, 20 bp, Artificial
  CRISPR gRNA sequence
tggtttttactataggtaat

SEQ ID NO: 303141 - DNA, 20 bp, Artificial
  CRISPR gRNA sequence
ccatattatctttgttcaat

SEQ ID NO: 303142 - DNA, 20 bp, Artificial
  CRISPR gRNA sequence
ttagctctattttttcccca

SEQ ID NO: 303143 - DNA, 20 bp, Artificial
  CRISPR gRNA sequence
gctctattttttccccaaag

SEQ ID NO: 303144 - DNA, 20 bp, Artificial
  CRISPR gRNA sequence
gcagatttttactgatcctt

SEQ ID NO: 303145 - DNA, 20 bp, Artificial
  CRISPR gRNA sequence
gatttttactgatccttcag

SEQ ID NO: 303146 - DNA, 20 bp, Artificial
  CRISPR gRNA sequence
ttttactgatccttcagaag

SEQ ID NO: 303147 - DNA, 20 bp, Artificial
  CRISPR gRNA sequence
cttcagaagcagactataaa

SEQ ID NO: 303148 - DNA, 20 bp, Artificial
  CRISPR gRNA sequence
gcagactataaaaagtacaa

SEQ ID NO: 303149 - DNA, 20 bp, Artificial
  CRISPR gRNA sequence
taaaaagtacaaaagacttt

SEQ ID NO: 303150 - DNA, 20 bp, Artificial
  CRISPR gRNA sequence
gactttcagttccctactcc

SEQ ID NO: 303151 - DNA, 20 bp, Artificial
  CRISPR gRNA sequence
ctcccttcaaatgcacttcc

SEQ ID NO: 303152 - DNA, 20 bp, Artificial
  CRISPR gRNA sequence
ccttcaaatgcacttcccag

SEQ ID NO: 303153 - DNA, 20 bp, Artificial
  CRISPR gRNA sequence
tcaaatgcacttcccagaag

SEQ ID NO: 303154 - DNA, 20 bp, Artificial
  CRISPR gRNA sequence
tgtcctctgccttctctcta

SEQ ID NO: 303155 - DNA, 20 bp, Artificial
  CRISPR gRNA sequence
tatagaccccccttttcccc

SEQ ID NO: 303156 - DNA, 20 bp, Artificial
  CRISPR gRNA sequence
atagaccccccttttcccct

SEQ ID NO: 303157 - DNA, 20 bp, Artificial
  CRISPR gRNA sequence
ccttttcccctgggcccctc

SEQ ID NO: 303158 - DNA, 20 bp, Artificial
  CRISPR gRNA sequence
gggcccctcaagtccccctc

SEQ ID NO: 303159 - DNA, 20 bp, Artificial
  CRISPR gRNA sequence
gtgtttttctaactcatttg

SEQ ID NO: 303160 - DNA, 20 bp, Artificial
  CRISPR gRNA sequence
actcatttgcagtctcatct

SEQ ID NO: 303161 - DNA, 20 bp, Artificial
  CRISPR gRNA sequence
catttgcagtctcatctgag

SEQ ID NO: 303162 - DNA, 20 bp, Artificial
  CRISPR gRNA sequence
atttgcagtctcatctgaga

SEQ ID NO: 303163 - DNA, 20 bp, Artificial
  CRISPR gRNA sequence
cagtctcatctgagaaggct

SEQ ID NO: 303164 - DNA, 20 bp, Artificial
  CRISPR gRNA sequence
cacaccattgaccacatacc

SEQ ID NO: 303165 - DNA, 20 bp, Artificial
  CRISPR gRNA sequence
gaccacataccaagcactga

SEQ ID NO: 303166 - DNA, 20 bp, Artificial
  CRISPR gRNA sequence
cataccaagcactgacagtt

SEQ ID NO: 303167 - DNA, 20 bp, Artificial
  CRISPR gRNA sequence
ctgacagttcagaattcatc

SEQ ID NO: 303168 - DNA, 20 bp, Artificial
  CRISPR gRNA sequence
acagttcagaattcatctgg

SEQ ID NO: 303169 - DNA, 20 bp, Artificial
  CRISPR gRNA sequence
gtggatgcgaatcattcctg

SEQ ID NO: 303170 - DNA, 20 bp, Artificial
  CRISPR gRNA sequence
tggatgcgaatcattcctgt

SEQ ID NO: 303171 - DNA, 20 bp, Artificial
  CRISPR gRNA sequence
ttcctgtgggctttttgtga

SEQ ID NO: 303172 - DNA, 20 bp, Artificial
  CRISPR gRNA sequence
gatggatgatacattgatac

SEQ ID NO: 303173 - DNA, 20 bp, Artificial
  CRISPR gRNA sequence
aagcccttgtccttgatctg

SEQ ID NO: 303174 - DNA, 20 bp, Artificial
  CRISPR gRNA sequence
tccttgatctgaagattgtg

SEQ ID NO: 303175 - DNA, 20 bp, Artificial
  CRISPR gRNA sequence
atctgaagattgtgaagtct

SEQ ID NO: 303176 - DNA, 20 bp, Artificial
  CRISPR gRNA sequence
tctgaagattgtgaagtctc

SEQ ID NO: 303177 - DNA, 20 bp, Artificial
  CRISPR gRNA sequence
ctgaagattgtgaagtctca

SEQ ID NO: 303178 - DNA, 20 bp, Artificial
  CRISPR gRNA sequence
tgtccgaatcaaaacttgtg

SEQ ID NO: 303179 - DNA, 20 bp, Artificial
  CRISPR gRNA sequence
acttgtgcggcccatatact

SEQ ID NO: 303180 - DNA, 20 bp, Artificial
  CRISPR gRNA sequence
tgtcaaatttctctttgcct

SEQ ID NO: 303181 - DNA, 20 bp, Artificial
  CRISPR gRNA sequence
ttgcctaagtatacctcatt

SEQ ID NO: 303182 - DNA, 20 bp, Artificial
  CRISPR gRNA sequence
agtatacctcattcagaacc

SEQ ID NO: 303183 - DNA, 20 bp, Artificial
  CRISPR gRNA sequence
cattcagaaccaagttttcc

SEQ ID NO: 303184 - DNA, 20 bp, Artificial
  CRISPR gRNA sequence
tggtcctgccaaaatactac

SEQ ID NO: 303185 - DNA, 20 bp, Artificial
  CRISPR gRNA sequence
caaaatactactagctcact

SEQ ID NO: 303186 - DNA, 20 bp, Artificial
  CRISPR gRNA sequence
aaaatactactagctcactc

SEQ ID NO: 303187 - DNA, 20 bp, Artificial
  CRISPR gRNA sequence
ctactagctcactcaggctt

SEQ ID NO: 303188 - DNA, 20 bp, Artificial
  CRISPR gRNA sequence
ctcactcaggctttggtttt

SEQ ID NO: 303189 - DNA, 20 bp, Artificial
  CRISPR gRNA sequence
cactcaggctttggttttga

SEQ ID NO: 303190 - DNA, 20 bp, Artificial
  CRISPR gRNA sequence
ggttttgagagtttgcaaat

SEQ ID NO: 303191 - DNA, 20 bp, Artificial
  CRISPR gRNA sequence
tgagagtttgcaaattggca

SEQ ID NO: 303192 - DNA, 20 bp, Artificial
  CRISPR gRNA sequence
gagtttgcaaattggcatgg

SEQ ID NO: 303193 - DNA, 20 bp, Artificial
  CRISPR gRNA sequence
agtttgcaaattggcatggc

SEQ ID NO: 303194 - DNA, 20 bp, Artificial
  CRISPR gRNA sequence
aaattggcatggcaggtctg

SEQ ID NO: 303195 - DNA, 20 bp, Artificial
  CRISPR gRNA sequence
gtctgcagtctcattgaaat

SEQ ID NO: 303196 - DNA, 20 bp, Artificial
  CRISPR gRNA sequence
ttgaaataagcttgaatctt

SEQ ID NO: 303197 - DNA, 20 bp, Artificial
  CRISPR gRNA sequence
gaaataagcttgaatcttca

SEQ ID NO: 303198 - DNA, 20 bp, Artificial
  CRISPR gRNA sequence
aaataagcttgaatcttcag

SEQ ID NO: 303199 - DNA, 20 bp, Artificial
  CRISPR gRNA sequence
ataagcttgaatcttcagag

SEQ ID NO: 303200 - DNA, 20 bp, Artificial
  CRISPR gRNA sequence
agcttgaatcttcagaggag

SEQ ID NO: 303201 - DNA, 20 bp, Artificial
  CRISPR gRNA sequence
cagaggagcagcacctaaaa

SEQ ID NO: 303202 - DNA, 20 bp, Artificial
  CRISPR gRNA sequence
aggagcagcacctaaaaaag

SEQ ID NO: 303203 - DNA, 20 bp, Artificial
  CRISPR gRNA sequence
ggagcagcacctaaaaaaga

SEQ ID NO: 303204 - DNA, 20 bp, Artificial
  CRISPR gRNA sequence
agcacctaaaaaagaaggtt

SEQ ID NO: 303205 - DNA, 20 bp, Artificial
  CRISPR gRNA sequence
gcacctaaaaaagaaggtta

SEQ ID NO: 303206 - DNA, 20 bp, Artificial
  CRISPR gRNA sequence
taaaaaagaaggttaaggat

SEQ ID NO: 303207 - DNA, 20 bp, Artificial
  CRISPR gRNA sequence
aaaaaagaaggttaaggatt

SEQ ID NO: 303208 - DNA, 20 bp, Artificial
  CRISPR gRNA sequence
aaaaagaaggttaaggatta

SEQ ID NO: 303209 - DNA, 20 bp, Artificial
  CRISPR gRNA sequence
aaagaaggttaaggattagg

SEQ ID NO: 303210 - DNA, 20 bp, Artificial
  CRISPR gRNA sequence
aagaaggttaaggattaggg

SEQ ID NO: 303211 - DNA, 20 bp, Artificial
  CRISPR gRNA sequence
agaaggttaaggattaggga

SEQ ID NO: 303212 - DNA, 20 bp, Artificial
  CRISPR gRNA sequence
aaggttaaggattagggagg

SEQ ID NO: 303213 - DNA, 20 bp, Artificial
  CRISPR gRNA sequence
aggattagggagggagaaac

SEQ ID NO: 303214 - DNA, 20 bp, Artificial
  CRISPR gRNA sequence
gattagggagggagaaacaa

SEQ ID NO: 303215 - DNA, 20 bp, Artificial
  CRISPR gRNA sequence
attagggagggagaaacaag

SEQ ID NO: 303216 - DNA, 20 bp, Artificial
  CRISPR gRNA sequence
gggagggagaaacaagagga

SEQ ID NO: 303217 - DNA, 20 bp, Artificial
  CRISPR gRNA sequence
ggagggagaaacaagaggaa

SEQ ID NO: 303218 - DNA, 20 bp, Artificial
  CRISPR gRNA sequence
gagggagaaacaagaggaaa

SEQ ID NO: 303219 - DNA, 20 bp, Artificial
  CRISPR gRNA sequence
agggagaaacaagaggaaag

SEQ ID NO: 303220 - DNA, 20 bp, Artificial
  CRISPR gRNA sequence
atttctctttatacaatacc

SEQ ID NO: 303221 - DNA, 20 bp, Artificial
  CRISPR gRNA sequence
atacccagatactatcttat

SEQ ID NO: 303222 - DNA, 20 bp, Artificial
  CRISPR gRNA sequence
tcttatcagtaatcatgctg

SEQ ID NO: 303223 - DNA, 20 bp, Artificial
  CRISPR gRNA sequence
cagtaatcatgctgaagaat

SEQ ID NO: 303224 - DNA, 20 bp, Artificial
  CRISPR gRNA sequence
atgctgaagaataagatatt

SEQ ID NO: 303225 - DNA, 20 bp, Artificial
  CRISPR gRNA sequence
aagaataagatattaagctc

SEQ ID NO: 303226 - DNA, 20 bp, Artificial
  CRISPR gRNA sequence
tggaactgtgcacatctgct

SEQ ID NO: 303227 - DNA, 20 bp, Artificial
  CRISPR gRNA sequence
gtgcacatctgcttggcatc

SEQ ID NO: 303228 - DNA, 20 bp, Artificial
  CRISPR gRNA sequence
gcacatctgcttggcatctg

SEQ ID NO: 303229 - DNA, 20 bp, Artificial
  CRISPR gRNA sequence
tctgcttggcatctggagat

SEQ ID NO: 303230 - DNA, 20 bp, Artificial
  CRISPR gRNA sequence
ctgcttggcatctggagatt

SEQ ID NO: 303231 - DNA, 20 bp, Artificial
  CRISPR gRNA sequence
ttcaccgctgactaaatgtg

SEQ ID NO: 303232 - DNA, 20 bp, Artificial
  CRISPR gRNA sequence
gtacaaactgcaatctttat

SEQ ID NO: 303233 - DNA, 20 bp, Artificial
  CRISPR gRNA sequence
actgcaatctttatgagcct

SEQ ID NO: 303234 - DNA, 20 bp, Artificial
  CRISPR gRNA sequence
gtttcctcatctgattaatg

SEQ ID NO: 303235 - DNA, 20 bp, Artificial
  CRISPR gRNA sequence
tcctcatctgattaatgaag

SEQ ID NO: 303236 - DNA, 20 bp, Artificial
  CRISPR gRNA sequence
agtggttgactaaatgttcc

SEQ ID NO: 303237 - DNA, 20 bp, Artificial
  CRISPR gRNA sequence
gtggttgactaaatgttcca

SEQ ID NO: 303238 - DNA, 20 bp, Artificial
  CRISPR gRNA sequence
tggttgactaaatgttccaa

SEQ ID NO: 303239 - DNA, 20 bp, Artificial
  CRISPR gRNA sequence
aaatgttccaagggtctttc

SEQ ID NO: 303240 - DNA, 20 bp, Artificial
  CRISPR gRNA sequence
caagggtctttctagtactg

SEQ ID NO: 303241 - DNA, 20 bp, Artificial
  CRISPR gRNA sequence
gttctgtgaatttaaattgc

SEQ ID NO: 303242 - DNA, 20 bp, Artificial
  CRISPR gRNA sequence
tgtgaatttaaattgcaaga

SEQ ID NO: 303243 - DNA, 20 bp, Artificial
  CRISPR gRNA sequence
gtgaatttaaattgcaagac

SEQ ID NO: 303244 - DNA, 20 bp, Artificial
  CRISPR gRNA sequence
tgaatttaaattgcaagaca

SEQ ID NO: 303245 - DNA, 20 bp, Artificial
  CRISPR gRNA sequence
attgcaagacagggaaaaac

SEQ ID NO: 303246 - DNA, 20 bp, Artificial
  CRISPR gRNA sequence
gcaagacagggaaaaaccag

SEQ ID NO: 303247 - DNA, 20 bp, Artificial
  CRISPR gRNA sequence
aagacagggaaaaaccagta

SEQ ID NO: 303248 - DNA, 20 bp, Artificial
  CRISPR gRNA sequence
cagggaaaaaccagtagagt

SEQ ID NO: 303249 - DNA, 20 bp, Artificial
  CRISPR gRNA sequence
tagacaacccattcacccac

SEQ ID NO: 303250 - DNA, 20 bp, Artificial
  CRISPR gRNA sequence
ccttcctataaccttaattt

SEQ ID NO: 303251 - DNA, 20 bp, Artificial
  CRISPR gRNA sequence
aattttagttttcatcactg

SEQ ID NO: 303252 - DNA, 20 bp, Artificial
  CRISPR gRNA sequence
tttcatcactgtagctgtta

SEQ ID NO: 303253 - DNA, 20 bp, Artificial
  CRISPR gRNA sequence
ttcatcactgtagctgttac

SEQ ID NO: 303254 - DNA, 20 bp, Artificial
  CRISPR gRNA sequence
aacttctacaccatcaccaa

SEQ ID NO: 303255 - DNA, 20 bp, Artificial
  CRISPR gRNA sequence
cctcccatccacatattcct

SEQ ID NO: 303256 - DNA, 20 bp, Artificial
  CRISPR gRNA sequence
acatattccttggtctgcta

SEQ ID NO: 303257 - DNA, 20 bp, Artificial
  CRISPR gRNA sequence
ccttggtctgctatggtgaa

SEQ ID NO: 303258 - DNA, 20 bp, Artificial
  CRISPR gRNA sequence
ggtgaaaagattgctgataa

SEQ ID NO: 303259 - DNA, 20 bp, Artificial
  CRISPR gRNA sequence
ctgataatggtaataaatta

SEQ ID NO: 303260 - DNA, 20 bp, Artificial
  CRISPR gRNA sequence
ccccctttattatacttcat

SEQ ID NO: 303261 - DNA, 20 bp, Artificial
  CRISPR gRNA sequence
ctttattatacttcattagt

SEQ ID NO: 303262 - DNA, 20 bp, Artificial
  CRISPR gRNA sequence
tttattatacttcattagtt

SEQ ID NO: 303263 - DNA, 20 bp, Artificial
  CRISPR gRNA sequence
ttattatacttcattagttg

SEQ ID NO: 303264 - DNA, 20 bp, Artificial
  CRISPR gRNA sequence
attagttggggaatcacgtt

SEQ ID NO: 303265 - DNA, 20 bp, Artificial
  CRISPR gRNA sequence
taacatctttgaaattcaaa

SEQ ID NO: 303266 - DNA, 20 bp, Artificial
  CRISPR gRNA sequence
aattcaaatagctcccttta

SEQ ID NO: 303267 - DNA, 20 bp, Artificial
  CRISPR gRNA sequence
ccctatgactgctgctccca

SEQ ID NO: 303268 - DNA, 20 bp, Artificial
  CRISPR gRNA sequence
atgactgctgctcccatggc

SEQ ID NO: 303269 - DNA, 20 bp, Artificial
  CRISPR gRNA sequence
ctcccatggccagcacttcc

SEQ ID NO: 303270 - DNA, 20 bp, Artificial
  CRISPR gRNA sequence
tcccatggccagcacttcca

SEQ ID NO: 303271 - DNA, 20 bp, Artificial
  CRISPR gRNA sequence
tccaaggatgtcaaatgctt

SEQ ID NO: 303272 - DNA, 20 bp, Artificial
  CRISPR gRNA sequence
tgctttagaaatgacttcga

SEQ ID NO: 303273 - DNA, 20 bp, Artificial
  CRISPR gRNA sequence
aatgacttcgatagtgaacc

SEQ ID NO: 303274 - DNA, 20 bp, Artificial
  CRISPR gRNA sequence
atgacttcgatagtgaacca

SEQ ID NO: 303275 - DNA, 20 bp, Artificial
  CRISPR gRNA sequence
tgaaccaaggcctttatttt

SEQ ID NO: 303276 - DNA, 20 bp, Artificial
  CRISPR gRNA sequence
ttattttcagtgacctctct

SEQ ID NO: 303277 - DNA, 20 bp, Artificial
  CRISPR gRNA sequence
gtgacctctctaagctcttt

SEQ ID NO: 303278 - DNA, 20 bp, Artificial
  CRISPR gRNA sequence
gacctctctaagctctttca

SEQ ID NO: 303279 - DNA, 20 bp, Artificial
  CRISPR gRNA sequence
ctctaagctctttcagagat

SEQ ID NO: 303280 - DNA, 20 bp, Artificial
  CRISPR gRNA sequence
aagctctttcagagatcaga

SEQ ID NO: 303281 - DNA, 20 bp, Artificial
  CRISPR gRNA sequence
gctctttcagagatcagaaa

SEQ ID NO: 303282 - DNA, 20 bp, Artificial
  CRISPR gRNA sequence
tcagagatcagaaagagaac

SEQ ID NO: 303283 - DNA, 20 bp, Artificial
  CRISPR gRNA sequence
cagagatcagaaagagaact

SEQ ID NO: 303284 - DNA, 20 bp, Artificial
  CRISPR gRNA sequence
agagaactgggcaaatttga

SEQ ID NO: 303285 - DNA, 20 bp, Artificial
  CRISPR gRNA sequence
gcaaatttgatggctgtttt

SEQ ID NO: 303286 - DNA, 20 bp, Artificial
  CRISPR gRNA sequence
tgatggctgttttcggattg

SEQ ID NO: 303287 - DNA, 20 bp, Artificial
  CRISPR gRNA sequence
tggctgttttcggattgtgg

SEQ ID NO: 303288 - DNA, 20 bp, Artificial
  CRISPR gRNA sequence
gtggtggtcaatgaccattt

SEQ ID NO: 303289 - DNA, 20 bp, Artificial
  CRISPR gRNA sequence
tggtggtcaatgaccattta

SEQ ID NO: 303290 - DNA, 20 bp, Artificial
  CRISPR gRNA sequence
aatgaccatttaaggcacat

SEQ ID NO: 303291 - DNA, 20 bp, Artificial
  CRISPR gRNA sequence
gaaatgctgaaaatgaatca

SEQ ID NO: 303292 - DNA, 20 bp, Artificial
  CRISPR gRNA sequence
tgctgaaaatgaatcataga

SEQ ID NO: 303293 - DNA, 20 bp, Artificial
  CRISPR gRNA sequence
gctgaaaatgaatcatagat

SEQ ID NO: 303294 - DNA, 20 bp, Artificial
  CRISPR gRNA sequence
gaaaatgaatcatagatggg

SEQ ID NO: 303295 - DNA, 20 bp, Artificial
  CRISPR gRNA sequence
aaaatgaatcatagatgggc

SEQ ID NO: 303296 - DNA, 20 bp, Artificial
  CRISPR gRNA sequence
tgaatcatagatgggcaggt

SEQ ID NO: 303297 - DNA, 20 bp, Artificial
  CRISPR gRNA sequence
gaatcatagatgggcaggtg

SEQ ID NO: 303298 - DNA, 20 bp, Artificial
  CRISPR gRNA sequence
gggcaggtgaggatgtgctt

SEQ ID NO: 303299 - DNA, 20 bp, Artificial
  CRISPR gRNA sequence
ggcaggtgaggatgtgcttt

SEQ ID NO: 303300 - DNA, 20 bp, Artificial
  CRISPR gRNA sequence
caggtgaggatgtgctttgg

SEQ ID NO: 303301 - DNA, 20 bp, Artificial
  CRISPR gRNA sequence
aggatgtgctttgggagtat

SEQ ID NO: 303302 - DNA, 20 bp, Artificial
  CRISPR gRNA sequence
ggatgtgctttgggagtatt

SEQ ID NO: 303303 - DNA, 20 bp, Artificial
  CRISPR gRNA sequence
gatgtgctttgggagtattg

SEQ ID NO: 303304 - DNA, 20 bp, Artificial
  CRISPR gRNA sequence
tgggagtattggggaaaccc

SEQ ID NO: 303305 - DNA, 20 bp, Artificial
  CRISPR gRNA sequence
gggagtattggggaaacccc

SEQ ID NO: 303306 - DNA, 20 bp, Artificial
  CRISPR gRNA sequence
caccacaaacttgctgctcc

SEQ ID NO: 303307 - DNA, 20 bp, Artificial
  CRISPR gRNA sequence
ctcccagtatgcactgaccc

SEQ ID NO: 303308 - DNA, 20 bp, Artificial
  CRISPR gRNA sequence
cctggacaattttacaacca

SEQ ID NO: 303309 - DNA, 20 bp, Artificial
  CRISPR gRNA sequence
tacaaccatagacatcatgc

SEQ ID NO: 303310 - DNA, 20 bp, Artificial
  CRISPR gRNA sequence
aaccatagacatcatgctgg

SEQ ID NO: 303311 - DNA, 20 bp, Artificial
  CRISPR gRNA sequence
accatagacatcatgctgga

SEQ ID NO: 303312 - DNA, 20 bp, Artificial
  CRISPR gRNA sequence
ccatagacatcatgctggaa

SEQ ID NO: 303313 - DNA, 20 bp, Artificial
  CRISPR gRNA sequence
gacatcatgctggaagggtt

SEQ ID NO: 303314 - DNA, 20 bp, Artificial
  CRISPR gRNA sequence
catcatgctggaagggttga

SEQ ID NO: 303315 - DNA, 20 bp, Artificial
  CRISPR gRNA sequence
atgctggaagggttgagaga

SEQ ID NO: 303316 - DNA, 20 bp, Artificial
  CRISPR gRNA sequence
tgctggaagggttgagagaa

SEQ ID NO: 303317 - DNA, 20 bp, Artificial
  CRISPR gRNA sequence
aagggttgagagaaaggctt

SEQ ID NO: 303318 - DNA, 20 bp, Artificial
  CRISPR gRNA sequence
agagaaaggctttagtcctt

SEQ ID NO: 303319 - DNA, 20 bp, Artificial
  CRISPR gRNA sequence
gagaaaggctttagtccttg

SEQ ID NO: 303320 - DNA, 20 bp, Artificial
  CRISPR gRNA sequence
tttagtccttgaggacactt

SEQ ID NO: 303321 - DNA, 20 bp, Artificial
  CRISPR gRNA sequence
ttagtccttgaggacacttt

SEQ ID NO: 303322 - DNA, 20 bp, Artificial
  CRISPR gRNA sequence
tagtccttgaggacactttg

SEQ ID NO: 303323 - DNA, 20 bp, Artificial
  CRISPR gRNA sequence
tgaggacactttggggtttg

SEQ ID NO: 303324 - DNA, 20 bp, Artificial
  CRISPR gRNA sequence
gaggacactttggggtttgt

SEQ ID NO: 303325 - DNA, 20 bp, Artificial
  CRISPR gRNA sequence
gacactttggggtttgtggg

SEQ ID NO: 303326 - DNA, 20 bp, Artificial
  CRISPR gRNA sequence
acactttggggtttgtggga

SEQ ID NO: 303327 - DNA, 20 bp, Artificial
  CRISPR gRNA sequence
tggggtttgtgggaaggatg

SEQ ID NO: 303328 - DNA, 20 bp, Artificial
  CRISPR gRNA sequence
ggggtttgtgggaaggatgt

SEQ ID NO: 303329 - DNA, 20 bp, Artificial
  CRISPR gRNA sequence
tacttaaatgtgaatgatca

SEQ ID NO: 303330 - DNA, 20 bp, Artificial
  CRISPR gRNA sequence
acttaaatgtgaatgatcac

SEQ ID NO: 303331 - DNA, 20 bp, Artificial
  CRISPR gRNA sequence
cttaaatgtgaatgatcacg

SEQ ID NO: 303332 - DNA, 20 bp, Artificial
  CRISPR gRNA sequence
gaatgatcacggggtttgtg

SEQ ID NO: 303333 - DNA, 20 bp, Artificial
  CRISPR gRNA sequence
aatgatcacggggtttgtgt

SEQ ID NO: 303334 - DNA, 20 bp, Artificial
  CRISPR gRNA sequence
ggtttgtgtaggaccttttc

SEQ ID NO: 303335 - DNA, 20 bp, Artificial
  CRISPR gRNA sequence
gtttgtgtaggaccttttct

SEQ ID NO: 303336 - DNA, 20 bp, Artificial
  CRISPR gRNA sequence
gtaggaccttttctaggtta

SEQ ID NO: 303337 - DNA, 20 bp, Artificial
  CRISPR gRNA sequence
tctaggttacagaattactt

SEQ ID NO: 303338 - DNA, 20 bp, Artificial
  CRISPR gRNA sequence
ttacagaattacttgagact

SEQ ID NO: 303339 - DNA, 20 bp, Artificial
  CRISPR gRNA sequence
aaaaaaaaaaaaaaaaaaaa

SEQ ID NO: 303340 - DNA, 20 bp, Artificial
  CRISPR gRNA sequence
aaaaaaaaaaaaaaaaaagt

SEQ ID NO: 303341 - DNA, 20 bp, Artificial
  CRISPR gRNA sequence
aaaaaaaaaaaaaaagtaag

SEQ ID NO: 303342 - DNA, 20 bp, Artificial
  CRISPR gRNA sequence
aaaaaaaaaaaagtaagcag

SEQ ID NO: 303343 - DNA, 20 bp, Artificial
  CRISPR gRNA sequence
aaaaaaaaagtaagcagtgg

SEQ ID NO: 303344 - DNA, 20 bp, Artificial
  CRISPR gRNA sequence
aaaaaaaagtaagcagtggt

SEQ ID NO: 303345 - DNA, 20 bp, Artificial
  CRISPR gRNA sequence
aaaagtaagcagtggtgggt

SEQ ID NO: 303346 - DNA, 20 bp, Artificial
  CRISPR gRNA sequence
agtaagcagtggtgggtgag

SEQ ID NO: 303347 - DNA, 20 bp, Artificial
  CRISPR gRNA sequence
gcagtggtgggtgagaagtg

SEQ ID NO: 303348 - DNA, 20 bp, Artificial
  CRISPR gRNA sequence
cagtggtgggtgagaagtgc

SEQ ID NO: 303349 - DNA, 20 bp, Artificial
  CRISPR gRNA sequence
agtggtgggtgagaagtgcg

SEQ ID NO: 303350 - DNA, 20 bp, Artificial
  CRISPR gRNA sequence
gtggtgggtgagaagtgcgg

SEQ ID NO: 303351 - DNA, 20 bp, Artificial
  CRISPR gRNA sequence
gtgggtgagaagtgcggggg

SEQ ID NO: 303352 - DNA, 20 bp, Artificial
  CRISPR gRNA sequence
gggtgagaagtgcgggggtg

SEQ ID NO: 303353 - DNA, 20 bp, Artificial
  CRISPR gRNA sequence
gtgagaagtgcgggggtgga

SEQ ID NO: 303354 - DNA, 20 bp, Artificial
  CRISPR gRNA sequence
agaagtgcgggggtggagag

SEQ ID NO: 303355 - DNA, 20 bp, Artificial
  CRISPR gRNA sequence
gaagtgcgggggtggagagt

SEQ ID NO: 303356 - DNA, 20 bp, Artificial
  CRISPR gRNA sequence
gtgcgggggtggagagtggg

SEQ ID NO: 303357 - DNA, 20 bp, Artificial
  CRISPR gRNA sequence
tgcgggggtggagagtggga

SEQ ID NO: 303358 - DNA, 20 bp, Artificial
  CRISPR gRNA sequence
gctgtttcttacttaatatg

SEQ ID NO: 303359 - DNA, 20 bp, Artificial
  CRISPR gRNA sequence
tttcttacttaatatgaagt

SEQ ID NO: 303360 - DNA, 20 bp, Artificial
  CRISPR gRNA sequence
tatgaagttagatgccacct

SEQ ID NO: 303361 - DNA, 20 bp, Artificial
  CRISPR gRNA sequence
tgaagttagatgccaccttg

SEQ ID NO: 303362 - DNA, 20 bp, Artificial
  CRISPR gRNA sequence
aagttagatgccaccttgga

SEQ ID NO: 303363 - DNA, 20 bp, Artificial
  CRISPR gRNA sequence
agttagatgccaccttggag

SEQ ID NO: 303364 - DNA, 20 bp, Artificial
  CRISPR gRNA sequence
tagatgccaccttggagagg

SEQ ID NO: 303365 - DNA, 20 bp, Artificial
  CRISPR gRNA sequence
tgccaccttggagaggaagt

SEQ ID NO: 303366 - DNA, 20 bp, Artificial
  CRISPR gRNA sequence
cttggagaggaagttagtgt

SEQ ID NO: 303367 - DNA, 20 bp, Artificial
  CRISPR gRNA sequence
ctaaataaaatttcatcatt

SEQ ID NO: 303368 - DNA, 20 bp, Artificial
  CRISPR gRNA sequence
taaataaaatttcatcattc

SEQ ID NO: 303369 - DNA, 20 bp, Artificial
  CRISPR gRNA sequence
catcattcaggatttatgtg

SEQ ID NO: 303370 - DNA, 20 bp, Artificial
  CRISPR gRNA sequence
atcattcaggatttatgtga

SEQ ID NO: 303371 - DNA, 20 bp, Artificial
  CRISPR gRNA sequence
tgtgaaggcatgttgacatt

SEQ ID NO: 303372 - DNA, 20 bp, Artificial
  CRISPR gRNA sequence
gtgaaggcatgttgacattg

SEQ ID NO: 303373 - DNA, 20 bp, Artificial
  CRISPR gRNA sequence
gaaggcatgttgacattgag

SEQ ID NO: 303374 - DNA, 20 bp, Artificial
  CRISPR gRNA sequence
aaggcatgttgacattgagg

SEQ ID NO: 303375 - DNA, 20 bp, Artificial
  CRISPR gRNA sequence
catgttgacattgaggagga

SEQ ID NO: 303376 - DNA, 20 bp, Artificial
  CRISPR gRNA sequence
atgttgacattgaggaggaa

SEQ ID NO: 303377 - DNA, 20 bp, Artificial
  CRISPR gRNA sequence
tgttgacattgaggaggaaa

SEQ ID NO: 303378 - DNA, 20 bp, Artificial
  CRISPR gRNA sequence
ttgacattgaggaggaaagg

SEQ ID NO: 303379 - DNA, 20 bp, Artificial
  CRISPR gRNA sequence
tgacattgaggaggaaaggg

SEQ ID NO: 303380 - DNA, 20 bp, Artificial
  CRISPR gRNA sequence
acattgaggaggaaagggag

SEQ ID NO: 303381 - DNA, 20 bp, Artificial
  CRISPR gRNA sequence
tgaggaggaaagggaggaga

SEQ ID NO: 303382 - DNA, 20 bp, Artificial
  CRISPR gRNA sequence
gaggaggaaagggaggagat

SEQ ID NO: 303383 - DNA, 20 bp, Artificial
  CRISPR gRNA sequence
aagggaggagatgggttgat

SEQ ID NO: 303384 - DNA, 20 bp, Artificial
  CRISPR gRNA sequence
gggaggagatgggttgatga

SEQ ID NO: 303385 - DNA, 20 bp, Artificial
  CRISPR gRNA sequence
gaggagatgggttgatgaga

SEQ ID NO: 303386 - DNA, 20 bp, Artificial
  CRISPR gRNA sequence
gatgggttgatgagagagat

SEQ ID NO: 303387 - DNA, 20 bp, Artificial
  CRISPR gRNA sequence
tgggttgatgagagagatga

SEQ ID NO: 303388 - DNA, 20 bp, Artificial
  CRISPR gRNA sequence
gggttgatgagagagatgag

SEQ ID NO: 303389 - DNA, 20 bp, Artificial
  CRISPR gRNA sequence
gttgatgagagagatgagag

SEQ ID NO: 303390 - DNA, 20 bp, Artificial
  CRISPR gRNA sequence
gatgagaggagcttcatttg

SEQ ID NO: 303391 - DNA, 20 bp, Artificial
  CRISPR gRNA sequence
tgagaggagcttcatttgaa

SEQ ID NO: 303392 - DNA, 20 bp, Artificial
  CRISPR gRNA sequence
agcttcatttgaagagttct

SEQ ID NO: 303393 - DNA, 20 bp, Artificial
  CRISPR gRNA sequence
ttcatttgaagagttctaag

SEQ ID NO: 303394 - DNA, 20 bp, Artificial
  CRISPR gRNA sequence
tcatttgaagagttctaagt

SEQ ID NO: 303395 - DNA, 20 bp, Artificial
  CRISPR gRNA sequence
catttgaagagttctaagtg

SEQ ID NO: 303396 - DNA, 20 bp, Artificial
  CRISPR gRNA sequence
atttgaagagttctaagtgg

SEQ ID NO: 303397 - DNA, 20 bp, Artificial
  CRISPR gRNA sequence
ttgaagagttctaagtgggg

SEQ ID NO: 303398 - DNA, 20 bp, Artificial
  CRISPR gRNA sequence
ggggagtaattaaattgatg

SEQ ID NO: 303399 - DNA, 20 bp, Artificial
  CRISPR gRNA sequence
attgatgtggtttctcttga

SEQ ID NO: 303400 - DNA, 20 bp, Artificial
  CRISPR gRNA sequence
tgatgtggtttctcttgaaa

SEQ ID NO: 303401 - DNA, 20 bp, Artificial
  CRISPR gRNA sequence
gatgtggtttctcttgaaag

SEQ ID NO: 303402 - DNA, 20 bp, Artificial
  CRISPR gRNA sequence
atgtggtttctcttgaaaga

SEQ ID NO: 303403 - DNA, 20 bp, Artificial
  CRISPR gRNA sequence
gtttctcttgaaagagggaa

SEQ ID NO: 303404 - DNA, 20 bp, Artificial
  CRISPR gRNA sequence
tctcttgaaagagggaatag

SEQ ID NO: 303405 - DNA, 20 bp, Artificial
  CRISPR gRNA sequence
ctcttgaaagagggaataga

SEQ ID NO: 303406 - DNA, 20 bp, Artificial
  CRISPR gRNA sequence
tgaaagagggaatagaagga

SEQ ID NO: 303407 - DNA, 20 bp, Artificial
  CRISPR gRNA sequence
gggaatagaaggacagataa

SEQ ID NO: 303408 - DNA, 20 bp, Artificial
  CRISPR gRNA sequence
ttgtcaaactaaactgtgta

SEQ ID NO: 303409 - DNA, 20 bp, Artificial
  CRISPR gRNA sequence
gtcaaactaaactgtgtaca

SEQ ID NO: 303410 - DNA, 20 bp, Artificial
  CRISPR gRNA sequence
aaactaaactgtgtacagag

SEQ ID NO: 303411 - DNA, 20 bp, Artificial
  CRISPR gRNA sequence
aaactgtgtacagagtggcc

SEQ ID NO: 303412 - DNA, 20 bp, Artificial
  CRISPR gRNA sequence
tgtgtacagagtggcccagt

SEQ ID NO: 303413 - DNA, 20 bp, Artificial
  CRISPR gRNA sequence
cccagtgagaacacataatc

SEQ ID NO: 303414 - DNA, 20 bp, Artificial
  CRISPR gRNA sequence
ccagtgagaacacataatca

SEQ ID NO: 303415 - DNA, 20 bp, Artificial
  CRISPR gRNA sequence
cagtgagaacacataatcaa

SEQ ID NO: 303416 - DNA, 20 bp, Artificial
  CRISPR gRNA sequence
agtgagaacacataatcaag

SEQ ID NO: 303417 - DNA, 20 bp, Artificial
  CRISPR gRNA sequence
agaacacataatcaaggggt

SEQ ID NO: 303418 - DNA, 20 bp, Artificial
  CRISPR gRNA sequence
acacataatcaaggggttgg

SEQ ID NO: 303419 - DNA, 20 bp, Artificial
  CRISPR gRNA sequence
cataatcaaggggttggtgg

SEQ ID NO: 303420 - DNA, 20 bp, Artificial
  CRISPR gRNA sequence
tggtggtggtcttgaactct

SEQ ID NO: 303421 - DNA, 20 bp, Artificial
  CRISPR gRNA sequence
ggtggtggtcttgaactctt

SEQ ID NO: 303422 - DNA, 20 bp, Artificial
  CRISPR gRNA sequence
gtggtggtcttgaactctta

SEQ ID NO: 303423 - DNA, 20 bp, Artificial
  CRISPR gRNA sequence
gtggtcttgaactcttaggg

SEQ ID NO: 303424 - DNA, 20 bp, Artificial
  CRISPR gRNA sequence
gtcttgaactcttagggaag

SEQ ID NO: 303425 - DNA, 20 bp, Artificial
  CRISPR gRNA sequence
tgaactcttagggaagcaga

SEQ ID NO: 303426 - DNA, 20 bp, Artificial
  CRISPR gRNA sequence
actcttagggaagcagacag

SEQ ID NO: 303427 - DNA, 20 bp, Artificial
  CRISPR gRNA sequence
ctcttagggaagcagacagc

SEQ ID NO: 303428 - DNA, 20 bp, Artificial
  CRISPR gRNA sequence
gggaagcagacagcaggcat

SEQ ID NO: 303429 - DNA, 20 bp, Artificial
  CRISPR gRNA sequence
aagcagacagcaggcatcag

SEQ ID NO: 303430 - DNA, 20 bp, Artificial
  CRISPR gRNA sequence
agcagacagcaggcatcagt

SEQ ID NO: 303431 - DNA, 20 bp, Artificial
  CRISPR gRNA sequence
cagacagcaggcatcagtgg

SEQ ID NO: 303432 - DNA, 20 bp, Artificial
  CRISPR gRNA sequence
gcctatttcactacactcac

SEQ ID NO: 303433 - DNA, 20 bp, Artificial
  CRISPR gRNA sequence
cctatttcactacactcact

SEQ ID NO: 303434 - DNA, 20 bp, Artificial
  CRISPR gRNA sequence
acactcactaggaccctgtg

SEQ ID NO: 303435 - DNA, 20 bp, Artificial
  CRISPR gRNA sequence
taggaccctgtgaagtactt

SEQ ID NO: 303436 - DNA, 20 bp, Artificial
  CRISPR gRNA sequence
aggaccctgtgaagtacttg

SEQ ID NO: 303437 - DNA, 20 bp, Artificial
  CRISPR gRNA sequence
ggtataaaatgcaccacctg

SEQ ID NO: 303438 - DNA, 20 bp, Artificial
  CRISPR gRNA sequence
tataaaatgcaccacctgta

SEQ ID NO: 303439 - DNA, 20 bp, Artificial
  CRISPR gRNA sequence
ataaaatgcaccacctgtag

SEQ ID NO: 303440 - DNA, 20 bp, Artificial
  CRISPR gRNA sequence
cacctgtagaggatgcgtac

SEQ ID NO: 303441 - DNA, 20 bp, Artificial
  CRISPR gRNA sequence
tagaggatgcgtaccggtat

SEQ ID NO: 303442 - DNA, 20 bp, Artificial
  CRISPR gRNA sequence
gaggatgcgtaccggtattg

SEQ ID NO: 303443 - DNA, 20 bp, Artificial
  CRISPR gRNA sequence
aggatgcgtaccggtattgg

SEQ ID NO: 303444 - DNA, 20 bp, Artificial
  CRISPR gRNA sequence
ggatgcgtaccggtattgga

SEQ ID NO: 303445 - DNA, 20 bp, Artificial
  CRISPR gRNA sequence
atgcgtaccggtattggagg

SEQ ID NO: 303446 - DNA, 20 bp, Artificial
  CRISPR gRNA sequence
tgcgtaccggtattggaggg

SEQ ID NO: 303447 - DNA, 20 bp, Artificial
  CRISPR gRNA sequence
gtaccggtattggagggagg

SEQ ID NO: 303448 - DNA, 20 bp, Artificial
  CRISPR gRNA sequence
taccggtattggagggagga

SEQ ID NO: 303449 - DNA, 20 bp, Artificial
  CRISPR gRNA sequence
aatctatatgcgtaccctga

SEQ ID NO: 303450 - DNA, 20 bp, Artificial
  CRISPR gRNA sequence
tatgcgtaccctgacagtga

SEQ ID NO: 303451 - DNA, 20 bp, Artificial
  CRISPR gRNA sequence
atgcgtaccctgacagtgaa

SEQ ID NO: 303452 - DNA, 20 bp, Artificial
  CRISPR gRNA sequence
tgcgtaccctgacagtgaaa

SEQ ID NO: 303453 - DNA, 20 bp, Artificial
  CRISPR gRNA sequence
cgtaccctgacagtgaaagg

SEQ ID NO: 303454 - DNA, 20 bp, Artificial
  CRISPR gRNA sequence
tgacagtgaaagggagacct

SEQ ID NO: 303455 - DNA, 20 bp, Artificial
  CRISPR gRNA sequence
gacagtgaaagggagaccta

SEQ ID NO: 303456 - DNA, 20 bp, Artificial
  CRISPR gRNA sequence
agtgaaagggagacctaagg

SEQ ID NO: 303457 - DNA, 20 bp, Artificial
  CRISPR gRNA sequence
agggagacctaaggaagatt

SEQ ID NO: 303458 - DNA, 20 bp, Artificial
  CRISPR gRNA sequence
gtgtttatgaatcaccttac

SEQ ID NO: 303459 - DNA, 20 bp, Artificial
  CRISPR gRNA sequence
tgtttatgaatcaccttaca

SEQ ID NO: 303460 - DNA, 20 bp, Artificial
  CRISPR gRNA sequence
tcaccttacaaggcaaacct

SEQ ID NO: 303461 - DNA, 20 bp, Artificial
  CRISPR gRNA sequence
caccttacaaggcaaacctg

SEQ ID NO: 303462 - DNA, 20 bp, Artificial
  CRISPR gRNA sequence
gcttctgcatcttctttgct

SEQ ID NO: 303463 - DNA, 20 bp, Artificial
  CRISPR gRNA sequence
ctgagctcttaatgtaatgc

SEQ ID NO: 303464 - DNA, 20 bp, Artificial
  CRISPR gRNA sequence
gagctcttaatgtaatgcaa

SEQ ID NO: 303465 - DNA, 20 bp, Artificial
  CRISPR gRNA sequence
aagagtgccccctactgtaa

SEQ ID NO: 303466 - DNA, 20 bp, Artificial
  CRISPR gRNA sequence
ccccctactgtaaaagcttc

SEQ ID NO: 303467 - DNA, 20 bp, Artificial
  CRISPR gRNA sequence
aagcttctagcattgtctct

SEQ ID NO: 303468 - DNA, 20 bp, Artificial
  CRISPR gRNA sequence
agcttctagcattgtctctg

SEQ ID NO: 303469 - DNA, 20 bp, Artificial
  CRISPR gRNA sequence
cattgtctctgaggaaatac

SEQ ID NO: 303470 - DNA, 20 bp, Artificial
  CRISPR gRNA sequence
ctctgaggaaatactggttt

SEQ ID NO: 303471 - DNA, 20 bp, Artificial
  CRISPR gRNA sequence
gtctaaattgtcatgtaata

SEQ ID NO: 303472 - DNA, 20 bp, Artificial
  CRISPR gRNA sequence
tctaaattgtcatgtaatat

SEQ ID NO: 303473 - DNA, 20 bp, Artificial
  CRISPR gRNA sequence
aattgtcatgtaatatagga

SEQ ID NO: 303474 - DNA, 20 bp, Artificial
  CRISPR gRNA sequence
atataggacagatgacctga

SEQ ID NO: 303475 - DNA, 20 bp, Artificial
  CRISPR gRNA sequence
ataggacagatgacctgatg

SEQ ID NO: 303476 - DNA, 20 bp, Artificial
  CRISPR gRNA sequence
tgatggagaaaccaaacaca

SEQ ID NO: 303477 - DNA, 20 bp, Artificial
  CRISPR gRNA sequence
ttaaaaattctgccaattaa

SEQ ID NO: 303478 - DNA, 20 bp, Artificial
  CRISPR gRNA sequence
gtcaatgttatgttattact

SEQ ID NO: 303479 - DNA, 20 bp, Artificial
  CRISPR gRNA sequence
ttatgttattactcagctgt

SEQ ID NO: 303480 - DNA, 20 bp, Artificial
  CRISPR gRNA sequence
cagctgtcagttgtgccttc

SEQ ID NO: 303481 - DNA, 20 bp, Artificial
  CRISPR gRNA sequence
tcagttgtgccttctggacc

SEQ ID NO: 303482 - DNA, 20 bp, Artificial
  CRISPR gRNA sequence
cctggaaatgacttcgtctt

SEQ ID NO: 303483 - DNA, 20 bp, Artificial
  CRISPR gRNA sequence
tttttttttttttttttctg

SEQ ID NO: 303484 - DNA, 20 bp, Artificial
  CRISPR gRNA sequence
tttttttttttttttctgta

SEQ ID NO: 303485 - DNA, 20 bp, Artificial
  CRISPR gRNA sequence
tttttttctgtagagcctca

SEQ ID NO: 303486 - DNA, 20 bp, Artificial
  CRISPR gRNA sequence
ccatccattctgtccactca

SEQ ID NO: 303487 - DNA, 20 bp, Artificial
  CRISPR gRNA sequence
cattctgtccactcacagac

SEQ ID NO: 303488 - DNA, 20 bp, Artificial
  CRISPR gRNA sequence
ccagtctaactccgctgacc

SEQ ID NO: 303489 - DNA, 20 bp, Artificial
  CRISPR gRNA sequence
cagtctaactccgctgaccc

SEQ ID NO: 303490 - DNA, 20 bp, Artificial
  CRISPR gRNA sequence
gacccaggccccttctccca

SEQ ID NO: 303491 - DNA, 20 bp, Artificial
  CRISPR gRNA sequence
ccttctcccaaagattacaa

SEQ ID NO: 303492 - DNA, 20 bp, Artificial
  CRISPR gRNA sequence
ggctttctcttccactcatc

SEQ ID NO: 303493 - DNA, 20 bp, Artificial
  CRISPR gRNA sequence
cgagtgctcccttcttcacc

SEQ ID NO: 303494 - DNA, 20 bp, Artificial
  CRISPR gRNA sequence
cttcttcacctagcaactga

SEQ ID NO: 303495 - DNA, 20 bp, Artificial
  CRISPR gRNA sequence
gcaactgaaagtgtgatgta

SEQ ID NO: 303496 - DNA, 20 bp, Artificial
  CRISPR gRNA sequence
agtgtgatgtatggaccaat

SEQ ID NO: 303497 - DNA, 20 bp, Artificial
  CRISPR gRNA sequence
aatgagattcacgtcacatg

SEQ ID NO: 303498 - DNA, 20 bp, Artificial
  CRISPR gRNA sequence
atgagattcacgtcacatgt

SEQ ID NO: 303499 - DNA, 20 bp, Artificial
  CRISPR gRNA sequence
gattcacgtcacatgtgggc

SEQ ID NO: 303500 - DNA, 20 bp, Artificial
  CRISPR gRNA sequence
atgtgggctggtctgaaaca

SEQ ID NO: 303501 - DNA, 20 bp, Artificial
  CRISPR gRNA sequence
ggtctgaaacacggaatctc

SEQ ID NO: 303502 - DNA, 20 bp, Artificial
  CRISPR gRNA sequence
cggaatctctggccccaccc

SEQ ID NO: 303503 - DNA, 20 bp, Artificial
  CRISPR gRNA sequence
ccacccaagacttactgatt

SEQ ID NO: 303504 - DNA, 20 bp, Artificial
  CRISPR gRNA sequence
ttcagaacctccattttaac

SEQ ID NO: 303505 - DNA, 20 bp, Artificial
  CRISPR gRNA sequence
cagaacctccattttaacaa

SEQ ID NO: 303506 - DNA, 20 bp, Artificial
  CRISPR gRNA sequence
ctccattttaacaagagcta

SEQ ID NO: 303507 - DNA, 20 bp, Artificial
  CRISPR gRNA sequence
tttaacaagagctatagttt

SEQ ID NO: 303508 - DNA, 20 bp, Artificial
  CRISPR gRNA sequence
aacaagagctatagtttgag

SEQ ID NO: 303509 - DNA, 20 bp, Artificial
  CRISPR gRNA sequence
tatagtttgagcagctgttg

SEQ ID NO: 303510 - DNA, 20 bp, Artificial
  CRISPR gRNA sequence
tagtttgagcagctgttgta

SEQ ID NO: 303511 - DNA, 20 bp, Artificial
  CRISPR gRNA sequence
agaatctctgcctctgtctc

SEQ ID NO: 303512 - DNA, 20 bp, Artificial
  CRISPR gRNA sequence
aatctctgcctctgtctcca

SEQ ID NO: 303513 - DNA, 20 bp, Artificial
  CRISPR gRNA sequence
ctctgcctctgtctccagag

SEQ ID NO: 303514 - DNA, 20 bp, Artificial
  CRISPR gRNA sequence
tctgtctccagagtggatca

SEQ ID NO: 303515 - DNA, 20 bp, Artificial
  CRISPR gRNA sequence
tttttccatccatccctcct

SEQ ID NO: 303516 - DNA, 20 bp, Artificial
  CRISPR gRNA sequence
cagactccctctcctcccca

SEQ ID NO: 303517 - DNA, 20 bp, Artificial
  CRISPR gRNA sequence
agactccctctcctccccat

SEQ ID NO: 303518 - DNA, 20 bp, Artificial
  CRISPR gRNA sequence
gactccctctcctccccatg

SEQ ID NO: 303519 - DNA, 20 bp, Artificial
  CRISPR gRNA sequence
tccctctcctccccatgggg

SEQ ID NO: 303520 - DNA, 20 bp, Artificial
  CRISPR gRNA sequence
atcactttgaaatccattct

SEQ ID NO: 303521 - DNA, 20 bp, Artificial
  CRISPR gRNA sequence
actttgaaatccattctgag

SEQ ID NO: 303522 - DNA, 20 bp, Artificial
  CRISPR gRNA sequence
tccattctgagtggaactga

SEQ ID NO: 303523 - DNA, 20 bp, Artificial
  CRISPR gRNA sequence
attttgcaatttatactcca

SEQ ID NO: 303524 - DNA, 20 bp, Artificial
  CRISPR gRNA sequence
catagcacctcaccaaccac

SEQ ID NO: 303525 - DNA, 20 bp, Artificial
  CRISPR gRNA sequence
ctggcttccatgatctcaca

SEQ ID NO: 303526 - DNA, 20 bp, Artificial
  CRISPR gRNA sequence
ggcttccatgatctcacaca

SEQ ID NO: 303527 - DNA, 20 bp, Artificial
  CRISPR gRNA sequence
tccatgatctcacacagagc

SEQ ID NO: 303528 - DNA, 20 bp, Artificial
  CRISPR gRNA sequence
ccatgatctcacacagagcc

SEQ ID NO: 303529 - DNA, 20 bp, Artificial
  CRISPR gRNA sequence
atctcacacagagccaggca

SEQ ID NO: 303530 - DNA, 20 bp, Artificial
  CRISPR gRNA sequence
tctcacacagagccaggcat

SEQ ID NO: 303531 - DNA, 20 bp, Artificial
  CRISPR gRNA sequence
ctcacacagagccaggcatg

SEQ ID NO: 303532 - DNA, 20 bp, Artificial
  CRISPR gRNA sequence
tcacacagagccaggcatgg

SEQ ID NO: 303533 - DNA, 20 bp, Artificial
  CRISPR gRNA sequence
taatcctttctctgactaaa

SEQ ID NO: 303534 - DNA, 20 bp, Artificial
  CRISPR gRNA sequence
aatcctttctctgactaaat

SEQ ID NO: 303535 - DNA, 20 bp, Artificial
  CRISPR gRNA sequence
atcctttctctgactaaatg

SEQ ID NO: 303536 - DNA, 20 bp, Artificial
  CRISPR gRNA sequence
tttctctgactaaatgggga

SEQ ID NO: 303537 - DNA, 20 bp, Artificial
  CRISPR gRNA sequence
ctgactaaatggggaaagtt

SEQ ID NO: 303538 - DNA, 20 bp, Artificial
  CRISPR gRNA sequence
aaatggggaaagtttggctc

SEQ ID NO: 303539 - DNA, 20 bp, Artificial
  CRISPR gRNA sequence
aatggggaaagtttggctca

SEQ ID NO: 303540 - DNA, 20 bp, Artificial
  CRISPR gRNA sequence
ctgtgatcaccaaatgactt

SEQ ID NO: 303541 - DNA, 20 bp, Artificial
  CRISPR gRNA sequence
tgtgatcaccaaatgacttc

SEQ ID NO: 303542 - DNA, 20 bp, Artificial
  CRISPR gRNA sequence
ggccttccattttatgaccc

SEQ ID NO: 303543 - DNA, 20 bp, Artificial
  CRISPR gRNA sequence
attttatgaccccagacctc

SEQ ID NO: 303544 - DNA, 20 bp, Artificial
  CRISPR gRNA sequence
accccagacctcaagccacc

SEQ ID NO: 303545 - DNA, 20 bp, Artificial
  CRISPR gRNA sequence
acctcaagccacctagcaac

SEQ ID NO: 303546 - DNA, 20 bp, Artificial
  CRISPR gRNA sequence
cacctagcaactggacttac

SEQ ID NO: 303547 - DNA, 20 bp, Artificial
  CRISPR gRNA sequence
acctagcaactggacttact

SEQ ID NO: 303548 - DNA, 20 bp, Artificial
  CRISPR gRNA sequence
ctggacttactgggattcca

SEQ ID NO: 303549 - DNA, 20 bp, Artificial
  CRISPR gRNA sequence
tggacttactgggattccat

SEQ ID NO: 303550 - DNA, 20 bp, Artificial
  CRISPR gRNA sequence
acttactgggattccatagg

SEQ ID NO: 303551 - DNA, 20 bp, Artificial
  CRISPR gRNA sequence
cttactgggattccataggt

SEQ ID NO: 303552 - DNA, 20 bp, Artificial
  CRISPR gRNA sequence
ctgggattccataggtgggt

SEQ ID NO: 303553 - DNA, 20 bp, Artificial
  CRISPR gRNA sequence
tccataggtgggtaagcatt

SEQ ID NO: 303554 - DNA, 20 bp, Artificial
  CRISPR gRNA sequence
ttgagaatctctcccttccc

SEQ ID NO: 303555 - DNA, 20 bp, Artificial
  CRISPR gRNA sequence
tctctcccttccccagcact

SEQ ID NO: 303556 - DNA, 20 bp, Artificial
  CRISPR gRNA sequence
ctctcccttccccagcactt

SEQ ID NO: 303557 - DNA, 20 bp, Artificial
  CRISPR gRNA sequence
cccttccccagcacttgggt

SEQ ID NO: 303558 - DNA, 20 bp, Artificial
  CRISPR gRNA sequence
cttccccagcacttgggtaa

SEQ ID NO: 303559 - DNA, 20 bp, Artificial
  CRISPR gRNA sequence
ttccccagcacttgggtaag

SEQ ID NO: 303560 - DNA, 20 bp, Artificial
  CRISPR gRNA sequence
cagcacttgggtaagaggaa

SEQ ID NO: 303561 - DNA, 20 bp, Artificial
  CRISPR gRNA sequence
ttgggtaagaggaatggtcg

SEQ ID NO: 303562 - DNA, 20 bp, Artificial
  CRISPR gRNA sequence
taagaggaatggtcgaagtc

SEQ ID NO: 303563 - DNA, 20 bp, Artificial
  CRISPR gRNA sequence
tggtcgaagtctagttacaa

SEQ ID NO: 303564 - DNA, 20 bp, Artificial
  CRISPR gRNA sequence
ggtcgaagtctagttacaat

SEQ ID NO: 303565 - DNA, 20 bp, Artificial
  CRISPR gRNA sequence
acaatgggttgctatgatgt

SEQ ID NO: 303566 - DNA, 20 bp, Artificial
  CRISPR gRNA sequence
caatgggttgctatgatgtc

SEQ ID NO: 303567 - DNA, 20 bp, Artificial
  CRISPR gRNA sequence
gttgctatgatgtcaggaac

SEQ ID NO: 303568 - DNA, 20 bp, Artificial
  CRISPR gRNA sequence
atgtcaggaacaagtcgctc

SEQ ID NO: 303569 - DNA, 20 bp, Artificial
  CRISPR gRNA sequence
gaacaagtcgctcaagaatc

SEQ ID NO: 303570 - DNA, 20 bp, Artificial
  CRISPR gRNA sequence
aagtcgctcaagaatccagc

SEQ ID NO: 303571 - DNA, 20 bp, Artificial
  CRISPR gRNA sequence
cagctagatgccttcgtaat

SEQ ID NO: 303572 - DNA, 20 bp, Artificial
  CRISPR gRNA sequence
gatgccttcgtaatcagctg

SEQ ID NO: 303573 - DNA, 20 bp, Artificial
  CRISPR gRNA sequence
atgccttcgtaatcagctga

SEQ ID NO: 303574 - DNA, 20 bp, Artificial
  CRISPR gRNA sequence
agctgaaggaatttgtttca

SEQ ID NO: 303575 - DNA, 20 bp, Artificial
  CRISPR gRNA sequence
gctgaaggaatttgtttcaa

SEQ ID NO: 303576 - DNA, 20 bp, Artificial
  CRISPR gRNA sequence
atttgtttcaaaggataatt

SEQ ID NO: 303577 - DNA, 20 bp, Artificial
  CRISPR gRNA sequence
tttgtttcaaaggataatta

SEQ ID NO: 303578 - DNA, 20 bp, Artificial
  CRISPR gRNA sequence
aggataattaaggacttcct

SEQ ID NO: 303579 - DNA, 20 bp, Artificial
  CRISPR gRNA sequence
tgagcaatacactctactgt

SEQ ID NO: 303580 - DNA, 20 bp, Artificial
  CRISPR gRNA sequence
actcaaaaactgtaatttgc

SEQ ID NO: 303581 - DNA, 20 bp, Artificial
  CRISPR gRNA sequence
tgtaatttgctagccttatg

SEQ ID NO: 303582 - DNA, 20 bp, Artificial
  CRISPR gRNA sequence
tatgaagtctctgaccccac

SEQ ID NO: 303583 - DNA, 20 bp, Artificial
  CRISPR gRNA sequence
atgaagtctctgaccccact

SEQ ID NO: 303584 - DNA, 20 bp, Artificial
  CRISPR gRNA sequence
ctctgaccccactgggactt

SEQ ID NO: 303585 - DNA, 20 bp, Artificial
  CRISPR gRNA sequence
actgggacttcagtgttccc

SEQ ID NO: 303586 - DNA, 20 bp, Artificial
  CRISPR gRNA sequence
aatgcatatcttatatgttt

SEQ ID NO: 303587 - DNA, 20 bp, Artificial
  CRISPR gRNA sequence
cttttactaaacttcctcca

SEQ ID NO: 303588 - DNA, 20 bp, Artificial
  CRISPR gRNA sequence
acttcctccaaagttttact

SEQ ID NO: 303589 - DNA, 20 bp, Artificial
  CRISPR gRNA sequence
agttttacttggccctttga

SEQ ID NO: 303590 - DNA, 20 bp, Artificial
  CRISPR gRNA sequence
ctcattccattacttactac

SEQ ID NO: 303591 - DNA, 20 bp, Artificial
  CRISPR gRNA sequence
tcattccattacttactaca

SEQ ID NO: 303592 - DNA, 20 bp, Artificial
  CRISPR gRNA sequence
ccttcattgactgtttccct

SEQ ID NO: 303593 - DNA, 20 bp, Artificial
  CRISPR gRNA sequence
cttcattgactgtttccctg

SEQ ID NO: 303594 - DNA, 20 bp, Artificial
  CRISPR gRNA sequence
tttccctgaggttattattt

SEQ ID NO: 303595 - DNA, 20 bp, Artificial
  CRISPR gRNA sequence
gttattatttcagtgaaatc

SEQ ID NO: 303596 - DNA, 20 bp, Artificial
  CRISPR gRNA sequence
gtgaaatctggcttcaccca

SEQ ID NO: 303597 - DNA, 20 bp, Artificial
  CRISPR gRNA sequence
tgaaatctggcttcacccaa

SEQ ID NO: 303598 - DNA, 20 bp, Artificial
  CRISPR gRNA sequence
aatctggcttcacccaaagg

SEQ ID NO: 303599 - DNA, 20 bp, Artificial
  CRISPR gRNA sequence
ccaaaggaagccacttgctc

SEQ ID NO: 303600 - DNA, 20 bp, Artificial
  CRISPR gRNA sequence
gaagccacttgctccagccc

SEQ ID NO: 303601 - DNA, 20 bp, Artificial
  CRISPR gRNA sequence
gtttgttttatcacactttg

SEQ ID NO: 303602 - DNA, 20 bp, Artificial
  CRISPR gRNA sequence
tttgttttatcacactttgt

SEQ ID NO: 303603 - DNA, 20 bp, Artificial
  CRISPR gRNA sequence
ttgttttatcacactttgtg

SEQ ID NO: 303604 - DNA, 20 bp, Artificial
  CRISPR gRNA sequence
tcacactttgtggggacttt

SEQ ID NO: 303605 - DNA, 20 bp, Artificial
  CRISPR gRNA sequence
gagcaacaccttcccctttt

SEQ ID NO: 303606 - DNA, 20 bp, Artificial
  CRISPR gRNA sequence
agcaacaccttccccttttg

SEQ ID NO: 303607 - DNA, 20 bp, Artificial
  CRISPR gRNA sequence
tctgactttctcattgcttg

SEQ ID NO: 303608 - DNA, 20 bp, Artificial
  CRISPR gRNA sequence
tctcattgcttgtagctact

SEQ ID NO: 303609 - DNA, 20 bp, Artificial
  CRISPR gRNA sequence
tcactaccaccttgctaaat

SEQ ID NO: 303610 - DNA, 20 bp, Artificial
  CRISPR gRNA sequence
cactaccaccttgctaaatg

SEQ ID NO: 303611 - DNA, 20 bp, Artificial
  CRISPR gRNA sequence
accttgctaaatgaggattt

SEQ ID NO: 303612 - DNA, 20 bp, Artificial
  CRISPR gRNA sequence
ctaaatgaggattttggcat

SEQ ID NO: 303613 - DNA, 20 bp, Artificial
  CRISPR gRNA sequence
aggattttggcattagatgc

SEQ ID NO: 303614 - DNA, 20 bp, Artificial
  CRISPR gRNA sequence
ggattttggcattagatgca

SEQ ID NO: 303615 - DNA, 20 bp, Artificial
  CRISPR gRNA sequence
gcaaggtcttgctaacaatt

SEQ ID NO: 303616 - DNA, 20 bp, Artificial
  CRISPR gRNA sequence
caaggtcttgctaacaattt

SEQ ID NO: 303617 - DNA, 20 bp, Artificial
  CRISPR gRNA sequence
tgggtgacttcttcatgaat

SEQ ID NO: 303618 - DNA, 20 bp, Artificial
  CRISPR gRNA sequence
ctttgatcttgtcaactcca

SEQ ID NO: 303619 - DNA, 20 bp, Artificial
  CRISPR gRNA sequence
tttgatcttgtcaactccac

SEQ ID NO: 303620 - DNA, 20 bp, Artificial
  CRISPR gRNA sequence
actccacaggtctacacccg

SEQ ID NO: 303621 - DNA, 20 bp, Artificial
  CRISPR gRNA sequence
tctacacccgcagactattt

SEQ ID NO: 303622 - DNA, 20 bp, Artificial
  CRISPR gRNA sequence
acacccgcagactatttcag

SEQ ID NO: 303623 - DNA, 20 bp, Artificial
  CRISPR gRNA sequence
taaccctgaaacttttcacc

SEQ ID NO: 303624 - DNA, 20 bp, Artificial
  CRISPR gRNA sequence
accctgaaacttttcacctg

SEQ ID NO: 303625 - DNA, 20 bp, Artificial
  CRISPR gRNA sequence
ctgaaacttttcacctggag

SEQ ID NO: 303626 - DNA, 20 bp, Artificial
  CRISPR gRNA sequence
acttttcacctggagcagct

SEQ ID NO: 303627 - DNA, 20 bp, Artificial
  CRISPR gRNA sequence
acctggagcagctcagtccc

SEQ ID NO: 303628 - DNA, 20 bp, Artificial
  CRISPR gRNA sequence
tccacaacctcctattcatc

SEQ ID NO: 303629 - DNA, 20 bp, Artificial
  CRISPR gRNA sequence
ccacaacctcctattcatcc

SEQ ID NO: 303630 - DNA, 20 bp, Artificial
  CRISPR gRNA sequence
aactgttgttcaacttaatc

SEQ ID NO: 303631 - DNA, 20 bp, Artificial
  CRISPR gRNA sequence
gttcaacttaatcaagacct

SEQ ID NO: 303632 - DNA, 20 bp, Artificial
  CRISPR gRNA sequence
atcaagacctcagctttatc

SEQ ID NO: 303633 - DNA, 20 bp, Artificial
  CRISPR gRNA sequence
tcagctttatccagaccctg

SEQ ID NO: 303634 - DNA, 20 bp, Artificial
  CRISPR gRNA sequence
tttatccagaccctgtagtg

SEQ ID NO: 303635 - DNA, 20 bp, Artificial
  CRISPR gRNA sequence
tgtagtgcagtgttttccac

SEQ ID NO: 303636 - DNA, 20 bp, Artificial
  CRISPR gRNA sequence
gtgttttccacaagaactct

SEQ ID NO: 303637 - DNA, 20 bp, Artificial
  CRISPR gRNA sequence
acaagaactcttagtgataa

SEQ ID NO: 303638 - DNA, 20 bp, Artificial
  CRISPR gRNA sequence
ctctgtgctgaacaatatga

SEQ ID NO: 303639 - DNA, 20 bp, Artificial
  CRISPR gRNA sequence
ctgaacaatatgatagccac

SEQ ID NO: 303640 - DNA, 20 bp, Artificial
  CRISPR gRNA sequence
atgatagccaccagcccctg

SEQ ID NO: 303641 - DNA, 20 bp, Artificial
  CRISPR gRNA sequence
caccagcccctgtggctatt

SEQ ID NO: 303642 - DNA, 20 bp, Artificial
  CRISPR gRNA sequence
gctattgagcaattgataca

SEQ ID NO: 303643 - DNA, 20 bp, Artificial
  CRISPR gRNA sequence
ttgagcaattgatacatagc

SEQ ID NO: 303644 - DNA, 20 bp, Artificial
  CRISPR gRNA sequence
gatacatagctagtatgact

SEQ ID NO: 303645 - DNA, 20 bp, Artificial
  CRISPR gRNA sequence
acatagctagtatgactgag

SEQ ID NO: 303646 - DNA, 20 bp, Artificial
  CRISPR gRNA sequence
attttaattaattgaaattt

SEQ ID NO: 303647 - DNA, 20 bp, Artificial
  CRISPR gRNA sequence
ttaattaattgaaatttaag

SEQ ID NO: 303648 - DNA, 20 bp, Artificial
  CRISPR gRNA sequence
gaaatttaagtagtcacata

SEQ ID NO: 303649 - DNA, 20 bp, Artificial
  CRISPR gRNA sequence
tttaagtagtcacatatggc

SEQ ID NO: 303650 - DNA, 20 bp, Artificial
  CRISPR gRNA sequence
aagtagtcacatatggctag

SEQ ID NO: 303651 - DNA, 20 bp, Artificial
  CRISPR gRNA sequence
atggctagtggttattatat

SEQ ID NO: 303652 - DNA, 20 bp, Artificial
  CRISPR gRNA sequence
tatattggacaatgcaacaa

SEQ ID NO: 303653 - DNA, 20 bp, Artificial
  CRISPR gRNA sequence
tgtctctataaaatttaccc

SEQ ID NO: 303654 - DNA, 20 bp, Artificial
  CRISPR gRNA sequence
gtctctataaaatttaccct

SEQ ID NO: 303655 - DNA, 20 bp, Artificial
  CRISPR gRNA sequence
tctctataaaatttaccctg

SEQ ID NO: 303656 - DNA, 20 bp, Artificial
  CRISPR gRNA sequence
ccctggggacactctacttt

SEQ ID NO: 303657 - DNA, 20 bp, Artificial
  CRISPR gRNA sequence
tacatatctgttcttacaac

SEQ ID NO: 303658 - DNA, 20 bp, Artificial
  CRISPR gRNA sequence
acatatctgttcttacaact

SEQ ID NO: 303659 - DNA, 20 bp, Artificial
  CRISPR gRNA sequence
gttcttacaactgggcaatt

SEQ ID NO: 303660 - DNA, 20 bp, Artificial
  CRISPR gRNA sequence
cttacaactgggcaattgag

SEQ ID NO: 303661 - DNA, 20 bp, Artificial
  CRISPR gRNA sequence
actgggcaattgagcagttc

SEQ ID NO: 303662 - DNA, 20 bp, Artificial
  CRISPR gRNA sequence
tgggcaattgagcagttctg

SEQ ID NO: 303663 - DNA, 20 bp, Artificial
  CRISPR gRNA sequence
gggcaattgagcagttctgg

SEQ ID NO: 303664 - DNA, 20 bp, Artificial
  CRISPR gRNA sequence
cagttctggaggaaattatt

SEQ ID NO: 303665 - DNA, 20 bp, Artificial
  CRISPR gRNA sequence
gaggaaattattcagttgtg

SEQ ID NO: 303666 - DNA, 20 bp, Artificial
  CRISPR gRNA sequence
aattattcagttgtgcggac

SEQ ID NO: 303667 - DNA, 20 bp, Artificial
  CRISPR gRNA sequence
ctggtgacattccaaatctg

SEQ ID NO: 303668 - DNA, 20 bp, Artificial
  CRISPR gRNA sequence
gtgtcctgtctcacttcact

SEQ ID NO: 303669 - DNA, 20 bp, Artificial
  CRISPR gRNA sequence
gtctcacttcactcggcctc

SEQ ID NO: 303670 - DNA, 20 bp, Artificial
  CRISPR gRNA sequence
tctcacttcactcggcctcc

SEQ ID NO: 303671 - DNA, 20 bp, Artificial
  CRISPR gRNA sequence
cggcctccaggctattcacc

SEQ ID NO: 303672 - DNA, 20 bp, Artificial
  CRISPR gRNA sequence
aaaccttgtgctactgcttt

SEQ ID NO: 303673 - DNA, 20 bp, Artificial
  CRISPR gRNA sequence
cttttagtttctctttccct

SEQ ID NO: 303674 - DNA, 20 bp, Artificial
  CRISPR gRNA sequence
tttagtttctctttcccttg

SEQ ID NO: 303675 - DNA, 20 bp, Artificial
  CRISPR gRNA sequence
cttggagtcaaactccctga

SEQ ID NO: 303676 - DNA, 20 bp, Artificial
  CRISPR gRNA sequence
tggagtcaaactccctgaaa

SEQ ID NO: 303677 - DNA, 20 bp, Artificial
  CRISPR gRNA sequence
gtcaaactccctgaaagagt

SEQ ID NO: 303678 - DNA, 20 bp, Artificial
  CRISPR gRNA sequence
aaactccctgaaagagtaag

SEQ ID NO: 303679 - DNA, 20 bp, Artificial
  CRISPR gRNA sequence
gcaattgctgcctttattcc

SEQ ID NO: 303680 - DNA, 20 bp, Artificial
  CRISPR gRNA sequence
tctactgaaactccctgaca

SEQ ID NO: 303681 - DNA, 20 bp, Artificial
  CRISPR gRNA sequence
ctactgaaactccctgacaa

SEQ ID NO: 303682 - DNA, 20 bp, Artificial
  CRISPR gRNA sequence
aactccctgacaaaggttgt

SEQ ID NO: 303683 - DNA, 20 bp, Artificial
  CRISPR gRNA sequence
ttgttggtgacttcacacca

SEQ ID NO: 303684 - DNA, 20 bp, Artificial
  CRISPR gRNA sequence
ggtgacttcacaccatggcc

SEQ ID NO: 303685 - DNA, 20 bp, Artificial
  CRISPR gRNA sequence
gtgacttcacaccatggcca

SEQ ID NO: 303686 - DNA, 20 bp, Artificial
  CRISPR gRNA sequence
tcacaccatggccaaggctt

SEQ ID NO: 303687 - DNA, 20 bp, Artificial
  CRISPR gRNA sequence
gccaaggcttgagctctttt

SEQ ID NO: 303688 - DNA, 20 bp, Artificial
  CRISPR gRNA sequence
ttgaccgctgtgtcaaatgc

SEQ ID NO: 303689 - DNA, 20 bp, Artificial
  CRISPR gRNA sequence
gctgtgtcaaatgcaagtgt

SEQ ID NO: 303690 - DNA, 20 bp, Artificial
  CRISPR gRNA sequence
ctcaaatcactctttaattt

SEQ ID NO: 303691 - DNA, 20 bp, Artificial
  CRISPR gRNA sequence
tctttaattttggtaacctt

SEQ ID NO: 303692 - DNA, 20 bp, Artificial
  CRISPR gRNA sequence
taaccttgagtgcatgttct

SEQ ID NO: 303693 - DNA, 20 bp, Artificial
  CRISPR gRNA sequence
tcttattctccatactttcc

SEQ ID NO: 303694 - DNA, 20 bp, Artificial
  CRISPR gRNA sequence
ctttcctggtttttctcctc

SEQ ID NO: 303695 - DNA, 20 bp, Artificial
  CRISPR gRNA sequence
gtttttctcctctagcccca

SEQ ID NO: 303696 - DNA, 20 bp, Artificial
  CRISPR gRNA sequence
gccccacggattcaactgtc

SEQ ID NO: 303697 - DNA, 20 bp, Artificial
  CRISPR gRNA sequence
cggattcaactgtcaagtaa

SEQ ID NO: 303698 - DNA, 20 bp, Artificial
  CRISPR gRNA sequence
aagtaaaagctaataactcc

SEQ ID NO: 303699 - DNA, 20 bp, Artificial
  CRISPR gRNA sequence
agtaaaagctaataactccc

SEQ ID NO: 303700 - DNA, 20 bp, Artificial
  CRISPR gRNA sequence
aactcccaggtgcttattgc

SEQ ID NO: 303701 - DNA, 20 bp, Artificial
  CRISPR gRNA sequence
tgccagcctataactttcac

SEQ ID NO: 303702 - DNA, 20 bp, Artificial
  CRISPR gRNA sequence
ccagcctataactttcacta

SEQ ID NO: 303703 - DNA, 20 bp, Artificial
  CRISPR gRNA sequence
tataactttcactagagttt

SEQ ID NO: 303704 - DNA, 20 bp, Artificial
  CRISPR gRNA sequence
acctgtattcaacttcctgc

SEQ ID NO: 303705 - DNA, 20 bp, Artificial
  CRISPR gRNA sequence
tcctgctggatgtctctatc

SEQ ID NO: 303706 - DNA, 20 bp, Artificial
  CRISPR gRNA sequence
gctggatgtctctatctaga

SEQ ID NO: 303707 - DNA, 20 bp, Artificial
  CRISPR gRNA sequence
tgtctctatctagatagcaa

SEQ ID NO: 303708 - DNA, 20 bp, Artificial
  CRISPR gRNA sequence
gtctctatctagatagcaac

SEQ ID NO: 303709 - DNA, 20 bp, Artificial
  CRISPR gRNA sequence
ggtactgtcttcctcccctt

SEQ ID NO: 303710 - DNA, 20 bp, Artificial
  CRISPR gRNA sequence
gccttcctctactctatctc

SEQ ID NO: 303711 - DNA, 20 bp, Artificial
  CRISPR gRNA sequence
ccttcctctactctatctca

SEQ ID NO: 303712 - DNA, 20 bp, Artificial
  CRISPR gRNA sequence
tcaaggaatgctcccctgtc

SEQ ID NO: 303713 - DNA, 20 bp, Artificial
  CRISPR gRNA sequence
caaggaatgctcccctgtct

SEQ ID NO: 303714 - DNA, 20 bp, Artificial
  CRISPR gRNA sequence
ctcccctgtctgggaatgac

SEQ ID NO: 303715 - DNA, 20 bp, Artificial
  CRISPR gRNA sequence
tctaaatcatctgtataacc

SEQ ID NO: 303716 - DNA, 20 bp, Artificial
  CRISPR gRNA sequence
tgtgtacccaaaatacccaa

SEQ ID NO: 303717 - DNA, 20 bp, Artificial
  CRISPR gRNA sequence
tgtacccaaaatacccaaca

SEQ ID NO: 303718 - DNA, 20 bp, Artificial
  CRISPR gRNA sequence
gtacccaaaatacccaacag

SEQ ID NO: 303719 - DNA, 20 bp, Artificial
  CRISPR gRNA sequence
acccaacagaggctctacac

SEQ ID NO: 303720 - DNA, 20 bp, Artificial
  CRISPR gRNA sequence
ggctctacacaagtgtgtct

SEQ ID NO: 303721 - DNA, 20 bp, Artificial
  CRISPR gRNA sequence
gctctacacaagtgtgtctg

SEQ ID NO: 303722 - DNA, 20 bp, Artificial
  CRISPR gRNA sequence
tctacacaagtgtgtctgag

SEQ ID NO: 303723 - DNA, 20 bp, Artificial
  CRISPR gRNA sequence
caagtgtgtctgaggagatc

SEQ ID NO: 303724 - DNA, 20 bp, Artificial
  CRISPR gRNA sequence
gaggagatctagaactacta

SEQ ID NO: 303725 - DNA, 20 bp, Artificial
  CRISPR gRNA sequence
agatctagaactactacagc

SEQ ID NO: 303726 - DNA, 20 bp, Artificial
  CRISPR gRNA sequence
atctagaactactacagcca

SEQ ID NO: 303727 - DNA, 20 bp, Artificial
  CRISPR gRNA sequence
gagctgaactccaatatgtt

SEQ ID NO: 303728 - DNA, 20 bp, Artificial
  CRISPR gRNA sequence
gaactccaatatgttaagaa

SEQ ID NO: 303729 - DNA, 20 bp, Artificial
  CRISPR gRNA sequence
aactccaatatgttaagaaa

SEQ ID NO: 303730 - DNA, 20 bp, Artificial
  CRISPR gRNA sequence
actccaatatgttaagaaaa

SEQ ID NO: 303731 - DNA, 20 bp, Artificial
  CRISPR gRNA sequence
ccaatatgttaagaaaaggg

SEQ ID NO: 303732 - DNA, 20 bp, Artificial
  CRISPR gRNA sequence
aatatgttaagaaaagggta

SEQ ID NO: 303733 - DNA, 20 bp, Artificial
  CRISPR gRNA sequence
atatgttaagaaaagggtag

SEQ ID NO: 303734 - DNA, 20 bp, Artificial
  CRISPR gRNA sequence
atgttaagaaaagggtagag

SEQ ID NO: 303735 - DNA, 20 bp, Artificial
  CRISPR gRNA sequence
gcctgctccgtccttgtccc

SEQ ID NO: 303736 - DNA, 20 bp, Artificial
  CRISPR gRNA sequence
cctgctccgtccttgtcccc

SEQ ID NO: 303737 - DNA, 20 bp, Artificial
  CRISPR gRNA sequence
tccgtccttgtccccgggtc

SEQ ID NO: 303738 - DNA, 20 bp, Artificial
  CRISPR gRNA sequence
gtccccgggtctagtttctc

SEQ ID NO: 303739 - DNA, 20 bp, Artificial
  CRISPR gRNA sequence
aaaatgatcccttaaaaata

SEQ ID NO: 303740 - DNA, 20 bp, Artificial
  CRISPR gRNA sequence
aatcacataatcctcctgtt

SEQ ID NO: 303741 - DNA, 20 bp, Artificial
  CRISPR gRNA sequence
cacataatcctcctgttcag

SEQ ID NO: 303742 - DNA, 20 bp, Artificial
  CRISPR gRNA sequence
accaaactgaaaaatatatc

SEQ ID NO: 303743 - DNA, 20 bp, Artificial
  CRISPR gRNA sequence
agatcccttcccctcacact

SEQ ID NO: 303744 - DNA, 20 bp, Artificial
  CRISPR gRNA sequence
cacactgagaactacatcca

SEQ ID NO: 303745 - DNA, 20 bp, Artificial
  CRISPR gRNA sequence
tacatccaaagtccttcccc

SEQ ID NO: 303746 - DNA, 20 bp, Artificial
  CRISPR gRNA sequence
agtccttcccctggccttac

SEQ ID NO: 303747 - DNA, 20 bp, Artificial
  CRISPR gRNA sequence
cttacaagacctcatgtaat

SEQ ID NO: 303748 - DNA, 20 bp, Artificial
  CRISPR gRNA sequence
ttacaagacctcatgtaatt

SEQ ID NO: 303749 - DNA, 20 bp, Artificial
  CRISPR gRNA sequence
acctcatgtaattgggtccc

SEQ ID NO: 303750 - DNA, 20 bp, Artificial
  CRISPR gRNA sequence
attgggtccccagtacctat

SEQ ID NO: 303751 - DNA, 20 bp, Artificial
  CRISPR gRNA sequence
ttgggtccccagtacctatc

SEQ ID NO: 303752 - DNA, 20 bp, Artificial
  CRISPR gRNA sequence
tttcccctgcttactctccc

SEQ ID NO: 303753 - DNA, 20 bp, Artificial
  CRISPR gRNA sequence
ctcccttgacattcctccaa

SEQ ID NO: 303754 - DNA, 20 bp, Artificial
  CRISPR gRNA sequence
aagatcacacactctgtctc

SEQ ID NO: 303755 - DNA, 20 bp, Artificial
  CRISPR gRNA sequence
ctcatgttgttccctctgtc

SEQ ID NO: 303756 - DNA, 20 bp, Artificial
  CRISPR gRNA sequence
atgttgttccctctgtccag

SEQ ID NO: 303757 - DNA, 20 bp, Artificial
  CRISPR gRNA sequence
tgttgttccctctgtccaga

SEQ ID NO: 303758 - DNA, 20 bp, Artificial
  CRISPR gRNA sequence
tgtccagaaggttcttcctc

SEQ ID NO: 303759 - DNA, 20 bp, Artificial
  CRISPR gRNA sequence
cagaaggttcttcctccaga

SEQ ID NO: 303760 - DNA, 20 bp, Artificial
  CRISPR gRNA sequence
tcttcctccagacagtctca

SEQ ID NO: 303761 - DNA, 20 bp, Artificial
  CRISPR gRNA sequence
agcttctccttcacttcatg

SEQ ID NO: 303762 - DNA, 20 bp, Artificial
  CRISPR gRNA sequence
gcttctccttcacttcatgt

SEQ ID NO: 303763 - DNA, 20 bp, Artificial
  CRISPR gRNA sequence
tttcattaaatgctacctcc

SEQ ID NO: 303764 - DNA, 20 bp, Artificial
  CRISPR gRNA sequence
ttcattaaatgctacctccc

SEQ ID NO: 303765 - DNA, 20 bp, Artificial
  CRISPR gRNA sequence
tcattaaatgctacctccca

SEQ ID NO: 303766 - DNA, 20 bp, Artificial
  CRISPR gRNA sequence
attaaatgctacctcccagg

SEQ ID NO: 303767 - DNA, 20 bp, Artificial
  CRISPR gRNA sequence
tttctctaaccattctattg

SEQ ID NO: 303768 - DNA, 20 bp, Artificial
  CRISPR gRNA sequence
tctaaccattctattgaaga

SEQ ID NO: 303769 - DNA, 20 bp, Artificial
  CRISPR gRNA sequence
ttctattgaagatagcatcc

SEQ ID NO: 303770 - DNA, 20 bp, Artificial
  CRISPR gRNA sequence
tctattgaagatagcatcct

SEQ ID NO: 303771 - DNA, 20 bp, Artificial
  CRISPR gRNA sequence
atgctgacttatatttattg

SEQ ID NO: 303772 - DNA, 20 bp, Artificial
  CRISPR gRNA sequence
tatcatgacatgacatgaca

SEQ ID NO: 303773 - DNA, 20 bp, Artificial
  CRISPR gRNA sequence
atgacatgacacggtatgtt

SEQ ID NO: 303774 - DNA, 20 bp, Artificial
  CRISPR gRNA sequence
ggttattgtctgtctctcct

SEQ ID NO: 303775 - DNA, 20 bp, Artificial
  CRISPR gRNA sequence
tctgtctctcctgagatgtc

SEQ ID NO: 303776 - DNA, 20 bp, Artificial
  CRISPR gRNA sequence
ctgtctctcctgagatgtct

SEQ ID NO: 303777 - DNA, 20 bp, Artificial
  CRISPR gRNA sequence
aaaatctatgtgtgattttt

SEQ ID NO: 303778 - DNA, 20 bp, Artificial
  CRISPR gRNA sequence
tgatttttcagacctgacca

SEQ ID NO: 303779 - DNA, 20 bp, Artificial
  CRISPR gRNA sequence
gatttttcagacctgaccac

SEQ ID NO: 303780 - DNA, 20 bp, Artificial
  CRISPR gRNA sequence
gacctgaccacaggcaatta

SEQ ID NO: 303781 - DNA, 20 bp, Artificial
  CRISPR gRNA sequence
cctgaccacaggcaattaaa

SEQ ID NO: 303782 - DNA, 20 bp, Artificial
  CRISPR gRNA sequence
ctgaccacaggcaattaaag

SEQ ID NO: 303783 - DNA, 20 bp, Artificial
  CRISPR gRNA sequence
ttaaagaggcttaatctgac

SEQ ID NO: 303784 - DNA, 20 bp, Artificial
  CRISPR gRNA sequence
ttaatctgacaagccttgct

SEQ ID NO: 303785 - DNA, 20 bp, Artificial
  CRISPR gRNA sequence
taatctgacaagccttgctg

SEQ ID NO: 303786 - DNA, 20 bp, Artificial
  CRISPR gRNA sequence
tctgacaagccttgctgagg

SEQ ID NO: 303787 - DNA, 20 bp, Artificial
  CRISPR gRNA sequence
tgaggaagttgccctttcta

SEQ ID NO: 303788 - DNA, 20 bp, Artificial
  CRISPR gRNA sequence
ggaagttgccctttctacag

SEQ ID NO: 303789 - DNA, 20 bp, Artificial
  CRISPR gRNA sequence
tgccctttctacagcagact

SEQ ID NO: 303790 - DNA, 20 bp, Artificial
  CRISPR gRNA sequence
tctacagcagacttggtgca

SEQ ID NO: 303791 - DNA, 20 bp, Artificial
  CRISPR gRNA sequence
cagcagacttggtgcacagt

SEQ ID NO: 303792 - DNA, 20 bp, Artificial
  CRISPR gRNA sequence
cttggtgcacagtcagtgca

SEQ ID NO: 303793 - DNA, 20 bp, Artificial
  CRISPR gRNA sequence
ggtgcacagtcagtgcatgg

SEQ ID NO: 303794 - DNA, 20 bp, Artificial
  CRISPR gRNA sequence
tcagtgcatggcagtctctg

SEQ ID NO: 303795 - DNA, 20 bp, Artificial
  CRISPR gRNA sequence
cagtgcatggcagtctctga

SEQ ID NO: 303796 - DNA, 20 bp, Artificial
  CRISPR gRNA sequence
agtgcatggcagtctctgaa

SEQ ID NO: 303797 - DNA, 20 bp, Artificial
  CRISPR gRNA sequence
gtgcatggcagtctctgaag

SEQ ID NO: 303798 - DNA, 20 bp, Artificial
  CRISPR gRNA sequence
tgcatggcagtctctgaagg

SEQ ID NO: 303799 - DNA, 20 bp, Artificial
  CRISPR gRNA sequence
ctctgaagggggctgcaatc

SEQ ID NO: 303800 - DNA, 20 bp, Artificial
  CRISPR gRNA sequence
gggggctgcaatcaagatct

SEQ ID NO: 303801 - DNA, 20 bp, Artificial
  CRISPR gRNA sequence
tcaagatctcagcctcccgc

SEQ ID NO: 303802 - DNA, 20 bp, Artificial
  CRISPR gRNA sequence
ttttcacatacttgcaatct

SEQ ID NO: 303803 - DNA, 20 bp, Artificial
  CRISPR gRNA sequence
acatacttgcaatcttagcc

SEQ ID NO: 303804 - DNA, 20 bp, Artificial
  CRISPR gRNA sequence
catacttgcaatcttagccc

SEQ ID NO: 303805 - DNA, 20 bp, Artificial
  CRISPR gRNA sequence
agcccaggcaccctcattct

SEQ ID NO: 303806 - DNA, 20 bp, Artificial
  CRISPR gRNA sequence
gcccaggcaccctcattctt

SEQ ID NO: 303807 - DNA, 20 bp, Artificial
  CRISPR gRNA sequence
attcttaggtctctttatct

SEQ ID NO: 303808 - DNA, 20 bp, Artificial
  CRISPR gRNA sequence
ttcttaggtctctttatctg

SEQ ID NO: 303809 - DNA, 20 bp, Artificial
  CRISPR gRNA sequence
ggtctctttatctgaggctc

SEQ ID NO: 303810 - DNA, 20 bp, Artificial
  CRISPR gRNA sequence
gtctctttatctgaggctct

SEQ ID NO: 303811 - DNA, 20 bp, Artificial
  CRISPR gRNA sequence
tctctttatctgaggctctg

SEQ ID NO: 303812 - DNA, 20 bp, Artificial
  CRISPR gRNA sequence
tttatctgaggctctggggt

SEQ ID NO: 303813 - DNA, 20 bp, Artificial
  CRISPR gRNA sequence
ttatctgaggctctggggtg

SEQ ID NO: 303814 - DNA, 20 bp, Artificial
  CRISPR gRNA sequence
aggctctggggtgaggtctt

SEQ ID NO: 303815 - DNA, 20 bp, Artificial
  CRISPR gRNA sequence
ggctctggggtgaggtcttc

SEQ ID NO: 303816 - DNA, 20 bp, Artificial
  CRISPR gRNA sequence
gtcttcaggcacctctgctg

SEQ ID NO: 303817 - DNA, 20 bp, Artificial
  CRISPR gRNA sequence
ctgctgaagcctcctcatca

SEQ ID NO: 303818 - DNA, 20 bp, Artificial
  CRISPR gRNA sequence
gctgaagcctcctcatcata

SEQ ID NO: 303819 - DNA, 20 bp, Artificial
  CRISPR gRNA sequence
gaagcctcctcatcatagag

SEQ ID NO: 303820 - DNA, 20 bp, Artificial
  CRISPR gRNA sequence
agaagacacttttctccact

SEQ ID NO: 303821 - DNA, 20 bp, Artificial
  CRISPR gRNA sequence
cacttttctccactcggact

SEQ ID NO: 303822 - DNA, 20 bp, Artificial
  CRISPR gRNA sequence
ctccactcggactcagtacc

SEQ ID NO: 303823 - DNA, 20 bp, Artificial
  CRISPR gRNA sequence
cttttccactccctgccttg

SEQ ID NO: 303824 - DNA, 20 bp, Artificial
  CRISPR gRNA sequence
cactgttttccactctgact

SEQ ID NO: 303825 - DNA, 20 bp, Artificial
  CRISPR gRNA sequence
ttccactctgactcagtacc

SEQ ID NO: 303826 - DNA, 20 bp, Artificial
  CRISPR gRNA sequence
cctagtattttttccactcc

SEQ ID NO: 303827 - DNA, 20 bp, Artificial
  CRISPR gRNA sequence
tttttccactcctagcccta

SEQ ID NO: 303828 - DNA, 20 bp, Artificial
  CRISPR gRNA sequence
cactattccccacgctaact

SEQ ID NO: 303829 - DNA, 20 bp, Artificial
  CRISPR gRNA sequence
actttgtacttttccactcc

SEQ ID NO: 303830 - DNA, 20 bp, Artificial
  CRISPR gRNA sequence
tcatgaattctccccaccct

SEQ ID NO: 303831 - DNA, 20 bp, Artificial
  CRISPR gRNA sequence
cccttggattcctccacccc

SEQ ID NO: 303832 - DNA, 20 bp, Artificial
  CRISPR gRNA sequence
ccttggattcctccaccccc

SEQ ID NO: 303833 - DNA, 20 bp, Artificial
  CRISPR gRNA sequence
ccccaggtccataaaactgc

SEQ ID NO: 303834 - DNA, 20 bp, Artificial
  CRISPR gRNA sequence
ccaggtccataaaactgcta

SEQ ID NO: 303835 - DNA, 20 bp, Artificial
  CRISPR gRNA sequence
aactgctagagcctttcatt

SEQ ID NO: 303836 - DNA, 20 bp, Artificial
  CRISPR gRNA sequence
actgctagagcctttcattt

SEQ ID NO: 303837 - DNA, 20 bp, Artificial
  CRISPR gRNA sequence
ctgctagagcctttcatttg

SEQ ID NO: 303838 - DNA, 20 bp, Artificial
  CRISPR gRNA sequence
ttcatttggggcttcttcaa

SEQ ID NO: 303839 - DNA, 20 bp, Artificial
  CRISPR gRNA sequence
tttggggcttcttcaatggt

SEQ ID NO: 303840 - DNA, 20 bp, Artificial
  CRISPR gRNA sequence
ttggggcttcttcaatggta

SEQ ID NO: 303841 - DNA, 20 bp, Artificial
  CRISPR gRNA sequence
caatggtaaggcgaccccct

SEQ ID NO: 303842 - DNA, 20 bp, Artificial
  CRISPR gRNA sequence
ctgattacctgaccctcgac

SEQ ID NO: 303843 - DNA, 20 bp, Artificial
  CRISPR gRNA sequence
actggtatactcactctatg

SEQ ID NO: 303844 - DNA, 20 bp, Artificial
  CRISPR gRNA sequence
ctggtatactcactctatgt

SEQ ID NO: 303845 - DNA, 20 bp, Artificial
  CRISPR gRNA sequence
tggtatactcactctatgtg

SEQ ID NO: 303846 - DNA, 20 bp, Artificial
  CRISPR gRNA sequence
actcactctatgtggggaaa

SEQ ID NO: 303847 - DNA, 20 bp, Artificial
  CRISPR gRNA sequence
ctctatgtggggaaatggaa

SEQ ID NO: 303848 - DNA, 20 bp, Artificial
  CRISPR gRNA sequence
tctatgtggggaaatggaac

SEQ ID NO: 303849 - DNA, 20 bp, Artificial
  CRISPR gRNA sequence
atgtggggaaatggaacagg

SEQ ID NO: 303850 - DNA, 20 bp, Artificial
  CRISPR gRNA sequence
gtggggaaatggaacaggca

SEQ ID NO: 303851 - DNA, 20 bp, Artificial
  CRISPR gRNA sequence
gtctgcccttcctcccattt

SEQ ID NO: 303852 - DNA, 20 bp, Artificial
  CRISPR gRNA sequence
gcctcttgattataccgtcg

SEQ ID NO: 303853 - DNA, 20 bp, Artificial
  CRISPR gRNA sequence
cttgattataccgtcgtagt

SEQ ID NO: 303854 - DNA, 20 bp, Artificial
  CRISPR gRNA sequence
tgattataccgtcgtagtaa

SEQ ID NO: 303855 - DNA, 20 bp, Artificial
  CRISPR gRNA sequence
ccgtcgtagtaagagattaa

SEQ ID NO: 303856 - DNA, 20 bp, Artificial
  CRISPR gRNA sequence
ttttgttttgctgctataat

SEQ ID NO: 303857 - DNA, 20 bp, Artificial
  CRISPR gRNA sequence
tcctctgacacctgacaact

SEQ ID NO: 303858 - DNA, 20 bp, Artificial
  CRISPR gRNA sequence
caactcagctctctctctcc

SEQ ID NO: 303859 - DNA, 20 bp, Artificial
  CRISPR gRNA sequence
cagctctctctctcccagct

SEQ ID NO: 303860 - DNA, 20 bp, Artificial
  CRISPR gRNA sequence
ctctctctcccagctcagct

SEQ ID NO: 303861 - DNA, 20 bp, Artificial
  CRISPR gRNA sequence
gagcacctgacatctcccat

SEQ ID NO: 303862 - DNA, 20 bp, Artificial
  CRISPR gRNA sequence
ctgacatctcccattagaat

SEQ ID NO: 303863 - DNA, 20 bp, Artificial
  CRISPR gRNA sequence
cattagaataagctccatga

SEQ ID NO: 303864 - DNA, 20 bp, Artificial
  CRISPR gRNA sequence
tagaataagctccatgacag

SEQ ID NO: 303865 - DNA, 20 bp, Artificial
  CRISPR gRNA sequence
agaataagctccatgacagc

SEQ ID NO: 303866 - DNA, 20 bp, Artificial
  CRISPR gRNA sequence
gaataagctccatgacagca

SEQ ID NO: 303867 - DNA, 20 bp, Artificial
  CRISPR gRNA sequence
aataagctccatgacagcag

SEQ ID NO: 303868 - DNA, 20 bp, Artificial
  CRISPR gRNA sequence
tttcctcactgtgacatttc

SEQ ID NO: 303869 - DNA, 20 bp, Artificial
  CRISPR gRNA sequence
aattgtcccttacaaatatg

SEQ ID NO: 303870 - DNA, 20 bp, Artificial
  CRISPR gRNA sequence
acaaatatgaagcactcaat

SEQ ID NO: 303871 - DNA, 20 bp, Artificial
  CRISPR gRNA sequence
cactcaataagtaattgttg

SEQ ID NO: 303872 - DNA, 20 bp, Artificial
  CRISPR gRNA sequence
caataagtaattgttgaaga

SEQ ID NO: 303873 - DNA, 20 bp, Artificial
  CRISPR gRNA sequence
aataagtaattgttgaagaa

SEQ ID NO: 303874 - DNA, 20 bp, Artificial
  CRISPR gRNA sequence
agtaattgttgaagaaagga

SEQ ID NO: 303875 - DNA, 20 bp, Artificial
  CRISPR gRNA sequence
gtaattgttgaagaaaggaa

SEQ ID NO: 303876 - DNA, 20 bp, Artificial
  CRISPR gRNA sequence
gaaaggaaaggaaaaatctc

SEQ ID NO: 303877 - DNA, 20 bp, Artificial
  CRISPR gRNA sequence
ggaaaaatctcaagaataac

SEQ ID NO: 303878 - DNA, 20 bp, Artificial
  CRISPR gRNA sequence
gaaaaatctcaagaataact

SEQ ID NO: 303879 - DNA, 20 bp, Artificial
  CRISPR gRNA sequence
aaaaatctcaagaataacta

SEQ ID NO: 303880 - DNA, 20 bp, Artificial
  CRISPR gRNA sequence
gggaaatgcaatttaaacct

SEQ ID NO: 303881 - DNA, 20 bp, Artificial
  CRISPR gRNA sequence
aatgcaatttaaacctcagt

SEQ ID NO: 303882 - DNA, 20 bp, Artificial
  CRISPR gRNA sequence
attctttttgcccatttgat

SEQ ID NO: 303883 - DNA, 20 bp, Artificial
  CRISPR gRNA sequence
gcacgtattaaaaaaaatac

SEQ ID NO: 303884 - DNA, 20 bp, Artificial
  CRISPR gRNA sequence
aaaaaaatactggtaatacc

SEQ ID NO: 303885 - DNA, 20 bp, Artificial
  CRISPR gRNA sequence
tggtaatacccagtgtccgc

SEQ ID NO: 303886 - DNA, 20 bp, Artificial
  CRISPR gRNA sequence
gtaatacccagtgtccgcga

SEQ ID NO: 303887 - DNA, 20 bp, Artificial
  CRISPR gRNA sequence
cccagtgtccgcgagagtgt

SEQ ID NO: 303888 - DNA, 20 bp, Artificial
  CRISPR gRNA sequence
ccagtgtccgcgagagtgtt

SEQ ID NO: 303889 - DNA, 20 bp, Artificial
  CRISPR gRNA sequence
ccgcgagagtgttaggaaaa

SEQ ID NO: 303890 - DNA, 20 bp, Artificial
  CRISPR gRNA sequence
cgcgagagtgttaggaaaat

SEQ ID NO: 303891 - DNA, 20 bp, Artificial
  CRISPR gRNA sequence
ctaactgctgaatttactgc

SEQ ID NO: 303892 - DNA, 20 bp, Artificial
  CRISPR gRNA sequence
ctgctggtaaaattctaaat

SEQ ID NO: 303893 - DNA, 20 bp, Artificial
  CRISPR gRNA sequence
ctaaattggtacaacctttt

SEQ ID NO: 303894 - DNA, 20 bp, Artificial
  CRISPR gRNA sequence
aaattggtacaacctttttg

SEQ ID NO: 303895 - DNA, 20 bp, Artificial
  CRISPR gRNA sequence
aattggtacaacctttttgg

SEQ ID NO: 303896 - DNA, 20 bp, Artificial
  CRISPR gRNA sequence
ggtacaacctttttggagga

SEQ ID NO: 303897 - DNA, 20 bp, Artificial
  CRISPR gRNA sequence
caacctttttggaggacagt

SEQ ID NO: 303898 - DNA, 20 bp, Artificial
  CRISPR gRNA sequence
gaggacagttggtaatatgt

SEQ ID NO: 303899 - DNA, 20 bp, Artificial
  CRISPR gRNA sequence
atatgtaagaaaattaatta

SEQ ID NO: 303900 - DNA, 20 bp, Artificial
  CRISPR gRNA sequence
tatgtaagaaaattaattat

SEQ ID NO: 303901 - DNA, 20 bp, Artificial
  CRISPR gRNA sequence
agaaaattaattatgggctt

SEQ ID NO: 303902 - DNA, 20 bp, Artificial
  CRISPR gRNA sequence
tatgggcttaagcattgact

SEQ ID NO: 303903 - DNA, 20 bp, Artificial
  CRISPR gRNA sequence
acttagcaactcaatttctt

SEQ ID NO: 303904 - DNA, 20 bp, Artificial
  CRISPR gRNA sequence
ttaagaattcattctacaaa

SEQ ID NO: 303905 - DNA, 20 bp, Artificial
  CRISPR gRNA sequence
aagatacatgtgcacaaaat

SEQ ID NO: 303906 - DNA, 20 bp, Artificial
  CRISPR gRNA sequence
gatacatgtgcacaaaatta

SEQ ID NO: 303907 - DNA, 20 bp, Artificial
  CRISPR gRNA sequence
atacatgtgcacaaaattag

SEQ ID NO: 303908 - DNA, 20 bp, Artificial
  CRISPR gRNA sequence
tgcacaaaattagaggtaca

SEQ ID NO: 303909 - DNA, 20 bp, Artificial
  CRISPR gRNA sequence
gcacaaaattagaggtacac

SEQ ID NO: 303910 - DNA, 20 bp, Artificial
  CRISPR gRNA sequence
cacaggtattcattgtttat

SEQ ID NO: 303911 - DNA, 20 bp, Artificial
  CRISPR gRNA sequence
tgtttataagaacaatacac

SEQ ID NO: 303912 - DNA, 20 bp, Artificial
  CRISPR gRNA sequence
aagaacaatacactggaaat

SEQ ID NO: 303913 - DNA, 20 bp, Artificial
  CRISPR gRNA sequence
tacactggaaataagttaaa

SEQ ID NO: 303914 - DNA, 20 bp, Artificial
  CRISPR gRNA sequence
aataatgatacatccataca

SEQ ID NO: 303915 - DNA, 20 bp, Artificial
  CRISPR gRNA sequence
ccatacaaagtaatgccatg

SEQ ID NO: 303916 - DNA, 20 bp, Artificial
  CRISPR gRNA sequence
aatgccatgtagctgtgaaa

SEQ ID NO: 303917 - DNA, 20 bp, Artificial
  CRISPR gRNA sequence
ccatgtagctgtgaaacaga

SEQ ID NO: 303918 - DNA, 20 bp, Artificial
  CRISPR gRNA sequence
agctgtgaaacagaaagcta

SEQ ID NO: 303919 - DNA, 20 bp, Artificial
  CRISPR gRNA sequence
gctgtgaaacagaaagctat

SEQ ID NO: 303920 - DNA, 20 bp, Artificial
  CRISPR gRNA sequence
ctgtgaaacagaaagctata

SEQ ID NO: 303921 - DNA, 20 bp, Artificial
  CRISPR gRNA sequence
tgaaacagaaagctataggg

SEQ ID NO: 303922 - DNA, 20 bp, Artificial
  CRISPR gRNA sequence
cagtacactattataactaa

SEQ ID NO: 303923 - DNA, 20 bp, Artificial
  CRISPR gRNA sequence
cactattataactaatagca

SEQ ID NO: 303924 - DNA, 20 bp, Artificial
  CRISPR gRNA sequence
ataactaatagcatggattc

SEQ ID NO: 303925 - DNA, 20 bp, Artificial
  CRISPR gRNA sequence
ctaatagcatggattctgga

SEQ ID NO: 303926 - DNA, 20 bp, Artificial
  CRISPR gRNA sequence
gcatggattctggacagcgt

SEQ ID NO: 303927 - DNA, 20 bp, Artificial
  CRISPR gRNA sequence
ggacagcgtgagttcaatct

SEQ ID NO: 303928 - DNA, 20 bp, Artificial
  CRISPR gRNA sequence
actcactgcctgtgttacca

SEQ ID NO: 303929 - DNA, 20 bp, Artificial
  CRISPR gRNA sequence
ctcactgcctgtgttaccat

SEQ ID NO: 303930 - DNA, 20 bp, Artificial
  CRISPR gRNA sequence
tacttaacttccctgtgtct

SEQ ID NO: 303931 - DNA, 20 bp, Artificial
  CRISPR gRNA sequence
tctcagtttcctcttgcaaa

SEQ ID NO: 303932 - DNA, 20 bp, Artificial
  CRISPR gRNA sequence
cagtttcctcttgcaaaaag

SEQ ID NO: 303933 - DNA, 20 bp, Artificial
  CRISPR gRNA sequence
agtttcctcttgcaaaaagc

SEQ ID NO: 303934 - DNA, 20 bp, Artificial
  CRISPR gRNA sequence
gcaaaaagcaggaacaataa

SEQ ID NO: 303935 - DNA, 20 bp, Artificial
  CRISPR gRNA sequence
caataatggtacctacctca

SEQ ID NO: 303936 - DNA, 20 bp, Artificial
  CRISPR gRNA sequence
aataatggtacctacctcat

SEQ ID NO: 303937 - DNA, 20 bp, Artificial
  CRISPR gRNA sequence
ctacctcataggtttgttgt

SEQ ID NO: 303938 - DNA, 20 bp, Artificial
  CRISPR gRNA sequence
tacctcataggtttgttgtg

SEQ ID NO: 303939 - DNA, 20 bp, Artificial
  CRISPR gRNA sequence
taggtttgttgtgaggatta

SEQ ID NO: 303940 - DNA, 20 bp, Artificial
  CRISPR gRNA sequence
gattaaagaaatgaatattt

SEQ ID NO: 303941 - DNA, 20 bp, Artificial
  CRISPR gRNA sequence
aaagaaatgaatatttgagt

SEQ ID NO: 303942 - DNA, 20 bp, Artificial
  CRISPR gRNA sequence
atgaatatttgagttagtgt

SEQ ID NO: 303943 - DNA, 20 bp, Artificial
  CRISPR gRNA sequence
gttagtgttggatcaaatac

SEQ ID NO: 303944 - DNA, 20 bp, Artificial
  CRISPR gRNA sequence
ttggatcaaatactggcctg

SEQ ID NO: 303945 - DNA, 20 bp, Artificial
  CRISPR gRNA sequence
atcaaatactggcctgtggt

SEQ ID NO: 303946 - DNA, 20 bp, Artificial
  CRISPR gRNA sequence
atttttaacattattaatga

SEQ ID NO: 303947 - DNA, 20 bp, Artificial
  CRISPR gRNA sequence
ttttaacattattaatgata

SEQ ID NO: 303948 - DNA, 20 bp, Artificial
  CRISPR gRNA sequence
gacataaaatcaataattta

SEQ ID NO: 303949 - DNA, 20 bp, Artificial
  CRISPR gRNA sequence
tactcaaaaaaaatttaaat

SEQ ID NO: 303950 - DNA, 20 bp, Artificial
  CRISPR gRNA sequence
aaaatttaaataagtatatt

SEQ ID NO: 303951 - DNA, 20 bp, Artificial
  CRISPR gRNA sequence
aaatttaaataagtatattt

SEQ ID NO: 303952 - DNA, 20 bp, Artificial
  CRISPR gRNA sequence
gtatatttaggatacttaaa

SEQ ID NO: 303953 - DNA, 20 bp, Artificial
  CRISPR gRNA sequence
gatacttaaaaagatatttg

SEQ ID NO: 303954 - DNA, 20 bp, Artificial
  CRISPR gRNA sequence
atatttgaagtaacatcaaa

SEQ ID NO: 303955 - DNA, 20 bp, Artificial
  CRISPR gRNA sequence
gaagtaacatcaaaaagtac

SEQ ID NO: 303956 - DNA, 20 bp, Artificial
  CRISPR gRNA sequence
gaaattataaaacataaaaa

SEQ ID NO: 303957 - DNA, 20 bp, Artificial
  CRISPR gRNA sequence
ttataaaacataaaaataga

SEQ ID NO: 303958 - DNA, 20 bp, Artificial
  CRISPR gRNA sequence
tataaaacataaaaatagat

SEQ ID NO: 303959 - DNA, 20 bp, Artificial
  CRISPR gRNA sequence
ataggccatgcctataatcc

SEQ ID NO: 303960 - DNA, 20 bp, Artificial
  CRISPR gRNA sequence
taggccatgcctataatccc

SEQ ID NO: 303961 - DNA, 20 bp, Artificial
  CRISPR gRNA sequence
gcctataatcccaggacttt

SEQ ID NO: 303962 - DNA, 20 bp, Artificial
  CRISPR gRNA sequence
tataatcccaggactttaag

SEQ ID NO: 303963 - DNA, 20 bp, Artificial
  CRISPR gRNA sequence
tcccaggactttaagaagct

SEQ ID NO: 303964 - DNA, 20 bp, Artificial
  CRISPR gRNA sequence
caggactttaagaagctgag

SEQ ID NO: 303965 - DNA, 20 bp, Artificial
  CRISPR gRNA sequence
ggactttaagaagctgagaa

SEQ ID NO: 303966 - DNA, 20 bp, Artificial
  CRISPR gRNA sequence
gagaagagataatcacttaa

SEQ ID NO: 303967 - DNA, 20 bp, Artificial
  CRISPR gRNA sequence
agaagagataatcacttaaa

SEQ ID NO: 303968 - DNA, 20 bp, Artificial
  CRISPR gRNA sequence
aagagataatcacttaaaag

SEQ ID NO: 303969 - DNA, 20 bp, Artificial
  CRISPR gRNA sequence
taatcacttaaaaggagttc

SEQ ID NO: 303970 - DNA, 20 bp, Artificial
  CRISPR gRNA sequence
acttaaaaggagttcaagac

SEQ ID NO: 303971 - DNA, 20 bp, Artificial
  CRISPR gRNA sequence
aaaggagttcaagaccagcc

SEQ ID NO: 303972 - DNA, 20 bp, Artificial
  CRISPR gRNA sequence
aaggagttcaagaccagcct

SEQ ID NO: 303973 - DNA, 20 bp, Artificial
  CRISPR gRNA sequence
tcaagaccagcctgggcaca

SEQ ID NO: 303974 - DNA, 20 bp, Artificial
  CRISPR gRNA sequence
gaccagcctgggcacaaagc

SEQ ID NO: 303975 - DNA, 20 bp, Artificial
  CRISPR gRNA sequence
aaagcgagaccccgtctcta

SEQ ID NO: 303976 - DNA, 20 bp, Artificial
  CRISPR gRNA sequence
aaaacaacaacaaaaaaaac

SEQ ID NO: 303977 - DNA, 20 bp, Artificial
  CRISPR gRNA sequence
caacaacaaaaaaaactagc

SEQ ID NO: 303978 - DNA, 20 bp, Artificial
  CRISPR gRNA sequence
aacaacaaaaaaaactagcc

SEQ ID NO: 303979 - DNA, 20 bp, Artificial
  CRISPR gRNA sequence
caaaaaaaactagccaggca

SEQ ID NO: 303980 - DNA, 20 bp, Artificial
  CRISPR gRNA sequence
aaaaaactagccaggcatgg

SEQ ID NO: 303981 - DNA, 20 bp, Artificial
  CRISPR gRNA sequence
ggcatggtggcatgtactta

SEQ ID NO: 303982 - DNA, 20 bp, Artificial
  CRISPR gRNA sequence
gtggcatgtacttatagtgc

SEQ ID NO: 303983 - DNA, 20 bp, Artificial
  CRISPR gRNA sequence
tacttatagtgccagctatt

SEQ ID NO: 303984 - DNA, 20 bp, Artificial
  CRISPR gRNA sequence
acttatagtgccagctattc

SEQ ID NO: 303985 - DNA, 20 bp, Artificial
  CRISPR gRNA sequence
tatagtgccagctattcagg

SEQ ID NO: 303986 - DNA, 20 bp, Artificial
  CRISPR gRNA sequence
tgccagctattcaggtggct

SEQ ID NO: 303987 - DNA, 20 bp, Artificial
  CRISPR gRNA sequence
gccagctattcaggtggctg

SEQ ID NO: 303988 - DNA, 20 bp, Artificial
  CRISPR gRNA sequence
agctattcaggtggctgagg

SEQ ID NO: 303989 - DNA, 20 bp, Artificial
  CRISPR gRNA sequence
ctgaggcagaaacatctctt

SEQ ID NO: 303990 - DNA, 20 bp, Artificial
  CRISPR gRNA sequence
gcagaaacatctcttgagcc

SEQ ID NO: 303991 - DNA, 20 bp, Artificial
  CRISPR gRNA sequence
cagaaacatctcttgagcct

SEQ ID NO: 303992 - DNA, 20 bp, Artificial
  CRISPR gRNA sequence
catctcttgagcctgggaat

SEQ ID NO: 303993 - DNA, 20 bp, Artificial
  CRISPR gRNA sequence
tctcttgagcctgggaatta

SEQ ID NO: 303994 - DNA, 20 bp, Artificial
  CRISPR gRNA sequence
ctcttgagcctgggaattag

SEQ ID NO: 303995 - DNA, 20 bp, Artificial
  CRISPR gRNA sequence
agcctgggaattagaggctg

SEQ ID NO: 303996 - DNA, 20 bp, Artificial
  CRISPR gRNA sequence
tgggaattagaggctgcagt

SEQ ID NO: 303997 - DNA, 20 bp, Artificial
  CRISPR gRNA sequence
gaggctgcagtaagctttga

SEQ ID NO: 303998 - DNA, 20 bp, Artificial
  CRISPR gRNA sequence
atagcaccactgcactcctc

SEQ ID NO: 303999 - DNA, 20 bp, Artificial
  CRISPR gRNA sequence
accactgcactcctctagcc

SEQ ID NO: 304000 - DNA, 20 bp, Artificial
  CRISPR gRNA sequence
ccactgcactcctctagcct

SEQ ID NO: 304001 - DNA, 20 bp, Artificial
  CRISPR gRNA sequence
cactcctctagcctgggtga

SEQ ID NO: 304002 - DNA, 20 bp, Artificial
  CRISPR gRNA sequence
ctcctctagcctgggtgaca

SEQ ID NO: 304003 - DNA, 20 bp, Artificial
  CRISPR gRNA sequence
tttgcttccataaatctcaa

SEQ ID NO: 304004 - DNA, 20 bp, Artificial
  CRISPR gRNA sequence
ataaatctcaacagtacttc

SEQ ID NO: 304005 - DNA, 20 bp, Artificial
  CRISPR gRNA sequence
taaatctcaacagtacttct

SEQ ID NO: 304006 - DNA, 20 bp, Artificial
  CRISPR gRNA sequence
aaatctcaacagtacttctg

SEQ ID NO: 304007 - DNA, 20 bp, Artificial
  CRISPR gRNA sequence
tacttctggggacaaaatac

SEQ ID NO: 304008 - DNA, 20 bp, Artificial
  CRISPR gRNA sequence
acttctggggacaaaatacc

SEQ ID NO: 304009 - DNA, 20 bp, Artificial
  CRISPR gRNA sequence
aaataccaggttacatattt

SEQ ID NO: 304010 - DNA, 20 bp, Artificial
  CRISPR gRNA sequence
caggttacatattttggaaa

SEQ ID NO: 304011 - DNA, 20 bp, Artificial
  CRISPR gRNA sequence
attaaaactcccctctcaca

SEQ ID NO: 304012 - DNA, 20 bp, Artificial
  CRISPR gRNA sequence
ttaaaactcccctctcacaa

SEQ ID NO: 304013 - DNA, 20 bp, Artificial
  CRISPR gRNA sequence
ccctctcacaaaggaaaaat

SEQ ID NO: 304014 - DNA, 20 bp, Artificial
  CRISPR gRNA sequence
cacaaaggaaaaataagcca

SEQ ID NO: 304015 - DNA, 20 bp, Artificial
  CRISPR gRNA sequence
aaaaaaatgtctgcttgcct

SEQ ID NO: 304016 - DNA, 20 bp, Artificial
  CRISPR gRNA sequence
aaaaaatgtctgcttgcctt

SEQ ID NO: 304017 - DNA, 20 bp, Artificial
  CRISPR gRNA sequence
aaaatgtctgcttgccttgg

SEQ ID NO: 304018 - DNA, 20 bp, Artificial
  CRISPR gRNA sequence
aaccctatacacatcctatt

SEQ ID NO: 304019 - DNA, 20 bp, Artificial
  CRISPR gRNA sequence
gtctgattgctcattttctc

SEQ ID NO: 304020 - DNA, 20 bp, Artificial
  CRISPR gRNA sequence
ttttctctggaacccactaa

SEQ ID NO: 304021 - DNA, 20 bp, Artificial
  CRISPR gRNA sequence
cctgaaacaatcaactaatt

SEQ ID NO: 304022 - DNA, 20 bp, Artificial
  CRISPR gRNA sequence
ctgaaacaatcaactaattt

SEQ ID NO: 304023 - DNA, 20 bp, Artificial
  CRISPR gRNA sequence
tgaaacaatcaactaatttg

SEQ ID NO: 304024 - DNA, 20 bp, Artificial
  CRISPR gRNA sequence
gaaacaatcaactaatttgg

SEQ ID NO: 304025 - DNA, 20 bp, Artificial
  CRISPR gRNA sequence
caatcaactaatttgggggt

SEQ ID NO: 304026 - DNA, 20 bp, Artificial
  CRISPR gRNA sequence
gggggtaagatactccctac

SEQ ID NO: 304027 - DNA, 20 bp, Artificial
  CRISPR gRNA sequence
tattttgaaaaacactgaaa

SEQ ID NO: 304028 - DNA, 20 bp, Artificial
  CRISPR gRNA sequence
tttgaaaaacactgaaatgg

SEQ ID NO: 304029 - DNA, 20 bp, Artificial
  CRISPR gRNA sequence
tgaaatggtggcttaacata

SEQ ID NO: 304030 - DNA, 20 bp, Artificial
  CRISPR gRNA sequence
gaaatggtggcttaacataa

SEQ ID NO: 304031 - DNA, 20 bp, Artificial
  CRISPR gRNA sequence
aaatggtggcttaacataaa

SEQ ID NO: 304032 - DNA, 20 bp, Artificial
  CRISPR gRNA sequence
aatggtggcttaacataaag

SEQ ID NO: 304033 - DNA, 20 bp, Artificial
  CRISPR gRNA sequence
acataaaggggtgaatccaa

SEQ ID NO: 304034 - DNA, 20 bp, Artificial
  CRISPR gRNA sequence
ggtgaatccaatagaactat

SEQ ID NO: 304035 - DNA, 20 bp, Artificial
  CRISPR gRNA sequence
gtgaatccaatagaactatt

SEQ ID NO: 304036 - DNA, 20 bp, Artificial
  CRISPR gRNA sequence
taggctccatgacaattctt

SEQ ID NO: 304037 - DNA, 20 bp, Artificial
  CRISPR gRNA sequence
aggctccatgacaattcttt

SEQ ID NO: 304038 - DNA, 20 bp, Artificial
  CRISPR gRNA sequence
tgacaattctttgggaatga

SEQ ID NO: 304039 - DNA, 20 bp, Artificial
  CRISPR gRNA sequence
gacaattctttgggaatgat

SEQ ID NO: 304040 - DNA, 20 bp, Artificial
  CRISPR gRNA sequence
ctcgactgtctattcacctc

SEQ ID NO: 304041 - DNA, 20 bp, Artificial
  CRISPR gRNA sequence
tcgactgtctattcacctcc

SEQ ID NO: 304042 - DNA, 20 bp, Artificial
  CRISPR gRNA sequence
gtctattcacctccaggtga

SEQ ID NO: 304043 - DNA, 20 bp, Artificial
  CRISPR gRNA sequence
ctccaggtgatggttttaat

SEQ ID NO: 304044 - DNA, 20 bp, Artificial
  CRISPR gRNA sequence
tccaggtgatggttttaatg

SEQ ID NO: 304045 - DNA, 20 bp, Artificial
  CRISPR gRNA sequence
ccaggtgatggttttaatga

SEQ ID NO: 304046 - DNA, 20 bp, Artificial
  CRISPR gRNA sequence
ttaatgagggctatcaacaa

SEQ ID NO: 304047 - DNA, 20 bp, Artificial
  CRISPR gRNA sequence
atgagggctatcaacaacag

SEQ ID NO: 304048 - DNA, 20 bp, Artificial
  CRISPR gRNA sequence
tgagggctatcaacaacagc

SEQ ID NO: 304049 - DNA, 20 bp, Artificial
  CRISPR gRNA sequence
ctatcaacaacagcaggaaa

SEQ ID NO: 304050 - DNA, 20 bp, Artificial
  CRISPR gRNA sequence
tatcaacaacagcaggaaat

SEQ ID NO: 304051 - DNA, 20 bp, Artificial
  CRISPR gRNA sequence
tcaacaacagcaggaaatgg

SEQ ID NO: 304052 - DNA, 20 bp, Artificial
  CRISPR gRNA sequence
cagcaggaaatgggagtcaa

SEQ ID NO: 304053 - DNA, 20 bp, Artificial
  CRISPR gRNA sequence
gtcaaaagtaaccacccacg

SEQ ID NO: 304054 - DNA, 20 bp, Artificial
  CRISPR gRNA sequence
gcagatatctgcaaaaatct

SEQ ID NO: 304055 - DNA, 20 bp, Artificial
  CRISPR gRNA sequence
cagatatctgcaaaaatctt

SEQ ID NO: 304056 - DNA, 20 bp, Artificial
  CRISPR gRNA sequence
gatatctgcaaaaatcttgg

SEQ ID NO: 304057 - DNA, 20 bp, Artificial
  CRISPR gRNA sequence
atatctgcaaaaatcttggg

SEQ ID NO: 304058 - DNA, 20 bp, Artificial
  CRISPR gRNA sequence
caaaaatcttgggaggaaaa

SEQ ID NO: 304059 - DNA, 20 bp, Artificial
  CRISPR gRNA sequence
aaatcttgggaggaaaacag

SEQ ID NO: 304060 - DNA, 20 bp, Artificial
  CRISPR gRNA sequence
gaaaacagtggacctttcca

SEQ ID NO: 304061 - DNA, 20 bp, Artificial
  CRISPR gRNA sequence
aaaacagtggacctttccac

SEQ ID NO: 304062 - DNA, 20 bp, Artificial
  CRISPR gRNA sequence
gtggacctttccacaggaat

SEQ ID NO: 304063 - DNA, 20 bp, Artificial
  CRISPR gRNA sequence
ttccacaggaatgagctttt

SEQ ID NO: 304064 - DNA, 20 bp, Artificial
  CRISPR gRNA sequence
gccaatcttacataaatctt

SEQ ID NO: 304065 - DNA, 20 bp, Artificial
  CRISPR gRNA sequence
ccaatcttacataaatctta

SEQ ID NO: 304066 - DNA, 20 bp, Artificial
  CRISPR gRNA sequence
atcttacataaatcttaagg

SEQ ID NO: 304067 - DNA, 20 bp, Artificial
  CRISPR gRNA sequence
tcttacataaatcttaaggt

SEQ ID NO: 304068 - DNA, 20 bp, Artificial
  CRISPR gRNA sequence
acataaatcttaaggtgggc

SEQ ID NO: 304069 - DNA, 20 bp, Artificial
  CRISPR gRNA sequence
cataaatcttaaggtgggcc

SEQ ID NO: 304070 - DNA, 20 bp, Artificial
  CRISPR gRNA sequence
atcttaaggtgggccgggcg

SEQ ID NO: 304071 - DNA, 20 bp, Artificial
  CRISPR gRNA sequence
ttaaggtgggccgggcgcag

SEQ ID NO: 304072 - DNA, 20 bp, Artificial
  CRISPR gRNA sequence
ctcatgcctgtctgtaatcc

SEQ ID NO: 304073 - DNA, 20 bp, Artificial
  CRISPR gRNA sequence
tgtctgtaatcccagcactt

SEQ ID NO: 304074 - DNA, 20 bp, Artificial
  CRISPR gRNA sequence
gtctgtaatcccagcacttt

SEQ ID NO: 304075 - DNA, 20 bp, Artificial
  CRISPR gRNA sequence
ctgtaatcccagcactttgg

SEQ ID NO: 304076 - DNA, 20 bp, Artificial
  CRISPR gRNA sequence
tgtaatcccagcactttggg

SEQ ID NO: 304077 - DNA, 20 bp, Artificial
  CRISPR gRNA sequence
tcccagcactttgggaggtc

SEQ ID NO: 304078 - DNA, 20 bp, Artificial
  CRISPR gRNA sequence
cccagcactttgggaggtcg

SEQ ID NO: 304079 - DNA, 20 bp, Artificial
  CRISPR gRNA sequence
agcactttgggaggtcgagg

SEQ ID NO: 304080 - DNA, 20 bp, Artificial
  CRISPR gRNA sequence
gcactttgggaggtcgaggc

SEQ ID NO: 304081 - DNA, 20 bp, Artificial
  CRISPR gRNA sequence
ctttgggaggtcgaggcggg

SEQ ID NO: 304082 - DNA, 20 bp, Artificial
  CRISPR gRNA sequence
tcgaggcgggcagatcacct

SEQ ID NO: 304083 - DNA, 20 bp, Artificial
  CRISPR gRNA sequence
cgaggcgggcagatcacctg

SEQ ID NO: 304084 - DNA, 20 bp, Artificial
  CRISPR gRNA sequence
gcgggcagatcacctgaggt

SEQ ID NO: 304085 - DNA, 20 bp, Artificial
  CRISPR gRNA sequence
cgggcagatcacctgaggtc

SEQ ID NO: 304086 - DNA, 20 bp, Artificial
  CRISPR gRNA sequence
ggcagatcacctgaggtcag

SEQ ID NO: 304087 - DNA, 20 bp, Artificial
  CRISPR gRNA sequence
tcacctgaggtcaggagttc

SEQ ID NO: 304088 - DNA, 20 bp, Artificial
  CRISPR gRNA sequence
tgaggtcaggagttcgagac

SEQ ID NO: 304089 - DNA, 20 bp, Artificial
  CRISPR gRNA sequence
tcaggagttcgagactagca

SEQ ID NO: 304090 - DNA, 20 bp, Artificial
  CRISPR gRNA sequence
cgagactagcatggccaaca

SEQ ID NO: 304091 - DNA, 20 bp, Artificial
  CRISPR gRNA sequence
ttgtgtatttttgtattttg

SEQ ID NO: 304092 - DNA, 20 bp, Artificial
  CRISPR gRNA sequence
tgtatttttgtattttgtgg

SEQ ID NO: 304093 - DNA, 20 bp, Artificial
  CRISPR gRNA sequence
atttttgtattttgtggtgg

SEQ ID NO: 304094 - DNA, 20 bp, Artificial
  CRISPR gRNA sequence
tttttgtattttgtggtggt

SEQ ID NO: 304095 - DNA, 20 bp, Artificial
  CRISPR gRNA sequence
tgtggtggtaggtgtaatcc

SEQ ID NO: 304096 - DNA, 20 bp, Artificial
  CRISPR gRNA sequence
taggtgtaatcccagctact

SEQ ID NO: 304097 - DNA, 20 bp, Artificial
  CRISPR gRNA sequence
aggtgtaatcccagctactt

SEQ ID NO: 304098 - DNA, 20 bp, Artificial
  CRISPR gRNA sequence
gtgtaatcccagctacttgg

SEQ ID NO: 304099 - DNA, 20 bp, Artificial
  CRISPR gRNA sequence
tgtaatcccagctacttggg

SEQ ID NO: 304100 - DNA, 20 bp, Artificial
  CRISPR gRNA sequence
tcccagctacttgggaggct

SEQ ID NO: 304101 - DNA, 20 bp, Artificial
  CRISPR gRNA sequence
cccagctacttgggaggctg

SEQ ID NO: 304102 - DNA, 20 bp, Artificial
  CRISPR gRNA sequence
gctacttgggaggctgaggc

SEQ ID NO: 304103 - DNA, 20 bp, Artificial
  CRISPR gRNA sequence
tacttgggaggctgaggcaa

SEQ ID NO: 304104 - DNA, 20 bp, Artificial
  CRISPR gRNA sequence
gcaagagaatcacttgaacc

SEQ ID NO: 304105 - DNA, 20 bp, Artificial
  CRISPR gRNA sequence
caagagaatcacttgaacct

SEQ ID NO: 304106 - DNA, 20 bp, Artificial
  CRISPR gRNA sequence
agagaatcacttgaacctgg

SEQ ID NO: 304107 - DNA, 20 bp, Artificial
  CRISPR gRNA sequence
gagaatcacttgaacctggg

SEQ ID NO: 304108 - DNA, 20 bp, Artificial
  CRISPR gRNA sequence
aatcacttgaacctgggagg

SEQ ID NO: 304109 - DNA, 20 bp, Artificial
  CRISPR gRNA sequence
atcacttgaacctgggaggc

SEQ ID NO: 304110 - DNA, 20 bp, Artificial
  CRISPR gRNA sequence
tcacttgaacctgggaggcg

SEQ ID NO: 304111 - DNA, 20 bp, Artificial
  CRISPR gRNA sequence
cacttgaacctgggaggcgg

SEQ ID NO: 304112 - DNA, 20 bp, Artificial
  CRISPR gRNA sequence
tgggaggcgggggttgccgt

SEQ ID NO: 304113 - DNA, 20 bp, Artificial
  CRISPR gRNA sequence
ggcgggggttgccgtgagcc

SEQ ID NO: 304114 - DNA, 20 bp, Artificial
  CRISPR gRNA sequence
aagatcatgccattgcactt

SEQ ID NO: 304115 - DNA, 20 bp, Artificial
  CRISPR gRNA sequence
catgccattgcactttagcc

SEQ ID NO: 304116 - DNA, 20 bp, Artificial
  CRISPR gRNA sequence
atgccattgcactttagcct

SEQ ID NO: 304117 - DNA, 20 bp, Artificial
  CRISPR gRNA sequence
ttgcactttagcctgggcaa

SEQ ID NO: 304118 - DNA, 20 bp, Artificial
  CRISPR gRNA sequence
gcactttagcctgggcaaca

SEQ ID NO: 304119 - DNA, 20 bp, Artificial
  CRISPR gRNA sequence
tttagcctgggcaacagagt

SEQ ID NO: 304120 - DNA, 20 bp, Artificial
  CRISPR gRNA sequence
aaaaaaaaaaaaaaatctta

SEQ ID NO: 304121 - DNA, 20 bp, Artificial
  CRISPR gRNA sequence
aaaaaaaaaatcttaaagtg

SEQ ID NO: 304122 - DNA, 20 bp, Artificial
  CRISPR gRNA sequence
aaatattccaactaccactc

SEQ ID NO: 304123 - DNA, 20 bp, Artificial
  CRISPR gRNA sequence
aatattccaactaccactcc

SEQ ID NO: 304124 - DNA, 20 bp, Artificial
  CRISPR gRNA sequence
tccaggtacatgaaattaac

SEQ ID NO: 304125 - DNA, 20 bp, Artificial
  CRISPR gRNA sequence
caggtacatgaaattaacta

SEQ ID NO: 304126 - DNA, 20 bp, Artificial
  CRISPR gRNA sequence
aggtacatgaaattaactag

SEQ ID NO: 304127 - DNA, 20 bp, Artificial
  CRISPR gRNA sequence
attaactagaggtgttgttc

SEQ ID NO: 304128 - DNA, 20 bp, Artificial
  CRISPR gRNA sequence
taactagaggtgttgttcaa

SEQ ID NO: 304129 - DNA, 20 bp, Artificial
  CRISPR gRNA sequence
aggtgttgttcaagagaaat

SEQ ID NO: 304130 - DNA, 20 bp, Artificial
  CRISPR gRNA sequence
gttgttcaagagaaatgaga

SEQ ID NO: 304131 - DNA, 20 bp, Artificial
  CRISPR gRNA sequence
caagagaaatgagaaagccc

SEQ ID NO: 304132 - DNA, 20 bp, Artificial
  CRISPR gRNA sequence
aagagaaatgagaaagccct

SEQ ID NO: 304133 - DNA, 20 bp, Artificial
  CRISPR gRNA sequence
aatgagaaagccctaggacc

SEQ ID NO: 304134 - DNA, 20 bp, Artificial
  CRISPR gRNA sequence
tgagaaagccctaggaccca

SEQ ID NO: 304135 - DNA, 20 bp, Artificial
  CRISPR gRNA sequence
cctaggacccagagaaccct

SEQ ID NO: 304136 - DNA, 20 bp, Artificial
  CRISPR gRNA sequence
ccagagaaccctcagacaaa

SEQ ID NO: 304137 - DNA, 20 bp, Artificial
  CRISPR gRNA sequence
agagaaccctcagacaaaaa

SEQ ID NO: 304138 - DNA, 20 bp, Artificial
  CRISPR gRNA sequence
agaaccctcagacaaaaaga

SEQ ID NO: 304139 - DNA, 20 bp, Artificial
  CRISPR gRNA sequence
accctcagacaaaaagagag

SEQ ID NO: 304140 - DNA, 20 bp, Artificial
  CRISPR gRNA sequence
gcagctaccaaaactcaaac

SEQ ID NO: 304141 - DNA, 20 bp, Artificial
  CRISPR gRNA sequence
ctaccaaaactcaaactgga

SEQ ID NO: 304142 - DNA, 20 bp, Artificial
  CRISPR gRNA sequence
aaagatacttcctcctgatg

SEQ ID NO: 304143 - DNA, 20 bp, Artificial
  CRISPR gRNA sequence
aagatacttcctcctgatgt

SEQ ID NO: 304144 - DNA, 20 bp, Artificial
  CRISPR gRNA sequence
gatacttcctcctgatgtgg

SEQ ID NO: 304145 - DNA, 20 bp, Artificial
  CRISPR gRNA sequence
tgatttttcaaaaacctctc

SEQ ID NO: 304146 - DNA, 20 bp, Artificial
  CRISPR gRNA sequence
ttcaaaaacctctctggctc

SEQ ID NO: 304147 - DNA, 20 bp, Artificial
  CRISPR gRNA sequence
cctctctggctccagcctaa

SEQ ID NO: 304148 - DNA, 20 bp, Artificial
  CRISPR gRNA sequence
gctccagcctaaaagtgtga

SEQ ID NO: 304149 - DNA, 20 bp, Artificial
  CRISPR gRNA sequence
tccagcctaaaagtgtgatg

SEQ ID NO: 304150 - DNA, 20 bp, Artificial
  CRISPR gRNA sequence
ccagcctaaaagtgtgatgg

SEQ ID NO: 304151 - DNA, 20 bp, Artificial
  CRISPR gRNA sequence
taaaagtgtgatggaggtgc

SEQ ID NO: 304152 - DNA, 20 bp, Artificial
  CRISPR gRNA sequence
aaaagtgtgatggaggtgcc

SEQ ID NO: 304153 - DNA, 20 bp, Artificial
  CRISPR gRNA sequence
gtgtgatggaggtgccagga

SEQ ID NO: 304154 - DNA, 20 bp, Artificial
  CRISPR gRNA sequence
tgatggaggtgccaggacag

SEQ ID NO: 304155 - DNA, 20 bp, Artificial
  CRISPR gRNA sequence
ggtgccaggacagtggcaaa

SEQ ID NO: 304156 - DNA, 20 bp, Artificial
  CRISPR gRNA sequence
tgccaggacagtggcaaaca

SEQ ID NO: 304157 - DNA, 20 bp, Artificial
  CRISPR gRNA sequence
cagtggcaaacagagcttga

SEQ ID NO: 304158 - DNA, 20 bp, Artificial
  CRISPR gRNA sequence
ggcaaacagagcttgaaagt

SEQ ID NO: 304159 - DNA, 20 bp, Artificial
  CRISPR gRNA sequence
aaacagagcttgaaagttag

SEQ ID NO: 304160 - DNA, 20 bp, Artificial
  CRISPR gRNA sequence
gaaagttagaagtgcctctg

SEQ ID NO: 304161 - DNA, 20 bp, Artificial
  CRISPR gRNA sequence
aaagttagaagtgcctctgc

SEQ ID NO: 304162 - DNA, 20 bp, Artificial
  CRISPR gRNA sequence
gttagaagtgcctctgcagg

SEQ ID NO: 304163 - DNA, 20 bp, Artificial
  CRISPR gRNA sequence
agtgcctctgcaggtggcac

SEQ ID NO: 304164 - DNA, 20 bp, Artificial
  CRISPR gRNA sequence
gtgcctctgcaggtggcact

SEQ ID NO: 304165 - DNA, 20 bp, Artificial
  CRISPR gRNA sequence
tcctttcgctttgtaaatac

SEQ ID NO: 304166 - DNA, 20 bp, Artificial
  CRISPR gRNA sequence
cctttcgctttgtaaataca

SEQ ID NO: 304167 - DNA, 20 bp, Artificial
  CRISPR gRNA sequence
aaactgtaacctaattctgc

SEQ ID NO: 304168 - DNA, 20 bp, Artificial
  CRISPR gRNA sequence
aactgtaacctaattctgca

SEQ ID NO: 304169 - DNA, 20 bp, Artificial
  CRISPR gRNA sequence
aacctaattctgcaaggcca

SEQ ID NO: 304170 - DNA, 20 bp, Artificial
  CRISPR gRNA sequence
acctaattctgcaaggccac

SEQ ID NO: 304171 - DNA, 20 bp, Artificial
  CRISPR gRNA sequence
aaggccacaggtgcccgttt

SEQ ID NO: 304172 - DNA, 20 bp, Artificial
  CRISPR gRNA sequence
tcccatccaattttatcctc

SEQ ID NO: 304173 - DNA, 20 bp, Artificial
  CRISPR gRNA sequence
ccatccaattttatcctcaa

SEQ ID NO: 304174 - DNA, 20 bp, Artificial
  CRISPR gRNA sequence
tccaattttatcctcaagag

SEQ ID NO: 304175 - DNA, 20 bp, Artificial
  CRISPR gRNA sequence
ccaattttatcctcaagagc

SEQ ID NO: 304176 - DNA, 20 bp, Artificial
  CRISPR gRNA sequence
caattttatcctcaagagca

SEQ ID NO: 304177 - DNA, 20 bp, Artificial
  CRISPR gRNA sequence
aattttatcctcaagagcag

SEQ ID NO: 304178 - DNA, 20 bp, Artificial
  CRISPR gRNA sequence
tttatcctcaagagcagggg

SEQ ID NO: 304179 - DNA, 20 bp, Artificial
  CRISPR gRNA sequence
actgtgtcaaatttccatga

SEQ ID NO: 304180 - DNA, 20 bp, Artificial
  CRISPR gRNA sequence
tgtgtcaaatttccatgaca

SEQ ID NO: 304181 - DNA, 20 bp, Artificial
  CRISPR gRNA sequence
gtgtcaaatttccatgacag

SEQ ID NO: 304182 - DNA, 20 bp, Artificial
  CRISPR gRNA sequence
atgacagaggacacaaaata

SEQ ID NO: 304183 - DNA, 20 bp, Artificial
  CRISPR gRNA sequence
tgacagaggacacaaaatat

SEQ ID NO: 304184 - DNA, 20 bp, Artificial
  CRISPR gRNA sequence
gacagaggacacaaaatata

SEQ ID NO: 304185 - DNA, 20 bp, Artificial
  CRISPR gRNA sequence
cagaggacacaaaatatagg

SEQ ID NO: 304186 - DNA, 20 bp, Artificial
  CRISPR gRNA sequence
agaggacacaaaatataggg

SEQ ID NO: 304187 - DNA, 20 bp, Artificial
  CRISPR gRNA sequence
gaggacacaaaatataggga

SEQ ID NO: 304188 - DNA, 20 bp, Artificial
  CRISPR gRNA sequence
cacaaaatatagggagggaa

SEQ ID NO: 304189 - DNA, 20 bp, Artificial
  CRISPR gRNA sequence
atagggagggaaaagttaaa

SEQ ID NO: 304190 - DNA, 20 bp, Artificial
  CRISPR gRNA sequence
atgccatgaaatgaattatt

SEQ ID NO: 304191 - DNA, 20 bp, Artificial
  CRISPR gRNA sequence
attattcagctctacatttt

SEQ ID NO: 304192 - DNA, 20 bp, Artificial
  CRISPR gRNA sequence
ttattcagctctacattttg

SEQ ID NO: 304193 - DNA, 20 bp, Artificial
  CRISPR gRNA sequence
tattcagctctacattttga

SEQ ID NO: 304194 - DNA, 20 bp, Artificial
  CRISPR gRNA sequence
tcagctctacattttgaggg

SEQ ID NO: 304195 - DNA, 20 bp, Artificial
  CRISPR gRNA sequence
cattttgagggtggattatg

SEQ ID NO: 304196 - DNA, 20 bp, Artificial
  CRISPR gRNA sequence
attttgagggtggattatgt

SEQ ID NO: 304197 - DNA, 20 bp, Artificial
  CRISPR gRNA sequence
ttgcatctcctttctccctt

SEQ ID NO: 304198 - DNA, 20 bp, Artificial
  CRISPR gRNA sequence
catctcctttctccctttgg

SEQ ID NO: 304199 - DNA, 20 bp, Artificial
  CRISPR gRNA sequence
tcctttctccctttggaagc

SEQ ID NO: 304200 - DNA, 20 bp, Artificial
  CRISPR gRNA sequence
ccctttggaagccggccctg

SEQ ID NO: 304201 - DNA, 20 bp, Artificial
  CRISPR gRNA sequence
ttggaagccggccctgtggc

SEQ ID NO: 304202 - DNA, 20 bp, Artificial
  CRISPR gRNA sequence
tggaagccggccctgtggct

SEQ ID NO: 304203 - DNA, 20 bp, Artificial
  CRISPR gRNA sequence
gtggctaggtcactgttcac

SEQ ID NO: 304204 - DNA, 20 bp, Artificial
  CRISPR gRNA sequence
taggtcactgttcaccagcc

SEQ ID NO: 304205 - DNA, 20 bp, Artificial
  CRISPR gRNA sequence
tcactgttcaccagcccagt

SEQ ID NO: 304206 - DNA, 20 bp, Artificial
  CRISPR gRNA sequence
ctgttcaccagcccagtaag

SEQ ID NO: 304207 - DNA, 20 bp, Artificial
  CRISPR gRNA sequence
gttcaccagcccagtaagca

SEQ ID NO: 304208 - DNA, 20 bp, Artificial
  CRISPR gRNA sequence
ttcaccagcccagtaagcag

SEQ ID NO: 304209 - DNA, 20 bp, Artificial
  CRISPR gRNA sequence
agtaagcagaggtgtgccct

SEQ ID NO: 304210 - DNA, 20 bp, Artificial
  CRISPR gRNA sequence
aagcagaggtgtgccctgag

SEQ ID NO: 304211 - DNA, 20 bp, Artificial
  CRISPR gRNA sequence
agaggtgtgccctgagaaga

SEQ ID NO: 304212 - DNA, 20 bp, Artificial
  CRISPR gRNA sequence
ctgagaagaaagaattcaaa

SEQ ID NO: 304213 - DNA, 20 bp, Artificial
  CRISPR gRNA sequence
tttcatcgtgtgtgaattac

SEQ ID NO: 304214 - DNA, 20 bp, Artificial
  CRISPR gRNA sequence
tattttctgatctgatgtca

SEQ ID NO: 304215 - DNA, 20 bp, Artificial
  CRISPR gRNA sequence
attttctgatctgatgtcat

SEQ ID NO: 304216 - DNA, 20 bp, Artificial
  CRISPR gRNA sequence
aaattgtactgccaaaaata

SEQ ID NO: 304217 - DNA, 20 bp, Artificial
  CRISPR gRNA sequence
tcaccaccataaaacttaaa

SEQ ID NO: 304218 - DNA, 20 bp, Artificial
  CRISPR gRNA sequence
aacttaaacggttaccattt

SEQ ID NO: 304219 - DNA, 20 bp, Artificial
  CRISPR gRNA sequence
acttaaacggttaccatttg

SEQ ID NO: 304220 - DNA, 20 bp, Artificial
  CRISPR gRNA sequence
gaggttgttgctttcaatat

SEQ ID NO: 304221 - DNA, 20 bp, Artificial
  CRISPR gRNA sequence
aatattggtaactcttttct

SEQ ID NO: 304222 - DNA, 20 bp, Artificial
  CRISPR gRNA sequence
atattggtaactcttttctc

SEQ ID NO: 304223 - DNA, 20 bp, Artificial
  CRISPR gRNA sequence
attggtaactcttttctcag

SEQ ID NO: 304224 - DNA, 20 bp, Artificial
  CRISPR gRNA sequence
taactcttttctcaggagct

SEQ ID NO: 304225 - DNA, 20 bp, Artificial
  CRISPR gRNA sequence
tcaggagctaagaaacttct

SEQ ID NO: 304226 - DNA, 20 bp, Artificial
  CRISPR gRNA sequence
ggagctaagaaacttctaag

SEQ ID NO: 304227 - DNA, 20 bp, Artificial
  CRISPR gRNA sequence
aaacttctaagaagtgtcaa

SEQ ID NO: 304228 - DNA, 20 bp, Artificial
  CRISPR gRNA sequence
agaagtgtcaatggcaaatc

SEQ ID NO: 304229 - DNA, 20 bp, Artificial
  CRISPR gRNA sequence
gaagtgtcaatggcaaatca

SEQ ID NO: 304230 - DNA, 20 bp, Artificial
  CRISPR gRNA sequence
aagtgtcaatggcaaatcaa

SEQ ID NO: 304231 - DNA, 20 bp, Artificial
  CRISPR gRNA sequence
caatggcaaatcaagggcaa

SEQ ID NO: 304232 - DNA, 20 bp, Artificial
  CRISPR gRNA sequence
gcaaaagtgacacctgaact

SEQ ID NO: 304233 - DNA, 20 bp, Artificial
  CRISPR gRNA sequence
acacctgaactcagttttca

SEQ ID NO: 304234 - DNA, 20 bp, Artificial
  CRISPR gRNA sequence
acctgaactcagttttcata

SEQ ID NO: 304235 - DNA, 20 bp, Artificial
  CRISPR gRNA sequence
tcagttttcatagagtgtct

SEQ ID NO: 304236 - DNA, 20 bp, Artificial
  CRISPR gRNA sequence
cggctttactttctcacttt

SEQ ID NO: 304237 - DNA, 20 bp, Artificial
  CRISPR gRNA sequence
actttctcactttcagtgtg

SEQ ID NO: 304238 - DNA, 20 bp, Artificial
  CRISPR gRNA sequence
tttctcactttcagtgtgcg

SEQ ID NO: 304239 - DNA, 20 bp, Artificial
  CRISPR gRNA sequence
tcactttcagtgtgcggagt

SEQ ID NO: 304240 - DNA, 20 bp, Artificial
  CRISPR gRNA sequence
gtgtgcggagtcagaaaatt

SEQ ID NO: 304241 - DNA, 20 bp, Artificial
  CRISPR gRNA sequence
tgcggagtcagaaaatttgg

SEQ ID NO: 304242 - DNA, 20 bp, Artificial
  CRISPR gRNA sequence
gcggagtcagaaaatttggt

SEQ ID NO: 304243 - DNA, 20 bp, Artificial
  CRISPR gRNA sequence
tcagaaaatttggtgggaaa

SEQ ID NO: 304244 - DNA, 20 bp, Artificial
  CRISPR gRNA sequence
tttggtgggaaatggtgttc

SEQ ID NO: 304245 - DNA, 20 bp, Artificial
  CRISPR gRNA sequence
tgggaaatggtgttccagtt

SEQ ID NO: 304246 - DNA, 20 bp, Artificial
  CRISPR gRNA sequence
tgttccagtttagtgttttc

SEQ ID NO: 304247 - DNA, 20 bp, Artificial
  CRISPR gRNA sequence
gttttctggaaatgtgtttc

SEQ ID NO: 304248 - DNA, 20 bp, Artificial
  CRISPR gRNA sequence
ttttctggaaatgtgtttcc

SEQ ID NO: 304249 - DNA, 20 bp, Artificial
  CRISPR gRNA sequence
tttctggaaatgtgtttcca

SEQ ID NO: 304250 - DNA, 20 bp, Artificial
  CRISPR gRNA sequence
catttttcttccttctctcc

SEQ ID NO: 304251 - DNA, 20 bp, Artificial
  CRISPR gRNA sequence
ttccttctctcccagatctt

SEQ ID NO: 304252 - DNA, 20 bp, Artificial
  CRISPR gRNA sequence
ccttctctcccagatcttga

SEQ ID NO: 304253 - DNA, 20 bp, Artificial
  CRISPR gRNA sequence
ctctcccagatcttgagagc

SEQ ID NO: 304254 - DNA, 20 bp, Artificial
  CRISPR gRNA sequence
tctcccagatcttgagagct

SEQ ID NO: 304255 - DNA, 20 bp, Artificial
  CRISPR gRNA sequence
ccagatcttgagagctgggc

SEQ ID NO: 304256 - DNA, 20 bp, Artificial
  CRISPR gRNA sequence
gctgggctggtcactttgat

SEQ ID NO: 304257 - DNA, 20 bp, Artificial
  CRISPR gRNA sequence
gggctggtcactttgatgag

SEQ ID NO: 304258 - DNA, 20 bp, Artificial
  CRISPR gRNA sequence
ggctggtcactttgatgaga

SEQ ID NO: 304259 - DNA, 20 bp, Artificial
  CRISPR gRNA sequence
gctggtcactttgatgagaa

SEQ ID NO: 304260 - DNA, 20 bp, Artificial
  CRISPR gRNA sequence
tcactttgatgagaagggct

SEQ ID NO: 304261 - DNA, 20 bp, Artificial
  CRISPR gRNA sequence
cactttgatgagaagggctt

SEQ ID NO: 304262 - DNA, 20 bp, Artificial
  CRISPR gRNA sequence
gatgagaagggcttgggccc

SEQ ID NO: 304263 - DNA, 20 bp, Artificial
  CRISPR gRNA sequence
agggcttgggcccaagctct

SEQ ID NO: 304264 - DNA, 20 bp, Artificial
  CRISPR gRNA sequence
gggcttgggcccaagctctt

SEQ ID NO: 304265 - DNA, 20 bp, Artificial
  CRISPR gRNA sequence
cccaagctcttgggtcaact

SEQ ID NO: 304266 - DNA, 20 bp, Artificial
  CRISPR gRNA sequence
ccaagctcttgggtcaactg

SEQ ID NO: 304267 - DNA, 20 bp, Artificial
  CRISPR gRNA sequence
tcttgggtcaactgaggtgt

SEQ ID NO: 304268 - DNA, 20 bp, Artificial
  CRISPR gRNA sequence
gtcaactgaggtgtcagctg

SEQ ID NO: 304269 - DNA, 20 bp, Artificial
  CRISPR gRNA sequence
tcaactgaggtgtcagctgc

SEQ ID NO: 304270 - DNA, 20 bp, Artificial
  CRISPR gRNA sequence
gaggtgtcagctgcaggtga

SEQ ID NO: 304271 - DNA, 20 bp, Artificial
  CRISPR gRNA sequence
aggtgtcagctgcaggtgat

SEQ ID NO: 304272 - DNA, 20 bp, Artificial
  CRISPR gRNA sequence
ggtgtcagctgcaggtgatg

SEQ ID NO: 304273 - DNA, 20 bp, Artificial
  CRISPR gRNA sequence
tgtcagctgcaggtgatggg

SEQ ID NO: 304274 - DNA, 20 bp, Artificial
  CRISPR gRNA sequence
gtcagctgcaggtgatgggg

SEQ ID NO: 304275 - DNA, 20 bp, Artificial
  CRISPR gRNA sequence
cagctgcaggtgatggggag

SEQ ID NO: 304276 - DNA, 20 bp, Artificial
  CRISPR gRNA sequence
agctgcaggtgatggggagg

SEQ ID NO: 304277 - DNA, 20 bp, Artificial
  CRISPR gRNA sequence
aggtgatggggaggaggcac

SEQ ID NO: 304278 - DNA, 20 bp, Artificial
  CRISPR gRNA sequence
gaggaggcactggatgaaca

SEQ ID NO: 304279 - DNA, 20 bp, Artificial
  CRISPR gRNA sequence
ggcactggatgaacacggat

SEQ ID NO: 304280 - DNA, 20 bp, Artificial
  CRISPR gRNA sequence
gcactggatgaacacggatg

SEQ ID NO: 304281 - DNA, 20 bp, Artificial
  CRISPR gRNA sequence
ctggatgaacacggatgagg

SEQ ID NO: 304282 - DNA, 20 bp, Artificial
  CRISPR gRNA sequence
gatgaacacggatgaggcag

SEQ ID NO: 304283 - DNA, 20 bp, Artificial
  CRISPR gRNA sequence
agaagctatattatccacca

SEQ ID NO: 304284 - DNA, 20 bp, Artificial
  CRISPR gRNA sequence
tattatccaccaaagctgtt

SEQ ID NO: 304285 - DNA, 20 bp, Artificial
  CRISPR gRNA sequence
attatccaccaaagctgttc

SEQ ID NO: 304286 - DNA, 20 bp, Artificial
  CRISPR gRNA sequence
ccaaagctgttcaggcccca

SEQ ID NO: 304287 - DNA, 20 bp, Artificial
  CRISPR gRNA sequence
aagctgttcaggccccatgg

SEQ ID NO: 304288 - DNA, 20 bp, Artificial
  CRISPR gRNA sequence
ctgttcaggccccatggaag

SEQ ID NO: 304289 - DNA, 20 bp, Artificial
  CRISPR gRNA sequence
gaagtcttaccacttattca

SEQ ID NO: 304290 - DNA, 20 bp, Artificial
  CRISPR gRNA sequence
acttattcatggtttaccac

SEQ ID NO: 304291 - DNA, 20 bp, Artificial
  CRISPR gRNA sequence
ttattcatggtttaccacaa

SEQ ID NO: 304292 - DNA, 20 bp, Artificial
  CRISPR gRNA sequence
tcatggtttaccacaagagt

SEQ ID NO: 304293 - DNA, 20 bp, Artificial
  CRISPR gRNA sequence
catggtttaccacaagagtt

SEQ ID NO: 304294 - DNA, 20 bp, Artificial
  CRISPR gRNA sequence
tggtttaccacaagagttag

SEQ ID NO: 304295 - DNA, 20 bp, Artificial
  CRISPR gRNA sequence
tttaccacaagagttaggag

SEQ ID NO: 304296 - DNA, 20 bp, Artificial
  CRISPR gRNA sequence
taccacaagagttaggagaa

SEQ ID NO: 304297 - DNA, 20 bp, Artificial
  CRISPR gRNA sequence
caagagttaggagaagagtc

SEQ ID NO: 304298 - DNA, 20 bp, Artificial
  CRISPR gRNA sequence
gaatgctaaatctacattgc

SEQ ID NO: 304299 - DNA, 20 bp, Artificial
  CRISPR gRNA sequence
aatgctaaatctacattgct

SEQ ID NO: 304300 - DNA, 20 bp, Artificial
  CRISPR gRNA sequence
acattgctgggtgtgaatcc

SEQ ID NO: 304301 - DNA, 20 bp, Artificial
  CRISPR gRNA sequence
tgaatccaagctctgccact

SEQ ID NO: 304302 - DNA, 20 bp, Artificial
  CRISPR gRNA sequence
atccaagctctgccacttag

SEQ ID NO: 304303 - DNA, 20 bp, Artificial
  CRISPR gRNA sequence
cttagtagctctgtcgatct

SEQ ID NO: 304304 - DNA, 20 bp, Artificial
  CRISPR gRNA sequence
ttagtagctctgtcgatctt

SEQ ID NO: 304305 - DNA, 20 bp, Artificial
  CRISPR gRNA sequence
ggtaaattacttcatctctc

SEQ ID NO: 304306 - DNA, 20 bp, Artificial
  CRISPR gRNA sequence
gtaaattacttcatctctct

SEQ ID NO: 304307 - DNA, 20 bp, Artificial
  CRISPR gRNA sequence
tacttcatctctctgggctt

SEQ ID NO: 304308 - DNA, 20 bp, Artificial
  CRISPR gRNA sequence
ttagtgtccacatcttaaaa

SEQ ID NO: 304309 - DNA, 20 bp, Artificial
  CRISPR gRNA sequence
tagtgtccacatcttaaaat

SEQ ID NO: 304310 - DNA, 20 bp, Artificial
  CRISPR gRNA sequence
ttaaaatgggaaataacaac

SEQ ID NO: 304311 - DNA, 20 bp, Artificial
  CRISPR gRNA sequence
ggaaataacaacaagaccta

SEQ ID NO: 304312 - DNA, 20 bp, Artificial
  CRISPR gRNA sequence
aataacaacaagacctaaag

SEQ ID NO: 304313 - DNA, 20 bp, Artificial
  CRISPR gRNA sequence
taacaacaagacctaaagca

SEQ ID NO: 304314 - DNA, 20 bp, Artificial
  CRISPR gRNA sequence
acaacaagacctaaagcaga

SEQ ID NO: 304315 - DNA, 20 bp, Artificial
  CRISPR gRNA sequence
ctaaagcagagagttattgt

SEQ ID NO: 304316 - DNA, 20 bp, Artificial
  CRISPR gRNA sequence
taaagcagagagttattgtg

SEQ ID NO: 304317 - DNA, 20 bp, Artificial
  CRISPR gRNA sequence
agttattgtgaggctcaaat

SEQ ID NO: 304318 - DNA, 20 bp, Artificial
  CRISPR gRNA sequence
tcaaatgagttaatatttat

SEQ ID NO: 304319 - DNA, 20 bp, Artificial
  CRISPR gRNA sequence
caaatgagttaatatttatg

SEQ ID NO: 304320 - DNA, 20 bp, Artificial
  CRISPR gRNA sequence
gttaatatttatgaggtact

SEQ ID NO: 304321 - DNA, 20 bp, Artificial
  CRISPR gRNA sequence
tatttatgaggtacttagaa

SEQ ID NO: 304322 - DNA, 20 bp, Artificial
  CRISPR gRNA sequence
tgaggtacttagaacagtac

SEQ ID NO: 304323 - DNA, 20 bp, Artificial
  CRISPR gRNA sequence
gaggtacttagaacagtacc

SEQ ID NO: 304324 - DNA, 20 bp, Artificial
  CRISPR gRNA sequence
ttagaacagtaccaggcaca

SEQ ID NO: 304325 - DNA, 20 bp, Artificial
  CRISPR gRNA sequence
aacagtaccaggcacaaagt

SEQ ID NO: 304326 - DNA, 20 bp, Artificial
  CRISPR gRNA sequence
acagtaccaggcacaaagta

SEQ ID NO: 304327 - DNA, 20 bp, Artificial
  CRISPR gRNA sequence
cagtaccaggcacaaagtaa

SEQ ID NO: 304328 - DNA, 20 bp, Artificial
  CRISPR gRNA sequence
atatactgtcatgtattgca

SEQ ID NO: 304329 - DNA, 20 bp, Artificial
  CRISPR gRNA sequence
tgtattgcacagccacattt

SEQ ID NO: 304330 - DNA, 20 bp, Artificial
  CRISPR gRNA sequence
cacatttcagtcatatacaa

SEQ ID NO: 304331 - DNA, 20 bp, Artificial
  CRISPR gRNA sequence
atttcagtcatatacaatgg

SEQ ID NO: 304332 - DNA, 20 bp, Artificial
  CRISPR gRNA sequence
atatacaatggtggtcccat

SEQ ID NO: 304333 - DNA, 20 bp, Artificial
  CRISPR gRNA sequence
tactgtatcttttctatgct

SEQ ID NO: 304334 - DNA, 20 bp, Artificial
  CRISPR gRNA sequence
tttctatgcttagatatgtt

SEQ ID NO: 304335 - DNA, 20 bp, Artificial
  CRISPR gRNA sequence
ccattgtgttacaacaccta

SEQ ID NO: 304336 - DNA, 20 bp, Artificial
  CRISPR gRNA sequence
gttacaacacctacagtatt

SEQ ID NO: 304337 - DNA, 20 bp, Artificial
  CRISPR gRNA sequence
aacacctacagtattcagca

SEQ ID NO: 304338 - DNA, 20 bp, Artificial
  CRISPR gRNA sequence
cagcacagtaacatgctgtg

SEQ ID NO: 304339 - DNA, 20 bp, Artificial
  CRISPR gRNA sequence
agcacagtaacatgctgtgc

SEQ ID NO: 304340 - DNA, 20 bp, Artificial
  CRISPR gRNA sequence
taacatgctgtgcaggcttg

SEQ ID NO: 304341 - DNA, 20 bp, Artificial
  CRISPR gRNA sequence
tgctgtgcaggcttgtagcc

SEQ ID NO: 304342 - DNA, 20 bp, Artificial
  CRISPR gRNA sequence
gctgtgcaggcttgtagcct

SEQ ID NO: 304343 - DNA, 20 bp, Artificial
  CRISPR gRNA sequence
tgtgcaggcttgtagcctag

SEQ ID NO: 304344 - DNA, 20 bp, Artificial
  CRISPR gRNA sequence
ggcttgtagcctaggagcaa

SEQ ID NO: 304345 - DNA, 20 bp, Artificial
  CRISPR gRNA sequence
gcttgtagcctaggagcaat

SEQ ID NO: 304346 - DNA, 20 bp, Artificial
  CRISPR gRNA sequence
ctaggagcaataggctgtgc

SEQ ID NO: 304347 - DNA, 20 bp, Artificial
  CRISPR gRNA sequence
taggagcaataggctgtgcc

SEQ ID NO: 304348 - DNA, 20 bp, Artificial
  CRISPR gRNA sequence
gagcaataggctgtgccagg

SEQ ID NO: 304349 - DNA, 20 bp, Artificial
  CRISPR gRNA sequence
taggctgtgccaggtagcct

SEQ ID NO: 304350 - DNA, 20 bp, Artificial
  CRISPR gRNA sequence
tgtgccaggtagcctaagta

SEQ ID NO: 304351 - DNA, 20 bp, Artificial
  CRISPR gRNA sequence
tgccaggtagcctaagtatg

SEQ ID NO: 304352 - DNA, 20 bp, Artificial
  CRISPR gRNA sequence
caggtagcctaagtatggag

SEQ ID NO: 304353 - DNA, 20 bp, Artificial
  CRISPR gRNA sequence
aggtagcctaagtatggagc

SEQ ID NO: 304354 - DNA, 20 bp, Artificial
  CRISPR gRNA sequence
atggagcaggctatgctatc

SEQ ID NO: 304355 - DNA, 20 bp, Artificial
  CRISPR gRNA sequence
tatgctatctagttttgtgt

SEQ ID NO: 304356 - DNA, 20 bp, Artificial
  CRISPR gRNA sequence
atgctatctagttttgtgta

SEQ ID NO: 304357 - DNA, 20 bp, Artificial
  CRISPR gRNA sequence
tcgcctaataatgtgtttct

SEQ ID NO: 304358 - DNA, 20 bp, Artificial
  CRISPR gRNA sequence
atttatcaaataaataaaat

SEQ ID NO: 304359 - DNA, 20 bp, Artificial
  CRISPR gRNA sequence
ataaaataagtcatgtgcga

SEQ ID NO: 304360 - DNA, 20 bp, Artificial
  CRISPR gRNA sequence
atggctcatgcatataattc

SEQ ID NO: 304361 - DNA, 20 bp, Artificial
  CRISPR gRNA sequence
atgcatataattctagcact

SEQ ID NO: 304362 - DNA, 20 bp, Artificial
  CRISPR gRNA sequence
tgcatataattctagcactt

SEQ ID NO: 304363 - DNA, 20 bp, Artificial
  CRISPR gRNA sequence
gcatataattctagcacttg

SEQ ID NO: 304364 - DNA, 20 bp, Artificial
  CRISPR gRNA sequence
atataattctagcacttggg

SEQ ID NO: 304365 - DNA, 20 bp, Artificial
  CRISPR gRNA sequence
tataattctagcacttgggg

SEQ ID NO: 304366 - DNA, 20 bp, Artificial
  CRISPR gRNA sequence
ttctagcacttggggaggct

SEQ ID NO: 304367 - DNA, 20 bp, Artificial
  CRISPR gRNA sequence
tctagcacttggggaggctg

SEQ ID NO: 304368 - DNA, 20 bp, Artificial
  CRISPR gRNA sequence
agcacttggggaggctgagg

SEQ ID NO: 304369 - DNA, 20 bp, Artificial
  CRISPR gRNA sequence
gcacttggggaggctgaggt

SEQ ID NO: 304370 - DNA, 20 bp, Artificial
  CRISPR gRNA sequence
acttggggaggctgaggtgg

SEQ ID NO: 304371 - DNA, 20 bp, Artificial
  CRISPR gRNA sequence
ctgaggtgggagaattgctt

SEQ ID NO: 304372 - DNA, 20 bp, Artificial
  CRISPR gRNA sequence
gtgggagaattgcttgagcc

SEQ ID NO: 304373 - DNA, 20 bp, Artificial
  CRISPR gRNA sequence
tgggagaattgcttgagccc

SEQ ID NO: 304374 - DNA, 20 bp, Artificial
  CRISPR gRNA sequence
ttgcttgagcccaggtaatc

SEQ ID NO: 304375 - DNA, 20 bp, Artificial
  CRISPR gRNA sequence
tgcttgagcccaggtaatcg

SEQ ID NO: 304376 - DNA, 20 bp, Artificial
  CRISPR gRNA sequence
agcccaggtaatcgaggcca

SEQ ID NO: 304377 - DNA, 20 bp, Artificial
  CRISPR gRNA sequence
caggtaatcgaggccacagt

SEQ ID NO: 304378 - DNA, 20 bp, Artificial
  CRISPR gRNA sequence
gtgactgtgccactgtactc

SEQ ID NO: 304379 - DNA, 20 bp, Artificial
  CRISPR gRNA sequence
tgtgccactgtactccagcc

SEQ ID NO: 304380 - DNA, 20 bp, Artificial
  CRISPR gRNA sequence
gtgccactgtactccagcct

SEQ ID NO: 304381 - DNA, 20 bp, Artificial
  CRISPR gRNA sequence
ctgtactccagcctgggtga

SEQ ID NO: 304382 - DNA, 20 bp, Artificial
  CRISPR gRNA sequence
gtactccagcctgggtgaca

SEQ ID NO: 304383 - DNA, 20 bp, Artificial
  CRISPR gRNA sequence
tccagcctgggtgacagaga

SEQ ID NO: 304384 - DNA, 20 bp, Artificial
  CRISPR gRNA sequence
aataaataaaataaataaat

SEQ ID NO: 304385 - DNA, 20 bp, Artificial
  CRISPR gRNA sequence
aaataaaataaataaataag

SEQ ID NO: 304386 - DNA, 20 bp, Artificial
  CRISPR gRNA sequence
taaaataaataaataagaag

SEQ ID NO: 304387 - DNA, 20 bp, Artificial
  CRISPR gRNA sequence
aaaataaataaataagaagt

SEQ ID NO: 304388 - DNA, 20 bp, Artificial
  CRISPR gRNA sequence
aaataaataagaagtgggat

SEQ ID NO: 304389 - DNA, 20 bp, Artificial
  CRISPR gRNA sequence
taaataagaagtgggatgag

SEQ ID NO: 304390 - DNA, 20 bp, Artificial
  CRISPR gRNA sequence
aaataagaagtgggatgaga

SEQ ID NO: 304391 - DNA, 20 bp, Artificial
  CRISPR gRNA sequence
aataagaagtgggatgagaa

SEQ ID NO: 304392 - DNA, 20 bp, Artificial
  CRISPR gRNA sequence
ggatgagaagggaatcttac

SEQ ID NO: 304393 - DNA, 20 bp, Artificial
  CRISPR gRNA sequence
tcttactggataatgttctc

SEQ ID NO: 304394 - DNA, 20 bp, Artificial
  CRISPR gRNA sequence
ttactggataatgttctcta

SEQ ID NO: 304395 - DNA, 20 bp, Artificial
  CRISPR gRNA sequence
acacatacctcccacatccc

SEQ ID NO: 304396 - DNA, 20 bp, Artificial
  CRISPR gRNA sequence
cacatacctcccacatcccc

SEQ ID NO: 304397 - DNA, 20 bp, Artificial
  CRISPR gRNA sequence
catacctcccacatccccag

SEQ ID NO: 304398 - DNA, 20 bp, Artificial
  CRISPR gRNA sequence
ctcccacatccccaggagct

SEQ ID NO: 304399 - DNA, 20 bp, Artificial
  CRISPR gRNA sequence
tcccacatccccaggagcta

SEQ ID NO: 304400 - DNA, 20 bp, Artificial
  CRISPR gRNA sequence
cacatccccaggagctaagg

SEQ ID NO: 304401 - DNA, 20 bp, Artificial
  CRISPR gRNA sequence
atccccaggagctaaggtag

SEQ ID NO: 304402 - DNA, 20 bp, Artificial
  CRISPR gRNA sequence
tccccaggagctaaggtagc

SEQ ID NO: 304403 - DNA, 20 bp, Artificial
  CRISPR gRNA sequence
ggagctaaggtagcaggtca

SEQ ID NO: 304404 - DNA, 20 bp, Artificial
  CRISPR gRNA sequence
gagctaaggtagcaggtcat

SEQ ID NO: 304405 - DNA, 20 bp, Artificial
  CRISPR gRNA sequence
aggtagcaggtcatgggccc

SEQ ID NO: 304406 - DNA, 20 bp, Artificial
  CRISPR gRNA sequence
ggtagcaggtcatgggccct

SEQ ID NO: 304407 - DNA, 20 bp, Artificial
  CRISPR gRNA sequence
gtagcaggtcatgggccctg

SEQ ID NO: 304408 - DNA, 20 bp, Artificial
  CRISPR gRNA sequence
tagcaggtcatgggccctgg

SEQ ID NO: 304409 - DNA, 20 bp, Artificial
  CRISPR gRNA sequence
aggtcatgggccctgggggt

SEQ ID NO: 304410 - DNA, 20 bp, Artificial
  CRISPR gRNA sequence
tcatgggccctgggggttgg

SEQ ID NO: 304411 - DNA, 20 bp, Artificial
  CRISPR gRNA sequence
ggaagctgctgttgttacct

SEQ ID NO: 304412 - DNA, 20 bp, Artificial
  CRISPR gRNA sequence
gctgctgttgttacctaagt

SEQ ID NO: 304413 - DNA, 20 bp, Artificial
  CRISPR gRNA sequence
ttgttacctaagtcagtgat

SEQ ID NO: 304414 - DNA, 20 bp, Artificial
  CRISPR gRNA sequence
tacctaagtcagtgatcagc

SEQ ID NO: 304415 - DNA, 20 bp, Artificial
  CRISPR gRNA sequence
gtgatcagctggcacatcta

SEQ ID NO: 304416 - DNA, 20 bp, Artificial
  CRISPR gRNA sequence
catctacagaccttgcactc

SEQ ID NO: 304417 - DNA, 20 bp, Artificial
  CRISPR gRNA sequence
atctacagaccttgcactca

SEQ ID NO: 304418 - DNA, 20 bp, Artificial
  CRISPR gRNA sequence
cttgcactcaaggactccac

SEQ ID NO: 304419 - DNA, 20 bp, Artificial
  CRISPR gRNA sequence
ctcaaggactccacaagctc

SEQ ID NO: 304420 - DNA, 20 bp, Artificial
  CRISPR gRNA sequence
tcaaggactccacaagctca

SEQ ID NO: 304421 - DNA, 20 bp, Artificial
  CRISPR gRNA sequence
ctccacaagctcaaggtgct

SEQ ID NO: 304422 - DNA, 20 bp, Artificial
  CRISPR gRNA sequence
cacaagctcaaggtgctaag

SEQ ID NO: 304423 - DNA, 20 bp, Artificial
  CRISPR gRNA sequence
caaggtgctaagcagaaaaa

SEQ ID NO: 304424 - DNA, 20 bp, Artificial
  CRISPR gRNA sequence
cagaaaaacagaaatctgaa

SEQ ID NO: 304425 - DNA, 20 bp, Artificial
  CRISPR gRNA sequence
agaaaaacagaaatctgaaa

SEQ ID NO: 304426 - DNA, 20 bp, Artificial
  CRISPR gRNA sequence
aaatctgaaaaggcttatcc

SEQ ID NO: 304427 - DNA, 20 bp, Artificial
  CRISPR gRNA sequence
ctgaaaaggcttatcccagc

SEQ ID NO: 304428 - DNA, 20 bp, Artificial
  CRISPR gRNA sequence
aaggcttatcccagccagca

SEQ ID NO: 304429 - DNA, 20 bp, Artificial
  CRISPR gRNA sequence
atcccagccagcatggatct

SEQ ID NO: 304430 - DNA, 20 bp, Artificial
  CRISPR gRNA sequence
tcccagccagcatggatctg

SEQ ID NO: 304431 - DNA, 20 bp, Artificial
  CRISPR gRNA sequence
cccagccagcatggatctga

SEQ ID NO: 304432 - DNA, 20 bp, Artificial
  CRISPR gRNA sequence
tctgagggaccatctctttg

SEQ ID NO: 304433 - DNA, 20 bp, Artificial
  CRISPR gRNA sequence
ccctgactcctcatcatcca

SEQ ID NO: 304434 - DNA, 20 bp, Artificial
  CRISPR gRNA sequence
tgactcctcatcatccacag

SEQ ID NO: 304435 - DNA, 20 bp, Artificial
  CRISPR gRNA sequence
ctcatcatccacagcagaca

SEQ ID NO: 304436 - DNA, 20 bp, Artificial
  CRISPR gRNA sequence
tcatcatccacagcagacat

SEQ ID NO: 304437 - DNA, 20 bp, Artificial
  CRISPR gRNA sequence
catcatccacagcagacatg

SEQ ID NO: 304438 - DNA, 20 bp, Artificial
  CRISPR gRNA sequence
atccacagcagacatgggga

SEQ ID NO: 304439 - DNA, 20 bp, Artificial
  CRISPR gRNA sequence
cacagcagacatggggacag

SEQ ID NO: 304440 - DNA, 20 bp, Artificial
  CRISPR gRNA sequence
cagacatggggacagtggcc

SEQ ID NO: 304441 - DNA, 20 bp, Artificial
  CRISPR gRNA sequence
agacatggggacagtggcca

SEQ ID NO: 304442 - DNA, 20 bp, Artificial
  CRISPR gRNA sequence
gacatggggacagtggccaa

SEQ ID NO: 304443 - DNA, 20 bp, Artificial
  CRISPR gRNA sequence
ggggacagtggccaagggcc

SEQ ID NO: 304444 - DNA, 20 bp, Artificial
  CRISPR gRNA sequence
gtggccaagggcctggtgtg

SEQ ID NO: 304445 - DNA, 20 bp, Artificial
  CRISPR gRNA sequence
gggcctggtgtgtggccatc

SEQ ID NO: 304446 - DNA, 20 bp, Artificial
  CRISPR gRNA sequence
gcctggtgtgtggccatctg

SEQ ID NO: 304447 - DNA, 20 bp, Artificial
  CRISPR gRNA sequence
cctggtgtgtggccatctgg

SEQ ID NO: 304448 - DNA, 20 bp, Artificial
  CRISPR gRNA sequence
tggtgtgtggccatctggag

SEQ ID NO: 304449 - DNA, 20 bp, Artificial
  CRISPR gRNA sequence
ggtgtgtggccatctggagg

SEQ ID NO: 304450 - DNA, 20 bp, Artificial
  CRISPR gRNA sequence
atctggaggaggtgaactca

SEQ ID NO: 304451 - DNA, 20 bp, Artificial
  CRISPR gRNA sequence
ggaggaggtgaactcatggc

SEQ ID NO: 304452 - DNA, 20 bp, Artificial
  CRISPR gRNA sequence
ggaggtgaactcatggctgg

SEQ ID NO: 304453 - DNA, 20 bp, Artificial
  CRISPR gRNA sequence
aactcatggctggtggcctg

SEQ ID NO: 304454 - DNA, 20 bp, Artificial
  CRISPR gRNA sequence
actcatggctggtggcctgt

SEQ ID NO: 304455 - DNA, 20 bp, Artificial
  CRISPR gRNA sequence
ctggtggcctgtgggtgctg

SEQ ID NO: 304456 - DNA, 20 bp, Artificial
  CRISPR gRNA sequence
tgggtgctgtagccaaactt

SEQ ID NO: 304457 - DNA, 20 bp, Artificial
  CRISPR gRNA sequence
gggtgctgtagccaaacttc

SEQ ID NO: 304458 - DNA, 20 bp, Artificial
  CRISPR gRNA sequence
ctgtagccaaacttcaggct

SEQ ID NO: 304459 - DNA, 20 bp, Artificial
  CRISPR gRNA sequence
ctcagttcacctccctgtct

SEQ ID NO: 304460 - DNA, 20 bp, Artificial
  CRISPR gRNA sequence
agttcacctccctgtcttag

SEQ ID NO: 304461 - DNA, 20 bp, Artificial
  CRISPR gRNA sequence
gttcacctccctgtcttagt

SEQ ID NO: 304462 - DNA, 20 bp, Artificial
  CRISPR gRNA sequence
ttcacctccctgtcttagtg

SEQ ID NO: 304463 - DNA, 20 bp, Artificial
  CRISPR gRNA sequence
acctccctgtcttagtgggg

SEQ ID NO: 304464 - DNA, 20 bp, Artificial
  CRISPR gRNA sequence
tagtggggtggcttccctct

SEQ ID NO: 304465 - DNA, 20 bp, Artificial
  CRISPR gRNA sequence
agtggggtggcttccctctc

SEQ ID NO: 304466 - DNA, 20 bp, Artificial
  CRISPR gRNA sequence
tggcttccctctcaggcctg

SEQ ID NO: 304467 - DNA, 20 bp, Artificial
  CRISPR gRNA sequence
ggcttccctctcaggcctgc

SEQ ID NO: 304468 - DNA, 20 bp, Artificial
  CRISPR gRNA sequence
ttccctctcaggcctgcagg

SEQ ID NO: 304469 - DNA, 20 bp, Artificial
  CRISPR gRNA sequence
ccctctcaggcctgcaggtg

SEQ ID NO: 304470 - DNA, 20 bp, Artificial
  CRISPR gRNA sequence
tcaggcctgcaggtggagac

SEQ ID NO: 304471 - DNA, 20 bp, Artificial
  CRISPR gRNA sequence
caggcctgcaggtggagaca

SEQ ID NO: 304472 - DNA, 20 bp, Artificial
  CRISPR gRNA sequence
ggcctgcaggtggagacaag

SEQ ID NO: 304473 - DNA, 20 bp, Artificial
  CRISPR gRNA sequence
ctgcaggtggagacaaggag

SEQ ID NO: 304474 - DNA, 20 bp, Artificial
  CRISPR gRNA sequence
caggtggagacaaggagcag

SEQ ID NO: 304475 - DNA, 20 bp, Artificial
  CRISPR gRNA sequence
aggtggagacaaggagcagc

SEQ ID NO: 304476 - DNA, 20 bp, Artificial
  CRISPR gRNA sequence
tggagacaaggagcagcagg

SEQ ID NO: 304477 - DNA, 20 bp, Artificial
  CRISPR gRNA sequence
ggagacaaggagcagcagga

SEQ ID NO: 304478 - DNA, 20 bp, Artificial
  CRISPR gRNA sequence
gagacaaggagcagcaggaa

SEQ ID NO: 304479 - DNA, 20 bp, Artificial
  CRISPR gRNA sequence
agacaaggagcagcaggaag

SEQ ID NO: 304480 - DNA, 20 bp, Artificial
  CRISPR gRNA sequence
caaggagcagcaggaagggg

SEQ ID NO: 304481 - DNA, 20 bp, Artificial
  CRISPR gRNA sequence
aaggagcagcaggaaggggt

SEQ ID NO: 304482 - DNA, 20 bp, Artificial
  CRISPR gRNA sequence
agcagcaggaaggggtgggc

SEQ ID NO: 304483 - DNA, 20 bp, Artificial
  CRISPR gRNA sequence
gcagcaggaaggggtgggcc

SEQ ID NO: 304484 - DNA, 20 bp, Artificial
  CRISPR gRNA sequence
agcaggaaggggtgggccag

SEQ ID NO: 304485 - DNA, 20 bp, Artificial
  CRISPR gRNA sequence
ggtgggccaggagtaactac

SEQ ID NO: 304486 - DNA, 20 bp, Artificial
  CRISPR gRNA sequence
aggagtaactacgagacact

SEQ ID NO: 304487 - DNA, 20 bp, Artificial
  CRISPR gRNA sequence
aactacgagacactgagtca

SEQ ID NO: 304488 - DNA, 20 bp, Artificial
  CRISPR gRNA sequence
actacgagacactgagtcac

SEQ ID NO: 304489 - DNA, 20 bp, Artificial
  CRISPR gRNA sequence
acactgagtcacaggataca

SEQ ID NO: 304490 - DNA, 20 bp, Artificial
  CRISPR gRNA sequence
ctgagtcacaggatacatgg

SEQ ID NO: 304491 - DNA, 20 bp, Artificial
  CRISPR gRNA sequence
tgagtcacaggatacatggc

SEQ ID NO: 304492 - DNA, 20 bp, Artificial
  CRISPR gRNA sequence
gagtcacaggatacatggca

SEQ ID NO: 304493 - DNA, 20 bp, Artificial
  CRISPR gRNA sequence
aggatacatggcagggaccg

SEQ ID NO: 304494 - DNA, 20 bp, Artificial
  CRISPR gRNA sequence
ccgcagccaactcctgttta

SEQ ID NO: 304495 - DNA, 20 bp, Artificial
  CRISPR gRNA sequence
ccaactcctgtttatagatg

SEQ ID NO: 304496 - DNA, 20 bp, Artificial
  CRISPR gRNA sequence
gatgaagaaactgaaactca

SEQ ID NO: 304497 - DNA, 20 bp, Artificial
  CRISPR gRNA sequence
gaagaaactgaaactcaaag

SEQ ID NO: 304498 - DNA, 20 bp, Artificial
  CRISPR gRNA sequence
actcaaagtggaactgtaaa

SEQ ID NO: 304499 - DNA, 20 bp, Artificial
  CRISPR gRNA sequence
ctcaaagtggaactgtaaac

SEQ ID NO: 304500 - DNA, 20 bp, Artificial
  CRISPR gRNA sequence
tcaaagtggaactgtaaaca

SEQ ID NO: 304501 - DNA, 20 bp, Artificial
  CRISPR gRNA sequence
aagtggaactgtaaacaggg

SEQ ID NO: 304502 - DNA, 20 bp, Artificial
  CRISPR gRNA sequence
actgtaaacagggaagatct

SEQ ID NO: 304503 - DNA, 20 bp, Artificial
  CRISPR gRNA sequence
agggaagatctgagttttgt

SEQ ID NO: 304504 - DNA, 20 bp, Artificial
  CRISPR gRNA sequence
gggaagatctgagttttgtg

SEQ ID NO: 304505 - DNA, 20 bp, Artificial
  CRISPR gRNA sequence
agatctgagttttgtgaggc

SEQ ID NO: 304506 - DNA, 20 bp, Artificial
  CRISPR gRNA sequence
ctggatgctgttaaaatttt

SEQ ID NO: 304507 - DNA, 20 bp, Artificial
  CRISPR gRNA sequence
tggatgctgttaaaattttg

SEQ ID NO: 304508 - DNA, 20 bp, Artificial
  CRISPR gRNA sequence
ggatgctgttaaaattttga

SEQ ID NO: 304509 - DNA, 20 bp, Artificial
  CRISPR gRNA sequence
gatgctgttaaaattttgag

SEQ ID NO: 304510 - DNA, 20 bp, Artificial
  CRISPR gRNA sequence
tgctgttaaaattttgaggg

SEQ ID NO: 304511 - DNA, 20 bp, Artificial
  CRISPR gRNA sequence
gctgttaaaattttgagggg

SEQ ID NO: 304512 - DNA, 20 bp, Artificial
  CRISPR gRNA sequence
gttaaaattttgaggggagg

SEQ ID NO: 304513 - DNA, 20 bp, Artificial
  CRISPR gRNA sequence
aaaattttgaggggaggtgg

SEQ ID NO: 304514 - DNA, 20 bp, Artificial
  CRISPR gRNA sequence
ttttgaggggaggtggtgga

SEQ ID NO: 304515 - DNA, 20 bp, Artificial
  CRISPR gRNA sequence
aggggaggtggtggatagtt

SEQ ID NO: 304516 - DNA, 20 bp, Artificial
  CRISPR gRNA sequence
ggtggtggatagttaagaaa

SEQ ID NO: 304517 - DNA, 20 bp, Artificial
  CRISPR gRNA sequence
gatagttaagaaaaagaatg

SEQ ID NO: 304518 - DNA, 20 bp, Artificial
  CRISPR gRNA sequence
cccctgactgctaacaccac

SEQ ID NO: 304519 - DNA, 20 bp, Artificial
  CRISPR gRNA sequence
tgactgctaacaccaccaga

SEQ ID NO: 304520 - DNA, 20 bp, Artificial
  CRISPR gRNA sequence
gactgctaacaccaccagac

SEQ ID NO: 304521 - DNA, 20 bp, Artificial
  CRISPR gRNA sequence
ctgctaacaccaccagacag

SEQ ID NO: 304522 - DNA, 20 bp, Artificial
  CRISPR gRNA sequence
aacaccaccagacaggagaa

SEQ ID NO: 304523 - DNA, 20 bp, Artificial
  CRISPR gRNA sequence
caccagacaggagaatggca

SEQ ID NO: 304524 - DNA, 20 bp, Artificial
  CRISPR gRNA sequence
ccagacaggagaatggcatg

SEQ ID NO: 304525 - DNA, 20 bp, Artificial
  CRISPR gRNA sequence
cagacaggagaatggcatgg

SEQ ID NO: 304526 - DNA, 20 bp, Artificial
  CRISPR gRNA sequence
agacaggagaatggcatgga

SEQ ID NO: 304527 - DNA, 20 bp, Artificial
  CRISPR gRNA sequence
ggagaatggcatggagggaa

SEQ ID NO: 304528 - DNA, 20 bp, Artificial
  CRISPR gRNA sequence
tggcatggagggaaaagttg

SEQ ID NO: 304529 - DNA, 20 bp, Artificial
  CRISPR gRNA sequence
gcatggagggaaaagttgca

SEQ ID NO: 304530 - DNA, 20 bp, Artificial
  CRISPR gRNA sequence
catggagggaaaagttgcag

SEQ ID NO: 304531 - DNA, 20 bp, Artificial
  CRISPR gRNA sequence
ggagggaaaagttgcagagg

SEQ ID NO: 304532 - DNA, 20 bp, Artificial
  CRISPR gRNA sequence
gagggaaaagttgcagagga

SEQ ID NO: 304533 - DNA, 20 bp, Artificial
  CRISPR gRNA sequence
gggaaaagttgcagaggaag

SEQ ID NO: 304534 - DNA, 20 bp, Artificial
  CRISPR gRNA sequence
aaagttgcagaggaaggaga

SEQ ID NO: 304535 - DNA, 20 bp, Artificial
  CRISPR gRNA sequence
gttgcagaggaaggagacag

SEQ ID NO: 304536 - DNA, 20 bp, Artificial
  CRISPR gRNA sequence
acagtggtcataacttattg

SEQ ID NO: 304537 - DNA, 20 bp, Artificial
  CRISPR gRNA sequence
tacttattcaaattttacca

SEQ ID NO: 304538 - DNA, 20 bp, Artificial
  CRISPR gRNA sequence
ttcaaattttaccaaagcat

SEQ ID NO: 304539 - DNA, 20 bp, Artificial
  CRISPR gRNA sequence
aattttaccaaagcataaga

SEQ ID NO: 304540 - DNA, 20 bp, Artificial
  CRISPR gRNA sequence
attttaccaaagcataagac

SEQ ID NO: 304541 - DNA, 20 bp, Artificial
  CRISPR gRNA sequence
aagacaggtgaccacactgc

SEQ ID NO: 304542 - DNA, 20 bp, Artificial
  CRISPR gRNA sequence
agacaggtgaccacactgct

SEQ ID NO: 304543 - DNA, 20 bp, Artificial
  CRISPR gRNA sequence
gacaggtgaccacactgcta

SEQ ID NO: 304544 - DNA, 20 bp, Artificial
  CRISPR gRNA sequence
acaggtgaccacactgctag

SEQ ID NO: 304545 - DNA, 20 bp, Artificial
  CRISPR gRNA sequence
caggtgaccacactgctagg

SEQ ID NO: 304546 - DNA, 20 bp, Artificial
  CRISPR gRNA sequence
cactgctagggggcccttca

SEQ ID NO: 304547 - DNA, 20 bp, Artificial
  CRISPR gRNA sequence
actgctagggggcccttcac

SEQ ID NO: 304548 - DNA, 20 bp, Artificial
  CRISPR gRNA sequence
ctgctagggggcccttcaca

SEQ ID NO: 304549 - DNA, 20 bp, Artificial
  CRISPR gRNA sequence
ggggcccttcacagggtctt

SEQ ID NO: 304550 - DNA, 20 bp, Artificial
  CRISPR gRNA sequence
gggcccttcacagggtcttg

SEQ ID NO: 304551 - DNA, 20 bp, Artificial
  CRISPR gRNA sequence
ggcccttcacagggtcttga

SEQ ID NO: 304552 - DNA, 20 bp, Artificial
  CRISPR gRNA sequence
gcccttcacagggtcttgag

SEQ ID NO: 304553 - DNA, 20 bp, Artificial
  CRISPR gRNA sequence
cccttcacagggtcttgagg

SEQ ID NO: 304554 - DNA, 20 bp, Artificial
  CRISPR gRNA sequence
acagggtcttgagggggatt

SEQ ID NO: 304555 - DNA, 20 bp, Artificial
  CRISPR gRNA sequence
ggtcttgagggggatttaga

SEQ ID NO: 304556 - DNA, 20 bp, Artificial
  CRISPR gRNA sequence
gtcttgagggggatttagaa

SEQ ID NO: 304557 - DNA, 20 bp, Artificial
  CRISPR gRNA sequence
tcttgagggggatttagaaa

SEQ ID NO: 304558 - DNA, 20 bp, Artificial
  CRISPR gRNA sequence
tttagaaagggttgtgcaaa

SEQ ID NO: 304559 - DNA, 20 bp, Artificial
  CRISPR gRNA sequence
tagaaagggttgtgcaaatg

SEQ ID NO: 304560 - DNA, 20 bp, Artificial
  CRISPR gRNA sequence
agaaagggttgtgcaaatgg

SEQ ID NO: 304561 - DNA, 20 bp, Artificial
  CRISPR gRNA sequence
gaaagggttgtgcaaatgga

SEQ ID NO: 304562 - DNA, 20 bp, Artificial
  CRISPR gRNA sequence
tgtgcaaatggagggctctg

SEQ ID NO: 304563 - DNA, 20 bp, Artificial
  CRISPR gRNA sequence
aatggagggctctgaagctt

SEQ ID NO: 304564 - DNA, 20 bp, Artificial
  CRISPR gRNA sequence
ctctgaagcttcagcttcat

SEQ ID NO: 304565 - DNA, 20 bp, Artificial
  CRISPR gRNA sequence
tcattggctccactataaat

SEQ ID NO: 304566 - DNA, 20 bp, Artificial
  CRISPR gRNA sequence
tataaatcagctgacacaat

SEQ ID NO: 304567 - DNA, 20 bp, Artificial
  CRISPR gRNA sequence
cacaattagctgaacatcca

SEQ ID NO: 304568 - DNA, 20 bp, Artificial
  CRISPR gRNA sequence
agctgaacatccatagttgt

SEQ ID NO: 304569 - DNA, 20 bp, Artificial
  CRISPR gRNA sequence
gctgaacatccatagttgtc

SEQ ID NO: 304570 - DNA, 20 bp, Artificial
  CRISPR gRNA sequence
gaacatccatagttgtcagg

SEQ ID NO: 304571 - DNA, 20 bp, Artificial
  CRISPR gRNA sequence
ccatagttgtcaggaagccg

SEQ ID NO: 304572 - DNA, 20 bp, Artificial
  CRISPR gRNA sequence
caggaagccgtggcaaccat

SEQ ID NO: 304573 - DNA, 20 bp, Artificial
  CRISPR gRNA sequence
aggaagccgtggcaaccatg

SEQ ID NO: 304574 - DNA, 20 bp, Artificial
  CRISPR gRNA sequence
gcaaccatgaggtatgtgca

SEQ ID NO: 304575 - DNA, 20 bp, Artificial
  CRISPR gRNA sequence
caaccatgaggtatgtgcat

SEQ ID NO: 304576 - DNA, 20 bp, Artificial
  CRISPR gRNA sequence
tgaggtatgtgcatgggctg

SEQ ID NO: 304577 - DNA, 20 bp, Artificial
  CRISPR gRNA sequence
gaggtatgtgcatgggctgt

SEQ ID NO: 304578 - DNA, 20 bp, Artificial
  CRISPR gRNA sequence
aggtatgtgcatgggctgta

SEQ ID NO: 304579 - DNA, 20 bp, Artificial
  CRISPR gRNA sequence
tatgtgcatgggctgtaggg

SEQ ID NO: 304580 - DNA, 20 bp, Artificial
  CRISPR gRNA sequence
atgtgcatgggctgtaggga

SEQ ID NO: 304581 - DNA, 20 bp, Artificial
  CRISPR gRNA sequence
tgtgcatgggctgtagggaa

SEQ ID NO: 304582 - DNA, 20 bp, Artificial
  CRISPR gRNA sequence
tgcatgggctgtagggaagg

SEQ ID NO: 304583 - DNA, 20 bp, Artificial
  CRISPR gRNA sequence
tgggctgtagggaagggagt

SEQ ID NO: 304584 - DNA, 20 bp, Artificial
  CRISPR gRNA sequence
ggctgtagggaagggagtga

SEQ ID NO: 304585 - DNA, 20 bp, Artificial
  CRISPR gRNA sequence
ctgtagggaagggagtgaga

SEQ ID NO: 304586 - DNA, 20 bp, Artificial
  CRISPR gRNA sequence
tgtagggaagggagtgagag

SEQ ID NO: 304587 - DNA, 20 bp, Artificial
  CRISPR gRNA sequence
gtagggaagggagtgagaga

SEQ ID NO: 304588 - DNA, 20 bp, Artificial
  CRISPR gRNA sequence
gggaagggagtgagagaggg

SEQ ID NO: 304589 - DNA, 20 bp, Artificial
  CRISPR gRNA sequence
ggaagggagtgagagagggt

SEQ ID NO: 304590 - DNA, 20 bp, Artificial
  CRISPR gRNA sequence
gaagggagtgagagagggta

SEQ ID NO: 304591 - DNA, 20 bp, Artificial
  CRISPR gRNA sequence
gggagtgagagagggtaggg

SEQ ID NO: 304592 - DNA, 20 bp, Artificial
  CRISPR gRNA sequence
gtgagagagggtagggaagt

SEQ ID NO: 304593 - DNA, 20 bp, Artificial
  CRISPR gRNA sequence
tgagagagggtagggaagtc

SEQ ID NO: 304594 - DNA, 20 bp, Artificial
  CRISPR gRNA sequence
gagagagggtagggaagtca

SEQ ID NO: 304595 - DNA, 20 bp, Artificial
  CRISPR gRNA sequence
tagggaagtcagggacgtga

SEQ ID NO: 304596 - DNA, 20 bp, Artificial
  CRISPR gRNA sequence
gaagtcagggacgtgaaagc

SEQ ID NO: 304597 - DNA, 20 bp, Artificial
  CRISPR gRNA sequence
gaaagccagtgctccgaatg

SEQ ID NO: 304598 - DNA, 20 bp, Artificial
  CRISPR gRNA sequence
aaagccagtgctccgaatga

SEQ ID NO: 304599 - DNA, 20 bp, Artificial
  CRISPR gRNA sequence
aagccagtgctccgaatgaa

SEQ ID NO: 304600 - DNA, 20 bp, Artificial
  CRISPR gRNA sequence
gccagtgctccgaatgaagg

SEQ ID NO: 304601 - DNA, 20 bp, Artificial
  CRISPR gRNA sequence
tccgaatgaagggagacttt

SEQ ID NO: 304602 - DNA, 20 bp, Artificial
  CRISPR gRNA sequence
ggagacttttggaattctgt

SEQ ID NO: 304603 - DNA, 20 bp, Artificial
  CRISPR gRNA sequence
gaattctgtcagttgtttcc

SEQ ID NO: 304604 - DNA, 20 bp, Artificial
  CRISPR gRNA sequence
aattctgtcagttgtttcct

SEQ ID NO: 304605 - DNA, 20 bp, Artificial
  CRISPR gRNA sequence
ttctgtcagttgtttcctag

SEQ ID NO: 304606 - DNA, 20 bp, Artificial
  CRISPR gRNA sequence
cagttgtttcctaggagcct

SEQ ID NO: 304607 - DNA, 20 bp, Artificial
  CRISPR gRNA sequence
tgtttcctaggagcctgaga

SEQ ID NO: 304608 - DNA, 20 bp, Artificial
  CRISPR gRNA sequence
tcctaggagcctgagaaaga

SEQ ID NO: 304609 - DNA, 20 bp, Artificial
  CRISPR gRNA sequence
gagcctgagaaagacagaaa

SEQ ID NO: 304610 - DNA, 20 bp, Artificial
  CRISPR gRNA sequence
agcctgagaaagacagaaac

SEQ ID NO: 304611 - DNA, 20 bp, Artificial
  CRISPR gRNA sequence
gcctgagaaagacagaaaca

SEQ ID NO: 304612 - DNA, 20 bp, Artificial
  CRISPR gRNA sequence
gagaaagacagaaacagggt

SEQ ID NO: 304613 - DNA, 20 bp, Artificial
  CRISPR gRNA sequence
gaaagacagaaacagggtca

SEQ ID NO: 304614 - DNA, 20 bp, Artificial
  CRISPR gRNA sequence
agacagaaacagggtcagag

SEQ ID NO: 304615 - DNA, 20 bp, Artificial
  CRISPR gRNA sequence
gaaacagggtcagagaagac

SEQ ID NO: 304616 - DNA, 20 bp, Artificial
  CRISPR gRNA sequence
acagggtcagagaagaccag

SEQ ID NO: 304617 - DNA, 20 bp, Artificial
  CRISPR gRNA sequence
agggtcagagaagaccagaa

SEQ ID NO: 304618 - DNA, 20 bp, Artificial
  CRISPR gRNA sequence
agaccagaagagaatatgtg

SEQ ID NO: 304619 - DNA, 20 bp, Artificial
  CRISPR gRNA sequence
agagaatatgtgtggaacaa

SEQ ID NO: 304620 - DNA, 20 bp, Artificial
  CRISPR gRNA sequence
agaatatgtgtggaacaaaa

SEQ ID NO: 304621 - DNA, 20 bp, Artificial
  CRISPR gRNA sequence
atgtgtggaacaaaagagtc

SEQ ID NO: 304622 - DNA, 20 bp, Artificial
  CRISPR gRNA sequence
ggaacaaaagagtcaagtct

SEQ ID NO: 304623 - DNA, 20 bp, Artificial
  CRISPR gRNA sequence
gaacaaaagagtcaagtctc

SEQ ID NO: 304624 - DNA, 20 bp, Artificial
  CRISPR gRNA sequence
aacaaaagagtcaagtctca

SEQ ID NO: 304625 - DNA, 20 bp, Artificial
  CRISPR gRNA sequence
acaaaagagtcaagtctcag

SEQ ID NO: 304626 - DNA, 20 bp, Artificial
  CRISPR gRNA sequence
gagtcaagtctcaggggcct

SEQ ID NO: 304627 - DNA, 20 bp, Artificial
  CRISPR gRNA sequence
aagtctcaggggcctcagtg

SEQ ID NO: 304628 - DNA, 20 bp, Artificial
  CRISPR gRNA sequence
tctcaggggcctcagtgcag

SEQ ID NO: 304629 - DNA, 20 bp, Artificial
  CRISPR gRNA sequence
gcagccttcccccatcccca

SEQ ID NO: 304630 - DNA, 20 bp, Artificial
  CRISPR gRNA sequence
cagccttcccccatccccat

SEQ ID NO: 304631 - DNA, 20 bp, Artificial
  CRISPR gRNA sequence
cttcccccatccccatggga

SEQ ID NO: 304632 - DNA, 20 bp, Artificial
  CRISPR gRNA sequence
ttcccccatccccatgggat

SEQ ID NO: 304633 - DNA, 20 bp, Artificial
  CRISPR gRNA sequence
cccatccccatgggatgggc

SEQ ID NO: 304634 - DNA, 20 bp, Artificial
  CRISPR gRNA sequence
ccatccccatgggatgggcc

SEQ ID NO: 304635 - DNA, 20 bp, Artificial
  CRISPR gRNA sequence
gggccaggctaccctactct

SEQ ID NO: 304636 - DNA, 20 bp, Artificial
  CRISPR gRNA sequence
gctaccctactctgagcatc

SEQ ID NO: 304637 - DNA, 20 bp, Artificial
  CRISPR gRNA sequence
ctaccctactctgagcatct

SEQ ID NO: 304638 - DNA, 20 bp, Artificial
  CRISPR gRNA sequence
gcatctaggctcactgatgt

SEQ ID NO: 304639 - DNA, 20 bp, Artificial
  CRISPR gRNA sequence
ggctcactgatgtgagactg

SEQ ID NO: 304640 - DNA, 20 bp, Artificial
  CRISPR gRNA sequence
ctcactgatgtgagactgca

SEQ ID NO: 304641 - DNA, 20 bp, Artificial
  CRISPR gRNA sequence
tcactgatgtgagactgcag

SEQ ID NO: 304642 - DNA, 20 bp, Artificial
  CRISPR gRNA sequence
actgatgtgagactgcagag

SEQ ID NO: 304643 - DNA, 20 bp, Artificial
  CRISPR gRNA sequence
ctgatgtgagactgcagagg

SEQ ID NO: 304644 - DNA, 20 bp, Artificial
  CRISPR gRNA sequence
atgtgagactgcagaggagg

SEQ ID NO: 304645 - DNA, 20 bp, Artificial
  CRISPR gRNA sequence
tgagactgcagaggaggaag

SEQ ID NO: 304646 - DNA, 20 bp, Artificial
  CRISPR gRNA sequence
gcagaggaggaagaagcaca

SEQ ID NO: 304647 - DNA, 20 bp, Artificial
  CRISPR gRNA sequence
cagaggaggaagaagcacac

SEQ ID NO: 304648 - DNA, 20 bp, Artificial
  CRISPR gRNA sequence
agaggaggaagaagcacacg

SEQ ID NO: 304649 - DNA, 20 bp, Artificial
  CRISPR gRNA sequence
gaggaggaagaagcacacgg

SEQ ID NO: 304650 - DNA, 20 bp, Artificial
  CRISPR gRNA sequence
aggaggaagaagcacacggg

SEQ ID NO: 304651 - DNA, 20 bp, Artificial
  CRISPR gRNA sequence
ggaggaagaagcacacgggg

SEQ ID NO: 304652 - DNA, 20 bp, Artificial
  CRISPR gRNA sequence
aggaagaagcacacgggggg

SEQ ID NO: 304653 - DNA, 20 bp, Artificial
  CRISPR gRNA sequence
gaagaagcacacggggggga

SEQ ID NO: 304654 - DNA, 20 bp, Artificial
  CRISPR gRNA sequence
cgggggggagagctccatcc

SEQ ID NO: 304655 - DNA, 20 bp, Artificial
  CRISPR gRNA sequence
ccatcccagctgcctgccat

SEQ ID NO: 304656 - DNA, 20 bp, Artificial
  CRISPR gRNA sequence
cataacacttccttcttctc

SEQ ID NO: 304657 - DNA, 20 bp, Artificial
  CRISPR gRNA sequence
ataacacttccttcttctcc

SEQ ID NO: 304658 - DNA, 20 bp, Artificial
  CRISPR gRNA sequence
cacttccttcttctccagga

SEQ ID NO: 304659 - DNA, 20 bp, Artificial
  CRISPR gRNA sequence
aggaaagtcttttttgcatg

SEQ ID NO: 304660 - DNA, 20 bp, Artificial
  CRISPR gRNA sequence
atgtggtcttgtacaatgct

SEQ ID NO: 304661 - DNA, 20 bp, Artificial
  CRISPR gRNA sequence
tggtcttgtacaatgctcag

SEQ ID NO: 304662 - DNA, 20 bp, Artificial
  CRISPR gRNA sequence
cttgtacaatgctcagtaga

SEQ ID NO: 304663 - DNA, 20 bp, Artificial
  CRISPR gRNA sequence
tacaatgctcagtagaaagt

SEQ ID NO: 304664 - DNA, 20 bp, Artificial
  CRISPR gRNA sequence
gaaagtgagtaaaacccacc

SEQ ID NO: 304665 - DNA, 20 bp, Artificial
  CRISPR gRNA sequence
gagtaaaacccaccaagtct

SEQ ID NO: 304666 - DNA, 20 bp, Artificial
  CRISPR gRNA sequence
agtaaaacccaccaagtctc

SEQ ID NO: 304667 - DNA, 20 bp, Artificial
  CRISPR gRNA sequence
aacccaccaagtctcaggcc

SEQ ID NO: 304668 - DNA, 20 bp, Artificial
  CRISPR gRNA sequence
acccaccaagtctcaggcct

SEQ ID NO: 304669 - DNA, 20 bp, Artificial
  CRISPR gRNA sequence
tctcaggcctgggcttgctg

SEQ ID NO: 304670 - DNA, 20 bp, Artificial
  CRISPR gRNA sequence
aggcctgggcttgctgtggt

SEQ ID NO: 304671 - DNA, 20 bp, Artificial
  CRISPR gRNA sequence
cttgctgtggtcagactcat

SEQ ID NO: 304672 - DNA, 20 bp, Artificial
  CRISPR gRNA sequence
ttgctgtggtcagactcatc

SEQ ID NO: 304673 - DNA, 20 bp, Artificial
  CRISPR gRNA sequence
gctgtggtcagactcatcag

SEQ ID NO: 304674 - DNA, 20 bp, Artificial
  CRISPR gRNA sequence
tggtcagactcatcaggaga

SEQ ID NO: 304675 - DNA, 20 bp, Artificial
  CRISPR gRNA sequence
tcagactcatcaggagacag

SEQ ID NO: 304676 - DNA, 20 bp, Artificial
  CRISPR gRNA sequence
cagactcatcaggagacagt

SEQ ID NO: 304677 - DNA, 20 bp, Artificial
  CRISPR gRNA sequence
atcaggagacagtaggattc

SEQ ID NO: 304678 - DNA, 20 bp, Artificial
  CRISPR gRNA sequence
tcaggagacagtaggattcc

SEQ ID NO: 304679 - DNA, 20 bp, Artificial
  CRISPR gRNA sequence
taggattccaggacttaaca

SEQ ID NO: 304680 - DNA, 20 bp, Artificial
  CRISPR gRNA sequence
ccaggacttaacaaagctga

SEQ ID NO: 304681 - DNA, 20 bp, Artificial
  CRISPR gRNA sequence
caggacttaacaaagctgaa

SEQ ID NO: 304682 - DNA, 20 bp, Artificial
  CRISPR gRNA sequence
caaagctgaaaggttcttac

SEQ ID NO: 304683 - DNA, 20 bp, Artificial
  CRISPR gRNA sequence
aagctgaaaggttcttacca

SEQ ID NO: 304684 - DNA, 20 bp, Artificial
  CRISPR gRNA sequence
gctgaaaggttcttaccaga

SEQ ID NO: 304685 - DNA, 20 bp, Artificial
  CRISPR gRNA sequence
gaaaggttcttaccagagag

SEQ ID NO: 304686 - DNA, 20 bp, Artificial
  CRISPR gRNA sequence
aaaggttcttaccagagagc

SEQ ID NO: 304687 - DNA, 20 bp, Artificial
  CRISPR gRNA sequence
ggttcttaccagagagcagg

SEQ ID NO: 304688 - DNA, 20 bp, Artificial
  CRISPR gRNA sequence
gttcttaccagagagcagga

SEQ ID NO: 304689 - DNA, 20 bp, Artificial
  CRISPR gRNA sequence
agagcaggaaggccatcaca

SEQ ID NO: 304690 - DNA, 20 bp, Artificial
  CRISPR gRNA sequence
agcaggaaggccatcacaaa

SEQ ID NO: 304691 - DNA, 20 bp, Artificial
  CRISPR gRNA sequence
atcacaaagagaatgttact

SEQ ID NO: 304692 - DNA, 20 bp, Artificial
  CRISPR gRNA sequence
gagaatgttactcagtccca

SEQ ID NO: 304693 - DNA, 20 bp, Artificial
  CRISPR gRNA sequence
gttactcagtcccatagtgc

SEQ ID NO: 304694 - DNA, 20 bp, Artificial
  CRISPR gRNA sequence
tactcagtcccatagtgcta

SEQ ID NO: 304695 - DNA, 20 bp, Artificial
  CRISPR gRNA sequence
agtcccatagtgctagagtc

SEQ ID NO: 304696 - DNA, 20 bp, Artificial
  CRISPR gRNA sequence
tgctagagtcgagaaaaaaa

SEQ ID NO: 304697 - DNA, 20 bp, Artificial
  CRISPR gRNA sequence
gctagagtcgagaaaaaaaa

SEQ ID NO: 304698 - DNA, 20 bp, Artificial
  CRISPR gRNA sequence
aaaaaaaggtaaaacttgat

SEQ ID NO: 304699 - DNA, 20 bp, Artificial
  CRISPR gRNA sequence
aaggtaaaacttgattagaa

SEQ ID NO: 304700 - DNA, 20 bp, Artificial
  CRISPR gRNA sequence
aggtaaaacttgattagaaa

SEQ ID NO: 304701 - DNA, 20 bp, Artificial
  CRISPR gRNA sequence
atgttcaccaaaacatgacc

SEQ ID NO: 304702 - DNA, 20 bp, Artificial
  CRISPR gRNA sequence
accaaaacatgacctggacg

SEQ ID NO: 304703 - DNA, 20 bp, Artificial
  CRISPR gRNA sequence
caaaacatgacctggacgtg

SEQ ID NO: 304704 - DNA, 20 bp, Artificial
  CRISPR gRNA sequence
catgacctggacgtggagtt

SEQ ID NO: 304705 - DNA, 20 bp, Artificial
  CRISPR gRNA sequence
atgacctggacgtggagttt

SEQ ID NO: 304706 - DNA, 20 bp, Artificial
  CRISPR gRNA sequence
cgtggagtttgggattcact

SEQ ID NO: 304707 - DNA, 20 bp, Artificial
  CRISPR gRNA sequence
gtggagtttgggattcactt

SEQ ID NO: 304708 - DNA, 20 bp, Artificial
  CRISPR gRNA sequence
ttgggattcacttgggttct

SEQ ID NO: 304709 - DNA, 20 bp, Artificial
  CRISPR gRNA sequence
tgggattcacttgggttctc

SEQ ID NO: 304710 - DNA, 20 bp, Artificial
  CRISPR gRNA sequence
cacttgggttctcgggtgtg

SEQ ID NO: 304711 - DNA, 20 bp, Artificial
  CRISPR gRNA sequence
cttgggttctcgggtgtgca

SEQ ID NO: 304712 - DNA, 20 bp, Artificial
  CRISPR gRNA sequence
cgggtgtgcagagacaatgc

SEQ ID NO: 304713 - DNA, 20 bp, Artificial
  CRISPR gRNA sequence
gggtgtgcagagacaatgcc

SEQ ID NO: 304714 - DNA, 20 bp, Artificial
  CRISPR gRNA sequence
ggtgtgcagagacaatgcca

SEQ ID NO: 304715 - DNA, 20 bp, Artificial
  CRISPR gRNA sequence
acaatgccagggcttcatca

SEQ ID NO: 304716 - DNA, 20 bp, Artificial
  CRISPR gRNA sequence
aagccatttccttttgctct

SEQ ID NO: 304717 - DNA, 20 bp, Artificial
  CRISPR gRNA sequence
tttgctcttagctccatcga

SEQ ID NO: 304718 - DNA, 20 bp, Artificial
  CRISPR gRNA sequence
ttgctcttagctccatcgat

SEQ ID NO: 304719 - DNA, 20 bp, Artificial
  CRISPR gRNA sequence
catcgataggtcacatttcc

SEQ ID NO: 304720 - DNA, 20 bp, Artificial
  CRISPR gRNA sequence
acatttcccagcctcccctg

SEQ ID NO: 304721 - DNA, 20 bp, Artificial
  CRISPR gRNA sequence
cagcctcccctgcagttata

SEQ ID NO: 304722 - DNA, 20 bp, Artificial
  CRISPR gRNA sequence
agcctcccctgcagttatac

SEQ ID NO: 304723 - DNA, 20 bp, Artificial
  CRISPR gRNA sequence
cctgcagttatacaggccat

SEQ ID NO: 304724 - DNA, 20 bp, Artificial
  CRISPR gRNA sequence
agttatacaggccatgagac

SEQ ID NO: 304725 - DNA, 20 bp, Artificial
  CRISPR gRNA sequence
caggccatgagactggcttc

SEQ ID NO: 304726 - DNA, 20 bp, Artificial
  CRISPR gRNA sequence
tgagactggcttctagccaa

SEQ ID NO: 304727 - DNA, 20 bp, Artificial
  CRISPR gRNA sequence
gcttctagccaatggaattg

SEQ ID NO: 304728 - DNA, 20 bp, Artificial
  CRISPR gRNA sequence
cttctagccaatggaattgt

SEQ ID NO: 304729 - DNA, 20 bp, Artificial
  CRISPR gRNA sequence
ctagccaatggaattgtggg

SEQ ID NO: 304730 - DNA, 20 bp, Artificial
  CRISPR gRNA sequence
caatggaattgtgggcagaa

SEQ ID NO: 304731 - DNA, 20 bp, Artificial
  CRISPR gRNA sequence
ggcagaaaagatgtttcttc

SEQ ID NO: 304732 - DNA, 20 bp, Artificial
  CRISPR gRNA sequence
aaagatgtttcttccagatc

SEQ ID NO: 304733 - DNA, 20 bp, Artificial
  CRISPR gRNA sequence
tcttccagatctggctgcta

SEQ ID NO: 304734 - DNA, 20 bp, Artificial
  CRISPR gRNA sequence
tcctccctctcctgccttct

SEQ ID NO: 304735 - DNA, 20 bp, Artificial
  CRISPR gRNA sequence
tccctctcctgccttcttag

SEQ ID NO: 304736 - DNA, 20 bp, Artificial
  CRISPR gRNA sequence
ctctcctgccttcttagcag

SEQ ID NO: 304737 - DNA, 20 bp, Artificial
  CRISPR gRNA sequence
tctcctgccttcttagcagc

SEQ ID NO: 304738 - DNA, 20 bp, Artificial
  CRISPR gRNA sequence
ctcctgccttcttagcagca

SEQ ID NO: 304739 - DNA, 20 bp, Artificial
  CRISPR gRNA sequence
tcctgccttcttagcagcag

SEQ ID NO: 304740 - DNA, 20 bp, Artificial
  CRISPR gRNA sequence
cttcttagcagcaggggatc

SEQ ID NO: 304741 - DNA, 20 bp, Artificial
  CRISPR gRNA sequence
tcttagcagcaggggatcca

SEQ ID NO: 304742 - DNA, 20 bp, Artificial
  CRISPR gRNA sequence
cttagcagcaggggatccag

SEQ ID NO: 304743 - DNA, 20 bp, Artificial
  CRISPR gRNA sequence
gggatccagaggaaatgtcc

SEQ ID NO: 304744 - DNA, 20 bp, Artificial
  CRISPR gRNA sequence
ggatccagaggaaatgtcca

SEQ ID NO: 304745 - DNA, 20 bp, Artificial
  CRISPR gRNA sequence
gatccagaggaaatgtccaa

SEQ ID NO: 304746 - DNA, 20 bp, Artificial
  CRISPR gRNA sequence
agaggaaatgtccaagggcc

SEQ ID NO: 304747 - DNA, 20 bp, Artificial
  CRISPR gRNA sequence
caagggcctagaaaatcgca

SEQ ID NO: 304748 - DNA, 20 bp, Artificial
  CRISPR gRNA sequence
aaaatcgcaaagtctcacaa

SEQ ID NO: 304749 - DNA, 20 bp, Artificial
  CRISPR gRNA sequence
atcgcaaagtctcacaatgg

SEQ ID NO: 304750 - DNA, 20 bp, Artificial
  CRISPR gRNA sequence
cgcaaagtctcacaatggaa

SEQ ID NO: 304751 - DNA, 20 bp, Artificial
  CRISPR gRNA sequence
gtctcacaatggaagagatc

SEQ ID NO: 304752 - DNA, 20 bp, Artificial
  CRISPR gRNA sequence
gtttgcttaataaactaata

SEQ ID NO: 304753 - DNA, 20 bp, Artificial
  CRISPR gRNA sequence
tgcttaataaactaataaag

SEQ ID NO: 304754 - DNA, 20 bp, Artificial
  CRISPR gRNA sequence
ctcccacaactgatctacaa

SEQ ID NO: 304755 - DNA, 20 bp, Artificial
  CRISPR gRNA sequence
tctacaatggattgtgatat

SEQ ID NO: 304756 - DNA, 20 bp, Artificial
  CRISPR gRNA sequence
attggcaaaaaataaaattt

SEQ ID NO: 304757 - DNA, 20 bp, Artificial
  CRISPR gRNA sequence
ttggcaaaaaataaaatttg

SEQ ID NO: 304758 - DNA, 20 bp, Artificial
  CRISPR gRNA sequence
tggcaaaaaataaaatttga

SEQ ID NO: 304759 - DNA, 20 bp, Artificial
  CRISPR gRNA sequence
atttgagggattgattattg

SEQ ID NO: 304760 - DNA, 20 bp, Artificial
  CRISPR gRNA sequence
tgagggattgattattgcag

SEQ ID NO: 304761 - DNA, 20 bp, Artificial
  CRISPR gRNA sequence
ggattgattattgcagtagc

SEQ ID NO: 304762 - DNA, 20 bp, Artificial
  CRISPR gRNA sequence
atttatcttgaccaacataa

SEQ ID NO: 304763 - DNA, 20 bp, Artificial
  CRISPR gRNA sequence
tttatcttgaccaacataac

SEQ ID NO: 304764 - DNA, 20 bp, Artificial
  CRISPR gRNA sequence
gaccaacataacaggcatga

SEQ ID NO: 304765 - DNA, 20 bp, Artificial
  CRISPR gRNA sequence
accaacataacaggcatgat

SEQ ID NO: 304766 - DNA, 20 bp, Artificial
  CRISPR gRNA sequence
ccaacataacaggcatgatg

SEQ ID NO: 304767 - DNA, 20 bp, Artificial
  CRISPR gRNA sequence
caacataacaggcatgatgg

SEQ ID NO: 304768 - DNA, 20 bp, Artificial
  CRISPR gRNA sequence
acaggcatgatgggggcaat

SEQ ID NO: 304769 - DNA, 20 bp, Artificial
  CRISPR gRNA sequence
gcatgatgggggcaatcggt

SEQ ID NO: 304770 - DNA, 20 bp, Artificial
  CRISPR gRNA sequence
gttagtattgcatttacgct

SEQ ID NO: 304771 - DNA, 20 bp, Artificial
  CRISPR gRNA sequence
gccttccttttgttttcctg

SEQ ID NO: 304772 - DNA, 20 bp, Artificial
  CRISPR gRNA sequence
tggttctcaaacttgaatgt

SEQ ID NO: 304773 - DNA, 20 bp, Artificial
  CRISPR gRNA sequence
gaatgtgagtaaaaatcacc

SEQ ID NO: 304774 - DNA, 20 bp, Artificial
  CRISPR gRNA sequence
atgtgagtaaaaatcacctg

SEQ ID NO: 304775 - DNA, 20 bp, Artificial
  CRISPR gRNA sequence
gtgagtaaaaatcacctgga

SEQ ID NO: 304776 - DNA, 20 bp, Artificial
  CRISPR gRNA sequence
aaatcacctggagagtttcc

SEQ ID NO: 304777 - DNA, 20 bp, Artificial
  CRISPR gRNA sequence
aatcacctggagagtttcct

SEQ ID NO: 304778 - DNA, 20 bp, Artificial
  CRISPR gRNA sequence
agtttcctgggcctcaacca

SEQ ID NO: 304779 - DNA, 20 bp, Artificial
  CRISPR gRNA sequence
tcctgggcctcaaccacaga

SEQ ID NO: 304780 - DNA, 20 bp, Artificial
  CRISPR gRNA sequence
ggcctcaaccacagaaagtc

SEQ ID NO: 304781 - DNA, 20 bp, Artificial
  CRISPR gRNA sequence
caaccacagaaagtctggct

SEQ ID NO: 304782 - DNA, 20 bp, Artificial
  CRISPR gRNA sequence
cacagaaagtctggcttagt

SEQ ID NO: 304783 - DNA, 20 bp, Artificial
  CRISPR gRNA sequence
gaaagtctggcttagtaagt

SEQ ID NO: 304784 - DNA, 20 bp, Artificial
  CRISPR gRNA sequence
aaagtctggcttagtaagtt

SEQ ID NO: 304785 - DNA, 20 bp, Artificial
  CRISPR gRNA sequence
atttttatgtttaacaacat

SEQ ID NO: 304786 - DNA, 20 bp, Artificial
  CRISPR gRNA sequence
tttttatgtttaacaacata

SEQ ID NO: 304787 - DNA, 20 bp, Artificial
  CRISPR gRNA sequence
taaggtgatgacaatgctgc

SEQ ID NO: 304788 - DNA, 20 bp, Artificial
  CRISPR gRNA sequence
gatgacaatgctgccggcct

SEQ ID NO: 304789 - DNA, 20 bp, Artificial
  CRISPR gRNA sequence
atgacaatgctgccggccta

SEQ ID NO: 304790 - DNA, 20 bp, Artificial
  CRISPR gRNA sequence
cggcctaaggaccacgcttt

SEQ ID NO: 304791 - DNA, 20 bp, Artificial
  CRISPR gRNA sequence
gcctaaggaccacgctttga

SEQ ID NO: 304792 - DNA, 20 bp, Artificial
  CRISPR gRNA sequence
ttcacttaatctacatgatg

SEQ ID NO: 304793 - DNA, 20 bp, Artificial
  CRISPR gRNA sequence
ttaatctacatgatgaagcc

SEQ ID NO: 304794 - DNA, 20 bp, Artificial
  CRISPR gRNA sequence
tacatgatgaagccaagaaa

SEQ ID NO: 304795 - DNA, 20 bp, Artificial
  CRISPR gRNA sequence
acatgatgaagccaagaaaa

SEQ ID NO: 304796 - DNA, 20 bp, Artificial
  CRISPR gRNA sequence
acccacgcacttaccctaac

SEQ ID NO: 304797 - DNA, 20 bp, Artificial
  CRISPR gRNA sequence
ttaccctaactagcaccaaa

SEQ ID NO: 304798 - DNA, 20 bp, Artificial
  CRISPR gRNA sequence
taccctaactagcaccaaaa

SEQ ID NO: 304799 - DNA, 20 bp, Artificial
  CRISPR gRNA sequence
ctagcaccaaaaaggctgct

SEQ ID NO: 304800 - DNA, 20 bp, Artificial
  CRISPR gRNA sequence
gcaccaaaaaggctgcttag

SEQ ID NO: 304801 - DNA, 20 bp, Artificial
  CRISPR gRNA sequence
aaggctgcttagtggcttat

SEQ ID NO: 304802 - DNA, 20 bp, Artificial
  CRISPR gRNA sequence
aggctgcttagtggcttata

SEQ ID NO: 304803 - DNA, 20 bp, Artificial
  CRISPR gRNA sequence
ctgcttagtggcttataagg

SEQ ID NO: 304804 - DNA, 20 bp, Artificial
  CRISPR gRNA sequence
tagtggcttataaggaagca

SEQ ID NO: 304805 - DNA, 20 bp, Artificial
  CRISPR gRNA sequence
cttataaggaagcaaagaat

SEQ ID NO: 304806 - DNA, 20 bp, Artificial
  CRISPR gRNA sequence
ttataaggaagcaaagaata

SEQ ID NO: 304807 - DNA, 20 bp, Artificial
  CRISPR gRNA sequence
ataaggaagcaaagaataag

SEQ ID NO: 304808 - DNA, 20 bp, Artificial
  CRISPR gRNA sequence
aaggaagcaaagaataagga

SEQ ID NO: 304809 - DNA, 20 bp, Artificial
  CRISPR gRNA sequence
aggaagcaaagaataaggag

SEQ ID NO: 304810 - DNA, 20 bp, Artificial
  CRISPR gRNA sequence
taaggagaggtgaccaacat

SEQ ID NO: 304811 - DNA, 20 bp, Artificial
  CRISPR gRNA sequence
tgaccaacattagatgcgat

SEQ ID NO: 304812 - DNA, 20 bp, Artificial
  CRISPR gRNA sequence
gaccaacattagatgcgatc

SEQ ID NO: 304813 - DNA, 20 bp, Artificial
  CRISPR gRNA sequence
tagatgcgatcaggcacatt

SEQ ID NO: 304814 - DNA, 20 bp, Artificial
  CRISPR gRNA sequence
agatgcgatcaggcacattc

SEQ ID NO: 304815 - DNA, 20 bp, Artificial
  CRISPR gRNA sequence
gcgatcaggcacattcagga

SEQ ID NO: 304816 - DNA, 20 bp, Artificial
  CRISPR gRNA sequence
caggcacattcaggatggta

SEQ ID NO: 304817 - DNA, 20 bp, Artificial
  CRISPR gRNA sequence
caggatggtatggccataca

SEQ ID NO: 304818 - DNA, 20 bp, Artificial
  CRISPR gRNA sequence
aggatggtatggccatacac

SEQ ID NO: 304819 - DNA, 20 bp, Artificial
  CRISPR gRNA sequence
tggtatggccatacacagga

SEQ ID NO: 304820 - DNA, 20 bp, Artificial
  CRISPR gRNA sequence
acaggaaagatgaccaacat

SEQ ID NO: 304821 - DNA, 20 bp, Artificial
  CRISPR gRNA sequence
aagatgaccaacatgagaaa

SEQ ID NO: 304822 - DNA, 20 bp, Artificial
  CRISPR gRNA sequence
agatgaccaacatgagaaac

SEQ ID NO: 304823 - DNA, 20 bp, Artificial
  CRISPR gRNA sequence
tgaccaacatgagaaacagg

SEQ ID NO: 304824 - DNA, 20 bp, Artificial
  CRISPR gRNA sequence
aacatgagaaacaggtggaa

SEQ ID NO: 304825 - DNA, 20 bp, Artificial
  CRISPR gRNA sequence
gtggaaaagcaaaccaaata

SEQ ID NO: 304826 - DNA, 20 bp, Artificial
  CRISPR gRNA sequence
tggaaaagcaaaccaaatac

SEQ ID NO: 304827 - DNA, 20 bp, Artificial
  CRISPR gRNA sequence
ccaaatacaggaatatgata

SEQ ID NO: 304828 - DNA, 20 bp, Artificial
  CRISPR gRNA sequence
aaatacaggaatatgataca

SEQ ID NO: 304829 - DNA, 20 bp, Artificial
  CRISPR gRNA sequence
caggaatatgatacagagcc

SEQ ID NO: 304830 - DNA, 20 bp, Artificial
  CRISPR gRNA sequence
aggaatatgatacagagcca

SEQ ID NO: 304831 - DNA, 20 bp, Artificial
  CRISPR gRNA sequence
tatgatacagagccaaggac

SEQ ID NO: 304832 - DNA, 20 bp, Artificial
  CRISPR gRNA sequence
atgatacagagccaaggaca

SEQ ID NO: 304833 - DNA, 20 bp, Artificial
  CRISPR gRNA sequence
tacagagccaaggacaaggc

SEQ ID NO: 304834 - DNA, 20 bp, Artificial
  CRISPR gRNA sequence
ccagtgctaaatgcttgccc

SEQ ID NO: 304835 - DNA, 20 bp, Artificial
  CRISPR gRNA sequence
aaatctgcccaatttgcact

SEQ ID NO: 304836 - DNA, 20 bp, Artificial
  CRISPR gRNA sequence
aatctgcccaatttgcactg

SEQ ID NO: 304837 - DNA, 20 bp, Artificial
  CRISPR gRNA sequence
atctgcccaatttgcactga

SEQ ID NO: 304838 - DNA, 20 bp, Artificial
  CRISPR gRNA sequence
tctgcccaatttgcactgag

SEQ ID NO: 304839 - DNA, 20 bp, Artificial
  CRISPR gRNA sequence
ctgcccaatttgcactgagg

SEQ ID NO: 304840 - DNA, 20 bp, Artificial
  CRISPR gRNA sequence
cactgagggggacataaatt

SEQ ID NO: 304841 - DNA, 20 bp, Artificial
  CRISPR gRNA sequence
ggggacataaatttggctta

SEQ ID NO: 304842 - DNA, 20 bp, Artificial
  CRISPR gRNA sequence
tttggcttatagctttttaa

SEQ ID NO: 304843 - DNA, 20 bp, Artificial
  CRISPR gRNA sequence
tttttaacagccaatgtaaa

SEQ ID NO: 304844 - DNA, 20 bp, Artificial
  CRISPR gRNA sequence
ttttaacagccaatgtaaaa

SEQ ID NO: 304845 - DNA, 20 bp, Artificial
  CRISPR gRNA sequence
tgtaaaaaggaaaacctaac

SEQ ID NO: 304846 - DNA, 20 bp, Artificial
  CRISPR gRNA sequence
ctaaccagtgaattaattca

SEQ ID NO: 304847 - DNA, 20 bp, Artificial
  CRISPR gRNA sequence
taaccagtgaattaattcac

SEQ ID NO: 304848 - DNA, 20 bp, Artificial
  CRISPR gRNA sequence
aggtctgtccactaaattca

SEQ ID NO: 304849 - DNA, 20 bp, Artificial
  CRISPR gRNA sequence
ggtctgtccactaaattcat

SEQ ID NO: 304850 - DNA, 20 bp, Artificial
  CRISPR gRNA sequence
aaaaacaaatcaattctttc

SEQ ID NO: 304851 - DNA, 20 bp, Artificial
  CRISPR gRNA sequence
aaaacaaatcaattctttcc

SEQ ID NO: 304852 - DNA, 20 bp, Artificial
  CRISPR gRNA sequence
aaatcaattctttccaggaa

SEQ ID NO: 304853 - DNA, 20 bp, Artificial
  CRISPR gRNA sequence
cacaactattcttgatcgaa

SEQ ID NO: 304854 - DNA, 20 bp, Artificial
  CRISPR gRNA sequence
aactattcttgatcgaatag

SEQ ID NO: 304855 - DNA, 20 bp, Artificial
  CRISPR gRNA sequence
aatagcagaaatgtatgccc

SEQ ID NO: 304856 - DNA, 20 bp, Artificial
  CRISPR gRNA sequence
gcagaaatgtatgccccaga

SEQ ID NO: 304857 - DNA, 20 bp, Artificial
  CRISPR gRNA sequence
atgccccagacggtgttgtc

SEQ ID NO: 304858 - DNA, 20 bp, Artificial
  CRISPR gRNA sequence
ccccagacggtgttgtctag

SEQ ID NO: 304859 - DNA, 20 bp, Artificial
  CRISPR gRNA sequence
gtttctttcctctgctctca

SEQ ID NO: 304860 - DNA, 20 bp, Artificial
  CRISPR gRNA sequence
tcctctgctctcatagcacc

SEQ ID NO: 304861 - DNA, 20 bp, Artificial
  CRISPR gRNA sequence
tgctctcatagcacccagtg

SEQ ID NO: 304862 - DNA, 20 bp, Artificial
  CRISPR gRNA sequence
gctctcatagcacccagtgc

SEQ ID NO: 304863 - DNA, 20 bp, Artificial
  CRISPR gRNA sequence
tagcacccagtgcaggacat

SEQ ID NO: 304864 - DNA, 20 bp, Artificial
  CRISPR gRNA sequence
agcacccagtgcaggacatt

SEQ ID NO: 304865 - DNA, 20 bp, Artificial
  CRISPR gRNA sequence
cccagtgcaggacattgggc

SEQ ID NO: 304866 - DNA, 20 bp, Artificial
  CRISPR gRNA sequence
agtgcaggacattgggctag

SEQ ID NO: 304867 - DNA, 20 bp, Artificial
  CRISPR gRNA sequence
tgttatgttttttttccttc

SEQ ID NO: 304868 - DNA, 20 bp, Artificial
  CRISPR gRNA sequence
ttttaataaatatttttgaa

SEQ ID NO: 304869 - DNA, 20 bp, Artificial
  CRISPR gRNA sequence
aaatatttttgaatagatca

SEQ ID NO: 304870 - DNA, 20 bp, Artificial
  CRISPR gRNA sequence
atagatcatggtactaaatg

SEQ ID NO: 304871 - DNA, 20 bp, Artificial
  CRISPR gRNA sequence
atcatggtactaaatgtaga

SEQ ID NO: 304872 - DNA, 20 bp, Artificial
  CRISPR gRNA sequence
gtagatggtactaaatttga

SEQ ID NO: 304873 - DNA, 20 bp, Artificial
  CRISPR gRNA sequence
ggtactaaatttgaaagata

SEQ ID NO: 304874 - DNA, 20 bp, Artificial
  CRISPR gRNA sequence
gtactaaatttgaaagataa

SEQ ID NO: 304875 - DNA, 20 bp, Artificial
  CRISPR gRNA sequence
tgaaagataaaggtgataaa

SEQ ID NO: 304876 - DNA, 20 bp, Artificial
  CRISPR gRNA sequence
aagataaaggtgataaatag

SEQ ID NO: 304877 - DNA, 20 bp, Artificial
  CRISPR gRNA sequence
taaaggtgataaatagtgga

SEQ ID NO: 304878 - DNA, 20 bp, Artificial
  CRISPR gRNA sequence
ggtgataaatagtggaaagc

SEQ ID NO: 304879 - DNA, 20 bp, Artificial
  CRISPR gRNA sequence
tggaaagcaagtctgcctcc

SEQ ID NO: 304880 - DNA, 20 bp, Artificial
  CRISPR gRNA sequence
tgcctcccagccttgtccct

SEQ ID NO: 304881 - DNA, 20 bp, Artificial
  CRISPR gRNA sequence
agccttgtcccttagctgtc

SEQ ID NO: 304882 - DNA, 20 bp, Artificial
  CRISPR gRNA sequence
agctgtctagttttcttcca

SEQ ID NO: 304883 - DNA, 20 bp, Artificial
  CRISPR gRNA sequence
ctgtctagttttcttccaca

SEQ ID NO: 304884 - DNA, 20 bp, Artificial
  CRISPR gRNA sequence
tgtctagttttcttccacag

SEQ ID NO: 304885 - DNA, 20 bp, Artificial
  CRISPR gRNA sequence
gttttcttccacagaggtaa

SEQ ID NO: 304886 - DNA, 20 bp, Artificial
  CRISPR gRNA sequence
ttttcttccacagaggtaac

SEQ ID NO: 304887 - DNA, 20 bp, Artificial
  CRISPR gRNA sequence
tttcttccacagaggtaaca

SEQ ID NO: 304888 - DNA, 20 bp, Artificial
  CRISPR gRNA sequence
ttcttccacagaggtaacag

SEQ ID NO: 304889 - DNA, 20 bp, Artificial
  CRISPR gRNA sequence
tgatcactgttacatgttac

SEQ ID NO: 304890 - DNA, 20 bp, Artificial
  CRISPR gRNA sequence
cagtttcttgcctctactta

SEQ ID NO: 304891 - DNA, 20 bp, Artificial
  CRISPR gRNA sequence
gcctctacttaaagttactt

SEQ ID NO: 304892 - DNA, 20 bp, Artificial
  CRISPR gRNA sequence
tctgttttctttttattttt

SEQ ID NO: 304893 - DNA, 20 bp, Artificial
  CRISPR gRNA sequence
tttttatttttaagcacaaa

SEQ ID NO: 304894 - DNA, 20 bp, Artificial
  CRISPR gRNA sequence
ttatttttaagcacaaatgg

SEQ ID NO: 304895 - DNA, 20 bp, Artificial
  CRISPR gRNA sequence
aaatggtagcatactatgta

SEQ ID NO: 304896 - DNA, 20 bp, Artificial
  CRISPR gRNA sequence
ttgcacacatatgactacct

SEQ ID NO: 304897 - DNA, 20 bp, Artificial
  CRISPR gRNA sequence
gcacacatatgactaccttg

SEQ ID NO: 304898 - DNA, 20 bp, Artificial
  CRISPR gRNA sequence
ccttggagattattctgtat

SEQ ID NO: 304899 - DNA, 20 bp, Artificial
  CRISPR gRNA sequence
attctgtatcagcatgtaac

SEQ ID NO: 304900 - DNA, 20 bp, Artificial
  CRISPR gRNA sequence
aacgagtatcctcatgctaa

SEQ ID NO: 304901 - DNA, 20 bp, Artificial
  CRISPR gRNA sequence
tcatgctaaaagttgcatat

SEQ ID NO: 304902 - DNA, 20 bp, Artificial
  CRISPR gRNA sequence
attagtctattgtattctat

SEQ ID NO: 304903 - DNA, 20 bp, Artificial
  CRISPR gRNA sequence
caataatatatatatatttc

SEQ ID NO: 304904 - DNA, 20 bp, Artificial
  CRISPR gRNA sequence
tatatatatttccagaccac

SEQ ID NO: 304905 - DNA, 20 bp, Artificial
  CRISPR gRNA sequence
tatttccagaccactagtga

SEQ ID NO: 304906 - DNA, 20 bp, Artificial
  CRISPR gRNA sequence
tttccaatcttttgttgcaa

SEQ ID NO: 304907 - DNA, 20 bp, Artificial
  CRISPR gRNA sequence
tgattatatgccatatcaca

SEQ ID NO: 304908 - DNA, 20 bp, Artificial
  CRISPR gRNA sequence
gattatatgccatatcacac

SEQ ID NO: 304909 - DNA, 20 bp, Artificial
  CRISPR gRNA sequence
tatatgccatatcacacagg

SEQ ID NO: 304910 - DNA, 20 bp, Artificial
  CRISPR gRNA sequence
atatgccatatcacacaggt

SEQ ID NO: 304911 - DNA, 20 bp, Artificial
  CRISPR gRNA sequence
atgccatatcacacaggtgg

SEQ ID NO: 304912 - DNA, 20 bp, Artificial
  CRISPR gRNA sequence
catatcacacaggtgggagt

SEQ ID NO: 304913 - DNA, 20 bp, Artificial
  CRISPR gRNA sequence
gtgggagtaagctatattcc

SEQ ID NO: 304914 - DNA, 20 bp, Artificial
  CRISPR gRNA sequence
ggagtaagctatattcctag

SEQ ID NO: 304915 - DNA, 20 bp, Artificial
  CRISPR gRNA sequence
gtaagctatattcctagaag

SEQ ID NO: 304916 - DNA, 20 bp, Artificial
  CRISPR gRNA sequence
gaagcagaatcgtttgacca

SEQ ID NO: 304917 - DNA, 20 bp, Artificial
  CRISPR gRNA sequence
aagcagaatcgtttgaccaa

SEQ ID NO: 304918 - DNA, 20 bp, Artificial
  CRISPR gRNA sequence
agcagaatcgtttgaccaaa

SEQ ID NO: 304919 - DNA, 20 bp, Artificial
  CRISPR gRNA sequence
atcgtttgaccaaagggttg

SEQ ID NO: 304920 - DNA, 20 bp, Artificial
  CRISPR gRNA sequence
ttgaccaaagggttgaagaa

SEQ ID NO: 304921 - DNA, 20 bp, Artificial
  CRISPR gRNA sequence
gttgcaaattgttctcccct

SEQ ID NO: 304922 - DNA, 20 bp, Artificial
  CRISPR gRNA sequence
gtttatgctctgatcaacac

SEQ ID NO: 304923 - DNA, 20 bp, Artificial
  CRISPR gRNA sequence
ttatgctctgatcaacacaa

SEQ ID NO: 304924 - DNA, 20 bp, Artificial
  CRISPR gRNA sequence
gttttctaatttgtgatctt

SEQ ID NO: 304925 - DNA, 20 bp, Artificial
  CRISPR gRNA sequence
taatttgtgatctttagcaa

SEQ ID NO: 304926 - DNA, 20 bp, Artificial
  CRISPR gRNA sequence
aatttgtgatctttagcaat

SEQ ID NO: 304927 - DNA, 20 bp, Artificial
  CRISPR gRNA sequence
tgatctttagcaataggaaa

SEQ ID NO: 304928 - DNA, 20 bp, Artificial
  CRISPR gRNA sequence
atggtgaaattacatctcat

SEQ ID NO: 304929 - DNA, 20 bp, Artificial
  CRISPR gRNA sequence
aaattacatctcataagttt

SEQ ID NO: 304930 - DNA, 20 bp, Artificial
  CRISPR gRNA sequence
ttttagaaatctttgttatt

SEQ ID NO: 304931 - DNA, 20 bp, Artificial
  CRISPR gRNA sequence
tgttatttagaaatctttat

SEQ ID NO: 304932 - DNA, 20 bp, Artificial
  CRISPR gRNA sequence
agaaatctttattagtttat

SEQ ID NO: 304933 - DNA, 20 bp, Artificial
  CRISPR gRNA sequence
gtttatgctctgatcaacac

SEQ ID NO: 304934 - DNA, 20 bp, Artificial
  CRISPR gRNA sequence
ttatgctctgatcaacacaa

SEQ ID NO: 304935 - DNA, 20 bp, Artificial
  CRISPR gRNA sequence
gttttctaatttgtgatctt

SEQ ID NO: 304936 - DNA, 20 bp, Artificial
  CRISPR gRNA sequence
taatttgtgatctttagcaa

SEQ ID NO: 304937 - DNA, 20 bp, Artificial
  CRISPR gRNA sequence
aatttgtgatctttagcaat

SEQ ID NO: 304938 - DNA, 20 bp, Artificial
  CRISPR gRNA sequence
tgatctttagcaataggaaa

SEQ ID NO: 304939 - DNA, 20 bp, Artificial
  CRISPR gRNA sequence
gcaataggaaacggtgaaat

SEQ ID NO: 304940 - DNA, 20 bp, Artificial
  CRISPR gRNA sequence
acggtgaaattagatctcat

SEQ ID NO: 304941 - DNA, 20 bp, Artificial
  CRISPR gRNA sequence
aaattagatctcataagttt

SEQ ID NO: 304942 - DNA, 20 bp, Artificial
  CRISPR gRNA sequence
taagttttagaaatctttat

SEQ ID NO: 304943 - DNA, 20 bp, Artificial
  CRISPR gRNA sequence
ttagaaatctttattagttg

SEQ ID NO: 304944 - DNA, 20 bp, Artificial
  CRISPR gRNA sequence
atttgccatcttcacctttt

SEQ ID NO: 304945 - DNA, 20 bp, Artificial
  CRISPR gRNA sequence
atcttcaccttttgagtgta

SEQ ID NO: 304946 - DNA, 20 bp, Artificial
  CRISPR gRNA sequence
ttcaccttttgagtgtacag

SEQ ID NO: 304947 - DNA, 20 bp, Artificial
  CRISPR gRNA sequence
aatacattcacattgttgta

SEQ ID NO: 304948 - DNA, 20 bp, Artificial
  CRISPR gRNA sequence
gtcatcactacatccatctt

SEQ ID NO: 304949 - DNA, 20 bp, Artificial
  CRISPR gRNA sequence
ctctttcatcttgcaaaact

SEQ ID NO: 304950 - DNA, 20 bp, Artificial
  CRISPR gRNA sequence
tcttctttctctcctcctct

SEQ ID NO: 304951 - DNA, 20 bp, Artificial
  CRISPR gRNA sequence
tttccatgaatttgactgct

SEQ ID NO: 304952 - DNA, 20 bp, Artificial
  CRISPR gRNA sequence
ttccatgaatttgactgctt

SEQ ID NO: 304953 - DNA, 20 bp, Artificial
  CRISPR gRNA sequence
tccatgaatttgactgctta

SEQ ID NO: 304954 - DNA, 20 bp, Artificial
  CRISPR gRNA sequence
aatttgactgcttagggtat

SEQ ID NO: 304955 - DNA, 20 bp, Artificial
  CRISPR gRNA sequence
agggtataagtaaactcata

SEQ ID NO: 304956 - DNA, 20 bp, Artificial
  CRISPR gRNA sequence
agtatttgtctttttgtgac

SEQ ID NO: 304957 - DNA, 20 bp, Artificial
  CRISPR gRNA sequence
tgtgactggcttatttcact

SEQ ID NO: 304958 - DNA, 20 bp, Artificial
  CRISPR gRNA sequence
tcacttagtataatgtattc

SEQ ID NO: 304959 - DNA, 20 bp, Artificial
  CRISPR gRNA sequence
cacttagtataatgtattca

SEQ ID NO: 304960 - DNA, 20 bp, Artificial
  CRISPR gRNA sequence
acttagtataatgtattcaa

SEQ ID NO: 304961 - DNA, 20 bp, Artificial
  CRISPR gRNA sequence
ttcaagggccatccacattg

SEQ ID NO: 304962 - DNA, 20 bp, Artificial
  CRISPR gRNA sequence
tttgaatttcctttctttct

SEQ ID NO: 304963 - DNA, 20 bp, Artificial
  CRISPR gRNA sequence
gtttatccattcatttttga

SEQ ID NO: 304964 - DNA, 20 bp, Artificial
  CRISPR gRNA sequence
ttcatttttgatggacattt

SEQ ID NO: 304965 - DNA, 20 bp, Artificial
  CRISPR gRNA sequence
tttgagttgcttccaccttt

SEQ ID NO: 304966 - DNA, 20 bp, Artificial
  CRISPR gRNA sequence
ttggctattgtgcataatgc

SEQ ID NO: 304967 - DNA, 20 bp, Artificial
  CRISPR gRNA sequence
tgcataatgctggtatgaac

SEQ ID NO: 304968 - DNA, 20 bp, Artificial
  CRISPR gRNA sequence
gcataatgctggtatgaaca

SEQ ID NO: 304969 - DNA, 20 bp, Artificial
  CRISPR gRNA sequence
ggctgtatgaatatctcttt

SEQ ID NO: 304970 - DNA, 20 bp, Artificial
  CRISPR gRNA sequence
tctctttaagactctgcttt

SEQ ID NO: 304971 - DNA, 20 bp, Artificial
  CRISPR gRNA sequence
gactctgctttcagttcttt

SEQ ID NO: 304972 - DNA, 20 bp, Artificial
  CRISPR gRNA sequence
actctgctttcagttctttt

SEQ ID NO: 304973 - DNA, 20 bp, Artificial
  CRISPR gRNA sequence
agttcttttgggtatatacc

SEQ ID NO: 304974 - DNA, 20 bp, Artificial
  CRISPR gRNA sequence
tcttttgggtatatacccag

SEQ ID NO: 304975 - DNA, 20 bp, Artificial
  CRISPR gRNA sequence
cttttgggtatatacccaga

SEQ ID NO: 304976 - DNA, 20 bp, Artificial
  CRISPR gRNA sequence
ttttgggtatatacccagaa

SEQ ID NO: 304977 - DNA, 20 bp, Artificial
  CRISPR gRNA sequence
tttgggtatatacccagaag

SEQ ID NO: 304978 - DNA, 20 bp, Artificial
  CRISPR gRNA sequence
atacccagaaggggaattgc

SEQ ID NO: 304979 - DNA, 20 bp, Artificial
  CRISPR gRNA sequence
aggggaattgctagatcatg

SEQ ID NO: 304980 - DNA, 20 bp, Artificial
  CRISPR gRNA sequence
cattctatttttaattttct

SEQ ID NO: 304981 - DNA, 20 bp, Artificial
  CRISPR gRNA sequence
attctatttttaattttctg

SEQ ID NO: 304982 - DNA, 20 bp, Artificial
  CRISPR gRNA sequence
aactgctacactattttcca

SEQ ID NO: 304983 - DNA, 20 bp, Artificial
  CRISPR gRNA sequence
tgctacactattttccatag

SEQ ID NO: 304984 - DNA, 20 bp, Artificial
  CRISPR gRNA sequence
tttacattcccatcgacaac

SEQ ID NO: 304985 - DNA, 20 bp, Artificial
  CRISPR gRNA sequence
ttcccatcgacaactggaac

SEQ ID NO: 304986 - DNA, 20 bp, Artificial
  CRISPR gRNA sequence
cccatcgacaactggaacaa

SEQ ID NO: 304987 - DNA, 20 bp, Artificial
  CRISPR gRNA sequence
caattctcatattctgtgat

SEQ ID NO: 304988 - DNA, 20 bp, Artificial
  CRISPR gRNA sequence
ttctcatattctgtgataag

SEQ ID NO: 304989 - DNA, 20 bp, Artificial
  CRISPR gRNA sequence
tctcatattctgtgataagt

SEQ ID NO: 304990 - DNA, 20 bp, Artificial
  CRISPR gRNA sequence
tgtgataagtaggttgctgt

SEQ ID NO: 304991 - DNA, 20 bp, Artificial
  CRISPR gRNA sequence
gtaggttgctgttggtgatt

SEQ ID NO: 304992 - DNA, 20 bp, Artificial
  CRISPR gRNA sequence
tgctgttggtgatttagtat

SEQ ID NO: 304993 - DNA, 20 bp, Artificial
  CRISPR gRNA sequence
gctgttggtgatttagtatg

SEQ ID NO: 304994 - DNA, 20 bp, Artificial
  CRISPR gRNA sequence
gttggtgatttagtatgagg

SEQ ID NO: 304995 - DNA, 20 bp, Artificial
  CRISPR gRNA sequence
atttagtatgaggaagctca

SEQ ID NO: 304996 - DNA, 20 bp, Artificial
  CRISPR gRNA sequence
tttagtatgaggaagctcac

SEQ ID NO: 304997 - DNA, 20 bp, Artificial
  CRISPR gRNA sequence
atgaggaagctcacaggaat

SEQ ID NO: 304998 - DNA, 20 bp, Artificial
  CRISPR gRNA sequence
ggaagctcacaggaatcaga

SEQ ID NO: 304999 - DNA, 20 bp, Artificial
  CRISPR gRNA sequence
aagctcacaggaatcagaca

SEQ ID NO: 305000 - DNA, 20 bp, Artificial
  CRISPR gRNA sequence
tcccatactctgcgcttgtg

SEQ ID NO: 305001 - DNA, 20 bp, Artificial
  CRISPR gRNA sequence
actctgcgcttgtgtggtgt

SEQ ID NO: 305002 - DNA, 20 bp, Artificial
  CRISPR gRNA sequence
cgcttgtgtggtgtcagctt

SEQ ID NO: 305003 - DNA, 20 bp, Artificial
  CRISPR gRNA sequence
tggtgtcagctttggctcaa

SEQ ID NO: 305004 - DNA, 20 bp, Artificial
  CRISPR gRNA sequence
ggtgtcagctttggctcaat

SEQ ID NO: 305005 - DNA, 20 bp, Artificial
  CRISPR gRNA sequence
gcccaaactctgaaatctat

SEQ ID NO: 305006 - DNA, 20 bp, Artificial
  CRISPR gRNA sequence
aaactctgaaatctattggc

SEQ ID NO: 305007 - DNA, 20 bp, Artificial
  CRISPR gRNA sequence
ctctgaaatctattggctgg

SEQ ID NO: 305008 - DNA, 20 bp, Artificial
  CRISPR gRNA sequence
tctgaaatctattggctgga

SEQ ID NO: 305009 - DNA, 20 bp, Artificial
  CRISPR gRNA sequence
ctgaaatctattggctggaa

SEQ ID NO: 305010 - DNA, 20 bp, Artificial
  CRISPR gRNA sequence
gaaatctattggctggaagg

SEQ ID NO: 305011 - DNA, 20 bp, Artificial
  CRISPR gRNA sequence
aaatctattggctggaaggg

SEQ ID NO: 305012 - DNA, 20 bp, Artificial
  CRISPR gRNA sequence
aatctattggctggaaggga

SEQ ID NO: 305013 - DNA, 20 bp, Artificial
  CRISPR gRNA sequence
tctattggctggaagggagg

SEQ ID NO: 305014 - DNA, 20 bp, Artificial
  CRISPR gRNA sequence
ttggctggaagggagggaga

SEQ ID NO: 305015 - DNA, 20 bp, Artificial
  CRISPR gRNA sequence
gaagggagggagacagcaat

SEQ ID NO: 305016 - DNA, 20 bp, Artificial
  CRISPR gRNA sequence
aagggagggagacagcaatc

SEQ ID NO: 305017 - DNA, 20 bp, Artificial
  CRISPR gRNA sequence
gggagacagcaatcaggaac

SEQ ID NO: 305018 - DNA, 20 bp, Artificial
  CRISPR gRNA sequence
gcaatcaggaaccagctgtt

SEQ ID NO: 305019 - DNA, 20 bp, Artificial
  CRISPR gRNA sequence
ccagctgttcagctcttaca

SEQ ID NO: 305020 - DNA, 20 bp, Artificial
  CRISPR gRNA sequence
ggaacacctactgtgtattt

SEQ ID NO: 305021 - DNA, 20 bp, Artificial
  CRISPR gRNA sequence
caactgaaaatatttgcaac

SEQ ID NO: 305022 - DNA, 20 bp, Artificial
  CRISPR gRNA sequence
aatatttgcaactagtcaca

SEQ ID NO: 305023 - DNA, 20 bp, Artificial
  CRISPR gRNA sequence
tattaattttctatgtataa

SEQ ID NO: 305024 - DNA, 20 bp, Artificial
  CRISPR gRNA sequence
ttaattttctatgtataaaa

SEQ ID NO: 305025 - DNA, 20 bp, Artificial
  CRISPR gRNA sequence
aagagcttctataaatcaat

SEQ ID NO: 305026 - DNA, 20 bp, Artificial
  CRISPR gRNA sequence
ttctataaatcaataagaaa

SEQ ID NO: 305027 - DNA, 20 bp, Artificial
  CRISPR gRNA sequence
tctataaatcaataagaaaa

SEQ ID NO: 305028 - DNA, 20 bp, Artificial
  CRISPR gRNA sequence
aatcaataagaaaaaggcca

SEQ ID NO: 305029 - DNA, 20 bp, Artificial
  CRISPR gRNA sequence
aggccaaagacccaaactaa

SEQ ID NO: 305030 - DNA, 20 bp, Artificial
  CRISPR gRNA sequence
ccaaagacccaaactaaaag

SEQ ID NO: 305031 - DNA, 20 bp, Artificial
  CRISPR gRNA sequence
caaagacccaaactaaaagc

SEQ ID NO: 305032 - DNA, 20 bp, Artificial
  CRISPR gRNA sequence
cccaaactaaaagcgggcaa

SEQ ID NO: 305033 - DNA, 20 bp, Artificial
  CRISPR gRNA sequence
aagcgggcaaaagaaatgta

SEQ ID NO: 305034 - DNA, 20 bp, Artificial
  CRISPR gRNA sequence
gggcaaaagaaatgtacaga

SEQ ID NO: 305035 - DNA, 20 bp, Artificial
  CRISPR gRNA sequence
agaaatgtacagatagtatg

SEQ ID NO: 305036 - DNA, 20 bp, Artificial
  CRISPR gRNA sequence
gtacagatagtatgtggaac

SEQ ID NO: 305037 - DNA, 20 bp, Artificial
  CRISPR gRNA sequence
aactatctcatacatttgaa

SEQ ID NO: 305038 - DNA, 20 bp, Artificial
  CRISPR gRNA sequence
atctcatacatttgaaaaga

SEQ ID NO: 305039 - DNA, 20 bp, Artificial
  CRISPR gRNA sequence
gatggtcatactcaaaataa

SEQ ID NO: 305040 - DNA, 20 bp, Artificial
  CRISPR gRNA sequence
agaaattcaatataaaatga

SEQ ID NO: 305041 - DNA, 20 bp, Artificial
  CRISPR gRNA sequence
attcaatataaaatgacagt

SEQ ID NO: 305042 - DNA, 20 bp, Artificial
  CRISPR gRNA sequence
gagaacaacttcctactcat

SEQ ID NO: 305043 - DNA, 20 bp, Artificial
  CRISPR gRNA sequence
agaacaacttcctactcatt

SEQ ID NO: 305044 - DNA, 20 bp, Artificial
  CRISPR gRNA sequence
caacttcctactcattaggc

SEQ ID NO: 305045 - DNA, 20 bp, Artificial
  CRISPR gRNA sequence
acaaaaaaaaaaaaaaaaaa

SEQ ID NO: 305046 - DNA, 20 bp, Artificial
  CRISPR gRNA sequence
aaaaaaaaaaaaaaaaaaaa

SEQ ID NO: 305047 - DNA, 20 bp, Artificial
  CRISPR gRNA sequence
aaaaaaaaaaaaaaaaaaag

SEQ ID NO: 305048 - DNA, 20 bp, Artificial
  CRISPR gRNA sequence
aaaaaaaaaaaaaaaaaaga

SEQ ID NO: 305049 - DNA, 20 bp, Artificial
  CRISPR gRNA sequence
atctgaactcccacctaata

SEQ ID NO: 305050 - DNA, 20 bp, Artificial
  CRISPR gRNA sequence
tctgaactcccacctaatat

SEQ ID NO: 305051 - DNA, 20 bp, Artificial
  CRISPR gRNA sequence
cctaatatgggaatcgctca

SEQ ID NO: 305052 - DNA, 20 bp, Artificial
  CRISPR gRNA sequence
cattatgttcgacctaacca

SEQ ID NO: 305053 - DNA, 20 bp, Artificial
  CRISPR gRNA sequence
accaaagacaatttttcttc

SEQ ID NO: 305054 - DNA, 20 bp, Artificial
  CRISPR gRNA sequence
ccaaagacaatttttcttct

SEQ ID NO: 305055 - DNA, 20 bp, Artificial
  CRISPR gRNA sequence
caaagacaatttttcttctg

SEQ ID NO: 305056 - DNA, 20 bp, Artificial
  CRISPR gRNA sequence
agacaatttttcttctgggg

SEQ ID NO: 305057 - DNA, 20 bp, Artificial
  CRISPR gRNA sequence
ttctggggtggcatgacaaa

SEQ ID NO: 305058 - DNA, 20 bp, Artificial
  CRISPR gRNA sequence
tctggggtggcatgacaaac

SEQ ID NO: 305059 - DNA, 20 bp, Artificial
  CRISPR gRNA sequence
ctggggtggcatgacaaaca

SEQ ID NO: 305060 - DNA, 20 bp, Artificial
  CRISPR gRNA sequence
ttcaaataattacatgaaat

SEQ ID NO: 305061 - DNA, 20 bp, Artificial
  CRISPR gRNA sequence
catgaaatcagtattgctct

SEQ ID NO: 305062 - DNA, 20 bp, Artificial
  CRISPR gRNA sequence
atgaaatcagtattgctcta

SEQ ID NO: 305063 - DNA, 20 bp, Artificial
  CRISPR gRNA sequence
agtattgctctaaggaatct

SEQ ID NO: 305064 - DNA, 20 bp, Artificial
  CRISPR gRNA sequence
tctaaggaatcttggacaaa

SEQ ID NO: 305065 - DNA, 20 bp, Artificial
  CRISPR gRNA sequence
aatggcccctgtaattcaca

SEQ ID NO: 305066 - DNA, 20 bp, Artificial
  CRISPR gRNA sequence
ggcccctgtaattcacacag

SEQ ID NO: 305067 - DNA, 20 bp, Artificial
  CRISPR gRNA sequence
gcccctgtaattcacacagt

SEQ ID NO: 305068 - DNA, 20 bp, Artificial
  CRISPR gRNA sequence
cccctgtaattcacacagtg

SEQ ID NO: 305069 - DNA, 20 bp, Artificial
  CRISPR gRNA sequence
cctgtaattcacacagtggg

SEQ ID NO: 305070 - DNA, 20 bp, Artificial
  CRISPR gRNA sequence
gtaattcacacagtggggag

SEQ ID NO: 305071 - DNA, 20 bp, Artificial
  CRISPR gRNA sequence
ggagaagcactgaccctgac

SEQ ID NO: 305072 - DNA, 20 bp, Artificial
  CRISPR gRNA sequence
gagaagcactgaccctgaca

SEQ ID NO: 305073 - DNA, 20 bp, Artificial
  CRISPR gRNA sequence
cactgaccctgacaaggaat

SEQ ID NO: 305074 - DNA, 20 bp, Artificial
  CRISPR gRNA sequence
cagtaccatttttgatttct

SEQ ID NO: 305075 - DNA, 20 bp, Artificial
  CRISPR gRNA sequence
ccatttttgatttctcagtt

SEQ ID NO: 305076 - DNA, 20 bp, Artificial
  CRISPR gRNA sequence
ttggaaactctctcttcccc

SEQ ID NO: 305077 - DNA, 20 bp, Artificial
  CRISPR gRNA sequence
tggaaactctctcttcccct

SEQ ID NO: 305078 - DNA, 20 bp, Artificial
  CRISPR gRNA sequence
aactctctcttcccctgggt

SEQ ID NO: 305079 - DNA, 20 bp, Artificial
  CRISPR gRNA sequence
tctctcttcccctgggttag

SEQ ID NO: 305080 - DNA, 20 bp, Artificial
  CRISPR gRNA sequence
taccttccttccgtcaatac

SEQ ID NO: 305081 - DNA, 20 bp, Artificial
  CRISPR gRNA sequence
aatactagttttgtcctctg

SEQ ID NO: 305082 - DNA, 20 bp, Artificial
  CRISPR gRNA sequence
ttttgtcctctgaagctatc

SEQ ID NO: 305083 - DNA, 20 bp, Artificial
  CRISPR gRNA sequence
ttgtcctctgaagctatcca

SEQ ID NO: 305084 - DNA, 20 bp, Artificial
  CRISPR gRNA sequence
cctctgaagctatccagagt

SEQ ID NO: 305085 - DNA, 20 bp, Artificial
  CRISPR gRNA sequence
agcctaacacacttctgcca

SEQ ID NO: 305086 - DNA, 20 bp, Artificial
  CRISPR gRNA sequence
cacttctgccaaagtctgtc

SEQ ID NO: 305087 - DNA, 20 bp, Artificial
  CRISPR gRNA sequence
acttctgccaaagtctgtca

SEQ ID NO: 305088 - DNA, 20 bp, Artificial
  CRISPR gRNA sequence
gccaaagtctgtcaaggatt

SEQ ID NO: 305089 - DNA, 20 bp, Artificial
  CRISPR gRNA sequence
gtctgtcaaggatttggtga

SEQ ID NO: 305090 - DNA, 20 bp, Artificial
  CRISPR gRNA sequence
cacatctctcctcaaaatcc

SEQ ID NO: 305091 - DNA, 20 bp, Artificial
  CRISPR gRNA sequence
ctctcctcaaaatcctggcc

SEQ ID NO: 305092 - DNA, 20 bp, Artificial
  CRISPR gRNA sequence
ctcaaaatcctggcctggcc

SEQ ID NO: 305093 - DNA, 20 bp, Artificial
  CRISPR gRNA sequence
tcaaaatcctggcctggccc

SEQ ID NO: 305094 - DNA, 20 bp, Artificial
  CRISPR gRNA sequence
aaaatcctggcctggcccag

SEQ ID NO: 305095 - DNA, 20 bp, Artificial
  CRISPR gRNA sequence
cccaggagtaacaatccttc

SEQ ID NO: 305096 - DNA, 20 bp, Artificial
  CRISPR gRNA sequence
ggagtaacaatccttccagt

SEQ ID NO: 305097 - DNA, 20 bp, Artificial
  CRISPR gRNA sequence
aagcttcactaatgttaatt

SEQ ID NO: 305098 - DNA, 20 bp, Artificial
  CRISPR gRNA sequence
gcttcactaatgttaatttg

SEQ ID NO: 305099 - DNA, 20 bp, Artificial
  CRISPR gRNA sequence
ttggagaccacacaccatcc

SEQ ID NO: 305100 - DNA, 20 bp, Artificial
  CRISPR gRNA sequence
caccatcctagaaaacactc

SEQ ID NO: 305101 - DNA, 20 bp, Artificial
  CRISPR gRNA sequence
tagaaaacactctggacact

SEQ ID NO: 305102 - DNA, 20 bp, Artificial
  CRISPR gRNA sequence
actctggacacttagtttat

SEQ ID NO: 305103 - DNA, 20 bp, Artificial
  CRISPR gRNA sequence
tatcagtgaccctgctgtaa

SEQ ID NO: 305104 - DNA, 20 bp, Artificial
  CRISPR gRNA sequence
atcagtgaccctgctgtaat

SEQ ID NO: 305105 - DNA, 20 bp, Artificial
  CRISPR gRNA sequence
aataggatgttaaaatactc

SEQ ID NO: 305106 - DNA, 20 bp, Artificial
  CRISPR gRNA sequence
tgatatgattttctttcatg

SEQ ID NO: 305107 - DNA, 20 bp, Artificial
  CRISPR gRNA sequence
gattttctttcatgaagtac

SEQ ID NO: 305108 - DNA, 20 bp, Artificial
  CRISPR gRNA sequence
aagtacaagtgccccatatg

SEQ ID NO: 305109 - DNA, 20 bp, Artificial
  CRISPR gRNA sequence
tgaagaatttctctccattc

SEQ ID NO: 305110 - DNA, 20 bp, Artificial
  CRISPR gRNA sequence
gatgtgtgatgtgtgtgtgc

SEQ ID NO: 305111 - DNA, 20 bp, Artificial
  CRISPR gRNA sequence
atgtgtgatgtgtgtgtgcg

SEQ ID NO: 305112 - DNA, 20 bp, Artificial
  CRISPR gRNA sequence
tgtgtgatgtgtgtgtgcga

SEQ ID NO: 305113 - DNA, 20 bp, Artificial
  CRISPR gRNA sequence
gatgtgtgtgtgcgagggtg

SEQ ID NO: 305114 - DNA, 20 bp, Artificial
  CRISPR gRNA sequence
atgtgtgtgtgcgagggtgt

SEQ ID NO: 305115 - DNA, 20 bp, Artificial
  CRISPR gRNA sequence
gtgtgtgcgagggtgtgggc

SEQ ID NO: 305116 - DNA, 20 bp, Artificial
  CRISPR gRNA sequence
tgtgtgcgagggtgtgggct

SEQ ID NO: 305117 - DNA, 20 bp, Artificial
  CRISPR gRNA sequence
tgcgagggtgtgggctgggt

SEQ ID NO: 305118 - DNA, 20 bp, Artificial
  CRISPR gRNA sequence
gcgagggtgtgggctgggtt

SEQ ID NO: 305119 - DNA, 20 bp, Artificial
  CRISPR gRNA sequence
agggtgtgggctgggttagg

SEQ ID NO: 305120 - DNA, 20 bp, Artificial
  CRISPR gRNA sequence
tgtgggctgggttaggaagc

SEQ ID NO: 305121 - DNA, 20 bp, Artificial
  CRISPR gRNA sequence
gccagtttctccaatgtcat

SEQ ID NO: 305122 - DNA, 20 bp, Artificial
  CRISPR gRNA sequence
ctccaatgtcattggccgtg

SEQ ID NO: 305123 - DNA, 20 bp, Artificial
  CRISPR gRNA sequence
caatgtcattggccgtgaag

SEQ ID NO: 305124 - DNA, 20 bp, Artificial
  CRISPR gRNA sequence
tcattggccgtgaagaagtg

SEQ ID NO: 305125 - DNA, 20 bp, Artificial
  CRISPR gRNA sequence
tagaaatgtccccactccct

SEQ ID NO: 305126 - DNA, 20 bp, Artificial
  CRISPR gRNA sequence
agaaatgtccccactccctc

SEQ ID NO: 305127 - DNA, 20 bp, Artificial
  CRISPR gRNA sequence
aatgaacctccaaccacaac

SEQ ID NO: 305128 - DNA, 20 bp, Artificial
  CRISPR gRNA sequence
gaacctccaaccacaaccag

SEQ ID NO: 305129 - DNA, 20 bp, Artificial
  CRISPR gRNA sequence
ccagaagccataactttctc

SEQ ID NO: 305130 - DNA, 20 bp, Artificial
  CRISPR gRNA sequence
gaagccataactttctccag

SEQ ID NO: 305131 - DNA, 20 bp, Artificial
  CRISPR gRNA sequence
aagccataactttctccagt

SEQ ID NO: 305132 - DNA, 20 bp, Artificial
  CRISPR gRNA sequence
ctttctccagtgggcctgta

SEQ ID NO: 305133 - DNA, 20 bp, Artificial
  CRISPR gRNA sequence
tctccagtgggcctgtaaag

SEQ ID NO: 305134 - DNA, 20 bp, Artificial
  CRISPR gRNA sequence
aaagtggaaactcttgcctt

SEQ ID NO: 305135 - DNA, 20 bp, Artificial
  CRISPR gRNA sequence
agtggaaactcttgccttcg

SEQ ID NO: 305136 - DNA, 20 bp, Artificial
  CRISPR gRNA sequence
gtggaaactcttgccttcgg

SEQ ID NO: 305137 - DNA, 20 bp, Artificial
  CRISPR gRNA sequence
tggaaactcttgccttcgga

SEQ ID NO: 305138 - DNA, 20 bp, Artificial
  CRISPR gRNA sequence
gaaactcttgccttcggagg

SEQ ID NO: 305139 - DNA, 20 bp, Artificial
  CRISPR gRNA sequence
aactcttgccttcggaggga

SEQ ID NO: 305140 - DNA, 20 bp, Artificial
  CRISPR gRNA sequence
ctcttgccttcggagggaga

SEQ ID NO: 305141 - DNA, 20 bp, Artificial
  CRISPR gRNA sequence
cttcggagggagagagcaaa

SEQ ID NO: 305142 - DNA, 20 bp, Artificial
  CRISPR gRNA sequence
ttcggagggagagagcaaaa

SEQ ID NO: 305143 - DNA, 20 bp, Artificial
  CRISPR gRNA sequence
tcggagggagagagcaaaaa

SEQ ID NO: 305144 - DNA, 20 bp, Artificial
  CRISPR gRNA sequence
cggagggagagagcaaaaag

SEQ ID NO: 305145 - DNA, 20 bp, Artificial
  CRISPR gRNA sequence
ggagagagcaaaaaggggaa

SEQ ID NO: 305146 - DNA, 20 bp, Artificial
  CRISPR gRNA sequence
gagagcaaaaaggggaatgg

SEQ ID NO: 305147 - DNA, 20 bp, Artificial
  CRISPR gRNA sequence
gagcaaaaaggggaatggaa

SEQ ID NO: 305148 - DNA, 20 bp, Artificial
  CRISPR gRNA sequence
agcaaaaaggggaatggaag

SEQ ID NO: 305149 - DNA, 20 bp, Artificial
  CRISPR gRNA sequence
aaaaggggaatggaagagga

SEQ ID NO: 305150 - DNA, 20 bp, Artificial
  CRISPR gRNA sequence
aatggaagaggaaagaacct

SEQ ID NO: 305151 - DNA, 20 bp, Artificial
  CRISPR gRNA sequence
gaaagaacctaagaatttac

SEQ ID NO: 305152 - DNA, 20 bp, Artificial
  CRISPR gRNA sequence
aaagaacctaagaatttacc

SEQ ID NO: 305153 - DNA, 20 bp, Artificial
  CRISPR gRNA sequence
aagaacctaagaatttaccg

SEQ ID NO: 305154 - DNA, 20 bp, Artificial
  CRISPR gRNA sequence
agaacctaagaatttaccgg

SEQ ID NO: 305155 - DNA, 20 bp, Artificial
  CRISPR gRNA sequence
gaacctaagaatttaccggg

SEQ ID NO: 305156 - DNA, 20 bp, Artificial
  CRISPR gRNA sequence
atttaccggggggattctct

SEQ ID NO: 305157 - DNA, 20 bp, Artificial
  CRISPR gRNA sequence
ttaccggggggattctctga

SEQ ID NO: 305158 - DNA, 20 bp, Artificial
  CRISPR gRNA sequence
taccggggggattctctgag

SEQ ID NO: 305159 - DNA, 20 bp, Artificial
  CRISPR gRNA sequence
ccggggggattctctgagag

SEQ ID NO: 305160 - DNA, 20 bp, Artificial
  CRISPR gRNA sequence
ctctgagaggagatttctgt

SEQ ID NO: 305161 - DNA, 20 bp, Artificial
  CRISPR gRNA sequence
agaggagatttctgtcagct

SEQ ID NO: 305162 - DNA, 20 bp, Artificial
  CRISPR gRNA sequence
agatttctgtcagctaagca

SEQ ID NO: 305163 - DNA, 20 bp, Artificial
  CRISPR gRNA sequence
ctgtcagctaagcacagaat

SEQ ID NO: 305164 - DNA, 20 bp, Artificial
  CRISPR gRNA sequence
tgtcagctaagcacagaata

SEQ ID NO: 305165 - DNA, 20 bp, Artificial
  CRISPR gRNA sequence
acagaataaggtctatgaat

SEQ ID NO: 305166 - DNA, 20 bp, Artificial
  CRISPR gRNA sequence
cagaataaggtctatgaata

SEQ ID NO: 305167 - DNA, 20 bp, Artificial
  CRISPR gRNA sequence
aataaggtctatgaataagg

SEQ ID NO: 305168 - DNA, 20 bp, Artificial
  CRISPR gRNA sequence
ataaggtctatgaataaggt

SEQ ID NO: 305169 - DNA, 20 bp, Artificial
  CRISPR gRNA sequence
tatgaataaggtgggtgaac

SEQ ID NO: 305170 - DNA, 20 bp, Artificial
  CRISPR gRNA sequence
aataaggtgggtgaactagt

SEQ ID NO: 305171 - DNA, 20 bp, Artificial
  CRISPR gRNA sequence
gaactagtcagaaatctaaa

SEQ ID NO: 305172 - DNA, 20 bp, Artificial
  CRISPR gRNA sequence
actagtcagaaatctaaaaa

SEQ ID NO: 305173 - DNA, 20 bp, Artificial
  CRISPR gRNA sequence
ctagtcagaaatctaaaaag

SEQ ID NO: 305174 - DNA, 20 bp, Artificial
  CRISPR gRNA sequence
agtcagaaatctaaaaagag

SEQ ID NO: 305175 - DNA, 20 bp, Artificial
  CRISPR gRNA sequence
aagaggagcctccatgtaaa

SEQ ID NO: 305176 - DNA, 20 bp, Artificial
  CRISPR gRNA sequence
gaggagcctccatgtaaatg

SEQ ID NO: 305177 - DNA, 20 bp, Artificial
  CRISPR gRNA sequence
aggagcctccatgtaaatgg

SEQ ID NO: 305178 - DNA, 20 bp, Artificial
  CRISPR gRNA sequence
atgtaaatggaggttcactc

SEQ ID NO: 305179 - DNA, 20 bp, Artificial
  CRISPR gRNA sequence
ggaggttcactccagaaacc

SEQ ID NO: 305180 - DNA, 20 bp, Artificial
  CRISPR gRNA sequence
ggttcactccagaaaccaag

SEQ ID NO: 305181 - DNA, 20 bp, Artificial
  CRISPR gRNA sequence
ttcactccagaaaccaagaa

SEQ ID NO: 305182 - DNA, 20 bp, Artificial
  CRISPR gRNA sequence
tttcacttactttgtatgtc

SEQ ID NO: 305183 - DNA, 20 bp, Artificial
  CRISPR gRNA sequence
actttgtatgtctggcccat

SEQ ID NO: 305184 - DNA, 20 bp, Artificial
  CRISPR gRNA sequence
tttgtatgtctggcccatca

SEQ ID NO: 305185 - DNA, 20 bp, Artificial
  CRISPR gRNA sequence
gcccatcagagaacatgaat

SEQ ID NO: 305186 - DNA, 20 bp, Artificial
  CRISPR gRNA sequence
ccatcagagaacatgaataa

SEQ ID NO: 305187 - DNA, 20 bp, Artificial
  CRISPR gRNA sequence
cagagaacatgaataagagt

SEQ ID NO: 305188 - DNA, 20 bp, Artificial
  CRISPR gRNA sequence
catattattactgctcacaa

SEQ ID NO: 305189 - DNA, 20 bp, Artificial
  CRISPR gRNA sequence
atattattactgctcacaac

SEQ ID NO: 305190 - DNA, 20 bp, Artificial
  CRISPR gRNA sequence
tattattactgctcacaaca

SEQ ID NO: 305191 - DNA, 20 bp, Artificial
  CRISPR gRNA sequence
attactgctcacaacagggt

SEQ ID NO: 305192 - DNA, 20 bp, Artificial
  CRISPR gRNA sequence
gattatttgtccccatgtta

SEQ ID NO: 305193 - DNA, 20 bp, Artificial
  CRISPR gRNA sequence
ttgtccccatgttacagatg

SEQ ID NO: 305194 - DNA, 20 bp, Artificial
  CRISPR gRNA sequence
tgtccccatgttacagatga

SEQ ID NO: 305195 - DNA, 20 bp, Artificial
  CRISPR gRNA sequence
ccatgttacagatgaaggaa

SEQ ID NO: 305196 - DNA, 20 bp, Artificial
  CRISPR gRNA sequence
atgttacagatgaaggaatg

SEQ ID NO: 305197 - DNA, 20 bp, Artificial
  CRISPR gRNA sequence
cagatgaaggaatggagtct

SEQ ID NO: 305198 - DNA, 20 bp, Artificial
  CRISPR gRNA sequence
gatgaaggaatggagtctca

SEQ ID NO: 305199 - DNA, 20 bp, Artificial
  CRISPR gRNA sequence
tgaaggaatggagtctcaga

SEQ ID NO: 305200 - DNA, 20 bp, Artificial
  CRISPR gRNA sequence
gaaggaatggagtctcagag

SEQ ID NO: 305201 - DNA, 20 bp, Artificial
  CRISPR gRNA sequence
atggagtctcagagaggtca

SEQ ID NO: 305202 - DNA, 20 bp, Artificial
  CRISPR gRNA sequence
agaggtcacagtacttgccc

SEQ ID NO: 305203 - DNA, 20 bp, Artificial
  CRISPR gRNA sequence
gaggtcacagtacttgccct

SEQ ID NO: 305204 - DNA, 20 bp, Artificial
  CRISPR gRNA sequence
agtacttgccctaggctgcc

SEQ ID NO: 305205 - DNA, 20 bp, Artificial
  CRISPR gRNA sequence
cttgccctaggctgcccagc

SEQ ID NO: 305206 - DNA, 20 bp, Artificial
  CRISPR gRNA sequence
taggctgcccagctagtaaa

SEQ ID NO: 305207 - DNA, 20 bp, Artificial
  CRISPR gRNA sequence
tgcccagctagtaaatggta

SEQ ID NO: 305208 - DNA, 20 bp, Artificial
  CRISPR gRNA sequence
agctagtaaatggtacagct

SEQ ID NO: 305209 - DNA, 20 bp, Artificial
  CRISPR gRNA sequence
agctgagatttaaacccatg

SEQ ID NO: 305210 - DNA, 20 bp, Artificial
  CRISPR gRNA sequence
cctgtgtttctttcacacac

SEQ ID NO: 305211 - DNA, 20 bp, Artificial
  CRISPR gRNA sequence
gtttctttcacacactggtg

SEQ ID NO: 305212 - DNA, 20 bp, Artificial
  CRISPR gRNA sequence
gcacgtttaaaaatgccaac

SEQ ID NO: 305213 - DNA, 20 bp, Artificial
  CRISPR gRNA sequence
aaccagtttttgctctgcca

SEQ ID NO: 305214 - DNA, 20 bp, Artificial
  CRISPR gRNA sequence
accagtttttgctctgccac

SEQ ID NO: 305215 - DNA, 20 bp, Artificial
  CRISPR gRNA sequence
cagtttttgctctgccacag

SEQ ID NO: 305216 - DNA, 20 bp, Artificial
  CRISPR gRNA sequence
ttttgctctgccacaggagc

SEQ ID NO: 305217 - DNA, 20 bp, Artificial
  CRISPR gRNA sequence
tgctctgccacaggagccag

SEQ ID NO: 305218 - DNA, 20 bp, Artificial
  CRISPR gRNA sequence
ctgccacaggagccagtgga

SEQ ID NO: 305219 - DNA, 20 bp, Artificial
  CRISPR gRNA sequence
tgccacaggagccagtggaa

SEQ ID NO: 305220 - DNA, 20 bp, Artificial
  CRISPR gRNA sequence
gaaaggactctgatgttatc

SEQ ID NO: 305221 - DNA, 20 bp, Artificial
  CRISPR gRNA sequence
tctgatgttatctagcctct

SEQ ID NO: 305222 - DNA, 20 bp, Artificial
  CRISPR gRNA sequence
atgttatctagcctctgaga

SEQ ID NO: 305223 - DNA, 20 bp, Artificial
  CRISPR gRNA sequence
tatctagcctctgagacaga

SEQ ID NO: 305224 - DNA, 20 bp, Artificial
  CRISPR gRNA sequence
atctagcctctgagacagac

SEQ ID NO: 305225 - DNA, 20 bp, Artificial
  CRISPR gRNA sequence
ctagcctctgagacagacgg

SEQ ID NO: 305226 - DNA, 20 bp, Artificial
  CRISPR gRNA sequence
gcctctgagacagacgggag

SEQ ID NO: 305227 - DNA, 20 bp, Artificial
  CRISPR gRNA sequence
tgagacagacgggagcagca

SEQ ID NO: 305228 - DNA, 20 bp, Artificial
  CRISPR gRNA sequence
cagacgggagcagcacagcc

SEQ ID NO: 305229 - DNA, 20 bp, Artificial
  CRISPR gRNA sequence
agacgggagcagcacagcct

SEQ ID NO: 305230 - DNA, 20 bp, Artificial
  CRISPR gRNA sequence
gacgggagcagcacagccta

SEQ ID NO: 305231 - DNA, 20 bp, Artificial
  CRISPR gRNA sequence
ggagcagcacagcctagggc

SEQ ID NO: 305232 - DNA, 20 bp, Artificial
  CRISPR gRNA sequence
gagcagcacagcctagggcc

SEQ ID NO: 305233 - DNA, 20 bp, Artificial
  CRISPR gRNA sequence
cagcctagggccaggtgtga

SEQ ID NO: 305234 - DNA, 20 bp, Artificial
  CRISPR gRNA sequence
cctagggccaggtgtgatgg

SEQ ID NO: 305235 - DNA, 20 bp, Artificial
  CRISPR gRNA sequence
ccaggtgtgatggtggctcc

SEQ ID NO: 305236 - DNA, 20 bp, Artificial
  CRISPR gRNA sequence
tgatggtggctcctggaatc

SEQ ID NO: 305237 - DNA, 20 bp, Artificial
  CRISPR gRNA sequence
atggtggctcctggaatcga

SEQ ID NO: 305238 - DNA, 20 bp, Artificial
  CRISPR gRNA sequence
tggtggctcctggaatcgag

SEQ ID NO: 305239 - DNA, 20 bp, Artificial
  CRISPR gRNA sequence
cctggaatcgagaggactct

SEQ ID NO: 305240 - DNA, 20 bp, Artificial
  CRISPR gRNA sequence
tggaatcgagaggactctca

SEQ ID NO: 305241 - DNA, 20 bp, Artificial
  CRISPR gRNA sequence
gaatcgagaggactctcaga

SEQ ID NO: 305242 - DNA, 20 bp, Artificial
  CRISPR gRNA sequence
cgagaggactctcagagaga

SEQ ID NO: 305243 - DNA, 20 bp, Artificial
  CRISPR gRNA sequence
ggactctcagagagacagac

SEQ ID NO: 305244 - DNA, 20 bp, Artificial
  CRISPR gRNA sequence
gactctcagagagacagact

SEQ ID NO: 305245 - DNA, 20 bp, Artificial
  CRISPR gRNA sequence
actctcagagagacagactg

SEQ ID NO: 305246 - DNA, 20 bp, Artificial
  CRISPR gRNA sequence
ctcagagagacagactgggg

SEQ ID NO: 305247 - DNA, 20 bp, Artificial
  CRISPR gRNA sequence
tcagagagacagactggggt

SEQ ID NO: 305248 - DNA, 20 bp, Artificial
  CRISPR gRNA sequence
agagagacagactggggtgg

SEQ ID NO: 305249 - DNA, 20 bp, Artificial
  CRISPR gRNA sequence
gagacagactggggtgggag

SEQ ID NO: 305250 - DNA, 20 bp, Artificial
  CRISPR gRNA sequence
acagactggggtgggagaag

SEQ ID NO: 305251 - DNA, 20 bp, Artificial
  CRISPR gRNA sequence
cagactggggtgggagaaga

SEQ ID NO: 305252 - DNA, 20 bp, Artificial
  CRISPR gRNA sequence
agactggggtgggagaagaa

SEQ ID NO: 305253 - DNA, 20 bp, Artificial
  CRISPR gRNA sequence
gactggggtgggagaagaag

SEQ ID NO: 305254 - DNA, 20 bp, Artificial
  CRISPR gRNA sequence
tgggagaagaaggggcccca

SEQ ID NO: 305255 - DNA, 20 bp, Artificial
  CRISPR gRNA sequence
ccaaagtatccctttgcatc

SEQ ID NO: 305256 - DNA, 20 bp, Artificial
  CRISPR gRNA sequence
aaagtatccctttgcatcaa

SEQ ID NO: 305257 - DNA, 20 bp, Artificial
  CRISPR gRNA sequence
aagtatccctttgcatcaag

SEQ ID NO: 305258 - DNA, 20 bp, Artificial
  CRISPR gRNA sequence
agtatccctttgcatcaaga

SEQ ID NO: 305259 - DNA, 20 bp, Artificial
  CRISPR gRNA sequence
atcaagagggtttctgccct

SEQ ID NO: 305260 - DNA, 20 bp, Artificial
  CRISPR gRNA sequence
ctcgaatacccactgtgtgc

SEQ ID NO: 305261 - DNA, 20 bp, Artificial
  CRISPR gRNA sequence
tcgaatacccactgtgtgcc

SEQ ID NO: 305262 - DNA, 20 bp, Artificial
  CRISPR gRNA sequence
tacccactgtgtgccaggta

SEQ ID NO: 305263 - DNA, 20 bp, Artificial
  CRISPR gRNA sequence
cccactgtgtgccaggtaca

SEQ ID NO: 305264 - DNA, 20 bp, Artificial
  CRISPR gRNA sequence
cactgtgtgccaggtacaga

SEQ ID NO: 305265 - DNA, 20 bp, Artificial
  CRISPR gRNA sequence
agtacttctccactttaacc

SEQ ID NO: 305266 - DNA, 20 bp, Artificial
  CRISPR gRNA sequence
cttctccactttaacctgga

SEQ ID NO: 305267 - DNA, 20 bp, Artificial
  CRISPR gRNA sequence
ttctccactttaacctggac

SEQ ID NO: 305268 - DNA, 20 bp, Artificial
  CRISPR gRNA sequence
actttaacctggacaggcac

SEQ ID NO: 305269 - DNA, 20 bp, Artificial
  CRISPR gRNA sequence
ctggacaggcaccagcttcc

SEQ ID NO: 305270 - DNA, 20 bp, Artificial
  CRISPR gRNA sequence
caggcaccagcttcccagcg

SEQ ID NO: 305271 - DNA, 20 bp, Artificial
  CRISPR gRNA sequence
ccagcttcccagcgtggatt

SEQ ID NO: 305272 - DNA, 20 bp, Artificial
  CRISPR gRNA sequence
cagcttcccagcgtggattt

SEQ ID NO: 305273 - DNA, 20 bp, Artificial
  CRISPR gRNA sequence
cccagcgtggatttaggctt

SEQ ID NO: 305274 - DNA, 20 bp, Artificial
  CRISPR gRNA sequence
ccagcgtggatttaggcttc

SEQ ID NO: 305275 - DNA, 20 bp, Artificial
  CRISPR gRNA sequence
gcttcaggtgcacactactg

SEQ ID NO: 305276 - DNA, 20 bp, Artificial
  CRISPR gRNA sequence
cacactactgtggaccatct

SEQ ID NO: 305277 - DNA, 20 bp, Artificial
  CRISPR gRNA sequence
tggaccatctaagccatatc

SEQ ID NO: 305278 - DNA, 20 bp, Artificial
  CRISPR gRNA sequence
accatctaagccatatctag

SEQ ID NO: 305279 - DNA, 20 bp, Artificial
  CRISPR gRNA sequence
catctaagccatatctagaa

SEQ ID NO: 305280 - DNA, 20 bp, Artificial
  CRISPR gRNA sequence
agccatatctagaagagctc

SEQ ID NO: 305281 - DNA, 20 bp, Artificial
  CRISPR gRNA sequence
gccatatctagaagagctct

SEQ ID NO: 305282 - DNA, 20 bp, Artificial
  CRISPR gRNA sequence
ccatatctagaagagctctg

SEQ ID NO: 305283 - DNA, 20 bp, Artificial
  CRISPR gRNA sequence
tctggggaaatatgactact

SEQ ID NO: 305284 - DNA, 20 bp, Artificial
  CRISPR gRNA sequence
ctggggaaatatgactactt

SEQ ID NO: 305285 - DNA, 20 bp, Artificial
  CRISPR gRNA sequence
gggaaatatgactacttggg

SEQ ID NO: 305286 - DNA, 20 bp, Artificial
  CRISPR gRNA sequence
atatgactacttgggcagaa

SEQ ID NO: 305287 - DNA, 20 bp, Artificial
  CRISPR gRNA sequence
tatgactacttgggcagaaa

SEQ ID NO: 305288 - DNA, 20 bp, Artificial
  CRISPR gRNA sequence
gactacttgggcagaaaagg

SEQ ID NO: 305289 - DNA, 20 bp, Artificial
  CRISPR gRNA sequence
actacttgggcagaaaagga

SEQ ID NO: 305290 - DNA, 20 bp, Artificial
  CRISPR gRNA sequence
gggcagaaaaggaaggaact

SEQ ID NO: 305291 - DNA, 20 bp, Artificial
  CRISPR gRNA sequence
cagaaaaggaaggaactaag

SEQ ID NO: 305292 - DNA, 20 bp, Artificial
  CRISPR gRNA sequence
agaaaaggaaggaactaaga

SEQ ID NO: 305293 - DNA, 20 bp, Artificial
  CRISPR gRNA sequence
gaaaaggaaggaactaagaa

SEQ ID NO: 305294 - DNA, 20 bp, Artificial
  CRISPR gRNA sequence
aaaaggaaggaactaagaag

SEQ ID NO: 305295 - DNA, 20 bp, Artificial
  CRISPR gRNA sequence
gaaggggtatctttgtatct

SEQ ID NO: 305296 - DNA, 20 bp, Artificial
  CRISPR gRNA sequence
aaggggtatctttgtatctg

SEQ ID NO: 305297 - DNA, 20 bp, Artificial
  CRISPR gRNA sequence
atctttgtatctgaggtctg

SEQ ID NO: 305298 - DNA, 20 bp, Artificial
  CRISPR gRNA sequence
tctttgtatctgaggtctga

SEQ ID NO: 305299 - DNA, 20 bp, Artificial
  CRISPR gRNA sequence
tttgtatctgaggtctgaag

SEQ ID NO: 305300 - DNA, 20 bp, Artificial
  CRISPR gRNA sequence
ctgaggtctgaaggagcatg

SEQ ID NO: 305301 - DNA, 20 bp, Artificial
  CRISPR gRNA sequence
tgaggtctgaaggagcatgt

SEQ ID NO: 305302 - DNA, 20 bp, Artificial
  CRISPR gRNA sequence
ggagcatgtgggctctcatt

SEQ ID NO: 305303 - DNA, 20 bp, Artificial
  CRISPR gRNA sequence
gagcatgtgggctctcattc

SEQ ID NO: 305304 - DNA, 20 bp, Artificial
  CRISPR gRNA sequence
tgtgggctctcattcaggca

SEQ ID NO: 305305 - DNA, 20 bp, Artificial
  CRISPR gRNA sequence
gtgggctctcattcaggcaa

SEQ ID NO: 305306 - DNA, 20 bp, Artificial
  CRISPR gRNA sequence
tgggctctcattcaggcaaa

SEQ ID NO: 305307 - DNA, 20 bp, Artificial
  CRISPR gRNA sequence
gctctcattcaggcaaaggg

SEQ ID NO: 305308 - DNA, 20 bp, Artificial
  CRISPR gRNA sequence
ctctcattcaggcaaagggc

SEQ ID NO: 305309 - DNA, 20 bp, Artificial
  CRISPR gRNA sequence
attcaggcaaagggcaggat

SEQ ID NO: 305310 - DNA, 20 bp, Artificial
  CRISPR gRNA sequence
ttcaggcaaagggcaggatg

SEQ ID NO: 305311 - DNA, 20 bp, Artificial
  CRISPR gRNA sequence
tcaggcaaagggcaggatga

SEQ ID NO: 305312 - DNA, 20 bp, Artificial
  CRISPR gRNA sequence
aggcaaagggcaggatgagg

SEQ ID NO: 305313 - DNA, 20 bp, Artificial
  CRISPR gRNA sequence
ggcaaagggcaggatgaggg

SEQ ID NO: 305314 - DNA, 20 bp, Artificial
  CRISPR gRNA sequence
aaagggcaggatgagggagg

SEQ ID NO: 305315 - DNA, 20 bp, Artificial
  CRISPR gRNA sequence
gcaggatgagggaggtggaa

SEQ ID NO: 305316 - DNA, 20 bp, Artificial
  CRISPR gRNA sequence
ggatgagggaggtggaatgg

SEQ ID NO: 305317 - DNA, 20 bp, Artificial
  CRISPR gRNA sequence
tgagggaggtggaatggcag

SEQ ID NO: 305318 - DNA, 20 bp, Artificial
  CRISPR gRNA sequence
ggaggtggaatggcagcagc

SEQ ID NO: 305319 - DNA, 20 bp, Artificial
  CRISPR gRNA sequence
ggaatggcagcagccagtaa

SEQ ID NO: 305320 - DNA, 20 bp, Artificial
  CRISPR gRNA sequence
gaatggcagcagccagtaat

SEQ ID NO: 305321 - DNA, 20 bp, Artificial
  CRISPR gRNA sequence
aatggcagcagccagtaatg

SEQ ID NO: 305322 - DNA, 20 bp, Artificial
  CRISPR gRNA sequence
ggcagcagccagtaatgggg

SEQ ID NO: 305323 - DNA, 20 bp, Artificial
  CRISPR gRNA sequence
gcagcagccagtaatggggt

SEQ ID NO: 305324 - DNA, 20 bp, Artificial
  CRISPR gRNA sequence
cagccagtaatggggtggga

SEQ ID NO: 305325 - DNA, 20 bp, Artificial
  CRISPR gRNA sequence
agccagtaatggggtgggac

SEQ ID NO: 305326 - DNA, 20 bp, Artificial
  CRISPR gRNA sequence
gccagtaatggggtgggaca

SEQ ID NO: 305327 - DNA, 20 bp, Artificial
  CRISPR gRNA sequence
ccagtaatggggtgggacag

SEQ ID NO: 305328 - DNA, 20 bp, Artificial
  CRISPR gRNA sequence
agtaatggggtgggacaggg

SEQ ID NO: 305329 - DNA, 20 bp, Artificial
  CRISPR gRNA sequence
tggggtgggacaggggagtg

SEQ ID NO: 305330 - DNA, 20 bp, Artificial
  CRISPR gRNA sequence
gggtgggacaggggagtgca

SEQ ID NO: 305331 - DNA, 20 bp, Artificial
  CRISPR gRNA sequence
gtgggacaggggagtgcaga

SEQ ID NO: 305332 - DNA, 20 bp, Artificial
  CRISPR gRNA sequence
tgggacaggggagtgcagag

SEQ ID NO: 305333 - DNA, 20 bp, Artificial
  CRISPR gRNA sequence
ggagtgcagagaggatgaaa

SEQ ID NO: 305334 - DNA, 20 bp, Artificial
  CRISPR gRNA sequence
gagtgcagagaggatgaaac

SEQ ID NO: 305335 - DNA, 20 bp, Artificial
  CRISPR gRNA sequence
tgcagagaggatgaaacagg

SEQ ID NO: 305336 - DNA, 20 bp, Artificial
  CRISPR gRNA sequence
gagaggatgaaacaggaagt

SEQ ID NO: 305337 - DNA, 20 bp, Artificial
  CRISPR gRNA sequence
gaggatgaaacaggaagtga

SEQ ID NO: 305338 - DNA, 20 bp, Artificial
  CRISPR gRNA sequence
aggatgaaacaggaagtgag

SEQ ID NO: 305339 - DNA, 20 bp, Artificial
  CRISPR gRNA sequence
gatgaaacaggaagtgagag

SEQ ID NO: 305340 - DNA, 20 bp, Artificial
  CRISPR gRNA sequence
atgaaacaggaagtgagagg

SEQ ID NO: 305341 - DNA, 20 bp, Artificial
  CRISPR gRNA sequence
tgaaacaggaagtgagagga

SEQ ID NO: 305342 - DNA, 20 bp, Artificial
  CRISPR gRNA sequence
gaaacaggaagtgagaggag

SEQ ID NO: 305343 - DNA, 20 bp, Artificial
  CRISPR gRNA sequence
gaagtgagaggaggggtcca

SEQ ID NO: 305344 - DNA, 20 bp, Artificial
  CRISPR gRNA sequence
gtgagaggaggggtccacag

SEQ ID NO: 305345 - DNA, 20 bp, Artificial
  CRISPR gRNA sequence
gaggggtccacagtagatgt

SEQ ID NO: 305346 - DNA, 20 bp, Artificial
  CRISPR gRNA sequence
ggggtccacagtagatgttg

SEQ ID NO: 305347 - DNA, 20 bp, Artificial
  CRISPR gRNA sequence
ggtccacagtagatgttgga

SEQ ID NO: 305348 - DNA, 20 bp, Artificial
  CRISPR gRNA sequence
gtagatgttggagagcaaca

SEQ ID NO: 305349 - DNA, 20 bp, Artificial
  CRISPR gRNA sequence
gttggagagcaacaaagaaa

SEQ ID NO: 305350 - DNA, 20 bp, Artificial
  CRISPR gRNA sequence
acttatttcacaactttgtg

SEQ ID NO: 305351 - DNA, 20 bp, Artificial
  CRISPR gRNA sequence
cacaactttgtgtagaatgt

SEQ ID NO: 305352 - DNA, 20 bp, Artificial
  CRISPR gRNA sequence
aactttgtgtagaatgttag

SEQ ID NO: 305353 - DNA, 20 bp, Artificial
  CRISPR gRNA sequence
tgtagaatgttagtggtaac

SEQ ID NO: 305354 - DNA, 20 bp, Artificial
  CRISPR gRNA sequence
tagaatgttagtggtaaccg

SEQ ID NO: 305355 - DNA, 20 bp, Artificial
  CRISPR gRNA sequence
gttagtggtaaccggagtat

SEQ ID NO: 305356 - DNA, 20 bp, Artificial
  CRISPR gRNA sequence
ttagtggtaaccggagtatc

SEQ ID NO: 305357 - DNA, 20 bp, Artificial
  CRISPR gRNA sequence
ggagtatcaggaaaaatgct

SEQ ID NO: 305358 - DNA, 20 bp, Artificial
  CRISPR gRNA sequence
gtatcaggaaaaatgctgag

SEQ ID NO: 305359 - DNA, 20 bp, Artificial
  CRISPR gRNA sequence
aaaaatgctgagaagtttgc

SEQ ID NO: 305360 - DNA, 20 bp, Artificial
  CRISPR gRNA sequence
tgagaagtttgctggtgcct

SEQ ID NO: 305361 - DNA, 20 bp, Artificial
  CRISPR gRNA sequence
gaagtttgctggtgcctcag

SEQ ID NO: 305362 - DNA, 20 bp, Artificial
  CRISPR gRNA sequence
aagtttgctggtgcctcaga

SEQ ID NO: 305363 - DNA, 20 bp, Artificial
  CRISPR gRNA sequence
gcctcagaaggttatttatt

SEQ ID NO: 305364 - DNA, 20 bp, Artificial
  CRISPR gRNA sequence
cctcagaaggttatttattg

SEQ ID NO: 305365 - DNA, 20 bp, Artificial
  CRISPR gRNA sequence
cagaaggttatttattgagg

SEQ ID NO: 305366 - DNA, 20 bp, Artificial
  CRISPR gRNA sequence
tatttattgaggtagtcttt

SEQ ID NO: 305367 - DNA, 20 bp, Artificial
  CRISPR gRNA sequence
atttattgaggtagtctttc

SEQ ID NO: 305368 - DNA, 20 bp, Artificial
  CRISPR gRNA sequence
aaacatttgctacatctact

SEQ ID NO: 305369 - DNA, 20 bp, Artificial
  CRISPR gRNA sequence
ttgctacatctactcagtgt

SEQ ID NO: 305370 - DNA, 20 bp, Artificial
  CRISPR gRNA sequence
actcagtgtcagacttgttc

SEQ ID NO: 305371 - DNA, 20 bp, Artificial
  CRISPR gRNA sequence
tcagtgtcagacttgttcta

SEQ ID NO: 305372 - DNA, 20 bp, Artificial
  CRISPR gRNA sequence
tcagacttgttctagagatt

SEQ ID NO: 305373 - DNA, 20 bp, Artificial
  CRISPR gRNA sequence
cagacttgttctagagattg

SEQ ID NO: 305374 - DNA, 20 bp, Artificial
  CRISPR gRNA sequence
agacttgttctagagattga

SEQ ID NO: 305375 - DNA, 20 bp, Artificial
  CRISPR gRNA sequence
gacttgttctagagattgag

SEQ ID NO: 305376 - DNA, 20 bp, Artificial
  CRISPR gRNA sequence
ctagagattgaggggttgta

SEQ ID NO: 305377 - DNA, 20 bp, Artificial
  CRISPR gRNA sequence
tgaggggttgtaaagacatg

SEQ ID NO: 305378 - DNA, 20 bp, Artificial
  CRISPR gRNA sequence
gaggggttgtaaagacatgt

SEQ ID NO: 305379 - DNA, 20 bp, Artificial
  CRISPR gRNA sequence
ttgtaaagacatgtaggcct

SEQ ID NO: 305380 - DNA, 20 bp, Artificial
  CRISPR gRNA sequence
gtaggccttggtcccccacc

SEQ ID NO: 305381 - DNA, 20 bp, Artificial
  CRISPR gRNA sequence
tggtcccccacctggcacta

SEQ ID NO: 305382 - DNA, 20 bp, Artificial
  CRISPR gRNA sequence
gtcccccacctggcactaaa

SEQ ID NO: 305383 - DNA, 20 bp, Artificial
  CRISPR gRNA sequence
ccccacctggcactaaagag

SEQ ID NO: 305384 - DNA, 20 bp, Artificial
  CRISPR gRNA sequence
ctggcactaaagagaagaaa

SEQ ID NO: 305385 - DNA, 20 bp, Artificial
  CRISPR gRNA sequence
gtccacaaataactacaatg

SEQ ID NO: 305386 - DNA, 20 bp, Artificial
  CRISPR gRNA sequence
tccacaaataactacaatgc

SEQ ID NO: 305387 - DNA, 20 bp, Artificial
  CRISPR gRNA sequence
aataactacaatgcaggctc

SEQ ID NO: 305388 - DNA, 20 bp, Artificial
  CRISPR gRNA sequence
ataactacaatgcaggctcc

SEQ ID NO: 305389 - DNA, 20 bp, Artificial
  CRISPR gRNA sequence
taactacaatgcaggctcca

SEQ ID NO: 305390 - DNA, 20 bp, Artificial
  CRISPR gRNA sequence
tacaatgcaggctccagggc

SEQ ID NO: 305391 - DNA, 20 bp, Artificial
  CRISPR gRNA sequence
tgcaggctccagggccagtg

SEQ ID NO: 305392 - DNA, 20 bp, Artificial
  CRISPR gRNA sequence
aggctccagggccagtgtgg

SEQ ID NO: 305393 - DNA, 20 bp, Artificial
  CRISPR gRNA sequence
ggctccagggccagtgtgga

SEQ ID NO: 305394 - DNA, 20 bp, Artificial
  CRISPR gRNA sequence
tccagggccagtgtggaagg

SEQ ID NO: 305395 - DNA, 20 bp, Artificial
  CRISPR gRNA sequence
agggccagtgtggaaggtgg

SEQ ID NO: 305396 - DNA, 20 bp, Artificial
  CRISPR gRNA sequence
gggccagtgtggaaggtggt

SEQ ID NO: 305397 - DNA, 20 bp, Artificial
  CRISPR gRNA sequence
ccagtgtggaaggtggtagg

SEQ ID NO: 305398 - DNA, 20 bp, Artificial
  CRISPR gRNA sequence
ggaaggtggtaggtagtcct

SEQ ID NO: 305399 - DNA, 20 bp, Artificial
  CRISPR gRNA sequence
ggtagtccttggcttcttgt

SEQ ID NO: 305400 - DNA, 20 bp, Artificial
  CRISPR gRNA sequence
gtagtccttggcttcttgtg

SEQ ID NO: 305401 - DNA, 20 bp, Artificial
  CRISPR gRNA sequence
tggcttcttgtgaggtatac

SEQ ID NO: 305402 - DNA, 20 bp, Artificial
  CRISPR gRNA sequence
gcttcttgtgaggtatacaa

SEQ ID NO: 305403 - DNA, 20 bp, Artificial
  CRISPR gRNA sequence
tatacaagagttcttaccct

SEQ ID NO: 305404 - DNA, 20 bp, Artificial
  CRISPR gRNA sequence
aagagttcttaccctgagca

SEQ ID NO: 305405 - DNA, 20 bp, Artificial
  CRISPR gRNA sequence
agttcttaccctgagcaaag

SEQ ID NO: 305406 - DNA, 20 bp, Artificial
  CRISPR gRNA sequence
gttcttaccctgagcaaagc

SEQ ID NO: 305407 - DNA, 20 bp, Artificial
  CRISPR gRNA sequence
ttcttaccctgagcaaagca

SEQ ID NO: 305408 - DNA, 20 bp, Artificial
  CRISPR gRNA sequence
tcttaccctgagcaaagcag

SEQ ID NO: 305409 - DNA, 20 bp, Artificial
  CRISPR gRNA sequence
gagcaaagcaggggacacca

SEQ ID NO: 305410 - DNA, 20 bp, Artificial
  CRISPR gRNA sequence
aggggacaccacagtctctg

SEQ ID NO: 305411 - DNA, 20 bp, Artificial
  CRISPR gRNA sequence
gggacaccacagtctctgtg

SEQ ID NO: 305412 - DNA, 20 bp, Artificial
  CRISPR gRNA sequence
ggacaccacagtctctgtgg

SEQ ID NO: 305413 - DNA, 20 bp, Artificial
  CRISPR gRNA sequence
caccacagtctctgtggagg

SEQ ID NO: 305414 - DNA, 20 bp, Artificial
  CRISPR gRNA sequence
accacagtctctgtggagga

SEQ ID NO: 305415 - DNA, 20 bp, Artificial
  CRISPR gRNA sequence
agtctctgtggaggaaggat

SEQ ID NO: 305416 - DNA, 20 bp, Artificial
  CRISPR gRNA sequence
gtctctgtggaggaaggatt

SEQ ID NO: 305417 - DNA, 20 bp, Artificial
  CRISPR gRNA sequence
ctgtggaggaaggattaggt

SEQ ID NO: 305418 - DNA, 20 bp, Artificial
  CRISPR gRNA sequence
aggaaggattaggtcggcct

SEQ ID NO: 305419 - DNA, 20 bp, Artificial
  CRISPR gRNA sequence
ggattaggtcggcctcagcc

SEQ ID NO: 305420 - DNA, 20 bp, Artificial
  CRISPR gRNA sequence
ttaggtcggcctcagcccag

SEQ ID NO: 305421 - DNA, 20 bp, Artificial
  CRISPR gRNA sequence
ggcctcagcccagcagcact

SEQ ID NO: 305422 - DNA, 20 bp, Artificial
  CRISPR gRNA sequence
gcctcagcccagcagcactc

SEQ ID NO: 305423 - DNA, 20 bp, Artificial
  CRISPR gRNA sequence
cctcagcccagcagcactca

SEQ ID NO: 305424 - DNA, 20 bp, Artificial
  CRISPR gRNA sequence
gcccagcagcactcagggcc

SEQ ID NO: 305425 - DNA, 20 bp, Artificial
  CRISPR gRNA sequence
cttctgccgattcatacttg

SEQ ID NO: 305426 - DNA, 20 bp, Artificial
  CRISPR gRNA sequence
tgccgattcatacttgtggt

SEQ ID NO: 305427 - DNA, 20 bp, Artificial
  CRISPR gRNA sequence
attcatacttgtggttggat

SEQ ID NO: 305428 - DNA, 20 bp, Artificial
  CRISPR gRNA sequence
atacttgtggttggataagc

SEQ ID NO: 305429 - DNA, 20 bp, Artificial
  CRISPR gRNA sequence
tacttgtggttggataagcc

SEQ ID NO: 305430 - DNA, 20 bp, Artificial
  CRISPR gRNA sequence
gttggataagccaggcctgc

SEQ ID NO: 305431 - DNA, 20 bp, Artificial
  CRISPR gRNA sequence
ataagccaggcctgctggac

SEQ ID NO: 305432 - DNA, 20 bp, Artificial
  CRISPR gRNA sequence
ctgctggactggcacgtcac

SEQ ID NO: 305433 - DNA, 20 bp, Artificial
  CRISPR gRNA sequence
tggcacgtcaccagctcgct

SEQ ID NO: 305434 - DNA, 20 bp, Artificial
  CRISPR gRNA sequence
gcacgtcaccagctcgctga

SEQ ID NO: 305435 - DNA, 20 bp, Artificial
  CRISPR gRNA sequence
cacgtcaccagctcgctgag

SEQ ID NO: 305436 - DNA, 20 bp, Artificial
  CRISPR gRNA sequence
cgtcaccagctcgctgagag

SEQ ID NO: 305437 - DNA, 20 bp, Artificial
  CRISPR gRNA sequence
tcaccagctcgctgagagga

SEQ ID NO: 305438 - DNA, 20 bp, Artificial
  CRISPR gRNA sequence
ccagctcgctgagaggagag

SEQ ID NO: 305439 - DNA, 20 bp, Artificial
  CRISPR gRNA sequence
agctcgctgagaggagagta

SEQ ID NO: 305440 - DNA, 20 bp, Artificial
  CRISPR gRNA sequence
ctgagaggagagtagagctc

SEQ ID NO: 305441 - DNA, 20 bp, Artificial
  CRISPR gRNA sequence
gtagagctccagtgcaacat

SEQ ID NO: 305442 - DNA, 20 bp, Artificial
  CRISPR gRNA sequence
ccagtgcaacatcagctccc

SEQ ID NO: 305443 - DNA, 20 bp, Artificial
  CRISPR gRNA sequence
cagtgcaacatcagctccct

SEQ ID NO: 305444 - DNA, 20 bp, Artificial
  CRISPR gRNA sequence
agtgcaacatcagctccctg

SEQ ID NO: 305445 - DNA, 20 bp, Artificial
  CRISPR gRNA sequence
acatcagctccctggggcct

SEQ ID NO: 305446 - DNA, 20 bp, Artificial
  CRISPR gRNA sequence
ctggggccttggtttgcctc

SEQ ID NO: 305447 - DNA, 20 bp, Artificial
  CRISPR gRNA sequence
tggggccttggtttgcctct

SEQ ID NO: 305448 - DNA, 20 bp, Artificial
  CRISPR gRNA sequence
tctgggtgtgacatgctgca

SEQ ID NO: 305449 - DNA, 20 bp, Artificial
  CRISPR gRNA sequence
tgctgcacagcgttacttct

SEQ ID NO: 305450 - DNA, 20 bp, Artificial
  CRISPR gRNA sequence
ctgcacagcgttacttctca

SEQ ID NO: 305451 - DNA, 20 bp, Artificial
  CRISPR gRNA sequence
agcgttacttctcagagcac

SEQ ID NO: 305452 - DNA, 20 bp, Artificial
  CRISPR gRNA sequence
gcgttacttctcagagcacc

SEQ ID NO: 305453 - DNA, 20 bp, Artificial
  CRISPR gRNA sequence
tctcagagcaccaggacctg

SEQ ID NO: 305454 - DNA, 20 bp, Artificial
  CRISPR gRNA sequence
ccgctgtcccaccccattac

SEQ ID NO: 305455 - DNA, 20 bp, Artificial
  CRISPR gRNA sequence
atcctgccctttgcctgaac

SEQ ID NO: 305456 - DNA, 20 bp, Artificial
  CRISPR gRNA sequence
cctgccctttgcctgaacaa

SEQ ID NO: 305457 - DNA, 20 bp, Artificial
  CRISPR gRNA sequence
caagagcccacacgctcctt

SEQ ID NO: 305458 - DNA, 20 bp, Artificial
  CRISPR gRNA sequence
ccacacgctccttcagacct

SEQ ID NO: 305459 - DNA, 20 bp, Artificial
  CRISPR gRNA sequence
tccttcagacctcagacaca

SEQ ID NO: 305460 - DNA, 20 bp, Artificial
  CRISPR gRNA sequence
gacacaaagatacctcttct

SEQ ID NO: 305461 - DNA, 20 bp, Artificial
  CRISPR gRNA sequence
agttccttccttttctgccc

SEQ ID NO: 305462 - DNA, 20 bp, Artificial
  CRISPR gRNA sequence
tccttccttttctgcccaag

SEQ ID NO: 305463 - DNA, 20 bp, Artificial
  CRISPR gRNA sequence
cccaagtagtcatatttccc

SEQ ID NO: 305464 - DNA, 20 bp, Artificial
  CRISPR gRNA sequence
caagtagtcatatttcccca

SEQ ID NO: 305465 - DNA, 20 bp, Artificial
  CRISPR gRNA sequence
atatttccccagagctcttc

SEQ ID NO: 305466 - DNA, 20 bp, Artificial
  CRISPR gRNA sequence
tatttccccagagctcttct

SEQ ID NO: 305467 - DNA, 20 bp, Artificial
  CRISPR gRNA sequence
ccccagagctcttctaggtg

SEQ ID NO: 305468 - DNA, 20 bp, Artificial
  CRISPR gRNA sequence
gagctcttctaggtgtggct

SEQ ID NO: 305469 - DNA, 20 bp, Artificial
  CRISPR gRNA sequence
tcttctaggtgtggcttaga

SEQ ID NO: 305470 - DNA, 20 bp, Artificial
  CRISPR gRNA sequence
ggtgtggcttagacggtaca

SEQ ID NO: 305471 - DNA, 20 bp, Artificial
  CRISPR gRNA sequence
gtggcttagacggtacacag

SEQ ID NO: 305472 - DNA, 20 bp, Artificial
  CRISPR gRNA sequence
tacacagtagtgtgcacctg

SEQ ID NO: 305473 - DNA, 20 bp, Artificial
  CRISPR gRNA sequence
cctgaagcctaaacccacgc

SEQ ID NO: 305474 - DNA, 20 bp, Artificial
  CRISPR gRNA sequence
ctgaagcctaaacccacgct

SEQ ID NO: 305475 - DNA, 20 bp, Artificial
  CRISPR gRNA sequence
aagcctaaacccacgctggg

SEQ ID NO: 305476 - DNA, 20 bp, Artificial
  CRISPR gRNA sequence
ctaaacccacgctgggaagc

SEQ ID NO: 305477 - DNA, 20 bp, Artificial
  CRISPR gRNA sequence
ctgggaagctggtgcctgtc

SEQ ID NO: 305478 - DNA, 20 bp, Artificial
  CRISPR gRNA sequence
gctggtgcctgtccagatta

SEQ ID NO: 305479 - DNA, 20 bp, Artificial
  CRISPR gRNA sequence
ggtgcctgtccagattacag

SEQ ID NO: 305480 - DNA, 20 bp, Artificial
  CRISPR gRNA sequence
tgcctgtccagattacagca

SEQ ID NO: 305481 - DNA, 20 bp, Artificial
  CRISPR gRNA sequence
ctgtccagattacagcagag

SEQ ID NO: 305482 - DNA, 20 bp, Artificial
  CRISPR gRNA sequence
agagaagaactctctgtacc

SEQ ID NO: 305483 - DNA, 20 bp, Artificial
  CRISPR gRNA sequence
aactctctgtacctggcaca

SEQ ID NO: 305484 - DNA, 20 bp, Artificial
  CRISPR gRNA sequence
tctctgtacctggcacacag

SEQ ID NO: 305485 - DNA, 20 bp, Artificial
  CRISPR gRNA sequence
ctctgtacctggcacacagt

SEQ ID NO: 305486 - DNA, 20 bp, Artificial
  CRISPR gRNA sequence
ctggcacacagtgggtattc

SEQ ID NO: 305487 - DNA, 20 bp, Artificial
  CRISPR gRNA sequence
gcacacagtgggtattcgag

SEQ ID NO: 305488 - DNA, 20 bp, Artificial
  CRISPR gRNA sequence
gggtattcgagcagtgtttg

SEQ ID NO: 305489 - DNA, 20 bp, Artificial
  CRISPR gRNA sequence
agcagtgtttgcagaatgaa

SEQ ID NO: 305490 - DNA, 20 bp, Artificial
  CRISPR gRNA sequence
agtgtttgcagaatgaacag

SEQ ID NO: 305491 - DNA, 20 bp, Artificial
  CRISPR gRNA sequence
ttgcagaatgaacagcagct

SEQ ID NO: 305492 - DNA, 20 bp, Artificial
  CRISPR gRNA sequence
tgcagaatgaacagcagctc

SEQ ID NO: 305493 - DNA, 20 bp, Artificial
  CRISPR gRNA sequence
gcagaatgaacagcagctca

SEQ ID NO: 305494 - DNA, 20 bp, Artificial
  CRISPR gRNA sequence
gaatgaacagcagctcaggg

SEQ ID NO: 305495 - DNA, 20 bp, Artificial
  CRISPR gRNA sequence
ctcagggcagaaaccctctt

SEQ ID NO: 305496 - DNA, 20 bp, Artificial
  CRISPR gRNA sequence
agggcagaaaccctcttgag

SEQ ID NO: 305497 - DNA, 20 bp, Artificial
  CRISPR gRNA sequence
agaaaccctcttgagcagct

SEQ ID NO: 305498 - DNA, 20 bp, Artificial
  CRISPR gRNA sequence
gaaaccctcttgagcagctc

SEQ ID NO: 305499 - DNA, 20 bp, Artificial
  CRISPR gRNA sequence
aaaccctcttgagcagctca

SEQ ID NO: 305500 - DNA, 20 bp, Artificial
  CRISPR gRNA sequence
ccctcttgagcagctcaggg

SEQ ID NO: 305501 - DNA, 20 bp, Artificial
  CRISPR gRNA sequence
tcagggcagaaaccctcttt

SEQ ID NO: 305502 - DNA, 20 bp, Artificial
  CRISPR gRNA sequence
agaaaccctctttgagatac

SEQ ID NO: 305503 - DNA, 20 bp, Artificial
  CRISPR gRNA sequence
gaaaccctctttgagatact

SEQ ID NO: 305504 - DNA, 20 bp, Artificial
  CRISPR gRNA sequence
accctctttgagatactggg

SEQ ID NO: 305505 - DNA, 20 bp, Artificial
  CRISPR gRNA sequence
cctctttgagatactgggaa

SEQ ID NO: 305506 - DNA, 20 bp, Artificial
  CRISPR gRNA sequence
tttgagatactgggaagagt

SEQ ID NO: 305507 - DNA, 20 bp, Artificial
  CRISPR gRNA sequence
agatactgggaagagtaaga

SEQ ID NO: 305508 - DNA, 20 bp, Artificial
  CRISPR gRNA sequence
gatactgggaagagtaagat

SEQ ID NO: 305509 - DNA, 20 bp, Artificial
  CRISPR gRNA sequence
ggcttatttccttctttata

SEQ ID NO: 305510 - DNA, 20 bp, Artificial
  CRISPR gRNA sequence
aagtttctgaactacaaaat

SEQ ID NO: 305511 - DNA, 20 bp, Artificial
  CRISPR gRNA sequence
tttctgaactacaaaataag

SEQ ID NO: 305512 - DNA, 20 bp, Artificial
  CRISPR gRNA sequence
ttctgaactacaaaataaga

SEQ ID NO: 305513 - DNA, 20 bp, Artificial
  CRISPR gRNA sequence
ctacaaaataagaaggttac

SEQ ID NO: 305514 - DNA, 20 bp, Artificial
  CRISPR gRNA sequence
tacaaaataagaaggttact

SEQ ID NO: 305515 - DNA, 20 bp, Artificial
  CRISPR gRNA sequence
aatcaaatatatttgaattt

SEQ ID NO: 305516 - DNA, 20 bp, Artificial
  CRISPR gRNA sequence
aaatatatttgaattttagc

SEQ ID NO: 305517 - DNA, 20 bp, Artificial
  CRISPR gRNA sequence
aatatatttgaattttagca

SEQ ID NO: 305518 - DNA, 20 bp, Artificial
  CRISPR gRNA sequence
aattttagcaaggcttctga

SEQ ID NO: 305519 - DNA, 20 bp, Artificial
  CRISPR gRNA sequence
ttttagcaaggcttctgaca

SEQ ID NO: 305520 - DNA, 20 bp, Artificial
  CRISPR gRNA sequence
gtatcttatgatatacgtga

SEQ ID NO: 305521 - DNA, 20 bp, Artificial
  CRISPR gRNA sequence
tgatatacgtgacagcaata

SEQ ID NO: 305522 - DNA, 20 bp, Artificial
  CRISPR gRNA sequence
atatacgtgacagcaatatg

SEQ ID NO: 305523 - DNA, 20 bp, Artificial
  CRISPR gRNA sequence
gacagcaatatggagaaatg

SEQ ID NO: 305524 - DNA, 20 bp, Artificial
  CRISPR gRNA sequence
acagcaatatggagaaatgt

SEQ ID NO: 305525 - DNA, 20 bp, Artificial
  CRISPR gRNA sequence
atgtaggattaatattgata

SEQ ID NO: 305526 - DNA, 20 bp, Artificial
  CRISPR gRNA sequence
ctcattcattcatttgctat

SEQ ID NO: 305527 - DNA, 20 bp, Artificial
  CRISPR gRNA sequence
ccacaaatatttattgaacc

SEQ ID NO: 305528 - DNA, 20 bp, Artificial
  CRISPR gRNA sequence
attgaaccaagcattgtgtt

SEQ ID NO: 305529 - DNA, 20 bp, Artificial
  CRISPR gRNA sequence
ccaagcattgtgtttggtgc

SEQ ID NO: 305530 - DNA, 20 bp, Artificial
  CRISPR gRNA sequence
caagcattgtgtttggtgct

SEQ ID NO: 305531 - DNA, 20 bp, Artificial
  CRISPR gRNA sequence
tttggtgctaggaatataat

SEQ ID NO: 305532 - DNA, 20 bp, Artificial
  CRISPR gRNA sequence
aggaatataatgagcaaaac

SEQ ID NO: 305533 - DNA, 20 bp, Artificial
  CRISPR gRNA sequence
ataatgagcaaaaccagaaa

SEQ ID NO: 305534 - DNA, 20 bp, Artificial
  CRISPR gRNA sequence
agaaacagttcctcttcacg

SEQ ID NO: 305535 - DNA, 20 bp, Artificial
  CRISPR gRNA sequence
cctcttcacgtggttgccta

SEQ ID NO: 305536 - DNA, 20 bp, Artificial
  CRISPR gRNA sequence
tcacgtggttgcctacagtt

SEQ ID NO: 305537 - DNA, 20 bp, Artificial
  CRISPR gRNA sequence
cgtggttgcctacagtttag

SEQ ID NO: 305538 - DNA, 20 bp, Artificial
  CRISPR gRNA sequence
ttgcctacagtttagtagaa

SEQ ID NO: 305539 - DNA, 20 bp, Artificial
  CRISPR gRNA sequence
ctacagtttagtagaaaagc

SEQ ID NO: 305540 - DNA, 20 bp, Artificial
  CRISPR gRNA sequence
agtttagtagaaaagcaaga

SEQ ID NO: 305541 - DNA, 20 bp, Artificial
  CRISPR gRNA sequence
agaaaagcaagatagtgatc

SEQ ID NO: 305542 - DNA, 20 bp, Artificial
  CRISPR gRNA sequence
atagtgatcaagtaatcata

SEQ ID NO: 305543 - DNA, 20 bp, Artificial
  CRISPR gRNA sequence
agtgatcaagtaatcataca

SEQ ID NO: 305544 - DNA, 20 bp, Artificial
  CRISPR gRNA sequence
catacagagaaatgtaaaac

SEQ ID NO: 305545 - DNA, 20 bp, Artificial
  CRISPR gRNA sequence
aatgtaaaactagctatgac

SEQ ID NO: 305546 - DNA, 20 bp, Artificial
  CRISPR gRNA sequence
agctatgacaagtgctacaa

SEQ ID NO: 305547 - DNA, 20 bp, Artificial
  CRISPR gRNA sequence
ctatgacaagtgctacaaaa

SEQ ID NO: 305548 - DNA, 20 bp, Artificial
  CRISPR gRNA sequence
atgacaagtgctacaaaaga

SEQ ID NO: 305549 - DNA, 20 bp, Artificial
  CRISPR gRNA sequence
tgacaagtgctacaaaagag

SEQ ID NO: 305550 - DNA, 20 bp, Artificial
  CRISPR gRNA sequence
tgctacaaaagagaggttca

SEQ ID NO: 305551 - DNA, 20 bp, Artificial
  CRISPR gRNA sequence
agagaggttcatggtacttt

SEQ ID NO: 305552 - DNA, 20 bp, Artificial
  CRISPR gRNA sequence
agaggttcatggtactttga

SEQ ID NO: 305553 - DNA, 20 bp, Artificial
  CRISPR gRNA sequence
ggtactttgagagcccataa

SEQ ID NO: 305554 - DNA, 20 bp, Artificial
  CRISPR gRNA sequence
gtactttgagagcccataac

SEQ ID NO: 305555 - DNA, 20 bp, Artificial
  CRISPR gRNA sequence
ttgagagcccataacaggac

SEQ ID NO: 305556 - DNA, 20 bp, Artificial
  CRISPR gRNA sequence
taacaggaccagcctaaact

SEQ ID NO: 305557 - DNA, 20 bp, Artificial
  CRISPR gRNA sequence
ccagcctaaactgagatctg

SEQ ID NO: 305558 - DNA, 20 bp, Artificial
  CRISPR gRNA sequence
agatctgaagaatgatataa

SEQ ID NO: 305559 - DNA, 20 bp, Artificial
  CRISPR gRNA sequence
gaatgatataatagattaaa

SEQ ID NO: 305560 - DNA, 20 bp, Artificial
  CRISPR gRNA sequence
taaaaagaaacacatatcct

SEQ ID NO: 305561 - DNA, 20 bp, Artificial
  CRISPR gRNA sequence
tggctactcctcctcccatg

SEQ ID NO: 305562 - DNA, 20 bp, Artificial
  CRISPR gRNA sequence
gctactcctcctcccatgaa

SEQ ID NO: 305563 - DNA, 20 bp, Artificial
  CRISPR gRNA sequence
ctactcctcctcccatgaag

SEQ ID NO: 305564 - DNA, 20 bp, Artificial
  CRISPR gRNA sequence
ctcctcctcccatgaagagg

SEQ ID NO: 305565 - DNA, 20 bp, Artificial
  CRISPR gRNA sequence
cctcctcccatgaagaggta

SEQ ID NO: 305566 - DNA, 20 bp, Artificial
  CRISPR gRNA sequence
ctcccatgaagaggtagagt

SEQ ID NO: 305567 - DNA, 20 bp, Artificial
  CRISPR gRNA sequence
ggatctcctctctttgaatc

SEQ ID NO: 305568 - DNA, 20 bp, Artificial
  CRISPR gRNA sequence
gatctcctctctttgaatct

SEQ ID NO: 305569 - DNA, 20 bp, Artificial
  CRISPR gRNA sequence
tcctctctttgaatctgggc

SEQ ID NO: 305570 - DNA, 20 bp, Artificial
  CRISPR gRNA sequence
ctttgaatctgggctagcct

SEQ ID NO: 305571 - DNA, 20 bp, Artificial
  CRISPR gRNA sequence
ctgagtgacctgtttgacca

SEQ ID NO: 305572 - DNA, 20 bp, Artificial
  CRISPR gRNA sequence
acctgtttgaccatagaata

SEQ ID NO: 305573 - DNA, 20 bp, Artificial
  CRISPR gRNA sequence
ttgaccatagaatacagtac

SEQ ID NO: 305574 - DNA, 20 bp, Artificial
  CRISPR gRNA sequence
tgaccatagaatacagtaca

SEQ ID NO: 305575 - DNA, 20 bp, Artificial
  CRISPR gRNA sequence
gaccatagaatacagtacaa

SEQ ID NO: 305576 - DNA, 20 bp, Artificial
  CRISPR gRNA sequence
atacagtacaagggatattc

SEQ ID NO: 305577 - DNA, 20 bp, Artificial
  CRISPR gRNA sequence
tacagtacaagggatattct

SEQ ID NO: 305578 - DNA, 20 bp, Artificial
  CRISPR gRNA sequence
aagggatattctgggacttc

SEQ ID NO: 305579 - DNA, 20 bp, Artificial
  CRISPR gRNA sequence
gggatattctgggacttcga

SEQ ID NO: 305580 - DNA, 20 bp, Artificial
  CRISPR gRNA sequence
attctgggacttcgagagct

SEQ ID NO: 305581 - DNA, 20 bp, Artificial
  CRISPR gRNA sequence
gacttcgagagcttggtcat

SEQ ID NO: 305582 - DNA, 20 bp, Artificial
  CRISPR gRNA sequence
ttcgagagcttggtcataag

SEQ ID NO: 305583 - DNA, 20 bp, Artificial
  CRISPR gRNA sequence
cttggtcataagaagcctca

SEQ ID NO: 305584 - DNA, 20 bp, Artificial
  CRISPR gRNA sequence
acagcttctacctgtctctc

SEQ ID NO: 305585 - DNA, 20 bp, Artificial
  CRISPR gRNA sequence
cagcttctacctgtctctct

SEQ ID NO: 305586 - DNA, 20 bp, Artificial
  CRISPR gRNA sequence
gcttctacctgtctctctgg

SEQ ID NO: 305587 - DNA, 20 bp, Artificial
  CRISPR gRNA sequence
ctctctgggagtaccttatc

SEQ ID NO: 305588 - DNA, 20 bp, Artificial
  CRISPR gRNA sequence
ctctgggagtaccttatctg

SEQ ID NO: 305589 - DNA, 20 bp, Artificial
  CRISPR gRNA sequence
agtaccttatctggagttct

SEQ ID NO: 305590 - DNA, 20 bp, Artificial
  CRISPR gRNA sequence
ggagttctgagccaccacgt

SEQ ID NO: 305591 - DNA, 20 bp, Artificial
  CRISPR gRNA sequence
gtaagatgtcccactacccc

SEQ ID NO: 305592 - DNA, 20 bp, Artificial
  CRISPR gRNA sequence
ctaccccgagaccatcatgc

SEQ ID NO: 305593 - DNA, 20 bp, Artificial
  CRISPR gRNA sequence
accccgagaccatcatgctg

SEQ ID NO: 305594 - DNA, 20 bp, Artificial
  CRISPR gRNA sequence
cccgagaccatcatgctgga

SEQ ID NO: 305595 - DNA, 20 bp, Artificial
  CRISPR gRNA sequence
ccgagaccatcatgctggag

SEQ ID NO: 305596 - DNA, 20 bp, Artificial
  CRISPR gRNA sequence
tcatgctggagaggactgta

SEQ ID NO: 305597 - DNA, 20 bp, Artificial
  CRISPR gRNA sequence
gagaggactgtatagctgtt

SEQ ID NO: 305598 - DNA, 20 bp, Artificial
  CRISPR gRNA sequence
agaggactgtatagctgttt

SEQ ID NO: 305599 - DNA, 20 bp, Artificial
  CRISPR gRNA sequence
tgtatagctgtttgggtcaa

SEQ ID NO: 305600 - DNA, 20 bp, Artificial
  CRISPR gRNA sequence
gctgtttgggtcaatggtcc

SEQ ID NO: 305601 - DNA, 20 bp, Artificial
  CRISPR gRNA sequence
ttgggtcaatggtcccagct

SEQ ID NO: 305602 - DNA, 20 bp, Artificial
  CRISPR gRNA sequence
gccttccacctatccctgcc

SEQ ID NO: 305603 - DNA, 20 bp, Artificial
  CRISPR gRNA sequence
acctatccctgccaagccac

SEQ ID NO: 305604 - DNA, 20 bp, Artificial
  CRISPR gRNA sequence
cagacatatgaataaaatct

SEQ ID NO: 305605 - DNA, 20 bp, Artificial
  CRISPR gRNA sequence
gaataaaatcttggatcttc

SEQ ID NO: 305606 - DNA, 20 bp, Artificial
  CRISPR gRNA sequence
aaatcttggatcttctagat

SEQ ID NO: 305607 - DNA, 20 bp, Artificial
  CRISPR gRNA sequence
aatcttggatcttctagatc

SEQ ID NO: 305608 - DNA, 20 bp, Artificial
  CRISPR gRNA sequence
atcttggatcttctagatca

SEQ ID NO: 305609 - DNA, 20 bp, Artificial
  CRISPR gRNA sequence
tcttggatcttctagatcag

SEQ ID NO: 305610 - DNA, 20 bp, Artificial
  CRISPR gRNA sequence
ggatcttctagatcaggggt

SEQ ID NO: 305611 - DNA, 20 bp, Artificial
  CRISPR gRNA sequence
gatcaggggtcagcaaacta

SEQ ID NO: 305612 - DNA, 20 bp, Artificial
  CRISPR gRNA sequence
ggtcagcaaactacagcctg

SEQ ID NO: 305613 - DNA, 20 bp, Artificial
  CRISPR gRNA sequence
gtcagcaaactacagcctgt

SEQ ID NO: 305614 - DNA, 20 bp, Artificial
  CRISPR gRNA sequence
tacagcctgtaggccaaatc

SEQ ID NO: 305615 - DNA, 20 bp, Artificial
  CRISPR gRNA sequence
ctaccacctatttttattaa

SEQ ID NO: 305616 - DNA, 20 bp, Artificial
  CRISPR gRNA sequence
atttttattaatagttgtac

SEQ ID NO: 305617 - DNA, 20 bp, Artificial
  CRISPR gRNA sequence
ctattgtaaattattatcta

SEQ ID NO: 305618 - DNA, 20 bp, Artificial
  CRISPR gRNA sequence
attatctatggctgcttttg

SEQ ID NO: 305619 - DNA, 20 bp, Artificial
  CRISPR gRNA sequence
tggctgcttttgcagtgcaa

SEQ ID NO: 305620 - DNA, 20 bp, Artificial
  CRISPR gRNA sequence
ctgcttttgcagtgcaatgg

SEQ ID NO: 305621 - DNA, 20 bp, Artificial
  CRISPR gRNA sequence
gcttttgcagtgcaatggaa

SEQ ID NO: 305622 - DNA, 20 bp, Artificial
  CRISPR gRNA sequence
agtgcaatggaagagttgaa

SEQ ID NO: 305623 - DNA, 20 bp, Artificial
  CRISPR gRNA sequence
gaagagttgaacagctatga

SEQ ID NO: 305624 - DNA, 20 bp, Artificial
  CRISPR gRNA sequence
agagttgaacagctatgatg

SEQ ID NO: 305625 - DNA, 20 bp, Artificial
  CRISPR gRNA sequence
cagctatgatggagactgca

SEQ ID NO: 305626 - DNA, 20 bp, Artificial
  CRISPR gRNA sequence
tggagactgcatggcctgca

SEQ ID NO: 305627 - DNA, 20 bp, Artificial
  CRISPR gRNA sequence
agctgaaaacattttctatg

SEQ ID NO: 305628 - DNA, 20 bp, Artificial
  CRISPR gRNA sequence
attttctatgtggcctttca

SEQ ID NO: 305629 - DNA, 20 bp, Artificial
  CRISPR gRNA sequence
aaactgcttgactcctgctc

SEQ ID NO: 305630 - DNA, 20 bp, Artificial
  CRISPR gRNA sequence
gcttgactcctgctctagat

SEQ ID NO: 305631 - DNA, 20 bp, Artificial
  CRISPR gRNA sequence
tgctctagatcagcactgtc

SEQ ID NO: 305632 - DNA, 20 bp, Artificial
  CRISPR gRNA sequence
ctagatcagcactgtccagt

SEQ ID NO: 305633 - DNA, 20 bp, Artificial
  CRISPR gRNA sequence
tgtccagtaagaatataaaa

SEQ ID NO: 305634 - DNA, 20 bp, Artificial
  CRISPR gRNA sequence
gtccagtaagaatataaaac

SEQ ID NO: 305635 - DNA, 20 bp, Artificial
  CRISPR gRNA sequence
agtaagaatataaaacaggc

SEQ ID NO: 305636 - DNA, 20 bp, Artificial
  CRISPR gRNA sequence
gtaagaatataaaacaggcc

SEQ ID NO: 305637 - DNA, 20 bp, Artificial
  CRISPR gRNA sequence
aatataaaacaggccaggtg

SEQ ID NO: 305638 - DNA, 20 bp, Artificial
  CRISPR gRNA sequence
ataaaacaggccaggtgtgg

SEQ ID NO: 305639 - DNA, 20 bp, Artificial
  CRISPR gRNA sequence
gtggctcatgcttgtaatcc

SEQ ID NO: 305640 - DNA, 20 bp, Artificial
  CRISPR gRNA sequence
tgcttgtaatcccagcactt

SEQ ID NO: 305641 - DNA, 20 bp, Artificial
  CRISPR gRNA sequence
gcttgtaatcccagcacttt

SEQ ID NO: 305642 - DNA, 20 bp, Artificial
  CRISPR gRNA sequence
ttgtaatcccagcactttgg

SEQ ID NO: 305643 - DNA, 20 bp, Artificial
  CRISPR gRNA sequence
tgtaatcccagcactttggg

SEQ ID NO: 305644 - DNA, 20 bp, Artificial
  CRISPR gRNA sequence
tcccagcactttgggaggcc

SEQ ID NO: 305645 - DNA, 20 bp, Artificial
  CRISPR gRNA sequence
cccagcactttgggaggccg

SEQ ID NO: 305646 - DNA, 20 bp, Artificial
  CRISPR gRNA sequence
agcactttgggaggccgagg

SEQ ID NO: 305647 - DNA, 20 bp, Artificial
  CRISPR gRNA sequence
gcactttgggaggccgaggt

SEQ ID NO: 305648 - DNA, 20 bp, Artificial
  CRISPR gRNA sequence
ctttgggaggccgaggtggg

SEQ ID NO: 305649 - DNA, 20 bp, Artificial
  CRISPR gRNA sequence
ccgaggtgggcagattacct

SEQ ID NO: 305650 - DNA, 20 bp, Artificial
  CRISPR gRNA sequence
cgaggtgggcagattacctg

SEQ ID NO: 305651 - DNA, 20 bp, Artificial
  CRISPR gRNA sequence
gtgggcagattacctgaggt

SEQ ID NO: 305652 - DNA, 20 bp, Artificial
  CRISPR gRNA sequence
tgggcagattacctgaggtc

SEQ ID NO: 305653 - DNA, 20 bp, Artificial
  CRISPR gRNA sequence
ggcagattacctgaggtcag

SEQ ID NO: 305654 - DNA, 20 bp, Artificial
  CRISPR gRNA sequence
ttacctgaggtcaggagttt

SEQ ID NO: 305655 - DNA, 20 bp, Artificial
  CRISPR gRNA sequence
tgaggtcaggagtttgagac

SEQ ID NO: 305656 - DNA, 20 bp, Artificial
  CRISPR gRNA sequence
tcaggagtttgagaccagcc

SEQ ID NO: 305657 - DNA, 20 bp, Artificial
  CRISPR gRNA sequence
tgagaccagcctggccatta

SEQ ID NO: 305658 - DNA, 20 bp, Artificial
  CRISPR gRNA sequence
gagaccagcctggccattat

SEQ ID NO: 305659 - DNA, 20 bp, Artificial
  CRISPR gRNA sequence
agaccagcctggccattatg

SEQ ID NO: 305660 - DNA, 20 bp, Artificial
  CRISPR gRNA sequence
tctactaaaaatacaaaaat

SEQ ID NO: 305661 - DNA, 20 bp, Artificial
  CRISPR gRNA sequence
ctaaaaatacaaaaattagc

SEQ ID NO: 305662 - DNA, 20 bp, Artificial
  CRISPR gRNA sequence
taaaaatacaaaaattagct

SEQ ID NO: 305663 - DNA, 20 bp, Artificial
  CRISPR gRNA sequence
atacaaaaattagctgggca

SEQ ID NO: 305664 - DNA, 20 bp, Artificial
  CRISPR gRNA sequence
caaaaattagctgggcatag

SEQ ID NO: 305665 - DNA, 20 bp, Artificial
  CRISPR gRNA sequence
aaattagctgggcatagtgg

SEQ ID NO: 305666 - DNA, 20 bp, Artificial
  CRISPR gRNA sequence
aattagctgggcatagtggc

SEQ ID NO: 305667 - DNA, 20 bp, Artificial
  CRISPR gRNA sequence
gtggcgggcacctgtaattt

SEQ ID NO: 305668 - DNA, 20 bp, Artificial
  CRISPR gRNA sequence
cacctgtaatttcagctact

SEQ ID NO: 305669 - DNA, 20 bp, Artificial
  CRISPR gRNA sequence
acctgtaatttcagctactc

SEQ ID NO: 305670 - DNA, 20 bp, Artificial
  CRISPR gRNA sequence
ctgtaatttcagctactcag

SEQ ID NO: 305671 - DNA, 20 bp, Artificial
  CRISPR gRNA sequence
tgtaatttcagctactcagg

SEQ ID NO: 305672 - DNA, 20 bp, Artificial
  CRISPR gRNA sequence
tttcagctactcaggaggct

SEQ ID NO: 305673 - DNA, 20 bp, Artificial
  CRISPR gRNA sequence
ttcagctactcaggaggctg

SEQ ID NO: 305674 - DNA, 20 bp, Artificial
  CRISPR gRNA sequence
agctactcaggaggctgagg

SEQ ID NO: 305675 - DNA, 20 bp, Artificial
  CRISPR gRNA sequence
gctactcaggaggctgaggc

SEQ ID NO: 305676 - DNA, 20 bp, Artificial
  CRISPR gRNA sequence
tactcaggaggctgaggcag

SEQ ID NO: 305677 - DNA, 20 bp, Artificial
  CRISPR gRNA sequence
gcaggagaatcacttgaacc

SEQ ID NO: 305678 - DNA, 20 bp, Artificial
  CRISPR gRNA sequence
caggagaatcacttgaacct

SEQ ID NO: 305679 - DNA, 20 bp, Artificial
  CRISPR gRNA sequence
ggagaatcacttgaacctgg

SEQ ID NO: 305680 - DNA, 20 bp, Artificial
  CRISPR gRNA sequence
gagaatcacttgaacctggg

SEQ ID NO: 305681 - DNA, 20 bp, Artificial
  CRISPR gRNA sequence
aatcacttgaacctgggagg

SEQ ID NO: 305682 - DNA, 20 bp, Artificial
  CRISPR gRNA sequence
tcacttgaacctgggaggca

SEQ ID NO: 305683 - DNA, 20 bp, Artificial
  CRISPR gRNA sequence
tgggaggcagagcttgcgat

SEQ ID NO: 305684 - DNA, 20 bp, Artificial
  CRISPR gRNA sequence
gaggcagagcttgcgatgag

SEQ ID NO: 305685 - DNA, 20 bp, Artificial
  CRISPR gRNA sequence
ggcagagcttgcgatgagca

SEQ ID NO: 305686 - DNA, 20 bp, Artificial
  CRISPR gRNA sequence
gagatctcgccactgcactc

SEQ ID NO: 305687 - DNA, 20 bp, Artificial
  CRISPR gRNA sequence
ctcgccactgcactccagcc

SEQ ID NO: 305688 - DNA, 20 bp, Artificial
  CRISPR gRNA sequence
tcgccactgcactccagcct

SEQ ID NO: 305689 - DNA, 20 bp, Artificial
  CRISPR gRNA sequence
ctgcactccagcctgggcaa

SEQ ID NO: 305690 - DNA, 20 bp, Artificial
  CRISPR gRNA sequence
gcactccagcctgggcaaca

SEQ ID NO: 305691 - DNA, 20 bp, Artificial
  CRISPR gRNA sequence
tccagcctgggcaacagagt

SEQ ID NO: 305692 - DNA, 20 bp, Artificial
  CRISPR gRNA sequence
aacagagtaagactccatct

SEQ ID NO: 305693 - DNA, 20 bp, Artificial
  CRISPR gRNA sequence
aagactccatctcagaaaaa

SEQ ID NO: 305694 - DNA, 20 bp, Artificial
  CRISPR gRNA sequence
agaaaaaaagaatacaatac

SEQ ID NO: 305695 - DNA, 20 bp, Artificial
  CRISPR gRNA sequence
acaatacaagccacaattac

SEQ ID NO: 305696 - DNA, 20 bp, Artificial
  CRISPR gRNA sequence
caagccacaattacaagcca

SEQ ID NO: 305697 - DNA, 20 bp, Artificial
  CRISPR gRNA sequence
agatataatttgaaaacttg

SEQ ID NO: 305698 - DNA, 20 bp, Artificial
  CRISPR gRNA sequence
tataatttgaaaacttgtag

SEQ ID NO: 305699 - DNA, 20 bp, Artificial
  CRISPR gRNA sequence
aacttgtagtagtcacatta

SEQ ID NO: 305700 - DNA, 20 bp, Artificial
  CRISPR gRNA sequence
gtcacattaaagaaattaaa

SEQ ID NO: 305701 - DNA, 20 bp, Artificial
  CRISPR gRNA sequence
ttaaagaaattaaaaagaaa

SEQ ID NO: 305702 - DNA, 20 bp, Artificial
  CRISPR gRNA sequence
taaagaaattaaaaagaaat

SEQ ID NO: 305703 - DNA, 20 bp, Artificial
  CRISPR gRNA sequence
ttataatctcaacatgtaat

SEQ ID NO: 305704 - DNA, 20 bp, Artificial
  CRISPR gRNA sequence
aacgaatattttaaattttt

SEQ ID NO: 305705 - DNA, 20 bp, Artificial
  CRISPR gRNA sequence
gaatattttaaattttttgg

SEQ ID NO: 305706 - DNA, 20 bp, Artificial
  CRISPR gRNA sequence
ccaaatcttcaataatcatg

SEQ ID NO: 305707 - DNA, 20 bp, Artificial
  CRISPR gRNA sequence
caaatcttcaataatcatgt

SEQ ID NO: 305708 - DNA, 20 bp, Artificial
  CRISPR gRNA sequence
ataatcatgtgggtgtttta

SEQ ID NO: 305709 - DNA, 20 bp, Artificial
  CRISPR gRNA sequence
atgtgggtgttttatagtta

SEQ ID NO: 305710 - DNA, 20 bp, Artificial
  CRISPR gRNA sequence
tagttatagcacatctcaat

SEQ ID NO: 305711 - DNA, 20 bp, Artificial
  CRISPR gRNA sequence
agttatagcacatctcaatt

SEQ ID NO: 305712 - DNA, 20 bp, Artificial
  CRISPR gRNA sequence
tagcacatctcaattaggac

SEQ ID NO: 305713 - DNA, 20 bp, Artificial
  CRISPR gRNA sequence
aattaggactggctgcattt

SEQ ID NO: 305714 - DNA, 20 bp, Artificial
  CRISPR gRNA sequence
attaggactggctgcatttc

SEQ ID NO: 305715 - DNA, 20 bp, Artificial
  CRISPR gRNA sequence
ctggctgcatttcaggtaac

SEQ ID NO: 305716 - DNA, 20 bp, Artificial
  CRISPR gRNA sequence
gctgcatttcaggtaaccag

SEQ ID NO: 305717 - DNA, 20 bp, Artificial
  CRISPR gRNA sequence
gtaaccagtggctaccaaac

SEQ ID NO: 305718 - DNA, 20 bp, Artificial
  CRISPR gRNA sequence
ccagtggctaccaaactgga

SEQ ID NO: 305719 - DNA, 20 bp, Artificial
  CRISPR gRNA sequence
caaactggacagtgcatctc

SEQ ID NO: 305720 - DNA, 20 bp, Artificial
  CRISPR gRNA sequence
tggacagtgcatctccagat

SEQ ID NO: 305721 - DNA, 20 bp, Artificial
  CRISPR gRNA sequence
ctccagatcagcccatccat

SEQ ID NO: 305722 - DNA, 20 bp, Artificial
  CRISPR gRNA sequence
atccatcagcttaataacat

SEQ ID NO: 305723 - DNA, 20 bp, Artificial
  CRISPR gRNA sequence
tccatcagcttaataacatc

SEQ ID NO: 305724 - DNA, 20 bp, Artificial
  CRISPR gRNA sequence
catcaggtgatatcaattga

SEQ ID NO: 305725 - DNA, 20 bp, Artificial
  CRISPR gRNA sequence
gtgatatcaattgatggcat

SEQ ID NO: 305726 - DNA, 20 bp, Artificial
  CRISPR gRNA sequence
tgatatcaattgatggcatg

SEQ ID NO: 305727 - DNA, 20 bp, Artificial
  CRISPR gRNA sequence
tcaattgatggcatgaggaa

SEQ ID NO: 305728 - DNA, 20 bp, Artificial
  CRISPR gRNA sequence
ggcatgaggaacagaaaaat

SEQ ID NO: 305729 - DNA, 20 bp, Artificial
  CRISPR gRNA sequence
gaggaacagaaaaatcagcc

SEQ ID NO: 305730 - DNA, 20 bp, Artificial
  CRISPR gRNA sequence
aggaacagaaaaatcagcca

SEQ ID NO: 305731 - DNA, 20 bp, Artificial
  CRISPR gRNA sequence
ttcctgaccccaaacattgt

SEQ ID NO: 305732 - DNA, 20 bp, Artificial
  CRISPR gRNA sequence
cctgaccccaaacattgtga

SEQ ID NO: 305733 - DNA, 20 bp, Artificial
  CRISPR gRNA sequence
tgaccccaaacattgtgaga

SEQ ID NO: 305734 - DNA, 20 bp, Artificial
  CRISPR gRNA sequence
gaccccaaacattgtgagag

SEQ ID NO: 305735 - DNA, 20 bp, Artificial
  CRISPR gRNA sequence
accccaaacattgtgagaga

SEQ ID NO: 305736 - DNA, 20 bp, Artificial
  CRISPR gRNA sequence
aaacattgtgagagagggta

SEQ ID NO: 305737 - DNA, 20 bp, Artificial
  CRISPR gRNA sequence
aacattgtgagagagggtaa

SEQ ID NO: 305738 - DNA, 20 bp, Artificial
  CRISPR gRNA sequence
ggtaaaggattcattgttct

SEQ ID NO: 305739 - DNA, 20 bp, Artificial
  CRISPR gRNA sequence
attcattgttctaagctgct

SEQ ID NO: 305740 - DNA, 20 bp, Artificial
  CRISPR gRNA sequence
ttgttctaagctgctaagtt

SEQ ID NO: 305741 - DNA, 20 bp, Artificial
  CRISPR gRNA sequence
gttctaagctgctaagtttg

SEQ ID NO: 305742 - DNA, 20 bp, Artificial
  CRISPR gRNA sequence
taagctgctaagtttggaga

SEQ ID NO: 305743 - DNA, 20 bp, Artificial
  CRISPR gRNA sequence
gagacagtttgtaacatacc

SEQ ID NO: 305744 - DNA, 20 bp, Artificial
  CRISPR gRNA sequence
gacagtttgtaacataccaa

SEQ ID NO: 305745 - DNA, 20 bp, Artificial
  CRISPR gRNA sequence
acagtttgtaacataccaag

SEQ ID NO: 305746 - DNA, 20 bp, Artificial
  CRISPR gRNA sequence
gtaacataccaagaggcaaa

SEQ ID NO: 305747 - DNA, 20 bp, Artificial
  CRISPR gRNA sequence
ataccaagaggcaaacagaa

SEQ ID NO: 305748 - DNA, 20 bp, Artificial
  CRISPR gRNA sequence
ggcaaacagaacagattgaa

SEQ ID NO: 305749 - DNA, 20 bp, Artificial
  CRISPR gRNA sequence
gcaaacagaacagattgaat

SEQ ID NO: 305750 - DNA, 20 bp, Artificial
  CRISPR gRNA sequence
aacagaacagattgaatagg

SEQ ID NO: 305751 - DNA, 20 bp, Artificial
  CRISPR gRNA sequence
acagaacagattgaataggt

SEQ ID NO: 305752 - DNA, 20 bp, Artificial
  CRISPR gRNA sequence
agattgaataggtaggtgct

SEQ ID NO: 305753 - DNA, 20 bp, Artificial
  CRISPR gRNA sequence
ttgaataggtaggtgctaag

SEQ ID NO: 305754 - DNA, 20 bp, Artificial
  CRISPR gRNA sequence
tgaataggtaggtgctaagt

SEQ ID NO: 305755 - DNA, 20 bp, Artificial
  CRISPR gRNA sequence
aggtaggtgctaagtaggtg

SEQ ID NO: 305756 - DNA, 20 bp, Artificial
  CRISPR gRNA sequence
ggtaggtgctaagtaggtga

SEQ ID NO: 305757 - DNA, 20 bp, Artificial
  CRISPR gRNA sequence
gtaggtgctaagtaggtgaa

SEQ ID NO: 305758 - DNA, 20 bp, Artificial
  CRISPR gRNA sequence
tgctaagtaggtgaagggct

SEQ ID NO: 305759 - DNA, 20 bp, Artificial
  CRISPR gRNA sequence
gctaagtaggtgaagggctt

SEQ ID NO: 305760 - DNA, 20 bp, Artificial
  CRISPR gRNA sequence
taagtaggtgaagggcttgg

SEQ ID NO: 305761 - DNA, 20 bp, Artificial
  CRISPR gRNA sequence
gtgaagggcttgggagttga

SEQ ID NO: 305762 - DNA, 20 bp, Artificial
  CRISPR gRNA sequence
tgaagggcttgggagttgac

SEQ ID NO: 305763 - DNA, 20 bp, Artificial
  CRISPR gRNA sequence
agggcttgggagttgacagg

SEQ ID NO: 305764 - DNA, 20 bp, Artificial
  CRISPR gRNA sequence
ggcttgggagttgacaggaa

SEQ ID NO: 305765 - DNA, 20 bp, Artificial
  CRISPR gRNA sequence
gagttgacaggaagagttct

SEQ ID NO: 305766 - DNA, 20 bp, Artificial
  CRISPR gRNA sequence
gacaggaagagttctcggca

SEQ ID NO: 305767 - DNA, 20 bp, Artificial
  CRISPR gRNA sequence
acaggaagagttctcggcaa

SEQ ID NO: 305768 - DNA, 20 bp, Artificial
  CRISPR gRNA sequence
caggaagagttctcggcaaa

SEQ ID NO: 305769 - DNA, 20 bp, Artificial
  CRISPR gRNA sequence
agagttctcggcaaagggaa

SEQ ID NO: 305770 - DNA, 20 bp, Artificial
  CRISPR gRNA sequence
caaagggaacagcatatgca

SEQ ID NO: 305771 - DNA, 20 bp, Artificial
  CRISPR gRNA sequence
aaagggaacagcatatgcaa

SEQ ID NO: 305772 - DNA, 20 bp, Artificial
  CRISPR gRNA sequence
acagcatatgcaaaggcgct

SEQ ID NO: 305773 - DNA, 20 bp, Artificial
  CRISPR gRNA sequence
cagcatatgcaaaggcgctg

SEQ ID NO: 305774 - DNA, 20 bp, Artificial
  CRISPR gRNA sequence
catatgcaaaggcgctgagg

SEQ ID NO: 305775 - DNA, 20 bp, Artificial
  CRISPR gRNA sequence
atatgcaaaggcgctgaggc

SEQ ID NO: 305776 - DNA, 20 bp, Artificial
  CRISPR gRNA sequence
atgcaaaggcgctgaggcag

SEQ ID NO: 305777 - DNA, 20 bp, Artificial
  CRISPR gRNA sequence
tgcaaaggcgctgaggcagg

SEQ ID NO: 305778 - DNA, 20 bp, Artificial
  CRISPR gRNA sequence
gcaaaggcgctgaggcagga

SEQ ID NO: 305779 - DNA, 20 bp, Artificial
  CRISPR gRNA sequence
gctgaggcaggagggcacgt

SEQ ID NO: 305780 - DNA, 20 bp, Artificial
  CRISPR gRNA sequence
tgaggcaggagggcacgtga

SEQ ID NO: 305781 - DNA, 20 bp, Artificial
  CRISPR gRNA sequence
ggcaggagggcacgtgagag

SEQ ID NO: 305782 - DNA, 20 bp, Artificial
  CRISPR gRNA sequence
gcaggagggcacgtgagaga

SEQ ID NO: 305783 - DNA, 20 bp, Artificial
  CRISPR gRNA sequence
gggcacgtgagagaaggtac

SEQ ID NO: 305784 - DNA, 20 bp, Artificial
  CRISPR gRNA sequence
ggcacgtgagagaaggtacg

SEQ ID NO: 305785 - DNA, 20 bp, Artificial
  CRISPR gRNA sequence
cacgtgagagaaggtacgag

SEQ ID NO: 305786 - DNA, 20 bp, Artificial
  CRISPR gRNA sequence
acgtgagagaaggtacgagg

SEQ ID NO: 305787 - DNA, 20 bp, Artificial
  CRISPR gRNA sequence
aaggtacgaggaggtccctg

SEQ ID NO: 305788 - DNA, 20 bp, Artificial
  CRISPR gRNA sequence
aggtccctgtggccaaaatg

SEQ ID NO: 305789 - DNA, 20 bp, Artificial
  CRISPR gRNA sequence
gtccctgtggccaaaatgaa

SEQ ID NO: 305790 - DNA, 20 bp, Artificial
  CRISPR gRNA sequence
ctgtggccaaaatgaagaga

SEQ ID NO: 305791 - DNA, 20 bp, Artificial
  CRISPR gRNA sequence
tgtggccaaaatgaagagac

SEQ ID NO: 305792 - DNA, 20 bp, Artificial
  CRISPR gRNA sequence
caaaatgaagagacaggtga

SEQ ID NO: 305793 - DNA, 20 bp, Artificial
  CRISPR gRNA sequence
tgaagagacaggtgaaagac

SEQ ID NO: 305794 - DNA, 20 bp, Artificial
  CRISPR gRNA sequence
gaagagacaggtgaaagaca

SEQ ID NO: 305795 - DNA, 20 bp, Artificial
  CRISPR gRNA sequence
acaggtgaaagacaaggctg

SEQ ID NO: 305796 - DNA, 20 bp, Artificial
  CRISPR gRNA sequence
aggtgaaagacaaggctgaa

SEQ ID NO: 305797 - DNA, 20 bp, Artificial
  CRISPR gRNA sequence
ggtgaaagacaaggctgaag

SEQ ID NO: 305798 - DNA, 20 bp, Artificial
  CRISPR gRNA sequence
aaagacaaggctgaagaggt

SEQ ID NO: 305799 - DNA, 20 bp, Artificial
  CRISPR gRNA sequence
gacaaggctgaagaggtgag

SEQ ID NO: 305800 - DNA, 20 bp, Artificial
  CRISPR gRNA sequence
acaaggctgaagaggtgagc

SEQ ID NO: 305801 - DNA, 20 bp, Artificial
  CRISPR gRNA sequence
caaggctgaagaggtgagca

SEQ ID NO: 305802 - DNA, 20 bp, Artificial
  CRISPR gRNA sequence
aaggctgaagaggtgagcag

SEQ ID NO: 305803 - DNA, 20 bp, Artificial
  CRISPR gRNA sequence
ctgaagaggtgagcaggggc

SEQ ID NO: 305804 - DNA, 20 bp, Artificial
  CRISPR gRNA sequence
ccagatcacacgtgtgttat

SEQ ID NO: 305805 - DNA, 20 bp, Artificial
  CRISPR gRNA sequence
atcacacgtgtgttattggt

SEQ ID NO: 305806 - DNA, 20 bp, Artificial
  CRISPR gRNA sequence
cgtgtgttattggtcagtta

SEQ ID NO: 305807 - DNA, 20 bp, Artificial
  CRISPR gRNA sequence
tattggtcagttaaagattt

SEQ ID NO: 305808 - DNA, 20 bp, Artificial
  CRISPR gRNA sequence
tctttatatgtgaaccacca

SEQ ID NO: 305809 - DNA, 20 bp, Artificial
  CRISPR gRNA sequence
atgtgaaccaccaaagaaat

SEQ ID NO: 305810 - DNA, 20 bp, Artificial
  CRISPR gRNA sequence
gtgaaccaccaaagaaatta

SEQ ID NO: 305811 - DNA, 20 bp, Artificial
  CRISPR gRNA sequence
ccaccaaagaaattagagct

SEQ ID NO: 305812 - DNA, 20 bp, Artificial
  CRISPR gRNA sequence
agagctgagactgatatcat

SEQ ID NO: 305813 - DNA, 20 bp, Artificial
  CRISPR gRNA sequence
catcagatttgcattttgaa

SEQ ID NO: 305814 - DNA, 20 bp, Artificial
  CRISPR gRNA sequence
gcattttgaaaagatgacca

SEQ ID NO: 305815 - DNA, 20 bp, Artificial
  CRISPR gRNA sequence
agatgaccatggtttctgtg

SEQ ID NO: 305816 - DNA, 20 bp, Artificial
  CRISPR gRNA sequence
catggtttctgtgtagcaaa

SEQ ID NO: 305817 - DNA, 20 bp, Artificial
  CRISPR gRNA sequence
tctgtgtagcaaatggatga

SEQ ID NO: 305818 - DNA, 20 bp, Artificial
  CRISPR gRNA sequence
ctgtgtagcaaatggatgat

SEQ ID NO: 305819 - DNA, 20 bp, Artificial
  CRISPR gRNA sequence
tgtgtagcaaatggatgata

SEQ ID NO: 305820 - DNA, 20 bp, Artificial
  CRISPR gRNA sequence
gtagcaaatggatgataggg

SEQ ID NO: 305821 - DNA, 20 bp, Artificial
  CRISPR gRNA sequence
caaatggatgatagggaagc

SEQ ID NO: 305822 - DNA, 20 bp, Artificial
  CRISPR gRNA sequence
aaatggatgatagggaagcc

SEQ ID NO: 305823 - DNA, 20 bp, Artificial
  CRISPR gRNA sequence
ggatgatagggaagccagga

SEQ ID NO: 305824 - DNA, 20 bp, Artificial
  CRISPR gRNA sequence
tagggaagccaggacagatg

SEQ ID NO: 305825 - DNA, 20 bp, Artificial
  CRISPR gRNA sequence
agggaagccaggacagatgc

SEQ ID NO: 305826 - DNA, 20 bp, Artificial
  CRISPR gRNA sequence
gaagccaggacagatgcagg

SEQ ID NO: 305827 - DNA, 20 bp, Artificial
  CRISPR gRNA sequence
acagatgcaggaagaccaat

SEQ ID NO: 305828 - DNA, 20 bp, Artificial
  CRISPR gRNA sequence
atgcaggaagaccaatcagt

SEQ ID NO: 305829 - DNA, 20 bp, Artificial
  CRISPR gRNA sequence
gttggctactgcaattgttt

SEQ ID NO: 305830 - DNA, 20 bp, Artificial
  CRISPR gRNA sequence
tactgcaattgtttgagtga

SEQ ID NO: 305831 - DNA, 20 bp, Artificial
  CRISPR gRNA sequence
tgcaattgtttgagtgaaag

SEQ ID NO: 305832 - DNA, 20 bp, Artificial
  CRISPR gRNA sequence
attgtttgagtgaaagaaga

SEQ ID NO: 305833 - DNA, 20 bp, Artificial
  CRISPR gRNA sequence
agtgaaagaagatggctgtt

SEQ ID NO: 305834 - DNA, 20 bp, Artificial
  CRISPR gRNA sequence
aagaagatggctgtttggtc

SEQ ID NO: 305835 - DNA, 20 bp, Artificial
  CRISPR gRNA sequence
agaagatggctgtttggtct

SEQ ID NO: 305836 - DNA, 20 bp, Artificial
  CRISPR gRNA sequence
gatggctgtttggtctggga

SEQ ID NO: 305837 - DNA, 20 bp, Artificial
  CRISPR gRNA sequence
ggctgtttggtctgggatag

SEQ ID NO: 305838 - DNA, 20 bp, Artificial
  CRISPR gRNA sequence
tgtttggtctgggatagtag

SEQ ID NO: 305839 - DNA, 20 bp, Artificial
  CRISPR gRNA sequence
gtttggtctgggatagtagc

SEQ ID NO: 305840 - DNA, 20 bp, Artificial
  CRISPR gRNA sequence
gtctgggatagtagcaggtg

SEQ ID NO: 305841 - DNA, 20 bp, Artificial
  CRISPR gRNA sequence
gggatagtagcaggtgaagt

SEQ ID NO: 305842 - DNA, 20 bp, Artificial
  CRISPR gRNA sequence
ggatagtagcaggtgaagta

SEQ ID NO: 305843 - DNA, 20 bp, Artificial
  CRISPR gRNA sequence
gatagtagcaggtgaagtaa

SEQ ID NO: 305844 - DNA, 20 bp, Artificial
  CRISPR gRNA sequence
tagcaggtgaagtaagggaa

SEQ ID NO: 305845 - DNA, 20 bp, Artificial
  CRISPR gRNA sequence
caggtgaagtaagggaaaag

SEQ ID NO: 305846 - DNA, 20 bp, Artificial
  CRISPR gRNA sequence
tgaagtaagggaaaagtgga

SEQ ID NO: 305847 - DNA, 20 bp, Artificial
  CRISPR gRNA sequence
aagggaaaagtggatagatc

SEQ ID NO: 305848 - DNA, 20 bp, Artificial
  CRISPR gRNA sequence
tggatagatcaagaaatatt

SEQ ID NO: 305849 - DNA, 20 bp, Artificial
  CRISPR gRNA sequence
atatttagaattataattaa

SEQ ID NO: 305850 - DNA, 20 bp, Artificial
  CRISPR gRNA sequence
tatttagaattataattaac

SEQ ID NO: 305851 - DNA, 20 bp, Artificial
  CRISPR gRNA sequence
gaattataattaacaggata

SEQ ID NO: 305852 - DNA, 20 bp, Artificial
  CRISPR gRNA sequence
taattaacaggatatggtga

SEQ ID NO: 305853 - DNA, 20 bp, Artificial
  CRISPR gRNA sequence
gatatggtgatagatcaata

SEQ ID NO: 305854 - DNA, 20 bp, Artificial
  CRISPR gRNA sequence
atatggtgatagatcaatat

SEQ ID NO: 305855 - DNA, 20 bp, Artificial
  CRISPR gRNA sequence
gatagatcaatatgggaaat

SEQ ID NO: 305856 - DNA, 20 bp, Artificial
  CRISPR gRNA sequence
atagatcaatatgggaaatg

SEQ ID NO: 305857 - DNA, 20 bp, Artificial
  CRISPR gRNA sequence
caatatgggaaatgaggaca

SEQ ID NO: 305858 - DNA, 20 bp, Artificial
  CRISPR gRNA sequence
attcatttattcatttgact

SEQ ID NO: 305859 - DNA, 20 bp, Artificial
  CRISPR gRNA sequence
actgcatcattcttgtctaa

SEQ ID NO: 305860 - DNA, 20 bp, Artificial
  CRISPR gRNA sequence
tgtctaaaagactgatccca

SEQ ID NO: 305861 - DNA, 20 bp, Artificial
  CRISPR gRNA sequence
ctaaaagactgatcccacag

SEQ ID NO: 305862 - DNA, 20 bp, Artificial
  CRISPR gRNA sequence
gatcccacagtggatgctac

SEQ ID NO: 305863 - DNA, 20 bp, Artificial
  CRISPR gRNA sequence
ctatttcacttttatgtatt

SEQ ID NO: 305864 - DNA, 20 bp, Artificial
  CRISPR gRNA sequence
tttagtaaaactactaataa

SEQ ID NO: 305865 - DNA, 20 bp, Artificial
  CRISPR gRNA sequence
aaaactactaataaaagcaa

SEQ ID NO: 305866 - DNA, 20 bp, Artificial
  CRISPR gRNA sequence
gaaatcaaacttatgctgtg

SEQ ID NO: 305867 - DNA, 20 bp, Artificial
  CRISPR gRNA sequence
tcaaacttatgctgtgcaga

SEQ ID NO: 305868 - DNA, 20 bp, Artificial
  CRISPR gRNA sequence
ctgtgcagatggcacaaaat

SEQ ID NO: 305869 - DNA, 20 bp, Artificial
  CRISPR gRNA sequence
gcagatggcacaaaatgaga

SEQ ID NO: 305870 - DNA, 20 bp, Artificial
  CRISPR gRNA sequence
atggcacaaaatgagacaga

SEQ ID NO: 305871 - DNA, 20 bp, Artificial
  CRISPR gRNA sequence
gagacagatagctcaaaaat

SEQ ID NO: 305872 - DNA, 20 bp, Artificial
  CRISPR gRNA sequence
cagatagctcaaaaatgagt

SEQ ID NO: 305873 - DNA, 20 bp, Artificial
  CRISPR gRNA sequence
tagctgaattaacattcata

SEQ ID NO: 305874 - DNA, 20 bp, Artificial
  CRISPR gRNA sequence
taacattcataaagcctgaa

SEQ ID NO: 305875 - DNA, 20 bp, Artificial
  CRISPR gRNA sequence
acattcataaagcctgaaaa

SEQ ID NO: 305876 - DNA, 20 bp, Artificial
  CRISPR gRNA sequence
attcataaagcctgaaaaga

SEQ ID NO: 305877 - DNA, 20 bp, Artificial
  CRISPR gRNA sequence
actaacatgatgaatctcct

SEQ ID NO: 305878 - DNA, 20 bp, Artificial
  CRISPR gRNA sequence
ctaacatgatgaatctcctg

SEQ ID NO: 305879 - DNA, 20 bp, Artificial
  CRISPR gRNA sequence
taacatgatgaatctcctga

SEQ ID NO: 305880 - DNA, 20 bp, Artificial
  CRISPR gRNA sequence
atgatgaatctcctgagggt

SEQ ID NO: 305881 - DNA, 20 bp, Artificial
  CRISPR gRNA sequence
aatctcctgagggtaagtgt

SEQ ID NO: 305882 - DNA, 20 bp, Artificial
  CRISPR gRNA sequence
aagtgtaagaatctgtactt

SEQ ID NO: 305883 - DNA, 20 bp, Artificial
  CRISPR gRNA sequence
ttttgaaataacaactgtgt

SEQ ID NO: 305884 - DNA, 20 bp, Artificial
  CRISPR gRNA sequence
ttgaaataacaactgtgtaa

SEQ ID NO: 305885 - DNA, 20 bp, Artificial
  CRISPR gRNA sequence
tgaaataacaactgtgtaag

SEQ ID NO: 305886 - DNA, 20 bp, Artificial
  CRISPR gRNA sequence
aataacaactgtgtaagagg

SEQ ID NO: 305887 - DNA, 20 bp, Artificial
  CRISPR gRNA sequence
aacaactgtgtaagaggaag

SEQ ID NO: 305888 - DNA, 20 bp, Artificial
  CRISPR gRNA sequence
aactgtgtaagaggaagaag

SEQ ID NO: 305889 - DNA, 20 bp, Artificial
  CRISPR gRNA sequence
gtaagaggaagaagtggaca

SEQ ID NO: 305890 - DNA, 20 bp, Artificial
  CRISPR gRNA sequence
taagaggaagaagtggacac

SEQ ID NO: 305891 - DNA, 20 bp, Artificial
  CRISPR gRNA sequence
agaggaagaagtggacacag

SEQ ID NO: 305892 - DNA, 20 bp, Artificial
  CRISPR gRNA sequence
agaagtggacacaggagaaa

SEQ ID NO: 305893 - DNA, 20 bp, Artificial
  CRISPR gRNA sequence
caggagaaatagtctatcca

SEQ ID NO: 305894 - DNA, 20 bp, Artificial
  CRISPR gRNA sequence
agtaaacataaaaatcacat

SEQ ID NO: 305895 - DNA, 20 bp, Artificial
  CRISPR gRNA sequence
cataaaaatcacataagtgt

SEQ ID NO: 305896 - DNA, 20 bp, Artificial
  CRISPR gRNA sequence
aaatcacataagtgttagtg

SEQ ID NO: 305897 - DNA, 20 bp, Artificial
  CRISPR gRNA sequence
acataagtgttagtgtggta

SEQ ID NO: 305898 - DNA, 20 bp, Artificial
  CRISPR gRNA sequence
agtgttagtgtggtatggct

SEQ ID NO: 305899 - DNA, 20 bp, Artificial
  CRISPR gRNA sequence
aagtaaatttcatccaatcc

SEQ ID NO: 305900 - DNA, 20 bp, Artificial
  CRISPR gRNA sequence
aatttcatccaatcctagtg

SEQ ID NO: 305901 - DNA, 20 bp, Artificial
  CRISPR gRNA sequence
atttcatccaatcctagtgt

SEQ ID NO: 305902 - DNA, 20 bp, Artificial
  CRISPR gRNA sequence
tcactgaactctgtgctaat

SEQ ID NO: 305903 - DNA, 20 bp, Artificial
  CRISPR gRNA sequence
taatcagaccacatcgcttg

SEQ ID NO: 305904 - DNA, 20 bp, Artificial
  CRISPR gRNA sequence
cttgtggtatcacgttctgt

SEQ ID NO: 305905 - DNA, 20 bp, Artificial
  CRISPR gRNA sequence
ttgtggtatcacgttctgtg

SEQ ID NO: 305906 - DNA, 20 bp, Artificial
  CRISPR gRNA sequence
ggtatcacgttctgtgaggt

SEQ ID NO: 305907 - DNA, 20 bp, Artificial
  CRISPR gRNA sequence
ttgaatgacactgacaaatt

SEQ ID NO: 305908 - DNA, 20 bp, Artificial
  CRISPR gRNA sequence
actgacaaattcggtttatc

SEQ ID NO: 305909 - DNA, 20 bp, Artificial
  CRISPR gRNA sequence
ctgacaaattcggtttatca

SEQ ID NO: 305910 - DNA, 20 bp, Artificial
  CRISPR gRNA sequence
tgacaaattcggtttatcaa

SEQ ID NO: 305911 - DNA, 20 bp, Artificial
  CRISPR gRNA sequence
gacaaattcggtttatcaag

SEQ ID NO: 305912 - DNA, 20 bp, Artificial
  CRISPR gRNA sequence
aaattcggtttatcaagggg

SEQ ID NO: 305913 - DNA, 20 bp, Artificial
  CRISPR gRNA sequence
aattcggtttatcaagggga

SEQ ID NO: 305914 - DNA, 20 bp, Artificial
  CRISPR gRNA sequence
attcggtttatcaaggggaa

SEQ ID NO: 305915 - DNA, 20 bp, Artificial
  CRISPR gRNA sequence
cggtttatcaaggggaaggg

SEQ ID NO: 305916 - DNA, 20 bp, Artificial
  CRISPR gRNA sequence
ttatcaaggggaagggcagc

SEQ ID NO: 305917 - DNA, 20 bp, Artificial
  CRISPR gRNA sequence
tatcaaggggaagggcagca

SEQ ID NO: 305918 - DNA, 20 bp, Artificial
  CRISPR gRNA sequence
ggaagggcagcaaggttcac

SEQ ID NO: 305919 - DNA, 20 bp, Artificial
  CRISPR gRNA sequence
taatgaaattatgtcaaatg

SEQ ID NO: 305920 - DNA, 20 bp, Artificial
  CRISPR gRNA sequence
gtcaaatgaagaacaactaa

SEQ ID NO: 305921 - DNA, 20 bp, Artificial
  CRISPR gRNA sequence
tcaaatgaagaacaactaaa

SEQ ID NO: 305922 - DNA, 20 bp, Artificial
  CRISPR gRNA sequence
tgaagaacaactaaaaggac

SEQ ID NO: 305923 - DNA, 20 bp, Artificial
  CRISPR gRNA sequence
gaagaacaactaaaaggact

SEQ ID NO: 305924 - DNA, 20 bp, Artificial
  CRISPR gRNA sequence
aagaacaactaaaaggacta

SEQ ID NO: 305925 - DNA, 20 bp, Artificial
  CRISPR gRNA sequence
ggactagggtaatgaacctg

SEQ ID NO: 305926 - DNA, 20 bp, Artificial
  CRISPR gRNA sequence
ctagggtaatgaacctgaag

SEQ ID NO: 305927 - DNA, 20 bp, Artificial
  CRISPR gRNA sequence
gtaatgaacctgaagaagaa

SEQ ID NO: 305928 - DNA, 20 bp, Artificial
  CRISPR gRNA sequence
cctgaagaagaaaagattgc

SEQ ID NO: 305929 - DNA, 20 bp, Artificial
  CRISPR gRNA sequence
aaaagattgcaagtatatgc

SEQ ID NO: 305930 - DNA, 20 bp, Artificial
  CRISPR gRNA sequence
aaagattgcaagtatatgct

SEQ ID NO: 305931 - DNA, 20 bp, Artificial
  CRISPR gRNA sequence
ctgggtgtctgcaaatatgt

SEQ ID NO: 305932 - DNA, 20 bp, Artificial
  CRISPR gRNA sequence
tgggtgtctgcaaatatgta

SEQ ID NO: 305933 - DNA, 20 bp, Artificial
  CRISPR gRNA sequence
gggtgtctgcaaatatgtaa

SEQ ID NO: 305934 - DNA, 20 bp, Artificial
  CRISPR gRNA sequence
aatatgtaagggcccttcca

SEQ ID NO: 305935 - DNA, 20 bp, Artificial
  CRISPR gRNA sequence
atatgtaagggcccttccat

SEQ ID NO: 305936 - DNA, 20 bp, Artificial
  CRISPR gRNA sequence
atgtaagggcccttccatgg

SEQ ID NO: 305937 - DNA, 20 bp, Artificial
  CRISPR gRNA sequence
tgtaagggcccttccatggg

SEQ ID NO: 305938 - DNA, 20 bp, Artificial
  CRISPR gRNA sequence
ggatacatacactgttgctg

SEQ ID NO: 305939 - DNA, 20 bp, Artificial
  CRISPR gRNA sequence
gatacatacactgttgctga

SEQ ID NO: 305940 - DNA, 20 bp, Artificial
  CRISPR gRNA sequence
atacatacactgttgctgaa

SEQ ID NO: 305941 - DNA, 20 bp, Artificial
  CRISPR gRNA sequence
atacactgttgctgaagggc

SEQ ID NO: 305942 - DNA, 20 bp, Artificial
  CRISPR gRNA sequence
cactgttgctgaagggcaag

SEQ ID NO: 305943 - DNA, 20 bp, Artificial
  CRISPR gRNA sequence
caagtagttccaataactaa

SEQ ID NO: 305944 - DNA, 20 bp, Artificial
  CRISPR gRNA sequence
gttccaataactaaaagtta

SEQ ID NO: 305945 - DNA, 20 bp, Artificial
  CRISPR gRNA sequence
ttccaataactaaaagttac

SEQ ID NO: 305946 - DNA, 20 bp, Artificial
  CRISPR gRNA sequence
tccaataactaaaagttaca

SEQ ID NO: 305947 - DNA, 20 bp, Artificial
  CRISPR gRNA sequence
caataactaaaagttacagg

SEQ ID NO: 305948 - DNA, 20 bp, Artificial
  CRISPR gRNA sequence
aactaaaagttacagggagc

SEQ ID NO: 305949 - DNA, 20 bp, Artificial
  CRISPR gRNA sequence
agttacagggagccagattt

SEQ ID NO: 305950 - DNA, 20 bp, Artificial
  CRISPR gRNA sequence
agggagccagatttcagttc

SEQ ID NO: 305951 - DNA, 20 bp, Artificial
  CRISPR gRNA sequence
cagatttcagttccagatga

SEQ ID NO: 305952 - DNA, 20 bp, Artificial
  CRISPR gRNA sequence
agatgatggaaaacttttaa

SEQ ID NO: 305953 - DNA, 20 bp, Artificial
  CRISPR gRNA sequence
atgatggaaaacttttaata

SEQ ID NO: 305954 - DNA, 20 bp, Artificial
  CRISPR gRNA sequence
gatggaaaacttttaataga

SEQ ID NO: 305955 - DNA, 20 bp, Artificial
  CRISPR gRNA sequence
aacttttaatagagagctac

SEQ ID NO: 305956 - DNA, 20 bp, Artificial
  CRISPR gRNA sequence
agagagctacaagcaatgac

SEQ ID NO: 305957 - DNA, 20 bp, Artificial
  CRISPR gRNA sequence
caatgactggattttcttgt

SEQ ID NO: 305958 - DNA, 20 bp, Artificial
  CRISPR gRNA sequence
aatgactggattttcttgtg

SEQ ID NO: 305959 - DNA, 20 bp, Artificial
  CRISPR gRNA sequence
ggattttcttgtgaggtgat

SEQ ID NO: 305960 - DNA, 20 bp, Artificial
  CRISPR gRNA sequence
ggtgataagctccctgtcac

SEQ ID NO: 305961 - DNA, 20 bp, Artificial
  CRISPR gRNA sequence
cacaagtactattcaaacca

SEQ ID NO: 305962 - DNA, 20 bp, Artificial
  CRISPR gRNA sequence
aagtactattcaaaccaaag

SEQ ID NO: 305963 - DNA, 20 bp, Artificial
  CRISPR gRNA sequence
agtactattcaaaccaaagt

SEQ ID NO: 305964 - DNA, 20 bp, Artificial
  CRISPR gRNA sequence
gtactattcaaaccaaagtg

SEQ ID NO: 305965 - DNA, 20 bp, Artificial
  CRISPR gRNA sequence
tactattcaaaccaaagtgg

SEQ ID NO: 305966 - DNA, 20 bp, Artificial
  CRISPR gRNA sequence
ccaaagtgggggtgataaca

SEQ ID NO: 305967 - DNA, 20 bp, Artificial
  CRISPR gRNA sequence
aagtgggggtgataacacag

SEQ ID NO: 305968 - DNA, 20 bp, Artificial
  CRISPR gRNA sequence
gtgggggtgataacacagaa

SEQ ID NO: 305969 - DNA, 20 bp, Artificial
  CRISPR gRNA sequence
ataacacagaagagacattt

SEQ ID NO: 305970 - DNA, 20 bp, Artificial
  CRISPR gRNA sequence
taacacagaagagacatttt

SEQ ID NO: 305971 - DNA, 20 bp, Artificial
  CRISPR gRNA sequence
acacagaagagacattttag

SEQ ID NO: 305972 - DNA, 20 bp, Artificial
  CRISPR gRNA sequence
ttaggagcgaatctcgaatt

SEQ ID NO: 305973 - DNA, 20 bp, Artificial
  CRISPR gRNA sequence
gagcgaatctcgaattgagt

SEQ ID NO: 305974 - DNA, 20 bp, Artificial
  CRISPR gRNA sequence
cgaatctcgaattgagtaag

SEQ ID NO: 305975 - DNA, 20 bp, Artificial
  CRISPR gRNA sequence
tggttgaactcataactttt

SEQ ID NO: 305976 - DNA, 20 bp, Artificial
  CRISPR gRNA sequence
taacttttcagttcacctct

SEQ ID NO: 305977 - DNA, 20 bp, Artificial
  CRISPR gRNA sequence
taagattctcattacatttc

SEQ ID NO: 305978 - DNA, 20 bp, Artificial
  CRISPR gRNA sequence
aagattctcattacatttcc

SEQ ID NO: 305979 - DNA, 20 bp, Artificial
  CRISPR gRNA sequence
ctcattacatttccaggaat

SEQ ID NO: 305980 - DNA, 20 bp, Artificial
  CRISPR gRNA sequence
tcattacatttccaggaata

SEQ ID NO: 305981 - DNA, 20 bp, Artificial
  CRISPR gRNA sequence
attacatttccaggaataag

SEQ ID NO: 305982 - DNA, 20 bp, Artificial
  CRISPR gRNA sequence
tccaggaataaggagaaata

SEQ ID NO: 305983 - DNA, 20 bp, Artificial
  CRISPR gRNA sequence
ccaggaataaggagaaataa

SEQ ID NO: 305984 - DNA, 20 bp, Artificial
  CRISPR gRNA sequence
aggaataaggagaaataaag

SEQ ID NO: 305985 - DNA, 20 bp, Artificial
  CRISPR gRNA sequence
gagaaataaaggagaacatc

SEQ ID NO: 305986 - DNA, 20 bp, Artificial
  CRISPR gRNA sequence
cactccatcgctctcaccct

SEQ ID NO: 305987 - DNA, 20 bp, Artificial
  CRISPR gRNA sequence
ccatcgctctcaccctgagt

SEQ ID NO: 305988 - DNA, 20 bp, Artificial
  CRISPR gRNA sequence
agttcctctcatttttaaca

SEQ ID NO: 305989 - DNA, 20 bp, Artificial
  CRISPR gRNA sequence
tcctctcatttttaacacag

SEQ ID NO: 305990 - DNA, 20 bp, Artificial
  CRISPR gRNA sequence
ttttaacacagtagacaata

SEQ ID NO: 305991 - DNA, 20 bp, Artificial
  CRISPR gRNA sequence
tagacaatatggtacattta

SEQ ID NO: 305992 - DNA, 20 bp, Artificial
  CRISPR gRNA sequence
agacaatatggtacatttaa

SEQ ID NO: 305993 - DNA, 20 bp, Artificial
  CRISPR gRNA sequence
acatttaaaggatccctgtc

SEQ ID NO: 305994 - DNA, 20 bp, Artificial
  CRISPR gRNA sequence
catttaaaggatccctgtct

SEQ ID NO: 305995 - DNA, 20 bp, Artificial
  CRISPR gRNA sequence
ttaaaggatccctgtctggg

SEQ ID NO: 305996 - DNA, 20 bp, Artificial
  CRISPR gRNA sequence
aaaggatccctgtctgggta

SEQ ID NO: 305997 - DNA, 20 bp, Artificial
  CRISPR gRNA sequence
ctgtctgggtagagtctgct

SEQ ID NO: 305998 - DNA, 20 bp, Artificial
  CRISPR gRNA sequence
ctgggtagagtctgctgagc

SEQ ID NO: 305999 - DNA, 20 bp, Artificial
  CRISPR gRNA sequence
gagtctgctgagctggctac

SEQ ID NO: 306000 - DNA, 20 bp, Artificial
  CRISPR gRNA sequence
tgagctggctacaagtgatc

SEQ ID NO: 306001 - DNA, 20 bp, Artificial
  CRISPR gRNA sequence
gagctggctacaagtgatcc

SEQ ID NO: 306002 - DNA, 20 bp, Artificial
  CRISPR gRNA sequence
agctggctacaagtgatcca

SEQ ID NO: 306003 - DNA, 20 bp, Artificial
  CRISPR gRNA sequence
ctacaagtgatccagggctt

SEQ ID NO: 306004 - DNA, 20 bp, Artificial
  CRISPR gRNA sequence
caagtgatccagggcttcag

SEQ ID NO: 306005 - DNA, 20 bp, Artificial
  CRISPR gRNA sequence
atccagggcttcagaagaca

SEQ ID NO: 306006 - DNA, 20 bp, Artificial
  CRISPR gRNA sequence
ccagggcttcagaagacatg

SEQ ID NO: 306007 - DNA, 20 bp, Artificial
  CRISPR gRNA sequence
gcttcagaagacatggagaa

SEQ ID NO: 306008 - DNA, 20 bp, Artificial
  CRISPR gRNA sequence
cagaagacatggagaacagc

SEQ ID NO: 306009 - DNA, 20 bp, Artificial
  CRISPR gRNA sequence
gagaacagcaagcactccta

SEQ ID NO: 306010 - DNA, 20 bp, Artificial
  CRISPR gRNA sequence
cagcaagcactcctacagct

SEQ ID NO: 306011 - DNA, 20 bp, Artificial
  CRISPR gRNA sequence
caagcactcctacagcttgg

SEQ ID NO: 306012 - DNA, 20 bp, Artificial
  CRISPR gRNA sequence
aagcactcctacagcttgga

SEQ ID NO: 306013 - DNA, 20 bp, Artificial
  CRISPR gRNA sequence
agcactcctacagcttggaa

SEQ ID NO: 306014 - DNA, 20 bp, Artificial
  CRISPR gRNA sequence
actcctacagcttggaaggg

SEQ ID NO: 306015 - DNA, 20 bp, Artificial
  CRISPR gRNA sequence
cagcttggaagggtggtgta

SEQ ID NO: 306016 - DNA, 20 bp, Artificial
  CRISPR gRNA sequence
agcttggaagggtggtgtaa

SEQ ID NO: 306017 - DNA, 20 bp, Artificial
  CRISPR gRNA sequence
ttggaagggtggtgtaaagg

SEQ ID NO: 306018 - DNA, 20 bp, Artificial
  CRISPR gRNA sequence
gggtggtgtaaaggtggtaa

SEQ ID NO: 306019 - DNA, 20 bp, Artificial
  CRISPR gRNA sequence
gtgtaaaggtggtaatagtt

SEQ ID NO: 306020 - DNA, 20 bp, Artificial
  CRISPR gRNA sequence
aaggtggtaatagttgagct

SEQ ID NO: 306021 - DNA, 20 bp, Artificial
  CRISPR gRNA sequence
atagttgagctgagctttga

SEQ ID NO: 306022 - DNA, 20 bp, Artificial
  CRISPR gRNA sequence
tagttgagctgagctttgac

SEQ ID NO: 306023 - DNA, 20 bp, Artificial
  CRISPR gRNA sequence
tgagctgagctttgacaggt

SEQ ID NO: 306024 - DNA, 20 bp, Artificial
  CRISPR gRNA sequence
ctgagctttgacaggtgagt

SEQ ID NO: 306025 - DNA, 20 bp, Artificial
  CRISPR gRNA sequence
tttgacaggtgagtcagact

SEQ ID NO: 306026 - DNA, 20 bp, Artificial
  CRISPR gRNA sequence
aggtgagtcagacttggtct

SEQ ID NO: 306027 - DNA, 20 bp, Artificial
  CRISPR gRNA sequence
cagaactgtaccctgcatgt

SEQ ID NO: 306028 - DNA, 20 bp, Artificial
  CRISPR gRNA sequence
ctgcatgttagaacttgcac

SEQ ID NO: 306029 - DNA, 20 bp, Artificial
  CRISPR gRNA sequence
gcacgagttgatttctgtta

SEQ ID NO: 306030 - DNA, 20 bp, Artificial
  CRISPR gRNA sequence
cgagttgatttctgttatag

SEQ ID NO: 306031 - DNA, 20 bp, Artificial
  CRISPR gRNA sequence
gatttctgttatagcagatg

SEQ ID NO: 306032 - DNA, 20 bp, Artificial
  CRISPR gRNA sequence
gatgaagttccaccctgtat

SEQ ID NO: 306033 - DNA, 20 bp, Artificial
  CRISPR gRNA sequence
ttccaccctgtattggtttt

SEQ ID NO: 306034 - DNA, 20 bp, Artificial
  CRISPR gRNA sequence
tgtattggttttaagtaatt

SEQ ID NO: 306035 - DNA, 20 bp, Artificial
  CRISPR gRNA sequence
attctgatactcccacttat

SEQ ID NO: 306036 - DNA, 20 bp, Artificial
  CRISPR gRNA sequence
ttctgatactcccacttatg

SEQ ID NO: 306037 - DNA, 20 bp, Artificial
  CRISPR gRNA sequence
tctgatactcccacttatga

SEQ ID NO: 306038 - DNA, 20 bp, Artificial
  CRISPR gRNA sequence
ctcccacttatgagggctgt

SEQ ID NO: 306039 - DNA, 20 bp, Artificial
  CRISPR gRNA sequence
acttatgagggctgttagcc

SEQ ID NO: 306040 - DNA, 20 bp, Artificial
  CRISPR gRNA sequence
cttatgagggctgttagcct

SEQ ID NO: 306041 - DNA, 20 bp, Artificial
  CRISPR gRNA sequence
tgggccactgcactgtttaa

SEQ ID NO: 306042 - DNA, 20 bp, Artificial
  CRISPR gRNA sequence
ctgtttaacagtcttcctct

SEQ ID NO: 306043 - DNA, 20 bp, Artificial
  CRISPR gRNA sequence
tcttcctttaacaataacaa

SEQ ID NO: 306044 - DNA, 20 bp, Artificial
  CRISPR gRNA sequence
aataacaatggttaatttcc

SEQ ID NO: 306045 - DNA, 20 bp, Artificial
  CRISPR gRNA sequence
taatttcctagaactcaacg

SEQ ID NO: 306046 - DNA, 20 bp, Artificial
  CRISPR gRNA sequence
tttcctagaactcaacgtgg

SEQ ID NO: 306047 - DNA, 20 bp, Artificial
  CRISPR gRNA sequence
ctatcgtcctctgtccttga

SEQ ID NO: 306048 - DNA, 20 bp, Artificial
  CRISPR gRNA sequence
tatcgtcctctgtccttgaa

SEQ ID NO: 306049 - DNA, 20 bp, Artificial
  CRISPR gRNA sequence
ctgtccttgaaaggctttgc

SEQ ID NO: 306050 - DNA, 20 bp, Artificial
  CRISPR gRNA sequence
agcttccaataattcttccc

SEQ ID NO: 306051 - DNA, 20 bp, Artificial
  CRISPR gRNA sequence
tccaataattcttccctaga

SEQ ID NO: 306052 - DNA, 20 bp, Artificial
  CRISPR gRNA sequence
taatatataaccctgcatcc

SEQ ID NO: 306053 - DNA, 20 bp, Artificial
  CRISPR gRNA sequence
aatatataaccctgcatccg

SEQ ID NO: 306054 - DNA, 20 bp, Artificial
  CRISPR gRNA sequence
catccgaggcatctgtttaa

SEQ ID NO: 306055 - DNA, 20 bp, Artificial
  CRISPR gRNA sequence
atccgaggcatctgtttaat

SEQ ID NO: 306056 - DNA, 20 bp, Artificial
  CRISPR gRNA sequence
catctgtttaatgggtctca

SEQ ID NO: 306057 - DNA, 20 bp, Artificial
  CRISPR gRNA sequence
caaagaactgatgcttccga

SEQ ID NO: 306058 - DNA, 20 bp, Artificial
  CRISPR gRNA sequence
cttccgaaagaaccactttt

SEQ ID NO: 306059 - DNA, 20 bp, Artificial
  CRISPR gRNA sequence
accactttttagtgttgatt

SEQ ID NO: 306060 - DNA, 20 bp, Artificial
  CRISPR gRNA sequence
tagtgttgattgagtttcac

SEQ ID NO: 306061 - DNA, 20 bp, Artificial
  CRISPR gRNA sequence
gtttcactggataaatattt

SEQ ID NO: 306062 - DNA, 20 bp, Artificial
  CRISPR gRNA sequence
tttgatacacacataacatc

SEQ ID NO: 306063 - DNA, 20 bp, Artificial
  CRISPR gRNA sequence
acctttttgatgcttttcat

SEQ ID NO: 306064 - DNA, 20 bp, Artificial
  CRISPR gRNA sequence
atattctttgacgactttct

SEQ ID NO: 306065 - DNA, 20 bp, Artificial
  CRISPR gRNA sequence
tctgagacacaatcaaataa

SEQ ID NO: 306066 - DNA, 20 bp, Artificial
  CRISPR gRNA sequence
acaatcaaataacagttttt

SEQ ID NO: 306067 - DNA, 20 bp, Artificial
  CRISPR gRNA sequence
caatcaaataacagttttta

SEQ ID NO: 306068 - DNA, 20 bp, Artificial
  CRISPR gRNA sequence
taacagtttttaaggacaca

SEQ ID NO: 306069 - DNA, 20 bp, Artificial
  CRISPR gRNA sequence
tttttaaggacacatggaaa

SEQ ID NO: 306070 - DNA, 20 bp, Artificial
  CRISPR gRNA sequence
tttaaggacacatggaaatg

SEQ ID NO: 306071 - DNA, 20 bp, Artificial
  CRISPR gRNA sequence
ttaaggacacatggaaatgg

SEQ ID NO: 306072 - DNA, 20 bp, Artificial
  CRISPR gRNA sequence
aaggacacatggaaatggag

SEQ ID NO: 306073 - DNA, 20 bp, Artificial
  CRISPR gRNA sequence
tggaaatggaggagtgacca

SEQ ID NO: 306074 - DNA, 20 bp, Artificial
  CRISPR gRNA sequence
gagtgaccatggaattttta

SEQ ID NO: 306075 - DNA, 20 bp, Artificial
  CRISPR gRNA sequence
agtgaccatggaatttttac

SEQ ID NO: 306076 - DNA, 20 bp, Artificial
  CRISPR gRNA sequence
accatggaatttttacagga

SEQ ID NO: 306077 - DNA, 20 bp, Artificial
  CRISPR gRNA sequence
tggaatttttacaggacagt

SEQ ID NO: 306078 - DNA, 20 bp, Artificial
  CRISPR gRNA sequence
tttttacaggacagtaagaa

SEQ ID NO: 306079 - DNA, 20 bp, Artificial
  CRISPR gRNA sequence
ggacagtaagaaaagctgac

SEQ ID NO: 306080 - DNA, 20 bp, Artificial
  CRISPR gRNA sequence
aagaaaagctgactggcctg

SEQ ID NO: 306081 - DNA, 20 bp, Artificial
  CRISPR gRNA sequence
aaaagctgactggcctgcag

SEQ ID NO: 306082 - DNA, 20 bp, Artificial
  CRISPR gRNA sequence
aagctgactggcctgcagca

SEQ ID NO: 306083 - DNA, 20 bp, Artificial
  CRISPR gRNA sequence
agctgactggcctgcagcag

SEQ ID NO: 306084 - DNA, 20 bp, Artificial
  CRISPR gRNA sequence
cctgcagcagaggttgtctt

SEQ ID NO: 306085 - DNA, 20 bp, Artificial
  CRISPR gRNA sequence
ggttgtctttggataaataa

SEQ ID NO: 306086 - DNA, 20 bp, Artificial
  CRISPR gRNA sequence
gttgtctttggataaataat

SEQ ID NO: 306087 - DNA, 20 bp, Artificial
  CRISPR gRNA sequence
tgtctttggataaataatgg

SEQ ID NO: 306088 - DNA, 20 bp, Artificial
  CRISPR gRNA sequence
ttggataaataatgggagat

SEQ ID NO: 306089 - DNA, 20 bp, Artificial
  CRISPR gRNA sequence
aatgggagattagtttctat

SEQ ID NO: 306090 - DNA, 20 bp, Artificial
  CRISPR gRNA sequence
gagattagtttctataagta

SEQ ID NO: 306091 - DNA, 20 bp, Artificial
  CRISPR gRNA sequence
ttagtttctataagtaaagc

SEQ ID NO: 306092 - DNA, 20 bp, Artificial
  CRISPR gRNA sequence
tagtttctataagtaaagca

SEQ ID NO: 306093 - DNA, 20 bp, Artificial
  CRISPR gRNA sequence
gtttctataagtaaagcaag

SEQ ID NO: 306094 - DNA, 20 bp, Artificial
  CRISPR gRNA sequence
ctataagtaaagcaaggagc

SEQ ID NO: 306095 - DNA, 20 bp, Artificial
  CRISPR gRNA sequence
aagtaaagcaaggagcaaga

SEQ ID NO: 306096 - DNA, 20 bp, Artificial
  CRISPR gRNA sequence
caaggagcaagatagcctaa

SEQ ID NO: 306097 - DNA, 20 bp, Artificial
  CRISPR gRNA sequence
aaggagcaagatagcctaat

SEQ ID NO: 306098 - DNA, 20 bp, Artificial
  CRISPR gRNA sequence
aggagcaagatagcctaata

SEQ ID NO: 306099 - DNA, 20 bp, Artificial
  CRISPR gRNA sequence
caagatagcctaatagggca

SEQ ID NO: 306100 - DNA, 20 bp, Artificial
  CRISPR gRNA sequence
atagcctaatagggcatgga

SEQ ID NO: 306101 - DNA, 20 bp, Artificial
  CRISPR gRNA sequence
tagggcatggaaagtcaaat

SEQ ID NO: 306102 - DNA, 20 bp, Artificial
  CRISPR gRNA sequence
agggcatggaaagtcaaata

SEQ ID NO: 306103 - DNA, 20 bp, Artificial
  CRISPR gRNA sequence
ggaattcatatttaatttaa

SEQ ID NO: 306104 - DNA, 20 bp, Artificial
  CRISPR gRNA sequence
tatttaatttaacagaaaat

SEQ ID NO: 306105 - DNA, 20 bp, Artificial
  CRISPR gRNA sequence
ttaatttaacagaaaattgg

SEQ ID NO: 306106 - DNA, 20 bp, Artificial
  CRISPR gRNA sequence
ttaacagaaaattggaagtt

SEQ ID NO: 306107 - DNA, 20 bp, Artificial
  CRISPR gRNA sequence
aattggaagtttggaattaa

SEQ ID NO: 306108 - DNA, 20 bp, Artificial
  CRISPR gRNA sequence
gaagtttggaattaatagtt

SEQ ID NO: 306109 - DNA, 20 bp, Artificial
  CRISPR gRNA sequence
aagtttggaattaatagttt

SEQ ID NO: 306110 - DNA, 20 bp, Artificial
  CRISPR gRNA sequence
gtttggaattaatagtttgg

SEQ ID NO: 306111 - DNA, 20 bp, Artificial
  CRISPR gRNA sequence
tggaattaatagtttgggag

SEQ ID NO: 306112 - DNA, 20 bp, Artificial
  CRISPR gRNA sequence
atagtttgggagcagaaaaa

SEQ ID NO: 306113 - DNA, 20 bp, Artificial
  CRISPR gRNA sequence
gcagaaaaatggtgtaatga

SEQ ID NO: 306114 - DNA, 20 bp, Artificial
  CRISPR gRNA sequence
aatggtgtaatgacagctta

SEQ ID NO: 306115 - DNA, 20 bp, Artificial
  CRISPR gRNA sequence
aatgacagcttaaagaaaat

SEQ ID NO: 306116 - DNA, 20 bp, Artificial
  CRISPR gRNA sequence
ttaaagaaaataagcctgtc

SEQ ID NO: 306117 - DNA, 20 bp, Artificial
  CRISPR gRNA sequence
aaagaaaataagcctgtcaa

SEQ ID NO: 306118 - DNA, 20 bp, Artificial
  CRISPR gRNA sequence
aagaaaataagcctgtcaag

SEQ ID NO: 306119 - DNA, 20 bp, Artificial
  CRISPR gRNA sequence
ataagcctgtcaagaggtga

SEQ ID NO: 306120 - DNA, 20 bp, Artificial
  CRISPR gRNA sequence
gcctgtcaagaggtgacggc

SEQ ID NO: 306121 - DNA, 20 bp, Artificial
  CRISPR gRNA sequence
caagaggtgacggctggtat

SEQ ID NO: 306122 - DNA, 20 bp, Artificial
  CRISPR gRNA sequence
aagaggtgacggctggtatc

SEQ ID NO: 306123 - DNA, 20 bp, Artificial
  CRISPR gRNA sequence
agaggtgacggctggtatca

SEQ ID NO: 306124 - DNA, 20 bp, Artificial
  CRISPR gRNA sequence
cggctggtatcagggtgatc

SEQ ID NO: 306125 - DNA, 20 bp, Artificial
  CRISPR gRNA sequence
tggtatcagggtgatcaaga

SEQ ID NO: 306126 - DNA, 20 bp, Artificial
  CRISPR gRNA sequence
atcagggtgatcaagaaagc

SEQ ID NO: 306127 - DNA, 20 bp, Artificial
  CRISPR gRNA sequence
gatcaagaaagccagtatta

SEQ ID NO: 306128 - DNA, 20 bp, Artificial
  CRISPR gRNA sequence
atcaagaaagccagtattac

SEQ ID NO: 306129 - DNA, 20 bp, Artificial
  CRISPR gRNA sequence
tattacaggctcgtcgactt

SEQ ID NO: 306130 - DNA, 20 bp, Artificial
  CRISPR gRNA sequence
acaggctcgtcgacttgaga

SEQ ID NO: 306131 - DNA, 20 bp, Artificial
  CRISPR gRNA sequence
gctcgtcgacttgagatggt

SEQ ID NO: 306132 - DNA, 20 bp, Artificial
  CRISPR gRNA sequence
gacttgagatggtgagcctg

SEQ ID NO: 306133 - DNA, 20 bp, Artificial
  CRISPR gRNA sequence
ttgagatggtgagcctgaag

SEQ ID NO: 306134 - DNA, 20 bp, Artificial
  CRISPR gRNA sequence
atggtgagcctgaagcagta

SEQ ID NO: 306135 - DNA, 20 bp, Artificial
  CRISPR gRNA sequence
ggtgagcctgaagcagtaaa

SEQ ID NO: 306136 - DNA, 20 bp, Artificial
  CRISPR gRNA sequence
gtgagcctgaagcagtaaag

SEQ ID NO: 306137 - DNA, 20 bp, Artificial
  CRISPR gRNA sequence
agcctgaagcagtaaagagg

SEQ ID NO: 306138 - DNA, 20 bp, Artificial
  CRISPR gRNA sequence
tgaagcagtaaagaggcagt

SEQ ID NO: 306139 - DNA, 20 bp, Artificial
  CRISPR gRNA sequence
aaagaggcagtcggcatgat

SEQ ID NO: 306140 - DNA, 20 bp, Artificial
  CRISPR gRNA sequence
aagaggcagtcggcatgatg

SEQ ID NO: 306141 - DNA, 20 bp, Artificial
  CRISPR gRNA sequence
aggcagtcggcatgatgagg

SEQ ID NO: 306142 - DNA, 20 bp, Artificial
  CRISPR gRNA sequence
ggcagtcggcatgatgagga

SEQ ID NO: 306143 - DNA, 20 bp, Artificial
  CRISPR gRNA sequence
gcagtcggcatgatgaggaa

SEQ ID NO: 306144 - DNA, 20 bp, Artificial
  CRISPR gRNA sequence
tcggcatgatgaggaaggga

SEQ ID NO: 306145 - DNA, 20 bp, Artificial
  CRISPR gRNA sequence
cggcatgatgaggaagggat

SEQ ID NO: 306146 - DNA, 20 bp, Artificial
  CRISPR gRNA sequence
gatgaggaagggatgggtgt

SEQ ID NO: 306147 - DNA, 20 bp, Artificial
  CRISPR gRNA sequence
atgaggaagggatgggtgtg

SEQ ID NO: 306148 - DNA, 20 bp, Artificial
  CRISPR gRNA sequence
tgaggaagggatgggtgtga

SEQ ID NO: 306149 - DNA, 20 bp, Artificial
  CRISPR gRNA sequence
gggtgtgagggctgcctcga

SEQ ID NO: 306150 - DNA, 20 bp, Artificial
  CRISPR gRNA sequence
gatggaacatgaacacttct

SEQ ID NO: 306151 - DNA, 20 bp, Artificial
  CRISPR gRNA sequence
catgaacacttcttggtgtc

SEQ ID NO: 306152 - DNA, 20 bp, Artificial
  CRISPR gRNA sequence
gaacacttcttggtgtctgg

SEQ ID NO: 306153 - DNA, 20 bp, Artificial
  CRISPR gRNA sequence
acttcttggtgtctggtgga

SEQ ID NO: 306154 - DNA, 20 bp, Artificial
  CRISPR gRNA sequence
ttcttggtgtctggtggaca

SEQ ID NO: 306155 - DNA, 20 bp, Artificial
  CRISPR gRNA sequence
tcttggtgtctggtggacag

SEQ ID NO: 306156 - DNA, 20 bp, Artificial
  CRISPR gRNA sequence
tggtggacagaggacatgac

SEQ ID NO: 306157 - DNA, 20 bp, Artificial
  CRISPR gRNA sequence
gtggacagaggacatgactg

SEQ ID NO: 306158 - DNA, 20 bp, Artificial
  CRISPR gRNA sequence
tggacagaggacatgactgg

SEQ ID NO: 306159 - DNA, 20 bp, Artificial
  CRISPR gRNA sequence
acagaggacatgactggagg

SEQ ID NO: 306160 - DNA, 20 bp, Artificial
  CRISPR gRNA sequence
agaggacatgactggaggtg

SEQ ID NO: 306161 - DNA, 20 bp, Artificial
  CRISPR gRNA sequence
gtggagacgtcctccatcct

SEQ ID NO: 306162 - DNA, 20 bp, Artificial
  CRISPR gRNA sequence
tcctgagctctgttttcctc

SEQ ID NO: 306163 - DNA, 20 bp, Artificial
  CRISPR gRNA sequence
tgttttcctcaagctcccac

SEQ ID NO: 306164 - DNA, 20 bp, Artificial
  CRISPR gRNA sequence
ccaccagccatgtctccttc

SEQ ID NO: 306165 - DNA, 20 bp, Artificial
  CRISPR gRNA sequence
agccatgtctccttctagct

SEQ ID NO: 306166 - DNA, 20 bp, Artificial
  CRISPR gRNA sequence
gccatgtctccttctagctt

SEQ ID NO: 306167 - DNA, 20 bp, Artificial
  CRISPR gRNA sequence
tgtctccttctagcttaggc

SEQ ID NO: 306168 - DNA, 20 bp, Artificial
  CRISPR gRNA sequence
gctggattttatgtctgact

SEQ ID NO: 306169 - DNA, 20 bp, Artificial
  CRISPR gRNA sequence
tttatgtctgacttggtttc

SEQ ID NO: 306170 - DNA, 20 bp, Artificial
  CRISPR gRNA sequence
cttggtttccagtctctcct

SEQ ID NO: 306171 - DNA, 20 bp, Artificial
  CRISPR gRNA sequence
tggtttccagtctctccttg

SEQ ID NO: 306172 - DNA, 20 bp, Artificial
  CRISPR gRNA sequence
tcccccttattccccatttg

SEQ ID NO: 306173 - DNA, 20 bp, Artificial
  CRISPR gRNA sequence
ccccttattccccatttgtg

SEQ ID NO: 306174 - DNA, 20 bp, Artificial
  CRISPR gRNA sequence
gaatgcttgttttctttcgt

SEQ ID NO: 306175 - DNA, 20 bp, Artificial
  CRISPR gRNA sequence
gttctttctgaaactcattt

SEQ ID NO: 306176 - DNA, 20 bp, Artificial
  CRISPR gRNA sequence
tctttctgaaactcatttga

SEQ ID NO: 306177 - DNA, 20 bp, Artificial
  CRISPR gRNA sequence
ctgaaactcatttgagagca

SEQ ID NO: 306178 - DNA, 20 bp, Artificial
  CRISPR gRNA sequence
gagagcacagtgtttccata

SEQ ID NO: 306179 - DNA, 20 bp, Artificial
  CRISPR gRNA sequence
cagtgtttccatacagacat

SEQ ID NO: 306180 - DNA, 20 bp, Artificial
  CRISPR gRNA sequence
agtgtttccatacagacatg

SEQ ID NO: 306181 - DNA, 20 bp, Artificial
  CRISPR gRNA sequence
tgtttccatacagacatgag

SEQ ID NO: 306182 - DNA, 20 bp, Artificial
  CRISPR gRNA sequence
tttccatacagacatgagga

SEQ ID NO: 306183 - DNA, 20 bp, Artificial
  CRISPR gRNA sequence
gacatgaggagagctgcatc

SEQ ID NO: 306184 - DNA, 20 bp, Artificial
  CRISPR gRNA sequence
acatgaggagagctgcatca

SEQ ID NO: 306185 - DNA, 20 bp, Artificial
  CRISPR gRNA sequence
aggagagctgcatcaaggat

SEQ ID NO: 306186 - DNA, 20 bp, Artificial
  CRISPR gRNA sequence
agagctgcatcaaggatgag

SEQ ID NO: 306187 - DNA, 20 bp, Artificial
  CRISPR gRNA sequence
gagctgcatcaaggatgagt

SEQ ID NO: 306188 - DNA, 20 bp, Artificial
  CRISPR gRNA sequence
gcatcaaggatgagtaggtg

SEQ ID NO: 306189 - DNA, 20 bp, Artificial
  CRISPR gRNA sequence
atcaaggatgagtaggtgca

SEQ ID NO: 306190 - DNA, 20 bp, Artificial
  CRISPR gRNA sequence
aaggatgagtaggtgcagag

SEQ ID NO: 306191 - DNA, 20 bp, Artificial
  CRISPR gRNA sequence
gcagagaagaaatgtcttcg

SEQ ID NO: 306192 - DNA, 20 bp, Artificial
  CRISPR gRNA sequence
aagaaatgtcttcgcagatt

SEQ ID NO: 306193 - DNA, 20 bp, Artificial
  CRISPR gRNA sequence
aaatgtcttcgcagatttag

SEQ ID NO: 306194 - DNA, 20 bp, Artificial
  CRISPR gRNA sequence
aatgtcttcgcagatttaga

SEQ ID NO: 306195 - DNA, 20 bp, Artificial
  CRISPR gRNA sequence
tgtcttcgcagatttagaag

SEQ ID NO: 306196 - DNA, 20 bp, Artificial
  CRISPR gRNA sequence
cttcgcagatttagaaggag

SEQ ID NO: 306197 - DNA, 20 bp, Artificial
  CRISPR gRNA sequence
tcgcagatttagaaggagca

SEQ ID NO: 306198 - DNA, 20 bp, Artificial
  CRISPR gRNA sequence
cgcagatttagaaggagcag

SEQ ID NO: 306199 - DNA, 20 bp, Artificial
  CRISPR gRNA sequence
gcagatttagaaggagcaga

SEQ ID NO: 306200 - DNA, 20 bp, Artificial
  CRISPR gRNA sequence
ttatccaccttccaatattg

SEQ ID NO: 306201 - DNA, 20 bp, Artificial
  CRISPR gRNA sequence
tatccaccttccaatattgt

SEQ ID NO: 306202 - DNA, 20 bp, Artificial
  CRISPR gRNA sequence
gcaactgaaatattaaaatg

SEQ ID NO: 306203 - DNA, 20 bp, Artificial
  CRISPR gRNA sequence
gaagaatgcgttcccctcac

SEQ ID NO: 306204 - DNA, 20 bp, Artificial
  CRISPR gRNA sequence
atgcgttcccctcactggcc

SEQ ID NO: 306205 - DNA, 20 bp, Artificial
  CRISPR gRNA sequence
cgttcccctcactggcctag

SEQ ID NO: 306206 - DNA, 20 bp, Artificial
  CRISPR gRNA sequence
tcccctcactggcctagaag

SEQ ID NO: 306207 - DNA, 20 bp, Artificial
  CRISPR gRNA sequence
cccctcactggcctagaaga

SEQ ID NO: 306208 - DNA, 20 bp, Artificial
  CRISPR gRNA sequence
cctcactggcctagaagaag

SEQ ID NO: 306209 - DNA, 20 bp, Artificial
  CRISPR gRNA sequence
ctggcctagaagaaggagca

SEQ ID NO: 306210 - DNA, 20 bp, Artificial
  CRISPR gRNA sequence
ctagaagaaggagcatagca

SEQ ID NO: 306211 - DNA, 20 bp, Artificial
  CRISPR gRNA sequence
gaaggagcatagcatggcga

SEQ ID NO: 306212 - DNA, 20 bp, Artificial
  CRISPR gRNA sequence
catagcatggcgatagcatt

SEQ ID NO: 306213 - DNA, 20 bp, Artificial
  CRISPR gRNA sequence
gcgatagcatttagcttttc

SEQ ID NO: 306214 - DNA, 20 bp, Artificial
  CRISPR gRNA sequence
tttagcttttccggtccccc

SEQ ID NO: 306215 - DNA, 20 bp, Artificial
  CRISPR gRNA sequence
tagcttttccggtcccccaa

SEQ ID NO: 306216 - DNA, 20 bp, Artificial
  CRISPR gRNA sequence
ccaagagcaaatctgtgtac

SEQ ID NO: 306217 - DNA, 20 bp, Artificial
  CRISPR gRNA sequence
atctgtgtacaagacacgcc

SEQ ID NO: 306218 - DNA, 20 bp, Artificial
  CRISPR gRNA sequence
caagacacgcctagttctcc

SEQ ID NO: 306219 - DNA, 20 bp, Artificial
  CRISPR gRNA sequence
ctagttctccgagttgtatc

SEQ ID NO: 306220 - DNA, 20 bp, Artificial
  CRISPR gRNA sequence
gaatcgaaactttctgaatc

SEQ ID NO: 306221 - DNA, 20 bp, Artificial
  CRISPR gRNA sequence
aatcgaaactttctgaatca

SEQ ID NO: 306222 - DNA, 20 bp, Artificial
  CRISPR gRNA sequence
ttcaaactattgatgaattt

SEQ ID NO: 306223 - DNA, 20 bp, Artificial
  CRISPR gRNA sequence
tttttttcctttttgccaaa

SEQ ID NO: 306224 - DNA, 20 bp, Artificial
  CRISPR gRNA sequence
ttttttcctttttgccaaaa

SEQ ID NO: 306225 - DNA, 20 bp, Artificial
  CRISPR gRNA sequence
ttcctttttgccaaaaaggt

SEQ ID NO: 306226 - DNA, 20 bp, Artificial
  CRISPR gRNA sequence
tcctttttgccaaaaaggta

SEQ ID NO: 306227 - DNA, 20 bp, Artificial
  CRISPR gRNA sequence
aaaaaggtaaggatcatgca

SEQ ID NO: 306228 - DNA, 20 bp, Artificial
  CRISPR gRNA sequence
aaggatcatgcaaagtttca

SEQ ID NO: 306229 - DNA, 20 bp, Artificial
  CRISPR gRNA sequence
aagtttcacagtgcttcttc

SEQ ID NO: 306230 - DNA, 20 bp, Artificial
  CRISPR gRNA sequence
tagtctgtgctcatccactc

SEQ ID NO: 306231 - DNA, 20 bp, Artificial
  CRISPR gRNA sequence
agtctgtgctcatccactcg

SEQ ID NO: 306232 - DNA, 20 bp, Artificial
  CRISPR gRNA sequence
gtctgtgctcatccactcga

SEQ ID NO: 306233 - DNA, 20 bp, Artificial
  CRISPR gRNA sequence
cactcgagggctctgactgt

SEQ ID NO: 306234 - DNA, 20 bp, Artificial
  CRISPR gRNA sequence
actcgagggctctgactgtc

SEQ ID NO: 306235 - DNA, 20 bp, Artificial
  CRISPR gRNA sequence
gggctctgactgtcaggtat

SEQ ID NO: 306236 - DNA, 20 bp, Artificial
  CRISPR gRNA sequence
ggctctgactgtcaggtatg

SEQ ID NO: 306237 - DNA, 20 bp, Artificial
  CRISPR gRNA sequence
actgtcaggtatgaggctca

SEQ ID NO: 306238 - DNA, 20 bp, Artificial
  CRISPR gRNA sequence
aggctcatagaactcactaa

SEQ ID NO: 306239 - DNA, 20 bp, Artificial
  CRISPR gRNA sequence
ggctcatagaactcactaaa

SEQ ID NO: 306240 - DNA, 20 bp, Artificial
  CRISPR gRNA sequence
gctcatagaactcactaaaa

SEQ ID NO: 306241 - DNA, 20 bp, Artificial
  CRISPR gRNA sequence
tcatagaactcactaaaagg

SEQ ID NO: 306242 - DNA, 20 bp, Artificial
  CRISPR gRNA sequence
aaagggagccatgcccatcc

SEQ ID NO: 306243 - DNA, 20 bp, Artificial
  CRISPR gRNA sequence
catgcccatcctggtcccct

SEQ ID NO: 306244 - DNA, 20 bp, Artificial
  CRISPR gRNA sequence
atgcccatcctggtccccta

SEQ ID NO: 306245 - DNA, 20 bp, Artificial
  CRISPR gRNA sequence
cccatcctggtcccctaagg

SEQ ID NO: 306246 - DNA, 20 bp, Artificial
  CRISPR gRNA sequence
tagcctgattcttgttttct

SEQ ID NO: 306247 - DNA, 20 bp, Artificial
  CRISPR gRNA sequence
gattcttgttttctcagaaa

SEQ ID NO: 306248 - DNA, 20 bp, Artificial
  CRISPR gRNA sequence
ttttctcagaaacagcatca

SEQ ID NO: 306249 - DNA, 20 bp, Artificial
  CRISPR gRNA sequence
cagaaacagcatcatggtca

SEQ ID NO: 306250 - DNA, 20 bp, Artificial
  CRISPR gRNA sequence
gaaacagcatcatggtcaaa

SEQ ID NO: 306251 - DNA, 20 bp, Artificial
  CRISPR gRNA sequence
aacagcatcatggtcaaaga

SEQ ID NO: 306252 - DNA, 20 bp, Artificial
  CRISPR gRNA sequence
acagcatcatggtcaaagag

SEQ ID NO: 306253 - DNA, 20 bp, Artificial
  CRISPR gRNA sequence
gcatcatggtcaaagagagg

SEQ ID NO: 306254 - DNA, 20 bp, Artificial
  CRISPR gRNA sequence
aagagaggaagccaacattt

SEQ ID NO: 306255 - DNA, 20 bp, Artificial
  CRISPR gRNA sequence
agagaggaagccaacatttc

SEQ ID NO: 306256 - DNA, 20 bp, Artificial
  CRISPR gRNA sequence
gagaggaagccaacatttca

SEQ ID NO: 306257 - DNA, 20 bp, Artificial
  CRISPR gRNA sequence
acatttcagggccacaactt

SEQ ID NO: 306258 - DNA, 20 bp, Artificial
  CRISPR gRNA sequence
catttcagggccacaacttg

SEQ ID NO: 306259 - DNA, 20 bp, Artificial
  CRISPR gRNA sequence
atttcagggccacaacttga

SEQ ID NO: 306260 - DNA, 20 bp, Artificial
  CRISPR gRNA sequence
tttcagggccacaacttgag

SEQ ID NO: 306261 - DNA, 20 bp, Artificial
  CRISPR gRNA sequence
tctctccccatactgtgcac

SEQ ID NO: 306262 - DNA, 20 bp, Artificial
  CRISPR gRNA sequence
accagtcctaccctgctgct

SEQ ID NO: 306263 - DNA, 20 bp, Artificial
  CRISPR gRNA sequence
ttcccacattactcattcct

SEQ ID NO: 306264 - DNA, 20 bp, Artificial
  CRISPR gRNA sequence
tcccacattactcattcctt

SEQ ID NO: 306265 - DNA, 20 bp, Artificial
  CRISPR gRNA sequence
cattactcattccttgggct

SEQ ID NO: 306266 - DNA, 20 bp, Artificial
  CRISPR gRNA sequence
attactcattccttgggcta

SEQ ID NO: 306267 - DNA, 20 bp, Artificial
  CRISPR gRNA sequence
tgggctaaggcattttttga

SEQ ID NO: 306268 - DNA, 20 bp, Artificial
  CRISPR gRNA sequence
ccctgttaaaatgcaaatgc

SEQ ID NO: 306269 - DNA, 20 bp, Artificial
  CRISPR gRNA sequence
gttaaaatgcaaatgctagc

SEQ ID NO: 306270 - DNA, 20 bp, Artificial
  CRISPR gRNA sequence
aaaatgcaaatgctagctgg

SEQ ID NO: 306271 - DNA, 20 bp, Artificial
  CRISPR gRNA sequence
aaatgcaaatgctagctgga

SEQ ID NO: 306272 - DNA, 20 bp, Artificial
  CRISPR gRNA sequence
tgcaaatgctagctggaagg

SEQ ID NO: 306273 - DNA, 20 bp, Artificial
  CRISPR gRNA sequence
caaatgctagctggaaggaa

SEQ ID NO: 306274 - DNA, 20 bp, Artificial
  CRISPR gRNA sequence
aaatgctagctggaaggaag

SEQ ID NO: 306275 - DNA, 20 bp, Artificial
  CRISPR gRNA sequence
aatgctagctggaaggaaga

SEQ ID NO: 306276 - DNA, 20 bp, Artificial
  CRISPR gRNA sequence
ggttttttttgtttgttttt

SEQ ID NO: 306277 - DNA, 20 bp, Artificial
  CRISPR gRNA sequence
tttgtttgtttttaagccat

SEQ ID NO: 306278 - DNA, 20 bp, Artificial
  CRISPR gRNA sequence
ttgtttgtttttaagccatt

SEQ ID NO: 306279 - DNA, 20 bp, Artificial
  CRISPR gRNA sequence
gtttttaagccattaggcat

SEQ ID NO: 306280 - DNA, 20 bp, Artificial
  CRISPR gRNA sequence
tttttaagccattaggcatt

SEQ ID NO: 306281 - DNA, 20 bp, Artificial
  CRISPR gRNA sequence
agccattaggcattaggttc

SEQ ID NO: 306282 - DNA, 20 bp, Artificial
  CRISPR gRNA sequence
ttcaagttaatttatctaaa

SEQ ID NO: 306283 - DNA, 20 bp, Artificial
  CRISPR gRNA sequence
tcaagttaatttatctaaaa

SEQ ID NO: 306284 - DNA, 20 bp, Artificial
  CRISPR gRNA sequence
taatttatctaaaaaggaca

SEQ ID NO: 306285 - DNA, 20 bp, Artificial
  CRISPR gRNA sequence
tctaaaaaggacatggaact

SEQ ID NO: 306286 - DNA, 20 bp, Artificial
  CRISPR gRNA sequence
aaaaggacatggaacttaga

SEQ ID NO: 306287 - DNA, 20 bp, Artificial
  CRISPR gRNA sequence
aaaggacatggaacttagaa

SEQ ID NO: 306288 - DNA, 20 bp, Artificial
  CRISPR gRNA sequence
atcatatccgtccatgaata

SEQ ID NO: 306289 - DNA, 20 bp, Artificial
  CRISPR gRNA sequence
tcatatccgtccatgaataa

SEQ ID NO: 306290 - DNA, 20 bp, Artificial
  CRISPR gRNA sequence
atatccgtccatgaataaag

SEQ ID NO: 306291 - DNA, 20 bp, Artificial
  CRISPR gRNA sequence
tatccgtccatgaataaagg

SEQ ID NO: 306292 - DNA, 20 bp, Artificial
  CRISPR gRNA sequence
catgaataaaggaggaccga

SEQ ID NO: 306293 - DNA, 20 bp, Artificial
  CRISPR gRNA sequence
atgaataaaggaggaccgat

SEQ ID NO: 306294 - DNA, 20 bp, Artificial
  CRISPR gRNA sequence
tgaataaaggaggaccgata

SEQ ID NO: 306295 - DNA, 20 bp, Artificial
  CRISPR gRNA sequence
aaggaggaccgatagggaac

SEQ ID NO: 306296 - DNA, 20 bp, Artificial
  CRISPR gRNA sequence
atagggaacgagatgcttcc

SEQ ID NO: 306297 - DNA, 20 bp, Artificial
  CRISPR gRNA sequence
acgagatgcttcccggtgtt

SEQ ID NO: 306298 - DNA, 20 bp, Artificial
  CRISPR gRNA sequence
cgagatgcttcccggtgttg

SEQ ID NO: 306299 - DNA, 20 bp, Artificial
  CRISPR gRNA sequence
gcttcccggtgttgaggtct

SEQ ID NO: 306300 - DNA, 20 bp, Artificial
  CRISPR gRNA sequence
cttcccggtgttgaggtctc

SEQ ID NO: 306301 - DNA, 20 bp, Artificial
  CRISPR gRNA sequence
ttcccggtgttgaggtctca

SEQ ID NO: 306302 - DNA, 20 bp, Artificial
  CRISPR gRNA sequence
ttgaggtctcagggccgtga

SEQ ID NO: 306303 - DNA, 20 bp, Artificial
  CRISPR gRNA sequence
tgaggtctcagggccgtgat

SEQ ID NO: 306304 - DNA, 20 bp, Artificial
  CRISPR gRNA sequence
gaggtctcagggccgtgatg

SEQ ID NO: 306305 - DNA, 20 bp, Artificial
  CRISPR gRNA sequence
ggtctcagggccgtgatggg

SEQ ID NO: 306306 - DNA, 20 bp, Artificial
  CRISPR gRNA sequence
gtctcagggccgtgatgggg

SEQ ID NO: 306307 - DNA, 20 bp, Artificial
  CRISPR gRNA sequence
tcagggccgtgatggggagg

SEQ ID NO: 306308 - DNA, 20 bp, Artificial
  CRISPR gRNA sequence
ggccgtgatggggaggtgga

SEQ ID NO: 306309 - DNA, 20 bp, Artificial
  CRISPR gRNA sequence
tggggaggtggaaagtgctg

SEQ ID NO: 306310 - DNA, 20 bp, Artificial
  CRISPR gRNA sequence
tcctccacacatattcaaaa

SEQ ID NO: 306311 - DNA, 20 bp, Artificial
  CRISPR gRNA sequence
ggcgcctatttcccaaacct

SEQ ID NO: 306312 - DNA, 20 bp, Artificial
  CRISPR gRNA sequence
tatttcccaaacctcagccc

SEQ ID NO: 306313 - DNA, 20 bp, Artificial
  CRISPR gRNA sequence
ccaaacctcagcccgagtgt

SEQ ID NO: 306314 - DNA, 20 bp, Artificial
  CRISPR gRNA sequence
cccgagtgtaagccaatgta

SEQ ID NO: 306315 - DNA, 20 bp, Artificial
  CRISPR gRNA sequence
gtgtaagccaatgtacagtt

SEQ ID NO: 306316 - DNA, 20 bp, Artificial
  CRISPR gRNA sequence
gccaatgtacagttcggaaa

SEQ ID NO: 306317 - DNA, 20 bp, Artificial
  CRISPR gRNA sequence
agttcggaaacagcactgta

SEQ ID NO: 306318 - DNA, 20 bp, Artificial
  CRISPR gRNA sequence
gttcggaaacagcactgtat

SEQ ID NO: 306319 - DNA, 20 bp, Artificial
  CRISPR gRNA sequence
tcggaaacagcactgtatag

SEQ ID NO: 306320 - DNA, 20 bp, Artificial
  CRISPR gRNA sequence
gaaacagcactgtataggag

SEQ ID NO: 306321 - DNA, 20 bp, Artificial
  CRISPR gRNA sequence
aacagcactgtataggagaa

SEQ ID NO: 306322 - DNA, 20 bp, Artificial
  CRISPR gRNA sequence
cagcactgtataggagaaga

SEQ ID NO: 306323 - DNA, 20 bp, Artificial
  CRISPR gRNA sequence
agcactgtataggagaagag

SEQ ID NO: 306324 - DNA, 20 bp, Artificial
  CRISPR gRNA sequence
cactgtataggagaagagag

SEQ ID NO: 306325 - DNA, 20 bp, Artificial
  CRISPR gRNA sequence
ctgtataggagaagagagga

SEQ ID NO: 306326 - DNA, 20 bp, Artificial
  CRISPR gRNA sequence
taggagaagagaggagagat

SEQ ID NO: 306327 - DNA, 20 bp, Artificial
  CRISPR gRNA sequence
aggagaagagaggagagata

SEQ ID NO: 306328 - DNA, 20 bp, Artificial
  CRISPR gRNA sequence
ggagaagagaggagagataa

SEQ ID NO: 306329 - DNA, 20 bp, Artificial
  CRISPR gRNA sequence
aagagaggagagataagggc

SEQ ID NO: 306330 - DNA, 20 bp, Artificial
  CRISPR gRNA sequence
aggagagataagggccagta

SEQ ID NO: 306331 - DNA, 20 bp, Artificial
  CRISPR gRNA sequence
ggagagataagggccagtaa

SEQ ID NO: 306332 - DNA, 20 bp, Artificial
  CRISPR gRNA sequence
gagagataagggccagtaaa

SEQ ID NO: 306333 - DNA, 20 bp, Artificial
  CRISPR gRNA sequence
ccagtaaagggctgtgtgcc

SEQ ID NO: 306334 - DNA, 20 bp, Artificial
  CRISPR gRNA sequence
agggctgtgtgcccagccta

SEQ ID NO: 306335 - DNA, 20 bp, Artificial
  CRISPR gRNA sequence
cacaaatactcttacctgcc

SEQ ID NO: 306336 - DNA, 20 bp, Artificial
  CRISPR gRNA sequence
tcttacctgcctggccatga

SEQ ID NO: 306337 - DNA, 20 bp, Artificial
  CRISPR gRNA sequence
cttacctgcctggccatgaa

SEQ ID NO: 306338 - DNA, 20 bp, Artificial
  CRISPR gRNA sequence
acctgcctggccatgaaagg

SEQ ID NO: 306339 - DNA, 20 bp, Artificial
  CRISPR gRNA sequence
ggccatgaaaggtggattgc

SEQ ID NO: 306340 - DNA, 20 bp, Artificial
  CRISPR gRNA sequence
gaaaggtggattgccagcac

SEQ ID NO: 306341 - DNA, 20 bp, Artificial
  CRISPR gRNA sequence
gtggattgccagcactagaa

SEQ ID NO: 306342 - DNA, 20 bp, Artificial
  CRISPR gRNA sequence
gccagcactagaatggactg

SEQ ID NO: 306343 - DNA, 20 bp, Artificial
  CRISPR gRNA sequence
atggactgtggaaaaatgcc

SEQ ID NO: 306344 - DNA, 20 bp, Artificial
  CRISPR gRNA sequence
tggactgtggaaaaatgccc

SEQ ID NO: 306345 - DNA, 20 bp, Artificial
  CRISPR gRNA sequence
ggactgtggaaaaatgccca

SEQ ID NO: 306346 - DNA, 20 bp, Artificial
  CRISPR gRNA sequence
ctctgtgcttgcttttgctc

SEQ ID NO: 306347 - DNA, 20 bp, Artificial
  CRISPR gRNA sequence
gctctagttttatctctttg

SEQ ID NO: 306348 - DNA, 20 bp, Artificial
  CRISPR gRNA sequence
tctttgaagcttcaatcccc

SEQ ID NO: 306349 - DNA, 20 bp, Artificial
  CRISPR gRNA sequence
gaagcttcaatcccctggcc

SEQ ID NO: 306350 - DNA, 20 bp, Artificial
  CRISPR gRNA sequence
aagcttcaatcccctggcct

SEQ ID NO: 306351 - DNA, 20 bp, Artificial
  CRISPR gRNA sequence
agcttcaatcccctggccta

SEQ ID NO: 306352 - DNA, 20 bp, Artificial
  CRISPR gRNA sequence
cctaacctcaactcccacct

SEQ ID NO: 306353 - DNA, 20 bp, Artificial
  CRISPR gRNA sequence
tcagtctgatttttgaaaca

SEQ ID NO: 306354 - DNA, 20 bp, Artificial
  CRISPR gRNA sequence
caaccttgatttttctgctg

SEQ ID NO: 306355 - DNA, 20 bp, Artificial
  CRISPR gRNA sequence
gatttttctgctgaagaatc

SEQ ID NO: 306356 - DNA, 20 bp, Artificial
  CRISPR gRNA sequence
ttctgctgaagaatctggct

SEQ ID NO: 306357 - DNA, 20 bp, Artificial
  CRISPR gRNA sequence
tgttttctccctacctgccc

SEQ ID NO: 306358 - DNA, 20 bp, Artificial
  CRISPR gRNA sequence
atcccatcctcacccccacc

SEQ ID NO: 306359 - DNA, 20 bp, Artificial
  CRISPR gRNA sequence
tcccatcctcacccccaccc

SEQ ID NO: 306360 - DNA, 20 bp, Artificial
  CRISPR gRNA sequence
catcctcacccccacccagg

SEQ ID NO: 306361 - DNA, 20 bp, Artificial
  CRISPR gRNA sequence
tcctcacccccacccaggaa

SEQ ID NO: 306362 - DNA, 20 bp, Artificial
  CRISPR gRNA sequence
cctcacccccacccaggaag

SEQ ID NO: 306363 - DNA, 20 bp, Artificial
  CRISPR gRNA sequence
ggaagaggcatatgaaattc

SEQ ID NO: 306364 - DNA, 20 bp, Artificial
  CRISPR gRNA sequence
agaggcatatgaaattcaag

SEQ ID NO: 306365 - DNA, 20 bp, Artificial
  CRISPR gRNA sequence
catatgaaattcaagaagaa

SEQ ID NO: 306366 - DNA, 20 bp, Artificial
  CRISPR gRNA sequence
taaccaaaatatcaaatgca

SEQ ID NO: 306367 - DNA, 20 bp, Artificial
  CRISPR gRNA sequence
aaccaaaatatcaaatgcaa

SEQ ID NO: 306368 - DNA, 20 bp, Artificial
  CRISPR gRNA sequence
aaatatcaaatgcaaaggct

SEQ ID NO: 306369 - DNA, 20 bp, Artificial
  CRISPR gRNA sequence
gcaaaggcttggtaattaat

SEQ ID NO: 306370 - DNA, 20 bp, Artificial
  CRISPR gRNA sequence
tggtaattaatcagctgata

SEQ ID NO: 306371 - DNA, 20 bp, Artificial
  CRISPR gRNA sequence
aatcagctgatatagtcaca

SEQ ID NO: 306372 - DNA, 20 bp, Artificial
  CRISPR gRNA sequence
gaacaatttccttcccttta

SEQ ID NO: 306373 - DNA, 20 bp, Artificial
  CRISPR gRNA sequence
tttaaagcactattgctatg

SEQ ID NO: 306374 - DNA, 20 bp, Artificial
  CRISPR gRNA sequence
tattgctatgtagtcatgtt

SEQ ID NO: 306375 - DNA, 20 bp, Artificial
  CRISPR gRNA sequence
aattaatgtgatttccccac

SEQ ID NO: 306376 - DNA, 20 bp, Artificial
  CRISPR gRNA sequence
attaatgtgatttccccact

SEQ ID NO: 306377 - DNA, 20 bp, Artificial
  CRISPR gRNA sequence
atgtgatttccccactaggc

SEQ ID NO: 306378 - DNA, 20 bp, Artificial
  CRISPR gRNA sequence
tccccactaggctagaaaac

SEQ ID NO: 306379 - DNA, 20 bp, Artificial
  CRISPR gRNA sequence
cccactaggctagaaaacaa

SEQ ID NO: 306380 - DNA, 20 bp, Artificial
  CRISPR gRNA sequence
taggctagaaaacaagagtg

SEQ ID NO: 306381 - DNA, 20 bp, Artificial
  CRISPR gRNA sequence
tgtcttttatgctacctgtt

SEQ ID NO: 306382 - DNA, 20 bp, Artificial
  CRISPR gRNA sequence
tatgctacctgttaagtccc

SEQ ID NO: 306383 - DNA, 20 bp, Artificial
  CRISPR gRNA sequence
cctgttaagtccctagtacc

SEQ ID NO: 306384 - DNA, 20 bp, Artificial
  CRISPR gRNA sequence
agtccctagtacctggaaca

SEQ ID NO: 306385 - DNA, 20 bp, Artificial
  CRISPR gRNA sequence
cctagtacctggaacatagc

SEQ ID NO: 306386 - DNA, 20 bp, Artificial
  CRISPR gRNA sequence
caagcacttaataactatat

SEQ ID NO: 306387 - DNA, 20 bp, Artificial
  CRISPR gRNA sequence
aagcacttaataactatatt

SEQ ID NO: 306388 - DNA, 20 bp, Artificial
  CRISPR gRNA sequence
ctatattaggaataaataaa

SEQ ID NO: 306389 - DNA, 20 bp, Artificial
  CRISPR gRNA sequence
atattaggaataaataaata

SEQ ID NO: 306390 - DNA, 20 bp, Artificial
  CRISPR gRNA sequence
aaataaatagagatttataa

SEQ ID NO: 306391 - DNA, 20 bp, Artificial
  CRISPR gRNA sequence
ataaaagcttccattataca

SEQ ID NO: 306392 - DNA, 20 bp, Artificial
  CRISPR gRNA sequence
taaaagcttccattatacac

SEQ ID NO: 306393 - DNA, 20 bp, Artificial
  CRISPR gRNA sequence
agcttccattatacacagga

SEQ ID NO: 306394 - DNA, 20 bp, Artificial
  CRISPR gRNA sequence
gctcacataaataatattaa

SEQ ID NO: 306395 - DNA, 20 bp, Artificial
  CRISPR gRNA sequence
aataatattaacggtatctg

SEQ ID NO: 306396 - DNA, 20 bp, Artificial
  CRISPR gRNA sequence
aatattaacggtatctgcag

SEQ ID NO: 306397 - DNA, 20 bp, Artificial
  CRISPR gRNA sequence
attaacggtatctgcagcag

SEQ ID NO: 306398 - DNA, 20 bp, Artificial
  CRISPR gRNA sequence
gcagacataacacgaactgc

SEQ ID NO: 306399 - DNA, 20 bp, Artificial
  CRISPR gRNA sequence
ataacacgaactgcaagtct

SEQ ID NO: 306400 - DNA, 20 bp, Artificial
  CRISPR gRNA sequence
tgcaagtctgagcacataaa

SEQ ID NO: 306401 - DNA, 20 bp, Artificial
  CRISPR gRNA sequence
gcacataaatagacgcattt

SEQ ID NO: 306402 - DNA, 20 bp, Artificial
  CRISPR gRNA sequence
taaatagacgcattttagta

SEQ ID NO: 306403 - DNA, 20 bp, Artificial
  CRISPR gRNA sequence
aaatagacgcattttagtac

SEQ ID NO: 306404 - DNA, 20 bp, Artificial
  CRISPR gRNA sequence
aatagacgcattttagtaca

SEQ ID NO: 306405 - DNA, 20 bp, Artificial
  CRISPR gRNA sequence
cgcattttagtacagggcct

SEQ ID NO: 306406 - DNA, 20 bp, Artificial
  CRISPR gRNA sequence
tagtacagggccttagtccc

SEQ ID NO: 306407 - DNA, 20 bp, Artificial
  CRISPR gRNA sequence
agggccttagtcccaagatt

SEQ ID NO: 306408 - DNA, 20 bp, Artificial
  CRISPR gRNA sequence
gggccttagtcccaagattg

SEQ ID NO: 306409 - DNA, 20 bp, Artificial
  CRISPR gRNA sequence
ccaagattgaggttacatgt

SEQ ID NO: 306410 - DNA, 20 bp, Artificial
  CRISPR gRNA sequence
gaggttacatgtaagataaa

SEQ ID NO: 306411 - DNA, 20 bp, Artificial
  CRISPR gRNA sequence
gttcatttccttcattatta

SEQ ID NO: 306412 - DNA, 20 bp, Artificial
  CRISPR gRNA sequence
ttccttcattattacagttt

SEQ ID NO: 306413 - DNA, 20 bp, Artificial
  CRISPR gRNA sequence
tccttcattattacagttta

SEQ ID NO: 306414 - DNA, 20 bp, Artificial
  CRISPR gRNA sequence
ccttcattattacagtttaa

SEQ ID NO: 306415 - DNA, 20 bp, Artificial
  CRISPR gRNA sequence
cttcattattacagtttaag

SEQ ID NO: 306416 - DNA, 20 bp, Artificial
  CRISPR gRNA sequence
tcattattacagtttaaggg

SEQ ID NO: 306417 - DNA, 20 bp, Artificial
  CRISPR gRNA sequence
ttattacagtttaaggggag

SEQ ID NO: 306418 - DNA, 20 bp, Artificial
  CRISPR gRNA sequence
tattacagtttaaggggagt

SEQ ID NO: 306419 - DNA, 20 bp, Artificial
  CRISPR gRNA sequence
tacagtttaaggggagtagg

SEQ ID NO: 306420 - DNA, 20 bp, Artificial
  CRISPR gRNA sequence
tgtcaaaaactattttcacc

SEQ ID NO: 306421 - DNA, 20 bp, Artificial
  CRISPR gRNA sequence
actattttcacctggctctc

SEQ ID NO: 306422 - DNA, 20 bp, Artificial
  CRISPR gRNA sequence
gaaccttaaattgctattaa

SEQ ID NO: 306423 - DNA, 20 bp, Artificial
  CRISPR gRNA sequence
accttaaattgctattaata

SEQ ID NO: 306424 - DNA, 20 bp, Artificial
  CRISPR gRNA sequence
attaatagagatgatatttt

SEQ ID NO: 306425 - DNA, 20 bp, Artificial
  CRISPR gRNA sequence
tttgcaaatgcaaatgcaaa

SEQ ID NO: 306426 - DNA, 20 bp, Artificial
  CRISPR gRNA sequence
ttgcaaatgcaaatgcaaat

SEQ ID NO: 306427 - DNA, 20 bp, Artificial
  CRISPR gRNA sequence
attatgttcaatcacttgct

SEQ ID NO: 306428 - DNA, 20 bp, Artificial
  CRISPR gRNA sequence
ttatgttcaatcacttgctt

SEQ ID NO: 306429 - DNA, 20 bp, Artificial
  CRISPR gRNA sequence
cttgggctcttttttgaccc

SEQ ID NO: 306430 - DNA, 20 bp, Artificial
  CRISPR gRNA sequence
aagaatatttctttttaaat

SEQ ID NO: 306431 - DNA, 20 bp, Artificial
  CRISPR gRNA sequence
tttctttttaaattagatct

SEQ ID NO: 306432 - DNA, 20 bp, Artificial
  CRISPR gRNA sequence
ttaaattagatcttggtctc

SEQ ID NO: 306433 - DNA, 20 bp, Artificial
  CRISPR gRNA sequence
agatcttggtctctggtgcc

SEQ ID NO: 306434 - DNA, 20 bp, Artificial
  CRISPR gRNA sequence
tcttggtctctggtgccaag

SEQ ID NO: 306435 - DNA, 20 bp, Artificial
  CRISPR gRNA sequence
cttggtctctggtgccaagt

SEQ ID NO: 306436 - DNA, 20 bp, Artificial
  CRISPR gRNA sequence
ttggtctctggtgccaagtg

SEQ ID NO: 306437 - DNA, 20 bp, Artificial
  CRISPR gRNA sequence
gtgccaagtggggctaatat

SEQ ID NO: 306438 - DNA, 20 bp, Artificial
  CRISPR gRNA sequence
tgccaagtggggctaatatt

SEQ ID NO: 306439 - DNA, 20 bp, Artificial
  CRISPR gRNA sequence
aagtggggctaatattggga

SEQ ID NO: 306440 - DNA, 20 bp, Artificial
  CRISPR gRNA sequence
agtggggctaatattgggat

SEQ ID NO: 306441 - DNA, 20 bp, Artificial
  CRISPR gRNA sequence
gtggggctaatattgggatg

SEQ ID NO: 306442 - DNA, 20 bp, Artificial
  CRISPR gRNA sequence
taatattgggatggggcact

SEQ ID NO: 306443 - DNA, 20 bp, Artificial
  CRISPR gRNA sequence
attgggatggggcacttgga

SEQ ID NO: 306444 - DNA, 20 bp, Artificial
  CRISPR gRNA sequence
ttgggatggggcacttggat

SEQ ID NO: 306445 - DNA, 20 bp, Artificial
  CRISPR gRNA sequence
ggatggggcacttggatggg

SEQ ID NO: 306446 - DNA, 20 bp, Artificial
  CRISPR gRNA sequence
acttggatgggaagaaatat

SEQ ID NO: 306447 - DNA, 20 bp, Artificial
  CRISPR gRNA sequence
cttggatgggaagaaatatt

SEQ ID NO: 306448 - DNA, 20 bp, Artificial
  CRISPR gRNA sequence
ttggatgggaagaaatattg

SEQ ID NO: 306449 - DNA, 20 bp, Artificial
  CRISPR gRNA sequence
gatgggaagaaatattgggg

SEQ ID NO: 306450 - DNA, 20 bp, Artificial
  CRISPR gRNA sequence
atgggaagaaatattgggga

SEQ ID NO: 306451 - DNA, 20 bp, Artificial
  CRISPR gRNA sequence
tgggaagaaatattggggaa

SEQ ID NO: 306452 - DNA, 20 bp, Artificial
  CRISPR gRNA sequence
aaatattggggaagggtctc

SEQ ID NO: 306453 - DNA, 20 bp, Artificial
  CRISPR gRNA sequence
ttggggaagggtctctggac

SEQ ID NO: 306454 - DNA, 20 bp, Artificial
  CRISPR gRNA sequence
ggggaagggtctctggacca

SEQ ID NO: 306455 - DNA, 20 bp, Artificial
  CRISPR gRNA sequence
gaagggtctctggaccagag

SEQ ID NO: 306456 - DNA, 20 bp, Artificial
  CRISPR gRNA sequence
aagggtctctggaccagaga

SEQ ID NO: 306457 - DNA, 20 bp, Artificial
  CRISPR gRNA sequence
agggtctctggaccagagaa

SEQ ID NO: 306458 - DNA, 20 bp, Artificial
  CRISPR gRNA sequence
tctctggaccagagaaggga

SEQ ID NO: 306459 - DNA, 20 bp, Artificial
  CRISPR gRNA sequence
ctctggaccagagaagggaa

SEQ ID NO: 306460 - DNA, 20 bp, Artificial
  CRISPR gRNA sequence
cagagaagggaaaggtcaaa

SEQ ID NO: 306461 - DNA, 20 bp, Artificial
  CRISPR gRNA sequence
agagaagggaaaggtcaaac

SEQ ID NO: 306462 - DNA, 20 bp, Artificial
  CRISPR gRNA sequence
aagggaaaggtcaaacagga

SEQ ID NO: 306463 - DNA, 20 bp, Artificial
  CRISPR gRNA sequence
aaaggtcaaacaggaaagcc

SEQ ID NO: 306464 - DNA, 20 bp, Artificial
  CRISPR gRNA sequence
gtcaaacaggaaagccaagt

SEQ ID NO: 306465 - DNA, 20 bp, Artificial
  CRISPR gRNA sequence
aaagccaagtaagtccattg

SEQ ID NO: 306466 - DNA, 20 bp, Artificial
  CRISPR gRNA sequence
agccaagtaagtccattgca

SEQ ID NO: 306467 - DNA, 20 bp, Artificial
  CRISPR gRNA sequence
ccaagtaagtccattgcaga

SEQ ID NO: 306468 - DNA, 20 bp, Artificial
  CRISPR gRNA sequence
caagtaagtccattgcagag

SEQ ID NO: 306469 - DNA, 20 bp, Artificial
  CRISPR gRNA sequence
gtccattgcagagaggctgc

SEQ ID NO: 306470 - DNA, 20 bp, Artificial
  CRISPR gRNA sequence
ccattgcagagaggctgcaa

SEQ ID NO: 306471 - DNA, 20 bp, Artificial
  CRISPR gRNA sequence
cattgcagagaggctgcaag

SEQ ID NO: 306472 - DNA, 20 bp, Artificial
  CRISPR gRNA sequence
ttgcagagaggctgcaagag

SEQ ID NO: 306473 - DNA, 20 bp, Artificial
  CRISPR gRNA sequence
tgcagagaggctgcaagagg

SEQ ID NO: 306474 - DNA, 20 bp, Artificial
  CRISPR gRNA sequence
aggaggaaatcccccttctc

SEQ ID NO: 306475 - DNA, 20 bp, Artificial
  CRISPR gRNA sequence
cccttctctggatttcccac

SEQ ID NO: 306476 - DNA, 20 bp, Artificial
  CRISPR gRNA sequence
ctctggatttcccactggca

SEQ ID NO: 306477 - DNA, 20 bp, Artificial
  CRISPR gRNA sequence
tctggatttcccactggcac

SEQ ID NO: 306478 - DNA, 20 bp, Artificial
  CRISPR gRNA sequence
ctggatttcccactggcaca

SEQ ID NO: 306479 - DNA, 20 bp, Artificial
  CRISPR gRNA sequence
tggatttcccactggcacag

SEQ ID NO: 306480 - DNA, 20 bp, Artificial
  CRISPR gRNA sequence
tcccactggcacaggggact

SEQ ID NO: 306481 - DNA, 20 bp, Artificial
  CRISPR gRNA sequence
cccactggcacaggggactc

SEQ ID NO: 306482 - DNA, 20 bp, Artificial
  CRISPR gRNA sequence
ctggcacaggggactcaggc

SEQ ID NO: 306483 - DNA, 20 bp, Artificial
  CRISPR gRNA sequence
tggcacaggggactcaggcg

SEQ ID NO: 306484 - DNA, 20 bp, Artificial
  CRISPR gRNA sequence
acaggggactcaggcgaggc

SEQ ID NO: 306485 - DNA, 20 bp, Artificial
  CRISPR gRNA sequence
gcgaggcgagctgacatctt

SEQ ID NO: 306486 - DNA, 20 bp, Artificial
  CRISPR gRNA sequence
catctttggactgcttcttc

SEQ ID NO: 306487 - DNA, 20 bp, Artificial
  CRISPR gRNA sequence
tctttggactgcttcttcta

SEQ ID NO: 306488 - DNA, 20 bp, Artificial
  CRISPR gRNA sequence
ttggactgcttcttctagag

SEQ ID NO: 306489 - DNA, 20 bp, Artificial
  CRISPR gRNA sequence
ggactgcttcttctagagca

SEQ ID NO: 306490 - DNA, 20 bp, Artificial
  CRISPR gRNA sequence
gactgcttcttctagagcag

SEQ ID NO: 306491 - DNA, 20 bp, Artificial
  CRISPR gRNA sequence
cttctagagcagaggctgct

SEQ ID NO: 306492 - DNA, 20 bp, Artificial
  CRISPR gRNA sequence
tctagagcagaggctgctcg

SEQ ID NO: 306493 - DNA, 20 bp, Artificial
  CRISPR gRNA sequence
cagaggctgctcggagaccc

SEQ ID NO: 306494 - DNA, 20 bp, Artificial
  CRISPR gRNA sequence
tcggagaccccagcacccca

SEQ ID NO: 306495 - DNA, 20 bp, Artificial
  CRISPR gRNA sequence
gaccccagcaccccaaagcc

SEQ ID NO: 306496 - DNA, 20 bp, Artificial
  CRISPR gRNA sequence
cagcaccccaaagccaagaa

SEQ ID NO: 306497 - DNA, 20 bp, Artificial
  CRISPR gRNA sequence
aagaacagctgccaattatt

SEQ ID NO: 306498 - DNA, 20 bp, Artificial
  CRISPR gRNA sequence
acagctgccaattatttggt

SEQ ID NO: 306499 - DNA, 20 bp, Artificial
  CRISPR gRNA sequence
gctgccaattatttggtaag

SEQ ID NO: 306500 - DNA, 20 bp, Artificial
  CRISPR gRNA sequence
ttcctgcctattttgtctct

SEQ ID NO: 306501 - DNA, 20 bp, Artificial
  CRISPR gRNA sequence
gtctcttagctcacgaaaaa

SEQ ID NO: 306502 - DNA, 20 bp, Artificial
  CRISPR gRNA sequence
tagctcacgaaaaacagatg

SEQ ID NO: 306503 - DNA, 20 bp, Artificial
  CRISPR gRNA sequence
agctcacgaaaaacagatga

SEQ ID NO: 306504 - DNA, 20 bp, Artificial
  CRISPR gRNA sequence
gctcacgaaaaacagatgaa

SEQ ID NO: 306505 - DNA, 20 bp, Artificial
  CRISPR gRNA sequence
gaaaaacagatgaagggatc

SEQ ID NO: 306506 - DNA, 20 bp, Artificial
  CRISPR gRNA sequence
aaacagatgaagggatctgg

SEQ ID NO: 306507 - DNA, 20 bp, Artificial
  CRISPR gRNA sequence
aacagatgaagggatctggc

SEQ ID NO: 306508 - DNA, 20 bp, Artificial
  CRISPR gRNA sequence
agatgaagggatctggcagg

SEQ ID NO: 306509 - DNA, 20 bp, Artificial
  CRISPR gRNA sequence
atgaagggatctggcaggaa

SEQ ID NO: 306510 - DNA, 20 bp, Artificial
  CRISPR gRNA sequence
agggatctggcaggaagaga

SEQ ID NO: 306511 - DNA, 20 bp, Artificial
  CRISPR gRNA sequence
gtaatatcccacctccaatg

SEQ ID NO: 306512 - DNA, 20 bp, Artificial
  CRISPR gRNA sequence
acctccaatgtagtcaatct

SEQ ID NO: 306513 - DNA, 20 bp, Artificial
  CRISPR gRNA sequence
tccaatgtagtcaatctgag

SEQ ID NO: 306514 - DNA, 20 bp, Artificial
  CRISPR gRNA sequence
aatctgagaagcaaacctga

SEQ ID NO: 306515 - DNA, 20 bp, Artificial
  CRISPR gRNA sequence
tgagaagcaaacctgatggt

SEQ ID NO: 306516 - DNA, 20 bp, Artificial
  CRISPR gRNA sequence
agaagcaaacctgatggtca

SEQ ID NO: 306517 - DNA, 20 bp, Artificial
  CRISPR gRNA sequence
gaagcaaacctgatggtcag

SEQ ID NO: 306518 - DNA, 20 bp, Artificial
  CRISPR gRNA sequence
acctgatggtcagaggtttt

SEQ ID NO: 306519 - DNA, 20 bp, Artificial
  CRISPR gRNA sequence
aatcccttttactcattctc

SEQ ID NO: 306520 - DNA, 20 bp, Artificial
  CRISPR gRNA sequence
ccttttactcattctctggc

SEQ ID NO: 306521 - DNA, 20 bp, Artificial
  CRISPR gRNA sequence
ctcattctctggccggccat

SEQ ID NO: 306522 - DNA, 20 bp, Artificial
  CRISPR gRNA sequence
ctggccggccattagcacat

SEQ ID NO: 306523 - DNA, 20 bp, Artificial
  CRISPR gRNA sequence
gcacatcagcatttctgccc

SEQ ID NO: 306524 - DNA, 20 bp, Artificial
  CRISPR gRNA sequence
cagcatttctgccccagatg

SEQ ID NO: 306525 - DNA, 20 bp, Artificial
  CRISPR gRNA sequence
tctgccccagatgcagcttg

SEQ ID NO: 306526 - DNA, 20 bp, Artificial
  CRISPR gRNA sequence
ctttatctcatgccactccc

SEQ ID NO: 306527 - DNA, 20 bp, Artificial
  CRISPR gRNA sequence
tttatctcatgccactccct

SEQ ID NO: 306528 - DNA, 20 bp, Artificial
  CRISPR gRNA sequence
atgccactccctaggcgtct

SEQ ID NO: 306529 - DNA, 20 bp, Artificial
  CRISPR gRNA sequence
tcacaaatgcctgtccactg

SEQ ID NO: 306530 - DNA, 20 bp, Artificial
  CRISPR gRNA sequence
ctgtccactgtagctccaaa

SEQ ID NO: 306531 - DNA, 20 bp, Artificial
  CRISPR gRNA sequence
gtccactgtagctccaaaaa

SEQ ID NO: 306532 - DNA, 20 bp, Artificial
  CRISPR gRNA sequence
ctgtagctccaaaaagagac

SEQ ID NO: 306533 - DNA, 20 bp, Artificial
  CRISPR gRNA sequence
caaaaagagaccagatgcat

SEQ ID NO: 306534 - DNA, 20 bp, Artificial
  CRISPR gRNA sequence
agagaccagatgcataagca

SEQ ID NO: 306535 - DNA, 20 bp, Artificial
  CRISPR gRNA sequence
gaccagatgcataagcacag

SEQ ID NO: 306536 - DNA, 20 bp, Artificial
  CRISPR gRNA sequence
ataagcacagcagcattccc

SEQ ID NO: 306537 - DNA, 20 bp, Artificial
  CRISPR gRNA sequence
taagcacagcagcattccca

SEQ ID NO: 306538 - DNA, 20 bp, Artificial
  CRISPR gRNA sequence
agcagcattcccaaggaaca

SEQ ID NO: 306539 - DNA, 20 bp, Artificial
  CRISPR gRNA sequence
agcattcccaaggaacacag

SEQ ID NO: 306540 - DNA, 20 bp, Artificial
  CRISPR gRNA sequence
ttcccaaggaacacagaagc

SEQ ID NO: 306541 - DNA, 20 bp, Artificial
  CRISPR gRNA sequence
tcccaaggaacacagaagca

SEQ ID NO: 306542 - DNA, 20 bp, Artificial
  CRISPR gRNA sequence
caaggaacacagaagcaagg

SEQ ID NO: 306543 - DNA, 20 bp, Artificial
  CRISPR gRNA sequence
gaacacagaagcaaggtggt

SEQ ID NO: 306544 - DNA, 20 bp, Artificial
  CRISPR gRNA sequence
aggtggtaagaataaaccaa

SEQ ID NO: 306545 - DNA, 20 bp, Artificial
  CRISPR gRNA sequence
ggtggtaagaataaaccaaa

SEQ ID NO: 306546 - DNA, 20 bp, Artificial
  CRISPR gRNA sequence
tggtaagaataaaccaaaag

SEQ ID NO: 306547 - DNA, 20 bp, Artificial
  CRISPR gRNA sequence
aaaccaaaaggagtatttgc

SEQ ID NO: 306548 - DNA, 20 bp, Artificial
  CRISPR gRNA sequence
gcgagctccccgtacctcct

SEQ ID NO: 306549 - DNA, 20 bp, Artificial
  CRISPR gRNA sequence
cgagctccccgtacctccta

SEQ ID NO: 306550 - DNA, 20 bp, Artificial
  CRISPR gRNA sequence
gtacctcctaaggctccttg

SEQ ID NO: 306551 - DNA, 20 bp, Artificial
  CRISPR gRNA sequence
acctcctaaggctccttgta

SEQ ID NO: 306552 - DNA, 20 bp, Artificial
  CRISPR gRNA sequence
ctcctaaggctccttgtaga

SEQ ID NO: 306553 - DNA, 20 bp, Artificial
  CRISPR gRNA sequence
cctaaggctccttgtagaga

SEQ ID NO: 306554 - DNA, 20 bp, Artificial
  CRISPR gRNA sequence
tgtagagagagaaataatgc

SEQ ID NO: 306555 - DNA, 20 bp, Artificial
  CRISPR gRNA sequence
gtagagagagaaataatgcc

SEQ ID NO: 306556 - DNA, 20 bp, Artificial
  CRISPR gRNA sequence
agaaataatgccaggactga

SEQ ID NO: 306557 - DNA, 20 bp, Artificial
  CRISPR gRNA sequence
aataatgccaggactgacgg

SEQ ID NO: 306558 - DNA, 20 bp, Artificial
  CRISPR gRNA sequence
ctgacggtagaactcaaata

SEQ ID NO: 306559 - DNA, 20 bp, Artificial
  CRISPR gRNA sequence
cggtagaactcaaatacaga

SEQ ID NO: 306560 - DNA, 20 bp, Artificial
  CRISPR gRNA sequence
ggtagaactcaaatacagaa

SEQ ID NO: 306561 - DNA, 20 bp, Artificial
  CRISPR gRNA sequence
gtagaactcaaatacagaaa

SEQ ID NO: 306562 - DNA, 20 bp, Artificial
  CRISPR gRNA sequence
tagaactcaaatacagaaag

SEQ ID NO: 306563 - DNA, 20 bp, Artificial
  CRISPR gRNA sequence
atacagaaaggggaactgac

SEQ ID NO: 306564 - DNA, 20 bp, Artificial
  CRISPR gRNA sequence
acagaaaggggaactgacta

SEQ ID NO: 306565 - DNA, 20 bp, Artificial
  CRISPR gRNA sequence
tgactagagaaacaacacca

SEQ ID NO: 306566 - DNA, 20 bp, Artificial
  CRISPR gRNA sequence
tagagaaacaacaccacagc

SEQ ID NO: 306567 - DNA, 20 bp, Artificial
  CRISPR gRNA sequence
agagaaacaacaccacagcc

SEQ ID NO: 306568 - DNA, 20 bp, Artificial
  CRISPR gRNA sequence
gagaaacaacaccacagcca

SEQ ID NO: 306569 - DNA, 20 bp, Artificial
  CRISPR gRNA sequence
aacaacaccacagccaggga

SEQ ID NO: 306570 - DNA, 20 bp, Artificial
  CRISPR gRNA sequence
ccagggacagtgctcttgct

SEQ ID NO: 306571 - DNA, 20 bp, Artificial
  CRISPR gRNA sequence
tggttccaaataacttctgc

SEQ ID NO: 306572 - DNA, 20 bp, Artificial
  CRISPR gRNA sequence
ttccaaataacttctgccgg

SEQ ID NO: 306573 - DNA, 20 bp, Artificial
  CRISPR gRNA sequence
tccaaataacttctgccggc

SEQ ID NO: 306574 - DNA, 20 bp, Artificial
  CRISPR gRNA sequence
aaataacttctgccggcagg

SEQ ID NO: 306575 - DNA, 20 bp, Artificial
  CRISPR gRNA sequence
aataacttctgccggcaggt

SEQ ID NO: 306576 - DNA, 20 bp, Artificial
  CRISPR gRNA sequence
aggtgggcatttccactgat

SEQ ID NO: 306577 - DNA, 20 bp, Artificial
  CRISPR gRNA sequence
gtcagttcccctttctgtat

SEQ ID NO: 306578 - DNA, 20 bp, Artificial
  CRISPR gRNA sequence
accttgcttctgtgttcctt

SEQ ID NO: 306579 - DNA, 20 bp, Artificial
  CRISPR gRNA sequence
tgtggaggctcagacgccta

SEQ ID NO: 306580 - DNA, 20 bp, Artificial
  CRISPR gRNA sequence
gatgtgctaatggccggcca

SEQ ID NO: 306581 - DNA, 20 bp, Artificial
  CRISPR gRNA sequence
tgctaatggccggccagaga

SEQ ID NO: 306582 - DNA, 20 bp, Artificial
  CRISPR gRNA sequence
ccggccagagaatgagtaaa

SEQ ID NO: 306583 - DNA, 20 bp, Artificial
  CRISPR gRNA sequence
cagattgactacattggagg

SEQ ID NO: 306584 - DNA, 20 bp, Artificial
  CRISPR gRNA sequence
ttggcagctgttcttggctt

SEQ ID NO: 306585 - DNA, 20 bp, Artificial
  CRISPR gRNA sequence
tgttcttggctttggggtgc

SEQ ID NO: 306586 - DNA, 20 bp, Artificial
  CRISPR gRNA sequence
aagatgtcagctcgcctcgc

SEQ ID NO: 306587 - DNA, 20 bp, Artificial
  CRISPR gRNA sequence
cagtgggaaatccagagaag

SEQ ID NO: 306588 - DNA, 20 bp, Artificial
  CRISPR gRNA sequence
taatttaaaaagaaatattc

SEQ ID NO: 306589 - DNA, 20 bp, Artificial
  CRISPR gRNA sequence
ttttggttagtctattcttc

SEQ ID NO: 306590 - DNA, 20 bp, Artificial
  CRISPR gRNA sequence
tgaatttcatatgcctcttc

SEQ ID NO: 306591 - DNA, 20 bp, Artificial
  CRISPR gRNA sequence
tcatatgcctcttcctgggt

SEQ ID NO: 306592 - DNA, 20 bp, Artificial
  CRISPR gRNA sequence
gcctcttcctgggtgggggt

SEQ ID NO: 306593 - DNA, 20 bp, Artificial
  CRISPR gRNA sequence
ttcctgggtgggggtgagga

SEQ ID NO: 306594 - DNA, 20 bp, Artificial
  CRISPR gRNA sequence
ggggtgaggatgggatttta

SEQ ID NO: 306595 - DNA, 20 bp, Artificial
  CRISPR gRNA sequence
ttcaaaaatcagactgaggt

SEQ ID NO: 306596 - DNA, 20 bp, Artificial
  CRISPR gRNA sequence
ctgaggtgggagttgaggtt

SEQ ID NO: 306597 - DNA, 20 bp, Artificial
  CRISPR gRNA sequence
ggttaggggtccctaggcca

SEQ ID NO: 306598 - DNA, 20 bp, Artificial
  CRISPR gRNA sequence
ctagagcaaaagcaagcaca

SEQ ID NO: 306599 - DNA, 20 bp, Artificial
  CRISPR gRNA sequence
cctttcatggccaggcaggt

SEQ ID NO: 306600 - DNA, 20 bp, Artificial
  CRISPR gRNA sequence
caggcaggtaagagtatttg

SEQ ID NO: 306601 - DNA, 20 bp, Artificial
  CRISPR gRNA sequence
tttgggaaataggcgccatt

SEQ ID NO: 306602 - DNA, 20 bp, Artificial
  CRISPR gRNA sequence
cggtcctcctttattcatgg

SEQ ID NO: 306603 - DNA, 20 bp, Artificial
  CRISPR gRNA sequence
tcaaaaaatgccttagccca

SEQ ID NO: 306604 - DNA, 20 bp, Artificial
  CRISPR gRNA sequence
aaaatgccttagcccaagga

SEQ ID NO: 306605 - DNA, 20 bp, Artificial
  CRISPR gRNA sequence
gcccaaggaatgagtaatgt

SEQ ID NO: 306606 - DNA, 20 bp, Artificial
  CRISPR gRNA sequence
aatgtgggaattccaagcag

SEQ ID NO: 306607 - DNA, 20 bp, Artificial
  CRISPR gRNA sequence
gatgctgtttctgagaaaac

SEQ ID NO: 306608 - DNA, 20 bp, Artificial
  CRISPR gRNA sequence
atcaggctaccttaggggac

SEQ ID NO: 306609 - DNA, 20 bp, Artificial
  CRISPR gRNA sequence
atgggcatggctccctttta

SEQ ID NO: 306610 - DNA, 20 bp, Artificial
  CRISPR gRNA sequence
atacctgacagtcagagccc

SEQ ID NO: 306611 - DNA, 20 bp, Artificial
  CRISPR gRNA sequence
ctgacagtcagagccctcga

SEQ ID NO: 306612 - DNA, 20 bp, Artificial
  CRISPR gRNA sequence
aattcatcaatagtttgaaa

SEQ ID NO: 306613 - DNA, 20 bp, Artificial
  CRISPR gRNA sequence
gttgcctacaatattggaag

SEQ ID NO: 306614 - DNA, 20 bp, Artificial
  CRISPR gRNA sequence
tggaaacactgtgctctcaa

SEQ ID NO: 306615 - DNA, 20 bp, Artificial
  CRISPR gRNA sequence
cagaaaaatctccacaaatg

SEQ ID NO: 306616 - DNA, 20 bp, Artificial
  CRISPR gRNA sequence
ctccacaaatggggaataag

SEQ ID NO: 306617 - DNA, 20 bp, Artificial
  CRISPR gRNA sequence
agcttgaggaaaacagagct

SEQ ID NO: 306618 - DNA, 20 bp, Artificial
  CRISPR gRNA sequence
aattttctgttaaattaaat

SEQ ID NO: 306619 - DNA, 20 bp, Artificial
  CRISPR gRNA sequence
tgtgtctcagaaagtcgtca

SEQ ID NO: 306620 - DNA, 20 bp, Artificial
  CRISPR gRNA sequence
agacccattaaacagatgcc

SEQ ID NO: 306621 - DNA, 20 bp, Artificial
  CRISPR gRNA sequence
ttaaacagatgcctcggatg

SEQ ID NO: 306622 - DNA, 20 bp, Artificial
  CRISPR gRNA sequence
atgcagggttatatattatc

SEQ ID NO: 306623 - DNA, 20 bp, Artificial
  CRISPR gRNA sequence
tatcaggaatctgtctaggg

SEQ ID NO: 306624 - DNA, 20 bp, Artificial
  CRISPR gRNA sequence
agaggacgatagctaccacg

SEQ ID NO: 306625 - DNA, 20 bp, Artificial
  CRISPR gRNA sequence
ggctaacagccctcataagt

SEQ ID NO: 306626 - DNA, 20 bp, Artificial
  CRISPR gRNA sequence
gccctcataagtgggagtat

SEQ ID NO: 306627 - DNA, 20 bp, Artificial
  CRISPR gRNA sequence
tcataagtgggagtatcaga

SEQ ID NO: 306628 - DNA, 20 bp, Artificial
  CRISPR gRNA sequence
ttaattacttaaaaccaata

SEQ ID NO: 306629 - DNA, 20 bp, Artificial
  CRISPR gRNA sequence
ctcgtgcaagttctaacatg

SEQ ID NO: 306630 - DNA, 20 bp, Artificial
  CRISPR gRNA sequence
acaccacccttccaagctgt

SEQ ID NO: 306631 - DNA, 20 bp, Artificial
  CRISPR gRNA sequence
tctccatgtcttctgaagcc

SEQ ID NO: 306632 - DNA, 20 bp, Artificial
  CRISPR gRNA sequence
tcagcagactctacccagac

SEQ ID NO: 306633 - DNA, 20 bp, Artificial
  CRISPR gRNA sequence
aaaaatgagaggaactgact

SEQ ID NO: 306634 - DNA, 20 bp, Artificial
  CRISPR gRNA sequence
ctgactcagggtgagagcga

SEQ ID NO: 306635 - DNA, 20 bp, Artificial
  CRISPR gRNA sequence
cttattcctggaaatgtaat

SEQ ID NO: 306636 - DNA, 20 bp, Artificial
  CRISPR gRNA sequence
tagaggtgaactgaaaagtt

SEQ ID NO: 306637 - DNA, 20 bp, Artificial
  CRISPR gRNA sequence
gttatcacccccactttggt

SEQ ID NO: 306638 - DNA, 20 bp, Artificial
  CRISPR gRNA sequence
ctgcccttccccttgataaa

SEQ ID NO: 306639 - DNA, 20 bp, Artificial
  CRISPR gRNA sequence
gcgatgtggtctgattagca

SEQ ID NO: 306640 - DNA, 20 bp, Artificial
  CRISPR gRNA sequence
tctgattagcacagagttca

SEQ ID NO: 306641 - DNA, 20 bp, Artificial
  CRISPR gRNA sequence
attagcacagagttcagtga

SEQ ID NO: 306642 - DNA, 20 bp, Artificial
  CRISPR gRNA sequence
tcagtgaatgaatcctacac

SEQ ID NO: 306643 - DNA, 20 bp, Artificial
  CRISPR gRNA sequence
gaatgaatcctacactagga

SEQ ID NO: 306644 - DNA, 20 bp, Artificial
  CRISPR gRNA sequence
atgtgatttttatgtttact

SEQ ID NO: 306645 - DNA, 20 bp, Artificial
  CRISPR gRNA sequence
agtctctcttttcaggcttt

SEQ ID NO: 306646 - DNA, 20 bp, Artificial
  CRISPR gRNA sequence
aaaagtgaaatagtgaaaca

SEQ ID NO: 306647 - DNA, 20 bp, Artificial
  CRISPR gRNA sequence
gagtcttgtagcatccactg

SEQ ID NO: 306648 - DNA, 20 bp, Artificial
  CRISPR gRNA sequence
gtgggatcagtcttttagac

SEQ ID NO: 306649 - DNA, 20 bp, Artificial
  CRISPR gRNA sequence
agacaagaatgatgcagttg

SEQ ID NO: 306650 - DNA, 20 bp, Artificial
  CRISPR gRNA sequence
tgatgcagttgctgagtcaa

SEQ ID NO: 306651 - DNA, 20 bp, Artificial
  CRISPR gRNA sequence
ttgctgagtcaaatgaataa

SEQ ID NO: 306652 - DNA, 20 bp, Artificial
  CRISPR gRNA sequence
aaacttagcagcttagaaca

SEQ ID NO: 306653 - DNA, 20 bp, Artificial
  CRISPR gRNA sequence
ttaccctctctcacaatgtt

SEQ ID NO: 306654 - DNA, 20 bp, Artificial
  CRISPR gRNA sequence
ctctcacaatgtttggggtc

SEQ ID NO: 306655 - DNA, 20 bp, Artificial
  CRISPR gRNA sequence
cacctgatgttattaagctg

SEQ ID NO: 306656 - DNA, 20 bp, Artificial
  CRISPR gRNA sequence
tgtattctttttttctgaga

SEQ ID NO: 306657 - DNA, 20 bp, Artificial
  CRISPR gRNA sequence
tcttactctgttgcccaggc

SEQ ID NO: 306658 - DNA, 20 bp, Artificial
  CRISPR gRNA sequence
gattctcctgcctcagcctc

SEQ ID NO: 306659 - DNA, 20 bp, Artificial
  CRISPR gRNA sequence
ttttgtatttttagtagaga

SEQ ID NO: 306660 - DNA, 20 bp, Artificial
  CRISPR gRNA sequence
acctcggcctcccaaagtgc

SEQ ID NO: 306661 - DNA, 20 bp, Artificial
  CRISPR gRNA sequence
ggacagtgctgatctagagc

SEQ ID NO: 306662 - DNA, 20 bp, Artificial
  CRISPR gRNA sequence
catatgtctggtggcttggc

SEQ ID NO: 306663 - DNA, 20 bp, Artificial
  CRISPR gRNA sequence
cctctccagcatgatggtct

SEQ ID NO: 306664 - DNA, 20 bp, Artificial
  CRISPR gRNA sequence
tgaccaagctctcgaagtcc

SEQ ID NO: 306665 - DNA, 20 bp, Artificial
  CRISPR gRNA sequence
ctctacctcttcatgggagg

SEQ ID NO: 306666 - DNA, 20 bp, Artificial
  CRISPR gRNA sequence
tcatgggaggaggagtagcc

SEQ ID NO: 306667 - DNA, 20 bp, Artificial
  CRISPR gRNA sequence
aataaatatttgtggaagaa

SEQ ID NO: 306668 - DNA, 20 bp, Artificial
  CRISPR gRNA sequence
aatatttgtggaagaaacga

SEQ ID NO: 306669 - DNA, 20 bp, Artificial
  CRISPR gRNA sequence
tttgtggaagaaacgaatga

SEQ ID NO: 306670 - DNA, 20 bp, Artificial
  CRISPR gRNA sequence
aatgaatgaaccaatagcaa

SEQ ID NO: 306671 - DNA, 20 bp, Artificial
  CRISPR gRNA sequence
aatgaaccaatagcaaatga

SEQ ID NO: 306672 - DNA, 20 bp, Artificial
  CRISPR gRNA sequence
aaccaatagcaaatgaatga

SEQ ID NO: 306673 - DNA, 20 bp, Artificial
  CRISPR gRNA sequence
actcttcccagtatctcaaa

SEQ ID NO: 306674 - DNA, 20 bp, Artificial
  CRISPR gRNA sequence
ttctgccctgagctgctcaa

SEQ ID NO: 306675 - DNA, 20 bp, Artificial
  CRISPR gRNA sequence
gttcattctgcaaacactgc

SEQ ID NO: 306676 - DNA, 20 bp, Artificial
  CRISPR gRNA sequence
cccactgtgtgccaggtaca

SEQ ID NO: 306677 - DNA, 20 bp, Artificial
  CRISPR gRNA sequence
acaggcaccagcttcccagc

SEQ ID NO: 306678 - DNA, 20 bp, Artificial
  CRISPR gRNA sequence
gctcttgttcaggcaaaggg

SEQ ID NO: 306679 - DNA, 20 bp, Artificial
  CRISPR gRNA sequence
aagggcaggatgaggggagg

SEQ ID NO: 306680 - DNA, 20 bp, Artificial
  CRISPR gRNA sequence
ggggtggcagcagccagtaa

SEQ ID NO: 306681 - DNA, 20 bp, Artificial
  CRISPR gRNA sequence
ccagtaatggggtgggacag

SEQ ID NO: 306682 - DNA, 20 bp, Artificial
  CRISPR gRNA sequence
gggtgggacagcggaatgca

SEQ ID NO: 306683 - DNA, 20 bp, Artificial
  CRISPR gRNA sequence
tggcttatccaaccacaagt

SEQ ID NO: 306684 - DNA, 20 bp, Artificial
  CRISPR gRNA sequence
agaaggcaatgagctgggcc

SEQ ID NO: 306685 - DNA, 20 bp, Artificial
  CRISPR gRNA sequence
gtggtgtcccctgctttgct

SEQ ID NO: 306686 - DNA, 20 bp, Artificial
  CRISPR gRNA sequence
tctctagaacaagtctgaca

SEQ ID NO: 306687 - DNA, 20 bp, Artificial
  CRISPR gRNA sequence
tccctcatcctgccctttgc

SEQ ID NO: 306688 - DNA, 20 bp, Artificial
  CRISPR gRNA sequence
ctctctgtacctggcacaca

SEQ ID NO: 306689 - DNA, 20 bp, Artificial
  CRISPR gRNA sequence
gggtattcgagcagtgtttg

SEQ ID NO: 306690 - DNA, 20 bp, Artificial
  CRISPR gRNA sequence
cagaaaccctcttgatgcaa

SEQ ID NO: 306691 - DNA, 20 bp, Artificial
  CRISPR gRNA sequence
ccaccccagtctgtctctct

SEQ ID NO: 306692 - DNA, 20 bp, Artificial
  CRISPR gRNA sequence
tctcagaggctagataacat

SEQ ID NO: 306693 - DNA, 20 bp, Artificial
  CRISPR gRNA sequence
gtgaaagaaacacaggctgc

SEQ ID NO: 306694 - DNA, 20 bp, Artificial
  CRISPR gRNA sequence
gacatacaaagtaagtgaaa

SEQ ID NO: 306695 - DNA, 20 bp, Artificial
  CRISPR gRNA sequence
caggtgctcttcttggtttc

SEQ ID NO: 306696 - DNA, 20 bp, Artificial
  CRISPR gRNA sequence
ctgacagaaatctcctctca

SEQ ID NO: 306697 - DNA, 20 bp, Artificial
  CRISPR gRNA sequence
tgctctctccctccgaaggc

SEQ ID NO: 306698 - DNA, 20 bp, Artificial
  CRISPR gRNA sequence
ggttggaggttcattcctga

SEQ ID NO: 306699 - DNA, 20 bp, Artificial
  CRISPR gRNA sequence
cacacatcacacatcatggc

SEQ ID NO: 306700 - DNA, 20 bp, Artificial
  CRISPR gRNA sequence
gaaagaaaatcatatcaatc

SEQ ID NO: 306701 - DNA, 20 bp, Artificial
  CRISPR gRNA sequence
attttaacatcctattacag

SEQ ID NO: 306702 - DNA, 20 bp, Artificial
  CRISPR gRNA sequence
tcactgataaactaagtgtc

SEQ ID NO: 306703 - DNA, 20 bp, Artificial
  CRISPR gRNA sequence
taagtgtccagagtgttttc

SEQ ID NO: 306704 - DNA, 20 bp, Artificial
  CRISPR gRNA sequence
acattagtgaagcttactgg

SEQ ID NO: 306705 - DNA, 20 bp, Artificial
  CRISPR gRNA sequence
ttgttactcctgggccaggc

SEQ ID NO: 306706 - DNA, 20 bp, Artificial
  CRISPR gRNA sequence
agaagtgtgttaggcttact

SEQ ID NO: 306707 - DNA, 20 bp, Artificial
  CRISPR gRNA sequence
gcttctaacccaggggaaga

SEQ ID NO: 306708 - DNA, 20 bp, Artificial
  CRISPR gRNA sequence
aaatggtactgattccttgt

SEQ ID NO: 306709 - DNA, 20 bp, Artificial
  CRISPR gRNA sequence
tcagtgcttctccccactgt

SEQ ID NO: 306710 - DNA, 20 bp, Artificial
  CRISPR gRNA sequence
tactgatttcatgtaattat

SEQ ID NO: 306711 - DNA, 20 bp, Artificial
  CRISPR gRNA sequence
gagcgattcccatattaggt

SEQ ID NO: 306712 - DNA, 20 bp, Artificial
  CRISPR gRNA sequence
tttttgtagtagccagccta

SEQ ID NO: 306713 - DNA, 20 bp, Artificial
  CRISPR gRNA sequence
gttctcactgtcattttata

SEQ ID NO: 306714 - DNA, 20 bp, Artificial
  CRISPR gRNA sequence
tatattgaatttcttttatt

SEQ ID NO: 306715 - DNA, 20 bp, Artificial
  CRISPR gRNA sequence
ttcttttgcccgcttttagt

SEQ ID NO: 306716 - DNA, 20 bp, Artificial
  CRISPR gRNA sequence
cccttccagccaatagattt

SEQ ID NO: 306717 - DNA, 20 bp, Artificial
  CRISPR gRNA sequence
aagctgacaccacacaagcg

SEQ ID NO: 306718 - DNA, 20 bp, Artificial
  CRISPR gRNA sequence
acaagcgcagagtatgggaa

SEQ ID NO: 306719 - DNA, 20 bp, Artificial
  CRISPR gRNA sequence
caacagcaacctacttatca

SEQ ID NO: 306720 - DNA, 20 bp, Artificial
  CRISPR gRNA sequence
acctacttatcacagaatat

SEQ ID NO: 306721 - DNA, 20 bp, Artificial
  CRISPR gRNA sequence
agaattgaacaagtgttggc

SEQ ID NO: 306722 - DNA, 20 bp, Artificial
  CRISPR gRNA sequence
ctcttgttccagttgtcgat

SEQ ID NO: 306723 - DNA, 20 bp, Artificial
  CRISPR gRNA sequence
gttcctcagaaaattaaaaa

SEQ ID NO: 306724 - DNA, 20 bp, Artificial
  CRISPR gRNA sequence
atgatctagcaattcccctt

SEQ ID NO: 306725 - DNA, 20 bp, Artificial
  CRISPR gRNA sequence
atacccaaaagaactgaaag

SEQ ID NO: 306726 - DNA, 20 bp, Artificial
  CRISPR gRNA sequence
aactcaaatgtccatcaaaa

SEQ ID NO: 306727 - DNA, 20 bp, Artificial
  CRISPR gRNA sequence
caaatgtccatcaaaaatga

SEQ ID NO: 306728 - DNA, 20 bp, Artificial
  CRISPR gRNA sequence
aatgtagtatgtacatacag

SEQ ID NO: 306729 - DNA, 20 bp, Artificial
  CRISPR gRNA sequence
attcaaacacatgctacaat

SEQ ID NO: 306730 - DNA, 20 bp, Artificial
  CRISPR gRNA sequence
tgctacaatgtggatggccc

SEQ ID NO: 306731 - DNA, 20 bp, Artificial
  CRISPR gRNA sequence
cacaaaaagacaaatactgt

SEQ ID NO: 306732 - DNA, 20 bp, Artificial
  CRISPR gRNA sequence
aaattcatggaaacagaagg

SEQ ID NO: 306733 - DNA, 20 bp, Artificial
  CRISPR gRNA sequence
gctgagaggaggagagaaag

SEQ ID NO: 306734 - DNA, 20 bp, Artificial
  CRISPR gRNA sequence
ggcttagttttgcaagatga

SEQ ID NO: 306735 - DNA, 20 bp, Artificial
  CRISPR gRNA sequence
aagatgaaagagttctgaag

SEQ ID NO: 306736 - DNA, 20 bp, Artificial
  CRISPR gRNA sequence
agtgatgactgtacaacaat

SEQ ID NO: 306737 - DNA, 20 bp, Artificial
  CRISPR gRNA sequence
ggtcaaacgattctgcttct

SEQ ID NO: 306738 - DNA, 20 bp, Artificial
  CRISPR gRNA sequence
tatatattattgtcatccaa

SEQ ID NO: 306739 - DNA, 20 bp, Artificial
  CRISPR gRNA sequence
taatatgcaacttttagcat

SEQ ID NO: 306740 - DNA, 20 bp, Artificial
  CRISPR gRNA sequence
atactcgttacatgctgata

SEQ ID NO: 306741 - DNA, 20 bp, Artificial
  CRISPR gRNA sequence
gcttaaaaataaaaagaaaa

SEQ ID NO: 306742 - DNA, 20 bp, Artificial
  CRISPR gRNA sequence
aaataaaaagaaaacagaat

SEQ ID NO: 306743 - DNA, 20 bp, Artificial
  CRISPR gRNA sequence
ttctagcccaatgtcctgca

SEQ ID NO: 306744 - DNA, 20 bp, Artificial
  CRISPR gRNA sequence
tacatttctgctattcgatc

SEQ ID NO: 306745 - DNA, 20 bp, Artificial
  CRISPR gRNA sequence
gttgtgcatcttttcctgga

SEQ ID NO: 306746 - DNA, 20 bp, Artificial
  CRISPR gRNA sequence
ttgtttttatcaacagacct

SEQ ID NO: 306747 - DNA, 20 bp, Artificial
  CRISPR gRNA sequence
tgaatttagtggacagacct

SEQ ID NO: 306748 - DNA, 20 bp, Artificial
  CRISPR gRNA sequence
ctgtgtatggccataccatc

SEQ ID NO: 306749 - DNA, 20 bp, Artificial
  CRISPR gRNA sequence
gcagcctttttggtgctagt

SEQ ID NO: 306750 - DNA, 20 bp, Artificial
  CRISPR gRNA sequence
gtgctagttagggtaagtgc

SEQ ID NO: 306751 - DNA, 20 bp, Artificial
  CRISPR gRNA sequence
ggcttcatcatgtagattaa

SEQ ID NO: 306752 - DNA, 20 bp, Artificial
  CRISPR gRNA sequence
gttgttaaacataaaaattc

SEQ ID NO: 306753 - DNA, 20 bp, Artificial
  CRISPR gRNA sequence
taggcccttggacatttcct

SEQ ID NO: 306754 - DNA, 20 bp, Artificial
  CRISPR gRNA sequence
ctgcacacccgagaacccaa

SEQ ID NO: 306755 - DNA, 20 bp, Artificial
  CRISPR gRNA sequence
tcgactctagcactatggga

SEQ ID NO: 306756 - DNA, 20 bp, Artificial
  CRISPR gRNA sequence
ctttcagctttgttaagtcc

SEQ ID NO: 306757 - DNA, 20 bp, Artificial
  CRISPR gRNA sequence
tggaatcctactgtctcctg

SEQ ID NO: 306758 - DNA, 20 bp, Artificial
  CRISPR gRNA sequence
aagcccaggcctgagacttg

SEQ ID NO: 306759 - DNA, 20 bp, Artificial
  CRISPR gRNA sequence
agcagctgatggcaggcagc

SEQ ID NO: 306760 - DNA, 20 bp, Artificial
  CRISPR gRNA sequence
catcagtgagcctagatgct

SEQ ID NO: 306761 - DNA, 20 bp, Artificial
  CRISPR gRNA sequence
gtgagcctagatgctcagag

SEQ ID NO: 306762 - DNA, 20 bp, Artificial
  CRISPR gRNA sequence
ggtagcctggcccatcccat

SEQ ID NO: 306763 - DNA, 20 bp, Artificial
  CRISPR gRNA sequence
ggctcctaggaaacaactga

SEQ ID NO: 306764 - DNA, 20 bp, Artificial
  CRISPR gRNA sequence
gccacggcttcctgacaact

SEQ ID NO: 306765 - DNA, 20 bp, Artificial
  CRISPR gRNA sequence
gtcttatgctttggtaaaat

SEQ ID NO: 306766 - DNA, 20 bp, Artificial
  CRISPR gRNA sequence
cagtcaggggcattttgtat

SEQ ID NO: 306767 - DNA, 20 bp, Artificial
  CRISPR gRNA sequence
tccctgtttacagttccact

SEQ ID NO: 306768 - DNA, 20 bp, Artificial
  CRISPR gRNA sequence
cagtttcttcatctataaac

SEQ ID NO: 306769 - DNA, 20 bp, Artificial
  CRISPR gRNA sequence
gcacccacaggccaccagcc

SEQ ID NO: 306770 - DNA, 20 bp, Artificial
  CRISPR gRNA sequence
ccactgtccccatgtctgct

SEQ ID NO: 306771 - DNA, 20 bp, Artificial
  CRISPR gRNA sequence
catgtctgctgtggatgatg

SEQ ID NO: 306772 - DNA, 20 bp, Artificial
  CRISPR gRNA sequence
tccctcagatccatgctggc

SEQ ID NO: 306773 - DNA, 20 bp, Artificial
  CRISPR gRNA sequence
tgcttagcaccttgagcttg

SEQ ID NO: 306774 - DNA, 20 bp, Artificial
  CRISPR gRNA sequence
accttgagcttgtggagtcc

SEQ ID NO: 306775 - DNA, 20 bp, Artificial
  CRISPR gRNA sequence
gacctgctaccttagctcct

SEQ ID NO: 306776 - DNA, 20 bp, Artificial
  CRISPR gRNA sequence
tctttctctgtcacccaggc

SEQ ID NO: 306777 - DNA, 20 bp, Artificial
  CRISPR gRNA sequence
acctcagcctccccaagtgc

SEQ ID NO: 306778 - DNA, 20 bp, Artificial
  CRISPR gRNA sequence
atgcatatatacacacagtc

SEQ ID NO: 306779 - DNA, 20 bp, Artificial
  CRISPR gRNA sequence
gtcatgaatcgtttaacaac

SEQ ID NO: 306780 - DNA, 20 bp, Artificial
  CRISPR gRNA sequence
ttgtcattgtataatcatca

SEQ ID NO: 306781 - DNA, 20 bp, Artificial
  CRISPR gRNA sequence
ctgcacagcatgttactgtg

SEQ ID NO: 306782 - DNA, 20 bp, Artificial
  CRISPR gRNA sequence
gagctactaagtggcagagc

SEQ ID NO: 306783 - DNA, 20 bp, Artificial
  CRISPR gRNA sequence
cctaactcttgtggtaaacc

SEQ ID NO: 306784 - DNA, 20 bp, Artificial
  CRISPR gRNA sequence
atggggcctgaacagctttg

SEQ ID NO: 306785 - DNA, 20 bp, Artificial
  CRISPR gRNA sequence
gccgagacactctatgaaaa

SEQ ID NO: 306786 - DNA, 20 bp, Artificial
  CRISPR gRNA sequence
agtttcttagctcctgagaa

SEQ ID NO: 306787 - DNA, 20 bp, Artificial
  CRISPR gRNA sequence
tttaagttttatggtggtga

SEQ ID NO: 306788 - DNA, 20 bp, Artificial
  CRISPR gRNA sequence
ttggcagtacaattttaaag

SEQ ID NO: 306789 - DNA, 20 bp, Artificial
  CRISPR gRNA sequence
aacaaaaaatcagattctat

SEQ ID NO: 306790 - DNA, 20 bp, Artificial
  CRISPR gRNA sequence
tccaccctcaaaatgtagag

SEQ ID NO: 306791 - DNA, 20 bp, Artificial
  CRISPR gRNA sequence
tatttgctgcccctgctctt

SEQ ID NO: 306792 - DNA, 20 bp, Artificial
  CRISPR gRNA sequence
ccctgctcttgaggataaaa

SEQ ID NO: 306793 - DNA, 20 bp, Artificial
  CRISPR gRNA sequence
tcttgaggataaaattggat

SEQ ID NO: 306794 - DNA, 20 bp, Artificial
  CRISPR gRNA sequence
aacgggcacctgtggccttg

SEQ ID NO: 306795 - DNA, 20 bp, Artificial
  CRISPR gRNA sequence
ccttgtatttacaaagcgaa

SEQ ID NO: 306796 - DNA, 20 bp, Artificial
  CRISPR gRNA sequence
ggaggaagtatctttccagt

SEQ ID NO: 306797 - DNA, 20 bp, Artificial
  CRISPR gRNA sequence
tagctgctctctttttgtct

SEQ ID NO: 306798 - DNA, 20 bp, Artificial
  CRISPR gRNA sequence
tctttttgtctgagggttct

SEQ ID NO: 306799 - DNA, 20 bp, Artificial
  CRISPR gRNA sequence
tctagttaatttcatgtacc

SEQ ID NO: 306800 - DNA, 20 bp, Artificial
  CRISPR gRNA sequence
catgtacctggagtggtagt

SEQ ID NO: 306801 - DNA, 20 bp, Artificial
  CRISPR gRNA sequence
ttttttttttttttttgaga

SEQ ID NO: 306802 - DNA, 20 bp, Artificial
  CRISPR gRNA sequence
gcctcagcctcccaagtagc

SEQ ID NO: 306803 - DNA, 20 bp, Artificial
  CRISPR gRNA sequence
ttttgtatttttggtagaga

SEQ ID NO: 306804 - DNA, 20 bp, Artificial
  CRISPR gRNA sequence
gcctcgacctcccaaagtgc

SEQ ID NO: 306805 - DNA, 20 bp, Artificial
  CRISPR gRNA sequence
agatttttgcagatatctgc

SEQ ID NO: 306806 - DNA, 20 bp, Artificial
  CRISPR gRNA sequence
attaaaaccatcacctggag

SEQ ID NO: 306807 - DNA, 20 bp, Artificial
  CRISPR gRNA sequence
gtcgagacctatcattccca

SEQ ID NO: 306808 - DNA, 20 bp, Artificial
  CRISPR gRNA sequence
catggagcctaatagttcta

SEQ ID NO: 306809 - DNA, 20 bp, Artificial
  CRISPR gRNA sequence
tagatatatgttatctagta

SEQ ID NO: 306810 - DNA, 20 bp, Artificial
  CRISPR gRNA sequence
ttgtttcaggagggctttta

SEQ ID NO: 306811 - DNA, 20 bp, Artificial
  CRISPR gRNA sequence
gatttagtggaagacagtca

SEQ ID NO: 306812 - DNA, 20 bp, Artificial
  CRISPR gRNA sequence
agtggaagacagtcactgaa

SEQ ID NO: 306813 - DNA, 20 bp, Artificial
  CRISPR gRNA sequence
gtcactgaataggatgtgta

SEQ ID NO: 306814 - DNA, 20 bp, Artificial
  CRISPR gRNA sequence
gtatagggttgtttgggagc

SEQ ID NO: 306815 - DNA, 20 bp, Artificial
  CRISPR gRNA sequence
ttatttttcctttgtgagag

SEQ ID NO: 306816 - DNA, 20 bp, Artificial
  CRISPR gRNA sequence
aactctgtcacccaggctag

SEQ ID NO: 306817 - DNA, 20 bp, Artificial
  CRISPR gRNA sequence
gatgtttctgcctcagccac

SEQ ID NO: 306818 - DNA, 20 bp, Artificial
  CRISPR gRNA sequence
gttttgttttgctttagaga

SEQ ID NO: 306819 - DNA, 20 bp, Artificial
  CRISPR gRNA sequence
ttctcagcttcttaaagtcc

SEQ ID NO: 306820 - DNA, 20 bp, Artificial
  CRISPR gRNA sequence
tatacttatttaaatttttt

SEQ ID NO: 306821 - DNA, 20 bp, Artificial
  CRISPR gRNA sequence
tgcctatggtaacacaggca

SEQ ID NO: 306822 - DNA, 20 bp, Artificial
  CRISPR gRNA sequence
gagattgaactcacgctgtc

SEQ ID NO: 306823 - DNA, 20 bp, Artificial
  CRISPR gRNA sequence
gctacatggcattactttgt

SEQ ID NO: 306824 - DNA, 20 bp, Artificial
  CRISPR gRNA sequence
gtgtattgttcttataaaca

SEQ ID NO: 306825 - DNA, 20 bp, Artificial
  CRISPR gRNA sequence
tgtgcacatgtatctttttg

SEQ ID NO: 306826 - DNA, 20 bp, Artificial
  CRISPR gRNA sequence
cacatgtatctttttgtaga

SEQ ID NO: 306827 - DNA, 20 bp, Artificial
  CRISPR gRNA sequence
tagaatgaattcttaagaaa

SEQ ID NO: 306828 - DNA, 20 bp, Artificial
  CRISPR gRNA sequence
ccaaaaaggttgtaccaatt

SEQ ID NO: 306829 - DNA, 20 bp, Artificial
  CRISPR gRNA sequence
tcctaacactctcgcggaca

SEQ ID NO: 306830 - DNA, 20 bp, Artificial
  CRISPR gRNA sequence
gtgccaatcaaatgggcaaa

SEQ ID NO: 306831 - DNA, 20 bp, Artificial
  CRISPR gRNA sequence
ctttcttcaacaattactta

SEQ ID NO: 306832 - DNA, 20 bp, Artificial
  CRISPR gRNA sequence
ctgagctgggagagagagag

SEQ ID NO: 306833 - DNA, 20 bp, Artificial
  CRISPR gRNA sequence
gcctgttccatttccccaca

SEQ ID NO: 306834 - DNA, 20 bp, Artificial
  CRISPR gRNA sequence
gttccatttccccacataga

SEQ ID NO: 306835 - DNA, 20 bp, Artificial
  CRISPR gRNA sequence
atagagtgagtataccagtc

SEQ ID NO: 306836 - DNA, 20 bp, Artificial
  CRISPR gRNA sequence
aggtaatcagtgcagactta

SEQ ID NO: 306837 - DNA, 20 bp, Artificial
  CRISPR gRNA sequence
tctagcagttttatggacct

SEQ ID NO: 306838 - DNA, 20 bp, Artificial
  CRISPR gRNA sequence
ttttatggacctgggggtgg

SEQ ID NO: 306839 - DNA, 20 bp, Artificial
  CRISPR gRNA sequence
acctgggggtggaggaatcc

SEQ ID NO: 306840 - DNA, 20 bp, Artificial
  CRISPR gRNA sequence
tggaggaatccaagggtggg

SEQ ID NO: 306841 - DNA, 20 bp, Artificial
  CRISPR gRNA sequence
gaaaatgaggtgagagggct

SEQ ID NO: 306842 - DNA, 20 bp, Artificial
  CRISPR gRNA sequence
gagtggaaaagtacaaagta

SEQ ID NO: 306843 - DNA, 20 bp, Artificial
  CRISPR gRNA sequence
caaagtactgagttagcgtg

SEQ ID NO: 306844 - DNA, 20 bp, Artificial
  CRISPR gRNA sequence
ggaatagtgtctttagggct

SEQ ID NO: 306845 - DNA, 20 bp, Artificial
  CRISPR gRNA sequence
agtggaaaaaatactaggta

SEQ ID NO: 306846 - DNA, 20 bp, Artificial
  CRISPR gRNA sequence
aaaaatactaggtactgagt

SEQ ID NO: 306847 - DNA, 20 bp, Artificial
  CRISPR gRNA sequence
aaaacagtgtcttcaaggca

SEQ ID NO: 306848 - DNA, 20 bp, Artificial
  CRISPR gRNA sequence
gagtggaaaagtgctaggta

SEQ ID NO: 306849 - DNA, 20 bp, Artificial
  CRISPR gRNA sequence
aaaagtgctaggtactgagt

SEQ ID NO: 306850 - DNA, 20 bp, Artificial
  CRISPR gRNA sequence
agcctcagataaagagacct

SEQ ID NO: 306851 - DNA, 20 bp, Artificial
  CRISPR gRNA sequence
agataaagagacctaagaat

SEQ ID NO: 306852 - DNA, 20 bp, Artificial
  CRISPR gRNA sequence
atataagtcagcatgaggga

SEQ ID NO: 306853 - DNA, 20 bp, Artificial
  CRISPR gRNA sequence
agcatgagggacagaatgcc

SEQ ID NO: 306854 - DNA, 20 bp, Artificial
  CRISPR gRNA sequence
gcccaggatgctatcttcaa

SEQ ID NO: 306855 - DNA, 20 bp, Artificial
  CRISPR gRNA sequence
catgagaagaggacttgaga

SEQ ID NO: 306856 - DNA, 20 bp, Artificial
  CRISPR gRNA sequence
cagagtgtgtgatcttttgg

SEQ ID NO: 306857 - DNA, 20 bp, Artificial
  CRISPR gRNA sequence
agggaggcagtgtggctggg

SEQ ID NO: 306858 - DNA, 20 bp, Artificial
  CRISPR gRNA sequence
gtaaggccaggggaaggact

SEQ ID NO: 306859 - DNA, 20 bp, Artificial
  CRISPR gRNA sequence
tagttctcagtgtgagggga

SEQ ID NO: 306860 - DNA, 20 bp, Artificial
  CRISPR gRNA sequence
tcagtgtgaggggaagggat

SEQ ID NO: 306861 - DNA, 20 bp, Artificial
  CRISPR gRNA sequence
catcagaggcttctgaacag

SEQ ID NO: 306862 - DNA, 20 bp, Artificial
  CRISPR gRNA sequence
tgattggagctgtattttta

SEQ ID NO: 306863 - DNA, 20 bp, Artificial
  CRISPR gRNA sequence
gacaaggacggagcaggcag

SEQ ID NO: 306864 - DNA, 20 bp, Artificial
  CRISPR gRNA sequence
ctacccttttcttaacatat

SEQ ID NO: 306865 - DNA, 20 bp, Artificial
  CRISPR gRNA sequence
acacttgtgtagagcctctg

SEQ ID NO: 306866 - DNA, 20 bp, Artificial
  CRISPR gRNA sequence
tagagcctctgttgggtatt

SEQ ID NO: 306867 - DNA, 20 bp, Artificial
  CRISPR gRNA sequence
ttagatgattgtagacagaa

SEQ ID NO: 306868 - DNA, 20 bp, Artificial
  CRISPR gRNA sequence
caggggagcattccttgaga

SEQ ID NO: 306869 - DNA, 20 bp, Artificial
  CRISPR gRNA sequence
tagagacatccagcaggaag

SEQ ID NO: 306870 - DNA, 20 bp, Artificial
  CRISPR gRNA sequence
taggctggcaataagcacct

SEQ ID NO: 306871 - DNA, 20 bp, Artificial
  CRISPR gRNA sequence
tattagcttttacttgacag

SEQ ID NO: 306872 - DNA, 20 bp, Artificial
  CRISPR gRNA sequence
agaaaaaccaggaaagtatg

SEQ ID NO: 306873 - DNA, 20 bp, Artificial
  CRISPR gRNA sequence
actcaaggttaccaaaatta

SEQ ID NO: 306874 - DNA, 20 bp, Artificial
  CRISPR gRNA sequence
aaggaaatcagagattggga

SEQ ID NO: 306875 - DNA, 20 bp, Artificial
  CRISPR gRNA sequence
gcatttgacacagcggtcaa

SEQ ID NO: 306876 - DNA, 20 bp, Artificial
  CRISPR gRNA sequence
gtcaccaacaacctttgtca

SEQ ID NO: 306877 - DNA, 20 bp, Artificial
  CRISPR gRNA sequence
gggagtttcagtagagaggt

SEQ ID NO: 306878 - DNA, 20 bp, Artificial
  CRISPR gRNA sequence
agaggtgggggtgggaggct

SEQ ID NO: 306879 - DNA, 20 bp, Artificial
  CRISPR gRNA sequence
aattgctgcttactctttca

SEQ ID NO: 306880 - DNA, 20 bp, Artificial
  CRISPR gRNA sequence
aagtaatggaggtgaaccag

SEQ ID NO: 306881 - DNA, 20 bp, Artificial
  CRISPR gRNA sequence
ccaggtgaatagcctggagg

SEQ ID NO: 306882 - DNA, 20 bp, Artificial
  CRISPR gRNA sequence
gagacaggacactgcagatt

SEQ ID NO: 306883 - DNA, 20 bp, Artificial
  CRISPR gRNA sequence
aatgtcaccagtccgcacaa

SEQ ID NO: 306884 - DNA, 20 bp, Artificial
  CRISPR gRNA sequence
acagatatgtagaccaaaag

SEQ ID NO: 306885 - DNA, 20 bp, Artificial
  CRISPR gRNA sequence
gaccaaaagtagagtgtccc

SEQ ID NO: 306886 - DNA, 20 bp, Artificial
  CRISPR gRNA sequence
ggtaaattttatagagacaa

SEQ ID NO: 306887 - DNA, 20 bp, Artificial
  CRISPR gRNA sequence
tgtttattgaagttgtggaa

SEQ ID NO: 306888 - DNA, 20 bp, Artificial
  CRISPR gRNA sequence
agagcatttccattatcact

SEQ ID NO: 306889 - DNA, 20 bp, Artificial
  CRISPR gRNA sequence
ttgtggaaaacactgcacta

SEQ ID NO: 306890 - DNA, 20 bp, Artificial
  CRISPR gRNA sequence
aaaacactgcactacagggt

SEQ ID NO: 306891 - DNA, 20 bp, Artificial
  CRISPR gRNA sequence
agttgaacaacagttgtaga

SEQ ID NO: 306892 - DNA, 20 bp, Artificial
  CRISPR gRNA sequence
ggagtaagcaagagcaaaac

SEQ ID NO: 306893 - DNA, 20 bp, Artificial
  CRISPR gRNA sequence
taagcaagagcaaaacctgg

SEQ ID NO: 306894 - DNA, 20 bp, Artificial
  CRISPR gRNA sequence
ctgctccaggtgaaaagttt

SEQ ID NO: 306895 - DNA, 20 bp, Artificial
  CRISPR gRNA sequence
ggcagctgctgaaatagtct

SEQ ID NO: 306896 - DNA, 20 bp, Artificial
  CRISPR gRNA sequence
agtctgcgggtgtagacctg

SEQ ID NO: 306897 - DNA, 20 bp, Artificial
  CRISPR gRNA sequence
gctggagcaagtggcttcct

SEQ ID NO: 306898 - DNA, 20 bp, Artificial
  CRISPR gRNA sequence
ctcagggaaacagtcaatga

SEQ ID NO: 306899 - DNA, 20 bp, Artificial
  CRISPR gRNA sequence
tgaaggggttaaagatgtgg

SEQ ID NO: 306900 - DNA, 20 bp, Artificial
  CRISPR gRNA sequence
agtttccttgtagtaagtaa

SEQ ID NO: 306901 - DNA, 20 bp, Artificial
  CRISPR gRNA sequence
ggaggaagtttagtaaaaga

SEQ ID NO: 306902 - DNA, 20 bp, Artificial
  CRISPR gRNA sequence
aacatataagatatgcattt

SEQ ID NO: 306903 - DNA, 20 bp, Artificial
  CRISPR gRNA sequence
agggaacactgaagtcccag

SEQ ID NO: 306904 - DNA, 20 bp, Artificial
  CRISPR gRNA sequence
aggctagcaaattacagttt

SEQ ID NO: 306905 - DNA, 20 bp, Artificial
  CRISPR gRNA sequence
tttgagtggcattccaacag

SEQ ID NO: 306906 - DNA, 20 bp, Artificial
  CRISPR gRNA sequence
ctgattacgaaggcatctag

SEQ ID NO: 306907 - DNA, 20 bp, Artificial
  CRISPR gRNA sequence
tctcaatgcttacccaccta

SEQ ID NO: 306908 - DNA, 20 bp, Artificial
  CRISPR gRNA sequence
ttgctaggtggcttgaggtc

SEQ ID NO: 306909 - DNA, 20 bp, Artificial
  CRISPR gRNA sequence
tttccccatttagtcagaga

SEQ ID NO: 306910 - DNA, 20 bp, Artificial
  CRISPR gRNA sequence
cagtggttggtgaggtgcta

SEQ ID NO: 306911 - DNA, 20 bp, Artificial
  CRISPR gRNA sequence
aaaatactttcagttccact

SEQ ID NO: 306912 - DNA, 20 bp, Artificial
  CRISPR gRNA sequence
tactttcagttccactcaga

SEQ ID NO: 306913 - DNA, 20 bp, Artificial
  CRISPR gRNA sequence
tccaccccatggggaggaga

SEQ ID NO: 306914 - DNA, 20 bp, Artificial
  CRISPR gRNA sequence
ggaggagagggagtctgagg

SEQ ID NO: 306915 - DNA, 20 bp, Artificial
  CRISPR gRNA sequence
gagagggagtctgaggaggg

SEQ ID NO: 306916 - DNA, 20 bp, Artificial
  CRISPR gRNA sequence
ctcttgttaaaatggaggtt

SEQ ID NO: 306917 - DNA, 20 bp, Artificial
  CRISPR gRNA sequence
aggttctgaatcagtaagtc

SEQ ID NO: 306918 - DNA, 20 bp, Artificial
  CRISPR gRNA sequence
cagaccagcccacatgtgac

SEQ ID NO: 306919 - DNA, 20 bp, Artificial
  CRISPR gRNA sequence
ggtgaagaagggagcactcg

SEQ ID NO: 306920 - DNA, 20 bp, Artificial
  CRISPR gRNA sequence
taatctttgggagaaggggc

SEQ ID NO: 306921 - DNA, 20 bp, Artificial
  CRISPR gRNA sequence
ggagaaggggcctgggtcag

SEQ ID NO: 306922 - DNA, 20 bp, Artificial
  CRISPR gRNA sequence
cagcggagttagactggtct

SEQ ID NO: 306923 - DNA, 20 bp, Artificial
  CRISPR gRNA sequence
tagactggtctgtgagtgga

SEQ ID NO: 306924 - DNA, 20 bp, Artificial
  CRISPR gRNA sequence
ctggtctgtgagtggacaga

SEQ ID NO: 306925 - DNA, 20 bp, Artificial
  CRISPR gRNA sequence
ccagaaggcacaactgacag

SEQ ID NO: 306926 - DNA, 20 bp, Artificial
  CRISPR gRNA sequence
taacattgactgttaattgg

SEQ ID NO: 306927 - DNA, 20 bp, Artificial
  CRISPR gRNA sequence
ttaggtctccctttcactgt

SEQ ID NO: 306928 - DNA, 20 bp, Artificial
  CRISPR gRNA sequence
tttatacctcaagtacttca

SEQ ID NO: 306929 - DNA, 20 bp, Artificial
  CRISPR gRNA sequence
aagtacttcacagggtccta

SEQ ID NO: 306930 - DNA, 20 bp, Artificial
  CRISPR gRNA sequence
tgcctgctgtctgcttccct

SEQ ID NO: 306931 - DNA, 20 bp, Artificial
  CRISPR gRNA sequence
aacatgccttcacataaatc

SEQ ID NO: 306932 - DNA, 20 bp, Artificial
  CRISPR gRNA sequence
gatcattcacatttaagtag

SEQ ID NO: 306933 - DNA, 20 bp, Artificial
  CRISPR gRNA sequence
tctatggttgtaaaattgtc

SEQ ID NO: 306934 - DNA, 20 bp, Artificial
  CRISPR gRNA sequence
agcagcaagtttgtggtgcc

SEQ ID NO: 306935 - DNA, 20 bp, Artificial
  CRISPR gRNA sequence
agttctgtaaagggagctat

SEQ ID NO: 306936 - DNA, 20 bp, Artificial
  CRISPR gRNA sequence
cttttcaccatagcagacca

SEQ ID NO: 306937 - DNA, 20 bp, Artificial
  CRISPR gRNA sequence
catagcagaccaaggaatat

SEQ ID NO: 306938 - DNA, 20 bp, Artificial
  CRISPR gRNA sequence
aggttataggaaggtaactg

SEQ ID NO: 306939 - DNA, 20 bp, Artificial
  CRISPR gRNA sequence
tataggaaggtaactggtgg

SEQ ID NO: 306940 - DNA, 20 bp, Artificial
  CRISPR gRNA sequence
ggaaggtaactggtgggtga

SEQ ID NO: 306941 - DNA, 20 bp, Artificial
  CRISPR gRNA sequence
gattactgataagatagtat

SEQ ID NO: 306942 - DNA, 20 bp, Artificial
  CRISPR gRNA sequence
caaactctcaaaaccaaagc

SEQ ID NO: 306943 - DNA, 20 bp, Artificial
  CRISPR gRNA sequence
aggaccaggaaaacttggtt

SEQ ID NO: 306944 - DNA, 20 bp, Artificial
  CRISPR gRNA sequence
atccatcacaaaaagcccac

SEQ ID NO: 306945 - DNA, 20 bp, Artificial
  CRISPR gRNA sequence
gaatgattcgcatccaccag

SEQ ID NO: 306946 - DNA, 20 bp, Artificial
  CRISPR gRNA sequence
cttctcagatgagactgcaa

SEQ ID NO: 306947 - DNA, 20 bp, Artificial
  CRISPR gRNA sequence
tgaggggcccaggggaaaag

SEQ ID NO: 306948 - DNA, 20 bp, Artificial
  CRISPR gRNA sequence
ttctgggaagtgcatttgaa

SEQ ID NO: 306949 - DNA, 20 bp, Artificial
  CRISPR gRNA sequence
aagtgcatttgaagggagtg

SEQ ID NO: 306950 - DNA, 20 bp, Artificial
  CRISPR gRNA sequence
ttgaagggagtgtagagtct

SEQ ID NO: 306951 - DNA, 20 bp, Artificial
  CRISPR gRNA sequence
ctttttatagtctgcttctg

SEQ ID NO: 306952 - DNA, 20 bp, Artificial
  CRISPR gRNA sequence
aattacctatagtaaaaacc

SEQ ID NO: 306953 - DNA, 20 bp, Artificial
  CRISPR gRNA sequence
gtcttacattcattttttcc

SEQ ID NO: 306954 - DNA, 20 bp, Artificial
  CRISPR gRNA sequence
aaagcggacagctgacacat

SEQ ID NO: 306955 - DNA, 20 bp, Artificial
  CRISPR gRNA sequence
cagcctcctctaggttgctt

SEQ ID NO: 306956 - DNA, 20 bp, Artificial
  CRISPR gRNA sequence
tccctcaggctgtcccttca

SEQ ID NO: 306957 - DNA, 20 bp, Artificial
  CRISPR gRNA sequence
gagcttgtccctttttattg

SEQ ID NO: 306958 - DNA, 20 bp, Artificial
  CRISPR gRNA sequence
attcaactcagtaaaagaca

SEQ ID NO: 306959 - DNA, 20 bp, Artificial
  CRISPR gRNA sequence
gtttctggtttggggctctt

SEQ ID NO: 306960 - DNA, 20 bp, Artificial
  CRISPR gRNA sequence
aatacccaggtgtggtatta

SEQ ID NO: 306961 - DNA, 20 bp, Artificial
  CRISPR gRNA sequence
caacacctattctaaaacca

SEQ ID NO: 306962 - DNA, 20 bp, Artificial
  CRISPR gRNA sequence
aacagaagcaaaagtaaaaa

SEQ ID NO: 306963 - DNA, 20 bp, Artificial
  CRISPR gRNA sequence
aaactaggctgcagggcttt

SEQ ID NO: 306964 - DNA, 20 bp, Artificial
  CRISPR gRNA sequence
caaatgacagaccttttagt

SEQ ID NO: 306965 - DNA, 20 bp, Artificial
  CRISPR gRNA sequence
ctagtaactataaaagaaca

SEQ ID NO: 306966 - DNA, 20 bp, Artificial
  CRISPR gRNA sequence
tcctgaacagccagaaaagt

SEQ ID NO: 306967 - DNA, 20 bp, Artificial
  CRISPR gRNA sequence
tgtatttttccctaaaatag

SEQ ID NO: 306968 - DNA, 20 bp, Artificial
  CRISPR gRNA sequence
gctggatttggccttcttct

SEQ ID NO: 306969 - DNA, 20 bp, Artificial
  CRISPR gRNA sequence
tcatgccaaaaatcagtgtt

SEQ ID NO: 306970 - DNA, 20 bp, Artificial
  CRISPR gRNA sequence
aaaaatcagtgttctgaatt

SEQ ID NO: 306971 - DNA, 20 bp, Artificial
  CRISPR gRNA sequence
ctcacttaccacaatcctgc

SEQ ID NO: 306972 - DNA, 20 bp, Artificial
  CRISPR gRNA sequence
gctctcttagtctggggagc

SEQ ID NO: 306973 - DNA, 20 bp, Artificial
  CRISPR gRNA sequence
cccatgggacacctgggccc

SEQ ID NO: 306974 - DNA, 20 bp, Artificial
  CRISPR gRNA sequence
ttagagagcacccctttgat

SEQ ID NO: 306975 - DNA, 20 bp, Artificial
  CRISPR gRNA sequence
tgtggcactcaccttgggct

SEQ ID NO: 306976 - DNA, 20 bp, Artificial
  CRISPR gRNA sequence
gttacccagaacctaagaag

SEQ ID NO: 306977 - DNA, 20 bp, Artificial
  CRISPR gRNA sequence
tgagtgttttgctaagaacc

SEQ ID NO: 306978 - DNA, 20 bp, Artificial
  CRISPR gRNA sequence
aagaaccaagaattcaacta

SEQ ID NO: 306979 - DNA, 20 bp, Artificial
  CRISPR gRNA sequence
atggaggtctcctgcttctc

SEQ ID NO: 306980 - DNA, 20 bp, Artificial
  CRISPR gRNA sequence
cctgcttctcctgagtgatg

SEQ ID NO: 306981 - DNA, 20 bp, Artificial
  CRISPR gRNA sequence
ctcagtctcttggtttacct

SEQ ID NO: 306982 - DNA, 20 bp, Artificial
  CRISPR gRNA sequence
tcttggtttacctttggatg

SEQ ID NO: 306983 - DNA, 20 bp, Artificial
  CRISPR gRNA sequence
gaagttttgatttaaaaata

SEQ ID NO: 306984 - DNA, 20 bp, Artificial
  CRISPR gRNA sequence
aatacaggattcctccaggc

SEQ ID NO: 306985 - DNA, 20 bp, Artificial
  CRISPR gRNA sequence
acatacaaatgatatttatt

SEQ ID NO: 306986 - DNA, 20 bp, Artificial
  CRISPR gRNA sequence
tttgggacattattggtcac

SEQ ID NO: 306987 - DNA, 20 bp, Artificial
  CRISPR gRNA sequence
tgcccttgaggaccttccaa

SEQ ID NO: 306988 - DNA, 20 bp, Artificial
  CRISPR gRNA sequence
taatgtgcacacatgaaaaa

SEQ ID NO: 306989 - DNA, 20 bp, Artificial
  CRISPR gRNA sequence
aaaactggatttttaaaagg

SEQ ID NO: 306990 - DNA, 20 bp, Artificial
  CRISPR gRNA sequence
ggatttttaaaaggttgaat

SEQ ID NO: 306991 - DNA, 20 bp, Artificial
  CRISPR gRNA sequence
cagaggtaggcaagatccct

SEQ ID NO: 306992 - DNA, 20 bp, Artificial
  CRISPR gRNA sequence
ggcaagatccctgagggtca

SEQ ID NO: 306993 - DNA, 20 bp, Artificial
  CRISPR gRNA sequence
agggaatggttcctaaagga

SEQ ID NO: 306994 - DNA, 20 bp, Artificial
  CRISPR gRNA sequence
taacatgtaaaataaattat

SEQ ID NO: 306995 - DNA, 20 bp, Artificial
  CRISPR gRNA sequence
ggtgaggaggggagggcatt

SEQ ID NO: 306996 - DNA, 20 bp, Artificial
  CRISPR gRNA sequence
aagcaggtgagaggaccaca

SEQ ID NO: 306997 - DNA, 20 bp, Artificial
  CRISPR gRNA sequence
gggacaagttcagtggagga

SEQ ID NO: 306998 - DNA, 20 bp, Artificial
  CRISPR gRNA sequence
gtaactgcaagattccctcc

SEQ ID NO: 306999 - DNA, 20 bp, Artificial
  CRISPR gRNA sequence
attcagacacttcagcctct

SEQ ID NO: 307000 - DNA, 20 bp, Artificial
  CRISPR gRNA sequence
ggaagatggggcttgcctct

SEQ ID NO: 307001 - DNA, 20 bp, Artificial
  CRISPR gRNA sequence
gatcagagataggttagacc

SEQ ID NO: 307002 - DNA, 20 bp, Artificial
  CRISPR gRNA sequence
aacccctaaccccctttact

SEQ ID NO: 307003 - DNA, 20 bp, Artificial
  CRISPR gRNA sequence
gagtgccaaactggctcaag

SEQ ID NO: 307004 - DNA, 20 bp, Artificial
  CRISPR gRNA sequence
tagactgggacagactcaaa

SEQ ID NO: 307005 - DNA, 20 bp, Artificial
  CRISPR gRNA sequence
gtcctaattttcctgaaatt

SEQ ID NO: 307006 - DNA, 20 bp, Artificial
  CRISPR gRNA sequence
ttccaactccccagaaactt

SEQ ID NO: 307007 - DNA, 20 bp, Artificial
  CRISPR gRNA sequence
ctggagattatagtggacag

SEQ ID NO: 307008 - DNA, 20 bp, Artificial
  CRISPR gRNA sequence
gaactgactgcagagggggg

SEQ ID NO: 307009 - DNA, 20 bp, Artificial
  CRISPR gRNA sequence
cagacacctcacccagattc

SEQ ID NO: 307010 - DNA, 20 bp, Artificial
  CRISPR gRNA sequence
actttctatggcctcctatt

SEQ ID NO: 307011 - DNA, 20 bp, Artificial
  CRISPR gRNA sequence
cctcccccagaccacattcc

SEQ ID NO: 307012 - DNA, 20 bp, Artificial
  CRISPR gRNA sequence
tcgcaactcttataaatgtg

SEQ ID NO: 307013 - DNA, 20 bp, Artificial
  CRISPR gRNA sequence
aactcttataaatgtggtga

SEQ ID NO: 307014 - DNA, 20 bp, Artificial
  CRISPR gRNA sequence
tgggaaaaaaggttttccct

SEQ ID NO: 307015 - DNA, 20 bp, Artificial
  CRISPR gRNA sequence
ggacctggtggtgtttaagc

SEQ ID NO: 307016 - DNA, 20 bp, Artificial
  CRISPR gRNA sequence
gatatttgctaaatgaccac

SEQ ID NO: 307017 - DNA, 20 bp, Artificial
  CRISPR gRNA sequence
tttcttatgaaataagttag

SEQ ID NO: 307018 - DNA, 20 bp, Artificial
  CRISPR gRNA sequence
tctatgttgttttccataat

SEQ ID NO: 307019 - DNA, 20 bp, Artificial
  CRISPR gRNA sequence
tccataattaggattatcat

SEQ ID NO: 307020 - DNA, 20 bp, Artificial
  CRISPR gRNA sequence
taagggttatttttcacaat

SEQ ID NO: 307021 - DNA, 20 bp, Artificial
  CRISPR gRNA sequence
gctgcaagatattccctttt

SEQ ID NO: 307022 - DNA, 20 bp, Artificial
  CRISPR gRNA sequence
caacctcattttttggacac

SEQ ID NO: 307023 - DNA, 20 bp, Artificial
  CRISPR gRNA sequence
cttatggtagaaagcacaag

SEQ ID NO: 307024 - DNA, 20 bp, Artificial
  CRISPR gRNA sequence
aaaatctaactagaaaatag

SEQ ID NO: 307025 - DNA, 20 bp, Artificial
  CRISPR gRNA sequence
aagaaattggggagcaacga

SEQ ID NO: 307026 - DNA, 20 bp, Artificial
  CRISPR gRNA sequence
ccattcaaactgccaatgta

SEQ ID NO: 307027 - DNA, 20 bp, Artificial
  CRISPR gRNA sequence
aggctttgacttttcaaggt

SEQ ID NO: 307028 - DNA, 20 bp, Artificial
  CRISPR gRNA sequence
gaagaagtgacttacatctt

SEQ ID NO: 307029 - DNA, 20 bp, Artificial
  CRISPR gRNA sequence
tgctagatttttcttcacat

SEQ ID NO: 307030 - DNA, 20 bp, Artificial
  CRISPR gRNA sequence
agcttacaaatgaaacaaag

SEQ ID NO: 307031 - DNA, 20 bp, Artificial
  CRISPR gRNA sequence
aagggttggagaaaaagatt

SEQ ID NO: 307032 - DNA, 20 bp, Artificial
  CRISPR gRNA sequence
gactagataggggagataaa

SEQ ID NO: 307033 - DNA, 20 bp, Artificial
  CRISPR gRNA sequence
gatgagatggtcagattggg

SEQ ID NO: 307034 - DNA, 20 bp, Artificial
  CRISPR gRNA sequence
gtggcacatacatgacccct

SEQ ID NO: 307035 - DNA, 20 bp, Artificial
  CRISPR gRNA sequence
tgacccctaagaatgtaatg

SEQ ID NO: 307036 - DNA, 20 bp, Artificial
  CRISPR gRNA sequence
tcagacagtcatccatgcca

SEQ ID NO: 307037 - DNA, 20 bp, Artificial
  CRISPR gRNA sequence
gatatgatatatttgtaaat

SEQ ID NO: 307038 - DNA, 20 bp, Artificial
  CRISPR gRNA sequence
gcaatatctgccattgcttt

SEQ ID NO: 307039 - DNA, 20 bp, Artificial
  CRISPR gRNA sequence
cttgagatggtgagattaac

SEQ ID NO: 307040 - DNA, 20 bp, Artificial
  CRISPR gRNA sequence
ggtgggcccaatgtaatcac

SEQ ID NO: 307041 - DNA, 20 bp, Artificial
  CRISPR gRNA sequence
gtcagagaacctttcctagc

SEQ ID NO: 307042 - DNA, 20 bp, Artificial
  CRISPR gRNA sequence
aaggaggaagccatgagcca

SEQ ID NO: 307043 - DNA, 20 bp, Artificial
  CRISPR gRNA sequence
cagccagccattaaggaaat

SEQ ID NO: 307044 - DNA, 20 bp, Artificial
  CRISPR gRNA sequence
agttctgcaactataaggag

SEQ ID NO: 307045 - DNA, 20 bp, Artificial
  CRISPR gRNA sequence
caagcttactgataactggt

SEQ ID NO: 307046 - DNA, 20 bp, Artificial
  CRISPR gRNA sequence
acccagtttaggctgtttaa

SEQ ID NO: 307047 - DNA, 20 bp, Artificial
  CRISPR gRNA sequence
aaatagggcagataaggcat

SEQ ID NO: 307048 - DNA, 20 bp, Artificial
  CRISPR gRNA sequence
aggcatgagaatttataact

SEQ ID NO: 307049 - DNA, 20 bp, Artificial
  CRISPR gRNA sequence
ctgaaattttacttcctcat

SEQ ID NO: 307050 - DNA, 20 bp, Artificial
  CRISPR gRNA sequence
tgcctccctagaacaaacct

SEQ ID NO: 307051 - DNA, 20 bp, Artificial
  CRISPR gRNA sequence
ctaggagtctcagctgtttc

SEQ ID NO: 307052 - DNA, 20 bp, Artificial
  CRISPR gRNA sequence
gcctcactctgtcaccaggc

SEQ ID NO: 307053 - DNA, 20 bp, Artificial
  CRISPR gRNA sequence
tttttgtattttcagtagag

SEQ ID NO: 307054 - DNA, 20 bp, Artificial
  CRISPR gRNA sequence
tgggttttcaccatgttggc

SEQ ID NO: 307055 - DNA, 20 bp, Artificial
  CRISPR gRNA sequence
cacatttccccttcaaaatg

SEQ ID NO: 307056 - DNA, 20 bp, Artificial
  CRISPR gRNA sequence
tgtaagcaaatttaaaagtt

SEQ ID NO: 307057 - DNA, 20 bp, Artificial
  CRISPR gRNA sequence
gatatggtgactattttgtc

SEQ ID NO: 307058 - DNA, 20 bp, Artificial
  CRISPR gRNA sequence
ctattttgtcatgggtataa

SEQ ID NO: 307059 - DNA, 20 bp, Artificial
  CRISPR gRNA sequence
ttctttttcaaaatttttat

SEQ ID NO: 307060 - DNA, 20 bp, Artificial
  CRISPR gRNA sequence
actaggtggtttttggttac

SEQ ID NO: 307061 - DNA, 20 bp, Artificial
  CRISPR gRNA sequence
cacccctcccactctttcct

SEQ ID NO: 307062 - DNA, 20 bp, Artificial
  CRISPR gRNA sequence
caatatttgtttctccattc

SEQ ID NO: 307063 - DNA, 20 bp, Artificial
  CRISPR gRNA sequence
cattcttgagttacttcact

SEQ ID NO: 307064 - DNA, 20 bp, Artificial
  CRISPR gRNA sequence
tattttgtttctttttatgg

SEQ ID NO: 307065 - DNA, 20 bp, Artificial
  CRISPR gRNA sequence
tggctgagtaatattccatg

SEQ ID NO: 307066 - DNA, 20 bp, Artificial
  CRISPR gRNA sequence
cacattttccttatccactc

SEQ ID NO: 307067 - DNA, 20 bp, Artificial
  CRISPR gRNA sequence
ttaggttggttccttatttt

SEQ ID NO: 307068 - DNA, 20 bp, Artificial
  CRISPR gRNA sequence
gcatgtgtctttttcatata

SEQ ID NO: 307069 - DNA, 20 bp, Artificial
  CRISPR gRNA sequence
atataatgaattattttcct

SEQ ID NO: 307070 - DNA, 20 bp, Artificial
  CRISPR gRNA sequence
tttgggtatatacccagtag

SEQ ID NO: 307071 - DNA, 20 bp, Artificial
  CRISPR gRNA sequence
tatacccagtagtaggattg

SEQ ID NO: 307072 - DNA, 20 bp, Artificial
  CRISPR gRNA sequence
aggattgctgaattaaatag

SEQ ID NO: 307073 - DNA, 20 bp, Artificial
  CRISPR gRNA sequence
gttctacttttagttcttta

SEQ ID NO: 307074 - DNA, 20 bp, Artificial
  CRISPR gRNA sequence
ttaataatggccattcttgc

SEQ ID NO: 307075 - DNA, 20 bp, Artificial
  CRISPR gRNA sequence
ccatttgtatattttctttt

SEQ ID NO: 307076 - DNA, 20 bp, Artificial
  CRISPR gRNA sequence
aaatatctgaagagctacca

SEQ ID NO: 307077 - DNA, 20 bp, Artificial
  CRISPR gRNA sequence
tgactctgaagggcatctct

SEQ ID NO: 307078 - DNA, 20 bp, Artificial
  CRISPR gRNA sequence
tctatgaatgaaggttatga

SEQ ID NO: 307079 - DNA, 20 bp, Artificial
  CRISPR gRNA sequence
gaaggttatgagagggtata

SEQ ID NO: 307080 - DNA, 20 bp, Artificial
  CRISPR gRNA sequence
attaaaaggtcttttaggcc

SEQ ID NO: 307081 - DNA, 20 bp, Artificial
  CRISPR gRNA sequence
caggcagatcaccttagatc

SEQ ID NO: 307082 - DNA, 20 bp, Artificial
  CRISPR gRNA sequence
actaaacatacaaaaattag

SEQ ID NO: 307083 - DNA, 20 bp, Artificial
  CRISPR gRNA sequence
tacttgggaggctgagagag

SEQ ID NO: 307084 - DNA, 20 bp, Artificial
  CRISPR gRNA sequence
tcacaccactgcactccagc

SEQ ID NO: 307085 - DNA, 20 bp, Artificial
  CRISPR gRNA sequence
gacttctgcttcctccaaca

SEQ ID NO: 307086 - DNA, 20 bp, Artificial
  CRISPR gRNA sequence
aacaaaggattaactgctat

SEQ ID NO: 307087 - DNA, 20 bp, Artificial
  CRISPR gRNA sequence
gaaacaactgttttcagaga

SEQ ID NO: 307088 - DNA, 20 bp, Artificial
  CRISPR gRNA sequence
acagcagaaaactgtagtcc

SEQ ID NO: 307089 - DNA, 20 bp, Artificial
  CRISPR gRNA sequence
tataatacatcatgatcaag

SEQ ID NO: 307090 - DNA, 20 bp, Artificial
  CRISPR gRNA sequence
aaaaacatatgatcatgtca

SEQ ID NO: 307091 - DNA, 20 bp, Artificial
  CRISPR gRNA sequence
agaaaagctctcataaaaat

SEQ ID NO: 307092 - DNA, 20 bp, Artificial
  CRISPR gRNA sequence
attgcttttaccttaagatg

SEQ ID NO: 307093 - DNA, 20 bp, Artificial
  CRISPR gRNA sequence
cttaagatggcgaatgtggg

SEQ ID NO: 307094 - DNA, 20 bp, Artificial
  CRISPR gRNA sequence
catgcttgtagaaaatcctg

SEQ ID NO: 307095 - DNA, 20 bp, Artificial
  CRISPR gRNA sequence
aaacctattaaaactgataa

SEQ ID NO: 307096 - DNA, 20 bp, Artificial
  CRISPR gRNA sequence
aagtgagtgtagcaaagaca

SEQ ID NO: 307097 - DNA, 20 bp, Artificial
  CRISPR gRNA sequence
tggagacataggccatgttt

SEQ ID NO: 307098 - DNA, 20 bp, Artificial
  CRISPR gRNA sequence
cattctctccaagttgatct

SEQ ID NO: 307099 - DNA, 20 bp, Artificial
  CRISPR gRNA sequence
aaaagttatagggaaatgca

SEQ ID NO: 307100 - DNA, 20 bp, Artificial
  CRISPR gRNA sequence
tactctggaggctgaggcag

SEQ ID NO: 307101 - DNA, 20 bp, Artificial
  CRISPR gRNA sequence
tgcactccagcctgggcaac

SEQ ID NO: 307102 - DNA, 20 bp, Artificial
  CRISPR gRNA sequence
tcagtcaatggaacaaaata

SEQ ID NO: 307103 - DNA, 20 bp, Artificial
  CRISPR gRNA sequence
ccaaggtaattccatgcaga

SEQ ID NO: 307104 - DNA, 20 bp, Artificial
  CRISPR gRNA sequence
cacaaagtaacttatatatt

SEQ ID NO: 307105 - DNA, 20 bp, Artificial
  CRISPR gRNA sequence
ccatatcataaaaagataaa

SEQ ID NO: 307106 - DNA, 20 bp, Artificial
  CRISPR gRNA sequence
agataccactgcacaccctc

SEQ ID NO: 307107 - DNA, 20 bp, Artificial
  CRISPR gRNA sequence
gataaacatcaagtgttgga

SEQ ID NO: 307108 - DNA, 20 bp, Artificial
  CRISPR gRNA sequence
aatactgcaaagctatagaa

SEQ ID NO: 307109 - DNA, 20 bp, Artificial
  CRISPR gRNA sequence
tgaaacaatccaggcacaag

SEQ ID NO: 307110 - DNA, 20 bp, Artificial
  CRISPR gRNA sequence
agtagattcatggttatcca

SEQ ID NO: 307111 - DNA, 20 bp, Artificial
  CRISPR gRNA sequence
ttatccatgggatgggggaa

SEQ ID NO: 307112 - DNA, 20 bp, Artificial
  CRISPR gRNA sequence
aaactctaaactgaaaatga

SEQ ID NO: 307113 - DNA, 20 bp, Artificial
  CRISPR gRNA sequence
aacagatggttttcggttac

SEQ ID NO: 307114 - DNA, 20 bp, Artificial
  CRISPR gRNA sequence
gatggttttcggttacatgg

SEQ ID NO: 307115 - DNA, 20 bp, Artificial
  CRISPR gRNA sequence
tccagtgacaggaagtgttc

SEQ ID NO: 307116 - DNA, 20 bp, Artificial
  CRISPR gRNA sequence
aatgctctatttagtaaaga

SEQ ID NO: 307117 - DNA, 20 bp, Artificial
  CRISPR gRNA sequence
caaaaccatcagaggtattg

SEQ ID NO: 307118 - DNA, 20 bp, Artificial
  CRISPR gRNA sequence
accatcagaggtattgttga

SEQ ID NO: 307119 - DNA, 20 bp, Artificial
  CRISPR gRNA sequence
cacccaggttagcaacctgt

SEQ ID NO: 307120 - DNA, 20 bp, Artificial
  CRISPR gRNA sequence
tataaaccttgctttcagaa

SEQ ID NO: 307121 - DNA, 20 bp, Artificial
  CRISPR gRNA sequence
aatggtattttttggttagc

SEQ ID NO: 307122 - DNA, 20 bp, Artificial
  CRISPR gRNA sequence
gaaaaatctatttccagtgt

SEQ ID NO: 307123 - DNA, 20 bp, Artificial
  CRISPR gRNA sequence
aaagggaaggcatatacttt

SEQ ID NO: 307124 - DNA, 20 bp, Artificial
  CRISPR gRNA sequence
tccccctgaaattgcatcat

SEQ ID NO: 307125 - DNA, 20 bp, Artificial
  CRISPR gRNA sequence
tccttcttttggtatctagg

SEQ ID NO: 307126 - DNA, 20 bp, Artificial
  CRISPR gRNA sequence
ccaacacaatggagagggaa

SEQ ID NO: 307127 - DNA, 20 bp, Artificial
  CRISPR gRNA sequence
tgagagagaggtataatccc

SEQ ID NO: 307128 - DNA, 20 bp, Artificial
  CRISPR gRNA sequence
atccccagagtgcctgttac

SEQ ID NO: 307129 - DNA, 20 bp, Artificial
  CRISPR gRNA sequence
tggaagaaaataacctgata

SEQ ID NO: 307130 - DNA, 20 bp, Artificial
  CRISPR gRNA sequence
aataacctgataatggatga

SEQ ID NO: 307131 - DNA, 20 bp, Artificial
  CRISPR gRNA sequence
tagtgggcatcctacatgtg

SEQ ID NO: 307132 - DNA, 20 bp, Artificial
  CRISPR gRNA sequence
gggcatcctacatgtgtgga

SEQ ID NO: 307133 - DNA, 20 bp, Artificial
  CRISPR gRNA sequence
aatgaataaatgaagaagtg

SEQ ID NO: 307134 - DNA, 20 bp, Artificial
  CRISPR gRNA sequence
tcaacttgttacagtgtcat

SEQ ID NO: 307135 - DNA, 20 bp, Artificial
  CRISPR gRNA sequence
aggttctcaataaatgttga

SEQ ID NO: 307136 - DNA, 20 bp, Artificial
  CRISPR gRNA sequence
gaaagaatgattgatgcatg

SEQ ID NO: 307137 - DNA, 20 bp, Artificial
  CRISPR gRNA sequence
tcctgagaaattaagctctc

SEQ ID NO: 307138 - DNA, 20 bp, Artificial
  CRISPR gRNA sequence
aggctctgactgcataccca

SEQ ID NO: 307139 - DNA, 20 bp, Artificial
  CRISPR gRNA sequence
cacaagcctggtttcagaga

SEQ ID NO: 307140 - DNA, 20 bp, Artificial
  CRISPR gRNA sequence
agagatagggtcataacccc

SEQ ID NO: 307141 - DNA, 20 bp, Artificial
  CRISPR gRNA sequence
cccagggtgcagagacaacc

SEQ ID NO: 307142 - DNA, 20 bp, Artificial
  CRISPR gRNA sequence
ggcacccttggacaatgaga

SEQ ID NO: 307143 - DNA, 20 bp, Artificial
  CRISPR gRNA sequence
ggaagggccaggcagaaata

SEQ ID NO: 307144 - DNA, 20 bp, Artificial
  CRISPR gRNA sequence
gtgatacatgtttttaatta

SEQ ID NO: 307145 - DNA, 20 bp, Artificial
  CRISPR gRNA sequence
gaaggcaaaaagacattacc

SEQ ID NO: 307146 - DNA, 20 bp, Artificial
  CRISPR gRNA sequence
gctccaggactccctctaag

SEQ ID NO: 307147 - DNA, 20 bp, Artificial
  CRISPR gRNA sequence
aaaactgccttttatctgcc

SEQ ID NO: 307148 - DNA, 20 bp, Artificial
  CRISPR gRNA sequence
aattctaagctggtgcccca

SEQ ID NO: 307149 - DNA, 20 bp, Artificial
  CRISPR gRNA sequence
taaacaactacctcctcagt

SEQ ID NO: 307150 - DNA, 20 bp, Artificial
  CRISPR gRNA sequence
agaaaagtctacccctgcta

SEQ ID NO: 307151 - DNA, 20 bp, Artificial
  CRISPR gRNA sequence
aggagttctcatccctctgt

SEQ ID NO: 307152 - DNA, 20 bp, Artificial
  CRISPR gRNA sequence
cagtaaggaaaacggtggcc

SEQ ID NO: 307153 - DNA, 20 bp, Artificial
  CRISPR gRNA sequence
acaagccatagtggagagaa

SEQ ID NO: 307154 - DNA, 20 bp, Artificial
  CRISPR gRNA sequence
agtcttgaaacaagcaacag

SEQ ID NO: 307155 - DNA, 20 bp, Artificial
  CRISPR gRNA sequence
agtttccctggtggtcaggg

SEQ ID NO: 307156 - DNA, 20 bp, Artificial
  CRISPR gRNA sequence
tttggtgatacccaagttat

SEQ ID NO: 307157 - DNA, 20 bp, Artificial
  CRISPR gRNA sequence
gagagccatcaccttgataa

SEQ ID NO: 307158 - DNA, 20 bp, Artificial
  CRISPR gRNA sequence
gccatcaccttgataatggg

SEQ ID NO: 307159 - DNA, 20 bp, Artificial
  CRISPR gRNA sequence
tgagagaggaagagctgcaa

SEQ ID NO: 307160 - DNA, 20 bp, Artificial
  CRISPR gRNA sequence
ccagcatagggctagcaaat

SEQ ID NO: 307161 - DNA, 20 bp, Artificial
  CRISPR gRNA sequence
atagggctagcaaatttgag

SEQ ID NO: 307162 - DNA, 20 bp, Artificial
  CRISPR gRNA sequence
ttgaaaacctggctctaagg

SEQ ID NO: 307163 - DNA, 20 bp, Artificial
  CRISPR gRNA sequence
gctctaaggtgggatcacta

SEQ ID NO: 307164 - DNA, 20 bp, Artificial
  CRISPR gRNA sequence
tttattttatgtaaaccctc

SEQ ID NO: 307165 - DNA, 20 bp, Artificial
  CRISPR gRNA sequence
acattttctgctttggcttc

SEQ ID NO: 307166 - DNA, 20 bp, Artificial
  CRISPR gRNA sequence
gatgttccctgctctgtcct

SEQ ID NO: 307167 - DNA, 20 bp, Artificial
  CRISPR gRNA sequence
agcagggaacatcagaccac

SEQ ID NO: 307168 - DNA, 20 bp, Artificial
  CRISPR gRNA sequence
ggaacatcagaccacaaggg

SEQ ID NO: 307169 - DNA, 20 bp, Artificial
  CRISPR gRNA sequence
cagaaaatgtagacttttaa

SEQ ID NO: 307170 - DNA, 20 bp, Artificial
  CRISPR gRNA sequence
ttagaaactagccaggtgct

SEQ ID NO: 307171 - DNA, 20 bp, Artificial
  CRISPR gRNA sequence
gagtctaatcaaggcagggg

SEQ ID NO: 307172 - DNA, 20 bp, Artificial
  CRISPR gRNA sequence
caggggcagggtaaaaacat

SEQ ID NO: 307173 - DNA, 20 bp, Artificial
  CRISPR gRNA sequence
catggcagtctataaccctt

SEQ ID NO: 307174 - DNA, 20 bp, Artificial
  CRISPR gRNA sequence
tttttgtggctcaggctccc

SEQ ID NO: 307175 - DNA, 20 bp, Artificial
  CRISPR gRNA sequence
atctgtaggctaagtaagcc

SEQ ID NO: 307176 - DNA, 20 bp, Artificial
  CRISPR gRNA sequence
cagctcttcctctctcagcc

SEQ ID NO: 307177 - DNA, 20 bp, Artificial
  CRISPR gRNA sequence
gaagatgacatcccaataac

SEQ ID NO: 307178 - DNA, 20 bp, Artificial
  CRISPR gRNA sequence
cttgtttcaagacttgttga

SEQ ID NO: 307179 - DNA, 20 bp, Artificial
  CRISPR gRNA sequence
cagacatttcatgtatttct

SEQ ID NO: 307180 - DNA, 20 bp, Artificial
  CRISPR gRNA sequence
tttttctctctctctctctt

SEQ ID NO: 307181 - DNA, 20 bp, Artificial
  CRISPR gRNA sequence
agtcagttcttcaagagaaa

SEQ ID NO: 307182 - DNA, 20 bp, Artificial
  CRISPR gRNA sequence
gttctctccactatggcttg

SEQ ID NO: 307183 - DNA, 20 bp, Artificial
  CRISPR gRNA sequence
ttccttactgaccctgacag

SEQ ID NO: 307184 - DNA, 20 bp, Artificial
  CRISPR gRNA sequence
agggatgagaactccttagc

SEQ ID NO: 307185 - DNA, 20 bp, Artificial
  CRISPR gRNA sequence
aattcagtggggcaccagct

SEQ ID NO: 307186 - DNA, 20 bp, Artificial
  CRISPR gRNA sequence
acaatctatgaaattaagag

SEQ ID NO: 307187 - DNA, 20 bp, Artificial
  CRISPR gRNA sequence
gaagtgaaaagaagcagtaa

SEQ ID NO: 307188 - DNA, 20 bp, Artificial
  CRISPR gRNA sequence
cttggcatacggagcagagc

SEQ ID NO: 307189 - DNA, 20 bp, Artificial
  CRISPR gRNA sequence
gggaggctattccacttaga

SEQ ID NO: 307190 - DNA, 20 bp, Artificial
  CRISPR gRNA sequence
gcccaggaacttacaaagga

SEQ ID NO: 307191 - DNA, 20 bp, Artificial
  CRISPR gRNA sequence
caaaggaaagggtagaaaaa

SEQ ID NO: 307192 - DNA, 20 bp, Artificial
  CRISPR gRNA sequence
tcatcagatctttcaggtat

SEQ ID NO: 307193 - DNA, 20 bp, Artificial
  CRISPR gRNA sequence
tctagatttcaatgataggg

SEQ ID NO: 307194 - DNA, 20 bp, Artificial
  CRISPR gRNA sequence
cttccagaccatttctgaaa

SEQ ID NO: 307195 - DNA, 20 bp, Artificial
  CRISPR gRNA sequence
atttctgaaactgagtgtga

SEQ ID NO: 307196 - DNA, 20 bp, Artificial
  CRISPR gRNA sequence
actgagtgtgacagggtagg

SEQ ID NO: 307197 - DNA, 20 bp, Artificial
  CRISPR gRNA sequence
agcaccctttctcattgtcc

SEQ ID NO: 307198 - DNA, 20 bp, Artificial
  CRISPR gRNA sequence
tctcattgtccaagggtgcc

SEQ ID NO: 307199 - DNA, 20 bp, Artificial
  CRISPR gRNA sequence
ggaattattagttttgttgc

SEQ ID NO: 307200 - DNA, 20 bp, Artificial
  CRISPR gRNA sequence
aatcacagtggctggtatat

SEQ ID NO: 307201 - DNA, 20 bp, Artificial
  CRISPR gRNA sequence
ctggtatatctggattagtg

SEQ ID NO: 307202 - DNA, 20 bp, Artificial
  CRISPR gRNA sequence
ctcggttgtctctgcaccct

SEQ ID NO: 307203 - DNA, 20 bp, Artificial
  CRISPR gRNA sequence
ctgaaaccaggcttgtgact

SEQ ID NO: 307204 - DNA, 20 bp, Artificial
  CRISPR gRNA sequence
ctgagggttgctttgatcct

SEQ ID NO: 307205 - DNA, 20 bp, Artificial
  CRISPR gRNA sequence
tgagagcttaatttctcagg

SEQ ID NO: 307206 - DNA, 20 bp, Artificial
  CRISPR gRNA sequence
ggtatggtctctgctcttca

SEQ ID NO: 307207 - DNA, 20 bp, Artificial
  CRISPR gRNA sequence
atttagttaagtctagttta

SEQ ID NO: 307208 - DNA, 20 bp, Artificial
  CRISPR gRNA sequence
gtgttattaagaaaaagcca

SEQ ID NO: 307209 - DNA, 20 bp, Artificial
  CRISPR gRNA sequence
tgacattttctagtttggga

SEQ ID NO: 307210 - DNA, 20 bp, Artificial
  CRISPR gRNA sequence
gctgcttgaggcaagatctg

SEQ ID NO: 307211 - DNA, 20 bp, Artificial
  CRISPR gRNA sequence
atttattcattccacacatg

SEQ ID NO: 307212 - DNA, 20 bp, Artificial
  CRISPR gRNA sequence
ctaggcactgtgccaggtac

SEQ ID NO: 307213 - DNA, 20 bp, Artificial
  CRISPR gRNA sequence
tgctttctgggcattgtgca

SEQ ID NO: 307214 - DNA, 20 bp, Artificial
  CRISPR gRNA sequence
attcaagtaacaggcactct

SEQ ID NO: 307215 - DNA, 20 bp, Artificial
  CRISPR gRNA sequence
cctctctctcatcaatgtct

SEQ ID NO: 307216 - DNA, 20 bp, Artificial
  CRISPR gRNA sequence
tctcatcaatgtctcagggt

SEQ ID NO: 307217 - DNA, 20 bp, Artificial
  CRISPR gRNA sequence
ctcaaatgatgcaatttcag

SEQ ID NO: 307218 - DNA, 20 bp, Artificial
  CRISPR gRNA sequence
aaccaaaaaataccattggg

SEQ ID NO: 307219 - DNA, 20 bp, Artificial
  CRISPR gRNA sequence
agcaatcattttgtgattgg

SEQ ID NO: 307220 - DNA, 20 bp, Artificial
  CRISPR gRNA sequence
tcggctagccagatggtgct

SEQ ID NO: 307221 - DNA, 20 bp, Artificial
  CRISPR gRNA sequence
ccagctagacctcacaaagc

SEQ ID NO: 307222 - DNA, 20 bp, Artificial
  CRISPR gRNA sequence
gacttgctactgacacaact

SEQ ID NO: 307223 - DNA, 20 bp, Artificial
  CRISPR gRNA sequence
aactccaacaggttgctaac

SEQ ID NO: 307224 - DNA, 20 bp, Artificial
  CRISPR gRNA sequence
tggaggtatttatagaccac

SEQ ID NO: 307225 - DNA, 20 bp, Artificial
  CRISPR gRNA sequence
ttatgaggccacaaagtcat

SEQ ID NO: 307226 - DNA, 20 bp, Artificial
  CRISPR gRNA sequence
ataagaatgatataatggac

SEQ ID NO: 307227 - DNA, 20 bp, Artificial
  CRISPR gRNA sequence
ggacttgggtacttgggggg

SEQ ID NO: 307228 - DNA, 20 bp, Artificial
  CRISPR gRNA sequence
gggggaagagtgagagagag

SEQ ID NO: 307229 - DNA, 20 bp, Artificial
  CRISPR gRNA sequence
gagtgagagagaggtggatg

SEQ ID NO: 307230 - DNA, 20 bp, Artificial
  CRISPR gRNA sequence
gaaggataaaagactacaca

SEQ ID NO: 307231 - DNA, 20 bp, Artificial
  CRISPR gRNA sequence
ttgggtacagtggacattgc

SEQ ID NO: 307232 - DNA, 20 bp, Artificial
  CRISPR gRNA sequence
aaacccaatcattttcagtt

SEQ ID NO: 307233 - DNA, 20 bp, Artificial
  CRISPR gRNA sequence
tttagagtttggtgatttta

SEQ ID NO: 307234 - DNA, 20 bp, Artificial
  CRISPR gRNA sequence
tgattcctttcccccatccc

SEQ ID NO: 307235 - DNA, 20 bp, Artificial
  CRISPR gRNA sequence
cccccatcccatggataacc

SEQ ID NO: 307236 - DNA, 20 bp, Artificial
  CRISPR gRNA sequence
aatgtgtattcttcttgtgc

SEQ ID NO: 307237 - DNA, 20 bp, Artificial
  CRISPR gRNA sequence
accgccaactgatgaaaatt

SEQ ID NO: 307238 - DNA, 20 bp, Artificial
  CRISPR gRNA sequence
gctgctatgaacatttgtgt

SEQ ID NO: 307239 - DNA, 20 bp, Artificial
  CRISPR gRNA sequence
atttctgtttggtaaatgtc

SEQ ID NO: 307240 - DNA, 20 bp, Artificial
  CRISPR gRNA sequence
ttggtaaatgtctaggattt

SEQ ID NO: 307241 - DNA, 20 bp, Artificial
  CRISPR gRNA sequence
tgggttgtatagcagtatat

SEQ ID NO: 307242 - DNA, 20 bp, Artificial
  CRISPR gRNA sequence
ttttaattttagccattcta

SEQ ID NO: 307243 - DNA, 20 bp, Artificial
  CRISPR gRNA sequence
ttcttcttgccttttattaa

SEQ ID NO: 307244 - DNA, 20 bp, Artificial
  CRISPR gRNA sequence
aatggattgtcttcttacta

SEQ ID NO: 307245 - DNA, 20 bp, Artificial
  CRISPR gRNA sequence
tagcaatatgtaattatata

SEQ ID NO: 307246 - DNA, 20 bp, Artificial
  CRISPR gRNA sequence
taggttcatactttttccat

SEQ ID NO: 307247 - DNA, 20 bp, Artificial
  CRISPR gRNA sequence
aaaatactatcctttctgca

SEQ ID NO: 307248 - DNA, 20 bp, Artificial
  CRISPR gRNA sequence
ttggtagctttgtcaacagt

SEQ ID NO: 307249 - DNA, 20 bp, Artificial
  CRISPR gRNA sequence
ttttttttttttttttgaga

SEQ ID NO: 307250 - DNA, 20 bp, Artificial
  CRISPR gRNA sequence
ttcactcttgttgcccaggc

SEQ ID NO: 307251 - DNA, 20 bp, Artificial
  CRISPR gRNA sequence
ctcacagcaacctctgcctc

SEQ ID NO: 307252 - DNA, 20 bp, Artificial
  CRISPR gRNA sequence
aattctcctgcctcagcctc

SEQ ID NO: 307253 - DNA, 20 bp, Artificial
  CRISPR gRNA sequence
gcctcagcctccagagtagc

SEQ ID NO: 307254 - DNA, 20 bp, Artificial
  CRISPR gRNA sequence
taacctttgttcttattttt

SEQ ID NO: 307255 - DNA, 20 bp, Artificial
  CRISPR gRNA sequence
ttgcatttccctataacttt

SEQ ID NO: 307256 - DNA, 20 bp, Artificial
  CRISPR gRNA sequence
gtatctattagagagcttac

SEQ ID NO: 307257 - DNA, 20 bp, Artificial
  CRISPR gRNA sequence
aatccatagatcaacttgga

SEQ ID NO: 307258 - DNA, 20 bp, Artificial
  CRISPR gRNA sequence
taggtttttgatagattcct

SEQ ID NO: 307259 - DNA, 20 bp, Artificial
  CRISPR gRNA sequence
caatgtggaacaaaagtaga

SEQ ID NO: 307260 - DNA, 20 bp, Artificial
  CRISPR gRNA sequence
atgaaatattatgctaacag

SEQ ID NO: 307261 - DNA, 20 bp, Artificial
  CRISPR gRNA sequence
ttttctttccatttaaaact

SEQ ID NO: 307262 - DNA, 20 bp, Artificial
  CRISPR gRNA sequence
ctttccatttaaaactatga

SEQ ID NO: 307263 - DNA, 20 bp, Artificial
  CRISPR gRNA sequence
taaaggttattgcctgattt

SEQ ID NO: 307264 - DNA, 20 bp, Artificial
  CRISPR gRNA sequence
gttgagcttacctgtgtttc

SEQ ID NO: 307265 - DNA, 20 bp, Artificial
  CRISPR gRNA sequence
tttatttatattttttaaga

SEQ ID NO: 307266 - DNA, 20 bp, Artificial
  CRISPR gRNA sequence
tgatcttctgtcacccaggc

SEQ ID NO: 307267 - DNA, 20 bp, Artificial
  CRISPR gRNA sequence
ctctcagcctcccaagtagc

SEQ ID NO: 307268 - DNA, 20 bp, Artificial
  CRISPR gRNA sequence
ttttgtatgtttagtagaaa

SEQ ID NO: 307269 - DNA, 20 bp, Artificial
  CRISPR gRNA sequence
ggtttcaccatgttggccag

SEQ ID NO: 307270 - DNA, 20 bp, Artificial
  CRISPR gRNA sequence
gcctcagcctccaaaagtgc

SEQ ID NO: 307271 - DNA, 20 bp, Artificial
  CRISPR gRNA sequence
tcattcatagagatgccctt

SEQ ID NO: 307272 - DNA, 20 bp, Artificial
  CRISPR gRNA sequence
ttgagctatttcttaattga

SEQ ID NO: 307273 - DNA, 20 bp, Artificial
  CRISPR gRNA sequence
ataatggtgtttataaggac

SEQ ID NO: 307274 - DNA, 20 bp, Artificial
  CRISPR gRNA sequence
agataccaccttactcctgc

SEQ ID NO: 307275 - DNA, 20 bp, Artificial
  CRISPR gRNA sequence
aaaaaataatagatgttggc

SEQ ID NO: 307276 - DNA, 20 bp, Artificial
  CRISPR gRNA sequence
aacatgtttacactgctggt

SEQ ID NO: 307277 - DNA, 20 bp, Artificial
  CRISPR gRNA sequence
ttaattcagcaatcctacta

SEQ ID NO: 307278 - DNA, 20 bp, Artificial
  CRISPR gRNA sequence
acctaaatgtccatcaaccc

SEQ ID NO: 307279 - DNA, 20 bp, Artificial
  CRISPR gRNA sequence
aaatgtccatcaacccatga

SEQ ID NO: 307280 - DNA, 20 bp, Artificial
  CRISPR gRNA sequence
aatgtggtaaatatccctca

SEQ ID NO: 307281 - DNA, 20 bp, Artificial
  CRISPR gRNA sequence
tattctaagtgaagtaactc

SEQ ID NO: 307282 - DNA, 20 bp, Artificial
  CRISPR gRNA sequence
ataagtgggagctaaactat

SEQ ID NO: 307283 - DNA, 20 bp, Artificial
  CRISPR gRNA sequence
ctatgaggatgcaaagacat

SEQ ID NO: 307284 - DNA, 20 bp, Artificial
  CRISPR gRNA sequence
gactttggggactcagagga

SEQ ID NO: 307285 - DNA, 20 bp, Artificial
  CRISPR gRNA sequence
gactcagaggaaagagtggg

SEQ ID NO: 307286 - DNA, 20 bp, Artificial
  CRISPR gRNA sequence
actggtgcagtgtacactgc

SEQ ID NO: 307287 - DNA, 20 bp, Artificial
  CRISPR gRNA sequence
ttcaaataaaaattttgaaa

SEQ ID NO: 307288 - DNA, 20 bp, Artificial
  CRISPR gRNA sequence
gtaaaaaaaggtacttatag

SEQ ID NO: 307289 - DNA, 20 bp, Artificial
  CRISPR gRNA sequence
tgtcttcagattaacacaaa

SEQ ID NO: 307290 - DNA, 20 bp, Artificial
  CRISPR gRNA sequence
aactttcagtctttaagcct

SEQ ID NO: 307291 - DNA, 20 bp, Artificial
  CRISPR gRNA sequence
tgtttaaatgttggttaaaa

SEQ ID NO: 307292 - DNA, 20 bp, Artificial
  CRISPR gRNA sequence
tacttgggaggctgaggcag

SEQ ID NO: 307293 - DNA, 20 bp, Artificial
  CRISPR gRNA sequence
actgcactccagcctggtga

SEQ ID NO: 307294 - DNA, 20 bp, Artificial
  CRISPR gRNA sequence
ctattttagtttttctccca

SEQ ID NO: 307295 - DNA, 20 bp, Artificial
  CRISPR gRNA sequence
tctcccaatgggtaagctga

SEQ ID NO: 307296 - DNA, 20 bp, Artificial
  CRISPR gRNA sequence
aagagagattggaaactggc

SEQ ID NO: 307297 - DNA, 20 bp, Artificial
  CRISPR gRNA sequence
attcatttaaacagcctaaa

SEQ ID NO: 307298 - DNA, 20 bp, Artificial
  CRISPR gRNA sequence
aaaactataatgagaaaaca

SEQ ID NO: 307299 - DNA, 20 bp, Artificial
  CRISPR gRNA sequence
aggaccgtctcctctgagaa

SEQ ID NO: 307300 - DNA, 20 bp, Artificial
  CRISPR gRNA sequence
tctgagaaagggattaacac

SEQ ID NO: 307301 - DNA, 20 bp, Artificial
  CRISPR gRNA sequence
gtaagcttgtgtctctgtgg

SEQ ID NO: 307302 - DNA, 20 bp, Artificial
  CRISPR gRNA sequence
tttccacattggtctcttgg

SEQ ID NO: 307303 - DNA, 20 bp, Artificial
  CRISPR gRNA sequence
catcttcaaagctagaaatg

SEQ ID NO: 307304 - DNA, 20 bp, Artificial
  CRISPR gRNA sequence
tgtgattacattgggcccac

SEQ ID NO: 307305 - DNA, 20 bp, Artificial
  CRISPR gRNA sequence
agataacatattacaggttc

SEQ ID NO: 307306 - DNA, 20 bp, Artificial
  CRISPR gRNA sequence
cctatcacatagccaatgcc

SEQ ID NO: 307307 - DNA, 20 bp, Artificial
  CRISPR gRNA sequence
ggcagatattgctgaagtta

SEQ ID NO: 307308 - DNA, 20 bp, Artificial
  CRISPR gRNA sequence
ctttgatcaaactcagtggc

SEQ ID NO: 307309 - DNA, 20 bp, Artificial
  CRISPR gRNA sequence
tcagtggcatggatgactgt

SEQ ID NO: 307310 - DNA, 20 bp, Artificial
  CRISPR gRNA sequence
atattcttcattacattctt

SEQ ID NO: 307311 - DNA, 20 bp, Artificial
  CRISPR gRNA sequence
tatgtctttacatctgtgct

SEQ ID NO: 307312 - DNA, 20 bp, Artificial
  CRISPR gRNA sequence
acactccatacattggcagt

SEQ ID NO: 307313 - DNA, 20 bp, Artificial
  CRISPR gRNA sequence
ttcttatttttaaagtacag

SEQ ID NO: 307314 - DNA, 20 bp, Artificial
  CRISPR gRNA sequence
ttaaagtacagcaggatgca

SEQ ID NO: 307315 - DNA, 20 bp, Artificial
  CRISPR gRNA sequence
tcttgtgctttctaccataa

SEQ ID NO: 307316 - DNA, 20 bp, Artificial
  CRISPR gRNA sequence
ttataacagaagtcagtggg

SEQ ID NO: 307317 - DNA, 20 bp, Artificial
  CRISPR gRNA sequence
attatggtgtatccacaaaa

SEQ ID NO: 307318 - DNA, 20 bp, Artificial
  CRISPR gRNA sequence
agccattaaaaatgatgctg

SEQ ID NO: 307319 - DNA, 20 bp, Artificial
  CRISPR gRNA sequence
taatcattttttcttattag

SEQ ID NO: 307320 - DNA, 20 bp, Artificial
  CRISPR gRNA sequence
tatttttggtatatatgata

SEQ ID NO: 307321 - DNA, 20 bp, Artificial
  CRISPR gRNA sequence
gtccacaatctttaacattt

SEQ ID NO: 307322 - DNA, 20 bp, Artificial
  CRISPR gRNA sequence
gactcactcaccacatttat

SEQ ID NO: 307323 - DNA, 20 bp, Artificial
  CRISPR gRNA sequence
ttcttcttcttccatttcca

SEQ ID NO: 307324 - DNA, 20 bp, Artificial
  CRISPR gRNA sequence
ggaagtacagctgtaatcca

SEQ ID NO: 307325 - DNA, 20 bp, Artificial
  CRISPR gRNA sequence
aatgtggtctgggggaggct

SEQ ID NO: 307326 - DNA, 20 bp, Artificial
  CRISPR gRNA sequence
acaaattttcaatcagccag

SEQ ID NO: 307327 - DNA, 20 bp, Artificial
  CRISPR gRNA sequence
cagggcctcagcagcgacct

SEQ ID NO: 307328 - DNA, 20 bp, Artificial
  CRISPR gRNA sequence
tgccatgccttcatggaggt

SEQ ID NO: 307329 - DNA, 20 bp, Artificial
  CRISPR gRNA sequence
ccgaccatgatcaggaagaa

SEQ ID NO: 307330 - DNA, 20 bp, Artificial
  CRISPR gRNA sequence
gtcagcctggcccgtgattc

SEQ ID NO: 307331 - DNA, 20 bp, Artificial
  CRISPR gRNA sequence
ctggcccgtgattctggaat

SEQ ID NO: 307332 - DNA, 20 bp, Artificial
  CRISPR gRNA sequence
tgagaactcctaagtttctg

SEQ ID NO: 307333 - DNA, 20 bp, Artificial
  CRISPR gRNA sequence
tttgtggggaaaacttagaa

SEQ ID NO: 307334 - DNA, 20 bp, Artificial
  CRISPR gRNA sequence
gtagacacatgccctgtttc

SEQ ID NO: 307335 - DNA, 20 bp, Artificial
  CRISPR gRNA sequence
caggccatatttaatccctt

SEQ ID NO: 307336 - DNA, 20 bp, Artificial
  CRISPR gRNA sequence
agtttggcactcccagtaaa

SEQ ID NO: 307337 - DNA, 20 bp, Artificial
  CRISPR gRNA sequence
cactcccagtaaagggggtt

SEQ ID NO: 307338 - DNA, 20 bp, Artificial
  CRISPR gRNA sequence
gcaaaaaaggccccttgact

SEQ ID NO: 307339 - DNA, 20 bp, Artificial
  CRISPR gRNA sequence
acctatctctgatcaagcga

SEQ ID NO: 307340 - DNA, 20 bp, Artificial
  CRISPR gRNA sequence
gctgaaacatttctgaagat

SEQ ID NO: 307341 - DNA, 20 bp, Artificial
  CRISPR gRNA sequence
aggcttctatctggccaaga

SEQ ID NO: 307342 - DNA, 20 bp, Artificial
  CRISPR gRNA sequence
ggagaagcaactgggacagg

SEQ ID NO: 307343 - DNA, 20 bp, Artificial
  CRISPR gRNA sequence
cgagttggctccaccattta

SEQ ID NO: 307344 - DNA, 20 bp, Artificial
  CRISPR gRNA sequence
attctcagaggctgaagtgt

SEQ ID NO: 307345 - DNA, 20 bp, Artificial
  CRISPR gRNA sequence
gagaaaggaggtgacaaagc

SEQ ID NO: 307346 - DNA, 20 bp, Artificial
  CRISPR gRNA sequence
caaagccagggtatggagca

SEQ ID NO: 307347 - DNA, 20 bp, Artificial
  CRISPR gRNA sequence
ccagggtatggagcaaggag

SEQ ID NO: 307348 - DNA, 20 bp, Artificial
  CRISPR gRNA sequence
ggtatggagcaaggagttgg

SEQ ID NO: 307349 - DNA, 20 bp, Artificial
  CRISPR gRNA sequence
caagaaatcaccgctggaga

SEQ ID NO: 307350 - DNA, 20 bp, Artificial
  CRISPR gRNA sequence
aaggtaagaagaaggcagat

SEQ ID NO: 307351 - DNA, 20 bp, Artificial
  CRISPR gRNA sequence
cagcacaggcagtgatggga

SEQ ID NO: 307352 - DNA, 20 bp, Artificial
  CRISPR gRNA sequence
agaccacctttattccagga

SEQ ID NO: 307353 - DNA, 20 bp, Artificial
  CRISPR gRNA sequence
cagttacagcttcttaaaag

SEQ ID NO: 307354 - DNA, 20 bp, Artificial
  CRISPR gRNA sequence
aaatatagacacatgccctc

SEQ ID NO: 307355 - DNA, 20 bp, Artificial
  CRISPR gRNA sequence
ctccactgaacttgtccctg

SEQ ID NO: 307356 - DNA, 20 bp, Artificial
  CRISPR gRNA sequence
agttttgggaacctgtcatc

SEQ ID NO: 307357 - DNA, 20 bp, Artificial
  CRISPR gRNA sequence
ggaaccattccctgaccctc

SEQ ID NO: 307358 - DNA, 20 bp, Artificial
  CRISPR gRNA sequence
ctcagggatcttgcctacct

SEQ ID NO: 307359 - DNA, 20 bp, Artificial
  CRISPR gRNA sequence
aatttagtcagatatttcca

SEQ ID NO: 307360 - DNA, 20 bp, Artificial
  CRISPR gRNA sequence
tttttcatgtgtgcacatta

SEQ ID NO: 307361 - DNA, 20 bp, Artificial
  CRISPR gRNA sequence
ggaaggtcctcaagggcaga

SEQ ID NO: 307362 - DNA, 20 bp, Artificial
  CRISPR gRNA sequence
gtatgtgttgtaatcaaaga

SEQ ID NO: 307363 - DNA, 20 bp, Artificial
  CRISPR gRNA sequence
aagaaagaattctagcctgg

SEQ ID NO: 307364 - DNA, 20 bp, Artificial
  CRISPR gRNA sequence
gtatttttaaatcaaaactt

SEQ ID NO: 307365 - DNA, 20 bp, Artificial
  CRISPR gRNA sequence
tccaaaggtaaaccaagaga

SEQ ID NO: 307366 - DNA, 20 bp, Artificial
  CRISPR gRNA sequence
gagaagcaggagacctccat

SEQ ID NO: 307367 - DNA, 20 bp, Artificial
  CRISPR gRNA sequence
ttcctagcaagtcggggaca

SEQ ID NO: 307368 - DNA, 20 bp, Artificial
  CRISPR gRNA sequence
agccgcgtcttgtcagtttc

SEQ ID NO: 307369 - DNA, 20 bp, Artificial
  CRISPR gRNA sequence
tcatattgctcgtaacatca

SEQ ID NO: 307370 - DNA, 20 bp, Artificial
  CRISPR gRNA sequence
aacaccatcatactcgatag

SEQ ID NO: 307371 - DNA, 20 bp, Artificial
  CRISPR gRNA sequence
aacactcatcttcttaggtt

SEQ ID NO: 307372 - DNA, 20 bp, Artificial
  CRISPR gRNA sequence
aagtttagatgtatctagga

SEQ ID NO: 307373 - DNA, 20 bp, Artificial
  CRISPR gRNA sequence
taggagggaatagcaaataa

SEQ ID NO: 307374 - DNA, 20 bp, Artificial
  CRISPR gRNA sequence
tggggcacacctgggagcct

SEQ ID NO: 307375 - DNA, 20 bp, Artificial
  CRISPR gRNA sequence
aatgtgaccctcagcccaag

SEQ ID NO: 307376 - DNA, 20 bp, Artificial
  CRISPR gRNA sequence
tcatgtttatttttcaacaa

SEQ ID NO: 307377 - DNA, 20 bp, Artificial
  CRISPR gRNA sequence
ttcctgcttatccaaatcaa

SEQ ID NO: 307378 - DNA, 20 bp, Artificial
  CRISPR gRNA sequence
aagtgacaggagggctgtaa

SEQ ID NO: 307379 - DNA, 20 bp, Artificial
  CRISPR gRNA sequence
caatgaagccactgtttcca

SEQ ID NO: 307380 - DNA, 20 bp, Artificial
  CRISPR gRNA sequence
aagccactgtttccagggag

SEQ ID NO: 307381 - DNA, 20 bp, Artificial
  CRISPR gRNA sequence
cccagactaagagagcagga

SEQ ID NO: 307382 - DNA, 20 bp, Artificial
  CRISPR gRNA sequence
agagcaggaaggaattgagc

SEQ ID NO: 307383 - DNA, 20 bp, Artificial
  CRISPR gRNA sequence
ggagtctcaccaggaactga

SEQ ID NO: 307384 - DNA, 20 bp, Artificial
  CRISPR gRNA sequence
atatctttcagaaacccaag

SEQ ID NO: 307385 - DNA, 20 bp, Artificial
  CRISPR gRNA sequence
cccaagcaggattgtggtaa

SEQ ID NO: 307386 - DNA, 20 bp, Artificial
  CRISPR gRNA sequence
agcaggattgtggtaagtga

SEQ ID NO: 307387 - DNA, 20 bp, Artificial
  CRISPR gRNA sequence
ggattgtggtaagtgagtgg

SEQ ID NO: 307388 - DNA, 20 bp, Artificial
  CRISPR gRNA sequence
aagtgagtgggtggatattt

SEQ ID NO: 307389 - DNA, 20 bp, Artificial
  CRISPR gRNA sequence
ttctcacttttctggctgtt

SEQ ID NO: 307390 - DNA, 20 bp, Artificial
  CRISPR gRNA sequence
gctgttcaggatcactggca

SEQ ID NO: 307391 - DNA, 20 bp, Artificial
  CRISPR gRNA sequence
tactatttgagcagtcttct

SEQ ID NO: 307392 - DNA, 20 bp, Artificial
  CRISPR gRNA sequence
gtctatgtggcctgtagaag

SEQ ID NO: 307393 - DNA, 20 bp, Artificial
  CRISPR gRNA sequence
aaatcacatgttgcgtaagt

SEQ ID NO: 307394 - DNA, 20 bp, Artificial
  CRISPR gRNA sequence
cctgaccacattttgaaaac

SEQ ID NO: 307395 - DNA, 20 bp, Artificial
  CRISPR gRNA sequence
gcagcctagtttaaatcaca

SEQ ID NO: 307396 - DNA, 20 bp, Artificial
  CRISPR gRNA sequence
tctgttttactctatggttt

SEQ ID NO: 307397 - DNA, 20 bp, Artificial
  CRISPR gRNA sequence
aagtttcatcaaaaattaac

SEQ ID NO: 307398 - DNA, 20 bp, Artificial
  CRISPR gRNA sequence
tggatccagtaataccacac

SEQ ID NO: 307399 - DNA, 20 bp, Artificial
  CRISPR gRNA sequence
aaacaacccaatgtctttta

SEQ ID NO: 307400 - DNA, 20 bp, Artificial
  CRISPR gRNA sequence
acccaatgtcttttactgag

SEQ ID NO: 307401 - DNA, 20 bp, Artificial
  CRISPR gRNA sequence
aatgtcttttactgagttga

SEQ ID NO: 307402 - DNA, 20 bp, Artificial
  CRISPR gRNA sequence
agctcgatatgtgcaacaac

SEQ ID NO: 307403 - DNA, 20 bp, Artificial
  CRISPR gRNA sequence
cgatatgtgcaacaacttgg

SEQ ID NO: 307404 - DNA, 20 bp, Artificial
  CRISPR gRNA sequence
ctgtcaaaaagacaaaacta

SEQ ID NO: 307405 - DNA, 20 bp, Artificial
  CRISPR gRNA sequence
aaaactataggatgcccaac

SEQ ID NO: 307406 - DNA, 20 bp, Artificial
  CRISPR gRNA sequence
taggatgcccaacaagggtt

SEQ ID NO: 307407 - DNA, 20 bp, Artificial
  CRISPR gRNA sequence
acaagggttatgagtgcaga

SEQ ID NO: 307408 - DNA, 20 bp, Artificial
  CRISPR gRNA sequence
gacagcctgagggaaatttt

SEQ ID NO: 307409 - DNA, 20 bp, Artificial
  CRISPR gRNA sequence
aggagctggtttgtaagttt

SEQ ID NO: 307410 - DNA, 20 bp, Artificial
  CRISPR gRNA sequence
aagtttgtgggttatgtttg

SEQ ID NO: 307411 - DNA, 20 bp, Artificial
  CRISPR gRNA sequence
atcttggacccaaggaaaaa

SEQ ID NO: 307412 - DNA, 20 bp, Artificial
  CRISPR gRNA sequence
cagtctcatctgagaaggct

SEQ ID NO: 307413 - DNA, 20 bp, Artificial
  CRISPR gRNA sequence
cataccaagcactgacagtt

SEQ ID NO: 307414 - DNA, 20 bp, Artificial
  CRISPR gRNA sequence
gacagttcagaattcatctg

SEQ ID NO: 307415 - DNA, 20 bp, Artificial
  CRISPR gRNA sequence
tcagaattcatctggtggat

SEQ ID NO: 307416 - DNA, 20 bp, Artificial
  CRISPR gRNA sequence
attcctgtgggctttttgtg

SEQ ID NO: 307417 - DNA, 20 bp, Artificial
  CRISPR gRNA sequence
atctgaagattgtgaagtct

SEQ ID NO: 307418 - DNA, 20 bp, Artificial
  CRISPR gRNA sequence
aagtctcagggtccaactgt

SEQ ID NO: 307419 - DNA, 20 bp, Artificial
  CRISPR gRNA sequence
acttgtgcggcccatatact

SEQ ID NO: 307420 - DNA, 20 bp, Artificial
  CRISPR gRNA sequence
ctcactcaggctttggtttt

SEQ ID NO: 307421 - DNA, 20 bp, Artificial
  CRISPR gRNA sequence
gcagtctcattgaaataagc

SEQ ID NO: 307422 - DNA, 20 bp, Artificial
  CRISPR gRNA sequence
agcacctaaaaaagaaggtt

SEQ ID NO: 307423 - DNA, 20 bp, Artificial
  CRISPR gRNA sequence
tcttatcagtaatcatgctg

SEQ ID NO: 307424 - DNA, 20 bp, Artificial
  CRISPR gRNA sequence
agtggttgactaaatgttcc

SEQ ID NO: 307425 - DNA, 20 bp, Artificial
  CRISPR gRNA sequence
ctttctagtactgtggttct

SEQ ID NO: 307426 - DNA, 20 bp, Artificial
  CRISPR gRNA sequence
gcaagacagggaaaaaccag

SEQ ID NO: 307427 - DNA, 20 bp, Artificial
  CRISPR gRNA sequence
ttattatacttcattagttg

SEQ ID NO: 307428 - DNA, 20 bp, Artificial
  CRISPR gRNA sequence
tcattagttggggaatcacg

SEQ ID NO: 307429 - DNA, 20 bp, Artificial
  CRISPR gRNA sequence
ctcccatggccagcacttcc

SEQ ID NO: 307430 - DNA, 20 bp, Artificial
  CRISPR gRNA sequence
ggcaaatttgatggctgttt

SEQ ID NO: 307431 - DNA, 20 bp, Artificial
  CRISPR gRNA sequence
tcaatgaccatttaaggcac

SEQ ID NO: 307432 - DNA, 20 bp, Artificial
  CRISPR gRNA sequence
acatgagtgaaatgctgaaa

SEQ ID NO: 307433 - DNA, 20 bp, Artificial
  CRISPR gRNA sequence
tgaatcatagatgggcaggt

SEQ ID NO: 307434 - DNA, 20 bp, Artificial
  CRISPR gRNA sequence
ggcaggtgaggatgtgcttt

SEQ ID NO: 307435 - DNA, 20 bp, Artificial
  CRISPR gRNA sequence
aaccatagacatcatgctgg

SEQ ID NO: 307436 - DNA, 20 bp, Artificial
  CRISPR gRNA sequence
tttagtccttgaggacactt

SEQ ID NO: 307437 - DNA, 20 bp, Artificial
  CRISPR gRNA sequence
gacactttggggtttgtggg

SEQ ID NO: 307438 - DNA, 20 bp, Artificial
  CRISPR gRNA sequence
ggccacccaactacttaaat

SEQ ID NO: 307439 - DNA, 20 bp, Artificial
  CRISPR gRNA sequence
tacttaaatgtgaatgatca

SEQ ID NO: 307440 - DNA, 20 bp, Artificial
  CRISPR gRNA sequence
gtaggaccttttctaggtta

SEQ ID NO: 307441 - DNA, 20 bp, Artificial
  CRISPR gRNA sequence
aaaaaaaaaagtaagcagtg

SEQ ID NO: 307442 - DNA, 20 bp, Artificial
  CRISPR gRNA sequence
cagtggtgggtgagaagtgc

SEQ ID NO: 307443 - DNA, 20 bp, Artificial
  CRISPR gRNA sequence
gggtgagaagtgcgggggtg

SEQ ID NO: 307444 - DNA, 20 bp, Artificial
  CRISPR gRNA sequence
ctaaataaaatttcatcatt

SEQ ID NO: 307445 - DNA, 20 bp, Artificial
  CRISPR gRNA sequence
ttgaggaggaaagggaggag

SEQ ID NO: 307446 - DNA, 20 bp, Artificial
  CRISPR gRNA sequence
gatgagaggagcttcatttg

SEQ ID NO: 307447 - DNA, 20 bp, Artificial
  CRISPR gRNA sequence
atttgaagagttctaagtgg

SEQ ID NO: 307448 - DNA, 20 bp, Artificial
  CRISPR gRNA sequence
atgtggtttctcttgaaaga

SEQ ID NO: 307449 - DNA, 20 bp, Artificial
  CRISPR gRNA sequence
ttgtcaaactaaactgtgta

SEQ ID NO: 307450 - DNA, 20 bp, Artificial
  CRISPR gRNA sequence
ccagtgagaacacataatca

SEQ ID NO: 307451 - DNA, 20 bp, Artificial
  CRISPR gRNA sequence
agcagacagcaggcatcagt

SEQ ID NO: 307452 - DNA, 20 bp, Artificial
  CRISPR gRNA sequence
cagtgggagtttgcacaaat

SEQ ID NO: 307453 - DNA, 20 bp, Artificial
  CRISPR gRNA sequence
tataaaatgcaccacctgta

SEQ ID NO: 307454 - DNA, 20 bp, Artificial
  CRISPR gRNA sequence
aaggaagatttagtgtgttt

SEQ ID NO: 307455 - DNA, 20 bp, Artificial
  CRISPR gRNA sequence
ctgagctcttaatgtaatgc

SEQ ID NO: 307456 - DNA, 20 bp, Artificial
  CRISPR gRNA sequence
acggctttctcttccactca

SEQ ID NO: 307457 - DNA, 20 bp, Artificial
  CRISPR gRNA sequence
atgtgggctggtctgaaaca

SEQ ID NO: 307458 - DNA, 20 bp, Artificial
  CRISPR gRNA sequence
tagtttgagcagctgttgta

SEQ ID NO: 307459 - DNA, 20 bp, Artificial
  CRISPR gRNA sequence
agaatctctgcctctgtctc

SEQ ID NO: 307460 - DNA, 20 bp, Artificial
  CRISPR gRNA sequence
tctctgcctctgtctccaga

SEQ ID NO: 307461 - DNA, 20 bp, Artificial
  CRISPR gRNA sequence
cagactccctctcctcccca

SEQ ID NO: 307462 - DNA, 20 bp, Artificial
  CRISPR gRNA sequence
aaatcactttgaaatccatt

SEQ ID NO: 307463 - DNA, 20 bp, Artificial
  CRISPR gRNA sequence
ctcacacagagccaggcatg

SEQ ID NO: 307464 - DNA, 20 bp, Artificial
  CRISPR gRNA sequence
cacctagcaactggacttac

SEQ ID NO: 307465 - DNA, 20 bp, Artificial
  CRISPR gRNA sequence
gacttactgggattccatag

SEQ ID NO: 307466 - DNA, 20 bp, Artificial
  CRISPR gRNA sequence
tccataggtgggtaagcatt

SEQ ID NO: 307467 - DNA, 20 bp, Artificial
  CRISPR gRNA sequence
atctctcccttccccagcac

SEQ ID NO: 307468 - DNA, 20 bp, Artificial
  CRISPR gRNA sequence
ttccccagcacttgggtaag

SEQ ID NO: 307469 - DNA, 20 bp, Artificial
  CRISPR gRNA sequence
atggtcgaagtctagttaca

SEQ ID NO: 307470 - DNA, 20 bp, Artificial
  CRISPR gRNA sequence
atgtcaggaacaagtcgctc

SEQ ID NO: 307471 - DNA, 20 bp, Artificial
  CRISPR gRNA sequence
atgccttcgtaatcagctga

SEQ ID NO: 307472 - DNA, 20 bp, Artificial
  CRISPR gRNA sequence
agctgaaggaatttgtttca

SEQ ID NO: 307473 - DNA, 20 bp, Artificial
  CRISPR gRNA sequence
tgagcaatacactctactgt

SEQ ID NO: 307474 - DNA, 20 bp, Artificial
  CRISPR gRNA sequence
aatgcatatcttatatgttt

SEQ ID NO: 307475 - DNA, 20 bp, Artificial
  CRISPR gRNA sequence
tcactaccaccttgctaaat

SEQ ID NO: 307476 - DNA, 20 bp, Artificial
  CRISPR gRNA sequence
tgcaaggtcttgctaacaat

SEQ ID NO: 307477 - DNA, 20 bp, Artificial
  CRISPR gRNA sequence
acaatttgggtgacttcttc

SEQ ID NO: 307478 - DNA, 20 bp, Artificial
  CRISPR gRNA sequence
tttgggtgacttcttcatga

SEQ ID NO: 307479 - DNA, 20 bp, Artificial
  CRISPR gRNA sequence
acctggagcagctcagtccc

SEQ ID NO: 307480 - DNA, 20 bp, Artificial
  CRISPR gRNA sequence
tagctagtatgactgagaag

SEQ ID NO: 307481 - DNA, 20 bp, Artificial
  CRISPR gRNA sequence
cttttagtttctctttccct

SEQ ID NO: 307482 - DNA, 20 bp, Artificial
  CRISPR gRNA sequence
cttggagtcaaactccctga

SEQ ID NO: 307483 - DNA, 20 bp, Artificial
  CRISPR gRNA sequence
actctttaattttggtaacc

SEQ ID NO: 307484 - DNA, 20 bp, Artificial
  CRISPR gRNA sequence
ggtttttctcctctagcccc

SEQ ID NO: 307485 - DNA, 20 bp, Artificial
  CRISPR gRNA sequence
tgccagcctataactttcac

SEQ ID NO: 307486 - DNA, 20 bp, Artificial
  CRISPR gRNA sequence
tacctgtattcaacttcctg

SEQ ID NO: 307487 - DNA, 20 bp, Artificial
  CRISPR gRNA sequence
ccttcctctactctatctca

SEQ ID NO: 307488 - DNA, 20 bp, Artificial
  CRISPR gRNA sequence
caaggaatgctcccctgtct

SEQ ID NO: 307489 - DNA, 20 bp, Artificial
  CRISPR gRNA sequence
aaatcatctgtataaccaag

SEQ ID NO: 307490 - DNA, 20 bp, Artificial
  CRISPR gRNA sequence
gaactccaatatgttaagaa

SEQ ID NO: 307491 - DNA, 20 bp, Artificial
  CRISPR gRNA sequence
tgcctgctccgtccttgtcc

SEQ ID NO: 307492 - DNA, 20 bp, Artificial
  CRISPR gRNA sequence
ccttacaagacctcatgtaa

SEQ ID NO: 307493 - DNA, 20 bp, Artificial
  CRISPR gRNA sequence
gtctgtctctcctgagatgt

SEQ ID NO: 307494 - DNA, 20 bp, Artificial
  CRISPR gRNA sequence
ggtctctttatctgaggctc

SEQ ID NO: 307495 - DNA, 20 bp, Artificial
  CRISPR gRNA sequence
cctctcacctcattttcctc

SEQ ID NO: 307496 - DNA, 20 bp, Artificial
  CRISPR gRNA sequence
ctcatgaattctccccaccc

SEQ ID NO: 307497 - DNA, 20 bp, Artificial
  CRISPR gRNA sequence
atgtggggaaatggaacagg

SEQ ID NO: 307498 - DNA, 20 bp, Artificial
  CRISPR gRNA sequence
gagcacctgacatctcccat

SEQ ID NO: 307499 - DNA, 20 bp, Artificial
  CRISPR gRNA sequence
gaaaggaaaggaaaaatctc

SEQ ID NO: 307500 - DNA, 20 bp, Artificial
  CRISPR gRNA sequence
tggtaatacccagtgtccgc

SEQ ID NO: 307501 - DNA, 20 bp, Artificial
  CRISPR gRNA sequence
tccgcgagagtgttaggaaa

SEQ ID NO: 307502 - DNA, 20 bp, Artificial
  CRISPR gRNA sequence
aggaaaatgggtcctaactg

SEQ ID NO: 307503 - DNA, 20 bp, Artificial
  CRISPR gRNA sequence
acttagcaactcaatttctt

SEQ ID NO: 307504 - DNA, 20 bp, Artificial
  CRISPR gRNA sequence
acactattataactaatagc

SEQ ID NO: 307505 - DNA, 20 bp, Artificial
  CRISPR gRNA sequence
tagcatggattctggacagc

SEQ ID NO: 307506 - DNA, 20 bp, Artificial
  CRISPR gRNA sequence
ctacctcataggtttgttgt

SEQ ID NO: 307507 - DNA, 20 bp, Artificial
  CRISPR gRNA sequence
ttgttgtgaggattaaagaa

SEQ ID NO: 307508 - DNA, 20 bp, Artificial
  CRISPR gRNA sequence
aggattaaagaaatgaatat

SEQ ID NO: 307509 - DNA, 20 bp, Artificial
  CRISPR gRNA sequence
aatgaatatttgagttagtg

SEQ ID NO: 307510 - DNA, 20 bp, Artificial
  CRISPR gRNA sequence
aaaatttaaataagtatatt

SEQ ID NO: 307511 - DNA, 20 bp, Artificial
  CRISPR gRNA sequence
agaagagataatcacttaaa

SEQ ID NO: 307512 - DNA, 20 bp, Artificial
  CRISPR gRNA sequence
cagaaacatctcttgagcct

SEQ ID NO: 307513 - DNA, 20 bp, Artificial
  CRISPR gRNA sequence
caccactgcactcctctagc

SEQ ID NO: 307514 - DNA, 20 bp, Artificial
  CRISPR gRNA sequence
cactcctctagcctgggtga

SEQ ID NO: 307515 - DNA, 20 bp, Artificial
  CRISPR gRNA sequence
ctgaaacaatcaactaattt

SEQ ID NO: 307516 - DNA, 20 bp, Artificial
  CRISPR gRNA sequence
gaaatggtggcttaacataa

SEQ ID NO: 307517 - DNA, 20 bp, Artificial
  CRISPR gRNA sequence
tggtggcttaacataaaggg

SEQ ID NO: 307518 - DNA, 20 bp, Artificial
  CRISPR gRNA sequence
aggctccatgacaattcttt

SEQ ID NO: 307519 - DNA, 20 bp, Artificial
  CRISPR gRNA sequence
tatcaacaacagcaggaaat

SEQ ID NO: 307520 - DNA, 20 bp, Artificial
  CRISPR gRNA sequence
aaaacagtggacctttccac

SEQ ID NO: 307521 - DNA, 20 bp, Artificial
  CRISPR gRNA sequence
cgggcagatcacctgaggtc

SEQ ID NO: 307522 - DNA, 20 bp, Artificial
  CRISPR gRNA sequence
tacttgggaggctgaggcaa

SEQ ID NO: 307523 - DNA, 20 bp, Artificial
  CRISPR gRNA sequence
atcacttgaacctgggaggc

SEQ ID NO: 307524 - DNA, 20 bp, Artificial
  CRISPR gRNA sequence
ttgcactttagcctgggcaa

SEQ ID NO: 307525 - DNA, 20 bp, Artificial
  CRISPR gRNA sequence
gtgcctctgcaggtggcact

SEQ ID NO: 307526 - DNA, 20 bp, Artificial
  CRISPR gRNA sequence
atagggagggaaaagttaaa

SEQ ID NO: 307527 - DNA, 20 bp, Artificial
  CRISPR gRNA sequence
tgctatttctatgccatgaa

SEQ ID NO: 307528 - DNA, 20 bp, Artificial
  CRISPR gRNA sequence
attattcagctctacatttt

SEQ ID NO: 307529 - DNA, 20 bp, Artificial
  CRISPR gRNA sequence
ttcagctctacattttgagg

SEQ ID NO: 307530 - DNA, 20 bp, Artificial
  CRISPR gRNA sequence
agaggtgtgccctgagaaga

SEQ ID NO: 307531 - DNA, 20 bp, Artificial
  CRISPR gRNA sequence
ctgagaagaaagaattcaaa

SEQ ID NO: 307532 - DNA, 20 bp, Artificial
  CRISPR gRNA sequence
tttgttgcttttcatcgtgt

SEQ ID NO: 307533 - DNA, 20 bp, Artificial
  CRISPR gRNA sequence
acacctgaactcagttttca

SEQ ID NO: 307534 - DNA, 20 bp, Artificial
  CRISPR gRNA sequence
actttctcactttcagtgtg

SEQ ID NO: 307535 - DNA, 20 bp, Artificial
  CRISPR gRNA sequence
aagggcttgggcccaagctc

SEQ ID NO: 307536 - DNA, 20 bp, Artificial
  CRISPR gRNA sequence
caggtgatggggaggaggca

SEQ ID NO: 307537 - DNA, 20 bp, Artificial
  CRISPR gRNA sequence
ggaggaggcactggatgaac

SEQ ID NO: 307538 - DNA, 20 bp, Artificial
  CRISPR gRNA sequence
acttattcatggtttaccac

SEQ ID NO: 307539 - DNA, 20 bp, Artificial
  CRISPR gRNA sequence
tttaccacaagagttaggag

SEQ ID NO: 307540 - DNA, 20 bp, Artificial
  CRISPR gRNA sequence
ttaggagaagagtcaagtga

SEQ ID NO: 307541 - DNA, 20 bp, Artificial
  CRISPR gRNA sequence
cgaatgctaaatctacattg

SEQ ID NO: 307542 - DNA, 20 bp, Artificial
  CRISPR gRNA sequence
ctaaatctacattgctgggt

SEQ ID NO: 307543 - DNA, 20 bp, Artificial
  CRISPR gRNA sequence
acttagtagctctgtcgatc

SEQ ID NO: 307544 - DNA, 20 bp, Artificial
  CRISPR gRNA sequence
taacaacaagacctaaagca

SEQ ID NO: 307545 - DNA, 20 bp, Artificial
  CRISPR gRNA sequence
agagttattgtgaggctcaa

SEQ ID NO: 307546 - DNA, 20 bp, Artificial
  CRISPR gRNA sequence
acagtaccaggcacaaagta

SEQ ID NO: 307547 - DNA, 20 bp, Artificial
  CRISPR gRNA sequence
acttggggaggctgaggtgg

SEQ ID NO: 307548 - DNA, 20 bp, Artificial
  CRISPR gRNA sequence
ctgtgccactgtactccagc

SEQ ID NO: 307549 - DNA, 20 bp, Artificial
  CRISPR gRNA sequence
taaaataaataaataagaag

SEQ ID NO: 307550 - DNA, 20 bp, Artificial
  CRISPR gRNA sequence
aataagaagtgggatgagaa

SEQ ID NO: 307551 - DNA, 20 bp, Artificial
  CRISPR gRNA sequence
gggatgagaagggaatctta

SEQ ID NO: 307552 - DNA, 20 bp, Artificial
  CRISPR gRNA sequence
tcttactggataatgttctc

SEQ ID NO: 307553 - DNA, 20 bp, Artificial
  CRISPR gRNA sequence
ggtagcaggtcatgggccct

SEQ ID NO: 307554 - DNA, 20 bp, Artificial
  CRISPR gRNA sequence
aaaggcttatcccagccagc

SEQ ID NO: 307555 - DNA, 20 bp, Artificial
  CRISPR gRNA sequence
gaactcatggctggtggcct

SEQ ID NO: 307556 - DNA, 20 bp, Artificial
  CRISPR gRNA sequence
agttcacctccctgtcttag

SEQ ID NO: 307557 - DNA, 20 bp, Artificial
  CRISPR gRNA sequence
ggagacaaggagcagcagga

SEQ ID NO: 307558 - DNA, 20 bp, Artificial
  CRISPR gRNA sequence
gcagcaggaaggggtgggcc

SEQ ID NO: 307559 - DNA, 20 bp, Artificial
  CRISPR gRNA sequence
ccaggagtaactacgagaca

SEQ ID NO: 307560 - DNA, 20 bp, Artificial
  CRISPR gRNA sequence
aactacgagacactgagtca

SEQ ID NO: 307561 - DNA, 20 bp, Artificial
  CRISPR gRNA sequence
gaactgtaaacagggaagat

SEQ ID NO: 307562 - DNA, 20 bp, Artificial
  CRISPR gRNA sequence
aagatctgagttttgtgagg

SEQ ID NO: 307563 - DNA, 20 bp, Artificial
  CRISPR gRNA sequence
taaaattttgaggggaggtg

SEQ ID NO: 307564 - DNA, 20 bp, Artificial
  CRISPR gRNA sequence
ggtggtggatagttaagaaa

SEQ ID NO: 307565 - DNA, 20 bp, Artificial
  CRISPR gRNA sequence
gatagttaagaaaaagaatg

SEQ ID NO: 307566 - DNA, 20 bp, Artificial
  CRISPR gRNA sequence
ctgctaacaccaccagacag

SEQ ID NO: 307567 - DNA, 20 bp, Artificial
  CRISPR gRNA sequence
cactgctagggggcccttca

SEQ ID NO: 307568 - DNA, 20 bp, Artificial
  CRISPR gRNA sequence
gcccttcacagggtcttgag

SEQ ID NO: 307569 - DNA, 20 bp, Artificial
  CRISPR gRNA sequence
ggtcttgagggggatttaga

SEQ ID NO: 307570 - DNA, 20 bp, Artificial
  CRISPR gRNA sequence
tgtgcatgggctgtagggaa

SEQ ID NO: 307571 - DNA, 20 bp, Artificial
  CRISPR gRNA sequence
ctgtagggaagggagtgaga

SEQ ID NO: 307572 - DNA, 20 bp, Artificial
  CRISPR gRNA sequence
gggacgtgaaagccagtgct

SEQ ID NO: 307573 - DNA, 20 bp, Artificial
  CRISPR gRNA sequence
tccgaatgaagggagacttt

SEQ ID NO: 307574 - DNA, 20 bp, Artificial
  CRISPR gRNA sequence
gagcctgagaaagacagaaa

SEQ ID NO: 307575 - DNA, 20 bp, Artificial
  CRISPR gRNA sequence
agggtcagagaagaccagaa

SEQ ID NO: 307576 - DNA, 20 bp, Artificial
  CRISPR gRNA sequence
agagaatatgtgtggaacaa

SEQ ID NO: 307577 - DNA, 20 bp, Artificial
  CRISPR gRNA sequence
gcagccttcccccatcccca

SEQ ID NO: 307578 - DNA, 20 bp, Artificial
  CRISPR gRNA sequence
tgtacaatgctcagtagaaa

SEQ ID NO: 307579 - DNA, 20 bp, Artificial
  CRISPR gRNA sequence
tcagactcatcaggagacag

SEQ ID NO: 307580 - DNA, 20 bp, Artificial
  CRISPR gRNA sequence
agcaggaaggccatcacaaa

SEQ ID NO: 307581 - DNA, 20 bp, Artificial
  CRISPR gRNA sequence
gttactcagtcccatagtgc

SEQ ID NO: 307582 - DNA, 20 bp, Artificial
  CRISPR gRNA sequence
accaaaacatgacctggacg

SEQ ID NO: 307583 - DNA, 20 bp, Artificial
  CRISPR gRNA sequence
catgacctggacgtggagtt

SEQ ID NO: 307584 - DNA, 20 bp, Artificial
  CRISPR gRNA sequence
acgtggagtttgggattcac

SEQ ID NO: 307585 - DNA, 20 bp, Artificial
  CRISPR gRNA sequence
tttgggattcacttgggttc

SEQ ID NO: 307586 - DNA, 20 bp, Artificial
  CRISPR gRNA sequence
tgagactggcttctagccaa

SEQ ID NO: 307587 - DNA, 20 bp, Artificial
  CRISPR gRNA sequence
ctcctgccttcttagcagca

SEQ ID NO: 307588 - DNA, 20 bp, Artificial
  CRISPR gRNA sequence
tctcccacaactgatctaca

SEQ ID NO: 307589 - DNA, 20 bp, Artificial
  CRISPR gRNA sequence
ttggcaaaaaataaaatttg

SEQ ID NO: 307590 - DNA, 20 bp, Artificial
  CRISPR gRNA sequence
ttttcctgtggttctcaaac

SEQ ID NO: 307591 - DNA, 20 bp, Artificial
  CRISPR gRNA sequence
tgtggttctcaaacttgaat

SEQ ID NO: 307592 - DNA, 20 bp, Artificial
  CRISPR gRNA sequence
atgtgagtaaaaatcacctg

SEQ ID NO: 307593 - DNA, 20 bp, Artificial
  CRISPR gRNA sequence
gaaagtctggcttagtaagt

SEQ ID NO: 307594 - DNA, 20 bp, Artificial
  CRISPR gRNA sequence
agtaagttgggatgaaaccc

SEQ ID NO: 307595 - DNA, 20 bp, Artificial
  CRISPR gRNA sequence
tacatgatgaagccaagaaa

SEQ ID NO: 307596 - DNA, 20 bp, Artificial
  CRISPR gRNA sequence
tagtggcttataaggaagca

SEQ ID NO: 307597 - DNA, 20 bp, Artificial
  CRISPR gRNA sequence
tagatgcgatcaggcacatt

SEQ ID NO: 307598 - DNA, 20 bp, Artificial
  CRISPR gRNA sequence
tggaaaagcaaaccaaatac

SEQ ID NO: 307599 - DNA, 20 bp, Artificial
  CRISPR gRNA sequence
taaaaaggaaaacctaacca

SEQ ID NO: 307600 - DNA, 20 bp, Artificial
  CRISPR gRNA sequence
agatgcacaactattcttga

SEQ ID NO: 307601 - DNA, 20 bp, Artificial
  CRISPR gRNA sequence
tctttttttaataaatattt

SEQ ID NO: 307602 - DNA, 20 bp, Artificial
  CRISPR gRNA sequence
ttttcttccacagaggtaac

SEQ ID NO: 307603 - DNA, 20 bp, Artificial
  CRISPR gRNA sequence
ttattctgtatcagcatgta

SEQ ID NO: 307604 - DNA, 20 bp, Artificial
  CRISPR gRNA sequence
tattagtctattgtattcta

SEQ ID NO: 307605 - DNA, 20 bp, Artificial
  CRISPR gRNA sequence
atatttccagaccactagtg

SEQ ID NO: 307606 - DNA, 20 bp, Artificial
  CRISPR gRNA sequence
atatgccatatcacacaggt

SEQ ID NO: 307607 - DNA, 20 bp, Artificial
  CRISPR gRNA sequence
gtaagctatattcctagaag

SEQ ID NO: 307608 - DNA, 20 bp, Artificial
  CRISPR gRNA sequence
gaagcagaatcgtttgacca

SEQ ID NO: 307609 - DNA, 20 bp, Artificial
  CRISPR gRNA sequence
atcgtttgaccaaagggttg

SEQ ID NO: 307610 - DNA, 20 bp, Artificial
  CRISPR gRNA sequence
gtttatgctctgatcaacac

SEQ ID NO: 307611 - DNA, 20 bp, Artificial
  CRISPR gRNA sequence
gtttatgctctgatcaacac

SEQ ID NO: 307612 - DNA, 20 bp, Artificial
  CRISPR gRNA sequence
aaatttgccatcttcacctt

SEQ ID NO: 307613 - DNA, 20 bp, Artificial
  CRISPR gRNA sequence
ccattccaccttctgtttcc

SEQ ID NO: 307614 - DNA, 20 bp, Artificial
  CRISPR gRNA sequence
tttccatgaatttgactgct

SEQ ID NO: 307615 - DNA, 20 bp, Artificial
  CRISPR gRNA sequence
atccacattgtagcatgtgt

SEQ ID NO: 307616 - DNA, 20 bp, Artificial
  CRISPR gRNA sequence
cattcatttttgatggacat

SEQ ID NO: 307617 - DNA, 20 bp, Artificial
  CRISPR gRNA sequence
gctggtatgaacaaggctgt

SEQ ID NO: 307618 - DNA, 20 bp, Artificial
  CRISPR gRNA sequence
agactctgctttcagttctt

SEQ ID NO: 307619 - DNA, 20 bp, Artificial
  CRISPR gRNA sequence
tttgggtatatacccagaag

SEQ ID NO: 307620 - DNA, 20 bp, Artificial
  CRISPR gRNA sequence
tttagtatgaggaagctcac

SEQ ID NO: 307621 - DNA, 20 bp, Artificial
  CRISPR gRNA sequence
aaaaaaaaaaagagggccct

SEQ ID NO: 307622 - DNA, 20 bp, Artificial
  CRISPR gRNA sequence
tctgaactcccacctaatat

SEQ ID NO: 307623 - DNA, 20 bp, Artificial
  CRISPR gRNA sequence
accaaagacaatttttcttc

SEQ ID NO: 307624 - DNA, 20 bp, Artificial
  CRISPR gRNA sequence
atgaaatcagtattgctcta

SEQ ID NO: 307625 - DNA, 20 bp, Artificial
  CRISPR gRNA sequence
gagaagcactgaccctgaca

SEQ ID NO: 307626 - DNA, 20 bp, Artificial
  CRISPR gRNA sequence
tttggaaactctctcttccc

SEQ ID NO: 307627 - DNA, 20 bp, Artificial
  CRISPR gRNA sequence
ttttgtcctctgaagctatc

SEQ ID NO: 307628 - DNA, 20 bp, Artificial
  CRISPR gRNA sequence
cacttctgccaaagtctgtc

SEQ ID NO: 307629 - DNA, 20 bp, Artificial
  CRISPR gRNA sequence
tcaaaatcctggcctggccc

SEQ ID NO: 307630 - DNA, 20 bp, Artificial
  CRISPR gRNA sequence
tatcagtgaccctgctgtaa

SEQ ID NO: 307631 - DNA, 20 bp, Artificial
  CRISPR gRNA sequence
aagtacaagtgccccatatg

SEQ ID NO: 307632 - DNA, 20 bp, Artificial
  CRISPR gRNA sequence
gatgtgtgatgtgtgtgtgc

SEQ ID NO: 307633 - DNA, 20 bp, Artificial
  CRISPR gRNA sequence
tgtgtgtgcgagggtgtggg

SEQ ID NO: 307634 - DNA, 20 bp, Artificial
  CRISPR gRNA sequence
agaaatgtccccactccctc

SEQ ID NO: 307635 - DNA, 20 bp, Artificial
  CRISPR gRNA sequence
cggagggagagagcaaaaag

SEQ ID NO: 307636 - DNA, 20 bp, Artificial
  CRISPR gRNA sequence
aatggaagaggaaagaacct

SEQ ID NO: 307637 - DNA, 20 bp, Artificial
  CRISPR gRNA sequence
agaacctaagaatttaccgg

SEQ ID NO: 307638 - DNA, 20 bp, Artificial
  CRISPR gRNA sequence
agatttctgtcagctaagca

SEQ ID NO: 307639 - DNA, 20 bp, Artificial
  CRISPR gRNA sequence
ctaagcacagaataaggtct

SEQ ID NO: 307640 - DNA, 20 bp, Artificial
  CRISPR gRNA sequence
gaataaggtctatgaataag

SEQ ID NO: 307641 - DNA, 20 bp, Artificial
  CRISPR gRNA sequence
tgtctggcccatcagagaac

SEQ ID NO: 307642 - DNA, 20 bp, Artificial
  CRISPR gRNA sequence
gcccatcagagaacatgaat

SEQ ID NO: 307643 - DNA, 20 bp, Artificial
  CRISPR gRNA sequence
catattattactgctcacaa

SEQ ID NO: 307644 - DNA, 20 bp, Artificial
  CRISPR gRNA sequence
tgtccccatgttacagatga

SEQ ID NO: 307645 - DNA, 20 bp, Artificial
  CRISPR gRNA sequence
ccatgttacagatgaaggaa

SEQ ID NO: 307646 - DNA, 20 bp, Artificial
  CRISPR gRNA sequence
ccaggtgtgatggtggctcc

SEQ ID NO: 307647 - DNA, 20 bp, Artificial
  CRISPR gRNA sequence
ggactctcagagagacagac

SEQ ID NO: 307648 - DNA, 20 bp, Artificial
  CRISPR gRNA sequence
aaagtatccctttgcatcaa

SEQ ID NO: 307649 - DNA, 20 bp, Artificial
  CRISPR gRNA sequence
gttcattctgcaaacactgc

SEQ ID NO: 307650 - DNA, 20 bp, Artificial
  CRISPR gRNA sequence
cccactgtgtgccaggtaca

SEQ ID NO: 307651 - DNA, 20 bp, Artificial
  CRISPR gRNA sequence
acaggcaccagcttcccagc

SEQ ID NO: 307652 - DNA, 20 bp, Artificial
  CRISPR gRNA sequence
agaaaaggaaggaactaaga

SEQ ID NO: 307653 - DNA, 20 bp, Artificial
  CRISPR gRNA sequence
gctctcattcaggcaaaggg

SEQ ID NO: 307654 - DNA, 20 bp, Artificial
  CRISPR gRNA sequence
aaagggcaggatgagggagg

SEQ ID NO: 307655 - DNA, 20 bp, Artificial
  CRISPR gRNA sequence
ggaatggcagcagccagtaa

SEQ ID NO: 307656 - DNA, 20 bp, Artificial
  CRISPR gRNA sequence
ccagtaatggggtgggacag

SEQ ID NO: 307657 - DNA, 20 bp, Artificial
  CRISPR gRNA sequence
gtgggacaggggagtgcaga

SEQ ID NO: 307658 - DNA, 20 bp, Artificial
  CRISPR gRNA sequence
atgaaacaggaagtgagagg

SEQ ID NO: 307659 - DNA, 20 bp, Artificial
  CRISPR gRNA sequence
acttatttcacaactttgtg

SEQ ID NO: 307660 - DNA, 20 bp, Artificial
  CRISPR gRNA sequence
tgtagaatgttagtggtaac

SEQ ID NO: 307661 - DNA, 20 bp, Artificial
  CRISPR gRNA sequence
cagacttgttctagagattg

SEQ ID NO: 307662 - DNA, 20 bp, Artificial
  CRISPR gRNA sequence
tggcttcttgtgaggtatac

SEQ ID NO: 307663 - DNA, 20 bp, Artificial
  CRISPR gRNA sequence
caccacagtctctgtggagg

SEQ ID NO: 307664 - DNA, 20 bp, Artificial
  CRISPR gRNA sequence
ctgccgattcatacttgtgg

SEQ ID NO: 307665 - DNA, 20 bp, Artificial
  CRISPR gRNA sequence
cgtcaccagctcgctgagag

SEQ ID NO: 307666 - DNA, 20 bp, Artificial
  CRISPR gRNA sequence
cctggggccttggtttgcct

SEQ ID NO: 307667 - DNA, 20 bp, Artificial
  CRISPR gRNA sequence
ctctctgtacctggcacaca

SEQ ID NO: 307668 - DNA, 20 bp, Artificial
  CRISPR gRNA sequence
gggtattcgagcagtgtttg

SEQ ID NO: 307669 - DNA, 20 bp, Artificial
  CRISPR gRNA sequence
accctctttgagatactggg

SEQ ID NO: 307670 - DNA, 20 bp, Artificial
  CRISPR gRNA sequence
tacaaaataagaaggttact

SEQ ID NO: 307671 - DNA, 20 bp, Artificial
  CRISPR gRNA sequence
ttactgggaatcaaatatat

SEQ ID NO: 307672 - DNA, 20 bp, Artificial
  CRISPR gRNA sequence
aattttagcaaggcttctga

SEQ ID NO: 307673 - DNA, 20 bp, Artificial
  CRISPR gRNA sequence
gacagcaatatggagaaatg

SEQ ID NO: 307674 - DNA, 20 bp, Artificial
  CRISPR gRNA sequence
caagcattgtgtttggtgct

SEQ ID NO: 307675 - DNA, 20 bp, Artificial
  CRISPR gRNA sequence
ccagcctaaactgagatctg

SEQ ID NO: 307676 - DNA, 20 bp, Artificial
  CRISPR gRNA sequence
ctcctcctcccatgaagagg

SEQ ID NO: 307677 - DNA, 20 bp, Artificial
  CRISPR gRNA sequence
cctcccatgaagaggtagag

SEQ ID NO: 307678 - DNA, 20 bp, Artificial
  CRISPR gRNA sequence
tagagttggatctcctctct

SEQ ID NO: 307679 - DNA, 20 bp, Artificial
  CRISPR gRNA sequence
ctctttgaatctgggctagc

SEQ ID NO: 307680 - DNA, 20 bp, Artificial
  CRISPR gRNA sequence
ctgagtgacctgtttgacca

SEQ ID NO: 307681 - DNA, 20 bp, Artificial
  CRISPR gRNA sequence
tgaccatagaatacagtaca

SEQ ID NO: 307682 - DNA, 20 bp, Artificial
  CRISPR gRNA sequence
cagcttctacctgtctctct

SEQ ID NO: 307683 - DNA, 20 bp, Artificial
  CRISPR gRNA sequence
ctctctgggagtaccttatc

SEQ ID NO: 307684 - DNA, 20 bp, Artificial
  CRISPR gRNA sequence
ggagaggactgtatagctgt

SEQ ID NO: 307685 - DNA, 20 bp, Artificial
  CRISPR gRNA sequence
cctgccaagccaccagacat

SEQ ID NO: 307686 - DNA, 20 bp, Artificial
  CRISPR gRNA sequence
ccagacatatgaataaaatc

SEQ ID NO: 307687 - DNA, 20 bp, Artificial
  CRISPR gRNA sequence
aatcttggatcttctagatc

SEQ ID NO: 307688 - DNA, 20 bp, Artificial
  CRISPR gRNA sequence
ctgcttttgcagtgcaatgg

SEQ ID NO: 307689 - DNA, 20 bp, Artificial
  CRISPR gRNA sequence
ctagatcagcactgtccagt

SEQ ID NO: 307690 - DNA, 20 bp, Artificial
  CRISPR gRNA sequence
tgggcagattacctgaggtc

SEQ ID NO: 307691 - DNA, 20 bp, Artificial
  CRISPR gRNA sequence
tactcaggaggctgaggcag

SEQ ID NO: 307692 - DNA, 20 bp, Artificial
  CRISPR gRNA sequence
ctgcactccagcctgggcaa

SEQ ID NO: 307693 - DNA, 20 bp, Artificial
  CRISPR gRNA sequence
aagactccatctcagaaaaa

SEQ ID NO: 307694 - DNA, 20 bp, Artificial
  CRISPR gRNA sequence
ttataatctcaacatgtaat

SEQ ID NO: 307695 - DNA, 20 bp, Artificial
  CRISPR gRNA sequence
aatcagaatacaaattatta

SEQ ID NO: 307696 - DNA, 20 bp, Artificial
  CRISPR gRNA sequence
accaaatcttcaataatcat

SEQ ID NO: 307697 - DNA, 20 bp, Artificial
  CRISPR gRNA sequence
tgaccccaaacattgtgaga

SEQ ID NO: 307698 - DNA, 20 bp, Artificial
  CRISPR gRNA sequence
aaacattgtgagagagggta

SEQ ID NO: 307699 - DNA, 20 bp, Artificial
  CRISPR gRNA sequence
caagaggcaaacagaacaga

SEQ ID NO: 307700 - DNA, 20 bp, Artificial
  CRISPR gRNA sequence
gctaagtaggtgaagggctt

SEQ ID NO: 307701 - DNA, 20 bp, Artificial
  CRISPR gRNA sequence
agggcttgggagttgacagg

SEQ ID NO: 307702 - DNA, 20 bp, Artificial
  CRISPR gRNA sequence
ccatggtttctgtgtagcaa

SEQ ID NO: 307703 - DNA, 20 bp, Artificial
  CRISPR gRNA sequence
cagttggctactgcaattgt

SEQ ID NO: 307704 - DNA, 20 bp, Artificial
  CRISPR gRNA sequence
aagaagatggctgtttggtc

SEQ ID NO: 307705 - DNA, 20 bp, Artificial
  CRISPR gRNA sequence
gcaggtgaagtaagggaaaa

SEQ ID NO: 307706 - DNA, 20 bp, Artificial
  CRISPR gRNA sequence
tggatagatcaagaaatatt

SEQ ID NO: 307707 - DNA, 20 bp, Artificial
  CRISPR gRNA sequence
atatttagaattataattaa

SEQ ID NO: 307708 - DNA, 20 bp, Artificial
  CRISPR gRNA sequence
tctaaaagactgatcccaca

SEQ ID NO: 307709 - DNA, 20 bp, Artificial
  CRISPR gRNA sequence
atgagacagatagctcaaaa

SEQ ID NO: 307710 - DNA, 20 bp, Artificial
  CRISPR gRNA sequence
atagctcaaaaatgagttag

SEQ ID NO: 307711 - DNA, 20 bp, Artificial
  CRISPR gRNA sequence
gagagactaatactaacatg

SEQ ID NO: 307712 - DNA, 20 bp, Artificial
  CRISPR gRNA sequence
actaacatgatgaatctcct

SEQ ID NO: 307713 - DNA, 20 bp, Artificial
  CRISPR gRNA sequence
aatctcctgagggtaagtgt

SEQ ID NO: 307714 - DNA, 20 bp, Artificial
  CRISPR gRNA sequence
aatttcatccaatcctagtg

SEQ ID NO: 307715 - DNA, 20 bp, Artificial
  CRISPR gRNA sequence
ttctgtgaggtcagttatac

SEQ ID NO: 307716 - DNA, 20 bp, Artificial
  CRISPR gRNA sequence
aagggcagcaaggttcacta

SEQ ID NO: 307717 - DNA, 20 bp, Artificial
  CRISPR gRNA sequence
tgaagaacaactaaaaggac

SEQ ID NO: 307718 - DNA, 20 bp, Artificial
  CRISPR gRNA sequence
gaaaagattgcaagtatatg

SEQ ID NO: 307719 - DNA, 20 bp, Artificial
  CRISPR gRNA sequence
atgtaagggcccttccatgg

SEQ ID NO: 307720 - DNA, 20 bp, Artificial
  CRISPR gRNA sequence
tagagagctacaagcaatga

SEQ ID NO: 307721 - DNA, 20 bp, Artificial
  CRISPR gRNA sequence
agtactattcaaaccaaagt

SEQ ID NO: 307722 - DNA, 20 bp, Artificial
  CRISPR gRNA sequence
acagaagagacattttagga

SEQ ID NO: 307723 - DNA, 20 bp, Artificial
  CRISPR gRNA sequence
agacattttaggagcgaatc

SEQ ID NO: 307724 - DNA, 20 bp, Artificial
  CRISPR gRNA sequence
ttttaggagcgaatctcgaa

SEQ ID NO: 307725 - DNA, 20 bp, Artificial
  CRISPR gRNA sequence
aagattctcattacatttcc

SEQ ID NO: 307726 - DNA, 20 bp, Artificial
  CRISPR gRNA sequence
gacactccatcgctctcacc

SEQ ID NO: 307727 - DNA, 20 bp, Artificial
  CRISPR gRNA sequence
tagacaatatggtacattta

SEQ ID NO: 307728 - DNA, 20 bp, Artificial
  CRISPR gRNA sequence
tacatttaaaggatccctgt

SEQ ID NO: 307729 - DNA, 20 bp, Artificial
  CRISPR gRNA sequence
ttaaaggatccctgtctggg

SEQ ID NO: 307730 - DNA, 20 bp, Artificial
  CRISPR gRNA sequence
caagcactcctacagcttgg

SEQ ID NO: 307731 - DNA, 20 bp, Artificial
  CRISPR gRNA sequence
gttgagctgagctttgacag

SEQ ID NO: 307732 - DNA, 20 bp, Artificial
  CRISPR gRNA sequence
ccctgcatgttagaacttgc

SEQ ID NO: 307733 - DNA, 20 bp, Artificial
  CRISPR gRNA sequence
gcatccgaggcatctgttta

SEQ ID NO: 307734 - DNA, 20 bp, Artificial
  CRISPR gRNA sequence
gaaccactttttagtgttga

SEQ ID NO: 307735 - DNA, 20 bp, Artificial
  CRISPR gRNA sequence
ttagtgttgattgagtttca

SEQ ID NO: 307736 - DNA, 20 bp, Artificial
  CRISPR gRNA sequence
ttaaggacacatggaaatgg

SEQ ID NO: 307737 - DNA, 20 bp, Artificial
  CRISPR gRNA sequence
tggaaatggaggagtgacca

SEQ ID NO: 307738 - DNA, 20 bp, Artificial
  CRISPR gRNA sequence
gcctgcagcagaggttgtct

SEQ ID NO: 307739 - DNA, 20 bp, Artificial
  CRISPR gRNA sequence
agggcatggaaagtcaaata

SEQ ID NO: 307740 - DNA, 20 bp, Artificial
  CRISPR gRNA sequence
ttaacagaaaattggaagtt

SEQ ID NO: 307741 - DNA, 20 bp, Artificial
  CRISPR gRNA sequence
caagaggtgacggctggtat

SEQ ID NO: 307742 - DNA, 20 bp, Artificial
  CRISPR gRNA sequence
ggcagtcggcatgatgagga

SEQ ID NO: 307743 - DNA, 20 bp, Artificial
  CRISPR gRNA sequence
gtcggcatgatgaggaaggg

SEQ ID NO: 307744 - DNA, 20 bp, Artificial
  CRISPR gRNA sequence
atgtctccttctagcttagg

SEQ ID NO: 307745 - DNA, 20 bp, Artificial
  CRISPR gRNA sequence
atttgtggagatttttctga

SEQ ID NO: 307746 - DNA, 20 bp, Artificial
  CRISPR gRNA sequence
ccgaatgcttgttttctttc

SEQ ID NO: 307747 - DNA, 20 bp, Artificial
  CRISPR gRNA sequence
gacatgaggagagctgcatc

SEQ ID NO: 307748 - DNA, 20 bp, Artificial
  CRISPR gRNA sequence
tgaggagagctgcatcaagg

SEQ ID NO: 307749 - DNA, 20 bp, Artificial
  CRISPR gRNA sequence
tcgcagatttagaaggagca

SEQ ID NO: 307750 - DNA, 20 bp, Artificial
  CRISPR gRNA sequence
gcaactgaaatattaaaatg

SEQ ID NO: 307751 - DNA, 20 bp, Artificial
  CRISPR gRNA sequence
tacaagacacgcctagttct

SEQ ID NO: 307752 - DNA, 20 bp, Artificial
  CRISPR gRNA sequence
ctagttctccgagttgtatc

SEQ ID NO: 307753 - DNA, 20 bp, Artificial
  CRISPR gRNA sequence
gtatctagaatcgaaacttt

SEQ ID NO: 307754 - DNA, 20 bp, Artificial
  CRISPR gRNA sequence
caccctatttcaaactattg

SEQ ID NO: 307755 - DNA, 20 bp, Artificial
  CRISPR gRNA sequence
ttcctttttgccaaaaaggt

SEQ ID NO: 307756 - DNA, 20 bp, Artificial
  CRISPR gRNA sequence
accagtcctaccctgctgct

SEQ ID NO: 307757 - DNA, 20 bp, Artificial
  CRISPR gRNA sequence
caaatgctagctggaaggaa

SEQ ID NO: 307758 - DNA, 20 bp, Artificial
  CRISPR gRNA sequence
aaaggacatggaacttagaa

SEQ ID NO: 307759 - DNA, 20 bp, Artificial
  CRISPR gRNA sequence
gaaaggaatcatatccgtcc

SEQ ID NO: 307760 - DNA, 20 bp, Artificial
  CRISPR gRNA sequence
cctatttcccaaacctcagc

SEQ ID NO: 307761 - DNA, 20 bp, Artificial
  CRISPR gRNA sequence
tacctgcctggccatgaaag

SEQ ID NO: 307762 - DNA, 20 bp, Artificial
  CRISPR gRNA sequence
gaaaggtggattgccagcac

SEQ ID NO: 307763 - DNA, 20 bp, Artificial
  CRISPR gRNA sequence
caaccttgatttttctgctg

SEQ ID NO: 307764 - DNA, 20 bp, Artificial
  CRISPR gRNA sequence
agaggcatatgaaattcaag

SEQ ID NO: 307765 - DNA, 20 bp, Artificial
  CRISPR gRNA sequence
tccccactaggctagaaaac

SEQ ID NO: 307766 - DNA, 20 bp, Artificial
  CRISPR gRNA sequence
aagcacttaataactatatt

SEQ ID NO: 307767 - DNA, 20 bp, Artificial
  CRISPR gRNA sequence
ataaaagcttccattataca

SEQ ID NO: 307768 - DNA, 20 bp, Artificial
  CRISPR gRNA sequence
cttcattattacagtttaag

SEQ ID NO: 307769 - DNA, 20 bp, Artificial
  CRISPR gRNA sequence
cttgggctcttttttgaccc

SEQ ID NO: 307770 - DNA, 20 bp, Artificial
  CRISPR gRNA sequence
gtgccaagtggggctaatat

SEQ ID NO: 307771 - DNA, 20 bp, Artificial
  CRISPR gRNA sequence
ctaatattgggatggggcac

SEQ ID NO: 307772 - DNA, 20 bp, Artificial
  CRISPR gRNA sequence
gatgggaagaaatattgggg

SEQ ID NO: 307773 - DNA, 20 bp, Artificial
  CRISPR gRNA sequence
gaggaggaaatcccccttct

SEQ ID NO: 307774 - DNA, 20 bp, Artificial
  CRISPR gRNA sequence
agctcacgaaaaacagatga

SEQ ID NO: 307775 - DNA, 20 bp, Artificial
  CRISPR gRNA sequence
gaacacagaagcaaggtggt

SEQ ID NO: 307776 - DNA, 20 bp, Artificial
  CRISPR gRNA sequence
ggtggtaagaataaaccaaa

SEQ ID NO: 307777 - DNA, 20 bp, Artificial
  CRISPR gRNA sequence
aggtgggcatttccactgat

SEQ ID NO: 307778 - DNA, 20 bp, Artificial
  CRISPR gRNA sequence
agcactgtccctggctgtgg

SEQ ID NO: 307779 - DNA, 20 bp, Artificial
  CRISPR gRNA sequence
gggagctcgcaaatactcct

SEQ ID NO: 307780 - DNA, 20 bp, Artificial
  CRISPR gRNA sequence
cttttggtttattcttacca

SEQ ID NO: 307781 - DNA, 20 bp, Artificial
  CRISPR gRNA sequence
tgtgttccttgggaatgctg

SEQ ID NO: 307782 - DNA, 20 bp, Artificial
  CRISPR gRNA sequence
tggacaggcatttgtgacag

SEQ ID NO: 307783 - DNA, 20 bp, Artificial
  CRISPR gRNA sequence
gccggccagagaatgagtaa

SEQ ID NO: 307784 - DNA, 20 bp, Artificial
  CRISPR gRNA sequence
agtaaaagggattgcagaga

SEQ ID NO: 307785 - DNA, 20 bp, Artificial
  CRISPR gRNA sequence
atgcttaaaacctctgacca

SEQ ID NO: 307786 - DNA, 20 bp, Artificial
  CRISPR gRNA sequence
ttaaaacctctgaccatcag

SEQ ID NO: 307787 - DNA, 20 bp, Artificial
  CRISPR gRNA sequence
tctgaccatcaggtttgctt

SEQ ID NO: 307788 - DNA, 20 bp, Artificial
  CRISPR gRNA sequence
tcttcctgccagatcccttc

SEQ ID NO: 307789 - DNA, 20 bp, Artificial
  CRISPR gRNA sequence
ccaaataattggcagctgtt

SEQ ID NO: 307790 - DNA, 20 bp, Artificial
  CRISPR gRNA sequence
ccagtgggaaatccagagaa

SEQ ID NO: 307791 - DNA, 20 bp, Artificial
  CRISPR gRNA sequence
gcctctctgcaatggactta

SEQ ID NO: 307792 - DNA, 20 bp, Artificial
  CRISPR gRNA sequence
gcaatggacttacttggctt

SEQ ID NO: 307793 - DNA, 20 bp, Artificial
  CRISPR gRNA sequence
ggtcaaaaaagagcccaagc

SEQ ID NO: 307794 - DNA, 20 bp, Artificial
  CRISPR gRNA sequence
caagcaagtgattgaacata

SEQ ID NO: 307795 - DNA, 20 bp, Artificial
  CRISPR gRNA sequence
atttgcatttgcatttgcaa

SEQ ID NO: 307796 - DNA, 20 bp, Artificial
  CRISPR gRNA sequence
gttctggagagccaggtgaa

SEQ ID NO: 307797 - DNA, 20 bp, Artificial
  CRISPR gRNA sequence
ctgtaataatgaaggaaatg

SEQ ID NO: 307798 - DNA, 20 bp, Artificial
  CRISPR gRNA sequence
tgagctatcctgtgtataat

SEQ ID NO: 307799 - DNA, 20 bp, Artificial
  CRISPR gRNA sequence
ttattcctaatatagttatt

SEQ ID NO: 307800 - DNA, 20 bp, Artificial
  CRISPR gRNA sequence
gacataaggaaaagctgcac

SEQ ID NO: 307801 - DNA, 20 bp, Artificial
  CRISPR gRNA sequence
taaacatgactacatagcaa

SEQ ID NO: 307802 - DNA, 20 bp, Artificial
  CRISPR gRNA sequence
ttgttctatgtgactatatc

SEQ ID NO: 307803 - DNA, 20 bp, Artificial
  CRISPR gRNA sequence
cttcctgggtgggggtgagg

SEQ ID NO: 307804 - DNA, 20 bp, Artificial
  CRISPR gRNA sequence
aagatgaagagataagccaa

SEQ ID NO: 307805 - DNA, 20 bp, Artificial
  CRISPR gRNA sequence
gaaaaatcaaggttgaaata

SEQ ID NO: 307806 - DNA, 20 bp, Artificial
  CRISPR gRNA sequence
aggttaggggtccctaggcc

SEQ ID NO: 307807 - DNA, 20 bp, Artificial
  CRISPR gRNA sequence
gggtccctaggccaggggat

SEQ ID NO: 307808 - DNA, 20 bp, Artificial
  CRISPR gRNA sequence
tcctctcttctcctatacag

SEQ ID NO: 307809 - DNA, 20 bp, Artificial
  CRISPR gRNA sequence
gtgctgtttccgaactgtac

SEQ ID NO: 307810 - DNA, 20 bp, Artificial
  CRISPR gRNA sequence
acattggcttacactcgggc

SEQ ID NO: 307811 - DNA, 20 bp, Artificial
  CRISPR gRNA sequence
cctcctttattcatggacgg

SEQ ID NO: 307812 - DNA, 20 bp, Artificial
  CRISPR gRNA sequence
ttaacttgaacctaatgcct

SEQ ID NO: 307813 - DNA, 20 bp, Artificial
  CRISPR gRNA sequence
gctagcatttgcattttaac

SEQ ID NO: 307814 - DNA, 20 bp, Artificial
  CRISPR gRNA sequence
tcaagttgtggccctgaaat

SEQ ID NO: 307815 - DNA, 20 bp, Artificial
  CRISPR gRNA sequence
cttcctctctttgaccatga

SEQ ID NO: 307816 - DNA, 20 bp, Artificial
  CRISPR gRNA sequence
aaatcgttctcaaattcatc

SEQ ID NO: 307817 - DNA, 20 bp, Artificial
  CRISPR gRNA sequence
atagtttgaaatagggtgtg

SEQ ID NO: 307818 - DNA, 20 bp, Artificial
  CRISPR gRNA sequence
atagggtgtgccttgattca

SEQ ID NO: 307819 - DNA, 20 bp, Artificial
  CRISPR gRNA sequence
gtgtgccttgattcagaaag

SEQ ID NO: 307820 - DNA, 20 bp, Artificial
  CRISPR gRNA sequence
agaactaggcgtgtcttgta

SEQ ID NO: 307821 - DNA, 20 bp, Artificial
  CRISPR gRNA sequence
tggaaacactgtgctctcaa

SEQ ID NO: 307822 - DNA, 20 bp, Artificial
  CRISPR gRNA sequence
tctccacaaatggggaataa

SEQ ID NO: 307823 - DNA, 20 bp, Artificial
  CRISPR gRNA sequence
tagaaggagacatggctggt

SEQ ID NO: 307824 - DNA, 20 bp, Artificial
  CRISPR gRNA sequence
catcatgccgactgcctctt

SEQ ID NO: 307825 - DNA, 20 bp, Artificial
  CRISPR gRNA sequence
caagtcgacgagcctgtaat

SEQ ID NO: 307826 - DNA, 20 bp, Artificial
  CRISPR gRNA sequence
ataccagccgtcacctcttg

SEQ ID NO: 307827 - DNA, 20 bp, Artificial
  CRISPR gRNA sequence
ccctattaggctatcttgct

SEQ ID NO: 307828 - DNA, 20 bp, Artificial
  CRISPR gRNA sequence
acaacctctgctgcaggcca

SEQ ID NO: 307829 - DNA, 20 bp, Artificial
  CRISPR gRNA sequence
atgtgtccttaaaaactgtt

SEQ ID NO: 307830 - DNA, 20 bp, Artificial
  CRISPR gRNA sequence
ctgtctagggaagaattatt

SEQ ID NO: 307831 - DNA, 20 bp, Artificial
  CRISPR gRNA sequence
ttgttattgttaaaggaaga

SEQ ID NO: 307832 - DNA, 20 bp, Artificial
  CRISPR gRNA sequence
accacccttccaagctgtag

SEQ ID NO: 307833 - DNA, 20 bp, Artificial
  CRISPR gRNA sequence
agttcaaccacttactcaat

SEQ ID NO: 307834 - DNA, 20 bp, Artificial
  CRISPR gRNA sequence
ttctgtgttatcacccccac

SEQ ID NO: 307835 - DNA, 20 bp, Artificial
  CRISPR gRNA sequence
tttgaatagtacttgtgaca

SEQ ID NO: 307836 - DNA, 20 bp, Artificial
  CRISPR gRNA sequence
acctcacaagaaaatccagt

SEQ ID NO: 307837 - DNA, 20 bp, Artificial
  CRISPR gRNA sequence
attgcttgtagctctctatt

SEQ ID NO: 307838 - DNA, 20 bp, Artificial
  CRISPR gRNA sequence
gtgataccacaagcgatgtg

SEQ ID NO: 307839 - DNA, 20 bp, Artificial
  CRISPR gRNA sequence
ttcagtgaatgaatcctaca

SEQ ID NO: 307840 - DNA, 20 bp, Artificial
  CRISPR gRNA sequence
gccataccacactaacactt

SEQ ID NO: 307841 - DNA, 20 bp, Artificial
  CRISPR gRNA sequence
cactaacacttatgtgattt

SEQ ID NO: 307842 - DNA, 20 bp, Artificial
  CRISPR gRNA sequence
ttgttatttcaaaactgaag

SEQ ID NO: 307843 - DNA, 20 bp, Artificial
  CRISPR gRNA sequence
agattcttacacttaccctc

SEQ ID NO: 307844 - DNA, 20 bp, Artificial
  CRISPR gRNA sequence
gttagtattagtctctcttt

SEQ ID NO: 307845 - DNA, 20 bp, Artificial
  CRISPR gRNA sequence
ttttgtgccatctgcacagc

SEQ ID NO: 307846 - DNA, 20 bp, Artificial
  CRISPR gRNA sequence
gtgccatctgcacagcataa

SEQ ID NO: 307847 - DNA, 20 bp, Artificial
  CRISPR gRNA sequence
cacagcataagtttgatttc

SEQ ID NO: 307848 - DNA, 20 bp, Artificial
  CRISPR gRNA sequence
tgatttctgttgcttttatt

SEQ ID NO: 307849 - DNA, 20 bp, Artificial
  CRISPR gRNA sequence
ctcaaacaattgcagtagcc

SEQ ID NO: 307850 - DNA, 20 bp, Artificial
  CRISPR gRNA sequence
attggtcttcctgcatctgt

SEQ ID NO: 307851 - DNA, 20 bp, Artificial
  CRISPR gRNA sequence
gcacctacctattcaatctg

SEQ ID NO: 307852 - DNA, 20 bp, Artificial
  CRISPR gRNA sequence
tacaaactgtctccaaactt

SEQ ID NO: 307853 - DNA, 20 bp, Artificial
  CRISPR gRNA sequence
gaatcctttaccctctctca

SEQ ID NO: 307854 - DNA, 20 bp, Artificial
  CRISPR gRNA sequence
caggaatttgagcgggcctt

SEQ ID NO: 307855 - DNA, 20 bp, Artificial
  CRISPR gRNA sequence
gctgatctggagatgcactg

SEQ ID NO: 307856 - DNA, 20 bp, Artificial
  CRISPR gRNA sequence
gctataactataaaacaccc

SEQ ID NO: 307857 - DNA, 20 bp, Artificial
  CRISPR gRNA sequence
taaaacacccacatgattat

SEQ ID NO: 307858 - DNA, 20 bp, Artificial
  CRISPR gRNA sequence
atattcgttaataatttgta

SEQ ID NO: 307859 - DNA, 20 bp, Artificial
  CRISPR gRNA sequence
atttgtattctgattacatg

SEQ ID NO: 307860 - DNA, 20 bp, Artificial
  CRISPR gRNA sequence
atttctttaatgtgactact

SEQ ID NO: 307861 - DNA, 20 bp, Artificial
  CRISPR gRNA sequence
acaagttttcaaattatatc

SEQ ID NO: 307862 - DNA, 20 bp, Artificial
  CRISPR gRNA sequence
ttatatctgtggcttgtaat

SEQ ID NO: 307863 - DNA, 20 bp, Artificial
  CRISPR gRNA sequence
aagctctgcctcccaggttc

SEQ ID NO: 307864 - DNA, 20 bp, Artificial
  CRISPR gRNA sequence
ttttgtatttttagtagaga

SEQ ID NO: 307865 - DNA, 20 bp, Artificial
  CRISPR gRNA sequence
cacctcggcctcccaaagtg

SEQ ID NO: 307866 - DNA, 20 bp, Artificial
  CRISPR gRNA sequence
agcatgagccaccacacctg

SEQ ID NO: 307867 - DNA, 20 bp, Artificial
  CRISPR gRNA sequence
ctgatctagagcaggagtca

SEQ ID NO: 307868 - DNA, 20 bp, Artificial
  CRISPR gRNA sequence
tctatgaaaggccacataga

SEQ ID NO: 307869 - DNA, 20 bp, Artificial
  CRISPR gRNA sequence
aaggccacatagaaaatgtt

SEQ ID NO: 307870 - DNA, 20 bp, Artificial
  CRISPR gRNA sequence
attaataaaaataggtggta

SEQ ID NO: 307871 - DNA, 20 bp, Artificial
  CRISPR gRNA sequence
gccagatttggcctacaggc

SEQ ID NO: 307872 - DNA, 20 bp, Artificial
  CRISPR gRNA sequence
tgacccctgatctagaagat

SEQ ID NO: 307873 - DNA, 20 bp, Artificial
  CRISPR gRNA sequence
aagattttattcatatgtct

SEQ ID NO: 307874 - DNA, 20 bp, Artificial
  CRISPR gRNA sequence
agagagacaggtagaagctg

SEQ ID NO: 307875 - DNA, 20 bp, Artificial
  CRISPR gRNA sequence
aaacaggtcactcaggctag

SEQ ID NO: 307876 - DNA, 20 bp, Artificial
  CRISPR gRNA sequence
gaggaggagtagccaaggat

SEQ ID NO: 307877 - DNA, 20 bp, Artificial
  CRISPR gRNA sequence
tattatatcattcttcagat

SEQ ID NO: 307878 - DNA, 20 bp, Artificial
  CRISPR gRNA sequence
cttttgtagcacttgtcata

SEQ ID NO: 307879 - DNA, 20 bp, Artificial
  CRISPR gRNA sequence
agctagttttacatttctct

SEQ ID NO: 307880 - DNA, 20 bp, Artificial
  CRISPR gRNA sequence
gtatgattacttgatcacta

SEQ ID NO: 307881 - DNA, 20 bp, Artificial
  CRISPR gRNA sequence
taggcaaccacgtgaagagg

SEQ ID NO: 307882 - DNA, 20 bp, Artificial
  CRISPR gRNA sequence
ccacgtgaagaggaactgtt

SEQ ID NO: 307883 - DNA, 20 bp, Artificial
  CRISPR gRNA sequence
tatattcctagcaccaaaca

SEQ ID NO: 307884 - DNA, 20 bp, Artificial
  CRISPR gRNA sequence
ccttgctaaaattcaaatat

SEQ ID NO: 307885 - DNA, 20 bp, Artificial
  CRISPR gRNA sequence
actcttcccagtatctcaaa

SEQ ID NO: 307886 - DNA, 20 bp, Artificial
  CRISPR gRNA sequence
ttctgccctgagctgctcaa

SEQ ID NO: 307887 - DNA, 20 bp, Artificial
  CRISPR gRNA sequence
ctgctgtaatctggacaggc

SEQ ID NO: 307888 - DNA, 20 bp, Artificial
  CRISPR gRNA sequence
acaggcaccagcttcccagc

SEQ ID NO: 307889 - DNA, 20 bp, Artificial
  CRISPR gRNA sequence
accagcttcccagcgtgggt

SEQ ID NO: 307890 - DNA, 20 bp, Artificial
  CRISPR gRNA sequence
tgacgtgccagtccagcagg

SEQ ID NO: 307891 - DNA, 20 bp, Artificial
  CRISPR gRNA sequence
tccacagagactgtggtgtc

SEQ ID NO: 307892 - DNA, 20 bp, Artificial
  CRISPR gRNA sequence
tgacactgagtagatgtagc

SEQ ID NO: 307893 - DNA, 20 bp, Artificial
  CRISPR gRNA sequence
tgtggacccctcctctcact

SEQ ID NO: 307894 - DNA, 20 bp, Artificial
  CRISPR gRNA sequence
ttccccagagctcttctaga

SEQ ID NO: 307895 - DNA, 20 bp, Artificial
  CRISPR gRNA sequence
gcacacagtgggtattcgag

SEQ ID NO: 307896 - DNA, 20 bp, Artificial
  CRISPR gRNA sequence
gtctgtctctctgagagtcc

SEQ ID NO: 307897 - DNA, 20 bp, Artificial
  CRISPR gRNA sequence
gtgaaagaaacacaggctgc

SEQ ID NO: 307898 - DNA, 20 bp, Artificial
  CRISPR gRNA sequence
ccctgttgtgagcagtaata

SEQ ID NO: 307899 - DNA, 20 bp, Artificial
  CRISPR gRNA sequence
agacatacaaagtaagtgaa

SEQ ID NO: 307900 - DNA, 20 bp, Artificial
  CRISPR gRNA sequence
ggattacggcaggtgctctt

SEQ ID NO: 307901 - DNA, 20 bp, Artificial
  CRISPR gRNA sequence
tttacatggaggctcctctt

SEQ ID NO: 307902 - DNA, 20 bp, Artificial
  CRISPR gRNA sequence
ccttattcatagaccttatt

SEQ ID NO: 307903 - DNA, 20 bp, Artificial
  CRISPR gRNA sequence
tgctctctccctccgaaggc

SEQ ID NO: 307904 - DNA, 20 bp, Artificial
  CRISPR gRNA sequence
acaggcccactggagaaagt

SEQ ID NO: 307905 - DNA, 20 bp, Artificial
  CRISPR gRNA sequence
cggccaatgacattggagaa

SEQ ID NO: 307906 - DNA, 20 bp, Artificial
  CRISPR gRNA sequence
actgataaactaagtgtcca

SEQ ID NO: 307907 - DNA, 20 bp, Artificial
  CRISPR gRNA sequence
ggtctccaaattaacattag

SEQ ID NO: 307908 - DNA, 20 bp, Artificial
  CRISPR gRNA sequence
aacattagtgaagcttactg

SEQ ID NO: 307909 - DNA, 20 bp, Artificial
  CRISPR gRNA sequence
attgttactcctgggccagg

SEQ ID NO: 307910 - DNA, 20 bp, Artificial
  CRISPR gRNA sequence
ggccaggattttgaggagag

SEQ ID NO: 307911 - DNA, 20 bp, Artificial
  CRISPR gRNA sequence
cagactttggcagaagtgtg

SEQ ID NO: 307912 - DNA, 20 bp, Artificial
  CRISPR gRNA sequence
agtgtgttaggcttactctg

SEQ ID NO: 307913 - DNA, 20 bp, Artificial
  CRISPR gRNA sequence
acggaaggaaggtaaggaga

SEQ ID NO: 307914 - DNA, 20 bp, Artificial
  CRISPR gRNA sequence
gcttctaacccaggggaaga

SEQ ID NO: 307915 - DNA, 20 bp, Artificial
  CRISPR gRNA sequence
aactgagaaatcaaaaatgg

SEQ ID NO: 307916 - DNA, 20 bp, Artificial
  CRISPR gRNA sequence
tactgattccttgtcagggt

SEQ ID NO: 307917 - DNA, 20 bp, Artificial
  CRISPR gRNA sequence
gaattacaggggccatttgt

SEQ ID NO: 307918 - DNA, 20 bp, Artificial
  CRISPR gRNA sequence
tccaagattccttagagcaa

SEQ ID NO: 307919 - DNA, 20 bp, Artificial
  CRISPR gRNA sequence
catgtaattatttgaatgaa

SEQ ID NO: 307920 - DNA, 20 bp, Artificial
  CRISPR gRNA sequence
taaatttatagtaaaatata

SEQ ID NO: 307921 - DNA, 20 bp, Artificial
  CRISPR gRNA sequence
aaatataatttgatttgtgt

SEQ ID NO: 307922 - DNA, 20 bp, Artificial
  CRISPR gRNA sequence
tctttggttaggtcgaacat

SEQ ID NO: 307923 - DNA, 20 bp, Artificial
  CRISPR gRNA sequence
taggtcgaacataatggttt

SEQ ID NO: 307924 - DNA, 20 bp, Artificial
  CRISPR gRNA sequence
ttttttggtttgcaaaccat

SEQ ID NO: 307925 - DNA, 20 bp, Artificial
  CRISPR gRNA sequence
attcccatattaggtgggag

SEQ ID NO: 307926 - DNA, 20 bp, Artificial
  CRISPR gRNA sequence
actatctgtacatttctttt

SEQ ID NO: 307927 - DNA, 20 bp, Artificial
  CRISPR gRNA sequence
gtacatttcttttgcccgct

SEQ ID NO: 307928 - DNA, 20 bp, Artificial
  CRISPR gRNA sequence
tgggtctttggcctttttct

SEQ ID NO: 307929 - DNA, 20 bp, Artificial
  CRISPR gRNA sequence
gtaagagctgaacagctggt

SEQ ID NO: 307930 - DNA, 20 bp, Artificial
  CRISPR gRNA sequence
tgtctccctcccttccagcc

SEQ ID NO: 307931 - DNA, 20 bp, Artificial
  CRISPR gRNA sequence
cccttccagccaatagattt

SEQ ID NO: 307932 - DNA, 20 bp, Artificial
  CRISPR gRNA sequence
gtatgggaacagagttctct

SEQ ID NO: 307933 - DNA, 20 bp, Artificial
  CRISPR gRNA sequence
gagttctctgtctgattcct

SEQ ID NO: 307934 - DNA, 20 bp, Artificial
  CRISPR gRNA sequence
cacaaaaagacaaatactgt

SEQ ID NO: 307935 - DNA, 20 bp, Artificial
  CRISPR gRNA sequence
aggaggagagaaagaagagt

SEQ ID NO: 307936 - DNA, 20 bp, Artificial
  CRISPR gRNA sequence
agttattgtttaataggtat

SEQ ID NO: 307937 - DNA, 20 bp, Artificial
  CRISPR gRNA sequence
ttgtttaataggtatagagg

SEQ ID NO: 307938 - DNA, 20 bp, Artificial
  CRISPR gRNA sequence
gtgtattatgccacaactaa

SEQ ID NO: 307939 - DNA, 20 bp, Artificial
  CRISPR gRNA sequence
aaacttatgagatctaattt

SEQ ID NO: 307940 - DNA, 20 bp, Artificial
  CRISPR gRNA sequence
cgtataatctcataaactaa

SEQ ID NO: 307941 - DNA, 20 bp, Artificial
  CRISPR gRNA sequence
taataaagatttctaaataa

SEQ ID NO: 307942 - DNA, 20 bp, Artificial
  CRISPR gRNA sequence
tattcttcaaccctttggtc

SEQ ID NO: 307943 - DNA, 20 bp, Artificial
  CRISPR gRNA sequence
tcaaccctttggtcaaacga

SEQ ID NO: 307944 - DNA, 20 bp, Artificial
  CRISPR gRNA sequence
aacgattctgcttctaggaa

SEQ ID NO: 307945 - DNA, 20 bp, Artificial
  CRISPR gRNA sequence
tgtgtgatatggcatataat

SEQ ID NO: 307946 - DNA, 20 bp, Artificial
  CRISPR gRNA sequence
tcaaggttttccattgcaac

SEQ ID NO: 307947 - DNA, 20 bp, Artificial
  CRISPR gRNA sequence
cgtacatagtatgctaccat

SEQ ID NO: 307948 - DNA, 20 bp, Artificial
  CRISPR gRNA sequence
aaagaaaacagaatatgggt

SEQ ID NO: 307949 - DNA, 20 bp, Artificial
  CRISPR gRNA sequence
aacagaatatgggtcaatgt

SEQ ID NO: 307950 - DNA, 20 bp, Artificial
  CRISPR gRNA sequence
aatatgggtcaatgtttttg

SEQ ID NO: 307951 - DNA, 20 bp, Artificial
  CRISPR gRNA sequence
gggacaaggctgggaggcag

SEQ ID NO: 307952 - DNA, 20 bp, Artificial
  CRISPR gRNA sequence
gagcagaggaaagaaacaca

SEQ ID NO: 307953 - DNA, 20 bp, Artificial
  CRISPR gRNA sequence
gtgcatcttttcctggaaag

SEQ ID NO: 307954 - DNA, 20 bp, Artificial
  CRISPR gRNA sequence
tcttttcctggaaagaattg

SEQ ID NO: 307955 - DNA, 20 bp, Artificial
  CRISPR gRNA sequence
cctgtgaattaattcactgg

SEQ ID NO: 307956 - DNA, 20 bp, Artificial
  CRISPR gRNA sequence
gtccccctcagtgcaaattg

SEQ ID NO: 307957 - DNA, 20 bp, Artificial
  CRISPR gRNA sequence
ctctgtatcatattcctgta

SEQ ID NO: 307958 - DNA, 20 bp, Artificial
  CRISPR gRNA sequence
gtatcatattcctgtatttg

SEQ ID NO: 307959 - DNA, 20 bp, Artificial
  CRISPR gRNA sequence
tgtatttggtttgcttttcc

SEQ ID NO: 307960 - DNA, 20 bp, Artificial
  CRISPR gRNA sequence
gttggtcacctctccttatt

SEQ ID NO: 307961 - DNA, 20 bp, Artificial
  CRISPR gRNA sequence
aagcaaagcatatccttttt

SEQ ID NO: 307962 - DNA, 20 bp, Artificial
  CRISPR gRNA sequence
cctttttcttggcttcatca

SEQ ID NO: 307963 - DNA, 20 bp, Artificial
  CRISPR gRNA sequence
gttgttaaacataaaaattc

SEQ ID NO: 307964 - DNA, 20 bp, Artificial
  CRISPR gRNA sequence
tgaggcccaggaaactctcc

SEQ ID NO: 307965 - DNA, 20 bp, Artificial
  CRISPR gRNA sequence
caggtgatttttactcacat

SEQ ID NO: 307966 - DNA, 20 bp, Artificial
  CRISPR gRNA sequence
ccacaggaaaacaaaaggaa

SEQ ID NO: 307967 - DNA, 20 bp, Artificial
  CRISPR gRNA sequence
ctaagcgtaaatgcaatact

SEQ ID NO: 307968 - DNA, 20 bp, Artificial
  CRISPR gRNA sequence
tgtgggagaggtgtaaagag

SEQ ID NO: 307969 - DNA, 20 bp, Artificial
  CRISPR gRNA sequence
ggtgtaaagagagctgcttt

SEQ ID NO: 307970 - DNA, 20 bp, Artificial
  CRISPR gRNA sequence
atctcttccattgtgagact

SEQ ID NO: 307971 - DNA, 20 bp, Artificial
  CRISPR gRNA sequence
tggagctaagagcaaaagga

SEQ ID NO: 307972 - DNA, 20 bp, Artificial
  CRISPR gRNA sequence
tcccaaactccacgtccagg

SEQ ID NO: 307973 - DNA, 20 bp, Artificial
  CRISPR gRNA sequence
caggtcatgttttggtgaac

SEQ ID NO: 307974 - DNA, 20 bp, Artificial
  CRISPR gRNA sequence
tgttttggtgaacatcggtt

SEQ ID NO: 307975 - DNA, 20 bp, Artificial
  CRISPR gRNA sequence
ttttcagtttccttttctaa

SEQ ID NO: 307976 - DNA, 20 bp, Artificial
  CRISPR gRNA sequence
ctgctctctggtaagaacct

SEQ ID NO: 307977 - DNA, 20 bp, Artificial
  CRISPR gRNA sequence
aagcccaggcctgagacttg

SEQ ID NO: 307978 - DNA, 20 bp, Artificial
  CRISPR gRNA sequence
tcctggagaagaaggaagtg

SEQ ID NO: 307979 - DNA, 20 bp, Artificial
  CRISPR gRNA sequence
gggatggagctctccccccc

SEQ ID NO: 307980 - DNA, 20 bp, Artificial
  CRISPR gRNA sequence
tctcttctggtcttctctga

SEQ ID NO: 307981 - DNA, 20 bp, Artificial
  CRISPR gRNA sequence
agtctcccttcattcggagc

SEQ ID NO: 307982 - DNA, 20 bp, Artificial
  CRISPR gRNA sequence
tgcacatacctcatggttgc

SEQ ID NO: 307983 - DNA, 20 bp, Artificial
  CRISPR gRNA sequence
gatgttcagctaattgtgtc

SEQ ID NO: 307984 - DNA, 20 bp, Artificial
  CRISPR gRNA sequence
tatagtggagccaatgaagc

SEQ ID NO: 307985 - DNA, 20 bp, Artificial
  CRISPR gRNA sequence
tagcagtgtggtcacctgtc

SEQ ID NO: 307986 - DNA, 20 bp, Artificial
  CRISPR gRNA sequence
cctcacaaaactcagatctt

SEQ ID NO: 307987 - DNA, 20 bp, Artificial
  CRISPR gRNA sequence
tccctgtttacagttccact

SEQ ID NO: 307988 - DNA, 20 bp, Artificial
  CRISPR gRNA sequence
tttacagttccactttgagt

SEQ ID NO: 307989 - DNA, 20 bp, Artificial
  CRISPR gRNA sequence
acagggaggtgaactgagcc

SEQ ID NO: 307990 - DNA, 20 bp, Artificial
  CRISPR gRNA sequence
tgctggctgggataagcctt

SEQ ID NO: 307991 - DNA, 20 bp, Artificial
  CRISPR gRNA sequence
tgggataagccttttcagat

SEQ ID NO: 307992 - DNA, 20 bp, Artificial
  CRISPR gRNA sequence
gccttttcagatttctgttt

SEQ ID NO: 307993 - DNA, 20 bp, Artificial
  CRISPR gRNA sequence
ctgtttttctgcttagcacc

SEQ ID NO: 307994 - DNA, 20 bp, Artificial
  CRISPR gRNA sequence
tcactgacttaggtaacaac

SEQ ID NO: 307995 - DNA, 20 bp, Artificial
  CRISPR gRNA sequence
actctagagaacattatcca

SEQ ID NO: 307996 - DNA, 20 bp, Artificial
  CRISPR gRNA sequence
acagtcacagctcactgtgg

SEQ ID NO: 307997 - DNA, 20 bp, Artificial
  CRISPR gRNA sequence
catatatacacacagtcatg

SEQ ID NO: 307998 - DNA, 20 bp, Artificial
  CRISPR gRNA sequence
gttctgagaaacacattatt

SEQ ID NO: 307999 - DNA, 20 bp, Artificial
  CRISPR gRNA sequence
atttgagcctcacaataact

SEQ ID NO: 308000 - DNA, 20 bp, Artificial
  CRISPR gRNA sequence
tcgacagagctactaagtgg

SEQ ID NO: 308001 - DNA, 20 bp, Artificial
  CRISPR gRNA sequence
agagctactaagtggcagag

SEQ ID NO: 308002 - DNA, 20 bp, Artificial
  CRISPR gRNA sequence
cttggattcacacccagcaa

SEQ ID NO: 308003 - DNA, 20 bp, Artificial
  CRISPR gRNA sequence
gacttcttccatggggcctg

SEQ ID NO: 308004 - DNA, 20 bp, Artificial
  CRISPR gRNA sequence
tgaacagctttggtggataa

SEQ ID NO: 308005 - DNA, 20 bp, Artificial
  CRISPR gRNA sequence
gctgacacctcagttgaccc

SEQ ID NO: 308006 - DNA, 20 bp, Artificial
  CRISPR gRNA sequence
agttcaggtgtcacttttgc

SEQ ID NO: 308007 - DNA, 20 bp, Artificial
  CRISPR gRNA sequence
atttgccattgacacttctt

SEQ ID NO: 308008 - DNA, 20 bp, Artificial
  CRISPR gRNA sequence
aagcaacaacctcaaatggt

SEQ ID NO: 308009 - DNA, 20 bp, Artificial
  CRISPR gRNA sequence
caacctcaaatggtaaccgt

SEQ ID NO: 308010 - DNA, 20 bp, Artificial
  CRISPR gRNA sequence
acgatgaaaagcaacaaaaa

SEQ ID NO: 308011 - DNA, 20 bp, Artificial
  CRISPR gRNA sequence
tctttcttctcagggcacac

SEQ ID NO: 308012 - DNA, 20 bp, Artificial
  CRISPR gRNA sequence
aacagtgacctagccacagg

SEQ ID NO: 308013 - DNA, 20 bp, Artificial
  CRISPR gRNA sequence
atagcaatacagtgaagcaa

SEQ ID NO: 308014 - DNA, 20 bp, Artificial
  CRISPR gRNA sequence
tcttgaggataaaattggat

SEQ ID NO: 308015 - DNA, 20 bp, Artificial
  CRISPR gRNA sequence
gtggccttgcagaattaggt

SEQ ID NO: 308016 - DNA, 20 bp, Artificial
  CRISPR gRNA sequence
aggcacttctaactttcaag

SEQ ID NO: 308017 - DNA, 20 bp, Artificial
  CRISPR gRNA sequence
cacttttaggctggagccag

SEQ ID NO: 308018 - DNA, 20 bp, Artificial
  CRISPR gRNA sequence
acatcaggaggaagtatctt

SEQ ID NO: 308019 - DNA, 20 bp, Artificial
  CRISPR gRNA sequence
ggaggaagtatctttccagt

SEQ ID NO: 308020 - DNA, 20 bp, Artificial
  CRISPR gRNA sequence
tctgagggttctctgggtcc

SEQ ID NO: 308021 - DNA, 20 bp, Artificial
  CRISPR gRNA sequence
agttggaatatttcttcact

SEQ ID NO: 308022 - DNA, 20 bp, Artificial
  CRISPR gRNA sequence
aacccccgcctcccaggttc

SEQ ID NO: 308023 - DNA, 20 bp, Artificial
  CRISPR gRNA sequence
tgcctcagcctcccaagtag

SEQ ID NO: 308024 - DNA, 20 bp, Artificial
  CRISPR gRNA sequence
ttttgtatttttggtagaga

SEQ ID NO: 308025 - DNA, 20 bp, Artificial
  CRISPR gRNA sequence
cgcctcgacctcccaaagtg

SEQ ID NO: 308026 - DNA, 20 bp, Artificial
  CRISPR gRNA sequence
gccactgcgcccggcccacc

SEQ ID NO: 308027 - DNA, 20 bp, Artificial
  CRISPR gRNA sequence
cggcccaccttaagatttat

SEQ ID NO: 308028 - DNA, 20 bp, Artificial
  CRISPR gRNA sequence
ctcattcctgtggaaaggtc

SEQ ID NO: 308029 - DNA, 20 bp, Artificial
  CRISPR gRNA sequence
aaaggtccactgttttcctc

SEQ ID NO: 308030 - DNA, 20 bp, Artificial
  CRISPR gRNA sequence
tcatggagcctaatagttct

SEQ ID NO: 308031 - DNA, 20 bp, Artificial
  CRISPR gRNA sequence
tttatgttaagccaccattt

SEQ ID NO: 308032 - DNA, 20 bp, Artificial
  CRISPR gRNA sequence
gagtatcttacccccaaatt

SEQ ID NO: 308033 - DNA, 20 bp, Artificial
  CRISPR gRNA sequence
atcttacccccaaattagtt

SEQ ID NO: 308034 - DNA, 20 bp, Artificial
  CRISPR gRNA sequence
aaattagttgattgtttcag

SEQ ID NO: 308035 - DNA, 20 bp, Artificial
  CRISPR gRNA sequence
agaaaatgagcaatcagaca

SEQ ID NO: 308036 - DNA, 20 bp, Artificial
  CRISPR gRNA sequence
actgaataggatgtgtatag

SEQ ID NO: 308037 - DNA, 20 bp, Artificial
  CRISPR gRNA sequence
acattttttttggaagaagc

SEQ ID NO: 308038 - DNA, 20 bp, Artificial
  CRISPR gRNA sequence
gaagcaagtgtttgagagac

SEQ ID NO: 308039 - DNA, 20 bp, Artificial
  CRISPR gRNA sequence
ttatttttcctttgtgagag

SEQ ID NO: 308040 - DNA, 20 bp, Artificial
  CRISPR gRNA sequence
ttttgtccccagaagtactg

SEQ ID NO: 308041 - DNA, 20 bp, Artificial
  CRISPR gRNA sequence
gaggagtgcagtggtgctat

SEQ ID NO: 308042 - DNA, 20 bp, Artificial
  CRISPR gRNA sequence
ctctaattcccaggctcaag

SEQ ID NO: 308043 - DNA, 20 bp, Artificial
  CRISPR gRNA sequence
agtacatgccaccatgcctg

SEQ ID NO: 308044 - DNA, 20 bp, Artificial
  CRISPR gRNA sequence
gcctggctagttttttttgt

SEQ ID NO: 308045 - DNA, 20 bp, Artificial
  CRISPR gRNA sequence
gctagttttttttgttgttg

SEQ ID NO: 308046 - DNA, 20 bp, Artificial
  CRISPR gRNA sequence
ttttttttgttgttgttttg

SEQ ID NO: 308047 - DNA, 20 bp, Artificial
  CRISPR gRNA sequence
gttttgctttagagacgggg

SEQ ID NO: 308048 - DNA, 20 bp, Artificial
  CRISPR gRNA sequence
gctggtcttgaactcctttt

SEQ ID NO: 308049 - DNA, 20 bp, Artificial
  CRISPR gRNA sequence
cttttaagtgattatctctt

SEQ ID NO: 308050 - DNA, 20 bp, Artificial
  CRISPR gRNA sequence
cttctcagcttcttaaagtc

SEQ ID NO: 308051 - DNA, 20 bp, Artificial
  CRISPR gRNA sequence
taggcatggcctatctattt

SEQ ID NO: 308052 - DNA, 20 bp, Artificial
  CRISPR gRNA sequence
gagtaaatttatctataaat

SEQ ID NO: 308053 - DNA, 20 bp, Artificial
  CRISPR gRNA sequence
acaaaaacaagtaaatcaat

SEQ ID NO: 308054 - DNA, 20 bp, Artificial
  CRISPR gRNA sequence
gaggtaggtaccattattgt

SEQ ID NO: 308055 - DNA, 20 bp, Artificial
  CRISPR gRNA sequence
acaggcagtgagtagttgag

SEQ ID NO: 308056 - DNA, 20 bp, Artificial
  CRISPR gRNA sequence
gttataatagtgtactgccc

SEQ ID NO: 308057 - DNA, 20 bp, Artificial
  CRISPR gRNA sequence
tagtgtactgccctatagct

SEQ ID NO: 308058 - DNA, 20 bp, Artificial
  CRISPR gRNA sequence
aagaaattgagttgctaagt

SEQ ID NO: 308059 - DNA, 20 bp, Artificial
  CRISPR gRNA sequence
ccaatcaaatgggcaaaaag

SEQ ID NO: 308060 - DNA, 20 bp, Artificial
  CRISPR gRNA sequence
caaaaagaatggtttctcac

SEQ ID NO: 308061 - DNA, 20 bp, Artificial
  CRISPR gRNA sequence
ttgcatttccctagttattc

SEQ ID NO: 308062 - DNA, 20 bp, Artificial
  CRISPR gRNA sequence
ttcttcaacaattacttatt

SEQ ID NO: 308063 - DNA, 20 bp, Artificial
  CRISPR gRNA sequence
tgacaaagcccctgctgtca

SEQ ID NO: 308064 - DNA, 20 bp, Artificial
  CRISPR gRNA sequence
gcaaaacaaaaataaaatag

SEQ ID NO: 308065 - DNA, 20 bp, Artificial
  CRISPR gRNA sequence
agccccaaatgaaaggctct

SEQ ID NO: 308066 - DNA, 20 bp, Artificial
  CRISPR gRNA sequence
aagtgtcttctctatgatga

SEQ ID NO: 308067 - DNA, 20 bp, Artificial
  CRISPR gRNA sequence
taagaatgagggtgcctggg

SEQ ID NO: 308068 - DNA, 20 bp, Artificial
  CRISPR gRNA sequence
tgactggcgggaggctgaga

SEQ ID NO: 308069 - DNA, 20 bp, Artificial
  CRISPR gRNA sequence
agaaagggcaacttcctcag

SEQ ID NO: 308070 - DNA, 20 bp, Artificial
  CRISPR gRNA sequence
caacttcctcagcaaggctt

SEQ ID NO: 308071 - DNA, 20 bp, Artificial
  CRISPR gRNA sequence
gtcaggtctgaaaaatcaca

SEQ ID NO: 308072 - DNA, 20 bp, Artificial
  CRISPR gRNA sequence
gaagggatctggatatattt

SEQ ID NO: 308073 - DNA, 20 bp, Artificial
  CRISPR gRNA sequence
tcagtttggtggaaggcatc

SEQ ID NO: 308074 - DNA, 20 bp, Artificial
  CRISPR gRNA sequence
gcatcagaggcttctgaaca

SEQ ID NO: 308075 - DNA, 20 bp, Artificial
  CRISPR gRNA sequence
ggcttctgaacaggaggatt

SEQ ID NO: 308076 - DNA, 20 bp, Artificial
  CRISPR gRNA sequence
ctgtatttttaagggatcat

SEQ ID NO: 308077 - DNA, 20 bp, Artificial
  CRISPR gRNA sequence
gttgggtattttgggtacac

SEQ ID NO: 308078 - DNA, 20 bp, Artificial
  CRISPR gRNA sequence
atgattcatcttggttatac

SEQ ID NO: 308079 - DNA, 20 bp, Artificial
  CRISPR gRNA sequence
cttggttatacagatgattt

SEQ ID NO: 308080 - DNA, 20 bp, Artificial
  CRISPR gRNA sequence
gcaataagcacctgggagtt

SEQ ID NO: 308081 - DNA, 20 bp, Artificial
  CRISPR gRNA sequence
tcaaggttaccaaaattaaa

SEQ ID NO: 308082 - DNA, 20 bp, Artificial
  CRISPR gRNA sequence
gagaaaattaacaaggaaat

SEQ ID NO: 308083 - DNA, 20 bp, Artificial
  CRISPR gRNA sequence
gtcaccaacaacctttgtca

SEQ ID NO: 308084 - DNA, 20 bp, Artificial
  CRISPR gRNA sequence
ctgggaataaaggcagcaat

SEQ ID NO: 308085 - DNA, 20 bp, Artificial
  CRISPR gRNA sequence
aattgctgcttactctttca

SEQ ID NO: 308086 - DNA, 20 bp, Artificial
  CRISPR gRNA sequence
agaaactaaaagcagtagca

SEQ ID NO: 308087 - DNA, 20 bp, Artificial
  CRISPR gRNA sequence
taaaagcagtagcacaaggt

SEQ ID NO: 308088 - DNA, 20 bp, Artificial
  CRISPR gRNA sequence
agtgaagtgagacaggacac

SEQ ID NO: 308089 - DNA, 20 bp, Artificial
  CRISPR gRNA sequence
aattttatagagacaaaggg

SEQ ID NO: 308090 - DNA, 20 bp, Artificial
  CRISPR gRNA sequence
tttcaattaattaaaattaa

SEQ ID NO: 308091 - DNA, 20 bp, Artificial
  CRISPR gRNA sequence
gggtctggataaagctgagg

SEQ ID NO: 308092 - DNA, 20 bp, Artificial
  CRISPR gRNA sequence
gatgaataggaggttgtgga

SEQ ID NO: 308093 - DNA, 20 bp, Artificial
  CRISPR gRNA sequence
tgtggacggagattagtata

SEQ ID NO: 308094 - DNA, 20 bp, Artificial
  CRISPR gRNA sequence
cggagattagtatattgaga

SEQ ID NO: 308095 - DNA, 20 bp, Artificial
  CRISPR gRNA sequence
ggactgagctgctccaggtg

SEQ ID NO: 308096 - DNA, 20 bp, Artificial
  CRISPR gRNA sequence
cagtagctggggctggagca

SEQ ID NO: 308097 - DNA, 20 bp, Artificial
  CRISPR gRNA sequence
agtggcttcctttgggtgaa

SEQ ID NO: 308098 - DNA, 20 bp, Artificial
  CRISPR gRNA sequence
tgaaggggttaaagatgtgg

SEQ ID NO: 308099 - DNA, 20 bp, Artificial
  CRISPR gRNA sequence
ccttgtagtaagtaatggaa

SEQ ID NO: 308100 - DNA, 20 bp, Artificial
  CRISPR gRNA sequence
gggccaagtaaaactttgga

SEQ ID NO: 308101 - DNA, 20 bp, Artificial
  CRISPR gRNA sequence
acttcataaggctagcaaat

SEQ ID NO: 308102 - DNA, 20 bp, Artificial
  CRISPR gRNA sequence
cctttgaaacaaattccttc

SEQ ID NO: 308103 - DNA, 20 bp, Artificial
  CRISPR gRNA sequence
gctgattacgaaggcatcta

SEQ ID NO: 308104 - DNA, 20 bp, Artificial
  CRISPR gRNA sequence
tacccaagtgctggggaagg

SEQ ID NO: 308105 - DNA, 20 bp, Artificial
  CRISPR gRNA sequence
ctggggaagggagagattct

SEQ ID NO: 308106 - DNA, 20 bp, Artificial
  CRISPR gRNA sequence
cccagtaagtccagttgcta

SEQ ID NO: 308107 - DNA, 20 bp, Artificial
  CRISPR gRNA sequence
ctttccccatttagtcagag

SEQ ID NO: 308108 - DNA, 20 bp, Artificial
  CRISPR gRNA sequence
atactttcagttccactcag

SEQ ID NO: 308109 - DNA, 20 bp, Artificial
  CRISPR gRNA sequence
tccactcagaatggatttca

SEQ ID NO: 308110 - DNA, 20 bp, Artificial
  CRISPR gRNA sequence
atccactctggagacagagg

SEQ ID NO: 308111 - DNA, 20 bp, Artificial
  CRISPR gRNA sequence
cagtaagtcttgggtggggc

SEQ ID NO: 308112 - DNA, 20 bp, Artificial
  CRISPR gRNA sequence
cttgggtggggccagagatt

SEQ ID NO: 308113 - DNA, 20 bp, Artificial
  CRISPR gRNA sequence
aattggcagaatttttaact

SEQ ID NO: 308114 - DNA, 20 bp, Artificial
  CRISPR gRNA sequence
gcagaatttttaactgtgtg

SEQ ID NO: 308115 - DNA, 20 bp, Artificial
  CRISPR gRNA sequence
atttcctcagagacaatgct

SEQ ID NO: 308116 - DNA, 20 bp, Artificial
  CRISPR gRNA sequence
gcaaagaagatgcagaagcc

SEQ ID NO: 308117 - DNA, 20 bp, Artificial
  CRISPR gRNA sequence
agcctcaggtttgccttgta

SEQ ID NO: 308118 - DNA, 20 bp, Artificial
  CRISPR gRNA sequence
tttcactgtcagggtacgca

SEQ ID NO: 308119 - DNA, 20 bp, Artificial
  CRISPR gRNA sequence
agtgagtgtagtgaaatagg

SEQ ID NO: 308120 - DNA, 20 bp, Artificial
  CRISPR gRNA sequence
aactcccactgatgcctgct

SEQ ID NO: 308121 - DNA, 20 bp, Artificial
  CRISPR gRNA sequence
gttcaagaccaccaccaacc

SEQ ID NO: 308122 - DNA, 20 bp, Artificial
  CRISPR gRNA sequence
tctcactgggccactctgta

SEQ ID NO: 308123 - DNA, 20 bp, Artificial
  CRISPR gRNA sequence
ctgggccactctgtacacag

SEQ ID NO: 308124 - DNA, 20 bp, Artificial
  CRISPR gRNA sequence
cccccgcacttctcacccac

SEQ ID NO: 308125 - DNA, 20 bp, Artificial
  CRISPR gRNA sequence
gtcagtgcatactgggagca

SEQ ID NO: 308126 - DNA, 20 bp, Artificial
  CRISPR gRNA sequence
agcagcaagtttgtggtgcc

SEQ ID NO: 308127 - DNA, 20 bp, Artificial
  CRISPR gRNA sequence
gcacatcctcacctgcccat

SEQ ID NO: 308128 - DNA, 20 bp, Artificial
  CRISPR gRNA sequence
gttctctttctgatctctga

SEQ ID NO: 308129 - DNA, 20 bp, Artificial
  CRISPR gRNA sequence
aatttcaaagatgttactca

SEQ ID NO: 308130 - DNA, 20 bp, Artificial
  CRISPR gRNA sequence
atgtggatgggaggggaggg

SEQ ID NO: 308131 - DNA, 20 bp, Artificial
  CRISPR gRNA sequence
tgaatgggttgtctaactct

SEQ ID NO: 308132 - DNA, 20 bp, Artificial
  CRISPR gRNA sequence
gatgaggaaactgaggctca

SEQ ID NO: 308133 - DNA, 20 bp, Artificial
  CRISPR gRNA sequence
aaactgaggctcataaagat

SEQ ID NO: 308134 - DNA, 20 bp, Artificial
  CRISPR gRNA sequence
caagcagatgtgcacagttc

SEQ ID NO: 308135 - DNA, 20 bp, Artificial
  CRISPR gRNA sequence
gcttaatatcttattcttca

SEQ ID NO: 308136 - DNA, 20 bp, Artificial
  CRISPR gRNA sequence
ggtattgtataaagagaaat

SEQ ID NO: 308137 - DNA, 20 bp, Artificial
  CRISPR gRNA sequence
ggaggttttttcccctttcc

SEQ ID NO: 308138 - DNA, 20 bp, Artificial
  CRISPR gRNA sequence
ttttttaggtgctgctcctc

SEQ ID NO: 308139 - DNA, 20 bp, Artificial
  CRISPR gRNA sequence
ggtgctgctcctctgaagat

SEQ ID NO: 308140 - DNA, 20 bp, Artificial
  CRISPR gRNA sequence
attccaagtatatgggccgc

SEQ ID NO: 308141 - DNA, 20 bp, Artificial
  CRISPR gRNA sequence
aagtatatgggccgcacaag

SEQ ID NO: 308142 - DNA, 20 bp, Artificial
  CRISPR gRNA sequence
acaatcttcagatcaaggac

SEQ ID NO: 308143 - DNA, 20 bp, Artificial
  CRISPR gRNA sequence
ccatcacaaaaagcccacag

SEQ ID NO: 308144 - DNA, 20 bp, Artificial
  CRISPR gRNA sequence
ccagatgaattctgaactgt

SEQ ID NO: 308145 - DNA, 20 bp, Artificial
  CRISPR gRNA sequence
tatgtggtcaatggtgtgtg

SEQ ID NO: 308146 - DNA, 20 bp, Artificial
  CRISPR gRNA sequence
agtcttttgtactttttata

SEQ ID NO: 308147 - DNA, 20 bp, Artificial
  CRISPR gRNA sequence
cttctgaaggatcagtaaaa

SEQ ID NO: 308148 - DNA, 20 bp, Artificial
  CRISPR gRNA sequence
catggataatttggccatca

SEQ ID NO: 308149 - DNA, 20 bp, Artificial
  CRISPR gRNA sequence
cattcattttttccttgggt

SEQ ID NO: 308150 - DNA, 20 bp, Artificial
  CRISPR gRNA sequence
aaagcggacagctgacacat

SEQ ID NO: 308151 - DNA, 20 bp, Artificial
  CRISPR gRNA sequence
tttcccttcagcctcctcta

SEQ ID NO: 308152 - DNA, 20 bp, Artificial
  CRISPR gRNA sequence
cctcctctaggttgcttatg

SEQ ID NO: 308153 - DNA, 20 bp, Artificial
  CRISPR gRNA sequence
acaaacttacaaaccagctc

SEQ ID NO: 308154 - DNA, 20 bp, Artificial
  CRISPR gRNA sequence
ttggaaggcctaaatgccac

SEQ ID NO: 308155 - DNA, 20 bp, Artificial
  CRISPR gRNA sequence
cacacagtaaaattattttt

SEQ ID NO: 308156 - DNA, 20 bp, Artificial
  CRISPR gRNA sequence
tttgttttgatatactgttc

SEQ ID NO: 308157 - DNA, 20 bp, Artificial
  CRISPR gRNA sequence
tactgattgtatagatcttg

SEQ ID NO: 308158 - DNA, 20 bp, Artificial
  CRISPR gRNA sequence
ataacccttgttgggcatcc

SEQ ID NO: 308159 - DNA, 20 bp, Artificial
  CRISPR gRNA sequence
acagtatgtaaccttttaag

SEQ ID NO: 308160 - DNA, 20 bp, Artificial
  CRISPR gRNA sequence
aaccttttaagcctggcttc

SEQ ID NO: 308161 - DNA, 20 bp, Artificial
  CRISPR gRNA sequence
ttctttcgtttagcgcgcct

SEQ ID NO: 308162 - DNA, 20 bp, Artificial
  CRISPR gRNA sequence
cacccaagttgttgcacata

SEQ ID NO: 308163 - DNA, 20 bp, Artificial
  CRISPR gRNA sequence
tttattgctgagtagcattt

SEQ ID NO: 308164 - DNA, 20 bp, Artificial
  CRISPR gRNA sequence
caactcagtaaaagacattg

SEQ ID NO: 308165 - DNA, 20 bp, Artificial
  CRISPR gRNA sequence
gtaaaagacattgggttgtt

SEQ ID NO: 308166 - DNA, 20 bp, Artificial
  CRISPR gRNA sequence
gctgctgtaaacgttcatgt

SEQ ID NO: 308167 - DNA, 20 bp, Artificial
  CRISPR gRNA sequence
agctgctccctttgaaccct

SEQ ID NO: 308168 - DNA, 20 bp, Artificial
  CRISPR gRNA sequence
gtgtgatttaaactaggctg

SEQ ID NO: 308169 - DNA, 20 bp, Artificial
  CRISPR gRNA sequence
tagttaaccaagtgctaaat

SEQ ID NO: 308170 - DNA, 20 bp, Artificial
  CRISPR gRNA sequence
atgtggtcaggtaccattgg

SEQ ID NO: 308171 - DNA, 20 bp, Artificial
  CRISPR gRNA sequence
attttgaaaagccatgttgt

SEQ ID NO: 308172 - DNA, 20 bp, Artificial
  CRISPR gRNA sequence
aaaactctaacttacgcaac

SEQ ID NO: 308173 - DNA, 20 bp, Artificial
  CRISPR gRNA sequence
aagaatacactaaattataa

SEQ ID NO: 308174 - DNA, 20 bp, Artificial
  CRISPR gRNA sequence
cctagtaactataaaagaac

SEQ ID NO: 308175 - DNA, 20 bp, Artificial
  CRISPR gRNA sequence
tggcaaaggcaagagaaaca

SEQ ID NO: 308176 - DNA, 20 bp, Artificial
  CRISPR gRNA sequence
atgtatttttccctaaaata

SEQ ID NO: 308177 - DNA, 20 bp, Artificial
  CRISPR gRNA sequence
cacccactcacttaccacaa

SEQ ID NO: 308178 - DNA, 20 bp, Artificial
  CRISPR gRNA sequence
ctcacttaccacaatcctgc

SEQ ID NO: 308179 - DNA, 20 bp, Artificial
  CRISPR gRNA sequence
agactctactccctggaaac

SEQ ID NO: 308180 - DNA, 20 bp, Artificial
  CRISPR gRNA sequence
ctgtcacttagagagcaccc

SEQ ID NO: 308181 - DNA, 20 bp, Artificial
  CRISPR gRNA sequence
ccctcctagatacatctaaa

SEQ ID NO: 308182 - DNA, 20 bp, Artificial
  CRISPR gRNA sequence
cctagatacatctaaactta

SEQ ID NO: 308183 - DNA, 20 bp, Artificial
  CRISPR gRNA sequence
ttgatttttttttatctctc

SEQ ID NO: 308184 - DNA, 20 bp, Artificial
  CRISPR gRNA sequence
tacccagaacctaagaagat

SEQ ID NO: 308185 - DNA, 20 bp, Artificial
  CRISPR gRNA sequence
gataatgtcacagaactgta

SEQ ID NO: 308186 - DNA, 20 bp, Artificial
  CRISPR gRNA sequence
cagaactgtacgacgtttcc

SEQ ID NO: 308187 - DNA, 20 bp, Artificial
  CRISPR gRNA sequence
tacgacgtttccatcagctt

SEQ ID NO: 308188 - DNA, 20 bp, Artificial
  CRISPR gRNA sequence
tattctggaaactgacaaga

SEQ ID NO: 308189 - DNA, 20 bp, Artificial
  CRISPR gRNA sequence
tcacctttctctataggtaa

SEQ ID NO: 308190 - DNA, 20 bp, Artificial
  CRISPR gRNA sequence
tttcagcaggtattatacac

SEQ ID NO: 308191 - DNA, 20 bp, Artificial
  CRISPR gRNA sequence
gaaggacccagatggaggtc

SEQ ID NO: 308192 - DNA, 20 bp, Artificial
  CRISPR gRNA sequence
cctatgttgcacttgaagaa

SEQ ID NO: 308193 - DNA, 20 bp, Artificial
  CRISPR gRNA sequence
ccctgaaactgactcagtct

SEQ ID NO: 308194 - DNA, 20 bp, Artificial
  CRISPR gRNA sequence
ctcttggtttacctttggat

SEQ ID NO: 308195 - DNA, 20 bp, Artificial
  CRISPR gRNA sequence
tacctttggatggaggattc

SEQ ID NO: 308196 - DNA, 20 bp, Artificial
  CRISPR gRNA sequence
ttggatggaggattctgaag

SEQ ID NO: 308197 - DNA, 20 bp, Artificial
  CRISPR gRNA sequence
tgaagttttgatttaaaaat

SEQ ID NO: 308198 - DNA, 20 bp, Artificial
  CRISPR gRNA sequence
cctccaggctagaattcttt

SEQ ID NO: 308199 - DNA, 20 bp, Artificial
  CRISPR gRNA sequence
tctttgattacaacacatac

SEQ ID NO: 308200 - DNA, 20 bp, Artificial
  CRISPR gRNA sequence
gtaatgtgcacacatgaaaa

SEQ ID NO: 308201 - DNA, 20 bp, Artificial
  CRISPR gRNA sequence
taaaataaaagtgactggta

SEQ ID NO: 308202 - DNA, 20 bp, Artificial
  CRISPR gRNA sequence
aaagaaagccttggaggcag

SEQ ID NO: 308203 - DNA, 20 bp, Artificial
  CRISPR gRNA sequence
agggacaagttcagtggagg

SEQ ID NO: 308204 - DNA, 20 bp, Artificial
  CRISPR gRNA sequence
ggagcctgacattttaaagt

SEQ ID NO: 308205 - DNA, 20 bp, Artificial
  CRISPR gRNA sequence
tcttttaagaagctgtaact

SEQ ID NO: 308206 - DNA, 20 bp, Artificial
  CRISPR gRNA sequence
taccttgaccccttctccag

SEQ ID NO: 308207 - DNA, 20 bp, Artificial
  CRISPR gRNA sequence
cccttctccagcggtgattt

SEQ ID NO: 308208 - DNA, 20 bp, Artificial
  CRISPR gRNA sequence
tccaactccttgctccatac

SEQ ID NO: 308209 - DNA, 20 bp, Artificial
  CRISPR gRNA sequence
gagccaactcgtcctgtccc

SEQ ID NO: 308210 - DNA, 20 bp, Artificial
  CRISPR gRNA sequence
agtacctccttcaatgtgta

SEQ ID NO: 308211 - DNA, 20 bp, Artificial
  CRISPR gRNA sequence
cctccttcaatgtgtaatta

SEQ ID NO: 308212 - DNA, 20 bp, Artificial
  CRISPR gRNA sequence
cccatagtctacaaattaac

SEQ ID NO: 308213 - DNA, 20 bp, Artificial
  CRISPR gRNA sequence
ctcatcatggctcaccttcc

SEQ ID NO: 308214 - DNA, 20 bp, Artificial
  CRISPR gRNA sequence
acaggtacccccatcttcag

SEQ ID NO: 308215 - DNA, 20 bp, Artificial
  CRISPR gRNA sequence
ctctagctgcctcaggaaga

SEQ ID NO: 308216 - DNA, 20 bp, Artificial
  CRISPR gRNA sequence
ggaagatggggcttgcctct

SEQ ID NO: 308217 - DNA, 20 bp, Artificial
  CRISPR gRNA sequence
cctctctgggtttcccattc

SEQ ID NO: 308218 - DNA, 20 bp, Artificial
  CRISPR gRNA sequence
atagactgggacagactcaa

SEQ ID NO: 308219 - DNA, 20 bp, Artificial
  CRISPR gRNA sequence
ggtcctaattttcctgaaat

SEQ ID NO: 308220 - DNA, 20 bp, Artificial
  CRISPR gRNA sequence
ttaaagtgggcgactccgtt

SEQ ID NO: 308221 - DNA, 20 bp, Artificial
  CRISPR gRNA sequence
ttctaagttttccccacaaa

SEQ ID NO: 308222 - DNA, 20 bp, Artificial
  CRISPR gRNA sequence
tcaaggcatgaagaaacatc

SEQ ID NO: 308223 - DNA, 20 bp, Artificial
  CRISPR gRNA sequence
ttgtccaagtgagaggtgtc

SEQ ID NO: 308224 - DNA, 20 bp, Artificial
  CRISPR gRNA sequence
gcctcagcacagacacctca

SEQ ID NO: 308225 - DNA, 20 bp, Artificial
  CRISPR gRNA sequence
gcatttggccagaggcatgg

SEQ ID NO: 308226 - DNA, 20 bp, Artificial
  CRISPR gRNA sequence
gactttctatggcctcctat

SEQ ID NO: 308227 - DNA, 20 bp, Artificial
  CRISPR gRNA sequence
atggcctcctattgtggatt

SEQ ID NO: 308228 - DNA, 20 bp, Artificial
  CRISPR gRNA sequence
cttttgtaaatgactctcct

SEQ ID NO: 308229 - DNA, 20 bp, Artificial
  CRISPR gRNA sequence
tgaaaatttgtggtcatttg

SEQ ID NO: 308230 - DNA, 20 bp, Artificial
  CRISPR gRNA sequence
gcctcccccagaccacattc

SEQ ID NO: 308231 - DNA, 20 bp, Artificial
  CRISPR gRNA sequence
ccaacagttattatatgtgt

SEQ ID NO: 308232 - DNA, 20 bp, Artificial
  CRISPR gRNA sequence
ccaatcggctggctgccttc

SEQ ID NO: 308233 - DNA, 20 bp, Artificial
  CRISPR gRNA sequence
gtcaggaagttgttgggaaa

SEQ ID NO: 308234 - DNA, 20 bp, Artificial
  CRISPR gRNA sequence
tgggaaaaaaggttttccct

SEQ ID NO: 308235 - DNA, 20 bp, Artificial
  CRISPR gRNA sequence
gaaaggcgacatttctaacc

SEQ ID NO: 308236 - DNA, 20 bp, Artificial
  CRISPR gRNA sequence
ctctggtttacaaatgtact

SEQ ID NO: 308237 - DNA, 20 bp, Artificial
  CRISPR gRNA sequence
tacttctggtttccagggaa

SEQ ID NO: 308238 - DNA, 20 bp, Artificial
  CRISPR gRNA sequence
tccagggaaaactgattatt

SEQ ID NO: 308239 - DNA, 20 bp, Artificial
  CRISPR gRNA sequence
gtgaaaccactcctaaatgt

SEQ ID NO: 308240 - DNA, 20 bp, Artificial
  CRISPR gRNA sequence
gttaaagattgtggacctgg

SEQ ID NO: 308241 - DNA, 20 bp, Artificial
  CRISPR gRNA sequence
tttgctaaatgaccacaaga

SEQ ID NO: 308242 - DNA, 20 bp, Artificial
  CRISPR gRNA sequence
cttctcgtctctaaaaaaat

SEQ ID NO: 308243 - DNA, 20 bp, Artificial
  CRISPR gRNA sequence
ataactccactaataagaaa

SEQ ID NO: 308244 - DNA, 20 bp, Artificial
  CRISPR gRNA sequence
aatatttttggtgcctatct

SEQ ID NO: 308245 - DNA, 20 bp, Artificial
  CRISPR gRNA sequence
tttttctgtgtatcaatcta

SEQ ID NO: 308246 - DNA, 20 bp, Artificial
  CRISPR gRNA sequence
atctatgttgttttccataa

SEQ ID NO: 308247 - DNA, 20 bp, Artificial
  CRISPR gRNA sequence
ttggacacttgagttagtcc

SEQ ID NO: 308248 - DNA, 20 bp, Artificial
  CRISPR gRNA sequence
cccactgacttctgttataa

SEQ ID NO: 308249 - DNA, 20 bp, Artificial
  CRISPR gRNA sequence
ataataatgccatgcctttt

SEQ ID NO: 308250 - DNA, 20 bp, Artificial
  CRISPR gRNA sequence
tagtttggtctggttctaag

SEQ ID NO: 308251 - DNA, 20 bp, Artificial
  CRISPR gRNA sequence
agtaattgcctccagtagta

SEQ ID NO: 308252 - DNA, 20 bp, Artificial
  CRISPR gRNA sequence
attgcctccagtagtaatta

SEQ ID NO: 308253 - DNA, 20 bp, Artificial
  CRISPR gRNA sequence
agtattgcctctggccagca

SEQ ID NO: 308254 - DNA, 20 bp, Artificial
  CRISPR gRNA sequence
cagcatcttgtttttcagta

SEQ ID NO: 308255 - DNA, 20 bp, Artificial
  CRISPR gRNA sequence
gccaatgtatggagtgtgct

SEQ ID NO: 308256 - DNA, 20 bp, Artificial
  CRISPR gRNA sequence
agcacagatgtaaagacata

SEQ ID NO: 308257 - DNA, 20 bp, Artificial
  CRISPR gRNA sequence
taaagacatatcatgcttgt

SEQ ID NO: 308258 - DNA, 20 bp, Artificial
  CRISPR gRNA sequence
aggctttgacttttcaaggt

SEQ ID NO: 308259 - DNA, 20 bp, Artificial
  CRISPR gRNA sequence
gacttttcaaggtgagagtt

SEQ ID NO: 308260 - DNA, 20 bp, Artificial
  CRISPR gRNA sequence
tgacttacatcttgggaata

SEQ ID NO: 308261 - DNA, 20 bp, Artificial
  CRISPR gRNA sequence
atcttgggaataagctgttt

SEQ ID NO: 308262 - DNA, 20 bp, Artificial
  CRISPR gRNA sequence
tttttcttcacattagaatg

SEQ ID NO: 308263 - DNA, 20 bp, Artificial
  CRISPR gRNA sequence
aaacaaagaagggttggaga

SEQ ID NO: 308264 - DNA, 20 bp, Artificial
  CRISPR gRNA sequence
gggttggagaaaaagattaa

SEQ ID NO: 308265 - DNA, 20 bp, Artificial
  CRISPR gRNA sequence
ctgtaggtacagatgagatg

SEQ ID NO: 308266 - DNA, 20 bp, Artificial
  CRISPR gRNA sequence
tcagacagtcatccatgcca

SEQ ID NO: 308267 - DNA, 20 bp, Artificial
  CRISPR gRNA sequence
agatatgatatatttgtaaa

SEQ ID NO: 308268 - DNA, 20 bp, Artificial
  CRISPR gRNA sequence
gtaacttcagcaatatctgc

SEQ ID NO: 308269 - DNA, 20 bp, Artificial
  CRISPR gRNA sequence
tggcaaaaggaacttcacat

SEQ ID NO: 308270 - DNA, 20 bp, Artificial
  CRISPR gRNA sequence
tcacataggtgattaaggca

SEQ ID NO: 308271 - DNA, 20 bp, Artificial
  CRISPR gRNA sequence
aaggcaccaagcttgagatg

SEQ ID NO: 308272 - DNA, 20 bp, Artificial
  CRISPR gRNA sequence
gcttgagatggtgagattaa

SEQ ID NO: 308273 - DNA, 20 bp, Artificial
  CRISPR gRNA sequence
gagaagctcaacccagcatt

SEQ ID NO: 308274 - DNA, 20 bp, Artificial
  CRISPR gRNA sequence
gccatgagccaaggaatgta

SEQ ID NO: 308275 - DNA, 20 bp, Artificial
  CRISPR gRNA sequence
gcagatccctccacagagac

SEQ ID NO: 308276 - DNA, 20 bp, Artificial
  CRISPR gRNA sequence
ggtaggaatttctccaaaag

SEQ ID NO: 308277 - DNA, 20 bp, Artificial
  CRISPR gRNA sequence
ttggcaccaaaagtcctatc

SEQ ID NO: 308278 - DNA, 20 bp, Artificial
  CRISPR gRNA sequence
cctatccagtgttttctcat

SEQ ID NO: 308279 - DNA, 20 bp, Artificial
  CRISPR gRNA sequence
gcctcaactgtatatattta

SEQ ID NO: 308280 - DNA, 20 bp, Artificial
  CRISPR gRNA sequence
gtatatatttacccagttta

SEQ ID NO: 308281 - DNA, 20 bp, Artificial
  CRISPR gRNA sequence
gaaatgccatagttattcta

SEQ ID NO: 308282 - DNA, 20 bp, Artificial
  CRISPR gRNA sequence
ttccaatctctcttctcttt

SEQ ID NO: 308283 - DNA, 20 bp, Artificial
  CRISPR gRNA sequence
tcccaaacagaaatcaccct

SEQ ID NO: 308284 - DNA, 20 bp, Artificial
  CRISPR gRNA sequence
gtatacaatgccctagcaac

SEQ ID NO: 308285 - DNA, 20 bp, Artificial
  CRISPR gRNA sequence
gccctagcaacaacggtttt

SEQ ID NO: 308286 - DNA, 20 bp, Artificial
  CRISPR gRNA sequence
agaacaaacctaggagtctc

SEQ ID NO: 308287 - DNA, 20 bp, Artificial
  CRISPR gRNA sequence
aggagtctcagctgtttcag

SEQ ID NO: 308288 - DNA, 20 bp, Artificial
  CRISPR gRNA sequence
aacctctgcctcccaggttc

SEQ ID NO: 308289 - DNA, 20 bp, Artificial
  CRISPR gRNA sequence
tttttgtattttcagtagag

SEQ ID NO: 308290 - DNA, 20 bp, Artificial
  CRISPR gRNA sequence
ctcgatctcttgacctcgtg

SEQ ID NO: 308291 - DNA, 20 bp, Artificial
  CRISPR gRNA sequence
acatttaaacagaaatattc

SEQ ID NO: 308292 - DNA, 20 bp, Artificial
  CRISPR gRNA sequence
ctgaatttgtaagcaaattt

SEQ ID NO: 308293 - DNA, 20 bp, Artificial
  CRISPR gRNA sequence
ttagaatctaccttttaatt

SEQ ID NO: 308294 - DNA, 20 bp, Artificial
  CRISPR gRNA sequence
tctgctttcatttttttgac

SEQ ID NO: 308295 - DNA, 20 bp, Artificial
  CRISPR gRNA sequence
aagtacctttttttacattt

SEQ ID NO: 308296 - DNA, 20 bp, Artificial
  CRISPR gRNA sequence
tttttcaaaatttttatttg

SEQ ID NO: 308297 - DNA, 20 bp, Artificial
  CRISPR gRNA sequence
ggaactactgaactaaacta

SEQ ID NO: 308298 - DNA, 20 bp, Artificial
  CRISPR gRNA sequence
tacatggataagttatttag

SEQ ID NO: 308299 - DNA, 20 bp, Artificial
  CRISPR gRNA sequence
ttcttatgtctttgcatcct

SEQ ID NO: 308300 - DNA, 20 bp, Artificial
  CRISPR gRNA sequence
tatcagtgaaaacatacaat

SEQ ID NO: 308301 - DNA, 20 bp, Artificial
  CRISPR gRNA sequence
agttgctgcaaatgccatta

SEQ ID NO: 308302 - DNA, 20 bp, Artificial
  CRISPR gRNA sequence
ctttgggtatatacccagta

SEQ ID NO: 308303 - DNA, 20 bp, Artificial
  CRISPR gRNA sequence
agttctttaaggaatctcca

SEQ ID NO: 308304 - DNA, 20 bp, Artificial
  CRISPR gRNA sequence
aatctccatactgttttcca

SEQ ID NO: 308305 - DNA, 20 bp, Artificial
  CRISPR gRNA sequence
ctgttttccatagtgtttgt

SEQ ID NO: 308306 - DNA, 20 bp, Artificial
  CRISPR gRNA sequence
ccatgccaacatctattatt

SEQ ID NO: 308307 - DNA, 20 bp, Artificial
  CRISPR gRNA sequence
ggagtaaggtggtatctcat

SEQ ID NO: 308308 - DNA, 20 bp, Artificial
  CRISPR gRNA sequence
tagtgatattgaactttttt

SEQ ID NO: 308309 - DNA, 20 bp, Artificial
  CRISPR gRNA sequence
ctttacaaaaatagaacata

SEQ ID NO: 308310 - DNA, 20 bp, Artificial
  CRISPR gRNA sequence
gaaatagctcaagtaactga

SEQ ID NO: 308311 - DNA, 20 bp, Artificial
  CRISPR gRNA sequence
tgaagagctaccatgggatg

SEQ ID NO: 308312 - DNA, 20 bp, Artificial
  CRISPR gRNA sequence
gctaccatgggatgcaaaga

SEQ ID NO: 308313 - DNA, 20 bp, Artificial
  CRISPR gRNA sequence
ttgggaggctgagagaggag

SEQ ID NO: 308314 - DNA, 20 bp, Artificial
  CRISPR gRNA sequence
ccagcctgggtgacagaaga

SEQ ID NO: 308315 - DNA, 20 bp, Artificial
  CRISPR gRNA sequence
attgtatagaagaagtagac

SEQ ID NO: 308316 - DNA, 20 bp, Artificial
  CRISPR gRNA sequence
agacttctgcttcctccaac

SEQ ID NO: 308317 - DNA, 20 bp, Artificial
  CRISPR gRNA sequence
gcagacaaaatatatgaaac

SEQ ID NO: 308318 - DNA, 20 bp, Artificial
  CRISPR gRNA sequence
aagaaaaaatgagataagcc

SEQ ID NO: 308319 - DNA, 20 bp, Artificial
  CRISPR gRNA sequence
gagataagccctatgattgc

SEQ ID NO: 308320 - DNA, 20 bp, Artificial
  CRISPR gRNA sequence
aactacaaacatctctcgtg

SEQ ID NO: 308321 - DNA, 20 bp, Artificial
  CRISPR gRNA sequence
tataatacatcatgatcaag

SEQ ID NO: 308322 - DNA, 20 bp, Artificial
  CRISPR gRNA sequence
tgacaaaattaatacccatt

SEQ ID NO: 308323 - DNA, 20 bp, Artificial
  CRISPR gRNA sequence
cataatatttcatgatagaa

SEQ ID NO: 308324 - DNA, 20 bp, Artificial
  CRISPR gRNA sequence
atatttcatgatagaagact

SEQ ID NO: 308325 - DNA, 20 bp, Artificial
  CRISPR gRNA sequence
agaaaaagaaataaaagaca

SEQ ID NO: 308326 - DNA, 20 bp, Artificial
  CRISPR gRNA sequence
tcttttttcacagataatga

SEQ ID NO: 308327 - DNA, 20 bp, Artificial
  CRISPR gRNA sequence
aaaataaatggagacatagg

SEQ ID NO: 308328 - DNA, 20 bp, Artificial
  CRISPR gRNA sequence
ccattctctccaagttgatc

SEQ ID NO: 308329 - DNA, 20 bp, Artificial
  CRISPR gRNA sequence
tctggaggctgaggcaggag

SEQ ID NO: 308330 - DNA, 20 bp, Artificial
  CRISPR gRNA sequence
gaacaaaatagagagtcaaa

SEQ ID NO: 308331 - DNA, 20 bp, Artificial
  CRISPR gRNA sequence
ggaaaacttttgttctttga

SEQ ID NO: 308332 - DNA, 20 bp, Artificial
  CRISPR gRNA sequence
tcaaaccacagacagggaga

SEQ ID NO: 308333 - DNA, 20 bp, Artificial
  CRISPR gRNA sequence
actcatacacaaatgttcat

SEQ ID NO: 308334 - DNA, 20 bp, Artificial
  CRISPR gRNA sequence
atacacaaatgttcatagca

SEQ ID NO: 308335 - DNA, 20 bp, Artificial
  CRISPR gRNA sequence
gaaaaagcaaaactatttta

SEQ ID NO: 308336 - DNA, 20 bp, Artificial
  CRISPR gRNA sequence
tcagctgaaaagcgaactat

SEQ ID NO: 308337 - DNA, 20 bp, Artificial
  CRISPR gRNA sequence
gcttataaaaatgttctcga

SEQ ID NO: 308338 - DNA, 20 bp, Artificial
  CRISPR gRNA sequence
atcaccaaactctaaactga

SEQ ID NO: 308339 - DNA, 20 bp, Artificial
  CRISPR gRNA sequence
aaactctaaactgaaaatga

SEQ ID NO: 308340 - DNA, 20 bp, Artificial
  CRISPR gRNA sequence
tattaattatacctccataa

SEQ ID NO: 308341 - DNA, 20 bp, Artificial
  CRISPR gRNA sequence
aattatacctccataaagct

SEQ ID NO: 308342 - DNA, 20 bp, Artificial
  CRISPR gRNA sequence
ttttatttttattttatttc

SEQ ID NO: 308343 - DNA, 20 bp, Artificial
  CRISPR gRNA sequence
tcaatagtttttggggaaca

SEQ ID NO: 308344 - DNA, 20 bp, Artificial
  CRISPR gRNA sequence
tacatggatgagttctttag

SEQ ID NO: 308345 - DNA, 20 bp, Artificial
  CRISPR gRNA sequence
gagttctttagtggtgattt

SEQ ID NO: 308346 - DNA, 20 bp, Artificial
  CRISPR gRNA sequence
tgactttgtggcctcataaa

SEQ ID NO: 308347 - DNA, 20 bp, Artificial
  CRISPR gRNA sequence
tttgtggcctcataaaagct

SEQ ID NO: 308348 - DNA, 20 bp, Artificial
  CRISPR gRNA sequence
aaccatcagaggtattgttg

SEQ ID NO: 308349 - DNA, 20 bp, Artificial
  CRISPR gRNA sequence
cacccaggttagcaacctgt

SEQ ID NO: 308350 - DNA, 20 bp, Artificial
  CRISPR gRNA sequence
aagtccctatcaatagcaac

SEQ ID NO: 308351 - DNA, 20 bp, Artificial
  CRISPR gRNA sequence
attcttagcaccatctggct

SEQ ID NO: 308352 - DNA, 20 bp, Artificial
  CRISPR gRNA sequence
cttctcctcctccttataaa

SEQ ID NO: 308353 - DNA, 20 bp, Artificial
  CRISPR gRNA sequence
ttataaaccttgctttcaga

SEQ ID NO: 308354 - DNA, 20 bp, Artificial
  CRISPR gRNA sequence
tagaaactcttccaatcaca

SEQ ID NO: 308355 - DNA, 20 bp, Artificial
  CRISPR gRNA sequence
atctaggaggaatacatttt

SEQ ID NO: 308356 - DNA, 20 bp, Artificial
  CRISPR gRNA sequence
ccagagtgcctgttacttga

SEQ ID NO: 308357 - DNA, 20 bp, Artificial
  CRISPR gRNA sequence
agacttcagaggtggtgaac

SEQ ID NO: 308358 - DNA, 20 bp, Artificial
  CRISPR gRNA sequence
ccccagtacctggcacagtg

SEQ ID NO: 308359 - DNA, 20 bp, Artificial
  CRISPR gRNA sequence
tgaagaagtggggaatgata

SEQ ID NO: 308360 - DNA, 20 bp, Artificial
  CRISPR gRNA sequence
gaagtggggaatgataacat

SEQ ID NO: 308361 - DNA, 20 bp, Artificial
  CRISPR gRNA sequence
catcttagtatttgctatgg

SEQ ID NO: 308362 - DNA, 20 bp, Artificial
  CRISPR gRNA sequence
ttacagtgtcatgtggatcc

SEQ ID NO: 308363 - DNA, 20 bp, Artificial
  CRISPR gRNA sequence
cttggctttttcttaataac

SEQ ID NO: 308364 - DNA, 20 bp, Artificial
  CRISPR gRNA sequence
tttttcttaataacaccaga

SEQ ID NO: 308365 - DNA, 20 bp, Artificial
  CRISPR gRNA sequence
gttctcaataaatgttgaaa

SEQ ID NO: 308366 - DNA, 20 bp, Artificial
  CRISPR gRNA sequence
aagcaaccctcagtcacaag

SEQ ID NO: 308367 - DNA, 20 bp, Artificial
  CRISPR gRNA sequence
taatccagatataccagcca

SEQ ID NO: 308368 - DNA, 20 bp, Artificial
  CRISPR gRNA sequence
atcctgcctaccctgtcaca

SEQ ID NO: 308369 - DNA, 20 bp, Artificial
  CRISPR gRNA sequence
tgtagaccgtggttcttttc

SEQ ID NO: 308370 - DNA, 20 bp, Artificial
  CRISPR gRNA sequence
ctttctccacctttctcttc

SEQ ID NO: 308371 - DNA, 20 bp, Artificial
  CRISPR gRNA sequence
ctccacctttctcttcaata

SEQ ID NO: 308372 - DNA, 20 bp, Artificial
  CRISPR gRNA sequence
gaaagatctgatgaagccca

SEQ ID NO: 308373 - DNA, 20 bp, Artificial
  CRISPR gRNA sequence
cttcatgcgacaaaagtgat

SEQ ID NO: 308374 - DNA, 20 bp, Artificial
  CRISPR gRNA sequence
tgtaagttcctgggcaacct

SEQ ID NO: 308375 - DNA, 20 bp, Artificial
  CRISPR gRNA sequence
agaggagactttaattctct

SEQ ID NO: 308376 - DNA, 20 bp, Artificial
  CRISPR gRNA sequence
gagcacacttatgggccaag

SEQ ID NO: 308377 - DNA, 20 bp, Artificial
  CRISPR gRNA sequence
aggaccaatacctcctccag

SEQ ID NO: 308378 - DNA, 20 bp, Artificial
  CRISPR gRNA sequence
tcagattcttctcttaattt

SEQ ID NO: 308379 - DNA, 20 bp, Artificial
  CRISPR gRNA sequence
tcttctcttaatttcataga

SEQ ID NO: 308380 - DNA, 20 bp, Artificial
  CRISPR gRNA sequence
gagatctatgtactgtaata

SEQ ID NO: 308381 - DNA, 20 bp, Artificial
  CRISPR gRNA sequence
tgggctgttgctaatattga

SEQ ID NO: 308382 - DNA, 20 bp, Artificial
  CRISPR gRNA sequence
ctgaataaacaggaaaatgc

SEQ ID NO: 308383 - DNA, 20 bp, Artificial
  CRISPR gRNA sequence
aaaatgccagagcttgtgaa

SEQ ID NO: 308384 - DNA, 20 bp, Artificial
  CRISPR gRNA sequence
caaatggacataagacagac

SEQ ID NO: 308385 - DNA, 20 bp, Artificial
  CRISPR gRNA sequence
agtttccctggtggtcaggg

SEQ ID NO: 308386 - DNA, 20 bp, Artificial
  CRISPR gRNA sequence
tgataatgggatgaatggaa

SEQ ID NO: 308387 - DNA, 20 bp, Artificial
  CRISPR gRNA sequence
agaccaagacacagatcacc

SEQ ID NO: 308388 - DNA, 20 bp, Artificial
  CRISPR gRNA sequence
agggctagcaaatttgagtt

SEQ ID NO: 308389 - DNA, 20 bp, Artificial
  CRISPR gRNA sequence
ctagcaaatttgagttggat

SEQ ID NO: 308390 - DNA, 20 bp, Artificial
  CRISPR gRNA sequence
gttatagactgccatgctag

SEQ ID NO: 308391 - DNA, 20 bp, Artificial
  CRISPR gRNA sequence
agcttgtccatgtaatattc

SEQ ID NO: 308392 - DNA, 20 bp, Artificial
  CRISPR gRNA sequence
atgtttttaccctgcccctg

SEQ ID NO: 308393 - DNA, 20 bp, Artificial
  CRISPR gRNA sequence
gattagactcctagcacctg

SEQ ID NO: 308394 - DNA, 20 bp, Artificial
  CRISPR gRNA sequence
tagcacctggctagtttcta

SEQ ID NO: 308395 - DNA, 20 bp, Artificial
  CRISPR gRNA sequence
ttctaacatgttttgtgcag

SEQ ID NO: 308396 - DNA, 20 bp, Artificial
  CRISPR gRNA sequence
tgtgcagcacagtttttaat

SEQ ID NO: 308397 - DNA, 20 bp, Artificial
  CRISPR gRNA sequence
ttcatttaaaagtctacatt

SEQ ID NO: 308398 - DNA, 20 bp, Artificial
  CRISPR gRNA sequence
taaaagtctacattttctgc

SEQ ID NO: 308399 - DNA, 20 bp, Artificial
  CRISPR gRNA sequence
aacatgggaatattacatgg

SEQ ID NO: 308400 - DNA, 20 bp, Artificial
  CRISPR gRNA sequence
catggcagtctataaccctt

SEQ ID NO: 308401 - DNA, 20 bp, Artificial
  CRISPR gRNA sequence
caggctccccagagttctct

SEQ ID NO: 308402 - DNA, 20 bp, Artificial
  CRISPR gRNA sequence
ttagtgatcccaccttagag

SEQ ID NO: 308403 - DNA, 20 bp, Artificial
  CRISPR gRNA sequence
cagtatatctgtctctgtat

SEQ ID NO: 308404 - DNA, 20 bp, Artificial
  CRISPR gRNA sequence
tgatggctctccctccccag

SEQ ID NO: 308405 - DNA, 20 bp, Artificial
  CRISPR gRNA sequence
atttggacagactatccatc

SEQ ID NO: 308406 - DNA, 20 bp, Artificial
  CRISPR gRNA sequence
ggacagactatccatctgtt

SEQ ID NO: 308407 - DNA, 20 bp, Artificial
  CRISPR gRNA sequence
gtgatctcttttggttcttt

SEQ ID NO: 308408 - DNA, 20 bp, Artificial
  CRISPR gRNA sequence
gttcacaagctctggcattt

SEQ ID NO: 308409 - DNA, 20 bp, Artificial
  CRISPR gRNA sequence
gtttattcagttctctccac

SEQ ID NO: 308410 - DNA, 20 bp, Artificial
  CRISPR gRNA sequence
ttgttgcctgtaccctaggc

SEQ ID NO: 308411 - DNA, 20 bp, Artificial
  CRISPR gRNA sequence
ctattacagtacatagatct

SEQ ID NO: 308412 - DNA, 20 bp, Artificial
  CRISPR gRNA sequence
cccacccagactgaggaggt

SEQ ID NO: 308413 - DNA, 20 bp, Artificial
  CRISPR gRNA sequence
cacacaaaattcagtggggc

SEQ ID NO: 308414 - DNA, 20 bp, Artificial
  CRISPR gRNA sequence
agaattctgggcagataaaa

SEQ ID NO: 308415 - DNA, 20 bp, Artificial
  CRISPR gRNA sequence
ccaggtcatgagccattaag

SEQ ID NO: 308416 - DNA, 20 bp, Artificial
  CRISPR gRNA sequence
tagaaaaaatgaatacttgt

SEQ ID NO: 308417 - DNA, 20 bp, Artificial
  CRISPR gRNA sequence
ttcgaacttttaaaaacacg

SEQ ID NO: 308418 - DNA, 20 bp, Artificial
  CRISPR gRNA sequence
ttcatcagatctttcaggta

SEQ ID NO: 308419 - DNA, 20 bp, Artificial
  CRISPR gRNA sequence
tttctctggagaaatagaag

SEQ ID NO: 308420 - DNA, 20 bp, Artificial
  CRISPR gRNA sequence
catttgagctactttctttt

SEQ ID NO: 308421 - DNA, 20 bp, Artificial
  CRISPR gRNA sequence
accacggtctacactgtcat

SEQ ID NO: 308422 - DNA, 20 bp, Artificial
  CRISPR gRNA sequence
aactgagtgtgacagggtag

SEQ ID NO: 308423 - DNA, 20 bp, Artificial
  CRISPR gRNA sequence
gtccaagggtgcccggaatt

SEQ ID NO: 308424 - DNA, 20 bp, Artificial
  CRISPR gRNA sequence
gaatcacagtggctggtata

SEQ ID NO: 308425 - DNA, 20 bp, Artificial
  CRISPR gRNA sequence
ttatgaccctatctctgaaa

SEQ ID NO: 308426 - DNA, 20 bp, Artificial
  CRISPR gRNA sequence
aaaccaggcttgtgactgag

SEQ ID NO: 308427 - DNA, 20 bp, Artificial
  CRISPR gRNA sequence
gtcagagccttgatattcct

SEQ ID NO: 308428 - DNA, 20 bp, Artificial
  CRISPR gRNA sequence
gatagaggtacagactatct

SEQ ID NO: 308429 - DNA, 20 bp, Artificial
  CRISPR gRNA sequence
taagtgctagcagcacaatg

SEQ ID NO: 308430 - DNA, 20 bp, Artificial
  CRISPR gRNA sequence
tggtatggtctctgctcttc

SEQ ID NO: 308431 - DNA, 20 bp, Artificial
  CRISPR gRNA sequence
cttcataggatttagttaag

SEQ ID NO: 308432 - DNA, 20 bp, Artificial
  CRISPR gRNA sequence
atttagttaagtctagttta

SEQ ID NO: 308433 - DNA, 20 bp, Artificial
  CRISPR gRNA sequence
actgtaacaagttgacattt

SEQ ID NO: 308434 - DNA, 20 bp, Artificial
  CRISPR gRNA sequence
tgacattttctagtttggga

SEQ ID NO: 308435 - DNA, 20 bp, Artificial
  CRISPR gRNA sequence
ggaaagggtttttaagaaag

SEQ ID NO: 308436 - DNA, 20 bp, Artificial
  CRISPR gRNA sequence
tgacttttacttgaccatga

SEQ ID NO: 308437 - DNA, 20 bp, Artificial
  CRISPR gRNA sequence
cttgaccatgacagagcttg

SEQ ID NO: 308438 - DNA, 20 bp, Artificial
  CRISPR gRNA sequence
ttattttcttccagttctta

SEQ ID NO: 308439 - DNA, 20 bp, Artificial
  CRISPR gRNA sequence
tcctctccctctccattagt

SEQ ID NO: 308440 - DNA, 20 bp, Artificial
  CRISPR gRNA sequence
tattcaagtaacaggcactc

SEQ ID NO: 308441 - DNA, 20 bp, Artificial
  CRISPR gRNA sequence
ctctcatcaatgtctcaggg

SEQ ID NO: 308442 - DNA, 20 bp, Artificial
  CRISPR gRNA sequence
ctcctagataccaaaagaag

SEQ ID NO: 308443 - DNA, 20 bp, Artificial
  CRISPR gRNA sequence
ccaaaagaaggaaagtttga

SEQ ID NO: 308444 - DNA, 20 bp, Artificial
  CRISPR gRNA sequence
actcaaatgatgcaatttca

SEQ ID NO: 308445 - DNA, 20 bp, Artificial
  CRISPR gRNA sequence
caatttcagggggattggga

SEQ ID NO: 308446 - DNA, 20 bp, Artificial
  CRISPR gRNA sequence
ccttaaattctaacactgga

SEQ ID NO: 308447 - DNA, 20 bp, Artificial
  CRISPR gRNA sequence
ccattgggaggggtaatata

SEQ ID NO: 308448 - DNA, 20 bp, Artificial
  CRISPR gRNA sequence
atttagttttagcaatcatt

SEQ ID NO: 308449 - DNA, 20 bp, Artificial
  CRISPR gRNA sequence
agcaatcattttgtgattgg

SEQ ID NO: 308450 - DNA, 20 bp, Artificial
  CRISPR gRNA sequence
ttctaatccttttctgaaag

SEQ ID NO: 308451 - DNA, 20 bp, Artificial
  CRISPR gRNA sequence
atccactcaacaatacctct

SEQ ID NO: 308452 - DNA, 20 bp, Artificial
  CRISPR gRNA sequence
caacaatacctctgatggtt

SEQ ID NO: 308453 - DNA, 20 bp, Artificial
  CRISPR gRNA sequence
tatgtgtgtatttaaaaaca

SEQ ID NO: 308454 - DNA, 20 bp, Artificial
  CRISPR gRNA sequence
aaaaataaaagataaaaaca

SEQ ID NO: 308455 - DNA, 20 bp, Artificial
  CRISPR gRNA sequence
aataataaaacccaatcatt

SEQ ID NO: 308456 - DNA, 20 bp, Artificial
  CRISPR gRNA sequence
aaacccaatcattttcagtt

SEQ ID NO: 308457 - DNA, 20 bp, Artificial
  CRISPR gRNA sequence
atcattttcagtttagagtt

SEQ ID NO: 308458 - DNA, 20 bp, Artificial
  CRISPR gRNA sequence
catttttataagccaaaata

SEQ ID NO: 308459 - DNA, 20 bp, Artificial
  CRISPR gRNA sequence
gccaaaatagttcgcttttc

SEQ ID NO: 308460 - DNA, 20 bp, Artificial
  CRISPR gRNA sequence
ataaccatgaatctacttaa

SEQ ID NO: 308461 - DNA, 20 bp, Artificial
  CRISPR gRNA sequence
catgaatctacttaaaatag

SEQ ID NO: 308462 - DNA, 20 bp, Artificial
  CRISPR gRNA sequence
taatgtgtattcttcttgtg

SEQ ID NO: 308463 - DNA, 20 bp, Artificial
  CRISPR gRNA sequence
gtgtattcttcttgtgcctg

SEQ ID NO: 308464 - DNA, 20 bp, Artificial
  CRISPR gRNA sequence
ctggattgtttcacttagca

SEQ ID NO: 308465 - DNA, 20 bp, Artificial
  CRISPR gRNA sequence
attagtagtccattcctttc

SEQ ID NO: 308466 - DNA, 20 bp, Artificial
  CRISPR gRNA sequence
actgatgaaaatttagaatg

SEQ ID NO: 308467 - DNA, 20 bp, Artificial
  CRISPR gRNA sequence
atttttaaattttttaaaat

SEQ ID NO: 308468 - DNA, 20 bp, Artificial
  CRISPR gRNA sequence
aatttctgtttggtaaatgt

SEQ ID NO: 308469 - DNA, 20 bp, Artificial
  CRISPR gRNA sequence
tgggttgtatagcagtatat

SEQ ID NO: 308470 - DNA, 20 bp, Artificial
  CRISPR gRNA sequence
tagcagtatatgagagtttc

SEQ ID NO: 308471 - DNA, 20 bp, Artificial
  CRISPR gRNA sequence
ttcatatcctctccaacact

SEQ ID NO: 308472 - DNA, 20 bp, Artificial
  CRISPR gRNA sequence
ggtgtgcagtggtatctcat

SEQ ID NO: 308473 - DNA, 20 bp, Artificial
  CRISPR gRNA sequence
cttcttcttgccttttatta

SEQ ID NO: 308474 - DNA, 20 bp, Artificial
  CRISPR gRNA sequence
ttatcagatatatattttgc

SEQ ID NO: 308475 - DNA, 20 bp, Artificial
  CRISPR gRNA sequence
gcaaacgttttctccctgtc

SEQ ID NO: 308476 - DNA, 20 bp, Artificial
  CRISPR gRNA sequence
tccctgtctgtggtttgact

SEQ ID NO: 308477 - DNA, 20 bp, Artificial
  CRISPR gRNA sequence
tttaaacaaagtcaaagaac

SEQ ID NO: 308478 - DNA, 20 bp, Artificial
  CRISPR gRNA sequence
tccattttatctttttatga

SEQ ID NO: 308479 - DNA, 20 bp, Artificial
  CRISPR gRNA sequence
ttatctttttatgatatggt

SEQ ID NO: 308480 - DNA, 20 bp, Artificial
  CRISPR gRNA sequence
acttgcctaacttaaggtta

SEQ ID NO: 308481 - DNA, 20 bp, Artificial
  CRISPR gRNA sequence
aaggttacaaagattttctc

SEQ ID NO: 308482 - DNA, 20 bp, Artificial
  CRISPR gRNA sequence
tttctgcatggaattacctt

SEQ ID NO: 308483 - DNA, 20 bp, Artificial
  CRISPR gRNA sequence
ttttttttttttttttgaga

SEQ ID NO: 308484 - DNA, 20 bp, Artificial
  CRISPR gRNA sequence
tgcctcagcctccagagtag

SEQ ID NO: 308485 - DNA, 20 bp, Artificial
  CRISPR gRNA sequence
cctttgttcttatttttcag

SEQ ID NO: 308486 - DNA, 20 bp, Artificial
  CRISPR gRNA sequence
ttcagaattgttttggcaat

SEQ ID NO: 308487 - DNA, 20 bp, Artificial
  CRISPR gRNA sequence
atttccctataacttttcga

SEQ ID NO: 308488 - DNA, 20 bp, Artificial
  CRISPR gRNA sequence
aagatttttagtatctatta

SEQ ID NO: 308489 - DNA, 20 bp, Artificial
  CRISPR gRNA sequence
agtatctattagagagctta

SEQ ID NO: 308490 - DNA, 20 bp, Artificial
  CRISPR gRNA sequence
tattagagagcttaccagga

SEQ ID NO: 308491 - DNA, 20 bp, Artificial
  CRISPR gRNA sequence
agagcttaccaggattttga

SEQ ID NO: 308492 - DNA, 20 bp, Artificial
  CRISPR gRNA sequence
ggttatcttaacatctagtc

SEQ ID NO: 308493 - DNA, 20 bp, Artificial
  CRISPR gRNA sequence
tggcctatgtctccatttat

SEQ ID NO: 308494 - DNA, 20 bp, Artificial
  CRISPR gRNA sequence
tttctccagtagtaatattg

SEQ ID NO: 308495 - DNA, 20 bp, Artificial
  CRISPR gRNA sequence
tttcagtatatagaccttgt

SEQ ID NO: 308496 - DNA, 20 bp, Artificial
  CRISPR gRNA sequence
ttgttttgttaaatttattt

SEQ ID NO: 308497 - DNA, 20 bp, Artificial
  CRISPR gRNA sequence
attaatttttttcaatgtac

SEQ ID NO: 308498 - DNA, 20 bp, Artificial
  CRISPR gRNA sequence
ttttgttagtatatagaaat

SEQ ID NO: 308499 - DNA, 20 bp, Artificial
  CRISPR gRNA sequence
tgtctttgctacactcactt

SEQ ID NO: 308500 - DNA, 20 bp, Artificial
  CRISPR gRNA sequence
acactcacttatcagtttta

SEQ ID NO: 308501 - DNA, 20 bp, Artificial
  CRISPR gRNA sequence
atcagttttaataggttttt

SEQ ID NO: 308502 - DNA, 20 bp, Artificial
  CRISPR gRNA sequence
ataggtttttgatagattcc

SEQ ID NO: 308503 - DNA, 20 bp, Artificial
  CRISPR gRNA sequence
gatcattatctgtgaaaaaa

SEQ ID NO: 308504 - DNA, 20 bp, Artificial
  CRISPR gRNA sequence
tcttttatttctttttctag

SEQ ID NO: 308505 - DNA, 20 bp, Artificial
  CRISPR gRNA sequence
tcttgtattcctatttttat

SEQ ID NO: 308506 - DNA, 20 bp, Artificial
  CRISPR gRNA sequence
gaatgggtattaattttgtc

SEQ ID NO: 308507 - DNA, 20 bp, Artificial
  CRISPR gRNA sequence
ctgtatccattgacatgatc

SEQ ID NO: 308508 - DNA, 20 bp, Artificial
  CRISPR gRNA sequence
tgatcatatgtttttttctt

SEQ ID NO: 308509 - DNA, 20 bp, Artificial
  CRISPR gRNA sequence
tttatgtagtaaaggttatt

SEQ ID NO: 308510 - DNA, 20 bp, Artificial
  CRISPR gRNA sequence
tattgcctgatttttgaatg

SEQ ID NO: 308511 - DNA, 20 bp, Artificial
  CRISPR gRNA sequence
tttttgaatgttgagcttac

SEQ ID NO: 308512 - DNA, 20 bp, Artificial
  CRISPR gRNA sequence
tattatacttttaacatatt

SEQ ID NO: 308513 - DNA, 20 bp, Artificial
  CRISPR gRNA sequence
tttgttaagcatttcacgag

SEQ ID NO: 308514 - DNA, 20 bp, Artificial
  CRISPR gRNA sequence
agcatttcacgagagatgtt

SEQ ID NO: 308515 - DNA, 20 bp, Artificial
  CRISPR gRNA sequence
gcagcaaactagagcaatca

SEQ ID NO: 308516 - DNA, 20 bp, Artificial
  CRISPR gRNA sequence
tctttccttcactcagggac

SEQ ID NO: 308517 - DNA, 20 bp, Artificial
  CRISPR gRNA sequence
gtcatccgatctctgaaaac

SEQ ID NO: 308518 - DNA, 20 bp, Artificial
  CRISPR gRNA sequence
acagttgtttcatatatttt

SEQ ID NO: 308519 - DNA, 20 bp, Artificial
  CRISPR gRNA sequence
atatattttgtctgctttct

SEQ ID NO: 308520 - DNA, 20 bp, Artificial
  CRISPR gRNA sequence
aacctctgcctcccaggttc

SEQ ID NO: 308521 - DNA, 20 bp, Artificial
  CRISPR gRNA sequence
tctctcagcctcccaagtag

SEQ ID NO: 308522 - DNA, 20 bp, Artificial
  CRISPR gRNA sequence
accacacccagctaattttt

SEQ ID NO: 308523 - DNA, 20 bp, Artificial
  CRISPR gRNA sequence
ttttgtatgtttagtagaaa

SEQ ID NO: 308524 - DNA, 20 bp, Artificial
  CRISPR gRNA sequence
tgcctcagcctccaaaagtg

SEQ ID NO: 308525 - DNA, 20 bp, Artificial
  CRISPR gRNA sequence
tcttaattgactgagttccc

SEQ ID NO: 308526 - DNA, 20 bp, Artificial
  CRISPR gRNA sequence
ctggttatgttctatttttg

SEQ ID NO: 308527 - DNA, 20 bp, Artificial
  CRISPR gRNA sequence
aagtttcttcttaaaaataa

SEQ ID NO: 308528 - DNA, 20 bp, Artificial
  CRISPR gRNA sequence
atggatgtggtgaaaaggga

SEQ ID NO: 308529 - DNA, 20 bp, Artificial
  CRISPR gRNA sequence
aaacactatggaaaacagta

SEQ ID NO: 308530 - DNA, 20 bp, Artificial
  CRISPR gRNA sequence
tgaaaaagacacatgcacac

SEQ ID NO: 308531 - DNA, 20 bp, Artificial
  CRISPR gRNA sequence
agaatggagaaacaaatatt

SEQ ID NO: 308532 - DNA, 20 bp, Artificial
  CRISPR gRNA sequence
atccatgtaaccaaaaacca

SEQ ID NO: 308533 - DNA, 20 bp, Artificial
  CRISPR gRNA sequence
aatacagtatttcagatgtc

SEQ ID NO: 308534 - DNA, 20 bp, Artificial
  CRISPR gRNA sequence
atgaaagcagacaattaaaa

SEQ ID NO: 308535 - DNA, 20 bp, Artificial
  CRISPR gRNA sequence
ggtagattctaaacttttaa

SEQ ID NO: 308536 - DNA, 20 bp, Artificial
  CRISPR gRNA sequence
gtctttaagcctgtgaatat

SEQ ID NO: 308537 - DNA, 20 bp, Artificial
  CRISPR gRNA sequence
actgaaaatacaaaaattac

SEQ ID NO: 308538 - DNA, 20 bp, Artificial
  CRISPR gRNA sequence
ttgggaggctgaggcaggag

SEQ ID NO: 308539 - DNA, 20 bp, Artificial
  CRISPR gRNA sequence
tcctgaaacagctgagactc

SEQ ID NO: 308540 - DNA, 20 bp, Artificial
  CRISPR gRNA sequence
gttgttgctagggcattgta

SEQ ID NO: 308541 - DNA, 20 bp, Artificial
  CRISPR gRNA sequence
aaaatttcagggggagctat

SEQ ID NO: 308542 - DNA, 20 bp, Artificial
  CRISPR gRNA sequence
tcccaatgggtaagctgata

SEQ ID NO: 308543 - DNA, 20 bp, Artificial
  CRISPR gRNA sequence
gggtaagctgatagggtgat

SEQ ID NO: 308544 - DNA, 20 bp, Artificial
  CRISPR gRNA sequence
gacaaaacaaaaaaagagaa

SEQ ID NO: 308545 - DNA, 20 bp, Artificial
  CRISPR gRNA sequence
ggacttttggtgccaagtta

SEQ ID NO: 308546 - DNA, 20 bp, Artificial
  CRISPR gRNA sequence
gaggaccgtctcctctgaga

SEQ ID NO: 308547 - DNA, 20 bp, Artificial
  CRISPR gRNA sequence
gaaattcctaccagttatca

SEQ ID NO: 308548 - DNA, 20 bp, Artificial
  CRISPR gRNA sequence
tgtgtctctgtggagggatc

SEQ ID NO: 308549 - DNA, 20 bp, Artificial
  CRISPR gRNA sequence
gctgtcaactgagagccact

SEQ ID NO: 308550 - DNA, 20 bp, Artificial
  CRISPR gRNA sequence
gctacttacattccttggct

SEQ ID NO: 308551 - DNA, 20 bp, Artificial
  CRISPR gRNA sequence
tcaaagctagaaatgctggg

SEQ ID NO: 308552 - DNA, 20 bp, Artificial
  CRISPR gRNA sequence
gaaatgctgggttgagcttc

SEQ ID NO: 308553 - DNA, 20 bp, Artificial
  CRISPR gRNA sequence
taggaaaggttctctgactc

SEQ ID NO: 308554 - DNA, 20 bp, Artificial
  CRISPR gRNA sequence
tccaggttaatctcaccatc

SEQ ID NO: 308555 - DNA, 20 bp, Artificial
  CRISPR gRNA sequence
ctccctccctacagtgatag

SEQ ID NO: 308556 - DNA, 20 bp, Artificial
  CRISPR gRNA sequence
gaccatctcatctgtaccta

SEQ ID NO: 308557 - DNA, 20 bp, Artificial
  CRISPR gRNA sequence
tttatctcccctatctagtc

SEQ ID NO: 308558 - DNA, 20 bp, Artificial
  CRISPR gRNA sequence
tatctagtctcctgattttt

SEQ ID NO: 308559 - DNA, 20 bp, Artificial
  CRISPR gRNA sequence
aatctttttctccaaccctt

SEQ ID NO: 308560 - DNA, 20 bp, Artificial
  CRISPR gRNA sequence
atgtgaagaaaaatctagca

SEQ ID NO: 308561 - DNA, 20 bp, Artificial
  CRISPR gRNA sequence
cgcagcacactccatacatt

SEQ ID NO: 308562 - DNA, 20 bp, Artificial
  CRISPR gRNA sequence
gcagtttgaatggctctgcc

SEQ ID NO: 308563 - DNA, 20 bp, Artificial
  CRISPR gRNA sequence
tgtcatccatctattttcta

SEQ ID NO: 308564 - DNA, 20 bp, Artificial
  CRISPR gRNA sequence
ggccagaggcaatactcatc

SEQ ID NO: 308565 - DNA, 20 bp, Artificial
  CRISPR gRNA sequence
ttactgagataaagtccaat

SEQ ID NO: 308566 - DNA, 20 bp, Artificial
  CRISPR gRNA sequence
ataacagaagtcagtgggga

SEQ ID NO: 308567 - DNA, 20 bp, Artificial
  CRISPR gRNA sequence
atcctaattatggaaaacaa

SEQ ID NO: 308568 - DNA, 20 bp, Artificial
  CRISPR gRNA sequence
ttttttcttattagtggagt

SEQ ID NO: 308569 - DNA, 20 bp, Artificial
  CRISPR gRNA sequence
tagaaattagttaaagttaa

SEQ ID NO: 308570 - DNA, 20 bp, Artificial
  CRISPR gRNA sequence
ctaacttatttcataagaaa

SEQ ID NO: 308571 - DNA, 20 bp, Artificial
  CRISPR gRNA sequence
agatttttttagagacgaga

SEQ ID NO: 308572 - DNA, 20 bp, Artificial
  CRISPR gRNA sequence
tgtggtcatttagcaaatat

SEQ ID NO: 308573 - DNA, 20 bp, Artificial
  CRISPR gRNA sequence
cacaatctttaacatttagg

SEQ ID NO: 308574 - DNA, 20 bp, Artificial
  CRISPR gRNA sequence
ggtagataaagcaagtaata

SEQ ID NO: 308575 - DNA, 20 bp, Artificial
  CRISPR gRNA sequence
acaagctccggaaggcagcc

SEQ ID NO: 308576 - DNA, 20 bp, Artificial
  CRISPR gRNA sequence
cacatttataagagttgcga

SEQ ID NO: 308577 - DNA, 20 bp, Artificial
  CRISPR gRNA sequence
agccaggagagtcatttaca

SEQ ID NO: 308578 - DNA, 20 bp, Artificial
  CRISPR gRNA sequence
aagaagagggtcagcctggc

SEQ ID NO: 308579 - DNA, 20 bp, Artificial
  CRISPR gRNA sequence
aggccctgaagttcctctcg

SEQ ID NO: 308580 - DNA, 20 bp, Artificial
  CRISPR gRNA sequence
cctctcacttggacaaatgg

SEQ ID NO: 308581 - DNA, 20 bp, Artificial
  CRISPR gRNA sequence
agcttccacaggcccctacc

SEQ ID NO: 308582 - DNA, 20 bp, Artificial
  CRISPR gRNA sequence
ggcccctacctctagttttc

SEQ ID NO: 308583 - DNA, 20 bp, Artificial
  CRISPR gRNA sequence
cctacctctagttttcattt

SEQ ID NO: 308584 - DNA, 20 bp, Artificial
  CRISPR gRNA sequence
cctctagttttcatttgctt

SEQ ID NO: 308585 - DNA, 20 bp, Artificial
  CRISPR gRNA sequence
agttttcatttgcttgtttg

SEQ ID NO: 308586 - DNA, 20 bp, Artificial
  CRISPR gRNA sequence
tttttcctactgaggtcaca

SEQ ID NO: 308587 - DNA, 20 bp, Artificial
  CRISPR gRNA sequence
gtcacagcaggtttcctctg

SEQ ID NO: 308588 - DNA, 20 bp, Artificial
  CRISPR gRNA sequence
ctcatctactgaaaaacctt

SEQ ID NO: 308589 - DNA, 20 bp, Artificial
  CRISPR gRNA sequence
acttccttacatgagaactc

SEQ ID NO: 308590 - DNA, 20 bp, Artificial
  CRISPR gRNA sequence
agtttctggggagttggaaa

SEQ ID NO: 308591 - DNA, 20 bp, Artificial
  CRISPR gRNA sequence
aaattaggaccagctgatct

SEQ ID NO: 308592 - DNA, 20 bp, Artificial
  CRISPR gRNA sequence
ctataatttgtagacacatg

SEQ ID NO: 308593 - DNA, 20 bp, Artificial
  CRISPR gRNA sequence
tcccagtctattccacttga

SEQ ID NO: 308594 - DNA, 20 bp, Artificial
  CRISPR gRNA sequence
ctgaagatgggggtacctgt

SEQ ID NO: 308595 - DNA, 20 bp, Artificial
  CRISPR gRNA sequence
aggaggtactgaacttcagg

SEQ ID NO: 308596 - DNA, 20 bp, Artificial
  CRISPR gRNA sequence
gaacttcaggcatagcttgg

SEQ ID NO: 308597 - DNA, 20 bp, Artificial
  CRISPR gRNA sequence
acgagttggctccaccattt

SEQ ID NO: 308598 - DNA, 20 bp, Artificial
  CRISPR gRNA sequence
gaagaagtcagtagcaggag

SEQ ID NO: 308599 - DNA, 20 bp, Artificial
  CRISPR gRNA sequence
ccaggagggaatcttgcagt

SEQ ID NO: 308600 - DNA, 20 bp, Artificial
  CRISPR gRNA sequence
gtcaggctcctattagtggc

SEQ ID NO: 308601 - DNA, 20 bp, Artificial
  CRISPR gRNA sequence
gctcctattagtggctactg

SEQ ID NO: 308602 - DNA, 20 bp, Artificial
  CRISPR gRNA sequence
cacacaagcatttctgcctc

SEQ ID NO: 308603 - DNA, 20 bp, Artificial
  CRISPR gRNA sequence
tgatccactgtggtcctctc

SEQ ID NO: 308604 - DNA, 20 bp, Artificial
  CRISPR gRNA sequence
ttttcagctacggaagtcac

SEQ ID NO: 308605 - DNA, 20 bp, Artificial
  CRISPR gRNA sequence
gatatttccatggaataaaa

SEQ ID NO: 308606 - DNA, 20 bp, Artificial
  CRISPR gRNA sequence
ccaattcaaccttttaaaaa

SEQ ID NO: 308607 - DNA, 20 bp, Artificial
  CRISPR gRNA sequence
catgtgtgcacattacaggg

SEQ ID NO: 308608 - DNA, 20 bp, Artificial
  CRISPR gRNA sequence
gcagagggggtgtcatatct

SEQ ID NO: 308609 - DNA, 20 bp, Artificial
  CRISPR gRNA sequence
aaggtaaaccaagagactga

SEQ ID NO: 308610 - DNA, 20 bp, Artificial
  CRISPR gRNA sequence
cgtcataaaatggcccagtt

SEQ ID NO: 308611 - DNA, 20 bp, Artificial
  CRISPR gRNA sequence
tgaaagaaatagtcttggaa

SEQ ID NO: 308612 - DNA, 20 bp, Artificial
  CRISPR gRNA sequence
gaagataaaagccgcgtctt

SEQ ID NO: 308613 - DNA, 20 bp, Artificial
  CRISPR gRNA sequence
tacagttctgtgacattatc

SEQ ID NO: 308614 - DNA, 20 bp, Artificial
  CRISPR gRNA sequence
agagataaaaaaaaatcaat

SEQ ID NO: 308615 - DNA, 20 bp, Artificial
  CRISPR gRNA sequence
gtgagtgccacataatgact

SEQ ID NO: 308616 - DNA, 20 bp, Artificial
  CRISPR gRNA sequence
tcatgtttatttttcaacaa

SEQ ID NO: 308617 - DNA, 20 bp, Artificial
  CRISPR gRNA sequence
ttcaacaatagagtttgcag

SEQ ID NO: 308618 - DNA, 20 bp, Artificial
  CRISPR gRNA sequence
agtttgcagccatgcttact

SEQ ID NO: 308619 - DNA, 20 bp, Artificial
  CRISPR gRNA sequence
gagggctgtaattgagtcac

SEQ ID NO: 308620 - DNA, 20 bp, Artificial
  CRISPR gRNA sequence
ccaaagatttacaatgaagc

SEQ ID NO: 308621 - DNA, 20 bp, Artificial
  CRISPR gRNA sequence
catatctttcagaaacccaa

SEQ ID NO: 308622 - DNA, 20 bp, Artificial
  CRISPR gRNA sequence
ttggaattcgaaattcagaa

SEQ ID NO: 308623 - DNA, 20 bp, Artificial
  CRISPR gRNA sequence
atacatgatcttaataaaca

SEQ ID NO: 308624 - DNA, 20 bp, Artificial
  CRISPR gRNA sequence
ttgttcttttatagttacta

SEQ ID NO: 308625 - DNA, 20 bp, Artificial
  CRISPR gRNA sequence
gtcatttgcatgtcatcttt

SEQ ID NO: 308626 - DNA, 20 bp, Artificial
  CRISPR gRNA sequence
gtagaaggtgaattgccaga

SEQ ID NO: 308627 - DNA, 20 bp, Artificial
  CRISPR gRNA sequence
aggtgaattgccagaccgtg

SEQ ID NO: 308628 - DNA, 20 bp, Artificial
  CRISPR gRNA sequence
aaatcacatgttgcgtaagt

SEQ ID NO: 308629 - DNA, 20 bp, Artificial
  CRISPR gRNA sequence
atacattaaaacaaatacaa

SEQ ID NO: 308630 - DNA, 20 bp, Artificial
  CRISPR gRNA sequence
aaatacaacatggcttttca

SEQ ID NO: 308631 - DNA, 20 bp, Artificial
  CRISPR gRNA sequence
acctgaccacattttgaaaa

SEQ ID NO: 308632 - DNA, 20 bp, Artificial
  CRISPR gRNA sequence
ctattcctaaagccctgcag

SEQ ID NO: 308633 - DNA, 20 bp, Artificial
  CRISPR gRNA sequence
gctctccattctatttttac

SEQ ID NO: 308634 - DNA, 20 bp, Artificial
  CRISPR gRNA sequence
cattctatttttacttttgc

SEQ ID NO: 308635 - DNA, 20 bp, Artificial
  CRISPR gRNA sequence
cttttgcttctgttttactc

SEQ ID NO: 308636 - DNA, 20 bp, Artificial
  CRISPR gRNA sequence
ataggtgttgatctgccttt

SEQ ID NO: 308637 - DNA, 20 bp, Artificial
  CRISPR gRNA sequence
tcacacaaaaacctgtacat

SEQ ID NO: 308638 - DNA, 20 bp, Artificial
  CRISPR gRNA sequence
ggcgcgctaaacgaaagaag

SEQ ID NO: 308639 - DNA, 20 bp, Artificial
  CRISPR gRNA sequence
gcttaaaaggttacatactg

SEQ ID NO: 308640 - DNA, 20 bp, Artificial
  CRISPR gRNA sequence
aaaaaataattttactgtgt

SEQ ID NO: 308641 - DNA, 20 bp, Artificial
  CRISPR gRNA sequence
aggtctcgtgaagcagagga

SEQ ID NO: 308642 - DNA, 20 bp, Artificial
  CRISPR gRNA sequence
tgaagcagaggagctggttt

SEQ ID NO: 308643 - DNA, 20 bp, Artificial
  CRISPR gRNA sequence
ctggtttgtaagtttgtggg

SEQ ID NO: 308644 - DNA, 20 bp, Artificial
  CRISPR gRNA sequence
aagtttgtgggttatgtttg

SEQ ID NO: 308645 - DNA, 20 bp, Artificial
  CRISPR gRNA sequence
aaaacccaaatgtgtcagct

SEQ ID NO: 308646 - DNA, 20 bp, Artificial
  CRISPR gRNA sequence
gctttgctaggagctccagg

SEQ ID NO: 308647 - DNA, 20 bp, Artificial
  CRISPR gRNA sequence
tttgtgatggccaaattatc

SEQ ID NO: 308648 - DNA, 20 bp, Artificial
  CRISPR gRNA sequence
tagctctattttttccccaa

SEQ ID NO: 308649 - DNA, 20 bp, Artificial
  CRISPR gRNA sequence
gggcccctcaagtccccctc

SEQ ID NO: 308650 - DNA, 20 bp, Artificial
  CRISPR gRNA sequence
ggtggatgcgaatcattcct

SEQ ID NO: 308651 - DNA, 20 bp, Artificial
  CRISPR gRNA sequence
acaagcccttgtccttgatc

SEQ ID NO: 308652 - DNA, 20 bp, Artificial
  CRISPR gRNA sequence
taagtatacctcattcagaa

SEQ ID NO: 308653 - DNA, 20 bp, Artificial
  CRISPR gRNA sequence
ccaaaatactactagctcac

SEQ ID NO: 308654 - DNA, 20 bp, Artificial
  CRISPR gRNA sequence
tactactagctcactcaggc

SEQ ID NO: 308655 - DNA, 20 bp, Artificial
  CRISPR gRNA sequence
ctcactcaggctttggtttt

SEQ ID NO: 308656 - DNA, 20 bp, Artificial
  CRISPR gRNA sequence
aggtctgcagtctcattgaa

SEQ ID NO: 308657 - DNA, 20 bp, Artificial
  CRISPR gRNA sequence
cagcacctaaaaaagaaggt

SEQ ID NO: 308658 - DNA, 20 bp, Artificial
  CRISPR gRNA sequence
taagctctggaactgtgcac

SEQ ID NO: 308659 - DNA, 20 bp, Artificial
  CRISPR gRNA sequence
gtgcacatctgcttggcatc

SEQ ID NO: 308660 - DNA, 20 bp, Artificial
  CRISPR gRNA sequence
ctggagattaggacctttgt

SEQ ID NO: 308661 - DNA, 20 bp, Artificial
  CRISPR gRNA sequence
aaactgcaatctttatgagc

SEQ ID NO: 308662 - DNA, 20 bp, Artificial
  CRISPR gRNA sequence
ttatgagcctcagtttcctc

SEQ ID NO: 308663 - DNA, 20 bp, Artificial
  CRISPR gRNA sequence
taccttcctataaccttaat

SEQ ID NO: 308664 - DNA, 20 bp, Artificial
  CRISPR gRNA sequence
ataacttctacaccatcacc

SEQ ID NO: 308665 - DNA, 20 bp, Artificial
  CRISPR gRNA sequence
ttccttggtctgctatggtg

SEQ ID NO: 308666 - DNA, 20 bp, Artificial
  CRISPR gRNA sequence
ccagcacttccaaggatgtc

SEQ ID NO: 308667 - DNA, 20 bp, Artificial
  CRISPR gRNA sequence
gagaactgggcaaatttgat

SEQ ID NO: 308668 - DNA, 20 bp, Artificial
  CRISPR gRNA sequence
gggcaaatttgatggctgtt

SEQ ID NO: 308669 - DNA, 20 bp, Artificial
  CRISPR gRNA sequence
tcatagatgggcaggtgagg

SEQ ID NO: 308670 - DNA, 20 bp, Artificial
  CRISPR gRNA sequence
catgctggaagggttgagag

SEQ ID NO: 308671 - DNA, 20 bp, Artificial
  CRISPR gRNA sequence
tttagtccttgaggacactt

SEQ ID NO: 308672 - DNA, 20 bp, Artificial
  CRISPR gRNA sequence
tacttaaatgtgaatgatca

SEQ ID NO: 308673 - DNA, 20 bp, Artificial
  CRISPR gRNA sequence
gcgggggtggagagtgggaa

SEQ ID NO: 308674 - DNA, 20 bp, Artificial
  CRISPR gRNA sequence
tctaaataaaatttcatcat

SEQ ID NO: 308675 - DNA, 20 bp, Artificial
  CRISPR gRNA sequence
gggttgatgagagagatgag

SEQ ID NO: 308676 - DNA, 20 bp, Artificial
  CRISPR gRNA sequence
tgggggagtaattaaattga

SEQ ID NO: 308677 - DNA, 20 bp, Artificial
  CRISPR gRNA sequence
agcagacagcaggcatcagt

SEQ ID NO: 308678 - DNA, 20 bp, Artificial
  CRISPR gRNA sequence
acagtgaaagggagacctaa

SEQ ID NO: 308679 - DNA, 20 bp, Artificial
  CRISPR gRNA sequence
ggagacctaaggaagattta

SEQ ID NO: 308680 - DNA, 20 bp, Artificial
  CRISPR gRNA sequence
atcaccttacaaggcaaacc

SEQ ID NO: 308681 - DNA, 20 bp, Artificial
  CRISPR gRNA sequence
gcaagagtgccccctactgt

SEQ ID NO: 308682 - DNA, 20 bp, Artificial
  CRISPR gRNA sequence
agcattgtctctgaggaaat

SEQ ID NO: 308683 - DNA, 20 bp, Artificial
  CRISPR gRNA sequence
ctggaaatgacttcgtcttt

SEQ ID NO: 308684 - DNA, 20 bp, Artificial
  CRISPR gRNA sequence
gtctttagctgcttctgtct

SEQ ID NO: 308685 - DNA, 20 bp, Artificial
  CRISPR gRNA sequence
ctgacccaggccccttctcc

SEQ ID NO: 308686 - DNA, 20 bp, Artificial
  CRISPR gRNA sequence
ccccttctcccaaagattac

SEQ ID NO: 308687 - DNA, 20 bp, Artificial
  CRISPR gRNA sequence
aaagtgtgatgtatggacca

SEQ ID NO: 308688 - DNA, 20 bp, Artificial
  CRISPR gRNA sequence
ctctggccccacccaagact

SEQ ID NO: 308689 - DNA, 20 bp, Artificial
  CRISPR gRNA sequence
acctccattttaacaagagc

SEQ ID NO: 308690 - DNA, 20 bp, Artificial
  CRISPR gRNA sequence
tccatagcacctcaccaacc

SEQ ID NO: 308691 - DNA, 20 bp, Artificial
  CRISPR gRNA sequence
cctttctctgactaaatggg

SEQ ID NO: 308692 - DNA, 20 bp, Artificial
  CRISPR gRNA sequence
ccacctagcaactggactta

SEQ ID NO: 308693 - DNA, 20 bp, Artificial
  CRISPR gRNA sequence
cttcgtaatcagctgaagga

SEQ ID NO: 308694 - DNA, 20 bp, Artificial
  CRISPR gRNA sequence
tatccccaaatgcatatctt

SEQ ID NO: 308695 - DNA, 20 bp, Artificial
  CRISPR gRNA sequence
attatctcttctttatgttc

SEQ ID NO: 308696 - DNA, 20 bp, Artificial
  CRISPR gRNA sequence
ttcttttactaaacttcctc

SEQ ID NO: 308697 - DNA, 20 bp, Artificial
  CRISPR gRNA sequence
acatctttaaccccttcatt

SEQ ID NO: 308698 - DNA, 20 bp, Artificial
  CRISPR gRNA sequence
aggttattatttcagtgaaa

SEQ ID NO: 308699 - DNA, 20 bp, Artificial
  CRISPR gRNA sequence
ccacttgctccagccccagc

SEQ ID NO: 308700 - DNA, 20 bp, Artificial
  CRISPR gRNA sequence
ttgctccagccccagctact

SEQ ID NO: 308701 - DNA, 20 bp, Artificial
  CRISPR gRNA sequence
tttgaggtgtctgactttct

SEQ ID NO: 308702 - DNA, 20 bp, Artificial
  CRISPR gRNA sequence
gtcactaccaccttgctaaa

SEQ ID NO: 308703 - DNA, 20 bp, Artificial
  CRISPR gRNA sequence
gtccacaacctcctattcat

SEQ ID NO: 308704 - DNA, 20 bp, Artificial
  CRISPR gRNA sequence
cctattcatccaggttttgc

SEQ ID NO: 308705 - DNA, 20 bp, Artificial
  CRISPR gRNA sequence
ttgttcaacttaatcaagac

SEQ ID NO: 308706 - DNA, 20 bp, Artificial
  CRISPR gRNA sequence
tttatccagaccctgtagtg

SEQ ID NO: 308707 - DNA, 20 bp, Artificial
  CRISPR gRNA sequence
ttcaaacacaaaccttgtgc

SEQ ID NO: 308708 - DNA, 20 bp, Artificial
  CRISPR gRNA sequence
acaaaccttgtgctactgct

SEQ ID NO: 308709 - DNA, 20 bp, Artificial
  CRISPR gRNA sequence
tggtgacttcacaccatggc

SEQ ID NO: 308710 - DNA, 20 bp, Artificial
  CRISPR gRNA sequence
atgctctattctttcccaat

SEQ ID NO: 308711 - DNA, 20 bp, Artificial
  CRISPR gRNA sequence
cttcttattctccatacttt

SEQ ID NO: 308712 - DNA, 20 bp, Artificial
  CRISPR gRNA sequence
tggtttttctcctctagccc

SEQ ID NO: 308713 - DNA, 20 bp, Artificial
  CRISPR gRNA sequence
agtaaaagctaataactccc

SEQ ID NO: 308714 - DNA, 20 bp, Artificial
  CRISPR gRNA sequence
tgccagcctataactttcac

SEQ ID NO: 308715 - DNA, 20 bp, Artificial
  CRISPR gRNA sequence
gctccgtccttgtccccggg

SEQ ID NO: 308716 - DNA, 20 bp, Artificial
  CRISPR gRNA sequence
gtacctatcaggcctctttc

SEQ ID NO: 308717 - DNA, 20 bp, Artificial
  CRISPR gRNA sequence
gttcttcctccagacagtct

SEQ ID NO: 308718 - DNA, 20 bp, Artificial
  CRISPR gRNA sequence
tcattaaatgctacctccca

SEQ ID NO: 308719 - DNA, 20 bp, Artificial
  CRISPR gRNA sequence
tcatgacatgacatgacacg

SEQ ID NO: 308720 - DNA, 20 bp, Artificial
  CRISPR gRNA sequence
tctctcctgagatgtctggg

SEQ ID NO: 308721 - DNA, 20 bp, Artificial
  CRISPR gRNA sequence
ggttctgattaaaaatctat

SEQ ID NO: 308722 - DNA, 20 bp, Artificial
  CRISPR gRNA sequence
acctgaccacaggcaattaa

SEQ ID NO: 308723 - DNA, 20 bp, Artificial
  CRISPR gRNA sequence
agatctcagcctcccgccag

SEQ ID NO: 308724 - DNA, 20 bp, Artificial
  CRISPR gRNA sequence
tccactccctgccttgaaga

SEQ ID NO: 308725 - DNA, 20 bp, Artificial
  CRISPR gRNA sequence
cctcatgaattctccccacc

SEQ ID NO: 308726 - DNA, 20 bp, Artificial
  CRISPR gRNA sequence
aactgctagagcctttcatt

SEQ ID NO: 308727 - DNA, 20 bp, Artificial
  CRISPR gRNA sequence
aaggcgaccccctaagtctg

SEQ ID NO: 308728 - DNA, 20 bp, Artificial
  CRISPR gRNA sequence
cccttcctcccattttagcc

SEQ ID NO: 308729 - DNA, 20 bp, Artificial
  CRISPR gRNA sequence
cttgattataccgtcgtagt

SEQ ID NO: 308730 - DNA, 20 bp, Artificial
  CRISPR gRNA sequence
taaaagctgaactattttat

SEQ ID NO: 308731 - DNA, 20 bp, Artificial
  CRISPR gRNA sequence
agaataagctccatgacagc

SEQ ID NO: 308732 - DNA, 20 bp, Artificial
  CRISPR gRNA sequence
agaaaccattctttttgccc

SEQ ID NO: 308733 - DNA, 20 bp, Artificial
  CRISPR gRNA sequence
aatatgtaagaaaattaatt

SEQ ID NO: 308734 - DNA, 20 bp, Artificial
  CRISPR gRNA sequence
attagaggtacacaggtatt

SEQ ID NO: 308735 - DNA, 20 bp, Artificial
  CRISPR gRNA sequence
aatacactggaaataagtta

SEQ ID NO: 308736 - DNA, 20 bp, Artificial
  CRISPR gRNA sequence
tacactattataactaatag

SEQ ID NO: 308737 - DNA, 20 bp, Artificial
  CRISPR gRNA sequence
attacttaacttccctgtgt

SEQ ID NO: 308738 - DNA, 20 bp, Artificial
  CRISPR gRNA sequence
acaataatggtacctacctc

SEQ ID NO: 308739 - DNA, 20 bp, Artificial
  CRISPR gRNA sequence
cctacctcataggtttgttg

SEQ ID NO: 308740 - DNA, 20 bp, Artificial
  CRISPR gRNA sequence
actggcctgtggtaagcatt

SEQ ID NO: 308741 - DNA, 20 bp, Artificial
  CRISPR gRNA sequence
tggtaagcattaattgattt

SEQ ID NO: 308742 - DNA, 20 bp, Artificial
  CRISPR gRNA sequence
gcattaattgatttacttgt

SEQ ID NO: 308743 - DNA, 20 bp, Artificial
  CRISPR gRNA sequence
cctgggaattagaggctgca

SEQ ID NO: 308744 - DNA, 20 bp, Artificial
  CRISPR gRNA sequence
cactcctctagcctgggtga

SEQ ID NO: 308745 - DNA, 20 bp, Artificial
  CRISPR gRNA sequence
ctagcctgggtgacagagtt

SEQ ID NO: 308746 - DNA, 20 bp, Artificial
  CRISPR gRNA sequence
taagccacagtctctcaaac

SEQ ID NO: 308747 - DNA, 20 bp, Artificial
  CRISPR gRNA sequence
ttgcttcttccaaaaaaaat

SEQ ID NO: 308748 - DNA, 20 bp, Artificial
  CRISPR gRNA sequence
gtcttccactaaatcaactt

SEQ ID NO: 308749 - DNA, 20 bp, Artificial
  CRISPR gRNA sequence
attttgaaaaacactgaaat

SEQ ID NO: 308750 - DNA, 20 bp, Artificial
  CRISPR gRNA sequence
ctgtctattcacctccaggt

SEQ ID NO: 308751 - DNA, 20 bp, Artificial
  CRISPR gRNA sequence
cagtggacctttccacagga

SEQ ID NO: 308752 - DNA, 20 bp, Artificial
  CRISPR gRNA sequence
cttcctcctgatgtgggagc

SEQ ID NO: 308753 - DNA, 20 bp, Artificial
  CRISPR gRNA sequence
ggtgccaggacagtggcaaa

SEQ ID NO: 308754 - DNA, 20 bp, Artificial
  CRISPR gRNA sequence
caggtggcactaggaattcc

SEQ ID NO: 308755 - DNA, 20 bp, Artificial
  CRISPR gRNA sequence
aattctgcaaggccacaggt

SEQ ID NO: 308756 - DNA, 20 bp, Artificial
  CRISPR gRNA sequence
gggagggaaaagttaaacag

SEQ ID NO: 308757 - DNA, 20 bp, Artificial
  CRISPR gRNA sequence
attcagctctacattttgag

SEQ ID NO: 308758 - DNA, 20 bp, Artificial
  CRISPR gRNA sequence
gaagaaagaattcaaataga

SEQ ID NO: 308759 - DNA, 20 bp, Artificial
  CRISPR gRNA sequence
tcaaatagaatctgattttt

SEQ ID NO: 308760 - DNA, 20 bp, Artificial
  CRISPR gRNA sequence
ttattttctgatctgatgtc

SEQ ID NO: 308761 - DNA, 20 bp, Artificial
  CRISPR gRNA sequence
aaacggttaccatttgaggt

SEQ ID NO: 308762 - DNA, 20 bp, Artificial
  CRISPR gRNA sequence
gggcaaaagtgacacctgaa

SEQ ID NO: 308763 - DNA, 20 bp, Artificial
  CRISPR gRNA sequence
actcagttttcatagagtgt

SEQ ID NO: 308764 - DNA, 20 bp, Artificial
  CRISPR gRNA sequence
aatttggtgggaaatggtgt

SEQ ID NO: 308765 - DNA, 20 bp, Artificial
  CRISPR gRNA sequence
tgggaaatggtgttccagtt

SEQ ID NO: 308766 - DNA, 20 bp, Artificial
  CRISPR gRNA sequence
cagtttagtgttttctggaa

SEQ ID NO: 308767 - DNA, 20 bp, Artificial
  CRISPR gRNA sequence
gggctggtcactttgatgag

SEQ ID NO: 308768 - DNA, 20 bp, Artificial
  CRISPR gRNA sequence
aagaagtcttaccacttatt

SEQ ID NO: 308769 - DNA, 20 bp, Artificial
  CRISPR gRNA sequence
gggtaaattacttcatctct

SEQ ID NO: 308770 - DNA, 20 bp, Artificial
  CRISPR gRNA sequence
tcatatacaatggtggtccc

SEQ ID NO: 308771 - DNA, 20 bp, Artificial
  CRISPR gRNA sequence
atatttttactgtatctttt

SEQ ID NO: 308772 - DNA, 20 bp, Artificial
  CRISPR gRNA sequence
tcagcacagtaacatgctgt

SEQ ID NO: 308773 - DNA, 20 bp, Artificial
  CRISPR gRNA sequence
gtatggagcaggctatgcta

SEQ ID NO: 308774 - DNA, 20 bp, Artificial
  CRISPR gRNA sequence
ttttgtgtaaggacacccta

SEQ ID NO: 308775 - DNA, 20 bp, Artificial
  CRISPR gRNA sequence
aatgacaaaatcgcctaata

SEQ ID NO: 308776 - DNA, 20 bp, Artificial
  CRISPR gRNA sequence
cagaacgtacccctgttgtt

SEQ ID NO: 308777 - DNA, 20 bp, Artificial
  CRISPR gRNA sequence
tggggaggctgaggtgggag

SEQ ID NO: 308778 - DNA, 20 bp, Artificial
  CRISPR gRNA sequence
gcagaaaaacagaaatctga

SEQ ID NO: 308779 - DNA, 20 bp, Artificial
  CRISPR gRNA sequence
tcacctccctgtcttagtgg

SEQ ID NO: 308780 - DNA, 20 bp, Artificial
  CRISPR gRNA sequence
tggcagggaccgcagccaac

SEQ ID NO: 308781 - DNA, 20 bp, Artificial
  CRISPR gRNA sequence
gaactgtaaacagggaagat

SEQ ID NO: 308782 - DNA, 20 bp, Artificial
  CRISPR gRNA sequence
ggcccttcacagggtcttga

SEQ ID NO: 308783 - DNA, 20 bp, Artificial
  CRISPR gRNA sequence
gttgtgcaaatggagggctc

SEQ ID NO: 308784 - DNA, 20 bp, Artificial
  CRISPR gRNA sequence
caaatggagggctctgaagc

SEQ ID NO: 308785 - DNA, 20 bp, Artificial
  CRISPR gRNA sequence
gagacttttggaattctgtc

SEQ ID NO: 308786 - DNA, 20 bp, Artificial
  CRISPR gRNA sequence
aaacccaccaagtctcaggc

SEQ ID NO: 308787 - DNA, 20 bp, Artificial
  CRISPR gRNA sequence
gtcagactcatcaggagaca

SEQ ID NO: 308788 - DNA, 20 bp, Artificial
  CRISPR gRNA sequence
tcgagaaaaaaaaaggtaaa

SEQ ID NO: 308789 - DNA, 20 bp, Artificial
  CRISPR gRNA sequence
accaaaacatgacctggacg

SEQ ID NO: 308790 - DNA, 20 bp, Artificial
  CRISPR gRNA sequence
acatgacctggacgtggagt

SEQ ID NO: 308791 - DNA, 20 bp, Artificial
  CRISPR gRNA sequence
cgggtgtgcagagacaatgc

SEQ ID NO: 308792 - DNA, 20 bp, Artificial
  CRISPR gRNA sequence
gcagttatacaggccatgag

SEQ ID NO: 308793 - DNA, 20 bp, Artificial
  CRISPR gRNA sequence
aatggaattgtgggcagaaa

SEQ ID NO: 308794 - DNA, 20 bp, Artificial
  CRISPR gRNA sequence
aagtctcacaatggaagaga

SEQ ID NO: 308795 - DNA, 20 bp, Artificial
  CRISPR gRNA sequence
ctcacaatggaagagatctg

SEQ ID NO: 308796 - DNA, 20 bp, Artificial
  CRISPR gRNA sequence
ctctcccacaactgatctac

SEQ ID NO: 308797 - DNA, 20 bp, Artificial
  CRISPR gRNA sequence
attggcaaaaaataaaattt

SEQ ID NO: 308798 - DNA, 20 bp, Artificial
  CRISPR gRNA sequence
gcaaaaaataaaatttgagg

SEQ ID NO: 308799 - DNA, 20 bp, Artificial
  CRISPR gRNA sequence
gcaatcggttagtattgcat

SEQ ID NO: 308800 - DNA, 20 bp, Artificial
  CRISPR gRNA sequence
cgcttagaaatctgccttcc

SEQ ID NO: 308801 - DNA, 20 bp, Artificial
  CRISPR gRNA sequence
atgtgagtaaaaatcacctg

SEQ ID NO: 308802 - DNA, 20 bp, Artificial
  CRISPR gRNA sequence
tgggcctcaaccacagaaag

SEQ ID NO: 308803 - DNA, 20 bp, Artificial
  CRISPR gRNA sequence
gggatgaaacccatgaattt

SEQ ID NO: 308804 - DNA, 20 bp, Artificial
  CRISPR gRNA sequence
caatgctgccggcctaagga

SEQ ID NO: 308805 - DNA, 20 bp, Artificial
  CRISPR gRNA sequence
tgatgaagccaagaaaaagg

SEQ ID NO: 308806 - DNA, 20 bp, Artificial
  CRISPR gRNA sequence
aagccaagaaaaaggatatg

SEQ ID NO: 308807 - DNA, 20 bp, Artificial
  CRISPR gRNA sequence
accctaactagcaccaaaaa

SEQ ID NO: 308808 - DNA, 20 bp, Artificial
  CRISPR gRNA sequence
tagcaccaaaaaggctgctt

SEQ ID NO: 308809 - DNA, 20 bp, Artificial
  CRISPR gRNA sequence
ccaaggacaaggccagtgct

SEQ ID NO: 308810 - DNA, 20 bp, Artificial
  CRISPR gRNA sequence
tgcactgagggggacataaa

SEQ ID NO: 308811 - DNA, 20 bp, Artificial
  CRISPR gRNA sequence
agggggacataaatttggct

SEQ ID NO: 308812 - DNA, 20 bp, Artificial
  CRISPR gRNA sequence
cggtgttgtctagaagccat

SEQ ID NO: 308813 - DNA, 20 bp, Artificial
  CRISPR gRNA sequence
cattgggctagaagtgtctg

SEQ ID NO: 308814 - DNA, 20 bp, Artificial
  CRISPR gRNA sequence
ccagccttgtcccttagctg

SEQ ID NO: 308815 - DNA, 20 bp, Artificial
  CRISPR gRNA sequence
ggtgatcactgttacatgtt

SEQ ID NO: 308816 - DNA, 20 bp, Artificial
  CRISPR gRNA sequence
aacaaaaacattgacccata

SEQ ID NO: 308817 - DNA, 20 bp, Artificial
  CRISPR gRNA sequence
acaaatggtagcatactatg

SEQ ID NO: 308818 - DNA, 20 bp, Artificial
  CRISPR gRNA sequence
ttgcacacatatgactacct

SEQ ID NO: 308819 - DNA, 20 bp, Artificial
  CRISPR gRNA sequence
cactagtgatggatacttaa

SEQ ID NO: 308820 - DNA, 20 bp, Artificial
  CRISPR gRNA sequence
tcttttgttgcaatggaaaa

SEQ ID NO: 308821 - DNA, 20 bp, Artificial
  CRISPR gRNA sequence
agctatattcctagaagcag

SEQ ID NO: 308822 - DNA, 20 bp, Artificial
  CRISPR gRNA sequence
tagttgcaaattgttctccc

SEQ ID NO: 308823 - DNA, 20 bp, Artificial
  CRISPR gRNA sequence
aattgttctcccctgagatt

SEQ ID NO: 308824 - DNA, 20 bp, Artificial
  CRISPR gRNA sequence
ttatgctctgatcaacacaa

SEQ ID NO: 308825 - DNA, 20 bp, Artificial
  CRISPR gRNA sequence
ttttcatgtaccttttgcca

SEQ ID NO: 308826 - DNA, 20 bp, Artificial
  CRISPR gRNA sequence
aaatggtgaaattacatctc

SEQ ID NO: 308827 - DNA, 20 bp, Artificial
  CRISPR gRNA sequence
tttgttatttagaaatcttt

SEQ ID NO: 308828 - DNA, 20 bp, Artificial
  CRISPR gRNA sequence
ttagaaatctttattagttt

SEQ ID NO: 308829 - DNA, 20 bp, Artificial
  CRISPR gRNA sequence
ctttattagtttatgagatt

SEQ ID NO: 308830 - DNA, 20 bp, Artificial
  CRISPR gRNA sequence
ttatgctctgatcaacacaa

SEQ ID NO: 308831 - DNA, 20 bp, Artificial
  CRISPR gRNA sequence
ttttcatgtaccttttgcca

SEQ ID NO: 308832 - DNA, 20 bp, Artificial
  CRISPR gRNA sequence
aaacggtgaaattagatctc

SEQ ID NO: 308833 - DNA, 20 bp, Artificial
  CRISPR gRNA sequence
ttgccaaccaccattccacc

SEQ ID NO: 308834 - DNA, 20 bp, Artificial
  CRISPR gRNA sequence
ccttctgtttccatgaattt

SEQ ID NO: 308835 - DNA, 20 bp, Artificial
  CRISPR gRNA sequence
acagtatttgtctttttgtg

SEQ ID NO: 308836 - DNA, 20 bp, Artificial
  CRISPR gRNA sequence
agggccatccacattgtagc

SEQ ID NO: 308837 - DNA, 20 bp, Artificial
  CRISPR gRNA sequence
cactgtatgtacatactaca

SEQ ID NO: 308838 - DNA, 20 bp, Artificial
  CRISPR gRNA sequence
tcatttttgatggacatttg

SEQ ID NO: 308839 - DNA, 20 bp, Artificial
  CRISPR gRNA sequence
gtatgaatatctctttaaga

SEQ ID NO: 308840 - DNA, 20 bp, Artificial
  CRISPR gRNA sequence
tgtgataagtaggttgctgt

SEQ ID NO: 308841 - DNA, 20 bp, Artificial
  CRISPR gRNA sequence
gagaactctgttcccatact

SEQ ID NO: 308842 - DNA, 20 bp, Artificial
  CRISPR gRNA sequence
atactctgcgcttgtgtggt

SEQ ID NO: 308843 - DNA, 20 bp, Artificial
  CRISPR gRNA sequence
tattaattttctatgtataa

SEQ ID NO: 308844 - DNA, 20 bp, Artificial
  CRISPR gRNA sequence
cacctaatatgggaatcgct

SEQ ID NO: 308845 - DNA, 20 bp, Artificial
  CRISPR gRNA sequence
tgacaaggaatcagtaccat

SEQ ID NO: 308846 - DNA, 20 bp, Artificial
  CRISPR gRNA sequence
atcagtaccatttttgattt

SEQ ID NO: 308847 - DNA, 20 bp, Artificial
  CRISPR gRNA sequence
ctctcttcccctgggttaga

SEQ ID NO: 308848 - DNA, 20 bp, Artificial
  CRISPR gRNA sequence
cttaccttccttccgtcaat

SEQ ID NO: 308849 - DNA, 20 bp, Artificial
  CRISPR gRNA sequence
acacttctgccaaagtctgt

SEQ ID NO: 308850 - DNA, 20 bp, Artificial
  CRISPR gRNA sequence
caggagtaacaatccttcca

SEQ ID NO: 308851 - DNA, 20 bp, Artificial
  CRISPR gRNA sequence
cctagaaaacactctggaca

SEQ ID NO: 308852 - DNA, 20 bp, Artificial
  CRISPR gRNA sequence
gtaataggatgttaaaatac

SEQ ID NO: 308853 - DNA, 20 bp, Artificial
  CRISPR gRNA sequence
tgttaaaatactcaagattg

SEQ ID NO: 308854 - DNA, 20 bp, Artificial
  CRISPR gRNA sequence
ggtgtgggctgggttaggaa

SEQ ID NO: 308855 - DNA, 20 bp, Artificial
  CRISPR gRNA sequence
aagaacctaagaatttaccg

SEQ ID NO: 308856 - DNA, 20 bp, Artificial
  CRISPR gRNA sequence
taccggggggattctctgag

SEQ ID NO: 308857 - DNA, 20 bp, Artificial
  CRISPR gRNA sequence
aacatgaataagagttggct

SEQ ID NO: 308858 - DNA, 20 bp, Artificial
  CRISPR gRNA sequence
ttattactgctcacaacagg

SEQ ID NO: 308859 - DNA, 20 bp, Artificial
  CRISPR gRNA sequence
ccagctagtaaatggtacag

SEQ ID NO: 308860 - DNA, 20 bp, Artificial
  CRISPR gRNA sequence
gagatttaaacccatgcagc

SEQ ID NO: 308861 - DNA, 20 bp, Artificial
  CRISPR gRNA sequence
ttctttcacacactggtgta

SEQ ID NO: 308862 - DNA, 20 bp, Artificial
  CRISPR gRNA sequence
tagcacgtttaaaaatgcca

SEQ ID NO: 308863 - DNA, 20 bp, Artificial
  CRISPR gRNA sequence
aaagtatccctttgcatcaa

SEQ ID NO: 308864 - DNA, 20 bp, Artificial
  CRISPR gRNA sequence
ccactttaacctggacaggc

SEQ ID NO: 308865 - DNA, 20 bp, Artificial
  CRISPR gRNA sequence
gacaggcaccagcttcccag

SEQ ID NO: 308866 - DNA, 20 bp, Artificial
  CRISPR gRNA sequence
accagcttcccagcgtggat

SEQ ID NO: 308867 - DNA, 20 bp, Artificial
  CRISPR gRNA sequence
gagtatcaggaaaaatgctg

SEQ ID NO: 308868 - DNA, 20 bp, Artificial
  CRISPR gRNA sequence
actcagtgtcagacttgttc

SEQ ID NO: 308869 - DNA, 20 bp, Artificial
  CRISPR gRNA sequence
gtggaaggtggtaggtagtc

SEQ ID NO: 308870 - DNA, 20 bp, Artificial
  CRISPR gRNA sequence
acaccacagtctctgtggag

SEQ ID NO: 308871 - DNA, 20 bp, Artificial
  CRISPR gRNA sequence
gggcccagctcattgccttc

SEQ ID NO: 308872 - DNA, 20 bp, Artificial
  CRISPR gRNA sequence
caacatcagctccctggggc

SEQ ID NO: 308873 - DNA, 20 bp, Artificial
  CRISPR gRNA sequence
cttctcagagcaccaggacc

SEQ ID NO: 308874 - DNA, 20 bp, Artificial
  CRISPR gRNA sequence
ttccccagagctcttctagg

SEQ ID NO: 308875 - DNA, 20 bp, Artificial
  CRISPR gRNA sequence
cgctgggaagctggtgcctg

SEQ ID NO: 308876 - DNA, 20 bp, Artificial
  CRISPR gRNA sequence
gcacacagtgggtattcgag

SEQ ID NO: 308877 - DNA, 20 bp, Artificial
  CRISPR gRNA sequence
gagatactgggaagagtaag

SEQ ID NO: 308878 - DNA, 20 bp, Artificial
  CRISPR gRNA sequence
taggcttatttccttcttta

SEQ ID NO: 308879 - DNA, 20 bp, Artificial
  CRISPR gRNA sequence
caaatatatttgaattttag

SEQ ID NO: 308880 - DNA, 20 bp, Artificial
  CRISPR gRNA sequence
tgacagcaatatggagaaat

SEQ ID NO: 308881 - DNA, 20 bp, Artificial
  CRISPR gRNA sequence
tgctattggttcattcattc

SEQ ID NO: 308882 - DNA, 20 bp, Artificial
  CRISPR gRNA sequence
aatatttattgaaccaagca

SEQ ID NO: 308883 - DNA, 20 bp, Artificial
  CRISPR gRNA sequence
ttcctcttcacgtggttgcc

SEQ ID NO: 308884 - DNA, 20 bp, Artificial
  CRISPR gRNA sequence
tgagatctgaagaatgatat

SEQ ID NO: 308885 - DNA, 20 bp, Artificial
  CRISPR gRNA sequence
aatctgggctagcctgagtg

SEQ ID NO: 308886 - DNA, 20 bp, Artificial
  CRISPR gRNA sequence
aagggatattctgggacttc

SEQ ID NO: 308887 - DNA, 20 bp, Artificial
  CRISPR gRNA sequence
agcttggtcataagaagcct

SEQ ID NO: 308888 - DNA, 20 bp, Artificial
  CRISPR gRNA sequence
catgctggagaggactgtat

SEQ ID NO: 308889 - DNA, 20 bp, Artificial
  CRISPR gRNA sequence
tattgtaaattattatctat

SEQ ID NO: 308890 - DNA, 20 bp, Artificial
  CRISPR gRNA sequence
atgtggcctttcatagaaaa

SEQ ID NO: 308891 - DNA, 20 bp, Artificial
  CRISPR gRNA sequence
aacaggccaggtgtggtggc

SEQ ID NO: 308892 - DNA, 20 bp, Artificial
  CRISPR gRNA sequence
cactttgggaggccgaggtg

SEQ ID NO: 308893 - DNA, 20 bp, Artificial
  CRISPR gRNA sequence
tgggcagattacctgaggtc

SEQ ID NO: 308894 - DNA, 20 bp, Artificial
  CRISPR gRNA sequence
aatcacttgaacctgggagg

SEQ ID NO: 308895 - DNA, 20 bp, Artificial
  CRISPR gRNA sequence
caaatcttcaataatcatgt

SEQ ID NO: 308896 - DNA, 20 bp, Artificial
  CRISPR gRNA sequence
atctccagatcagcccatcc

SEQ ID NO: 308897 - DNA, 20 bp, Artificial
  CRISPR gRNA sequence
caaacattgtgagagagggt

SEQ ID NO: 308898 - DNA, 20 bp, Artificial
  CRISPR gRNA sequence
ggattcattgttctaagctg

SEQ ID NO: 308899 - DNA, 20 bp, Artificial
  CRISPR gRNA sequence
tctaagctgctaagtttgga

SEQ ID NO: 308900 - DNA, 20 bp, Artificial
  CRISPR gRNA sequence
acataccaagaggcaaacag

SEQ ID NO: 308901 - DNA, 20 bp, Artificial
  CRISPR gRNA sequence
aggtaggtgctaagtaggtg

SEQ ID NO: 308902 - DNA, 20 bp, Artificial
  CRISPR gRNA sequence
cacgtgtgttattggtcagt

SEQ ID NO: 308903 - DNA, 20 bp, Artificial
  CRISPR gRNA sequence
ttagagctgagactgatatc

SEQ ID NO: 308904 - DNA, 20 bp, Artificial
  CRISPR gRNA sequence
ttgcattttgaaaagatgac

SEQ ID NO: 308905 - DNA, 20 bp, Artificial
  CRISPR gRNA sequence
accaatcagttggctactgc

SEQ ID NO: 308906 - DNA, 20 bp, Artificial
  CRISPR gRNA sequence
ttgtttgagtgaaagaagat

SEQ ID NO: 308907 - DNA, 20 bp, Artificial
  CRISPR gRNA sequence
tatgggaaatgaggacaaag

SEQ ID NO: 308908 - DNA, 20 bp, Artificial
  CRISPR gRNA sequence
ggaaatgaggacaaagtatt

SEQ ID NO: 308909 - DNA, 20 bp, Artificial
  CRISPR gRNA sequence
acagtggatgctacaagact

SEQ ID NO: 308910 - DNA, 20 bp, Artificial
  CRISPR gRNA sequence
gtaagtgtaagaatctgtac

SEQ ID NO: 308911 - DNA, 20 bp, Artificial
  CRISPR gRNA sequence
aaatttcatccaatcctagt

SEQ ID NO: 308912 - DNA, 20 bp, Artificial
  CRISPR gRNA sequence
actctgtgctaatcagacca

SEQ ID NO: 308913 - DNA, 20 bp, Artificial
  CRISPR gRNA sequence
acttgaatgacactgacaaa

SEQ ID NO: 308914 - DNA, 20 bp, Artificial
  CRISPR gRNA sequence
gggtaatgaacctgaagaag

SEQ ID NO: 308915 - DNA, 20 bp, Artificial
  CRISPR gRNA sequence
ataactaaaagttacaggga

SEQ ID NO: 308916 - DNA, 20 bp, Artificial
  CRISPR gRNA sequence
atagagagctacaagcaatg

SEQ ID NO: 308917 - DNA, 20 bp, Artificial
  CRISPR gRNA sequence
cataacttttcagttcacct

SEQ ID NO: 308918 - DNA, 20 bp, Artificial
  CRISPR gRNA sequence
tgagctggctacaagtgatc

SEQ ID NO: 308919 - DNA, 20 bp, Artificial
  CRISPR gRNA sequence
tggagaacagcaagcactcc

SEQ ID NO: 308920 - DNA, 20 bp, Artificial
  CRISPR gRNA sequence
taaaggtggtaatagttgag

SEQ ID NO: 308921 - DNA, 20 bp, Artificial
  CRISPR gRNA sequence
tgcatgttagaacttgcacg

SEQ ID NO: 308922 - DNA, 20 bp, Artificial
  CRISPR gRNA sequence
cagatgaagttccaccctgt

SEQ ID NO: 308923 - DNA, 20 bp, Artificial
  CRISPR gRNA sequence
gctgttagcctgggccactg

SEQ ID NO: 308924 - DNA, 20 bp, Artificial
  CRISPR gRNA sequence
gctatcgtcctctgtccttg

SEQ ID NO: 308925 - DNA, 20 bp, Artificial
  CRISPR gRNA sequence
ctctgtccttgaaaggcttt

SEQ ID NO: 308926 - DNA, 20 bp, Artificial
  CRISPR gRNA sequence
cttccaataattcttcccta

SEQ ID NO: 308927 - DNA, 20 bp, Artificial
  CRISPR gRNA sequence
tataaccctgcatccgaggc

SEQ ID NO: 308928 - DNA, 20 bp, Artificial
  CRISPR gRNA sequence
tttaatgggtctcaaagaac

SEQ ID NO: 308929 - DNA, 20 bp, Artificial
  CRISPR gRNA sequence
ccgaaagaaccactttttag

SEQ ID NO: 308930 - DNA, 20 bp, Artificial
  CRISPR gRNA sequence
gaaccactttttagtgttga

SEQ ID NO: 308931 - DNA, 20 bp, Artificial
  CRISPR gRNA sequence
aacatcaagtataacctttt

SEQ ID NO: 308932 - DNA, 20 bp, Artificial
  CRISPR gRNA sequence
tttctgagacacaatcaaat

SEQ ID NO: 308933 - DNA, 20 bp, Artificial
  CRISPR gRNA sequence
gttgtctttggataaataat

SEQ ID NO: 308934 - DNA, 20 bp, Artificial
  CRISPR gRNA sequence
ctttggataaataatgggag

SEQ ID NO: 308935 - DNA, 20 bp, Artificial
  CRISPR gRNA sequence
atttaatttaacagaaaatt

SEQ ID NO: 308936 - DNA, 20 bp, Artificial
  CRISPR gRNA sequence
aaaattggaagtttggaatt

SEQ ID NO: 308937 - DNA, 20 bp, Artificial
  CRISPR gRNA sequence
gagcagaaaaatggtgtaat

SEQ ID NO: 308938 - DNA, 20 bp, Artificial
  CRISPR gRNA sequence
gagacgtcctccatcctgag

SEQ ID NO: 308939 - DNA, 20 bp, Artificial
  CRISPR gRNA sequence
tcccaccagccatgtctcct

SEQ ID NO: 308940 - DNA, 20 bp, Artificial
  CRISPR gRNA sequence
catgtctccttctagcttag

SEQ ID NO: 308941 - DNA, 20 bp, Artificial
  CRISPR gRNA sequence
aggctggattttatgtctga

SEQ ID NO: 308942 - DNA, 20 bp, Artificial
  CRISPR gRNA sequence
tcccccttattccccatttg

SEQ ID NO: 308943 - DNA, 20 bp, Artificial
  CRISPR gRNA sequence
ttgtggagatttttctgacc

SEQ ID NO: 308944 - DNA, 20 bp, Artificial
  CRISPR gRNA sequence
ggagatttttctgaccgaat

SEQ ID NO: 308945 - DNA, 20 bp, Artificial
  CRISPR gRNA sequence
ctgaaactcatttgagagca

SEQ ID NO: 308946 - DNA, 20 bp, Artificial
  CRISPR gRNA sequence
gtgcagagaagaaatgtctt

SEQ ID NO: 308947 - DNA, 20 bp, Artificial
  CRISPR gRNA sequence
gcagatttagaaggagcaga

SEQ ID NO: 308948 - DNA, 20 bp, Artificial
  CRISPR gRNA sequence
agcatagcatggcgatagca

SEQ ID NO: 308949 - DNA, 20 bp, Artificial
  CRISPR gRNA sequence
caaactattgatgaatttga

SEQ ID NO: 308950 - DNA, 20 bp, Artificial
  CRISPR gRNA sequence
ccaaaaaggtaaggatcatg

SEQ ID NO: 308951 - DNA, 20 bp, Artificial
  CRISPR gRNA sequence
aaggatcatgcaaagtttca

SEQ ID NO: 308952 - DNA, 20 bp, Artificial
  CRISPR gRNA sequence
catcctggtcccctaaggta

SEQ ID NO: 308953 - DNA, 20 bp, Artificial
  CRISPR gRNA sequence
gtcccctaaggtagcctgat

SEQ ID NO: 308954 - DNA, 20 bp, Artificial
  CRISPR gRNA sequence
actgtgcaccagtcctaccc

SEQ ID NO: 308955 - DNA, 20 bp, Artificial
  CRISPR gRNA sequence
caaatgctagctggaaggaa

SEQ ID NO: 308956 - DNA, 20 bp, Artificial
  CRISPR gRNA sequence
gctggaaggaagagggtttt

SEQ ID NO: 308957 - DNA, 20 bp, Artificial
  CRISPR gRNA sequence
gaaggaagagggtttttttt

SEQ ID NO: 308958 - DNA, 20 bp, Artificial
  CRISPR gRNA sequence
aggaggaccgatagggaacg

SEQ ID NO: 308959 - DNA, 20 bp, Artificial
  CRISPR gRNA sequence
ttacctgcctggccatgaaa

SEQ ID NO: 308960 - DNA, 20 bp, Artificial
  CRISPR gRNA sequence
agggacctctctgccactct

SEQ ID NO: 308961 - DNA, 20 bp, Artificial
  CRISPR gRNA sequence
acctctctgccactctctgt

SEQ ID NO: 308962 - DNA, 20 bp, Artificial
  CRISPR gRNA sequence
ctctctgtgcttgcttttgc

SEQ ID NO: 308963 - DNA, 20 bp, Artificial
  CRISPR gRNA sequence
ttgctctagttttatctctt

SEQ ID NO: 308964 - DNA, 20 bp, Artificial
  CRISPR gRNA sequence
taacctcaactcccacctca

SEQ ID NO: 308965 - DNA, 20 bp, Artificial
  CRISPR gRNA sequence
tttgaaacatggtatttcaa

SEQ ID NO: 308966 - DNA, 20 bp, Artificial
  CRISPR gRNA sequence
ttgatttttctgctgaagaa

SEQ ID NO: 308967 - DNA, 20 bp, Artificial
  CRISPR gRNA sequence
ttttctgctgaagaatctgg

SEQ ID NO: 308968 - DNA, 20 bp, Artificial
  CRISPR gRNA sequence
ggcttatctcttcatctttc

SEQ ID NO: 308969 - DNA, 20 bp, Artificial
  CRISPR gRNA sequence
ctaaccaaaatatcaaatgc

SEQ ID NO: 308970 - DNA, 20 bp, Artificial
  CRISPR gRNA sequence
aaagcactattgctatgtag

SEQ ID NO: 308971 - DNA, 20 bp, Artificial
  CRISPR gRNA sequence
ttgctatgtagtcatgttta

SEQ ID NO: 308972 - DNA, 20 bp, Artificial
  CRISPR gRNA sequence
tgtttagtgtgattaaatta

SEQ ID NO: 308973 - DNA, 20 bp, Artificial
  CRISPR gRNA sequence
actaggctagaaaacaagag

SEQ ID NO: 308974 - DNA, 20 bp, Artificial
  CRISPR gRNA sequence
ctatattaggaataaataaa

SEQ ID NO: 308975 - DNA, 20 bp, Artificial
  CRISPR gRNA sequence
ataaataaatagagatttat

SEQ ID NO: 308976 - DNA, 20 bp, Artificial
  CRISPR gRNA sequence
tttagtacagggccttagtc

SEQ ID NO: 308977 - DNA, 20 bp, Artificial
  CRISPR gRNA sequence
cagttcatttccttcattat

SEQ ID NO: 308978 - DNA, 20 bp, Artificial
  CRISPR gRNA sequence
taatagagatgatattttaa

SEQ ID NO: 308979 - DNA, 20 bp, Artificial
  CRISPR gRNA sequence
gaaacacattatgttcaatc

SEQ ID NO: 308980 - DNA, 20 bp, Artificial
  CRISPR gRNA sequence
agaggaggaaatcccccttc

SEQ ID NO: 308981 - DNA, 20 bp, Artificial
  CRISPR gRNA sequence
gaggcgagctgacatctttg

SEQ ID NO: 308982 - DNA, 20 bp, Artificial
  CRISPR gRNA sequence
gaagggatctggcaggaaga

SEQ ID NO: 308983 - DNA, 20 bp, Artificial
  CRISPR gRNA sequence
gagaagcaaacctgatggtc

SEQ ID NO: 308984 - DNA, 20 bp, Artificial
  CRISPR gRNA sequence
atcagcatttctgccccaga

SEQ ID NO: 308985 - DNA, 20 bp, Artificial
  CRISPR gRNA sequence
tttctgccccagatgcagct

SEQ ID NO: 308986 - DNA, 20 bp, Artificial
  CRISPR gRNA sequence
accacagccagggacagtgc

SEQ ID NO: 308987 - DNA, 20 bp, Artificial
  CRISPR gRNA sequence
agctgcaagctgcatctggg

SEQ ID NO: 308988 - DNA, 20 bp, Artificial
  CRISPR gRNA sequence
tgatgtgctaatggccggcc

SEQ ID NO: 308989 - DNA, 20 bp, Artificial
  CRISPR gRNA sequence
gagaccaagatctaatttaa

SEQ ID NO: 308990 - DNA, 20 bp, Artificial
  CRISPR gRNA sequence
gttgaggctagggcaggtag

SEQ ID NO: 308991 - DNA, 20 bp, Artificial
  CRISPR gRNA sequence
gggcaggtagggagaaaaca

SEQ ID NO: 308992 - DNA, 20 bp, Artificial
  CRISPR gRNA sequence
aagccaagccagattcttca

SEQ ID NO: 308993 - DNA, 20 bp, Artificial
  CRISPR gRNA sequence
gtaagagtatttgtggggtg

SEQ ID NO: 308994 - DNA, 20 bp, Artificial
  CRISPR gRNA sequence
cattttgaatatgtgtggag

SEQ ID NO: 308995 - DNA, 20 bp, Artificial
  CRISPR gRNA sequence
tttgaccatgatgctgtttc

SEQ ID NO: 308996 - DNA, 20 bp, Artificial
  CRISPR gRNA sequence
tgatgctgtttctgagaaaa

SEQ ID NO: 308997 - DNA, 20 bp, Artificial
  CRISPR gRNA sequence
gaaatagggtgtgccttgat

SEQ ID NO: 308998 - DNA, 20 bp, Artificial
  CRISPR gRNA sequence
actgtgctctcaaatgagtt

SEQ ID NO: 308999 - DNA, 20 bp, Artificial
  CRISPR gRNA sequence
ttcagaaagaacaactcacg

SEQ ID NO: 309000 - DNA, 20 bp, Artificial
  CRISPR gRNA sequence
gaaagaaaacaagcattcgg

SEQ ID NO: 309001 - DNA, 20 bp, Artificial
  CRISPR gRNA sequence
tcttgctccttgctttactt

SEQ ID NO: 309002 - DNA, 20 bp, Artificial
  CRISPR gRNA sequence
aactgttatttgattgtgtc

SEQ ID NO: 309003 - DNA, 20 bp, Artificial
  CRISPR gRNA sequence
ttgtgtctcagaaagtcgtc

SEQ ID NO: 309004 - DNA, 20 bp, Artificial
  CRISPR gRNA sequence
ttatcaggaatctgtctagg

SEQ ID NO: 309005 - DNA, 20 bp, Artificial
  CRISPR gRNA sequence
agccctcataagtgggagta

SEQ ID NO: 309006 - DNA, 20 bp, Artificial
  CRISPR gRNA sequence
gtggaacttcatctgctata

SEQ ID NO: 309007 - DNA, 20 bp, Artificial
  CRISPR gRNA sequence
ccttattcctggaaatgtaa

SEQ ID NO: 309008 - DNA, 20 bp, Artificial
  CRISPR gRNA sequence
acagggagcttatcacctca

SEQ ID NO: 309009 - DNA, 20 bp, Artificial
  CRISPR gRNA sequence
tgtgggatcagtcttttaga

SEQ ID NO: 309010 - DNA, 20 bp, Artificial
  CRISPR gRNA sequence
ccctatcatccatttgctac

SEQ ID NO: 309011 - DNA, 20 bp, Artificial
  CRISPR gRNA sequence
ttttttctatgaaaggccac

SEQ ID NO: 309012 - DNA, 20 bp, Artificial
  CRISPR gRNA sequence
atgaccaagctctcgaagtc

SEQ ID NO: 309013 - DNA, 20 bp, Artificial
  CRISPR gRNA sequence
tggttcaataaatatttgtg

SEQ ID NO: 309014 - DNA, 20 bp, Artificial
  CRISPR gRNA sequence
taaccttcttattttgtagt

SEQ ID NO: 309015 - DNA, 20 bp, Artificial
  CRISPR gRNA sequence
ggggaaatatgactacttgg

SEQ ID NO: 309016 - DNA, 20 bp, Artificial
  CRISPR gRNA sequence
tgggtattcgagcagtgttt

SEQ ID NO: 309017 - DNA, 20 bp, Artificial
  CRISPR gRNA sequence
agaatgaacagcagctcagg

SEQ ID NO: 309018 - DNA, 20 bp, Artificial
  CRISPR gRNA sequence
acgtgctacaccagtgtgtg

SEQ ID NO: 309019 - DNA, 20 bp, Artificial
  CRISPR gRNA sequence
ccttattctgtgcttagctg

SEQ ID NO: 309020 - DNA, 20 bp, Artificial
  CRISPR gRNA sequence
gctgacagaaatctcctctc

SEQ ID NO: 309021 - DNA, 20 bp, Artificial
  CRISPR gRNA sequence
ttccactttacaggcccact

SEQ ID NO: 309022 - DNA, 20 bp, Artificial
  CRISPR gRNA sequence
tcttcacggccaatgacatt

SEQ ID NO: 309023 - DNA, 20 bp, Artificial
  CRISPR gRNA sequence
acacacatcacacatcatgg

SEQ ID NO: 309024 - DNA, 20 bp, Artificial
  CRISPR gRNA sequence
acacatcatggctagaatgg

SEQ ID NO: 309025 - DNA, 20 bp, Artificial
  CRISPR gRNA sequence
tggggcacttgtacttcatg

SEQ ID NO: 309026 - DNA, 20 bp, Artificial
  CRISPR gRNA sequence
ggaagagagagtttccaaac

SEQ ID NO: 309027 - DNA, 20 bp, Artificial
  CRISPR gRNA sequence
ctgtttgtcatgccacccca

SEQ ID NO: 309028 - DNA, 20 bp, Artificial
  CRISPR gRNA sequence
ttatagaagctcttttatac

SEQ ID NO: 309029 - DNA, 20 bp, Artificial
  CRISPR gRNA sequence
ccaacagcaacctacttatc

SEQ ID NO: 309030 - DNA, 20 bp, Artificial
  CRISPR gRNA sequence
aacctacttatcacagaata

SEQ ID NO: 309031 - DNA, 20 bp, Artificial
  CRISPR gRNA sequence
acaagtgttggcaaggatgt

SEQ ID NO: 309032 - DNA, 20 bp, Artificial
  CRISPR gRNA sequence
gaaaatagtgtagcagttcc

SEQ ID NO: 309033 - DNA, 20 bp, Artificial
  CRISPR gRNA sequence
agttcctcagaaaattaaaa

SEQ ID NO: 309034 - DNA, 20 bp, Artificial
  CRISPR gRNA sequence
cagtggaatatcatttagtc

SEQ ID NO: 309035 - DNA, 20 bp, Artificial
  CRISPR gRNA sequence
ggaatatcatttagtcttag

SEQ ID NO: 309036 - DNA, 20 bp, Artificial
  CRISPR gRNA sequence
tggcaagagctgagaggagg

SEQ ID NO: 309037 - DNA, 20 bp, Artificial
  CRISPR gRNA sequence
ctattgctaaagatcacaaa

SEQ ID NO: 309038 - DNA, 20 bp, Artificial
  CRISPR gRNA sequence
ctattgctaaagatcacaaa

SEQ ID NO: 309039 - DNA, 20 bp, Artificial
  CRISPR gRNA sequence
atatatattattgtcatcca

SEQ ID NO: 309040 - DNA, 20 bp, Artificial
  CRISPR gRNA sequence
gatactcgttacatgctgat

SEQ ID NO: 309041 - DNA, 20 bp, Artificial
  CRISPR gRNA sequence
ccatttgtgcttaaaaataa

SEQ ID NO: 309042 - DNA, 20 bp, Artificial
  CRISPR gRNA sequence
tgcttaaaaataaaaagaaa

SEQ ID NO: 309043 - DNA, 20 bp, Artificial
  CRISPR gRNA sequence
aaagtaactttaagtagagg

SEQ ID NO: 309044 - DNA, 20 bp, Artificial
  CRISPR gRNA sequence
tcacccctgttacctctgtg

SEQ ID NO: 309045 - DNA, 20 bp, Artificial
  CRISPR gRNA sequence
ttcaaaaatatttattaaaa

SEQ ID NO: 309046 - DNA, 20 bp, Artificial
  CRISPR gRNA sequence
gggtgctatgagagcagagg

SEQ ID NO: 309047 - DNA, 20 bp, Artificial
  CRISPR gRNA sequence
atacatttctgctattcgat

SEQ ID NO: 309048 - DNA, 20 bp, Artificial
  CRISPR gRNA sequence
agttgtgcatcttttcctgg

SEQ ID NO: 309049 - DNA, 20 bp, Artificial
  CRISPR gRNA sequence
gaaggagggaggagggagag

SEQ ID NO: 309050 - DNA, 20 bp, Artificial
  CRISPR gRNA sequence
gactttagcagccagatctg

SEQ ID NO: 309051 - DNA, 20 bp, Artificial
  CRISPR gRNA sequence
aggctcctaggaaacaactg

SEQ ID NO: 309052 - DNA, 20 bp, Artificial
  CRISPR gRNA sequence
cacctcagcctccccaagtg

SEQ ID NO: 309053 - DNA, 20 bp, Artificial
  CRISPR gRNA sequence
ttaacaacaggggtacgttc

SEQ ID NO: 309054 - DNA, 20 bp, Artificial
  CRISPR gRNA sequence
gtatctgaacatatctaagc

SEQ ID NO: 309055 - DNA, 20 bp, Artificial
  CRISPR gRNA sequence
ctcaagatctgggagagaag

SEQ ID NO: 309056 - DNA, 20 bp, Artificial
  CRISPR gRNA sequence
aatgccctggaaacacattt

SEQ ID NO: 309057 - DNA, 20 bp, Artificial
  CRISPR gRNA sequence
ctgactccgcacactgaaag

SEQ ID NO: 309058 - DNA, 20 bp, Artificial
  CRISPR gRNA sequence
cttagaagtttcttagctcc

SEQ ID NO: 309059 - DNA, 20 bp, Artificial
  CRISPR gRNA sequence
gtttaagttttatggtggtg

SEQ ID NO: 309060 - DNA, 20 bp, Artificial
  CRISPR gRNA sequence
cagtacaattttaaagtgga

SEQ ID NO: 309061 - DNA, 20 bp, Artificial
  CRISPR gRNA sequence
agaaagcccatgacatcaga

SEQ ID NO: 309062 - DNA, 20 bp, Artificial
  CRISPR gRNA sequence
cacagggccggcttccaaag

SEQ ID NO: 309063 - DNA, 20 bp, Artificial
  CRISPR gRNA sequence
tgaataattcatttcatggc

SEQ ID NO: 309064 - DNA, 20 bp, Artificial
  CRISPR gRNA sequence
aaacgggcacctgtggcctt

SEQ ID NO: 309065 - DNA, 20 bp, Artificial
  CRISPR gRNA sequence
agtcgagacctatcattccc

SEQ ID NO: 309066 - DNA, 20 bp, Artificial
  CRISPR gRNA sequence
gagggcttttagtgggttcc

SEQ ID NO: 309067 - DNA, 20 bp, Artificial
  CRISPR gRNA sequence
tgagattgaactcacgctgt

SEQ ID NO: 309068 - DNA, 20 bp, Artificial
  CRISPR gRNA sequence
ttgtgcacatgtatcttttt

SEQ ID NO: 309069 - DNA, 20 bp, Artificial
  CRISPR gRNA sequence
ctttttgtagaatgaattct

SEQ ID NO: 309070 - DNA, 20 bp, Artificial
  CRISPR gRNA sequence
tccaaaaaggttgtaccaat

SEQ ID NO: 309071 - DNA, 20 bp, Artificial
  CRISPR gRNA sequence
cgtgccaatcaaatgggcaa

SEQ ID NO: 309072 - DNA, 20 bp, Artificial
  CRISPR gRNA sequence
gtggaggaatccaagggtgg

SEQ ID NO: 309073 - DNA, 20 bp, Artificial
  CRISPR gRNA sequence
gctaggtactgagtccgagt

SEQ ID NO: 309074 - DNA, 20 bp, Artificial
  CRISPR gRNA sequence
gagcctcagataaagagacc

SEQ ID NO: 309075 - DNA, 20 bp, Artificial
  CRISPR gRNA sequence
gactgtgcaccaagtctgct

SEQ ID NO: 309076 - DNA, 20 bp, Artificial
  CRISPR gRNA sequence
aatataagtcagcatgaggg

SEQ ID NO: 309077 - DNA, 20 bp, Artificial
  CRISPR gRNA sequence
tgcccaggatgctatcttca

SEQ ID NO: 309078 - DNA, 20 bp, Artificial
  CRISPR gRNA sequence
ctatcttcaatagaatggtt

SEQ ID NO: 309079 - DNA, 20 bp, Artificial
  CRISPR gRNA sequence
tttaagggatcattttggct

SEQ ID NO: 309080 - DNA, 20 bp, Artificial
  CRISPR gRNA sequence
gttgaatccgtggggctaga

SEQ ID NO: 309081 - DNA, 20 bp, Artificial
  CRISPR gRNA sequence
gagaaaaaccaggaaagtat

SEQ ID NO: 309082 - DNA, 20 bp, Artificial
  CRISPR gRNA sequence
accaaaattaaagagtgatt

SEQ ID NO: 309083 - DNA, 20 bp, Artificial
  CRISPR gRNA sequence
caaggaaatcagagattggg

SEQ ID NO: 309084 - DNA, 20 bp, Artificial
  CRISPR gRNA sequence
ggagtttgactccaagggaa

SEQ ID NO: 309085 - DNA, 20 bp, Artificial
  CRISPR gRNA sequence
cctgtggagttgacaagatc

SEQ ID NO: 309086 - DNA, 20 bp, Artificial
  CRISPR gRNA sequence
gacttagtagctacaagcaa

SEQ ID NO: 309087 - DNA, 20 bp, Artificial
  CRISPR gRNA sequence
caaactttccccatttagtc

SEQ ID NO: 309088 - DNA, 20 bp, Artificial
  CRISPR gRNA sequence
caaaatactttcagttccac

SEQ ID NO: 309089 - DNA, 20 bp, Artificial
  CRISPR gRNA sequence
gggagcactcgatgagtgga

SEQ ID NO: 309090 - DNA, 20 bp, Artificial
  CRISPR gRNA sequence
ttagactggtctgtgagtgg

SEQ ID NO: 309091 - DNA, 20 bp, Artificial
  CRISPR gRNA sequence
agaagatactgtgaggctct

SEQ ID NO: 309092 - DNA, 20 bp, Artificial
  CRISPR gRNA sequence
ataacattgactgttaattg

SEQ ID NO: 309093 - DNA, 20 bp, Artificial
  CRISPR gRNA sequence
tccttctattccctctttca

SEQ ID NO: 309094 - DNA, 20 bp, Artificial
  CRISPR gRNA sequence
gcatctaacttcatattaag

SEQ ID NO: 309095 - DNA, 20 bp, Artificial
  CRISPR gRNA sequence
gtctcaagtaattctgtaac

SEQ ID NO: 309096 - DNA, 20 bp, Artificial
  CRISPR gRNA sequence
aaattcacagaaccacagta

SEQ ID NO: 309097 - DNA, 20 bp, Artificial
  CRISPR gRNA sequence
agtatctgggtattgtataa

SEQ ID NO: 309098 - DNA, 20 bp, Artificial
  CRISPR gRNA sequence
aatgaggtatacttaggcaa

SEQ ID NO: 309099 - DNA, 20 bp, Artificial
  CRISPR gRNA sequence
cagatgagactgcaaatgag

SEQ ID NO: 309100 - DNA, 20 bp, Artificial
  CRISPR gRNA sequence
aaacagaagcaaaagtaaaa

SEQ ID NO: 309101 - DNA, 20 bp, Artificial
  CRISPR gRNA sequence
tgtatttgttttaatgtata

SEQ ID NO: 309102 - DNA, 20 bp, Artificial
  CRISPR gRNA sequence
gcaaatgacagaccttttag

SEQ ID NO: 309103 - DNA, 20 bp, Artificial
  CRISPR gRNA sequence
atgccagtgatcctgaacag

SEQ ID NO: 309104 - DNA, 20 bp, Artificial
  CRISPR gRNA sequence
atcctgaacagccagaaaag

SEQ ID NO: 309105 - DNA, 20 bp, Artificial
  CRISPR gRNA sequence
aagtgagaatggcaaaggca

SEQ ID NO: 309106 - DNA, 20 bp, Artificial
  CRISPR gRNA sequence
tagtaccaatttctaatata

SEQ ID NO: 309107 - DNA, 20 bp, Artificial
  CRISPR gRNA sequence
atgagtgttttgctaagaac

SEQ ID NO: 309108 - DNA, 20 bp, Artificial
  CRISPR gRNA sequence
atcgagtatgatggtgttat

SEQ ID NO: 309109 - DNA, 20 bp, Artificial
  CRISPR gRNA sequence
tacgagcctatgttgcactt

SEQ ID NO: 309110 - DNA, 20 bp, Artificial
  CRISPR gRNA sequence
aaatacaggattcctccagg

SEQ ID NO: 309111 - DNA, 20 bp, Artificial
  CRISPR gRNA sequence
ctgcccttgaggaccttcca

SEQ ID NO: 309112 - DNA, 20 bp, Artificial
  CRISPR gRNA sequence
gtaagtgcaggaggtatgtc

SEQ ID NO: 309113 - DNA, 20 bp, Artificial
  CRISPR gRNA sequence
tgtcaaagaaagccttggag

SEQ ID NO: 309114 - DNA, 20 bp, Artificial
  CRISPR gRNA sequence
tattcagacacttcagcctc

SEQ ID NO: 309115 - DNA, 20 bp, Artificial
  CRISPR gRNA sequence
ttcaacaggtacccccatct

SEQ ID NO: 309116 - DNA, 20 bp, Artificial
  CRISPR gRNA sequence
gccaacaacttcttaacatc

SEQ ID NO: 309117 - DNA, 20 bp, Artificial
  CRISPR gRNA sequence
aaagcctgttttccaactcc

SEQ ID NO: 309118 - DNA, 20 bp, Artificial
  CRISPR gRNA sequence
gtgaaggttcctcaaggcat

SEQ ID NO: 309119 - DNA, 20 bp, Artificial
  CRISPR gRNA sequence
tctggagattatagtggaca

SEQ ID NO: 309120 - DNA, 20 bp, Artificial
  CRISPR gRNA sequence
acagacacctcacccagatt

SEQ ID NO: 309121 - DNA, 20 bp, Artificial
  CRISPR gRNA sequence
aataaagagaagagcagcta

SEQ ID NO: 309122 - DNA, 20 bp, Artificial
  CRISPR gRNA sequence
taatgctgctcttggacttc

SEQ ID NO: 309123 - DNA, 20 bp, Artificial
  CRISPR gRNA sequence
ggatatttgctaaatgacca

SEQ ID NO: 309124 - DNA, 20 bp, Artificial
  CRISPR gRNA sequence
ataatctataactccactaa

SEQ ID NO: 309125 - DNA, 20 bp, Artificial
  CRISPR gRNA sequence
aaccttctaactcacttatg

SEQ ID NO: 309126 - DNA, 20 bp, Artificial
  CRISPR gRNA sequence
atactgattttaaaatctaa

SEQ ID NO: 309127 - DNA, 20 bp, Artificial
  CRISPR gRNA sequence
atcctgctgtactttaaaaa

SEQ ID NO: 309128 - DNA, 20 bp, Artificial
  CRISPR gRNA sequence
ttgctagatttttcttcaca

SEQ ID NO: 309129 - DNA, 20 bp, Artificial
  CRISPR gRNA sequence
aaatgaaacaaagaagggtt

SEQ ID NO: 309130 - DNA, 20 bp, Artificial
  CRISPR gRNA sequence
tttcttcctccatgaggcaa

SEQ ID NO: 309131 - DNA, 20 bp, Artificial
  CRISPR gRNA sequence
agtggcacatacatgacccc

SEQ ID NO: 309132 - DNA, 20 bp, Artificial
  CRISPR gRNA sequence
atgacccctaagaatgtaat

SEQ ID NO: 309133 - DNA, 20 bp, Artificial
  CRISPR gRNA sequence
aatgtaatgaagaatattgg

SEQ ID NO: 309134 - DNA, 20 bp, Artificial
  CRISPR gRNA sequence
gaacctttcctagctgggat

SEQ ID NO: 309135 - DNA, 20 bp, Artificial
  CRISPR gRNA sequence
caaatagggcagataaggca

SEQ ID NO: 309136 - DNA, 20 bp, Artificial
  CRISPR gRNA sequence
gaattactgtcttttcccaa

SEQ ID NO: 309137 - DNA, 20 bp, Artificial
  CRISPR gRNA sequence
ccctatcagcttacccattg

SEQ ID NO: 309138 - DNA, 20 bp, Artificial
  CRISPR gRNA sequence
aaggtaaagtgcctttttca

SEQ ID NO: 309139 - DNA, 20 bp, Artificial
  CRISPR gRNA sequence
cgtttttaaccaacatttaa

SEQ ID NO: 309140 - DNA, 20 bp, Artificial
  CRISPR gRNA sequence
ttgtaagcaaatttaaaagt

SEQ ID NO: 309141 - DNA, 20 bp, Artificial
  CRISPR gRNA sequence
ccattcttgagttacttcac

SEQ ID NO: 309142 - DNA, 20 bp, Artificial
  CRISPR gRNA sequence
gccatttgtatattttcttt

SEQ ID NO: 309143 - DNA, 20 bp, Artificial
  CRISPR gRNA sequence
ataaacaccattatttttaa

SEQ ID NO: 309144 - DNA, 20 bp, Artificial
  CRISPR gRNA sequence
catctgggaactcagtcaat

SEQ ID NO: 309145 - DNA, 20 bp, Artificial
  CRISPR gRNA sequence
ctacttgggaggctgagaga

SEQ ID NO: 309146 - DNA, 20 bp, Artificial
  CRISPR gRNA sequence
tgccctctttccataaacaa

SEQ ID NO: 309147 - DNA, 20 bp, Artificial
  CRISPR gRNA sequence
cagagatcggatgacagaca

SEQ ID NO: 309148 - DNA, 20 bp, Artificial
  CRISPR gRNA sequence
ctgtagtccctgagtgaagg

SEQ ID NO: 309149 - DNA, 20 bp, Artificial
  CRISPR gRNA sequence
tgaactaggaaaagacattg

SEQ ID NO: 309150 - DNA, 20 bp, Artificial
  CRISPR gRNA sequence
taggaaaagacattgcaaga

SEQ ID NO: 309151 - DNA, 20 bp, Artificial
  CRISPR gRNA sequence
atgatcaagtggggtttatt

SEQ ID NO: 309152 - DNA, 20 bp, Artificial
  CRISPR gRNA sequence
ttactacataaataaactaa

SEQ ID NO: 309153 - DNA, 20 bp, Artificial
  CRISPR gRNA sequence
ccattcatagttttaaatgg

SEQ ID NO: 309154 - DNA, 20 bp, Artificial
  CRISPR gRNA sequence
ttgtactggaggtcatagcc

SEQ ID NO: 309155 - DNA, 20 bp, Artificial
  CRISPR gRNA sequence
tcatagccagagaaacaaga

SEQ ID NO: 309156 - DNA, 20 bp, Artificial
  CRISPR gRNA sequence
ccagagaaacaagactagaa

SEQ ID NO: 309157 - DNA, 20 bp, Artificial
  CRISPR gRNA sequence
cacagataatgatcatgctt

SEQ ID NO: 309158 - DNA, 20 bp, Artificial
  CRISPR gRNA sequence
aactatacaatattactact

SEQ ID NO: 309159 - DNA, 20 bp, Artificial
  CRISPR gRNA sequence
gaaaagttatagggaaatgc

SEQ ID NO: 309160 - DNA, 20 bp, Artificial
  CRISPR gRNA sequence
ctactctggaggctgaggca

SEQ ID NO: 309161 - DNA, 20 bp, Artificial
  CRISPR gRNA sequence
agctaccaaggtaattccat

SEQ ID NO: 309162 - DNA, 20 bp, Artificial
  CRISPR gRNA sequence
acacaaagtaacttatatat

SEQ ID NO: 309163 - DNA, 20 bp, Artificial
  CRISPR gRNA sequence
ttaaaatgaaaggacttcca

SEQ ID NO: 309164 - DNA, 20 bp, Artificial
  CRISPR gRNA sequence
gacttccaaaagaaaacaga

SEQ ID NO: 309165 - DNA, 20 bp, Artificial
  CRISPR gRNA sequence
caagtcttcttagataggac

SEQ ID NO: 309166 - DNA, 20 bp, Artificial
  CRISPR gRNA sequence
aaaagtcaaaccacagacag

SEQ ID NO: 309167 - DNA, 20 bp, Artificial
  CRISPR gRNA sequence
gagataccactgcacaccct

SEQ ID NO: 309168 - DNA, 20 bp, Artificial
  CRISPR gRNA sequence
ctcatatactgctatacaac

SEQ ID NO: 309169 - DNA, 20 bp, Artificial
  CRISPR gRNA sequence
aaatcctagacatttaccaa

SEQ ID NO: 309170 - DNA, 20 bp, Artificial
  CRISPR gRNA sequence
caatgaaatactgcaaagct

SEQ ID NO: 309171 - DNA, 20 bp, Artificial
  CRISPR gRNA sequence
gtgaaacaatccaggcacaa

SEQ ID NO: 309172 - DNA, 20 bp, Artificial
  CRISPR gRNA sequence
aatttcatgtatatgaaatt

SEQ ID NO: 309173 - DNA, 20 bp, Artificial
  CRISPR gRNA sequence
ttccagtgacaggaagtgtt

SEQ ID NO: 309174 - DNA, 20 bp, Artificial
  CRISPR gRNA sequence
gaatgctctatttagtaaag

SEQ ID NO: 309175 - DNA, 20 bp, Artificial
  CRISPR gRNA sequence
atcatcacaacagtcagcct

SEQ ID NO: 309176 - DNA, 20 bp, Artificial
  CRISPR gRNA sequence
gctttgtgaggtctagctgg

SEQ ID NO: 309177 - DNA, 20 bp, Artificial
  CRISPR gRNA sequence
cctccttataaaccttgctt

SEQ ID NO: 309178 - DNA, 20 bp, Artificial
  CRISPR gRNA sequence
accttgctttcagaaaagga

SEQ ID NO: 309179 - DNA, 20 bp, Artificial
  CRISPR gRNA sequence
tgaaaaatctatttccagtg

SEQ ID NO: 309180 - DNA, 20 bp, Artificial
  CRISPR gRNA sequence
tgttagaatttaaggcacag

SEQ ID NO: 309181 - DNA, 20 bp, Artificial
  CRISPR gRNA sequence
aggcatatactttttgaatg

SEQ ID NO: 309182 - DNA, 20 bp, Artificial
  CRISPR gRNA sequence
agggaagagagtgaacagac

SEQ ID NO: 309183 - DNA, 20 bp, Artificial
  CRISPR gRNA sequence
ataaaactagttaagaactg

SEQ ID NO: 309184 - DNA, 20 bp, Artificial
  CRISPR gRNA sequence
gggtatccaatgcacaatgc

SEQ ID NO: 309185 - DNA, 20 bp, Artificial
  CRISPR gRNA sequence
cttaaaaaccctttcccaaa

SEQ ID NO: 309186 - DNA, 20 bp, Artificial
  CRISPR gRNA sequence
caggttctcaataaatgttg

SEQ ID NO: 309187 - DNA, 20 bp, Artificial
  CRISPR gRNA sequence
gtctgtacctctatccctcc

SEQ ID NO: 309188 - DNA, 20 bp, Artificial
  CRISPR gRNA sequence
ttccgggcacccttggacaa

SEQ ID NO: 309189 - DNA, 20 bp, Artificial
  CRISPR gRNA sequence
ctaccctgtcacactcagtt

SEQ ID NO: 309190 - DNA, 20 bp, Artificial
  CRISPR gRNA sequence
gagggcatgggaagggccag

SEQ ID NO: 309191 - DNA, 20 bp, Artificial
  CRISPR gRNA sequence
ttctgccctatcattgaaat

SEQ ID NO: 309192 - DNA, 20 bp, Artificial
  CRISPR gRNA sequence
cctatcattgaaatctagaa

SEQ ID NO: 309193 - DNA, 20 bp, Artificial
  CRISPR gRNA sequence
atcttttcttctatttctcc

SEQ ID NO: 309194 - DNA, 20 bp, Artificial
  CRISPR gRNA sequence
gaaaactgccttttatctgc

SEQ ID NO: 309195 - DNA, 20 bp, Artificial
  CRISPR gRNA sequence
tagtgtgattactatgctct

SEQ ID NO: 309196 - DNA, 20 bp, Artificial
  CRISPR gRNA sequence
aatactcaaaagagagagag

SEQ ID NO: 309197 - DNA, 20 bp, Artificial
  CRISPR gRNA sequence
aaaaagagagatcttgatcc

SEQ ID NO: 309198 - DNA, 20 bp, Artificial
  CRISPR gRNA sequence
atacagagacagatatactg

SEQ ID NO: 309199 - DNA, 20 bp, Artificial
  CRISPR gRNA sequence
gtagtactcttgaagccaaa

SEQ ID NO: 309200 - DNA, 20 bp, Artificial
  CRISPR gRNA sequence
actgtgctgcacaaaacatg

SEQ ID NO: 309201 - DNA, 20 bp, Artificial
  CRISPR gRNA sequence
tctcactagtcagttcttca

SEQ ID NO: 309202 - DNA, 20 bp, Artificial
  CRISPR gRNA sequence
aaattcagtggggcaccagc

SEQ ID NO: 309203 - DNA, 20 bp, Artificial
  CRISPR gRNA sequence
ggcagataaaaggcagtttt

SEQ ID NO: 309204 - DNA, 20 bp, Artificial
  CRISPR gRNA sequence
cacaatctatgaaattaaga

SEQ ID NO: 309205 - DNA, 20 bp, Artificial
  CRISPR gRNA sequence
tgaagtgaaaagaagcagta

SEQ ID NO: 309206 - DNA, 20 bp, Artificial
  CRISPR gRNA sequence
taatgtctttttgccttctg

SEQ ID NO: 309207 - DNA, 20 bp, Artificial
  CRISPR gRNA sequence
aggaacttacaaaggaaagg

SEQ ID NO: 309208 - DNA, 20 bp, Artificial
  CRISPR gRNA sequence
ggtatatggattttttctct

SEQ ID NO: 309209 - DNA, 20 bp, Artificial
  CRISPR gRNA sequence
attttttctctggagaaata

SEQ ID NO: 309210 - DNA, 20 bp, Artificial
  CRISPR gRNA sequence
ttctagatttcaatgatagg

SEQ ID NO: 309211 - DNA, 20 bp, Artificial
  CRISPR gRNA sequence
tgccattggaacagcaatga

SEQ ID NO: 309212 - DNA, 20 bp, Artificial
  CRISPR gRNA sequence
gaggagaaacaaactattga

SEQ ID NO: 309213 - DNA, 20 bp, Artificial
  CRISPR gRNA sequence
aaactattgaagagaaaggt

SEQ ID NO: 309214 - DNA, 20 bp, Artificial
  CRISPR gRNA sequence
agagaaaggtggagaaagca

SEQ ID NO: 309215 - DNA, 20 bp, Artificial
  CRISPR gRNA sequence
cggaattattagttttgttg

SEQ ID NO: 309216 - DNA, 20 bp, Artificial
  CRISPR gRNA sequence
taagcataatctggtgttat

SEQ ID NO: 309217 - DNA, 20 bp, Artificial
  CRISPR gRNA sequence
ctagtttgggaaagggtttt

SEQ ID NO: 309218 - DNA, 20 bp, Artificial
  CRISPR gRNA sequence
tgctgcttgaggcaagatct

SEQ ID NO: 309219 - DNA, 20 bp, Artificial
  CRISPR gRNA sequence
ttcaaagttctgggactgag

SEQ ID NO: 309220 - DNA, 20 bp, Artificial
  CRISPR gRNA sequence
atcggctagccagatggtgc

SEQ ID NO: 309221 - DNA, 20 bp, Artificial
  CRISPR gRNA sequence
atggaggtatttatagacca

SEQ ID NO: 309222 - DNA, 20 bp, Artificial
  CRISPR gRNA sequence
tttatgaggccacaaagtca

SEQ ID NO: 309223 - DNA, 20 bp, Artificial
  CRISPR gRNA sequence
gtgacaggtgcatcaaaatc

SEQ ID NO: 309224 - DNA, 20 bp, Artificial
  CRISPR gRNA sequence
caccgccaactgatgaaaat

SEQ ID NO: 309225 - DNA, 20 bp, Artificial
  CRISPR gRNA sequence
ttaacctttgttcttatttt

SEQ ID NO: 309226 - DNA, 20 bp, Artificial
  CRISPR gRNA sequence
taatccatagatcaacttgg

SEQ ID NO: 309227 - DNA, 20 bp, Artificial
  CRISPR gRNA sequence
acaattgcttttgttagtat

SEQ ID NO: 309228 - DNA, 20 bp, Artificial
  CRISPR gRNA sequence
catgaaatattatgctaaca

SEQ ID NO: 309229 - DNA, 20 bp, Artificial
  CRISPR gRNA sequence
agctaatttttgtatgttta

SEQ ID NO: 309230 - DNA, 20 bp, Artificial
  CRISPR gRNA sequence
cctaaaagaccttttaattg

SEQ ID NO: 309231 - DNA, 20 bp, Artificial
  CRISPR gRNA sequence
acatgaatagacaattctga

SEQ ID NO: 309232 - DNA, 20 bp, Artificial
  CRISPR gRNA sequence
gagataccaccttactcctg

SEQ ID NO: 309233 - DNA, 20 bp, Artificial
  CRISPR gRNA sequence
ggaatattactcagccataa

SEQ ID NO: 309234 - DNA, 20 bp, Artificial
  CRISPR gRNA sequence
ttattctaagtgaagtaact

SEQ ID NO: 309235 - DNA, 20 bp, Artificial
  CRISPR gRNA sequence
aagtgaagtaactcaagaat

SEQ ID NO: 309236 - DNA, 20 bp, Artificial
  CRISPR gRNA sequence
actatgaggatgcaaagaca

SEQ ID NO: 309237 - DNA, 20 bp, Artificial
  CRISPR gRNA sequence
tgacaggtggcaccaaagtc

SEQ ID NO: 309238 - DNA, 20 bp, Artificial
  CRISPR gRNA sequence
attcaaataaaaattttgaa

SEQ ID NO: 309239 - DNA, 20 bp, Artificial
  CRISPR gRNA sequence
ctacttgggaggctgaggca

SEQ ID NO: 309240 - DNA, 20 bp, Artificial
  CRISPR gRNA sequence
tgaaaaaggcactttacctt

SEQ ID NO: 309241 - DNA, 20 bp, Artificial
  CRISPR gRNA sequence
gaagagagattggaaactgg

SEQ ID NO: 309242 - DNA, 20 bp, Artificial
  CRISPR gRNA sequence
taaatatatacagttgaggc

SEQ ID NO: 309243 - DNA, 20 bp, Artificial
  CRISPR gRNA sequence
gaggcatagaaaaactataa

SEQ ID NO: 309244 - DNA, 20 bp, Artificial
  CRISPR gRNA sequence
agtttgaggaccgtctcctc

SEQ ID NO: 309245 - DNA, 20 bp, Artificial
  CRISPR gRNA sequence
taggaggaagctccactttt

SEQ ID NO: 309246 - DNA, 20 bp, Artificial
  CRISPR gRNA sequence
gtttccacattggtctcttg

SEQ ID NO: 309247 - DNA, 20 bp, Artificial
  CRISPR gRNA sequence
tcctccttccatcttcaaag

SEQ ID NO: 309248 - DNA, 20 bp, Artificial
  CRISPR gRNA sequence
tggcagatattgctgaagtt

SEQ ID NO: 309249 - DNA, 20 bp, Artificial
  CRISPR gRNA sequence
tttctgattgcctcatggag

SEQ ID NO: 309250 - DNA, 20 bp, Artificial
  CRISPR gRNA sequence
taagctgatcattctaatgt

SEQ ID NO: 309251 - DNA, 20 bp, Artificial
  CRISPR gRNA sequence
tttaaatggcaatgaggttg

SEQ ID NO: 309252 - DNA, 20 bp, Artificial
  CRISPR gRNA sequence
gaattttatacttttatatc

SEQ ID NO: 309253 - DNA, 20 bp, Artificial
  CRISPR gRNA sequence
cagccattaaaaatgatgct

SEQ ID NO: 309254 - DNA, 20 bp, Artificial
  CRISPR gRNA sequence
aaaacaacatagattgatac

SEQ ID NO: 309255 - DNA, 20 bp, Artificial
  CRISPR gRNA sequence
tgataatggatatgtattac

SEQ ID NO: 309256 - DNA, 20 bp, Artificial
  CRISPR gRNA sequence
aattcatctaacttatttca

SEQ ID NO: 309257 - DNA, 20 bp, Artificial
  CRISPR gRNA sequence
gtacatttgtaaaccagagg

SEQ ID NO: 309258 - DNA, 20 bp, Artificial
  CRISPR gRNA sequence
cttcttcttcttccatttcc

SEQ ID NO: 309259 - DNA, 20 bp, Artificial
  CRISPR gRNA sequence
ttccatttccatagaattag

SEQ ID NO: 309260 - DNA, 20 bp, Artificial
  CRISPR gRNA sequence
gaaatccacaataggaggcc

SEQ ID NO: 309261 - DNA, 20 bp, Artificial
  CRISPR gRNA sequence
tcagggcctcagcagcgacc

SEQ ID NO: 309262 - DNA, 20 bp, Artificial
  CRISPR gRNA sequence
aacctatctctgatcaagcg

SEQ ID NO: 309263 - DNA, 20 bp, Artificial
  CRISPR gRNA sequence
atctgaacaacaagacactg

SEQ ID NO: 309264 - DNA, 20 bp, Artificial
  CRISPR gRNA sequence
tgtcactggagggggcaagc

SEQ ID NO: 309265 - DNA, 20 bp, Artificial
  CRISPR gRNA sequence
cctccactgaacttgtccct

SEQ ID NO: 309266 - DNA, 20 bp, Artificial
  CRISPR gRNA sequence
cagttttgggaacctgtcat

SEQ ID NO: 309267 - DNA, 20 bp, Artificial
  CRISPR gRNA sequence
cgcatgtatgtgttgtaatc

SEQ ID NO: 309268 - DNA, 20 bp, Artificial
  CRISPR gRNA sequence
tgtatgtgttgtaatcaaag

SEQ ID NO: 309269 - DNA, 20 bp, Artificial
  CRISPR gRNA sequence
tgtatttttaaatcaaaact

SEQ ID NO: 309270 - DNA, 20 bp, Artificial
  CRISPR gRNA sequence
tttgtgtataatacctgctg

SEQ ID NO: 309271 - DNA, 20 bp, Artificial
  CRISPR gRNA sequence
tggaaaacagctttacctat

SEQ ID NO: 309272 - DNA, 20 bp, Artificial
  CRISPR gRNA sequence
aagccgcgtcttgtcagttt

SEQ ID NO: 309273 - DNA, 20 bp, Artificial
  CRISPR gRNA sequence
tgtacacattttctgttata

SEQ ID NO: 309274 - DNA, 20 bp, Artificial
  CRISPR gRNA sequence
gatgccctgcgtcatatctt

SEQ ID NO: 309275 - DNA, 20 bp, Artificial
  CRISPR gRNA sequence
cctgtgtcatgtgccttctg

SEQ ID NO: 309276 - DNA, 20 bp, Artificial
  CRISPR gRNA sequence
ttctgttttactctatggtt

SEQ ID NO: 309277 - DNA, 20 bp, Artificial
  CRISPR gRNA sequence
ttattcataagagccccaaa

SEQ ID NO: 309278 - DNA, 20 bp, Artificial
  CRISPR gRNA sequence
tgagggaaatttttagggtg

SEQ ID NO: 309279 - DNA, 20 bp, Artificial
  CRISPR gRNA sequence
gcagtctcatctgagaaggc

SEQ ID NO: 309280 - DNA, 20 bp, Artificial
  CRISPR gRNA sequence
acataccaagcactgacagt

SEQ ID NO: 309281 - DNA, 20 bp, Artificial
  CRISPR gRNA sequence
gaaggttaaggattagggag

SEQ ID NO: 309282 - DNA, 20 bp, Artificial
  CRISPR gRNA sequence
atcttatcagtaatcatgct

SEQ ID NO: 309283 - DNA, 20 bp, Artificial
  CRISPR gRNA sequence
ttccaaggatgtcaaatgct

SEQ ID NO: 309284 - DNA, 20 bp, Artificial
  CRISPR gRNA sequence
tctctaagctctttcagaga

SEQ ID NO: 309285 - DNA, 20 bp, Artificial
  CRISPR gRNA sequence
acatcatgctggaagggttg

SEQ ID NO: 309286 - DNA, 20 bp, Artificial
  CRISPR gRNA sequence
tgtaggaccttttctaggtt

SEQ ID NO: 309287 - DNA, 20 bp, Artificial
  CRISPR gRNA sequence
tataggacagatgacctgat

SEQ ID NO: 309288 - DNA, 20 bp, Artificial
  CRISPR gRNA sequence
atagtttgagcagctgttgt

SEQ ID NO: 309289 - DNA, 20 bp, Artificial
  CRISPR gRNA sequence
ctctgtctccagagtggatc

SEQ ID NO: 309290 - DNA, 20 bp, Artificial
  CRISPR gRNA sequence
ttccataggtgggtaagcat

SEQ ID NO: 309291 - DNA, 20 bp, Artificial
  CRISPR gRNA sequence
gatgtcaggaacaagtcgct

SEQ ID NO: 309292 - DNA, 20 bp, Artificial
  CRISPR gRNA sequence
aaatgcatatcttatatgtt

SEQ ID NO: 309293 - DNA, 20 bp, Artificial
  CRISPR gRNA sequence
cacctggagcagctcagtcc

SEQ ID NO: 309294 - DNA, 20 bp, Artificial
  CRISPR gRNA sequence
agagctgaactccaatatgt

SEQ ID NO: 309295 - DNA, 20 bp, Artificial
  CRISPR gRNA sequence
tgagcacctgacatctccca

SEQ ID NO: 309296 - DNA, 20 bp, Artificial
  CRISPR gRNA sequence
gcactcaataagtaattgtt

SEQ ID NO: 309297 - DNA, 20 bp, Artificial
  CRISPR gRNA sequence
agaaaggaaaggaaaaatct

SEQ ID NO: 309298 - DNA, 20 bp, Artificial
  CRISPR gRNA sequence
aaatgcaatttaaacctcag

SEQ ID NO: 309299 - DNA, 20 bp, Artificial
  CRISPR gRNA sequence
ggaggacagttggtaatatg

SEQ ID NO: 309300 - DNA, 20 bp, Artificial
  CRISPR gRNA sequence
gacttagcaactcaatttct

SEQ ID NO: 309301 - DNA, 20 bp, Artificial
  CRISPR gRNA sequence
taatgccatgtagctgtgaa

SEQ ID NO: 309302 - DNA, 20 bp, Artificial
  CRISPR gRNA sequence
ataggtttgttgtgaggatt

SEQ ID NO: 309303 - DNA, 20 bp, Artificial
  CRISPR gRNA sequence
tgaagtaacatcaaaaagta

SEQ ID NO: 309304 - DNA, 20 bp, Artificial
  CRISPR gRNA sequence
cagctattcaggtggctgag

SEQ ID NO: 309305 - DNA, 20 bp, Artificial
  CRISPR gRNA sequence
ctacttgggaggctgaggca

SEQ ID NO: 309306 - DNA, 20 bp, Artificial
  CRISPR gRNA sequence
aaaaaaaaaaatcttaaagt

SEQ ID NO: 309307 - DNA, 20 bp, Artificial
  CRISPR gRNA sequence
ttaactagaggtgttgttca

SEQ ID NO: 309308 - DNA, 20 bp, Artificial
  CRISPR gRNA sequence
gaggtgttgttcaagagaaa

SEQ ID NO: 309309 - DNA, 20 bp, Artificial
  CRISPR gRNA sequence
tatagggagggaaaagttaa

SEQ ID NO: 309310 - DNA, 20 bp, Artificial
  CRISPR gRNA sequence
taagcagaggtgtgccctga

SEQ ID NO: 309311 - DNA, 20 bp, Artificial
  CRISPR gRNA sequence
cagaggtgtgccctgagaag

SEQ ID NO: 309312 - DNA, 20 bp, Artificial
  CRISPR gRNA sequence
cctgagaagaaagaattcaa

SEQ ID NO: 309313 - DNA, 20 bp, Artificial
  CRISPR gRNA sequence
gtaactcttttctcaggagc

SEQ ID NO: 309314 - DNA, 20 bp, Artificial
  CRISPR gRNA sequence
ctcactttcagtgtgcggag

SEQ ID NO: 309315 - DNA, 20 bp, Artificial
  CRISPR gRNA sequence
cacttggggaggctgaggtg

SEQ ID NO: 309316 - DNA, 20 bp, Artificial
  CRISPR gRNA sequence
tgtactccagcctgggtgac

SEQ ID NO: 309317 - DNA, 20 bp, Artificial
  CRISPR gRNA sequence
ccacaagctcaaggtgctaa

SEQ ID NO: 309318 - DNA, 20 bp, Artificial
  CRISPR gRNA sequence
tcaaggtgctaagcagaaaa

SEQ ID NO: 309319 - DNA, 20 bp, Artificial
  CRISPR gRNA sequence
gccaactcctgtttatagat

SEQ ID NO: 309320 - DNA, 20 bp, Artificial
  CRISPR gRNA sequence
gaggggaggtggtggatagt

SEQ ID NO: 309321 - DNA, 20 bp, Artificial
  CRISPR gRNA sequence
aggtggtggatagttaagaa

SEQ ID NO: 309322 - DNA, 20 bp, Artificial
  CRISPR gRNA sequence
ggatagttaagaaaaagaat

SEQ ID NO: 309323 - DNA, 20 bp, Artificial
  CRISPR gRNA sequence
actgctaacaccaccagaca

SEQ ID NO: 309324 - DNA, 20 bp, Artificial
  CRISPR gRNA sequence
cacagggtcttgagggggat

SEQ ID NO: 309325 - DNA, 20 bp, Artificial
  CRISPR gRNA sequence
tcagttgtttcctaggagcc

SEQ ID NO: 309326 - DNA, 20 bp, Artificial
  CRISPR gRNA sequence
ttcctaggagcctgagaaag

SEQ ID NO: 309327 - DNA, 20 bp, Artificial
  CRISPR gRNA sequence
cagggtcagagaagaccaga

SEQ ID NO: 309328 - DNA, 20 bp, Artificial
  CRISPR gRNA sequence
gtggtcttgtacaatgctca

SEQ ID NO: 309329 - DNA, 20 bp, Artificial
  CRISPR gRNA sequence
gagcaggaaggccatcacaa

SEQ ID NO: 309330 - DNA, 20 bp, Artificial
  CRISPR gRNA sequence
cagtcccatagtgctagagt

SEQ ID NO: 309331 - DNA, 20 bp, Artificial
  CRISPR gRNA sequence
aaaaaaaaggtaaaacttga

SEQ ID NO: 309332 - DNA, 20 bp, Artificial
  CRISPR gRNA sequence
tctagccaatggaattgtgg

SEQ ID NO: 309333 - DNA, 20 bp, Artificial
  CRISPR gRNA sequence
cagaggaaatgtccaagggc

SEQ ID NO: 309334 - DNA, 20 bp, Artificial
  CRISPR gRNA sequence
ggttagtattgcatttacgc

SEQ ID NO: 309335 - DNA, 20 bp, Artificial
  CRISPR gRNA sequence
gagtttcctgggcctcaacc

SEQ ID NO: 309336 - DNA, 20 bp, Artificial
  CRISPR gRNA sequence
cttaatctacatgatgaagc

SEQ ID NO: 309337 - DNA, 20 bp, Artificial
  CRISPR gRNA sequence
ttagtggcttataaggaagc

SEQ ID NO: 309338 - DNA, 20 bp, Artificial
  CRISPR gRNA sequence
cacaggaaagatgaccaaca

SEQ ID NO: 309339 - DNA, 20 bp, Artificial
  CRISPR gRNA sequence
gccagtgctaaatgcttgcc

SEQ ID NO: 309340 - DNA, 20 bp, Artificial
  CRISPR gRNA sequence
caactattcttgatcgaata

SEQ ID NO: 309341 - DNA, 20 bp, Artificial
  CRISPR gRNA sequence
agtaagctatattcctagaa

SEQ ID NO: 309342 - DNA, 20 bp, Artificial
  CRISPR gRNA sequence
aatcgtttgaccaaagggtt

SEQ ID NO: 309343 - DNA, 20 bp, Artificial
  CRISPR gRNA sequence
gaaattacatctcataagtt

SEQ ID NO: 309344 - DNA, 20 bp, Artificial
  CRISPR gRNA sequence
gttttagaaatctttgttat

SEQ ID NO: 309345 - DNA, 20 bp, Artificial
  CRISPR gRNA sequence
gaaattagatctcataagtt

SEQ ID NO: 309346 - DNA, 20 bp, Artificial
  CRISPR gRNA sequence
aaagagcttctataaatcaa

SEQ ID NO: 309347 - DNA, 20 bp, Artificial
  CRISPR gRNA sequence
acccaaactaaaagcgggca

SEQ ID NO: 309348 - DNA, 20 bp, Artificial
  CRISPR gRNA sequence
agatggtcatactcaaaata

SEQ ID NO: 309349 - DNA, 20 bp, Artificial
  CRISPR gRNA sequence
tttggagaccacacaccatc

SEQ ID NO: 309350 - DNA, 20 bp, Artificial
  CRISPR gRNA sequence
gaagtacaagtgccccatat

SEQ ID NO: 309351 - DNA, 20 bp, Artificial
  CRISPR gRNA sequence
gtcattggccgtgaagaagt

SEQ ID NO: 309352 - DNA, 20 bp, Artificial
  CRISPR gRNA sequence
gaatggaagaggaaagaacc

SEQ ID NO: 309353 - DNA, 20 bp, Artificial
  CRISPR gRNA sequence
gagatttctgtcagctaagc

SEQ ID NO: 309354 - DNA, 20 bp, Artificial
  CRISPR gRNA sequence
gaataaggtgggtgaactag

SEQ ID NO: 309355 - DNA, 20 bp, Artificial
  CRISPR gRNA sequence
catgtaaatggaggttcact

SEQ ID NO: 309356 - DNA, 20 bp, Artificial
  CRISPR gRNA sequence
ggggaaatatgactacttgg

SEQ ID NO: 309357 - DNA, 20 bp, Artificial
  CRISPR gRNA sequence
agtagatgttggagagcaac

SEQ ID NO: 309358 - DNA, 20 bp, Artificial
  CRISPR gRNA sequence
gacttatttcacaactttgt

SEQ ID NO: 309359 - DNA, 20 bp, Artificial
  CRISPR gRNA sequence
cccccacctggcactaaaga

SEQ ID NO: 309360 - DNA, 20 bp, Artificial
  CRISPR gRNA sequence
tgggtattcgagcagtgttt

SEQ ID NO: 309361 - DNA, 20 bp, Artificial
  CRISPR gRNA sequence
agaatgaacagcagctcagg

SEQ ID NO: 309362 - DNA, 20 bp, Artificial
  CRISPR gRNA sequence
accctcttgagcagctcagg

SEQ ID NO: 309363 - DNA, 20 bp, Artificial
  CRISPR gRNA sequence
gatatacgtgacagcaatat

SEQ ID NO: 309364 - DNA, 20 bp, Artificial
  CRISPR gRNA sequence
taggaatataatgagcaaaa

SEQ ID NO: 309365 - DNA, 20 bp, Artificial
  CRISPR gRNA sequence
acgtggttgcctacagttta

SEQ ID NO: 309366 - DNA, 20 bp, Artificial
  CRISPR gRNA sequence
tagtgatcaagtaatcatac

SEQ ID NO: 309367 - DNA, 20 bp, Artificial
  CRISPR gRNA sequence
accagcctaaactgagatct

SEQ ID NO: 309368 - DNA, 20 bp, Artificial
  CRISPR gRNA sequence
agaatgatataatagattaa

SEQ ID NO: 309369 - DNA, 20 bp, Artificial
  CRISPR gRNA sequence
cctgagtgacctgtttgacc

SEQ ID NO: 309370 - DNA, 20 bp, Artificial
  CRISPR gRNA sequence
cattttctatgtggcctttc

SEQ ID NO: 309371 - DNA, 20 bp, Artificial
  CRISPR gRNA sequence
tctagatcagcactgtccag

SEQ ID NO: 309372 - DNA, 20 bp, Artificial
  CRISPR gRNA sequence
ctactcaggaggctgaggca

SEQ ID NO: 309373 - DNA, 20 bp, Artificial
  CRISPR gRNA sequence
caacagagtaagactccatc

SEQ ID NO: 309374 - DNA, 20 bp, Artificial
  CRISPR gRNA sequence
taagactccatctcagaaaa

SEQ ID NO: 309375 - DNA, 20 bp, Artificial
  CRISPR gRNA sequence
aaacttgtagtagtcacatt

SEQ ID NO: 309376 - DNA, 20 bp, Artificial
  CRISPR gRNA sequence
agtcacattaaagaaattaa

SEQ ID NO: 309377 - DNA, 20 bp, Artificial
  CRISPR gRNA sequence
attataatctcaacatgtaa

SEQ ID NO: 309378 - DNA, 20 bp, Artificial
  CRISPR gRNA sequence
atcaattgatggcatgagga

SEQ ID NO: 309379 - DNA, 20 bp, Artificial
  CRISPR gRNA sequence
gtctttatatgtgaaccacc

SEQ ID NO: 309380 - DNA, 20 bp, Artificial
  CRISPR gRNA sequence
taagggaaaagtggatagat

SEQ ID NO: 309381 - DNA, 20 bp, Artificial
  CRISPR gRNA sequence
gtggatagatcaagaaatat

SEQ ID NO: 309382 - DNA, 20 bp, Artificial
  CRISPR gRNA sequence
taaaactactaataaaagca

SEQ ID NO: 309383 - DNA, 20 bp, Artificial
  CRISPR gRNA sequence
gaatctcctgagggtaagtg

SEQ ID NO: 309384 - DNA, 20 bp, Artificial
  CRISPR gRNA sequence
aagaggaagaagtggacaca

SEQ ID NO: 309385 - DNA, 20 bp, Artificial
  CRISPR gRNA sequence
actagggtaatgaacctgaa

SEQ ID NO: 309386 - DNA, 20 bp, Artificial
  CRISPR gRNA sequence
cattacatttccaggaataa

SEQ ID NO: 309387 - DNA, 20 bp, Artificial
  CRISPR gRNA sequence
actgtttaacagtcttcctc

SEQ ID NO: 309388 - DNA, 20 bp, Artificial
  CRISPR gRNA sequence
atggaatttttacaggacag

SEQ ID NO: 309389 - DNA, 20 bp, Artificial
  CRISPR gRNA sequence
aggaattcatatttaattta

SEQ ID NO: 309390 - DNA, 20 bp, Artificial
  CRISPR gRNA sequence
ttggaattaatagtttggga

SEQ ID NO: 309391 - DNA, 20 bp, Artificial
  CRISPR gRNA sequence
aaatggtgtaatgacagctt

SEQ ID NO: 309392 - DNA, 20 bp, Artificial
  CRISPR gRNA sequence
acggctggtatcagggtgat

SEQ ID NO: 309393 - DNA, 20 bp, Artificial
  CRISPR gRNA sequence
caaggatgagtaggtgcaga

SEQ ID NO: 309394 - DNA, 20 bp, Artificial
  CRISPR gRNA sequence
ggcaactgaaatattaaaat

SEQ ID NO: 309395 - DNA, 20 bp, Artificial
  CRISPR gRNA sequence
cctagttctccgagttgtat

SEQ ID NO: 309396 - DNA, 20 bp, Artificial
  CRISPR gRNA sequence
gtagcctgattcttgttttc

SEQ ID NO: 309397 - DNA, 20 bp, Artificial
  CRISPR gRNA sequence
atctaaaaaggacatggaac

SEQ ID NO: 309398 - DNA, 20 bp, Artificial
  CRISPR gRNA sequence
tgaaaggtggattgccagca

SEQ ID NO: 309399 - DNA, 20 bp, Artificial
  CRISPR gRNA sequence
tcaaccttgatttttctgct

SEQ ID NO: 309400 - DNA, 20 bp, Artificial
  CRISPR gRNA sequence
aagaggcatatgaaattcaa

SEQ ID NO: 309401 - DNA, 20 bp, Artificial
  CRISPR gRNA sequence
aatgtgatttccccactagg

SEQ ID NO: 309402 - DNA, 20 bp, Artificial
  CRISPR gRNA sequence
gcttgggctcttttttgacc

SEQ ID NO: 309403 - DNA, 20 bp, Artificial
  CRISPR gRNA sequence
gggatggggcacttggatgg

SEQ ID NO: 309404 - DNA, 20 bp, Artificial
  CRISPR gRNA sequence
ggaacacagaagcaaggtgg

SEQ ID NO: 309405 - DNA, 20 bp, Artificial
  CRISPR gRNA sequence
tcctaaggctccttgtagag

SEQ ID NO: 309406 - DNA, 20 bp, Artificial
  CRISPR gRNA sequence
actgacggtagaactcaaat

SEQ ID NO: 309407 - DNA, 20 bp, Artificial
  CRISPR gRNA sequence
tacagaaaggggaactgact

SEQ ID NO: 309408 - DNA, 20 bp, Artificial
  CRISPR gRNA sequence
caggtgggcatttccactga

SEQ ID NO: 309409 - DNA, 20 bp, Artificial
  CRISPR gRNA sequence
gggattgcagagagcatgct

SEQ ID NO: 309410 - DNA, 20 bp, Artificial
  CRISPR gRNA sequence
gaggctagggcaggtaggga

SEQ ID NO: 309411 - DNA, 20 bp, Artificial
  CRISPR gRNA sequence
ggattgaagcttcaaagaga

SEQ ID NO: 309412 - DNA, 20 bp, Artificial
  CRISPR gRNA sequence
aacctaatgcctaatggctt

SEQ ID NO: 309413 - DNA, 20 bp, Artificial
  CRISPR gRNA sequence
atggcttaaaaacaaacaaa

SEQ ID NO: 309414 - DNA, 20 bp, Artificial
  CRISPR gRNA sequence
gaccatgatgctgtttctga

SEQ ID NO: 309415 - DNA, 20 bp, Artificial
  CRISPR gRNA sequence
agaaagaacaactcacgaaa

SEQ ID NO: 309416 - DNA, 20 bp, Artificial
  CRISPR gRNA sequence
atggctggtgggagcttgag

SEQ ID NO: 309417 - DNA, 20 bp, Artificial
  CRISPR gRNA sequence
ctccatttccatgtgtcctt

SEQ ID NO: 309418 - DNA, 20 bp, Artificial
  CRISPR gRNA sequence
aatgagtggacttaattact

SEQ ID NO: 309419 - DNA, 20 bp, Artificial
  CRISPR gRNA sequence
ctcttacacagttgttattt

SEQ ID NO: 309420 - DNA, 20 bp, Artificial
  CRISPR gRNA sequence
attgagatgtgctataacta

SEQ ID NO: 309421 - DNA, 20 bp, Artificial
  CRISPR gRNA sequence
actggctcctgtggcagagc

SEQ ID NO: 309422 - DNA, 20 bp, Artificial
  CRISPR gRNA sequence
ctctggatagcttcagagga

SEQ ID NO: 309423 - DNA, 20 bp, Artificial
  CRISPR gRNA sequence
ccacaactaataaagatttc

SEQ ID NO: 309424 - DNA, 20 bp, Artificial
  CRISPR gRNA sequence
ttgctaaagatcacaaatta

SEQ ID NO: 309425 - DNA, 20 bp, Artificial
  CRISPR gRNA sequence
ttctaaataacaaagatttc

SEQ ID NO: 309426 - DNA, 20 bp, Artificial
  CRISPR gRNA sequence
ttgctaaagatcacaaatta

SEQ ID NO: 309427 - DNA, 20 bp, Artificial
  CRISPR gRNA sequence
ccaaggtagtcatatgtgtg

SEQ ID NO: 309428 - DNA, 20 bp, Artificial
  CRISPR gRNA sequence
tttgtgcttaaaaataaaaa

SEQ ID NO: 309429 - DNA, 20 bp, Artificial
  CRISPR gRNA sequence
cccctgttacctctgtggaa

SEQ ID NO: 309430 - DNA, 20 bp, Artificial
  CRISPR gRNA sequence
aggtatagtctagaaggaaa

SEQ ID NO: 309431 - DNA, 20 bp, Artificial
  CRISPR gRNA sequence
ttcaagtttgagaaccacag

SEQ ID NO: 309432 - DNA, 20 bp, Artificial
  CRISPR gRNA sequence
tttaacagcatccagcctca

SEQ ID NO: 309433 - DNA, 20 bp, Artificial
  CRISPR gRNA sequence
catcatagggtgtccttaca

SEQ ID NO: 309434 - DNA, 20 bp, Artificial
  CRISPR gRNA sequence
gccctggaaacacatttcca

SEQ ID NO: 309435 - DNA, 20 bp, Artificial
  CRISPR gRNA sequence
gtaaagccgagacactctat

SEQ ID NO: 309436 - DNA, 20 bp, Artificial
  CRISPR gRNA sequence
ctgttgttgatagccctcat

SEQ ID NO: 309437 - DNA, 20 bp, Artificial
  CRISPR gRNA sequence
tgttgagatttatggaagca

SEQ ID NO: 309438 - DNA, 20 bp, Artificial
  CRISPR gRNA sequence
ataatgttaaaaataaataa

SEQ ID NO: 309439 - DNA, 20 bp, Artificial
  CRISPR gRNA sequence
ttaaaaataaataaaaaaac

SEQ ID NO: 309440 - DNA, 20 bp, Artificial
  CRISPR gRNA sequence
agaggagccaattatagcag

SEQ ID NO: 309441 - DNA, 20 bp, Artificial
  CRISPR gRNA sequence
ctaggtactgagtcagagtg

SEQ ID NO: 309442 - DNA, 20 bp, Artificial
  CRISPR gRNA sequence
aatccgtggggctagaggag

SEQ ID NO: 309443 - DNA, 20 bp, Artificial
  CRISPR gRNA sequence
tatcactaagagttcttgtg

SEQ ID NO: 309444 - DNA, 20 bp, Artificial
  CRISPR gRNA sequence
gtagaaggagtaagcaagag

SEQ ID NO: 309445 - DNA, 20 bp, Artificial
  CRISPR gRNA sequence
aaagtccccacaaagtgtga

SEQ ID NO: 309446 - DNA, 20 bp, Artificial
  CRISPR gRNA sequence
gaggctttcaaagggccaag

SEQ ID NO: 309447 - DNA, 20 bp, Artificial
  CRISPR gRNA sequence
tattacatgacaatttagac

SEQ ID NO: 309448 - DNA, 20 bp, Artificial
  CRISPR gRNA sequence
gtcattgaccaccacaatcc

SEQ ID NO: 309449 - DNA, 20 bp, Artificial
  CRISPR gRNA sequence
cctgtaacagctacagtgat

SEQ ID NO: 309450 - DNA, 20 bp, Artificial
  CRISPR gRNA sequence
catgccaatttgcaaactct

SEQ ID NO: 309451 - DNA, 20 bp, Artificial
  CRISPR gRNA sequence
tagtattttggcaggaccag

SEQ ID NO: 309452 - DNA, 20 bp, Artificial
  CRISPR gRNA sequence
tgagactgcaaatgagttag

SEQ ID NO: 309453 - DNA, 20 bp, Artificial
  CRISPR gRNA sequence
tatggctaattacctatagt

SEQ ID NO: 309454 - DNA, 20 bp, Artificial
  CRISPR gRNA sequence
gcctggtagacagaagggaa

SEQ ID NO: 309455 - DNA, 20 bp, Artificial
  CRISPR gRNA sequence
aatgccactacagatttttt

SEQ ID NO: 309456 - DNA, 20 bp, Artificial
  CRISPR gRNA sequence
aggcagatcaacacctattc

SEQ ID NO: 309457 - DNA, 20 bp, Artificial
  CRISPR gRNA sequence
cctattctaaaaccatagag

SEQ ID NO: 309458 - DNA, 20 bp, Artificial
  CRISPR gRNA sequence
tttgttttaatgtatattag

SEQ ID NO: 309459 - DNA, 20 bp, Artificial
  CRISPR gRNA sequence
caaatagtacactgatatag

SEQ ID NO: 309460 - DNA, 20 bp, Artificial
  CRISPR gRNA sequence
acattattggtcacaggagt

SEQ ID NO: 309461 - DNA, 20 bp, Artificial
  CRISPR gRNA sequence
ccctgtaatgtgcacacatg

SEQ ID NO: 309462 - DNA, 20 bp, Artificial
  CRISPR gRNA sequence
cattctggatgacaggttcc

SEQ ID NO: 309463 - DNA, 20 bp, Artificial
  CRISPR gRNA sequence
ctgctgtgacctcagtagga

SEQ ID NO: 309464 - DNA, 20 bp, Artificial
  CRISPR gRNA sequence
aactaaacaaacaagcaaat

SEQ ID NO: 309465 - DNA, 20 bp, Artificial
  CRISPR gRNA sequence
atgtacttctggtttccagg

SEQ ID NO: 309466 - DNA, 20 bp, Artificial
  CRISPR gRNA sequence
atcagcttacccattgggag

SEQ ID NO: 309467 - DNA, 20 bp, Artificial
  CRISPR gRNA sequence
tttagctcccacttatcagt

SEQ ID NO: 309468 - DNA, 20 bp, Artificial
  CRISPR gRNA sequence
agatcggatgacagacagca

SEQ ID NO: 309469 - DNA, 20 bp, Artificial
  CRISPR gRNA sequence
gaaaagacattgcaagaaaa

SEQ ID NO: 309470 - DNA, 20 bp, Artificial
  CRISPR gRNA sequence
cataaataaactaaaaagaa

SEQ ID NO: 309471 - DNA, 20 bp, Artificial
  CRISPR gRNA sequence
atcatgtcaatggatacagg

SEQ ID NO: 309472 - DNA, 20 bp, Artificial
  CRISPR gRNA sequence
catacagattggaaaggaag

SEQ ID NO: 309473 - DNA, 20 bp, Artificial
  CRISPR gRNA sequence
aaaatcctgaggaatctatc

SEQ ID NO: 309474 - DNA, 20 bp, Artificial
  CRISPR gRNA sequence
ggaatctatcaaaaacctat

SEQ ID NO: 309475 - DNA, 20 bp, Artificial
  CRISPR gRNA sequence
taatagcatcaaataatatt

SEQ ID NO: 309476 - DNA, 20 bp, Artificial
  CRISPR gRNA sequence
aaacttggaaataaatttaa

SEQ ID NO: 309477 - DNA, 20 bp, Artificial
  CRISPR gRNA sequence
aagtacaaggtctatatact

SEQ ID NO: 309478 - DNA, 20 bp, Artificial
  CRISPR gRNA sequence
tgcaaagaatctacaattgc

SEQ ID NO: 309479 - DNA, 20 bp, Artificial
  CRISPR gRNA sequence
aaatgaaaggacttccaaaa

SEQ ID NO: 309480 - DNA, 20 bp, Artificial
  CRISPR gRNA sequence
ttagataggacacagaaagc

SEQ ID NO: 309481 - DNA, 20 bp, Artificial
  CRISPR gRNA sequence
aaatggatgtcatcaatatg

SEQ ID NO: 309482 - DNA, 20 bp, Artificial
  CRISPR gRNA sequence
ttgttctttgactttgttta

SEQ ID NO: 309483 - DNA, 20 bp, Artificial
  CRISPR gRNA sequence
agtcaaaccacagacaggga

SEQ ID NO: 309484 - DNA, 20 bp, Artificial
  CRISPR gRNA sequence
gtcatcagggaagtacaaat

SEQ ID NO: 309485 - DNA, 20 bp, Artificial
  CRISPR gRNA sequence
atatgaaatttgagaaaaag

SEQ ID NO: 309486 - DNA, 20 bp, Artificial
  CRISPR gRNA sequence
atttagtaaagacagaatca

SEQ ID NO: 309487 - DNA, 20 bp, Artificial
  CRISPR gRNA sequence
tccaatcacaaaatgattgc

SEQ ID NO: 309488 - DNA, 20 bp, Artificial
  CRISPR gRNA sequence
aatggagagggagaggaaaa

SEQ ID NO: 309489 - DNA, 20 bp, Artificial
  CRISPR gRNA sequence
gcctcaagcagcactttctt

SEQ ID NO: 309490 - DNA, 20 bp, Artificial
  CRISPR gRNA sequence
agccactgtgattctagcaa

SEQ ID NO: 309491 - DNA, 20 bp, Artificial
  CRISPR gRNA sequence
aatagacctctcaatttctg

SEQ ID NO: 309492 - DNA, 20 bp, Artificial
  CRISPR gRNA sequence
cctctgtcagggtcagtaag

SEQ ID NO: 309493 - DNA, 20 bp, Artificial
  CRISPR gRNA sequence
atactgggagaaatgacttt

SEQ ID NO: 309494 - DNA, 20 bp, Artificial
  CRISPR gRNA sequence
gaatgtaacaagcatttatt

SEQ ID NO: 309495 - DNA, 20 bp, Artificial
  CRISPR gRNA sequence
ttattaaaaactgtgctgca

SEQ ID NO: 309496 - DNA, 20 bp, Artificial
  CRISPR gRNA sequence
aatcaaggcaggggcagggt

SEQ ID NO: 309497 - DNA, 20 bp, Artificial
  CRISPR gRNA sequence
ttcctctggttgccttgagc

SEQ ID NO: 309498 - DNA, 20 bp, Artificial
  CRISPR gRNA sequence
cccaataacttgggtatcac

SEQ ID NO: 309499 - DNA, 20 bp, Artificial
  CRISPR gRNA sequence
ttgagaggtctatttaaaaa

SEQ ID NO: 309500 - DNA, 20 bp, Artificial
  CRISPR gRNA sequence
atgggctttactctttaatt

SEQ ID NO: 309501 - DNA, 20 bp, Artificial
  CRISPR gRNA sequence
gaagatgtcttcgaactttt

SEQ ID NO: 309502 - DNA, 20 bp, Artificial
  CRISPR gRNA sequence
atgtgtgtatgtgtgtattt

SEQ ID NO: 309503 - DNA, 20 bp, Artificial
  CRISPR gRNA sequence
aagaactcatccatgtaacc

SEQ ID NO: 309504 - DNA, 20 bp, Artificial
  CRISPR gRNA sequence
ccgaaaaccatctgttcccc

SEQ ID NO: 309505 - DNA, 20 bp, Artificial
  CRISPR gRNA sequence
ataaaataaaaataaaagat

SEQ ID NO: 309506 - DNA, 20 bp, Artificial
  CRISPR gRNA sequence
gaggtataattaataaataa

SEQ ID NO: 309507 - DNA, 20 bp, Artificial
  CRISPR gRNA sequence
tgagagcttttctttccatt

SEQ ID NO: 309508 - DNA, 20 bp, Artificial
  CRISPR gRNA sequence
ctgtctgtcatccgatctct

SEQ ID NO: 309509 - DNA, 20 bp, Artificial
  CRISPR gRNA sequence
actatcagggaaatgcaaat

SEQ ID NO: 309510 - DNA, 20 bp, Artificial
  CRISPR gRNA sequence
aaactagtacaaacactatg

SEQ ID NO: 309511 - DNA, 20 bp, Artificial
  CRISPR gRNA sequence
aataacttatccatgtaacc

SEQ ID NO: 309512 - DNA, 20 bp, Artificial
  CRISPR gRNA sequence
gtttagttcagtagttccca

SEQ ID NO: 309513 - DNA, 20 bp, Artificial
  CRISPR gRNA sequence
tttctgtttaaatgttggtt

SEQ ID NO: 309514 - DNA, 20 bp, Artificial
  CRISPR gRNA sequence
accatcctggccaacatggt

SEQ ID NO: 309515 - DNA, 20 bp, Artificial
  CRISPR gRNA sequence
gttctagggaggcaagctgt

SEQ ID NO: 309516 - DNA, 20 bp, Artificial
  CRISPR gRNA sequence
gccttatctgccctatttga

SEQ ID NO: 309517 - DNA, 20 bp, Artificial
  CRISPR gRNA sequence
tatatacagttgaggcatag

SEQ ID NO: 309518 - DNA, 20 bp, Artificial
  CRISPR gRNA sequence
gcatagaaaaactataatga

SEQ ID NO: 309519 - DNA, 20 bp, Artificial
  CRISPR gRNA sequence
ggttgaaagaaagtgaagct

SEQ ID NO: 309520 - DNA, 20 bp, Artificial
  CRISPR gRNA sequence
attttaaaatcagtatactg

SEQ ID NO: 309521 - DNA, 20 bp, Artificial
  CRISPR gRNA sequence
ggggagggtgtttataataa

SEQ ID NO: 309522 - DNA, 20 bp, Artificial
  CRISPR gRNA sequence
ttatgataatcctaattatg

SEQ ID NO: 309523 - DNA, 20 bp, Artificial
  CRISPR gRNA sequence
actgccagtctgtataggct

SEQ ID NO: 309524 - DNA, 20 bp, Artificial
  CRISPR gRNA sequence
ataggctcaaaactccaagg

SEQ ID NO: 309525 - DNA, 20 bp, Artificial
  CRISPR gRNA sequence
catttccatagaattagaca

SEQ ID NO: 309526 - DNA, 20 bp, Artificial
  CRISPR gRNA sequence
tcagcatatctcatctactg

SEQ ID NO: 309527 - DNA, 20 bp, Artificial
  CRISPR gRNA sequence
cctaagtttctggggagttg

SEQ ID NO: 309528 - DNA, 20 bp, Artificial
  CRISPR gRNA sequence
tggaaaacaggctttgtggg

SEQ ID NO: 309529 - DNA, 20 bp, Artificial
  CRISPR gRNA sequence
ggaatcctgtatttttaaat

SEQ ID NO: 309530 - DNA, 20 bp, Artificial
  CRISPR gRNA sequence
tgctgaaagaaatagtcttg

SEQ ID NO: 309531 - DNA, 20 bp, Artificial
  CRISPR gRNA sequence
gttgaattcttggttcttag

SEQ ID NO: 309532 - DNA, 20 bp, Artificial
  CRISPR gRNA sequence
agagtttttctaatatacat

SEQ ID NO: 309533 - DNA, 20 bp, Artificial
  CRISPR gRNA sequence
atgcttatctgtgtcccacc

SEQ ID NO: 309534 - DNA, 20 bp, Artificial
  CRISPR gRNA sequence
atggtacctgaccacatttt

SEQ ID NO: 309535 - DNA, 20 bp, Artificial
  CRISPR gRNA sequence
ctgagaacttatgttcacac

SEQ ID NO: 309536 - DNA, 20 bp, Artificial
  CRISPR gRNA sequence
atgtgacactgtcaaaaaga

SEQ ID NO: 309537 - DNA, 20 bp, Artificial
  CRISPR gRNA sequence
caatcagtagaacagtatat

SEQ ID NO: 309538 - DNA, 20 bp, Artificial
  CRISPR gRNA sequence
aacctagaggaggctgaagg

SEQ ID NO: 309539 - DNA, 20 bp, Artificial
  CRISPR gRNA sequence
cagggtccaactgtccgaat

SEQ ID NO: 309540 - DNA, 20 bp, Artificial
  CRISPR gRNA sequence
agaaacaagaggaaagggga

SEQ ID NO: 309541 - DNA, 20 bp, Artificial
  CRISPR gRNA sequence
atttaaattgcaagacaggg

SEQ ID NO: 309542 - DNA, 20 bp, Artificial
  CRISPR gRNA sequence
ctactgttggaatgccactc

SEQ ID NO: 309543 - DNA, 20 bp, Artificial
  CRISPR gRNA sequence
ttcctccacccccaggtcca

SEQ ID NO: 309544 - DNA, 20 bp, Artificial
  CRISPR gRNA sequence
tcaaaaagtacaagaaatta

SEQ ID NO: 309545 - DNA, 20 bp, Artificial
  CRISPR gRNA sequence
gcgagaccccgtctctaaag

SEQ ID NO: 309546 - DNA, 20 bp, Artificial
  CRISPR gRNA sequence
accccgtctctaaagcaaaa

SEQ ID NO: 309547 - DNA, 20 bp, Artificial
  CRISPR gRNA sequence
caaaacaaaacaacaacaaa

SEQ ID NO: 309548 - DNA, 20 bp, Artificial
  CRISPR gRNA sequence
acatattttggaaatggtat

SEQ ID NO: 309549 - DNA, 20 bp, Artificial
  CRISPR gRNA sequence
gataacatatatctattttg

SEQ ID NO: 309550 - DNA, 20 bp, Artificial
  CRISPR gRNA sequence
atctgcaaaaatcttgggag

SEQ ID NO: 309551 - DNA, 20 bp, Artificial
  CRISPR gRNA sequence
gacaaaaagagagcagctac

SEQ ID NO: 309552 - DNA, 20 bp, Artificial
  CRISPR gRNA sequence
gtgggagctactgatttttc

SEQ ID NO: 309553 - DNA, 20 bp, Artificial
  CRISPR gRNA sequence
cacttattctctcaccacca

SEQ ID NO: 309554 - DNA, 20 bp, Artificial
  CRISPR gRNA sequence
aagctcaaggtgctaagcag

SEQ ID NO: 309555 - DNA, 20 bp, Artificial
  CRISPR gRNA sequence
aatgctcagtagaaagtgag

SEQ ID NO: 309556 - DNA, 20 bp, Artificial
  CRISPR gRNA sequence
agagtcgagaaaaaaaaagg

SEQ ID NO: 309557 - DNA, 20 bp, Artificial
  CRISPR gRNA sequence
cttgattagaaaaggaaact

SEQ ID NO: 309558 - DNA, 20 bp, Artificial
  CRISPR gRNA sequence
aactgaaaaccgatgttcac

SEQ ID NO: 309559 - DNA, 20 bp, Artificial
  CRISPR gRNA sequence
ttaacagccaatgtaaaaag

SEQ ID NO: 309560 - DNA, 20 bp, Artificial
  CRISPR gRNA sequence
aaattcataggtctgttgat

SEQ ID NO: 309561 - DNA, 20 bp, Artificial
  CRISPR gRNA sequence
ctacttaaagttactttaga

SEQ ID NO: 309562 - DNA, 20 bp, Artificial
  CRISPR gRNA sequence
tactttagacaaaactaaac

SEQ ID NO: 309563 - DNA, 20 bp, Artificial
  CRISPR gRNA sequence
tccaatcttttgttgcaatg

SEQ ID NO: 309564 - DNA, 20 bp, Artificial
  CRISPR gRNA sequence
ttcagaactctttcatcttg

SEQ ID NO: 309565 - DNA, 20 bp, Artificial
  CRISPR gRNA sequence
cgctcatggtttgcaaacca

SEQ ID NO: 309566 - DNA, 20 bp, Artificial
  CRISPR gRNA sequence
ggagaccacacaccatccta

SEQ ID NO: 309567 - DNA, 20 bp, Artificial
  CRISPR gRNA sequence
ggtgctaggaatataatgag

SEQ ID NO: 309568 - DNA, 20 bp, Artificial
  CRISPR gRNA sequence
agtaatcatacagagaaatg

SEQ ID NO: 309569 - DNA, 20 bp, Artificial
  CRISPR gRNA sequence
actgcatggcctgcaaagct

SEQ ID NO: 309570 - DNA, 20 bp, Artificial
  CRISPR gRNA sequence
tctatgtggcctttcataga

SEQ ID NO: 309571 - DNA, 20 bp, Artificial
  CRISPR gRNA sequence
agcactgtccagtaagaata

SEQ ID NO: 309572 - DNA, 20 bp, Artificial
  CRISPR gRNA sequence
acaagccacagatataattt

SEQ ID NO: 309573 - DNA, 20 bp, Artificial
  CRISPR gRNA sequence
tttcacttttatgtatttag

SEQ ID NO: 309574 - DNA, 20 bp, Artificial
  CRISPR gRNA sequence
gatttcagttccagatgatg

SEQ ID NO: 309575 - DNA, 20 bp, Artificial
  CRISPR gRNA sequence
gtgatttccccactaggcta

SEQ ID NO: 309576 - DNA, 20 bp, Artificial
  CRISPR gRNA sequence
agtaggaagttccctttgtc

SEQ ID NO: 309577 - DNA, 20 bp, Artificial
  CRISPR gRNA sequence
attttgtctcttagctcacg

SEQ ID NO: 309578 - DNA, 20 bp, Artificial
  CRISPR gRNA sequence
tcatcagtggaaatgcccac

SEQ ID NO: 309579 - DNA, 20 bp, Artificial
  CRISPR gRNA sequence
atcagtggaaatgcccacct

SEQ ID NO: 309580 - DNA, 20 bp, Artificial
  CRISPR gRNA sequence
ccggcagaagttatttggaa

SEQ ID NO: 309581 - DNA, 20 bp, Artificial
  CRISPR gRNA sequence
tttggaaccaagcaagagca

SEQ ID NO: 309582 - DNA, 20 bp, Artificial
  CRISPR gRNA sequence
ggaaccaagcaagagcactg

SEQ ID NO: 309583 - DNA, 20 bp, Artificial
  CRISPR gRNA sequence
gaaccaagcaagagcactgt

SEQ ID NO: 309584 - DNA, 20 bp, Artificial
  CRISPR gRNA sequence
tccctggctgtggtgttgtt

SEQ ID NO: 309585 - DNA, 20 bp, Artificial
  CRISPR gRNA sequence
gctgtggtgttgtttctcta

SEQ ID NO: 309586 - DNA, 20 bp, Artificial
  CRISPR gRNA sequence
tggtgttgtttctctagtca

SEQ ID NO: 309587 - DNA, 20 bp, Artificial
  CRISPR gRNA sequence
tttctctagtcagttcccct

SEQ ID NO: 309588 - DNA, 20 bp, Artificial
  CRISPR gRNA sequence
ctctagtcagttcccctttc

SEQ ID NO: 309589 - DNA, 20 bp, Artificial
  CRISPR gRNA sequence
tctagtcagttcccctttct

SEQ ID NO: 309590 - DNA, 20 bp, Artificial
  CRISPR gRNA sequence
tagtcagttcccctttctgt

SEQ ID NO: 309591 - DNA, 20 bp, Artificial
  CRISPR gRNA sequence
gtcagttcccctttctgtat

SEQ ID NO: 309592 - DNA, 20 bp, Artificial
  CRISPR gRNA sequence
ccctttctgtatttgagttc

SEQ ID NO: 309593 - DNA, 20 bp, Artificial
  CRISPR gRNA sequence
tctgtatttgagttctaccg

SEQ ID NO: 309594 - DNA, 20 bp, Artificial
  CRISPR gRNA sequence
ctgtatttgagttctaccgt

SEQ ID NO: 309595 - DNA, 20 bp, Artificial
  CRISPR gRNA sequence
tgtatttgagttctaccgtc

SEQ ID NO: 309596 - DNA, 20 bp, Artificial
  CRISPR gRNA sequence
tatttgagttctaccgtcag

SEQ ID NO: 309597 - DNA, 20 bp, Artificial
  CRISPR gRNA sequence
gagttctaccgtcagtcctg

SEQ ID NO: 309598 - DNA, 20 bp, Artificial
  CRISPR gRNA sequence
agttctaccgtcagtcctgg

SEQ ID NO: 309599 - DNA, 20 bp, Artificial
  CRISPR gRNA sequence
taccgtcagtcctggcatta

SEQ ID NO: 309600 - DNA, 20 bp, Artificial
  CRISPR gRNA sequence
ccgtcagtcctggcattatt

SEQ ID NO: 309601 - DNA, 20 bp, Artificial
  CRISPR gRNA sequence
gcattatttctctctctaca

SEQ ID NO: 309602 - DNA, 20 bp, Artificial
  CRISPR gRNA sequence
tttctctctctacaaggagc

SEQ ID NO: 309603 - DNA, 20 bp, Artificial
  CRISPR gRNA sequence
ctctctctacaaggagcctt

SEQ ID NO: 309604 - DNA, 20 bp, Artificial
  CRISPR gRNA sequence
tctctctacaaggagcctta

SEQ ID NO: 309605 - DNA, 20 bp, Artificial
  CRISPR gRNA sequence
tctctacaaggagccttagg

SEQ ID NO: 309606 - DNA, 20 bp, Artificial
  CRISPR gRNA sequence
tctacaaggagccttaggag

SEQ ID NO: 309607 - DNA, 20 bp, Artificial
  CRISPR gRNA sequence
tacaaggagccttaggaggt

SEQ ID NO: 309608 - DNA, 20 bp, Artificial
  CRISPR gRNA sequence
caaggagccttaggaggtac

SEQ ID NO: 309609 - DNA, 20 bp, Artificial
  CRISPR gRNA sequence
aggaggtacggggagctcgc

SEQ ID NO: 309610 - DNA, 20 bp, Artificial
  CRISPR gRNA sequence
ggaggtacggggagctcgca

SEQ ID NO: 309611 - DNA, 20 bp, Artificial
  CRISPR gRNA sequence
gcaaatactccttttggttt

SEQ ID NO: 309612 - DNA, 20 bp, Artificial
  CRISPR gRNA sequence
cttttggtttattcttacca

SEQ ID NO: 309613 - DNA, 20 bp, Artificial
  CRISPR gRNA sequence
ttggtttattcttaccacct

SEQ ID NO: 309614 - DNA, 20 bp, Artificial
  CRISPR gRNA sequence
tggtttattcttaccacctt

SEQ ID NO: 309615 - DNA, 20 bp, Artificial
  CRISPR gRNA sequence
ggtttattcttaccaccttg

SEQ ID NO: 309616 - DNA, 20 bp, Artificial
  CRISPR gRNA sequence
gtttattcttaccaccttgc

SEQ ID NO: 309617 - DNA, 20 bp, Artificial
  CRISPR gRNA sequence
attcttaccaccttgcttct

SEQ ID NO: 309618 - DNA, 20 bp, Artificial
  CRISPR gRNA sequence
ttcttaccaccttgcttctg

SEQ ID NO: 309619 - DNA, 20 bp, Artificial
  CRISPR gRNA sequence
ttaccaccttgcttctgtgt

SEQ ID NO: 309620 - DNA, 20 bp, Artificial
  CRISPR gRNA sequence
accaccttgcttctgtgttc

SEQ ID NO: 309621 - DNA, 20 bp, Artificial
  CRISPR gRNA sequence
ccaccttgcttctgtgttcc

SEQ ID NO: 309622 - DNA, 20 bp, Artificial
  CRISPR gRNA sequence
gcttctgtgttccttgggaa

SEQ ID NO: 309623 - DNA, 20 bp, Artificial
  CRISPR gRNA sequence
cttctgtgttccttgggaat

SEQ ID NO: 309624 - DNA, 20 bp, Artificial
  CRISPR gRNA sequence
ctgtgttccttgggaatgct

SEQ ID NO: 309625 - DNA, 20 bp, Artificial
  CRISPR gRNA sequence
tgtgttccttgggaatgctg

SEQ ID NO: 309626 - DNA, 20 bp, Artificial
  CRISPR gRNA sequence
tgttccttgggaatgctgct

SEQ ID NO: 309627 - DNA, 20 bp, Artificial
  CRISPR gRNA sequence
cttgggaatgctgctgtgct

SEQ ID NO: 309628 - DNA, 20 bp, Artificial
  CRISPR gRNA sequence
gggaatgctgctgtgcttat

SEQ ID NO: 309629 - DNA, 20 bp, Artificial
  CRISPR gRNA sequence
ggaatgctgctgtgcttatg

SEQ ID NO: 309630 - DNA, 20 bp, Artificial
  CRISPR gRNA sequence
ctgtgcttatgcatctggtc

SEQ ID NO: 309631 - DNA, 20 bp, Artificial
  CRISPR gRNA sequence
tgcttatgcatctggtctct

SEQ ID NO: 309632 - DNA, 20 bp, Artificial
  CRISPR gRNA sequence
atgcatctggtctctttttg

SEQ ID NO: 309633 - DNA, 20 bp, Artificial
  CRISPR gRNA sequence
tgcatctggtctctttttgg

SEQ ID NO: 309634 - DNA, 20 bp, Artificial
  CRISPR gRNA sequence
gtctctttttggagctacag

SEQ ID NO: 309635 - DNA, 20 bp, Artificial
  CRISPR gRNA sequence
tttttggagctacagtggac

SEQ ID NO: 309636 - DNA, 20 bp, Artificial
  CRISPR gRNA sequence
tttggagctacagtggacag

SEQ ID NO: 309637 - DNA, 20 bp, Artificial
  CRISPR gRNA sequence
ttggagctacagtggacagg

SEQ ID NO: 309638 - DNA, 20 bp, Artificial
  CRISPR gRNA sequence
tggagctacagtggacaggc

SEQ ID NO: 309639 - DNA, 20 bp, Artificial
  CRISPR gRNA sequence
ggagctacagtggacaggca

SEQ ID NO: 309640 - DNA, 20 bp, Artificial
  CRISPR gRNA sequence
gagctacagtggacaggcat

SEQ ID NO: 309641 - DNA, 20 bp, Artificial
  CRISPR gRNA sequence
cagtggacaggcatttgtga

SEQ ID NO: 309642 - DNA, 20 bp, Artificial
  CRISPR gRNA sequence
gtgacaggtatgtttgtgga

SEQ ID NO: 309643 - DNA, 20 bp, Artificial
  CRISPR gRNA sequence
tgacaggtatgtttgtggag

SEQ ID NO: 309644 - DNA, 20 bp, Artificial
  CRISPR gRNA sequence
gtggaggctcagacgcctag

SEQ ID NO: 309645 - DNA, 20 bp, Artificial
  CRISPR gRNA sequence
tggaggctcagacgcctagg

SEQ ID NO: 309646 - DNA, 20 bp, Artificial
  CRISPR gRNA sequence
agacgcctagggagtggcat

SEQ ID NO: 309647 - DNA, 20 bp, Artificial
  CRISPR gRNA sequence
gggagtggcatgagataaag

SEQ ID NO: 309648 - DNA, 20 bp, Artificial
  CRISPR gRNA sequence
caagctgcatctggggcaga

SEQ ID NO: 309649 - DNA, 20 bp, Artificial
  CRISPR gRNA sequence
catctggggcagaaatgctg

SEQ ID NO: 309650 - DNA, 20 bp, Artificial
  CRISPR gRNA sequence
gggcagaaatgctgatgtgc

SEQ ID NO: 309651 - DNA, 20 bp, Artificial
  CRISPR gRNA sequence
atgtgctaatggccggccag

SEQ ID NO: 309652 - DNA, 20 bp, Artificial
  CRISPR gRNA sequence
atggccggccagagaatgag

SEQ ID NO: 309653 - DNA, 20 bp, Artificial
  CRISPR gRNA sequence
cagagagcatgcttaaaacc

SEQ ID NO: 309654 - DNA, 20 bp, Artificial
  CRISPR gRNA sequence
aaaacctctgaccatcaggt

SEQ ID NO: 309655 - DNA, 20 bp, Artificial
  CRISPR gRNA sequence
aaacctctgaccatcaggtt

SEQ ID NO: 309656 - DNA, 20 bp, Artificial
  CRISPR gRNA sequence
tgaccatcaggtttgcttct

SEQ ID NO: 309657 - DNA, 20 bp, Artificial
  CRISPR gRNA sequence
accatcaggtttgcttctca

SEQ ID NO: 309658 - DNA, 20 bp, Artificial
  CRISPR gRNA sequence
gcttctcagattgactacat

SEQ ID NO: 309659 - DNA, 20 bp, Artificial
  CRISPR gRNA sequence
cttctcagattgactacatt

SEQ ID NO: 309660 - DNA, 20 bp, Artificial
  CRISPR gRNA sequence
ctcagattgactacattgga

SEQ ID NO: 309661 - DNA, 20 bp, Artificial
  CRISPR gRNA sequence
tcagattgactacattggag

SEQ ID NO: 309662 - DNA, 20 bp, Artificial
  CRISPR gRNA sequence
agattgactacattggaggt

SEQ ID NO: 309663 - DNA, 20 bp, Artificial
  CRISPR gRNA sequence
actacattggaggtgggata

SEQ ID NO: 309664 - DNA, 20 bp, Artificial
  CRISPR gRNA sequence
cattggaggtgggatattac

SEQ ID NO: 309665 - DNA, 20 bp, Artificial
  CRISPR gRNA sequence
gaggtgggatattacaaaaa

SEQ ID NO: 309666 - DNA, 20 bp, Artificial
  CRISPR gRNA sequence
caaaaatctgtctcttcctg

SEQ ID NO: 309667 - DNA, 20 bp, Artificial
  CRISPR gRNA sequence
tctcttcctgccagatccct

SEQ ID NO: 309668 - DNA, 20 bp, Artificial
  CRISPR gRNA sequence
ttcctgccagatcccttcat

SEQ ID NO: 309669 - DNA, 20 bp, Artificial
  CRISPR gRNA sequence
cctgccagatcccttcatct

SEQ ID NO: 309670 - DNA, 20 bp, Artificial
  CRISPR gRNA sequence
ctgccagatcccttcatctg

SEQ ID NO: 309671 - DNA, 20 bp, Artificial
  CRISPR gRNA sequence
ccagatcccttcatctgttt

SEQ ID NO: 309672 - DNA, 20 bp, Artificial
  CRISPR gRNA sequence
catctgtttttcgtgagcta

SEQ ID NO: 309673 - DNA, 20 bp, Artificial
  CRISPR gRNA sequence
atctgtttttcgtgagctaa

SEQ ID NO: 309674 - DNA, 20 bp, Artificial
  CRISPR gRNA sequence
tttttcgtgagctaagagac

SEQ ID NO: 309675 - DNA, 20 bp, Artificial
  CRISPR gRNA sequence
ttcgtgagctaagagacaaa

SEQ ID NO: 309676 - DNA, 20 bp, Artificial
  CRISPR gRNA sequence
tcgtgagctaagagacaaaa

SEQ ID NO: 309677 - DNA, 20 bp, Artificial
  CRISPR gRNA sequence
cgtgagctaagagacaaaat

SEQ ID NO: 309678 - DNA, 20 bp, Artificial
  CRISPR gRNA sequence
gtgagctaagagacaaaata

SEQ ID NO: 309679 - DNA, 20 bp, Artificial
  CRISPR gRNA sequence
agagacaaaataggcaggaa

SEQ ID NO: 309680 - DNA, 20 bp, Artificial
  CRISPR gRNA sequence
accaaataattggcagctgt

SEQ ID NO: 309681 - DNA, 20 bp, Artificial
  CRISPR gRNA sequence
ccaaataattggcagctgtt

SEQ ID NO: 309682 - DNA, 20 bp, Artificial
  CRISPR gRNA sequence
gcagctgttcttggctttgg

SEQ ID NO: 309683 - DNA, 20 bp, Artificial
  CRISPR gRNA sequence
ttcttggctttggggtgctg

SEQ ID NO: 309684 - DNA, 20 bp, Artificial
  CRISPR gRNA sequence
ttggctttggggtgctgggg

SEQ ID NO: 309685 - DNA, 20 bp, Artificial
  CRISPR gRNA sequence
ggctttggggtgctggggtc

SEQ ID NO: 309686 - DNA, 20 bp, Artificial
  CRISPR gRNA sequence
gctttggggtgctggggtct

SEQ ID NO: 309687 - DNA, 20 bp, Artificial
  CRISPR gRNA sequence
tggggtgctggggtctccga

SEQ ID NO: 309688 - DNA, 20 bp, Artificial
  CRISPR gRNA sequence
ggggtgctggggtctccgag

SEQ ID NO: 309689 - DNA, 20 bp, Artificial
  CRISPR gRNA sequence
gggtgctggggtctccgagc

SEQ ID NO: 309690 - DNA, 20 bp, Artificial
  CRISPR gRNA sequence
gggtctccgagcagcctctg

SEQ ID NO: 309691 - DNA, 20 bp, Artificial
  CRISPR gRNA sequence
cgagcagcctctgctctaga

SEQ ID NO: 309692 - DNA, 20 bp, Artificial
  CRISPR gRNA sequence
tgctctagaagaagcagtcc

SEQ ID NO: 309693 - DNA, 20 bp, Artificial
  CRISPR gRNA sequence
ctctagaagaagcagtccaa

SEQ ID NO: 309694 - DNA, 20 bp, Artificial
  CRISPR gRNA sequence
tagaagaagcagtccaaaga

SEQ ID NO: 309695 - DNA, 20 bp, Artificial
  CRISPR gRNA sequence
gaagaagcagtccaaagatg

SEQ ID NO: 309696 - DNA, 20 bp, Artificial
  CRISPR gRNA sequence
gcctcgcctgagtcccctgt

SEQ ID NO: 309697 - DNA, 20 bp, Artificial
  CRISPR gRNA sequence
gcctgagtcccctgtgccag

SEQ ID NO: 309698 - DNA, 20 bp, Artificial
  CRISPR gRNA sequence
agtcccctgtgccagtggga

SEQ ID NO: 309699 - DNA, 20 bp, Artificial
  CRISPR gRNA sequence
tgccagtgggaaatccagag

SEQ ID NO: 309700 - DNA, 20 bp, Artificial
  CRISPR gRNA sequence
cctcctcttgcagcctctct

SEQ ID NO: 309701 - DNA, 20 bp, Artificial
  CRISPR gRNA sequence
ctcctcttgcagcctctctg

SEQ ID NO: 309702 - DNA, 20 bp, Artificial
  CRISPR gRNA sequence
ctcttgcagcctctctgcaa

SEQ ID NO: 309703 - DNA, 20 bp, Artificial
  CRISPR gRNA sequence
ttgcagcctctctgcaatgg

SEQ ID NO: 309704 - DNA, 20 bp, Artificial
  CRISPR gRNA sequence
gcagcctctctgcaatggac

SEQ ID NO: 309705 - DNA, 20 bp, Artificial
  CRISPR gRNA sequence
cagcctctctgcaatggact

SEQ ID NO: 309706 - DNA, 20 bp, Artificial
  CRISPR gRNA sequence
tctgcaatggacttacttgg

SEQ ID NO: 309707 - DNA, 20 bp, Artificial
  CRISPR gRNA sequence
tgcaatggacttacttggct

SEQ ID NO: 309708 - DNA, 20 bp, Artificial
  CRISPR gRNA sequence
caatggacttacttggcttt

SEQ ID NO: 309709 - DNA, 20 bp, Artificial
  CRISPR gRNA sequence
acttggctttcctgtttgac

SEQ ID NO: 309710 - DNA, 20 bp, Artificial
  CRISPR gRNA sequence
cttggctttcctgtttgacc

SEQ ID NO: 309711 - DNA, 20 bp, Artificial
  CRISPR gRNA sequence
ggctttcctgtttgaccttt

SEQ ID NO: 309712 - DNA, 20 bp, Artificial
  CRISPR gRNA sequence
gctttcctgtttgacctttc

SEQ ID NO: 309713 - DNA, 20 bp, Artificial
  CRISPR gRNA sequence
tcctgtttgacctttccctt

SEQ ID NO: 309714 - DNA, 20 bp, Artificial
  CRISPR gRNA sequence
cctgtttgacctttcccttc

SEQ ID NO: 309715 - DNA, 20 bp, Artificial
  CRISPR gRNA sequence
ctgtttgacctttcccttct

SEQ ID NO: 309716 - DNA, 20 bp, Artificial
  CRISPR gRNA sequence
tttgacctttcccttctctg

SEQ ID NO: 309717 - DNA, 20 bp, Artificial
  CRISPR gRNA sequence
gacctttcccttctctggtc

SEQ ID NO: 309718 - DNA, 20 bp, Artificial
  CRISPR gRNA sequence
acctttcccttctctggtcc

SEQ ID NO: 309719 - DNA, 20 bp, Artificial
  CRISPR gRNA sequence
tcccttctctggtccagaga

SEQ ID NO: 309720 - DNA, 20 bp, Artificial
  CRISPR gRNA sequence
cccttctctggtccagagac

SEQ ID NO: 309721 - DNA, 20 bp, Artificial
  CRISPR gRNA sequence
ccttctctggtccagagacc

SEQ ID NO: 309722 - DNA, 20 bp, Artificial
  CRISPR gRNA sequence
ctctggtccagagacccttc

SEQ ID NO: 309723 - DNA, 20 bp, Artificial
  CRISPR gRNA sequence
tctggtccagagacccttcc

SEQ ID NO: 309724 - DNA, 20 bp, Artificial
  CRISPR gRNA sequence
tggtccagagacccttcccc

SEQ ID NO: 309725 - DNA, 20 bp, Artificial
  CRISPR gRNA sequence
gtccagagacccttccccaa

SEQ ID NO: 309726 - DNA, 20 bp, Artificial
  CRISPR gRNA sequence
ccccaatatttcttcccatc

SEQ ID NO: 309727 - DNA, 20 bp, Artificial
  CRISPR gRNA sequence
cccaatatttcttcccatcc

SEQ ID NO: 309728 - DNA, 20 bp, Artificial
  CRISPR gRNA sequence
cttcccatccaagtgcccca

SEQ ID NO: 309729 - DNA, 20 bp, Artificial
  CRISPR gRNA sequence
ttcccatccaagtgccccat

SEQ ID NO: 309730 - DNA, 20 bp, Artificial
  CRISPR gRNA sequence
cccatccaagtgccccatcc

SEQ ID NO: 309731 - DNA, 20 bp, Artificial
  CRISPR gRNA sequence
ccatccaagtgccccatccc

SEQ ID NO: 309732 - DNA, 20 bp, Artificial
  CRISPR gRNA sequence
gccccacttggcaccagaga

SEQ ID NO: 309733 - DNA, 20 bp, Artificial
  CRISPR gRNA sequence
ggcaccagagaccaagatct

SEQ ID NO: 309734 - DNA, 20 bp, Artificial
  CRISPR gRNA sequence
gcaccagagaccaagatcta

SEQ ID NO: 309735 - DNA, 20 bp, Artificial
  CRISPR gRNA sequence
atttaaaaagaaatattctt

SEQ ID NO: 309736 - DNA, 20 bp, Artificial
  CRISPR gRNA sequence
aaaaagaaatattcttgggt

SEQ ID NO: 309737 - DNA, 20 bp, Artificial
  CRISPR gRNA sequence
aaaagaaatattcttgggtc

SEQ ID NO: 309738 - DNA, 20 bp, Artificial
  CRISPR gRNA sequence
ttgggtcaaaaaagagccca

SEQ ID NO: 309739 - DNA, 20 bp, Artificial
  CRISPR gRNA sequence
gggtcaaaaaagagcccaag

SEQ ID NO: 309740 - DNA, 20 bp, Artificial
  CRISPR gRNA sequence
ggtcaaaaaagagcccaagc

SEQ ID NO: 309741 - DNA, 20 bp, Artificial
  CRISPR gRNA sequence
aacataatgtgtttcacata

SEQ ID NO: 309742 - DNA, 20 bp, Artificial
  CRISPR gRNA sequence
cacatacggtgaacctattt

SEQ ID NO: 309743 - DNA, 20 bp, Artificial
  CRISPR gRNA sequence
acatacggtgaacctatttg

SEQ ID NO: 309744 - DNA, 20 bp, Artificial
  CRISPR gRNA sequence
tttgcatttgcatttgcaaa

SEQ ID NO: 309745 - DNA, 20 bp, Artificial
  CRISPR gRNA sequence
gcatttgcatttgcaaacgg

SEQ ID NO: 309746 - DNA, 20 bp, Artificial
  CRISPR gRNA sequence
catttgcatttgcaaacggg

SEQ ID NO: 309747 - DNA, 20 bp, Artificial
  CRISPR gRNA sequence
gcatttgcaaacgggcttaa

SEQ ID NO: 309748 - DNA, 20 bp, Artificial
  CRISPR gRNA sequence
catttgcaaacgggcttaaa

SEQ ID NO: 309749 - DNA, 20 bp, Artificial
  CRISPR gRNA sequence
gcaaacgggcttaaaatatc

SEQ ID NO: 309750 - DNA, 20 bp, Artificial
  CRISPR gRNA sequence
caaacgggcttaaaatatca

SEQ ID NO: 309751 - DNA, 20 bp, Artificial
  CRISPR gRNA sequence
aaaatatcatctctattaat

SEQ ID NO: 309752 - DNA, 20 bp, Artificial
  CRISPR gRNA sequence
aaatatcatctctattaata

SEQ ID NO: 309753 - DNA, 20 bp, Artificial
  CRISPR gRNA sequence
tattaatagcaatttaaggt

SEQ ID NO: 309754 - DNA, 20 bp, Artificial
  CRISPR gRNA sequence
ttaatagcaatttaaggttc

SEQ ID NO: 309755 - DNA, 20 bp, Artificial
  CRISPR gRNA sequence
atagcaatttaaggttctgg

SEQ ID NO: 309756 - DNA, 20 bp, Artificial
  CRISPR gRNA sequence
aaggttctggagagccaggt

SEQ ID NO: 309757 - DNA, 20 bp, Artificial
  CRISPR gRNA sequence
aggttctggagagccaggtg

SEQ ID NO: 309758 - DNA, 20 bp, Artificial
  CRISPR gRNA sequence
tggagagccaggtgaaaata

SEQ ID NO: 309759 - DNA, 20 bp, Artificial
  CRISPR gRNA sequence
gagagccaggtgaaaatagt

SEQ ID NO: 309760 - DNA, 20 bp, Artificial
  CRISPR gRNA sequence
ttgacaaagggaacttccta

SEQ ID NO: 309761 - DNA, 20 bp, Artificial
  CRISPR gRNA sequence
tgacaaagggaacttcctac

SEQ ID NO: 309762 - DNA, 20 bp, Artificial
  CRISPR gRNA sequence
gacaaagggaacttcctact

SEQ ID NO: 309763 - DNA, 20 bp, Artificial
  CRISPR gRNA sequence
acaaagggaacttcctactc

SEQ ID NO: 309764 - DNA, 20 bp, Artificial
  CRISPR gRNA sequence
cctactccccttaaactgta

SEQ ID NO: 309765 - DNA, 20 bp, Artificial
  CRISPR gRNA sequence
ctactccccttaaactgtaa

SEQ ID NO: 309766 - DNA, 20 bp, Artificial
  CRISPR gRNA sequence
ctccccttaaactgtaataa

SEQ ID NO: 309767 - DNA, 20 bp, Artificial
  CRISPR gRNA sequence
cccttaaactgtaataatga

SEQ ID NO: 309768 - DNA, 20 bp, Artificial
  CRISPR gRNA sequence
aaactgtaataatgaaggaa

SEQ ID NO: 309769 - DNA, 20 bp, Artificial
  CRISPR gRNA sequence
aactgtaataatgaaggaaa

SEQ ID NO: 309770 - DNA, 20 bp, Artificial
  CRISPR gRNA sequence
taataatgaaggaaatgaac

SEQ ID NO: 309771 - DNA, 20 bp, Artificial
  CRISPR gRNA sequence
tttatcttacatgtaacctc

SEQ ID NO: 309772 - DNA, 20 bp, Artificial
  CRISPR gRNA sequence
atcttacatgtaacctcaat

SEQ ID NO: 309773 - DNA, 20 bp, Artificial
  CRISPR gRNA sequence
tcttacatgtaacctcaatc

SEQ ID NO: 309774 - DNA, 20 bp, Artificial
  CRISPR gRNA sequence
acatgtaacctcaatcttgg

SEQ ID NO: 309775 - DNA, 20 bp, Artificial
  CRISPR gRNA sequence
catgtaacctcaatcttggg

SEQ ID NO: 309776 - DNA, 20 bp, Artificial
  CRISPR gRNA sequence
aatcttgggactaaggccct

SEQ ID NO: 309777 - DNA, 20 bp, Artificial
  CRISPR gRNA sequence
gggactaaggccctgtacta

SEQ ID NO: 309778 - DNA, 20 bp, Artificial
  CRISPR gRNA sequence
ggactaaggccctgtactaa

SEQ ID NO: 309779 - DNA, 20 bp, Artificial
  CRISPR gRNA sequence
aggccctgtactaaaatgcg

SEQ ID NO: 309780 - DNA, 20 bp, Artificial
  CRISPR gRNA sequence
tactaaaatgcgtctattta

SEQ ID NO: 309781 - DNA, 20 bp, Artificial
  CRISPR gRNA sequence
aaatgcgtctatttatgtgc

SEQ ID NO: 309782 - DNA, 20 bp, Artificial
  CRISPR gRNA sequence
tttatgtgctcagacttgca

SEQ ID NO: 309783 - DNA, 20 bp, Artificial
  CRISPR gRNA sequence
atgtgctcagacttgcagtt

SEQ ID NO: 309784 - DNA, 20 bp, Artificial
  CRISPR gRNA sequence
tgtgctcagacttgcagttc

SEQ ID NO: 309785 - DNA, 20 bp, Artificial
  CRISPR gRNA sequence
agacttgcagttcgtgttat

SEQ ID NO: 309786 - DNA, 20 bp, Artificial
  CRISPR gRNA sequence
gcagttcgtgttatgtctgc

SEQ ID NO: 309787 - DNA, 20 bp, Artificial
  CRISPR gRNA sequence
cagttcgtgttatgtctgct

SEQ ID NO: 309788 - DNA, 20 bp, Artificial
  CRISPR gRNA sequence
gtgttatgtctgctgctgca

SEQ ID NO: 309789 - DNA, 20 bp, Artificial
  CRISPR gRNA sequence
tgtctgctgctgcagatacc

SEQ ID NO: 309790 - DNA, 20 bp, Artificial
  CRISPR gRNA sequence
ctgctgcagataccgttaat

SEQ ID NO: 309791 - DNA, 20 bp, Artificial
  CRISPR gRNA sequence
ctgcagataccgttaatatt

SEQ ID NO: 309792 - DNA, 20 bp, Artificial
  CRISPR gRNA sequence
cagataccgttaatattatt

SEQ ID NO: 309793 - DNA, 20 bp, Artificial
  CRISPR gRNA sequence
atattatttatgtgagctat

SEQ ID NO: 309794 - DNA, 20 bp, Artificial
  CRISPR gRNA sequence
tttatgtgagctatcctgtg

SEQ ID NO: 309795 - DNA, 20 bp, Artificial
  CRISPR gRNA sequence
atgtgagctatcctgtgtat

SEQ ID NO: 309796 - DNA, 20 bp, Artificial
  CRISPR gRNA sequence
tgtgagctatcctgtgtata

SEQ ID NO: 309797 - DNA, 20 bp, Artificial
  CRISPR gRNA sequence
tcctgtgtataatggaagct

SEQ ID NO: 309798 - DNA, 20 bp, Artificial
  CRISPR gRNA sequence
tgtataatggaagcttttat

SEQ ID NO: 309799 - DNA, 20 bp, Artificial
  CRISPR gRNA sequence
ttataaatctctatttattt

SEQ ID NO: 309800 - DNA, 20 bp, Artificial
  CRISPR gRNA sequence
tataaatctctatttattta

SEQ ID NO: 309801 - DNA, 20 bp, Artificial
  CRISPR gRNA sequence
ataaatctctatttatttat

SEQ ID NO: 309802 - DNA, 20 bp, Artificial
  CRISPR gRNA sequence
taaatctctatttatttatt

SEQ ID NO: 309803 - DNA, 20 bp, Artificial
  CRISPR gRNA sequence
tatttatttattcctaatat

SEQ ID NO: 309804 - DNA, 20 bp, Artificial
  CRISPR gRNA sequence
tttatttattcctaatatag

SEQ ID NO: 309805 - DNA, 20 bp, Artificial
  CRISPR gRNA sequence
atttattcctaatatagtta

SEQ ID NO: 309806 - DNA, 20 bp, Artificial
  CRISPR gRNA sequence
tttattcctaatatagttat

SEQ ID NO: 309807 - DNA, 20 bp, Artificial
  CRISPR gRNA sequence
attcctaatatagttattaa

SEQ ID NO: 309808 - DNA, 20 bp, Artificial
  CRISPR gRNA sequence
ttcctaatatagttattaag

SEQ ID NO: 309809 - DNA, 20 bp, Artificial
  CRISPR gRNA sequence
ctaatatagttattaagtgc

SEQ ID NO: 309810 - DNA, 20 bp, Artificial
  CRISPR gRNA sequence
atatagttattaagtgcttg

SEQ ID NO: 309811 - DNA, 20 bp, Artificial
  CRISPR gRNA sequence
ttaagtgcttgctatgttcc

SEQ ID NO: 309812 - DNA, 20 bp, Artificial
  CRISPR gRNA sequence
agtgcttgctatgttccagg

SEQ ID NO: 309813 - DNA, 20 bp, Artificial
  CRISPR gRNA sequence
gctatgttccaggtactagg

SEQ ID NO: 309814 - DNA, 20 bp, Artificial
  CRISPR gRNA sequence
ctatgttccaggtactaggg

SEQ ID NO: 309815 - DNA, 20 bp, Artificial
  CRISPR gRNA sequence
tgttccaggtactagggact

SEQ ID NO: 309816 - DNA, 20 bp, Artificial
  CRISPR gRNA sequence
caggtactagggacttaaca

SEQ ID NO: 309817 - DNA, 20 bp, Artificial
  CRISPR gRNA sequence
gggacttaacaggtagcata

SEQ ID NO: 309818 - DNA, 20 bp, Artificial
  CRISPR gRNA sequence
aacaggtagcataaaagaca

SEQ ID NO: 309819 - DNA, 20 bp, Artificial
  CRISPR gRNA sequence
acaggtagcataaaagacat

SEQ ID NO: 309820 - DNA, 20 bp, Artificial
  CRISPR gRNA sequence
cactcttgttttctagccta

SEQ ID NO: 309821 - DNA, 20 bp, Artificial
  CRISPR gRNA sequence
ttgttttctagcctagtggg

SEQ ID NO: 309822 - DNA, 20 bp, Artificial
  CRISPR gRNA sequence
gttttctagcctagtgggga

SEQ ID NO: 309823 - DNA, 20 bp, Artificial
  CRISPR gRNA sequence
ttttctagcctagtggggaa

SEQ ID NO: 309824 - DNA, 20 bp, Artificial
  CRISPR gRNA sequence
tctagcctagtggggaaatc

SEQ ID NO: 309825 - DNA, 20 bp, Artificial
  CRISPR gRNA sequence
ctagcctagtggggaaatca

SEQ ID NO: 309826 - DNA, 20 bp, Artificial
  CRISPR gRNA sequence
tagcctagtggggaaatcac

SEQ ID NO: 309827 - DNA, 20 bp, Artificial
  CRISPR gRNA sequence
gcctagtggggaaatcacat

SEQ ID NO: 309828 - DNA, 20 bp, Artificial
  CRISPR gRNA sequence
gtggggaaatcacattaatt

SEQ ID NO: 309829 - DNA, 20 bp, Artificial
  CRISPR gRNA sequence
atttaatcacactaaacatg

SEQ ID NO: 309830 - DNA, 20 bp, Artificial
  CRISPR gRNA sequence
aatcacactaaacatgacta

SEQ ID NO: 309831 - DNA, 20 bp, Artificial
  CRISPR gRNA sequence
atcacactaaacatgactac

SEQ ID NO: 309832 - DNA, 20 bp, Artificial
  CRISPR gRNA sequence
aacatgactacatagcaata

SEQ ID NO: 309833 - DNA, 20 bp, Artificial
  CRISPR gRNA sequence
catagcaatagtgctttaaa

SEQ ID NO: 309834 - DNA, 20 bp, Artificial
  CRISPR gRNA sequence
taaagggaaggaaattgttc

SEQ ID NO: 309835 - DNA, 20 bp, Artificial
  CRISPR gRNA sequence
aaagggaaggaaattgttct

SEQ ID NO: 309836 - DNA, 20 bp, Artificial
  CRISPR gRNA sequence
aagggaaggaaattgttcta

SEQ ID NO: 309837 - DNA, 20 bp, Artificial
  CRISPR gRNA sequence
ttctatgtgactatatcagc

SEQ ID NO: 309838 - DNA, 20 bp, Artificial
  CRISPR gRNA sequence
tatgtgactatatcagctga

SEQ ID NO: 309839 - DNA, 20 bp, Artificial
  CRISPR gRNA sequence
tgtgactatatcagctgatt

SEQ ID NO: 309840 - DNA, 20 bp, Artificial
  CRISPR gRNA sequence
tatcagctgattaattacca

SEQ ID NO: 309841 - DNA, 20 bp, Artificial
  CRISPR gRNA sequence
attaattaccaagcctttgc

SEQ ID NO: 309842 - DNA, 20 bp, Artificial
  CRISPR gRNA sequence
attaccaagcctttgcattt

SEQ ID NO: 309843 - DNA, 20 bp, Artificial
  CRISPR gRNA sequence
ccaagcctttgcatttgata

SEQ ID NO: 309844 - DNA, 20 bp, Artificial
  CRISPR gRNA sequence
tgcatttgatattttggtta

SEQ ID NO: 309845 - DNA, 20 bp, Artificial
  CRISPR gRNA sequence
gcatttgatattttggttag

SEQ ID NO: 309846 - DNA, 20 bp, Artificial
  CRISPR gRNA sequence
catttgatattttggttagt

SEQ ID NO: 309847 - DNA, 20 bp, Artificial
  CRISPR gRNA sequence
gatattttggttagtctatt

SEQ ID NO: 309848 - DNA, 20 bp, Artificial
  CRISPR gRNA sequence
atattttggttagtctattc

SEQ ID NO: 309849 - DNA, 20 bp, Artificial
  CRISPR gRNA sequence
tggttagtctattcttcttg

SEQ ID NO: 309850 - DNA, 20 bp, Artificial
  CRISPR gRNA sequence
ggttagtctattcttcttga

SEQ ID NO: 309851 - DNA, 20 bp, Artificial
  CRISPR gRNA sequence
gttagtctattcttcttgaa

SEQ ID NO: 309852 - DNA, 20 bp, Artificial
  CRISPR gRNA sequence
gtctattcttcttgaatttc

SEQ ID NO: 309853 - DNA, 20 bp, Artificial
  CRISPR gRNA sequence
ttcttcttgaatttcatatg

SEQ ID NO: 309854 - DNA, 20 bp, Artificial
  CRISPR gRNA sequence
ttcttgaatttcatatgcct

SEQ ID NO: 309855 - DNA, 20 bp, Artificial
  CRISPR gRNA sequence
cttgaatttcatatgcctct

SEQ ID NO: 309856 - DNA, 20 bp, Artificial
  CRISPR gRNA sequence
ttgaatttcatatgcctctt

SEQ ID NO: 309857 - DNA, 20 bp, Artificial
  CRISPR gRNA sequence
gaatttcatatgcctcttcc

SEQ ID NO: 309858 - DNA, 20 bp, Artificial
  CRISPR gRNA sequence
aatttcatatgcctcttcct

SEQ ID NO: 309859 - DNA, 20 bp, Artificial
  CRISPR gRNA sequence
catatgcctcttcctgggtg

SEQ ID NO: 309860 - DNA, 20 bp, Artificial
  CRISPR gRNA sequence
atatgcctcttcctgggtgg

SEQ ID NO: 309861 - DNA, 20 bp, Artificial
  CRISPR gRNA sequence
ttcctgggtgggggtgagga

SEQ ID NO: 309862 - DNA, 20 bp, Artificial
  CRISPR gRNA sequence
cctgggtgggggtgaggatg

SEQ ID NO: 309863 - DNA, 20 bp, Artificial
  CRISPR gRNA sequence
ctgggtgggggtgaggatgg

SEQ ID NO: 309864 - DNA, 20 bp, Artificial
  CRISPR gRNA sequence
ggtgggggtgaggatgggat

SEQ ID NO: 309865 - DNA, 20 bp, Artificial
  CRISPR gRNA sequence
tatggagttgaggctagggc

SEQ ID NO: 309866 - DNA, 20 bp, Artificial
  CRISPR gRNA sequence
atggagttgaggctagggca

SEQ ID NO: 309867 - DNA, 20 bp, Artificial
  CRISPR gRNA sequence
tggagttgaggctagggcag

SEQ ID NO: 309868 - DNA, 20 bp, Artificial
  CRISPR gRNA sequence
aggctagggcaggtagggag

SEQ ID NO: 309869 - DNA, 20 bp, Artificial
  CRISPR gRNA sequence
gggcaggtagggagaaaaca

SEQ ID NO: 309870 - DNA, 20 bp, Artificial
  CRISPR gRNA sequence
ttcagcagaaaaatcaaggt

SEQ ID NO: 309871 - DNA, 20 bp, Artificial
  CRISPR gRNA sequence
cagcagaaaaatcaaggttg

SEQ ID NO: 309872 - DNA, 20 bp, Artificial
  CRISPR gRNA sequence
agcagaaaaatcaaggttga

SEQ ID NO: 309873 - DNA, 20 bp, Artificial
  CRISPR gRNA sequence
aaataccatgtttcaaaaat

SEQ ID NO: 309874 - DNA, 20 bp, Artificial
  CRISPR gRNA sequence
caaaaatcagactgaggtgg

SEQ ID NO: 309875 - DNA, 20 bp, Artificial
  CRISPR gRNA sequence
aaaaatcagactgaggtggg

SEQ ID NO: 309876 - DNA, 20 bp, Artificial
  CRISPR gRNA sequence
aggtgggagttgaggttagg

SEQ ID NO: 309877 - DNA, 20 bp, Artificial
  CRISPR gRNA sequence
aggttaggggtccctaggcc

SEQ ID NO: 309878 - DNA, 20 bp, Artificial
  CRISPR gRNA sequence
ggggtccctaggccagggga

SEQ ID NO: 309879 - DNA, 20 bp, Artificial
  CRISPR gRNA sequence
ggccaggggattgaagcttc

SEQ ID NO: 309880 - DNA, 20 bp, Artificial
  CRISPR gRNA sequence
aagcttcaaagagataaaac

SEQ ID NO: 309881 - DNA, 20 bp, Artificial
  CRISPR gRNA sequence
caaagagataaaactagagc

SEQ ID NO: 309882 - DNA, 20 bp, Artificial
  CRISPR gRNA sequence
aaagagataaaactagagca

SEQ ID NO: 309883 - DNA, 20 bp, Artificial
  CRISPR gRNA sequence
gagcaaaagcaagcacagag

SEQ ID NO: 309884 - DNA, 20 bp, Artificial
  CRISPR gRNA sequence
ggcatttttccacagtccat

SEQ ID NO: 309885 - DNA, 20 bp, Artificial
  CRISPR gRNA sequence
ttccacagtccattctagtg

SEQ ID NO: 309886 - DNA, 20 bp, Artificial
  CRISPR gRNA sequence
tccacagtccattctagtgc

SEQ ID NO: 309887 - DNA, 20 bp, Artificial
  CRISPR gRNA sequence
ccacagtccattctagtgct

SEQ ID NO: 309888 - DNA, 20 bp, Artificial
  CRISPR gRNA sequence
cacagtccattctagtgctg

SEQ ID NO: 309889 - DNA, 20 bp, Artificial
  CRISPR gRNA sequence
tagtgctggcaatccacctt

SEQ ID NO: 309890 - DNA, 20 bp, Artificial
  CRISPR gRNA sequence
gtgctggcaatccacctttc

SEQ ID NO: 309891 - DNA, 20 bp, Artificial
  CRISPR gRNA sequence
gcaatccacctttcatggcc

SEQ ID NO: 309892 - DNA, 20 bp, Artificial
  CRISPR gRNA sequence
tcatggccaggcaggtaaga

SEQ ID NO: 309893 - DNA, 20 bp, Artificial
  CRISPR gRNA sequence
catggccaggcaggtaagag

SEQ ID NO: 309894 - DNA, 20 bp, Artificial
  CRISPR gRNA sequence
atggccaggcaggtaagagt

SEQ ID NO: 309895 - DNA, 20 bp, Artificial
  CRISPR gRNA sequence
gtggggtgggagaaaggaca

SEQ ID NO: 309896 - DNA, 20 bp, Artificial
  CRISPR gRNA sequence
tggggtgggagaaaggacag

SEQ ID NO: 309897 - DNA, 20 bp, Artificial
  CRISPR gRNA sequence
ggcacacagccctttactgg

SEQ ID NO: 309898 - DNA, 20 bp, Artificial
  CRISPR gRNA sequence
tactggcccttatctctcct

SEQ ID NO: 309899 - DNA, 20 bp, Artificial
  CRISPR gRNA sequence
actggcccttatctctcctc

SEQ ID NO: 309900 - DNA, 20 bp, Artificial
  CRISPR gRNA sequence
ctggcccttatctctcctct

SEQ ID NO: 309901 - DNA, 20 bp, Artificial
  CRISPR gRNA sequence
gcccttatctctcctctctt

SEQ ID NO: 309902 - DNA, 20 bp, Artificial
  CRISPR gRNA sequence
atctctcctctcttctccta

SEQ ID NO: 309903 - DNA, 20 bp, Artificial
  CRISPR gRNA sequence
tctctcctctcttctcctat

SEQ ID NO: 309904 - DNA, 20 bp, Artificial
  CRISPR gRNA sequence
tcctctcttctcctatacag

SEQ ID NO: 309905 - DNA, 20 bp, Artificial
  CRISPR gRNA sequence
ctctcttctcctatacagtg

SEQ ID NO: 309906 - DNA, 20 bp, Artificial
  CRISPR gRNA sequence
tcttctcctatacagtgctg

SEQ ID NO: 309907 - DNA, 20 bp, Artificial
  CRISPR gRNA sequence
ttctcctatacagtgctgtt

SEQ ID NO: 309908 - DNA, 20 bp, Artificial
  CRISPR gRNA sequence
ctcctatacagtgctgtttc

SEQ ID NO: 309909 - DNA, 20 bp, Artificial
  CRISPR gRNA sequence
tcctatacagtgctgtttcc

SEQ ID NO: 309910 - DNA, 20 bp, Artificial
  CRISPR gRNA sequence
ctatacagtgctgtttccga

SEQ ID NO: 309911 - DNA, 20 bp, Artificial
  CRISPR gRNA sequence
tacagtgctgtttccgaact

SEQ ID NO: 309912 - DNA, 20 bp, Artificial
  CRISPR gRNA sequence
tttccgaactgtacattggc

SEQ ID NO: 309913 - DNA, 20 bp, Artificial
  CRISPR gRNA sequence
ccgaactgtacattggctta

SEQ ID NO: 309914 - DNA, 20 bp, Artificial
  CRISPR gRNA sequence
cgaactgtacattggcttac

SEQ ID NO: 309915 - DNA, 20 bp, Artificial
  CRISPR gRNA sequence
tacattggcttacactcggg

SEQ ID NO: 309916 - DNA, 20 bp, Artificial
  CRISPR gRNA sequence
gcttacactcgggctgaggt

SEQ ID NO: 309917 - DNA, 20 bp, Artificial
  CRISPR gRNA sequence
acactcgggctgaggtttgg

SEQ ID NO: 309918 - DNA, 20 bp, Artificial
  CRISPR gRNA sequence
cactcgggctgaggtttggg

SEQ ID NO: 309919 - DNA, 20 bp, Artificial
  CRISPR gRNA sequence
gggctgaggtttgggaaata

SEQ ID NO: 309920 - DNA, 20 bp, Artificial
  CRISPR gRNA sequence
aggtttgggaaataggcgcc

SEQ ID NO: 309921 - DNA, 20 bp, Artificial
  CRISPR gRNA sequence
gggaaataggcgccattttg

SEQ ID NO: 309922 - DNA, 20 bp, Artificial
  CRISPR gRNA sequence
ggaaataggcgccattttga

SEQ ID NO: 309923 - DNA, 20 bp, Artificial
  CRISPR gRNA sequence
tgaatatgtgtggaggaaga

SEQ ID NO: 309924 - DNA, 20 bp, Artificial
  CRISPR gRNA sequence
gaatatgtgtggaggaagaa

SEQ ID NO: 309925 - DNA, 20 bp, Artificial
  CRISPR gRNA sequence
aatatgtgtggaggaagaaa

SEQ ID NO: 309926 - DNA, 20 bp, Artificial
  CRISPR gRNA sequence
cagcactttccacctcccca

SEQ ID NO: 309927 - DNA, 20 bp, Artificial
  CRISPR gRNA sequence
agcactttccacctccccat

SEQ ID NO: 309928 - DNA, 20 bp, Artificial
  CRISPR gRNA sequence
tccacctccccatcacggcc

SEQ ID NO: 309929 - DNA, 20 bp, Artificial
  CRISPR gRNA sequence
ccacctccccatcacggccc

SEQ ID NO: 309930 - DNA, 20 bp, Artificial
  CRISPR gRNA sequence
cacctccccatcacggccct

SEQ ID NO: 309931 - DNA, 20 bp, Artificial
  CRISPR gRNA sequence
cccatcacggccctgagacc

SEQ ID NO: 309932 - DNA, 20 bp, Artificial
  CRISPR gRNA sequence
agacctcaacaccgggaagc

SEQ ID NO: 309933 - DNA, 20 bp, Artificial
  CRISPR gRNA sequence
aacaccgggaagcatctcgt

SEQ ID NO: 309934 - DNA, 20 bp, Artificial
  CRISPR gRNA sequence
gttccctatcggtcctcctt

SEQ ID NO: 309935 - DNA, 20 bp, Artificial
  CRISPR gRNA sequence
cctatcggtcctcctttatt

SEQ ID NO: 309936 - DNA, 20 bp, Artificial
  CRISPR gRNA sequence
tcggtcctcctttattcatg

SEQ ID NO: 309937 - DNA, 20 bp, Artificial
  CRISPR gRNA sequence
ctttattcatggacggatat

SEQ ID NO: 309938 - DNA, 20 bp, Artificial
  CRISPR gRNA sequence
tattcatggacggatatgat

SEQ ID NO: 309939 - DNA, 20 bp, Artificial
  CRISPR gRNA sequence
attcatggacggatatgatt

SEQ ID NO: 309940 - DNA, 20 bp, Artificial
  CRISPR gRNA sequence
ttcatggacggatatgattc

SEQ ID NO: 309941 - DNA, 20 bp, Artificial
  CRISPR gRNA sequence
atggacggatatgattcctt

SEQ ID NO: 309942 - DNA, 20 bp, Artificial
  CRISPR gRNA sequence
ctttctaagttccatgtcct

SEQ ID NO: 309943 - DNA, 20 bp, Artificial
  CRISPR gRNA sequence
tctaagttccatgtcctttt

SEQ ID NO: 309944 - DNA, 20 bp, Artificial
  CRISPR gRNA sequence
ctaagttccatgtccttttt

SEQ ID NO: 309945 - DNA, 20 bp, Artificial
  CRISPR gRNA sequence
taagttccatgtccttttta

SEQ ID NO: 309946 - DNA, 20 bp, Artificial
  CRISPR gRNA sequence
agttccatgtcctttttaga

SEQ ID NO: 309947 - DNA, 20 bp, Artificial
  CRISPR gRNA sequence
catgtcctttttagataaat

SEQ ID NO: 309948 - DNA, 20 bp, Artificial
  CRISPR gRNA sequence
tttagataaattaacttgaa

SEQ ID NO: 309949 - DNA, 20 bp, Artificial
  CRISPR gRNA sequence
ttagataaattaacttgaac

SEQ ID NO: 309950 - DNA, 20 bp, Artificial
  CRISPR gRNA sequence
tagataaattaacttgaacc

SEQ ID NO: 309951 - DNA, 20 bp, Artificial
  CRISPR gRNA sequence
agataaattaacttgaacct

SEQ ID NO: 309952 - DNA, 20 bp, Artificial
  CRISPR gRNA sequence
gataaattaacttgaaccta

SEQ ID NO: 309953 - DNA, 20 bp, Artificial
  CRISPR gRNA sequence
acttgaacctaatgcctaat

SEQ ID NO: 309954 - DNA, 20 bp, Artificial
  CRISPR gRNA sequence
gaacctaatgcctaatggct

SEQ ID NO: 309955 - DNA, 20 bp, Artificial
  CRISPR gRNA sequence
aacctaatgcctaatggctt

SEQ ID NO: 309956 - DNA, 20 bp, Artificial
  CRISPR gRNA sequence
atgcctaatggcttaaaaac

SEQ ID NO: 309957 - DNA, 20 bp, Artificial
  CRISPR gRNA sequence
atggcttaaaaacaaacaaa

SEQ ID NO: 309958 - DNA, 20 bp, Artificial
  CRISPR gRNA sequence
aaaaacaaacaaaaaaaacc

SEQ ID NO: 309959 - DNA, 20 bp, Artificial
  CRISPR gRNA sequence
aaaacaaacaaaaaaaaccc

SEQ ID NO: 309960 - DNA, 20 bp, Artificial
  CRISPR gRNA sequence
ttccttccagctagcatttg

SEQ ID NO: 309961 - DNA, 20 bp, Artificial
  CRISPR gRNA sequence
ccttccagctagcatttgca

SEQ ID NO: 309962 - DNA, 20 bp, Artificial
  CRISPR gRNA sequence
cttccagctagcatttgcat

SEQ ID NO: 309963 - DNA, 20 bp, Artificial
  CRISPR gRNA sequence
ccagctagcatttgcatttt

SEQ ID NO: 309964 - DNA, 20 bp, Artificial
  CRISPR gRNA sequence
cagctagcatttgcatttta

SEQ ID NO: 309965 - DNA, 20 bp, Artificial
  CRISPR gRNA sequence
gcatttgcattttaacaggg

SEQ ID NO: 309966 - DNA, 20 bp, Artificial
  CRISPR gRNA sequence
gcattttaacaggggctttc

SEQ ID NO: 309967 - DNA, 20 bp, Artificial
  CRISPR gRNA sequence
cattttaacaggggctttca

SEQ ID NO: 309968 - DNA, 20 bp, Artificial
  CRISPR gRNA sequence
taacaggggctttcaaaaaa

SEQ ID NO: 309969 - DNA, 20 bp, Artificial
  CRISPR gRNA sequence
aacaggggctttcaaaaaat

SEQ ID NO: 309970 - DNA, 20 bp, Artificial
  CRISPR gRNA sequence
acaggggctttcaaaaaatg

SEQ ID NO: 309971 - DNA, 20 bp, Artificial
  CRISPR gRNA sequence
tcaaaaaatgccttagccca

SEQ ID NO: 309972 - DNA, 20 bp, Artificial
  CRISPR gRNA sequence
caaaaaatgccttagcccaa

SEQ ID NO: 309973 - DNA, 20 bp, Artificial
  CRISPR gRNA sequence
aaaaaatgccttagcccaag

SEQ ID NO: 309974 - DNA, 20 bp, Artificial
  CRISPR gRNA sequence
agcccaaggaatgagtaatg

SEQ ID NO: 309975 - DNA, 20 bp, Artificial
  CRISPR gRNA sequence
gcccaaggaatgagtaatgt

SEQ ID NO: 309976 - DNA, 20 bp, Artificial
  CRISPR gRNA sequence
caagcagcagggtaggactg

SEQ ID NO: 309977 - DNA, 20 bp, Artificial
  CRISPR gRNA sequence
gtgcacagtatggggagaga

SEQ ID NO: 309978 - DNA, 20 bp, Artificial
  CRISPR gRNA sequence
aagttgtggccctgaaatgt

SEQ ID NO: 309979 - DNA, 20 bp, Artificial
  CRISPR gRNA sequence
tggccctgaaatgttggctt

SEQ ID NO: 309980 - DNA, 20 bp, Artificial
  CRISPR gRNA sequence
aaatgttggcttcctctctt

SEQ ID NO: 309981 - DNA, 20 bp, Artificial
  CRISPR gRNA sequence
gcttcctctctttgaccatg

SEQ ID NO: 309982 - DNA, 20 bp, Artificial
  CRISPR gRNA sequence
cctctctttgaccatgatgc

SEQ ID NO: 309983 - DNA, 20 bp, Artificial
  CRISPR gRNA sequence
ctctctttgaccatgatgct

SEQ ID NO: 309984 - DNA, 20 bp, Artificial
  CRISPR gRNA sequence
tctttgaccatgatgctgtt

SEQ ID NO: 309985 - DNA, 20 bp, Artificial
  CRISPR gRNA sequence
tttgaccatgatgctgtttc

SEQ ID NO: 309986 - DNA, 20 bp, Artificial
  CRISPR gRNA sequence
tgaccatgatgctgtttctg

SEQ ID NO: 309987 - DNA, 20 bp, Artificial
  CRISPR gRNA sequence
gaccatgatgctgtttctga

SEQ ID NO: 309988 - DNA, 20 bp, Artificial
  CRISPR gRNA sequence
accatgatgctgtttctgag

SEQ ID NO: 309989 - DNA, 20 bp, Artificial
  CRISPR gRNA sequence
tttctgagaaaacaagaatc

SEQ ID NO: 309990 - DNA, 20 bp, Artificial
  CRISPR gRNA sequence
ctgagaaaacaagaatcagg

SEQ ID NO: 309991 - DNA, 20 bp, Artificial
  CRISPR gRNA sequence
tgagaaaacaagaatcaggc

SEQ ID NO: 309992 - DNA, 20 bp, Artificial
  CRISPR gRNA sequence
agaaaacaagaatcaggcta

SEQ ID NO: 309993 - DNA, 20 bp, Artificial
  CRISPR gRNA sequence
ccttaggggaccaggatggg

SEQ ID NO: 309994 - DNA, 20 bp, Artificial
  CRISPR gRNA sequence
aggggaccaggatgggcatg

SEQ ID NO: 309995 - DNA, 20 bp, Artificial
  CRISPR gRNA sequence
ggggaccaggatgggcatgg

SEQ ID NO: 309996 - DNA, 20 bp, Artificial
  CRISPR gRNA sequence
ccttttagtgagttctatga

SEQ ID NO: 309997 - DNA, 20 bp, Artificial
  CRISPR gRNA sequence
ttagtgagttctatgagcct

SEQ ID NO: 309998 - DNA, 20 bp, Artificial
  CRISPR gRNA sequence
tagtgagttctatgagcctc

SEQ ID NO: 309999 - DNA, 20 bp, Artificial
  CRISPR gRNA sequence
agtgagttctatgagcctca

SEQ ID NO: 310000 - DNA, 20 bp, Artificial
  CRISPR gRNA sequence
gtgagttctatgagcctcat

SEQ ID NO: 310001 - DNA, 20 bp, Artificial
  CRISPR gRNA sequence
tatgagcctcatacctgaca

SEQ ID NO: 310002 - DNA, 20 bp, Artificial
  CRISPR gRNA sequence
tgagcctcatacctgacagt

SEQ ID NO: 310003 - DNA, 20 bp, Artificial
  CRISPR gRNA sequence
atacctgacagtcagagccc

SEQ ID NO: 310004 - DNA, 20 bp, Artificial
  CRISPR gRNA sequence
acagtcagagccctcgagtg

SEQ ID NO: 310005 - DNA, 20 bp, Artificial
  CRISPR gRNA sequence
gagtggatgagcacagacta

SEQ ID NO: 310006 - DNA, 20 bp, Artificial
  CRISPR gRNA sequence
gaagaagcactgtgaaactt

SEQ ID NO: 310007 - DNA, 20 bp, Artificial
  CRISPR gRNA sequence
tgaaactttgcatgatcctt

SEQ ID NO: 310008 - DNA, 20 bp, Artificial
  CRISPR gRNA sequence
tgcatgatccttaccttttt

SEQ ID NO: 310009 - DNA, 20 bp, Artificial
  CRISPR gRNA sequence
gcatgatccttacctttttg

SEQ ID NO: 310010 - DNA, 20 bp, Artificial
  CRISPR gRNA sequence
catgatccttacctttttgg

SEQ ID NO: 310011 - DNA, 20 bp, Artificial
  CRISPR gRNA sequence
acctttttggcaaaaaggaa

SEQ ID NO: 310012 - DNA, 20 bp, Artificial
  CRISPR gRNA sequence
cctttttggcaaaaaggaaa

SEQ ID NO: 310013 - DNA, 20 bp, Artificial
  CRISPR gRNA sequence
tttggcaaaaaggaaaaaaa

SEQ ID NO: 310014 - DNA, 20 bp, Artificial
  CRISPR gRNA sequence
ttggcaaaaaggaaaaaaaa

SEQ ID NO: 310015 - DNA, 20 bp, Artificial
  CRISPR gRNA sequence
tggcaaaaaggaaaaaaaat

SEQ ID NO: 310016 - DNA, 20 bp, Artificial
  CRISPR gRNA sequence
ggcaaaaaggaaaaaaaatc

SEQ ID NO: 310017 - DNA, 20 bp, Artificial
  CRISPR gRNA sequence
gcaaaaaggaaaaaaaatcg

SEQ ID NO: 310018 - DNA, 20 bp, Artificial
  CRISPR gRNA sequence
tcaaattcatcaatagtttg

SEQ ID NO: 310019 - DNA, 20 bp, Artificial
  CRISPR gRNA sequence
aaattcatcaatagtttgaa

SEQ ID NO: 310020 - DNA, 20 bp, Artificial
  CRISPR gRNA sequence
atcaatagtttgaaataggg

SEQ ID NO: 310021 - DNA, 20 bp, Artificial
  CRISPR gRNA sequence
gaaatagggtgtgccttgat

SEQ ID NO: 310022 - DNA, 20 bp, Artificial
  CRISPR gRNA sequence
aaatagggtgtgccttgatt

SEQ ID NO: 310023 - DNA, 20 bp, Artificial
  CRISPR gRNA sequence
gattcagaaagtttcgattc

SEQ ID NO: 310024 - DNA, 20 bp, Artificial
  CRISPR gRNA sequence
attcagaaagtttcgattct

SEQ ID NO: 310025 - DNA, 20 bp, Artificial
  CRISPR gRNA sequence
agaaagtttcgattctagat

SEQ ID NO: 310026 - DNA, 20 bp, Artificial
  CRISPR gRNA sequence
cgattctagatacaactcgg

SEQ ID NO: 310027 - DNA, 20 bp, Artificial
  CRISPR gRNA sequence
gattctagatacaactcgga

SEQ ID NO: 310028 - DNA, 20 bp, Artificial
  CRISPR gRNA sequence
tagatacaactcggagaact

SEQ ID NO: 310029 - DNA, 20 bp, Artificial
  CRISPR gRNA sequence
gatacaactcggagaactag

SEQ ID NO: 310030 - DNA, 20 bp, Artificial
  CRISPR gRNA sequence
ggagaactaggcgtgtcttg

SEQ ID NO: 310031 - DNA, 20 bp, Artificial
  CRISPR gRNA sequence
ggcgtgtcttgtacacagat

SEQ ID NO: 310032 - DNA, 20 bp, Artificial
  CRISPR gRNA sequence
gtacacagatttgctcttgg

SEQ ID NO: 310033 - DNA, 20 bp, Artificial
  CRISPR gRNA sequence
tacacagatttgctcttggg

SEQ ID NO: 310034 - DNA, 20 bp, Artificial
  CRISPR gRNA sequence
gctcttgggggaccggaaaa

SEQ ID NO: 310035 - DNA, 20 bp, Artificial
  CRISPR gRNA sequence
ctcttgggggaccggaaaag

SEQ ID NO: 310036 - DNA, 20 bp, Artificial
  CRISPR gRNA sequence
ttgggggaccggaaaagcta

SEQ ID NO: 310037 - DNA, 20 bp, Artificial
  CRISPR gRNA sequence
gggggaccggaaaagctaaa

SEQ ID NO: 310038 - DNA, 20 bp, Artificial
  CRISPR gRNA sequence
ggggaccggaaaagctaaat

SEQ ID NO: 310039 - DNA, 20 bp, Artificial
  CRISPR gRNA sequence
aatgctatcgccatgctatg

SEQ ID NO: 310040 - DNA, 20 bp, Artificial
  CRISPR gRNA sequence
tcgccatgctatgctccttc

SEQ ID NO: 310041 - DNA, 20 bp, Artificial
  CRISPR gRNA sequence
tgctccttcttctaggccag

SEQ ID NO: 310042 - DNA, 20 bp, Artificial
  CRISPR gRNA sequence
cttcttctaggccagtgagg

SEQ ID NO: 310043 - DNA, 20 bp, Artificial
  CRISPR gRNA sequence
cttctaggccagtgagggga

SEQ ID NO: 310044 - DNA, 20 bp, Artificial
  CRISPR gRNA sequence
ttctaggccagtgaggggaa

SEQ ID NO: 310045 - DNA, 20 bp, Artificial
  CRISPR gRNA sequence
ctaggccagtgaggggaacg

SEQ ID NO: 310046 - DNA, 20 bp, Artificial
  CRISPR gRNA sequence
taggccagtgaggggaacgc

SEQ ID NO: 310047 - DNA, 20 bp, Artificial
  CRISPR gRNA sequence
ggccagtgaggggaacgcat

SEQ ID NO: 310048 - DNA, 20 bp, Artificial
  CRISPR gRNA sequence
ttcattttaatatttcagtt

SEQ ID NO: 310049 - DNA, 20 bp, Artificial
  CRISPR gRNA sequence
cattttaatatttcagttgc

SEQ ID NO: 310050 - DNA, 20 bp, Artificial
  CRISPR gRNA sequence
attttaatatttcagttgcc

SEQ ID NO: 310051 - DNA, 20 bp, Artificial
  CRISPR gRNA sequence
taatatttcagttgcctaca

SEQ ID NO: 310052 - DNA, 20 bp, Artificial
  CRISPR gRNA sequence
aatatttcagttgcctacaa

SEQ ID NO: 310053 - DNA, 20 bp, Artificial
  CRISPR gRNA sequence
atatttcagttgcctacaat

SEQ ID NO: 310054 - DNA, 20 bp, Artificial
  CRISPR gRNA sequence
cagttgcctacaatattgga

SEQ ID NO: 310055 - DNA, 20 bp, Artificial
  CRISPR gRNA sequence
agttgcctacaatattggaa

SEQ ID NO: 310056 - DNA, 20 bp, Artificial
  CRISPR gRNA sequence
cctacaatattggaaggtgg

SEQ ID NO: 310057 - DNA, 20 bp, Artificial
  CRISPR gRNA sequence
caatattggaaggtggataa

SEQ ID NO: 310058 - DNA, 20 bp, Artificial
  CRISPR gRNA sequence
gaaggtggataaaagcaccc

SEQ ID NO: 310059 - DNA, 20 bp, Artificial
  CRISPR gRNA sequence
tgctccttctaaatctgcga

SEQ ID NO: 310060 - DNA, 20 bp, Artificial
  CRISPR gRNA sequence
ctccttctaaatctgcgaag

SEQ ID NO: 310061 - DNA, 20 bp, Artificial
  CRISPR gRNA sequence
cttctaaatctgcgaagaca

SEQ ID NO: 310062 - DNA, 20 bp, Artificial
  CRISPR gRNA sequence
ctaaatctgcgaagacattt

SEQ ID NO: 310063 - DNA, 20 bp, Artificial
  CRISPR gRNA sequence
taaatctgcgaagacatttc

SEQ ID NO: 310064 - DNA, 20 bp, Artificial
  CRISPR gRNA sequence
aatctgcgaagacatttctt

SEQ ID NO: 310065 - DNA, 20 bp, Artificial
  CRISPR gRNA sequence
cgaagacatttcttctctgc

SEQ ID NO: 310066 - DNA, 20 bp, Artificial
  CRISPR gRNA sequence
cttctctgcacctactcatc

SEQ ID NO: 310067 - DNA, 20 bp, Artificial
  CRISPR gRNA sequence
ttctctgcacctactcatcc

SEQ ID NO: 310068 - DNA, 20 bp, Artificial
  CRISPR gRNA sequence
ctctgcacctactcatcctt

SEQ ID NO: 310069 - DNA, 20 bp, Artificial
  CRISPR gRNA sequence
tctgcacctactcatccttg

SEQ ID NO: 310070 - DNA, 20 bp, Artificial
  CRISPR gRNA sequence
tgcacctactcatccttgat

SEQ ID NO: 310071 - DNA, 20 bp, Artificial
  CRISPR gRNA sequence
cacctactcatccttgatgc

SEQ ID NO: 310072 - DNA, 20 bp, Artificial
  CRISPR gRNA sequence
ctcatccttgatgcagctct

SEQ ID NO: 310073 - DNA, 20 bp, Artificial
  CRISPR gRNA sequence
atccttgatgcagctctcct

SEQ ID NO: 310074 - DNA, 20 bp, Artificial
  CRISPR gRNA sequence
gatgcagctctcctcatgtc

SEQ ID NO: 310075 - DNA, 20 bp, Artificial
  CRISPR gRNA sequence
atgcagctctcctcatgtct

SEQ ID NO: 310076 - DNA, 20 bp, Artificial
  CRISPR gRNA sequence
tcctcatgtctgtatggaaa

SEQ ID NO: 310077 - DNA, 20 bp, Artificial
  CRISPR gRNA sequence
ctcatgtctgtatggaaaca

SEQ ID NO: 310078 - DNA, 20 bp, Artificial
  CRISPR gRNA sequence
atgtctgtatggaaacactg

SEQ ID NO: 310079 - DNA, 20 bp, Artificial
  CRISPR gRNA sequence
tatggaaacactgtgctctc

SEQ ID NO: 310080 - DNA, 20 bp, Artificial
  CRISPR gRNA sequence
tgctctcaaatgagtttcag

SEQ ID NO: 310081 - DNA, 20 bp, Artificial
  CRISPR gRNA sequence
tcaaatgagtttcagaaaga

SEQ ID NO: 310082 - DNA, 20 bp, Artificial
  CRISPR gRNA sequence
aaatgagtttcagaaagaac

SEQ ID NO: 310083 - DNA, 20 bp, Artificial
  CRISPR gRNA sequence
cagaaagaacaactcacgaa

SEQ ID NO: 310084 - DNA, 20 bp, Artificial
  CRISPR gRNA sequence
agaaagaacaactcacgaaa

SEQ ID NO: 310085 - DNA, 20 bp, Artificial
  CRISPR gRNA sequence
acgaaagaaaacaagcattc

SEQ ID NO: 310086 - DNA, 20 bp, Artificial
  CRISPR gRNA sequence
ggtcagaaaaatctccacaa

SEQ ID NO: 310087 - DNA, 20 bp, Artificial
  CRISPR gRNA sequence
cacaaatggggaataagggg

SEQ ID NO: 310088 - DNA, 20 bp, Artificial
  CRISPR gRNA sequence
gctccaaggagagactggaa

SEQ ID NO: 310089 - DNA, 20 bp, Artificial
  CRISPR gRNA sequence
ctccaaggagagactggaaa

SEQ ID NO: 310090 - DNA, 20 bp, Artificial
  CRISPR gRNA sequence
caaggagagactggaaacca

SEQ ID NO: 310091 - DNA, 20 bp, Artificial
  CRISPR gRNA sequence
gaaaccaagtcagacataaa

SEQ ID NO: 310092 - DNA, 20 bp, Artificial
  CRISPR gRNA sequence
agctagaaggagacatggct

SEQ ID NO: 310093 - DNA, 20 bp, Artificial
  CRISPR gRNA sequence
gaaggagacatggctggtgg

SEQ ID NO: 310094 - DNA, 20 bp, Artificial
  CRISPR gRNA sequence
gtgggagcttgaggaaaaca

SEQ ID NO: 310095 - DNA, 20 bp, Artificial
  CRISPR gRNA sequence
gaggaaaacagagctcagga

SEQ ID NO: 310096 - DNA, 20 bp, Artificial
  CRISPR gRNA sequence
aggaaaacagagctcaggat

SEQ ID NO: 310097 - DNA, 20 bp, Artificial
  CRISPR gRNA sequence
aggatggaggacgtctccac

SEQ ID NO: 310098 - DNA, 20 bp, Artificial
  CRISPR gRNA sequence
cacctccagtcatgtcctct

SEQ ID NO: 310099 - DNA, 20 bp, Artificial
  CRISPR gRNA sequence
cagtcatgtcctctgtccac

SEQ ID NO: 310100 - DNA, 20 bp, Artificial
  CRISPR gRNA sequence
tgtccaccagacaccaagaa

SEQ ID NO: 310101 - DNA, 20 bp, Artificial
  CRISPR gRNA sequence
tccaccagacaccaagaagt

SEQ ID NO: 310102 - DNA, 20 bp, Artificial
  CRISPR gRNA sequence
atgttccatcgaggcagccc

SEQ ID NO: 310103 - DNA, 20 bp, Artificial
  CRISPR gRNA sequence
catcgaggcagccctcacac

SEQ ID NO: 310104 - DNA, 20 bp, Artificial
  CRISPR gRNA sequence
acacccatcccttcctcatc

SEQ ID NO: 310105 - DNA, 20 bp, Artificial
  CRISPR gRNA sequence
cctcatcatgccgactgcct

SEQ ID NO: 310106 - DNA, 20 bp, Artificial
  CRISPR gRNA sequence
ctcatcatgccgactgcctc

SEQ ID NO: 310107 - DNA, 20 bp, Artificial
  CRISPR gRNA sequence
atcatgccgactgcctcttt

SEQ ID NO: 310108 - DNA, 20 bp, Artificial
  CRISPR gRNA sequence
cctctttactgcttcaggct

SEQ ID NO: 310109 - DNA, 20 bp, Artificial
  CRISPR gRNA sequence
tttactgcttcaggctcacc

SEQ ID NO: 310110 - DNA, 20 bp, Artificial
  CRISPR gRNA sequence
tactgcttcaggctcaccat

SEQ ID NO: 310111 - DNA, 20 bp, Artificial
  CRISPR gRNA sequence
actgcttcaggctcaccatc

SEQ ID NO: 310112 - DNA, 20 bp, Artificial
  CRISPR gRNA sequence
ctgcttcaggctcaccatct

SEQ ID NO: 310113 - DNA, 20 bp, Artificial
  CRISPR gRNA sequence
cttcaggctcaccatctcaa

SEQ ID NO: 310114 - DNA, 20 bp, Artificial
  CRISPR gRNA sequence
caggctcaccatctcaagtc

SEQ ID NO: 310115 - DNA, 20 bp, Artificial
  CRISPR gRNA sequence
aggctcaccatctcaagtcg

SEQ ID NO: 310116 - DNA, 20 bp, Artificial
  CRISPR gRNA sequence
accatctcaagtcgacgagc

SEQ ID NO: 310117 - DNA, 20 bp, Artificial
  CRISPR gRNA sequence
aagtcgacgagcctgtaata

SEQ ID NO: 310118 - DNA, 20 bp, Artificial
  CRISPR gRNA sequence
taatactggctttcttgatc

SEQ ID NO: 310119 - DNA, 20 bp, Artificial
  CRISPR gRNA sequence
gctttcttgatcaccctgat

SEQ ID NO: 310120 - DNA, 20 bp, Artificial
  CRISPR gRNA sequence
tcttgatcaccctgatacca

SEQ ID NO: 310121 - DNA, 20 bp, Artificial
  CRISPR gRNA sequence
cttgatcaccctgataccag

SEQ ID NO: 310122 - DNA, 20 bp, Artificial
  CRISPR gRNA sequence
ttgatcaccctgataccagc

SEQ ID NO: 310123 - DNA, 20 bp, Artificial
  CRISPR gRNA sequence
gatcaccctgataccagccg

SEQ ID NO: 310124 - DNA, 20 bp, Artificial
  CRISPR gRNA sequence
atcaccctgataccagccgt

SEQ ID NO: 310125 - DNA, 20 bp, Artificial
  CRISPR gRNA sequence
ataccagccgtcacctcttg

SEQ ID NO: 310126 - DNA, 20 bp, Artificial
  CRISPR gRNA sequence
ttgacaggcttattttcttt

SEQ ID NO: 310127 - DNA, 20 bp, Artificial
  CRISPR gRNA sequence
gacaggcttattttctttaa

SEQ ID NO: 310128 - DNA, 20 bp, Artificial
  CRISPR gRNA sequence
acaggcttattttctttaag

SEQ ID NO: 310129 - DNA, 20 bp, Artificial
  CRISPR gRNA sequence
attttctttaagctgtcatt

SEQ ID NO: 310130 - DNA, 20 bp, Artificial
  CRISPR gRNA sequence
ttttctttaagctgtcatta

SEQ ID NO: 310131 - DNA, 20 bp, Artificial
  CRISPR gRNA sequence
tctttaagctgtcattacac

SEQ ID NO: 310132 - DNA, 20 bp, Artificial
  CRISPR gRNA sequence
ctttaagctgtcattacacc

SEQ ID NO: 310133 - DNA, 20 bp, Artificial
  CRISPR gRNA sequence
tttaagctgtcattacacca

SEQ ID NO: 310134 - DNA, 20 bp, Artificial
  CRISPR gRNA sequence
taagctgtcattacaccatt

SEQ ID NO: 310135 - DNA, 20 bp, Artificial
  CRISPR gRNA sequence
aagctgtcattacaccattt

SEQ ID NO: 310136 - DNA, 20 bp, Artificial
  CRISPR gRNA sequence
agctgtcattacaccatttt

SEQ ID NO: 310137 - DNA, 20 bp, Artificial
  CRISPR gRNA sequence
tcattacaccatttttctgc

SEQ ID NO: 310138 - DNA, 20 bp, Artificial
  CRISPR gRNA sequence
caccatttttctgctcccaa

SEQ ID NO: 310139 - DNA, 20 bp, Artificial
  CRISPR gRNA sequence
ttctgctcccaaactattaa

SEQ ID NO: 310140 - DNA, 20 bp, Artificial
  CRISPR gRNA sequence
tctgctcccaaactattaat

SEQ ID NO: 310141 - DNA, 20 bp, Artificial
  CRISPR gRNA sequence
ctgctcccaaactattaatt

SEQ ID NO: 310142 - DNA, 20 bp, Artificial
  CRISPR gRNA sequence
tgctcccaaactattaattc

SEQ ID NO: 310143 - DNA, 20 bp, Artificial
  CRISPR gRNA sequence
ctcccaaactattaattcca

SEQ ID NO: 310144 - DNA, 20 bp, Artificial
  CRISPR gRNA sequence
ccaaactattaattccaaac

SEQ ID NO: 310145 - DNA, 20 bp, Artificial
  CRISPR gRNA sequence
ttaattccaaacttccaatt

SEQ ID NO: 310146 - DNA, 20 bp, Artificial
  CRISPR gRNA sequence
attccaaacttccaattttc

SEQ ID NO: 310147 - DNA, 20 bp, Artificial
  CRISPR gRNA sequence
caaacttccaattttctgtt

SEQ ID NO: 310148 - DNA, 20 bp, Artificial
  CRISPR gRNA sequence
ccaattttctgttaaattaa

SEQ ID NO: 310149 - DNA, 20 bp, Artificial
  CRISPR gRNA sequence
caattttctgttaaattaaa

SEQ ID NO: 310150 - DNA, 20 bp, Artificial
  CRISPR gRNA sequence
tctgttaaattaaatatgaa

SEQ ID NO: 310151 - DNA, 20 bp, Artificial
  CRISPR gRNA sequence
ctgttaaattaaatatgaat

SEQ ID NO: 310152 - DNA, 20 bp, Artificial
  CRISPR gRNA sequence
tgttaaattaaatatgaatt

SEQ ID NO: 310153 - DNA, 20 bp, Artificial
  CRISPR gRNA sequence
ttaaattaaatatgaattcc

SEQ ID NO: 310154 - DNA, 20 bp, Artificial
  CRISPR gRNA sequence
aattaaatatgaattcctta

SEQ ID NO: 310155 - DNA, 20 bp, Artificial
  CRISPR gRNA sequence
aatatgaattccttatttga

SEQ ID NO: 310156 - DNA, 20 bp, Artificial
  CRISPR gRNA sequence
cttatttgactttccatgcc

SEQ ID NO: 310157 - DNA, 20 bp, Artificial
  CRISPR gRNA sequence
atttgactttccatgcccta

SEQ ID NO: 310158 - DNA, 20 bp, Artificial
  CRISPR gRNA sequence
tttgactttccatgccctat

SEQ ID NO: 310159 - DNA, 20 bp, Artificial
  CRISPR gRNA sequence
gactttccatgccctattag

SEQ ID NO: 310160 - DNA, 20 bp, Artificial
  CRISPR gRNA sequence
actttccatgccctattagg

SEQ ID NO: 310161 - DNA, 20 bp, Artificial
  CRISPR gRNA sequence
tccatgccctattaggctat

SEQ ID NO: 310162 - DNA, 20 bp, Artificial
  CRISPR gRNA sequence
ccatgccctattaggctatc

SEQ ID NO: 310163 - DNA, 20 bp, Artificial
  CRISPR gRNA sequence
catgccctattaggctatct

SEQ ID NO: 310164 - DNA, 20 bp, Artificial
  CRISPR gRNA sequence
ttaggctatcttgctccttg

SEQ ID NO: 310165 - DNA, 20 bp, Artificial
  CRISPR gRNA sequence
ggctatcttgctccttgctt

SEQ ID NO: 310166 - DNA, 20 bp, Artificial
  CRISPR gRNA sequence
tcttgctccttgctttactt

SEQ ID NO: 310167 - DNA, 20 bp, Artificial
  CRISPR gRNA sequence
gctccttgctttacttatag

SEQ ID NO: 310168 - DNA, 20 bp, Artificial
  CRISPR gRNA sequence
ctccttgctttacttataga

SEQ ID NO: 310169 - DNA, 20 bp, Artificial
  CRISPR gRNA sequence
cttgctttacttatagaaac

SEQ ID NO: 310170 - DNA, 20 bp, Artificial
  CRISPR gRNA sequence
gctttacttatagaaactaa

SEQ ID NO: 310171 - DNA, 20 bp, Artificial
  CRISPR gRNA sequence
ctttacttatagaaactaat

SEQ ID NO: 310172 - DNA, 20 bp, Artificial
  CRISPR gRNA sequence
tacttatagaaactaatctc

SEQ ID NO: 310173 - DNA, 20 bp, Artificial
  CRISPR gRNA sequence
acttatagaaactaatctcc

SEQ ID NO: 310174 - DNA, 20 bp, Artificial
  CRISPR gRNA sequence
cttatagaaactaatctccc

SEQ ID NO: 310175 - DNA, 20 bp, Artificial
  CRISPR gRNA sequence
atagaaactaatctcccatt

SEQ ID NO: 310176 - DNA, 20 bp, Artificial
  CRISPR gRNA sequence
tagaaactaatctcccatta

SEQ ID NO: 310177 - DNA, 20 bp, Artificial
  CRISPR gRNA sequence
atctcccattatttatccaa

SEQ ID NO: 310178 - DNA, 20 bp, Artificial
  CRISPR gRNA sequence
ccattatttatccaaagaca

SEQ ID NO: 310179 - DNA, 20 bp, Artificial
  CRISPR gRNA sequence
tttatccaaagacaacctct

SEQ ID NO: 310180 - DNA, 20 bp, Artificial
  CRISPR gRNA sequence
atccaaagacaacctctgct

SEQ ID NO: 310181 - DNA, 20 bp, Artificial
  CRISPR gRNA sequence
tccaaagacaacctctgctg

SEQ ID NO: 310182 - DNA, 20 bp, Artificial
  CRISPR gRNA sequence
tgctgcaggccagtcagctt

SEQ ID NO: 310183 - DNA, 20 bp, Artificial
  CRISPR gRNA sequence
ctgcaggccagtcagctttt

SEQ ID NO: 310184 - DNA, 20 bp, Artificial
  CRISPR gRNA sequence
caggccagtcagcttttctt

SEQ ID NO: 310185 - DNA, 20 bp, Artificial
  CRISPR gRNA sequence
ttcttactgtcctgtaaaaa

SEQ ID NO: 310186 - DNA, 20 bp, Artificial
  CRISPR gRNA sequence
tcttactgtcctgtaaaaat

SEQ ID NO: 310187 - DNA, 20 bp, Artificial
  CRISPR gRNA sequence
cttactgtcctgtaaaaatt

SEQ ID NO: 310188 - DNA, 20 bp, Artificial
  CRISPR gRNA sequence
ttactgtcctgtaaaaattc

SEQ ID NO: 310189 - DNA, 20 bp, Artificial
  CRISPR gRNA sequence
actgtcctgtaaaaattcca

SEQ ID NO: 310190 - DNA, 20 bp, Artificial
  CRISPR gRNA sequence
ctgtcctgtaaaaattccat

SEQ ID NO: 310191 - DNA, 20 bp, Artificial
  CRISPR gRNA sequence
tcctgtaaaaattccatggt

SEQ ID NO: 310192 - DNA, 20 bp, Artificial
  CRISPR gRNA sequence
taaaaattccatggtcactc

SEQ ID NO: 310193 - DNA, 20 bp, Artificial
  CRISPR gRNA sequence
catggtcactcctccatttc

SEQ ID NO: 310194 - DNA, 20 bp, Artificial
  CRISPR gRNA sequence
ctccatttccatgtgtcctt

SEQ ID NO: 310195 - DNA, 20 bp, Artificial
  CRISPR gRNA sequence
catttccatgtgtccttaaa

SEQ ID NO: 310196 - DNA, 20 bp, Artificial
  CRISPR gRNA sequence
ccatgtgtccttaaaaactg

SEQ ID NO: 310197 - DNA, 20 bp, Artificial
  CRISPR gRNA sequence
catgtgtccttaaaaactgt

SEQ ID NO: 310198 - DNA, 20 bp, Artificial
  CRISPR gRNA sequence
aaaaactgttatttgattgt

SEQ ID NO: 310199 - DNA, 20 bp, Artificial
  CRISPR gRNA sequence
aaaactgttatttgattgtg

SEQ ID NO: 310200 - DNA, 20 bp, Artificial
  CRISPR gRNA sequence
ttatttgattgtgtctcaga

SEQ ID NO: 310201 - DNA, 20 bp, Artificial
  CRISPR gRNA sequence
tttgattgtgtctcagaaag

SEQ ID NO: 310202 - DNA, 20 bp, Artificial
  CRISPR gRNA sequence
gattgtgtctcagaaagtcg

SEQ ID NO: 310203 - DNA, 20 bp, Artificial
  CRISPR gRNA sequence
attgtgtctcagaaagtcgt

SEQ ID NO: 310204 - DNA, 20 bp, Artificial
  CRISPR gRNA sequence
tgtctcagaaagtcgtcaaa

SEQ ID NO: 310205 - DNA, 20 bp, Artificial
  CRISPR gRNA sequence
agaaagtcgtcaaagaatat

SEQ ID NO: 310206 - DNA, 20 bp, Artificial
  CRISPR gRNA sequence
tacttgatgttatgtgtgta

SEQ ID NO: 310207 - DNA, 20 bp, Artificial
  CRISPR gRNA sequence
gatgttatgtgtgtatcaaa

SEQ ID NO: 310208 - DNA, 20 bp, Artificial
  CRISPR gRNA sequence
atgttatgtgtgtatcaaaa

SEQ ID NO: 310209 - DNA, 20 bp, Artificial
  CRISPR gRNA sequence
tgtgtgtatcaaaaatatgg

SEQ ID NO: 310210 - DNA, 20 bp, Artificial
  CRISPR gRNA sequence
aaatatttatccagtgaaac

SEQ ID NO: 310211 - DNA, 20 bp, Artificial
  CRISPR gRNA sequence
atccagtgaaactcaatcaa

SEQ ID NO: 310212 - DNA, 20 bp, Artificial
  CRISPR gRNA sequence
tccagtgaaactcaatcaac

SEQ ID NO: 310213 - DNA, 20 bp, Artificial
  CRISPR gRNA sequence
aatcaacactaaaaagtggt

SEQ ID NO: 310214 - DNA, 20 bp, Artificial
  CRISPR gRNA sequence
aaaagtggttctttcggaag

SEQ ID NO: 310215 - DNA, 20 bp, Artificial
  CRISPR gRNA sequence
tttcggaagcatcagttctt

SEQ ID NO: 310216 - DNA, 20 bp, Artificial
  CRISPR gRNA sequence
tcggaagcatcagttctttg

SEQ ID NO: 310217 - DNA, 20 bp, Artificial
  CRISPR gRNA sequence
cggaagcatcagttctttga

SEQ ID NO: 310218 - DNA, 20 bp, Artificial
  CRISPR gRNA sequence
ggaagcatcagttctttgag

SEQ ID NO: 310219 - DNA, 20 bp, Artificial
  CRISPR gRNA sequence
tttgagacccattaaacaga

SEQ ID NO: 310220 - DNA, 20 bp, Artificial
  CRISPR gRNA sequence
tgagacccattaaacagatg

SEQ ID NO: 310221 - DNA, 20 bp, Artificial
  CRISPR gRNA sequence
gagacccattaaacagatgc

SEQ ID NO: 310222 - DNA, 20 bp, Artificial
  CRISPR gRNA sequence
agacccattaaacagatgcc

SEQ ID NO: 310223 - DNA, 20 bp, Artificial
  CRISPR gRNA sequence
aacagatgcctcggatgcag

SEQ ID NO: 310224 - DNA, 20 bp, Artificial
  CRISPR gRNA sequence
ggatgcagggttatatatta

SEQ ID NO: 310225 - DNA, 20 bp, Artificial
  CRISPR gRNA sequence
tatattatcaggaatctgtc

SEQ ID NO: 310226 - DNA, 20 bp, Artificial
  CRISPR gRNA sequence
tcaggaatctgtctagggaa

SEQ ID NO: 310227 - DNA, 20 bp, Artificial
  CRISPR gRNA sequence
tctagggaagaattattgga

SEQ ID NO: 310228 - DNA, 20 bp, Artificial
  CRISPR gRNA sequence
gggaagaattattggaagct

SEQ ID NO: 310229 - DNA, 20 bp, Artificial
  CRISPR gRNA sequence
ttggaagcttgcaaagcctt

SEQ ID NO: 310230 - DNA, 20 bp, Artificial
  CRISPR gRNA sequence
gaagcttgcaaagcctttca

SEQ ID NO: 310231 - DNA, 20 bp, Artificial
  CRISPR gRNA sequence
gcaaagcctttcaaggacag

SEQ ID NO: 310232 - DNA, 20 bp, Artificial
  CRISPR gRNA sequence
caaagcctttcaaggacaga

SEQ ID NO: 310233 - DNA, 20 bp, Artificial
  CRISPR gRNA sequence
tcaaggacagaggacgatag

SEQ ID NO: 310234 - DNA, 20 bp, Artificial
  CRISPR gRNA sequence
caaggacagaggacgatagc

SEQ ID NO: 310235 - DNA, 20 bp, Artificial
  CRISPR gRNA sequence
aaggacagaggacgatagct

SEQ ID NO: 310236 - DNA, 20 bp, Artificial
  CRISPR gRNA sequence
ccacgttgagttctaggaaa

SEQ ID NO: 310237 - DNA, 20 bp, Artificial
  CRISPR gRNA sequence
agttctaggaaattaaccat

SEQ ID NO: 310238 - DNA, 20 bp, Artificial
  CRISPR gRNA sequence
taggaaattaaccattgtta

SEQ ID NO: 310239 - DNA, 20 bp, Artificial
  CRISPR gRNA sequence
ggaaattaaccattgttatt

SEQ ID NO: 310240 - DNA, 20 bp, Artificial
  CRISPR gRNA sequence
accattgttattgttaaagg

SEQ ID NO: 310241 - DNA, 20 bp, Artificial
  CRISPR gRNA sequence
ttattgttaaaggaagacag

SEQ ID NO: 310242 - DNA, 20 bp, Artificial
  CRISPR gRNA sequence
ttgttaaaggaagacagcgt

SEQ ID NO: 310243 - DNA, 20 bp, Artificial
  CRISPR gRNA sequence
ttaaaggaagacagcgtttc

SEQ ID NO: 310244 - DNA, 20 bp, Artificial
  CRISPR gRNA sequence
aaggaagacagcgtttctca

SEQ ID NO: 310245 - DNA, 20 bp, Artificial
  CRISPR gRNA sequence
ctcagaggaagactgttaaa

SEQ ID NO: 310246 - DNA, 20 bp, Artificial
  CRISPR gRNA sequence
tcagaggaagactgttaaac

SEQ ID NO: 310247 - DNA, 20 bp, Artificial
  CRISPR gRNA sequence
agaggaagactgttaaacag

SEQ ID NO: 310248 - DNA, 20 bp, Artificial
  CRISPR gRNA sequence
ttaaacagtgcagtggccca

SEQ ID NO: 310249 - DNA, 20 bp, Artificial
  CRISPR gRNA sequence
aacagtgcagtggcccaggc

SEQ ID NO: 310250 - DNA, 20 bp, Artificial
  CRISPR gRNA sequence
acagccctcataagtgggag

SEQ ID NO: 310251 - DNA, 20 bp, Artificial
  CRISPR gRNA sequence
ataagtgggagtatcagaat

SEQ ID NO: 310252 - DNA, 20 bp, Artificial
  CRISPR gRNA sequence
aattacttaaaaccaataca

SEQ ID NO: 310253 - DNA, 20 bp, Artificial
  CRISPR gRNA sequence
attacttaaaaccaatacag

SEQ ID NO: 310254 - DNA, 20 bp, Artificial
  CRISPR gRNA sequence
cttaaaaccaatacagggtg

SEQ ID NO: 310255 - DNA, 20 bp, Artificial
  CRISPR gRNA sequence
aaaaccaatacagggtggaa

SEQ ID NO: 310256 - DNA, 20 bp, Artificial
  CRISPR gRNA sequence
aaaccaatacagggtggaac

SEQ ID NO: 310257 - DNA, 20 bp, Artificial
  CRISPR gRNA sequence
catctgctataacagaaatc

SEQ ID NO: 310258 - DNA, 20 bp, Artificial
  CRISPR gRNA sequence
atctgctataacagaaatca

SEQ ID NO: 310259 - DNA, 20 bp, Artificial
  CRISPR gRNA sequence
ctataacagaaatcaactcg

SEQ ID NO: 310260 - DNA, 20 bp, Artificial
  CRISPR gRNA sequence
taacagaaatcaactcgtgc

SEQ ID NO: 310261 - DNA, 20 bp, Artificial
  CRISPR gRNA sequence
gtgcaagttctaacatgcag

SEQ ID NO: 310262 - DNA, 20 bp, Artificial
  CRISPR gRNA sequence
taacatgcagggtacagttc

SEQ ID NO: 310263 - DNA, 20 bp, Artificial
  CRISPR gRNA sequence
acatgcagggtacagttctg

SEQ ID NO: 310264 - DNA, 20 bp, Artificial
  CRISPR gRNA sequence
tgagaccaagtctgactcac

SEQ ID NO: 310265 - DNA, 20 bp, Artificial
  CRISPR gRNA sequence
agaccaagtctgactcacct

SEQ ID NO: 310266 - DNA, 20 bp, Artificial
  CRISPR gRNA sequence
actcacctgtcaaagctcag

SEQ ID NO: 310267 - DNA, 20 bp, Artificial
  CRISPR gRNA sequence
acctgtcaaagctcagctca

SEQ ID NO: 310268 - DNA, 20 bp, Artificial
  CRISPR gRNA sequence
tcaaagctcagctcaactat

SEQ ID NO: 310269 - DNA, 20 bp, Artificial
  CRISPR gRNA sequence
agctcaactattaccacctt

SEQ ID NO: 310270 - DNA, 20 bp, Artificial
  CRISPR gRNA sequence
aactattaccacctttacac

SEQ ID NO: 310271 - DNA, 20 bp, Artificial
  CRISPR gRNA sequence
ttaccacctttacaccaccc

SEQ ID NO: 310272 - DNA, 20 bp, Artificial
  CRISPR gRNA sequence
ccacctttacaccacccttc

SEQ ID NO: 310273 - DNA, 20 bp, Artificial
  CRISPR gRNA sequence
tacaccacccttccaagctg

SEQ ID NO: 310274 - DNA, 20 bp, Artificial
  CRISPR gRNA sequence
acaccacccttccaagctgt

SEQ ID NO: 310275 - DNA, 20 bp, Artificial
  CRISPR gRNA sequence
caccacccttccaagctgta

SEQ ID NO: 310276 - DNA, 20 bp, Artificial
  CRISPR gRNA sequence
ccaagctgtaggagtgcttg

SEQ ID NO: 310277 - DNA, 20 bp, Artificial
  CRISPR gRNA sequence
caagctgtaggagtgcttgc

SEQ ID NO: 310278 - DNA, 20 bp, Artificial
  CRISPR gRNA sequence
taggagtgcttgctgttctc

SEQ ID NO: 310279 - DNA, 20 bp, Artificial
  CRISPR gRNA sequence
gctgttctccatgtcttctg

SEQ ID NO: 310280 - DNA, 20 bp, Artificial
  CRISPR gRNA sequence
ctgttctccatgtcttctga

SEQ ID NO: 310281 - DNA, 20 bp, Artificial
  CRISPR gRNA sequence
ttctccatgtcttctgaagc

SEQ ID NO: 310282 - DNA, 20 bp, Artificial
  CRISPR gRNA sequence
tccatgtcttctgaagccct

SEQ ID NO: 310283 - DNA, 20 bp, Artificial
  CRISPR gRNA sequence
catgtcttctgaagccctgg

SEQ ID NO: 310284 - DNA, 20 bp, Artificial
  CRISPR gRNA sequence
ctgaagccctggatcacttg

SEQ ID NO: 310285 - DNA, 20 bp, Artificial
  CRISPR gRNA sequence
tgaagccctggatcacttgt

SEQ ID NO: 310286 - DNA, 20 bp, Artificial
  CRISPR gRNA sequence
aagccctggatcacttgtag

SEQ ID NO: 310287 - DNA, 20 bp, Artificial
  CRISPR gRNA sequence
gatcacttgtagccagctca

SEQ ID NO: 310288 - DNA, 20 bp, Artificial
  CRISPR gRNA sequence
gtagccagctcagcagactc

SEQ ID NO: 310289 - DNA, 20 bp, Artificial
  CRISPR gRNA sequence
tagccagctcagcagactct

SEQ ID NO: 310290 - DNA, 20 bp, Artificial
  CRISPR gRNA sequence
agcagactctacccagacag

SEQ ID NO: 310291 - DNA, 20 bp, Artificial
  CRISPR gRNA sequence
tacccagacagggatccttt

SEQ ID NO: 310292 - DNA, 20 bp, Artificial
  CRISPR gRNA sequence
cccagacagggatcctttaa

SEQ ID NO: 310293 - DNA, 20 bp, Artificial
  CRISPR gRNA sequence
taaatgtaccatattgtcta

SEQ ID NO: 310294 - DNA, 20 bp, Artificial
  CRISPR gRNA sequence
aaatgtaccatattgtctac

SEQ ID NO: 310295 - DNA, 20 bp, Artificial
  CRISPR gRNA sequence
aatgtaccatattgtctact

SEQ ID NO: 310296 - DNA, 20 bp, Artificial
  CRISPR gRNA sequence
tctactgtgttaaaaatgag

SEQ ID NO: 310297 - DNA, 20 bp, Artificial
  CRISPR gRNA sequence
ctgtgttaaaaatgagagga

SEQ ID NO: 310298 - DNA, 20 bp, Artificial
  CRISPR gRNA sequence
tgttaaaaatgagaggaact

SEQ ID NO: 310299 - DNA, 20 bp, Artificial
  CRISPR gRNA sequence
aaaatgagaggaactgactc

SEQ ID NO: 310300 - DNA, 20 bp, Artificial
  CRISPR gRNA sequence
actcagggtgagagcgatgg

SEQ ID NO: 310301 - DNA, 20 bp, Artificial
  CRISPR gRNA sequence
agggtgagagcgatggagtg

SEQ ID NO: 310302 - DNA, 20 bp, Artificial
  CRISPR gRNA sequence
tcctttatttctccttattc

SEQ ID NO: 310303 - DNA, 20 bp, Artificial
  CRISPR gRNA sequence
ctttatttctccttattcct

SEQ ID NO: 310304 - DNA, 20 bp, Artificial
  CRISPR gRNA sequence
tatttctccttattcctgga

SEQ ID NO: 310305 - DNA, 20 bp, Artificial
  CRISPR gRNA sequence
atttctccttattcctggaa

SEQ ID NO: 310306 - DNA, 20 bp, Artificial
  CRISPR gRNA sequence
tttctccttattcctggaaa

SEQ ID NO: 310307 - DNA, 20 bp, Artificial
  CRISPR gRNA sequence
ctccttattcctggaaatgt

SEQ ID NO: 310308 - DNA, 20 bp, Artificial
  CRISPR gRNA sequence
tccttattcctggaaatgta

SEQ ID NO: 310309 - DNA, 20 bp, Artificial
  CRISPR gRNA sequence
cttattcctggaaatgtaat

SEQ ID NO: 310310 - DNA, 20 bp, Artificial
  CRISPR gRNA sequence
attcctggaaatgtaatgag

SEQ ID NO: 310311 - DNA, 20 bp, Artificial
  CRISPR gRNA sequence
ttcctggaaatgtaatgaga

SEQ ID NO: 310312 - DNA, 20 bp, Artificial
  CRISPR gRNA sequence
ctggaaatgtaatgagaatc

SEQ ID NO: 310313 - DNA, 20 bp, Artificial
  CRISPR gRNA sequence
gaaatgtaatgagaatctta

SEQ ID NO: 310314 - DNA, 20 bp, Artificial
  CRISPR gRNA sequence
agaggtgaactgaaaagtta

SEQ ID NO: 310315 - DNA, 20 bp, Artificial
  CRISPR gRNA sequence
gaggtgaactgaaaagttat

SEQ ID NO: 310316 - DNA, 20 bp, Artificial
  CRISPR gRNA sequence
aaaagttatgagttcaacca

SEQ ID NO: 310317 - DNA, 20 bp, Artificial
  CRISPR gRNA sequence
tgagttcaaccacttactca

SEQ ID NO: 310318 - DNA, 20 bp, Artificial
  CRISPR gRNA sequence
aaccacttactcaattcgag

SEQ ID NO: 310319 - DNA, 20 bp, Artificial
  CRISPR gRNA sequence
actcaattcgagattcgctc

SEQ ID NO: 310320 - DNA, 20 bp, Artificial
  CRISPR gRNA sequence
ctcaattcgagattcgctcc

SEQ ID NO: 310321 - DNA, 20 bp, Artificial
  CRISPR gRNA sequence
aattcgagattcgctcctaa

SEQ ID NO: 310322 - DNA, 20 bp, Artificial
  CRISPR gRNA sequence
gagattcgctcctaaaatgt

SEQ ID NO: 310323 - DNA, 20 bp, Artificial
  CRISPR gRNA sequence
gctcctaaaatgtctcttct

SEQ ID NO: 310324 - DNA, 20 bp, Artificial
  CRISPR gRNA sequence
ctaaaatgtctcttctgtgt

SEQ ID NO: 310325 - DNA, 20 bp, Artificial
  CRISPR gRNA sequence
aaatgtctcttctgtgttat

SEQ ID NO: 310326 - DNA, 20 bp, Artificial
  CRISPR gRNA sequence
ttctgtgttatcacccccac

SEQ ID NO: 310327 - DNA, 20 bp, Artificial
  CRISPR gRNA sequence
ctgtgttatcacccccactt

SEQ ID NO: 310328 - DNA, 20 bp, Artificial
  CRISPR gRNA sequence
tgtgttatcacccccacttt

SEQ ID NO: 310329 - DNA, 20 bp, Artificial
  CRISPR gRNA sequence
tgttatcacccccactttgg

SEQ ID NO: 310330 - DNA, 20 bp, Artificial
  CRISPR gRNA sequence
tcacccccactttggtttga

SEQ ID NO: 310331 - DNA, 20 bp, Artificial
  CRISPR gRNA sequence
tggtttgaatagtacttgtg

SEQ ID NO: 310332 - DNA, 20 bp, Artificial
  CRISPR gRNA sequence
ggtttgaatagtacttgtga

SEQ ID NO: 310333 - DNA, 20 bp, Artificial
  CRISPR gRNA sequence
gtttgaatagtacttgtgac

SEQ ID NO: 310334 - DNA, 20 bp, Artificial
  CRISPR gRNA sequence
gaatagtacttgtgacaggg

SEQ ID NO: 310335 - DNA, 20 bp, Artificial
  CRISPR gRNA sequence
aatagtacttgtgacaggga

SEQ ID NO: 310336 - DNA, 20 bp, Artificial
  CRISPR gRNA sequence
gtgacagggagcttatcacc

SEQ ID NO: 310337 - DNA, 20 bp, Artificial
  CRISPR gRNA sequence
tgacagggagcttatcacct

SEQ ID NO: 310338 - DNA, 20 bp, Artificial
  CRISPR gRNA sequence
atcacctcacaagaaaatcc

SEQ ID NO: 310339 - DNA, 20 bp, Artificial
  CRISPR gRNA sequence
tcacctcacaagaaaatcca

SEQ ID NO: 310340 - DNA, 20 bp, Artificial
  CRISPR gRNA sequence
acaagaaaatccagtcattg

SEQ ID NO: 310341 - DNA, 20 bp, Artificial
  CRISPR gRNA sequence
cttgtagctctctattaaaa

SEQ ID NO: 310342 - DNA, 20 bp, Artificial
  CRISPR gRNA sequence
gtagctctctattaaaagtt

SEQ ID NO: 310343 - DNA, 20 bp, Artificial
  CRISPR gRNA sequence
tagctctctattaaaagttt

SEQ ID NO: 310344 - DNA, 20 bp, Artificial
  CRISPR gRNA sequence
tctattaaaagttttccatc

SEQ ID NO: 310345 - DNA, 20 bp, Artificial
  CRISPR gRNA sequence
tattaaaagttttccatcat

SEQ ID NO: 310346 - DNA, 20 bp, Artificial
  CRISPR gRNA sequence
ttaaaagttttccatcatct

SEQ ID NO: 310347 - DNA, 20 bp, Artificial
  CRISPR gRNA sequence
aaagttttccatcatctgga

SEQ ID NO: 310348 - DNA, 20 bp, Artificial
  CRISPR gRNA sequence
tccatcatctggaactgaaa

SEQ ID NO: 310349 - DNA, 20 bp, Artificial
  CRISPR gRNA sequence
ccatcatctggaactgaaat

SEQ ID NO: 310350 - DNA, 20 bp, Artificial
  CRISPR gRNA sequence
catcatctggaactgaaatc

SEQ ID NO: 310351 - DNA, 20 bp, Artificial
  CRISPR gRNA sequence
gaactgaaatctggctccct

SEQ ID NO: 310352 - DNA, 20 bp, Artificial
  CRISPR gRNA sequence
aaatctggctccctgtaact

SEQ ID NO: 310353 - DNA, 20 bp, Artificial
  CRISPR gRNA sequence
gctccctgtaacttttagtt

SEQ ID NO: 310354 - DNA, 20 bp, Artificial
  CRISPR gRNA sequence
cctgtaacttttagttattg

SEQ ID NO: 310355 - DNA, 20 bp, Artificial
  CRISPR gRNA sequence
taacttttagttattggaac

SEQ ID NO: 310356 - DNA, 20 bp, Artificial
  CRISPR gRNA sequence
ttagttattggaactacttg

SEQ ID NO: 310357 - DNA, 20 bp, Artificial
  CRISPR gRNA sequence
tagttattggaactacttgc

SEQ ID NO: 310358 - DNA, 20 bp, Artificial
  CRISPR gRNA sequence
agttattggaactacttgcc

SEQ ID NO: 310359 - DNA, 20 bp, Artificial
  CRISPR gRNA sequence
gttattggaactacttgccc

SEQ ID NO: 310360 - DNA, 20 bp, Artificial
  CRISPR gRNA sequence
ttggaactacttgcccttca

SEQ ID NO: 310361 - DNA, 20 bp, Artificial
  CRISPR gRNA sequence
gaactacttgcccttcagca

SEQ ID NO: 310362 - DNA, 20 bp, Artificial
  CRISPR gRNA sequence
cttgcccttcagcaacagtg

SEQ ID NO: 310363 - DNA, 20 bp, Artificial
  CRISPR gRNA sequence
gcccttcagcaacagtgtat

SEQ ID NO: 310364 - DNA, 20 bp, Artificial
  CRISPR gRNA sequence
cccttcagcaacagtgtatg

SEQ ID NO: 310365 - DNA, 20 bp, Artificial
  CRISPR gRNA sequence
cagcaacagtgtatgtatcc

SEQ ID NO: 310366 - DNA, 20 bp, Artificial
  CRISPR gRNA sequence
agcaacagtgtatgtatcct

SEQ ID NO: 310367 - DNA, 20 bp, Artificial
  CRISPR gRNA sequence
ccatggaagggcccttacat

SEQ ID NO: 310368 - DNA, 20 bp, Artificial
  CRISPR gRNA sequence
acatatttgcagacacccag

SEQ ID NO: 310369 - DNA, 20 bp, Artificial
  CRISPR gRNA sequence
catatttgcagacacccagc

SEQ ID NO: 310370 - DNA, 20 bp, Artificial
  CRISPR gRNA sequence
gcagacacccagcatatact

SEQ ID NO: 310371 - DNA, 20 bp, Artificial
  CRISPR gRNA sequence
cagacacccagcatatactt

SEQ ID NO: 310372 - DNA, 20 bp, Artificial
  CRISPR gRNA sequence
gcaatcttttcttcttcagg

SEQ ID NO: 310373 - DNA, 20 bp, Artificial
  CRISPR gRNA sequence
caatcttttcttcttcaggt

SEQ ID NO: 310374 - DNA, 20 bp, Artificial
  CRISPR gRNA sequence
ttcttcttcaggttcattac

SEQ ID NO: 310375 - DNA, 20 bp, Artificial
  CRISPR gRNA sequence
tcttcttcaggttcattacc

SEQ ID NO: 310376 - DNA, 20 bp, Artificial
  CRISPR gRNA sequence
cttcttcaggttcattaccc

SEQ ID NO: 310377 - DNA, 20 bp, Artificial
  CRISPR gRNA sequence
ttcttcaggttcattaccct

SEQ ID NO: 310378 - DNA, 20 bp, Artificial
  CRISPR gRNA sequence
cttcaggttcattaccctag

SEQ ID NO: 310379 - DNA, 20 bp, Artificial
  CRISPR gRNA sequence
ttcaggttcattaccctagt

SEQ ID NO: 310380 - DNA, 20 bp, Artificial
  CRISPR gRNA sequence
caggttcattaccctagtcc

SEQ ID NO: 310381 - DNA, 20 bp, Artificial
  CRISPR gRNA sequence
aggttcattaccctagtcct

SEQ ID NO: 310382 - DNA, 20 bp, Artificial
  CRISPR gRNA sequence
attaccctagtccttttagt

SEQ ID NO: 310383 - DNA, 20 bp, Artificial
  CRISPR gRNA sequence
ccctagtccttttagttgtt

SEQ ID NO: 310384 - DNA, 20 bp, Artificial
  CRISPR gRNA sequence
gtccttttagttgttcttca

SEQ ID NO: 310385 - DNA, 20 bp, Artificial
  CRISPR gRNA sequence
ttagttgttcttcatttgac

SEQ ID NO: 310386 - DNA, 20 bp, Artificial
  CRISPR gRNA sequence
tagttgttcttcatttgaca

SEQ ID NO: 310387 - DNA, 20 bp, Artificial
  CRISPR gRNA sequence
agttgttcttcatttgacat

SEQ ID NO: 310388 - DNA, 20 bp, Artificial
  CRISPR gRNA sequence
gttgttcttcatttgacata

SEQ ID NO: 310389 - DNA, 20 bp, Artificial
  CRISPR gRNA sequence
ttcttcatttgacataattt

SEQ ID NO: 310390 - DNA, 20 bp, Artificial
  CRISPR gRNA sequence
ttcatttgacataatttcat

SEQ ID NO: 310391 - DNA, 20 bp, Artificial
  CRISPR gRNA sequence
catttgacataatttcatta

SEQ ID NO: 310392 - DNA, 20 bp, Artificial
  CRISPR gRNA sequence
atttgacataatttcattat

SEQ ID NO: 310393 - DNA, 20 bp, Artificial
  CRISPR gRNA sequence
gacataatttcattattcac

SEQ ID NO: 310394 - DNA, 20 bp, Artificial
  CRISPR gRNA sequence
acataatttcattattcact

SEQ ID NO: 310395 - DNA, 20 bp, Artificial
  CRISPR gRNA sequence
cattattcactagtgaacct

SEQ ID NO: 310396 - DNA, 20 bp, Artificial
  CRISPR gRNA sequence
attattcactagtgaacctt

SEQ ID NO: 310397 - DNA, 20 bp, Artificial
  CRISPR gRNA sequence
ttcactagtgaaccttgctg

SEQ ID NO: 310398 - DNA, 20 bp, Artificial
  CRISPR gRNA sequence
actagtgaaccttgctgccc

SEQ ID NO: 310399 - DNA, 20 bp, Artificial
  CRISPR gRNA sequence
gtgaaccttgctgcccttcc

SEQ ID NO: 310400 - DNA, 20 bp, Artificial
  CRISPR gRNA sequence
gctgcccttccccttgataa

SEQ ID NO: 310401 - DNA, 20 bp, Artificial
  CRISPR gRNA sequence
ctgcccttccccttgataaa

SEQ ID NO: 310402 - DNA, 20 bp, Artificial
  CRISPR gRNA sequence
cccttccccttgataaaccg

SEQ ID NO: 310403 - DNA, 20 bp, Artificial
  CRISPR gRNA sequence
ccccttgataaaccgaattt

SEQ ID NO: 310404 - DNA, 20 bp, Artificial
  CRISPR gRNA sequence
cccttgataaaccgaatttg

SEQ ID NO: 310405 - DNA, 20 bp, Artificial
  CRISPR gRNA sequence
gataaaccgaatttgtcagt

SEQ ID NO: 310406 - DNA, 20 bp, Artificial
  CRISPR gRNA sequence
ataaaccgaatttgtcagtg

SEQ ID NO: 310407 - DNA, 20 bp, Artificial
  CRISPR gRNA sequence
gtcagtgtcattcaagtata

SEQ ID NO: 310408 - DNA, 20 bp, Artificial
  CRISPR gRNA sequence
tcagtgtcattcaagtataa

SEQ ID NO: 310409 - DNA, 20 bp, Artificial
  CRISPR gRNA sequence
aagtataactgacctcacag

SEQ ID NO: 310410 - DNA, 20 bp, Artificial
  CRISPR gRNA sequence
acctcacagaacgtgatacc

SEQ ID NO: 310411 - DNA, 20 bp, Artificial
  CRISPR gRNA sequence
acagaacgtgataccacaag

SEQ ID NO: 310412 - DNA, 20 bp, Artificial
  CRISPR gRNA sequence
attagcacagagttcagtga

SEQ ID NO: 310413 - DNA, 20 bp, Artificial
  CRISPR gRNA sequence
gcacagagttcagtgaatga

SEQ ID NO: 310414 - DNA, 20 bp, Artificial
  CRISPR gRNA sequence
agtgaatgaatcctacacta

SEQ ID NO: 310415 - DNA, 20 bp, Artificial
  CRISPR gRNA sequence
cactaggattggatgaaatt

SEQ ID NO: 310416 - DNA, 20 bp, Artificial
  CRISPR gRNA sequence
ggattggatgaaatttactt

SEQ ID NO: 310417 - DNA, 20 bp, Artificial
  CRISPR gRNA sequence
gatgaaatttacttagccat

SEQ ID NO: 310418 - DNA, 20 bp, Artificial
  CRISPR gRNA sequence
acttagccataccacactaa

SEQ ID NO: 310419 - DNA, 20 bp, Artificial
  CRISPR gRNA sequence
cttagccataccacactaac

SEQ ID NO: 310420 - DNA, 20 bp, Artificial
  CRISPR gRNA sequence
agccataccacactaacact

SEQ ID NO: 310421 - DNA, 20 bp, Artificial
  CRISPR gRNA sequence
gccataccacactaacactt

SEQ ID NO: 310422 - DNA, 20 bp, Artificial
  CRISPR gRNA sequence
acacttatgtgatttttatg

SEQ ID NO: 310423 - DNA, 20 bp, Artificial
  CRISPR gRNA sequence
atgtgatttttatgtttact

SEQ ID NO: 310424 - DNA, 20 bp, Artificial
  CRISPR gRNA sequence
tgtgatttttatgtttacta

SEQ ID NO: 310425 - DNA, 20 bp, Artificial
  CRISPR gRNA sequence
ttatgtttactatggataga

SEQ ID NO: 310426 - DNA, 20 bp, Artificial
  CRISPR gRNA sequence
tatgtttactatggatagac

SEQ ID NO: 310427 - DNA, 20 bp, Artificial
  CRISPR gRNA sequence
atgtttactatggatagact

SEQ ID NO: 310428 - DNA, 20 bp, Artificial
  CRISPR gRNA sequence
tgtttactatggatagacta

SEQ ID NO: 310429 - DNA, 20 bp, Artificial
  CRISPR gRNA sequence
actatggatagactatttct

SEQ ID NO: 310430 - DNA, 20 bp, Artificial
  CRISPR gRNA sequence
ctatggatagactatttctc

SEQ ID NO: 310431 - DNA, 20 bp, Artificial
  CRISPR gRNA sequence
tggatagactatttctcctg

SEQ ID NO: 310432 - DNA, 20 bp, Artificial
  CRISPR gRNA sequence
tttctcctgtgtccacttct

SEQ ID NO: 310433 - DNA, 20 bp, Artificial
  CRISPR gRNA sequence
ctcctgtgtccacttcttcc

SEQ ID NO: 310434 - DNA, 20 bp, Artificial
  CRISPR gRNA sequence
tcctgtgtccacttcttcct

SEQ ID NO: 310435 - DNA, 20 bp, Artificial
  CRISPR gRNA sequence
ctgtgtccacttcttcctct

SEQ ID NO: 310436 - DNA, 20 bp, Artificial
  CRISPR gRNA sequence
tgtccacttcttcctcttac

SEQ ID NO: 310437 - DNA, 20 bp, Artificial
  CRISPR gRNA sequence
cttcctcttacacagttgtt

SEQ ID NO: 310438 - DNA, 20 bp, Artificial
  CRISPR gRNA sequence
ttcctcttacacagttgtta

SEQ ID NO: 310439 - DNA, 20 bp, Artificial
  CRISPR gRNA sequence
cctcttacacagttgttatt

SEQ ID NO: 310440 - DNA, 20 bp, Artificial
  CRISPR gRNA sequence
ctcttacacagttgttattt

SEQ ID NO: 310441 - DNA, 20 bp, Artificial
  CRISPR gRNA sequence
ttacacagttgttatttcaa

SEQ ID NO: 310442 - DNA, 20 bp, Artificial
  CRISPR gRNA sequence
acacagttgttatttcaaaa

SEQ ID NO: 310443 - DNA, 20 bp, Artificial
  CRISPR gRNA sequence
cacagttgttatttcaaaac

SEQ ID NO: 310444 - DNA, 20 bp, Artificial
  CRISPR gRNA sequence
ttatttcaaaactgaagtac

SEQ ID NO: 310445 - DNA, 20 bp, Artificial
  CRISPR gRNA sequence
tttcaaaactgaagtacaga

SEQ ID NO: 310446 - DNA, 20 bp, Artificial
  CRISPR gRNA sequence
caaaactgaagtacagattc

SEQ ID NO: 310447 - DNA, 20 bp, Artificial
  CRISPR gRNA sequence
aaaactgaagtacagattct

SEQ ID NO: 310448 - DNA, 20 bp, Artificial
  CRISPR gRNA sequence
aagtacagattcttacactt

SEQ ID NO: 310449 - DNA, 20 bp, Artificial
  CRISPR gRNA sequence
ttacacttaccctcaggaga

SEQ ID NO: 310450 - DNA, 20 bp, Artificial
  CRISPR gRNA sequence
acacttaccctcaggagatt

SEQ ID NO: 310451 - DNA, 20 bp, Artificial
  CRISPR gRNA sequence
cacttaccctcaggagattc

SEQ ID NO: 310452 - DNA, 20 bp, Artificial
  CRISPR gRNA sequence
accctcaggagattcatcat

SEQ ID NO: 310453 - DNA, 20 bp, Artificial
  CRISPR gRNA sequence
ccctcaggagattcatcatg

SEQ ID NO: 310454 - DNA, 20 bp, Artificial
  CRISPR gRNA sequence
aggagattcatcatgttagt

SEQ ID NO: 310455 - DNA, 20 bp, Artificial
  CRISPR gRNA sequence
atcatgttagtattagtctc

SEQ ID NO: 310456 - DNA, 20 bp, Artificial
  CRISPR gRNA sequence
gtattagtctctcttttcag

SEQ ID NO: 310457 - DNA, 20 bp, Artificial
  CRISPR gRNA sequence
gtctctcttttcaggcttta

SEQ ID NO: 310458 - DNA, 20 bp, Artificial
  CRISPR gRNA sequence
tcttttcaggctttatgaat

SEQ ID NO: 310459 - DNA, 20 bp, Artificial
  CRISPR gRNA sequence
ttttcaggctttatgaatgt

SEQ ID NO: 310460 - DNA, 20 bp, Artificial
  CRISPR gRNA sequence
ttcaggctttatgaatgtta

SEQ ID NO: 310461 - DNA, 20 bp, Artificial
  CRISPR gRNA sequence
tcaggctttatgaatgttaa

SEQ ID NO: 310462 - DNA, 20 bp, Artificial
  CRISPR gRNA sequence
caggctttatgaatgttaat

SEQ ID NO: 310463 - DNA, 20 bp, Artificial
  CRISPR gRNA sequence
aggctttatgaatgttaatt

SEQ ID NO: 310464 - DNA, 20 bp, Artificial
  CRISPR gRNA sequence
tatgaatgttaattcagcta

SEQ ID NO: 310465 - DNA, 20 bp, Artificial
  CRISPR gRNA sequence
atgaatgttaattcagctaa

SEQ ID NO: 310466 - DNA, 20 bp, Artificial
  CRISPR gRNA sequence
tgaatgttaattcagctaac

SEQ ID NO: 310467 - DNA, 20 bp, Artificial
  CRISPR gRNA sequence
attcagctaactcatttttg

SEQ ID NO: 310468 - DNA, 20 bp, Artificial
  CRISPR gRNA sequence
agctaactcatttttgagct

SEQ ID NO: 310469 - DNA, 20 bp, Artificial
  CRISPR gRNA sequence
actcatttttgagctatctg

SEQ ID NO: 310470 - DNA, 20 bp, Artificial
  CRISPR gRNA sequence
atttttgagctatctgtctc

SEQ ID NO: 310471 - DNA, 20 bp, Artificial
  CRISPR gRNA sequence
ttgagctatctgtctcattt

SEQ ID NO: 310472 - DNA, 20 bp, Artificial
  CRISPR gRNA sequence
tgagctatctgtctcatttt

SEQ ID NO: 310473 - DNA, 20 bp, Artificial
  CRISPR gRNA sequence
gagctatctgtctcattttg

SEQ ID NO: 310474 - DNA, 20 bp, Artificial
  CRISPR gRNA sequence
agctatctgtctcattttgt

SEQ ID NO: 310475 - DNA, 20 bp, Artificial
  CRISPR gRNA sequence
tctgtctcattttgtgccat

SEQ ID NO: 310476 - DNA, 20 bp, Artificial
  CRISPR gRNA sequence
tctcattttgtgccatctgc

SEQ ID NO: 310477 - DNA, 20 bp, Artificial
  CRISPR gRNA sequence
attttgtgccatctgcacag

SEQ ID NO: 310478 - DNA, 20 bp, Artificial
  CRISPR gRNA sequence
tgtgccatctgcacagcata

SEQ ID NO: 310479 - DNA, 20 bp, Artificial
  CRISPR gRNA sequence
gtgccatctgcacagcataa

SEQ ID NO: 310480 - DNA, 20 bp, Artificial
  CRISPR gRNA sequence
tgccatctgcacagcataag

SEQ ID NO: 310481 - DNA, 20 bp, Artificial
  CRISPR gRNA sequence
cacagcataagtttgatttc

SEQ ID NO: 310482 - DNA, 20 bp, Artificial
  CRISPR gRNA sequence
gatttctgttgcttttatta

SEQ ID NO: 310483 - DNA, 20 bp, Artificial
  CRISPR gRNA sequence
atttctgttgcttttattag

SEQ ID NO: 310484 - DNA, 20 bp, Artificial
  CRISPR gRNA sequence
ctgttgcttttattagtagt

SEQ ID NO: 310485 - DNA, 20 bp, Artificial
  CRISPR gRNA sequence
tgttgcttttattagtagtt

SEQ ID NO: 310486 - DNA, 20 bp, Artificial
  CRISPR gRNA sequence
ttgcttttattagtagtttt

SEQ ID NO: 310487 - DNA, 20 bp, Artificial
  CRISPR gRNA sequence
cttttattagtagttttact

SEQ ID NO: 310488 - DNA, 20 bp, Artificial
  CRISPR gRNA sequence
ttattagtagttttactaaa

SEQ ID NO: 310489 - DNA, 20 bp, Artificial
  CRISPR gRNA sequence
tattagtagttttactaaat

SEQ ID NO: 310490 - DNA, 20 bp, Artificial
  CRISPR gRNA sequence
attagtagttttactaaata

SEQ ID NO: 310491 - DNA, 20 bp, Artificial
  CRISPR gRNA sequence
ttagtagttttactaaatac

SEQ ID NO: 310492 - DNA, 20 bp, Artificial
  CRISPR gRNA sequence
gtagttttactaaatacata

SEQ ID NO: 310493 - DNA, 20 bp, Artificial
  CRISPR gRNA sequence
tactaaatacataaaagtga

SEQ ID NO: 310494 - DNA, 20 bp, Artificial
  CRISPR gRNA sequence
actaaatacataaaagtgaa

SEQ ID NO: 310495 - DNA, 20 bp, Artificial
  CRISPR gRNA sequence
ctaaatacataaaagtgaaa

SEQ ID NO: 310496 - DNA, 20 bp, Artificial
  CRISPR gRNA sequence
aatacataaaagtgaaatag

SEQ ID NO: 310497 - DNA, 20 bp, Artificial
  CRISPR gRNA sequence
gtagcatccactgtgggatc

SEQ ID NO: 310498 - DNA, 20 bp, Artificial
  CRISPR gRNA sequence
tagcatccactgtgggatca

SEQ ID NO: 310499 - DNA, 20 bp, Artificial
  CRISPR gRNA sequence
tgggatcagtcttttagaca

SEQ ID NO: 310500 - DNA, 20 bp, Artificial
  CRISPR gRNA sequence
ttagacaagaatgatgcagt

SEQ ID NO: 310501 - DNA, 20 bp, Artificial
  CRISPR gRNA sequence
tagacaagaatgatgcagtt

SEQ ID NO: 310502 - DNA, 20 bp, Artificial
  CRISPR gRNA sequence
agacaagaatgatgcagttg

SEQ ID NO: 310503 - DNA, 20 bp, Artificial
  CRISPR gRNA sequence
gacaagaatgatgcagttgc

SEQ ID NO: 310504 - DNA, 20 bp, Artificial
  CRISPR gRNA sequence
ctgagtcaaatgaataaatg

SEQ ID NO: 310505 - DNA, 20 bp, Artificial
  CRISPR gRNA sequence
agtcaaatgaataaatgaat

SEQ ID NO: 310506 - DNA, 20 bp, Artificial
  CRISPR gRNA sequence
tgtcctcatttcccatattg

SEQ ID NO: 310507 - DNA, 20 bp, Artificial
  CRISPR gRNA sequence
gtcctcatttcccatattga

SEQ ID NO: 310508 - DNA, 20 bp, Artificial
  CRISPR gRNA sequence
tcctcatttcccatattgat

SEQ ID NO: 310509 - DNA, 20 bp, Artificial
  CRISPR gRNA sequence
atttcccatattgatctatc

SEQ ID NO: 310510 - DNA, 20 bp, Artificial
  CRISPR gRNA sequence
cccatattgatctatcacca

SEQ ID NO: 310511 - DNA, 20 bp, Artificial
  CRISPR gRNA sequence
ccatattgatctatcaccat

SEQ ID NO: 310512 - DNA, 20 bp, Artificial
  CRISPR gRNA sequence
atctatcaccatatcctgtt

SEQ ID NO: 310513 - DNA, 20 bp, Artificial
  CRISPR gRNA sequence
tcaccatatcctgttaatta

SEQ ID NO: 310514 - DNA, 20 bp, Artificial
  CRISPR gRNA sequence
ttaattataattctaaatat

SEQ ID NO: 310515 - DNA, 20 bp, Artificial
  CRISPR gRNA sequence
attataattctaaatatttc

SEQ ID NO: 310516 - DNA, 20 bp, Artificial
  CRISPR gRNA sequence
taattctaaatatttcttga

SEQ ID NO: 310517 - DNA, 20 bp, Artificial
  CRISPR gRNA sequence
taaatatttcttgatctatc

SEQ ID NO: 310518 - DNA, 20 bp, Artificial
  CRISPR gRNA sequence
aatatttcttgatctatcca

SEQ ID NO: 310519 - DNA, 20 bp, Artificial
  CRISPR gRNA sequence
cttgatctatccacttttcc

SEQ ID NO: 310520 - DNA, 20 bp, Artificial
  CRISPR gRNA sequence
ttgatctatccacttttccc

SEQ ID NO: 310521 - DNA, 20 bp, Artificial
  CRISPR gRNA sequence
gatctatccacttttccctt

SEQ ID NO: 310522 - DNA, 20 bp, Artificial
  CRISPR gRNA sequence
atctatccacttttccctta

SEQ ID NO: 310523 - DNA, 20 bp, Artificial
  CRISPR gRNA sequence
tccacttttcccttacttca

SEQ ID NO: 310524 - DNA, 20 bp, Artificial
  CRISPR gRNA sequence
ttcccttacttcacctgcta

SEQ ID NO: 310525 - DNA, 20 bp, Artificial
  CRISPR gRNA sequence
tcccttacttcacctgctac

SEQ ID NO: 310526 - DNA, 20 bp, Artificial
  CRISPR gRNA sequence
cccttacttcacctgctact

SEQ ID NO: 310527 - DNA, 20 bp, Artificial
  CRISPR gRNA sequence
ccttacttcacctgctacta

SEQ ID NO: 310528 - DNA, 20 bp, Artificial
  CRISPR gRNA sequence
acttcacctgctactatccc

SEQ ID NO: 310529 - DNA, 20 bp, Artificial
  CRISPR gRNA sequence
cttcacctgctactatccca

SEQ ID NO: 310530 - DNA, 20 bp, Artificial
  CRISPR gRNA sequence
cacctgctactatcccagac

SEQ ID NO: 310531 - DNA, 20 bp, Artificial
  CRISPR gRNA sequence
acctgctactatcccagacc

SEQ ID NO: 310532 - DNA, 20 bp, Artificial
  CRISPR gRNA sequence
ctactatcccagaccaaaca

SEQ ID NO: 310533 - DNA, 20 bp, Artificial
  CRISPR gRNA sequence
ctatcccagaccaaacagcc

SEQ ID NO: 310534 - DNA, 20 bp, Artificial
  CRISPR gRNA sequence
tcccagaccaaacagccatc

SEQ ID NO: 310535 - DNA, 20 bp, Artificial
  CRISPR gRNA sequence
ctttcactcaaacaattgca

SEQ ID NO: 310536 - DNA, 20 bp, Artificial
  CRISPR gRNA sequence
tttcactcaaacaattgcag

SEQ ID NO: 310537 - DNA, 20 bp, Artificial
  CRISPR gRNA sequence
tcactcaaacaattgcagta

SEQ ID NO: 310538 - DNA, 20 bp, Artificial
  CRISPR gRNA sequence
cactcaaacaattgcagtag

SEQ ID NO: 310539 - DNA, 20 bp, Artificial
  CRISPR gRNA sequence
actcaaacaattgcagtagc

SEQ ID NO: 310540 - DNA, 20 bp, Artificial
  CRISPR gRNA sequence
aaacaattgcagtagccaac

SEQ ID NO: 310541 - DNA, 20 bp, Artificial
  CRISPR gRNA sequence
cagtagccaactgattggtc

SEQ ID NO: 310542 - DNA, 20 bp, Artificial
  CRISPR gRNA sequence
attggtcttcctgcatctgt

SEQ ID NO: 310543 - DNA, 20 bp, Artificial
  CRISPR gRNA sequence
gtcttcctgcatctgtcctg

SEQ ID NO: 310544 - DNA, 20 bp, Artificial
  CRISPR gRNA sequence
cctgcatctgtcctggcttc

SEQ ID NO: 310545 - DNA, 20 bp, Artificial
  CRISPR gRNA sequence
ctgcatctgtcctggcttcc

SEQ ID NO: 310546 - DNA, 20 bp, Artificial
  CRISPR gRNA sequence
catctgtcctggcttcccta

SEQ ID NO: 310547 - DNA, 20 bp, Artificial
  CRISPR gRNA sequence
tcctggcttccctatcatcc

SEQ ID NO: 310548 - DNA, 20 bp, Artificial
  CRISPR gRNA sequence
gcttccctatcatccatttg

SEQ ID NO: 310549 - DNA, 20 bp, Artificial
  CRISPR gRNA sequence
ccctatcatccatttgctac

SEQ ID NO: 310550 - DNA, 20 bp, Artificial
  CRISPR gRNA sequence
cctatcatccatttgctaca

SEQ ID NO: 310551 - DNA, 20 bp, Artificial
  CRISPR gRNA sequence
tcatccatttgctacacaga

SEQ ID NO: 310552 - DNA, 20 bp, Artificial
  CRISPR gRNA sequence
gctacacagaaaccatggtc

SEQ ID NO: 310553 - DNA, 20 bp, Artificial
  CRISPR gRNA sequence
ctacacagaaaccatggtca

SEQ ID NO: 310554 - DNA, 20 bp, Artificial
  CRISPR gRNA sequence
cacagaaaccatggtcatct

SEQ ID NO: 310555 - DNA, 20 bp, Artificial
  CRISPR gRNA sequence
ttcaaaatgcaaatctgatg

SEQ ID NO: 310556 - DNA, 20 bp, Artificial
  CRISPR gRNA sequence
tcaaaatgcaaatctgatga

SEQ ID NO: 310557 - DNA, 20 bp, Artificial
  CRISPR gRNA sequence
caaaatgcaaatctgatgat

SEQ ID NO: 310558 - DNA, 20 bp, Artificial
  CRISPR gRNA sequence
aaaatgcaaatctgatgata

SEQ ID NO: 310559 - DNA, 20 bp, Artificial
  CRISPR gRNA sequence
atgatatcagtctcagctct

SEQ ID NO: 310560 - DNA, 20 bp, Artificial
  CRISPR gRNA sequence
agctctaatttctttggtgg

SEQ ID NO: 310561 - DNA, 20 bp, Artificial
  CRISPR gRNA sequence
taatttctttggtggttcac

SEQ ID NO: 310562 - DNA, 20 bp, Artificial
  CRISPR gRNA sequence
atttctttggtggttcacat

SEQ ID NO: 310563 - DNA, 20 bp, Artificial
  CRISPR gRNA sequence
ctttggtggttcacatataa

SEQ ID NO: 310564 - DNA, 20 bp, Artificial
  CRISPR gRNA sequence
tttggtggttcacatataaa

SEQ ID NO: 310565 - DNA, 20 bp, Artificial
  CRISPR gRNA sequence
tggtggttcacatataaaga

SEQ ID NO: 310566 - DNA, 20 bp, Artificial
  CRISPR gRNA sequence
ggtggttcacatataaagac

SEQ ID NO: 310567 - DNA, 20 bp, Artificial
  CRISPR gRNA sequence
gtggttcacatataaagact

SEQ ID NO: 310568 - DNA, 20 bp, Artificial
  CRISPR gRNA sequence
acatataaagactgaaatct

SEQ ID NO: 310569 - DNA, 20 bp, Artificial
  CRISPR gRNA sequence
aaatctttaactgaccaata

SEQ ID NO: 310570 - DNA, 20 bp, Artificial
  CRISPR gRNA sequence
taactgaccaataacacacg

SEQ ID NO: 310571 - DNA, 20 bp, Artificial
  CRISPR gRNA sequence
aactgaccaataacacacgt

SEQ ID NO: 310572 - DNA, 20 bp, Artificial
  CRISPR gRNA sequence
actgaccaataacacacgtg

SEQ ID NO: 310573 - DNA, 20 bp, Artificial
  CRISPR gRNA sequence
accaataacacacgtgtgat

SEQ ID NO: 310574 - DNA, 20 bp, Artificial
  CRISPR gRNA sequence
gcccctgctcacctcttcag

SEQ ID NO: 310575 - DNA, 20 bp, Artificial
  CRISPR gRNA sequence
ctcacctcttcagccttgtc

SEQ ID NO: 310576 - DNA, 20 bp, Artificial
  CRISPR gRNA sequence
acctcttcagccttgtcttt

SEQ ID NO: 310577 - DNA, 20 bp, Artificial
  CRISPR gRNA sequence
ttcagccttgtctttcacct

SEQ ID NO: 310578 - DNA, 20 bp, Artificial
  CRISPR gRNA sequence
cagccttgtctttcacctgt

SEQ ID NO: 310579 - DNA, 20 bp, Artificial
  CRISPR gRNA sequence
agccttgtctttcacctgtc

SEQ ID NO: 310580 - DNA, 20 bp, Artificial
  CRISPR gRNA sequence
gtctttcacctgtctcttca

SEQ ID NO: 310581 - DNA, 20 bp, Artificial
  CRISPR gRNA sequence
tctttcacctgtctcttcat

SEQ ID NO: 310582 - DNA, 20 bp, Artificial
  CRISPR gRNA sequence
tcacctgtctcttcattttg

SEQ ID NO: 310583 - DNA, 20 bp, Artificial
  CRISPR gRNA sequence
cacctgtctcttcattttgg

SEQ ID NO: 310584 - DNA, 20 bp, Artificial
  CRISPR gRNA sequence
acctgtctcttcattttggc

SEQ ID NO: 310585 - DNA, 20 bp, Artificial
  CRISPR gRNA sequence
tctcttcattttggccacag

SEQ ID NO: 310586 - DNA, 20 bp, Artificial
  CRISPR gRNA sequence
ttcattttggccacagggac

SEQ ID NO: 310587 - DNA, 20 bp, Artificial
  CRISPR gRNA sequence
cattttggccacagggacct

SEQ ID NO: 310588 - DNA, 20 bp, Artificial
  CRISPR gRNA sequence
attttggccacagggacctc

SEQ ID NO: 310589 - DNA, 20 bp, Artificial
  CRISPR gRNA sequence
tggccacagggacctcctcg

SEQ ID NO: 310590 - DNA, 20 bp, Artificial
  CRISPR gRNA sequence
ggccacagggacctcctcgt

SEQ ID NO: 310591 - DNA, 20 bp, Artificial
  CRISPR gRNA sequence
gccacagggacctcctcgta

SEQ ID NO: 310592 - DNA, 20 bp, Artificial
  CRISPR gRNA sequence
ctcgtaccttctctcacgtg

SEQ ID NO: 310593 - DNA, 20 bp, Artificial
  CRISPR gRNA sequence
gtaccttctctcacgtgccc

SEQ ID NO: 310594 - DNA, 20 bp, Artificial
  CRISPR gRNA sequence
ctctcacgtgccctcctgcc

SEQ ID NO: 310595 - DNA, 20 bp, Artificial
  CRISPR gRNA sequence
tctcacgtgccctcctgcct

SEQ ID NO: 310596 - DNA, 20 bp, Artificial
  CRISPR gRNA sequence
tcacgtgccctcctgcctca

SEQ ID NO: 310597 - DNA, 20 bp, Artificial
  CRISPR gRNA sequence
acgtgccctcctgcctcagc

SEQ ID NO: 310598 - DNA, 20 bp, Artificial
  CRISPR gRNA sequence
ctgcctcagcgcctttgcat

SEQ ID NO: 310599 - DNA, 20 bp, Artificial
  CRISPR gRNA sequence
cctcagcgcctttgcatatg

SEQ ID NO: 310600 - DNA, 20 bp, Artificial
  CRISPR gRNA sequence
agcgcctttgcatatgctgt

SEQ ID NO: 310601 - DNA, 20 bp, Artificial
  CRISPR gRNA sequence
tgcatatgctgttccctttg

SEQ ID NO: 310602 - DNA, 20 bp, Artificial
  CRISPR gRNA sequence
gcatatgctgttccctttgc

SEQ ID NO: 310603 - DNA, 20 bp, Artificial
  CRISPR gRNA sequence
catatgctgttccctttgcc

SEQ ID NO: 310604 - DNA, 20 bp, Artificial
  CRISPR gRNA sequence
ttccctttgccgagaactct

SEQ ID NO: 310605 - DNA, 20 bp, Artificial
  CRISPR gRNA sequence
cctttgccgagaactcttcc

SEQ ID NO: 310606 - DNA, 20 bp, Artificial
  CRISPR gRNA sequence
tgccgagaactcttcctgtc

SEQ ID NO: 310607 - DNA, 20 bp, Artificial
  CRISPR gRNA sequence
gccgagaactcttcctgtca

SEQ ID NO: 310608 - DNA, 20 bp, Artificial
  CRISPR gRNA sequence
ccgagaactcttcctgtcaa

SEQ ID NO: 310609 - DNA, 20 bp, Artificial
  CRISPR gRNA sequence
ttcctgtcaactcccaagcc

SEQ ID NO: 310610 - DNA, 20 bp, Artificial
  CRISPR gRNA sequence
cctgtcaactcccaagccct

SEQ ID NO: 310611 - DNA, 20 bp, Artificial
  CRISPR gRNA sequence
ctgtcaactcccaagccctt

SEQ ID NO: 310612 - DNA, 20 bp, Artificial
  CRISPR gRNA sequence
tcaactcccaagcccttcac

SEQ ID NO: 310613 - DNA, 20 bp, Artificial
  CRISPR gRNA sequence
ccaagcccttcacctactta

SEQ ID NO: 310614 - DNA, 20 bp, Artificial
  CRISPR gRNA sequence
cacctacttagcacctacct

SEQ ID NO: 310615 - DNA, 20 bp, Artificial
  CRISPR gRNA sequence
acctacttagcacctaccta

SEQ ID NO: 310616 - DNA, 20 bp, Artificial
  CRISPR gRNA sequence
cttagcacctacctattcaa

SEQ ID NO: 310617 - DNA, 20 bp, Artificial
  CRISPR gRNA sequence
agcacctacctattcaatct

SEQ ID NO: 310618 - DNA, 20 bp, Artificial
  CRISPR gRNA sequence
gcacctacctattcaatctg

SEQ ID NO: 310619 - DNA, 20 bp, Artificial
  CRISPR gRNA sequence
cctattcaatctgttctgtt

SEQ ID NO: 310620 - DNA, 20 bp, Artificial
  CRISPR gRNA sequence
ttcaatctgttctgtttgcc

SEQ ID NO: 310621 - DNA, 20 bp, Artificial
  CRISPR gRNA sequence
aatctgttctgtttgcctct

SEQ ID NO: 310622 - DNA, 20 bp, Artificial
  CRISPR gRNA sequence
ttctgtttgcctcttggtat

SEQ ID NO: 310623 - DNA, 20 bp, Artificial
  CRISPR gRNA sequence
tgtttgcctcttggtatgtt

SEQ ID NO: 310624 - DNA, 20 bp, Artificial
  CRISPR gRNA sequence
tttgcctcttggtatgttac

SEQ ID NO: 310625 - DNA, 20 bp, Artificial
  CRISPR gRNA sequence
gcctcttggtatgttacaaa

SEQ ID NO: 310626 - DNA, 20 bp, Artificial
  CRISPR gRNA sequence
cctcttggtatgttacaaac

SEQ ID NO: 310627 - DNA, 20 bp, Artificial
  CRISPR gRNA sequence
ttggtatgttacaaactgtc

SEQ ID NO: 310628 - DNA, 20 bp, Artificial
  CRISPR gRNA sequence
ggtatgttacaaactgtctc

SEQ ID NO: 310629 - DNA, 20 bp, Artificial
  CRISPR gRNA sequence
gtatgttacaaactgtctcc

SEQ ID NO: 310630 - DNA, 20 bp, Artificial
  CRISPR gRNA sequence
caaactgtctccaaacttag

SEQ ID NO: 310631 - DNA, 20 bp, Artificial
  CRISPR gRNA sequence
tctccaaacttagcagctta

SEQ ID NO: 310632 - DNA, 20 bp, Artificial
  CRISPR gRNA sequence
caaacttagcagcttagaac

SEQ ID NO: 310633 - DNA, 20 bp, Artificial
  CRISPR gRNA sequence
agcagcttagaacaatgaat

SEQ ID NO: 310634 - DNA, 20 bp, Artificial
  CRISPR gRNA sequence
gcagcttagaacaatgaatc

SEQ ID NO: 310635 - DNA, 20 bp, Artificial
  CRISPR gRNA sequence
agaacaatgaatcctttacc

SEQ ID NO: 310636 - DNA, 20 bp, Artificial
  CRISPR gRNA sequence
gaacaatgaatcctttaccc

SEQ ID NO: 310637 - DNA, 20 bp, Artificial
  CRISPR gRNA sequence
taccctctctcacaatgttt

SEQ ID NO: 310638 - DNA, 20 bp, Artificial
  CRISPR gRNA sequence
accctctctcacaatgtttg

SEQ ID NO: 310639 - DNA, 20 bp, Artificial
  CRISPR gRNA sequence
ccctctctcacaatgtttgg

SEQ ID NO: 310640 - DNA, 20 bp, Artificial
  CRISPR gRNA sequence
tctcacaatgtttggggtca

SEQ ID NO: 310641 - DNA, 20 bp, Artificial
  CRISPR gRNA sequence
tcacaatgtttggggtcagg

SEQ ID NO: 310642 - DNA, 20 bp, Artificial
  CRISPR gRNA sequence
acaatgtttggggtcaggaa

SEQ ID NO: 310643 - DNA, 20 bp, Artificial
  CRISPR gRNA sequence
ggggtcaggaatttgagcgg

SEQ ID NO: 310644 - DNA, 20 bp, Artificial
  CRISPR gRNA sequence
gggtcaggaatttgagcggg

SEQ ID NO: 310645 - DNA, 20 bp, Artificial
  CRISPR gRNA sequence
gagcgggccttggctgattt

SEQ ID NO: 310646 - DNA, 20 bp, Artificial
  CRISPR gRNA sequence
agcgggccttggctgatttt

SEQ ID NO: 310647 - DNA, 20 bp, Artificial
  CRISPR gRNA sequence
ggctgatttttctgttcctc

SEQ ID NO: 310648 - DNA, 20 bp, Artificial
  CRISPR gRNA sequence
gctgatttttctgttcctca

SEQ ID NO: 310649 - DNA, 20 bp, Artificial
  CRISPR gRNA sequence
atttttctgttcctcatgcc

SEQ ID NO: 310650 - DNA, 20 bp, Artificial
  CRISPR gRNA sequence
ttctgttcctcatgccatca

SEQ ID NO: 310651 - DNA, 20 bp, Artificial
  CRISPR gRNA sequence
tctgttcctcatgccatcaa

SEQ ID NO: 310652 - DNA, 20 bp, Artificial
  CRISPR gRNA sequence
ctgttcctcatgccatcaat

SEQ ID NO: 310653 - DNA, 20 bp, Artificial
  CRISPR gRNA sequence
tgttcctcatgccatcaatt

SEQ ID NO: 310654 - DNA, 20 bp, Artificial
  CRISPR gRNA sequence
ttcctcatgccatcaattga

SEQ ID NO: 310655 - DNA, 20 bp, Artificial
  CRISPR gRNA sequence
ctcatgccatcaattgatat

SEQ ID NO: 310656 - DNA, 20 bp, Artificial
  CRISPR gRNA sequence
atgccatcaattgatatcac

SEQ ID NO: 310657 - DNA, 20 bp, Artificial
  CRISPR gRNA sequence
atatcacctgatgttattaa

SEQ ID NO: 310658 - DNA, 20 bp, Artificial
  CRISPR gRNA sequence
atgttattaagctgatggat

SEQ ID NO: 310659 - DNA, 20 bp, Artificial
  CRISPR gRNA sequence
ttaagctgatggatgggctg

SEQ ID NO: 310660 - DNA, 20 bp, Artificial
  CRISPR gRNA sequence
agctgatggatgggctgatc

SEQ ID NO: 310661 - DNA, 20 bp, Artificial
  CRISPR gRNA sequence
atggatgggctgatctggag

SEQ ID NO: 310662 - DNA, 20 bp, Artificial
  CRISPR gRNA sequence
atctggagatgcactgtcca

SEQ ID NO: 310663 - DNA, 20 bp, Artificial
  CRISPR gRNA sequence
gagatgcactgtccagtttg

SEQ ID NO: 310664 - DNA, 20 bp, Artificial
  CRISPR gRNA sequence
tccagtttggtagccactgg

SEQ ID NO: 310665 - DNA, 20 bp, Artificial
  CRISPR gRNA sequence
ggtagccactggttacctga

SEQ ID NO: 310666 - DNA, 20 bp, Artificial
  CRISPR gRNA sequence
gtagccactggttacctgaa

SEQ ID NO: 310667 - DNA, 20 bp, Artificial
  CRISPR gRNA sequence
gttacctgaaatgcagccag

SEQ ID NO: 310668 - DNA, 20 bp, Artificial
  CRISPR gRNA sequence
cctgaaatgcagccagtcct

SEQ ID NO: 310669 - DNA, 20 bp, Artificial
  CRISPR gRNA sequence
aaatgcagccagtcctaatt

SEQ ID NO: 310670 - DNA, 20 bp, Artificial
  CRISPR gRNA sequence
attgagatgtgctataacta

SEQ ID NO: 310671 - DNA, 20 bp, Artificial
  CRISPR gRNA sequence
agatgtgctataactataaa

SEQ ID NO: 310672 - DNA, 20 bp, Artificial
  CRISPR gRNA sequence
taactataaaacacccacat

SEQ ID NO: 310673 - DNA, 20 bp, Artificial
  CRISPR gRNA sequence
taaaacacccacatgattat

SEQ ID NO: 310674 - DNA, 20 bp, Artificial
  CRISPR gRNA sequence
ttgaagatttggtgccacca

SEQ ID NO: 310675 - DNA, 20 bp, Artificial
  CRISPR gRNA sequence
aagatttggtgccaccaaaa

SEQ ID NO: 310676 - DNA, 20 bp, Artificial
  CRISPR gRNA sequence
ggtgccaccaaaaaatttaa

SEQ ID NO: 310677 - DNA, 20 bp, Artificial
  CRISPR gRNA sequence
gtgccaccaaaaaatttaaa

SEQ ID NO: 310678 - DNA, 20 bp, Artificial
  CRISPR gRNA sequence
aaaatattcgttaataattt

SEQ ID NO: 310679 - DNA, 20 bp, Artificial
  CRISPR gRNA sequence
aaatattcgttaataatttg

SEQ ID NO: 310680 - DNA, 20 bp, Artificial
  CRISPR gRNA sequence
gttaataatttgtattctga

SEQ ID NO: 310681 - DNA, 20 bp, Artificial
  CRISPR gRNA sequence
ataatttgtattctgattac

SEQ ID NO: 310682 - DNA, 20 bp, Artificial
  CRISPR gRNA sequence
gtattctgattacatgttga

SEQ ID NO: 310683 - DNA, 20 bp, Artificial
  CRISPR gRNA sequence
tattctgattacatgttgag

SEQ ID NO: 310684 - DNA, 20 bp, Artificial
  CRISPR gRNA sequence
tgattacatgttgagattat

SEQ ID NO: 310685 - DNA, 20 bp, Artificial
  CRISPR gRNA sequence
attacatgttgagattataa

SEQ ID NO: 310686 - DNA, 20 bp, Artificial
  CRISPR gRNA sequence
catgttgagattataatatt

SEQ ID NO: 310687 - DNA, 20 bp, Artificial
  CRISPR gRNA sequence
agattataatatttcacata

SEQ ID NO: 310688 - DNA, 20 bp, Artificial
  CRISPR gRNA sequence
taatatttcacatacatcag

SEQ ID NO: 310689 - DNA, 20 bp, Artificial
  CRISPR gRNA sequence
cacatacatcagataacata

SEQ ID NO: 310690 - DNA, 20 bp, Artificial
  CRISPR gRNA sequence
acatacatcagataacataa

SEQ ID NO: 310691 - DNA, 20 bp, Artificial
  CRISPR gRNA sequence
aaattaatgtcacctatttc

SEQ ID NO: 310692 - DNA, 20 bp, Artificial
  CRISPR gRNA sequence
atgtcacctatttcttttta

SEQ ID NO: 310693 - DNA, 20 bp, Artificial
  CRISPR gRNA sequence
tttctttttaatttctttaa

SEQ ID NO: 310694 - DNA, 20 bp, Artificial
  CRISPR gRNA sequence
ctttttaatttctttaatgt

SEQ ID NO: 310695 - DNA, 20 bp, Artificial
  CRISPR gRNA sequence
tttttaatttctttaatgtg

SEQ ID NO: 310696 - DNA, 20 bp, Artificial
  CRISPR gRNA sequence
tttaatttctttaatgtgac

SEQ ID NO: 310697 - DNA, 20 bp, Artificial
  CRISPR gRNA sequence
ttaatttctttaatgtgact

SEQ ID NO: 310698 - DNA, 20 bp, Artificial
  CRISPR gRNA sequence
taatttctttaatgtgacta

SEQ ID NO: 310699 - DNA, 20 bp, Artificial
  CRISPR gRNA sequence
aatttctttaatgtgactac

SEQ ID NO: 310700 - DNA, 20 bp, Artificial
  CRISPR gRNA sequence
atttctttaatgtgactact

SEQ ID NO: 310701 - DNA, 20 bp, Artificial
  CRISPR gRNA sequence
ctttaatgtgactactacaa

SEQ ID NO: 310702 - DNA, 20 bp, Artificial
  CRISPR gRNA sequence
tttaatgtgactactacaag

SEQ ID NO: 310703 - DNA, 20 bp, Artificial
  CRISPR gRNA sequence
taatgtgactactacaagtt

SEQ ID NO: 310704 - DNA, 20 bp, Artificial
  CRISPR gRNA sequence
aatgtgactactacaagttt

SEQ ID NO: 310705 - DNA, 20 bp, Artificial
  CRISPR gRNA sequence
atgtgactactacaagtttt

SEQ ID NO: 310706 - DNA, 20 bp, Artificial
  CRISPR gRNA sequence
ctacaagttttcaaattata

SEQ ID NO: 310707 - DNA, 20 bp, Artificial
  CRISPR gRNA sequence
caagttttcaaattatatct

SEQ ID NO: 310708 - DNA, 20 bp, Artificial
  CRISPR gRNA sequence
tcaaattatatctgtggctt

SEQ ID NO: 310709 - DNA, 20 bp, Artificial
  CRISPR gRNA sequence
caaattatatctgtggcttg

SEQ ID NO: 310710 - DNA, 20 bp, Artificial
  CRISPR gRNA sequence
aaattatatctgtggcttgt

SEQ ID NO: 310711 - DNA, 20 bp, Artificial
  CRISPR gRNA sequence
tatctgtggcttgtaattgt

SEQ ID NO: 310712 - DNA, 20 bp, Artificial
  CRISPR gRNA sequence
tggcttgtaattgtggcttg

SEQ ID NO: 310713 - DNA, 20 bp, Artificial
  CRISPR gRNA sequence
gtaattgtggcttgtattgt

SEQ ID NO: 310714 - DNA, 20 bp, Artificial
  CRISPR gRNA sequence
taattgtggcttgtattgta

SEQ ID NO: 310715 - DNA, 20 bp, Artificial
  CRISPR gRNA sequence
tggcttgtattgtattcttt

SEQ ID NO: 310716 - DNA, 20 bp, Artificial
  CRISPR gRNA sequence
gtattgtattctttttttct

SEQ ID NO: 310717 - DNA, 20 bp, Artificial
  CRISPR gRNA sequence
tattgtattctttttttctg

SEQ ID NO: 310718 - DNA, 20 bp, Artificial
  CRISPR gRNA sequence
tattctttttttctgagatg

SEQ ID NO: 310719 - DNA, 20 bp, Artificial
  CRISPR gRNA sequence
tttttttctgagatggagtc

SEQ ID NO: 310720 - DNA, 20 bp, Artificial
  CRISPR gRNA sequence
tttttctgagatggagtctt

SEQ ID NO: 310721 - DNA, 20 bp, Artificial
  CRISPR gRNA sequence
ttttctgagatggagtctta

SEQ ID NO: 310722 - DNA, 20 bp, Artificial
  CRISPR gRNA sequence
tttctgagatggagtcttac

SEQ ID NO: 310723 - DNA, 20 bp, Artificial
  CRISPR gRNA sequence
ttctgagatggagtcttact

SEQ ID NO: 310724 - DNA, 20 bp, Artificial
  CRISPR gRNA sequence
tctgagatggagtcttactc

SEQ ID NO: 310725 - DNA, 20 bp, Artificial
  CRISPR gRNA sequence
ctgagatggagtcttactct

SEQ ID NO: 310726 - DNA, 20 bp, Artificial
  CRISPR gRNA sequence
tgagatggagtcttactctg

SEQ ID NO: 310727 - DNA, 20 bp, Artificial
  CRISPR gRNA sequence
agatggagtcttactctgtt

SEQ ID NO: 310728 - DNA, 20 bp, Artificial
  CRISPR gRNA sequence
actctgttgcccaggctgga

SEQ ID NO: 310729 - DNA, 20 bp, Artificial
  CRISPR gRNA sequence
ctctgttgcccaggctggag

SEQ ID NO: 310730 - DNA, 20 bp, Artificial
  CRISPR gRNA sequence
tgttgcccaggctggagtgc

SEQ ID NO: 310731 - DNA, 20 bp, Artificial
  CRISPR gRNA sequence
ttgcccaggctggagtgcag

SEQ ID NO: 310732 - DNA, 20 bp, Artificial
  CRISPR gRNA sequence
cccaggctggagtgcagtgg

SEQ ID NO: 310733 - DNA, 20 bp, Artificial
  CRISPR gRNA sequence
gagtgcagtggcgagatctc

SEQ ID NO: 310734 - DNA, 20 bp, Artificial
  CRISPR gRNA sequence
tgctcatcgcaagctctgcc

SEQ ID NO: 310735 - DNA, 20 bp, Artificial
  CRISPR gRNA sequence
ctcatcgcaagctctgcctc

SEQ ID NO: 310736 - DNA, 20 bp, Artificial
  CRISPR gRNA sequence
atcgcaagctctgcctccca

SEQ ID NO: 310737 - DNA, 20 bp, Artificial
  CRISPR gRNA sequence
tgcctcccaggttcaagtga

SEQ ID NO: 310738 - DNA, 20 bp, Artificial
  CRISPR gRNA sequence
cctcccaggttcaagtgatt

SEQ ID NO: 310739 - DNA, 20 bp, Artificial
  CRISPR gRNA sequence
ccaggttcaagtgattctcc

SEQ ID NO: 310740 - DNA, 20 bp, Artificial
  CRISPR gRNA sequence
aagtgattctcctgcctcag

SEQ ID NO: 310741 - DNA, 20 bp, Artificial
  CRISPR gRNA sequence
tcctgcctcagcctcctgag

SEQ ID NO: 310742 - DNA, 20 bp, Artificial
  CRISPR gRNA sequence
ctgcctcagcctcctgagta

SEQ ID NO: 310743 - DNA, 20 bp, Artificial
  CRISPR gRNA sequence
cctcagcctcctgagtagct

SEQ ID NO: 310744 - DNA, 20 bp, Artificial
  CRISPR gRNA sequence
agcctcctgagtagctgaaa

SEQ ID NO: 310745 - DNA, 20 bp, Artificial
  CRISPR gRNA sequence
ctgagtagctgaaattacag

SEQ ID NO: 310746 - DNA, 20 bp, Artificial
  CRISPR gRNA sequence
agtagctgaaattacaggtg

SEQ ID NO: 310747 - DNA, 20 bp, Artificial
  CRISPR gRNA sequence
aaattacaggtgcccgccac

SEQ ID NO: 310748 - DNA, 20 bp, Artificial
  CRISPR gRNA sequence
caggtgcccgccactatgcc

SEQ ID NO: 310749 - DNA, 20 bp, Artificial
  CRISPR gRNA sequence
tgcccagctaatttttgtat

SEQ ID NO: 310750 - DNA, 20 bp, Artificial
  CRISPR gRNA sequence
atttttgtatttttagtaga

SEQ ID NO: 310751 - DNA, 20 bp, Artificial
  CRISPR gRNA sequence
ttgtatttttagtagagacg

SEQ ID NO: 310752 - DNA, 20 bp, Artificial
  CRISPR gRNA sequence
tgtatttttagtagagacgg

SEQ ID NO: 310753 - DNA, 20 bp, Artificial
  CRISPR gRNA sequence
gtatttttagtagagacggg

SEQ ID NO: 310754 - DNA, 20 bp, Artificial
  CRISPR gRNA sequence
tatttttagtagagacgggg

SEQ ID NO: 310755 - DNA, 20 bp, Artificial
  CRISPR gRNA sequence
ttagtagagacggggtttcc

SEQ ID NO: 310756 - DNA, 20 bp, Artificial
  CRISPR gRNA sequence
tagtagagacggggtttccc

SEQ ID NO: 310757 - DNA, 20 bp, Artificial
  CRISPR gRNA sequence
agtagagacggggtttcccc

SEQ ID NO: 310758 - DNA, 20 bp, Artificial
  CRISPR gRNA sequence
gtagagacggggtttcccca

SEQ ID NO: 310759 - DNA, 20 bp, Artificial
  CRISPR gRNA sequence
ccccataatggccaggctgg

SEQ ID NO: 310760 - DNA, 20 bp, Artificial
  CRISPR gRNA sequence
cccataatggccaggctggt

SEQ ID NO: 310761 - DNA, 20 bp, Artificial
  CRISPR gRNA sequence
gtctcaaactcctgacctca

SEQ ID NO: 310762 - DNA, 20 bp, Artificial
  CRISPR gRNA sequence
aaactcctgacctcaggtaa

SEQ ID NO: 310763 - DNA, 20 bp, Artificial
  CRISPR gRNA sequence
ctgacctcaggtaatctgcc

SEQ ID NO: 310764 - DNA, 20 bp, Artificial
  CRISPR gRNA sequence
acctcaggtaatctgcccac

SEQ ID NO: 310765 - DNA, 20 bp, Artificial
  CRISPR gRNA sequence
aggtaatctgcccacctcgg

SEQ ID NO: 310766 - DNA, 20 bp, Artificial
  CRISPR gRNA sequence
cccacctcggcctcccaaag

SEQ ID NO: 310767 - DNA, 20 bp, Artificial
  CRISPR gRNA sequence
ggcctcccaaagtgctggga

SEQ ID NO: 310768 - DNA, 20 bp, Artificial
  CRISPR gRNA sequence
ccaaagtgctgggattacaa

SEQ ID NO: 310769 - DNA, 20 bp, Artificial
  CRISPR gRNA sequence
ggattacaagcatgagccac

SEQ ID NO: 310770 - DNA, 20 bp, Artificial
  CRISPR gRNA sequence
caagcatgagccaccacacc

SEQ ID NO: 310771 - DNA, 20 bp, Artificial
  CRISPR gRNA sequence
gcctgttttatattcttact

SEQ ID NO: 310772 - DNA, 20 bp, Artificial
  CRISPR gRNA sequence
ttttatattcttactggaca

SEQ ID NO: 310773 - DNA, 20 bp, Artificial
  CRISPR gRNA sequence
tatattcttactggacagtg

SEQ ID NO: 310774 - DNA, 20 bp, Artificial
  CRISPR gRNA sequence
atattcttactggacagtgc

SEQ ID NO: 310775 - DNA, 20 bp, Artificial
  CRISPR gRNA sequence
tattcttactggacagtgct

SEQ ID NO: 310776 - DNA, 20 bp, Artificial
  CRISPR gRNA sequence
ttactggacagtgctgatct

SEQ ID NO: 310777 - DNA, 20 bp, Artificial
  CRISPR gRNA sequence
actggacagtgctgatctag

SEQ ID NO: 310778 - DNA, 20 bp, Artificial
  CRISPR gRNA sequence
ctggacagtgctgatctaga

SEQ ID NO: 310779 - DNA, 20 bp, Artificial
  CRISPR gRNA sequence
gacagtgctgatctagagca

SEQ ID NO: 310780 - DNA, 20 bp, Artificial
  CRISPR gRNA sequence
atctagagcaggagtcaagc

SEQ ID NO: 310781 - DNA, 20 bp, Artificial
  CRISPR gRNA sequence
gagcaggagtcaagcagttt

SEQ ID NO: 310782 - DNA, 20 bp, Artificial
  CRISPR gRNA sequence
tttctatgaaaggccacata

SEQ ID NO: 310783 - DNA, 20 bp, Artificial
  CRISPR gRNA sequence
ttctatgaaaggccacatag

SEQ ID NO: 310784 - DNA, 20 bp, Artificial
  CRISPR gRNA sequence
tctatgaaaggccacataga

SEQ ID NO: 310785 - DNA, 20 bp, Artificial
  CRISPR gRNA sequence
ctatgaaaggccacatagaa

SEQ ID NO: 310786 - DNA, 20 bp, Artificial
  CRISPR gRNA sequence
tatgaaaggccacatagaaa

SEQ ID NO: 310787 - DNA, 20 bp, Artificial
  CRISPR gRNA sequence
tgaaaggccacatagaaaat

SEQ ID NO: 310788 - DNA, 20 bp, Artificial
  CRISPR gRNA sequence
tcagctttgcaggccatgca

SEQ ID NO: 310789 - DNA, 20 bp, Artificial
  CRISPR gRNA sequence
cagctttgcaggccatgcag

SEQ ID NO: 310790 - DNA, 20 bp, Artificial
  CRISPR gRNA sequence
agctttgcaggccatgcagt

SEQ ID NO: 310791 - DNA, 20 bp, Artificial
  CRISPR gRNA sequence
tgcaggccatgcagtctcca

SEQ ID NO: 310792 - DNA, 20 bp, Artificial
  CRISPR gRNA sequence
gcaggccatgcagtctccat

SEQ ID NO: 310793 - DNA, 20 bp, Artificial
  CRISPR gRNA sequence
caggccatgcagtctccatc

SEQ ID NO: 310794 - DNA, 20 bp, Artificial
  CRISPR gRNA sequence
catcatagctgttcaactct

SEQ ID NO: 310795 - DNA, 20 bp, Artificial
  CRISPR gRNA sequence
ttcaactcttccattgcact

SEQ ID NO: 310796 - DNA, 20 bp, Artificial
  CRISPR gRNA sequence
aactcttccattgcactgca

SEQ ID NO: 310797 - DNA, 20 bp, Artificial
  CRISPR gRNA sequence
ttccattgcactgcaaaagc

SEQ ID NO: 310798 - DNA, 20 bp, Artificial
  CRISPR gRNA sequence
ccattgcactgcaaaagcag

SEQ ID NO: 310799 - DNA, 20 bp, Artificial
  CRISPR gRNA sequence
cattgcactgcaaaagcagc

SEQ ID NO: 310800 - DNA, 20 bp, Artificial
  CRISPR gRNA sequence
cactgcaaaagcagccatag

SEQ ID NO: 310801 - DNA, 20 bp, Artificial
  CRISPR gRNA sequence
caaaagcagccatagataat

SEQ ID NO: 310802 - DNA, 20 bp, Artificial
  CRISPR gRNA sequence
acaatagacatagcagtgtt

SEQ ID NO: 310803 - DNA, 20 bp, Artificial
  CRISPR gRNA sequence
caatagacatagcagtgttc

SEQ ID NO: 310804 - DNA, 20 bp, Artificial
  CRISPR gRNA sequence
cagtacaactattaataaaa

SEQ ID NO: 310805 - DNA, 20 bp, Artificial
  CRISPR gRNA sequence
ttaataaaaataggtggtag

SEQ ID NO: 310806 - DNA, 20 bp, Artificial
  CRISPR gRNA sequence
ataaaaataggtggtagcca

SEQ ID NO: 310807 - DNA, 20 bp, Artificial
  CRISPR gRNA sequence
ggcctacaggctgtagtttg

SEQ ID NO: 310808 - DNA, 20 bp, Artificial
  CRISPR gRNA sequence
gcctacaggctgtagtttgc

SEQ ID NO: 310809 - DNA, 20 bp, Artificial
  CRISPR gRNA sequence
caggctgtagtttgctgacc

SEQ ID NO: 310810 - DNA, 20 bp, Artificial
  CRISPR gRNA sequence
tagtttgctgacccctgatc

SEQ ID NO: 310811 - DNA, 20 bp, Artificial
  CRISPR gRNA sequence
gctgacccctgatctagaag

SEQ ID NO: 310812 - DNA, 20 bp, Artificial
  CRISPR gRNA sequence
ctgacccctgatctagaaga

SEQ ID NO: 310813 - DNA, 20 bp, Artificial
  CRISPR gRNA sequence
acccctgatctagaagatcc

SEQ ID NO: 310814 - DNA, 20 bp, Artificial
  CRISPR gRNA sequence
atctagaagatccaagattt

SEQ ID NO: 310815 - DNA, 20 bp, Artificial
  CRISPR gRNA sequence
gaagatccaagattttattc

SEQ ID NO: 310816 - DNA, 20 bp, Artificial
  CRISPR gRNA sequence
tattcatatgtctggtggct

SEQ ID NO: 310817 - DNA, 20 bp, Artificial
  CRISPR gRNA sequence
attcatatgtctggtggctt

SEQ ID NO: 310818 - DNA, 20 bp, Artificial
  CRISPR gRNA sequence
ttcatatgtctggtggcttg

SEQ ID NO: 310819 - DNA, 20 bp, Artificial
  CRISPR gRNA sequence
atatgtctggtggcttggca

SEQ ID NO: 310820 - DNA, 20 bp, Artificial
  CRISPR gRNA sequence
gtggcttggcagggataggt

SEQ ID NO: 310821 - DNA, 20 bp, Artificial
  CRISPR gRNA sequence
ggcagggataggtggaaggc

SEQ ID NO: 310822 - DNA, 20 bp, Artificial
  CRISPR gRNA sequence
gcagggataggtggaaggct

SEQ ID NO: 310823 - DNA, 20 bp, Artificial
  CRISPR gRNA sequence
agctgggaccattgacccaa

SEQ ID NO: 310824 - DNA, 20 bp, Artificial
  CRISPR gRNA sequence
ggaccattgacccaaacagc

SEQ ID NO: 310825 - DNA, 20 bp, Artificial
  CRISPR gRNA sequence
acccaaacagctatacagtc

SEQ ID NO: 310826 - DNA, 20 bp, Artificial
  CRISPR gRNA sequence
tacagtcctctccagcatga

SEQ ID NO: 310827 - DNA, 20 bp, Artificial
  CRISPR gRNA sequence
tccagcatgatggtctcggg

SEQ ID NO: 310828 - DNA, 20 bp, Artificial
  CRISPR gRNA sequence
cagcatgatggtctcggggt

SEQ ID NO: 310829 - DNA, 20 bp, Artificial
  CRISPR gRNA sequence
ggggtagtgggacatcttac

SEQ ID NO: 310830 - DNA, 20 bp, Artificial
  CRISPR gRNA sequence
acgtggtggctcagaactcc

SEQ ID NO: 310831 - DNA, 20 bp, Artificial
  CRISPR gRNA sequence
cgtggtggctcagaactcca

SEQ ID NO: 310832 - DNA, 20 bp, Artificial
  CRISPR gRNA sequence
agaactccagataaggtact

SEQ ID NO: 310833 - DNA, 20 bp, Artificial
  CRISPR gRNA sequence
cagataaggtactcccagag

SEQ ID NO: 310834 - DNA, 20 bp, Artificial
  CRISPR gRNA sequence
ccagagagacaggtagaagc

SEQ ID NO: 310835 - DNA, 20 bp, Artificial
  CRISPR gRNA sequence
tgaggcttcttatgaccaag

SEQ ID NO: 310836 - DNA, 20 bp, Artificial
  CRISPR gRNA sequence
cttatgaccaagctctcgaa

SEQ ID NO: 310837 - DNA, 20 bp, Artificial
  CRISPR gRNA sequence
ttatgaccaagctctcgaag

SEQ ID NO: 310838 - DNA, 20 bp, Artificial
  CRISPR gRNA sequence
atgaccaagctctcgaagtc

SEQ ID NO: 310839 - DNA, 20 bp, Artificial
  CRISPR gRNA sequence
tgaccaagctctcgaagtcc

SEQ ID NO: 310840 - DNA, 20 bp, Artificial
  CRISPR gRNA sequence
tcgaagtcccagaatatccc

SEQ ID NO: 310841 - DNA, 20 bp, Artificial
  CRISPR gRNA sequence
gaagtcccagaatatccctt

SEQ ID NO: 310842 - DNA, 20 bp, Artificial
  CRISPR gRNA sequence
gtactgtattctatggtcaa

SEQ ID NO: 310843 - DNA, 20 bp, Artificial
  CRISPR gRNA sequence
tactgtattctatggtcaaa

SEQ ID NO: 310844 - DNA, 20 bp, Artificial
  CRISPR gRNA sequence
tattctatggtcaaacaggt

SEQ ID NO: 310845 - DNA, 20 bp, Artificial
  CRISPR gRNA sequence
tatggtcaaacaggtcactc

SEQ ID NO: 310846 - DNA, 20 bp, Artificial
  CRISPR gRNA sequence
tggtcaaacaggtcactcag

SEQ ID NO: 310847 - DNA, 20 bp, Artificial
  CRISPR gRNA sequence
aggctagcccagattcaaag

SEQ ID NO: 310848 - DNA, 20 bp, Artificial
  CRISPR gRNA sequence
gcccagattcaaagagagga

SEQ ID NO: 310849 - DNA, 20 bp, Artificial
  CRISPR gRNA sequence
aaagagaggagatccaactc

SEQ ID NO: 310850 - DNA, 20 bp, Artificial
  CRISPR gRNA sequence
tacctcttcatgggaggagg

SEQ ID NO: 310851 - DNA, 20 bp, Artificial
  CRISPR gRNA sequence
cctcttcatgggaggaggag

SEQ ID NO: 310852 - DNA, 20 bp, Artificial
  CRISPR gRNA sequence
ttcatgggaggaggagtagc

SEQ ID NO: 310853 - DNA, 20 bp, Artificial
  CRISPR gRNA sequence
catgggaggaggagtagcca

SEQ ID NO: 310854 - DNA, 20 bp, Artificial
  CRISPR gRNA sequence
atgggaggaggagtagccaa

SEQ ID NO: 310855 - DNA, 20 bp, Artificial
  CRISPR gRNA sequence
ctttttaatctattatatca

SEQ ID NO: 310856 - DNA, 20 bp, Artificial
  CRISPR gRNA sequence
tttttaatctattatatcat

SEQ ID NO: 310857 - DNA, 20 bp, Artificial
  CRISPR gRNA sequence
tttaatctattatatcattc

SEQ ID NO: 310858 - DNA, 20 bp, Artificial
  CRISPR gRNA sequence
ttaatctattatatcattct

SEQ ID NO: 310859 - DNA, 20 bp, Artificial
  CRISPR gRNA sequence
taatctattatatcattctt

SEQ ID NO: 310860 - DNA, 20 bp, Artificial
  CRISPR gRNA sequence
aatctattatatcattcttc

SEQ ID NO: 310861 - DNA, 20 bp, Artificial
  CRISPR gRNA sequence
atctattatatcattcttca

SEQ ID NO: 310862 - DNA, 20 bp, Artificial
  CRISPR gRNA sequence
ttatatcattcttcagatct

SEQ ID NO: 310863 - DNA, 20 bp, Artificial
  CRISPR gRNA sequence
tatcattcttcagatctcag

SEQ ID NO: 310864 - DNA, 20 bp, Artificial
  CRISPR gRNA sequence
ttcagatctcagtttaggct

SEQ ID NO: 310865 - DNA, 20 bp, Artificial
  CRISPR gRNA sequence
cagatctcagtttaggctgg

SEQ ID NO: 310866 - DNA, 20 bp, Artificial
  CRISPR gRNA sequence
agatctcagtttaggctggt

SEQ ID NO: 310867 - DNA, 20 bp, Artificial
  CRISPR gRNA sequence
agtttaggctggtcctgtta

SEQ ID NO: 310868 - DNA, 20 bp, Artificial
  CRISPR gRNA sequence
aggctggtcctgttatgggc

SEQ ID NO: 310869 - DNA, 20 bp, Artificial
  CRISPR gRNA sequence
ggctggtcctgttatgggct

SEQ ID NO: 310870 - DNA, 20 bp, Artificial
  CRISPR gRNA sequence
gtcctgttatgggctctcaa

SEQ ID NO: 310871 - DNA, 20 bp, Artificial
  CRISPR gRNA sequence
ttatgggctctcaaagtacc

SEQ ID NO: 310872 - DNA, 20 bp, Artificial
  CRISPR gRNA sequence
tgggctctcaaagtaccatg

SEQ ID NO: 310873 - DNA, 20 bp, Artificial
  CRISPR gRNA sequence
tcaaagtaccatgaacctct

SEQ ID NO: 310874 - DNA, 20 bp, Artificial
  CRISPR gRNA sequence
aaagtaccatgaacctctct

SEQ ID NO: 310875 - DNA, 20 bp, Artificial
  CRISPR gRNA sequence
tcttttgtagcacttgtcat

SEQ ID NO: 310876 - DNA, 20 bp, Artificial
  CRISPR gRNA sequence
ttttgtagcacttgtcatag

SEQ ID NO: 310877 - DNA, 20 bp, Artificial
  CRISPR gRNA sequence
ttgtagcacttgtcatagct

SEQ ID NO: 310878 - DNA, 20 bp, Artificial
  CRISPR gRNA sequence
tgtagcacttgtcatagcta

SEQ ID NO: 310879 - DNA, 20 bp, Artificial
  CRISPR gRNA sequence
gtagcacttgtcatagctag

SEQ ID NO: 310880 - DNA, 20 bp, Artificial
  CRISPR gRNA sequence
tagcacttgtcatagctagt

SEQ ID NO: 310881 - DNA, 20 bp, Artificial
  CRISPR gRNA sequence
gtcatagctagttttacatt

SEQ ID NO: 310882 - DNA, 20 bp, Artificial
  CRISPR gRNA sequence
tcatagctagttttacattt

SEQ ID NO: 310883 - DNA, 20 bp, Artificial
  CRISPR gRNA sequence
gttttacatttctctgtatg

SEQ ID NO: 310884 - DNA, 20 bp, Artificial
  CRISPR gRNA sequence
tacatttctctgtatgatta

SEQ ID NO: 310885 - DNA, 20 bp, Artificial
  CRISPR gRNA sequence
acatttctctgtatgattac

SEQ ID NO: 310886 - DNA, 20 bp, Artificial
  CRISPR gRNA sequence
catttctctgtatgattact

SEQ ID NO: 310887 - DNA, 20 bp, Artificial
  CRISPR gRNA sequence
ctctgtatgattacttgatc

SEQ ID NO: 310888 - DNA, 20 bp, Artificial
  CRISPR gRNA sequence
tctgtatgattacttgatca

SEQ ID NO: 310889 - DNA, 20 bp, Artificial
  CRISPR gRNA sequence
tgtatgattacttgatcact

SEQ ID NO: 310890 - DNA, 20 bp, Artificial
  CRISPR gRNA sequence
tatgattacttgatcactat

SEQ ID NO: 310891 - DNA, 20 bp, Artificial
  CRISPR gRNA sequence
cttgatcactatcttgcttt

SEQ ID NO: 310892 - DNA, 20 bp, Artificial
  CRISPR gRNA sequence
gatcactatcttgcttttct

SEQ ID NO: 310893 - DNA, 20 bp, Artificial
  CRISPR gRNA sequence
atcactatcttgcttttcta

SEQ ID NO: 310894 - DNA, 20 bp, Artificial
  CRISPR gRNA sequence
tcttgcttttctactaaact

SEQ ID NO: 310895 - DNA, 20 bp, Artificial
  CRISPR gRNA sequence
gcttttctactaaactgtag

SEQ ID NO: 310896 - DNA, 20 bp, Artificial
  CRISPR gRNA sequence
cttttctactaaactgtagg

SEQ ID NO: 310897 - DNA, 20 bp, Artificial
  CRISPR gRNA sequence
ttctactaaactgtaggcaa

SEQ ID NO: 310898 - DNA, 20 bp, Artificial
  CRISPR gRNA sequence
tctactaaactgtaggcaac

SEQ ID NO: 310899 - DNA, 20 bp, Artificial
  CRISPR gRNA sequence
ctactaaactgtaggcaacc

SEQ ID NO: 310900 - DNA, 20 bp, Artificial
  CRISPR gRNA sequence
tactaaactgtaggcaacca

SEQ ID NO: 310901 - DNA, 20 bp, Artificial
  CRISPR gRNA sequence
ctaaactgtaggcaaccacg

SEQ ID NO: 310902 - DNA, 20 bp, Artificial
  CRISPR gRNA sequence
aactgtaggcaaccacgtga

SEQ ID NO: 310903 - DNA, 20 bp, Artificial
  CRISPR gRNA sequence
taggcaaccacgtgaagagg

SEQ ID NO: 310904 - DNA, 20 bp, Artificial
  CRISPR gRNA sequence
tttctggttttgctcattat

SEQ ID NO: 310905 - DNA, 20 bp, Artificial
  CRISPR gRNA sequence
ctggttttgctcattatatt

SEQ ID NO: 310906 - DNA, 20 bp, Artificial
  CRISPR gRNA sequence
tggttttgctcattatattc

SEQ ID NO: 310907 - DNA, 20 bp, Artificial
  CRISPR gRNA sequence
gttttgctcattatattcct

SEQ ID NO: 310908 - DNA, 20 bp, Artificial
  CRISPR gRNA sequence
tgctcattatattcctagca

SEQ ID NO: 310909 - DNA, 20 bp, Artificial
  CRISPR gRNA sequence
gctcattatattcctagcac

SEQ ID NO: 310910 - DNA, 20 bp, Artificial
  CRISPR gRNA sequence
ctcattatattcctagcacc

SEQ ID NO: 310911 - DNA, 20 bp, Artificial
  CRISPR gRNA sequence
attatattcctagcaccaaa

SEQ ID NO: 310912 - DNA, 20 bp, Artificial
  CRISPR gRNA sequence
tattcctagcaccaaacaca

SEQ ID NO: 310913 - DNA, 20 bp, Artificial
  CRISPR gRNA sequence
ctagcaccaaacacaatgct

SEQ ID NO: 310914 - DNA, 20 bp, Artificial
  CRISPR gRNA sequence
gcaccaaacacaatgcttgg

SEQ ID NO: 310915 - DNA, 20 bp, Artificial
  CRISPR gRNA sequence
ggttcaataaatatttgtgg

SEQ ID NO: 310916 - DNA, 20 bp, Artificial
  CRISPR gRNA sequence
gttcaataaatatttgtgga

SEQ ID NO: 310917 - DNA, 20 bp, Artificial
  CRISPR gRNA sequence
aataaatatttgtggaagaa

SEQ ID NO: 310918 - DNA, 20 bp, Artificial
  CRISPR gRNA sequence
gtggaagaaacgaatgaatg

SEQ ID NO: 310919 - DNA, 20 bp, Artificial
  CRISPR gRNA sequence
tggaagaaacgaatgaatga

SEQ ID NO: 310920 - DNA, 20 bp, Artificial
  CRISPR gRNA sequence
tatcaatattaatcctacat

SEQ ID NO: 310921 - DNA, 20 bp, Artificial
  CRISPR gRNA sequence
atcctacatttctccatatt

SEQ ID NO: 310922 - DNA, 20 bp, Artificial
  CRISPR gRNA sequence
catttctccatattgctgtc

SEQ ID NO: 310923 - DNA, 20 bp, Artificial
  CRISPR gRNA sequence
ctccatattgctgtcacgta

SEQ ID NO: 310924 - DNA, 20 bp, Artificial
  CRISPR gRNA sequence
tccatattgctgtcacgtat

SEQ ID NO: 310925 - DNA, 20 bp, Artificial
  CRISPR gRNA sequence
catattgctgtcacgtatat

SEQ ID NO: 310926 - DNA, 20 bp, Artificial
  CRISPR gRNA sequence
ctgtcacgtatatcataaga

SEQ ID NO: 310927 - DNA, 20 bp, Artificial
  CRISPR gRNA sequence
tcacgtatatcataagatac

SEQ ID NO: 310928 - DNA, 20 bp, Artificial
  CRISPR gRNA sequence
tgtcagaagccttgctaaaa

SEQ ID NO: 310929 - DNA, 20 bp, Artificial
  CRISPR gRNA sequence
tcagaagccttgctaaaatt

SEQ ID NO: 310930 - DNA, 20 bp, Artificial
  CRISPR gRNA sequence
gctaaaattcaaatatattt

SEQ ID NO: 310931 - DNA, 20 bp, Artificial
  CRISPR gRNA sequence
ctaaaattcaaatatatttg

SEQ ID NO: 310932 - DNA, 20 bp, Artificial
  CRISPR gRNA sequence
aaattcaaatatatttgatt

SEQ ID NO: 310933 - DNA, 20 bp, Artificial
  CRISPR gRNA sequence
aaatatatttgattcccagt

SEQ ID NO: 310934 - DNA, 20 bp, Artificial
  CRISPR gRNA sequence
gattcccagtaaccttctta

SEQ ID NO: 310935 - DNA, 20 bp, Artificial
  CRISPR gRNA sequence
attcccagtaaccttcttat

SEQ ID NO: 310936 - DNA, 20 bp, Artificial
  CRISPR gRNA sequence
ccagtaaccttcttattttg

SEQ ID NO: 310937 - DNA, 20 bp, Artificial
  CRISPR gRNA sequence
cttattttgtagttcagaaa

SEQ ID NO: 310938 - DNA, 20 bp, Artificial
  CRISPR gRNA sequence
ttattttgtagttcagaaac

SEQ ID NO: 310939 - DNA, 20 bp, Artificial
  CRISPR gRNA sequence
attttgtagttcagaaactt

SEQ ID NO: 310940 - DNA, 20 bp, Artificial
  CRISPR gRNA sequence
ttttgtagttcagaaacttt

SEQ ID NO: 310941 - DNA, 20 bp, Artificial
  CRISPR gRNA sequence
tgtagttcagaaactttata

SEQ ID NO: 310942 - DNA, 20 bp, Artificial
  CRISPR gRNA sequence
gtagttcagaaactttataa

SEQ ID NO: 310943 - DNA, 20 bp, Artificial
  CRISPR gRNA sequence
tagttcagaaactttataaa

SEQ ID NO: 310944 - DNA, 20 bp, Artificial
  CRISPR gRNA sequence
agaaactttataaagaagga

SEQ ID NO: 310945 - DNA, 20 bp, Artificial
  CRISPR gRNA sequence
tataaagaaggaaataagcc

SEQ ID NO: 310946 - DNA, 20 bp, Artificial
  CRISPR gRNA sequence
ataaagaaggaaataagcct

SEQ ID NO: 310947 - DNA, 20 bp, Artificial
  CRISPR gRNA sequence
taaagaaggaaataagccta

SEQ ID NO: 310948 - DNA, 20 bp, Artificial
  CRISPR gRNA sequence
tcttactcttcccagtatct

SEQ ID NO: 310949 - DNA, 20 bp, Artificial
  CRISPR gRNA sequence
actcttcccagtatctcaaa

SEQ ID NO: 310950 - DNA, 20 bp, Artificial
  CRISPR gRNA sequence
ctcttcccagtatctcaaag

SEQ ID NO: 310951 - DNA, 20 bp, Artificial
  CRISPR gRNA sequence
ttcccagtatctcaaagagg

SEQ ID NO: 310952 - DNA, 20 bp, Artificial
  CRISPR gRNA sequence
cccagtatctcaaagagggt

SEQ ID NO: 310953 - DNA, 20 bp, Artificial
  CRISPR gRNA sequence
ccagtatctcaaagagggtt

SEQ ID NO: 310954 - DNA, 20 bp, Artificial
  CRISPR gRNA sequence
aaagagggtttctgccctga

SEQ ID NO: 310955 - DNA, 20 bp, Artificial
  CRISPR gRNA sequence
ctgccctgagctgctcaaga

SEQ ID NO: 310956 - DNA, 20 bp, Artificial
  CRISPR gRNA sequence
tgccctgagctgctcaagag

SEQ ID NO: 310957 - DNA, 20 bp, Artificial
  CRISPR gRNA sequence
ccctgagctgctcaagaggg

SEQ ID NO: 310958 - DNA, 20 bp, Artificial
  CRISPR gRNA sequence
agctgctcaagagggtttct

SEQ ID NO: 310959 - DNA, 20 bp, Artificial
  CRISPR gRNA sequence
ctcaagagggtttctgccct

SEQ ID NO: 310960 - DNA, 20 bp, Artificial
  CRISPR gRNA sequence
aagagggtttctgccctgag

SEQ ID NO: 310961 - DNA, 20 bp, Artificial
  CRISPR gRNA sequence
ctgccctgagctgctgttca

SEQ ID NO: 310962 - DNA, 20 bp, Artificial
  CRISPR gRNA sequence
tgccctgagctgctgttcat

SEQ ID NO: 310963 - DNA, 20 bp, Artificial
  CRISPR gRNA sequence
ccctgagctgctgttcattc

SEQ ID NO: 310964 - DNA, 20 bp, Artificial
  CRISPR gRNA sequence
agctgctgttcattctgcaa

SEQ ID NO: 310965 - DNA, 20 bp, Artificial
  CRISPR gRNA sequence
ctgttcattctgcaaacact

SEQ ID NO: 310966 - DNA, 20 bp, Artificial
  CRISPR gRNA sequence
ttcattctgcaaacactgct

SEQ ID NO: 310967 - DNA, 20 bp, Artificial
  CRISPR gRNA sequence
attctgcaaacactgctcga

SEQ ID NO: 310968 - DNA, 20 bp, Artificial
  CRISPR gRNA sequence
tgcaaacactgctcgaatac

SEQ ID NO: 310969 - DNA, 20 bp, Artificial
  CRISPR gRNA sequence
caaacactgctcgaataccc

SEQ ID NO: 310970 - DNA, 20 bp, Artificial
  CRISPR gRNA sequence
ctcgaatacccactgtgtgc

SEQ ID NO: 310971 - DNA, 20 bp, Artificial
  CRISPR gRNA sequence
gaatacccactgtgtgccag

SEQ ID NO: 310972 - DNA, 20 bp, Artificial
  CRISPR gRNA sequence
tgtgccaggtacagagagtt

SEQ ID NO: 310973 - DNA, 20 bp, Artificial
  CRISPR gRNA sequence
ttctctgctgtaatctggac

SEQ ID NO: 310974 - DNA, 20 bp, Artificial
  CRISPR gRNA sequence
ctctgctgtaatctggacag

SEQ ID NO: 310975 - DNA, 20 bp, Artificial
  CRISPR gRNA sequence
tctgctgtaatctggacagg

SEQ ID NO: 310976 - DNA, 20 bp, Artificial
  CRISPR gRNA sequence
tgctgtaatctggacaggca

SEQ ID NO: 310977 - DNA, 20 bp, Artificial
  CRISPR gRNA sequence
ctgtaatctggacaggcacc

SEQ ID NO: 310978 - DNA, 20 bp, Artificial
  CRISPR gRNA sequence
taatctggacaggcaccagc

SEQ ID NO: 310979 - DNA, 20 bp, Artificial
  CRISPR gRNA sequence
gacaggcaccagcttcccag

SEQ ID NO: 310980 - DNA, 20 bp, Artificial
  CRISPR gRNA sequence
cccagcgtgggtttaggctt

SEQ ID NO: 310981 - DNA, 20 bp, Artificial
  CRISPR gRNA sequence
ccagcgtgggtttaggcttc

SEQ ID NO: 310982 - DNA, 20 bp, Artificial
  CRISPR gRNA sequence
aggcttcaggtgcacactac

SEQ ID NO: 310983 - DNA, 20 bp, Artificial
  CRISPR gRNA sequence
ggcttcaggtgcacactact

SEQ ID NO: 310984 - DNA, 20 bp, Artificial
  CRISPR gRNA sequence
caggtgcacactactgtgta

SEQ ID NO: 310985 - DNA, 20 bp, Artificial
  CRISPR gRNA sequence
aggtgcacactactgtgtac

SEQ ID NO: 310986 - DNA, 20 bp, Artificial
  CRISPR gRNA sequence
ctgtgtaccgtctaagccac

SEQ ID NO: 310987 - DNA, 20 bp, Artificial
  CRISPR gRNA sequence
tgtaccgtctaagccacacc

SEQ ID NO: 310988 - DNA, 20 bp, Artificial
  CRISPR gRNA sequence
agccacacctagaagagctc

SEQ ID NO: 310989 - DNA, 20 bp, Artificial
  CRISPR gRNA sequence
gaagagctctggggaaatat

SEQ ID NO: 310990 - DNA, 20 bp, Artificial
  CRISPR gRNA sequence
tggggaaatatgactacttg

SEQ ID NO: 310991 - DNA, 20 bp, Artificial
  CRISPR gRNA sequence
gggaaatatgactacttggg

SEQ ID NO: 310992 - DNA, 20 bp, Artificial
  CRISPR gRNA sequence
cttgggcagaaaaggaagga

SEQ ID NO: 310993 - DNA, 20 bp, Artificial
  CRISPR gRNA sequence
gggcagaaaaggaaggaact

SEQ ID NO: 310994 - DNA, 20 bp, Artificial
  CRISPR gRNA sequence
ggcagaaaaggaaggaacta

SEQ ID NO: 310995 - DNA, 20 bp, Artificial
  CRISPR gRNA sequence
agaagaggtatctttgtgtc

SEQ ID NO: 310996 - DNA, 20 bp, Artificial
  CRISPR gRNA sequence
tgtgtctgaggtctgaagga

SEQ ID NO: 310997 - DNA, 20 bp, Artificial
  CRISPR gRNA sequence
gtgtctgaggtctgaaggag

SEQ ID NO: 310998 - DNA, 20 bp, Artificial
  CRISPR gRNA sequence
tgtctgaggtctgaaggagc

SEQ ID NO: 310999 - DNA, 20 bp, Artificial
  CRISPR gRNA sequence
aggtctgaaggagcgtgtgg

SEQ ID NO: 311000 - DNA, 20 bp, Artificial
  CRISPR gRNA sequence
aaggagcgtgtgggctcttg

SEQ ID NO: 311001 - DNA, 20 bp, Artificial
  CRISPR gRNA sequence
ttgttcaggcaaagggcagg

SEQ ID NO: 311002 - DNA, 20 bp, Artificial
  CRISPR gRNA sequence
gttcaggcaaagggcaggat

SEQ ID NO: 311003 - DNA, 20 bp, Artificial
  CRISPR gRNA sequence
ttcaggcaaagggcaggatg

SEQ ID NO: 311004 - DNA, 20 bp, Artificial
  CRISPR gRNA sequence
aggcaaagggcaggatgagg

SEQ ID NO: 311005 - DNA, 20 bp, Artificial
  CRISPR gRNA sequence
caggtcctggtgctctgaga

SEQ ID NO: 311006 - DNA, 20 bp, Artificial
  CRISPR gRNA sequence
aggtcctggtgctctgagaa

SEQ ID NO: 311007 - DNA, 20 bp, Artificial
  CRISPR gRNA sequence
gtgctctgagaagtaacgct

SEQ ID NO: 311008 - DNA, 20 bp, Artificial
  CRISPR gRNA sequence
tgagaagtaacgctgtgcag

SEQ ID NO: 311009 - DNA, 20 bp, Artificial
  CRISPR gRNA sequence
agaagtaacgctgtgcagca

SEQ ID NO: 311010 - DNA, 20 bp, Artificial
  CRISPR gRNA sequence
tgcagcatgtcacacccaga

SEQ ID NO: 311011 - DNA, 20 bp, Artificial
  CRISPR gRNA sequence
atgttgcactggagctctac

SEQ ID NO: 311012 - DNA, 20 bp, Artificial
  CRISPR gRNA sequence
cactggagctctactctcct

SEQ ID NO: 311013 - DNA, 20 bp, Artificial
  CRISPR gRNA sequence
gagctctactctcctctcag

SEQ ID NO: 311014 - DNA, 20 bp, Artificial
  CRISPR gRNA sequence
tactctcctctcagcgagct

SEQ ID NO: 311015 - DNA, 20 bp, Artificial
  CRISPR gRNA sequence
ctctcctctcagcgagctgg

SEQ ID NO: 311016 - DNA, 20 bp, Artificial
  CRISPR gRNA sequence
tcctctcagcgagctggtga

SEQ ID NO: 311017 - DNA, 20 bp, Artificial
  CRISPR gRNA sequence
ctctcagcgagctggtgacg

SEQ ID NO: 311018 - DNA, 20 bp, Artificial
  CRISPR gRNA sequence
tcagcgagctggtgacgtgc

SEQ ID NO: 311019 - DNA, 20 bp, Artificial
  CRISPR gRNA sequence
agcgagctggtgacgtgcca

SEQ ID NO: 311020 - DNA, 20 bp, Artificial
  CRISPR gRNA sequence
gtgacgtgccagtccagcag

SEQ ID NO: 311021 - DNA, 20 bp, Artificial
  CRISPR gRNA sequence
gcttatccaaccacaagtat

SEQ ID NO: 311022 - DNA, 20 bp, Artificial
  CRISPR gRNA sequence
atccaaccacaagtatgaat

SEQ ID NO: 311023 - DNA, 20 bp, Artificial
  CRISPR gRNA sequence
tccaaccacaagtatgaatc

SEQ ID NO: 311024 - DNA, 20 bp, Artificial
  CRISPR gRNA sequence
ggccctgagtgctgctgggc

SEQ ID NO: 311025 - DNA, 20 bp, Artificial
  CRISPR gRNA sequence
agtgctgctgggctgaggcc

SEQ ID NO: 311026 - DNA, 20 bp, Artificial
  CRISPR gRNA sequence
ctgggctgaggccgacctaa

SEQ ID NO: 311027 - DNA, 20 bp, Artificial
  CRISPR gRNA sequence
ggctgaggccgacctaatcc

SEQ ID NO: 311028 - DNA, 20 bp, Artificial
  CRISPR gRNA sequence
aggccgacctaatccttcct

SEQ ID NO: 311029 - DNA, 20 bp, Artificial
  CRISPR gRNA sequence
atccttcctccacagagact

SEQ ID NO: 311030 - DNA, 20 bp, Artificial
  CRISPR gRNA sequence
cctccacagagactgtggtg

SEQ ID NO: 311031 - DNA, 20 bp, Artificial
  CRISPR gRNA sequence
ctccacagagactgtggtgt

SEQ ID NO: 311032 - DNA, 20 bp, Artificial
  CRISPR gRNA sequence
cacagagactgtggtgtccc

SEQ ID NO: 311033 - DNA, 20 bp, Artificial
  CRISPR gRNA sequence
tggtgtcccctgctttgctc

SEQ ID NO: 311034 - DNA, 20 bp, Artificial
  CRISPR gRNA sequence
ctttgctcagggtaagaact

SEQ ID NO: 311035 - DNA, 20 bp, Artificial
  CRISPR gRNA sequence
tgctcagggtaagaactctt

SEQ ID NO: 311036 - DNA, 20 bp, Artificial
  CRISPR gRNA sequence
gctcagggtaagaactcttg

SEQ ID NO: 311037 - DNA, 20 bp, Artificial
  CRISPR gRNA sequence
ctcagggtaagaactcttgt

SEQ ID NO: 311038 - DNA, 20 bp, Artificial
  CRISPR gRNA sequence
agggtaagaactcttgtata

SEQ ID NO: 311039 - DNA, 20 bp, Artificial
  CRISPR gRNA sequence
ttgtatacctcacaagaagc

SEQ ID NO: 311040 - DNA, 20 bp, Artificial
  CRISPR gRNA sequence
gtatacctcacaagaagcca

SEQ ID NO: 311041 - DNA, 20 bp, Artificial
  CRISPR gRNA sequence
tatacctcacaagaagccaa

SEQ ID NO: 311042 - DNA, 20 bp, Artificial
  CRISPR gRNA sequence
acaagaagccaaggactacc

SEQ ID NO: 311043 - DNA, 20 bp, Artificial
  CRISPR gRNA sequence
cctaccaccttccacactgg

SEQ ID NO: 311044 - DNA, 20 bp, Artificial
  CRISPR gRNA sequence
ccaccttccacactggccct

SEQ ID NO: 311045 - DNA, 20 bp, Artificial
  CRISPR gRNA sequence
ccacactggccctggagcct

SEQ ID NO: 311046 - DNA, 20 bp, Artificial
  CRISPR gRNA sequence
cacactggccctggagcctg

SEQ ID NO: 311047 - DNA, 20 bp, Artificial
  CRISPR gRNA sequence
gccctggagcctgcattgta

SEQ ID NO: 311048 - DNA, 20 bp, Artificial
  CRISPR gRNA sequence
gagcctgcattgtagttatt

SEQ ID NO: 311049 - DNA, 20 bp, Artificial
  CRISPR gRNA sequence
cattgtagttatttgtggac

SEQ ID NO: 311050 - DNA, 20 bp, Artificial
  CRISPR gRNA sequence
tagttatttgtggacacttt

SEQ ID NO: 311051 - DNA, 20 bp, Artificial
  CRISPR gRNA sequence
tttgtggacactttttcttc

SEQ ID NO: 311052 - DNA, 20 bp, Artificial
  CRISPR gRNA sequence
gtggacactttttcttctct

SEQ ID NO: 311053 - DNA, 20 bp, Artificial
  CRISPR gRNA sequence
tggacactttttcttctctt

SEQ ID NO: 311054 - DNA, 20 bp, Artificial
  CRISPR gRNA sequence
tttcttctctttagtgccag

SEQ ID NO: 311055 - DNA, 20 bp, Artificial
  CRISPR gRNA sequence
ttcttctctttagtgccagg

SEQ ID NO: 311056 - DNA, 20 bp, Artificial
  CRISPR gRNA sequence
tcttctctttagtgccaggt

SEQ ID NO: 311057 - DNA, 20 bp, Artificial
  CRISPR gRNA sequence
cttctctttagtgccaggtg

SEQ ID NO: 311058 - DNA, 20 bp, Artificial
  CRISPR gRNA sequence
ttctctttagtgccaggtgg

SEQ ID NO: 311059 - DNA, 20 bp, Artificial
  CRISPR gRNA sequence
ctctttagtgccaggtgggg

SEQ ID NO: 311060 - DNA, 20 bp, Artificial
  CRISPR gRNA sequence
tctttagtgccaggtggggg

SEQ ID NO: 311061 - DNA, 20 bp, Artificial
  CRISPR gRNA sequence
tttagtgccaggtgggggac

SEQ ID NO: 311062 - DNA, 20 bp, Artificial
  CRISPR gRNA sequence
tagtgccaggtgggggacca

SEQ ID NO: 311063 - DNA, 20 bp, Artificial
  CRISPR gRNA sequence
agtgccaggtgggggaccaa

SEQ ID NO: 311064 - DNA, 20 bp, Artificial
  CRISPR gRNA sequence
gtgccaggtgggggaccaag

SEQ ID NO: 311065 - DNA, 20 bp, Artificial
  CRISPR gRNA sequence
catgtctttacaacccctca

SEQ ID NO: 311066 - DNA, 20 bp, Artificial
  CRISPR gRNA sequence
tacaacccctcaatctctag

SEQ ID NO: 311067 - DNA, 20 bp, Artificial
  CRISPR gRNA sequence
acaacccctcaatctctaga

SEQ ID NO: 311068 - DNA, 20 bp, Artificial
  CRISPR gRNA sequence
caacccctcaatctctagaa

SEQ ID NO: 311069 - DNA, 20 bp, Artificial
  CRISPR gRNA sequence
aatctctagaacaagtctga

SEQ ID NO: 311070 - DNA, 20 bp, Artificial
  CRISPR gRNA sequence
tagaacaagtctgacactga

SEQ ID NO: 311071 - DNA, 20 bp, Artificial
  CRISPR gRNA sequence
gaacaagtctgacactgagt

SEQ ID NO: 311072 - DNA, 20 bp, Artificial
  CRISPR gRNA sequence
acactgagtagatgtagcaa

SEQ ID NO: 311073 - DNA, 20 bp, Artificial
  CRISPR gRNA sequence
agtagatgtagcaaatgttt

SEQ ID NO: 311074 - DNA, 20 bp, Artificial
  CRISPR gRNA sequence
gcctgaaagactacctcaat

SEQ ID NO: 311075 - DNA, 20 bp, Artificial
  CRISPR gRNA sequence
cctgaaagactacctcaata

SEQ ID NO: 311076 - DNA, 20 bp, Artificial
  CRISPR gRNA sequence
aaagactacctcaataaata

SEQ ID NO: 311077 - DNA, 20 bp, Artificial
  CRISPR gRNA sequence
cctcaataaataaccttctg

SEQ ID NO: 311078 - DNA, 20 bp, Artificial
  CRISPR gRNA sequence
aataaataaccttctgaggc

SEQ ID NO: 311079 - DNA, 20 bp, Artificial
  CRISPR gRNA sequence
ctgaggcaccagcaaacttc

SEQ ID NO: 311080 - DNA, 20 bp, Artificial
  CRISPR gRNA sequence
tgaggcaccagcaaacttct

SEQ ID NO: 311081 - DNA, 20 bp, Artificial
  CRISPR gRNA sequence
aggcaccagcaaacttctca

SEQ ID NO: 311082 - DNA, 20 bp, Artificial
  CRISPR gRNA sequence
ctcagcatttttcctgatac

SEQ ID NO: 311083 - DNA, 20 bp, Artificial
  CRISPR gRNA sequence
tcagcatttttcctgatact

SEQ ID NO: 311084 - DNA, 20 bp, Artificial
  CRISPR gRNA sequence
agcatttttcctgatactcc

SEQ ID NO: 311085 - DNA, 20 bp, Artificial
  CRISPR gRNA sequence
ttcctgatactccggttacc

SEQ ID NO: 311086 - DNA, 20 bp, Artificial
  CRISPR gRNA sequence
tcctgatactccggttacca

SEQ ID NO: 311087 - DNA, 20 bp, Artificial
  CRISPR gRNA sequence
cctgatactccggttaccac

SEQ ID NO: 311088 - DNA, 20 bp, Artificial
  CRISPR gRNA sequence
ctgatactccggttaccact

SEQ ID NO: 311089 - DNA, 20 bp, Artificial
  CRISPR gRNA sequence
atactccggttaccactaac

SEQ ID NO: 311090 - DNA, 20 bp, Artificial
  CRISPR gRNA sequence
cggttaccactaacattcta

SEQ ID NO: 311091 - DNA, 20 bp, Artificial
  CRISPR gRNA sequence
ccactaacattctacacaaa

SEQ ID NO: 311092 - DNA, 20 bp, Artificial
  CRISPR gRNA sequence
acattctacacaaagttgtg

SEQ ID NO: 311093 - DNA, 20 bp, Artificial
  CRISPR gRNA sequence
tacacaaagttgtgaaataa

SEQ ID NO: 311094 - DNA, 20 bp, Artificial
  CRISPR gRNA sequence
cacaaagttgtgaaataagt

SEQ ID NO: 311095 - DNA, 20 bp, Artificial
  CRISPR gRNA sequence
tgaaataagtctttttcttt

SEQ ID NO: 311096 - DNA, 20 bp, Artificial
  CRISPR gRNA sequence
tttctttgttgctctccaac

SEQ ID NO: 311097 - DNA, 20 bp, Artificial
  CRISPR gRNA sequence
ttctttgttgctctccaaca

SEQ ID NO: 311098 - DNA, 20 bp, Artificial
  CRISPR gRNA sequence
tctttgttgctctccaacat

SEQ ID NO: 311099 - DNA, 20 bp, Artificial
  CRISPR gRNA sequence
ctttgttgctctccaacatc

SEQ ID NO: 311100 - DNA, 20 bp, Artificial
  CRISPR gRNA sequence
tttgttgctctccaacatct

SEQ ID NO: 311101 - DNA, 20 bp, Artificial
  CRISPR gRNA sequence
tgttgctctccaacatctac

SEQ ID NO: 311102 - DNA, 20 bp, Artificial
  CRISPR gRNA sequence
gttgctctccaacatctact

SEQ ID NO: 311103 - DNA, 20 bp, Artificial
  CRISPR gRNA sequence
ttgctctccaacatctactg

SEQ ID NO: 311104 - DNA, 20 bp, Artificial
  CRISPR gRNA sequence
ctctccaacatctactgtgg

SEQ ID NO: 311105 - DNA, 20 bp, Artificial
  CRISPR gRNA sequence
tccaacatctactgtggacc

SEQ ID NO: 311106 - DNA, 20 bp, Artificial
  CRISPR gRNA sequence
caacatctactgtggacccc

SEQ ID NO: 311107 - DNA, 20 bp, Artificial
  CRISPR gRNA sequence
ctgtggacccctcctctcac

SEQ ID NO: 311108 - DNA, 20 bp, Artificial
  CRISPR gRNA sequence
tggacccctcctctcacttc

SEQ ID NO: 311109 - DNA, 20 bp, Artificial
  CRISPR gRNA sequence
ctctcacttcctgtttcatc

SEQ ID NO: 311110 - DNA, 20 bp, Artificial
  CRISPR gRNA sequence
tcacttcctgtttcatcctc

SEQ ID NO: 311111 - DNA, 20 bp, Artificial
  CRISPR gRNA sequence
acttcctgtttcatcctctc

SEQ ID NO: 311112 - DNA, 20 bp, Artificial
  CRISPR gRNA sequence
cctgtttcatcctctctgca

SEQ ID NO: 311113 - DNA, 20 bp, Artificial
  CRISPR gRNA sequence
ctgtttcatcctctctgcac

SEQ ID NO: 311114 - DNA, 20 bp, Artificial
  CRISPR gRNA sequence
tttcatcctctctgcactcc

SEQ ID NO: 311115 - DNA, 20 bp, Artificial
  CRISPR gRNA sequence
catcctctctgcactcccct

SEQ ID NO: 311116 - DNA, 20 bp, Artificial
  CRISPR gRNA sequence
atcctctctgcactcccctg

SEQ ID NO: 311117 - DNA, 20 bp, Artificial
  CRISPR gRNA sequence
tctgcactcccctgtcccac

SEQ ID NO: 311118 - DNA, 20 bp, Artificial
  CRISPR gRNA sequence
tgcactcccctgtcccaccc

SEQ ID NO: 311119 - DNA, 20 bp, Artificial
  CRISPR gRNA sequence
cactcccctgtcccacccca

SEQ ID NO: 311120 - DNA, 20 bp, Artificial
  CRISPR gRNA sequence
ccctgtcccaccccattact

SEQ ID NO: 311121 - DNA, 20 bp, Artificial
  CRISPR gRNA sequence
tcccaccccattactggctg

SEQ ID NO: 311122 - DNA, 20 bp, Artificial
  CRISPR gRNA sequence
ctggctgctgccattccacc

SEQ ID NO: 311123 - DNA, 20 bp, Artificial
  CRISPR gRNA sequence
gctgctgccattccacctcc

SEQ ID NO: 311124 - DNA, 20 bp, Artificial
  CRISPR gRNA sequence
ctgccattccacctccctca

SEQ ID NO: 311125 - DNA, 20 bp, Artificial
  CRISPR gRNA sequence
ccattccacctccctcatcc

SEQ ID NO: 311126 - DNA, 20 bp, Artificial
  CRISPR gRNA sequence
cacctccctcatcctgccct

SEQ ID NO: 311127 - DNA, 20 bp, Artificial
  CRISPR gRNA sequence
cctcatcctgccctttgcct

SEQ ID NO: 311128 - DNA, 20 bp, Artificial
  CRISPR gRNA sequence
atcctgccctttgcctgaat

SEQ ID NO: 311129 - DNA, 20 bp, Artificial
  CRISPR gRNA sequence
ccctttgcctgaatgagagc

SEQ ID NO: 311130 - DNA, 20 bp, Artificial
  CRISPR gRNA sequence
tgcctgaatgagagcccaca

SEQ ID NO: 311131 - DNA, 20 bp, Artificial
  CRISPR gRNA sequence
gcctgaatgagagcccacat

SEQ ID NO: 311132 - DNA, 20 bp, Artificial
  CRISPR gRNA sequence
cctgaatgagagcccacatg

SEQ ID NO: 311133 - DNA, 20 bp, Artificial
  CRISPR gRNA sequence
aatgagagcccacatgctcc

SEQ ID NO: 311134 - DNA, 20 bp, Artificial
  CRISPR gRNA sequence
cttcagacctcagatacaaa

SEQ ID NO: 311135 - DNA, 20 bp, Artificial
  CRISPR gRNA sequence
cagacctcagatacaaagat

SEQ ID NO: 311136 - DNA, 20 bp, Artificial
  CRISPR gRNA sequence
agacctcagatacaaagata

SEQ ID NO: 311137 - DNA, 20 bp, Artificial
  CRISPR gRNA sequence
agatacaaagataccccttc

SEQ ID NO: 311138 - DNA, 20 bp, Artificial
  CRISPR gRNA sequence
cttagttccttccttttctg

SEQ ID NO: 311139 - DNA, 20 bp, Artificial
  CRISPR gRNA sequence
ttagttccttccttttctgc

SEQ ID NO: 311140 - DNA, 20 bp, Artificial
  CRISPR gRNA sequence
agttccttccttttctgccc

SEQ ID NO: 311141 - DNA, 20 bp, Artificial
  CRISPR gRNA sequence
gttccttccttttctgccca

SEQ ID NO: 311142 - DNA, 20 bp, Artificial
  CRISPR gRNA sequence
cttccttttctgcccaagta

SEQ ID NO: 311143 - DNA, 20 bp, Artificial
  CRISPR gRNA sequence
ccttttctgcccaagtagtc

SEQ ID NO: 311144 - DNA, 20 bp, Artificial
  CRISPR gRNA sequence
cttttctgcccaagtagtca

SEQ ID NO: 311145 - DNA, 20 bp, Artificial
  CRISPR gRNA sequence
ttctgcccaagtagtcatat

SEQ ID NO: 311146 - DNA, 20 bp, Artificial
  CRISPR gRNA sequence
tctgcccaagtagtcatatt

SEQ ID NO: 311147 - DNA, 20 bp, Artificial
  CRISPR gRNA sequence
ctgcccaagtagtcatattt

SEQ ID NO: 311148 - DNA, 20 bp, Artificial
  CRISPR gRNA sequence
tgcccaagtagtcatatttc

SEQ ID NO: 311149 - DNA, 20 bp, Artificial
  CRISPR gRNA sequence
cccaagtagtcatatttccc

SEQ ID NO: 311150 - DNA, 20 bp, Artificial
  CRISPR gRNA sequence
ccccagagctcttctagata

SEQ ID NO: 311151 - DNA, 20 bp, Artificial
  CRISPR gRNA sequence
cccagagctcttctagatat

SEQ ID NO: 311152 - DNA, 20 bp, Artificial
  CRISPR gRNA sequence
ttctagatatggcttagatg

SEQ ID NO: 311153 - DNA, 20 bp, Artificial
  CRISPR gRNA sequence
ctagatatggcttagatggt

SEQ ID NO: 311154 - DNA, 20 bp, Artificial
  CRISPR gRNA sequence
tagatatggcttagatggtc

SEQ ID NO: 311155 - DNA, 20 bp, Artificial
  CRISPR gRNA sequence
gatatggcttagatggtcca

SEQ ID NO: 311156 - DNA, 20 bp, Artificial
  CRISPR gRNA sequence
agatggtccacagtagtgtg

SEQ ID NO: 311157 - DNA, 20 bp, Artificial
  CRISPR gRNA sequence
gatggtccacagtagtgtgc

SEQ ID NO: 311158 - DNA, 20 bp, Artificial
  CRISPR gRNA sequence
aagcctaaatccacgctggg

SEQ ID NO: 311159 - DNA, 20 bp, Artificial
  CRISPR gRNA sequence
aatccacgctgggaagctgg

SEQ ID NO: 311160 - DNA, 20 bp, Artificial
  CRISPR gRNA sequence
ggaagctggtgcctgtccag

SEQ ID NO: 311161 - DNA, 20 bp, Artificial
  CRISPR gRNA sequence
gtgcctgtccaggttaaagt

SEQ ID NO: 311162 - DNA, 20 bp, Artificial
  CRISPR gRNA sequence
tccaggttaaagtggagaag

SEQ ID NO: 311163 - DNA, 20 bp, Artificial
  CRISPR gRNA sequence
aagtggagaagtactctctg

SEQ ID NO: 311164 - DNA, 20 bp, Artificial
  CRISPR gRNA sequence
tctgtacctggcacacagtg

SEQ ID NO: 311165 - DNA, 20 bp, Artificial
  CRISPR gRNA sequence
tgtacctggcacacagtggg

SEQ ID NO: 311166 - DNA, 20 bp, Artificial
  CRISPR gRNA sequence
tacctggcacacagtgggta

SEQ ID NO: 311167 - DNA, 20 bp, Artificial
  CRISPR gRNA sequence
gcacacagtgggtattcgag

SEQ ID NO: 311168 - DNA, 20 bp, Artificial
  CRISPR gRNA sequence
gagcagtgtttgcagaatga

SEQ ID NO: 311169 - DNA, 20 bp, Artificial
  CRISPR gRNA sequence
gcagaatgaacagcagctca

SEQ ID NO: 311170 - DNA, 20 bp, Artificial
  CRISPR gRNA sequence
cagaatgaacagcagctcag

SEQ ID NO: 311171 - DNA, 20 bp, Artificial
  CRISPR gRNA sequence
agggcagaaaccctcttgat

SEQ ID NO: 311172 - DNA, 20 bp, Artificial
  CRISPR gRNA sequence
ttgatgcaaagggatacttt

SEQ ID NO: 311173 - DNA, 20 bp, Artificial
  CRISPR gRNA sequence
gatgcaaagggatactttgg

SEQ ID NO: 311174 - DNA, 20 bp, Artificial
  CRISPR gRNA sequence
atgcaaagggatactttggg

SEQ ID NO: 311175 - DNA, 20 bp, Artificial
  CRISPR gRNA sequence
tggggccccttcttctccca

SEQ ID NO: 311176 - DNA, 20 bp, Artificial
  CRISPR gRNA sequence
ggggccccttcttctcccac

SEQ ID NO: 311177 - DNA, 20 bp, Artificial
  CRISPR gRNA sequence
gggccccttcttctcccacc

SEQ ID NO: 311178 - DNA, 20 bp, Artificial
  CRISPR gRNA sequence
cttctcccaccccagtctgt

SEQ ID NO: 311179 - DNA, 20 bp, Artificial
  CRISPR gRNA sequence
ttctcccaccccagtctgtc

SEQ ID NO: 311180 - DNA, 20 bp, Artificial
  CRISPR gRNA sequence
ctcccaccccagtctgtctc

SEQ ID NO: 311181 - DNA, 20 bp, Artificial
  CRISPR gRNA sequence
tcccaccccagtctgtctct

SEQ ID NO: 311182 - DNA, 20 bp, Artificial
  CRISPR gRNA sequence
ccaccccagtctgtctctct

SEQ ID NO: 311183 - DNA, 20 bp, Artificial
  CRISPR gRNA sequence
tctctctgagagtcctctcg

SEQ ID NO: 311184 - DNA, 20 bp, Artificial
  CRISPR gRNA sequence
tctgagagtcctctcgattc

SEQ ID NO: 311185 - DNA, 20 bp, Artificial
  CRISPR gRNA sequence
tgagagtcctctcgattcca

SEQ ID NO: 311186 - DNA, 20 bp, Artificial
  CRISPR gRNA sequence
agagtcctctcgattccagg

SEQ ID NO: 311187 - DNA, 20 bp, Artificial
  CRISPR gRNA sequence
tcgattccaggagccaccat

SEQ ID NO: 311188 - DNA, 20 bp, Artificial
  CRISPR gRNA sequence
gattccaggagccaccatca

SEQ ID NO: 311189 - DNA, 20 bp, Artificial
  CRISPR gRNA sequence
caggagccaccatcacacct

SEQ ID NO: 311190 - DNA, 20 bp, Artificial
  CRISPR gRNA sequence
gccctaggctgtgctgctcc

SEQ ID NO: 311191 - DNA, 20 bp, Artificial
  CRISPR gRNA sequence
ggctgtgctgctcccgtctg

SEQ ID NO: 311192 - DNA, 20 bp, Artificial
  CRISPR gRNA sequence
tgctgctcccgtctgtctca

SEQ ID NO: 311193 - DNA, 20 bp, Artificial
  CRISPR gRNA sequence
ctcccgtctgtctcagaggc

SEQ ID NO: 311194 - DNA, 20 bp, Artificial
  CRISPR gRNA sequence
ccgtctgtctcagaggctag

SEQ ID NO: 311195 - DNA, 20 bp, Artificial
  CRISPR gRNA sequence
tctcagaggctagataacat

SEQ ID NO: 311196 - DNA, 20 bp, Artificial
  CRISPR gRNA sequence
agaggctagataacatcaga

SEQ ID NO: 311197 - DNA, 20 bp, Artificial
  CRISPR gRNA sequence
gataacatcagagtcctttc

SEQ ID NO: 311198 - DNA, 20 bp, Artificial
  CRISPR gRNA sequence
tccactggctcctgtggcag

SEQ ID NO: 311199 - DNA, 20 bp, Artificial
  CRISPR gRNA sequence
ccactggctcctgtggcaga

SEQ ID NO: 311200 - DNA, 20 bp, Artificial
  CRISPR gRNA sequence
cactggctcctgtggcagag

SEQ ID NO: 311201 - DNA, 20 bp, Artificial
  CRISPR gRNA sequence
gctcctgtggcagagcaaaa

SEQ ID NO: 311202 - DNA, 20 bp, Artificial
  CRISPR gRNA sequence
ctgtggcagagcaaaaactg

SEQ ID NO: 311203 - DNA, 20 bp, Artificial
  CRISPR gRNA sequence
tggcagagcaaaaactggtt

SEQ ID NO: 311204 - DNA, 20 bp, Artificial
  CRISPR gRNA sequence
gttggcatttttaaacgtgc

SEQ ID NO: 311205 - DNA, 20 bp, Artificial
  CRISPR gRNA sequence
gcatttttaaacgtgctaca

SEQ ID NO: 311206 - DNA, 20 bp, Artificial
  CRISPR gRNA sequence
ttaaacgtgctacaccagtg

SEQ ID NO: 311207 - DNA, 20 bp, Artificial
  CRISPR gRNA sequence
taaacgtgctacaccagtgt

SEQ ID NO: 311208 - DNA, 20 bp, Artificial
  CRISPR gRNA sequence
aaacgtgctacaccagtgtg

SEQ ID NO: 311209 - DNA, 20 bp, Artificial
  CRISPR gRNA sequence
aacgtgctacaccagtgtgt

SEQ ID NO: 311210 - DNA, 20 bp, Artificial
  CRISPR gRNA sequence
caccagtgtgtgaaagaaac

SEQ ID NO: 311211 - DNA, 20 bp, Artificial
  CRISPR gRNA sequence
catgggtttaaatctcagct

SEQ ID NO: 311212 - DNA, 20 bp, Artificial
  CRISPR gRNA sequence
aaatctcagctgtaccattt

SEQ ID NO: 311213 - DNA, 20 bp, Artificial
  CRISPR gRNA sequence
aatctcagctgtaccattta

SEQ ID NO: 311214 - DNA, 20 bp, Artificial
  CRISPR gRNA sequence
agctgtaccatttactagct

SEQ ID NO: 311215 - DNA, 20 bp, Artificial
  CRISPR gRNA sequence
taccatttactagctgggca

SEQ ID NO: 311216 - DNA, 20 bp, Artificial
  CRISPR gRNA sequence
actagctgggcagcctaggg

SEQ ID NO: 311217 - DNA, 20 bp, Artificial
  CRISPR gRNA sequence
ctagctgggcagcctagggc

SEQ ID NO: 311218 - DNA, 20 bp, Artificial
  CRISPR gRNA sequence
gctgggcagcctagggcaag

SEQ ID NO: 311219 - DNA, 20 bp, Artificial
  CRISPR gRNA sequence
ggcagcctagggcaagtact

SEQ ID NO: 311220 - DNA, 20 bp, Artificial
  CRISPR gRNA sequence
gggcaagtactgtgacctct

SEQ ID NO: 311221 - DNA, 20 bp, Artificial
  CRISPR gRNA sequence
tgacctctctgagactccat

SEQ ID NO: 311222 - DNA, 20 bp, Artificial
  CRISPR gRNA sequence
tctgagactccattccttca

SEQ ID NO: 311223 - DNA, 20 bp, Artificial
  CRISPR gRNA sequence
tgagactccattccttcatc

SEQ ID NO: 311224 - DNA, 20 bp, Artificial
  CRISPR gRNA sequence
agactccattccttcatctg

SEQ ID NO: 311225 - DNA, 20 bp, Artificial
  CRISPR gRNA sequence
cattccttcatctgtaacat

SEQ ID NO: 311226 - DNA, 20 bp, Artificial
  CRISPR gRNA sequence
cttcatctgtaacatgggga

SEQ ID NO: 311227 - DNA, 20 bp, Artificial
  CRISPR gRNA sequence
catctgtaacatggggacaa

SEQ ID NO: 311228 - DNA, 20 bp, Artificial
  CRISPR gRNA sequence
atctgtaacatggggacaaa

SEQ ID NO: 311229 - DNA, 20 bp, Artificial
  CRISPR gRNA sequence
taacatggggacaaataatc

SEQ ID NO: 311230 - DNA, 20 bp, Artificial
  CRISPR gRNA sequence
accctgttgtgagcagtaat

SEQ ID NO: 311231 - DNA, 20 bp, Artificial
  CRISPR gRNA sequence
ttgtgagcagtaataatatg

SEQ ID NO: 311232 - DNA, 20 bp, Artificial
  CRISPR gRNA sequence
tgagcagtaataatatgatt

SEQ ID NO: 311233 - DNA, 20 bp, Artificial
  CRISPR gRNA sequence
atcatttagccaactcttat

SEQ ID NO: 311234 - DNA, 20 bp, Artificial
  CRISPR gRNA sequence
agccaactcttattcatgtt

SEQ ID NO: 311235 - DNA, 20 bp, Artificial
  CRISPR gRNA sequence
gccaactcttattcatgttc

SEQ ID NO: 311236 - DNA, 20 bp, Artificial
  CRISPR gRNA sequence
ttattcatgttctctgatgg

SEQ ID NO: 311237 - DNA, 20 bp, Artificial
  CRISPR gRNA sequence
attcatgttctctgatgggc

SEQ ID NO: 311238 - DNA, 20 bp, Artificial
  CRISPR gRNA sequence
ttcatgttctctgatgggcc

SEQ ID NO: 311239 - DNA, 20 bp, Artificial
  CRISPR gRNA sequence
atgttctctgatgggccaga

SEQ ID NO: 311240 - DNA, 20 bp, Artificial
  CRISPR gRNA sequence
tctgatgggccagacataca

SEQ ID NO: 311241 - DNA, 20 bp, Artificial
  CRISPR gRNA sequence
tgatgggccagacatacaaa

SEQ ID NO: 311242 - DNA, 20 bp, Artificial
  CRISPR gRNA sequence
atgggccagacatacaaagt

SEQ ID NO: 311243 - DNA, 20 bp, Artificial
  CRISPR gRNA sequence
cggcaggtgctcttcttggt

SEQ ID NO: 311244 - DNA, 20 bp, Artificial
  CRISPR gRNA sequence
ttcttggtttctggagtgaa

SEQ ID NO: 311245 - DNA, 20 bp, Artificial
  CRISPR gRNA sequence
cttggtttctggagtgaacc

SEQ ID NO: 311246 - DNA, 20 bp, Artificial
  CRISPR gRNA sequence
ttggtttctggagtgaacct

SEQ ID NO: 311247 - DNA, 20 bp, Artificial
  CRISPR gRNA sequence
ggtttctggagtgaacctcc

SEQ ID NO: 311248 - DNA, 20 bp, Artificial
  CRISPR gRNA sequence
gtttctggagtgaacctcca

SEQ ID NO: 311249 - DNA, 20 bp, Artificial
  CRISPR gRNA sequence
ctggagtgaacctccattta

SEQ ID NO: 311250 - DNA, 20 bp, Artificial
  CRISPR gRNA sequence
tggagtgaacctccatttac

SEQ ID NO: 311251 - DNA, 20 bp, Artificial
  CRISPR gRNA sequence
gagtgaacctccatttacat

SEQ ID NO: 311252 - DNA, 20 bp, Artificial
  CRISPR gRNA sequence
catttacatggaggctcctc

SEQ ID NO: 311253 - DNA, 20 bp, Artificial
  CRISPR gRNA sequence
acatggaggctcctcttttt

SEQ ID NO: 311254 - DNA, 20 bp, Artificial
  CRISPR gRNA sequence
catggaggctcctcttttta

SEQ ID NO: 311255 - DNA, 20 bp, Artificial
  CRISPR gRNA sequence
ctctttttagatttctgact

SEQ ID NO: 311256 - DNA, 20 bp, Artificial
  CRISPR gRNA sequence
tttttagatttctgactagt

SEQ ID NO: 311257 - DNA, 20 bp, Artificial
  CRISPR gRNA sequence
tttagatttctgactagttc

SEQ ID NO: 311258 - DNA, 20 bp, Artificial
  CRISPR gRNA sequence
ttagatttctgactagttca

SEQ ID NO: 311259 - DNA, 20 bp, Artificial
  CRISPR gRNA sequence
tagatttctgactagttcac

SEQ ID NO: 311260 - DNA, 20 bp, Artificial
  CRISPR gRNA sequence
agatttctgactagttcacc

SEQ ID NO: 311261 - DNA, 20 bp, Artificial
  CRISPR gRNA sequence
gatttctgactagttcaccc

SEQ ID NO: 311262 - DNA, 20 bp, Artificial
  CRISPR gRNA sequence
ctgactagttcacccacctt

SEQ ID NO: 311263 - DNA, 20 bp, Artificial
  CRISPR gRNA sequence
tgactagttcacccacctta

SEQ ID NO: 311264 - DNA, 20 bp, Artificial
  CRISPR gRNA sequence
actagttcacccaccttatt

SEQ ID NO: 311265 - DNA, 20 bp, Artificial
  CRISPR gRNA sequence
gttcacccaccttattcata

SEQ ID NO: 311266 - DNA, 20 bp, Artificial
  CRISPR gRNA sequence
acccaccttattcatagacc

SEQ ID NO: 311267 - DNA, 20 bp, Artificial
  CRISPR gRNA sequence
attcatagaccttattctgt

SEQ ID NO: 311268 - DNA, 20 bp, Artificial
  CRISPR gRNA sequence
ttcatagaccttattctgtg

SEQ ID NO: 311269 - DNA, 20 bp, Artificial
  CRISPR gRNA sequence
atagaccttattctgtgctt

SEQ ID NO: 311270 - DNA, 20 bp, Artificial
  CRISPR gRNA sequence
attctgtgcttagctgacag

SEQ ID NO: 311271 - DNA, 20 bp, Artificial
  CRISPR gRNA sequence
ttctgtgcttagctgacaga

SEQ ID NO: 311272 - DNA, 20 bp, Artificial
  CRISPR gRNA sequence
tgtgcttagctgacagaaat

SEQ ID NO: 311273 - DNA, 20 bp, Artificial
  CRISPR gRNA sequence
tgcttagctgacagaaatct

SEQ ID NO: 311274 - DNA, 20 bp, Artificial
  CRISPR gRNA sequence
agctgacagaaatctcctct

SEQ ID NO: 311275 - DNA, 20 bp, Artificial
  CRISPR gRNA sequence
gctgacagaaatctcctctc

SEQ ID NO: 311276 - DNA, 20 bp, Artificial
  CRISPR gRNA sequence
acagaaatctcctctcagag

SEQ ID NO: 311277 - DNA, 20 bp, Artificial
  CRISPR gRNA sequence
ctctcagagaatccccccgg

SEQ ID NO: 311278 - DNA, 20 bp, Artificial
  CRISPR gRNA sequence
tcagagaatccccccggtaa

SEQ ID NO: 311279 - DNA, 20 bp, Artificial
  CRISPR gRNA sequence
agagaatccccccggtaaat

SEQ ID NO: 311280 - DNA, 20 bp, Artificial
  CRISPR gRNA sequence
ttaggttctttcctcttcca

SEQ ID NO: 311281 - DNA, 20 bp, Artificial
  CRISPR gRNA sequence
aggttctttcctcttccatt

SEQ ID NO: 311282 - DNA, 20 bp, Artificial
  CRISPR gRNA sequence
ggttctttcctcttccattc

SEQ ID NO: 311283 - DNA, 20 bp, Artificial
  CRISPR gRNA sequence
tttcctcttccattcccctt

SEQ ID NO: 311284 - DNA, 20 bp, Artificial
  CRISPR gRNA sequence
tcctcttccattcccctttt

SEQ ID NO: 311285 - DNA, 20 bp, Artificial
  CRISPR gRNA sequence
cctcttccattccccttttt

SEQ ID NO: 311286 - DNA, 20 bp, Artificial
  CRISPR gRNA sequence
ctcttccattcccctttttg

SEQ ID NO: 311287 - DNA, 20 bp, Artificial
  CRISPR gRNA sequence
ttccattcccctttttgctc

SEQ ID NO: 311288 - DNA, 20 bp, Artificial
  CRISPR gRNA sequence
ccattcccctttttgctctc

SEQ ID NO: 311289 - DNA, 20 bp, Artificial
  CRISPR gRNA sequence
cattcccctttttgctctct

SEQ ID NO: 311290 - DNA, 20 bp, Artificial
  CRISPR gRNA sequence
ccctttttgctctctccctc

SEQ ID NO: 311291 - DNA, 20 bp, Artificial
  CRISPR gRNA sequence
tttgctctctccctccgaag

SEQ ID NO: 311292 - DNA, 20 bp, Artificial
  CRISPR gRNA sequence
ttgctctctccctccgaagg

SEQ ID NO: 311293 - DNA, 20 bp, Artificial
  CRISPR gRNA sequence
tgctctctccctccgaaggc

SEQ ID NO: 311294 - DNA, 20 bp, Artificial
  CRISPR gRNA sequence
gctctctccctccgaaggca

SEQ ID NO: 311295 - DNA, 20 bp, Artificial
  CRISPR gRNA sequence
ctctctccctccgaaggcaa

SEQ ID NO: 311296 - DNA, 20 bp, Artificial
  CRISPR gRNA sequence
tctccctccgaaggcaagag

SEQ ID NO: 311297 - DNA, 20 bp, Artificial
  CRISPR gRNA sequence
tccctccgaaggcaagagtt

SEQ ID NO: 311298 - DNA, 20 bp, Artificial
  CRISPR gRNA sequence
cctccgaaggcaagagtttc

SEQ ID NO: 311299 - DNA, 20 bp, Artificial
  CRISPR gRNA sequence
cgaaggcaagagtttccact

SEQ ID NO: 311300 - DNA, 20 bp, Artificial
  CRISPR gRNA sequence
ccactttacaggcccactgg

SEQ ID NO: 311301 - DNA, 20 bp, Artificial
  CRISPR gRNA sequence
cactttacaggcccactgga

SEQ ID NO: 311302 - DNA, 20 bp, Artificial
  CRISPR gRNA sequence
tacaggcccactggagaaag

SEQ ID NO: 311303 - DNA, 20 bp, Artificial
  CRISPR gRNA sequence
acaggcccactggagaaagt

SEQ ID NO: 311304 - DNA, 20 bp, Artificial
  CRISPR gRNA sequence
caggcccactggagaaagtt

SEQ ID NO: 311305 - DNA, 20 bp, Artificial
  CRISPR gRNA sequence
gagaaagttatggcttctgg

SEQ ID NO: 311306 - DNA, 20 bp, Artificial
  CRISPR gRNA sequence
tggcttctggttgtggttgg

SEQ ID NO: 311307 - DNA, 20 bp, Artificial
  CRISPR gRNA sequence
ctggttgtggttggaggttc

SEQ ID NO: 311308 - DNA, 20 bp, Artificial
  CRISPR gRNA sequence
tggttgtggttggaggttca

SEQ ID NO: 311309 - DNA, 20 bp, Artificial
  CRISPR gRNA sequence
gttgtggttggaggttcatt

SEQ ID NO: 311310 - DNA, 20 bp, Artificial
  CRISPR gRNA sequence
tggttggaggttcattcctg

SEQ ID NO: 311311 - DNA, 20 bp, Artificial
  CRISPR gRNA sequence
gaggttcattcctgagggag

SEQ ID NO: 311312 - DNA, 20 bp, Artificial
  CRISPR gRNA sequence
attcctgagggagtggggac

SEQ ID NO: 311313 - DNA, 20 bp, Artificial
  CRISPR gRNA sequence
ctgagggagtggggacattt

SEQ ID NO: 311314 - DNA, 20 bp, Artificial
  CRISPR gRNA sequence
agggagtggggacatttcta

SEQ ID NO: 311315 - DNA, 20 bp, Artificial
  CRISPR gRNA sequence
ctacacttcttcacggccaa

SEQ ID NO: 311316 - DNA, 20 bp, Artificial
  CRISPR gRNA sequence
tacacttcttcacggccaat

SEQ ID NO: 311317 - DNA, 20 bp, Artificial
  CRISPR gRNA sequence
cacttcttcacggccaatga

SEQ ID NO: 311318 - DNA, 20 bp, Artificial
  CRISPR gRNA sequence
cttcacggccaatgacattg

SEQ ID NO: 311319 - DNA, 20 bp, Artificial
  CRISPR gRNA sequence
ttcacggccaatgacattgg

SEQ ID NO: 311320 - DNA, 20 bp, Artificial
  CRISPR gRNA sequence
cacggccaatgacattggag

SEQ ID NO: 311321 - DNA, 20 bp, Artificial
  CRISPR gRNA sequence
acggccaatgacattggaga

SEQ ID NO: 311322 - DNA, 20 bp, Artificial
  CRISPR gRNA sequence
gagaaactggcttcctaacc

SEQ ID NO: 311323 - DNA, 20 bp, Artificial
  CRISPR gRNA sequence
gcttcctaacccagcccaca

SEQ ID NO: 311324 - DNA, 20 bp, Artificial
  CRISPR gRNA sequence
cctaacccagcccacaccct

SEQ ID NO: 311325 - DNA, 20 bp, Artificial
  CRISPR gRNA sequence
ctaacccagcccacaccctc

SEQ ID NO: 311326 - DNA, 20 bp, Artificial
  CRISPR gRNA sequence
acccagcccacaccctcgca

SEQ ID NO: 311327 - DNA, 20 bp, Artificial
  CRISPR gRNA sequence
gcacacacacatcacacatc

SEQ ID NO: 311328 - DNA, 20 bp, Artificial
  CRISPR gRNA sequence
gaatggagagaaattcttca

SEQ ID NO: 311329 - DNA, 20 bp, Artificial
  CRISPR gRNA sequence
ttcatatggggcacttgtac

SEQ ID NO: 311330 - DNA, 20 bp, Artificial
  CRISPR gRNA sequence
catatggggcacttgtactt

SEQ ID NO: 311331 - DNA, 20 bp, Artificial
  CRISPR gRNA sequence
atatggggcacttgtacttc

SEQ ID NO: 311332 - DNA, 20 bp, Artificial
  CRISPR gRNA sequence
gtacttcatgaaagaaaatc

SEQ ID NO: 311333 - DNA, 20 bp, Artificial
  CRISPR gRNA sequence
tacttcatgaaagaaaatca

SEQ ID NO: 311334 - DNA, 20 bp, Artificial
  CRISPR gRNA sequence
catgaaagaaaatcatatca

SEQ ID NO: 311335 - DNA, 20 bp, Artificial
  CRISPR gRNA sequence
atgaaagaaaatcatatcaa

SEQ ID NO: 311336 - DNA, 20 bp, Artificial
  CRISPR gRNA sequence
gagtattttaacatcctatt

SEQ ID NO: 311337 - DNA, 20 bp, Artificial
  CRISPR gRNA sequence
agtattttaacatcctatta

SEQ ID NO: 311338 - DNA, 20 bp, Artificial
  CRISPR gRNA sequence
taacatcctattacagcagg

SEQ ID NO: 311339 - DNA, 20 bp, Artificial
  CRISPR gRNA sequence
aacatcctattacagcaggg

SEQ ID NO: 311340 - DNA, 20 bp, Artificial
  CRISPR gRNA sequence
acatcctattacagcagggt

SEQ ID NO: 311341 - DNA, 20 bp, Artificial
  CRISPR gRNA sequence
ttacagcagggtcactgata

SEQ ID NO: 311342 - DNA, 20 bp, Artificial
  CRISPR gRNA sequence
cagcagggtcactgataaac

SEQ ID NO: 311343 - DNA, 20 bp, Artificial
  CRISPR gRNA sequence
ataaactaagtgtccagagt

SEQ ID NO: 311344 - DNA, 20 bp, Artificial
  CRISPR gRNA sequence
agtgtccagagtgttttcta

SEQ ID NO: 311345 - DNA, 20 bp, Artificial
  CRISPR gRNA sequence
tctaggatggtgtgtggtct

SEQ ID NO: 311346 - DNA, 20 bp, Artificial
  CRISPR gRNA sequence
ctaggatggtgtgtggtctc

SEQ ID NO: 311347 - DNA, 20 bp, Artificial
  CRISPR gRNA sequence
taggatggtgtgtggtctcc

SEQ ID NO: 311348 - DNA, 20 bp, Artificial
  CRISPR gRNA sequence
ggatggtgtgtggtctccaa

SEQ ID NO: 311349 - DNA, 20 bp, Artificial
  CRISPR gRNA sequence
caaattaacattagtgaagc

SEQ ID NO: 311350 - DNA, 20 bp, Artificial
  CRISPR gRNA sequence
acattagtgaagcttactgg

SEQ ID NO: 311351 - DNA, 20 bp, Artificial
  CRISPR gRNA sequence
gtgaagcttactggaaggat

SEQ ID NO: 311352 - DNA, 20 bp, Artificial
  CRISPR gRNA sequence
actggaaggattgttactcc

SEQ ID NO: 311353 - DNA, 20 bp, Artificial
  CRISPR gRNA sequence
ctggaaggattgttactcct

SEQ ID NO: 311354 - DNA, 20 bp, Artificial
  CRISPR gRNA sequence
gaaggattgttactcctggg

SEQ ID NO: 311355 - DNA, 20 bp, Artificial
  CRISPR gRNA sequence
ttactcctgggccaggccag

SEQ ID NO: 311356 - DNA, 20 bp, Artificial
  CRISPR gRNA sequence
ctcctgggccaggccaggat

SEQ ID NO: 311357 - DNA, 20 bp, Artificial
  CRISPR gRNA sequence
ctgggccaggccaggatttt

SEQ ID NO: 311358 - DNA, 20 bp, Artificial
  CRISPR gRNA sequence
ggccaggccaggattttgag

SEQ ID NO: 311359 - DNA, 20 bp, Artificial
  CRISPR gRNA sequence
tgaggagagatgtgtttgct

SEQ ID NO: 311360 - DNA, 20 bp, Artificial
  CRISPR gRNA sequence
gaggagagatgtgtttgctg

SEQ ID NO: 311361 - DNA, 20 bp, Artificial
  CRISPR gRNA sequence
aggagagatgtgtttgctgt

SEQ ID NO: 311362 - DNA, 20 bp, Artificial
  CRISPR gRNA sequence
gctgtcaccaaatccttgac

SEQ ID NO: 311363 - DNA, 20 bp, Artificial
  CRISPR gRNA sequence
ctgtcaccaaatccttgaca

SEQ ID NO: 311364 - DNA, 20 bp, Artificial
  CRISPR gRNA sequence
tcaccaaatccttgacagac

SEQ ID NO: 311365 - DNA, 20 bp, Artificial
  CRISPR gRNA sequence
gacagactttggcagaagtg

SEQ ID NO: 311366 - DNA, 20 bp, Artificial
  CRISPR gRNA sequence
acagactttggcagaagtgt

SEQ ID NO: 311367 - DNA, 20 bp, Artificial
  CRISPR gRNA sequence
tggcagaagtgtgttaggct

SEQ ID NO: 311368 - DNA, 20 bp, Artificial
  CRISPR gRNA sequence
ggcagaagtgtgttaggctt

SEQ ID NO: 311369 - DNA, 20 bp, Artificial
  CRISPR gRNA sequence
gcagaagtgtgttaggctta

SEQ ID NO: 311370 - DNA, 20 bp, Artificial
  CRISPR gRNA sequence
ggcttactctggatagcttc

SEQ ID NO: 311371 - DNA, 20 bp, Artificial
  CRISPR gRNA sequence
actctggatagcttcagagg

SEQ ID NO: 311372 - DNA, 20 bp, Artificial
  CRISPR gRNA sequence
ctctggatagcttcagagga

SEQ ID NO: 311373 - DNA, 20 bp, Artificial
  CRISPR gRNA sequence
tggatagcttcagaggacaa

SEQ ID NO: 311374 - DNA, 20 bp, Artificial
  CRISPR gRNA sequence
gatagcttcagaggacaaaa

SEQ ID NO: 311375 - DNA, 20 bp, Artificial
  CRISPR gRNA sequence
cagaggacaaaactagtatt

SEQ ID NO: 311376 - DNA, 20 bp, Artificial
  CRISPR gRNA sequence
agaggacaaaactagtattg

SEQ ID NO: 311377 - DNA, 20 bp, Artificial
  CRISPR gRNA sequence
gtattgacggaaggaaggta

SEQ ID NO: 311378 - DNA, 20 bp, Artificial
  CRISPR gRNA sequence
acggaaggaaggtaaggaga

SEQ ID NO: 311379 - DNA, 20 bp, Artificial
  CRISPR gRNA sequence
ctaacccaggggaagagaga

SEQ ID NO: 311380 - DNA, 20 bp, Artificial
  CRISPR gRNA sequence
taacccaggggaagagagag

SEQ ID NO: 311381 - DNA, 20 bp, Artificial
  CRISPR gRNA sequence
acccaggggaagagagagtt

SEQ ID NO: 311382 - DNA, 20 bp, Artificial
  CRISPR gRNA sequence
ccaaactgagaaatcaaaaa

SEQ ID NO: 311383 - DNA, 20 bp, Artificial
  CRISPR gRNA sequence
caaactgagaaatcaaaaat

SEQ ID NO: 311384 - DNA, 20 bp, Artificial
  CRISPR gRNA sequence
agaaatcaaaaatggtactg

SEQ ID NO: 311385 - DNA, 20 bp, Artificial
  CRISPR gRNA sequence
attccttgtcagggtcagtg

SEQ ID NO: 311386 - DNA, 20 bp, Artificial
  CRISPR gRNA sequence
cttgtcagggtcagtgcttc

SEQ ID NO: 311387 - DNA, 20 bp, Artificial
  CRISPR gRNA sequence
gtcagggtcagtgcttctcc

SEQ ID NO: 311388 - DNA, 20 bp, Artificial
  CRISPR gRNA sequence
tcagggtcagtgcttctccc

SEQ ID NO: 311389 - DNA, 20 bp, Artificial
  CRISPR gRNA sequence
ctccccactgtgtgaattac

SEQ ID NO: 311390 - DNA, 20 bp, Artificial
  CRISPR gRNA sequence
tccccactgtgtgaattaca

SEQ ID NO: 311391 - DNA, 20 bp, Artificial
  CRISPR gRNA sequence
cccactgtgtgaattacagg

SEQ ID NO: 311392 - DNA, 20 bp, Artificial
  CRISPR gRNA sequence
tgtgaattacaggggccatt

SEQ ID NO: 311393 - DNA, 20 bp, Artificial
  CRISPR gRNA sequence
caggggccatttgtccaaga

SEQ ID NO: 311394 - DNA, 20 bp, Artificial
  CRISPR gRNA sequence
gtccaagattccttagagca

SEQ ID NO: 311395 - DNA, 20 bp, Artificial
  CRISPR gRNA sequence
tccaagattccttagagcaa

SEQ ID NO: 311396 - DNA, 20 bp, Artificial
  CRISPR gRNA sequence
cttagagcaatactgatttc

SEQ ID NO: 311397 - DNA, 20 bp, Artificial
  CRISPR gRNA sequence
agagcaatactgatttcatg

SEQ ID NO: 311398 - DNA, 20 bp, Artificial
  CRISPR gRNA sequence
gagcaatactgatttcatgt

SEQ ID NO: 311399 - DNA, 20 bp, Artificial
  CRISPR gRNA sequence
atttcatgtaattatttgaa

SEQ ID NO: 311400 - DNA, 20 bp, Artificial
  CRISPR gRNA sequence
catgtaattatttgaatgaa

SEQ ID NO: 311401 - DNA, 20 bp, Artificial
  CRISPR gRNA sequence
atgtaattatttgaatgaaa

SEQ ID NO: 311402 - DNA, 20 bp, Artificial
  CRISPR gRNA sequence
tttgaatgaaaggtgatttg

SEQ ID NO: 311403 - DNA, 20 bp, Artificial
  CRISPR gRNA sequence
gaatgaaaggtgatttgtta

SEQ ID NO: 311404 - DNA, 20 bp, Artificial
  CRISPR gRNA sequence
aatgaaaggtgatttgttaa

SEQ ID NO: 311405 - DNA, 20 bp, Artificial
  CRISPR gRNA sequence
gttaaatttatagtaaaata

SEQ ID NO: 311406 - DNA, 20 bp, Artificial
  CRISPR gRNA sequence
ttaaatttatagtaaaatat

SEQ ID NO: 311407 - DNA, 20 bp, Artificial
  CRISPR gRNA sequence
aatttatagtaaaatataat

SEQ ID NO: 311408 - DNA, 20 bp, Artificial
  CRISPR gRNA sequence
atagtaaaatataatttgat

SEQ ID NO: 311409 - DNA, 20 bp, Artificial
  CRISPR gRNA sequence
tagtaaaatataatttgatt

SEQ ID NO: 311410 - DNA, 20 bp, Artificial
  CRISPR gRNA sequence
gatttgtgtccctgtttgtc

SEQ ID NO: 311411 - DNA, 20 bp, Artificial
  CRISPR gRNA sequence
atttgtgtccctgtttgtca

SEQ ID NO: 311412 - DNA, 20 bp, Artificial
  CRISPR gRNA sequence
gtgtccctgtttgtcatgcc

SEQ ID NO: 311413 - DNA, 20 bp, Artificial
  CRISPR gRNA sequence
tgtccctgtttgtcatgcca

SEQ ID NO: 311414 - DNA, 20 bp, Artificial
  CRISPR gRNA sequence
tttgtcatgccaccccagaa

SEQ ID NO: 311415 - DNA, 20 bp, Artificial
  CRISPR gRNA sequence
gtcatgccaccccagaagaa

SEQ ID NO: 311416 - DNA, 20 bp, Artificial
  CRISPR gRNA sequence
tcatgccaccccagaagaaa

SEQ ID NO: 311417 - DNA, 20 bp, Artificial
  CRISPR gRNA sequence
tctttggttaggtcgaacat

SEQ ID NO: 311418 - DNA, 20 bp, Artificial
  CRISPR gRNA sequence
tggttaggtcgaacataatg

SEQ ID NO: 311419 - DNA, 20 bp, Artificial
  CRISPR gRNA sequence
ggttaggtcgaacataatgg

SEQ ID NO: 311420 - DNA, 20 bp, Artificial
  CRISPR gRNA sequence
gttaggtcgaacataatggt

SEQ ID NO: 311421 - DNA, 20 bp, Artificial
  CRISPR gRNA sequence
ggtcgaacataatggttttt

SEQ ID NO: 311422 - DNA, 20 bp, Artificial
  CRISPR gRNA sequence
tttggtttgcaaaccatgag

SEQ ID NO: 311423 - DNA, 20 bp, Artificial
  CRISPR gRNA sequence
ttggtttgcaaaccatgagc

SEQ ID NO: 311424 - DNA, 20 bp, Artificial
  CRISPR gRNA sequence
tggtttgcaaaccatgagcg

SEQ ID NO: 311425 - DNA, 20 bp, Artificial
  CRISPR gRNA sequence
ggtttgcaaaccatgagcga

SEQ ID NO: 311426 - DNA, 20 bp, Artificial
  CRISPR gRNA sequence
gtttgcaaaccatgagcgat

SEQ ID NO: 311427 - DNA, 20 bp, Artificial
  CRISPR gRNA sequence
gcaaaccatgagcgattccc

SEQ ID NO: 311428 - DNA, 20 bp, Artificial
  CRISPR gRNA sequence
caaaccatgagcgattccca

SEQ ID NO: 311429 - DNA, 20 bp, Artificial
  CRISPR gRNA sequence
ccatattaggtgggagttca

SEQ ID NO: 311430 - DNA, 20 bp, Artificial
  CRISPR gRNA sequence
ggtgggagttcagattcaaa

SEQ ID NO: 311431 - DNA, 20 bp, Artificial
  CRISPR gRNA sequence
agattcaaagggccctcttt

SEQ ID NO: 311432 - DNA, 20 bp, Artificial
  CRISPR gRNA sequence
aaagggccctcttttttttt

SEQ ID NO: 311433 - DNA, 20 bp, Artificial
  CRISPR gRNA sequence
tttttttttttttttttttt

SEQ ID NO: 311434 - DNA, 20 bp, Artificial
  CRISPR gRNA sequence
ttttttttttttttttttgt

SEQ ID NO: 311435 - DNA, 20 bp, Artificial
  CRISPR gRNA sequence
tttttttttttttttttgta

SEQ ID NO: 311436 - DNA, 20 bp, Artificial
  CRISPR gRNA sequence
ttttttttttttttttgtag

SEQ ID NO: 311437 - DNA, 20 bp, Artificial
  CRISPR gRNA sequence
tttttttttttttttgtagt

SEQ ID NO: 311438 - DNA, 20 bp, Artificial
  CRISPR gRNA sequence
ttttttttttttttgtagta

SEQ ID NO: 311439 - DNA, 20 bp, Artificial
  CRISPR gRNA sequence
tttttttttttttgtagtag

SEQ ID NO: 311440 - DNA, 20 bp, Artificial
  CRISPR gRNA sequence
ttttttttttttgtagtagc

SEQ ID NO: 311441 - DNA, 20 bp, Artificial
  CRISPR gRNA sequence
tttttttttttgtagtagcc

SEQ ID NO: 311442 - DNA, 20 bp, Artificial
  CRISPR gRNA sequence
ttttttttttgtagtagcca

SEQ ID NO: 311443 - DNA, 20 bp, Artificial
  CRISPR gRNA sequence
tttttttttgtagtagccag

SEQ ID NO: 311444 - DNA, 20 bp, Artificial
  CRISPR gRNA sequence
ttttttttgtagtagccagc

SEQ ID NO: 311445 - DNA, 20 bp, Artificial
  CRISPR gRNA sequence
tttttttgtagtagccagcc

SEQ ID NO: 311446 - DNA, 20 bp, Artificial
  CRISPR gRNA sequence
ttttttgtagtagccagcct

SEQ ID NO: 311447 - DNA, 20 bp, Artificial
  CRISPR gRNA sequence
tttttgtagtagccagccta

SEQ ID NO: 311448 - DNA, 20 bp, Artificial
  CRISPR gRNA sequence
ttttgtagtagccagcctaa

SEQ ID NO: 311449 - DNA, 20 bp, Artificial
  CRISPR gRNA sequence
tttgtagtagccagcctaat

SEQ ID NO: 311450 - DNA, 20 bp, Artificial
  CRISPR gRNA sequence
ttgtagtagccagcctaatg

SEQ ID NO: 311451 - DNA, 20 bp, Artificial
  CRISPR gRNA sequence
tgtagtagccagcctaatga

SEQ ID NO: 311452 - DNA, 20 bp, Artificial
  CRISPR gRNA sequence
gtagtagccagcctaatgag

SEQ ID NO: 311453 - DNA, 20 bp, Artificial
  CRISPR gRNA sequence
tagtagccagcctaatgagt

SEQ ID NO: 311454 - DNA, 20 bp, Artificial
  CRISPR gRNA sequence
atgagtaggaagttgttctc

SEQ ID NO: 311455 - DNA, 20 bp, Artificial
  CRISPR gRNA sequence
ttctcactgtcattttatat

SEQ ID NO: 311456 - DNA, 20 bp, Artificial
  CRISPR gRNA sequence
tcactgtcattttatattga

SEQ ID NO: 311457 - DNA, 20 bp, Artificial
  CRISPR gRNA sequence
actgtcattttatattgaat

SEQ ID NO: 311458 - DNA, 20 bp, Artificial
  CRISPR gRNA sequence
tcattttatattgaatttct

SEQ ID NO: 311459 - DNA, 20 bp, Artificial
  CRISPR gRNA sequence
tatattgaatttcttttatt

SEQ ID NO: 311460 - DNA, 20 bp, Artificial
  CRISPR gRNA sequence
atattgaatttcttttattt

SEQ ID NO: 311461 - DNA, 20 bp, Artificial
  CRISPR gRNA sequence
tattgaatttcttttatttt

SEQ ID NO: 311462 - DNA, 20 bp, Artificial
  CRISPR gRNA sequence
aatttcttttattttgagta

SEQ ID NO: 311463 - DNA, 20 bp, Artificial
  CRISPR gRNA sequence
cttttattttgagtatgacc

SEQ ID NO: 311464 - DNA, 20 bp, Artificial
  CRISPR gRNA sequence
ttttattttgagtatgacca

SEQ ID NO: 311465 - DNA, 20 bp, Artificial
  CRISPR gRNA sequence
ttattttgagtatgaccatc

SEQ ID NO: 311466 - DNA, 20 bp, Artificial
  CRISPR gRNA sequence
tattttgagtatgaccatct

SEQ ID NO: 311467 - DNA, 20 bp, Artificial
  CRISPR gRNA sequence
attttgagtatgaccatctt

SEQ ID NO: 311468 - DNA, 20 bp, Artificial
  CRISPR gRNA sequence
ttttgagtatgaccatcttt

SEQ ID NO: 311469 - DNA, 20 bp, Artificial
  CRISPR gRNA sequence
tgagtatgaccatcttttca

SEQ ID NO: 311470 - DNA, 20 bp, Artificial
  CRISPR gRNA sequence
gagtatgaccatcttttcaa

SEQ ID NO: 311471 - DNA, 20 bp, Artificial
  CRISPR gRNA sequence
agtatgaccatcttttcaaa

SEQ ID NO: 311472 - DNA, 20 bp, Artificial
  CRISPR gRNA sequence
ttcaaatgtatgagatagtt

SEQ ID NO: 311473 - DNA, 20 bp, Artificial
  CRISPR gRNA sequence
tcaaatgtatgagatagtta

SEQ ID NO: 311474 - DNA, 20 bp, Artificial
  CRISPR gRNA sequence
caaatgtatgagatagttat

SEQ ID NO: 311475 - DNA, 20 bp, Artificial
  CRISPR gRNA sequence
aaatgtatgagatagttatt

SEQ ID NO: 311476 - DNA, 20 bp, Artificial
  CRISPR gRNA sequence
tttccagttccacatactat

SEQ ID NO: 311477 - DNA, 20 bp, Artificial
  CRISPR gRNA sequence
ccagttccacatactatctg

SEQ ID NO: 311478 - DNA, 20 bp, Artificial
  CRISPR gRNA sequence
cagttccacatactatctgt

SEQ ID NO: 311479 - DNA, 20 bp, Artificial
  CRISPR gRNA sequence
cacatactatctgtacattt

SEQ ID NO: 311480 - DNA, 20 bp, Artificial
  CRISPR gRNA sequence
tctgtacatttcttttgccc

SEQ ID NO: 311481 - DNA, 20 bp, Artificial
  CRISPR gRNA sequence
tacatttcttttgcccgctt

SEQ ID NO: 311482 - DNA, 20 bp, Artificial
  CRISPR gRNA sequence
cttttgcccgcttttagttt

SEQ ID NO: 311483 - DNA, 20 bp, Artificial
  CRISPR gRNA sequence
ttttgcccgcttttagtttg

SEQ ID NO: 311484 - DNA, 20 bp, Artificial
  CRISPR gRNA sequence
ttgcccgcttttagtttggg

SEQ ID NO: 311485 - DNA, 20 bp, Artificial
  CRISPR gRNA sequence
tgcccgcttttagtttgggt

SEQ ID NO: 311486 - DNA, 20 bp, Artificial
  CRISPR gRNA sequence
gcccgcttttagtttgggtc

SEQ ID NO: 311487 - DNA, 20 bp, Artificial
  CRISPR gRNA sequence
cccgcttttagtttgggtct

SEQ ID NO: 311488 - DNA, 20 bp, Artificial
  CRISPR gRNA sequence
ttagtttgggtctttggcct

SEQ ID NO: 311489 - DNA, 20 bp, Artificial
  CRISPR gRNA sequence
tagtttgggtctttggcctt

SEQ ID NO: 311490 - DNA, 20 bp, Artificial
  CRISPR gRNA sequence
agtttgggtctttggccttt

SEQ ID NO: 311491 - DNA, 20 bp, Artificial
  CRISPR gRNA sequence
gtttgggtctttggcctttt

SEQ ID NO: 311492 - DNA, 20 bp, Artificial
  CRISPR gRNA sequence
gggtctttggcctttttctt

SEQ ID NO: 311493 - DNA, 20 bp, Artificial
  CRISPR gRNA sequence
ggtctttggcctttttctta

SEQ ID NO: 311494 - DNA, 20 bp, Artificial
  CRISPR gRNA sequence
tggcctttttcttattgatt

SEQ ID NO: 311495 - DNA, 20 bp, Artificial
  CRISPR gRNA sequence
ggcctttttcttattgattt

SEQ ID NO: 311496 - DNA, 20 bp, Artificial
  CRISPR gRNA sequence
gcctttttcttattgattta

SEQ ID NO: 311497 - DNA, 20 bp, Artificial
  CRISPR gRNA sequence
tttcttattgatttatagaa

SEQ ID NO: 311498 - DNA, 20 bp, Artificial
  CRISPR gRNA sequence
ttcttattgatttatagaag

SEQ ID NO: 311499 - DNA, 20 bp, Artificial
  CRISPR gRNA sequence
tcttattgatttatagaagc

SEQ ID NO: 311500 - DNA, 20 bp, Artificial
  CRISPR gRNA sequence
cttattgatttatagaagct

SEQ ID NO: 311501 - DNA, 20 bp, Artificial
  CRISPR gRNA sequence
ttattgatttatagaagctc

SEQ ID NO: 311502 - DNA, 20 bp, Artificial
  CRISPR gRNA sequence
attgatttatagaagctctt

SEQ ID NO: 311503 - DNA, 20 bp, Artificial
  CRISPR gRNA sequence
ttgatttatagaagctcttt

SEQ ID NO: 311504 - DNA, 20 bp, Artificial
  CRISPR gRNA sequence
atttatagaagctcttttat

SEQ ID NO: 311505 - DNA, 20 bp, Artificial
  CRISPR gRNA sequence
atagaagctcttttatacat

SEQ ID NO: 311506 - DNA, 20 bp, Artificial
  CRISPR gRNA sequence
tagaagctcttttatacata

SEQ ID NO: 311507 - DNA, 20 bp, Artificial
  CRISPR gRNA sequence
ttttatacatagaaaattaa

SEQ ID NO: 311508 - DNA, 20 bp, Artificial
  CRISPR gRNA sequence
ttatacatagaaaattaata

SEQ ID NO: 311509 - DNA, 20 bp, Artificial
  CRISPR gRNA sequence
tatacatagaaaattaatac

SEQ ID NO: 311510 - DNA, 20 bp, Artificial
  CRISPR gRNA sequence
atacatagaaaattaatact

SEQ ID NO: 311511 - DNA, 20 bp, Artificial
  CRISPR gRNA sequence
tacatagaaaattaatactt

SEQ ID NO: 311512 - DNA, 20 bp, Artificial
  CRISPR gRNA sequence
atactttgtgactagttgca

SEQ ID NO: 311513 - DNA, 20 bp, Artificial
  CRISPR gRNA sequence
tgtgactagttgcaaatatt

SEQ ID NO: 311514 - DNA, 20 bp, Artificial
  CRISPR gRNA sequence
gtgactagttgcaaatattt

SEQ ID NO: 311515 - DNA, 20 bp, Artificial
  CRISPR gRNA sequence
tgactagttgcaaatatttt

SEQ ID NO: 311516 - DNA, 20 bp, Artificial
  CRISPR gRNA sequence
gttgcaaatattttcagttg

SEQ ID NO: 311517 - DNA, 20 bp, Artificial
  CRISPR gRNA sequence
caaatattttcagttgctga

SEQ ID NO: 311518 - DNA, 20 bp, Artificial
  CRISPR gRNA sequence
tcagttgctgaaatacacag

SEQ ID NO: 311519 - DNA, 20 bp, Artificial
  CRISPR gRNA sequence
cagttgctgaaatacacagt

SEQ ID NO: 311520 - DNA, 20 bp, Artificial
  CRISPR gRNA sequence
agttgctgaaatacacagta

SEQ ID NO: 311521 - DNA, 20 bp, Artificial
  CRISPR gRNA sequence
ctgaaatacacagtaggtgt

SEQ ID NO: 311522 - DNA, 20 bp, Artificial
  CRISPR gRNA sequence
aaatacacagtaggtgttcc

SEQ ID NO: 311523 - DNA, 20 bp, Artificial
  CRISPR gRNA sequence
catgtaagagctgaacagct

SEQ ID NO: 311524 - DNA, 20 bp, Artificial
  CRISPR gRNA sequence
aacagctggttcctgattgc

SEQ ID NO: 311525 - DNA, 20 bp, Artificial
  CRISPR gRNA sequence
gttcctgattgctgtctccc

SEQ ID NO: 311526 - DNA, 20 bp, Artificial
  CRISPR gRNA sequence
ctgattgctgtctccctccc

SEQ ID NO: 311527 - DNA, 20 bp, Artificial
  CRISPR gRNA sequence
attgctgtctccctcccttc

SEQ ID NO: 311528 - DNA, 20 bp, Artificial
  CRISPR gRNA sequence
ctgtctccctcccttccagc

SEQ ID NO: 311529 - DNA, 20 bp, Artificial
  CRISPR gRNA sequence
tctccctcccttccagccaa

SEQ ID NO: 311530 - DNA, 20 bp, Artificial
  CRISPR gRNA sequence
cctcccttccagccaataga

SEQ ID NO: 311531 - DNA, 20 bp, Artificial
  CRISPR gRNA sequence
ccttccagccaatagatttc

SEQ ID NO: 311532 - DNA, 20 bp, Artificial
  CRISPR gRNA sequence
ccagccaatagatttcagag

SEQ ID NO: 311533 - DNA, 20 bp, Artificial
  CRISPR gRNA sequence
cagccaatagatttcagagt

SEQ ID NO: 311534 - DNA, 20 bp, Artificial
  CRISPR gRNA sequence
cagagtttgggcattaccta

SEQ ID NO: 311535 - DNA, 20 bp, Artificial
  CRISPR gRNA sequence
agagtttgggcattacctat

SEQ ID NO: 311536 - DNA, 20 bp, Artificial
  CRISPR gRNA sequence
gggcattacctattgagcca

SEQ ID NO: 311537 - DNA, 20 bp, Artificial
  CRISPR gRNA sequence
ggcattacctattgagccaa

SEQ ID NO: 311538 - DNA, 20 bp, Artificial
  CRISPR gRNA sequence
cctattgagccaaagctgac

SEQ ID NO: 311539 - DNA, 20 bp, Artificial
  CRISPR gRNA sequence
ttgagccaaagctgacacca

SEQ ID NO: 311540 - DNA, 20 bp, Artificial
  CRISPR gRNA sequence
agccaaagctgacaccacac

SEQ ID NO: 311541 - DNA, 20 bp, Artificial
  CRISPR gRNA sequence
acaccacacaagcgcagagt

SEQ ID NO: 311542 - DNA, 20 bp, Artificial
  CRISPR gRNA sequence
tctgtctgattcctgtgagc

SEQ ID NO: 311543 - DNA, 20 bp, Artificial
  CRISPR gRNA sequence
tgtctgattcctgtgagctt

SEQ ID NO: 311544 - DNA, 20 bp, Artificial
  CRISPR gRNA sequence
tctgattcctgtgagcttcc

SEQ ID NO: 311545 - DNA, 20 bp, Artificial
  CRISPR gRNA sequence
attcctgtgagcttcctcat

SEQ ID NO: 311546 - DNA, 20 bp, Artificial
  CRISPR gRNA sequence
ctgtgagcttcctcatacta

SEQ ID NO: 311547 - DNA, 20 bp, Artificial
  CRISPR gRNA sequence
tgagcttcctcatactaaat

SEQ ID NO: 311548 - DNA, 20 bp, Artificial
  CRISPR gRNA sequence
cctcatactaaatcaccaac

SEQ ID NO: 311549 - DNA, 20 bp, Artificial
  CRISPR gRNA sequence
ctcatactaaatcaccaaca

SEQ ID NO: 311550 - DNA, 20 bp, Artificial
  CRISPR gRNA sequence
atactaaatcaccaacagca

SEQ ID NO: 311551 - DNA, 20 bp, Artificial
  CRISPR gRNA sequence
aatcaccaacagcaacctac

SEQ ID NO: 311552 - DNA, 20 bp, Artificial
  CRISPR gRNA sequence
cttatcacagaatatgagaa

SEQ ID NO: 311553 - DNA, 20 bp, Artificial
  CRISPR gRNA sequence
atcacagaatatgagaattg

SEQ ID NO: 311554 - DNA, 20 bp, Artificial
  CRISPR gRNA sequence
tcacagaatatgagaattga

SEQ ID NO: 311555 - DNA, 20 bp, Artificial
  CRISPR gRNA sequence
aacaagtgttggcaaggatg

SEQ ID NO: 311556 - DNA, 20 bp, Artificial
  CRISPR gRNA sequence
gcaaggatgtggagaaattg

SEQ ID NO: 311557 - DNA, 20 bp, Artificial
  CRISPR gRNA sequence
gagctcttgttccagttgtc

SEQ ID NO: 311558 - DNA, 20 bp, Artificial
  CRISPR gRNA sequence
ttgttccagttgtcgatggg

SEQ ID NO: 311559 - DNA, 20 bp, Artificial
  CRISPR gRNA sequence
gttccagttgtcgatgggaa

SEQ ID NO: 311560 - DNA, 20 bp, Artificial
  CRISPR gRNA sequence
ttccagttgtcgatgggaat

SEQ ID NO: 311561 - DNA, 20 bp, Artificial
  CRISPR gRNA sequence
cagttgtcgatgggaatgta

SEQ ID NO: 311562 - DNA, 20 bp, Artificial
  CRISPR gRNA sequence
tcgatgggaatgtaaagtga

SEQ ID NO: 311563 - DNA, 20 bp, Artificial
  CRISPR gRNA sequence
ctatggaaaatagtgtagca

SEQ ID NO: 311564 - DNA, 20 bp, Artificial
  CRISPR gRNA sequence
tggaaaatagtgtagcagtt

SEQ ID NO: 311565 - DNA, 20 bp, Artificial
  CRISPR gRNA sequence
ctcagaaaattaaaaataga

SEQ ID NO: 311566 - DNA, 20 bp, Artificial
  CRISPR gRNA sequence
agaaaattaaaaatagaatg

SEQ ID NO: 311567 - DNA, 20 bp, Artificial
  CRISPR gRNA sequence
aaaatagaatgaccacatga

SEQ ID NO: 311568 - DNA, 20 bp, Artificial
  CRISPR gRNA sequence
gcaattccccttctgggtat

SEQ ID NO: 311569 - DNA, 20 bp, Artificial
  CRISPR gRNA sequence
cccttctgggtatataccca

SEQ ID NO: 311570 - DNA, 20 bp, Artificial
  CRISPR gRNA sequence
ctgggtatatacccaaaaga

SEQ ID NO: 311571 - DNA, 20 bp, Artificial
  CRISPR gRNA sequence
tgggtatatacccaaaagaa

SEQ ID NO: 311572 - DNA, 20 bp, Artificial
  CRISPR gRNA sequence
ggtatatacccaaaagaact

SEQ ID NO: 311573 - DNA, 20 bp, Artificial
  CRISPR gRNA sequence
aaagcagagtcttaaagaga

SEQ ID NO: 311574 - DNA, 20 bp, Artificial
  CRISPR gRNA sequence
aaagagatattcatacagcc

SEQ ID NO: 311575 - DNA, 20 bp, Artificial
  CRISPR gRNA sequence
aagagatattcatacagcct

SEQ ID NO: 311576 - DNA, 20 bp, Artificial
  CRISPR gRNA sequence
atacagccttgttcatacca

SEQ ID NO: 311577 - DNA, 20 bp, Artificial
  CRISPR gRNA sequence
gttcataccagcattatgca

SEQ ID NO: 311578 - DNA, 20 bp, Artificial
  CRISPR gRNA sequence
ttcataccagcattatgcac

SEQ ID NO: 311579 - DNA, 20 bp, Artificial
  CRISPR gRNA sequence
ataccagcattatgcacaat

SEQ ID NO: 311580 - DNA, 20 bp, Artificial
  CRISPR gRNA sequence
tgcacaatagccaaaaggtg

SEQ ID NO: 311581 - DNA, 20 bp, Artificial
  CRISPR gRNA sequence
aaatgtccatcaaaaatgaa

SEQ ID NO: 311582 - DNA, 20 bp, Artificial
  CRISPR gRNA sequence
agtcttagaaagaaaggaaa

SEQ ID NO: 311583 - DNA, 20 bp, Artificial
  CRISPR gRNA sequence
gtcttagaaagaaaggaaat

SEQ ID NO: 311584 - DNA, 20 bp, Artificial
  CRISPR gRNA sequence
agaaagaaaggaaattcaaa

SEQ ID NO: 311585 - DNA, 20 bp, Artificial
  CRISPR gRNA sequence
gaaagaaaggaaattcaaac

SEQ ID NO: 311586 - DNA, 20 bp, Artificial
  CRISPR gRNA sequence
aaacacatgctacaatgtgg

SEQ ID NO: 311587 - DNA, 20 bp, Artificial
  CRISPR gRNA sequence
caatgtggatggcccttgaa

SEQ ID NO: 311588 - DNA, 20 bp, Artificial
  CRISPR gRNA sequence
gaatacattatactaagtga

SEQ ID NO: 311589 - DNA, 20 bp, Artificial
  CRISPR gRNA sequence
aatacattatactaagtgaa

SEQ ID NO: 311590 - DNA, 20 bp, Artificial
  CRISPR gRNA sequence
tactaagtgaaataagccag

SEQ ID NO: 311591 - DNA, 20 bp, Artificial
  CRISPR gRNA sequence
agtgaaataagccagtcaca

SEQ ID NO: 311592 - DNA, 20 bp, Artificial
  CRISPR gRNA sequence
tatgagtttacttataccct

SEQ ID NO: 311593 - DNA, 20 bp, Artificial
  CRISPR gRNA sequence
acttataccctaagcagtca

SEQ ID NO: 311594 - DNA, 20 bp, Artificial
  CRISPR gRNA sequence
cttataccctaagcagtcaa

SEQ ID NO: 311595 - DNA, 20 bp, Artificial
  CRISPR gRNA sequence
ataccctaagcagtcaaatt

SEQ ID NO: 311596 - DNA, 20 bp, Artificial
  CRISPR gRNA sequence
taccctaagcagtcaaattc

SEQ ID NO: 311597 - DNA, 20 bp, Artificial
  CRISPR gRNA sequence
agcagtcaaattcatggaaa

SEQ ID NO: 311598 - DNA, 20 bp, Artificial
  CRISPR gRNA sequence
atggaaacagaaggtggaat

SEQ ID NO: 311599 - DNA, 20 bp, Artificial
  CRISPR gRNA sequence
gcaagagctgagaggaggag

SEQ ID NO: 311600 - DNA, 20 bp, Artificial
  CRISPR gRNA sequence
agaggaggagagaaagaaga

SEQ ID NO: 311601 - DNA, 20 bp, Artificial
  CRISPR gRNA sequence
ttgtttaataggtatagagg

SEQ ID NO: 311602 - DNA, 20 bp, Artificial
  CRISPR gRNA sequence
tttaataggtatagaggctt

SEQ ID NO: 311603 - DNA, 20 bp, Artificial
  CRISPR gRNA sequence
aataggtatagaggcttagt

SEQ ID NO: 311604 - DNA, 20 bp, Artificial
  CRISPR gRNA sequence
ataggtatagaggcttagtt

SEQ ID NO: 311605 - DNA, 20 bp, Artificial
  CRISPR gRNA sequence
agttttgcaagatgaaagag

SEQ ID NO: 311606 - DNA, 20 bp, Artificial
  CRISPR gRNA sequence
gttttgcaagatgaaagagt

SEQ ID NO: 311607 - DNA, 20 bp, Artificial
  CRISPR gRNA sequence
tgcaagatgaaagagttctg

SEQ ID NO: 311608 - DNA, 20 bp, Artificial
  CRISPR gRNA sequence
gcaagatgaaagagttctga

SEQ ID NO: 311609 - DNA, 20 bp, Artificial
  CRISPR gRNA sequence
caagatgaaagagttctgaa

SEQ ID NO: 311610 - DNA, 20 bp, Artificial
  CRISPR gRNA sequence
tgaagatggatgtagtgatg

SEQ ID NO: 311611 - DNA, 20 bp, Artificial
  CRISPR gRNA sequence
aagatggatgtagtgatgac

SEQ ID NO: 311612 - DNA, 20 bp, Artificial
  CRISPR gRNA sequence
tacaacaatgtgaatgtatt

SEQ ID NO: 311613 - DNA, 20 bp, Artificial
  CRISPR gRNA sequence
cataccactgtacactcaaa

SEQ ID NO: 311614 - DNA, 20 bp, Artificial
  CRISPR gRNA sequence
ataccactgtacactcaaaa

SEQ ID NO: 311615 - DNA, 20 bp, Artificial
  CRISPR gRNA sequence
tacactcaaaaggtgaagat

SEQ ID NO: 311616 - DNA, 20 bp, Artificial
  CRISPR gRNA sequence
aaaaggtgaagatggcaaat

SEQ ID NO: 311617 - DNA, 20 bp, Artificial
  CRISPR gRNA sequence
tatgtgtattatgccacaac

SEQ ID NO: 311618 - DNA, 20 bp, Artificial
  CRISPR gRNA sequence
atgtgtattatgccacaact

SEQ ID NO: 311619 - DNA, 20 bp, Artificial
  CRISPR gRNA sequence
tgtgtattatgccacaacta

SEQ ID NO: 311620 - DNA, 20 bp, Artificial
  CRISPR gRNA sequence
tgccacaactaataaagatt

SEQ ID NO: 311621 - DNA, 20 bp, Artificial
  CRISPR gRNA sequence
ataaagatttctaaaactta

SEQ ID NO: 311622 - DNA, 20 bp, Artificial
  CRISPR gRNA sequence
ctaaaacttatgagatctaa

SEQ ID NO: 311623 - DNA, 20 bp, Artificial
  CRISPR gRNA sequence
taaaacttatgagatctaat

SEQ ID NO: 311624 - DNA, 20 bp, Artificial
  CRISPR gRNA sequence
aaacttatgagatctaattt

SEQ ID NO: 311625 - DNA, 20 bp, Artificial
  CRISPR gRNA sequence
atgagatctaatttcaccgt

SEQ ID NO: 311626 - DNA, 20 bp, Artificial
  CRISPR gRNA sequence
tgagatctaatttcaccgtt

SEQ ID NO: 311627 - DNA, 20 bp, Artificial
  CRISPR gRNA sequence
atttcaccgtttcctattgc

SEQ ID NO: 311628 - DNA, 20 bp, Artificial
  CRISPR gRNA sequence
caccgtttcctattgctaaa

SEQ ID NO: 311629 - DNA, 20 bp, Artificial
  CRISPR gRNA sequence
accgtttcctattgctaaag

SEQ ID NO: 311630 - DNA, 20 bp, Artificial
  CRISPR gRNA sequence
cctattgctaaagatcacaa

SEQ ID NO: 311631 - DNA, 20 bp, Artificial
  CRISPR gRNA sequence
ctattgctaaagatcacaaa

SEQ ID NO: 311632 - DNA, 20 bp, Artificial
  CRISPR gRNA sequence
ttgctaaagatcacaaatta

SEQ ID NO: 311633 - DNA, 20 bp, Artificial
  CRISPR gRNA sequence
ctaaagatcacaaattagaa

SEQ ID NO: 311634 - DNA, 20 bp, Artificial
  CRISPR gRNA sequence
aagatcacaaattagaaaac

SEQ ID NO: 311635 - DNA, 20 bp, Artificial
  CRISPR gRNA sequence
gaaaacacgttggcaaaagg

SEQ ID NO: 311636 - DNA, 20 bp, Artificial
  CRISPR gRNA sequence
gcaaaaggtacatgaaaata

SEQ ID NO: 311637 - DNA, 20 bp, Artificial
  CRISPR gRNA sequence
ttgtgttgatcagagcataa

SEQ ID NO: 311638 - DNA, 20 bp, Artificial
  CRISPR gRNA sequence
gtgttgatcagagcataaac

SEQ ID NO: 311639 - DNA, 20 bp, Artificial
  CRISPR gRNA sequence
tgttgatcagagcataaacg

SEQ ID NO: 311640 - DNA, 20 bp, Artificial
  CRISPR gRNA sequence
atcagagcataaacgtataa

SEQ ID NO: 311641 - DNA, 20 bp, Artificial
  CRISPR gRNA sequence
ataaactaataaagatttct

SEQ ID NO: 311642 - DNA, 20 bp, Artificial
  CRISPR gRNA sequence
ataaagatttctaaataaca

SEQ ID NO: 311643 - DNA, 20 bp, Artificial
  CRISPR gRNA sequence
ctaaataacaaagatttcta

SEQ ID NO: 311644 - DNA, 20 bp, Artificial
  CRISPR gRNA sequence
taaataacaaagatttctaa

SEQ ID NO: 311645 - DNA, 20 bp, Artificial
  CRISPR gRNA sequence
aataacaaagatttctaaaa

SEQ ID NO: 311646 - DNA, 20 bp, Artificial
  CRISPR gRNA sequence
ctaaaacttatgagatgtaa

SEQ ID NO: 311647 - DNA, 20 bp, Artificial
  CRISPR gRNA sequence
taaaacttatgagatgtaat

SEQ ID NO: 311648 - DNA, 20 bp, Artificial
  CRISPR gRNA sequence
aaacttatgagatgtaattt

SEQ ID NO: 311649 - DNA, 20 bp, Artificial
  CRISPR gRNA sequence
atgagatgtaatttcaccat

SEQ ID NO: 311650 - DNA, 20 bp, Artificial
  CRISPR gRNA sequence
tgagatgtaatttcaccatt

SEQ ID NO: 311651 - DNA, 20 bp, Artificial
  CRISPR gRNA sequence
caccatttcctattgctaaa

SEQ ID NO: 311652 - DNA, 20 bp, Artificial
  CRISPR gRNA sequence
accatttcctattgctaaag

SEQ ID NO: 311653 - DNA, 20 bp, Artificial
  CRISPR gRNA sequence
cctattgctaaagatcacaa

SEQ ID NO: 311654 - DNA, 20 bp, Artificial
  CRISPR gRNA sequence
ctattgctaaagatcacaaa

SEQ ID NO: 311655 - DNA, 20 bp, Artificial
  CRISPR gRNA sequence
ttgctaaagatcacaaatta

SEQ ID NO: 311656 - DNA, 20 bp, Artificial
  CRISPR gRNA sequence
ctaaagatcacaaattagaa

SEQ ID NO: 311657 - DNA, 20 bp, Artificial
  CRISPR gRNA sequence
aagatcacaaattagaaaac

SEQ ID NO: 311658 - DNA, 20 bp, Artificial
  CRISPR gRNA sequence
gaaaacatgttggcaaaagg

SEQ ID NO: 311659 - DNA, 20 bp, Artificial
  CRISPR gRNA sequence
gcaaaaggtacatgaaaata

SEQ ID NO: 311660 - DNA, 20 bp, Artificial
  CRISPR gRNA sequence
ttgtgttgatcagagcataa

SEQ ID NO: 311661 - DNA, 20 bp, Artificial
  CRISPR gRNA sequence
gtgttgatcagagcataaac

SEQ ID NO: 311662 - DNA, 20 bp, Artificial
  CRISPR gRNA sequence
tgttgatcagagcataaacg

SEQ ID NO: 311663 - DNA, 20 bp, Artificial
  CRISPR gRNA sequence
atcagagcataaacgtataa

SEQ ID NO: 311664 - DNA, 20 bp, Artificial
  CRISPR gRNA sequence
aggggagaacaatttgcaac

SEQ ID NO: 311665 - DNA, 20 bp, Artificial
  CRISPR gRNA sequence
gcaactattcttcaaccctt

SEQ ID NO: 311666 - DNA, 20 bp, Artificial
  CRISPR gRNA sequence
caactattcttcaacccttt

SEQ ID NO: 311667 - DNA, 20 bp, Artificial
  CRISPR gRNA sequence
ttcttcaaccctttggtcaa

SEQ ID NO: 311668 - DNA, 20 bp, Artificial
  CRISPR gRNA sequence
ttcaaccctttggtcaaacg

SEQ ID NO: 311669 - DNA, 20 bp, Artificial
  CRISPR gRNA sequence
caaccctttggtcaaacgat

SEQ ID NO: 311670 - DNA, 20 bp, Artificial
  CRISPR gRNA sequence
aaccctttggtcaaacgatt

SEQ ID NO: 311671 - DNA, 20 bp, Artificial
  CRISPR gRNA sequence
tggtcaaacgattctgcttc

SEQ ID NO: 311672 - DNA, 20 bp, Artificial
  CRISPR gRNA sequence
ggtcaaacgattctgcttct

SEQ ID NO: 311673 - DNA, 20 bp, Artificial
  CRISPR gRNA sequence
gtcaaacgattctgcttcta

SEQ ID NO: 311674 - DNA, 20 bp, Artificial
  CRISPR gRNA sequence
tgcttctaggaatatagctt

SEQ ID NO: 311675 - DNA, 20 bp, Artificial
  CRISPR gRNA sequence
cttctaggaatatagcttac

SEQ ID NO: 311676 - DNA, 20 bp, Artificial
  CRISPR gRNA sequence
ctaggaatatagcttactcc

SEQ ID NO: 311677 - DNA, 20 bp, Artificial
  CRISPR gRNA sequence
taggaatatagcttactccc

SEQ ID NO: 311678 - DNA, 20 bp, Artificial
  CRISPR gRNA sequence
ggaatatagcttactcccac

SEQ ID NO: 311679 - DNA, 20 bp, Artificial
  CRISPR gRNA sequence
actcccacctgtgtgatatg

SEQ ID NO: 311680 - DNA, 20 bp, Artificial
  CRISPR gRNA sequence
ctcccacctgtgtgatatgg

SEQ ID NO: 311681 - DNA, 20 bp, Artificial
  CRISPR gRNA sequence
ccacctgtgtgatatggcat

SEQ ID NO: 311682 - DNA, 20 bp, Artificial
  CRISPR gRNA sequence
tgtgatatggcatataatca

SEQ ID NO: 311683 - DNA, 20 bp, Artificial
  CRISPR gRNA sequence
tccattgcaacaaaagattg

SEQ ID NO: 311684 - DNA, 20 bp, Artificial
  CRISPR gRNA sequence
ccattgcaacaaaagattgg

SEQ ID NO: 311685 - DNA, 20 bp, Artificial
  CRISPR gRNA sequence
cattgcaacaaaagattgga

SEQ ID NO: 311686 - DNA, 20 bp, Artificial
  CRISPR gRNA sequence
caacaaaagattggaaacaa

SEQ ID NO: 311687 - DNA, 20 bp, Artificial
  CRISPR gRNA sequence
gaaacaacgttaagtatcca

SEQ ID NO: 311688 - DNA, 20 bp, Artificial
  CRISPR gRNA sequence
agtatccatcactagtggtc

SEQ ID NO: 311689 - DNA, 20 bp, Artificial
  CRISPR gRNA sequence
gtggtctggaaatatatata

SEQ ID NO: 311690 - DNA, 20 bp, Artificial
  CRISPR gRNA sequence
gaaatatatatatattattg

SEQ ID NO: 311691 - DNA, 20 bp, Artificial
  CRISPR gRNA sequence
ttgtcatccaatagaataca

SEQ ID NO: 311692 - DNA, 20 bp, Artificial
  CRISPR gRNA sequence
tcatccaatagaatacaata

SEQ ID NO: 311693 - DNA, 20 bp, Artificial
  CRISPR gRNA sequence
atatgcaacttttagcatga

SEQ ID NO: 311694 - DNA, 20 bp, Artificial
  CRISPR gRNA sequence
ttagcatgaggatactcgtt

SEQ ID NO: 311695 - DNA, 20 bp, Artificial
  CRISPR gRNA sequence
tagcatgaggatactcgtta

SEQ ID NO: 311696 - DNA, 20 bp, Artificial
  CRISPR gRNA sequence
agcatgaggatactcgttac

SEQ ID NO: 311697 - DNA, 20 bp, Artificial
  CRISPR gRNA sequence
gcatgaggatactcgttaca

SEQ ID NO: 311698 - DNA, 20 bp, Artificial
  CRISPR gRNA sequence
gttacatgctgatacagaat

SEQ ID NO: 311699 - DNA, 20 bp, Artificial
  CRISPR gRNA sequence
catgctgatacagaataatc

SEQ ID NO: 311700 - DNA, 20 bp, Artificial
  CRISPR gRNA sequence
atacagaataatctccaagg

SEQ ID NO: 311701 - DNA, 20 bp, Artificial
  CRISPR gRNA sequence
caaggtagtcatatgtgtgc

SEQ ID NO: 311702 - DNA, 20 bp, Artificial
  CRISPR gRNA sequence
ccatttgtgcttaaaaataa

SEQ ID NO: 311703 - DNA, 20 bp, Artificial
  CRISPR gRNA sequence
gtgcttaaaaataaaaagaa

SEQ ID NO: 311704 - DNA, 20 bp, Artificial
  CRISPR gRNA sequence
tgcttaaaaataaaaagaaa

SEQ ID NO: 311705 - DNA, 20 bp, Artificial
  CRISPR gRNA sequence
aaaaataaaaagaaaacaga

SEQ ID NO: 311706 - DNA, 20 bp, Artificial
  CRISPR gRNA sequence
aaaataaaaagaaaacagaa

SEQ ID NO: 311707 - DNA, 20 bp, Artificial
  CRISPR gRNA sequence
ttgtttagttttgtctaaag

SEQ ID NO: 311708 - DNA, 20 bp, Artificial
  CRISPR gRNA sequence
tgtttagttttgtctaaagt

SEQ ID NO: 311709 - DNA, 20 bp, Artificial
  CRISPR gRNA sequence
gtttagttttgtctaaagta

SEQ ID NO: 311710 - DNA, 20 bp, Artificial
  CRISPR gRNA sequence
tttagttttgtctaaagtaa

SEQ ID NO: 311711 - DNA, 20 bp, Artificial
  CRISPR gRNA sequence
agttttgtctaaagtaactt

SEQ ID NO: 311712 - DNA, 20 bp, Artificial
  CRISPR gRNA sequence
gttttgtctaaagtaacttt

SEQ ID NO: 311713 - DNA, 20 bp, Artificial
  CRISPR gRNA sequence
tgtctaaagtaactttaagt

SEQ ID NO: 311714 - DNA, 20 bp, Artificial
  CRISPR gRNA sequence
gtctaaagtaactttaagta

SEQ ID NO: 311715 - DNA, 20 bp, Artificial
  CRISPR gRNA sequence
tctaaagtaactttaagtag

SEQ ID NO: 311716 - DNA, 20 bp, Artificial
  CRISPR gRNA sequence
aagtaactttaagtagaggc

SEQ ID NO: 311717 - DNA, 20 bp, Artificial
  CRISPR gRNA sequence
taagtagaggcaagaaactg

SEQ ID NO: 311718 - DNA, 20 bp, Artificial
  CRISPR gRNA sequence
aagtagaggcaagaaactgg

SEQ ID NO: 311719 - DNA, 20 bp, Artificial
  CRISPR gRNA sequence
agtagaggcaagaaactggt

SEQ ID NO: 311720 - DNA, 20 bp, Artificial
  CRISPR gRNA sequence
gtaacatgtaacagtgatca

SEQ ID NO: 311721 - DNA, 20 bp, Artificial
  CRISPR gRNA sequence
ttacctctgtggaagaaaac

SEQ ID NO: 311722 - DNA, 20 bp, Artificial
  CRISPR gRNA sequence
cctctgtggaagaaaactag

SEQ ID NO: 311723 - DNA, 20 bp, Artificial
  CRISPR gRNA sequence
tgtggaagaaaactagacag

SEQ ID NO: 311724 - DNA, 20 bp, Artificial
  CRISPR gRNA sequence
tggaagaaaactagacagct

SEQ ID NO: 311725 - DNA, 20 bp, Artificial
  CRISPR gRNA sequence
gacagctaagggacaaggct

SEQ ID NO: 311726 - DNA, 20 bp, Artificial
  CRISPR gRNA sequence
agggacaaggctgggaggca

SEQ ID NO: 311727 - DNA, 20 bp, Artificial
  CRISPR gRNA sequence
ggaggcagacttgctttcca

SEQ ID NO: 311728 - DNA, 20 bp, Artificial
  CRISPR gRNA sequence
gctttccactatttatcacc

SEQ ID NO: 311729 - DNA, 20 bp, Artificial
  CRISPR gRNA sequence
ctttccactatttatcacct

SEQ ID NO: 311730 - DNA, 20 bp, Artificial
  CRISPR gRNA sequence
tccactatttatcaccttta

SEQ ID NO: 311731 - DNA, 20 bp, Artificial
  CRISPR gRNA sequence
ccactatttatcacctttat

SEQ ID NO: 311732 - DNA, 20 bp, Artificial
  CRISPR gRNA sequence
cactatttatcacctttatc

SEQ ID NO: 311733 - DNA, 20 bp, Artificial
  CRISPR gRNA sequence
tttatcacctttatctttca

SEQ ID NO: 311734 - DNA, 20 bp, Artificial
  CRISPR gRNA sequence
atcacctttatctttcaaat

SEQ ID NO: 311735 - DNA, 20 bp, Artificial
  CRISPR gRNA sequence
tcacctttatctttcaaatt

SEQ ID NO: 311736 - DNA, 20 bp, Artificial
  CRISPR gRNA sequence
tatctttcaaatttagtacc

SEQ ID NO: 311737 - DNA, 20 bp, Artificial
  CRISPR gRNA sequence
atctttcaaatttagtacca

SEQ ID NO: 311738 - DNA, 20 bp, Artificial
  CRISPR gRNA sequence
tctttcaaatttagtaccat

SEQ ID NO: 311739 - DNA, 20 bp, Artificial
  CRISPR gRNA sequence
tcaaatttagtaccatctac

SEQ ID NO: 311740 - DNA, 20 bp, Artificial
  CRISPR gRNA sequence
caaatttagtaccatctaca

SEQ ID NO: 311741 - DNA, 20 bp, Artificial
  CRISPR gRNA sequence
aaatttagtaccatctacat

SEQ ID NO: 311742 - DNA, 20 bp, Artificial
  CRISPR gRNA sequence
agtaccatctacatttagta

SEQ ID NO: 311743 - DNA, 20 bp, Artificial
  CRISPR gRNA sequence
gtaccatctacatttagtac

SEQ ID NO: 311744 - DNA, 20 bp, Artificial
  CRISPR gRNA sequence
catttagtaccatgatctat

SEQ ID NO: 311745 - DNA, 20 bp, Artificial
  CRISPR gRNA sequence
agtaccatgatctattcaaa

SEQ ID NO: 311746 - DNA, 20 bp, Artificial
  CRISPR gRNA sequence
gtaccatgatctattcaaaa

SEQ ID NO: 311747 - DNA, 20 bp, Artificial
  CRISPR gRNA sequence
ttcaaaaatatttattaaaa

SEQ ID NO: 311748 - DNA, 20 bp, Artificial
  CRISPR gRNA sequence
aaaaatatttattaaaaaaa

SEQ ID NO: 311749 - DNA, 20 bp, Artificial
  CRISPR gRNA sequence
attaaaaaaagaaaaggtat

SEQ ID NO: 311750 - DNA, 20 bp, Artificial
  CRISPR gRNA sequence
ttaaaaaaagaaaaggtata

SEQ ID NO: 311751 - DNA, 20 bp, Artificial
  CRISPR gRNA sequence
aaaaaagaaaaggtatagtc

SEQ ID NO: 311752 - DNA, 20 bp, Artificial
  CRISPR gRNA sequence
gaaggaaaaaaaacataaca

SEQ ID NO: 311753 - DNA, 20 bp, Artificial
  CRISPR gRNA sequence
ctagcccaatgtcctgcact

SEQ ID NO: 311754 - DNA, 20 bp, Artificial
  CRISPR gRNA sequence
tagcccaatgtcctgcactg

SEQ ID NO: 311755 - DNA, 20 bp, Artificial
  CRISPR gRNA sequence
gcccaatgtcctgcactggg

SEQ ID NO: 311756 - DNA, 20 bp, Artificial
  CRISPR gRNA sequence
cactgggtgctatgagagca

SEQ ID NO: 311757 - DNA, 20 bp, Artificial
  CRISPR gRNA sequence
ggtgctatgagagcagagga

SEQ ID NO: 311758 - DNA, 20 bp, Artificial
  CRISPR gRNA sequence
tgagagcagaggaaagaaac

SEQ ID NO: 311759 - DNA, 20 bp, Artificial
  CRISPR gRNA sequence
ctagacaacaccgtctgggg

SEQ ID NO: 311760 - DNA, 20 bp, Artificial
  CRISPR gRNA sequence
tagacaacaccgtctggggc

SEQ ID NO: 311761 - DNA, 20 bp, Artificial
  CRISPR gRNA sequence
gacaacaccgtctggggcat

SEQ ID NO: 311762 - DNA, 20 bp, Artificial
  CRISPR gRNA sequence
gggcatacatttctgctatt

SEQ ID NO: 311763 - DNA, 20 bp, Artificial
  CRISPR gRNA sequence
ctgctattcgatcaagaata

SEQ ID NO: 311764 - DNA, 20 bp, Artificial
  CRISPR gRNA sequence
tgctattcgatcaagaatag

SEQ ID NO: 311765 - DNA, 20 bp, Artificial
  CRISPR gRNA sequence
ctattcgatcaagaatagtt

SEQ ID NO: 311766 - DNA, 20 bp, Artificial
  CRISPR gRNA sequence
ttcgatcaagaatagttgtg

SEQ ID NO: 311767 - DNA, 20 bp, Artificial
  CRISPR gRNA sequence
gatcaagaatagttgtgcat

SEQ ID NO: 311768 - DNA, 20 bp, Artificial
  CRISPR gRNA sequence
tgcatcttttcctggaaaga

SEQ ID NO: 311769 - DNA, 20 bp, Artificial
  CRISPR gRNA sequence
ttcctggaaagaattgattt

SEQ ID NO: 311770 - DNA, 20 bp, Artificial
  CRISPR gRNA sequence
tcctggaaagaattgatttg

SEQ ID NO: 311771 - DNA, 20 bp, Artificial
  CRISPR gRNA sequence
cctggaaagaattgatttgt

SEQ ID NO: 311772 - DNA, 20 bp, Artificial
  CRISPR gRNA sequence
ctggaaagaattgatttgtt

SEQ ID NO: 311773 - DNA, 20 bp, Artificial
  CRISPR gRNA sequence
gaaagaattgatttgttttt

SEQ ID NO: 311774 - DNA, 20 bp, Artificial
  CRISPR gRNA sequence
atttgtttttatcaacagac

SEQ ID NO: 311775 - DNA, 20 bp, Artificial
  CRISPR gRNA sequence
gtttttatcaacagacctat

SEQ ID NO: 311776 - DNA, 20 bp, Artificial
  CRISPR gRNA sequence
tttttatcaacagacctatg

SEQ ID NO: 311777 - DNA, 20 bp, Artificial
  CRISPR gRNA sequence
ttatcaacagacctatgaat

SEQ ID NO: 311778 - DNA, 20 bp, Artificial
  CRISPR gRNA sequence
tatcaacagacctatgaatt

SEQ ID NO: 311779 - DNA, 20 bp, Artificial
  CRISPR gRNA sequence
atcaacagacctatgaattt

SEQ ID NO: 311780 - DNA, 20 bp, Artificial
  CRISPR gRNA sequence
tcaacagacctatgaattta

SEQ ID NO: 311781 - DNA, 20 bp, Artificial
  CRISPR gRNA sequence
tgaatttagtggacagacct

SEQ ID NO: 311782 - DNA, 20 bp, Artificial
  CRISPR gRNA sequence
agtggacagacctgtgaatt

SEQ ID NO: 311783 - DNA, 20 bp, Artificial
  CRISPR gRNA sequence
gtggacagacctgtgaatta

SEQ ID NO: 311784 - DNA, 20 bp, Artificial
  CRISPR gRNA sequence
tgaattaattcactggttag

SEQ ID NO: 311785 - DNA, 20 bp, Artificial
  CRISPR gRNA sequence
attcactggttaggttttcc

SEQ ID NO: 311786 - DNA, 20 bp, Artificial
  CRISPR gRNA sequence
actggttaggttttcctttt

SEQ ID NO: 311787 - DNA, 20 bp, Artificial
  CRISPR gRNA sequence
gttaggttttcctttttaca

SEQ ID NO: 311788 - DNA, 20 bp, Artificial
  CRISPR gRNA sequence
ggttttcctttttacattgg

SEQ ID NO: 311789 - DNA, 20 bp, Artificial
  CRISPR gRNA sequence
tcctttttacattggctgtt

SEQ ID NO: 311790 - DNA, 20 bp, Artificial
  CRISPR gRNA sequence
cctttttacattggctgtta

SEQ ID NO: 311791 - DNA, 20 bp, Artificial
  CRISPR gRNA sequence
ctttttacattggctgttaa

SEQ ID NO: 311792 - DNA, 20 bp, Artificial
  CRISPR gRNA sequence
tttacattggctgttaaaaa

SEQ ID NO: 311793 - DNA, 20 bp, Artificial
  CRISPR gRNA sequence
ttacattggctgttaaaaag

SEQ ID NO: 311794 - DNA, 20 bp, Artificial
  CRISPR gRNA sequence
tacattggctgttaaaaagc

SEQ ID NO: 311795 - DNA, 20 bp, Artificial
  CRISPR gRNA sequence
acattggctgttaaaaagct

SEQ ID NO: 311796 - DNA, 20 bp, Artificial
  CRISPR gRNA sequence
cattggctgttaaaaagcta

SEQ ID NO: 311797 - DNA, 20 bp, Artificial
  CRISPR gRNA sequence
gctgttaaaaagctataagc

SEQ ID NO: 311798 - DNA, 20 bp, Artificial
  CRISPR gRNA sequence
ttaaaaagctataagccaaa

SEQ ID NO: 311799 - DNA, 20 bp, Artificial
  CRISPR gRNA sequence
aaaagctataagccaaattt

SEQ ID NO: 311800 - DNA, 20 bp, Artificial
  CRISPR gRNA sequence
taagccaaatttatgtcccc

SEQ ID NO: 311801 - DNA, 20 bp, Artificial
  CRISPR gRNA sequence
atgtccccctcagtgcaaat

SEQ ID NO: 311802 - DNA, 20 bp, Artificial
  CRISPR gRNA sequence
tgtccccctcagtgcaaatt

SEQ ID NO: 311803 - DNA, 20 bp, Artificial
  CRISPR gRNA sequence
agtgcaaattgggcagattt

SEQ ID NO: 311804 - DNA, 20 bp, Artificial
  CRISPR gRNA sequence
ggcagatttctagggcaagc

SEQ ID NO: 311805 - DNA, 20 bp, Artificial
  CRISPR gRNA sequence
ctagggcaagcatttagcac

SEQ ID NO: 311806 - DNA, 20 bp, Artificial
  CRISPR gRNA sequence
tagggcaagcatttagcact

SEQ ID NO: 311807 - DNA, 20 bp, Artificial
  CRISPR gRNA sequence
gggcaagcatttagcactgg

SEQ ID NO: 311808 - DNA, 20 bp, Artificial
  CRISPR gRNA sequence
agcactggccttgtccttgg

SEQ ID NO: 311809 - DNA, 20 bp, Artificial
  CRISPR gRNA sequence
gcactggccttgtccttggc

SEQ ID NO: 311810 - DNA, 20 bp, Artificial
  CRISPR gRNA sequence
gccttgtccttggctctgta

SEQ ID NO: 311811 - DNA, 20 bp, Artificial
  CRISPR gRNA sequence
gtccttggctctgtatcata

SEQ ID NO: 311812 - DNA, 20 bp, Artificial
  CRISPR gRNA sequence
tccttggctctgtatcatat

SEQ ID NO: 311813 - DNA, 20 bp, Artificial
  CRISPR gRNA sequence
ggctctgtatcatattcctg

SEQ ID NO: 311814 - DNA, 20 bp, Artificial
  CRISPR gRNA sequence
gctctgtatcatattcctgt

SEQ ID NO: 311815 - DNA, 20 bp, Artificial
  CRISPR gRNA sequence
tgtatcatattcctgtattt

SEQ ID NO: 311816 - DNA, 20 bp, Artificial
  CRISPR gRNA sequence
tatcatattcctgtatttgg

SEQ ID NO: 311817 - DNA, 20 bp, Artificial
  CRISPR gRNA sequence
ctgtatttggtttgcttttc

SEQ ID NO: 311818 - DNA, 20 bp, Artificial
  CRISPR gRNA sequence
tatttggtttgcttttccac

SEQ ID NO: 311819 - DNA, 20 bp, Artificial
  CRISPR gRNA sequence
ggtttgcttttccacctgtt

SEQ ID NO: 311820 - DNA, 20 bp, Artificial
  CRISPR gRNA sequence
gtttgcttttccacctgttt

SEQ ID NO: 311821 - DNA, 20 bp, Artificial
  CRISPR gRNA sequence
gcttttccacctgtttctca

SEQ ID NO: 311822 - DNA, 20 bp, Artificial
  CRISPR gRNA sequence
cttttccacctgtttctcat

SEQ ID NO: 311823 - DNA, 20 bp, Artificial
  CRISPR gRNA sequence
ttccacctgtttctcatgtt

SEQ ID NO: 311824 - DNA, 20 bp, Artificial
  CRISPR gRNA sequence
tccacctgtttctcatgttg

SEQ ID NO: 311825 - DNA, 20 bp, Artificial
  CRISPR gRNA sequence
ccacctgtttctcatgttgg

SEQ ID NO: 311826 - DNA, 20 bp, Artificial
  CRISPR gRNA sequence
cacctgtttctcatgttggt

SEQ ID NO: 311827 - DNA, 20 bp, Artificial
  CRISPR gRNA sequence
tttctcatgttggtcatctt

SEQ ID NO: 311828 - DNA, 20 bp, Artificial
  CRISPR gRNA sequence
ctcatgttggtcatctttcc

SEQ ID NO: 311829 - DNA, 20 bp, Artificial
  CRISPR gRNA sequence
tcatgttggtcatctttcct

SEQ ID NO: 311830 - DNA, 20 bp, Artificial
  CRISPR gRNA sequence
atgttggtcatctttcctgt

SEQ ID NO: 311831 - DNA, 20 bp, Artificial
  CRISPR gRNA sequence
gtcatctttcctgtgtatgg

SEQ ID NO: 311832 - DNA, 20 bp, Artificial
  CRISPR gRNA sequence
tcctgtgtatggccatacca

SEQ ID NO: 311833 - DNA, 20 bp, Artificial
  CRISPR gRNA sequence
cctgtgtatggccataccat

SEQ ID NO: 311834 - DNA, 20 bp, Artificial
  CRISPR gRNA sequence
ctgtgtatggccataccatc

SEQ ID NO: 311835 - DNA, 20 bp, Artificial
  CRISPR gRNA sequence
tgtatggccataccatcctg

SEQ ID NO: 311836 - DNA, 20 bp, Artificial
  CRISPR gRNA sequence
aatgtgcctgatcgcatcta

SEQ ID NO: 311837 - DNA, 20 bp, Artificial
  CRISPR gRNA sequence
atcgcatctaatgttggtca

SEQ ID NO: 311838 - DNA, 20 bp, Artificial
  CRISPR gRNA sequence
atgttggtcacctctcctta

SEQ ID NO: 311839 - DNA, 20 bp, Artificial
  CRISPR gRNA sequence
gtcacctctccttattcttt

SEQ ID NO: 311840 - DNA, 20 bp, Artificial
  CRISPR gRNA sequence
tccttattctttgcttcctt

SEQ ID NO: 311841 - DNA, 20 bp, Artificial
  CRISPR gRNA sequence
cttattctttgcttccttat

SEQ ID NO: 311842 - DNA, 20 bp, Artificial
  CRISPR gRNA sequence
attctttgcttccttataag

SEQ ID NO: 311843 - DNA, 20 bp, Artificial
  CRISPR gRNA sequence
ttctttgcttccttataagc

SEQ ID NO: 311844 - DNA, 20 bp, Artificial
  CRISPR gRNA sequence
tttgcttccttataagccac

SEQ ID NO: 311845 - DNA, 20 bp, Artificial
  CRISPR gRNA sequence
tgcttccttataagccacta

SEQ ID NO: 311846 - DNA, 20 bp, Artificial
  CRISPR gRNA sequence
gcttccttataagccactaa

SEQ ID NO: 311847 - DNA, 20 bp, Artificial
  CRISPR gRNA sequence
cttccttataagccactaag

SEQ ID NO: 311848 - DNA, 20 bp, Artificial
  CRISPR gRNA sequence
ccttataagccactaagcag

SEQ ID NO: 311849 - DNA, 20 bp, Artificial
  CRISPR gRNA sequence
cttataagccactaagcagc

SEQ ID NO: 311850 - DNA, 20 bp, Artificial
  CRISPR gRNA sequence
ataagccactaagcagcctt

SEQ ID NO: 311851 - DNA, 20 bp, Artificial
  CRISPR gRNA sequence
taagccactaagcagccttt

SEQ ID NO: 311852 - DNA, 20 bp, Artificial
  CRISPR gRNA sequence
agcagcctttttggtgctag

SEQ ID NO: 311853 - DNA, 20 bp, Artificial
  CRISPR gRNA sequence
tttggtgctagttagggtaa

SEQ ID NO: 311854 - DNA, 20 bp, Artificial
  CRISPR gRNA sequence
ttggtgctagttagggtaag

SEQ ID NO: 311855 - DNA, 20 bp, Artificial
  CRISPR gRNA sequence
tggtgctagttagggtaagt

SEQ ID NO: 311856 - DNA, 20 bp, Artificial
  CRISPR gRNA sequence
ggtgctagttagggtaagtg

SEQ ID NO: 311857 - DNA, 20 bp, Artificial
  CRISPR gRNA sequence
gtgctagttagggtaagtgc

SEQ ID NO: 311858 - DNA, 20 bp, Artificial
  CRISPR gRNA sequence
gttagggtaagtgcgtgggt

SEQ ID NO: 311859 - DNA, 20 bp, Artificial
  CRISPR gRNA sequence
gggtaagtgcgtgggtagtg

SEQ ID NO: 311860 - DNA, 20 bp, Artificial
  CRISPR gRNA sequence
taaagcaaagcatatccttt

SEQ ID NO: 311861 - DNA, 20 bp, Artificial
  CRISPR gRNA sequence
tttcttggcttcatcatgta

SEQ ID NO: 311862 - DNA, 20 bp, Artificial
  CRISPR gRNA sequence
ttcttggcttcatcatgtag

SEQ ID NO: 311863 - DNA, 20 bp, Artificial
  CRISPR gRNA sequence
tcttggcttcatcatgtaga

SEQ ID NO: 311864 - DNA, 20 bp, Artificial
  CRISPR gRNA sequence
cttggcttcatcatgtagat

SEQ ID NO: 311865 - DNA, 20 bp, Artificial
  CRISPR gRNA sequence
ttggcttcatcatgtagatt

SEQ ID NO: 311866 - DNA, 20 bp, Artificial
  CRISPR gRNA sequence
ggcttcatcatgtagattaa

SEQ ID NO: 311867 - DNA, 20 bp, Artificial
  CRISPR gRNA sequence
gcttcatcatgtagattaag

SEQ ID NO: 311868 - DNA, 20 bp, Artificial
  CRISPR gRNA sequence
catcatgtagattaagtgaa

SEQ ID NO: 311869 - DNA, 20 bp, Artificial
  CRISPR gRNA sequence
atcatgtagattaagtgaat

SEQ ID NO: 311870 - DNA, 20 bp, Artificial
  CRISPR gRNA sequence
agtgaattgctctcaaagcg

SEQ ID NO: 311871 - DNA, 20 bp, Artificial
  CRISPR gRNA sequence
ctctcaaagcgtggtcctta

SEQ ID NO: 311872 - DNA, 20 bp, Artificial
  CRISPR gRNA sequence
tcaaagcgtggtccttaggc

SEQ ID NO: 311873 - DNA, 20 bp, Artificial
  CRISPR gRNA sequence
aaagcgtggtccttaggccg

SEQ ID NO: 311874 - DNA, 20 bp, Artificial
  CRISPR gRNA sequence
aggccggcagcattgtcatc

SEQ ID NO: 311875 - DNA, 20 bp, Artificial
  CRISPR gRNA sequence
ggccggcagcattgtcatca

SEQ ID NO: 311876 - DNA, 20 bp, Artificial
  CRISPR gRNA sequence
tcatcaccttatgttgttaa

SEQ ID NO: 311877 - DNA, 20 bp, Artificial
  CRISPR gRNA sequence
atgttgttaaacataaaaat

SEQ ID NO: 311878 - DNA, 20 bp, Artificial
  CRISPR gRNA sequence
tgttgttaaacataaaaatt

SEQ ID NO: 311879 - DNA, 20 bp, Artificial
  CRISPR gRNA sequence
ttaaacataaaaattcatgg

SEQ ID NO: 311880 - DNA, 20 bp, Artificial
  CRISPR gRNA sequence
aacataaaaattcatgggtt

SEQ ID NO: 311881 - DNA, 20 bp, Artificial
  CRISPR gRNA sequence
atgggtttcatcccaactta

SEQ ID NO: 311882 - DNA, 20 bp, Artificial
  CRISPR gRNA sequence
catcccaacttactaagcca

SEQ ID NO: 311883 - DNA, 20 bp, Artificial
  CRISPR gRNA sequence
atcccaacttactaagccag

SEQ ID NO: 311884 - DNA, 20 bp, Artificial
  CRISPR gRNA sequence
actaagccagactttctgtg

SEQ ID NO: 311885 - DNA, 20 bp, Artificial
  CRISPR gRNA sequence
ctaagccagactttctgtgg

SEQ ID NO: 311886 - DNA, 20 bp, Artificial
  CRISPR gRNA sequence
agccagactttctgtggttg

SEQ ID NO: 311887 - DNA, 20 bp, Artificial
  CRISPR gRNA sequence
tctgtggttgaggcccagga

SEQ ID NO: 311888 - DNA, 20 bp, Artificial
  CRISPR gRNA sequence
ctgtggttgaggcccaggaa

SEQ ID NO: 311889 - DNA, 20 bp, Artificial
  CRISPR gRNA sequence
tgtggttgaggcccaggaaa

SEQ ID NO: 311890 - DNA, 20 bp, Artificial
  CRISPR gRNA sequence
tggttgaggcccaggaaact

SEQ ID NO: 311891 - DNA, 20 bp, Artificial
  CRISPR gRNA sequence
aggcccaggaaactctccag

SEQ ID NO: 311892 - DNA, 20 bp, Artificial
  CRISPR gRNA sequence
tccaggtgatttttactcac

SEQ ID NO: 311893 - DNA, 20 bp, Artificial
  CRISPR gRNA sequence
caggtgatttttactcacat

SEQ ID NO: 311894 - DNA, 20 bp, Artificial
  CRISPR gRNA sequence
ttactcacattcaagtttga

SEQ ID NO: 311895 - DNA, 20 bp, Artificial
  CRISPR gRNA sequence
tactcacattcaagtttgag

SEQ ID NO: 311896 - DNA, 20 bp, Artificial
  CRISPR gRNA sequence
actcacattcaagtttgaga

SEQ ID NO: 311897 - DNA, 20 bp, Artificial
  CRISPR gRNA sequence
ctcacattcaagtttgagaa

SEQ ID NO: 311898 - DNA, 20 bp, Artificial
  CRISPR gRNA sequence
acattcaagtttgagaacca

SEQ ID NO: 311899 - DNA, 20 bp, Artificial
  CRISPR gRNA sequence
aagtttgagaaccacaggaa

SEQ ID NO: 311900 - DNA, 20 bp, Artificial
  CRISPR gRNA sequence
gagaaccacaggaaaacaaa

SEQ ID NO: 311901 - DNA, 20 bp, Artificial
  CRISPR gRNA sequence
agaaccacaggaaaacaaaa

SEQ ID NO: 311902 - DNA, 20 bp, Artificial
  CRISPR gRNA sequence
ctaagcgtaaatgcaatact

SEQ ID NO: 311903 - DNA, 20 bp, Artificial
  CRISPR gRNA sequence
taagcgtaaatgcaatacta

SEQ ID NO: 311904 - DNA, 20 bp, Artificial
  CRISPR gRNA sequence
agcgtaaatgcaatactaac

SEQ ID NO: 311905 - DNA, 20 bp, Artificial
  CRISPR gRNA sequence
accgattgcccccatcatgc

SEQ ID NO: 311906 - DNA, 20 bp, Artificial
  CRISPR gRNA sequence
cccccatcatgcctgttatg

SEQ ID NO: 311907 - DNA, 20 bp, Artificial
  CRISPR gRNA sequence
ttatgttggtcaagataaat

SEQ ID NO: 311908 - DNA, 20 bp, Artificial
  CRISPR gRNA sequence
tgttggtcaagataaataat

SEQ ID NO: 311909 - DNA, 20 bp, Artificial
  CRISPR gRNA sequence
gtcaagataaataatactag

SEQ ID NO: 311910 - DNA, 20 bp, Artificial
  CRISPR gRNA sequence
gctactgcaataatcaatcc

SEQ ID NO: 311911 - DNA, 20 bp, Artificial
  CRISPR gRNA sequence
ctgcaataatcaatccctca

SEQ ID NO: 311912 - DNA, 20 bp, Artificial
  CRISPR gRNA sequence
caataatcaatccctcaaat

SEQ ID NO: 311913 - DNA, 20 bp, Artificial
  CRISPR gRNA sequence
aaattttattttttgccaat

SEQ ID NO: 311914 - DNA, 20 bp, Artificial
  CRISPR gRNA sequence
tattttttgccaatatcaca

SEQ ID NO: 311915 - DNA, 20 bp, Artificial
  CRISPR gRNA sequence
attttttgccaatatcacaa

SEQ ID NO: 311916 - DNA, 20 bp, Artificial
  CRISPR gRNA sequence
ttttttgccaatatcacaat

SEQ ID NO: 311917 - DNA, 20 bp, Artificial
  CRISPR gRNA sequence
tttgccaatatcacaatcca

SEQ ID NO: 311918 - DNA, 20 bp, Artificial
  CRISPR gRNA sequence
ttgccaatatcacaatccat

SEQ ID NO: 311919 - DNA, 20 bp, Artificial
  CRISPR gRNA sequence
tgccaatatcacaatccatt

SEQ ID NO: 311920 - DNA, 20 bp, Artificial
  CRISPR gRNA sequence
gccaatatcacaatccattg

SEQ ID NO: 311921 - DNA, 20 bp, Artificial
  CRISPR gRNA sequence
ccaatatcacaatccattgt

SEQ ID NO: 311922 - DNA, 20 bp, Artificial
  CRISPR gRNA sequence
tagatcagttgtgggagagg

SEQ ID NO: 311923 - DNA, 20 bp, Artificial
  CRISPR gRNA sequence
tgggagaggtgtaaagagag

SEQ ID NO: 311924 - DNA, 20 bp, Artificial
  CRISPR gRNA sequence
ctttattagtttattaagca

SEQ ID NO: 311925 - DNA, 20 bp, Artificial
  CRISPR gRNA sequence
tattagtttattaagcaaac

SEQ ID NO: 311926 - DNA, 20 bp, Artificial
  CRISPR gRNA sequence
attagtttattaagcaaacc

SEQ ID NO: 311927 - DNA, 20 bp, Artificial
  CRISPR gRNA sequence
ttagtttattaagcaaacca

SEQ ID NO: 311928 - DNA, 20 bp, Artificial
  CRISPR gRNA sequence
gtttattaagcaaaccagat

SEQ ID NO: 311929 - DNA, 20 bp, Artificial
  CRISPR gRNA sequence
attaagcaaaccagatctct

SEQ ID NO: 311930 - DNA, 20 bp, Artificial
  CRISPR gRNA sequence
ttaagcaaaccagatctctt

SEQ ID NO: 311931 - DNA, 20 bp, Artificial
  CRISPR gRNA sequence
agcaaaccagatctcttcca

SEQ ID NO: 311932 - DNA, 20 bp, Artificial
  CRISPR gRNA sequence
ttccattgtgagactttgcg

SEQ ID NO: 311933 - DNA, 20 bp, Artificial
  CRISPR gRNA sequence
ccattgtgagactttgcgat

SEQ ID NO: 311934 - DNA, 20 bp, Artificial
  CRISPR gRNA sequence
cattgtgagactttgcgatt

SEQ ID NO: 311935 - DNA, 20 bp, Artificial
  CRISPR gRNA sequence
tgagactttgcgattttcta

SEQ ID NO: 311936 - DNA, 20 bp, Artificial
  CRISPR gRNA sequence
tgcgattttctaggcccttg

SEQ ID NO: 311937 - DNA, 20 bp, Artificial
  CRISPR gRNA sequence
gcgattttctaggcccttgg

SEQ ID NO: 311938 - DNA, 20 bp, Artificial
  CRISPR gRNA sequence
cgattttctaggcccttgga

SEQ ID NO: 311939 - DNA, 20 bp, Artificial
  CRISPR gRNA sequence
tctaggcccttggacatttc

SEQ ID NO: 311940 - DNA, 20 bp, Artificial
  CRISPR gRNA sequence
ctaggcccttggacatttcc

SEQ ID NO: 311941 - DNA, 20 bp, Artificial
  CRISPR gRNA sequence
taggcccttggacatttcct

SEQ ID NO: 311942 - DNA, 20 bp, Artificial
  CRISPR gRNA sequence
ggcccttggacatttcctct

SEQ ID NO: 311943 - DNA, 20 bp, Artificial
  CRISPR gRNA sequence
ggacatttcctctggatccc

SEQ ID NO: 311944 - DNA, 20 bp, Artificial
  CRISPR gRNA sequence
gacatttcctctggatcccc

SEQ ID NO: 311945 - DNA, 20 bp, Artificial
  CRISPR gRNA sequence
cctctggatcccctgctgct

SEQ ID NO: 311946 - DNA, 20 bp, Artificial
  CRISPR gRNA sequence
ctctggatcccctgctgcta

SEQ ID NO: 311947 - DNA, 20 bp, Artificial
  CRISPR gRNA sequence
tggatcccctgctgctaaga

SEQ ID NO: 311948 - DNA, 20 bp, Artificial
  CRISPR gRNA sequence
gatcccctgctgctaagaag

SEQ ID NO: 311949 - DNA, 20 bp, Artificial
  CRISPR gRNA sequence
ctgctaagaaggcaggagag

SEQ ID NO: 311950 - DNA, 20 bp, Artificial
  CRISPR gRNA sequence
ctaagaaggcaggagaggga

SEQ ID NO: 311951 - DNA, 20 bp, Artificial
  CRISPR gRNA sequence
agaaggcaggagagggagga

SEQ ID NO: 311952 - DNA, 20 bp, Artificial
  CRISPR gRNA sequence
tagcagccagatctggaaga

SEQ ID NO: 311953 - DNA, 20 bp, Artificial
  CRISPR gRNA sequence
agcagccagatctggaagaa

SEQ ID NO: 311954 - DNA, 20 bp, Artificial
  CRISPR gRNA sequence
gcagccagatctggaagaaa

SEQ ID NO: 311955 - DNA, 20 bp, Artificial
  CRISPR gRNA sequence
gaagaaacatcttttctgcc

SEQ ID NO: 311956 - DNA, 20 bp, Artificial
  CRISPR gRNA sequence
ttctgcccacaattccattg

SEQ ID NO: 311957 - DNA, 20 bp, Artificial
  CRISPR gRNA sequence
tctgcccacaattccattgg

SEQ ID NO: 311958 - DNA, 20 bp, Artificial
  CRISPR gRNA sequence
ctgcccacaattccattggc

SEQ ID NO: 311959 - DNA, 20 bp, Artificial
  CRISPR gRNA sequence
tgcccacaattccattggct

SEQ ID NO: 311960 - DNA, 20 bp, Artificial
  CRISPR gRNA sequence
cccacaattccattggctag

SEQ ID NO: 311961 - DNA, 20 bp, Artificial
  CRISPR gRNA sequence
cattggctagaagccagtct

SEQ ID NO: 311962 - DNA, 20 bp, Artificial
  CRISPR gRNA sequence
gctagaagccagtctcatgg

SEQ ID NO: 311963 - DNA, 20 bp, Artificial
  CRISPR gRNA sequence
gaagccagtctcatggcctg

SEQ ID NO: 311964 - DNA, 20 bp, Artificial
  CRISPR gRNA sequence
atggcctgtataactgcagg

SEQ ID NO: 311965 - DNA, 20 bp, Artificial
  CRISPR gRNA sequence
tataactgcaggggaggctg

SEQ ID NO: 311966 - DNA, 20 bp, Artificial
  CRISPR gRNA sequence
caggggaggctgggaaatgt

SEQ ID NO: 311967 - DNA, 20 bp, Artificial
  CRISPR gRNA sequence
ggaaatgtgacctatcgatg

SEQ ID NO: 311968 - DNA, 20 bp, Artificial
  CRISPR gRNA sequence
tcgatggagctaagagcaaa

SEQ ID NO: 311969 - DNA, 20 bp, Artificial
  CRISPR gRNA sequence
agagcaaaaggaaatggctt

SEQ ID NO: 311970 - DNA, 20 bp, Artificial
  CRISPR gRNA sequence
tgatgaagccctggcattgt

SEQ ID NO: 311971 - DNA, 20 bp, Artificial
  CRISPR gRNA sequence
gatgaagccctggcattgtc

SEQ ID NO: 311972 - DNA, 20 bp, Artificial
  CRISPR gRNA sequence
atgaagccctggcattgtct

SEQ ID NO: 311973 - DNA, 20 bp, Artificial
  CRISPR gRNA sequence
gcattgtctctgcacacccg

SEQ ID NO: 311974 - DNA, 20 bp, Artificial
  CRISPR gRNA sequence
tctctgcacacccgagaacc

SEQ ID NO: 311975 - DNA, 20 bp, Artificial
  CRISPR gRNA sequence
tgcacacccgagaacccaag

SEQ ID NO: 311976 - DNA, 20 bp, Artificial
  CRISPR gRNA sequence
cacacccgagaacccaagtg

SEQ ID NO: 311977 - DNA, 20 bp, Artificial
  CRISPR gRNA sequence
cacgtccaggtcatgttttg

SEQ ID NO: 311978 - DNA, 20 bp, Artificial
  CRISPR gRNA sequence
tggtgaacatcggttttcag

SEQ ID NO: 311979 - DNA, 20 bp, Artificial
  CRISPR gRNA sequence
ggtgaacatcggttttcagt

SEQ ID NO: 311980 - DNA, 20 bp, Artificial
  CRISPR gRNA sequence
gtgaacatcggttttcagtt

SEQ ID NO: 311981 - DNA, 20 bp, Artificial
  CRISPR gRNA sequence
tcagtttccttttctaatca

SEQ ID NO: 311982 - DNA, 20 bp, Artificial
  CRISPR gRNA sequence
cagtttccttttctaatcaa

SEQ ID NO: 311983 - DNA, 20 bp, Artificial
  CRISPR gRNA sequence
agtttccttttctaatcaag

SEQ ID NO: 311984 - DNA, 20 bp, Artificial
  CRISPR gRNA sequence
ccttttctaatcaagtttta

SEQ ID NO: 311985 - DNA, 20 bp, Artificial
  CRISPR gRNA sequence
cttttctaatcaagttttac

SEQ ID NO: 311986 - DNA, 20 bp, Artificial
  CRISPR gRNA sequence
ttctaatcaagttttacctt

SEQ ID NO: 311987 - DNA, 20 bp, Artificial
  CRISPR gRNA sequence
tctaatcaagttttaccttt

SEQ ID NO: 311988 - DNA, 20 bp, Artificial
  CRISPR gRNA sequence
ctaatcaagttttacctttt

SEQ ID NO: 311989 - DNA, 20 bp, Artificial
  CRISPR gRNA sequence
taatcaagttttaccttttt

SEQ ID NO: 311990 - DNA, 20 bp, Artificial
  CRISPR gRNA sequence
atcaagttttaccttttttt

SEQ ID NO: 311991 - DNA, 20 bp, Artificial
  CRISPR gRNA sequence
tacctttttttttctcgact

SEQ ID NO: 311992 - DNA, 20 bp, Artificial
  CRISPR gRNA sequence
acctttttttttctcgactc

SEQ ID NO: 311993 - DNA, 20 bp, Artificial
  CRISPR gRNA sequence
cctttttttttctcgactct

SEQ ID NO: 311994 - DNA, 20 bp, Artificial
  CRISPR gRNA sequence
tttttttctcgactctagca

SEQ ID NO: 311995 - DNA, 20 bp, Artificial
  CRISPR gRNA sequence
ttttttctcgactctagcac

SEQ ID NO: 311996 - DNA, 20 bp, Artificial
  CRISPR gRNA sequence
tttttctcgactctagcact

SEQ ID NO: 311997 - DNA, 20 bp, Artificial
  CRISPR gRNA sequence
ttttctcgactctagcacta

SEQ ID NO: 311998 - DNA, 20 bp, Artificial
  CRISPR gRNA sequence
tttctcgactctagcactat

SEQ ID NO: 311999 - DNA, 20 bp, Artificial
  CRISPR gRNA sequence
ttctcgactctagcactatg

SEQ ID NO: 312000 - DNA, 20 bp, Artificial
  CRISPR gRNA sequence
tctcgactctagcactatgg

SEQ ID NO: 312001 - DNA, 20 bp, Artificial
  CRISPR gRNA sequence
ctcgactctagcactatggg

SEQ ID NO: 312002 - DNA, 20 bp, Artificial
  CRISPR gRNA sequence
tcgactctagcactatggga

SEQ ID NO: 312003 - DNA, 20 bp, Artificial
  CRISPR gRNA sequence
gactctagcactatgggact

SEQ ID NO: 312004 - DNA, 20 bp, Artificial
  CRISPR gRNA sequence
tagcactatgggactgagta

SEQ ID NO: 312005 - DNA, 20 bp, Artificial
  CRISPR gRNA sequence
gcactatgggactgagtaac

SEQ ID NO: 312006 - DNA, 20 bp, Artificial
  CRISPR gRNA sequence
tgggactgagtaacattctc

SEQ ID NO: 312007 - DNA, 20 bp, Artificial
  CRISPR gRNA sequence
agtaacattctctttgtgat

SEQ ID NO: 312008 - DNA, 20 bp, Artificial
  CRISPR gRNA sequence
tctttgtgatggccttcctg

SEQ ID NO: 312009 - DNA, 20 bp, Artificial
  CRISPR gRNA sequence
tttgtgatggccttcctgct

SEQ ID NO: 312010 - DNA, 20 bp, Artificial
  CRISPR gRNA sequence
tgtgatggccttcctgctct

SEQ ID NO: 312011 - DNA, 20 bp, Artificial
  CRISPR gRNA sequence
gtgatggccttcctgctctc

SEQ ID NO: 312012 - DNA, 20 bp, Artificial
  CRISPR gRNA sequence
tgatggccttcctgctctct

SEQ ID NO: 312013 - DNA, 20 bp, Artificial
  CRISPR gRNA sequence
cctgctctctggtaagaacc

SEQ ID NO: 312014 - DNA, 20 bp, Artificial
  CRISPR gRNA sequence
ctgctctctggtaagaacct

SEQ ID NO: 312015 - DNA, 20 bp, Artificial
  CRISPR gRNA sequence
ctctctggtaagaacctttc

SEQ ID NO: 312016 - DNA, 20 bp, Artificial
  CRISPR gRNA sequence
tctggtaagaacctttcagc

SEQ ID NO: 312017 - DNA, 20 bp, Artificial
  CRISPR gRNA sequence
tggtaagaacctttcagctt

SEQ ID NO: 312018 - DNA, 20 bp, Artificial
  CRISPR gRNA sequence
gtaagaacctttcagctttg

SEQ ID NO: 312019 - DNA, 20 bp, Artificial
  CRISPR gRNA sequence
tcagctttgttaagtcctgg

SEQ ID NO: 312020 - DNA, 20 bp, Artificial
  CRISPR gRNA sequence
cagctttgttaagtcctgga

SEQ ID NO: 312021 - DNA, 20 bp, Artificial
  CRISPR gRNA sequence
agctttgttaagtcctggaa

SEQ ID NO: 312022 - DNA, 20 bp, Artificial
  CRISPR gRNA sequence
tgttaagtcctggaatccta

SEQ ID NO: 312023 - DNA, 20 bp, Artificial
  CRISPR gRNA sequence
gttaagtcctggaatcctac

SEQ ID NO: 312024 - DNA, 20 bp, Artificial
  CRISPR gRNA sequence
ttaagtcctggaatcctact

SEQ ID NO: 312025 - DNA, 20 bp, Artificial
  CRISPR gRNA sequence
agtcctggaatcctactgtc

SEQ ID NO: 312026 - DNA, 20 bp, Artificial
  CRISPR gRNA sequence
gaatcctactgtctcctgat

SEQ ID NO: 312027 - DNA, 20 bp, Artificial
  CRISPR gRNA sequence
ctgtctcctgatgagtctga

SEQ ID NO: 312028 - DNA, 20 bp, Artificial
  CRISPR gRNA sequence
tctcctgatgagtctgacca

SEQ ID NO: 312029 - DNA, 20 bp, Artificial
  CRISPR gRNA sequence
ctgatgagtctgaccacagc

SEQ ID NO: 312030 - DNA, 20 bp, Artificial
  CRISPR gRNA sequence
atgagtctgaccacagcaag

SEQ ID NO: 312031 - DNA, 20 bp, Artificial
  CRISPR gRNA sequence
accacagcaagcccaggcct

SEQ ID NO: 312032 - DNA, 20 bp, Artificial
  CRISPR gRNA sequence
agacttggtgggttttactc

SEQ ID NO: 312033 - DNA, 20 bp, Artificial
  CRISPR gRNA sequence
ggtgggttttactcactttc

SEQ ID NO: 312034 - DNA, 20 bp, Artificial
  CRISPR gRNA sequence
gtgggttttactcactttct

SEQ ID NO: 312035 - DNA, 20 bp, Artificial
  CRISPR gRNA sequence
tactcactttctactgagca

SEQ ID NO: 312036 - DNA, 20 bp, Artificial
  CRISPR gRNA sequence
actcactttctactgagcat

SEQ ID NO: 312037 - DNA, 20 bp, Artificial
  CRISPR gRNA sequence
ctcactttctactgagcatt

SEQ ID NO: 312038 - DNA, 20 bp, Artificial
  CRISPR gRNA sequence
actttctactgagcattgta

SEQ ID NO: 312039 - DNA, 20 bp, Artificial
  CRISPR gRNA sequence
tctactgagcattgtacaag

SEQ ID NO: 312040 - DNA, 20 bp, Artificial
  CRISPR gRNA sequence
ctactgagcattgtacaaga

SEQ ID NO: 312041 - DNA, 20 bp, Artificial
  CRISPR gRNA sequence
tactgagcattgtacaagac

SEQ ID NO: 312042 - DNA, 20 bp, Artificial
  CRISPR gRNA sequence
ctgagcattgtacaagacca

SEQ ID NO: 312043 - DNA, 20 bp, Artificial
  CRISPR gRNA sequence
agcattgtacaagaccacat

SEQ ID NO: 312044 - DNA, 20 bp, Artificial
  CRISPR gRNA sequence
tacaagaccacatgcaaaaa

SEQ ID NO: 312045 - DNA, 20 bp, Artificial
  CRISPR gRNA sequence
tcctggagaagaaggaagtg

SEQ ID NO: 312046 - DNA, 20 bp, Artificial
  CRISPR gRNA sequence
cctggagaagaaggaagtgt

SEQ ID NO: 312047 - DNA, 20 bp, Artificial
  CRISPR gRNA sequence
ctggagaagaaggaagtgtt

SEQ ID NO: 312048 - DNA, 20 bp, Artificial
  CRISPR gRNA sequence
gagaagaaggaagtgttatg

SEQ ID NO: 312049 - DNA, 20 bp, Artificial
  CRISPR gRNA sequence
tgattgagagcagctgatgg

SEQ ID NO: 312050 - DNA, 20 bp, Artificial
  CRISPR gRNA sequence
agagcagctgatggcaggca

SEQ ID NO: 312051 - DNA, 20 bp, Artificial
  CRISPR gRNA sequence
atggcaggcagctgggatgg

SEQ ID NO: 312052 - DNA, 20 bp, Artificial
  CRISPR gRNA sequence
ggatggagctctcccccccg

SEQ ID NO: 312053 - DNA, 20 bp, Artificial
  CRISPR gRNA sequence
tcccccccgtgtgcttcttc

SEQ ID NO: 312054 - DNA, 20 bp, Artificial
  CRISPR gRNA sequence
ccccccgtgtgcttcttcct

SEQ ID NO: 312055 - DNA, 20 bp, Artificial
  CRISPR gRNA sequence
cttcctcctctgcagtctca

SEQ ID NO: 312056 - DNA, 20 bp, Artificial
  CRISPR gRNA sequence
ttcctcctctgcagtctcac

SEQ ID NO: 312057 - DNA, 20 bp, Artificial
  CRISPR gRNA sequence
cctcctctgcagtctcacat

SEQ ID NO: 312058 - DNA, 20 bp, Artificial
  CRISPR gRNA sequence
ctcctctgcagtctcacatc

SEQ ID NO: 312059 - DNA, 20 bp, Artificial
  CRISPR gRNA sequence
ctctgcagtctcacatcagt

SEQ ID NO: 312060 - DNA, 20 bp, Artificial
  CRISPR gRNA sequence
tgcagtctcacatcagtgag

SEQ ID NO: 312061 - DNA, 20 bp, Artificial
  CRISPR gRNA sequence
cagtctcacatcagtgagcc

SEQ ID NO: 312062 - DNA, 20 bp, Artificial
  CRISPR gRNA sequence
acatcagtgagcctagatgc

SEQ ID NO: 312063 - DNA, 20 bp, Artificial
  CRISPR gRNA sequence
gatgctcagagtagggtagc

SEQ ID NO: 312064 - DNA, 20 bp, Artificial
  CRISPR gRNA sequence
agagtagggtagcctggccc

SEQ ID NO: 312065 - DNA, 20 bp, Artificial
  CRISPR gRNA sequence
gcccatcccatggggatggg

SEQ ID NO: 312066 - DNA, 20 bp, Artificial
  CRISPR gRNA sequence
ctgcactgaggcccctgaga

SEQ ID NO: 312067 - DNA, 20 bp, Artificial
  CRISPR gRNA sequence
cactgaggcccctgagactt

SEQ ID NO: 312068 - DNA, 20 bp, Artificial
  CRISPR gRNA sequence
aggcccctgagacttgactc

SEQ ID NO: 312069 - DNA, 20 bp, Artificial
  CRISPR gRNA sequence
agacttgactcttttgttcc

SEQ ID NO: 312070 - DNA, 20 bp, Artificial
  CRISPR gRNA sequence
gactcttttgttccacacat

SEQ ID NO: 312071 - DNA, 20 bp, Artificial
  CRISPR gRNA sequence
actcttttgttccacacata

SEQ ID NO: 312072 - DNA, 20 bp, Artificial
  CRISPR gRNA sequence
ttttgttccacacatattct

SEQ ID NO: 312073 - DNA, 20 bp, Artificial
  CRISPR gRNA sequence
ttgttccacacatattctct

SEQ ID NO: 312074 - DNA, 20 bp, Artificial
  CRISPR gRNA sequence
tgttccacacatattctctt

SEQ ID NO: 312075 - DNA, 20 bp, Artificial
  CRISPR gRNA sequence
gttccacacatattctcttc

SEQ ID NO: 312076 - DNA, 20 bp, Artificial
  CRISPR gRNA sequence
ttccacacatattctcttct

SEQ ID NO: 312077 - DNA, 20 bp, Artificial
  CRISPR gRNA sequence
cacacatattctcttctggt

SEQ ID NO: 312078 - DNA, 20 bp, Artificial
  CRISPR gRNA sequence
tcttctggtcttctctgacc

SEQ ID NO: 312079 - DNA, 20 bp, Artificial
  CRISPR gRNA sequence
ttctggtcttctctgaccct

SEQ ID NO: 312080 - DNA, 20 bp, Artificial
  CRISPR gRNA sequence
ctggtcttctctgaccctgt

SEQ ID NO: 312081 - DNA, 20 bp, Artificial
  CRISPR gRNA sequence
tggtcttctctgaccctgtt

SEQ ID NO: 312082 - DNA, 20 bp, Artificial
  CRISPR gRNA sequence
gtcttctctgaccctgtttc

SEQ ID NO: 312083 - DNA, 20 bp, Artificial
  CRISPR gRNA sequence
ctctgaccctgtttctgtct

SEQ ID NO: 312084 - DNA, 20 bp, Artificial
  CRISPR gRNA sequence
tctgaccctgtttctgtctt

SEQ ID NO: 312085 - DNA, 20 bp, Artificial
  CRISPR gRNA sequence
tgaccctgtttctgtctttc

SEQ ID NO: 312086 - DNA, 20 bp, Artificial
  CRISPR gRNA sequence
accctgtttctgtctttctc

SEQ ID NO: 312087 - DNA, 20 bp, Artificial
  CRISPR gRNA sequence
tttctgtctttctcaggctc

SEQ ID NO: 312088 - DNA, 20 bp, Artificial
  CRISPR gRNA sequence
ctgtctttctcaggctccta

SEQ ID NO: 312089 - DNA, 20 bp, Artificial
  CRISPR gRNA sequence
tgtctttctcaggctcctag

SEQ ID NO: 312090 - DNA, 20 bp, Artificial
  CRISPR gRNA sequence
tctttctcaggctcctagga

SEQ ID NO: 312091 - DNA, 20 bp, Artificial
  CRISPR gRNA sequence
tctcaggctcctaggaaaca

SEQ ID NO: 312092 - DNA, 20 bp, Artificial
  CRISPR gRNA sequence
ctcaggctcctaggaaacaa

SEQ ID NO: 312093 - DNA, 20 bp, Artificial
  CRISPR gRNA sequence
tcaggctcctaggaaacaac

SEQ ID NO: 312094 - DNA, 20 bp, Artificial
  CRISPR gRNA sequence
aggctcctaggaaacaactg

SEQ ID NO: 312095 - DNA, 20 bp, Artificial
  CRISPR gRNA sequence
ctaggaaacaactgacagaa

SEQ ID NO: 312096 - DNA, 20 bp, Artificial
  CRISPR gRNA sequence
ggaaacaactgacagaattc

SEQ ID NO: 312097 - DNA, 20 bp, Artificial
  CRISPR gRNA sequence
acagaattccaaaagtctcc

SEQ ID NO: 312098 - DNA, 20 bp, Artificial
  CRISPR gRNA sequence
caaaagtctcccttcattcg

SEQ ID NO: 312099 - DNA, 20 bp, Artificial
  CRISPR gRNA sequence
ccttcattcggagcactggc

SEQ ID NO: 312100 - DNA, 20 bp, Artificial
  CRISPR gRNA sequence
cattcggagcactggctttc

SEQ ID NO: 312101 - DNA, 20 bp, Artificial
  CRISPR gRNA sequence
attcggagcactggctttca

SEQ ID NO: 312102 - DNA, 20 bp, Artificial
  CRISPR gRNA sequence
ggagcactggctttcacgtc

SEQ ID NO: 312103 - DNA, 20 bp, Artificial
  CRISPR gRNA sequence
gctttcacgtccctgacttc

SEQ ID NO: 312104 - DNA, 20 bp, Artificial
  CRISPR gRNA sequence
tcacgtccctgacttcccta

SEQ ID NO: 312105 - DNA, 20 bp, Artificial
  CRISPR gRNA sequence
cacgtccctgacttccctac

SEQ ID NO: 312106 - DNA, 20 bp, Artificial
  CRISPR gRNA sequence
acgtccctgacttccctacc

SEQ ID NO: 312107 - DNA, 20 bp, Artificial
  CRISPR gRNA sequence
acttccctaccctctctcac

SEQ ID NO: 312108 - DNA, 20 bp, Artificial
  CRISPR gRNA sequence
ccctaccctctctcactccc

SEQ ID NO: 312109 - DNA, 20 bp, Artificial
  CRISPR gRNA sequence
cctaccctctctcactccct

SEQ ID NO: 312110 - DNA, 20 bp, Artificial
  CRISPR gRNA sequence
ccctctctcactcccttccc

SEQ ID NO: 312111 - DNA, 20 bp, Artificial
  CRISPR gRNA sequence
tctcactcccttccctacag

SEQ ID NO: 312112 - DNA, 20 bp, Artificial
  CRISPR gRNA sequence
tcactcccttccctacagcc

SEQ ID NO: 312113 - DNA, 20 bp, Artificial
  CRISPR gRNA sequence
actcccttccctacagccca

SEQ ID NO: 312114 - DNA, 20 bp, Artificial
  CRISPR gRNA sequence
ccttccctacagcccatgca

SEQ ID NO: 312115 - DNA, 20 bp, Artificial
  CRISPR gRNA sequence
ccctacagcccatgcacata

SEQ ID NO: 312116 - DNA, 20 bp, Artificial
  CRISPR gRNA sequence
cctacagcccatgcacatac

SEQ ID NO: 312117 - DNA, 20 bp, Artificial
  CRISPR gRNA sequence
cagcccatgcacatacctca

SEQ ID NO: 312118 - DNA, 20 bp, Artificial
  CRISPR gRNA sequence
atggttgccacggcttcctg

SEQ ID NO: 312119 - DNA, 20 bp, Artificial
  CRISPR gRNA sequence
ccacggcttcctgacaacta

SEQ ID NO: 312120 - DNA, 20 bp, Artificial
  CRISPR gRNA sequence
cctgacaactatggatgttc

SEQ ID NO: 312121 - DNA, 20 bp, Artificial
  CRISPR gRNA sequence
ctgacaactatggatgttca

SEQ ID NO: 312122 - DNA, 20 bp, Artificial
  CRISPR gRNA sequence
acaactatggatgttcagct

SEQ ID NO: 312123 - DNA, 20 bp, Artificial
  CRISPR gRNA sequence
tggatgttcagctaattgtg

SEQ ID NO: 312124 - DNA, 20 bp, Artificial
  CRISPR gRNA sequence
agctaattgtgtcagctgat

SEQ ID NO: 312125 - DNA, 20 bp, Artificial
  CRISPR gRNA sequence
attgtgtcagctgatttata

SEQ ID NO: 312126 - DNA, 20 bp, Artificial
  CRISPR gRNA sequence
tgtcagctgatttatagtgg

SEQ ID NO: 312127 - DNA, 20 bp, Artificial
  CRISPR gRNA sequence
atttatagtggagccaatga

SEQ ID NO: 312128 - DNA, 20 bp, Artificial
  CRISPR gRNA sequence
atagtggagccaatgaagct

SEQ ID NO: 312129 - DNA, 20 bp, Artificial
  CRISPR gRNA sequence
tagtggagccaatgaagctg

SEQ ID NO: 312130 - DNA, 20 bp, Artificial
  CRISPR gRNA sequence
aagcttcagagccctccatt

SEQ ID NO: 312131 - DNA, 20 bp, Artificial
  CRISPR gRNA sequence
cagagccctccatttgcaca

SEQ ID NO: 312132 - DNA, 20 bp, Artificial
  CRISPR gRNA sequence
agagccctccatttgcacaa

SEQ ID NO: 312133 - DNA, 20 bp, Artificial
  CRISPR gRNA sequence
catttgcacaaccctttcta

SEQ ID NO: 312134 - DNA, 20 bp, Artificial
  CRISPR gRNA sequence
gcacaaccctttctaaatcc

SEQ ID NO: 312135 - DNA, 20 bp, Artificial
  CRISPR gRNA sequence
cacaaccctttctaaatccc

SEQ ID NO: 312136 - DNA, 20 bp, Artificial
  CRISPR gRNA sequence
tctaaatccccctcaagacc

SEQ ID NO: 312137 - DNA, 20 bp, Artificial
  CRISPR gRNA sequence
ctaaatccccctcaagaccc

SEQ ID NO: 312138 - DNA, 20 bp, Artificial
  CRISPR gRNA sequence
taaatccccctcaagaccct

SEQ ID NO: 312139 - DNA, 20 bp, Artificial
  CRISPR gRNA sequence
aatccccctcaagaccctgt

SEQ ID NO: 312140 - DNA, 20 bp, Artificial
  CRISPR gRNA sequence
aagaccctgtgaagggcccc

SEQ ID NO: 312141 - DNA, 20 bp, Artificial
  CRISPR gRNA sequence
tgaagggccccctagcagtg

SEQ ID NO: 312142 - DNA, 20 bp, Artificial
  CRISPR gRNA sequence
gcagtgtggtcacctgtctt

SEQ ID NO: 312143 - DNA, 20 bp, Artificial
  CRISPR gRNA sequence
tcttatgctttggtaaaatt

SEQ ID NO: 312144 - DNA, 20 bp, Artificial
  CRISPR gRNA sequence
atgctttggtaaaatttgaa

SEQ ID NO: 312145 - DNA, 20 bp, Artificial
  CRISPR gRNA sequence
tgctttggtaaaatttgaat

SEQ ID NO: 312146 - DNA, 20 bp, Artificial
  CRISPR gRNA sequence
tggtaaaatttgaataagta

SEQ ID NO: 312147 - DNA, 20 bp, Artificial
  CRISPR gRNA sequence
ggtaaaatttgaataagtaa

SEQ ID NO: 312148 - DNA, 20 bp, Artificial
  CRISPR gRNA sequence
gtaaaatttgaataagtaag

SEQ ID NO: 312149 - DNA, 20 bp, Artificial
  CRISPR gRNA sequence
gaataagtaagatattgtaa

SEQ ID NO: 312150 - DNA, 20 bp, Artificial
  CRISPR gRNA sequence
aataagtaagatattgtaac

SEQ ID NO: 312151 - DNA, 20 bp, Artificial
  CRISPR gRNA sequence
taaccacaataagttatgac

SEQ ID NO: 312152 - DNA, 20 bp, Artificial
  CRISPR gRNA sequence
tgaccactgtctccttcctc

SEQ ID NO: 312153 - DNA, 20 bp, Artificial
  CRISPR gRNA sequence
tctccttcctctgcaacttt

SEQ ID NO: 312154 - DNA, 20 bp, Artificial
  CRISPR gRNA sequence
cttcctctgcaacttttccc

SEQ ID NO: 312155 - DNA, 20 bp, Artificial
  CRISPR gRNA sequence
cctctgcaacttttccctcc

SEQ ID NO: 312156 - DNA, 20 bp, Artificial
  CRISPR gRNA sequence
ctctgcaacttttccctcca

SEQ ID NO: 312157 - DNA, 20 bp, Artificial
  CRISPR gRNA sequence
tgcaacttttccctccatgc

SEQ ID NO: 312158 - DNA, 20 bp, Artificial
  CRISPR gRNA sequence
caacttttccctccatgcca

SEQ ID NO: 312159 - DNA, 20 bp, Artificial
  CRISPR gRNA sequence
ttccctccatgccattctcc

SEQ ID NO: 312160 - DNA, 20 bp, Artificial
  CRISPR gRNA sequence
tccctccatgccattctcct

SEQ ID NO: 312161 - DNA, 20 bp, Artificial
  CRISPR gRNA sequence
ccctccatgccattctcctg

SEQ ID NO: 312162 - DNA, 20 bp, Artificial
  CRISPR gRNA sequence
cctccatgccattctcctgt

SEQ ID NO: 312163 - DNA, 20 bp, Artificial
  CRISPR gRNA sequence
catgccattctcctgtctgg

SEQ ID NO: 312164 - DNA, 20 bp, Artificial
  CRISPR gRNA sequence
tcctgtctggtggtgttagc

SEQ ID NO: 312165 - DNA, 20 bp, Artificial
  CRISPR gRNA sequence
ctgtctggtggtgttagcag

SEQ ID NO: 312166 - DNA, 20 bp, Artificial
  CRISPR gRNA sequence
tctggtggtgttagcagtca

SEQ ID NO: 312167 - DNA, 20 bp, Artificial
  CRISPR gRNA sequence
gtggtgttagcagtcagggg

SEQ ID NO: 312168 - DNA, 20 bp, Artificial
  CRISPR gRNA sequence
gcagtcaggggcattttgta

SEQ ID NO: 312169 - DNA, 20 bp, Artificial
  CRISPR gRNA sequence
tgtatttgaattctacattc

SEQ ID NO: 312170 - DNA, 20 bp, Artificial
  CRISPR gRNA sequence
gtatttgaattctacattct

SEQ ID NO: 312171 - DNA, 20 bp, Artificial
  CRISPR gRNA sequence
tatttgaattctacattctt

SEQ ID NO: 312172 - DNA, 20 bp, Artificial
  CRISPR gRNA sequence
gaattctacattctttttct

SEQ ID NO: 312173 - DNA, 20 bp, Artificial
  CRISPR gRNA sequence
aattctacattctttttctt

SEQ ID NO: 312174 - DNA, 20 bp, Artificial
  CRISPR gRNA sequence
tacattctttttcttaacta

SEQ ID NO: 312175 - DNA, 20 bp, Artificial
  CRISPR gRNA sequence
cattctttttcttaactatc

SEQ ID NO: 312176 - DNA, 20 bp, Artificial
  CRISPR gRNA sequence
tttttcttaactatccacca

SEQ ID NO: 312177 - DNA, 20 bp, Artificial
  CRISPR gRNA sequence
tttcttaactatccaccacc

SEQ ID NO: 312178 - DNA, 20 bp, Artificial
  CRISPR gRNA sequence
ttcttaactatccaccacct

SEQ ID NO: 312179 - DNA, 20 bp, Artificial
  CRISPR gRNA sequence
tcttaactatccaccacctc

SEQ ID NO: 312180 - DNA, 20 bp, Artificial
  CRISPR gRNA sequence
cttaactatccaccacctcc

SEQ ID NO: 312181 - DNA, 20 bp, Artificial
  CRISPR gRNA sequence
ttaactatccaccacctccc

SEQ ID NO: 312182 - DNA, 20 bp, Artificial
  CRISPR gRNA sequence
aactatccaccacctcccct

SEQ ID NO: 312183 - DNA, 20 bp, Artificial
  CRISPR gRNA sequence
actatccaccacctcccctc

SEQ ID NO: 312184 - DNA, 20 bp, Artificial
  CRISPR gRNA sequence
tccaccacctcccctcaaaa

SEQ ID NO: 312185 - DNA, 20 bp, Artificial
  CRISPR gRNA sequence
ccctcaaaattttaacagca

SEQ ID NO: 312186 - DNA, 20 bp, Artificial
  CRISPR gRNA sequence
aaaattttaacagcatccag

SEQ ID NO: 312187 - DNA, 20 bp, Artificial
  CRISPR gRNA sequence
taacagcatccagcctcaca

SEQ ID NO: 312188 - DNA, 20 bp, Artificial
  CRISPR gRNA sequence
aacagcatccagcctcacaa

SEQ ID NO: 312189 - DNA, 20 bp, Artificial
  CRISPR gRNA sequence
acagcatccagcctcacaaa

SEQ ID NO: 312190 - DNA, 20 bp, Artificial
  CRISPR gRNA sequence
acaaaactcagatcttccct

SEQ ID NO: 312191 - DNA, 20 bp, Artificial
  CRISPR gRNA sequence
agatcttccctgtttacagt

SEQ ID NO: 312192 - DNA, 20 bp, Artificial
  CRISPR gRNA sequence
ccctgtttacagttccactt

SEQ ID NO: 312193 - DNA, 20 bp, Artificial
  CRISPR gRNA sequence
cctgtttacagttccacttt

SEQ ID NO: 312194 - DNA, 20 bp, Artificial
  CRISPR gRNA sequence
tttacagttccactttgagt

SEQ ID NO: 312195 - DNA, 20 bp, Artificial
  CRISPR gRNA sequence
acagttccactttgagtttc

SEQ ID NO: 312196 - DNA, 20 bp, Artificial
  CRISPR gRNA sequence
cagttccactttgagtttca

SEQ ID NO: 312197 - DNA, 20 bp, Artificial
  CRISPR gRNA sequence
cactttgagtttcagtttct

SEQ ID NO: 312198 - DNA, 20 bp, Artificial
  CRISPR gRNA sequence
tgagtttcagtttcttcatc

SEQ ID NO: 312199 - DNA, 20 bp, Artificial
  CRISPR gRNA sequence
gagtttcagtttcttcatct

SEQ ID NO: 312200 - DNA, 20 bp, Artificial
  CRISPR gRNA sequence
agtttcagtttcttcatcta

SEQ ID NO: 312201 - DNA, 20 bp, Artificial
  CRISPR gRNA sequence
cagtttcttcatctataaac

SEQ ID NO: 312202 - DNA, 20 bp, Artificial
  CRISPR gRNA sequence
agtttcttcatctataaaca

SEQ ID NO: 312203 - DNA, 20 bp, Artificial
  CRISPR gRNA sequence
cttcatctataaacaggagt

SEQ ID NO: 312204 - DNA, 20 bp, Artificial
  CRISPR gRNA sequence
ttcatctataaacaggagtt

SEQ ID NO: 312205 - DNA, 20 bp, Artificial
  CRISPR gRNA sequence
catctataaacaggagttgg

SEQ ID NO: 312206 - DNA, 20 bp, Artificial
  CRISPR gRNA sequence
atctataaacaggagttggc

SEQ ID NO: 312207 - DNA, 20 bp, Artificial
  CRISPR gRNA sequence
taaacaggagttggctgcgg

SEQ ID NO: 312208 - DNA, 20 bp, Artificial
  CRISPR gRNA sequence
gctgcggtccctgccatgta

SEQ ID NO: 312209 - DNA, 20 bp, Artificial
  CRISPR gRNA sequence
cggtccctgccatgtatcct

SEQ ID NO: 312210 - DNA, 20 bp, Artificial
  CRISPR gRNA sequence
ccatgtatcctgtgactcag

SEQ ID NO: 312211 - DNA, 20 bp, Artificial
  CRISPR gRNA sequence
tgactcagtgtctcgtagtt

SEQ ID NO: 312212 - DNA, 20 bp, Artificial
  CRISPR gRNA sequence
agtgtctcgtagttactcct

SEQ ID NO: 312213 - DNA, 20 bp, Artificial
  CRISPR gRNA sequence
gtagttactcctggcccacc

SEQ ID NO: 312214 - DNA, 20 bp, Artificial
  CRISPR gRNA sequence
ctcctggcccaccccttcct

SEQ ID NO: 312215 - DNA, 20 bp, Artificial
  CRISPR gRNA sequence
ctggcccaccccttcctgct

SEQ ID NO: 312216 - DNA, 20 bp, Artificial
  CRISPR gRNA sequence
gcccaccccttcctgctgct

SEQ ID NO: 312217 - DNA, 20 bp, Artificial
  CRISPR gRNA sequence
cctgctgctccttgtctcca

SEQ ID NO: 312218 - DNA, 20 bp, Artificial
  CRISPR gRNA sequence
ctgctgctccttgtctccac

SEQ ID NO: 312219 - DNA, 20 bp, Artificial
  CRISPR gRNA sequence
ctgctccttgtctccacctg

SEQ ID NO: 312220 - DNA, 20 bp, Artificial
  CRISPR gRNA sequence
ctccttgtctccacctgcag

SEQ ID NO: 312221 - DNA, 20 bp, Artificial
  CRISPR gRNA sequence
cttgtctccacctgcaggcc

SEQ ID NO: 312222 - DNA, 20 bp, Artificial
  CRISPR gRNA sequence
gtctccacctgcaggcctga

SEQ ID NO: 312223 - DNA, 20 bp, Artificial
  CRISPR gRNA sequence
tctccacctgcaggcctgag

SEQ ID NO: 312224 - DNA, 20 bp, Artificial
  CRISPR gRNA sequence
cacctgcaggcctgagaggg

SEQ ID NO: 312225 - DNA, 20 bp, Artificial
  CRISPR gRNA sequence
caggcctgagagggaagcca

SEQ ID NO: 312226 - DNA, 20 bp, Artificial
  CRISPR gRNA sequence
agagggaagccaccccacta

SEQ ID NO: 312227 - DNA, 20 bp, Artificial
  CRISPR gRNA sequence
agacagggaggtgaactgag

SEQ ID NO: 312228 - DNA, 20 bp, Artificial
  CRISPR gRNA sequence
agcctgaagtttggctacag

SEQ ID NO: 312229 - DNA, 20 bp, Artificial
  CRISPR gRNA sequence
aagtttggctacagcaccca

SEQ ID NO: 312230 - DNA, 20 bp, Artificial
  CRISPR gRNA sequence
ggctacagcacccacaggcc

SEQ ID NO: 312231 - DNA, 20 bp, Artificial
  CRISPR gRNA sequence
gctacagcacccacaggcca

SEQ ID NO: 312232 - DNA, 20 bp, Artificial
  CRISPR gRNA sequence
cagcacccacaggccaccag

SEQ ID NO: 312233 - DNA, 20 bp, Artificial
  CRISPR gRNA sequence
acctcctccagatggccaca

SEQ ID NO: 312234 - DNA, 20 bp, Artificial
  CRISPR gRNA sequence
ctccagatggccacacacca

SEQ ID NO: 312235 - DNA, 20 bp, Artificial
  CRISPR gRNA sequence
cagatggccacacaccaggc

SEQ ID NO: 312236 - DNA, 20 bp, Artificial
  CRISPR gRNA sequence
ggccactgtccccatgtctg

SEQ ID NO: 312237 - DNA, 20 bp, Artificial
  CRISPR gRNA sequence
gccactgtccccatgtctgc

SEQ ID NO: 312238 - DNA, 20 bp, Artificial
  CRISPR gRNA sequence
tccccatgtctgctgtggat

SEQ ID NO: 312239 - DNA, 20 bp, Artificial
  CRISPR gRNA sequence
ctgtggatgatgaggagtca

SEQ ID NO: 312240 - DNA, 20 bp, Artificial
  CRISPR gRNA sequence
tggatgatgaggagtcaggg

SEQ ID NO: 312241 - DNA, 20 bp, Artificial
  CRISPR gRNA sequence
caaagagatggtccctcaga

SEQ ID NO: 312242 - DNA, 20 bp, Artificial
  CRISPR gRNA sequence
agatccatgctggctgggat

SEQ ID NO: 312243 - DNA, 20 bp, Artificial
  CRISPR gRNA sequence
gctgggataagccttttcag

SEQ ID NO: 312244 - DNA, 20 bp, Artificial
  CRISPR gRNA sequence
ggataagccttttcagattt

SEQ ID NO: 312245 - DNA, 20 bp, Artificial
  CRISPR gRNA sequence
ttcagatttctgtttttctg

SEQ ID NO: 312246 - DNA, 20 bp, Artificial
  CRISPR gRNA sequence
tcagatttctgtttttctgc

SEQ ID NO: 312247 - DNA, 20 bp, Artificial
  CRISPR gRNA sequence
cagatttctgtttttctgct

SEQ ID NO: 312248 - DNA, 20 bp, Artificial
  CRISPR gRNA sequence
agatttctgtttttctgctt

SEQ ID NO: 312249 - DNA, 20 bp, Artificial
  CRISPR gRNA sequence
ctgtttttctgcttagcacc

SEQ ID NO: 312250 - DNA, 20 bp, Artificial
  CRISPR gRNA sequence
tgtttttctgcttagcacct

SEQ ID NO: 312251 - DNA, 20 bp, Artificial
  CRISPR gRNA sequence
tttttctgcttagcaccttg

SEQ ID NO: 312252 - DNA, 20 bp, Artificial
  CRISPR gRNA sequence
ttctgcttagcaccttgagc

SEQ ID NO: 312253 - DNA, 20 bp, Artificial
  CRISPR gRNA sequence
tctgcttagcaccttgagct

SEQ ID NO: 312254 - DNA, 20 bp, Artificial
  CRISPR gRNA sequence
ctgcttagcaccttgagctt

SEQ ID NO: 312255 - DNA, 20 bp, Artificial
  CRISPR gRNA sequence
tgcttagcaccttgagcttg

SEQ ID NO: 312256 - DNA, 20 bp, Artificial
  CRISPR gRNA sequence
cttagcaccttgagcttgtg

SEQ ID NO: 312257 - DNA, 20 bp, Artificial
  CRISPR gRNA sequence
agcaccttgagcttgtggag

SEQ ID NO: 312258 - DNA, 20 bp, Artificial
  CRISPR gRNA sequence
gcaccttgagcttgtggagt

SEQ ID NO: 312259 - DNA, 20 bp, Artificial
  CRISPR gRNA sequence
gagcttgtggagtccttgag

SEQ ID NO: 312260 - DNA, 20 bp, Artificial
  CRISPR gRNA sequence
agcttgtggagtccttgagt

SEQ ID NO: 312261 - DNA, 20 bp, Artificial
  CRISPR gRNA sequence
gtggagtccttgagtgcaag

SEQ ID NO: 312262 - DNA, 20 bp, Artificial
  CRISPR gRNA sequence
tggagtccttgagtgcaagg

SEQ ID NO: 312263 - DNA, 20 bp, Artificial
  CRISPR gRNA sequence
gagtgcaaggtctgtagatg

SEQ ID NO: 312264 - DNA, 20 bp, Artificial
  CRISPR gRNA sequence
agtgcaaggtctgtagatgt

SEQ ID NO: 312265 - DNA, 20 bp, Artificial
  CRISPR gRNA sequence
tagatgtgccagctgatcac

SEQ ID NO: 312266 - DNA, 20 bp, Artificial
  CRISPR gRNA sequence
atcactgacttaggtaacaa

SEQ ID NO: 312267 - DNA, 20 bp, Artificial
  CRISPR gRNA sequence
acttaggtaacaacagcagc

SEQ ID NO: 312268 - DNA, 20 bp, Artificial
  CRISPR gRNA sequence
aggtaacaacagcagcttcc

SEQ ID NO: 312269 - DNA, 20 bp, Artificial
  CRISPR gRNA sequence
ggtaacaacagcagcttcca

SEQ ID NO: 312270 - DNA, 20 bp, Artificial
  CRISPR gRNA sequence
ccaacccccagggcccatga

SEQ ID NO: 312271 - DNA, 20 bp, Artificial
  CRISPR gRNA sequence
caacccccagggcccatgac

SEQ ID NO: 312272 - DNA, 20 bp, Artificial
  CRISPR gRNA sequence
ctaccttagctcctggggat

SEQ ID NO: 312273 - DNA, 20 bp, Artificial
  CRISPR gRNA sequence
ccttagctcctggggatgtg

SEQ ID NO: 312274 - DNA, 20 bp, Artificial
  CRISPR gRNA sequence
agctcctggggatgtgggag

SEQ ID NO: 312275 - DNA, 20 bp, Artificial
  CRISPR gRNA sequence
gctcctggggatgtgggagg

SEQ ID NO: 312276 - DNA, 20 bp, Artificial
  CRISPR gRNA sequence
ctggggatgtgggaggtatg

SEQ ID NO: 312277 - DNA, 20 bp, Artificial
  CRISPR gRNA sequence
gggatgtgggaggtatgtgt

SEQ ID NO: 312278 - DNA, 20 bp, Artificial
  CRISPR gRNA sequence
tagagaacattatccagtaa

SEQ ID NO: 312279 - DNA, 20 bp, Artificial
  CRISPR gRNA sequence
gagaacattatccagtaaga

SEQ ID NO: 312280 - DNA, 20 bp, Artificial
  CRISPR gRNA sequence
tccagtaagattcccttctc

SEQ ID NO: 312281 - DNA, 20 bp, Artificial
  CRISPR gRNA sequence
ccttctcatcccacttctta

SEQ ID NO: 312282 - DNA, 20 bp, Artificial
  CRISPR gRNA sequence
ctcatcccacttcttattta

SEQ ID NO: 312283 - DNA, 20 bp, Artificial
  CRISPR gRNA sequence
tcatcccacttcttatttat

SEQ ID NO: 312284 - DNA, 20 bp, Artificial
  CRISPR gRNA sequence
atcccacttcttatttattt

SEQ ID NO: 312285 - DNA, 20 bp, Artificial
  CRISPR gRNA sequence
cttatttatttattttattt

SEQ ID NO: 312286 - DNA, 20 bp, Artificial
  CRISPR gRNA sequence
ttatttatttattttattta

SEQ ID NO: 312287 - DNA, 20 bp, Artificial
  CRISPR gRNA sequence
atttatttattttatttatt

SEQ ID NO: 312288 - DNA, 20 bp, Artificial
  CRISPR gRNA sequence
tttatttattttatttattt

SEQ ID NO: 312289 - DNA, 20 bp, Artificial
  CRISPR gRNA sequence
atttattttatttattttat

SEQ ID NO: 312290 - DNA, 20 bp, Artificial
  CRISPR gRNA sequence
tttattttatttattttatt

SEQ ID NO: 312291 - DNA, 20 bp, Artificial
  CRISPR gRNA sequence
attttatttattttattttt

SEQ ID NO: 312292 - DNA, 20 bp, Artificial
  CRISPR gRNA sequence
ttttatttattttatttttt

SEQ ID NO: 312293 - DNA, 20 bp, Artificial
  CRISPR gRNA sequence
tatttattttattttttgag

SEQ ID NO: 312294 - DNA, 20 bp, Artificial
  CRISPR gRNA sequence
atttattttattttttgaga

SEQ ID NO: 312295 - DNA, 20 bp, Artificial
  CRISPR gRNA sequence
tttattttattttttgagac

SEQ ID NO: 312296 - DNA, 20 bp, Artificial
  CRISPR gRNA sequence
attttattttttgagacagc

SEQ ID NO: 312297 - DNA, 20 bp, Artificial
  CRISPR gRNA sequence
ttttattttttgagacagca

SEQ ID NO: 312298 - DNA, 20 bp, Artificial
  CRISPR gRNA sequence
tattttttgagacagcatct

SEQ ID NO: 312299 - DNA, 20 bp, Artificial
  CRISPR gRNA sequence
attttttgagacagcatctt

SEQ ID NO: 312300 - DNA, 20 bp, Artificial
  CRISPR gRNA sequence
ttttttgagacagcatcttt

SEQ ID NO: 312301 - DNA, 20 bp, Artificial
  CRISPR gRNA sequence
tttgagacagcatctttctc

SEQ ID NO: 312302 - DNA, 20 bp, Artificial
  CRISPR gRNA sequence
ttgagacagcatctttctct

SEQ ID NO: 312303 - DNA, 20 bp, Artificial
  CRISPR gRNA sequence
tgagacagcatctttctctg

SEQ ID NO: 312304 - DNA, 20 bp, Artificial
  CRISPR gRNA sequence
gagacagcatctttctctgt

SEQ ID NO: 312305 - DNA, 20 bp, Artificial
  CRISPR gRNA sequence
agacagcatctttctctgtc

SEQ ID NO: 312306 - DNA, 20 bp, Artificial
  CRISPR gRNA sequence
tctctgtcacccaggctgga

SEQ ID NO: 312307 - DNA, 20 bp, Artificial
  CRISPR gRNA sequence
ctctgtcacccaggctggag

SEQ ID NO: 312308 - DNA, 20 bp, Artificial
  CRISPR gRNA sequence
tctgtcacccaggctggagt

SEQ ID NO: 312309 - DNA, 20 bp, Artificial
  CRISPR gRNA sequence
tgtcacccaggctggagtac

SEQ ID NO: 312310 - DNA, 20 bp, Artificial
  CRISPR gRNA sequence
tcacccaggctggagtacag

SEQ ID NO: 312311 - DNA, 20 bp, Artificial
  CRISPR gRNA sequence
gagtacagtggcacagtcac

SEQ ID NO: 312312 - DNA, 20 bp, Artificial
  CRISPR gRNA sequence
actgtggcctcgattacctg

SEQ ID NO: 312313 - DNA, 20 bp, Artificial
  CRISPR gRNA sequence
tggcctcgattacctgggct

SEQ ID NO: 312314 - DNA, 20 bp, Artificial
  CRISPR gRNA sequence
gattacctgggctcaagcaa

SEQ ID NO: 312315 - DNA, 20 bp, Artificial
  CRISPR gRNA sequence
cctgggctcaagcaattctc

SEQ ID NO: 312316 - DNA, 20 bp, Artificial
  CRISPR gRNA sequence
ggctcaagcaattctcccac

SEQ ID NO: 312317 - DNA, 20 bp, Artificial
  CRISPR gRNA sequence
aagcaattctcccacctcag

SEQ ID NO: 312318 - DNA, 20 bp, Artificial
  CRISPR gRNA sequence
tcccacctcagcctccccaa

SEQ ID NO: 312319 - DNA, 20 bp, Artificial
  CRISPR gRNA sequence
ccacctcagcctccccaagt

SEQ ID NO: 312320 - DNA, 20 bp, Artificial
  CRISPR gRNA sequence
agcctccccaagtgctagaa

SEQ ID NO: 312321 - DNA, 20 bp, Artificial
  CRISPR gRNA sequence
cccaagtgctagaattatat

SEQ ID NO: 312322 - DNA, 20 bp, Artificial
  CRISPR gRNA sequence
gaattatatgcatgagccat

SEQ ID NO: 312323 - DNA, 20 bp, Artificial
  CRISPR gRNA sequence
tatgcatgagccatcgcaca

SEQ ID NO: 312324 - DNA, 20 bp, Artificial
  CRISPR gRNA sequence
attttatttatttgataaat

SEQ ID NO: 312325 - DNA, 20 bp, Artificial
  CRISPR gRNA sequence
ttttatttatttgataaatg

SEQ ID NO: 312326 - DNA, 20 bp, Artificial
  CRISPR gRNA sequence
tatttatttgataaatgcat

SEQ ID NO: 312327 - DNA, 20 bp, Artificial
  CRISPR gRNA sequence
atttatttgataaatgcata

SEQ ID NO: 312328 - DNA, 20 bp, Artificial
  CRISPR gRNA sequence
tttatttgataaatgcatat

SEQ ID NO: 312329 - DNA, 20 bp, Artificial
  CRISPR gRNA sequence
atttgataaatgcatatata

SEQ ID NO: 312330 - DNA, 20 bp, Artificial
  CRISPR gRNA sequence
tttgataaatgcatatatac

SEQ ID NO: 312331 - DNA, 20 bp, Artificial
  CRISPR gRNA sequence
gataaatgcatatatacaca

SEQ ID NO: 312332 - DNA, 20 bp, Artificial
  CRISPR gRNA sequence
ataaatgcatatatacacac

SEQ ID NO: 312333 - DNA, 20 bp, Artificial
  CRISPR gRNA sequence
aacaacaggggtacgttctg

SEQ ID NO: 312334 - DNA, 20 bp, Artificial
  CRISPR gRNA sequence
acaacaggggtacgttctga

SEQ ID NO: 312335 - DNA, 20 bp, Artificial
  CRISPR gRNA sequence
tgagaaacacattattaggc

SEQ ID NO: 312336 - DNA, 20 bp, Artificial
  CRISPR gRNA sequence
agaaacacattattaggcga

SEQ ID NO: 312337 - DNA, 20 bp, Artificial
  CRISPR gRNA sequence
ttaggcgattttgtcattgt

SEQ ID NO: 312338 - DNA, 20 bp, Artificial
  CRISPR gRNA sequence
ggcgattttgtcattgtata

SEQ ID NO: 312339 - DNA, 20 bp, Artificial
  CRISPR gRNA sequence
tgtcattgtataatcatcat

SEQ ID NO: 312340 - DNA, 20 bp, Artificial
  CRISPR gRNA sequence
gtcattgtataatcatcata

SEQ ID NO: 312341 - DNA, 20 bp, Artificial
  CRISPR gRNA sequence
tcattgtataatcatcatag

SEQ ID NO: 312342 - DNA, 20 bp, Artificial
  CRISPR gRNA sequence
tataatcatcatagggtgtc

SEQ ID NO: 312343 - DNA, 20 bp, Artificial
  CRISPR gRNA sequence
acacaaaactagatagcata

SEQ ID NO: 312344 - DNA, 20 bp, Artificial
  CRISPR gRNA sequence
cacaaaactagatagcatag

SEQ ID NO: 312345 - DNA, 20 bp, Artificial
  CRISPR gRNA sequence
gatagcatagcctgctccat

SEQ ID NO: 312346 - DNA, 20 bp, Artificial
  CRISPR gRNA sequence
ctccatacttaggctacctg

SEQ ID NO: 312347 - DNA, 20 bp, Artificial
  CRISPR gRNA sequence
catacttaggctacctggca

SEQ ID NO: 312348 - DNA, 20 bp, Artificial
  CRISPR gRNA sequence
aggctacctggcacagccta

SEQ ID NO: 312349 - DNA, 20 bp, Artificial
  CRISPR gRNA sequence
ggctacctggcacagcctat

SEQ ID NO: 312350 - DNA, 20 bp, Artificial
  CRISPR gRNA sequence
cctggcacagcctattgctc

SEQ ID NO: 312351 - DNA, 20 bp, Artificial
  CRISPR gRNA sequence
gcacagcctattgctcctag

SEQ ID NO: 312352 - DNA, 20 bp, Artificial
  CRISPR gRNA sequence
ttgctcctaggctacaagcc

SEQ ID NO: 312353 - DNA, 20 bp, Artificial
  CRISPR gRNA sequence
ctcctaggctacaagcctgc

SEQ ID NO: 312354 - DNA, 20 bp, Artificial
  CRISPR gRNA sequence
ctaggctacaagcctgcaca

SEQ ID NO: 312355 - DNA, 20 bp, Artificial
  CRISPR gRNA sequence
ggctacaagcctgcacagca

SEQ ID NO: 312356 - DNA, 20 bp, Artificial
  CRISPR gRNA sequence
caagcctgcacagcatgtta

SEQ ID NO: 312357 - DNA, 20 bp, Artificial
  CRISPR gRNA sequence
cacagcatgttactgtgctg

SEQ ID NO: 312358 - DNA, 20 bp, Artificial
  CRISPR gRNA sequence
ctgtgctgaatactgtaggt

SEQ ID NO: 312359 - DNA, 20 bp, Artificial
  CRISPR gRNA sequence
tgctgaatactgtaggtgtt

SEQ ID NO: 312360 - DNA, 20 bp, Artificial
  CRISPR gRNA sequence
aatactgtaggtgttgtaac

SEQ ID NO: 312361 - DNA, 20 bp, Artificial
  CRISPR gRNA sequence
taggtgttgtaacacaatgg

SEQ ID NO: 312362 - DNA, 20 bp, Artificial
  CRISPR gRNA sequence
taacacaatggtatgtattt

SEQ ID NO: 312363 - DNA, 20 bp, Artificial
  CRISPR gRNA sequence
ttgtatctgaacatatctaa

SEQ ID NO: 312364 - DNA, 20 bp, Artificial
  CRISPR gRNA sequence
tgtatctgaacatatctaag

SEQ ID NO: 312365 - DNA, 20 bp, Artificial
  CRISPR gRNA sequence
gtatctgaacatatctaagc

SEQ ID NO: 312366 - DNA, 20 bp, Artificial
  CRISPR gRNA sequence
tatctgaacatatctaagca

SEQ ID NO: 312367 - DNA, 20 bp, Artificial
  CRISPR gRNA sequence
aacatatctaagcatagaaa

SEQ ID NO: 312368 - DNA, 20 bp, Artificial
  CRISPR gRNA sequence
agcatagaaaagatacagta

SEQ ID NO: 312369 - DNA, 20 bp, Artificial
  CRISPR gRNA sequence
taatcttatgggaccaccat

SEQ ID NO: 312370 - DNA, 20 bp, Artificial
  CRISPR gRNA sequence
atgggaccaccattgtatat

SEQ ID NO: 312371 - DNA, 20 bp, Artificial
  CRISPR gRNA sequence
tgggaccaccattgtatatg

SEQ ID NO: 312372 - DNA, 20 bp, Artificial
  CRISPR gRNA sequence
tatatgactgaaatgtggct

SEQ ID NO: 312373 - DNA, 20 bp, Artificial
  CRISPR gRNA sequence
aaatgtggctgtgcaataca

SEQ ID NO: 312374 - DNA, 20 bp, Artificial
  CRISPR gRNA sequence
tgcaatacatgacagtatat

SEQ ID NO: 312375 - DNA, 20 bp, Artificial
  CRISPR gRNA sequence
actttgtgcctggtactgtt

SEQ ID NO: 312376 - DNA, 20 bp, Artificial
  CRISPR gRNA sequence
ctttgtgcctggtactgttc

SEQ ID NO: 312377 - DNA, 20 bp, Artificial
  CRISPR gRNA sequence
tgtgcctggtactgttctaa

SEQ ID NO: 312378 - DNA, 20 bp, Artificial
  CRISPR gRNA sequence
gtgcctggtactgttctaag

SEQ ID NO: 312379 - DNA, 20 bp, Artificial
  CRISPR gRNA sequence
tgcctggtactgttctaagt

SEQ ID NO: 312380 - DNA, 20 bp, Artificial
  CRISPR gRNA sequence
gtactgttctaagtacctca

SEQ ID NO: 312381 - DNA, 20 bp, Artificial
  CRISPR gRNA sequence
ttctaagtacctcataaata

SEQ ID NO: 312382 - DNA, 20 bp, Artificial
  CRISPR gRNA sequence
taagtacctcataaatatta

SEQ ID NO: 312383 - DNA, 20 bp, Artificial
  CRISPR gRNA sequence
agtacctcataaatattaac

SEQ ID NO: 312384 - DNA, 20 bp, Artificial
  CRISPR gRNA sequence
ataaatattaactcatttga

SEQ ID NO: 312385 - DNA, 20 bp, Artificial
  CRISPR gRNA sequence
actcatttgagcctcacaat

SEQ ID NO: 312386 - DNA, 20 bp, Artificial
  CRISPR gRNA sequence
atttgagcctcacaataact

SEQ ID NO: 312387 - DNA, 20 bp, Artificial
  CRISPR gRNA sequence
gagcctcacaataactctct

SEQ ID NO: 312388 - DNA, 20 bp, Artificial
  CRISPR gRNA sequence
agcctcacaataactctctg

SEQ ID NO: 312389 - DNA, 20 bp, Artificial
  CRISPR gRNA sequence
acaataactctctgctttag

SEQ ID NO: 312390 - DNA, 20 bp, Artificial
  CRISPR gRNA sequence
tctgctttaggtcttgttgt

SEQ ID NO: 312391 - DNA, 20 bp, Artificial
  CRISPR gRNA sequence
tgctttaggtcttgttgtta

SEQ ID NO: 312392 - DNA, 20 bp, Artificial
  CRISPR gRNA sequence
ctttaggtcttgttgttatt

SEQ ID NO: 312393 - DNA, 20 bp, Artificial
  CRISPR gRNA sequence
taggtcttgttgttatttcc

SEQ ID NO: 312394 - DNA, 20 bp, Artificial
  CRISPR gRNA sequence
aggtcttgttgttatttccc

SEQ ID NO: 312395 - DNA, 20 bp, Artificial
  CRISPR gRNA sequence
ggtcttgttgttatttccca

SEQ ID NO: 312396 - DNA, 20 bp, Artificial
  CRISPR gRNA sequence
gttgttatttcccattttaa

SEQ ID NO: 312397 - DNA, 20 bp, Artificial
  CRISPR gRNA sequence
ttgttatttcccattttaag

SEQ ID NO: 312398 - DNA, 20 bp, Artificial
  CRISPR gRNA sequence
ttatttcccattttaagatg

SEQ ID NO: 312399 - DNA, 20 bp, Artificial
  CRISPR gRNA sequence
tttcccattttaagatgtgg

SEQ ID NO: 312400 - DNA, 20 bp, Artificial
  CRISPR gRNA sequence
cccattttaagatgtggaca

SEQ ID NO: 312401 - DNA, 20 bp, Artificial
  CRISPR gRNA sequence
ccattttaagatgtggacac

SEQ ID NO: 312402 - DNA, 20 bp, Artificial
  CRISPR gRNA sequence
taagatgtggacactaaagc

SEQ ID NO: 312403 - DNA, 20 bp, Artificial
  CRISPR gRNA sequence
aagatgtggacactaaagcc

SEQ ID NO: 312404 - DNA, 20 bp, Artificial
  CRISPR gRNA sequence
agatgtggacactaaagccc

SEQ ID NO: 312405 - DNA, 20 bp, Artificial
  CRISPR gRNA sequence
aagcccagagagatgaagta

SEQ ID NO: 312406 - DNA, 20 bp, Artificial
  CRISPR gRNA sequence
acccaagatcgacagagcta

SEQ ID NO: 312407 - DNA, 20 bp, Artificial
  CRISPR gRNA sequence
cccaagatcgacagagctac

SEQ ID NO: 312408 - DNA, 20 bp, Artificial
  CRISPR gRNA sequence
ctaagtggcagagcttggat

SEQ ID NO: 312409 - DNA, 20 bp, Artificial
  CRISPR gRNA sequence
agtggcagagcttggattca

SEQ ID NO: 312410 - DNA, 20 bp, Artificial
  CRISPR gRNA sequence
ggattcacacccagcaatgt

SEQ ID NO: 312411 - DNA, 20 bp, Artificial
  CRISPR gRNA sequence
gattcacacccagcaatgta

SEQ ID NO: 312412 - DNA, 20 bp, Artificial
  CRISPR gRNA sequence
acacccagcaatgtagattt

SEQ ID NO: 312413 - DNA, 20 bp, Artificial
  CRISPR gRNA sequence
agcattcgttcacttgactc

SEQ ID NO: 312414 - DNA, 20 bp, Artificial
  CRISPR gRNA sequence
gcattcgttcacttgactct

SEQ ID NO: 312415 - DNA, 20 bp, Artificial
  CRISPR gRNA sequence
gttcacttgactcttctcct

SEQ ID NO: 312416 - DNA, 20 bp, Artificial
  CRISPR gRNA sequence
acttgactcttctcctaact

SEQ ID NO: 312417 - DNA, 20 bp, Artificial
  CRISPR gRNA sequence
gactcttctcctaactcttg

SEQ ID NO: 312418 - DNA, 20 bp, Artificial
  CRISPR gRNA sequence
actcttctcctaactcttgt

SEQ ID NO: 312419 - DNA, 20 bp, Artificial
  CRISPR gRNA sequence
ttctcctaactcttgtggta

SEQ ID NO: 312420 - DNA, 20 bp, Artificial
  CRISPR gRNA sequence
ctcctaactcttgtggtaaa

SEQ ID NO: 312421 - DNA, 20 bp, Artificial
  CRISPR gRNA sequence
tcctaactcttgtggtaaac

SEQ ID NO: 312422 - DNA, 20 bp, Artificial
  CRISPR gRNA sequence
ctaactcttgtggtaaacca

SEQ ID NO: 312423 - DNA, 20 bp, Artificial
  CRISPR gRNA sequence
actcttgtggtaaaccatga

SEQ ID NO: 312424 - DNA, 20 bp, Artificial
  CRISPR gRNA sequence
ttgtggtaaaccatgaataa

SEQ ID NO: 312425 - DNA, 20 bp, Artificial
  CRISPR gRNA sequence
gtggtaaaccatgaataagt

SEQ ID NO: 312426 - DNA, 20 bp, Artificial
  CRISPR gRNA sequence
tggtaaaccatgaataagtg

SEQ ID NO: 312427 - DNA, 20 bp, Artificial
  CRISPR gRNA sequence
cttccatggggcctgaacag

SEQ ID NO: 312428 - DNA, 20 bp, Artificial
  CRISPR gRNA sequence
ttccatggggcctgaacagc

SEQ ID NO: 312429 - DNA, 20 bp, Artificial
  CRISPR gRNA sequence
ccatggggcctgaacagctt

SEQ ID NO: 312430 - DNA, 20 bp, Artificial
  CRISPR gRNA sequence
catggggcctgaacagcttt

SEQ ID NO: 312431 - DNA, 20 bp, Artificial
  CRISPR gRNA sequence
aacagctttggtggataata

SEQ ID NO: 312432 - DNA, 20 bp, Artificial
  CRISPR gRNA sequence
tggtggataatatagcttct

SEQ ID NO: 312433 - DNA, 20 bp, Artificial
  CRISPR gRNA sequence
ggtggataatatagcttctg

SEQ ID NO: 312434 - DNA, 20 bp, Artificial
  CRISPR gRNA sequence
gtggataatatagcttctgc

SEQ ID NO: 312435 - DNA, 20 bp, Artificial
  CRISPR gRNA sequence
ctgcctcatccgtgttcatc

SEQ ID NO: 312436 - DNA, 20 bp, Artificial
  CRISPR gRNA sequence
tgcctcatccgtgttcatcc

SEQ ID NO: 312437 - DNA, 20 bp, Artificial
  CRISPR gRNA sequence
cctcatccgtgttcatccag

SEQ ID NO: 312438 - DNA, 20 bp, Artificial
  CRISPR gRNA sequence
atccgtgttcatccagtgcc

SEQ ID NO: 312439 - DNA, 20 bp, Artificial
  CRISPR gRNA sequence
atccagtgcctcctccccat

SEQ ID NO: 312440 - DNA, 20 bp, Artificial
  CRISPR gRNA sequence
ctccccatcacctgcagctg

SEQ ID NO: 312441 - DNA, 20 bp, Artificial
  CRISPR gRNA sequence
cccatcacctgcagctgaca

SEQ ID NO: 312442 - DNA, 20 bp, Artificial
  CRISPR gRNA sequence
cagctgacacctcagttgac

SEQ ID NO: 312443 - DNA, 20 bp, Artificial
  CRISPR gRNA sequence
acacctcagttgacccaaga

SEQ ID NO: 312444 - DNA, 20 bp, Artificial
  CRISPR gRNA sequence
agttgacccaagagcttggg

SEQ ID NO: 312445 - DNA, 20 bp, Artificial
  CRISPR gRNA sequence
acccaagagcttgggcccaa

SEQ ID NO: 312446 - DNA, 20 bp, Artificial
  CRISPR gRNA sequence
gggcccaagcccttctcatc

SEQ ID NO: 312447 - DNA, 20 bp, Artificial
  CRISPR gRNA sequence
ggcccaagcccttctcatca

SEQ ID NO: 312448 - DNA, 20 bp, Artificial
  CRISPR gRNA sequence
ctcatcaaagtgaccagccc

SEQ ID NO: 312449 - DNA, 20 bp, Artificial
  CRISPR gRNA sequence
tcatcaaagtgaccagccca

SEQ ID NO: 312450 - DNA, 20 bp, Artificial
  CRISPR gRNA sequence
atcaaagtgaccagcccagc

SEQ ID NO: 312451 - DNA, 20 bp, Artificial
  CRISPR gRNA sequence
tcaagatctgggagagaagg

SEQ ID NO: 312452 - DNA, 20 bp, Artificial
  CRISPR gRNA sequence
aagatctgggagagaaggaa

SEQ ID NO: 312453 - DNA, 20 bp, Artificial
  CRISPR gRNA sequence
ggagagaaggaagaaaaatg

SEQ ID NO: 312454 - DNA, 20 bp, Artificial
  CRISPR gRNA sequence
gaaacacatttccagaaaac

SEQ ID NO: 312455 - DNA, 20 bp, Artificial
  CRISPR gRNA sequence
ccagaaaacactaaactgga

SEQ ID NO: 312456 - DNA, 20 bp, Artificial
  CRISPR gRNA sequence
cagaaaacactaaactggaa

SEQ ID NO: 312457 - DNA, 20 bp, Artificial
  CRISPR gRNA sequence
aactggaacaccatttccca

SEQ ID NO: 312458 - DNA, 20 bp, Artificial
  CRISPR gRNA sequence
gaacaccatttcccaccaaa

SEQ ID NO: 312459 - DNA, 20 bp, Artificial
  CRISPR gRNA sequence
cccaccaaattttctgactc

SEQ ID NO: 312460 - DNA, 20 bp, Artificial
  CRISPR gRNA sequence
ccaccaaattttctgactcc

SEQ ID NO: 312461 - DNA, 20 bp, Artificial
  CRISPR gRNA sequence
tctgactccgcacactgaaa

SEQ ID NO: 312462 - DNA, 20 bp, Artificial
  CRISPR gRNA sequence
ctgactccgcacactgaaag

SEQ ID NO: 312463 - DNA, 20 bp, Artificial
  CRISPR gRNA sequence
tgactccgcacactgaaagt

SEQ ID NO: 312464 - DNA, 20 bp, Artificial
  CRISPR gRNA sequence
actccgcacactgaaagtga

SEQ ID NO: 312465 - DNA, 20 bp, Artificial
  CRISPR gRNA sequence
cgcacactgaaagtgagaaa

SEQ ID NO: 312466 - DNA, 20 bp, Artificial
  CRISPR gRNA sequence
aaagtgagaaagtaaagccg

SEQ ID NO: 312467 - DNA, 20 bp, Artificial
  CRISPR gRNA sequence
tatgaaaactgagttcaggt

SEQ ID NO: 312468 - DNA, 20 bp, Artificial
  CRISPR gRNA sequence
tgaaaactgagttcaggtgt

SEQ ID NO: 312469 - DNA, 20 bp, Artificial
  CRISPR gRNA sequence
agttcaggtgtcacttttgc

SEQ ID NO: 312470 - DNA, 20 bp, Artificial
  CRISPR gRNA sequence
aggtgtcacttttgcccttg

SEQ ID NO: 312471 - DNA, 20 bp, Artificial
  CRISPR gRNA sequence
ttgcccttgatttgccattg

SEQ ID NO: 312472 - DNA, 20 bp, Artificial
  CRISPR gRNA sequence
tgcccttgatttgccattga

SEQ ID NO: 312473 - DNA, 20 bp, Artificial
  CRISPR gRNA sequence
gcccttgatttgccattgac

SEQ ID NO: 312474 - DNA, 20 bp, Artificial
  CRISPR gRNA sequence
cccttgatttgccattgaca

SEQ ID NO: 312475 - DNA, 20 bp, Artificial
  CRISPR gRNA sequence
gatttgccattgacacttct

SEQ ID NO: 312476 - DNA, 20 bp, Artificial
  CRISPR gRNA sequence
atttgccattgacacttctt

SEQ ID NO: 312477 - DNA, 20 bp, Artificial
  CRISPR gRNA sequence
gccattgacacttcttagaa

SEQ ID NO: 312478 - DNA, 20 bp, Artificial
  CRISPR gRNA sequence
ccattgacacttcttagaag

SEQ ID NO: 312479 - DNA, 20 bp, Artificial
  CRISPR gRNA sequence
acacttcttagaagtttctt

SEQ ID NO: 312480 - DNA, 20 bp, Artificial
  CRISPR gRNA sequence
cttagaagtttcttagctcc

SEQ ID NO: 312481 - DNA, 20 bp, Artificial
  CRISPR gRNA sequence
ttagaagtttcttagctcct

SEQ ID NO: 312482 - DNA, 20 bp, Artificial
  CRISPR gRNA sequence
agaagtttcttagctcctga

SEQ ID NO: 312483 - DNA, 20 bp, Artificial
  CRISPR gRNA sequence
gaagtttcttagctcctgag

SEQ ID NO: 312484 - DNA, 20 bp, Artificial
  CRISPR gRNA sequence
cttagctcctgagaaaagag

SEQ ID NO: 312485 - DNA, 20 bp, Artificial
  CRISPR gRNA sequence
ttagctcctgagaaaagagt

SEQ ID NO: 312486 - DNA, 20 bp, Artificial
  CRISPR gRNA sequence
agctcctgagaaaagagtta

SEQ ID NO: 312487 - DNA, 20 bp, Artificial
  CRISPR gRNA sequence
gctcctgagaaaagagttac

SEQ ID NO: 312488 - DNA, 20 bp, Artificial
  CRISPR gRNA sequence
ctgagaaaagagttaccaat

SEQ ID NO: 312489 - DNA, 20 bp, Artificial
  CRISPR gRNA sequence
agaaaagagttaccaatatt

SEQ ID NO: 312490 - DNA, 20 bp, Artificial
  CRISPR gRNA sequence
ccaatattgaaagcaacaac

SEQ ID NO: 312491 - DNA, 20 bp, Artificial
  CRISPR gRNA sequence
aaagcaacaacctcaaatgg

SEQ ID NO: 312492 - DNA, 20 bp, Artificial
  CRISPR gRNA sequence
aaatggtaaccgtttaagtt

SEQ ID NO: 312493 - DNA, 20 bp, Artificial
  CRISPR gRNA sequence
aagttttatggtggtgagag

SEQ ID NO: 312494 - DNA, 20 bp, Artificial
  CRISPR gRNA sequence
agttttatggtggtgagaga

SEQ ID NO: 312495 - DNA, 20 bp, Artificial
  CRISPR gRNA sequence
tatggtggtgagagaataag

SEQ ID NO: 312496 - DNA, 20 bp, Artificial
  CRISPR gRNA sequence
atggtggtgagagaataagt

SEQ ID NO: 312497 - DNA, 20 bp, Artificial
  CRISPR gRNA sequence
tggtggtgagagaataagtg

SEQ ID NO: 312498 - DNA, 20 bp, Artificial
  CRISPR gRNA sequence
tatttttggcagtacaattt

SEQ ID NO: 312499 - DNA, 20 bp, Artificial
  CRISPR gRNA sequence
ttggcagtacaattttaaag

SEQ ID NO: 312500 - DNA, 20 bp, Artificial
  CRISPR gRNA sequence
tggcagtacaattttaaagt

SEQ ID NO: 312501 - DNA, 20 bp, Artificial
  CRISPR gRNA sequence
ggcagtacaattttaaagtg

SEQ ID NO: 312502 - DNA, 20 bp, Artificial
  CRISPR gRNA sequence
gcagtacaattttaaagtgg

SEQ ID NO: 312503 - DNA, 20 bp, Artificial
  CRISPR gRNA sequence
taaagtggaatagaaagccc

SEQ ID NO: 312504 - DNA, 20 bp, Artificial
  CRISPR gRNA sequence
aaagtggaatagaaagccca

SEQ ID NO: 312505 - DNA, 20 bp, Artificial
  CRISPR gRNA sequence
aagtggaatagaaagcccat

SEQ ID NO: 312506 - DNA, 20 bp, Artificial
  CRISPR gRNA sequence
ccagtaattcacacacgatg

SEQ ID NO: 312507 - DNA, 20 bp, Artificial
  CRISPR gRNA sequence
acacacgatgaaaagcaaca

SEQ ID NO: 312508 - DNA, 20 bp, Artificial
  CRISPR gRNA sequence
tatttgaattctttcttctc

SEQ ID NO: 312509 - DNA, 20 bp, Artificial
  CRISPR gRNA sequence
tttgaattctttcttctcag

SEQ ID NO: 312510 - DNA, 20 bp, Artificial
  CRISPR gRNA sequence
gaattctttcttctcagggc

SEQ ID NO: 312511 - DNA, 20 bp, Artificial
  CRISPR gRNA sequence
aattctttcttctcagggca

SEQ ID NO: 312512 - DNA, 20 bp, Artificial
  CRISPR gRNA sequence
tttcttctcagggcacacct

SEQ ID NO: 312513 - DNA, 20 bp, Artificial
  CRISPR gRNA sequence
tcttctcagggcacacctct

SEQ ID NO: 312514 - DNA, 20 bp, Artificial
  CRISPR gRNA sequence
cttctcagggcacacctctg

SEQ ID NO: 312515 - DNA, 20 bp, Artificial
  CRISPR gRNA sequence
ttctcagggcacacctctgc

SEQ ID NO: 312516 - DNA, 20 bp, Artificial
  CRISPR gRNA sequence
ctcagggcacacctctgctt

SEQ ID NO: 312517 - DNA, 20 bp, Artificial
  CRISPR gRNA sequence
tcagggcacacctctgctta

SEQ ID NO: 312518 - DNA, 20 bp, Artificial
  CRISPR gRNA sequence
agggcacacctctgcttact

SEQ ID NO: 312519 - DNA, 20 bp, Artificial
  CRISPR gRNA sequence
tgcttactgggctggtgaac

SEQ ID NO: 312520 - DNA, 20 bp, Artificial
  CRISPR gRNA sequence
cttactgggctggtgaacag

SEQ ID NO: 312521 - DNA, 20 bp, Artificial
  CRISPR gRNA sequence
actgggctggtgaacagtga

SEQ ID NO: 312522 - DNA, 20 bp, Artificial
  CRISPR gRNA sequence
ctgggctggtgaacagtgac

SEQ ID NO: 312523 - DNA, 20 bp, Artificial
  CRISPR gRNA sequence
ggctggtgaacagtgaccta

SEQ ID NO: 312524 - DNA, 20 bp, Artificial
  CRISPR gRNA sequence
gtgaacagtgacctagccac

SEQ ID NO: 312525 - DNA, 20 bp, Artificial
  CRISPR gRNA sequence
gccacagggccggcttccaa

SEQ ID NO: 312526 - DNA, 20 bp, Artificial
  CRISPR gRNA sequence
ccaaagggagaaaggagatg

SEQ ID NO: 312527 - DNA, 20 bp, Artificial
  CRISPR gRNA sequence
caaagggagaaaggagatgc

SEQ ID NO: 312528 - DNA, 20 bp, Artificial
  CRISPR gRNA sequence
gcccacataatccaccctca

SEQ ID NO: 312529 - DNA, 20 bp, Artificial
  CRISPR gRNA sequence
aaaatgtagagctgaataat

SEQ ID NO: 312530 - DNA, 20 bp, Artificial
  CRISPR gRNA sequence
aataattcatttcatggcat

SEQ ID NO: 312531 - DNA, 20 bp, Artificial
  CRISPR gRNA sequence
atttcatggcatagaaatag

SEQ ID NO: 312532 - DNA, 20 bp, Artificial
  CRISPR gRNA sequence
catggcatagaaatagcaat

SEQ ID NO: 312533 - DNA, 20 bp, Artificial
  CRISPR gRNA sequence
atggcatagaaatagcaata

SEQ ID NO: 312534 - DNA, 20 bp, Artificial
  CRISPR gRNA sequence
tgtttaacttttccctccct

SEQ ID NO: 312535 - DNA, 20 bp, Artificial
  CRISPR gRNA sequence
tttaacttttccctccctat

SEQ ID NO: 312536 - DNA, 20 bp, Artificial
  CRISPR gRNA sequence
aacttttccctccctatatt

SEQ ID NO: 312537 - DNA, 20 bp, Artificial
  CRISPR gRNA sequence
acttttccctccctatattt

SEQ ID NO: 312538 - DNA, 20 bp, Artificial
  CRISPR gRNA sequence
ttccctccctatattttgtg

SEQ ID NO: 312539 - DNA, 20 bp, Artificial
  CRISPR gRNA sequence
tccctccctatattttgtgt

SEQ ID NO: 312540 - DNA, 20 bp, Artificial
  CRISPR gRNA sequence
ccctccctatattttgtgtc

SEQ ID NO: 312541 - DNA, 20 bp, Artificial
  CRISPR gRNA sequence
cctccctatattttgtgtcc

SEQ ID NO: 312542 - DNA, 20 bp, Artificial
  CRISPR gRNA sequence
cctatattttgtgtcctctg

SEQ ID NO: 312543 - DNA, 20 bp, Artificial
  CRISPR gRNA sequence
tattttgtgtcctctgtcat

SEQ ID NO: 312544 - DNA, 20 bp, Artificial
  CRISPR gRNA sequence
tgtgtcctctgtcatggaaa

SEQ ID NO: 312545 - DNA, 20 bp, Artificial
  CRISPR gRNA sequence
gtgtcctctgtcatggaaat

SEQ ID NO: 312546 - DNA, 20 bp, Artificial
  CRISPR gRNA sequence
tgtcctctgtcatggaaatt

SEQ ID NO: 312547 - DNA, 20 bp, Artificial
  CRISPR gRNA sequence
tgtcatggaaatttgacaca

SEQ ID NO: 312548 - DNA, 20 bp, Artificial
  CRISPR gRNA sequence
tcatggaaatttgacacagt

SEQ ID NO: 312549 - DNA, 20 bp, Artificial
  CRISPR gRNA sequence
gacacagtagtatttgctgc

SEQ ID NO: 312550 - DNA, 20 bp, Artificial
  CRISPR gRNA sequence
acacagtagtatttgctgcc

SEQ ID NO: 312551 - DNA, 20 bp, Artificial
  CRISPR gRNA sequence
gctgcccctgctcttgagga

SEQ ID NO: 312552 - DNA, 20 bp, Artificial
  CRISPR gRNA sequence
ctgcccctgctcttgaggat

SEQ ID NO: 312553 - DNA, 20 bp, Artificial
  CRISPR gRNA sequence
cccctgctcttgaggataaa

SEQ ID NO: 312554 - DNA, 20 bp, Artificial
  CRISPR gRNA sequence
ctcttgaggataaaattgga

SEQ ID NO: 312555 - DNA, 20 bp, Artificial
  CRISPR gRNA sequence
ttgaggataaaattggatgg

SEQ ID NO: 312556 - DNA, 20 bp, Artificial
  CRISPR gRNA sequence
gaggataaaattggatggga

SEQ ID NO: 312557 - DNA, 20 bp, Artificial
  CRISPR gRNA sequence
aggataaaattggatgggag

SEQ ID NO: 312558 - DNA, 20 bp, Artificial
  CRISPR gRNA sequence
gatgggagtttaagactgaa

SEQ ID NO: 312559 - DNA, 20 bp, Artificial
  CRISPR gRNA sequence
aagactgaaacgggcacctg

SEQ ID NO: 312560 - DNA, 20 bp, Artificial
  CRISPR gRNA sequence
agactgaaacgggcacctgt

SEQ ID NO: 312561 - DNA, 20 bp, Artificial
  CRISPR gRNA sequence
aaacgggcacctgtggcctt

SEQ ID NO: 312562 - DNA, 20 bp, Artificial
  CRISPR gRNA sequence
tggccttgcagaattaggtt

SEQ ID NO: 312563 - DNA, 20 bp, Artificial
  CRISPR gRNA sequence
gcagaattaggttacagttt

SEQ ID NO: 312564 - DNA, 20 bp, Artificial
  CRISPR gRNA sequence
cagaattaggttacagtttg

SEQ ID NO: 312565 - DNA, 20 bp, Artificial
  CRISPR gRNA sequence
ggttacagtttgtgccttgt

SEQ ID NO: 312566 - DNA, 20 bp, Artificial
  CRISPR gRNA sequence
cagtttgtgccttgtattta

SEQ ID NO: 312567 - DNA, 20 bp, Artificial
  CRISPR gRNA sequence
gtgccttgtatttacaaagc

SEQ ID NO: 312568 - DNA, 20 bp, Artificial
  CRISPR gRNA sequence
tgccttgtatttacaaagcg

SEQ ID NO: 312569 - DNA, 20 bp, Artificial
  CRISPR gRNA sequence
gtatttacaaagcgaaagga

SEQ ID NO: 312570 - DNA, 20 bp, Artificial
  CRISPR gRNA sequence
tatttacaaagcgaaaggaa

SEQ ID NO: 312571 - DNA, 20 bp, Artificial
  CRISPR gRNA sequence
acaaagcgaaaggaattcct

SEQ ID NO: 312572 - DNA, 20 bp, Artificial
  CRISPR gRNA sequence
caaagcgaaaggaattccta

SEQ ID NO: 312573 - DNA, 20 bp, Artificial
  CRISPR gRNA sequence
ctagtgccacctgcagaggc

SEQ ID NO: 312574 - DNA, 20 bp, Artificial
  CRISPR gRNA sequence
gtgccacctgcagaggcact

SEQ ID NO: 312575 - DNA, 20 bp, Artificial
  CRISPR gRNA sequence
cagaggcacttctaactttc

SEQ ID NO: 312576 - DNA, 20 bp, Artificial
  CRISPR gRNA sequence
ctaactttcaagctctgttt

SEQ ID NO: 312577 - DNA, 20 bp, Artificial
  CRISPR gRNA sequence
taactttcaagctctgtttg

SEQ ID NO: 312578 - DNA, 20 bp, Artificial
  CRISPR gRNA sequence
actttcaagctctgtttgcc

SEQ ID NO: 312579 - DNA, 20 bp, Artificial
  CRISPR gRNA sequence
tcaagctctgtttgccactg

SEQ ID NO: 312580 - DNA, 20 bp, Artificial
  CRISPR gRNA sequence
caagctctgtttgccactgt

SEQ ID NO: 312581 - DNA, 20 bp, Artificial
  CRISPR gRNA sequence
aagctctgtttgccactgtc

SEQ ID NO: 312582 - DNA, 20 bp, Artificial
  CRISPR gRNA sequence
tgtttgccactgtcctggca

SEQ ID NO: 312583 - DNA, 20 bp, Artificial
  CRISPR gRNA sequence
tttgccactgtcctggcacc

SEQ ID NO: 312584 - DNA, 20 bp, Artificial
  CRISPR gRNA sequence
gccactgtcctggcacctcc

SEQ ID NO: 312585 - DNA, 20 bp, Artificial
  CRISPR gRNA sequence
ccactgtcctggcacctcca

SEQ ID NO: 312586 - DNA, 20 bp, Artificial
  CRISPR gRNA sequence
tcctggcacctccatcacac

SEQ ID NO: 312587 - DNA, 20 bp, Artificial
  CRISPR gRNA sequence
gcacctccatcacactttta

SEQ ID NO: 312588 - DNA, 20 bp, Artificial
  CRISPR gRNA sequence
catcacacttttaggctgga

SEQ ID NO: 312589 - DNA, 20 bp, Artificial
  CRISPR gRNA sequence
ttaggctggagccagagagg

SEQ ID NO: 312590 - DNA, 20 bp, Artificial
  CRISPR gRNA sequence
taggctggagccagagaggt

SEQ ID NO: 312591 - DNA, 20 bp, Artificial
  CRISPR gRNA sequence
aggctggagccagagaggtt

SEQ ID NO: 312592 - DNA, 20 bp, Artificial
  CRISPR gRNA sequence
ggctggagccagagaggttt

SEQ ID NO: 312593 - DNA, 20 bp, Artificial
  CRISPR gRNA sequence
gagccagagaggtttttgaa

SEQ ID NO: 312594 - DNA, 20 bp, Artificial
  CRISPR gRNA sequence
ttgaaaaatcagtagctccc

SEQ ID NO: 312595 - DNA, 20 bp, Artificial
  CRISPR gRNA sequence
tgaaaaatcagtagctccca

SEQ ID NO: 312596 - DNA, 20 bp, Artificial
  CRISPR gRNA sequence
gaaaaatcagtagctcccac

SEQ ID NO: 312597 - DNA, 20 bp, Artificial
  CRISPR gRNA sequence
aaaaatcagtagctcccaca

SEQ ID NO: 312598 - DNA, 20 bp, Artificial
  CRISPR gRNA sequence
ccacatcaggaggaagtatc

SEQ ID NO: 312599 - DNA, 20 bp, Artificial
  CRISPR gRNA sequence
tccagtttgagttttggtag

SEQ ID NO: 312600 - DNA, 20 bp, Artificial
  CRISPR gRNA sequence
ccagtttgagttttggtagc

SEQ ID NO: 312601 - DNA, 20 bp, Artificial
  CRISPR gRNA sequence
cagtttgagttttggtagct

SEQ ID NO: 312602 - DNA, 20 bp, Artificial
  CRISPR gRNA sequence
gagttttggtagctgctctc

SEQ ID NO: 312603 - DNA, 20 bp, Artificial
  CRISPR gRNA sequence
agttttggtagctgctctct

SEQ ID NO: 312604 - DNA, 20 bp, Artificial
  CRISPR gRNA sequence
tggtagctgctctctttttg

SEQ ID NO: 312605 - DNA, 20 bp, Artificial
  CRISPR gRNA sequence
ggtagctgctctctttttgt

SEQ ID NO: 312606 - DNA, 20 bp, Artificial
  CRISPR gRNA sequence
gtagctgctctctttttgtc

SEQ ID NO: 312607 - DNA, 20 bp, Artificial
  CRISPR gRNA sequence
ctctctttttgtctgagggt

SEQ ID NO: 312608 - DNA, 20 bp, Artificial
  CRISPR gRNA sequence
tctttttgtctgagggttct

SEQ ID NO: 312609 - DNA, 20 bp, Artificial
  CRISPR gRNA sequence
tttttgtctgagggttctct

SEQ ID NO: 312610 - DNA, 20 bp, Artificial
  CRISPR gRNA sequence
tttgtctgagggttctctgg

SEQ ID NO: 312611 - DNA, 20 bp, Artificial
  CRISPR gRNA sequence
ttgtctgagggttctctggg

SEQ ID NO: 312612 - DNA, 20 bp, Artificial
  CRISPR gRNA sequence
tgtctgagggttctctgggt

SEQ ID NO: 312613 - DNA, 20 bp, Artificial
  CRISPR gRNA sequence
gtctgagggttctctgggtc

SEQ ID NO: 312614 - DNA, 20 bp, Artificial
  CRISPR gRNA sequence
tctgagggttctctgggtcc

SEQ ID NO: 312615 - DNA, 20 bp, Artificial
  CRISPR gRNA sequence
agggttctctgggtcctagg

SEQ ID NO: 312616 - DNA, 20 bp, Artificial
  CRISPR gRNA sequence
tctgggtcctagggctttct

SEQ ID NO: 312617 - DNA, 20 bp, Artificial
  CRISPR gRNA sequence
tgggtcctagggctttctca

SEQ ID NO: 312618 - DNA, 20 bp, Artificial
  CRISPR gRNA sequence
ggtcctagggctttctcatt

SEQ ID NO: 312619 - DNA, 20 bp, Artificial
  CRISPR gRNA sequence
gggctttctcatttctcttg

SEQ ID NO: 312620 - DNA, 20 bp, Artificial
  CRISPR gRNA sequence
tctcatttctcttgaacaac

SEQ ID NO: 312621 - DNA, 20 bp, Artificial
  CRISPR gRNA sequence
ctcatttctcttgaacaaca

SEQ ID NO: 312622 - DNA, 20 bp, Artificial
  CRISPR gRNA sequence
tcatttctcttgaacaacac

SEQ ID NO: 312623 - DNA, 20 bp, Artificial
  CRISPR gRNA sequence
atttctcttgaacaacacct

SEQ ID NO: 312624 - DNA, 20 bp, Artificial
  CRISPR gRNA sequence
ctcttgaacaacacctctag

SEQ ID NO: 312625 - DNA, 20 bp, Artificial
  CRISPR gRNA sequence
tcttgaacaacacctctagt

SEQ ID NO: 312626 - DNA, 20 bp, Artificial
  CRISPR gRNA sequence
ttgaacaacacctctagtta

SEQ ID NO: 312627 - DNA, 20 bp, Artificial
  CRISPR gRNA sequence
gaacaacacctctagttaat

SEQ ID NO: 312628 - DNA, 20 bp, Artificial
  CRISPR gRNA sequence
aacaacacctctagttaatt

SEQ ID NO: 312629 - DNA, 20 bp, Artificial
  CRISPR gRNA sequence
tagttaatttcatgtacctg

SEQ ID NO: 312630 - DNA, 20 bp, Artificial
  CRISPR gRNA sequence
gttaatttcatgtacctgga

SEQ ID NO: 312631 - DNA, 20 bp, Artificial
  CRISPR gRNA sequence
atttcatgtacctggagtgg

SEQ ID NO: 312632 - DNA, 20 bp, Artificial
  CRISPR gRNA sequence
catgtacctggagtggtagt

SEQ ID NO: 312633 - DNA, 20 bp, Artificial
  CRISPR gRNA sequence
atgtacctggagtggtagtt

SEQ ID NO: 312634 - DNA, 20 bp, Artificial
  CRISPR gRNA sequence
gagtggtagttggaatattt

SEQ ID NO: 312635 - DNA, 20 bp, Artificial
  CRISPR gRNA sequence
gaatatttcttcactttaag

SEQ ID NO: 312636 - DNA, 20 bp, Artificial
  CRISPR gRNA sequence
cttcactttaagattttttt

SEQ ID NO: 312637 - DNA, 20 bp, Artificial
  CRISPR gRNA sequence
ttcactttaagatttttttt

SEQ ID NO: 312638 - DNA, 20 bp, Artificial
  CRISPR gRNA sequence
cactttaagatttttttttt

SEQ ID NO: 312639 - DNA, 20 bp, Artificial
  CRISPR gRNA sequence
actttaagattttttttttt

SEQ ID NO: 312640 - DNA, 20 bp, Artificial
  CRISPR gRNA sequence
taagattttttttttttttt

SEQ ID NO: 312641 - DNA, 20 bp, Artificial
  CRISPR gRNA sequence
aagatttttttttttttttt

SEQ ID NO: 312642 - DNA, 20 bp, Artificial
  CRISPR gRNA sequence
agattttttttttttttttt

SEQ ID NO: 312643 - DNA, 20 bp, Artificial
  CRISPR gRNA sequence
tttttttttttttttgagat

SEQ ID NO: 312644 - DNA, 20 bp, Artificial
  CRISPR gRNA sequence
ttttttttttttttgagatg

SEQ ID NO: 312645 - DNA, 20 bp, Artificial
  CRISPR gRNA sequence
tttttttttttttgagatgg

SEQ ID NO: 312646 - DNA, 20 bp, Artificial
  CRISPR gRNA sequence
ttttttttttttgagatgga

SEQ ID NO: 312647 - DNA, 20 bp, Artificial
  CRISPR gRNA sequence
tttttttttttgagatggag

SEQ ID NO: 312648 - DNA, 20 bp, Artificial
  CRISPR gRNA sequence
ttttttttttgagatggagt

SEQ ID NO: 312649 - DNA, 20 bp, Artificial
  CRISPR gRNA sequence
tttttttttgagatggagtc

SEQ ID NO: 312650 - DNA, 20 bp, Artificial
  CRISPR gRNA sequence
ttttttttgagatggagtct

SEQ ID NO: 312651 - DNA, 20 bp, Artificial
  CRISPR gRNA sequence
tttttttgagatggagtctc

SEQ ID NO: 312652 - DNA, 20 bp, Artificial
  CRISPR gRNA sequence
ttttttgagatggagtctca

SEQ ID NO: 312653 - DNA, 20 bp, Artificial
  CRISPR gRNA sequence
tttttgagatggagtctcac

SEQ ID NO: 312654 - DNA, 20 bp, Artificial
  CRISPR gRNA sequence
ttttgagatggagtctcact

SEQ ID NO: 312655 - DNA, 20 bp, Artificial
  CRISPR gRNA sequence
tttgagatggagtctcactc

SEQ ID NO: 312656 - DNA, 20 bp, Artificial
  CRISPR gRNA sequence
ttgagatggagtctcactct

SEQ ID NO: 312657 - DNA, 20 bp, Artificial
  CRISPR gRNA sequence
tgagatggagtctcactctg

SEQ ID NO: 312658 - DNA, 20 bp, Artificial
  CRISPR gRNA sequence
gagatggagtctcactctgt

SEQ ID NO: 312659 - DNA, 20 bp, Artificial
  CRISPR gRNA sequence
agatggagtctcactctgtt

SEQ ID NO: 312660 - DNA, 20 bp, Artificial
  CRISPR gRNA sequence
actctgttgcccaggctaaa

SEQ ID NO: 312661 - DNA, 20 bp, Artificial
  CRISPR gRNA sequence
tgttgcccaggctaaagtgc

SEQ ID NO: 312662 - DNA, 20 bp, Artificial
  CRISPR gRNA sequence
ttgcccaggctaaagtgcaa

SEQ ID NO: 312663 - DNA, 20 bp, Artificial
  CRISPR gRNA sequence
cccaggctaaagtgcaatgg

SEQ ID NO: 312664 - DNA, 20 bp, Artificial
  CRISPR gRNA sequence
aagtgcaatggcatgatctt

SEQ ID NO: 312665 - DNA, 20 bp, Artificial
  CRISPR gRNA sequence
ggctcacggcaacccccgcc

SEQ ID NO: 312666 - DNA, 20 bp, Artificial
  CRISPR gRNA sequence
gctcacggcaacccccgcct

SEQ ID NO: 312667 - DNA, 20 bp, Artificial
  CRISPR gRNA sequence
acggcaacccccgcctccca

SEQ ID NO: 312668 - DNA, 20 bp, Artificial
  CRISPR gRNA sequence
ccaggttcaagtgattctct

SEQ ID NO: 312669 - DNA, 20 bp, Artificial
  CRISPR gRNA sequence
aagtgattctcttgcctcag

SEQ ID NO: 312670 - DNA, 20 bp, Artificial
  CRISPR gRNA sequence
tcttgcctcagcctcccaag

SEQ ID NO: 312671 - DNA, 20 bp, Artificial
  CRISPR gRNA sequence
ttgcctcagcctcccaagta

SEQ ID NO: 312672 - DNA, 20 bp, Artificial
  CRISPR gRNA sequence
gcctcagcctcccaagtagc

SEQ ID NO: 312673 - DNA, 20 bp, Artificial
  CRISPR gRNA sequence
cctcagcctcccaagtagct

SEQ ID NO: 312674 - DNA, 20 bp, Artificial
  CRISPR gRNA sequence
agcctcccaagtagctggga

SEQ ID NO: 312675 - DNA, 20 bp, Artificial
  CRISPR gRNA sequence
ccaagtagctgggattacac

SEQ ID NO: 312676 - DNA, 20 bp, Artificial
  CRISPR gRNA sequence
ggattacacctaccaccaca

SEQ ID NO: 312677 - DNA, 20 bp, Artificial
  CRISPR gRNA sequence
cacctaccaccacaaaatac

SEQ ID NO: 312678 - DNA, 20 bp, Artificial
  CRISPR gRNA sequence
ccaccacaaaatacaaaaat

SEQ ID NO: 312679 - DNA, 20 bp, Artificial
  CRISPR gRNA sequence
ttgtatttttggtagagacg

SEQ ID NO: 312680 - DNA, 20 bp, Artificial
  CRISPR gRNA sequence
tgtatttttggtagagacgg

SEQ ID NO: 312681 - DNA, 20 bp, Artificial
  CRISPR gRNA sequence
gtatttttggtagagacggg

SEQ ID NO: 312682 - DNA, 20 bp, Artificial
  CRISPR gRNA sequence
tatttttggtagagacgggg

SEQ ID NO: 312683 - DNA, 20 bp, Artificial
  CRISPR gRNA sequence
ttggtagagacggggtttca

SEQ ID NO: 312684 - DNA, 20 bp, Artificial
  CRISPR gRNA sequence
tggtagagacggggtttcac

SEQ ID NO: 312685 - DNA, 20 bp, Artificial
  CRISPR gRNA sequence
ggtagagacggggtttcacc

SEQ ID NO: 312686 - DNA, 20 bp, Artificial
  CRISPR gRNA sequence
gtagagacggggtttcacca

SEQ ID NO: 312687 - DNA, 20 bp, Artificial
  CRISPR gRNA sequence
caccatgttggccatgctag

SEQ ID NO: 312688 - DNA, 20 bp, Artificial
  CRISPR gRNA sequence
accatgttggccatgctagt

SEQ ID NO: 312689 - DNA, 20 bp, Artificial
  CRISPR gRNA sequence
gccatgctagtctcgaactc

SEQ ID NO: 312690 - DNA, 20 bp, Artificial
  CRISPR gRNA sequence
gtctcgaactcctgacctca

SEQ ID NO: 312691 - DNA, 20 bp, Artificial
  CRISPR gRNA sequence
gaactcctgacctcaggtga

SEQ ID NO: 312692 - DNA, 20 bp, Artificial
  CRISPR gRNA sequence
ctgacctcaggtgatctgcc

SEQ ID NO: 312693 - DNA, 20 bp, Artificial
  CRISPR gRNA sequence
acctcaggtgatctgcccgc

SEQ ID NO: 312694 - DNA, 20 bp, Artificial
  CRISPR gRNA sequence
aggtgatctgcccgcctcga

SEQ ID NO: 312695 - DNA, 20 bp, Artificial
  CRISPR gRNA sequence
cccgcctcgacctcccaaag

SEQ ID NO: 312696 - DNA, 20 bp, Artificial
  CRISPR gRNA sequence
gacctcccaaagtgctggga

SEQ ID NO: 312697 - DNA, 20 bp, Artificial
  CRISPR gRNA sequence
ccaaagtgctgggattacag

SEQ ID NO: 312698 - DNA, 20 bp, Artificial
  CRISPR gRNA sequence
ggattacagacaggcatgag

SEQ ID NO: 312699 - DNA, 20 bp, Artificial
  CRISPR gRNA sequence
cagacaggcatgagccactg

SEQ ID NO: 312700 - DNA, 20 bp, Artificial
  CRISPR gRNA sequence
cgcccggcccaccttaagat

SEQ ID NO: 312701 - DNA, 20 bp, Artificial
  CRISPR gRNA sequence
aagatttatgtaagattggc

SEQ ID NO: 312702 - DNA, 20 bp, Artificial
  CRISPR gRNA sequence
agatttatgtaagattggct

SEQ ID NO: 312703 - DNA, 20 bp, Artificial
  CRISPR gRNA sequence
atgtaagattggctcaaaag

SEQ ID NO: 312704 - DNA, 20 bp, Artificial
  CRISPR gRNA sequence
tgtaagattggctcaaaagc

SEQ ID NO: 312705 - DNA, 20 bp, Artificial
  CRISPR gRNA sequence
gctcaaaagctcattcctgt

SEQ ID NO: 312706 - DNA, 20 bp, Artificial
  CRISPR gRNA sequence
aaaagctcattcctgtggaa

SEQ ID NO: 312707 - DNA, 20 bp, Artificial
  CRISPR gRNA sequence
attcctgtggaaaggtccac

SEQ ID NO: 312708 - DNA, 20 bp, Artificial
  CRISPR gRNA sequence
ctgtggaaaggtccactgtt

SEQ ID NO: 312709 - DNA, 20 bp, Artificial
  CRISPR gRNA sequence
tggaaaggtccactgttttc

SEQ ID NO: 312710 - DNA, 20 bp, Artificial
  CRISPR gRNA sequence
ttttcctcccaagatttttg

SEQ ID NO: 312711 - DNA, 20 bp, Artificial
  CRISPR gRNA sequence
tcctcccaagatttttgcag

SEQ ID NO: 312712 - DNA, 20 bp, Artificial
  CRISPR gRNA sequence
cctcccaagatttttgcaga

SEQ ID NO: 312713 - DNA, 20 bp, Artificial
  CRISPR gRNA sequence
ctcccaagatttttgcagat

SEQ ID NO: 312714 - DNA, 20 bp, Artificial
  CRISPR gRNA sequence
ccaagatttttgcagatatc

SEQ ID NO: 312715 - DNA, 20 bp, Artificial
  CRISPR gRNA sequence
ttgcagatatctgcgtgggt

SEQ ID NO: 312716 - DNA, 20 bp, Artificial
  CRISPR gRNA sequence
tgcagatatctgcgtgggtg

SEQ ID NO: 312717 - DNA, 20 bp, Artificial
  CRISPR gRNA sequence
gcagatatctgcgtgggtgg

SEQ ID NO: 312718 - DNA, 20 bp, Artificial
  CRISPR gRNA sequence
cagatatctgcgtgggtggt

SEQ ID NO: 312719 - DNA, 20 bp, Artificial
  CRISPR gRNA sequence
cgtgggtggttacttttgac

SEQ ID NO: 312720 - DNA, 20 bp, Artificial
  CRISPR gRNA sequence
cttttgactcccatttcctg

SEQ ID NO: 312721 - DNA, 20 bp, Artificial
  CRISPR gRNA sequence
ttgactcccatttcctgctg

SEQ ID NO: 312722 - DNA, 20 bp, Artificial
  CRISPR gRNA sequence
tgactcccatttcctgctgt

SEQ ID NO: 312723 - DNA, 20 bp, Artificial
  CRISPR gRNA sequence
gactcccatttcctgctgtt

SEQ ID NO: 312724 - DNA, 20 bp, Artificial
  CRISPR gRNA sequence
actcccatttcctgctgttg

SEQ ID NO: 312725 - DNA, 20 bp, Artificial
  CRISPR gRNA sequence
ccatttcctgctgttgttga

SEQ ID NO: 312726 - DNA, 20 bp, Artificial
  CRISPR gRNA sequence
cctgctgttgttgatagccc

SEQ ID NO: 312727 - DNA, 20 bp, Artificial
  CRISPR gRNA sequence
ctgctgttgttgatagccct

SEQ ID NO: 312728 - DNA, 20 bp, Artificial
  CRISPR gRNA sequence
ctgttgttgatagccctcat

SEQ ID NO: 312729 - DNA, 20 bp, Artificial
  CRISPR gRNA sequence
ttgttgatagccctcattaa

SEQ ID NO: 312730 - DNA, 20 bp, Artificial
  CRISPR gRNA sequence
ttgatagccctcattaaaac

SEQ ID NO: 312731 - DNA, 20 bp, Artificial
  CRISPR gRNA sequence
atagccctcattaaaaccat

SEQ ID NO: 312732 - DNA, 20 bp, Artificial
  CRISPR gRNA sequence
attaaaaccatcacctggag

SEQ ID NO: 312733 - DNA, 20 bp, Artificial
  CRISPR gRNA sequence
aaaccatcacctggaggtga

SEQ ID NO: 312734 - DNA, 20 bp, Artificial
  CRISPR gRNA sequence
gaggtgaatagacagtcgag

SEQ ID NO: 312735 - DNA, 20 bp, Artificial
  CRISPR gRNA sequence
tcattcccaaagaattgtca

SEQ ID NO: 312736 - DNA, 20 bp, Artificial
  CRISPR gRNA sequence
ccaaagaattgtcatggagc

SEQ ID NO: 312737 - DNA, 20 bp, Artificial
  CRISPR gRNA sequence
tcatggagcctaatagttct

SEQ ID NO: 312738 - DNA, 20 bp, Artificial
  CRISPR gRNA sequence
atagttctattggattcacc

SEQ ID NO: 312739 - DNA, 20 bp, Artificial
  CRISPR gRNA sequence
tattggattcacccctttat

SEQ ID NO: 312740 - DNA, 20 bp, Artificial
  CRISPR gRNA sequence
ttggattcacccctttatgt

SEQ ID NO: 312741 - DNA, 20 bp, Artificial
  CRISPR gRNA sequence
gattcacccctttatgttaa

SEQ ID NO: 312742 - DNA, 20 bp, Artificial
  CRISPR gRNA sequence
acccctttatgttaagccac

SEQ ID NO: 312743 - DNA, 20 bp, Artificial
  CRISPR gRNA sequence
tatgttaagccaccatttca

SEQ ID NO: 312744 - DNA, 20 bp, Artificial
  CRISPR gRNA sequence
atgttaagccaccatttcag

SEQ ID NO: 312745 - DNA, 20 bp, Artificial
  CRISPR gRNA sequence
tgttaagccaccatttcagt

SEQ ID NO: 312746 - DNA, 20 bp, Artificial
  CRISPR gRNA sequence
agccaccatttcagtgtttt

SEQ ID NO: 312747 - DNA, 20 bp, Artificial
  CRISPR gRNA sequence
cagtgtttttcaaaatagat

SEQ ID NO: 312748 - DNA, 20 bp, Artificial
  CRISPR gRNA sequence
agtgtttttcaaaatagata

SEQ ID NO: 312749 - DNA, 20 bp, Artificial
  CRISPR gRNA sequence
ttcaaaatagatatatgtta

SEQ ID NO: 312750 - DNA, 20 bp, Artificial
  CRISPR gRNA sequence
tcaaaatagatatatgttat

SEQ ID NO: 312751 - DNA, 20 bp, Artificial
  CRISPR gRNA sequence
caaaatagatatatgttatc

SEQ ID NO: 312752 - DNA, 20 bp, Artificial
  CRISPR gRNA sequence
aaaatagatatatgttatct

SEQ ID NO: 312753 - DNA, 20 bp, Artificial
  CRISPR gRNA sequence
tctagtagggagtatcttac

SEQ ID NO: 312754 - DNA, 20 bp, Artificial
  CRISPR gRNA sequence
gtagggagtatcttaccccc

SEQ ID NO: 312755 - DNA, 20 bp, Artificial
  CRISPR gRNA sequence
acccccaaattagttgattg

SEQ ID NO: 312756 - DNA, 20 bp, Artificial
  CRISPR gRNA sequence
cccccaaattagttgattgt

SEQ ID NO: 312757 - DNA, 20 bp, Artificial
  CRISPR gRNA sequence
gttgattgtttcaggagggc

SEQ ID NO: 312758 - DNA, 20 bp, Artificial
  CRISPR gRNA sequence
attgtttcaggagggctttt

SEQ ID NO: 312759 - DNA, 20 bp, Artificial
  CRISPR gRNA sequence
tttcaggagggcttttagtg

SEQ ID NO: 312760 - DNA, 20 bp, Artificial
  CRISPR gRNA sequence
caggagggcttttagtgggt

SEQ ID NO: 312761 - DNA, 20 bp, Artificial
  CRISPR gRNA sequence
aggagggcttttagtgggtt

SEQ ID NO: 312762 - DNA, 20 bp, Artificial
  CRISPR gRNA sequence
ttagtgggttccagagaaaa

SEQ ID NO: 312763 - DNA, 20 bp, Artificial
  CRISPR gRNA sequence
tagtgggttccagagaaaat

SEQ ID NO: 312764 - DNA, 20 bp, Artificial
  CRISPR gRNA sequence
agtgggttccagagaaaatg

SEQ ID NO: 312765 - DNA, 20 bp, Artificial
  CRISPR gRNA sequence
gtgggttccagagaaaatga

SEQ ID NO: 312766 - DNA, 20 bp, Artificial
  CRISPR gRNA sequence
cagagaaaatgagcaatcag

SEQ ID NO: 312767 - DNA, 20 bp, Artificial
  CRISPR gRNA sequence
atttagtggaagacagtcac

SEQ ID NO: 312768 - DNA, 20 bp, Artificial
  CRISPR gRNA sequence
agtggaagacagtcactgaa

SEQ ID NO: 312769 - DNA, 20 bp, Artificial
  CRISPR gRNA sequence
gtggaagacagtcactgaat

SEQ ID NO: 312770 - DNA, 20 bp, Artificial
  CRISPR gRNA sequence
aataggatgtgtatagggtt

SEQ ID NO: 312771 - DNA, 20 bp, Artificial
  CRISPR gRNA sequence
tttgggagcaagagtgaaat

SEQ ID NO: 312772 - DNA, 20 bp, Artificial
  CRISPR gRNA sequence
gggagcaagagtgaaattgg

SEQ ID NO: 312773 - DNA, 20 bp, Artificial
  CRISPR gRNA sequence
ggagcaagagtgaaattggt

SEQ ID NO: 312774 - DNA, 20 bp, Artificial
  CRISPR gRNA sequence
gtatggaacagagaggctcc

SEQ ID NO: 312775 - DNA, 20 bp, Artificial
  CRISPR gRNA sequence
ccaaggcaagcagacatttt

SEQ ID NO: 312776 - DNA, 20 bp, Artificial
  CRISPR gRNA sequence
tttttggaagaagcaagtgt

SEQ ID NO: 312777 - DNA, 20 bp, Artificial
  CRISPR gRNA sequence
ttttggaagaagcaagtgtt

SEQ ID NO: 312778 - DNA, 20 bp, Artificial
  CRISPR gRNA sequence
tttggaagaagcaagtgttt

SEQ ID NO: 312779 - DNA, 20 bp, Artificial
  CRISPR gRNA sequence
ttggaagaagcaagtgtttg

SEQ ID NO: 312780 - DNA, 20 bp, Artificial
  CRISPR gRNA sequence
tggaagaagcaagtgtttga

SEQ ID NO: 312781 - DNA, 20 bp, Artificial
  CRISPR gRNA sequence
ggaagaagcaagtgtttgag

SEQ ID NO: 312782 - DNA, 20 bp, Artificial
  CRISPR gRNA sequence
gaagaagcaagtgtttgaga

SEQ ID NO: 312783 - DNA, 20 bp, Artificial
  CRISPR gRNA sequence
gagagactgtggcttatttt

SEQ ID NO: 312784 - DNA, 20 bp, Artificial
  CRISPR gRNA sequence
agagactgtggcttattttt

SEQ ID NO: 312785 - DNA, 20 bp, Artificial
  CRISPR gRNA sequence
tggcttatttttcctttgtg

SEQ ID NO: 312786 - DNA, 20 bp, Artificial
  CRISPR gRNA sequence
atttttcctttgtgagaggg

SEQ ID NO: 312787 - DNA, 20 bp, Artificial
  CRISPR gRNA sequence
tttttcctttgtgagagggg

SEQ ID NO: 312788 - DNA, 20 bp, Artificial
  CRISPR gRNA sequence
ttcctttgtgagaggggagt

SEQ ID NO: 312789 - DNA, 20 bp, Artificial
  CRISPR gRNA sequence
tcctttgtgagaggggagtt

SEQ ID NO: 312790 - DNA, 20 bp, Artificial
  CRISPR gRNA sequence
cctttgtgagaggggagttt

SEQ ID NO: 312791 - DNA, 20 bp, Artificial
  CRISPR gRNA sequence
ctttgtgagaggggagtttt

SEQ ID NO: 312792 - DNA, 20 bp, Artificial
  CRISPR gRNA sequence
tgtgagaggggagttttaat

SEQ ID NO: 312793 - DNA, 20 bp, Artificial
  CRISPR gRNA sequence
gtgagaggggagttttaata

SEQ ID NO: 312794 - DNA, 20 bp, Artificial
  CRISPR gRNA sequence
tgagaggggagttttaatac

SEQ ID NO: 312795 - DNA, 20 bp, Artificial
  CRISPR gRNA sequence
taataccatttccaaaatat

SEQ ID NO: 312796 - DNA, 20 bp, Artificial
  CRISPR gRNA sequence
aataccatttccaaaatatg

SEQ ID NO: 312797 - DNA, 20 bp, Artificial
  CRISPR gRNA sequence
ataccatttccaaaatatgt

SEQ ID NO: 312798 - DNA, 20 bp, Artificial
  CRISPR gRNA sequence
ccaaaatatgtaacctggta

SEQ ID NO: 312799 - DNA, 20 bp, Artificial
  CRISPR gRNA sequence
caaaatatgtaacctggtat

SEQ ID NO: 312800 - DNA, 20 bp, Artificial
  CRISPR gRNA sequence
gtattttgtccccagaagta

SEQ ID NO: 312801 - DNA, 20 bp, Artificial
  CRISPR gRNA sequence
tgtccccagaagtactgttg

SEQ ID NO: 312802 - DNA, 20 bp, Artificial
  CRISPR gRNA sequence
gtccccagaagtactgttga

SEQ ID NO: 312803 - DNA, 20 bp, Artificial
  CRISPR gRNA sequence
tccccagaagtactgttgag

SEQ ID NO: 312804 - DNA, 20 bp, Artificial
  CRISPR gRNA sequence
ttgagatttatggaagcaaa

SEQ ID NO: 312805 - DNA, 20 bp, Artificial
  CRISPR gRNA sequence
agatttatggaagcaaaaaa

SEQ ID NO: 312806 - DNA, 20 bp, Artificial
  CRISPR gRNA sequence
atggaagcaaaaaactctgt

SEQ ID NO: 312807 - DNA, 20 bp, Artificial
  CRISPR gRNA sequence
tggaagcaaaaaactctgtc

SEQ ID NO: 312808 - DNA, 20 bp, Artificial
  CRISPR gRNA sequence
tgtcacccaggctagaggag

SEQ ID NO: 312809 - DNA, 20 bp, Artificial
  CRISPR gRNA sequence
tcacccaggctagaggagtg

SEQ ID NO: 312810 - DNA, 20 bp, Artificial
  CRISPR gRNA sequence
gaggagtgcagtggtgctat

SEQ ID NO: 312811 - DNA, 20 bp, Artificial
  CRISPR gRNA sequence
tcaaagcttactgcagcctc

SEQ ID NO: 312812 - DNA, 20 bp, Artificial
  CRISPR gRNA sequence
actgcagcctctaattccca

SEQ ID NO: 312813 - DNA, 20 bp, Artificial
  CRISPR gRNA sequence
ctgcagcctctaattcccag

SEQ ID NO: 312814 - DNA, 20 bp, Artificial
  CRISPR gRNA sequence
cagcctctaattcccaggct

SEQ ID NO: 312815 - DNA, 20 bp, Artificial
  CRISPR gRNA sequence
taattcccaggctcaagaga

SEQ ID NO: 312816 - DNA, 20 bp, Artificial
  CRISPR gRNA sequence
attcccaggctcaagagatg

SEQ ID NO: 312817 - DNA, 20 bp, Artificial
  CRISPR gRNA sequence
ccaggctcaagagatgtttc

SEQ ID NO: 312818 - DNA, 20 bp, Artificial
  CRISPR gRNA sequence
aagagatgtttctgcctcag

SEQ ID NO: 312819 - DNA, 20 bp, Artificial
  CRISPR gRNA sequence
ctgcctcagccacctgaata

SEQ ID NO: 312820 - DNA, 20 bp, Artificial
  CRISPR gRNA sequence
tgcctcagccacctgaatag

SEQ ID NO: 312821 - DNA, 20 bp, Artificial
  CRISPR gRNA sequence
cctcagccacctgaatagct

SEQ ID NO: 312822 - DNA, 20 bp, Artificial
  CRISPR gRNA sequence
agccacctgaatagctggca

SEQ ID NO: 312823 - DNA, 20 bp, Artificial
  CRISPR gRNA sequence
aatagctggcactataagta

SEQ ID NO: 312824 - DNA, 20 bp, Artificial
  CRISPR gRNA sequence
gcactataagtacatgccac

SEQ ID NO: 312825 - DNA, 20 bp, Artificial
  CRISPR gRNA sequence
taagtacatgccaccatgcc

SEQ ID NO: 312826 - DNA, 20 bp, Artificial
  CRISPR gRNA sequence
gctagttttttttgttgttg

SEQ ID NO: 312827 - DNA, 20 bp, Artificial
  CRISPR gRNA sequence
gttttttttgttgttgtttt

SEQ ID NO: 312828 - DNA, 20 bp, Artificial
  CRISPR gRNA sequence
tttttgttgttgttttgttt

SEQ ID NO: 312829 - DNA, 20 bp, Artificial
  CRISPR gRNA sequence
ttttgttgttgttttgtttt

SEQ ID NO: 312830 - DNA, 20 bp, Artificial
  CRISPR gRNA sequence
tttgttgttgttttgttttg

SEQ ID NO: 312831 - DNA, 20 bp, Artificial
  CRISPR gRNA sequence
ttgttgttgttttgttttgc

SEQ ID NO: 312832 - DNA, 20 bp, Artificial
  CRISPR gRNA sequence
tgttgttgttttgttttgct

SEQ ID NO: 312833 - DNA, 20 bp, Artificial
  CRISPR gRNA sequence
gttgttgttttgttttgctt

SEQ ID NO: 312834 - DNA, 20 bp, Artificial
  CRISPR gRNA sequence
ttgttgttttgttttgcttt

SEQ ID NO: 312835 - DNA, 20 bp, Artificial
  CRISPR gRNA sequence
ttgttttgttttgctttaga

SEQ ID NO: 312836 - DNA, 20 bp, Artificial
  CRISPR gRNA sequence
ttttgttttgctttagagac

SEQ ID NO: 312837 - DNA, 20 bp, Artificial
  CRISPR gRNA sequence
tgttttgctttagagacggg

SEQ ID NO: 312838 - DNA, 20 bp, Artificial
  CRISPR gRNA sequence
gttttgctttagagacgggg

SEQ ID NO: 312839 - DNA, 20 bp, Artificial
  CRISPR gRNA sequence
ttttgctttagagacggggt

SEQ ID NO: 312840 - DNA, 20 bp, Artificial
  CRISPR gRNA sequence
tgctttagagacggggtctc

SEQ ID NO: 312841 - DNA, 20 bp, Artificial
  CRISPR gRNA sequence
gctttagagacggggtctcg

SEQ ID NO: 312842 - DNA, 20 bp, Artificial
  CRISPR gRNA sequence
ctttagagacggggtctcgc

SEQ ID NO: 312843 - DNA, 20 bp, Artificial
  CRISPR gRNA sequence
tagagacggggtctcgcttt

SEQ ID NO: 312844 - DNA, 20 bp, Artificial
  CRISPR gRNA sequence
agagacggggtctcgctttg

SEQ ID NO: 312845 - DNA, 20 bp, Artificial
  CRISPR gRNA sequence
gagacggggtctcgctttgt

SEQ ID NO: 312846 - DNA, 20 bp, Artificial
  CRISPR gRNA sequence
gctttgtgcccaggctggtc

SEQ ID NO: 312847 - DNA, 20 bp, Artificial
  CRISPR gRNA sequence
tgtgcccaggctggtcttga

SEQ ID NO: 312848 - DNA, 20 bp, Artificial
  CRISPR gRNA sequence
gtgcccaggctggtcttgaa

SEQ ID NO: 312849 - DNA, 20 bp, Artificial
  CRISPR gRNA sequence
tgcccaggctggtcttgaac

SEQ ID NO: 312850 - DNA, 20 bp, Artificial
  CRISPR gRNA sequence
gtcttgaactccttttaagt

SEQ ID NO: 312851 - DNA, 20 bp, Artificial
  CRISPR gRNA sequence
gaactccttttaagtgatta

SEQ ID NO: 312852 - DNA, 20 bp, Artificial
  CRISPR gRNA sequence
aactccttttaagtgattat

SEQ ID NO: 312853 - DNA, 20 bp, Artificial
  CRISPR gRNA sequence
cttttaagtgattatctctt

SEQ ID NO: 312854 - DNA, 20 bp, Artificial
  CRISPR gRNA sequence
ttaagtgattatctcttctc

SEQ ID NO: 312855 - DNA, 20 bp, Artificial
  CRISPR gRNA sequence
taagtgattatctcttctca

SEQ ID NO: 312856 - DNA, 20 bp, Artificial
  CRISPR gRNA sequence
aagtgattatctcttctcag

SEQ ID NO: 312857 - DNA, 20 bp, Artificial
  CRISPR gRNA sequence
agtgattatctcttctcagc

SEQ ID NO: 312858 - DNA, 20 bp, Artificial
  CRISPR gRNA sequence
tctcttctcagcttcttaaa

SEQ ID NO: 312859 - DNA, 20 bp, Artificial
  CRISPR gRNA sequence
ttctcagcttcttaaagtcc

SEQ ID NO: 312860 - DNA, 20 bp, Artificial
  CRISPR gRNA sequence
ctcagcttcttaaagtcctg

SEQ ID NO: 312861 - DNA, 20 bp, Artificial
  CRISPR gRNA sequence
tcagcttcttaaagtcctgg

SEQ ID NO: 312862 - DNA, 20 bp, Artificial
  CRISPR gRNA sequence
agcttcttaaagtcctggga

SEQ ID NO: 312863 - DNA, 20 bp, Artificial
  CRISPR gRNA sequence
cttaaagtcctgggattata

SEQ ID NO: 312864 - DNA, 20 bp, Artificial
  CRISPR gRNA sequence
ttaaagtcctgggattatag

SEQ ID NO: 312865 - DNA, 20 bp, Artificial
  CRISPR gRNA sequence
aaagtcctgggattataggc

SEQ ID NO: 312866 - DNA, 20 bp, Artificial
  CRISPR gRNA sequence
aagtcctgggattataggca

SEQ ID NO: 312867 - DNA, 20 bp, Artificial
  CRISPR gRNA sequence
ggattataggcatggcctat

SEQ ID NO: 312868 - DNA, 20 bp, Artificial
  CRISPR gRNA sequence
taggcatggcctatctattt

SEQ ID NO: 312869 - DNA, 20 bp, Artificial
  CRISPR gRNA sequence
tctatttttatgttttataa

SEQ ID NO: 312870 - DNA, 20 bp, Artificial
  CRISPR gRNA sequence
tttttatgttttataatttc

SEQ ID NO: 312871 - DNA, 20 bp, Artificial
  CRISPR gRNA sequence
ttatgttttataatttcttg

SEQ ID NO: 312872 - DNA, 20 bp, Artificial
  CRISPR gRNA sequence
tatgttttataatttcttgt

SEQ ID NO: 312873 - DNA, 20 bp, Artificial
  CRISPR gRNA sequence
atgttttataatttcttgta

SEQ ID NO: 312874 - DNA, 20 bp, Artificial
  CRISPR gRNA sequence
tgttttataatttcttgtac

SEQ ID NO: 312875 - DNA, 20 bp, Artificial
  CRISPR gRNA sequence
tataatttcttgtacttttt

SEQ ID NO: 312876 - DNA, 20 bp, Artificial
  CRISPR gRNA sequence
ataatttcttgtactttttg

SEQ ID NO: 312877 - DNA, 20 bp, Artificial
  CRISPR gRNA sequence
taatttcttgtactttttga

SEQ ID NO: 312878 - DNA, 20 bp, Artificial
  CRISPR gRNA sequence
cttgtactttttgatgttac

SEQ ID NO: 312879 - DNA, 20 bp, Artificial
  CRISPR gRNA sequence
ttgtactttttgatgttact

SEQ ID NO: 312880 - DNA, 20 bp, Artificial
  CRISPR gRNA sequence
gtactttttgatgttacttc

SEQ ID NO: 312881 - DNA, 20 bp, Artificial
  CRISPR gRNA sequence
tactttttgatgttacttca

SEQ ID NO: 312882 - DNA, 20 bp, Artificial
  CRISPR gRNA sequence
tttgatgttacttcaaatat

SEQ ID NO: 312883 - DNA, 20 bp, Artificial
  CRISPR gRNA sequence
ttgatgttacttcaaatatc

SEQ ID NO: 312884 - DNA, 20 bp, Artificial
  CRISPR gRNA sequence
tgatgttacttcaaatatct

SEQ ID NO: 312885 - DNA, 20 bp, Artificial
  CRISPR gRNA sequence
gatgttacttcaaatatctt

SEQ ID NO: 312886 - DNA, 20 bp, Artificial
  CRISPR gRNA sequence
atgttacttcaaatatcttt

SEQ ID NO: 312887 - DNA, 20 bp, Artificial
  CRISPR gRNA sequence
cttcaaatatctttttaagt

SEQ ID NO: 312888 - DNA, 20 bp, Artificial
  CRISPR gRNA sequence
caaatatctttttaagtatc

SEQ ID NO: 312889 - DNA, 20 bp, Artificial
  CRISPR gRNA sequence
aaatatctttttaagtatcc

SEQ ID NO: 312890 - DNA, 20 bp, Artificial
  CRISPR gRNA sequence
tttaagtatcctaaatatac

SEQ ID NO: 312891 - DNA, 20 bp, Artificial
  CRISPR gRNA sequence
ttaagtatcctaaatatact

SEQ ID NO: 312892 - DNA, 20 bp, Artificial
  CRISPR gRNA sequence
taagtatcctaaatatactt

SEQ ID NO: 312893 - DNA, 20 bp, Artificial
  CRISPR gRNA sequence
aagtatcctaaatatactta

SEQ ID NO: 312894 - DNA, 20 bp, Artificial
  CRISPR gRNA sequence
agtatcctaaatatacttat

SEQ ID NO: 312895 - DNA, 20 bp, Artificial
  CRISPR gRNA sequence
aatatacttatttaaatttt

SEQ ID NO: 312896 - DNA, 20 bp, Artificial
  CRISPR gRNA sequence
atttaaattttttttgagta

SEQ ID NO: 312897 - DNA, 20 bp, Artificial
  CRISPR gRNA sequence
tttaaattttttttgagtaa

SEQ ID NO: 312898 - DNA, 20 bp, Artificial
  CRISPR gRNA sequence
aaattttttttgagtaaatt

SEQ ID NO: 312899 - DNA, 20 bp, Artificial
  CRISPR gRNA sequence
aattttttttgagtaaattt

SEQ ID NO: 312900 - DNA, 20 bp, Artificial
  CRISPR gRNA sequence
tttttgagtaaatttatcta

SEQ ID NO: 312901 - DNA, 20 bp, Artificial
  CRISPR gRNA sequence
ttttgagtaaatttatctat

SEQ ID NO: 312902 - DNA, 20 bp, Artificial
  CRISPR gRNA sequence
tttgagtaaatttatctata

SEQ ID NO: 312903 - DNA, 20 bp, Artificial
  CRISPR gRNA sequence
ttgagtaaatttatctataa

SEQ ID NO: 312904 - DNA, 20 bp, Artificial
  CRISPR gRNA sequence
tgagtaaatttatctataaa

SEQ ID NO: 312905 - DNA, 20 bp, Artificial
  CRISPR gRNA sequence
gagtaaatttatctataaat

SEQ ID NO: 312906 - DNA, 20 bp, Artificial
  CRISPR gRNA sequence
agtaaatttatctataaatt

SEQ ID NO: 312907 - DNA, 20 bp, Artificial
  CRISPR gRNA sequence
atctataaattattgatttt

SEQ ID NO: 312908 - DNA, 20 bp, Artificial
  CRISPR gRNA sequence
tctataaattattgatttta

SEQ ID NO: 312909 - DNA, 20 bp, Artificial
  CRISPR gRNA sequence
taaattattgattttatgtc

SEQ ID NO: 312910 - DNA, 20 bp, Artificial
  CRISPR gRNA sequence
ttgattttatgtcgatagac

SEQ ID NO: 312911 - DNA, 20 bp, Artificial
  CRISPR gRNA sequence
attttatgtcgatagacatt

SEQ ID NO: 312912 - DNA, 20 bp, Artificial
  CRISPR gRNA sequence
tatgtcgatagacattgttc

SEQ ID NO: 312913 - DNA, 20 bp, Artificial
  CRISPR gRNA sequence
atgtcgatagacattgttct

SEQ ID NO: 312914 - DNA, 20 bp, Artificial
  CRISPR gRNA sequence
tgtcgatagacattgttctc

SEQ ID NO: 312915 - DNA, 20 bp, Artificial
  CRISPR gRNA sequence
ttctctatcattaataatgt

SEQ ID NO: 312916 - DNA, 20 bp, Artificial
  CRISPR gRNA sequence
tctatcattaataatgttaa

SEQ ID NO: 312917 - DNA, 20 bp, Artificial
  CRISPR gRNA sequence
tatcattaataatgttaaaa

SEQ ID NO: 312918 - DNA, 20 bp, Artificial
  CRISPR gRNA sequence
tcattaataatgttaaaaat

SEQ ID NO: 312919 - DNA, 20 bp, Artificial
  CRISPR gRNA sequence
ataatgttaaaaataaataa

SEQ ID NO: 312920 - DNA, 20 bp, Artificial
  CRISPR gRNA sequence
aaaataaataaaaaaacaaa

SEQ ID NO: 312921 - DNA, 20 bp, Artificial
  CRISPR gRNA sequence
atgcttaccacaggccagta

SEQ ID NO: 312922 - DNA, 20 bp, Artificial
  CRISPR gRNA sequence
accacaggccagtatttgat

SEQ ID NO: 312923 - DNA, 20 bp, Artificial
  CRISPR gRNA sequence
ccacaggccagtatttgatc

SEQ ID NO: 312924 - DNA, 20 bp, Artificial
  CRISPR gRNA sequence
gatccaacactaactcaaat

SEQ ID NO: 312925 - DNA, 20 bp, Artificial
  CRISPR gRNA sequence
atccaacactaactcaaata

SEQ ID NO: 312926 - DNA, 20 bp, Artificial
  CRISPR gRNA sequence
actcaaatattcatttcttt

SEQ ID NO: 312927 - DNA, 20 bp, Artificial
  CRISPR gRNA sequence
aaatattcatttctttaatc

SEQ ID NO: 312928 - DNA, 20 bp, Artificial
  CRISPR gRNA sequence
atttctttaatcctcacaac

SEQ ID NO: 312929 - DNA, 20 bp, Artificial
  CRISPR gRNA sequence
ctttaatcctcacaacaaac

SEQ ID NO: 312930 - DNA, 20 bp, Artificial
  CRISPR gRNA sequence
tttaatcctcacaacaaacc

SEQ ID NO: 312931 - DNA, 20 bp, Artificial
  CRISPR gRNA sequence
taatcctcacaacaaaccta

SEQ ID NO: 312932 - DNA, 20 bp, Artificial
  CRISPR gRNA sequence
aatcctcacaacaaacctat

SEQ ID NO: 312933 - DNA, 20 bp, Artificial
  CRISPR gRNA sequence
atcctcacaacaaacctatg

SEQ ID NO: 312934 - DNA, 20 bp, Artificial
  CRISPR gRNA sequence
acaacaaacctatgaggtag

SEQ ID NO: 312935 - DNA, 20 bp, Artificial
  CRISPR gRNA sequence
tgaggtaggtaccattattg

SEQ ID NO: 312936 - DNA, 20 bp, Artificial
  CRISPR gRNA sequence
ttgttcctgctttttgcaag

SEQ ID NO: 312937 - DNA, 20 bp, Artificial
  CRISPR gRNA sequence
ttcctgctttttgcaagagg

SEQ ID NO: 312938 - DNA, 20 bp, Artificial
  CRISPR gRNA sequence
ctgctttttgcaagaggaaa

SEQ ID NO: 312939 - DNA, 20 bp, Artificial
  CRISPR gRNA sequence
ctttttgcaagaggaaactg

SEQ ID NO: 312940 - DNA, 20 bp, Artificial
  CRISPR gRNA sequence
tttgcaagaggaaactgaga

SEQ ID NO: 312941 - DNA, 20 bp, Artificial
  CRISPR gRNA sequence
ttgcaagaggaaactgagac

SEQ ID NO: 312942 - DNA, 20 bp, Artificial
  CRISPR gRNA sequence
tgcaagaggaaactgagaca

SEQ ID NO: 312943 - DNA, 20 bp, Artificial
  CRISPR gRNA sequence
gcaagaggaaactgagacac

SEQ ID NO: 312944 - DNA, 20 bp, Artificial
  CRISPR gRNA sequence
caagaggaaactgagacaca

SEQ ID NO: 312945 - DNA, 20 bp, Artificial
  CRISPR gRNA sequence
agacacagggaagttaagta

SEQ ID NO: 312946 - DNA, 20 bp, Artificial
  CRISPR gRNA sequence
agtaatttgcctatggtaac

SEQ ID NO: 312947 - DNA, 20 bp, Artificial
  CRISPR gRNA sequence
gcctatggtaacacaggcag

SEQ ID NO: 312948 - DNA, 20 bp, Artificial
  CRISPR gRNA sequence
cctatggtaacacaggcagt

SEQ ID NO: 312949 - DNA, 20 bp, Artificial
  CRISPR gRNA sequence
tggtaacacaggcagtgagt

SEQ ID NO: 312950 - DNA, 20 bp, Artificial
  CRISPR gRNA sequence
agctgagattgaactcacgc

SEQ ID NO: 312951 - DNA, 20 bp, Artificial
  CRISPR gRNA sequence
agattgaactcacgctgtcc

SEQ ID NO: 312952 - DNA, 20 bp, Artificial
  CRISPR gRNA sequence
aactcacgctgtccagaatc

SEQ ID NO: 312953 - DNA, 20 bp, Artificial
  CRISPR gRNA sequence
acgctgtccagaatccatgc

SEQ ID NO: 312954 - DNA, 20 bp, Artificial
  CRISPR gRNA sequence
tccagaatccatgctattag

SEQ ID NO: 312955 - DNA, 20 bp, Artificial
  CRISPR gRNA sequence
ttagttataatagtgtactg

SEQ ID NO: 312956 - DNA, 20 bp, Artificial
  CRISPR gRNA sequence
gttataatagtgtactgccc

SEQ ID NO: 312957 - DNA, 20 bp, Artificial
  CRISPR gRNA sequence
taatagtgtactgccctata

SEQ ID NO: 312958 - DNA, 20 bp, Artificial
  CRISPR gRNA sequence
ccctatagctttctgtttca

SEQ ID NO: 312959 - DNA, 20 bp, Artificial
  CRISPR gRNA sequence
tagctttctgtttcacagct

SEQ ID NO: 312960 - DNA, 20 bp, Artificial
  CRISPR gRNA sequence
tctgtttcacagctacatgg

SEQ ID NO: 312961 - DNA, 20 bp, Artificial
  CRISPR gRNA sequence
ctgtttcacagctacatggc

SEQ ID NO: 312962 - DNA, 20 bp, Artificial
  CRISPR gRNA sequence
tgtttcacagctacatggca

SEQ ID NO: 312963 - DNA, 20 bp, Artificial
  CRISPR gRNA sequence
tttcacagctacatggcatt

SEQ ID NO: 312964 - DNA, 20 bp, Artificial
  CRISPR gRNA sequence
cacagctacatggcattact

SEQ ID NO: 312965 - DNA, 20 bp, Artificial
  CRISPR gRNA sequence
acagctacatggcattactt

SEQ ID NO: 312966 - DNA, 20 bp, Artificial
  CRISPR gRNA sequence
catggcattactttgtatgg

SEQ ID NO: 312967 - DNA, 20 bp, Artificial
  CRISPR gRNA sequence
ctttgtatggatgtatcatt

SEQ ID NO: 312968 - DNA, 20 bp, Artificial
  CRISPR gRNA sequence
tgtatggatgtatcattatt

SEQ ID NO: 312969 - DNA, 20 bp, Artificial
  CRISPR gRNA sequence
gtatggatgtatcattattt

SEQ ID NO: 312970 - DNA, 20 bp, Artificial
  CRISPR gRNA sequence
tatggatgtatcattatttg

SEQ ID NO: 312971 - DNA, 20 bp, Artificial
  CRISPR gRNA sequence
tttgttaaaccatttaactt

SEQ ID NO: 312972 - DNA, 20 bp, Artificial
  CRISPR gRNA sequence
gttaaaccatttaacttatt

SEQ ID NO: 312973 - DNA, 20 bp, Artificial
  CRISPR gRNA sequence
ttaaaccatttaacttattt

SEQ ID NO: 312974 - DNA, 20 bp, Artificial
  CRISPR gRNA sequence
aaccatttaacttatttcca

SEQ ID NO: 312975 - DNA, 20 bp, Artificial
  CRISPR gRNA sequence
aacttatttccagtgtattg

SEQ ID NO: 312976 - DNA, 20 bp, Artificial
  CRISPR gRNA sequence
acttatttccagtgtattgt

SEQ ID NO: 312977 - DNA, 20 bp, Artificial
  CRISPR gRNA sequence
atttccagtgtattgttctt

SEQ ID NO: 312978 - DNA, 20 bp, Artificial
  CRISPR gRNA sequence
tttccagtgtattgttctta

SEQ ID NO: 312979 - DNA, 20 bp, Artificial
  CRISPR gRNA sequence
ccagtgtattgttcttataa

SEQ ID NO: 312980 - DNA, 20 bp, Artificial
  CRISPR gRNA sequence
cagtgtattgttcttataaa

SEQ ID NO: 312981 - DNA, 20 bp, Artificial
  CRISPR gRNA sequence
ttcttataaacaatgaatac

SEQ ID NO: 312982 - DNA, 20 bp, Artificial
  CRISPR gRNA sequence
ttataaacaatgaatacctg

SEQ ID NO: 312983 - DNA, 20 bp, Artificial
  CRISPR gRNA sequence
ataaacaatgaatacctgtg

SEQ ID NO: 312984 - DNA, 20 bp, Artificial
  CRISPR gRNA sequence
taaacaatgaatacctgtgt

SEQ ID NO: 312985 - DNA, 20 bp, Artificial
  CRISPR gRNA sequence
tgtacctctaattttgtgca

SEQ ID NO: 312986 - DNA, 20 bp, Artificial
  CRISPR gRNA sequence
taattttgtgcacatgtatc

SEQ ID NO: 312987 - DNA, 20 bp, Artificial
  CRISPR gRNA sequence
attttgtgcacatgtatctt

SEQ ID NO: 312988 - DNA, 20 bp, Artificial
  CRISPR gRNA sequence
tgtgcacatgtatctttttg

SEQ ID NO: 312989 - DNA, 20 bp, Artificial
  CRISPR gRNA sequence
gtgcacatgtatctttttgt

SEQ ID NO: 312990 - DNA, 20 bp, Artificial
  CRISPR gRNA sequence
tgcacatgtatctttttgta

SEQ ID NO: 312991 - DNA, 20 bp, Artificial
  CRISPR gRNA sequence
tttgtagaatgaattcttaa

SEQ ID NO: 312992 - DNA, 20 bp, Artificial
  CRISPR gRNA sequence
ttgtagaatgaattcttaag

SEQ ID NO: 312993 - DNA, 20 bp, Artificial
  CRISPR gRNA sequence
tgtagaatgaattcttaaga

SEQ ID NO: 312994 - DNA, 20 bp, Artificial
  CRISPR gRNA sequence
gtagaatgaattcttaagaa

SEQ ID NO: 312995 - DNA, 20 bp, Artificial
  CRISPR gRNA sequence
tagaatgaattcttaagaaa

SEQ ID NO: 312996 - DNA, 20 bp, Artificial
  CRISPR gRNA sequence
ttaagaaattgagttgctaa

SEQ ID NO: 312997 - DNA, 20 bp, Artificial
  CRISPR gRNA sequence
aagaaattgagttgctaagt

SEQ ID NO: 312998 - DNA, 20 bp, Artificial
  CRISPR gRNA sequence
agaaattgagttgctaagtc

SEQ ID NO: 312999 - DNA, 20 bp, Artificial
  CRISPR gRNA sequence
agttgctaagtcaatgctta

SEQ ID NO: 313000 - DNA, 20 bp, Artificial
  CRISPR gRNA sequence
ctaagtcaatgcttaagccc

SEQ ID NO: 313001 - DNA, 20 bp, Artificial
  CRISPR gRNA sequence
agtcaatgcttaagcccata

SEQ ID NO: 313002 - DNA, 20 bp, Artificial
  CRISPR gRNA sequence
aagcccataattaattttct

SEQ ID NO: 313003 - DNA, 20 bp, Artificial
  CRISPR gRNA sequence
agcccataattaattttctt

SEQ ID NO: 313004 - DNA, 20 bp, Artificial
  CRISPR gRNA sequence
attttcttacatattaccaa

SEQ ID NO: 313005 - DNA, 20 bp, Artificial
  CRISPR gRNA sequence
tcttacatattaccaactgt

SEQ ID NO: 313006 - DNA, 20 bp, Artificial
  CRISPR gRNA sequence
cttacatattaccaactgtc

SEQ ID NO: 313007 - DNA, 20 bp, Artificial
  CRISPR gRNA sequence
ttacatattaccaactgtcc

SEQ ID NO: 313008 - DNA, 20 bp, Artificial
  CRISPR gRNA sequence
acatattaccaactgtcctc

SEQ ID NO: 313009 - DNA, 20 bp, Artificial
  CRISPR gRNA sequence
catattaccaactgtcctcc

SEQ ID NO: 313010 - DNA, 20 bp, Artificial
  CRISPR gRNA sequence
ccaactgtcctccaaaaagg

SEQ ID NO: 313011 - DNA, 20 bp, Artificial
  CRISPR gRNA sequence
tcctccaaaaaggttgtacc

SEQ ID NO: 313012 - DNA, 20 bp, Artificial
  CRISPR gRNA sequence
caaaaaggttgtaccaattt

SEQ ID NO: 313013 - DNA, 20 bp, Artificial
  CRISPR gRNA sequence
taccaatttagaattttacc

SEQ ID NO: 313014 - DNA, 20 bp, Artificial
  CRISPR gRNA sequence
agaattttaccagcagtaaa

SEQ ID NO: 313015 - DNA, 20 bp, Artificial
  CRISPR gRNA sequence
gaattttaccagcagtaaat

SEQ ID NO: 313016 - DNA, 20 bp, Artificial
  CRISPR gRNA sequence
taccagcagtaaattcagca

SEQ ID NO: 313017 - DNA, 20 bp, Artificial
  CRISPR gRNA sequence
accagcagtaaattcagcag

SEQ ID NO: 313018 - DNA, 20 bp, Artificial
  CRISPR gRNA sequence
ccagcagtaaattcagcagt

SEQ ID NO: 313019 - DNA, 20 bp, Artificial
  CRISPR gRNA sequence
agcagttaggacccattttc

SEQ ID NO: 313020 - DNA, 20 bp, Artificial
  CRISPR gRNA sequence
ggacccattttcctaacact

SEQ ID NO: 313021 - DNA, 20 bp, Artificial
  CRISPR gRNA sequence
tcctaacactctcgcggaca

SEQ ID NO: 313022 - DNA, 20 bp, Artificial
  CRISPR gRNA sequence
cctaacactctcgcggacac

SEQ ID NO: 313023 - DNA, 20 bp, Artificial
  CRISPR gRNA sequence
ctaacactctcgcggacact

SEQ ID NO: 313024 - DNA, 20 bp, Artificial
  CRISPR gRNA sequence
acactctcgcggacactggg

SEQ ID NO: 313025 - DNA, 20 bp, Artificial
  CRISPR gRNA sequence
tcgcggacactgggtattac

SEQ ID NO: 313026 - DNA, 20 bp, Artificial
  CRISPR gRNA sequence
gcggacactgggtattacca

SEQ ID NO: 313027 - DNA, 20 bp, Artificial
  CRISPR gRNA sequence
ggtattaccagtattttttt

SEQ ID NO: 313028 - DNA, 20 bp, Artificial
  CRISPR gRNA sequence
ccagtattttttttaatacg

SEQ ID NO: 313029 - DNA, 20 bp, Artificial
  CRISPR gRNA sequence
tttttaatacgtgccaatca

SEQ ID NO: 313030 - DNA, 20 bp, Artificial
  CRISPR gRNA sequence
ttttaatacgtgccaatcaa

SEQ ID NO: 313031 - DNA, 20 bp, Artificial
  CRISPR gRNA sequence
tttaatacgtgccaatcaaa

SEQ ID NO: 313032 - DNA, 20 bp, Artificial
  CRISPR gRNA sequence
ttaatacgtgccaatcaaat

SEQ ID NO: 313033 - DNA, 20 bp, Artificial
  CRISPR gRNA sequence
taatacgtgccaatcaaatg

SEQ ID NO: 313034 - DNA, 20 bp, Artificial
  CRISPR gRNA sequence
aatacgtgccaatcaaatgg

SEQ ID NO: 313035 - DNA, 20 bp, Artificial
  CRISPR gRNA sequence
atacgtgccaatcaaatggg

SEQ ID NO: 313036 - DNA, 20 bp, Artificial
  CRISPR gRNA sequence
ctcactgaggtttaaattgc

SEQ ID NO: 313037 - DNA, 20 bp, Artificial
  CRISPR gRNA sequence
tcactgaggtttaaattgca

SEQ ID NO: 313038 - DNA, 20 bp, Artificial
  CRISPR gRNA sequence
actgaggtttaaattgcatt

SEQ ID NO: 313039 - DNA, 20 bp, Artificial
  CRISPR gRNA sequence
aggtttaaattgcatttccc

SEQ ID NO: 313040 - DNA, 20 bp, Artificial
  CRISPR gRNA sequence
aaattgcatttccctagtta

SEQ ID NO: 313041 - DNA, 20 bp, Artificial
  CRISPR gRNA sequence
aattgcatttccctagttat

SEQ ID NO: 313042 - DNA, 20 bp, Artificial
  CRISPR gRNA sequence
catttccctagttattcttg

SEQ ID NO: 313043 - DNA, 20 bp, Artificial
  CRISPR gRNA sequence
ccctagttattcttgagatt

SEQ ID NO: 313044 - DNA, 20 bp, Artificial
  CRISPR gRNA sequence
cctagttattcttgagattt

SEQ ID NO: 313045 - DNA, 20 bp, Artificial
  CRISPR gRNA sequence
gttattcttgagatttttcc

SEQ ID NO: 313046 - DNA, 20 bp, Artificial
  CRISPR gRNA sequence
ttcttgagatttttcctttc

SEQ ID NO: 313047 - DNA, 20 bp, Artificial
  CRISPR gRNA sequence
ttgagatttttcctttcctt

SEQ ID NO: 313048 - DNA, 20 bp, Artificial
  CRISPR gRNA sequence
gagatttttcctttcctttc

SEQ ID NO: 313049 - DNA, 20 bp, Artificial
  CRISPR gRNA sequence
agatttttcctttcctttct

SEQ ID NO: 313050 - DNA, 20 bp, Artificial
  CRISPR gRNA sequence
ttcctttcctttcttcaaca

SEQ ID NO: 313051 - DNA, 20 bp, Artificial
  CRISPR gRNA sequence
tcctttcctttcttcaacaa

SEQ ID NO: 313052 - DNA, 20 bp, Artificial
  CRISPR gRNA sequence
cctttcctttcttcaacaat

SEQ ID NO: 313053 - DNA, 20 bp, Artificial
  CRISPR gRNA sequence
ctttcctttcttcaacaatt

SEQ ID NO: 313054 - DNA, 20 bp, Artificial
  CRISPR gRNA sequence
tcctttcttcaacaattact

SEQ ID NO: 313055 - DNA, 20 bp, Artificial
  CRISPR gRNA sequence
cctttcttcaacaattactt

SEQ ID NO: 313056 - DNA, 20 bp, Artificial
  CRISPR gRNA sequence
ctttcttcaacaattactta

SEQ ID NO: 313057 - DNA, 20 bp, Artificial
  CRISPR gRNA sequence
tcttcaacaattacttattg

SEQ ID NO: 313058 - DNA, 20 bp, Artificial
  CRISPR gRNA sequence
cttcaacaattacttattga

SEQ ID NO: 313059 - DNA, 20 bp, Artificial
  CRISPR gRNA sequence
ttcaacaattacttattgag

SEQ ID NO: 313060 - DNA, 20 bp, Artificial
  CRISPR gRNA sequence
caacaattacttattgagtg

SEQ ID NO: 313061 - DNA, 20 bp, Artificial
  CRISPR gRNA sequence
aacaattacttattgagtgc

SEQ ID NO: 313062 - DNA, 20 bp, Artificial
  CRISPR gRNA sequence
cttattgagtgcttcatatt

SEQ ID NO: 313063 - DNA, 20 bp, Artificial
  CRISPR gRNA sequence
attgagtgcttcatatttgt

SEQ ID NO: 313064 - DNA, 20 bp, Artificial
  CRISPR gRNA sequence
ttgagtgcttcatatttgta

SEQ ID NO: 313065 - DNA, 20 bp, Artificial
  CRISPR gRNA sequence
agtgcttcatatttgtaagg

SEQ ID NO: 313066 - DNA, 20 bp, Artificial
  CRISPR gRNA sequence
catatttgtaagggacaatt

SEQ ID NO: 313067 - DNA, 20 bp, Artificial
  CRISPR gRNA sequence
atatttgtaagggacaattg

SEQ ID NO: 313068 - DNA, 20 bp, Artificial
  CRISPR gRNA sequence
gtaagggacaattgcaggta

SEQ ID NO: 313069 - DNA, 20 bp, Artificial
  CRISPR gRNA sequence
taagggacaattgcaggtac

SEQ ID NO: 313070 - DNA, 20 bp, Artificial
  CRISPR gRNA sequence
caggtactggaaatgtcaca

SEQ ID NO: 313071 - DNA, 20 bp, Artificial
  CRISPR gRNA sequence
gaaatgtcacagtgaggaaa

SEQ ID NO: 313072 - DNA, 20 bp, Artificial
  CRISPR gRNA sequence
ctgtcatggagcttattcta

SEQ ID NO: 313073 - DNA, 20 bp, Artificial
  CRISPR gRNA sequence
tcatggagcttattctaatg

SEQ ID NO: 313074 - DNA, 20 bp, Artificial
  CRISPR gRNA sequence
attctaatgggagatgtcag

SEQ ID NO: 313075 - DNA, 20 bp, Artificial
  CRISPR gRNA sequence
ttctaatgggagatgtcagg

SEQ ID NO: 313076 - DNA, 20 bp, Artificial
  CRISPR gRNA sequence
taatgggagatgtcaggtgc

SEQ ID NO: 313077 - DNA, 20 bp, Artificial
  CRISPR gRNA sequence
atgggagatgtcaggtgctc

SEQ ID NO: 313078 - DNA, 20 bp, Artificial
  CRISPR gRNA sequence
agctgagctgggagagagag

SEQ ID NO: 313079 - DNA, 20 bp, Artificial
  CRISPR gRNA sequence
agctgggagagagagagctg

SEQ ID NO: 313080 - DNA, 20 bp, Artificial
  CRISPR gRNA sequence
ggagagagagagctgagttg

SEQ ID NO: 313081 - DNA, 20 bp, Artificial
  CRISPR gRNA sequence
agttgtcaggtgtcagagga

SEQ ID NO: 313082 - DNA, 20 bp, Artificial
  CRISPR gRNA sequence
tcaggtgtcagaggagccaa

SEQ ID NO: 313083 - DNA, 20 bp, Artificial
  CRISPR gRNA sequence
tagcagcaaaacaaaaataa

SEQ ID NO: 313084 - DNA, 20 bp, Artificial
  CRISPR gRNA sequence
agcttttaatctcttactac

SEQ ID NO: 313085 - DNA, 20 bp, Artificial
  CRISPR gRNA sequence
ttaatctcttactacgacgg

SEQ ID NO: 313086 - DNA, 20 bp, Artificial
  CRISPR gRNA sequence
taatctcttactacgacggt

SEQ ID NO: 313087 - DNA, 20 bp, Artificial
  CRISPR gRNA sequence
aatctcttactacgacggta

SEQ ID NO: 313088 - DNA, 20 bp, Artificial
  CRISPR gRNA sequence
atctcttactacgacggtat

SEQ ID NO: 313089 - DNA, 20 bp, Artificial
  CRISPR gRNA sequence
ttactacgacggtataatca

SEQ ID NO: 313090 - DNA, 20 bp, Artificial
  CRISPR gRNA sequence
actacgacggtataatcaag

SEQ ID NO: 313091 - DNA, 20 bp, Artificial
  CRISPR gRNA sequence
ctacgacggtataatcaaga

SEQ ID NO: 313092 - DNA, 20 bp, Artificial
  CRISPR gRNA sequence
cgacggtataatcaagaggc

SEQ ID NO: 313093 - DNA, 20 bp, Artificial
  CRISPR gRNA sequence
aaatgggaggaagggcagac

SEQ ID NO: 313094 - DNA, 20 bp, Artificial
  CRISPR gRNA sequence
tgcctgttccatttccccac

SEQ ID NO: 313095 - DNA, 20 bp, Artificial
  CRISPR gRNA sequence
cctgttccatttccccacat

SEQ ID NO: 313096 - DNA, 20 bp, Artificial
  CRISPR gRNA sequence
ttccatttccccacatagag

SEQ ID NO: 313097 - DNA, 20 bp, Artificial
  CRISPR gRNA sequence
catttccccacatagagtga

SEQ ID NO: 313098 - DNA, 20 bp, Artificial
  CRISPR gRNA sequence
ccccacatagagtgagtata

SEQ ID NO: 313099 - DNA, 20 bp, Artificial
  CRISPR gRNA sequence
cccacatagagtgagtatac

SEQ ID NO: 313100 - DNA, 20 bp, Artificial
  CRISPR gRNA sequence
agggggtcgccttaccattg

SEQ ID NO: 313101 - DNA, 20 bp, Artificial
  CRISPR gRNA sequence
gggggtcgccttaccattga

SEQ ID NO: 313102 - DNA, 20 bp, Artificial
  CRISPR gRNA sequence
accattgaagaagccccaaa

SEQ ID NO: 313103 - DNA, 20 bp, Artificial
  CRISPR gRNA sequence
ccattgaagaagccccaaat

SEQ ID NO: 313104 - DNA, 20 bp, Artificial
  CRISPR gRNA sequence
aagaagccccaaatgaaagg

SEQ ID NO: 313105 - DNA, 20 bp, Artificial
  CRISPR gRNA sequence
tagcagttttatggacctgg

SEQ ID NO: 313106 - DNA, 20 bp, Artificial
  CRISPR gRNA sequence
gcagttttatggacctgggg

SEQ ID NO: 313107 - DNA, 20 bp, Artificial
  CRISPR gRNA sequence
tatggacctgggggtggagg

SEQ ID NO: 313108 - DNA, 20 bp, Artificial
  CRISPR gRNA sequence
atggacctgggggtggagga

SEQ ID NO: 313109 - DNA, 20 bp, Artificial
  CRISPR gRNA sequence
tggacctgggggtggaggaa

SEQ ID NO: 313110 - DNA, 20 bp, Artificial
  CRISPR gRNA sequence
ggggtggaggaatccaaggg

SEQ ID NO: 313111 - DNA, 20 bp, Artificial
  CRISPR gRNA sequence
atgaggaaaatgaggtgaga

SEQ ID NO: 313112 - DNA, 20 bp, Artificial
  CRISPR gRNA sequence
ggagtggaaaagtacaaagt

SEQ ID NO: 313113 - DNA, 20 bp, Artificial
  CRISPR gRNA sequence
agttagcgtggggaatagtg

SEQ ID NO: 313114 - DNA, 20 bp, Artificial
  CRISPR gRNA sequence
gcgtggggaatagtgtcttt

SEQ ID NO: 313115 - DNA, 20 bp, Artificial
  CRISPR gRNA sequence
tagggctaggagtggaaaaa

SEQ ID NO: 313116 - DNA, 20 bp, Artificial
  CRISPR gRNA sequence
agggctaggagtggaaaaaa

SEQ ID NO: 313117 - DNA, 20 bp, Artificial
  CRISPR gRNA sequence
gggctaggagtggaaaaaat

SEQ ID NO: 313118 - DNA, 20 bp, Artificial
  CRISPR gRNA sequence
ggagtggaaaaaatactagg

SEQ ID NO: 313119 - DNA, 20 bp, Artificial
  CRISPR gRNA sequence
ggtactgagtcagagtggaa

SEQ ID NO: 313120 - DNA, 20 bp, Artificial
  CRISPR gRNA sequence
agtcagagtggaaaacagtg

SEQ ID NO: 313121 - DNA, 20 bp, Artificial
  CRISPR gRNA sequence
caaggcagggagtggaaaag

SEQ ID NO: 313122 - DNA, 20 bp, Artificial
  CRISPR gRNA sequence
aaggcagggagtggaaaagt

SEQ ID NO: 313123 - DNA, 20 bp, Artificial
  CRISPR gRNA sequence
ggtactgagtccgagtggag

SEQ ID NO: 313124 - DNA, 20 bp, Artificial
  CRISPR gRNA sequence
agtccgagtggagaaaagtg

SEQ ID NO: 313125 - DNA, 20 bp, Artificial
  CRISPR gRNA sequence
ctctatgatgaggaggcttc

SEQ ID NO: 313126 - DNA, 20 bp, Artificial
  CRISPR gRNA sequence
tctatgatgaggaggcttca

SEQ ID NO: 313127 - DNA, 20 bp, Artificial
  CRISPR gRNA sequence
tatgatgaggaggcttcagc

SEQ ID NO: 313128 - DNA, 20 bp, Artificial
  CRISPR gRNA sequence
tgatgaggaggcttcagcag

SEQ ID NO: 313129 - DNA, 20 bp, Artificial
  CRISPR gRNA sequence
cagcagaggtgcctgaagac

SEQ ID NO: 313130 - DNA, 20 bp, Artificial
  CRISPR gRNA sequence
agcagaggtgcctgaagacc

SEQ ID NO: 313131 - DNA, 20 bp, Artificial
  CRISPR gRNA sequence
aagacctcaccccagagcct

SEQ ID NO: 313132 - DNA, 20 bp, Artificial
  CRISPR gRNA sequence
accccagagcctcagataaa

SEQ ID NO: 313133 - DNA, 20 bp, Artificial
  CRISPR gRNA sequence
agataaagagacctaagaat

SEQ ID NO: 313134 - DNA, 20 bp, Artificial
  CRISPR gRNA sequence
agaatgagggtgcctgggct

SEQ ID NO: 313135 - DNA, 20 bp, Artificial
  CRISPR gRNA sequence
ggctaagattgcaagtatgt

SEQ ID NO: 313136 - DNA, 20 bp, Artificial
  CRISPR gRNA sequence
agattgcaagtatgtgaaaa

SEQ ID NO: 313137 - DNA, 20 bp, Artificial
  CRISPR gRNA sequence
caagtatgtgaaaaagcatg

SEQ ID NO: 313138 - DNA, 20 bp, Artificial
  CRISPR gRNA sequence
gcgggaggctgagatcttga

SEQ ID NO: 313139 - DNA, 20 bp, Artificial
  CRISPR gRNA sequence
agatcttgattgcagccccc

SEQ ID NO: 313140 - DNA, 20 bp, Artificial
  CRISPR gRNA sequence
gattgcagcccccttcagag

SEQ ID NO: 313141 - DNA, 20 bp, Artificial
  CRISPR gRNA sequence
attgcagcccccttcagaga

SEQ ID NO: 313142 - DNA, 20 bp, Artificial
  CRISPR gRNA sequence
cagcccccttcagagactgc

SEQ ID NO: 313143 - DNA, 20 bp, Artificial
  CRISPR gRNA sequence
cagagactgccatgcactga

SEQ ID NO: 313144 - DNA, 20 bp, Artificial
  CRISPR gRNA sequence
agagactgccatgcactgac

SEQ ID NO: 313145 - DNA, 20 bp, Artificial
  CRISPR gRNA sequence
ccatgcactgactgtgcacc

SEQ ID NO: 313146 - DNA, 20 bp, Artificial
  CRISPR gRNA sequence
actgtgcaccaagtctgctg

SEQ ID NO: 313147 - DNA, 20 bp, Artificial
  CRISPR gRNA sequence
tgcaccaagtctgctgtaga

SEQ ID NO: 313148 - DNA, 20 bp, Artificial
  CRISPR gRNA sequence
ctgtagaaagggcaacttcc

SEQ ID NO: 313149 - DNA, 20 bp, Artificial
  CRISPR gRNA sequence
tagaaagggcaacttcctca

SEQ ID NO: 313150 - DNA, 20 bp, Artificial
  CRISPR gRNA sequence
cctcagcaaggcttgtcaga

SEQ ID NO: 313151 - DNA, 20 bp, Artificial
  CRISPR gRNA sequence
ctcagcaaggcttgtcagat

SEQ ID NO: 313152 - DNA, 20 bp, Artificial
  CRISPR gRNA sequence
agcaaggcttgtcagattaa

SEQ ID NO: 313153 - DNA, 20 bp, Artificial
  CRISPR gRNA sequence
gtcagattaagcctctttaa

SEQ ID NO: 313154 - DNA, 20 bp, Artificial
  CRISPR gRNA sequence
tcagattaagcctctttaat

SEQ ID NO: 313155 - DNA, 20 bp, Artificial
  CRISPR gRNA sequence
agcctctttaattgcctgtg

SEQ ID NO: 313156 - DNA, 20 bp, Artificial
  CRISPR gRNA sequence
tttaattgcctgtggtcagg

SEQ ID NO: 313157 - DNA, 20 bp, Artificial
  CRISPR gRNA sequence
taattgcctgtggtcaggtc

SEQ ID NO: 313158 - DNA, 20 bp, Artificial
  CRISPR gRNA sequence
aattgcctgtggtcaggtct

SEQ ID NO: 313159 - DNA, 20 bp, Artificial
  CRISPR gRNA sequence
attgcctgtggtcaggtctg

SEQ ID NO: 313160 - DNA, 20 bp, Artificial
  CRISPR gRNA sequence
cctgtggtcaggtctgaaaa

SEQ ID NO: 313161 - DNA, 20 bp, Artificial
  CRISPR gRNA sequence
tggtcaggtctgaaaaatca

SEQ ID NO: 313162 - DNA, 20 bp, Artificial
  CRISPR gRNA sequence
aaaaatcacacatagatttt

SEQ ID NO: 313163 - DNA, 20 bp, Artificial
  CRISPR gRNA sequence
ttaatcagaacccagacatc

SEQ ID NO: 313164 - DNA, 20 bp, Artificial
  CRISPR gRNA sequence
taatcagaacccagacatct

SEQ ID NO: 313165 - DNA, 20 bp, Artificial
  CRISPR gRNA sequence
aatcagaacccagacatctc

SEQ ID NO: 313166 - DNA, 20 bp, Artificial
  CRISPR gRNA sequence
atcagaacccagacatctca

SEQ ID NO: 313167 - DNA, 20 bp, Artificial
  CRISPR gRNA sequence
aggagagacagacaataacc

SEQ ID NO: 313168 - DNA, 20 bp, Artificial
  CRISPR gRNA sequence
tcttcaatagaatggttaga

SEQ ID NO: 313169 - DNA, 20 bp, Artificial
  CRISPR gRNA sequence
caatagaatggttagagaaa

SEQ ID NO: 313170 - DNA, 20 bp, Artificial
  CRISPR gRNA sequence
aatagaatggttagagaaat

SEQ ID NO: 313171 - DNA, 20 bp, Artificial
  CRISPR gRNA sequence
gagaaatctccctgggaggt

SEQ ID NO: 313172 - DNA, 20 bp, Artificial
  CRISPR gRNA sequence
cctgggaggtagcatttaat

SEQ ID NO: 313173 - DNA, 20 bp, Artificial
  CRISPR gRNA sequence
ggaggtagcatttaatgaaa

SEQ ID NO: 313174 - DNA, 20 bp, Artificial
  CRISPR gRNA sequence
aatgaaagacctacatgaag

SEQ ID NO: 313175 - DNA, 20 bp, Artificial
  CRISPR gRNA sequence
atgaaagacctacatgaagt

SEQ ID NO: 313176 - DNA, 20 bp, Artificial
  CRISPR gRNA sequence
catgaagtgaaggagaagct

SEQ ID NO: 313177 - DNA, 20 bp, Artificial
  CRISPR gRNA sequence
tgagactgtctggaggaaga

SEQ ID NO: 313178 - DNA, 20 bp, Artificial
  CRISPR gRNA sequence
tctggaggaagaaccttctg

SEQ ID NO: 313179 - DNA, 20 bp, Artificial
  CRISPR gRNA sequence
gaggaagaaccttctggaca

SEQ ID NO: 313180 - DNA, 20 bp, Artificial
  CRISPR gRNA sequence
ctggacagagggaacaacat

SEQ ID NO: 313181 - DNA, 20 bp, Artificial
  CRISPR gRNA sequence
tggacagagggaacaacatg

SEQ ID NO: 313182 - DNA, 20 bp, Artificial
  CRISPR gRNA sequence
gacagagggaacaacatgag

SEQ ID NO: 313183 - DNA, 20 bp, Artificial
  CRISPR gRNA sequence
gagacagagtgtgtgatctt

SEQ ID NO: 313184 - DNA, 20 bp, Artificial
  CRISPR gRNA sequence
agacagagtgtgtgatcttt

SEQ ID NO: 313185 - DNA, 20 bp, Artificial
  CRISPR gRNA sequence
ttggaggaatgtcaagggag

SEQ ID NO: 313186 - DNA, 20 bp, Artificial
  CRISPR gRNA sequence
tggaggaatgtcaagggagg

SEQ ID NO: 313187 - DNA, 20 bp, Artificial
  CRISPR gRNA sequence
ggaggaatgtcaagggaggc

SEQ ID NO: 313188 - DNA, 20 bp, Artificial
  CRISPR gRNA sequence
gaggaatgtcaagggaggca

SEQ ID NO: 313189 - DNA, 20 bp, Artificial
  CRISPR gRNA sequence
gggagagtaagcaggggaaa

SEQ ID NO: 313190 - DNA, 20 bp, Artificial
  CRISPR gRNA sequence
ataggtactggggacccaat

SEQ ID NO: 313191 - DNA, 20 bp, Artificial
  CRISPR gRNA sequence
gggacccaattacatgaggt

SEQ ID NO: 313192 - DNA, 20 bp, Artificial
  CRISPR gRNA sequence
catgaggtcttgtaaggcca

SEQ ID NO: 313193 - DNA, 20 bp, Artificial
  CRISPR gRNA sequence
gtaaggccaggggaaggact

SEQ ID NO: 313194 - DNA, 20 bp, Artificial
  CRISPR gRNA sequence
taaggccaggggaaggactt

SEQ ID NO: 313195 - DNA, 20 bp, Artificial
  CRISPR gRNA sequence
tggatgtagttctcagtgtg

SEQ ID NO: 313196 - DNA, 20 bp, Artificial
  CRISPR gRNA sequence
ggatgtagttctcagtgtga

SEQ ID NO: 313197 - DNA, 20 bp, Artificial
  CRISPR gRNA sequence
gatgtagttctcagtgtgag

SEQ ID NO: 313198 - DNA, 20 bp, Artificial
  CRISPR gRNA sequence
tcagtgtgaggggaagggat

SEQ ID NO: 313199 - DNA, 20 bp, Artificial
  CRISPR gRNA sequence
agtgtgaggggaagggatct

SEQ ID NO: 313200 - DNA, 20 bp, Artificial
  CRISPR gRNA sequence
gatatatttttcagtttggt

SEQ ID NO: 313201 - DNA, 20 bp, Artificial
  CRISPR gRNA sequence
ttcagtttggtggaaggcat

SEQ ID NO: 313202 - DNA, 20 bp, Artificial
  CRISPR gRNA sequence
tcagtttggtggaaggcatc

SEQ ID NO: 313203 - DNA, 20 bp, Artificial
  CRISPR gRNA sequence
cagtttggtggaaggcatca

SEQ ID NO: 313204 - DNA, 20 bp, Artificial
  CRISPR gRNA sequence
agtttggtggaaggcatcag

SEQ ID NO: 313205 - DNA, 20 bp, Artificial
  CRISPR gRNA sequence
ggtggaaggcatcagaggct

SEQ ID NO: 313206 - DNA, 20 bp, Artificial
  CRISPR gRNA sequence
gtggaaggcatcagaggctt

SEQ ID NO: 313207 - DNA, 20 bp, Artificial
  CRISPR gRNA sequence
ctgaacaggaggattatgtg

SEQ ID NO: 313208 - DNA, 20 bp, Artificial
  CRISPR gRNA sequence
tgaacaggaggattatgtga

SEQ ID NO: 313209 - DNA, 20 bp, Artificial
  CRISPR gRNA sequence
aacaggaggattatgtgatt

SEQ ID NO: 313210 - DNA, 20 bp, Artificial
  CRISPR gRNA sequence
tgtgattggagctgtatttt

SEQ ID NO: 313211 - DNA, 20 bp, Artificial
  CRISPR gRNA sequence
gagctgtatttttaagggat

SEQ ID NO: 313212 - DNA, 20 bp, Artificial
  CRISPR gRNA sequence
tatttttaagggatcatttt

SEQ ID NO: 313213 - DNA, 20 bp, Artificial
  CRISPR gRNA sequence
ttaagggatcattttggctt

SEQ ID NO: 313214 - DNA, 20 bp, Artificial
  CRISPR gRNA sequence
taagggatcattttggcttg

SEQ ID NO: 313215 - DNA, 20 bp, Artificial
  CRISPR gRNA sequence
aagggatcattttggcttga

SEQ ID NO: 313216 - DNA, 20 bp, Artificial
  CRISPR gRNA sequence
agggatcattttggcttgag

SEQ ID NO: 313217 - DNA, 20 bp, Artificial
  CRISPR gRNA sequence
tggcttgagaaactagaccc

SEQ ID NO: 313218 - DNA, 20 bp, Artificial
  CRISPR gRNA sequence
ggcttgagaaactagacccg

SEQ ID NO: 313219 - DNA, 20 bp, Artificial
  CRISPR gRNA sequence
gcttgagaaactagacccgg

SEQ ID NO: 313220 - DNA, 20 bp, Artificial
  CRISPR gRNA sequence
gagaaactagacccggggac

SEQ ID NO: 313221 - DNA, 20 bp, Artificial
  CRISPR gRNA sequence
agaaactagacccggggaca

SEQ ID NO: 313222 - DNA, 20 bp, Artificial
  CRISPR gRNA sequence
gacccggggacaaggacgga

SEQ ID NO: 313223 - DNA, 20 bp, Artificial
  CRISPR gRNA sequence
ggagacaattacattagtct

SEQ ID NO: 313224 - DNA, 20 bp, Artificial
  CRISPR gRNA sequence
cattagtctcctctaccctt

SEQ ID NO: 313225 - DNA, 20 bp, Artificial
  CRISPR gRNA sequence
gtctcctctacccttttctt

SEQ ID NO: 313226 - DNA, 20 bp, Artificial
  CRISPR gRNA sequence
ctctacccttttcttaacat

SEQ ID NO: 313227 - DNA, 20 bp, Artificial
  CRISPR gRNA sequence
tacccttttcttaacatatt

SEQ ID NO: 313228 - DNA, 20 bp, Artificial
  CRISPR gRNA sequence
cccttttcttaacatattgg

SEQ ID NO: 313229 - DNA, 20 bp, Artificial
  CRISPR gRNA sequence
ttcttaacatattggagttc

SEQ ID NO: 313230 - DNA, 20 bp, Artificial
  CRISPR gRNA sequence
tcttaacatattggagttca

SEQ ID NO: 313231 - DNA, 20 bp, Artificial
  CRISPR gRNA sequence
cttaacatattggagttcag

SEQ ID NO: 313232 - DNA, 20 bp, Artificial
  CRISPR gRNA sequence
ttaacatattggagttcagc

SEQ ID NO: 313233 - DNA, 20 bp, Artificial
  CRISPR gRNA sequence
aacatattggagttcagctc

SEQ ID NO: 313234 - DNA, 20 bp, Artificial
  CRISPR gRNA sequence
acatattggagttcagctct

SEQ ID NO: 313235 - DNA, 20 bp, Artificial
  CRISPR gRNA sequence
gagttcagctctggctgtag

SEQ ID NO: 313236 - DNA, 20 bp, Artificial
  CRISPR gRNA sequence
agctctggctgtagtagttc

SEQ ID NO: 313237 - DNA, 20 bp, Artificial
  CRISPR gRNA sequence
tggctgtagtagttctagat

SEQ ID NO: 313238 - DNA, 20 bp, Artificial
  CRISPR gRNA sequence
gctgtagtagttctagatct

SEQ ID NO: 313239 - DNA, 20 bp, Artificial
  CRISPR gRNA sequence
tagtagttctagatctcctc

SEQ ID NO: 313240 - DNA, 20 bp, Artificial
  CRISPR gRNA sequence
tagatctcctcagacacact

SEQ ID NO: 313241 - DNA, 20 bp, Artificial
  CRISPR gRNA sequence
gatctcctcagacacacttg

SEQ ID NO: 313242 - DNA, 20 bp, Artificial
  CRISPR gRNA sequence
ctcagacacacttgtgtaga

SEQ ID NO: 313243 - DNA, 20 bp, Artificial
  CRISPR gRNA sequence
agacacacttgtgtagagcc

SEQ ID NO: 313244 - DNA, 20 bp, Artificial
  CRISPR gRNA sequence
gtgtagagcctctgttgggt

SEQ ID NO: 313245 - DNA, 20 bp, Artificial
  CRISPR gRNA sequence
tgtagagcctctgttgggta

SEQ ID NO: 313246 - DNA, 20 bp, Artificial
  CRISPR gRNA sequence
tgttgggtattttgggtaca

SEQ ID NO: 313247 - DNA, 20 bp, Artificial
  CRISPR gRNA sequence
ttgggtattttgggtacaca

SEQ ID NO: 313248 - DNA, 20 bp, Artificial
  CRISPR gRNA sequence
ggtattttgggtacacaaat

SEQ ID NO: 313249 - DNA, 20 bp, Artificial
  CRISPR gRNA sequence
tgggtacacaaatgattcat

SEQ ID NO: 313250 - DNA, 20 bp, Artificial
  CRISPR gRNA sequence
gggtacacaaatgattcatc

SEQ ID NO: 313251 - DNA, 20 bp, Artificial
  CRISPR gRNA sequence
ggtacacaaatgattcatct

SEQ ID NO: 313252 - DNA, 20 bp, Artificial
  CRISPR gRNA sequence
atcttggttatacagatgat

SEQ ID NO: 313253 - DNA, 20 bp, Artificial
  CRISPR gRNA sequence
ggttatacagatgatttaga

SEQ ID NO: 313254 - DNA, 20 bp, Artificial
  CRISPR gRNA sequence
gttatacagatgatttagat

SEQ ID NO: 313255 - DNA, 20 bp, Artificial
  CRISPR gRNA sequence
tacagatgatttagatgatt

SEQ ID NO: 313256 - DNA, 20 bp, Artificial
  CRISPR gRNA sequence
agatgattgtagacagaaga

SEQ ID NO: 313257 - DNA, 20 bp, Artificial
  CRISPR gRNA sequence
gatgattgtagacagaagag

SEQ ID NO: 313258 - DNA, 20 bp, Artificial
  CRISPR gRNA sequence
tagacagaagagggttgtct

SEQ ID NO: 313259 - DNA, 20 bp, Artificial
  CRISPR gRNA sequence
tctggtcattcccagacagg

SEQ ID NO: 313260 - DNA, 20 bp, Artificial
  CRISPR gRNA sequence
gtcattcccagacaggggag

SEQ ID NO: 313261 - DNA, 20 bp, Artificial
  CRISPR gRNA sequence
ccagacaggggagcattcct

SEQ ID NO: 313262 - DNA, 20 bp, Artificial
  CRISPR gRNA sequence
cttgagatagagtagaggaa

SEQ ID NO: 313263 - DNA, 20 bp, Artificial
  CRISPR gRNA sequence
gagatagagtagaggaaggc

SEQ ID NO: 313264 - DNA, 20 bp, Artificial
  CRISPR gRNA sequence
agatagagtagaggaaggct

SEQ ID NO: 313265 - DNA, 20 bp, Artificial
  CRISPR gRNA sequence
aaggggaggaagacagtacc

SEQ ID NO: 313266 - DNA, 20 bp, Artificial
  CRISPR gRNA sequence
ttgctatctagatagagaca

SEQ ID NO: 313267 - DNA, 20 bp, Artificial
  CRISPR gRNA sequence
ctatctagatagagacatcc

SEQ ID NO: 313268 - DNA, 20 bp, Artificial
  CRISPR gRNA sequence
tctagatagagacatccagc

SEQ ID NO: 313269 - DNA, 20 bp, Artificial
  CRISPR gRNA sequence
gatagagacatccagcagga

SEQ ID NO: 313270 - DNA, 20 bp, Artificial
  CRISPR gRNA sequence
aatacaggtatctgaaactc

SEQ ID NO: 313271 - DNA, 20 bp, Artificial
  CRISPR gRNA sequence
aaactctagtgaaagttata

SEQ ID NO: 313272 - DNA, 20 bp, Artificial
  CRISPR gRNA sequence
tagtgaaagttataggctgg

SEQ ID NO: 313273 - DNA, 20 bp, Artificial
  CRISPR gRNA sequence
gtgaaagttataggctggca

SEQ ID NO: 313274 - DNA, 20 bp, Artificial
  CRISPR gRNA sequence
taggctggcaataagcacct

SEQ ID NO: 313275 - DNA, 20 bp, Artificial
  CRISPR gRNA sequence
gcaataagcacctgggagtt

SEQ ID NO: 313276 - DNA, 20 bp, Artificial
  CRISPR gRNA sequence
ggagttattagcttttactt

SEQ ID NO: 313277 - DNA, 20 bp, Artificial
  CRISPR gRNA sequence
ttagcttttacttgacagtt

SEQ ID NO: 313278 - DNA, 20 bp, Artificial
  CRISPR gRNA sequence
gcttttacttgacagttgaa

SEQ ID NO: 313279 - DNA, 20 bp, Artificial
  CRISPR gRNA sequence
ttacttgacagttgaatccg

SEQ ID NO: 313280 - DNA, 20 bp, Artificial
  CRISPR gRNA sequence
tacttgacagttgaatccgt

SEQ ID NO: 313281 - DNA, 20 bp, Artificial
  CRISPR gRNA sequence
acttgacagttgaatccgtg

SEQ ID NO: 313282 - DNA, 20 bp, Artificial
  CRISPR gRNA sequence
cttgacagttgaatccgtgg

SEQ ID NO: 313283 - DNA, 20 bp, Artificial
  CRISPR gRNA sequence
gacagttgaatccgtggggc

SEQ ID NO: 313284 - DNA, 20 bp, Artificial
  CRISPR gRNA sequence
acagttgaatccgtggggct

SEQ ID NO: 313285 - DNA, 20 bp, Artificial
  CRISPR gRNA sequence
aatccgtggggctagaggag

SEQ ID NO: 313286 - DNA, 20 bp, Artificial
  CRISPR gRNA sequence
gaggagaaaaaccaggaaag

SEQ ID NO: 313287 - DNA, 20 bp, Artificial
  CRISPR gRNA sequence
aaggttaccaaaattaaaga

SEQ ID NO: 313288 - DNA, 20 bp, Artificial
  CRISPR gRNA sequence
ccaaaattaaagagtgattt

SEQ ID NO: 313289 - DNA, 20 bp, Artificial
  CRISPR gRNA sequence
aagagtgatttgagaaaatt

SEQ ID NO: 313290 - DNA, 20 bp, Artificial
  CRISPR gRNA sequence
gagaaaattaacaaggaaat

SEQ ID NO: 313291 - DNA, 20 bp, Artificial
  CRISPR gRNA sequence
agaaaattaacaaggaaatc

SEQ ID NO: 313292 - DNA, 20 bp, Artificial
  CRISPR gRNA sequence
acaaggaaatcagagattgg

SEQ ID NO: 313293 - DNA, 20 bp, Artificial
  CRISPR gRNA sequence
ggaaagaatagagcatttca

SEQ ID NO: 313294 - DNA, 20 bp, Artificial
  CRISPR gRNA sequence
caatgaggagagatgccaac

SEQ ID NO: 313295 - DNA, 20 bp, Artificial
  CRISPR gRNA sequence
aatgaggagagatgccaaca

SEQ ID NO: 313296 - DNA, 20 bp, Artificial
  CRISPR gRNA sequence
gcatttgacacagcggtcaa

SEQ ID NO: 313297 - DNA, 20 bp, Artificial
  CRISPR gRNA sequence
catttgacacagcggtcaaa

SEQ ID NO: 313298 - DNA, 20 bp, Artificial
  CRISPR gRNA sequence
gacacagcggtcaaatgagt

SEQ ID NO: 313299 - DNA, 20 bp, Artificial
  CRISPR gRNA sequence
acacagcggtcaaatgagtt

SEQ ID NO: 313300 - DNA, 20 bp, Artificial
  CRISPR gRNA sequence
agatctgaaaagagctcaag

SEQ ID NO: 313301 - DNA, 20 bp, Artificial
  CRISPR gRNA sequence
aaaagagctcaagccttggc

SEQ ID NO: 313302 - DNA, 20 bp, Artificial
  CRISPR gRNA sequence
aagccttggccatggtgtga

SEQ ID NO: 313303 - DNA, 20 bp, Artificial
  CRISPR gRNA sequence
ggccatggtgtgaagtcacc

SEQ ID NO: 313304 - DNA, 20 bp, Artificial
  CRISPR gRNA sequence
gccatggtgtgaagtcacca

SEQ ID NO: 313305 - DNA, 20 bp, Artificial
  CRISPR gRNA sequence
tgtcagggagtttcagtaga

SEQ ID NO: 313306 - DNA, 20 bp, Artificial
  CRISPR gRNA sequence
gtcagggagtttcagtagag

SEQ ID NO: 313307 - DNA, 20 bp, Artificial
  CRISPR gRNA sequence
tcagggagtttcagtagaga

SEQ ID NO: 313308 - DNA, 20 bp, Artificial
  CRISPR gRNA sequence
cagtagagaggtgggggtgg

SEQ ID NO: 313309 - DNA, 20 bp, Artificial
  CRISPR gRNA sequence
agtagagaggtgggggtggg

SEQ ID NO: 313310 - DNA, 20 bp, Artificial
  CRISPR gRNA sequence
ggaataaaggcagcaattgc

SEQ ID NO: 313311 - DNA, 20 bp, Artificial
  CRISPR gRNA sequence
ctgcttactctttcagggag

SEQ ID NO: 313312 - DNA, 20 bp, Artificial
  CRISPR gRNA sequence
cttactctttcagggagttt

SEQ ID NO: 313313 - DNA, 20 bp, Artificial
  CRISPR gRNA sequence
actctttcagggagtttgac

SEQ ID NO: 313314 - DNA, 20 bp, Artificial
  CRISPR gRNA sequence
ctctttcagggagtttgact

SEQ ID NO: 313315 - DNA, 20 bp, Artificial
  CRISPR gRNA sequence
tttcagggagtttgactcca

SEQ ID NO: 313316 - DNA, 20 bp, Artificial
  CRISPR gRNA sequence
tcagggagtttgactccaag

SEQ ID NO: 313317 - DNA, 20 bp, Artificial
  CRISPR gRNA sequence
cagggagtttgactccaagg

SEQ ID NO: 313318 - DNA, 20 bp, Artificial
  CRISPR gRNA sequence
agggagtttgactccaaggg

SEQ ID NO: 313319 - DNA, 20 bp, Artificial
  CRISPR gRNA sequence
gactccaagggaaagagaaa

SEQ ID NO: 313320 - DNA, 20 bp, Artificial
  CRISPR gRNA sequence
actccaagggaaagagaaac

SEQ ID NO: 313321 - DNA, 20 bp, Artificial
  CRISPR gRNA sequence
caagggaaagagaaactaaa

SEQ ID NO: 313322 - DNA, 20 bp, Artificial
  CRISPR gRNA sequence
aaagcagtagcacaaggttt

SEQ ID NO: 313323 - DNA, 20 bp, Artificial
  CRISPR gRNA sequence
gtgtttgaagtaatggaggt

SEQ ID NO: 313324 - DNA, 20 bp, Artificial
  CRISPR gRNA sequence
tgtttgaagtaatggaggtg

SEQ ID NO: 313325 - DNA, 20 bp, Artificial
  CRISPR gRNA sequence
gaagtaatggaggtgaacca

SEQ ID NO: 313326 - DNA, 20 bp, Artificial
  CRISPR gRNA sequence
aagtaatggaggtgaaccag

SEQ ID NO: 313327 - DNA, 20 bp, Artificial
  CRISPR gRNA sequence
gaggccgagtgaagtgagac

SEQ ID NO: 313328 - DNA, 20 bp, Artificial
  CRISPR gRNA sequence
cagatttggaatgtcaccag

SEQ ID NO: 313329 - DNA, 20 bp, Artificial
  CRISPR gRNA sequence
ggaatgtcaccagtccgcac

SEQ ID NO: 313330 - DNA, 20 bp, Artificial
  CRISPR gRNA sequence
gaatgtcaccagtccgcaca

SEQ ID NO: 313331 - DNA, 20 bp, Artificial
  CRISPR gRNA sequence
aataatttcctccagaactg

SEQ ID NO: 313332 - DNA, 20 bp, Artificial
  CRISPR gRNA sequence
cctccagaactgctcaattg

SEQ ID NO: 313333 - DNA, 20 bp, Artificial
  CRISPR gRNA sequence
ctccagaactgctcaattgc

SEQ ID NO: 313334 - DNA, 20 bp, Artificial
  CRISPR gRNA sequence
cagaactgctcaattgccca

SEQ ID NO: 313335 - DNA, 20 bp, Artificial
  CRISPR gRNA sequence
ctcaattgcccagttgtaag

SEQ ID NO: 313336 - DNA, 20 bp, Artificial
  CRISPR gRNA sequence
aattgcccagttgtaagaac

SEQ ID NO: 313337 - DNA, 20 bp, Artificial
  CRISPR gRNA sequence
cccagttgtaagaacagata

SEQ ID NO: 313338 - DNA, 20 bp, Artificial
  CRISPR gRNA sequence
taagaacagatatgtagacc

SEQ ID NO: 313339 - DNA, 20 bp, Artificial
  CRISPR gRNA sequence
tatagagacaaaggggtgtg

SEQ ID NO: 313340 - DNA, 20 bp, Artificial
  CRISPR gRNA sequence
atagagacaaaggggtgtgt

SEQ ID NO: 313341 - DNA, 20 bp, Artificial
  CRISPR gRNA sequence
tagagacaaaggggtgtgtt

SEQ ID NO: 313342 - DNA, 20 bp, Artificial
  CRISPR gRNA sequence
attgaagttgtggaaaggaa

SEQ ID NO: 313343 - DNA, 20 bp, Artificial
  CRISPR gRNA sequence
ttgaagttgtggaaaggaat

SEQ ID NO: 313344 - DNA, 20 bp, Artificial
  CRISPR gRNA sequence
aagttgtggaaaggaataat

SEQ ID NO: 313345 - DNA, 20 bp, Artificial
  CRISPR gRNA sequence
tggaaaggaataattacaaa

SEQ ID NO: 313346 - DNA, 20 bp, Artificial
  CRISPR gRNA sequence
caaagacatactattgttgc

SEQ ID NO: 313347 - DNA, 20 bp, Artificial
  CRISPR gRNA sequence
ttgttgcattgtccaatata

SEQ ID NO: 313348 - DNA, 20 bp, Artificial
  CRISPR gRNA sequence
ttgcattgtccaatataata

SEQ ID NO: 313349 - DNA, 20 bp, Artificial
  CRISPR gRNA sequence
cattgtccaatataataacc

SEQ ID NO: 313350 - DNA, 20 bp, Artificial
  CRISPR gRNA sequence
tccaatataataaccactag

SEQ ID NO: 313351 - DNA, 20 bp, Artificial
  CRISPR gRNA sequence
gccatatgtgactacttaaa

SEQ ID NO: 313352 - DNA, 20 bp, Artificial
  CRISPR gRNA sequence
cttaaatttcaattaattaa

SEQ ID NO: 313353 - DNA, 20 bp, Artificial
  CRISPR gRNA sequence
aaatttcaattaattaaaat

SEQ ID NO: 313354 - DNA, 20 bp, Artificial
  CRISPR gRNA sequence
aatttcaattaattaaaatt

SEQ ID NO: 313355 - DNA, 20 bp, Artificial
  CRISPR gRNA sequence
caattaattaaaattaaata

SEQ ID NO: 313356 - DNA, 20 bp, Artificial
  CRISPR gRNA sequence
aattaattaaaattaaataa

SEQ ID NO: 313357 - DNA, 20 bp, Artificial
  CRISPR gRNA sequence
attaaaattaaataagatta

SEQ ID NO: 313358 - DNA, 20 bp, Artificial
  CRISPR gRNA sequence
aaattaaataagattaaaaa

SEQ ID NO: 313359 - DNA, 20 bp, Artificial
  CRISPR gRNA sequence
aataagattaaaaattcatc

SEQ ID NO: 313360 - DNA, 20 bp, Artificial
  CRISPR gRNA sequence
aaaattcatcttctcagtca

SEQ ID NO: 313361 - DNA, 20 bp, Artificial
  CRISPR gRNA sequence
atcttctcagtcatactagc

SEQ ID NO: 313362 - DNA, 20 bp, Artificial
  CRISPR gRNA sequence
ctcagtcatactagctatgt

SEQ ID NO: 313363 - DNA, 20 bp, Artificial
  CRISPR gRNA sequence
tcagtcatactagctatgta

SEQ ID NO: 313364 - DNA, 20 bp, Artificial
  CRISPR gRNA sequence
agtcatactagctatgtatc

SEQ ID NO: 313365 - DNA, 20 bp, Artificial
  CRISPR gRNA sequence
gctatgtatcaattgctcaa

SEQ ID NO: 313366 - DNA, 20 bp, Artificial
  CRISPR gRNA sequence
tgtatcaattgctcaatagc

SEQ ID NO: 313367 - DNA, 20 bp, Artificial
  CRISPR gRNA sequence
ctcaatagccacaggggctg

SEQ ID NO: 313368 - DNA, 20 bp, Artificial
  CRISPR gRNA sequence
aatagccacaggggctggtg

SEQ ID NO: 313369 - DNA, 20 bp, Artificial
  CRISPR gRNA sequence
gtggctatcatattgttcag

SEQ ID NO: 313370 - DNA, 20 bp, Artificial
  CRISPR gRNA sequence
tcatattgttcagcacagag

SEQ ID NO: 313371 - DNA, 20 bp, Artificial
  CRISPR gRNA sequence
ttcagcacagagacagagca

SEQ ID NO: 313372 - DNA, 20 bp, Artificial
  CRISPR gRNA sequence
agcacagagacagagcattt

SEQ ID NO: 313373 - DNA, 20 bp, Artificial
  CRISPR gRNA sequence
ccattatcactaagagttct

SEQ ID NO: 313374 - DNA, 20 bp, Artificial
  CRISPR gRNA sequence
cattatcactaagagttctt

SEQ ID NO: 313375 - DNA, 20 bp, Artificial
  CRISPR gRNA sequence
tcactaagagttcttgtgga

SEQ ID NO: 313376 - DNA, 20 bp, Artificial
  CRISPR gRNA sequence
agagttcttgtggaaaacac

SEQ ID NO: 313377 - DNA, 20 bp, Artificial
  CRISPR gRNA sequence
ttgtggaaaacactgcacta

SEQ ID NO: 313378 - DNA, 20 bp, Artificial
  CRISPR gRNA sequence
gtggaaaacactgcactaca

SEQ ID NO: 313379 - DNA, 20 bp, Artificial
  CRISPR gRNA sequence
tggaaaacactgcactacag

SEQ ID NO: 313380 - DNA, 20 bp, Artificial
  CRISPR gRNA sequence
cactacagggtctggataaa

SEQ ID NO: 313381 - DNA, 20 bp, Artificial
  CRISPR gRNA sequence
cagggtctggataaagctga

SEQ ID NO: 313382 - DNA, 20 bp, Artificial
  CRISPR gRNA sequence
gataaagctgaggtcttgat

SEQ ID NO: 313383 - DNA, 20 bp, Artificial
  CRISPR gRNA sequence
aggtcttgattaagttgaac

SEQ ID NO: 313384 - DNA, 20 bp, Artificial
  CRISPR gRNA sequence
gattaagttgaacaacagtt

SEQ ID NO: 313385 - DNA, 20 bp, Artificial
  CRISPR gRNA sequence
attaagttgaacaacagttg

SEQ ID NO: 313386 - DNA, 20 bp, Artificial
  CRISPR gRNA sequence
agttgaacaacagttgtaga

SEQ ID NO: 313387 - DNA, 20 bp, Artificial
  CRISPR gRNA sequence
aacaacagttgtagaaggag

SEQ ID NO: 313388 - DNA, 20 bp, Artificial
  CRISPR gRNA sequence
tagaaggagtaagcaagagc

SEQ ID NO: 313389 - DNA, 20 bp, Artificial
  CRISPR gRNA sequence
gatgaataggaggttgtgga

SEQ ID NO: 313390 - DNA, 20 bp, Artificial
  CRISPR gRNA sequence
tggacggagattagtatatt

SEQ ID NO: 313391 - DNA, 20 bp, Artificial
  CRISPR gRNA sequence
gtatattgagattaagattc

SEQ ID NO: 313392 - DNA, 20 bp, Artificial
  CRISPR gRNA sequence
agattaagattctagggact

SEQ ID NO: 313393 - DNA, 20 bp, Artificial
  CRISPR gRNA sequence
agattctagggactgagctg

SEQ ID NO: 313394 - DNA, 20 bp, Artificial
  CRISPR gRNA sequence
tagggactgagctgctccag

SEQ ID NO: 313395 - DNA, 20 bp, Artificial
  CRISPR gRNA sequence
gggactgagctgctccaggt

SEQ ID NO: 313396 - DNA, 20 bp, Artificial
  CRISPR gRNA sequence
agctgctccaggtgaaaagt

SEQ ID NO: 313397 - DNA, 20 bp, Artificial
  CRISPR gRNA sequence
ctccaggtgaaaagtttcag

SEQ ID NO: 313398 - DNA, 20 bp, Artificial
  CRISPR gRNA sequence
caggtgaaaagtttcagggt

SEQ ID NO: 313399 - DNA, 20 bp, Artificial
  CRISPR gRNA sequence
cagggttatgtcataagaag

SEQ ID NO: 313400 - DNA, 20 bp, Artificial
  CRISPR gRNA sequence
agggttatgtcataagaagg

SEQ ID NO: 313401 - DNA, 20 bp, Artificial
  CRISPR gRNA sequence
tgtcataagaaggtgggggg

SEQ ID NO: 313402 - DNA, 20 bp, Artificial
  CRISPR gRNA sequence
ctgaaatagtctgcgggtgt

SEQ ID NO: 313403 - DNA, 20 bp, Artificial
  CRISPR gRNA sequence
aaatagtctgcgggtgtaga

SEQ ID NO: 313404 - DNA, 20 bp, Artificial
  CRISPR gRNA sequence
cgggtgtagacctgtggagt

SEQ ID NO: 313405 - DNA, 20 bp, Artificial
  CRISPR gRNA sequence
tggagttgacaagatcaaag

SEQ ID NO: 313406 - DNA, 20 bp, Artificial
  CRISPR gRNA sequence
acaagatcaaagaaatttga

SEQ ID NO: 313407 - DNA, 20 bp, Artificial
  CRISPR gRNA sequence
gaggcaaggttgttagactc

SEQ ID NO: 313408 - DNA, 20 bp, Artificial
  CRISPR gRNA sequence
aggcaaggttgttagactca

SEQ ID NO: 313409 - DNA, 20 bp, Artificial
  CRISPR gRNA sequence
ttagactcattcatgaagaa

SEQ ID NO: 313410 - DNA, 20 bp, Artificial
  CRISPR gRNA sequence
gactcattcatgaagaagtc

SEQ ID NO: 313411 - DNA, 20 bp, Artificial
  CRISPR gRNA sequence
attcatgaagaagtcaccca

SEQ ID NO: 313412 - DNA, 20 bp, Artificial
  CRISPR gRNA sequence
atgaagaagtcacccaaatt

SEQ ID NO: 313413 - DNA, 20 bp, Artificial
  CRISPR gRNA sequence
ttagcaagaccttgcatcta

SEQ ID NO: 313414 - DNA, 20 bp, Artificial
  CRISPR gRNA sequence
gcaagaccttgcatctaatg

SEQ ID NO: 313415 - DNA, 20 bp, Artificial
  CRISPR gRNA sequence
gcatctaatgccaaaatcct

SEQ ID NO: 313416 - DNA, 20 bp, Artificial
  CRISPR gRNA sequence
catctaatgccaaaatcctc

SEQ ID NO: 313417 - DNA, 20 bp, Artificial
  CRISPR gRNA sequence
atgccaaaatcctcatttag

SEQ ID NO: 313418 - DNA, 20 bp, Artificial
  CRISPR gRNA sequence
atttagcaaggtggtagtga

SEQ ID NO: 313419 - DNA, 20 bp, Artificial
  CRISPR gRNA sequence
agcaaggtggtagtgactta

SEQ ID NO: 313420 - DNA, 20 bp, Artificial
  CRISPR gRNA sequence
gcaaggtggtagtgacttag

SEQ ID NO: 313421 - DNA, 20 bp, Artificial
  CRISPR gRNA sequence
agtagctacaagcaatgaga

SEQ ID NO: 313422 - DNA, 20 bp, Artificial
  CRISPR gRNA sequence
gtagctacaagcaatgagaa

SEQ ID NO: 313423 - DNA, 20 bp, Artificial
  CRISPR gRNA sequence
caagcaatgagaaagtcaga

SEQ ID NO: 313424 - DNA, 20 bp, Artificial
  CRISPR gRNA sequence
aaaaggggaaggtgttgctc

SEQ ID NO: 313425 - DNA, 20 bp, Artificial
  CRISPR gRNA sequence
ctcaaagtccccacaaagtg

SEQ ID NO: 313426 - DNA, 20 bp, Artificial
  CRISPR gRNA sequence
aaagtccccacaaagtgtga

SEQ ID NO: 313427 - DNA, 20 bp, Artificial
  CRISPR gRNA sequence
gggctggagcaagtggcttc

SEQ ID NO: 313428 - DNA, 20 bp, Artificial
  CRISPR gRNA sequence
gagcaagtggcttcctttgg

SEQ ID NO: 313429 - DNA, 20 bp, Artificial
  CRISPR gRNA sequence
cctttgggtgaagccagatt

SEQ ID NO: 313430 - DNA, 20 bp, Artificial
  CRISPR gRNA sequence
ctttgggtgaagccagattt

SEQ ID NO: 313431 - DNA, 20 bp, Artificial
  CRISPR gRNA sequence
tgggtgaagccagatttcac

SEQ ID NO: 313432 - DNA, 20 bp, Artificial
  CRISPR gRNA sequence
gggtgaagccagatttcact

SEQ ID NO: 313433 - DNA, 20 bp, Artificial
  CRISPR gRNA sequence
ggtgaagccagatttcactg

SEQ ID NO: 313434 - DNA, 20 bp, Artificial
  CRISPR gRNA sequence
cactgaaataataacctcag

SEQ ID NO: 313435 - DNA, 20 bp, Artificial
  CRISPR gRNA sequence
actgaaataataacctcagg

SEQ ID NO: 313436 - DNA, 20 bp, Artificial
  CRISPR gRNA sequence
aaataataacctcagggaaa

SEQ ID NO: 313437 - DNA, 20 bp, Artificial
  CRISPR gRNA sequence
agggaaacagtcaatgaagg

SEQ ID NO: 313438 - DNA, 20 bp, Artificial
  CRISPR gRNA sequence
aagatgtgggagagtttcct

SEQ ID NO: 313439 - DNA, 20 bp, Artificial
  CRISPR gRNA sequence
ccttgtagtaagtaatggaa

SEQ ID NO: 313440 - DNA, 20 bp, Artificial
  CRISPR gRNA sequence
cttgtagtaagtaatggaat

SEQ ID NO: 313441 - DNA, 20 bp, Artificial
  CRISPR gRNA sequence
gtagtaagtaatggaatgag

SEQ ID NO: 313442 - DNA, 20 bp, Artificial
  CRISPR gRNA sequence
tagtaagtaatggaatgagg

SEQ ID NO: 313443 - DNA, 20 bp, Artificial
  CRISPR gRNA sequence
tcaaagggccaagtaaaact

SEQ ID NO: 313444 - DNA, 20 bp, Artificial
  CRISPR gRNA sequence
caaagggccaagtaaaactt

SEQ ID NO: 313445 - DNA, 20 bp, Artificial
  CRISPR gRNA sequence
aaagggccaagtaaaacttt

SEQ ID NO: 313446 - DNA, 20 bp, Artificial
  CRISPR gRNA sequence
tggaggaagtttagtaaaag

SEQ ID NO: 313447 - DNA, 20 bp, Artificial
  CRISPR gRNA sequence
ggaggaagtttagtaaaaga

SEQ ID NO: 313448 - DNA, 20 bp, Artificial
  CRISPR gRNA sequence
gaggaagtttagtaaaagaa

SEQ ID NO: 313449 - DNA, 20 bp, Artificial
  CRISPR gRNA sequence
agtaaaagaaggaatttttt

SEQ ID NO: 313450 - DNA, 20 bp, Artificial
  CRISPR gRNA sequence
gtaaaagaaggaattttttt

SEQ ID NO: 313451 - DNA, 20 bp, Artificial
  CRISPR gRNA sequence
tttttagtacagataagcat

SEQ ID NO: 313452 - DNA, 20 bp, Artificial
  CRISPR gRNA sequence
ttttagtacagataagcata

SEQ ID NO: 313453 - DNA, 20 bp, Artificial
  CRISPR gRNA sequence
tttagtacagataagcatag

SEQ ID NO: 313454 - DNA, 20 bp, Artificial
  CRISPR gRNA sequence
ttagtacagataagcatagg

SEQ ID NO: 313455 - DNA, 20 bp, Artificial
  CRISPR gRNA sequence
tagtacagataagcatagga

SEQ ID NO: 313456 - DNA, 20 bp, Artificial
  CRISPR gRNA sequence
agtacagataagcataggaa

SEQ ID NO: 313457 - DNA, 20 bp, Artificial
  CRISPR gRNA sequence
gtacagataagcataggaac

SEQ ID NO: 313458 - DNA, 20 bp, Artificial
  CRISPR gRNA sequence
ttaaacatataagatatgca

SEQ ID NO: 313459 - DNA, 20 bp, Artificial
  CRISPR gRNA sequence
aaacatataagatatgcatt

SEQ ID NO: 313460 - DNA, 20 bp, Artificial
  CRISPR gRNA sequence
aacatataagatatgcattt

SEQ ID NO: 313461 - DNA, 20 bp, Artificial
  CRISPR gRNA sequence
ggggatagcagccagggaac

SEQ ID NO: 313462 - DNA, 20 bp, Artificial
  CRISPR gRNA sequence
gggatagcagccagggaaca

SEQ ID NO: 313463 - DNA, 20 bp, Artificial
  CRISPR gRNA sequence
aagtcccagtggggtcagag

SEQ ID NO: 313464 - DNA, 20 bp, Artificial
  CRISPR gRNA sequence
cataaggctagcaaattaca

SEQ ID NO: 313465 - DNA, 20 bp, Artificial
  CRISPR gRNA sequence
ataaggctagcaaattacag

SEQ ID NO: 313466 - DNA, 20 bp, Artificial
  CRISPR gRNA sequence
gcaaattacagtttttgagt

SEQ ID NO: 313467 - DNA, 20 bp, Artificial
  CRISPR gRNA sequence
cagtttttgagtggcattcc

SEQ ID NO: 313468 - DNA, 20 bp, Artificial
  CRISPR gRNA sequence
ttgagtggcattccaacagt

SEQ ID NO: 313469 - DNA, 20 bp, Artificial
  CRISPR gRNA sequence
tgagtggcattccaacagta

SEQ ID NO: 313470 - DNA, 20 bp, Artificial
  CRISPR gRNA sequence
gagtggcattccaacagtag

SEQ ID NO: 313471 - DNA, 20 bp, Artificial
  CRISPR gRNA sequence
agtggcattccaacagtaga

SEQ ID NO: 313472 - DNA, 20 bp, Artificial
  CRISPR gRNA sequence
caacagtagagtgtattgct

SEQ ID NO: 313473 - DNA, 20 bp, Artificial
  CRISPR gRNA sequence
ctcaggaagtccttaattat

SEQ ID NO: 313474 - DNA, 20 bp, Artificial
  CRISPR gRNA sequence
aggaagtccttaattatcct

SEQ ID NO: 313475 - DNA, 20 bp, Artificial
  CRISPR gRNA sequence
aattatcctttgaaacaaat

SEQ ID NO: 313476 - DNA, 20 bp, Artificial
  CRISPR gRNA sequence
attatcctttgaaacaaatt

SEQ ID NO: 313477 - DNA, 20 bp, Artificial
  CRISPR gRNA sequence
tcctttgaaacaaattcctt

SEQ ID NO: 313478 - DNA, 20 bp, Artificial
  CRISPR gRNA sequence
tgaaacaaattccttcagct

SEQ ID NO: 313479 - DNA, 20 bp, Artificial
  CRISPR gRNA sequence
gaaacaaattccttcagctg

SEQ ID NO: 313480 - DNA, 20 bp, Artificial
  CRISPR gRNA sequence
aaacaaattccttcagctga

SEQ ID NO: 313481 - DNA, 20 bp, Artificial
  CRISPR gRNA sequence
cttcagctgattacgaaggc

SEQ ID NO: 313482 - DNA, 20 bp, Artificial
  CRISPR gRNA sequence
cagctgattacgaaggcatc

SEQ ID NO: 313483 - DNA, 20 bp, Artificial
  CRISPR gRNA sequence
agctgattacgaaggcatct

SEQ ID NO: 313484 - DNA, 20 bp, Artificial
  CRISPR gRNA sequence
attacgaaggcatctagctg

SEQ ID NO: 313485 - DNA, 20 bp, Artificial
  CRISPR gRNA sequence
cgaaggcatctagctggatt

SEQ ID NO: 313486 - DNA, 20 bp, Artificial
  CRISPR gRNA sequence
gctggattcttgagcgactt

SEQ ID NO: 313487 - DNA, 20 bp, Artificial
  CRISPR gRNA sequence
gattcttgagcgacttgttc

SEQ ID NO: 313488 - DNA, 20 bp, Artificial
  CRISPR gRNA sequence
ttgagcgacttgttcctgac

SEQ ID NO: 313489 - DNA, 20 bp, Artificial
  CRISPR gRNA sequence
gagcgacttgttcctgacat

SEQ ID NO: 313490 - DNA, 20 bp, Artificial
  CRISPR gRNA sequence
agcgacttgttcctgacatc

SEQ ID NO: 313491 - DNA, 20 bp, Artificial
  CRISPR gRNA sequence
gttcctgacatcatagcaac

SEQ ID NO: 313492 - DNA, 20 bp, Artificial
  CRISPR gRNA sequence
ttcctgacatcatagcaacc

SEQ ID NO: 313493 - DNA, 20 bp, Artificial
  CRISPR gRNA sequence
ctgacatcatagcaacccat

SEQ ID NO: 313494 - DNA, 20 bp, Artificial
  CRISPR gRNA sequence
acatcatagcaacccattgt

SEQ ID NO: 313495 - DNA, 20 bp, Artificial
  CRISPR gRNA sequence
taactagacttcgaccattc

SEQ ID NO: 313496 - DNA, 20 bp, Artificial
  CRISPR gRNA sequence
gacttcgaccattcctctta

SEQ ID NO: 313497 - DNA, 20 bp, Artificial
  CRISPR gRNA sequence
cgaccattcctcttacccaa

SEQ ID NO: 313498 - DNA, 20 bp, Artificial
  CRISPR gRNA sequence
gaccattcctcttacccaag

SEQ ID NO: 313499 - DNA, 20 bp, Artificial
  CRISPR gRNA sequence
ctcttacccaagtgctgggg

SEQ ID NO: 313500 - DNA, 20 bp, Artificial
  CRISPR gRNA sequence
ttacccaagtgctggggaag

SEQ ID NO: 313501 - DNA, 20 bp, Artificial
  CRISPR gRNA sequence
acccaagtgctggggaaggg

SEQ ID NO: 313502 - DNA, 20 bp, Artificial
  CRISPR gRNA sequence
cccaagtgctggggaaggga

SEQ ID NO: 313503 - DNA, 20 bp, Artificial
  CRISPR gRNA sequence
gggaagggagagattctcaa

SEQ ID NO: 313504 - DNA, 20 bp, Artificial
  CRISPR gRNA sequence
tcaatgcttacccacctatg

SEQ ID NO: 313505 - DNA, 20 bp, Artificial
  CRISPR gRNA sequence
aatgcttacccacctatgga

SEQ ID NO: 313506 - DNA, 20 bp, Artificial
  CRISPR gRNA sequence
acccacctatggaatcccag

SEQ ID NO: 313507 - DNA, 20 bp, Artificial
  CRISPR gRNA sequence
cccacctatggaatcccagt

SEQ ID NO: 313508 - DNA, 20 bp, Artificial
  CRISPR gRNA sequence
tggaatcccagtaagtccag

SEQ ID NO: 313509 - DNA, 20 bp, Artificial
  CRISPR gRNA sequence
ctaggtggcttgaggtctgg

SEQ ID NO: 313510 - DNA, 20 bp, Artificial
  CRISPR gRNA sequence
ggtggcttgaggtctggggt

SEQ ID NO: 313511 - DNA, 20 bp, Artificial
  CRISPR gRNA sequence
gaggtctggggtcataaaat

SEQ ID NO: 313512 - DNA, 20 bp, Artificial
  CRISPR gRNA sequence
aggtctggggtcataaaatg

SEQ ID NO: 313513 - DNA, 20 bp, Artificial
  CRISPR gRNA sequence
gggtcataaaatggaaggcc

SEQ ID NO: 313514 - DNA, 20 bp, Artificial
  CRISPR gRNA sequence
aagtcatttggtgatcacag

SEQ ID NO: 313515 - DNA, 20 bp, Artificial
  CRISPR gRNA sequence
ggtgatcacagaccttgagc

SEQ ID NO: 313516 - DNA, 20 bp, Artificial
  CRISPR gRNA sequence
gtgatcacagaccttgagcc

SEQ ID NO: 313517 - DNA, 20 bp, Artificial
  CRISPR gRNA sequence
gagccaaactttccccattt

SEQ ID NO: 313518 - DNA, 20 bp, Artificial
  CRISPR gRNA sequence
agccaaactttccccattta

SEQ ID NO: 313519 - DNA, 20 bp, Artificial
  CRISPR gRNA sequence
tccccatttagtcagagaaa

SEQ ID NO: 313520 - DNA, 20 bp, Artificial
  CRISPR gRNA sequence
ccccatttagtcagagaaag

SEQ ID NO: 313521 - DNA, 20 bp, Artificial
  CRISPR gRNA sequence
cccatttagtcagagaaagg

SEQ ID NO: 313522 - DNA, 20 bp, Artificial
  CRISPR gRNA sequence
agtcagagaaaggattagca

SEQ ID NO: 313523 - DNA, 20 bp, Artificial
  CRISPR gRNA sequence
gtcagagaaaggattagcag

SEQ ID NO: 313524 - DNA, 20 bp, Artificial
  CRISPR gRNA sequence
gcagcatcccccatgcctgg

SEQ ID NO: 313525 - DNA, 20 bp, Artificial
  CRISPR gRNA sequence
gctctgtgtgagatcatgga

SEQ ID NO: 313526 - DNA, 20 bp, Artificial
  CRISPR gRNA sequence
tgtgtgagatcatggaagcc

SEQ ID NO: 313527 - DNA, 20 bp, Artificial
  CRISPR gRNA sequence
tgtgagatcatggaagccag

SEQ ID NO: 313528 - DNA, 20 bp, Artificial
  CRISPR gRNA sequence
gtgaggtgctatggagtata

SEQ ID NO: 313529 - DNA, 20 bp, Artificial
  CRISPR gRNA sequence
tggagtataaattgcaaaat

SEQ ID NO: 313530 - DNA, 20 bp, Artificial
  CRISPR gRNA sequence
caaaatactttcagttccac

SEQ ID NO: 313531 - DNA, 20 bp, Artificial
  CRISPR gRNA sequence
tcagttccactcagaatgga

SEQ ID NO: 313532 - DNA, 20 bp, Artificial
  CRISPR gRNA sequence
cagttccactcagaatggat

SEQ ID NO: 313533 - DNA, 20 bp, Artificial
  CRISPR gRNA sequence
agttccactcagaatggatt

SEQ ID NO: 313534 - DNA, 20 bp, Artificial
  CRISPR gRNA sequence
cactcagaatggatttcaaa

SEQ ID NO: 313535 - DNA, 20 bp, Artificial
  CRISPR gRNA sequence
agaatggatttcaaagtgat

SEQ ID NO: 313536 - DNA, 20 bp, Artificial
  CRISPR gRNA sequence
caaagtgatttccaccccat

SEQ ID NO: 313537 - DNA, 20 bp, Artificial
  CRISPR gRNA sequence
aaagtgatttccaccccatg

SEQ ID NO: 313538 - DNA, 20 bp, Artificial
  CRISPR gRNA sequence
ccaccccatggggaggagag

SEQ ID NO: 313539 - DNA, 20 bp, Artificial
  CRISPR gRNA sequence
caccccatggggaggagagg

SEQ ID NO: 313540 - DNA, 20 bp, Artificial
  CRISPR gRNA sequence
aggagggatggatggaaaaa

SEQ ID NO: 313541 - DNA, 20 bp, Artificial
  CRISPR gRNA sequence
tcatgtcattttctgtgatc

SEQ ID NO: 313542 - DNA, 20 bp, Artificial
  CRISPR gRNA sequence
catgtcattttctgtgatcc

SEQ ID NO: 313543 - DNA, 20 bp, Artificial
  CRISPR gRNA sequence
atgtcattttctgtgatcca

SEQ ID NO: 313544 - DNA, 20 bp, Artificial
  CRISPR gRNA sequence
tctgtgatccactctggaga

SEQ ID NO: 313545 - DNA, 20 bp, Artificial
  CRISPR gRNA sequence
ctgtgatccactctggagac

SEQ ID NO: 313546 - DNA, 20 bp, Artificial
  CRISPR gRNA sequence
tgtgatccactctggagaca

SEQ ID NO: 313547 - DNA, 20 bp, Artificial
  CRISPR gRNA sequence
tgatccactctggagacaga

SEQ ID NO: 313548 - DNA, 20 bp, Artificial
  CRISPR gRNA sequence
tggagacagaggcagagatt

SEQ ID NO: 313549 - DNA, 20 bp, Artificial
  CRISPR gRNA sequence
gagacagaggcagagattct

SEQ ID NO: 313550 - DNA, 20 bp, Artificial
  CRISPR gRNA sequence
tctacaacagctgctcaaac

SEQ ID NO: 313551 - DNA, 20 bp, Artificial
  CRISPR gRNA sequence
tacaacagctgctcaaacta

SEQ ID NO: 313552 - DNA, 20 bp, Artificial
  CRISPR gRNA sequence
caacagctgctcaaactata

SEQ ID NO: 313553 - DNA, 20 bp, Artificial
  CRISPR gRNA sequence
ctcaaactatagctcttgtt

SEQ ID NO: 313554 - DNA, 20 bp, Artificial
  CRISPR gRNA sequence
aaactatagctcttgttaaa

SEQ ID NO: 313555 - DNA, 20 bp, Artificial
  CRISPR gRNA sequence
tagctcttgttaaaatggag

SEQ ID NO: 313556 - DNA, 20 bp, Artificial
  CRISPR gRNA sequence
ttgttaaaatggaggttctg

SEQ ID NO: 313557 - DNA, 20 bp, Artificial
  CRISPR gRNA sequence
gttaaaatggaggttctgaa

SEQ ID NO: 313558 - DNA, 20 bp, Artificial
  CRISPR gRNA sequence
ttaaaatggaggttctgaat

SEQ ID NO: 313559 - DNA, 20 bp, Artificial
  CRISPR gRNA sequence
aaatggaggttctgaatcag

SEQ ID NO: 313560 - DNA, 20 bp, Artificial
  CRISPR gRNA sequence
tgaatcagtaagtcttgggt

SEQ ID NO: 313561 - DNA, 20 bp, Artificial
  CRISPR gRNA sequence
aatcagtaagtcttgggtgg

SEQ ID NO: 313562 - DNA, 20 bp, Artificial
  CRISPR gRNA sequence
gggtggggccagagattccg

SEQ ID NO: 313563 - DNA, 20 bp, Artificial
  CRISPR gRNA sequence
ggtggggccagagattccgt

SEQ ID NO: 313564 - DNA, 20 bp, Artificial
  CRISPR gRNA sequence
cgtgtttcagaccagcccac

SEQ ID NO: 313565 - DNA, 20 bp, Artificial
  CRISPR gRNA sequence
cagaccagcccacatgtgac

SEQ ID NO: 313566 - DNA, 20 bp, Artificial
  CRISPR gRNA sequence
agaccagcccacatgtgacg

SEQ ID NO: 313567 - DNA, 20 bp, Artificial
  CRISPR gRNA sequence
attggtccatacatcacact

SEQ ID NO: 313568 - DNA, 20 bp, Artificial
  CRISPR gRNA sequence
gtccatacatcacactttca

SEQ ID NO: 313569 - DNA, 20 bp, Artificial
  CRISPR gRNA sequence
tcagttgctaggtgaagaag

SEQ ID NO: 313570 - DNA, 20 bp, Artificial
  CRISPR gRNA sequence
cagttgctaggtgaagaagg

SEQ ID NO: 313571 - DNA, 20 bp, Artificial
  CRISPR gRNA sequence
agttgctaggtgaagaaggg

SEQ ID NO: 313572 - DNA, 20 bp, Artificial
  CRISPR gRNA sequence
ctaggtgaagaagggagcac

SEQ ID NO: 313573 - DNA, 20 bp, Artificial
  CRISPR gRNA sequence
ggtgaagaagggagcactcg

SEQ ID NO: 313574 - DNA, 20 bp, Artificial
  CRISPR gRNA sequence
gatgagtggaagagaaagcc

SEQ ID NO: 313575 - DNA, 20 bp, Artificial
  CRISPR gRNA sequence
taatctttgggagaaggggc

SEQ ID NO: 313576 - DNA, 20 bp, Artificial
  CRISPR gRNA sequence
tgggagaaggggcctgggtc

SEQ ID NO: 313577 - DNA, 20 bp, Artificial
  CRISPR gRNA sequence
gggagaaggggcctgggtca

SEQ ID NO: 313578 - DNA, 20 bp, Artificial
  CRISPR gRNA sequence
ggagaaggggcctgggtcag

SEQ ID NO: 313579 - DNA, 20 bp, Artificial
  CRISPR gRNA sequence
ggtcagcggagttagactgg

SEQ ID NO: 313580 - DNA, 20 bp, Artificial
  CRISPR gRNA sequence
gactggtctgtgagtggaca

SEQ ID NO: 313581 - DNA, 20 bp, Artificial
  CRISPR gRNA sequence
gtctgtgagtggacagaatg

SEQ ID NO: 313582 - DNA, 20 bp, Artificial
  CRISPR gRNA sequence
tgagtggacagaatggatgg

SEQ ID NO: 313583 - DNA, 20 bp, Artificial
  CRISPR gRNA sequence
tgaggctctacagaaaaaaa

SEQ ID NO: 313584 - DNA, 20 bp, Artificial
  CRISPR gRNA sequence
tacagaaaaaaaaaaaaaaa

SEQ ID NO: 313585 - DNA, 20 bp, Artificial
  CRISPR gRNA sequence
cagaaaaaaaaaaaaaaaaa

SEQ ID NO: 313586 - DNA, 20 bp, Artificial
  CRISPR gRNA sequence
aagacgaagtcatttccagg

SEQ ID NO: 313587 - DNA, 20 bp, Artificial
  CRISPR gRNA sequence
ccaggtccagaaggcacaac

SEQ ID NO: 313588 - DNA, 20 bp, Artificial
  CRISPR gRNA sequence
caggtccagaaggcacaact

SEQ ID NO: 313589 - DNA, 20 bp, Artificial
  CRISPR gRNA sequence
acagctgagtaataacataa

SEQ ID NO: 313590 - DNA, 20 bp, Artificial
  CRISPR gRNA sequence
agtaataacataacattgac

SEQ ID NO: 313591 - DNA, 20 bp, Artificial
  CRISPR gRNA sequence
actgttaattggcagaattt

SEQ ID NO: 313592 - DNA, 20 bp, Artificial
  CRISPR gRNA sequence
ttaattggcagaatttttaa

SEQ ID NO: 313593 - DNA, 20 bp, Artificial
  CRISPR gRNA sequence
attggcagaatttttaactg

SEQ ID NO: 313594 - DNA, 20 bp, Artificial
  CRISPR gRNA sequence
gcagaatttttaactgtgtg

SEQ ID NO: 313595 - DNA, 20 bp, Artificial
  CRISPR gRNA sequence
ttaactgtgtgtttggtttc

SEQ ID NO: 313596 - DNA, 20 bp, Artificial
  CRISPR gRNA sequence
taactgtgtgtttggtttct

SEQ ID NO: 313597 - DNA, 20 bp, Artificial
  CRISPR gRNA sequence
aactgtgtgtttggtttctc

SEQ ID NO: 313598 - DNA, 20 bp, Artificial
  CRISPR gRNA sequence
actgtgtgtttggtttctcc

SEQ ID NO: 313599 - DNA, 20 bp, Artificial
  CRISPR gRNA sequence
tgtgtttggtttctccatca

SEQ ID NO: 313600 - DNA, 20 bp, Artificial
  CRISPR gRNA sequence
ggtttctccatcaggtcatc

SEQ ID NO: 313601 - DNA, 20 bp, Artificial
  CRISPR gRNA sequence
gtttctccatcaggtcatct

SEQ ID NO: 313602 - DNA, 20 bp, Artificial
  CRISPR gRNA sequence
ctccatcaggtcatctgtcc

SEQ ID NO: 313603 - DNA, 20 bp, Artificial
  CRISPR gRNA sequence
tccatcaggtcatctgtcct

SEQ ID NO: 313604 - DNA, 20 bp, Artificial
  CRISPR gRNA sequence
catcaggtcatctgtcctat

SEQ ID NO: 313605 - DNA, 20 bp, Artificial
  CRISPR gRNA sequence
tcctatattacatgacaatt

SEQ ID NO: 313606 - DNA, 20 bp, Artificial
  CRISPR gRNA sequence
tattacatgacaatttagac

SEQ ID NO: 313607 - DNA, 20 bp, Artificial
  CRISPR gRNA sequence
catgacaatttagactaaaa

SEQ ID NO: 313608 - DNA, 20 bp, Artificial
  CRISPR gRNA sequence
agactaaaaccagtatttcc

SEQ ID NO: 313609 - DNA, 20 bp, Artificial
  CRISPR gRNA sequence
gactaaaaccagtatttcct

SEQ ID NO: 313610 - DNA, 20 bp, Artificial
  CRISPR gRNA sequence
aaaccagtatttcctcagag

SEQ ID NO: 313611 - DNA, 20 bp, Artificial
  CRISPR gRNA sequence
cctcagagacaatgctagaa

SEQ ID NO: 313612 - DNA, 20 bp, Artificial
  CRISPR gRNA sequence
ctcagagacaatgctagaag

SEQ ID NO: 313613 - DNA, 20 bp, Artificial
  CRISPR gRNA sequence
agagacaatgctagaagctt

SEQ ID NO: 313614 - DNA, 20 bp, Artificial
  CRISPR gRNA sequence
gaagcttttacagtaggggg

SEQ ID NO: 313615 - DNA, 20 bp, Artificial
  CRISPR gRNA sequence
ttacagtagggggcactctt

SEQ ID NO: 313616 - DNA, 20 bp, Artificial
  CRISPR gRNA sequence
tacagtagggggcactcttg

SEQ ID NO: 313617 - DNA, 20 bp, Artificial
  CRISPR gRNA sequence
acagtagggggcactcttgc

SEQ ID NO: 313618 - DNA, 20 bp, Artificial
  CRISPR gRNA sequence
cagtagggggcactcttgca

SEQ ID NO: 313619 - DNA, 20 bp, Artificial
  CRISPR gRNA sequence
ttgcattacattaagagctc

SEQ ID NO: 313620 - DNA, 20 bp, Artificial
  CRISPR gRNA sequence
gcattacattaagagctcag

SEQ ID NO: 313621 - DNA, 20 bp, Artificial
  CRISPR gRNA sequence
cattacattaagagctcagc

SEQ ID NO: 313622 - DNA, 20 bp, Artificial
  CRISPR gRNA sequence
cattaagagctcagcaaaga

SEQ ID NO: 313623 - DNA, 20 bp, Artificial
  CRISPR gRNA sequence
agagctcagcaaagaagatg

SEQ ID NO: 313624 - DNA, 20 bp, Artificial
  CRISPR gRNA sequence
agcaaagaagatgcagaagc

SEQ ID NO: 313625 - DNA, 20 bp, Artificial
  CRISPR gRNA sequence
aggtttgccttgtaaggtga

SEQ ID NO: 313626 - DNA, 20 bp, Artificial
  CRISPR gRNA sequence
gccttgtaaggtgattcata

SEQ ID NO: 313627 - DNA, 20 bp, Artificial
  CRISPR gRNA sequence
ccttgtaaggtgattcataa

SEQ ID NO: 313628 - DNA, 20 bp, Artificial
  CRISPR gRNA sequence
gtaaggtgattcataaacac

SEQ ID NO: 313629 - DNA, 20 bp, Artificial
  CRISPR gRNA sequence
taaggtgattcataaacaca

SEQ ID NO: 313630 - DNA, 20 bp, Artificial
  CRISPR gRNA sequence
ataaacacactaaatcttcc

SEQ ID NO: 313631 - DNA, 20 bp, Artificial
  CRISPR gRNA sequence
aatcttccttaggtctccct

SEQ ID NO: 313632 - DNA, 20 bp, Artificial
  CRISPR gRNA sequence
ccttaggtctccctttcact

SEQ ID NO: 313633 - DNA, 20 bp, Artificial
  CRISPR gRNA sequence
cttaggtctccctttcactg

SEQ ID NO: 313634 - DNA, 20 bp, Artificial
  CRISPR gRNA sequence
aggtctccctttcactgtca

SEQ ID NO: 313635 - DNA, 20 bp, Artificial
  CRISPR gRNA sequence
ggtctccctttcactgtcag

SEQ ID NO: 313636 - DNA, 20 bp, Artificial
  CRISPR gRNA sequence
cctttcactgtcagggtacg

SEQ ID NO: 313637 - DNA, 20 bp, Artificial
  CRISPR gRNA sequence
tcactgtcagggtacgcata

SEQ ID NO: 313638 - DNA, 20 bp, Artificial
  CRISPR gRNA sequence
cactgtcagggtacgcatat

SEQ ID NO: 313639 - DNA, 20 bp, Artificial
  CRISPR gRNA sequence
actgtcagggtacgcatata

SEQ ID NO: 313640 - DNA, 20 bp, Artificial
  CRISPR gRNA sequence
tcagggtacgcatatagatt

SEQ ID NO: 313641 - DNA, 20 bp, Artificial
  CRISPR gRNA sequence
tccttcctccctccaatacc

SEQ ID NO: 313642 - DNA, 20 bp, Artificial
  CRISPR gRNA sequence
ccttcctccctccaataccg

SEQ ID NO: 313643 - DNA, 20 bp, Artificial
  CRISPR gRNA sequence
cttcctccctccaataccgg

SEQ ID NO: 313644 - DNA, 20 bp, Artificial
  CRISPR gRNA sequence
cctccctccaataccggtac

SEQ ID NO: 313645 - DNA, 20 bp, Artificial
  CRISPR gRNA sequence
ctccctccaataccggtacg

SEQ ID NO: 313646 - DNA, 20 bp, Artificial
  CRISPR gRNA sequence
cctccaataccggtacgcat

SEQ ID NO: 313647 - DNA, 20 bp, Artificial
  CRISPR gRNA sequence
caataccggtacgcatcctc

SEQ ID NO: 313648 - DNA, 20 bp, Artificial
  CRISPR gRNA sequence
tacaggtggtgcattttata

SEQ ID NO: 313649 - DNA, 20 bp, Artificial
  CRISPR gRNA sequence
caggtggtgcattttatacc

SEQ ID NO: 313650 - DNA, 20 bp, Artificial
  CRISPR gRNA sequence
tatacctcaagtacttcaca

SEQ ID NO: 313651 - DNA, 20 bp, Artificial
  CRISPR gRNA sequence
atacctcaagtacttcacag

SEQ ID NO: 313652 - DNA, 20 bp, Artificial
  CRISPR gRNA sequence
tacctcaagtacttcacagg

SEQ ID NO: 313653 - DNA, 20 bp, Artificial
  CRISPR gRNA sequence
aagtacttcacagggtccta

SEQ ID NO: 313654 - DNA, 20 bp, Artificial
  CRISPR gRNA sequence
cacagggtcctagtgagtgt

SEQ ID NO: 313655 - DNA, 20 bp, Artificial
  CRISPR gRNA sequence
acagggtcctagtgagtgta

SEQ ID NO: 313656 - DNA, 20 bp, Artificial
  CRISPR gRNA sequence
gtgagtgtagtgaaataggc

SEQ ID NO: 313657 - DNA, 20 bp, Artificial
  CRISPR gRNA sequence
atatttgtgcaaactcccac

SEQ ID NO: 313658 - DNA, 20 bp, Artificial
  CRISPR gRNA sequence
gtgcaaactcccactgatgc

SEQ ID NO: 313659 - DNA, 20 bp, Artificial
  CRISPR gRNA sequence
tgcaaactcccactgatgcc

SEQ ID NO: 313660 - DNA, 20 bp, Artificial
  CRISPR gRNA sequence
ccactgatgcctgctgtctg

SEQ ID NO: 313661 - DNA, 20 bp, Artificial
  CRISPR gRNA sequence
atgcctgctgtctgcttccc

SEQ ID NO: 313662 - DNA, 20 bp, Artificial
  CRISPR gRNA sequence
ctgtctgcttccctaagagt

SEQ ID NO: 313663 - DNA, 20 bp, Artificial
  CRISPR gRNA sequence
tctgcttccctaagagttca

SEQ ID NO: 313664 - DNA, 20 bp, Artificial
  CRISPR gRNA sequence
cttccctaagagttcaagac

SEQ ID NO: 313665 - DNA, 20 bp, Artificial
  CRISPR gRNA sequence
ccctaagagttcaagaccac

SEQ ID NO: 313666 - DNA, 20 bp, Artificial
  CRISPR gRNA sequence
cctaagagttcaagaccacc

SEQ ID NO: 313667 - DNA, 20 bp, Artificial
  CRISPR gRNA sequence
agagttcaagaccaccacca

SEQ ID NO: 313668 - DNA, 20 bp, Artificial
  CRISPR gRNA sequence
aagaccaccaccaacccctt

SEQ ID NO: 313669 - DNA, 20 bp, Artificial
  CRISPR gRNA sequence
gattatgtgttctcactggg

SEQ ID NO: 313670 - DNA, 20 bp, Artificial
  CRISPR gRNA sequence
attatgtgttctcactgggc

SEQ ID NO: 313671 - DNA, 20 bp, Artificial
  CRISPR gRNA sequence
tgtgttctcactgggccact

SEQ ID NO: 313672 - DNA, 20 bp, Artificial
  CRISPR gRNA sequence
tcactgggccactctgtaca

SEQ ID NO: 313673 - DNA, 20 bp, Artificial
  CRISPR gRNA sequence
actgggccactctgtacaca

SEQ ID NO: 313674 - DNA, 20 bp, Artificial
  CRISPR gRNA sequence
ggccactctgtacacagttt

SEQ ID NO: 313675 - DNA, 20 bp, Artificial
  CRISPR gRNA sequence
tgtacacagtttagtttgac

SEQ ID NO: 313676 - DNA, 20 bp, Artificial
  CRISPR gRNA sequence
tacacagtttagtttgacaa

SEQ ID NO: 313677 - DNA, 20 bp, Artificial
  CRISPR gRNA sequence
agtttgacaagtgcatgtca

SEQ ID NO: 313678 - DNA, 20 bp, Artificial
  CRISPR gRNA sequence
gtttgacaagtgcatgtcac

SEQ ID NO: 313679 - DNA, 20 bp, Artificial
  CRISPR gRNA sequence
gacaagtgcatgtcactgtt

SEQ ID NO: 313680 - DNA, 20 bp, Artificial
  CRISPR gRNA sequence
acaagtgcatgtcactgtta

SEQ ID NO: 313681 - DNA, 20 bp, Artificial
  CRISPR gRNA sequence
ttatctgtccttctattccc

SEQ ID NO: 313682 - DNA, 20 bp, Artificial
  CRISPR gRNA sequence
tctgtccttctattccctct

SEQ ID NO: 313683 - DNA, 20 bp, Artificial
  CRISPR gRNA sequence
tccttctattccctctttca

SEQ ID NO: 313684 - DNA, 20 bp, Artificial
  CRISPR gRNA sequence
ctattccctctttcaagaga

SEQ ID NO: 313685 - DNA, 20 bp, Artificial
  CRISPR gRNA sequence
tattccctctttcaagagaa

SEQ ID NO: 313686 - DNA, 20 bp, Artificial
  CRISPR gRNA sequence
ttccctctttcaagagaaac

SEQ ID NO: 313687 - DNA, 20 bp, Artificial
  CRISPR gRNA sequence
cctctttcaagagaaaccac

SEQ ID NO: 313688 - DNA, 20 bp, Artificial
  CRISPR gRNA sequence
tttcaagagaaaccacatca

SEQ ID NO: 313689 - DNA, 20 bp, Artificial
  CRISPR gRNA sequence
tcaagagaaaccacatcaat

SEQ ID NO: 313690 - DNA, 20 bp, Artificial
  CRISPR gRNA sequence
caagagaaaccacatcaatt

SEQ ID NO: 313691 - DNA, 20 bp, Artificial
  CRISPR gRNA sequence
aagagaaaccacatcaattt

SEQ ID NO: 313692 - DNA, 20 bp, Artificial
  CRISPR gRNA sequence
aattactcccccacttagaa

SEQ ID NO: 313693 - DNA, 20 bp, Artificial
  CRISPR gRNA sequence
attactcccccacttagaac

SEQ ID NO: 313694 - DNA, 20 bp, Artificial
  CRISPR gRNA sequence
ctcccccacttagaactctt

SEQ ID NO: 313695 - DNA, 20 bp, Artificial
  CRISPR gRNA sequence
ccccacttagaactcttcaa

SEQ ID NO: 313696 - DNA, 20 bp, Artificial
  CRISPR gRNA sequence
agaactcttcaaatgaagct

SEQ ID NO: 313697 - DNA, 20 bp, Artificial
  CRISPR gRNA sequence
gaactcttcaaatgaagctc

SEQ ID NO: 313698 - DNA, 20 bp, Artificial
  CRISPR gRNA sequence
ttcaaatgaagctcctctca

SEQ ID NO: 313699 - DNA, 20 bp, Artificial
  CRISPR gRNA sequence
caaatgaagctcctctcatc

SEQ ID NO: 313700 - DNA, 20 bp, Artificial
  CRISPR gRNA sequence
aaatgaagctcctctcatct

SEQ ID NO: 313701 - DNA, 20 bp, Artificial
  CRISPR gRNA sequence
ctctcatctctctcatcaac

SEQ ID NO: 313702 - DNA, 20 bp, Artificial
  CRISPR gRNA sequence
tcatctctctcatcaaccca

SEQ ID NO: 313703 - DNA, 20 bp, Artificial
  CRISPR gRNA sequence
atctctctcatcaacccatc

SEQ ID NO: 313704 - DNA, 20 bp, Artificial
  CRISPR gRNA sequence
tctcatcaacccatctcctc

SEQ ID NO: 313705 - DNA, 20 bp, Artificial
  CRISPR gRNA sequence
tcatcaacccatctcctccc

SEQ ID NO: 313706 - DNA, 20 bp, Artificial
  CRISPR gRNA sequence
atcaacccatctcctccctt

SEQ ID NO: 313707 - DNA, 20 bp, Artificial
  CRISPR gRNA sequence
ctccctttcctcctcaatgt

SEQ ID NO: 313708 - DNA, 20 bp, Artificial
  CRISPR gRNA sequence
cctttcctcctcaatgtcaa

SEQ ID NO: 313709 - DNA, 20 bp, Artificial
  CRISPR gRNA sequence
tcctcctcaatgtcaacatg

SEQ ID NO: 313710 - DNA, 20 bp, Artificial
  CRISPR gRNA sequence
cctcctcaatgtcaacatgc

SEQ ID NO: 313711 - DNA, 20 bp, Artificial
  CRISPR gRNA sequence
ctcctcaatgtcaacatgcc

SEQ ID NO: 313712 - DNA, 20 bp, Artificial
  CRISPR gRNA sequence
ctcaatgtcaacatgccttc

SEQ ID NO: 313713 - DNA, 20 bp, Artificial
  CRISPR gRNA sequence
aatgtcaacatgccttcaca

SEQ ID NO: 313714 - DNA, 20 bp, Artificial
  CRISPR gRNA sequence
cacataaatcctgaatgatg

SEQ ID NO: 313715 - DNA, 20 bp, Artificial
  CRISPR gRNA sequence
acataaatcctgaatgatga

SEQ ID NO: 313716 - DNA, 20 bp, Artificial
  CRISPR gRNA sequence
aatgatgaaattttatttag

SEQ ID NO: 313717 - DNA, 20 bp, Artificial
  CRISPR gRNA sequence
tatttagaacttacactaac

SEQ ID NO: 313718 - DNA, 20 bp, Artificial
  CRISPR gRNA sequence
atttagaacttacactaact

SEQ ID NO: 313719 - DNA, 20 bp, Artificial
  CRISPR gRNA sequence
tttagaacttacactaactt

SEQ ID NO: 313720 - DNA, 20 bp, Artificial
  CRISPR gRNA sequence
agaacttacactaacttcct

SEQ ID NO: 313721 - DNA, 20 bp, Artificial
  CRISPR gRNA sequence
gaacttacactaacttcctc

SEQ ID NO: 313722 - DNA, 20 bp, Artificial
  CRISPR gRNA sequence
acactaacttcctctccaag

SEQ ID NO: 313723 - DNA, 20 bp, Artificial
  CRISPR gRNA sequence
cactaacttcctctccaagg

SEQ ID NO: 313724 - DNA, 20 bp, Artificial
  CRISPR gRNA sequence
acttcctctccaaggtggca

SEQ ID NO: 313725 - DNA, 20 bp, Artificial
  CRISPR gRNA sequence
cctctccaaggtggcatcta

SEQ ID NO: 313726 - DNA, 20 bp, Artificial
  CRISPR gRNA sequence
ctctccaaggtggcatctaa

SEQ ID NO: 313727 - DNA, 20 bp, Artificial
  CRISPR gRNA sequence
tccaaggtggcatctaactt

SEQ ID NO: 313728 - DNA, 20 bp, Artificial
  CRISPR gRNA sequence
caaggtggcatctaacttca

SEQ ID NO: 313729 - DNA, 20 bp, Artificial
  CRISPR gRNA sequence
acttcatattaagtaagaaa

SEQ ID NO: 313730 - DNA, 20 bp, Artificial
  CRISPR gRNA sequence
catattaagtaagaaacagc

SEQ ID NO: 313731 - DNA, 20 bp, Artificial
  CRISPR gRNA sequence
atattaagtaagaaacagcc

SEQ ID NO: 313732 - DNA, 20 bp, Artificial
  CRISPR gRNA sequence
agtaagaaacagccttccca

SEQ ID NO: 313733 - DNA, 20 bp, Artificial
  CRISPR gRNA sequence
cccactctccacccccgcac

SEQ ID NO: 313734 - DNA, 20 bp, Artificial
  CRISPR gRNA sequence
ccactctccacccccgcact

SEQ ID NO: 313735 - DNA, 20 bp, Artificial
  CRISPR gRNA sequence
tccacccccgcacttctcac

SEQ ID NO: 313736 - DNA, 20 bp, Artificial
  CRISPR gRNA sequence
cacccccgcacttctcaccc

SEQ ID NO: 313737 - DNA, 20 bp, Artificial
  CRISPR gRNA sequence
ctcacccaccactgcttact

SEQ ID NO: 313738 - DNA, 20 bp, Artificial
  CRISPR gRNA sequence
tcacccaccactgcttactt

SEQ ID NO: 313739 - DNA, 20 bp, Artificial
  CRISPR gRNA sequence
acccaccactgcttactttt

SEQ ID NO: 313740 - DNA, 20 bp, Artificial
  CRISPR gRNA sequence
cttacttttttttttttttt

SEQ ID NO: 313741 - DNA, 20 bp, Artificial
  CRISPR gRNA sequence
actttttttttttttttttt

SEQ ID NO: 313742 - DNA, 20 bp, Artificial
  CRISPR gRNA sequence
cttttttttttttttttttt

SEQ ID NO: 313743 - DNA, 20 bp, Artificial
  CRISPR gRNA sequence
tttttttttttttttttttt

SEQ ID NO: 313744 - DNA, 20 bp, Artificial
  CRISPR gRNA sequence
tttttttttttttttttttt

SEQ ID NO: 313745 - DNA, 20 bp, Artificial
  CRISPR gRNA sequence
tttttttttttttttttttt

SEQ ID NO: 313746 - DNA, 20 bp, Artificial
  CRISPR gRNA sequence
tttttttttttttttttttt

SEQ ID NO: 313747 - DNA, 20 bp, Artificial
  CRISPR gRNA sequence
tttttttttttttttttttt

SEQ ID NO: 313748 - DNA, 20 bp, Artificial
  CRISPR gRNA sequence
tttttttttttttttttttt

SEQ ID NO: 313749 - DNA, 20 bp, Artificial
  CRISPR gRNA sequence
tttttttttttttttttttg

SEQ ID NO: 313750 - DNA, 20 bp, Artificial
  CRISPR gRNA sequence
ttttttttttttttttttgc

SEQ ID NO: 313751 - DNA, 20 bp, Artificial
  CRISPR gRNA sequence
tttttttttttttttttgcc

SEQ ID NO: 313752 - DNA, 20 bp, Artificial
  CRISPR gRNA sequence
ttttttttttttttttgcca

SEQ ID NO: 313753 - DNA, 20 bp, Artificial
  CRISPR gRNA sequence
tttttttttttttttgccaa

SEQ ID NO: 313754 - DNA, 20 bp, Artificial
  CRISPR gRNA sequence
ttttttttttttttgccaag

SEQ ID NO: 313755 - DNA, 20 bp, Artificial
  CRISPR gRNA sequence
tttttttttttttgccaagt

SEQ ID NO: 313756 - DNA, 20 bp, Artificial
  CRISPR gRNA sequence
ttttttttttttgccaagtc

SEQ ID NO: 313757 - DNA, 20 bp, Artificial
  CRISPR gRNA sequence
tttttttttttgccaagtct

SEQ ID NO: 313758 - DNA, 20 bp, Artificial
  CRISPR gRNA sequence
ttttttttttgccaagtctc

SEQ ID NO: 313759 - DNA, 20 bp, Artificial
  CRISPR gRNA sequence
tttttttttgccaagtctca

SEQ ID NO: 313760 - DNA, 20 bp, Artificial
  CRISPR gRNA sequence
ttttttttgccaagtctcaa

SEQ ID NO: 313761 - DNA, 20 bp, Artificial
  CRISPR gRNA sequence
tttttttgccaagtctcaag

SEQ ID NO: 313762 - DNA, 20 bp, Artificial
  CRISPR gRNA sequence
ttttttgccaagtctcaagt

SEQ ID NO: 313763 - DNA, 20 bp, Artificial
  CRISPR gRNA sequence
tttttgccaagtctcaagta

SEQ ID NO: 313764 - DNA, 20 bp, Artificial
  CRISPR gRNA sequence
ttttgccaagtctcaagtaa

SEQ ID NO: 313765 - DNA, 20 bp, Artificial
  CRISPR gRNA sequence
tttgccaagtctcaagtaat

SEQ ID NO: 313766 - DNA, 20 bp, Artificial
  CRISPR gRNA sequence
ttgccaagtctcaagtaatt

SEQ ID NO: 313767 - DNA, 20 bp, Artificial
  CRISPR gRNA sequence
tgccaagtctcaagtaattc

SEQ ID NO: 313768 - DNA, 20 bp, Artificial
  CRISPR gRNA sequence
gccaagtctcaagtaattct

SEQ ID NO: 313769 - DNA, 20 bp, Artificial
  CRISPR gRNA sequence
ccaagtctcaagtaattctg

SEQ ID NO: 313770 - DNA, 20 bp, Artificial
  CRISPR gRNA sequence
aagtaattctgtaacctaga

SEQ ID NO: 313771 - DNA, 20 bp, Artificial
  CRISPR gRNA sequence
tgtaacctagaaaaggtcct

SEQ ID NO: 313772 - DNA, 20 bp, Artificial
  CRISPR gRNA sequence
taacctagaaaaggtcctac

SEQ ID NO: 313773 - DNA, 20 bp, Artificial
  CRISPR gRNA sequence
gaaaaggtcctacacaaacc

SEQ ID NO: 313774 - DNA, 20 bp, Artificial
  CRISPR gRNA sequence
cacaaaccccgtgatcattc

SEQ ID NO: 313775 - DNA, 20 bp, Artificial
  CRISPR gRNA sequence
acatttaagtagttgggtgg

SEQ ID NO: 313776 - DNA, 20 bp, Artificial
  CRISPR gRNA sequence
aagtagttgggtggcccaca

SEQ ID NO: 313777 - DNA, 20 bp, Artificial
  CRISPR gRNA sequence
agtagttgggtggcccacat

SEQ ID NO: 313778 - DNA, 20 bp, Artificial
  CRISPR gRNA sequence
ggtggcccacatccttccca

SEQ ID NO: 313779 - DNA, 20 bp, Artificial
  CRISPR gRNA sequence
cccacaaaccccaaagtgtc

SEQ ID NO: 313780 - DNA, 20 bp, Artificial
  CRISPR gRNA sequence
ccacaaaccccaaagtgtcc

SEQ ID NO: 313781 - DNA, 20 bp, Artificial
  CRISPR gRNA sequence
aaggactaaagcctttctct

SEQ ID NO: 313782 - DNA, 20 bp, Artificial
  CRISPR gRNA sequence
aagcctttctctcaaccctt

SEQ ID NO: 313783 - DNA, 20 bp, Artificial
  CRISPR gRNA sequence
tctctcaacccttccagcat

SEQ ID NO: 313784 - DNA, 20 bp, Artificial
  CRISPR gRNA sequence
ctctcaacccttccagcatg

SEQ ID NO: 313785 - DNA, 20 bp, Artificial
  CRISPR gRNA sequence
tctcaacccttccagcatga

SEQ ID NO: 313786 - DNA, 20 bp, Artificial
  CRISPR gRNA sequence
tcaacccttccagcatgatg

SEQ ID NO: 313787 - DNA, 20 bp, Artificial
  CRISPR gRNA sequence
aacccttccagcatgatgtc

SEQ ID NO: 313788 - DNA, 20 bp, Artificial
  CRISPR gRNA sequence
ccagcatgatgtctatggtt

SEQ ID NO: 313789 - DNA, 20 bp, Artificial
  CRISPR gRNA sequence
cagcatgatgtctatggttg

SEQ ID NO: 313790 - DNA, 20 bp, Artificial
  CRISPR gRNA sequence
tggttgtaaaattgtccagg

SEQ ID NO: 313791 - DNA, 20 bp, Artificial
  CRISPR gRNA sequence
taaaattgtccagggtcagt

SEQ ID NO: 313792 - DNA, 20 bp, Artificial
  CRISPR gRNA sequence
tccagggtcagtgcatactg

SEQ ID NO: 313793 - DNA, 20 bp, Artificial
  CRISPR gRNA sequence
ggagcagcaagtttgtggtg

SEQ ID NO: 313794 - DNA, 20 bp, Artificial
  CRISPR gRNA sequence
gtggtgcctggggtttcccc

SEQ ID NO: 313795 - DNA, 20 bp, Artificial
  CRISPR gRNA sequence
tggtgcctggggtttcccca

SEQ ID NO: 313796 - DNA, 20 bp, Artificial
  CRISPR gRNA sequence
gggtttccccaatactccca

SEQ ID NO: 313797 - DNA, 20 bp, Artificial
  CRISPR gRNA sequence
ccccaatactcccaaagcac

SEQ ID NO: 313798 - DNA, 20 bp, Artificial
  CRISPR gRNA sequence
cccaatactcccaaagcaca

SEQ ID NO: 313799 - DNA, 20 bp, Artificial
  CRISPR gRNA sequence
ccaaagcacatcctcacctg

SEQ ID NO: 313800 - DNA, 20 bp, Artificial
  CRISPR gRNA sequence
acctgcccatctatgattca

SEQ ID NO: 313801 - DNA, 20 bp, Artificial
  CRISPR gRNA sequence
cccatctatgattcattttc

SEQ ID NO: 313802 - DNA, 20 bp, Artificial
  CRISPR gRNA sequence
tgattcattttcagcatttc

SEQ ID NO: 313803 - DNA, 20 bp, Artificial
  CRISPR gRNA sequence
attttcagcatttcactcat

SEQ ID NO: 313804 - DNA, 20 bp, Artificial
  CRISPR gRNA sequence
tcagcatttcactcatgtgc

SEQ ID NO: 313805 - DNA, 20 bp, Artificial
  CRISPR gRNA sequence
cagcatttcactcatgtgcc

SEQ ID NO: 313806 - DNA, 20 bp, Artificial
  CRISPR gRNA sequence
agcatttcactcatgtgcct

SEQ ID NO: 313807 - DNA, 20 bp, Artificial
  CRISPR gRNA sequence
cactcatgtgccttaaatgg

SEQ ID NO: 313808 - DNA, 20 bp, Artificial
  CRISPR gRNA sequence
actcatgtgccttaaatggt

SEQ ID NO: 313809 - DNA, 20 bp, Artificial
  CRISPR gRNA sequence
atgtgccttaaatggtcatt

SEQ ID NO: 313810 - DNA, 20 bp, Artificial
  CRISPR gRNA sequence
aaatggtcattgaccaccac

SEQ ID NO: 313811 - DNA, 20 bp, Artificial
  CRISPR gRNA sequence
aatggtcattgaccaccaca

SEQ ID NO: 313812 - DNA, 20 bp, Artificial
  CRISPR gRNA sequence
accaccacaatccgaaaaca

SEQ ID NO: 313813 - DNA, 20 bp, Artificial
  CRISPR gRNA sequence
gcccagttctctttctgatc

SEQ ID NO: 313814 - DNA, 20 bp, Artificial
  CRISPR gRNA sequence
cccagttctctttctgatct

SEQ ID NO: 313815 - DNA, 20 bp, Artificial
  CRISPR gRNA sequence
tctttctgatctctgaaaga

SEQ ID NO: 313816 - DNA, 20 bp, Artificial
  CRISPR gRNA sequence
tttctgatctctgaaagagc

SEQ ID NO: 313817 - DNA, 20 bp, Artificial
  CRISPR gRNA sequence
tctgatctctgaaagagctt

SEQ ID NO: 313818 - DNA, 20 bp, Artificial
  CRISPR gRNA sequence
ctgatctctgaaagagctta

SEQ ID NO: 313819 - DNA, 20 bp, Artificial
  CRISPR gRNA sequence
tgatctctgaaagagcttag

SEQ ID NO: 313820 - DNA, 20 bp, Artificial
  CRISPR gRNA sequence
atctctgaaagagcttagag

SEQ ID NO: 313821 - DNA, 20 bp, Artificial
  CRISPR gRNA sequence
tgaaagagcttagagaggtc

SEQ ID NO: 313822 - DNA, 20 bp, Artificial
  CRISPR gRNA sequence
aaagagcttagagaggtcac

SEQ ID NO: 313823 - DNA, 20 bp, Artificial
  CRISPR gRNA sequence
agagaggtcactgaaaataa

SEQ ID NO: 313824 - DNA, 20 bp, Artificial
  CRISPR gRNA sequence
gagaggtcactgaaaataaa

SEQ ID NO: 313825 - DNA, 20 bp, Artificial
  CRISPR gRNA sequence
aaaataaaggccttggttca

SEQ ID NO: 313826 - DNA, 20 bp, Artificial
  CRISPR gRNA sequence
ggttcactatcgaagtcatt

SEQ ID NO: 313827 - DNA, 20 bp, Artificial
  CRISPR gRNA sequence
gttcactatcgaagtcattt

SEQ ID NO: 313828 - DNA, 20 bp, Artificial
  CRISPR gRNA sequence
actatcgaagtcatttctaa

SEQ ID NO: 313829 - DNA, 20 bp, Artificial
  CRISPR gRNA sequence
tcgaagtcatttctaaagca

SEQ ID NO: 313830 - DNA, 20 bp, Artificial
  CRISPR gRNA sequence
ctaaagcatttgacatcctt

SEQ ID NO: 313831 - DNA, 20 bp, Artificial
  CRISPR gRNA sequence
taaagcatttgacatccttg

SEQ ID NO: 313832 - DNA, 20 bp, Artificial
  CRISPR gRNA sequence
aagcatttgacatccttgga

SEQ ID NO: 313833 - DNA, 20 bp, Artificial
  CRISPR gRNA sequence
gacatccttggaagtgctgg

SEQ ID NO: 313834 - DNA, 20 bp, Artificial
  CRISPR gRNA sequence
acatccttggaagtgctggc

SEQ ID NO: 313835 - DNA, 20 bp, Artificial
  CRISPR gRNA sequence
ggaagtgctggccatgggag

SEQ ID NO: 313836 - DNA, 20 bp, Artificial
  CRISPR gRNA sequence
gaagtgctggccatgggagc

SEQ ID NO: 313837 - DNA, 20 bp, Artificial
  CRISPR gRNA sequence
gccatgggagcagcagtcat

SEQ ID NO: 313838 - DNA, 20 bp, Artificial
  CRISPR gRNA sequence
tgtaaagggagctatttgaa

SEQ ID NO: 313839 - DNA, 20 bp, Artificial
  CRISPR gRNA sequence
taaagggagctatttgaatt

SEQ ID NO: 313840 - DNA, 20 bp, Artificial
  CRISPR gRNA sequence
tttgaatttcaaagatgtta

SEQ ID NO: 313841 - DNA, 20 bp, Artificial
  CRISPR gRNA sequence
gaatttcaaagatgttactc

SEQ ID NO: 313842 - DNA, 20 bp, Artificial
  CRISPR gRNA sequence
aatttcaaagatgttactca

SEQ ID NO: 313843 - DNA, 20 bp, Artificial
  CRISPR gRNA sequence
caaagatgttactcaacgtg

SEQ ID NO: 313844 - DNA, 20 bp, Artificial
  CRISPR gRNA sequence
aaagatgttactcaacgtga

SEQ ID NO: 313845 - DNA, 20 bp, Artificial
  CRISPR gRNA sequence
ctcaacgtgattccccaact

SEQ ID NO: 313846 - DNA, 20 bp, Artificial
  CRISPR gRNA sequence
aacgtgattccccaactaat

SEQ ID NO: 313847 - DNA, 20 bp, Artificial
  CRISPR gRNA sequence
cccaactaatgaagtataat

SEQ ID NO: 313848 - DNA, 20 bp, Artificial
  CRISPR gRNA sequence
atgaagtataataaaggggg

SEQ ID NO: 313849 - DNA, 20 bp, Artificial
  CRISPR gRNA sequence
taatttattaccattatcag

SEQ ID NO: 313850 - DNA, 20 bp, Artificial
  CRISPR gRNA sequence
attaccattatcagcaatct

SEQ ID NO: 313851 - DNA, 20 bp, Artificial
  CRISPR gRNA sequence
ttaccattatcagcaatctt

SEQ ID NO: 313852 - DNA, 20 bp, Artificial
  CRISPR gRNA sequence
ccattatcagcaatcttttc

SEQ ID NO: 313853 - DNA, 20 bp, Artificial
  CRISPR gRNA sequence
tcagcaatcttttcaccata

SEQ ID NO: 313854 - DNA, 20 bp, Artificial
  CRISPR gRNA sequence
ttcaccatagcagaccaagg

SEQ ID NO: 313855 - DNA, 20 bp, Artificial
  CRISPR gRNA sequence
tcaccatagcagaccaagga

SEQ ID NO: 313856 - DNA, 20 bp, Artificial
  CRISPR gRNA sequence
caccatagcagaccaaggaa

SEQ ID NO: 313857 - DNA, 20 bp, Artificial
  CRISPR gRNA sequence
accatagcagaccaaggaat

SEQ ID NO: 313858 - DNA, 20 bp, Artificial
  CRISPR gRNA sequence
ttggtgatggtgtagaagtt

SEQ ID NO: 313859 - DNA, 20 bp, Artificial
  CRISPR gRNA sequence
tggtgatggtgtagaagtta

SEQ ID NO: 313860 - DNA, 20 bp, Artificial
  CRISPR gRNA sequence
ggtgatggtgtagaagttat

SEQ ID NO: 313861 - DNA, 20 bp, Artificial
  CRISPR gRNA sequence
gtgatggtgtagaagttatg

SEQ ID NO: 313862 - DNA, 20 bp, Artificial
  CRISPR gRNA sequence
tggaacctgtaacagctaca

SEQ ID NO: 313863 - DNA, 20 bp, Artificial
  CRISPR gRNA sequence
taacagctacagtgatgaaa

SEQ ID NO: 313864 - DNA, 20 bp, Artificial
  CRISPR gRNA sequence
cagtgatgaaaactaaaatt

SEQ ID NO: 313865 - DNA, 20 bp, Artificial
  CRISPR gRNA sequence
aaattaaggttataggaagg

SEQ ID NO: 313866 - DNA, 20 bp, Artificial
  CRISPR gRNA sequence
aggttataggaaggtaactg

SEQ ID NO: 313867 - DNA, 20 bp, Artificial
  CRISPR gRNA sequence
taggaaggtaactggtgggt

SEQ ID NO: 313868 - DNA, 20 bp, Artificial
  CRISPR gRNA sequence
gtgggtgaatgggttgtcta

SEQ ID NO: 313869 - DNA, 20 bp, Artificial
  CRISPR gRNA sequence
tctaactctactggtttttc

SEQ ID NO: 313870 - DNA, 20 bp, Artificial
  CRISPR gRNA sequence
actctactggtttttccctg

SEQ ID NO: 313871 - DNA, 20 bp, Artificial
  CRISPR gRNA sequence
tactggtttttccctgtctt

SEQ ID NO: 313872 - DNA, 20 bp, Artificial
  CRISPR gRNA sequence
ctggtttttccctgtcttgc

SEQ ID NO: 313873 - DNA, 20 bp, Artificial
  CRISPR gRNA sequence
gtttttccctgtcttgcaat

SEQ ID NO: 313874 - DNA, 20 bp, Artificial
  CRISPR gRNA sequence
ttccctgtcttgcaatttaa

SEQ ID NO: 313875 - DNA, 20 bp, Artificial
  CRISPR gRNA sequence
tccctgtcttgcaatttaaa

SEQ ID NO: 313876 - DNA, 20 bp, Artificial
  CRISPR gRNA sequence
ccctgtcttgcaatttaaat

SEQ ID NO: 313877 - DNA, 20 bp, Artificial
  CRISPR gRNA sequence
cctgtcttgcaatttaaatt

SEQ ID NO: 313878 - DNA, 20 bp, Artificial
  CRISPR gRNA sequence
tcttgcaatttaaattcaca

SEQ ID NO: 313879 - DNA, 20 bp, Artificial
  CRISPR gRNA sequence
gcaatttaaattcacagaac

SEQ ID NO: 313880 - DNA, 20 bp, Artificial
  CRISPR gRNA sequence
caatttaaattcacagaacc

SEQ ID NO: 313881 - DNA, 20 bp, Artificial
  CRISPR gRNA sequence
aaattcacagaaccacagta

SEQ ID NO: 313882 - DNA, 20 bp, Artificial
  CRISPR gRNA sequence
aattcacagaaccacagtac

SEQ ID NO: 313883 - DNA, 20 bp, Artificial
  CRISPR gRNA sequence
acagaaccacagtactagaa

SEQ ID NO: 313884 - DNA, 20 bp, Artificial
  CRISPR gRNA sequence
gaaagacccttggaacattt

SEQ ID NO: 313885 - DNA, 20 bp, Artificial
  CRISPR gRNA sequence
ggaacatttagtcaaccact

SEQ ID NO: 313886 - DNA, 20 bp, Artificial
  CRISPR gRNA sequence
gaacatttagtcaaccactt

SEQ ID NO: 313887 - DNA, 20 bp, Artificial
  CRISPR gRNA sequence
agtcaaccacttcattaatc

SEQ ID NO: 313888 - DNA, 20 bp, Artificial
  CRISPR gRNA sequence
gtcaaccacttcattaatca

SEQ ID NO: 313889 - DNA, 20 bp, Artificial
  CRISPR gRNA sequence
cattaatcagatgaggaaac

SEQ ID NO: 313890 - DNA, 20 bp, Artificial
  CRISPR gRNA sequence
attaatcagatgaggaaact

SEQ ID NO: 313891 - DNA, 20 bp, Artificial
  CRISPR gRNA sequence
atcagatgaggaaactgagg

SEQ ID NO: 313892 - DNA, 20 bp, Artificial
  CRISPR gRNA sequence
aggctcataaagattgcagt

SEQ ID NO: 313893 - DNA, 20 bp, Artificial
  CRISPR gRNA sequence
ataaagattgcagtttgtac

SEQ ID NO: 313894 - DNA, 20 bp, Artificial
  CRISPR gRNA sequence
cagtttgtacaaggccacac

SEQ ID NO: 313895 - DNA, 20 bp, Artificial
  CRISPR gRNA sequence
gtacaaggccacacatttag

SEQ ID NO: 313896 - DNA, 20 bp, Artificial
  CRISPR gRNA sequence
tacaaggccacacatttagt

SEQ ID NO: 313897 - DNA, 20 bp, Artificial
  CRISPR gRNA sequence
agtcagcggtgaagcaagga

SEQ ID NO: 313898 - DNA, 20 bp, Artificial
  CRISPR gRNA sequence
gtcagcggtgaagcaaggac

SEQ ID NO: 313899 - DNA, 20 bp, Artificial
  CRISPR gRNA sequence
atctccagatgccaagcaga

SEQ ID NO: 313900 - DNA, 20 bp, Artificial
  CRISPR gRNA sequence
cagatgccaagcagatgtgc

SEQ ID NO: 313901 - DNA, 20 bp, Artificial
  CRISPR gRNA sequence
cagagcttaatatcttattc

SEQ ID NO: 313902 - DNA, 20 bp, Artificial
  CRISPR gRNA sequence
aatatcttattcttcagcat

SEQ ID NO: 313903 - DNA, 20 bp, Artificial
  CRISPR gRNA sequence
atatcttattcttcagcatg

SEQ ID NO: 313904 - DNA, 20 bp, Artificial
  CRISPR gRNA sequence
attcttcagcatgattactg

SEQ ID NO: 313905 - DNA, 20 bp, Artificial
  CRISPR gRNA sequence
ttcttcagcatgattactga

SEQ ID NO: 313906 - DNA, 20 bp, Artificial
  CRISPR gRNA sequence
ttcagcatgattactgataa

SEQ ID NO: 313907 - DNA, 20 bp, Artificial
  CRISPR gRNA sequence
cagcatgattactgataaga

SEQ ID NO: 313908 - DNA, 20 bp, Artificial
  CRISPR gRNA sequence
agcatgattactgataagat

SEQ ID NO: 313909 - DNA, 20 bp, Artificial
  CRISPR gRNA sequence
ctgataagatagtatctggg

SEQ ID NO: 313910 - DNA, 20 bp, Artificial
  CRISPR gRNA sequence
ataagatagtatctgggtat

SEQ ID NO: 313911 - DNA, 20 bp, Artificial
  CRISPR gRNA sequence
ggtattgtataaagagaaat

SEQ ID NO: 313912 - DNA, 20 bp, Artificial
  CRISPR gRNA sequence
tataaagagaaatggaggtt

SEQ ID NO: 313913 - DNA, 20 bp, Artificial
  CRISPR gRNA sequence
tttcccctttcctcttgttt

SEQ ID NO: 313914 - DNA, 20 bp, Artificial
  CRISPR gRNA sequence
ttcccctttcctcttgtttc

SEQ ID NO: 313915 - DNA, 20 bp, Artificial
  CRISPR gRNA sequence
tcccctttcctcttgtttct

SEQ ID NO: 313916 - DNA, 20 bp, Artificial
  CRISPR gRNA sequence
cccctttcctcttgtttctc

SEQ ID NO: 313917 - DNA, 20 bp, Artificial
  CRISPR gRNA sequence
ccctttcctcttgtttctcc

SEQ ID NO: 313918 - DNA, 20 bp, Artificial
  CRISPR gRNA sequence
tcctcttgtttctccctccc

SEQ ID NO: 313919 - DNA, 20 bp, Artificial
  CRISPR gRNA sequence
cctcttgtttctccctccct

SEQ ID NO: 313920 - DNA, 20 bp, Artificial
  CRISPR gRNA sequence
ctcttgtttctccctcccta

SEQ ID NO: 313921 - DNA, 20 bp, Artificial
  CRISPR gRNA sequence
ttgtttctccctccctaatc

SEQ ID NO: 313922 - DNA, 20 bp, Artificial
  CRISPR gRNA sequence
gtttctccctccctaatcct

SEQ ID NO: 313923 - DNA, 20 bp, Artificial
  CRISPR gRNA sequence
tttctccctccctaatcctt

SEQ ID NO: 313924 - DNA, 20 bp, Artificial
  CRISPR gRNA sequence
ctccctccctaatccttaac

SEQ ID NO: 313925 - DNA, 20 bp, Artificial
  CRISPR gRNA sequence
tccctccctaatccttaacc

SEQ ID NO: 313926 - DNA, 20 bp, Artificial
  CRISPR gRNA sequence
cctccctaatccttaacctt

SEQ ID NO: 313927 - DNA, 20 bp, Artificial
  CRISPR gRNA sequence
cctaatccttaaccttcttt

SEQ ID NO: 313928 - DNA, 20 bp, Artificial
  CRISPR gRNA sequence
atccttaaccttctttttta

SEQ ID NO: 313929 - DNA, 20 bp, Artificial
  CRISPR gRNA sequence
aaccttcttttttaggtgct

SEQ ID NO: 313930 - DNA, 20 bp, Artificial
  CRISPR gRNA sequence
accttcttttttaggtgctg

SEQ ID NO: 313931 - DNA, 20 bp, Artificial
  CRISPR gRNA sequence
cttttttaggtgctgctcct

SEQ ID NO: 313932 - DNA, 20 bp, Artificial
  CRISPR gRNA sequence
ttttttaggtgctgctcctc

SEQ ID NO: 313933 - DNA, 20 bp, Artificial
  CRISPR gRNA sequence
ttttaggtgctgctcctctg

SEQ ID NO: 313934 - DNA, 20 bp, Artificial
  CRISPR gRNA sequence
tttaggtgctgctcctctga

SEQ ID NO: 313935 - DNA, 20 bp, Artificial
  CRISPR gRNA sequence
ttaggtgctgctcctctgaa

SEQ ID NO: 313936 - DNA, 20 bp, Artificial
  CRISPR gRNA sequence
taggtgctgctcctctgaag

SEQ ID NO: 313937 - DNA, 20 bp, Artificial
  CRISPR gRNA sequence
aggtgctgctcctctgaaga

SEQ ID NO: 313938 - DNA, 20 bp, Artificial
  CRISPR gRNA sequence
ggtgctgctcctctgaagat

SEQ ID NO: 313939 - DNA, 20 bp, Artificial
  CRISPR gRNA sequence
ctcctctgaagattcaagct

SEQ ID NO: 313940 - DNA, 20 bp, Artificial
  CRISPR gRNA sequence
ctctgaagattcaagcttat

SEQ ID NO: 313941 - DNA, 20 bp, Artificial
  CRISPR gRNA sequence
tgaagattcaagcttatttc

SEQ ID NO: 313942 - DNA, 20 bp, Artificial
  CRISPR gRNA sequence
aagattcaagcttatttcaa

SEQ ID NO: 313943 - DNA, 20 bp, Artificial
  CRISPR gRNA sequence
aagcttatttcaatgagact

SEQ ID NO: 313944 - DNA, 20 bp, Artificial
  CRISPR gRNA sequence
atttcaatgagactgcagac

SEQ ID NO: 313945 - DNA, 20 bp, Artificial
  CRISPR gRNA sequence
tttcaatgagactgcagacc

SEQ ID NO: 313946 - DNA, 20 bp, Artificial
  CRISPR gRNA sequence
caatgagactgcagacctgc

SEQ ID NO: 313947 - DNA, 20 bp, Artificial
  CRISPR gRNA sequence
aatgagactgcagacctgcc

SEQ ID NO: 313948 - DNA, 20 bp, Artificial
  CRISPR gRNA sequence
cagacctgccatgccaattt

SEQ ID NO: 313949 - DNA, 20 bp, Artificial
  CRISPR gRNA sequence
ccatgccaatttgcaaactc

SEQ ID NO: 313950 - DNA, 20 bp, Artificial
  CRISPR gRNA sequence
gcaaactctcaaaaccaaag

SEQ ID NO: 313951 - DNA, 20 bp, Artificial
  CRISPR gRNA sequence
caaactctcaaaaccaaagc

SEQ ID NO: 313952 - DNA, 20 bp, Artificial
  CRISPR gRNA sequence
tcaaaaccaaagcctgagtg

SEQ ID NO: 313953 - DNA, 20 bp, Artificial
  CRISPR gRNA sequence
aaaaccaaagcctgagtgag

SEQ ID NO: 313954 - DNA, 20 bp, Artificial
  CRISPR gRNA sequence
agtgagctagtagtattttg

SEQ ID NO: 313955 - DNA, 20 bp, Artificial
  CRISPR gRNA sequence
gtagtattttggcaggacca

SEQ ID NO: 313956 - DNA, 20 bp, Artificial
  CRISPR gRNA sequence
tggcaggaccaggaaaactt

SEQ ID NO: 313957 - DNA, 20 bp, Artificial
  CRISPR gRNA sequence
ggcaggaccaggaaaacttg

SEQ ID NO: 313958 - DNA, 20 bp, Artificial
  CRISPR gRNA sequence
gcaggaccaggaaaacttgg

SEQ ID NO: 313959 - DNA, 20 bp, Artificial
  CRISPR gRNA sequence
ggttctgaatgaggtatact

SEQ ID NO: 313960 - DNA, 20 bp, Artificial
  CRISPR gRNA sequence
gttctgaatgaggtatactt

SEQ ID NO: 313961 - DNA, 20 bp, Artificial
  CRISPR gRNA sequence
tgaatgaggtatacttaggc

SEQ ID NO: 313962 - DNA, 20 bp, Artificial
  CRISPR gRNA sequence
aatgaggtatacttaggcaa

SEQ ID NO: 313963 - DNA, 20 bp, Artificial
  CRISPR gRNA sequence
aggcaaagagaaatttgaca

SEQ ID NO: 313964 - DNA, 20 bp, Artificial
  CRISPR gRNA sequence
ggcaaagagaaatttgacag

SEQ ID NO: 313965 - DNA, 20 bp, Artificial
  CRISPR gRNA sequence
gacagtgttcattccaagta

SEQ ID NO: 313966 - DNA, 20 bp, Artificial
  CRISPR gRNA sequence
acagtgttcattccaagtat

SEQ ID NO: 313967 - DNA, 20 bp, Artificial
  CRISPR gRNA sequence
attccaagtatatgggccgc

SEQ ID NO: 313968 - DNA, 20 bp, Artificial
  CRISPR gRNA sequence
caagtatatgggccgcacaa

SEQ ID NO: 313969 - DNA, 20 bp, Artificial
  CRISPR gRNA sequence
tgattcggacagttggaccc

SEQ ID NO: 313970 - DNA, 20 bp, Artificial
  CRISPR gRNA sequence
gattcggacagttggaccct

SEQ ID NO: 313971 - DNA, 20 bp, Artificial
  CRISPR gRNA sequence
attcggacagttggaccctg

SEQ ID NO: 313972 - DNA, 20 bp, Artificial
  CRISPR gRNA sequence
ggacagttggaccctgagac

SEQ ID NO: 313973 - DNA, 20 bp, Artificial
  CRISPR gRNA sequence
gaccctgagacttcacaatc

SEQ ID NO: 313974 - DNA, 20 bp, Artificial
  CRISPR gRNA sequence
agacttcacaatcttcagat

SEQ ID NO: 313975 - DNA, 20 bp, Artificial
  CRISPR gRNA sequence
cacaatcttcagatcaagga

SEQ ID NO: 313976 - DNA, 20 bp, Artificial
  CRISPR gRNA sequence
acaatcttcagatcaaggac

SEQ ID NO: 313977 - DNA, 20 bp, Artificial
  CRISPR gRNA sequence
cagatcaaggacaagggctt

SEQ ID NO: 313978 - DNA, 20 bp, Artificial
  CRISPR gRNA sequence
agatcaaggacaagggcttg

SEQ ID NO: 313979 - DNA, 20 bp, Artificial
  CRISPR gRNA sequence
gtatcaatgtatcatccatc

SEQ ID NO: 313980 - DNA, 20 bp, Artificial
  CRISPR gRNA sequence
tatcaatgtatcatccatca

SEQ ID NO: 313981 - DNA, 20 bp, Artificial
  CRISPR gRNA sequence
gcatccaccagatgaattct

SEQ ID NO: 313982 - DNA, 20 bp, Artificial
  CRISPR gRNA sequence
tgaactgtcagtgcttggta

SEQ ID NO: 313983 - DNA, 20 bp, Artificial
  CRISPR gRNA sequence
aactgtcagtgcttggtatg

SEQ ID NO: 313984 - DNA, 20 bp, Artificial
  CRISPR gRNA sequence
tcagtgcttggtatgtggtc

SEQ ID NO: 313985 - DNA, 20 bp, Artificial
  CRISPR gRNA sequence
ggtatgtggtcaatggtgtg

SEQ ID NO: 313986 - DNA, 20 bp, Artificial
  CRISPR gRNA sequence
gtatgtggtcaatggtgtgt

SEQ ID NO: 313987 - DNA, 20 bp, Artificial
  CRISPR gRNA sequence
agattcttagccttctcaga

SEQ ID NO: 313988 - DNA, 20 bp, Artificial
  CRISPR gRNA sequence
ttagccttctcagatgagac

SEQ ID NO: 313989 - DNA, 20 bp, Artificial
  CRISPR gRNA sequence
agccttctcagatgagactg

SEQ ID NO: 313990 - DNA, 20 bp, Artificial
  CRISPR gRNA sequence
gccttctcagatgagactgc

SEQ ID NO: 313991 - DNA, 20 bp, Artificial
  CRISPR gRNA sequence
ctcagatgagactgcaaatg

SEQ ID NO: 313992 - DNA, 20 bp, Artificial
  CRISPR gRNA sequence
tcagatgagactgcaaatga

SEQ ID NO: 313993 - DNA, 20 bp, Artificial
  CRISPR gRNA sequence
agatgagactgcaaatgagt

SEQ ID NO: 313994 - DNA, 20 bp, Artificial
  CRISPR gRNA sequence
caaatgagttagaaaaacac

SEQ ID NO: 313995 - DNA, 20 bp, Artificial
  CRISPR gRNA sequence
gaaaaacactggagggggac

SEQ ID NO: 313996 - DNA, 20 bp, Artificial
  CRISPR gRNA sequence
gagggggacttgaggggccc

SEQ ID NO: 313997 - DNA, 20 bp, Artificial
  CRISPR gRNA sequence
gaggggcccaggggaaaagg

SEQ ID NO: 313998 - DNA, 20 bp, Artificial
  CRISPR gRNA sequence
aggggcccaggggaaaaggg

SEQ ID NO: 313999 - DNA, 20 bp, Artificial
  CRISPR gRNA sequence
tagagagaaggcagaggaca

SEQ ID NO: 314000 - DNA, 20 bp, Artificial
  CRISPR gRNA sequence
ctgggaagtgcatttgaagg

SEQ ID NO: 314001 - DNA, 20 bp, Artificial
  CRISPR gRNA sequence
tgggaagtgcatttgaaggg

SEQ ID NO: 314002 - DNA, 20 bp, Artificial
  CRISPR gRNA sequence
ggaagtgcatttgaagggag

SEQ ID NO: 314003 - DNA, 20 bp, Artificial
  CRISPR gRNA sequence
gaagggagtgtagagtctgg

SEQ ID NO: 314004 - DNA, 20 bp, Artificial
  CRISPR gRNA sequence
aagggagtgtagagtctggg

SEQ ID NO: 314005 - DNA, 20 bp, Artificial
  CRISPR gRNA sequence
ggagtagggaactgaaagtc

SEQ ID NO: 314006 - DNA, 20 bp, Artificial
  CRISPR gRNA sequence
aaagtcttttgtacttttta

SEQ ID NO: 314007 - DNA, 20 bp, Artificial
  CRISPR gRNA sequence
ttgtactttttatagtctgc

SEQ ID NO: 314008 - DNA, 20 bp, Artificial
  CRISPR gRNA sequence
tgtactttttatagtctgct

SEQ ID NO: 314009 - DNA, 20 bp, Artificial
  CRISPR gRNA sequence
gtactttttatagtctgctt

SEQ ID NO: 314010 - DNA, 20 bp, Artificial
  CRISPR gRNA sequence
tactttttatagtctgcttc

SEQ ID NO: 314011 - DNA, 20 bp, Artificial
  CRISPR gRNA sequence
tttatagtctgcttctgaag

SEQ ID NO: 314012 - DNA, 20 bp, Artificial
  CRISPR gRNA sequence
ttatagtctgcttctgaagg

SEQ ID NO: 314013 - DNA, 20 bp, Artificial
  CRISPR gRNA sequence
tatagtctgcttctgaagga

SEQ ID NO: 314014 - DNA, 20 bp, Artificial
  CRISPR gRNA sequence
atagtctgcttctgaaggat

SEQ ID NO: 314015 - DNA, 20 bp, Artificial
  CRISPR gRNA sequence
tagtctgcttctgaaggatc

SEQ ID NO: 314016 - DNA, 20 bp, Artificial
  CRISPR gRNA sequence
cttctgaaggatcagtaaaa

SEQ ID NO: 314017 - DNA, 20 bp, Artificial
  CRISPR gRNA sequence
ctgaaggatcagtaaaaatc

SEQ ID NO: 314018 - DNA, 20 bp, Artificial
  CRISPR gRNA sequence
tgaaggatcagtaaaaatct

SEQ ID NO: 314019 - DNA, 20 bp, Artificial
  CRISPR gRNA sequence
aaggatcagtaaaaatctgc

SEQ ID NO: 314020 - DNA, 20 bp, Artificial
  CRISPR gRNA sequence
ctttggggaaaaaatagagc

SEQ ID NO: 314021 - DNA, 20 bp, Artificial
  CRISPR gRNA sequence
tggggaaaaaatagagctaa

SEQ ID NO: 314022 - DNA, 20 bp, Artificial
  CRISPR gRNA sequence
ggggaaaaaatagagctaat

SEQ ID NO: 314023 - DNA, 20 bp, Artificial
  CRISPR gRNA sequence
gggaaaaaatagagctaatt

SEQ ID NO: 314024 - DNA, 20 bp, Artificial
  CRISPR gRNA sequence
attgaacaaagataatatgg

SEQ ID NO: 314025 - DNA, 20 bp, Artificial
  CRISPR gRNA sequence
aacaaagataatatggctaa

SEQ ID NO: 314026 - DNA, 20 bp, Artificial
  CRISPR gRNA sequence
attacctatagtaaaaacca

SEQ ID NO: 314027 - DNA, 20 bp, Artificial
  CRISPR gRNA sequence
cctatagtaaaaaccatgga

SEQ ID NO: 314028 - DNA, 20 bp, Artificial
  CRISPR gRNA sequence
tagtaaaaaccatggataat

SEQ ID NO: 314029 - DNA, 20 bp, Artificial
  CRISPR gRNA sequence
ggccatcacaaagtttatat

SEQ ID NO: 314030 - DNA, 20 bp, Artificial
  CRISPR gRNA sequence
gccatcacaaagtttatata

SEQ ID NO: 314031 - DNA, 20 bp, Artificial
  CRISPR gRNA sequence
atataaccataaaggcctca

SEQ ID NO: 314032 - DNA, 20 bp, Artificial
  CRISPR gRNA sequence
tataaccataaaggcctcag

SEQ ID NO: 314033 - DNA, 20 bp, Artificial
  CRISPR gRNA sequence
agatgtcttacattcatttt

SEQ ID NO: 314034 - DNA, 20 bp, Artificial
  CRISPR gRNA sequence
acattcattttttccttggg

SEQ ID NO: 314035 - DNA, 20 bp, Artificial
  CRISPR gRNA sequence
cattcattttttccttgggt

SEQ ID NO: 314036 - DNA, 20 bp, Artificial
  CRISPR gRNA sequence
attttttccttgggtccaag

SEQ ID NO: 314037 - DNA, 20 bp, Artificial
  CRISPR gRNA sequence
tttccttgggtccaagattt

SEQ ID NO: 314038 - DNA, 20 bp, Artificial
  CRISPR gRNA sequence
ttccttgggtccaagatttt

SEQ ID NO: 314039 - DNA, 20 bp, Artificial
  CRISPR gRNA sequence
tccttgggtccaagattttt

SEQ ID NO: 314040 - DNA, 20 bp, Artificial
  CRISPR gRNA sequence
ccttgggtccaagatttttc

SEQ ID NO: 314041 - DNA, 20 bp, Artificial
  CRISPR gRNA sequence
cttgggtccaagatttttca

SEQ ID NO: 314042 - DNA, 20 bp, Artificial
  CRISPR gRNA sequence
gggtccaagatttttcacct

SEQ ID NO: 314043 - DNA, 20 bp, Artificial
  CRISPR gRNA sequence
ggtccaagatttttcaccta

SEQ ID NO: 314044 - DNA, 20 bp, Artificial
  CRISPR gRNA sequence
ttcacctactaaatctttgc

SEQ ID NO: 314045 - DNA, 20 bp, Artificial
  CRISPR gRNA sequence
tcacctactaaatctttgcc

SEQ ID NO: 314046 - DNA, 20 bp, Artificial
  CRISPR gRNA sequence
cacctactaaatctttgcct

SEQ ID NO: 314047 - DNA, 20 bp, Artificial
  CRISPR gRNA sequence
acctactaaatctttgcctg

SEQ ID NO: 314048 - DNA, 20 bp, Artificial
  CRISPR gRNA sequence
ctaaatctttgcctggagct

SEQ ID NO: 314049 - DNA, 20 bp, Artificial
  CRISPR gRNA sequence
aatctttgcctggagctcct

SEQ ID NO: 314050 - DNA, 20 bp, Artificial
  CRISPR gRNA sequence
tgcctggagctcctagcaaa

SEQ ID NO: 314051 - DNA, 20 bp, Artificial
  CRISPR gRNA sequence
gcctggagctcctagcaaag

SEQ ID NO: 314052 - DNA, 20 bp, Artificial
  CRISPR gRNA sequence
cctggagctcctagcaaagc

SEQ ID NO: 314053 - DNA, 20 bp, Artificial
  CRISPR gRNA sequence
gagctcctagcaaagcggac

SEQ ID NO: 314054 - DNA, 20 bp, Artificial
  CRISPR gRNA sequence
ctagcaaagcggacagctga

SEQ ID NO: 314055 - DNA, 20 bp, Artificial
  CRISPR gRNA sequence
gcaaagcggacagctgacac

SEQ ID NO: 314056 - DNA, 20 bp, Artificial
  CRISPR gRNA sequence
acacatttgggttttccctt

SEQ ID NO: 314057 - DNA, 20 bp, Artificial
  CRISPR gRNA sequence
gggttttcccttcagcctcc

SEQ ID NO: 314058 - DNA, 20 bp, Artificial
  CRISPR gRNA sequence
ggttttcccttcagcctcct

SEQ ID NO: 314059 - DNA, 20 bp, Artificial
  CRISPR gRNA sequence
tcccttcagcctcctctagg

SEQ ID NO: 314060 - DNA, 20 bp, Artificial
  CRISPR gRNA sequence
cccttcagcctcctctaggt

SEQ ID NO: 314061 - DNA, 20 bp, Artificial
  CRISPR gRNA sequence
ccttcagcctcctctaggtt

SEQ ID NO: 314062 - DNA, 20 bp, Artificial
  CRISPR gRNA sequence
cagcctcctctaggttgctt

SEQ ID NO: 314063 - DNA, 20 bp, Artificial
  CRISPR gRNA sequence
agcctcctctaggttgctta

SEQ ID NO: 314064 - DNA, 20 bp, Artificial
  CRISPR gRNA sequence
ctctaggttgcttatgagtt

SEQ ID NO: 314065 - DNA, 20 bp, Artificial
  CRISPR gRNA sequence
taggttgcttatgagttgtt

SEQ ID NO: 314066 - DNA, 20 bp, Artificial
  CRISPR gRNA sequence
ggttgcttatgagttgtttg

SEQ ID NO: 314067 - DNA, 20 bp, Artificial
  CRISPR gRNA sequence
cttatgagttgtttgctgcc

SEQ ID NO: 314068 - DNA, 20 bp, Artificial
  CRISPR gRNA sequence
atgagttgtttgctgccaca

SEQ ID NO: 314069 - DNA, 20 bp, Artificial
  CRISPR gRNA sequence
tgagttgtttgctgccacaa

SEQ ID NO: 314070 - DNA, 20 bp, Artificial
  CRISPR gRNA sequence
tttgctgccacaaccatgag

SEQ ID NO: 314071 - DNA, 20 bp, Artificial
  CRISPR gRNA sequence
gctgccacaaccatgagcct

SEQ ID NO: 314072 - DNA, 20 bp, Artificial
  CRISPR gRNA sequence
ctgccacaaccatgagcctg

SEQ ID NO: 314073 - DNA, 20 bp, Artificial
  CRISPR gRNA sequence
ccacaaccatgagcctggta

SEQ ID NO: 314074 - DNA, 20 bp, Artificial
  CRISPR gRNA sequence
gtagacagaagggaaaaaaa

SEQ ID NO: 314075 - DNA, 20 bp, Artificial
  CRISPR gRNA sequence
acaaaccagctcctctgctt

SEQ ID NO: 314076 - DNA, 20 bp, Artificial
  CRISPR gRNA sequence
caaaccagctcctctgcttc

SEQ ID NO: 314077 - DNA, 20 bp, Artificial
  CRISPR gRNA sequence
ctctgcttcacgagaccttg

SEQ ID NO: 314078 - DNA, 20 bp, Artificial
  CRISPR gRNA sequence
tgcttcacgagaccttggaa

SEQ ID NO: 314079 - DNA, 20 bp, Artificial
  CRISPR gRNA sequence
cttcacgagaccttggaagg

SEQ ID NO: 314080 - DNA, 20 bp, Artificial
  CRISPR gRNA sequence
cacgagaccttggaaggcct

SEQ ID NO: 314081 - DNA, 20 bp, Artificial
  CRISPR gRNA sequence
acgagaccttggaaggccta

SEQ ID NO: 314082 - DNA, 20 bp, Artificial
  CRISPR gRNA sequence
ggaaggcctaaatgccacta

SEQ ID NO: 314083 - DNA, 20 bp, Artificial
  CRISPR gRNA sequence
gaaggcctaaatgccactac

SEQ ID NO: 314084 - DNA, 20 bp, Artificial
  CRISPR gRNA sequence
aatgccactacagatttttt

SEQ ID NO: 314085 - DNA, 20 bp, Artificial
  CRISPR gRNA sequence
cagatttttttaaaactatc

SEQ ID NO: 314086 - DNA, 20 bp, Artificial
  CRISPR gRNA sequence
ttttaaaactatcacacagt

SEQ ID NO: 314087 - DNA, 20 bp, Artificial
  CRISPR gRNA sequence
tttaaaactatcacacagta

SEQ ID NO: 314088 - DNA, 20 bp, Artificial
  CRISPR gRNA sequence
ttaaaactatcacacagtaa

SEQ ID NO: 314089 - DNA, 20 bp, Artificial
  CRISPR gRNA sequence
taaaactatcacacagtaaa

SEQ ID NO: 314090 - DNA, 20 bp, Artificial
  CRISPR gRNA sequence
aaaactatcacacagtaaaa

SEQ ID NO: 314091 - DNA, 20 bp, Artificial
  CRISPR gRNA sequence
aaactatcacacagtaaaat

SEQ ID NO: 314092 - DNA, 20 bp, Artificial
  CRISPR gRNA sequence
tcacacagtaaaattatttt

SEQ ID NO: 314093 - DNA, 20 bp, Artificial
  CRISPR gRNA sequence
tttttttttgttttgatata

SEQ ID NO: 314094 - DNA, 20 bp, Artificial
  CRISPR gRNA sequence
ttttttgttttgatatactg

SEQ ID NO: 314095 - DNA, 20 bp, Artificial
  CRISPR gRNA sequence
tttttgttttgatatactgt

SEQ ID NO: 314096 - DNA, 20 bp, Artificial
  CRISPR gRNA sequence
ttttgttttgatatactgtt

SEQ ID NO: 314097 - DNA, 20 bp, Artificial
  CRISPR gRNA sequence
tttgttttgatatactgttc

SEQ ID NO: 314098 - DNA, 20 bp, Artificial
  CRISPR gRNA sequence
ttgttttgatatactgttct

SEQ ID NO: 314099 - DNA, 20 bp, Artificial
  CRISPR gRNA sequence
tgttttgatatactgttcta

SEQ ID NO: 314100 - DNA, 20 bp, Artificial
  CRISPR gRNA sequence
gttttgatatactgttctac

SEQ ID NO: 314101 - DNA, 20 bp, Artificial
  CRISPR gRNA sequence
ttttgatatactgttctact

SEQ ID NO: 314102 - DNA, 20 bp, Artificial
  CRISPR gRNA sequence
tgatatactgttctactgat

SEQ ID NO: 314103 - DNA, 20 bp, Artificial
  CRISPR gRNA sequence
gatatactgttctactgatt

SEQ ID NO: 314104 - DNA, 20 bp, Artificial
  CRISPR gRNA sequence
atatactgttctactgattg

SEQ ID NO: 314105 - DNA, 20 bp, Artificial
  CRISPR gRNA sequence
ttctactgattgtatagatc

SEQ ID NO: 314106 - DNA, 20 bp, Artificial
  CRISPR gRNA sequence
tactgattgtatagatcttg

SEQ ID NO: 314107 - DNA, 20 bp, Artificial
  CRISPR gRNA sequence
ctgattgtatagatcttgta

SEQ ID NO: 314108 - DNA, 20 bp, Artificial
  CRISPR gRNA sequence
attgtatagatcttgtatag

SEQ ID NO: 314109 - DNA, 20 bp, Artificial
  CRISPR gRNA sequence
tatagatcttgtatagattt

SEQ ID NO: 314110 - DNA, 20 bp, Artificial
  CRISPR gRNA sequence
gtatagatttaggtaaccgc

SEQ ID NO: 314111 - DNA, 20 bp, Artificial
  CRISPR gRNA sequence
tatagatttaggtaaccgcc

SEQ ID NO: 314112 - DNA, 20 bp, Artificial
  CRISPR gRNA sequence
aggtaaccgccacaggacat

SEQ ID NO: 314113 - DNA, 20 bp, Artificial
  CRISPR gRNA sequence
ggtaaccgccacaggacata

SEQ ID NO: 314114 - DNA, 20 bp, Artificial
  CRISPR gRNA sequence
ctatcaccctaaaaatttcc

SEQ ID NO: 314115 - DNA, 20 bp, Artificial
  CRISPR gRNA sequence
tatcaccctaaaaatttccc

SEQ ID NO: 314116 - DNA, 20 bp, Artificial
  CRISPR gRNA sequence
tcaccctaaaaatttccctc

SEQ ID NO: 314117 - DNA, 20 bp, Artificial
  CRISPR gRNA sequence
aaaatttccctcaggctgtc

SEQ ID NO: 314118 - DNA, 20 bp, Artificial
  CRISPR gRNA sequence
ccctcaggctgtcccttcat

SEQ ID NO: 314119 - DNA, 20 bp, Artificial
  CRISPR gRNA sequence
cctcaggctgtcccttcata

SEQ ID NO: 314120 - DNA, 20 bp, Artificial
  CRISPR gRNA sequence
aggctgtcccttcatagagt

SEQ ID NO: 314121 - DNA, 20 bp, Artificial
  CRISPR gRNA sequence
tcccttcatagagtcatacc

SEQ ID NO: 314122 - DNA, 20 bp, Artificial
  CRISPR gRNA sequence
catagagtcataccctgtct

SEQ ID NO: 314123 - DNA, 20 bp, Artificial
  CRISPR gRNA sequence
atagagtcataccctgtctg

SEQ ID NO: 314124 - DNA, 20 bp, Artificial
  CRISPR gRNA sequence
tctgcactcataacccttgt

SEQ ID NO: 314125 - DNA, 20 bp, Artificial
  CRISPR gRNA sequence
cactcataacccttgttggg

SEQ ID NO: 314126 - DNA, 20 bp, Artificial
  CRISPR gRNA sequence
ataacccttgttgggcatcc

SEQ ID NO: 314127 - DNA, 20 bp, Artificial
  CRISPR gRNA sequence
gttgggcatcctatagtttt

SEQ ID NO: 314128 - DNA, 20 bp, Artificial
  CRISPR gRNA sequence
ttgggcatcctatagttttg

SEQ ID NO: 314129 - DNA, 20 bp, Artificial
  CRISPR gRNA sequence
ggcatcctatagttttgtct

SEQ ID NO: 314130 - DNA, 20 bp, Artificial
  CRISPR gRNA sequence
tagttttgtctttttgacag

SEQ ID NO: 314131 - DNA, 20 bp, Artificial
  CRISPR gRNA sequence
tgtctttttgacagtgtcac

SEQ ID NO: 314132 - DNA, 20 bp, Artificial
  CRISPR gRNA sequence
gtctttttgacagtgtcaca

SEQ ID NO: 314133 - DNA, 20 bp, Artificial
  CRISPR gRNA sequence
tctttttgacagtgtcacat

SEQ ID NO: 314134 - DNA, 20 bp, Artificial
  CRISPR gRNA sequence
tttgacagtgtcacataagt

SEQ ID NO: 314135 - DNA, 20 bp, Artificial
  CRISPR gRNA sequence
ttgacagtgtcacataagtg

SEQ ID NO: 314136 - DNA, 20 bp, Artificial
  CRISPR gRNA sequence
tgacagtgtcacataagtga

SEQ ID NO: 314137 - DNA, 20 bp, Artificial
  CRISPR gRNA sequence
gacagtgtcacataagtgaa

SEQ ID NO: 314138 - DNA, 20 bp, Artificial
  CRISPR gRNA sequence
acagtgtcacataagtgaag

SEQ ID NO: 314139 - DNA, 20 bp, Artificial
  CRISPR gRNA sequence
ttaagcctggcttctttcgt

SEQ ID NO: 314140 - DNA, 20 bp, Artificial
  CRISPR gRNA sequence
taagcctggcttctttcgtt

SEQ ID NO: 314141 - DNA, 20 bp, Artificial
  CRISPR gRNA sequence
aagcctggcttctttcgttt

SEQ ID NO: 314142 - DNA, 20 bp, Artificial
  CRISPR gRNA sequence
agcctggcttctttcgttta

SEQ ID NO: 314143 - DNA, 20 bp, Artificial
  CRISPR gRNA sequence
gcttctttcgtttagcgcgc

SEQ ID NO: 314144 - DNA, 20 bp, Artificial
  CRISPR gRNA sequence
ctttcgtttagcgcgccttc

SEQ ID NO: 314145 - DNA, 20 bp, Artificial
  CRISPR gRNA sequence
tttcgtttagcgcgccttcg

SEQ ID NO: 314146 - DNA, 20 bp, Artificial
  CRISPR gRNA sequence
tcgtttagcgcgccttcgag

SEQ ID NO: 314147 - DNA, 20 bp, Artificial
  CRISPR gRNA sequence
cgtttagcgcgccttcgaga

SEQ ID NO: 314148 - DNA, 20 bp, Artificial
  CRISPR gRNA sequence
gtttagcgcgccttcgagat

SEQ ID NO: 314149 - DNA, 20 bp, Artificial
  CRISPR gRNA sequence
agcgcgccttcgagattcac

SEQ ID NO: 314150 - DNA, 20 bp, Artificial
  CRISPR gRNA sequence
gcgcgccttcgagattcacc

SEQ ID NO: 314151 - DNA, 20 bp, Artificial
  CRISPR gRNA sequence
cgagattcacccaagttgtt

SEQ ID NO: 314152 - DNA, 20 bp, Artificial
  CRISPR gRNA sequence
gagattcacccaagttgttg

SEQ ID NO: 314153 - DNA, 20 bp, Artificial
  CRISPR gRNA sequence
acccaagttgttgcacatat

SEQ ID NO: 314154 - DNA, 20 bp, Artificial
  CRISPR gRNA sequence
ttgcacatatcgagcttgtc

SEQ ID NO: 314155 - DNA, 20 bp, Artificial
  CRISPR gRNA sequence
cacatatcgagcttgtccct

SEQ ID NO: 314156 - DNA, 20 bp, Artificial
  CRISPR gRNA sequence
gtccctttttattgctgagt

SEQ ID NO: 314157 - DNA, 20 bp, Artificial
  CRISPR gRNA sequence
tccctttttattgctgagta

SEQ ID NO: 314158 - DNA, 20 bp, Artificial
  CRISPR gRNA sequence
tttattgctgagtagcattt

SEQ ID NO: 314159 - DNA, 20 bp, Artificial
  CRISPR gRNA sequence
ttattgctgagtagcatttt

SEQ ID NO: 314160 - DNA, 20 bp, Artificial
  CRISPR gRNA sequence
tattgctgagtagcatttta

SEQ ID NO: 314161 - DNA, 20 bp, Artificial
  CRISPR gRNA sequence
attgctgagtagcattttat

SEQ ID NO: 314162 - DNA, 20 bp, Artificial
  CRISPR gRNA sequence
ttgctgagtagcattttatt

SEQ ID NO: 314163 - DNA, 20 bp, Artificial
  CRISPR gRNA sequence
ctgagtagcattttattgtt

SEQ ID NO: 314164 - DNA, 20 bp, Artificial
  CRISPR gRNA sequence
agtagcattttattgtttat

SEQ ID NO: 314165 - DNA, 20 bp, Artificial
  CRISPR gRNA sequence
tattgtttatccattcaact

SEQ ID NO: 314166 - DNA, 20 bp, Artificial
  CRISPR gRNA sequence
attgtttatccattcaactc

SEQ ID NO: 314167 - DNA, 20 bp, Artificial
  CRISPR gRNA sequence
ttgtttatccattcaactca

SEQ ID NO: 314168 - DNA, 20 bp, Artificial
  CRISPR gRNA sequence
tttatccattcaactcagta

SEQ ID NO: 314169 - DNA, 20 bp, Artificial
  CRISPR gRNA sequence
atccattcaactcagtaaaa

SEQ ID NO: 314170 - DNA, 20 bp, Artificial
  CRISPR gRNA sequence
tccattcaactcagtaaaag

SEQ ID NO: 314171 - DNA, 20 bp, Artificial
  CRISPR gRNA sequence
aactcagtaaaagacattgg

SEQ ID NO: 314172 - DNA, 20 bp, Artificial
  CRISPR gRNA sequence
agtaaaagacattgggttgt

SEQ ID NO: 314173 - DNA, 20 bp, Artificial
  CRISPR gRNA sequence
ggttgtttctggtttggggc

SEQ ID NO: 314174 - DNA, 20 bp, Artificial
  CRISPR gRNA sequence
tttctggtttggggctctta

SEQ ID NO: 314175 - DNA, 20 bp, Artificial
  CRISPR gRNA sequence
ctggtttggggctcttatga

SEQ ID NO: 314176 - DNA, 20 bp, Artificial
  CRISPR gRNA sequence
tggtttggggctcttatgaa

SEQ ID NO: 314177 - DNA, 20 bp, Artificial
  CRISPR gRNA sequence
gtttggggctcttatgaata

SEQ ID NO: 314178 - DNA, 20 bp, Artificial
  CRISPR gRNA sequence
ggggctcttatgaataaggc

SEQ ID NO: 314179 - DNA, 20 bp, Artificial
  CRISPR gRNA sequence
gggctcttatgaataaggct

SEQ ID NO: 314180 - DNA, 20 bp, Artificial
  CRISPR gRNA sequence
ttatgaataaggctgctgta

SEQ ID NO: 314181 - DNA, 20 bp, Artificial
  CRISPR gRNA sequence
atgaataaggctgctgtaaa

SEQ ID NO: 314182 - DNA, 20 bp, Artificial
  CRISPR gRNA sequence
tgaataaggctgctgtaaac

SEQ ID NO: 314183 - DNA, 20 bp, Artificial
  CRISPR gRNA sequence
ctgtaaacgttcatgtacag

SEQ ID NO: 314184 - DNA, 20 bp, Artificial
  CRISPR gRNA sequence
taaacgttcatgtacaggtt

SEQ ID NO: 314185 - DNA, 20 bp, Artificial
  CRISPR gRNA sequence
atgtacaggtttttgtgtga

SEQ ID NO: 314186 - DNA, 20 bp, Artificial
  CRISPR gRNA sequence
ttgtgtgaacataagttctc

SEQ ID NO: 314187 - DNA, 20 bp, Artificial
  CRISPR gRNA sequence
tgtgtgaacataagttctca

SEQ ID NO: 314188 - DNA, 20 bp, Artificial
  CRISPR gRNA sequence
gtgtgaacataagttctcag

SEQ ID NO: 314189 - DNA, 20 bp, Artificial
  CRISPR gRNA sequence
tgtgaacataagttctcagt

SEQ ID NO: 314190 - DNA, 20 bp, Artificial
  CRISPR gRNA sequence
tcagttctctagaggaaata

SEQ ID NO: 314191 - DNA, 20 bp, Artificial
  CRISPR gRNA sequence
agttctctagaggaaatacc

SEQ ID NO: 314192 - DNA, 20 bp, Artificial
  CRISPR gRNA sequence
tctagaggaaatacccaggt

SEQ ID NO: 314193 - DNA, 20 bp, Artificial
  CRISPR gRNA sequence
tagaggaaatacccaggtgt

SEQ ID NO: 314194 - DNA, 20 bp, Artificial
  CRISPR gRNA sequence
gaggaaatacccaggtgtgg

SEQ ID NO: 314195 - DNA, 20 bp, Artificial
  CRISPR gRNA sequence
ctggatccaggttaattttt

SEQ ID NO: 314196 - DNA, 20 bp, Artificial
  CRISPR gRNA sequence
gatccaggttaatttttgat

SEQ ID NO: 314197 - DNA, 20 bp, Artificial
  CRISPR gRNA sequence
atttttgatgaaacttgaaa

SEQ ID NO: 314198 - DNA, 20 bp, Artificial
  CRISPR gRNA sequence
ttgatgaaacttgaaaaggc

SEQ ID NO: 314199 - DNA, 20 bp, Artificial
  CRISPR gRNA sequence
tgatgaaacttgaaaaggca

SEQ ID NO: 314200 - DNA, 20 bp, Artificial
  CRISPR gRNA sequence
gatgaaacttgaaaaggcag

SEQ ID NO: 314201 - DNA, 20 bp, Artificial
  CRISPR gRNA sequence
atgaaacttgaaaaggcaga

SEQ ID NO: 314202 - DNA, 20 bp, Artificial
  CRISPR gRNA sequence
gaaaaggcagatcaacacct

SEQ ID NO: 314203 - DNA, 20 bp, Artificial
  CRISPR gRNA sequence
aaaaggcagatcaacaccta

SEQ ID NO: 314204 - DNA, 20 bp, Artificial
  CRISPR gRNA sequence
ttctaaaaccatagagtaaa

SEQ ID NO: 314205 - DNA, 20 bp, Artificial
  CRISPR gRNA sequence
taaaaccatagagtaaaaca

SEQ ID NO: 314206 - DNA, 20 bp, Artificial
  CRISPR gRNA sequence
aaaccatagagtaaaacaga

SEQ ID NO: 314207 - DNA, 20 bp, Artificial
  CRISPR gRNA sequence
ctccctttgaaccctgtgtg

SEQ ID NO: 314208 - DNA, 20 bp, Artificial
  CRISPR gRNA sequence
cctttgaaccctgtgtgatt

SEQ ID NO: 314209 - DNA, 20 bp, Artificial
  CRISPR gRNA sequence
tgaaccctgtgtgatttaaa

SEQ ID NO: 314210 - DNA, 20 bp, Artificial
  CRISPR gRNA sequence
gaaccctgtgtgatttaaac

SEQ ID NO: 314211 - DNA, 20 bp, Artificial
  CRISPR gRNA sequence
aaccctgtgtgatttaaact

SEQ ID NO: 314212 - DNA, 20 bp, Artificial
  CRISPR gRNA sequence
tgtgatttaaactaggctgc

SEQ ID NO: 314213 - DNA, 20 bp, Artificial
  CRISPR gRNA sequence
aaactaggctgcagggcttt

SEQ ID NO: 314214 - DNA, 20 bp, Artificial
  CRISPR gRNA sequence
aactaggctgcagggcttta

SEQ ID NO: 314215 - DNA, 20 bp, Artificial
  CRISPR gRNA sequence
ggctgcagggctttaggaat

SEQ ID NO: 314216 - DNA, 20 bp, Artificial
  CRISPR gRNA sequence
cagggctttaggaatagtta

SEQ ID NO: 314217 - DNA, 20 bp, Artificial
  CRISPR gRNA sequence
taggaatagttaaccaagtg

SEQ ID NO: 314218 - DNA, 20 bp, Artificial
  CRISPR gRNA sequence
aggaatagttaaccaagtgc

SEQ ID NO: 314219 - DNA, 20 bp, Artificial
  CRISPR gRNA sequence
ggaatagttaaccaagtgct

SEQ ID NO: 314220 - DNA, 20 bp, Artificial
  CRISPR gRNA sequence
accaagtgctaaatccgtgt

SEQ ID NO: 314221 - DNA, 20 bp, Artificial
  CRISPR gRNA sequence
aatccgtgttttcaaaatgt

SEQ ID NO: 314222 - DNA, 20 bp, Artificial
  CRISPR gRNA sequence
tcaaaatgtggtcaggtacc

SEQ ID NO: 314223 - DNA, 20 bp, Artificial
  CRISPR gRNA sequence
caaaatgtggtcaggtacca

SEQ ID NO: 314224 - DNA, 20 bp, Artificial
  CRISPR gRNA sequence
aaaatgtggtcaggtaccat

SEQ ID NO: 314225 - DNA, 20 bp, Artificial
  CRISPR gRNA sequence
gaaatgttttaggtgggaca

SEQ ID NO: 314226 - DNA, 20 bp, Artificial
  CRISPR gRNA sequence
taggtgggacacagataagc

SEQ ID NO: 314227 - DNA, 20 bp, Artificial
  CRISPR gRNA sequence
aggtgggacacagataagca

SEQ ID NO: 314228 - DNA, 20 bp, Artificial
  CRISPR gRNA sequence
ggtgggacacagataagcat

SEQ ID NO: 314229 - DNA, 20 bp, Artificial
  CRISPR gRNA sequence
tgaaaagccatgttgtattt

SEQ ID NO: 314230 - DNA, 20 bp, Artificial
  CRISPR gRNA sequence
gaaaagccatgttgtatttg

SEQ ID NO: 314231 - DNA, 20 bp, Artificial
  CRISPR gRNA sequence
aaaagccatgttgtatttgt

SEQ ID NO: 314232 - DNA, 20 bp, Artificial
  CRISPR gRNA sequence
tatttgttttaatgtatatt

SEQ ID NO: 314233 - DNA, 20 bp, Artificial
  CRISPR gRNA sequence
gttttaatgtatattagaaa

SEQ ID NO: 314234 - DNA, 20 bp, Artificial
  CRISPR gRNA sequence
ttttaatgtatattagaaaa

SEQ ID NO: 314235 - DNA, 20 bp, Artificial
  CRISPR gRNA sequence
taatgtatattagaaaaact

SEQ ID NO: 314236 - DNA, 20 bp, Artificial
  CRISPR gRNA sequence
aatgtatattagaaaaactc

SEQ ID NO: 314237 - DNA, 20 bp, Artificial
  CRISPR gRNA sequence
atgtatattagaaaaactct

SEQ ID NO: 314238 - DNA, 20 bp, Artificial
  CRISPR gRNA sequence
gaaaaactctaacttacgca

SEQ ID NO: 314239 - DNA, 20 bp, Artificial
  CRISPR gRNA sequence
taacttacgcaacatgtgat

SEQ ID NO: 314240 - DNA, 20 bp, Artificial
  CRISPR gRNA sequence
acttacgcaacatgtgattt

SEQ ID NO: 314241 - DNA, 20 bp, Artificial
  CRISPR gRNA sequence
acgcaacatgtgatttcaca

SEQ ID NO: 314242 - DNA, 20 bp, Artificial
  CRISPR gRNA sequence
cgcaacatgtgatttcacag

SEQ ID NO: 314243 - DNA, 20 bp, Artificial
  CRISPR gRNA sequence
cacagatcttgttaatgaag

SEQ ID NO: 314244 - DNA, 20 bp, Artificial
  CRISPR gRNA sequence
acagatcttgttaatgaagc

SEQ ID NO: 314245 - DNA, 20 bp, Artificial
  CRISPR gRNA sequence
gttaatgaagctaaacacgg

SEQ ID NO: 314246 - DNA, 20 bp, Artificial
  CRISPR gRNA sequence
ttaatgaagctaaacacggt

SEQ ID NO: 314247 - DNA, 20 bp, Artificial
  CRISPR gRNA sequence
atgaagctaaacacggtctg

SEQ ID NO: 314248 - DNA, 20 bp, Artificial
  CRISPR gRNA sequence
aacacggtctggcaattcac

SEQ ID NO: 314249 - DNA, 20 bp, Artificial
  CRISPR gRNA sequence
gcaattcaccttctacaggc

SEQ ID NO: 314250 - DNA, 20 bp, Artificial
  CRISPR gRNA sequence
accttctacaggccacatag

SEQ ID NO: 314251 - DNA, 20 bp, Artificial
  CRISPR gRNA sequence
ctacaggccacatagactcc

SEQ ID NO: 314252 - DNA, 20 bp, Artificial
  CRISPR gRNA sequence
tacaggccacatagactcca

SEQ ID NO: 314253 - DNA, 20 bp, Artificial
  CRISPR gRNA sequence
caggccacatagactccaag

SEQ ID NO: 314254 - DNA, 20 bp, Artificial
  CRISPR gRNA sequence
caagaagactgctcaaatag

SEQ ID NO: 314255 - DNA, 20 bp, Artificial
  CRISPR gRNA sequence
ctcaaatagtacactgatat

SEQ ID NO: 314256 - DNA, 20 bp, Artificial
  CRISPR gRNA sequence
aaatagtacactgatatagc

SEQ ID NO: 314257 - DNA, 20 bp, Artificial
  CRISPR gRNA sequence
atatagcaaaacttataaag

SEQ ID NO: 314258 - DNA, 20 bp, Artificial
  CRISPR gRNA sequence
ataaagatgacatgcaaatg

SEQ ID NO: 314259 - DNA, 20 bp, Artificial
  CRISPR gRNA sequence
taaagatgacatgcaaatga

SEQ ID NO: 314260 - DNA, 20 bp, Artificial
  CRISPR gRNA sequence
ttagtaagaatacactaaat

SEQ ID NO: 314261 - DNA, 20 bp, Artificial
  CRISPR gRNA sequence
tagtaagaatacactaaatt

SEQ ID NO: 314262 - DNA, 20 bp, Artificial
  CRISPR gRNA sequence
agtaagaatacactaaatta

SEQ ID NO: 314263 - DNA, 20 bp, Artificial
  CRISPR gRNA sequence
gtaagaatacactaaattat

SEQ ID NO: 314264 - DNA, 20 bp, Artificial
  CRISPR gRNA sequence
aattataaattagtttgtag

SEQ ID NO: 314265 - DNA, 20 bp, Artificial
  CRISPR gRNA sequence
taaattagtttgtagaacct

SEQ ID NO: 314266 - DNA, 20 bp, Artificial
  CRISPR gRNA sequence
gtttgtagaacctgcaaact

SEQ ID NO: 314267 - DNA, 20 bp, Artificial
  CRISPR gRNA sequence
gtagaacctgcaaactacct

SEQ ID NO: 314268 - DNA, 20 bp, Artificial
  CRISPR gRNA sequence
tagaacctgcaaactaccta

SEQ ID NO: 314269 - DNA, 20 bp, Artificial
  CRISPR gRNA sequence
caaactacctagtaactata

SEQ ID NO: 314270 - DNA, 20 bp, Artificial
  CRISPR gRNA sequence
cctagtaactataaaagaac

SEQ ID NO: 314271 - DNA, 20 bp, Artificial
  CRISPR gRNA sequence
gtaactataaaagaacaagg

SEQ ID NO: 314272 - DNA, 20 bp, Artificial
  CRISPR gRNA sequence
taaaagaacaagggattttt

SEQ ID NO: 314273 - DNA, 20 bp, Artificial
  CRISPR gRNA sequence
tttctgacagaaggcacatg

SEQ ID NO: 314274 - DNA, 20 bp, Artificial
  CRISPR gRNA sequence
ttctgacagaaggcacatga

SEQ ID NO: 314275 - DNA, 20 bp, Artificial
  CRISPR gRNA sequence
tctgacagaaggcacatgac

SEQ ID NO: 314276 - DNA, 20 bp, Artificial
  CRISPR gRNA sequence
ctgacagaaggcacatgaca

SEQ ID NO: 314277 - DNA, 20 bp, Artificial
  CRISPR gRNA sequence
tgacagaaggcacatgacac

SEQ ID NO: 314278 - DNA, 20 bp, Artificial
  CRISPR gRNA sequence
acagaaggcacatgacacag

SEQ ID NO: 314279 - DNA, 20 bp, Artificial
  CRISPR gRNA sequence
gggactccatgccagtgatc

SEQ ID NO: 314280 - DNA, 20 bp, Artificial
  CRISPR gRNA sequence
catgccagtgatcctgaaca

SEQ ID NO: 314281 - DNA, 20 bp, Artificial
  CRISPR gRNA sequence
aacagccagaaaagtgagaa

SEQ ID NO: 314282 - DNA, 20 bp, Artificial
  CRISPR gRNA sequence
tgtttattaagatcatgtat

SEQ ID NO: 314283 - DNA, 20 bp, Artificial
  CRISPR gRNA sequence
attaagatcatgtatttttc

SEQ ID NO: 314284 - DNA, 20 bp, Artificial
  CRISPR gRNA sequence
ttaagatcatgtatttttcc

SEQ ID NO: 314285 - DNA, 20 bp, Artificial
  CRISPR gRNA sequence
agatcatgtatttttcccta

SEQ ID NO: 314286 - DNA, 20 bp, Artificial
  CRISPR gRNA sequence
ttccctaaaatagctggatt

SEQ ID NO: 314287 - DNA, 20 bp, Artificial
  CRISPR gRNA sequence
tccctaaaatagctggattt

SEQ ID NO: 314288 - DNA, 20 bp, Artificial
  CRISPR gRNA sequence
ccctaaaatagctggatttg

SEQ ID NO: 314289 - DNA, 20 bp, Artificial
  CRISPR gRNA sequence
cctaaaatagctggatttgg

SEQ ID NO: 314290 - DNA, 20 bp, Artificial
  CRISPR gRNA sequence
aaatagctggatttggcctt

SEQ ID NO: 314291 - DNA, 20 bp, Artificial
  CRISPR gRNA sequence
gatttggccttcttcttaga

SEQ ID NO: 314292 - DNA, 20 bp, Artificial
  CRISPR gRNA sequence
ggccttcttcttagagtatg

SEQ ID NO: 314293 - DNA, 20 bp, Artificial
  CRISPR gRNA sequence
gccttcttcttagagtatgt

SEQ ID NO: 314294 - DNA, 20 bp, Artificial
  CRISPR gRNA sequence
cttcttagagtatgttatga

SEQ ID NO: 314295 - DNA, 20 bp, Artificial
  CRISPR gRNA sequence
ttcttagagtatgttatgaa

SEQ ID NO: 314296 - DNA, 20 bp, Artificial
  CRISPR gRNA sequence
cttagagtatgttatgaaga

SEQ ID NO: 314297 - DNA, 20 bp, Artificial
  CRISPR gRNA sequence
ttagagtatgttatgaagac

SEQ ID NO: 314298 - DNA, 20 bp, Artificial
  CRISPR gRNA sequence
agagtatgttatgaagacac

SEQ ID NO: 314299 - DNA, 20 bp, Artificial
  CRISPR gRNA sequence
gagtatgttatgaagacact

SEQ ID NO: 314300 - DNA, 20 bp, Artificial
  CRISPR gRNA sequence
tgaagacactttgatgctca

SEQ ID NO: 314301 - DNA, 20 bp, Artificial
  CRISPR gRNA sequence
tgatgctcatgccaaaaatc

SEQ ID NO: 314302 - DNA, 20 bp, Artificial
  CRISPR gRNA sequence
gatgctcatgccaaaaatca

SEQ ID NO: 314303 - DNA, 20 bp, Artificial
  CRISPR gRNA sequence
atgctcatgccaaaaatcag

SEQ ID NO: 314304 - DNA, 20 bp, Artificial
  CRISPR gRNA sequence
atgccaaaaatcagtgttct

SEQ ID NO: 314305 - DNA, 20 bp, Artificial
  CRISPR gRNA sequence
tgaatttcgaattccaaaat

SEQ ID NO: 314306 - DNA, 20 bp, Artificial
  CRISPR gRNA sequence
aatttcgaattccaaaatat

SEQ ID NO: 314307 - DNA, 20 bp, Artificial
  CRISPR gRNA sequence
cgaattccaaaatatccacc

SEQ ID NO: 314308 - DNA, 20 bp, Artificial
  CRISPR gRNA sequence
gaattccaaaatatccaccc

SEQ ID NO: 314309 - DNA, 20 bp, Artificial
  CRISPR gRNA sequence
caaaatatccacccactcac

SEQ ID NO: 314310 - DNA, 20 bp, Artificial
  CRISPR gRNA sequence
acttaccacaatcctgcttg

SEQ ID NO: 314311 - DNA, 20 bp, Artificial
  CRISPR gRNA sequence
accacaatcctgcttgggtt

SEQ ID NO: 314312 - DNA, 20 bp, Artificial
  CRISPR gRNA sequence
ccacaatcctgcttgggttt

SEQ ID NO: 314313 - DNA, 20 bp, Artificial
  CRISPR gRNA sequence
cttgggtttctgaaagatat

SEQ ID NO: 314314 - DNA, 20 bp, Artificial
  CRISPR gRNA sequence
gggtttctgaaagatatgac

SEQ ID NO: 314315 - DNA, 20 bp, Artificial
  CRISPR gRNA sequence
ggtttctgaaagatatgacg

SEQ ID NO: 314316 - DNA, 20 bp, Artificial
  CRISPR gRNA sequence
ctgaaagatatgacgcaggg

SEQ ID NO: 314317 - DNA, 20 bp, Artificial
  CRISPR gRNA sequence
tgaaagatatgacgcagggc

SEQ ID NO: 314318 - DNA, 20 bp, Artificial
  CRISPR gRNA sequence
aaagatatgacgcagggcat

SEQ ID NO: 314319 - DNA, 20 bp, Artificial
  CRISPR gRNA sequence
agcaccatgaactctgtcag

SEQ ID NO: 314320 - DNA, 20 bp, Artificial
  CRISPR gRNA sequence
tgtcagttcctggtgagact

SEQ ID NO: 314321 - DNA, 20 bp, Artificial
  CRISPR gRNA sequence
tcagttcctggtgagactcc

SEQ ID NO: 314322 - DNA, 20 bp, Artificial
  CRISPR gRNA sequence
ctggtgagactccagctcaa

SEQ ID NO: 314323 - DNA, 20 bp, Artificial
  CRISPR gRNA sequence
gtgagactccagctcaattc

SEQ ID NO: 314324 - DNA, 20 bp, Artificial
  CRISPR gRNA sequence
cagctcaattccttcctgct

SEQ ID NO: 314325 - DNA, 20 bp, Artificial
  CRISPR gRNA sequence
aattccttcctgctctctta

SEQ ID NO: 314326 - DNA, 20 bp, Artificial
  CRISPR gRNA sequence
cttcctgctctcttagtctg

SEQ ID NO: 314327 - DNA, 20 bp, Artificial
  CRISPR gRNA sequence
cctgctctcttagtctgggg

SEQ ID NO: 314328 - DNA, 20 bp, Artificial
  CRISPR gRNA sequence
ctgctctcttagtctgggga

SEQ ID NO: 314329 - DNA, 20 bp, Artificial
  CRISPR gRNA sequence
ctctcttagtctggggagct

SEQ ID NO: 314330 - DNA, 20 bp, Artificial
  CRISPR gRNA sequence
tcttagtctggggagctgga

SEQ ID NO: 314331 - DNA, 20 bp, Artificial
  CRISPR gRNA sequence
ttagtctggggagctggaat

SEQ ID NO: 314332 - DNA, 20 bp, Artificial
  CRISPR gRNA sequence
agtctggggagctggaatgt

SEQ ID NO: 314333 - DNA, 20 bp, Artificial
  CRISPR gRNA sequence
gtctggggagctggaatgtg

SEQ ID NO: 314334 - DNA, 20 bp, Artificial
  CRISPR gRNA sequence
gggagctggaatgtgcccca

SEQ ID NO: 314335 - DNA, 20 bp, Artificial
  CRISPR gRNA sequence
gaatgtgccccatgggacac

SEQ ID NO: 314336 - DNA, 20 bp, Artificial
  CRISPR gRNA sequence
ggccctagagtcagaccact

SEQ ID NO: 314337 - DNA, 20 bp, Artificial
  CRISPR gRNA sequence
gagtcagaccacttctcctt

SEQ ID NO: 314338 - DNA, 20 bp, Artificial
  CRISPR gRNA sequence
ctccttccaaagactctact

SEQ ID NO: 314339 - DNA, 20 bp, Artificial
  CRISPR gRNA sequence
tccttccaaagactctactc

SEQ ID NO: 314340 - DNA, 20 bp, Artificial
  CRISPR gRNA sequence
cttccaaagactctactccc

SEQ ID NO: 314341 - DNA, 20 bp, Artificial
  CRISPR gRNA sequence
ccaaagactctactccctgg

SEQ ID NO: 314342 - DNA, 20 bp, Artificial
  CRISPR gRNA sequence
caaagactctactccctgga

SEQ ID NO: 314343 - DNA, 20 bp, Artificial
  CRISPR gRNA sequence
tactccctggaaacagtggc

SEQ ID NO: 314344 - DNA, 20 bp, Artificial
  CRISPR gRNA sequence
ctccctggaaacagtggctt

SEQ ID NO: 314345 - DNA, 20 bp, Artificial
  CRISPR gRNA sequence
cctggaaacagtggcttcat

SEQ ID NO: 314346 - DNA, 20 bp, Artificial
  CRISPR gRNA sequence
gaaacagtggcttcattgta

SEQ ID NO: 314347 - DNA, 20 bp, Artificial
  CRISPR gRNA sequence
cattgtaaatctttggtgac

SEQ ID NO: 314348 - DNA, 20 bp, Artificial
  CRISPR gRNA sequence
attgtaaatctttggtgact

SEQ ID NO: 314349 - DNA, 20 bp, Artificial
  CRISPR gRNA sequence
taaatctttggtgactcaat

SEQ ID NO: 314350 - DNA, 20 bp, Artificial
  CRISPR gRNA sequence
tggtgactcaattacagccc

SEQ ID NO: 314351 - DNA, 20 bp, Artificial
  CRISPR gRNA sequence
ggtgactcaattacagccct

SEQ ID NO: 314352 - DNA, 20 bp, Artificial
  CRISPR gRNA sequence
gtgactcaattacagccctc

SEQ ID NO: 314353 - DNA, 20 bp, Artificial
  CRISPR gRNA sequence
aattacagccctcctgtcac

SEQ ID NO: 314354 - DNA, 20 bp, Artificial
  CRISPR gRNA sequence
cagccctcctgtcacttaga

SEQ ID NO: 314355 - DNA, 20 bp, Artificial
  CRISPR gRNA sequence
ctgtcacttagagagcaccc

SEQ ID NO: 314356 - DNA, 20 bp, Artificial
  CRISPR gRNA sequence
tcacttagagagcacccctt

SEQ ID NO: 314357 - DNA, 20 bp, Artificial
  CRISPR gRNA sequence
agagagcacccctttgattt

SEQ ID NO: 314358 - DNA, 20 bp, Artificial
  CRISPR gRNA sequence
gagagcacccctttgatttg

SEQ ID NO: 314359 - DNA, 20 bp, Artificial
  CRISPR gRNA sequence
tgatttggataagcaggaag

SEQ ID NO: 314360 - DNA, 20 bp, Artificial
  CRISPR gRNA sequence
gatttggataagcaggaagt

SEQ ID NO: 314361 - DNA, 20 bp, Artificial
  CRISPR gRNA sequence
atttggataagcaggaagta

SEQ ID NO: 314362 - DNA, 20 bp, Artificial
  CRISPR gRNA sequence
ggataagcaggaagtaagca

SEQ ID NO: 314363 - DNA, 20 bp, Artificial
  CRISPR gRNA sequence
gataagcaggaagtaagcat

SEQ ID NO: 314364 - DNA, 20 bp, Artificial
  CRISPR gRNA sequence
caaactctattgttgaaaaa

SEQ ID NO: 314365 - DNA, 20 bp, Artificial
  CRISPR gRNA sequence
tattgttgaaaaataaacat

SEQ ID NO: 314366 - DNA, 20 bp, Artificial
  CRISPR gRNA sequence
ttgttgaaaaataaacatga

SEQ ID NO: 314367 - DNA, 20 bp, Artificial
  CRISPR gRNA sequence
ttgaaaaataaacatgaagt

SEQ ID NO: 314368 - DNA, 20 bp, Artificial
  CRISPR gRNA sequence
aaaaataaacatgaagtcat

SEQ ID NO: 314369 - DNA, 20 bp, Artificial
  CRISPR gRNA sequence
tgtggcactcaccttgggct

SEQ ID NO: 314370 - DNA, 20 bp, Artificial
  CRISPR gRNA sequence
accttgggctgagggtcaca

SEQ ID NO: 314371 - DNA, 20 bp, Artificial
  CRISPR gRNA sequence
gggctgagggtcacatttta

SEQ ID NO: 314372 - DNA, 20 bp, Artificial
  CRISPR gRNA sequence
ggctgagggtcacattttag

SEQ ID NO: 314373 - DNA, 20 bp, Artificial
  CRISPR gRNA sequence
agggtcacattttagacacc

SEQ ID NO: 314374 - DNA, 20 bp, Artificial
  CRISPR gRNA sequence
tagacaccctgaggctccca

SEQ ID NO: 314375 - DNA, 20 bp, Artificial
  CRISPR gRNA sequence
agacaccctgaggctcccag

SEQ ID NO: 314376 - DNA, 20 bp, Artificial
  CRISPR gRNA sequence
gacaccctgaggctcccagg

SEQ ID NO: 314377 - DNA, 20 bp, Artificial
  CRISPR gRNA sequence
aggctcccaggtgtgcccca

SEQ ID NO: 314378 - DNA, 20 bp, Artificial
  CRISPR gRNA sequence
ccaggtgtgccccaatgagc

SEQ ID NO: 314379 - DNA, 20 bp, Artificial
  CRISPR gRNA sequence
tttgctattccctcctagat

SEQ ID NO: 314380 - DNA, 20 bp, Artificial
  CRISPR gRNA sequence
gctattccctcctagataca

SEQ ID NO: 314381 - DNA, 20 bp, Artificial
  CRISPR gRNA sequence
ctattccctcctagatacat

SEQ ID NO: 314382 - DNA, 20 bp, Artificial
  CRISPR gRNA sequence
ttccctcctagatacatcta

SEQ ID NO: 314383 - DNA, 20 bp, Artificial
  CRISPR gRNA sequence
cctcctagatacatctaaac

SEQ ID NO: 314384 - DNA, 20 bp, Artificial
  CRISPR gRNA sequence
ctagatacatctaaacttag

SEQ ID NO: 314385 - DNA, 20 bp, Artificial
  CRISPR gRNA sequence
gatacatctaaacttagatt

SEQ ID NO: 314386 - DNA, 20 bp, Artificial
  CRISPR gRNA sequence
aacttagattgatttttttt

SEQ ID NO: 314387 - DNA, 20 bp, Artificial
  CRISPR gRNA sequence
agattgatttttttttatct

SEQ ID NO: 314388 - DNA, 20 bp, Artificial
  CRISPR gRNA sequence
gattgatttttttttatctc

SEQ ID NO: 314389 - DNA, 20 bp, Artificial
  CRISPR gRNA sequence
atttttttttatctctcttc

SEQ ID NO: 314390 - DNA, 20 bp, Artificial
  CRISPR gRNA sequence
ttttttatctctcttctgct

SEQ ID NO: 314391 - DNA, 20 bp, Artificial
  CRISPR gRNA sequence
tttttatctctcttctgctt

SEQ ID NO: 314392 - DNA, 20 bp, Artificial
  CRISPR gRNA sequence
ttttatctctcttctgcttt

SEQ ID NO: 314393 - DNA, 20 bp, Artificial
  CRISPR gRNA sequence
tttatctctcttctgctttc

SEQ ID NO: 314394 - DNA, 20 bp, Artificial
  CRISPR gRNA sequence
ttatctctcttctgctttca

SEQ ID NO: 314395 - DNA, 20 bp, Artificial
  CRISPR gRNA sequence
tatctctcttctgctttcag

SEQ ID NO: 314396 - DNA, 20 bp, Artificial
  CRISPR gRNA sequence
atctctcttctgctttcagc

SEQ ID NO: 314397 - DNA, 20 bp, Artificial
  CRISPR gRNA sequence
tctctcttctgctttcagct

SEQ ID NO: 314398 - DNA, 20 bp, Artificial
  CRISPR gRNA sequence
tcttctgctttcagctaact

SEQ ID NO: 314399 - DNA, 20 bp, Artificial
  CRISPR gRNA sequence
ttctgctttcagctaacttc

SEQ ID NO: 314400 - DNA, 20 bp, Artificial
  CRISPR gRNA sequence
ctgctttcagctaacttcag

SEQ ID NO: 314401 - DNA, 20 bp, Artificial
  CRISPR gRNA sequence
tgctttcagctaacttcagt

SEQ ID NO: 314402 - DNA, 20 bp, Artificial
  CRISPR gRNA sequence
ctttcagctaacttcagtca

SEQ ID NO: 314403 - DNA, 20 bp, Artificial
  CRISPR gRNA sequence
tcagctaacttcagtcaacc

SEQ ID NO: 314404 - DNA, 20 bp, Artificial
  CRISPR gRNA sequence
cagctaacttcagtcaacct

SEQ ID NO: 314405 - DNA, 20 bp, Artificial
  CRISPR gRNA sequence
agctaacttcagtcaacctg

SEQ ID NO: 314406 - DNA, 20 bp, Artificial
  CRISPR gRNA sequence
acttcagtcaacctgaaata

SEQ ID NO: 314407 - DNA, 20 bp, Artificial
  CRISPR gRNA sequence
cagtcaacctgaaatagtac

SEQ ID NO: 314408 - DNA, 20 bp, Artificial
  CRISPR gRNA sequence
agtcaacctgaaatagtacc

SEQ ID NO: 314409 - DNA, 20 bp, Artificial
  CRISPR gRNA sequence
aaatagtaccaatttctaat

SEQ ID NO: 314410 - DNA, 20 bp, Artificial
  CRISPR gRNA sequence
ctaatataacagaaaatgtg

SEQ ID NO: 314411 - DNA, 20 bp, Artificial
  CRISPR gRNA sequence
taatataacagaaaatgtgt

SEQ ID NO: 314412 - DNA, 20 bp, Artificial
  CRISPR gRNA sequence
atataacagaaaatgtgtac

SEQ ID NO: 314413 - DNA, 20 bp, Artificial
  CRISPR gRNA sequence
gacctgctcatctatacacg

SEQ ID NO: 314414 - DNA, 20 bp, Artificial
  CRISPR gRNA sequence
acctgctcatctatacacgg

SEQ ID NO: 314415 - DNA, 20 bp, Artificial
  CRISPR gRNA sequence
ctcatctatacacggttacc

SEQ ID NO: 314416 - DNA, 20 bp, Artificial
  CRISPR gRNA sequence
atctatacacggttacccag

SEQ ID NO: 314417 - DNA, 20 bp, Artificial
  CRISPR gRNA sequence
tacacggttacccagaacct

SEQ ID NO: 314418 - DNA, 20 bp, Artificial
  CRISPR gRNA sequence
cccagaacctaagaagatga

SEQ ID NO: 314419 - DNA, 20 bp, Artificial
  CRISPR gRNA sequence
agaagatgagtgttttgcta

SEQ ID NO: 314420 - DNA, 20 bp, Artificial
  CRISPR gRNA sequence
tgctaagaaccaagaattca

SEQ ID NO: 314421 - DNA, 20 bp, Artificial
  CRISPR gRNA sequence
gctaagaaccaagaattcaa

SEQ ID NO: 314422 - DNA, 20 bp, Artificial
  CRISPR gRNA sequence
ctaagaaccaagaattcaac

SEQ ID NO: 314423 - DNA, 20 bp, Artificial
  CRISPR gRNA sequence
agaaccaagaattcaactat

SEQ ID NO: 314424 - DNA, 20 bp, Artificial
  CRISPR gRNA sequence
aactatcgagtatgatggtg

SEQ ID NO: 314425 - DNA, 20 bp, Artificial
  CRISPR gRNA sequence
tcgagtatgatggtgttatg

SEQ ID NO: 314426 - DNA, 20 bp, Artificial
  CRISPR gRNA sequence
tgcagaaatctcaagataat

SEQ ID NO: 314427 - DNA, 20 bp, Artificial
  CRISPR gRNA sequence
aagataatgtcacagaactg

SEQ ID NO: 314428 - DNA, 20 bp, Artificial
  CRISPR gRNA sequence
tacgacgtttccatcagctt

SEQ ID NO: 314429 - DNA, 20 bp, Artificial
  CRISPR gRNA sequence
ccatcagcttgtctgtttca

SEQ ID NO: 314430 - DNA, 20 bp, Artificial
  CRISPR gRNA sequence
catcagcttgtctgtttcat

SEQ ID NO: 314431 - DNA, 20 bp, Artificial
  CRISPR gRNA sequence
gtctgtttcattccctgatg

SEQ ID NO: 314432 - DNA, 20 bp, Artificial
  CRISPR gRNA sequence
tctgtttcattccctgatgt

SEQ ID NO: 314433 - DNA, 20 bp, Artificial
  CRISPR gRNA sequence
tttcattccctgatgttacg

SEQ ID NO: 314434 - DNA, 20 bp, Artificial
  CRISPR gRNA sequence
cattccctgatgttacgagc

SEQ ID NO: 314435 - DNA, 20 bp, Artificial
  CRISPR gRNA sequence
attccctgatgttacgagca

SEQ ID NO: 314436 - DNA, 20 bp, Artificial
  CRISPR gRNA sequence
cctgatgttacgagcaatat

SEQ ID NO: 314437 - DNA, 20 bp, Artificial
  CRISPR gRNA sequence
atgttacgagcaatatgacc

SEQ ID NO: 314438 - DNA, 20 bp, Artificial
  CRISPR gRNA sequence
cgagcaatatgaccatcttc

SEQ ID NO: 314439 - DNA, 20 bp, Artificial
  CRISPR gRNA sequence
ctgtattctggaaactgaca

SEQ ID NO: 314440 - DNA, 20 bp, Artificial
  CRISPR gRNA sequence
tgtattctggaaactgacaa

SEQ ID NO: 314441 - DNA, 20 bp, Artificial
  CRISPR gRNA sequence
tattctggaaactgacaaga

SEQ ID NO: 314442 - DNA, 20 bp, Artificial
  CRISPR gRNA sequence
tggaaactgacaagacgcgg

SEQ ID NO: 314443 - DNA, 20 bp, Artificial
  CRISPR gRNA sequence
gaaactgacaagacgcggct

SEQ ID NO: 314444 - DNA, 20 bp, Artificial
  CRISPR gRNA sequence
acaagacgcggcttttatct

SEQ ID NO: 314445 - DNA, 20 bp, Artificial
  CRISPR gRNA sequence
ttatcttcacctttctctat

SEQ ID NO: 314446 - DNA, 20 bp, Artificial
  CRISPR gRNA sequence
tatcttcacctttctctata

SEQ ID NO: 314447 - DNA, 20 bp, Artificial
  CRISPR gRNA sequence
atcttcacctttctctatag

SEQ ID NO: 314448 - DNA, 20 bp, Artificial
  CRISPR gRNA sequence
tcttcacctttctctatagg

SEQ ID NO: 314449 - DNA, 20 bp, Artificial
  CRISPR gRNA sequence
cacctttctctataggtaaa

SEQ ID NO: 314450 - DNA, 20 bp, Artificial
  CRISPR gRNA sequence
acctttctctataggtaaag

SEQ ID NO: 314451 - DNA, 20 bp, Artificial
  CRISPR gRNA sequence
tctctataggtaaagctgtt

SEQ ID NO: 314452 - DNA, 20 bp, Artificial
  CRISPR gRNA sequence
ctctataggtaaagctgttt

SEQ ID NO: 314453 - DNA, 20 bp, Artificial
  CRISPR gRNA sequence
tctataggtaaagctgtttt

SEQ ID NO: 314454 - DNA, 20 bp, Artificial
  CRISPR gRNA sequence
tataggtaaagctgttttcc

SEQ ID NO: 314455 - DNA, 20 bp, Artificial
  CRISPR gRNA sequence
taggtaaagctgttttccaa

SEQ ID NO: 314456 - DNA, 20 bp, Artificial
  CRISPR gRNA sequence
ttttccaagactatttcttt

SEQ ID NO: 314457 - DNA, 20 bp, Artificial
  CRISPR gRNA sequence
tccaagactatttctttcag

SEQ ID NO: 314458 - DNA, 20 bp, Artificial
  CRISPR gRNA sequence
ccaagactatttctttcagc

SEQ ID NO: 314459 - DNA, 20 bp, Artificial
  CRISPR gRNA sequence
caagactatttctttcagca

SEQ ID NO: 314460 - DNA, 20 bp, Artificial
  CRISPR gRNA sequence
tttctttcagcaggtattat

SEQ ID NO: 314461 - DNA, 20 bp, Artificial
  CRISPR gRNA sequence
ctttcagcaggtattataca

SEQ ID NO: 314462 - DNA, 20 bp, Artificial
  CRISPR gRNA sequence
tttcagcaggtattatacac

SEQ ID NO: 314463 - DNA, 20 bp, Artificial
  CRISPR gRNA sequence
tcagcaggtattatacacaa

SEQ ID NO: 314464 - DNA, 20 bp, Artificial
  CRISPR gRNA sequence
cagcaggtattatacacaaa

SEQ ID NO: 314465 - DNA, 20 bp, Artificial
  CRISPR gRNA sequence
agcaggtattatacacaaat

SEQ ID NO: 314466 - DNA, 20 bp, Artificial
  CRISPR gRNA sequence
tacacaaatgcttaaggcag

SEQ ID NO: 314467 - DNA, 20 bp, Artificial
  CRISPR gRNA sequence
aaggcagatcatccaatgtc

SEQ ID NO: 314468 - DNA, 20 bp, Artificial
  CRISPR gRNA sequence
aggcagatcatccaatgtcc

SEQ ID NO: 314469 - DNA, 20 bp, Artificial
  CRISPR gRNA sequence
gctaggaaacctccaactgg

SEQ ID NO: 314470 - DNA, 20 bp, Artificial
  CRISPR gRNA sequence
ctaggaaacctccaactggg

SEQ ID NO: 314471 - DNA, 20 bp, Artificial
  CRISPR gRNA sequence
ggaaacctccaactgggcca

SEQ ID NO: 314472 - DNA, 20 bp, Artificial
  CRISPR gRNA sequence
caactgggccattttatgac

SEQ ID NO: 314473 - DNA, 20 bp, Artificial
  CRISPR gRNA sequence
ggccattttatgacgctgtt

SEQ ID NO: 314474 - DNA, 20 bp, Artificial
  CRISPR gRNA sequence
tatgacgctgttaggaagga

SEQ ID NO: 314475 - DNA, 20 bp, Artificial
  CRISPR gRNA sequence
atgacgctgttaggaaggac

SEQ ID NO: 314476 - DNA, 20 bp, Artificial
  CRISPR gRNA sequence
tgacgctgttaggaaggacc

SEQ ID NO: 314477 - DNA, 20 bp, Artificial
  CRISPR gRNA sequence
ttaggaaggacccagatgga

SEQ ID NO: 314478 - DNA, 20 bp, Artificial
  CRISPR gRNA sequence
ggaaggacccagatggaggt

SEQ ID NO: 314479 - DNA, 20 bp, Artificial
  CRISPR gRNA sequence
ctgcttctcctgagtgatgc

SEQ ID NO: 314480 - DNA, 20 bp, Artificial
  CRISPR gRNA sequence
cttctcctgagtgatgcagg

SEQ ID NO: 314481 - DNA, 20 bp, Artificial
  CRISPR gRNA sequence
ctcctgagtgatgcagggtc

SEQ ID NO: 314482 - DNA, 20 bp, Artificial
  CRISPR gRNA sequence
tcctgagtgatgcagggtcc

SEQ ID NO: 314483 - DNA, 20 bp, Artificial
  CRISPR gRNA sequence
ctgagtgatgcagggtccag

SEQ ID NO: 314484 - DNA, 20 bp, Artificial
  CRISPR gRNA sequence
agtgatgcagggtccaggag

SEQ ID NO: 314485 - DNA, 20 bp, Artificial
  CRISPR gRNA sequence
cgagcctatgttgcacttga

SEQ ID NO: 314486 - DNA, 20 bp, Artificial
  CRISPR gRNA sequence
tgttgcacttgaagaaatat

SEQ ID NO: 314487 - DNA, 20 bp, Artificial
  CRISPR gRNA sequence
cacttgaagaaatatgcttt

SEQ ID NO: 314488 - DNA, 20 bp, Artificial
  CRISPR gRNA sequence
gaagaaatatgcttttagcc

SEQ ID NO: 314489 - DNA, 20 bp, Artificial
  CRISPR gRNA sequence
aagaaatatgcttttagccc

SEQ ID NO: 314490 - DNA, 20 bp, Artificial
  CRISPR gRNA sequence
ttagccctgaaactgactca

SEQ ID NO: 314491 - DNA, 20 bp, Artificial
  CRISPR gRNA sequence
tagccctgaaactgactcag

SEQ ID NO: 314492 - DNA, 20 bp, Artificial
  CRISPR gRNA sequence
agccctgaaactgactcagt

SEQ ID NO: 314493 - DNA, 20 bp, Artificial
  CRISPR gRNA sequence
gccctgaaactgactcagtc

SEQ ID NO: 314494 - DNA, 20 bp, Artificial
  CRISPR gRNA sequence
aaactgactcagtctcttgg

SEQ ID NO: 314495 - DNA, 20 bp, Artificial
  CRISPR gRNA sequence
actcagtctcttggtttacc

SEQ ID NO: 314496 - DNA, 20 bp, Artificial
  CRISPR gRNA sequence
agtctcttggtttacctttg

SEQ ID NO: 314497 - DNA, 20 bp, Artificial
  CRISPR gRNA sequence
ttggtttacctttggatgga

SEQ ID NO: 314498 - DNA, 20 bp, Artificial
  CRISPR gRNA sequence
ggtttacctttggatggagg

SEQ ID NO: 314499 - DNA, 20 bp, Artificial
  CRISPR gRNA sequence
gtttacctttggatggagga

SEQ ID NO: 314500 - DNA, 20 bp, Artificial
  CRISPR gRNA sequence
acctttggatggaggattct

SEQ ID NO: 314501 - DNA, 20 bp, Artificial
  CRISPR gRNA sequence
cctttggatggaggattctg

SEQ ID NO: 314502 - DNA, 20 bp, Artificial
  CRISPR gRNA sequence
tggatggaggattctgaagt

SEQ ID NO: 314503 - DNA, 20 bp, Artificial
  CRISPR gRNA sequence
ggatggaggattctgaagtt

SEQ ID NO: 314504 - DNA, 20 bp, Artificial
  CRISPR gRNA sequence
gatggaggattctgaagttt

SEQ ID NO: 314505 - DNA, 20 bp, Artificial
  CRISPR gRNA sequence
tgaagttttgatttaaaaat

SEQ ID NO: 314506 - DNA, 20 bp, Artificial
  CRISPR gRNA sequence
aagttttgatttaaaaatac

SEQ ID NO: 314507 - DNA, 20 bp, Artificial
  CRISPR gRNA sequence
tgatttaaaaatacaggatt

SEQ ID NO: 314508 - DNA, 20 bp, Artificial
  CRISPR gRNA sequence
gatttaaaaatacaggattc

SEQ ID NO: 314509 - DNA, 20 bp, Artificial
  CRISPR gRNA sequence
atttaaaaatacaggattcc

SEQ ID NO: 314510 - DNA, 20 bp, Artificial
  CRISPR gRNA sequence
aaaaatacaggattcctcca

SEQ ID NO: 314511 - DNA, 20 bp, Artificial
  CRISPR gRNA sequence
aaaatacaggattcctccag

SEQ ID NO: 314512 - DNA, 20 bp, Artificial
  CRISPR gRNA sequence
ctccaggctagaattctttc

SEQ ID NO: 314513 - DNA, 20 bp, Artificial
  CRISPR gRNA sequence
caggctagaattctttcttt

SEQ ID NO: 314514 - DNA, 20 bp, Artificial
  CRISPR gRNA sequence
gaattctttctttgattaca

SEQ ID NO: 314515 - DNA, 20 bp, Artificial
  CRISPR gRNA sequence
tttctttgattacaacacat

SEQ ID NO: 314516 - DNA, 20 bp, Artificial
  CRISPR gRNA sequence
tctttgattacaacacatac

SEQ ID NO: 314517 - DNA, 20 bp, Artificial
  CRISPR gRNA sequence
ctttgattacaacacataca

SEQ ID NO: 314518 - DNA, 20 bp, Artificial
  CRISPR gRNA sequence
tttgattacaacacatacat

SEQ ID NO: 314519 - DNA, 20 bp, Artificial
  CRISPR gRNA sequence
tgattacaacacatacatgc

SEQ ID NO: 314520 - DNA, 20 bp, Artificial
  CRISPR gRNA sequence
gattacaacacatacatgcg

SEQ ID NO: 314521 - DNA, 20 bp, Artificial
  CRISPR gRNA sequence
attacaacacatacatgcgc

SEQ ID NO: 314522 - DNA, 20 bp, Artificial
  CRISPR gRNA sequence
caacacatacatgcgcttgc

SEQ ID NO: 314523 - DNA, 20 bp, Artificial
  CRISPR gRNA sequence
gcacacacacacacacacac

SEQ ID NO: 314524 - DNA, 20 bp, Artificial
  CRISPR gRNA sequence
cacacacacacacacacaca

SEQ ID NO: 314525 - DNA, 20 bp, Artificial
  CRISPR gRNA sequence
attgtgagtatagaaccatt

SEQ ID NO: 314526 - DNA, 20 bp, Artificial
  CRISPR gRNA sequence
ttgtgagtatagaaccattt

SEQ ID NO: 314527 - DNA, 20 bp, Artificial
  CRISPR gRNA sequence
tgagtatagaaccatttggg

SEQ ID NO: 314528 - DNA, 20 bp, Artificial
  CRISPR gRNA sequence
gggacattattggtcacagg

SEQ ID NO: 314529 - DNA, 20 bp, Artificial
  CRISPR gRNA sequence
ggacattattggtcacagga

SEQ ID NO: 314530 - DNA, 20 bp, Artificial
  CRISPR gRNA sequence
ttggtcacaggagtgaaaac

SEQ ID NO: 314531 - DNA, 20 bp, Artificial
  CRISPR gRNA sequence
gtcacaggagtgaaaacaaa

SEQ ID NO: 314532 - DNA, 20 bp, Artificial
  CRISPR gRNA sequence
tgcccttgaggaccttccaa

SEQ ID NO: 314533 - DNA, 20 bp, Artificial
  CRISPR gRNA sequence
cccttgaggaccttccaata

SEQ ID NO: 314534 - DNA, 20 bp, Artificial
  CRISPR gRNA sequence
gaggaccttccaatagaatc

SEQ ID NO: 314535 - DNA, 20 bp, Artificial
  CRISPR gRNA sequence
aggaccttccaatagaatca

SEQ ID NO: 314536 - DNA, 20 bp, Artificial
  CRISPR gRNA sequence
ccaatagaatcagaaccctg

SEQ ID NO: 314537 - DNA, 20 bp, Artificial
  CRISPR gRNA sequence
caatagaatcagaaccctgt

SEQ ID NO: 314538 - DNA, 20 bp, Artificial
  CRISPR gRNA sequence
taatgtgcacacatgaaaaa

SEQ ID NO: 314539 - DNA, 20 bp, Artificial
  CRISPR gRNA sequence
gatttttaaaaggttgaatt

SEQ ID NO: 314540 - DNA, 20 bp, Artificial
  CRISPR gRNA sequence
ttaaaaggttgaattggaat

SEQ ID NO: 314541 - DNA, 20 bp, Artificial
  CRISPR gRNA sequence
taaaaggttgaattggaatc

SEQ ID NO: 314542 - DNA, 20 bp, Artificial
  CRISPR gRNA sequence
aaaaggttgaattggaatct

SEQ ID NO: 314543 - DNA, 20 bp, Artificial
  CRISPR gRNA sequence
aaaggttgaattggaatcta

SEQ ID NO: 314544 - DNA, 20 bp, Artificial
  CRISPR gRNA sequence
aattggaatctaaattttat

SEQ ID NO: 314545 - DNA, 20 bp, Artificial
  CRISPR gRNA sequence
gaatctaaattttattccat

SEQ ID NO: 314546 - DNA, 20 bp, Artificial
  CRISPR gRNA sequence
aattttattccatggaaata

SEQ ID NO: 314547 - DNA, 20 bp, Artificial
  CRISPR gRNA sequence
tattccatggaaatatctga

SEQ ID NO: 314548 - DNA, 20 bp, Artificial
  CRISPR gRNA sequence
attccatggaaatatctgac

SEQ ID NO: 314549 - DNA, 20 bp, Artificial
  CRISPR gRNA sequence
ttccatggaaatatctgact

SEQ ID NO: 314550 - DNA, 20 bp, Artificial
  CRISPR gRNA sequence
catggaaatatctgactaaa

SEQ ID NO: 314551 - DNA, 20 bp, Artificial
  CRISPR gRNA sequence
actaaatttaaaataaaagt

SEQ ID NO: 314552 - DNA, 20 bp, Artificial
  CRISPR gRNA sequence
aatttaaaataaaagtgact

SEQ ID NO: 314553 - DNA, 20 bp, Artificial
  CRISPR gRNA sequence
aaaataaaagtgactggtaa

SEQ ID NO: 314554 - DNA, 20 bp, Artificial
  CRISPR gRNA sequence
aaataaaagtgactggtaat

SEQ ID NO: 314555 - DNA, 20 bp, Artificial
  CRISPR gRNA sequence
gtaatgagatttatgggcat

SEQ ID NO: 314556 - DNA, 20 bp, Artificial
  CRISPR gRNA sequence
atgggcattcagaggtaggc

SEQ ID NO: 314557 - DNA, 20 bp, Artificial
  CRISPR gRNA sequence
tgggcattcagaggtaggca

SEQ ID NO: 314558 - DNA, 20 bp, Artificial
  CRISPR gRNA sequence
agaggtaggcaagatccctg

SEQ ID NO: 314559 - DNA, 20 bp, Artificial
  CRISPR gRNA sequence
agggtcagggaatggttcct

SEQ ID NO: 314560 - DNA, 20 bp, Artificial
  CRISPR gRNA sequence
ctaaaggaaggggtaccttg

SEQ ID NO: 314561 - DNA, 20 bp, Artificial
  CRISPR gRNA sequence
aaggaaggggtaccttgtaa

SEQ ID NO: 314562 - DNA, 20 bp, Artificial
  CRISPR gRNA sequence
gtaacatgtaaaataaatta

SEQ ID NO: 314563 - DNA, 20 bp, Artificial
  CRISPR gRNA sequence
taacatgtaaaataaattat

SEQ ID NO: 314564 - DNA, 20 bp, Artificial
  CRISPR gRNA sequence
ttggggttaataaatgtggt

SEQ ID NO: 314565 - DNA, 20 bp, Artificial
  CRISPR gRNA sequence
gggttaataaatgtggtgag

SEQ ID NO: 314566 - DNA, 20 bp, Artificial
  CRISPR gRNA sequence
ataaatgtggtgaggagggg

SEQ ID NO: 314567 - DNA, 20 bp, Artificial
  CRISPR gRNA sequence
tggatgacaggttcccaaaa

SEQ ID NO: 314568 - DNA, 20 bp, Artificial
  CRISPR gRNA sequence
gatgacaggttcccaaaact

SEQ ID NO: 314569 - DNA, 20 bp, Artificial
  CRISPR gRNA sequence
ccaaaactgtggtgacttcc

SEQ ID NO: 314570 - DNA, 20 bp, Artificial
  CRISPR gRNA sequence
tggtgacttccgtagctgaa

SEQ ID NO: 314571 - DNA, 20 bp, Artificial
  CRISPR gRNA sequence
ccgtagctgaaaaaatttga

SEQ ID NO: 314572 - DNA, 20 bp, Artificial
  CRISPR gRNA sequence
cgtagctgaaaaaatttgag

SEQ ID NO: 314573 - DNA, 20 bp, Artificial
  CRISPR gRNA sequence
aaaaaatttgagacagtatc

SEQ ID NO: 314574 - DNA, 20 bp, Artificial
  CRISPR gRNA sequence
gagacagtatctgggctaag

SEQ ID NO: 314575 - DNA, 20 bp, Artificial
  CRISPR gRNA sequence
agacagtatctgggctaagc

SEQ ID NO: 314576 - DNA, 20 bp, Artificial
  CRISPR gRNA sequence
ggctaagcaggtgagaggac

SEQ ID NO: 314577 - DNA, 20 bp, Artificial
  CRISPR gRNA sequence
agcaggtgagaggaccacag

SEQ ID NO: 314578 - DNA, 20 bp, Artificial
  CRISPR gRNA sequence
tatctgacgtaagtgcagga

SEQ ID NO: 314579 - DNA, 20 bp, Artificial
  CRISPR gRNA sequence
acgtaagtgcaggaggtatg

SEQ ID NO: 314580 - DNA, 20 bp, Artificial
  CRISPR gRNA sequence
ggaggcagaaatgcttgtgt

SEQ ID NO: 314581 - DNA, 20 bp, Artificial
  CRISPR gRNA sequence
gaggcagaaatgcttgtgtg

SEQ ID NO: 314582 - DNA, 20 bp, Artificial
  CRISPR gRNA sequence
gtgtgttcacaagtattctt

SEQ ID NO: 314583 - DNA, 20 bp, Artificial
  CRISPR gRNA sequence
tgtgttcacaagtattcttc

SEQ ID NO: 314584 - DNA, 20 bp, Artificial
  CRISPR gRNA sequence
acaagtattcttcagggaca

SEQ ID NO: 314585 - DNA, 20 bp, Artificial
  CRISPR gRNA sequence
ttcagggacaagttcagtgg

SEQ ID NO: 314586 - DNA, 20 bp, Artificial
  CRISPR gRNA sequence
cagggacaagttcagtggag

SEQ ID NO: 314587 - DNA, 20 bp, Artificial
  CRISPR gRNA sequence
agggacaagttcagtggagg

SEQ ID NO: 314588 - DNA, 20 bp, Artificial
  CRISPR gRNA sequence
agtggaggaaaggattgaaa

SEQ ID NO: 314589 - DNA, 20 bp, Artificial
  CRISPR gRNA sequence
aaactaagcagtagccacta

SEQ ID NO: 314590 - DNA, 20 bp, Artificial
  CRISPR gRNA sequence
agcagtagccactaatagga

SEQ ID NO: 314591 - DNA, 20 bp, Artificial
  CRISPR gRNA sequence
ataggagcctgacattttaa

SEQ ID NO: 314592 - DNA, 20 bp, Artificial
  CRISPR gRNA sequence
acattttaaagtcctggctt

SEQ ID NO: 314593 - DNA, 20 bp, Artificial
  CRISPR gRNA sequence
taaagtcctggctttaccca

SEQ ID NO: 314594 - DNA, 20 bp, Artificial
  CRISPR gRNA sequence
aaagtcctggctttacccag

SEQ ID NO: 314595 - DNA, 20 bp, Artificial
  CRISPR gRNA sequence
aagtcctggctttacccagg

SEQ ID NO: 314596 - DNA, 20 bp, Artificial
  CRISPR gRNA sequence
gctttacccaggagggcatg

SEQ ID NO: 314597 - DNA, 20 bp, Artificial
  CRISPR gRNA sequence
tacccaggagggcatgtgtc

SEQ ID NO: 314598 - DNA, 20 bp, Artificial
  CRISPR gRNA sequence
acccaggagggcatgtgtct

SEQ ID NO: 314599 - DNA, 20 bp, Artificial
  CRISPR gRNA sequence
cccaggagggcatgtgtcta

SEQ ID NO: 314600 - DNA, 20 bp, Artificial
  CRISPR gRNA sequence
tatttgactcctcttttaag

SEQ ID NO: 314601 - DNA, 20 bp, Artificial
  CRISPR gRNA sequence
gactcctcttttaagaagct

SEQ ID NO: 314602 - DNA, 20 bp, Artificial
  CRISPR gRNA sequence
actcctcttttaagaagctg

SEQ ID NO: 314603 - DNA, 20 bp, Artificial
  CRISPR gRNA sequence
ctcttttaagaagctgtaac

SEQ ID NO: 314604 - DNA, 20 bp, Artificial
  CRISPR gRNA sequence
ttttaagaagctgtaactgc

SEQ ID NO: 314605 - DNA, 20 bp, Artificial
  CRISPR gRNA sequence
ttaagaagctgtaactgcaa

SEQ ID NO: 314606 - DNA, 20 bp, Artificial
  CRISPR gRNA sequence
taagaagctgtaactgcaag

SEQ ID NO: 314607 - DNA, 20 bp, Artificial
  CRISPR gRNA sequence
aagaagctgtaactgcaaga

SEQ ID NO: 314608 - DNA, 20 bp, Artificial
  CRISPR gRNA sequence
agaagctgtaactgcaagat

SEQ ID NO: 314609 - DNA, 20 bp, Artificial
  CRISPR gRNA sequence
taactgcaagattccctcct

SEQ ID NO: 314610 - DNA, 20 bp, Artificial
  CRISPR gRNA sequence
caagattccctcctggaata

SEQ ID NO: 314611 - DNA, 20 bp, Artificial
  CRISPR gRNA sequence
cctcctggaataaaggtggt

SEQ ID NO: 314612 - DNA, 20 bp, Artificial
  CRISPR gRNA sequence
ctggaataaaggtggtctgc

SEQ ID NO: 314613 - DNA, 20 bp, Artificial
  CRISPR gRNA sequence
gaataaaggtggtctgcatc

SEQ ID NO: 314614 - DNA, 20 bp, Artificial
  CRISPR gRNA sequence
catctaccctgtcccatcac

SEQ ID NO: 314615 - DNA, 20 bp, Artificial
  CRISPR gRNA sequence
ccctgtcccatcactgcctg

SEQ ID NO: 314616 - DNA, 20 bp, Artificial
  CRISPR gRNA sequence
tcccatcactgcctgtgctg

SEQ ID NO: 314617 - DNA, 20 bp, Artificial
  CRISPR gRNA sequence
cctgtgctgaccttgacacc

SEQ ID NO: 314618 - DNA, 20 bp, Artificial
  CRISPR gRNA sequence
tgctgaccttgacacccaca

SEQ ID NO: 314619 - DNA, 20 bp, Artificial
  CRISPR gRNA sequence
accttgacacccacatctgc

SEQ ID NO: 314620 - DNA, 20 bp, Artificial
  CRISPR gRNA sequence
gacacccacatctgccttct

SEQ ID NO: 314621 - DNA, 20 bp, Artificial
  CRISPR gRNA sequence
acacccacatctgccttctt

SEQ ID NO: 314622 - DNA, 20 bp, Artificial
  CRISPR gRNA sequence
ccttcttcttaccttgaccc

SEQ ID NO: 314623 - DNA, 20 bp, Artificial
  CRISPR gRNA sequence
cttcttaccttgaccccttc

SEQ ID NO: 314624 - DNA, 20 bp, Artificial
  CRISPR gRNA sequence
ttcttaccttgaccccttct

SEQ ID NO: 314625 - DNA, 20 bp, Artificial
  CRISPR gRNA sequence
cttaccttgaccccttctcc

SEQ ID NO: 314626 - DNA, 20 bp, Artificial
  CRISPR gRNA sequence
ttaccttgaccccttctcca

SEQ ID NO: 314627 - DNA, 20 bp, Artificial
  CRISPR gRNA sequence
accttgaccccttctccagc

SEQ ID NO: 314628 - DNA, 20 bp, Artificial
  CRISPR gRNA sequence
ccttgaccccttctccagcg

SEQ ID NO: 314629 - DNA, 20 bp, Artificial
  CRISPR gRNA sequence
gaccccttctccagcggtga

SEQ ID NO: 314630 - DNA, 20 bp, Artificial
  CRISPR gRNA sequence
accccttctccagcggtgat

SEQ ID NO: 314631 - DNA, 20 bp, Artificial
  CRISPR gRNA sequence
ctccagcggtgatttcttgg

SEQ ID NO: 314632 - DNA, 20 bp, Artificial
  CRISPR gRNA sequence
tccagcggtgatttcttggc

SEQ ID NO: 314633 - DNA, 20 bp, Artificial
  CRISPR gRNA sequence
cagcggtgatttcttggctt

SEQ ID NO: 314634 - DNA, 20 bp, Artificial
  CRISPR gRNA sequence
cttggcttgccccctccagt

SEQ ID NO: 314635 - DNA, 20 bp, Artificial
  CRISPR gRNA sequence
ttggcttgccccctccagtg

SEQ ID NO: 314636 - DNA, 20 bp, Artificial
  CRISPR gRNA sequence
ggcttgccccctccagtgac

SEQ ID NO: 314637 - DNA, 20 bp, Artificial
  CRISPR gRNA sequence
gcttgccccctccagtgaca

SEQ ID NO: 314638 - DNA, 20 bp, Artificial
  CRISPR gRNA sequence
gccccctccagtgacatcca

SEQ ID NO: 314639 - DNA, 20 bp, Artificial
  CRISPR gRNA sequence
ccccctccagtgacatccat

SEQ ID NO: 314640 - DNA, 20 bp, Artificial
  CRISPR gRNA sequence
cagtgacatccatccaactc

SEQ ID NO: 314641 - DNA, 20 bp, Artificial
  CRISPR gRNA sequence
cttgctccataccctggctt

SEQ ID NO: 314642 - DNA, 20 bp, Artificial
  CRISPR gRNA sequence
gctccataccctggctttgt

SEQ ID NO: 314643 - DNA, 20 bp, Artificial
  CRISPR gRNA sequence
ctccataccctggctttgtc

SEQ ID NO: 314644 - DNA, 20 bp, Artificial
  CRISPR gRNA sequence
cataccctggctttgtcacc

SEQ ID NO: 314645 - DNA, 20 bp, Artificial
  CRISPR gRNA sequence
gctttgtcacctcctttctc

SEQ ID NO: 314646 - DNA, 20 bp, Artificial
  CRISPR gRNA sequence
tgtcacctcctttctcccag

SEQ ID NO: 314647 - DNA, 20 bp, Artificial
  CRISPR gRNA sequence
gtcacctcctttctcccagt

SEQ ID NO: 314648 - DNA, 20 bp, Artificial
  CRISPR gRNA sequence
tcacctcctttctcccagtg

SEQ ID NO: 314649 - DNA, 20 bp, Artificial
  CRISPR gRNA sequence
ctttctcccagtgtcttgtt

SEQ ID NO: 314650 - DNA, 20 bp, Artificial
  CRISPR gRNA sequence
tctcccagtgtcttgttgtt

SEQ ID NO: 314651 - DNA, 20 bp, Artificial
  CRISPR gRNA sequence
ctcccagtgtcttgttgttc

SEQ ID NO: 314652 - DNA, 20 bp, Artificial
  CRISPR gRNA sequence
tcccagtgtcttgttgttca

SEQ ID NO: 314653 - DNA, 20 bp, Artificial
  CRISPR gRNA sequence
ccagtgtcttgttgttcaga

SEQ ID NO: 314654 - DNA, 20 bp, Artificial
  CRISPR gRNA sequence
gttgttcagatataacttgg

SEQ ID NO: 314655 - DNA, 20 bp, Artificial
  CRISPR gRNA sequence
ttgttcagatataacttggt

SEQ ID NO: 314656 - DNA, 20 bp, Artificial
  CRISPR gRNA sequence
ttcagatataacttggtctg

SEQ ID NO: 314657 - DNA, 20 bp, Artificial
  CRISPR gRNA sequence
agatataacttggtctgtga

SEQ ID NO: 314658 - DNA, 20 bp, Artificial
  CRISPR gRNA sequence
ggtctgtgaacagcccacgg

SEQ ID NO: 314659 - DNA, 20 bp, Artificial
  CRISPR gRNA sequence
gtctgtgaacagcccacggg

SEQ ID NO: 314660 - DNA, 20 bp, Artificial
  CRISPR gRNA sequence
tgaacagcccacggggccag

SEQ ID NO: 314661 - DNA, 20 bp, Artificial
  CRISPR gRNA sequence
tacaactgggccaatctcat

SEQ ID NO: 314662 - DNA, 20 bp, Artificial
  CRISPR gRNA sequence
acaactgggccaatctcatc

SEQ ID NO: 314663 - DNA, 20 bp, Artificial
  CRISPR gRNA sequence
caactgggccaatctcatct

SEQ ID NO: 314664 - DNA, 20 bp, Artificial
  CRISPR gRNA sequence
ggccaatctcatctcctgct

SEQ ID NO: 314665 - DNA, 20 bp, Artificial
  CRISPR gRNA sequence
atctcctgctactgacttct

SEQ ID NO: 314666 - DNA, 20 bp, Artificial
  CRISPR gRNA sequence
ctgctactgacttcttccta

SEQ ID NO: 314667 - DNA, 20 bp, Artificial
  CRISPR gRNA sequence
ctactgacttcttcctattc

SEQ ID NO: 314668 - DNA, 20 bp, Artificial
  CRISPR gRNA sequence
ctgacttcttcctattcaga

SEQ ID NO: 314669 - DNA, 20 bp, Artificial
  CRISPR gRNA sequence
acttcttcctattcagacac

SEQ ID NO: 314670 - DNA, 20 bp, Artificial
  CRISPR gRNA sequence
cttcctattcagacacttca

SEQ ID NO: 314671 - DNA, 20 bp, Artificial
  CRISPR gRNA sequence
ttcctattcagacacttcag

SEQ ID NO: 314672 - DNA, 20 bp, Artificial
  CRISPR gRNA sequence
cctattcagacacttcagcc

SEQ ID NO: 314673 - DNA, 20 bp, Artificial
  CRISPR gRNA sequence
ctattcagacacttcagcct

SEQ ID NO: 314674 - DNA, 20 bp, Artificial
  CRISPR gRNA sequence
ttcagacacttcagcctctg

SEQ ID NO: 314675 - DNA, 20 bp, Artificial
  CRISPR gRNA sequence
agacacttcagcctctgaga

SEQ ID NO: 314676 - DNA, 20 bp, Artificial
  CRISPR gRNA sequence
cagcctctgagaatccagta

SEQ ID NO: 314677 - DNA, 20 bp, Artificial
  CRISPR gRNA sequence
agcctctgagaatccagtaa

SEQ ID NO: 314678 - DNA, 20 bp, Artificial
  CRISPR gRNA sequence
tgagaatccagtaaatggtg

SEQ ID NO: 314679 - DNA, 20 bp, Artificial
  CRISPR gRNA sequence
agaatccagtaaatggtgga

SEQ ID NO: 314680 - DNA, 20 bp, Artificial
  CRISPR gRNA sequence
gtcctgtcccagttgcttct

SEQ ID NO: 314681 - DNA, 20 bp, Artificial
  CRISPR gRNA sequence
tcccagttgcttctcctgta

SEQ ID NO: 314682 - DNA, 20 bp, Artificial
  CRISPR gRNA sequence
cttctcctgtatcctctctt

SEQ ID NO: 314683 - DNA, 20 bp, Artificial
  CRISPR gRNA sequence
ctcctgtatcctctcttggc

SEQ ID NO: 314684 - DNA, 20 bp, Artificial
  CRISPR gRNA sequence
tcctgtatcctctcttggcc

SEQ ID NO: 314685 - DNA, 20 bp, Artificial
  CRISPR gRNA sequence
ctgtatcctctcttggccag

SEQ ID NO: 314686 - DNA, 20 bp, Artificial
  CRISPR gRNA sequence
tatcctctcttggccagata

SEQ ID NO: 314687 - DNA, 20 bp, Artificial
  CRISPR gRNA sequence
tcttggccagatagaagcct

SEQ ID NO: 314688 - DNA, 20 bp, Artificial
  CRISPR gRNA sequence
ttggccagatagaagcctct

SEQ ID NO: 314689 - DNA, 20 bp, Artificial
  CRISPR gRNA sequence
ggccagatagaagcctctcc

SEQ ID NO: 314690 - DNA, 20 bp, Artificial
  CRISPR gRNA sequence
gccagatagaagcctctcca

SEQ ID NO: 314691 - DNA, 20 bp, Artificial
  CRISPR gRNA sequence
tccaagctatgcctgaagtt

SEQ ID NO: 314692 - DNA, 20 bp, Artificial
  CRISPR gRNA sequence
caagctatgcctgaagttca

SEQ ID NO: 314693 - DNA, 20 bp, Artificial
  CRISPR gRNA sequence
tgcctgaagttcagtacctc

SEQ ID NO: 314694 - DNA, 20 bp, Artificial
  CRISPR gRNA sequence
aagttcagtacctccttcaa

SEQ ID NO: 314695 - DNA, 20 bp, Artificial
  CRISPR gRNA sequence
agtacctccttcaatgtgta

SEQ ID NO: 314696 - DNA, 20 bp, Artificial
  CRISPR gRNA sequence
cttcaatgtgtaattagttt

SEQ ID NO: 314697 - DNA, 20 bp, Artificial
  CRISPR gRNA sequence
caatgtgtaattagtttgat

SEQ ID NO: 314698 - DNA, 20 bp, Artificial
  CRISPR gRNA sequence
aatgtgtaattagtttgatt

SEQ ID NO: 314699 - DNA, 20 bp, Artificial
  CRISPR gRNA sequence
gtttgattggtggccacaag

SEQ ID NO: 314700 - DNA, 20 bp, Artificial
  CRISPR gRNA sequence
gattggtggccacaagatgg

SEQ ID NO: 314701 - DNA, 20 bp, Artificial
  CRISPR gRNA sequence
attggtggccacaagatggc

SEQ ID NO: 314702 - DNA, 20 bp, Artificial
  CRISPR gRNA sequence
gtggccacaagatggccata

SEQ ID NO: 314703 - DNA, 20 bp, Artificial
  CRISPR gRNA sequence
tgttacggctcccatagtct

SEQ ID NO: 314704 - DNA, 20 bp, Artificial
  CRISPR gRNA sequence
ttacggctcccatagtctac

SEQ ID NO: 314705 - DNA, 20 bp, Artificial
  CRISPR gRNA sequence
cggctcccatagtctacaaa

SEQ ID NO: 314706 - DNA, 20 bp, Artificial
  CRISPR gRNA sequence
ccatagtctacaaattaaca

SEQ ID NO: 314707 - DNA, 20 bp, Artificial
  CRISPR gRNA sequence
caaattaacaggggcttgcc

SEQ ID NO: 314708 - DNA, 20 bp, Artificial
  CRISPR gRNA sequence
acaggggcttgccaccacta

SEQ ID NO: 314709 - DNA, 20 bp, Artificial
  CRISPR gRNA sequence
gccaccactataacctcatc

SEQ ID NO: 314710 - DNA, 20 bp, Artificial
  CRISPR gRNA sequence
ccaccactataacctcatca

SEQ ID NO: 314711 - DNA, 20 bp, Artificial
  CRISPR gRNA sequence
taacctcatcatggctcacc

SEQ ID NO: 314712 - DNA, 20 bp, Artificial
  CRISPR gRNA sequence
atcatggctcaccttcctgc

SEQ ID NO: 314713 - DNA, 20 bp, Artificial
  CRISPR gRNA sequence
accttcctgctgcttctcaa

SEQ ID NO: 314714 - DNA, 20 bp, Artificial
  CRISPR gRNA sequence
cctgctgcttctcaactact

SEQ ID NO: 314715 - DNA, 20 bp, Artificial
  CRISPR gRNA sequence
ctgctgcttctcaactactg

SEQ ID NO: 314716 - DNA, 20 bp, Artificial
  CRISPR gRNA sequence
ctgcttctcaactactgttc

SEQ ID NO: 314717 - DNA, 20 bp, Artificial
  CRISPR gRNA sequence
cttctcaactactgttctgc

SEQ ID NO: 314718 - DNA, 20 bp, Artificial
  CRISPR gRNA sequence
ctcaactactgttctgccaa

SEQ ID NO: 314719 - DNA, 20 bp, Artificial
  CRISPR gRNA sequence
tcaactactgttctgccaaa

SEQ ID NO: 314720 - DNA, 20 bp, Artificial
  CRISPR gRNA sequence
aactactgttctgccaaact

SEQ ID NO: 314721 - DNA, 20 bp, Artificial
  CRISPR gRNA sequence
ctgttctgccaaacttcaac

SEQ ID NO: 314722 - DNA, 20 bp, Artificial
  CRISPR gRNA sequence
ttctgccaaacttcaacagg

SEQ ID NO: 314723 - DNA, 20 bp, Artificial
  CRISPR gRNA sequence
tgccaaacttcaacaggtac

SEQ ID NO: 314724 - DNA, 20 bp, Artificial
  CRISPR gRNA sequence
ccaaacttcaacaggtaccc

SEQ ID NO: 314725 - DNA, 20 bp, Artificial
  CRISPR gRNA sequence
caacaggtacccccatcttc

SEQ ID NO: 314726 - DNA, 20 bp, Artificial
  CRISPR gRNA sequence
aacaggtacccccatcttca

SEQ ID NO: 314727 - DNA, 20 bp, Artificial
  CRISPR gRNA sequence
cagaaatgtttcagctctag

SEQ ID NO: 314728 - DNA, 20 bp, Artificial
  CRISPR gRNA sequence
agaaatgtttcagctctagc

SEQ ID NO: 314729 - DNA, 20 bp, Artificial
  CRISPR gRNA sequence
cagctctagctgcctcagga

SEQ ID NO: 314730 - DNA, 20 bp, Artificial
  CRISPR gRNA sequence
agctctagctgcctcaggaa

SEQ ID NO: 314731 - DNA, 20 bp, Artificial
  CRISPR gRNA sequence
tagctgcctcaggaagatgg

SEQ ID NO: 314732 - DNA, 20 bp, Artificial
  CRISPR gRNA sequence
gctgcctcaggaagatgggg

SEQ ID NO: 314733 - DNA, 20 bp, Artificial
  CRISPR gRNA sequence
cctcaggaagatggggcttg

SEQ ID NO: 314734 - DNA, 20 bp, Artificial
  CRISPR gRNA sequence
aggaagatggggcttgcctc

SEQ ID NO: 314735 - DNA, 20 bp, Artificial
  CRISPR gRNA sequence
gcctctctgggtttcccatt

SEQ ID NO: 314736 - DNA, 20 bp, Artificial
  CRISPR gRNA sequence
cctctctgggtttcccattc

SEQ ID NO: 314737 - DNA, 20 bp, Artificial
  CRISPR gRNA sequence
tctgggtttcccattctatc

SEQ ID NO: 314738 - DNA, 20 bp, Artificial
  CRISPR gRNA sequence
tgggtttcccattctatcgc

SEQ ID NO: 314739 - DNA, 20 bp, Artificial
  CRISPR gRNA sequence
ggtttcccattctatcgctt

SEQ ID NO: 314740 - DNA, 20 bp, Artificial
  CRISPR gRNA sequence
cccattctatcgcttgatca

SEQ ID NO: 314741 - DNA, 20 bp, Artificial
  CRISPR gRNA sequence
ccattctatcgcttgatcag

SEQ ID NO: 314742 - DNA, 20 bp, Artificial
  CRISPR gRNA sequence
tatcgcttgatcagagatag

SEQ ID NO: 314743 - DNA, 20 bp, Artificial
  CRISPR gRNA sequence
tcgcttgatcagagataggt

SEQ ID NO: 314744 - DNA, 20 bp, Artificial
  CRISPR gRNA sequence
gatcagagataggttagacc

SEQ ID NO: 314745 - DNA, 20 bp, Artificial
  CRISPR gRNA sequence
atcagagataggttagaccc

SEQ ID NO: 314746 - DNA, 20 bp, Artificial
  CRISPR gRNA sequence
gaccctgagtcaaggggcct

SEQ ID NO: 314747 - DNA, 20 bp, Artificial
  CRISPR gRNA sequence
agtcaaggggccttttttgc

SEQ ID NO: 314748 - DNA, 20 bp, Artificial
  CRISPR gRNA sequence
ttttgcatgttaaaaggtag

SEQ ID NO: 314749 - DNA, 20 bp, Artificial
  CRISPR gRNA sequence
tttgcatgttaaaaggtagc

SEQ ID NO: 314750 - DNA, 20 bp, Artificial
  CRISPR gRNA sequence
ttgcatgttaaaaggtagca

SEQ ID NO: 314751 - DNA, 20 bp, Artificial
  CRISPR gRNA sequence
tgcatgttaaaaggtagcag

SEQ ID NO: 314752 - DNA, 20 bp, Artificial
  CRISPR gRNA sequence
gcatgttaaaaggtagcagc

SEQ ID NO: 314753 - DNA, 20 bp, Artificial
  CRISPR gRNA sequence
catgttaaaaggtagcagcc

SEQ ID NO: 314754 - DNA, 20 bp, Artificial
  CRISPR gRNA sequence
aaaggtagcagcctccacgt

SEQ ID NO: 314755 - DNA, 20 bp, Artificial
  CRISPR gRNA sequence
cacgttagtaagtataaccc

SEQ ID NO: 314756 - DNA, 20 bp, Artificial
  CRISPR gRNA sequence
gtaagtataacccctaaccc

SEQ ID NO: 314757 - DNA, 20 bp, Artificial
  CRISPR gRNA sequence
accccctttactgggagtgc

SEQ ID NO: 314758 - DNA, 20 bp, Artificial
  CRISPR gRNA sequence
tactgggagtgccaaactgg

SEQ ID NO: 314759 - DNA, 20 bp, Artificial
  CRISPR gRNA sequence
actgggagtgccaaactggc

SEQ ID NO: 314760 - DNA, 20 bp, Artificial
  CRISPR gRNA sequence
ctgggagtgccaaactggct

SEQ ID NO: 314761 - DNA, 20 bp, Artificial
  CRISPR gRNA sequence
ggagtgccaaactggctcaa

SEQ ID NO: 314762 - DNA, 20 bp, Artificial
  CRISPR gRNA sequence
gctcaagtggaatagactgg

SEQ ID NO: 314763 - DNA, 20 bp, Artificial
  CRISPR gRNA sequence
aagtggaatagactgggaca

SEQ ID NO: 314764 - DNA, 20 bp, Artificial
  CRISPR gRNA sequence
ggacagactcaaaagggatt

SEQ ID NO: 314765 - DNA, 20 bp, Artificial
  CRISPR gRNA sequence
aaaagggattaaatatggcc

SEQ ID NO: 314766 - DNA, 20 bp, Artificial
  CRISPR gRNA sequence
aatatggcctgcaatgccaa

SEQ ID NO: 314767 - DNA, 20 bp, Artificial
  CRISPR gRNA sequence
caatgccaacaacttcttaa

SEQ ID NO: 314768 - DNA, 20 bp, Artificial
  CRISPR gRNA sequence
cttaacatcccagaaacagg

SEQ ID NO: 314769 - DNA, 20 bp, Artificial
  CRISPR gRNA sequence
ttaacatcccagaaacaggg

SEQ ID NO: 314770 - DNA, 20 bp, Artificial
  CRISPR gRNA sequence
aacatcccagaaacagggca

SEQ ID NO: 314771 - DNA, 20 bp, Artificial
  CRISPR gRNA sequence
acatcccagaaacagggcat

SEQ ID NO: 314772 - DNA, 20 bp, Artificial
  CRISPR gRNA sequence
caaattatagctaagctaat

SEQ ID NO: 314773 - DNA, 20 bp, Artificial
  CRISPR gRNA sequence
tagctaagctaatagatcag

SEQ ID NO: 314774 - DNA, 20 bp, Artificial
  CRISPR gRNA sequence
agctaatagatcagctggtc

SEQ ID NO: 314775 - DNA, 20 bp, Artificial
  CRISPR gRNA sequence
atagatcagctggtcctaat

SEQ ID NO: 314776 - DNA, 20 bp, Artificial
  CRISPR gRNA sequence
gtcctaattttcctgaaatt

SEQ ID NO: 314777 - DNA, 20 bp, Artificial
  CRISPR gRNA sequence
attttcctgaaatttgggat

SEQ ID NO: 314778 - DNA, 20 bp, Artificial
  CRISPR gRNA sequence
tcctgaaatttgggattagc

SEQ ID NO: 314779 - DNA, 20 bp, Artificial
  CRISPR gRNA sequence
cctgaaatttgggattagct

SEQ ID NO: 314780 - DNA, 20 bp, Artificial
  CRISPR gRNA sequence
ctgaaatttgggattagcta

SEQ ID NO: 314781 - DNA, 20 bp, Artificial
  CRISPR gRNA sequence
aaatttgggattagctacca

SEQ ID NO: 314782 - DNA, 20 bp, Artificial
  CRISPR gRNA sequence
gggattagctaccagaactg

SEQ ID NO: 314783 - DNA, 20 bp, Artificial
  CRISPR gRNA sequence
ggattagctaccagaactgt

SEQ ID NO: 314784 - DNA, 20 bp, Artificial
  CRISPR gRNA sequence
gctaccagaactgttcccaa

SEQ ID NO: 314785 - DNA, 20 bp, Artificial
  CRISPR gRNA sequence
ccagaactgttcccaaaaat

SEQ ID NO: 314786 - DNA, 20 bp, Artificial
  CRISPR gRNA sequence
ttcccaaaaatgtctttaaa

SEQ ID NO: 314787 - DNA, 20 bp, Artificial
  CRISPR gRNA sequence
ccaaaaatgtctttaaagtg

SEQ ID NO: 314788 - DNA, 20 bp, Artificial
  CRISPR gRNA sequence
taaagtgggcgactccgttc

SEQ ID NO: 314789 - DNA, 20 bp, Artificial
  CRISPR gRNA sequence
aaagtgggcgactccgttct

SEQ ID NO: 314790 - DNA, 20 bp, Artificial
  CRISPR gRNA sequence
aagtgggcgactccgttcta

SEQ ID NO: 314791 - DNA, 20 bp, Artificial
  CRISPR gRNA sequence
cgttctaagttttccccaca

SEQ ID NO: 314792 - DNA, 20 bp, Artificial
  CRISPR gRNA sequence
taagttttccccacaaagcc

SEQ ID NO: 314793 - DNA, 20 bp, Artificial
  CRISPR gRNA sequence
agttttccccacaaagcctg

SEQ ID NO: 314794 - DNA, 20 bp, Artificial
  CRISPR gRNA sequence
tccccacaaagcctgttttc

SEQ ID NO: 314795 - DNA, 20 bp, Artificial
  CRISPR gRNA sequence
ccccacaaagcctgttttcc

SEQ ID NO: 314796 - DNA, 20 bp, Artificial
  CRISPR gRNA sequence
cccacaaagcctgttttcca

SEQ ID NO: 314797 - DNA, 20 bp, Artificial
  CRISPR gRNA sequence
ttttccaactccccagaaac

SEQ ID NO: 314798 - DNA, 20 bp, Artificial
  CRISPR gRNA sequence
tccaactccccagaaactta

SEQ ID NO: 314799 - DNA, 20 bp, Artificial
  CRISPR gRNA sequence
ccaactccccagaaacttag

SEQ ID NO: 314800 - DNA, 20 bp, Artificial
  CRISPR gRNA sequence
caactccccagaaacttagg

SEQ ID NO: 314801 - DNA, 20 bp, Artificial
  CRISPR gRNA sequence
cccagaaacttaggagttct

SEQ ID NO: 314802 - DNA, 20 bp, Artificial
  CRISPR gRNA sequence
aggagttctcatgtaaggaa

SEQ ID NO: 314803 - DNA, 20 bp, Artificial
  CRISPR gRNA sequence
ggagttctcatgtaaggaag

SEQ ID NO: 314804 - DNA, 20 bp, Artificial
  CRISPR gRNA sequence
tcatgtaaggaagtagttcc

SEQ ID NO: 314805 - DNA, 20 bp, Artificial
  CRISPR gRNA sequence
atgtaaggaagtagttcctg

SEQ ID NO: 314806 - DNA, 20 bp, Artificial
  CRISPR gRNA sequence
ctgaaggcgtgaaggttcct

SEQ ID NO: 314807 - DNA, 20 bp, Artificial
  CRISPR gRNA sequence
aaggcgtgaaggttcctcaa

SEQ ID NO: 314808 - DNA, 20 bp, Artificial
  CRISPR gRNA sequence
ctcaaggcatgaagaaacat

SEQ ID NO: 314809 - DNA, 20 bp, Artificial
  CRISPR gRNA sequence
aaggcatgaagaaacatcaa

SEQ ID NO: 314810 - DNA, 20 bp, Artificial
  CRISPR gRNA sequence
ttcagtagatgagatatgct

SEQ ID NO: 314811 - DNA, 20 bp, Artificial
  CRISPR gRNA sequence
tcagtagatgagatatgctg

SEQ ID NO: 314812 - DNA, 20 bp, Artificial
  CRISPR gRNA sequence
cagtagatgagatatgctga

SEQ ID NO: 314813 - DNA, 20 bp, Artificial
  CRISPR gRNA sequence
agtagatgagatatgctgaa

SEQ ID NO: 314814 - DNA, 20 bp, Artificial
  CRISPR gRNA sequence
aaagccatgcagaggaaacc

SEQ ID NO: 314815 - DNA, 20 bp, Artificial
  CRISPR gRNA sequence
ctgtgacctcagtaggaaaa

SEQ ID NO: 314816 - DNA, 20 bp, Artificial
  CRISPR gRNA sequence
tgacctcagtaggaaaaaac

SEQ ID NO: 314817 - DNA, 20 bp, Artificial
  CRISPR gRNA sequence
agtaggaaaaaactaaacaa

SEQ ID NO: 314818 - DNA, 20 bp, Artificial
  CRISPR gRNA sequence
aacaaacaagcaaatgaaaa

SEQ ID NO: 314819 - DNA, 20 bp, Artificial
  CRISPR gRNA sequence
gaggtaggggcctgtggaag

SEQ ID NO: 314820 - DNA, 20 bp, Artificial
  CRISPR gRNA sequence
tggaagctgttccatttgtc

SEQ ID NO: 314821 - DNA, 20 bp, Artificial
  CRISPR gRNA sequence
ttccatttgtccaagtgaga

SEQ ID NO: 314822 - DNA, 20 bp, Artificial
  CRISPR gRNA sequence
catttgtccaagtgagaggt

SEQ ID NO: 314823 - DNA, 20 bp, Artificial
  CRISPR gRNA sequence
gtccaagtgagaggtgtctg

SEQ ID NO: 314824 - DNA, 20 bp, Artificial
  CRISPR gRNA sequence
tccaagtgagaggtgtctgg

SEQ ID NO: 314825 - DNA, 20 bp, Artificial
  CRISPR gRNA sequence
gagattatagtggacagaag

SEQ ID NO: 314826 - DNA, 20 bp, Artificial
  CRISPR gRNA sequence
tagtggacagaagaatcatc

SEQ ID NO: 314827 - DNA, 20 bp, Artificial
  CRISPR gRNA sequence
cagggcctgggaactgactg

SEQ ID NO: 314828 - DNA, 20 bp, Artificial
  CRISPR gRNA sequence
agggcctgggaactgactgc

SEQ ID NO: 314829 - DNA, 20 bp, Artificial
  CRISPR gRNA sequence
ggaactgactgcagaggggg

SEQ ID NO: 314830 - DNA, 20 bp, Artificial
  CRISPR gRNA sequence
actgcagaggggggcaggat

SEQ ID NO: 314831 - DNA, 20 bp, Artificial
  CRISPR gRNA sequence
cagaggggggcaggatagca

SEQ ID NO: 314832 - DNA, 20 bp, Artificial
  CRISPR gRNA sequence
cacgtgcagagcctcagcac

SEQ ID NO: 314833 - DNA, 20 bp, Artificial
  CRISPR gRNA sequence
agcacagacacctcacccag

SEQ ID NO: 314834 - DNA, 20 bp, Artificial
  CRISPR gRNA sequence
acccagattccagaatcacg

SEQ ID NO: 314835 - DNA, 20 bp, Artificial
  CRISPR gRNA sequence
cagaatcacgggccaggctg

SEQ ID NO: 314836 - DNA, 20 bp, Artificial
  CRISPR gRNA sequence
accctcttcttcctgatcat

SEQ ID NO: 314837 - DNA, 20 bp, Artificial
  CRISPR gRNA sequence
ttcttcctgatcatggtcgg

SEQ ID NO: 314838 - DNA, 20 bp, Artificial
  CRISPR gRNA sequence
cttcctgatcatggtcggtg

SEQ ID NO: 314839 - DNA, 20 bp, Artificial
  CRISPR gRNA sequence
ttcctgatcatggtcggtgt

SEQ ID NO: 314840 - DNA, 20 bp, Artificial
  CRISPR gRNA sequence
cctgatcatggtcggtgtta

SEQ ID NO: 314841 - DNA, 20 bp, Artificial
  CRISPR gRNA sequence
ctgatcatggtcggtgttat

SEQ ID NO: 314842 - DNA, 20 bp, Artificial
  CRISPR gRNA sequence
atcatggtcggtgttatccc

SEQ ID NO: 314843 - DNA, 20 bp, Artificial
  CRISPR gRNA sequence
tccccacctccatgaaggca

SEQ ID NO: 314844 - DNA, 20 bp, Artificial
  CRISPR gRNA sequence
catgaaggcatggcagctca

SEQ ID NO: 314845 - DNA, 20 bp, Artificial
  CRISPR gRNA sequence
agtccaggcatttggccaga

SEQ ID NO: 314846 - DNA, 20 bp, Artificial
  CRISPR gRNA sequence
ggccagaggcatgggctcga

SEQ ID NO: 314847 - DNA, 20 bp, Artificial
  CRISPR gRNA sequence
gccagaggcatgggctcgat

SEQ ID NO: 314848 - DNA, 20 bp, Artificial
  CRISPR gRNA sequence
gattcttaggtcgctgctga

SEQ ID NO: 314849 - DNA, 20 bp, Artificial
  CRISPR gRNA sequence
ttaggtcgctgctgaggccc

SEQ ID NO: 314850 - DNA, 20 bp, Artificial
  CRISPR gRNA sequence
aggtcgctgctgaggccctg

SEQ ID NO: 314851 - DNA, 20 bp, Artificial
  CRISPR gRNA sequence
ggtcgctgctgaggccctga

SEQ ID NO: 314852 - DNA, 20 bp, Artificial
  CRISPR gRNA sequence
ctgaggccctgagcctggga

SEQ ID NO: 314853 - DNA, 20 bp, Artificial
  CRISPR gRNA sequence
aggccctgagcctgggactt

SEQ ID NO: 314854 - DNA, 20 bp, Artificial
  CRISPR gRNA sequence
agcctgggactttctatggc

SEQ ID NO: 314855 - DNA, 20 bp, Artificial
  CRISPR gRNA sequence
ggactttctatggcctccta

SEQ ID NO: 314856 - DNA, 20 bp, Artificial
  CRISPR gRNA sequence
tctatggcctcctattgtgg

SEQ ID NO: 314857 - DNA, 20 bp, Artificial
  CRISPR gRNA sequence
ctatggcctcctattgtgga

SEQ ID NO: 314858 - DNA, 20 bp, Artificial
  CRISPR gRNA sequence
tatggcctcctattgtggat

SEQ ID NO: 314859 - DNA, 20 bp, Artificial
  CRISPR gRNA sequence
tggcctcctattgtggattt

SEQ ID NO: 314860 - DNA, 20 bp, Artificial
  CRISPR gRNA sequence
ctattgtggatttcaggctt

SEQ ID NO: 314861 - DNA, 20 bp, Artificial
  CRISPR gRNA sequence
ttgtggatttcaggcttctc

SEQ ID NO: 314862 - DNA, 20 bp, Artificial
  CRISPR gRNA sequence
tggatttcaggcttctctgg

SEQ ID NO: 314863 - DNA, 20 bp, Artificial
  CRISPR gRNA sequence
caggcttctctggccttaga

SEQ ID NO: 314864 - DNA, 20 bp, Artificial
  CRISPR gRNA sequence
aggcttctctggccttagag

SEQ ID NO: 314865 - DNA, 20 bp, Artificial
  CRISPR gRNA sequence
ctctggccttagagccctgg

SEQ ID NO: 314866 - DNA, 20 bp, Artificial
  CRISPR gRNA sequence
tctggccttagagccctggg

SEQ ID NO: 314867 - DNA, 20 bp, Artificial
  CRISPR gRNA sequence
tggccttagagccctgggga

SEQ ID NO: 314868 - DNA, 20 bp, Artificial
  CRISPR gRNA sequence
gccttagagccctggggaga

SEQ ID NO: 314869 - DNA, 20 bp, Artificial
  CRISPR gRNA sequence
agagccctggggagaggctg

SEQ ID NO: 314870 - DNA, 20 bp, Artificial
  CRISPR gRNA sequence
gagccctggggagaggctgg

SEQ ID NO: 314871 - DNA, 20 bp, Artificial
  CRISPR gRNA sequence
gggagaggctggcaggtaaa

SEQ ID NO: 314872 - DNA, 20 bp, Artificial
  CRISPR gRNA sequence
gcaggtaaataaagagaaga

SEQ ID NO: 314873 - DNA, 20 bp, Artificial
  CRISPR gRNA sequence
gcagaaaccttttgtaaatg

SEQ ID NO: 314874 - DNA, 20 bp, Artificial
  CRISPR gRNA sequence
ttgtaaatgactctcctggc

SEQ ID NO: 314875 - DNA, 20 bp, Artificial
  CRISPR gRNA sequence
tgtaaatgactctcctggct

SEQ ID NO: 314876 - DNA, 20 bp, Artificial
  CRISPR gRNA sequence
gtaaatgactctcctggctg

SEQ ID NO: 314877 - DNA, 20 bp, Artificial
  CRISPR gRNA sequence
taaatgactctcctggctga

SEQ ID NO: 314878 - DNA, 20 bp, Artificial
  CRISPR gRNA sequence
tcctggctgattgaaaattt

SEQ ID NO: 314879 - DNA, 20 bp, Artificial
  CRISPR gRNA sequence
ctggctgattgaaaatttgt

SEQ ID NO: 314880 - DNA, 20 bp, Artificial
  CRISPR gRNA sequence
gctgattgaaaatttgtggt

SEQ ID NO: 314881 - DNA, 20 bp, Artificial
  CRISPR gRNA sequence
attgaaaatttgtggtcatt

SEQ ID NO: 314882 - DNA, 20 bp, Artificial
  CRISPR gRNA sequence
aaaatttgtggtcatttgta

SEQ ID NO: 314883 - DNA, 20 bp, Artificial
  CRISPR gRNA sequence
gtggtcatttgtagagcttg

SEQ ID NO: 314884 - DNA, 20 bp, Artificial
  CRISPR gRNA sequence
tggtcatttgtagagcttga

SEQ ID NO: 314885 - DNA, 20 bp, Artificial
  CRISPR gRNA sequence
gtagagcttgaggaccctca

SEQ ID NO: 314886 - DNA, 20 bp, Artificial
  CRISPR gRNA sequence
tagagcttgaggaccctcag

SEQ ID NO: 314887 - DNA, 20 bp, Artificial
  CRISPR gRNA sequence
gaggaccctcagcctccccc

SEQ ID NO: 314888 - DNA, 20 bp, Artificial
  CRISPR gRNA sequence
aggaccctcagcctccccca

SEQ ID NO: 314889 - DNA, 20 bp, Artificial
  CRISPR gRNA sequence
agcctcccccagaccacatt

SEQ ID NO: 314890 - DNA, 20 bp, Artificial
  CRISPR gRNA sequence
ccccagaccacattccttgg

SEQ ID NO: 314891 - DNA, 20 bp, Artificial
  CRISPR gRNA sequence
cttggattacagctgtactt

SEQ ID NO: 314892 - DNA, 20 bp, Artificial
  CRISPR gRNA sequence
ggattacagctgtacttcca

SEQ ID NO: 314893 - DNA, 20 bp, Artificial
  CRISPR gRNA sequence
gattacagctgtacttccaa

SEQ ID NO: 314894 - DNA, 20 bp, Artificial
  CRISPR gRNA sequence
cagctgtacttccaacagtt

SEQ ID NO: 314895 - DNA, 20 bp, Artificial
  CRISPR gRNA sequence
tacttccaacagttattata

SEQ ID NO: 314896 - DNA, 20 bp, Artificial
  CRISPR gRNA sequence
ccaacagttattatatgtgt

SEQ ID NO: 314897 - DNA, 20 bp, Artificial
  CRISPR gRNA sequence
caacagttattatatgtgtg

SEQ ID NO: 314898 - DNA, 20 bp, Artificial
  CRISPR gRNA sequence
ttatatgtgtgatggttttc

SEQ ID NO: 314899 - DNA, 20 bp, Artificial
  CRISPR gRNA sequence
tatgtgtgatggttttctgt

SEQ ID NO: 314900 - DNA, 20 bp, Artificial
  CRISPR gRNA sequence
tctgtctaattctatggaaa

SEQ ID NO: 314901 - DNA, 20 bp, Artificial
  CRISPR gRNA sequence
ctgtctaattctatggaaat

SEQ ID NO: 314902 - DNA, 20 bp, Artificial
  CRISPR gRNA sequence
tgtctaattctatggaaatg

SEQ ID NO: 314903 - DNA, 20 bp, Artificial
  CRISPR gRNA sequence
tctaattctatggaaatgga

SEQ ID NO: 314904 - DNA, 20 bp, Artificial
  CRISPR gRNA sequence
attctatggaaatggaagaa

SEQ ID NO: 314905 - DNA, 20 bp, Artificial
  CRISPR gRNA sequence
tatggaaatggaagaagaag

SEQ ID NO: 314906 - DNA, 20 bp, Artificial
  CRISPR gRNA sequence
tggaaatggaagaagaagaa

SEQ ID NO: 314907 - DNA, 20 bp, Artificial
  CRISPR gRNA sequence
gcaactcttataaatgtggt

SEQ ID NO: 314908 - DNA, 20 bp, Artificial
  CRISPR gRNA sequence
ttataaatgtggtgagtgag

SEQ ID NO: 314909 - DNA, 20 bp, Artificial
  CRISPR gRNA sequence
ataaatgtggtgagtgagtc

SEQ ID NO: 314910 - DNA, 20 bp, Artificial
  CRISPR gRNA sequence
taaatgtggtgagtgagtcc

SEQ ID NO: 314911 - DNA, 20 bp, Artificial
  CRISPR gRNA sequence
gtcctccccacagactgtca

SEQ ID NO: 314912 - DNA, 20 bp, Artificial
  CRISPR gRNA sequence
tcctccccacagactgtcac

SEQ ID NO: 314913 - DNA, 20 bp, Artificial
  CRISPR gRNA sequence
cccacagactgtcactttgc

SEQ ID NO: 314914 - DNA, 20 bp, Artificial
  CRISPR gRNA sequence
tcactttgcacctacttccc

SEQ ID NO: 314915 - DNA, 20 bp, Artificial
  CRISPR gRNA sequence
tgcacctacttcccaatcgg

SEQ ID NO: 314916 - DNA, 20 bp, Artificial
  CRISPR gRNA sequence
gcacctacttcccaatcggc

SEQ ID NO: 314917 - DNA, 20 bp, Artificial
  CRISPR gRNA sequence
cacctacttcccaatcggct

SEQ ID NO: 314918 - DNA, 20 bp, Artificial
  CRISPR gRNA sequence
cttcccaatcggctggctgc

SEQ ID NO: 314919 - DNA, 20 bp, Artificial
  CRISPR gRNA sequence
cccaatcggctggctgcctt

SEQ ID NO: 314920 - DNA, 20 bp, Artificial
  CRISPR gRNA sequence
ccaatcggctggctgccttc

SEQ ID NO: 314921 - DNA, 20 bp, Artificial
  CRISPR gRNA sequence
gctgccttccggagcttgtt

SEQ ID NO: 314922 - DNA, 20 bp, Artificial
  CRISPR gRNA sequence
ccttccggagcttgttggct

SEQ ID NO: 314923 - DNA, 20 bp, Artificial
  CRISPR gRNA sequence
ccggagcttgttggctgagc

SEQ ID NO: 314924 - DNA, 20 bp, Artificial
  CRISPR gRNA sequence
cggagcttgttggctgagcc

SEQ ID NO: 314925 - DNA, 20 bp, Artificial
  CRISPR gRNA sequence
gttggctgagcctagactgg

SEQ ID NO: 314926 - DNA, 20 bp, Artificial
  CRISPR gRNA sequence
ttggctgagcctagactggc

SEQ ID NO: 314927 - DNA, 20 bp, Artificial
  CRISPR gRNA sequence
gctgagcctagactggcaaa

SEQ ID NO: 314928 - DNA, 20 bp, Artificial
  CRISPR gRNA sequence
agcctagactggcaaaaagt

SEQ ID NO: 314929 - DNA, 20 bp, Artificial
  CRISPR gRNA sequence
gactggcaaaaagtcaggaa

SEQ ID NO: 314930 - DNA, 20 bp, Artificial
  CRISPR gRNA sequence
gcaaaaagtcaggaagttgt

SEQ ID NO: 314931 - DNA, 20 bp, Artificial
  CRISPR gRNA sequence
ttgggaaaaaaggttttccc

SEQ ID NO: 314932 - DNA, 20 bp, Artificial
  CRISPR gRNA sequence
ggaaaaaaggttttcccttg

SEQ ID NO: 314933 - DNA, 20 bp, Artificial
  CRISPR gRNA sequence
tcccttggagttttgagcct

SEQ ID NO: 314934 - DNA, 20 bp, Artificial
  CRISPR gRNA sequence
cccttggagttttgagccta

SEQ ID NO: 314935 - DNA, 20 bp, Artificial
  CRISPR gRNA sequence
ccttggagttttgagcctat

SEQ ID NO: 314936 - DNA, 20 bp, Artificial
  CRISPR gRNA sequence
ggagttttgagcctatacag

SEQ ID NO: 314937 - DNA, 20 bp, Artificial
  CRISPR gRNA sequence
gagttttgagcctatacaga

SEQ ID NO: 314938 - DNA, 20 bp, Artificial
  CRISPR gRNA sequence
tgagcctatacagactggca

SEQ ID NO: 314939 - DNA, 20 bp, Artificial
  CRISPR gRNA sequence
gagcctatacagactggcag

SEQ ID NO: 314940 - DNA, 20 bp, Artificial
  CRISPR gRNA sequence
agcctatacagactggcagt

SEQ ID NO: 314941 - DNA, 20 bp, Artificial
  CRISPR gRNA sequence
tacagactggcagtagcaga

SEQ ID NO: 314942 - DNA, 20 bp, Artificial
  CRISPR gRNA sequence
gcagtagcagataatgctgc

SEQ ID NO: 314943 - DNA, 20 bp, Artificial
  CRISPR gRNA sequence
ctcttggacttcaaagaaag

SEQ ID NO: 314944 - DNA, 20 bp, Artificial
  CRISPR gRNA sequence
ttggacttcaaagaaaggcg

SEQ ID NO: 314945 - DNA, 20 bp, Artificial
  CRISPR gRNA sequence
ggacttcaaagaaaggcgac

SEQ ID NO: 314946 - DNA, 20 bp, Artificial
  CRISPR gRNA sequence
gacttcaaagaaaggcgaca

SEQ ID NO: 314947 - DNA, 20 bp, Artificial
  CRISPR gRNA sequence
caaagaaaggcgacatttct

SEQ ID NO: 314948 - DNA, 20 bp, Artificial
  CRISPR gRNA sequence
aaagaaaggcgacatttcta

SEQ ID NO: 314949 - DNA, 20 bp, Artificial
  CRISPR gRNA sequence
ctaacctctggtttacaaat

SEQ ID NO: 314950 - DNA, 20 bp, Artificial
  CRISPR gRNA sequence
taacctctggtttacaaatg

SEQ ID NO: 314951 - DNA, 20 bp, Artificial
  CRISPR gRNA sequence
acctctggtttacaaatgta

SEQ ID NO: 314952 - DNA, 20 bp, Artificial
  CRISPR gRNA sequence
tggtttacaaatgtacttct

SEQ ID NO: 314953 - DNA, 20 bp, Artificial
  CRISPR gRNA sequence
gtttacaaatgtacttctgg

SEQ ID NO: 314954 - DNA, 20 bp, Artificial
  CRISPR gRNA sequence
acaaatgtacttctggtttc

SEQ ID NO: 314955 - DNA, 20 bp, Artificial
  CRISPR gRNA sequence
caaatgtacttctggtttcc

SEQ ID NO: 314956 - DNA, 20 bp, Artificial
  CRISPR gRNA sequence
ctggtttccagggaaaactg

SEQ ID NO: 314957 - DNA, 20 bp, Artificial
  CRISPR gRNA sequence
tggtttccagggaaaactga

SEQ ID NO: 314958 - DNA, 20 bp, Artificial
  CRISPR gRNA sequence
gtttccagggaaaactgatt

SEQ ID NO: 314959 - DNA, 20 bp, Artificial
  CRISPR gRNA sequence
ccagggaaaactgattatta

SEQ ID NO: 314960 - DNA, 20 bp, Artificial
  CRISPR gRNA sequence
cagggaaaactgattattac

SEQ ID NO: 314961 - DNA, 20 bp, Artificial
  CRISPR gRNA sequence
attattacttgctttatcta

SEQ ID NO: 314962 - DNA, 20 bp, Artificial
  CRISPR gRNA sequence
ttacttgctttatctacctc

SEQ ID NO: 314963 - DNA, 20 bp, Artificial
  CRISPR gRNA sequence
cttgctttatctacctcact

SEQ ID NO: 314964 - DNA, 20 bp, Artificial
  CRISPR gRNA sequence
gctttatctacctcacttca

SEQ ID NO: 314965 - DNA, 20 bp, Artificial
  CRISPR gRNA sequence
ctttatctacctcacttcat

SEQ ID NO: 314966 - DNA, 20 bp, Artificial
  CRISPR gRNA sequence
tatctacctcacttcatgag

SEQ ID NO: 314967 - DNA, 20 bp, Artificial
  CRISPR gRNA sequence
atctacctcacttcatgagg

SEQ ID NO: 314968 - DNA, 20 bp, Artificial
  CRISPR gRNA sequence
tctacctcacttcatgaggt

SEQ ID NO: 314969 - DNA, 20 bp, Artificial
  CRISPR gRNA sequence
cctcacttcatgaggttact

SEQ ID NO: 314970 - DNA, 20 bp, Artificial
  CRISPR gRNA sequence
acttcatgaggttactgtga

SEQ ID NO: 314971 - DNA, 20 bp, Artificial
  CRISPR gRNA sequence
catgaggttactgtgacata

SEQ ID NO: 314972 - DNA, 20 bp, Artificial
  CRISPR gRNA sequence
atgaggttactgtgacatat

SEQ ID NO: 314973 - DNA, 20 bp, Artificial
  CRISPR gRNA sequence
ctgtgacatatacataaagt

SEQ ID NO: 314974 - DNA, 20 bp, Artificial
  CRISPR gRNA sequence
tgacatatacataaagtaaa

SEQ ID NO: 314975 - DNA, 20 bp, Artificial
  CRISPR gRNA sequence
ctaaatgttaaagattgtgg

SEQ ID NO: 314976 - DNA, 20 bp, Artificial
  CRISPR gRNA sequence
aatgttaaagattgtggacc

SEQ ID NO: 314977 - DNA, 20 bp, Artificial
  CRISPR gRNA sequence
aagattgtggacctggtggt

SEQ ID NO: 314978 - DNA, 20 bp, Artificial
  CRISPR gRNA sequence
tggacctggtggtgtttaag

SEQ ID NO: 314979 - DNA, 20 bp, Artificial
  CRISPR gRNA sequence
gtggtgtttaagcagggata

SEQ ID NO: 314980 - DNA, 20 bp, Artificial
  CRISPR gRNA sequence
aagcagggatatttgctaaa

SEQ ID NO: 314981 - DNA, 20 bp, Artificial
  CRISPR gRNA sequence
agcagggatatttgctaaat

SEQ ID NO: 314982 - DNA, 20 bp, Artificial
  CRISPR gRNA sequence
gctaaatgaccacaagaatc

SEQ ID NO: 314983 - DNA, 20 bp, Artificial
  CRISPR gRNA sequence
ctaaatgaccacaagaatca

SEQ ID NO: 314984 - DNA, 20 bp, Artificial
  CRISPR gRNA sequence
aatgaccacaagaatcagct

SEQ ID NO: 314985 - DNA, 20 bp, Artificial
  CRISPR gRNA sequence
ctcgtctctaaaaaaatcta

SEQ ID NO: 314986 - DNA, 20 bp, Artificial
  CRISPR gRNA sequence
tcgtctctaaaaaaatctag

SEQ ID NO: 314987 - DNA, 20 bp, Artificial
  CRISPR gRNA sequence
gtctctaaaaaaatctaggt

SEQ ID NO: 314988 - DNA, 20 bp, Artificial
  CRISPR gRNA sequence
taaaaaaatctaggtttctt

SEQ ID NO: 314989 - DNA, 20 bp, Artificial
  CRISPR gRNA sequence
aaaaaatctaggtttcttat

SEQ ID NO: 314990 - DNA, 20 bp, Artificial
  CRISPR gRNA sequence
ggtttcttatgaaataagtt

SEQ ID NO: 314991 - DNA, 20 bp, Artificial
  CRISPR gRNA sequence
cttatgaaataagttagatg

SEQ ID NO: 314992 - DNA, 20 bp, Artificial
  CRISPR gRNA sequence
ttatgaaataagttagatga

SEQ ID NO: 314993 - DNA, 20 bp, Artificial
  CRISPR gRNA sequence
atgaaataagttagatgaat

SEQ ID NO: 314994 - DNA, 20 bp, Artificial
  CRISPR gRNA sequence
tgaaataagttagatgaatt

SEQ ID NO: 314995 - DNA, 20 bp, Artificial
  CRISPR gRNA sequence
gatgaattattgcccattga

SEQ ID NO: 314996 - DNA, 20 bp, Artificial
  CRISPR gRNA sequence
ttgcccattgacttataaca

SEQ ID NO: 314997 - DNA, 20 bp, Artificial
  CRISPR gRNA sequence
cccattgacttataacaaac

SEQ ID NO: 314998 - DNA, 20 bp, Artificial
  CRISPR gRNA sequence
acttataacaaacaatatta

SEQ ID NO: 314999 - DNA, 20 bp, Artificial
  CRISPR gRNA sequence
ataacaaacaatattaactt

SEQ ID NO: 315000 - DNA, 20 bp, Artificial
  CRISPR gRNA sequence
taacaaacaatattaacttt

SEQ ID NO: 315001 - DNA, 20 bp, Artificial
  CRISPR gRNA sequence
actttaactaatttctaagt

SEQ ID NO: 315002 - DNA, 20 bp, Artificial
  CRISPR gRNA sequence
taactaatttctaagtaata

SEQ ID NO: 315003 - DNA, 20 bp, Artificial
  CRISPR gRNA sequence
aactaatttctaagtaatac

SEQ ID NO: 315004 - DNA, 20 bp, Artificial
  CRISPR gRNA sequence
actaatttctaagtaataca

SEQ ID NO: 315005 - DNA, 20 bp, Artificial
  CRISPR gRNA sequence
atttctaagtaatacatatc

SEQ ID NO: 315006 - DNA, 20 bp, Artificial
  CRISPR gRNA sequence
ctaagtaatacatatccatt

SEQ ID NO: 315007 - DNA, 20 bp, Artificial
  CRISPR gRNA sequence
taagtaatacatatccatta

SEQ ID NO: 315008 - DNA, 20 bp, Artificial
  CRISPR gRNA sequence
agtaatacatatccattatc

SEQ ID NO: 315009 - DNA, 20 bp, Artificial
  CRISPR gRNA sequence
tcatatataccaaaaataaa

SEQ ID NO: 315010 - DNA, 20 bp, Artificial
  CRISPR gRNA sequence
taactccactaataagaaaa

SEQ ID NO: 315011 - DNA, 20 bp, Artificial
  CRISPR gRNA sequence
cactaataagaaaaaatgat

SEQ ID NO: 315012 - DNA, 20 bp, Artificial
  CRISPR gRNA sequence
ataagaaaaaatgattacac

SEQ ID NO: 315013 - DNA, 20 bp, Artificial
  CRISPR gRNA sequence
cacaaatatttttggtgcct

SEQ ID NO: 315014 - DNA, 20 bp, Artificial
  CRISPR gRNA sequence
ttggtgcctatctttaagat

SEQ ID NO: 315015 - DNA, 20 bp, Artificial
  CRISPR gRNA sequence
tggtgcctatctttaagatt

SEQ ID NO: 315016 - DNA, 20 bp, Artificial
  CRISPR gRNA sequence
ggtgcctatctttaagattt

SEQ ID NO: 315017 - DNA, 20 bp, Artificial
  CRISPR gRNA sequence
gtgcctatctttaagatttt

SEQ ID NO: 315018 - DNA, 20 bp, Artificial
  CRISPR gRNA sequence
tctttaagatttttctgtgt

SEQ ID NO: 315019 - DNA, 20 bp, Artificial
  CRISPR gRNA sequence
taagatttttctgtgtatca

SEQ ID NO: 315020 - DNA, 20 bp, Artificial
  CRISPR gRNA sequence
aagatttttctgtgtatcaa

SEQ ID NO: 315021 - DNA, 20 bp, Artificial
  CRISPR gRNA sequence
agatttttctgtgtatcaat

SEQ ID NO: 315022 - DNA, 20 bp, Artificial
  CRISPR gRNA sequence
ttctgtgtatcaatctatgt

SEQ ID NO: 315023 - DNA, 20 bp, Artificial
  CRISPR gRNA sequence
tctgtgtatcaatctatgtt

SEQ ID NO: 315024 - DNA, 20 bp, Artificial
  CRISPR gRNA sequence
ctgtgtatcaatctatgttg

SEQ ID NO: 315025 - DNA, 20 bp, Artificial
  CRISPR gRNA sequence
tgtgtatcaatctatgttgt

SEQ ID NO: 315026 - DNA, 20 bp, Artificial
  CRISPR gRNA sequence
tgtatcaatctatgttgttt

SEQ ID NO: 315027 - DNA, 20 bp, Artificial
  CRISPR gRNA sequence
tgttgttttccataattagg

SEQ ID NO: 315028 - DNA, 20 bp, Artificial
  CRISPR gRNA sequence
ttttccataattaggattat

SEQ ID NO: 315029 - DNA, 20 bp, Artificial
  CRISPR gRNA sequence
tccataattaggattatcat

SEQ ID NO: 315030 - DNA, 20 bp, Artificial
  CRISPR gRNA sequence
ccataattaggattatcata

SEQ ID NO: 315031 - DNA, 20 bp, Artificial
  CRISPR gRNA sequence
cataattaggattatcataa

SEQ ID NO: 315032 - DNA, 20 bp, Artificial
  CRISPR gRNA sequence
ggattatcataagggttatt

SEQ ID NO: 315033 - DNA, 20 bp, Artificial
  CRISPR gRNA sequence
tcataagggttatttttcac

SEQ ID NO: 315034 - DNA, 20 bp, Artificial
  CRISPR gRNA sequence
tttttcacaatttggataat

SEQ ID NO: 315035 - DNA, 20 bp, Artificial
  CRISPR gRNA sequence
ttcacaatttggataatata

SEQ ID NO: 315036 - DNA, 20 bp, Artificial
  CRISPR gRNA sequence
tcacaatttggataatatat

SEQ ID NO: 315037 - DNA, 20 bp, Artificial
  CRISPR gRNA sequence
cacaatttggataatatatg

SEQ ID NO: 315038 - DNA, 20 bp, Artificial
  CRISPR gRNA sequence
acaatttggataatatatgt

SEQ ID NO: 315039 - DNA, 20 bp, Artificial
  CRISPR gRNA sequence
ggataatatatgtactgtgt

SEQ ID NO: 315040 - DNA, 20 bp, Artificial
  CRISPR gRNA sequence
gataatatatgtactgtgtt

SEQ ID NO: 315041 - DNA, 20 bp, Artificial
  CRISPR gRNA sequence
tgttctaattttgttatact

SEQ ID NO: 315042 - DNA, 20 bp, Artificial
  CRISPR gRNA sequence
taattttgttatactaaatg

SEQ ID NO: 315043 - DNA, 20 bp, Artificial
  CRISPR gRNA sequence
attttgttatactaaatgta

SEQ ID NO: 315044 - DNA, 20 bp, Artificial
  CRISPR gRNA sequence
tgttatactaaatgtagcaa

SEQ ID NO: 315045 - DNA, 20 bp, Artificial
  CRISPR gRNA sequence
gttatactaaatgtagcaag

SEQ ID NO: 315046 - DNA, 20 bp, Artificial
  CRISPR gRNA sequence
ttatactaaatgtagcaaga

SEQ ID NO: 315047 - DNA, 20 bp, Artificial
  CRISPR gRNA sequence
tactaaatgtagcaagacaa

SEQ ID NO: 315048 - DNA, 20 bp, Artificial
  CRISPR gRNA sequence
aatgtagcaagacaattttc

SEQ ID NO: 315049 - DNA, 20 bp, Artificial
  CRISPR gRNA sequence
tcaatgtcataaatatcatt

SEQ ID NO: 315050 - DNA, 20 bp, Artificial
  CRISPR gRNA sequence
caatgtcataaatatcattc

SEQ ID NO: 315051 - DNA, 20 bp, Artificial
  CRISPR gRNA sequence
aatgtcataaatatcattct

SEQ ID NO: 315052 - DNA, 20 bp, Artificial
  CRISPR gRNA sequence
tacagcatcatttttaatgg

SEQ ID NO: 315053 - DNA, 20 bp, Artificial
  CRISPR gRNA sequence
cagcatcatttttaatggct

SEQ ID NO: 315054 - DNA, 20 bp, Artificial
  CRISPR gRNA sequence
ttaatggctgcaagatattc

SEQ ID NO: 315055 - DNA, 20 bp, Artificial
  CRISPR gRNA sequence
taatggctgcaagatattcc

SEQ ID NO: 315056 - DNA, 20 bp, Artificial
  CRISPR gRNA sequence
aatggctgcaagatattccc

SEQ ID NO: 315057 - DNA, 20 bp, Artificial
  CRISPR gRNA sequence
atggctgcaagatattccct

SEQ ID NO: 315058 - DNA, 20 bp, Artificial
  CRISPR gRNA sequence
caagatattcccttttgtgg

SEQ ID NO: 315059 - DNA, 20 bp, Artificial
  CRISPR gRNA sequence
ccttttgtggatacaccata

SEQ ID NO: 315060 - DNA, 20 bp, Artificial
  CRISPR gRNA sequence
ttgtggatacaccataattt

SEQ ID NO: 315061 - DNA, 20 bp, Artificial
  CRISPR gRNA sequence
tgtggatacaccataattta

SEQ ID NO: 315062 - DNA, 20 bp, Artificial
  CRISPR gRNA sequence
gtggatacaccataatttat

SEQ ID NO: 315063 - DNA, 20 bp, Artificial
  CRISPR gRNA sequence
tggatacaccataatttatt

SEQ ID NO: 315064 - DNA, 20 bp, Artificial
  CRISPR gRNA sequence
atttatttaaccaacctcat

SEQ ID NO: 315065 - DNA, 20 bp, Artificial
  CRISPR gRNA sequence
tttatttaaccaacctcatt

SEQ ID NO: 315066 - DNA, 20 bp, Artificial
  CRISPR gRNA sequence
atttaaccaacctcattttt

SEQ ID NO: 315067 - DNA, 20 bp, Artificial
  CRISPR gRNA sequence
tttaaccaacctcatttttt

SEQ ID NO: 315068 - DNA, 20 bp, Artificial
  CRISPR gRNA sequence
aaccaacctcattttttgga

SEQ ID NO: 315069 - DNA, 20 bp, Artificial
  CRISPR gRNA sequence
accaacctcattttttggac

SEQ ID NO: 315070 - DNA, 20 bp, Artificial
  CRISPR gRNA sequence
attttttggacacttgagtt

SEQ ID NO: 315071 - DNA, 20 bp, Artificial
  CRISPR gRNA sequence
tttggacacttgagttagtc

SEQ ID NO: 315072 - DNA, 20 bp, Artificial
  CRISPR gRNA sequence
ttggacacttgagttagtcc

SEQ ID NO: 315073 - DNA, 20 bp, Artificial
  CRISPR gRNA sequence
tggacacttgagttagtcca

SEQ ID NO: 315074 - DNA, 20 bp, Artificial
  CRISPR gRNA sequence
ggacacttgagttagtccaa

SEQ ID NO: 315075 - DNA, 20 bp, Artificial
  CRISPR gRNA sequence
gacacttgagttagtccaat

SEQ ID NO: 315076 - DNA, 20 bp, Artificial
  CRISPR gRNA sequence
gagttagtccaatagttttg

SEQ ID NO: 315077 - DNA, 20 bp, Artificial
  CRISPR gRNA sequence
agttagtccaatagttttgt

SEQ ID NO: 315078 - DNA, 20 bp, Artificial
  CRISPR gRNA sequence
gtccaatagttttgttatta

SEQ ID NO: 315079 - DNA, 20 bp, Artificial
  CRISPR gRNA sequence
tgttattataaacaccctcc

SEQ ID NO: 315080 - DNA, 20 bp, Artificial
  CRISPR gRNA sequence
gttattataaacaccctccc

SEQ ID NO: 315081 - DNA, 20 bp, Artificial
  CRISPR gRNA sequence
ttattataaacaccctcccc

SEQ ID NO: 315082 - DNA, 20 bp, Artificial
  CRISPR gRNA sequence
ttataaacaccctccccact

SEQ ID NO: 315083 - DNA, 20 bp, Artificial
  CRISPR gRNA sequence
taaacaccctccccactgac

SEQ ID NO: 315084 - DNA, 20 bp, Artificial
  CRISPR gRNA sequence
cccactgacttctgttataa

SEQ ID NO: 315085 - DNA, 20 bp, Artificial
  CRISPR gRNA sequence
acttctgttataaaaatgtt

SEQ ID NO: 315086 - DNA, 20 bp, Artificial
  CRISPR gRNA sequence
ctgttataaaaatgtttcat

SEQ ID NO: 315087 - DNA, 20 bp, Artificial
  CRISPR gRNA sequence
tgttataaaaatgtttcatg

SEQ ID NO: 315088 - DNA, 20 bp, Artificial
  CRISPR gRNA sequence
ttataaaaatgtttcatggg

SEQ ID NO: 315089 - DNA, 20 bp, Artificial
  CRISPR gRNA sequence
taaaaatgtttcatggggac

SEQ ID NO: 315090 - DNA, 20 bp, Artificial
  CRISPR gRNA sequence
catggggacaaagtggtccc

SEQ ID NO: 315091 - DNA, 20 bp, Artificial
  CRISPR gRNA sequence
atggggacaaagtggtccct

SEQ ID NO: 315092 - DNA, 20 bp, Artificial
  CRISPR gRNA sequence
actttataataatgccatgc

SEQ ID NO: 315093 - DNA, 20 bp, Artificial
  CRISPR gRNA sequence
tataataatgccatgccttt

SEQ ID NO: 315094 - DNA, 20 bp, Artificial
  CRISPR gRNA sequence
ataataatgccatgcctttt

SEQ ID NO: 315095 - DNA, 20 bp, Artificial
  CRISPR gRNA sequence
taataatgccatgccttttt

SEQ ID NO: 315096 - DNA, 20 bp, Artificial
  CRISPR gRNA sequence
tttgtagtttggtctggttc

SEQ ID NO: 315097 - DNA, 20 bp, Artificial
  CRISPR gRNA sequence
ttgtagtttggtctggttct

SEQ ID NO: 315098 - DNA, 20 bp, Artificial
  CRISPR gRNA sequence
tgtagtttggtctggttcta

SEQ ID NO: 315099 - DNA, 20 bp, Artificial
  CRISPR gRNA sequence
gtagtttggtctggttctaa

SEQ ID NO: 315100 - DNA, 20 bp, Artificial
  CRISPR gRNA sequence
tagtttggtctggttctaag

SEQ ID NO: 315101 - DNA, 20 bp, Artificial
  CRISPR gRNA sequence
ggtctggttctaagctaaga

SEQ ID NO: 315102 - DNA, 20 bp, Artificial
  CRISPR gRNA sequence
gtctggttctaagctaagat

SEQ ID NO: 315103 - DNA, 20 bp, Artificial
  CRISPR gRNA sequence
gttctaagctaagattggac

SEQ ID NO: 315104 - DNA, 20 bp, Artificial
  CRISPR gRNA sequence
taagctaagattggacttta

SEQ ID NO: 315105 - DNA, 20 bp, Artificial
  CRISPR gRNA sequence
agctaagattggactttatc

SEQ ID NO: 315106 - DNA, 20 bp, Artificial
  CRISPR gRNA sequence
agattggactttatctcagt

SEQ ID NO: 315107 - DNA, 20 bp, Artificial
  CRISPR gRNA sequence
gactttatctcagtaattgc

SEQ ID NO: 315108 - DNA, 20 bp, Artificial
  CRISPR gRNA sequence
tatctcagtaattgcctcca

SEQ ID NO: 315109 - DNA, 20 bp, Artificial
  CRISPR gRNA sequence
atctcagtaattgcctccag

SEQ ID NO: 315110 - DNA, 20 bp, Artificial
  CRISPR gRNA sequence
tctcagtaattgcctccagt

SEQ ID NO: 315111 - DNA, 20 bp, Artificial
  CRISPR gRNA sequence
agtaattgcctccagtagta

SEQ ID NO: 315112 - DNA, 20 bp, Artificial
  CRISPR gRNA sequence
cctccagtagtaattagttt

SEQ ID NO: 315113 - DNA, 20 bp, Artificial
  CRISPR gRNA sequence
cagtagtaattagtttgatt

SEQ ID NO: 315114 - DNA, 20 bp, Artificial
  CRISPR gRNA sequence
gtttgattggtgctaataat

SEQ ID NO: 315115 - DNA, 20 bp, Artificial
  CRISPR gRNA sequence
gattggtgctaataattaag

SEQ ID NO: 315116 - DNA, 20 bp, Artificial
  CRISPR gRNA sequence
attggtgctaataattaagg

SEQ ID NO: 315117 - DNA, 20 bp, Artificial
  CRISPR gRNA sequence
gtgctaataattaaggtaac

SEQ ID NO: 315118 - DNA, 20 bp, Artificial
  CRISPR gRNA sequence
ataattaaggtaaccttcta

SEQ ID NO: 315119 - DNA, 20 bp, Artificial
  CRISPR gRNA sequence
aggtaaccttctaactcact

SEQ ID NO: 315120 - DNA, 20 bp, Artificial
  CRISPR gRNA sequence
ctaactcacttatggtagaa

SEQ ID NO: 315121 - DNA, 20 bp, Artificial
  CRISPR gRNA sequence
taactcacttatggtagaaa

SEQ ID NO: 315122 - DNA, 20 bp, Artificial
  CRISPR gRNA sequence
actcacttatggtagaaagc

SEQ ID NO: 315123 - DNA, 20 bp, Artificial
  CRISPR gRNA sequence
acttatggtagaaagcacaa

SEQ ID NO: 315124 - DNA, 20 bp, Artificial
  CRISPR gRNA sequence
atggtagaaagcacaagatg

SEQ ID NO: 315125 - DNA, 20 bp, Artificial
  CRISPR gRNA sequence
tggtagaaagcacaagatga

SEQ ID NO: 315126 - DNA, 20 bp, Artificial
  CRISPR gRNA sequence
cctctggccagcatcttgtt

SEQ ID NO: 315127 - DNA, 20 bp, Artificial
  CRISPR gRNA sequence
tggccagcatcttgtttttc

SEQ ID NO: 315128 - DNA, 20 bp, Artificial
  CRISPR gRNA sequence
gccagcatcttgtttttcag

SEQ ID NO: 315129 - DNA, 20 bp, Artificial
  CRISPR gRNA sequence
gtttttcagtatactgattt

SEQ ID NO: 315130 - DNA, 20 bp, Artificial
  CRISPR gRNA sequence
tttttcagtatactgatttt

SEQ ID NO: 315131 - DNA, 20 bp, Artificial
  CRISPR gRNA sequence
ttcagtatactgattttaaa

SEQ ID NO: 315132 - DNA, 20 bp, Artificial
  CRISPR gRNA sequence
tcagtatactgattttaaaa

SEQ ID NO: 315133 - DNA, 20 bp, Artificial
  CRISPR gRNA sequence
cagtatactgattttaaaat

SEQ ID NO: 315134 - DNA, 20 bp, Artificial
  CRISPR gRNA sequence
agtatactgattttaaaatc

SEQ ID NO: 315135 - DNA, 20 bp, Artificial
  CRISPR gRNA sequence
attttaaaatctaactagaa

SEQ ID NO: 315136 - DNA, 20 bp, Artificial
  CRISPR gRNA sequence
taaaatctaactagaaaata

SEQ ID NO: 315137 - DNA, 20 bp, Artificial
  CRISPR gRNA sequence
aaaatctaactagaaaatag

SEQ ID NO: 315138 - DNA, 20 bp, Artificial
  CRISPR gRNA sequence
aaatctaactagaaaataga

SEQ ID NO: 315139 - DNA, 20 bp, Artificial
  CRISPR gRNA sequence
actagaaaatagatggatga

SEQ ID NO: 315140 - DNA, 20 bp, Artificial
  CRISPR gRNA sequence
gaaaatagatggatgacatt

SEQ ID NO: 315141 - DNA, 20 bp, Artificial
  CRISPR gRNA sequence
gcagtcattcaatgcatcct

SEQ ID NO: 315142 - DNA, 20 bp, Artificial
  CRISPR gRNA sequence
aatgcatcctgctgtacttt

SEQ ID NO: 315143 - DNA, 20 bp, Artificial
  CRISPR gRNA sequence
ctgtactttaaaaataagaa

SEQ ID NO: 315144 - DNA, 20 bp, Artificial
  CRISPR gRNA sequence
tactttaaaaataagaaatt

SEQ ID NO: 315145 - DNA, 20 bp, Artificial
  CRISPR gRNA sequence
taaaaataagaaattgggga

SEQ ID NO: 315146 - DNA, 20 bp, Artificial
  CRISPR gRNA sequence
aaaaataagaaattggggag

SEQ ID NO: 315147 - DNA, 20 bp, Artificial
  CRISPR gRNA sequence
aaaataagaaattggggagc

SEQ ID NO: 315148 - DNA, 20 bp, Artificial
  CRISPR gRNA sequence
gggagcaacgatcgaattta

SEQ ID NO: 315149 - DNA, 20 bp, Artificial
  CRISPR gRNA sequence
aaataaattaacacaaagca

SEQ ID NO: 315150 - DNA, 20 bp, Artificial
  CRISPR gRNA sequence
aataaattaacacaaagcat

SEQ ID NO: 315151 - DNA, 20 bp, Artificial
  CRISPR gRNA sequence
acacaaagcatgtggcagag

SEQ ID NO: 315152 - DNA, 20 bp, Artificial
  CRISPR gRNA sequence
aaactgccaatgtatggagt

SEQ ID NO: 315153 - DNA, 20 bp, Artificial
  CRISPR gRNA sequence
ccaatgtatggagtgtgctg

SEQ ID NO: 315154 - DNA, 20 bp, Artificial
  CRISPR gRNA sequence
cgagatttctatgatataaa

SEQ ID NO: 315155 - DNA, 20 bp, Artificial
  CRISPR gRNA sequence
ctatgatataaaagtataaa

SEQ ID NO: 315156 - DNA, 20 bp, Artificial
  CRISPR gRNA sequence
tatgatataaaagtataaaa

SEQ ID NO: 315157 - DNA, 20 bp, Artificial
  CRISPR gRNA sequence
tgatataaaagtataaaatt

SEQ ID NO: 315158 - DNA, 20 bp, Artificial
  CRISPR gRNA sequence
ctagcacagatgtaaagaca

SEQ ID NO: 315159 - DNA, 20 bp, Artificial
  CRISPR gRNA sequence
gcacagatgtaaagacatat

SEQ ID NO: 315160 - DNA, 20 bp, Artificial
  CRISPR gRNA sequence
gtccaggctttgacttttca

SEQ ID NO: 315161 - DNA, 20 bp, Artificial
  CRISPR gRNA sequence
tccaggctttgacttttcaa

SEQ ID NO: 315162 - DNA, 20 bp, Artificial
  CRISPR gRNA sequence
tgacttttcaaggtgagagt

SEQ ID NO: 315163 - DNA, 20 bp, Artificial
  CRISPR gRNA sequence
gacttttcaaggtgagagtt

SEQ ID NO: 315164 - DNA, 20 bp, Artificial
  CRISPR gRNA sequence
acttttcaaggtgagagttt

SEQ ID NO: 315165 - DNA, 20 bp, Artificial
  CRISPR gRNA sequence
ttcaaggtgagagttttgag

SEQ ID NO: 315166 - DNA, 20 bp, Artificial
  CRISPR gRNA sequence
tcaaggtgagagttttgagc

SEQ ID NO: 315167 - DNA, 20 bp, Artificial
  CRISPR gRNA sequence
caaggtgagagttttgagct

SEQ ID NO: 315168 - DNA, 20 bp, Artificial
  CRISPR gRNA sequence
aaggtgagagttttgagctt

SEQ ID NO: 315169 - DNA, 20 bp, Artificial
  CRISPR gRNA sequence
tgagcttcactttctttcaa

SEQ ID NO: 315170 - DNA, 20 bp, Artificial
  CRISPR gRNA sequence
gagcttcactttctttcaac

SEQ ID NO: 315171 - DNA, 20 bp, Artificial
  CRISPR gRNA sequence
agcttcactttctttcaacc

SEQ ID NO: 315172 - DNA, 20 bp, Artificial
  CRISPR gRNA sequence
cactttctttcaacctcatt

SEQ ID NO: 315173 - DNA, 20 bp, Artificial
  CRISPR gRNA sequence
actttctttcaacctcattg

SEQ ID NO: 315174 - DNA, 20 bp, Artificial
  CRISPR gRNA sequence
tctttcaacctcattgccat

SEQ ID NO: 315175 - DNA, 20 bp, Artificial
  CRISPR gRNA sequence
ctttcaacctcattgccatt

SEQ ID NO: 315176 - DNA, 20 bp, Artificial
  CRISPR gRNA sequence
tttcaacctcattgccattt

SEQ ID NO: 315177 - DNA, 20 bp, Artificial
  CRISPR gRNA sequence
tcaacctcattgccatttaa

SEQ ID NO: 315178 - DNA, 20 bp, Artificial
  CRISPR gRNA sequence
caacctcattgccatttaaa

SEQ ID NO: 315179 - DNA, 20 bp, Artificial
  CRISPR gRNA sequence
aacctcattgccatttaaaa

SEQ ID NO: 315180 - DNA, 20 bp, Artificial
  CRISPR gRNA sequence
attgccatttaaaattagtc

SEQ ID NO: 315181 - DNA, 20 bp, Artificial
  CRISPR gRNA sequence
ccatttaaaattagtcaaat

SEQ ID NO: 315182 - DNA, 20 bp, Artificial
  CRISPR gRNA sequence
aaaattagtcaaatatgaag

SEQ ID NO: 315183 - DNA, 20 bp, Artificial
  CRISPR gRNA sequence
aaattagtcaaatatgaaga

SEQ ID NO: 315184 - DNA, 20 bp, Artificial
  CRISPR gRNA sequence
gtcaaatatgaagaagtgac

SEQ ID NO: 315185 - DNA, 20 bp, Artificial
  CRISPR gRNA sequence
acatcttgggaataagctgt

SEQ ID NO: 315186 - DNA, 20 bp, Artificial
  CRISPR gRNA sequence
catcttgggaataagctgtt

SEQ ID NO: 315187 - DNA, 20 bp, Artificial
  CRISPR gRNA sequence
gggaataagctgtttgctag

SEQ ID NO: 315188 - DNA, 20 bp, Artificial
  CRISPR gRNA sequence
ggaataagctgtttgctaga

SEQ ID NO: 315189 - DNA, 20 bp, Artificial
  CRISPR gRNA sequence
tttgctagatttttcttcac

SEQ ID NO: 315190 - DNA, 20 bp, Artificial
  CRISPR gRNA sequence
gctagatttttcttcacatt

SEQ ID NO: 315191 - DNA, 20 bp, Artificial
  CRISPR gRNA sequence
ctagatttttcttcacatta

SEQ ID NO: 315192 - DNA, 20 bp, Artificial
  CRISPR gRNA sequence
gatttttcttcacattagaa

SEQ ID NO: 315193 - DNA, 20 bp, Artificial
  CRISPR gRNA sequence
ttcttcacattagaatgatc

SEQ ID NO: 315194 - DNA, 20 bp, Artificial
  CRISPR gRNA sequence
tcttcacattagaatgatca

SEQ ID NO: 315195 - DNA, 20 bp, Artificial
  CRISPR gRNA sequence
cttcacattagaatgatcag

SEQ ID NO: 315196 - DNA, 20 bp, Artificial
  CRISPR gRNA sequence
ttcacattagaatgatcagc

SEQ ID NO: 315197 - DNA, 20 bp, Artificial
  CRISPR gRNA sequence
cacattagaatgatcagctt

SEQ ID NO: 315198 - DNA, 20 bp, Artificial
  CRISPR gRNA sequence
acattagaatgatcagctta

SEQ ID NO: 315199 - DNA, 20 bp, Artificial
  CRISPR gRNA sequence
gaatgatcagcttacaaatg

SEQ ID NO: 315200 - DNA, 20 bp, Artificial
  CRISPR gRNA sequence
acaaatgaaacaaagaaggg

SEQ ID NO: 315201 - DNA, 20 bp, Artificial
  CRISPR gRNA sequence
caaatgaaacaaagaagggt

SEQ ID NO: 315202 - DNA, 20 bp, Artificial
  CRISPR gRNA sequence
gagaaaaagattaaggatgt

SEQ ID NO: 315203 - DNA, 20 bp, Artificial
  CRISPR gRNA sequence
aggatgtttcttcctccatg

SEQ ID NO: 315204 - DNA, 20 bp, Artificial
  CRISPR gRNA sequence
cttcctccatgaggcaatca

SEQ ID NO: 315205 - DNA, 20 bp, Artificial
  CRISPR gRNA sequence
ttcctccatgaggcaatcag

SEQ ID NO: 315206 - DNA, 20 bp, Artificial
  CRISPR gRNA sequence
cctccatgaggcaatcagaa

SEQ ID NO: 315207 - DNA, 20 bp, Artificial
  CRISPR gRNA sequence
ctccatgaggcaatcagaaa

SEQ ID NO: 315208 - DNA, 20 bp, Artificial
  CRISPR gRNA sequence
catgaggcaatcagaaaaaa

SEQ ID NO: 315209 - DNA, 20 bp, Artificial
  CRISPR gRNA sequence
gataggggagataaagagga

SEQ ID NO: 315210 - DNA, 20 bp, Artificial
  CRISPR gRNA sequence
acatgagagaagttagaagg

SEQ ID NO: 315211 - DNA, 20 bp, Artificial
  CRISPR gRNA sequence
gaaggtggttaaataagctc

SEQ ID NO: 315212 - DNA, 20 bp, Artificial
  CRISPR gRNA sequence
aataagctctgtaggtacag

SEQ ID NO: 315213 - DNA, 20 bp, Artificial
  CRISPR gRNA sequence
tgtaggtacagatgagatgg

SEQ ID NO: 315214 - DNA, 20 bp, Artificial
  CRISPR gRNA sequence
taggtacagatgagatggtc

SEQ ID NO: 315215 - DNA, 20 bp, Artificial
  CRISPR gRNA sequence
ggctgagtggcacatacatg

SEQ ID NO: 315216 - DNA, 20 bp, Artificial
  CRISPR gRNA sequence
agtggcacatacatgacccc

SEQ ID NO: 315217 - DNA, 20 bp, Artificial
  CRISPR gRNA sequence
agaatgtaatgaagaatatt

SEQ ID NO: 315218 - DNA, 20 bp, Artificial
  CRISPR gRNA sequence
gtaagaaaaagttatttatt

SEQ ID NO: 315219 - DNA, 20 bp, Artificial
  CRISPR gRNA sequence
tttattcagacagtcatcca

SEQ ID NO: 315220 - DNA, 20 bp, Artificial
  CRISPR gRNA sequence
attcagacagtcatccatgc

SEQ ID NO: 315221 - DNA, 20 bp, Artificial
  CRISPR gRNA sequence
ttcagacagtcatccatgcc

SEQ ID NO: 315222 - DNA, 20 bp, Artificial
  CRISPR gRNA sequence
agacagtcatccatgccact

SEQ ID NO: 315223 - DNA, 20 bp, Artificial
  CRISPR gRNA sequence
agtttgatcaaagagagaag

SEQ ID NO: 315224 - DNA, 20 bp, Artificial
  CRISPR gRNA sequence
gatcaaagagagaagccttg

SEQ ID NO: 315225 - DNA, 20 bp, Artificial
  CRISPR gRNA sequence
atcaaagagagaagccttgc

SEQ ID NO: 315226 - DNA, 20 bp, Artificial
  CRISPR gRNA sequence
gctatcactgtagggaggga

SEQ ID NO: 315227 - DNA, 20 bp, Artificial
  CRISPR gRNA sequence
ctatcactgtagggagggag

SEQ ID NO: 315228 - DNA, 20 bp, Artificial
  CRISPR gRNA sequence
tcactgtagggagggaggtg

SEQ ID NO: 315229 - DNA, 20 bp, Artificial
  CRISPR gRNA sequence
tagggagggaggtgcaacag

SEQ ID NO: 315230 - DNA, 20 bp, Artificial
  CRISPR gRNA sequence
tgccattatagatatgatat

SEQ ID NO: 315231 - DNA, 20 bp, Artificial
  CRISPR gRNA sequence
tagatatgatatatttgtaa

SEQ ID NO: 315232 - DNA, 20 bp, Artificial
  CRISPR gRNA sequence
gtaaatttggattctgtaac

SEQ ID NO: 315233 - DNA, 20 bp, Artificial
  CRISPR gRNA sequence
taaatttggattctgtaact

SEQ ID NO: 315234 - DNA, 20 bp, Artificial
  CRISPR gRNA sequence
ggattctgtaacttcagcaa

SEQ ID NO: 315235 - DNA, 20 bp, Artificial
  CRISPR gRNA sequence
gattctgtaacttcagcaat

SEQ ID NO: 315236 - DNA, 20 bp, Artificial
  CRISPR gRNA sequence
tgtaacttcagcaatatctg

SEQ ID NO: 315237 - DNA, 20 bp, Artificial
  CRISPR gRNA sequence
taacttcagcaatatctgcc

SEQ ID NO: 315238 - DNA, 20 bp, Artificial
  CRISPR gRNA sequence
cagcaatatctgccattgct

SEQ ID NO: 315239 - DNA, 20 bp, Artificial
  CRISPR gRNA sequence
agcaatatctgccattgctt

SEQ ID NO: 315240 - DNA, 20 bp, Artificial
  CRISPR gRNA sequence
ccattgctttgtgggtactc

SEQ ID NO: 315241 - DNA, 20 bp, Artificial
  CRISPR gRNA sequence
ctttgtgggtactcctggca

SEQ ID NO: 315242 - DNA, 20 bp, Artificial
  CRISPR gRNA sequence
tgtgggtactcctggcattg

SEQ ID NO: 315243 - DNA, 20 bp, Artificial
  CRISPR gRNA sequence
gtgggtactcctggcattgg

SEQ ID NO: 315244 - DNA, 20 bp, Artificial
  CRISPR gRNA sequence
tgggtactcctggcattggc

SEQ ID NO: 315245 - DNA, 20 bp, Artificial
  CRISPR gRNA sequence
ctggcattggctatgtgata

SEQ ID NO: 315246 - DNA, 20 bp, Artificial
  CRISPR gRNA sequence
gcattggctatgtgataggt

SEQ ID NO: 315247 - DNA, 20 bp, Artificial
  CRISPR gRNA sequence
gctatgtgataggtaaaata

SEQ ID NO: 315248 - DNA, 20 bp, Artificial
  CRISPR gRNA sequence
tgtgataggtaaaataatgc

SEQ ID NO: 315249 - DNA, 20 bp, Artificial
  CRISPR gRNA sequence
ctatactccagaacctgtaa

SEQ ID NO: 315250 - DNA, 20 bp, Artificial
  CRISPR gRNA sequence
tactccagaacctgtaatat

SEQ ID NO: 315251 - DNA, 20 bp, Artificial
  CRISPR gRNA sequence
cagaacctgtaatatgttat

SEQ ID NO: 315252 - DNA, 20 bp, Artificial
  CRISPR gRNA sequence
taatatgttatcttacatgg

SEQ ID NO: 315253 - DNA, 20 bp, Artificial
  CRISPR gRNA sequence
tcttacatggcaaaaggaac

SEQ ID NO: 315254 - DNA, 20 bp, Artificial
  CRISPR gRNA sequence
acatggcaaaaggaacttca

SEQ ID NO: 315255 - DNA, 20 bp, Artificial
  CRISPR gRNA sequence
catggcaaaaggaacttcac

SEQ ID NO: 315256 - DNA, 20 bp, Artificial
  CRISPR gRNA sequence
cacataggtgattaaggcac

SEQ ID NO: 315257 - DNA, 20 bp, Artificial
  CRISPR gRNA sequence
acataggtgattaaggcacc

SEQ ID NO: 315258 - DNA, 20 bp, Artificial
  CRISPR gRNA sequence
aggcaccaagcttgagatgg

SEQ ID NO: 315259 - DNA, 20 bp, Artificial
  CRISPR gRNA sequence
gagatggtgagattaacctg

SEQ ID NO: 315260 - DNA, 20 bp, Artificial
  CRISPR gRNA sequence
agatggtgagattaacctgg

SEQ ID NO: 315261 - DNA, 20 bp, Artificial
  CRISPR gRNA sequence
acctggattatccaggtggg

SEQ ID NO: 315262 - DNA, 20 bp, Artificial
  CRISPR gRNA sequence
gattatccaggtgggcccaa

SEQ ID NO: 315263 - DNA, 20 bp, Artificial
  CRISPR gRNA sequence
tccaggtgggcccaatgtaa

SEQ ID NO: 315264 - DNA, 20 bp, Artificial
  CRISPR gRNA sequence
tcctagctgggatggagaaa

SEQ ID NO: 315265 - DNA, 20 bp, Artificial
  CRISPR gRNA sequence
cctagctgggatggagaaat

SEQ ID NO: 315266 - DNA, 20 bp, Artificial
  CRISPR gRNA sequence
ctagctgggatggagaaatg

SEQ ID NO: 315267 - DNA, 20 bp, Artificial
  CRISPR gRNA sequence
gctgggatggagaaatgaac

SEQ ID NO: 315268 - DNA, 20 bp, Artificial
  CRISPR gRNA sequence
ggatggagaaatgaactgga

SEQ ID NO: 315269 - DNA, 20 bp, Artificial
  CRISPR gRNA sequence
gaagaaggagagatctgaaa

SEQ ID NO: 315270 - DNA, 20 bp, Artificial
  CRISPR gRNA sequence
aaacttgagaagctcaaccc

SEQ ID NO: 315271 - DNA, 20 bp, Artificial
  CRISPR gRNA sequence
gagaagctcaacccagcatt

SEQ ID NO: 315272 - DNA, 20 bp, Artificial
  CRISPR gRNA sequence
agaagctcaacccagcattt

SEQ ID NO: 315273 - DNA, 20 bp, Artificial
  CRISPR gRNA sequence
aacccagcatttctagcttt

SEQ ID NO: 315274 - DNA, 20 bp, Artificial
  CRISPR gRNA sequence
ctagctttgaagatggaagg

SEQ ID NO: 315275 - DNA, 20 bp, Artificial
  CRISPR gRNA sequence
tagctttgaagatggaagga

SEQ ID NO: 315276 - DNA, 20 bp, Artificial
  CRISPR gRNA sequence
gctttgaagatggaaggagg

SEQ ID NO: 315277 - DNA, 20 bp, Artificial
  CRISPR gRNA sequence
tgaagatggaaggaggaagc

SEQ ID NO: 315278 - DNA, 20 bp, Artificial
  CRISPR gRNA sequence
gaagatggaaggaggaagcc

SEQ ID NO: 315279 - DNA, 20 bp, Artificial
  CRISPR gRNA sequence
aagatggaaggaggaagcca

SEQ ID NO: 315280 - DNA, 20 bp, Artificial
  CRISPR gRNA sequence
ctagaagctggaagtggctc

SEQ ID NO: 315281 - DNA, 20 bp, Artificial
  CRISPR gRNA sequence
tagaagctggaagtggctct

SEQ ID NO: 315282 - DNA, 20 bp, Artificial
  CRISPR gRNA sequence
gaagctggaagtggctctca

SEQ ID NO: 315283 - DNA, 20 bp, Artificial
  CRISPR gRNA sequence
gaagtggctctcagttgaca

SEQ ID NO: 315284 - DNA, 20 bp, Artificial
  CRISPR gRNA sequence
tcagttgacagccagccatt

SEQ ID NO: 315285 - DNA, 20 bp, Artificial
  CRISPR gRNA sequence
agttgacagccagccattaa

SEQ ID NO: 315286 - DNA, 20 bp, Artificial
  CRISPR gRNA sequence
acagccagccattaaggaaa

SEQ ID NO: 315287 - DNA, 20 bp, Artificial
  CRISPR gRNA sequence
aggaaattaggatctcagtt

SEQ ID NO: 315288 - DNA, 20 bp, Artificial
  CRISPR gRNA sequence
ggatctcagttctgcaacta

SEQ ID NO: 315289 - DNA, 20 bp, Artificial
  CRISPR gRNA sequence
agttctgcaactataaggag

SEQ ID NO: 315290 - DNA, 20 bp, Artificial
  CRISPR gRNA sequence
tgcaactataaggagctgaa

SEQ ID NO: 315291 - DNA, 20 bp, Artificial
  CRISPR gRNA sequence
caactataaggagctgaatt

SEQ ID NO: 315292 - DNA, 20 bp, Artificial
  CRISPR gRNA sequence
taaggagctgaattctgcca

SEQ ID NO: 315293 - DNA, 20 bp, Artificial
  CRISPR gRNA sequence
aattctgccaagagaccaat

SEQ ID NO: 315294 - DNA, 20 bp, Artificial
  CRISPR gRNA sequence
tgccaagagaccaatgtgga

SEQ ID NO: 315295 - DNA, 20 bp, Artificial
  CRISPR gRNA sequence
ccaagagaccaatgtggaaa

SEQ ID NO: 315296 - DNA, 20 bp, Artificial
  CRISPR gRNA sequence
cacagagacacaagcttact

SEQ ID NO: 315297 - DNA, 20 bp, Artificial
  CRISPR gRNA sequence
actgataactggtaggaatt

SEQ ID NO: 315298 - DNA, 20 bp, Artificial
  CRISPR gRNA sequence
ctgataactggtaggaattt

SEQ ID NO: 315299 - DNA, 20 bp, Artificial
  CRISPR gRNA sequence
ataactggtaggaatttctc

SEQ ID NO: 315300 - DNA, 20 bp, Artificial
  CRISPR gRNA sequence
gtaggaatttctccaaaagt

SEQ ID NO: 315301 - DNA, 20 bp, Artificial
  CRISPR gRNA sequence
ctccaaaagtggagcttcct

SEQ ID NO: 315302 - DNA, 20 bp, Artificial
  CRISPR gRNA sequence
tccaaaagtggagcttcctc

SEQ ID NO: 315303 - DNA, 20 bp, Artificial
  CRISPR gRNA sequence
caaaagtggagcttcctcct

SEQ ID NO: 315304 - DNA, 20 bp, Artificial
  CRISPR gRNA sequence
cctcctactccagtgttaat

SEQ ID NO: 315305 - DNA, 20 bp, Artificial
  CRISPR gRNA sequence
ctcctactccagtgttaatc

SEQ ID NO: 315306 - DNA, 20 bp, Artificial
  CRISPR gRNA sequence
ctactccagtgttaatccct

SEQ ID NO: 315307 - DNA, 20 bp, Artificial
  CRISPR gRNA sequence
ctccagtgttaatccctttc

SEQ ID NO: 315308 - DNA, 20 bp, Artificial
  CRISPR gRNA sequence
cagtgttaatccctttctca

SEQ ID NO: 315309 - DNA, 20 bp, Artificial
  CRISPR gRNA sequence
atccctttctcagaggagac

SEQ ID NO: 315310 - DNA, 20 bp, Artificial
  CRISPR gRNA sequence
tctcagaggagacggtcctc

SEQ ID NO: 315311 - DNA, 20 bp, Artificial
  CRISPR gRNA sequence
ctcagaggagacggtcctca

SEQ ID NO: 315312 - DNA, 20 bp, Artificial
  CRISPR gRNA sequence
tcagaggagacggtcctcaa

SEQ ID NO: 315313 - DNA, 20 bp, Artificial
  CRISPR gRNA sequence
agaggagacggtcctcaaac

SEQ ID NO: 315314 - DNA, 20 bp, Artificial
  CRISPR gRNA sequence
aaactaactaacttggcacc

SEQ ID NO: 315315 - DNA, 20 bp, Artificial
  CRISPR gRNA sequence
actaacttggcaccaaaagt

SEQ ID NO: 315316 - DNA, 20 bp, Artificial
  CRISPR gRNA sequence
acttggcaccaaaagtccta

SEQ ID NO: 315317 - DNA, 20 bp, Artificial
  CRISPR gRNA sequence
ggcaccaaaagtcctatcca

SEQ ID NO: 315318 - DNA, 20 bp, Artificial
  CRISPR gRNA sequence
gcaccaaaagtcctatccag

SEQ ID NO: 315319 - DNA, 20 bp, Artificial
  CRISPR gRNA sequence
tccagtgttttctcattata

SEQ ID NO: 315320 - DNA, 20 bp, Artificial
  CRISPR gRNA sequence
tctcattatagtttttctat

SEQ ID NO: 315321 - DNA, 20 bp, Artificial
  CRISPR gRNA sequence
ctcattatagtttttctatg

SEQ ID NO: 315322 - DNA, 20 bp, Artificial
  CRISPR gRNA sequence
tcattatagtttttctatgc

SEQ ID NO: 315323 - DNA, 20 bp, Artificial
  CRISPR gRNA sequence
attatagtttttctatgcct

SEQ ID NO: 315324 - DNA, 20 bp, Artificial
  CRISPR gRNA sequence
tagtttttctatgcctcaac

SEQ ID NO: 315325 - DNA, 20 bp, Artificial
  CRISPR gRNA sequence
ttctatgcctcaactgtata

SEQ ID NO: 315326 - DNA, 20 bp, Artificial
  CRISPR gRNA sequence
tctatgcctcaactgtatat

SEQ ID NO: 315327 - DNA, 20 bp, Artificial
  CRISPR gRNA sequence
ctatgcctcaactgtatata

SEQ ID NO: 315328 - DNA, 20 bp, Artificial
  CRISPR gRNA sequence
tatgcctcaactgtatatat

SEQ ID NO: 315329 - DNA, 20 bp, Artificial
  CRISPR gRNA sequence
tgcctcaactgtatatattt

SEQ ID NO: 315330 - DNA, 20 bp, Artificial
  CRISPR gRNA sequence
aactgtatatatttacccag

SEQ ID NO: 315331 - DNA, 20 bp, Artificial
  CRISPR gRNA sequence
tatatatttacccagtttag

SEQ ID NO: 315332 - DNA, 20 bp, Artificial
  CRISPR gRNA sequence
acccagtttaggctgtttaa

SEQ ID NO: 315333 - DNA, 20 bp, Artificial
  CRISPR gRNA sequence
cccagtttaggctgtttaaa

SEQ ID NO: 315334 - DNA, 20 bp, Artificial
  CRISPR gRNA sequence
aggctgtttaaatgaataaa

SEQ ID NO: 315335 - DNA, 20 bp, Artificial
  CRISPR gRNA sequence
ggctgtttaaatgaataaaa

SEQ ID NO: 315336 - DNA, 20 bp, Artificial
  CRISPR gRNA sequence
tttaaatgaataaaaaggaa

SEQ ID NO: 315337 - DNA, 20 bp, Artificial
  CRISPR gRNA sequence
aaatgaataaaaaggaaatg

SEQ ID NO: 315338 - DNA, 20 bp, Artificial
  CRISPR gRNA sequence
aatgaataaaaaggaaatgc

SEQ ID NO: 315339 - DNA, 20 bp, Artificial
  CRISPR gRNA sequence
ttctagccagtttccaatct

SEQ ID NO: 315340 - DNA, 20 bp, Artificial
  CRISPR gRNA sequence
tagccagtttccaatctctc

SEQ ID NO: 315341 - DNA, 20 bp, Artificial
  CRISPR gRNA sequence
gccagtttccaatctctctt

SEQ ID NO: 315342 - DNA, 20 bp, Artificial
  CRISPR gRNA sequence
ccaatctctcttctcttttt

SEQ ID NO: 315343 - DNA, 20 bp, Artificial
  CRISPR gRNA sequence
caatctctcttctctttttt

SEQ ID NO: 315344 - DNA, 20 bp, Artificial
  CRISPR gRNA sequence
tcttctctttttttgttttg

SEQ ID NO: 315345 - DNA, 20 bp, Artificial
  CRISPR gRNA sequence
ttctctttttttgttttgtc

SEQ ID NO: 315346 - DNA, 20 bp, Artificial
  CRISPR gRNA sequence
ctctttttttgttttgtcaa

SEQ ID NO: 315347 - DNA, 20 bp, Artificial
  CRISPR gRNA sequence
tctttttttgttttgtcaaa

SEQ ID NO: 315348 - DNA, 20 bp, Artificial
  CRISPR gRNA sequence
tttttttgttttgtcaaata

SEQ ID NO: 315349 - DNA, 20 bp, Artificial
  CRISPR gRNA sequence
tttttgttttgtcaaatagg

SEQ ID NO: 315350 - DNA, 20 bp, Artificial
  CRISPR gRNA sequence
ttttgttttgtcaaataggg

SEQ ID NO: 315351 - DNA, 20 bp, Artificial
  CRISPR gRNA sequence
tttgttttgtcaaatagggc

SEQ ID NO: 315352 - DNA, 20 bp, Artificial
  CRISPR gRNA sequence
ttgttttgtcaaatagggca

SEQ ID NO: 315353 - DNA, 20 bp, Artificial
  CRISPR gRNA sequence
tgttttgtcaaatagggcag

SEQ ID NO: 315354 - DNA, 20 bp, Artificial
  CRISPR gRNA sequence
gttttgtcaaatagggcaga

SEQ ID NO: 315355 - DNA, 20 bp, Artificial
  CRISPR gRNA sequence
ttttgtcaaatagggcagat

SEQ ID NO: 315356 - DNA, 20 bp, Artificial
  CRISPR gRNA sequence
tgtcaaatagggcagataag

SEQ ID NO: 315357 - DNA, 20 bp, Artificial
  CRISPR gRNA sequence
gtcaaatagggcagataagg

SEQ ID NO: 315358 - DNA, 20 bp, Artificial
  CRISPR gRNA sequence
tcaaatagggcagataaggc

SEQ ID NO: 315359 - DNA, 20 bp, Artificial
  CRISPR gRNA sequence
ataactatgaattactgtct

SEQ ID NO: 315360 - DNA, 20 bp, Artificial
  CRISPR gRNA sequence
taactatgaattactgtctt

SEQ ID NO: 315361 - DNA, 20 bp, Artificial
  CRISPR gRNA sequence
tgaattactgtcttttccca

SEQ ID NO: 315362 - DNA, 20 bp, Artificial
  CRISPR gRNA sequence
ctgtcttttcccaaacagaa

SEQ ID NO: 315363 - DNA, 20 bp, Artificial
  CRISPR gRNA sequence
tcttttcccaaacagaaatc

SEQ ID NO: 315364 - DNA, 20 bp, Artificial
  CRISPR gRNA sequence
ttcccaaacagaaatcaccc

SEQ ID NO: 315365 - DNA, 20 bp, Artificial
  CRISPR gRNA sequence
tcccaaacagaaatcaccct

SEQ ID NO: 315366 - DNA, 20 bp, Artificial
  CRISPR gRNA sequence
cccaaacagaaatcacccta

SEQ ID NO: 315367 - DNA, 20 bp, Artificial
  CRISPR gRNA sequence
ccaaacagaaatcaccctat

SEQ ID NO: 315368 - DNA, 20 bp, Artificial
  CRISPR gRNA sequence
tcagcttacccattgggaga

SEQ ID NO: 315369 - DNA, 20 bp, Artificial
  CRISPR gRNA sequence
acccattgggagaaaaacta

SEQ ID NO: 315370 - DNA, 20 bp, Artificial
  CRISPR gRNA sequence
cccattgggagaaaaactaa

SEQ ID NO: 315371 - DNA, 20 bp, Artificial
  CRISPR gRNA sequence
ggagaaaaactaaaatagct

SEQ ID NO: 315372 - DNA, 20 bp, Artificial
  CRISPR gRNA sequence
aaatagctccccctgaaatt

SEQ ID NO: 315373 - DNA, 20 bp, Artificial
  CRISPR gRNA sequence
cccctgaaattttacttcct

SEQ ID NO: 315374 - DNA, 20 bp, Artificial
  CRISPR gRNA sequence
aaattttacttcctcatttg

SEQ ID NO: 315375 - DNA, 20 bp, Artificial
  CRISPR gRNA sequence
tacttcctcatttgggtctt

SEQ ID NO: 315376 - DNA, 20 bp, Artificial
  CRISPR gRNA sequence
acttcctcatttgggtcttg

SEQ ID NO: 315377 - DNA, 20 bp, Artificial
  CRISPR gRNA sequence
cttcctcatttgggtcttgt

SEQ ID NO: 315378 - DNA, 20 bp, Artificial
  CRISPR gRNA sequence
cctcatttgggtcttgtgtg

SEQ ID NO: 315379 - DNA, 20 bp, Artificial
  CRISPR gRNA sequence
ctcatttgggtcttgtgtga

SEQ ID NO: 315380 - DNA, 20 bp, Artificial
  CRISPR gRNA sequence
atttgggtcttgtgtgactg

SEQ ID NO: 315381 - DNA, 20 bp, Artificial
  CRISPR gRNA sequence
gggtcttgtgtgactgaaat

SEQ ID NO: 315382 - DNA, 20 bp, Artificial
  CRISPR gRNA sequence
ggtcttgtgtgactgaaatc

SEQ ID NO: 315383 - DNA, 20 bp, Artificial
  CRISPR gRNA sequence
gtgtgactgaaatctgtata

SEQ ID NO: 315384 - DNA, 20 bp, Artificial
  CRISPR gRNA sequence
tgtgactgaaatctgtatac

SEQ ID NO: 315385 - DNA, 20 bp, Artificial
  CRISPR gRNA sequence
aaatctgtatacaatgccct

SEQ ID NO: 315386 - DNA, 20 bp, Artificial
  CRISPR gRNA sequence
tatacaatgccctagcaaca

SEQ ID NO: 315387 - DNA, 20 bp, Artificial
  CRISPR gRNA sequence
gcaacaacggtttttacagc

SEQ ID NO: 315388 - DNA, 20 bp, Artificial
  CRISPR gRNA sequence
ttacagcttgcctccctaga

SEQ ID NO: 315389 - DNA, 20 bp, Artificial
  CRISPR gRNA sequence
tacagcttgcctccctagaa

SEQ ID NO: 315390 - DNA, 20 bp, Artificial
  CRISPR gRNA sequence
acagcttgcctccctagaac

SEQ ID NO: 315391 - DNA, 20 bp, Artificial
  CRISPR gRNA sequence
cagcttgcctccctagaaca

SEQ ID NO: 315392 - DNA, 20 bp, Artificial
  CRISPR gRNA sequence
gcctccctagaacaaaccta

SEQ ID NO: 315393 - DNA, 20 bp, Artificial
  CRISPR gRNA sequence
cctccctagaacaaacctag

SEQ ID NO: 315394 - DNA, 20 bp, Artificial
  CRISPR gRNA sequence
cctagaacaaacctaggagt

SEQ ID NO: 315395 - DNA, 20 bp, Artificial
  CRISPR gRNA sequence
gaacaaacctaggagtctca

SEQ ID NO: 315396 - DNA, 20 bp, Artificial
  CRISPR gRNA sequence
ggagtctcagctgtttcagg

SEQ ID NO: 315397 - DNA, 20 bp, Artificial
  CRISPR gRNA sequence
agctgtttcaggaatgattt

SEQ ID NO: 315398 - DNA, 20 bp, Artificial
  CRISPR gRNA sequence
tttcaggaatgatttcttaa

SEQ ID NO: 315399 - DNA, 20 bp, Artificial
  CRISPR gRNA sequence
caggaatgatttcttaaagg

SEQ ID NO: 315400 - DNA, 20 bp, Artificial
  CRISPR gRNA sequence
aggaatgatttcttaaaggt

SEQ ID NO: 315401 - DNA, 20 bp, Artificial
  CRISPR gRNA sequence
cttaaaggtaaagtgccttt

SEQ ID NO: 315402 - DNA, 20 bp, Artificial
  CRISPR gRNA sequence
ttaaaggtaaagtgcctttt

SEQ ID NO: 315403 - DNA, 20 bp, Artificial
  CRISPR gRNA sequence
aaaggtaaagtgcctttttc

SEQ ID NO: 315404 - DNA, 20 bp, Artificial
  CRISPR gRNA sequence
aaggtaaagtgcctttttca

SEQ ID NO: 315405 - DNA, 20 bp, Artificial
  CRISPR gRNA sequence
tttcaaaagaaattattatt

SEQ ID NO: 315406 - DNA, 20 bp, Artificial
  CRISPR gRNA sequence
ttcaaaagaaattattatta

SEQ ID NO: 315407 - DNA, 20 bp, Artificial
  CRISPR gRNA sequence
tcaaaagaaattattattat

SEQ ID NO: 315408 - DNA, 20 bp, Artificial
  CRISPR gRNA sequence
caaaagaaattattattatt

SEQ ID NO: 315409 - DNA, 20 bp, Artificial
  CRISPR gRNA sequence
aaaagaaattattattattt

SEQ ID NO: 315410 - DNA, 20 bp, Artificial
  CRISPR gRNA sequence
ttattatttttttttaattt

SEQ ID NO: 315411 - DNA, 20 bp, Artificial
  CRISPR gRNA sequence
ttatttttttttaatttttt

SEQ ID NO: 315412 - DNA, 20 bp, Artificial
  CRISPR gRNA sequence
tttttttttaattttttttt

SEQ ID NO: 315413 - DNA, 20 bp, Artificial
  CRISPR gRNA sequence
ttttttaattttttttttgt

SEQ ID NO: 315414 - DNA, 20 bp, Artificial
  CRISPR gRNA sequence
tttttaattttttttttgtg

SEQ ID NO: 315415 - DNA, 20 bp, Artificial
  CRISPR gRNA sequence
ttttaattttttttttgtgt

SEQ ID NO: 315416 - DNA, 20 bp, Artificial
  CRISPR gRNA sequence
tttaattttttttttgtgtg

SEQ ID NO: 315417 - DNA, 20 bp, Artificial
  CRISPR gRNA sequence
ttaattttttttttgtgtgt

SEQ ID NO: 315418 - DNA, 20 bp, Artificial
  CRISPR gRNA sequence
taattttttttttgtgtgtg

SEQ ID NO: 315419 - DNA, 20 bp, Artificial
  CRISPR gRNA sequence
aattttttttttgtgtgtgt

SEQ ID NO: 315420 - DNA, 20 bp, Artificial
  CRISPR gRNA sequence
attttttttttgtgtgtgtg

SEQ ID NO: 315421 - DNA, 20 bp, Artificial
  CRISPR gRNA sequence
tttttttgtgtgtgtgtgag

SEQ ID NO: 315422 - DNA, 20 bp, Artificial
  CRISPR gRNA sequence
ttttttgtgtgtgtgtgaga

SEQ ID NO: 315423 - DNA, 20 bp, Artificial
  CRISPR gRNA sequence
tttttgtgtgtgtgtgagac

SEQ ID NO: 315424 - DNA, 20 bp, Artificial
  CRISPR gRNA sequence
ttttgtgtgtgtgtgagaca

SEQ ID NO: 315425 - DNA, 20 bp, Artificial
  CRISPR gRNA sequence
tttgtgtgtgtgtgagacag

SEQ ID NO: 315426 - DNA, 20 bp, Artificial
  CRISPR gRNA sequence
ttgtgtgtgtgtgagacaga

SEQ ID NO: 315427 - DNA, 20 bp, Artificial
  CRISPR gRNA sequence
tgtgtgtgtgtgagacagag

SEQ ID NO: 315428 - DNA, 20 bp, Artificial
  CRISPR gRNA sequence
gtgtgtgtgtgagacagagc

SEQ ID NO: 315429 - DNA, 20 bp, Artificial
  CRISPR gRNA sequence
tgtgtgtgtgagacagagcc

SEQ ID NO: 315430 - DNA, 20 bp, Artificial
  CRISPR gRNA sequence
actctgtcaccaggctggag

SEQ ID NO: 315431 - DNA, 20 bp, Artificial
  CRISPR gRNA sequence
tgtcaccaggctggagtgca

SEQ ID NO: 315432 - DNA, 20 bp, Artificial
  CRISPR gRNA sequence
tcaccaggctggagtgcagt

SEQ ID NO: 315433 - DNA, 20 bp, Artificial
  CRISPR gRNA sequence
gagtgcagtggcacgatctc

SEQ ID NO: 315434 - DNA, 20 bp, Artificial
  CRISPR gRNA sequence
agcacactgcaacctctgcc

SEQ ID NO: 315435 - DNA, 20 bp, Artificial
  CRISPR gRNA sequence
caacctctgcctcccaggtt

SEQ ID NO: 315436 - DNA, 20 bp, Artificial
  CRISPR gRNA sequence
tgcctcccaggttcaagcga

SEQ ID NO: 315437 - DNA, 20 bp, Artificial
  CRISPR gRNA sequence
cctcccaggttcaagcgatt

SEQ ID NO: 315438 - DNA, 20 bp, Artificial
  CRISPR gRNA sequence
ccaggttcaagcgattctcc

SEQ ID NO: 315439 - DNA, 20 bp, Artificial
  CRISPR gRNA sequence
aagcgattctcctgcctcag

SEQ ID NO: 315440 - DNA, 20 bp, Artificial
  CRISPR gRNA sequence
tcctgcctcagcctcccaag

SEQ ID NO: 315441 - DNA, 20 bp, Artificial
  CRISPR gRNA sequence
ctgcctcagcctcccaagta

SEQ ID NO: 315442 - DNA, 20 bp, Artificial
  CRISPR gRNA sequence
cctcagcctcccaagtagct

SEQ ID NO: 315443 - DNA, 20 bp, Artificial
  CRISPR gRNA sequence
agcctcccaagtagctggga

SEQ ID NO: 315444 - DNA, 20 bp, Artificial
  CRISPR gRNA sequence
ccaagtagctgggactacag

SEQ ID NO: 315445 - DNA, 20 bp, Artificial
  CRISPR gRNA sequence
ggactacaggcacgtgccac

SEQ ID NO: 315446 - DNA, 20 bp, Artificial
  CRISPR gRNA sequence
caggcacgtgccaccaagcc

SEQ ID NO: 315447 - DNA, 20 bp, Artificial
  CRISPR gRNA sequence
ttgtattttcagtagagatg

SEQ ID NO: 315448 - DNA, 20 bp, Artificial
  CRISPR gRNA sequence
tgtattttcagtagagatgg

SEQ ID NO: 315449 - DNA, 20 bp, Artificial
  CRISPR gRNA sequence
gtattttcagtagagatggg

SEQ ID NO: 315450 - DNA, 20 bp, Artificial
  CRISPR gRNA sequence
tattttcagtagagatgggt

SEQ ID NO: 315451 - DNA, 20 bp, Artificial
  CRISPR gRNA sequence
tcagtagagatgggttttca

SEQ ID NO: 315452 - DNA, 20 bp, Artificial
  CRISPR gRNA sequence
cagtagagatgggttttcac

SEQ ID NO: 315453 - DNA, 20 bp, Artificial
  CRISPR gRNA sequence
agtagagatgggttttcacc

SEQ ID NO: 315454 - DNA, 20 bp, Artificial
  CRISPR gRNA sequence
tcaccatgttggccaggatg

SEQ ID NO: 315455 - DNA, 20 bp, Artificial
  CRISPR gRNA sequence
caccatgttggccaggatgg

SEQ ID NO: 315456 - DNA, 20 bp, Artificial
  CRISPR gRNA sequence
accatgttggccaggatggt

SEQ ID NO: 315457 - DNA, 20 bp, Artificial
  CRISPR gRNA sequence
gccaggatggtctcgatctc

SEQ ID NO: 315458 - DNA, 20 bp, Artificial
  CRISPR gRNA sequence
gatctcttgacctcgtgatc

SEQ ID NO: 315459 - DNA, 20 bp, Artificial
  CRISPR gRNA sequence
ttgacctcgtgatccgtttt

SEQ ID NO: 315460 - DNA, 20 bp, Artificial
  CRISPR gRNA sequence
gacctcgtgatccgttttta

SEQ ID NO: 315461 - DNA, 20 bp, Artificial
  CRISPR gRNA sequence
acctcgtgatccgtttttaa

SEQ ID NO: 315462 - DNA, 20 bp, Artificial
  CRISPR gRNA sequence
gtgatccgtttttaaccaac

SEQ ID NO: 315463 - DNA, 20 bp, Artificial
  CRISPR gRNA sequence
ttaaccaacatttaaacaga

SEQ ID NO: 315464 - DNA, 20 bp, Artificial
  CRISPR gRNA sequence
taaccaacatttaaacagaa

SEQ ID NO: 315465 - DNA, 20 bp, Artificial
  CRISPR gRNA sequence
aaccaacatttaaacagaaa

SEQ ID NO: 315466 - DNA, 20 bp, Artificial
  CRISPR gRNA sequence
accaacatttaaacagaaat

SEQ ID NO: 315467 - DNA, 20 bp, Artificial
  CRISPR gRNA sequence
aaacagaaatattcacaggc

SEQ ID NO: 315468 - DNA, 20 bp, Artificial
  CRISPR gRNA sequence
aacagaaatattcacaggct

SEQ ID NO: 315469 - DNA, 20 bp, Artificial
  CRISPR gRNA sequence
acaggcttaaagactgaaag

SEQ ID NO: 315470 - DNA, 20 bp, Artificial
  CRISPR gRNA sequence
aaagactgaaagttagtgat

SEQ ID NO: 315471 - DNA, 20 bp, Artificial
  CRISPR gRNA sequence
aagactgaaagttagtgata

SEQ ID NO: 315472 - DNA, 20 bp, Artificial
  CRISPR gRNA sequence
aaagttagtgatatcatcac

SEQ ID NO: 315473 - DNA, 20 bp, Artificial
  CRISPR gRNA sequence
gtgatatcatcacatttccc

SEQ ID NO: 315474 - DNA, 20 bp, Artificial
  CRISPR gRNA sequence
ccccttcaaaatgctgaatt

SEQ ID NO: 315475 - DNA, 20 bp, Artificial
  CRISPR gRNA sequence
cccttcaaaatgctgaattt

SEQ ID NO: 315476 - DNA, 20 bp, Artificial
  CRISPR gRNA sequence
caaaatgctgaatttgtaag

SEQ ID NO: 315477 - DNA, 20 bp, Artificial
  CRISPR gRNA sequence
aaaatgctgaatttgtaagc

SEQ ID NO: 315478 - DNA, 20 bp, Artificial
  CRISPR gRNA sequence
aatttgtaagcaaatttaaa

SEQ ID NO: 315479 - DNA, 20 bp, Artificial
  CRISPR gRNA sequence
gtaagcaaatttaaaagttt

SEQ ID NO: 315480 - DNA, 20 bp, Artificial
  CRISPR gRNA sequence
taagcaaatttaaaagttta

SEQ ID NO: 315481 - DNA, 20 bp, Artificial
  CRISPR gRNA sequence
aaaagtttagaatctacctt

SEQ ID NO: 315482 - DNA, 20 bp, Artificial
  CRISPR gRNA sequence
aaagtttagaatctaccttt

SEQ ID NO: 315483 - DNA, 20 bp, Artificial
  CRISPR gRNA sequence
agaatctaccttttaattgt

SEQ ID NO: 315484 - DNA, 20 bp, Artificial
  CRISPR gRNA sequence
gaatctaccttttaattgtc

SEQ ID NO: 315485 - DNA, 20 bp, Artificial
  CRISPR gRNA sequence
ccttttaattgtctgctttc

SEQ ID NO: 315486 - DNA, 20 bp, Artificial
  CRISPR gRNA sequence
ttaattgtctgctttcattt

SEQ ID NO: 315487 - DNA, 20 bp, Artificial
  CRISPR gRNA sequence
taattgtctgctttcatttt

SEQ ID NO: 315488 - DNA, 20 bp, Artificial
  CRISPR gRNA sequence
aattgtctgctttcattttt

SEQ ID NO: 315489 - DNA, 20 bp, Artificial
  CRISPR gRNA sequence
attgtctgctttcatttttt

SEQ ID NO: 315490 - DNA, 20 bp, Artificial
  CRISPR gRNA sequence
tctgctttcatttttttgac

SEQ ID NO: 315491 - DNA, 20 bp, Artificial
  CRISPR gRNA sequence
ctttcatttttttgacagtg

SEQ ID NO: 315492 - DNA, 20 bp, Artificial
  CRISPR gRNA sequence
tcatttttttgacagtggct

SEQ ID NO: 315493 - DNA, 20 bp, Artificial
  CRISPR gRNA sequence
catttttttgacagtggctt

SEQ ID NO: 315494 - DNA, 20 bp, Artificial
  CRISPR gRNA sequence
atttttttgacagtggcttt

SEQ ID NO: 315495 - DNA, 20 bp, Artificial
  CRISPR gRNA sequence
ttttgacagtggcttttttt

SEQ ID NO: 315496 - DNA, 20 bp, Artificial
  CRISPR gRNA sequence
tttgacagtggctttttttg

SEQ ID NO: 315497 - DNA, 20 bp, Artificial
  CRISPR gRNA sequence
ttgacagtggctttttttga

SEQ ID NO: 315498 - DNA, 20 bp, Artificial
  CRISPR gRNA sequence
tgacagtggctttttttgat

SEQ ID NO: 315499 - DNA, 20 bp, Artificial
  CRISPR gRNA sequence
gacagtggctttttttgata

SEQ ID NO: 315500 - DNA, 20 bp, Artificial
  CRISPR gRNA sequence
acagtggctttttttgatat

SEQ ID NO: 315501 - DNA, 20 bp, Artificial
  CRISPR gRNA sequence
tttttgatatggtgactatt

SEQ ID NO: 315502 - DNA, 20 bp, Artificial
  CRISPR gRNA sequence
ttttgatatggtgactattt

SEQ ID NO: 315503 - DNA, 20 bp, Artificial
  CRISPR gRNA sequence
tttgatatggtgactatttt

SEQ ID NO: 315504 - DNA, 20 bp, Artificial
  CRISPR gRNA sequence
ttgatatggtgactattttg

SEQ ID NO: 315505 - DNA, 20 bp, Artificial
  CRISPR gRNA sequence
tgatatggtgactattttgt

SEQ ID NO: 315506 - DNA, 20 bp, Artificial
  CRISPR gRNA sequence
gatatggtgactattttgtc

SEQ ID NO: 315507 - DNA, 20 bp, Artificial
  CRISPR gRNA sequence
atatggtgactattttgtca

SEQ ID NO: 315508 - DNA, 20 bp, Artificial
  CRISPR gRNA sequence
ttttgtcatgggtataaaag

SEQ ID NO: 315509 - DNA, 20 bp, Artificial
  CRISPR gRNA sequence
tgtcatgggtataaaaggat

SEQ ID NO: 315510 - DNA, 20 bp, Artificial
  CRISPR gRNA sequence
gtcatgggtataaaaggata

SEQ ID NO: 315511 - DNA, 20 bp, Artificial
  CRISPR gRNA sequence
tcatgggtataaaaggataa

SEQ ID NO: 315512 - DNA, 20 bp, Artificial
  CRISPR gRNA sequence
attttgtgttaatctgaaga

SEQ ID NO: 315513 - DNA, 20 bp, Artificial
  CRISPR gRNA sequence
tgtgttaatctgaagacatc

SEQ ID NO: 315514 - DNA, 20 bp, Artificial
  CRISPR gRNA sequence
gtgttaatctgaagacatct

SEQ ID NO: 315515 - DNA, 20 bp, Artificial
  CRISPR gRNA sequence
tgttaatctgaagacatctg

SEQ ID NO: 315516 - DNA, 20 bp, Artificial
  CRISPR gRNA sequence
atctgaagacatctgaaata

SEQ ID NO: 315517 - DNA, 20 bp, Artificial
  CRISPR gRNA sequence
aagacatctgaaatactgta

SEQ ID NO: 315518 - DNA, 20 bp, Artificial
  CRISPR gRNA sequence
aaatactgtattcaactata

SEQ ID NO: 315519 - DNA, 20 bp, Artificial
  CRISPR gRNA sequence
tattcaactataagtacctt

SEQ ID NO: 315520 - DNA, 20 bp, Artificial
  CRISPR gRNA sequence
aactataagtaccttttttt

SEQ ID NO: 315521 - DNA, 20 bp, Artificial
  CRISPR gRNA sequence
taagtacctttttttacatt

SEQ ID NO: 315522 - DNA, 20 bp, Artificial
  CRISPR gRNA sequence
tttttacatttataagattc

SEQ ID NO: 315523 - DNA, 20 bp, Artificial
  CRISPR gRNA sequence
ttttacatttataagattct

SEQ ID NO: 315524 - DNA, 20 bp, Artificial
  CRISPR gRNA sequence
tttacatttataagattctt

SEQ ID NO: 315525 - DNA, 20 bp, Artificial
  CRISPR gRNA sequence
ttacatttataagattcttt

SEQ ID NO: 315526 - DNA, 20 bp, Artificial
  CRISPR gRNA sequence
tacatttataagattctttt

SEQ ID NO: 315527 - DNA, 20 bp, Artificial
  CRISPR gRNA sequence
acatttataagattcttttt

SEQ ID NO: 315528 - DNA, 20 bp, Artificial
  CRISPR gRNA sequence
catttataagattctttttc

SEQ ID NO: 315529 - DNA, 20 bp, Artificial
  CRISPR gRNA sequence
ataagattctttttcaaaat

SEQ ID NO: 315530 - DNA, 20 bp, Artificial
  CRISPR gRNA sequence
taagattctttttcaaaatt

SEQ ID NO: 315531 - DNA, 20 bp, Artificial
  CRISPR gRNA sequence
tttttcaaaatttttatttg

SEQ ID NO: 315532 - DNA, 20 bp, Artificial
  CRISPR gRNA sequence
tttcaaaatttttatttgaa

SEQ ID NO: 315533 - DNA, 20 bp, Artificial
  CRISPR gRNA sequence
ttcaaaatttttatttgaat

SEQ ID NO: 315534 - DNA, 20 bp, Artificial
  CRISPR gRNA sequence
tcaaaatttttatttgaata

SEQ ID NO: 315535 - DNA, 20 bp, Artificial
  CRISPR gRNA sequence
caaaatttttatttgaatag

SEQ ID NO: 315536 - DNA, 20 bp, Artificial
  CRISPR gRNA sequence
aaaatttttatttgaatagt

SEQ ID NO: 315537 - DNA, 20 bp, Artificial
  CRISPR gRNA sequence
ttatttgaatagttttttgg

SEQ ID NO: 315538 - DNA, 20 bp, Artificial
  CRISPR gRNA sequence
tatttgaatagttttttggg

SEQ ID NO: 315539 - DNA, 20 bp, Artificial
  CRISPR gRNA sequence
atttgaatagttttttggga

SEQ ID NO: 315540 - DNA, 20 bp, Artificial
  CRISPR gRNA sequence
tttgaatagttttttgggaa

SEQ ID NO: 315541 - DNA, 20 bp, Artificial
  CRISPR gRNA sequence
gaatagttttttgggaacta

SEQ ID NO: 315542 - DNA, 20 bp, Artificial
  CRISPR gRNA sequence
aatagttttttgggaactac

SEQ ID NO: 315543 - DNA, 20 bp, Artificial
  CRISPR gRNA sequence
tttgggaactactgaactaa

SEQ ID NO: 315544 - DNA, 20 bp, Artificial
  CRISPR gRNA sequence
ttgggaactactgaactaaa

SEQ ID NO: 315545 - DNA, 20 bp, Artificial
  CRISPR gRNA sequence
tgggaactactgaactaaac

SEQ ID NO: 315546 - DNA, 20 bp, Artificial
  CRISPR gRNA sequence
gggaactactgaactaaact

SEQ ID NO: 315547 - DNA, 20 bp, Artificial
  CRISPR gRNA sequence
ggaactactgaactaaacta

SEQ ID NO: 315548 - DNA, 20 bp, Artificial
  CRISPR gRNA sequence
ctgaactaaactaggtggtt

SEQ ID NO: 315549 - DNA, 20 bp, Artificial
  CRISPR gRNA sequence
aactaaactaggtggttttt

SEQ ID NO: 315550 - DNA, 20 bp, Artificial
  CRISPR gRNA sequence
aactaggtggtttttggtta

SEQ ID NO: 315551 - DNA, 20 bp, Artificial
  CRISPR gRNA sequence
ggtggtttttggttacatgg

SEQ ID NO: 315552 - DNA, 20 bp, Artificial
  CRISPR gRNA sequence
ttggttacatggataagtta

SEQ ID NO: 315553 - DNA, 20 bp, Artificial
  CRISPR gRNA sequence
tggttacatggataagttat

SEQ ID NO: 315554 - DNA, 20 bp, Artificial
  CRISPR gRNA sequence
ggttacatggataagttatt

SEQ ID NO: 315555 - DNA, 20 bp, Artificial
  CRISPR gRNA sequence
gttacatggataagttattt

SEQ ID NO: 315556 - DNA, 20 bp, Artificial
  CRISPR gRNA sequence
catggataagttatttagtg

SEQ ID NO: 315557 - DNA, 20 bp, Artificial
  CRISPR gRNA sequence
tttagtggtgatttctgaga

SEQ ID NO: 315558 - DNA, 20 bp, Artificial
  CRISPR gRNA sequence
agtggtgatttctgagactt

SEQ ID NO: 315559 - DNA, 20 bp, Artificial
  CRISPR gRNA sequence
gtggtgatttctgagacttt

SEQ ID NO: 315560 - DNA, 20 bp, Artificial
  CRISPR gRNA sequence
ctgagactttggtgccacct

SEQ ID NO: 315561 - DNA, 20 bp, Artificial
  CRISPR gRNA sequence
tgagactttggtgccacctg

SEQ ID NO: 315562 - DNA, 20 bp, Artificial
  CRISPR gRNA sequence
agactttggtgccacctgtc

SEQ ID NO: 315563 - DNA, 20 bp, Artificial
  CRISPR gRNA sequence
tggtgccacctgtcactcga

SEQ ID NO: 315564 - DNA, 20 bp, Artificial
  CRISPR gRNA sequence
ggtgccacctgtcactcgag

SEQ ID NO: 315565 - DNA, 20 bp, Artificial
  CRISPR gRNA sequence
gtgccacctgtcactcgagc

SEQ ID NO: 315566 - DNA, 20 bp, Artificial
  CRISPR gRNA sequence
tcactcgagcagtgtacact

SEQ ID NO: 315567 - DNA, 20 bp, Artificial
  CRISPR gRNA sequence
gagcagtgtacactgcacca

SEQ ID NO: 315568 - DNA, 20 bp, Artificial
  CRISPR gRNA sequence
caccagtgtgtagtctttta

SEQ ID NO: 315569 - DNA, 20 bp, Artificial
  CRISPR gRNA sequence
ttatctctcacccctcccac

SEQ ID NO: 315570 - DNA, 20 bp, Artificial
  CRISPR gRNA sequence
tatctctcacccctcccact

SEQ ID NO: 315571 - DNA, 20 bp, Artificial
  CRISPR gRNA sequence
atctctcacccctcccactc

SEQ ID NO: 315572 - DNA, 20 bp, Artificial
  CRISPR gRNA sequence
tctctcacccctcccactct

SEQ ID NO: 315573 - DNA, 20 bp, Artificial
  CRISPR gRNA sequence
tcacccctcccactctttcc

SEQ ID NO: 315574 - DNA, 20 bp, Artificial
  CRISPR gRNA sequence
acccctcccactctttcctc

SEQ ID NO: 315575 - DNA, 20 bp, Artificial
  CRISPR gRNA sequence
ccactctttcctctgagtcc

SEQ ID NO: 315576 - DNA, 20 bp, Artificial
  CRISPR gRNA sequence
tttcctctgagtccccaaag

SEQ ID NO: 315577 - DNA, 20 bp, Artificial
  CRISPR gRNA sequence
tcctctgagtccccaaagtc

SEQ ID NO: 315578 - DNA, 20 bp, Artificial
  CRISPR gRNA sequence
cctctgagtccccaaagtcc

SEQ ID NO: 315579 - DNA, 20 bp, Artificial
  CRISPR gRNA sequence
ctctgagtccccaaagtcca

SEQ ID NO: 315580 - DNA, 20 bp, Artificial
  CRISPR gRNA sequence
tgagtccccaaagtccatta

SEQ ID NO: 315581 - DNA, 20 bp, Artificial
  CRISPR gRNA sequence
agtccccaaagtccattata

SEQ ID NO: 315582 - DNA, 20 bp, Artificial
  CRISPR gRNA sequence
tattattcttatgtctttgc

SEQ ID NO: 315583 - DNA, 20 bp, Artificial
  CRISPR gRNA sequence
ttcttatgtctttgcatcct

SEQ ID NO: 315584 - DNA, 20 bp, Artificial
  CRISPR gRNA sequence
ttatgtctttgcatcctcat

SEQ ID NO: 315585 - DNA, 20 bp, Artificial
  CRISPR gRNA sequence
atgtctttgcatcctcatag

SEQ ID NO: 315586 - DNA, 20 bp, Artificial
  CRISPR gRNA sequence
tgtctttgcatcctcatagt

SEQ ID NO: 315587 - DNA, 20 bp, Artificial
  CRISPR gRNA sequence
tgcatcctcatagtttagct

SEQ ID NO: 315588 - DNA, 20 bp, Artificial
  CRISPR gRNA sequence
gcatcctcatagtttagctc

SEQ ID NO: 315589 - DNA, 20 bp, Artificial
  CRISPR gRNA sequence
catcctcatagtttagctcc

SEQ ID NO: 315590 - DNA, 20 bp, Artificial
  CRISPR gRNA sequence
atagtttagctcccacttat

SEQ ID NO: 315591 - DNA, 20 bp, Artificial
  CRISPR gRNA sequence
agctcccacttatcagtgaa

SEQ ID NO: 315592 - DNA, 20 bp, Artificial
  CRISPR gRNA sequence
gctcccacttatcagtgaaa

SEQ ID NO: 315593 - DNA, 20 bp, Artificial
  CRISPR gRNA sequence
ccacttatcagtgaaaacat

SEQ ID NO: 315594 - DNA, 20 bp, Artificial
  CRISPR gRNA sequence
atcagtgaaaacatacaata

SEQ ID NO: 315595 - DNA, 20 bp, Artificial
  CRISPR gRNA sequence
tcagtgaaaacatacaatat

SEQ ID NO: 315596 - DNA, 20 bp, Artificial
  CRISPR gRNA sequence
gtttctccattcttgagtta

SEQ ID NO: 315597 - DNA, 20 bp, Artificial
  CRISPR gRNA sequence
tttctccattcttgagttac

SEQ ID NO: 315598 - DNA, 20 bp, Artificial
  CRISPR gRNA sequence
ctccattcttgagttacttc

SEQ ID NO: 315599 - DNA, 20 bp, Artificial
  CRISPR gRNA sequence
tccattcttgagttacttca

SEQ ID NO: 315600 - DNA, 20 bp, Artificial
  CRISPR gRNA sequence
cattcttgagttacttcact

SEQ ID NO: 315601 - DNA, 20 bp, Artificial
  CRISPR gRNA sequence
ttgagttacttcacttagaa

SEQ ID NO: 315602 - DNA, 20 bp, Artificial
  CRISPR gRNA sequence
gagttacttcacttagaata

SEQ ID NO: 315603 - DNA, 20 bp, Artificial
  CRISPR gRNA sequence
agttacttcacttagaataa

SEQ ID NO: 315604 - DNA, 20 bp, Artificial
  CRISPR gRNA sequence
cttcacttagaataatggtc

SEQ ID NO: 315605 - DNA, 20 bp, Artificial
  CRISPR gRNA sequence
cacttagaataatggtctct

SEQ ID NO: 315606 - DNA, 20 bp, Artificial
  CRISPR gRNA sequence
acttagaataatggtctctg

SEQ ID NO: 315607 - DNA, 20 bp, Artificial
  CRISPR gRNA sequence
agaataatggtctctggttc

SEQ ID NO: 315608 - DNA, 20 bp, Artificial
  CRISPR gRNA sequence
gaataatggtctctggttcc

SEQ ID NO: 315609 - DNA, 20 bp, Artificial
  CRISPR gRNA sequence
tggttccatcaaagttgctg

SEQ ID NO: 315610 - DNA, 20 bp, Artificial
  CRISPR gRNA sequence
gttccatcaaagttgctgca

SEQ ID NO: 315611 - DNA, 20 bp, Artificial
  CRISPR gRNA sequence
catcaaagttgctgcaaatg

SEQ ID NO: 315612 - DNA, 20 bp, Artificial
  CRISPR gRNA sequence
ctgcaaatgccattattttg

SEQ ID NO: 315613 - DNA, 20 bp, Artificial
  CRISPR gRNA sequence
caaatgccattattttgttt

SEQ ID NO: 315614 - DNA, 20 bp, Artificial
  CRISPR gRNA sequence
ttttgtttctttttatggct

SEQ ID NO: 315615 - DNA, 20 bp, Artificial
  CRISPR gRNA sequence
tgtttctttttatggctgag

SEQ ID NO: 315616 - DNA, 20 bp, Artificial
  CRISPR gRNA sequence
gtttctttttatggctgagt

SEQ ID NO: 315617 - DNA, 20 bp, Artificial
  CRISPR gRNA sequence
tttctttttatggctgagta

SEQ ID NO: 315618 - DNA, 20 bp, Artificial
  CRISPR gRNA sequence
ctttttatggctgagtaata

SEQ ID NO: 315619 - DNA, 20 bp, Artificial
  CRISPR gRNA sequence
tttttatggctgagtaatat

SEQ ID NO: 315620 - DNA, 20 bp, Artificial
  CRISPR gRNA sequence
tttatggctgagtaatattc

SEQ ID NO: 315621 - DNA, 20 bp, Artificial
  CRISPR gRNA sequence
ttatggctgagtaatattcc

SEQ ID NO: 315622 - DNA, 20 bp, Artificial
  CRISPR gRNA sequence
tatggctgagtaatattcca

SEQ ID NO: 315623 - DNA, 20 bp, Artificial
  CRISPR gRNA sequence
atggctgagtaatattccat

SEQ ID NO: 315624 - DNA, 20 bp, Artificial
  CRISPR gRNA sequence
tggctgagtaatattccatg

SEQ ID NO: 315625 - DNA, 20 bp, Artificial
  CRISPR gRNA sequence
agtaatattccatgagggat

SEQ ID NO: 315626 - DNA, 20 bp, Artificial
  CRISPR gRNA sequence
catgagggatatttaccaca

SEQ ID NO: 315627 - DNA, 20 bp, Artificial
  CRISPR gRNA sequence
accacattttccttatccac

SEQ ID NO: 315628 - DNA, 20 bp, Artificial
  CRISPR gRNA sequence
ccacattttccttatccact

SEQ ID NO: 315629 - DNA, 20 bp, Artificial
  CRISPR gRNA sequence
tccttatccactcatgggtt

SEQ ID NO: 315630 - DNA, 20 bp, Artificial
  CRISPR gRNA sequence
ccttatccactcatgggttg

SEQ ID NO: 315631 - DNA, 20 bp, Artificial
  CRISPR gRNA sequence
cttatccactcatgggttga

SEQ ID NO: 315632 - DNA, 20 bp, Artificial
  CRISPR gRNA sequence
atccactcatgggttgatgg

SEQ ID NO: 315633 - DNA, 20 bp, Artificial
  CRISPR gRNA sequence
tccactcatgggttgatgga

SEQ ID NO: 315634 - DNA, 20 bp, Artificial
  CRISPR gRNA sequence
atgggttgatggacatttag

SEQ ID NO: 315635 - DNA, 20 bp, Artificial
  CRISPR gRNA sequence
atggacatttaggttggttc

SEQ ID NO: 315636 - DNA, 20 bp, Artificial
  CRISPR gRNA sequence
aggttggttccttatttttg

SEQ ID NO: 315637 - DNA, 20 bp, Artificial
  CRISPR gRNA sequence
ggttggttccttatttttgg

SEQ ID NO: 315638 - DNA, 20 bp, Artificial
  CRISPR gRNA sequence
gttccttatttttggaattg

SEQ ID NO: 315639 - DNA, 20 bp, Artificial
  CRISPR gRNA sequence
cttatttttggaattgcaaa

SEQ ID NO: 315640 - DNA, 20 bp, Artificial
  CRISPR gRNA sequence
atttttggaattgcaaattg

SEQ ID NO: 315641 - DNA, 20 bp, Artificial
  CRISPR gRNA sequence
tttttggaattgcaaattgt

SEQ ID NO: 315642 - DNA, 20 bp, Artificial
  CRISPR gRNA sequence
ttggaattgcaaattgtgct

SEQ ID NO: 315643 - DNA, 20 bp, Artificial
  CRISPR gRNA sequence
tggaattgcaaattgtgctg

SEQ ID NO: 315644 - DNA, 20 bp, Artificial
  CRISPR gRNA sequence
ggaattgcaaattgtgctgc

SEQ ID NO: 315645 - DNA, 20 bp, Artificial
  CRISPR gRNA sequence
gaattgcaaattgtgctgct

SEQ ID NO: 315646 - DNA, 20 bp, Artificial
  CRISPR gRNA sequence
caaattgtgctgctataaac

SEQ ID NO: 315647 - DNA, 20 bp, Artificial
  CRISPR gRNA sequence
tgctgctataaacatgcgtg

SEQ ID NO: 315648 - DNA, 20 bp, Artificial
  CRISPR gRNA sequence
ctataaacatgcgtgtgcat

SEQ ID NO: 315649 - DNA, 20 bp, Artificial
  CRISPR gRNA sequence
taaacatgcgtgtgcatgtg

SEQ ID NO: 315650 - DNA, 20 bp, Artificial
  CRISPR gRNA sequence
tttcatataatgaattattt

SEQ ID NO: 315651 - DNA, 20 bp, Artificial
  CRISPR gRNA sequence
ttcatataatgaattatttt

SEQ ID NO: 315652 - DNA, 20 bp, Artificial
  CRISPR gRNA sequence
tcatataatgaattattttc

SEQ ID NO: 315653 - DNA, 20 bp, Artificial
  CRISPR gRNA sequence
catataatgaattattttcc

SEQ ID NO: 315654 - DNA, 20 bp, Artificial
  CRISPR gRNA sequence
atataatgaattattttcct

SEQ ID NO: 315655 - DNA, 20 bp, Artificial
  CRISPR gRNA sequence
ttttcctttgggtatatacc

SEQ ID NO: 315656 - DNA, 20 bp, Artificial
  CRISPR gRNA sequence
tcctttgggtatatacccag

SEQ ID NO: 315657 - DNA, 20 bp, Artificial
  CRISPR gRNA sequence
cctttgggtatatacccagt

SEQ ID NO: 315658 - DNA, 20 bp, Artificial
  CRISPR gRNA sequence
ctttgggtatatacccagta

SEQ ID NO: 315659 - DNA, 20 bp, Artificial
  CRISPR gRNA sequence
tgggtatatacccagtagta

SEQ ID NO: 315660 - DNA, 20 bp, Artificial
  CRISPR gRNA sequence
gggtatatacccagtagtag

SEQ ID NO: 315661 - DNA, 20 bp, Artificial
  CRISPR gRNA sequence
ggtatatacccagtagtagg

SEQ ID NO: 315662 - DNA, 20 bp, Artificial
  CRISPR gRNA sequence
ctgaattaaatagtagagtt

SEQ ID NO: 315663 - DNA, 20 bp, Artificial
  CRISPR gRNA sequence
aattaaatagtagagttcta

SEQ ID NO: 315664 - DNA, 20 bp, Artificial
  CRISPR gRNA sequence
aatagtagagttctactttt

SEQ ID NO: 315665 - DNA, 20 bp, Artificial
  CRISPR gRNA sequence
tacttttagttctttaagga

SEQ ID NO: 315666 - DNA, 20 bp, Artificial
  CRISPR gRNA sequence
cttttagttctttaaggaat

SEQ ID NO: 315667 - DNA, 20 bp, Artificial
  CRISPR gRNA sequence
ttagttctttaaggaatctc

SEQ ID NO: 315668 - DNA, 20 bp, Artificial
  CRISPR gRNA sequence
tagttctttaaggaatctcc

SEQ ID NO: 315669 - DNA, 20 bp, Artificial
  CRISPR gRNA sequence
agttctttaaggaatctcca

SEQ ID NO: 315670 - DNA, 20 bp, Artificial
  CRISPR gRNA sequence
gttctttaaggaatctccat

SEQ ID NO: 315671 - DNA, 20 bp, Artificial
  CRISPR gRNA sequence
tttaaggaatctccatactg

SEQ ID NO: 315672 - DNA, 20 bp, Artificial
  CRISPR gRNA sequence
taaggaatctccatactgtt

SEQ ID NO: 315673 - DNA, 20 bp, Artificial
  CRISPR gRNA sequence
aaggaatctccatactgttt

SEQ ID NO: 315674 - DNA, 20 bp, Artificial
  CRISPR gRNA sequence
aggaatctccatactgtttt

SEQ ID NO: 315675 - DNA, 20 bp, Artificial
  CRISPR gRNA sequence
catactgttttccatagtgt

SEQ ID NO: 315676 - DNA, 20 bp, Artificial
  CRISPR gRNA sequence
ttttccatagtgtttgtact

SEQ ID NO: 315677 - DNA, 20 bp, Artificial
  CRISPR gRNA sequence
tccatagtgtttgtactagt

SEQ ID NO: 315678 - DNA, 20 bp, Artificial
  CRISPR gRNA sequence
ccatagtgtttgtactagtt

SEQ ID NO: 315679 - DNA, 20 bp, Artificial
  CRISPR gRNA sequence
catagtgtttgtactagttt

SEQ ID NO: 315680 - DNA, 20 bp, Artificial
  CRISPR gRNA sequence
gtactagtttacattcccac

SEQ ID NO: 315681 - DNA, 20 bp, Artificial
  CRISPR gRNA sequence
tactagtttacattcccacc

SEQ ID NO: 315682 - DNA, 20 bp, Artificial
  CRISPR gRNA sequence
gtttacattcccaccagcag

SEQ ID NO: 315683 - DNA, 20 bp, Artificial
  CRISPR gRNA sequence
acattcccaccagcagtgta

SEQ ID NO: 315684 - DNA, 20 bp, Artificial
  CRISPR gRNA sequence
cattcccaccagcagtgtaa

SEQ ID NO: 315685 - DNA, 20 bp, Artificial
  CRISPR gRNA sequence
ccaccagcagtgtaaacatg

SEQ ID NO: 315686 - DNA, 20 bp, Artificial
  CRISPR gRNA sequence
ccttttcaccacatccatgc

SEQ ID NO: 315687 - DNA, 20 bp, Artificial
  CRISPR gRNA sequence
ttcaccacatccatgccaac

SEQ ID NO: 315688 - DNA, 20 bp, Artificial
  CRISPR gRNA sequence
tcaccacatccatgccaaca

SEQ ID NO: 315689 - DNA, 20 bp, Artificial
  CRISPR gRNA sequence
caccacatccatgccaacat

SEQ ID NO: 315690 - DNA, 20 bp, Artificial
  CRISPR gRNA sequence
accacatccatgccaacatc

SEQ ID NO: 315691 - DNA, 20 bp, Artificial
  CRISPR gRNA sequence
ttattttttgattttttaat

SEQ ID NO: 315692 - DNA, 20 bp, Artificial
  CRISPR gRNA sequence
ttttttgattttttaataat

SEQ ID NO: 315693 - DNA, 20 bp, Artificial
  CRISPR gRNA sequence
tttgattttttaataatggc

SEQ ID NO: 315694 - DNA, 20 bp, Artificial
  CRISPR gRNA sequence
ttgattttttaataatggcc

SEQ ID NO: 315695 - DNA, 20 bp, Artificial
  CRISPR gRNA sequence
tgattttttaataatggcca

SEQ ID NO: 315696 - DNA, 20 bp, Artificial
  CRISPR gRNA sequence
gattttttaataatggccat

SEQ ID NO: 315697 - DNA, 20 bp, Artificial
  CRISPR gRNA sequence
attttttaataatggccatt

SEQ ID NO: 315698 - DNA, 20 bp, Artificial
  CRISPR gRNA sequence
tttaataatggccattcttg

SEQ ID NO: 315699 - DNA, 20 bp, Artificial
  CRISPR gRNA sequence
ttaataatggccattcttgc

SEQ ID NO: 315700 - DNA, 20 bp, Artificial
  CRISPR gRNA sequence
taataatggccattcttgca

SEQ ID NO: 315701 - DNA, 20 bp, Artificial
  CRISPR gRNA sequence
aataatggccattcttgcag

SEQ ID NO: 315702 - DNA, 20 bp, Artificial
  CRISPR gRNA sequence
ataatggccattcttgcagg

SEQ ID NO: 315703 - DNA, 20 bp, Artificial
  CRISPR gRNA sequence
ttgcaggagtaaggtggtat

SEQ ID NO: 315704 - DNA, 20 bp, Artificial
  CRISPR gRNA sequence
gcaggagtaaggtggtatct

SEQ ID NO: 315705 - DNA, 20 bp, Artificial
  CRISPR gRNA sequence
caggagtaaggtggtatctc

SEQ ID NO: 315706 - DNA, 20 bp, Artificial
  CRISPR gRNA sequence
atggtggttttaatttgcat

SEQ ID NO: 315707 - DNA, 20 bp, Artificial
  CRISPR gRNA sequence
taatttgcatttccctgata

SEQ ID NO: 315708 - DNA, 20 bp, Artificial
  CRISPR gRNA sequence
aatttgcatttccctgatag

SEQ ID NO: 315709 - DNA, 20 bp, Artificial
  CRISPR gRNA sequence
atttgcatttccctgatagt

SEQ ID NO: 315710 - DNA, 20 bp, Artificial
  CRISPR gRNA sequence
gcatttccctgatagttagt

SEQ ID NO: 315711 - DNA, 20 bp, Artificial
  CRISPR gRNA sequence
catttccctgatagttagtg

SEQ ID NO: 315712 - DNA, 20 bp, Artificial
  CRISPR gRNA sequence
ccctgatagttagtgatatt

SEQ ID NO: 315713 - DNA, 20 bp, Artificial
  CRISPR gRNA sequence
cctgatagttagtgatattg

SEQ ID NO: 315714 - DNA, 20 bp, Artificial
  CRISPR gRNA sequence
atagttagtgatattgaact

SEQ ID NO: 315715 - DNA, 20 bp, Artificial
  CRISPR gRNA sequence
gtgatattgaactttttttc

SEQ ID NO: 315716 - DNA, 20 bp, Artificial
  CRISPR gRNA sequence
aactttttttcatgtttgtt

SEQ ID NO: 315717 - DNA, 20 bp, Artificial
  CRISPR gRNA sequence
tttttcatgtttgttggcca

SEQ ID NO: 315718 - DNA, 20 bp, Artificial
  CRISPR gRNA sequence
ttttcatgtttgttggccat

SEQ ID NO: 315719 - DNA, 20 bp, Artificial
  CRISPR gRNA sequence
tttcatgtttgttggccatt

SEQ ID NO: 315720 - DNA, 20 bp, Artificial
  CRISPR gRNA sequence
ttcatgtttgttggccattt

SEQ ID NO: 315721 - DNA, 20 bp, Artificial
  CRISPR gRNA sequence
tcatgtttgttggccatttg

SEQ ID NO: 315722 - DNA, 20 bp, Artificial
  CRISPR gRNA sequence
catgtttgttggccatttgt

SEQ ID NO: 315723 - DNA, 20 bp, Artificial
  CRISPR gRNA sequence
atgtttgttggccatttgta

SEQ ID NO: 315724 - DNA, 20 bp, Artificial
  CRISPR gRNA sequence
gttggccatttgtatatttt

SEQ ID NO: 315725 - DNA, 20 bp, Artificial
  CRISPR gRNA sequence
ttggccatttgtatattttc

SEQ ID NO: 315726 - DNA, 20 bp, Artificial
  CRISPR gRNA sequence
gccatttgtatattttcttt

SEQ ID NO: 315727 - DNA, 20 bp, Artificial
  CRISPR gRNA sequence
gtatattttcttttcagaat

SEQ ID NO: 315728 - DNA, 20 bp, Artificial
  CRISPR gRNA sequence
tatattttcttttcagaatt

SEQ ID NO: 315729 - DNA, 20 bp, Artificial
  CRISPR gRNA sequence
tcttttcagaattgtctatt

SEQ ID NO: 315730 - DNA, 20 bp, Artificial
  CRISPR gRNA sequence
cttttcagaattgtctattc

SEQ ID NO: 315731 - DNA, 20 bp, Artificial
  CRISPR gRNA sequence
ttttcagaattgtctattca

SEQ ID NO: 315732 - DNA, 20 bp, Artificial
  CRISPR gRNA sequence
ttcagaattgtctattcatg

SEQ ID NO: 315733 - DNA, 20 bp, Artificial
  CRISPR gRNA sequence
tcagaattgtctattcatgt

SEQ ID NO: 315734 - DNA, 20 bp, Artificial
  CRISPR gRNA sequence
cagaattgtctattcatgtc

SEQ ID NO: 315735 - DNA, 20 bp, Artificial
  CRISPR gRNA sequence
agaattgtctattcatgtcc

SEQ ID NO: 315736 - DNA, 20 bp, Artificial
  CRISPR gRNA sequence
tctattcatgtccttataaa

SEQ ID NO: 315737 - DNA, 20 bp, Artificial
  CRISPR gRNA sequence
ttcatgtccttataaacacc

SEQ ID NO: 315738 - DNA, 20 bp, Artificial
  CRISPR gRNA sequence
atgtccttataaacaccatt

SEQ ID NO: 315739 - DNA, 20 bp, Artificial
  CRISPR gRNA sequence
ataaacaccattatttttaa

SEQ ID NO: 315740 - DNA, 20 bp, Artificial
  CRISPR gRNA sequence
taaacaccattatttttaag

SEQ ID NO: 315741 - DNA, 20 bp, Artificial
  CRISPR gRNA sequence
tttttaagaagaaactttac

SEQ ID NO: 315742 - DNA, 20 bp, Artificial
  CRISPR gRNA sequence
ttaagaagaaactttacaaa

SEQ ID NO: 315743 - DNA, 20 bp, Artificial
  CRISPR gRNA sequence
taagaagaaactttacaaaa

SEQ ID NO: 315744 - DNA, 20 bp, Artificial
  CRISPR gRNA sequence
aagaagaaactttacaaaaa

SEQ ID NO: 315745 - DNA, 20 bp, Artificial
  CRISPR gRNA sequence
agaagaaactttacaaaaat

SEQ ID NO: 315746 - DNA, 20 bp, Artificial
  CRISPR gRNA sequence
tacaaaaatagaacataacc

SEQ ID NO: 315747 - DNA, 20 bp, Artificial
  CRISPR gRNA sequence
acaaaaatagaacataacca

SEQ ID NO: 315748 - DNA, 20 bp, Artificial
  CRISPR gRNA sequence
caaaaatagaacataaccag

SEQ ID NO: 315749 - DNA, 20 bp, Artificial
  CRISPR gRNA sequence
ataaagcatctgggaactca

SEQ ID NO: 315750 - DNA, 20 bp, Artificial
  CRISPR gRNA sequence
taaagcatctgggaactcag

SEQ ID NO: 315751 - DNA, 20 bp, Artificial
  CRISPR gRNA sequence
ggaactcagtcaattaagaa

SEQ ID NO: 315752 - DNA, 20 bp, Artificial
  CRISPR gRNA sequence
agtcaattaagaaatagctc

SEQ ID NO: 315753 - DNA, 20 bp, Artificial
  CRISPR gRNA sequence
agaaatagctcaagtaactg

SEQ ID NO: 315754 - DNA, 20 bp, Artificial
  CRISPR gRNA sequence
aagtaactgatgatgcttca

SEQ ID NO: 315755 - DNA, 20 bp, Artificial
  CRISPR gRNA sequence
atgatgcttcacctgaaaga

SEQ ID NO: 315756 - DNA, 20 bp, Artificial
  CRISPR gRNA sequence
cacctgaaagaaggcctgga

SEQ ID NO: 315757 - DNA, 20 bp, Artificial
  CRISPR gRNA sequence
acctgaaagaaggcctggag

SEQ ID NO: 315758 - DNA, 20 bp, Artificial
  CRISPR gRNA sequence
aaagaaggcctggagagaac

SEQ ID NO: 315759 - DNA, 20 bp, Artificial
  CRISPR gRNA sequence
gagagaacagagatactgtc

SEQ ID NO: 315760 - DNA, 20 bp, Artificial
  CRISPR gRNA sequence
tcttcaaatatctgaagagc

SEQ ID NO: 315761 - DNA, 20 bp, Artificial
  CRISPR gRNA sequence
caaatatctgaagagctacc

SEQ ID NO: 315762 - DNA, 20 bp, Artificial
  CRISPR gRNA sequence
aaatatctgaagagctacca

SEQ ID NO: 315763 - DNA, 20 bp, Artificial
  CRISPR gRNA sequence
aagagctaccatgggatgca

SEQ ID NO: 315764 - DNA, 20 bp, Artificial
  CRISPR gRNA sequence
ccatgggatgcaaagattga

SEQ ID NO: 315765 - DNA, 20 bp, Artificial
  CRISPR gRNA sequence
agcttgatggtatgactctg

SEQ ID NO: 315766 - DNA, 20 bp, Artificial
  CRISPR gRNA sequence
gatggtatgactctgaaggg

SEQ ID NO: 315767 - DNA, 20 bp, Artificial
  CRISPR gRNA sequence
atggtatgactctgaagggc

SEQ ID NO: 315768 - DNA, 20 bp, Artificial
  CRISPR gRNA sequence
tgaagggcatctctatgaat

SEQ ID NO: 315769 - DNA, 20 bp, Artificial
  CRISPR gRNA sequence
aagggcatctctatgaatga

SEQ ID NO: 315770 - DNA, 20 bp, Artificial
  CRISPR gRNA sequence
tatgaatgaaggttatgaga

SEQ ID NO: 315771 - DNA, 20 bp, Artificial
  CRISPR gRNA sequence
tgaatgaaggttatgagagg

SEQ ID NO: 315772 - DNA, 20 bp, Artificial
  CRISPR gRNA sequence
tgagagggtataaggaatta

SEQ ID NO: 315773 - DNA, 20 bp, Artificial
  CRISPR gRNA sequence
agagagacttttctaacaat

SEQ ID NO: 315774 - DNA, 20 bp, Artificial
  CRISPR gRNA sequence
ttctaacaattaaaaggtct

SEQ ID NO: 315775 - DNA, 20 bp, Artificial
  CRISPR gRNA sequence
tctaacaattaaaaggtctt

SEQ ID NO: 315776 - DNA, 20 bp, Artificial
  CRISPR gRNA sequence
ctaacaattaaaaggtcttt

SEQ ID NO: 315777 - DNA, 20 bp, Artificial
  CRISPR gRNA sequence
taacaattaaaaggtctttt

SEQ ID NO: 315778 - DNA, 20 bp, Artificial
  CRISPR gRNA sequence
acaattaaaaggtcttttag

SEQ ID NO: 315779 - DNA, 20 bp, Artificial
  CRISPR gRNA sequence
aaaggtcttttaggccaggg

SEQ ID NO: 315780 - DNA, 20 bp, Artificial
  CRISPR gRNA sequence
ttaggccaggggtggtggct

SEQ ID NO: 315781 - DNA, 20 bp, Artificial
  CRISPR gRNA sequence
taggccaggggtggtggctc

SEQ ID NO: 315782 - DNA, 20 bp, Artificial
  CRISPR gRNA sequence
aggccaggggtggtggctca

SEQ ID NO: 315783 - DNA, 20 bp, Artificial
  CRISPR gRNA sequence
ggccaggggtggtggctcac

SEQ ID NO: 315784 - DNA, 20 bp, Artificial
  CRISPR gRNA sequence
acacctgtaatcccagcact

SEQ ID NO: 315785 - DNA, 20 bp, Artificial
  CRISPR gRNA sequence
taatcccagcacttttggag

SEQ ID NO: 315786 - DNA, 20 bp, Artificial
  CRISPR gRNA sequence
ttggaggctgaggcaggcag

SEQ ID NO: 315787 - DNA, 20 bp, Artificial
  CRISPR gRNA sequence
tggaggctgaggcaggcaga

SEQ ID NO: 315788 - DNA, 20 bp, Artificial
  CRISPR gRNA sequence
ggaggctgaggcaggcagat

SEQ ID NO: 315789 - DNA, 20 bp, Artificial
  CRISPR gRNA sequence
gaggctgaggcaggcagatc

SEQ ID NO: 315790 - DNA, 20 bp, Artificial
  CRISPR gRNA sequence
aggcaggcagatcaccttag

SEQ ID NO: 315791 - DNA, 20 bp, Artificial
  CRISPR gRNA sequence
agatcaggagttcgagaccc

SEQ ID NO: 315792 - DNA, 20 bp, Artificial
  CRISPR gRNA sequence
gatcaggagttcgagacccg

SEQ ID NO: 315793 - DNA, 20 bp, Artificial
  CRISPR gRNA sequence
gagacccgcctggccaacat

SEQ ID NO: 315794 - DNA, 20 bp, Artificial
  CRISPR gRNA sequence
gccaacatggtgaaacccca

SEQ ID NO: 315795 - DNA, 20 bp, Artificial
  CRISPR gRNA sequence
ctactaaacatacaaaaatt

SEQ ID NO: 315796 - DNA, 20 bp, Artificial
  CRISPR gRNA sequence
tactaaacatacaaaaatta

SEQ ID NO: 315797 - DNA, 20 bp, Artificial
  CRISPR gRNA sequence
ctaaacatacaaaaattagc

SEQ ID NO: 315798 - DNA, 20 bp, Artificial
  CRISPR gRNA sequence
aacatacaaaaattagctgg

SEQ ID NO: 315799 - DNA, 20 bp, Artificial
  CRISPR gRNA sequence
gctgggtgtggtggcaggca

SEQ ID NO: 315800 - DNA, 20 bp, Artificial
  CRISPR gRNA sequence
ggtgtggtggcaggcacctg

SEQ ID NO: 315801 - DNA, 20 bp, Artificial
  CRISPR gRNA sequence
taatcccagctacttgggag

SEQ ID NO: 315802 - DNA, 20 bp, Artificial
  CRISPR gRNA sequence
cttgggaggctgagagagga

SEQ ID NO: 315803 - DNA, 20 bp, Artificial
  CRISPR gRNA sequence
gggaggctgagagaggagaa

SEQ ID NO: 315804 - DNA, 20 bp, Artificial
  CRISPR gRNA sequence
ggaggctgagagaggagaat

SEQ ID NO: 315805 - DNA, 20 bp, Artificial
  CRISPR gRNA sequence
agagaggagaatcgcttgaa

SEQ ID NO: 315806 - DNA, 20 bp, Artificial
  CRISPR gRNA sequence
gaacctgggaggcagaggtt

SEQ ID NO: 315807 - DNA, 20 bp, Artificial
  CRISPR gRNA sequence
aacctgggaggcagaggttg

SEQ ID NO: 315808 - DNA, 20 bp, Artificial
  CRISPR gRNA sequence
ggaggcagaggttgcagtga

SEQ ID NO: 315809 - DNA, 20 bp, Artificial
  CRISPR gRNA sequence
cagtgagccaagatcacacc

SEQ ID NO: 315810 - DNA, 20 bp, Artificial
  CRISPR gRNA sequence
cactccagcctgggtgacag

SEQ ID NO: 315811 - DNA, 20 bp, Artificial
  CRISPR gRNA sequence
cagcctgggtgacagaagat

SEQ ID NO: 315812 - DNA, 20 bp, Artificial
  CRISPR gRNA sequence
ggtgacagaagatcaagatt

SEQ ID NO: 315813 - DNA, 20 bp, Artificial
  CRISPR gRNA sequence
cgtcttaaaaaatataaata

SEQ ID NO: 315814 - DNA, 20 bp, Artificial
  CRISPR gRNA sequence
aaaaaatataaataaataaa

SEQ ID NO: 315815 - DNA, 20 bp, Artificial
  CRISPR gRNA sequence
aaaaatataaataaataaat

SEQ ID NO: 315816 - DNA, 20 bp, Artificial
  CRISPR gRNA sequence
taaaattgtatagaagaagt

SEQ ID NO: 315817 - DNA, 20 bp, Artificial
  CRISPR gRNA sequence
aaaattgtatagaagaagta

SEQ ID NO: 315818 - DNA, 20 bp, Artificial
  CRISPR gRNA sequence
aaattgtatagaagaagtag

SEQ ID NO: 315819 - DNA, 20 bp, Artificial
  CRISPR gRNA sequence
tatagaagaagtagacttct

SEQ ID NO: 315820 - DNA, 20 bp, Artificial
  CRISPR gRNA sequence
ctgcttcctccaacaaagga

SEQ ID NO: 315821 - DNA, 20 bp, Artificial
  CRISPR gRNA sequence
tgcttcctccaacaaaggat

SEQ ID NO: 315822 - DNA, 20 bp, Artificial
  CRISPR gRNA sequence
cttcctccaacaaaggatta

SEQ ID NO: 315823 - DNA, 20 bp, Artificial
  CRISPR gRNA sequence
cctccaacaaaggattaact

SEQ ID NO: 315824 - DNA, 20 bp, Artificial
  CRISPR gRNA sequence
ctccaacaaaggattaactg

SEQ ID NO: 315825 - DNA, 20 bp, Artificial
  CRISPR gRNA sequence
caacaaaggattaactgcta

SEQ ID NO: 315826 - DNA, 20 bp, Artificial
  CRISPR gRNA sequence
actgctataggaattgccct

SEQ ID NO: 315827 - DNA, 20 bp, Artificial
  CRISPR gRNA sequence
ctataggaattgccctcttt

SEQ ID NO: 315828 - DNA, 20 bp, Artificial
  CRISPR gRNA sequence
taggaattgccctctttcca

SEQ ID NO: 315829 - DNA, 20 bp, Artificial
  CRISPR gRNA sequence
ccctctttccataaacaact

SEQ ID NO: 315830 - DNA, 20 bp, Artificial
  CRISPR gRNA sequence
tttccataaacaactagaaa

SEQ ID NO: 315831 - DNA, 20 bp, Artificial
  CRISPR gRNA sequence
tccataaacaactagaaagc

SEQ ID NO: 315832 - DNA, 20 bp, Artificial
  CRISPR gRNA sequence
ccataaacaactagaaagca

SEQ ID NO: 315833 - DNA, 20 bp, Artificial
  CRISPR gRNA sequence
cataaacaactagaaagcag

SEQ ID NO: 315834 - DNA, 20 bp, Artificial
  CRISPR gRNA sequence
gaaagcagacaaaatatatg

SEQ ID NO: 315835 - DNA, 20 bp, Artificial
  CRISPR gRNA sequence
ttttcagagatcggatgaca

SEQ ID NO: 315836 - DNA, 20 bp, Artificial
  CRISPR gRNA sequence
tcagagatcggatgacagac

SEQ ID NO: 315837 - DNA, 20 bp, Artificial
  CRISPR gRNA sequence
cagagatcggatgacagaca

SEQ ID NO: 315838 - DNA, 20 bp, Artificial
  CRISPR gRNA sequence
agagatcggatgacagacag

SEQ ID NO: 315839 - DNA, 20 bp, Artificial
  CRISPR gRNA sequence
tagtccctgagtgaaggaaa

SEQ ID NO: 315840 - DNA, 20 bp, Artificial
  CRISPR gRNA sequence
agtgaaggaaagaaaaaatg

SEQ ID NO: 315841 - DNA, 20 bp, Artificial
  CRISPR gRNA sequence
tgattgctctagtttgctgc

SEQ ID NO: 315842 - DNA, 20 bp, Artificial
  CRISPR gRNA sequence
ctctagtttgctgcctggag

SEQ ID NO: 315843 - DNA, 20 bp, Artificial
  CRISPR gRNA sequence
tagtttgctgcctggagcca

SEQ ID NO: 315844 - DNA, 20 bp, Artificial
  CRISPR gRNA sequence
gtttgctgcctggagccagt

SEQ ID NO: 315845 - DNA, 20 bp, Artificial
  CRISPR gRNA sequence
gctgcctggagccagtgtcc

SEQ ID NO: 315846 - DNA, 20 bp, Artificial
  CRISPR gRNA sequence
ctgcctggagccagtgtcca

SEQ ID NO: 315847 - DNA, 20 bp, Artificial
  CRISPR gRNA sequence
cctggagccagtgtccaggc

SEQ ID NO: 315848 - DNA, 20 bp, Artificial
  CRISPR gRNA sequence
gagccagtgtccaggcccct

SEQ ID NO: 315849 - DNA, 20 bp, Artificial
  CRISPR gRNA sequence
tgaaggcaggggagccctga

SEQ ID NO: 315850 - DNA, 20 bp, Artificial
  CRISPR gRNA sequence
aaggcaggggagccctgata

SEQ ID NO: 315851 - DNA, 20 bp, Artificial
  CRISPR gRNA sequence
atactgaactaggaaaagac

SEQ ID NO: 315852 - DNA, 20 bp, Artificial
  CRISPR gRNA sequence
aactaggaaaagacattgca

SEQ ID NO: 315853 - DNA, 20 bp, Artificial
  CRISPR gRNA sequence
ggaaaagacattgcaagaaa

SEQ ID NO: 315854 - DNA, 20 bp, Artificial
  CRISPR gRNA sequence
caagaaaagaaaactacaaa

SEQ ID NO: 315855 - DNA, 20 bp, Artificial
  CRISPR gRNA sequence
caaacatctctcgtgaaatg

SEQ ID NO: 315856 - DNA, 20 bp, Artificial
  CRISPR gRNA sequence
tcgtgaaatgcttaacaaaa

SEQ ID NO: 315857 - DNA, 20 bp, Artificial
  CRISPR gRNA sequence
gtgaaatgcttaacaaaatt

SEQ ID NO: 315858 - DNA, 20 bp, Artificial
  CRISPR gRNA sequence
aacaaaattagcaactaaaa

SEQ ID NO: 315859 - DNA, 20 bp, Artificial
  CRISPR gRNA sequence
acaaaattagcaactaaaat

SEQ ID NO: 315860 - DNA, 20 bp, Artificial
  CRISPR gRNA sequence
gcaactaaaatctagcaata

SEQ ID NO: 315861 - DNA, 20 bp, Artificial
  CRISPR gRNA sequence
aaatctagcaatatgttaaa

SEQ ID NO: 315862 - DNA, 20 bp, Artificial
  CRISPR gRNA sequence
gcaatatgttaaaagtataa

SEQ ID NO: 315863 - DNA, 20 bp, Artificial
  CRISPR gRNA sequence
aaagtataatacatcatgat

SEQ ID NO: 315864 - DNA, 20 bp, Artificial
  CRISPR gRNA sequence
attcaagaaacacaggtaag

SEQ ID NO: 315865 - DNA, 20 bp, Artificial
  CRISPR gRNA sequence
ttcaagaaacacaggtaagc

SEQ ID NO: 315866 - DNA, 20 bp, Artificial
  CRISPR gRNA sequence
aagaaacacaggtaagctca

SEQ ID NO: 315867 - DNA, 20 bp, Artificial
  CRISPR gRNA sequence
aacattcaaaaatcaggcaa

SEQ ID NO: 315868 - DNA, 20 bp, Artificial
  CRISPR gRNA sequence
aaaaatcaggcaataacctt

SEQ ID NO: 315869 - DNA, 20 bp, Artificial
  CRISPR gRNA sequence
tactacataaataaactaaa

SEQ ID NO: 315870 - DNA, 20 bp, Artificial
  CRISPR gRNA sequence
actacataaataaactaaaa

SEQ ID NO: 315871 - DNA, 20 bp, Artificial
  CRISPR gRNA sequence
ctacataaataaactaaaaa

SEQ ID NO: 315872 - DNA, 20 bp, Artificial
  CRISPR gRNA sequence
cataaataaactaaaaagaa

SEQ ID NO: 315873 - DNA, 20 bp, Artificial
  CRISPR gRNA sequence
aaaagaaaaaaacatatgat

SEQ ID NO: 315874 - DNA, 20 bp, Artificial
  CRISPR gRNA sequence
ttgacaaaattaatacccat

SEQ ID NO: 315875 - DNA, 20 bp, Artificial
  CRISPR gRNA sequence
tgacaaaattaatacccatt

SEQ ID NO: 315876 - DNA, 20 bp, Artificial
  CRISPR gRNA sequence
gacaaaattaatacccattc

SEQ ID NO: 315877 - DNA, 20 bp, Artificial
  CRISPR gRNA sequence
acaaaattaatacccattca

SEQ ID NO: 315878 - DNA, 20 bp, Artificial
  CRISPR gRNA sequence
atacccattcatagttttaa

SEQ ID NO: 315879 - DNA, 20 bp, Artificial
  CRISPR gRNA sequence
atagttttaaatggaaagaa

SEQ ID NO: 315880 - DNA, 20 bp, Artificial
  CRISPR gRNA sequence
taaatggaaagaaaagctct

SEQ ID NO: 315881 - DNA, 20 bp, Artificial
  CRISPR gRNA sequence
aaatggaaagaaaagctctc

SEQ ID NO: 315882 - DNA, 20 bp, Artificial
  CRISPR gRNA sequence
aatggaaagaaaagctctca

SEQ ID NO: 315883 - DNA, 20 bp, Artificial
  CRISPR gRNA sequence
tcataaaaataggaatacaa

SEQ ID NO: 315884 - DNA, 20 bp, Artificial
  CRISPR gRNA sequence
ataaaaataggaatacaaga

SEQ ID NO: 315885 - DNA, 20 bp, Artificial
  CRISPR gRNA sequence
cctcaacctgacaaaggaca

SEQ ID NO: 315886 - DNA, 20 bp, Artificial
  CRISPR gRNA sequence
ctcaacctgacaaaggacat

SEQ ID NO: 315887 - DNA, 20 bp, Artificial
  CRISPR gRNA sequence
aacctgacaaaggacatcta

SEQ ID NO: 315888 - DNA, 20 bp, Artificial
  CRISPR gRNA sequence
acaaaggacatctaccaaaa

SEQ ID NO: 315889 - DNA, 20 bp, Artificial
  CRISPR gRNA sequence
ccaaaaattcttctgttagc

SEQ ID NO: 315890 - DNA, 20 bp, Artificial
  CRISPR gRNA sequence
ttctgttagcataatatttc

SEQ ID NO: 315891 - DNA, 20 bp, Artificial
  CRISPR gRNA sequence
ctgttagcataatatttcat

SEQ ID NO: 315892 - DNA, 20 bp, Artificial
  CRISPR gRNA sequence
tgttagcataatatttcatg

SEQ ID NO: 315893 - DNA, 20 bp, Artificial
  CRISPR gRNA sequence
ttagcataatatttcatgat

SEQ ID NO: 315894 - DNA, 20 bp, Artificial
  CRISPR gRNA sequence
gcataatatttcatgataga

SEQ ID NO: 315895 - DNA, 20 bp, Artificial
  CRISPR gRNA sequence
catgatagaagactgattgc

SEQ ID NO: 315896 - DNA, 20 bp, Artificial
  CRISPR gRNA sequence
atgatagaagactgattgct

SEQ ID NO: 315897 - DNA, 20 bp, Artificial
  CRISPR gRNA sequence
attgcttttaccttaagatg

SEQ ID NO: 315898 - DNA, 20 bp, Artificial
  CRISPR gRNA sequence
cttttaccttaagatggcga

SEQ ID NO: 315899 - DNA, 20 bp, Artificial
  CRISPR gRNA sequence
ttaccttaagatggcgaatg

SEQ ID NO: 315900 - DNA, 20 bp, Artificial
  CRISPR gRNA sequence
taccttaagatggcgaatgt

SEQ ID NO: 315901 - DNA, 20 bp, Artificial
  CRISPR gRNA sequence
accttaagatggcgaatgtg

SEQ ID NO: 315902 - DNA, 20 bp, Artificial
  CRISPR gRNA sequence
ccttaagatggcgaatgtgg

SEQ ID NO: 315903 - DNA, 20 bp, Artificial
  CRISPR gRNA sequence
aagatggcgaatgtggggag

SEQ ID NO: 315904 - DNA, 20 bp, Artificial
  CRISPR gRNA sequence
agatggcgaatgtggggagg

SEQ ID NO: 315905 - DNA, 20 bp, Artificial
  CRISPR gRNA sequence
ctctctctacttttgttcca

SEQ ID NO: 315906 - DNA, 20 bp, Artificial
  CRISPR gRNA sequence
tctctacttttgttccacat

SEQ ID NO: 315907 - DNA, 20 bp, Artificial
  CRISPR gRNA sequence
tctacttttgttccacattg

SEQ ID NO: 315908 - DNA, 20 bp, Artificial
  CRISPR gRNA sequence
tacttttgttccacattgta

SEQ ID NO: 315909 - DNA, 20 bp, Artificial
  CRISPR gRNA sequence
cttttgttccacattgtact

SEQ ID NO: 315910 - DNA, 20 bp, Artificial
  CRISPR gRNA sequence
ttgttccacattgtactgga

SEQ ID NO: 315911 - DNA, 20 bp, Artificial
  CRISPR gRNA sequence
tgttccacattgtactggag

SEQ ID NO: 315912 - DNA, 20 bp, Artificial
  CRISPR gRNA sequence
gttccacattgtactggagg

SEQ ID NO: 315913 - DNA, 20 bp, Artificial
  CRISPR gRNA sequence
ttccacattgtactggaggt

SEQ ID NO: 315914 - DNA, 20 bp, Artificial
  CRISPR gRNA sequence
cacattgtactggaggtcat

SEQ ID NO: 315915 - DNA, 20 bp, Artificial
  CRISPR gRNA sequence
tactggaggtcatagccaga

SEQ ID NO: 315916 - DNA, 20 bp, Artificial
  CRISPR gRNA sequence
gaggtcatagccagagaaac

SEQ ID NO: 315917 - DNA, 20 bp, Artificial
  CRISPR gRNA sequence
gaaaaagaaataaaagacat

SEQ ID NO: 315918 - DNA, 20 bp, Artificial
  CRISPR gRNA sequence
gaaaggaagtaaaactgtct

SEQ ID NO: 315919 - DNA, 20 bp, Artificial
  CRISPR gRNA sequence
tcttttttcacagataatga

SEQ ID NO: 315920 - DNA, 20 bp, Artificial
  CRISPR gRNA sequence
ttttcacagataatgatcat

SEQ ID NO: 315921 - DNA, 20 bp, Artificial
  CRISPR gRNA sequence
tttcacagataatgatcatg

SEQ ID NO: 315922 - DNA, 20 bp, Artificial
  CRISPR gRNA sequence
ttcacagataatgatcatgc

SEQ ID NO: 315923 - DNA, 20 bp, Artificial
  CRISPR gRNA sequence
tcacagataatgatcatgct

SEQ ID NO: 315924 - DNA, 20 bp, Artificial
  CRISPR gRNA sequence
cacagataatgatcatgctt

SEQ ID NO: 315925 - DNA, 20 bp, Artificial
  CRISPR gRNA sequence
acagataatgatcatgcttg

SEQ ID NO: 315926 - DNA, 20 bp, Artificial
  CRISPR gRNA sequence
gtagaaaatcctgaggaatc

SEQ ID NO: 315927 - DNA, 20 bp, Artificial
  CRISPR gRNA sequence
tagaaaatcctgaggaatct

SEQ ID NO: 315928 - DNA, 20 bp, Artificial
  CRISPR gRNA sequence
aggaatctatcaaaaaccta

SEQ ID NO: 315929 - DNA, 20 bp, Artificial
  CRISPR gRNA sequence
tcaaaaacctattaaaactg

SEQ ID NO: 315930 - DNA, 20 bp, Artificial
  CRISPR gRNA sequence
ttaaaactgataagtgagtg

SEQ ID NO: 315931 - DNA, 20 bp, Artificial
  CRISPR gRNA sequence
aaactgataagtgagtgtag

SEQ ID NO: 315932 - DNA, 20 bp, Artificial
  CRISPR gRNA sequence
ataagtgagtgtagcaaaga

SEQ ID NO: 315933 - DNA, 20 bp, Artificial
  CRISPR gRNA sequence
tttctatatactaacaaaag

SEQ ID NO: 315934 - DNA, 20 bp, Artificial
  CRISPR gRNA sequence
ctatatactaacaaaagcaa

SEQ ID NO: 315935 - DNA, 20 bp, Artificial
  CRISPR gRNA sequence
tatatactaacaaaagcaat

SEQ ID NO: 315936 - DNA, 20 bp, Artificial
  CRISPR gRNA sequence
tatactaacaaaagcaattg

SEQ ID NO: 315937 - DNA, 20 bp, Artificial
  CRISPR gRNA sequence
acaaaagcaattgtacattg

SEQ ID NO: 315938 - DNA, 20 bp, Artificial
  CRISPR gRNA sequence
tacattgaaaaaaattaata

SEQ ID NO: 315939 - DNA, 20 bp, Artificial
  CRISPR gRNA sequence
aaaaaaattaatagcattta

SEQ ID NO: 315940 - DNA, 20 bp, Artificial
  CRISPR gRNA sequence
atagcatttataatagcatc

SEQ ID NO: 315941 - DNA, 20 bp, Artificial
  CRISPR gRNA sequence
ataatagcatcaaataatat

SEQ ID NO: 315942 - DNA, 20 bp, Artificial
  CRISPR gRNA sequence
taatagcatcaaataatatt

SEQ ID NO: 315943 - DNA, 20 bp, Artificial
  CRISPR gRNA sequence
aaaacttggaaataaattta

SEQ ID NO: 315944 - DNA, 20 bp, Artificial
  CRISPR gRNA sequence
ggaaataaatttaacaaaac

SEQ ID NO: 315945 - DNA, 20 bp, Artificial
  CRISPR gRNA sequence
gaaataaatttaacaaaaca

SEQ ID NO: 315946 - DNA, 20 bp, Artificial
  CRISPR gRNA sequence
aacaaaacaagtacaaggtc

SEQ ID NO: 315947 - DNA, 20 bp, Artificial
  CRISPR gRNA sequence
acaaaacaagtacaaggtct

SEQ ID NO: 315948 - DNA, 20 bp, Artificial
  CRISPR gRNA sequence
tatactgaaaactatacaat

SEQ ID NO: 315949 - DNA, 20 bp, Artificial
  CRISPR gRNA sequence
aaaactatacaatattacta

SEQ ID NO: 315950 - DNA, 20 bp, Artificial
  CRISPR gRNA sequence
tacaatattactactggaga

SEQ ID NO: 315951 - DNA, 20 bp, Artificial
  CRISPR gRNA sequence
ctactggagaaattaaagta

SEQ ID NO: 315952 - DNA, 20 bp, Artificial
  CRISPR gRNA sequence
ctggagaaattaaagtaaac

SEQ ID NO: 315953 - DNA, 20 bp, Artificial
  CRISPR gRNA sequence
gagaaattaaagtaaaccaa

SEQ ID NO: 315954 - DNA, 20 bp, Artificial
  CRISPR gRNA sequence
aagtaaaccaaaataaatgg

SEQ ID NO: 315955 - DNA, 20 bp, Artificial
  CRISPR gRNA sequence
atgaatcagaagactagatg

SEQ ID NO: 315956 - DNA, 20 bp, Artificial
  CRISPR gRNA sequence
tgaatcagaagactagatgt

SEQ ID NO: 315957 - DNA, 20 bp, Artificial
  CRISPR gRNA sequence
gatgttaagataaccattct

SEQ ID NO: 315958 - DNA, 20 bp, Artificial
  CRISPR gRNA sequence
agataaccattctctccaag

SEQ ID NO: 315959 - DNA, 20 bp, Artificial
  CRISPR gRNA sequence
tctccaagttgatctatgga

SEQ ID NO: 315960 - DNA, 20 bp, Artificial
  CRISPR gRNA sequence
tccaagttgatctatggatt

SEQ ID NO: 315961 - DNA, 20 bp, Artificial
  CRISPR gRNA sequence
caagttgatctatggattaa

SEQ ID NO: 315962 - DNA, 20 bp, Artificial
  CRISPR gRNA sequence
atctatggattaaatgtaat

SEQ ID NO: 315963 - DNA, 20 bp, Artificial
  CRISPR gRNA sequence
tggattaaatgtaatcacaa

SEQ ID NO: 315964 - DNA, 20 bp, Artificial
  CRISPR gRNA sequence
aatgtaatcacaatcaaaat

SEQ ID NO: 315965 - DNA, 20 bp, Artificial
  CRISPR gRNA sequence
gtaagctctctaatagatac

SEQ ID NO: 315966 - DNA, 20 bp, Artificial
  CRISPR gRNA sequence
tctaatagatactaaaaatc

SEQ ID NO: 315967 - DNA, 20 bp, Artificial
  CRISPR gRNA sequence
taatagatactaaaaatctt

SEQ ID NO: 315968 - DNA, 20 bp, Artificial
  CRISPR gRNA sequence
atagatactaaaaatcttac

SEQ ID NO: 315969 - DNA, 20 bp, Artificial
  CRISPR gRNA sequence
aaaatcttactcgaaaagtt

SEQ ID NO: 315970 - DNA, 20 bp, Artificial
  CRISPR gRNA sequence
actcgaaaagttatagggaa

SEQ ID NO: 315971 - DNA, 20 bp, Artificial
  CRISPR gRNA sequence
ctcgaaaagttatagggaaa

SEQ ID NO: 315972 - DNA, 20 bp, Artificial
  CRISPR gRNA sequence
gaaaagttatagggaaatgc

SEQ ID NO: 315973 - DNA, 20 bp, Artificial
  CRISPR gRNA sequence
tagggaaatgcaaagaatct

SEQ ID NO: 315974 - DNA, 20 bp, Artificial
  CRISPR gRNA sequence
caattgccaaaacaattctg

SEQ ID NO: 315975 - DNA, 20 bp, Artificial
  CRISPR gRNA sequence
ccaaaacaattctgaaaaat

SEQ ID NO: 315976 - DNA, 20 bp, Artificial
  CRISPR gRNA sequence
tgaaaaataagaacaaaggt

SEQ ID NO: 315977 - DNA, 20 bp, Artificial
  CRISPR gRNA sequence
aaaaataagaacaaaggtta

SEQ ID NO: 315978 - DNA, 20 bp, Artificial
  CRISPR gRNA sequence
aaaatacaaaattagccagg

SEQ ID NO: 315979 - DNA, 20 bp, Artificial
  CRISPR gRNA sequence
gccaggcatggtggcgcatg

SEQ ID NO: 315980 - DNA, 20 bp, Artificial
  CRISPR gRNA sequence
taatcccagctactctggag

SEQ ID NO: 315981 - DNA, 20 bp, Artificial
  CRISPR gRNA sequence
ctctggaggctgaggcagga

SEQ ID NO: 315982 - DNA, 20 bp, Artificial
  CRISPR gRNA sequence
tggaggctgaggcaggagaa

SEQ ID NO: 315983 - DNA, 20 bp, Artificial
  CRISPR gRNA sequence
gaggctgaggcaggagaatt

SEQ ID NO: 315984 - DNA, 20 bp, Artificial
  CRISPR gRNA sequence
aggcaggagaattgcttgaa

SEQ ID NO: 315985 - DNA, 20 bp, Artificial
  CRISPR gRNA sequence
cttgaacccgggaggcagag

SEQ ID NO: 315986 - DNA, 20 bp, Artificial
  CRISPR gRNA sequence
gaacccgggaggcagaggtt

SEQ ID NO: 315987 - DNA, 20 bp, Artificial
  CRISPR gRNA sequence
aacccgggaggcagaggttg

SEQ ID NO: 315988 - DNA, 20 bp, Artificial
  CRISPR gRNA sequence
ctgtgagctgagatcgtgcc

SEQ ID NO: 315989 - DNA, 20 bp, Artificial
  CRISPR gRNA sequence
tgagctgagatcgtgccatt

SEQ ID NO: 315990 - DNA, 20 bp, Artificial
  CRISPR gRNA sequence
agatcgtgccattgcactcc

SEQ ID NO: 315991 - DNA, 20 bp, Artificial
  CRISPR gRNA sequence
cactccagcctgggcaacaa

SEQ ID NO: 315992 - DNA, 20 bp, Artificial
  CRISPR gRNA sequence
cagcctgggcaacaagagtg

SEQ ID NO: 315993 - DNA, 20 bp, Artificial
  CRISPR gRNA sequence
ggcaacaagagtgaaactcc

SEQ ID NO: 315994 - DNA, 20 bp, Artificial
  CRISPR gRNA sequence
cctctcaaaaaaaaaaaaaa

SEQ ID NO: 315995 - DNA, 20 bp, Artificial
  CRISPR gRNA sequence
tcaaaaaaaaaaaaaaaaaa

SEQ ID NO: 315996 - DNA, 20 bp, Artificial
  CRISPR gRNA sequence
aaaaaaaaaaaaaaaaaaaa

SEQ ID NO: 315997 - DNA, 20 bp, Artificial
  CRISPR gRNA sequence
aacctacctaatttcaatat

SEQ ID NO: 315998 - DNA, 20 bp, Artificial
  CRISPR gRNA sequence
acctacctaatttcaatatt

SEQ ID NO: 315999 - DNA, 20 bp, Artificial
  CRISPR gRNA sequence
cctaatttcaatatttacta

SEQ ID NO: 316000 - DNA, 20 bp, Artificial
  CRISPR gRNA sequence
atttcaatatttactatata

SEQ ID NO: 316001 - DNA, 20 bp, Artificial
  CRISPR gRNA sequence
caatatttactatatatagt

SEQ ID NO: 316002 - DNA, 20 bp, Artificial
  CRISPR gRNA sequence
aatatttactatatatagta

SEQ ID NO: 316003 - DNA, 20 bp, Artificial
  CRISPR gRNA sequence
actatatatagtaattaata

SEQ ID NO: 316004 - DNA, 20 bp, Artificial
  CRISPR gRNA sequence
ctatatatagtaattaatac

SEQ ID NO: 316005 - DNA, 20 bp, Artificial
  CRISPR gRNA sequence
tatatagtaattaatacagt

SEQ ID NO: 316006 - DNA, 20 bp, Artificial
  CRISPR gRNA sequence
atacagtgtgatattggtaa

SEQ ID NO: 316007 - DNA, 20 bp, Artificial
  CRISPR gRNA sequence
gtaaaaggacagacatatca

SEQ ID NO: 316008 - DNA, 20 bp, Artificial
  CRISPR gRNA sequence
acactgttgacaaagctacc

SEQ ID NO: 316009 - DNA, 20 bp, Artificial
  CRISPR gRNA sequence
ttgacaaagctaccaaggta

SEQ ID NO: 316010 - DNA, 20 bp, Artificial
  CRISPR gRNA sequence
acaaagctaccaaggtaatt

SEQ ID NO: 316011 - DNA, 20 bp, Artificial
  CRISPR gRNA sequence
ccaaggtaattccatgcaga

SEQ ID NO: 316012 - DNA, 20 bp, Artificial
  CRISPR gRNA sequence
catgcagaaaggatagtatt

SEQ ID NO: 316013 - DNA, 20 bp, Artificial
  CRISPR gRNA sequence
tcaacaaatagtgttgggac

SEQ ID NO: 316014 - DNA, 20 bp, Artificial
  CRISPR gRNA sequence
caacaaatagtgttgggaca

SEQ ID NO: 316015 - DNA, 20 bp, Artificial
  CRISPR gRNA sequence
aacaaatagtgttgggacaa

SEQ ID NO: 316016 - DNA, 20 bp, Artificial
  CRISPR gRNA sequence
ggacaattagatatccacat

SEQ ID NO: 316017 - DNA, 20 bp, Artificial
  CRISPR gRNA sequence
gatatccacatggaaaaagt

SEQ ID NO: 316018 - DNA, 20 bp, Artificial
  CRISPR gRNA sequence
gacacacacaaagtaactta

SEQ ID NO: 316019 - DNA, 20 bp, Artificial
  CRISPR gRNA sequence
atatattaagaattaaaatg

SEQ ID NO: 316020 - DNA, 20 bp, Artificial
  CRISPR gRNA sequence
tatattaagaattaaaatga

SEQ ID NO: 316021 - DNA, 20 bp, Artificial
  CRISPR gRNA sequence
agaattaaaatgaaaggact

SEQ ID NO: 316022 - DNA, 20 bp, Artificial
  CRISPR gRNA sequence
aaatgaaaggacttccaaaa

SEQ ID NO: 316023 - DNA, 20 bp, Artificial
  CRISPR gRNA sequence
ccaaaagaaaacagaggaga

SEQ ID NO: 316024 - DNA, 20 bp, Artificial
  CRISPR gRNA sequence
caaaagaaaacagaggagaa

SEQ ID NO: 316025 - DNA, 20 bp, Artificial
  CRISPR gRNA sequence
tgtaaccttaagttaggcaa

SEQ ID NO: 316026 - DNA, 20 bp, Artificial
  CRISPR gRNA sequence
gtaaccttaagttaggcaag

SEQ ID NO: 316027 - DNA, 20 bp, Artificial
  CRISPR gRNA sequence
taaccttaagttaggcaagt

SEQ ID NO: 316028 - DNA, 20 bp, Artificial
  CRISPR gRNA sequence
aagttaggcaagtcttctta

SEQ ID NO: 316029 - DNA, 20 bp, Artificial
  CRISPR gRNA sequence
agttaggcaagtcttcttag

SEQ ID NO: 316030 - DNA, 20 bp, Artificial
  CRISPR gRNA sequence
ggcaagtcttcttagatagg

SEQ ID NO: 316031 - DNA, 20 bp, Artificial
  CRISPR gRNA sequence
cttagataggacacagaaag

SEQ ID NO: 316032 - DNA, 20 bp, Artificial
  CRISPR gRNA sequence
ttagataggacacagaaagc

SEQ ID NO: 316033 - DNA, 20 bp, Artificial
  CRISPR gRNA sequence
agataggacacagaaagcaa

SEQ ID NO: 316034 - DNA, 20 bp, Artificial
  CRISPR gRNA sequence
gataggacacagaaagcaaa

SEQ ID NO: 316035 - DNA, 20 bp, Artificial
  CRISPR gRNA sequence
ttgttctttgactttgttta

SEQ ID NO: 316036 - DNA, 20 bp, Artificial
  CRISPR gRNA sequence
tgttctttgactttgtttaa

SEQ ID NO: 316037 - DNA, 20 bp, Artificial
  CRISPR gRNA sequence
gttctttgactttgtttaaa

SEQ ID NO: 316038 - DNA, 20 bp, Artificial
  CRISPR gRNA sequence
ttctttgactttgtttaaaa

SEQ ID NO: 316039 - DNA, 20 bp, Artificial
  CRISPR gRNA sequence
tttgactttgtttaaaaaac

SEQ ID NO: 316040 - DNA, 20 bp, Artificial
  CRISPR gRNA sequence
tgactttgtttaaaaaacga

SEQ ID NO: 316041 - DNA, 20 bp, Artificial
  CRISPR gRNA sequence
gactttgtttaaaaaacgaa

SEQ ID NO: 316042 - DNA, 20 bp, Artificial
  CRISPR gRNA sequence
actttgtttaaaaaacgaaa

SEQ ID NO: 316043 - DNA, 20 bp, Artificial
  CRISPR gRNA sequence
tgtttaaaaaacgaaaagtc

SEQ ID NO: 316044 - DNA, 20 bp, Artificial
  CRISPR gRNA sequence
gtttaaaaaacgaaaagtca

SEQ ID NO: 316045 - DNA, 20 bp, Artificial
  CRISPR gRNA sequence
tttaaaaaacgaaaagtcaa

SEQ ID NO: 316046 - DNA, 20 bp, Artificial
  CRISPR gRNA sequence
aaaaaacgaaaagtcaaacc

SEQ ID NO: 316047 - DNA, 20 bp, Artificial
  CRISPR gRNA sequence
aaaaacgaaaagtcaaacca

SEQ ID NO: 316048 - DNA, 20 bp, Artificial
  CRISPR gRNA sequence
gcaaaatatatatctgataa

SEQ ID NO: 316049 - DNA, 20 bp, Artificial
  CRISPR gRNA sequence
caaaatatatatctgataaa

SEQ ID NO: 316050 - DNA, 20 bp, Artificial
  CRISPR gRNA sequence
ataaaggacttgtatccagt

SEQ ID NO: 316051 - DNA, 20 bp, Artificial
  CRISPR gRNA sequence
gtatccagtatataattaca

SEQ ID NO: 316052 - DNA, 20 bp, Artificial
  CRISPR gRNA sequence
tatccagtatataattacat

SEQ ID NO: 316053 - DNA, 20 bp, Artificial
  CRISPR gRNA sequence
catattgctactcattagta

SEQ ID NO: 316054 - DNA, 20 bp, Artificial
  CRISPR gRNA sequence
ctactcattagtaagaagac

SEQ ID NO: 316055 - DNA, 20 bp, Artificial
  CRISPR gRNA sequence
ctcattagtaagaagacaat

SEQ ID NO: 316056 - DNA, 20 bp, Artificial
  CRISPR gRNA sequence
attagtaagaagacaatcca

SEQ ID NO: 316057 - DNA, 20 bp, Artificial
  CRISPR gRNA sequence
gtaagaagacaatccattta

SEQ ID NO: 316058 - DNA, 20 bp, Artificial
  CRISPR gRNA sequence
aataaaaggcaagaagaaga

SEQ ID NO: 316059 - DNA, 20 bp, Artificial
  CRISPR gRNA sequence
ataaaaggcaagaagaagag

SEQ ID NO: 316060 - DNA, 20 bp, Artificial
  CRISPR gRNA sequence
gaacagatacataacagaag

SEQ ID NO: 316061 - DNA, 20 bp, Artificial
  CRISPR gRNA sequence
aacagatacataacagaaga

SEQ ID NO: 316062 - DNA, 20 bp, Artificial
  CRISPR gRNA sequence
gtcatcagggaagtacaaat

SEQ ID NO: 316063 - DNA, 20 bp, Artificial
  CRISPR gRNA sequence
aaacgataatgagataccac

SEQ ID NO: 316064 - DNA, 20 bp, Artificial
  CRISPR gRNA sequence
cacaccctctagaatggcta

SEQ ID NO: 316065 - DNA, 20 bp, Artificial
  CRISPR gRNA sequence
tagaatggctaaaattaaaa

SEQ ID NO: 316066 - DNA, 20 bp, Artificial
  CRISPR gRNA sequence
gaatggctaaaattaaaagg

SEQ ID NO: 316067 - DNA, 20 bp, Artificial
  CRISPR gRNA sequence
aaattaaaaggtctgataaa

SEQ ID NO: 316068 - DNA, 20 bp, Artificial
  CRISPR gRNA sequence
aaaggtctgataaacatcaa

SEQ ID NO: 316069 - DNA, 20 bp, Artificial
  CRISPR gRNA sequence
ataaacatcaagtgttggag

SEQ ID NO: 316070 - DNA, 20 bp, Artificial
  CRISPR gRNA sequence
gagaggatatgaagcaactg

SEQ ID NO: 316071 - DNA, 20 bp, Artificial
  CRISPR gRNA sequence
aaactctcatatactgctat

SEQ ID NO: 316072 - DNA, 20 bp, Artificial
  CRISPR gRNA sequence
tcatatactgctatacaacc

SEQ ID NO: 316073 - DNA, 20 bp, Artificial
  CRISPR gRNA sequence
atatactgctatacaaccca

SEQ ID NO: 316074 - DNA, 20 bp, Artificial
  CRISPR gRNA sequence
ctatacaacccagaaatcct

SEQ ID NO: 316075 - DNA, 20 bp, Artificial
  CRISPR gRNA sequence
tacaacccagaaatcctaga

SEQ ID NO: 316076 - DNA, 20 bp, Artificial
  CRISPR gRNA sequence
gacatttaccaaacagaaat

SEQ ID NO: 316077 - DNA, 20 bp, Artificial
  CRISPR gRNA sequence
accaaacagaaattttaaaa

SEQ ID NO: 316078 - DNA, 20 bp, Artificial
  CRISPR gRNA sequence
ccaaacagaaattttaaaaa

SEQ ID NO: 316079 - DNA, 20 bp, Artificial
  CRISPR gRNA sequence
taaaaaatttaaaaatatat

SEQ ID NO: 316080 - DNA, 20 bp, Artificial
  CRISPR gRNA sequence
aaaaaatttaaaaatatata

SEQ ID NO: 316081 - DNA, 20 bp, Artificial
  CRISPR gRNA sequence
aaaaatttaaaaatatataa

SEQ ID NO: 316082 - DNA, 20 bp, Artificial
  CRISPR gRNA sequence
aaaaatatataaagactcat

SEQ ID NO: 316083 - DNA, 20 bp, Artificial
  CRISPR gRNA sequence
aaaatatataaagactcata

SEQ ID NO: 316084 - DNA, 20 bp, Artificial
  CRISPR gRNA sequence
atacacaaatgttcatagca

SEQ ID NO: 316085 - DNA, 20 bp, Artificial
  CRISPR gRNA sequence
atagcagcttgcttcataat

SEQ ID NO: 316086 - DNA, 20 bp, Artificial
  CRISPR gRNA sequence
gcttcataataccaaacctg

SEQ ID NO: 316087 - DNA, 20 bp, Artificial
  CRISPR gRNA sequence
cttcataataccaaacctgg

SEQ ID NO: 316088 - DNA, 20 bp, Artificial
  CRISPR gRNA sequence
cataataccaaacctggcat

SEQ ID NO: 316089 - DNA, 20 bp, Artificial
  CRISPR gRNA sequence
ataataccaaacctggcatt

SEQ ID NO: 316090 - DNA, 20 bp, Artificial
  CRISPR gRNA sequence
gcattctaaattttcatcag

SEQ ID NO: 316091 - DNA, 20 bp, Artificial
  CRISPR gRNA sequence
taaattttcatcagttggcg

SEQ ID NO: 316092 - DNA, 20 bp, Artificial
  CRISPR gRNA sequence
aattttcatcagttggcggt

SEQ ID NO: 316093 - DNA, 20 bp, Artificial
  CRISPR gRNA sequence
tcatcagttggcggtggtat

SEQ ID NO: 316094 - DNA, 20 bp, Artificial
  CRISPR gRNA sequence
catcagttggcggtggtata

SEQ ID NO: 316095 - DNA, 20 bp, Artificial
  CRISPR gRNA sequence
atcagttggcggtggtatat

SEQ ID NO: 316096 - DNA, 20 bp, Artificial
  CRISPR gRNA sequence
gcggtggtatatttatacaa

SEQ ID NO: 316097 - DNA, 20 bp, Artificial
  CRISPR gRNA sequence
atacaatgaaatactgcaaa

SEQ ID NO: 316098 - DNA, 20 bp, Artificial
  CRISPR gRNA sequence
tacaatgaaatactgcaaag

SEQ ID NO: 316099 - DNA, 20 bp, Artificial
  CRISPR gRNA sequence
caaagctatagaaaggaatg

SEQ ID NO: 316100 - DNA, 20 bp, Artificial
  CRISPR gRNA sequence
tagaaaggaatggactacta

SEQ ID NO: 316101 - DNA, 20 bp, Artificial
  CRISPR gRNA sequence
ctaataatacacaagaacat

SEQ ID NO: 316102 - DNA, 20 bp, Artificial
  CRISPR gRNA sequence
ataatacacaagaacataga

SEQ ID NO: 316103 - DNA, 20 bp, Artificial
  CRISPR gRNA sequence
caaaagcattatgctaagtg

SEQ ID NO: 316104 - DNA, 20 bp, Artificial
  CRISPR gRNA sequence
aaaagcattatgctaagtga

SEQ ID NO: 316105 - DNA, 20 bp, Artificial
  CRISPR gRNA sequence
tgctaagtgaaacaatccag

SEQ ID NO: 316106 - DNA, 20 bp, Artificial
  CRISPR gRNA sequence
agtgaaacaatccaggcaca

SEQ ID NO: 316107 - DNA, 20 bp, Artificial
  CRISPR gRNA sequence
tacaatttcatgtatatgaa

SEQ ID NO: 316108 - DNA, 20 bp, Artificial
  CRISPR gRNA sequence
catgtatatgaaatttgaga

SEQ ID NO: 316109 - DNA, 20 bp, Artificial
  CRISPR gRNA sequence
atgtatatgaaatttgagaa

SEQ ID NO: 316110 - DNA, 20 bp, Artificial
  CRISPR gRNA sequence
gagaaaaagcaaaactattt

SEQ ID NO: 316111 - DNA, 20 bp, Artificial
  CRISPR gRNA sequence
agaaaaagcaaaactatttt

SEQ ID NO: 316112 - DNA, 20 bp, Artificial
  CRISPR gRNA sequence
ttttaagtagattcatggtt

SEQ ID NO: 316113 - DNA, 20 bp, Artificial
  CRISPR gRNA sequence
taagtagattcatggttatc

SEQ ID NO: 316114 - DNA, 20 bp, Artificial
  CRISPR gRNA sequence
aagtagattcatggttatcc

SEQ ID NO: 316115 - DNA, 20 bp, Artificial
  CRISPR gRNA sequence
agtagattcatggttatcca

SEQ ID NO: 316116 - DNA, 20 bp, Artificial
  CRISPR gRNA sequence
atggttatccatgggatggg

SEQ ID NO: 316117 - DNA, 20 bp, Artificial
  CRISPR gRNA sequence
tccatgggatgggggaaagg

SEQ ID NO: 316118 - DNA, 20 bp, Artificial
  CRISPR gRNA sequence
aaaagcgaactattttggct

SEQ ID NO: 316119 - DNA, 20 bp, Artificial
  CRISPR gRNA sequence
ttttggcttataaaaatgtt

SEQ ID NO: 316120 - DNA, 20 bp, Artificial
  CRISPR gRNA sequence
tggcttataaaaatgttctc

SEQ ID NO: 316121 - DNA, 20 bp, Artificial
  CRISPR gRNA sequence
ggcttataaaaatgttctcg

SEQ ID NO: 316122 - DNA, 20 bp, Artificial
  CRISPR gRNA sequence
gcttataaaaatgttctcga

SEQ ID NO: 316123 - DNA, 20 bp, Artificial
  CRISPR gRNA sequence
ataaaaatgttctcgatctt

SEQ ID NO: 316124 - DNA, 20 bp, Artificial
  CRISPR gRNA sequence
taaaaatgttctcgatcttg

SEQ ID NO: 316125 - DNA, 20 bp, Artificial
  CRISPR gRNA sequence
tcgatcttgattgtggtggt

SEQ ID NO: 316126 - DNA, 20 bp, Artificial
  CRISPR gRNA sequence
gatcttgattgtggtggtgg

SEQ ID NO: 316127 - DNA, 20 bp, Artificial
  CRISPR gRNA sequence
gattgtggtggtggttacgt

SEQ ID NO: 316128 - DNA, 20 bp, Artificial
  CRISPR gRNA sequence
attgtggtggtggttacgtg

SEQ ID NO: 316129 - DNA, 20 bp, Artificial
  CRISPR gRNA sequence
tggtggtggttacgtgacta

SEQ ID NO: 316130 - DNA, 20 bp, Artificial
  CRISPR gRNA sequence
cgtgactatatatattcgtt

SEQ ID NO: 316131 - DNA, 20 bp, Artificial
  CRISPR gRNA sequence
tatatattcgttaaaatcac

SEQ ID NO: 316132 - DNA, 20 bp, Artificial
  CRISPR gRNA sequence
gttaaaatcaccaaactcta

SEQ ID NO: 316133 - DNA, 20 bp, Artificial
  CRISPR gRNA sequence
aaatcaccaaactctaaact

SEQ ID NO: 316134 - DNA, 20 bp, Artificial
  CRISPR gRNA sequence
taaactgaaaatgattgggt

SEQ ID NO: 316135 - DNA, 20 bp, Artificial
  CRISPR gRNA sequence
aactgaaaatgattgggttt

SEQ ID NO: 316136 - DNA, 20 bp, Artificial
  CRISPR gRNA sequence
aaaatgattgggttttatta

SEQ ID NO: 316137 - DNA, 20 bp, Artificial
  CRISPR gRNA sequence
ggttttattatttattaatt

SEQ ID NO: 316138 - DNA, 20 bp, Artificial
  CRISPR gRNA sequence
tattatttattaattatacc

SEQ ID NO: 316139 - DNA, 20 bp, Artificial
  CRISPR gRNA sequence
attatttattaattatacct

SEQ ID NO: 316140 - DNA, 20 bp, Artificial
  CRISPR gRNA sequence
ttatttattaattatacctc

SEQ ID NO: 316141 - DNA, 20 bp, Artificial
  CRISPR gRNA sequence
tttattaattatacctccat

SEQ ID NO: 316142 - DNA, 20 bp, Artificial
  CRISPR gRNA sequence
attaattatacctccataaa

SEQ ID NO: 316143 - DNA, 20 bp, Artificial
  CRISPR gRNA sequence
ttaattatacctccataaag

SEQ ID NO: 316144 - DNA, 20 bp, Artificial
  CRISPR gRNA sequence
attatacctccataaagctg

SEQ ID NO: 316145 - DNA, 20 bp, Artificial
  CRISPR gRNA sequence
tacctccataaagctgattg

SEQ ID NO: 316146 - DNA, 20 bp, Artificial
  CRISPR gRNA sequence
cataaagctgattgttttta

SEQ ID NO: 316147 - DNA, 20 bp, Artificial
  CRISPR gRNA sequence
attgtttttatcttttattt

SEQ ID NO: 316148 - DNA, 20 bp, Artificial
  CRISPR gRNA sequence
tttttatcttttatttttat

SEQ ID NO: 316149 - DNA, 20 bp, Artificial
  CRISPR gRNA sequence
ttatcttttatttttatttt

SEQ ID NO: 316150 - DNA, 20 bp, Artificial
  CRISPR gRNA sequence
tatcttttatttttatttta

SEQ ID NO: 316151 - DNA, 20 bp, Artificial
  CRISPR gRNA sequence
atcttttatttttattttat

SEQ ID NO: 316152 - DNA, 20 bp, Artificial
  CRISPR gRNA sequence
tcttttatttttattttatt

SEQ ID NO: 316153 - DNA, 20 bp, Artificial
  CRISPR gRNA sequence
ttatttttattttatttcaa

SEQ ID NO: 316154 - DNA, 20 bp, Artificial
  CRISPR gRNA sequence
tatttttattttatttcaat

SEQ ID NO: 316155 - DNA, 20 bp, Artificial
  CRISPR gRNA sequence
atttttattttatttcaata

SEQ ID NO: 316156 - DNA, 20 bp, Artificial
  CRISPR gRNA sequence
tttttattttatttcaatag

SEQ ID NO: 316157 - DNA, 20 bp, Artificial
  CRISPR gRNA sequence
ttattttatttcaatagttt

SEQ ID NO: 316158 - DNA, 20 bp, Artificial
  CRISPR gRNA sequence
tattttatttcaatagtttt

SEQ ID NO: 316159 - DNA, 20 bp, Artificial
  CRISPR gRNA sequence
attttatttcaatagttttt

SEQ ID NO: 316160 - DNA, 20 bp, Artificial
  CRISPR gRNA sequence
ttttatttcaatagtttttg

SEQ ID NO: 316161 - DNA, 20 bp, Artificial
  CRISPR gRNA sequence
tatttcaatagtttttgggg

SEQ ID NO: 316162 - DNA, 20 bp, Artificial
  CRISPR gRNA sequence
atttcaatagtttttgggga

SEQ ID NO: 316163 - DNA, 20 bp, Artificial
  CRISPR gRNA sequence
tttcaatagtttttggggaa

SEQ ID NO: 316164 - DNA, 20 bp, Artificial
  CRISPR gRNA sequence
caatagtttttggggaacag

SEQ ID NO: 316165 - DNA, 20 bp, Artificial
  CRISPR gRNA sequence
aatagtttttggggaacaga

SEQ ID NO: 316166 - DNA, 20 bp, Artificial
  CRISPR gRNA sequence
ttggggaacagatggttttc

SEQ ID NO: 316167 - DNA, 20 bp, Artificial
  CRISPR gRNA sequence
tggggaacagatggttttcg

SEQ ID NO: 316168 - DNA, 20 bp, Artificial
  CRISPR gRNA sequence
ggggaacagatggttttcgg

SEQ ID NO: 316169 - DNA, 20 bp, Artificial
  CRISPR gRNA sequence
gggaacagatggttttcggt

SEQ ID NO: 316170 - DNA, 20 bp, Artificial
  CRISPR gRNA sequence
tcggttacatggatgagttc

SEQ ID NO: 316171 - DNA, 20 bp, Artificial
  CRISPR gRNA sequence
cggttacatggatgagttct

SEQ ID NO: 316172 - DNA, 20 bp, Artificial
  CRISPR gRNA sequence
ggttacatggatgagttctt

SEQ ID NO: 316173 - DNA, 20 bp, Artificial
  CRISPR gRNA sequence
catggatgagttctttagtg

SEQ ID NO: 316174 - DNA, 20 bp, Artificial
  CRISPR gRNA sequence
tttagtggtgatttctgaga

SEQ ID NO: 316175 - DNA, 20 bp, Artificial
  CRISPR gRNA sequence
tagtggtgatttctgagatt

SEQ ID NO: 316176 - DNA, 20 bp, Artificial
  CRISPR gRNA sequence
agtggtgatttctgagattt

SEQ ID NO: 316177 - DNA, 20 bp, Artificial
  CRISPR gRNA sequence
gtggtgatttctgagatttt

SEQ ID NO: 316178 - DNA, 20 bp, Artificial
  CRISPR gRNA sequence
ctgagattttgatgcacctg

SEQ ID NO: 316179 - DNA, 20 bp, Artificial
  CRISPR gRNA sequence
tgagattttgatgcacctgt

SEQ ID NO: 316180 - DNA, 20 bp, Artificial
  CRISPR gRNA sequence
agattttgatgcacctgtca

SEQ ID NO: 316181 - DNA, 20 bp, Artificial
  CRISPR gRNA sequence
tgatgcacctgtcacccgag

SEQ ID NO: 316182 - DNA, 20 bp, Artificial
  CRISPR gRNA sequence
gatgcacctgtcacccgagc

SEQ ID NO: 316183 - DNA, 20 bp, Artificial
  CRISPR gRNA sequence
atgcacctgtcacccgagca

SEQ ID NO: 316184 - DNA, 20 bp, Artificial
  CRISPR gRNA sequence
tcacccgagcaatgtccact

SEQ ID NO: 316185 - DNA, 20 bp, Artificial
  CRISPR gRNA sequence
tacccaatgtgtagtctttt

SEQ ID NO: 316186 - DNA, 20 bp, Artificial
  CRISPR gRNA sequence
ttatccttcatccacctctc

SEQ ID NO: 316187 - DNA, 20 bp, Artificial
  CRISPR gRNA sequence
tatccttcatccacctctct

SEQ ID NO: 316188 - DNA, 20 bp, Artificial
  CRISPR gRNA sequence
atccttcatccacctctctc

SEQ ID NO: 316189 - DNA, 20 bp, Artificial
  CRISPR gRNA sequence
tccttcatccacctctctct

SEQ ID NO: 316190 - DNA, 20 bp, Artificial
  CRISPR gRNA sequence
catccacctctctctcactc

SEQ ID NO: 316191 - DNA, 20 bp, Artificial
  CRISPR gRNA sequence
atccacctctctctcactct

SEQ ID NO: 316192 - DNA, 20 bp, Artificial
  CRISPR gRNA sequence
tctctcactcttccccccaa

SEQ ID NO: 316193 - DNA, 20 bp, Artificial
  CRISPR gRNA sequence
tctcactcttccccccaagt

SEQ ID NO: 316194 - DNA, 20 bp, Artificial
  CRISPR gRNA sequence
tcactcttccccccaagtac

SEQ ID NO: 316195 - DNA, 20 bp, Artificial
  CRISPR gRNA sequence
actcttccccccaagtaccc

SEQ ID NO: 316196 - DNA, 20 bp, Artificial
  CRISPR gRNA sequence
ttccccccaagtacccaagt

SEQ ID NO: 316197 - DNA, 20 bp, Artificial
  CRISPR gRNA sequence
ccccccaagtacccaagtcc

SEQ ID NO: 316198 - DNA, 20 bp, Artificial
  CRISPR gRNA sequence
cccccaagtacccaagtcca

SEQ ID NO: 316199 - DNA, 20 bp, Artificial
  CRISPR gRNA sequence
tatcattcttatgactttgt

SEQ ID NO: 316200 - DNA, 20 bp, Artificial
  CRISPR gRNA sequence
ttatgactttgtggcctcat

SEQ ID NO: 316201 - DNA, 20 bp, Artificial
  CRISPR gRNA sequence
atgactttgtggcctcataa

SEQ ID NO: 316202 - DNA, 20 bp, Artificial
  CRISPR gRNA sequence
tgactttgtggcctcataaa

SEQ ID NO: 316203 - DNA, 20 bp, Artificial
  CRISPR gRNA sequence
tgtggcctcataaaagctga

SEQ ID NO: 316204 - DNA, 20 bp, Artificial
  CRISPR gRNA sequence
gtggcctcataaaagctgat

SEQ ID NO: 316205 - DNA, 20 bp, Artificial
  CRISPR gRNA sequence
tggcctcataaaagctgatt

SEQ ID NO: 316206 - DNA, 20 bp, Artificial
  CRISPR gRNA sequence
ataaaagctgattgttttta

SEQ ID NO: 316207 - DNA, 20 bp, Artificial
  CRISPR gRNA sequence
attgtttttaaatacacaca

SEQ ID NO: 316208 - DNA, 20 bp, Artificial
  CRISPR gRNA sequence
tttttaaatacacacataca

SEQ ID NO: 316209 - DNA, 20 bp, Artificial
  CRISPR gRNA sequence
ttaaatacacacatacacac

SEQ ID NO: 316210 - DNA, 20 bp, Artificial
  CRISPR gRNA sequence
taaatacacacatacacaca

SEQ ID NO: 316211 - DNA, 20 bp, Artificial
  CRISPR gRNA sequence
aaatacacacatacacacat

SEQ ID NO: 316212 - DNA, 20 bp, Artificial
  CRISPR gRNA sequence
aatacacacatacacacata

SEQ ID NO: 316213 - DNA, 20 bp, Artificial
  CRISPR gRNA sequence
ccagtgacaggaagtgttca

SEQ ID NO: 316214 - DNA, 20 bp, Artificial
  CRISPR gRNA sequence
cagtgacaggaagtgttcaa

SEQ ID NO: 316215 - DNA, 20 bp, Artificial
  CRISPR gRNA sequence
aagaatgctctatttagtaa

SEQ ID NO: 316216 - DNA, 20 bp, Artificial
  CRISPR gRNA sequence
tatttagtaaagacagaatc

SEQ ID NO: 316217 - DNA, 20 bp, Artificial
  CRISPR gRNA sequence
tttagtaaagacagaatcac

SEQ ID NO: 316218 - DNA, 20 bp, Artificial
  CRISPR gRNA sequence
agtaaagacagaatcacaaa

SEQ ID NO: 316219 - DNA, 20 bp, Artificial
  CRISPR gRNA sequence
gtaaagacagaatcacaaaa

SEQ ID NO: 316220 - DNA, 20 bp, Artificial
  CRISPR gRNA sequence
ttgagtggattcttgtggtc

SEQ ID NO: 316221 - DNA, 20 bp, Artificial
  CRISPR gRNA sequence
agtggattcttgtggtctat

SEQ ID NO: 316222 - DNA, 20 bp, Artificial
  CRISPR gRNA sequence
ttgtggtctataaatacctc

SEQ ID NO: 316223 - DNA, 20 bp, Artificial
  CRISPR gRNA sequence
gtggtctataaatacctcca

SEQ ID NO: 316224 - DNA, 20 bp, Artificial
  CRISPR gRNA sequence
tggtctataaatacctccat

SEQ ID NO: 316225 - DNA, 20 bp, Artificial
  CRISPR gRNA sequence
taaatacctccatggacacc

SEQ ID NO: 316226 - DNA, 20 bp, Artificial
  CRISPR gRNA sequence
catggacacccaggttagca

SEQ ID NO: 316227 - DNA, 20 bp, Artificial
  CRISPR gRNA sequence
gcaacctgttggagtttacg

SEQ ID NO: 316228 - DNA, 20 bp, Artificial
  CRISPR gRNA sequence
ttggagtttacgtgggacaa

SEQ ID NO: 316229 - DNA, 20 bp, Artificial
  CRISPR gRNA sequence
gagtttacgtgggacaatag

SEQ ID NO: 316230 - DNA, 20 bp, Artificial
  CRISPR gRNA sequence
acgtgggacaatagcatcat

SEQ ID NO: 316231 - DNA, 20 bp, Artificial
  CRISPR gRNA sequence
cgtgggacaatagcatcatc

SEQ ID NO: 316232 - DNA, 20 bp, Artificial
  CRISPR gRNA sequence
gagaaatttacatcccaagt

SEQ ID NO: 316233 - DNA, 20 bp, Artificial
  CRISPR gRNA sequence
acatcccaagttgtgtcagt

SEQ ID NO: 316234 - DNA, 20 bp, Artificial
  CRISPR gRNA sequence
catcccaagttgtgtcagta

SEQ ID NO: 316235 - DNA, 20 bp, Artificial
  CRISPR gRNA sequence
tgtcagtagcaagtccctat

SEQ ID NO: 316236 - DNA, 20 bp, Artificial
  CRISPR gRNA sequence
tcaatagcaactcaggcttt

SEQ ID NO: 316237 - DNA, 20 bp, Artificial
  CRISPR gRNA sequence
aggctttgtgaggtctagct

SEQ ID NO: 316238 - DNA, 20 bp, Artificial
  CRISPR gRNA sequence
tgtgaggtctagctggctag

SEQ ID NO: 316239 - DNA, 20 bp, Artificial
  CRISPR gRNA sequence
gtgaggtctagctggctaga

SEQ ID NO: 316240 - DNA, 20 bp, Artificial
  CRISPR gRNA sequence
tgaggtctagctggctagaa

SEQ ID NO: 316241 - DNA, 20 bp, Artificial
  CRISPR gRNA sequence
gctggctagaaatttcccac

SEQ ID NO: 316242 - DNA, 20 bp, Artificial
  CRISPR gRNA sequence
gctagaaatttcccacttgg

SEQ ID NO: 316243 - DNA, 20 bp, Artificial
  CRISPR gRNA sequence
gaaatttcccacttggcctt

SEQ ID NO: 316244 - DNA, 20 bp, Artificial
  CRISPR gRNA sequence
cccacttggccttgcccatg

SEQ ID NO: 316245 - DNA, 20 bp, Artificial
  CRISPR gRNA sequence
ccacttggccttgcccatgc

SEQ ID NO: 316246 - DNA, 20 bp, Artificial
  CRISPR gRNA sequence
ggccttgcccatgcaacatt

SEQ ID NO: 316247 - DNA, 20 bp, Artificial
  CRISPR gRNA sequence
gccttgcccatgcaacattg

SEQ ID NO: 316248 - DNA, 20 bp, Artificial
  CRISPR gRNA sequence
gcccatgcaacattgtgtaa

SEQ ID NO: 316249 - DNA, 20 bp, Artificial
  CRISPR gRNA sequence
cccatgcaacattgtgtaat

SEQ ID NO: 316250 - DNA, 20 bp, Artificial
  CRISPR gRNA sequence
tgtaatattcttagcaccat

SEQ ID NO: 316251 - DNA, 20 bp, Artificial
  CRISPR gRNA sequence
ttagcaccatctggctagcc

SEQ ID NO: 316252 - DNA, 20 bp, Artificial
  CRISPR gRNA sequence
agcaccatctggctagccga

SEQ ID NO: 316253 - DNA, 20 bp, Artificial
  CRISPR gRNA sequence
gcaccatctggctagccgat

SEQ ID NO: 316254 - DNA, 20 bp, Artificial
  CRISPR gRNA sequence
gctagccgatttaggcatca

SEQ ID NO: 316255 - DNA, 20 bp, Artificial
  CRISPR gRNA sequence
gccgatttaggcatcaacat

SEQ ID NO: 316256 - DNA, 20 bp, Artificial
  CRISPR gRNA sequence
aggcatcaacatcttcaaga

SEQ ID NO: 316257 - DNA, 20 bp, Artificial
  CRISPR gRNA sequence
ggcatcaacatcttcaagac

SEQ ID NO: 316258 - DNA, 20 bp, Artificial
  CRISPR gRNA sequence
caagacttcttctcctcctc

SEQ ID NO: 316259 - DNA, 20 bp, Artificial
  CRISPR gRNA sequence
aagacttcttctcctcctcc

SEQ ID NO: 316260 - DNA, 20 bp, Artificial
  CRISPR gRNA sequence
cttctcctcctccttataaa

SEQ ID NO: 316261 - DNA, 20 bp, Artificial
  CRISPR gRNA sequence
ttctcctcctccttataaac

SEQ ID NO: 316262 - DNA, 20 bp, Artificial
  CRISPR gRNA sequence
ctcctcctccttataaacct

SEQ ID NO: 316263 - DNA, 20 bp, Artificial
  CRISPR gRNA sequence
tcctcctccttataaacctt

SEQ ID NO: 316264 - DNA, 20 bp, Artificial
  CRISPR gRNA sequence
ctcctccttataaaccttgc

SEQ ID NO: 316265 - DNA, 20 bp, Artificial
  CRISPR gRNA sequence
ctccttataaaccttgcttt

SEQ ID NO: 316266 - DNA, 20 bp, Artificial
  CRISPR gRNA sequence
cttataaaccttgctttcag

SEQ ID NO: 316267 - DNA, 20 bp, Artificial
  CRISPR gRNA sequence
ataaaccttgctttcagaaa

SEQ ID NO: 316268 - DNA, 20 bp, Artificial
  CRISPR gRNA sequence
taaaccttgctttcagaaaa

SEQ ID NO: 316269 - DNA, 20 bp, Artificial
  CRISPR gRNA sequence
gctttcagaaaaggattaga

SEQ ID NO: 316270 - DNA, 20 bp, Artificial
  CRISPR gRNA sequence
ctttcagaaaaggattagaa

SEQ ID NO: 316271 - DNA, 20 bp, Artificial
  CRISPR gRNA sequence
tcagaaaaggattagaaact

SEQ ID NO: 316272 - DNA, 20 bp, Artificial
  CRISPR gRNA sequence
cagaaaaggattagaaactc

SEQ ID NO: 316273 - DNA, 20 bp, Artificial
  CRISPR gRNA sequence
agaaaaggattagaaactct

SEQ ID NO: 316274 - DNA, 20 bp, Artificial
  CRISPR gRNA sequence
gaaactcttccaatcacaaa

SEQ ID NO: 316275 - DNA, 20 bp, Artificial
  CRISPR gRNA sequence
ttccaatcacaaaatgattg

SEQ ID NO: 316276 - DNA, 20 bp, Artificial
  CRISPR gRNA sequence
ccaatcacaaaatgattgct

SEQ ID NO: 316277 - DNA, 20 bp, Artificial
  CRISPR gRNA sequence
caatcacaaaatgattgcta

SEQ ID NO: 316278 - DNA, 20 bp, Artificial
  CRISPR gRNA sequence
ctaaaactaaatatattacc

SEQ ID NO: 316279 - DNA, 20 bp, Artificial
  CRISPR gRNA sequence
aaactaaatatattacccct

SEQ ID NO: 316280 - DNA, 20 bp, Artificial
  CRISPR gRNA sequence
aatatattacccctcccaat

SEQ ID NO: 316281 - DNA, 20 bp, Artificial
  CRISPR gRNA sequence
cccctcccaatggtattttt

SEQ ID NO: 316282 - DNA, 20 bp, Artificial
  CRISPR gRNA sequence
ccaatggtattttttggtta

SEQ ID NO: 316283 - DNA, 20 bp, Artificial
  CRISPR gRNA sequence
tttggttagccaggatagag

SEQ ID NO: 316284 - DNA, 20 bp, Artificial
  CRISPR gRNA sequence
ttggttagccaggatagaga

SEQ ID NO: 316285 - DNA, 20 bp, Artificial
  CRISPR gRNA sequence
tggttagccaggatagagat

SEQ ID NO: 316286 - DNA, 20 bp, Artificial
  CRISPR gRNA sequence
ggttagccaggatagagata

SEQ ID NO: 316287 - DNA, 20 bp, Artificial
  CRISPR gRNA sequence
gttagccaggatagagatat

SEQ ID NO: 316288 - DNA, 20 bp, Artificial
  CRISPR gRNA sequence
gccaggatagagatataagt

SEQ ID NO: 316289 - DNA, 20 bp, Artificial
  CRISPR gRNA sequence
tttccagtgttagaatttaa

SEQ ID NO: 316290 - DNA, 20 bp, Artificial
  CRISPR gRNA sequence
ccagtgttagaatttaaggc

SEQ ID NO: 316291 - DNA, 20 bp, Artificial
  CRISPR gRNA sequence
cagtgttagaatttaaggca

SEQ ID NO: 316292 - DNA, 20 bp, Artificial
  CRISPR gRNA sequence
gaatttaaggcacagtgaga

SEQ ID NO: 316293 - DNA, 20 bp, Artificial
  CRISPR gRNA sequence
aaggcacagtgagaaaggga

SEQ ID NO: 316294 - DNA, 20 bp, Artificial
  CRISPR gRNA sequence
aggcacagtgagaaagggaa

SEQ ID NO: 316295 - DNA, 20 bp, Artificial
  CRISPR gRNA sequence
tttgaatgcaagaaacttct

SEQ ID NO: 316296 - DNA, 20 bp, Artificial
  CRISPR gRNA sequence
ttgaatgcaagaaacttctt

SEQ ID NO: 316297 - DNA, 20 bp, Artificial
  CRISPR gRNA sequence
tgaatgcaagaaacttcttc

SEQ ID NO: 316298 - DNA, 20 bp, Artificial
  CRISPR gRNA sequence
gaatgcaagaaacttcttcc

SEQ ID NO: 316299 - DNA, 20 bp, Artificial
  CRISPR gRNA sequence
aatgcaagaaacttcttccc

SEQ ID NO: 316300 - DNA, 20 bp, Artificial
  CRISPR gRNA sequence
cttcccaatccccctgaaat

SEQ ID NO: 316301 - DNA, 20 bp, Artificial
  CRISPR gRNA sequence
ttcccaatccccctgaaatt

SEQ ID NO: 316302 - DNA, 20 bp, Artificial
  CRISPR gRNA sequence
cccaatccccctgaaattgc

SEQ ID NO: 316303 - DNA, 20 bp, Artificial
  CRISPR gRNA sequence
ccaatccccctgaaattgca

SEQ ID NO: 316304 - DNA, 20 bp, Artificial
  CRISPR gRNA sequence
aaattgcatcatttgagtaa

SEQ ID NO: 316305 - DNA, 20 bp, Artificial
  CRISPR gRNA sequence
catcatttgagtaactatct

SEQ ID NO: 316306 - DNA, 20 bp, Artificial
  CRISPR gRNA sequence
gagtaactatctcttccata

SEQ ID NO: 316307 - DNA, 20 bp, Artificial
  CRISPR gRNA sequence
agtaactatctcttccatat

SEQ ID NO: 316308 - DNA, 20 bp, Artificial
  CRISPR gRNA sequence
tctcttccatatataaagtc

SEQ ID NO: 316309 - DNA, 20 bp, Artificial
  CRISPR gRNA sequence
ttccatatataaagtcacaa

SEQ ID NO: 316310 - DNA, 20 bp, Artificial
  CRISPR gRNA sequence
ccatatataaagtcacaaca

SEQ ID NO: 316311 - DNA, 20 bp, Artificial
  CRISPR gRNA sequence
catatataaagtcacaacaa

SEQ ID NO: 316312 - DNA, 20 bp, Artificial
  CRISPR gRNA sequence
ctctctcagtcccagaactt

SEQ ID NO: 316313 - DNA, 20 bp, Artificial
  CRISPR gRNA sequence
tctctcagtcccagaacttt

SEQ ID NO: 316314 - DNA, 20 bp, Artificial
  CRISPR gRNA sequence
tctcagtcccagaactttga

SEQ ID NO: 316315 - DNA, 20 bp, Artificial
  CRISPR gRNA sequence
tcagtcccagaactttgaag

SEQ ID NO: 316316 - DNA, 20 bp, Artificial
  CRISPR gRNA sequence
agtcccagaactttgaagcc

SEQ ID NO: 316317 - DNA, 20 bp, Artificial
  CRISPR gRNA sequence
tgaagccttttcaaactttc

SEQ ID NO: 316318 - DNA, 20 bp, Artificial
  CRISPR gRNA sequence
gaagccttttcaaactttcc

SEQ ID NO: 316319 - DNA, 20 bp, Artificial
  CRISPR gRNA sequence
aagccttttcaaactttcct

SEQ ID NO: 316320 - DNA, 20 bp, Artificial
  CRISPR gRNA sequence
ttcaaactttccttcttttg

SEQ ID NO: 316321 - DNA, 20 bp, Artificial
  CRISPR gRNA sequence
tcaaactttccttcttttgg

SEQ ID NO: 316322 - DNA, 20 bp, Artificial
  CRISPR gRNA sequence
caaactttccttcttttggt

SEQ ID NO: 316323 - DNA, 20 bp, Artificial
  CRISPR gRNA sequence
aaactttccttcttttggta

SEQ ID NO: 316324 - DNA, 20 bp, Artificial
  CRISPR gRNA sequence
tccttcttttggtatctagg

SEQ ID NO: 316325 - DNA, 20 bp, Artificial
  CRISPR gRNA sequence
ccttcttttggtatctagga

SEQ ID NO: 316326 - DNA, 20 bp, Artificial
  CRISPR gRNA sequence
cttcttttggtatctaggag

SEQ ID NO: 316327 - DNA, 20 bp, Artificial
  CRISPR gRNA sequence
cttttggtatctaggaggaa

SEQ ID NO: 316328 - DNA, 20 bp, Artificial
  CRISPR gRNA sequence
ttttggtatctaggaggaat

SEQ ID NO: 316329 - DNA, 20 bp, Artificial
  CRISPR gRNA sequence
ttggtatctaggaggaatac

SEQ ID NO: 316330 - DNA, 20 bp, Artificial
  CRISPR gRNA sequence
tggtatctaggaggaataca

SEQ ID NO: 316331 - DNA, 20 bp, Artificial
  CRISPR gRNA sequence
ggtatctaggaggaatacat

SEQ ID NO: 316332 - DNA, 20 bp, Artificial
  CRISPR gRNA sequence
gtatctaggaggaatacatt

SEQ ID NO: 316333 - DNA, 20 bp, Artificial
  CRISPR gRNA sequence
ggaggaatacatttttgaag

SEQ ID NO: 316334 - DNA, 20 bp, Artificial
  CRISPR gRNA sequence
ttgaagattgttcttggtgt

SEQ ID NO: 316335 - DNA, 20 bp, Artificial
  CRISPR gRNA sequence
tgaagattgttcttggtgtc

SEQ ID NO: 316336 - DNA, 20 bp, Artificial
  CRISPR gRNA sequence
gaagattgttcttggtgtct

SEQ ID NO: 316337 - DNA, 20 bp, Artificial
  CRISPR gRNA sequence
aagattgttcttggtgtctt

SEQ ID NO: 316338 - DNA, 20 bp, Artificial
  CRISPR gRNA sequence
ttcttggtgtctttcaggaa

SEQ ID NO: 316339 - DNA, 20 bp, Artificial
  CRISPR gRNA sequence
ttggtgtctttcaggaacca

SEQ ID NO: 316340 - DNA, 20 bp, Artificial
  CRISPR gRNA sequence
ggtgtctttcaggaaccaac

SEQ ID NO: 316341 - DNA, 20 bp, Artificial
  CRISPR gRNA sequence
gtgtctttcaggaaccaaca

SEQ ID NO: 316342 - DNA, 20 bp, Artificial
  CRISPR gRNA sequence
tcaggaaccaacacaatgga

SEQ ID NO: 316343 - DNA, 20 bp, Artificial
  CRISPR gRNA sequence
caggaaccaacacaatggag

SEQ ID NO: 316344 - DNA, 20 bp, Artificial
  CRISPR gRNA sequence
aggaaccaacacaatggaga

SEQ ID NO: 316345 - DNA, 20 bp, Artificial
  CRISPR gRNA sequence
accctgagacattgatgaga

SEQ ID NO: 316346 - DNA, 20 bp, Artificial
  CRISPR gRNA sequence
agacattgatgagagagagg

SEQ ID NO: 316347 - DNA, 20 bp, Artificial
  CRISPR gRNA sequence
atgagagagaggtataatcc

SEQ ID NO: 316348 - DNA, 20 bp, Artificial
  CRISPR gRNA sequence
ttacttgaataggcttatgc

SEQ ID NO: 316349 - DNA, 20 bp, Artificial
  CRISPR gRNA sequence
cttgaataggcttatgccta

SEQ ID NO: 316350 - DNA, 20 bp, Artificial
  CRISPR gRNA sequence
gaataggcttatgcctaaca

SEQ ID NO: 316351 - DNA, 20 bp, Artificial
  CRISPR gRNA sequence
aataggcttatgcctaacat

SEQ ID NO: 316352 - DNA, 20 bp, Artificial
  CRISPR gRNA sequence
atgcctaacatatgttgaga

SEQ ID NO: 316353 - DNA, 20 bp, Artificial
  CRISPR gRNA sequence
tgcctaacatatgttgagac

SEQ ID NO: 316354 - DNA, 20 bp, Artificial
  CRISPR gRNA sequence
acatatgttgagacctcagc

SEQ ID NO: 316355 - DNA, 20 bp, Artificial
  CRISPR gRNA sequence
agacctcagcaaacctgaac

SEQ ID NO: 316356 - DNA, 20 bp, Artificial
  CRISPR gRNA sequence
agcaaacctgaactaatgga

SEQ ID NO: 316357 - DNA, 20 bp, Artificial
  CRISPR gRNA sequence
aactaatggagagggagagg

SEQ ID NO: 316358 - DNA, 20 bp, Artificial
  CRISPR gRNA sequence
atggagagggagaggaaaat

SEQ ID NO: 316359 - DNA, 20 bp, Artificial
  CRISPR gRNA sequence
gttaagaactggaagaaaat

SEQ ID NO: 316360 - DNA, 20 bp, Artificial
  CRISPR gRNA sequence
agaactggaagaaaataacc

SEQ ID NO: 316361 - DNA, 20 bp, Artificial
  CRISPR gRNA sequence
gaagaaaataacctgataat

SEQ ID NO: 316362 - DNA, 20 bp, Artificial
  CRISPR gRNA sequence
ataatggatgacagggtatc

SEQ ID NO: 316363 - DNA, 20 bp, Artificial
  CRISPR gRNA sequence
tgtcatggtcaagtaaaagt

SEQ ID NO: 316364 - DNA, 20 bp, Artificial
  CRISPR gRNA sequence
tcatggtcaagtaaaagtca

SEQ ID NO: 316365 - DNA, 20 bp, Artificial
  CRISPR gRNA sequence
cagaggtggtgaacatgggc

SEQ ID NO: 316366 - DNA, 20 bp, Artificial
  CRISPR gRNA sequence
agaggtggtgaacatgggct

SEQ ID NO: 316367 - DNA, 20 bp, Artificial
  CRISPR gRNA sequence
catcttatctgccacagtaa

SEQ ID NO: 316368 - DNA, 20 bp, Artificial
  CRISPR gRNA sequence
atcttatctgccacagtaac

SEQ ID NO: 316369 - DNA, 20 bp, Artificial
  CRISPR gRNA sequence
atctgccacagtaaccccag

SEQ ID NO: 316370 - DNA, 20 bp, Artificial
  CRISPR gRNA sequence
tctgccacagtaaccccagt

SEQ ID NO: 316371 - DNA, 20 bp, Artificial
  CRISPR gRNA sequence
ccacagtaaccccagtacct

SEQ ID NO: 316372 - DNA, 20 bp, Artificial
  CRISPR gRNA sequence
gcacagtgcctagattagtg

SEQ ID NO: 316373 - DNA, 20 bp, Artificial
  CRISPR gRNA sequence
gattagtgggcatcctacat

SEQ ID NO: 316374 - DNA, 20 bp, Artificial
  CRISPR gRNA sequence
gtgggcatcctacatgtgtg

SEQ ID NO: 316375 - DNA, 20 bp, Artificial
  CRISPR gRNA sequence
catgtgtggaatgaataaat

SEQ ID NO: 316376 - DNA, 20 bp, Artificial
  CRISPR gRNA sequence
gcttcagcctgagcatctta

SEQ ID NO: 316377 - DNA, 20 bp, Artificial
  CRISPR gRNA sequence
cttcagcctgagcatcttag

SEQ ID NO: 316378 - DNA, 20 bp, Artificial
  CRISPR gRNA sequence
cagcctgagcatcttagtat

SEQ ID NO: 316379 - DNA, 20 bp, Artificial
  CRISPR gRNA sequence
agcctgagcatcttagtatt

SEQ ID NO: 316380 - DNA, 20 bp, Artificial
  CRISPR gRNA sequence
agcatcttagtatttgctat

SEQ ID NO: 316381 - DNA, 20 bp, Artificial
  CRISPR gRNA sequence
agtatttgctatggccctgt

SEQ ID NO: 316382 - DNA, 20 bp, Artificial
  CRISPR gRNA sequence
gtatttgctatggccctgtt

SEQ ID NO: 316383 - DNA, 20 bp, Artificial
  CRISPR gRNA sequence
gctatggccctgtttagatg

SEQ ID NO: 316384 - DNA, 20 bp, Artificial
  CRISPR gRNA sequence
ctatggccctgtttagatgt

SEQ ID NO: 316385 - DNA, 20 bp, Artificial
  CRISPR gRNA sequence
tggccctgtttagatgttct

SEQ ID NO: 316386 - DNA, 20 bp, Artificial
  CRISPR gRNA sequence
tttagatgttcttctgccac

SEQ ID NO: 316387 - DNA, 20 bp, Artificial
  CRISPR gRNA sequence
agatgttcttctgccacttc

SEQ ID NO: 316388 - DNA, 20 bp, Artificial
  CRISPR gRNA sequence
gatgttcttctgccacttct

SEQ ID NO: 316389 - DNA, 20 bp, Artificial
  CRISPR gRNA sequence
ttctgccacttctttacctc

SEQ ID NO: 316390 - DNA, 20 bp, Artificial
  CRISPR gRNA sequence
ctgccacttctttacctcat

SEQ ID NO: 316391 - DNA, 20 bp, Artificial
  CRISPR gRNA sequence
tgccacttctttacctcatt

SEQ ID NO: 316392 - DNA, 20 bp, Artificial
  CRISPR gRNA sequence
ccacttctttacctcattct

SEQ ID NO: 316393 - DNA, 20 bp, Artificial
  CRISPR gRNA sequence
ctttacctcattcttcagat

SEQ ID NO: 316394 - DNA, 20 bp, Artificial
  CRISPR gRNA sequence
tttacctcattcttcagatc

SEQ ID NO: 316395 - DNA, 20 bp, Artificial
  CRISPR gRNA sequence
tacctcattcttcagatctt

SEQ ID NO: 316396 - DNA, 20 bp, Artificial
  CRISPR gRNA sequence
acctcattcttcagatcttg

SEQ ID NO: 316397 - DNA, 20 bp, Artificial
  CRISPR gRNA sequence
cctcattcttcagatcttgc

SEQ ID NO: 316398 - DNA, 20 bp, Artificial
  CRISPR gRNA sequence
attcttcagatcttgcctca

SEQ ID NO: 316399 - DNA, 20 bp, Artificial
  CRISPR gRNA sequence
ttcagatcttgcctcaagca

SEQ ID NO: 316400 - DNA, 20 bp, Artificial
  CRISPR gRNA sequence
cagatcttgcctcaagcagc

SEQ ID NO: 316401 - DNA, 20 bp, Artificial
  CRISPR gRNA sequence
agatcttgcctcaagcagca

SEQ ID NO: 316402 - DNA, 20 bp, Artificial
  CRISPR gRNA sequence
gcctcaagcagcactttctt

SEQ ID NO: 316403 - DNA, 20 bp, Artificial
  CRISPR gRNA sequence
cctcaagcagcactttctta

SEQ ID NO: 316404 - DNA, 20 bp, Artificial
  CRISPR gRNA sequence
aagcagcactttcttaaaaa

SEQ ID NO: 316405 - DNA, 20 bp, Artificial
  CRISPR gRNA sequence
tcttaaaaaccctttcccaa

SEQ ID NO: 316406 - DNA, 20 bp, Artificial
  CRISPR gRNA sequence
cttaaaaaccctttcccaaa

SEQ ID NO: 316407 - DNA, 20 bp, Artificial
  CRISPR gRNA sequence
ttaaaaaccctttcccaaac

SEQ ID NO: 316408 - DNA, 20 bp, Artificial
  CRISPR gRNA sequence
aaaaaccctttcccaaacta

SEQ ID NO: 316409 - DNA, 20 bp, Artificial
  CRISPR gRNA sequence
aaaaccctttcccaaactag

SEQ ID NO: 316410 - DNA, 20 bp, Artificial
  CRISPR gRNA sequence
tcccaaactagaaaatgtca

SEQ ID NO: 316411 - DNA, 20 bp, Artificial
  CRISPR gRNA sequence
cccaaactagaaaatgtcaa

SEQ ID NO: 316412 - DNA, 20 bp, Artificial
  CRISPR gRNA sequence
ccaaactagaaaatgtcaac

SEQ ID NO: 316413 - DNA, 20 bp, Artificial
  CRISPR gRNA sequence
gaaaatgtcaacttgttaca

SEQ ID NO: 316414 - DNA, 20 bp, Artificial
  CRISPR gRNA sequence
gttacagtgtcatgtggatc

SEQ ID NO: 316415 - DNA, 20 bp, Artificial
  CRISPR gRNA sequence
ttacagtgtcatgtggatcc

SEQ ID NO: 316416 - DNA, 20 bp, Artificial
  CRISPR gRNA sequence
cagtgtcatgtggatccctt

SEQ ID NO: 316417 - DNA, 20 bp, Artificial
  CRISPR gRNA sequence
ggctttttcttaataacacc

SEQ ID NO: 316418 - DNA, 20 bp, Artificial
  CRISPR gRNA sequence
gctttttcttaataacacca

SEQ ID NO: 316419 - DNA, 20 bp, Artificial
  CRISPR gRNA sequence
tttcttaataacaccagatt

SEQ ID NO: 316420 - DNA, 20 bp, Artificial
  CRISPR gRNA sequence
ttcttaataacaccagatta

SEQ ID NO: 316421 - DNA, 20 bp, Artificial
  CRISPR gRNA sequence
tcttaataacaccagattat

SEQ ID NO: 316422 - DNA, 20 bp, Artificial
  CRISPR gRNA sequence
cttaataacaccagattatg

SEQ ID NO: 316423 - DNA, 20 bp, Artificial
  CRISPR gRNA sequence
ttaataacaccagattatgc

SEQ ID NO: 316424 - DNA, 20 bp, Artificial
  CRISPR gRNA sequence
aataacaccagattatgctt

SEQ ID NO: 316425 - DNA, 20 bp, Artificial
  CRISPR gRNA sequence
ataacaccagattatgctta

SEQ ID NO: 316426 - DNA, 20 bp, Artificial
  CRISPR gRNA sequence
tgcttacatatttgtgtaat

SEQ ID NO: 316427 - DNA, 20 bp, Artificial
  CRISPR gRNA sequence
acatatttgtgtaattatct

SEQ ID NO: 316428 - DNA, 20 bp, Artificial
  CRISPR gRNA sequence
catatttgtgtaattatctt

SEQ ID NO: 316429 - DNA, 20 bp, Artificial
  CRISPR gRNA sequence
gtgtaattatcttattaaac

SEQ ID NO: 316430 - DNA, 20 bp, Artificial
  CRISPR gRNA sequence
tgtaattatcttattaaact

SEQ ID NO: 316431 - DNA, 20 bp, Artificial
  CRISPR gRNA sequence
tcttattaaactctataaac

SEQ ID NO: 316432 - DNA, 20 bp, Artificial
  CRISPR gRNA sequence
attaaactctataaactaga

SEQ ID NO: 316433 - DNA, 20 bp, Artificial
  CRISPR gRNA sequence
ttaaactctataaactagac

SEQ ID NO: 316434 - DNA, 20 bp, Artificial
  CRISPR gRNA sequence
aactctataaactagactta

SEQ ID NO: 316435 - DNA, 20 bp, Artificial
  CRISPR gRNA sequence
tataaactagacttaactaa

SEQ ID NO: 316436 - DNA, 20 bp, Artificial
  CRISPR gRNA sequence
taaactagacttaactaaat

SEQ ID NO: 316437 - DNA, 20 bp, Artificial
  CRISPR gRNA sequence
gacttaactaaatcctatga

SEQ ID NO: 316438 - DNA, 20 bp, Artificial
  CRISPR gRNA sequence
aactaaatcctatgaagagc

SEQ ID NO: 316439 - DNA, 20 bp, Artificial
  CRISPR gRNA sequence
actaaatcctatgaagagca

SEQ ID NO: 316440 - DNA, 20 bp, Artificial
  CRISPR gRNA sequence
aatcctatgaagagcagaga

SEQ ID NO: 316441 - DNA, 20 bp, Artificial
  CRISPR gRNA sequence
tgaagagcagagaccatacc

SEQ ID NO: 316442 - DNA, 20 bp, Artificial
  CRISPR gRNA sequence
agctcatcattgtgctgcta

SEQ ID NO: 316443 - DNA, 20 bp, Artificial
  CRISPR gRNA sequence
atcattgtgctgctagcact

SEQ ID NO: 316444 - DNA, 20 bp, Artificial
  CRISPR gRNA sequence
tgctgctagcacttagcatg

SEQ ID NO: 316445 - DNA, 20 bp, Artificial
  CRISPR gRNA sequence
ctagcacttagcatggtgcc

SEQ ID NO: 316446 - DNA, 20 bp, Artificial
  CRISPR gRNA sequence
gcacttagcatggtgcctgg

SEQ ID NO: 316447 - DNA, 20 bp, Artificial
  CRISPR gRNA sequence
agcatggtgcctggcatata

SEQ ID NO: 316448 - DNA, 20 bp, Artificial
  CRISPR gRNA sequence
gcatggtgcctggcatatag

SEQ ID NO: 316449 - DNA, 20 bp, Artificial
  CRISPR gRNA sequence
gcatatagcaggttctcaat

SEQ ID NO: 316450 - DNA, 20 bp, Artificial
  CRISPR gRNA sequence
tcaataaatgttgaaagaat

SEQ ID NO: 316451 - DNA, 20 bp, Artificial
  CRISPR gRNA sequence
aataaatgttgaaagaatga

SEQ ID NO: 316452 - DNA, 20 bp, Artificial
  CRISPR gRNA sequence
aaagaatgattgatgcatga

SEQ ID NO: 316453 - DNA, 20 bp, Artificial
  CRISPR gRNA sequence
atgcatgatgaatacataaa

SEQ ID NO: 316454 - DNA, 20 bp, Artificial
  CRISPR gRNA sequence
gtggtgatcagtcctttcac

SEQ ID NO: 316455 - DNA, 20 bp, Artificial
  CRISPR gRNA sequence
tcacaacgtgaagctatcag

SEQ ID NO: 316456 - DNA, 20 bp, Artificial
  CRISPR gRNA sequence
cacaacgtgaagctatcaga

SEQ ID NO: 316457 - DNA, 20 bp, Artificial
  CRISPR gRNA sequence
acaacgtgaagctatcagat

SEQ ID NO: 316458 - DNA, 20 bp, Artificial
  CRISPR gRNA sequence
tcagatagtctgtacctcta

SEQ ID NO: 316459 - DNA, 20 bp, Artificial
  CRISPR gRNA sequence
tacctctatccctcctgaga

SEQ ID NO: 316460 - DNA, 20 bp, Artificial
  CRISPR gRNA sequence
tatccctcctgagaaattaa

SEQ ID NO: 316461 - DNA, 20 bp, Artificial
  CRISPR gRNA sequence
tccctcctgagaaattaagc

SEQ ID NO: 316462 - DNA, 20 bp, Artificial
  CRISPR gRNA sequence
ctgagaaattaagctctcag

SEQ ID NO: 316463 - DNA, 20 bp, Artificial
  CRISPR gRNA sequence
agaaattaagctctcaggaa

SEQ ID NO: 316464 - DNA, 20 bp, Artificial
  CRISPR gRNA sequence
agctctcaggaatatcaagg

SEQ ID NO: 316465 - DNA, 20 bp, Artificial
  CRISPR gRNA sequence
tcaggaatatcaaggctctg

SEQ ID NO: 316466 - DNA, 20 bp, Artificial
  CRISPR gRNA sequence
aggaatatcaaggctctgac

SEQ ID NO: 316467 - DNA, 20 bp, Artificial
  CRISPR gRNA sequence
tgactgcatacccataggat

SEQ ID NO: 316468 - DNA, 20 bp, Artificial
  CRISPR gRNA sequence
actgcatacccataggatca

SEQ ID NO: 316469 - DNA, 20 bp, Artificial
  CRISPR gRNA sequence
catacccataggatcaaagc

SEQ ID NO: 316470 - DNA, 20 bp, Artificial
  CRISPR gRNA sequence
agtcacaagcctggtttcag

SEQ ID NO: 316471 - DNA, 20 bp, Artificial
  CRISPR gRNA sequence
gtttcagagatagggtcata

SEQ ID NO: 316472 - DNA, 20 bp, Artificial
  CRISPR gRNA sequence
cagagatagggtcataaccc

SEQ ID NO: 316473 - DNA, 20 bp, Artificial
  CRISPR gRNA sequence
agagatagggtcataacccc

SEQ ID NO: 316474 - DNA, 20 bp, Artificial
  CRISPR gRNA sequence
atccagatataccagccact

SEQ ID NO: 316475 - DNA, 20 bp, Artificial
  CRISPR gRNA sequence
tgattctagcaacaaaacta

SEQ ID NO: 316476 - DNA, 20 bp, Artificial
  CRISPR gRNA sequence
tagcaacaaaactaataatt

SEQ ID NO: 316477 - DNA, 20 bp, Artificial
  CRISPR gRNA sequence
gcaacaaaactaataattcc

SEQ ID NO: 316478 - DNA, 20 bp, Artificial
  CRISPR gRNA sequence
ataattccgggcacccttgg

SEQ ID NO: 316479 - DNA, 20 bp, Artificial
  CRISPR gRNA sequence
cgggcacccttggacaatga

SEQ ID NO: 316480 - DNA, 20 bp, Artificial
  CRISPR gRNA sequence
ggacaatgagaaagggtgct

SEQ ID NO: 316481 - DNA, 20 bp, Artificial
  CRISPR gRNA sequence
gacaatgagaaagggtgctg

SEQ ID NO: 316482 - DNA, 20 bp, Artificial
  CRISPR gRNA sequence
aaatcctgcctaccctgtca

SEQ ID NO: 316483 - DNA, 20 bp, Artificial
  CRISPR gRNA sequence
cctaccctgtcacactcagt

SEQ ID NO: 316484 - DNA, 20 bp, Artificial
  CRISPR gRNA sequence
ccctgtcacactcagtttca

SEQ ID NO: 316485 - DNA, 20 bp, Artificial
  CRISPR gRNA sequence
tcacactcagtttcagaaat

SEQ ID NO: 316486 - DNA, 20 bp, Artificial
  CRISPR gRNA sequence
agtttcagaaatggtctgga

SEQ ID NO: 316487 - DNA, 20 bp, Artificial
  CRISPR gRNA sequence
cagaaatggtctggaagagc

SEQ ID NO: 316488 - DNA, 20 bp, Artificial
  CRISPR gRNA sequence
agaaatggtctggaagagcc

SEQ ID NO: 316489 - DNA, 20 bp, Artificial
  CRISPR gRNA sequence
gaagagcctgcagagggcag

SEQ ID NO: 316490 - DNA, 20 bp, Artificial
  CRISPR gRNA sequence
cagagggcaggcagcagaga

SEQ ID NO: 316491 - DNA, 20 bp, Artificial
  CRISPR gRNA sequence
ttgaagcatagatgacagtg

SEQ ID NO: 316492 - DNA, 20 bp, Artificial
  CRISPR gRNA sequence
gaagcatagatgacagtgta

SEQ ID NO: 316493 - DNA, 20 bp, Artificial
  CRISPR gRNA sequence
aagcatagatgacagtgtag

SEQ ID NO: 316494 - DNA, 20 bp, Artificial
  CRISPR gRNA sequence
ttttctcttgctttctccac

SEQ ID NO: 316495 - DNA, 20 bp, Artificial
  CRISPR gRNA sequence
ttctcttgctttctccacct

SEQ ID NO: 316496 - DNA, 20 bp, Artificial
  CRISPR gRNA sequence
tctcttgctttctccacctt

SEQ ID NO: 316497 - DNA, 20 bp, Artificial
  CRISPR gRNA sequence
ctcttgctttctccaccttt

SEQ ID NO: 316498 - DNA, 20 bp, Artificial
  CRISPR gRNA sequence
tcttgctttctccacctttc

SEQ ID NO: 316499 - DNA, 20 bp, Artificial
  CRISPR gRNA sequence
ttgctttctccacctttctc

SEQ ID NO: 316500 - DNA, 20 bp, Artificial
  CRISPR gRNA sequence
gctttctccacctttctctt

SEQ ID NO: 316501 - DNA, 20 bp, Artificial
  CRISPR gRNA sequence
ctttctccacctttctcttc

SEQ ID NO: 316502 - DNA, 20 bp, Artificial
  CRISPR gRNA sequence
tctccacctttctcttcaat

SEQ ID NO: 316503 - DNA, 20 bp, Artificial
  CRISPR gRNA sequence
ctccacctttctcttcaata

SEQ ID NO: 316504 - DNA, 20 bp, Artificial
  CRISPR gRNA sequence
tccacctttctcttcaatag

SEQ ID NO: 316505 - DNA, 20 bp, Artificial
  CRISPR gRNA sequence
cacctttctcttcaatagtt

SEQ ID NO: 316506 - DNA, 20 bp, Artificial
  CRISPR gRNA sequence
tctcttcaatagtttgtttc

SEQ ID NO: 316507 - DNA, 20 bp, Artificial
  CRISPR gRNA sequence
ctcttcaatagtttgtttct

SEQ ID NO: 316508 - DNA, 20 bp, Artificial
  CRISPR gRNA sequence
tcttcaatagtttgtttctc

SEQ ID NO: 316509 - DNA, 20 bp, Artificial
  CRISPR gRNA sequence
ttcaatagtttgtttctcct

SEQ ID NO: 316510 - DNA, 20 bp, Artificial
  CRISPR gRNA sequence
caatagtttgtttctcctca

SEQ ID NO: 316511 - DNA, 20 bp, Artificial
  CRISPR gRNA sequence
aatagtttgtttctcctcat

SEQ ID NO: 316512 - DNA, 20 bp, Artificial
  CRISPR gRNA sequence
gtttctcctcattgctgttc

SEQ ID NO: 316513 - DNA, 20 bp, Artificial
  CRISPR gRNA sequence
tttctcctcattgctgttcc

SEQ ID NO: 316514 - DNA, 20 bp, Artificial
  CRISPR gRNA sequence
ctcctcattgctgttccaat

SEQ ID NO: 316515 - DNA, 20 bp, Artificial
  CRISPR gRNA sequence
tcctcattgctgttccaatg

SEQ ID NO: 316516 - DNA, 20 bp, Artificial
  CRISPR gRNA sequence
ctcattgctgttccaatggc

SEQ ID NO: 316517 - DNA, 20 bp, Artificial
  CRISPR gRNA sequence
attgctgttccaatggcaac

SEQ ID NO: 316518 - DNA, 20 bp, Artificial
  CRISPR gRNA sequence
ctgttccaatggcaacctct

SEQ ID NO: 316519 - DNA, 20 bp, Artificial
  CRISPR gRNA sequence
ttccaatggcaacctctatt

SEQ ID NO: 316520 - DNA, 20 bp, Artificial
  CRISPR gRNA sequence
caatggcaacctctattctg

SEQ ID NO: 316521 - DNA, 20 bp, Artificial
  CRISPR gRNA sequence
tattctgccctatcattgaa

SEQ ID NO: 316522 - DNA, 20 bp, Artificial
  CRISPR gRNA sequence
ttctgccctatcattgaaat

SEQ ID NO: 316523 - DNA, 20 bp, Artificial
  CRISPR gRNA sequence
tgccctatcattgaaatcta

SEQ ID NO: 316524 - DNA, 20 bp, Artificial
  CRISPR gRNA sequence
ccctatcattgaaatctaga

SEQ ID NO: 316525 - DNA, 20 bp, Artificial
  CRISPR gRNA sequence
tcattgaaatctagaaaaag

SEQ ID NO: 316526 - DNA, 20 bp, Artificial
  CRISPR gRNA sequence
aaatctagaaaaagaaagta

SEQ ID NO: 316527 - DNA, 20 bp, Artificial
  CRISPR gRNA sequence
gaaaaagaaagtagctcaaa

SEQ ID NO: 316528 - DNA, 20 bp, Artificial
  CRISPR gRNA sequence
aaatgtgaaatatcacctaa

SEQ ID NO: 316529 - DNA, 20 bp, Artificial
  CRISPR gRNA sequence
atcttttcttctatttctcc

SEQ ID NO: 316530 - DNA, 20 bp, Artificial
  CRISPR gRNA sequence
ttcttctatttctccagaga

SEQ ID NO: 316531 - DNA, 20 bp, Artificial
  CRISPR gRNA sequence
tcttctatttctccagagaa

SEQ ID NO: 316532 - DNA, 20 bp, Artificial
  CRISPR gRNA sequence
cttctatttctccagagaaa

SEQ ID NO: 316533 - DNA, 20 bp, Artificial
  CRISPR gRNA sequence
ttctatttctccagagaaaa

SEQ ID NO: 316534 - DNA, 20 bp, Artificial
  CRISPR gRNA sequence
ctatttctccagagaaaaaa

SEQ ID NO: 316535 - DNA, 20 bp, Artificial
  CRISPR gRNA sequence
tatttctccagagaaaaaat

SEQ ID NO: 316536 - DNA, 20 bp, Artificial
  CRISPR gRNA sequence
tttctccagagaaaaaatcc

SEQ ID NO: 316537 - DNA, 20 bp, Artificial
  CRISPR gRNA sequence
ctccagagaaaaaatccata

SEQ ID NO: 316538 - DNA, 20 bp, Artificial
  CRISPR gRNA sequence
tccagagaaaaaatccatat

SEQ ID NO: 316539 - DNA, 20 bp, Artificial
  CRISPR gRNA sequence
cagagaaaaaatccatatac

SEQ ID NO: 316540 - DNA, 20 bp, Artificial
  CRISPR gRNA sequence
aaagatctgatgaagcccag

SEQ ID NO: 316541 - DNA, 20 bp, Artificial
  CRISPR gRNA sequence
atgaagcccagcgtgttttt

SEQ ID NO: 316542 - DNA, 20 bp, Artificial
  CRISPR gRNA sequence
ttaaaagttcgaagacatct

SEQ ID NO: 316543 - DNA, 20 bp, Artificial
  CRISPR gRNA sequence
taaaagttcgaagacatctt

SEQ ID NO: 316544 - DNA, 20 bp, Artificial
  CRISPR gRNA sequence
aaaagttcgaagacatcttc

SEQ ID NO: 316545 - DNA, 20 bp, Artificial
  CRISPR gRNA sequence
aaagttcgaagacatcttca

SEQ ID NO: 316546 - DNA, 20 bp, Artificial
  CRISPR gRNA sequence
gaagacatcttcatgcgaca

SEQ ID NO: 316547 - DNA, 20 bp, Artificial
  CRISPR gRNA sequence
catgcgacaaaagtgataca

SEQ ID NO: 316548 - DNA, 20 bp, Artificial
  CRISPR gRNA sequence
atgcgacaaaagtgatacat

SEQ ID NO: 316549 - DNA, 20 bp, Artificial
  CRISPR gRNA sequence
ttaattaaagagtaaagccc

SEQ ID NO: 316550 - DNA, 20 bp, Artificial
  CRISPR gRNA sequence
taattaaagagtaaagccca

SEQ ID NO: 316551 - DNA, 20 bp, Artificial
  CRISPR gRNA sequence
aattaaagagtaaagcccat

SEQ ID NO: 316552 - DNA, 20 bp, Artificial
  CRISPR gRNA sequence
attaaagagtaaagcccata

SEQ ID NO: 316553 - DNA, 20 bp, Artificial
  CRISPR gRNA sequence
aagagtaaagcccatacaag

SEQ ID NO: 316554 - DNA, 20 bp, Artificial
  CRISPR gRNA sequence
attttttctaccctttcctt

SEQ ID NO: 316555 - DNA, 20 bp, Artificial
  CRISPR gRNA sequence
tttctaccctttcctttgta

SEQ ID NO: 316556 - DNA, 20 bp, Artificial
  CRISPR gRNA sequence
ttctaccctttcctttgtaa

SEQ ID NO: 316557 - DNA, 20 bp, Artificial
  CRISPR gRNA sequence
tctaccctttcctttgtaag

SEQ ID NO: 316558 - DNA, 20 bp, Artificial
  CRISPR gRNA sequence
ctaccctttcctttgtaagt

SEQ ID NO: 316559 - DNA, 20 bp, Artificial
  CRISPR gRNA sequence
taccctttcctttgtaagtt

SEQ ID NO: 316560 - DNA, 20 bp, Artificial
  CRISPR gRNA sequence
ccctttcctttgtaagttcc

SEQ ID NO: 316561 - DNA, 20 bp, Artificial
  CRISPR gRNA sequence
tcctttgtaagttcctgggc

SEQ ID NO: 316562 - DNA, 20 bp, Artificial
  CRISPR gRNA sequence
cctttgtaagttcctgggca

SEQ ID NO: 316563 - DNA, 20 bp, Artificial
  CRISPR gRNA sequence
ctttgtaagttcctgggcaa

SEQ ID NO: 316564 - DNA, 20 bp, Artificial
  CRISPR gRNA sequence
tgtaagttcctgggcaacct

SEQ ID NO: 316565 - DNA, 20 bp, Artificial
  CRISPR gRNA sequence
gtaagttcctgggcaacctt

SEQ ID NO: 316566 - DNA, 20 bp, Artificial
  CRISPR gRNA sequence
taagttcctgggcaaccttt

SEQ ID NO: 316567 - DNA, 20 bp, Artificial
  CRISPR gRNA sequence
ctgggcaacctttttgattt

SEQ ID NO: 316568 - DNA, 20 bp, Artificial
  CRISPR gRNA sequence
ggcaacctttttgatttctt

SEQ ID NO: 316569 - DNA, 20 bp, Artificial
  CRISPR gRNA sequence
tttgatttcttccagaaggc

SEQ ID NO: 316570 - DNA, 20 bp, Artificial
  CRISPR gRNA sequence
ttgatttcttccagaaggca

SEQ ID NO: 316571 - DNA, 20 bp, Artificial
  CRISPR gRNA sequence
tgatttcttccagaaggcaa

SEQ ID NO: 316572 - DNA, 20 bp, Artificial
  CRISPR gRNA sequence
gatttcttccagaaggcaaa

SEQ ID NO: 316573 - DNA, 20 bp, Artificial
  CRISPR gRNA sequence
atttcttccagaaggcaaaa

SEQ ID NO: 316574 - DNA, 20 bp, Artificial
  CRISPR gRNA sequence
cttccagaaggcaaaaagac

SEQ ID NO: 316575 - DNA, 20 bp, Artificial
  CRISPR gRNA sequence
ttccagaaggcaaaaagaca

SEQ ID NO: 316576 - DNA, 20 bp, Artificial
  CRISPR gRNA sequence
ccagaaggcaaaaagacatt

SEQ ID NO: 316577 - DNA, 20 bp, Artificial
  CRISPR gRNA sequence
cagaaggcaaaaagacatta

SEQ ID NO: 316578 - DNA, 20 bp, Artificial
  CRISPR gRNA sequence
ccatgagtaataagggggct

SEQ ID NO: 316579 - DNA, 20 bp, Artificial
  CRISPR gRNA sequence
caggactccctctaagtgga

SEQ ID NO: 316580 - DNA, 20 bp, Artificial
  CRISPR gRNA sequence
cctctaagtggaatagcctc

SEQ ID NO: 316581 - DNA, 20 bp, Artificial
  CRISPR gRNA sequence
taagtggaatagcctccctg

SEQ ID NO: 316582 - DNA, 20 bp, Artificial
  CRISPR gRNA sequence
agtggaatagcctccctgta

SEQ ID NO: 316583 - DNA, 20 bp, Artificial
  CRISPR gRNA sequence
cctgtaactccagctctgct

SEQ ID NO: 316584 - DNA, 20 bp, Artificial
  CRISPR gRNA sequence
taactccagctctgctccgt

SEQ ID NO: 316585 - DNA, 20 bp, Artificial
  CRISPR gRNA sequence
cagctctgctccgtatgcca

SEQ ID NO: 316586 - DNA, 20 bp, Artificial
  CRISPR gRNA sequence
tgctccgtatgccaagagga

SEQ ID NO: 316587 - DNA, 20 bp, Artificial
  CRISPR gRNA sequence
ctccgtatgccaagaggaga

SEQ ID NO: 316588 - DNA, 20 bp, Artificial
  CRISPR gRNA sequence
cgtatgccaagaggagactt

SEQ ID NO: 316589 - DNA, 20 bp, Artificial
  CRISPR gRNA sequence
taattctcttactgcttctt

SEQ ID NO: 316590 - DNA, 20 bp, Artificial
  CRISPR gRNA sequence
aattctcttactgcttcttt

SEQ ID NO: 316591 - DNA, 20 bp, Artificial
  CRISPR gRNA sequence
attctcttactgcttctttt

SEQ ID NO: 316592 - DNA, 20 bp, Artificial
  CRISPR gRNA sequence
tcttactgcttcttttcact

SEQ ID NO: 316593 - DNA, 20 bp, Artificial
  CRISPR gRNA sequence
ttactgcttcttttcacttc

SEQ ID NO: 316594 - DNA, 20 bp, Artificial
  CRISPR gRNA sequence
actgcttcttttcacttcag

SEQ ID NO: 316595 - DNA, 20 bp, Artificial
  CRISPR gRNA sequence
ctgcttcttttcacttcaga

SEQ ID NO: 316596 - DNA, 20 bp, Artificial
  CRISPR gRNA sequence
cttcttttcacttcagagca

SEQ ID NO: 316597 - DNA, 20 bp, Artificial
  CRISPR gRNA sequence
cttttcacttcagagcacac

SEQ ID NO: 316598 - DNA, 20 bp, Artificial
  CRISPR gRNA sequence
ttttcacttcagagcacact

SEQ ID NO: 316599 - DNA, 20 bp, Artificial
  CRISPR gRNA sequence
ttcacttcagagcacactta

SEQ ID NO: 316600 - DNA, 20 bp, Artificial
  CRISPR gRNA sequence
tcacttcagagcacacttat

SEQ ID NO: 316601 - DNA, 20 bp, Artificial
  CRISPR gRNA sequence
cacttcagagcacacttatg

SEQ ID NO: 316602 - DNA, 20 bp, Artificial
  CRISPR gRNA sequence
acttcagagcacacttatgg

SEQ ID NO: 316603 - DNA, 20 bp, Artificial
  CRISPR gRNA sequence
cagagcacacttatgggcca

SEQ ID NO: 316604 - DNA, 20 bp, Artificial
  CRISPR gRNA sequence
agagcacacttatgggccaa

SEQ ID NO: 316605 - DNA, 20 bp, Artificial
  CRISPR gRNA sequence
atgggccaagcccagcttaa

SEQ ID NO: 316606 - DNA, 20 bp, Artificial
  CRISPR gRNA sequence
tgggccaagcccagcttaat

SEQ ID NO: 316607 - DNA, 20 bp, Artificial
  CRISPR gRNA sequence
aatggctcatgacctggaaa

SEQ ID NO: 316608 - DNA, 20 bp, Artificial
  CRISPR gRNA sequence
atggctcatgacctggaaat

SEQ ID NO: 316609 - DNA, 20 bp, Artificial
  CRISPR gRNA sequence
atgacctggaaataaaattt

SEQ ID NO: 316610 - DNA, 20 bp, Artificial
  CRISPR gRNA sequence
gaaataaaatttaggaccaa

SEQ ID NO: 316611 - DNA, 20 bp, Artificial
  CRISPR gRNA sequence
aggaccaatacctcctccag

SEQ ID NO: 316612 - DNA, 20 bp, Artificial
  CRISPR gRNA sequence
ggaccaatacctcctccaga

SEQ ID NO: 316613 - DNA, 20 bp, Artificial
  CRISPR gRNA sequence
ctccagatcagattcttctc

SEQ ID NO: 316614 - DNA, 20 bp, Artificial
  CRISPR gRNA sequence
cagatcagattcttctctta

SEQ ID NO: 316615 - DNA, 20 bp, Artificial
  CRISPR gRNA sequence
ttctcttaatttcatagatt

SEQ ID NO: 316616 - DNA, 20 bp, Artificial
  CRISPR gRNA sequence
ctcttaatttcatagattgt

SEQ ID NO: 316617 - DNA, 20 bp, Artificial
  CRISPR gRNA sequence
tcttaatttcatagattgtg

SEQ ID NO: 316618 - DNA, 20 bp, Artificial
  CRISPR gRNA sequence
ttaatttcatagattgtgtt

SEQ ID NO: 316619 - DNA, 20 bp, Artificial
  CRISPR gRNA sequence
aatttcatagattgtgtttt

SEQ ID NO: 316620 - DNA, 20 bp, Artificial
  CRISPR gRNA sequence
atttcatagattgtgttttt

SEQ ID NO: 316621 - DNA, 20 bp, Artificial
  CRISPR gRNA sequence
catagattgtgttttttttt

SEQ ID NO: 316622 - DNA, 20 bp, Artificial
  CRISPR gRNA sequence
atagattgtgtttttttttt

SEQ ID NO: 316623 - DNA, 20 bp, Artificial
  CRISPR gRNA sequence
tgttttttttttaaatagac

SEQ ID NO: 316624 - DNA, 20 bp, Artificial
  CRISPR gRNA sequence
tttttttaaatagacctctc

SEQ ID NO: 316625 - DNA, 20 bp, Artificial
  CRISPR gRNA sequence
ttttttaaatagacctctca

SEQ ID NO: 316626 - DNA, 20 bp, Artificial
  CRISPR gRNA sequence
tttttaaatagacctctcaa

SEQ ID NO: 316627 - DNA, 20 bp, Artificial
  CRISPR gRNA sequence
ttttaaatagacctctcaat

SEQ ID NO: 316628 - DNA, 20 bp, Artificial
  CRISPR gRNA sequence
tttaaatagacctctcaatt

SEQ ID NO: 316629 - DNA, 20 bp, Artificial
  CRISPR gRNA sequence
ttaaatagacctctcaattt

SEQ ID NO: 316630 - DNA, 20 bp, Artificial
  CRISPR gRNA sequence
taaatagacctctcaatttc

SEQ ID NO: 316631 - DNA, 20 bp, Artificial
  CRISPR gRNA sequence
aaatagacctctcaatttct

SEQ ID NO: 316632 - DNA, 20 bp, Artificial
  CRISPR gRNA sequence
aatagacctctcaatttctg

SEQ ID NO: 316633 - DNA, 20 bp, Artificial
  CRISPR gRNA sequence
tcaatttctggaaaactgcc

SEQ ID NO: 316634 - DNA, 20 bp, Artificial
  CRISPR gRNA sequence
aatttctggaaaactgcctt

SEQ ID NO: 316635 - DNA, 20 bp, Artificial
  CRISPR gRNA sequence
ctggaaaactgccttttatc

SEQ ID NO: 316636 - DNA, 20 bp, Artificial
  CRISPR gRNA sequence
tggaaaactgccttttatct

SEQ ID NO: 316637 - DNA, 20 bp, Artificial
  CRISPR gRNA sequence
gaaaactgccttttatctgc

SEQ ID NO: 316638 - DNA, 20 bp, Artificial
  CRISPR gRNA sequence
ccttttatctgcccagaatt

SEQ ID NO: 316639 - DNA, 20 bp, Artificial
  CRISPR gRNA sequence
ttatctgcccagaattctaa

SEQ ID NO: 316640 - DNA, 20 bp, Artificial
  CRISPR gRNA sequence
tatctgcccagaattctaag

SEQ ID NO: 316641 - DNA, 20 bp, Artificial
  CRISPR gRNA sequence
atctgcccagaattctaagc

SEQ ID NO: 316642 - DNA, 20 bp, Artificial
  CRISPR gRNA sequence
tctgcccagaattctaagct

SEQ ID NO: 316643 - DNA, 20 bp, Artificial
  CRISPR gRNA sequence
cccagaattctaagctggtg

SEQ ID NO: 316644 - DNA, 20 bp, Artificial
  CRISPR gRNA sequence
taagctggtgccccactgaa

SEQ ID NO: 316645 - DNA, 20 bp, Artificial
  CRISPR gRNA sequence
agctggtgccccactgaatt

SEQ ID NO: 316646 - DNA, 20 bp, Artificial
  CRISPR gRNA sequence
gtgccccactgaattttgtg

SEQ ID NO: 316647 - DNA, 20 bp, Artificial
  CRISPR gRNA sequence
aattttgtgtgtacctgtga

SEQ ID NO: 316648 - DNA, 20 bp, Artificial
  CRISPR gRNA sequence
tgtgtgtacctgtgactaaa

SEQ ID NO: 316649 - DNA, 20 bp, Artificial
  CRISPR gRNA sequence
gtgtgtacctgtgactaaac

SEQ ID NO: 316650 - DNA, 20 bp, Artificial
  CRISPR gRNA sequence
tgtgtacctgtgactaaaca

SEQ ID NO: 316651 - DNA, 20 bp, Artificial
  CRISPR gRNA sequence
tgactaaacaactacctcct

SEQ ID NO: 316652 - DNA, 20 bp, Artificial
  CRISPR gRNA sequence
aacaactacctcctcagtct

SEQ ID NO: 316653 - DNA, 20 bp, Artificial
  CRISPR gRNA sequence
cctcctcagtctgggtggga

SEQ ID NO: 316654 - DNA, 20 bp, Artificial
  CRISPR gRNA sequence
ctcagtctgggtgggactta

SEQ ID NO: 316655 - DNA, 20 bp, Artificial
  CRISPR gRNA sequence
agtctgggtgggacttatgt

SEQ ID NO: 316656 - DNA, 20 bp, Artificial
  CRISPR gRNA sequence
ggtgggacttatgtatttat

SEQ ID NO: 316657 - DNA, 20 bp, Artificial
  CRISPR gRNA sequence
atgtatttatgaccttatag

SEQ ID NO: 316658 - DNA, 20 bp, Artificial
  CRISPR gRNA sequence
tgtatttatgaccttatagt

SEQ ID NO: 316659 - DNA, 20 bp, Artificial
  CRISPR gRNA sequence
atgaccttatagtgttaata

SEQ ID NO: 316660 - DNA, 20 bp, Artificial
  CRISPR gRNA sequence
tgaccttatagtgttaatat

SEQ ID NO: 316661 - DNA, 20 bp, Artificial
  CRISPR gRNA sequence
atagtgttaatatcttgaaa

SEQ ID NO: 316662 - DNA, 20 bp, Artificial
  CRISPR gRNA sequence
tagtgttaatatcttgaaac

SEQ ID NO: 316663 - DNA, 20 bp, Artificial
  CRISPR gRNA sequence
atatcttgaaacatagagat

SEQ ID NO: 316664 - DNA, 20 bp, Artificial
  CRISPR gRNA sequence
gaaacatagagatctatgta

SEQ ID NO: 316665 - DNA, 20 bp, Artificial
  CRISPR gRNA sequence
aaacatagagatctatgtac

SEQ ID NO: 316666 - DNA, 20 bp, Artificial
  CRISPR gRNA sequence
tgtactgtaatagtgtgatt

SEQ ID NO: 316667 - DNA, 20 bp, Artificial
  CRISPR gRNA sequence
taatagtgtgattactatgc

SEQ ID NO: 316668 - DNA, 20 bp, Artificial
  CRISPR gRNA sequence
ctatgctctagagaaaagtc

SEQ ID NO: 316669 - DNA, 20 bp, Artificial
  CRISPR gRNA sequence
tgctctagagaaaagtctac

SEQ ID NO: 316670 - DNA, 20 bp, Artificial
  CRISPR gRNA sequence
tagagaaaagtctacccctg

SEQ ID NO: 316671 - DNA, 20 bp, Artificial
  CRISPR gRNA sequence
gagaaaagtctacccctgct

SEQ ID NO: 316672 - DNA, 20 bp, Artificial
  CRISPR gRNA sequence
cccctgctaaggagttctca

SEQ ID NO: 316673 - DNA, 20 bp, Artificial
  CRISPR gRNA sequence
ctaaggagttctcatccctc

SEQ ID NO: 316674 - DNA, 20 bp, Artificial
  CRISPR gRNA sequence
aggagttctcatccctctgt

SEQ ID NO: 316675 - DNA, 20 bp, Artificial
  CRISPR gRNA sequence
tcatccctctgtcagggtca

SEQ ID NO: 316676 - DNA, 20 bp, Artificial
  CRISPR gRNA sequence
atccctctgtcagggtcagt

SEQ ID NO: 316677 - DNA, 20 bp, Artificial
  CRISPR gRNA sequence
tgtcagggtcagtaaggaaa

SEQ ID NO: 316678 - DNA, 20 bp, Artificial
  CRISPR gRNA sequence
tcagggtcagtaaggaaaac

SEQ ID NO: 316679 - DNA, 20 bp, Artificial
  CRISPR gRNA sequence
gggtacaggcaacaatgagc

SEQ ID NO: 316680 - DNA, 20 bp, Artificial
  CRISPR gRNA sequence
aatttggggaaattaggaga

SEQ ID NO: 316681 - DNA, 20 bp, Artificial
  CRISPR gRNA sequence
ggggaaattaggagaggcag

SEQ ID NO: 316682 - DNA, 20 bp, Artificial
  CRISPR gRNA sequence
gggaaattaggagaggcaga

SEQ ID NO: 316683 - DNA, 20 bp, Artificial
  CRISPR gRNA sequence
ggagaggcagagatagaacc

SEQ ID NO: 316684 - DNA, 20 bp, Artificial
  CRISPR gRNA sequence
gagccacttctatctgggct

SEQ ID NO: 316685 - DNA, 20 bp, Artificial
  CRISPR gRNA sequence
ctatctgggctgttgctaat

SEQ ID NO: 316686 - DNA, 20 bp, Artificial
  CRISPR gRNA sequence
tatctgggctgttgctaata

SEQ ID NO: 316687 - DNA, 20 bp, Artificial
  CRISPR gRNA sequence
tctgggctgttgctaatatt

SEQ ID NO: 316688 - DNA, 20 bp, Artificial
  CRISPR gRNA sequence
ggctgttgctaatattgagg

SEQ ID NO: 316689 - DNA, 20 bp, Artificial
  CRISPR gRNA sequence
ttgctaatattgaggaggct

SEQ ID NO: 316690 - DNA, 20 bp, Artificial
  CRISPR gRNA sequence
ctaatattgaggaggcttgc

SEQ ID NO: 316691 - DNA, 20 bp, Artificial
  CRISPR gRNA sequence
atattgaggaggcttgcccc

SEQ ID NO: 316692 - DNA, 20 bp, Artificial
  CRISPR gRNA sequence
aggaggcttgccccacccaa

SEQ ID NO: 316693 - DNA, 20 bp, Artificial
  CRISPR gRNA sequence
gccccacccaacaagccata

SEQ ID NO: 316694 - DNA, 20 bp, Artificial
  CRISPR gRNA sequence
ccccacccaacaagccatag

SEQ ID NO: 316695 - DNA, 20 bp, Artificial
  CRISPR gRNA sequence
aataaacaggaaaatgccag

SEQ ID NO: 316696 - DNA, 20 bp, Artificial
  CRISPR gRNA sequence
gtgaaccctgtttctcttga

SEQ ID NO: 316697 - DNA, 20 bp, Artificial
  CRISPR gRNA sequence
tgaaccctgtttctcttgaa

SEQ ID NO: 316698 - DNA, 20 bp, Artificial
  CRISPR gRNA sequence
tttctcttgaagaactgact

SEQ ID NO: 316699 - DNA, 20 bp, Artificial
  CRISPR gRNA sequence
ctcttgaagaactgactagt

SEQ ID NO: 316700 - DNA, 20 bp, Artificial
  CRISPR gRNA sequence
tcttgaagaactgactagtg

SEQ ID NO: 316701 - DNA, 20 bp, Artificial
  CRISPR gRNA sequence
ttgaagaactgactagtgag

SEQ ID NO: 316702 - DNA, 20 bp, Artificial
  CRISPR gRNA sequence
gaagaactgactagtgagat

SEQ ID NO: 316703 - DNA, 20 bp, Artificial
  CRISPR gRNA sequence
aagaactgactagtgagatg

SEQ ID NO: 316704 - DNA, 20 bp, Artificial
  CRISPR gRNA sequence
actagtgagatggcctgggg

SEQ ID NO: 316705 - DNA, 20 bp, Artificial
  CRISPR gRNA sequence
gtgagatggcctggggaagc

SEQ ID NO: 316706 - DNA, 20 bp, Artificial
  CRISPR gRNA sequence
gggaagctgtgaaagaacca

SEQ ID NO: 316707 - DNA, 20 bp, Artificial
  CRISPR gRNA sequence
tgaaagaaccaaaagagatc

SEQ ID NO: 316708 - DNA, 20 bp, Artificial
  CRISPR gRNA sequence
aaaagagagagagagagaaa

SEQ ID NO: 316709 - DNA, 20 bp, Artificial
  CRISPR gRNA sequence
gatccacagaaatacatgaa

SEQ ID NO: 316710 - DNA, 20 bp, Artificial
  CRISPR gRNA sequence
atccacagaaatacatgaaa

SEQ ID NO: 316711 - DNA, 20 bp, Artificial
  CRISPR gRNA sequence
gtctgtccaccccatcaaca

SEQ ID NO: 316712 - DNA, 20 bp, Artificial
  CRISPR gRNA sequence
tccaccccatcaacaagtct

SEQ ID NO: 316713 - DNA, 20 bp, Artificial
  CRISPR gRNA sequence
gaaacaagcaacagatggat

SEQ ID NO: 316714 - DNA, 20 bp, Artificial
  CRISPR gRNA sequence
aaacaagcaacagatggata

SEQ ID NO: 316715 - DNA, 20 bp, Artificial
  CRISPR gRNA sequence
tccaaatggacataagacag

SEQ ID NO: 316716 - DNA, 20 bp, Artificial
  CRISPR gRNA sequence
ccctggtggtcagggagggg

SEQ ID NO: 316717 - DNA, 20 bp, Artificial
  CRISPR gRNA sequence
cctggtggtcagggaggggt

SEQ ID NO: 316718 - DNA, 20 bp, Artificial
  CRISPR gRNA sequence
gtggtcagggaggggttttg

SEQ ID NO: 316719 - DNA, 20 bp, Artificial
  CRISPR gRNA sequence
tggtgatacccaagttattg

SEQ ID NO: 316720 - DNA, 20 bp, Artificial
  CRISPR gRNA sequence
ggtgatacccaagttattgg

SEQ ID NO: 316721 - DNA, 20 bp, Artificial
  CRISPR gRNA sequence
gtgatacccaagttattggg

SEQ ID NO: 316722 - DNA, 20 bp, Artificial
  CRISPR gRNA sequence
ttgggatgtcatcttcctgg

SEQ ID NO: 316723 - DNA, 20 bp, Artificial
  CRISPR gRNA sequence
ggatgtcatcttcctggaag

SEQ ID NO: 316724 - DNA, 20 bp, Artificial
  CRISPR gRNA sequence
cctggaagcagagctgggga

SEQ ID NO: 316725 - DNA, 20 bp, Artificial
  CRISPR gRNA sequence
ctggaagcagagctggggag

SEQ ID NO: 316726 - DNA, 20 bp, Artificial
  CRISPR gRNA sequence
gaagcagagctggggaggga

SEQ ID NO: 316727 - DNA, 20 bp, Artificial
  CRISPR gRNA sequence
gggagggagagccatcacct

SEQ ID NO: 316728 - DNA, 20 bp, Artificial
  CRISPR gRNA sequence
gataatgggatgaatggaag

SEQ ID NO: 316729 - DNA, 20 bp, Artificial
  CRISPR gRNA sequence
ataatgggatgaatggaagg

SEQ ID NO: 316730 - DNA, 20 bp, Artificial
  CRISPR gRNA sequence
aggactttccactcctggct

SEQ ID NO: 316731 - DNA, 20 bp, Artificial
  CRISPR gRNA sequence
ggactttccactcctggctg

SEQ ID NO: 316732 - DNA, 20 bp, Artificial
  CRISPR gRNA sequence
tccactcctggctgagagag

SEQ ID NO: 316733 - DNA, 20 bp, Artificial
  CRISPR gRNA sequence
ccactcctggctgagagagg

SEQ ID NO: 316734 - DNA, 20 bp, Artificial
  CRISPR gRNA sequence
cactcctggctgagagagga

SEQ ID NO: 316735 - DNA, 20 bp, Artificial
  CRISPR gRNA sequence
ctggctgagagaggaagagc

SEQ ID NO: 316736 - DNA, 20 bp, Artificial
  CRISPR gRNA sequence
gctgagagaggaagagctgc

SEQ ID NO: 316737 - DNA, 20 bp, Artificial
  CRISPR gRNA sequence
agagaggaagagctgcaacg

SEQ ID NO: 316738 - DNA, 20 bp, Artificial
  CRISPR gRNA sequence
caacggaattaggaagacca

SEQ ID NO: 316739 - DNA, 20 bp, Artificial
  CRISPR gRNA sequence
ggaagaccaagacacagatc

SEQ ID NO: 316740 - DNA, 20 bp, Artificial
  CRISPR gRNA sequence
acttagcctacagatgtcct

SEQ ID NO: 316741 - DNA, 20 bp, Artificial
  CRISPR gRNA sequence
cttagcctacagatgtccta

SEQ ID NO: 316742 - DNA, 20 bp, Artificial
  CRISPR gRNA sequence
agcctacagatgtcctacgg

SEQ ID NO: 316743 - DNA, 20 bp, Artificial
  CRISPR gRNA sequence
gcctacagatgtcctacggg

SEQ ID NO: 316744 - DNA, 20 bp, Artificial
  CRISPR gRNA sequence
cagatgtcctacgggaacgt

SEQ ID NO: 316745 - DNA, 20 bp, Artificial
  CRISPR gRNA sequence
cgggaacgtgggctggccca

SEQ ID NO: 316746 - DNA, 20 bp, Artificial
  CRISPR gRNA sequence
gcccagcatagggctagcaa

SEQ ID NO: 316747 - DNA, 20 bp, Artificial
  CRISPR gRNA sequence
gcaaatttgagttggatgat

SEQ ID NO: 316748 - DNA, 20 bp, Artificial
  CRISPR gRNA sequence
gagttggatgattgtttttg

SEQ ID NO: 316749 - DNA, 20 bp, Artificial
  CRISPR gRNA sequence
agttggatgattgtttttgc

SEQ ID NO: 316750 - DNA, 20 bp, Artificial
  CRISPR gRNA sequence
gatgattgtttttgctcaag

SEQ ID NO: 316751 - DNA, 20 bp, Artificial
  CRISPR gRNA sequence
tttttgctcaaggcaaccag

SEQ ID NO: 316752 - DNA, 20 bp, Artificial
  CRISPR gRNA sequence
ttgctcaaggcaaccagagg

SEQ ID NO: 316753 - DNA, 20 bp, Artificial
  CRISPR gRNA sequence
tgctcaaggcaaccagagga

SEQ ID NO: 316754 - DNA, 20 bp, Artificial
  CRISPR gRNA sequence
gctcaaggcaaccagaggaa

SEQ ID NO: 316755 - DNA, 20 bp, Artificial
  CRISPR gRNA sequence
ctcaaggcaaccagaggaaa

SEQ ID NO: 316756 - DNA, 20 bp, Artificial
  CRISPR gRNA sequence
aaggcaaccagaggaaactt

SEQ ID NO: 316757 - DNA, 20 bp, Artificial
  CRISPR gRNA sequence
gcatacagagacagatatac

SEQ ID NO: 316758 - DNA, 20 bp, Artificial
  CRISPR gRNA sequence
catacagagacagatatact

SEQ ID NO: 316759 - DNA, 20 bp, Artificial
  CRISPR gRNA sequence
ggagaaatgactttgaaaac

SEQ ID NO: 316760 - DNA, 20 bp, Artificial
  CRISPR gRNA sequence
tgaaaacctggctctaaggt

SEQ ID NO: 316761 - DNA, 20 bp, Artificial
  CRISPR gRNA sequence
gaaaacctggctctaaggtg

SEQ ID NO: 316762 - DNA, 20 bp, Artificial
  CRISPR gRNA sequence
aaaacctggctctaaggtgg

SEQ ID NO: 316763 - DNA, 20 bp, Artificial
  CRISPR gRNA sequence
gctctaaggtgggatcacta

SEQ ID NO: 316764 - DNA, 20 bp, Artificial
  CRISPR gRNA sequence
taaggtgggatcactaaggg

SEQ ID NO: 316765 - DNA, 20 bp, Artificial
  CRISPR gRNA sequence
aggtgggatcactaagggat

SEQ ID NO: 316766 - DNA, 20 bp, Artificial
  CRISPR gRNA sequence
agggatggggcagtctctgc

SEQ ID NO: 316767 - DNA, 20 bp, Artificial
  CRISPR gRNA sequence
tgcccaaacataaagagaac

SEQ ID NO: 316768 - DNA, 20 bp, Artificial
  CRISPR gRNA sequence
cccaaacataaagagaactc

SEQ ID NO: 316769 - DNA, 20 bp, Artificial
  CRISPR gRNA sequence
tggggagcctgagccacaaa

SEQ ID NO: 316770 - DNA, 20 bp, Artificial
  CRISPR gRNA sequence
gggagcctgagccacaaaaa

SEQ ID NO: 316771 - DNA, 20 bp, Artificial
  CRISPR gRNA sequence
agccacaaaaatgttccttt

SEQ ID NO: 316772 - DNA, 20 bp, Artificial
  CRISPR gRNA sequence
ctttattttatgtaaaccct

SEQ ID NO: 316773 - DNA, 20 bp, Artificial
  CRISPR gRNA sequence
tattttatgtaaaccctcaa

SEQ ID NO: 316774 - DNA, 20 bp, Artificial
  CRISPR gRNA sequence
attttatgtaaaccctcaag

SEQ ID NO: 316775 - DNA, 20 bp, Artificial
  CRISPR gRNA sequence
ttttatgtaaaccctcaagg

SEQ ID NO: 316776 - DNA, 20 bp, Artificial
  CRISPR gRNA sequence
tatgtaaaccctcaagggtt

SEQ ID NO: 316777 - DNA, 20 bp, Artificial
  CRISPR gRNA sequence
atgtaaaccctcaagggtta

SEQ ID NO: 316778 - DNA, 20 bp, Artificial
  CRISPR gRNA sequence
tgtaaaccctcaagggttat

SEQ ID NO: 316779 - DNA, 20 bp, Artificial
  CRISPR gRNA sequence
aagggttatagactgccatg

SEQ ID NO: 316780 - DNA, 20 bp, Artificial
  CRISPR gRNA sequence
tagactgccatgctagacaa

SEQ ID NO: 316781 - DNA, 20 bp, Artificial
  CRISPR gRNA sequence
ccatgctagacaagcttgtc

SEQ ID NO: 316782 - DNA, 20 bp, Artificial
  CRISPR gRNA sequence
gacaagcttgtccatgtaat

SEQ ID NO: 316783 - DNA, 20 bp, Artificial
  CRISPR gRNA sequence
gtccatgtaatattcccatg

SEQ ID NO: 316784 - DNA, 20 bp, Artificial
  CRISPR gRNA sequence
tccatgtaatattcccatgt

SEQ ID NO: 316785 - DNA, 20 bp, Artificial
  CRISPR gRNA sequence
ccatgtttttaccctgcccc

SEQ ID NO: 316786 - DNA, 20 bp, Artificial
  CRISPR gRNA sequence
ttaccctgcccctgccttga

SEQ ID NO: 316787 - DNA, 20 bp, Artificial
  CRISPR gRNA sequence
taccctgcccctgccttgat

SEQ ID NO: 316788 - DNA, 20 bp, Artificial
  CRISPR gRNA sequence
accctgcccctgccttgatt

SEQ ID NO: 316789 - DNA, 20 bp, Artificial
  CRISPR gRNA sequence
ccctgcccctgccttgatta

SEQ ID NO: 316790 - DNA, 20 bp, Artificial
  CRISPR gRNA sequence
cccctgccttgattagactc

SEQ ID NO: 316791 - DNA, 20 bp, Artificial
  CRISPR gRNA sequence
ccttgattagactcctagca

SEQ ID NO: 316792 - DNA, 20 bp, Artificial
  CRISPR gRNA sequence
gattagactcctagcacctg

SEQ ID NO: 316793 - DNA, 20 bp, Artificial
  CRISPR gRNA sequence
attagactcctagcacctgg

SEQ ID NO: 316794 - DNA, 20 bp, Artificial
  CRISPR gRNA sequence
gactcctagcacctggctag

SEQ ID NO: 316795 - DNA, 20 bp, Artificial
  CRISPR gRNA sequence
ctagcacctggctagtttct

SEQ ID NO: 316796 - DNA, 20 bp, Artificial
  CRISPR gRNA sequence
gcacctggctagtttctaac

SEQ ID NO: 316797 - DNA, 20 bp, Artificial
  CRISPR gRNA sequence
gctagtttctaacatgtttt

SEQ ID NO: 316798 - DNA, 20 bp, Artificial
  CRISPR gRNA sequence
gtttctaacatgttttgtgc

SEQ ID NO: 316799 - DNA, 20 bp, Artificial
  CRISPR gRNA sequence
ctaacatgttttgtgcagca

SEQ ID NO: 316800 - DNA, 20 bp, Artificial
  CRISPR gRNA sequence
taacatgttttgtgcagcac

SEQ ID NO: 316801 - DNA, 20 bp, Artificial
  CRISPR gRNA sequence
acatgttttgtgcagcacag

SEQ ID NO: 316802 - DNA, 20 bp, Artificial
  CRISPR gRNA sequence
tgtgcagcacagtttttaat

SEQ ID NO: 316803 - DNA, 20 bp, Artificial
  CRISPR gRNA sequence
gtgcagcacagtttttaata

SEQ ID NO: 316804 - DNA, 20 bp, Artificial
  CRISPR gRNA sequence
tgcagcacagtttttaataa

SEQ ID NO: 316805 - DNA, 20 bp, Artificial
  CRISPR gRNA sequence
ttaataaatgcttgttacat

SEQ ID NO: 316806 - DNA, 20 bp, Artificial
  CRISPR gRNA sequence
taataaatgcttgttacatt

SEQ ID NO: 316807 - DNA, 20 bp, Artificial
  CRISPR gRNA sequence
aataaatgcttgttacattc

SEQ ID NO: 316808 - DNA, 20 bp, Artificial
  CRISPR gRNA sequence
ataaatgcttgttacattca

SEQ ID NO: 316809 - DNA, 20 bp, Artificial
  CRISPR gRNA sequence
gttacattcatttaaaagtc

SEQ ID NO: 316810 - DNA, 20 bp, Artificial
  CRISPR gRNA sequence
ttacattcatttaaaagtct

SEQ ID NO: 316811 - DNA, 20 bp, Artificial
  CRISPR gRNA sequence
cattcatttaaaagtctaca

SEQ ID NO: 316812 - DNA, 20 bp, Artificial
  CRISPR gRNA sequence
atttaaaagtctacattttc

SEQ ID NO: 316813 - DNA, 20 bp, Artificial
  CRISPR gRNA sequence
aaaagtctacattttctgct

SEQ ID NO: 316814 - DNA, 20 bp, Artificial
  CRISPR gRNA sequence
aaagtctacattttctgctt

SEQ ID NO: 316815 - DNA, 20 bp, Artificial
  CRISPR gRNA sequence
cattttctgctttggcttca

SEQ ID NO: 316816 - DNA, 20 bp, Artificial
  CRISPR gRNA sequence
tctgctttggcttcaagagt

SEQ ID NO: 316817 - DNA, 20 bp, Artificial
  CRISPR gRNA sequence
ctgctttggcttcaagagta

SEQ ID NO: 316818 - DNA, 20 bp, Artificial
  CRISPR gRNA sequence
tgctttggcttcaagagtac

SEQ ID NO: 316819 - DNA, 20 bp, Artificial
  CRISPR gRNA sequence
ctttggcttcaagagtacta

SEQ ID NO: 316820 - DNA, 20 bp, Artificial
  CRISPR gRNA sequence
tggcttcaagagtactactc

SEQ ID NO: 316821 - DNA, 20 bp, Artificial
  CRISPR gRNA sequence
ggcttcaagagtactactca

SEQ ID NO: 316822 - DNA, 20 bp, Artificial
  CRISPR gRNA sequence
gcttcaagagtactactcaa

SEQ ID NO: 316823 - DNA, 20 bp, Artificial
  CRISPR gRNA sequence
caagagtactactcaaccct

SEQ ID NO: 316824 - DNA, 20 bp, Artificial
  CRISPR gRNA sequence
aagagtactactcaaccctt

SEQ ID NO: 316825 - DNA, 20 bp, Artificial
  CRISPR gRNA sequence
ctcaacccttgtggtctgat

SEQ ID NO: 316826 - DNA, 20 bp, Artificial
  CRISPR gRNA sequence
aacccttgtggtctgatgtt

SEQ ID NO: 316827 - DNA, 20 bp, Artificial
  CRISPR gRNA sequence
gtggtctgatgttccctgct

SEQ ID NO: 316828 - DNA, 20 bp, Artificial
  CRISPR gRNA sequence
tggtctgatgttccctgctc

SEQ ID NO: 316829 - DNA, 20 bp, Artificial
  CRISPR gRNA sequence
atgttccctgctctgtcctc

SEQ ID NO: 316830 - DNA, 20 bp, Artificial
  CRISPR gRNA sequence
cctgctctgtcctctgaatg

SEQ ID NO: 316831 - DNA, 20 bp, Artificial
  CRISPR gRNA sequence
ctctgtcctctgaatgtact

SEQ ID NO: 316832 - DNA, 20 bp, Artificial
  CRISPR gRNA sequence
tgtcctctgaatgtacttcc

SEQ ID NO: 316833 - DNA, 20 bp, Artificial
  CRISPR gRNA sequence
tcctctgaatgtacttcctt

SEQ ID NO: 316834 - DNA, 20 bp, Artificial
  CRISPR gRNA sequence
tgaatgtacttcctttctct

SEQ ID NO: 316835 - DNA, 20 bp, Artificial
  CRISPR gRNA sequence
aatgtacttcctttctcttt

SEQ ID NO: 316836 - DNA, 20 bp, Artificial
  CRISPR gRNA sequence
agaggacagagcagggaaca

SEQ ID NO: 316837 - DNA, 20 bp, Artificial
  CRISPR gRNA sequence
agtagtactcttgaagccaa

SEQ ID NO: 316838 - DNA, 20 bp, Artificial
  CRISPR gRNA sequence
ttgaagccaaagcagaaaat

SEQ ID NO: 316839 - DNA, 20 bp, Artificial
  CRISPR gRNA sequence
gaagccaaagcagaaaatgt

SEQ ID NO: 316840 - DNA, 20 bp, Artificial
  CRISPR gRNA sequence
aagccaaagcagaaaatgta

SEQ ID NO: 316841 - DNA, 20 bp, Artificial
  CRISPR gRNA sequence
ttaaatgaatgtaacaagca

SEQ ID NO: 316842 - DNA, 20 bp, Artificial
  CRISPR gRNA sequence
taaatgaatgtaacaagcat

SEQ ID NO: 316843 - DNA, 20 bp, Artificial
  CRISPR gRNA sequence
aaatgaatgtaacaagcatt

SEQ ID NO: 316844 - DNA, 20 bp, Artificial
  CRISPR gRNA sequence
aatgaatgtaacaagcattt

SEQ ID NO: 316845 - DNA, 20 bp, Artificial
  CRISPR gRNA sequence
attaaaaactgtgctgcaca

SEQ ID NO: 316846 - DNA, 20 bp, Artificial
  CRISPR gRNA sequence
ttaaaaactgtgctgcacaa

SEQ ID NO: 316847 - DNA, 20 bp, Artificial
  CRISPR gRNA sequence
aaaactgtgctgcacaaaac

SEQ ID NO: 316848 - DNA, 20 bp, Artificial
  CRISPR gRNA sequence
tgctgcacaaaacatgttag

SEQ ID NO: 316849 - DNA, 20 bp, Artificial
  CRISPR gRNA sequence
cacaaaacatgttagaaact

SEQ ID NO: 316850 - DNA, 20 bp, Artificial
  CRISPR gRNA sequence
gaaactagccaggtgctagg

SEQ ID NO: 316851 - DNA, 20 bp, Artificial
  CRISPR gRNA sequence
gccaggtgctaggagtctaa

SEQ ID NO: 316852 - DNA, 20 bp, Artificial
  CRISPR gRNA sequence
ggagtctaatcaaggcaggg

SEQ ID NO: 316853 - DNA, 20 bp, Artificial
  CRISPR gRNA sequence
atcaaggcaggggcagggta

SEQ ID NO: 316854 - DNA, 20 bp, Artificial
  CRISPR gRNA sequence
catggacaagcttgtctagc

SEQ ID NO: 316855 - DNA, 20 bp, Artificial
  CRISPR gRNA sequence
gtctagcatggcagtctata

SEQ ID NO: 316856 - DNA, 20 bp, Artificial
  CRISPR gRNA sequence
tctagcatggcagtctataa

SEQ ID NO: 316857 - DNA, 20 bp, Artificial
  CRISPR gRNA sequence
gcatggcagtctataaccct

SEQ ID NO: 316858 - DNA, 20 bp, Artificial
  CRISPR gRNA sequence
taacccttgagggtttacat

SEQ ID NO: 316859 - DNA, 20 bp, Artificial
  CRISPR gRNA sequence
gagggtttacataaaataaa

SEQ ID NO: 316860 - DNA, 20 bp, Artificial
  CRISPR gRNA sequence
agggtttacataaaataaag

SEQ ID NO: 316861 - DNA, 20 bp, Artificial
  CRISPR gRNA sequence
acataaaataaaggaacatt

SEQ ID NO: 316862 - DNA, 20 bp, Artificial
  CRISPR gRNA sequence
cataaaataaaggaacattt

SEQ ID NO: 316863 - DNA, 20 bp, Artificial
  CRISPR gRNA sequence
ttgtggctcaggctccccag

SEQ ID NO: 316864 - DNA, 20 bp, Artificial
  CRISPR gRNA sequence
tgtggctcaggctccccaga

SEQ ID NO: 316865 - DNA, 20 bp, Artificial
  CRISPR gRNA sequence
gtggctcaggctccccagag

SEQ ID NO: 316866 - DNA, 20 bp, Artificial
  CRISPR gRNA sequence
tggctcaggctccccagagt

SEQ ID NO: 316867 - DNA, 20 bp, Artificial
  CRISPR gRNA sequence
aggctccccagagttctctt

SEQ ID NO: 316868 - DNA, 20 bp, Artificial
  CRISPR gRNA sequence
cccagagttctctttatgtt

SEQ ID NO: 316869 - DNA, 20 bp, Artificial
  CRISPR gRNA sequence
tctttatgtttgggcagaga

SEQ ID NO: 316870 - DNA, 20 bp, Artificial
  CRISPR gRNA sequence
tttatgtttgggcagagact

SEQ ID NO: 316871 - DNA, 20 bp, Artificial
  CRISPR gRNA sequence
tatgtttgggcagagactgc

SEQ ID NO: 316872 - DNA, 20 bp, Artificial
  CRISPR gRNA sequence
atgtttgggcagagactgcc

SEQ ID NO: 316873 - DNA, 20 bp, Artificial
  CRISPR gRNA sequence
tgtttgggcagagactgccc

SEQ ID NO: 316874 - DNA, 20 bp, Artificial
  CRISPR gRNA sequence
gggcagagactgccccatcc

SEQ ID NO: 316875 - DNA, 20 bp, Artificial
  CRISPR gRNA sequence
ggcagagactgccccatccc

SEQ ID NO: 316876 - DNA, 20 bp, Artificial
  CRISPR gRNA sequence
ccccatcccttagtgatccc

SEQ ID NO: 316877 - DNA, 20 bp, Artificial
  CRISPR gRNA sequence
agtgatcccaccttagagcc

SEQ ID NO: 316878 - DNA, 20 bp, Artificial
  CRISPR gRNA sequence
gtgatcccaccttagagcca

SEQ ID NO: 316879 - DNA, 20 bp, Artificial
  CRISPR gRNA sequence
agagccaggttttcaaagtc

SEQ ID NO: 316880 - DNA, 20 bp, Artificial
  CRISPR gRNA sequence
gagccaggttttcaaagtca

SEQ ID NO: 316881 - DNA, 20 bp, Artificial
  CRISPR gRNA sequence
tcaaagtcatttctcccagt

SEQ ID NO: 316882 - DNA, 20 bp, Artificial
  CRISPR gRNA sequence
caaagtcatttctcccagta

SEQ ID NO: 316883 - DNA, 20 bp, Artificial
  CRISPR gRNA sequence
aaagtcatttctcccagtat

SEQ ID NO: 316884 - DNA, 20 bp, Artificial
  CRISPR gRNA sequence
ctcccagtatatctgtctct

SEQ ID NO: 316885 - DNA, 20 bp, Artificial
  CRISPR gRNA sequence
tcccagtatatctgtctctg

SEQ ID NO: 316886 - DNA, 20 bp, Artificial
  CRISPR gRNA sequence
ccagtatatctgtctctgta

SEQ ID NO: 316887 - DNA, 20 bp, Artificial
  CRISPR gRNA sequence
tctctgtatgcaagtttcct

SEQ ID NO: 316888 - DNA, 20 bp, Artificial
  CRISPR gRNA sequence
tgtatgcaagtttcctctgg

SEQ ID NO: 316889 - DNA, 20 bp, Artificial
  CRISPR gRNA sequence
tatgcaagtttcctctggtt

SEQ ID NO: 316890 - DNA, 20 bp, Artificial
  CRISPR gRNA sequence
cctctggttgccttgagcaa

SEQ ID NO: 316891 - DNA, 20 bp, Artificial
  CRISPR gRNA sequence
ctctggttgccttgagcaaa

SEQ ID NO: 316892 - DNA, 20 bp, Artificial
  CRISPR gRNA sequence
tggttgccttgagcaaaaac

SEQ ID NO: 316893 - DNA, 20 bp, Artificial
  CRISPR gRNA sequence
gttgccttgagcaaaaacaa

SEQ ID NO: 316894 - DNA, 20 bp, Artificial
  CRISPR gRNA sequence
ccttgagcaaaaacaatcat

SEQ ID NO: 316895 - DNA, 20 bp, Artificial
  CRISPR gRNA sequence
gagcaaaaacaatcatccaa

SEQ ID NO: 316896 - DNA, 20 bp, Artificial
  CRISPR gRNA sequence
agcaaaaacaatcatccaac

SEQ ID NO: 316897 - DNA, 20 bp, Artificial
  CRISPR gRNA sequence
aaatttgctagccctatgct

SEQ ID NO: 316898 - DNA, 20 bp, Artificial
  CRISPR gRNA sequence
gctagccctatgctgggcca

SEQ ID NO: 316899 - DNA, 20 bp, Artificial
  CRISPR gRNA sequence
ctagccctatgctgggccag

SEQ ID NO: 316900 - DNA, 20 bp, Artificial
  CRISPR gRNA sequence
gccctatgctgggccagccc

SEQ ID NO: 316901 - DNA, 20 bp, Artificial
  CRISPR gRNA sequence
tgctgggccagcccacgttc

SEQ ID NO: 316902 - DNA, 20 bp, Artificial
  CRISPR gRNA sequence
ggccagcccacgttcccgta

SEQ ID NO: 316903 - DNA, 20 bp, Artificial
  CRISPR gRNA sequence
ccgtaggacatctgtaggct

SEQ ID NO: 316904 - DNA, 20 bp, Artificial
  CRISPR gRNA sequence
taggctaagtaagccccggg

SEQ ID NO: 316905 - DNA, 20 bp, Artificial
  CRISPR gRNA sequence
agtaagccccgggtgatctg

SEQ ID NO: 316906 - DNA, 20 bp, Artificial
  CRISPR gRNA sequence
tgtcttggtcttcctaattc

SEQ ID NO: 316907 - DNA, 20 bp, Artificial
  CRISPR gRNA sequence
ggtcttcctaattccgttgc

SEQ ID NO: 316908 - DNA, 20 bp, Artificial
  CRISPR gRNA sequence
gtcttcctaattccgttgca

SEQ ID NO: 316909 - DNA, 20 bp, Artificial
  CRISPR gRNA sequence
cctaattccgttgcagctct

SEQ ID NO: 316910 - DNA, 20 bp, Artificial
  CRISPR gRNA sequence
ctaattccgttgcagctctt

SEQ ID NO: 316911 - DNA, 20 bp, Artificial
  CRISPR gRNA sequence
attccgttgcagctcttcct

SEQ ID NO: 316912 - DNA, 20 bp, Artificial
  CRISPR gRNA sequence
cgttgcagctcttcctctct

SEQ ID NO: 316913 - DNA, 20 bp, Artificial
  CRISPR gRNA sequence
cagctcttcctctctcagcc

SEQ ID NO: 316914 - DNA, 20 bp, Artificial
  CRISPR gRNA sequence
ttcctctctcagccaggagt

SEQ ID NO: 316915 - DNA, 20 bp, Artificial
  CRISPR gRNA sequence
cctctctcagccaggagtgg

SEQ ID NO: 316916 - DNA, 20 bp, Artificial
  CRISPR gRNA sequence
ctctctcagccaggagtgga

SEQ ID NO: 316917 - DNA, 20 bp, Artificial
  CRISPR gRNA sequence
tctcagccaggagtggaaag

SEQ ID NO: 316918 - DNA, 20 bp, Artificial
  CRISPR gRNA sequence
tcagccaggagtggaaagtc

SEQ ID NO: 316919 - DNA, 20 bp, Artificial
  CRISPR gRNA sequence
agccaggagtggaaagtcct

SEQ ID NO: 316920 - DNA, 20 bp, Artificial
  CRISPR gRNA sequence
agcctccttccattcatccc

SEQ ID NO: 316921 - DNA, 20 bp, Artificial
  CRISPR gRNA sequence
cttccattcatcccattatc

SEQ ID NO: 316922 - DNA, 20 bp, Artificial
  CRISPR gRNA sequence
ccattcatcccattatcaag

SEQ ID NO: 316923 - DNA, 20 bp, Artificial
  CRISPR gRNA sequence
cattcatcccattatcaagg

SEQ ID NO: 316924 - DNA, 20 bp, Artificial
  CRISPR gRNA sequence
atcccattatcaaggtgatg

SEQ ID NO: 316925 - DNA, 20 bp, Artificial
  CRISPR gRNA sequence
tcaaggtgatggctctccct

SEQ ID NO: 316926 - DNA, 20 bp, Artificial
  CRISPR gRNA sequence
tccctccccagctctgcttc

SEQ ID NO: 316927 - DNA, 20 bp, Artificial
  CRISPR gRNA sequence
cctccccagctctgcttcca

SEQ ID NO: 316928 - DNA, 20 bp, Artificial
  CRISPR gRNA sequence
cccagctctgcttccaggaa

SEQ ID NO: 316929 - DNA, 20 bp, Artificial
  CRISPR gRNA sequence
tgcttccaggaagatgacat

SEQ ID NO: 316930 - DNA, 20 bp, Artificial
  CRISPR gRNA sequence
cttccaggaagatgacatcc

SEQ ID NO: 316931 - DNA, 20 bp, Artificial
  CRISPR gRNA sequence
ccaggaagatgacatcccaa

SEQ ID NO: 316932 - DNA, 20 bp, Artificial
  CRISPR gRNA sequence
caggaagatgacatcccaat

SEQ ID NO: 316933 - DNA, 20 bp, Artificial
  CRISPR gRNA sequence
gggtatcaccaaaacccctc

SEQ ID NO: 316934 - DNA, 20 bp, Artificial
  CRISPR gRNA sequence
ggtatcaccaaaacccctcc

SEQ ID NO: 316935 - DNA, 20 bp, Artificial
  CRISPR gRNA sequence
cctgaccaccagggaaactg

SEQ ID NO: 316936 - DNA, 20 bp, Artificial
  CRISPR gRNA sequence
accaccagggaaactgctgt

SEQ ID NO: 316937 - DNA, 20 bp, Artificial
  CRISPR gRNA sequence
ctgtctgtcttatgtccatt

SEQ ID NO: 316938 - DNA, 20 bp, Artificial
  CRISPR gRNA sequence
tctgtcttatgtccatttgg

SEQ ID NO: 316939 - DNA, 20 bp, Artificial
  CRISPR gRNA sequence
tcttatgtccatttggacag

SEQ ID NO: 316940 - DNA, 20 bp, Artificial
  CRISPR gRNA sequence
atgtccatttggacagacta

SEQ ID NO: 316941 - DNA, 20 bp, Artificial
  CRISPR gRNA sequence
tgtccatttggacagactat

SEQ ID NO: 316942 - DNA, 20 bp, Artificial
  CRISPR gRNA sequence
ggacagactatccatctgtt

SEQ ID NO: 316943 - DNA, 20 bp, Artificial
  CRISPR gRNA sequence
gacagactatccatctgttg

SEQ ID NO: 316944 - DNA, 20 bp, Artificial
  CRISPR gRNA sequence
tccatctgttgcttgtttca

SEQ ID NO: 316945 - DNA, 20 bp, Artificial
  CRISPR gRNA sequence
ttgcttgtttcaagacttgt

SEQ ID NO: 316946 - DNA, 20 bp, Artificial
  CRISPR gRNA sequence
cttgtttcaagacttgttga

SEQ ID NO: 316947 - DNA, 20 bp, Artificial
  CRISPR gRNA sequence
gtttcaagacttgttgatgg

SEQ ID NO: 316948 - DNA, 20 bp, Artificial
  CRISPR gRNA sequence
tttcaagacttgttgatggg

SEQ ID NO: 316949 - DNA, 20 bp, Artificial
  CRISPR gRNA sequence
caagacttgttgatggggtg

SEQ ID NO: 316950 - DNA, 20 bp, Artificial
  CRISPR gRNA sequence
aagacttgttgatggggtgg

SEQ ID NO: 316951 - DNA, 20 bp, Artificial
  CRISPR gRNA sequence
gttgatggggtggacagacc

SEQ ID NO: 316952 - DNA, 20 bp, Artificial
  CRISPR gRNA sequence
ttgatggggtggacagacca

SEQ ID NO: 316953 - DNA, 20 bp, Artificial
  CRISPR gRNA sequence
atggggtggacagaccagac

SEQ ID NO: 316954 - DNA, 20 bp, Artificial
  CRISPR gRNA sequence
catgtatttctgtggatcaa

SEQ ID NO: 316955 - DNA, 20 bp, Artificial
  CRISPR gRNA sequence
atgtatttctgtggatcaag

SEQ ID NO: 316956 - DNA, 20 bp, Artificial
  CRISPR gRNA sequence
ctgtggatcaagatctctct

SEQ ID NO: 316957 - DNA, 20 bp, Artificial
  CRISPR gRNA sequence
tgtggatcaagatctctctt

SEQ ID NO: 316958 - DNA, 20 bp, Artificial
  CRISPR gRNA sequence
tggatcaagatctctctttt

SEQ ID NO: 316959 - DNA, 20 bp, Artificial
  CRISPR gRNA sequence
tcttttttctctctctctct

SEQ ID NO: 316960 - DNA, 20 bp, Artificial
  CRISPR gRNA sequence
ttttttctctctctctctct

SEQ ID NO: 316961 - DNA, 20 bp, Artificial
  CRISPR gRNA sequence
ttttctctctctctctcttt

SEQ ID NO: 316962 - DNA, 20 bp, Artificial
  CRISPR gRNA sequence
tttctctctctctctctttt

SEQ ID NO: 316963 - DNA, 20 bp, Artificial
  CRISPR gRNA sequence
ttctctctctctctcttttg

SEQ ID NO: 316964 - DNA, 20 bp, Artificial
  CRISPR gRNA sequence
tctctctctctctcttttga

SEQ ID NO: 316965 - DNA, 20 bp, Artificial
  CRISPR gRNA sequence
ctctctctctctcttttgag

SEQ ID NO: 316966 - DNA, 20 bp, Artificial
  CRISPR gRNA sequence
tctctctctctcttttgagt

SEQ ID NO: 316967 - DNA, 20 bp, Artificial
  CRISPR gRNA sequence
tctctctctcttttgagtat

SEQ ID NO: 316968 - DNA, 20 bp, Artificial
  CRISPR gRNA sequence
tctctctcttttgagtattg

SEQ ID NO: 316969 - DNA, 20 bp, Artificial
  CRISPR gRNA sequence
tctctcttttgagtattgtg

SEQ ID NO: 316970 - DNA, 20 bp, Artificial
  CRISPR gRNA sequence
tctcttttgagtattgtgat

SEQ ID NO: 316971 - DNA, 20 bp, Artificial
  CRISPR gRNA sequence
tcttttgagtattgtgatct

SEQ ID NO: 316972 - DNA, 20 bp, Artificial
  CRISPR gRNA sequence
ttttgagtattgtgatctct

SEQ ID NO: 316973 - DNA, 20 bp, Artificial
  CRISPR gRNA sequence
ttgagtattgtgatctcttt

SEQ ID NO: 316974 - DNA, 20 bp, Artificial
  CRISPR gRNA sequence
tgagtattgtgatctctttt

SEQ ID NO: 316975 - DNA, 20 bp, Artificial
  CRISPR gRNA sequence
gagtattgtgatctcttttg

SEQ ID NO: 316976 - DNA, 20 bp, Artificial
  CRISPR gRNA sequence
agtattgtgatctcttttgg

SEQ ID NO: 316977 - DNA, 20 bp, Artificial
  CRISPR gRNA sequence
tgatctcttttggttctttc

SEQ ID NO: 316978 - DNA, 20 bp, Artificial
  CRISPR gRNA sequence
ttttggttctttcacagctt

SEQ ID NO: 316979 - DNA, 20 bp, Artificial
  CRISPR gRNA sequence
ttggttctttcacagcttcc

SEQ ID NO: 316980 - DNA, 20 bp, Artificial
  CRISPR gRNA sequence
tggttctttcacagcttccc

SEQ ID NO: 316981 - DNA, 20 bp, Artificial
  CRISPR gRNA sequence
ggttctttcacagcttcccc

SEQ ID NO: 316982 - DNA, 20 bp, Artificial
  CRISPR gRNA sequence
gttctttcacagcttcccca

SEQ ID NO: 316983 - DNA, 20 bp, Artificial
  CRISPR gRNA sequence
tttcacagcttccccaggcc

SEQ ID NO: 316984 - DNA, 20 bp, Artificial
  CRISPR gRNA sequence
tcacagcttccccaggccat

SEQ ID NO: 316985 - DNA, 20 bp, Artificial
  CRISPR gRNA sequence
cacagcttccccaggccatc

SEQ ID NO: 316986 - DNA, 20 bp, Artificial
  CRISPR gRNA sequence
acagcttccccaggccatct

SEQ ID NO: 316987 - DNA, 20 bp, Artificial
  CRISPR gRNA sequence
ccccaggccatctcactagt

SEQ ID NO: 316988 - DNA, 20 bp, Artificial
  CRISPR gRNA sequence
cccaggccatctcactagtc

SEQ ID NO: 316989 - DNA, 20 bp, Artificial
  CRISPR gRNA sequence
actagtcagttcttcaagag

SEQ ID NO: 316990 - DNA, 20 bp, Artificial
  CRISPR gRNA sequence
gtcagttcttcaagagaaac

SEQ ID NO: 316991 - DNA, 20 bp, Artificial
  CRISPR gRNA sequence
ttcaagagaaacagggttca

SEQ ID NO: 316992 - DNA, 20 bp, Artificial
  CRISPR gRNA sequence
caagagaaacagggttcaca

SEQ ID NO: 316993 - DNA, 20 bp, Artificial
  CRISPR gRNA sequence
aagagaaacagggttcacaa

SEQ ID NO: 316994 - DNA, 20 bp, Artificial
  CRISPR gRNA sequence
acaagctctggcattttcct

SEQ ID NO: 316995 - DNA, 20 bp, Artificial
  CRISPR gRNA sequence
tggcattttcctgtttattc

SEQ ID NO: 316996 - DNA, 20 bp, Artificial
  CRISPR gRNA sequence
gcattttcctgtttattcag

SEQ ID NO: 316997 - DNA, 20 bp, Artificial
  CRISPR gRNA sequence
tcctgtttattcagttctct

SEQ ID NO: 316998 - DNA, 20 bp, Artificial
  CRISPR gRNA sequence
cctgtttattcagttctctc

SEQ ID NO: 316999 - DNA, 20 bp, Artificial
  CRISPR gRNA sequence
ctgtttattcagttctctcc

SEQ ID NO: 317000 - DNA, 20 bp, Artificial
  CRISPR gRNA sequence
tttattcagttctctccact

SEQ ID NO: 317001 - DNA, 20 bp, Artificial
  CRISPR gRNA sequence
attcagttctctccactatg

SEQ ID NO: 317002 - DNA, 20 bp, Artificial
  CRISPR gRNA sequence
ttcagttctctccactatgg

SEQ ID NO: 317003 - DNA, 20 bp, Artificial
  CRISPR gRNA sequence
agttctctccactatggctt

SEQ ID NO: 317004 - DNA, 20 bp, Artificial
  CRISPR gRNA sequence
tctccactatggcttgttgg

SEQ ID NO: 317005 - DNA, 20 bp, Artificial
  CRISPR gRNA sequence
tccactatggcttgttgggt

SEQ ID NO: 317006 - DNA, 20 bp, Artificial
  CRISPR gRNA sequence
cactatggcttgttgggtgg

SEQ ID NO: 317007 - DNA, 20 bp, Artificial
  CRISPR gRNA sequence
tggcttgttgggtggggcaa

SEQ ID NO: 317008 - DNA, 20 bp, Artificial
  CRISPR gRNA sequence
gttgggtggggcaagcctcc

SEQ ID NO: 317009 - DNA, 20 bp, Artificial
  CRISPR gRNA sequence
ttgggtggggcaagcctcct

SEQ ID NO: 317010 - DNA, 20 bp, Artificial
  CRISPR gRNA sequence
ggtggggcaagcctcctcaa

SEQ ID NO: 317011 - DNA, 20 bp, Artificial
  CRISPR gRNA sequence
ctcaatattagcaacagccc

SEQ ID NO: 317012 - DNA, 20 bp, Artificial
  CRISPR gRNA sequence
aatattagcaacagcccaga

SEQ ID NO: 317013 - DNA, 20 bp, Artificial
  CRISPR gRNA sequence
gcaacagcccagatagaagt

SEQ ID NO: 317014 - DNA, 20 bp, Artificial
  CRISPR gRNA sequence
caggttctatctctgcctct

SEQ ID NO: 317015 - DNA, 20 bp, Artificial
  CRISPR gRNA sequence
tatctctgcctctcctaatt

SEQ ID NO: 317016 - DNA, 20 bp, Artificial
  CRISPR gRNA sequence
tctctgcctctcctaatttc

SEQ ID NO: 317017 - DNA, 20 bp, Artificial
  CRISPR gRNA sequence
tgcctctcctaatttcccca

SEQ ID NO: 317018 - DNA, 20 bp, Artificial
  CRISPR gRNA sequence
cctctcctaatttccccaaa

SEQ ID NO: 317019 - DNA, 20 bp, Artificial
  CRISPR gRNA sequence
tcctaatttccccaaattta

SEQ ID NO: 317020 - DNA, 20 bp, Artificial
  CRISPR gRNA sequence
ctaatttccccaaatttagg

SEQ ID NO: 317021 - DNA, 20 bp, Artificial
  CRISPR gRNA sequence
atttccccaaatttaggttg

SEQ ID NO: 317022 - DNA, 20 bp, Artificial
  CRISPR gRNA sequence
ccccaaatttaggttggtct

SEQ ID NO: 317023 - DNA, 20 bp, Artificial
  CRISPR gRNA sequence
cccaaatttaggttggtctg

SEQ ID NO: 317024 - DNA, 20 bp, Artificial
  CRISPR gRNA sequence
aggttggtctgctcattgtt

SEQ ID NO: 317025 - DNA, 20 bp, Artificial
  CRISPR gRNA sequence
ggttggtctgctcattgttg

SEQ ID NO: 317026 - DNA, 20 bp, Artificial
  CRISPR gRNA sequence
gtctgctcattgttgcctgt

SEQ ID NO: 317027 - DNA, 20 bp, Artificial
  CRISPR gRNA sequence
ctcattgttgcctgtaccct

SEQ ID NO: 317028 - DNA, 20 bp, Artificial
  CRISPR gRNA sequence
attgttgcctgtaccctagg

SEQ ID NO: 317029 - DNA, 20 bp, Artificial
  CRISPR gRNA sequence
ttgcctgtaccctaggccac

SEQ ID NO: 317030 - DNA, 20 bp, Artificial
  CRISPR gRNA sequence
cctgtaccctaggccaccgt

SEQ ID NO: 317031 - DNA, 20 bp, Artificial
  CRISPR gRNA sequence
taccctaggccaccgttttc

SEQ ID NO: 317032 - DNA, 20 bp, Artificial
  CRISPR gRNA sequence
ggccaccgttttccttactg

SEQ ID NO: 317033 - DNA, 20 bp, Artificial
  CRISPR gRNA sequence
tccttactgaccctgacaga

SEQ ID NO: 317034 - DNA, 20 bp, Artificial
  CRISPR gRNA sequence
ccttactgaccctgacagag

SEQ ID NO: 317035 - DNA, 20 bp, Artificial
  CRISPR gRNA sequence
cttactgaccctgacagagg

SEQ ID NO: 317036 - DNA, 20 bp, Artificial
  CRISPR gRNA sequence
actgaccctgacagagggat

SEQ ID NO: 317037 - DNA, 20 bp, Artificial
  CRISPR gRNA sequence
ctgaccctgacagagggatg

SEQ ID NO: 317038 - DNA, 20 bp, Artificial
  CRISPR gRNA sequence
accctgacagagggatgaga

SEQ ID NO: 317039 - DNA, 20 bp, Artificial
  CRISPR gRNA sequence
acagagggatgagaactcct

SEQ ID NO: 317040 - DNA, 20 bp, Artificial
  CRISPR gRNA sequence
cttagcaggggtagactttt

SEQ ID NO: 317041 - DNA, 20 bp, Artificial
  CRISPR gRNA sequence
agcaggggtagacttttctc

SEQ ID NO: 317042 - DNA, 20 bp, Artificial
  CRISPR gRNA sequence
gcaggggtagacttttctct

SEQ ID NO: 317043 - DNA, 20 bp, Artificial
  CRISPR gRNA sequence
ttctctagagcatagtaatc

SEQ ID NO: 317044 - DNA, 20 bp, Artificial
  CRISPR gRNA sequence
tctctagagcatagtaatca

SEQ ID NO: 317045 - DNA, 20 bp, Artificial
  CRISPR gRNA sequence
ctctagagcatagtaatcac

SEQ ID NO: 317046 - DNA, 20 bp, Artificial
  CRISPR gRNA sequence
tctagagcatagtaatcaca

SEQ ID NO: 317047 - DNA, 20 bp, Artificial
  CRISPR gRNA sequence
tagagcatagtaatcacact

SEQ ID NO: 317048 - DNA, 20 bp, Artificial
  CRISPR gRNA sequence
gagcatagtaatcacactat

SEQ ID NO: 317049 - DNA, 20 bp, Artificial
  CRISPR gRNA sequence
ttacagtacatagatctcta

SEQ ID NO: 317050 - DNA, 20 bp, Artificial
  CRISPR gRNA sequence
cagtacatagatctctatgt

SEQ ID NO: 317051 - DNA, 20 bp, Artificial
  CRISPR gRNA sequence
tatgtttcaagatattaaca

SEQ ID NO: 317052 - DNA, 20 bp, Artificial
  CRISPR gRNA sequence
tgtttcaagatattaacact

SEQ ID NO: 317053 - DNA, 20 bp, Artificial
  CRISPR gRNA sequence
caagatattaacactataag

SEQ ID NO: 317054 - DNA, 20 bp, Artificial
  CRISPR gRNA sequence
aagatattaacactataagg

SEQ ID NO: 317055 - DNA, 20 bp, Artificial
  CRISPR gRNA sequence
acactataaggtcataaata

SEQ ID NO: 317056 - DNA, 20 bp, Artificial
  CRISPR gRNA sequence
taaggtcataaatacataag

SEQ ID NO: 317057 - DNA, 20 bp, Artificial
  CRISPR gRNA sequence
aggaggtagttgtttagtca

SEQ ID NO: 317058 - DNA, 20 bp, Artificial
  CRISPR gRNA sequence
tttagtcacaggtacacaca

SEQ ID NO: 317059 - DNA, 20 bp, Artificial
  CRISPR gRNA sequence
agtcacaggtacacacaaaa

SEQ ID NO: 317060 - DNA, 20 bp, Artificial
  CRISPR gRNA sequence
gtcacaggtacacacaaaat

SEQ ID NO: 317061 - DNA, 20 bp, Artificial
  CRISPR gRNA sequence
agtggggcaccagcttagaa

SEQ ID NO: 317062 - DNA, 20 bp, Artificial
  CRISPR gRNA sequence
agaattctgggcagataaaa

SEQ ID NO: 317063 - DNA, 20 bp, Artificial
  CRISPR gRNA sequence
gaattctgggcagataaaag

SEQ ID NO: 317064 - DNA, 20 bp, Artificial
  CRISPR gRNA sequence
tgggcagataaaaggcagtt

SEQ ID NO: 317065 - DNA, 20 bp, Artificial
  CRISPR gRNA sequence
ggcagataaaaggcagtttt

SEQ ID NO: 317066 - DNA, 20 bp, Artificial
  CRISPR gRNA sequence
tccagaaattgagaggtcta

SEQ ID NO: 317067 - DNA, 20 bp, Artificial
  CRISPR gRNA sequence
ccagaaattgagaggtctat

SEQ ID NO: 317068 - DNA, 20 bp, Artificial
  CRISPR gRNA sequence
cagaaattgagaggtctatt

SEQ ID NO: 317069 - DNA, 20 bp, Artificial
  CRISPR gRNA sequence
agaggtctatttaaaaaaaa

SEQ ID NO: 317070 - DNA, 20 bp, Artificial
  CRISPR gRNA sequence
tttaaaaaaaaaacacaatc

SEQ ID NO: 317071 - DNA, 20 bp, Artificial
  CRISPR gRNA sequence
aaaaaaaaaacacaatctat

SEQ ID NO: 317072 - DNA, 20 bp, Artificial
  CRISPR gRNA sequence
aaaaaaaaacacaatctatg

SEQ ID NO: 317073 - DNA, 20 bp, Artificial
  CRISPR gRNA sequence
tgaaattaagagaagaatct

SEQ ID NO: 317074 - DNA, 20 bp, Artificial
  CRISPR gRNA sequence
agagaagaatctgatctgga

SEQ ID NO: 317075 - DNA, 20 bp, Artificial
  CRISPR gRNA sequence
atctggaggaggtattggtc

SEQ ID NO: 317076 - DNA, 20 bp, Artificial
  CRISPR gRNA sequence
gaggaggtattggtcctaaa

SEQ ID NO: 317077 - DNA, 20 bp, Artificial
  CRISPR gRNA sequence
gtcctaaattttatttccag

SEQ ID NO: 317078 - DNA, 20 bp, Artificial
  CRISPR gRNA sequence
aattttatttccaggtcatg

SEQ ID NO: 317079 - DNA, 20 bp, Artificial
  CRISPR gRNA sequence
tatttccaggtcatgagcca

SEQ ID NO: 317080 - DNA, 20 bp, Artificial
  CRISPR gRNA sequence
atttccaggtcatgagccat

SEQ ID NO: 317081 - DNA, 20 bp, Artificial
  CRISPR gRNA sequence
tttccaggtcatgagccatt

SEQ ID NO: 317082 - DNA, 20 bp, Artificial
  CRISPR gRNA sequence
ccaggtcatgagccattaag

SEQ ID NO: 317083 - DNA, 20 bp, Artificial
  CRISPR gRNA sequence
caggtcatgagccattaagc

SEQ ID NO: 317084 - DNA, 20 bp, Artificial
  CRISPR gRNA sequence
agctgggcttggcccataag

SEQ ID NO: 317085 - DNA, 20 bp, Artificial
  CRISPR gRNA sequence
ggcttggcccataagtgtgc

SEQ ID NO: 317086 - DNA, 20 bp, Artificial
  CRISPR gRNA sequence
ggcccataagtgtgctctga

SEQ ID NO: 317087 - DNA, 20 bp, Artificial
  CRISPR gRNA sequence
gcccataagtgtgctctgaa

SEQ ID NO: 317088 - DNA, 20 bp, Artificial
  CRISPR gRNA sequence
tgaagtgaaaagaagcagta

SEQ ID NO: 317089 - DNA, 20 bp, Artificial
  CRISPR gRNA sequence
aagtgaaaagaagcagtaag

SEQ ID NO: 317090 - DNA, 20 bp, Artificial
  CRISPR gRNA sequence
aagtctcctcttggcatacg

SEQ ID NO: 317091 - DNA, 20 bp, Artificial
  CRISPR gRNA sequence
ctcttggcatacggagcaga

SEQ ID NO: 317092 - DNA, 20 bp, Artificial
  CRISPR gRNA sequence
ttggcatacggagcagagct

SEQ ID NO: 317093 - DNA, 20 bp, Artificial
  CRISPR gRNA sequence
ggcatacggagcagagctgg

SEQ ID NO: 317094 - DNA, 20 bp, Artificial
  CRISPR gRNA sequence
gcatacggagcagagctgga

SEQ ID NO: 317095 - DNA, 20 bp, Artificial
  CRISPR gRNA sequence
gagttacagggaggctattc

SEQ ID NO: 317096 - DNA, 20 bp, Artificial
  CRISPR gRNA sequence
cagggaggctattccactta

SEQ ID NO: 317097 - DNA, 20 bp, Artificial
  CRISPR gRNA sequence
ttccacttagagggagtcct

SEQ ID NO: 317098 - DNA, 20 bp, Artificial
  CRISPR gRNA sequence
cacttagagggagtcctgga

SEQ ID NO: 317099 - DNA, 20 bp, Artificial
  CRISPR gRNA sequence
agagggagtcctggagcccc

SEQ ID NO: 317100 - DNA, 20 bp, Artificial
  CRISPR gRNA sequence
gagggagtcctggagccccc

SEQ ID NO: 317101 - DNA, 20 bp, Artificial
  CRISPR gRNA sequence
gagcccccttattactcatg

SEQ ID NO: 317102 - DNA, 20 bp, Artificial
  CRISPR gRNA sequence
attactcatggtaatgtctt

SEQ ID NO: 317103 - DNA, 20 bp, Artificial
  CRISPR gRNA sequence
ttactcatggtaatgtcttt

SEQ ID NO: 317104 - DNA, 20 bp, Artificial
  CRISPR gRNA sequence
ctcatggtaatgtctttttg

SEQ ID NO: 317105 - DNA, 20 bp, Artificial
  CRISPR gRNA sequence
atggtaatgtctttttgcct

SEQ ID NO: 317106 - DNA, 20 bp, Artificial
  CRISPR gRNA sequence
tttgccttctggaagaaatc

SEQ ID NO: 317107 - DNA, 20 bp, Artificial
  CRISPR gRNA sequence
ttgccttctggaagaaatca

SEQ ID NO: 317108 - DNA, 20 bp, Artificial
  CRISPR gRNA sequence
tgccttctggaagaaatcaa

SEQ ID NO: 317109 - DNA, 20 bp, Artificial
  CRISPR gRNA sequence
gccttctggaagaaatcaaa

SEQ ID NO: 317110 - DNA, 20 bp, Artificial
  CRISPR gRNA sequence
ccttctggaagaaatcaaaa

SEQ ID NO: 317111 - DNA, 20 bp, Artificial
  CRISPR gRNA sequence
ctggaagaaatcaaaaaggt

SEQ ID NO: 317112 - DNA, 20 bp, Artificial
  CRISPR gRNA sequence
tggaagaaatcaaaaaggtt

SEQ ID NO: 317113 - DNA, 20 bp, Artificial
  CRISPR gRNA sequence
gaagaaatcaaaaaggttgc

SEQ ID NO: 317114 - DNA, 20 bp, Artificial
  CRISPR gRNA sequence
cccaggaacttacaaaggaa

SEQ ID NO: 317115 - DNA, 20 bp, Artificial
  CRISPR gRNA sequence
acaaaggaaagggtagaaaa

SEQ ID NO: 317116 - DNA, 20 bp, Artificial
  CRISPR gRNA sequence
caaaggaaagggtagaaaaa

SEQ ID NO: 317117 - DNA, 20 bp, Artificial
  CRISPR gRNA sequence
gtatgggctttactctttaa

SEQ ID NO: 317118 - DNA, 20 bp, Artificial
  CRISPR gRNA sequence
tatgggctttactctttaat

SEQ ID NO: 317119 - DNA, 20 bp, Artificial
  CRISPR gRNA sequence
tactctttaattaaaaacat

SEQ ID NO: 317120 - DNA, 20 bp, Artificial
  CRISPR gRNA sequence
actctttaattaaaaacatg

SEQ ID NO: 317121 - DNA, 20 bp, Artificial
  CRISPR gRNA sequence
ctctttaattaaaaacatgt

SEQ ID NO: 317122 - DNA, 20 bp, Artificial
  CRISPR gRNA sequence
tttaattaaaaacatgtatc

SEQ ID NO: 317123 - DNA, 20 bp, Artificial
  CRISPR gRNA sequence
taattaaaaacatgtatcac

SEQ ID NO: 317124 - DNA, 20 bp, Artificial
  CRISPR gRNA sequence
aattaaaaacatgtatcact

SEQ ID NO: 317125 - DNA, 20 bp, Artificial
  CRISPR gRNA sequence
attaaaaacatgtatcactt

SEQ ID NO: 317126 - DNA, 20 bp, Artificial
  CRISPR gRNA sequence
aaaacatgtatcacttttgt

SEQ ID NO: 317127 - DNA, 20 bp, Artificial
  CRISPR gRNA sequence
ttgtcgcatgaagatgtctt

SEQ ID NO: 317128 - DNA, 20 bp, Artificial
  CRISPR gRNA sequence
tgtcgcatgaagatgtcttc

SEQ ID NO: 317129 - DNA, 20 bp, Artificial
  CRISPR gRNA sequence
gtcgcatgaagatgtcttcg

SEQ ID NO: 317130 - DNA, 20 bp, Artificial
  CRISPR gRNA sequence
tcgcatgaagatgtcttcga

SEQ ID NO: 317131 - DNA, 20 bp, Artificial
  CRISPR gRNA sequence
cgaacttttaaaaacacgct

SEQ ID NO: 317132 - DNA, 20 bp, Artificial
  CRISPR gRNA sequence
gaacttttaaaaacacgctg

SEQ ID NO: 317133 - DNA, 20 bp, Artificial
  CRISPR gRNA sequence
ttaaaaacacgctgggcttc

SEQ ID NO: 317134 - DNA, 20 bp, Artificial
  CRISPR gRNA sequence
taaaaacacgctgggcttca

SEQ ID NO: 317135 - DNA, 20 bp, Artificial
  CRISPR gRNA sequence
aaaaacacgctgggcttcat

SEQ ID NO: 317136 - DNA, 20 bp, Artificial
  CRISPR gRNA sequence
aaaacacgctgggcttcatc

SEQ ID NO: 317137 - DNA, 20 bp, Artificial
  CRISPR gRNA sequence
ggcttcatcagatctttcag

SEQ ID NO: 317138 - DNA, 20 bp, Artificial
  CRISPR gRNA sequence
catcagatctttcaggtata

SEQ ID NO: 317139 - DNA, 20 bp, Artificial
  CRISPR gRNA sequence
atcagatctttcaggtatat

SEQ ID NO: 317140 - DNA, 20 bp, Artificial
  CRISPR gRNA sequence
tcaggtatatggattttttc

SEQ ID NO: 317141 - DNA, 20 bp, Artificial
  CRISPR gRNA sequence
caggtatatggattttttct

SEQ ID NO: 317142 - DNA, 20 bp, Artificial
  CRISPR gRNA sequence
aggtatatggattttttctc

SEQ ID NO: 317143 - DNA, 20 bp, Artificial
  CRISPR gRNA sequence
tttctctggagaaatagaag

SEQ ID NO: 317144 - DNA, 20 bp, Artificial
  CRISPR gRNA sequence
ttctctggagaaatagaaga

SEQ ID NO: 317145 - DNA, 20 bp, Artificial
  CRISPR gRNA sequence
tctctggagaaatagaagaa

SEQ ID NO: 317146 - DNA, 20 bp, Artificial
  CRISPR gRNA sequence
ctctggagaaatagaagaaa

SEQ ID NO: 317147 - DNA, 20 bp, Artificial
  CRISPR gRNA sequence
tctggagaaatagaagaaaa

SEQ ID NO: 317148 - DNA, 20 bp, Artificial
  CRISPR gRNA sequence
tggagaaatagaagaaaaga

SEQ ID NO: 317149 - DNA, 20 bp, Artificial
  CRISPR gRNA sequence
gagaaatagaagaaaagatt

SEQ ID NO: 317150 - DNA, 20 bp, Artificial
  CRISPR gRNA sequence
ggtgatatttcacatttgag

SEQ ID NO: 317151 - DNA, 20 bp, Artificial
  CRISPR gRNA sequence
cacatttgagctactttctt

SEQ ID NO: 317152 - DNA, 20 bp, Artificial
  CRISPR gRNA sequence
acatttgagctactttcttt

SEQ ID NO: 317153 - DNA, 20 bp, Artificial
  CRISPR gRNA sequence
gagctactttctttttctag

SEQ ID NO: 317154 - DNA, 20 bp, Artificial
  CRISPR gRNA sequence
agctactttctttttctaga

SEQ ID NO: 317155 - DNA, 20 bp, Artificial
  CRISPR gRNA sequence
ctttctttttctagatttca

SEQ ID NO: 317156 - DNA, 20 bp, Artificial
  CRISPR gRNA sequence
tctttttctagatttcaatg

SEQ ID NO: 317157 - DNA, 20 bp, Artificial
  CRISPR gRNA sequence
ctttttctagatttcaatga

SEQ ID NO: 317158 - DNA, 20 bp, Artificial
  CRISPR gRNA sequence
tttttctagatttcaatgat

SEQ ID NO: 317159 - DNA, 20 bp, Artificial
  CRISPR gRNA sequence
tttctagatttcaatgatag

SEQ ID NO: 317160 - DNA, 20 bp, Artificial
  CRISPR gRNA sequence
ttctagatttcaatgatagg

SEQ ID NO: 317161 - DNA, 20 bp, Artificial
  CRISPR gRNA sequence
tctagatttcaatgataggg

SEQ ID NO: 317162 - DNA, 20 bp, Artificial
  CRISPR gRNA sequence
ctagatttcaatgatagggc

SEQ ID NO: 317163 - DNA, 20 bp, Artificial
  CRISPR gRNA sequence
tagatttcaatgatagggca

SEQ ID NO: 317164 - DNA, 20 bp, Artificial
  CRISPR gRNA sequence
gatttcaatgatagggcaga

SEQ ID NO: 317165 - DNA, 20 bp, Artificial
  CRISPR gRNA sequence
caatgatagggcagaataga

SEQ ID NO: 317166 - DNA, 20 bp, Artificial
  CRISPR gRNA sequence
aatgatagggcagaatagag

SEQ ID NO: 317167 - DNA, 20 bp, Artificial
  CRISPR gRNA sequence
ccattggaacagcaatgagg

SEQ ID NO: 317168 - DNA, 20 bp, Artificial
  CRISPR gRNA sequence
gaacagcaatgaggagaaac

SEQ ID NO: 317169 - DNA, 20 bp, Artificial
  CRISPR gRNA sequence
ttgaagagaaaggtggagaa

SEQ ID NO: 317170 - DNA, 20 bp, Artificial
  CRISPR gRNA sequence
aagagaaaggtggagaaagc

SEQ ID NO: 317171 - DNA, 20 bp, Artificial
  CRISPR gRNA sequence
cactgtcatctatgcttcaa

SEQ ID NO: 317172 - DNA, 20 bp, Artificial
  CRISPR gRNA sequence
tcatctatgcttcaagagct

SEQ ID NO: 317173 - DNA, 20 bp, Artificial
  CRISPR gRNA sequence
tgcttcaagagctacccttt

SEQ ID NO: 317174 - DNA, 20 bp, Artificial
  CRISPR gRNA sequence
caagagctaccctttatttc

SEQ ID NO: 317175 - DNA, 20 bp, Artificial
  CRISPR gRNA sequence
aagagctaccctttatttct

SEQ ID NO: 317176 - DNA, 20 bp, Artificial
  CRISPR gRNA sequence
ccctttatttctgcctggcc

SEQ ID NO: 317177 - DNA, 20 bp, Artificial
  CRISPR gRNA sequence
tatttctgcctggcccttcc

SEQ ID NO: 317178 - DNA, 20 bp, Artificial
  CRISPR gRNA sequence
atttctgcctggcccttccc

SEQ ID NO: 317179 - DNA, 20 bp, Artificial
  CRISPR gRNA sequence
tttctgcctggcccttccca

SEQ ID NO: 317180 - DNA, 20 bp, Artificial
  CRISPR gRNA sequence
ctgcctggcccttcccatgc

SEQ ID NO: 317181 - DNA, 20 bp, Artificial
  CRISPR gRNA sequence
tgcctggcccttcccatgcc

SEQ ID NO: 317182 - DNA, 20 bp, Artificial
  CRISPR gRNA sequence
cctggcccttcccatgccct

SEQ ID NO: 317183 - DNA, 20 bp, Artificial
  CRISPR gRNA sequence
gcccttcccatgccctctgc

SEQ ID NO: 317184 - DNA, 20 bp, Artificial
  CRISPR gRNA sequence
cccatgccctctgccggttc

SEQ ID NO: 317185 - DNA, 20 bp, Artificial
  CRISPR gRNA sequence
ccatgccctctgccggttct

SEQ ID NO: 317186 - DNA, 20 bp, Artificial
  CRISPR gRNA sequence
tgccggttctctgctgcctg

SEQ ID NO: 317187 - DNA, 20 bp, Artificial
  CRISPR gRNA sequence
ccggttctctgctgcctgcc

SEQ ID NO: 317188 - DNA, 20 bp, Artificial
  CRISPR gRNA sequence
tctgctgcctgccctctgca

SEQ ID NO: 317189 - DNA, 20 bp, Artificial
  CRISPR gRNA sequence
tgctgcctgccctctgcagg

SEQ ID NO: 317190 - DNA, 20 bp, Artificial
  CRISPR gRNA sequence
ctgcctgccctctgcaggct

SEQ ID NO: 317191 - DNA, 20 bp, Artificial
  CRISPR gRNA sequence
cctgccctctgcaggctctt

SEQ ID NO: 317192 - DNA, 20 bp, Artificial
  CRISPR gRNA sequence
ccctctgcaggctcttccag

SEQ ID NO: 317193 - DNA, 20 bp, Artificial
  CRISPR gRNA sequence
tgcaggctcttccagaccat

SEQ ID NO: 317194 - DNA, 20 bp, Artificial
  CRISPR gRNA sequence
caggctcttccagaccattt

SEQ ID NO: 317195 - DNA, 20 bp, Artificial
  CRISPR gRNA sequence
ttccagaccatttctgaaac

SEQ ID NO: 317196 - DNA, 20 bp, Artificial
  CRISPR gRNA sequence
ccagaccatttctgaaactg

SEQ ID NO: 317197 - DNA, 20 bp, Artificial
  CRISPR gRNA sequence
cagaccatttctgaaactga

SEQ ID NO: 317198 - DNA, 20 bp, Artificial
  CRISPR gRNA sequence
ctgaaactgagtgtgacagg

SEQ ID NO: 317199 - DNA, 20 bp, Artificial
  CRISPR gRNA sequence
tgaaactgagtgtgacaggg

SEQ ID NO: 317200 - DNA, 20 bp, Artificial
  CRISPR gRNA sequence
aaactgagtgtgacagggta

SEQ ID NO: 317201 - DNA, 20 bp, Artificial
  CRISPR gRNA sequence
agtgtgacagggtaggcagg

SEQ ID NO: 317202 - DNA, 20 bp, Artificial
  CRISPR gRNA sequence
cagcaccctttctcattgtc

SEQ ID NO: 317203 - DNA, 20 bp, Artificial
  CRISPR gRNA sequence
agcaccctttctcattgtcc

SEQ ID NO: 317204 - DNA, 20 bp, Artificial
  CRISPR gRNA sequence
tctcattgtccaagggtgcc

SEQ ID NO: 317205 - DNA, 20 bp, Artificial
  CRISPR gRNA sequence
ctcattgtccaagggtgccc

SEQ ID NO: 317206 - DNA, 20 bp, Artificial
  CRISPR gRNA sequence
tcattgtccaagggtgcccg

SEQ ID NO: 317207 - DNA, 20 bp, Artificial
  CRISPR gRNA sequence
attgtccaagggtgcccgga

SEQ ID NO: 317208 - DNA, 20 bp, Artificial
  CRISPR gRNA sequence
tccaagggtgcccggaatta

SEQ ID NO: 317209 - DNA, 20 bp, Artificial
  CRISPR gRNA sequence
ttagttttgttgctagaatc

SEQ ID NO: 317210 - DNA, 20 bp, Artificial
  CRISPR gRNA sequence
gttttgttgctagaatcaca

SEQ ID NO: 317211 - DNA, 20 bp, Artificial
  CRISPR gRNA sequence
tgttgctagaatcacagtgg

SEQ ID NO: 317212 - DNA, 20 bp, Artificial
  CRISPR gRNA sequence
gttgctagaatcacagtggc

SEQ ID NO: 317213 - DNA, 20 bp, Artificial
  CRISPR gRNA sequence
ttgctagaatcacagtggct

SEQ ID NO: 317214 - DNA, 20 bp, Artificial
  CRISPR gRNA sequence
ctagaatcacagtggctggt

SEQ ID NO: 317215 - DNA, 20 bp, Artificial
  CRISPR gRNA sequence
gaatcacagtggctggtata

SEQ ID NO: 317216 - DNA, 20 bp, Artificial
  CRISPR gRNA sequence
gtatatctggattagtgctg

SEQ ID NO: 317217 - DNA, 20 bp, Artificial
  CRISPR gRNA sequence
gattagtgctgggtactctc

SEQ ID NO: 317218 - DNA, 20 bp, Artificial
  CRISPR gRNA sequence
gtgctgggtactctcggttg

SEQ ID NO: 317219 - DNA, 20 bp, Artificial
  CRISPR gRNA sequence
ggtactctcggttgtctctg

SEQ ID NO: 317220 - DNA, 20 bp, Artificial
  CRISPR gRNA sequence
tcggttgtctctgcaccctg

SEQ ID NO: 317221 - DNA, 20 bp, Artificial
  CRISPR gRNA sequence
ggttgtctctgcaccctggg

SEQ ID NO: 317222 - DNA, 20 bp, Artificial
  CRISPR gRNA sequence
tctctgcaccctgggggtta

SEQ ID NO: 317223 - DNA, 20 bp, Artificial
  CRISPR gRNA sequence
tgcaccctgggggttatgac

SEQ ID NO: 317224 - DNA, 20 bp, Artificial
  CRISPR gRNA sequence
caccctgggggttatgaccc

SEQ ID NO: 317225 - DNA, 20 bp, Artificial
  CRISPR gRNA sequence
ggggttatgaccctatctct

SEQ ID NO: 317226 - DNA, 20 bp, Artificial
  CRISPR gRNA sequence
tgaccctatctctgaaacca

SEQ ID NO: 317227 - DNA, 20 bp, Artificial
  CRISPR gRNA sequence
tctctgaaaccaggcttgtg

SEQ ID NO: 317228 - DNA, 20 bp, Artificial
  CRISPR gRNA sequence
tgaaaccaggcttgtgactg

SEQ ID NO: 317229 - DNA, 20 bp, Artificial
  CRISPR gRNA sequence
aaaccaggcttgtgactgag

SEQ ID NO: 317230 - DNA, 20 bp, Artificial
  CRISPR gRNA sequence
gtgactgagggttgctttga

SEQ ID NO: 317231 - DNA, 20 bp, Artificial
  CRISPR gRNA sequence
tgactgagggttgctttgat

SEQ ID NO: 317232 - DNA, 20 bp, Artificial
  CRISPR gRNA sequence
agggttgctttgatcctatg

SEQ ID NO: 317233 - DNA, 20 bp, Artificial
  CRISPR gRNA sequence
ctttgatcctatgggtatgc

SEQ ID NO: 317234 - DNA, 20 bp, Artificial
  CRISPR gRNA sequence
tgatcctatgggtatgcagt

SEQ ID NO: 317235 - DNA, 20 bp, Artificial
  CRISPR gRNA sequence
gatcctatgggtatgcagtc

SEQ ID NO: 317236 - DNA, 20 bp, Artificial
  CRISPR gRNA sequence
atcctatgggtatgcagtca

SEQ ID NO: 317237 - DNA, 20 bp, Artificial
  CRISPR gRNA sequence
tgggtatgcagtcagagcct

SEQ ID NO: 317238 - DNA, 20 bp, Artificial
  CRISPR gRNA sequence
gatattcctgagagcttaat

SEQ ID NO: 317239 - DNA, 20 bp, Artificial
  CRISPR gRNA sequence
atattcctgagagcttaatt

SEQ ID NO: 317240 - DNA, 20 bp, Artificial
  CRISPR gRNA sequence
ctgagagcttaatttctcag

SEQ ID NO: 317241 - DNA, 20 bp, Artificial
  CRISPR gRNA sequence
agagcttaatttctcaggag

SEQ ID NO: 317242 - DNA, 20 bp, Artificial
  CRISPR gRNA sequence
aatttctcaggagggataga

SEQ ID NO: 317243 - DNA, 20 bp, Artificial
  CRISPR gRNA sequence
atttctcaggagggatagag

SEQ ID NO: 317244 - DNA, 20 bp, Artificial
  CRISPR gRNA sequence
ctcaggagggatagaggtac

SEQ ID NO: 317245 - DNA, 20 bp, Artificial
  CRISPR gRNA sequence
tcaggagggatagaggtaca

SEQ ID NO: 317246 - DNA, 20 bp, Artificial
  CRISPR gRNA sequence
aggagggatagaggtacaga

SEQ ID NO: 317247 - DNA, 20 bp, Artificial
  CRISPR gRNA sequence
tctgatagcttcacgttgtg

SEQ ID NO: 317248 - DNA, 20 bp, Artificial
  CRISPR gRNA sequence
atagcttcacgttgtgaaag

SEQ ID NO: 317249 - DNA, 20 bp, Artificial
  CRISPR gRNA sequence
cacgttgtgaaaggactgat

SEQ ID NO: 317250 - DNA, 20 bp, Artificial
  CRISPR gRNA sequence
acgttgtgaaaggactgatc

SEQ ID NO: 317251 - DNA, 20 bp, Artificial
  CRISPR gRNA sequence
tgaaaggactgatcaccacg

SEQ ID NO: 317252 - DNA, 20 bp, Artificial
  CRISPR gRNA sequence
atcaccacgaacttttatgt

SEQ ID NO: 317253 - DNA, 20 bp, Artificial
  CRISPR gRNA sequence
ttatgtattcatcatgcatc

SEQ ID NO: 317254 - DNA, 20 bp, Artificial
  CRISPR gRNA sequence
tatgtattcatcatgcatca

SEQ ID NO: 317255 - DNA, 20 bp, Artificial
  CRISPR gRNA sequence
atgtattcatcatgcatcaa

SEQ ID NO: 317256 - DNA, 20 bp, Artificial
  CRISPR gRNA sequence
tgtattcatcatgcatcaat

SEQ ID NO: 317257 - DNA, 20 bp, Artificial
  CRISPR gRNA sequence
atcatgcatcaatcattctt

SEQ ID NO: 317258 - DNA, 20 bp, Artificial
  CRISPR gRNA sequence
tttcaacatttattgagaac

SEQ ID NO: 317259 - DNA, 20 bp, Artificial
  CRISPR gRNA sequence
tcaacatttattgagaacct

SEQ ID NO: 317260 - DNA, 20 bp, Artificial
  CRISPR gRNA sequence
caacatttattgagaacctg

SEQ ID NO: 317261 - DNA, 20 bp, Artificial
  CRISPR gRNA sequence
aacatttattgagaacctgc

SEQ ID NO: 317262 - DNA, 20 bp, Artificial
  CRISPR gRNA sequence
attgagaacctgctatatgc

SEQ ID NO: 317263 - DNA, 20 bp, Artificial
  CRISPR gRNA sequence
ttgagaacctgctatatgcc

SEQ ID NO: 317264 - DNA, 20 bp, Artificial
  CRISPR gRNA sequence
agaacctgctatatgccagg

SEQ ID NO: 317265 - DNA, 20 bp, Artificial
  CRISPR gRNA sequence
ctatatgccaggcaccatgc

SEQ ID NO: 317266 - DNA, 20 bp, Artificial
  CRISPR gRNA sequence
tatgccaggcaccatgctaa

SEQ ID NO: 317267 - DNA, 20 bp, Artificial
  CRISPR gRNA sequence
agtgctagcagcacaatgat

SEQ ID NO: 317268 - DNA, 20 bp, Artificial
  CRISPR gRNA sequence
gcagcacaatgatgagctta

SEQ ID NO: 317269 - DNA, 20 bp, Artificial
  CRISPR gRNA sequence
aactggtatggtctctgctc

SEQ ID NO: 317270 - DNA, 20 bp, Artificial
  CRISPR gRNA sequence
actggtatggtctctgctct

SEQ ID NO: 317271 - DNA, 20 bp, Artificial
  CRISPR gRNA sequence
gtatggtctctgctcttcat

SEQ ID NO: 317272 - DNA, 20 bp, Artificial
  CRISPR gRNA sequence
tgctcttcataggatttagt

SEQ ID NO: 317273 - DNA, 20 bp, Artificial
  CRISPR gRNA sequence
ctcttcataggatttagtta

SEQ ID NO: 317274 - DNA, 20 bp, Artificial
  CRISPR gRNA sequence
ttcataggatttagttaagt

SEQ ID NO: 317275 - DNA, 20 bp, Artificial
  CRISPR gRNA sequence
cataggatttagttaagtct

SEQ ID NO: 317276 - DNA, 20 bp, Artificial
  CRISPR gRNA sequence
ataggatttagttaagtcta

SEQ ID NO: 317277 - DNA, 20 bp, Artificial
  CRISPR gRNA sequence
agttaagtctagtttataga

SEQ ID NO: 317278 - DNA, 20 bp, Artificial
  CRISPR gRNA sequence
gttaagtctagtttatagag

SEQ ID NO: 317279 - DNA, 20 bp, Artificial
  CRISPR gRNA sequence
agtctagtttatagagttta

SEQ ID NO: 317280 - DNA, 20 bp, Artificial
  CRISPR gRNA sequence
gtttatagagtttaataaga

SEQ ID NO: 317281 - DNA, 20 bp, Artificial
  CRISPR gRNA sequence
atagagtttaataagataat

SEQ ID NO: 317282 - DNA, 20 bp, Artificial
  CRISPR gRNA sequence
tagagtttaataagataatt

SEQ ID NO: 317283 - DNA, 20 bp, Artificial
  CRISPR gRNA sequence
aataagataattacacaaat

SEQ ID NO: 317284 - DNA, 20 bp, Artificial
  CRISPR gRNA sequence
ataagataattacacaaata

SEQ ID NO: 317285 - DNA, 20 bp, Artificial
  CRISPR gRNA sequence
cacaaatatgtaagcataat

SEQ ID NO: 317286 - DNA, 20 bp, Artificial
  CRISPR gRNA sequence
gtgttattaagaaaaagcca

SEQ ID NO: 317287 - DNA, 20 bp, Artificial
  CRISPR gRNA sequence
ttaagaaaaagccaagggat

SEQ ID NO: 317288 - DNA, 20 bp, Artificial
  CRISPR gRNA sequence
agaaaaagccaagggatcca

SEQ ID NO: 317289 - DNA, 20 bp, Artificial
  CRISPR gRNA sequence
taacaagttgacattttcta

SEQ ID NO: 317290 - DNA, 20 bp, Artificial
  CRISPR gRNA sequence
acattttctagtttgggaaa

SEQ ID NO: 317291 - DNA, 20 bp, Artificial
  CRISPR gRNA sequence
tctagtttgggaaagggttt

SEQ ID NO: 317292 - DNA, 20 bp, Artificial
  CRISPR gRNA sequence
ctagtttgggaaagggtttt

SEQ ID NO: 317293 - DNA, 20 bp, Artificial
  CRISPR gRNA sequence
tagtttgggaaagggttttt

SEQ ID NO: 317294 - DNA, 20 bp, Artificial
  CRISPR gRNA sequence
gtttgggaaagggtttttaa

SEQ ID NO: 317295 - DNA, 20 bp, Artificial
  CRISPR gRNA sequence
gggaaagggtttttaagaaa

SEQ ID NO: 317296 - DNA, 20 bp, Artificial
  CRISPR gRNA sequence
ggaaagggtttttaagaaag

SEQ ID NO: 317297 - DNA, 20 bp, Artificial
  CRISPR gRNA sequence
ttaagaaagtgctgcttgag

SEQ ID NO: 317298 - DNA, 20 bp, Artificial
  CRISPR gRNA sequence
taagaaagtgctgcttgagg

SEQ ID NO: 317299 - DNA, 20 bp, Artificial
  CRISPR gRNA sequence
aagaaagtgctgcttgaggc

SEQ ID NO: 317300 - DNA, 20 bp, Artificial
  CRISPR gRNA sequence
agaaagtgctgcttgaggca

SEQ ID NO: 317301 - DNA, 20 bp, Artificial
  CRISPR gRNA sequence
cttgaggcaagatctgaaga

SEQ ID NO: 317302 - DNA, 20 bp, Artificial
  CRISPR gRNA sequence
gaggcaagatctgaagaatg

SEQ ID NO: 317303 - DNA, 20 bp, Artificial
  CRISPR gRNA sequence
aggcaagatctgaagaatga

SEQ ID NO: 317304 - DNA, 20 bp, Artificial
  CRISPR gRNA sequence
aagaatgaggtaaagaagtg

SEQ ID NO: 317305 - DNA, 20 bp, Artificial
  CRISPR gRNA sequence
aacagggccatagcaaatac

SEQ ID NO: 317306 - DNA, 20 bp, Artificial
  CRISPR gRNA sequence
agatgctcaggctgaagcaa

SEQ ID NO: 317307 - DNA, 20 bp, Artificial
  CRISPR gRNA sequence
aggctgaagcaaacatgtta

SEQ ID NO: 317308 - DNA, 20 bp, Artificial
  CRISPR gRNA sequence
aagcaaacatgttatcattc

SEQ ID NO: 317309 - DNA, 20 bp, Artificial
  CRISPR gRNA sequence
tcattccccacttcttcatt

SEQ ID NO: 317310 - DNA, 20 bp, Artificial
  CRISPR gRNA sequence
cccacttcttcatttattca

SEQ ID NO: 317311 - DNA, 20 bp, Artificial
  CRISPR gRNA sequence
cttcatttattcattccaca

SEQ ID NO: 317312 - DNA, 20 bp, Artificial
  CRISPR gRNA sequence
ttcatttattcattccacac

SEQ ID NO: 317313 - DNA, 20 bp, Artificial
  CRISPR gRNA sequence
catttattcattccacacat

SEQ ID NO: 317314 - DNA, 20 bp, Artificial
  CRISPR gRNA sequence
atttattcattccacacatg

SEQ ID NO: 317315 - DNA, 20 bp, Artificial
  CRISPR gRNA sequence
attcattccacacatgtagg

SEQ ID NO: 317316 - DNA, 20 bp, Artificial
  CRISPR gRNA sequence
ttcattccacacatgtagga

SEQ ID NO: 317317 - DNA, 20 bp, Artificial
  CRISPR gRNA sequence
attccacacatgtaggatgc

SEQ ID NO: 317318 - DNA, 20 bp, Artificial
  CRISPR gRNA sequence
cacacatgtaggatgcccac

SEQ ID NO: 317319 - DNA, 20 bp, Artificial
  CRISPR gRNA sequence
atctaggcactgtgccaggt

SEQ ID NO: 317320 - DNA, 20 bp, Artificial
  CRISPR gRNA sequence
ggcactgtgccaggtactgg

SEQ ID NO: 317321 - DNA, 20 bp, Artificial
  CRISPR gRNA sequence
tgccaggtactggggttact

SEQ ID NO: 317322 - DNA, 20 bp, Artificial
  CRISPR gRNA sequence
gggttactgtggcagataag

SEQ ID NO: 317323 - DNA, 20 bp, Artificial
  CRISPR gRNA sequence
ctgtggcagataagatgaag

SEQ ID NO: 317324 - DNA, 20 bp, Artificial
  CRISPR gRNA sequence
tggcagataagatgaagccc

SEQ ID NO: 317325 - DNA, 20 bp, Artificial
  CRISPR gRNA sequence
accacctctgaagtctttgg

SEQ ID NO: 317326 - DNA, 20 bp, Artificial
  CRISPR gRNA sequence
tgaagtctttggtattgact

SEQ ID NO: 317327 - DNA, 20 bp, Artificial
  CRISPR gRNA sequence
aagtctttggtattgacttt

SEQ ID NO: 317328 - DNA, 20 bp, Artificial
  CRISPR gRNA sequence
tggtattgacttttacttga

SEQ ID NO: 317329 - DNA, 20 bp, Artificial
  CRISPR gRNA sequence
ggtattgacttttacttgac

SEQ ID NO: 317330 - DNA, 20 bp, Artificial
  CRISPR gRNA sequence
gtattgacttttacttgacc

SEQ ID NO: 317331 - DNA, 20 bp, Artificial
  CRISPR gRNA sequence
acttttacttgaccatgaca

SEQ ID NO: 317332 - DNA, 20 bp, Artificial
  CRISPR gRNA sequence
ttacttgaccatgacagagc

SEQ ID NO: 317333 - DNA, 20 bp, Artificial
  CRISPR gRNA sequence
tacttgaccatgacagagct

SEQ ID NO: 317334 - DNA, 20 bp, Artificial
  CRISPR gRNA sequence
acttgaccatgacagagctt

SEQ ID NO: 317335 - DNA, 20 bp, Artificial
  CRISPR gRNA sequence
cttgaccatgacagagcttg

SEQ ID NO: 317336 - DNA, 20 bp, Artificial
  CRISPR gRNA sequence
gaccatgacagagcttgtca

SEQ ID NO: 317337 - DNA, 20 bp, Artificial
  CRISPR gRNA sequence
accatgacagagcttgtcat

SEQ ID NO: 317338 - DNA, 20 bp, Artificial
  CRISPR gRNA sequence
gtcatgctttctgggcattg

SEQ ID NO: 317339 - DNA, 20 bp, Artificial
  CRISPR gRNA sequence
tcatgctttctgggcattgt

SEQ ID NO: 317340 - DNA, 20 bp, Artificial
  CRISPR gRNA sequence
tctgggcattgtgcattgga

SEQ ID NO: 317341 - DNA, 20 bp, Artificial
  CRISPR gRNA sequence
ctgggcattgtgcattggat

SEQ ID NO: 317342 - DNA, 20 bp, Artificial
  CRISPR gRNA sequence
tgggcattgtgcattggata

SEQ ID NO: 317343 - DNA, 20 bp, Artificial
  CRISPR gRNA sequence
ggcattgtgcattggatacc

SEQ ID NO: 317344 - DNA, 20 bp, Artificial
  CRISPR gRNA sequence
tgcattggataccctgtcat

SEQ ID NO: 317345 - DNA, 20 bp, Artificial
  CRISPR gRNA sequence
gataccctgtcatccattat

SEQ ID NO: 317346 - DNA, 20 bp, Artificial
  CRISPR gRNA sequence
tcatccattatcaggttatt

SEQ ID NO: 317347 - DNA, 20 bp, Artificial
  CRISPR gRNA sequence
tcaggttattttcttccagt

SEQ ID NO: 317348 - DNA, 20 bp, Artificial
  CRISPR gRNA sequence
ttttcttccagttcttaact

SEQ ID NO: 317349 - DNA, 20 bp, Artificial
  CRISPR gRNA sequence
tcttccagttcttaactagt

SEQ ID NO: 317350 - DNA, 20 bp, Artificial
  CRISPR gRNA sequence
cttccagttcttaactagtt

SEQ ID NO: 317351 - DNA, 20 bp, Artificial
  CRISPR gRNA sequence
ttccagttcttaactagttt

SEQ ID NO: 317352 - DNA, 20 bp, Artificial
  CRISPR gRNA sequence
ccagttcttaactagtttta

SEQ ID NO: 317353 - DNA, 20 bp, Artificial
  CRISPR gRNA sequence
cagttcttaactagttttat

SEQ ID NO: 317354 - DNA, 20 bp, Artificial
  CRISPR gRNA sequence
ttaactagttttattttcct

SEQ ID NO: 317355 - DNA, 20 bp, Artificial
  CRISPR gRNA sequence
aactagttttattttcctct

SEQ ID NO: 317356 - DNA, 20 bp, Artificial
  CRISPR gRNA sequence
actagttttattttcctctc

SEQ ID NO: 317357 - DNA, 20 bp, Artificial
  CRISPR gRNA sequence
gttttattttcctctccctc

SEQ ID NO: 317358 - DNA, 20 bp, Artificial
  CRISPR gRNA sequence
tattttcctctccctctcca

SEQ ID NO: 317359 - DNA, 20 bp, Artificial
  CRISPR gRNA sequence
attttcctctccctctccat

SEQ ID NO: 317360 - DNA, 20 bp, Artificial
  CRISPR gRNA sequence
ttttcctctccctctccatt

SEQ ID NO: 317361 - DNA, 20 bp, Artificial
  CRISPR gRNA sequence
tcctctccctctccattagt

SEQ ID NO: 317362 - DNA, 20 bp, Artificial
  CRISPR gRNA sequence
cctctccctctccattagtt

SEQ ID NO: 317363 - DNA, 20 bp, Artificial
  CRISPR gRNA sequence
ctctccctctccattagttc

SEQ ID NO: 317364 - DNA, 20 bp, Artificial
  CRISPR gRNA sequence
tccctctccattagttcagg

SEQ ID NO: 317365 - DNA, 20 bp, Artificial
  CRISPR gRNA sequence
cctctccattagttcaggtt

SEQ ID NO: 317366 - DNA, 20 bp, Artificial
  CRISPR gRNA sequence
tccattagttcaggtttgct

SEQ ID NO: 317367 - DNA, 20 bp, Artificial
  CRISPR gRNA sequence
cattagttcaggtttgctga

SEQ ID NO: 317368 - DNA, 20 bp, Artificial
  CRISPR gRNA sequence
gttcaggtttgctgaggtct

SEQ ID NO: 317369 - DNA, 20 bp, Artificial
  CRISPR gRNA sequence
aggtttgctgaggtctcaac

SEQ ID NO: 317370 - DNA, 20 bp, Artificial
  CRISPR gRNA sequence
gctgaggtctcaacatatgt

SEQ ID NO: 317371 - DNA, 20 bp, Artificial
  CRISPR gRNA sequence
ctgaggtctcaacatatgtt

SEQ ID NO: 317372 - DNA, 20 bp, Artificial
  CRISPR gRNA sequence
aggtctcaacatatgttagg

SEQ ID NO: 317373 - DNA, 20 bp, Artificial
  CRISPR gRNA sequence
aacatatgttaggcataagc

SEQ ID NO: 317374 - DNA, 20 bp, Artificial
  CRISPR gRNA sequence
ggcataagcctattcaagta

SEQ ID NO: 317375 - DNA, 20 bp, Artificial
  CRISPR gRNA sequence
ttcaagtaacaggcactctg

SEQ ID NO: 317376 - DNA, 20 bp, Artificial
  CRISPR gRNA sequence
aagtaacaggcactctgggg

SEQ ID NO: 317377 - DNA, 20 bp, Artificial
  CRISPR gRNA sequence
tggggattatacctctctct

SEQ ID NO: 317378 - DNA, 20 bp, Artificial
  CRISPR gRNA sequence
gggattatacctctctctca

SEQ ID NO: 317379 - DNA, 20 bp, Artificial
  CRISPR gRNA sequence
tacctctctctcatcaatgt

SEQ ID NO: 317380 - DNA, 20 bp, Artificial
  CRISPR gRNA sequence
tctctcatcaatgtctcagg

SEQ ID NO: 317381 - DNA, 20 bp, Artificial
  CRISPR gRNA sequence
tctcatcaatgtctcagggt

SEQ ID NO: 317382 - DNA, 20 bp, Artificial
  CRISPR gRNA sequence
tcatcaatgtctcagggtca

SEQ ID NO: 317383 - DNA, 20 bp, Artificial
  CRISPR gRNA sequence
atcaatgtctcagggtcagg

SEQ ID NO: 317384 - DNA, 20 bp, Artificial
  CRISPR gRNA sequence
agggtcaggatttacctttt

SEQ ID NO: 317385 - DNA, 20 bp, Artificial
  CRISPR gRNA sequence
accttttcttggtctgttca

SEQ ID NO: 317386 - DNA, 20 bp, Artificial
  CRISPR gRNA sequence
ccttttcttggtctgttcac

SEQ ID NO: 317387 - DNA, 20 bp, Artificial
  CRISPR gRNA sequence
ttcttggtctgttcactctc

SEQ ID NO: 317388 - DNA, 20 bp, Artificial
  CRISPR gRNA sequence
tcttggtctgttcactctct

SEQ ID NO: 317389 - DNA, 20 bp, Artificial
  CRISPR gRNA sequence
cttggtctgttcactctctt

SEQ ID NO: 317390 - DNA, 20 bp, Artificial
  CRISPR gRNA sequence
ttggtctgttcactctcttc

SEQ ID NO: 317391 - DNA, 20 bp, Artificial
  CRISPR gRNA sequence
ggtctgttcactctcttccc

SEQ ID NO: 317392 - DNA, 20 bp, Artificial
  CRISPR gRNA sequence
gtctgttcactctcttccct

SEQ ID NO: 317393 - DNA, 20 bp, Artificial
  CRISPR gRNA sequence
ttcactctcttccctctcca

SEQ ID NO: 317394 - DNA, 20 bp, Artificial
  CRISPR gRNA sequence
actctcttccctctccattg

SEQ ID NO: 317395 - DNA, 20 bp, Artificial
  CRISPR gRNA sequence
tcttccctctccattgtgtt

SEQ ID NO: 317396 - DNA, 20 bp, Artificial
  CRISPR gRNA sequence
ttccctctccattgtgttgg

SEQ ID NO: 317397 - DNA, 20 bp, Artificial
  CRISPR gRNA sequence
ccctctccattgtgttggtt

SEQ ID NO: 317398 - DNA, 20 bp, Artificial
  CRISPR gRNA sequence
cctctccattgtgttggttc

SEQ ID NO: 317399 - DNA, 20 bp, Artificial
  CRISPR gRNA sequence
tccattgtgttggttcctga

SEQ ID NO: 317400 - DNA, 20 bp, Artificial
  CRISPR gRNA sequence
cattgtgttggttcctgaaa

SEQ ID NO: 317401 - DNA, 20 bp, Artificial
  CRISPR gRNA sequence
tgttggttcctgaaagacac

SEQ ID NO: 317402 - DNA, 20 bp, Artificial
  CRISPR gRNA sequence
gttcctgaaagacaccaaga

SEQ ID NO: 317403 - DNA, 20 bp, Artificial
  CRISPR gRNA sequence
ctgaaagacaccaagaacaa

SEQ ID NO: 317404 - DNA, 20 bp, Artificial
  CRISPR gRNA sequence
aaagacaccaagaacaatct

SEQ ID NO: 317405 - DNA, 20 bp, Artificial
  CRISPR gRNA sequence
caaaaatgtattcctcctag

SEQ ID NO: 317406 - DNA, 20 bp, Artificial
  CRISPR gRNA sequence
aaaaatgtattcctcctaga

SEQ ID NO: 317407 - DNA, 20 bp, Artificial
  CRISPR gRNA sequence
ctcctagataccaaaagaag

SEQ ID NO: 317408 - DNA, 20 bp, Artificial
  CRISPR gRNA sequence
ctagataccaaaagaaggaa

SEQ ID NO: 317409 - DNA, 20 bp, Artificial
  CRISPR gRNA sequence
gataccaaaagaaggaaagt

SEQ ID NO: 317410 - DNA, 20 bp, Artificial
  CRISPR gRNA sequence
gaaaaggcttcaaagttctg

SEQ ID NO: 317411 - DNA, 20 bp, Artificial
  CRISPR gRNA sequence
aaaaggcttcaaagttctgg

SEQ ID NO: 317412 - DNA, 20 bp, Artificial
  CRISPR gRNA sequence
caaagttctgggactgagag

SEQ ID NO: 317413 - DNA, 20 bp, Artificial
  CRISPR gRNA sequence
aaagttctgggactgagaga

SEQ ID NO: 317414 - DNA, 20 bp, Artificial
  CRISPR gRNA sequence
tgggactgagagagaaattg

SEQ ID NO: 317415 - DNA, 20 bp, Artificial
  CRISPR gRNA sequence
ggactgagagagaaattgtt

SEQ ID NO: 317416 - DNA, 20 bp, Artificial
  CRISPR gRNA sequence
agagagaaattgttgtgact

SEQ ID NO: 317417 - DNA, 20 bp, Artificial
  CRISPR gRNA sequence
ttgtgactttatatatggaa

SEQ ID NO: 317418 - DNA, 20 bp, Artificial
  CRISPR gRNA sequence
tgactttatatatggaagag

SEQ ID NO: 317419 - DNA, 20 bp, Artificial
  CRISPR gRNA sequence
tatatatggaagagatagtt

SEQ ID NO: 317420 - DNA, 20 bp, Artificial
  CRISPR gRNA sequence
atatatggaagagatagtta

SEQ ID NO: 317421 - DNA, 20 bp, Artificial
  CRISPR gRNA sequence
tatatggaagagatagttac

SEQ ID NO: 317422 - DNA, 20 bp, Artificial
  CRISPR gRNA sequence
ctcaaatgatgcaatttcag

SEQ ID NO: 317423 - DNA, 20 bp, Artificial
  CRISPR gRNA sequence
aaatgatgcaatttcagggg

SEQ ID NO: 317424 - DNA, 20 bp, Artificial
  CRISPR gRNA sequence
cagggggattgggaagaagt

SEQ ID NO: 317425 - DNA, 20 bp, Artificial
  CRISPR gRNA sequence
agggggattgggaagaagtt

SEQ ID NO: 317426 - DNA, 20 bp, Artificial
  CRISPR gRNA sequence
ggaagaagtttcttgcattc

SEQ ID NO: 317427 - DNA, 20 bp, Artificial
  CRISPR gRNA sequence
cttgcattcaaaaagtatat

SEQ ID NO: 317428 - DNA, 20 bp, Artificial
  CRISPR gRNA sequence
ttgcattcaaaaagtatatg

SEQ ID NO: 317429 - DNA, 20 bp, Artificial
  CRISPR gRNA sequence
gcattcaaaaagtatatgcc

SEQ ID NO: 317430 - DNA, 20 bp, Artificial
  CRISPR gRNA sequence
cattcaaaaagtatatgcct

SEQ ID NO: 317431 - DNA, 20 bp, Artificial
  CRISPR gRNA sequence
aaaaagtatatgccttccct

SEQ ID NO: 317432 - DNA, 20 bp, Artificial
  CRISPR gRNA sequence
ccctttctcactgtgcctta

SEQ ID NO: 317433 - DNA, 20 bp, Artificial
  CRISPR gRNA sequence
cctttctcactgtgccttaa

SEQ ID NO: 317434 - DNA, 20 bp, Artificial
  CRISPR gRNA sequence
tctcactgtgccttaaattc

SEQ ID NO: 317435 - DNA, 20 bp, Artificial
  CRISPR gRNA sequence
ctcactgtgccttaaattct

SEQ ID NO: 317436 - DNA, 20 bp, Artificial
  CRISPR gRNA sequence
tcactgtgccttaaattcta

SEQ ID NO: 317437 - DNA, 20 bp, Artificial
  CRISPR gRNA sequence
actgtgccttaaattctaac

SEQ ID NO: 317438 - DNA, 20 bp, Artificial
  CRISPR gRNA sequence
tgccttaaattctaacactg

SEQ ID NO: 317439 - DNA, 20 bp, Artificial
  CRISPR gRNA sequence
aaattctaacactggaaata

SEQ ID NO: 317440 - DNA, 20 bp, Artificial
  CRISPR gRNA sequence
aattctaacactggaaatag

SEQ ID NO: 317441 - DNA, 20 bp, Artificial
  CRISPR gRNA sequence
taacactggaaatagatttt

SEQ ID NO: 317442 - DNA, 20 bp, Artificial
  CRISPR gRNA sequence
acactggaaatagatttttc

SEQ ID NO: 317443 - DNA, 20 bp, Artificial
  CRISPR gRNA sequence
gaaatagatttttcacttat

SEQ ID NO: 317444 - DNA, 20 bp, Artificial
  CRISPR gRNA sequence
ttcacttatatctctatcct

SEQ ID NO: 317445 - DNA, 20 bp, Artificial
  CRISPR gRNA sequence
tcacttatatctctatcctg

SEQ ID NO: 317446 - DNA, 20 bp, Artificial
  CRISPR gRNA sequence
cacttatatctctatcctgg

SEQ ID NO: 317447 - DNA, 20 bp, Artificial
  CRISPR gRNA sequence
acttatatctctatcctggc

SEQ ID NO: 317448 - DNA, 20 bp, Artificial
  CRISPR gRNA sequence
atatctctatcctggctaac

SEQ ID NO: 317449 - DNA, 20 bp, Artificial
  CRISPR gRNA sequence
tatctctatcctggctaacc

SEQ ID NO: 317450 - DNA, 20 bp, Artificial
  CRISPR gRNA sequence
tatcctggctaaccaaaaaa

SEQ ID NO: 317451 - DNA, 20 bp, Artificial
  CRISPR gRNA sequence
tcctggctaaccaaaaaata

SEQ ID NO: 317452 - DNA, 20 bp, Artificial
  CRISPR gRNA sequence
gctaaccaaaaaataccatt

SEQ ID NO: 317453 - DNA, 20 bp, Artificial
  CRISPR gRNA sequence
accaaaaaataccattggga

SEQ ID NO: 317454 - DNA, 20 bp, Artificial
  CRISPR gRNA sequence
ggaggggtaatatatttagt

SEQ ID NO: 317455 - DNA, 20 bp, Artificial
  CRISPR gRNA sequence
agttttagcaatcattttgt

SEQ ID NO: 317456 - DNA, 20 bp, Artificial
  CRISPR gRNA sequence
gttttagcaatcattttgtg

SEQ ID NO: 317457 - DNA, 20 bp, Artificial
  CRISPR gRNA sequence
tagcaatcattttgtgattg

SEQ ID NO: 317458 - DNA, 20 bp, Artificial
  CRISPR gRNA sequence
agcaatcattttgtgattgg

SEQ ID NO: 317459 - DNA, 20 bp, Artificial
  CRISPR gRNA sequence
gcaatcattttgtgattgga

SEQ ID NO: 317460 - DNA, 20 bp, Artificial
  CRISPR gRNA sequence
tgtgattggaagagtttcta

SEQ ID NO: 317461 - DNA, 20 bp, Artificial
  CRISPR gRNA sequence
gtgattggaagagtttctaa

SEQ ID NO: 317462 - DNA, 20 bp, Artificial
  CRISPR gRNA sequence
tgattggaagagtttctaat

SEQ ID NO: 317463 - DNA, 20 bp, Artificial
  CRISPR gRNA sequence
gaagagtttctaatcctttt

SEQ ID NO: 317464 - DNA, 20 bp, Artificial
  CRISPR gRNA sequence
ctaatccttttctgaaagca

SEQ ID NO: 317465 - DNA, 20 bp, Artificial
  CRISPR gRNA sequence
taatccttttctgaaagcaa

SEQ ID NO: 317466 - DNA, 20 bp, Artificial
  CRISPR gRNA sequence
atccttttctgaaagcaagg

SEQ ID NO: 317467 - DNA, 20 bp, Artificial
  CRISPR gRNA sequence
ttctgaaagcaaggtttata

SEQ ID NO: 317468 - DNA, 20 bp, Artificial
  CRISPR gRNA sequence
tctgaaagcaaggtttataa

SEQ ID NO: 317469 - DNA, 20 bp, Artificial
  CRISPR gRNA sequence
ctgaaagcaaggtttataag

SEQ ID NO: 317470 - DNA, 20 bp, Artificial
  CRISPR gRNA sequence
tgaaagcaaggtttataagg

SEQ ID NO: 317471 - DNA, 20 bp, Artificial
  CRISPR gRNA sequence
aaagcaaggtttataaggag

SEQ ID NO: 317472 - DNA, 20 bp, Artificial
  CRISPR gRNA sequence
ataaggaggaggagaagaag

SEQ ID NO: 317473 - DNA, 20 bp, Artificial
  CRISPR gRNA sequence
taaggaggaggagaagaagt

SEQ ID NO: 317474 - DNA, 20 bp, Artificial
  CRISPR gRNA sequence
gaagatgttgatgcctaaat

SEQ ID NO: 317475 - DNA, 20 bp, Artificial
  CRISPR gRNA sequence
aagatgttgatgcctaaatc

SEQ ID NO: 317476 - DNA, 20 bp, Artificial
  CRISPR gRNA sequence
atgcctaaatcggctagcca

SEQ ID NO: 317477 - DNA, 20 bp, Artificial
  CRISPR gRNA sequence
aatcggctagccagatggtg

SEQ ID NO: 317478 - DNA, 20 bp, Artificial
  CRISPR gRNA sequence
gccagatggtgctaagaata

SEQ ID NO: 317479 - DNA, 20 bp, Artificial
  CRISPR gRNA sequence
agaatattacacaatgttgc

SEQ ID NO: 317480 - DNA, 20 bp, Artificial
  CRISPR gRNA sequence
cacaatgttgcatgggcaag

SEQ ID NO: 317481 - DNA, 20 bp, Artificial
  CRISPR gRNA sequence
catgggcaaggccaagtggg

SEQ ID NO: 317482 - DNA, 20 bp, Artificial
  CRISPR gRNA sequence
ctagccagctagacctcaca

SEQ ID NO: 317483 - DNA, 20 bp, Artificial
  CRISPR gRNA sequence
tagccagctagacctcacaa

SEQ ID NO: 317484 - DNA, 20 bp, Artificial
  CRISPR gRNA sequence
gccagctagacctcacaaag

SEQ ID NO: 317485 - DNA, 20 bp, Artificial
  CRISPR gRNA sequence
gacctcacaaagcctgagtt

SEQ ID NO: 317486 - DNA, 20 bp, Artificial
  CRISPR gRNA sequence
acaaagcctgagttgctatt

SEQ ID NO: 317487 - DNA, 20 bp, Artificial
  CRISPR gRNA sequence
agttgctattgatagggact

SEQ ID NO: 317488 - DNA, 20 bp, Artificial
  CRISPR gRNA sequence
ctattgatagggacttgcta

SEQ ID NO: 317489 - DNA, 20 bp, Artificial
  CRISPR gRNA sequence
ttgatagggacttgctactg

SEQ ID NO: 317490 - DNA, 20 bp, Artificial
  CRISPR gRNA sequence
atagggacttgctactgaca

SEQ ID NO: 317491 - DNA, 20 bp, Artificial
  CRISPR gRNA sequence
gctactgacacaacttggga

SEQ ID NO: 317492 - DNA, 20 bp, Artificial
  CRISPR gRNA sequence
ctactgacacaacttgggat

SEQ ID NO: 317493 - DNA, 20 bp, Artificial
  CRISPR gRNA sequence
ctgacacaacttgggatgta

SEQ ID NO: 317494 - DNA, 20 bp, Artificial
  CRISPR gRNA sequence
acacaacttgggatgtaaat

SEQ ID NO: 317495 - DNA, 20 bp, Artificial
  CRISPR gRNA sequence
gggatgtaaatttctctagg

SEQ ID NO: 317496 - DNA, 20 bp, Artificial
  CRISPR gRNA sequence
ggatgtaaatttctctaggc

SEQ ID NO: 317497 - DNA, 20 bp, Artificial
  CRISPR gRNA sequence
ctctaggctgactgttgtga

SEQ ID NO: 317498 - DNA, 20 bp, Artificial
  CRISPR gRNA sequence
tctaggctgactgttgtgat

SEQ ID NO: 317499 - DNA, 20 bp, Artificial
  CRISPR gRNA sequence
taggctgactgttgtgatga

SEQ ID NO: 317500 - DNA, 20 bp, Artificial
  CRISPR gRNA sequence
ggctgactgttgtgatgatg

SEQ ID NO: 317501 - DNA, 20 bp, Artificial
  CRISPR gRNA sequence
actgttgtgatgatgctatt

SEQ ID NO: 317502 - DNA, 20 bp, Artificial
  CRISPR gRNA sequence
ttgtgatgatgctattgtcc

SEQ ID NO: 317503 - DNA, 20 bp, Artificial
  CRISPR gRNA sequence
tgatgatgctattgtcccac

SEQ ID NO: 317504 - DNA, 20 bp, Artificial
  CRISPR gRNA sequence
ttgtcccacgtaaactccaa

SEQ ID NO: 317505 - DNA, 20 bp, Artificial
  CRISPR gRNA sequence
tcccacgtaaactccaacag

SEQ ID NO: 317506 - DNA, 20 bp, Artificial
  CRISPR gRNA sequence
caacaggttgctaacctggg

SEQ ID NO: 317507 - DNA, 20 bp, Artificial
  CRISPR gRNA sequence
ctaacctgggtgtccatgga

SEQ ID NO: 317508 - DNA, 20 bp, Artificial
  CRISPR gRNA sequence
acctgggtgtccatggaggt

SEQ ID NO: 317509 - DNA, 20 bp, Artificial
  CRISPR gRNA sequence
ggtgtccatggaggtattta

SEQ ID NO: 317510 - DNA, 20 bp, Artificial
  CRISPR gRNA sequence
atagaccacaagaatccact

SEQ ID NO: 317511 - DNA, 20 bp, Artificial
  CRISPR gRNA sequence
tagaccacaagaatccactc

SEQ ID NO: 317512 - DNA, 20 bp, Artificial
  CRISPR gRNA sequence
aacaatacctctgatggttt

SEQ ID NO: 317513 - DNA, 20 bp, Artificial
  CRISPR gRNA sequence
tgatggttttgtgattctgt

SEQ ID NO: 317514 - DNA, 20 bp, Artificial
  CRISPR gRNA sequence
atggttttgtgattctgtct

SEQ ID NO: 317515 - DNA, 20 bp, Artificial
  CRISPR gRNA sequence
tgtgattctgtctttactaa

SEQ ID NO: 317516 - DNA, 20 bp, Artificial
  CRISPR gRNA sequence
gtgattctgtctttactaaa

SEQ ID NO: 317517 - DNA, 20 bp, Artificial
  CRISPR gRNA sequence
tgattctgtctttactaaat

SEQ ID NO: 317518 - DNA, 20 bp, Artificial
  CRISPR gRNA sequence
tgtctttactaaatagagca

SEQ ID NO: 317519 - DNA, 20 bp, Artificial
  CRISPR gRNA sequence
tctttactaaatagagcatt

SEQ ID NO: 317520 - DNA, 20 bp, Artificial
  CRISPR gRNA sequence
tactaaatagagcattcttg

SEQ ID NO: 317521 - DNA, 20 bp, Artificial
  CRISPR gRNA sequence
actaaatagagcattcttga

SEQ ID NO: 317522 - DNA, 20 bp, Artificial
  CRISPR gRNA sequence
ctaaatagagcattcttgaa

SEQ ID NO: 317523 - DNA, 20 bp, Artificial
  CRISPR gRNA sequence
aatagagcattcttgaacac

SEQ ID NO: 317524 - DNA, 20 bp, Artificial
  CRISPR gRNA sequence
ttgaacacttcctgtcactg

SEQ ID NO: 317525 - DNA, 20 bp, Artificial
  CRISPR gRNA sequence
gaacacttcctgtcactgga

SEQ ID NO: 317526 - DNA, 20 bp, Artificial
  CRISPR gRNA sequence
aacacttcctgtcactggaa

SEQ ID NO: 317527 - DNA, 20 bp, Artificial
  CRISPR gRNA sequence
cctgtcactggaagttctct

SEQ ID NO: 317528 - DNA, 20 bp, Artificial
  CRISPR gRNA sequence
ctgtcactggaagttctctt

SEQ ID NO: 317529 - DNA, 20 bp, Artificial
  CRISPR gRNA sequence
tcactggaagttctctttta

SEQ ID NO: 317530 - DNA, 20 bp, Artificial
  CRISPR gRNA sequence
gaagttctcttttatgtgtg

SEQ ID NO: 317531 - DNA, 20 bp, Artificial
  CRISPR gRNA sequence
tcttttatgtgtgtatgtgt

SEQ ID NO: 317532 - DNA, 20 bp, Artificial
  CRISPR gRNA sequence
ttttatgtgtgtatgtgtgt

SEQ ID NO: 317533 - DNA, 20 bp, Artificial
  CRISPR gRNA sequence
ttatgtgtgtatgtgtgtat

SEQ ID NO: 317534 - DNA, 20 bp, Artificial
  CRISPR gRNA sequence
tatgtgtgtatgtgtgtatt

SEQ ID NO: 317535 - DNA, 20 bp, Artificial
  CRISPR gRNA sequence
atgtgtgtatgtgtgtattt

SEQ ID NO: 317536 - DNA, 20 bp, Artificial
  CRISPR gRNA sequence
tgtgtgtatgtgtgtattta

SEQ ID NO: 317537 - DNA, 20 bp, Artificial
  CRISPR gRNA sequence
aaaaacaatcagcttttatg

SEQ ID NO: 317538 - DNA, 20 bp, Artificial
  CRISPR gRNA sequence
aaaacaatcagcttttatga

SEQ ID NO: 317539 - DNA, 20 bp, Artificial
  CRISPR gRNA sequence
ttatgaggccacaaagtcat

SEQ ID NO: 317540 - DNA, 20 bp, Artificial
  CRISPR gRNA sequence
tatgaggccacaaagtcata

SEQ ID NO: 317541 - DNA, 20 bp, Artificial
  CRISPR gRNA sequence
atgaggccacaaagtcataa

SEQ ID NO: 317542 - DNA, 20 bp, Artificial
  CRISPR gRNA sequence
tgaggccacaaagtcataag

SEQ ID NO: 317543 - DNA, 20 bp, Artificial
  CRISPR gRNA sequence
gggtacttggggggaagagt

SEQ ID NO: 317544 - DNA, 20 bp, Artificial
  CRISPR gRNA sequence
ggtacttggggggaagagtg

SEQ ID NO: 317545 - DNA, 20 bp, Artificial
  CRISPR gRNA sequence
ggggggaagagtgagagaga

SEQ ID NO: 317546 - DNA, 20 bp, Artificial
  CRISPR gRNA sequence
gggggaagagtgagagagag

SEQ ID NO: 317547 - DNA, 20 bp, Artificial
  CRISPR gRNA sequence
cacattgggtacagtggaca

SEQ ID NO: 317548 - DNA, 20 bp, Artificial
  CRISPR gRNA sequence
ggtacagtggacattgctcg

SEQ ID NO: 317549 - DNA, 20 bp, Artificial
  CRISPR gRNA sequence
ctcgggtgacaggtgcatca

SEQ ID NO: 317550 - DNA, 20 bp, Artificial
  CRISPR gRNA sequence
gggtgacaggtgcatcaaaa

SEQ ID NO: 317551 - DNA, 20 bp, Artificial
  CRISPR gRNA sequence
agaaatcaccactaaagaac

SEQ ID NO: 317552 - DNA, 20 bp, Artificial
  CRISPR gRNA sequence
aagaactcatccatgtaacc

SEQ ID NO: 317553 - DNA, 20 bp, Artificial
  CRISPR gRNA sequence
atccatgtaaccgaaaacca

SEQ ID NO: 317554 - DNA, 20 bp, Artificial
  CRISPR gRNA sequence
ttccccaaaaactattgaaa

SEQ ID NO: 317555 - DNA, 20 bp, Artificial
  CRISPR gRNA sequence
cccaaaaactattgaaataa

SEQ ID NO: 317556 - DNA, 20 bp, Artificial
  CRISPR gRNA sequence
ttgaaataaaataaaaataa

SEQ ID NO: 317557 - DNA, 20 bp, Artificial
  CRISPR gRNA sequence
aaataaaataaaaataaaag

SEQ ID NO: 317558 - DNA, 20 bp, Artificial
  CRISPR gRNA sequence
tatggaggtataattaataa

SEQ ID NO: 317559 - DNA, 20 bp, Artificial
  CRISPR gRNA sequence
atggaggtataattaataaa

SEQ ID NO: 317560 - DNA, 20 bp, Artificial
  CRISPR gRNA sequence
tggaggtataattaataaat

SEQ ID NO: 317561 - DNA, 20 bp, Artificial
  CRISPR gRNA sequence
ataaataataaaacccaatc

SEQ ID NO: 317562 - DNA, 20 bp, Artificial
  CRISPR gRNA sequence
tcagtttagagtttggtgat

SEQ ID NO: 317563 - DNA, 20 bp, Artificial
  CRISPR gRNA sequence
cagtttagagtttggtgatt

SEQ ID NO: 317564 - DNA, 20 bp, Artificial
  CRISPR gRNA sequence
agtttagagtttggtgattt

SEQ ID NO: 317565 - DNA, 20 bp, Artificial
  CRISPR gRNA sequence
agagtttggtgattttaacg

SEQ ID NO: 317566 - DNA, 20 bp, Artificial
  CRISPR gRNA sequence
gagtttggtgattttaacga

SEQ ID NO: 317567 - DNA, 20 bp, Artificial
  CRISPR gRNA sequence
ggtgattttaacgaatatat

SEQ ID NO: 317568 - DNA, 20 bp, Artificial
  CRISPR gRNA sequence
gtgattttaacgaatatata

SEQ ID NO: 317569 - DNA, 20 bp, Artificial
  CRISPR gRNA sequence
taacgaatatatatagtcac

SEQ ID NO: 317570 - DNA, 20 bp, Artificial
  CRISPR gRNA sequence
aacgaatatatatagtcacg

SEQ ID NO: 317571 - DNA, 20 bp, Artificial
  CRISPR gRNA sequence
acgaatatatatagtcacgt

SEQ ID NO: 317572 - DNA, 20 bp, Artificial
  CRISPR gRNA sequence
ttataagccaaaatagttcg

SEQ ID NO: 317573 - DNA, 20 bp, Artificial
  CRISPR gRNA sequence
tataagccaaaatagttcgc

SEQ ID NO: 317574 - DNA, 20 bp, Artificial
  CRISPR gRNA sequence
ataagccaaaatagttcgct

SEQ ID NO: 317575 - DNA, 20 bp, Artificial
  CRISPR gRNA sequence
taagccaaaatagttcgctt

SEQ ID NO: 317576 - DNA, 20 bp, Artificial
  CRISPR gRNA sequence
gcttttcagctgattccttt

SEQ ID NO: 317577 - DNA, 20 bp, Artificial
  CRISPR gRNA sequence
ttcagctgattcctttcccc

SEQ ID NO: 317578 - DNA, 20 bp, Artificial
  CRISPR gRNA sequence
tcagctgattcctttccccc

SEQ ID NO: 317579 - DNA, 20 bp, Artificial
  CRISPR gRNA sequence
cagctgattcctttccccca

SEQ ID NO: 317580 - DNA, 20 bp, Artificial
  CRISPR gRNA sequence
agctgattcctttcccccat

SEQ ID NO: 317581 - DNA, 20 bp, Artificial
  CRISPR gRNA sequence
attcctttcccccatcccat

SEQ ID NO: 317582 - DNA, 20 bp, Artificial
  CRISPR gRNA sequence
ctttcccccatcccatggat

SEQ ID NO: 317583 - DNA, 20 bp, Artificial
  CRISPR gRNA sequence
tcccccatcccatggataac

SEQ ID NO: 317584 - DNA, 20 bp, Artificial
  CRISPR gRNA sequence
cccccatcccatggataacc

SEQ ID NO: 317585 - DNA, 20 bp, Artificial
  CRISPR gRNA sequence
ccccatcccatggataacca

SEQ ID NO: 317586 - DNA, 20 bp, Artificial
  CRISPR gRNA sequence
cttaaaatagttttgctttt

SEQ ID NO: 317587 - DNA, 20 bp, Artificial
  CRISPR gRNA sequence
aaaatagttttgctttttct

SEQ ID NO: 317588 - DNA, 20 bp, Artificial
  CRISPR gRNA sequence
aaatagttttgctttttctc

SEQ ID NO: 317589 - DNA, 20 bp, Artificial
  CRISPR gRNA sequence
tgctttttctcaaatttcat

SEQ ID NO: 317590 - DNA, 20 bp, Artificial
  CRISPR gRNA sequence
gctttttctcaaatttcata

SEQ ID NO: 317591 - DNA, 20 bp, Artificial
  CRISPR gRNA sequence
ctttttctcaaatttcatat

SEQ ID NO: 317592 - DNA, 20 bp, Artificial
  CRISPR gRNA sequence
tttctcaaatttcatataca

SEQ ID NO: 317593 - DNA, 20 bp, Artificial
  CRISPR gRNA sequence
ttctcaaatttcatatacat

SEQ ID NO: 317594 - DNA, 20 bp, Artificial
  CRISPR gRNA sequence
tctcaaatttcatatacatg

SEQ ID NO: 317595 - DNA, 20 bp, Artificial
  CRISPR gRNA sequence
ctcaaatttcatatacatga

SEQ ID NO: 317596 - DNA, 20 bp, Artificial
  CRISPR gRNA sequence
tcaaatttcatatacatgaa

SEQ ID NO: 317597 - DNA, 20 bp, Artificial
  CRISPR gRNA sequence
aaatttcatatacatgaaat

SEQ ID NO: 317598 - DNA, 20 bp, Artificial
  CRISPR gRNA sequence
catatacatgaaattgtata

SEQ ID NO: 317599 - DNA, 20 bp, Artificial
  CRISPR gRNA sequence
atatacatgaaattgtataa

SEQ ID NO: 317600 - DNA, 20 bp, Artificial
  CRISPR gRNA sequence
tataatgtgtattcttcttg

SEQ ID NO: 317601 - DNA, 20 bp, Artificial
  CRISPR gRNA sequence
ttcttgtgcctggattgttt

SEQ ID NO: 317602 - DNA, 20 bp, Artificial
  CRISPR gRNA sequence
cttgtgcctggattgtttca

SEQ ID NO: 317603 - DNA, 20 bp, Artificial
  CRISPR gRNA sequence
ttgtgcctggattgtttcac

SEQ ID NO: 317604 - DNA, 20 bp, Artificial
  CRISPR gRNA sequence
gtgcctggattgtttcactt

SEQ ID NO: 317605 - DNA, 20 bp, Artificial
  CRISPR gRNA sequence
tgcctggattgtttcactta

SEQ ID NO: 317606 - DNA, 20 bp, Artificial
  CRISPR gRNA sequence
gattgtttcacttagcataa

SEQ ID NO: 317607 - DNA, 20 bp, Artificial
  CRISPR gRNA sequence
tttcacttagcataatgctt

SEQ ID NO: 317608 - DNA, 20 bp, Artificial
  CRISPR gRNA sequence
cacttagcataatgcttttg

SEQ ID NO: 317609 - DNA, 20 bp, Artificial
  CRISPR gRNA sequence
acttagcataatgcttttga

SEQ ID NO: 317610 - DNA, 20 bp, Artificial
  CRISPR gRNA sequence
agcataatgcttttgaaatt

SEQ ID NO: 317611 - DNA, 20 bp, Artificial
  CRISPR gRNA sequence
gcataatgcttttgaaattt

SEQ ID NO: 317612 - DNA, 20 bp, Artificial
  CRISPR gRNA sequence
ttgaaatttatctatgttct

SEQ ID NO: 317613 - DNA, 20 bp, Artificial
  CRISPR gRNA sequence
tgaaatttatctatgttctt

SEQ ID NO: 317614 - DNA, 20 bp, Artificial
  CRISPR gRNA sequence
gaaatttatctatgttcttg

SEQ ID NO: 317615 - DNA, 20 bp, Artificial
  CRISPR gRNA sequence
aaatttatctatgttcttgt

SEQ ID NO: 317616 - DNA, 20 bp, Artificial
  CRISPR gRNA sequence
atctatgttcttgtgtatta

SEQ ID NO: 317617 - DNA, 20 bp, Artificial
  CRISPR gRNA sequence
tctatgttcttgtgtattat

SEQ ID NO: 317618 - DNA, 20 bp, Artificial
  CRISPR gRNA sequence
tgttcttgtgtattattagt

SEQ ID NO: 317619 - DNA, 20 bp, Artificial
  CRISPR gRNA sequence
ttgtgtattattagtagtcc

SEQ ID NO: 317620 - DNA, 20 bp, Artificial
  CRISPR gRNA sequence
gtgtattattagtagtccat

SEQ ID NO: 317621 - DNA, 20 bp, Artificial
  CRISPR gRNA sequence
tgtattattagtagtccatt

SEQ ID NO: 317622 - DNA, 20 bp, Artificial
  CRISPR gRNA sequence
ttagtagtccattcctttct

SEQ ID NO: 317623 - DNA, 20 bp, Artificial
  CRISPR gRNA sequence
gtagtccattcctttctata

SEQ ID NO: 317624 - DNA, 20 bp, Artificial
  CRISPR gRNA sequence
ctttctatagctttgcagta

SEQ ID NO: 317625 - DNA, 20 bp, Artificial
  CRISPR gRNA sequence
tctatagctttgcagtattt

SEQ ID NO: 317626 - DNA, 20 bp, Artificial
  CRISPR gRNA sequence
ctatagctttgcagtatttc

SEQ ID NO: 317627 - DNA, 20 bp, Artificial
  CRISPR gRNA sequence
tatagctttgcagtatttca

SEQ ID NO: 317628 - DNA, 20 bp, Artificial
  CRISPR gRNA sequence
tagctttgcagtatttcatt

SEQ ID NO: 317629 - DNA, 20 bp, Artificial
  CRISPR gRNA sequence
tgcagtatttcattgtataa

SEQ ID NO: 317630 - DNA, 20 bp, Artificial
  CRISPR gRNA sequence
gcagtatttcattgtataaa

SEQ ID NO: 317631 - DNA, 20 bp, Artificial
  CRISPR gRNA sequence
cagtatttcattgtataaat

SEQ ID NO: 317632 - DNA, 20 bp, Artificial
  CRISPR gRNA sequence
cattgtataaatataccacc

SEQ ID NO: 317633 - DNA, 20 bp, Artificial
  CRISPR gRNA sequence
attgtataaatataccaccg

SEQ ID NO: 317634 - DNA, 20 bp, Artificial
  CRISPR gRNA sequence
tataaatataccaccgccaa

SEQ ID NO: 317635 - DNA, 20 bp, Artificial
  CRISPR gRNA sequence
atgaaaatttagaatgccag

SEQ ID NO: 317636 - DNA, 20 bp, Artificial
  CRISPR gRNA sequence
agaatgccaggtttggtatt

SEQ ID NO: 317637 - DNA, 20 bp, Artificial
  CRISPR gRNA sequence
gaatgccaggtttggtatta

SEQ ID NO: 317638 - DNA, 20 bp, Artificial
  CRISPR gRNA sequence
ggtattatgaagcaagctgc

SEQ ID NO: 317639 - DNA, 20 bp, Artificial
  CRISPR gRNA sequence
gtattatgaagcaagctgct

SEQ ID NO: 317640 - DNA, 20 bp, Artificial
  CRISPR gRNA sequence
tgaagcaagctgctatgaac

SEQ ID NO: 317641 - DNA, 20 bp, Artificial
  CRISPR gRNA sequence
ctatgaacatttgtgtatga

SEQ ID NO: 317642 - DNA, 20 bp, Artificial
  CRISPR gRNA sequence
tgaacatttgtgtatgagtc

SEQ ID NO: 317643 - DNA, 20 bp, Artificial
  CRISPR gRNA sequence
gtgtatgagtctttatatat

SEQ ID NO: 317644 - DNA, 20 bp, Artificial
  CRISPR gRNA sequence
tgtatgagtctttatatatt

SEQ ID NO: 317645 - DNA, 20 bp, Artificial
  CRISPR gRNA sequence
tatatatttttaaatttttt

SEQ ID NO: 317646 - DNA, 20 bp, Artificial
  CRISPR gRNA sequence
atatatttttaaatttttta

SEQ ID NO: 317647 - DNA, 20 bp, Artificial
  CRISPR gRNA sequence
tatatttttaaattttttaa

SEQ ID NO: 317648 - DNA, 20 bp, Artificial
  CRISPR gRNA sequence
ttaaattttttaaaatttct

SEQ ID NO: 317649 - DNA, 20 bp, Artificial
  CRISPR gRNA sequence
taaattttttaaaatttctg

SEQ ID NO: 317650 - DNA, 20 bp, Artificial
  CRISPR gRNA sequence
aaattttttaaaatttctgt

SEQ ID NO: 317651 - DNA, 20 bp, Artificial
  CRISPR gRNA sequence
aattttttaaaatttctgtt

SEQ ID NO: 317652 - DNA, 20 bp, Artificial
  CRISPR gRNA sequence
tttaaaatttctgtttggta

SEQ ID NO: 317653 - DNA, 20 bp, Artificial
  CRISPR gRNA sequence
ttaaaatttctgtttggtaa

SEQ ID NO: 317654 - DNA, 20 bp, Artificial
  CRISPR gRNA sequence
taaaatttctgtttggtaaa

SEQ ID NO: 317655 - DNA, 20 bp, Artificial
  CRISPR gRNA sequence
aaaatttctgtttggtaaat

SEQ ID NO: 317656 - DNA, 20 bp, Artificial
  CRISPR gRNA sequence
aaatttctgtttggtaaatg

SEQ ID NO: 317657 - DNA, 20 bp, Artificial
  CRISPR gRNA sequence
ctgtttggtaaatgtctagg

SEQ ID NO: 317658 - DNA, 20 bp, Artificial
  CRISPR gRNA sequence
tgtttggtaaatgtctagga

SEQ ID NO: 317659 - DNA, 20 bp, Artificial
  CRISPR gRNA sequence
tttggtaaatgtctaggatt

SEQ ID NO: 317660 - DNA, 20 bp, Artificial
  CRISPR gRNA sequence
ggtaaatgtctaggatttct

SEQ ID NO: 317661 - DNA, 20 bp, Artificial
  CRISPR gRNA sequence
gtaaatgtctaggatttctg

SEQ ID NO: 317662 - DNA, 20 bp, Artificial
  CRISPR gRNA sequence
ggatttctgggttgtatagc

SEQ ID NO: 317663 - DNA, 20 bp, Artificial
  CRISPR gRNA sequence
ctgggttgtatagcagtata

SEQ ID NO: 317664 - DNA, 20 bp, Artificial
  CRISPR gRNA sequence
tgggttgtatagcagtatat

SEQ ID NO: 317665 - DNA, 20 bp, Artificial
  CRISPR gRNA sequence
ggttgtatagcagtatatga

SEQ ID NO: 317666 - DNA, 20 bp, Artificial
  CRISPR gRNA sequence
tatagcagtatatgagagtt

SEQ ID NO: 317667 - DNA, 20 bp, Artificial
  CRISPR gRNA sequence
cagttgcttcatatcctctc

SEQ ID NO: 317668 - DNA, 20 bp, Artificial
  CRISPR gRNA sequence
agttgcttcatatcctctcc

SEQ ID NO: 317669 - DNA, 20 bp, Artificial
  CRISPR gRNA sequence
cttcatatcctctccaacac

SEQ ID NO: 317670 - DNA, 20 bp, Artificial
  CRISPR gRNA sequence
catatcctctccaacacttg

SEQ ID NO: 317671 - DNA, 20 bp, Artificial
  CRISPR gRNA sequence
atatcctctccaacacttga

SEQ ID NO: 317672 - DNA, 20 bp, Artificial
  CRISPR gRNA sequence
tccaacacttgatgtttatc

SEQ ID NO: 317673 - DNA, 20 bp, Artificial
  CRISPR gRNA sequence
caacacttgatgtttatcag

SEQ ID NO: 317674 - DNA, 20 bp, Artificial
  CRISPR gRNA sequence
gatgtttatcagacctttta

SEQ ID NO: 317675 - DNA, 20 bp, Artificial
  CRISPR gRNA sequence
atgtttatcagaccttttaa

SEQ ID NO: 317676 - DNA, 20 bp, Artificial
  CRISPR gRNA sequence
atcagaccttttaattttag

SEQ ID NO: 317677 - DNA, 20 bp, Artificial
  CRISPR gRNA sequence
tcagaccttttaattttagc

SEQ ID NO: 317678 - DNA, 20 bp, Artificial
  CRISPR gRNA sequence
ttaattttagccattctaga

SEQ ID NO: 317679 - DNA, 20 bp, Artificial
  CRISPR gRNA sequence
taattttagccattctagag

SEQ ID NO: 317680 - DNA, 20 bp, Artificial
  CRISPR gRNA sequence
aattttagccattctagagg

SEQ ID NO: 317681 - DNA, 20 bp, Artificial
  CRISPR gRNA sequence
attttagccattctagaggg

SEQ ID NO: 317682 - DNA, 20 bp, Artificial
  CRISPR gRNA sequence
tagccattctagagggtgtg

SEQ ID NO: 317683 - DNA, 20 bp, Artificial
  CRISPR gRNA sequence
agccattctagagggtgtgc

SEQ ID NO: 317684 - DNA, 20 bp, Artificial
  CRISPR gRNA sequence
gccattctagagggtgtgca

SEQ ID NO: 317685 - DNA, 20 bp, Artificial
  CRISPR gRNA sequence
tagagggtgtgcagtggtat

SEQ ID NO: 317686 - DNA, 20 bp, Artificial
  CRISPR gRNA sequence
gagggtgtgcagtggtatct

SEQ ID NO: 317687 - DNA, 20 bp, Artificial
  CRISPR gRNA sequence
attatcgttttaatttgtac

SEQ ID NO: 317688 - DNA, 20 bp, Artificial
  CRISPR gRNA sequence
tcgttttaatttgtacttcc

SEQ ID NO: 317689 - DNA, 20 bp, Artificial
  CRISPR gRNA sequence
taatttgtacttccctgatg

SEQ ID NO: 317690 - DNA, 20 bp, Artificial
  CRISPR gRNA sequence
aatttgtacttccctgatga

SEQ ID NO: 317691 - DNA, 20 bp, Artificial
  CRISPR gRNA sequence
atttgtacttccctgatgac

SEQ ID NO: 317692 - DNA, 20 bp, Artificial
  CRISPR gRNA sequence
gtacttccctgatgactaat

SEQ ID NO: 317693 - DNA, 20 bp, Artificial
  CRISPR gRNA sequence
tacttccctgatgactaatg

SEQ ID NO: 317694 - DNA, 20 bp, Artificial
  CRISPR gRNA sequence
ccctgatgactaatgatgtt

SEQ ID NO: 317695 - DNA, 20 bp, Artificial
  CRISPR gRNA sequence
cctgatgactaatgatgttg

SEQ ID NO: 317696 - DNA, 20 bp, Artificial
  CRISPR gRNA sequence
atgactaatgatgttgtgac

SEQ ID NO: 317697 - DNA, 20 bp, Artificial
  CRISPR gRNA sequence
atgatgttgtgactgtgctc

SEQ ID NO: 317698 - DNA, 20 bp, Artificial
  CRISPR gRNA sequence
tgactgtgctcatcggccat

SEQ ID NO: 317699 - DNA, 20 bp, Artificial
  CRISPR gRNA sequence
tgctcatcggccatctgtat

SEQ ID NO: 317700 - DNA, 20 bp, Artificial
  CRISPR gRNA sequence
atcggccatctgtatatctt

SEQ ID NO: 317701 - DNA, 20 bp, Artificial
  CRISPR gRNA sequence
tatatcttcttctgttatgt

SEQ ID NO: 317702 - DNA, 20 bp, Artificial
  CRISPR gRNA sequence
cttctgttatgtatctgttc

SEQ ID NO: 317703 - DNA, 20 bp, Artificial
  CRISPR gRNA sequence
ttctgttatgtatctgttca

SEQ ID NO: 317704 - DNA, 20 bp, Artificial
  CRISPR gRNA sequence
ctgttatgtatctgttcaag

SEQ ID NO: 317705 - DNA, 20 bp, Artificial
  CRISPR gRNA sequence
tgttatgtatctgttcaagt

SEQ ID NO: 317706 - DNA, 20 bp, Artificial
  CRISPR gRNA sequence
ttatgtatctgttcaagtct

SEQ ID NO: 317707 - DNA, 20 bp, Artificial
  CRISPR gRNA sequence
tgtatctgttcaagtctctt

SEQ ID NO: 317708 - DNA, 20 bp, Artificial
  CRISPR gRNA sequence
ttcaagtctcttcttcttgc

SEQ ID NO: 317709 - DNA, 20 bp, Artificial
  CRISPR gRNA sequence
aagtctcttcttcttgcctt

SEQ ID NO: 317710 - DNA, 20 bp, Artificial
  CRISPR gRNA sequence
ttcttcttgccttttattaa

SEQ ID NO: 317711 - DNA, 20 bp, Artificial
  CRISPR gRNA sequence
cttcttgccttttattaaat

SEQ ID NO: 317712 - DNA, 20 bp, Artificial
  CRISPR gRNA sequence
ttcttgccttttattaaatg

SEQ ID NO: 317713 - DNA, 20 bp, Artificial
  CRISPR gRNA sequence
cttgccttttattaaatgga

SEQ ID NO: 317714 - DNA, 20 bp, Artificial
  CRISPR gRNA sequence
ttgccttttattaaatggat

SEQ ID NO: 317715 - DNA, 20 bp, Artificial
  CRISPR gRNA sequence
gccttttattaaatggattg

SEQ ID NO: 317716 - DNA, 20 bp, Artificial
  CRISPR gRNA sequence
ccttttattaaatggattgt

SEQ ID NO: 317717 - DNA, 20 bp, Artificial
  CRISPR gRNA sequence
ttattaaatggattgtcttc

SEQ ID NO: 317718 - DNA, 20 bp, Artificial
  CRISPR gRNA sequence
tattaaatggattgtcttct

SEQ ID NO: 317719 - DNA, 20 bp, Artificial
  CRISPR gRNA sequence
attaaatggattgtcttctt

SEQ ID NO: 317720 - DNA, 20 bp, Artificial
  CRISPR gRNA sequence
ttaaatggattgtcttctta

SEQ ID NO: 317721 - DNA, 20 bp, Artificial
  CRISPR gRNA sequence
aatggattgtcttcttacta

SEQ ID NO: 317722 - DNA, 20 bp, Artificial
  CRISPR gRNA sequence
tcttcttactaatgagtagc

SEQ ID NO: 317723 - DNA, 20 bp, Artificial
  CRISPR gRNA sequence
cttactaatgagtagcaata

SEQ ID NO: 317724 - DNA, 20 bp, Artificial
  CRISPR gRNA sequence
ttactaatgagtagcaatat

SEQ ID NO: 317725 - DNA, 20 bp, Artificial
  CRISPR gRNA sequence
actaatgagtagcaatatgt

SEQ ID NO: 317726 - DNA, 20 bp, Artificial
  CRISPR gRNA sequence
ctaatgagtagcaatatgta

SEQ ID NO: 317727 - DNA, 20 bp, Artificial
  CRISPR gRNA sequence
atgagtagcaatatgtaatt

SEQ ID NO: 317728 - DNA, 20 bp, Artificial
  CRISPR gRNA sequence
tatactggatacaagtcctt

SEQ ID NO: 317729 - DNA, 20 bp, Artificial
  CRISPR gRNA sequence
gatacaagtcctttatcaga

SEQ ID NO: 317730 - DNA, 20 bp, Artificial
  CRISPR gRNA sequence
tatcagatatatattttgca

SEQ ID NO: 317731 - DNA, 20 bp, Artificial
  CRISPR gRNA sequence
atcagatatatattttgcaa

SEQ ID NO: 317732 - DNA, 20 bp, Artificial
  CRISPR gRNA sequence
tcagatatatattttgcaaa

SEQ ID NO: 317733 - DNA, 20 bp, Artificial
  CRISPR gRNA sequence
tgcaaacgttttctccctgt

SEQ ID NO: 317734 - DNA, 20 bp, Artificial
  CRISPR gRNA sequence
gcaaacgttttctccctgtc

SEQ ID NO: 317735 - DNA, 20 bp, Artificial
  CRISPR gRNA sequence
caaacgttttctccctgtct

SEQ ID NO: 317736 - DNA, 20 bp, Artificial
  CRISPR gRNA sequence
tctccctgtctgtggtttga

SEQ ID NO: 317737 - DNA, 20 bp, Artificial
  CRISPR gRNA sequence
ctccctgtctgtggtttgac

SEQ ID NO: 317738 - DNA, 20 bp, Artificial
  CRISPR gRNA sequence
tccctgtctgtggtttgact

SEQ ID NO: 317739 - DNA, 20 bp, Artificial
  CRISPR gRNA sequence
cctgtctgtggtttgacttt

SEQ ID NO: 317740 - DNA, 20 bp, Artificial
  CRISPR gRNA sequence
tctgtggtttgacttttcgt

SEQ ID NO: 317741 - DNA, 20 bp, Artificial
  CRISPR gRNA sequence
tggtttgacttttcgttttt

SEQ ID NO: 317742 - DNA, 20 bp, Artificial
  CRISPR gRNA sequence
gacttttcgttttttaaaca

SEQ ID NO: 317743 - DNA, 20 bp, Artificial
  CRISPR gRNA sequence
acttttcgttttttaaacaa

SEQ ID NO: 317744 - DNA, 20 bp, Artificial
  CRISPR gRNA sequence
ttcgttttttaaacaaagtc

SEQ ID NO: 317745 - DNA, 20 bp, Artificial
  CRISPR gRNA sequence
tcgttttttaaacaaagtca

SEQ ID NO: 317746 - DNA, 20 bp, Artificial
  CRISPR gRNA sequence
cgttttttaaacaaagtcaa

SEQ ID NO: 317747 - DNA, 20 bp, Artificial
  CRISPR gRNA sequence
gttttttaaacaaagtcaaa

SEQ ID NO: 317748 - DNA, 20 bp, Artificial
  CRISPR gRNA sequence
tttaaacaaagtcaaagaac

SEQ ID NO: 317749 - DNA, 20 bp, Artificial
  CRISPR gRNA sequence
ttaaacaaagtcaaagaaca

SEQ ID NO: 317750 - DNA, 20 bp, Artificial
  CRISPR gRNA sequence
taaacaaagtcaaagaacaa

SEQ ID NO: 317751 - DNA, 20 bp, Artificial
  CRISPR gRNA sequence
aaacaaagtcaaagaacaaa

SEQ ID NO: 317752 - DNA, 20 bp, Artificial
  CRISPR gRNA sequence
aacaaagtcaaagaacaaaa

SEQ ID NO: 317753 - DNA, 20 bp, Artificial
  CRISPR gRNA sequence
tccatattgatgacatccat

SEQ ID NO: 317754 - DNA, 20 bp, Artificial
  CRISPR gRNA sequence
ccatattgatgacatccatt

SEQ ID NO: 317755 - DNA, 20 bp, Artificial
  CRISPR gRNA sequence
catattgatgacatccattt

SEQ ID NO: 317756 - DNA, 20 bp, Artificial
  CRISPR gRNA sequence
atgacatccattttatcttt

SEQ ID NO: 317757 - DNA, 20 bp, Artificial
  CRISPR gRNA sequence
tatctttttatgatatggtt

SEQ ID NO: 317758 - DNA, 20 bp, Artificial
  CRISPR gRNA sequence
atctttttatgatatggttt

SEQ ID NO: 317759 - DNA, 20 bp, Artificial
  CRISPR gRNA sequence
tctttttatgatatggtttt

SEQ ID NO: 317760 - DNA, 20 bp, Artificial
  CRISPR gRNA sequence
tttatgatatggtttttgct

SEQ ID NO: 317761 - DNA, 20 bp, Artificial
  CRISPR gRNA sequence
ttatgatatggtttttgctt

SEQ ID NO: 317762 - DNA, 20 bp, Artificial
  CRISPR gRNA sequence
tatgatatggtttttgcttt

SEQ ID NO: 317763 - DNA, 20 bp, Artificial
  CRISPR gRNA sequence
atgatatggtttttgctttc

SEQ ID NO: 317764 - DNA, 20 bp, Artificial
  CRISPR gRNA sequence
tgatatggtttttgctttct

SEQ ID NO: 317765 - DNA, 20 bp, Artificial
  CRISPR gRNA sequence
ttgctttctgtgtcctatct

SEQ ID NO: 317766 - DNA, 20 bp, Artificial
  CRISPR gRNA sequence
tgctttctgtgtcctatcta

SEQ ID NO: 317767 - DNA, 20 bp, Artificial
  CRISPR gRNA sequence
gctttctgtgtcctatctaa

SEQ ID NO: 317768 - DNA, 20 bp, Artificial
  CRISPR gRNA sequence
ctttctgtgtcctatctaag

SEQ ID NO: 317769 - DNA, 20 bp, Artificial
  CRISPR gRNA sequence
tctgtgtcctatctaagaag

SEQ ID NO: 317770 - DNA, 20 bp, Artificial
  CRISPR gRNA sequence
ctgtgtcctatctaagaaga

SEQ ID NO: 317771 - DNA, 20 bp, Artificial
  CRISPR gRNA sequence
tgtgtcctatctaagaagac

SEQ ID NO: 317772 - DNA, 20 bp, Artificial
  CRISPR gRNA sequence
tgtcctatctaagaagactt

SEQ ID NO: 317773 - DNA, 20 bp, Artificial
  CRISPR gRNA sequence
tctaagaagacttgcctaac

SEQ ID NO: 317774 - DNA, 20 bp, Artificial
  CRISPR gRNA sequence
agaagacttgcctaacttaa

SEQ ID NO: 317775 - DNA, 20 bp, Artificial
  CRISPR gRNA sequence
gcctaacttaaggttacaaa

SEQ ID NO: 317776 - DNA, 20 bp, Artificial
  CRISPR gRNA sequence
cctaacttaaggttacaaag

SEQ ID NO: 317777 - DNA, 20 bp, Artificial
  CRISPR gRNA sequence
acttaaggttacaaagattt

SEQ ID NO: 317778 - DNA, 20 bp, Artificial
  CRISPR gRNA sequence
aaggttacaaagattttctc

SEQ ID NO: 317779 - DNA, 20 bp, Artificial
  CRISPR gRNA sequence
aggttacaaagattttctcc

SEQ ID NO: 317780 - DNA, 20 bp, Artificial
  CRISPR gRNA sequence
caaagattttctcctctgtt

SEQ ID NO: 317781 - DNA, 20 bp, Artificial
  CRISPR gRNA sequence
tctcctctgttttcttttgg

SEQ ID NO: 317782 - DNA, 20 bp, Artificial
  CRISPR gRNA sequence
ctcctctgttttcttttgga

SEQ ID NO: 317783 - DNA, 20 bp, Artificial
  CRISPR gRNA sequence
tcctctgttttcttttggaa

SEQ ID NO: 317784 - DNA, 20 bp, Artificial
  CRISPR gRNA sequence
ctctgttttcttttggaagt

SEQ ID NO: 317785 - DNA, 20 bp, Artificial
  CRISPR gRNA sequence
tgttttcttttggaagtcct

SEQ ID NO: 317786 - DNA, 20 bp, Artificial
  CRISPR gRNA sequence
ttttcttttggaagtccttt

SEQ ID NO: 317787 - DNA, 20 bp, Artificial
  CRISPR gRNA sequence
tcttttggaagtcctttcat

SEQ ID NO: 317788 - DNA, 20 bp, Artificial
  CRISPR gRNA sequence
cttttggaagtcctttcatt

SEQ ID NO: 317789 - DNA, 20 bp, Artificial
  CRISPR gRNA sequence
ttttggaagtcctttcattt

SEQ ID NO: 317790 - DNA, 20 bp, Artificial
  CRISPR gRNA sequence
ttggaagtcctttcatttta

SEQ ID NO: 317791 - DNA, 20 bp, Artificial
  CRISPR gRNA sequence
tggaagtcctttcattttaa

SEQ ID NO: 317792 - DNA, 20 bp, Artificial
  CRISPR gRNA sequence
ggaagtcctttcattttaat

SEQ ID NO: 317793 - DNA, 20 bp, Artificial
  CRISPR gRNA sequence
gaagtcctttcattttaatt

SEQ ID NO: 317794 - DNA, 20 bp, Artificial
  CRISPR gRNA sequence
tcattttaattcttaatata

SEQ ID NO: 317795 - DNA, 20 bp, Artificial
  CRISPR gRNA sequence
cattttaattcttaatatat

SEQ ID NO: 317796 - DNA, 20 bp, Artificial
  CRISPR gRNA sequence
attttaattcttaatatata

SEQ ID NO: 317797 - DNA, 20 bp, Artificial
  CRISPR gRNA sequence
taattcttaatatataagtt

SEQ ID NO: 317798 - DNA, 20 bp, Artificial
  CRISPR gRNA sequence
aattcttaatatataagtta

SEQ ID NO: 317799 - DNA, 20 bp, Artificial
  CRISPR gRNA sequence
attcttaatatataagttac

SEQ ID NO: 317800 - DNA, 20 bp, Artificial
  CRISPR gRNA sequence
ttaatatataagttactttg

SEQ ID NO: 317801 - DNA, 20 bp, Artificial
  CRISPR gRNA sequence
aatatataagttactttgtg

SEQ ID NO: 317802 - DNA, 20 bp, Artificial
  CRISPR gRNA sequence
atatataagttactttgtgt

SEQ ID NO: 317803 - DNA, 20 bp, Artificial
  CRISPR gRNA sequence
ctttgtgtgtgtctaggttc

SEQ ID NO: 317804 - DNA, 20 bp, Artificial
  CRISPR gRNA sequence
tgtgtgtgtctaggttcata

SEQ ID NO: 317805 - DNA, 20 bp, Artificial
  CRISPR gRNA sequence
gtgtgtgtctaggttcatac

SEQ ID NO: 317806 - DNA, 20 bp, Artificial
  CRISPR gRNA sequence
tgtgtgtctaggttcatact

SEQ ID NO: 317807 - DNA, 20 bp, Artificial
  CRISPR gRNA sequence
ggttcatactttttccatgt

SEQ ID NO: 317808 - DNA, 20 bp, Artificial
  CRISPR gRNA sequence
atactttttccatgtggata

SEQ ID NO: 317809 - DNA, 20 bp, Artificial
  CRISPR gRNA sequence
tttccatgtggatatctaat

SEQ ID NO: 317810 - DNA, 20 bp, Artificial
  CRISPR gRNA sequence
ttccatgtggatatctaatt

SEQ ID NO: 317811 - DNA, 20 bp, Artificial
  CRISPR gRNA sequence
tccatgtggatatctaattg

SEQ ID NO: 317812 - DNA, 20 bp, Artificial
  CRISPR gRNA sequence
ccatgtggatatctaattgt

SEQ ID NO: 317813 - DNA, 20 bp, Artificial
  CRISPR gRNA sequence
catgtggatatctaattgtc

SEQ ID NO: 317814 - DNA, 20 bp, Artificial
  CRISPR gRNA sequence
attgtcccaacactatttgt

SEQ ID NO: 317815 - DNA, 20 bp, Artificial
  CRISPR gRNA sequence
tcccaacactatttgttgaa

SEQ ID NO: 317816 - DNA, 20 bp, Artificial
  CRISPR gRNA sequence
tttgttgaaaatactatcct

SEQ ID NO: 317817 - DNA, 20 bp, Artificial
  CRISPR gRNA sequence
gttgaaaatactatcctttc

SEQ ID NO: 317818 - DNA, 20 bp, Artificial
  CRISPR gRNA sequence
ttgaaaatactatcctttct

SEQ ID NO: 317819 - DNA, 20 bp, Artificial
  CRISPR gRNA sequence
aaaatactatcctttctgca

SEQ ID NO: 317820 - DNA, 20 bp, Artificial
  CRISPR gRNA sequence
tcctttctgcatggaattac

SEQ ID NO: 317821 - DNA, 20 bp, Artificial
  CRISPR gRNA sequence
tctgcatggaattaccttgg

SEQ ID NO: 317822 - DNA, 20 bp, Artificial
  CRISPR gRNA sequence
ctgcatggaattaccttggt

SEQ ID NO: 317823 - DNA, 20 bp, Artificial
  CRISPR gRNA sequence
tgcatggaattaccttggta

SEQ ID NO: 317824 - DNA, 20 bp, Artificial
  CRISPR gRNA sequence
catggaattaccttggtagc

SEQ ID NO: 317825 - DNA, 20 bp, Artificial
  CRISPR gRNA sequence
ccttggtagctttgtcaaca

SEQ ID NO: 317826 - DNA, 20 bp, Artificial
  CRISPR gRNA sequence
ggtagctttgtcaacagtgt

SEQ ID NO: 317827 - DNA, 20 bp, Artificial
  CRISPR gRNA sequence
gtagctttgtcaacagtgtg

SEQ ID NO: 317828 - DNA, 20 bp, Artificial
  CRISPR gRNA sequence
tgtcaacagtgtgaatctat

SEQ ID NO: 317829 - DNA, 20 bp, Artificial
  CRISPR gRNA sequence
gtcaacagtgtgaatctatt

SEQ ID NO: 317830 - DNA, 20 bp, Artificial
  CRISPR gRNA sequence
tcaacagtgtgaatctattt

SEQ ID NO: 317831 - DNA, 20 bp, Artificial
  CRISPR gRNA sequence
tttttgactctctattttgt

SEQ ID NO: 317832 - DNA, 20 bp, Artificial
  CRISPR gRNA sequence
ttgactctctattttgttcc

SEQ ID NO: 317833 - DNA, 20 bp, Artificial
  CRISPR gRNA sequence
tgactctctattttgttcca

SEQ ID NO: 317834 - DNA, 20 bp, Artificial
  CRISPR gRNA sequence
gactctctattttgttccat

SEQ ID NO: 317835 - DNA, 20 bp, Artificial
  CRISPR gRNA sequence
actctctattttgttccatt

SEQ ID NO: 317836 - DNA, 20 bp, Artificial
  CRISPR gRNA sequence
tctattttgttccattgact

SEQ ID NO: 317837 - DNA, 20 bp, Artificial
  CRISPR gRNA sequence
tattttgttccattgactga

SEQ ID NO: 317838 - DNA, 20 bp, Artificial
  CRISPR gRNA sequence
ttttgttccattgactgata

SEQ ID NO: 317839 - DNA, 20 bp, Artificial
  CRISPR gRNA sequence
tgttccattgactgatatgt

SEQ ID NO: 317840 - DNA, 20 bp, Artificial
  CRISPR gRNA sequence
gttccattgactgatatgtc

SEQ ID NO: 317841 - DNA, 20 bp, Artificial
  CRISPR gRNA sequence
ttccattgactgatatgtct

SEQ ID NO: 317842 - DNA, 20 bp, Artificial
  CRISPR gRNA sequence
cattgactgatatgtctgtc

SEQ ID NO: 317843 - DNA, 20 bp, Artificial
  CRISPR gRNA sequence
actgatatgtctgtcctttt

SEQ ID NO: 317844 - DNA, 20 bp, Artificial
  CRISPR gRNA sequence
atatgtctgtccttttacca

SEQ ID NO: 317845 - DNA, 20 bp, Artificial
  CRISPR gRNA sequence
tccttttaccaatatcacac

SEQ ID NO: 317846 - DNA, 20 bp, Artificial
  CRISPR gRNA sequence
ttaccaatatcacactgtat

SEQ ID NO: 317847 - DNA, 20 bp, Artificial
  CRISPR gRNA sequence
taccaatatcacactgtatt

SEQ ID NO: 317848 - DNA, 20 bp, Artificial
  CRISPR gRNA sequence
accaatatcacactgtatta

SEQ ID NO: 317849 - DNA, 20 bp, Artificial
  CRISPR gRNA sequence
ccaatatcacactgtattaa

SEQ ID NO: 317850 - DNA, 20 bp, Artificial
  CRISPR gRNA sequence
tattaattactatatatagt

SEQ ID NO: 317851 - DNA, 20 bp, Artificial
  CRISPR gRNA sequence
attactatatatagtaaata

SEQ ID NO: 317852 - DNA, 20 bp, Artificial
  CRISPR gRNA sequence
ctatatatagtaaatattga

SEQ ID NO: 317853 - DNA, 20 bp, Artificial
  CRISPR gRNA sequence
tatatagtaaatattgaaat

SEQ ID NO: 317854 - DNA, 20 bp, Artificial
  CRISPR gRNA sequence
aaattaggtaggttaagtcc

SEQ ID NO: 317855 - DNA, 20 bp, Artificial
  CRISPR gRNA sequence
ggtaggttaagtccaccttt

SEQ ID NO: 317856 - DNA, 20 bp, Artificial
  CRISPR gRNA sequence
agtccacctttgttcttttt

SEQ ID NO: 317857 - DNA, 20 bp, Artificial
  CRISPR gRNA sequence
tgttcttttttttttttttt

SEQ ID NO: 317858 - DNA, 20 bp, Artificial
  CRISPR gRNA sequence
gttctttttttttttttttt

SEQ ID NO: 317859 - DNA, 20 bp, Artificial
  CRISPR gRNA sequence
ttcttttttttttttttttt

SEQ ID NO: 317860 - DNA, 20 bp, Artificial
  CRISPR gRNA sequence
tttttttttttttttttttt

SEQ ID NO: 317861 - DNA, 20 bp, Artificial
  CRISPR gRNA sequence
tttttttttttttttttttt

SEQ ID NO: 317862 - DNA, 20 bp, Artificial
  CRISPR gRNA sequence
tttttttttttttttttttt

SEQ ID NO: 317863 - DNA, 20 bp, Artificial
  CRISPR gRNA sequence
tttttttttttttttttttt

SEQ ID NO: 317864 - DNA, 20 bp, Artificial
  CRISPR gRNA sequence
tttttttttttttttttttt

SEQ ID NO: 317865 - DNA, 20 bp, Artificial
  CRISPR gRNA sequence
tttttttttttttttttttt

SEQ ID NO: 317866 - DNA, 20 bp, Artificial
  CRISPR gRNA sequence
tttttttttttttttttttt

SEQ ID NO: 317867 - DNA, 20 bp, Artificial
  CRISPR gRNA sequence
tttttttttttttttttttg

SEQ ID NO: 317868 - DNA, 20 bp, Artificial
  CRISPR gRNA sequence
ttttttttttttttttttga

SEQ ID NO: 317869 - DNA, 20 bp, Artificial
  CRISPR gRNA sequence
tttttttttttttttttgag

SEQ ID NO: 317870 - DNA, 20 bp, Artificial
  CRISPR gRNA sequence
ttttttttttttttttgaga

SEQ ID NO: 317871 - DNA, 20 bp, Artificial
  CRISPR gRNA sequence
tttttttttttttttgagag

SEQ ID NO: 317872 - DNA, 20 bp, Artificial
  CRISPR gRNA sequence
ttttttttttttttgagagg

SEQ ID NO: 317873 - DNA, 20 bp, Artificial
  CRISPR gRNA sequence
tttttttttttttgagaggg

SEQ ID NO: 317874 - DNA, 20 bp, Artificial
  CRISPR gRNA sequence
ttttttttttttgagaggga

SEQ ID NO: 317875 - DNA, 20 bp, Artificial
  CRISPR gRNA sequence
tttttttttttgagagggag

SEQ ID NO: 317876 - DNA, 20 bp, Artificial
  CRISPR gRNA sequence
ttttttttttgagagggagt

SEQ ID NO: 317877 - DNA, 20 bp, Artificial
  CRISPR gRNA sequence
tttttttttgagagggagtt

SEQ ID NO: 317878 - DNA, 20 bp, Artificial
  CRISPR gRNA sequence
ttttttttgagagggagttt

SEQ ID NO: 317879 - DNA, 20 bp, Artificial
  CRISPR gRNA sequence
tttttttgagagggagtttc

SEQ ID NO: 317880 - DNA, 20 bp, Artificial
  CRISPR gRNA sequence
ttttttgagagggagtttca

SEQ ID NO: 317881 - DNA, 20 bp, Artificial
  CRISPR gRNA sequence
tttttgagagggagtttcac

SEQ ID NO: 317882 - DNA, 20 bp, Artificial
  CRISPR gRNA sequence
ttttgagagggagtttcact

SEQ ID NO: 317883 - DNA, 20 bp, Artificial
  CRISPR gRNA sequence
tttgagagggagtttcactc

SEQ ID NO: 317884 - DNA, 20 bp, Artificial
  CRISPR gRNA sequence
ttgagagggagtttcactct

SEQ ID NO: 317885 - DNA, 20 bp, Artificial
  CRISPR gRNA sequence
tgagagggagtttcactctt

SEQ ID NO: 317886 - DNA, 20 bp, Artificial
  CRISPR gRNA sequence
gagagggagtttcactcttg

SEQ ID NO: 317887 - DNA, 20 bp, Artificial
  CRISPR gRNA sequence
agagggagtttcactcttgt

SEQ ID NO: 317888 - DNA, 20 bp, Artificial
  CRISPR gRNA sequence
cactcttgttgcccaggctg

SEQ ID NO: 317889 - DNA, 20 bp, Artificial
  CRISPR gRNA sequence
actcttgttgcccaggctgg

SEQ ID NO: 317890 - DNA, 20 bp, Artificial
  CRISPR gRNA sequence
ttgttgcccaggctggagtg

SEQ ID NO: 317891 - DNA, 20 bp, Artificial
  CRISPR gRNA sequence
gttgcccaggctggagtgca

SEQ ID NO: 317892 - DNA, 20 bp, Artificial
  CRISPR gRNA sequence
ttgcccaggctggagtgcaa

SEQ ID NO: 317893 - DNA, 20 bp, Artificial
  CRISPR gRNA sequence
cccaggctggagtgcaatgg

SEQ ID NO: 317894 - DNA, 20 bp, Artificial
  CRISPR gRNA sequence
gagtgcaatggcacgatctc

SEQ ID NO: 317895 - DNA, 20 bp, Artificial
  CRISPR gRNA sequence
agctcacagcaacctctgcc

SEQ ID NO: 317896 - DNA, 20 bp, Artificial
  CRISPR gRNA sequence
acagcaacctctgcctcccg

SEQ ID NO: 317897 - DNA, 20 bp, Artificial
  CRISPR gRNA sequence
tgcctcccgggttcaagcaa

SEQ ID NO: 317898 - DNA, 20 bp, Artificial
  CRISPR gRNA sequence
cctcccgggttcaagcaatt

SEQ ID NO: 317899 - DNA, 20 bp, Artificial
  CRISPR gRNA sequence
ccgggttcaagcaattctcc

SEQ ID NO: 317900 - DNA, 20 bp, Artificial
  CRISPR gRNA sequence
aagcaattctcctgcctcag

SEQ ID NO: 317901 - DNA, 20 bp, Artificial
  CRISPR gRNA sequence
tcctgcctcagcctccagag

SEQ ID NO: 317902 - DNA, 20 bp, Artificial
  CRISPR gRNA sequence
ctgcctcagcctccagagta

SEQ ID NO: 317903 - DNA, 20 bp, Artificial
  CRISPR gRNA sequence
cctcagcctccagagtagct

SEQ ID NO: 317904 - DNA, 20 bp, Artificial
  CRISPR gRNA sequence
agcctccagagtagctggga

SEQ ID NO: 317905 - DNA, 20 bp, Artificial
  CRISPR gRNA sequence
cagagtagctgggattacag

SEQ ID NO: 317906 - DNA, 20 bp, Artificial
  CRISPR gRNA sequence
ggattacaggcatgcgccac

SEQ ID NO: 317907 - DNA, 20 bp, Artificial
  CRISPR gRNA sequence
caggcatgcgccaccatgcc

SEQ ID NO: 317908 - DNA, 20 bp, Artificial
  CRISPR gRNA sequence
gctaattttgtatttttaac

SEQ ID NO: 317909 - DNA, 20 bp, Artificial
  CRISPR gRNA sequence
attttgtatttttaaccttt

SEQ ID NO: 317910 - DNA, 20 bp, Artificial
  CRISPR gRNA sequence
tgtatttttaacctttgttc

SEQ ID NO: 317911 - DNA, 20 bp, Artificial
  CRISPR gRNA sequence
gtatttttaacctttgttct

SEQ ID NO: 317912 - DNA, 20 bp, Artificial
  CRISPR gRNA sequence
tatttttaacctttgttctt

SEQ ID NO: 317913 - DNA, 20 bp, Artificial
  CRISPR gRNA sequence
ttaacctttgttcttatttt

SEQ ID NO: 317914 - DNA, 20 bp, Artificial
  CRISPR gRNA sequence
taacctttgttcttattttt

SEQ ID NO: 317915 - DNA, 20 bp, Artificial
  CRISPR gRNA sequence
aacctttgttcttatttttc

SEQ ID NO: 317916 - DNA, 20 bp, Artificial
  CRISPR gRNA sequence
acctttgttcttatttttca

SEQ ID NO: 317917 - DNA, 20 bp, Artificial
  CRISPR gRNA sequence
tgttcttatttttcagaatt

SEQ ID NO: 317918 - DNA, 20 bp, Artificial
  CRISPR gRNA sequence
gttcttatttttcagaattg

SEQ ID NO: 317919 - DNA, 20 bp, Artificial
  CRISPR gRNA sequence
ttcttatttttcagaattgt

SEQ ID NO: 317920 - DNA, 20 bp, Artificial
  CRISPR gRNA sequence
ttatttttcagaattgtttt

SEQ ID NO: 317921 - DNA, 20 bp, Artificial
  CRISPR gRNA sequence
atttttcagaattgttttgg

SEQ ID NO: 317922 - DNA, 20 bp, Artificial
  CRISPR gRNA sequence
tttttcagaattgttttggc

SEQ ID NO: 317923 - DNA, 20 bp, Artificial
  CRISPR gRNA sequence
ttcagaattgttttggcaat

SEQ ID NO: 317924 - DNA, 20 bp, Artificial
  CRISPR gRNA sequence
tcagaattgttttggcaatt

SEQ ID NO: 317925 - DNA, 20 bp, Artificial
  CRISPR gRNA sequence
cagaattgttttggcaattg

SEQ ID NO: 317926 - DNA, 20 bp, Artificial
  CRISPR gRNA sequence
agaattgttttggcaattgt

SEQ ID NO: 317927 - DNA, 20 bp, Artificial
  CRISPR gRNA sequence
ttttggcaattgtagattct

SEQ ID NO: 317928 - DNA, 20 bp, Artificial
  CRISPR gRNA sequence
tggcaattgtagattctttg

SEQ ID NO: 317929 - DNA, 20 bp, Artificial
  CRISPR gRNA sequence
ggcaattgtagattctttgc

SEQ ID NO: 317930 - DNA, 20 bp, Artificial
  CRISPR gRNA sequence
gcaattgtagattctttgca

SEQ ID NO: 317931 - DNA, 20 bp, Artificial
  CRISPR gRNA sequence
tagattctttgcatttccct

SEQ ID NO: 317932 - DNA, 20 bp, Artificial
  CRISPR gRNA sequence
tttgcatttccctataactt

SEQ ID NO: 317933 - DNA, 20 bp, Artificial
  CRISPR gRNA sequence
tgcatttccctataactttt

SEQ ID NO: 317934 - DNA, 20 bp, Artificial
  CRISPR gRNA sequence
gcatttccctataacttttc

SEQ ID NO: 317935 - DNA, 20 bp, Artificial
  CRISPR gRNA sequence
catttccctataacttttcg

SEQ ID NO: 317936 - DNA, 20 bp, Artificial
  CRISPR gRNA sequence
ccctataacttttcgagtaa

SEQ ID NO: 317937 - DNA, 20 bp, Artificial
  CRISPR gRNA sequence
cctataacttttcgagtaag

SEQ ID NO: 317938 - DNA, 20 bp, Artificial
  CRISPR gRNA sequence
taacttttcgagtaagattt

SEQ ID NO: 317939 - DNA, 20 bp, Artificial
  CRISPR gRNA sequence
ttcgagtaagatttttagta

SEQ ID NO: 317940 - DNA, 20 bp, Artificial
  CRISPR gRNA sequence
tcgagtaagatttttagtat

SEQ ID NO: 317941 - DNA, 20 bp, Artificial
  CRISPR gRNA sequence
cgagtaagatttttagtatc

SEQ ID NO: 317942 - DNA, 20 bp, Artificial
  CRISPR gRNA sequence
gagtaagatttttagtatct

SEQ ID NO: 317943 - DNA, 20 bp, Artificial
  CRISPR gRNA sequence
ttagtatctattagagagct

SEQ ID NO: 317944 - DNA, 20 bp, Artificial
  CRISPR gRNA sequence
tagtatctattagagagctt

SEQ ID NO: 317945 - DNA, 20 bp, Artificial
  CRISPR gRNA sequence
agtatctattagagagctta

SEQ ID NO: 317946 - DNA, 20 bp, Artificial
  CRISPR gRNA sequence
gtatctattagagagcttac

SEQ ID NO: 317947 - DNA, 20 bp, Artificial
  CRISPR gRNA sequence
ttagagagcttaccaggatt

SEQ ID NO: 317948 - DNA, 20 bp, Artificial
  CRISPR gRNA sequence
gagagcttaccaggattttg

SEQ ID NO: 317949 - DNA, 20 bp, Artificial
  CRISPR gRNA sequence
accaggattttgattgtgat

SEQ ID NO: 317950 - DNA, 20 bp, Artificial
  CRISPR gRNA sequence
ccaggattttgattgtgatt

SEQ ID NO: 317951 - DNA, 20 bp, Artificial
  CRISPR gRNA sequence
tgattgtgattacatttaat

SEQ ID NO: 317952 - DNA, 20 bp, Artificial
  CRISPR gRNA sequence
gattgtgattacatttaatc

SEQ ID NO: 317953 - DNA, 20 bp, Artificial
  CRISPR gRNA sequence
attgtgattacatttaatcc

SEQ ID NO: 317954 - DNA, 20 bp, Artificial
  CRISPR gRNA sequence
tgattacatttaatccatag

SEQ ID NO: 317955 - DNA, 20 bp, Artificial
  CRISPR gRNA sequence
catttaatccatagatcaac

SEQ ID NO: 317956 - DNA, 20 bp, Artificial
  CRISPR gRNA sequence
aatccatagatcaacttgga

SEQ ID NO: 317957 - DNA, 20 bp, Artificial
  CRISPR gRNA sequence
atccatagatcaacttggag

SEQ ID NO: 317958 - DNA, 20 bp, Artificial
  CRISPR gRNA sequence
ggagagaatggttatcttaa

SEQ ID NO: 317959 - DNA, 20 bp, Artificial
  CRISPR gRNA sequence
gagagaatggttatcttaac

SEQ ID NO: 317960 - DNA, 20 bp, Artificial
  CRISPR gRNA sequence
tcttaacatctagtcttctg

SEQ ID NO: 317961 - DNA, 20 bp, Artificial
  CRISPR gRNA sequence
aacatctagtcttctgattc

SEQ ID NO: 317962 - DNA, 20 bp, Artificial
  CRISPR gRNA sequence
acatctagtcttctgattca

SEQ ID NO: 317963 - DNA, 20 bp, Artificial
  CRISPR gRNA sequence
gtcttctgattcataaacat

SEQ ID NO: 317964 - DNA, 20 bp, Artificial
  CRISPR gRNA sequence
ctgattcataaacatggcct

SEQ ID NO: 317965 - DNA, 20 bp, Artificial
  CRISPR gRNA sequence
tgattcataaacatggccta

SEQ ID NO: 317966 - DNA, 20 bp, Artificial
  CRISPR gRNA sequence
attcataaacatggcctatg

SEQ ID NO: 317967 - DNA, 20 bp, Artificial
  CRISPR gRNA sequence
ataaacatggcctatgtctc

SEQ ID NO: 317968 - DNA, 20 bp, Artificial
  CRISPR gRNA sequence
tgtctccatttattttggtt

SEQ ID NO: 317969 - DNA, 20 bp, Artificial
  CRISPR gRNA sequence
catttattttggtttacttt

SEQ ID NO: 317970 - DNA, 20 bp, Artificial
  CRISPR gRNA sequence
attttggtttactttaattt

SEQ ID NO: 317971 - DNA, 20 bp, Artificial
  CRISPR gRNA sequence
ttttggtttactttaatttc

SEQ ID NO: 317972 - DNA, 20 bp, Artificial
  CRISPR gRNA sequence
tggtttactttaatttctcc

SEQ ID NO: 317973 - DNA, 20 bp, Artificial
  CRISPR gRNA sequence
ggtttactttaatttctcca

SEQ ID NO: 317974 - DNA, 20 bp, Artificial
  CRISPR gRNA sequence
gtttactttaatttctccag

SEQ ID NO: 317975 - DNA, 20 bp, Artificial
  CRISPR gRNA sequence
actttaatttctccagtagt

SEQ ID NO: 317976 - DNA, 20 bp, Artificial
  CRISPR gRNA sequence
ctttaatttctccagtagta

SEQ ID NO: 317977 - DNA, 20 bp, Artificial
  CRISPR gRNA sequence
taatttctccagtagtaata

SEQ ID NO: 317978 - DNA, 20 bp, Artificial
  CRISPR gRNA sequence
aatttctccagtagtaatat

SEQ ID NO: 317979 - DNA, 20 bp, Artificial
  CRISPR gRNA sequence
atttctccagtagtaatatt

SEQ ID NO: 317980 - DNA, 20 bp, Artificial
  CRISPR gRNA sequence
ctccagtagtaatattgtat

SEQ ID NO: 317981 - DNA, 20 bp, Artificial
  CRISPR gRNA sequence
tccagtagtaatattgtata

SEQ ID NO: 317982 - DNA, 20 bp, Artificial
  CRISPR gRNA sequence
cagtagtaatattgtatagt

SEQ ID NO: 317983 - DNA, 20 bp, Artificial
  CRISPR gRNA sequence
tatagttttcagtatataga

SEQ ID NO: 317984 - DNA, 20 bp, Artificial
  CRISPR gRNA sequence
tcagtatatagaccttgtac

SEQ ID NO: 317985 - DNA, 20 bp, Artificial
  CRISPR gRNA sequence
cagtatatagaccttgtact

SEQ ID NO: 317986 - DNA, 20 bp, Artificial
  CRISPR gRNA sequence
agtatatagaccttgtactt

SEQ ID NO: 317987 - DNA, 20 bp, Artificial
  CRISPR gRNA sequence
gtacttgttttgttaaattt

SEQ ID NO: 317988 - DNA, 20 bp, Artificial
  CRISPR gRNA sequence
tacttgttttgttaaattta

SEQ ID NO: 317989 - DNA, 20 bp, Artificial
  CRISPR gRNA sequence
gttttgttaaatttatttcc

SEQ ID NO: 317990 - DNA, 20 bp, Artificial
  CRISPR gRNA sequence
ttttgttaaatttatttcca

SEQ ID NO: 317991 - DNA, 20 bp, Artificial
  CRISPR gRNA sequence
tgttaaatttatttccaagt

SEQ ID NO: 317992 - DNA, 20 bp, Artificial
  CRISPR gRNA sequence
gttaaatttatttccaagtt

SEQ ID NO: 317993 - DNA, 20 bp, Artificial
  CRISPR gRNA sequence
ttaaatttatttccaagttt

SEQ ID NO: 317994 - DNA, 20 bp, Artificial
  CRISPR gRNA sequence
aatttatttccaagttttta

SEQ ID NO: 317995 - DNA, 20 bp, Artificial
  CRISPR gRNA sequence
atttccaagtttttaatatt

SEQ ID NO: 317996 - DNA, 20 bp, Artificial
  CRISPR gRNA sequence
tttccaagtttttaatatta

SEQ ID NO: 317997 - DNA, 20 bp, Artificial
  CRISPR gRNA sequence
ccaagtttttaatattattt

SEQ ID NO: 317998 - DNA, 20 bp, Artificial
  CRISPR gRNA sequence
caagtttttaatattatttg

SEQ ID NO: 317999 - DNA, 20 bp, Artificial
  CRISPR gRNA sequence
ttaatattatttgatgctat

SEQ ID NO: 318000 - DNA, 20 bp, Artificial
  CRISPR gRNA sequence
taatattatttgatgctatt

SEQ ID NO: 318001 - DNA, 20 bp, Artificial
  CRISPR gRNA sequence
aatattatttgatgctatta

SEQ ID NO: 318002 - DNA, 20 bp, Artificial
  CRISPR gRNA sequence
atattatttgatgctattat

SEQ ID NO: 318003 - DNA, 20 bp, Artificial
  CRISPR gRNA sequence
tttgatgctattataaatgc

SEQ ID NO: 318004 - DNA, 20 bp, Artificial
  CRISPR gRNA sequence
gatgctattataaatgctat

SEQ ID NO: 318005 - DNA, 20 bp, Artificial
  CRISPR gRNA sequence
atgctattataaatgctatt

SEQ ID NO: 318006 - DNA, 20 bp, Artificial
  CRISPR gRNA sequence
ttataaatgctattaatttt

SEQ ID NO: 318007 - DNA, 20 bp, Artificial
  CRISPR gRNA sequence
taaatgctattaattttttt

SEQ ID NO: 318008 - DNA, 20 bp, Artificial
  CRISPR gRNA sequence
ttaatttttttcaatgtaca

SEQ ID NO: 318009 - DNA, 20 bp, Artificial
  CRISPR gRNA sequence
atttttttcaatgtacaatt

SEQ ID NO: 318010 - DNA, 20 bp, Artificial
  CRISPR gRNA sequence
ttttcaatgtacaattgctt

SEQ ID NO: 318011 - DNA, 20 bp, Artificial
  CRISPR gRNA sequence
tttcaatgtacaattgcttt

SEQ ID NO: 318012 - DNA, 20 bp, Artificial
  CRISPR gRNA sequence
ttcaatgtacaattgctttt

SEQ ID NO: 318013 - DNA, 20 bp, Artificial
  CRISPR gRNA sequence
tcaatgtacaattgcttttg

SEQ ID NO: 318014 - DNA, 20 bp, Artificial
  CRISPR gRNA sequence
caatgtacaattgcttttgt

SEQ ID NO: 318015 - DNA, 20 bp, Artificial
  CRISPR gRNA sequence
aatgtacaattgcttttgtt

SEQ ID NO: 318016 - DNA, 20 bp, Artificial
  CRISPR gRNA sequence
cttttgttagtatatagaaa

SEQ ID NO: 318017 - DNA, 20 bp, Artificial
  CRISPR gRNA sequence
ttgttagtatatagaaataa

SEQ ID NO: 318018 - DNA, 20 bp, Artificial
  CRISPR gRNA sequence
tgttagtatatagaaataat

SEQ ID NO: 318019 - DNA, 20 bp, Artificial
  CRISPR gRNA sequence
gttagtatatagaaataatt

SEQ ID NO: 318020 - DNA, 20 bp, Artificial
  CRISPR gRNA sequence
ttagtatatagaaataattg

SEQ ID NO: 318021 - DNA, 20 bp, Artificial
  CRISPR gRNA sequence
gtatatagaaataattgatt

SEQ ID NO: 318022 - DNA, 20 bp, Artificial
  CRISPR gRNA sequence
attttgtgtattgactttgt

SEQ ID NO: 318023 - DNA, 20 bp, Artificial
  CRISPR gRNA sequence
tgtgtattgactttgtatcc

SEQ ID NO: 318024 - DNA, 20 bp, Artificial
  CRISPR gRNA sequence
gtgtattgactttgtatcct

SEQ ID NO: 318025 - DNA, 20 bp, Artificial
  CRISPR gRNA sequence
tgtattgactttgtatcctg

SEQ ID NO: 318026 - DNA, 20 bp, Artificial
  CRISPR gRNA sequence
actttgtatcctgtgtcttt

SEQ ID NO: 318027 - DNA, 20 bp, Artificial
  CRISPR gRNA sequence
tgtatcctgtgtctttgcta

SEQ ID NO: 318028 - DNA, 20 bp, Artificial
  CRISPR gRNA sequence
gtatcctgtgtctttgctac

SEQ ID NO: 318029 - DNA, 20 bp, Artificial
  CRISPR gRNA sequence
tatcctgtgtctttgctaca

SEQ ID NO: 318030 - DNA, 20 bp, Artificial
  CRISPR gRNA sequence
tgtctttgctacactcactt

SEQ ID NO: 318031 - DNA, 20 bp, Artificial
  CRISPR gRNA sequence
tgctacactcacttatcagt

SEQ ID NO: 318032 - DNA, 20 bp, Artificial
  CRISPR gRNA sequence
gctacactcacttatcagtt

SEQ ID NO: 318033 - DNA, 20 bp, Artificial
  CRISPR gRNA sequence
ctacactcacttatcagttt

SEQ ID NO: 318034 - DNA, 20 bp, Artificial
  CRISPR gRNA sequence
cactcacttatcagttttaa

SEQ ID NO: 318035 - DNA, 20 bp, Artificial
  CRISPR gRNA sequence
acttatcagttttaataggt

SEQ ID NO: 318036 - DNA, 20 bp, Artificial
  CRISPR gRNA sequence
atcagttttaataggttttt

SEQ ID NO: 318037 - DNA, 20 bp, Artificial
  CRISPR gRNA sequence
tcagttttaataggtttttg

SEQ ID NO: 318038 - DNA, 20 bp, Artificial
  CRISPR gRNA sequence
taataggtttttgatagatt

SEQ ID NO: 318039 - DNA, 20 bp, Artificial
  CRISPR gRNA sequence
aataggtttttgatagattc

SEQ ID NO: 318040 - DNA, 20 bp, Artificial
  CRISPR gRNA sequence
ataggtttttgatagattcc

SEQ ID NO: 318041 - DNA, 20 bp, Artificial
  CRISPR gRNA sequence
ttgatagattcctcaggatt

SEQ ID NO: 318042 - DNA, 20 bp, Artificial
  CRISPR gRNA sequence
tgatagattcctcaggattt

SEQ ID NO: 318043 - DNA, 20 bp, Artificial
  CRISPR gRNA sequence
gatagattcctcaggatttt

SEQ ID NO: 318044 - DNA, 20 bp, Artificial
  CRISPR gRNA sequence
atagattcctcaggattttc

SEQ ID NO: 318045 - DNA, 20 bp, Artificial
  CRISPR gRNA sequence
ctcaggattttctacaagca

SEQ ID NO: 318046 - DNA, 20 bp, Artificial
  CRISPR gRNA sequence
aggattttctacaagcatga

SEQ ID NO: 318047 - DNA, 20 bp, Artificial
  CRISPR gRNA sequence
tctacaagcatgatcattat

SEQ ID NO: 318048 - DNA, 20 bp, Artificial
  CRISPR gRNA sequence
ctacaagcatgatcattatc

SEQ ID NO: 318049 - DNA, 20 bp, Artificial
  CRISPR gRNA sequence
tacaagcatgatcattatct

SEQ ID NO: 318050 - DNA, 20 bp, Artificial
  CRISPR gRNA sequence
caagcatgatcattatctgt

SEQ ID NO: 318051 - DNA, 20 bp, Artificial
  CRISPR gRNA sequence
tctgtgaaaaaagacagttt

SEQ ID NO: 318052 - DNA, 20 bp, Artificial
  CRISPR gRNA sequence
tgaaaaaagacagttttact

SEQ ID NO: 318053 - DNA, 20 bp, Artificial
  CRISPR gRNA sequence
tacttcctttccaatctgta

SEQ ID NO: 318054 - DNA, 20 bp, Artificial
  CRISPR gRNA sequence
acttcctttccaatctgtat

SEQ ID NO: 318055 - DNA, 20 bp, Artificial
  CRISPR gRNA sequence
cttcctttccaatctgtatg

SEQ ID NO: 318056 - DNA, 20 bp, Artificial
  CRISPR gRNA sequence
cctttccaatctgtatgtct

SEQ ID NO: 318057 - DNA, 20 bp, Artificial
  CRISPR gRNA sequence
ctttccaatctgtatgtctt

SEQ ID NO: 318058 - DNA, 20 bp, Artificial
  CRISPR gRNA sequence
tccaatctgtatgtctttta

SEQ ID NO: 318059 - DNA, 20 bp, Artificial
  CRISPR gRNA sequence
ccaatctgtatgtcttttat

SEQ ID NO: 318060 - DNA, 20 bp, Artificial
  CRISPR gRNA sequence
caatctgtatgtcttttatt

SEQ ID NO: 318061 - DNA, 20 bp, Artificial
  CRISPR gRNA sequence
tatgtcttttatttcttttt

SEQ ID NO: 318062 - DNA, 20 bp, Artificial
  CRISPR gRNA sequence
ttatttctttttctagtctt

SEQ ID NO: 318063 - DNA, 20 bp, Artificial
  CRISPR gRNA sequence
tatttctttttctagtcttg

SEQ ID NO: 318064 - DNA, 20 bp, Artificial
  CRISPR gRNA sequence
atttctttttctagtcttgt

SEQ ID NO: 318065 - DNA, 20 bp, Artificial
  CRISPR gRNA sequence
tttctttttctagtcttgtt

SEQ ID NO: 318066 - DNA, 20 bp, Artificial
  CRISPR gRNA sequence
ctttttctagtcttgtttct

SEQ ID NO: 318067 - DNA, 20 bp, Artificial
  CRISPR gRNA sequence
tttttctagtcttgtttctc

SEQ ID NO: 318068 - DNA, 20 bp, Artificial
  CRISPR gRNA sequence
tttctagtcttgtttctctg

SEQ ID NO: 318069 - DNA, 20 bp, Artificial
  CRISPR gRNA sequence
ttctagtcttgtttctctgg

SEQ ID NO: 318070 - DNA, 20 bp, Artificial
  CRISPR gRNA sequence
tctagtcttgtttctctggc

SEQ ID NO: 318071 - DNA, 20 bp, Artificial
  CRISPR gRNA sequence
ctagtcttgtttctctggct

SEQ ID NO: 318072 - DNA, 20 bp, Artificial
  CRISPR gRNA sequence
tagtcttgtttctctggcta

SEQ ID NO: 318073 - DNA, 20 bp, Artificial
  CRISPR gRNA sequence
gtcttgtttctctggctatg

SEQ ID NO: 318074 - DNA, 20 bp, Artificial
  CRISPR gRNA sequence
gtttctctggctatgacctc

SEQ ID NO: 318075 - DNA, 20 bp, Artificial
  CRISPR gRNA sequence
tttctctggctatgacctcc

SEQ ID NO: 318076 - DNA, 20 bp, Artificial
  CRISPR gRNA sequence
ctctggctatgacctccagt

SEQ ID NO: 318077 - DNA, 20 bp, Artificial
  CRISPR gRNA sequence
tctggctatgacctccagta

SEQ ID NO: 318078 - DNA, 20 bp, Artificial
  CRISPR gRNA sequence
tggctatgacctccagtaca

SEQ ID NO: 318079 - DNA, 20 bp, Artificial
  CRISPR gRNA sequence
gctatgacctccagtacaat

SEQ ID NO: 318080 - DNA, 20 bp, Artificial
  CRISPR gRNA sequence
tgacctccagtacaatgtgg

SEQ ID NO: 318081 - DNA, 20 bp, Artificial
  CRISPR gRNA sequence
cagtacaatgtggaacaaaa

SEQ ID NO: 318082 - DNA, 20 bp, Artificial
  CRISPR gRNA sequence
cccacattcgccatcttaag

SEQ ID NO: 318083 - DNA, 20 bp, Artificial
  CRISPR gRNA sequence
gccatcttaaggtaaaagca

SEQ ID NO: 318084 - DNA, 20 bp, Artificial
  CRISPR gRNA sequence
aaggtaaaagcaatcagtct

SEQ ID NO: 318085 - DNA, 20 bp, Artificial
  CRISPR gRNA sequence
aggtaaaagcaatcagtctt

SEQ ID NO: 318086 - DNA, 20 bp, Artificial
  CRISPR gRNA sequence
ctatcatgaaatattatgct

SEQ ID NO: 318087 - DNA, 20 bp, Artificial
  CRISPR gRNA sequence
tatcatgaaatattatgcta

SEQ ID NO: 318088 - DNA, 20 bp, Artificial
  CRISPR gRNA sequence
tcatgaaatattatgctaac

SEQ ID NO: 318089 - DNA, 20 bp, Artificial
  CRISPR gRNA sequence
tgctaacagaagaatttttg

SEQ ID NO: 318090 - DNA, 20 bp, Artificial
  CRISPR gRNA sequence
acagaagaatttttggtaga

SEQ ID NO: 318091 - DNA, 20 bp, Artificial
  CRISPR gRNA sequence
ttggtagatgtcctttgtca

SEQ ID NO: 318092 - DNA, 20 bp, Artificial
  CRISPR gRNA sequence
tggtagatgtcctttgtcag

SEQ ID NO: 318093 - DNA, 20 bp, Artificial
  CRISPR gRNA sequence
ggtagatgtcctttgtcagg

SEQ ID NO: 318094 - DNA, 20 bp, Artificial
  CRISPR gRNA sequence
gtagatgtcctttgtcaggt

SEQ ID NO: 318095 - DNA, 20 bp, Artificial
  CRISPR gRNA sequence
tgtcaggttgaggaagtcat

SEQ ID NO: 318096 - DNA, 20 bp, Artificial
  CRISPR gRNA sequence
gtcaggttgaggaagtcatc

SEQ ID NO: 318097 - DNA, 20 bp, Artificial
  CRISPR gRNA sequence
tcaggttgaggaagtcatct

SEQ ID NO: 318098 - DNA, 20 bp, Artificial
  CRISPR gRNA sequence
aggaagtcatcttgtattcc

SEQ ID NO: 318099 - DNA, 20 bp, Artificial
  CRISPR gRNA sequence
gtattcctatttttatgaga

SEQ ID NO: 318100 - DNA, 20 bp, Artificial
  CRISPR gRNA sequence
tattcctatttttatgagag

SEQ ID NO: 318101 - DNA, 20 bp, Artificial
  CRISPR gRNA sequence
ctatttttatgagagctttt

SEQ ID NO: 318102 - DNA, 20 bp, Artificial
  CRISPR gRNA sequence
tttttatgagagcttttctt

SEQ ID NO: 318103 - DNA, 20 bp, Artificial
  CRISPR gRNA sequence
ttatgagagcttttctttcc

SEQ ID NO: 318104 - DNA, 20 bp, Artificial
  CRISPR gRNA sequence
tatgagagcttttctttcca

SEQ ID NO: 318105 - DNA, 20 bp, Artificial
  CRISPR gRNA sequence
atgagagcttttctttccat

SEQ ID NO: 318106 - DNA, 20 bp, Artificial
  CRISPR gRNA sequence
tgagagcttttctttccatt

SEQ ID NO: 318107 - DNA, 20 bp, Artificial
  CRISPR gRNA sequence
ttctttccatttaaaactat

SEQ ID NO: 318108 - DNA, 20 bp, Artificial
  CRISPR gRNA sequence
tctttccatttaaaactatg

SEQ ID NO: 318109 - DNA, 20 bp, Artificial
  CRISPR gRNA sequence
ctttccatttaaaactatga

SEQ ID NO: 318110 - DNA, 20 bp, Artificial
  CRISPR gRNA sequence
tttccatttaaaactatgaa

SEQ ID NO: 318111 - DNA, 20 bp, Artificial
  CRISPR gRNA sequence
tccatttaaaactatgaatg

SEQ ID NO: 318112 - DNA, 20 bp, Artificial
  CRISPR gRNA sequence
ccatttaaaactatgaatgg

SEQ ID NO: 318113 - DNA, 20 bp, Artificial
  CRISPR gRNA sequence
catttaaaactatgaatggg

SEQ ID NO: 318114 - DNA, 20 bp, Artificial
  CRISPR gRNA sequence
aaaactatgaatgggtatta

SEQ ID NO: 318115 - DNA, 20 bp, Artificial
  CRISPR gRNA sequence
aaactatgaatgggtattaa

SEQ ID NO: 318116 - DNA, 20 bp, Artificial
  CRISPR gRNA sequence
tgaatgggtattaattttgt

SEQ ID NO: 318117 - DNA, 20 bp, Artificial
  CRISPR gRNA sequence
attttgtcaaaagtttttcc

SEQ ID NO: 318118 - DNA, 20 bp, Artificial
  CRISPR gRNA sequence
tgtcaaaagtttttcctgta

SEQ ID NO: 318119 - DNA, 20 bp, Artificial
  CRISPR gRNA sequence
gtcaaaagtttttcctgtat

SEQ ID NO: 318120 - DNA, 20 bp, Artificial
  CRISPR gRNA sequence
tcaaaagtttttcctgtatc

SEQ ID NO: 318121 - DNA, 20 bp, Artificial
  CRISPR gRNA sequence
ttcctgtatccattgacatg

SEQ ID NO: 318122 - DNA, 20 bp, Artificial
  CRISPR gRNA sequence
tcctgtatccattgacatga

SEQ ID NO: 318123 - DNA, 20 bp, Artificial
  CRISPR gRNA sequence
cctgtatccattgacatgat

SEQ ID NO: 318124 - DNA, 20 bp, Artificial
  CRISPR gRNA sequence
ctgtatccattgacatgatc

SEQ ID NO: 318125 - DNA, 20 bp, Artificial
  CRISPR gRNA sequence
tatccattgacatgatcata

SEQ ID NO: 318126 - DNA, 20 bp, Artificial
  CRISPR gRNA sequence
acatgatcatatgttttttt

SEQ ID NO: 318127 - DNA, 20 bp, Artificial
  CRISPR gRNA sequence
ttttctttttagtttattta

SEQ ID NO: 318128 - DNA, 20 bp, Artificial
  CRISPR gRNA sequence
tttctttttagtttatttat

SEQ ID NO: 318129 - DNA, 20 bp, Artificial
  CRISPR gRNA sequence
ttctttttagtttatttatg

SEQ ID NO: 318130 - DNA, 20 bp, Artificial
  CRISPR gRNA sequence
tctttttagtttatttatgt

SEQ ID NO: 318131 - DNA, 20 bp, Artificial
  CRISPR gRNA sequence
ctttttagtttatttatgta

SEQ ID NO: 318132 - DNA, 20 bp, Artificial
  CRISPR gRNA sequence
tttttagtttatttatgtag

SEQ ID NO: 318133 - DNA, 20 bp, Artificial
  CRISPR gRNA sequence
tttagtttatttatgtagta

SEQ ID NO: 318134 - DNA, 20 bp, Artificial
  CRISPR gRNA sequence
ttagtttatttatgtagtaa

SEQ ID NO: 318135 - DNA, 20 bp, Artificial
  CRISPR gRNA sequence
tagtttatttatgtagtaaa

SEQ ID NO: 318136 - DNA, 20 bp, Artificial
  CRISPR gRNA sequence
agtttatttatgtagtaaag

SEQ ID NO: 318137 - DNA, 20 bp, Artificial
  CRISPR gRNA sequence
gtttatttatgtagtaaagg

SEQ ID NO: 318138 - DNA, 20 bp, Artificial
  CRISPR gRNA sequence
atttatgtagtaaaggttat

SEQ ID NO: 318139 - DNA, 20 bp, Artificial
  CRISPR gRNA sequence
tttatgtagtaaaggttatt

SEQ ID NO: 318140 - DNA, 20 bp, Artificial
  CRISPR gRNA sequence
atgtagtaaaggttattgcc

SEQ ID NO: 318141 - DNA, 20 bp, Artificial
  CRISPR gRNA sequence
tgtagtaaaggttattgcct

SEQ ID NO: 318142 - DNA, 20 bp, Artificial
  CRISPR gRNA sequence
ttgcctgatttttgaatgtt

SEQ ID NO: 318143 - DNA, 20 bp, Artificial
  CRISPR gRNA sequence
cctgatttttgaatgttgag

SEQ ID NO: 318144 - DNA, 20 bp, Artificial
  CRISPR gRNA sequence
atttttgaatgttgagctta

SEQ ID NO: 318145 - DNA, 20 bp, Artificial
  CRISPR gRNA sequence
ttgaatgttgagcttacctg

SEQ ID NO: 318146 - DNA, 20 bp, Artificial
  CRISPR gRNA sequence
tgaatgttgagcttacctgt

SEQ ID NO: 318147 - DNA, 20 bp, Artificial
  CRISPR gRNA sequence
gaatgttgagcttacctgtg

SEQ ID NO: 318148 - DNA, 20 bp, Artificial
  CRISPR gRNA sequence
aatgttgagcttacctgtgt

SEQ ID NO: 318149 - DNA, 20 bp, Artificial
  CRISPR gRNA sequence
agcttacctgtgtttcttga

SEQ ID NO: 318150 - DNA, 20 bp, Artificial
  CRISPR gRNA sequence
acctgtgtttcttgaataaa

SEQ ID NO: 318151 - DNA, 20 bp, Artificial
  CRISPR gRNA sequence
cctgtgtttcttgaataaac

SEQ ID NO: 318152 - DNA, 20 bp, Artificial
  CRISPR gRNA sequence
tgtttcttgaataaacccca

SEQ ID NO: 318153 - DNA, 20 bp, Artificial
  CRISPR gRNA sequence
cttgaataaaccccacttga

SEQ ID NO: 318154 - DNA, 20 bp, Artificial
  CRISPR gRNA sequence
ttgaataaaccccacttgat

SEQ ID NO: 318155 - DNA, 20 bp, Artificial
  CRISPR gRNA sequence
gaataaaccccacttgatca

SEQ ID NO: 318156 - DNA, 20 bp, Artificial
  CRISPR gRNA sequence
aataaaccccacttgatcat

SEQ ID NO: 318157 - DNA, 20 bp, Artificial
  CRISPR gRNA sequence
gatcatgatgtattatactt

SEQ ID NO: 318158 - DNA, 20 bp, Artificial
  CRISPR gRNA sequence
atcatgatgtattatacttt

SEQ ID NO: 318159 - DNA, 20 bp, Artificial
  CRISPR gRNA sequence
tacttttaacatattgctag

SEQ ID NO: 318160 - DNA, 20 bp, Artificial
  CRISPR gRNA sequence
ttaacatattgctagatttt

SEQ ID NO: 318161 - DNA, 20 bp, Artificial
  CRISPR gRNA sequence
taacatattgctagatttta

SEQ ID NO: 318162 - DNA, 20 bp, Artificial
  CRISPR gRNA sequence
aacatattgctagattttag

SEQ ID NO: 318163 - DNA, 20 bp, Artificial
  CRISPR gRNA sequence
acatattgctagattttagt

SEQ ID NO: 318164 - DNA, 20 bp, Artificial
  CRISPR gRNA sequence
ctagattttagttgctaatt

SEQ ID NO: 318165 - DNA, 20 bp, Artificial
  CRISPR gRNA sequence
gattttagttgctaattttg

SEQ ID NO: 318166 - DNA, 20 bp, Artificial
  CRISPR gRNA sequence
tagttgctaattttgttaag

SEQ ID NO: 318167 - DNA, 20 bp, Artificial
  CRISPR gRNA sequence
agttgctaattttgttaagc

SEQ ID NO: 318168 - DNA, 20 bp, Artificial
  CRISPR gRNA sequence
gttgctaattttgttaagca

SEQ ID NO: 318169 - DNA, 20 bp, Artificial
  CRISPR gRNA sequence
ctaattttgttaagcatttc

SEQ ID NO: 318170 - DNA, 20 bp, Artificial
  CRISPR gRNA sequence
attttgttaagcatttcacg

SEQ ID NO: 318171 - DNA, 20 bp, Artificial
  CRISPR gRNA sequence
tgttaagcatttcacgagag

SEQ ID NO: 318172 - DNA, 20 bp, Artificial
  CRISPR gRNA sequence
gttaagcatttcacgagaga

SEQ ID NO: 318173 - DNA, 20 bp, Artificial
  CRISPR gRNA sequence
ttaagcatttcacgagagat

SEQ ID NO: 318174 - DNA, 20 bp, Artificial
  CRISPR gRNA sequence
agcatttcacgagagatgtt

SEQ ID NO: 318175 - DNA, 20 bp, Artificial
  CRISPR gRNA sequence
cacgagagatgtttgtagtt

SEQ ID NO: 318176 - DNA, 20 bp, Artificial
  CRISPR gRNA sequence
acgagagatgtttgtagttt

SEQ ID NO: 318177 - DNA, 20 bp, Artificial
  CRISPR gRNA sequence
gtagttttcttttcttgcaa

SEQ ID NO: 318178 - DNA, 20 bp, Artificial
  CRISPR gRNA sequence
tagttttcttttcttgcaat

SEQ ID NO: 318179 - DNA, 20 bp, Artificial
  CRISPR gRNA sequence
tcttttcttgcaatgtcttt

SEQ ID NO: 318180 - DNA, 20 bp, Artificial
  CRISPR gRNA sequence
cttttcttgcaatgtctttt

SEQ ID NO: 318181 - DNA, 20 bp, Artificial
  CRISPR gRNA sequence
ttttcttgcaatgtcttttc

SEQ ID NO: 318182 - DNA, 20 bp, Artificial
  CRISPR gRNA sequence
ttcttgcaatgtcttttcct

SEQ ID NO: 318183 - DNA, 20 bp, Artificial
  CRISPR gRNA sequence
tcttgcaatgtcttttccta

SEQ ID NO: 318184 - DNA, 20 bp, Artificial
  CRISPR gRNA sequence
cttgcaatgtcttttcctag

SEQ ID NO: 318185 - DNA, 20 bp, Artificial
  CRISPR gRNA sequence
ttgcaatgtcttttcctagt

SEQ ID NO: 318186 - DNA, 20 bp, Artificial
  CRISPR gRNA sequence
gcaatgtcttttcctagttc

SEQ ID NO: 318187 - DNA, 20 bp, Artificial
  CRISPR gRNA sequence
caatgtcttttcctagttca

SEQ ID NO: 318188 - DNA, 20 bp, Artificial
  CRISPR gRNA sequence
ttcctagttcagtatcaggg

SEQ ID NO: 318189 - DNA, 20 bp, Artificial
  CRISPR gRNA sequence
tcctagttcagtatcagggc

SEQ ID NO: 318190 - DNA, 20 bp, Artificial
  CRISPR gRNA sequence
cctagttcagtatcagggct

SEQ ID NO: 318191 - DNA, 20 bp, Artificial
  CRISPR gRNA sequence
ctagttcagtatcagggctc

SEQ ID NO: 318192 - DNA, 20 bp, Artificial
  CRISPR gRNA sequence
gttcagtatcagggctcccc

SEQ ID NO: 318193 - DNA, 20 bp, Artificial
  CRISPR gRNA sequence
agtatcagggctcccctgcc

SEQ ID NO: 318194 - DNA, 20 bp, Artificial
  CRISPR gRNA sequence
ccctgccttcagaggggcct

SEQ ID NO: 318195 - DNA, 20 bp, Artificial
  CRISPR gRNA sequence
ccttcagaggggcctggaca

SEQ ID NO: 318196 - DNA, 20 bp, Artificial
  CRISPR gRNA sequence
cagaggggcctggacactgg

SEQ ID NO: 318197 - DNA, 20 bp, Artificial
  CRISPR gRNA sequence
agaggggcctggacactggc

SEQ ID NO: 318198 - DNA, 20 bp, Artificial
  CRISPR gRNA sequence
gacactggctccaggcagca

SEQ ID NO: 318199 - DNA, 20 bp, Artificial
  CRISPR gRNA sequence
gctccaggcagcaaactaga

SEQ ID NO: 318200 - DNA, 20 bp, Artificial
  CRISPR gRNA sequence
caggcagcaaactagagcaa

SEQ ID NO: 318201 - DNA, 20 bp, Artificial
  CRISPR gRNA sequence
gagcaatcatagggcttatc

SEQ ID NO: 318202 - DNA, 20 bp, Artificial
  CRISPR gRNA sequence
atctcattttttctttcctt

SEQ ID NO: 318203 - DNA, 20 bp, Artificial
  CRISPR gRNA sequence
tctcattttttctttccttc

SEQ ID NO: 318204 - DNA, 20 bp, Artificial
  CRISPR gRNA sequence
attttttctttccttcactc

SEQ ID NO: 318205 - DNA, 20 bp, Artificial
  CRISPR gRNA sequence
tttctttccttcactcaggg

SEQ ID NO: 318206 - DNA, 20 bp, Artificial
  CRISPR gRNA sequence
ttctttccttcactcaggga

SEQ ID NO: 318207 - DNA, 20 bp, Artificial
  CRISPR gRNA sequence
tctttccttcactcagggac

SEQ ID NO: 318208 - DNA, 20 bp, Artificial
  CRISPR gRNA sequence
ctttccttcactcagggact

SEQ ID NO: 318209 - DNA, 20 bp, Artificial
  CRISPR gRNA sequence
tttccttcactcagggacta

SEQ ID NO: 318210 - DNA, 20 bp, Artificial
  CRISPR gRNA sequence
tccttcactcagggactaca

SEQ ID NO: 318211 - DNA, 20 bp, Artificial
  CRISPR gRNA sequence
ccttcactcagggactacag

SEQ ID NO: 318212 - DNA, 20 bp, Artificial
  CRISPR gRNA sequence
cttcactcagggactacagt

SEQ ID NO: 318213 - DNA, 20 bp, Artificial
  CRISPR gRNA sequence
cactcagggactacagtttt

SEQ ID NO: 318214 - DNA, 20 bp, Artificial
  CRISPR gRNA sequence
actcagggactacagttttc

SEQ ID NO: 318215 - DNA, 20 bp, Artificial
  CRISPR gRNA sequence
agggactacagttttctgct

SEQ ID NO: 318216 - DNA, 20 bp, Artificial
  CRISPR gRNA sequence
cagttttctgctgtctgtca

SEQ ID NO: 318217 - DNA, 20 bp, Artificial
  CRISPR gRNA sequence
tctgctgtctgtcatccgat

SEQ ID NO: 318218 - DNA, 20 bp, Artificial
  CRISPR gRNA sequence
ctgctgtctgtcatccgatc

SEQ ID NO: 318219 - DNA, 20 bp, Artificial
  CRISPR gRNA sequence
tgctgtctgtcatccgatct

SEQ ID NO: 318220 - DNA, 20 bp, Artificial
  CRISPR gRNA sequence
ctgtctgtcatccgatctct

SEQ ID NO: 318221 - DNA, 20 bp, Artificial
  CRISPR gRNA sequence
tctgtcatccgatctctgaa

SEQ ID NO: 318222 - DNA, 20 bp, Artificial
  CRISPR gRNA sequence
tcatccgatctctgaaaaca

SEQ ID NO: 318223 - DNA, 20 bp, Artificial
  CRISPR gRNA sequence
tgaaaacagttgtttcatat

SEQ ID NO: 318224 - DNA, 20 bp, Artificial
  CRISPR gRNA sequence
aaaacagttgtttcatatat

SEQ ID NO: 318225 - DNA, 20 bp, Artificial
  CRISPR gRNA sequence
tttcatatattttgtctgct

SEQ ID NO: 318226 - DNA, 20 bp, Artificial
  CRISPR gRNA sequence
catatattttgtctgctttc

SEQ ID NO: 318227 - DNA, 20 bp, Artificial
  CRISPR gRNA sequence
atatattttgtctgctttct

SEQ ID NO: 318228 - DNA, 20 bp, Artificial
  CRISPR gRNA sequence
tgtctgctttctagttgttt

SEQ ID NO: 318229 - DNA, 20 bp, Artificial
  CRISPR gRNA sequence
gtctgctttctagttgttta

SEQ ID NO: 318230 - DNA, 20 bp, Artificial
  CRISPR gRNA sequence
tctgctttctagttgtttat

SEQ ID NO: 318231 - DNA, 20 bp, Artificial
  CRISPR gRNA sequence
ctttctagttgtttatggaa

SEQ ID NO: 318232 - DNA, 20 bp, Artificial
  CRISPR gRNA sequence
tctagttgtttatggaaaga

SEQ ID NO: 318233 - DNA, 20 bp, Artificial
  CRISPR gRNA sequence
ctagttgtttatggaaagag

SEQ ID NO: 318234 - DNA, 20 bp, Artificial
  CRISPR gRNA sequence
tagttgtttatggaaagagg

SEQ ID NO: 318235 - DNA, 20 bp, Artificial
  CRISPR gRNA sequence
gttgtttatggaaagagggc

SEQ ID NO: 318236 - DNA, 20 bp, Artificial
  CRISPR gRNA sequence
tttatggaaagagggcaatt

SEQ ID NO: 318237 - DNA, 20 bp, Artificial
  CRISPR gRNA sequence
atggaaagagggcaattcct

SEQ ID NO: 318238 - DNA, 20 bp, Artificial
  CRISPR gRNA sequence
tggaaagagggcaattccta

SEQ ID NO: 318239 - DNA, 20 bp, Artificial
  CRISPR gRNA sequence
ctatagcagttaatcctttg

SEQ ID NO: 318240 - DNA, 20 bp, Artificial
  CRISPR gRNA sequence
tagcagttaatcctttgttg

SEQ ID NO: 318241 - DNA, 20 bp, Artificial
  CRISPR gRNA sequence
atcctttgttggaggaagca

SEQ ID NO: 318242 - DNA, 20 bp, Artificial
  CRISPR gRNA sequence
tgttggaggaagcagaagtc

SEQ ID NO: 318243 - DNA, 20 bp, Artificial
  CRISPR gRNA sequence
gttggaggaagcagaagtct

SEQ ID NO: 318244 - DNA, 20 bp, Artificial
  CRISPR gRNA sequence
ttggaggaagcagaagtcta

SEQ ID NO: 318245 - DNA, 20 bp, Artificial
  CRISPR gRNA sequence
gaggaagcagaagtctactt

SEQ ID NO: 318246 - DNA, 20 bp, Artificial
  CRISPR gRNA sequence
cttcttctatacaattttaa

SEQ ID NO: 318247 - DNA, 20 bp, Artificial
  CRISPR gRNA sequence
cttctatacaattttaaaga

SEQ ID NO: 318248 - DNA, 20 bp, Artificial
  CRISPR gRNA sequence
ttctatacaattttaaagac

SEQ ID NO: 318249 - DNA, 20 bp, Artificial
  CRISPR gRNA sequence
ctatacaattttaaagacta

SEQ ID NO: 318250 - DNA, 20 bp, Artificial
  CRISPR gRNA sequence
tatacaattttaaagactat

SEQ ID NO: 318251 - DNA, 20 bp, Artificial
  CRISPR gRNA sequence
tacaattttaaagactattt

SEQ ID NO: 318252 - DNA, 20 bp, Artificial
  CRISPR gRNA sequence
taaagactatttatttattt

SEQ ID NO: 318253 - DNA, 20 bp, Artificial
  CRISPR gRNA sequence
aaagactatttatttattta

SEQ ID NO: 318254 - DNA, 20 bp, Artificial
  CRISPR gRNA sequence
aagactatttatttatttat

SEQ ID NO: 318255 - DNA, 20 bp, Artificial
  CRISPR gRNA sequence
tttatttatttatttattta

SEQ ID NO: 318256 - DNA, 20 bp, Artificial
  CRISPR gRNA sequence
atttatttatttatttattt

SEQ ID NO: 318257 - DNA, 20 bp, Artificial
  CRISPR gRNA sequence
tttatttatttatttattta

SEQ ID NO: 318258 - DNA, 20 bp, Artificial
  CRISPR gRNA sequence
atttatttatttatttatat

SEQ ID NO: 318259 - DNA, 20 bp, Artificial
  CRISPR gRNA sequence
tttatttatttatttatatt

SEQ ID NO: 318260 - DNA, 20 bp, Artificial
  CRISPR gRNA sequence
atttatttatttatattttt

SEQ ID NO: 318261 - DNA, 20 bp, Artificial
  CRISPR gRNA sequence
tttatttatttatatttttt

SEQ ID NO: 318262 - DNA, 20 bp, Artificial
  CRISPR gRNA sequence
atttatttatattttttaag

SEQ ID NO: 318263 - DNA, 20 bp, Artificial
  CRISPR gRNA sequence
tttatttatattttttaaga

SEQ ID NO: 318264 - DNA, 20 bp, Artificial
  CRISPR gRNA sequence
atttatattttttaagacgg

SEQ ID NO: 318265 - DNA, 20 bp, Artificial
  CRISPR gRNA sequence
tttatattttttaagacgga

SEQ ID NO: 318266 - DNA, 20 bp, Artificial
  CRISPR gRNA sequence
atattttttaagacggaatc

SEQ ID NO: 318267 - DNA, 20 bp, Artificial
  CRISPR gRNA sequence
tattttttaagacggaatct

SEQ ID NO: 318268 - DNA, 20 bp, Artificial
  CRISPR gRNA sequence
tttaagacggaatcttgatc

SEQ ID NO: 318269 - DNA, 20 bp, Artificial
  CRISPR gRNA sequence
ttaagacggaatcttgatct

SEQ ID NO: 318270 - DNA, 20 bp, Artificial
  CRISPR gRNA sequence
taagacggaatcttgatctt

SEQ ID NO: 318271 - DNA, 20 bp, Artificial
  CRISPR gRNA sequence
aagacggaatcttgatcttc

SEQ ID NO: 318272 - DNA, 20 bp, Artificial
  CRISPR gRNA sequence
agacggaatcttgatcttct

SEQ ID NO: 318273 - DNA, 20 bp, Artificial
  CRISPR gRNA sequence
gatcttctgtcacccaggct

SEQ ID NO: 318274 - DNA, 20 bp, Artificial
  CRISPR gRNA sequence
atcttctgtcacccaggctg

SEQ ID NO: 318275 - DNA, 20 bp, Artificial
  CRISPR gRNA sequence
ctgtcacccaggctggagtg

SEQ ID NO: 318276 - DNA, 20 bp, Artificial
  CRISPR gRNA sequence
tgtcacccaggctggagtgc

SEQ ID NO: 318277 - DNA, 20 bp, Artificial
  CRISPR gRNA sequence
tcacccaggctggagtgcag

SEQ ID NO: 318278 - DNA, 20 bp, Artificial
  CRISPR gRNA sequence
gagtgcagtggtgtgatctt

SEQ ID NO: 318279 - DNA, 20 bp, Artificial
  CRISPR gRNA sequence
ggctcactgcaacctctgcc

SEQ ID NO: 318280 - DNA, 20 bp, Artificial
  CRISPR gRNA sequence
gctcactgcaacctctgcct

SEQ ID NO: 318281 - DNA, 20 bp, Artificial
  CRISPR gRNA sequence
actgcaacctctgcctccca

SEQ ID NO: 318282 - DNA, 20 bp, Artificial
  CRISPR gRNA sequence
caacctctgcctcccaggtt

SEQ ID NO: 318283 - DNA, 20 bp, Artificial
  CRISPR gRNA sequence
tgcctcccaggttcaagcga

SEQ ID NO: 318284 - DNA, 20 bp, Artificial
  CRISPR gRNA sequence
cctcccaggttcaagcgatt

SEQ ID NO: 318285 - DNA, 20 bp, Artificial
  CRISPR gRNA sequence
ccaggttcaagcgattctcc

SEQ ID NO: 318286 - DNA, 20 bp, Artificial
  CRISPR gRNA sequence
aagcgattctcctctctcag

SEQ ID NO: 318287 - DNA, 20 bp, Artificial
  CRISPR gRNA sequence
tcctctctcagcctcccaag

SEQ ID NO: 318288 - DNA, 20 bp, Artificial
  CRISPR gRNA sequence
ctctctcagcctcccaagta

SEQ ID NO: 318289 - DNA, 20 bp, Artificial
  CRISPR gRNA sequence
tctcagcctcccaagtagct

SEQ ID NO: 318290 - DNA, 20 bp, Artificial
  CRISPR gRNA sequence
tcagcctcccaagtagctgg

SEQ ID NO: 318291 - DNA, 20 bp, Artificial
  CRISPR gRNA sequence
agcctcccaagtagctggga

SEQ ID NO: 318292 - DNA, 20 bp, Artificial
  CRISPR gRNA sequence
ccaagtagctgggattacag

SEQ ID NO: 318293 - DNA, 20 bp, Artificial
  CRISPR gRNA sequence
ggattacaggtgcctgccac

SEQ ID NO: 318294 - DNA, 20 bp, Artificial
  CRISPR gRNA sequence
caggtgcctgccaccacacc

SEQ ID NO: 318295 - DNA, 20 bp, Artificial
  CRISPR gRNA sequence
ccaccacacccagctaattt

SEQ ID NO: 318296 - DNA, 20 bp, Artificial
  CRISPR gRNA sequence
atttttgtatgtttagtaga

SEQ ID NO: 318297 - DNA, 20 bp, Artificial
  CRISPR gRNA sequence
ttgtatgtttagtagaaatg

SEQ ID NO: 318298 - DNA, 20 bp, Artificial
  CRISPR gRNA sequence
tgtatgtttagtagaaatgg

SEQ ID NO: 318299 - DNA, 20 bp, Artificial
  CRISPR gRNA sequence
gtatgtttagtagaaatggg

SEQ ID NO: 318300 - DNA, 20 bp, Artificial
  CRISPR gRNA sequence
tatgtttagtagaaatgggg

SEQ ID NO: 318301 - DNA, 20 bp, Artificial
  CRISPR gRNA sequence
agtagaaatggggtttcacc

SEQ ID NO: 318302 - DNA, 20 bp, Artificial
  CRISPR gRNA sequence
gtagaaatggggtttcacca

SEQ ID NO: 318303 - DNA, 20 bp, Artificial
  CRISPR gRNA sequence
caccatgttggccaggcggg

SEQ ID NO: 318304 - DNA, 20 bp, Artificial
  CRISPR gRNA sequence
accatgttggccaggcgggt

SEQ ID NO: 318305 - DNA, 20 bp, Artificial
  CRISPR gRNA sequence
gccaggcgggtctcgaactc

SEQ ID NO: 318306 - DNA, 20 bp, Artificial
  CRISPR gRNA sequence
gaactcctgatctaaggtga

SEQ ID NO: 318307 - DNA, 20 bp, Artificial
  CRISPR gRNA sequence
ctgatctaaggtgatctgcc

SEQ ID NO: 318308 - DNA, 20 bp, Artificial
  CRISPR gRNA sequence
atctaaggtgatctgcctgc

SEQ ID NO: 318309 - DNA, 20 bp, Artificial
  CRISPR gRNA sequence
aggtgatctgcctgcctcag

SEQ ID NO: 318310 - DNA, 20 bp, Artificial
  CRISPR gRNA sequence
cctgcctcagcctccaaaag

SEQ ID NO: 318311 - DNA, 20 bp, Artificial
  CRISPR gRNA sequence
cctcagcctccaaaagtgct

SEQ ID NO: 318312 - DNA, 20 bp, Artificial
  CRISPR gRNA sequence
agcctccaaaagtgctggga

SEQ ID NO: 318313 - DNA, 20 bp, Artificial
  CRISPR gRNA sequence
caaaagtgctgggattacag

SEQ ID NO: 318314 - DNA, 20 bp, Artificial
  CRISPR gRNA sequence
ggattacaggtgtgagccac

SEQ ID NO: 318315 - DNA, 20 bp, Artificial
  CRISPR gRNA sequence
caggtgtgagccaccacccc

SEQ ID NO: 318316 - DNA, 20 bp, Artificial
  CRISPR gRNA sequence
gcctaaaagaccttttaatt

SEQ ID NO: 318317 - DNA, 20 bp, Artificial
  CRISPR gRNA sequence
aaagaccttttaattgttag

SEQ ID NO: 318318 - DNA, 20 bp, Artificial
  CRISPR gRNA sequence
ttaattgttagaaaagtctc

SEQ ID NO: 318319 - DNA, 20 bp, Artificial
  CRISPR gRNA sequence
taattgttagaaaagtctct

SEQ ID NO: 318320 - DNA, 20 bp, Artificial
  CRISPR gRNA sequence
aattgttagaaaagtctctc

SEQ ID NO: 318321 - DNA, 20 bp, Artificial
  CRISPR gRNA sequence
attgttagaaaagtctctct

SEQ ID NO: 318322 - DNA, 20 bp, Artificial
  CRISPR gRNA sequence
ttagaaaagtctctcttaat

SEQ ID NO: 318323 - DNA, 20 bp, Artificial
  CRISPR gRNA sequence
gaaaagtctctcttaattcc

SEQ ID NO: 318324 - DNA, 20 bp, Artificial
  CRISPR gRNA sequence
tcttaattccttataccctc

SEQ ID NO: 318325 - DNA, 20 bp, Artificial
  CRISPR gRNA sequence
ttaattccttataccctctc

SEQ ID NO: 318326 - DNA, 20 bp, Artificial
  CRISPR gRNA sequence
aattccttataccctctcat

SEQ ID NO: 318327 - DNA, 20 bp, Artificial
  CRISPR gRNA sequence
attccttataccctctcata

SEQ ID NO: 318328 - DNA, 20 bp, Artificial
  CRISPR gRNA sequence
cttataccctctcataacct

SEQ ID NO: 318329 - DNA, 20 bp, Artificial
  CRISPR gRNA sequence
ataccctctcataaccttca

SEQ ID NO: 318330 - DNA, 20 bp, Artificial
  CRISPR gRNA sequence
taccctctcataaccttcat

SEQ ID NO: 318331 - DNA, 20 bp, Artificial
  CRISPR gRNA sequence
tcataaccttcattcataga

SEQ ID NO: 318332 - DNA, 20 bp, Artificial
  CRISPR gRNA sequence
ataaccttcattcatagaga

SEQ ID NO: 318333 - DNA, 20 bp, Artificial
  CRISPR gRNA sequence
cattcatagagatgcccttc

SEQ ID NO: 318334 - DNA, 20 bp, Artificial
  CRISPR gRNA sequence
attcatagagatgcccttca

SEQ ID NO: 318335 - DNA, 20 bp, Artificial
  CRISPR gRNA sequence
atagagatgcccttcagagt

SEQ ID NO: 318336 - DNA, 20 bp, Artificial
  CRISPR gRNA sequence
cagagtcataccatcaagct

SEQ ID NO: 318337 - DNA, 20 bp, Artificial
  CRISPR gRNA sequence
agagtcataccatcaagctc

SEQ ID NO: 318338 - DNA, 20 bp, Artificial
  CRISPR gRNA sequence
aatctttgcatcccatggta

SEQ ID NO: 318339 - DNA, 20 bp, Artificial
  CRISPR gRNA sequence
tgcatcccatggtagctctt

SEQ ID NO: 318340 - DNA, 20 bp, Artificial
  CRISPR gRNA sequence
gcatcccatggtagctcttc

SEQ ID NO: 318341 - DNA, 20 bp, Artificial
  CRISPR gRNA sequence
catcccatggtagctcttca

SEQ ID NO: 318342 - DNA, 20 bp, Artificial
  CRISPR gRNA sequence
ttcagatatttgaagacagt

SEQ ID NO: 318343 - DNA, 20 bp, Artificial
  CRISPR gRNA sequence
cagatatttgaagacagtat

SEQ ID NO: 318344 - DNA, 20 bp, Artificial
  CRISPR gRNA sequence
agatatttgaagacagtatc

SEQ ID NO: 318345 - DNA, 20 bp, Artificial
  CRISPR gRNA sequence
gaagacagtatctctgttct

SEQ ID NO: 318346 - DNA, 20 bp, Artificial
  CRISPR gRNA sequence
aagacagtatctctgttctc

SEQ ID NO: 318347 - DNA, 20 bp, Artificial
  CRISPR gRNA sequence
tgttctctccaggccttctt

SEQ ID NO: 318348 - DNA, 20 bp, Artificial
  CRISPR gRNA sequence
ttctctccaggccttctttc

SEQ ID NO: 318349 - DNA, 20 bp, Artificial
  CRISPR gRNA sequence
tctccaggccttctttcagg

SEQ ID NO: 318350 - DNA, 20 bp, Artificial
  CRISPR gRNA sequence
tccaggccttctttcaggtg

SEQ ID NO: 318351 - DNA, 20 bp, Artificial
  CRISPR gRNA sequence
caggccttctttcaggtgaa

SEQ ID NO: 318352 - DNA, 20 bp, Artificial
  CRISPR gRNA sequence
ctttcaggtgaagcatcatc

SEQ ID NO: 318353 - DNA, 20 bp, Artificial
  CRISPR gRNA sequence
tttcaggtgaagcatcatca

SEQ ID NO: 318354 - DNA, 20 bp, Artificial
  CRISPR gRNA sequence
tcaggtgaagcatcatcagt

SEQ ID NO: 318355 - DNA, 20 bp, Artificial
  CRISPR gRNA sequence
caggtgaagcatcatcagtt

SEQ ID NO: 318356 - DNA, 20 bp, Artificial
  CRISPR gRNA sequence
aggtgaagcatcatcagtta

SEQ ID NO: 318357 - DNA, 20 bp, Artificial
  CRISPR gRNA sequence
cttgagctatttcttaattg

SEQ ID NO: 318358 - DNA, 20 bp, Artificial
  CRISPR gRNA sequence
gagctatttcttaattgact

SEQ ID NO: 318359 - DNA, 20 bp, Artificial
  CRISPR gRNA sequence
agctatttcttaattgactg

SEQ ID NO: 318360 - DNA, 20 bp, Artificial
  CRISPR gRNA sequence
tttcttaattgactgagttc

SEQ ID NO: 318361 - DNA, 20 bp, Artificial
  CRISPR gRNA sequence
cttaattgactgagttccca

SEQ ID NO: 318362 - DNA, 20 bp, Artificial
  CRISPR gRNA sequence
ttaattgactgagttcccag

SEQ ID NO: 318363 - DNA, 20 bp, Artificial
  CRISPR gRNA sequence
aattgactgagttcccagat

SEQ ID NO: 318364 - DNA, 20 bp, Artificial
  CRISPR gRNA sequence
attgactgagttcccagatg

SEQ ID NO: 318365 - DNA, 20 bp, Artificial
  CRISPR gRNA sequence
actgagttcccagatgcttt

SEQ ID NO: 318366 - DNA, 20 bp, Artificial
  CRISPR gRNA sequence
agttcccagatgctttataa

SEQ ID NO: 318367 - DNA, 20 bp, Artificial
  CRISPR gRNA sequence
ccagatgctttataaatctg

SEQ ID NO: 318368 - DNA, 20 bp, Artificial
  CRISPR gRNA sequence
tataaatctggttatgttct

SEQ ID NO: 318369 - DNA, 20 bp, Artificial
  CRISPR gRNA sequence
ataaatctggttatgttcta

SEQ ID NO: 318370 - DNA, 20 bp, Artificial
  CRISPR gRNA sequence
taaatctggttatgttctat

SEQ ID NO: 318371 - DNA, 20 bp, Artificial
  CRISPR gRNA sequence
gttatgttctatttttgtaa

SEQ ID NO: 318372 - DNA, 20 bp, Artificial
  CRISPR gRNA sequence
tgttctatttttgtaaagtt

SEQ ID NO: 318373 - DNA, 20 bp, Artificial
  CRISPR gRNA sequence
tatttttgtaaagtttcttc

SEQ ID NO: 318374 - DNA, 20 bp, Artificial
  CRISPR gRNA sequence
tttttgtaaagtttcttctt

SEQ ID NO: 318375 - DNA, 20 bp, Artificial
  CRISPR gRNA sequence
ttgtaaagtttcttcttaaa

SEQ ID NO: 318376 - DNA, 20 bp, Artificial
  CRISPR gRNA sequence
tgtaaagtttcttcttaaaa

SEQ ID NO: 318377 - DNA, 20 bp, Artificial
  CRISPR gRNA sequence
gtaaagtttcttcttaaaaa

SEQ ID NO: 318378 - DNA, 20 bp, Artificial
  CRISPR gRNA sequence
taaagtttcttcttaaaaat

SEQ ID NO: 318379 - DNA, 20 bp, Artificial
  CRISPR gRNA sequence
cttcttaaaaataatggtgt

SEQ ID NO: 318380 - DNA, 20 bp, Artificial
  CRISPR gRNA sequence
ttcttaaaaataatggtgtt

SEQ ID NO: 318381 - DNA, 20 bp, Artificial
  CRISPR gRNA sequence
cttaaaaataatggtgttta

SEQ ID NO: 318382 - DNA, 20 bp, Artificial
  CRISPR gRNA sequence
ttaaaaataatggtgtttat

SEQ ID NO: 318383 - DNA, 20 bp, Artificial
  CRISPR gRNA sequence
aaaaataatggtgtttataa

SEQ ID NO: 318384 - DNA, 20 bp, Artificial
  CRISPR gRNA sequence
aaaataatggtgtttataag

SEQ ID NO: 318385 - DNA, 20 bp, Artificial
  CRISPR gRNA sequence
ataaggacatgaatagacaa

SEQ ID NO: 318386 - DNA, 20 bp, Artificial
  CRISPR gRNA sequence
taaggacatgaatagacaat

SEQ ID NO: 318387 - DNA, 20 bp, Artificial
  CRISPR gRNA sequence
tgaaaagaaaatatacaaat

SEQ ID NO: 318388 - DNA, 20 bp, Artificial
  CRISPR gRNA sequence
aaaagaaaatatacaaatgg

SEQ ID NO: 318389 - DNA, 20 bp, Artificial
  CRISPR gRNA sequence
aatatcactaactatcaggg

SEQ ID NO: 318390 - DNA, 20 bp, Artificial
  CRISPR gRNA sequence
actatcagggaaatgcaaat

SEQ ID NO: 318391 - DNA, 20 bp, Artificial
  CRISPR gRNA sequence
tcagggaaatgcaaattaaa

SEQ ID NO: 318392 - DNA, 20 bp, Artificial
  CRISPR gRNA sequence
aaaccaccatgagataccac

SEQ ID NO: 318393 - DNA, 20 bp, Artificial
  CRISPR gRNA sequence
actcctgcaagaatggccat

SEQ ID NO: 318394 - DNA, 20 bp, Artificial
  CRISPR gRNA sequence
ctcctgcaagaatggccatt

SEQ ID NO: 318395 - DNA, 20 bp, Artificial
  CRISPR gRNA sequence
ctgcaagaatggccattatt

SEQ ID NO: 318396 - DNA, 20 bp, Artificial
  CRISPR gRNA sequence
caagaatggccattattaaa

SEQ ID NO: 318397 - DNA, 20 bp, Artificial
  CRISPR gRNA sequence
ttaaaaaatcaaaaaataat

SEQ ID NO: 318398 - DNA, 20 bp, Artificial
  CRISPR gRNA sequence
aaaaatcaaaaaataataga

SEQ ID NO: 318399 - DNA, 20 bp, Artificial
  CRISPR gRNA sequence
gcatggatgtggtgaaaagg

SEQ ID NO: 318400 - DNA, 20 bp, Artificial
  CRISPR gRNA sequence
acactgctggtgggaatgta

SEQ ID NO: 318401 - DNA, 20 bp, Artificial
  CRISPR gRNA sequence
cactgctggtgggaatgtaa

SEQ ID NO: 318402 - DNA, 20 bp, Artificial
  CRISPR gRNA sequence
ctggtgggaatgtaaactag

SEQ ID NO: 318403 - DNA, 20 bp, Artificial
  CRISPR gRNA sequence
gtgggaatgtaaactagtac

SEQ ID NO: 318404 - DNA, 20 bp, Artificial
  CRISPR gRNA sequence
gtacaaacactatggaaaac

SEQ ID NO: 318405 - DNA, 20 bp, Artificial
  CRISPR gRNA sequence
tggaaaacagtatggagatt

SEQ ID NO: 318406 - DNA, 20 bp, Artificial
  CRISPR gRNA sequence
cttaaagaactaaaagtaga

SEQ ID NO: 318407 - DNA, 20 bp, Artificial
  CRISPR gRNA sequence
aaagaactaaaagtagaact

SEQ ID NO: 318408 - DNA, 20 bp, Artificial
  CRISPR gRNA sequence
aagaactaaaagtagaactc

SEQ ID NO: 318409 - DNA, 20 bp, Artificial
  CRISPR gRNA sequence
aaagtagaactctactattt

SEQ ID NO: 318410 - DNA, 20 bp, Artificial
  CRISPR gRNA sequence
tactatttaattcagcaatc

SEQ ID NO: 318411 - DNA, 20 bp, Artificial
  CRISPR gRNA sequence
ctatttaattcagcaatcct

SEQ ID NO: 318412 - DNA, 20 bp, Artificial
  CRISPR gRNA sequence
tttaattcagcaatcctact

SEQ ID NO: 318413 - DNA, 20 bp, Artificial
  CRISPR gRNA sequence
aattcagcaatcctactact

SEQ ID NO: 318414 - DNA, 20 bp, Artificial
  CRISPR gRNA sequence
attcagcaatcctactactg

SEQ ID NO: 318415 - DNA, 20 bp, Artificial
  CRISPR gRNA sequence
agcaatcctactactgggta

SEQ ID NO: 318416 - DNA, 20 bp, Artificial
  CRISPR gRNA sequence
ctactgggtatatacccaaa

SEQ ID NO: 318417 - DNA, 20 bp, Artificial
  CRISPR gRNA sequence
ctgggtatatacccaaagga

SEQ ID NO: 318418 - DNA, 20 bp, Artificial
  CRISPR gRNA sequence
ggtatatacccaaaggaaaa

SEQ ID NO: 318419 - DNA, 20 bp, Artificial
  CRISPR gRNA sequence
attatatgaaaaagacacat

SEQ ID NO: 318420 - DNA, 20 bp, Artificial
  CRISPR gRNA sequence
tatgaaaaagacacatgcac

SEQ ID NO: 318421 - DNA, 20 bp, Artificial
  CRISPR gRNA sequence
atagcagcacaatttgcaat

SEQ ID NO: 318422 - DNA, 20 bp, Artificial
  CRISPR gRNA sequence
tagcagcacaatttgcaatt

SEQ ID NO: 318423 - DNA, 20 bp, Artificial
  CRISPR gRNA sequence
gcaattccaaaaataaggaa

SEQ ID NO: 318424 - DNA, 20 bp, Artificial
  CRISPR gRNA sequence
caattccaaaaataaggaac

SEQ ID NO: 318425 - DNA, 20 bp, Artificial
  CRISPR gRNA sequence
caaaaataaggaaccaacct

SEQ ID NO: 318426 - DNA, 20 bp, Artificial
  CRISPR gRNA sequence
aatgtccatcaacccatgag

SEQ ID NO: 318427 - DNA, 20 bp, Artificial
  CRISPR gRNA sequence
atggaatattactcagccat

SEQ ID NO: 318428 - DNA, 20 bp, Artificial
  CRISPR gRNA sequence
ctcagccataaaaagaaaca

SEQ ID NO: 318429 - DNA, 20 bp, Artificial
  CRISPR gRNA sequence
agccataaaaagaaacaaaa

SEQ ID NO: 318430 - DNA, 20 bp, Artificial
  CRISPR gRNA sequence
gcagcaactttgatggaacc

SEQ ID NO: 318431 - DNA, 20 bp, Artificial
  CRISPR gRNA sequence
cagcaactttgatggaacca

SEQ ID NO: 318432 - DNA, 20 bp, Artificial
  CRISPR gRNA sequence
tgatggaaccagagaccatt

SEQ ID NO: 318433 - DNA, 20 bp, Artificial
  CRISPR gRNA sequence
gatggaaccagagaccatta

SEQ ID NO: 318434 - DNA, 20 bp, Artificial
  CRISPR gRNA sequence
atggaaccagagaccattat

SEQ ID NO: 318435 - DNA, 20 bp, Artificial
  CRISPR gRNA sequence
ttctaagtgaagtaactcaa

SEQ ID NO: 318436 - DNA, 20 bp, Artificial
  CRISPR gRNA sequence
taagtgaagtaactcaagaa

SEQ ID NO: 318437 - DNA, 20 bp, Artificial
  CRISPR gRNA sequence
agtgaagtaactcaagaatg

SEQ ID NO: 318438 - DNA, 20 bp, Artificial
  CRISPR gRNA sequence
aagaatggagaaacaaatat

SEQ ID NO: 318439 - DNA, 20 bp, Artificial
  CRISPR gRNA sequence
tatgttttcactgataagtg

SEQ ID NO: 318440 - DNA, 20 bp, Artificial
  CRISPR gRNA sequence
tcactgataagtgggagcta

SEQ ID NO: 318441 - DNA, 20 bp, Artificial
  CRISPR gRNA sequence
cactgataagtgggagctaa

SEQ ID NO: 318442 - DNA, 20 bp, Artificial
  CRISPR gRNA sequence
actgataagtgggagctaaa

SEQ ID NO: 318443 - DNA, 20 bp, Artificial
  CRISPR gRNA sequence
ataagtgggagctaaactat

SEQ ID NO: 318444 - DNA, 20 bp, Artificial
  CRISPR gRNA sequence
aactatgaggatgcaaagac

SEQ ID NO: 318445 - DNA, 20 bp, Artificial
  CRISPR gRNA sequence
tgaggatgcaaagacataag

SEQ ID NO: 318446 - DNA, 20 bp, Artificial
  CRISPR gRNA sequence
tggggactcagaggaaagag

SEQ ID NO: 318447 - DNA, 20 bp, Artificial
  CRISPR gRNA sequence
ggggactcagaggaaagagt

SEQ ID NO: 318448 - DNA, 20 bp, Artificial
  CRISPR gRNA sequence
gggactcagaggaaagagtg

SEQ ID NO: 318449 - DNA, 20 bp, Artificial
  CRISPR gRNA sequence
agaggaaagagtgggagggg

SEQ ID NO: 318450 - DNA, 20 bp, Artificial
  CRISPR gRNA sequence
cacactggtgcagtgtacac

SEQ ID NO: 318451 - DNA, 20 bp, Artificial
  CRISPR gRNA sequence
gtgcagtgtacactgctcga

SEQ ID NO: 318452 - DNA, 20 bp, Artificial
  CRISPR gRNA sequence
ctcgagtgacaggtggcacc

SEQ ID NO: 318453 - DNA, 20 bp, Artificial
  CRISPR gRNA sequence
gagtgacaggtggcaccaaa

SEQ ID NO: 318454 - DNA, 20 bp, Artificial
  CRISPR gRNA sequence
agaaatcaccactaaataac

SEQ ID NO: 318455 - DNA, 20 bp, Artificial
  CRISPR gRNA sequence
aataacttatccatgtaacc

SEQ ID NO: 318456 - DNA, 20 bp, Artificial
  CRISPR gRNA sequence
atccatgtaaccaaaaacca

SEQ ID NO: 318457 - DNA, 20 bp, Artificial
  CRISPR gRNA sequence
tccatgtaaccaaaaaccac

SEQ ID NO: 318458 - DNA, 20 bp, Artificial
  CRISPR gRNA sequence
gtttagttcagtagttccca

SEQ ID NO: 318459 - DNA, 20 bp, Artificial
  CRISPR gRNA sequence
agttcagtagttcccaaaaa

SEQ ID NO: 318460 - DNA, 20 bp, Artificial
  CRISPR gRNA sequence
gttcagtagttcccaaaaaa

SEQ ID NO: 318461 - DNA, 20 bp, Artificial
  CRISPR gRNA sequence
agtagttcccaaaaaactat

SEQ ID NO: 318462 - DNA, 20 bp, Artificial
  CRISPR gRNA sequence
ccaaaaaactattcaaataa

SEQ ID NO: 318463 - DNA, 20 bp, Artificial
  CRISPR gRNA sequence
ttcaaataaaaattttgaaa

SEQ ID NO: 318464 - DNA, 20 bp, Artificial
  CRISPR gRNA sequence
aaataaaaattttgaaaaag

SEQ ID NO: 318465 - DNA, 20 bp, Artificial
  CRISPR gRNA sequence
tgaaaaagaatcttataaat

SEQ ID NO: 318466 - DNA, 20 bp, Artificial
  CRISPR gRNA sequence
gaaaaagaatcttataaatg

SEQ ID NO: 318467 - DNA, 20 bp, Artificial
  CRISPR gRNA sequence
aaaaagaatcttataaatgt

SEQ ID NO: 318468 - DNA, 20 bp, Artificial
  CRISPR gRNA sequence
ataaatgtaaaaaaaggtac

SEQ ID NO: 318469 - DNA, 20 bp, Artificial
  CRISPR gRNA sequence
taaatgtaaaaaaaggtact

SEQ ID NO: 318470 - DNA, 20 bp, Artificial
  CRISPR gRNA sequence
atagttgaatacagtatttc

SEQ ID NO: 318471 - DNA, 20 bp, Artificial
  CRISPR gRNA sequence
tagttgaatacagtatttca

SEQ ID NO: 318472 - DNA, 20 bp, Artificial
  CRISPR gRNA sequence
aatacagtatttcagatgtc

SEQ ID NO: 318473 - DNA, 20 bp, Artificial
  CRISPR gRNA sequence
cagatgtcttcagattaaca

SEQ ID NO: 318474 - DNA, 20 bp, Artificial
  CRISPR gRNA sequence
agatgtcttcagattaacac

SEQ ID NO: 318475 - DNA, 20 bp, Artificial
  CRISPR gRNA sequence
cagattaacacaaaatgaat

SEQ ID NO: 318476 - DNA, 20 bp, Artificial
  CRISPR gRNA sequence
agattaacacaaaatgaatt

SEQ ID NO: 318477 - DNA, 20 bp, Artificial
  CRISPR gRNA sequence
acacaaaatgaattatcctt

SEQ ID NO: 318478 - DNA, 20 bp, Artificial
  CRISPR gRNA sequence
tccttttatacccatgacaa

SEQ ID NO: 318479 - DNA, 20 bp, Artificial
  CRISPR gRNA sequence
ttatacccatgacaaaatag

SEQ ID NO: 318480 - DNA, 20 bp, Artificial
  CRISPR gRNA sequence
tatacccatgacaaaatagt

SEQ ID NO: 318481 - DNA, 20 bp, Artificial
  CRISPR gRNA sequence
atacccatgacaaaatagtc

SEQ ID NO: 318482 - DNA, 20 bp, Artificial
  CRISPR gRNA sequence
tacccatgacaaaatagtca

SEQ ID NO: 318483 - DNA, 20 bp, Artificial
  CRISPR gRNA sequence
tcaaaaaaatgaaagcagac

SEQ ID NO: 318484 - DNA, 20 bp, Artificial
  CRISPR gRNA sequence
aaaggtagattctaaacttt

SEQ ID NO: 318485 - DNA, 20 bp, Artificial
  CRISPR gRNA sequence
taaacttttaaatttgctta

SEQ ID NO: 318486 - DNA, 20 bp, Artificial
  CRISPR gRNA sequence
aacttttaaatttgcttaca

SEQ ID NO: 318487 - DNA, 20 bp, Artificial
  CRISPR gRNA sequence
ttaaatttgcttacaaattc

SEQ ID NO: 318488 - DNA, 20 bp, Artificial
  CRISPR gRNA sequence
taaatttgcttacaaattca

SEQ ID NO: 318489 - DNA, 20 bp, Artificial
  CRISPR gRNA sequence
aaatttgcttacaaattcag

SEQ ID NO: 318490 - DNA, 20 bp, Artificial
  CRISPR gRNA sequence
aatttgcttacaaattcagc

SEQ ID NO: 318491 - DNA, 20 bp, Artificial
  CRISPR gRNA sequence
gcttacaaattcagcatttt

SEQ ID NO: 318492 - DNA, 20 bp, Artificial
  CRISPR gRNA sequence
cttacaaattcagcattttg

SEQ ID NO: 318493 - DNA, 20 bp, Artificial
  CRISPR gRNA sequence
acaaattcagcattttgaag

SEQ ID NO: 318494 - DNA, 20 bp, Artificial
  CRISPR gRNA sequence
caaattcagcattttgaagg

SEQ ID NO: 318495 - DNA, 20 bp, Artificial
  CRISPR gRNA sequence
agcattttgaaggggaaatg

SEQ ID NO: 318496 - DNA, 20 bp, Artificial
  CRISPR gRNA sequence
tgaaggggaaatgtgatgat

SEQ ID NO: 318497 - DNA, 20 bp, Artificial
  CRISPR gRNA sequence
gaaggggaaatgtgatgata

SEQ ID NO: 318498 - DNA, 20 bp, Artificial
  CRISPR gRNA sequence
aaggggaaatgtgatgatat

SEQ ID NO: 318499 - DNA, 20 bp, Artificial
  CRISPR gRNA sequence
actttcagtctttaagcctg

SEQ ID NO: 318500 - DNA, 20 bp, Artificial
  CRISPR gRNA sequence
tcagtctttaagcctgtgaa

SEQ ID NO: 318501 - DNA, 20 bp, Artificial
  CRISPR gRNA sequence
cagtctttaagcctgtgaat

SEQ ID NO: 318502 - DNA, 20 bp, Artificial
  CRISPR gRNA sequence
agtctttaagcctgtgaata

SEQ ID NO: 318503 - DNA, 20 bp, Artificial
  CRISPR gRNA sequence
taagcctgtgaatatttctg

SEQ ID NO: 318504 - DNA, 20 bp, Artificial
  CRISPR gRNA sequence
aagcctgtgaatatttctgt

SEQ ID NO: 318505 - DNA, 20 bp, Artificial
  CRISPR gRNA sequence
agcctgtgaatatttctgtt

SEQ ID NO: 318506 - DNA, 20 bp, Artificial
  CRISPR gRNA sequence
tgaatatttctgtttaaatg

SEQ ID NO: 318507 - DNA, 20 bp, Artificial
  CRISPR gRNA sequence
ctgtttaaatgttggttaaa

SEQ ID NO: 318508 - DNA, 20 bp, Artificial
  CRISPR gRNA sequence
tgtttaaatgttggttaaaa

SEQ ID NO: 318509 - DNA, 20 bp, Artificial
  CRISPR gRNA sequence
tttaaatgttggttaaaaac

SEQ ID NO: 318510 - DNA, 20 bp, Artificial
  CRISPR gRNA sequence
aaatgttggttaaaaacgga

SEQ ID NO: 318511 - DNA, 20 bp, Artificial
  CRISPR gRNA sequence
aatgttggttaaaaacggat

SEQ ID NO: 318512 - DNA, 20 bp, Artificial
  CRISPR gRNA sequence
gttaaaaacggatcacgagg

SEQ ID NO: 318513 - DNA, 20 bp, Artificial
  CRISPR gRNA sequence
aaaacggatcacgaggtcaa

SEQ ID NO: 318514 - DNA, 20 bp, Artificial
  CRISPR gRNA sequence
gccaacatggtgaaaaccca

SEQ ID NO: 318515 - DNA, 20 bp, Artificial
  CRISPR gRNA sequence
tactgaaaatacaaaaatta

SEQ ID NO: 318516 - DNA, 20 bp, Artificial
  CRISPR gRNA sequence
ctgaaaatacaaaaattacc

SEQ ID NO: 318517 - DNA, 20 bp, Artificial
  CRISPR gRNA sequence
aaaatacaaaaattacctgg

SEQ ID NO: 318518 - DNA, 20 bp, Artificial
  CRISPR gRNA sequence
cctgggcttggtggcacgtg

SEQ ID NO: 318519 - DNA, 20 bp, Artificial
  CRISPR gRNA sequence
ggcttggtggcacgtgcctg

SEQ ID NO: 318520 - DNA, 20 bp, Artificial
  CRISPR gRNA sequence
ggtggcacgtgcctgtagtc

SEQ ID NO: 318521 - DNA, 20 bp, Artificial
  CRISPR gRNA sequence
gtggcacgtgcctgtagtcc

SEQ ID NO: 318522 - DNA, 20 bp, Artificial
  CRISPR gRNA sequence
tagtcccagctacttgggag

SEQ ID NO: 318523 - DNA, 20 bp, Artificial
  CRISPR gRNA sequence
cttgggaggctgaggcagga

SEQ ID NO: 318524 - DNA, 20 bp, Artificial
  CRISPR gRNA sequence
gggaggctgaggcaggagaa

SEQ ID NO: 318525 - DNA, 20 bp, Artificial
  CRISPR gRNA sequence
ggaggctgaggcaggagaat

SEQ ID NO: 318526 - DNA, 20 bp, Artificial
  CRISPR gRNA sequence
aggcaggagaatcgcttgaa

SEQ ID NO: 318527 - DNA, 20 bp, Artificial
  CRISPR gRNA sequence
gaacctgggaggcagaggtt

SEQ ID NO: 318528 - DNA, 20 bp, Artificial
  CRISPR gRNA sequence
aacctgggaggcagaggttg

SEQ ID NO: 318529 - DNA, 20 bp, Artificial
  CRISPR gRNA sequence
ggaggcagaggttgcagtgt

SEQ ID NO: 318530 - DNA, 20 bp, Artificial
  CRISPR gRNA sequence
cagtgtgctgagatcgtgcc

SEQ ID NO: 318531 - DNA, 20 bp, Artificial
  CRISPR gRNA sequence
agatcgtgccactgcactcc

SEQ ID NO: 318532 - DNA, 20 bp, Artificial
  CRISPR gRNA sequence
cactccagcctggtgacaga

SEQ ID NO: 318533 - DNA, 20 bp, Artificial
  CRISPR gRNA sequence
cagcctggtgacagagtgag

SEQ ID NO: 318534 - DNA, 20 bp, Artificial
  CRISPR gRNA sequence
gtgacagagtgaggctctgt

SEQ ID NO: 318535 - DNA, 20 bp, Artificial
  CRISPR gRNA sequence
tgtctcacacacacacaaaa

SEQ ID NO: 318536 - DNA, 20 bp, Artificial
  CRISPR gRNA sequence
tctcacacacacacaaaaaa

SEQ ID NO: 318537 - DNA, 20 bp, Artificial
  CRISPR gRNA sequence
acacacacacaaaaaaaaaa

SEQ ID NO: 318538 - DNA, 20 bp, Artificial
  CRISPR gRNA sequence
aaaaaaaataataataattt

SEQ ID NO: 318539 - DNA, 20 bp, Artificial
  CRISPR gRNA sequence
cttttgaaaaaggcacttta

SEQ ID NO: 318540 - DNA, 20 bp, Artificial
  CRISPR gRNA sequence
ttttgaaaaaggcactttac

SEQ ID NO: 318541 - DNA, 20 bp, Artificial
  CRISPR gRNA sequence
ttgaaaaaggcactttacct

SEQ ID NO: 318542 - DNA, 20 bp, Artificial
  CRISPR gRNA sequence
tgaaaaaggcactttacctt

SEQ ID NO: 318543 - DNA, 20 bp, Artificial
  CRISPR gRNA sequence
gaaaaaggcactttaccttt

SEQ ID NO: 318544 - DNA, 20 bp, Artificial
  CRISPR gRNA sequence
aaaaaggcactttaccttta

SEQ ID NO: 318545 - DNA, 20 bp, Artificial
  CRISPR gRNA sequence
tacctttaagaaatcattcc

SEQ ID NO: 318546 - DNA, 20 bp, Artificial
  CRISPR gRNA sequence
acctttaagaaatcattcct

SEQ ID NO: 318547 - DNA, 20 bp, Artificial
  CRISPR gRNA sequence
cctttaagaaatcattcctg

SEQ ID NO: 318548 - DNA, 20 bp, Artificial
  CRISPR gRNA sequence
taagaaatcattcctgaaac

SEQ ID NO: 318549 - DNA, 20 bp, Artificial
  CRISPR gRNA sequence
aagaaatcattcctgaaaca

SEQ ID NO: 318550 - DNA, 20 bp, Artificial
  CRISPR gRNA sequence
agaaatcattcctgaaacag

SEQ ID NO: 318551 - DNA, 20 bp, Artificial
  CRISPR gRNA sequence
ctgaaacagctgagactcct

SEQ ID NO: 318552 - DNA, 20 bp, Artificial
  CRISPR gRNA sequence
aaacagctgagactcctagg

SEQ ID NO: 318553 - DNA, 20 bp, Artificial
  CRISPR gRNA sequence
agactcctaggtttgttcta

SEQ ID NO: 318554 - DNA, 20 bp, Artificial
  CRISPR gRNA sequence
ctaggtttgttctagggagg

SEQ ID NO: 318555 - DNA, 20 bp, Artificial
  CRISPR gRNA sequence
ggtttgttctagggaggcaa

SEQ ID NO: 318556 - DNA, 20 bp, Artificial
  CRISPR gRNA sequence
gttctagggaggcaagctgt

SEQ ID NO: 318557 - DNA, 20 bp, Artificial
  CRISPR gRNA sequence
ttctagggaggcaagctgta

SEQ ID NO: 318558 - DNA, 20 bp, Artificial
  CRISPR gRNA sequence
tagggaggcaagctgtaaaa

SEQ ID NO: 318559 - DNA, 20 bp, Artificial
  CRISPR gRNA sequence
gggaggcaagctgtaaaaac

SEQ ID NO: 318560 - DNA, 20 bp, Artificial
  CRISPR gRNA sequence
taaaaaccgttgttgctagg

SEQ ID NO: 318561 - DNA, 20 bp, Artificial
  CRISPR gRNA sequence
ttgctagggcattgtataca

SEQ ID NO: 318562 - DNA, 20 bp, Artificial
  CRISPR gRNA sequence
ctagggcattgtatacagat

SEQ ID NO: 318563 - DNA, 20 bp, Artificial
  CRISPR gRNA sequence
gggcattgtatacagatttc

SEQ ID NO: 318564 - DNA, 20 bp, Artificial
  CRISPR gRNA sequence
tatacagatttcagtcacac

SEQ ID NO: 318565 - DNA, 20 bp, Artificial
  CRISPR gRNA sequence
cagtcacacaagacccaaat

SEQ ID NO: 318566 - DNA, 20 bp, Artificial
  CRISPR gRNA sequence
agtcacacaagacccaaatg

SEQ ID NO: 318567 - DNA, 20 bp, Artificial
  CRISPR gRNA sequence
cagggggagctattttagtt

SEQ ID NO: 318568 - DNA, 20 bp, Artificial
  CRISPR gRNA sequence
agggggagctattttagttt

SEQ ID NO: 318569 - DNA, 20 bp, Artificial
  CRISPR gRNA sequence
ttttagtttttctcccaatg

SEQ ID NO: 318570 - DNA, 20 bp, Artificial
  CRISPR gRNA sequence
tagtttttctcccaatgggt

SEQ ID NO: 318571 - DNA, 20 bp, Artificial
  CRISPR gRNA sequence
agtttttctcccaatgggta

SEQ ID NO: 318572 - DNA, 20 bp, Artificial
  CRISPR gRNA sequence
gtttttctcccaatgggtaa

SEQ ID NO: 318573 - DNA, 20 bp, Artificial
  CRISPR gRNA sequence
ttctcccaatgggtaagctg

SEQ ID NO: 318574 - DNA, 20 bp, Artificial
  CRISPR gRNA sequence
tctcccaatgggtaagctga

SEQ ID NO: 318575 - DNA, 20 bp, Artificial
  CRISPR gRNA sequence
ctcccaatgggtaagctgat

SEQ ID NO: 318576 - DNA, 20 bp, Artificial
  CRISPR gRNA sequence
tcccaatgggtaagctgata

SEQ ID NO: 318577 - DNA, 20 bp, Artificial
  CRISPR gRNA sequence
ccaatgggtaagctgatagg

SEQ ID NO: 318578 - DNA, 20 bp, Artificial
  CRISPR gRNA sequence
atagggtgatttctgtttgg

SEQ ID NO: 318579 - DNA, 20 bp, Artificial
  CRISPR gRNA sequence
ctgtttgggaaaagacagta

SEQ ID NO: 318580 - DNA, 20 bp, Artificial
  CRISPR gRNA sequence
tgtttgggaaaagacagtaa

SEQ ID NO: 318581 - DNA, 20 bp, Artificial
  CRISPR gRNA sequence
tttgggaaaagacagtaatt

SEQ ID NO: 318582 - DNA, 20 bp, Artificial
  CRISPR gRNA sequence
gggaaaagacagtaattcat

SEQ ID NO: 318583 - DNA, 20 bp, Artificial
  CRISPR gRNA sequence
ggaaaagacagtaattcata

SEQ ID NO: 318584 - DNA, 20 bp, Artificial
  CRISPR gRNA sequence
atagttataaattctcatgc

SEQ ID NO: 318585 - DNA, 20 bp, Artificial
  CRISPR gRNA sequence
taaattctcatgccttatct

SEQ ID NO: 318586 - DNA, 20 bp, Artificial
  CRISPR gRNA sequence
tcatgccttatctgccctat

SEQ ID NO: 318587 - DNA, 20 bp, Artificial
  CRISPR gRNA sequence
atgccttatctgccctattt

SEQ ID NO: 318588 - DNA, 20 bp, Artificial
  CRISPR gRNA sequence
atctgccctatttgacaaaa

SEQ ID NO: 318589 - DNA, 20 bp, Artificial
  CRISPR gRNA sequence
tctgccctatttgacaaaac

SEQ ID NO: 318590 - DNA, 20 bp, Artificial
  CRISPR gRNA sequence
ccctatttgacaaaacaaaa

SEQ ID NO: 318591 - DNA, 20 bp, Artificial
  CRISPR gRNA sequence
tttgacaaaacaaaaaaaga

SEQ ID NO: 318592 - DNA, 20 bp, Artificial
  CRISPR gRNA sequence
gacaaaacaaaaaaagagaa

SEQ ID NO: 318593 - DNA, 20 bp, Artificial
  CRISPR gRNA sequence
acaaaacaaaaaaagagaag

SEQ ID NO: 318594 - DNA, 20 bp, Artificial
  CRISPR gRNA sequence
gaaactggctagaataacta

SEQ ID NO: 318595 - DNA, 20 bp, Artificial
  CRISPR gRNA sequence
gctagaataactatggcatt

SEQ ID NO: 318596 - DNA, 20 bp, Artificial
  CRISPR gRNA sequence
gaataactatggcatttcct

SEQ ID NO: 318597 - DNA, 20 bp, Artificial
  CRISPR gRNA sequence
tggcatttcctttttattca

SEQ ID NO: 318598 - DNA, 20 bp, Artificial
  CRISPR gRNA sequence
cctttttattcatttaaaca

SEQ ID NO: 318599 - DNA, 20 bp, Artificial
  CRISPR gRNA sequence
ctttttattcatttaaacag

SEQ ID NO: 318600 - DNA, 20 bp, Artificial
  CRISPR gRNA sequence
tttattcatttaaacagcct

SEQ ID NO: 318601 - DNA, 20 bp, Artificial
  CRISPR gRNA sequence
ttattcatttaaacagccta

SEQ ID NO: 318602 - DNA, 20 bp, Artificial
  CRISPR gRNA sequence
tattcatttaaacagcctaa

SEQ ID NO: 318603 - DNA, 20 bp, Artificial
  CRISPR gRNA sequence
attcatttaaacagcctaaa

SEQ ID NO: 318604 - DNA, 20 bp, Artificial
  CRISPR gRNA sequence
ttcatttaaacagcctaaac

SEQ ID NO: 318605 - DNA, 20 bp, Artificial
  CRISPR gRNA sequence
atttaaacagcctaaactgg

SEQ ID NO: 318606 - DNA, 20 bp, Artificial
  CRISPR gRNA sequence
aaacagcctaaactgggtaa

SEQ ID NO: 318607 - DNA, 20 bp, Artificial
  CRISPR gRNA sequence
aacagcctaaactgggtaaa

SEQ ID NO: 318608 - DNA, 20 bp, Artificial
  CRISPR gRNA sequence
aactgggtaaatatatacag

SEQ ID NO: 318609 - DNA, 20 bp, Artificial
  CRISPR gRNA sequence
ggtaaatatatacagttgag

SEQ ID NO: 318610 - DNA, 20 bp, Artificial
  CRISPR gRNA sequence
aggcatagaaaaactataat

SEQ ID NO: 318611 - DNA, 20 bp, Artificial
  CRISPR gRNA sequence
taatgagaaaacactggata

SEQ ID NO: 318612 - DNA, 20 bp, Artificial
  CRISPR gRNA sequence
gataggacttttggtgccaa

SEQ ID NO: 318613 - DNA, 20 bp, Artificial
  CRISPR gRNA sequence
ttggtgccaagttagttagt

SEQ ID NO: 318614 - DNA, 20 bp, Artificial
  CRISPR gRNA sequence
tggtgccaagttagttagtt

SEQ ID NO: 318615 - DNA, 20 bp, Artificial
  CRISPR gRNA sequence
ggtgccaagttagttagttt

SEQ ID NO: 318616 - DNA, 20 bp, Artificial
  CRISPR gRNA sequence
gtgccaagttagttagtttg

SEQ ID NO: 318617 - DNA, 20 bp, Artificial
  CRISPR gRNA sequence
gttagtttgaggaccgtctc

SEQ ID NO: 318618 - DNA, 20 bp, Artificial
  CRISPR gRNA sequence
gtttgaggaccgtctcctct

SEQ ID NO: 318619 - DNA, 20 bp, Artificial
  CRISPR gRNA sequence
gaggaccgtctcctctgaga

SEQ ID NO: 318620 - DNA, 20 bp, Artificial
  CRISPR gRNA sequence
aggaccgtctcctctgagaa

SEQ ID NO: 318621 - DNA, 20 bp, Artificial
  CRISPR gRNA sequence
ctctgagaaagggattaaca

SEQ ID NO: 318622 - DNA, 20 bp, Artificial
  CRISPR gRNA sequence
tgagaaagggattaacactg

SEQ ID NO: 318623 - DNA, 20 bp, Artificial
  CRISPR gRNA sequence
agaaagggattaacactgga

SEQ ID NO: 318624 - DNA, 20 bp, Artificial
  CRISPR gRNA sequence
acactggagtaggaggaagc

SEQ ID NO: 318625 - DNA, 20 bp, Artificial
  CRISPR gRNA sequence
gagtaggaggaagctccact

SEQ ID NO: 318626 - DNA, 20 bp, Artificial
  CRISPR gRNA sequence
cacttttggagaaattccta

SEQ ID NO: 318627 - DNA, 20 bp, Artificial
  CRISPR gRNA sequence
ttggagaaattcctaccagt

SEQ ID NO: 318628 - DNA, 20 bp, Artificial
  CRISPR gRNA sequence
tggagaaattcctaccagtt

SEQ ID NO: 318629 - DNA, 20 bp, Artificial
  CRISPR gRNA sequence
ggagaaattcctaccagtta

SEQ ID NO: 318630 - DNA, 20 bp, Artificial
  CRISPR gRNA sequence
gagaaattcctaccagttat

SEQ ID NO: 318631 - DNA, 20 bp, Artificial
  CRISPR gRNA sequence
ctaccagttatcagtaagct

SEQ ID NO: 318632 - DNA, 20 bp, Artificial
  CRISPR gRNA sequence
ccagttatcagtaagcttgt

SEQ ID NO: 318633 - DNA, 20 bp, Artificial
  CRISPR gRNA sequence
tcagtaagcttgtgtctctg

SEQ ID NO: 318634 - DNA, 20 bp, Artificial
  CRISPR gRNA sequence
gtgtctctgtggagggatct

SEQ ID NO: 318635 - DNA, 20 bp, Artificial
  CRISPR gRNA sequence
tgtctctgtggagggatctg

SEQ ID NO: 318636 - DNA, 20 bp, Artificial
  CRISPR gRNA sequence
tgtggagggatctgctgttt

SEQ ID NO: 318637 - DNA, 20 bp, Artificial
  CRISPR gRNA sequence
tggagggatctgctgtttcc

SEQ ID NO: 318638 - DNA, 20 bp, Artificial
  CRISPR gRNA sequence
ctgtttccacattggtctct

SEQ ID NO: 318639 - DNA, 20 bp, Artificial
  CRISPR gRNA sequence
tttccacattggtctcttgg

SEQ ID NO: 318640 - DNA, 20 bp, Artificial
  CRISPR gRNA sequence
ccacattggtctcttggcag

SEQ ID NO: 318641 - DNA, 20 bp, Artificial
  CRISPR gRNA sequence
cacattggtctcttggcaga

SEQ ID NO: 318642 - DNA, 20 bp, Artificial
  CRISPR gRNA sequence
gtctcttggcagaattcagc

SEQ ID NO: 318643 - DNA, 20 bp, Artificial
  CRISPR gRNA sequence
ttggcagaattcagctcctt

SEQ ID NO: 318644 - DNA, 20 bp, Artificial
  CRISPR gRNA sequence
ggcagaattcagctccttat

SEQ ID NO: 318645 - DNA, 20 bp, Artificial
  CRISPR gRNA sequence
gcagaattcagctccttata

SEQ ID NO: 318646 - DNA, 20 bp, Artificial
  CRISPR gRNA sequence
agctccttatagttgcagaa

SEQ ID NO: 318647 - DNA, 20 bp, Artificial
  CRISPR gRNA sequence
cttatagttgcagaactgag

SEQ ID NO: 318648 - DNA, 20 bp, Artificial
  CRISPR gRNA sequence
atagttgcagaactgagatc

SEQ ID NO: 318649 - DNA, 20 bp, Artificial
  CRISPR gRNA sequence
tagttgcagaactgagatcc

SEQ ID NO: 318650 - DNA, 20 bp, Artificial
  CRISPR gRNA sequence
cagaactgagatcctaattt

SEQ ID NO: 318651 - DNA, 20 bp, Artificial
  CRISPR gRNA sequence
agatcctaatttccttaatg

SEQ ID NO: 318652 - DNA, 20 bp, Artificial
  CRISPR gRNA sequence
atttccttaatggctggctg

SEQ ID NO: 318653 - DNA, 20 bp, Artificial
  CRISPR gRNA sequence
ccttaatggctggctgtcaa

SEQ ID NO: 318654 - DNA, 20 bp, Artificial
  CRISPR gRNA sequence
cttaatggctggctgtcaac

SEQ ID NO: 318655 - DNA, 20 bp, Artificial
  CRISPR gRNA sequence
aatggctggctgtcaactga

SEQ ID NO: 318656 - DNA, 20 bp, Artificial
  CRISPR gRNA sequence
atggctggctgtcaactgag

SEQ ID NO: 318657 - DNA, 20 bp, Artificial
  CRISPR gRNA sequence
gctgtcaactgagagccact

SEQ ID NO: 318658 - DNA, 20 bp, Artificial
  CRISPR gRNA sequence
tcaactgagagccacttcca

SEQ ID NO: 318659 - DNA, 20 bp, Artificial
  CRISPR gRNA sequence
agagccacttccagcttcta

SEQ ID NO: 318660 - DNA, 20 bp, Artificial
  CRISPR gRNA sequence
ccagcttctagaagctactt

SEQ ID NO: 318661 - DNA, 20 bp, Artificial
  CRISPR gRNA sequence
cagcttctagaagctactta

SEQ ID NO: 318662 - DNA, 20 bp, Artificial
  CRISPR gRNA sequence
ctagaagctacttacattcc

SEQ ID NO: 318663 - DNA, 20 bp, Artificial
  CRISPR gRNA sequence
tagaagctacttacattcct

SEQ ID NO: 318664 - DNA, 20 bp, Artificial
  CRISPR gRNA sequence
gaagctacttacattccttg

SEQ ID NO: 318665 - DNA, 20 bp, Artificial
  CRISPR gRNA sequence
cttacattccttggctcatg

SEQ ID NO: 318666 - DNA, 20 bp, Artificial
  CRISPR gRNA sequence
acattccttggctcatggct

SEQ ID NO: 318667 - DNA, 20 bp, Artificial
  CRISPR gRNA sequence
cattccttggctcatggctt

SEQ ID NO: 318668 - DNA, 20 bp, Artificial
  CRISPR gRNA sequence
cttggctcatggcttcctcc

SEQ ID NO: 318669 - DNA, 20 bp, Artificial
  CRISPR gRNA sequence
ggctcatggcttcctccttc

SEQ ID NO: 318670 - DNA, 20 bp, Artificial
  CRISPR gRNA sequence
gctcatggcttcctccttcc

SEQ ID NO: 318671 - DNA, 20 bp, Artificial
  CRISPR gRNA sequence
atggcttcctccttccatct

SEQ ID NO: 318672 - DNA, 20 bp, Artificial
  CRISPR gRNA sequence
cctccttccatcttcaaagc

SEQ ID NO: 318673 - DNA, 20 bp, Artificial
  CRISPR gRNA sequence
ctccttccatcttcaaagct

SEQ ID NO: 318674 - DNA, 20 bp, Artificial
  CRISPR gRNA sequence
cttccatcttcaaagctaga

SEQ ID NO: 318675 - DNA, 20 bp, Artificial
  CRISPR gRNA sequence
ccatcttcaaagctagaaat

SEQ ID NO: 318676 - DNA, 20 bp, Artificial
  CRISPR gRNA sequence
catcttcaaagctagaaatg

SEQ ID NO: 318677 - DNA, 20 bp, Artificial
  CRISPR gRNA sequence
caaagctagaaatgctgggt

SEQ ID NO: 318678 - DNA, 20 bp, Artificial
  CRISPR gRNA sequence
aaagctagaaatgctgggtt

SEQ ID NO: 318679 - DNA, 20 bp, Artificial
  CRISPR gRNA sequence
gaaatgctgggttgagcttc

SEQ ID NO: 318680 - DNA, 20 bp, Artificial
  CRISPR gRNA sequence
ggttgagcttctcaagtttc

SEQ ID NO: 318681 - DNA, 20 bp, Artificial
  CRISPR gRNA sequence
agcttctcaagtttcagatc

SEQ ID NO: 318682 - DNA, 20 bp, Artificial
  CRISPR gRNA sequence
ctcaagtttcagatctctcc

SEQ ID NO: 318683 - DNA, 20 bp, Artificial
  CRISPR gRNA sequence
tcaagtttcagatctctcct

SEQ ID NO: 318684 - DNA, 20 bp, Artificial
  CRISPR gRNA sequence
aagtttcagatctctccttc

SEQ ID NO: 318685 - DNA, 20 bp, Artificial
  CRISPR gRNA sequence
cagatctctccttcttccag

SEQ ID NO: 318686 - DNA, 20 bp, Artificial
  CRISPR gRNA sequence
agatctctccttcttccagt

SEQ ID NO: 318687 - DNA, 20 bp, Artificial
  CRISPR gRNA sequence
tccttcttccagttcatttc

SEQ ID NO: 318688 - DNA, 20 bp, Artificial
  CRISPR gRNA sequence
cttcttccagttcatttctc

SEQ ID NO: 318689 - DNA, 20 bp, Artificial
  CRISPR gRNA sequence
cttccagttcatttctccat

SEQ ID NO: 318690 - DNA, 20 bp, Artificial
  CRISPR gRNA sequence
ttccagttcatttctccatc

SEQ ID NO: 318691 - DNA, 20 bp, Artificial
  CRISPR gRNA sequence
ccagttcatttctccatccc

SEQ ID NO: 318692 - DNA, 20 bp, Artificial
  CRISPR gRNA sequence
cagttcatttctccatccca

SEQ ID NO: 318693 - DNA, 20 bp, Artificial
  CRISPR gRNA sequence
atttctccatcccagctagg

SEQ ID NO: 318694 - DNA, 20 bp, Artificial
  CRISPR gRNA sequence
ctccatcccagctaggaaag

SEQ ID NO: 318695 - DNA, 20 bp, Artificial
  CRISPR gRNA sequence
tccatcccagctaggaaagg

SEQ ID NO: 318696 - DNA, 20 bp, Artificial
  CRISPR gRNA sequence
catcccagctaggaaaggtt

SEQ ID NO: 318697 - DNA, 20 bp, Artificial
  CRISPR gRNA sequence
ggaaaggttctctgactcat

SEQ ID NO: 318698 - DNA, 20 bp, Artificial
  CRISPR gRNA sequence
tctgactcatgtgattacat

SEQ ID NO: 318699 - DNA, 20 bp, Artificial
  CRISPR gRNA sequence
tgactcatgtgattacattg

SEQ ID NO: 318700 - DNA, 20 bp, Artificial
  CRISPR gRNA sequence
actcatgtgattacattggg

SEQ ID NO: 318701 - DNA, 20 bp, Artificial
  CRISPR gRNA sequence
atgtgattacattgggccca

SEQ ID NO: 318702 - DNA, 20 bp, Artificial
  CRISPR gRNA sequence
cattgggcccacctggataa

SEQ ID NO: 318703 - DNA, 20 bp, Artificial
  CRISPR gRNA sequence
ggcccacctggataatccag

SEQ ID NO: 318704 - DNA, 20 bp, Artificial
  CRISPR gRNA sequence
gataatccaggttaatctca

SEQ ID NO: 318705 - DNA, 20 bp, Artificial
  CRISPR gRNA sequence
atctcaccatctcaagcttg

SEQ ID NO: 318706 - DNA, 20 bp, Artificial
  CRISPR gRNA sequence
accatctcaagcttggtgcc

SEQ ID NO: 318707 - DNA, 20 bp, Artificial
  CRISPR gRNA sequence
aagcttggtgccttaatcac

SEQ ID NO: 318708 - DNA, 20 bp, Artificial
  CRISPR gRNA sequence
ggtgccttaatcacctatgt

SEQ ID NO: 318709 - DNA, 20 bp, Artificial
  CRISPR gRNA sequence
gtgccttaatcacctatgtg

SEQ ID NO: 318710 - DNA, 20 bp, Artificial
  CRISPR gRNA sequence
aatcacctatgtgaagttcc

SEQ ID NO: 318711 - DNA, 20 bp, Artificial
  CRISPR gRNA sequence
atcacctatgtgaagttcct

SEQ ID NO: 318712 - DNA, 20 bp, Artificial
  CRISPR gRNA sequence
tgtgaagttccttttgccat

SEQ ID NO: 318713 - DNA, 20 bp, Artificial
  CRISPR gRNA sequence
cttttgccatgtaagataac

SEQ ID NO: 318714 - DNA, 20 bp, Artificial
  CRISPR gRNA sequence
ttgccatgtaagataacata

SEQ ID NO: 318715 - DNA, 20 bp, Artificial
  CRISPR gRNA sequence
tgccatgtaagataacatat

SEQ ID NO: 318716 - DNA, 20 bp, Artificial
  CRISPR gRNA sequence
gccatgtaagataacatatt

SEQ ID NO: 318717 - DNA, 20 bp, Artificial
  CRISPR gRNA sequence
ccatgtaagataacatatta

SEQ ID NO: 318718 - DNA, 20 bp, Artificial
  CRISPR gRNA sequence
caggttctggagtataggag

SEQ ID NO: 318719 - DNA, 20 bp, Artificial
  CRISPR gRNA sequence
tggagtataggaggtggacg

SEQ ID NO: 318720 - DNA, 20 bp, Artificial
  CRISPR gRNA sequence
gagtataggaggtggacgtc

SEQ ID NO: 318721 - DNA, 20 bp, Artificial
  CRISPR gRNA sequence
gtggggggcattattttacc

SEQ ID NO: 318722 - DNA, 20 bp, Artificial
  CRISPR gRNA sequence
tggggggcattattttacct

SEQ ID NO: 318723 - DNA, 20 bp, Artificial
  CRISPR gRNA sequence
ttttacctatcacatagcca

SEQ ID NO: 318724 - DNA, 20 bp, Artificial
  CRISPR gRNA sequence
tacctatcacatagccaatg

SEQ ID NO: 318725 - DNA, 20 bp, Artificial
  CRISPR gRNA sequence
acctatcacatagccaatgc

SEQ ID NO: 318726 - DNA, 20 bp, Artificial
  CRISPR gRNA sequence
cctatcacatagccaatgcc

SEQ ID NO: 318727 - DNA, 20 bp, Artificial
  CRISPR gRNA sequence
tcacatagccaatgccagga

SEQ ID NO: 318728 - DNA, 20 bp, Artificial
  CRISPR gRNA sequence
ctgaagttacagaatccaaa

SEQ ID NO: 318729 - DNA, 20 bp, Artificial
  CRISPR gRNA sequence
aagttacagaatccaaattt

SEQ ID NO: 318730 - DNA, 20 bp, Artificial
  CRISPR gRNA sequence
cagaatccaaatttacaaat

SEQ ID NO: 318731 - DNA, 20 bp, Artificial
  CRISPR gRNA sequence
acaaatatatcatatctata

SEQ ID NO: 318732 - DNA, 20 bp, Artificial
  CRISPR gRNA sequence
caaatatatcatatctataa

SEQ ID NO: 318733 - DNA, 20 bp, Artificial
  CRISPR gRNA sequence
taatggcatagttatacctg

SEQ ID NO: 318734 - DNA, 20 bp, Artificial
  CRISPR gRNA sequence
tacctgttgcacctccctcc

SEQ ID NO: 318735 - DNA, 20 bp, Artificial
  CRISPR gRNA sequence
ttgcacctccctccctacag

SEQ ID NO: 318736 - DNA, 20 bp, Artificial
  CRISPR gRNA sequence
cacctccctccctacagtga

SEQ ID NO: 318737 - DNA, 20 bp, Artificial
  CRISPR gRNA sequence
cctccctacagtgatagcaa

SEQ ID NO: 318738 - DNA, 20 bp, Artificial
  CRISPR gRNA sequence
cctacagtgatagcaaggct

SEQ ID NO: 318739 - DNA, 20 bp, Artificial
  CRISPR gRNA sequence
cagtgatagcaaggcttctc

SEQ ID NO: 318740 - DNA, 20 bp, Artificial
  CRISPR gRNA sequence
ctctctttgatcaaactcag

SEQ ID NO: 318741 - DNA, 20 bp, Artificial
  CRISPR gRNA sequence
tctctttgatcaaactcagt

SEQ ID NO: 318742 - DNA, 20 bp, Artificial
  CRISPR gRNA sequence
tctttgatcaaactcagtgg

SEQ ID NO: 318743 - DNA, 20 bp, Artificial
  CRISPR gRNA sequence
tttgatcaaactcagtggca

SEQ ID NO: 318744 - DNA, 20 bp, Artificial
  CRISPR gRNA sequence
tgatcaaactcagtggcatg

SEQ ID NO: 318745 - DNA, 20 bp, Artificial
  CRISPR gRNA sequence
gatcaaactcagtggcatgg

SEQ ID NO: 318746 - DNA, 20 bp, Artificial
  CRISPR gRNA sequence
atcaaactcagtggcatgga

SEQ ID NO: 318747 - DNA, 20 bp, Artificial
  CRISPR gRNA sequence
agtggcatggatgactgtct

SEQ ID NO: 318748 - DNA, 20 bp, Artificial
  CRISPR gRNA sequence
tctgaataaataactttttc

SEQ ID NO: 318749 - DNA, 20 bp, Artificial
  CRISPR gRNA sequence
aataaataactttttcttac

SEQ ID NO: 318750 - DNA, 20 bp, Artificial
  CRISPR gRNA sequence
tttcttaccaatattcttca

SEQ ID NO: 318751 - DNA, 20 bp, Artificial
  CRISPR gRNA sequence
ttcttaccaatattcttcat

SEQ ID NO: 318752 - DNA, 20 bp, Artificial
  CRISPR gRNA sequence
tcttaccaatattcttcatt

SEQ ID NO: 318753 - DNA, 20 bp, Artificial
  CRISPR gRNA sequence
cttaccaatattcttcatta

SEQ ID NO: 318754 - DNA, 20 bp, Artificial
  CRISPR gRNA sequence
ttaccaatattcttcattac

SEQ ID NO: 318755 - DNA, 20 bp, Artificial
  CRISPR gRNA sequence
accaatattcttcattacat

SEQ ID NO: 318756 - DNA, 20 bp, Artificial
  CRISPR gRNA sequence
ccaatattcttcattacatt

SEQ ID NO: 318757 - DNA, 20 bp, Artificial
  CRISPR gRNA sequence
ttcattacattcttaggggt

SEQ ID NO: 318758 - DNA, 20 bp, Artificial
  CRISPR gRNA sequence
cattacattcttaggggtca

SEQ ID NO: 318759 - DNA, 20 bp, Artificial
  CRISPR gRNA sequence
attacattcttaggggtcat

SEQ ID NO: 318760 - DNA, 20 bp, Artificial
  CRISPR gRNA sequence
cattcttaggggtcatgtat

SEQ ID NO: 318761 - DNA, 20 bp, Artificial
  CRISPR gRNA sequence
ttaggggtcatgtatgtgcc

SEQ ID NO: 318762 - DNA, 20 bp, Artificial
  CRISPR gRNA sequence
aggggtcatgtatgtgccac

SEQ ID NO: 318763 - DNA, 20 bp, Artificial
  CRISPR gRNA sequence
ggggtcatgtatgtgccact

SEQ ID NO: 318764 - DNA, 20 bp, Artificial
  CRISPR gRNA sequence
agcccaatctgaccatctca

SEQ ID NO: 318765 - DNA, 20 bp, Artificial
  CRISPR gRNA sequence
accatctcatctgtacctac

SEQ ID NO: 318766 - DNA, 20 bp, Artificial
  CRISPR gRNA sequence
atctgtacctacagagctta

SEQ ID NO: 318767 - DNA, 20 bp, Artificial
  CRISPR gRNA sequence
tacctacagagcttatttaa

SEQ ID NO: 318768 - DNA, 20 bp, Artificial
  CRISPR gRNA sequence
cagagcttatttaaccacct

SEQ ID NO: 318769 - DNA, 20 bp, Artificial
  CRISPR gRNA sequence
atttaaccaccttctaactt

SEQ ID NO: 318770 - DNA, 20 bp, Artificial
  CRISPR gRNA sequence
tttaaccaccttctaacttc

SEQ ID NO: 318771 - DNA, 20 bp, Artificial
  CRISPR gRNA sequence
aaccaccttctaacttctct

SEQ ID NO: 318772 - DNA, 20 bp, Artificial
  CRISPR gRNA sequence
accaccttctaacttctctc

SEQ ID NO: 318773 - DNA, 20 bp, Artificial
  CRISPR gRNA sequence
ctaacttctctcatgtgaac

SEQ ID NO: 318774 - DNA, 20 bp, Artificial
  CRISPR gRNA sequence
taacttctctcatgtgaaca

SEQ ID NO: 318775 - DNA, 20 bp, Artificial
  CRISPR gRNA sequence
acttctctcatgtgaacaca

SEQ ID NO: 318776 - DNA, 20 bp, Artificial
  CRISPR gRNA sequence
ctctcatgtgaacacacata

SEQ ID NO: 318777 - DNA, 20 bp, Artificial
  CRISPR gRNA sequence
tctcatgtgaacacacatat

SEQ ID NO: 318778 - DNA, 20 bp, Artificial
  CRISPR gRNA sequence
tcatgtgaacacacatatcc

SEQ ID NO: 318779 - DNA, 20 bp, Artificial
  CRISPR gRNA sequence
atgtgaacacacatatcctc

SEQ ID NO: 318780 - DNA, 20 bp, Artificial
  CRISPR gRNA sequence
tttatctcccctatctagtc

SEQ ID NO: 318781 - DNA, 20 bp, Artificial
  CRISPR gRNA sequence
tatctcccctatctagtctc

SEQ ID NO: 318782 - DNA, 20 bp, Artificial
  CRISPR gRNA sequence
atctcccctatctagtctcc

SEQ ID NO: 318783 - DNA, 20 bp, Artificial
  CRISPR gRNA sequence
tctcccctatctagtctcct

SEQ ID NO: 318784 - DNA, 20 bp, Artificial
  CRISPR gRNA sequence
ccctatctagtctcctgatt

SEQ ID NO: 318785 - DNA, 20 bp, Artificial
  CRISPR gRNA sequence
tctagtctcctgattttttt

SEQ ID NO: 318786 - DNA, 20 bp, Artificial
  CRISPR gRNA sequence
gtctcctgatttttttctga

SEQ ID NO: 318787 - DNA, 20 bp, Artificial
  CRISPR gRNA sequence
ctgatttttttctgattgcc

SEQ ID NO: 318788 - DNA, 20 bp, Artificial
  CRISPR gRNA sequence
atttttttctgattgcctca

SEQ ID NO: 318789 - DNA, 20 bp, Artificial
  CRISPR gRNA sequence
ttttctgattgcctcatgga

SEQ ID NO: 318790 - DNA, 20 bp, Artificial
  CRISPR gRNA sequence
tttctgattgcctcatggag

SEQ ID NO: 318791 - DNA, 20 bp, Artificial
  CRISPR gRNA sequence
ttctgattgcctcatggagg

SEQ ID NO: 318792 - DNA, 20 bp, Artificial
  CRISPR gRNA sequence
tctgattgcctcatggagga

SEQ ID NO: 318793 - DNA, 20 bp, Artificial
  CRISPR gRNA sequence
ctgattgcctcatggaggaa

SEQ ID NO: 318794 - DNA, 20 bp, Artificial
  CRISPR gRNA sequence
tgattgcctcatggaggaag

SEQ ID NO: 318795 - DNA, 20 bp, Artificial
  CRISPR gRNA sequence
attgcctcatggaggaagaa

SEQ ID NO: 318796 - DNA, 20 bp, Artificial
  CRISPR gRNA sequence
cctcatggaggaagaaacat

SEQ ID NO: 318797 - DNA, 20 bp, Artificial
  CRISPR gRNA sequence
atggaggaagaaacatcctt

SEQ ID NO: 318798 - DNA, 20 bp, Artificial
  CRISPR gRNA sequence
aatctttttctccaaccctt

SEQ ID NO: 318799 - DNA, 20 bp, Artificial
  CRISPR gRNA sequence
atctttttctccaacccttc

SEQ ID NO: 318800 - DNA, 20 bp, Artificial
  CRISPR gRNA sequence
tttctccaacccttctttgt

SEQ ID NO: 318801 - DNA, 20 bp, Artificial
  CRISPR gRNA sequence
ttctccaacccttctttgtt

SEQ ID NO: 318802 - DNA, 20 bp, Artificial
  CRISPR gRNA sequence
tctccaacccttctttgttt

SEQ ID NO: 318803 - DNA, 20 bp, Artificial
  CRISPR gRNA sequence
ctccaacccttctttgtttc

SEQ ID NO: 318804 - DNA, 20 bp, Artificial
  CRISPR gRNA sequence
tccaacccttctttgtttca

SEQ ID NO: 318805 - DNA, 20 bp, Artificial
  CRISPR gRNA sequence
caacccttctttgtttcatt

SEQ ID NO: 318806 - DNA, 20 bp, Artificial
  CRISPR gRNA sequence
ctttgtttcatttgtaagct

SEQ ID NO: 318807 - DNA, 20 bp, Artificial
  CRISPR gRNA sequence
tttgtttcatttgtaagctg

SEQ ID NO: 318808 - DNA, 20 bp, Artificial
  CRISPR gRNA sequence
tgtttcatttgtaagctgat

SEQ ID NO: 318809 - DNA, 20 bp, Artificial
  CRISPR gRNA sequence
gtttcatttgtaagctgatc

SEQ ID NO: 318810 - DNA, 20 bp, Artificial
  CRISPR gRNA sequence
tttcatttgtaagctgatca

SEQ ID NO: 318811 - DNA, 20 bp, Artificial
  CRISPR gRNA sequence
catttgtaagctgatcattc

SEQ ID NO: 318812 - DNA, 20 bp, Artificial
  CRISPR gRNA sequence
atttgtaagctgatcattct

SEQ ID NO: 318813 - DNA, 20 bp, Artificial
  CRISPR gRNA sequence
gtaagctgatcattctaatg

SEQ ID NO: 318814 - DNA, 20 bp, Artificial
  CRISPR gRNA sequence
taagctgatcattctaatgt

SEQ ID NO: 318815 - DNA, 20 bp, Artificial
  CRISPR gRNA sequence
atcattctaatgtgaagaaa

SEQ ID NO: 318816 - DNA, 20 bp, Artificial
  CRISPR gRNA sequence
taatgtgaagaaaaatctag

SEQ ID NO: 318817 - DNA, 20 bp, Artificial
  CRISPR gRNA sequence
atgtgaagaaaaatctagca

SEQ ID NO: 318818 - DNA, 20 bp, Artificial
  CRISPR gRNA sequence
gcaaacagcttattcccaag

SEQ ID NO: 318819 - DNA, 20 bp, Artificial
  CRISPR gRNA sequence
attcccaagatgtaagtcac

SEQ ID NO: 318820 - DNA, 20 bp, Artificial
  CRISPR gRNA sequence
ttcccaagatgtaagtcact

SEQ ID NO: 318821 - DNA, 20 bp, Artificial
  CRISPR gRNA sequence
ccaagatgtaagtcacttct

SEQ ID NO: 318822 - DNA, 20 bp, Artificial
  CRISPR gRNA sequence
cttcatatttgactaatttt

SEQ ID NO: 318823 - DNA, 20 bp, Artificial
  CRISPR gRNA sequence
ttcatatttgactaatttta

SEQ ID NO: 318824 - DNA, 20 bp, Artificial
  CRISPR gRNA sequence
catatttgactaattttaaa

SEQ ID NO: 318825 - DNA, 20 bp, Artificial
  CRISPR gRNA sequence
atatttgactaattttaaat

SEQ ID NO: 318826 - DNA, 20 bp, Artificial
  CRISPR gRNA sequence
gactaattttaaatggcaat

SEQ ID NO: 318827 - DNA, 20 bp, Artificial
  CRISPR gRNA sequence
actaattttaaatggcaatg

SEQ ID NO: 318828 - DNA, 20 bp, Artificial
  CRISPR gRNA sequence
attttaaatggcaatgaggt

SEQ ID NO: 318829 - DNA, 20 bp, Artificial
  CRISPR gRNA sequence
taaatggcaatgaggttgaa

SEQ ID NO: 318830 - DNA, 20 bp, Artificial
  CRISPR gRNA sequence
aaatggcaatgaggttgaaa

SEQ ID NO: 318831 - DNA, 20 bp, Artificial
  CRISPR gRNA sequence
aatggcaatgaggttgaaag

SEQ ID NO: 318832 - DNA, 20 bp, Artificial
  CRISPR gRNA sequence
aaagaaagtgaagctcaaaa

SEQ ID NO: 318833 - DNA, 20 bp, Artificial
  CRISPR gRNA sequence
aaaactctcaccttgaaaag

SEQ ID NO: 318834 - DNA, 20 bp, Artificial
  CRISPR gRNA sequence
tcaccttgaaaagtcaaagc

SEQ ID NO: 318835 - DNA, 20 bp, Artificial
  CRISPR gRNA sequence
accttgaaaagtcaaagcct

SEQ ID NO: 318836 - DNA, 20 bp, Artificial
  CRISPR gRNA sequence
gaaaagtcaaagcctggaca

SEQ ID NO: 318837 - DNA, 20 bp, Artificial
  CRISPR gRNA sequence
aaaagtcaaagcctggacaa

SEQ ID NO: 318838 - DNA, 20 bp, Artificial
  CRISPR gRNA sequence
gacaagcatgatatgtcttt

SEQ ID NO: 318839 - DNA, 20 bp, Artificial
  CRISPR gRNA sequence
tacatctgtgctaggaattt

SEQ ID NO: 318840 - DNA, 20 bp, Artificial
  CRISPR gRNA sequence
acatctgtgctaggaatttt

SEQ ID NO: 318841 - DNA, 20 bp, Artificial
  CRISPR gRNA sequence
catctgtgctaggaatttta

SEQ ID NO: 318842 - DNA, 20 bp, Artificial
  CRISPR gRNA sequence
tgctaggaattttatacttt

SEQ ID NO: 318843 - DNA, 20 bp, Artificial
  CRISPR gRNA sequence
ggaattttatacttttatat

SEQ ID NO: 318844 - DNA, 20 bp, Artificial
  CRISPR gRNA sequence
tatacttttatatcatagaa

SEQ ID NO: 318845 - DNA, 20 bp, Artificial
  CRISPR gRNA sequence
atacttttatatcatagaaa

SEQ ID NO: 318846 - DNA, 20 bp, Artificial
  CRISPR gRNA sequence
tacttttatatcatagaaat

SEQ ID NO: 318847 - DNA, 20 bp, Artificial
  CRISPR gRNA sequence
ttatatcatagaaatctcgc

SEQ ID NO: 318848 - DNA, 20 bp, Artificial
  CRISPR gRNA sequence
tatatcatagaaatctcgca

SEQ ID NO: 318849 - DNA, 20 bp, Artificial
  CRISPR gRNA sequence
atatcatagaaatctcgcag

SEQ ID NO: 318850 - DNA, 20 bp, Artificial
  CRISPR gRNA sequence
tatcatagaaatctcgcagc

SEQ ID NO: 318851 - DNA, 20 bp, Artificial
  CRISPR gRNA sequence
gcagcacactccatacattg

SEQ ID NO: 318852 - DNA, 20 bp, Artificial
  CRISPR gRNA sequence
catacattggcagtttgaat

SEQ ID NO: 318853 - DNA, 20 bp, Artificial
  CRISPR gRNA sequence
gcagtttgaatggctctgcc

SEQ ID NO: 318854 - DNA, 20 bp, Artificial
  CRISPR gRNA sequence
gaatggctctgccacatgct

SEQ ID NO: 318855 - DNA, 20 bp, Artificial
  CRISPR gRNA sequence
aatggctctgccacatgctt

SEQ ID NO: 318856 - DNA, 20 bp, Artificial
  CRISPR gRNA sequence
tgccacatgctttgtgttaa

SEQ ID NO: 318857 - DNA, 20 bp, Artificial
  CRISPR gRNA sequence
ccacatgctttgtgttaatt

SEQ ID NO: 318858 - DNA, 20 bp, Artificial
  CRISPR gRNA sequence
tgtgttaatttatttaaatt

SEQ ID NO: 318859 - DNA, 20 bp, Artificial
  CRISPR gRNA sequence
gtgttaatttatttaaattc

SEQ ID NO: 318860 - DNA, 20 bp, Artificial
  CRISPR gRNA sequence
tgttaatttatttaaattcg

SEQ ID NO: 318861 - DNA, 20 bp, Artificial
  CRISPR gRNA sequence
atttatttaaattcgatcgt

SEQ ID NO: 318862 - DNA, 20 bp, Artificial
  CRISPR gRNA sequence
atttaaattcgatcgttgct

SEQ ID NO: 318863 - DNA, 20 bp, Artificial
  CRISPR gRNA sequence
tttaaattcgatcgttgctc

SEQ ID NO: 318864 - DNA, 20 bp, Artificial
  CRISPR gRNA sequence
aaattcgatcgttgctcccc

SEQ ID NO: 318865 - DNA, 20 bp, Artificial
  CRISPR gRNA sequence
aattcgatcgttgctcccca

SEQ ID NO: 318866 - DNA, 20 bp, Artificial
  CRISPR gRNA sequence
gatcgttgctccccaatttc

SEQ ID NO: 318867 - DNA, 20 bp, Artificial
  CRISPR gRNA sequence
ctccccaatttcttattttt

SEQ ID NO: 318868 - DNA, 20 bp, Artificial
  CRISPR gRNA sequence
cccaatttcttatttttaaa

SEQ ID NO: 318869 - DNA, 20 bp, Artificial
  CRISPR gRNA sequence
cttatttttaaagtacagca

SEQ ID NO: 318870 - DNA, 20 bp, Artificial
  CRISPR gRNA sequence
ttatttttaaagtacagcag

SEQ ID NO: 318871 - DNA, 20 bp, Artificial
  CRISPR gRNA sequence
atttttaaagtacagcagga

SEQ ID NO: 318872 - DNA, 20 bp, Artificial
  CRISPR gRNA sequence
tttttaaagtacagcaggat

SEQ ID NO: 318873 - DNA, 20 bp, Artificial
  CRISPR gRNA sequence
ttaaagtacagcaggatgca

SEQ ID NO: 318874 - DNA, 20 bp, Artificial
  CRISPR gRNA sequence
taaagtacagcaggatgcat

SEQ ID NO: 318875 - DNA, 20 bp, Artificial
  CRISPR gRNA sequence
aaagtacagcaggatgcatt

SEQ ID NO: 318876 - DNA, 20 bp, Artificial
  CRISPR gRNA sequence
aagtacagcaggatgcattg

SEQ ID NO: 318877 - DNA, 20 bp, Artificial
  CRISPR gRNA sequence
aatgactgctaatgtcatcc

SEQ ID NO: 318878 - DNA, 20 bp, Artificial
  CRISPR gRNA sequence
ctaatgtcatccatctattt

SEQ ID NO: 318879 - DNA, 20 bp, Artificial
  CRISPR gRNA sequence
atgtcatccatctattttct

SEQ ID NO: 318880 - DNA, 20 bp, Artificial
  CRISPR gRNA sequence
ttttctagttagattttaaa

SEQ ID NO: 318881 - DNA, 20 bp, Artificial
  CRISPR gRNA sequence
tctagttagattttaaaatc

SEQ ID NO: 318882 - DNA, 20 bp, Artificial
  CRISPR gRNA sequence
ctagttagattttaaaatca

SEQ ID NO: 318883 - DNA, 20 bp, Artificial
  CRISPR gRNA sequence
tagttagattttaaaatcag

SEQ ID NO: 318884 - DNA, 20 bp, Artificial
  CRISPR gRNA sequence
gttagattttaaaatcagta

SEQ ID NO: 318885 - DNA, 20 bp, Artificial
  CRISPR gRNA sequence
gattttaaaatcagtatact

SEQ ID NO: 318886 - DNA, 20 bp, Artificial
  CRISPR gRNA sequence
taaaatcagtatactgaaaa

SEQ ID NO: 318887 - DNA, 20 bp, Artificial
  CRISPR gRNA sequence
aaaatcagtatactgaaaaa

SEQ ID NO: 318888 - DNA, 20 bp, Artificial
  CRISPR gRNA sequence
aaatcagtatactgaaaaac

SEQ ID NO: 318889 - DNA, 20 bp, Artificial
  CRISPR gRNA sequence
aaaaacaagatgctggccag

SEQ ID NO: 318890 - DNA, 20 bp, Artificial
  CRISPR gRNA sequence
gccagaggcaatactcatct

SEQ ID NO: 318891 - DNA, 20 bp, Artificial
  CRISPR gRNA sequence
atcttgtgctttctaccata

SEQ ID NO: 318892 - DNA, 20 bp, Artificial
  CRISPR gRNA sequence
gtgctttctaccataagtga

SEQ ID NO: 318893 - DNA, 20 bp, Artificial
  CRISPR gRNA sequence
tgctttctaccataagtgag

SEQ ID NO: 318894 - DNA, 20 bp, Artificial
  CRISPR gRNA sequence
tctaccataagtgagttaga

SEQ ID NO: 318895 - DNA, 20 bp, Artificial
  CRISPR gRNA sequence
ctaccataagtgagttagaa

SEQ ID NO: 318896 - DNA, 20 bp, Artificial
  CRISPR gRNA sequence
taccataagtgagttagaag

SEQ ID NO: 318897 - DNA, 20 bp, Artificial
  CRISPR gRNA sequence
ccataagtgagttagaaggt

SEQ ID NO: 318898 - DNA, 20 bp, Artificial
  CRISPR gRNA sequence
gaaggttaccttaattatta

SEQ ID NO: 318899 - DNA, 20 bp, Artificial
  CRISPR gRNA sequence
ccttaattattagcaccaat

SEQ ID NO: 318900 - DNA, 20 bp, Artificial
  CRISPR gRNA sequence
aattattagcaccaatcaaa

SEQ ID NO: 318901 - DNA, 20 bp, Artificial
  CRISPR gRNA sequence
attattagcaccaatcaaac

SEQ ID NO: 318902 - DNA, 20 bp, Artificial
  CRISPR gRNA sequence
ttagcaccaatcaaactaat

SEQ ID NO: 318903 - DNA, 20 bp, Artificial
  CRISPR gRNA sequence
gcaccaatcaaactaattac

SEQ ID NO: 318904 - DNA, 20 bp, Artificial
  CRISPR gRNA sequence
attactactggaggcaatta

SEQ ID NO: 318905 - DNA, 20 bp, Artificial
  CRISPR gRNA sequence
ctactggaggcaattactga

SEQ ID NO: 318906 - DNA, 20 bp, Artificial
  CRISPR gRNA sequence
ctggaggcaattactgagat

SEQ ID NO: 318907 - DNA, 20 bp, Artificial
  CRISPR gRNA sequence
gaggcaattactgagataaa

SEQ ID NO: 318908 - DNA, 20 bp, Artificial
  CRISPR gRNA sequence
ctgagataaagtccaatctt

SEQ ID NO: 318909 - DNA, 20 bp, Artificial
  CRISPR gRNA sequence
agataaagtccaatcttagc

SEQ ID NO: 318910 - DNA, 20 bp, Artificial
  CRISPR gRNA sequence
agcttagaaccagaccaaac

SEQ ID NO: 318911 - DNA, 20 bp, Artificial
  CRISPR gRNA sequence
gcttagaaccagaccaaact

SEQ ID NO: 318912 - DNA, 20 bp, Artificial
  CRISPR gRNA sequence
agaaccagaccaaactacaa

SEQ ID NO: 318913 - DNA, 20 bp, Artificial
  CRISPR gRNA sequence
gaaccagaccaaactacaaa

SEQ ID NO: 318914 - DNA, 20 bp, Artificial
  CRISPR gRNA sequence
caaaaaggcatggcattatt

SEQ ID NO: 318915 - DNA, 20 bp, Artificial
  CRISPR gRNA sequence
ttataaagttagggaccact

SEQ ID NO: 318916 - DNA, 20 bp, Artificial
  CRISPR gRNA sequence
taaagttagggaccactttg

SEQ ID NO: 318917 - DNA, 20 bp, Artificial
  CRISPR gRNA sequence
gggaccactttgtccccatg

SEQ ID NO: 318918 - DNA, 20 bp, Artificial
  CRISPR gRNA sequence
tgtccccatgaaacattttt

SEQ ID NO: 318919 - DNA, 20 bp, Artificial
  CRISPR gRNA sequence
gtccccatgaaacattttta

SEQ ID NO: 318920 - DNA, 20 bp, Artificial
  CRISPR gRNA sequence
tccccatgaaacatttttat

SEQ ID NO: 318921 - DNA, 20 bp, Artificial
  CRISPR gRNA sequence
ttataacagaagtcagtggg

SEQ ID NO: 318922 - DNA, 20 bp, Artificial
  CRISPR gRNA sequence
tataacagaagtcagtgggg

SEQ ID NO: 318923 - DNA, 20 bp, Artificial
  CRISPR gRNA sequence
ataacagaagtcagtgggga

SEQ ID NO: 318924 - DNA, 20 bp, Artificial
  CRISPR gRNA sequence
taacagaagtcagtggggag

SEQ ID NO: 318925 - DNA, 20 bp, Artificial
  CRISPR gRNA sequence
ataataacaaaactattgga

SEQ ID NO: 318926 - DNA, 20 bp, Artificial
  CRISPR gRNA sequence
taataacaaaactattggac

SEQ ID NO: 318927 - DNA, 20 bp, Artificial
  CRISPR gRNA sequence
ttggactaactcaagtgtcc

SEQ ID NO: 318928 - DNA, 20 bp, Artificial
  CRISPR gRNA sequence
gactaactcaagtgtccaaa

SEQ ID NO: 318929 - DNA, 20 bp, Artificial
  CRISPR gRNA sequence
actcaagtgtccaaaaaatg

SEQ ID NO: 318930 - DNA, 20 bp, Artificial
  CRISPR gRNA sequence
aagtgtccaaaaaatgaggt

SEQ ID NO: 318931 - DNA, 20 bp, Artificial
  CRISPR gRNA sequence
gttaaataaataaattatgg

SEQ ID NO: 318932 - DNA, 20 bp, Artificial
  CRISPR gRNA sequence
aataaataaattatggtgta

SEQ ID NO: 318933 - DNA, 20 bp, Artificial
  CRISPR gRNA sequence
tggtgtatccacaaaaggga

SEQ ID NO: 318934 - DNA, 20 bp, Artificial
  CRISPR gRNA sequence
gcagccattaaaaatgatgc

SEQ ID NO: 318935 - DNA, 20 bp, Artificial
  CRISPR gRNA sequence
cagccattaaaaatgatgct

SEQ ID NO: 318936 - DNA, 20 bp, Artificial
  CRISPR gRNA sequence
aaaatgatgctgtagaatga

SEQ ID NO: 318937 - DNA, 20 bp, Artificial
  CRISPR gRNA sequence
tagaatgatatttatgacat

SEQ ID NO: 318938 - DNA, 20 bp, Artificial
  CRISPR gRNA sequence
atgacattgaaaattgtctt

SEQ ID NO: 318939 - DNA, 20 bp, Artificial
  CRISPR gRNA sequence
tgacattgaaaattgtcttg

SEQ ID NO: 318940 - DNA, 20 bp, Artificial
  CRISPR gRNA sequence
aaaattgtcttgctacattt

SEQ ID NO: 318941 - DNA, 20 bp, Artificial
  CRISPR gRNA sequence
tcttgctacatttagtataa

SEQ ID NO: 318942 - DNA, 20 bp, Artificial
  CRISPR gRNA sequence
gctacatttagtataacaaa

SEQ ID NO: 318943 - DNA, 20 bp, Artificial
  CRISPR gRNA sequence
ctacatttagtataacaaaa

SEQ ID NO: 318944 - DNA, 20 bp, Artificial
  CRISPR gRNA sequence
catttagtataacaaaatta

SEQ ID NO: 318945 - DNA, 20 bp, Artificial
  CRISPR gRNA sequence
agtataacaaaattagaaca

SEQ ID NO: 318946 - DNA, 20 bp, Artificial
  CRISPR gRNA sequence
gtataacaaaattagaacac

SEQ ID NO: 318947 - DNA, 20 bp, Artificial
  CRISPR gRNA sequence
gaacacagtacatatattat

SEQ ID NO: 318948 - DNA, 20 bp, Artificial
  CRISPR gRNA sequence
tccaaattgtgaaaaataac

SEQ ID NO: 318949 - DNA, 20 bp, Artificial
  CRISPR gRNA sequence
tgaaaaataacccttatgat

SEQ ID NO: 318950 - DNA, 20 bp, Artificial
  CRISPR gRNA sequence
atgataatcctaattatgga

SEQ ID NO: 318951 - DNA, 20 bp, Artificial
  CRISPR gRNA sequence
tgataatcctaattatggaa

SEQ ID NO: 318952 - DNA, 20 bp, Artificial
  CRISPR gRNA sequence
attatggaaaacaacataga

SEQ ID NO: 318953 - DNA, 20 bp, Artificial
  CRISPR gRNA sequence
tggaaaacaacatagattga

SEQ ID NO: 318954 - DNA, 20 bp, Artificial
  CRISPR gRNA sequence
atacacagaaaaatcttaaa

SEQ ID NO: 318955 - DNA, 20 bp, Artificial
  CRISPR gRNA sequence
aaagataggcaccaaaaata

SEQ ID NO: 318956 - DNA, 20 bp, Artificial
  CRISPR gRNA sequence
aagataggcaccaaaaatat

SEQ ID NO: 318957 - DNA, 20 bp, Artificial
  CRISPR gRNA sequence
gtgtaatcattttttcttat

SEQ ID NO: 318958 - DNA, 20 bp, Artificial
  CRISPR gRNA sequence
tgtaatcattttttcttatt

SEQ ID NO: 318959 - DNA, 20 bp, Artificial
  CRISPR gRNA sequence
tttcttattagtggagttat

SEQ ID NO: 318960 - DNA, 20 bp, Artificial
  CRISPR gRNA sequence
ttcttattagtggagttata

SEQ ID NO: 318961 - DNA, 20 bp, Artificial
  CRISPR gRNA sequence
tcttattagtggagttatag

SEQ ID NO: 318962 - DNA, 20 bp, Artificial
  CRISPR gRNA sequence
cttattagtggagttataga

SEQ ID NO: 318963 - DNA, 20 bp, Artificial
  CRISPR gRNA sequence
ttattagtggagttatagat

SEQ ID NO: 318964 - DNA, 20 bp, Artificial
  CRISPR gRNA sequence
attagtggagttatagatta

SEQ ID NO: 318965 - DNA, 20 bp, Artificial
  CRISPR gRNA sequence
ttagtggagttatagattat

SEQ ID NO: 318966 - DNA, 20 bp, Artificial
  CRISPR gRNA sequence
gtggagttatagattatttt

SEQ ID NO: 318967 - DNA, 20 bp, Artificial
  CRISPR gRNA sequence
tagattattttatttttggt

SEQ ID NO: 318968 - DNA, 20 bp, Artificial
  CRISPR gRNA sequence
ttttatttttggtatatatg

SEQ ID NO: 318969 - DNA, 20 bp, Artificial
  CRISPR gRNA sequence
tatttttggtatatatgata

SEQ ID NO: 318970 - DNA, 20 bp, Artificial
  CRISPR gRNA sequence
atttttggtatatatgataa

SEQ ID NO: 318971 - DNA, 20 bp, Artificial
  CRISPR gRNA sequence
tttttggtatatatgataat

SEQ ID NO: 318972 - DNA, 20 bp, Artificial
  CRISPR gRNA sequence
ttggtatatatgataatgga

SEQ ID NO: 318973 - DNA, 20 bp, Artificial
  CRISPR gRNA sequence
tggtatatatgataatggat

SEQ ID NO: 318974 - DNA, 20 bp, Artificial
  CRISPR gRNA sequence
ggtatatatgataatggata

SEQ ID NO: 318975 - DNA, 20 bp, Artificial
  CRISPR gRNA sequence
gtatatatgataatggatat

SEQ ID NO: 318976 - DNA, 20 bp, Artificial
  CRISPR gRNA sequence
cttagaaattagttaaagtt

SEQ ID NO: 318977 - DNA, 20 bp, Artificial
  CRISPR gRNA sequence
agaaattagttaaagttaat

SEQ ID NO: 318978 - DNA, 20 bp, Artificial
  CRISPR gRNA sequence
gaaattagttaaagttaata

SEQ ID NO: 318979 - DNA, 20 bp, Artificial
  CRISPR gRNA sequence
gttaaagttaatattgtttg

SEQ ID NO: 318980 - DNA, 20 bp, Artificial
  CRISPR gRNA sequence
aagttaatattgtttgttat

SEQ ID NO: 318981 - DNA, 20 bp, Artificial
  CRISPR gRNA sequence
atattgtttgttataagtca

SEQ ID NO: 318982 - DNA, 20 bp, Artificial
  CRISPR gRNA sequence
tttgttataagtcaatgggc

SEQ ID NO: 318983 - DNA, 20 bp, Artificial
  CRISPR gRNA sequence
gttataagtcaatgggcaat

SEQ ID NO: 318984 - DNA, 20 bp, Artificial
  CRISPR gRNA sequence
ttataagtcaatgggcaata

SEQ ID NO: 318985 - DNA, 20 bp, Artificial
  CRISPR gRNA sequence
taagtcaatgggcaataatt

SEQ ID NO: 318986 - DNA, 20 bp, Artificial
  CRISPR gRNA sequence
atctaacttatttcataaga

SEQ ID NO: 318987 - DNA, 20 bp, Artificial
  CRISPR gRNA sequence
acttatttcataagaaacct

SEQ ID NO: 318988 - DNA, 20 bp, Artificial
  CRISPR gRNA sequence
atttcataagaaacctagat

SEQ ID NO: 318989 - DNA, 20 bp, Artificial
  CRISPR gRNA sequence
tttcataagaaacctagatt

SEQ ID NO: 318990 - DNA, 20 bp, Artificial
  CRISPR gRNA sequence
cataagaaacctagattttt

SEQ ID NO: 318991 - DNA, 20 bp, Artificial
  CRISPR gRNA sequence
ataagaaacctagatttttt

SEQ ID NO: 318992 - DNA, 20 bp, Artificial
  CRISPR gRNA sequence
gatttttttagagacgagaa

SEQ ID NO: 318993 - DNA, 20 bp, Artificial
  CRISPR gRNA sequence
ttttagagacgagaagctga

SEQ ID NO: 318994 - DNA, 20 bp, Artificial
  CRISPR gRNA sequence
tttagagacgagaagctgat

SEQ ID NO: 318995 - DNA, 20 bp, Artificial
  CRISPR gRNA sequence
ttagagacgagaagctgatt

SEQ ID NO: 318996 - DNA, 20 bp, Artificial
  CRISPR gRNA sequence
tagagacgagaagctgattc

SEQ ID NO: 318997 - DNA, 20 bp, Artificial
  CRISPR gRNA sequence
agagacgagaagctgattct

SEQ ID NO: 318998 - DNA, 20 bp, Artificial
  CRISPR gRNA sequence
gagacgagaagctgattctt

SEQ ID NO: 318999 - DNA, 20 bp, Artificial
  CRISPR gRNA sequence
attcttgtggtcatttagca

SEQ ID NO: 319000 - DNA, 20 bp, Artificial
  CRISPR gRNA sequence
ttgtggtcatttagcaaata

SEQ ID NO: 319001 - DNA, 20 bp, Artificial
  CRISPR gRNA sequence
gtggtcatttagcaaatatc

SEQ ID NO: 319002 - DNA, 20 bp, Artificial
  CRISPR gRNA sequence
tggtcatttagcaaatatcc

SEQ ID NO: 319003 - DNA, 20 bp, Artificial
  CRISPR gRNA sequence
agcaaatatccctgcttaaa

SEQ ID NO: 319004 - DNA, 20 bp, Artificial
  CRISPR gRNA sequence
gcaaatatccctgcttaaac

SEQ ID NO: 319005 - DNA, 20 bp, Artificial
  CRISPR gRNA sequence
cttaaacaccaccaggtcca

SEQ ID NO: 319006 - DNA, 20 bp, Artificial
  CRISPR gRNA sequence
aaacaccaccaggtccacaa

SEQ ID NO: 319007 - DNA, 20 bp, Artificial
  CRISPR gRNA sequence
aacaccaccaggtccacaat

SEQ ID NO: 319008 - DNA, 20 bp, Artificial
  CRISPR gRNA sequence
taacatttaggagtggtttc

SEQ ID NO: 319009 - DNA, 20 bp, Artificial
  CRISPR gRNA sequence
aacatttaggagtggtttca

SEQ ID NO: 319010 - DNA, 20 bp, Artificial
  CRISPR gRNA sequence
acatttaggagtggtttcac

SEQ ID NO: 319011 - DNA, 20 bp, Artificial
  CRISPR gRNA sequence
aggagtggtttcaccatttt

SEQ ID NO: 319012 - DNA, 20 bp, Artificial
  CRISPR gRNA sequence
ggagtggtttcaccatttta

SEQ ID NO: 319013 - DNA, 20 bp, Artificial
  CRISPR gRNA sequence
caccattttactttatgtat

SEQ ID NO: 319014 - DNA, 20 bp, Artificial
  CRISPR gRNA sequence
accattttactttatgtata

SEQ ID NO: 319015 - DNA, 20 bp, Artificial
  CRISPR gRNA sequence
tactttatgtatatgtcaca

SEQ ID NO: 319016 - DNA, 20 bp, Artificial
  CRISPR gRNA sequence
actttatgtatatgtcacag

SEQ ID NO: 319017 - DNA, 20 bp, Artificial
  CRISPR gRNA sequence
ctttatgtatatgtcacagt

SEQ ID NO: 319018 - DNA, 20 bp, Artificial
  CRISPR gRNA sequence
tatgtatatgtcacagtaac

SEQ ID NO: 319019 - DNA, 20 bp, Artificial
  CRISPR gRNA sequence
atgtatatgtcacagtaacc

SEQ ID NO: 319020 - DNA, 20 bp, Artificial
  CRISPR gRNA sequence
tgtatatgtcacagtaacct

SEQ ID NO: 319021 - DNA, 20 bp, Artificial
  CRISPR gRNA sequence
atgaagtgaggtagataaag

SEQ ID NO: 319022 - DNA, 20 bp, Artificial
  CRISPR gRNA sequence
tccctggaaaccagaagtac

SEQ ID NO: 319023 - DNA, 20 bp, Artificial
  CRISPR gRNA sequence
ccctggaaaccagaagtaca

SEQ ID NO: 319024 - DNA, 20 bp, Artificial
  CRISPR gRNA sequence
cctggaaaccagaagtacat

SEQ ID NO: 319025 - DNA, 20 bp, Artificial
  CRISPR gRNA sequence
gaaaccagaagtacatttgt

SEQ ID NO: 319026 - DNA, 20 bp, Artificial
  CRISPR gRNA sequence
gtaaaccagaggttagaaat

SEQ ID NO: 319027 - DNA, 20 bp, Artificial
  CRISPR gRNA sequence
taaaccagaggttagaaatg

SEQ ID NO: 319028 - DNA, 20 bp, Artificial
  CRISPR gRNA sequence
gaaatgtcgcctttctttga

SEQ ID NO: 319029 - DNA, 20 bp, Artificial
  CRISPR gRNA sequence
tctttgaagtccaagagcag

SEQ ID NO: 319030 - DNA, 20 bp, Artificial
  CRISPR gRNA sequence
ctttgaagtccaagagcagc

SEQ ID NO: 319031 - DNA, 20 bp, Artificial
  CRISPR gRNA sequence
tttgaagtccaagagcagca

SEQ ID NO: 319032 - DNA, 20 bp, Artificial
  CRISPR gRNA sequence
tgaagtccaagagcagcatt

SEQ ID NO: 319033 - DNA, 20 bp, Artificial
  CRISPR gRNA sequence
gaagtccaagagcagcatta

SEQ ID NO: 319034 - DNA, 20 bp, Artificial
  CRISPR gRNA sequence
aagtccaagagcagcattat

SEQ ID NO: 319035 - DNA, 20 bp, Artificial
  CRISPR gRNA sequence
tctgctactgccagtctgta

SEQ ID NO: 319036 - DNA, 20 bp, Artificial
  CRISPR gRNA sequence
ctactgccagtctgtatagg

SEQ ID NO: 319037 - DNA, 20 bp, Artificial
  CRISPR gRNA sequence
ctgccagtctgtataggctc

SEQ ID NO: 319038 - DNA, 20 bp, Artificial
  CRISPR gRNA sequence
ccagtctgtataggctcaaa

SEQ ID NO: 319039 - DNA, 20 bp, Artificial
  CRISPR gRNA sequence
tataggctcaaaactccaag

SEQ ID NO: 319040 - DNA, 20 bp, Artificial
  CRISPR gRNA sequence
aaaactccaagggaaaacct

SEQ ID NO: 319041 - DNA, 20 bp, Artificial
  CRISPR gRNA sequence
caagggaaaaccttttttcc

SEQ ID NO: 319042 - DNA, 20 bp, Artificial
  CRISPR gRNA sequence
ttttcccaacaacttcctga

SEQ ID NO: 319043 - DNA, 20 bp, Artificial
  CRISPR gRNA sequence
tttcccaacaacttcctgac

SEQ ID NO: 319044 - DNA, 20 bp, Artificial
  CRISPR gRNA sequence
ttcccaacaacttcctgact

SEQ ID NO: 319045 - DNA, 20 bp, Artificial
  CRISPR gRNA sequence
tcccaacaacttcctgactt

SEQ ID NO: 319046 - DNA, 20 bp, Artificial
  CRISPR gRNA sequence
cccaacaacttcctgacttt

SEQ ID NO: 319047 - DNA, 20 bp, Artificial
  CRISPR gRNA sequence
ccaacaacttcctgactttt

SEQ ID NO: 319048 - DNA, 20 bp, Artificial
  CRISPR gRNA sequence
cctgactttttgccagtcta

SEQ ID NO: 319049 - DNA, 20 bp, Artificial
  CRISPR gRNA sequence
ctgactttttgccagtctag

SEQ ID NO: 319050 - DNA, 20 bp, Artificial
  CRISPR gRNA sequence
actttttgccagtctaggct

SEQ ID NO: 319051 - DNA, 20 bp, Artificial
  CRISPR gRNA sequence
tttgccagtctaggctcagc

SEQ ID NO: 319052 - DNA, 20 bp, Artificial
  CRISPR gRNA sequence
ttgccagtctaggctcagcc

SEQ ID NO: 319053 - DNA, 20 bp, Artificial
  CRISPR gRNA sequence
tgccagtctaggctcagcca

SEQ ID NO: 319054 - DNA, 20 bp, Artificial
  CRISPR gRNA sequence
gccagtctaggctcagccaa

SEQ ID NO: 319055 - DNA, 20 bp, Artificial
  CRISPR gRNA sequence
ccagtctaggctcagccaac

SEQ ID NO: 319056 - DNA, 20 bp, Artificial
  CRISPR gRNA sequence
ggctcagccaacaagctccg

SEQ ID NO: 319057 - DNA, 20 bp, Artificial
  CRISPR gRNA sequence
agccaacaagctccggaagg

SEQ ID NO: 319058 - DNA, 20 bp, Artificial
  CRISPR gRNA sequence
cggaaggcagccagccgatt

SEQ ID NO: 319059 - DNA, 20 bp, Artificial
  CRISPR gRNA sequence
ggaagtaggtgcaaagtgac

SEQ ID NO: 319060 - DNA, 20 bp, Artificial
  CRISPR gRNA sequence
tggggaggacaaggactcac

SEQ ID NO: 319061 - DNA, 20 bp, Artificial
  CRISPR gRNA sequence
actcaccacatttataagag

SEQ ID NO: 319062 - DNA, 20 bp, Artificial
  CRISPR gRNA sequence
accacatttataagagttgc

SEQ ID NO: 319063 - DNA, 20 bp, Artificial
  CRISPR gRNA sequence
ataagagttgcgaggccgct

SEQ ID NO: 319064 - DNA, 20 bp, Artificial
  CRISPR gRNA sequence
taagagttgcgaggccgctt

SEQ ID NO: 319065 - DNA, 20 bp, Artificial
  CRISPR gRNA sequence
cgaggccgcttcttcttctt

SEQ ID NO: 319066 - DNA, 20 bp, Artificial
  CRISPR gRNA sequence
cttcttcttccatttccata

SEQ ID NO: 319067 - DNA, 20 bp, Artificial
  CRISPR gRNA sequence
ttcttcttccatttccatag

SEQ ID NO: 319068 - DNA, 20 bp, Artificial
  CRISPR gRNA sequence
cttcttccatttccatagaa

SEQ ID NO: 319069 - DNA, 20 bp, Artificial
  CRISPR gRNA sequence
ttcttccatttccatagaat

SEQ ID NO: 319070 - DNA, 20 bp, Artificial
  CRISPR gRNA sequence
cttccatttccatagaatta

SEQ ID NO: 319071 - DNA, 20 bp, Artificial
  CRISPR gRNA sequence
ttccatttccatagaattag

SEQ ID NO: 319072 - DNA, 20 bp, Artificial
  CRISPR gRNA sequence
ccatttccatagaattagac

SEQ ID NO: 319073 - DNA, 20 bp, Artificial
  CRISPR gRNA sequence
catttccatagaattagaca

SEQ ID NO: 319074 - DNA, 20 bp, Artificial
  CRISPR gRNA sequence
ccatagaattagacagaaaa

SEQ ID NO: 319075 - DNA, 20 bp, Artificial
  CRISPR gRNA sequence
catagaattagacagaaaac

SEQ ID NO: 319076 - DNA, 20 bp, Artificial
  CRISPR gRNA sequence
gacagaaaaccatcacacat

SEQ ID NO: 319077 - DNA, 20 bp, Artificial
  CRISPR gRNA sequence
ttggaagtacagctgtaatc

SEQ ID NO: 319078 - DNA, 20 bp, Artificial
  CRISPR gRNA sequence
gaagtacagctgtaatccaa

SEQ ID NO: 319079 - DNA, 20 bp, Artificial
  CRISPR gRNA sequence
taatccaaggaatgtggtct

SEQ ID NO: 319080 - DNA, 20 bp, Artificial
  CRISPR gRNA sequence
ggggaggctgagggtcctca

SEQ ID NO: 319081 - DNA, 20 bp, Artificial
  CRISPR gRNA sequence
agggtcctcaagctctacaa

SEQ ID NO: 319082 - DNA, 20 bp, Artificial
  CRISPR gRNA sequence
aagctctacaaatgaccaca

SEQ ID NO: 319083 - DNA, 20 bp, Artificial
  CRISPR gRNA sequence
tacaaatgaccacaaatttt

SEQ ID NO: 319084 - DNA, 20 bp, Artificial
  CRISPR gRNA sequence
caaatgaccacaaattttca

SEQ ID NO: 319085 - DNA, 20 bp, Artificial
  CRISPR gRNA sequence
tcaatcagccaggagagtca

SEQ ID NO: 319086 - DNA, 20 bp, Artificial
  CRISPR gRNA sequence
caatcagccaggagagtcat

SEQ ID NO: 319087 - DNA, 20 bp, Artificial
  CRISPR gRNA sequence
aatcagccaggagagtcatt

SEQ ID NO: 319088 - DNA, 20 bp, Artificial
  CRISPR gRNA sequence
acaaaaggtttctgctagct

SEQ ID NO: 319089 - DNA, 20 bp, Artificial
  CRISPR gRNA sequence
caaaaggtttctgctagctg

SEQ ID NO: 319090 - DNA, 20 bp, Artificial
  CRISPR gRNA sequence
ctgctagctgctcttctctt

SEQ ID NO: 319091 - DNA, 20 bp, Artificial
  CRISPR gRNA sequence
tgctagctgctcttctcttt

SEQ ID NO: 319092 - DNA, 20 bp, Artificial
  CRISPR gRNA sequence
ctagctgctcttctctttat

SEQ ID NO: 319093 - DNA, 20 bp, Artificial
  CRISPR gRNA sequence
gctgctcttctctttattta

SEQ ID NO: 319094 - DNA, 20 bp, Artificial
  CRISPR gRNA sequence
ctcttctctttatttacctg

SEQ ID NO: 319095 - DNA, 20 bp, Artificial
  CRISPR gRNA sequence
ttctctttatttacctgcca

SEQ ID NO: 319096 - DNA, 20 bp, Artificial
  CRISPR gRNA sequence
ctctttatttacctgccagc

SEQ ID NO: 319097 - DNA, 20 bp, Artificial
  CRISPR gRNA sequence
tctttatttacctgccagcc

SEQ ID NO: 319098 - DNA, 20 bp, Artificial
  CRISPR gRNA sequence
tttatttacctgccagcctc

SEQ ID NO: 319099 - DNA, 20 bp, Artificial
  CRISPR gRNA sequence
tatttacctgccagcctctc

SEQ ID NO: 319100 - DNA, 20 bp, Artificial
  CRISPR gRNA sequence
atttacctgccagcctctcc

SEQ ID NO: 319101 - DNA, 20 bp, Artificial
  CRISPR gRNA sequence
tttacctgccagcctctccc

SEQ ID NO: 319102 - DNA, 20 bp, Artificial
  CRISPR gRNA sequence
acctgccagcctctccccag

SEQ ID NO: 319103 - DNA, 20 bp, Artificial
  CRISPR gRNA sequence
cctgccagcctctccccagg

SEQ ID NO: 319104 - DNA, 20 bp, Artificial
  CRISPR gRNA sequence
ccagcctctccccagggctc

SEQ ID NO: 319105 - DNA, 20 bp, Artificial
  CRISPR gRNA sequence
tccccagggctctaaggcca

SEQ ID NO: 319106 - DNA, 20 bp, Artificial
  CRISPR gRNA sequence
cccagggctctaaggccaga

SEQ ID NO: 319107 - DNA, 20 bp, Artificial
  CRISPR gRNA sequence
taaggccagagaagcctgaa

SEQ ID NO: 319108 - DNA, 20 bp, Artificial
  CRISPR gRNA sequence
aggccagagaagcctgaaat

SEQ ID NO: 319109 - DNA, 20 bp, Artificial
  CRISPR gRNA sequence
aaatccacaataggaggcca

SEQ ID NO: 319110 - DNA, 20 bp, Artificial
  CRISPR gRNA sequence
agggcctcagcagcgaccta

SEQ ID NO: 319111 - DNA, 20 bp, Artificial
  CRISPR gRNA sequence
agcagcgacctaagaatcga

SEQ ID NO: 319112 - DNA, 20 bp, Artificial
  CRISPR gRNA sequence
agaatcgagcccatgcctct

SEQ ID NO: 319113 - DNA, 20 bp, Artificial
  CRISPR gRNA sequence
tggccaaatgcctggactga

SEQ ID NO: 319114 - DNA, 20 bp, Artificial
  CRISPR gRNA sequence
gccaaatgcctggactgagc

SEQ ID NO: 319115 - DNA, 20 bp, Artificial
  CRISPR gRNA sequence
gactgagctgccatgccttc

SEQ ID NO: 319116 - DNA, 20 bp, Artificial
  CRISPR gRNA sequence
agctgccatgccttcatgga

SEQ ID NO: 319117 - DNA, 20 bp, Artificial
  CRISPR gRNA sequence
ccatgccttcatggaggtgg

SEQ ID NO: 319118 - DNA, 20 bp, Artificial
  CRISPR gRNA sequence
catggaggtggggataacac

SEQ ID NO: 319119 - DNA, 20 bp, Artificial
  CRISPR gRNA sequence
atggaggtggggataacacc

SEQ ID NO: 319120 - DNA, 20 bp, Artificial
  CRISPR gRNA sequence
gcccgtgattctggaatctg

SEQ ID NO: 319121 - DNA, 20 bp, Artificial
  CRISPR gRNA sequence
tggaatctgggtgaggtgtc

SEQ ID NO: 319122 - DNA, 20 bp, Artificial
  CRISPR gRNA sequence
gaatctgggtgaggtgtctg

SEQ ID NO: 319123 - DNA, 20 bp, Artificial
  CRISPR gRNA sequence
ggtgaggtgtctgtgctgag

SEQ ID NO: 319124 - DNA, 20 bp, Artificial
  CRISPR gRNA sequence
tgctgaggctctgcacgtgc

SEQ ID NO: 319125 - DNA, 20 bp, Artificial
  CRISPR gRNA sequence
aggctctgcacgtgcagtca

SEQ ID NO: 319126 - DNA, 20 bp, Artificial
  CRISPR gRNA sequence
tgcacgtgcagtcatttgtg

SEQ ID NO: 319127 - DNA, 20 bp, Artificial
  CRISPR gRNA sequence
cacgtgcagtcatttgtgcc

SEQ ID NO: 319128 - DNA, 20 bp, Artificial
  CRISPR gRNA sequence
gtgccgtgcctgctatcctg

SEQ ID NO: 319129 - DNA, 20 bp, Artificial
  CRISPR gRNA sequence
tgccgtgcctgctatcctgc

SEQ ID NO: 319130 - DNA, 20 bp, Artificial
  CRISPR gRNA sequence
ctatcctgcccccctctgca

SEQ ID NO: 319131 - DNA, 20 bp, Artificial
  CRISPR gRNA sequence
tcctgcccccctctgcagtc

SEQ ID NO: 319132 - DNA, 20 bp, Artificial
  CRISPR gRNA sequence
cccccctctgcagtcagttc

SEQ ID NO: 319133 - DNA, 20 bp, Artificial
  CRISPR gRNA sequence
tgcagtcagttcccaggccc

SEQ ID NO: 319134 - DNA, 20 bp, Artificial
  CRISPR gRNA sequence
cagtcagttcccaggccctg

SEQ ID NO: 319135 - DNA, 20 bp, Artificial
  CRISPR gRNA sequence
ccaggccctgaagttcctct

SEQ ID NO: 319136 - DNA, 20 bp, Artificial
  CRISPR gRNA sequence
aagttcctctcgtgatgatt

SEQ ID NO: 319137 - DNA, 20 bp, Artificial
  CRISPR gRNA sequence
ctctcgtgatgattcttctg

SEQ ID NO: 319138 - DNA, 20 bp, Artificial
  CRISPR gRNA sequence
tcgtgatgattcttctgtcc

SEQ ID NO: 319139 - DNA, 20 bp, Artificial
  CRISPR gRNA sequence
gtgatgattcttctgtccac

SEQ ID NO: 319140 - DNA, 20 bp, Artificial
  CRISPR gRNA sequence
ttctgtccactataatctcc

SEQ ID NO: 319141 - DNA, 20 bp, Artificial
  CRISPR gRNA sequence
ctgtccactataatctccag

SEQ ID NO: 319142 - DNA, 20 bp, Artificial
  CRISPR gRNA sequence
tgtccactataatctccaga

SEQ ID NO: 319143 - DNA, 20 bp, Artificial
  CRISPR gRNA sequence
tccactataatctccagaca

SEQ ID NO: 319144 - DNA, 20 bp, Artificial
  CRISPR gRNA sequence
taatctccagacacctctca

SEQ ID NO: 319145 - DNA, 20 bp, Artificial
  CRISPR gRNA sequence
cagacacctctcacttggac

SEQ ID NO: 319146 - DNA, 20 bp, Artificial
  CRISPR gRNA sequence
tcacttggacaaatggaaca

SEQ ID NO: 319147 - DNA, 20 bp, Artificial
  CRISPR gRNA sequence
acttggacaaatggaacagc

SEQ ID NO: 319148 - DNA, 20 bp, Artificial
  CRISPR gRNA sequence
ggacaaatggaacagcttcc

SEQ ID NO: 319149 - DNA, 20 bp, Artificial
  CRISPR gRNA sequence
gacaaatggaacagcttcca

SEQ ID NO: 319150 - DNA, 20 bp, Artificial
  CRISPR gRNA sequence
ccacaggcccctacctctag

SEQ ID NO: 319151 - DNA, 20 bp, Artificial
  CRISPR gRNA sequence
cacaggcccctacctctagt

SEQ ID NO: 319152 - DNA, 20 bp, Artificial
  CRISPR gRNA sequence
cctctagttttcatttgctt

SEQ ID NO: 319153 - DNA, 20 bp, Artificial
  CRISPR gRNA sequence
tagttttcatttgcttgttt

SEQ ID NO: 319154 - DNA, 20 bp, Artificial
  CRISPR gRNA sequence
gttttcatttgcttgtttgt

SEQ ID NO: 319155 - DNA, 20 bp, Artificial
  CRISPR gRNA sequence
tcatttgcttgtttgtttag

SEQ ID NO: 319156 - DNA, 20 bp, Artificial
  CRISPR gRNA sequence
catttgcttgtttgtttagt

SEQ ID NO: 319157 - DNA, 20 bp, Artificial
  CRISPR gRNA sequence
atttgcttgtttgtttagtt

SEQ ID NO: 319158 - DNA, 20 bp, Artificial
  CRISPR gRNA sequence
gcttgtttgtttagtttttt

SEQ ID NO: 319159 - DNA, 20 bp, Artificial
  CRISPR gRNA sequence
cttgtttgtttagttttttc

SEQ ID NO: 319160 - DNA, 20 bp, Artificial
  CRISPR gRNA sequence
gtttgtttagttttttccta

SEQ ID NO: 319161 - DNA, 20 bp, Artificial
  CRISPR gRNA sequence
tttgtttagttttttcctac

SEQ ID NO: 319162 - DNA, 20 bp, Artificial
  CRISPR gRNA sequence
gtttagttttttcctactga

SEQ ID NO: 319163 - DNA, 20 bp, Artificial
  CRISPR gRNA sequence
tttagttttttcctactgag

SEQ ID NO: 319164 - DNA, 20 bp, Artificial
  CRISPR gRNA sequence
agttttttcctactgaggtc

SEQ ID NO: 319165 - DNA, 20 bp, Artificial
  CRISPR gRNA sequence
gttttttcctactgaggtca

SEQ ID NO: 319166 - DNA, 20 bp, Artificial
  CRISPR gRNA sequence
tttcctactgaggtcacagc

SEQ ID NO: 319167 - DNA, 20 bp, Artificial
  CRISPR gRNA sequence
ttcctactgaggtcacagca

SEQ ID NO: 319168 - DNA, 20 bp, Artificial
  CRISPR gRNA sequence
tcctactgaggtcacagcag

SEQ ID NO: 319169 - DNA, 20 bp, Artificial
  CRISPR gRNA sequence
cctactgaggtcacagcagg

SEQ ID NO: 319170 - DNA, 20 bp, Artificial
  CRISPR gRNA sequence
ctactgaggtcacagcaggt

SEQ ID NO: 319171 - DNA, 20 bp, Artificial
  CRISPR gRNA sequence
ctgaggtcacagcaggtttc

SEQ ID NO: 319172 - DNA, 20 bp, Artificial
  CRISPR gRNA sequence
aggtcacagcaggtttcctc

SEQ ID NO: 319173 - DNA, 20 bp, Artificial
  CRISPR gRNA sequence
cctctgcatggctttcagca

SEQ ID NO: 319174 - DNA, 20 bp, Artificial
  CRISPR gRNA sequence
ctctgcatggctttcagcat

SEQ ID NO: 319175 - DNA, 20 bp, Artificial
  CRISPR gRNA sequence
tgcatggctttcagcatatc

SEQ ID NO: 319176 - DNA, 20 bp, Artificial
  CRISPR gRNA sequence
catggctttcagcatatctc

SEQ ID NO: 319177 - DNA, 20 bp, Artificial
  CRISPR gRNA sequence
tcagcatatctcatctactg

SEQ ID NO: 319178 - DNA, 20 bp, Artificial
  CRISPR gRNA sequence
cagcatatctcatctactga

SEQ ID NO: 319179 - DNA, 20 bp, Artificial
  CRISPR gRNA sequence
agcatatctcatctactgaa

SEQ ID NO: 319180 - DNA, 20 bp, Artificial
  CRISPR gRNA sequence
atctactgaaaaacctttga

SEQ ID NO: 319181 - DNA, 20 bp, Artificial
  CRISPR gRNA sequence
ctgaaaaacctttgatgttt

SEQ ID NO: 319182 - DNA, 20 bp, Artificial
  CRISPR gRNA sequence
aaaaacctttgatgtttctt

SEQ ID NO: 319183 - DNA, 20 bp, Artificial
  CRISPR gRNA sequence
tgatgtttcttcatgccttg

SEQ ID NO: 319184 - DNA, 20 bp, Artificial
  CRISPR gRNA sequence
gatgtttcttcatgccttga

SEQ ID NO: 319185 - DNA, 20 bp, Artificial
  CRISPR gRNA sequence
atgtttcttcatgccttgag

SEQ ID NO: 319186 - DNA, 20 bp, Artificial
  CRISPR gRNA sequence
cttcatgccttgaggaacct

SEQ ID NO: 319187 - DNA, 20 bp, Artificial
  CRISPR gRNA sequence
ttcatgccttgaggaacctt

SEQ ID NO: 319188 - DNA, 20 bp, Artificial
  CRISPR gRNA sequence
catgccttgaggaaccttca

SEQ ID NO: 319189 - DNA, 20 bp, Artificial
  CRISPR gRNA sequence
atgccttgaggaaccttcac

SEQ ID NO: 319190 - DNA, 20 bp, Artificial
  CRISPR gRNA sequence
gaggaaccttcacgccttca

SEQ ID NO: 319191 - DNA, 20 bp, Artificial
  CRISPR gRNA sequence
aggaaccttcacgccttcag

SEQ ID NO: 319192 - DNA, 20 bp, Artificial
  CRISPR gRNA sequence
cacgccttcaggaactactt

SEQ ID NO: 319193 - DNA, 20 bp, Artificial
  CRISPR gRNA sequence
acgccttcaggaactacttc

SEQ ID NO: 319194 - DNA, 20 bp, Artificial
  CRISPR gRNA sequence
caggaactacttccttacat

SEQ ID NO: 319195 - DNA, 20 bp, Artificial
  CRISPR gRNA sequence
aggaactacttccttacatg

SEQ ID NO: 319196 - DNA, 20 bp, Artificial
  CRISPR gRNA sequence
cttccttacatgagaactcc

SEQ ID NO: 319197 - DNA, 20 bp, Artificial
  CRISPR gRNA sequence
ccttacatgagaactcctaa

SEQ ID NO: 319198 - DNA, 20 bp, Artificial
  CRISPR gRNA sequence
cttacatgagaactcctaag

SEQ ID NO: 319199 - DNA, 20 bp, Artificial
  CRISPR gRNA sequence
acatgagaactcctaagttt

SEQ ID NO: 319200 - DNA, 20 bp, Artificial
  CRISPR gRNA sequence
catgagaactcctaagtttc

SEQ ID NO: 319201 - DNA, 20 bp, Artificial
  CRISPR gRNA sequence
ctaagtttctggggagttgg

SEQ ID NO: 319202 - DNA, 20 bp, Artificial
  CRISPR gRNA sequence
agtttctggggagttggaaa

SEQ ID NO: 319203 - DNA, 20 bp, Artificial
  CRISPR gRNA sequence
ctggggagttggaaaacagg

SEQ ID NO: 319204 - DNA, 20 bp, Artificial
  CRISPR gRNA sequence
tggggagttggaaaacaggc

SEQ ID NO: 319205 - DNA, 20 bp, Artificial
  CRISPR gRNA sequence
gggagttggaaaacaggctt

SEQ ID NO: 319206 - DNA, 20 bp, Artificial
  CRISPR gRNA sequence
gaaaacaggctttgtgggga

SEQ ID NO: 319207 - DNA, 20 bp, Artificial
  CRISPR gRNA sequence
tgtggggaaaacttagaacg

SEQ ID NO: 319208 - DNA, 20 bp, Artificial
  CRISPR gRNA sequence
gtggggaaaacttagaacgg

SEQ ID NO: 319209 - DNA, 20 bp, Artificial
  CRISPR gRNA sequence
tggggaaaacttagaacgga

SEQ ID NO: 319210 - DNA, 20 bp, Artificial
  CRISPR gRNA sequence
agaacggagtcgcccacttt

SEQ ID NO: 319211 - DNA, 20 bp, Artificial
  CRISPR gRNA sequence
gaacggagtcgcccacttta

SEQ ID NO: 319212 - DNA, 20 bp, Artificial
  CRISPR gRNA sequence
taaagacatttttgggaaca

SEQ ID NO: 319213 - DNA, 20 bp, Artificial
  CRISPR gRNA sequence
aaagacatttttgggaacag

SEQ ID NO: 319214 - DNA, 20 bp, Artificial
  CRISPR gRNA sequence
aagacatttttgggaacagt

SEQ ID NO: 319215 - DNA, 20 bp, Artificial
  CRISPR gRNA sequence
ttgggaacagttctggtagc

SEQ ID NO: 319216 - DNA, 20 bp, Artificial
  CRISPR gRNA sequence
tgggaacagttctggtagct

SEQ ID NO: 319217 - DNA, 20 bp, Artificial
  CRISPR gRNA sequence
gggaacagttctggtagcta

SEQ ID NO: 319218 - DNA, 20 bp, Artificial
  CRISPR gRNA sequence
ggaacagttctggtagctaa

SEQ ID NO: 319219 - DNA, 20 bp, Artificial
  CRISPR gRNA sequence
tggtagctaatcccaaattt

SEQ ID NO: 319220 - DNA, 20 bp, Artificial
  CRISPR gRNA sequence
gtagctaatcccaaatttca

SEQ ID NO: 319221 - DNA, 20 bp, Artificial
  CRISPR gRNA sequence
atcccaaatttcaggaaaat

SEQ ID NO: 319222 - DNA, 20 bp, Artificial
  CRISPR gRNA sequence
caggaaaattaggaccagct

SEQ ID NO: 319223 - DNA, 20 bp, Artificial
  CRISPR gRNA sequence
aggaaaattaggaccagctg

SEQ ID NO: 319224 - DNA, 20 bp, Artificial
  CRISPR gRNA sequence
ggaccagctgatctattagc

SEQ ID NO: 319225 - DNA, 20 bp, Artificial
  CRISPR gRNA sequence
atctattagcttagctataa

SEQ ID NO: 319226 - DNA, 20 bp, Artificial
  CRISPR gRNA sequence
ttagcttagctataatttgt

SEQ ID NO: 319227 - DNA, 20 bp, Artificial
  CRISPR gRNA sequence
gcttagctataatttgtaga

SEQ ID NO: 319228 - DNA, 20 bp, Artificial
  CRISPR gRNA sequence
agctataatttgtagacaca

SEQ ID NO: 319229 - DNA, 20 bp, Artificial
  CRISPR gRNA sequence
gctataatttgtagacacat

SEQ ID NO: 319230 - DNA, 20 bp, Artificial
  CRISPR gRNA sequence
taatttgtagacacatgccc

SEQ ID NO: 319231 - DNA, 20 bp, Artificial
  CRISPR gRNA sequence
gtagacacatgccctgtttc

SEQ ID NO: 319232 - DNA, 20 bp, Artificial
  CRISPR gRNA sequence
tagacacatgccctgtttct

SEQ ID NO: 319233 - DNA, 20 bp, Artificial
  CRISPR gRNA sequence
tttctgggatgttaagaagt

SEQ ID NO: 319234 - DNA, 20 bp, Artificial
  CRISPR gRNA sequence
ctgggatgttaagaagttgt

SEQ ID NO: 319235 - DNA, 20 bp, Artificial
  CRISPR gRNA sequence
tgggatgttaagaagttgtt

SEQ ID NO: 319236 - DNA, 20 bp, Artificial
  CRISPR gRNA sequence
ggatgttaagaagttgttgg

SEQ ID NO: 319237 - DNA, 20 bp, Artificial
  CRISPR gRNA sequence
agaagttgttggcattgcag

SEQ ID NO: 319238 - DNA, 20 bp, Artificial
  CRISPR gRNA sequence
ttggcattgcaggccatatt

SEQ ID NO: 319239 - DNA, 20 bp, Artificial
  CRISPR gRNA sequence
gcattgcaggccatatttaa

SEQ ID NO: 319240 - DNA, 20 bp, Artificial
  CRISPR gRNA sequence
caggccatatttaatccctt

SEQ ID NO: 319241 - DNA, 20 bp, Artificial
  CRISPR gRNA sequence
aatcccttttgagtctgtcc

SEQ ID NO: 319242 - DNA, 20 bp, Artificial
  CRISPR gRNA sequence
atcccttttgagtctgtccc

SEQ ID NO: 319243 - DNA, 20 bp, Artificial
  CRISPR gRNA sequence
ttgagtctgtcccagtctat

SEQ ID NO: 319244 - DNA, 20 bp, Artificial
  CRISPR gRNA sequence
tgagtctgtcccagtctatt

SEQ ID NO: 319245 - DNA, 20 bp, Artificial
  CRISPR gRNA sequence
gagtctgtcccagtctattc

SEQ ID NO: 319246 - DNA, 20 bp, Artificial
  CRISPR gRNA sequence
agtctgtcccagtctattcc

SEQ ID NO: 319247 - DNA, 20 bp, Artificial
  CRISPR gRNA sequence
tcccagtctattccacttga

SEQ ID NO: 319248 - DNA, 20 bp, Artificial
  CRISPR gRNA sequence
ttccacttgagccagtttgg

SEQ ID NO: 319249 - DNA, 20 bp, Artificial
  CRISPR gRNA sequence
cacttgagccagtttggcac

SEQ ID NO: 319250 - DNA, 20 bp, Artificial
  CRISPR gRNA sequence
gagccagtttggcactccca

SEQ ID NO: 319251 - DNA, 20 bp, Artificial
  CRISPR gRNA sequence
agccagtttggcactcccag

SEQ ID NO: 319252 - DNA, 20 bp, Artificial
  CRISPR gRNA sequence
ggcactcccagtaaaggggg

SEQ ID NO: 319253 - DNA, 20 bp, Artificial
  CRISPR gRNA sequence
gcactcccagtaaagggggt

SEQ ID NO: 319254 - DNA, 20 bp, Artificial
  CRISPR gRNA sequence
ccagtaaagggggttagggg

SEQ ID NO: 319255 - DNA, 20 bp, Artificial
  CRISPR gRNA sequence
ggggttatacttactaacgt

SEQ ID NO: 319256 - DNA, 20 bp, Artificial
  CRISPR gRNA sequence
tacttactaacgtggaggct

SEQ ID NO: 319257 - DNA, 20 bp, Artificial
  CRISPR gRNA sequence
actaacgtggaggctgctac

SEQ ID NO: 319258 - DNA, 20 bp, Artificial
  CRISPR gRNA sequence
ctaacgtggaggctgctacc

SEQ ID NO: 319259 - DNA, 20 bp, Artificial
  CRISPR gRNA sequence
acgtggaggctgctaccttt

SEQ ID NO: 319260 - DNA, 20 bp, Artificial
  CRISPR gRNA sequence
ctaccttttaacatgcaaaa

SEQ ID NO: 319261 - DNA, 20 bp, Artificial
  CRISPR gRNA sequence
ccttttaacatgcaaaaaag

SEQ ID NO: 319262 - DNA, 20 bp, Artificial
  CRISPR gRNA sequence
ttaacatgcaaaaaaggccc

SEQ ID NO: 319263 - DNA, 20 bp, Artificial
  CRISPR gRNA sequence
taacatgcaaaaaaggcccc

SEQ ID NO: 319264 - DNA, 20 bp, Artificial
  CRISPR gRNA sequence
aacatgcaaaaaaggcccct

SEQ ID NO: 319265 - DNA, 20 bp, Artificial
  CRISPR gRNA sequence
acatgcaaaaaaggcccctt

SEQ ID NO: 319266 - DNA, 20 bp, Artificial
  CRISPR gRNA sequence
gactcagggtctaacctatc

SEQ ID NO: 319267 - DNA, 20 bp, Artificial
  CRISPR gRNA sequence
actcagggtctaacctatct

SEQ ID NO: 319268 - DNA, 20 bp, Artificial
  CRISPR gRNA sequence
agggtctaacctatctctga

SEQ ID NO: 319269 - DNA, 20 bp, Artificial
  CRISPR gRNA sequence
acctatctctgatcaagcga

SEQ ID NO: 319270 - DNA, 20 bp, Artificial
  CRISPR gRNA sequence
tctctgatcaagcgatagaa

SEQ ID NO: 319271 - DNA, 20 bp, Artificial
  CRISPR gRNA sequence
tgatcaagcgatagaatggg

SEQ ID NO: 319272 - DNA, 20 bp, Artificial
  CRISPR gRNA sequence
atcaagcgatagaatgggaa

SEQ ID NO: 319273 - DNA, 20 bp, Artificial
  CRISPR gRNA sequence
cctgaggcagctagagctga

SEQ ID NO: 319274 - DNA, 20 bp, Artificial
  CRISPR gRNA sequence
ctgaggcagctagagctgaa

SEQ ID NO: 319275 - DNA, 20 bp, Artificial
  CRISPR gRNA sequence
aggcagctagagctgaaaca

SEQ ID NO: 319276 - DNA, 20 bp, Artificial
  CRISPR gRNA sequence
gagctgaaacatttctgaag

SEQ ID NO: 319277 - DNA, 20 bp, Artificial
  CRISPR gRNA sequence
aaacatttctgaagatgggg

SEQ ID NO: 319278 - DNA, 20 bp, Artificial
  CRISPR gRNA sequence
ctgaagatgggggtacctgt

SEQ ID NO: 319279 - DNA, 20 bp, Artificial
  CRISPR gRNA sequence
tgaagatgggggtacctgtt

SEQ ID NO: 319280 - DNA, 20 bp, Artificial
  CRISPR gRNA sequence
aagatgggggtacctgttga

SEQ ID NO: 319281 - DNA, 20 bp, Artificial
  CRISPR gRNA sequence
ttgaagtttggcagaacagt

SEQ ID NO: 319282 - DNA, 20 bp, Artificial
  CRISPR gRNA sequence
aagtttggcagaacagtagt

SEQ ID NO: 319283 - DNA, 20 bp, Artificial
  CRISPR gRNA sequence
ggcagaacagtagttgagaa

SEQ ID NO: 319284 - DNA, 20 bp, Artificial
  CRISPR gRNA sequence
gcagaacagtagttgagaag

SEQ ID NO: 319285 - DNA, 20 bp, Artificial
  CRISPR gRNA sequence
agaagcagcaggaaggtgag

SEQ ID NO: 319286 - DNA, 20 bp, Artificial
  CRISPR gRNA sequence
tagtggtggcaagcccctgt

SEQ ID NO: 319287 - DNA, 20 bp, Artificial
  CRISPR gRNA sequence
ttaatttgtagactatggga

SEQ ID NO: 319288 - DNA, 20 bp, Artificial
  CRISPR gRNA sequence
atttgtagactatgggagcc

SEQ ID NO: 319289 - DNA, 20 bp, Artificial
  CRISPR gRNA sequence
gtagactatgggagccgtaa

SEQ ID NO: 319290 - DNA, 20 bp, Artificial
  CRISPR gRNA sequence
tagactatgggagccgtaac

SEQ ID NO: 319291 - DNA, 20 bp, Artificial
  CRISPR gRNA sequence
tgggagccgtaacagagggc

SEQ ID NO: 319292 - DNA, 20 bp, Artificial
  CRISPR gRNA sequence
gggcatgtcatatatggcca

SEQ ID NO: 319293 - DNA, 20 bp, Artificial
  CRISPR gRNA sequence
gtggccaccaatcaaactaa

SEQ ID NO: 319294 - DNA, 20 bp, Artificial
  CRISPR gRNA sequence
tggccaccaatcaaactaat

SEQ ID NO: 319295 - DNA, 20 bp, Artificial
  CRISPR gRNA sequence
attacacattgaaggaggta

SEQ ID NO: 319296 - DNA, 20 bp, Artificial
  CRISPR gRNA sequence
cacattgaaggaggtactga

SEQ ID NO: 319297 - DNA, 20 bp, Artificial
  CRISPR gRNA sequence
aaggaggtactgaacttcag

SEQ ID NO: 319298 - DNA, 20 bp, Artificial
  CRISPR gRNA sequence
aacttcaggcatagcttgga

SEQ ID NO: 319299 - DNA, 20 bp, Artificial
  CRISPR gRNA sequence
caggcatagcttggagaggc

SEQ ID NO: 319300 - DNA, 20 bp, Artificial
  CRISPR gRNA sequence
aggcatagcttggagaggct

SEQ ID NO: 319301 - DNA, 20 bp, Artificial
  CRISPR gRNA sequence
ggagaggcttctatctggcc

SEQ ID NO: 319302 - DNA, 20 bp, Artificial
  CRISPR gRNA sequence
gagaggcttctatctggcca

SEQ ID NO: 319303 - DNA, 20 bp, Artificial
  CRISPR gRNA sequence
ctatctggccaagagaggat

SEQ ID NO: 319304 - DNA, 20 bp, Artificial
  CRISPR gRNA sequence
tatctggccaagagaggata

SEQ ID NO: 319305 - DNA, 20 bp, Artificial
  CRISPR gRNA sequence
tctggccaagagaggataca

SEQ ID NO: 319306 - DNA, 20 bp, Artificial
  CRISPR gRNA sequence
gccaagagaggatacaggag

SEQ ID NO: 319307 - DNA, 20 bp, Artificial
  CRISPR gRNA sequence
ggacaggacgagttggctcc

SEQ ID NO: 319308 - DNA, 20 bp, Artificial
  CRISPR gRNA sequence
gctccaccatttactggatt

SEQ ID NO: 319309 - DNA, 20 bp, Artificial
  CRISPR gRNA sequence
caccatttactggattctca

SEQ ID NO: 319310 - DNA, 20 bp, Artificial
  CRISPR gRNA sequence
actggattctcagaggctga

SEQ ID NO: 319311 - DNA, 20 bp, Artificial
  CRISPR gRNA sequence
ctggattctcagaggctgaa

SEQ ID NO: 319312 - DNA, 20 bp, Artificial
  CRISPR gRNA sequence
gattctcagaggctgaagtg

SEQ ID NO: 319313 - DNA, 20 bp, Artificial
  CRISPR gRNA sequence
tcagaggctgaagtgtctga

SEQ ID NO: 319314 - DNA, 20 bp, Artificial
  CRISPR gRNA sequence
agaggctgaagtgtctgaat

SEQ ID NO: 319315 - DNA, 20 bp, Artificial
  CRISPR gRNA sequence
aagtgtctgaataggaagaa

SEQ ID NO: 319316 - DNA, 20 bp, Artificial
  CRISPR gRNA sequence
aataggaagaagtcagtagc

SEQ ID NO: 319317 - DNA, 20 bp, Artificial
  CRISPR gRNA sequence
gcccagttgtaaagttggtt

SEQ ID NO: 319318 - DNA, 20 bp, Artificial
  CRISPR gRNA sequence
taaagttggttcatggggac

SEQ ID NO: 319319 - DNA, 20 bp, Artificial
  CRISPR gRNA sequence
gttcatggggactggccccg

SEQ ID NO: 319320 - DNA, 20 bp, Artificial
  CRISPR gRNA sequence
atggggactggccccgtggg

SEQ ID NO: 319321 - DNA, 20 bp, Artificial
  CRISPR gRNA sequence
gccccgtgggctgttcacag

SEQ ID NO: 319322 - DNA, 20 bp, Artificial
  CRISPR gRNA sequence
ttcacagaccaagttatatc

SEQ ID NO: 319323 - DNA, 20 bp, Artificial
  CRISPR gRNA sequence
acagaccaagttatatctga

SEQ ID NO: 319324 - DNA, 20 bp, Artificial
  CRISPR gRNA sequence
tatctgaacaacaagacact

SEQ ID NO: 319325 - DNA, 20 bp, Artificial
  CRISPR gRNA sequence
aacaacaagacactgggaga

SEQ ID NO: 319326 - DNA, 20 bp, Artificial
  CRISPR gRNA sequence
ggagaaaggaggtgacaaag

SEQ ID NO: 319327 - DNA, 20 bp, Artificial
  CRISPR gRNA sequence
gatggatgtcactggagggg

SEQ ID NO: 319328 - DNA, 20 bp, Artificial
  CRISPR gRNA sequence
gagggggcaagccaagaaat

SEQ ID NO: 319329 - DNA, 20 bp, Artificial
  CRISPR gRNA sequence
gagaaggggtcaaggtaaga

SEQ ID NO: 319330 - DNA, 20 bp, Artificial
  CRISPR gRNA sequence
tattccaggagggaatcttg

SEQ ID NO: 319331 - DNA, 20 bp, Artificial
  CRISPR gRNA sequence
attccaggagggaatcttgc

SEQ ID NO: 319332 - DNA, 20 bp, Artificial
  CRISPR gRNA sequence
ttccaggagggaatcttgca

SEQ ID NO: 319333 - DNA, 20 bp, Artificial
  CRISPR gRNA sequence
caggagggaatcttgcagtt

SEQ ID NO: 319334 - DNA, 20 bp, Artificial
  CRISPR gRNA sequence
gcagttacagcttcttaaaa

SEQ ID NO: 319335 - DNA, 20 bp, Artificial
  CRISPR gRNA sequence
cagttacagcttcttaaaag

SEQ ID NO: 319336 - DNA, 20 bp, Artificial
  CRISPR gRNA sequence
cagcttcttaaaagaggagt

SEQ ID NO: 319337 - DNA, 20 bp, Artificial
  CRISPR gRNA sequence
cttaaaagaggagtcaaata

SEQ ID NO: 319338 - DNA, 20 bp, Artificial
  CRISPR gRNA sequence
ttaaaagaggagtcaaatat

SEQ ID NO: 319339 - DNA, 20 bp, Artificial
  CRISPR gRNA sequence
aaaagaggagtcaaatatag

SEQ ID NO: 319340 - DNA, 20 bp, Artificial
  CRISPR gRNA sequence
aaagaggagtcaaatataga

SEQ ID NO: 319341 - DNA, 20 bp, Artificial
  CRISPR gRNA sequence
ctgggtaaagccaggacttt

SEQ ID NO: 319342 - DNA, 20 bp, Artificial
  CRISPR gRNA sequence
ggtaaagccaggactttaaa

SEQ ID NO: 319343 - DNA, 20 bp, Artificial
  CRISPR gRNA sequence
taaaatgtcaggctcctatt

SEQ ID NO: 319344 - DNA, 20 bp, Artificial
  CRISPR gRNA sequence
aaaatgtcaggctcctatta

SEQ ID NO: 319345 - DNA, 20 bp, Artificial
  CRISPR gRNA sequence
aaatgtcaggctcctattag

SEQ ID NO: 319346 - DNA, 20 bp, Artificial
  CRISPR gRNA sequence
ctattagtggctactgctta

SEQ ID NO: 319347 - DNA, 20 bp, Artificial
  CRISPR gRNA sequence
ttagtggctactgcttagtt

SEQ ID NO: 319348 - DNA, 20 bp, Artificial
  CRISPR gRNA sequence
gtggctactgcttagtttca

SEQ ID NO: 319349 - DNA, 20 bp, Artificial
  CRISPR gRNA sequence
ctgcttagtttcaatccttt

SEQ ID NO: 319350 - DNA, 20 bp, Artificial
  CRISPR gRNA sequence
cttagtttcaatcctttcct

SEQ ID NO: 319351 - DNA, 20 bp, Artificial
  CRISPR gRNA sequence
agtttcaatcctttcctcca

SEQ ID NO: 319352 - DNA, 20 bp, Artificial
  CRISPR gRNA sequence
gtttcaatcctttcctccac

SEQ ID NO: 319353 - DNA, 20 bp, Artificial
  CRISPR gRNA sequence
caatcctttcctccactgaa

SEQ ID NO: 319354 - DNA, 20 bp, Artificial
  CRISPR gRNA sequence
aatcctttcctccactgaac

SEQ ID NO: 319355 - DNA, 20 bp, Artificial
  CRISPR gRNA sequence
tcctccactgaacttgtccc

SEQ ID NO: 319356 - DNA, 20 bp, Artificial
  CRISPR gRNA sequence
cctccactgaacttgtccct

SEQ ID NO: 319357 - DNA, 20 bp, Artificial
  CRISPR gRNA sequence
ctccactgaacttgtccctg

SEQ ID NO: 319358 - DNA, 20 bp, Artificial
  CRISPR gRNA sequence
cactgaacttgtccctgaag

SEQ ID NO: 319359 - DNA, 20 bp, Artificial
  CRISPR gRNA sequence
aacttgtccctgaagaatac

SEQ ID NO: 319360 - DNA, 20 bp, Artificial
  CRISPR gRNA sequence
gtccctgaagaatacttgtg

SEQ ID NO: 319361 - DNA, 20 bp, Artificial
  CRISPR gRNA sequence
tccctgaagaatacttgtga

SEQ ID NO: 319362 - DNA, 20 bp, Artificial
  CRISPR gRNA sequence
aagaatacttgtgaacacac

SEQ ID NO: 319363 - DNA, 20 bp, Artificial
  CRISPR gRNA sequence
gtgaacacacaagcatttct

SEQ ID NO: 319364 - DNA, 20 bp, Artificial
  CRISPR gRNA sequence
tgaacacacaagcatttctg

SEQ ID NO: 319365 - DNA, 20 bp, Artificial
  CRISPR gRNA sequence
ctgcctccaaggctttcttt

SEQ ID NO: 319366 - DNA, 20 bp, Artificial
  CRISPR gRNA sequence
tgcctccaaggctttctttg

SEQ ID NO: 319367 - DNA, 20 bp, Artificial
  CRISPR gRNA sequence
cctccaaggctttctttgac

SEQ ID NO: 319368 - DNA, 20 bp, Artificial
  CRISPR gRNA sequence
caaggctttctttgacatac

SEQ ID NO: 319369 - DNA, 20 bp, Artificial
  CRISPR gRNA sequence
tctttgacatacctcctgca

SEQ ID NO: 319370 - DNA, 20 bp, Artificial
  CRISPR gRNA sequence
ctttgacatacctcctgcac

SEQ ID NO: 319371 - DNA, 20 bp, Artificial
  CRISPR gRNA sequence
tttgacatacctcctgcact

SEQ ID NO: 319372 - DNA, 20 bp, Artificial
  CRISPR gRNA sequence
tgacatacctcctgcactta

SEQ ID NO: 319373 - DNA, 20 bp, Artificial
  CRISPR gRNA sequence
gacatacctcctgcacttac

SEQ ID NO: 319374 - DNA, 20 bp, Artificial
  CRISPR gRNA sequence
acatacctcctgcacttacg

SEQ ID NO: 319375 - DNA, 20 bp, Artificial
  CRISPR gRNA sequence
ctgcacttacgtcagataca

SEQ ID NO: 319376 - DNA, 20 bp, Artificial
  CRISPR gRNA sequence
cacttacgtcagatacagct

SEQ ID NO: 319377 - DNA, 20 bp, Artificial
  CRISPR gRNA sequence
acgtcagatacagctgatcc

SEQ ID NO: 319378 - DNA, 20 bp, Artificial
  CRISPR gRNA sequence
cgtcagatacagctgatcca

SEQ ID NO: 319379 - DNA, 20 bp, Artificial
  CRISPR gRNA sequence
atccactgtggtcctctcac

SEQ ID NO: 319380 - DNA, 20 bp, Artificial
  CRISPR gRNA sequence
tggtcctctcacctgcttag

SEQ ID NO: 319381 - DNA, 20 bp, Artificial
  CRISPR gRNA sequence
tcacctgcttagcccagata

SEQ ID NO: 319382 - DNA, 20 bp, Artificial
  CRISPR gRNA sequence
acctgcttagcccagatact

SEQ ID NO: 319383 - DNA, 20 bp, Artificial
  CRISPR gRNA sequence
cttagcccagatactgtctc

SEQ ID NO: 319384 - DNA, 20 bp, Artificial
  CRISPR gRNA sequence
agcccagatactgtctcaaa

SEQ ID NO: 319385 - DNA, 20 bp, Artificial
  CRISPR gRNA sequence
gcccagatactgtctcaaat

SEQ ID NO: 319386 - DNA, 20 bp, Artificial
  CRISPR gRNA sequence
tctcaaattttttcagctac

SEQ ID NO: 319387 - DNA, 20 bp, Artificial
  CRISPR gRNA sequence
aaattttttcagctacggaa

SEQ ID NO: 319388 - DNA, 20 bp, Artificial
  CRISPR gRNA sequence
tttcagctacggaagtcacc

SEQ ID NO: 319389 - DNA, 20 bp, Artificial
  CRISPR gRNA sequence
ttcagctacggaagtcacca

SEQ ID NO: 319390 - DNA, 20 bp, Artificial
  CRISPR gRNA sequence
tcagctacggaagtcaccac

SEQ ID NO: 319391 - DNA, 20 bp, Artificial
  CRISPR gRNA sequence
cagctacggaagtcaccaca

SEQ ID NO: 319392 - DNA, 20 bp, Artificial
  CRISPR gRNA sequence
agctacggaagtcaccacag

SEQ ID NO: 319393 - DNA, 20 bp, Artificial
  CRISPR gRNA sequence
cggaagtcaccacagttttg

SEQ ID NO: 319394 - DNA, 20 bp, Artificial
  CRISPR gRNA sequence
tgggaacctgtcatccagaa

SEQ ID NO: 319395 - DNA, 20 bp, Artificial
  CRISPR gRNA sequence
gggaacctgtcatccagaat

SEQ ID NO: 319396 - DNA, 20 bp, Artificial
  CRISPR gRNA sequence
ggaacctgtcatccagaatg

SEQ ID NO: 319397 - DNA, 20 bp, Artificial
  CRISPR gRNA sequence
tcatccagaatgccctcccc

SEQ ID NO: 319398 - DNA, 20 bp, Artificial
  CRISPR gRNA sequence
ccctcctcaccacatttatt

SEQ ID NO: 319399 - DNA, 20 bp, Artificial
  CRISPR gRNA sequence
ctcaccacatttattaaccc

SEQ ID NO: 319400 - DNA, 20 bp, Artificial
  CRISPR gRNA sequence
accacatttattaaccccaa

SEQ ID NO: 319401 - DNA, 20 bp, Artificial
  CRISPR gRNA sequence
attaaccccaataatttatt

SEQ ID NO: 319402 - DNA, 20 bp, Artificial
  CRISPR gRNA sequence
ttaaccccaataatttattt

SEQ ID NO: 319403 - DNA, 20 bp, Artificial
  CRISPR gRNA sequence
accccaataatttattttac

SEQ ID NO: 319404 - DNA, 20 bp, Artificial
  CRISPR gRNA sequence
attttacatgttacaaggta

SEQ ID NO: 319405 - DNA, 20 bp, Artificial
  CRISPR gRNA sequence
ttttacatgttacaaggtac

SEQ ID NO: 319406 - DNA, 20 bp, Artificial
  CRISPR gRNA sequence
tacatgttacaaggtacccc

SEQ ID NO: 319407 - DNA, 20 bp, Artificial
  CRISPR gRNA sequence
acatgttacaaggtacccct

SEQ ID NO: 319408 - DNA, 20 bp, Artificial
  CRISPR gRNA sequence
catgttacaaggtacccctt

SEQ ID NO: 319409 - DNA, 20 bp, Artificial
  CRISPR gRNA sequence
caaggtaccccttcctttag

SEQ ID NO: 319410 - DNA, 20 bp, Artificial
  CRISPR gRNA sequence
cctttaggaaccattccctg

SEQ ID NO: 319411 - DNA, 20 bp, Artificial
  CRISPR gRNA sequence
ctttaggaaccattccctga

SEQ ID NO: 319412 - DNA, 20 bp, Artificial
  CRISPR gRNA sequence
taggaaccattccctgaccc

SEQ ID NO: 319413 - DNA, 20 bp, Artificial
  CRISPR gRNA sequence
aggaaccattccctgaccct

SEQ ID NO: 319414 - DNA, 20 bp, Artificial
  CRISPR gRNA sequence
ggaaccattccctgaccctc

SEQ ID NO: 319415 - DNA, 20 bp, Artificial
  CRISPR gRNA sequence
cctgaccctcagggatcttg

SEQ ID NO: 319416 - DNA, 20 bp, Artificial
  CRISPR gRNA sequence
accctcagggatcttgccta

SEQ ID NO: 319417 - DNA, 20 bp, Artificial
  CRISPR gRNA sequence
agggatcttgcctacctctg

SEQ ID NO: 319418 - DNA, 20 bp, Artificial
  CRISPR gRNA sequence
gcctacctctgaatgcccat

SEQ ID NO: 319419 - DNA, 20 bp, Artificial
  CRISPR gRNA sequence
cctacctctgaatgcccata

SEQ ID NO: 319420 - DNA, 20 bp, Artificial
  CRISPR gRNA sequence
cctctgaatgcccataaatc

SEQ ID NO: 319421 - DNA, 20 bp, Artificial
  CRISPR gRNA sequence
tgaatgcccataaatctcat

SEQ ID NO: 319422 - DNA, 20 bp, Artificial
  CRISPR gRNA sequence
aatgcccataaatctcatta

SEQ ID NO: 319423 - DNA, 20 bp, Artificial
  CRISPR gRNA sequence
attaccagtcacttttattt

SEQ ID NO: 319424 - DNA, 20 bp, Artificial
  CRISPR gRNA sequence
ccagtcacttttattttaaa

SEQ ID NO: 319425 - DNA, 20 bp, Artificial
  CRISPR gRNA sequence
ttattttaaatttagtcaga

SEQ ID NO: 319426 - DNA, 20 bp, Artificial
  CRISPR gRNA sequence
tattttaaatttagtcagat

SEQ ID NO: 319427 - DNA, 20 bp, Artificial
  CRISPR gRNA sequence
attttaaatttagtcagata

SEQ ID NO: 319428 - DNA, 20 bp, Artificial
  CRISPR gRNA sequence
ttttaaatttagtcagatat

SEQ ID NO: 319429 - DNA, 20 bp, Artificial
  CRISPR gRNA sequence
taaatttagtcagatatttc

SEQ ID NO: 319430 - DNA, 20 bp, Artificial
  CRISPR gRNA sequence
aaatttagtcagatatttcc

SEQ ID NO: 319431 - DNA, 20 bp, Artificial
  CRISPR gRNA sequence
aatttagtcagatatttcca

SEQ ID NO: 319432 - DNA, 20 bp, Artificial
  CRISPR gRNA sequence
agtcagatatttccatggaa

SEQ ID NO: 319433 - DNA, 20 bp, Artificial
  CRISPR gRNA sequence
gtcagatatttccatggaat

SEQ ID NO: 319434 - DNA, 20 bp, Artificial
  CRISPR gRNA sequence
ccatggaataaaatttagat

SEQ ID NO: 319435 - DNA, 20 bp, Artificial
  CRISPR gRNA sequence
catggaataaaatttagatt

SEQ ID NO: 319436 - DNA, 20 bp, Artificial
  CRISPR gRNA sequence
agattccaattcaacctttt

SEQ ID NO: 319437 - DNA, 20 bp, Artificial
  CRISPR gRNA sequence
gattccaattcaacctttta

SEQ ID NO: 319438 - DNA, 20 bp, Artificial
  CRISPR gRNA sequence
caattcaaccttttaaaaat

SEQ ID NO: 319439 - DNA, 20 bp, Artificial
  CRISPR gRNA sequence
aaccttttaaaaatccagtt

SEQ ID NO: 319440 - DNA, 20 bp, Artificial
  CRISPR gRNA sequence
ttaaaaatccagtttttcat

SEQ ID NO: 319441 - DNA, 20 bp, Artificial
  CRISPR gRNA sequence
taaaaatccagtttttcatg

SEQ ID NO: 319442 - DNA, 20 bp, Artificial
  CRISPR gRNA sequence
aaaaatccagtttttcatgt

SEQ ID NO: 319443 - DNA, 20 bp, Artificial
  CRISPR gRNA sequence
aaaatccagtttttcatgtg

SEQ ID NO: 319444 - DNA, 20 bp, Artificial
  CRISPR gRNA sequence
ttcatgtgtgcacattacag

SEQ ID NO: 319445 - DNA, 20 bp, Artificial
  CRISPR gRNA sequence
tcatgtgtgcacattacagg

SEQ ID NO: 319446 - DNA, 20 bp, Artificial
  CRISPR gRNA sequence
catgtgtgcacattacaggg

SEQ ID NO: 319447 - DNA, 20 bp, Artificial
  CRISPR gRNA sequence
atgtgtgcacattacagggt

SEQ ID NO: 319448 - DNA, 20 bp, Artificial
  CRISPR gRNA sequence
cagggttctgattctattgg

SEQ ID NO: 319449 - DNA, 20 bp, Artificial
  CRISPR gRNA sequence
tgattctattggaaggtcct

SEQ ID NO: 319450 - DNA, 20 bp, Artificial
  CRISPR gRNA sequence
attctattggaaggtcctca

SEQ ID NO: 319451 - DNA, 20 bp, Artificial
  CRISPR gRNA sequence
tattggaaggtcctcaaggg

SEQ ID NO: 319452 - DNA, 20 bp, Artificial
  CRISPR gRNA sequence
ttggaaggtcctcaagggca

SEQ ID NO: 319453 - DNA, 20 bp, Artificial
  CRISPR gRNA sequence
gaaggtcctcaagggcagag

SEQ ID NO: 319454 - DNA, 20 bp, Artificial
  CRISPR gRNA sequence
aagggcagagggggtgtcat

SEQ ID NO: 319455 - DNA, 20 bp, Artificial
  CRISPR gRNA sequence
tttgttttcactcctgtgac

SEQ ID NO: 319456 - DNA, 20 bp, Artificial
  CRISPR gRNA sequence
ttgttttcactcctgtgacc

SEQ ID NO: 319457 - DNA, 20 bp, Artificial
  CRISPR gRNA sequence
tgttttcactcctgtgacca

SEQ ID NO: 319458 - DNA, 20 bp, Artificial
  CRISPR gRNA sequence
gttttcactcctgtgaccaa

SEQ ID NO: 319459 - DNA, 20 bp, Artificial
  CRISPR gRNA sequence
ttttcactcctgtgaccaat

SEQ ID NO: 319460 - DNA, 20 bp, Artificial
  CRISPR gRNA sequence
tcactcctgtgaccaataat

SEQ ID NO: 319461 - DNA, 20 bp, Artificial
  CRISPR gRNA sequence
cactcctgtgaccaataatg

SEQ ID NO: 319462 - DNA, 20 bp, Artificial
  CRISPR gRNA sequence
actcctgtgaccaataatgt

SEQ ID NO: 319463 - DNA, 20 bp, Artificial
  CRISPR gRNA sequence
ctgtgaccaataatgtccca

SEQ ID NO: 319464 - DNA, 20 bp, Artificial
  CRISPR gRNA sequence
tgaccaataatgtcccaaat

SEQ ID NO: 319465 - DNA, 20 bp, Artificial
  CRISPR gRNA sequence
tatactcacaataaatatca

SEQ ID NO: 319466 - DNA, 20 bp, Artificial
  CRISPR gRNA sequence
tactcacaataaatatcatt

SEQ ID NO: 319467 - DNA, 20 bp, Artificial
  CRISPR gRNA sequence
acaataaatatcatttgtat

SEQ ID NO: 319468 - DNA, 20 bp, Artificial
  CRISPR gRNA sequence
gtatgtctgcatgtatgcat

SEQ ID NO: 319469 - DNA, 20 bp, Artificial
  CRISPR gRNA sequence
tatgtctgcatgtatgcatg

SEQ ID NO: 319470 - DNA, 20 bp, Artificial
  CRISPR gRNA sequence
catgtatgcatggtgtgtgt

SEQ ID NO: 319471 - DNA, 20 bp, Artificial
  CRISPR gRNA sequence
taatcaaagaaagaattcta

SEQ ID NO: 319472 - DNA, 20 bp, Artificial
  CRISPR gRNA sequence
tagcctggaggaatcctgta

SEQ ID NO: 319473 - DNA, 20 bp, Artificial
  CRISPR gRNA sequence
gcctggaggaatcctgtatt

SEQ ID NO: 319474 - DNA, 20 bp, Artificial
  CRISPR gRNA sequence
gaggaatcctgtatttttaa

SEQ ID NO: 319475 - DNA, 20 bp, Artificial
  CRISPR gRNA sequence
tatttttaaatcaaaacttc

SEQ ID NO: 319476 - DNA, 20 bp, Artificial
  CRISPR gRNA sequence
ttaaatcaaaacttcagaat

SEQ ID NO: 319477 - DNA, 20 bp, Artificial
  CRISPR gRNA sequence
taaatcaaaacttcagaatc

SEQ ID NO: 319478 - DNA, 20 bp, Artificial
  CRISPR gRNA sequence
aaatcaaaacttcagaatcc

SEQ ID NO: 319479 - DNA, 20 bp, Artificial
  CRISPR gRNA sequence
aatcaaaacttcagaatcct

SEQ ID NO: 319480 - DNA, 20 bp, Artificial
  CRISPR gRNA sequence
cagaatcctccatccaaagg

SEQ ID NO: 319481 - DNA, 20 bp, Artificial
  CRISPR gRNA sequence
agaatcctccatccaaaggt

SEQ ID NO: 319482 - DNA, 20 bp, Artificial
  CRISPR gRNA sequence
catccaaaggtaaaccaaga

SEQ ID NO: 319483 - DNA, 20 bp, Artificial
  CRISPR gRNA sequence
agtcagtttcagggctaaaa

SEQ ID NO: 319484 - DNA, 20 bp, Artificial
  CRISPR gRNA sequence
cagggctaaaagcatatttc

SEQ ID NO: 319485 - DNA, 20 bp, Artificial
  CRISPR gRNA sequence
agggctaaaagcatatttct

SEQ ID NO: 319486 - DNA, 20 bp, Artificial
  CRISPR gRNA sequence
aaagcatatttcttcaagtg

SEQ ID NO: 319487 - DNA, 20 bp, Artificial
  CRISPR gRNA sequence
cttcaagtgcaacataggct

SEQ ID NO: 319488 - DNA, 20 bp, Artificial
  CRISPR gRNA sequence
ttcaagtgcaacataggctc

SEQ ID NO: 319489 - DNA, 20 bp, Artificial
  CRISPR gRNA sequence
caagtgcaacataggctcgt

SEQ ID NO: 319490 - DNA, 20 bp, Artificial
  CRISPR gRNA sequence
aagtgcaacataggctcgta

SEQ ID NO: 319491 - DNA, 20 bp, Artificial
  CRISPR gRNA sequence
gtagcctcctggaccctgca

SEQ ID NO: 319492 - DNA, 20 bp, Artificial
  CRISPR gRNA sequence
ctggaccctgcatcactcag

SEQ ID NO: 319493 - DNA, 20 bp, Artificial
  CRISPR gRNA sequence
gaccctgcatcactcaggag

SEQ ID NO: 319494 - DNA, 20 bp, Artificial
  CRISPR gRNA sequence
catcactcaggagaagcagg

SEQ ID NO: 319495 - DNA, 20 bp, Artificial
  CRISPR gRNA sequence
aggagaagcaggagacctcc

SEQ ID NO: 319496 - DNA, 20 bp, Artificial
  CRISPR gRNA sequence
catctgggtccttcctaaca

SEQ ID NO: 319497 - DNA, 20 bp, Artificial
  CRISPR gRNA sequence
ggtccttcctaacagcgtca

SEQ ID NO: 319498 - DNA, 20 bp, Artificial
  CRISPR gRNA sequence
cctaacagcgtcataaaatg

SEQ ID NO: 319499 - DNA, 20 bp, Artificial
  CRISPR gRNA sequence
ctaacagcgtcataaaatgg

SEQ ID NO: 319500 - DNA, 20 bp, Artificial
  CRISPR gRNA sequence
acagcgtcataaaatggccc

SEQ ID NO: 319501 - DNA, 20 bp, Artificial
  CRISPR gRNA sequence
gaggtttcctagcaagtcgg

SEQ ID NO: 319502 - DNA, 20 bp, Artificial
  CRISPR gRNA sequence
cctagcaagtcggggacatt

SEQ ID NO: 319503 - DNA, 20 bp, Artificial
  CRISPR gRNA sequence
ctagcaagtcggggacattg

SEQ ID NO: 319504 - DNA, 20 bp, Artificial
  CRISPR gRNA sequence
gcaagtcggggacattggat

SEQ ID NO: 319505 - DNA, 20 bp, Artificial
  CRISPR gRNA sequence
gatgatctgccttaagcatt

SEQ ID NO: 319506 - DNA, 20 bp, Artificial
  CRISPR gRNA sequence
ccttaagcatttgtgtataa

SEQ ID NO: 319507 - DNA, 20 bp, Artificial
  CRISPR gRNA sequence
aagcatttgtgtataatacc

SEQ ID NO: 319508 - DNA, 20 bp, Artificial
  CRISPR gRNA sequence
agcatttgtgtataatacct

SEQ ID NO: 319509 - DNA, 20 bp, Artificial
  CRISPR gRNA sequence
gtgtataatacctgctgaaa

SEQ ID NO: 319510 - DNA, 20 bp, Artificial
  CRISPR gRNA sequence
tgtataatacctgctgaaag

SEQ ID NO: 319511 - DNA, 20 bp, Artificial
  CRISPR gRNA sequence
ctgaaagaaatagtcttgga

SEQ ID NO: 319512 - DNA, 20 bp, Artificial
  CRISPR gRNA sequence
aaagaaatagtcttggaaaa

SEQ ID NO: 319513 - DNA, 20 bp, Artificial
  CRISPR gRNA sequence
ggaaaacagctttacctata

SEQ ID NO: 319514 - DNA, 20 bp, Artificial
  CRISPR gRNA sequence
gaaaacagctttacctatag

SEQ ID NO: 319515 - DNA, 20 bp, Artificial
  CRISPR gRNA sequence
tacctatagagaaaggtgaa

SEQ ID NO: 319516 - DNA, 20 bp, Artificial
  CRISPR gRNA sequence
acctatagagaaaggtgaag

SEQ ID NO: 319517 - DNA, 20 bp, Artificial
  CRISPR gRNA sequence
cctatagagaaaggtgaaga

SEQ ID NO: 319518 - DNA, 20 bp, Artificial
  CRISPR gRNA sequence
tagagaaaggtgaagataaa

SEQ ID NO: 319519 - DNA, 20 bp, Artificial
  CRISPR gRNA sequence
gtcagtttccagaatacaga

SEQ ID NO: 319520 - DNA, 20 bp, Artificial
  CRISPR gRNA sequence
tcagtttccagaatacagaa

SEQ ID NO: 319521 - DNA, 20 bp, Artificial
  CRISPR gRNA sequence
ccagaatacagaagatggtc

SEQ ID NO: 319522 - DNA, 20 bp, Artificial
  CRISPR gRNA sequence
cagaatacagaagatggtca

SEQ ID NO: 319523 - DNA, 20 bp, Artificial
  CRISPR gRNA sequence
ctcgtaacatcagggaatga

SEQ ID NO: 319524 - DNA, 20 bp, Artificial
  CRISPR gRNA sequence
gtaacatcagggaatgaaac

SEQ ID NO: 319525 - DNA, 20 bp, Artificial
  CRISPR gRNA sequence
atggaaacgtcgtacagttc

SEQ ID NO: 319526 - DNA, 20 bp, Artificial
  CRISPR gRNA sequence
tgtgacattatcttgagatt

SEQ ID NO: 319527 - DNA, 20 bp, Artificial
  CRISPR gRNA sequence
tgacattatcttgagatttc

SEQ ID NO: 319528 - DNA, 20 bp, Artificial
  CRISPR gRNA sequence
tcttgagatttctgcataac

SEQ ID NO: 319529 - DNA, 20 bp, Artificial
  CRISPR gRNA sequence
gagatttctgcataacacca

SEQ ID NO: 319530 - DNA, 20 bp, Artificial
  CRISPR gRNA sequence
agatttctgcataacaccat

SEQ ID NO: 319531 - DNA, 20 bp, Artificial
  CRISPR gRNA sequence
ctgcataacaccatcatact

SEQ ID NO: 319532 - DNA, 20 bp, Artificial
  CRISPR gRNA sequence
tgcataacaccatcatactc

SEQ ID NO: 319533 - DNA, 20 bp, Artificial
  CRISPR gRNA sequence
cataacaccatcatactcga

SEQ ID NO: 319534 - DNA, 20 bp, Artificial
  CRISPR gRNA sequence
gatagttgaattcttggttc

SEQ ID NO: 319535 - DNA, 20 bp, Artificial
  CRISPR gRNA sequence
aattcttggttcttagcaaa

SEQ ID NO: 319536 - DNA, 20 bp, Artificial
  CRISPR gRNA sequence
ttggttcttagcaaaacact

SEQ ID NO: 319537 - DNA, 20 bp, Artificial
  CRISPR gRNA sequence
ggttcttagcaaaacactca

SEQ ID NO: 319538 - DNA, 20 bp, Artificial
  CRISPR gRNA sequence
gttcttagcaaaacactcat

SEQ ID NO: 319539 - DNA, 20 bp, Artificial
  CRISPR gRNA sequence
ttagcaaaacactcatcttc

SEQ ID NO: 319540 - DNA, 20 bp, Artificial
  CRISPR gRNA sequence
agcaaaacactcatcttctt

SEQ ID NO: 319541 - DNA, 20 bp, Artificial
  CRISPR gRNA sequence
gcaaaacactcatcttctta

SEQ ID NO: 319542 - DNA, 20 bp, Artificial
  CRISPR gRNA sequence
atcttcttaggttctgggta

SEQ ID NO: 319543 - DNA, 20 bp, Artificial
  CRISPR gRNA sequence
cttaggttctgggtaaccgt

SEQ ID NO: 319544 - DNA, 20 bp, Artificial
  CRISPR gRNA sequence
ttaggttctgggtaaccgtg

SEQ ID NO: 319545 - DNA, 20 bp, Artificial
  CRISPR gRNA sequence
aggttctgggtaaccgtgta

SEQ ID NO: 319546 - DNA, 20 bp, Artificial
  CRISPR gRNA sequence
ggttctgggtaaccgtgtat

SEQ ID NO: 319547 - DNA, 20 bp, Artificial
  CRISPR gRNA sequence
tgggtaaccgtgtatagatg

SEQ ID NO: 319548 - DNA, 20 bp, Artificial
  CRISPR gRNA sequence
ggtaaccgtgtatagatgag

SEQ ID NO: 319549 - DNA, 20 bp, Artificial
  CRISPR gRNA sequence
atgtacacattttctgttat

SEQ ID NO: 319550 - DNA, 20 bp, Artificial
  CRISPR gRNA sequence
tgtacacattttctgttata

SEQ ID NO: 319551 - DNA, 20 bp, Artificial
  CRISPR gRNA sequence
tctgttatattagaaattgg

SEQ ID NO: 319552 - DNA, 20 bp, Artificial
  CRISPR gRNA sequence
ctgttatattagaaattggt

SEQ ID NO: 319553 - DNA, 20 bp, Artificial
  CRISPR gRNA sequence
tgttatattagaaattggta

SEQ ID NO: 319554 - DNA, 20 bp, Artificial
  CRISPR gRNA sequence
ttatattagaaattggtact

SEQ ID NO: 319555 - DNA, 20 bp, Artificial
  CRISPR gRNA sequence
tattagaaattggtactatt

SEQ ID NO: 319556 - DNA, 20 bp, Artificial
  CRISPR gRNA sequence
gaaattggtactatttcagg

SEQ ID NO: 319557 - DNA, 20 bp, Artificial
  CRISPR gRNA sequence
gtactatttcaggttgactg

SEQ ID NO: 319558 - DNA, 20 bp, Artificial
  CRISPR gRNA sequence
tttcaggttgactgaagtta

SEQ ID NO: 319559 - DNA, 20 bp, Artificial
  CRISPR gRNA sequence
caggttgactgaagttagct

SEQ ID NO: 319560 - DNA, 20 bp, Artificial
  CRISPR gRNA sequence
aggttgactgaagttagctg

SEQ ID NO: 319561 - DNA, 20 bp, Artificial
  CRISPR gRNA sequence
actgaagttagctgaaagca

SEQ ID NO: 319562 - DNA, 20 bp, Artificial
  CRISPR gRNA sequence
aagttagctgaaagcagaag

SEQ ID NO: 319563 - DNA, 20 bp, Artificial
  CRISPR gRNA sequence
gctgaaagcagaagagagat

SEQ ID NO: 319564 - DNA, 20 bp, Artificial
  CRISPR gRNA sequence
aaagcagaagagagataaaa

SEQ ID NO: 319565 - DNA, 20 bp, Artificial
  CRISPR gRNA sequence
agtttagatgtatctaggag

SEQ ID NO: 319566 - DNA, 20 bp, Artificial
  CRISPR gRNA sequence
agatgtatctaggagggaat

SEQ ID NO: 319567 - DNA, 20 bp, Artificial
  CRISPR gRNA sequence
gatgtatctaggagggaata

SEQ ID NO: 319568 - DNA, 20 bp, Artificial
  CRISPR gRNA sequence
ggagggaatagcaaataact

SEQ ID NO: 319569 - DNA, 20 bp, Artificial
  CRISPR gRNA sequence
ggtacttgatctggggctca

SEQ ID NO: 319570 - DNA, 20 bp, Artificial
  CRISPR gRNA sequence
gatctggggctcattggggc

SEQ ID NO: 319571 - DNA, 20 bp, Artificial
  CRISPR gRNA sequence
atctggggctcattggggca

SEQ ID NO: 319572 - DNA, 20 bp, Artificial
  CRISPR gRNA sequence
gggctcattggggcacacct

SEQ ID NO: 319573 - DNA, 20 bp, Artificial
  CRISPR gRNA sequence
attggggcacacctgggagc

SEQ ID NO: 319574 - DNA, 20 bp, Artificial
  CRISPR gRNA sequence
gggcacacctgggagcctca

SEQ ID NO: 319575 - DNA, 20 bp, Artificial
  CRISPR gRNA sequence
ggagcctcagggtgtctaaa

SEQ ID NO: 319576 - DNA, 20 bp, Artificial
  CRISPR gRNA sequence
agggtgtctaaaatgtgacc

SEQ ID NO: 319577 - DNA, 20 bp, Artificial
  CRISPR gRNA sequence
aaatgtgaccctcagcccaa

SEQ ID NO: 319578 - DNA, 20 bp, Artificial
  CRISPR gRNA sequence
agcccaaggtgagtgccaca

SEQ ID NO: 319579 - DNA, 20 bp, Artificial
  CRISPR gRNA sequence
catgtttatttttcaacaat

SEQ ID NO: 319580 - DNA, 20 bp, Artificial
  CRISPR gRNA sequence
atgtttatttttcaacaata

SEQ ID NO: 319581 - DNA, 20 bp, Artificial
  CRISPR gRNA sequence
atttttcaacaatagagttt

SEQ ID NO: 319582 - DNA, 20 bp, Artificial
  CRISPR gRNA sequence
tttttcaacaatagagtttg

SEQ ID NO: 319583 - DNA, 20 bp, Artificial
  CRISPR gRNA sequence
ttcaacaatagagtttgcag

SEQ ID NO: 319584 - DNA, 20 bp, Artificial
  CRISPR gRNA sequence
tcaacaatagagtttgcagc

SEQ ID NO: 319585 - DNA, 20 bp, Artificial
  CRISPR gRNA sequence
caacaatagagtttgcagcc

SEQ ID NO: 319586 - DNA, 20 bp, Artificial
  CRISPR gRNA sequence
aacaatagagtttgcagcca

SEQ ID NO: 319587 - DNA, 20 bp, Artificial
  CRISPR gRNA sequence
gcagccatgcttacttcctg

SEQ ID NO: 319588 - DNA, 20 bp, Artificial
  CRISPR gRNA sequence
cagccatgcttacttcctgc

SEQ ID NO: 319589 - DNA, 20 bp, Artificial
  CRISPR gRNA sequence
acttcctgcttatccaaatc

SEQ ID NO: 319590 - DNA, 20 bp, Artificial
  CRISPR gRNA sequence
cttcctgcttatccaaatca

SEQ ID NO: 319591 - DNA, 20 bp, Artificial
  CRISPR gRNA sequence
cctgcttatccaaatcaaag

SEQ ID NO: 319592 - DNA, 20 bp, Artificial
  CRISPR gRNA sequence
ctgcttatccaaatcaaagg

SEQ ID NO: 319593 - DNA, 20 bp, Artificial
  CRISPR gRNA sequence
cttatccaaatcaaaggggt

SEQ ID NO: 319594 - DNA, 20 bp, Artificial
  CRISPR gRNA sequence
atccaaatcaaaggggtgct

SEQ ID NO: 319595 - DNA, 20 bp, Artificial
  CRISPR gRNA sequence
tccaaatcaaaggggtgctc

SEQ ID NO: 319596 - DNA, 20 bp, Artificial
  CRISPR gRNA sequence
tctaagtgacaggagggctg

SEQ ID NO: 319597 - DNA, 20 bp, Artificial
  CRISPR gRNA sequence
taagtgacaggagggctgta

SEQ ID NO: 319598 - DNA, 20 bp, Artificial
  CRISPR gRNA sequence
agtgacaggagggctgtaat

SEQ ID NO: 319599 - DNA, 20 bp, Artificial
  CRISPR gRNA sequence
taattgagtcaccaaagatt

SEQ ID NO: 319600 - DNA, 20 bp, Artificial
  CRISPR gRNA sequence
agtcaccaaagatttacaat

SEQ ID NO: 319601 - DNA, 20 bp, Artificial
  CRISPR gRNA sequence
acaatgaagccactgtttcc

SEQ ID NO: 319602 - DNA, 20 bp, Artificial
  CRISPR gRNA sequence
caatgaagccactgtttcca

SEQ ID NO: 319603 - DNA, 20 bp, Artificial
  CRISPR gRNA sequence
tttccagggagtagagtctt

SEQ ID NO: 319604 - DNA, 20 bp, Artificial
  CRISPR gRNA sequence
ccagggagtagagtctttgg

SEQ ID NO: 319605 - DNA, 20 bp, Artificial
  CRISPR gRNA sequence
cagggagtagagtctttgga

SEQ ID NO: 319606 - DNA, 20 bp, Artificial
  CRISPR gRNA sequence
tggaaggagaagtggtctga

SEQ ID NO: 319607 - DNA, 20 bp, Artificial
  CRISPR gRNA sequence
ggaaggagaagtggtctgac

SEQ ID NO: 319608 - DNA, 20 bp, Artificial
  CRISPR gRNA sequence
gaaggagaagtggtctgact

SEQ ID NO: 319609 - DNA, 20 bp, Artificial
  CRISPR gRNA sequence
actctagggcccaggtgtcc

SEQ ID NO: 319610 - DNA, 20 bp, Artificial
  CRISPR gRNA sequence
tagggcccaggtgtcccatg

SEQ ID NO: 319611 - DNA, 20 bp, Artificial
  CRISPR gRNA sequence
gggcccaggtgtcccatggg

SEQ ID NO: 319612 - DNA, 20 bp, Artificial
  CRISPR gRNA sequence
cagctccccagactaagaga

SEQ ID NO: 319613 - DNA, 20 bp, Artificial
  CRISPR gRNA sequence
cccagactaagagagcagga

SEQ ID NO: 319614 - DNA, 20 bp, Artificial
  CRISPR gRNA sequence
agagagcaggaaggaattga

SEQ ID NO: 319615 - DNA, 20 bp, Artificial
  CRISPR gRNA sequence
agctggagtctcaccaggaa

SEQ ID NO: 319616 - DNA, 20 bp, Artificial
  CRISPR gRNA sequence
gagtctcaccaggaactgac

SEQ ID NO: 319617 - DNA, 20 bp, Artificial
  CRISPR gRNA sequence
accaggaactgacagagttc

SEQ ID NO: 319618 - DNA, 20 bp, Artificial
  CRISPR gRNA sequence
acagagttcatggtgctgag

SEQ ID NO: 319619 - DNA, 20 bp, Artificial
  CRISPR gRNA sequence
atggtgctgagatgccctgc

SEQ ID NO: 319620 - DNA, 20 bp, Artificial
  CRISPR gRNA sequence
agatgccctgcgtcatatct

SEQ ID NO: 319621 - DNA, 20 bp, Artificial
  CRISPR gRNA sequence
cgtcatatctttcagaaacc

SEQ ID NO: 319622 - DNA, 20 bp, Artificial
  CRISPR gRNA sequence
tcagaaacccaagcaggatt

SEQ ID NO: 319623 - DNA, 20 bp, Artificial
  CRISPR gRNA sequence
cagaaacccaagcaggattg

SEQ ID NO: 319624 - DNA, 20 bp, Artificial
  CRISPR gRNA sequence
agaaacccaagcaggattgt

SEQ ID NO: 319625 - DNA, 20 bp, Artificial
  CRISPR gRNA sequence
tggtaagtgagtgggtggat

SEQ ID NO: 319626 - DNA, 20 bp, Artificial
  CRISPR gRNA sequence
tggaattcgaaattcagaac

SEQ ID NO: 319627 - DNA, 20 bp, Artificial
  CRISPR gRNA sequence
ggaattcgaaattcagaaca

SEQ ID NO: 319628 - DNA, 20 bp, Artificial
  CRISPR gRNA sequence
gaattcgaaattcagaacac

SEQ ID NO: 319629 - DNA, 20 bp, Artificial
  CRISPR gRNA sequence
gaaattcagaacactgattt

SEQ ID NO: 319630 - DNA, 20 bp, Artificial
  CRISPR gRNA sequence
agaacactgatttttggcat

SEQ ID NO: 319631 - DNA, 20 bp, Artificial
  CRISPR gRNA sequence
atttttggcatgagcatcaa

SEQ ID NO: 319632 - DNA, 20 bp, Artificial
  CRISPR gRNA sequence
ttggcatgagcatcaaagtg

SEQ ID NO: 319633 - DNA, 20 bp, Artificial
  CRISPR gRNA sequence
tggcatgagcatcaaagtgt

SEQ ID NO: 319634 - DNA, 20 bp, Artificial
  CRISPR gRNA sequence
ggcatgagcatcaaagtgtc

SEQ ID NO: 319635 - DNA, 20 bp, Artificial
  CRISPR gRNA sequence
gcatgagcatcaaagtgtct

SEQ ID NO: 319636 - DNA, 20 bp, Artificial
  CRISPR gRNA sequence
cataacatactctaagaaga

SEQ ID NO: 319637 - DNA, 20 bp, Artificial
  CRISPR gRNA sequence
ataacatactctaagaagaa

SEQ ID NO: 319638 - DNA, 20 bp, Artificial
  CRISPR gRNA sequence
taagaagaaggccaaatcca

SEQ ID NO: 319639 - DNA, 20 bp, Artificial
  CRISPR gRNA sequence
agaagaaggccaaatccagc

SEQ ID NO: 319640 - DNA, 20 bp, Artificial
  CRISPR gRNA sequence
ttttagggaaaaatacatga

SEQ ID NO: 319641 - DNA, 20 bp, Artificial
  CRISPR gRNA sequence
tagggaaaaatacatgatct

SEQ ID NO: 319642 - DNA, 20 bp, Artificial
  CRISPR gRNA sequence
agggaaaaatacatgatctt

SEQ ID NO: 319643 - DNA, 20 bp, Artificial
  CRISPR gRNA sequence
gggaaaaatacatgatctta

SEQ ID NO: 319644 - DNA, 20 bp, Artificial
  CRISPR gRNA sequence
aataaacacagtgtttctct

SEQ ID NO: 319645 - DNA, 20 bp, Artificial
  CRISPR gRNA sequence
ataaacacagtgtttctctt

SEQ ID NO: 319646 - DNA, 20 bp, Artificial
  CRISPR gRNA sequence
ctcttgcctttgccattctc

SEQ ID NO: 319647 - DNA, 20 bp, Artificial
  CRISPR gRNA sequence
tcttgcctttgccattctca

SEQ ID NO: 319648 - DNA, 20 bp, Artificial
  CRISPR gRNA sequence
ttgcctttgccattctcact

SEQ ID NO: 319649 - DNA, 20 bp, Artificial
  CRISPR gRNA sequence
gcctttgccattctcacttt

SEQ ID NO: 319650 - DNA, 20 bp, Artificial
  CRISPR gRNA sequence
cctttgccattctcactttt

SEQ ID NO: 319651 - DNA, 20 bp, Artificial
  CRISPR gRNA sequence
tgccattctcacttttctgg

SEQ ID NO: 319652 - DNA, 20 bp, Artificial
  CRISPR gRNA sequence
gccattctcacttttctggc

SEQ ID NO: 319653 - DNA, 20 bp, Artificial
  CRISPR gRNA sequence
ccattctcacttttctggct

SEQ ID NO: 319654 - DNA, 20 bp, Artificial
  CRISPR gRNA sequence
tcacttttctggctgttcag

SEQ ID NO: 319655 - DNA, 20 bp, Artificial
  CRISPR gRNA sequence
acttttctggctgttcagga

SEQ ID NO: 319656 - DNA, 20 bp, Artificial
  CRISPR gRNA sequence
ttctggctgttcaggatcac

SEQ ID NO: 319657 - DNA, 20 bp, Artificial
  CRISPR gRNA sequence
tctggctgttcaggatcact

SEQ ID NO: 319658 - DNA, 20 bp, Artificial
  CRISPR gRNA sequence
ctggctgttcaggatcactg

SEQ ID NO: 319659 - DNA, 20 bp, Artificial
  CRISPR gRNA sequence
tggctgttcaggatcactgg

SEQ ID NO: 319660 - DNA, 20 bp, Artificial
  CRISPR gRNA sequence
gctgttcaggatcactggca

SEQ ID NO: 319661 - DNA, 20 bp, Artificial
  CRISPR gRNA sequence
ttcaggatcactggcatgga

SEQ ID NO: 319662 - DNA, 20 bp, Artificial
  CRISPR gRNA sequence
aggatcactggcatggagtc

SEQ ID NO: 319663 - DNA, 20 bp, Artificial
  CRISPR gRNA sequence
gcatggagtccctagacctg

SEQ ID NO: 319664 - DNA, 20 bp, Artificial
  CRISPR gRNA sequence
gacctgtgtcatgtgccttc

SEQ ID NO: 319665 - DNA, 20 bp, Artificial
  CRISPR gRNA sequence
tgtcatgtgccttctgtcag

SEQ ID NO: 319666 - DNA, 20 bp, Artificial
  CRISPR gRNA sequence
ctgtcagaaaaaatcccttg

SEQ ID NO: 319667 - DNA, 20 bp, Artificial
  CRISPR gRNA sequence
tgtcagaaaaaatcccttgt

SEQ ID NO: 319668 - DNA, 20 bp, Artificial
  CRISPR gRNA sequence
tcagaaaaaatcccttgttc

SEQ ID NO: 319669 - DNA, 20 bp, Artificial
  CRISPR gRNA sequence
gttcttttatagttactagg

SEQ ID NO: 319670 - DNA, 20 bp, Artificial
  CRISPR gRNA sequence
ttcttttatagttactaggt

SEQ ID NO: 319671 - DNA, 20 bp, Artificial
  CRISPR gRNA sequence
ttttatagttactaggtagt

SEQ ID NO: 319672 - DNA, 20 bp, Artificial
  CRISPR gRNA sequence
ttatagttactaggtagttt

SEQ ID NO: 319673 - DNA, 20 bp, Artificial
  CRISPR gRNA sequence
tatagttactaggtagtttg

SEQ ID NO: 319674 - DNA, 20 bp, Artificial
  CRISPR gRNA sequence
atagttactaggtagtttgc

SEQ ID NO: 319675 - DNA, 20 bp, Artificial
  CRISPR gRNA sequence
tagttactaggtagtttgca

SEQ ID NO: 319676 - DNA, 20 bp, Artificial
  CRISPR gRNA sequence
ctaggtagtttgcaggttct

SEQ ID NO: 319677 - DNA, 20 bp, Artificial
  CRISPR gRNA sequence
ggtagtttgcaggttctaca

SEQ ID NO: 319678 - DNA, 20 bp, Artificial
  CRISPR gRNA sequence
gcaggttctacaaactaatt

SEQ ID NO: 319679 - DNA, 20 bp, Artificial
  CRISPR gRNA sequence
caggttctacaaactaattt

SEQ ID NO: 319680 - DNA, 20 bp, Artificial
  CRISPR gRNA sequence
tacaaactaatttataattt

SEQ ID NO: 319681 - DNA, 20 bp, Artificial
  CRISPR gRNA sequence
caaactaatttataatttag

SEQ ID NO: 319682 - DNA, 20 bp, Artificial
  CRISPR gRNA sequence
atttataatttagtgtattc

SEQ ID NO: 319683 - DNA, 20 bp, Artificial
  CRISPR gRNA sequence
ataatttagtgtattcttac

SEQ ID NO: 319684 - DNA, 20 bp, Artificial
  CRISPR gRNA sequence
taatttagtgtattcttact

SEQ ID NO: 319685 - DNA, 20 bp, Artificial
  CRISPR gRNA sequence
agtgtattcttactaaaagg

SEQ ID NO: 319686 - DNA, 20 bp, Artificial
  CRISPR gRNA sequence
gtgtattcttactaaaaggt

SEQ ID NO: 319687 - DNA, 20 bp, Artificial
  CRISPR gRNA sequence
ttactaaaaggtctgtcatt

SEQ ID NO: 319688 - DNA, 20 bp, Artificial
  CRISPR gRNA sequence
actaaaaggtctgtcatttg

SEQ ID NO: 319689 - DNA, 20 bp, Artificial
  CRISPR gRNA sequence
ctaaaaggtctgtcatttgc

SEQ ID NO: 319690 - DNA, 20 bp, Artificial
  CRISPR gRNA sequence
aaaggtctgtcatttgcatg

SEQ ID NO: 319691 - DNA, 20 bp, Artificial
  CRISPR gRNA sequence
tcatttgcatgtcatcttta

SEQ ID NO: 319692 - DNA, 20 bp, Artificial
  CRISPR gRNA sequence
gcatgtcatctttataagtt

SEQ ID NO: 319693 - DNA, 20 bp, Artificial
  CRISPR gRNA sequence
catgtcatctttataagttt

SEQ ID NO: 319694 - DNA, 20 bp, Artificial
  CRISPR gRNA sequence
tataagttttgctatatcag

SEQ ID NO: 319695 - DNA, 20 bp, Artificial
  CRISPR gRNA sequence
ataagttttgctatatcagt

SEQ ID NO: 319696 - DNA, 20 bp, Artificial
  CRISPR gRNA sequence
taagttttgctatatcagtg

SEQ ID NO: 319697 - DNA, 20 bp, Artificial
  CRISPR gRNA sequence
tgctatatcagtgtactatt

SEQ ID NO: 319698 - DNA, 20 bp, Artificial
  CRISPR gRNA sequence
gctatatcagtgtactattt

SEQ ID NO: 319699 - DNA, 20 bp, Artificial
  CRISPR gRNA sequence
ctatatcagtgtactatttg

SEQ ID NO: 319700 - DNA, 20 bp, Artificial
  CRISPR gRNA sequence
tatcagtgtactatttgagc

SEQ ID NO: 319701 - DNA, 20 bp, Artificial
  CRISPR gRNA sequence
tttgagcagtcttcttggag

SEQ ID NO: 319702 - DNA, 20 bp, Artificial
  CRISPR gRNA sequence
gagcagtcttcttggagtct

SEQ ID NO: 319703 - DNA, 20 bp, Artificial
  CRISPR gRNA sequence
agcagtcttcttggagtcta

SEQ ID NO: 319704 - DNA, 20 bp, Artificial
  CRISPR gRNA sequence
cttggagtctatgtggcctg

SEQ ID NO: 319705 - DNA, 20 bp, Artificial
  CRISPR gRNA sequence
ttggagtctatgtggcctgt

SEQ ID NO: 319706 - DNA, 20 bp, Artificial
  CRISPR gRNA sequence
ggagtctatgtggcctgtag

SEQ ID NO: 319707 - DNA, 20 bp, Artificial
  CRISPR gRNA sequence
gagtctatgtggcctgtaga

SEQ ID NO: 319708 - DNA, 20 bp, Artificial
  CRISPR gRNA sequence
tgtggcctgtagaaggtgaa

SEQ ID NO: 319709 - DNA, 20 bp, Artificial
  CRISPR gRNA sequence
tagaaggtgaattgccagac

SEQ ID NO: 319710 - DNA, 20 bp, Artificial
  CRISPR gRNA sequence
ccagaccgtgtttagcttca

SEQ ID NO: 319711 - DNA, 20 bp, Artificial
  CRISPR gRNA sequence
agcttcattaacaagatctg

SEQ ID NO: 319712 - DNA, 20 bp, Artificial
  CRISPR gRNA sequence
gcttcattaacaagatctgt

SEQ ID NO: 319713 - DNA, 20 bp, Artificial
  CRISPR gRNA sequence
cattaacaagatctgtgaaa

SEQ ID NO: 319714 - DNA, 20 bp, Artificial
  CRISPR gRNA sequence
attaacaagatctgtgaaat

SEQ ID NO: 319715 - DNA, 20 bp, Artificial
  CRISPR gRNA sequence
acaagatctgtgaaatcaca

SEQ ID NO: 319716 - DNA, 20 bp, Artificial
  CRISPR gRNA sequence
tgaaatcacatgttgcgtaa

SEQ ID NO: 319717 - DNA, 20 bp, Artificial
  CRISPR gRNA sequence
cgtaagttagagtttttcta

SEQ ID NO: 319718 - DNA, 20 bp, Artificial
  CRISPR gRNA sequence
gagtttttctaatatacatt

SEQ ID NO: 319719 - DNA, 20 bp, Artificial
  CRISPR gRNA sequence
ttctaatatacattaaaaca

SEQ ID NO: 319720 - DNA, 20 bp, Artificial
  CRISPR gRNA sequence
tctaatatacattaaaacaa

SEQ ID NO: 319721 - DNA, 20 bp, Artificial
  CRISPR gRNA sequence
ctaatatacattaaaacaaa

SEQ ID NO: 319722 - DNA, 20 bp, Artificial
  CRISPR gRNA sequence
taatatacattaaaacaaat

SEQ ID NO: 319723 - DNA, 20 bp, Artificial
  CRISPR gRNA sequence
atatacattaaaacaaatac

SEQ ID NO: 319724 - DNA, 20 bp, Artificial
  CRISPR gRNA sequence
aaacaaatacaacatggctt

SEQ ID NO: 319725 - DNA, 20 bp, Artificial
  CRISPR gRNA sequence
ttcaaaatgcttatctgtgt

SEQ ID NO: 319726 - DNA, 20 bp, Artificial
  CRISPR gRNA sequence
tcaaaatgcttatctgtgtc

SEQ ID NO: 319727 - DNA, 20 bp, Artificial
  CRISPR gRNA sequence
caaaatgcttatctgtgtcc

SEQ ID NO: 319728 - DNA, 20 bp, Artificial
  CRISPR gRNA sequence
aaaatgcttatctgtgtccc

SEQ ID NO: 319729 - DNA, 20 bp, Artificial
  CRISPR gRNA sequence
atctgtgtcccacctaaaac

SEQ ID NO: 319730 - DNA, 20 bp, Artificial
  CRISPR gRNA sequence
tctgtgtcccacctaaaaca

SEQ ID NO: 319731 - DNA, 20 bp, Artificial
  CRISPR gRNA sequence
tgtcccacctaaaacatttc

SEQ ID NO: 319732 - DNA, 20 bp, Artificial
  CRISPR gRNA sequence
aaacatttccaatggtacct

SEQ ID NO: 319733 - DNA, 20 bp, Artificial
  CRISPR gRNA sequence
ccaatggtacctgaccacat

SEQ ID NO: 319734 - DNA, 20 bp, Artificial
  CRISPR gRNA sequence
caatggtacctgaccacatt

SEQ ID NO: 319735 - DNA, 20 bp, Artificial
  CRISPR gRNA sequence
accacattttgaaaacacgg

SEQ ID NO: 319736 - DNA, 20 bp, Artificial
  CRISPR gRNA sequence
tgaaaacacggatttagcac

SEQ ID NO: 319737 - DNA, 20 bp, Artificial
  CRISPR gRNA sequence
gaaaacacggatttagcact

SEQ ID NO: 319738 - DNA, 20 bp, Artificial
  CRISPR gRNA sequence
aaaacacggatttagcactt

SEQ ID NO: 319739 - DNA, 20 bp, Artificial
  CRISPR gRNA sequence
agcacttggttaactattcc

SEQ ID NO: 319740 - DNA, 20 bp, Artificial
  CRISPR gRNA sequence
gcacttggttaactattcct

SEQ ID NO: 319741 - DNA, 20 bp, Artificial
  CRISPR gRNA sequence
ggttaactattcctaaagcc

SEQ ID NO: 319742 - DNA, 20 bp, Artificial
  CRISPR gRNA sequence
gttaactattcctaaagccc

SEQ ID NO: 319743 - DNA, 20 bp, Artificial
  CRISPR gRNA sequence
actattcctaaagccctgca

SEQ ID NO: 319744 - DNA, 20 bp, Artificial
  CRISPR gRNA sequence
ttcctaaagccctgcagcct

SEQ ID NO: 319745 - DNA, 20 bp, Artificial
  CRISPR gRNA sequence
ctaaagccctgcagcctagt

SEQ ID NO: 319746 - DNA, 20 bp, Artificial
  CRISPR gRNA sequence
aagccctgcagcctagttta

SEQ ID NO: 319747 - DNA, 20 bp, Artificial
  CRISPR gRNA sequence
cagcctagtttaaatcacac

SEQ ID NO: 319748 - DNA, 20 bp, Artificial
  CRISPR gRNA sequence
gtttaaatcacacagggttc

SEQ ID NO: 319749 - DNA, 20 bp, Artificial
  CRISPR gRNA sequence
aaatcacacagggttcaaag

SEQ ID NO: 319750 - DNA, 20 bp, Artificial
  CRISPR gRNA sequence
aatcacacagggttcaaagg

SEQ ID NO: 319751 - DNA, 20 bp, Artificial
  CRISPR gRNA sequence
aaagggagcagctctccatt

SEQ ID NO: 319752 - DNA, 20 bp, Artificial
  CRISPR gRNA sequence
tccattctatttttactttt

SEQ ID NO: 319753 - DNA, 20 bp, Artificial
  CRISPR gRNA sequence
cattctatttttacttttgc

SEQ ID NO: 319754 - DNA, 20 bp, Artificial
  CRISPR gRNA sequence
tatttttacttttgcttctg

SEQ ID NO: 319755 - DNA, 20 bp, Artificial
  CRISPR gRNA sequence
tttttacttttgcttctgtt

SEQ ID NO: 319756 - DNA, 20 bp, Artificial
  CRISPR gRNA sequence
ttacttttgcttctgtttta

SEQ ID NO: 319757 - DNA, 20 bp, Artificial
  CRISPR gRNA sequence
tacttttgcttctgttttac

SEQ ID NO: 319758 - DNA, 20 bp, Artificial
  CRISPR gRNA sequence
acttttgcttctgttttact

SEQ ID NO: 319759 - DNA, 20 bp, Artificial
  CRISPR gRNA sequence
cttttgcttctgttttactc

SEQ ID NO: 319760 - DNA, 20 bp, Artificial
  CRISPR gRNA sequence
ttgcttctgttttactctat

SEQ ID NO: 319761 - DNA, 20 bp, Artificial
  CRISPR gRNA sequence
tgcttctgttttactctatg

SEQ ID NO: 319762 - DNA, 20 bp, Artificial
  CRISPR gRNA sequence
gcttctgttttactctatgg

SEQ ID NO: 319763 - DNA, 20 bp, Artificial
  CRISPR gRNA sequence
cttctgttttactctatggt

SEQ ID NO: 319764 - DNA, 20 bp, Artificial
  CRISPR gRNA sequence
ctgttttactctatggtttt

SEQ ID NO: 319765 - DNA, 20 bp, Artificial
  CRISPR gRNA sequence
tgttttactctatggtttta

SEQ ID NO: 319766 - DNA, 20 bp, Artificial
  CRISPR gRNA sequence
ttttactctatggttttaga

SEQ ID NO: 319767 - DNA, 20 bp, Artificial
  CRISPR gRNA sequence
tactctatggttttagaata

SEQ ID NO: 319768 - DNA, 20 bp, Artificial
  CRISPR gRNA sequence
actctatggttttagaatag

SEQ ID NO: 319769 - DNA, 20 bp, Artificial
  CRISPR gRNA sequence
ctctatggttttagaatagg

SEQ ID NO: 319770 - DNA, 20 bp, Artificial
  CRISPR gRNA sequence
tatggttttagaataggtgt

SEQ ID NO: 319771 - DNA, 20 bp, Artificial
  CRISPR gRNA sequence
tggttttagaataggtgttg

SEQ ID NO: 319772 - DNA, 20 bp, Artificial
  CRISPR gRNA sequence
tagaataggtgttgatctgc

SEQ ID NO: 319773 - DNA, 20 bp, Artificial
  CRISPR gRNA sequence
agaataggtgttgatctgcc

SEQ ID NO: 319774 - DNA, 20 bp, Artificial
  CRISPR gRNA sequence
gaataggtgttgatctgcct

SEQ ID NO: 319775 - DNA, 20 bp, Artificial
  CRISPR gRNA sequence
atctgccttttcaagtttca

SEQ ID NO: 319776 - DNA, 20 bp, Artificial
  CRISPR gRNA sequence
ccttttcaagtttcatcaaa

SEQ ID NO: 319777 - DNA, 20 bp, Artificial
  CRISPR gRNA sequence
ttcaagtttcatcaaaaatt

SEQ ID NO: 319778 - DNA, 20 bp, Artificial
  CRISPR gRNA sequence
tcaagtttcatcaaaaatta

SEQ ID NO: 319779 - DNA, 20 bp, Artificial
  CRISPR gRNA sequence
caagtttcatcaaaaattaa

SEQ ID NO: 319780 - DNA, 20 bp, Artificial
  CRISPR gRNA sequence
aagtttcatcaaaaattaac

SEQ ID NO: 319781 - DNA, 20 bp, Artificial
  CRISPR gRNA sequence
catcaaaaattaacctggat

SEQ ID NO: 319782 - DNA, 20 bp, Artificial
  CRISPR gRNA sequence
atcaaaaattaacctggatc

SEQ ID NO: 319783 - DNA, 20 bp, Artificial
  CRISPR gRNA sequence
acctggatccagtaatacca

SEQ ID NO: 319784 - DNA, 20 bp, Artificial
  CRISPR gRNA sequence
gatccagtaataccacacct

SEQ ID NO: 319785 - DNA, 20 bp, Artificial
  CRISPR gRNA sequence
ggtatttcctctagagaact

SEQ ID NO: 319786 - DNA, 20 bp, Artificial
  CRISPR gRNA sequence
cctctagagaactgagaact

SEQ ID NO: 319787 - DNA, 20 bp, Artificial
  CRISPR gRNA sequence
ctctagagaactgagaactt

SEQ ID NO: 319788 - DNA, 20 bp, Artificial
  CRISPR gRNA sequence
tagagaactgagaacttatg

SEQ ID NO: 319789 - DNA, 20 bp, Artificial
  CRISPR gRNA sequence
gagaactgagaacttatgtt

SEQ ID NO: 319790 - DNA, 20 bp, Artificial
  CRISPR gRNA sequence
agaacttatgttcacacaaa

SEQ ID NO: 319791 - DNA, 20 bp, Artificial
  CRISPR gRNA sequence
atgttcacacaaaaacctgt

SEQ ID NO: 319792 - DNA, 20 bp, Artificial
  CRISPR gRNA sequence
tgttcacacaaaaacctgta

SEQ ID NO: 319793 - DNA, 20 bp, Artificial
  CRISPR gRNA sequence
acacaaaaacctgtacatga

SEQ ID NO: 319794 - DNA, 20 bp, Artificial
  CRISPR gRNA sequence
tacatgaacgtttacagcag

SEQ ID NO: 319795 - DNA, 20 bp, Artificial
  CRISPR gRNA sequence
acagcagccttattcataag

SEQ ID NO: 319796 - DNA, 20 bp, Artificial
  CRISPR gRNA sequence
cagcagccttattcataaga

SEQ ID NO: 319797 - DNA, 20 bp, Artificial
  CRISPR gRNA sequence
attcataagagccccaaacc

SEQ ID NO: 319798 - DNA, 20 bp, Artificial
  CRISPR gRNA sequence
ttcataagagccccaaacca

SEQ ID NO: 319799 - DNA, 20 bp, Artificial
  CRISPR gRNA sequence
ataagagccccaaaccagaa

SEQ ID NO: 319800 - DNA, 20 bp, Artificial
  CRISPR gRNA sequence
ttactgagttgaatggataa

SEQ ID NO: 319801 - DNA, 20 bp, Artificial
  CRISPR gRNA sequence
tactgagttgaatggataaa

SEQ ID NO: 319802 - DNA, 20 bp, Artificial
  CRISPR gRNA sequence
actgagttgaatggataaac

SEQ ID NO: 319803 - DNA, 20 bp, Artificial
  CRISPR gRNA sequence
ctgagttgaatggataaaca

SEQ ID NO: 319804 - DNA, 20 bp, Artificial
  CRISPR gRNA sequence
agttgaatggataaacaata

SEQ ID NO: 319805 - DNA, 20 bp, Artificial
  CRISPR gRNA sequence
aatggataaacaataaaatg

SEQ ID NO: 319806 - DNA, 20 bp, Artificial
  CRISPR gRNA sequence
ctcagcaataaaaagggaca

SEQ ID NO: 319807 - DNA, 20 bp, Artificial
  CRISPR gRNA sequence
agcaataaaaagggacaagc

SEQ ID NO: 319808 - DNA, 20 bp, Artificial
  CRISPR gRNA sequence
gatatgtgcaacaacttggg

SEQ ID NO: 319809 - DNA, 20 bp, Artificial
  CRISPR gRNA sequence
gggtgaatctcgaaggcgcg

SEQ ID NO: 319810 - DNA, 20 bp, Artificial
  CRISPR gRNA sequence
ggtgaatctcgaaggcgcgc

SEQ ID NO: 319811 - DNA, 20 bp, Artificial
  CRISPR gRNA sequence
gaaggcgcgctaaacgaaag

SEQ ID NO: 319812 - DNA, 20 bp, Artificial
  CRISPR gRNA sequence
aacgaaagaagccaggctta

SEQ ID NO: 319813 - DNA, 20 bp, Artificial
  CRISPR gRNA sequence
aaaaggttacatactgtgtg

SEQ ID NO: 319814 - DNA, 20 bp, Artificial
  CRISPR gRNA sequence
aaaggttacatactgtgtgg

SEQ ID NO: 319815 - DNA, 20 bp, Artificial
  CRISPR gRNA sequence
catactgtgtggcttcactt

SEQ ID NO: 319816 - DNA, 20 bp, Artificial
  CRISPR gRNA sequence
tgtggcttcacttatgtgac

SEQ ID NO: 319817 - DNA, 20 bp, Artificial
  CRISPR gRNA sequence
cacttatgtgacactgtcaa

SEQ ID NO: 319818 - DNA, 20 bp, Artificial
  CRISPR gRNA sequence
acttatgtgacactgtcaaa

SEQ ID NO: 319819 - DNA, 20 bp, Artificial
  CRISPR gRNA sequence
atgtgacactgtcaaaaaga

SEQ ID NO: 319820 - DNA, 20 bp, Artificial
  CRISPR gRNA sequence
tgtgacactgtcaaaaagac

SEQ ID NO: 319821 - DNA, 20 bp, Artificial
  CRISPR gRNA sequence
tcaaaaagacaaaactatag

SEQ ID NO: 319822 - DNA, 20 bp, Artificial
  CRISPR gRNA sequence
taggatgcccaacaagggtt

SEQ ID NO: 319823 - DNA, 20 bp, Artificial
  CRISPR gRNA sequence
tgagtgcagacagggtatga

SEQ ID NO: 319824 - DNA, 20 bp, Artificial
  CRISPR gRNA sequence
tatgaagggacagcctgagg

SEQ ID NO: 319825 - DNA, 20 bp, Artificial
  CRISPR gRNA sequence
tgaagggacagcctgaggga

SEQ ID NO: 319826 - DNA, 20 bp, Artificial
  CRISPR gRNA sequence
agggaaatttttagggtgat

SEQ ID NO: 319827 - DNA, 20 bp, Artificial
  CRISPR gRNA sequence
ttagggtgatagaaatgctc

SEQ ID NO: 319828 - DNA, 20 bp, Artificial
  CRISPR gRNA sequence
tagggtgatagaaatgctct

SEQ ID NO: 319829 - DNA, 20 bp, Artificial
  CRISPR gRNA sequence
agggtgatagaaatgctcta

SEQ ID NO: 319830 - DNA, 20 bp, Artificial
  CRISPR gRNA sequence
gggtgatagaaatgctctat

SEQ ID NO: 319831 - DNA, 20 bp, Artificial
  CRISPR gRNA sequence
tatgtcctgtggcggttacc

SEQ ID NO: 319832 - DNA, 20 bp, Artificial
  CRISPR gRNA sequence
tgtcctgtggcggttaccta

SEQ ID NO: 319833 - DNA, 20 bp, Artificial
  CRISPR gRNA sequence
tggcggttacctaaatctat

SEQ ID NO: 319834 - DNA, 20 bp, Artificial
  CRISPR gRNA sequence
cctaaatctatacaagatct

SEQ ID NO: 319835 - DNA, 20 bp, Artificial
  CRISPR gRNA sequence
aatctatacaagatctatac

SEQ ID NO: 319836 - DNA, 20 bp, Artificial
  CRISPR gRNA sequence
tacaagatctatacaatcag

SEQ ID NO: 319837 - DNA, 20 bp, Artificial
  CRISPR gRNA sequence
tacaatcagtagaacagtat

SEQ ID NO: 319838 - DNA, 20 bp, Artificial
  CRISPR gRNA sequence
tactgtgtgatagttttaaa

SEQ ID NO: 319839 - DNA, 20 bp, Artificial
  CRISPR gRNA sequence
actgtgtgatagttttaaaa

SEQ ID NO: 319840 - DNA, 20 bp, Artificial
  CRISPR gRNA sequence
ctgtgtgatagttttaaaaa

SEQ ID NO: 319841 - DNA, 20 bp, Artificial
  CRISPR gRNA sequence
tgtgatagttttaaaaaaat

SEQ ID NO: 319842 - DNA, 20 bp, Artificial
  CRISPR gRNA sequence
taaaaaaatctgtagtggca

SEQ ID NO: 319843 - DNA, 20 bp, Artificial
  CRISPR gRNA sequence
aaaaaaatctgtagtggcat

SEQ ID NO: 319844 - DNA, 20 bp, Artificial
  CRISPR gRNA sequence
aaaaaatctgtagtggcatt

SEQ ID NO: 319845 - DNA, 20 bp, Artificial
  CRISPR gRNA sequence
tagtggcatttaggccttcc

SEQ ID NO: 319846 - DNA, 20 bp, Artificial
  CRISPR gRNA sequence
aggccttccaaggtctcgtg

SEQ ID NO: 319847 - DNA, 20 bp, Artificial
  CRISPR gRNA sequence
ggccttccaaggtctcgtga

SEQ ID NO: 319848 - DNA, 20 bp, Artificial
  CRISPR gRNA sequence
ccaaggtctcgtgaagcaga

SEQ ID NO: 319849 - DNA, 20 bp, Artificial
  CRISPR gRNA sequence
caaggtctcgtgaagcagag

SEQ ID NO: 319850 - DNA, 20 bp, Artificial
  CRISPR gRNA sequence
gtgaagcagaggagctggtt

SEQ ID NO: 319851 - DNA, 20 bp, Artificial
  CRISPR gRNA sequence
gtttgtaagtttgtgggtta

SEQ ID NO: 319852 - DNA, 20 bp, Artificial
  CRISPR gRNA sequence
gtaagtttgtgggttatgtt

SEQ ID NO: 319853 - DNA, 20 bp, Artificial
  CRISPR gRNA sequence
taagtttgtgggttatgttt

SEQ ID NO: 319854 - DNA, 20 bp, Artificial
  CRISPR gRNA sequence
gtgggttatgtttgttgggt

SEQ ID NO: 319855 - DNA, 20 bp, Artificial
  CRISPR gRNA sequence
tgggttatgtttgttgggtt

SEQ ID NO: 319856 - DNA, 20 bp, Artificial
  CRISPR gRNA sequence
tgtttgttgggtttttttcc

SEQ ID NO: 319857 - DNA, 20 bp, Artificial
  CRISPR gRNA sequence
gttgggtttttttcccttct

SEQ ID NO: 319858 - DNA, 20 bp, Artificial
  CRISPR gRNA sequence
ttgggtttttttcccttctg

SEQ ID NO: 319859 - DNA, 20 bp, Artificial
  CRISPR gRNA sequence
ggtttttttcccttctgtct

SEQ ID NO: 319860 - DNA, 20 bp, Artificial
  CRISPR gRNA sequence
ttttcccttctgtctaccag

SEQ ID NO: 319861 - DNA, 20 bp, Artificial
  CRISPR gRNA sequence
tttcccttctgtctaccagg

SEQ ID NO: 319862 - DNA, 20 bp, Artificial
  CRISPR gRNA sequence
ttcccttctgtctaccaggc

SEQ ID NO: 319863 - DNA, 20 bp, Artificial
  CRISPR gRNA sequence
tcccttctgtctaccaggct

SEQ ID NO: 319864 - DNA, 20 bp, Artificial
  CRISPR gRNA sequence
cccttctgtctaccaggctc

SEQ ID NO: 319865 - DNA, 20 bp, Artificial
  CRISPR gRNA sequence
ccttctgtctaccaggctca

SEQ ID NO: 319866 - DNA, 20 bp, Artificial
  CRISPR gRNA sequence
ctgtctaccaggctcatggt

SEQ ID NO: 319867 - DNA, 20 bp, Artificial
  CRISPR gRNA sequence
tgtctaccaggctcatggtt

SEQ ID NO: 319868 - DNA, 20 bp, Artificial
  CRISPR gRNA sequence
tctaccaggctcatggttgt

SEQ ID NO: 319869 - DNA, 20 bp, Artificial
  CRISPR gRNA sequence
ccaggctcatggttgtggca

SEQ ID NO: 319870 - DNA, 20 bp, Artificial
  CRISPR gRNA sequence
atggttgtggcagcaaacaa

SEQ ID NO: 319871 - DNA, 20 bp, Artificial
  CRISPR gRNA sequence
tggcagcaaacaactcataa

SEQ ID NO: 319872 - DNA, 20 bp, Artificial
  CRISPR gRNA sequence
ataagcaacctagaggaggc

SEQ ID NO: 319873 - DNA, 20 bp, Artificial
  CRISPR gRNA sequence
gaggaggctgaagggaaaac

SEQ ID NO: 319874 - DNA, 20 bp, Artificial
  CRISPR gRNA sequence
aagggaaaacccaaatgtgt

SEQ ID NO: 319875 - DNA, 20 bp, Artificial
  CRISPR gRNA sequence
tccgctttgctaggagctcc

SEQ ID NO: 319876 - DNA, 20 bp, Artificial
  CRISPR gRNA sequence
tgctaggagctccaggcaaa

SEQ ID NO: 319877 - DNA, 20 bp, Artificial
  CRISPR gRNA sequence
gctaggagctccaggcaaag

SEQ ID NO: 319878 - DNA, 20 bp, Artificial
  CRISPR gRNA sequence
ctaggagctccaggcaaaga

SEQ ID NO: 319879 - DNA, 20 bp, Artificial
  CRISPR gRNA sequence
ggagctccaggcaaagattt

SEQ ID NO: 319880 - DNA, 20 bp, Artificial
  CRISPR gRNA sequence
caggcaaagatttagtaggt

SEQ ID NO: 319881 - DNA, 20 bp, Artificial
  CRISPR gRNA sequence
agtaggtgaaaaatcttgga

SEQ ID NO: 319882 - DNA, 20 bp, Artificial
  CRISPR gRNA sequence
gtaggtgaaaaatcttggac

SEQ ID NO: 319883 - DNA, 20 bp, Artificial
  CRISPR gRNA sequence
ggacccaaggaaaaaatgaa

SEQ ID NO: 319884 - DNA, 20 bp, Artificial
  CRISPR gRNA sequence
gacccaaggaaaaaatgaat

SEQ ID NO: 319885 - DNA, 20 bp, Artificial
  CRISPR gRNA sequence
aggcctttatggttatataa

SEQ ID NO: 319886 - DNA, 20 bp, Artificial
  CRISPR gRNA sequence
tatggttatataaactttgt

SEQ ID NO: 319887 - DNA, 20 bp, Artificial
  CRISPR gRNA sequence
atggttatataaactttgtg

SEQ ID NO: 319888 - DNA, 20 bp, Artificial
  CRISPR gRNA sequence
tggttatataaactttgtga

SEQ ID NO: 319889 - DNA, 20 bp, Artificial
  CRISPR gRNA sequence
tataaactttgtgatggcca

SEQ ID NO: 319890 - DNA, 20 bp, Artificial
  CRISPR gRNA sequence
tgtgatggccaaattatcca

SEQ ID NO: 319891 - DNA, 20 bp, Artificial
  CRISPR gRNA sequence
gtgatggccaaattatccat

SEQ ID NO: 319892 - DNA, 20 bp, Artificial
  CRISPR gRNA sequence
tgatggccaaattatccatg

SEQ ID NO: 319893 - DNA, 20 bp, Artificial
  CRISPR gRNA sequence
tccatggtttttactatagg

SEQ ID NO: 319894 - DNA, 20 bp, Artificial
  CRISPR gRNA sequence
ttactataggtaattagcca

SEQ ID NO: 319895 - DNA, 20 bp, Artificial
  CRISPR gRNA sequence
tactataggtaattagccat

SEQ ID NO: 319896 - DNA, 20 bp, Artificial
  CRISPR gRNA sequence
actataggtaattagccata

SEQ ID NO: 319897 - DNA, 20 bp, Artificial
  CRISPR gRNA sequence
ctataggtaattagccatat

SEQ ID NO: 319898 - DNA, 20 bp, Artificial
  CRISPR gRNA sequence
taggtaattagccatattat

SEQ ID NO: 319899 - DNA, 20 bp, Artificial
  CRISPR gRNA sequence
gccatattatctttgttcaa

SEQ ID NO: 319900 - DNA, 20 bp, Artificial
  CRISPR gRNA sequence
tctttgttcaattagctcta

SEQ ID NO: 319901 - DNA, 20 bp, Artificial
  CRISPR gRNA sequence
tgttcaattagctctatttt

SEQ ID NO: 319902 - DNA, 20 bp, Artificial
  CRISPR gRNA sequence
gttcaattagctctattttt

SEQ ID NO: 319903 - DNA, 20 bp, Artificial
  CRISPR gRNA sequence
ttcaattagctctatttttt

SEQ ID NO: 319904 - DNA, 20 bp, Artificial
  CRISPR gRNA sequence
aattagctctattttttccc

SEQ ID NO: 319905 - DNA, 20 bp, Artificial
  CRISPR gRNA sequence
gctctattttttccccaaag

SEQ ID NO: 319906 - DNA, 20 bp, Artificial
  CRISPR gRNA sequence
tattttttccccaaagcaga

SEQ ID NO: 319907 - DNA, 20 bp, Artificial
  CRISPR gRNA sequence
ttttttccccaaagcagatt

SEQ ID NO: 319908 - DNA, 20 bp, Artificial
  CRISPR gRNA sequence
tttccccaaagcagattttt

SEQ ID NO: 319909 - DNA, 20 bp, Artificial
  CRISPR gRNA sequence
ttccccaaagcagattttta

SEQ ID NO: 319910 - DNA, 20 bp, Artificial
  CRISPR gRNA sequence
tccccaaagcagatttttac

SEQ ID NO: 319911 - DNA, 20 bp, Artificial
  CRISPR gRNA sequence
ccccaaagcagatttttact

SEQ ID NO: 319912 - DNA, 20 bp, Artificial
  CRISPR gRNA sequence
cccaaagcagatttttactg

SEQ ID NO: 319913 - DNA, 20 bp, Artificial
  CRISPR gRNA sequence
ttactgatccttcagaagca

SEQ ID NO: 319914 - DNA, 20 bp, Artificial
  CRISPR gRNA sequence
tactgatccttcagaagcag

SEQ ID NO: 319915 - DNA, 20 bp, Artificial
  CRISPR gRNA sequence
actgatccttcagaagcaga

SEQ ID NO: 319916 - DNA, 20 bp, Artificial
  CRISPR gRNA sequence
ctgatccttcagaagcagac

SEQ ID NO: 319917 - DNA, 20 bp, Artificial
  CRISPR gRNA sequence
atccttcagaagcagactat

SEQ ID NO: 319918 - DNA, 20 bp, Artificial
  CRISPR gRNA sequence
cagaagcagactataaaaag

SEQ ID NO: 319919 - DNA, 20 bp, Artificial
  CRISPR gRNA sequence
agaagcagactataaaaagt

SEQ ID NO: 319920 - DNA, 20 bp, Artificial
  CRISPR gRNA sequence
taaaaagtacaaaagacttt

SEQ ID NO: 319921 - DNA, 20 bp, Artificial
  CRISPR gRNA sequence
tcagttccctactcccagac

SEQ ID NO: 319922 - DNA, 20 bp, Artificial
  CRISPR gRNA sequence
cagttccctactcccagact

SEQ ID NO: 319923 - DNA, 20 bp, Artificial
  CRISPR gRNA sequence
agttccctactcccagactc

SEQ ID NO: 319924 - DNA, 20 bp, Artificial
  CRISPR gRNA sequence
cctactcccagactctacac

SEQ ID NO: 319925 - DNA, 20 bp, Artificial
  CRISPR gRNA sequence
ctcccagactctacactccc

SEQ ID NO: 319926 - DNA, 20 bp, Artificial
  CRISPR gRNA sequence
ccagactctacactcccttc

SEQ ID NO: 319927 - DNA, 20 bp, Artificial
  CRISPR gRNA sequence
tacactcccttcaaatgcac

SEQ ID NO: 319928 - DNA, 20 bp, Artificial
  CRISPR gRNA sequence
cactcccttcaaatgcactt

SEQ ID NO: 319929 - DNA, 20 bp, Artificial
  CRISPR gRNA sequence
ccttcaaatgcacttcccag

SEQ ID NO: 319930 - DNA, 20 bp, Artificial
  CRISPR gRNA sequence
caaatgcacttcccagaagt

SEQ ID NO: 319931 - DNA, 20 bp, Artificial
  CRISPR gRNA sequence
aaatgcacttcccagaagtg

SEQ ID NO: 319932 - DNA, 20 bp, Artificial
  CRISPR gRNA sequence
cccagaagtggctgtcctct

SEQ ID NO: 319933 - DNA, 20 bp, Artificial
  CRISPR gRNA sequence
ccagaagtggctgtcctctg

SEQ ID NO: 319934 - DNA, 20 bp, Artificial
  CRISPR gRNA sequence
tcctctgccttctctctata

SEQ ID NO: 319935 - DNA, 20 bp, Artificial
  CRISPR gRNA sequence
tgccttctctctatagaccc

SEQ ID NO: 319936 - DNA, 20 bp, Artificial
  CRISPR gRNA sequence
ccttctctctatagaccccc

SEQ ID NO: 319937 - DNA, 20 bp, Artificial
  CRISPR gRNA sequence
ctctctatagaccccccttt

SEQ ID NO: 319938 - DNA, 20 bp, Artificial
  CRISPR gRNA sequence
tctctatagacccccctttt

SEQ ID NO: 319939 - DNA, 20 bp, Artificial
  CRISPR gRNA sequence
tctatagaccccccttttcc

SEQ ID NO: 319940 - DNA, 20 bp, Artificial
  CRISPR gRNA sequence
tatagaccccccttttcccc

SEQ ID NO: 319941 - DNA, 20 bp, Artificial
  CRISPR gRNA sequence
tagaccccccttttcccctg

SEQ ID NO: 319942 - DNA, 20 bp, Artificial
  CRISPR gRNA sequence
ttcccctgggcccctcaagt

SEQ ID NO: 319943 - DNA, 20 bp, Artificial
  CRISPR gRNA sequence
tcccctgggcccctcaagtc

SEQ ID NO: 319944 - DNA, 20 bp, Artificial
  CRISPR gRNA sequence
cccctgggcccctcaagtcc

SEQ ID NO: 319945 - DNA, 20 bp, Artificial
  CRISPR gRNA sequence
ccctgggcccctcaagtccc

SEQ ID NO: 319946 - DNA, 20 bp, Artificial
  CRISPR gRNA sequence
ggcccctcaagtccccctcc

SEQ ID NO: 319947 - DNA, 20 bp, Artificial
  CRISPR gRNA sequence
aagtccccctccagtgtttt

SEQ ID NO: 319948 - DNA, 20 bp, Artificial
  CRISPR gRNA sequence
cagtgtttttctaactcatt

SEQ ID NO: 319949 - DNA, 20 bp, Artificial
  CRISPR gRNA sequence
ttctaactcatttgcagtct

SEQ ID NO: 319950 - DNA, 20 bp, Artificial
  CRISPR gRNA sequence
tctaactcatttgcagtctc

SEQ ID NO: 319951 - DNA, 20 bp, Artificial
  CRISPR gRNA sequence
ctaactcatttgcagtctca

SEQ ID NO: 319952 - DNA, 20 bp, Artificial
  CRISPR gRNA sequence
taactcatttgcagtctcat

SEQ ID NO: 319953 - DNA, 20 bp, Artificial
  CRISPR gRNA sequence
actcatttgcagtctcatct

SEQ ID NO: 319954 - DNA, 20 bp, Artificial
  CRISPR gRNA sequence
atttgcagtctcatctgaga

SEQ ID NO: 319955 - DNA, 20 bp, Artificial
  CRISPR gRNA sequence
gcagtctcatctgagaaggc

SEQ ID NO: 319956 - DNA, 20 bp, Artificial
  CRISPR gRNA sequence
cagtctcatctgagaaggct

SEQ ID NO: 319957 - DNA, 20 bp, Artificial
  CRISPR gRNA sequence
atctgagaaggctaagaatc

SEQ ID NO: 319958 - DNA, 20 bp, Artificial
  CRISPR gRNA sequence
agaaggctaagaatctgaac

SEQ ID NO: 319959 - DNA, 20 bp, Artificial
  CRISPR gRNA sequence
agaatctgaacacacaccat

SEQ ID NO: 319960 - DNA, 20 bp, Artificial
  CRISPR gRNA sequence
aacacacaccattgaccaca

SEQ ID NO: 319961 - DNA, 20 bp, Artificial
  CRISPR gRNA sequence
accacataccaagcactgac

SEQ ID NO: 319962 - DNA, 20 bp, Artificial
  CRISPR gRNA sequence
acagttcagaattcatctgg

SEQ ID NO: 319963 - DNA, 20 bp, Artificial
  CRISPR gRNA sequence
agaattcatctggtggatgc

SEQ ID NO: 319964 - DNA, 20 bp, Artificial
  CRISPR gRNA sequence
atctggtggatgcgaatcat

SEQ ID NO: 319965 - DNA, 20 bp, Artificial
  CRISPR gRNA sequence
gtggatgcgaatcattcctg

SEQ ID NO: 319966 - DNA, 20 bp, Artificial
  CRISPR gRNA sequence
ctgtgggctttttgtgatgg

SEQ ID NO: 319967 - DNA, 20 bp, Artificial
  CRISPR gRNA sequence
tgggctttttgtgatggatg

SEQ ID NO: 319968 - DNA, 20 bp, Artificial
  CRISPR gRNA sequence
tttgtgatggatgatacatt

SEQ ID NO: 319969 - DNA, 20 bp, Artificial
  CRISPR gRNA sequence
ttgtgatggatgatacattg

SEQ ID NO: 319970 - DNA, 20 bp, Artificial
  CRISPR gRNA sequence
tgtgatggatgatacattga

SEQ ID NO: 319971 - DNA, 20 bp, Artificial
  CRISPR gRNA sequence
gtgatggatgatacattgat

SEQ ID NO: 319972 - DNA, 20 bp, Artificial
  CRISPR gRNA sequence
tgatggatgatacattgata

SEQ ID NO: 319973 - DNA, 20 bp, Artificial
  CRISPR gRNA sequence
atacaagcccttgtccttga

SEQ ID NO: 319974 - DNA, 20 bp, Artificial
  CRISPR gRNA sequence
gtccttgatctgaagattgt

SEQ ID NO: 319975 - DNA, 20 bp, Artificial
  CRISPR gRNA sequence
tccttgatctgaagattgtg

SEQ ID NO: 319976 - DNA, 20 bp, Artificial
  CRISPR gRNA sequence
gatctgaagattgtgaagtc

SEQ ID NO: 319977 - DNA, 20 bp, Artificial
  CRISPR gRNA sequence
atctgaagattgtgaagtct

SEQ ID NO: 319978 - DNA, 20 bp, Artificial
  CRISPR gRNA sequence
aagattgtgaagtctcaggg

SEQ ID NO: 319979 - DNA, 20 bp, Artificial
  CRISPR gRNA sequence
tgaagtctcagggtccaact

SEQ ID NO: 319980 - DNA, 20 bp, Artificial
  CRISPR gRNA sequence
agggtccaactgtccgaatc

SEQ ID NO: 319981 - DNA, 20 bp, Artificial
  CRISPR gRNA sequence
tccgaatcaaaacttgtgcg

SEQ ID NO: 319982 - DNA, 20 bp, Artificial
  CRISPR gRNA sequence
gtgcggcccatatacttgga

SEQ ID NO: 319983 - DNA, 20 bp, Artificial
  CRISPR gRNA sequence
tgcggcccatatacttggaa

SEQ ID NO: 319984 - DNA, 20 bp, Artificial
  CRISPR gRNA sequence
ggaatgaacactgtcaaatt

SEQ ID NO: 319985 - DNA, 20 bp, Artificial
  CRISPR gRNA sequence
gaatgaacactgtcaaattt

SEQ ID NO: 319986 - DNA, 20 bp, Artificial
  CRISPR gRNA sequence
tcaaatttctctttgcctaa

SEQ ID NO: 319987 - DNA, 20 bp, Artificial
  CRISPR gRNA sequence
ctctttgcctaagtatacct

SEQ ID NO: 319988 - DNA, 20 bp, Artificial
  CRISPR gRNA sequence
tctttgcctaagtatacctc

SEQ ID NO: 319989 - DNA, 20 bp, Artificial
  CRISPR gRNA sequence
tttgcctaagtatacctcat

SEQ ID NO: 319990 - DNA, 20 bp, Artificial
  CRISPR gRNA sequence
tgcctaagtatacctcattc

SEQ ID NO: 319991 - DNA, 20 bp, Artificial
  CRISPR gRNA sequence
gcctaagtatacctcattca

SEQ ID NO: 319992 - DNA, 20 bp, Artificial
  CRISPR gRNA sequence
cctaagtatacctcattcag

SEQ ID NO: 319993 - DNA, 20 bp, Artificial
  CRISPR gRNA sequence
agtatacctcattcagaacc

SEQ ID NO: 319994 - DNA, 20 bp, Artificial
  CRISPR gRNA sequence
attcagaaccaagttttcct

SEQ ID NO: 319995 - DNA, 20 bp, Artificial
  CRISPR gRNA sequence
agaaccaagttttcctggtc

SEQ ID NO: 319996 - DNA, 20 bp, Artificial
  CRISPR gRNA sequence
tcctggtcctgccaaaatac

SEQ ID NO: 319997 - DNA, 20 bp, Artificial
  CRISPR gRNA sequence
cctggtcctgccaaaatact

SEQ ID NO: 319998 - DNA, 20 bp, Artificial
  CRISPR gRNA sequence
ctggtcctgccaaaatacta

SEQ ID NO: 319999 - DNA, 20 bp, Artificial
  CRISPR gRNA sequence
gtcctgccaaaatactacta

SEQ ID NO: 320000 - DNA, 20 bp, Artificial
  CRISPR gRNA sequence
ccaaaatactactagctcac

SEQ ID NO: 320001 - DNA, 20 bp, Artificial
  CRISPR gRNA sequence
ctagctcactcaggctttgg

SEQ ID NO: 320002 - DNA, 20 bp, Artificial
  CRISPR gRNA sequence
gctcactcaggctttggttt

SEQ ID NO: 320003 - DNA, 20 bp, Artificial
  CRISPR gRNA sequence
actcaggctttggttttgag

SEQ ID NO: 320004 - DNA, 20 bp, Artificial
  CRISPR gRNA sequence
aggctttggttttgagagtt

SEQ ID NO: 320005 - DNA, 20 bp, Artificial
  CRISPR gRNA sequence
tggttttgagagtttgcaaa

SEQ ID NO: 320006 - DNA, 20 bp, Artificial
  CRISPR gRNA sequence
ggttttgagagtttgcaaat

SEQ ID NO: 320007 - DNA, 20 bp, Artificial
  CRISPR gRNA sequence
gttttgagagtttgcaaatt

SEQ ID NO: 320008 - DNA, 20 bp, Artificial
  CRISPR gRNA sequence
tgagagtttgcaaattggca

SEQ ID NO: 320009 - DNA, 20 bp, Artificial
  CRISPR gRNA sequence
gagagtttgcaaattggcat

SEQ ID NO: 320010 - DNA, 20 bp, Artificial
  CRISPR gRNA sequence
agagtttgcaaattggcatg

SEQ ID NO: 320011 - DNA, 20 bp, Artificial
  CRISPR gRNA sequence
gcaaattggcatggcaggtc

SEQ ID NO: 320012 - DNA, 20 bp, Artificial
  CRISPR gRNA sequence
caaattggcatggcaggtct

SEQ ID NO: 320013 - DNA, 20 bp, Artificial
  CRISPR gRNA sequence
gcatggcaggtctgcagtct

SEQ ID NO: 320014 - DNA, 20 bp, Artificial
  CRISPR gRNA sequence
cagtctcattgaaataagct

SEQ ID NO: 320015 - DNA, 20 bp, Artificial
  CRISPR gRNA sequence
attgaaataagcttgaatct

SEQ ID NO: 320016 - DNA, 20 bp, Artificial
  CRISPR gRNA sequence
aaataagcttgaatcttcag

SEQ ID NO: 320017 - DNA, 20 bp, Artificial
  CRISPR gRNA sequence
gaatcttcagaggagcagca

SEQ ID NO: 320018 - DNA, 20 bp, Artificial
  CRISPR gRNA sequence
aatcttcagaggagcagcac

SEQ ID NO: 320019 - DNA, 20 bp, Artificial
  CRISPR gRNA sequence
cagaggagcagcacctaaaa

SEQ ID NO: 320020 - DNA, 20 bp, Artificial
  CRISPR gRNA sequence
agaggagcagcacctaaaaa

SEQ ID NO: 320021 - DNA, 20 bp, Artificial
  CRISPR gRNA sequence
aaaaagaaggttaaggatta

SEQ ID NO: 320022 - DNA, 20 bp, Artificial
  CRISPR gRNA sequence
aggattagggagggagaaac

SEQ ID NO: 320023 - DNA, 20 bp, Artificial
  CRISPR gRNA sequence
gggagggagaaacaagagga

SEQ ID NO: 320024 - DNA, 20 bp, Artificial
  CRISPR gRNA sequence
catttctctttatacaatac

SEQ ID NO: 320025 - DNA, 20 bp, Artificial
  CRISPR gRNA sequence
ctctttatacaatacccaga

SEQ ID NO: 320026 - DNA, 20 bp, Artificial
  CRISPR gRNA sequence
tctttatacaatacccagat

SEQ ID NO: 320027 - DNA, 20 bp, Artificial
  CRISPR gRNA sequence
tttatacaatacccagatac

SEQ ID NO: 320028 - DNA, 20 bp, Artificial
  CRISPR gRNA sequence
tatacaatacccagatacta

SEQ ID NO: 320029 - DNA, 20 bp, Artificial
  CRISPR gRNA sequence
atacaatacccagatactat

SEQ ID NO: 320030 - DNA, 20 bp, Artificial
  CRISPR gRNA sequence
tacaatacccagatactatc

SEQ ID NO: 320031 - DNA, 20 bp, Artificial
  CRISPR gRNA sequence
tcttatcagtaatcatgctg

SEQ ID NO: 320032 - DNA, 20 bp, Artificial
  CRISPR gRNA sequence
atcagtaatcatgctgaaga

SEQ ID NO: 320033 - DNA, 20 bp, Artificial
  CRISPR gRNA sequence
tcagtaatcatgctgaagaa

SEQ ID NO: 320034 - DNA, 20 bp, Artificial
  CRISPR gRNA sequence
aagaataagatattaagctc

SEQ ID NO: 320035 - DNA, 20 bp, Artificial
  CRISPR gRNA sequence
agctctggaactgtgcacat

SEQ ID NO: 320036 - DNA, 20 bp, Artificial
  CRISPR gRNA sequence
tggaactgtgcacatctgct

SEQ ID NO: 320037 - DNA, 20 bp, Artificial
  CRISPR gRNA sequence
gaactgtgcacatctgcttg

SEQ ID NO: 320038 - DNA, 20 bp, Artificial
  CRISPR gRNA sequence
tgcacatctgcttggcatct

SEQ ID NO: 320039 - DNA, 20 bp, Artificial
  CRISPR gRNA sequence
cttggcatctggagattagg

SEQ ID NO: 320040 - DNA, 20 bp, Artificial
  CRISPR gRNA sequence
ggcatctggagattaggacc

SEQ ID NO: 320041 - DNA, 20 bp, Artificial
  CRISPR gRNA sequence
gcatctggagattaggacct

SEQ ID NO: 320042 - DNA, 20 bp, Artificial
  CRISPR gRNA sequence
gagattaggacctttgtcct

SEQ ID NO: 320043 - DNA, 20 bp, Artificial
  CRISPR gRNA sequence
ggacctttgtccttgcttca

SEQ ID NO: 320044 - DNA, 20 bp, Artificial
  CRISPR gRNA sequence
tgtccttgcttcaccgctga

SEQ ID NO: 320045 - DNA, 20 bp, Artificial
  CRISPR gRNA sequence
gtccttgcttcaccgctgac

SEQ ID NO: 320046 - DNA, 20 bp, Artificial
  CRISPR gRNA sequence
tccttgcttcaccgctgact

SEQ ID NO: 320047 - DNA, 20 bp, Artificial
  CRISPR gRNA sequence
gcttcaccgctgactaaatg

SEQ ID NO: 320048 - DNA, 20 bp, Artificial
  CRISPR gRNA sequence
cttcaccgctgactaaatgt

SEQ ID NO: 320049 - DNA, 20 bp, Artificial
  CRISPR gRNA sequence
caccgctgactaaatgtgtg

SEQ ID NO: 320050 - DNA, 20 bp, Artificial
  CRISPR gRNA sequence
accgctgactaaatgtgtgg

SEQ ID NO: 320051 - DNA, 20 bp, Artificial
  CRISPR gRNA sequence
actaaatgtgtggccttgta

SEQ ID NO: 320052 - DNA, 20 bp, Artificial
  CRISPR gRNA sequence
aatgtgtggccttgtacaaa

SEQ ID NO: 320053 - DNA, 20 bp, Artificial
  CRISPR gRNA sequence
gtacaaactgcaatctttat

SEQ ID NO: 320054 - DNA, 20 bp, Artificial
  CRISPR gRNA sequence
tacaaactgcaatctttatg

SEQ ID NO: 320055 - DNA, 20 bp, Artificial
  CRISPR gRNA sequence
caatctttatgagcctcagt

SEQ ID NO: 320056 - DNA, 20 bp, Artificial
  CRISPR gRNA sequence
tatgagcctcagtttcctca

SEQ ID NO: 320057 - DNA, 20 bp, Artificial
  CRISPR gRNA sequence
atgagcctcagtttcctcat

SEQ ID NO: 320058 - DNA, 20 bp, Artificial
  CRISPR gRNA sequence
tgagcctcagtttcctcatc

SEQ ID NO: 320059 - DNA, 20 bp, Artificial
  CRISPR gRNA sequence
agtttcctcatctgattaat

SEQ ID NO: 320060 - DNA, 20 bp, Artificial
  CRISPR gRNA sequence
cctcatctgattaatgaagt

SEQ ID NO: 320061 - DNA, 20 bp, Artificial
  CRISPR gRNA sequence
ctcatctgattaatgaagtg

SEQ ID NO: 320062 - DNA, 20 bp, Artificial
  CRISPR gRNA sequence
atctgattaatgaagtggtt

SEQ ID NO: 320063 - DNA, 20 bp, Artificial
  CRISPR gRNA sequence
attaatgaagtggttgacta

SEQ ID NO: 320064 - DNA, 20 bp, Artificial
  CRISPR gRNA sequence
atgaagtggttgactaaatg

SEQ ID NO: 320065 - DNA, 20 bp, Artificial
  CRISPR gRNA sequence
actaaatgttccaagggtct

SEQ ID NO: 320066 - DNA, 20 bp, Artificial
  CRISPR gRNA sequence
aatgttccaagggtctttct

SEQ ID NO: 320067 - DNA, 20 bp, Artificial
  CRISPR gRNA sequence
caagggtctttctagtactg

SEQ ID NO: 320068 - DNA, 20 bp, Artificial
  CRISPR gRNA sequence
tctagtactgtggttctgtg

SEQ ID NO: 320069 - DNA, 20 bp, Artificial
  CRISPR gRNA sequence
ctagtactgtggttctgtga

SEQ ID NO: 320070 - DNA, 20 bp, Artificial
  CRISPR gRNA sequence
tagtactgtggttctgtgaa

SEQ ID NO: 320071 - DNA, 20 bp, Artificial
  CRISPR gRNA sequence
gtactgtggttctgtgaatt

SEQ ID NO: 320072 - DNA, 20 bp, Artificial
  CRISPR gRNA sequence
tggttctgtgaatttaaatt

SEQ ID NO: 320073 - DNA, 20 bp, Artificial
  CRISPR gRNA sequence
tgtgaatttaaattgcaaga

SEQ ID NO: 320074 - DNA, 20 bp, Artificial
  CRISPR gRNA sequence
tgaatttaaattgcaagaca

SEQ ID NO: 320075 - DNA, 20 bp, Artificial
  CRISPR gRNA sequence
aaattgcaagacagggaaaa

SEQ ID NO: 320076 - DNA, 20 bp, Artificial
  CRISPR gRNA sequence
aattgcaagacagggaaaaa

SEQ ID NO: 320077 - DNA, 20 bp, Artificial
  CRISPR gRNA sequence
caagacagggaaaaaccagt

SEQ ID NO: 320078 - DNA, 20 bp, Artificial
  CRISPR gRNA sequence
gacaacccattcacccacca

SEQ ID NO: 320079 - DNA, 20 bp, Artificial
  CRISPR gRNA sequence
acccaccagttaccttccta

SEQ ID NO: 320080 - DNA, 20 bp, Artificial
  CRISPR gRNA sequence
ccttcctataaccttaattt

SEQ ID NO: 320081 - DNA, 20 bp, Artificial
  CRISPR gRNA sequence
cctataaccttaattttagt

SEQ ID NO: 320082 - DNA, 20 bp, Artificial
  CRISPR gRNA sequence
ctataaccttaattttagtt

SEQ ID NO: 320083 - DNA, 20 bp, Artificial
  CRISPR gRNA sequence
taaccttaattttagttttc

SEQ ID NO: 320084 - DNA, 20 bp, Artificial
  CRISPR gRNA sequence
aattttagttttcatcactg

SEQ ID NO: 320085 - DNA, 20 bp, Artificial
  CRISPR gRNA sequence
attttagttttcatcactgt

SEQ ID NO: 320086 - DNA, 20 bp, Artificial
  CRISPR gRNA sequence
tagttttcatcactgtagct

SEQ ID NO: 320087 - DNA, 20 bp, Artificial
  CRISPR gRNA sequence
agttttcatcactgtagctg

SEQ ID NO: 320088 - DNA, 20 bp, Artificial
  CRISPR gRNA sequence
gttttcatcactgtagctgt

SEQ ID NO: 320089 - DNA, 20 bp, Artificial
  CRISPR gRNA sequence
tcatcactgtagctgttaca

SEQ ID NO: 320090 - DNA, 20 bp, Artificial
  CRISPR gRNA sequence
catcactgtagctgttacag

SEQ ID NO: 320091 - DNA, 20 bp, Artificial
  CRISPR gRNA sequence
atcactgtagctgttacagg

SEQ ID NO: 320092 - DNA, 20 bp, Artificial
  CRISPR gRNA sequence
tagctgttacaggttccata

SEQ ID NO: 320093 - DNA, 20 bp, Artificial
  CRISPR gRNA sequence
ttacaggttccataacttct

SEQ ID NO: 320094 - DNA, 20 bp, Artificial
  CRISPR gRNA sequence
caggttccataacttctaca

SEQ ID NO: 320095 - DNA, 20 bp, Artificial
  CRISPR gRNA sequence
cataacttctacaccatcac

SEQ ID NO: 320096 - DNA, 20 bp, Artificial
  CRISPR gRNA sequence
ctacaccatcaccaaaagct

SEQ ID NO: 320097 - DNA, 20 bp, Artificial
  CRISPR gRNA sequence
tacaccatcaccaaaagctt

SEQ ID NO: 320098 - DNA, 20 bp, Artificial
  CRISPR gRNA sequence
caccatcaccaaaagctttc

SEQ ID NO: 320099 - DNA, 20 bp, Artificial
  CRISPR gRNA sequence
tcccctcccctcccatccac

SEQ ID NO: 320100 - DNA, 20 bp, Artificial
  CRISPR gRNA sequence
cccctcccctcccatccaca

SEQ ID NO: 320101 - DNA, 20 bp, Artificial
  CRISPR gRNA sequence
ccctcccctcccatccacat

SEQ ID NO: 320102 - DNA, 20 bp, Artificial
  CRISPR gRNA sequence
ccctcccatccacatattcc

SEQ ID NO: 320103 - DNA, 20 bp, Artificial
  CRISPR gRNA sequence
ccatccacatattccttggt

SEQ ID NO: 320104 - DNA, 20 bp, Artificial
  CRISPR gRNA sequence
cttggtctgctatggtgaaa

SEQ ID NO: 320105 - DNA, 20 bp, Artificial
  CRISPR gRNA sequence
ggtctgctatggtgaaaaga

SEQ ID NO: 320106 - DNA, 20 bp, Artificial
  CRISPR gRNA sequence
gtctgctatggtgaaaagat

SEQ ID NO: 320107 - DNA, 20 bp, Artificial
  CRISPR gRNA sequence
ctatggtgaaaagattgctg

SEQ ID NO: 320108 - DNA, 20 bp, Artificial
  CRISPR gRNA sequence
tggtgaaaagattgctgata

SEQ ID NO: 320109 - DNA, 20 bp, Artificial
  CRISPR gRNA sequence
ctgataatggtaataaatta

SEQ ID NO: 320110 - DNA, 20 bp, Artificial
  CRISPR gRNA sequence
ataatggtaataaattatag

SEQ ID NO: 320111 - DNA, 20 bp, Artificial
  CRISPR gRNA sequence
tagcccccctttattatact

SEQ ID NO: 320112 - DNA, 20 bp, Artificial
  CRISPR gRNA sequence
tattatacttcattagttgg

SEQ ID NO: 320113 - DNA, 20 bp, Artificial
  CRISPR gRNA sequence
attatacttcattagttggg

SEQ ID NO: 320114 - DNA, 20 bp, Artificial
  CRISPR gRNA sequence
ttatacttcattagttgggg

SEQ ID NO: 320115 - DNA, 20 bp, Artificial
  CRISPR gRNA sequence
tacttcattagttggggaat

SEQ ID NO: 320116 - DNA, 20 bp, Artificial
  CRISPR gRNA sequence
cattagttggggaatcacgt

SEQ ID NO: 320117 - DNA, 20 bp, Artificial
  CRISPR gRNA sequence
attagttggggaatcacgtt

SEQ ID NO: 320118 - DNA, 20 bp, Artificial
  CRISPR gRNA sequence
gttggggaatcacgttgagt

SEQ ID NO: 320119 - DNA, 20 bp, Artificial
  CRISPR gRNA sequence
gggaatcacgttgagtaaca

SEQ ID NO: 320120 - DNA, 20 bp, Artificial
  CRISPR gRNA sequence
agtaacatctttgaaattca

SEQ ID NO: 320121 - DNA, 20 bp, Artificial
  CRISPR gRNA sequence
tgaaattcaaatagctccct

SEQ ID NO: 320122 - DNA, 20 bp, Artificial
  CRISPR gRNA sequence
gaaattcaaatagctccctt

SEQ ID NO: 320123 - DNA, 20 bp, Artificial
  CRISPR gRNA sequence
aaattcaaatagctcccttt

SEQ ID NO: 320124 - DNA, 20 bp, Artificial
  CRISPR gRNA sequence
aaatagctccctttacagaa

SEQ ID NO: 320125 - DNA, 20 bp, Artificial
  CRISPR gRNA sequence
cctttacagaacttccccta

SEQ ID NO: 320126 - DNA, 20 bp, Artificial
  CRISPR gRNA sequence
tacagaacttcccctatgac

SEQ ID NO: 320127 - DNA, 20 bp, Artificial
  CRISPR gRNA sequence
acagaacttcccctatgact

SEQ ID NO: 320128 - DNA, 20 bp, Artificial
  CRISPR gRNA sequence
cagaacttcccctatgactg

SEQ ID NO: 320129 - DNA, 20 bp, Artificial
  CRISPR gRNA sequence
cccctatgactgctgctccc

SEQ ID NO: 320130 - DNA, 20 bp, Artificial
  CRISPR gRNA sequence
ccctatgactgctgctccca

SEQ ID NO: 320131 - DNA, 20 bp, Artificial
  CRISPR gRNA sequence
tgactgctgctcccatggcc

SEQ ID NO: 320132 - DNA, 20 bp, Artificial
  CRISPR gRNA sequence
ctgctcccatggccagcact

SEQ ID NO: 320133 - DNA, 20 bp, Artificial
  CRISPR gRNA sequence
ctcccatggccagcacttcc

SEQ ID NO: 320134 - DNA, 20 bp, Artificial
  CRISPR gRNA sequence
ccatggccagcacttccaag

SEQ ID NO: 320135 - DNA, 20 bp, Artificial
  CRISPR gRNA sequence
ccaaggatgtcaaatgcttt

SEQ ID NO: 320136 - DNA, 20 bp, Artificial
  CRISPR gRNA sequence
caaggatgtcaaatgcttta

SEQ ID NO: 320137 - DNA, 20 bp, Artificial
  CRISPR gRNA sequence
tagaaatgacttcgatagtg

SEQ ID NO: 320138 - DNA, 20 bp, Artificial
  CRISPR gRNA sequence
agaaatgacttcgatagtga

SEQ ID NO: 320139 - DNA, 20 bp, Artificial
  CRISPR gRNA sequence
gaaatgacttcgatagtgaa

SEQ ID NO: 320140 - DNA, 20 bp, Artificial
  CRISPR gRNA sequence
cgatagtgaaccaaggcctt

SEQ ID NO: 320141 - DNA, 20 bp, Artificial
  CRISPR gRNA sequence
gatagtgaaccaaggccttt

SEQ ID NO: 320142 - DNA, 20 bp, Artificial
  CRISPR gRNA sequence
tattttcagtgacctctcta

SEQ ID NO: 320143 - DNA, 20 bp, Artificial
  CRISPR gRNA sequence
attttcagtgacctctctaa

SEQ ID NO: 320144 - DNA, 20 bp, Artificial
  CRISPR gRNA sequence
ttttcagtgacctctctaag

SEQ ID NO: 320145 - DNA, 20 bp, Artificial
  CRISPR gRNA sequence
tcagtgacctctctaagctc

SEQ ID NO: 320146 - DNA, 20 bp, Artificial
  CRISPR gRNA sequence
cagtgacctctctaagctct

SEQ ID NO: 320147 - DNA, 20 bp, Artificial
  CRISPR gRNA sequence
agtgacctctctaagctctt

SEQ ID NO: 320148 - DNA, 20 bp, Artificial
  CRISPR gRNA sequence
tctaagctctttcagagatc

SEQ ID NO: 320149 - DNA, 20 bp, Artificial
  CRISPR gRNA sequence
taagctctttcagagatcag

SEQ ID NO: 320150 - DNA, 20 bp, Artificial
  CRISPR gRNA sequence
agctctttcagagatcagaa

SEQ ID NO: 320151 - DNA, 20 bp, Artificial
  CRISPR gRNA sequence
tttcagagatcagaaagaga

SEQ ID NO: 320152 - DNA, 20 bp, Artificial
  CRISPR gRNA sequence
tcagagatcagaaagagaac

SEQ ID NO: 320153 - DNA, 20 bp, Artificial
  CRISPR gRNA sequence
cagagatcagaaagagaact

SEQ ID NO: 320154 - DNA, 20 bp, Artificial
  CRISPR gRNA sequence
agagatcagaaagagaactg

SEQ ID NO: 320155 - DNA, 20 bp, Artificial
  CRISPR gRNA sequence
ggcaaatttgatggctgttt

SEQ ID NO: 320156 - DNA, 20 bp, Artificial
  CRISPR gRNA sequence
gatggctgttttcggattgt

SEQ ID NO: 320157 - DNA, 20 bp, Artificial
  CRISPR gRNA sequence
atggctgttttcggattgtg

SEQ ID NO: 320158 - DNA, 20 bp, Artificial
  CRISPR gRNA sequence
ttttcggattgtggtggtca

SEQ ID NO: 320159 - DNA, 20 bp, Artificial
  CRISPR gRNA sequence
tcggattgtggtggtcaatg

SEQ ID NO: 320160 - DNA, 20 bp, Artificial
  CRISPR gRNA sequence
cggattgtggtggtcaatga

SEQ ID NO: 320161 - DNA, 20 bp, Artificial
  CRISPR gRNA sequence
ggattgtggtggtcaatgac

SEQ ID NO: 320162 - DNA, 20 bp, Artificial
  CRISPR gRNA sequence
tggtggtcaatgaccattta

SEQ ID NO: 320163 - DNA, 20 bp, Artificial
  CRISPR gRNA sequence
aaggcacatgagtgaaatgc

SEQ ID NO: 320164 - DNA, 20 bp, Artificial
  CRISPR gRNA sequence
aggcacatgagtgaaatgct

SEQ ID NO: 320165 - DNA, 20 bp, Artificial
  CRISPR gRNA sequence
aaaatgaatcatagatgggc

SEQ ID NO: 320166 - DNA, 20 bp, Artificial
  CRISPR gRNA sequence
tgggagtattggggaaaccc

SEQ ID NO: 320167 - DNA, 20 bp, Artificial
  CRISPR gRNA sequence
gggagtattggggaaacccc

SEQ ID NO: 320168 - DNA, 20 bp, Artificial
  CRISPR gRNA sequence
ggagtattggggaaacccca

SEQ ID NO: 320169 - DNA, 20 bp, Artificial
  CRISPR gRNA sequence
gggaaaccccaggcaccaca

SEQ ID NO: 320170 - DNA, 20 bp, Artificial
  CRISPR gRNA sequence
gctgctcccagtatgcactg

SEQ ID NO: 320171 - DNA, 20 bp, Artificial
  CRISPR gRNA sequence
ctgctcccagtatgcactga

SEQ ID NO: 320172 - DNA, 20 bp, Artificial
  CRISPR gRNA sequence
ctcccagtatgcactgaccc

SEQ ID NO: 320173 - DNA, 20 bp, Artificial
  CRISPR gRNA sequence
ccagtatgcactgaccctgg

SEQ ID NO: 320174 - DNA, 20 bp, Artificial
  CRISPR gRNA sequence
accctggacaattttacaac

SEQ ID NO: 320175 - DNA, 20 bp, Artificial
  CRISPR gRNA sequence
gacaattttacaaccataga

SEQ ID NO: 320176 - DNA, 20 bp, Artificial
  CRISPR gRNA sequence
tacaaccatagacatcatgc

SEQ ID NO: 320177 - DNA, 20 bp, Artificial
  CRISPR gRNA sequence
acaaccatagacatcatgct

SEQ ID NO: 320178 - DNA, 20 bp, Artificial
  CRISPR gRNA sequence
caaccatagacatcatgctg

SEQ ID NO: 320179 - DNA, 20 bp, Artificial
  CRISPR gRNA sequence
gaagggttgagagaaaggct

SEQ ID NO: 320180 - DNA, 20 bp, Artificial
  CRISPR gRNA sequence
agagaaaggctttagtcctt

SEQ ID NO: 320181 - DNA, 20 bp, Artificial
  CRISPR gRNA sequence
tagtccttgaggacactttg

SEQ ID NO: 320182 - DNA, 20 bp, Artificial
  CRISPR gRNA sequence
agtccttgaggacactttgg

SEQ ID NO: 320183 - DNA, 20 bp, Artificial
  CRISPR gRNA sequence
gtccttgaggacactttggg

SEQ ID NO: 320184 - DNA, 20 bp, Artificial
  CRISPR gRNA sequence
gaggacactttggggtttgt

SEQ ID NO: 320185 - DNA, 20 bp, Artificial
  CRISPR gRNA sequence
aggacactttggggtttgtg

SEQ ID NO: 320186 - DNA, 20 bp, Artificial
  CRISPR gRNA sequence
tggggtttgtgggaaggatg

SEQ ID NO: 320187 - DNA, 20 bp, Artificial
  CRISPR gRNA sequence
ggggtttgtgggaaggatgt

SEQ ID NO: 320188 - DNA, 20 bp, Artificial
  CRISPR gRNA sequence
gggtttgtgggaaggatgtg

SEQ ID NO: 320189 - DNA, 20 bp, Artificial
  CRISPR gRNA sequence
gtgggaaggatgtgggccac

SEQ ID NO: 320190 - DNA, 20 bp, Artificial
  CRISPR gRNA sequence
tgggaaggatgtgggccacc

SEQ ID NO: 320191 - DNA, 20 bp, Artificial
  CRISPR gRNA sequence
cttaaatgtgaatgatcacg

SEQ ID NO: 320192 - DNA, 20 bp, Artificial
  CRISPR gRNA sequence
aaatgtgaatgatcacgggg

SEQ ID NO: 320193 - DNA, 20 bp, Artificial
  CRISPR gRNA sequence
aatgtgaatgatcacggggt

SEQ ID NO: 320194 - DNA, 20 bp, Artificial
  CRISPR gRNA sequence
gtgtaggaccttttctaggt

SEQ ID NO: 320195 - DNA, 20 bp, Artificial
  CRISPR gRNA sequence
tgtaggaccttttctaggtt

SEQ ID NO: 320196 - DNA, 20 bp, Artificial
  CRISPR gRNA sequence
ttctaggttacagaattact

SEQ ID NO: 320197 - DNA, 20 bp, Artificial
  CRISPR gRNA sequence
tctaggttacagaattactt

SEQ ID NO: 320198 - DNA, 20 bp, Artificial
  CRISPR gRNA sequence
ctaggttacagaattacttg

SEQ ID NO: 320199 - DNA, 20 bp, Artificial
  CRISPR gRNA sequence
taggttacagaattacttga

SEQ ID NO: 320200 - DNA, 20 bp, Artificial
  CRISPR gRNA sequence
ggttacagaattacttgaga

SEQ ID NO: 320201 - DNA, 20 bp, Artificial
  CRISPR gRNA sequence
cagaattacttgagacttgg

SEQ ID NO: 320202 - DNA, 20 bp, Artificial
  CRISPR gRNA sequence
cttgagacttggcaaaaaaa

SEQ ID NO: 320203 - DNA, 20 bp, Artificial
  CRISPR gRNA sequence
gagacttggcaaaaaaaaaa

SEQ ID NO: 320204 - DNA, 20 bp, Artificial
  CRISPR gRNA sequence
agacttggcaaaaaaaaaaa

SEQ ID NO: 320205 - DNA, 20 bp, Artificial
  CRISPR gRNA sequence
ggcaaaaaaaaaaaaaaaaa

SEQ ID NO: 320206 - DNA, 20 bp, Artificial
  CRISPR gRNA sequence
gcaaaaaaaaaaaaaaaaaa

SEQ ID NO: 320207 - DNA, 20 bp, Artificial
  CRISPR gRNA sequence
tttcttacttaatatgaagt

SEQ ID NO: 320208 - DNA, 20 bp, Artificial
  CRISPR gRNA sequence
cttacttaatatgaagttag

SEQ ID NO: 320209 - DNA, 20 bp, Artificial
  CRISPR gRNA sequence
ttacttaatatgaagttaga

SEQ ID NO: 320210 - DNA, 20 bp, Artificial
  CRISPR gRNA sequence
acttaatatgaagttagatg

SEQ ID NO: 320211 - DNA, 20 bp, Artificial
  CRISPR gRNA sequence
cttaatatgaagttagatgc

SEQ ID NO: 320212 - DNA, 20 bp, Artificial
  CRISPR gRNA sequence
aatatgaagttagatgccac

SEQ ID NO: 320213 - DNA, 20 bp, Artificial
  CRISPR gRNA sequence
atatgaagttagatgccacc

SEQ ID NO: 320214 - DNA, 20 bp, Artificial
  CRISPR gRNA sequence
gatgccaccttggagaggaa

SEQ ID NO: 320215 - DNA, 20 bp, Artificial
  CRISPR gRNA sequence
ggagaggaagttagtgtaag

SEQ ID NO: 320216 - DNA, 20 bp, Artificial
  CRISPR gRNA sequence
gagaggaagttagtgtaagt

SEQ ID NO: 320217 - DNA, 20 bp, Artificial
  CRISPR gRNA sequence
gtgtaagttctaaataaaat

SEQ ID NO: 320218 - DNA, 20 bp, Artificial
  CRISPR gRNA sequence
taaataaaatttcatcattc

SEQ ID NO: 320219 - DNA, 20 bp, Artificial
  CRISPR gRNA sequence
aataaaatttcatcattcag

SEQ ID NO: 320220 - DNA, 20 bp, Artificial
  CRISPR gRNA sequence
catcattcaggatttatgtg

SEQ ID NO: 320221 - DNA, 20 bp, Artificial
  CRISPR gRNA sequence
atcattcaggatttatgtga

SEQ ID NO: 320222 - DNA, 20 bp, Artificial
  CRISPR gRNA sequence
aggatttatgtgaaggcatg

SEQ ID NO: 320223 - DNA, 20 bp, Artificial
  CRISPR gRNA sequence
atgtgaaggcatgttgacat

SEQ ID NO: 320224 - DNA, 20 bp, Artificial
  CRISPR gRNA sequence
tgtgaaggcatgttgacatt

SEQ ID NO: 320225 - DNA, 20 bp, Artificial
  CRISPR gRNA sequence
acattgaggaggaaagggag

SEQ ID NO: 320226 - DNA, 20 bp, Artificial
  CRISPR gRNA sequence
aggaggaaagggaggagatg

SEQ ID NO: 320227 - DNA, 20 bp, Artificial
  CRISPR gRNA sequence
atgagagagatgagaggagc

SEQ ID NO: 320228 - DNA, 20 bp, Artificial
  CRISPR gRNA sequence
catttgaagagttctaagtg

SEQ ID NO: 320229 - DNA, 20 bp, Artificial
  CRISPR gRNA sequence
atttgaagagttctaagtgg

SEQ ID NO: 320230 - DNA, 20 bp, Artificial
  CRISPR gRNA sequence
gaagagttctaagtggggga

SEQ ID NO: 320231 - DNA, 20 bp, Artificial
  CRISPR gRNA sequence
aagagttctaagtgggggag

SEQ ID NO: 320232 - DNA, 20 bp, Artificial
  CRISPR gRNA sequence
taagtgggggagtaattaaa

SEQ ID NO: 320233 - DNA, 20 bp, Artificial
  CRISPR gRNA sequence
agtgggggagtaattaaatt

SEQ ID NO: 320234 - DNA, 20 bp, Artificial
  CRISPR gRNA sequence
aattgatgtggtttctcttg

SEQ ID NO: 320235 - DNA, 20 bp, Artificial
  CRISPR gRNA sequence
atgtggtttctcttgaaaga

SEQ ID NO: 320236 - DNA, 20 bp, Artificial
  CRISPR gRNA sequence
ctcttgaaagagggaataga

SEQ ID NO: 320237 - DNA, 20 bp, Artificial
  CRISPR gRNA sequence
tcttgaaagagggaatagaa

SEQ ID NO: 320238 - DNA, 20 bp, Artificial
  CRISPR gRNA sequence
ttgaaagagggaatagaagg

SEQ ID NO: 320239 - DNA, 20 bp, Artificial
  CRISPR gRNA sequence
gaaagagggaatagaaggac

SEQ ID NO: 320240 - DNA, 20 bp, Artificial
  CRISPR gRNA sequence
aaagagggaatagaaggaca

SEQ ID NO: 320241 - DNA, 20 bp, Artificial
  CRISPR gRNA sequence
gtcaaactaaactgtgtaca

SEQ ID NO: 320242 - DNA, 20 bp, Artificial
  CRISPR gRNA sequence
tcaaactaaactgtgtacag

SEQ ID NO: 320243 - DNA, 20 bp, Artificial
  CRISPR gRNA sequence
aactgtgtacagagtggccc

SEQ ID NO: 320244 - DNA, 20 bp, Artificial
  CRISPR gRNA sequence
tgtacagagtggcccagtga

SEQ ID NO: 320245 - DNA, 20 bp, Artificial
  CRISPR gRNA sequence
gtggtggtcttgaactctta

SEQ ID NO: 320246 - DNA, 20 bp, Artificial
  CRISPR gRNA sequence
gaactcttagggaagcagac

SEQ ID NO: 320247 - DNA, 20 bp, Artificial
  CRISPR gRNA sequence
aactcttagggaagcagaca

SEQ ID NO: 320248 - DNA, 20 bp, Artificial
  CRISPR gRNA sequence
ttagggaagcagacagcagg

SEQ ID NO: 320249 - DNA, 20 bp, Artificial
  CRISPR gRNA sequence
agggaagcagacagcaggca

SEQ ID NO: 320250 - DNA, 20 bp, Artificial
  CRISPR gRNA sequence
gggaagcagacagcaggcat

SEQ ID NO: 320251 - DNA, 20 bp, Artificial
  CRISPR gRNA sequence
gcacaaatatgaatcactgc

SEQ ID NO: 320252 - DNA, 20 bp, Artificial
  CRISPR gRNA sequence
cacaaatatgaatcactgcc

SEQ ID NO: 320253 - DNA, 20 bp, Artificial
  CRISPR gRNA sequence
cctatttcactacactcact

SEQ ID NO: 320254 - DNA, 20 bp, Artificial
  CRISPR gRNA sequence
tttcactacactcactagga

SEQ ID NO: 320255 - DNA, 20 bp, Artificial
  CRISPR gRNA sequence
cactacactcactaggaccc

SEQ ID NO: 320256 - DNA, 20 bp, Artificial
  CRISPR gRNA sequence
actacactcactaggaccct

SEQ ID NO: 320257 - DNA, 20 bp, Artificial
  CRISPR gRNA sequence
cactcactaggaccctgtga

SEQ ID NO: 320258 - DNA, 20 bp, Artificial
  CRISPR gRNA sequence
actaggaccctgtgaagtac

SEQ ID NO: 320259 - DNA, 20 bp, Artificial
  CRISPR gRNA sequence
ggaccctgtgaagtacttga

SEQ ID NO: 320260 - DNA, 20 bp, Artificial
  CRISPR gRNA sequence
tgaagtacttgaggtataaa

SEQ ID NO: 320261 - DNA, 20 bp, Artificial
  CRISPR gRNA sequence
gaggtataaaatgcaccacc

SEQ ID NO: 320262 - DNA, 20 bp, Artificial
  CRISPR gRNA sequence
aggtataaaatgcaccacct

SEQ ID NO: 320263 - DNA, 20 bp, Artificial
  CRISPR gRNA sequence
tagaggatgcgtaccggtat

SEQ ID NO: 320264 - DNA, 20 bp, Artificial
  CRISPR gRNA sequence
gagggaggaaggaaaatcta

SEQ ID NO: 320265 - DNA, 20 bp, Artificial
  CRISPR gRNA sequence
tatgcgtaccctgacagtga

SEQ ID NO: 320266 - DNA, 20 bp, Artificial
  CRISPR gRNA sequence
acagtgaaagggagacctaa

SEQ ID NO: 320267 - DNA, 20 bp, Artificial
  CRISPR gRNA sequence
aggaagatttagtgtgttta

SEQ ID NO: 320268 - DNA, 20 bp, Artificial
  CRISPR gRNA sequence
agtgtgtttatgaatcacct

SEQ ID NO: 320269 - DNA, 20 bp, Artificial
  CRISPR gRNA sequence
gtgtgtttatgaatcacctt

SEQ ID NO: 320270 - DNA, 20 bp, Artificial
  CRISPR gRNA sequence
atgaatcaccttacaaggca

SEQ ID NO: 320271 - DNA, 20 bp, Artificial
  CRISPR gRNA sequence
tgaatcaccttacaaggcaa

SEQ ID NO: 320272 - DNA, 20 bp, Artificial
  CRISPR gRNA sequence
acaaggcaaacctgaggctt

SEQ ID NO: 320273 - DNA, 20 bp, Artificial
  CRISPR gRNA sequence
caaggcaaacctgaggcttc

SEQ ID NO: 320274 - DNA, 20 bp, Artificial
  CRISPR gRNA sequence
aggcttctgcatcttctttg

SEQ ID NO: 320275 - DNA, 20 bp, Artificial
  CRISPR gRNA sequence
ctgcatcttctttgctgagc

SEQ ID NO: 320276 - DNA, 20 bp, Artificial
  CRISPR gRNA sequence
tgcatcttctttgctgagct

SEQ ID NO: 320277 - DNA, 20 bp, Artificial
  CRISPR gRNA sequence
catcttctttgctgagctct

SEQ ID NO: 320278 - DNA, 20 bp, Artificial
  CRISPR gRNA sequence
ctttgctgagctcttaatgt

SEQ ID NO: 320279 - DNA, 20 bp, Artificial
  CRISPR gRNA sequence
tttgctgagctcttaatgta

SEQ ID NO: 320280 - DNA, 20 bp, Artificial
  CRISPR gRNA sequence
tgctgagctcttaatgtaat

SEQ ID NO: 320281 - DNA, 20 bp, Artificial
  CRISPR gRNA sequence
gctgagctcttaatgtaatg

SEQ ID NO: 320282 - DNA, 20 bp, Artificial
  CRISPR gRNA sequence
ctgagctcttaatgtaatgc

SEQ ID NO: 320283 - DNA, 20 bp, Artificial
  CRISPR gRNA sequence
agctcttaatgtaatgcaag

SEQ ID NO: 320284 - DNA, 20 bp, Artificial
  CRISPR gRNA sequence
ttaatgtaatgcaagagtgc

SEQ ID NO: 320285 - DNA, 20 bp, Artificial
  CRISPR gRNA sequence
aatgtaatgcaagagtgccc

SEQ ID NO: 320286 - DNA, 20 bp, Artificial
  CRISPR gRNA sequence
atgtaatgcaagagtgcccc

SEQ ID NO: 320287 - DNA, 20 bp, Artificial
  CRISPR gRNA sequence
ctgtaaaagcttctagcatt

SEQ ID NO: 320288 - DNA, 20 bp, Artificial
  CRISPR gRNA sequence
taaaagcttctagcattgtc

SEQ ID NO: 320289 - DNA, 20 bp, Artificial
  CRISPR gRNA sequence
ctagcattgtctctgaggaa

SEQ ID NO: 320290 - DNA, 20 bp, Artificial
  CRISPR gRNA sequence
tagcattgtctctgaggaaa

SEQ ID NO: 320291 - DNA, 20 bp, Artificial
  CRISPR gRNA sequence
gcattgtctctgaggaaata

SEQ ID NO: 320292 - DNA, 20 bp, Artificial
  CRISPR gRNA sequence
tctctgaggaaatactggtt

SEQ ID NO: 320293 - DNA, 20 bp, Artificial
  CRISPR gRNA sequence
tgaggaaatactggttttag

SEQ ID NO: 320294 - DNA, 20 bp, Artificial
  CRISPR gRNA sequence
aggaaatactggttttagtc

SEQ ID NO: 320295 - DNA, 20 bp, Artificial
  CRISPR gRNA sequence
gttttagtctaaattgtcat

SEQ ID NO: 320296 - DNA, 20 bp, Artificial
  CRISPR gRNA sequence
tagtctaaattgtcatgtaa

SEQ ID NO: 320297 - DNA, 20 bp, Artificial
  CRISPR gRNA sequence
agtctaaattgtcatgtaat

SEQ ID NO: 320298 - DNA, 20 bp, Artificial
  CRISPR gRNA sequence
gtctaaattgtcatgtaata

SEQ ID NO: 320299 - DNA, 20 bp, Artificial
  CRISPR gRNA sequence
aattgtcatgtaatatagga

SEQ ID NO: 320300 - DNA, 20 bp, Artificial
  CRISPR gRNA sequence
tcatgtaatataggacagat

SEQ ID NO: 320301 - DNA, 20 bp, Artificial
  CRISPR gRNA sequence
atggagaaaccaaacacaca

SEQ ID NO: 320302 - DNA, 20 bp, Artificial
  CRISPR gRNA sequence
aaaattctgccaattaacag

SEQ ID NO: 320303 - DNA, 20 bp, Artificial
  CRISPR gRNA sequence
tgccaattaacagtcaatgt

SEQ ID NO: 320304 - DNA, 20 bp, Artificial
  CRISPR gRNA sequence
ccaattaacagtcaatgtta

SEQ ID NO: 320305 - DNA, 20 bp, Artificial
  CRISPR gRNA sequence
acagtcaatgttatgttatt

SEQ ID NO: 320306 - DNA, 20 bp, Artificial
  CRISPR gRNA sequence
tgttattactcagctgtcag

SEQ ID NO: 320307 - DNA, 20 bp, Artificial
  CRISPR gRNA sequence
ttactcagctgtcagttgtg

SEQ ID NO: 320308 - DNA, 20 bp, Artificial
  CRISPR gRNA sequence
ctcagctgtcagttgtgcct

SEQ ID NO: 320309 - DNA, 20 bp, Artificial
  CRISPR gRNA sequence
agctgtcagttgtgccttct

SEQ ID NO: 320310 - DNA, 20 bp, Artificial
  CRISPR gRNA sequence
tcagttgtgccttctggacc

SEQ ID NO: 320311 - DNA, 20 bp, Artificial
  CRISPR gRNA sequence
tgccttctggacctggaaat

SEQ ID NO: 320312 - DNA, 20 bp, Artificial
  CRISPR gRNA sequence
ctggacctggaaatgacttc

SEQ ID NO: 320313 - DNA, 20 bp, Artificial
  CRISPR gRNA sequence
tggacctggaaatgacttcg

SEQ ID NO: 320314 - DNA, 20 bp, Artificial
  CRISPR gRNA sequence
gacctggaaatgacttcgtc

SEQ ID NO: 320315 - DNA, 20 bp, Artificial
  CRISPR gRNA sequence
gaaatgacttcgtctttagc

SEQ ID NO: 320316 - DNA, 20 bp, Artificial
  CRISPR gRNA sequence
cgtctttagctgcttctgtc

SEQ ID NO: 320317 - DNA, 20 bp, Artificial
  CRISPR gRNA sequence
gtctttagctgcttctgtct

SEQ ID NO: 320318 - DNA, 20 bp, Artificial
  CRISPR gRNA sequence
tagctgcttctgtcttcttg

SEQ ID NO: 320319 - DNA, 20 bp, Artificial
  CRISPR gRNA sequence
agctgcttctgtcttcttga

SEQ ID NO: 320320 - DNA, 20 bp, Artificial
  CRISPR gRNA sequence
gctgcttctgtcttcttgat

SEQ ID NO: 320321 - DNA, 20 bp, Artificial
  CRISPR gRNA sequence
cttctgtcttcttgatttac

SEQ ID NO: 320322 - DNA, 20 bp, Artificial
  CRISPR gRNA sequence
ctgtcttcttgatttacata

SEQ ID NO: 320323 - DNA, 20 bp, Artificial
  CRISPR gRNA sequence
tgtcttcttgatttacatat

SEQ ID NO: 320324 - DNA, 20 bp, Artificial
  CRISPR gRNA sequence
tcttcttgatttacatatat

SEQ ID NO: 320325 - DNA, 20 bp, Artificial
  CRISPR gRNA sequence
cttgatttacatatatatat

SEQ ID NO: 320326 - DNA, 20 bp, Artificial
  CRISPR gRNA sequence
ttgatttacatatatatata

SEQ ID NO: 320327 - DNA, 20 bp, Artificial
  CRISPR gRNA sequence
gatttacatatatatatata

SEQ ID NO: 320328 - DNA, 20 bp, Artificial
  CRISPR gRNA sequence
atttacatatatatatatat

SEQ ID NO: 320329 - DNA, 20 bp, Artificial
  CRISPR gRNA sequence
acatatatatatatatatat

SEQ ID NO: 320330 - DNA, 20 bp, Artificial
  CRISPR gRNA sequence
catatatatatatatatata

SEQ ID NO: 320331 - DNA, 20 bp, Artificial
  CRISPR gRNA sequence
ttttttttttttttttctgt

SEQ ID NO: 320332 - DNA, 20 bp, Artificial
  CRISPR gRNA sequence
tttttttttttttttctgta

SEQ ID NO: 320333 - DNA, 20 bp, Artificial
  CRISPR gRNA sequence
ttttttttttttttctgtag

SEQ ID NO: 320334 - DNA, 20 bp, Artificial
  CRISPR gRNA sequence
tttttttttttttctgtaga

SEQ ID NO: 320335 - DNA, 20 bp, Artificial
  CRISPR gRNA sequence
ttttttttttttctgtagag

SEQ ID NO: 320336 - DNA, 20 bp, Artificial
  CRISPR gRNA sequence
tttttttttttctgtagagc

SEQ ID NO: 320337 - DNA, 20 bp, Artificial
  CRISPR gRNA sequence
ttttttttttctgtagagcc

SEQ ID NO: 320338 - DNA, 20 bp, Artificial
  CRISPR gRNA sequence
tttttttttctgtagagcct

SEQ ID NO: 320339 - DNA, 20 bp, Artificial
  CRISPR gRNA sequence
ttttttttctgtagagcctc

SEQ ID NO: 320340 - DNA, 20 bp, Artificial
  CRISPR gRNA sequence
tttttttctgtagagcctca

SEQ ID NO: 320341 - DNA, 20 bp, Artificial
  CRISPR gRNA sequence
ttttttctgtagagcctcac

SEQ ID NO: 320342 - DNA, 20 bp, Artificial
  CRISPR gRNA sequence
tttttctgtagagcctcaca

SEQ ID NO: 320343 - DNA, 20 bp, Artificial
  CRISPR gRNA sequence
ttttctgtagagcctcacag

SEQ ID NO: 320344 - DNA, 20 bp, Artificial
  CRISPR gRNA sequence
tttctgtagagcctcacagt

SEQ ID NO: 320345 - DNA, 20 bp, Artificial
  CRISPR gRNA sequence
ttctgtagagcctcacagta

SEQ ID NO: 320346 - DNA, 20 bp, Artificial
  CRISPR gRNA sequence
tctgtagagcctcacagtat

SEQ ID NO: 320347 - DNA, 20 bp, Artificial
  CRISPR gRNA sequence
ctgtagagcctcacagtatc

SEQ ID NO: 320348 - DNA, 20 bp, Artificial
  CRISPR gRNA sequence
tgtagagcctcacagtatct

SEQ ID NO: 320349 - DNA, 20 bp, Artificial
  CRISPR gRNA sequence
tagagcctcacagtatcttc

SEQ ID NO: 320350 - DNA, 20 bp, Artificial
  CRISPR gRNA sequence
acagtatcttctttccttcc

SEQ ID NO: 320351 - DNA, 20 bp, Artificial
  CRISPR gRNA sequence
ctttccttcccatccattct

SEQ ID NO: 320352 - DNA, 20 bp, Artificial
  CRISPR gRNA sequence
tttccttcccatccattctg

SEQ ID NO: 320353 - DNA, 20 bp, Artificial
  CRISPR gRNA sequence
tccttcccatccattctgtc

SEQ ID NO: 320354 - DNA, 20 bp, Artificial
  CRISPR gRNA sequence
ccttcccatccattctgtcc

SEQ ID NO: 320355 - DNA, 20 bp, Artificial
  CRISPR gRNA sequence
cttcccatccattctgtcca

SEQ ID NO: 320356 - DNA, 20 bp, Artificial
  CRISPR gRNA sequence
cccatccattctgtccactc

SEQ ID NO: 320357 - DNA, 20 bp, Artificial
  CRISPR gRNA sequence
ccatccattctgtccactca

SEQ ID NO: 320358 - DNA, 20 bp, Artificial
  CRISPR gRNA sequence
tgtccactcacagaccagtc

SEQ ID NO: 320359 - DNA, 20 bp, Artificial
  CRISPR gRNA sequence
tccactcacagaccagtcta

SEQ ID NO: 320360 - DNA, 20 bp, Artificial
  CRISPR gRNA sequence
acagaccagtctaactccgc

SEQ ID NO: 320361 - DNA, 20 bp, Artificial
  CRISPR gRNA sequence
actccgctgacccaggcccc

SEQ ID NO: 320362 - DNA, 20 bp, Artificial
  CRISPR gRNA sequence
cgctgacccaggccccttct

SEQ ID NO: 320363 - DNA, 20 bp, Artificial
  CRISPR gRNA sequence
acccaggccccttctcccaa

SEQ ID NO: 320364 - DNA, 20 bp, Artificial
  CRISPR gRNA sequence
ctcccaaagattacaacggc

SEQ ID NO: 320365 - DNA, 20 bp, Artificial
  CRISPR gRNA sequence
tcccaaagattacaacggct

SEQ ID NO: 320366 - DNA, 20 bp, Artificial
  CRISPR gRNA sequence
ccaaagattacaacggcttt

SEQ ID NO: 320367 - DNA, 20 bp, Artificial
  CRISPR gRNA sequence
caacggctttctcttccact

SEQ ID NO: 320368 - DNA, 20 bp, Artificial
  CRISPR gRNA sequence
tctcttccactcatcgagtg

SEQ ID NO: 320369 - DNA, 20 bp, Artificial
  CRISPR gRNA sequence
ctcttccactcatcgagtgc

SEQ ID NO: 320370 - DNA, 20 bp, Artificial
  CRISPR gRNA sequence
tcttccactcatcgagtgct

SEQ ID NO: 320371 - DNA, 20 bp, Artificial
  CRISPR gRNA sequence
ttccactcatcgagtgctcc

SEQ ID NO: 320372 - DNA, 20 bp, Artificial
  CRISPR gRNA sequence
ccactcatcgagtgctccct

SEQ ID NO: 320373 - DNA, 20 bp, Artificial
  CRISPR gRNA sequence
cactcatcgagtgctccctt

SEQ ID NO: 320374 - DNA, 20 bp, Artificial
  CRISPR gRNA sequence
atcgagtgctcccttcttca

SEQ ID NO: 320375 - DNA, 20 bp, Artificial
  CRISPR gRNA sequence
ccttcttcacctagcaactg

SEQ ID NO: 320376 - DNA, 20 bp, Artificial
  CRISPR gRNA sequence
cttcacctagcaactgaaag

SEQ ID NO: 320377 - DNA, 20 bp, Artificial
  CRISPR gRNA sequence
ttcacctagcaactgaaagt

SEQ ID NO: 320378 - DNA, 20 bp, Artificial
  CRISPR gRNA sequence
cacctagcaactgaaagtgt

SEQ ID NO: 320379 - DNA, 20 bp, Artificial
  CRISPR gRNA sequence
acctagcaactgaaagtgtg

SEQ ID NO: 320380 - DNA, 20 bp, Artificial
  CRISPR gRNA sequence
gcaactgaaagtgtgatgta

SEQ ID NO: 320381 - DNA, 20 bp, Artificial
  CRISPR gRNA sequence
aaagtgtgatgtatggacca

SEQ ID NO: 320382 - DNA, 20 bp, Artificial
  CRISPR gRNA sequence
acgtcacatgtgggctggtc

SEQ ID NO: 320383 - DNA, 20 bp, Artificial
  CRISPR gRNA sequence
gtctgaaacacggaatctct

SEQ ID NO: 320384 - DNA, 20 bp, Artificial
  CRISPR gRNA sequence
aaacacggaatctctggccc

SEQ ID NO: 320385 - DNA, 20 bp, Artificial
  CRISPR gRNA sequence
tggccccacccaagacttac

SEQ ID NO: 320386 - DNA, 20 bp, Artificial
  CRISPR gRNA sequence
gccccacccaagacttactg

SEQ ID NO: 320387 - DNA, 20 bp, Artificial
  CRISPR gRNA sequence
actgattcagaacctccatt

SEQ ID NO: 320388 - DNA, 20 bp, Artificial
  CRISPR gRNA sequence
ctgattcagaacctccattt

SEQ ID NO: 320389 - DNA, 20 bp, Artificial
  CRISPR gRNA sequence
attcagaacctccattttaa

SEQ ID NO: 320390 - DNA, 20 bp, Artificial
  CRISPR gRNA sequence
agaacctccattttaacaag

SEQ ID NO: 320391 - DNA, 20 bp, Artificial
  CRISPR gRNA sequence
cattttaacaagagctatag

SEQ ID NO: 320392 - DNA, 20 bp, Artificial
  CRISPR gRNA sequence
taacaagagctatagtttga

SEQ ID NO: 320393 - DNA, 20 bp, Artificial
  CRISPR gRNA sequence
aacaagagctatagtttgag

SEQ ID NO: 320394 - DNA, 20 bp, Artificial
  CRISPR gRNA sequence
acaagagctatagtttgagc

SEQ ID NO: 320395 - DNA, 20 bp, Artificial
  CRISPR gRNA sequence
tagtttgagcagctgttgta

SEQ ID NO: 320396 - DNA, 20 bp, Artificial
  CRISPR gRNA sequence
gagcagctgttgtagagaat

SEQ ID NO: 320397 - DNA, 20 bp, Artificial
  CRISPR gRNA sequence
agcagctgttgtagagaatc

SEQ ID NO: 320398 - DNA, 20 bp, Artificial
  CRISPR gRNA sequence
ttgtagagaatctctgcctc

SEQ ID NO: 320399 - DNA, 20 bp, Artificial
  CRISPR gRNA sequence
tagagaatctctgcctctgt

SEQ ID NO: 320400 - DNA, 20 bp, Artificial
  CRISPR gRNA sequence
tgcctctgtctccagagtgg

SEQ ID NO: 320401 - DNA, 20 bp, Artificial
  CRISPR gRNA sequence
cctctgtctccagagtggat

SEQ ID NO: 320402 - DNA, 20 bp, Artificial
  CRISPR gRNA sequence
tgtctccagagtggatcaca

SEQ ID NO: 320403 - DNA, 20 bp, Artificial
  CRISPR gRNA sequence
tctccagagtggatcacaga

SEQ ID NO: 320404 - DNA, 20 bp, Artificial
  CRISPR gRNA sequence
cagagtggatcacagaaaat

SEQ ID NO: 320405 - DNA, 20 bp, Artificial
  CRISPR gRNA sequence
tttttccatccatccctcct

SEQ ID NO: 320406 - DNA, 20 bp, Artificial
  CRISPR gRNA sequence
ttttccatccatccctcctc

SEQ ID NO: 320407 - DNA, 20 bp, Artificial
  CRISPR gRNA sequence
tttccatccatccctcctca

SEQ ID NO: 320408 - DNA, 20 bp, Artificial
  CRISPR gRNA sequence
ttccatccatccctcctcag

SEQ ID NO: 320409 - DNA, 20 bp, Artificial
  CRISPR gRNA sequence
tccatccatccctcctcaga

SEQ ID NO: 320410 - DNA, 20 bp, Artificial
  CRISPR gRNA sequence
ccatccatccctcctcagac

SEQ ID NO: 320411 - DNA, 20 bp, Artificial
  CRISPR gRNA sequence
catccatccctcctcagact

SEQ ID NO: 320412 - DNA, 20 bp, Artificial
  CRISPR gRNA sequence
ctcagactccctctcctccc

SEQ ID NO: 320413 - DNA, 20 bp, Artificial
  CRISPR gRNA sequence
agactccctctcctccccat

SEQ ID NO: 320414 - DNA, 20 bp, Artificial
  CRISPR gRNA sequence
cctctcctccccatggggtg

SEQ ID NO: 320415 - DNA, 20 bp, Artificial
  CRISPR gRNA sequence
tcctccccatggggtggaaa

SEQ ID NO: 320416 - DNA, 20 bp, Artificial
  CRISPR gRNA sequence
ctccccatggggtggaaatc

SEQ ID NO: 320417 - DNA, 20 bp, Artificial
  CRISPR gRNA sequence
cccatggggtggaaatcact

SEQ ID NO: 320418 - DNA, 20 bp, Artificial
  CRISPR gRNA sequence
tgaaatccattctgagtgga

SEQ ID NO: 320419 - DNA, 20 bp, Artificial
  CRISPR gRNA sequence
gaaatccattctgagtggaa

SEQ ID NO: 320420 - DNA, 20 bp, Artificial
  CRISPR gRNA sequence
aaatccattctgagtggaac

SEQ ID NO: 320421 - DNA, 20 bp, Artificial
  CRISPR gRNA sequence
tgagtggaactgaaagtatt

SEQ ID NO: 320422 - DNA, 20 bp, Artificial
  CRISPR gRNA sequence
agtggaactgaaagtatttt

SEQ ID NO: 320423 - DNA, 20 bp, Artificial
  CRISPR gRNA sequence
aaagtattttgcaatttata

SEQ ID NO: 320424 - DNA, 20 bp, Artificial
  CRISPR gRNA sequence
tgcaatttatactccatagc

SEQ ID NO: 320425 - DNA, 20 bp, Artificial
  CRISPR gRNA sequence
gcaatttatactccatagca

SEQ ID NO: 320426 - DNA, 20 bp, Artificial
  CRISPR gRNA sequence
caatttatactccatagcac

SEQ ID NO: 320427 - DNA, 20 bp, Artificial
  CRISPR gRNA sequence
atactccatagcacctcacc

SEQ ID NO: 320428 - DNA, 20 bp, Artificial
  CRISPR gRNA sequence
tactccatagcacctcacca

SEQ ID NO: 320429 - DNA, 20 bp, Artificial
  CRISPR gRNA sequence
catagcacctcaccaaccac

SEQ ID NO: 320430 - DNA, 20 bp, Artificial
  CRISPR gRNA sequence
accaaccactggcttccatg

SEQ ID NO: 320431 - DNA, 20 bp, Artificial
  CRISPR gRNA sequence
gcttccatgatctcacacag

SEQ ID NO: 320432 - DNA, 20 bp, Artificial
  CRISPR gRNA sequence
ccatgatctcacacagagcc

SEQ ID NO: 320433 - DNA, 20 bp, Artificial
  CRISPR gRNA sequence
catgatctcacacagagcca

SEQ ID NO: 320434 - DNA, 20 bp, Artificial
  CRISPR gRNA sequence
acacagagccaggcatgggg

SEQ ID NO: 320435 - DNA, 20 bp, Artificial
  CRISPR gRNA sequence
ctaatcctttctctgactaa

SEQ ID NO: 320436 - DNA, 20 bp, Artificial
  CRISPR gRNA sequence
atcctttctctgactaaatg

SEQ ID NO: 320437 - DNA, 20 bp, Artificial
  CRISPR gRNA sequence
tctctgactaaatggggaaa

SEQ ID NO: 320438 - DNA, 20 bp, Artificial
  CRISPR gRNA sequence
ctctgactaaatggggaaag

SEQ ID NO: 320439 - DNA, 20 bp, Artificial
  CRISPR gRNA sequence
tctgactaaatggggaaagt

SEQ ID NO: 320440 - DNA, 20 bp, Artificial
  CRISPR gRNA sequence
tgactaaatggggaaagttt

SEQ ID NO: 320441 - DNA, 20 bp, Artificial
  CRISPR gRNA sequence
actaaatggggaaagtttgg

SEQ ID NO: 320442 - DNA, 20 bp, Artificial
  CRISPR gRNA sequence
aatggggaaagtttggctca

SEQ ID NO: 320443 - DNA, 20 bp, Artificial
  CRISPR gRNA sequence
ggctcaaggtctgtgatcac

SEQ ID NO: 320444 - DNA, 20 bp, Artificial
  CRISPR gRNA sequence
gctcaaggtctgtgatcacc

SEQ ID NO: 320445 - DNA, 20 bp, Artificial
  CRISPR gRNA sequence
aaggtctgtgatcaccaaat

SEQ ID NO: 320446 - DNA, 20 bp, Artificial
  CRISPR gRNA sequence
tgatcaccaaatgacttcag

SEQ ID NO: 320447 - DNA, 20 bp, Artificial
  CRISPR gRNA sequence
caggccttccattttatgac

SEQ ID NO: 320448 - DNA, 20 bp, Artificial
  CRISPR gRNA sequence
aggccttccattttatgacc

SEQ ID NO: 320449 - DNA, 20 bp, Artificial
  CRISPR gRNA sequence
ccattttatgaccccagacc

SEQ ID NO: 320450 - DNA, 20 bp, Artificial
  CRISPR gRNA sequence
cattttatgaccccagacct

SEQ ID NO: 320451 - DNA, 20 bp, Artificial
  CRISPR gRNA sequence
tatgaccccagacctcaagc

SEQ ID NO: 320452 - DNA, 20 bp, Artificial
  CRISPR gRNA sequence
atgaccccagacctcaagcc

SEQ ID NO: 320453 - DNA, 20 bp, Artificial
  CRISPR gRNA sequence
tgaccccagacctcaagcca

SEQ ID NO: 320454 - DNA, 20 bp, Artificial
  CRISPR gRNA sequence
aagccacctagcaactggac

SEQ ID NO: 320455 - DNA, 20 bp, Artificial
  CRISPR gRNA sequence
gcaactggacttactgggat

SEQ ID NO: 320456 - DNA, 20 bp, Artificial
  CRISPR gRNA sequence
gacttactgggattccatag

SEQ ID NO: 320457 - DNA, 20 bp, Artificial
  CRISPR gRNA sequence
actgggattccataggtggg

SEQ ID NO: 320458 - DNA, 20 bp, Artificial
  CRISPR gRNA sequence
ctgggattccataggtgggt

SEQ ID NO: 320459 - DNA, 20 bp, Artificial
  CRISPR gRNA sequence
ggattccataggtgggtaag

SEQ ID NO: 320460 - DNA, 20 bp, Artificial
  CRISPR gRNA sequence
cataggtgggtaagcattga

SEQ ID NO: 320461 - DNA, 20 bp, Artificial
  CRISPR gRNA sequence
agaatctctcccttccccag

SEQ ID NO: 320462 - DNA, 20 bp, Artificial
  CRISPR gRNA sequence
tcccttccccagcacttggg

SEQ ID NO: 320463 - DNA, 20 bp, Artificial
  CRISPR gRNA sequence
ccttccccagcacttgggta

SEQ ID NO: 320464 - DNA, 20 bp, Artificial
  CRISPR gRNA sequence
ccccagcacttgggtaagag

SEQ ID NO: 320465 - DNA, 20 bp, Artificial
  CRISPR gRNA sequence
cccagcacttgggtaagagg

SEQ ID NO: 320466 - DNA, 20 bp, Artificial
  CRISPR gRNA sequence
gggtaagaggaatggtcgaa

SEQ ID NO: 320467 - DNA, 20 bp, Artificial
  CRISPR gRNA sequence
ggtaagaggaatggtcgaag

SEQ ID NO: 320468 - DNA, 20 bp, Artificial
  CRISPR gRNA sequence
gttacaatgggttgctatga

SEQ ID NO: 320469 - DNA, 20 bp, Artificial
  CRISPR gRNA sequence
caatgggttgctatgatgtc

SEQ ID NO: 320470 - DNA, 20 bp, Artificial
  CRISPR gRNA sequence
ctatgatgtcaggaacaagt

SEQ ID NO: 320471 - DNA, 20 bp, Artificial
  CRISPR gRNA sequence
tgatgtcaggaacaagtcgc

SEQ ID NO: 320472 - DNA, 20 bp, Artificial
  CRISPR gRNA sequence
aagaatccagctagatgcct

SEQ ID NO: 320473 - DNA, 20 bp, Artificial
  CRISPR gRNA sequence
gatgccttcgtaatcagctg

SEQ ID NO: 320474 - DNA, 20 bp, Artificial
  CRISPR gRNA sequence
cgtaatcagctgaaggaatt

SEQ ID NO: 320475 - DNA, 20 bp, Artificial
  CRISPR gRNA sequence
gtaatcagctgaaggaattt

SEQ ID NO: 320476 - DNA, 20 bp, Artificial
  CRISPR gRNA sequence
aaggaatttgtttcaaagga

SEQ ID NO: 320477 - DNA, 20 bp, Artificial
  CRISPR gRNA sequence
gtttcaaaggataattaagg

SEQ ID NO: 320478 - DNA, 20 bp, Artificial
  CRISPR gRNA sequence
tttcaaaggataattaagga

SEQ ID NO: 320479 - DNA, 20 bp, Artificial
  CRISPR gRNA sequence
caaaggataattaaggactt

SEQ ID NO: 320480 - DNA, 20 bp, Artificial
  CRISPR gRNA sequence
aaaggataattaaggacttc

SEQ ID NO: 320481 - DNA, 20 bp, Artificial
  CRISPR gRNA sequence
aggacttcctgagcaataca

SEQ ID NO: 320482 - DNA, 20 bp, Artificial
  CRISPR gRNA sequence
cctgagcaatacactctact

SEQ ID NO: 320483 - DNA, 20 bp, Artificial
  CRISPR gRNA sequence
ctgagcaatacactctactg

SEQ ID NO: 320484 - DNA, 20 bp, Artificial
  CRISPR gRNA sequence
agcaatacactctactgttg

SEQ ID NO: 320485 - DNA, 20 bp, Artificial
  CRISPR gRNA sequence
tactgttggaatgccactca

SEQ ID NO: 320486 - DNA, 20 bp, Artificial
  CRISPR gRNA sequence
ctgttggaatgccactcaaa

SEQ ID NO: 320487 - DNA, 20 bp, Artificial
  CRISPR gRNA sequence
ttggaatgccactcaaaaac

SEQ ID NO: 320488 - DNA, 20 bp, Artificial
  CRISPR gRNA sequence
gaatgccactcaaaaactgt

SEQ ID NO: 320489 - DNA, 20 bp, Artificial
  CRISPR gRNA sequence
aaaaactgtaatttgctagc

SEQ ID NO: 320490 - DNA, 20 bp, Artificial
  CRISPR gRNA sequence
taatttgctagccttatgaa

SEQ ID NO: 320491 - DNA, 20 bp, Artificial
  CRISPR gRNA sequence
gctagccttatgaagtctct

SEQ ID NO: 320492 - DNA, 20 bp, Artificial
  CRISPR gRNA sequence
ctagccttatgaagtctctg

SEQ ID NO: 320493 - DNA, 20 bp, Artificial
  CRISPR gRNA sequence
gccttatgaagtctctgacc

SEQ ID NO: 320494 - DNA, 20 bp, Artificial
  CRISPR gRNA sequence
atgaagtctctgaccccact

SEQ ID NO: 320495 - DNA, 20 bp, Artificial
  CRISPR gRNA sequence
tgaagtctctgaccccactg

SEQ ID NO: 320496 - DNA, 20 bp, Artificial
  CRISPR gRNA sequence
tgaccccactgggacttcag

SEQ ID NO: 320497 - DNA, 20 bp, Artificial
  CRISPR gRNA sequence
accccactgggacttcagtg

SEQ ID NO: 320498 - DNA, 20 bp, Artificial
  CRISPR gRNA sequence
ggacttcagtgttccctggc

SEQ ID NO: 320499 - DNA, 20 bp, Artificial
  CRISPR gRNA sequence
cagtgttccctggctgctat

SEQ ID NO: 320500 - DNA, 20 bp, Artificial
  CRISPR gRNA sequence
agtgttccctggctgctatc

SEQ ID NO: 320501 - DNA, 20 bp, Artificial
  CRISPR gRNA sequence
cctggctgctatccccaaat

SEQ ID NO: 320502 - DNA, 20 bp, Artificial
  CRISPR gRNA sequence
gctgctatccccaaatgcat

SEQ ID NO: 320503 - DNA, 20 bp, Artificial
  CRISPR gRNA sequence
ctatccccaaatgcatatct

SEQ ID NO: 320504 - DNA, 20 bp, Artificial
  CRISPR gRNA sequence
tccccaaatgcatatcttat

SEQ ID NO: 320505 - DNA, 20 bp, Artificial
  CRISPR gRNA sequence
atatgtttaagaattatctc

SEQ ID NO: 320506 - DNA, 20 bp, Artificial
  CRISPR gRNA sequence
tatgtttaagaattatctct

SEQ ID NO: 320507 - DNA, 20 bp, Artificial
  CRISPR gRNA sequence
aagaattatctcttctttat

SEQ ID NO: 320508 - DNA, 20 bp, Artificial
  CRISPR gRNA sequence
agaattatctcttctttatg

SEQ ID NO: 320509 - DNA, 20 bp, Artificial
  CRISPR gRNA sequence
tctcttctttatgttcctat

SEQ ID NO: 320510 - DNA, 20 bp, Artificial
  CRISPR gRNA sequence
ttctttatgttcctatgctt

SEQ ID NO: 320511 - DNA, 20 bp, Artificial
  CRISPR gRNA sequence
ctttatgttcctatgcttat

SEQ ID NO: 320512 - DNA, 20 bp, Artificial
  CRISPR gRNA sequence
tttatgttcctatgcttatc

SEQ ID NO: 320513 - DNA, 20 bp, Artificial
  CRISPR gRNA sequence
tatgttcctatgcttatctg

SEQ ID NO: 320514 - DNA, 20 bp, Artificial
  CRISPR gRNA sequence
atgttcctatgcttatctgt

SEQ ID NO: 320515 - DNA, 20 bp, Artificial
  CRISPR gRNA sequence
tgttcctatgcttatctgta

SEQ ID NO: 320516 - DNA, 20 bp, Artificial
  CRISPR gRNA sequence
ctatgcttatctgtactaaa

SEQ ID NO: 320517 - DNA, 20 bp, Artificial
  CRISPR gRNA sequence
tgcttatctgtactaaaaaa

SEQ ID NO: 320518 - DNA, 20 bp, Artificial
  CRISPR gRNA sequence
atctgtactaaaaaaaattc

SEQ ID NO: 320519 - DNA, 20 bp, Artificial
  CRISPR gRNA sequence
tctgtactaaaaaaaattcc

SEQ ID NO: 320520 - DNA, 20 bp, Artificial
  CRISPR gRNA sequence
tactaaaaaaaattccttct

SEQ ID NO: 320521 - DNA, 20 bp, Artificial
  CRISPR gRNA sequence
aaaaaaattccttcttttac

SEQ ID NO: 320522 - DNA, 20 bp, Artificial
  CRISPR gRNA sequence
cttcttttactaaacttcct

SEQ ID NO: 320523 - DNA, 20 bp, Artificial
  CRISPR gRNA sequence
cttttactaaacttcctcca

SEQ ID NO: 320524 - DNA, 20 bp, Artificial
  CRISPR gRNA sequence
ttttactaaacttcctccaa

SEQ ID NO: 320525 - DNA, 20 bp, Artificial
  CRISPR gRNA sequence
ttactaaacttcctccaaag

SEQ ID NO: 320526 - DNA, 20 bp, Artificial
  CRISPR gRNA sequence
tactaaacttcctccaaagt

SEQ ID NO: 320527 - DNA, 20 bp, Artificial
  CRISPR gRNA sequence
actaaacttcctccaaagtt

SEQ ID NO: 320528 - DNA, 20 bp, Artificial
  CRISPR gRNA sequence
ctaaacttcctccaaagttt

SEQ ID NO: 320529 - DNA, 20 bp, Artificial
  CRISPR gRNA sequence
aacttcctccaaagttttac

SEQ ID NO: 320530 - DNA, 20 bp, Artificial
  CRISPR gRNA sequence
cctccaaagttttacttggc

SEQ ID NO: 320531 - DNA, 20 bp, Artificial
  CRISPR gRNA sequence
ctccaaagttttacttggcc

SEQ ID NO: 320532 - DNA, 20 bp, Artificial
  CRISPR gRNA sequence
caaagttttacttggccctt

SEQ ID NO: 320533 - DNA, 20 bp, Artificial
  CRISPR gRNA sequence
tacttggccctttgaaagcc

SEQ ID NO: 320534 - DNA, 20 bp, Artificial
  CRISPR gRNA sequence
acttggccctttgaaagcct

SEQ ID NO: 320535 - DNA, 20 bp, Artificial
  CRISPR gRNA sequence
cttggccctttgaaagcctc

SEQ ID NO: 320536 - DNA, 20 bp, Artificial
  CRISPR gRNA sequence
ggccctttgaaagcctcatt

SEQ ID NO: 320537 - DNA, 20 bp, Artificial
  CRISPR gRNA sequence
gccctttgaaagcctcattc

SEQ ID NO: 320538 - DNA, 20 bp, Artificial
  CRISPR gRNA sequence
tgaaagcctcattccattac

SEQ ID NO: 320539 - DNA, 20 bp, Artificial
  CRISPR gRNA sequence
gaaagcctcattccattact

SEQ ID NO: 320540 - DNA, 20 bp, Artificial
  CRISPR gRNA sequence
aaagcctcattccattactt

SEQ ID NO: 320541 - DNA, 20 bp, Artificial
  CRISPR gRNA sequence
attccattacttactacaag

SEQ ID NO: 320542 - DNA, 20 bp, Artificial
  CRISPR gRNA sequence
cattacttactacaaggaaa

SEQ ID NO: 320543 - DNA, 20 bp, Artificial
  CRISPR gRNA sequence
cttactacaaggaaactctc

SEQ ID NO: 320544 - DNA, 20 bp, Artificial
  CRISPR gRNA sequence
actacaaggaaactctccca

SEQ ID NO: 320545 - DNA, 20 bp, Artificial
  CRISPR gRNA sequence
ctacaaggaaactctcccac

SEQ ID NO: 320546 - DNA, 20 bp, Artificial
  CRISPR gRNA sequence
caaggaaactctcccacatc

SEQ ID NO: 320547 - DNA, 20 bp, Artificial
  CRISPR gRNA sequence
tcccacatctttaacccctt

SEQ ID NO: 320548 - DNA, 20 bp, Artificial
  CRISPR gRNA sequence
ccacatctttaaccccttca

SEQ ID NO: 320549 - DNA, 20 bp, Artificial
  CRISPR gRNA sequence
taaccccttcattgactgtt

SEQ ID NO: 320550 - DNA, 20 bp, Artificial
  CRISPR gRNA sequence
aaccccttcattgactgttt

SEQ ID NO: 320551 - DNA, 20 bp, Artificial
  CRISPR gRNA sequence
accccttcattgactgtttc

SEQ ID NO: 320552 - DNA, 20 bp, Artificial
  CRISPR gRNA sequence
cattgactgtttccctgagg

SEQ ID NO: 320553 - DNA, 20 bp, Artificial
  CRISPR gRNA sequence
attgactgtttccctgaggt

SEQ ID NO: 320554 - DNA, 20 bp, Artificial
  CRISPR gRNA sequence
actgtttccctgaggttatt

SEQ ID NO: 320555 - DNA, 20 bp, Artificial
  CRISPR gRNA sequence
tttccctgaggttattattt

SEQ ID NO: 320556 - DNA, 20 bp, Artificial
  CRISPR gRNA sequence
ccctgaggttattatttcag

SEQ ID NO: 320557 - DNA, 20 bp, Artificial
  CRISPR gRNA sequence
cctgaggttattatttcagt

SEQ ID NO: 320558 - DNA, 20 bp, Artificial
  CRISPR gRNA sequence
aggttattatttcagtgaaa

SEQ ID NO: 320559 - DNA, 20 bp, Artificial
  CRISPR gRNA sequence
ttatttcagtgaaatctggc

SEQ ID NO: 320560 - DNA, 20 bp, Artificial
  CRISPR gRNA sequence
tttcagtgaaatctggcttc

SEQ ID NO: 320561 - DNA, 20 bp, Artificial
  CRISPR gRNA sequence
cagtgaaatctggcttcacc

SEQ ID NO: 320562 - DNA, 20 bp, Artificial
  CRISPR gRNA sequence
agtgaaatctggcttcaccc

SEQ ID NO: 320563 - DNA, 20 bp, Artificial
  CRISPR gRNA sequence
gcttcacccaaaggaagcca

SEQ ID NO: 320564 - DNA, 20 bp, Artificial
  CRISPR gRNA sequence
cacccaaaggaagccacttg

SEQ ID NO: 320565 - DNA, 20 bp, Artificial
  CRISPR gRNA sequence
acccaaaggaagccacttgc

SEQ ID NO: 320566 - DNA, 20 bp, Artificial
  CRISPR gRNA sequence
gctccagccccagctactgt

SEQ ID NO: 320567 - DNA, 20 bp, Artificial
  CRISPR gRNA sequence
ctccagccccagctactgtt

SEQ ID NO: 320568 - DNA, 20 bp, Artificial
  CRISPR gRNA sequence
cagccccagctactgtttgt

SEQ ID NO: 320569 - DNA, 20 bp, Artificial
  CRISPR gRNA sequence
ctgtttgttttatcacactt

SEQ ID NO: 320570 - DNA, 20 bp, Artificial
  CRISPR gRNA sequence
tttgttttatcacactttgt

SEQ ID NO: 320571 - DNA, 20 bp, Artificial
  CRISPR gRNA sequence
gttttatcacactttgtggg

SEQ ID NO: 320572 - DNA, 20 bp, Artificial
  CRISPR gRNA sequence
ttttatcacactttgtgggg

SEQ ID NO: 320573 - DNA, 20 bp, Artificial
  CRISPR gRNA sequence
tatcacactttgtggggact

SEQ ID NO: 320574 - DNA, 20 bp, Artificial
  CRISPR gRNA sequence
atcacactttgtggggactt

SEQ ID NO: 320575 - DNA, 20 bp, Artificial
  CRISPR gRNA sequence
tcacactttgtggggacttt

SEQ ID NO: 320576 - DNA, 20 bp, Artificial
  CRISPR gRNA sequence
tgtggggactttgagcaaca

SEQ ID NO: 320577 - DNA, 20 bp, Artificial
  CRISPR gRNA sequence
gtggggactttgagcaacac

SEQ ID NO: 320578 - DNA, 20 bp, Artificial
  CRISPR gRNA sequence
tggggactttgagcaacacc

SEQ ID NO: 320579 - DNA, 20 bp, Artificial
  CRISPR gRNA sequence
tgagcaacaccttccccttt

SEQ ID NO: 320580 - DNA, 20 bp, Artificial
  CRISPR gRNA sequence
gagcaacaccttcccctttt

SEQ ID NO: 320581 - DNA, 20 bp, Artificial
  CRISPR gRNA sequence
agcaacaccttccccttttg

SEQ ID NO: 320582 - DNA, 20 bp, Artificial
  CRISPR gRNA sequence
ccccttttgaggtgtctgac

SEQ ID NO: 320583 - DNA, 20 bp, Artificial
  CRISPR gRNA sequence
cccttttgaggtgtctgact

SEQ ID NO: 320584 - DNA, 20 bp, Artificial
  CRISPR gRNA sequence
ttgaggtgtctgactttctc

SEQ ID NO: 320585 - DNA, 20 bp, Artificial
  CRISPR gRNA sequence
tgaggtgtctgactttctca

SEQ ID NO: 320586 - DNA, 20 bp, Artificial
  CRISPR gRNA sequence
gaggtgtctgactttctcat

SEQ ID NO: 320587 - DNA, 20 bp, Artificial
  CRISPR gRNA sequence
aggtgtctgactttctcatt

SEQ ID NO: 320588 - DNA, 20 bp, Artificial
  CRISPR gRNA sequence
actttctcattgcttgtagc

SEQ ID NO: 320589 - DNA, 20 bp, Artificial
  CRISPR gRNA sequence
tctcattgcttgtagctact

SEQ ID NO: 320590 - DNA, 20 bp, Artificial
  CRISPR gRNA sequence
ctcattgcttgtagctacta

SEQ ID NO: 320591 - DNA, 20 bp, Artificial
  CRISPR gRNA sequence
tcattgcttgtagctactaa

SEQ ID NO: 320592 - DNA, 20 bp, Artificial
  CRISPR gRNA sequence
attgcttgtagctactaagt

SEQ ID NO: 320593 - DNA, 20 bp, Artificial
  CRISPR gRNA sequence
cttgtagctactaagtcact

SEQ ID NO: 320594 - DNA, 20 bp, Artificial
  CRISPR gRNA sequence
gtagctactaagtcactacc

SEQ ID NO: 320595 - DNA, 20 bp, Artificial
  CRISPR gRNA sequence
tagctactaagtcactacca

SEQ ID NO: 320596 - DNA, 20 bp, Artificial
  CRISPR gRNA sequence
ctaagtcactaccaccttgc

SEQ ID NO: 320597 - DNA, 20 bp, Artificial
  CRISPR gRNA sequence
agtcactaccaccttgctaa

SEQ ID NO: 320598 - DNA, 20 bp, Artificial
  CRISPR gRNA sequence
ccaccttgctaaatgaggat

SEQ ID NO: 320599 - DNA, 20 bp, Artificial
  CRISPR gRNA sequence
gctaaatgaggattttggca

SEQ ID NO: 320600 - DNA, 20 bp, Artificial
  CRISPR gRNA sequence
ctaaatgaggattttggcat

SEQ ID NO: 320601 - DNA, 20 bp, Artificial
  CRISPR gRNA sequence
aatgaggattttggcattag

SEQ ID NO: 320602 - DNA, 20 bp, Artificial
  CRISPR gRNA sequence
tggcattagatgcaaggtct

SEQ ID NO: 320603 - DNA, 20 bp, Artificial
  CRISPR gRNA sequence
ggcattagatgcaaggtctt

SEQ ID NO: 320604 - DNA, 20 bp, Artificial
  CRISPR gRNA sequence
gcattagatgcaaggtcttg

SEQ ID NO: 320605 - DNA, 20 bp, Artificial
  CRISPR gRNA sequence
gatgcaaggtcttgctaaca

SEQ ID NO: 320606 - DNA, 20 bp, Artificial
  CRISPR gRNA sequence
gctaacaatttgggtgactt

SEQ ID NO: 320607 - DNA, 20 bp, Artificial
  CRISPR gRNA sequence
ctaacaatttgggtgacttc

SEQ ID NO: 320608 - DNA, 20 bp, Artificial
  CRISPR gRNA sequence
acaatttgggtgacttcttc

SEQ ID NO: 320609 - DNA, 20 bp, Artificial
  CRISPR gRNA sequence
gggtgacttcttcatgaatg

SEQ ID NO: 320610 - DNA, 20 bp, Artificial
  CRISPR gRNA sequence
ggtgacttcttcatgaatga

SEQ ID NO: 320611 - DNA, 20 bp, Artificial
  CRISPR gRNA sequence
cttcatgaatgagtctaaca

SEQ ID NO: 320612 - DNA, 20 bp, Artificial
  CRISPR gRNA sequence
ttcatgaatgagtctaacaa

SEQ ID NO: 320613 - DNA, 20 bp, Artificial
  CRISPR gRNA sequence
catgaatgagtctaacaacc

SEQ ID NO: 320614 - DNA, 20 bp, Artificial
  CRISPR gRNA sequence
atgaatgagtctaacaacct

SEQ ID NO: 320615 - DNA, 20 bp, Artificial
  CRISPR gRNA sequence
acaaccttgcctcaaatttc

SEQ ID NO: 320616 - DNA, 20 bp, Artificial
  CRISPR gRNA sequence
gcctcaaatttctttgatct

SEQ ID NO: 320617 - DNA, 20 bp, Artificial
  CRISPR gRNA sequence
cctcaaatttctttgatctt

SEQ ID NO: 320618 - DNA, 20 bp, Artificial
  CRISPR gRNA sequence
aaatttctttgatcttgtca

SEQ ID NO: 320619 - DNA, 20 bp, Artificial
  CRISPR gRNA sequence
ctttgatcttgtcaactcca

SEQ ID NO: 320620 - DNA, 20 bp, Artificial
  CRISPR gRNA sequence
tttgatcttgtcaactccac

SEQ ID NO: 320621 - DNA, 20 bp, Artificial
  CRISPR gRNA sequence
tgatcttgtcaactccacag

SEQ ID NO: 320622 - DNA, 20 bp, Artificial
  CRISPR gRNA sequence
gatcttgtcaactccacagg

SEQ ID NO: 320623 - DNA, 20 bp, Artificial
  CRISPR gRNA sequence
atcttgtcaactccacaggt

SEQ ID NO: 320624 - DNA, 20 bp, Artificial
  CRISPR gRNA sequence
gtcaactccacaggtctaca

SEQ ID NO: 320625 - DNA, 20 bp, Artificial
  CRISPR gRNA sequence
tcaactccacaggtctacac

SEQ ID NO: 320626 - DNA, 20 bp, Artificial
  CRISPR gRNA sequence
cacaggtctacacccgcaga

SEQ ID NO: 320627 - DNA, 20 bp, Artificial
  CRISPR gRNA sequence
cacccgcagactatttcagc

SEQ ID NO: 320628 - DNA, 20 bp, Artificial
  CRISPR gRNA sequence
tttcagcagctgccccccac

SEQ ID NO: 320629 - DNA, 20 bp, Artificial
  CRISPR gRNA sequence
cagcagctgccccccacctt

SEQ ID NO: 320630 - DNA, 20 bp, Artificial
  CRISPR gRNA sequence
agcagctgccccccaccttc

SEQ ID NO: 320631 - DNA, 20 bp, Artificial
  CRISPR gRNA sequence
ccccccaccttcttatgaca

SEQ ID NO: 320632 - DNA, 20 bp, Artificial
  CRISPR gRNA sequence
cttatgacataaccctgaaa

SEQ ID NO: 320633 - DNA, 20 bp, Artificial
  CRISPR gRNA sequence
ttatgacataaccctgaaac

SEQ ID NO: 320634 - DNA, 20 bp, Artificial
  CRISPR gRNA sequence
atgacataaccctgaaactt

SEQ ID NO: 320635 - DNA, 20 bp, Artificial
  CRISPR gRNA sequence
tgacataaccctgaaacttt

SEQ ID NO: 320636 - DNA, 20 bp, Artificial
  CRISPR gRNA sequence
aaacttttcacctggagcag

SEQ ID NO: 320637 - DNA, 20 bp, Artificial
  CRISPR gRNA sequence
ttcacctggagcagctcagt

SEQ ID NO: 320638 - DNA, 20 bp, Artificial
  CRISPR gRNA sequence
tcacctggagcagctcagtc

SEQ ID NO: 320639 - DNA, 20 bp, Artificial
  CRISPR gRNA sequence
cacctggagcagctcagtcc

SEQ ID NO: 320640 - DNA, 20 bp, Artificial
  CRISPR gRNA sequence
acctggagcagctcagtccc

SEQ ID NO: 320641 - DNA, 20 bp, Artificial
  CRISPR gRNA sequence
gagcagctcagtccctagaa

SEQ ID NO: 320642 - DNA, 20 bp, Artificial
  CRISPR gRNA sequence
agtccctagaatcttaatct

SEQ ID NO: 320643 - DNA, 20 bp, Artificial
  CRISPR gRNA sequence
gaatcttaatctcaatatac

SEQ ID NO: 320644 - DNA, 20 bp, Artificial
  CRISPR gRNA sequence
aatctcaatatactaatctc

SEQ ID NO: 320645 - DNA, 20 bp, Artificial
  CRISPR gRNA sequence
atctcaatatactaatctcc

SEQ ID NO: 320646 - DNA, 20 bp, Artificial
  CRISPR gRNA sequence
aatatactaatctccgtcca

SEQ ID NO: 320647 - DNA, 20 bp, Artificial
  CRISPR gRNA sequence
atctccgtccacaacctcct

SEQ ID NO: 320648 - DNA, 20 bp, Artificial
  CRISPR gRNA sequence
cgtccacaacctcctattca

SEQ ID NO: 320649 - DNA, 20 bp, Artificial
  CRISPR gRNA sequence
ctattcatccaggttttgct

SEQ ID NO: 320650 - DNA, 20 bp, Artificial
  CRISPR gRNA sequence
ttcatccaggttttgctctt

SEQ ID NO: 320651 - DNA, 20 bp, Artificial
  CRISPR gRNA sequence
atccaggttttgctcttgct

SEQ ID NO: 320652 - DNA, 20 bp, Artificial
  CRISPR gRNA sequence
tgctcttgcttactccttct

SEQ ID NO: 320653 - DNA, 20 bp, Artificial
  CRISPR gRNA sequence
gctcttgcttactccttcta

SEQ ID NO: 320654 - DNA, 20 bp, Artificial
  CRISPR gRNA sequence
ctcttgcttactccttctac

SEQ ID NO: 320655 - DNA, 20 bp, Artificial
  CRISPR gRNA sequence
ttgcttactccttctacaac

SEQ ID NO: 320656 - DNA, 20 bp, Artificial
  CRISPR gRNA sequence
gcttactccttctacaactg

SEQ ID NO: 320657 - DNA, 20 bp, Artificial
  CRISPR gRNA sequence
cttactccttctacaactgt

SEQ ID NO: 320658 - DNA, 20 bp, Artificial
  CRISPR gRNA sequence
actccttctacaactgttgt

SEQ ID NO: 320659 - DNA, 20 bp, Artificial
  CRISPR gRNA sequence
ctccttctacaactgttgtt

SEQ ID NO: 320660 - DNA, 20 bp, Artificial
  CRISPR gRNA sequence
cttctacaactgttgttcaa

SEQ ID NO: 320661 - DNA, 20 bp, Artificial
  CRISPR gRNA sequence
ctacaactgttgttcaactt

SEQ ID NO: 320662 - DNA, 20 bp, Artificial
  CRISPR gRNA sequence
tacaactgttgttcaactta

SEQ ID NO: 320663 - DNA, 20 bp, Artificial
  CRISPR gRNA sequence
caactgttgttcaacttaat

SEQ ID NO: 320664 - DNA, 20 bp, Artificial
  CRISPR gRNA sequence
ttgttcaacttaatcaagac

SEQ ID NO: 320665 - DNA, 20 bp, Artificial
  CRISPR gRNA sequence
ttcaacttaatcaagacctc

SEQ ID NO: 320666 - DNA, 20 bp, Artificial
  CRISPR gRNA sequence
aacttaatcaagacctcagc

SEQ ID NO: 320667 - DNA, 20 bp, Artificial
  CRISPR gRNA sequence
aatcaagacctcagctttat

SEQ ID NO: 320668 - DNA, 20 bp, Artificial
  CRISPR gRNA sequence
atcaagacctcagctttatc

SEQ ID NO: 320669 - DNA, 20 bp, Artificial
  CRISPR gRNA sequence
agctttatccagaccctgta

SEQ ID NO: 320670 - DNA, 20 bp, Artificial
  CRISPR gRNA sequence
tatccagaccctgtagtgca

SEQ ID NO: 320671 - DNA, 20 bp, Artificial
  CRISPR gRNA sequence
atccagaccctgtagtgcag

SEQ ID NO: 320672 - DNA, 20 bp, Artificial
  CRISPR gRNA sequence
tccagaccctgtagtgcagt

SEQ ID NO: 320673 - DNA, 20 bp, Artificial
  CRISPR gRNA sequence
tagtgcagtgttttccacaa

SEQ ID NO: 320674 - DNA, 20 bp, Artificial
  CRISPR gRNA sequence
tccacaagaactcttagtga

SEQ ID NO: 320675 - DNA, 20 bp, Artificial
  CRISPR gRNA sequence
ccacaagaactcttagtgat

SEQ ID NO: 320676 - DNA, 20 bp, Artificial
  CRISPR gRNA sequence
cacaagaactcttagtgata

SEQ ID NO: 320677 - DNA, 20 bp, Artificial
  CRISPR gRNA sequence
ttagtgataatggaaatgct

SEQ ID NO: 320678 - DNA, 20 bp, Artificial
  CRISPR gRNA sequence
agtgataatggaaatgctct

SEQ ID NO: 320679 - DNA, 20 bp, Artificial
  CRISPR gRNA sequence
gtgataatggaaatgctctg

SEQ ID NO: 320680 - DNA, 20 bp, Artificial
  CRISPR gRNA sequence
tgtctctgtgctgaacaata

SEQ ID NO: 320681 - DNA, 20 bp, Artificial
  CRISPR gRNA sequence
tctctgtgctgaacaatatg

SEQ ID NO: 320682 - DNA, 20 bp, Artificial
  CRISPR gRNA sequence
tgtgctgaacaatatgatag

SEQ ID NO: 320683 - DNA, 20 bp, Artificial
  CRISPR gRNA sequence
tgctgaacaatatgatagcc

SEQ ID NO: 320684 - DNA, 20 bp, Artificial
  CRISPR gRNA sequence
aacaatatgatagccaccag

SEQ ID NO: 320685 - DNA, 20 bp, Artificial
  CRISPR gRNA sequence
tggctattgagcaattgata

SEQ ID NO: 320686 - DNA, 20 bp, Artificial
  CRISPR gRNA sequence
ttgagcaattgatacatagc

SEQ ID NO: 320687 - DNA, 20 bp, Artificial
  CRISPR gRNA sequence
agcaattgatacatagctag

SEQ ID NO: 320688 - DNA, 20 bp, Artificial
  CRISPR gRNA sequence
atacatagctagtatgactg

SEQ ID NO: 320689 - DNA, 20 bp, Artificial
  CRISPR gRNA sequence
gtatgactgagaagatgaat

SEQ ID NO: 320690 - DNA, 20 bp, Artificial
  CRISPR gRNA sequence
agaagatgaatttttaatct

SEQ ID NO: 320691 - DNA, 20 bp, Artificial
  CRISPR gRNA sequence
ttaatcttatttaattttaa

SEQ ID NO: 320692 - DNA, 20 bp, Artificial
  CRISPR gRNA sequence
taatcttatttaattttaat

SEQ ID NO: 320693 - DNA, 20 bp, Artificial
  CRISPR gRNA sequence
aatcttatttaattttaatt

SEQ ID NO: 320694 - DNA, 20 bp, Artificial
  CRISPR gRNA sequence
atcttatttaattttaatta

SEQ ID NO: 320695 - DNA, 20 bp, Artificial
  CRISPR gRNA sequence
atttaattttaattaattga

SEQ ID NO: 320696 - DNA, 20 bp, Artificial
  CRISPR gRNA sequence
tttaattttaattaattgaa

SEQ ID NO: 320697 - DNA, 20 bp, Artificial
  CRISPR gRNA sequence
aattttaattaattgaaatt

SEQ ID NO: 320698 - DNA, 20 bp, Artificial
  CRISPR gRNA sequence
attttaattaattgaaattt

SEQ ID NO: 320699 - DNA, 20 bp, Artificial
  CRISPR gRNA sequence
taattaattgaaatttaagt

SEQ ID NO: 320700 - DNA, 20 bp, Artificial
  CRISPR gRNA sequence
aattaattgaaatttaagta

SEQ ID NO: 320701 - DNA, 20 bp, Artificial
  CRISPR gRNA sequence
attaattgaaatttaagtag

SEQ ID NO: 320702 - DNA, 20 bp, Artificial
  CRISPR gRNA sequence
attgaaatttaagtagtcac

SEQ ID NO: 320703 - DNA, 20 bp, Artificial
  CRISPR gRNA sequence
aaatttaagtagtcacatat

SEQ ID NO: 320704 - DNA, 20 bp, Artificial
  CRISPR gRNA sequence
aagtagtcacatatggctag

SEQ ID NO: 320705 - DNA, 20 bp, Artificial
  CRISPR gRNA sequence
agtagtcacatatggctagt

SEQ ID NO: 320706 - DNA, 20 bp, Artificial
  CRISPR gRNA sequence
gtggttattatattggacaa

SEQ ID NO: 320707 - DNA, 20 bp, Artificial
  CRISPR gRNA sequence
ttatattggacaatgcaaca

SEQ ID NO: 320708 - DNA, 20 bp, Artificial
  CRISPR gRNA sequence
tattggacaatgcaacaata

SEQ ID NO: 320709 - DNA, 20 bp, Artificial
  CRISPR gRNA sequence
gacaatgcaacaatagtatg

SEQ ID NO: 320710 - DNA, 20 bp, Artificial
  CRISPR gRNA sequence
tgtaattattcctttccaca

SEQ ID NO: 320711 - DNA, 20 bp, Artificial
  CRISPR gRNA sequence
gtaattattcctttccacaa

SEQ ID NO: 320712 - DNA, 20 bp, Artificial
  CRISPR gRNA sequence
taattattcctttccacaac

SEQ ID NO: 320713 - DNA, 20 bp, Artificial
  CRISPR gRNA sequence
ttcctttccacaacttcaat

SEQ ID NO: 320714 - DNA, 20 bp, Artificial
  CRISPR gRNA sequence
ctttccacaacttcaataaa

SEQ ID NO: 320715 - DNA, 20 bp, Artificial
  CRISPR gRNA sequence
tccacaacttcaataaacac

SEQ ID NO: 320716 - DNA, 20 bp, Artificial
  CRISPR gRNA sequence
ccacaacttcaataaacaca

SEQ ID NO: 320717 - DNA, 20 bp, Artificial
  CRISPR gRNA sequence
cacaacttcaataaacacac

SEQ ID NO: 320718 - DNA, 20 bp, Artificial
  CRISPR gRNA sequence
caataaacacacccctttgt

SEQ ID NO: 320719 - DNA, 20 bp, Artificial
  CRISPR gRNA sequence
aataaacacacccctttgtc

SEQ ID NO: 320720 - DNA, 20 bp, Artificial
  CRISPR gRNA sequence
tgtctctataaaatttaccc

SEQ ID NO: 320721 - DNA, 20 bp, Artificial
  CRISPR gRNA sequence
gtctctataaaatttaccct

SEQ ID NO: 320722 - DNA, 20 bp, Artificial
  CRISPR gRNA sequence
tctctataaaatttaccctg

SEQ ID NO: 320723 - DNA, 20 bp, Artificial
  CRISPR gRNA sequence
tataaaatttaccctgggga

SEQ ID NO: 320724 - DNA, 20 bp, Artificial
  CRISPR gRNA sequence
taaaatttaccctggggaca

SEQ ID NO: 320725 - DNA, 20 bp, Artificial
  CRISPR gRNA sequence
accctggggacactctactt

SEQ ID NO: 320726 - DNA, 20 bp, Artificial
  CRISPR gRNA sequence
ccctggggacactctacttt

SEQ ID NO: 320727 - DNA, 20 bp, Artificial
  CRISPR gRNA sequence
gggacactctacttttggtc

SEQ ID NO: 320728 - DNA, 20 bp, Artificial
  CRISPR gRNA sequence
tacttttggtctacatatct

SEQ ID NO: 320729 - DNA, 20 bp, Artificial
  CRISPR gRNA sequence
cttttggtctacatatctgt

SEQ ID NO: 320730 - DNA, 20 bp, Artificial
  CRISPR gRNA sequence
ttggtctacatatctgttct

SEQ ID NO: 320731 - DNA, 20 bp, Artificial
  CRISPR gRNA sequence
tggtctacatatctgttctt

SEQ ID NO: 320732 - DNA, 20 bp, Artificial
  CRISPR gRNA sequence
ggtctacatatctgttctta

SEQ ID NO: 320733 - DNA, 20 bp, Artificial
  CRISPR gRNA sequence
gtctacatatctgttcttac

SEQ ID NO: 320734 - DNA, 20 bp, Artificial
  CRISPR gRNA sequence
catatctgttcttacaactg

SEQ ID NO: 320735 - DNA, 20 bp, Artificial
  CRISPR gRNA sequence
ttcttacaactgggcaattg

SEQ ID NO: 320736 - DNA, 20 bp, Artificial
  CRISPR gRNA sequence
ttacaactgggcaattgagc

SEQ ID NO: 320737 - DNA, 20 bp, Artificial
  CRISPR gRNA sequence
acaactgggcaattgagcag

SEQ ID NO: 320738 - DNA, 20 bp, Artificial
  CRISPR gRNA sequence
caactgggcaattgagcagt

SEQ ID NO: 320739 - DNA, 20 bp, Artificial
  CRISPR gRNA sequence
ggcaattgagcagttctgga

SEQ ID NO: 320740 - DNA, 20 bp, Artificial
  CRISPR gRNA sequence
agcagttctggaggaaatta

SEQ ID NO: 320741 - DNA, 20 bp, Artificial
  CRISPR gRNA sequence
tggaggaaattattcagttg

SEQ ID NO: 320742 - DNA, 20 bp, Artificial
  CRISPR gRNA sequence
gaggaaattattcagttgtg

SEQ ID NO: 320743 - DNA, 20 bp, Artificial
  CRISPR gRNA sequence
ttcagttgtgcggactggtg

SEQ ID NO: 320744 - DNA, 20 bp, Artificial
  CRISPR gRNA sequence
agttgtgcggactggtgaca

SEQ ID NO: 320745 - DNA, 20 bp, Artificial
  CRISPR gRNA sequence
tgcggactggtgacattcca

SEQ ID NO: 320746 - DNA, 20 bp, Artificial
  CRISPR gRNA sequence
gtgacattccaaatctgcag

SEQ ID NO: 320747 - DNA, 20 bp, Artificial
  CRISPR gRNA sequence
caaatctgcagtgtcctgtc

SEQ ID NO: 320748 - DNA, 20 bp, Artificial
  CRISPR gRNA sequence
cagtgtcctgtctcacttca

SEQ ID NO: 320749 - DNA, 20 bp, Artificial
  CRISPR gRNA sequence
tctcacttcactcggcctcc

SEQ ID NO: 320750 - DNA, 20 bp, Artificial
  CRISPR gRNA sequence
acttcactcggcctccaggc

SEQ ID NO: 320751 - DNA, 20 bp, Artificial
  CRISPR gRNA sequence
cactcggcctccaggctatt

SEQ ID NO: 320752 - DNA, 20 bp, Artificial
  CRISPR gRNA sequence
actcggcctccaggctattc

SEQ ID NO: 320753 - DNA, 20 bp, Artificial
  CRISPR gRNA sequence
ggcctccaggctattcacct

SEQ ID NO: 320754 - DNA, 20 bp, Artificial
  CRISPR gRNA sequence
caggctattcacctggttca

SEQ ID NO: 320755 - DNA, 20 bp, Artificial
  CRISPR gRNA sequence
ttcacctggttcacctccat

SEQ ID NO: 320756 - DNA, 20 bp, Artificial
  CRISPR gRNA sequence
acctggttcacctccattac

SEQ ID NO: 320757 - DNA, 20 bp, Artificial
  CRISPR gRNA sequence
gttcacctccattacttcaa

SEQ ID NO: 320758 - DNA, 20 bp, Artificial
  CRISPR gRNA sequence
acctccattacttcaaacac

SEQ ID NO: 320759 - DNA, 20 bp, Artificial
  CRISPR gRNA sequence
cattacttcaaacacaaacc

SEQ ID NO: 320760 - DNA, 20 bp, Artificial
  CRISPR gRNA sequence
cttcaaacacaaaccttgtg

SEQ ID NO: 320761 - DNA, 20 bp, Artificial
  CRISPR gRNA sequence
caaacacaaaccttgtgcta

SEQ ID NO: 320762 - DNA, 20 bp, Artificial
  CRISPR gRNA sequence
aaacacaaaccttgtgctac

SEQ ID NO: 320763 - DNA, 20 bp, Artificial
  CRISPR gRNA sequence
gtgctactgcttttagtttc

SEQ ID NO: 320764 - DNA, 20 bp, Artificial
  CRISPR gRNA sequence
tgctactgcttttagtttct

SEQ ID NO: 320765 - DNA, 20 bp, Artificial
  CRISPR gRNA sequence
ctgcttttagtttctctttc

SEQ ID NO: 320766 - DNA, 20 bp, Artificial
  CRISPR gRNA sequence
cttttagtttctctttccct

SEQ ID NO: 320767 - DNA, 20 bp, Artificial
  CRISPR gRNA sequence
ttagtttctctttcccttgg

SEQ ID NO: 320768 - DNA, 20 bp, Artificial
  CRISPR gRNA sequence
tagtttctctttcccttgga

SEQ ID NO: 320769 - DNA, 20 bp, Artificial
  CRISPR gRNA sequence
agtttctctttcccttggag

SEQ ID NO: 320770 - DNA, 20 bp, Artificial
  CRISPR gRNA sequence
gtttctctttcccttggagt

SEQ ID NO: 320771 - DNA, 20 bp, Artificial
  CRISPR gRNA sequence
ctctttcccttggagtcaaa

SEQ ID NO: 320772 - DNA, 20 bp, Artificial
  CRISPR gRNA sequence
tctttcccttggagtcaaac

SEQ ID NO: 320773 - DNA, 20 bp, Artificial
  CRISPR gRNA sequence
tttcccttggagtcaaactc

SEQ ID NO: 320774 - DNA, 20 bp, Artificial
  CRISPR gRNA sequence
tcccttggagtcaaactccc

SEQ ID NO: 320775 - DNA, 20 bp, Artificial
  CRISPR gRNA sequence
cccttggagtcaaactccct

SEQ ID NO: 320776 - DNA, 20 bp, Artificial
  CRISPR gRNA sequence
ccttggagtcaaactccctg

SEQ ID NO: 320777 - DNA, 20 bp, Artificial
  CRISPR gRNA sequence
ggagtcaaactccctgaaag

SEQ ID NO: 320778 - DNA, 20 bp, Artificial
  CRISPR gRNA sequence
gagtcaaactccctgaaaga

SEQ ID NO: 320779 - DNA, 20 bp, Artificial
  CRISPR gRNA sequence
cctgaaagagtaagcagcaa

SEQ ID NO: 320780 - DNA, 20 bp, Artificial
  CRISPR gRNA sequence
aaagagtaagcagcaattgc

SEQ ID NO: 320781 - DNA, 20 bp, Artificial
  CRISPR gRNA sequence
ctgcctttattcccagcctc

SEQ ID NO: 320782 - DNA, 20 bp, Artificial
  CRISPR gRNA sequence
cctttattcccagcctccca

SEQ ID NO: 320783 - DNA, 20 bp, Artificial
  CRISPR gRNA sequence
tattcccagcctcccacccc

SEQ ID NO: 320784 - DNA, 20 bp, Artificial
  CRISPR gRNA sequence
attcccagcctcccaccccc

SEQ ID NO: 320785 - DNA, 20 bp, Artificial
  CRISPR gRNA sequence
ttcccagcctcccaccccca

SEQ ID NO: 320786 - DNA, 20 bp, Artificial
  CRISPR gRNA sequence
ccagcctcccacccccacct

SEQ ID NO: 320787 - DNA, 20 bp, Artificial
  CRISPR gRNA sequence
ccacccccacctctctactg

SEQ ID NO: 320788 - DNA, 20 bp, Artificial
  CRISPR gRNA sequence
tctactgaaactccctgaca

SEQ ID NO: 320789 - DNA, 20 bp, Artificial
  CRISPR gRNA sequence
tactgaaactccctgacaaa

SEQ ID NO: 320790 - DNA, 20 bp, Artificial
  CRISPR gRNA sequence
ctgaaactccctgacaaagg

SEQ ID NO: 320791 - DNA, 20 bp, Artificial
  CRISPR gRNA sequence
aaactccctgacaaaggttg

SEQ ID NO: 320792 - DNA, 20 bp, Artificial
  CRISPR gRNA sequence
cctgacaaaggttgttggtg

SEQ ID NO: 320793 - DNA, 20 bp, Artificial
  CRISPR gRNA sequence
acaaaggttgttggtgactt

SEQ ID NO: 320794 - DNA, 20 bp, Artificial
  CRISPR gRNA sequence
ttggtgacttcacaccatgg

SEQ ID NO: 320795 - DNA, 20 bp, Artificial
  CRISPR gRNA sequence
gtgacttcacaccatggcca

SEQ ID NO: 320796 - DNA, 20 bp, Artificial
  CRISPR gRNA sequence
cacaccatggccaaggcttg

SEQ ID NO: 320797 - DNA, 20 bp, Artificial
  CRISPR gRNA sequence
acaccatggccaaggcttga

SEQ ID NO: 320798 - DNA, 20 bp, Artificial
  CRISPR gRNA sequence
gagctcttttcagatctcaa

SEQ ID NO: 320799 - DNA, 20 bp, Artificial
  CRISPR gRNA sequence
agctcttttcagatctcaac

SEQ ID NO: 320800 - DNA, 20 bp, Artificial
  CRISPR gRNA sequence
ttttcagatctcaactcatt

SEQ ID NO: 320801 - DNA, 20 bp, Artificial
  CRISPR gRNA sequence
ttcagatctcaactcatttg

SEQ ID NO: 320802 - DNA, 20 bp, Artificial
  CRISPR gRNA sequence
tcagatctcaactcatttga

SEQ ID NO: 320803 - DNA, 20 bp, Artificial
  CRISPR gRNA sequence
cagatctcaactcatttgac

SEQ ID NO: 320804 - DNA, 20 bp, Artificial
  CRISPR gRNA sequence
agatctcaactcatttgacc

SEQ ID NO: 320805 - DNA, 20 bp, Artificial
  CRISPR gRNA sequence
aactcatttgaccgctgtgt

SEQ ID NO: 320806 - DNA, 20 bp, Artificial
  CRISPR gRNA sequence
atttgaccgctgtgtcaaat

SEQ ID NO: 320807 - DNA, 20 bp, Artificial
  CRISPR gRNA sequence
gaccgctgtgtcaaatgcaa

SEQ ID NO: 320808 - DNA, 20 bp, Artificial
  CRISPR gRNA sequence
accgctgtgtcaaatgcaag

SEQ ID NO: 320809 - DNA, 20 bp, Artificial
  CRISPR gRNA sequence
tgtcaaatgcaagtgttggc

SEQ ID NO: 320810 - DNA, 20 bp, Artificial
  CRISPR gRNA sequence
gcatctctcctcattgaaat

SEQ ID NO: 320811 - DNA, 20 bp, Artificial
  CRISPR gRNA sequence
tcctcattgaaatgctctat

SEQ ID NO: 320812 - DNA, 20 bp, Artificial
  CRISPR gRNA sequence
ctcattgaaatgctctattc

SEQ ID NO: 320813 - DNA, 20 bp, Artificial
  CRISPR gRNA sequence
attgaaatgctctattcttt

SEQ ID NO: 320814 - DNA, 20 bp, Artificial
  CRISPR gRNA sequence
aaatgctctattctttccca

SEQ ID NO: 320815 - DNA, 20 bp, Artificial
  CRISPR gRNA sequence
tattctttcccaatctctga

SEQ ID NO: 320816 - DNA, 20 bp, Artificial
  CRISPR gRNA sequence
ttctttcccaatctctgatt

SEQ ID NO: 320817 - DNA, 20 bp, Artificial
  CRISPR gRNA sequence
tttcccaatctctgatttcc

SEQ ID NO: 320818 - DNA, 20 bp, Artificial
  CRISPR gRNA sequence
tcccaatctctgatttcctt

SEQ ID NO: 320819 - DNA, 20 bp, Artificial
  CRISPR gRNA sequence
cccaatctctgatttccttg

SEQ ID NO: 320820 - DNA, 20 bp, Artificial
  CRISPR gRNA sequence
ccaatctctgatttccttgt

SEQ ID NO: 320821 - DNA, 20 bp, Artificial
  CRISPR gRNA sequence
tgatttccttgttaattttc

SEQ ID NO: 320822 - DNA, 20 bp, Artificial
  CRISPR gRNA sequence
atttccttgttaattttctc

SEQ ID NO: 320823 - DNA, 20 bp, Artificial
  CRISPR gRNA sequence
ccttgttaattttctcaaat

SEQ ID NO: 320824 - DNA, 20 bp, Artificial
  CRISPR gRNA sequence
cttgttaattttctcaaatc

SEQ ID NO: 320825 - DNA, 20 bp, Artificial
  CRISPR gRNA sequence
gttaattttctcaaatcact

SEQ ID NO: 320826 - DNA, 20 bp, Artificial
  CRISPR gRNA sequence
ttaattttctcaaatcactc

SEQ ID NO: 320827 - DNA, 20 bp, Artificial
  CRISPR gRNA sequence
attttctcaaatcactcttt

SEQ ID NO: 320828 - DNA, 20 bp, Artificial
  CRISPR gRNA sequence
tctcaaatcactctttaatt

SEQ ID NO: 320829 - DNA, 20 bp, Artificial
  CRISPR gRNA sequence
ctcaaatcactctttaattt

SEQ ID NO: 320830 - DNA, 20 bp, Artificial
  CRISPR gRNA sequence
tcaaatcactctttaatttt

SEQ ID NO: 320831 - DNA, 20 bp, Artificial
  CRISPR gRNA sequence
aaatcactctttaattttgg

SEQ ID NO: 320832 - DNA, 20 bp, Artificial
  CRISPR gRNA sequence
tttaattttggtaaccttga

SEQ ID NO: 320833 - DNA, 20 bp, Artificial
  CRISPR gRNA sequence
taattttggtaaccttgagt

SEQ ID NO: 320834 - DNA, 20 bp, Artificial
  CRISPR gRNA sequence
aattttggtaaccttgagtg

SEQ ID NO: 320835 - DNA, 20 bp, Artificial
  CRISPR gRNA sequence
attttggtaaccttgagtgc

SEQ ID NO: 320836 - DNA, 20 bp, Artificial
  CRISPR gRNA sequence
tggtaaccttgagtgcatgt

SEQ ID NO: 320837 - DNA, 20 bp, Artificial
  CRISPR gRNA sequence
ggtaaccttgagtgcatgtt

SEQ ID NO: 320838 - DNA, 20 bp, Artificial
  CRISPR gRNA sequence
gtaaccttgagtgcatgttc

SEQ ID NO: 320839 - DNA, 20 bp, Artificial
  CRISPR gRNA sequence
gagtgcatgttcttggtctt

SEQ ID NO: 320840 - DNA, 20 bp, Artificial
  CRISPR gRNA sequence
agtgcatgttcttggtcttc

SEQ ID NO: 320841 - DNA, 20 bp, Artificial
  CRISPR gRNA sequence
ttggtcttcttattctccat

SEQ ID NO: 320842 - DNA, 20 bp, Artificial
  CRISPR gRNA sequence
ggtcttcttattctccatac

SEQ ID NO: 320843 - DNA, 20 bp, Artificial
  CRISPR gRNA sequence
gtcttcttattctccatact

SEQ ID NO: 320844 - DNA, 20 bp, Artificial
  CRISPR gRNA sequence
cttattctccatactttcct

SEQ ID NO: 320845 - DNA, 20 bp, Artificial
  CRISPR gRNA sequence
ttattctccatactttcctg

SEQ ID NO: 320846 - DNA, 20 bp, Artificial
  CRISPR gRNA sequence
attctccatactttcctggt

SEQ ID NO: 320847 - DNA, 20 bp, Artificial
  CRISPR gRNA sequence
ttctccatactttcctggtt

SEQ ID NO: 320848 - DNA, 20 bp, Artificial
  CRISPR gRNA sequence
tccatactttcctggttttt

SEQ ID NO: 320849 - DNA, 20 bp, Artificial
  CRISPR gRNA sequence
catactttcctggtttttct

SEQ ID NO: 320850 - DNA, 20 bp, Artificial
  CRISPR gRNA sequence
tcctggtttttctcctctag

SEQ ID NO: 320851 - DNA, 20 bp, Artificial
  CRISPR gRNA sequence
cctggtttttctcctctagc

SEQ ID NO: 320852 - DNA, 20 bp, Artificial
  CRISPR gRNA sequence
ctggtttttctcctctagcc

SEQ ID NO: 320853 - DNA, 20 bp, Artificial
  CRISPR gRNA sequence
gtttttctcctctagcccca

SEQ ID NO: 320854 - DNA, 20 bp, Artificial
  CRISPR gRNA sequence
ttctcctctagccccacgga

SEQ ID NO: 320855 - DNA, 20 bp, Artificial
  CRISPR gRNA sequence
tctcctctagccccacggat

SEQ ID NO: 320856 - DNA, 20 bp, Artificial
  CRISPR gRNA sequence
ctcctctagccccacggatt

SEQ ID NO: 320857 - DNA, 20 bp, Artificial
  CRISPR gRNA sequence
tcctctagccccacggattc

SEQ ID NO: 320858 - DNA, 20 bp, Artificial
  CRISPR gRNA sequence
ctctagccccacggattcaa

SEQ ID NO: 320859 - DNA, 20 bp, Artificial
  CRISPR gRNA sequence
tagccccacggattcaactg

SEQ ID NO: 320860 - DNA, 20 bp, Artificial
  CRISPR gRNA sequence
gccccacggattcaactgtc

SEQ ID NO: 320861 - DNA, 20 bp, Artificial
  CRISPR gRNA sequence
aactgtcaagtaaaagctaa

SEQ ID NO: 320862 - DNA, 20 bp, Artificial
  CRISPR gRNA sequence
tcaagtaaaagctaataact

SEQ ID NO: 320863 - DNA, 20 bp, Artificial
  CRISPR gRNA sequence
ataactcccaggtgcttatt

SEQ ID NO: 320864 - DNA, 20 bp, Artificial
  CRISPR gRNA sequence
ccaggtgcttattgccagcc

SEQ ID NO: 320865 - DNA, 20 bp, Artificial
  CRISPR gRNA sequence
attgccagcctataactttc

SEQ ID NO: 320866 - DNA, 20 bp, Artificial
  CRISPR gRNA sequence
ttgccagcctataactttca

SEQ ID NO: 320867 - DNA, 20 bp, Artificial
  CRISPR gRNA sequence
ccagcctataactttcacta

SEQ ID NO: 320868 - DNA, 20 bp, Artificial
  CRISPR gRNA sequence
taactttcactagagtttca

SEQ ID NO: 320869 - DNA, 20 bp, Artificial
  CRISPR gRNA sequence
tcactagagtttcagatacc

SEQ ID NO: 320870 - DNA, 20 bp, Artificial
  CRISPR gRNA sequence
cactagagtttcagatacct

SEQ ID NO: 320871 - DNA, 20 bp, Artificial
  CRISPR gRNA sequence
actagagtttcagatacctg

SEQ ID NO: 320872 - DNA, 20 bp, Artificial
  CRISPR gRNA sequence
gagtttcagatacctgtatt

SEQ ID NO: 320873 - DNA, 20 bp, Artificial
  CRISPR gRNA sequence
cagatacctgtattcaactt

SEQ ID NO: 320874 - DNA, 20 bp, Artificial
  CRISPR gRNA sequence
agatacctgtattcaacttc

SEQ ID NO: 320875 - DNA, 20 bp, Artificial
  CRISPR gRNA sequence
tattcaacttcctgctggat

SEQ ID NO: 320876 - DNA, 20 bp, Artificial
  CRISPR gRNA sequence
aacttcctgctggatgtctc

SEQ ID NO: 320877 - DNA, 20 bp, Artificial
  CRISPR gRNA sequence
cctgctggatgtctctatct

SEQ ID NO: 320878 - DNA, 20 bp, Artificial
  CRISPR gRNA sequence
ctgctggatgtctctatcta

SEQ ID NO: 320879 - DNA, 20 bp, Artificial
  CRISPR gRNA sequence
ctggatgtctctatctagat

SEQ ID NO: 320880 - DNA, 20 bp, Artificial
  CRISPR gRNA sequence
gatgtctctatctagatagc

SEQ ID NO: 320881 - DNA, 20 bp, Artificial
  CRISPR gRNA sequence
tatctagatagcaacaggta

SEQ ID NO: 320882 - DNA, 20 bp, Artificial
  CRISPR gRNA sequence
tctagatagcaacaggtact

SEQ ID NO: 320883 - DNA, 20 bp, Artificial
  CRISPR gRNA sequence
gatagcaacaggtactgtct

SEQ ID NO: 320884 - DNA, 20 bp, Artificial
  CRISPR gRNA sequence
tcttcctccccttcagcctt

SEQ ID NO: 320885 - DNA, 20 bp, Artificial
  CRISPR gRNA sequence
cctccccttcagccttcctc

SEQ ID NO: 320886 - DNA, 20 bp, Artificial
  CRISPR gRNA sequence
ctccccttcagccttcctct

SEQ ID NO: 320887 - DNA, 20 bp, Artificial
  CRISPR gRNA sequence
cccttcagccttcctctact

SEQ ID NO: 320888 - DNA, 20 bp, Artificial
  CRISPR gRNA sequence
cagccttcctctactctatc

SEQ ID NO: 320889 - DNA, 20 bp, Artificial
  CRISPR gRNA sequence
agccttcctctactctatct

SEQ ID NO: 320890 - DNA, 20 bp, Artificial
  CRISPR gRNA sequence
cctctactctatctcaagga

SEQ ID NO: 320891 - DNA, 20 bp, Artificial
  CRISPR gRNA sequence
ctctactctatctcaaggaa

SEQ ID NO: 320892 - DNA, 20 bp, Artificial
  CRISPR gRNA sequence
tactctatctcaaggaatgc

SEQ ID NO: 320893 - DNA, 20 bp, Artificial
  CRISPR gRNA sequence
ctctatctcaaggaatgctc

SEQ ID NO: 320894 - DNA, 20 bp, Artificial
  CRISPR gRNA sequence
tatctcaaggaatgctcccc

SEQ ID NO: 320895 - DNA, 20 bp, Artificial
  CRISPR gRNA sequence
tctcaaggaatgctcccctg

SEQ ID NO: 320896 - DNA, 20 bp, Artificial
  CRISPR gRNA sequence
aaggaatgctcccctgtctg

SEQ ID NO: 320897 - DNA, 20 bp, Artificial
  CRISPR gRNA sequence
ccctgtctgggaatgaccag

SEQ ID NO: 320898 - DNA, 20 bp, Artificial
  CRISPR gRNA sequence
tctgggaatgaccagacaac

SEQ ID NO: 320899 - DNA, 20 bp, Artificial
  CRISPR gRNA sequence
ggaatgaccagacaaccctc

SEQ ID NO: 320900 - DNA, 20 bp, Artificial
  CRISPR gRNA sequence
ttctgtctacaatcatctaa

SEQ ID NO: 320901 - DNA, 20 bp, Artificial
  CRISPR gRNA sequence
ctgtctacaatcatctaaat

SEQ ID NO: 320902 - DNA, 20 bp, Artificial
  CRISPR gRNA sequence
tgtctacaatcatctaaatc

SEQ ID NO: 320903 - DNA, 20 bp, Artificial
  CRISPR gRNA sequence
tctacaatcatctaaatcat

SEQ ID NO: 320904 - DNA, 20 bp, Artificial
  CRISPR gRNA sequence
caatcatctaaatcatctgt

SEQ ID NO: 320905 - DNA, 20 bp, Artificial
  CRISPR gRNA sequence
aatcatctgtataaccaaga

SEQ ID NO: 320906 - DNA, 20 bp, Artificial
  CRISPR gRNA sequence
tataaccaagatgaatcatt

SEQ ID NO: 320907 - DNA, 20 bp, Artificial
  CRISPR gRNA sequence
gtgtacccaaaatacccaac

SEQ ID NO: 320908 - DNA, 20 bp, Artificial
  CRISPR gRNA sequence
tgtacccaaaatacccaaca

SEQ ID NO: 320909 - DNA, 20 bp, Artificial
  CRISPR gRNA sequence
tacacaagtgtgtctgagga

SEQ ID NO: 320910 - DNA, 20 bp, Artificial
  CRISPR gRNA sequence
cacaagtgtgtctgaggaga

SEQ ID NO: 320911 - DNA, 20 bp, Artificial
  CRISPR gRNA sequence
aggagatctagaactactac

SEQ ID NO: 320912 - DNA, 20 bp, Artificial
  CRISPR gRNA sequence
gaactactacagccagagct

SEQ ID NO: 320913 - DNA, 20 bp, Artificial
  CRISPR gRNA sequence
ctacagccagagctgaactc

SEQ ID NO: 320914 - DNA, 20 bp, Artificial
  CRISPR gRNA sequence
cagccagagctgaactccaa

SEQ ID NO: 320915 - DNA, 20 bp, Artificial
  CRISPR gRNA sequence
aactccaatatgttaagaaa

SEQ ID NO: 320916 - DNA, 20 bp, Artificial
  CRISPR gRNA sequence
caatatgttaagaaaagggt

SEQ ID NO: 320917 - DNA, 20 bp, Artificial
  CRISPR gRNA sequence
agaaaagggtagaggagact

SEQ ID NO: 320918 - DNA, 20 bp, Artificial
  CRISPR gRNA sequence
atgtaattgtctcctaactc

SEQ ID NO: 320919 - DNA, 20 bp, Artificial
  CRISPR gRNA sequence
tctcctaactcatctgcctg

SEQ ID NO: 320920 - DNA, 20 bp, Artificial
  CRISPR gRNA sequence
ctaactcatctgcctgctcc

SEQ ID NO: 320921 - DNA, 20 bp, Artificial
  CRISPR gRNA sequence
actcatctgcctgctccgtc

SEQ ID NO: 320922 - DNA, 20 bp, Artificial
  CRISPR gRNA sequence
atctgcctgctccgtccttg

SEQ ID NO: 320923 - DNA, 20 bp, Artificial
  CRISPR gRNA sequence
cctgctccgtccttgtcccc

SEQ ID NO: 320924 - DNA, 20 bp, Artificial
  CRISPR gRNA sequence
ctccgtccttgtccccgggt

SEQ ID NO: 320925 - DNA, 20 bp, Artificial
  CRISPR gRNA sequence
cgtccttgtccccgggtcta

SEQ ID NO: 320926 - DNA, 20 bp, Artificial
  CRISPR gRNA sequence
gtccccgggtctagtttctc

SEQ ID NO: 320927 - DNA, 20 bp, Artificial
  CRISPR gRNA sequence
tccccgggtctagtttctca

SEQ ID NO: 320928 - DNA, 20 bp, Artificial
  CRISPR gRNA sequence
gtttctcaagccaaaatgat

SEQ ID NO: 320929 - DNA, 20 bp, Artificial
  CRISPR gRNA sequence
ctcaagccaaaatgatccct

SEQ ID NO: 320930 - DNA, 20 bp, Artificial
  CRISPR gRNA sequence
tcaagccaaaatgatccctt

SEQ ID NO: 320931 - DNA, 20 bp, Artificial
  CRISPR gRNA sequence
aagccaaaatgatcccttaa

SEQ ID NO: 320932 - DNA, 20 bp, Artificial
  CRISPR gRNA sequence
aaaaatacagctccaatcac

SEQ ID NO: 320933 - DNA, 20 bp, Artificial
  CRISPR gRNA sequence
aaaatacagctccaatcaca

SEQ ID NO: 320934 - DNA, 20 bp, Artificial
  CRISPR gRNA sequence
caatcacataatcctcctgt

SEQ ID NO: 320935 - DNA, 20 bp, Artificial
  CRISPR gRNA sequence
ctgttcagaagcctctgatg

SEQ ID NO: 320936 - DNA, 20 bp, Artificial
  CRISPR gRNA sequence
ttcagaagcctctgatgcct

SEQ ID NO: 320937 - DNA, 20 bp, Artificial
  CRISPR gRNA sequence
agaagcctctgatgccttcc

SEQ ID NO: 320938 - DNA, 20 bp, Artificial
  CRISPR gRNA sequence
tgatgccttccaccaaactg

SEQ ID NO: 320939 - DNA, 20 bp, Artificial
  CRISPR gRNA sequence
atgccttccaccaaactgaa

SEQ ID NO: 320940 - DNA, 20 bp, Artificial
  CRISPR gRNA sequence
ccaccaaactgaaaaatata

SEQ ID NO: 320941 - DNA, 20 bp, Artificial
  CRISPR gRNA sequence
caccaaactgaaaaatatat

SEQ ID NO: 320942 - DNA, 20 bp, Artificial
  CRISPR gRNA sequence
aaaaatatatccagatccct

SEQ ID NO: 320943 - DNA, 20 bp, Artificial
  CRISPR gRNA sequence
cccctcacactgagaactac

SEQ ID NO: 320944 - DNA, 20 bp, Artificial
  CRISPR gRNA sequence
ccctcacactgagaactaca

SEQ ID NO: 320945 - DNA, 20 bp, Artificial
  CRISPR gRNA sequence
acactgagaactacatccaa

SEQ ID NO: 320946 - DNA, 20 bp, Artificial
  CRISPR gRNA sequence
agaactacatccaaagtcct

SEQ ID NO: 320947 - DNA, 20 bp, Artificial
  CRISPR gRNA sequence
catccaaagtccttcccctg

SEQ ID NO: 320948 - DNA, 20 bp, Artificial
  CRISPR gRNA sequence
cccctggccttacaagacct

SEQ ID NO: 320949 - DNA, 20 bp, Artificial
  CRISPR gRNA sequence
ccctggccttacaagacctc

SEQ ID NO: 320950 - DNA, 20 bp, Artificial
  CRISPR gRNA sequence
gccttacaagacctcatgta

SEQ ID NO: 320951 - DNA, 20 bp, Artificial
  CRISPR gRNA sequence
acaagacctcatgtaattgg

SEQ ID NO: 320952 - DNA, 20 bp, Artificial
  CRISPR gRNA sequence
caagacctcatgtaattggg

SEQ ID NO: 320953 - DNA, 20 bp, Artificial
  CRISPR gRNA sequence
atgtaattgggtccccagta

SEQ ID NO: 320954 - DNA, 20 bp, Artificial
  CRISPR gRNA sequence
ggtccccagtacctatcagg

SEQ ID NO: 320955 - DNA, 20 bp, Artificial
  CRISPR gRNA sequence
tcaggcctctttcccctgct

SEQ ID NO: 320956 - DNA, 20 bp, Artificial
  CRISPR gRNA sequence
tttcccctgcttactctccc

SEQ ID NO: 320957 - DNA, 20 bp, Artificial
  CRISPR gRNA sequence
tcccctgcttactctcccca

SEQ ID NO: 320958 - DNA, 20 bp, Artificial
  CRISPR gRNA sequence
cccctgcttactctccccag

SEQ ID NO: 320959 - DNA, 20 bp, Artificial
  CRISPR gRNA sequence
ccctgcttactctccccagc

SEQ ID NO: 320960 - DNA, 20 bp, Artificial
  CRISPR gRNA sequence
cttactctccccagccacac

SEQ ID NO: 320961 - DNA, 20 bp, Artificial
  CRISPR gRNA sequence
actctccccagccacactgc

SEQ ID NO: 320962 - DNA, 20 bp, Artificial
  CRISPR gRNA sequence
ctctccccagccacactgcc

SEQ ID NO: 320963 - DNA, 20 bp, Artificial
  CRISPR gRNA sequence
tccccagccacactgcctcc

SEQ ID NO: 320964 - DNA, 20 bp, Artificial
  CRISPR gRNA sequence
cccagccacactgcctccct

SEQ ID NO: 320965 - DNA, 20 bp, Artificial
  CRISPR gRNA sequence
cctcccttgacattcctcca

SEQ ID NO: 320966 - DNA, 20 bp, Artificial
  CRISPR gRNA sequence
ccttgacattcctccaaaag

SEQ ID NO: 320967 - DNA, 20 bp, Artificial
  CRISPR gRNA sequence
gacattcctccaaaagatca

SEQ ID NO: 320968 - DNA, 20 bp, Artificial
  CRISPR gRNA sequence
acattcctccaaaagatcac

SEQ ID NO: 320969 - DNA, 20 bp, Artificial
  CRISPR gRNA sequence
ctccaaaagatcacacactc

SEQ ID NO: 320970 - DNA, 20 bp, Artificial
  CRISPR gRNA sequence
caaaagatcacacactctgt

SEQ ID NO: 320971 - DNA, 20 bp, Artificial
  CRISPR gRNA sequence
tgtctcaagtcctcttctca

SEQ ID NO: 320972 - DNA, 20 bp, Artificial
  CRISPR gRNA sequence
tctcaagtcctcttctcatg

SEQ ID NO: 320973 - DNA, 20 bp, Artificial
  CRISPR gRNA sequence
aagtcctcttctcatgttgt

SEQ ID NO: 320974 - DNA, 20 bp, Artificial
  CRISPR gRNA sequence
ttctcatgttgttccctctg

SEQ ID NO: 320975 - DNA, 20 bp, Artificial
  CRISPR gRNA sequence
ctcatgttgttccctctgtc

SEQ ID NO: 320976 - DNA, 20 bp, Artificial
  CRISPR gRNA sequence
tcatgttgttccctctgtcc

SEQ ID NO: 320977 - DNA, 20 bp, Artificial
  CRISPR gRNA sequence
atgttgttccctctgtccag

SEQ ID NO: 320978 - DNA, 20 bp, Artificial
  CRISPR gRNA sequence
ttccctctgtccagaaggtt

SEQ ID NO: 320979 - DNA, 20 bp, Artificial
  CRISPR gRNA sequence
cctctgtccagaaggttctt

SEQ ID NO: 320980 - DNA, 20 bp, Artificial
  CRISPR gRNA sequence
tgtccagaaggttcttcctc

SEQ ID NO: 320981 - DNA, 20 bp, Artificial
  CRISPR gRNA sequence
tccagaaggttcttcctcca

SEQ ID NO: 320982 - DNA, 20 bp, Artificial
  CRISPR gRNA sequence
ttcctccagacagtctcata

SEQ ID NO: 320983 - DNA, 20 bp, Artificial
  CRISPR gRNA sequence
cctccagacagtctcatagc

SEQ ID NO: 320984 - DNA, 20 bp, Artificial
  CRISPR gRNA sequence
ctccagacagtctcatagct

SEQ ID NO: 320985 - DNA, 20 bp, Artificial
  CRISPR gRNA sequence
cagacagtctcatagcttct

SEQ ID NO: 320986 - DNA, 20 bp, Artificial
  CRISPR gRNA sequence
atagcttctccttcacttca

SEQ ID NO: 320987 - DNA, 20 bp, Artificial
  CRISPR gRNA sequence
ctccttcacttcatgtaggt

SEQ ID NO: 320988 - DNA, 20 bp, Artificial
  CRISPR gRNA sequence
tccttcacttcatgtaggtc

SEQ ID NO: 320989 - DNA, 20 bp, Artificial
  CRISPR gRNA sequence
cttcacttcatgtaggtctt

SEQ ID NO: 320990 - DNA, 20 bp, Artificial
  CRISPR gRNA sequence
cacttcatgtaggtctttca

SEQ ID NO: 320991 - DNA, 20 bp, Artificial
  CRISPR gRNA sequence
acttcatgtaggtctttcat

SEQ ID NO: 320992 - DNA, 20 bp, Artificial
  CRISPR gRNA sequence
catgtaggtctttcattaaa

SEQ ID NO: 320993 - DNA, 20 bp, Artificial
  CRISPR gRNA sequence
atgtaggtctttcattaaat

SEQ ID NO: 320994 - DNA, 20 bp, Artificial
  CRISPR gRNA sequence
tcattaaatgctacctccca

SEQ ID NO: 320995 - DNA, 20 bp, Artificial
  CRISPR gRNA sequence
cattaaatgctacctcccag

SEQ ID NO: 320996 - DNA, 20 bp, Artificial
  CRISPR gRNA sequence
attaaatgctacctcccagg

SEQ ID NO: 320997 - DNA, 20 bp, Artificial
  CRISPR gRNA sequence
aatgctacctcccagggaga

SEQ ID NO: 320998 - DNA, 20 bp, Artificial
  CRISPR gRNA sequence
cctcccagggagatttctct

SEQ ID NO: 320999 - DNA, 20 bp, Artificial
  CRISPR gRNA sequence
ccagggagatttctctaacc

SEQ ID NO: 321000 - DNA, 20 bp, Artificial
  CRISPR gRNA sequence
ctctaaccattctattgaag

SEQ ID NO: 321001 - DNA, 20 bp, Artificial
  CRISPR gRNA sequence
tctaaccattctattgaaga

SEQ ID NO: 321002 - DNA, 20 bp, Artificial
  CRISPR gRNA sequence
taaccattctattgaagata

SEQ ID NO: 321003 - DNA, 20 bp, Artificial
  CRISPR gRNA sequence
accattctattgaagatagc

SEQ ID NO: 321004 - DNA, 20 bp, Artificial
  CRISPR gRNA sequence
tattgaagatagcatcctgg

SEQ ID NO: 321005 - DNA, 20 bp, Artificial
  CRISPR gRNA sequence
ttgaagatagcatcctgggc

SEQ ID NO: 321006 - DNA, 20 bp, Artificial
  CRISPR gRNA sequence
aagatagcatcctgggcatt

SEQ ID NO: 321007 - DNA, 20 bp, Artificial
  CRISPR gRNA sequence
ggcattctgtccctcatgct

SEQ ID NO: 321008 - DNA, 20 bp, Artificial
  CRISPR gRNA sequence
tgtccctcatgctgacttat

SEQ ID NO: 321009 - DNA, 20 bp, Artificial
  CRISPR gRNA sequence
tccctcatgctgacttatat

SEQ ID NO: 321010 - DNA, 20 bp, Artificial
  CRISPR gRNA sequence
atgctgacttatatttattg

SEQ ID NO: 321011 - DNA, 20 bp, Artificial
  CRISPR gRNA sequence
acttatatttattgtggtac

SEQ ID NO: 321012 - DNA, 20 bp, Artificial
  CRISPR gRNA sequence
atatttattgtggtacttat

SEQ ID NO: 321013 - DNA, 20 bp, Artificial
  CRISPR gRNA sequence
tatttattgtggtacttatc

SEQ ID NO: 321014 - DNA, 20 bp, Artificial
  CRISPR gRNA sequence
attgtggtacttatcatgac

SEQ ID NO: 321015 - DNA, 20 bp, Artificial
  CRISPR gRNA sequence
ttgtggtacttatcatgaca

SEQ ID NO: 321016 - DNA, 20 bp, Artificial
  CRISPR gRNA sequence
tggtacttatcatgacatga

SEQ ID NO: 321017 - DNA, 20 bp, Artificial
  CRISPR gRNA sequence
atcatgacatgacatgacac

SEQ ID NO: 321018 - DNA, 20 bp, Artificial
  CRISPR gRNA sequence
tcatgacatgacatgacacg

SEQ ID NO: 321019 - DNA, 20 bp, Artificial
  CRISPR gRNA sequence
ggttattgtctgtctctcct

SEQ ID NO: 321020 - DNA, 20 bp, Artificial
  CRISPR gRNA sequence
gttattgtctgtctctcctg

SEQ ID NO: 321021 - DNA, 20 bp, Artificial
  CRISPR gRNA sequence
ttgtctgtctctcctgagat

SEQ ID NO: 321022 - DNA, 20 bp, Artificial
  CRISPR gRNA sequence
tctgtctctcctgagatgtc

SEQ ID NO: 321023 - DNA, 20 bp, Artificial
  CRISPR gRNA sequence
tctctcctgagatgtctggg

SEQ ID NO: 321024 - DNA, 20 bp, Artificial
  CRISPR gRNA sequence
tcctgagatgtctgggttct

SEQ ID NO: 321025 - DNA, 20 bp, Artificial
  CRISPR gRNA sequence
ctgagatgtctgggttctga

SEQ ID NO: 321026 - DNA, 20 bp, Artificial
  CRISPR gRNA sequence
agatgtctgggttctgatta

SEQ ID NO: 321027 - DNA, 20 bp, Artificial
  CRISPR gRNA sequence
ggttctgattaaaaatctat

SEQ ID NO: 321028 - DNA, 20 bp, Artificial
  CRISPR gRNA sequence
tgattaaaaatctatgtgtg

SEQ ID NO: 321029 - DNA, 20 bp, Artificial
  CRISPR gRNA sequence
attaaaaatctatgtgtgat

SEQ ID NO: 321030 - DNA, 20 bp, Artificial
  CRISPR gRNA sequence
aaaatctatgtgtgattttt

SEQ ID NO: 321031 - DNA, 20 bp, Artificial
  CRISPR gRNA sequence
tgtgtgatttttcagacctg

SEQ ID NO: 321032 - DNA, 20 bp, Artificial
  CRISPR gRNA sequence
ttcagacctgaccacaggca

SEQ ID NO: 321033 - DNA, 20 bp, Artificial
  CRISPR gRNA sequence
tcagacctgaccacaggcaa

SEQ ID NO: 321034 - DNA, 20 bp, Artificial
  CRISPR gRNA sequence
cagacctgaccacaggcaat

SEQ ID NO: 321035 - DNA, 20 bp, Artificial
  CRISPR gRNA sequence
agacctgaccacaggcaatt

SEQ ID NO: 321036 - DNA, 20 bp, Artificial
  CRISPR gRNA sequence
accacaggcaattaaagagg

SEQ ID NO: 321037 - DNA, 20 bp, Artificial
  CRISPR gRNA sequence
aagaggcttaatctgacaag

SEQ ID NO: 321038 - DNA, 20 bp, Artificial
  CRISPR gRNA sequence
aatctgacaagccttgctga

SEQ ID NO: 321039 - DNA, 20 bp, Artificial
  CRISPR gRNA sequence
atctgacaagccttgctgag

SEQ ID NO: 321040 - DNA, 20 bp, Artificial
  CRISPR gRNA sequence
acaagccttgctgaggaagt

SEQ ID NO: 321041 - DNA, 20 bp, Artificial
  CRISPR gRNA sequence
gctgaggaagttgccctttc

SEQ ID NO: 321042 - DNA, 20 bp, Artificial
  CRISPR gRNA sequence
ctgaggaagttgccctttct

SEQ ID NO: 321043 - DNA, 20 bp, Artificial
  CRISPR gRNA sequence
aggaagttgccctttctaca

SEQ ID NO: 321044 - DNA, 20 bp, Artificial
  CRISPR gRNA sequence
ccctttctacagcagacttg

SEQ ID NO: 321045 - DNA, 20 bp, Artificial
  CRISPR gRNA sequence
tctacagcagacttggtgca

SEQ ID NO: 321046 - DNA, 20 bp, Artificial
  CRISPR gRNA sequence
ctacagcagacttggtgcac

SEQ ID NO: 321047 - DNA, 20 bp, Artificial
  CRISPR gRNA sequence
tacagcagacttggtgcaca

SEQ ID NO: 321048 - DNA, 20 bp, Artificial
  CRISPR gRNA sequence
cagcagacttggtgcacagt

SEQ ID NO: 321049 - DNA, 20 bp, Artificial
  CRISPR gRNA sequence
ggtgcacagtcagtgcatgg

SEQ ID NO: 321050 - DNA, 20 bp, Artificial
  CRISPR gRNA sequence
gtgcacagtcagtgcatggc

SEQ ID NO: 321051 - DNA, 20 bp, Artificial
  CRISPR gRNA sequence
tgaagggggctgcaatcaag

SEQ ID NO: 321052 - DNA, 20 bp, Artificial
  CRISPR gRNA sequence
aagggggctgcaatcaagat

SEQ ID NO: 321053 - DNA, 20 bp, Artificial
  CRISPR gRNA sequence
caatcaagatctcagcctcc

SEQ ID NO: 321054 - DNA, 20 bp, Artificial
  CRISPR gRNA sequence
agcctcccgccagtcatgct

SEQ ID NO: 321055 - DNA, 20 bp, Artificial
  CRISPR gRNA sequence
ccgccagtcatgctttttca

SEQ ID NO: 321056 - DNA, 20 bp, Artificial
  CRISPR gRNA sequence
tttcacatacttgcaatctt

SEQ ID NO: 321057 - DNA, 20 bp, Artificial
  CRISPR gRNA sequence
ttcacatacttgcaatctta

SEQ ID NO: 321058 - DNA, 20 bp, Artificial
  CRISPR gRNA sequence
tcacatacttgcaatcttag

SEQ ID NO: 321059 - DNA, 20 bp, Artificial
  CRISPR gRNA sequence
cacatacttgcaatcttagc

SEQ ID NO: 321060 - DNA, 20 bp, Artificial
  CRISPR gRNA sequence
acatacttgcaatcttagcc

SEQ ID NO: 321061 - DNA, 20 bp, Artificial
  CRISPR gRNA sequence
gcaatcttagcccaggcacc

SEQ ID NO: 321062 - DNA, 20 bp, Artificial
  CRISPR gRNA sequence
caatcttagcccaggcaccc

SEQ ID NO: 321063 - DNA, 20 bp, Artificial
  CRISPR gRNA sequence
agcccaggcaccctcattct

SEQ ID NO: 321064 - DNA, 20 bp, Artificial
  CRISPR gRNA sequence
gcccaggcaccctcattctt

SEQ ID NO: 321065 - DNA, 20 bp, Artificial
  CRISPR gRNA sequence
attcttaggtctctttatct

SEQ ID NO: 321066 - DNA, 20 bp, Artificial
  CRISPR gRNA sequence
ttaggtctctttatctgagg

SEQ ID NO: 321067 - DNA, 20 bp, Artificial
  CRISPR gRNA sequence
aggtctctttatctgaggct

SEQ ID NO: 321068 - DNA, 20 bp, Artificial
  CRISPR gRNA sequence
ggtctctttatctgaggctc

SEQ ID NO: 321069 - DNA, 20 bp, Artificial
  CRISPR gRNA sequence
tttatctgaggctctggggt

SEQ ID NO: 321070 - DNA, 20 bp, Artificial
  CRISPR gRNA sequence
tatctgaggctctggggtga

SEQ ID NO: 321071 - DNA, 20 bp, Artificial
  CRISPR gRNA sequence
atctgaggctctggggtgag

SEQ ID NO: 321072 - DNA, 20 bp, Artificial
  CRISPR gRNA sequence
tctgaggctctggggtgagg

SEQ ID NO: 321073 - DNA, 20 bp, Artificial
  CRISPR gRNA sequence
aggctctggggtgaggtctt

SEQ ID NO: 321074 - DNA, 20 bp, Artificial
  CRISPR gRNA sequence
tggggtgaggtcttcaggca

SEQ ID NO: 321075 - DNA, 20 bp, Artificial
  CRISPR gRNA sequence
gggtgaggtcttcaggcacc

SEQ ID NO: 321076 - DNA, 20 bp, Artificial
  CRISPR gRNA sequence
caggcacctctgctgaagcc

SEQ ID NO: 321077 - DNA, 20 bp, Artificial
  CRISPR gRNA sequence
aggcacctctgctgaagcct

SEQ ID NO: 321078 - DNA, 20 bp, Artificial
  CRISPR gRNA sequence
tgctgaagcctcctcatcat

SEQ ID NO: 321079 - DNA, 20 bp, Artificial
  CRISPR gRNA sequence
ctgaagcctcctcatcatag

SEQ ID NO: 321080 - DNA, 20 bp, Artificial
  CRISPR gRNA sequence
aagcctcctcatcatagaga

SEQ ID NO: 321081 - DNA, 20 bp, Artificial
  CRISPR gRNA sequence
ctcatcatagagaagacact

SEQ ID NO: 321082 - DNA, 20 bp, Artificial
  CRISPR gRNA sequence
atcatagagaagacactttt

SEQ ID NO: 321083 - DNA, 20 bp, Artificial
  CRISPR gRNA sequence
ttctccactcggactcagta

SEQ ID NO: 321084 - DNA, 20 bp, Artificial
  CRISPR gRNA sequence
tctccactcggactcagtac

SEQ ID NO: 321085 - DNA, 20 bp, Artificial
  CRISPR gRNA sequence
ctccactcggactcagtacc

SEQ ID NO: 321086 - DNA, 20 bp, Artificial
  CRISPR gRNA sequence
tccactcggactcagtacct

SEQ ID NO: 321087 - DNA, 20 bp, Artificial
  CRISPR gRNA sequence
cactcggactcagtacctag

SEQ ID NO: 321088 - DNA, 20 bp, Artificial
  CRISPR gRNA sequence
ggactcagtacctagcactt

SEQ ID NO: 321089 - DNA, 20 bp, Artificial
  CRISPR gRNA sequence
agtacctagcacttttccac

SEQ ID NO: 321090 - DNA, 20 bp, Artificial
  CRISPR gRNA sequence
gcacttttccactccctgcc

SEQ ID NO: 321091 - DNA, 20 bp, Artificial
  CRISPR gRNA sequence
ttccactccctgccttgaag

SEQ ID NO: 321092 - DNA, 20 bp, Artificial
  CRISPR gRNA sequence
tccactccctgccttgaaga

SEQ ID NO: 321093 - DNA, 20 bp, Artificial
  CRISPR gRNA sequence
ccactccctgccttgaagac

SEQ ID NO: 321094 - DNA, 20 bp, Artificial
  CRISPR gRNA sequence
cactccctgccttgaagaca

SEQ ID NO: 321095 - DNA, 20 bp, Artificial
  CRISPR gRNA sequence
cctgccttgaagacactgtt

SEQ ID NO: 321096 - DNA, 20 bp, Artificial
  CRISPR gRNA sequence
ccttgaagacactgttttcc

SEQ ID NO: 321097 - DNA, 20 bp, Artificial
  CRISPR gRNA sequence
gaagacactgttttccactc

SEQ ID NO: 321098 - DNA, 20 bp, Artificial
  CRISPR gRNA sequence
aagacactgttttccactct

SEQ ID NO: 321099 - DNA, 20 bp, Artificial
  CRISPR gRNA sequence
ttttccactctgactcagta

SEQ ID NO: 321100 - DNA, 20 bp, Artificial
  CRISPR gRNA sequence
tccactctgactcagtacct

SEQ ID NO: 321101 - DNA, 20 bp, Artificial
  CRISPR gRNA sequence
ccactctgactcagtaccta

SEQ ID NO: 321102 - DNA, 20 bp, Artificial
  CRISPR gRNA sequence
cactctgactcagtacctag

SEQ ID NO: 321103 - DNA, 20 bp, Artificial
  CRISPR gRNA sequence
tgactcagtacctagtattt

SEQ ID NO: 321104 - DNA, 20 bp, Artificial
  CRISPR gRNA sequence
actcagtacctagtattttt

SEQ ID NO: 321105 - DNA, 20 bp, Artificial
  CRISPR gRNA sequence
agtacctagtattttttcca

SEQ ID NO: 321106 - DNA, 20 bp, Artificial
  CRISPR gRNA sequence
gtattttttccactcctagc

SEQ ID NO: 321107 - DNA, 20 bp, Artificial
  CRISPR gRNA sequence
tttccactcctagccctaaa

SEQ ID NO: 321108 - DNA, 20 bp, Artificial
  CRISPR gRNA sequence
ttccactcctagccctaaag

SEQ ID NO: 321109 - DNA, 20 bp, Artificial
  CRISPR gRNA sequence
tccactcctagccctaaaga

SEQ ID NO: 321110 - DNA, 20 bp, Artificial
  CRISPR gRNA sequence
ccactcctagccctaaagac

SEQ ID NO: 321111 - DNA, 20 bp, Artificial
  CRISPR gRNA sequence
cactcctagccctaaagaca

SEQ ID NO: 321112 - DNA, 20 bp, Artificial
  CRISPR gRNA sequence
ctagccctaaagacactatt

SEQ ID NO: 321113 - DNA, 20 bp, Artificial
  CRISPR gRNA sequence
gccctaaagacactattccc

SEQ ID NO: 321114 - DNA, 20 bp, Artificial
  CRISPR gRNA sequence
aagacactattccccacgct

SEQ ID NO: 321115 - DNA, 20 bp, Artificial
  CRISPR gRNA sequence
ttccccacgctaactcagta

SEQ ID NO: 321116 - DNA, 20 bp, Artificial
  CRISPR gRNA sequence
cccacgctaactcagtactt

SEQ ID NO: 321117 - DNA, 20 bp, Artificial
  CRISPR gRNA sequence
actcagtactttgtactttt

SEQ ID NO: 321118 - DNA, 20 bp, Artificial
  CRISPR gRNA sequence
agtactttgtacttttccac

SEQ ID NO: 321119 - DNA, 20 bp, Artificial
  CRISPR gRNA sequence
tgtacttttccactcctagc

SEQ ID NO: 321120 - DNA, 20 bp, Artificial
  CRISPR gRNA sequence
gtacttttccactcctagcc

SEQ ID NO: 321121 - DNA, 20 bp, Artificial
  CRISPR gRNA sequence
tacttttccactcctagccc

SEQ ID NO: 321122 - DNA, 20 bp, Artificial
  CRISPR gRNA sequence
ttccactcctagccctctca

SEQ ID NO: 321123 - DNA, 20 bp, Artificial
  CRISPR gRNA sequence
tccactcctagccctctcac

SEQ ID NO: 321124 - DNA, 20 bp, Artificial
  CRISPR gRNA sequence
ccactcctagccctctcacc

SEQ ID NO: 321125 - DNA, 20 bp, Artificial
  CRISPR gRNA sequence
cactcctagccctctcacct

SEQ ID NO: 321126 - DNA, 20 bp, Artificial
  CRISPR gRNA sequence
ctagccctctcacctcattt

SEQ ID NO: 321127 - DNA, 20 bp, Artificial
  CRISPR gRNA sequence
gccctctcacctcattttcc

SEQ ID NO: 321128 - DNA, 20 bp, Artificial
  CRISPR gRNA sequence
tcacctcattttcctcatga

SEQ ID NO: 321129 - DNA, 20 bp, Artificial
  CRISPR gRNA sequence
acctcattttcctcatgaat

SEQ ID NO: 321130 - DNA, 20 bp, Artificial
  CRISPR gRNA sequence
attttcctcatgaattctcc

SEQ ID NO: 321131 - DNA, 20 bp, Artificial
  CRISPR gRNA sequence
tcctcatgaattctccccac

SEQ ID NO: 321132 - DNA, 20 bp, Artificial
  CRISPR gRNA sequence
cctcatgaattctccccacc

SEQ ID NO: 321133 - DNA, 20 bp, Artificial
  CRISPR gRNA sequence
ctcatgaattctccccaccc

SEQ ID NO: 321134 - DNA, 20 bp, Artificial
  CRISPR gRNA sequence
atgaattctccccacccttg

SEQ ID NO: 321135 - DNA, 20 bp, Artificial
  CRISPR gRNA sequence
tccccacccttggattcctc

SEQ ID NO: 321136 - DNA, 20 bp, Artificial
  CRISPR gRNA sequence
cccacccttggattcctcca

SEQ ID NO: 321137 - DNA, 20 bp, Artificial
  CRISPR gRNA sequence
ggattcctccacccccaggt

SEQ ID NO: 321138 - DNA, 20 bp, Artificial
  CRISPR gRNA sequence
gattcctccacccccaggtc

SEQ ID NO: 321139 - DNA, 20 bp, Artificial
  CRISPR gRNA sequence
ctccacccccaggtccataa

SEQ ID NO: 321140 - DNA, 20 bp, Artificial
  CRISPR gRNA sequence
cacccccaggtccataaaac

SEQ ID NO: 321141 - DNA, 20 bp, Artificial
  CRISPR gRNA sequence
ctagagcctttcatttgggg

SEQ ID NO: 321142 - DNA, 20 bp, Artificial
  CRISPR gRNA sequence
gagcctttcatttggggctt

SEQ ID NO: 321143 - DNA, 20 bp, Artificial
  CRISPR gRNA sequence
tcatttggggcttcttcaat

SEQ ID NO: 321144 - DNA, 20 bp, Artificial
  CRISPR gRNA sequence
catttggggcttcttcaatg

SEQ ID NO: 321145 - DNA, 20 bp, Artificial
  CRISPR gRNA sequence
atttggggcttcttcaatgg

SEQ ID NO: 321146 - DNA, 20 bp, Artificial
  CRISPR gRNA sequence
ggggcttcttcaatggtaag

SEQ ID NO: 321147 - DNA, 20 bp, Artificial
  CRISPR gRNA sequence
gggcttcttcaatggtaagg

SEQ ID NO: 321148 - DNA, 20 bp, Artificial
  CRISPR gRNA sequence
cttcaatggtaaggcgaccc

SEQ ID NO: 321149 - DNA, 20 bp, Artificial
  CRISPR gRNA sequence
ttcaatggtaaggcgacccc

SEQ ID NO: 321150 - DNA, 20 bp, Artificial
  CRISPR gRNA sequence
caatggtaaggcgaccccct

SEQ ID NO: 321151 - DNA, 20 bp, Artificial
  CRISPR gRNA sequence
aatggtaaggcgacccccta

SEQ ID NO: 321152 - DNA, 20 bp, Artificial
  CRISPR gRNA sequence
agtctgcactgattacctga

SEQ ID NO: 321153 - DNA, 20 bp, Artificial
  CRISPR gRNA sequence
cactgattacctgaccctcg

SEQ ID NO: 321154 - DNA, 20 bp, Artificial
  CRISPR gRNA sequence
attacctgaccctcgactgg

SEQ ID NO: 321155 - DNA, 20 bp, Artificial
  CRISPR gRNA sequence
cctgaccctcgactggtata

SEQ ID NO: 321156 - DNA, 20 bp, Artificial
  CRISPR gRNA sequence
accctcgactggtatactca

SEQ ID NO: 321157 - DNA, 20 bp, Artificial
  CRISPR gRNA sequence
gactggtatactcactctat

SEQ ID NO: 321158 - DNA, 20 bp, Artificial
  CRISPR gRNA sequence
gtatactcactctatgtggg

SEQ ID NO: 321159 - DNA, 20 bp, Artificial
  CRISPR gRNA sequence
actctatgtggggaaatgga

SEQ ID NO: 321160 - DNA, 20 bp, Artificial
  CRISPR gRNA sequence
tatgtggggaaatggaacag

SEQ ID NO: 321161 - DNA, 20 bp, Artificial
  CRISPR gRNA sequence
tgtggggaaatggaacaggc

SEQ ID NO: 321162 - DNA, 20 bp, Artificial
  CRISPR gRNA sequence
cccttcctcccattttagcc

SEQ ID NO: 321163 - DNA, 20 bp, Artificial
  CRISPR gRNA sequence
cctcccattttagcctcttg

SEQ ID NO: 321164 - DNA, 20 bp, Artificial
  CRISPR gRNA sequence
ctcccattttagcctcttga

SEQ ID NO: 321165 - DNA, 20 bp, Artificial
  CRISPR gRNA sequence
ccattttagcctcttgatta

SEQ ID NO: 321166 - DNA, 20 bp, Artificial
  CRISPR gRNA sequence
tagcctcttgattataccgt

SEQ ID NO: 321167 - DNA, 20 bp, Artificial
  CRISPR gRNA sequence
agcctcttgattataccgtc

SEQ ID NO: 321168 - DNA, 20 bp, Artificial
  CRISPR gRNA sequence
gcctcttgattataccgtcg

SEQ ID NO: 321169 - DNA, 20 bp, Artificial
  CRISPR gRNA sequence
ttgattataccgtcgtagta

SEQ ID NO: 321170 - DNA, 20 bp, Artificial
  CRISPR gRNA sequence
gattataccgtcgtagtaag

SEQ ID NO: 321171 - DNA, 20 bp, Artificial
  CRISPR gRNA sequence
attataccgtcgtagtaaga

SEQ ID NO: 321172 - DNA, 20 bp, Artificial
  CRISPR gRNA sequence
taccgtcgtagtaagagatt

SEQ ID NO: 321173 - DNA, 20 bp, Artificial
  CRISPR gRNA sequence
aaagctgaactattttattt

SEQ ID NO: 321174 - DNA, 20 bp, Artificial
  CRISPR gRNA sequence
aactattttatttttgtttt

SEQ ID NO: 321175 - DNA, 20 bp, Artificial
  CRISPR gRNA sequence
ttttatttttgttttgctgc

SEQ ID NO: 321176 - DNA, 20 bp, Artificial
  CRISPR gRNA sequence
tatttttgttttgctgctat

SEQ ID NO: 321177 - DNA, 20 bp, Artificial
  CRISPR gRNA sequence
atttttgttttgctgctata

SEQ ID NO: 321178 - DNA, 20 bp, Artificial
  CRISPR gRNA sequence
tttttgttttgctgctataa

SEQ ID NO: 321179 - DNA, 20 bp, Artificial
  CRISPR gRNA sequence
ttgttttgctgctataattg

SEQ ID NO: 321180 - DNA, 20 bp, Artificial
  CRISPR gRNA sequence
tgttttgctgctataattgg

SEQ ID NO: 321181 - DNA, 20 bp, Artificial
  CRISPR gRNA sequence
gttttgctgctataattggc

SEQ ID NO: 321182 - DNA, 20 bp, Artificial
  CRISPR gRNA sequence
ttttgctgctataattggct

SEQ ID NO: 321183 - DNA, 20 bp, Artificial
  CRISPR gRNA sequence
tgctgctataattggctcct

SEQ ID NO: 321184 - DNA, 20 bp, Artificial
  CRISPR gRNA sequence
gctgctataattggctcctc

SEQ ID NO: 321185 - DNA, 20 bp, Artificial
  CRISPR gRNA sequence
ctgctataattggctcctct

SEQ ID NO: 321186 - DNA, 20 bp, Artificial
  CRISPR gRNA sequence
ctataattggctcctctgac

SEQ ID NO: 321187 - DNA, 20 bp, Artificial
  CRISPR gRNA sequence
taattggctcctctgacacc

SEQ ID NO: 321188 - DNA, 20 bp, Artificial
  CRISPR gRNA sequence
gctcctctgacacctgacaa

SEQ ID NO: 321189 - DNA, 20 bp, Artificial
  CRISPR gRNA sequence
ctctgacacctgacaactca

SEQ ID NO: 321190 - DNA, 20 bp, Artificial
  CRISPR gRNA sequence
tgacacctgacaactcagct

SEQ ID NO: 321191 - DNA, 20 bp, Artificial
  CRISPR gRNA sequence
acacctgacaactcagctct

SEQ ID NO: 321192 - DNA, 20 bp, Artificial
  CRISPR gRNA sequence
acaactcagctctctctctc

SEQ ID NO: 321193 - DNA, 20 bp, Artificial
  CRISPR gRNA sequence
agctctctctctcccagctc

SEQ ID NO: 321194 - DNA, 20 bp, Artificial
  CRISPR gRNA sequence
tctctctcccagctcagctg

SEQ ID NO: 321195 - DNA, 20 bp, Artificial
  CRISPR gRNA sequence
tctctcccagctcagctgag

SEQ ID NO: 321196 - DNA, 20 bp, Artificial
  CRISPR gRNA sequence
tctcccagctcagctgagca

SEQ ID NO: 321197 - DNA, 20 bp, Artificial
  CRISPR gRNA sequence
tcccagctcagctgagcacc

SEQ ID NO: 321198 - DNA, 20 bp, Artificial
  CRISPR gRNA sequence
ccagctcagctgagcacctg

SEQ ID NO: 321199 - DNA, 20 bp, Artificial
  CRISPR gRNA sequence
agctgagcacctgacatctc

SEQ ID NO: 321200 - DNA, 20 bp, Artificial
  CRISPR gRNA sequence
agcacctgacatctcccatt

SEQ ID NO: 321201 - DNA, 20 bp, Artificial
  CRISPR gRNA sequence
acatctcccattagaataag

SEQ ID NO: 321202 - DNA, 20 bp, Artificial
  CRISPR gRNA sequence
ccattagaataagctccatg

SEQ ID NO: 321203 - DNA, 20 bp, Artificial
  CRISPR gRNA sequence
gaataagctccatgacagca

SEQ ID NO: 321204 - DNA, 20 bp, Artificial
  CRISPR gRNA sequence
catgacagcaggggctttgt

SEQ ID NO: 321205 - DNA, 20 bp, Artificial
  CRISPR gRNA sequence
tgtcacttttcctcactgtg

SEQ ID NO: 321206 - DNA, 20 bp, Artificial
  CRISPR gRNA sequence
gtcacttttcctcactgtga

SEQ ID NO: 321207 - DNA, 20 bp, Artificial
  CRISPR gRNA sequence
tcacttttcctcactgtgac

SEQ ID NO: 321208 - DNA, 20 bp, Artificial
  CRISPR gRNA sequence
ttcctcactgtgacatttcc

SEQ ID NO: 321209 - DNA, 20 bp, Artificial
  CRISPR gRNA sequence
tcctcactgtgacatttcca

SEQ ID NO: 321210 - DNA, 20 bp, Artificial
  CRISPR gRNA sequence
cctcactgtgacatttccag

SEQ ID NO: 321211 - DNA, 20 bp, Artificial
  CRISPR gRNA sequence
ctcactgtgacatttccagt

SEQ ID NO: 321212 - DNA, 20 bp, Artificial
  CRISPR gRNA sequence
actgtgacatttccagtacc

SEQ ID NO: 321213 - DNA, 20 bp, Artificial
  CRISPR gRNA sequence
tgacatttccagtacctgca

SEQ ID NO: 321214 - DNA, 20 bp, Artificial
  CRISPR gRNA sequence
ccagtacctgcaattgtccc

SEQ ID NO: 321215 - DNA, 20 bp, Artificial
  CRISPR gRNA sequence
cagtacctgcaattgtccct

SEQ ID NO: 321216 - DNA, 20 bp, Artificial
  CRISPR gRNA sequence
caattgtcccttacaaatat

SEQ ID NO: 321217 - DNA, 20 bp, Artificial
  CRISPR gRNA sequence
tcccttacaaatatgaagca

SEQ ID NO: 321218 - DNA, 20 bp, Artificial
  CRISPR gRNA sequence
acaaatatgaagcactcaat

SEQ ID NO: 321219 - DNA, 20 bp, Artificial
  CRISPR gRNA sequence
caaatatgaagcactcaata

SEQ ID NO: 321220 - DNA, 20 bp, Artificial
  CRISPR gRNA sequence
aataagtaattgttgaagaa

SEQ ID NO: 321221 - DNA, 20 bp, Artificial
  CRISPR gRNA sequence
ttgaagaaaggaaaggaaaa

SEQ ID NO: 321222 - DNA, 20 bp, Artificial
  CRISPR gRNA sequence
aagaaaggaaaggaaaaatc

SEQ ID NO: 321223 - DNA, 20 bp, Artificial
  CRISPR gRNA sequence
aagaataactagggaaatgc

SEQ ID NO: 321224 - DNA, 20 bp, Artificial
  CRISPR gRNA sequence
gggaaatgcaatttaaacct

SEQ ID NO: 321225 - DNA, 20 bp, Artificial
  CRISPR gRNA sequence
aaacctcagtgagaaaccat

SEQ ID NO: 321226 - DNA, 20 bp, Artificial
  CRISPR gRNA sequence
aacctcagtgagaaaccatt

SEQ ID NO: 321227 - DNA, 20 bp, Artificial
  CRISPR gRNA sequence
agtgagaaaccattcttttt

SEQ ID NO: 321228 - DNA, 20 bp, Artificial
  CRISPR gRNA sequence
tttttgcccatttgattggc

SEQ ID NO: 321229 - DNA, 20 bp, Artificial
  CRISPR gRNA sequence
tttgcccatttgattggcac

SEQ ID NO: 321230 - DNA, 20 bp, Artificial
  CRISPR gRNA sequence
ttgcccatttgattggcacg

SEQ ID NO: 321231 - DNA, 20 bp, Artificial
  CRISPR gRNA sequence
tgcccatttgattggcacgt

SEQ ID NO: 321232 - DNA, 20 bp, Artificial
  CRISPR gRNA sequence
gcccatttgattggcacgta

SEQ ID NO: 321233 - DNA, 20 bp, Artificial
  CRISPR gRNA sequence
cccatttgattggcacgtat

SEQ ID NO: 321234 - DNA, 20 bp, Artificial
  CRISPR gRNA sequence
gattggcacgtattaaaaaa

SEQ ID NO: 321235 - DNA, 20 bp, Artificial
  CRISPR gRNA sequence
attggcacgtattaaaaaaa

SEQ ID NO: 321236 - DNA, 20 bp, Artificial
  CRISPR gRNA sequence
gcacgtattaaaaaaaatac

SEQ ID NO: 321237 - DNA, 20 bp, Artificial
  CRISPR gRNA sequence
aaaaaaatactggtaatacc

SEQ ID NO: 321238 - DNA, 20 bp, Artificial
  CRISPR gRNA sequence
gtaatacccagtgtccgcga

SEQ ID NO: 321239 - DNA, 20 bp, Artificial
  CRISPR gRNA sequence
ggaaaatgggtcctaactgc

SEQ ID NO: 321240 - DNA, 20 bp, Artificial
  CRISPR gRNA sequence
actgctgaatttactgctgg

SEQ ID NO: 321241 - DNA, 20 bp, Artificial
  CRISPR gRNA sequence
ctgaatttactgctggtaaa

SEQ ID NO: 321242 - DNA, 20 bp, Artificial
  CRISPR gRNA sequence
aatttactgctggtaaaatt

SEQ ID NO: 321243 - DNA, 20 bp, Artificial
  CRISPR gRNA sequence
actgctggtaaaattctaaa

SEQ ID NO: 321244 - DNA, 20 bp, Artificial
  CRISPR gRNA sequence
ctgctggtaaaattctaaat

SEQ ID NO: 321245 - DNA, 20 bp, Artificial
  CRISPR gRNA sequence
ctggtaaaattctaaattgg

SEQ ID NO: 321246 - DNA, 20 bp, Artificial
  CRISPR gRNA sequence
gtaaaattctaaattggtac

SEQ ID NO: 321247 - DNA, 20 bp, Artificial
  CRISPR gRNA sequence
taaattggtacaaccttttt

SEQ ID NO: 321248 - DNA, 20 bp, Artificial
  CRISPR gRNA sequence
aattggtacaacctttttgg

SEQ ID NO: 321249 - DNA, 20 bp, Artificial
  CRISPR gRNA sequence
gtacaacctttttggaggac

SEQ ID NO: 321250 - DNA, 20 bp, Artificial
  CRISPR gRNA sequence
tttggaggacagttggtaat

SEQ ID NO: 321251 - DNA, 20 bp, Artificial
  CRISPR gRNA sequence
ttggaggacagttggtaata

SEQ ID NO: 321252 - DNA, 20 bp, Artificial
  CRISPR gRNA sequence
tggaggacagttggtaatat

SEQ ID NO: 321253 - DNA, 20 bp, Artificial
  CRISPR gRNA sequence
ggaggacagttggtaatatg

SEQ ID NO: 321254 - DNA, 20 bp, Artificial
  CRISPR gRNA sequence
gaggacagttggtaatatgt

SEQ ID NO: 321255 - DNA, 20 bp, Artificial
  CRISPR gRNA sequence
gtaatatgtaagaaaattaa

SEQ ID NO: 321256 - DNA, 20 bp, Artificial
  CRISPR gRNA sequence
attatgggcttaagcattga

SEQ ID NO: 321257 - DNA, 20 bp, Artificial
  CRISPR gRNA sequence
tgggcttaagcattgactta

SEQ ID NO: 321258 - DNA, 20 bp, Artificial
  CRISPR gRNA sequence
aagcattgacttagcaactc

SEQ ID NO: 321259 - DNA, 20 bp, Artificial
  CRISPR gRNA sequence
agcattgacttagcaactca

SEQ ID NO: 321260 - DNA, 20 bp, Artificial
  CRISPR gRNA sequence
acttagcaactcaatttctt

SEQ ID NO: 321261 - DNA, 20 bp, Artificial
  CRISPR gRNA sequence
agcaactcaatttcttaaga

SEQ ID NO: 321262 - DNA, 20 bp, Artificial
  CRISPR gRNA sequence
gcaactcaatttcttaagaa

SEQ ID NO: 321263 - DNA, 20 bp, Artificial
  CRISPR gRNA sequence
aatttcttaagaattcattc

SEQ ID NO: 321264 - DNA, 20 bp, Artificial
  CRISPR gRNA sequence
cttaagaattcattctacaa

SEQ ID NO: 321265 - DNA, 20 bp, Artificial
  CRISPR gRNA sequence
ttaagaattcattctacaaa

SEQ ID NO: 321266 - DNA, 20 bp, Artificial
  CRISPR gRNA sequence
aagaattcattctacaaaaa

SEQ ID NO: 321267 - DNA, 20 bp, Artificial
  CRISPR gRNA sequence
agaattcattctacaaaaag

SEQ ID NO: 321268 - DNA, 20 bp, Artificial
  CRISPR gRNA sequence
attctacaaaaagatacatg

SEQ ID NO: 321269 - DNA, 20 bp, Artificial
  CRISPR gRNA sequence
tacaaaaagatacatgtgca

SEQ ID NO: 321270 - DNA, 20 bp, Artificial
  CRISPR gRNA sequence
caaaaagatacatgtgcaca

SEQ ID NO: 321271 - DNA, 20 bp, Artificial
  CRISPR gRNA sequence
gaggtacacaggtattcatt

SEQ ID NO: 321272 - DNA, 20 bp, Artificial
  CRISPR gRNA sequence
attgtttataagaacaatac

SEQ ID NO: 321273 - DNA, 20 bp, Artificial
  CRISPR gRNA sequence
tttataagaacaatacactg

SEQ ID NO: 321274 - DNA, 20 bp, Artificial
  CRISPR gRNA sequence
ataagaacaatacactggaa

SEQ ID NO: 321275 - DNA, 20 bp, Artificial
  CRISPR gRNA sequence
taagaacaatacactggaaa

SEQ ID NO: 321276 - DNA, 20 bp, Artificial
  CRISPR gRNA sequence
gaaataagttaaatggttta

SEQ ID NO: 321277 - DNA, 20 bp, Artificial
  CRISPR gRNA sequence
aatggtttaacaaataatga

SEQ ID NO: 321278 - DNA, 20 bp, Artificial
  CRISPR gRNA sequence
aacaaataatgatacatcca

SEQ ID NO: 321279 - DNA, 20 bp, Artificial
  CRISPR gRNA sequence
acaaataatgatacatccat

SEQ ID NO: 321280 - DNA, 20 bp, Artificial
  CRISPR gRNA sequence
tgaaacagaaagctataggg

SEQ ID NO: 321281 - DNA, 20 bp, Artificial
  CRISPR gRNA sequence
tagggcagtacactattata

SEQ ID NO: 321282 - DNA, 20 bp, Artificial
  CRISPR gRNA sequence
ttataactaatagcatggat

SEQ ID NO: 321283 - DNA, 20 bp, Artificial
  CRISPR gRNA sequence
taactaatagcatggattct

SEQ ID NO: 321284 - DNA, 20 bp, Artificial
  CRISPR gRNA sequence
atagcatggattctggacag

SEQ ID NO: 321285 - DNA, 20 bp, Artificial
  CRISPR gRNA sequence
tggacagcgtgagttcaatc

SEQ ID NO: 321286 - DNA, 20 bp, Artificial
  CRISPR gRNA sequence
gacagcgtgagttcaatctc

SEQ ID NO: 321287 - DNA, 20 bp, Artificial
  CRISPR gRNA sequence
aatctcagctcaactactca

SEQ ID NO: 321288 - DNA, 20 bp, Artificial
  CRISPR gRNA sequence
agctcaactactcactgcct

SEQ ID NO: 321289 - DNA, 20 bp, Artificial
  CRISPR gRNA sequence
aactactcactgcctgtgtt

SEQ ID NO: 321290 - DNA, 20 bp, Artificial
  CRISPR gRNA sequence
ctcactgcctgtgttaccat

SEQ ID NO: 321291 - DNA, 20 bp, Artificial
  CRISPR gRNA sequence
actgcctgtgttaccatagg

SEQ ID NO: 321292 - DNA, 20 bp, Artificial
  CRISPR gRNA sequence
cctgtgttaccataggcaaa

SEQ ID NO: 321293 - DNA, 20 bp, Artificial
  CRISPR gRNA sequence
tgttaccataggcaaattac

SEQ ID NO: 321294 - DNA, 20 bp, Artificial
  CRISPR gRNA sequence
ccataggcaaattacttaac

SEQ ID NO: 321295 - DNA, 20 bp, Artificial
  CRISPR gRNA sequence
cttaacttccctgtgtctca

SEQ ID NO: 321296 - DNA, 20 bp, Artificial
  CRISPR gRNA sequence
aacttccctgtgtctcagtt

SEQ ID NO: 321297 - DNA, 20 bp, Artificial
  CRISPR gRNA sequence
acttccctgtgtctcagttt

SEQ ID NO: 321298 - DNA, 20 bp, Artificial
  CRISPR gRNA sequence
ccctgtgtctcagtttcctc

SEQ ID NO: 321299 - DNA, 20 bp, Artificial
  CRISPR gRNA sequence
cctgtgtctcagtttcctct

SEQ ID NO: 321300 - DNA, 20 bp, Artificial
  CRISPR gRNA sequence
tgtctcagtttcctcttgca

SEQ ID NO: 321301 - DNA, 20 bp, Artificial
  CRISPR gRNA sequence
agtttcctcttgcaaaaagc

SEQ ID NO: 321302 - DNA, 20 bp, Artificial
  CRISPR gRNA sequence
cctcttgcaaaaagcaggaa

SEQ ID NO: 321303 - DNA, 20 bp, Artificial
  CRISPR gRNA sequence
ctcttgcaaaaagcaggaac

SEQ ID NO: 321304 - DNA, 20 bp, Artificial
  CRISPR gRNA sequence
ttgcaaaaagcaggaacaat

SEQ ID NO: 321305 - DNA, 20 bp, Artificial
  CRISPR gRNA sequence
gcaaaaagcaggaacaataa

SEQ ID NO: 321306 - DNA, 20 bp, Artificial
  CRISPR gRNA sequence
caaaaagcaggaacaataat

SEQ ID NO: 321307 - DNA, 20 bp, Artificial
  CRISPR gRNA sequence
cctcataggtttgttgtgag

SEQ ID NO: 321308 - DNA, 20 bp, Artificial
  CRISPR gRNA sequence
ataggtttgttgtgaggatt

SEQ ID NO: 321309 - DNA, 20 bp, Artificial
  CRISPR gRNA sequence
gttgtgaggattaaagaaat

SEQ ID NO: 321310 - DNA, 20 bp, Artificial
  CRISPR gRNA sequence
ttgtgaggattaaagaaatg

SEQ ID NO: 321311 - DNA, 20 bp, Artificial
  CRISPR gRNA sequence
tgaggattaaagaaatgaat

SEQ ID NO: 321312 - DNA, 20 bp, Artificial
  CRISPR gRNA sequence
aagaaatgaatatttgagtt

SEQ ID NO: 321313 - DNA, 20 bp, Artificial
  CRISPR gRNA sequence
gagttagtgttggatcaaat

SEQ ID NO: 321314 - DNA, 20 bp, Artificial
  CRISPR gRNA sequence
agttagtgttggatcaaata

SEQ ID NO: 321315 - DNA, 20 bp, Artificial
  CRISPR gRNA sequence
gtgttggatcaaatactggc

SEQ ID NO: 321316 - DNA, 20 bp, Artificial
  CRISPR gRNA sequence
gatcaaatactggcctgtgg

SEQ ID NO: 321317 - DNA, 20 bp, Artificial
  CRISPR gRNA sequence
gcctgtggtaagcattaatt

SEQ ID NO: 321318 - DNA, 20 bp, Artificial
  CRISPR gRNA sequence
tggtaagcattaattgattt

SEQ ID NO: 321319 - DNA, 20 bp, Artificial
  CRISPR gRNA sequence
attgatttacttgtttttgt

SEQ ID NO: 321320 - DNA, 20 bp, Artificial
  CRISPR gRNA sequence
atttacttgtttttgttttt

SEQ ID NO: 321321 - DNA, 20 bp, Artificial
  CRISPR gRNA sequence
acttgtttttgtttttttat

SEQ ID NO: 321322 - DNA, 20 bp, Artificial
  CRISPR gRNA sequence
cttgtttttgtttttttatt

SEQ ID NO: 321323 - DNA, 20 bp, Artificial
  CRISPR gRNA sequence
gtttttgtttttttatttat

SEQ ID NO: 321324 - DNA, 20 bp, Artificial
  CRISPR gRNA sequence
tttttgtttttttatttatt

SEQ ID NO: 321325 - DNA, 20 bp, Artificial
  CRISPR gRNA sequence
ttgtttttttatttattttt

SEQ ID NO: 321326 - DNA, 20 bp, Artificial
  CRISPR gRNA sequence
tgtttttttatttattttta

SEQ ID NO: 321327 - DNA, 20 bp, Artificial
  CRISPR gRNA sequence
gtttttttatttatttttaa

SEQ ID NO: 321328 - DNA, 20 bp, Artificial
  CRISPR gRNA sequence
tttttttatttatttttaac

SEQ ID NO: 321329 - DNA, 20 bp, Artificial
  CRISPR gRNA sequence
ttttatttatttttaacatt

SEQ ID NO: 321330 - DNA, 20 bp, Artificial
  CRISPR gRNA sequence
tttatttatttttaacatta

SEQ ID NO: 321331 - DNA, 20 bp, Artificial
  CRISPR gRNA sequence
ttatttatttttaacattat

SEQ ID NO: 321332 - DNA, 20 bp, Artificial
  CRISPR gRNA sequence
tatttatttttaacattatt

SEQ ID NO: 321333 - DNA, 20 bp, Artificial
  CRISPR gRNA sequence
atttatttttaacattatta

SEQ ID NO: 321334 - DNA, 20 bp, Artificial
  CRISPR gRNA sequence
tttatttttaacattattaa

SEQ ID NO: 321335 - DNA, 20 bp, Artificial
  CRISPR gRNA sequence
atttttaacattattaatga

SEQ ID NO: 321336 - DNA, 20 bp, Artificial
  CRISPR gRNA sequence
tttttaacattattaatgat

SEQ ID NO: 321337 - DNA, 20 bp, Artificial
  CRISPR gRNA sequence
ttaacattattaatgataga

SEQ ID NO: 321338 - DNA, 20 bp, Artificial
  CRISPR gRNA sequence
taacattattaatgatagag

SEQ ID NO: 321339 - DNA, 20 bp, Artificial
  CRISPR gRNA sequence
aacattattaatgatagaga

SEQ ID NO: 321340 - DNA, 20 bp, Artificial
  CRISPR gRNA sequence
acattattaatgatagagaa

SEQ ID NO: 321341 - DNA, 20 bp, Artificial
  CRISPR gRNA sequence
ttaatgatagagaacaatgt

SEQ ID NO: 321342 - DNA, 20 bp, Artificial
  CRISPR gRNA sequence
atgatagagaacaatgtcta

SEQ ID NO: 321343 - DNA, 20 bp, Artificial
  CRISPR gRNA sequence
tcgacataaaatcaataatt

SEQ ID NO: 321344 - DNA, 20 bp, Artificial
  CRISPR gRNA sequence
atagataaatttactcaaaa

SEQ ID NO: 321345 - DNA, 20 bp, Artificial
  CRISPR gRNA sequence
tagataaatttactcaaaaa

SEQ ID NO: 321346 - DNA, 20 bp, Artificial
  CRISPR gRNA sequence
actcaaaaaaaatttaaata

SEQ ID NO: 321347 - DNA, 20 bp, Artificial
  CRISPR gRNA sequence
ctcaaaaaaaatttaaataa

SEQ ID NO: 321348 - DNA, 20 bp, Artificial
  CRISPR gRNA sequence
aaaaaaaatttaaataagta

SEQ ID NO: 321349 - DNA, 20 bp, Artificial
  CRISPR gRNA sequence
aaataagtatatttaggata

SEQ ID NO: 321350 - DNA, 20 bp, Artificial
  CRISPR gRNA sequence
aataagtatatttaggatac

SEQ ID NO: 321351 - DNA, 20 bp, Artificial
  CRISPR gRNA sequence
aggatacttaaaaagatatt

SEQ ID NO: 321352 - DNA, 20 bp, Artificial
  CRISPR gRNA sequence
ggatacttaaaaagatattt

SEQ ID NO: 321353 - DNA, 20 bp, Artificial
  CRISPR gRNA sequence
aaaaagatatttgaagtaac

SEQ ID NO: 321354 - DNA, 20 bp, Artificial
  CRISPR gRNA sequence
aaaagatatttgaagtaaca

SEQ ID NO: 321355 - DNA, 20 bp, Artificial
  CRISPR gRNA sequence
gaagtaacatcaaaaagtac

SEQ ID NO: 321356 - DNA, 20 bp, Artificial
  CRISPR gRNA sequence
aagtaacatcaaaaagtaca

SEQ ID NO: 321357 - DNA, 20 bp, Artificial
  CRISPR gRNA sequence
taaaacataaaaatagatag

SEQ ID NO: 321358 - DNA, 20 bp, Artificial
  CRISPR gRNA sequence
taatcccaggactttaagaa

SEQ ID NO: 321359 - DNA, 20 bp, Artificial
  CRISPR gRNA sequence
taagaagctgagaagagata

SEQ ID NO: 321360 - DNA, 20 bp, Artificial
  CRISPR gRNA sequence
aagaagctgagaagagataa

SEQ ID NO: 321361 - DNA, 20 bp, Artificial
  CRISPR gRNA sequence
agaagctgagaagagataat

SEQ ID NO: 321362 - DNA, 20 bp, Artificial
  CRISPR gRNA sequence
agaagagataatcacttaaa

SEQ ID NO: 321363 - DNA, 20 bp, Artificial
  CRISPR gRNA sequence
aaaaggagttcaagaccagc

SEQ ID NO: 321364 - DNA, 20 bp, Artificial
  CRISPR gRNA sequence
aaaggagttcaagaccagcc

SEQ ID NO: 321365 - DNA, 20 bp, Artificial
  CRISPR gRNA sequence
aagaccagcctgggcacaaa

SEQ ID NO: 321366 - DNA, 20 bp, Artificial
  CRISPR gRNA sequence
ggcacaaagcgagaccccgt

SEQ ID NO: 321367 - DNA, 20 bp, Artificial
  CRISPR gRNA sequence
taaagcaaaacaaaacaaca

SEQ ID NO: 321368 - DNA, 20 bp, Artificial
  CRISPR gRNA sequence
aagcaaaacaaaacaacaac

SEQ ID NO: 321369 - DNA, 20 bp, Artificial
  CRISPR gRNA sequence
gccaggcatggtggcatgta

SEQ ID NO: 321370 - DNA, 20 bp, Artificial
  CRISPR gRNA sequence
atagtgccagctattcaggt

SEQ ID NO: 321371 - DNA, 20 bp, Artificial
  CRISPR gRNA sequence
tagtgccagctattcaggtg

SEQ ID NO: 321372 - DNA, 20 bp, Artificial
  CRISPR gRNA sequence
ttcaggtggctgaggcagaa

SEQ ID NO: 321373 - DNA, 20 bp, Artificial
  CRISPR gRNA sequence
aggtggctgaggcagaaaca

SEQ ID NO: 321374 - DNA, 20 bp, Artificial
  CRISPR gRNA sequence
aggcagaaacatctcttgag

SEQ ID NO: 321375 - DNA, 20 bp, Artificial
  CRISPR gRNA sequence
ttgagcctgggaattagagg

SEQ ID NO: 321376 - DNA, 20 bp, Artificial
  CRISPR gRNA sequence
gagcctgggaattagaggct

SEQ ID NO: 321377 - DNA, 20 bp, Artificial
  CRISPR gRNA sequence
agcctgggaattagaggctg

SEQ ID NO: 321378 - DNA, 20 bp, Artificial
  CRISPR gRNA sequence
ggaattagaggctgcagtaa

SEQ ID NO: 321379 - DNA, 20 bp, Artificial
  CRISPR gRNA sequence
gaggctgcagtaagctttga

SEQ ID NO: 321380 - DNA, 20 bp, Artificial
  CRISPR gRNA sequence
cagtaagctttgatagcacc

SEQ ID NO: 321381 - DNA, 20 bp, Artificial
  CRISPR gRNA sequence
tgatagcaccactgcactcc

SEQ ID NO: 321382 - DNA, 20 bp, Artificial
  CRISPR gRNA sequence
gatagcaccactgcactcct

SEQ ID NO: 321383 - DNA, 20 bp, Artificial
  CRISPR gRNA sequence
atagcaccactgcactcctc

SEQ ID NO: 321384 - DNA, 20 bp, Artificial
  CRISPR gRNA sequence
cactcctctagcctgggtga

SEQ ID NO: 321385 - DNA, 20 bp, Artificial
  CRISPR gRNA sequence
ctctagcctgggtgacagag

SEQ ID NO: 321386 - DNA, 20 bp, Artificial
  CRISPR gRNA sequence
tagcctgggtgacagagttt

SEQ ID NO: 321387 - DNA, 20 bp, Artificial
  CRISPR gRNA sequence
gcctgggtgacagagttttt

SEQ ID NO: 321388 - DNA, 20 bp, Artificial
  CRISPR gRNA sequence
ggtgacagagttttttgctt

SEQ ID NO: 321389 - DNA, 20 bp, Artificial
  CRISPR gRNA sequence
tttgcttccataaatctcaa

SEQ ID NO: 321390 - DNA, 20 bp, Artificial
  CRISPR gRNA sequence
ttgcttccataaatctcaac

SEQ ID NO: 321391 - DNA, 20 bp, Artificial
  CRISPR gRNA sequence
tgcttccataaatctcaaca

SEQ ID NO: 321392 - DNA, 20 bp, Artificial
  CRISPR gRNA sequence
gcttccataaatctcaacag

SEQ ID NO: 321393 - DNA, 20 bp, Artificial
  CRISPR gRNA sequence
cttccataaatctcaacagt

SEQ ID NO: 321394 - DNA, 20 bp, Artificial
  CRISPR gRNA sequence
ccataaatctcaacagtact

SEQ ID NO: 321395 - DNA, 20 bp, Artificial
  CRISPR gRNA sequence
cataaatctcaacagtactt

SEQ ID NO: 321396 - DNA, 20 bp, Artificial
  CRISPR gRNA sequence
aacagtacttctggggacaa

SEQ ID NO: 321397 - DNA, 20 bp, Artificial
  CRISPR gRNA sequence
ctggggacaaaataccaggt

SEQ ID NO: 321398 - DNA, 20 bp, Artificial
  CRISPR gRNA sequence
tggggacaaaataccaggtt

SEQ ID NO: 321399 - DNA, 20 bp, Artificial
  CRISPR gRNA sequence
gggacaaaataccaggttac

SEQ ID NO: 321400 - DNA, 20 bp, Artificial
  CRISPR gRNA sequence
catattttggaaatggtatt

SEQ ID NO: 321401 - DNA, 20 bp, Artificial
  CRISPR gRNA sequence
tggaaatggtattaaaactc

SEQ ID NO: 321402 - DNA, 20 bp, Artificial
  CRISPR gRNA sequence
ggaaatggtattaaaactcc

SEQ ID NO: 321403 - DNA, 20 bp, Artificial
  CRISPR gRNA sequence
gaaatggtattaaaactccc

SEQ ID NO: 321404 - DNA, 20 bp, Artificial
  CRISPR gRNA sequence
aaactcccctctcacaaagg

SEQ ID NO: 321405 - DNA, 20 bp, Artificial
  CRISPR gRNA sequence
ccctctcacaaaggaaaaat

SEQ ID NO: 321406 - DNA, 20 bp, Artificial
  CRISPR gRNA sequence
tcacaaaggaaaaataagcc

SEQ ID NO: 321407 - DNA, 20 bp, Artificial
  CRISPR gRNA sequence
acaaaggaaaaataagccac

SEQ ID NO: 321408 - DNA, 20 bp, Artificial
  CRISPR gRNA sequence
tcaaacacttgcttcttcca

SEQ ID NO: 321409 - DNA, 20 bp, Artificial
  CRISPR gRNA sequence
aaacacttgcttcttccaaa

SEQ ID NO: 321410 - DNA, 20 bp, Artificial
  CRISPR gRNA sequence
gcttcttccaaaaaaaatgt

SEQ ID NO: 321411 - DNA, 20 bp, Artificial
  CRISPR gRNA sequence
cttcttccaaaaaaaatgtc

SEQ ID NO: 321412 - DNA, 20 bp, Artificial
  CRISPR gRNA sequence
cttccaaaaaaaatgtctgc

SEQ ID NO: 321413 - DNA, 20 bp, Artificial
  CRISPR gRNA sequence
ttccaaaaaaaatgtctgct

SEQ ID NO: 321414 - DNA, 20 bp, Artificial
  CRISPR gRNA sequence
ccaaaaaaaatgtctgcttg

SEQ ID NO: 321415 - DNA, 20 bp, Artificial
  CRISPR gRNA sequence
caaaaaaaatgtctgcttgc

SEQ ID NO: 321416 - DNA, 20 bp, Artificial
  CRISPR gRNA sequence
cttgccttgggagcctctct

SEQ ID NO: 321417 - DNA, 20 bp, Artificial
  CRISPR gRNA sequence
gccttgggagcctctctgtt

SEQ ID NO: 321418 - DNA, 20 bp, Artificial
  CRISPR gRNA sequence
ccttgggagcctctctgttc

SEQ ID NO: 321419 - DNA, 20 bp, Artificial
  CRISPR gRNA sequence
gggagcctctctgttccata

SEQ ID NO: 321420 - DNA, 20 bp, Artificial
  CRISPR gRNA sequence
ggagcctctctgttccatac

SEQ ID NO: 321421 - DNA, 20 bp, Artificial
  CRISPR gRNA sequence
tctgttccataccaatttca

SEQ ID NO: 321422 - DNA, 20 bp, Artificial
  CRISPR gRNA sequence
tgttccataccaatttcact

SEQ ID NO: 321423 - DNA, 20 bp, Artificial
  CRISPR gRNA sequence
ttccataccaatttcactct

SEQ ID NO: 321424 - DNA, 20 bp, Artificial
  CRISPR gRNA sequence
cataccaatttcactcttgc

SEQ ID NO: 321425 - DNA, 20 bp, Artificial
  CRISPR gRNA sequence
cactcttgctcccaaacaac

SEQ ID NO: 321426 - DNA, 20 bp, Artificial
  CRISPR gRNA sequence
actcttgctcccaaacaacc

SEQ ID NO: 321427 - DNA, 20 bp, Artificial
  CRISPR gRNA sequence
ttgctcccaaacaaccctat

SEQ ID NO: 321428 - DNA, 20 bp, Artificial
  CRISPR gRNA sequence
gctcccaaacaaccctatac

SEQ ID NO: 321429 - DNA, 20 bp, Artificial
  CRISPR gRNA sequence
ctcccaaacaaccctataca

SEQ ID NO: 321430 - DNA, 20 bp, Artificial
  CRISPR gRNA sequence
ccaaacaaccctatacacat

SEQ ID NO: 321431 - DNA, 20 bp, Artificial
  CRISPR gRNA sequence
tacacatcctattcagtgac

SEQ ID NO: 321432 - DNA, 20 bp, Artificial
  CRISPR gRNA sequence
ttcagtgactgtcttccact

SEQ ID NO: 321433 - DNA, 20 bp, Artificial
  CRISPR gRNA sequence
agtgactgtcttccactaaa

SEQ ID NO: 321434 - DNA, 20 bp, Artificial
  CRISPR gRNA sequence
tcttccactaaatcaacttg

SEQ ID NO: 321435 - DNA, 20 bp, Artificial
  CRISPR gRNA sequence
ccactaaatcaacttgtctg

SEQ ID NO: 321436 - DNA, 20 bp, Artificial
  CRISPR gRNA sequence
cactaaatcaacttgtctga

SEQ ID NO: 321437 - DNA, 20 bp, Artificial
  CRISPR gRNA sequence
aatcaacttgtctgattgct

SEQ ID NO: 321438 - DNA, 20 bp, Artificial
  CRISPR gRNA sequence
gtctgattgctcattttctc

SEQ ID NO: 321439 - DNA, 20 bp, Artificial
  CRISPR gRNA sequence
tctgattgctcattttctct

SEQ ID NO: 321440 - DNA, 20 bp, Artificial
  CRISPR gRNA sequence
attgctcattttctctggaa

SEQ ID NO: 321441 - DNA, 20 bp, Artificial
  CRISPR gRNA sequence
ctcattttctctggaaccca

SEQ ID NO: 321442 - DNA, 20 bp, Artificial
  CRISPR gRNA sequence
attttctctggaacccacta

SEQ ID NO: 321443 - DNA, 20 bp, Artificial
  CRISPR gRNA sequence
tctctggaacccactaaaag

SEQ ID NO: 321444 - DNA, 20 bp, Artificial
  CRISPR gRNA sequence
ctctggaacccactaaaagc

SEQ ID NO: 321445 - DNA, 20 bp, Artificial
  CRISPR gRNA sequence
tctggaacccactaaaagcc

SEQ ID NO: 321446 - DNA, 20 bp, Artificial
  CRISPR gRNA sequence
tggaacccactaaaagccct

SEQ ID NO: 321447 - DNA, 20 bp, Artificial
  CRISPR gRNA sequence
gaacccactaaaagccctcc

SEQ ID NO: 321448 - DNA, 20 bp, Artificial
  CRISPR gRNA sequence
aaagccctcctgaaacaatc

SEQ ID NO: 321449 - DNA, 20 bp, Artificial
  CRISPR gRNA sequence
ctgaaacaatcaactaattt

SEQ ID NO: 321450 - DNA, 20 bp, Artificial
  CRISPR gRNA sequence
aaacaatcaactaatttggg

SEQ ID NO: 321451 - DNA, 20 bp, Artificial
  CRISPR gRNA sequence
atttgggggtaagatactcc

SEQ ID NO: 321452 - DNA, 20 bp, Artificial
  CRISPR gRNA sequence
gggggtaagatactccctac

SEQ ID NO: 321453 - DNA, 20 bp, Artificial
  CRISPR gRNA sequence
ggggtaagatactccctact

SEQ ID NO: 321454 - DNA, 20 bp, Artificial
  CRISPR gRNA sequence
cctactagataacatatatc

SEQ ID NO: 321455 - DNA, 20 bp, Artificial
  CRISPR gRNA sequence
ctagataacatatatctatt

SEQ ID NO: 321456 - DNA, 20 bp, Artificial
  CRISPR gRNA sequence
gataacatatatctattttg

SEQ ID NO: 321457 - DNA, 20 bp, Artificial
  CRISPR gRNA sequence
ttttgaaaaacactgaaatg

SEQ ID NO: 321458 - DNA, 20 bp, Artificial
  CRISPR gRNA sequence
tgaaaaacactgaaatggtg

SEQ ID NO: 321459 - DNA, 20 bp, Artificial
  CRISPR gRNA sequence
gaaaaacactgaaatggtgg

SEQ ID NO: 321460 - DNA, 20 bp, Artificial
  CRISPR gRNA sequence
aaaaacactgaaatggtggc

SEQ ID NO: 321461 - DNA, 20 bp, Artificial
  CRISPR gRNA sequence
aaatggtggcttaacataaa

SEQ ID NO: 321462 - DNA, 20 bp, Artificial
  CRISPR gRNA sequence
aacataaaggggtgaatcca

SEQ ID NO: 321463 - DNA, 20 bp, Artificial
  CRISPR gRNA sequence
acataaaggggtgaatccaa

SEQ ID NO: 321464 - DNA, 20 bp, Artificial
  CRISPR gRNA sequence
ttaggctccatgacaattct

SEQ ID NO: 321465 - DNA, 20 bp, Artificial
  CRISPR gRNA sequence
ggctccatgacaattctttg

SEQ ID NO: 321466 - DNA, 20 bp, Artificial
  CRISPR gRNA sequence
catgacaattctttgggaat

SEQ ID NO: 321467 - DNA, 20 bp, Artificial
  CRISPR gRNA sequence
tttgggaatgataggtctcg

SEQ ID NO: 321468 - DNA, 20 bp, Artificial
  CRISPR gRNA sequence
tgggaatgataggtctcgac

SEQ ID NO: 321469 - DNA, 20 bp, Artificial
  CRISPR gRNA sequence
gggaatgataggtctcgact

SEQ ID NO: 321470 - DNA, 20 bp, Artificial
  CRISPR gRNA sequence
ggaatgataggtctcgactg

SEQ ID NO: 321471 - DNA, 20 bp, Artificial
  CRISPR gRNA sequence
gactgtctattcacctccag

SEQ ID NO: 321472 - DNA, 20 bp, Artificial
  CRISPR gRNA sequence
tctattcacctccaggtgat

SEQ ID NO: 321473 - DNA, 20 bp, Artificial
  CRISPR gRNA sequence
ttcacctccaggtgatggtt

SEQ ID NO: 321474 - DNA, 20 bp, Artificial
  CRISPR gRNA sequence
acctccaggtgatggtttta

SEQ ID NO: 321475 - DNA, 20 bp, Artificial
  CRISPR gRNA sequence
caggtgatggttttaatgag

SEQ ID NO: 321476 - DNA, 20 bp, Artificial
  CRISPR gRNA sequence
taatgagggctatcaacaac

SEQ ID NO: 321477 - DNA, 20 bp, Artificial
  CRISPR gRNA sequence
aatgagggctatcaacaaca

SEQ ID NO: 321478 - DNA, 20 bp, Artificial
  CRISPR gRNA sequence
atgagggctatcaacaacag

SEQ ID NO: 321479 - DNA, 20 bp, Artificial
  CRISPR gRNA sequence
tcaacaacagcaggaaatgg

SEQ ID NO: 321480 - DNA, 20 bp, Artificial
  CRISPR gRNA sequence
caaaaatcttgggaggaaaa

SEQ ID NO: 321481 - DNA, 20 bp, Artificial
  CRISPR gRNA sequence
gggaggaaaacagtggacct

SEQ ID NO: 321482 - DNA, 20 bp, Artificial
  CRISPR gRNA sequence
ggaggaaaacagtggacctt

SEQ ID NO: 321483 - DNA, 20 bp, Artificial
  CRISPR gRNA sequence
tccacaggaatgagcttttg

SEQ ID NO: 321484 - DNA, 20 bp, Artificial
  CRISPR gRNA sequence
ccacaggaatgagcttttga

SEQ ID NO: 321485 - DNA, 20 bp, Artificial
  CRISPR gRNA sequence
cacaggaatgagcttttgag

SEQ ID NO: 321486 - DNA, 20 bp, Artificial
  CRISPR gRNA sequence
ttgagccaatcttacataaa

SEQ ID NO: 321487 - DNA, 20 bp, Artificial
  CRISPR gRNA sequence
tgagccaatcttacataaat

SEQ ID NO: 321488 - DNA, 20 bp, Artificial
  CRISPR gRNA sequence
gagccaatcttacataaatc

SEQ ID NO: 321489 - DNA, 20 bp, Artificial
  CRISPR gRNA sequence
agccaatcttacataaatct

SEQ ID NO: 321490 - DNA, 20 bp, Artificial
  CRISPR gRNA sequence
acataaatcttaaggtgggc

SEQ ID NO: 321491 - DNA, 20 bp, Artificial
  CRISPR gRNA sequence
cataaatcttaaggtgggcc

SEQ ID NO: 321492 - DNA, 20 bp, Artificial
  CRISPR gRNA sequence
aaggtgggccgggcgcagtg

SEQ ID NO: 321493 - DNA, 20 bp, Artificial
  CRISPR gRNA sequence
aggtgggccgggcgcagtgg

SEQ ID NO: 321494 - DNA, 20 bp, Artificial
  CRISPR gRNA sequence
atgcctgtctgtaatcccag

SEQ ID NO: 321495 - DNA, 20 bp, Artificial
  CRISPR gRNA sequence
tctgtaatcccagcactttg

SEQ ID NO: 321496 - DNA, 20 bp, Artificial
  CRISPR gRNA sequence
taatcccagcactttgggag

SEQ ID NO: 321497 - DNA, 20 bp, Artificial
  CRISPR gRNA sequence
tgggaggtcgaggcgggcag

SEQ ID NO: 321498 - DNA, 20 bp, Artificial
  CRISPR gRNA sequence
gggaggtcgaggcgggcaga

SEQ ID NO: 321499 - DNA, 20 bp, Artificial
  CRISPR gRNA sequence
ggaggtcgaggcgggcagat

SEQ ID NO: 321500 - DNA, 20 bp, Artificial
  CRISPR gRNA sequence
aggtcaggagttcgagacta

SEQ ID NO: 321501 - DNA, 20 bp, Artificial
  CRISPR gRNA sequence
gagactagcatggccaacat

SEQ ID NO: 321502 - DNA, 20 bp, Artificial
  CRISPR gRNA sequence
gcatggccaacatggtgaaa

SEQ ID NO: 321503 - DNA, 20 bp, Artificial
  CRISPR gRNA sequence
taccaaaaatacaaaaatta

SEQ ID NO: 321504 - DNA, 20 bp, Artificial
  CRISPR gRNA sequence
ccaaaaatacaaaaattatt

SEQ ID NO: 321505 - DNA, 20 bp, Artificial
  CRISPR gRNA sequence
tttgtgtatttttgtatttt

SEQ ID NO: 321506 - DNA, 20 bp, Artificial
  CRISPR gRNA sequence
gtgtatttttgtattttgtg

SEQ ID NO: 321507 - DNA, 20 bp, Artificial
  CRISPR gRNA sequence
tgtatttttgtattttgtgg

SEQ ID NO: 321508 - DNA, 20 bp, Artificial
  CRISPR gRNA sequence
ttgtattttgtggtggtagg

SEQ ID NO: 321509 - DNA, 20 bp, Artificial
  CRISPR gRNA sequence
tgtattttgtggtggtaggt

SEQ ID NO: 321510 - DNA, 20 bp, Artificial
  CRISPR gRNA sequence
gtattttgtggtggtaggtg

SEQ ID NO: 321511 - DNA, 20 bp, Artificial
  CRISPR gRNA sequence
tattttgtggtggtaggtgt

SEQ ID NO: 321512 - DNA, 20 bp, Artificial
  CRISPR gRNA sequence
tgtggtggtaggtgtaatcc

SEQ ID NO: 321513 - DNA, 20 bp, Artificial
  CRISPR gRNA sequence
gtggtggtaggtgtaatccc

SEQ ID NO: 321514 - DNA, 20 bp, Artificial
  CRISPR gRNA sequence
tggtggtaggtgtaatccca

SEQ ID NO: 321515 - DNA, 20 bp, Artificial
  CRISPR gRNA sequence
cttgggaggctgaggcaaga

SEQ ID NO: 321516 - DNA, 20 bp, Artificial
  CRISPR gRNA sequence
gggaggctgaggcaagagaa

SEQ ID NO: 321517 - DNA, 20 bp, Artificial
  CRISPR gRNA sequence
ggaggctgaggcaagagaat

SEQ ID NO: 321518 - DNA, 20 bp, Artificial
  CRISPR gRNA sequence
aggcaagagaatcacttgaa

SEQ ID NO: 321519 - DNA, 20 bp, Artificial
  CRISPR gRNA sequence
gaacctgggaggcgggggtt

SEQ ID NO: 321520 - DNA, 20 bp, Artificial
  CRISPR gRNA sequence
aacctgggaggcgggggttg

SEQ ID NO: 321521 - DNA, 20 bp, Artificial
  CRISPR gRNA sequence
ggaggcgggggttgccgtga

SEQ ID NO: 321522 - DNA, 20 bp, Artificial
  CRISPR gRNA sequence
ccgtgagccaagatcatgcc

SEQ ID NO: 321523 - DNA, 20 bp, Artificial
  CRISPR gRNA sequence
cactttagcctgggcaacag

SEQ ID NO: 321524 - DNA, 20 bp, Artificial
  CRISPR gRNA sequence
tagcctgggcaacagagtga

SEQ ID NO: 321525 - DNA, 20 bp, Artificial
  CRISPR gRNA sequence
agcctgggcaacagagtgag

SEQ ID NO: 321526 - DNA, 20 bp, Artificial
  CRISPR gRNA sequence
gcctgggcaacagagtgaga

SEQ ID NO: 321527 - DNA, 20 bp, Artificial
  CRISPR gRNA sequence
ggcaacagagtgagactcca

SEQ ID NO: 321528 - DNA, 20 bp, Artificial
  CRISPR gRNA sequence
catctcaaaaaaaaaaaaaa

SEQ ID NO: 321529 - DNA, 20 bp, Artificial
  CRISPR gRNA sequence
aaaaaaaaaaaaaaaaaatc

SEQ ID NO: 321530 - DNA, 20 bp, Artificial
  CRISPR gRNA sequence
aaagtgaagaaatattccaa

SEQ ID NO: 321531 - DNA, 20 bp, Artificial
  CRISPR gRNA sequence
aagtgaagaaatattccaac

SEQ ID NO: 321532 - DNA, 20 bp, Artificial
  CRISPR gRNA sequence
caactaccactccaggtaca

SEQ ID NO: 321533 - DNA, 20 bp, Artificial
  CRISPR gRNA sequence
ccactccaggtacatgaaat

SEQ ID NO: 321534 - DNA, 20 bp, Artificial
  CRISPR gRNA sequence
caggtacatgaaattaacta

SEQ ID NO: 321535 - DNA, 20 bp, Artificial
  CRISPR gRNA sequence
actagaggtgttgttcaaga

SEQ ID NO: 321536 - DNA, 20 bp, Artificial
  CRISPR gRNA sequence
gaggtgttgttcaagagaaa

SEQ ID NO: 321537 - DNA, 20 bp, Artificial
  CRISPR gRNA sequence
ttcaagagaaatgagaaagc

SEQ ID NO: 321538 - DNA, 20 bp, Artificial
  CRISPR gRNA sequence
aagagaaatgagaaagccct

SEQ ID NO: 321539 - DNA, 20 bp, Artificial
  CRISPR gRNA sequence
ggacccagagaaccctcaga

SEQ ID NO: 321540 - DNA, 20 bp, Artificial
  CRISPR gRNA sequence
agacaaaaagagagcagcta

SEQ ID NO: 321541 - DNA, 20 bp, Artificial
  CRISPR gRNA sequence
ccaaaactcaaactggaaag

SEQ ID NO: 321542 - DNA, 20 bp, Artificial
  CRISPR gRNA sequence
aaactggaaagatacttcct

SEQ ID NO: 321543 - DNA, 20 bp, Artificial
  CRISPR gRNA sequence
gaaagatacttcctcctgat

SEQ ID NO: 321544 - DNA, 20 bp, Artificial
  CRISPR gRNA sequence
cctcctgatgtgggagctac

SEQ ID NO: 321545 - DNA, 20 bp, Artificial
  CRISPR gRNA sequence
ctcctgatgtgggagctact

SEQ ID NO: 321546 - DNA, 20 bp, Artificial
  CRISPR gRNA sequence
ctgatgtgggagctactgat

SEQ ID NO: 321547 - DNA, 20 bp, Artificial
  CRISPR gRNA sequence
atgtgggagctactgatttt

SEQ ID NO: 321548 - DNA, 20 bp, Artificial
  CRISPR gRNA sequence
ctgatttttcaaaaacctct

SEQ ID NO: 321549 - DNA, 20 bp, Artificial
  CRISPR gRNA sequence
atttttcaaaaacctctctg

SEQ ID NO: 321550 - DNA, 20 bp, Artificial
  CRISPR gRNA sequence
ttcaaaaacctctctggctc

SEQ ID NO: 321551 - DNA, 20 bp, Artificial
  CRISPR gRNA sequence
tcaaaaacctctctggctcc

SEQ ID NO: 321552 - DNA, 20 bp, Artificial
  CRISPR gRNA sequence
caaaaacctctctggctcca

SEQ ID NO: 321553 - DNA, 20 bp, Artificial
  CRISPR gRNA sequence
aaaaacctctctggctccag

SEQ ID NO: 321554 - DNA, 20 bp, Artificial
  CRISPR gRNA sequence
tctggctccagcctaaaagt

SEQ ID NO: 321555 - DNA, 20 bp, Artificial
  CRISPR gRNA sequence
tggctccagcctaaaagtgt

SEQ ID NO: 321556 - DNA, 20 bp, Artificial
  CRISPR gRNA sequence
gctccagcctaaaagtgtga

SEQ ID NO: 321557 - DNA, 20 bp, Artificial
  CRISPR gRNA sequence
cagcctaaaagtgtgatgga

SEQ ID NO: 321558 - DNA, 20 bp, Artificial
  CRISPR gRNA sequence
aaagtgtgatggaggtgcca

SEQ ID NO: 321559 - DNA, 20 bp, Artificial
  CRISPR gRNA sequence
gaaagttagaagtgcctctg

SEQ ID NO: 321560 - DNA, 20 bp, Artificial
  CRISPR gRNA sequence
aaagttagaagtgcctctgc

SEQ ID NO: 321561 - DNA, 20 bp, Artificial
  CRISPR gRNA sequence
gaagtgcctctgcaggtggc

SEQ ID NO: 321562 - DNA, 20 bp, Artificial
  CRISPR gRNA sequence
tgcaggtggcactaggaatt

SEQ ID NO: 321563 - DNA, 20 bp, Artificial
  CRISPR gRNA sequence
caggtggcactaggaattcc

SEQ ID NO: 321564 - DNA, 20 bp, Artificial
  CRISPR gRNA sequence
ggaattcctttcgctttgta

SEQ ID NO: 321565 - DNA, 20 bp, Artificial
  CRISPR gRNA sequence
ctttcgctttgtaaatacaa

SEQ ID NO: 321566 - DNA, 20 bp, Artificial
  CRISPR gRNA sequence
tcgctttgtaaatacaaggc

SEQ ID NO: 321567 - DNA, 20 bp, Artificial
  CRISPR gRNA sequence
cgctttgtaaatacaaggca

SEQ ID NO: 321568 - DNA, 20 bp, Artificial
  CRISPR gRNA sequence
gctttgtaaatacaaggcac

SEQ ID NO: 321569 - DNA, 20 bp, Artificial
  CRISPR gRNA sequence
tgtaaatacaaggcacaaac

SEQ ID NO: 321570 - DNA, 20 bp, Artificial
  CRISPR gRNA sequence
gtaaatacaaggcacaaact

SEQ ID NO: 321571 - DNA, 20 bp, Artificial
  CRISPR gRNA sequence
taaatacaaggcacaaactg

SEQ ID NO: 321572 - DNA, 20 bp, Artificial
  CRISPR gRNA sequence
taacctaattctgcaaggcc

SEQ ID NO: 321573 - DNA, 20 bp, Artificial
  CRISPR gRNA sequence
attctgcaaggccacaggtg

SEQ ID NO: 321574 - DNA, 20 bp, Artificial
  CRISPR gRNA sequence
tgcaaggccacaggtgcccg

SEQ ID NO: 321575 - DNA, 20 bp, Artificial
  CRISPR gRNA sequence
caaggccacaggtgcccgtt

SEQ ID NO: 321576 - DNA, 20 bp, Artificial
  CRISPR gRNA sequence
cagtcttaaactcccatcca

SEQ ID NO: 321577 - DNA, 20 bp, Artificial
  CRISPR gRNA sequence
agtcttaaactcccatccaa

SEQ ID NO: 321578 - DNA, 20 bp, Artificial
  CRISPR gRNA sequence
aaactcccatccaattttat

SEQ ID NO: 321579 - DNA, 20 bp, Artificial
  CRISPR gRNA sequence
aactcccatccaattttatc

SEQ ID NO: 321580 - DNA, 20 bp, Artificial
  CRISPR gRNA sequence
ccatccaattttatcctcaa

SEQ ID NO: 321581 - DNA, 20 bp, Artificial
  CRISPR gRNA sequence
tatcctcaagagcaggggca

SEQ ID NO: 321582 - DNA, 20 bp, Artificial
  CRISPR gRNA sequence
atcctcaagagcaggggcag

SEQ ID NO: 321583 - DNA, 20 bp, Artificial
  CRISPR gRNA sequence
tcctcaagagcaggggcagc

SEQ ID NO: 321584 - DNA, 20 bp, Artificial
  CRISPR gRNA sequence
aagagcaggggcagcaaata

SEQ ID NO: 321585 - DNA, 20 bp, Artificial
  CRISPR gRNA sequence
ctgtgtcaaatttccatgac

SEQ ID NO: 321586 - DNA, 20 bp, Artificial
  CRISPR gRNA sequence
tgtcaaatttccatgacaga

SEQ ID NO: 321587 - DNA, 20 bp, Artificial
  CRISPR gRNA sequence
ccatgacagaggacacaaaa

SEQ ID NO: 321588 - DNA, 20 bp, Artificial
  CRISPR gRNA sequence
catgacagaggacacaaaat

SEQ ID NO: 321589 - DNA, 20 bp, Artificial
  CRISPR gRNA sequence
aacagaattgcttcactgta

SEQ ID NO: 321590 - DNA, 20 bp, Artificial
  CRISPR gRNA sequence
cttcactgtattgctatttc

SEQ ID NO: 321591 - DNA, 20 bp, Artificial
  CRISPR gRNA sequence
cactgtattgctatttctat

SEQ ID NO: 321592 - DNA, 20 bp, Artificial
  CRISPR gRNA sequence
actgtattgctatttctatg

SEQ ID NO: 321593 - DNA, 20 bp, Artificial
  CRISPR gRNA sequence
tattgctatttctatgccat

SEQ ID NO: 321594 - DNA, 20 bp, Artificial
  CRISPR gRNA sequence
ctatttctatgccatgaaat

SEQ ID NO: 321595 - DNA, 20 bp, Artificial
  CRISPR gRNA sequence
tttctatgccatgaaatgaa

SEQ ID NO: 321596 - DNA, 20 bp, Artificial
  CRISPR gRNA sequence
ctatgccatgaaatgaatta

SEQ ID NO: 321597 - DNA, 20 bp, Artificial
  CRISPR gRNA sequence
tatgccatgaaatgaattat

SEQ ID NO: 321598 - DNA, 20 bp, Artificial
  CRISPR gRNA sequence
tgccatgaaatgaattattc

SEQ ID NO: 321599 - DNA, 20 bp, Artificial
  CRISPR gRNA sequence
ttcagctctacattttgagg

SEQ ID NO: 321600 - DNA, 20 bp, Artificial
  CRISPR gRNA sequence
agctctacattttgagggtg

SEQ ID NO: 321601 - DNA, 20 bp, Artificial
  CRISPR gRNA sequence
tacattttgagggtggatta

SEQ ID NO: 321602 - DNA, 20 bp, Artificial
  CRISPR gRNA sequence
cattttgagggtggattatg

SEQ ID NO: 321603 - DNA, 20 bp, Artificial
  CRISPR gRNA sequence
tgagggtggattatgtgggc

SEQ ID NO: 321604 - DNA, 20 bp, Artificial
  CRISPR gRNA sequence
gagggtggattatgtgggcc

SEQ ID NO: 321605 - DNA, 20 bp, Artificial
  CRISPR gRNA sequence
agggtggattatgtgggcca

SEQ ID NO: 321606 - DNA, 20 bp, Artificial
  CRISPR gRNA sequence
tgtgggccaattgcatctcc

SEQ ID NO: 321607 - DNA, 20 bp, Artificial
  CRISPR gRNA sequence
catctcctttctccctttgg

SEQ ID NO: 321608 - DNA, 20 bp, Artificial
  CRISPR gRNA sequence
ctttctccctttggaagccg

SEQ ID NO: 321609 - DNA, 20 bp, Artificial
  CRISPR gRNA sequence
tctccctttggaagccggcc

SEQ ID NO: 321610 - DNA, 20 bp, Artificial
  CRISPR gRNA sequence
ctccctttggaagccggccc

SEQ ID NO: 321611 - DNA, 20 bp, Artificial
  CRISPR gRNA sequence
tccctttggaagccggccct

SEQ ID NO: 321612 - DNA, 20 bp, Artificial
  CRISPR gRNA sequence
cctttggaagccggccctgt

SEQ ID NO: 321613 - DNA, 20 bp, Artificial
  CRISPR gRNA sequence
tggaagccggccctgtggct

SEQ ID NO: 321614 - DNA, 20 bp, Artificial
  CRISPR gRNA sequence
ggaagccggccctgtggcta

SEQ ID NO: 321615 - DNA, 20 bp, Artificial
  CRISPR gRNA sequence
gaagccggccctgtggctag

SEQ ID NO: 321616 - DNA, 20 bp, Artificial
  CRISPR gRNA sequence
tggctaggtcactgttcacc

SEQ ID NO: 321617 - DNA, 20 bp, Artificial
  CRISPR gRNA sequence
ggtcactgttcaccagccca

SEQ ID NO: 321618 - DNA, 20 bp, Artificial
  CRISPR gRNA sequence
ttcaccagcccagtaagcag

SEQ ID NO: 321619 - DNA, 20 bp, Artificial
  CRISPR gRNA sequence
accagcccagtaagcagagg

SEQ ID NO: 321620 - DNA, 20 bp, Artificial
  CRISPR gRNA sequence
agaagaaagaattcaaatag

SEQ ID NO: 321621 - DNA, 20 bp, Artificial
  CRISPR gRNA sequence
aaatagaatctgattttttg

SEQ ID NO: 321622 - DNA, 20 bp, Artificial
  CRISPR gRNA sequence
attttttgttgcttttcatc

SEQ ID NO: 321623 - DNA, 20 bp, Artificial
  CRISPR gRNA sequence
tttgttgcttttcatcgtgt

SEQ ID NO: 321624 - DNA, 20 bp, Artificial
  CRISPR gRNA sequence
ttgttgcttttcatcgtgtg

SEQ ID NO: 321625 - DNA, 20 bp, Artificial
  CRISPR gRNA sequence
tgttgcttttcatcgtgtgt

SEQ ID NO: 321626 - DNA, 20 bp, Artificial
  CRISPR gRNA sequence
gttgcttttcatcgtgtgtg

SEQ ID NO: 321627 - DNA, 20 bp, Artificial
  CRISPR gRNA sequence
ttgcttttcatcgtgtgtga

SEQ ID NO: 321628 - DNA, 20 bp, Artificial
  CRISPR gRNA sequence
cttttcatcgtgtgtgaatt

SEQ ID NO: 321629 - DNA, 20 bp, Artificial
  CRISPR gRNA sequence
ttcatcgtgtgtgaattact

SEQ ID NO: 321630 - DNA, 20 bp, Artificial
  CRISPR gRNA sequence
tcatcgtgtgtgaattactg

SEQ ID NO: 321631 - DNA, 20 bp, Artificial
  CRISPR gRNA sequence
catcgtgtgtgaattactgg

SEQ ID NO: 321632 - DNA, 20 bp, Artificial
  CRISPR gRNA sequence
atcgtgtgtgaattactggc

SEQ ID NO: 321633 - DNA, 20 bp, Artificial
  CRISPR gRNA sequence
ctggcaatgttattttctga

SEQ ID NO: 321634 - DNA, 20 bp, Artificial
  CRISPR gRNA sequence
gcaatgttattttctgatct

SEQ ID NO: 321635 - DNA, 20 bp, Artificial
  CRISPR gRNA sequence
ttttctgatctgatgtcatg

SEQ ID NO: 321636 - DNA, 20 bp, Artificial
  CRISPR gRNA sequence
tctgatctgatgtcatgggc

SEQ ID NO: 321637 - DNA, 20 bp, Artificial
  CRISPR gRNA sequence
ctgatctgatgtcatgggct

SEQ ID NO: 321638 - DNA, 20 bp, Artificial
  CRISPR gRNA sequence
tgatctgatgtcatgggctt

SEQ ID NO: 321639 - DNA, 20 bp, Artificial
  CRISPR gRNA sequence
atctgatgtcatgggctttc

SEQ ID NO: 321640 - DNA, 20 bp, Artificial
  CRISPR gRNA sequence
atgtcatgggctttctattc

SEQ ID NO: 321641 - DNA, 20 bp, Artificial
  CRISPR gRNA sequence
tctattccactttaaaattg

SEQ ID NO: 321642 - DNA, 20 bp, Artificial
  CRISPR gRNA sequence
ctattccactttaaaattgt

SEQ ID NO: 321643 - DNA, 20 bp, Artificial
  CRISPR gRNA sequence
tattccactttaaaattgta

SEQ ID NO: 321644 - DNA, 20 bp, Artificial
  CRISPR gRNA sequence
ttccactttaaaattgtact

SEQ ID NO: 321645 - DNA, 20 bp, Artificial
  CRISPR gRNA sequence
cactttaaaattgtactgcc

SEQ ID NO: 321646 - DNA, 20 bp, Artificial
  CRISPR gRNA sequence
taaaattgtactgccaaaaa

SEQ ID NO: 321647 - DNA, 20 bp, Artificial
  CRISPR gRNA sequence
aaaattgtactgccaaaaat

SEQ ID NO: 321648 - DNA, 20 bp, Artificial
  CRISPR gRNA sequence
aaattgtactgccaaaaata

SEQ ID NO: 321649 - DNA, 20 bp, Artificial
  CRISPR gRNA sequence
tactgccaaaaatatagtca

SEQ ID NO: 321650 - DNA, 20 bp, Artificial
  CRISPR gRNA sequence
ccaaaaatatagtcacttat

SEQ ID NO: 321651 - DNA, 20 bp, Artificial
  CRISPR gRNA sequence
attctctcaccaccataaaa

SEQ ID NO: 321652 - DNA, 20 bp, Artificial
  CRISPR gRNA sequence
ttctctcaccaccataaaac

SEQ ID NO: 321653 - DNA, 20 bp, Artificial
  CRISPR gRNA sequence
tctcaccaccataaaactta

SEQ ID NO: 321654 - DNA, 20 bp, Artificial
  CRISPR gRNA sequence
tcaccaccataaaacttaaa

SEQ ID NO: 321655 - DNA, 20 bp, Artificial
  CRISPR gRNA sequence
accaccataaaacttaaacg

SEQ ID NO: 321656 - DNA, 20 bp, Artificial
  CRISPR gRNA sequence
aaacggttaccatttgaggt

SEQ ID NO: 321657 - DNA, 20 bp, Artificial
  CRISPR gRNA sequence
aacggttaccatttgaggtt

SEQ ID NO: 321658 - DNA, 20 bp, Artificial
  CRISPR gRNA sequence
ccatttgaggttgttgcttt

SEQ ID NO: 321659 - DNA, 20 bp, Artificial
  CRISPR gRNA sequence
gaggttgttgctttcaatat

SEQ ID NO: 321660 - DNA, 20 bp, Artificial
  CRISPR gRNA sequence
aggttgttgctttcaatatt

SEQ ID NO: 321661 - DNA, 20 bp, Artificial
  CRISPR gRNA sequence
ttgctttcaatattggtaac

SEQ ID NO: 321662 - DNA, 20 bp, Artificial
  CRISPR gRNA sequence
ctttcaatattggtaactct

SEQ ID NO: 321663 - DNA, 20 bp, Artificial
  CRISPR gRNA sequence
tcaatattggtaactctttt

SEQ ID NO: 321664 - DNA, 20 bp, Artificial
  CRISPR gRNA sequence
caatattggtaactcttttc

SEQ ID NO: 321665 - DNA, 20 bp, Artificial
  CRISPR gRNA sequence
aatattggtaactcttttct

SEQ ID NO: 321666 - DNA, 20 bp, Artificial
  CRISPR gRNA sequence
gtaactcttttctcaggagc

SEQ ID NO: 321667 - DNA, 20 bp, Artificial
  CRISPR gRNA sequence
ttttctcaggagctaagaaa

SEQ ID NO: 321668 - DNA, 20 bp, Artificial
  CRISPR gRNA sequence
ttctcaggagctaagaaact

SEQ ID NO: 321669 - DNA, 20 bp, Artificial
  CRISPR gRNA sequence
tctcaggagctaagaaactt

SEQ ID NO: 321670 - DNA, 20 bp, Artificial
  CRISPR gRNA sequence
ctcaggagctaagaaacttc

SEQ ID NO: 321671 - DNA, 20 bp, Artificial
  CRISPR gRNA sequence
tcaggagctaagaaacttct

SEQ ID NO: 321672 - DNA, 20 bp, Artificial
  CRISPR gRNA sequence
aggagctaagaaacttctaa

SEQ ID NO: 321673 - DNA, 20 bp, Artificial
  CRISPR gRNA sequence
agaaacttctaagaagtgtc

SEQ ID NO: 321674 - DNA, 20 bp, Artificial
  CRISPR gRNA sequence
ctaagaagtgtcaatggcaa

SEQ ID NO: 321675 - DNA, 20 bp, Artificial
  CRISPR gRNA sequence
taagaagtgtcaatggcaaa

SEQ ID NO: 321676 - DNA, 20 bp, Artificial
  CRISPR gRNA sequence
agaagtgtcaatggcaaatc

SEQ ID NO: 321677 - DNA, 20 bp, Artificial
  CRISPR gRNA sequence
aactcagttttcatagagtg

SEQ ID NO: 321678 - DNA, 20 bp, Artificial
  CRISPR gRNA sequence
agttttcatagagtgtctcg

SEQ ID NO: 321679 - DNA, 20 bp, Artificial
  CRISPR gRNA sequence
tcatagagtgtctcggcttt

SEQ ID NO: 321680 - DNA, 20 bp, Artificial
  CRISPR gRNA sequence
catagagtgtctcggcttta

SEQ ID NO: 321681 - DNA, 20 bp, Artificial
  CRISPR gRNA sequence
atagagtgtctcggctttac

SEQ ID NO: 321682 - DNA, 20 bp, Artificial
  CRISPR gRNA sequence
ggctttactttctcactttc

SEQ ID NO: 321683 - DNA, 20 bp, Artificial
  CRISPR gRNA sequence
tactttctcactttcagtgt

SEQ ID NO: 321684 - DNA, 20 bp, Artificial
  CRISPR gRNA sequence
actttctcactttcagtgtg

SEQ ID NO: 321685 - DNA, 20 bp, Artificial
  CRISPR gRNA sequence
ctttctcactttcagtgtgc

SEQ ID NO: 321686 - DNA, 20 bp, Artificial
  CRISPR gRNA sequence
tctcactttcagtgtgcgga

SEQ ID NO: 321687 - DNA, 20 bp, Artificial
  CRISPR gRNA sequence
ctcactttcagtgtgcggag

SEQ ID NO: 321688 - DNA, 20 bp, Artificial
  CRISPR gRNA sequence
tcactttcagtgtgcggagt

SEQ ID NO: 321689 - DNA, 20 bp, Artificial
  CRISPR gRNA sequence
actttcagtgtgcggagtca

SEQ ID NO: 321690 - DNA, 20 bp, Artificial
  CRISPR gRNA sequence
tcagtgtgcggagtcagaaa

SEQ ID NO: 321691 - DNA, 20 bp, Artificial
  CRISPR gRNA sequence
cagtgtgcggagtcagaaaa

SEQ ID NO: 321692 - DNA, 20 bp, Artificial
  CRISPR gRNA sequence
agtgtgcggagtcagaaaat

SEQ ID NO: 321693 - DNA, 20 bp, Artificial
  CRISPR gRNA sequence
ggtgggaaatggtgttccag

SEQ ID NO: 321694 - DNA, 20 bp, Artificial
  CRISPR gRNA sequence
gtgggaaatggtgttccagt

SEQ ID NO: 321695 - DNA, 20 bp, Artificial
  CRISPR gRNA sequence
cagtttagtgttttctggaa

SEQ ID NO: 321696 - DNA, 20 bp, Artificial
  CRISPR gRNA sequence
agtgttttctggaaatgtgt

SEQ ID NO: 321697 - DNA, 20 bp, Artificial
  CRISPR gRNA sequence
gtgttttctggaaatgtgtt

SEQ ID NO: 321698 - DNA, 20 bp, Artificial
  CRISPR gRNA sequence
tctggaaatgtgtttccagg

SEQ ID NO: 321699 - DNA, 20 bp, Artificial
  CRISPR gRNA sequence
ctggaaatgtgtttccaggg

SEQ ID NO: 321700 - DNA, 20 bp, Artificial
  CRISPR gRNA sequence
tggaaatgtgtttccagggc

SEQ ID NO: 321701 - DNA, 20 bp, Artificial
  CRISPR gRNA sequence
gaaatgtgtttccagggcat

SEQ ID NO: 321702 - DNA, 20 bp, Artificial
  CRISPR gRNA sequence
ccagggcatttttcttcctt

SEQ ID NO: 321703 - DNA, 20 bp, Artificial
  CRISPR gRNA sequence
cagggcatttttcttccttc

SEQ ID NO: 321704 - DNA, 20 bp, Artificial
  CRISPR gRNA sequence
ttcttccttctctcccagat

SEQ ID NO: 321705 - DNA, 20 bp, Artificial
  CRISPR gRNA sequence
tcttccttctctcccagatc

SEQ ID NO: 321706 - DNA, 20 bp, Artificial
  CRISPR gRNA sequence
cttccttctctcccagatct

SEQ ID NO: 321707 - DNA, 20 bp, Artificial
  CRISPR gRNA sequence
ttccttctctcccagatctt

SEQ ID NO: 321708 - DNA, 20 bp, Artificial
  CRISPR gRNA sequence
ccttctctcccagatcttga

SEQ ID NO: 321709 - DNA, 20 bp, Artificial
  CRISPR gRNA sequence
cttctctcccagatcttgag

SEQ ID NO: 321710 - DNA, 20 bp, Artificial
  CRISPR gRNA sequence
ctctcccagatcttgagagc

SEQ ID NO: 321711 - DNA, 20 bp, Artificial
  CRISPR gRNA sequence
tctcccagatcttgagagct

SEQ ID NO: 321712 - DNA, 20 bp, Artificial
  CRISPR gRNA sequence
tcccagatcttgagagctgg

SEQ ID NO: 321713 - DNA, 20 bp, Artificial
  CRISPR gRNA sequence
ccagatcttgagagctgggc

SEQ ID NO: 321714 - DNA, 20 bp, Artificial
  CRISPR gRNA sequence
gagagctgggctggtcactt

SEQ ID NO: 321715 - DNA, 20 bp, Artificial
  CRISPR gRNA sequence
agagctgggctggtcacttt

SEQ ID NO: 321716 - DNA, 20 bp, Artificial
  CRISPR gRNA sequence
ggctggtcactttgatgaga

SEQ ID NO: 321717 - DNA, 20 bp, Artificial
  CRISPR gRNA sequence
gtcactttgatgagaagggc

SEQ ID NO: 321718 - DNA, 20 bp, Artificial
  CRISPR gRNA sequence
tgatgagaagggcttgggcc

SEQ ID NO: 321719 - DNA, 20 bp, Artificial
  CRISPR gRNA sequence
gatgagaagggcttgggccc

SEQ ID NO: 321720 - DNA, 20 bp, Artificial
  CRISPR gRNA sequence
atgagaagggcttgggccca

SEQ ID NO: 321721 - DNA, 20 bp, Artificial
  CRISPR gRNA sequence
gggcccaagctcttgggtca

SEQ ID NO: 321722 - DNA, 20 bp, Artificial
  CRISPR gRNA sequence
ggcccaagctcttgggtcaa

SEQ ID NO: 321723 - DNA, 20 bp, Artificial
  CRISPR gRNA sequence
ttgggtcaactgaggtgtca

SEQ ID NO: 321724 - DNA, 20 bp, Artificial
  CRISPR gRNA sequence
gggtcaactgaggtgtcagc

SEQ ID NO: 321725 - DNA, 20 bp, Artificial
  CRISPR gRNA sequence
ggtcaactgaggtgtcagct

SEQ ID NO: 321726 - DNA, 20 bp, Artificial
  CRISPR gRNA sequence
aggtgtcagctgcaggtgat

SEQ ID NO: 321727 - DNA, 20 bp, Artificial
  CRISPR gRNA sequence
caggtgatggggaggaggca

SEQ ID NO: 321728 - DNA, 20 bp, Artificial
  CRISPR gRNA sequence
gatgaacacggatgaggcag

SEQ ID NO: 321729 - DNA, 20 bp, Artificial
  CRISPR gRNA sequence
tattatccaccaaagctgtt

SEQ ID NO: 321730 - DNA, 20 bp, Artificial
  CRISPR gRNA sequence
tccaccaaagctgttcaggc

SEQ ID NO: 321731 - DNA, 20 bp, Artificial
  CRISPR gRNA sequence
ttcaggccccatggaagaag

SEQ ID NO: 321732 - DNA, 20 bp, Artificial
  CRISPR gRNA sequence
aggccccatggaagaagtct

SEQ ID NO: 321733 - DNA, 20 bp, Artificial
  CRISPR gRNA sequence
accacttattcatggtttac

SEQ ID NO: 321734 - DNA, 20 bp, Artificial
  CRISPR gRNA sequence
ccacttattcatggtttacc

SEQ ID NO: 321735 - DNA, 20 bp, Artificial
  CRISPR gRNA sequence
attcatggtttaccacaaga

SEQ ID NO: 321736 - DNA, 20 bp, Artificial
  CRISPR gRNA sequence
ttcatggtttaccacaagag

SEQ ID NO: 321737 - DNA, 20 bp, Artificial
  CRISPR gRNA sequence
atggtttaccacaagagtta

SEQ ID NO: 321738 - DNA, 20 bp, Artificial
  CRISPR gRNA sequence
accacaagagttaggagaag

SEQ ID NO: 321739 - DNA, 20 bp, Artificial
  CRISPR gRNA sequence
ccacaagagttaggagaaga

SEQ ID NO: 321740 - DNA, 20 bp, Artificial
  CRISPR gRNA sequence
ggagaagagtcaagtgaacg

SEQ ID NO: 321741 - DNA, 20 bp, Artificial
  CRISPR gRNA sequence
aatctacattgctgggtgtg

SEQ ID NO: 321742 - DNA, 20 bp, Artificial
  CRISPR gRNA sequence
cattgctgggtgtgaatcca

SEQ ID NO: 321743 - DNA, 20 bp, Artificial
  CRISPR gRNA sequence
ctgggtgtgaatccaagctc

SEQ ID NO: 321744 - DNA, 20 bp, Artificial
  CRISPR gRNA sequence
ggtgtgaatccaagctctgc

SEQ ID NO: 321745 - DNA, 20 bp, Artificial
  CRISPR gRNA sequence
tgccacttagtagctctgtc

SEQ ID NO: 321746 - DNA, 20 bp, Artificial
  CRISPR gRNA sequence
ccacttagtagctctgtcga

SEQ ID NO: 321747 - DNA, 20 bp, Artificial
  CRISPR gRNA sequence
agtagctctgtcgatcttgg

SEQ ID NO: 321748 - DNA, 20 bp, Artificial
  CRISPR gRNA sequence
gtagctctgtcgatcttggg

SEQ ID NO: 321749 - DNA, 20 bp, Artificial
  CRISPR gRNA sequence
tgtcgatcttgggtaaatta

SEQ ID NO: 321750 - DNA, 20 bp, Artificial
  CRISPR gRNA sequence
tcgatcttgggtaaattact

SEQ ID NO: 321751 - DNA, 20 bp, Artificial
  CRISPR gRNA sequence
gggtaaattacttcatctct

SEQ ID NO: 321752 - DNA, 20 bp, Artificial
  CRISPR gRNA sequence
ggtaaattacttcatctctc

SEQ ID NO: 321753 - DNA, 20 bp, Artificial
  CRISPR gRNA sequence
cttcatctctctgggcttta

SEQ ID NO: 321754 - DNA, 20 bp, Artificial
  CRISPR gRNA sequence
catctctctgggctttagtg

SEQ ID NO: 321755 - DNA, 20 bp, Artificial
  CRISPR gRNA sequence
atctctctgggctttagtgt

SEQ ID NO: 321756 - DNA, 20 bp, Artificial
  CRISPR gRNA sequence
tctgggctttagtgtccaca

SEQ ID NO: 321757 - DNA, 20 bp, Artificial
  CRISPR gRNA sequence
tgggctttagtgtccacatc

SEQ ID NO: 321758 - DNA, 20 bp, Artificial
  CRISPR gRNA sequence
ggctttagtgtccacatctt

SEQ ID NO: 321759 - DNA, 20 bp, Artificial
  CRISPR gRNA sequence
tagtgtccacatcttaaaat

SEQ ID NO: 321760 - DNA, 20 bp, Artificial
  CRISPR gRNA sequence
agtgtccacatcttaaaatg

SEQ ID NO: 321761 - DNA, 20 bp, Artificial
  CRISPR gRNA sequence
gtgtccacatcttaaaatgg

SEQ ID NO: 321762 - DNA, 20 bp, Artificial
  CRISPR gRNA sequence
aaaatgggaaataacaacaa

SEQ ID NO: 321763 - DNA, 20 bp, Artificial
  CRISPR gRNA sequence
aaatgggaaataacaacaag

SEQ ID NO: 321764 - DNA, 20 bp, Artificial
  CRISPR gRNA sequence
aagcagagagttattgtgag

SEQ ID NO: 321765 - DNA, 20 bp, Artificial
  CRISPR gRNA sequence
ttgtgaggctcaaatgagtt

SEQ ID NO: 321766 - DNA, 20 bp, Artificial
  CRISPR gRNA sequence
tgaggctcaaatgagttaat

SEQ ID NO: 321767 - DNA, 20 bp, Artificial
  CRISPR gRNA sequence
aaatgagttaatatttatga

SEQ ID NO: 321768 - DNA, 20 bp, Artificial
  CRISPR gRNA sequence
atatttatgaggtacttaga

SEQ ID NO: 321769 - DNA, 20 bp, Artificial
  CRISPR gRNA sequence
atgaggtacttagaacagta

SEQ ID NO: 321770 - DNA, 20 bp, Artificial
  CRISPR gRNA sequence
tgaggtacttagaacagtac

SEQ ID NO: 321771 - DNA, 20 bp, Artificial
  CRISPR gRNA sequence
agaacagtaccaggcacaaa

SEQ ID NO: 321772 - DNA, 20 bp, Artificial
  CRISPR gRNA sequence
gaacagtaccaggcacaaag

SEQ ID NO: 321773 - DNA, 20 bp, Artificial
  CRISPR gRNA sequence
tcatgtattgcacagccaca

SEQ ID NO: 321774 - DNA, 20 bp, Artificial
  CRISPR gRNA sequence
cacagccacatttcagtcat

SEQ ID NO: 321775 - DNA, 20 bp, Artificial
  CRISPR gRNA sequence
cagtcatatacaatggtggt

SEQ ID NO: 321776 - DNA, 20 bp, Artificial
  CRISPR gRNA sequence
agtcatatacaatggtggtc

SEQ ID NO: 321777 - DNA, 20 bp, Artificial
  CRISPR gRNA sequence
taacaccatatttttactgt

SEQ ID NO: 321778 - DNA, 20 bp, Artificial
  CRISPR gRNA sequence
ttactgtatcttttctatgc

SEQ ID NO: 321779 - DNA, 20 bp, Artificial
  CRISPR gRNA sequence
tactgtatcttttctatgct

SEQ ID NO: 321780 - DNA, 20 bp, Artificial
  CRISPR gRNA sequence
actgtatcttttctatgctt

SEQ ID NO: 321781 - DNA, 20 bp, Artificial
  CRISPR gRNA sequence
ctgtatcttttctatgctta

SEQ ID NO: 321782 - DNA, 20 bp, Artificial
  CRISPR gRNA sequence
tatcttttctatgcttagat

SEQ ID NO: 321783 - DNA, 20 bp, Artificial
  CRISPR gRNA sequence
ttctatgcttagatatgttc

SEQ ID NO: 321784 - DNA, 20 bp, Artificial
  CRISPR gRNA sequence
tctatgcttagatatgttca

SEQ ID NO: 321785 - DNA, 20 bp, Artificial
  CRISPR gRNA sequence
ctatgcttagatatgttcag

SEQ ID NO: 321786 - DNA, 20 bp, Artificial
  CRISPR gRNA sequence
tatgcttagatatgttcaga

SEQ ID NO: 321787 - DNA, 20 bp, Artificial
  CRISPR gRNA sequence
tgcttagatatgttcagata

SEQ ID NO: 321788 - DNA, 20 bp, Artificial
  CRISPR gRNA sequence
agatatgttcagatacaaaa

SEQ ID NO: 321789 - DNA, 20 bp, Artificial
  CRISPR gRNA sequence
gatatgttcagatacaaaaa

SEQ ID NO: 321790 - DNA, 20 bp, Artificial
  CRISPR gRNA sequence
agatacaaaaatacatacca

SEQ ID NO: 321791 - DNA, 20 bp, Artificial
  CRISPR gRNA sequence
tgttacaacacctacagtat

SEQ ID NO: 321792 - DNA, 20 bp, Artificial
  CRISPR gRNA sequence
caacacctacagtattcagc

SEQ ID NO: 321793 - DNA, 20 bp, Artificial
  CRISPR gRNA sequence
cagtattcagcacagtaaca

SEQ ID NO: 321794 - DNA, 20 bp, Artificial
  CRISPR gRNA sequence
agcacagtaacatgctgtgc

SEQ ID NO: 321795 - DNA, 20 bp, Artificial
  CRISPR gRNA sequence
tgcaggcttgtagcctagga

SEQ ID NO: 321796 - DNA, 20 bp, Artificial
  CRISPR gRNA sequence
gtagcctaggagcaataggc

SEQ ID NO: 321797 - DNA, 20 bp, Artificial
  CRISPR gRNA sequence
tagcctaggagcaataggct

SEQ ID NO: 321798 - DNA, 20 bp, Artificial
  CRISPR gRNA sequence
ggagcaataggctgtgccag

SEQ ID NO: 321799 - DNA, 20 bp, Artificial
  CRISPR gRNA sequence
tgccaggtagcctaagtatg

SEQ ID NO: 321800 - DNA, 20 bp, Artificial
  CRISPR gRNA sequence
agtatggagcaggctatgct

SEQ ID NO: 321801 - DNA, 20 bp, Artificial
  CRISPR gRNA sequence
tgctatctagttttgtgtaa

SEQ ID NO: 321802 - DNA, 20 bp, Artificial
  CRISPR gRNA sequence
tctagttttgtgtaaggaca

SEQ ID NO: 321803 - DNA, 20 bp, Artificial
  CRISPR gRNA sequence
gttttgtgtaaggacaccct

SEQ ID NO: 321804 - DNA, 20 bp, Artificial
  CRISPR gRNA sequence
tgtgtaaggacaccctatga

SEQ ID NO: 321805 - DNA, 20 bp, Artificial
  CRISPR gRNA sequence
gtgtaaggacaccctatgat

SEQ ID NO: 321806 - DNA, 20 bp, Artificial
  CRISPR gRNA sequence
tgtaaggacaccctatgatg

SEQ ID NO: 321807 - DNA, 20 bp, Artificial
  CRISPR gRNA sequence
tgatgattatacaatgacaa

SEQ ID NO: 321808 - DNA, 20 bp, Artificial
  CRISPR gRNA sequence
tacaatgacaaaatcgccta

SEQ ID NO: 321809 - DNA, 20 bp, Artificial
  CRISPR gRNA sequence
ataatgtgtttctcagaacg

SEQ ID NO: 321810 - DNA, 20 bp, Artificial
  CRISPR gRNA sequence
ctcagaacgtacccctgttg

SEQ ID NO: 321811 - DNA, 20 bp, Artificial
  CRISPR gRNA sequence
tcagaacgtacccctgttgt

SEQ ID NO: 321812 - DNA, 20 bp, Artificial
  CRISPR gRNA sequence
agaacgtacccctgttgtta

SEQ ID NO: 321813 - DNA, 20 bp, Artificial
  CRISPR gRNA sequence
ttgttaaacgattcatgact

SEQ ID NO: 321814 - DNA, 20 bp, Artificial
  CRISPR gRNA sequence
ttaaacgattcatgactgtg

SEQ ID NO: 321815 - DNA, 20 bp, Artificial
  CRISPR gRNA sequence
aacgattcatgactgtgtgt

SEQ ID NO: 321816 - DNA, 20 bp, Artificial
  CRISPR gRNA sequence
atgactgtgtgtatatatgc

SEQ ID NO: 321817 - DNA, 20 bp, Artificial
  CRISPR gRNA sequence
tgtgtatatatgcatttatc

SEQ ID NO: 321818 - DNA, 20 bp, Artificial
  CRISPR gRNA sequence
atcaaataaataaaataagt

SEQ ID NO: 321819 - DNA, 20 bp, Artificial
  CRISPR gRNA sequence
tcaaataaataaaataagtc

SEQ ID NO: 321820 - DNA, 20 bp, Artificial
  CRISPR gRNA sequence
atgcatataattctagcact

SEQ ID NO: 321821 - DNA, 20 bp, Artificial
  CRISPR gRNA sequence
tagcacttggggaggctgag

SEQ ID NO: 321822 - DNA, 20 bp, Artificial
  CRISPR gRNA sequence
gcacttggggaggctgaggt

SEQ ID NO: 321823 - DNA, 20 bp, Artificial
  CRISPR gRNA sequence
ggggaggctgaggtgggaga

SEQ ID NO: 321824 - DNA, 20 bp, Artificial
  CRISPR gRNA sequence
gggaggctgaggtgggagaa

SEQ ID NO: 321825 - DNA, 20 bp, Artificial
  CRISPR gRNA sequence
aggtgggagaattgcttgag

SEQ ID NO: 321826 - DNA, 20 bp, Artificial
  CRISPR gRNA sequence
cttgagcccaggtaatcgag

SEQ ID NO: 321827 - DNA, 20 bp, Artificial
  CRISPR gRNA sequence
gagcccaggtaatcgaggcc

SEQ ID NO: 321828 - DNA, 20 bp, Artificial
  CRISPR gRNA sequence
agcccaggtaatcgaggcca

SEQ ID NO: 321829 - DNA, 20 bp, Artificial
  CRISPR gRNA sequence
tgactgtgccactgtactcc

SEQ ID NO: 321830 - DNA, 20 bp, Artificial
  CRISPR gRNA sequence
tgccactgtactccagcctg

SEQ ID NO: 321831 - DNA, 20 bp, Artificial
  CRISPR gRNA sequence
tactccagcctgggtgacag

SEQ ID NO: 321832 - DNA, 20 bp, Artificial
  CRISPR gRNA sequence
cagcctgggtgacagagaaa

SEQ ID NO: 321833 - DNA, 20 bp, Artificial
  CRISPR gRNA sequence
ggtgacagagaaagatgctg

SEQ ID NO: 321834 - DNA, 20 bp, Artificial
  CRISPR gRNA sequence
tctcaaaaaataaaataaat

SEQ ID NO: 321835 - DNA, 20 bp, Artificial
  CRISPR gRNA sequence
aaaaaataaaataaataaaa

SEQ ID NO: 321836 - DNA, 20 bp, Artificial
  CRISPR gRNA sequence
actggataatgttctctaga

SEQ ID NO: 321837 - DNA, 20 bp, Artificial
  CRISPR gRNA sequence
ctggataatgttctctagag

SEQ ID NO: 321838 - DNA, 20 bp, Artificial
  CRISPR gRNA sequence
gataatgttctctagagtct

SEQ ID NO: 321839 - DNA, 20 bp, Artificial
  CRISPR gRNA sequence
tctagagtcttcttgccttg

SEQ ID NO: 321840 - DNA, 20 bp, Artificial
  CRISPR gRNA sequence
tagagtcttcttgccttgct

SEQ ID NO: 321841 - DNA, 20 bp, Artificial
  CRISPR gRNA sequence
gagtcttcttgccttgctct

SEQ ID NO: 321842 - DNA, 20 bp, Artificial
  CRISPR gRNA sequence
cttgccttgctctctgacac

SEQ ID NO: 321843 - DNA, 20 bp, Artificial
  CRISPR gRNA sequence
ttgccttgctctctgacaca

SEQ ID NO: 321844 - DNA, 20 bp, Artificial
  CRISPR gRNA sequence
gccttgctctctgacacaca

SEQ ID NO: 321845 - DNA, 20 bp, Artificial
  CRISPR gRNA sequence
ccttgctctctgacacacac

SEQ ID NO: 321846 - DNA, 20 bp, Artificial
  CRISPR gRNA sequence
gctctctgacacacacatac

SEQ ID NO: 321847 - DNA, 20 bp, Artificial
  CRISPR gRNA sequence
ctctctgacacacacatacc

SEQ ID NO: 321848 - DNA, 20 bp, Artificial
  CRISPR gRNA sequence
tctgacacacacatacctcc

SEQ ID NO: 321849 - DNA, 20 bp, Artificial
  CRISPR gRNA sequence
tgacacacacatacctccca

SEQ ID NO: 321850 - DNA, 20 bp, Artificial
  CRISPR gRNA sequence
acacacacatacctcccaca

SEQ ID NO: 321851 - DNA, 20 bp, Artificial
  CRISPR gRNA sequence
ccacatccccaggagctaag

SEQ ID NO: 321852 - DNA, 20 bp, Artificial
  CRISPR gRNA sequence
aggtagcaggtcatgggccc

SEQ ID NO: 321853 - DNA, 20 bp, Artificial
  CRISPR gRNA sequence
ggggttggaagctgctgttg

SEQ ID NO: 321854 - DNA, 20 bp, Artificial
  CRISPR gRNA sequence
gaagctgctgttgttaccta

SEQ ID NO: 321855 - DNA, 20 bp, Artificial
  CRISPR gRNA sequence
ctgttgttacctaagtcagt

SEQ ID NO: 321856 - DNA, 20 bp, Artificial
  CRISPR gRNA sequence
ttgttacctaagtcagtgat

SEQ ID NO: 321857 - DNA, 20 bp, Artificial
  CRISPR gRNA sequence
ttacctaagtcagtgatcag

SEQ ID NO: 321858 - DNA, 20 bp, Artificial
  CRISPR gRNA sequence
cctaagtcagtgatcagctg

SEQ ID NO: 321859 - DNA, 20 bp, Artificial
  CRISPR gRNA sequence
agtcagtgatcagctggcac

SEQ ID NO: 321860 - DNA, 20 bp, Artificial
  CRISPR gRNA sequence
gcacatctacagaccttgca

SEQ ID NO: 321861 - DNA, 20 bp, Artificial
  CRISPR gRNA sequence
cagaccttgcactcaaggac

SEQ ID NO: 321862 - DNA, 20 bp, Artificial
  CRISPR gRNA sequence
gcactcaaggactccacaag

SEQ ID NO: 321863 - DNA, 20 bp, Artificial
  CRISPR gRNA sequence
cactcaaggactccacaagc

SEQ ID NO: 321864 - DNA, 20 bp, Artificial
  CRISPR gRNA sequence
aaggactccacaagctcaag

SEQ ID NO: 321865 - DNA, 20 bp, Artificial
  CRISPR gRNA sequence
cacaagctcaaggtgctaag

SEQ ID NO: 321866 - DNA, 20 bp, Artificial
  CRISPR gRNA sequence
aaggtgctaagcagaaaaac

SEQ ID NO: 321867 - DNA, 20 bp, Artificial
  CRISPR gRNA sequence
agcagaaaaacagaaatctg

SEQ ID NO: 321868 - DNA, 20 bp, Artificial
  CRISPR gRNA sequence
aaaaggcttatcccagccag

SEQ ID NO: 321869 - DNA, 20 bp, Artificial
  CRISPR gRNA sequence
atcccagccagcatggatct

SEQ ID NO: 321870 - DNA, 20 bp, Artificial
  CRISPR gRNA sequence
tcccagccagcatggatctg

SEQ ID NO: 321871 - DNA, 20 bp, Artificial
  CRISPR gRNA sequence
agggaccatctctttgtagt

SEQ ID NO: 321872 - DNA, 20 bp, Artificial
  CRISPR gRNA sequence
tttgtagttccctgactcct

SEQ ID NO: 321873 - DNA, 20 bp, Artificial
  CRISPR gRNA sequence
tgtagttccctgactcctca

SEQ ID NO: 321874 - DNA, 20 bp, Artificial
  CRISPR gRNA sequence
gtagttccctgactcctcat

SEQ ID NO: 321875 - DNA, 20 bp, Artificial
  CRISPR gRNA sequence
tagttccctgactcctcatc

SEQ ID NO: 321876 - DNA, 20 bp, Artificial
  CRISPR gRNA sequence
cctgactcctcatcatccac

SEQ ID NO: 321877 - DNA, 20 bp, Artificial
  CRISPR gRNA sequence
actcctcatcatccacagca

SEQ ID NO: 321878 - DNA, 20 bp, Artificial
  CRISPR gRNA sequence
ctcatcatccacagcagaca

SEQ ID NO: 321879 - DNA, 20 bp, Artificial
  CRISPR gRNA sequence
atcatccacagcagacatgg

SEQ ID NO: 321880 - DNA, 20 bp, Artificial
  CRISPR gRNA sequence
gtgtgtggccatctggagga

SEQ ID NO: 321881 - DNA, 20 bp, Artificial
  CRISPR gRNA sequence
gaggaggtgaactcatggct

SEQ ID NO: 321882 - DNA, 20 bp, Artificial
  CRISPR gRNA sequence
atggctggtggcctgtgggt

SEQ ID NO: 321883 - DNA, 20 bp, Artificial
  CRISPR gRNA sequence
gtggcctgtgggtgctgtag

SEQ ID NO: 321884 - DNA, 20 bp, Artificial
  CRISPR gRNA sequence
tgggtgctgtagccaaactt

SEQ ID NO: 321885 - DNA, 20 bp, Artificial
  CRISPR gRNA sequence
tagccaaacttcaggctcag

SEQ ID NO: 321886 - DNA, 20 bp, Artificial
  CRISPR gRNA sequence
caggctcagttcacctccct

SEQ ID NO: 321887 - DNA, 20 bp, Artificial
  CRISPR gRNA sequence
aggctcagttcacctccctg

SEQ ID NO: 321888 - DNA, 20 bp, Artificial
  CRISPR gRNA sequence
agttcacctccctgtcttag

SEQ ID NO: 321889 - DNA, 20 bp, Artificial
  CRISPR gRNA sequence
acctccctgtcttagtgggg

SEQ ID NO: 321890 - DNA, 20 bp, Artificial
  CRISPR gRNA sequence
cctgtcttagtggggtggct

SEQ ID NO: 321891 - DNA, 20 bp, Artificial
  CRISPR gRNA sequence
tcttagtggggtggcttccc

SEQ ID NO: 321892 - DNA, 20 bp, Artificial
  CRISPR gRNA sequence
agtggggtggcttccctctc

SEQ ID NO: 321893 - DNA, 20 bp, Artificial
  CRISPR gRNA sequence
gtggggtggcttccctctca

SEQ ID NO: 321894 - DNA, 20 bp, Artificial
  CRISPR gRNA sequence
ccctctcaggcctgcaggtg

SEQ ID NO: 321895 - DNA, 20 bp, Artificial
  CRISPR gRNA sequence
cctctcaggcctgcaggtgg

SEQ ID NO: 321896 - DNA, 20 bp, Artificial
  CRISPR gRNA sequence
tcaggcctgcaggtggagac

SEQ ID NO: 321897 - DNA, 20 bp, Artificial
  CRISPR gRNA sequence
aggcctgcaggtggagacaa

SEQ ID NO: 321898 - DNA, 20 bp, Artificial
  CRISPR gRNA sequence
caggtggagacaaggagcag

SEQ ID NO: 321899 - DNA, 20 bp, Artificial
  CRISPR gRNA sequence
cgagacactgagtcacagga

SEQ ID NO: 321900 - DNA, 20 bp, Artificial
  CRISPR gRNA sequence
agtcacaggatacatggcag

SEQ ID NO: 321901 - DNA, 20 bp, Artificial
  CRISPR gRNA sequence
ctgtttatagatgaagaaac

SEQ ID NO: 321902 - DNA, 20 bp, Artificial
  CRISPR gRNA sequence
tttatagatgaagaaactga

SEQ ID NO: 321903 - DNA, 20 bp, Artificial
  CRISPR gRNA sequence
atagatgaagaaactgaaac

SEQ ID NO: 321904 - DNA, 20 bp, Artificial
  CRISPR gRNA sequence
tagatgaagaaactgaaact

SEQ ID NO: 321905 - DNA, 20 bp, Artificial
  CRISPR gRNA sequence
aaactcaaagtggaactgta

SEQ ID NO: 321906 - DNA, 20 bp, Artificial
  CRISPR gRNA sequence
aaagtggaactgtaaacagg

SEQ ID NO: 321907 - DNA, 20 bp, Artificial
  CRISPR gRNA sequence
taaacagggaagatctgagt

SEQ ID NO: 321908 - DNA, 20 bp, Artificial
  CRISPR gRNA sequence
agttttgtgaggctggatgc

SEQ ID NO: 321909 - DNA, 20 bp, Artificial
  CRISPR gRNA sequence
tgtgaggctggatgctgtta

SEQ ID NO: 321910 - DNA, 20 bp, Artificial
  CRISPR gRNA sequence
gtgaggctggatgctgttaa

SEQ ID NO: 321911 - DNA, 20 bp, Artificial
  CRISPR gRNA sequence
tgaggctggatgctgttaaa

SEQ ID NO: 321912 - DNA, 20 bp, Artificial
  CRISPR gRNA sequence
gatgctgttaaaattttgag

SEQ ID NO: 321913 - DNA, 20 bp, Artificial
  CRISPR gRNA sequence
ttaaaattttgaggggaggt

SEQ ID NO: 321914 - DNA, 20 bp, Artificial
  CRISPR gRNA sequence
aaattttgaggggaggtggt

SEQ ID NO: 321915 - DNA, 20 bp, Artificial
  CRISPR gRNA sequence
tgaggggaggtggtggatag

SEQ ID NO: 321916 - DNA, 20 bp, Artificial
  CRISPR gRNA sequence
gaggggaggtggtggatagt

SEQ ID NO: 321917 - DNA, 20 bp, Artificial
  CRISPR gRNA sequence
aggggaggtggtggatagtt

SEQ ID NO: 321918 - DNA, 20 bp, Artificial
  CRISPR gRNA sequence
agaaaaagaatgtagaattc

SEQ ID NO: 321919 - DNA, 20 bp, Artificial
  CRISPR gRNA sequence
aaatacaaaatgcccctgac

SEQ ID NO: 321920 - DNA, 20 bp, Artificial
  CRISPR gRNA sequence
actgctaacaccaccagaca

SEQ ID NO: 321921 - DNA, 20 bp, Artificial
  CRISPR gRNA sequence
ctaacaccaccagacaggag

SEQ ID NO: 321922 - DNA, 20 bp, Artificial
  CRISPR gRNA sequence
acaccaccagacaggagaat

SEQ ID NO: 321923 - DNA, 20 bp, Artificial
  CRISPR gRNA sequence
cagaggaaggagacagtggt

SEQ ID NO: 321924 - DNA, 20 bp, Artificial
  CRISPR gRNA sequence
attgtggttacaatatctta

SEQ ID NO: 321925 - DNA, 20 bp, Artificial
  CRISPR gRNA sequence
ttgtggttacaatatcttac

SEQ ID NO: 321926 - DNA, 20 bp, Artificial
  CRISPR gRNA sequence
tggttacaatatcttactta

SEQ ID NO: 321927 - DNA, 20 bp, Artificial
  CRISPR gRNA sequence
caatatcttacttattcaaa

SEQ ID NO: 321928 - DNA, 20 bp, Artificial
  CRISPR gRNA sequence
acttattcaaattttaccaa

SEQ ID NO: 321929 - DNA, 20 bp, Artificial
  CRISPR gRNA sequence
cttattcaaattttaccaaa

SEQ ID NO: 321930 - DNA, 20 bp, Artificial
  CRISPR gRNA sequence
attcaaattttaccaaagca

SEQ ID NO: 321931 - DNA, 20 bp, Artificial
  CRISPR gRNA sequence
ttcaaattttaccaaagcat

SEQ ID NO: 321932 - DNA, 20 bp, Artificial
  CRISPR gRNA sequence
aaattttaccaaagcataag

SEQ ID NO: 321933 - DNA, 20 bp, Artificial
  CRISPR gRNA sequence
taccaaagcataagacaggt

SEQ ID NO: 321934 - DNA, 20 bp, Artificial
  CRISPR gRNA sequence
accaaagcataagacaggtg

SEQ ID NO: 321935 - DNA, 20 bp, Artificial
  CRISPR gRNA sequence
ccaaagcataagacaggtga

SEQ ID NO: 321936 - DNA, 20 bp, Artificial
  CRISPR gRNA sequence
ctagggggcccttcacaggg

SEQ ID NO: 321937 - DNA, 20 bp, Artificial
  CRISPR gRNA sequence
gggggcccttcacagggtct

SEQ ID NO: 321938 - DNA, 20 bp, Artificial
  CRISPR gRNA sequence
cacagggtcttgagggggat

SEQ ID NO: 321939 - DNA, 20 bp, Artificial
  CRISPR gRNA sequence
acagggtcttgagggggatt

SEQ ID NO: 321940 - DNA, 20 bp, Artificial
  CRISPR gRNA sequence
gagggggatttagaaagggt

SEQ ID NO: 321941 - DNA, 20 bp, Artificial
  CRISPR gRNA sequence
agggggatttagaaagggtt

SEQ ID NO: 321942 - DNA, 20 bp, Artificial
  CRISPR gRNA sequence
agaaagggttgtgcaaatgg

SEQ ID NO: 321943 - DNA, 20 bp, Artificial
  CRISPR gRNA sequence
gaaagggttgtgcaaatgga

SEQ ID NO: 321944 - DNA, 20 bp, Artificial
  CRISPR gRNA sequence
tgcaaatggagggctctgaa

SEQ ID NO: 321945 - DNA, 20 bp, Artificial
  CRISPR gRNA sequence
tgaagcttcagcttcattgg

SEQ ID NO: 321946 - DNA, 20 bp, Artificial
  CRISPR gRNA sequence
aagcttcagcttcattggct

SEQ ID NO: 321947 - DNA, 20 bp, Artificial
  CRISPR gRNA sequence
cagcttcattggctccacta

SEQ ID NO: 321948 - DNA, 20 bp, Artificial
  CRISPR gRNA sequence
agcttcattggctccactat

SEQ ID NO: 321949 - DNA, 20 bp, Artificial
  CRISPR gRNA sequence
cattggctccactataaatc

SEQ ID NO: 321950 - DNA, 20 bp, Artificial
  CRISPR gRNA sequence
attggctccactataaatca

SEQ ID NO: 321951 - DNA, 20 bp, Artificial
  CRISPR gRNA sequence
gctccactataaatcagctg

SEQ ID NO: 321952 - DNA, 20 bp, Artificial
  CRISPR gRNA sequence
cactataaatcagctgacac

SEQ ID NO: 321953 - DNA, 20 bp, Artificial
  CRISPR gRNA sequence
taaatcagctgacacaatta

SEQ ID NO: 321954 - DNA, 20 bp, Artificial
  CRISPR gRNA sequence
acacaattagctgaacatcc

SEQ ID NO: 321955 - DNA, 20 bp, Artificial
  CRISPR gRNA sequence
gctgaacatccatagttgtc

SEQ ID NO: 321956 - DNA, 20 bp, Artificial
  CRISPR gRNA sequence
aacatccatagttgtcagga

SEQ ID NO: 321957 - DNA, 20 bp, Artificial
  CRISPR gRNA sequence
tcaggaagccgtggcaacca

SEQ ID NO: 321958 - DNA, 20 bp, Artificial
  CRISPR gRNA sequence
tagggaagggagtgagagag

SEQ ID NO: 321959 - DNA, 20 bp, Artificial
  CRISPR gRNA sequence
cgaatgaagggagacttttg

SEQ ID NO: 321960 - DNA, 20 bp, Artificial
  CRISPR gRNA sequence
ttggaattctgtcagttgtt

SEQ ID NO: 321961 - DNA, 20 bp, Artificial
  CRISPR gRNA sequence
tggaattctgtcagttgttt

SEQ ID NO: 321962 - DNA, 20 bp, Artificial
  CRISPR gRNA sequence
ggaattctgtcagttgtttc

SEQ ID NO: 321963 - DNA, 20 bp, Artificial
  CRISPR gRNA sequence
gaattctgtcagttgtttcc

SEQ ID NO: 321964 - DNA, 20 bp, Artificial
  CRISPR gRNA sequence
tgtcagttgtttcctaggag

SEQ ID NO: 321965 - DNA, 20 bp, Artificial
  CRISPR gRNA sequence
tcagttgtttcctaggagcc

SEQ ID NO: 321966 - DNA, 20 bp, Artificial
  CRISPR gRNA sequence
tttcctaggagcctgagaaa

SEQ ID NO: 321967 - DNA, 20 bp, Artificial
  CRISPR gRNA sequence
cctaggagcctgagaaagac

SEQ ID NO: 321968 - DNA, 20 bp, Artificial
  CRISPR gRNA sequence
ctaggagcctgagaaagaca

SEQ ID NO: 321969 - DNA, 20 bp, Artificial
  CRISPR gRNA sequence
ggagcctgagaaagacagaa

SEQ ID NO: 321970 - DNA, 20 bp, Artificial
  CRISPR gRNA sequence
agaaagacagaaacagggtc

SEQ ID NO: 321971 - DNA, 20 bp, Artificial
  CRISPR gRNA sequence
aggggcctcagtgcagcagc

SEQ ID NO: 321972 - DNA, 20 bp, Artificial
  CRISPR gRNA sequence
agtgcagcagccttccccca

SEQ ID NO: 321973 - DNA, 20 bp, Artificial
  CRISPR gRNA sequence
cccccatccccatgggatgg

SEQ ID NO: 321974 - DNA, 20 bp, Artificial
  CRISPR gRNA sequence
ccccatccccatgggatggg

SEQ ID NO: 321975 - DNA, 20 bp, Artificial
  CRISPR gRNA sequence
ccctactctgagcatctagg

SEQ ID NO: 321976 - DNA, 20 bp, Artificial
  CRISPR gRNA sequence
ctctgagcatctaggctcac

SEQ ID NO: 321977 - DNA, 20 bp, Artificial
  CRISPR gRNA sequence
tgagcatctaggctcactga

SEQ ID NO: 321978 - DNA, 20 bp, Artificial
  CRISPR gRNA sequence
agcatctaggctcactgatg

SEQ ID NO: 321979 - DNA, 20 bp, Artificial
  CRISPR gRNA sequence
ggctcactgatgtgagactg

SEQ ID NO: 321980 - DNA, 20 bp, Artificial
  CRISPR gRNA sequence
actgatgtgagactgcagag

SEQ ID NO: 321981 - DNA, 20 bp, Artificial
  CRISPR gRNA sequence
atgtgagactgcagaggagg

SEQ ID NO: 321982 - DNA, 20 bp, Artificial
  CRISPR gRNA sequence
cagaggaggaagaagcacac

SEQ ID NO: 321983 - DNA, 20 bp, Artificial
  CRISPR gRNA sequence
catcccagctgcctgccatc

SEQ ID NO: 321984 - DNA, 20 bp, Artificial
  CRISPR gRNA sequence
cctgccatcagctgctctca

SEQ ID NO: 321985 - DNA, 20 bp, Artificial
  CRISPR gRNA sequence
ccatcagctgctctcaatca

SEQ ID NO: 321986 - DNA, 20 bp, Artificial
  CRISPR gRNA sequence
ctctcaatcataacacttcc

SEQ ID NO: 321987 - DNA, 20 bp, Artificial
  CRISPR gRNA sequence
tcaatcataacacttccttc

SEQ ID NO: 321988 - DNA, 20 bp, Artificial
  CRISPR gRNA sequence
aatcataacacttccttctt

SEQ ID NO: 321989 - DNA, 20 bp, Artificial
  CRISPR gRNA sequence
ccttcttctccaggaaagtc

SEQ ID NO: 321990 - DNA, 20 bp, Artificial
  CRISPR gRNA sequence
cttcttctccaggaaagtct

SEQ ID NO: 321991 - DNA, 20 bp, Artificial
  CRISPR gRNA sequence
cttctccaggaaagtctttt

SEQ ID NO: 321992 - DNA, 20 bp, Artificial
  CRISPR gRNA sequence
ttctccaggaaagtcttttt

SEQ ID NO: 321993 - DNA, 20 bp, Artificial
  CRISPR gRNA sequence
ctccaggaaagtcttttttg

SEQ ID NO: 321994 - DNA, 20 bp, Artificial
  CRISPR gRNA sequence
tccaggaaagtcttttttgc

SEQ ID NO: 321995 - DNA, 20 bp, Artificial
  CRISPR gRNA sequence
caggaaagtcttttttgcat

SEQ ID NO: 321996 - DNA, 20 bp, Artificial
  CRISPR gRNA sequence
ttttgcatgtggtcttgtac

SEQ ID NO: 321997 - DNA, 20 bp, Artificial
  CRISPR gRNA sequence
tttgcatgtggtcttgtaca

SEQ ID NO: 321998 - DNA, 20 bp, Artificial
  CRISPR gRNA sequence
ttgcatgtggtcttgtacaa

SEQ ID NO: 321999 - DNA, 20 bp, Artificial
  CRISPR gRNA sequence
tgcatgtggtcttgtacaat

SEQ ID NO: 322000 - DNA, 20 bp, Artificial
  CRISPR gRNA sequence
gcatgtggtcttgtacaatg

SEQ ID NO: 322001 - DNA, 20 bp, Artificial
  CRISPR gRNA sequence
catgtggtcttgtacaatgc

SEQ ID NO: 322002 - DNA, 20 bp, Artificial
  CRISPR gRNA sequence
gtacaatgctcagtagaaag

SEQ ID NO: 322003 - DNA, 20 bp, Artificial
  CRISPR gRNA sequence
tacaatgctcagtagaaagt

SEQ ID NO: 322004 - DNA, 20 bp, Artificial
  CRISPR gRNA sequence
agtagaaagtgagtaaaacc

SEQ ID NO: 322005 - DNA, 20 bp, Artificial
  CRISPR gRNA sequence
aggcctgggcttgctgtggt

SEQ ID NO: 322006 - DNA, 20 bp, Artificial
  CRISPR gRNA sequence
ggcttgctgtggtcagactc

SEQ ID NO: 322007 - DNA, 20 bp, Artificial
  CRISPR gRNA sequence
gctgtggtcagactcatcag

SEQ ID NO: 322008 - DNA, 20 bp, Artificial
  CRISPR gRNA sequence
ctgtggtcagactcatcagg

SEQ ID NO: 322009 - DNA, 20 bp, Artificial
  CRISPR gRNA sequence
tggtcagactcatcaggaga

SEQ ID NO: 322010 - DNA, 20 bp, Artificial
  CRISPR gRNA sequence
atcaggagacagtaggattc

SEQ ID NO: 322011 - DNA, 20 bp, Artificial
  CRISPR gRNA sequence
caggacttaacaaagctgaa

SEQ ID NO: 322012 - DNA, 20 bp, Artificial
  CRISPR gRNA sequence
aacaaagctgaaaggttctt

SEQ ID NO: 322013 - DNA, 20 bp, Artificial
  CRISPR gRNA sequence
acaaagctgaaaggttctta

SEQ ID NO: 322014 - DNA, 20 bp, Artificial
  CRISPR gRNA sequence
aaaggttcttaccagagagc

SEQ ID NO: 322015 - DNA, 20 bp, Artificial
  CRISPR gRNA sequence
ttaccagagagcaggaaggc

SEQ ID NO: 322016 - DNA, 20 bp, Artificial
  CRISPR gRNA sequence
accagagagcaggaaggcca

SEQ ID NO: 322017 - DNA, 20 bp, Artificial
  CRISPR gRNA sequence
ccagagagcaggaaggccat

SEQ ID NO: 322018 - DNA, 20 bp, Artificial
  CRISPR gRNA sequence
ctcagtcccatagtgctaga

SEQ ID NO: 322019 - DNA, 20 bp, Artificial
  CRISPR gRNA sequence
agtcccatagtgctagagtc

SEQ ID NO: 322020 - DNA, 20 bp, Artificial
  CRISPR gRNA sequence
gagtcgagaaaaaaaaaggt

SEQ ID NO: 322021 - DNA, 20 bp, Artificial
  CRISPR gRNA sequence
gattagaaaaggaaactgaa

SEQ ID NO: 322022 - DNA, 20 bp, Artificial
  CRISPR gRNA sequence
attagaaaaggaaactgaaa

SEQ ID NO: 322023 - DNA, 20 bp, Artificial
  CRISPR gRNA sequence
gaaaaggaaactgaaaaccg

SEQ ID NO: 322024 - DNA, 20 bp, Artificial
  CRISPR gRNA sequence
aaaaccgatgttcaccaaaa

SEQ ID NO: 322025 - DNA, 20 bp, Artificial
  CRISPR gRNA sequence
accaaaacatgacctggacg

SEQ ID NO: 322026 - DNA, 20 bp, Artificial
  CRISPR gRNA sequence
gacgtggagtttgggattca

SEQ ID NO: 322027 - DNA, 20 bp, Artificial
  CRISPR gRNA sequence
gggattcacttgggttctcg

SEQ ID NO: 322028 - DNA, 20 bp, Artificial
  CRISPR gRNA sequence
ggattcacttgggttctcgg

SEQ ID NO: 322029 - DNA, 20 bp, Artificial
  CRISPR gRNA sequence
acttgggttctcgggtgtgc

SEQ ID NO: 322030 - DNA, 20 bp, Artificial
  CRISPR gRNA sequence
gggttctcgggtgtgcagag

SEQ ID NO: 322031 - DNA, 20 bp, Artificial
  CRISPR gRNA sequence
ggttctcgggtgtgcagaga

SEQ ID NO: 322032 - DNA, 20 bp, Artificial
  CRISPR gRNA sequence
tcgggtgtgcagagacaatg

SEQ ID NO: 322033 - DNA, 20 bp, Artificial
  CRISPR gRNA sequence
gggtgtgcagagacaatgcc

SEQ ID NO: 322034 - DNA, 20 bp, Artificial
  CRISPR gRNA sequence
catcaaagccatttcctttt

SEQ ID NO: 322035 - DNA, 20 bp, Artificial
  CRISPR gRNA sequence
atcaaagccatttccttttg

SEQ ID NO: 322036 - DNA, 20 bp, Artificial
  CRISPR gRNA sequence
ccttttgctcttagctccat

SEQ ID NO: 322037 - DNA, 20 bp, Artificial
  CRISPR gRNA sequence
cttttgctcttagctccatc

SEQ ID NO: 322038 - DNA, 20 bp, Artificial
  CRISPR gRNA sequence
ttgctcttagctccatcgat

SEQ ID NO: 322039 - DNA, 20 bp, Artificial
  CRISPR gRNA sequence
tgctcttagctccatcgata

SEQ ID NO: 322040 - DNA, 20 bp, Artificial
  CRISPR gRNA sequence
gctcttagctccatcgatag

SEQ ID NO: 322041 - DNA, 20 bp, Artificial
  CRISPR gRNA sequence
ctcttagctccatcgatagg

SEQ ID NO: 322042 - DNA, 20 bp, Artificial
  CRISPR gRNA sequence
ttagctccatcgataggtca

SEQ ID NO: 322043 - DNA, 20 bp, Artificial
  CRISPR gRNA sequence
agctccatcgataggtcaca

SEQ ID NO: 322044 - DNA, 20 bp, Artificial
  CRISPR gRNA sequence
gctccatcgataggtcacat

SEQ ID NO: 322045 - DNA, 20 bp, Artificial
  CRISPR gRNA sequence
catcgataggtcacatttcc

SEQ ID NO: 322046 - DNA, 20 bp, Artificial
  CRISPR gRNA sequence
cccagcctcccctgcagtta

SEQ ID NO: 322047 - DNA, 20 bp, Artificial
  CRISPR gRNA sequence
ccagcctcccctgcagttat

SEQ ID NO: 322048 - DNA, 20 bp, Artificial
  CRISPR gRNA sequence
ccctgcagttatacaggcca

SEQ ID NO: 322049 - DNA, 20 bp, Artificial
  CRISPR gRNA sequence
cagttatacaggccatgaga

SEQ ID NO: 322050 - DNA, 20 bp, Artificial
  CRISPR gRNA sequence
tacaggccatgagactggct

SEQ ID NO: 322051 - DNA, 20 bp, Artificial
  CRISPR gRNA sequence
gcttctagccaatggaattg

SEQ ID NO: 322052 - DNA, 20 bp, Artificial
  CRISPR gRNA sequence
ctagccaatggaattgtggg

SEQ ID NO: 322053 - DNA, 20 bp, Artificial
  CRISPR gRNA sequence
tagccaatggaattgtgggc

SEQ ID NO: 322054 - DNA, 20 bp, Artificial
  CRISPR gRNA sequence
gccaatggaattgtgggcag

SEQ ID NO: 322055 - DNA, 20 bp, Artificial
  CRISPR gRNA sequence
tgggcagaaaagatgtttct

SEQ ID NO: 322056 - DNA, 20 bp, Artificial
  CRISPR gRNA sequence
cttccagatctggctgctaa

SEQ ID NO: 322057 - DNA, 20 bp, Artificial
  CRISPR gRNA sequence
ttccagatctggctgctaaa

SEQ ID NO: 322058 - DNA, 20 bp, Artificial
  CRISPR gRNA sequence
ccagatctggctgctaaagt

SEQ ID NO: 322059 - DNA, 20 bp, Artificial
  CRISPR gRNA sequence
cagatctggctgctaaagtc

SEQ ID NO: 322060 - DNA, 20 bp, Artificial
  CRISPR gRNA sequence
gctgctaaagtctcttctct

SEQ ID NO: 322061 - DNA, 20 bp, Artificial
  CRISPR gRNA sequence
ctaaagtctcttctctttcc

SEQ ID NO: 322062 - DNA, 20 bp, Artificial
  CRISPR gRNA sequence
aagtctcttctctttcctcc

SEQ ID NO: 322063 - DNA, 20 bp, Artificial
  CRISPR gRNA sequence
ttctctttcctccctctcct

SEQ ID NO: 322064 - DNA, 20 bp, Artificial
  CRISPR gRNA sequence
ctctttcctccctctcctgc

SEQ ID NO: 322065 - DNA, 20 bp, Artificial
  CRISPR gRNA sequence
tctttcctccctctcctgcc

SEQ ID NO: 322066 - DNA, 20 bp, Artificial
  CRISPR gRNA sequence
tttcctccctctcctgcctt

SEQ ID NO: 322067 - DNA, 20 bp, Artificial
  CRISPR gRNA sequence
tcctccctctcctgccttct

SEQ ID NO: 322068 - DNA, 20 bp, Artificial
  CRISPR gRNA sequence
cctccctctcctgccttctt

SEQ ID NO: 322069 - DNA, 20 bp, Artificial
  CRISPR gRNA sequence
ctccctctcctgccttctta

SEQ ID NO: 322070 - DNA, 20 bp, Artificial
  CRISPR gRNA sequence
cctctcctgccttcttagca

SEQ ID NO: 322071 - DNA, 20 bp, Artificial
  CRISPR gRNA sequence
tcctgccttcttagcagcag

SEQ ID NO: 322072 - DNA, 20 bp, Artificial
  CRISPR gRNA sequence
ctgccttcttagcagcaggg

SEQ ID NO: 322073 - DNA, 20 bp, Artificial
  CRISPR gRNA sequence
ccttcttagcagcaggggat

SEQ ID NO: 322074 - DNA, 20 bp, Artificial
  CRISPR gRNA sequence
cttagcagcaggggatccag

SEQ ID NO: 322075 - DNA, 20 bp, Artificial
  CRISPR gRNA sequence
ttagcagcaggggatccaga

SEQ ID NO: 322076 - DNA, 20 bp, Artificial
  CRISPR gRNA sequence
agcagcaggggatccagagg

SEQ ID NO: 322077 - DNA, 20 bp, Artificial
  CRISPR gRNA sequence
gcagcaggggatccagagga

SEQ ID NO: 322078 - DNA, 20 bp, Artificial
  CRISPR gRNA sequence
gaaaatcgcaaagtctcaca

SEQ ID NO: 322079 - DNA, 20 bp, Artificial
  CRISPR gRNA sequence
acaatggaagagatctggtt

SEQ ID NO: 322080 - DNA, 20 bp, Artificial
  CRISPR gRNA sequence
gtttgcttaataaactaata

SEQ ID NO: 322081 - DNA, 20 bp, Artificial
  CRISPR gRNA sequence
gcttaataaactaataaagc

SEQ ID NO: 322082 - DNA, 20 bp, Artificial
  CRISPR gRNA sequence
cttaataaactaataaagca

SEQ ID NO: 322083 - DNA, 20 bp, Artificial
  CRISPR gRNA sequence
aataaactaataaagcagct

SEQ ID NO: 322084 - DNA, 20 bp, Artificial
  CRISPR gRNA sequence
ataaactaataaagcagctc

SEQ ID NO: 322085 - DNA, 20 bp, Artificial
  CRISPR gRNA sequence
ataaagcagctctctttaca

SEQ ID NO: 322086 - DNA, 20 bp, Artificial
  CRISPR gRNA sequence
tctttacacctctcccacaa

SEQ ID NO: 322087 - DNA, 20 bp, Artificial
  CRISPR gRNA sequence
tttacacctctcccacaact

SEQ ID NO: 322088 - DNA, 20 bp, Artificial
  CRISPR gRNA sequence
tacacctctcccacaactga

SEQ ID NO: 322089 - DNA, 20 bp, Artificial
  CRISPR gRNA sequence
acacctctcccacaactgat

SEQ ID NO: 322090 - DNA, 20 bp, Artificial
  CRISPR gRNA sequence
cacctctcccacaactgatc

SEQ ID NO: 322091 - DNA, 20 bp, Artificial
  CRISPR gRNA sequence
tcccacaactgatctacaat

SEQ ID NO: 322092 - DNA, 20 bp, Artificial
  CRISPR gRNA sequence
ccacaactgatctacaatgg

SEQ ID NO: 322093 - DNA, 20 bp, Artificial
  CRISPR gRNA sequence
atctacaatggattgtgata

SEQ ID NO: 322094 - DNA, 20 bp, Artificial
  CRISPR gRNA sequence
caatggattgtgatattggc

SEQ ID NO: 322095 - DNA, 20 bp, Artificial
  CRISPR gRNA sequence
tgatattggcaaaaaataaa

SEQ ID NO: 322096 - DNA, 20 bp, Artificial
  CRISPR gRNA sequence
gcaaaaaataaaatttgagg

SEQ ID NO: 322097 - DNA, 20 bp, Artificial
  CRISPR gRNA sequence
gagggattgattattgcagt

SEQ ID NO: 322098 - DNA, 20 bp, Artificial
  CRISPR gRNA sequence
agggattgattattgcagta

SEQ ID NO: 322099 - DNA, 20 bp, Artificial
  CRISPR gRNA sequence
attattgcagtagctagtat

SEQ ID NO: 322100 - DNA, 20 bp, Artificial
  CRISPR gRNA sequence
ttgcagtagctagtattatt

SEQ ID NO: 322101 - DNA, 20 bp, Artificial
  CRISPR gRNA sequence
cagtagctagtattatttat

SEQ ID NO: 322102 - DNA, 20 bp, Artificial
  CRISPR gRNA sequence
gtattatttatcttgaccaa

SEQ ID NO: 322103 - DNA, 20 bp, Artificial
  CRISPR gRNA sequence
tttatcttgaccaacataac

SEQ ID NO: 322104 - DNA, 20 bp, Artificial
  CRISPR gRNA sequence
atcttgaccaacataacagg

SEQ ID NO: 322105 - DNA, 20 bp, Artificial
  CRISPR gRNA sequence
tcttgaccaacataacaggc

SEQ ID NO: 322106 - DNA, 20 bp, Artificial
  CRISPR gRNA sequence
gaccaacataacaggcatga

SEQ ID NO: 322107 - DNA, 20 bp, Artificial
  CRISPR gRNA sequence
accaacataacaggcatgat

SEQ ID NO: 322108 - DNA, 20 bp, Artificial
  CRISPR gRNA sequence
gtattgcatttacgcttaga

SEQ ID NO: 322109 - DNA, 20 bp, Artificial
  CRISPR gRNA sequence
catttacgcttagaaatctg

SEQ ID NO: 322110 - DNA, 20 bp, Artificial
  CRISPR gRNA sequence
acgcttagaaatctgccttc

SEQ ID NO: 322111 - DNA, 20 bp, Artificial
  CRISPR gRNA sequence
cgcttagaaatctgccttcc

SEQ ID NO: 322112 - DNA, 20 bp, Artificial
  CRISPR gRNA sequence
agaaatctgccttccttttg

SEQ ID NO: 322113 - DNA, 20 bp, Artificial
  CRISPR gRNA sequence
gaaatctgccttccttttgt

SEQ ID NO: 322114 - DNA, 20 bp, Artificial
  CRISPR gRNA sequence
ccttccttttgttttcctgt

SEQ ID NO: 322115 - DNA, 20 bp, Artificial
  CRISPR gRNA sequence
ccttttgttttcctgtggtt

SEQ ID NO: 322116 - DNA, 20 bp, Artificial
  CRISPR gRNA sequence
cttttgttttcctgtggttc

SEQ ID NO: 322117 - DNA, 20 bp, Artificial
  CRISPR gRNA sequence
ttgttttcctgtggttctca

SEQ ID NO: 322118 - DNA, 20 bp, Artificial
  CRISPR gRNA sequence
tgttttcctgtggttctcaa

SEQ ID NO: 322119 - DNA, 20 bp, Artificial
  CRISPR gRNA sequence
gttttcctgtggttctcaaa

SEQ ID NO: 322120 - DNA, 20 bp, Artificial
  CRISPR gRNA sequence
ttttcctgtggttctcaaac

SEQ ID NO: 322121 - DNA, 20 bp, Artificial
  CRISPR gRNA sequence
tcctgtggttctcaaacttg

SEQ ID NO: 322122 - DNA, 20 bp, Artificial
  CRISPR gRNA sequence
cctgtggttctcaaacttga

SEQ ID NO: 322123 - DNA, 20 bp, Artificial
  CRISPR gRNA sequence
ctgtggttctcaaacttgaa

SEQ ID NO: 322124 - DNA, 20 bp, Artificial
  CRISPR gRNA sequence
tggttctcaaacttgaatgt

SEQ ID NO: 322125 - DNA, 20 bp, Artificial
  CRISPR gRNA sequence
tcaaacttgaatgtgagtaa

SEQ ID NO: 322126 - DNA, 20 bp, Artificial
  CRISPR gRNA sequence
aaacttgaatgtgagtaaaa

SEQ ID NO: 322127 - DNA, 20 bp, Artificial
  CRISPR gRNA sequence
gaatgtgagtaaaaatcacc

SEQ ID NO: 322128 - DNA, 20 bp, Artificial
  CRISPR gRNA sequence
aatgtgagtaaaaatcacct

SEQ ID NO: 322129 - DNA, 20 bp, Artificial
  CRISPR gRNA sequence
gagagtttcctgggcctcaa

SEQ ID NO: 322130 - DNA, 20 bp, Artificial
  CRISPR gRNA sequence
cctgggcctcaaccacagaa

SEQ ID NO: 322131 - DNA, 20 bp, Artificial
  CRISPR gRNA sequence
ctgggcctcaaccacagaaa

SEQ ID NO: 322132 - DNA, 20 bp, Artificial
  CRISPR gRNA sequence
ggcctcaaccacagaaagtc

SEQ ID NO: 322133 - DNA, 20 bp, Artificial
  CRISPR gRNA sequence
aaccacagaaagtctggctt

SEQ ID NO: 322134 - DNA, 20 bp, Artificial
  CRISPR gRNA sequence
gcttagtaagttgggatgaa

SEQ ID NO: 322135 - DNA, 20 bp, Artificial
  CRISPR gRNA sequence
agtaagttgggatgaaaccc

SEQ ID NO: 322136 - DNA, 20 bp, Artificial
  CRISPR gRNA sequence
gtaagttgggatgaaaccca

SEQ ID NO: 322137 - DNA, 20 bp, Artificial
  CRISPR gRNA sequence
ggatgaaacccatgaatttt

SEQ ID NO: 322138 - DNA, 20 bp, Artificial
  CRISPR gRNA sequence
ttatgtttaacaacataagg

SEQ ID NO: 322139 - DNA, 20 bp, Artificial
  CRISPR gRNA sequence
tatgtttaacaacataaggt

SEQ ID NO: 322140 - DNA, 20 bp, Artificial
  CRISPR gRNA sequence
atgtttaacaacataaggtg

SEQ ID NO: 322141 - DNA, 20 bp, Artificial
  CRISPR gRNA sequence
tgtttaacaacataaggtga

SEQ ID NO: 322142 - DNA, 20 bp, Artificial
  CRISPR gRNA sequence
aacaacataaggtgatgaca

SEQ ID NO: 322143 - DNA, 20 bp, Artificial
  CRISPR gRNA sequence
acaacataaggtgatgacaa

SEQ ID NO: 322144 - DNA, 20 bp, Artificial
  CRISPR gRNA sequence
ccggcctaaggaccacgctt

SEQ ID NO: 322145 - DNA, 20 bp, Artificial
  CRISPR gRNA sequence
aggaccacgctttgagagca

SEQ ID NO: 322146 - DNA, 20 bp, Artificial
  CRISPR gRNA sequence
tgagagcaattcacttaatc

SEQ ID NO: 322147 - DNA, 20 bp, Artificial
  CRISPR gRNA sequence
gagagcaattcacttaatct

SEQ ID NO: 322148 - DNA, 20 bp, Artificial
  CRISPR gRNA sequence
agagcaattcacttaatcta

SEQ ID NO: 322149 - DNA, 20 bp, Artificial
  CRISPR gRNA sequence
acttaatctacatgatgaag

SEQ ID NO: 322150 - DNA, 20 bp, Artificial
  CRISPR gRNA sequence
aatctacatgatgaagccaa

SEQ ID NO: 322151 - DNA, 20 bp, Artificial
  CRISPR gRNA sequence
atctacatgatgaagccaag

SEQ ID NO: 322152 - DNA, 20 bp, Artificial
  CRISPR gRNA sequence
catgatgaagccaagaaaaa

SEQ ID NO: 322153 - DNA, 20 bp, Artificial
  CRISPR gRNA sequence
tgctttataacctctatctt

SEQ ID NO: 322154 - DNA, 20 bp, Artificial
  CRISPR gRNA sequence
gctttataacctctatcttc

SEQ ID NO: 322155 - DNA, 20 bp, Artificial
  CRISPR gRNA sequence
ctttataacctctatcttct

SEQ ID NO: 322156 - DNA, 20 bp, Artificial
  CRISPR gRNA sequence
tataacctctatcttctttc

SEQ ID NO: 322157 - DNA, 20 bp, Artificial
  CRISPR gRNA sequence
ataacctctatcttctttct

SEQ ID NO: 322158 - DNA, 20 bp, Artificial
  CRISPR gRNA sequence
taacctctatcttctttctt

SEQ ID NO: 322159 - DNA, 20 bp, Artificial
  CRISPR gRNA sequence
tatcttctttcttcctctcc

SEQ ID NO: 322160 - DNA, 20 bp, Artificial
  CRISPR gRNA sequence
tcttctttcttcctctccct

SEQ ID NO: 322161 - DNA, 20 bp, Artificial
  CRISPR gRNA sequence
ctttcttcctctccctcctc

SEQ ID NO: 322162 - DNA, 20 bp, Artificial
  CRISPR gRNA sequence
tttcttcctctccctcctcc

SEQ ID NO: 322163 - DNA, 20 bp, Artificial
  CRISPR gRNA sequence
tcttcctctccctcctccct

SEQ ID NO: 322164 - DNA, 20 bp, Artificial
  CRISPR gRNA sequence
cttcctctccctcctccctc

SEQ ID NO: 322165 - DNA, 20 bp, Artificial
  CRISPR gRNA sequence
ttcctctccctcctccctcc

SEQ ID NO: 322166 - DNA, 20 bp, Artificial
  CRISPR gRNA sequence
cctctccctcctccctcctt

SEQ ID NO: 322167 - DNA, 20 bp, Artificial
  CRISPR gRNA sequence
ctctccctcctccctccttc

SEQ ID NO: 322168 - DNA, 20 bp, Artificial
  CRISPR gRNA sequence
tccctcctccctccttcact

SEQ ID NO: 322169 - DNA, 20 bp, Artificial
  CRISPR gRNA sequence
cctcctccctccttcactac

SEQ ID NO: 322170 - DNA, 20 bp, Artificial
  CRISPR gRNA sequence
ctccctccttcactacccac

SEQ ID NO: 322171 - DNA, 20 bp, Artificial
  CRISPR gRNA sequence
cctccttcactacccacgca

SEQ ID NO: 322172 - DNA, 20 bp, Artificial
  CRISPR gRNA sequence
cttcactacccacgcactta

SEQ ID NO: 322173 - DNA, 20 bp, Artificial
  CRISPR gRNA sequence
cactacccacgcacttaccc

SEQ ID NO: 322174 - DNA, 20 bp, Artificial
  CRISPR gRNA sequence
actacccacgcacttaccct

SEQ ID NO: 322175 - DNA, 20 bp, Artificial
  CRISPR gRNA sequence
cccacgcacttaccctaact

SEQ ID NO: 322176 - DNA, 20 bp, Artificial
  CRISPR gRNA sequence
accctaactagcaccaaaaa

SEQ ID NO: 322177 - DNA, 20 bp, Artificial
  CRISPR gRNA sequence
ccctaactagcaccaaaaag

SEQ ID NO: 322178 - DNA, 20 bp, Artificial
  CRISPR gRNA sequence
actagcaccaaaaaggctgc

SEQ ID NO: 322179 - DNA, 20 bp, Artificial
  CRISPR gRNA sequence
gcaccaaaaaggctgcttag

SEQ ID NO: 322180 - DNA, 20 bp, Artificial
  CRISPR gRNA sequence
cttagtggcttataaggaag

SEQ ID NO: 322181 - DNA, 20 bp, Artificial
  CRISPR gRNA sequence
agtggcttataaggaagcaa

SEQ ID NO: 322182 - DNA, 20 bp, Artificial
  CRISPR gRNA sequence
gtggcttataaggaagcaaa

SEQ ID NO: 322183 - DNA, 20 bp, Artificial
  CRISPR gRNA sequence
ataaggaagcaaagaataag

SEQ ID NO: 322184 - DNA, 20 bp, Artificial
  CRISPR gRNA sequence
taaggaagcaaagaataagg

SEQ ID NO: 322185 - DNA, 20 bp, Artificial
  CRISPR gRNA sequence
gatgcgatcaggcacattca

SEQ ID NO: 322186 - DNA, 20 bp, Artificial
  CRISPR gRNA sequence
aggatggtatggccatacac

SEQ ID NO: 322187 - DNA, 20 bp, Artificial
  CRISPR gRNA sequence
aatgcttgccctagaaatct

SEQ ID NO: 322188 - DNA, 20 bp, Artificial
  CRISPR gRNA sequence
gccctagaaatctgcccaat

SEQ ID NO: 322189 - DNA, 20 bp, Artificial
  CRISPR gRNA sequence
ccctagaaatctgcccaatt

SEQ ID NO: 322190 - DNA, 20 bp, Artificial
  CRISPR gRNA sequence
gaaatctgcccaatttgcac

SEQ ID NO: 322191 - DNA, 20 bp, Artificial
  CRISPR gRNA sequence
cccaatttgcactgaggggg

SEQ ID NO: 322192 - DNA, 20 bp, Artificial
  CRISPR gRNA sequence
gcactgagggggacataaat

SEQ ID NO: 322193 - DNA, 20 bp, Artificial
  CRISPR gRNA sequence
cactgagggggacataaatt

SEQ ID NO: 322194 - DNA, 20 bp, Artificial
  CRISPR gRNA sequence
agggggacataaatttggct

SEQ ID NO: 322195 - DNA, 20 bp, Artificial
  CRISPR gRNA sequence
ggcttatagctttttaacag

SEQ ID NO: 322196 - DNA, 20 bp, Artificial
  CRISPR gRNA sequence
gcttatagctttttaacagc

SEQ ID NO: 322197 - DNA, 20 bp, Artificial
  CRISPR gRNA sequence
atagctttttaacagccaat

SEQ ID NO: 322198 - DNA, 20 bp, Artificial
  CRISPR gRNA sequence
tagctttttaacagccaatg

SEQ ID NO: 322199 - DNA, 20 bp, Artificial
  CRISPR gRNA sequence
tttaacagccaatgtaaaaa

SEQ ID NO: 322200 - DNA, 20 bp, Artificial
  CRISPR gRNA sequence
ttaacagccaatgtaaaaag

SEQ ID NO: 322201 - DNA, 20 bp, Artificial
  CRISPR gRNA sequence
taacagccaatgtaaaaagg

SEQ ID NO: 322202 - DNA, 20 bp, Artificial
  CRISPR gRNA sequence
aacagccaatgtaaaaagga

SEQ ID NO: 322203 - DNA, 20 bp, Artificial
  CRISPR gRNA sequence
acagccaatgtaaaaaggaa

SEQ ID NO: 322204 - DNA, 20 bp, Artificial
  CRISPR gRNA sequence
accagtgaattaattcacag

SEQ ID NO: 322205 - DNA, 20 bp, Artificial
  CRISPR gRNA sequence
attcacaggtctgtccacta

SEQ ID NO: 322206 - DNA, 20 bp, Artificial
  CRISPR gRNA sequence
acaggtctgtccactaaatt

SEQ ID NO: 322207 - DNA, 20 bp, Artificial
  CRISPR gRNA sequence
tccactaaattcataggtct

SEQ ID NO: 322208 - DNA, 20 bp, Artificial
  CRISPR gRNA sequence
aattcataggtctgttgata

SEQ ID NO: 322209 - DNA, 20 bp, Artificial
  CRISPR gRNA sequence
ataggtctgttgataaaaac

SEQ ID NO: 322210 - DNA, 20 bp, Artificial
  CRISPR gRNA sequence
ttgataaaaacaaatcaatt

SEQ ID NO: 322211 - DNA, 20 bp, Artificial
  CRISPR gRNA sequence
ataaaaacaaatcaattctt

SEQ ID NO: 322212 - DNA, 20 bp, Artificial
  CRISPR gRNA sequence
tttccaggaaaagatgcaca

SEQ ID NO: 322213 - DNA, 20 bp, Artificial
  CRISPR gRNA sequence
tccaggaaaagatgcacaac

SEQ ID NO: 322214 - DNA, 20 bp, Artificial
  CRISPR gRNA sequence
ccaggaaaagatgcacaact

SEQ ID NO: 322215 - DNA, 20 bp, Artificial
  CRISPR gRNA sequence
caggaaaagatgcacaacta

SEQ ID NO: 322216 - DNA, 20 bp, Artificial
  CRISPR gRNA sequence
ttcttgatcgaatagcagaa

SEQ ID NO: 322217 - DNA, 20 bp, Artificial
  CRISPR gRNA sequence
ttgatcgaatagcagaaatg

SEQ ID NO: 322218 - DNA, 20 bp, Artificial
  CRISPR gRNA sequence
gatcgaatagcagaaatgta

SEQ ID NO: 322219 - DNA, 20 bp, Artificial
  CRISPR gRNA sequence
atcgaatagcagaaatgtat

SEQ ID NO: 322220 - DNA, 20 bp, Artificial
  CRISPR gRNA sequence
tctagaagccatatgtgttt

SEQ ID NO: 322221 - DNA, 20 bp, Artificial
  CRISPR gRNA sequence
gaagccatatgtgtttcttt

SEQ ID NO: 322222 - DNA, 20 bp, Artificial
  CRISPR gRNA sequence
ctttcctctgctctcatagc

SEQ ID NO: 322223 - DNA, 20 bp, Artificial
  CRISPR gRNA sequence
tttcctctgctctcatagca

SEQ ID NO: 322224 - DNA, 20 bp, Artificial
  CRISPR gRNA sequence
tcctctgctctcatagcacc

SEQ ID NO: 322225 - DNA, 20 bp, Artificial
  CRISPR gRNA sequence
cctctgctctcatagcaccc

SEQ ID NO: 322226 - DNA, 20 bp, Artificial
  CRISPR gRNA sequence
ctctgctctcatagcaccca

SEQ ID NO: 322227 - DNA, 20 bp, Artificial
  CRISPR gRNA sequence
tgctctcatagcacccagtg

SEQ ID NO: 322228 - DNA, 20 bp, Artificial
  CRISPR gRNA sequence
ctctcatagcacccagtgca

SEQ ID NO: 322229 - DNA, 20 bp, Artificial
  CRISPR gRNA sequence
tcatagcacccagtgcagga

SEQ ID NO: 322230 - DNA, 20 bp, Artificial
  CRISPR gRNA sequence
atagcacccagtgcaggaca

SEQ ID NO: 322231 - DNA, 20 bp, Artificial
  CRISPR gRNA sequence
ggctagaagtgtctgttatg

SEQ ID NO: 322232 - DNA, 20 bp, Artificial
  CRISPR gRNA sequence
gaagtgtctgttatgttttt

SEQ ID NO: 322233 - DNA, 20 bp, Artificial
  CRISPR gRNA sequence
ttatgttttttttccttcta

SEQ ID NO: 322234 - DNA, 20 bp, Artificial
  CRISPR gRNA sequence
tgttttttttccttctagac

SEQ ID NO: 322235 - DNA, 20 bp, Artificial
  CRISPR gRNA sequence
tttttccttctagactatac

SEQ ID NO: 322236 - DNA, 20 bp, Artificial
  CRISPR gRNA sequence
ttttccttctagactatacc

SEQ ID NO: 322237 - DNA, 20 bp, Artificial
  CRISPR gRNA sequence
tttccttctagactatacct

SEQ ID NO: 322238 - DNA, 20 bp, Artificial
  CRISPR gRNA sequence
ttccttctagactatacctt

SEQ ID NO: 322239 - DNA, 20 bp, Artificial
  CRISPR gRNA sequence
tccttctagactataccttt

SEQ ID NO: 322240 - DNA, 20 bp, Artificial
  CRISPR gRNA sequence
ccttctagactatacctttt

SEQ ID NO: 322241 - DNA, 20 bp, Artificial
  CRISPR gRNA sequence
cttctagactataccttttc

SEQ ID NO: 322242 - DNA, 20 bp, Artificial
  CRISPR gRNA sequence
ctagactataccttttcttt

SEQ ID NO: 322243 - DNA, 20 bp, Artificial
  CRISPR gRNA sequence
tagactataccttttctttt

SEQ ID NO: 322244 - DNA, 20 bp, Artificial
  CRISPR gRNA sequence
gactataccttttctttttt

SEQ ID NO: 322245 - DNA, 20 bp, Artificial
  CRISPR gRNA sequence
taccttttctttttttaata

SEQ ID NO: 322246 - DNA, 20 bp, Artificial
  CRISPR gRNA sequence
ttctttttttaataaatatt

SEQ ID NO: 322247 - DNA, 20 bp, Artificial
  CRISPR gRNA sequence
tctttttttaataaatattt

SEQ ID NO: 322248 - DNA, 20 bp, Artificial
  CRISPR gRNA sequence
ctttttttaataaatatttt

SEQ ID NO: 322249 - DNA, 20 bp, Artificial
  CRISPR gRNA sequence
tttttttaataaatattttt

SEQ ID NO: 322250 - DNA, 20 bp, Artificial
  CRISPR gRNA sequence
tttttaataaatatttttga

SEQ ID NO: 322251 - DNA, 20 bp, Artificial
  CRISPR gRNA sequence
ttttaataaatatttttgaa

SEQ ID NO: 322252 - DNA, 20 bp, Artificial
  CRISPR gRNA sequence
tttaataaatatttttgaat

SEQ ID NO: 322253 - DNA, 20 bp, Artificial
  CRISPR gRNA sequence
ttaataaatatttttgaata

SEQ ID NO: 322254 - DNA, 20 bp, Artificial
  CRISPR gRNA sequence
taataaatatttttgaatag

SEQ ID NO: 322255 - DNA, 20 bp, Artificial
  CRISPR gRNA sequence
aataaatatttttgaataga

SEQ ID NO: 322256 - DNA, 20 bp, Artificial
  CRISPR gRNA sequence
ataaatatttttgaatagat

SEQ ID NO: 322257 - DNA, 20 bp, Artificial
  CRISPR gRNA sequence
ttgaatagatcatggtacta

SEQ ID NO: 322258 - DNA, 20 bp, Artificial
  CRISPR gRNA sequence
tgaatagatcatggtactaa

SEQ ID NO: 322259 - DNA, 20 bp, Artificial
  CRISPR gRNA sequence
gaatagatcatggtactaaa

SEQ ID NO: 322260 - DNA, 20 bp, Artificial
  CRISPR gRNA sequence
aatagatcatggtactaaat

SEQ ID NO: 322261 - DNA, 20 bp, Artificial
  CRISPR gRNA sequence
aatgtagatggtactaaatt

SEQ ID NO: 322262 - DNA, 20 bp, Artificial
  CRISPR gRNA sequence
aatttgaaagataaaggtga

SEQ ID NO: 322263 - DNA, 20 bp, Artificial
  CRISPR gRNA sequence
gaaagataaaggtgataaat

SEQ ID NO: 322264 - DNA, 20 bp, Artificial
  CRISPR gRNA sequence
aaagataaaggtgataaata

SEQ ID NO: 322265 - DNA, 20 bp, Artificial
  CRISPR gRNA sequence
cctcccagccttgtccctta

SEQ ID NO: 322266 - DNA, 20 bp, Artificial
  CRISPR gRNA sequence
ccagccttgtcccttagctg

SEQ ID NO: 322267 - DNA, 20 bp, Artificial
  CRISPR gRNA sequence
gtcccttagctgtctagttt

SEQ ID NO: 322268 - DNA, 20 bp, Artificial
  CRISPR gRNA sequence
tcccttagctgtctagtttt

SEQ ID NO: 322269 - DNA, 20 bp, Artificial
  CRISPR gRNA sequence
agctgtctagttttcttcca

SEQ ID NO: 322270 - DNA, 20 bp, Artificial
  CRISPR gRNA sequence
gctgtctagttttcttccac

SEQ ID NO: 322271 - DNA, 20 bp, Artificial
  CRISPR gRNA sequence
tctagttttcttccacagag

SEQ ID NO: 322272 - DNA, 20 bp, Artificial
  CRISPR gRNA sequence
gttttcttccacagaggtaa

SEQ ID NO: 322273 - DNA, 20 bp, Artificial
  CRISPR gRNA sequence
tcttccacagaggtaacagg

SEQ ID NO: 322274 - DNA, 20 bp, Artificial
  CRISPR gRNA sequence
cttccacagaggtaacaggg

SEQ ID NO: 322275 - DNA, 20 bp, Artificial
  CRISPR gRNA sequence
ttccacagaggtaacagggg

SEQ ID NO: 322276 - DNA, 20 bp, Artificial
  CRISPR gRNA sequence
ccacagaggtaacaggggtg

SEQ ID NO: 322277 - DNA, 20 bp, Artificial
  CRISPR gRNA sequence
cacagaggtaacaggggtga

SEQ ID NO: 322278 - DNA, 20 bp, Artificial
  CRISPR gRNA sequence
ttacatgttaccagtttctt

SEQ ID NO: 322279 - DNA, 20 bp, Artificial
  CRISPR gRNA sequence
catgttaccagtttcttgcc

SEQ ID NO: 322280 - DNA, 20 bp, Artificial
  CRISPR gRNA sequence
ccagtttcttgcctctactt

SEQ ID NO: 322281 - DNA, 20 bp, Artificial
  CRISPR gRNA sequence
cttgcctctacttaaagtta

SEQ ID NO: 322282 - DNA, 20 bp, Artificial
  CRISPR gRNA sequence
ttgcctctacttaaagttac

SEQ ID NO: 322283 - DNA, 20 bp, Artificial
  CRISPR gRNA sequence
gcctctacttaaagttactt

SEQ ID NO: 322284 - DNA, 20 bp, Artificial
  CRISPR gRNA sequence
cctctacttaaagttacttt

SEQ ID NO: 322285 - DNA, 20 bp, Artificial
  CRISPR gRNA sequence
tacttaaagttactttagac

SEQ ID NO: 322286 - DNA, 20 bp, Artificial
  CRISPR gRNA sequence
cttaaagttactttagacaa

SEQ ID NO: 322287 - DNA, 20 bp, Artificial
  CRISPR gRNA sequence
aaagttactttagacaaaac

SEQ ID NO: 322288 - DNA, 20 bp, Artificial
  CRISPR gRNA sequence
aagttactttagacaaaact

SEQ ID NO: 322289 - DNA, 20 bp, Artificial
  CRISPR gRNA sequence
ctttagacaaaactaaacaa

SEQ ID NO: 322290 - DNA, 20 bp, Artificial
  CRISPR gRNA sequence
tagacaaaactaaacaaaaa

SEQ ID NO: 322291 - DNA, 20 bp, Artificial
  CRISPR gRNA sequence
agacaaaactaaacaaaaac

SEQ ID NO: 322292 - DNA, 20 bp, Artificial
  CRISPR gRNA sequence
gacaaaactaaacaaaaaca

SEQ ID NO: 322293 - DNA, 20 bp, Artificial
  CRISPR gRNA sequence
aacaaaaacattgacccata

SEQ ID NO: 322294 - DNA, 20 bp, Artificial
  CRISPR gRNA sequence
acccatattctgttttcttt

SEQ ID NO: 322295 - DNA, 20 bp, Artificial
  CRISPR gRNA sequence
tgttttctttttatttttaa

SEQ ID NO: 322296 - DNA, 20 bp, Artificial
  CRISPR gRNA sequence
ttttctttttatttttaagc

SEQ ID NO: 322297 - DNA, 20 bp, Artificial
  CRISPR gRNA sequence
tctttttatttttaagcaca

SEQ ID NO: 322298 - DNA, 20 bp, Artificial
  CRISPR gRNA sequence
ctttttatttttaagcacaa

SEQ ID NO: 322299 - DNA, 20 bp, Artificial
  CRISPR gRNA sequence
tttttatttttaagcacaaa

SEQ ID NO: 322300 - DNA, 20 bp, Artificial
  CRISPR gRNA sequence
tttatttttaagcacaaatg

SEQ ID NO: 322301 - DNA, 20 bp, Artificial
  CRISPR gRNA sequence
ttatttttaagcacaaatgg

SEQ ID NO: 322302 - DNA, 20 bp, Artificial
  CRISPR gRNA sequence
tatttttaagcacaaatggt

SEQ ID NO: 322303 - DNA, 20 bp, Artificial
  CRISPR gRNA sequence
atttttaagcacaaatggta

SEQ ID NO: 322304 - DNA, 20 bp, Artificial
  CRISPR gRNA sequence
tttttaagcacaaatggtag

SEQ ID NO: 322305 - DNA, 20 bp, Artificial
  CRISPR gRNA sequence
ttaagcacaaatggtagcat

SEQ ID NO: 322306 - DNA, 20 bp, Artificial
  CRISPR gRNA sequence
taagcacaaatggtagcata

SEQ ID NO: 322307 - DNA, 20 bp, Artificial
  CRISPR gRNA sequence
aagcacaaatggtagcatac

SEQ ID NO: 322308 - DNA, 20 bp, Artificial
  CRISPR gRNA sequence
agcacaaatggtagcatact

SEQ ID NO: 322309 - DNA, 20 bp, Artificial
  CRISPR gRNA sequence
tgtacggttttgcacacata

SEQ ID NO: 322310 - DNA, 20 bp, Artificial
  CRISPR gRNA sequence
tgcacacatatgactacctt

SEQ ID NO: 322311 - DNA, 20 bp, Artificial
  CRISPR gRNA sequence
gcacacatatgactaccttg

SEQ ID NO: 322312 - DNA, 20 bp, Artificial
  CRISPR gRNA sequence
cacacatatgactaccttgg

SEQ ID NO: 322313 - DNA, 20 bp, Artificial
  CRISPR gRNA sequence
ccttggagattattctgtat

SEQ ID NO: 322314 - DNA, 20 bp, Artificial
  CRISPR gRNA sequence
ggagattattctgtatcagc

SEQ ID NO: 322315 - DNA, 20 bp, Artificial
  CRISPR gRNA sequence
gagattattctgtatcagca

SEQ ID NO: 322316 - DNA, 20 bp, Artificial
  CRISPR gRNA sequence
ttctgtatcagcatgtaacg

SEQ ID NO: 322317 - DNA, 20 bp, Artificial
  CRISPR gRNA sequence
tgtatcagcatgtaacgagt

SEQ ID NO: 322318 - DNA, 20 bp, Artificial
  CRISPR gRNA sequence
tatcagcatgtaacgagtat

SEQ ID NO: 322319 - DNA, 20 bp, Artificial
  CRISPR gRNA sequence
atgctaaaagttgcatatta

SEQ ID NO: 322320 - DNA, 20 bp, Artificial
  CRISPR gRNA sequence
aaagttgcatattagtctat

SEQ ID NO: 322321 - DNA, 20 bp, Artificial
  CRISPR gRNA sequence
catattagtctattgtattc

SEQ ID NO: 322322 - DNA, 20 bp, Artificial
  CRISPR gRNA sequence
gtctattgtattctattgga

SEQ ID NO: 322323 - DNA, 20 bp, Artificial
  CRISPR gRNA sequence
ttgtattctattggatgaca

SEQ ID NO: 322324 - DNA, 20 bp, Artificial
  CRISPR gRNA sequence
tattctattggatgacaata

SEQ ID NO: 322325 - DNA, 20 bp, Artificial
  CRISPR gRNA sequence
tattggatgacaataatata

SEQ ID NO: 322326 - DNA, 20 bp, Artificial
  CRISPR gRNA sequence
ttggatgacaataatatata

SEQ ID NO: 322327 - DNA, 20 bp, Artificial
  CRISPR gRNA sequence
gatgacaataatatatatat

SEQ ID NO: 322328 - DNA, 20 bp, Artificial
  CRISPR gRNA sequence
ccagaccactagtgatggat

SEQ ID NO: 322329 - DNA, 20 bp, Artificial
  CRISPR gRNA sequence
cagaccactagtgatggata

SEQ ID NO: 322330 - DNA, 20 bp, Artificial
  CRISPR gRNA sequence
gtgatggatacttaacgttg

SEQ ID NO: 322331 - DNA, 20 bp, Artificial
  CRISPR gRNA sequence
aacgttgtttccaatctttt

SEQ ID NO: 322332 - DNA, 20 bp, Artificial
  CRISPR gRNA sequence
acgttgtttccaatcttttg

SEQ ID NO: 322333 - DNA, 20 bp, Artificial
  CRISPR gRNA sequence
tttccaatcttttgttgcaa

SEQ ID NO: 322334 - DNA, 20 bp, Artificial
  CRISPR gRNA sequence
ccaatcttttgttgcaatgg

SEQ ID NO: 322335 - DNA, 20 bp, Artificial
  CRISPR gRNA sequence
caatcttttgttgcaatgga

SEQ ID NO: 322336 - DNA, 20 bp, Artificial
  CRISPR gRNA sequence
ttgttgcaatggaaaacctt

SEQ ID NO: 322337 - DNA, 20 bp, Artificial
  CRISPR gRNA sequence
tgttgcaatggaaaaccttg

SEQ ID NO: 322338 - DNA, 20 bp, Artificial
  CRISPR gRNA sequence
gttgcaatggaaaaccttga

SEQ ID NO: 322339 - DNA, 20 bp, Artificial
  CRISPR gRNA sequence
ttgcaatggaaaaccttgat

SEQ ID NO: 322340 - DNA, 20 bp, Artificial
  CRISPR gRNA sequence
caatggaaaaccttgattat

SEQ ID NO: 322341 - DNA, 20 bp, Artificial
  CRISPR gRNA sequence
gattatatgccatatcacac

SEQ ID NO: 322342 - DNA, 20 bp, Artificial
  CRISPR gRNA sequence
attatatgccatatcacaca

SEQ ID NO: 322343 - DNA, 20 bp, Artificial
  CRISPR gRNA sequence
tatgccatatcacacaggtg

SEQ ID NO: 322344 - DNA, 20 bp, Artificial
  CRISPR gRNA sequence
tattcctagaagcagaatcg

SEQ ID NO: 322345 - DNA, 20 bp, Artificial
  CRISPR gRNA sequence
ctagaagcagaatcgtttga

SEQ ID NO: 322346 - DNA, 20 bp, Artificial
  CRISPR gRNA sequence
gaagcagaatcgtttgacca

SEQ ID NO: 322347 - DNA, 20 bp, Artificial
  CRISPR gRNA sequence
gaccaaagggttgaagaata

SEQ ID NO: 322348 - DNA, 20 bp, Artificial
  CRISPR gRNA sequence
accaaagggttgaagaatag

SEQ ID NO: 322349 - DNA, 20 bp, Artificial
  CRISPR gRNA sequence
aagaatagttgcaaattgtt

SEQ ID NO: 322350 - DNA, 20 bp, Artificial
  CRISPR gRNA sequence
caaattgttctcccctgaga

SEQ ID NO: 322351 - DNA, 20 bp, Artificial
  CRISPR gRNA sequence
ttctcccctgagattatacg

SEQ ID NO: 322352 - DNA, 20 bp, Artificial
  CRISPR gRNA sequence
tcccctgagattatacgttt

SEQ ID NO: 322353 - DNA, 20 bp, Artificial
  CRISPR gRNA sequence
ccctgagattatacgtttat

SEQ ID NO: 322354 - DNA, 20 bp, Artificial
  CRISPR gRNA sequence
agattatacgtttatgctct

SEQ ID NO: 322355 - DNA, 20 bp, Artificial
  CRISPR gRNA sequence
tacgtttatgctctgatcaa

SEQ ID NO: 322356 - DNA, 20 bp, Artificial
  CRISPR gRNA sequence
atgctctgatcaacacaaga

SEQ ID NO: 322357 - DNA, 20 bp, Artificial
  CRISPR gRNA sequence
tgctctgatcaacacaagag

SEQ ID NO: 322358 - DNA, 20 bp, Artificial
  CRISPR gRNA sequence
tgatcaacacaagagtgctt

SEQ ID NO: 322359 - DNA, 20 bp, Artificial
  CRISPR gRNA sequence
atcaacacaagagtgcttat

SEQ ID NO: 322360 - DNA, 20 bp, Artificial
  CRISPR gRNA sequence
attttcatgtaccttttgcc

SEQ ID NO: 322361 - DNA, 20 bp, Artificial
  CRISPR gRNA sequence
ttttcatgtaccttttgcca

SEQ ID NO: 322362 - DNA, 20 bp, Artificial
  CRISPR gRNA sequence
tcatgtaccttttgccaaca

SEQ ID NO: 322363 - DNA, 20 bp, Artificial
  CRISPR gRNA sequence
catgtaccttttgccaacat

SEQ ID NO: 322364 - DNA, 20 bp, Artificial
  CRISPR gRNA sequence
atgtaccttttgccaacatg

SEQ ID NO: 322365 - DNA, 20 bp, Artificial
  CRISPR gRNA sequence
ttgccaacatgttttctaat

SEQ ID NO: 322366 - DNA, 20 bp, Artificial
  CRISPR gRNA sequence
tgccaacatgttttctaatt

SEQ ID NO: 322367 - DNA, 20 bp, Artificial
  CRISPR gRNA sequence
gccaacatgttttctaattt

SEQ ID NO: 322368 - DNA, 20 bp, Artificial
  CRISPR gRNA sequence
ccaacatgttttctaatttg

SEQ ID NO: 322369 - DNA, 20 bp, Artificial
  CRISPR gRNA sequence
tctaatttgtgatctttagc

SEQ ID NO: 322370 - DNA, 20 bp, Artificial
  CRISPR gRNA sequence
ctaatttgtgatctttagca

SEQ ID NO: 322371 - DNA, 20 bp, Artificial
  CRISPR gRNA sequence
taatttgtgatctttagcaa

SEQ ID NO: 322372 - DNA, 20 bp, Artificial
  CRISPR gRNA sequence
atttgtgatctttagcaata

SEQ ID NO: 322373 - DNA, 20 bp, Artificial
  CRISPR gRNA sequence
gtgatctttagcaataggaa

SEQ ID NO: 322374 - DNA, 20 bp, Artificial
  CRISPR gRNA sequence
tgatctttagcaataggaaa

SEQ ID NO: 322375 - DNA, 20 bp, Artificial
  CRISPR gRNA sequence
tagcaataggaaatggtgaa

SEQ ID NO: 322376 - DNA, 20 bp, Artificial
  CRISPR gRNA sequence
agcaataggaaatggtgaaa

SEQ ID NO: 322377 - DNA, 20 bp, Artificial
  CRISPR gRNA sequence
gcaataggaaatggtgaaat

SEQ ID NO: 322378 - DNA, 20 bp, Artificial
  CRISPR gRNA sequence
catctcataagttttagaaa

SEQ ID NO: 322379 - DNA, 20 bp, Artificial
  CRISPR gRNA sequence
ataagttttagaaatctttg

SEQ ID NO: 322380 - DNA, 20 bp, Artificial
  CRISPR gRNA sequence
tagaaatctttgttatttag

SEQ ID NO: 322381 - DNA, 20 bp, Artificial
  CRISPR gRNA sequence
agaaatctttgttatttaga

SEQ ID NO: 322382 - DNA, 20 bp, Artificial
  CRISPR gRNA sequence
gaaatctttgttatttagaa

SEQ ID NO: 322383 - DNA, 20 bp, Artificial
  CRISPR gRNA sequence
tgttatttagaaatctttat

SEQ ID NO: 322384 - DNA, 20 bp, Artificial
  CRISPR gRNA sequence
gttatttagaaatctttatt

SEQ ID NO: 322385 - DNA, 20 bp, Artificial
  CRISPR gRNA sequence
ttatttagaaatctttatta

SEQ ID NO: 322386 - DNA, 20 bp, Artificial
  CRISPR gRNA sequence
tttagaaatctttattagtt

SEQ ID NO: 322387 - DNA, 20 bp, Artificial
  CRISPR gRNA sequence
agaaatctttattagtttat

SEQ ID NO: 322388 - DNA, 20 bp, Artificial
  CRISPR gRNA sequence
gaaatctttattagtttatg

SEQ ID NO: 322389 - DNA, 20 bp, Artificial
  CRISPR gRNA sequence
tattagtttatgagattata

SEQ ID NO: 322390 - DNA, 20 bp, Artificial
  CRISPR gRNA sequence
attagtttatgagattatac

SEQ ID NO: 322391 - DNA, 20 bp, Artificial
  CRISPR gRNA sequence
ttagtttatgagattatacg

SEQ ID NO: 322392 - DNA, 20 bp, Artificial
  CRISPR gRNA sequence
gtttatgagattatacgttt

SEQ ID NO: 322393 - DNA, 20 bp, Artificial
  CRISPR gRNA sequence
atgagattatacgtttatgc

SEQ ID NO: 322394 - DNA, 20 bp, Artificial
  CRISPR gRNA sequence
tgagattatacgtttatgct

SEQ ID NO: 322395 - DNA, 20 bp, Artificial
  CRISPR gRNA sequence
tacgtttatgctctgatcaa

SEQ ID NO: 322396 - DNA, 20 bp, Artificial
  CRISPR gRNA sequence
atgctctgatcaacacaaga

SEQ ID NO: 322397 - DNA, 20 bp, Artificial
  CRISPR gRNA sequence
tgctctgatcaacacaagag

SEQ ID NO: 322398 - DNA, 20 bp, Artificial
  CRISPR gRNA sequence
tgatcaacacaagagtgctt

SEQ ID NO: 322399 - DNA, 20 bp, Artificial
  CRISPR gRNA sequence
atcaacacaagagtgcttat

SEQ ID NO: 322400 - DNA, 20 bp, Artificial
  CRISPR gRNA sequence
attttcatgtaccttttgcc

SEQ ID NO: 322401 - DNA, 20 bp, Artificial
  CRISPR gRNA sequence
ttttcatgtaccttttgcca

SEQ ID NO: 322402 - DNA, 20 bp, Artificial
  CRISPR gRNA sequence
tcatgtaccttttgccaacg

SEQ ID NO: 322403 - DNA, 20 bp, Artificial
  CRISPR gRNA sequence
catgtaccttttgccaacgt

SEQ ID NO: 322404 - DNA, 20 bp, Artificial
  CRISPR gRNA sequence
atgtaccttttgccaacgtg

SEQ ID NO: 322405 - DNA, 20 bp, Artificial
  CRISPR gRNA sequence
ttgccaacgtgttttctaat

SEQ ID NO: 322406 - DNA, 20 bp, Artificial
  CRISPR gRNA sequence
tgccaacgtgttttctaatt

SEQ ID NO: 322407 - DNA, 20 bp, Artificial
  CRISPR gRNA sequence
gccaacgtgttttctaattt

SEQ ID NO: 322408 - DNA, 20 bp, Artificial
  CRISPR gRNA sequence
ccaacgtgttttctaatttg

SEQ ID NO: 322409 - DNA, 20 bp, Artificial
  CRISPR gRNA sequence
tctaatttgtgatctttagc

SEQ ID NO: 322410 - DNA, 20 bp, Artificial
  CRISPR gRNA sequence
ctaatttgtgatctttagca

SEQ ID NO: 322411 - DNA, 20 bp, Artificial
  CRISPR gRNA sequence
taatttgtgatctttagcaa

SEQ ID NO: 322412 - DNA, 20 bp, Artificial
  CRISPR gRNA sequence
atttgtgatctttagcaata

SEQ ID NO: 322413 - DNA, 20 bp, Artificial
  CRISPR gRNA sequence
gtgatctttagcaataggaa

SEQ ID NO: 322414 - DNA, 20 bp, Artificial
  CRISPR gRNA sequence
tgatctttagcaataggaaa

SEQ ID NO: 322415 - DNA, 20 bp, Artificial
  CRISPR gRNA sequence
tagcaataggaaacggtgaa

SEQ ID NO: 322416 - DNA, 20 bp, Artificial
  CRISPR gRNA sequence
agcaataggaaacggtgaaa

SEQ ID NO: 322417 - DNA, 20 bp, Artificial
  CRISPR gRNA sequence
gcaataggaaacggtgaaat

SEQ ID NO: 322418 - DNA, 20 bp, Artificial
  CRISPR gRNA sequence
gatctcataagttttagaaa

SEQ ID NO: 322419 - DNA, 20 bp, Artificial
  CRISPR gRNA sequence
ataagttttagaaatcttta

SEQ ID NO: 322420 - DNA, 20 bp, Artificial
  CRISPR gRNA sequence
tagaaatctttattagttgt

SEQ ID NO: 322421 - DNA, 20 bp, Artificial
  CRISPR gRNA sequence
agaaatctttattagttgtg

SEQ ID NO: 322422 - DNA, 20 bp, Artificial
  CRISPR gRNA sequence
gaaatctttattagttgtgg

SEQ ID NO: 322423 - DNA, 20 bp, Artificial
  CRISPR gRNA sequence
tattagttgtggcataatac

SEQ ID NO: 322424 - DNA, 20 bp, Artificial
  CRISPR gRNA sequence
attagttgtggcataataca

SEQ ID NO: 322425 - DNA, 20 bp, Artificial
  CRISPR gRNA sequence
ttagttgtggcataatacac

SEQ ID NO: 322426 - DNA, 20 bp, Artificial
  CRISPR gRNA sequence
gttgtggcataatacacata

SEQ ID NO: 322427 - DNA, 20 bp, Artificial
  CRISPR gRNA sequence
tggcataatacacataaaat

SEQ ID NO: 322428 - DNA, 20 bp, Artificial
  CRISPR gRNA sequence
gccatcttcaccttttgagt

SEQ ID NO: 322429 - DNA, 20 bp, Artificial
  CRISPR gRNA sequence
ccatcttcaccttttgagtg

SEQ ID NO: 322430 - DNA, 20 bp, Artificial
  CRISPR gRNA sequence
caccttttgagtgtacagtg

SEQ ID NO: 322431 - DNA, 20 bp, Artificial
  CRISPR gRNA sequence
accttttgagtgtacagtgg

SEQ ID NO: 322432 - DNA, 20 bp, Artificial
  CRISPR gRNA sequence
ttgagtgtacagtggtatga

SEQ ID NO: 322433 - DNA, 20 bp, Artificial
  CRISPR gRNA sequence
tgagtgtacagtggtatgaa

SEQ ID NO: 322434 - DNA, 20 bp, Artificial
  CRISPR gRNA sequence
gagtgtacagtggtatgaaa

SEQ ID NO: 322435 - DNA, 20 bp, Artificial
  CRISPR gRNA sequence
agtgtacagtggtatgaaat

SEQ ID NO: 322436 - DNA, 20 bp, Artificial
  CRISPR gRNA sequence
acattgttgtacagtcatca

SEQ ID NO: 322437 - DNA, 20 bp, Artificial
  CRISPR gRNA sequence
ttgtacagtcatcactacat

SEQ ID NO: 322438 - DNA, 20 bp, Artificial
  CRISPR gRNA sequence
tacagtcatcactacatcca

SEQ ID NO: 322439 - DNA, 20 bp, Artificial
  CRISPR gRNA sequence
catccatcttcagaactctt

SEQ ID NO: 322440 - DNA, 20 bp, Artificial
  CRISPR gRNA sequence
cagaactctttcatcttgca

SEQ ID NO: 322441 - DNA, 20 bp, Artificial
  CRISPR gRNA sequence
agaactctttcatcttgcaa

SEQ ID NO: 322442 - DNA, 20 bp, Artificial
  CRISPR gRNA sequence
tttcatcttgcaaaactaag

SEQ ID NO: 322443 - DNA, 20 bp, Artificial
  CRISPR gRNA sequence
tcatcttgcaaaactaagcc

SEQ ID NO: 322444 - DNA, 20 bp, Artificial
  CRISPR gRNA sequence
catcttgcaaaactaagcct

SEQ ID NO: 322445 - DNA, 20 bp, Artificial
  CRISPR gRNA sequence
atcttgcaaaactaagcctc

SEQ ID NO: 322446 - DNA, 20 bp, Artificial
  CRISPR gRNA sequence
gcaaaactaagcctctatac

SEQ ID NO: 322447 - DNA, 20 bp, Artificial
  CRISPR gRNA sequence
caaaactaagcctctatacc

SEQ ID NO: 322448 - DNA, 20 bp, Artificial
  CRISPR gRNA sequence
agcctctatacctattaaac

SEQ ID NO: 322449 - DNA, 20 bp, Artificial
  CRISPR gRNA sequence
tatacctattaaacaataac

SEQ ID NO: 322450 - DNA, 20 bp, Artificial
  CRISPR gRNA sequence
tacctattaaacaataactc

SEQ ID NO: 322451 - DNA, 20 bp, Artificial
  CRISPR gRNA sequence
ttaaacaataactcttcttt

SEQ ID NO: 322452 - DNA, 20 bp, Artificial
  CRISPR gRNA sequence
aacaataactcttctttctc

SEQ ID NO: 322453 - DNA, 20 bp, Artificial
  CRISPR gRNA sequence
ttctttctctcctcctctca

SEQ ID NO: 322454 - DNA, 20 bp, Artificial
  CRISPR gRNA sequence
ctttctctcctcctctcagc

SEQ ID NO: 322455 - DNA, 20 bp, Artificial
  CRISPR gRNA sequence
tttctctcctcctctcagct

SEQ ID NO: 322456 - DNA, 20 bp, Artificial
  CRISPR gRNA sequence
tctctcctcctctcagctct

SEQ ID NO: 322457 - DNA, 20 bp, Artificial
  CRISPR gRNA sequence
ctctcctcctctcagctctt

SEQ ID NO: 322458 - DNA, 20 bp, Artificial
  CRISPR gRNA sequence
tctcctcctctcagctcttg

SEQ ID NO: 322459 - DNA, 20 bp, Artificial
  CRISPR gRNA sequence
tcctcctctcagctcttgcc

SEQ ID NO: 322460 - DNA, 20 bp, Artificial
  CRISPR gRNA sequence
ctcctctcagctcttgccaa

SEQ ID NO: 322461 - DNA, 20 bp, Artificial
  CRISPR gRNA sequence
ctctcagctcttgccaacca

SEQ ID NO: 322462 - DNA, 20 bp, Artificial
  CRISPR gRNA sequence
tcagctcttgccaaccacca

SEQ ID NO: 322463 - DNA, 20 bp, Artificial
  CRISPR gRNA sequence
agctcttgccaaccaccatt

SEQ ID NO: 322464 - DNA, 20 bp, Artificial
  CRISPR gRNA sequence
ttgccaaccaccattccacc

SEQ ID NO: 322465 - DNA, 20 bp, Artificial
  CRISPR gRNA sequence
gccaaccaccattccacctt

SEQ ID NO: 322466 - DNA, 20 bp, Artificial
  CRISPR gRNA sequence
ccaaccaccattccaccttc

SEQ ID NO: 322467 - DNA, 20 bp, Artificial
  CRISPR gRNA sequence
caccttctgtttccatgaat

SEQ ID NO: 322468 - DNA, 20 bp, Artificial
  CRISPR gRNA sequence
ctgtttccatgaatttgact

SEQ ID NO: 322469 - DNA, 20 bp, Artificial
  CRISPR gRNA sequence
tgtttccatgaatttgactg

SEQ ID NO: 322470 - DNA, 20 bp, Artificial
  CRISPR gRNA sequence
tttccatgaatttgactgct

SEQ ID NO: 322471 - DNA, 20 bp, Artificial
  CRISPR gRNA sequence
ccatgaatttgactgcttag

SEQ ID NO: 322472 - DNA, 20 bp, Artificial
  CRISPR gRNA sequence
catgaatttgactgcttagg

SEQ ID NO: 322473 - DNA, 20 bp, Artificial
  CRISPR gRNA sequence
gactgcttagggtataagta

SEQ ID NO: 322474 - DNA, 20 bp, Artificial
  CRISPR gRNA sequence
actgcttagggtataagtaa

SEQ ID NO: 322475 - DNA, 20 bp, Artificial
  CRISPR gRNA sequence
cttagggtataagtaaactc

SEQ ID NO: 322476 - DNA, 20 bp, Artificial
  CRISPR gRNA sequence
agggtataagtaaactcata

SEQ ID NO: 322477 - DNA, 20 bp, Artificial
  CRISPR gRNA sequence
gggtataagtaaactcatac

SEQ ID NO: 322478 - DNA, 20 bp, Artificial
  CRISPR gRNA sequence
atacagtatttgtctttttg

SEQ ID NO: 322479 - DNA, 20 bp, Artificial
  CRISPR gRNA sequence
gtctttttgtgactggctta

SEQ ID NO: 322480 - DNA, 20 bp, Artificial
  CRISPR gRNA sequence
tctttttgtgactggcttat

SEQ ID NO: 322481 - DNA, 20 bp, Artificial
  CRISPR gRNA sequence
tttgtgactggcttatttca

SEQ ID NO: 322482 - DNA, 20 bp, Artificial
  CRISPR gRNA sequence
ttgtgactggcttatttcac

SEQ ID NO: 322483 - DNA, 20 bp, Artificial
  CRISPR gRNA sequence
tgtgactggcttatttcact

SEQ ID NO: 322484 - DNA, 20 bp, Artificial
  CRISPR gRNA sequence
gtgactggcttatttcactt

SEQ ID NO: 322485 - DNA, 20 bp, Artificial
  CRISPR gRNA sequence
tgactggcttatttcactta

SEQ ID NO: 322486 - DNA, 20 bp, Artificial
  CRISPR gRNA sequence
gcttatttcacttagtataa

SEQ ID NO: 322487 - DNA, 20 bp, Artificial
  CRISPR gRNA sequence
atttcacttagtataatgta

SEQ ID NO: 322488 - DNA, 20 bp, Artificial
  CRISPR gRNA sequence
tttcacttagtataatgtat

SEQ ID NO: 322489 - DNA, 20 bp, Artificial
  CRISPR gRNA sequence
cacttagtataatgtattca

SEQ ID NO: 322490 - DNA, 20 bp, Artificial
  CRISPR gRNA sequence
acttagtataatgtattcaa

SEQ ID NO: 322491 - DNA, 20 bp, Artificial
  CRISPR gRNA sequence
agtataatgtattcaagggc

SEQ ID NO: 322492 - DNA, 20 bp, Artificial
  CRISPR gRNA sequence
gtataatgtattcaagggcc

SEQ ID NO: 322493 - DNA, 20 bp, Artificial
  CRISPR gRNA sequence
aagggccatccacattgtag

SEQ ID NO: 322494 - DNA, 20 bp, Artificial
  CRISPR gRNA sequence
tagcatgtgtttgaatttcc

SEQ ID NO: 322495 - DNA, 20 bp, Artificial
  CRISPR gRNA sequence
gaatttcctttctttctaag

SEQ ID NO: 322496 - DNA, 20 bp, Artificial
  CRISPR gRNA sequence
aatttcctttctttctaaga

SEQ ID NO: 322497 - DNA, 20 bp, Artificial
  CRISPR gRNA sequence
cctttctttctaagactaaa

SEQ ID NO: 322498 - DNA, 20 bp, Artificial
  CRISPR gRNA sequence
ctttctttctaagactaaat

SEQ ID NO: 322499 - DNA, 20 bp, Artificial
  CRISPR gRNA sequence
tctttctaagactaaatgat

SEQ ID NO: 322500 - DNA, 20 bp, Artificial
  CRISPR gRNA sequence
ctttctaagactaaatgata

SEQ ID NO: 322501 - DNA, 20 bp, Artificial
  CRISPR gRNA sequence
tttctaagactaaatgatat

SEQ ID NO: 322502 - DNA, 20 bp, Artificial
  CRISPR gRNA sequence
tctaagactaaatgatattc

SEQ ID NO: 322503 - DNA, 20 bp, Artificial
  CRISPR gRNA sequence
ctaagactaaatgatattcc

SEQ ID NO: 322504 - DNA, 20 bp, Artificial
  CRISPR gRNA sequence
taagactaaatgatattcca

SEQ ID NO: 322505 - DNA, 20 bp, Artificial
  CRISPR gRNA sequence
agactaaatgatattccact

SEQ ID NO: 322506 - DNA, 20 bp, Artificial
  CRISPR gRNA sequence
aatgatattccactgtatgt

SEQ ID NO: 322507 - DNA, 20 bp, Artificial
  CRISPR gRNA sequence
cactgtatgtacatactaca

SEQ ID NO: 322508 - DNA, 20 bp, Artificial
  CRISPR gRNA sequence
tatgtacatactacattttg

SEQ ID NO: 322509 - DNA, 20 bp, Artificial
  CRISPR gRNA sequence
cattttgtttatccattcat

SEQ ID NO: 322510 - DNA, 20 bp, Artificial
  CRISPR gRNA sequence
tgtttatccattcatttttg

SEQ ID NO: 322511 - DNA, 20 bp, Artificial
  CRISPR gRNA sequence
gtttatccattcatttttga

SEQ ID NO: 322512 - DNA, 20 bp, Artificial
  CRISPR gRNA sequence
tttatccattcatttttgat

SEQ ID NO: 322513 - DNA, 20 bp, Artificial
  CRISPR gRNA sequence
atccattcatttttgatgga

SEQ ID NO: 322514 - DNA, 20 bp, Artificial
  CRISPR gRNA sequence
tccattcatttttgatggac

SEQ ID NO: 322515 - DNA, 20 bp, Artificial
  CRISPR gRNA sequence
atttttgatggacatttgag

SEQ ID NO: 322516 - DNA, 20 bp, Artificial
  CRISPR gRNA sequence
ttgatggacatttgagttgc

SEQ ID NO: 322517 - DNA, 20 bp, Artificial
  CRISPR gRNA sequence
tgatggacatttgagttgct

SEQ ID NO: 322518 - DNA, 20 bp, Artificial
  CRISPR gRNA sequence
gatggacatttgagttgctt

SEQ ID NO: 322519 - DNA, 20 bp, Artificial
  CRISPR gRNA sequence
atggacatttgagttgcttc

SEQ ID NO: 322520 - DNA, 20 bp, Artificial
  CRISPR gRNA sequence
gagttgcttccaccttttgg

SEQ ID NO: 322521 - DNA, 20 bp, Artificial
  CRISPR gRNA sequence
agttgcttccaccttttggc

SEQ ID NO: 322522 - DNA, 20 bp, Artificial
  CRISPR gRNA sequence
cttccaccttttggctattg

SEQ ID NO: 322523 - DNA, 20 bp, Artificial
  CRISPR gRNA sequence
ccaccttttggctattgtgc

SEQ ID NO: 322524 - DNA, 20 bp, Artificial
  CRISPR gRNA sequence
caccttttggctattgtgca

SEQ ID NO: 322525 - DNA, 20 bp, Artificial
  CRISPR gRNA sequence
ttggctattgtgcataatgc

SEQ ID NO: 322526 - DNA, 20 bp, Artificial
  CRISPR gRNA sequence
tggctattgtgcataatgct

SEQ ID NO: 322527 - DNA, 20 bp, Artificial
  CRISPR gRNA sequence
ggctattgtgcataatgctg

SEQ ID NO: 322528 - DNA, 20 bp, Artificial
  CRISPR gRNA sequence
gctattgtgcataatgctgg

SEQ ID NO: 322529 - DNA, 20 bp, Artificial
  CRISPR gRNA sequence
ttgtgcataatgctggtatg

SEQ ID NO: 322530 - DNA, 20 bp, Artificial
  CRISPR gRNA sequence
tgcataatgctggtatgaac

SEQ ID NO: 322531 - DNA, 20 bp, Artificial
  CRISPR gRNA sequence
gtatgaacaaggctgtatga

SEQ ID NO: 322532 - DNA, 20 bp, Artificial
  CRISPR gRNA sequence
tatgaatatctctttaagac

SEQ ID NO: 322533 - DNA, 20 bp, Artificial
  CRISPR gRNA sequence
tttaagactctgctttcagt

SEQ ID NO: 322534 - DNA, 20 bp, Artificial
  CRISPR gRNA sequence
taagactctgctttcagttc

SEQ ID NO: 322535 - DNA, 20 bp, Artificial
  CRISPR gRNA sequence
aagactctgctttcagttct

SEQ ID NO: 322536 - DNA, 20 bp, Artificial
  CRISPR gRNA sequence
agactctgctttcagttctt

SEQ ID NO: 322537 - DNA, 20 bp, Artificial
  CRISPR gRNA sequence
tgctttcagttcttttgggt

SEQ ID NO: 322538 - DNA, 20 bp, Artificial
  CRISPR gRNA sequence
ctttcagttcttttgggtat

SEQ ID NO: 322539 - DNA, 20 bp, Artificial
  CRISPR gRNA sequence
tcagttcttttgggtatata

SEQ ID NO: 322540 - DNA, 20 bp, Artificial
  CRISPR gRNA sequence
cagttcttttgggtatatac

SEQ ID NO: 322541 - DNA, 20 bp, Artificial
  CRISPR gRNA sequence
agttcttttgggtatatacc

SEQ ID NO: 322542 - DNA, 20 bp, Artificial
  CRISPR gRNA sequence
ttttgggtatatacccagaa

SEQ ID NO: 322543 - DNA, 20 bp, Artificial
  CRISPR gRNA sequence
ttgggtatatacccagaagg

SEQ ID NO: 322544 - DNA, 20 bp, Artificial
  CRISPR gRNA sequence
tgggtatatacccagaaggg

SEQ ID NO: 322545 - DNA, 20 bp, Artificial
  CRISPR gRNA sequence
gggtatatacccagaagggg

SEQ ID NO: 322546 - DNA, 20 bp, Artificial
  CRISPR gRNA sequence
ggtatatacccagaagggga

SEQ ID NO: 322547 - DNA, 20 bp, Artificial
  CRISPR gRNA sequence
ctagatcatgtggtcattct

SEQ ID NO: 322548 - DNA, 20 bp, Artificial
  CRISPR gRNA sequence
gatcatgtggtcattctatt

SEQ ID NO: 322549 - DNA, 20 bp, Artificial
  CRISPR gRNA sequence
tatttttaattttctgagga

SEQ ID NO: 322550 - DNA, 20 bp, Artificial
  CRISPR gRNA sequence
tttttaattttctgaggaac

SEQ ID NO: 322551 - DNA, 20 bp, Artificial
  CRISPR gRNA sequence
ttaattttctgaggaactgc

SEQ ID NO: 322552 - DNA, 20 bp, Artificial
  CRISPR gRNA sequence
taattttctgaggaactgct

SEQ ID NO: 322553 - DNA, 20 bp, Artificial
  CRISPR gRNA sequence
aattttctgaggaactgcta

SEQ ID NO: 322554 - DNA, 20 bp, Artificial
  CRISPR gRNA sequence
attttctgaggaactgctac

SEQ ID NO: 322555 - DNA, 20 bp, Artificial
  CRISPR gRNA sequence
tctgaggaactgctacacta

SEQ ID NO: 322556 - DNA, 20 bp, Artificial
  CRISPR gRNA sequence
ctgaggaactgctacactat

SEQ ID NO: 322557 - DNA, 20 bp, Artificial
  CRISPR gRNA sequence
tgaggaactgctacactatt

SEQ ID NO: 322558 - DNA, 20 bp, Artificial
  CRISPR gRNA sequence
aggaactgctacactatttt

SEQ ID NO: 322559 - DNA, 20 bp, Artificial
  CRISPR gRNA sequence
ctacactattttccatagca

SEQ ID NO: 322560 - DNA, 20 bp, Artificial
  CRISPR gRNA sequence
cactattttccatagcagcg

SEQ ID NO: 322561 - DNA, 20 bp, Artificial
  CRISPR gRNA sequence
ttttccatagcagcgacatc

SEQ ID NO: 322562 - DNA, 20 bp, Artificial
  CRISPR gRNA sequence
tccatagcagcgacatcact

SEQ ID NO: 322563 - DNA, 20 bp, Artificial
  CRISPR gRNA sequence
ccatagcagcgacatcactt

SEQ ID NO: 322564 - DNA, 20 bp, Artificial
  CRISPR gRNA sequence
catagcagcgacatcacttt

SEQ ID NO: 322565 - DNA, 20 bp, Artificial
  CRISPR gRNA sequence
tacattcccatcgacaactg

SEQ ID NO: 322566 - DNA, 20 bp, Artificial
  CRISPR gRNA sequence
acattcccatcgacaactgg

SEQ ID NO: 322567 - DNA, 20 bp, Artificial
  CRISPR gRNA sequence
cattcccatcgacaactgga

SEQ ID NO: 322568 - DNA, 20 bp, Artificial
  CRISPR gRNA sequence
ccatcgacaactggaacaag

SEQ ID NO: 322569 - DNA, 20 bp, Artificial
  CRISPR gRNA sequence
gaacaagagctccaatttct

SEQ ID NO: 322570 - DNA, 20 bp, Artificial
  CRISPR gRNA sequence
caatttctccacatccttgc

SEQ ID NO: 322571 - DNA, 20 bp, Artificial
  CRISPR gRNA sequence
ctccacatccttgccaacac

SEQ ID NO: 322572 - DNA, 20 bp, Artificial
  CRISPR gRNA sequence
tccacatccttgccaacact

SEQ ID NO: 322573 - DNA, 20 bp, Artificial
  CRISPR gRNA sequence
cacatccttgccaacacttg

SEQ ID NO: 322574 - DNA, 20 bp, Artificial
  CRISPR gRNA sequence
gccaacacttgttcaattct

SEQ ID NO: 322575 - DNA, 20 bp, Artificial
  CRISPR gRNA sequence
ccaacacttgttcaattctc

SEQ ID NO: 322576 - DNA, 20 bp, Artificial
  CRISPR gRNA sequence
gttcaattctcatattctgt

SEQ ID NO: 322577 - DNA, 20 bp, Artificial
  CRISPR gRNA sequence
ttcaattctcatattctgtg

SEQ ID NO: 322578 - DNA, 20 bp, Artificial
  CRISPR gRNA sequence
aattctcatattctgtgata

SEQ ID NO: 322579 - DNA, 20 bp, Artificial
  CRISPR gRNA sequence
tcatattctgtgataagtag

SEQ ID NO: 322580 - DNA, 20 bp, Artificial
  CRISPR gRNA sequence
atattctgtgataagtaggt

SEQ ID NO: 322581 - DNA, 20 bp, Artificial
  CRISPR gRNA sequence
tgtgataagtaggttgctgt

SEQ ID NO: 322582 - DNA, 20 bp, Artificial
  CRISPR gRNA sequence
tgataagtaggttgctgttg

SEQ ID NO: 322583 - DNA, 20 bp, Artificial
  CRISPR gRNA sequence
ctgttggtgatttagtatga

SEQ ID NO: 322584 - DNA, 20 bp, Artificial
  CRISPR gRNA sequence
ttggtgatttagtatgagga

SEQ ID NO: 322585 - DNA, 20 bp, Artificial
  CRISPR gRNA sequence
gtgatttagtatgaggaagc

SEQ ID NO: 322586 - DNA, 20 bp, Artificial
  CRISPR gRNA sequence
agtatgaggaagctcacagg

SEQ ID NO: 322587 - DNA, 20 bp, Artificial
  CRISPR gRNA sequence
gtatgaggaagctcacagga

SEQ ID NO: 322588 - DNA, 20 bp, Artificial
  CRISPR gRNA sequence
acaggaatcagacagagaac

SEQ ID NO: 322589 - DNA, 20 bp, Artificial
  CRISPR gRNA sequence
tgttcccatactctgcgctt

SEQ ID NO: 322590 - DNA, 20 bp, Artificial
  CRISPR gRNA sequence
ttcccatactctgcgcttgt

SEQ ID NO: 322591 - DNA, 20 bp, Artificial
  CRISPR gRNA sequence
ccatactctgcgcttgtgtg

SEQ ID NO: 322592 - DNA, 20 bp, Artificial
  CRISPR gRNA sequence
tgcgcttgtgtggtgtcagc

SEQ ID NO: 322593 - DNA, 20 bp, Artificial
  CRISPR gRNA sequence
cgcttgtgtggtgtcagctt

SEQ ID NO: 322594 - DNA, 20 bp, Artificial
  CRISPR gRNA sequence
gtgtggtgtcagctttggct

SEQ ID NO: 322595 - DNA, 20 bp, Artificial
  CRISPR gRNA sequence
tgtggtgtcagctttggctc

SEQ ID NO: 322596 - DNA, 20 bp, Artificial
  CRISPR gRNA sequence
tggctcaataggtaatgccc

SEQ ID NO: 322597 - DNA, 20 bp, Artificial
  CRISPR gRNA sequence
ggctcaataggtaatgccca

SEQ ID NO: 322598 - DNA, 20 bp, Artificial
  CRISPR gRNA sequence
gctcaataggtaatgcccaa

SEQ ID NO: 322599 - DNA, 20 bp, Artificial
  CRISPR gRNA sequence
aataggtaatgcccaaactc

SEQ ID NO: 322600 - DNA, 20 bp, Artificial
  CRISPR gRNA sequence
tgaaatctattggctggaag

SEQ ID NO: 322601 - DNA, 20 bp, Artificial
  CRISPR gRNA sequence
aaatctattggctggaaggg

SEQ ID NO: 322602 - DNA, 20 bp, Artificial
  CRISPR gRNA sequence
ttggctggaagggagggaga

SEQ ID NO: 322603 - DNA, 20 bp, Artificial
  CRISPR gRNA sequence
gctggaagggagggagacag

SEQ ID NO: 322604 - DNA, 20 bp, Artificial
  CRISPR gRNA sequence
gaagggagggagacagcaat

SEQ ID NO: 322605 - DNA, 20 bp, Artificial
  CRISPR gRNA sequence
ttcagctcttacatggaaca

SEQ ID NO: 322606 - DNA, 20 bp, Artificial
  CRISPR gRNA sequence
agctcttacatggaacacct

SEQ ID NO: 322607 - DNA, 20 bp, Artificial
  CRISPR gRNA sequence
ttacatggaacacctactgt

SEQ ID NO: 322608 - DNA, 20 bp, Artificial
  CRISPR gRNA sequence
acatggaacacctactgtgt

SEQ ID NO: 322609 - DNA, 20 bp, Artificial
  CRISPR gRNA sequence
catggaacacctactgtgta

SEQ ID NO: 322610 - DNA, 20 bp, Artificial
  CRISPR gRNA sequence
ctgtgtatttcagcaactga

SEQ ID NO: 322611 - DNA, 20 bp, Artificial
  CRISPR gRNA sequence
tgtatttcagcaactgaaaa

SEQ ID NO: 322612 - DNA, 20 bp, Artificial
  CRISPR gRNA sequence
cagcaactgaaaatatttgc

SEQ ID NO: 322613 - DNA, 20 bp, Artificial
  CRISPR gRNA sequence
agcaactgaaaatatttgca

SEQ ID NO: 322614 - DNA, 20 bp, Artificial
  CRISPR gRNA sequence
aaaatatttgcaactagtca

SEQ ID NO: 322615 - DNA, 20 bp, Artificial
  CRISPR gRNA sequence
gcaactagtcacaaagtatt

SEQ ID NO: 322616 - DNA, 20 bp, Artificial
  CRISPR gRNA sequence
caactagtcacaaagtatta

SEQ ID NO: 322617 - DNA, 20 bp, Artificial
  CRISPR gRNA sequence
gtcacaaagtattaattttc

SEQ ID NO: 322618 - DNA, 20 bp, Artificial
  CRISPR gRNA sequence
attttctatgtataaaagag

SEQ ID NO: 322619 - DNA, 20 bp, Artificial
  CRISPR gRNA sequence
tctatgtataaaagagcttc

SEQ ID NO: 322620 - DNA, 20 bp, Artificial
  CRISPR gRNA sequence
ctatgtataaaagagcttct

SEQ ID NO: 322621 - DNA, 20 bp, Artificial
  CRISPR gRNA sequence
tatgtataaaagagcttcta

SEQ ID NO: 322622 - DNA, 20 bp, Artificial
  CRISPR gRNA sequence
tgtataaaagagcttctata

SEQ ID NO: 322623 - DNA, 20 bp, Artificial
  CRISPR gRNA sequence
ctataaatcaataagaaaaa

SEQ ID NO: 322624 - DNA, 20 bp, Artificial
  CRISPR gRNA sequence
tataaatcaataagaaaaag

SEQ ID NO: 322625 - DNA, 20 bp, Artificial
  CRISPR gRNA sequence
taaatcaataagaaaaaggc

SEQ ID NO: 322626 - DNA, 20 bp, Artificial
  CRISPR gRNA sequence
aaagcgggcaaaagaaatgt

SEQ ID NO: 322627 - DNA, 20 bp, Artificial
  CRISPR gRNA sequence
gaaataactatctcatacat

SEQ ID NO: 322628 - DNA, 20 bp, Artificial
  CRISPR gRNA sequence
tctcatacatttgaaaagat

SEQ ID NO: 322629 - DNA, 20 bp, Artificial
  CRISPR gRNA sequence
atacatttgaaaagatggtc

SEQ ID NO: 322630 - DNA, 20 bp, Artificial
  CRISPR gRNA sequence
gaaaagatggtcatactcaa

SEQ ID NO: 322631 - DNA, 20 bp, Artificial
  CRISPR gRNA sequence
aaaagatggtcatactcaaa

SEQ ID NO: 322632 - DNA, 20 bp, Artificial
  CRISPR gRNA sequence
aaaataaaagaaattcaata

SEQ ID NO: 322633 - DNA, 20 bp, Artificial
  CRISPR gRNA sequence
aatataaaatgacagtgaga

SEQ ID NO: 322634 - DNA, 20 bp, Artificial
  CRISPR gRNA sequence
cctactcattaggctggcta

SEQ ID NO: 322635 - DNA, 20 bp, Artificial
  CRISPR gRNA sequence
ctactcattaggctggctac

SEQ ID NO: 322636 - DNA, 20 bp, Artificial
  CRISPR gRNA sequence
ctcattaggctggctactac

SEQ ID NO: 322637 - DNA, 20 bp, Artificial
  CRISPR gRNA sequence
attaggctggctactacaaa

SEQ ID NO: 322638 - DNA, 20 bp, Artificial
  CRISPR gRNA sequence
ggctggctactacaaaaaaa

SEQ ID NO: 322639 - DNA, 20 bp, Artificial
  CRISPR gRNA sequence
gctactacaaaaaaaaaaaa

SEQ ID NO: 322640 - DNA, 20 bp, Artificial
  CRISPR gRNA sequence
ctacaaaaaaaaaaaaaaaa

SEQ ID NO: 322641 - DNA, 20 bp, Artificial
  CRISPR gRNA sequence
caaaaaaaaaaaaaaaaaaa

SEQ ID NO: 322642 - DNA, 20 bp, Artificial
  CRISPR gRNA sequence
tgaatctgaactcccaccta

SEQ ID NO: 322643 - DNA, 20 bp, Artificial
  CRISPR gRNA sequence
gaatctgaactcccacctaa

SEQ ID NO: 322644 - DNA, 20 bp, Artificial
  CRISPR gRNA sequence
aatctgaactcccacctaat

SEQ ID NO: 322645 - DNA, 20 bp, Artificial
  CRISPR gRNA sequence
aactcccacctaatatggga

SEQ ID NO: 322646 - DNA, 20 bp, Artificial
  CRISPR gRNA sequence
ccacctaatatgggaatcgc

SEQ ID NO: 322647 - DNA, 20 bp, Artificial
  CRISPR gRNA sequence
atatgggaatcgctcatggt

SEQ ID NO: 322648 - DNA, 20 bp, Artificial
  CRISPR gRNA sequence
atggtttgcaaaccaaaaaa

SEQ ID NO: 322649 - DNA, 20 bp, Artificial
  CRISPR gRNA sequence
gcaaaccaaaaaaccattat

SEQ ID NO: 322650 - DNA, 20 bp, Artificial
  CRISPR gRNA sequence
caaaccaaaaaaccattatg

SEQ ID NO: 322651 - DNA, 20 bp, Artificial
  CRISPR gRNA sequence
tgttcgacctaaccaaagac

SEQ ID NO: 322652 - DNA, 20 bp, Artificial
  CRISPR gRNA sequence
gacctaaccaaagacaattt

SEQ ID NO: 322653 - DNA, 20 bp, Artificial
  CRISPR gRNA sequence
accaaagacaatttttcttc

SEQ ID NO: 322654 - DNA, 20 bp, Artificial
  CRISPR gRNA sequence
ttcttctggggtggcatgac

SEQ ID NO: 322655 - DNA, 20 bp, Artificial
  CRISPR gRNA sequence
tcttctggggtggcatgaca

SEQ ID NO: 322656 - DNA, 20 bp, Artificial
  CRISPR gRNA sequence
cttctggggtggcatgacaa

SEQ ID NO: 322657 - DNA, 20 bp, Artificial
  CRISPR gRNA sequence
ttctggggtggcatgacaaa

SEQ ID NO: 322658 - DNA, 20 bp, Artificial
  CRISPR gRNA sequence
ctggggtggcatgacaaaca

SEQ ID NO: 322659 - DNA, 20 bp, Artificial
  CRISPR gRNA sequence
tggggtggcatgacaaacag

SEQ ID NO: 322660 - DNA, 20 bp, Artificial
  CRISPR gRNA sequence
gggtggcatgacaaacaggg

SEQ ID NO: 322661 - DNA, 20 bp, Artificial
  CRISPR gRNA sequence
tattttactataaatttaac

SEQ ID NO: 322662 - DNA, 20 bp, Artificial
  CRISPR gRNA sequence
tactataaatttaacaaatc

SEQ ID NO: 322663 - DNA, 20 bp, Artificial
  CRISPR gRNA sequence
actataaatttaacaaatca

SEQ ID NO: 322664 - DNA, 20 bp, Artificial
  CRISPR gRNA sequence
ctataaatttaacaaatcac

SEQ ID NO: 322665 - DNA, 20 bp, Artificial
  CRISPR gRNA sequence
taaatttaacaaatcacctt

SEQ ID NO: 322666 - DNA, 20 bp, Artificial
  CRISPR gRNA sequence
aacaaatcacctttcattca

SEQ ID NO: 322667 - DNA, 20 bp, Artificial
  CRISPR gRNA sequence
acaaatcacctttcattcaa

SEQ ID NO: 322668 - DNA, 20 bp, Artificial
  CRISPR gRNA sequence
tcattcaaataattacatga

SEQ ID NO: 322669 - DNA, 20 bp, Artificial
  CRISPR gRNA sequence
cattcaaataattacatgaa

SEQ ID NO: 322670 - DNA, 20 bp, Artificial
  CRISPR gRNA sequence
attcaaataattacatgaaa

SEQ ID NO: 322671 - DNA, 20 bp, Artificial
  CRISPR gRNA sequence
aaataattacatgaaatcag

SEQ ID NO: 322672 - DNA, 20 bp, Artificial
  CRISPR gRNA sequence
catgaaatcagtattgctct

SEQ ID NO: 322673 - DNA, 20 bp, Artificial
  CRISPR gRNA sequence
ctctaaggaatcttggacaa

SEQ ID NO: 322674 - DNA, 20 bp, Artificial
  CRISPR gRNA sequence
taaggaatcttggacaaatg

SEQ ID NO: 322675 - DNA, 20 bp, Artificial
  CRISPR gRNA sequence
aggaatcttggacaaatggc

SEQ ID NO: 322676 - DNA, 20 bp, Artificial
  CRISPR gRNA sequence
ggacaaatggcccctgtaat

SEQ ID NO: 322677 - DNA, 20 bp, Artificial
  CRISPR gRNA sequence
gacaaatggcccctgtaatt

SEQ ID NO: 322678 - DNA, 20 bp, Artificial
  CRISPR gRNA sequence
taattcacacagtggggaga

SEQ ID NO: 322679 - DNA, 20 bp, Artificial
  CRISPR gRNA sequence
acacagtggggagaagcact

SEQ ID NO: 322680 - DNA, 20 bp, Artificial
  CRISPR gRNA sequence
accctgacaaggaatcagta

SEQ ID NO: 322681 - DNA, 20 bp, Artificial
  CRISPR gRNA sequence
acaaggaatcagtaccattt

SEQ ID NO: 322682 - DNA, 20 bp, Artificial
  CRISPR gRNA sequence
ttgatttctcagtttggaaa

SEQ ID NO: 322683 - DNA, 20 bp, Artificial
  CRISPR gRNA sequence
tgatttctcagtttggaaac

SEQ ID NO: 322684 - DNA, 20 bp, Artificial
  CRISPR gRNA sequence
gatttctcagtttggaaact

SEQ ID NO: 322685 - DNA, 20 bp, Artificial
  CRISPR gRNA sequence
atttctcagtttggaaactc

SEQ ID NO: 322686 - DNA, 20 bp, Artificial
  CRISPR gRNA sequence
ctcagtttggaaactctctc

SEQ ID NO: 322687 - DNA, 20 bp, Artificial
  CRISPR gRNA sequence
tcagtttggaaactctctct

SEQ ID NO: 322688 - DNA, 20 bp, Artificial
  CRISPR gRNA sequence
agtttggaaactctctcttc

SEQ ID NO: 322689 - DNA, 20 bp, Artificial
  CRISPR gRNA sequence
ggaaactctctcttcccctg

SEQ ID NO: 322690 - DNA, 20 bp, Artificial
  CRISPR gRNA sequence
gaaactctctcttcccctgg

SEQ ID NO: 322691 - DNA, 20 bp, Artificial
  CRISPR gRNA sequence
tctcttcccctgggttagaa

SEQ ID NO: 322692 - DNA, 20 bp, Artificial
  CRISPR gRNA sequence
tcttcccctgggttagaagc

SEQ ID NO: 322693 - DNA, 20 bp, Artificial
  CRISPR gRNA sequence
ttcccctgggttagaagctg

SEQ ID NO: 322694 - DNA, 20 bp, Artificial
  CRISPR gRNA sequence
cccctgggttagaagctgct

SEQ ID NO: 322695 - DNA, 20 bp, Artificial
  CRISPR gRNA sequence
ccctgggttagaagctgctt

SEQ ID NO: 322696 - DNA, 20 bp, Artificial
  CRISPR gRNA sequence
ggttagaagctgcttctcct

SEQ ID NO: 322697 - DNA, 20 bp, Artificial
  CRISPR gRNA sequence
gaagctgcttctccttacct

SEQ ID NO: 322698 - DNA, 20 bp, Artificial
  CRISPR gRNA sequence
cttctccttaccttccttcc

SEQ ID NO: 322699 - DNA, 20 bp, Artificial
  CRISPR gRNA sequence
ctccttaccttccttccgtc

SEQ ID NO: 322700 - DNA, 20 bp, Artificial
  CRISPR gRNA sequence
tccttaccttccttccgtca

SEQ ID NO: 322701 - DNA, 20 bp, Artificial
  CRISPR gRNA sequence
cttaccttccttccgtcaat

SEQ ID NO: 322702 - DNA, 20 bp, Artificial
  CRISPR gRNA sequence
accttccttccgtcaatact

SEQ ID NO: 322703 - DNA, 20 bp, Artificial
  CRISPR gRNA sequence
ccttccttccgtcaatacta

SEQ ID NO: 322704 - DNA, 20 bp, Artificial
  CRISPR gRNA sequence
ccttccgtcaatactagttt

SEQ ID NO: 322705 - DNA, 20 bp, Artificial
  CRISPR gRNA sequence
cttccgtcaatactagtttt

SEQ ID NO: 322706 - DNA, 20 bp, Artificial
  CRISPR gRNA sequence
ccgtcaatactagttttgtc

SEQ ID NO: 322707 - DNA, 20 bp, Artificial
  CRISPR gRNA sequence
cgtcaatactagttttgtcc

SEQ ID NO: 322708 - DNA, 20 bp, Artificial
  CRISPR gRNA sequence
gttttgtcctctgaagctat

SEQ ID NO: 322709 - DNA, 20 bp, Artificial
  CRISPR gRNA sequence
tgtcctctgaagctatccag

SEQ ID NO: 322710 - DNA, 20 bp, Artificial
  CRISPR gRNA sequence
gtcctctgaagctatccaga

SEQ ID NO: 322711 - DNA, 20 bp, Artificial
  CRISPR gRNA sequence
tcctctgaagctatccagag

SEQ ID NO: 322712 - DNA, 20 bp, Artificial
  CRISPR gRNA sequence
tgaagctatccagagtaagc

SEQ ID NO: 322713 - DNA, 20 bp, Artificial
  CRISPR gRNA sequence
aagctatccagagtaagcct

SEQ ID NO: 322714 - DNA, 20 bp, Artificial
  CRISPR gRNA sequence
tccagagtaagcctaacaca

SEQ ID NO: 322715 - DNA, 20 bp, Artificial
  CRISPR gRNA sequence
acacacttctgccaaagtct

SEQ ID NO: 322716 - DNA, 20 bp, Artificial
  CRISPR gRNA sequence
ctgccaaagtctgtcaagga

SEQ ID NO: 322717 - DNA, 20 bp, Artificial
  CRISPR gRNA sequence
tgccaaagtctgtcaaggat

SEQ ID NO: 322718 - DNA, 20 bp, Artificial
  CRISPR gRNA sequence
ccaaagtctgtcaaggattt

SEQ ID NO: 322719 - DNA, 20 bp, Artificial
  CRISPR gRNA sequence
tcaaggatttggtgacagca

SEQ ID NO: 322720 - DNA, 20 bp, Artificial
  CRISPR gRNA sequence
ggtgacagcaaacacatctc

SEQ ID NO: 322721 - DNA, 20 bp, Artificial
  CRISPR gRNA sequence
gtgacagcaaacacatctct

SEQ ID NO: 322722 - DNA, 20 bp, Artificial
  CRISPR gRNA sequence
tcctcaaaatcctggcctgg

SEQ ID NO: 322723 - DNA, 20 bp, Artificial
  CRISPR gRNA sequence
ctcaaaatcctggcctggcc

SEQ ID NO: 322724 - DNA, 20 bp, Artificial
  CRISPR gRNA sequence
aaaatcctggcctggcccag

SEQ ID NO: 322725 - DNA, 20 bp, Artificial
  CRISPR gRNA sequence
gcctggcccaggagtaacaa

SEQ ID NO: 322726 - DNA, 20 bp, Artificial
  CRISPR gRNA sequence
gcccaggagtaacaatcctt

SEQ ID NO: 322727 - DNA, 20 bp, Artificial
  CRISPR gRNA sequence
ccagtaagcttcactaatgt

SEQ ID NO: 322728 - DNA, 20 bp, Artificial
  CRISPR gRNA sequence
cagtaagcttcactaatgtt

SEQ ID NO: 322729 - DNA, 20 bp, Artificial
  CRISPR gRNA sequence
cactaatgttaatttggaga

SEQ ID NO: 322730 - DNA, 20 bp, Artificial
  CRISPR gRNA sequence
actaatgttaatttggagac

SEQ ID NO: 322731 - DNA, 20 bp, Artificial
  CRISPR gRNA sequence
atgttaatttggagaccaca

SEQ ID NO: 322732 - DNA, 20 bp, Artificial
  CRISPR gRNA sequence
atttggagaccacacaccat

SEQ ID NO: 322733 - DNA, 20 bp, Artificial
  CRISPR gRNA sequence
ggagaccacacaccatccta

SEQ ID NO: 322734 - DNA, 20 bp, Artificial
  CRISPR gRNA sequence
gagaccacacaccatcctag

SEQ ID NO: 322735 - DNA, 20 bp, Artificial
  CRISPR gRNA sequence
gaaaacactctggacactta

SEQ ID NO: 322736 - DNA, 20 bp, Artificial
  CRISPR gRNA sequence
tggacacttagtttatcagt

SEQ ID NO: 322737 - DNA, 20 bp, Artificial
  CRISPR gRNA sequence
gacacttagtttatcagtga

SEQ ID NO: 322738 - DNA, 20 bp, Artificial
  CRISPR gRNA sequence
agtttatcagtgaccctgct

SEQ ID NO: 322739 - DNA, 20 bp, Artificial
  CRISPR gRNA sequence
gtttatcagtgaccctgctg

SEQ ID NO: 322740 - DNA, 20 bp, Artificial
  CRISPR gRNA sequence
atcagtgaccctgctgtaat

SEQ ID NO: 322741 - DNA, 20 bp, Artificial
  CRISPR gRNA sequence
tcagtgaccctgctgtaata

SEQ ID NO: 322742 - DNA, 20 bp, Artificial
  CRISPR gRNA sequence
ctgtaataggatgttaaaat

SEQ ID NO: 322743 - DNA, 20 bp, Artificial
  CRISPR gRNA sequence
taataggatgttaaaatact

SEQ ID NO: 322744 - DNA, 20 bp, Artificial
  CRISPR gRNA sequence
aaatactcaagattgatatg

SEQ ID NO: 322745 - DNA, 20 bp, Artificial
  CRISPR gRNA sequence
aagattgatatgattttctt

SEQ ID NO: 322746 - DNA, 20 bp, Artificial
  CRISPR gRNA sequence
atatgattttctttcatgaa

SEQ ID NO: 322747 - DNA, 20 bp, Artificial
  CRISPR gRNA sequence
tctttcatgaagtacaagtg

SEQ ID NO: 322748 - DNA, 20 bp, Artificial
  CRISPR gRNA sequence
ctttcatgaagtacaagtgc

SEQ ID NO: 322749 - DNA, 20 bp, Artificial
  CRISPR gRNA sequence
tttcatgaagtacaagtgcc

SEQ ID NO: 322750 - DNA, 20 bp, Artificial
  CRISPR gRNA sequence
tcatgaagtacaagtgcccc

SEQ ID NO: 322751 - DNA, 20 bp, Artificial
  CRISPR gRNA sequence
catgaagtacaagtgcccca

SEQ ID NO: 322752 - DNA, 20 bp, Artificial
  CRISPR gRNA sequence
atgaagtacaagtgccccat

SEQ ID NO: 322753 - DNA, 20 bp, Artificial
  CRISPR gRNA sequence
ctctccattctagccatgat

SEQ ID NO: 322754 - DNA, 20 bp, Artificial
  CRISPR gRNA sequence
tctccattctagccatgatg

SEQ ID NO: 322755 - DNA, 20 bp, Artificial
  CRISPR gRNA sequence
tccattctagccatgatgtg

SEQ ID NO: 322756 - DNA, 20 bp, Artificial
  CRISPR gRNA sequence
cattctagccatgatgtgtg

SEQ ID NO: 322757 - DNA, 20 bp, Artificial
  CRISPR gRNA sequence
tagccatgatgtgtgatgtg

SEQ ID NO: 322758 - DNA, 20 bp, Artificial
  CRISPR gRNA sequence
gccatgatgtgtgatgtgtg

SEQ ID NO: 322759 - DNA, 20 bp, Artificial
  CRISPR gRNA sequence
ggttaggaagccagtttctc

SEQ ID NO: 322760 - DNA, 20 bp, Artificial
  CRISPR gRNA sequence
ggaagccagtttctccaatg

SEQ ID NO: 322761 - DNA, 20 bp, Artificial
  CRISPR gRNA sequence
ctccaatgtcattggccgtg

SEQ ID NO: 322762 - DNA, 20 bp, Artificial
  CRISPR gRNA sequence
tccaatgtcattggccgtga

SEQ ID NO: 322763 - DNA, 20 bp, Artificial
  CRISPR gRNA sequence
caatgtcattggccgtgaag

SEQ ID NO: 322764 - DNA, 20 bp, Artificial
  CRISPR gRNA sequence
gccgtgaagaagtgtagaaa

SEQ ID NO: 322765 - DNA, 20 bp, Artificial
  CRISPR gRNA sequence
cctcaggaatgaacctccaa

SEQ ID NO: 322766 - DNA, 20 bp, Artificial
  CRISPR gRNA sequence
aggaatgaacctccaaccac

SEQ ID NO: 322767 - DNA, 20 bp, Artificial
  CRISPR gRNA sequence
caaccacaaccagaagccat

SEQ ID NO: 322768 - DNA, 20 bp, Artificial
  CRISPR gRNA sequence
tctccagtgggcctgtaaag

SEQ ID NO: 322769 - DNA, 20 bp, Artificial
  CRISPR gRNA sequence
ctccagtgggcctgtaaagt

SEQ ID NO: 322770 - DNA, 20 bp, Artificial
  CRISPR gRNA sequence
tccagtgggcctgtaaagtg

SEQ ID NO: 322771 - DNA, 20 bp, Artificial
  CRISPR gRNA sequence
cagtgggcctgtaaagtgga

SEQ ID NO: 322772 - DNA, 20 bp, Artificial
  CRISPR gRNA sequence
taaagtggaaactcttgcct

SEQ ID NO: 322773 - DNA, 20 bp, Artificial
  CRISPR gRNA sequence
ttgccttcggagggagagag

SEQ ID NO: 322774 - DNA, 20 bp, Artificial
  CRISPR gRNA sequence
gccttcggagggagagagca

SEQ ID NO: 322775 - DNA, 20 bp, Artificial
  CRISPR gRNA sequence
ccttcggagggagagagcaa

SEQ ID NO: 322776 - DNA, 20 bp, Artificial
  CRISPR gRNA sequence
cggagggagagagcaaaaag

SEQ ID NO: 322777 - DNA, 20 bp, Artificial
  CRISPR gRNA sequence
ggagggagagagcaaaaagg

SEQ ID NO: 322778 - DNA, 20 bp, Artificial
  CRISPR gRNA sequence
agaatttaccggggggattc

SEQ ID NO: 322779 - DNA, 20 bp, Artificial
  CRISPR gRNA sequence
accggggggattctctgaga

SEQ ID NO: 322780 - DNA, 20 bp, Artificial
  CRISPR gRNA sequence
ccggggggattctctgagag

SEQ ID NO: 322781 - DNA, 20 bp, Artificial
  CRISPR gRNA sequence
tctgagaggagatttctgtc

SEQ ID NO: 322782 - DNA, 20 bp, Artificial
  CRISPR gRNA sequence
tgagaggagatttctgtcag

SEQ ID NO: 322783 - DNA, 20 bp, Artificial
  CRISPR gRNA sequence
agaggagatttctgtcagct

SEQ ID NO: 322784 - DNA, 20 bp, Artificial
  CRISPR gRNA sequence
ctgtcagctaagcacagaat

SEQ ID NO: 322785 - DNA, 20 bp, Artificial
  CRISPR gRNA sequence
tgtcagctaagcacagaata

SEQ ID NO: 322786 - DNA, 20 bp, Artificial
  CRISPR gRNA sequence
tcagctaagcacagaataag

SEQ ID NO: 322787 - DNA, 20 bp, Artificial
  CRISPR gRNA sequence
agcacagaataaggtctatg

SEQ ID NO: 322788 - DNA, 20 bp, Artificial
  CRISPR gRNA sequence
tgaataaggtgggtgaacta

SEQ ID NO: 322789 - DNA, 20 bp, Artificial
  CRISPR gRNA sequence
gtcagaaatctaaaaagagg

SEQ ID NO: 322790 - DNA, 20 bp, Artificial
  CRISPR gRNA sequence
aaaagaggagcctccatgta

SEQ ID NO: 322791 - DNA, 20 bp, Artificial
  CRISPR gRNA sequence
catgtaaatggaggttcact

SEQ ID NO: 322792 - DNA, 20 bp, Artificial
  CRISPR gRNA sequence
actccagaaaccaagaagag

SEQ ID NO: 322793 - DNA, 20 bp, Artificial
  CRISPR gRNA sequence
cagaaaccaagaagagcacc

SEQ ID NO: 322794 - DNA, 20 bp, Artificial
  CRISPR gRNA sequence
ccgtaatccactttcactta

SEQ ID NO: 322795 - DNA, 20 bp, Artificial
  CRISPR gRNA sequence
tcacttactttgtatgtctg

SEQ ID NO: 322796 - DNA, 20 bp, Artificial
  CRISPR gRNA sequence
cacttactttgtatgtctgg

SEQ ID NO: 322797 - DNA, 20 bp, Artificial
  CRISPR gRNA sequence
acttactttgtatgtctggc

SEQ ID NO: 322798 - DNA, 20 bp, Artificial
  CRISPR gRNA sequence
actttgtatgtctggcccat

SEQ ID NO: 322799 - DNA, 20 bp, Artificial
  CRISPR gRNA sequence
ctttgtatgtctggcccatc

SEQ ID NO: 322800 - DNA, 20 bp, Artificial
  CRISPR gRNA sequence
tgtatgtctggcccatcaga

SEQ ID NO: 322801 - DNA, 20 bp, Artificial
  CRISPR gRNA sequence
gtatgtctggcccatcagag

SEQ ID NO: 322802 - DNA, 20 bp, Artificial
  CRISPR gRNA sequence
tatgtctggcccatcagaga

SEQ ID NO: 322803 - DNA, 20 bp, Artificial
  CRISPR gRNA sequence
gcccatcagagaacatgaat

SEQ ID NO: 322804 - DNA, 20 bp, Artificial
  CRISPR gRNA sequence
gctaaatgattaatcatatt

SEQ ID NO: 322805 - DNA, 20 bp, Artificial
  CRISPR gRNA sequence
aatgattaatcatattatta

SEQ ID NO: 322806 - DNA, 20 bp, Artificial
  CRISPR gRNA sequence
atcatattattactgctcac

SEQ ID NO: 322807 - DNA, 20 bp, Artificial
  CRISPR gRNA sequence
ttactgctcacaacagggtg

SEQ ID NO: 322808 - DNA, 20 bp, Artificial
  CRISPR gRNA sequence
ctgctcacaacagggtgaga

SEQ ID NO: 322809 - DNA, 20 bp, Artificial
  CRISPR gRNA sequence
ctcacaacagggtgagatta

SEQ ID NO: 322810 - DNA, 20 bp, Artificial
  CRISPR gRNA sequence
acaacagggtgagattattt

SEQ ID NO: 322811 - DNA, 20 bp, Artificial
  CRISPR gRNA sequence
tttgtccccatgttacagat

SEQ ID NO: 322812 - DNA, 20 bp, Artificial
  CRISPR gRNA sequence
gtccccatgttacagatgaa

SEQ ID NO: 322813 - DNA, 20 bp, Artificial
  CRISPR gRNA sequence
tccccatgttacagatgaag

SEQ ID NO: 322814 - DNA, 20 bp, Artificial
  CRISPR gRNA sequence
cagatgaaggaatggagtct

SEQ ID NO: 322815 - DNA, 20 bp, Artificial
  CRISPR gRNA sequence
agagaggtcacagtacttgc

SEQ ID NO: 322816 - DNA, 20 bp, Artificial
  CRISPR gRNA sequence
gccctaggctgcccagctag

SEQ ID NO: 322817 - DNA, 20 bp, Artificial
  CRISPR gRNA sequence
ccctaggctgcccagctagt

SEQ ID NO: 322818 - DNA, 20 bp, Artificial
  CRISPR gRNA sequence
ggctgcccagctagtaaatg

SEQ ID NO: 322819 - DNA, 20 bp, Artificial
  CRISPR gRNA sequence
cccagctagtaaatggtaca

SEQ ID NO: 322820 - DNA, 20 bp, Artificial
  CRISPR gRNA sequence
gtaaatggtacagctgagat

SEQ ID NO: 322821 - DNA, 20 bp, Artificial
  CRISPR gRNA sequence
agatttaaacccatgcagcc

SEQ ID NO: 322822 - DNA, 20 bp, Artificial
  CRISPR gRNA sequence
aaacccatgcagcctgtgtt

SEQ ID NO: 322823 - DNA, 20 bp, Artificial
  CRISPR gRNA sequence
aacccatgcagcctgtgttt

SEQ ID NO: 322824 - DNA, 20 bp, Artificial
  CRISPR gRNA sequence
tgtttctttcacacactggt

SEQ ID NO: 322825 - DNA, 20 bp, Artificial
  CRISPR gRNA sequence
ctttcacacactggtgtagc

SEQ ID NO: 322826 - DNA, 20 bp, Artificial
  CRISPR gRNA sequence
tttcacacactggtgtagca

SEQ ID NO: 322827 - DNA, 20 bp, Artificial
  CRISPR gRNA sequence
tcacacactggtgtagcacg

SEQ ID NO: 322828 - DNA, 20 bp, Artificial
  CRISPR gRNA sequence
cacacactggtgtagcacgt

SEQ ID NO: 322829 - DNA, 20 bp, Artificial
  CRISPR gRNA sequence
acacactggtgtagcacgtt

SEQ ID NO: 322830 - DNA, 20 bp, Artificial
  CRISPR gRNA sequence
gtgtagcacgtttaaaaatg

SEQ ID NO: 322831 - DNA, 20 bp, Artificial
  CRISPR gRNA sequence
aaaaatgccaaccagttttt

SEQ ID NO: 322832 - DNA, 20 bp, Artificial
  CRISPR gRNA sequence
aaaatgccaaccagtttttg

SEQ ID NO: 322833 - DNA, 20 bp, Artificial
  CRISPR gRNA sequence
ttgctctgccacaggagcca

SEQ ID NO: 322834 - DNA, 20 bp, Artificial
  CRISPR gRNA sequence
tgctctgccacaggagccag

SEQ ID NO: 322835 - DNA, 20 bp, Artificial
  CRISPR gRNA sequence
gctctgccacaggagccagt

SEQ ID NO: 322836 - DNA, 20 bp, Artificial
  CRISPR gRNA sequence
ctctgccacaggagccagtg

SEQ ID NO: 322837 - DNA, 20 bp, Artificial
  CRISPR gRNA sequence
tgccacaggagccagtggaa

SEQ ID NO: 322838 - DNA, 20 bp, Artificial
  CRISPR gRNA sequence
ccacaggagccagtggaaag

SEQ ID NO: 322839 - DNA, 20 bp, Artificial
  CRISPR gRNA sequence
tgatgttatctagcctctga

SEQ ID NO: 322840 - DNA, 20 bp, Artificial
  CRISPR gRNA sequence
atgttatctagcctctgaga

SEQ ID NO: 322841 - DNA, 20 bp, Artificial
  CRISPR gRNA sequence
tctagcctctgagacagacg

SEQ ID NO: 322842 - DNA, 20 bp, Artificial
  CRISPR gRNA sequence
gcctctgagacagacgggag

SEQ ID NO: 322843 - DNA, 20 bp, Artificial
  CRISPR gRNA sequence
tgagacagacgggagcagca

SEQ ID NO: 322844 - DNA, 20 bp, Artificial
  CRISPR gRNA sequence
agacagacgggagcagcaca

SEQ ID NO: 322845 - DNA, 20 bp, Artificial
  CRISPR gRNA sequence
gggccaggtgtgatggtggc

SEQ ID NO: 322846 - DNA, 20 bp, Artificial
  CRISPR gRNA sequence
ctggaatcgagaggactctc

SEQ ID NO: 322847 - DNA, 20 bp, Artificial
  CRISPR gRNA sequence
gaatcgagaggactctcaga

SEQ ID NO: 322848 - DNA, 20 bp, Artificial
  CRISPR gRNA sequence
tcagagagacagactggggt

SEQ ID NO: 322849 - DNA, 20 bp, Artificial
  CRISPR gRNA sequence
agagagacagactggggtgg

SEQ ID NO: 322850 - DNA, 20 bp, Artificial
  CRISPR gRNA sequence
gggtgggagaagaaggggcc

SEQ ID NO: 322851 - DNA, 20 bp, Artificial
  CRISPR gRNA sequence
tgcatcaagagggtttctgc

SEQ ID NO: 322852 - DNA, 20 bp, Artificial
  CRISPR gRNA sequence
gcatcaagagggtttctgcc

SEQ ID NO: 322853 - DNA, 20 bp, Artificial
  CRISPR gRNA sequence
catcaagagggtttctgccc

SEQ ID NO: 322854 - DNA, 20 bp, Artificial
  CRISPR gRNA sequence
ctgccctgagctgctgttca

SEQ ID NO: 322855 - DNA, 20 bp, Artificial
  CRISPR gRNA sequence
tgccctgagctgctgttcat

SEQ ID NO: 322856 - DNA, 20 bp, Artificial
  CRISPR gRNA sequence
ccctgagctgctgttcattc

SEQ ID NO: 322857 - DNA, 20 bp, Artificial
  CRISPR gRNA sequence
agctgctgttcattctgcaa

SEQ ID NO: 322858 - DNA, 20 bp, Artificial
  CRISPR gRNA sequence
ctgttcattctgcaaacact

SEQ ID NO: 322859 - DNA, 20 bp, Artificial
  CRISPR gRNA sequence
ttcattctgcaaacactgct

SEQ ID NO: 322860 - DNA, 20 bp, Artificial
  CRISPR gRNA sequence
attctgcaaacactgctcga

SEQ ID NO: 322861 - DNA, 20 bp, Artificial
  CRISPR gRNA sequence
tgcaaacactgctcgaatac

SEQ ID NO: 322862 - DNA, 20 bp, Artificial
  CRISPR gRNA sequence
caaacactgctcgaataccc

SEQ ID NO: 322863 - DNA, 20 bp, Artificial
  CRISPR gRNA sequence
ctcgaatacccactgtgtgc

SEQ ID NO: 322864 - DNA, 20 bp, Artificial
  CRISPR gRNA sequence
gaatacccactgtgtgccag

SEQ ID NO: 322865 - DNA, 20 bp, Artificial
  CRISPR gRNA sequence
tgtgccaggtacagagagta

SEQ ID NO: 322866 - DNA, 20 bp, Artificial
  CRISPR gRNA sequence
ctccactttaacctggacag

SEQ ID NO: 322867 - DNA, 20 bp, Artificial
  CRISPR gRNA sequence
tccactttaacctggacagg

SEQ ID NO: 322868 - DNA, 20 bp, Artificial
  CRISPR gRNA sequence
cactttaacctggacaggca

SEQ ID NO: 322869 - DNA, 20 bp, Artificial
  CRISPR gRNA sequence
taacctggacaggcaccagc

SEQ ID NO: 322870 - DNA, 20 bp, Artificial
  CRISPR gRNA sequence
aacctggacaggcaccagct

SEQ ID NO: 322871 - DNA, 20 bp, Artificial
  CRISPR gRNA sequence
acctggacaggcaccagctt

SEQ ID NO: 322872 - DNA, 20 bp, Artificial
  CRISPR gRNA sequence
gacaggcaccagcttcccag

SEQ ID NO: 322873 - DNA, 20 bp, Artificial
  CRISPR gRNA sequence
cccagcgtggatttaggctt

SEQ ID NO: 322874 - DNA, 20 bp, Artificial
  CRISPR gRNA sequence
ccagcgtggatttaggcttc

SEQ ID NO: 322875 - DNA, 20 bp, Artificial
  CRISPR gRNA sequence
aggcttcaggtgcacactac

SEQ ID NO: 322876 - DNA, 20 bp, Artificial
  CRISPR gRNA sequence
ggcttcaggtgcacactact

SEQ ID NO: 322877 - DNA, 20 bp, Artificial
  CRISPR gRNA sequence
caggtgcacactactgtgga

SEQ ID NO: 322878 - DNA, 20 bp, Artificial
  CRISPR gRNA sequence
aggtgcacactactgtggac

SEQ ID NO: 322879 - DNA, 20 bp, Artificial
  CRISPR gRNA sequence
ctgtggaccatctaagccat

SEQ ID NO: 322880 - DNA, 20 bp, Artificial
  CRISPR gRNA sequence
tggaccatctaagccatatc

SEQ ID NO: 322881 - DNA, 20 bp, Artificial
  CRISPR gRNA sequence
agccatatctagaagagctc

SEQ ID NO: 322882 - DNA, 20 bp, Artificial
  CRISPR gRNA sequence
gaagagctctggggaaatat

SEQ ID NO: 322883 - DNA, 20 bp, Artificial
  CRISPR gRNA sequence
tggggaaatatgactacttg

SEQ ID NO: 322884 - DNA, 20 bp, Artificial
  CRISPR gRNA sequence
gggaaatatgactacttggg

SEQ ID NO: 322885 - DNA, 20 bp, Artificial
  CRISPR gRNA sequence
cttgggcagaaaaggaagga

SEQ ID NO: 322886 - DNA, 20 bp, Artificial
  CRISPR gRNA sequence
gggcagaaaaggaaggaact

SEQ ID NO: 322887 - DNA, 20 bp, Artificial
  CRISPR gRNA sequence
ggcagaaaaggaaggaacta

SEQ ID NO: 322888 - DNA, 20 bp, Artificial
  CRISPR gRNA sequence
agaaggggtatctttgtatc

SEQ ID NO: 322889 - DNA, 20 bp, Artificial
  CRISPR gRNA sequence
tgtatctgaggtctgaagga

SEQ ID NO: 322890 - DNA, 20 bp, Artificial
  CRISPR gRNA sequence
gtatctgaggtctgaaggag

SEQ ID NO: 322891 - DNA, 20 bp, Artificial
  CRISPR gRNA sequence
tatctgaggtctgaaggagc

SEQ ID NO: 322892 - DNA, 20 bp, Artificial
  CRISPR gRNA sequence
aggtctgaaggagcatgtgg

SEQ ID NO: 322893 - DNA, 20 bp, Artificial
  CRISPR gRNA sequence
aaggagcatgtgggctctca

SEQ ID NO: 322894 - DNA, 20 bp, Artificial
  CRISPR gRNA sequence
tcattcaggcaaagggcagg

SEQ ID NO: 322895 - DNA, 20 bp, Artificial
  CRISPR gRNA sequence
attcaggcaaagggcaggat

SEQ ID NO: 322896 - DNA, 20 bp, Artificial
  CRISPR gRNA sequence
aggcaaagggcaggatgagg

SEQ ID NO: 322897 - DNA, 20 bp, Artificial
  CRISPR gRNA sequence
gagagcaacaaagaaaaaga

SEQ ID NO: 322898 - DNA, 20 bp, Artificial
  CRISPR gRNA sequence
atttcacaactttgtgtaga

SEQ ID NO: 322899 - DNA, 20 bp, Artificial
  CRISPR gRNA sequence
tttcacaactttgtgtagaa

SEQ ID NO: 322900 - DNA, 20 bp, Artificial
  CRISPR gRNA sequence
cacaactttgtgtagaatgt

SEQ ID NO: 322901 - DNA, 20 bp, Artificial
  CRISPR gRNA sequence
acaactttgtgtagaatgtt

SEQ ID NO: 322902 - DNA, 20 bp, Artificial
  CRISPR gRNA sequence
tgtgtagaatgttagtggta

SEQ ID NO: 322903 - DNA, 20 bp, Artificial
  CRISPR gRNA sequence
gtgtagaatgttagtggtaa

SEQ ID NO: 322904 - DNA, 20 bp, Artificial
  CRISPR gRNA sequence
tgtagaatgttagtggtaac

SEQ ID NO: 322905 - DNA, 20 bp, Artificial
  CRISPR gRNA sequence
gtggtaaccggagtatcagg

SEQ ID NO: 322906 - DNA, 20 bp, Artificial
  CRISPR gRNA sequence
agaagtttgctggtgcctca

SEQ ID NO: 322907 - DNA, 20 bp, Artificial
  CRISPR gRNA sequence
gctggtgcctcagaaggtta

SEQ ID NO: 322908 - DNA, 20 bp, Artificial
  CRISPR gRNA sequence
ctggtgcctcagaaggttat

SEQ ID NO: 322909 - DNA, 20 bp, Artificial
  CRISPR gRNA sequence
gtgcctcagaaggttattta

SEQ ID NO: 322910 - DNA, 20 bp, Artificial
  CRISPR gRNA sequence
agaaggttatttattgaggt

SEQ ID NO: 322911 - DNA, 20 bp, Artificial
  CRISPR gRNA sequence
tttattgaggtagtctttca

SEQ ID NO: 322912 - DNA, 20 bp, Artificial
  CRISPR gRNA sequence
attgaggtagtctttcaggc

SEQ ID NO: 322913 - DNA, 20 bp, Artificial
  CRISPR gRNA sequence
ttgaggtagtctttcaggca

SEQ ID NO: 322914 - DNA, 20 bp, Artificial
  CRISPR gRNA sequence
aggtagtctttcaggcaaac

SEQ ID NO: 322915 - DNA, 20 bp, Artificial
  CRISPR gRNA sequence
tcaggcaaacatttgctaca

SEQ ID NO: 322916 - DNA, 20 bp, Artificial
  CRISPR gRNA sequence
caggcaaacatttgctacat

SEQ ID NO: 322917 - DNA, 20 bp, Artificial
  CRISPR gRNA sequence
aggcaaacatttgctacatc

SEQ ID NO: 322918 - DNA, 20 bp, Artificial
  CRISPR gRNA sequence
gctacatctactcagtgtca

SEQ ID NO: 322919 - DNA, 20 bp, Artificial
  CRISPR gRNA sequence
ctacatctactcagtgtcag

SEQ ID NO: 322920 - DNA, 20 bp, Artificial
  CRISPR gRNA sequence
catctactcagtgtcagact

SEQ ID NO: 322921 - DNA, 20 bp, Artificial
  CRISPR gRNA sequence
ctcagtgtcagacttgttct

SEQ ID NO: 322922 - DNA, 20 bp, Artificial
  CRISPR gRNA sequence
agtgtcagacttgttctaga

SEQ ID NO: 322923 - DNA, 20 bp, Artificial
  CRISPR gRNA sequence
gttctagagattgaggggtt

SEQ ID NO: 322924 - DNA, 20 bp, Artificial
  CRISPR gRNA sequence
ttctagagattgaggggttg

SEQ ID NO: 322925 - DNA, 20 bp, Artificial
  CRISPR gRNA sequence
tagagattgaggggttgtaa

SEQ ID NO: 322926 - DNA, 20 bp, Artificial
  CRISPR gRNA sequence
gagattgaggggttgtaaag

SEQ ID NO: 322927 - DNA, 20 bp, Artificial
  CRISPR gRNA sequence
aggggttgtaaagacatgta

SEQ ID NO: 322928 - DNA, 20 bp, Artificial
  CRISPR gRNA sequence
taaagacatgtaggccttgg

SEQ ID NO: 322929 - DNA, 20 bp, Artificial
  CRISPR gRNA sequence
ggtcccccacctggcactaa

SEQ ID NO: 322930 - DNA, 20 bp, Artificial
  CRISPR gRNA sequence
gtcccccacctggcactaaa

SEQ ID NO: 322931 - DNA, 20 bp, Artificial
  CRISPR gRNA sequence
gcactaaagagaagaaaaag

SEQ ID NO: 322932 - DNA, 20 bp, Artificial
  CRISPR gRNA sequence
aagagaagaaaaagtgtcca

SEQ ID NO: 322933 - DNA, 20 bp, Artificial
  CRISPR gRNA sequence
caatgcaggctccagggcca

SEQ ID NO: 322934 - DNA, 20 bp, Artificial
  CRISPR gRNA sequence
cagggccagtgtggaaggtg

SEQ ID NO: 322935 - DNA, 20 bp, Artificial
  CRISPR gRNA sequence
ggcttcttgtgaggtataca

SEQ ID NO: 322936 - DNA, 20 bp, Artificial
  CRISPR gRNA sequence
gcttcttgtgaggtatacaa

SEQ ID NO: 322937 - DNA, 20 bp, Artificial
  CRISPR gRNA sequence
cttgtgaggtatacaagagt

SEQ ID NO: 322938 - DNA, 20 bp, Artificial
  CRISPR gRNA sequence
ttgtgaggtatacaagagtt

SEQ ID NO: 322939 - DNA, 20 bp, Artificial
  CRISPR gRNA sequence
gtgaggtatacaagagttct

SEQ ID NO: 322940 - DNA, 20 bp, Artificial
  CRISPR gRNA sequence
tgaggtatacaagagttctt

SEQ ID NO: 322941 - DNA, 20 bp, Artificial
  CRISPR gRNA sequence
ttaccctgagcaaagcaggg

SEQ ID NO: 322942 - DNA, 20 bp, Artificial
  CRISPR gRNA sequence
accctgagcaaagcagggga

SEQ ID NO: 322943 - DNA, 20 bp, Artificial
  CRISPR gRNA sequence
ccctgagcaaagcaggggac

SEQ ID NO: 322944 - DNA, 20 bp, Artificial
  CRISPR gRNA sequence
agcaaagcaggggacaccac

SEQ ID NO: 322945 - DNA, 20 bp, Artificial
  CRISPR gRNA sequence
tgtggaggaaggattaggtc

SEQ ID NO: 322946 - DNA, 20 bp, Artificial
  CRISPR gRNA sequence
tggaggaaggattaggtcgg

SEQ ID NO: 322947 - DNA, 20 bp, Artificial
  CRISPR gRNA sequence
ggtcggcctcagcccagcag

SEQ ID NO: 322948 - DNA, 20 bp, Artificial
  CRISPR gRNA sequence
agcccagcagcactcagggc

SEQ ID NO: 322949 - DNA, 20 bp, Artificial
  CRISPR gRNA sequence
agggcccagctcattgcctt

SEQ ID NO: 322950 - DNA, 20 bp, Artificial
  CRISPR gRNA sequence
attgccttctgccgattcat

SEQ ID NO: 322951 - DNA, 20 bp, Artificial
  CRISPR gRNA sequence
ccttctgccgattcatactt

SEQ ID NO: 322952 - DNA, 20 bp, Artificial
  CRISPR gRNA sequence
ctgccgattcatacttgtgg

SEQ ID NO: 322953 - DNA, 20 bp, Artificial
  CRISPR gRNA sequence
tgccgattcatacttgtggt

SEQ ID NO: 322954 - DNA, 20 bp, Artificial
  CRISPR gRNA sequence
ccgattcatacttgtggttg

SEQ ID NO: 322955 - DNA, 20 bp, Artificial
  CRISPR gRNA sequence
atacttgtggttggataagc

SEQ ID NO: 322956 - DNA, 20 bp, Artificial
  CRISPR gRNA sequence
gtggttggataagccaggcc

SEQ ID NO: 322957 - DNA, 20 bp, Artificial
  CRISPR gRNA sequence
tggttggataagccaggcct

SEQ ID NO: 322958 - DNA, 20 bp, Artificial
  CRISPR gRNA sequence
gataagccaggcctgctgga

SEQ ID NO: 322959 - DNA, 20 bp, Artificial
  CRISPR gRNA sequence
ctggactggcacgtcaccag

SEQ ID NO: 322960 - DNA, 20 bp, Artificial
  CRISPR gRNA sequence
gactggcacgtcaccagctc

SEQ ID NO: 322961 - DNA, 20 bp, Artificial
  CRISPR gRNA sequence
gcacgtcaccagctcgctga

SEQ ID NO: 322962 - DNA, 20 bp, Artificial
  CRISPR gRNA sequence
gctgagaggagagtagagct

SEQ ID NO: 322963 - DNA, 20 bp, Artificial
  CRISPR gRNA sequence
agaggagagtagagctccag

SEQ ID NO: 322964 - DNA, 20 bp, Artificial
  CRISPR gRNA sequence
cagtgcaacatcagctccct

SEQ ID NO: 322965 - DNA, 20 bp, Artificial
  CRISPR gRNA sequence
cctggggccttggtttgcct

SEQ ID NO: 322966 - DNA, 20 bp, Artificial
  CRISPR gRNA sequence
gggccttggtttgcctctgg

SEQ ID NO: 322967 - DNA, 20 bp, Artificial
  CRISPR gRNA sequence
ggtttgcctctgggtgtgac

SEQ ID NO: 322968 - DNA, 20 bp, Artificial
  CRISPR gRNA sequence
gtttgcctctgggtgtgaca

SEQ ID NO: 322969 - DNA, 20 bp, Artificial
  CRISPR gRNA sequence
gcctctgggtgtgacatgct

SEQ ID NO: 322970 - DNA, 20 bp, Artificial
  CRISPR gRNA sequence
cctctgggtgtgacatgctg

SEQ ID NO: 322971 - DNA, 20 bp, Artificial
  CRISPR gRNA sequence
tgggtgtgacatgctgcaca

SEQ ID NO: 322972 - DNA, 20 bp, Artificial
  CRISPR gRNA sequence
ggtgtgacatgctgcacagc

SEQ ID NO: 322973 - DNA, 20 bp, Artificial
  CRISPR gRNA sequence
cacagcgttacttctcagag

SEQ ID NO: 322974 - DNA, 20 bp, Artificial
  CRISPR gRNA sequence
cttctcagagcaccaggacc

SEQ ID NO: 322975 - DNA, 20 bp, Artificial
  CRISPR gRNA sequence
ctcagagcaccaggacctga

SEQ ID NO: 322976 - DNA, 20 bp, Artificial
  CRISPR gRNA sequence
tcagagcaccaggacctgaa

SEQ ID NO: 322977 - DNA, 20 bp, Artificial
  CRISPR gRNA sequence
agagcaccaggacctgaagt

SEQ ID NO: 322978 - DNA, 20 bp, Artificial
  CRISPR gRNA sequence
aagtttcatcctctgcattc

SEQ ID NO: 322979 - DNA, 20 bp, Artificial
  CRISPR gRNA sequence
catcctctgcattccgctgt

SEQ ID NO: 322980 - DNA, 20 bp, Artificial
  CRISPR gRNA sequence
atcctctgcattccgctgtc

SEQ ID NO: 322981 - DNA, 20 bp, Artificial
  CRISPR gRNA sequence
tgcattccgctgtcccaccc

SEQ ID NO: 322982 - DNA, 20 bp, Artificial
  CRISPR gRNA sequence
cattccgctgtcccacccca

SEQ ID NO: 322983 - DNA, 20 bp, Artificial
  CRISPR gRNA sequence
cgctgtcccaccccattact

SEQ ID NO: 322984 - DNA, 20 bp, Artificial
  CRISPR gRNA sequence
tcccaccccattactggctg

SEQ ID NO: 322985 - DNA, 20 bp, Artificial
  CRISPR gRNA sequence
ctggctgctgccaccccacc

SEQ ID NO: 322986 - DNA, 20 bp, Artificial
  CRISPR gRNA sequence
gctgctgccaccccacctcc

SEQ ID NO: 322987 - DNA, 20 bp, Artificial
  CRISPR gRNA sequence
ctgccaccccacctcccctc

SEQ ID NO: 322988 - DNA, 20 bp, Artificial
  CRISPR gRNA sequence
ccaccccacctcccctcatc

SEQ ID NO: 322989 - DNA, 20 bp, Artificial
  CRISPR gRNA sequence
ccctcatcctgccctttgcc

SEQ ID NO: 322990 - DNA, 20 bp, Artificial
  CRISPR gRNA sequence
atcctgccctttgcctgaac

SEQ ID NO: 322991 - DNA, 20 bp, Artificial
  CRISPR gRNA sequence
ccctttgcctgaacaagagc

SEQ ID NO: 322992 - DNA, 20 bp, Artificial
  CRISPR gRNA sequence
tgcctgaacaagagcccaca

SEQ ID NO: 322993 - DNA, 20 bp, Artificial
  CRISPR gRNA sequence
gcctgaacaagagcccacac

SEQ ID NO: 322994 - DNA, 20 bp, Artificial
  CRISPR gRNA sequence
cctgaacaagagcccacacg

SEQ ID NO: 322995 - DNA, 20 bp, Artificial
  CRISPR gRNA sequence
aacaagagcccacacgctcc

SEQ ID NO: 322996 - DNA, 20 bp, Artificial
  CRISPR gRNA sequence
cttcagacctcagacacaaa

SEQ ID NO: 322997 - DNA, 20 bp, Artificial
  CRISPR gRNA sequence
cagacctcagacacaaagat

SEQ ID NO: 322998 - DNA, 20 bp, Artificial
  CRISPR gRNA sequence
agacctcagacacaaagata

SEQ ID NO: 322999 - DNA, 20 bp, Artificial
  CRISPR gRNA sequence
agacacaaagatacctcttc

SEQ ID NO: 323000 - DNA, 20 bp, Artificial
  CRISPR gRNA sequence
ttcttagttccttccttttc

SEQ ID NO: 323001 - DNA, 20 bp, Artificial
  CRISPR gRNA sequence
cttagttccttccttttctg

SEQ ID NO: 323002 - DNA, 20 bp, Artificial
  CRISPR gRNA sequence
ttagttccttccttttctgc

SEQ ID NO: 323003 - DNA, 20 bp, Artificial
  CRISPR gRNA sequence
agttccttccttttctgccc

SEQ ID NO: 323004 - DNA, 20 bp, Artificial
  CRISPR gRNA sequence
gttccttccttttctgccca

SEQ ID NO: 323005 - DNA, 20 bp, Artificial
  CRISPR gRNA sequence
cttccttttctgcccaagta

SEQ ID NO: 323006 - DNA, 20 bp, Artificial
  CRISPR gRNA sequence
ccttttctgcccaagtagtc

SEQ ID NO: 323007 - DNA, 20 bp, Artificial
  CRISPR gRNA sequence
cttttctgcccaagtagtca

SEQ ID NO: 323008 - DNA, 20 bp, Artificial
  CRISPR gRNA sequence
ttctgcccaagtagtcatat

SEQ ID NO: 323009 - DNA, 20 bp, Artificial
  CRISPR gRNA sequence
tctgcccaagtagtcatatt

SEQ ID NO: 323010 - DNA, 20 bp, Artificial
  CRISPR gRNA sequence
ctgcccaagtagtcatattt

SEQ ID NO: 323011 - DNA, 20 bp, Artificial
  CRISPR gRNA sequence
tgcccaagtagtcatatttc

SEQ ID NO: 323012 - DNA, 20 bp, Artificial
  CRISPR gRNA sequence
cccaagtagtcatatttccc

SEQ ID NO: 323013 - DNA, 20 bp, Artificial
  CRISPR gRNA sequence
ccccagagctcttctaggtg

SEQ ID NO: 323014 - DNA, 20 bp, Artificial
  CRISPR gRNA sequence
cccagagctcttctaggtgt

SEQ ID NO: 323015 - DNA, 20 bp, Artificial
  CRISPR gRNA sequence
ttctaggtgtggcttagacg

SEQ ID NO: 323016 - DNA, 20 bp, Artificial
  CRISPR gRNA sequence
ctaggtgtggcttagacggt

SEQ ID NO: 323017 - DNA, 20 bp, Artificial
  CRISPR gRNA sequence
taggtgtggcttagacggta

SEQ ID NO: 323018 - DNA, 20 bp, Artificial
  CRISPR gRNA sequence
ggtgtggcttagacggtaca

SEQ ID NO: 323019 - DNA, 20 bp, Artificial
  CRISPR gRNA sequence
agacggtacacagtagtgtg

SEQ ID NO: 323020 - DNA, 20 bp, Artificial
  CRISPR gRNA sequence
gacggtacacagtagtgtgc

SEQ ID NO: 323021 - DNA, 20 bp, Artificial
  CRISPR gRNA sequence
aagcctaaacccacgctggg

SEQ ID NO: 323022 - DNA, 20 bp, Artificial
  CRISPR gRNA sequence
aacccacgctgggaagctgg

SEQ ID NO: 323023 - DNA, 20 bp, Artificial
  CRISPR gRNA sequence
ggaagctggtgcctgtccag

SEQ ID NO: 323024 - DNA, 20 bp, Artificial
  CRISPR gRNA sequence
gtgcctgtccagattacagc

SEQ ID NO: 323025 - DNA, 20 bp, Artificial
  CRISPR gRNA sequence
tccagattacagcagagaag

SEQ ID NO: 323026 - DNA, 20 bp, Artificial
  CRISPR gRNA sequence
cagcagagaagaactctctg

SEQ ID NO: 323027 - DNA, 20 bp, Artificial
  CRISPR gRNA sequence
tctgtacctggcacacagtg

SEQ ID NO: 323028 - DNA, 20 bp, Artificial
  CRISPR gRNA sequence
tgtacctggcacacagtggg

SEQ ID NO: 323029 - DNA, 20 bp, Artificial
  CRISPR gRNA sequence
tacctggcacacagtgggta

SEQ ID NO: 323030 - DNA, 20 bp, Artificial
  CRISPR gRNA sequence
gcacacagtgggtattcgag

SEQ ID NO: 323031 - DNA, 20 bp, Artificial
  CRISPR gRNA sequence
gagcagtgtttgcagaatga

SEQ ID NO: 323032 - DNA, 20 bp, Artificial
  CRISPR gRNA sequence
gcagaatgaacagcagctca

SEQ ID NO: 323033 - DNA, 20 bp, Artificial
  CRISPR gRNA sequence
cagaatgaacagcagctcag

SEQ ID NO: 323034 - DNA, 20 bp, Artificial
  CRISPR gRNA sequence
agggcagaaaccctcttgag

SEQ ID NO: 323035 - DNA, 20 bp, Artificial
  CRISPR gRNA sequence
ttgagcagctcagggcagaa

SEQ ID NO: 323036 - DNA, 20 bp, Artificial
  CRISPR gRNA sequence
gagcagctcagggcagaaac

SEQ ID NO: 323037 - DNA, 20 bp, Artificial
  CRISPR gRNA sequence
agcagctcagggcagaaacc

SEQ ID NO: 323038 - DNA, 20 bp, Artificial
  CRISPR gRNA sequence
agggcagaaaccctctttga

SEQ ID NO: 323039 - DNA, 20 bp, Artificial
  CRISPR gRNA sequence
tttgagatactgggaagagt

SEQ ID NO: 323040 - DNA, 20 bp, Artificial
  CRISPR gRNA sequence
tgagatactgggaagagtaa

SEQ ID NO: 323041 - DNA, 20 bp, Artificial
  CRISPR gRNA sequence
gagatactgggaagagtaag

SEQ ID NO: 323042 - DNA, 20 bp, Artificial
  CRISPR gRNA sequence
agatactgggaagagtaaga

SEQ ID NO: 323043 - DNA, 20 bp, Artificial
  CRISPR gRNA sequence
ggaagagtaagataggctta

SEQ ID NO: 323044 - DNA, 20 bp, Artificial
  CRISPR gRNA sequence
atttccttctttataaagtt

SEQ ID NO: 323045 - DNA, 20 bp, Artificial
  CRISPR gRNA sequence
tttccttctttataaagttt

SEQ ID NO: 323046 - DNA, 20 bp, Artificial
  CRISPR gRNA sequence
ccttctttataaagtttctg

SEQ ID NO: 323047 - DNA, 20 bp, Artificial
  CRISPR gRNA sequence
cttctttataaagtttctga

SEQ ID NO: 323048 - DNA, 20 bp, Artificial
  CRISPR gRNA sequence
ctttataaagtttctgaact

SEQ ID NO: 323049 - DNA, 20 bp, Artificial
  CRISPR gRNA sequence
tttataaagtttctgaacta

SEQ ID NO: 323050 - DNA, 20 bp, Artificial
  CRISPR gRNA sequence
tataaagtttctgaactaca

SEQ ID NO: 323051 - DNA, 20 bp, Artificial
  CRISPR gRNA sequence
ataaagtttctgaactacaa

SEQ ID NO: 323052 - DNA, 20 bp, Artificial
  CRISPR gRNA sequence
taaagtttctgaactacaaa

SEQ ID NO: 323053 - DNA, 20 bp, Artificial
  CRISPR gRNA sequence
ctgaactacaaaataagaag

SEQ ID NO: 323054 - DNA, 20 bp, Artificial
  CRISPR gRNA sequence
tgaactacaaaataagaagg

SEQ ID NO: 323055 - DNA, 20 bp, Artificial
  CRISPR gRNA sequence
aactacaaaataagaaggtt

SEQ ID NO: 323056 - DNA, 20 bp, Artificial
  CRISPR gRNA sequence
caaaataagaaggttactgg

SEQ ID NO: 323057 - DNA, 20 bp, Artificial
  CRISPR gRNA sequence
ctgggaatcaaatatatttg

SEQ ID NO: 323058 - DNA, 20 bp, Artificial
  CRISPR gRNA sequence
ggaatcaaatatatttgaat

SEQ ID NO: 323059 - DNA, 20 bp, Artificial
  CRISPR gRNA sequence
gaattttagcaaggcttctg

SEQ ID NO: 323060 - DNA, 20 bp, Artificial
  CRISPR gRNA sequence
aattttagcaaggcttctga

SEQ ID NO: 323061 - DNA, 20 bp, Artificial
  CRISPR gRNA sequence
tagcaaggcttctgacagag

SEQ ID NO: 323062 - DNA, 20 bp, Artificial
  CRISPR gRNA sequence
agcaaggcttctgacagagt

SEQ ID NO: 323063 - DNA, 20 bp, Artificial
  CRISPR gRNA sequence
gcaaggcttctgacagagta

SEQ ID NO: 323064 - DNA, 20 bp, Artificial
  CRISPR gRNA sequence
ctgacagagtatcttatgat

SEQ ID NO: 323065 - DNA, 20 bp, Artificial
  CRISPR gRNA sequence
tgacagagtatcttatgata

SEQ ID NO: 323066 - DNA, 20 bp, Artificial
  CRISPR gRNA sequence
acagagtatcttatgatata

SEQ ID NO: 323067 - DNA, 20 bp, Artificial
  CRISPR gRNA sequence
atgatatacgtgacagcaat

SEQ ID NO: 323068 - DNA, 20 bp, Artificial
  CRISPR gRNA sequence
tgatatacgtgacagcaata

SEQ ID NO: 323069 - DNA, 20 bp, Artificial
  CRISPR gRNA sequence
atattgatacagttattact

SEQ ID NO: 323070 - DNA, 20 bp, Artificial
  CRISPR gRNA sequence
atacagttattactcattca

SEQ ID NO: 323071 - DNA, 20 bp, Artificial
  CRISPR gRNA sequence
ttactcattcattcatttgc

SEQ ID NO: 323072 - DNA, 20 bp, Artificial
  CRISPR gRNA sequence
ctcattcattcatttgctat

SEQ ID NO: 323073 - DNA, 20 bp, Artificial
  CRISPR gRNA sequence
attcattcatttgctattgg

SEQ ID NO: 323074 - DNA, 20 bp, Artificial
  CRISPR gRNA sequence
attcatttgctattggttca

SEQ ID NO: 323075 - DNA, 20 bp, Artificial
  CRISPR gRNA sequence
atttgctattggttcattca

SEQ ID NO: 323076 - DNA, 20 bp, Artificial
  CRISPR gRNA sequence
gctattggttcattcattca

SEQ ID NO: 323077 - DNA, 20 bp, Artificial
  CRISPR gRNA sequence
ctattggttcattcattcat

SEQ ID NO: 323078 - DNA, 20 bp, Artificial
  CRISPR gRNA sequence
ttggttcattcattcattcg

SEQ ID NO: 323079 - DNA, 20 bp, Artificial
  CRISPR gRNA sequence
gttcattcattcattcgttt

SEQ ID NO: 323080 - DNA, 20 bp, Artificial
  CRISPR gRNA sequence
attcattcattcgtttcttc

SEQ ID NO: 323081 - DNA, 20 bp, Artificial
  CRISPR gRNA sequence
attcattcgtttcttccaca

SEQ ID NO: 323082 - DNA, 20 bp, Artificial
  CRISPR gRNA sequence
attcgtttcttccacaaata

SEQ ID NO: 323083 - DNA, 20 bp, Artificial
  CRISPR gRNA sequence
gtttcttccacaaatattta

SEQ ID NO: 323084 - DNA, 20 bp, Artificial
  CRISPR gRNA sequence
cttccacaaatatttattga

SEQ ID NO: 323085 - DNA, 20 bp, Artificial
  CRISPR gRNA sequence
ttccacaaatatttattgaa

SEQ ID NO: 323086 - DNA, 20 bp, Artificial
  CRISPR gRNA sequence
ccacaaatatttattgaacc

SEQ ID NO: 323087 - DNA, 20 bp, Artificial
  CRISPR gRNA sequence
cacaaatatttattgaacca

SEQ ID NO: 323088 - DNA, 20 bp, Artificial
  CRISPR gRNA sequence
attgaaccaagcattgtgtt

SEQ ID NO: 323089 - DNA, 20 bp, Artificial
  CRISPR gRNA sequence
ttgaaccaagcattgtgttt

SEQ ID NO: 323090 - DNA, 20 bp, Artificial
  CRISPR gRNA sequence
aaccaagcattgtgtttggt

SEQ ID NO: 323091 - DNA, 20 bp, Artificial
  CRISPR gRNA sequence
tgtttggtgctaggaatata

SEQ ID NO: 323092 - DNA, 20 bp, Artificial
  CRISPR gRNA sequence
ggtgctaggaatataatgag

SEQ ID NO: 323093 - DNA, 20 bp, Artificial
  CRISPR gRNA sequence
gtgctaggaatataatgagc

SEQ ID NO: 323094 - DNA, 20 bp, Artificial
  CRISPR gRNA sequence
ggaatataatgagcaaaacc

SEQ ID NO: 323095 - DNA, 20 bp, Artificial
  CRISPR gRNA sequence
ctcttcacgtggttgcctac

SEQ ID NO: 323096 - DNA, 20 bp, Artificial
  CRISPR gRNA sequence
ttcacgtggttgcctacagt

SEQ ID NO: 323097 - DNA, 20 bp, Artificial
  CRISPR gRNA sequence
cacgtggttgcctacagttt

SEQ ID NO: 323098 - DNA, 20 bp, Artificial
  CRISPR gRNA sequence
acgtggttgcctacagttta

SEQ ID NO: 323099 - DNA, 20 bp, Artificial
  CRISPR gRNA sequence
cctacagtttagtagaaaag

SEQ ID NO: 323100 - DNA, 20 bp, Artificial
  CRISPR gRNA sequence
cagtttagtagaaaagcaag

SEQ ID NO: 323101 - DNA, 20 bp, Artificial
  CRISPR gRNA sequence
agtagaaaagcaagatagtg

SEQ ID NO: 323102 - DNA, 20 bp, Artificial
  CRISPR gRNA sequence
gtagaaaagcaagatagtga

SEQ ID NO: 323103 - DNA, 20 bp, Artificial
  CRISPR gRNA sequence
gctatgacaagtgctacaaa

SEQ ID NO: 323104 - DNA, 20 bp, Artificial
  CRISPR gRNA sequence
tgacaagtgctacaaaagag

SEQ ID NO: 323105 - DNA, 20 bp, Artificial
  CRISPR gRNA sequence
caaaagagaggttcatggta

SEQ ID NO: 323106 - DNA, 20 bp, Artificial
  CRISPR gRNA sequence
atggtactttgagagcccat

SEQ ID NO: 323107 - DNA, 20 bp, Artificial
  CRISPR gRNA sequence
tgagagcccataacaggacc

SEQ ID NO: 323108 - DNA, 20 bp, Artificial
  CRISPR gRNA sequence
gagagcccataacaggacca

SEQ ID NO: 323109 - DNA, 20 bp, Artificial
  CRISPR gRNA sequence
agagcccataacaggaccag

SEQ ID NO: 323110 - DNA, 20 bp, Artificial
  CRISPR gRNA sequence
aactgagatctgaagaatga

SEQ ID NO: 323111 - DNA, 20 bp, Artificial
  CRISPR gRNA sequence
agatctgaagaatgatataa

SEQ ID NO: 323112 - DNA, 20 bp, Artificial
  CRISPR gRNA sequence
aagaatgatataatagatta

SEQ ID NO: 323113 - DNA, 20 bp, Artificial
  CRISPR gRNA sequence
aaaagaaacacatatccttg

SEQ ID NO: 323114 - DNA, 20 bp, Artificial
  CRISPR gRNA sequence
ggctactcctcctcccatga

SEQ ID NO: 323115 - DNA, 20 bp, Artificial
  CRISPR gRNA sequence
gctactcctcctcccatgaa

SEQ ID NO: 323116 - DNA, 20 bp, Artificial
  CRISPR gRNA sequence
ctcctcctcccatgaagagg

SEQ ID NO: 323117 - DNA, 20 bp, Artificial
  CRISPR gRNA sequence
ctcctcccatgaagaggtag

SEQ ID NO: 323118 - DNA, 20 bp, Artificial
  CRISPR gRNA sequence
ctcccatgaagaggtagagt

SEQ ID NO: 323119 - DNA, 20 bp, Artificial
  CRISPR gRNA sequence
ccatgaagaggtagagttgg

SEQ ID NO: 323120 - DNA, 20 bp, Artificial
  CRISPR gRNA sequence
gatctcctctctttgaatct

SEQ ID NO: 323121 - DNA, 20 bp, Artificial
  CRISPR gRNA sequence
ctctctttgaatctgggcta

SEQ ID NO: 323122 - DNA, 20 bp, Artificial
  CRISPR gRNA sequence
tctttgaatctgggctagcc

SEQ ID NO: 323123 - DNA, 20 bp, Artificial
  CRISPR gRNA sequence
tttgaatctgggctagcctg

SEQ ID NO: 323124 - DNA, 20 bp, Artificial
  CRISPR gRNA sequence
tgaatctgggctagcctgag

SEQ ID NO: 323125 - DNA, 20 bp, Artificial
  CRISPR gRNA sequence
gaatctgggctagcctgagt

SEQ ID NO: 323126 - DNA, 20 bp, Artificial
  CRISPR gRNA sequence
aatctgggctagcctgagtg

SEQ ID NO: 323127 - DNA, 20 bp, Artificial
  CRISPR gRNA sequence
ggctagcctgagtgacctgt

SEQ ID NO: 323128 - DNA, 20 bp, Artificial
  CRISPR gRNA sequence
gcctgagtgacctgtttgac

SEQ ID NO: 323129 - DNA, 20 bp, Artificial
  CRISPR gRNA sequence
agtgacctgtttgaccatag

SEQ ID NO: 323130 - DNA, 20 bp, Artificial
  CRISPR gRNA sequence
tttgaccatagaatacagta

SEQ ID NO: 323131 - DNA, 20 bp, Artificial
  CRISPR gRNA sequence
gaccatagaatacagtacaa

SEQ ID NO: 323132 - DNA, 20 bp, Artificial
  CRISPR gRNA sequence
accatagaatacagtacaag

SEQ ID NO: 323133 - DNA, 20 bp, Artificial
  CRISPR gRNA sequence
tgggacttcgagagcttggt

SEQ ID NO: 323134 - DNA, 20 bp, Artificial
  CRISPR gRNA sequence
ggacttcgagagcttggtca

SEQ ID NO: 323135 - DNA, 20 bp, Artificial
  CRISPR gRNA sequence
cgagagcttggtcataagaa

SEQ ID NO: 323136 - DNA, 20 bp, Artificial
  CRISPR gRNA sequence
gagagcttggtcataagaag

SEQ ID NO: 323137 - DNA, 20 bp, Artificial
  CRISPR gRNA sequence
ggtcataagaagcctcacag

SEQ ID NO: 323138 - DNA, 20 bp, Artificial
  CRISPR gRNA sequence
gtcataagaagcctcacagc

SEQ ID NO: 323139 - DNA, 20 bp, Artificial
  CRISPR gRNA sequence
acagcttctacctgtctctc

SEQ ID NO: 323140 - DNA, 20 bp, Artificial
  CRISPR gRNA sequence
ctacctgtctctctgggagt

SEQ ID NO: 323141 - DNA, 20 bp, Artificial
  CRISPR gRNA sequence
tacctgtctctctgggagta

SEQ ID NO: 323142 - DNA, 20 bp, Artificial
  CRISPR gRNA sequence
cctgtctctctgggagtacc

SEQ ID NO: 323143 - DNA, 20 bp, Artificial
  CRISPR gRNA sequence
tctctctgggagtaccttat

SEQ ID NO: 323144 - DNA, 20 bp, Artificial
  CRISPR gRNA sequence
tctgggagtaccttatctgg

SEQ ID NO: 323145 - DNA, 20 bp, Artificial
  CRISPR gRNA sequence
tgggagtaccttatctggag

SEQ ID NO: 323146 - DNA, 20 bp, Artificial
  CRISPR gRNA sequence
ggagtaccttatctggagtt

SEQ ID NO: 323147 - DNA, 20 bp, Artificial
  CRISPR gRNA sequence
atctggagttctgagccacc

SEQ ID NO: 323148 - DNA, 20 bp, Artificial
  CRISPR gRNA sequence
tctggagttctgagccacca

SEQ ID NO: 323149 - DNA, 20 bp, Artificial
  CRISPR gRNA sequence
gagttctgagccaccacgta

SEQ ID NO: 323150 - DNA, 20 bp, Artificial
  CRISPR gRNA sequence
tgagccaccacgtaagatgt

SEQ ID NO: 323151 - DNA, 20 bp, Artificial
  CRISPR gRNA sequence
agccaccacgtaagatgtcc

SEQ ID NO: 323152 - DNA, 20 bp, Artificial
  CRISPR gRNA sequence
ccccgagaccatcatgctgg

SEQ ID NO: 323153 - DNA, 20 bp, Artificial
  CRISPR gRNA sequence
gagaggactgtatagctgtt

SEQ ID NO: 323154 - DNA, 20 bp, Artificial
  CRISPR gRNA sequence
tatagctgtttgggtcaatg

SEQ ID NO: 323155 - DNA, 20 bp, Artificial
  CRISPR gRNA sequence
tttgggtcaatggtcccagc

SEQ ID NO: 323156 - DNA, 20 bp, Artificial
  CRISPR gRNA sequence
gggtcaatggtcccagctga

SEQ ID NO: 323157 - DNA, 20 bp, Artificial
  CRISPR gRNA sequence
ggtcaatggtcccagctgag

SEQ ID NO: 323158 - DNA, 20 bp, Artificial
  CRISPR gRNA sequence
agccttccacctatccctgc

SEQ ID NO: 323159 - DNA, 20 bp, Artificial
  CRISPR gRNA sequence
ccacctatccctgccaagcc

SEQ ID NO: 323160 - DNA, 20 bp, Artificial
  CRISPR gRNA sequence
cacctatccctgccaagcca

SEQ ID NO: 323161 - DNA, 20 bp, Artificial
  CRISPR gRNA sequence
tccctgccaagccaccagac

SEQ ID NO: 323162 - DNA, 20 bp, Artificial
  CRISPR gRNA sequence
ccaagccaccagacatatga

SEQ ID NO: 323163 - DNA, 20 bp, Artificial
  CRISPR gRNA sequence
ggatcttctagatcaggggt

SEQ ID NO: 323164 - DNA, 20 bp, Artificial
  CRISPR gRNA sequence
gatcttctagatcaggggtc

SEQ ID NO: 323165 - DNA, 20 bp, Artificial
  CRISPR gRNA sequence
ctagatcaggggtcagcaaa

SEQ ID NO: 323166 - DNA, 20 bp, Artificial
  CRISPR gRNA sequence
tagatcaggggtcagcaaac

SEQ ID NO: 323167 - DNA, 20 bp, Artificial
  CRISPR gRNA sequence
gatcaggggtcagcaaacta

SEQ ID NO: 323168 - DNA, 20 bp, Artificial
  CRISPR gRNA sequence
cagcctgtaggccaaatctg

SEQ ID NO: 323169 - DNA, 20 bp, Artificial
  CRISPR gRNA sequence
taggccaaatctggctacca

SEQ ID NO: 323170 - DNA, 20 bp, Artificial
  CRISPR gRNA sequence
gctaccacctatttttatta

SEQ ID NO: 323171 - DNA, 20 bp, Artificial
  CRISPR gRNA sequence
ccacctatttttattaatag

SEQ ID NO: 323172 - DNA, 20 bp, Artificial
  CRISPR gRNA sequence
tttttattaatagttgtact

SEQ ID NO: 323173 - DNA, 20 bp, Artificial
  CRISPR gRNA sequence
ttattaatagttgtactgga

SEQ ID NO: 323174 - DNA, 20 bp, Artificial
  CRISPR gRNA sequence
tattaatagttgtactggaa

SEQ ID NO: 323175 - DNA, 20 bp, Artificial
  CRISPR gRNA sequence
attaatagttgtactggaac

SEQ ID NO: 323176 - DNA, 20 bp, Artificial
  CRISPR gRNA sequence
ttaatagttgtactggaaca

SEQ ID NO: 323177 - DNA, 20 bp, Artificial
  CRISPR gRNA sequence
atagttgtactggaacactg

SEQ ID NO: 323178 - DNA, 20 bp, Artificial
  CRISPR gRNA sequence
tactggaacactgctatgtc

SEQ ID NO: 323179 - DNA, 20 bp, Artificial
  CRISPR gRNA sequence
gaacactgctatgtctattg

SEQ ID NO: 323180 - DNA, 20 bp, Artificial
  CRISPR gRNA sequence
ctatgtctattgtaaattat

SEQ ID NO: 323181 - DNA, 20 bp, Artificial
  CRISPR gRNA sequence
tgtctattgtaaattattat

SEQ ID NO: 323182 - DNA, 20 bp, Artificial
  CRISPR gRNA sequence
ttgtaaattattatctatgg

SEQ ID NO: 323183 - DNA, 20 bp, Artificial
  CRISPR gRNA sequence
taaattattatctatggctg

SEQ ID NO: 323184 - DNA, 20 bp, Artificial
  CRISPR gRNA sequence
ttatctatggctgcttttgc

SEQ ID NO: 323185 - DNA, 20 bp, Artificial
  CRISPR gRNA sequence
tctatggctgcttttgcagt

SEQ ID NO: 323186 - DNA, 20 bp, Artificial
  CRISPR gRNA sequence
tggctgcttttgcagtgcaa

SEQ ID NO: 323187 - DNA, 20 bp, Artificial
  CRISPR gRNA sequence
cttttgcagtgcaatggaag

SEQ ID NO: 323188 - DNA, 20 bp, Artificial
  CRISPR gRNA sequence
ttgcagtgcaatggaagagt

SEQ ID NO: 323189 - DNA, 20 bp, Artificial
  CRISPR gRNA sequence
tgcagtgcaatggaagagtt

SEQ ID NO: 323190 - DNA, 20 bp, Artificial
  CRISPR gRNA sequence
gcagtgcaatggaagagttg

SEQ ID NO: 323191 - DNA, 20 bp, Artificial
  CRISPR gRNA sequence
cagtgcaatggaagagttga

SEQ ID NO: 323192 - DNA, 20 bp, Artificial
  CRISPR gRNA sequence
aacagctatgatggagactg

SEQ ID NO: 323193 - DNA, 20 bp, Artificial
  CRISPR gRNA sequence
tgatggagactgcatggcct

SEQ ID NO: 323194 - DNA, 20 bp, Artificial
  CRISPR gRNA sequence
catggcctgcaaagctgaaa

SEQ ID NO: 323195 - DNA, 20 bp, Artificial
  CRISPR gRNA sequence
caaagctgaaaacattttct

SEQ ID NO: 323196 - DNA, 20 bp, Artificial
  CRISPR gRNA sequence
aaaacattttctatgtggcc

SEQ ID NO: 323197 - DNA, 20 bp, Artificial
  CRISPR gRNA sequence
tctatgtggcctttcataga

SEQ ID NO: 323198 - DNA, 20 bp, Artificial
  CRISPR gRNA sequence
ctatgtggcctttcatagaa

SEQ ID NO: 323199 - DNA, 20 bp, Artificial
  CRISPR gRNA sequence
tatgtggcctttcatagaaa

SEQ ID NO: 323200 - DNA, 20 bp, Artificial
  CRISPR gRNA sequence
tgtggcctttcatagaaaaa

SEQ ID NO: 323201 - DNA, 20 bp, Artificial
  CRISPR gRNA sequence
tcatagaaaaaactgcttga

SEQ ID NO: 323202 - DNA, 20 bp, Artificial
  CRISPR gRNA sequence
catagaaaaaactgcttgac

SEQ ID NO: 323203 - DNA, 20 bp, Artificial
  CRISPR gRNA sequence
atagaaaaaactgcttgact

SEQ ID NO: 323204 - DNA, 20 bp, Artificial
  CRISPR gRNA sequence
cttgactcctgctctagatc

SEQ ID NO: 323205 - DNA, 20 bp, Artificial
  CRISPR gRNA sequence
gactcctgctctagatcagc

SEQ ID NO: 323206 - DNA, 20 bp, Artificial
  CRISPR gRNA sequence
actcctgctctagatcagca

SEQ ID NO: 323207 - DNA, 20 bp, Artificial
  CRISPR gRNA sequence
ctgctctagatcagcactgt

SEQ ID NO: 323208 - DNA, 20 bp, Artificial
  CRISPR gRNA sequence
ctctagatcagcactgtcca

SEQ ID NO: 323209 - DNA, 20 bp, Artificial
  CRISPR gRNA sequence
tagatcagcactgtccagta

SEQ ID NO: 323210 - DNA, 20 bp, Artificial
  CRISPR gRNA sequence
gatcagcactgtccagtaag

SEQ ID NO: 323211 - DNA, 20 bp, Artificial
  CRISPR gRNA sequence
tccagtaagaatataaaaca

SEQ ID NO: 323212 - DNA, 20 bp, Artificial
  CRISPR gRNA sequence
atgcttgtaatcccagcact

SEQ ID NO: 323213 - DNA, 20 bp, Artificial
  CRISPR gRNA sequence
gtaatcccagcactttggga

SEQ ID NO: 323214 - DNA, 20 bp, Artificial
  CRISPR gRNA sequence
taatcccagcactttgggag

SEQ ID NO: 323215 - DNA, 20 bp, Artificial
  CRISPR gRNA sequence
tgggaggccgaggtgggcag

SEQ ID NO: 323216 - DNA, 20 bp, Artificial
  CRISPR gRNA sequence
gggaggccgaggtgggcaga

SEQ ID NO: 323217 - DNA, 20 bp, Artificial
  CRISPR gRNA sequence
ggaggccgaggtgggcagat

SEQ ID NO: 323218 - DNA, 20 bp, Artificial
  CRISPR gRNA sequence
cctgaggtcaggagtttgag

SEQ ID NO: 323219 - DNA, 20 bp, Artificial
  CRISPR gRNA sequence
aggtcaggagtttgagacca

SEQ ID NO: 323220 - DNA, 20 bp, Artificial
  CRISPR gRNA sequence
gagaccagcctggccattat

SEQ ID NO: 323221 - DNA, 20 bp, Artificial
  CRISPR gRNA sequence
agaccagcctggccattatg

SEQ ID NO: 323222 - DNA, 20 bp, Artificial
  CRISPR gRNA sequence
gccattatggggaaaccccg

SEQ ID NO: 323223 - DNA, 20 bp, Artificial
  CRISPR gRNA sequence
tggggaaaccccgtctctac

SEQ ID NO: 323224 - DNA, 20 bp, Artificial
  CRISPR gRNA sequence
tactaaaaatacaaaaatta

SEQ ID NO: 323225 - DNA, 20 bp, Artificial
  CRISPR gRNA sequence
ctaaaaatacaaaaattagc

SEQ ID NO: 323226 - DNA, 20 bp, Artificial
  CRISPR gRNA sequence
aaaatacaaaaattagctgg

SEQ ID NO: 323227 - DNA, 20 bp, Artificial
  CRISPR gRNA sequence
gctgggcatagtggcgggca

SEQ ID NO: 323228 - DNA, 20 bp, Artificial
  CRISPR gRNA sequence
ggcatagtggcgggcacctg

SEQ ID NO: 323229 - DNA, 20 bp, Artificial
  CRISPR gRNA sequence
taatttcagctactcaggag

SEQ ID NO: 323230 - DNA, 20 bp, Artificial
  CRISPR gRNA sequence
cagctactcaggaggctgag

SEQ ID NO: 323231 - DNA, 20 bp, Artificial
  CRISPR gRNA sequence
agctactcaggaggctgagg

SEQ ID NO: 323232 - DNA, 20 bp, Artificial
  CRISPR gRNA sequence
ctcaggaggctgaggcagga

SEQ ID NO: 323233 - DNA, 20 bp, Artificial
  CRISPR gRNA sequence
aggaggctgaggcaggagaa

SEQ ID NO: 323234 - DNA, 20 bp, Artificial
  CRISPR gRNA sequence
aggcaggagaatcacttgaa

SEQ ID NO: 323235 - DNA, 20 bp, Artificial
  CRISPR gRNA sequence
gaacctgggaggcagagctt

SEQ ID NO: 323236 - DNA, 20 bp, Artificial
  CRISPR gRNA sequence
aacctgggaggcagagcttg

SEQ ID NO: 323237 - DNA, 20 bp, Artificial
  CRISPR gRNA sequence
ggaggcagagcttgcgatga

SEQ ID NO: 323238 - DNA, 20 bp, Artificial
  CRISPR gRNA sequence
gcgatgagcagagatctcgc

SEQ ID NO: 323239 - DNA, 20 bp, Artificial
  CRISPR gRNA sequence
cgatgagcagagatctcgcc

SEQ ID NO: 323240 - DNA, 20 bp, Artificial
  CRISPR gRNA sequence
gccactgcactccagcctgg

SEQ ID NO: 323241 - DNA, 20 bp, Artificial
  CRISPR gRNA sequence
cactccagcctgggcaacag

SEQ ID NO: 323242 - DNA, 20 bp, Artificial
  CRISPR gRNA sequence
cagcctgggcaacagagtaa

SEQ ID NO: 323243 - DNA, 20 bp, Artificial
  CRISPR gRNA sequence
ggcaacagagtaagactcca

SEQ ID NO: 323244 - DNA, 20 bp, Artificial
  CRISPR gRNA sequence
catctcagaaaaaaagaata

SEQ ID NO: 323245 - DNA, 20 bp, Artificial
  CRISPR gRNA sequence
agaaaaaaagaatacaatac

SEQ ID NO: 323246 - DNA, 20 bp, Artificial
  CRISPR gRNA sequence
caagccacagatataatttg

SEQ ID NO: 323247 - DNA, 20 bp, Artificial
  CRISPR gRNA sequence
gaaaacttgtagtagtcaca

SEQ ID NO: 323248 - DNA, 20 bp, Artificial
  CRISPR gRNA sequence
aaaacttgtagtagtcacat

SEQ ID NO: 323249 - DNA, 20 bp, Artificial
  CRISPR gRNA sequence
gtagtagtcacattaaagaa

SEQ ID NO: 323250 - DNA, 20 bp, Artificial
  CRISPR gRNA sequence
tagtagtcacattaaagaaa

SEQ ID NO: 323251 - DNA, 20 bp, Artificial
  CRISPR gRNA sequence
aagaaattaaaaagaaatag

SEQ ID NO: 323252 - DNA, 20 bp, Artificial
  CRISPR gRNA sequence
aaaagaaataggtgacatta

SEQ ID NO: 323253 - DNA, 20 bp, Artificial
  CRISPR gRNA sequence
attttaatgacattttatgt

SEQ ID NO: 323254 - DNA, 20 bp, Artificial
  CRISPR gRNA sequence
taatgacattttatgttatc

SEQ ID NO: 323255 - DNA, 20 bp, Artificial
  CRISPR gRNA sequence
aatgacattttatgttatct

SEQ ID NO: 323256 - DNA, 20 bp, Artificial
  CRISPR gRNA sequence
atgacattttatgttatctg

SEQ ID NO: 323257 - DNA, 20 bp, Artificial
  CRISPR gRNA sequence
tatgttatctgatgtatgtg

SEQ ID NO: 323258 - DNA, 20 bp, Artificial
  CRISPR gRNA sequence
atgttatctgatgtatgtga

SEQ ID NO: 323259 - DNA, 20 bp, Artificial
  CRISPR gRNA sequence
tgttatctgatgtatgtgaa

SEQ ID NO: 323260 - DNA, 20 bp, Artificial
  CRISPR gRNA sequence
tctgatgtatgtgaaatatt

SEQ ID NO: 323261 - DNA, 20 bp, Artificial
  CRISPR gRNA sequence
atgtatgtgaaatattataa

SEQ ID NO: 323262 - DNA, 20 bp, Artificial
  CRISPR gRNA sequence
taatctcaacatgtaatcag

SEQ ID NO: 323263 - DNA, 20 bp, Artificial
  CRISPR gRNA sequence
aacatgtaatcagaatacaa

SEQ ID NO: 323264 - DNA, 20 bp, Artificial
  CRISPR gRNA sequence
ttaacgaatattttaaattt

SEQ ID NO: 323265 - DNA, 20 bp, Artificial
  CRISPR gRNA sequence
acgaatattttaaatttttt

SEQ ID NO: 323266 - DNA, 20 bp, Artificial
  CRISPR gRNA sequence
taaattttttggtggcacca

SEQ ID NO: 323267 - DNA, 20 bp, Artificial
  CRISPR gRNA sequence
aaattttttggtggcaccaa

SEQ ID NO: 323268 - DNA, 20 bp, Artificial
  CRISPR gRNA sequence
aattttttggtggcaccaaa

SEQ ID NO: 323269 - DNA, 20 bp, Artificial
  CRISPR gRNA sequence
tttggtggcaccaaatcttc

SEQ ID NO: 323270 - DNA, 20 bp, Artificial
  CRISPR gRNA sequence
ttggtggcaccaaatcttca

SEQ ID NO: 323271 - DNA, 20 bp, Artificial
  CRISPR gRNA sequence
tggtggcaccaaatcttcaa

SEQ ID NO: 323272 - DNA, 20 bp, Artificial
  CRISPR gRNA sequence
ggtggcaccaaatcttcaat

SEQ ID NO: 323273 - DNA, 20 bp, Artificial
  CRISPR gRNA sequence
gtggcaccaaatcttcaata

SEQ ID NO: 323274 - DNA, 20 bp, Artificial
  CRISPR gRNA sequence
caataatcatgtgggtgttt

SEQ ID NO: 323275 - DNA, 20 bp, Artificial
  CRISPR gRNA sequence
aataatcatgtgggtgtttt

SEQ ID NO: 323276 - DNA, 20 bp, Artificial
  CRISPR gRNA sequence
tatagttatagcacatctca

SEQ ID NO: 323277 - DNA, 20 bp, Artificial
  CRISPR gRNA sequence
atagttatagcacatctcaa

SEQ ID NO: 323278 - DNA, 20 bp, Artificial
  CRISPR gRNA sequence
tagttatagcacatctcaat

SEQ ID NO: 323279 - DNA, 20 bp, Artificial
  CRISPR gRNA sequence
tagcacatctcaattaggac

SEQ ID NO: 323280 - DNA, 20 bp, Artificial
  CRISPR gRNA sequence
aattaggactggctgcattt

SEQ ID NO: 323281 - DNA, 20 bp, Artificial
  CRISPR gRNA sequence
ggactggctgcatttcaggt

SEQ ID NO: 323282 - DNA, 20 bp, Artificial
  CRISPR gRNA sequence
gctgcatttcaggtaaccag

SEQ ID NO: 323283 - DNA, 20 bp, Artificial
  CRISPR gRNA sequence
catttcaggtaaccagtggc

SEQ ID NO: 323284 - DNA, 20 bp, Artificial
  CRISPR gRNA sequence
caggtaaccagtggctacca

SEQ ID NO: 323285 - DNA, 20 bp, Artificial
  CRISPR gRNA sequence
aggtaaccagtggctaccaa

SEQ ID NO: 323286 - DNA, 20 bp, Artificial
  CRISPR gRNA sequence
ccaaactggacagtgcatct

SEQ ID NO: 323287 - DNA, 20 bp, Artificial
  CRISPR gRNA sequence
gacagtgcatctccagatca

SEQ ID NO: 323288 - DNA, 20 bp, Artificial
  CRISPR gRNA sequence
cagatcagcccatccatcag

SEQ ID NO: 323289 - DNA, 20 bp, Artificial
  CRISPR gRNA sequence
aataacatcaggtgatatca

SEQ ID NO: 323290 - DNA, 20 bp, Artificial
  CRISPR gRNA sequence
ataacatcaggtgatatcaa

SEQ ID NO: 323291 - DNA, 20 bp, Artificial
  CRISPR gRNA sequence
atggcatgaggaacagaaaa

SEQ ID NO: 323292 - DNA, 20 bp, Artificial
  CRISPR gRNA sequence
aaattcctgaccccaaacat

SEQ ID NO: 323293 - DNA, 20 bp, Artificial
  CRISPR gRNA sequence
ctgaccccaaacattgtgag

SEQ ID NO: 323294 - DNA, 20 bp, Artificial
  CRISPR gRNA sequence
accccaaacattgtgagaga

SEQ ID NO: 323295 - DNA, 20 bp, Artificial
  CRISPR gRNA sequence
tgagagagggtaaaggattc

SEQ ID NO: 323296 - DNA, 20 bp, Artificial
  CRISPR gRNA sequence
attgttctaagctgctaagt

SEQ ID NO: 323297 - DNA, 20 bp, Artificial
  CRISPR gRNA sequence
ttctaagctgctaagtttgg

SEQ ID NO: 323298 - DNA, 20 bp, Artificial
  CRISPR gRNA sequence
taagctgctaagtttggaga

SEQ ID NO: 323299 - DNA, 20 bp, Artificial
  CRISPR gRNA sequence
agctgctaagtttggagaca

SEQ ID NO: 323300 - DNA, 20 bp, Artificial
  CRISPR gRNA sequence
ctaagtttggagacagtttg

SEQ ID NO: 323301 - DNA, 20 bp, Artificial
  CRISPR gRNA sequence
agtttggagacagtttgtaa

SEQ ID NO: 323302 - DNA, 20 bp, Artificial
  CRISPR gRNA sequence
ggagacagtttgtaacatac

SEQ ID NO: 323303 - DNA, 20 bp, Artificial
  CRISPR gRNA sequence
gagacagtttgtaacatacc

SEQ ID NO: 323304 - DNA, 20 bp, Artificial
  CRISPR gRNA sequence
gtaacataccaagaggcaaa

SEQ ID NO: 323305 - DNA, 20 bp, Artificial
  CRISPR gRNA sequence
taacataccaagaggcaaac

SEQ ID NO: 323306 - DNA, 20 bp, Artificial
  CRISPR gRNA sequence
aataggtaggtgctaagtag

SEQ ID NO: 323307 - DNA, 20 bp, Artificial
  CRISPR gRNA sequence
agtaggtgaagggcttggga

SEQ ID NO: 323308 - DNA, 20 bp, Artificial
  CRISPR gRNA sequence
gggagttgacaggaagagtt

SEQ ID NO: 323309 - DNA, 20 bp, Artificial
  CRISPR gRNA sequence
ggagttgacaggaagagttc

SEQ ID NO: 323310 - DNA, 20 bp, Artificial
  CRISPR gRNA sequence
acaggaagagttctcggcaa

SEQ ID NO: 323311 - DNA, 20 bp, Artificial
  CRISPR gRNA sequence
tcggcaaagggaacagcata

SEQ ID NO: 323312 - DNA, 20 bp, Artificial
  CRISPR gRNA sequence
ggcaaagggaacagcatatg

SEQ ID NO: 323313 - DNA, 20 bp, Artificial
  CRISPR gRNA sequence
aggcaggagggcacgtgaga

SEQ ID NO: 323314 - DNA, 20 bp, Artificial
  CRISPR gRNA sequence
tggccaaaatgaagagacag

SEQ ID NO: 323315 - DNA, 20 bp, Artificial
  CRISPR gRNA sequence
aagaggtgagcaggggccag

SEQ ID NO: 323316 - DNA, 20 bp, Artificial
  CRISPR gRNA sequence
ttggtcagttaaagatttca

SEQ ID NO: 323317 - DNA, 20 bp, Artificial
  CRISPR gRNA sequence
gtcagttaaagatttcagtc

SEQ ID NO: 323318 - DNA, 20 bp, Artificial
  CRISPR gRNA sequence
aagatttcagtctttatatg

SEQ ID NO: 323319 - DNA, 20 bp, Artificial
  CRISPR gRNA sequence
cagtctttatatgtgaacca

SEQ ID NO: 323320 - DNA, 20 bp, Artificial
  CRISPR gRNA sequence
agtctttatatgtgaaccac

SEQ ID NO: 323321 - DNA, 20 bp, Artificial
  CRISPR gRNA sequence
tatatgtgaaccaccaaaga

SEQ ID NO: 323322 - DNA, 20 bp, Artificial
  CRISPR gRNA sequence
atatgtgaaccaccaaagaa

SEQ ID NO: 323323 - DNA, 20 bp, Artificial
  CRISPR gRNA sequence
tatgtgaaccaccaaagaaa

SEQ ID NO: 323324 - DNA, 20 bp, Artificial
  CRISPR gRNA sequence
gagctgagactgatatcatc

SEQ ID NO: 323325 - DNA, 20 bp, Artificial
  CRISPR gRNA sequence
agactgatatcatcagattt

SEQ ID NO: 323326 - DNA, 20 bp, Artificial
  CRISPR gRNA sequence
atatcatcagatttgcattt

SEQ ID NO: 323327 - DNA, 20 bp, Artificial
  CRISPR gRNA sequence
gcattttgaaaagatgacca

SEQ ID NO: 323328 - DNA, 20 bp, Artificial
  CRISPR gRNA sequence
cattttgaaaagatgaccat

SEQ ID NO: 323329 - DNA, 20 bp, Artificial
  CRISPR gRNA sequence
tgaaaagatgaccatggttt

SEQ ID NO: 323330 - DNA, 20 bp, Artificial
  CRISPR gRNA sequence
gaaaagatgaccatggtttc

SEQ ID NO: 323331 - DNA, 20 bp, Artificial
  CRISPR gRNA sequence
aaaagatgaccatggtttct

SEQ ID NO: 323332 - DNA, 20 bp, Artificial
  CRISPR gRNA sequence
ctgtgtagcaaatggatgat

SEQ ID NO: 323333 - DNA, 20 bp, Artificial
  CRISPR gRNA sequence
tgtgtagcaaatggatgata

SEQ ID NO: 323334 - DNA, 20 bp, Artificial
  CRISPR gRNA sequence
tgtagcaaatggatgatagg

SEQ ID NO: 323335 - DNA, 20 bp, Artificial
  CRISPR gRNA sequence
gctactgcaattgtttgagt

SEQ ID NO: 323336 - DNA, 20 bp, Artificial
  CRISPR gRNA sequence
ctgcaattgtttgagtgaaa

SEQ ID NO: 323337 - DNA, 20 bp, Artificial
  CRISPR gRNA sequence
caattgtttgagtgaaagaa

SEQ ID NO: 323338 - DNA, 20 bp, Artificial
  CRISPR gRNA sequence
tttgagtgaaagaagatggc

SEQ ID NO: 323339 - DNA, 20 bp, Artificial
  CRISPR gRNA sequence
gagtgaaagaagatggctgt

SEQ ID NO: 323340 - DNA, 20 bp, Artificial
  CRISPR gRNA sequence
agtgaaagaagatggctgtt

SEQ ID NO: 323341 - DNA, 20 bp, Artificial
  CRISPR gRNA sequence
tttggtctgggatagtagca

SEQ ID NO: 323342 - DNA, 20 bp, Artificial
  CRISPR gRNA sequence
ggtctgggatagtagcaggt

SEQ ID NO: 323343 - DNA, 20 bp, Artificial
  CRISPR gRNA sequence
gtctgggatagtagcaggtg

SEQ ID NO: 323344 - DNA, 20 bp, Artificial
  CRISPR gRNA sequence
ggatagtagcaggtgaagta

SEQ ID NO: 323345 - DNA, 20 bp, Artificial
  CRISPR gRNA sequence
agaattataattaacaggat

SEQ ID NO: 323346 - DNA, 20 bp, Artificial
  CRISPR gRNA sequence
gaattataattaacaggata

SEQ ID NO: 323347 - DNA, 20 bp, Artificial
  CRISPR gRNA sequence
taattaacaggatatggtga

SEQ ID NO: 323348 - DNA, 20 bp, Artificial
  CRISPR gRNA sequence
acaggatatggtgatagatc

SEQ ID NO: 323349 - DNA, 20 bp, Artificial
  CRISPR gRNA sequence
tttgatttattcatttattc

SEQ ID NO: 323350 - DNA, 20 bp, Artificial
  CRISPR gRNA sequence
gatttattcatttattcatt

SEQ ID NO: 323351 - DNA, 20 bp, Artificial
  CRISPR gRNA sequence
atttattcatttattcattt

SEQ ID NO: 323352 - DNA, 20 bp, Artificial
  CRISPR gRNA sequence
attcatttattcatttgact

SEQ ID NO: 323353 - DNA, 20 bp, Artificial
  CRISPR gRNA sequence
ttcatttattcatttgactc

SEQ ID NO: 323354 - DNA, 20 bp, Artificial
  CRISPR gRNA sequence
atttattcatttgactcagc

SEQ ID NO: 323355 - DNA, 20 bp, Artificial
  CRISPR gRNA sequence
attcatttgactcagcaact

SEQ ID NO: 323356 - DNA, 20 bp, Artificial
  CRISPR gRNA sequence
ttcatttgactcagcaactg

SEQ ID NO: 323357 - DNA, 20 bp, Artificial
  CRISPR gRNA sequence
atttgactcagcaactgcat

SEQ ID NO: 323358 - DNA, 20 bp, Artificial
  CRISPR gRNA sequence
gactcagcaactgcatcatt

SEQ ID NO: 323359 - DNA, 20 bp, Artificial
  CRISPR gRNA sequence
actcagcaactgcatcattc

SEQ ID NO: 323360 - DNA, 20 bp, Artificial
  CRISPR gRNA sequence
agcaactgcatcattcttgt

SEQ ID NO: 323361 - DNA, 20 bp, Artificial
  CRISPR gRNA sequence
catcattcttgtctaaaaga

SEQ ID NO: 323362 - DNA, 20 bp, Artificial
  CRISPR gRNA sequence
ttgtctaaaagactgatccc

SEQ ID NO: 323363 - DNA, 20 bp, Artificial
  CRISPR gRNA sequence
gtctaaaagactgatcccac

SEQ ID NO: 323364 - DNA, 20 bp, Artificial
  CRISPR gRNA sequence
tctaaaagactgatcccaca

SEQ ID NO: 323365 - DNA, 20 bp, Artificial
  CRISPR gRNA sequence
aaagactgatcccacagtgg

SEQ ID NO: 323366 - DNA, 20 bp, Artificial
  CRISPR gRNA sequence
atcccacagtggatgctaca

SEQ ID NO: 323367 - DNA, 20 bp, Artificial
  CRISPR gRNA sequence
caagactctgtgtttcacta

SEQ ID NO: 323368 - DNA, 20 bp, Artificial
  CRISPR gRNA sequence
tgtgtttcactatttcactt

SEQ ID NO: 323369 - DNA, 20 bp, Artificial
  CRISPR gRNA sequence
tgtttcactatttcactttt

SEQ ID NO: 323370 - DNA, 20 bp, Artificial
  CRISPR gRNA sequence
cactatttcacttttatgta

SEQ ID NO: 323371 - DNA, 20 bp, Artificial
  CRISPR gRNA sequence
actatttcacttttatgtat

SEQ ID NO: 323372 - DNA, 20 bp, Artificial
  CRISPR gRNA sequence
tttcacttttatgtatttag

SEQ ID NO: 323373 - DNA, 20 bp, Artificial
  CRISPR gRNA sequence
cacttttatgtatttagtaa

SEQ ID NO: 323374 - DNA, 20 bp, Artificial
  CRISPR gRNA sequence
acttttatgtatttagtaaa

SEQ ID NO: 323375 - DNA, 20 bp, Artificial
  CRISPR gRNA sequence
ttatgtatttagtaaaacta

SEQ ID NO: 323376 - DNA, 20 bp, Artificial
  CRISPR gRNA sequence
tatgtatttagtaaaactac

SEQ ID NO: 323377 - DNA, 20 bp, Artificial
  CRISPR gRNA sequence
atgtatttagtaaaactact

SEQ ID NO: 323378 - DNA, 20 bp, Artificial
  CRISPR gRNA sequence
tgtatttagtaaaactacta

SEQ ID NO: 323379 - DNA, 20 bp, Artificial
  CRISPR gRNA sequence
agtaaaactactaataaaag

SEQ ID NO: 323380 - DNA, 20 bp, Artificial
  CRISPR gRNA sequence
gtaaaactactaataaaagc

SEQ ID NO: 323381 - DNA, 20 bp, Artificial
  CRISPR gRNA sequence
ctaataaaagcaacagaaat

SEQ ID NO: 323382 - DNA, 20 bp, Artificial
  CRISPR gRNA sequence
ataaaagcaacagaaatcaa

SEQ ID NO: 323383 - DNA, 20 bp, Artificial
  CRISPR gRNA sequence
atgctgtgcagatggcacaa

SEQ ID NO: 323384 - DNA, 20 bp, Artificial
  CRISPR gRNA sequence
tgctgtgcagatggcacaaa

SEQ ID NO: 323385 - DNA, 20 bp, Artificial
  CRISPR gRNA sequence
tgcagatggcacaaaatgag

SEQ ID NO: 323386 - DNA, 20 bp, Artificial
  CRISPR gRNA sequence
aaaaatgagttagctgaatt

SEQ ID NO: 323387 - DNA, 20 bp, Artificial
  CRISPR gRNA sequence
gctgaattaacattcataaa

SEQ ID NO: 323388 - DNA, 20 bp, Artificial
  CRISPR gRNA sequence
aattaacattcataaagcct

SEQ ID NO: 323389 - DNA, 20 bp, Artificial
  CRISPR gRNA sequence
acattcataaagcctgaaaa

SEQ ID NO: 323390 - DNA, 20 bp, Artificial
  CRISPR gRNA sequence
ataaagcctgaaaagagaga

SEQ ID NO: 323391 - DNA, 20 bp, Artificial
  CRISPR gRNA sequence
aaaagagagactaatactaa

SEQ ID NO: 323392 - DNA, 20 bp, Artificial
  CRISPR gRNA sequence
atactaacatgatgaatctc

SEQ ID NO: 323393 - DNA, 20 bp, Artificial
  CRISPR gRNA sequence
acatgatgaatctcctgagg

SEQ ID NO: 323394 - DNA, 20 bp, Artificial
  CRISPR gRNA sequence
ctgagggtaagtgtaagaat

SEQ ID NO: 323395 - DNA, 20 bp, Artificial
  CRISPR gRNA sequence
agggtaagtgtaagaatctg

SEQ ID NO: 323396 - DNA, 20 bp, Artificial
  CRISPR gRNA sequence
tacttcagttttgaaataac

SEQ ID NO: 323397 - DNA, 20 bp, Artificial
  CRISPR gRNA sequence
cagttttgaaataacaactg

SEQ ID NO: 323398 - DNA, 20 bp, Artificial
  CRISPR gRNA sequence
agttttgaaataacaactgt

SEQ ID NO: 323399 - DNA, 20 bp, Artificial
  CRISPR gRNA sequence
tgaaataacaactgtgtaag

SEQ ID NO: 323400 - DNA, 20 bp, Artificial
  CRISPR gRNA sequence
gaaataacaactgtgtaaga

SEQ ID NO: 323401 - DNA, 20 bp, Artificial
  CRISPR gRNA sequence
aaataacaactgtgtaagag

SEQ ID NO: 323402 - DNA, 20 bp, Artificial
  CRISPR gRNA sequence
tgtaagaggaagaagtggac

SEQ ID NO: 323403 - DNA, 20 bp, Artificial
  CRISPR gRNA sequence
tccatagtaaacataaaaat

SEQ ID NO: 323404 - DNA, 20 bp, Artificial
  CRISPR gRNA sequence
gtgtggtatggctaagtaaa

SEQ ID NO: 323405 - DNA, 20 bp, Artificial
  CRISPR gRNA sequence
agtaaatttcatccaatcct

SEQ ID NO: 323406 - DNA, 20 bp, Artificial
  CRISPR gRNA sequence
catccaatcctagtgtagga

SEQ ID NO: 323407 - DNA, 20 bp, Artificial
  CRISPR gRNA sequence
atccaatcctagtgtaggat

SEQ ID NO: 323408 - DNA, 20 bp, Artificial
  CRISPR gRNA sequence
gtgtaggattcattcactga

SEQ ID NO: 323409 - DNA, 20 bp, Artificial
  CRISPR gRNA sequence
attcactgaactctgtgcta

SEQ ID NO: 323410 - DNA, 20 bp, Artificial
  CRISPR gRNA sequence
actgaactctgtgctaatca

SEQ ID NO: 323411 - DNA, 20 bp, Artificial
  CRISPR gRNA sequence
aactctgtgctaatcagacc

SEQ ID NO: 323412 - DNA, 20 bp, Artificial
  CRISPR gRNA sequence
tgtgctaatcagaccacatc

SEQ ID NO: 323413 - DNA, 20 bp, Artificial
  CRISPR gRNA sequence
tgctaatcagaccacatcgc

SEQ ID NO: 323414 - DNA, 20 bp, Artificial
  CRISPR gRNA sequence
atcagaccacatcgcttgtg

SEQ ID NO: 323415 - DNA, 20 bp, Artificial
  CRISPR gRNA sequence
gtggtatcacgttctgtgag

SEQ ID NO: 323416 - DNA, 20 bp, Artificial
  CRISPR gRNA sequence
tggtatcacgttctgtgagg

SEQ ID NO: 323417 - DNA, 20 bp, Artificial
  CRISPR gRNA sequence
tgtgaggtcagttatacttg

SEQ ID NO: 323418 - DNA, 20 bp, Artificial
  CRISPR gRNA sequence
tgaggtcagttatacttgaa

SEQ ID NO: 323419 - DNA, 20 bp, Artificial
  CRISPR gRNA sequence
tacttgaatgacactgacaa

SEQ ID NO: 323420 - DNA, 20 bp, Artificial
  CRISPR gRNA sequence
gaatgacactgacaaattcg

SEQ ID NO: 323421 - DNA, 20 bp, Artificial
  CRISPR gRNA sequence
aatgacactgacaaattcgg

SEQ ID NO: 323422 - DNA, 20 bp, Artificial
  CRISPR gRNA sequence
acaaattcggtttatcaagg

SEQ ID NO: 323423 - DNA, 20 bp, Artificial
  CRISPR gRNA sequence
ggtttatcaaggggaagggc

SEQ ID NO: 323424 - DNA, 20 bp, Artificial
  CRISPR gRNA sequence
atcaaggggaagggcagcaa

SEQ ID NO: 323425 - DNA, 20 bp, Artificial
  CRISPR gRNA sequence
tcaaggggaagggcagcaag

SEQ ID NO: 323426 - DNA, 20 bp, Artificial
  CRISPR gRNA sequence
actagtgaataatgaaatta

SEQ ID NO: 323427 - DNA, 20 bp, Artificial
  CRISPR gRNA sequence
gtgaataatgaaattatgtc

SEQ ID NO: 323428 - DNA, 20 bp, Artificial
  CRISPR gRNA sequence
tgtcaaatgaagaacaacta

SEQ ID NO: 323429 - DNA, 20 bp, Artificial
  CRISPR gRNA sequence
aaaggactagggtaatgaac

SEQ ID NO: 323430 - DNA, 20 bp, Artificial
  CRISPR gRNA sequence
gggtaatgaacctgaagaag

SEQ ID NO: 323431 - DNA, 20 bp, Artificial
  CRISPR gRNA sequence
aagaagaaaagattgcaagt

SEQ ID NO: 323432 - DNA, 20 bp, Artificial
  CRISPR gRNA sequence
caagtatatgctgggtgtct

SEQ ID NO: 323433 - DNA, 20 bp, Artificial
  CRISPR gRNA sequence
ggtgtctgcaaatatgtaag

SEQ ID NO: 323434 - DNA, 20 bp, Artificial
  CRISPR gRNA sequence
caaatatgtaagggcccttc

SEQ ID NO: 323435 - DNA, 20 bp, Artificial
  CRISPR gRNA sequence
ccatgggaggatacatacac

SEQ ID NO: 323436 - DNA, 20 bp, Artificial
  CRISPR gRNA sequence
catgggaggatacatacact

SEQ ID NO: 323437 - DNA, 20 bp, Artificial
  CRISPR gRNA sequence
ttgctgaagggcaagtagtt

SEQ ID NO: 323438 - DNA, 20 bp, Artificial
  CRISPR gRNA sequence
ctgaagggcaagtagttcca

SEQ ID NO: 323439 - DNA, 20 bp, Artificial
  CRISPR gRNA sequence
aagggcaagtagttccaata

SEQ ID NO: 323440 - DNA, 20 bp, Artificial
  CRISPR gRNA sequence
caataactaaaagttacagg

SEQ ID NO: 323441 - DNA, 20 bp, Artificial
  CRISPR gRNA sequence
aaagttacagggagccagat

SEQ ID NO: 323442 - DNA, 20 bp, Artificial
  CRISPR gRNA sequence
cagggagccagatttcagtt

SEQ ID NO: 323443 - DNA, 20 bp, Artificial
  CRISPR gRNA sequence
cagttccagatgatggaaaa

SEQ ID NO: 323444 - DNA, 20 bp, Artificial
  CRISPR gRNA sequence
agttccagatgatggaaaac

SEQ ID NO: 323445 - DNA, 20 bp, Artificial
  CRISPR gRNA sequence
cagatgatggaaaactttta

SEQ ID NO: 323446 - DNA, 20 bp, Artificial
  CRISPR gRNA sequence
ttaatagagagctacaagca

SEQ ID NO: 323447 - DNA, 20 bp, Artificial
  CRISPR gRNA sequence
taatagagagctacaagcaa

SEQ ID NO: 323448 - DNA, 20 bp, Artificial
  CRISPR gRNA sequence
aatagagagctacaagcaat

SEQ ID NO: 323449 - DNA, 20 bp, Artificial
  CRISPR gRNA sequence
atagagagctacaagcaatg

SEQ ID NO: 323450 - DNA, 20 bp, Artificial
  CRISPR gRNA sequence
caagcaatgactggattttc

SEQ ID NO: 323451 - DNA, 20 bp, Artificial
  CRISPR gRNA sequence
gattttcttgtgaggtgata

SEQ ID NO: 323452 - DNA, 20 bp, Artificial
  CRISPR gRNA sequence
tcttgtgaggtgataagctc

SEQ ID NO: 323453 - DNA, 20 bp, Artificial
  CRISPR gRNA sequence
cttgtgaggtgataagctcc

SEQ ID NO: 323454 - DNA, 20 bp, Artificial
  CRISPR gRNA sequence
ttgtgaggtgataagctccc

SEQ ID NO: 323455 - DNA, 20 bp, Artificial
  CRISPR gRNA sequence
gtgaggtgataagctccctg

SEQ ID NO: 323456 - DNA, 20 bp, Artificial
  CRISPR gRNA sequence
tgaggtgataagctccctgt

SEQ ID NO: 323457 - DNA, 20 bp, Artificial
  CRISPR gRNA sequence
cctgtcacaagtactattca

SEQ ID NO: 323458 - DNA, 20 bp, Artificial
  CRISPR gRNA sequence
tcacaagtactattcaaacc

SEQ ID NO: 323459 - DNA, 20 bp, Artificial
  CRISPR gRNA sequence
ttcaaaccaaagtgggggtg

SEQ ID NO: 323460 - DNA, 20 bp, Artificial
  CRISPR gRNA sequence
aaaccaaagtgggggtgata

SEQ ID NO: 323461 - DNA, 20 bp, Artificial
  CRISPR gRNA sequence
taggagcgaatctcgaattg

SEQ ID NO: 323462 - DNA, 20 bp, Artificial
  CRISPR gRNA sequence
aggagcgaatctcgaattga

SEQ ID NO: 323463 - DNA, 20 bp, Artificial
  CRISPR gRNA sequence
ggagcgaatctcgaattgag

SEQ ID NO: 323464 - DNA, 20 bp, Artificial
  CRISPR gRNA sequence
gaattgagtaagtggttgaa

SEQ ID NO: 323465 - DNA, 20 bp, Artificial
  CRISPR gRNA sequence
agtaagtggttgaactcata

SEQ ID NO: 323466 - DNA, 20 bp, Artificial
  CRISPR gRNA sequence
aactcataacttttcagttc

SEQ ID NO: 323467 - DNA, 20 bp, Artificial
  CRISPR gRNA sequence
ataacttttcagttcacctc

SEQ ID NO: 323468 - DNA, 20 bp, Artificial
  CRISPR gRNA sequence
ttcagttcacctctaagatt

SEQ ID NO: 323469 - DNA, 20 bp, Artificial
  CRISPR gRNA sequence
tcagttcacctctaagattc

SEQ ID NO: 323470 - DNA, 20 bp, Artificial
  CRISPR gRNA sequence
cagttcacctctaagattct

SEQ ID NO: 323471 - DNA, 20 bp, Artificial
  CRISPR gRNA sequence
agttcacctctaagattctc

SEQ ID NO: 323472 - DNA, 20 bp, Artificial
  CRISPR gRNA sequence
acctctaagattctcattac

SEQ ID NO: 323473 - DNA, 20 bp, Artificial
  CRISPR gRNA sequence
taagattctcattacatttc

SEQ ID NO: 323474 - DNA, 20 bp, Artificial
  CRISPR gRNA sequence
agattctcattacatttcca

SEQ ID NO: 323475 - DNA, 20 bp, Artificial
  CRISPR gRNA sequence
tcattacatttccaggaata

SEQ ID NO: 323476 - DNA, 20 bp, Artificial
  CRISPR gRNA sequence
attacatttccaggaataag

SEQ ID NO: 323477 - DNA, 20 bp, Artificial
  CRISPR gRNA sequence
catttccaggaataaggaga

SEQ ID NO: 323478 - DNA, 20 bp, Artificial
  CRISPR gRNA sequence
ccaggaataaggagaaataa

SEQ ID NO: 323479 - DNA, 20 bp, Artificial
  CRISPR gRNA sequence
caggaataaggagaaataaa

SEQ ID NO: 323480 - DNA, 20 bp, Artificial
  CRISPR gRNA sequence
gacactccatcgctctcacc

SEQ ID NO: 323481 - DNA, 20 bp, Artificial
  CRISPR gRNA sequence
catcgctctcaccctgagtc

SEQ ID NO: 323482 - DNA, 20 bp, Artificial
  CRISPR gRNA sequence
tcaccctgagtcagttcctc

SEQ ID NO: 323483 - DNA, 20 bp, Artificial
  CRISPR gRNA sequence
accctgagtcagttcctctc

SEQ ID NO: 323484 - DNA, 20 bp, Artificial
  CRISPR gRNA sequence
agtcagttcctctcattttt

SEQ ID NO: 323485 - DNA, 20 bp, Artificial
  CRISPR gRNA sequence
ctctcatttttaacacagta

SEQ ID NO: 323486 - DNA, 20 bp, Artificial
  CRISPR gRNA sequence
tcatttttaacacagtagac

SEQ ID NO: 323487 - DNA, 20 bp, Artificial
  CRISPR gRNA sequence
atttttaacacagtagacaa

SEQ ID NO: 323488 - DNA, 20 bp, Artificial
  CRISPR gRNA sequence
ttaacacagtagacaatatg

SEQ ID NO: 323489 - DNA, 20 bp, Artificial
  CRISPR gRNA sequence
taacacagtagacaatatgg

SEQ ID NO: 323490 - DNA, 20 bp, Artificial
  CRISPR gRNA sequence
aacacagtagacaatatggt

SEQ ID NO: 323491 - DNA, 20 bp, Artificial
  CRISPR gRNA sequence
acacagtagacaatatggta

SEQ ID NO: 323492 - DNA, 20 bp, Artificial
  CRISPR gRNA sequence
aaaggatccctgtctgggta

SEQ ID NO: 323493 - DNA, 20 bp, Artificial
  CRISPR gRNA sequence
aaggatccctgtctgggtag

SEQ ID NO: 323494 - DNA, 20 bp, Artificial
  CRISPR gRNA sequence
tctgggtagagtctgctgag

SEQ ID NO: 323495 - DNA, 20 bp, Artificial
  CRISPR gRNA sequence
ggtagagtctgctgagctgg

SEQ ID NO: 323496 - DNA, 20 bp, Artificial
  CRISPR gRNA sequence
ctgagctggctacaagtgat

SEQ ID NO: 323497 - DNA, 20 bp, Artificial
  CRISPR gRNA sequence
agctggctacaagtgatcca

SEQ ID NO: 323498 - DNA, 20 bp, Artificial
  CRISPR gRNA sequence
gctacaagtgatccagggct

SEQ ID NO: 323499 - DNA, 20 bp, Artificial
  CRISPR gRNA sequence
caagtgatccagggcttcag

SEQ ID NO: 323500 - DNA, 20 bp, Artificial
  CRISPR gRNA sequence
cagaagacatggagaacagc

SEQ ID NO: 323501 - DNA, 20 bp, Artificial
  CRISPR gRNA sequence
agaagacatggagaacagca

SEQ ID NO: 323502 - DNA, 20 bp, Artificial
  CRISPR gRNA sequence
ctacagcttggaagggtggt

SEQ ID NO: 323503 - DNA, 20 bp, Artificial
  CRISPR gRNA sequence
cagcttggaagggtggtgta

SEQ ID NO: 323504 - DNA, 20 bp, Artificial
  CRISPR gRNA sequence
ggaagggtggtgtaaaggtg

SEQ ID NO: 323505 - DNA, 20 bp, Artificial
  CRISPR gRNA sequence
gaagggtggtgtaaaggtgg

SEQ ID NO: 323506 - DNA, 20 bp, Artificial
  CRISPR gRNA sequence
agctgagctttgacaggtga

SEQ ID NO: 323507 - DNA, 20 bp, Artificial
  CRISPR gRNA sequence
agctttgacaggtgagtcag

SEQ ID NO: 323508 - DNA, 20 bp, Artificial
  CRISPR gRNA sequence
tgacaggtgagtcagacttg

SEQ ID NO: 323509 - DNA, 20 bp, Artificial
  CRISPR gRNA sequence
gacaggtgagtcagacttgg

SEQ ID NO: 323510 - DNA, 20 bp, Artificial
  CRISPR gRNA sequence
acaggtgagtcagacttggt

SEQ ID NO: 323511 - DNA, 20 bp, Artificial
  CRISPR gRNA sequence
ggtctcagaactgtaccctg

SEQ ID NO: 323512 - DNA, 20 bp, Artificial
  CRISPR gRNA sequence
gtctcagaactgtaccctgc

SEQ ID NO: 323513 - DNA, 20 bp, Artificial
  CRISPR gRNA sequence
agaactgtaccctgcatgtt

SEQ ID NO: 323514 - DNA, 20 bp, Artificial
  CRISPR gRNA sequence
taccctgcatgttagaactt

SEQ ID NO: 323515 - DNA, 20 bp, Artificial
  CRISPR gRNA sequence
catgttagaacttgcacgag

SEQ ID NO: 323516 - DNA, 20 bp, Artificial
  CRISPR gRNA sequence
gaacttgcacgagttgattt

SEQ ID NO: 323517 - DNA, 20 bp, Artificial
  CRISPR gRNA sequence
gcacgagttgatttctgtta

SEQ ID NO: 323518 - DNA, 20 bp, Artificial
  CRISPR gRNA sequence
cacgagttgatttctgttat

SEQ ID NO: 323519 - DNA, 20 bp, Artificial
  CRISPR gRNA sequence
atttctgttatagcagatga

SEQ ID NO: 323520 - DNA, 20 bp, Artificial
  CRISPR gRNA sequence
ctgttatagcagatgaagtt

SEQ ID NO: 323521 - DNA, 20 bp, Artificial
  CRISPR gRNA sequence
tgttatagcagatgaagttc

SEQ ID NO: 323522 - DNA, 20 bp, Artificial
  CRISPR gRNA sequence
ttatagcagatgaagttcca

SEQ ID NO: 323523 - DNA, 20 bp, Artificial
  CRISPR gRNA sequence
tagcagatgaagttccaccc

SEQ ID NO: 323524 - DNA, 20 bp, Artificial
  CRISPR gRNA sequence
caccctgtattggttttaag

SEQ ID NO: 323525 - DNA, 20 bp, Artificial
  CRISPR gRNA sequence
tattggttttaagtaattaa

SEQ ID NO: 323526 - DNA, 20 bp, Artificial
  CRISPR gRNA sequence
gttttaagtaattaagtcca

SEQ ID NO: 323527 - DNA, 20 bp, Artificial
  CRISPR gRNA sequence
taagtaattaagtccactca

SEQ ID NO: 323528 - DNA, 20 bp, Artificial
  CRISPR gRNA sequence
aagtaattaagtccactcat

SEQ ID NO: 323529 - DNA, 20 bp, Artificial
  CRISPR gRNA sequence
agtaattaagtccactcatt

SEQ ID NO: 323530 - DNA, 20 bp, Artificial
  CRISPR gRNA sequence
agtccactcattctgatact

SEQ ID NO: 323531 - DNA, 20 bp, Artificial
  CRISPR gRNA sequence
attctgatactcccacttat

SEQ ID NO: 323532 - DNA, 20 bp, Artificial
  CRISPR gRNA sequence
tgatactcccacttatgagg

SEQ ID NO: 323533 - DNA, 20 bp, Artificial
  CRISPR gRNA sequence
atactcccacttatgagggc

SEQ ID NO: 323534 - DNA, 20 bp, Artificial
  CRISPR gRNA sequence
ccacttatgagggctgttag

SEQ ID NO: 323535 - DNA, 20 bp, Artificial
  CRISPR gRNA sequence
atgagggctgttagcctggg

SEQ ID NO: 323536 - DNA, 20 bp, Artificial
  CRISPR gRNA sequence
tgagggctgttagcctgggc

SEQ ID NO: 323537 - DNA, 20 bp, Artificial
  CRISPR gRNA sequence
ttagcctgggccactgcact

SEQ ID NO: 323538 - DNA, 20 bp, Artificial
  CRISPR gRNA sequence
gcctgggccactgcactgtt

SEQ ID NO: 323539 - DNA, 20 bp, Artificial
  CRISPR gRNA sequence
ggccactgcactgtttaaca

SEQ ID NO: 323540 - DNA, 20 bp, Artificial
  CRISPR gRNA sequence
cactgtttaacagtcttcct

SEQ ID NO: 323541 - DNA, 20 bp, Artificial
  CRISPR gRNA sequence
tttaacagtcttcctctgag

SEQ ID NO: 323542 - DNA, 20 bp, Artificial
  CRISPR gRNA sequence
aacagtcttcctctgagaaa

SEQ ID NO: 323543 - DNA, 20 bp, Artificial
  CRISPR gRNA sequence
acagtcttcctctgagaaac

SEQ ID NO: 323544 - DNA, 20 bp, Artificial
  CRISPR gRNA sequence
cctctgagaaacgctgtctt

SEQ ID NO: 323545 - DNA, 20 bp, Artificial
  CRISPR gRNA sequence
ctctgagaaacgctgtcttc

SEQ ID NO: 323546 - DNA, 20 bp, Artificial
  CRISPR gRNA sequence
tgagaaacgctgtcttcctt

SEQ ID NO: 323547 - DNA, 20 bp, Artificial
  CRISPR gRNA sequence
agaaacgctgtcttccttta

SEQ ID NO: 323548 - DNA, 20 bp, Artificial
  CRISPR gRNA sequence
tcttcctttaacaataacaa

SEQ ID NO: 323549 - DNA, 20 bp, Artificial
  CRISPR gRNA sequence
cctttaacaataacaatggt

SEQ ID NO: 323550 - DNA, 20 bp, Artificial
  CRISPR gRNA sequence
ctttaacaataacaatggtt

SEQ ID NO: 323551 - DNA, 20 bp, Artificial
  CRISPR gRNA sequence
taacaataacaatggttaat

SEQ ID NO: 323552 - DNA, 20 bp, Artificial
  CRISPR gRNA sequence
aacaataacaatggttaatt

SEQ ID NO: 323553 - DNA, 20 bp, Artificial
  CRISPR gRNA sequence
acaataacaatggttaattt

SEQ ID NO: 323554 - DNA, 20 bp, Artificial
  CRISPR gRNA sequence
atttcctagaactcaacgtg

SEQ ID NO: 323555 - DNA, 20 bp, Artificial
  CRISPR gRNA sequence
cctagaactcaacgtggtag

SEQ ID NO: 323556 - DNA, 20 bp, Artificial
  CRISPR gRNA sequence
ctagaactcaacgtggtagc

SEQ ID NO: 323557 - DNA, 20 bp, Artificial
  CRISPR gRNA sequence
gaactcaacgtggtagctat

SEQ ID NO: 323558 - DNA, 20 bp, Artificial
  CRISPR gRNA sequence
aacgtggtagctatcgtcct

SEQ ID NO: 323559 - DNA, 20 bp, Artificial
  CRISPR gRNA sequence
tcgtcctctgtccttgaaag

SEQ ID NO: 323560 - DNA, 20 bp, Artificial
  CRISPR gRNA sequence
tgtccttgaaaggctttgca

SEQ ID NO: 323561 - DNA, 20 bp, Artificial
  CRISPR gRNA sequence
tccttgaaaggctttgcaag

SEQ ID NO: 323562 - DNA, 20 bp, Artificial
  CRISPR gRNA sequence
gaaaggctttgcaagcttcc

SEQ ID NO: 323563 - DNA, 20 bp, Artificial
  CRISPR gRNA sequence
aaaggctttgcaagcttcca

SEQ ID NO: 323564 - DNA, 20 bp, Artificial
  CRISPR gRNA sequence
tgcaagcttccaataattct

SEQ ID NO: 323565 - DNA, 20 bp, Artificial
  CRISPR gRNA sequence
gcaagcttccaataattctt

SEQ ID NO: 323566 - DNA, 20 bp, Artificial
  CRISPR gRNA sequence
caagcttccaataattcttc

SEQ ID NO: 323567 - DNA, 20 bp, Artificial
  CRISPR gRNA sequence
ccaataattcttccctagac

SEQ ID NO: 323568 - DNA, 20 bp, Artificial
  CRISPR gRNA sequence
caataattcttccctagaca

SEQ ID NO: 323569 - DNA, 20 bp, Artificial
  CRISPR gRNA sequence
ttccctagacagattcctga

SEQ ID NO: 323570 - DNA, 20 bp, Artificial
  CRISPR gRNA sequence
ccctagacagattcctgata

SEQ ID NO: 323571 - DNA, 20 bp, Artificial
  CRISPR gRNA sequence
cctagacagattcctgataa

SEQ ID NO: 323572 - DNA, 20 bp, Artificial
  CRISPR gRNA sequence
gacagattcctgataatata

SEQ ID NO: 323573 - DNA, 20 bp, Artificial
  CRISPR gRNA sequence
ctgataatatataaccctgc

SEQ ID NO: 323574 - DNA, 20 bp, Artificial
  CRISPR gRNA sequence
ataatatataaccctgcatc

SEQ ID NO: 323575 - DNA, 20 bp, Artificial
  CRISPR gRNA sequence
catccgaggcatctgtttaa

SEQ ID NO: 323576 - DNA, 20 bp, Artificial
  CRISPR gRNA sequence
tttaatgggtctcaaagaac

SEQ ID NO: 323577 - DNA, 20 bp, Artificial
  CRISPR gRNA sequence
aatgggtctcaaagaactga

SEQ ID NO: 323578 - DNA, 20 bp, Artificial
  CRISPR gRNA sequence
atgggtctcaaagaactgat

SEQ ID NO: 323579 - DNA, 20 bp, Artificial
  CRISPR gRNA sequence
aaagaactgatgcttccgaa

SEQ ID NO: 323580 - DNA, 20 bp, Artificial
  CRISPR gRNA sequence
atgcttccgaaagaaccact

SEQ ID NO: 323581 - DNA, 20 bp, Artificial
  CRISPR gRNA sequence
ccgaaagaaccactttttag

SEQ ID NO: 323582 - DNA, 20 bp, Artificial
  CRISPR gRNA sequence
cgaaagaaccactttttagt

SEQ ID NO: 323583 - DNA, 20 bp, Artificial
  CRISPR gRNA sequence
tttagtgttgattgagtttc

SEQ ID NO: 323584 - DNA, 20 bp, Artificial
  CRISPR gRNA sequence
ttagtgttgattgagtttca

SEQ ID NO: 323585 - DNA, 20 bp, Artificial
  CRISPR gRNA sequence
tagtgttgattgagtttcac

SEQ ID NO: 323586 - DNA, 20 bp, Artificial
  CRISPR gRNA sequence
agtgttgattgagtttcact

SEQ ID NO: 323587 - DNA, 20 bp, Artificial
  CRISPR gRNA sequence
gtgttgattgagtttcactg

SEQ ID NO: 323588 - DNA, 20 bp, Artificial
  CRISPR gRNA sequence
attgagtttcactggataaa

SEQ ID NO: 323589 - DNA, 20 bp, Artificial
  CRISPR gRNA sequence
agtttcactggataaatatt

SEQ ID NO: 323590 - DNA, 20 bp, Artificial
  CRISPR gRNA sequence
cactggataaatatttcagc

SEQ ID NO: 323591 - DNA, 20 bp, Artificial
  CRISPR gRNA sequence
actggataaatatttcagcc

SEQ ID NO: 323592 - DNA, 20 bp, Artificial
  CRISPR gRNA sequence
gataaatatttcagccatat

SEQ ID NO: 323593 - DNA, 20 bp, Artificial
  CRISPR gRNA sequence
cagccatatttttgatacac

SEQ ID NO: 323594 - DNA, 20 bp, Artificial
  CRISPR gRNA sequence
agccatatttttgatacaca

SEQ ID NO: 323595 - DNA, 20 bp, Artificial
  CRISPR gRNA sequence
ttgatacacacataacatca

SEQ ID NO: 323596 - DNA, 20 bp, Artificial
  CRISPR gRNA sequence
tgatacacacataacatcaa

SEQ ID NO: 323597 - DNA, 20 bp, Artificial
  CRISPR gRNA sequence
gatacacacataacatcaag

SEQ ID NO: 323598 - DNA, 20 bp, Artificial
  CRISPR gRNA sequence
atacacacataacatcaagt

SEQ ID NO: 323599 - DNA, 20 bp, Artificial
  CRISPR gRNA sequence
tttgatgcttttcattggta

SEQ ID NO: 323600 - DNA, 20 bp, Artificial
  CRISPR gRNA sequence
ttgatgcttttcattggtat

SEQ ID NO: 323601 - DNA, 20 bp, Artificial
  CRISPR gRNA sequence
tgatgcttttcattggtata

SEQ ID NO: 323602 - DNA, 20 bp, Artificial
  CRISPR gRNA sequence
gatgcttttcattggtatat

SEQ ID NO: 323603 - DNA, 20 bp, Artificial
  CRISPR gRNA sequence
atgcttttcattggtatata

SEQ ID NO: 323604 - DNA, 20 bp, Artificial
  CRISPR gRNA sequence
ttcattggtatatattcttt

SEQ ID NO: 323605 - DNA, 20 bp, Artificial
  CRISPR gRNA sequence
tcattggtatatattctttg

SEQ ID NO: 323606 - DNA, 20 bp, Artificial
  CRISPR gRNA sequence
cattggtatatattctttga

SEQ ID NO: 323607 - DNA, 20 bp, Artificial
  CRISPR gRNA sequence
attggtatatattctttgac

SEQ ID NO: 323608 - DNA, 20 bp, Artificial
  CRISPR gRNA sequence
gtatatattctttgacgact

SEQ ID NO: 323609 - DNA, 20 bp, Artificial
  CRISPR gRNA sequence
tttgacgactttctgagaca

SEQ ID NO: 323610 - DNA, 20 bp, Artificial
  CRISPR gRNA sequence
tgacgactttctgagacaca

SEQ ID NO: 323611 - DNA, 20 bp, Artificial
  CRISPR gRNA sequence
gacgactttctgagacacaa

SEQ ID NO: 323612 - DNA, 20 bp, Artificial
  CRISPR gRNA sequence
acgactttctgagacacaat

SEQ ID NO: 323613 - DNA, 20 bp, Artificial
  CRISPR gRNA sequence
tctgagacacaatcaaataa

SEQ ID NO: 323614 - DNA, 20 bp, Artificial
  CRISPR gRNA sequence
ctgagacacaatcaaataac

SEQ ID NO: 323615 - DNA, 20 bp, Artificial
  CRISPR gRNA sequence
tgagacacaatcaaataaca

SEQ ID NO: 323616 - DNA, 20 bp, Artificial
  CRISPR gRNA sequence
agacacaatcaaataacagt

SEQ ID NO: 323617 - DNA, 20 bp, Artificial
  CRISPR gRNA sequence
ttaaggacacatggaaatgg

SEQ ID NO: 323618 - DNA, 20 bp, Artificial
  CRISPR gRNA sequence
taaggacacatggaaatgga

SEQ ID NO: 323619 - DNA, 20 bp, Artificial
  CRISPR gRNA sequence
aaggacacatggaaatggag

SEQ ID NO: 323620 - DNA, 20 bp, Artificial
  CRISPR gRNA sequence
aggacacatggaaatggagg

SEQ ID NO: 323621 - DNA, 20 bp, Artificial
  CRISPR gRNA sequence
ttacaggacagtaagaaaag

SEQ ID NO: 323622 - DNA, 20 bp, Artificial
  CRISPR gRNA sequence
tacaggacagtaagaaaagc

SEQ ID NO: 323623 - DNA, 20 bp, Artificial
  CRISPR gRNA sequence
acaggacagtaagaaaagct

SEQ ID NO: 323624 - DNA, 20 bp, Artificial
  CRISPR gRNA sequence
caggacagtaagaaaagctg

SEQ ID NO: 323625 - DNA, 20 bp, Artificial
  CRISPR gRNA sequence
actggcctgcagcagaggtt

SEQ ID NO: 323626 - DNA, 20 bp, Artificial
  CRISPR gRNA sequence
gcctgcagcagaggttgtct

SEQ ID NO: 323627 - DNA, 20 bp, Artificial
  CRISPR gRNA sequence
cagcagaggttgtctttgga

SEQ ID NO: 323628 - DNA, 20 bp, Artificial
  CRISPR gRNA sequence
tctttggataaataatggga

SEQ ID NO: 323629 - DNA, 20 bp, Artificial
  CRISPR gRNA sequence
tggataaataatgggagatt

SEQ ID NO: 323630 - DNA, 20 bp, Artificial
  CRISPR gRNA sequence
ggataaataatgggagatta

SEQ ID NO: 323631 - DNA, 20 bp, Artificial
  CRISPR gRNA sequence
gataaataatgggagattag

SEQ ID NO: 323632 - DNA, 20 bp, Artificial
  CRISPR gRNA sequence
gtttctataagtaaagcaag

SEQ ID NO: 323633 - DNA, 20 bp, Artificial
  CRISPR gRNA sequence
ctataagtaaagcaaggagc

SEQ ID NO: 323634 - DNA, 20 bp, Artificial
  CRISPR gRNA sequence
tataagtaaagcaaggagca

SEQ ID NO: 323635 - DNA, 20 bp, Artificial
  CRISPR gRNA sequence
taagtaaagcaaggagcaag

SEQ ID NO: 323636 - DNA, 20 bp, Artificial
  CRISPR gRNA sequence
atagggcatggaaagtcaaa

SEQ ID NO: 323637 - DNA, 20 bp, Artificial
  CRISPR gRNA sequence
atatttaatttaacagaaaa

SEQ ID NO: 323638 - DNA, 20 bp, Artificial
  CRISPR gRNA sequence
aatttaacagaaaattggaa

SEQ ID NO: 323639 - DNA, 20 bp, Artificial
  CRISPR gRNA sequence
atttaacagaaaattggaag

SEQ ID NO: 323640 - DNA, 20 bp, Artificial
  CRISPR gRNA sequence
aacagaaaattggaagtttg

SEQ ID NO: 323641 - DNA, 20 bp, Artificial
  CRISPR gRNA sequence
acagaaaattggaagtttgg

SEQ ID NO: 323642 - DNA, 20 bp, Artificial
  CRISPR gRNA sequence
gaagtttggaattaatagtt

SEQ ID NO: 323643 - DNA, 20 bp, Artificial
  CRISPR gRNA sequence
ggaattaatagtttgggagc

SEQ ID NO: 323644 - DNA, 20 bp, Artificial
  CRISPR gRNA sequence
gaattaatagtttgggagca

SEQ ID NO: 323645 - DNA, 20 bp, Artificial
  CRISPR gRNA sequence
atagtttgggagcagaaaaa

SEQ ID NO: 323646 - DNA, 20 bp, Artificial
  CRISPR gRNA sequence
gggagcagaaaaatggtgta

SEQ ID NO: 323647 - DNA, 20 bp, Artificial
  CRISPR gRNA sequence
ggagcagaaaaatggtgtaa

SEQ ID NO: 323648 - DNA, 20 bp, Artificial
  CRISPR gRNA sequence
aaagaaaataagcctgtcaa

SEQ ID NO: 323649 - DNA, 20 bp, Artificial
  CRISPR gRNA sequence
aagaaaataagcctgtcaag

SEQ ID NO: 323650 - DNA, 20 bp, Artificial
  CRISPR gRNA sequence
tcaagaggtgacggctggta

SEQ ID NO: 323651 - DNA, 20 bp, Artificial
  CRISPR gRNA sequence
gtatcagggtgatcaagaaa

SEQ ID NO: 323652 - DNA, 20 bp, Artificial
  CRISPR gRNA sequence
caggctcgtcgacttgagat

SEQ ID NO: 323653 - DNA, 20 bp, Artificial
  CRISPR gRNA sequence
gtcgacttgagatggtgagc

SEQ ID NO: 323654 - DNA, 20 bp, Artificial
  CRISPR gRNA sequence
gagatggtgagcctgaagca

SEQ ID NO: 323655 - DNA, 20 bp, Artificial
  CRISPR gRNA sequence
agatggtgagcctgaagcag

SEQ ID NO: 323656 - DNA, 20 bp, Artificial
  CRISPR gRNA sequence
aagcagtaaagaggcagtcg

SEQ ID NO: 323657 - DNA, 20 bp, Artificial
  CRISPR gRNA sequence
cctcgatggaacatgaacac

SEQ ID NO: 323658 - DNA, 20 bp, Artificial
  CRISPR gRNA sequence
gatggaacatgaacacttct

SEQ ID NO: 323659 - DNA, 20 bp, Artificial
  CRISPR gRNA sequence
cttggtgtctggtggacaga

SEQ ID NO: 323660 - DNA, 20 bp, Artificial
  CRISPR gRNA sequence
ttggtgtctggtggacagag

SEQ ID NO: 323661 - DNA, 20 bp, Artificial
  CRISPR gRNA sequence
ggtgtctggtggacagagga

SEQ ID NO: 323662 - DNA, 20 bp, Artificial
  CRISPR gRNA sequence
gtgtctggtggacagaggac

SEQ ID NO: 323663 - DNA, 20 bp, Artificial
  CRISPR gRNA sequence
gtggacagaggacatgactg

SEQ ID NO: 323664 - DNA, 20 bp, Artificial
  CRISPR gRNA sequence
gaggtggagacgtcctccat

SEQ ID NO: 323665 - DNA, 20 bp, Artificial
  CRISPR gRNA sequence
catcctgagctctgttttcc

SEQ ID NO: 323666 - DNA, 20 bp, Artificial
  CRISPR gRNA sequence
agctctgttttcctcaagct

SEQ ID NO: 323667 - DNA, 20 bp, Artificial
  CRISPR gRNA sequence
tgttttcctcaagctcccac

SEQ ID NO: 323668 - DNA, 20 bp, Artificial
  CRISPR gRNA sequence
ttttcctcaagctcccacca

SEQ ID NO: 323669 - DNA, 20 bp, Artificial
  CRISPR gRNA sequence
tcctcaagctcccaccagcc

SEQ ID NO: 323670 - DNA, 20 bp, Artificial
  CRISPR gRNA sequence
cctcaagctcccaccagcca

SEQ ID NO: 323671 - DNA, 20 bp, Artificial
  CRISPR gRNA sequence
ctcaagctcccaccagccat

SEQ ID NO: 323672 - DNA, 20 bp, Artificial
  CRISPR gRNA sequence
aagctcccaccagccatgtc

SEQ ID NO: 323673 - DNA, 20 bp, Artificial
  CRISPR gRNA sequence
ccaccagccatgtctccttc

SEQ ID NO: 323674 - DNA, 20 bp, Artificial
  CRISPR gRNA sequence
cttctagcttaggctggatt

SEQ ID NO: 323675 - DNA, 20 bp, Artificial
  CRISPR gRNA sequence
ctagcttaggctggatttta

SEQ ID NO: 323676 - DNA, 20 bp, Artificial
  CRISPR gRNA sequence
tagcttaggctggattttat

SEQ ID NO: 323677 - DNA, 20 bp, Artificial
  CRISPR gRNA sequence
gcttaggctggattttatgt

SEQ ID NO: 323678 - DNA, 20 bp, Artificial
  CRISPR gRNA sequence
aggctggattttatgtctga

SEQ ID NO: 323679 - DNA, 20 bp, Artificial
  CRISPR gRNA sequence
ggctggattttatgtctgac

SEQ ID NO: 323680 - DNA, 20 bp, Artificial
  CRISPR gRNA sequence
gattttatgtctgacttggt

SEQ ID NO: 323681 - DNA, 20 bp, Artificial
  CRISPR gRNA sequence
tatgtctgacttggtttcca

SEQ ID NO: 323682 - DNA, 20 bp, Artificial
  CRISPR gRNA sequence
atgtctgacttggtttccag

SEQ ID NO: 323683 - DNA, 20 bp, Artificial
  CRISPR gRNA sequence
tgtctgacttggtttccagt

SEQ ID NO: 323684 - DNA, 20 bp, Artificial
  CRISPR gRNA sequence
acttggtttccagtctctcc

SEQ ID NO: 323685 - DNA, 20 bp, Artificial
  CRISPR gRNA sequence
ggtttccagtctctccttgg

SEQ ID NO: 323686 - DNA, 20 bp, Artificial
  CRISPR gRNA sequence
gtttccagtctctccttgga

SEQ ID NO: 323687 - DNA, 20 bp, Artificial
  CRISPR gRNA sequence
ccagtctctccttggagcaa

SEQ ID NO: 323688 - DNA, 20 bp, Artificial
  CRISPR gRNA sequence
cagtctctccttggagcaaa

SEQ ID NO: 323689 - DNA, 20 bp, Artificial
  CRISPR gRNA sequence
tccttggagcaaatccccct

SEQ ID NO: 323690 - DNA, 20 bp, Artificial
  CRISPR gRNA sequence
cttggagcaaatccccctta

SEQ ID NO: 323691 - DNA, 20 bp, Artificial
  CRISPR gRNA sequence
ggagcaaatcccccttattc

SEQ ID NO: 323692 - DNA, 20 bp, Artificial
  CRISPR gRNA sequence
gagcaaatcccccttattcc

SEQ ID NO: 323693 - DNA, 20 bp, Artificial
  CRISPR gRNA sequence
attccccatttgtggagatt

SEQ ID NO: 323694 - DNA, 20 bp, Artificial
  CRISPR gRNA sequence
ttccccatttgtggagattt

SEQ ID NO: 323695 - DNA, 20 bp, Artificial
  CRISPR gRNA sequence
cccatttgtggagatttttc

SEQ ID NO: 323696 - DNA, 20 bp, Artificial
  CRISPR gRNA sequence
gtggagatttttctgaccga

SEQ ID NO: 323697 - DNA, 20 bp, Artificial
  CRISPR gRNA sequence
tggagatttttctgaccgaa

SEQ ID NO: 323698 - DNA, 20 bp, Artificial
  CRISPR gRNA sequence
ttctgaccgaatgcttgttt

SEQ ID NO: 323699 - DNA, 20 bp, Artificial
  CRISPR gRNA sequence
tctgaccgaatgcttgtttt

SEQ ID NO: 323700 - DNA, 20 bp, Artificial
  CRISPR gRNA sequence
ctgaccgaatgcttgttttc

SEQ ID NO: 323701 - DNA, 20 bp, Artificial
  CRISPR gRNA sequence
tgaccgaatgcttgttttct

SEQ ID NO: 323702 - DNA, 20 bp, Artificial
  CRISPR gRNA sequence
accgaatgcttgttttcttt

SEQ ID NO: 323703 - DNA, 20 bp, Artificial
  CRISPR gRNA sequence
gttttctttcgtgagttgtt

SEQ ID NO: 323704 - DNA, 20 bp, Artificial
  CRISPR gRNA sequence
ttttctttcgtgagttgttc

SEQ ID NO: 323705 - DNA, 20 bp, Artificial
  CRISPR gRNA sequence
tctttcgtgagttgttcttt

SEQ ID NO: 323706 - DNA, 20 bp, Artificial
  CRISPR gRNA sequence
ctttcgtgagttgttctttc

SEQ ID NO: 323707 - DNA, 20 bp, Artificial
  CRISPR gRNA sequence
tttcgtgagttgttctttct

SEQ ID NO: 323708 - DNA, 20 bp, Artificial
  CRISPR gRNA sequence
tcgtgagttgttctttctga

SEQ ID NO: 323709 - DNA, 20 bp, Artificial
  CRISPR gRNA sequence
cgtgagttgttctttctgaa

SEQ ID NO: 323710 - DNA, 20 bp, Artificial
  CRISPR gRNA sequence
gtgagttgttctttctgaaa

SEQ ID NO: 323711 - DNA, 20 bp, Artificial
  CRISPR gRNA sequence
ttctttctgaaactcatttg

SEQ ID NO: 323712 - DNA, 20 bp, Artificial
  CRISPR gRNA sequence
tttctgaaactcatttgaga

SEQ ID NO: 323713 - DNA, 20 bp, Artificial
  CRISPR gRNA sequence
tctgaaactcatttgagagc

SEQ ID NO: 323714 - DNA, 20 bp, Artificial
  CRISPR gRNA sequence
ctgaaactcatttgagagca

SEQ ID NO: 323715 - DNA, 20 bp, Artificial
  CRISPR gRNA sequence
tgaaactcatttgagagcac

SEQ ID NO: 323716 - DNA, 20 bp, Artificial
  CRISPR gRNA sequence
aaactcatttgagagcacag

SEQ ID NO: 323717 - DNA, 20 bp, Artificial
  CRISPR gRNA sequence
atttgagagcacagtgtttc

SEQ ID NO: 323718 - DNA, 20 bp, Artificial
  CRISPR gRNA sequence
gagagcacagtgtttccata

SEQ ID NO: 323719 - DNA, 20 bp, Artificial
  CRISPR gRNA sequence
agagcacagtgtttccatac

SEQ ID NO: 323720 - DNA, 20 bp, Artificial
  CRISPR gRNA sequence
ccatacagacatgaggagag

SEQ ID NO: 323721 - DNA, 20 bp, Artificial
  CRISPR gRNA sequence
catacagacatgaggagagc

SEQ ID NO: 323722 - DNA, 20 bp, Artificial
  CRISPR gRNA sequence
catcaaggatgagtaggtgc

SEQ ID NO: 323723 - DNA, 20 bp, Artificial
  CRISPR gRNA sequence
cgcagatttagaaggagcag

SEQ ID NO: 323724 - DNA, 20 bp, Artificial
  CRISPR gRNA sequence
gcagatttagaaggagcaga

SEQ ID NO: 323725 - DNA, 20 bp, Artificial
  CRISPR gRNA sequence
agaaggagcagagggtgctt

SEQ ID NO: 323726 - DNA, 20 bp, Artificial
  CRISPR gRNA sequence
gaaggagcagagggtgcttt

SEQ ID NO: 323727 - DNA, 20 bp, Artificial
  CRISPR gRNA sequence
ttatccaccttccaatattg

SEQ ID NO: 323728 - DNA, 20 bp, Artificial
  CRISPR gRNA sequence
tatccaccttccaatattgt

SEQ ID NO: 323729 - DNA, 20 bp, Artificial
  CRISPR gRNA sequence
atccaccttccaatattgta

SEQ ID NO: 323730 - DNA, 20 bp, Artificial
  CRISPR gRNA sequence
tccaccttccaatattgtag

SEQ ID NO: 323731 - DNA, 20 bp, Artificial
  CRISPR gRNA sequence
ccaatattgtaggcaactga

SEQ ID NO: 323732 - DNA, 20 bp, Artificial
  CRISPR gRNA sequence
caatattgtaggcaactgaa

SEQ ID NO: 323733 - DNA, 20 bp, Artificial
  CRISPR gRNA sequence
taggcaactgaaatattaaa

SEQ ID NO: 323734 - DNA, 20 bp, Artificial
  CRISPR gRNA sequence
aaatattaaaatgaagaatg

SEQ ID NO: 323735 - DNA, 20 bp, Artificial
  CRISPR gRNA sequence
aaatgaagaatgcgttcccc

SEQ ID NO: 323736 - DNA, 20 bp, Artificial
  CRISPR gRNA sequence
ccctcactggcctagaagaa

SEQ ID NO: 323737 - DNA, 20 bp, Artificial
  CRISPR gRNA sequence
actggcctagaagaaggagc

SEQ ID NO: 323738 - DNA, 20 bp, Artificial
  CRISPR gRNA sequence
gcctagaagaaggagcatag

SEQ ID NO: 323739 - DNA, 20 bp, Artificial
  CRISPR gRNA sequence
gaagaaggagcatagcatgg

SEQ ID NO: 323740 - DNA, 20 bp, Artificial
  CRISPR gRNA sequence
agcttttccggtcccccaag

SEQ ID NO: 323741 - DNA, 20 bp, Artificial
  CRISPR gRNA sequence
gcttttccggtcccccaaga

SEQ ID NO: 323742 - DNA, 20 bp, Artificial
  CRISPR gRNA sequence
ttccggtcccccaagagcaa

SEQ ID NO: 323743 - DNA, 20 bp, Artificial
  CRISPR gRNA sequence
tccggtcccccaagagcaaa

SEQ ID NO: 323744 - DNA, 20 bp, Artificial
  CRISPR gRNA sequence
ccggtcccccaagagcaaat

SEQ ID NO: 323745 - DNA, 20 bp, Artificial
  CRISPR gRNA sequence
cggtcccccaagagcaaatc

SEQ ID NO: 323746 - DNA, 20 bp, Artificial
  CRISPR gRNA sequence
tgtacaagacacgcctagtt

SEQ ID NO: 323747 - DNA, 20 bp, Artificial
  CRISPR gRNA sequence
gttctccgagttgtatctag

SEQ ID NO: 323748 - DNA, 20 bp, Artificial
  CRISPR gRNA sequence
tccgagttgtatctagaatc

SEQ ID NO: 323749 - DNA, 20 bp, Artificial
  CRISPR gRNA sequence
cgagttgtatctagaatcga

SEQ ID NO: 323750 - DNA, 20 bp, Artificial
  CRISPR gRNA sequence
tatctagaatcgaaactttc

SEQ ID NO: 323751 - DNA, 20 bp, Artificial
  CRISPR gRNA sequence
gaatcgaaactttctgaatc

SEQ ID NO: 323752 - DNA, 20 bp, Artificial
  CRISPR gRNA sequence
tctgaatcaaggcacaccct

SEQ ID NO: 323753 - DNA, 20 bp, Artificial
  CRISPR gRNA sequence
ctgaatcaaggcacacccta

SEQ ID NO: 323754 - DNA, 20 bp, Artificial
  CRISPR gRNA sequence
tgaatcaaggcacaccctat

SEQ ID NO: 323755 - DNA, 20 bp, Artificial
  CRISPR gRNA sequence
aatcaaggcacaccctattt

SEQ ID NO: 323756 - DNA, 20 bp, Artificial
  CRISPR gRNA sequence
tttcaaactattgatgaatt

SEQ ID NO: 323757 - DNA, 20 bp, Artificial
  CRISPR gRNA sequence
caaactattgatgaatttga

SEQ ID NO: 323758 - DNA, 20 bp, Artificial
  CRISPR gRNA sequence
aaactattgatgaatttgag

SEQ ID NO: 323759 - DNA, 20 bp, Artificial
  CRISPR gRNA sequence
ttgatgaatttgagaacgat

SEQ ID NO: 323760 - DNA, 20 bp, Artificial
  CRISPR gRNA sequence
atgaatttgagaacgatttt

SEQ ID NO: 323761 - DNA, 20 bp, Artificial
  CRISPR gRNA sequence
gagaacgattttttttcctt

SEQ ID NO: 323762 - DNA, 20 bp, Artificial
  CRISPR gRNA sequence
agaacgattttttttccttt

SEQ ID NO: 323763 - DNA, 20 bp, Artificial
  CRISPR gRNA sequence
tttttcctttttgccaaaaa

SEQ ID NO: 323764 - DNA, 20 bp, Artificial
  CRISPR gRNA sequence
ttttcctttttgccaaaaag

SEQ ID NO: 323765 - DNA, 20 bp, Artificial
  CRISPR gRNA sequence
tttcctttttgccaaaaagg

SEQ ID NO: 323766 - DNA, 20 bp, Artificial
  CRISPR gRNA sequence
ttcctttttgccaaaaaggt

SEQ ID NO: 323767 - DNA, 20 bp, Artificial
  CRISPR gRNA sequence
tcctttttgccaaaaaggta

SEQ ID NO: 323768 - DNA, 20 bp, Artificial
  CRISPR gRNA sequence
cctttttgccaaaaaggtaa

SEQ ID NO: 323769 - DNA, 20 bp, Artificial
  CRISPR gRNA sequence
ctttttgccaaaaaggtaag

SEQ ID NO: 323770 - DNA, 20 bp, Artificial
  CRISPR gRNA sequence
tttgccaaaaaggtaaggat

SEQ ID NO: 323771 - DNA, 20 bp, Artificial
  CRISPR gRNA sequence
ttgccaaaaaggtaaggatc

SEQ ID NO: 323772 - DNA, 20 bp, Artificial
  CRISPR gRNA sequence
tgccaaaaaggtaaggatca

SEQ ID NO: 323773 - DNA, 20 bp, Artificial
  CRISPR gRNA sequence
gccaaaaaggtaaggatcat

SEQ ID NO: 323774 - DNA, 20 bp, Artificial
  CRISPR gRNA sequence
ccaaaaaggtaaggatcatg

SEQ ID NO: 323775 - DNA, 20 bp, Artificial
  CRISPR gRNA sequence
cacagtgcttcttctagtct

SEQ ID NO: 323776 - DNA, 20 bp, Artificial
  CRISPR gRNA sequence
acagtgcttcttctagtctg

SEQ ID NO: 323777 - DNA, 20 bp, Artificial
  CRISPR gRNA sequence
cttctagtctgtgctcatcc

SEQ ID NO: 323778 - DNA, 20 bp, Artificial
  CRISPR gRNA sequence
ttctagtctgtgctcatcca

SEQ ID NO: 323779 - DNA, 20 bp, Artificial
  CRISPR gRNA sequence
ctagtctgtgctcatccact

SEQ ID NO: 323780 - DNA, 20 bp, Artificial
  CRISPR gRNA sequence
tagtctgtgctcatccactc

SEQ ID NO: 323781 - DNA, 20 bp, Artificial
  CRISPR gRNA sequence
gtctgtgctcatccactcga

SEQ ID NO: 323782 - DNA, 20 bp, Artificial
  CRISPR gRNA sequence
tgctcatccactcgagggct

SEQ ID NO: 323783 - DNA, 20 bp, Artificial
  CRISPR gRNA sequence
atccactcgagggctctgac

SEQ ID NO: 323784 - DNA, 20 bp, Artificial
  CRISPR gRNA sequence
gagggctctgactgtcaggt

SEQ ID NO: 323785 - DNA, 20 bp, Artificial
  CRISPR gRNA sequence
tgactgtcaggtatgaggct

SEQ ID NO: 323786 - DNA, 20 bp, Artificial
  CRISPR gRNA sequence
actgtcaggtatgaggctca

SEQ ID NO: 323787 - DNA, 20 bp, Artificial
  CRISPR gRNA sequence
tcaggtatgaggctcataga

SEQ ID NO: 323788 - DNA, 20 bp, Artificial
  CRISPR gRNA sequence
atagaactcactaaaaggga

SEQ ID NO: 323789 - DNA, 20 bp, Artificial
  CRISPR gRNA sequence
actaaaagggagccatgccc

SEQ ID NO: 323790 - DNA, 20 bp, Artificial
  CRISPR gRNA sequence
aaagggagccatgcccatcc

SEQ ID NO: 323791 - DNA, 20 bp, Artificial
  CRISPR gRNA sequence
gtcccctaaggtagcctgat

SEQ ID NO: 323792 - DNA, 20 bp, Artificial
  CRISPR gRNA sequence
aggtagcctgattcttgttt

SEQ ID NO: 323793 - DNA, 20 bp, Artificial
  CRISPR gRNA sequence
attcttgttttctcagaaac

SEQ ID NO: 323794 - DNA, 20 bp, Artificial
  CRISPR gRNA sequence
ttgttttctcagaaacagca

SEQ ID NO: 323795 - DNA, 20 bp, Artificial
  CRISPR gRNA sequence
gttttctcagaaacagcatc

SEQ ID NO: 323796 - DNA, 20 bp, Artificial
  CRISPR gRNA sequence
ttttctcagaaacagcatca

SEQ ID NO: 323797 - DNA, 20 bp, Artificial
  CRISPR gRNA sequence
tctcagaaacagcatcatgg

SEQ ID NO: 323798 - DNA, 20 bp, Artificial
  CRISPR gRNA sequence
ctcagaaacagcatcatggt

SEQ ID NO: 323799 - DNA, 20 bp, Artificial
  CRISPR gRNA sequence
tcagaaacagcatcatggtc

SEQ ID NO: 323800 - DNA, 20 bp, Artificial
  CRISPR gRNA sequence
agaaacagcatcatggtcaa

SEQ ID NO: 323801 - DNA, 20 bp, Artificial
  CRISPR gRNA sequence
cagggccacaacttgagggg

SEQ ID NO: 323802 - DNA, 20 bp, Artificial
  CRISPR gRNA sequence
agggccacaacttgaggggc

SEQ ID NO: 323803 - DNA, 20 bp, Artificial
  CRISPR gRNA sequence
gaggggccttctctccccat

SEQ ID NO: 323804 - DNA, 20 bp, Artificial
  CRISPR gRNA sequence
aggggccttctctccccata

SEQ ID NO: 323805 - DNA, 20 bp, Artificial
  CRISPR gRNA sequence
ctctccccatactgtgcacc

SEQ ID NO: 323806 - DNA, 20 bp, Artificial
  CRISPR gRNA sequence
tctccccatactgtgcacca

SEQ ID NO: 323807 - DNA, 20 bp, Artificial
  CRISPR gRNA sequence
tccccatactgtgcaccagt

SEQ ID NO: 323808 - DNA, 20 bp, Artificial
  CRISPR gRNA sequence
cccatactgtgcaccagtcc

SEQ ID NO: 323809 - DNA, 20 bp, Artificial
  CRISPR gRNA sequence
tgcaccagtcctaccctgct

SEQ ID NO: 323810 - DNA, 20 bp, Artificial
  CRISPR gRNA sequence
ccctgctgcttggaattccc

SEQ ID NO: 323811 - DNA, 20 bp, Artificial
  CRISPR gRNA sequence
ctgcttggaattcccacatt

SEQ ID NO: 323812 - DNA, 20 bp, Artificial
  CRISPR gRNA sequence
cttggaattcccacattact

SEQ ID NO: 323813 - DNA, 20 bp, Artificial
  CRISPR gRNA sequence
ggaattcccacattactcat

SEQ ID NO: 323814 - DNA, 20 bp, Artificial
  CRISPR gRNA sequence
gaattcccacattactcatt

SEQ ID NO: 323815 - DNA, 20 bp, Artificial
  CRISPR gRNA sequence
ccacattactcattccttgg

SEQ ID NO: 323816 - DNA, 20 bp, Artificial
  CRISPR gRNA sequence
ctcattccttgggctaaggc

SEQ ID NO: 323817 - DNA, 20 bp, Artificial
  CRISPR gRNA sequence
attccttgggctaaggcatt

SEQ ID NO: 323818 - DNA, 20 bp, Artificial
  CRISPR gRNA sequence
cttgggctaaggcatttttt

SEQ ID NO: 323819 - DNA, 20 bp, Artificial
  CRISPR gRNA sequence
gggctaaggcattttttgaa

SEQ ID NO: 323820 - DNA, 20 bp, Artificial
  CRISPR gRNA sequence
ggctaaggcattttttgaaa

SEQ ID NO: 323821 - DNA, 20 bp, Artificial
  CRISPR gRNA sequence
aggcattttttgaaagcccc

SEQ ID NO: 323822 - DNA, 20 bp, Artificial
  CRISPR gRNA sequence
tttgaaagcccctgttaaaa

SEQ ID NO: 323823 - DNA, 20 bp, Artificial
  CRISPR gRNA sequence
ttgaaagcccctgttaaaat

SEQ ID NO: 323824 - DNA, 20 bp, Artificial
  CRISPR gRNA sequence
tgaaagcccctgttaaaatg

SEQ ID NO: 323825 - DNA, 20 bp, Artificial
  CRISPR gRNA sequence
gaaagcccctgttaaaatgc

SEQ ID NO: 323826 - DNA, 20 bp, Artificial
  CRISPR gRNA sequence
aaagcccctgttaaaatgca

SEQ ID NO: 323827 - DNA, 20 bp, Artificial
  CRISPR gRNA sequence
ttaaaatgcaaatgctagct

SEQ ID NO: 323828 - DNA, 20 bp, Artificial
  CRISPR gRNA sequence
aaatgcaaatgctagctgga

SEQ ID NO: 323829 - DNA, 20 bp, Artificial
  CRISPR gRNA sequence
gctggaaggaagagggtttt

SEQ ID NO: 323830 - DNA, 20 bp, Artificial
  CRISPR gRNA sequence
gaaggaagagggtttttttt

SEQ ID NO: 323831 - DNA, 20 bp, Artificial
  CRISPR gRNA sequence
tttttgtttgtttttaagcc

SEQ ID NO: 323832 - DNA, 20 bp, Artificial
  CRISPR gRNA sequence
ttttgtttgtttttaagcca

SEQ ID NO: 323833 - DNA, 20 bp, Artificial
  CRISPR gRNA sequence
tttgtttgtttttaagccat

SEQ ID NO: 323834 - DNA, 20 bp, Artificial
  CRISPR gRNA sequence
ttgtttgtttttaagccatt

SEQ ID NO: 323835 - DNA, 20 bp, Artificial
  CRISPR gRNA sequence
tgtttgtttttaagccatta

SEQ ID NO: 323836 - DNA, 20 bp, Artificial
  CRISPR gRNA sequence
gtttgtttttaagccattag

SEQ ID NO: 323837 - DNA, 20 bp, Artificial
  CRISPR gRNA sequence
tttgtttttaagccattagg

SEQ ID NO: 323838 - DNA, 20 bp, Artificial
  CRISPR gRNA sequence
gtttttaagccattaggcat

SEQ ID NO: 323839 - DNA, 20 bp, Artificial
  CRISPR gRNA sequence
tttttaagccattaggcatt

SEQ ID NO: 323840 - DNA, 20 bp, Artificial
  CRISPR gRNA sequence
ttaagccattaggcattagg

SEQ ID NO: 323841 - DNA, 20 bp, Artificial
  CRISPR gRNA sequence
taagccattaggcattaggt

SEQ ID NO: 323842 - DNA, 20 bp, Artificial
  CRISPR gRNA sequence
aagccattaggcattaggtt

SEQ ID NO: 323843 - DNA, 20 bp, Artificial
  CRISPR gRNA sequence
agccattaggcattaggttc

SEQ ID NO: 323844 - DNA, 20 bp, Artificial
  CRISPR gRNA sequence
ggcattaggttcaagttaat

SEQ ID NO: 323845 - DNA, 20 bp, Artificial
  CRISPR gRNA sequence
ggttcaagttaatttatcta

SEQ ID NO: 323846 - DNA, 20 bp, Artificial
  CRISPR gRNA sequence
aagttaatttatctaaaaag

SEQ ID NO: 323847 - DNA, 20 bp, Artificial
  CRISPR gRNA sequence
atttatctaaaaaggacatg

SEQ ID NO: 323848 - DNA, 20 bp, Artificial
  CRISPR gRNA sequence
atctaaaaaggacatggaac

SEQ ID NO: 323849 - DNA, 20 bp, Artificial
  CRISPR gRNA sequence
tctaaaaaggacatggaact

SEQ ID NO: 323850 - DNA, 20 bp, Artificial
  CRISPR gRNA sequence
aaaaggacatggaacttaga

SEQ ID NO: 323851 - DNA, 20 bp, Artificial
  CRISPR gRNA sequence
agaaaggaatcatatccgtc

SEQ ID NO: 323852 - DNA, 20 bp, Artificial
  CRISPR gRNA sequence
gaaaggaatcatatccgtcc

SEQ ID NO: 323853 - DNA, 20 bp, Artificial
  CRISPR gRNA sequence
cccggtgttgaggtctcagg

SEQ ID NO: 323854 - DNA, 20 bp, Artificial
  CRISPR gRNA sequence
ccggtgttgaggtctcaggg

SEQ ID NO: 323855 - DNA, 20 bp, Artificial
  CRISPR gRNA sequence
aggtctcagggccgtgatgg

SEQ ID NO: 323856 - DNA, 20 bp, Artificial
  CRISPR gRNA sequence
agggccgtgatggggaggtg

SEQ ID NO: 323857 - DNA, 20 bp, Artificial
  CRISPR gRNA sequence
aagacacacttttcttcctc

SEQ ID NO: 323858 - DNA, 20 bp, Artificial
  CRISPR gRNA sequence
ttcttcctccacacatattc

SEQ ID NO: 323859 - DNA, 20 bp, Artificial
  CRISPR gRNA sequence
tcttcctccacacatattca

SEQ ID NO: 323860 - DNA, 20 bp, Artificial
  CRISPR gRNA sequence
cttcctccacacatattcaa

SEQ ID NO: 323861 - DNA, 20 bp, Artificial
  CRISPR gRNA sequence
ttcctccacacatattcaaa

SEQ ID NO: 323862 - DNA, 20 bp, Artificial
  CRISPR gRNA sequence
cctccacacatattcaaaat

SEQ ID NO: 323863 - DNA, 20 bp, Artificial
  CRISPR gRNA sequence
ctccacacatattcaaaatg

SEQ ID NO: 323864 - DNA, 20 bp, Artificial
  CRISPR gRNA sequence
cacacatattcaaaatggcg

SEQ ID NO: 323865 - DNA, 20 bp, Artificial
  CRISPR gRNA sequence
aaaatggcgcctatttccca

SEQ ID NO: 323866 - DNA, 20 bp, Artificial
  CRISPR gRNA sequence
tttcccaaacctcagcccga

SEQ ID NO: 323867 - DNA, 20 bp, Artificial
  CRISPR gRNA sequence
cccaaacctcagcccgagtg

SEQ ID NO: 323868 - DNA, 20 bp, Artificial
  CRISPR gRNA sequence
ccaaacctcagcccgagtgt

SEQ ID NO: 323869 - DNA, 20 bp, Artificial
  CRISPR gRNA sequence
agcccgagtgtaagccaatg

SEQ ID NO: 323870 - DNA, 20 bp, Artificial
  CRISPR gRNA sequence
ggaaacagcactgtatagga

SEQ ID NO: 323871 - DNA, 20 bp, Artificial
  CRISPR gRNA sequence
tataggagaagagaggagag

SEQ ID NO: 323872 - DNA, 20 bp, Artificial
  CRISPR gRNA sequence
tgtgcccagcctatggccct

SEQ ID NO: 323873 - DNA, 20 bp, Artificial
  CRISPR gRNA sequence
tggccctgtcctttctccca

SEQ ID NO: 323874 - DNA, 20 bp, Artificial
  CRISPR gRNA sequence
tcctttctcccaccccacaa

SEQ ID NO: 323875 - DNA, 20 bp, Artificial
  CRISPR gRNA sequence
tctcccaccccacaaatact

SEQ ID NO: 323876 - DNA, 20 bp, Artificial
  CRISPR gRNA sequence
ctcccaccccacaaatactc

SEQ ID NO: 323877 - DNA, 20 bp, Artificial
  CRISPR gRNA sequence
tcccaccccacaaatactct

SEQ ID NO: 323878 - DNA, 20 bp, Artificial
  CRISPR gRNA sequence
ccaccccacaaatactctta

SEQ ID NO: 323879 - DNA, 20 bp, Artificial
  CRISPR gRNA sequence
ttacctgcctggccatgaaa

SEQ ID NO: 323880 - DNA, 20 bp, Artificial
  CRISPR gRNA sequence
acctgcctggccatgaaagg

SEQ ID NO: 323881 - DNA, 20 bp, Artificial
  CRISPR gRNA sequence
cctgcctggccatgaaaggt

SEQ ID NO: 323882 - DNA, 20 bp, Artificial
  CRISPR gRNA sequence
cctggccatgaaaggtggat

SEQ ID NO: 323883 - DNA, 20 bp, Artificial
  CRISPR gRNA sequence
gccatgaaaggtggattgcc

SEQ ID NO: 323884 - DNA, 20 bp, Artificial
  CRISPR gRNA sequence
ccagcactagaatggactgt

SEQ ID NO: 323885 - DNA, 20 bp, Artificial
  CRISPR gRNA sequence
gaatggactgtggaaaaatg

SEQ ID NO: 323886 - DNA, 20 bp, Artificial
  CRISPR gRNA sequence
tggaaaaatgcccagggacc

SEQ ID NO: 323887 - DNA, 20 bp, Artificial
  CRISPR gRNA sequence
tctgccactctctgtgcttg

SEQ ID NO: 323888 - DNA, 20 bp, Artificial
  CRISPR gRNA sequence
tgccactctctgtgcttgct

SEQ ID NO: 323889 - DNA, 20 bp, Artificial
  CRISPR gRNA sequence
ccactctctgtgcttgcttt

SEQ ID NO: 323890 - DNA, 20 bp, Artificial
  CRISPR gRNA sequence
tctgtgcttgcttttgctct

SEQ ID NO: 323891 - DNA, 20 bp, Artificial
  CRISPR gRNA sequence
tgtgcttgcttttgctctag

SEQ ID NO: 323892 - DNA, 20 bp, Artificial
  CRISPR gRNA sequence
tgcttgcttttgctctagtt

SEQ ID NO: 323893 - DNA, 20 bp, Artificial
  CRISPR gRNA sequence
gcttttgctctagttttatc

SEQ ID NO: 323894 - DNA, 20 bp, Artificial
  CRISPR gRNA sequence
cttttgctctagttttatct

SEQ ID NO: 323895 - DNA, 20 bp, Artificial
  CRISPR gRNA sequence
ttgctctagttttatctctt

SEQ ID NO: 323896 - DNA, 20 bp, Artificial
  CRISPR gRNA sequence
tgctctagttttatctcttt

SEQ ID NO: 323897 - DNA, 20 bp, Artificial
  CRISPR gRNA sequence
gctctagttttatctctttg

SEQ ID NO: 323898 - DNA, 20 bp, Artificial
  CRISPR gRNA sequence
ctctagttttatctctttga

SEQ ID NO: 323899 - DNA, 20 bp, Artificial
  CRISPR gRNA sequence
tagttttatctctttgaagc

SEQ ID NO: 323900 - DNA, 20 bp, Artificial
  CRISPR gRNA sequence
gttttatctctttgaagctt

SEQ ID NO: 323901 - DNA, 20 bp, Artificial
  CRISPR gRNA sequence
tatctctttgaagcttcaat

SEQ ID NO: 323902 - DNA, 20 bp, Artificial
  CRISPR gRNA sequence
atctctttgaagcttcaatc

SEQ ID NO: 323903 - DNA, 20 bp, Artificial
  CRISPR gRNA sequence
tctctttgaagcttcaatcc

SEQ ID NO: 323904 - DNA, 20 bp, Artificial
  CRISPR gRNA sequence
tttgaagcttcaatcccctg

SEQ ID NO: 323905 - DNA, 20 bp, Artificial
  CRISPR gRNA sequence
tgaagcttcaatcccctggc

SEQ ID NO: 323906 - DNA, 20 bp, Artificial
  CRISPR gRNA sequence
gaagcttcaatcccctggcc

SEQ ID NO: 323907 - DNA, 20 bp, Artificial
  CRISPR gRNA sequence
aagcttcaatcccctggcct

SEQ ID NO: 323908 - DNA, 20 bp, Artificial
  CRISPR gRNA sequence
caatcccctggcctagggac

SEQ ID NO: 323909 - DNA, 20 bp, Artificial
  CRISPR gRNA sequence
aatcccctggcctagggacc

SEQ ID NO: 323910 - DNA, 20 bp, Artificial
  CRISPR gRNA sequence
gcctagggacccctaacctc

SEQ ID NO: 323911 - DNA, 20 bp, Artificial
  CRISPR gRNA sequence
gggacccctaacctcaactc

SEQ ID NO: 323912 - DNA, 20 bp, Artificial
  CRISPR gRNA sequence
acctcaactcccacctcagt

SEQ ID NO: 323913 - DNA, 20 bp, Artificial
  CRISPR gRNA sequence
aactcccacctcagtctgat

SEQ ID NO: 323914 - DNA, 20 bp, Artificial
  CRISPR gRNA sequence
ccacctcagtctgatttttg

SEQ ID NO: 323915 - DNA, 20 bp, Artificial
  CRISPR gRNA sequence
agtctgatttttgaaacatg

SEQ ID NO: 323916 - DNA, 20 bp, Artificial
  CRISPR gRNA sequence
atttttgaaacatggtattt

SEQ ID NO: 323917 - DNA, 20 bp, Artificial
  CRISPR gRNA sequence
ttgaaacatggtatttcaac

SEQ ID NO: 323918 - DNA, 20 bp, Artificial
  CRISPR gRNA sequence
tgaaacatggtatttcaacc

SEQ ID NO: 323919 - DNA, 20 bp, Artificial
  CRISPR gRNA sequence
gaaacatggtatttcaacct

SEQ ID NO: 323920 - DNA, 20 bp, Artificial
  CRISPR gRNA sequence
aaacatggtatttcaacctt

SEQ ID NO: 323921 - DNA, 20 bp, Artificial
  CRISPR gRNA sequence
caaccttgatttttctgctg

SEQ ID NO: 323922 - DNA, 20 bp, Artificial
  CRISPR gRNA sequence
aaccttgatttttctgctga

SEQ ID NO: 323923 - DNA, 20 bp, Artificial
  CRISPR gRNA sequence
gatttttctgctgaagaatc

SEQ ID NO: 323924 - DNA, 20 bp, Artificial
  CRISPR gRNA sequence
atttttctgctgaagaatct

SEQ ID NO: 323925 - DNA, 20 bp, Artificial
  CRISPR gRNA sequence
ttctgctgaagaatctggct

SEQ ID NO: 323926 - DNA, 20 bp, Artificial
  CRISPR gRNA sequence
tctgctgaagaatctggctt

SEQ ID NO: 323927 - DNA, 20 bp, Artificial
  CRISPR gRNA sequence
ctgctgaagaatctggcttg

SEQ ID NO: 323928 - DNA, 20 bp, Artificial
  CRISPR gRNA sequence
tgctgaagaatctggcttgg

SEQ ID NO: 323929 - DNA, 20 bp, Artificial
  CRISPR gRNA sequence
ctgaagaatctggcttggct

SEQ ID NO: 323930 - DNA, 20 bp, Artificial
  CRISPR gRNA sequence
aagaatctggcttggcttat

SEQ ID NO: 323931 - DNA, 20 bp, Artificial
  CRISPR gRNA sequence
gcttggcttatctcttcatc

SEQ ID NO: 323932 - DNA, 20 bp, Artificial
  CRISPR gRNA sequence
ggcttatctcttcatctttc

SEQ ID NO: 323933 - DNA, 20 bp, Artificial
  CRISPR gRNA sequence
gcttatctcttcatctttct

SEQ ID NO: 323934 - DNA, 20 bp, Artificial
  CRISPR gRNA sequence
atctcttcatctttctcatg

SEQ ID NO: 323935 - DNA, 20 bp, Artificial
  CRISPR gRNA sequence
tctcttcatctttctcatgt

SEQ ID NO: 323936 - DNA, 20 bp, Artificial
  CRISPR gRNA sequence
ttcatctttctcatgttttc

SEQ ID NO: 323937 - DNA, 20 bp, Artificial
  CRISPR gRNA sequence
catctttctcatgttttctc

SEQ ID NO: 323938 - DNA, 20 bp, Artificial
  CRISPR gRNA sequence
atctttctcatgttttctcc

SEQ ID NO: 323939 - DNA, 20 bp, Artificial
  CRISPR gRNA sequence
tctcatgttttctccctacc

SEQ ID NO: 323940 - DNA, 20 bp, Artificial
  CRISPR gRNA sequence
ctcatgttttctccctacct

SEQ ID NO: 323941 - DNA, 20 bp, Artificial
  CRISPR gRNA sequence
tcatgttttctccctacctg

SEQ ID NO: 323942 - DNA, 20 bp, Artificial
  CRISPR gRNA sequence
atgttttctccctacctgcc

SEQ ID NO: 323943 - DNA, 20 bp, Artificial
  CRISPR gRNA sequence
tctccctacctgccctagcc

SEQ ID NO: 323944 - DNA, 20 bp, Artificial
  CRISPR gRNA sequence
ctccctacctgccctagcct

SEQ ID NO: 323945 - DNA, 20 bp, Artificial
  CRISPR gRNA sequence
tccctacctgccctagcctc

SEQ ID NO: 323946 - DNA, 20 bp, Artificial
  CRISPR gRNA sequence
cctacctgccctagcctcaa

SEQ ID NO: 323947 - DNA, 20 bp, Artificial
  CRISPR gRNA sequence
cctgccctagcctcaactcc

SEQ ID NO: 323948 - DNA, 20 bp, Artificial
  CRISPR gRNA sequence
ccctagcctcaactccataa

SEQ ID NO: 323949 - DNA, 20 bp, Artificial
  CRISPR gRNA sequence
gcctcaactccataaaatcc

SEQ ID NO: 323950 - DNA, 20 bp, Artificial
  CRISPR gRNA sequence
aactccataaaatcccatcc

SEQ ID NO: 323951 - DNA, 20 bp, Artificial
  CRISPR gRNA sequence
cataaaatcccatcctcacc

SEQ ID NO: 323952 - DNA, 20 bp, Artificial
  CRISPR gRNA sequence
acccccacccaggaagaggc

SEQ ID NO: 323953 - DNA, 20 bp, Artificial
  CRISPR gRNA sequence
aagaagaatagactaaccaa

SEQ ID NO: 323954 - DNA, 20 bp, Artificial
  CRISPR gRNA sequence
accaaaatatcaaatgcaaa

SEQ ID NO: 323955 - DNA, 20 bp, Artificial
  CRISPR gRNA sequence
ggtaattaatcagctgatat

SEQ ID NO: 323956 - DNA, 20 bp, Artificial
  CRISPR gRNA sequence
gtaattaatcagctgatata

SEQ ID NO: 323957 - DNA, 20 bp, Artificial
  CRISPR gRNA sequence
atcagctgatatagtcacat

SEQ ID NO: 323958 - DNA, 20 bp, Artificial
  CRISPR gRNA sequence
atatagtcacatagaacaat

SEQ ID NO: 323959 - DNA, 20 bp, Artificial
  CRISPR gRNA sequence
ccttccctttaaagcactat

SEQ ID NO: 323960 - DNA, 20 bp, Artificial
  CRISPR gRNA sequence
cttccctttaaagcactatt

SEQ ID NO: 323961 - DNA, 20 bp, Artificial
  CRISPR gRNA sequence
ccctttaaagcactattgct

SEQ ID NO: 323962 - DNA, 20 bp, Artificial
  CRISPR gRNA sequence
cctttaaagcactattgcta

SEQ ID NO: 323963 - DNA, 20 bp, Artificial
  CRISPR gRNA sequence
taaagcactattgctatgta

SEQ ID NO: 323964 - DNA, 20 bp, Artificial
  CRISPR gRNA sequence
aaagcactattgctatgtag

SEQ ID NO: 323965 - DNA, 20 bp, Artificial
  CRISPR gRNA sequence
aagcactattgctatgtagt

SEQ ID NO: 323966 - DNA, 20 bp, Artificial
  CRISPR gRNA sequence
ttgctatgtagtcatgttta

SEQ ID NO: 323967 - DNA, 20 bp, Artificial
  CRISPR gRNA sequence
ctatgtagtcatgtttagtg

SEQ ID NO: 323968 - DNA, 20 bp, Artificial
  CRISPR gRNA sequence
tgtagtcatgtttagtgtga

SEQ ID NO: 323969 - DNA, 20 bp, Artificial
  CRISPR gRNA sequence
agtgtgattaaattaatgtg

SEQ ID NO: 323970 - DNA, 20 bp, Artificial
  CRISPR gRNA sequence
gtgtgattaaattaatgtga

SEQ ID NO: 323971 - DNA, 20 bp, Artificial
  CRISPR gRNA sequence
aattaatgtgatttccccac

SEQ ID NO: 323972 - DNA, 20 bp, Artificial
  CRISPR gRNA sequence
atgtgatttccccactaggc

SEQ ID NO: 323973 - DNA, 20 bp, Artificial
  CRISPR gRNA sequence
ccccactaggctagaaaaca

SEQ ID NO: 323974 - DNA, 20 bp, Artificial
  CRISPR gRNA sequence
cccactaggctagaaaacaa

SEQ ID NO: 323975 - DNA, 20 bp, Artificial
  CRISPR gRNA sequence
ggctagaaaacaagagtgca

SEQ ID NO: 323976 - DNA, 20 bp, Artificial
  CRISPR gRNA sequence
gaaaacaagagtgcagcttt

SEQ ID NO: 323977 - DNA, 20 bp, Artificial
  CRISPR gRNA sequence
ttccttatgtcttttatgct

SEQ ID NO: 323978 - DNA, 20 bp, Artificial
  CRISPR gRNA sequence
tccttatgtcttttatgcta

SEQ ID NO: 323979 - DNA, 20 bp, Artificial
  CRISPR gRNA sequence
ccttatgtcttttatgctac

SEQ ID NO: 323980 - DNA, 20 bp, Artificial
  CRISPR gRNA sequence
cttatgtcttttatgctacc

SEQ ID NO: 323981 - DNA, 20 bp, Artificial
  CRISPR gRNA sequence
atgtcttttatgctacctgt

SEQ ID NO: 323982 - DNA, 20 bp, Artificial
  CRISPR gRNA sequence
tgtcttttatgctacctgtt

SEQ ID NO: 323983 - DNA, 20 bp, Artificial
  CRISPR gRNA sequence
ttatgctacctgttaagtcc

SEQ ID NO: 323984 - DNA, 20 bp, Artificial
  CRISPR gRNA sequence
tatgctacctgttaagtccc

SEQ ID NO: 323985 - DNA, 20 bp, Artificial
  CRISPR gRNA sequence
atgctacctgttaagtccct

SEQ ID NO: 323986 - DNA, 20 bp, Artificial
  CRISPR gRNA sequence
tgctacctgttaagtcccta

SEQ ID NO: 323987 - DNA, 20 bp, Artificial
  CRISPR gRNA sequence
cctgttaagtccctagtacc

SEQ ID NO: 323988 - DNA, 20 bp, Artificial
  CRISPR gRNA sequence
ttaagtccctagtacctgga

SEQ ID NO: 323989 - DNA, 20 bp, Artificial
  CRISPR gRNA sequence
agtccctagtacctggaaca

SEQ ID NO: 323990 - DNA, 20 bp, Artificial
  CRISPR gRNA sequence
gtacctggaacatagcaagc

SEQ ID NO: 323991 - DNA, 20 bp, Artificial
  CRISPR gRNA sequence
gaacatagcaagcacttaat

SEQ ID NO: 323992 - DNA, 20 bp, Artificial
  CRISPR gRNA sequence
aataactatattaggaataa

SEQ ID NO: 323993 - DNA, 20 bp, Artificial
  CRISPR gRNA sequence
ataactatattaggaataaa

SEQ ID NO: 323994 - DNA, 20 bp, Artificial
  CRISPR gRNA sequence
tattaggaataaataaatag

SEQ ID NO: 323995 - DNA, 20 bp, Artificial
  CRISPR gRNA sequence
ggaataaataaatagagatt

SEQ ID NO: 323996 - DNA, 20 bp, Artificial
  CRISPR gRNA sequence
ataaaagcttccattataca

SEQ ID NO: 323997 - DNA, 20 bp, Artificial
  CRISPR gRNA sequence
taaaagcttccattatacac

SEQ ID NO: 323998 - DNA, 20 bp, Artificial
  CRISPR gRNA sequence
ccattatacacaggatagct

SEQ ID NO: 323999 - DNA, 20 bp, Artificial
  CRISPR gRNA sequence
cattatacacaggatagctc

SEQ ID NO: 324000 - DNA, 20 bp, Artificial
  CRISPR gRNA sequence
tacacaggatagctcacata

SEQ ID NO: 324001 - DNA, 20 bp, Artificial
  CRISPR gRNA sequence
acataaataatattaacggt

SEQ ID NO: 324002 - DNA, 20 bp, Artificial
  CRISPR gRNA sequence
acggtatctgcagcagcaga

SEQ ID NO: 324003 - DNA, 20 bp, Artificial
  CRISPR gRNA sequence
cagcagcagacataacacga

SEQ ID NO: 324004 - DNA, 20 bp, Artificial
  CRISPR gRNA sequence
caagtctgagcacataaata

SEQ ID NO: 324005 - DNA, 20 bp, Artificial
  CRISPR gRNA sequence
agcacataaatagacgcatt

SEQ ID NO: 324006 - DNA, 20 bp, Artificial
  CRISPR gRNA sequence
tagtacagggccttagtccc

SEQ ID NO: 324007 - DNA, 20 bp, Artificial
  CRISPR gRNA sequence
agtacagggccttagtccca

SEQ ID NO: 324008 - DNA, 20 bp, Artificial
  CRISPR gRNA sequence
gtacagggccttagtcccaa

SEQ ID NO: 324009 - DNA, 20 bp, Artificial
  CRISPR gRNA sequence
agtcccaagattgaggttac

SEQ ID NO: 324010 - DNA, 20 bp, Artificial
  CRISPR gRNA sequence
gtcccaagattgaggttaca

SEQ ID NO: 324011 - DNA, 20 bp, Artificial
  CRISPR gRNA sequence
aggttacatgtaagataaac

SEQ ID NO: 324012 - DNA, 20 bp, Artificial
  CRISPR gRNA sequence
catgtaagataaacagttca

SEQ ID NO: 324013 - DNA, 20 bp, Artificial
  CRISPR gRNA sequence
atttccttcattattacagt

SEQ ID NO: 324014 - DNA, 20 bp, Artificial
  CRISPR gRNA sequence
ccttcattattacagtttaa

SEQ ID NO: 324015 - DNA, 20 bp, Artificial
  CRISPR gRNA sequence
cttcattattacagtttaag

SEQ ID NO: 324016 - DNA, 20 bp, Artificial
  CRISPR gRNA sequence
cattattacagtttaagggg

SEQ ID NO: 324017 - DNA, 20 bp, Artificial
  CRISPR gRNA sequence
attattacagtttaagggga

SEQ ID NO: 324018 - DNA, 20 bp, Artificial
  CRISPR gRNA sequence
ttacagtttaaggggagtag

SEQ ID NO: 324019 - DNA, 20 bp, Artificial
  CRISPR gRNA sequence
cagtttaaggggagtaggaa

SEQ ID NO: 324020 - DNA, 20 bp, Artificial
  CRISPR gRNA sequence
aaggggagtaggaagttccc

SEQ ID NO: 324021 - DNA, 20 bp, Artificial
  CRISPR gRNA sequence
aggggagtaggaagttccct

SEQ ID NO: 324022 - DNA, 20 bp, Artificial
  CRISPR gRNA sequence
cctttgtcaaaaactatttt

SEQ ID NO: 324023 - DNA, 20 bp, Artificial
  CRISPR gRNA sequence
tgtcaaaaactattttcacc

SEQ ID NO: 324024 - DNA, 20 bp, Artificial
  CRISPR gRNA sequence
gtcaaaaactattttcacct

SEQ ID NO: 324025 - DNA, 20 bp, Artificial
  CRISPR gRNA sequence
tcaaaaactattttcacctg

SEQ ID NO: 324026 - DNA, 20 bp, Artificial
  CRISPR gRNA sequence
ttttcacctggctctccaga

SEQ ID NO: 324027 - DNA, 20 bp, Artificial
  CRISPR gRNA sequence
tcacctggctctccagaacc

SEQ ID NO: 324028 - DNA, 20 bp, Artificial
  CRISPR gRNA sequence
cacctggctctccagaacct

SEQ ID NO: 324029 - DNA, 20 bp, Artificial
  CRISPR gRNA sequence
acctggctctccagaacctt

SEQ ID NO: 324030 - DNA, 20 bp, Artificial
  CRISPR gRNA sequence
gctctccagaaccttaaatt

SEQ ID NO: 324031 - DNA, 20 bp, Artificial
  CRISPR gRNA sequence
tccagaaccttaaattgcta

SEQ ID NO: 324032 - DNA, 20 bp, Artificial
  CRISPR gRNA sequence
cagaaccttaaattgctatt

SEQ ID NO: 324033 - DNA, 20 bp, Artificial
  CRISPR gRNA sequence
aaattgctattaatagagat

SEQ ID NO: 324034 - DNA, 20 bp, Artificial
  CRISPR gRNA sequence
aattgctattaatagagatg

SEQ ID NO: 324035 - DNA, 20 bp, Artificial
  CRISPR gRNA sequence
ctattaatagagatgatatt

SEQ ID NO: 324036 - DNA, 20 bp, Artificial
  CRISPR gRNA sequence
ttaatagagatgatatttta

SEQ ID NO: 324037 - DNA, 20 bp, Artificial
  CRISPR gRNA sequence
atagagatgatattttaagc

SEQ ID NO: 324038 - DNA, 20 bp, Artificial
  CRISPR gRNA sequence
taagcccgtttgcaaatgca

SEQ ID NO: 324039 - DNA, 20 bp, Artificial
  CRISPR gRNA sequence
aagcccgtttgcaaatgcaa

SEQ ID NO: 324040 - DNA, 20 bp, Artificial
  CRISPR gRNA sequence
agcccgtttgcaaatgcaaa

SEQ ID NO: 324041 - DNA, 20 bp, Artificial
  CRISPR gRNA sequence
gcaaatgcaaatgcaaatag

SEQ ID NO: 324042 - DNA, 20 bp, Artificial
  CRISPR gRNA sequence
caaatgcaaatgcaaatagg

SEQ ID NO: 324043 - DNA, 20 bp, Artificial
  CRISPR gRNA sequence
accgtatgtgaaacacatta

SEQ ID NO: 324044 - DNA, 20 bp, Artificial
  CRISPR gRNA sequence
tgttcaatcacttgcttggg

SEQ ID NO: 324045 - DNA, 20 bp, Artificial
  CRISPR gRNA sequence
aatcacttgcttgggctctt

SEQ ID NO: 324046 - DNA, 20 bp, Artificial
  CRISPR gRNA sequence
gcttgggctcttttttgacc

SEQ ID NO: 324047 - DNA, 20 bp, Artificial
  CRISPR gRNA sequence
cttgggctcttttttgaccc

SEQ ID NO: 324048 - DNA, 20 bp, Artificial
  CRISPR gRNA sequence
gggctcttttttgacccaag

SEQ ID NO: 324049 - DNA, 20 bp, Artificial
  CRISPR gRNA sequence
ggctcttttttgacccaaga

SEQ ID NO: 324050 - DNA, 20 bp, Artificial
  CRISPR gRNA sequence
ttttttgacccaagaatatt

SEQ ID NO: 324051 - DNA, 20 bp, Artificial
  CRISPR gRNA sequence
ttttgacccaagaatatttc

SEQ ID NO: 324052 - DNA, 20 bp, Artificial
  CRISPR gRNA sequence
tttgacccaagaatatttct

SEQ ID NO: 324053 - DNA, 20 bp, Artificial
  CRISPR gRNA sequence
ttgacccaagaatatttctt

SEQ ID NO: 324054 - DNA, 20 bp, Artificial
  CRISPR gRNA sequence
tgacccaagaatatttcttt

SEQ ID NO: 324055 - DNA, 20 bp, Artificial
  CRISPR gRNA sequence
gacccaagaatatttctttt

SEQ ID NO: 324056 - DNA, 20 bp, Artificial
  CRISPR gRNA sequence
acccaagaatatttcttttt

SEQ ID NO: 324057 - DNA, 20 bp, Artificial
  CRISPR gRNA sequence
ctttttaaattagatcttgg

SEQ ID NO: 324058 - DNA, 20 bp, Artificial
  CRISPR gRNA sequence
tttttaaattagatcttggt

SEQ ID NO: 324059 - DNA, 20 bp, Artificial
  CRISPR gRNA sequence
tttaaattagatcttggtct

SEQ ID NO: 324060 - DNA, 20 bp, Artificial
  CRISPR gRNA sequence
ttaaattagatcttggtctc

SEQ ID NO: 324061 - DNA, 20 bp, Artificial
  CRISPR gRNA sequence
taaattagatcttggtctct

SEQ ID NO: 324062 - DNA, 20 bp, Artificial
  CRISPR gRNA sequence
aaattagatcttggtctctg

SEQ ID NO: 324063 - DNA, 20 bp, Artificial
  CRISPR gRNA sequence
aattagatcttggtctctgg

SEQ ID NO: 324064 - DNA, 20 bp, Artificial
  CRISPR gRNA sequence
gatcttggtctctggtgcca

SEQ ID NO: 324065 - DNA, 20 bp, Artificial
  CRISPR gRNA sequence
ggtctctggtgccaagtggg

SEQ ID NO: 324066 - DNA, 20 bp, Artificial
  CRISPR gRNA sequence
gtctctggtgccaagtgggg

SEQ ID NO: 324067 - DNA, 20 bp, Artificial
  CRISPR gRNA sequence
tggtgccaagtggggctaat

SEQ ID NO: 324068 - DNA, 20 bp, Artificial
  CRISPR gRNA sequence
gtgccaagtggggctaatat

SEQ ID NO: 324069 - DNA, 20 bp, Artificial
  CRISPR gRNA sequence
atattgggatggggcacttg

SEQ ID NO: 324070 - DNA, 20 bp, Artificial
  CRISPR gRNA sequence
ggatggggcacttggatggg

SEQ ID NO: 324071 - DNA, 20 bp, Artificial
  CRISPR gRNA sequence
ggatgggaagaaatattggg

SEQ ID NO: 324072 - DNA, 20 bp, Artificial
  CRISPR gRNA sequence
gatgggaagaaatattgggg

SEQ ID NO: 324073 - DNA, 20 bp, Artificial
  CRISPR gRNA sequence
gggaagggtctctggaccag

SEQ ID NO: 324074 - DNA, 20 bp, Artificial
  CRISPR gRNA sequence
tggaccagagaagggaaagg

SEQ ID NO: 324075 - DNA, 20 bp, Artificial
  CRISPR gRNA sequence
gaccagagaagggaaaggtc

SEQ ID NO: 324076 - DNA, 20 bp, Artificial
  CRISPR gRNA sequence
cagagaggctgcaagaggag

SEQ ID NO: 324077 - DNA, 20 bp, Artificial
  CRISPR gRNA sequence
caagaggaggaaatccccct

SEQ ID NO: 324078 - DNA, 20 bp, Artificial
  CRISPR gRNA sequence
ctctggatttcccactggca

SEQ ID NO: 324079 - DNA, 20 bp, Artificial
  CRISPR gRNA sequence
tctggatttcccactggcac

SEQ ID NO: 324080 - DNA, 20 bp, Artificial
  CRISPR gRNA sequence
tggatttcccactggcacag

SEQ ID NO: 324081 - DNA, 20 bp, Artificial
  CRISPR gRNA sequence
gatttcccactggcacaggg

SEQ ID NO: 324082 - DNA, 20 bp, Artificial
  CRISPR gRNA sequence
cccactggcacaggggactc

SEQ ID NO: 324083 - DNA, 20 bp, Artificial
  CRISPR gRNA sequence
ccactggcacaggggactca

SEQ ID NO: 324084 - DNA, 20 bp, Artificial
  CRISPR gRNA sequence
gcacaggggactcaggcgag

SEQ ID NO: 324085 - DNA, 20 bp, Artificial
  CRISPR gRNA sequence
aggcgaggcgagctgacatc

SEQ ID NO: 324086 - DNA, 20 bp, Artificial
  CRISPR gRNA sequence
acatctttggactgcttctt

SEQ ID NO: 324087 - DNA, 20 bp, Artificial
  CRISPR gRNA sequence
tggactgcttcttctagagc

SEQ ID NO: 324088 - DNA, 20 bp, Artificial
  CRISPR gRNA sequence
ggactgcttcttctagagca

SEQ ID NO: 324089 - DNA, 20 bp, Artificial
  CRISPR gRNA sequence
gactgcttcttctagagcag

SEQ ID NO: 324090 - DNA, 20 bp, Artificial
  CRISPR gRNA sequence
cttcttctagagcagaggct

SEQ ID NO: 324091 - DNA, 20 bp, Artificial
  CRISPR gRNA sequence
cttctagagcagaggctgct

SEQ ID NO: 324092 - DNA, 20 bp, Artificial
  CRISPR gRNA sequence
ttctagagcagaggctgctc

SEQ ID NO: 324093 - DNA, 20 bp, Artificial
  CRISPR gRNA sequence
ctagagcagaggctgctcgg

SEQ ID NO: 324094 - DNA, 20 bp, Artificial
  CRISPR gRNA sequence
tagagcagaggctgctcgga

SEQ ID NO: 324095 - DNA, 20 bp, Artificial
  CRISPR gRNA sequence
gagcagaggctgctcggaga

SEQ ID NO: 324096 - DNA, 20 bp, Artificial
  CRISPR gRNA sequence
ctcggagaccccagcacccc

SEQ ID NO: 324097 - DNA, 20 bp, Artificial
  CRISPR gRNA sequence
ggagaccccagcaccccaaa

SEQ ID NO: 324098 - DNA, 20 bp, Artificial
  CRISPR gRNA sequence
ccaattatttggtaagtggc

SEQ ID NO: 324099 - DNA, 20 bp, Artificial
  CRISPR gRNA sequence
tttggtaagtggcaccttct

SEQ ID NO: 324100 - DNA, 20 bp, Artificial
  CRISPR gRNA sequence
ggtaagtggcaccttctatt

SEQ ID NO: 324101 - DNA, 20 bp, Artificial
  CRISPR gRNA sequence
gtaagtggcaccttctattt

SEQ ID NO: 324102 - DNA, 20 bp, Artificial
  CRISPR gRNA sequence
ctatttcctgcctattttgt

SEQ ID NO: 324103 - DNA, 20 bp, Artificial
  CRISPR gRNA sequence
tatttcctgcctattttgtc

SEQ ID NO: 324104 - DNA, 20 bp, Artificial
  CRISPR gRNA sequence
tttcctgcctattttgtctc

SEQ ID NO: 324105 - DNA, 20 bp, Artificial
  CRISPR gRNA sequence
cctgcctattttgtctctta

SEQ ID NO: 324106 - DNA, 20 bp, Artificial
  CRISPR gRNA sequence
ctgcctattttgtctcttag

SEQ ID NO: 324107 - DNA, 20 bp, Artificial
  CRISPR gRNA sequence
cctattttgtctcttagctc

SEQ ID NO: 324108 - DNA, 20 bp, Artificial
  CRISPR gRNA sequence
ttttgtctcttagctcacga

SEQ ID NO: 324109 - DNA, 20 bp, Artificial
  CRISPR gRNA sequence
tgtctcttagctcacgaaaa

SEQ ID NO: 324110 - DNA, 20 bp, Artificial
  CRISPR gRNA sequence
gtctcttagctcacgaaaaa

SEQ ID NO: 324111 - DNA, 20 bp, Artificial
  CRISPR gRNA sequence
tctcttagctcacgaaaaac

SEQ ID NO: 324112 - DNA, 20 bp, Artificial
  CRISPR gRNA sequence
ttagctcacgaaaaacagat

SEQ ID NO: 324113 - DNA, 20 bp, Artificial
  CRISPR gRNA sequence
agctcacgaaaaacagatga

SEQ ID NO: 324114 - DNA, 20 bp, Artificial
  CRISPR gRNA sequence
gctcacgaaaaacagatgaa

SEQ ID NO: 324115 - DNA, 20 bp, Artificial
  CRISPR gRNA sequence
acgaaaaacagatgaaggga

SEQ ID NO: 324116 - DNA, 20 bp, Artificial
  CRISPR gRNA sequence
gcaggaagagacagattttt

SEQ ID NO: 324117 - DNA, 20 bp, Artificial
  CRISPR gRNA sequence
ttgtaatatcccacctccaa

SEQ ID NO: 324118 - DNA, 20 bp, Artificial
  CRISPR gRNA sequence
tgtaatatcccacctccaat

SEQ ID NO: 324119 - DNA, 20 bp, Artificial
  CRISPR gRNA sequence
gtaatatcccacctccaatg

SEQ ID NO: 324120 - DNA, 20 bp, Artificial
  CRISPR gRNA sequence
taatatcccacctccaatgt

SEQ ID NO: 324121 - DNA, 20 bp, Artificial
  CRISPR gRNA sequence
caatgtagtcaatctgagaa

SEQ ID NO: 324122 - DNA, 20 bp, Artificial
  CRISPR gRNA sequence
agaagcaaacctgatggtca

SEQ ID NO: 324123 - DNA, 20 bp, Artificial
  CRISPR gRNA sequence
atggtcagaggttttaagca

SEQ ID NO: 324124 - DNA, 20 bp, Artificial
  CRISPR gRNA sequence
taagcatgctctctgcaatc

SEQ ID NO: 324125 - DNA, 20 bp, Artificial
  CRISPR gRNA sequence
aagcatgctctctgcaatcc

SEQ ID NO: 324126 - DNA, 20 bp, Artificial
  CRISPR gRNA sequence
agcatgctctctgcaatccc

SEQ ID NO: 324127 - DNA, 20 bp, Artificial
  CRISPR gRNA sequence
tctgcaatcccttttactca

SEQ ID NO: 324128 - DNA, 20 bp, Artificial
  CRISPR gRNA sequence
tgcaatcccttttactcatt

SEQ ID NO: 324129 - DNA, 20 bp, Artificial
  CRISPR gRNA sequence
caatcccttttactcattct

SEQ ID NO: 324130 - DNA, 20 bp, Artificial
  CRISPR gRNA sequence
ttactcattctctggccggc

SEQ ID NO: 324131 - DNA, 20 bp, Artificial
  CRISPR gRNA sequence
tactcattctctggccggcc

SEQ ID NO: 324132 - DNA, 20 bp, Artificial
  CRISPR gRNA sequence
actcattctctggccggcca

SEQ ID NO: 324133 - DNA, 20 bp, Artificial
  CRISPR gRNA sequence
ctcattctctggccggccat

SEQ ID NO: 324134 - DNA, 20 bp, Artificial
  CRISPR gRNA sequence
attctctggccggccattag

SEQ ID NO: 324135 - DNA, 20 bp, Artificial
  CRISPR gRNA sequence
tctggccggccattagcaca

SEQ ID NO: 324136 - DNA, 20 bp, Artificial
  CRISPR gRNA sequence
tggccggccattagcacatc

SEQ ID NO: 324137 - DNA, 20 bp, Artificial
  CRISPR gRNA sequence
gccggccattagcacatcag

SEQ ID NO: 324138 - DNA, 20 bp, Artificial
  CRISPR gRNA sequence
gcacatcagcatttctgccc

SEQ ID NO: 324139 - DNA, 20 bp, Artificial
  CRISPR gRNA sequence
ctgccccagatgcagcttgc

SEQ ID NO: 324140 - DNA, 20 bp, Artificial
  CRISPR gRNA sequence
tgccccagatgcagcttgca

SEQ ID NO: 324141 - DNA, 20 bp, Artificial
  CRISPR gRNA sequence
ccccagatgcagcttgcagc

SEQ ID NO: 324142 - DNA, 20 bp, Artificial
  CRISPR gRNA sequence
gcagctttatctcatgccac

SEQ ID NO: 324143 - DNA, 20 bp, Artificial
  CRISPR gRNA sequence
cagctttatctcatgccact

SEQ ID NO: 324144 - DNA, 20 bp, Artificial
  CRISPR gRNA sequence
tatctcatgccactccctag

SEQ ID NO: 324145 - DNA, 20 bp, Artificial
  CRISPR gRNA sequence
atctcatgccactccctagg

SEQ ID NO: 324146 - DNA, 20 bp, Artificial
  CRISPR gRNA sequence
tctcatgccactccctaggc

SEQ ID NO: 324147 - DNA, 20 bp, Artificial
  CRISPR gRNA sequence
atgccactccctaggcgtct

SEQ ID NO: 324148 - DNA, 20 bp, Artificial
  CRISPR gRNA sequence
cctaggcgtctgagcctcca

SEQ ID NO: 324149 - DNA, 20 bp, Artificial
  CRISPR gRNA sequence
ggcgtctgagcctccacaaa

SEQ ID NO: 324150 - DNA, 20 bp, Artificial
  CRISPR gRNA sequence
agcctccacaaacatacctg

SEQ ID NO: 324151 - DNA, 20 bp, Artificial
  CRISPR gRNA sequence
cacaaacatacctgtcacaa

SEQ ID NO: 324152 - DNA, 20 bp, Artificial
  CRISPR gRNA sequence
tcacaaatgcctgtccactg

SEQ ID NO: 324153 - DNA, 20 bp, Artificial
  CRISPR gRNA sequence
tccactgtagctccaaaaag

SEQ ID NO: 324154 - DNA, 20 bp, Artificial
  CRISPR gRNA sequence
tagctccaaaaagagaccag

SEQ ID NO: 324155 - DNA, 20 bp, Artificial
  CRISPR gRNA sequence
caaaaagagaccagatgcat

SEQ ID NO: 324156 - DNA, 20 bp, Artificial
  CRISPR gRNA sequence
ccaaggaacacagaagcaag

SEQ ID NO: 324157 - DNA, 20 bp, Artificial
  CRISPR gRNA sequence
gcgagctccccgtacctcct

SEQ ID NO: 324158 - DNA, 20 bp, Artificial
  CRISPR gRNA sequence
cgagctccccgtacctccta

SEQ ID NO: 324159 - DNA, 20 bp, Artificial
  CRISPR gRNA sequence
cccgtacctcctaaggctcc

SEQ ID NO: 324160 - DNA, 20 bp, Artificial
  CRISPR gRNA sequence
ctaaggctccttgtagagag

SEQ ID NO: 324161 - DNA, 20 bp, Artificial
  CRISPR gRNA sequence
aggctccttgtagagagaga

SEQ ID NO: 324162 - DNA, 20 bp, Artificial
  CRISPR gRNA sequence
cttgtagagagagaaataat

SEQ ID NO: 324163 - DNA, 20 bp, Artificial
  CRISPR gRNA sequence
gtagagagagaaataatgcc

SEQ ID NO: 324164 - DNA, 20 bp, Artificial
  CRISPR gRNA sequence
tagagagagaaataatgcca

SEQ ID NO: 324165 - DNA, 20 bp, Artificial
  CRISPR gRNA sequence
acggtagaactcaaatacag

SEQ ID NO: 324166 - DNA, 20 bp, Artificial
  CRISPR gRNA sequence
aaatacagaaaggggaactg

SEQ ID NO: 324167 - DNA, 20 bp, Artificial
  CRISPR gRNA sequence
actagagaaacaacaccaca

SEQ ID NO: 324168 - DNA, 20 bp, Artificial
  CRISPR gRNA sequence
gagaaacaacaccacagcca

SEQ ID NO: 324169 - DNA, 20 bp, Artificial
  CRISPR gRNA sequence
ttgcttggttccaaataact

SEQ ID NO: 324170 - DNA, 20 bp, Artificial
  CRISPR gRNA sequence
gcttggttccaaataacttc

SEQ ID NO: 324171 - DNA, 20 bp, Artificial
  CRISPR gRNA sequence
cttggttccaaataacttct

SEQ ID NO: 324172 - DNA, 20 bp, Artificial
  CRISPR gRNA sequence
ggttccaaataacttctgcc

SEQ ID NO: 324173 - DNA, 20 bp, Artificial
  CRISPR gRNA sequence
gttccaaataacttctgccg

SEQ ID NO: 324174 - DNA, 20 bp, Artificial
  CRISPR gRNA sequence
caaataacttctgccggcag

SEQ ID NO: 324175 - DNA, 20 bp, Artificial
  CRISPR gRNA sequence
ctgccggcaggtgggcattt

SEQ ID NO: 324176 - DNA, 20 bp, Artificial
  CRISPR gRNA sequence
tgccggcaggtgggcatttc

SEQ ID NO: 324177 - DNA, 20 bp, Artificial
  CRISPR gRNA sequence
ccggcaggtgggcatttcca

SEQ ID NO: 324178 - DNA, 20 bp, Artificial
  CRISPR gRNA sequence
gatctgttatctgaaatgtc

SEQ ID NO: 324179 - DNA, 20 bp, Artificial
  CRISPR gRNA sequence
atctgttatctgaaatgtcc

SEQ ID NO: 324180 - DNA, 20 bp, Artificial
  CRISPR gRNA sequence
tctgttatctgaaatgtcca

SEQ ID NO: 324181 - DNA, 20 bp, Artificial
  CRISPR gRNA sequence
ctgaaatgtccagggcacca

SEQ ID NO: 324182 - DNA, 20 bp, Artificial
  CRISPR gRNA sequence
gaaatgtccagggcaccata

SEQ ID NO: 324183 - DNA, 20 bp, Artificial
  CRISPR gRNA sequence
atagagtttttattgacact

SEQ ID NO: 324184 - DNA, 20 bp, Artificial
  CRISPR gRNA sequence
tttttattgacactaagtat

SEQ ID NO: 324185 - DNA, 20 bp, Artificial
  CRISPR gRNA sequence
tttattgacactaagtatca

SEQ ID NO: 324186 - DNA, 20 bp, Artificial
  CRISPR gRNA sequence
gtatcagagttcaccctaaa

SEQ ID NO: 324187 - DNA, 20 bp, Artificial
  CRISPR gRNA sequence
agagttcaccctaaaaagcc

SEQ ID NO: 324188 - DNA, 20 bp, Artificial
  CRISPR gRNA sequence
gagttcaccctaaaaagcca

SEQ ID NO: 324189 - DNA, 20 bp, Artificial
  CRISPR gRNA sequence
gttcaccctaaaaagccaag

SEQ ID NO: 324190 - DNA, 20 bp, Artificial
  CRISPR gRNA sequence
ttcaccctaaaaagccaagg

SEQ ID NO: 324191 - DNA, 20 bp, Artificial
  CRISPR gRNA sequence
ccctaaaaagccaaggagga

SEQ ID NO: 324192 - DNA, 20 bp, Artificial
  CRISPR gRNA sequence
cctaaaaagccaaggaggaa

SEQ ID NO: 324193 - DNA, 20 bp, Artificial
  CRISPR gRNA sequence
gataatgtaaaaatacttcc

SEQ ID NO: 324194 - DNA, 20 bp, Artificial
  CRISPR gRNA sequence
aaaatacttcctagcccctg

SEQ ID NO: 324195 - DNA, 20 bp, Artificial
  CRISPR gRNA sequence
cccctgtagaccttacaaaa

SEQ ID NO: 324196 - DNA, 20 bp, Artificial
  CRISPR gRNA sequence
ccttacaaaaaagatcattc

SEQ ID NO: 324197 - DNA, 20 bp, Artificial
  CRISPR gRNA sequence
ttacaaaaaagatcattctg

SEQ ID NO: 324198 - DNA, 20 bp, Artificial
  CRISPR gRNA sequence
ccctgattccttctcttgaa

SEQ ID NO: 324199 - DNA, 20 bp, Artificial
  CRISPR gRNA sequence
tccttctcttgaatggcata

SEQ ID NO: 324200 - DNA, 20 bp, Artificial
  CRISPR gRNA sequence
ttctcttgaatggcatatag

SEQ ID NO: 324201 - DNA, 20 bp, Artificial
  CRISPR gRNA sequence
ggcatatagcagactctata

SEQ ID NO: 324202 - DNA, 20 bp, Artificial
  CRISPR gRNA sequence
aataatgctacatacaatgt

SEQ ID NO: 324203 - DNA, 20 bp, Artificial
  CRISPR gRNA sequence
tttgttttctctttcacact

SEQ ID NO: 324204 - DNA, 20 bp, Artificial
  CRISPR gRNA sequence
tcacactgagccctattctt

SEQ ID NO: 324205 - DNA, 20 bp, Artificial
  CRISPR gRNA sequence
cacactgagccctattcttg

SEQ ID NO: 324206 - DNA, 20 bp, Artificial
  CRISPR gRNA sequence
cctattcttgaggttgaaaa

SEQ ID NO: 324207 - DNA, 20 bp, Artificial
  CRISPR gRNA sequence
ctattcttgaggttgaaaaa

SEQ ID NO: 324208 - DNA, 20 bp, Artificial
  CRISPR gRNA sequence
tcttgaggttgaaaaaagga

SEQ ID NO: 324209 - DNA, 20 bp, Artificial
  CRISPR gRNA sequence
aggttgaaaaaaggaaagtt

SEQ ID NO: 324210 - DNA, 20 bp, Artificial
  CRISPR gRNA sequence
taaataatcaaataaactaa

SEQ ID NO: 324211 - DNA, 20 bp, Artificial
  CRISPR gRNA sequence
aatcaaataaactaaaagtg

SEQ ID NO: 324212 - DNA, 20 bp, Artificial
  CRISPR gRNA sequence
atcaaataaactaaaagtga

SEQ ID NO: 324213 - DNA, 20 bp, Artificial
  CRISPR gRNA sequence
aaataaactaaaagtgaagg

SEQ ID NO: 324214 - DNA, 20 bp, Artificial
  CRISPR gRNA sequence
aaaagtgaaggcagaacttt

SEQ ID NO: 324215 - DNA, 20 bp, Artificial
  CRISPR gRNA sequence
agtgaaggcagaacttttag

SEQ ID NO: 324216 - DNA, 20 bp, Artificial
  CRISPR gRNA sequence
gtgaaggcagaacttttagt

SEQ ID NO: 324217 - DNA, 20 bp, Artificial
  CRISPR gRNA sequence
ttagtaggtatgatcctatc

SEQ ID NO: 324218 - DNA, 20 bp, Artificial
  CRISPR gRNA sequence
tagtaggtatgatcctatct

SEQ ID NO: 324219 - DNA, 20 bp, Artificial
  CRISPR gRNA sequence
agtaggtatgatcctatcta

SEQ ID NO: 324220 - DNA, 20 bp, Artificial
  CRISPR gRNA sequence
tatctagggatacatttttt

SEQ ID NO: 324221 - DNA, 20 bp, Artificial
  CRISPR gRNA sequence
ctagggatacattttttcag

SEQ ID NO: 324222 - DNA, 20 bp, Artificial
  CRISPR gRNA sequence
ttttttcagtggcaaaaaaa

SEQ ID NO: 324223 - DNA, 20 bp, Artificial
  CRISPR gRNA sequence
tcaaatgtttcatcttgtgc

SEQ ID NO: 324224 - DNA, 20 bp, Artificial
  CRISPR gRNA sequence
tttcatcttgtgctggctca

SEQ ID NO: 324225 - DNA, 20 bp, Artificial
  CRISPR gRNA sequence
atcttgtgctggctcaaagt

SEQ ID NO: 324226 - DNA, 20 bp, Artificial
  CRISPR gRNA sequence
gtgctggctcaaagtgagtt

SEQ ID NO: 324227 - DNA, 20 bp, Artificial
  CRISPR gRNA sequence
ggctcaaagtgagttaagtg

SEQ ID NO: 324228 - DNA, 20 bp, Artificial
  CRISPR gRNA sequence
aaagtgagttaagtgcagtt

SEQ ID NO: 324229 - DNA, 20 bp, Artificial
  CRISPR gRNA sequence
agtgagttaagtgcagttaa

SEQ ID NO: 324230 - DNA, 20 bp, Artificial
  CRISPR gRNA sequence
gtgagttaagtgcagttaag

SEQ ID NO: 324231 - DNA, 20 bp, Artificial
  CRISPR gRNA sequence
taagtgcagttaagaggatt

SEQ ID NO: 324232 - DNA, 20 bp, Artificial
  CRISPR gRNA sequence
aagtgcagttaagaggattg

SEQ ID NO: 324233 - DNA, 20 bp, Artificial
  CRISPR gRNA sequence
gttaagaggattgaggaatg

SEQ ID NO: 324234 - DNA, 20 bp, Artificial
  CRISPR gRNA sequence
aggattgaggaatgtagaat

SEQ ID NO: 324235 - DNA, 20 bp, Artificial
  CRISPR gRNA sequence
gaggaatgtagaatgagcac

SEQ ID NO: 324236 - DNA, 20 bp, Artificial
  CRISPR gRNA sequence
aggaatgtagaatgagcaca

SEQ ID NO: 324237 - DNA, 20 bp, Artificial
  CRISPR gRNA sequence
atgtagaatgagcacaagga

SEQ ID NO: 324238 - DNA, 20 bp, Artificial
  CRISPR gRNA sequence
aatgagcacaaggacagttt

SEQ ID NO: 324239 - DNA, 20 bp, Artificial
  CRISPR gRNA sequence
atgagcacaaggacagtttt

SEQ ID NO: 324240 - DNA, 20 bp, Artificial
  CRISPR gRNA sequence
gacagttttgggctacttgc

SEQ ID NO: 324241 - DNA, 20 bp, Artificial
  CRISPR gRNA sequence
ttgctggtttatgccttttc

SEQ ID NO: 324242 - DNA, 20 bp, Artificial
  CRISPR gRNA sequence
gccttttctagaatctcatg

SEQ ID NO: 324243 - DNA, 20 bp, Artificial
  CRISPR gRNA sequence
tagaatctcatgaagtcctt

SEQ ID NO: 324244 - DNA, 20 bp, Artificial
  CRISPR gRNA sequence
aatctcatgaagtcctttag

SEQ ID NO: 324245 - DNA, 20 bp, Artificial
  CRISPR gRNA sequence
tttagcggcatgaatgacat

SEQ ID NO: 324246 - DNA, 20 bp, Artificial
  CRISPR gRNA sequence
agcggcatgaatgacatgag

SEQ ID NO: 324247 - DNA, 20 bp, Artificial
  CRISPR gRNA sequence
atgaatgacatgagcagctt

SEQ ID NO: 324248 - DNA, 20 bp, Artificial
  CRISPR gRNA sequence
cattcatccatttactcatg

SEQ ID NO: 324249 - DNA, 20 bp, Artificial
  CRISPR gRNA sequence
ccatttactcatgtagcatt

SEQ ID NO: 324250 - DNA, 20 bp, Artificial
  CRISPR gRNA sequence
tgtagcattgagcacctgcc

SEQ ID NO: 324251 - DNA, 20 bp, Artificial
  CRISPR gRNA sequence
agcattgagcacctgcctgg

SEQ ID NO: 324252 - DNA, 20 bp, Artificial
  CRISPR gRNA sequence
attgagcacctgcctggtag

SEQ ID NO: 324253 - DNA, 20 bp, Artificial
  CRISPR gRNA sequence
ttgagcacctgcctggtagc

SEQ ID NO: 324254 - DNA, 20 bp, Artificial
  CRISPR gRNA sequence
cctggtagcaggtactgtgc

SEQ ID NO: 324255 - DNA, 20 bp, Artificial
  CRISPR gRNA sequence
gtagcaggtactgtgccaga

SEQ ID NO: 324256 - DNA, 20 bp, Artificial
  CRISPR gRNA sequence
gtgccagatggtgtatgtac

SEQ ID NO: 324257 - DNA, 20 bp, Artificial
  CRISPR gRNA sequence
tgccagatggtgtatgtaca

SEQ ID NO: 324258 - DNA, 20 bp, Artificial
  CRISPR gRNA sequence
gatggtgtatgtacaaggat

SEQ ID NO: 324259 - DNA, 20 bp, Artificial
  CRISPR gRNA sequence
tgtacaaggatgagcaaaac

SEQ ID NO: 324260 - DNA, 20 bp, Artificial
  CRISPR gRNA sequence
gtacaaggatgagcaaaacc

SEQ ID NO: 324261 - DNA, 20 bp, Artificial
  CRISPR gRNA sequence
ccaggtcaacccctgttctt

SEQ ID NO: 324262 - DNA, 20 bp, Artificial
  CRISPR gRNA sequence
ggtcaacccctgttctttgg

SEQ ID NO: 324263 - DNA, 20 bp, Artificial
  CRISPR gRNA sequence
gtcaacccctgttctttgga

SEQ ID NO: 324264 - DNA, 20 bp, Artificial
  CRISPR gRNA sequence
ttctttggaaggtaactgca

SEQ ID NO: 324265 - DNA, 20 bp, Artificial
  CRISPR gRNA sequence
tttggaaggtaactgcatgg

SEQ ID NO: 324266 - DNA, 20 bp, Artificial
  CRISPR gRNA sequence
tggaaggtaactgcatggta

SEQ ID NO: 324267 - DNA, 20 bp, Artificial
  CRISPR gRNA sequence
gaaggtaactgcatggtaga

SEQ ID NO: 324268 - DNA, 20 bp, Artificial
  CRISPR gRNA sequence
aggtaactgcatggtagaga

SEQ ID NO: 324269 - DNA, 20 bp, Artificial
  CRISPR gRNA sequence
ccattgattaatgataatta

SEQ ID NO: 324270 - DNA, 20 bp, Artificial
  CRISPR gRNA sequence
cattgattaatgataattac

SEQ ID NO: 324271 - DNA, 20 bp, Artificial
  CRISPR gRNA sequence
caggcaaaactcaattatat

SEQ ID NO: 324272 - DNA, 20 bp, Artificial
  CRISPR gRNA sequence
aggcaaaactcaattatatg

SEQ ID NO: 324273 - DNA, 20 bp, Artificial
  CRISPR gRNA sequence
ggcaaaactcaattatatga

SEQ ID NO: 324274 - DNA, 20 bp, Artificial
  CRISPR gRNA sequence
attatatgagggaatgtaac

SEQ ID NO: 324275 - DNA, 20 bp, Artificial
  CRISPR gRNA sequence
ttatatgagggaatgtaaca

SEQ ID NO: 324276 - DNA, 20 bp, Artificial
  CRISPR gRNA sequence
atatgagggaatgtaacaag

SEQ ID NO: 324277 - DNA, 20 bp, Artificial
  CRISPR gRNA sequence
aatgtaacaaggagcttgac

SEQ ID NO: 324278 - DNA, 20 bp, Artificial
  CRISPR gRNA sequence
aacaaggagcttgactagac

SEQ ID NO: 324279 - DNA, 20 bp, Artificial
  CRISPR gRNA sequence
acaaggagcttgactagact

SEQ ID NO: 324280 - DNA, 20 bp, Artificial
  CRISPR gRNA sequence
aggagcttgactagactggg

SEQ ID NO: 324281 - DNA, 20 bp, Artificial
  CRISPR gRNA sequence
ggagcttgactagactgggt

SEQ ID NO: 324282 - DNA, 20 bp, Artificial
  CRISPR gRNA sequence
ttgactagactgggtgggtg

SEQ ID NO: 324283 - DNA, 20 bp, Artificial
  CRISPR gRNA sequence
gactagactgggtgggtgtg

SEQ ID NO: 324284 - DNA, 20 bp, Artificial
  CRISPR gRNA sequence
actagactgggtgggtgtgg

SEQ ID NO: 324285 - DNA, 20 bp, Artificial
  CRISPR gRNA sequence
actgggtgggtgtggaggtg

SEQ ID NO: 324286 - DNA, 20 bp, Artificial
  CRISPR gRNA sequence
gtgggtgtggaggtgtagct

SEQ ID NO: 324287 - DNA, 20 bp, Artificial
  CRISPR gRNA sequence
tgggtgtggaggtgtagctg

SEQ ID NO: 324288 - DNA, 20 bp, Artificial
  CRISPR gRNA sequence
ggtgtggaggtgtagctgag

SEQ ID NO: 324289 - DNA, 20 bp, Artificial
  CRISPR gRNA sequence
gtggaggtgtagctgaggag

SEQ ID NO: 324290 - DNA, 20 bp, Artificial
  CRISPR gRNA sequence
tggaggtgtagctgaggagc

SEQ ID NO: 324291 - DNA, 20 bp, Artificial
  CRISPR gRNA sequence
ggaggtgtagctgaggagca

SEQ ID NO: 324292 - DNA, 20 bp, Artificial
  CRISPR gRNA sequence
ctgaggagcagggttcattg

SEQ ID NO: 324293 - DNA, 20 bp, Artificial
  CRISPR gRNA sequence
cattgaagtctttcctgtgc

SEQ ID NO: 324294 - DNA, 20 bp, Artificial
  CRISPR gRNA sequence
tgaagtctttcctgtgcaag

SEQ ID NO: 324295 - DNA, 20 bp, Artificial
  CRISPR gRNA sequence
ttcctgtgcaagtggcactt

SEQ ID NO: 324296 - DNA, 20 bp, Artificial
  CRISPR gRNA sequence
ctgtgcaagtggcacttgag

SEQ ID NO: 324297 - DNA, 20 bp, Artificial
  CRISPR gRNA sequence
gtgcaagtggcacttgagcg

SEQ ID NO: 324298 - DNA, 20 bp, Artificial
  CRISPR gRNA sequence
ggcacttgagcggagatttc

SEQ ID NO: 324299 - DNA, 20 bp, Artificial
  CRISPR gRNA sequence
gcacttgagcggagatttca

SEQ ID NO: 324300 - DNA, 20 bp, Artificial
  CRISPR gRNA sequence
tgagcggagatttcaaggac

SEQ ID NO: 324301 - DNA, 20 bp, Artificial
  CRISPR gRNA sequence
gagcggagatttcaaggaca

SEQ ID NO: 324302 - DNA, 20 bp, Artificial
  CRISPR gRNA sequence
cggagatttcaaggacaagg

SEQ ID NO: 324303 - DNA, 20 bp, Artificial
  CRISPR gRNA sequence
aaggacaaggtagcaatcaa

SEQ ID NO: 324304 - DNA, 20 bp, Artificial
  CRISPR gRNA sequence
aggacaaggtagcaatcaat

SEQ ID NO: 324305 - DNA, 20 bp, Artificial
  CRISPR gRNA sequence
ggacaaggtagcaatcaatg

SEQ ID NO: 324306 - DNA, 20 bp, Artificial
  CRISPR gRNA sequence
acaaggtagcaatcaatggg

SEQ ID NO: 324307 - DNA, 20 bp, Artificial
  CRISPR gRNA sequence
gtagcaatcaatggggagaa

SEQ ID NO: 324308 - DNA, 20 bp, Artificial
  CRISPR gRNA sequence
tcaatggggagaacggtatg

SEQ ID NO: 324309 - DNA, 20 bp, Artificial
  CRISPR gRNA sequence
caatggggagaacggtatga

SEQ ID NO: 324310 - DNA, 20 bp, Artificial
  CRISPR gRNA sequence
tggggagaacggtatgaagg

SEQ ID NO: 324311 - DNA, 20 bp, Artificial
  CRISPR gRNA sequence
ggggagaacggtatgaaggt

SEQ ID NO: 324312 - DNA, 20 bp, Artificial
  CRISPR gRNA sequence
gggagaacggtatgaaggta

SEQ ID NO: 324313 - DNA, 20 bp, Artificial
  CRISPR gRNA sequence
agaacggtatgaaggtaggg

SEQ ID NO: 324314 - DNA, 20 bp, Artificial
  CRISPR gRNA sequence
gggaagaacgttccatacca

SEQ ID NO: 324315 - DNA, 20 bp, Artificial
  CRISPR gRNA sequence
aagaacgttccataccatgg

SEQ ID NO: 324316 - DNA, 20 bp, Artificial
  CRISPR gRNA sequence
agaacgttccataccatgga

SEQ ID NO: 324317 - DNA, 20 bp, Artificial
  CRISPR gRNA sequence
ttccataccatggaaggaac

SEQ ID NO: 324318 - DNA, 20 bp, Artificial
  CRISPR gRNA sequence
ccatggaaggaacaagtgca

SEQ ID NO: 324319 - DNA, 20 bp, Artificial
  CRISPR gRNA sequence
atggaaggaacaagtgcaaa

SEQ ID NO: 324320 - DNA, 20 bp, Artificial
  CRISPR gRNA sequence
gaacaagtgcaaagagcctg

SEQ ID NO: 324321 - DNA, 20 bp, Artificial
  CRISPR gRNA sequence
caagtgcaaagagcctgtgg

SEQ ID NO: 324322 - DNA, 20 bp, Artificial
  CRISPR gRNA sequence
aagtgcaaagagcctgtggc

SEQ ID NO: 324323 - DNA, 20 bp, Artificial
  CRISPR gRNA sequence
tgcaaagagcctgtggcagg

SEQ ID NO: 324324 - DNA, 20 bp, Artificial
  CRISPR gRNA sequence
gcaaagagcctgtggcagga

SEQ ID NO: 324325 - DNA, 20 bp, Artificial
  CRISPR gRNA sequence
agcctgtggcaggaaggaat

SEQ ID NO: 324326 - DNA, 20 bp, Artificial
  CRISPR gRNA sequence
gcctgtggcaggaaggaatg

SEQ ID NO: 324327 - DNA, 20 bp, Artificial
  CRISPR gRNA sequence
gtggcaggaaggaatgaggt

SEQ ID NO: 324328 - DNA, 20 bp, Artificial
  CRISPR gRNA sequence
tggcaggaaggaatgaggta

SEQ ID NO: 324329 - DNA, 20 bp, Artificial
  CRISPR gRNA sequence
aggaaggaatgaggtaaggt

SEQ ID NO: 324330 - DNA, 20 bp, Artificial
  CRISPR gRNA sequence
ggaaggaatgaggtaaggtt

SEQ ID NO: 324331 - DNA, 20 bp, Artificial
  CRISPR gRNA sequence
gaaggaatgaggtaaggtta

SEQ ID NO: 324332 - DNA, 20 bp, Artificial
  CRISPR gRNA sequence
atgaggtaaggttagggaac

SEQ ID NO: 324333 - DNA, 20 bp, Artificial
  CRISPR gRNA sequence
aggtaaggttagggaactag

SEQ ID NO: 324334 - DNA, 20 bp, Artificial
  CRISPR gRNA sequence
aaggttagggaactagaaga

SEQ ID NO: 324335 - DNA, 20 bp, Artificial
  CRISPR gRNA sequence
gttagggaactagaagaaag

SEQ ID NO: 324336 - DNA, 20 bp, Artificial
  CRISPR gRNA sequence
gggaactagaagaaagcaga

SEQ ID NO: 324337 - DNA, 20 bp, Artificial
  CRISPR gRNA sequence
gaaagcagacagatgtgcct

SEQ ID NO: 324338 - DNA, 20 bp, Artificial
  CRISPR gRNA sequence
gacagatgtgcctgagcaca

SEQ ID NO: 324339 - DNA, 20 bp, Artificial
  CRISPR gRNA sequence
cagatgtgcctgagcacaaa

SEQ ID NO: 324340 - DNA, 20 bp, Artificial
  CRISPR gRNA sequence
agatgtgcctgagcacaaag

SEQ ID NO: 324341 - DNA, 20 bp, Artificial
  CRISPR gRNA sequence
gatgtgcctgagcacaaaga

SEQ ID NO: 324342 - DNA, 20 bp, Artificial
  CRISPR gRNA sequence
gtgcctgagcacaaagaggg

SEQ ID NO: 324343 - DNA, 20 bp, Artificial
  CRISPR gRNA sequence
gcctgagcacaaagagggaa

SEQ ID NO: 324344 - DNA, 20 bp, Artificial
  CRISPR gRNA sequence
cctgagcacaaagagggaag

SEQ ID NO: 324345 - DNA, 20 bp, Artificial
  CRISPR gRNA sequence
gcacaaagagggaagaggct

SEQ ID NO: 324346 - DNA, 20 bp, Artificial
  CRISPR gRNA sequence
aagagggaagaggctgagct

SEQ ID NO: 324347 - DNA, 20 bp, Artificial
  CRISPR gRNA sequence
gaagaggctgagcttggtcc

SEQ ID NO: 324348 - DNA, 20 bp, Artificial
  CRISPR gRNA sequence
cttggtccaagatgaccaac

SEQ ID NO: 324349 - DNA, 20 bp, Artificial
  CRISPR gRNA sequence
ccaagatgaccaactggtcc

SEQ ID NO: 324350 - DNA, 20 bp, Artificial
  CRISPR gRNA sequence
gatgaccaactggtccaagt

SEQ ID NO: 324351 - DNA, 20 bp, Artificial
  CRISPR gRNA sequence
caactggtccaagttggtcc

SEQ ID NO: 324352 - DNA, 20 bp, Artificial
  CRISPR gRNA sequence
aactggtccaagttggtcca

SEQ ID NO: 324353 - DNA, 20 bp, Artificial
  CRISPR gRNA sequence
ggtccaagttggtccaaggt

SEQ ID NO: 324354 - DNA, 20 bp, Artificial
  CRISPR gRNA sequence
gtccaagttggtccaaggtg

SEQ ID NO: 324355 - DNA, 20 bp, Artificial
  CRISPR gRNA sequence
aagttggtccaaggtgaggc

SEQ ID NO: 324356 - DNA, 20 bp, Artificial
  CRISPR gRNA sequence
tggtccaaggtgaggctgga

SEQ ID NO: 324357 - DNA, 20 bp, Artificial
  CRISPR gRNA sequence
ggtccaaggtgaggctggaa

SEQ ID NO: 324358 - DNA, 20 bp, Artificial
  CRISPR gRNA sequence
caaggtgaggctggaaagga

SEQ ID NO: 324359 - DNA, 20 bp, Artificial
  CRISPR gRNA sequence
ggtgaggctggaaaggaaag

SEQ ID NO: 324360 - DNA, 20 bp, Artificial
  CRISPR gRNA sequence
tgaggctggaaaggaaagta

SEQ ID NO: 324361 - DNA, 20 bp, Artificial
  CRISPR gRNA sequence
gaggctggaaaggaaagtag

SEQ ID NO: 324362 - DNA, 20 bp, Artificial
  CRISPR gRNA sequence
ctggaaaggaaagtagaggc

SEQ ID NO: 324363 - DNA, 20 bp, Artificial
  CRISPR gRNA sequence
aaagtagaggccagaccatt

SEQ ID NO: 324364 - DNA, 20 bp, Artificial
  CRISPR gRNA sequence
gccagaccattcagaccata

SEQ ID NO: 324365 - DNA, 20 bp, Artificial
  CRISPR gRNA sequence
agaccatatagtctatgttc

SEQ ID NO: 324366 - DNA, 20 bp, Artificial
  CRISPR gRNA sequence
atagtctatgttccagattt

SEQ ID NO: 324367 - DNA, 20 bp, Artificial
  CRISPR gRNA sequence
cagattttggatattcttcc

SEQ ID NO: 324368 - DNA, 20 bp, Artificial
  CRISPR gRNA sequence
ggatattcttccaagaacgt

SEQ ID NO: 324369 - DNA, 20 bp, Artificial
  CRISPR gRNA sequence
aagaacgttggtaccattcg

SEQ ID NO: 324370 - DNA, 20 bp, Artificial
  CRISPR gRNA sequence
aacgttggtaccattcgtgg

SEQ ID NO: 324371 - DNA, 20 bp, Artificial
  CRISPR gRNA sequence
acgttggtaccattcgtgga

SEQ ID NO: 324372 - DNA, 20 bp, Artificial
  CRISPR gRNA sequence
cgttggtaccattcgtggaa

SEQ ID NO: 324373 - DNA, 20 bp, Artificial
  CRISPR gRNA sequence
attgataaaaatcattcaac

SEQ ID NO: 324374 - DNA, 20 bp, Artificial
  CRISPR gRNA sequence
ttgataaaaatcattcaact

SEQ ID NO: 324375 - DNA, 20 bp, Artificial
  CRISPR gRNA sequence
tcaactaggccaaaccaatt

SEQ ID NO: 324376 - DNA, 20 bp, Artificial
  CRISPR gRNA sequence
caactaggccaaaccaattt

SEQ ID NO: 324377 - DNA, 20 bp, Artificial
  CRISPR gRNA sequence
ctaggccaaaccaatttggg

SEQ ID NO: 324378 - DNA, 20 bp, Artificial
  CRISPR gRNA sequence
caaaccaatttgggcagttc

SEQ ID NO: 324379 - DNA, 20 bp, Artificial
  CRISPR gRNA sequence
aatttgggcagttctggttg

SEQ ID NO: 324380 - DNA, 20 bp, Artificial
  CRISPR gRNA sequence
tctggttgtggtattatgct

SEQ ID NO: 324381 - DNA, 20 bp, Artificial
  CRISPR gRNA sequence
ctggttgtggtattatgctc

SEQ ID NO: 324382 - DNA, 20 bp, Artificial
  CRISPR gRNA sequence
ggttgtggtattatgctcag

SEQ ID NO: 324383 - DNA, 20 bp, Artificial
  CRISPR gRNA sequence
tattatgctcaggagaatta

SEQ ID NO: 324384 - DNA, 20 bp, Artificial
  CRISPR gRNA sequence
tatgctcaggagaattaaag

SEQ ID NO: 324385 - DNA, 20 bp, Artificial
  CRISPR gRNA sequence
caggagaattaaagtagcat

SEQ ID NO: 324386 - DNA, 20 bp, Artificial
  CRISPR gRNA sequence
tagcatcggtgtcaattctg

SEQ ID NO: 324387 - DNA, 20 bp, Artificial
  CRISPR gRNA sequence
catcggtgtcaattctgtgg

SEQ ID NO: 324388 - DNA, 20 bp, Artificial
  CRISPR gRNA sequence
atcggtgtcaattctgtgga

SEQ ID NO: 324389 - DNA, 20 bp, Artificial
  CRISPR gRNA sequence
gtgtcaattctgtggaaggt

SEQ ID NO: 324390 - DNA, 20 bp, Artificial
  CRISPR gRNA sequence
attctgtggaaggtgagatc

SEQ ID NO: 324391 - DNA, 20 bp, Artificial
  CRISPR gRNA sequence
tggaaggtgagatccagcct

SEQ ID NO: 324392 - DNA, 20 bp, Artificial
  CRISPR gRNA sequence
ggaaggtgagatccagcctt

SEQ ID NO: 324393 - DNA, 20 bp, Artificial
  CRISPR gRNA sequence
aggtgagatccagccttagg

SEQ ID NO: 324394 - DNA, 20 bp, Artificial
  CRISPR gRNA sequence
ggtgagatccagccttaggt

SEQ ID NO: 324395 - DNA, 20 bp, Artificial
  CRISPR gRNA sequence
gccttaggtaggattgtttt

SEQ ID NO: 324396 - DNA, 20 bp, Artificial
  CRISPR gRNA sequence
gtaggattgttttaagtttc

SEQ ID NO: 324397 - DNA, 20 bp, Artificial
  CRISPR gRNA sequence
ttgttttaagtttccagatt

SEQ ID NO: 324398 - DNA, 20 bp, Artificial
  CRISPR gRNA sequence
ctgacgaataatttgtattc

SEQ ID NO: 324399 - DNA, 20 bp, Artificial
  CRISPR gRNA sequence
ttctggaacaatattcatcg

SEQ ID NO: 324400 - DNA, 20 bp, Artificial
  CRISPR gRNA sequence
caatgttcactctcattata

SEQ ID NO: 324401 - DNA, 20 bp, Artificial
  CRISPR gRNA sequence
gttcactctcattataaaga

SEQ ID NO: 324402 - DNA, 20 bp, Artificial
  CRISPR gRNA sequence
ctcattataaagaaagccat

SEQ ID NO: 324403 - DNA, 20 bp, Artificial
  CRISPR gRNA sequence
ataaagaaagccatgagatg

SEQ ID NO: 324404 - DNA, 20 bp, Artificial
  CRISPR gRNA sequence
atgagatgtggcatgctgtt

SEQ ID NO: 324405 - DNA, 20 bp, Artificial
  CRISPR gRNA sequence
gtggcatgctgtttggcatg

SEQ ID NO: 324406 - DNA, 20 bp, Artificial
  CRISPR gRNA sequence
gtttggcatgtggcaaacct

SEQ ID NO: 324407 - DNA, 20 bp, Artificial
  CRISPR gRNA sequence
tttggcatgtggcaaacctg

SEQ ID NO: 324408 - DNA, 20 bp, Artificial
  CRISPR gRNA sequence
atgtggcaaacctgaggcac

SEQ ID NO: 324409 - DNA, 20 bp, Artificial
  CRISPR gRNA sequence
tggcaaacctgaggcacgag

SEQ ID NO: 324410 - DNA, 20 bp, Artificial
  CRISPR gRNA sequence
ctgaggcacgagtggctaaa

SEQ ID NO: 324411 - DNA, 20 bp, Artificial
  CRISPR gRNA sequence
aatggtaacaataaatctgc

SEQ ID NO: 324412 - DNA, 20 bp, Artificial
  CRISPR gRNA sequence
atctccacaatgcatgtatc

SEQ ID NO: 324413 - DNA, 20 bp, Artificial
  CRISPR gRNA sequence
atccagaaactgccatgtaa

SEQ ID NO: 324414 - DNA, 20 bp, Artificial
  CRISPR gRNA sequence
actgccatgtaaaagctcta

SEQ ID NO: 324415 - DNA, 20 bp, Artificial
  CRISPR gRNA sequence
atgtaaaagctctaaagaaa

SEQ ID NO: 324416 - DNA, 20 bp, Artificial
  CRISPR gRNA sequence
gtaaaagctctaaagaaaaa

SEQ ID NO: 324417 - DNA, 20 bp, Artificial
  CRISPR gRNA sequence
aaagaaaaagagccaaactc

SEQ ID NO: 324418 - DNA, 20 bp, Artificial
  CRISPR gRNA sequence
gagccaaactcaagtaaact

SEQ ID NO: 324419 - DNA, 20 bp, Artificial
  CRISPR gRNA sequence
ttcaatcctcccaatttaca

SEQ ID NO: 324420 - DNA, 20 bp, Artificial
  CRISPR gRNA sequence
tcaatcctcccaatttacat

SEQ ID NO: 324421 - DNA, 20 bp, Artificial
  CRISPR gRNA sequence
ataggctttctcatgccatg

SEQ ID NO: 324422 - DNA, 20 bp, Artificial
  CRISPR gRNA sequence
tttctcatgccatgaagatg

SEQ ID NO: 324423 - DNA, 20 bp, Artificial
  CRISPR gRNA sequence
ttctcatgccatgaagatgt

SEQ ID NO: 324424 - DNA, 20 bp, Artificial
  CRISPR gRNA sequence
gatgtaggcattcttacctt

SEQ ID NO: 324425 - DNA, 20 bp, Artificial
  CRISPR gRNA sequence
taggcattcttacctttagt

SEQ ID NO: 324426 - DNA, 20 bp, Artificial
  CRISPR gRNA sequence
ttacctttagtcagtgtttg

SEQ ID NO: 324427 - DNA, 20 bp, Artificial
  CRISPR gRNA sequence
gtgtttgaagaatttccaac

SEQ ID NO: 324428 - DNA, 20 bp, Artificial
  CRISPR gRNA sequence
tgtttgaagaatttccaacc

SEQ ID NO: 324429 - DNA, 20 bp, Artificial
  CRISPR gRNA sequence
tgaagaatttccaaccagga

SEQ ID NO: 324430 - DNA, 20 bp, Artificial
  CRISPR gRNA sequence
gaagaatttccaaccaggaa

SEQ ID NO: 324431 - DNA, 20 bp, Artificial
  CRISPR gRNA sequence
atttccaaccaggaaaggtt

SEQ ID NO: 324432 - DNA, 20 bp, Artificial
  CRISPR gRNA sequence
aggttaagtgatttgttaca

SEQ ID NO: 324433 - DNA, 20 bp, Artificial
  CRISPR gRNA sequence
ttaagtgatttgttacacag

SEQ ID NO: 324434 - DNA, 20 bp, Artificial
  CRISPR gRNA sequence
gtgatttgttacacagtagt

SEQ ID NO: 324435 - DNA, 20 bp, Artificial
  CRISPR gRNA sequence
atttgttacacagtagttgg

SEQ ID NO: 324436 - DNA, 20 bp, Artificial
  CRISPR gRNA sequence
tgttacacagtagttggtgg

SEQ ID NO: 324437 - DNA, 20 bp, Artificial
  CRISPR gRNA sequence
agtagttggtggcagaacca

SEQ ID NO: 324438 - DNA, 20 bp, Artificial
  CRISPR gRNA sequence
gttggtggcagaaccaaagt

SEQ ID NO: 324439 - DNA, 20 bp, Artificial
  CRISPR gRNA sequence
attctttctaaactgtgttg

SEQ ID NO: 324440 - DNA, 20 bp, Artificial
  CRISPR gRNA sequence
ctttctaaactgtgttgaag

SEQ ID NO: 324441 - DNA, 20 bp, Artificial
  CRISPR gRNA sequence
tctaaactgtgttgaagtag

SEQ ID NO: 324442 - DNA, 20 bp, Artificial
  CRISPR gRNA sequence
taaactgtgttgaagtagtg

SEQ ID NO: 324443 - DNA, 20 bp, Artificial
  CRISPR gRNA sequence
aaactgtgttgaagtagtgg

SEQ ID NO: 324444 - DNA, 20 bp, Artificial
  CRISPR gRNA sequence
ggaggtgtaacataaatcta

SEQ ID NO: 324445 - DNA, 20 bp, Artificial
  CRISPR gRNA sequence
gaggtgtaacataaatctaa

SEQ ID NO: 324446 - DNA, 20 bp, Artificial
  CRISPR gRNA sequence
ttctgatcacctttgttatt

SEQ ID NO: 324447 - DNA, 20 bp, Artificial
  CRISPR gRNA sequence
ttgttatttggttgtgaatt

SEQ ID NO: 324448 - DNA, 20 bp, Artificial
  CRISPR gRNA sequence
ttatttggttgtgaattaag

SEQ ID NO: 324449 - DNA, 20 bp, Artificial
  CRISPR gRNA sequence
tatttggttgtgaattaaga

SEQ ID NO: 324450 - DNA, 20 bp, Artificial
  CRISPR gRNA sequence
tggttgtgaattaagaagga

SEQ ID NO: 324451 - DNA, 20 bp, Artificial
  CRISPR gRNA sequence
ggttgtgaattaagaaggat

SEQ ID NO: 324452 - DNA, 20 bp, Artificial
  CRISPR gRNA sequence
atgggaatcttgctgatttc

SEQ ID NO: 324453 - DNA, 20 bp, Artificial
  CRISPR gRNA sequence
tgctgatttctagtctttga

SEQ ID NO: 324454 - DNA, 20 bp, Artificial
  CRISPR gRNA sequence
gtctttgatggatctcaatg

SEQ ID NO: 324455 - DNA, 20 bp, Artificial
  CRISPR gRNA sequence
tctcaatgtagaatttaaca

SEQ ID NO: 324456 - DNA, 20 bp, Artificial
  CRISPR gRNA sequence
ttgtttttttttaatgaact

SEQ ID NO: 324457 - DNA, 20 bp, Artificial
  CRISPR gRNA sequence
gtttttttttaatgaacttg

SEQ ID NO: 324458 - DNA, 20 bp, Artificial
  CRISPR gRNA sequence
ttttaatgaacttggagcaa

SEQ ID NO: 324459 - DNA, 20 bp, Artificial
  CRISPR gRNA sequence
tttaatgaacttggagcaat

SEQ ID NO: 324460 - DNA, 20 bp, Artificial
  CRISPR gRNA sequence
gaatgtctaactacattttg

SEQ ID NO: 324461 - DNA, 20 bp, Artificial
  CRISPR gRNA sequence
cattttgaagaccctctttg

SEQ ID NO: 324462 - DNA, 20 bp, Artificial
  CRISPR gRNA sequence
gaccctctttgtagacctta

SEQ ID NO: 324463 - DNA, 20 bp, Artificial
  CRISPR gRNA sequence
accctctttgtagaccttat

SEQ ID NO: 324464 - DNA, 20 bp, Artificial
  CRISPR gRNA sequence
tttgtagaccttataggcaa

SEQ ID NO: 324465 - DNA, 20 bp, Artificial
  CRISPR gRNA sequence
ttgtagaccttataggcaac

SEQ ID NO: 324466 - DNA, 20 bp, Artificial
  CRISPR gRNA sequence
tgtagaccttataggcaaca

SEQ ID NO: 324467 - DNA, 20 bp, Artificial
  CRISPR gRNA sequence
ataggcaacagggaccatat

SEQ ID NO: 324468 - DNA, 20 bp, Artificial
  CRISPR gRNA sequence
aacagggaccatatgagtga

SEQ ID NO: 324469 - DNA, 20 bp, Artificial
  CRISPR gRNA sequence
acagggaccatatgagtgat

SEQ ID NO: 324470 - DNA, 20 bp, Artificial
  CRISPR gRNA sequence
atgagtgatgggacaaattc

SEQ ID NO: 324471 - DNA, 20 bp, Artificial
  CRISPR gRNA sequence
gatgggacaaattctggttt

SEQ ID NO: 324472 - DNA, 20 bp, Artificial
  CRISPR gRNA sequence
ggacaaattctggttttaga

SEQ ID NO: 324473 - DNA, 20 bp, Artificial
  CRISPR gRNA sequence
ttttagaaagactactttaa

SEQ ID NO: 324474 - DNA, 20 bp, Artificial
  CRISPR gRNA sequence
tagaaagactactttaaaag

SEQ ID NO: 324475 - DNA, 20 bp, Artificial
  CRISPR gRNA sequence
agactactttaaaagcagtg

SEQ ID NO: 324476 - DNA, 20 bp, Artificial
  CRISPR gRNA sequence
aagcagtgtggataatacac

SEQ ID NO: 324477 - DNA, 20 bp, Artificial
  CRISPR gRNA sequence
gtgtggataatacaccagat

SEQ ID NO: 324478 - DNA, 20 bp, Artificial
  CRISPR gRNA sequence
tgtggataatacaccagatt

SEQ ID NO: 324479 - DNA, 20 bp, Artificial
  CRISPR gRNA sequence
ggataatacaccagattggg

SEQ ID NO: 324480 - DNA, 20 bp, Artificial
  CRISPR gRNA sequence
gataatacaccagattggga

SEQ ID NO: 324481 - DNA, 20 bp, Artificial
  CRISPR gRNA sequence
ataatacaccagattgggaa

SEQ ID NO: 324482 - DNA, 20 bp, Artificial
  CRISPR gRNA sequence
accagattgggaagggctga

SEQ ID NO: 324483 - DNA, 20 bp, Artificial
  CRISPR gRNA sequence
agattgggaagggctgatgg

SEQ ID NO: 324484 - DNA, 20 bp, Artificial
  CRISPR gRNA sequence
attgggaagggctgatggca

SEQ ID NO: 324485 - DNA, 20 bp, Artificial
  CRISPR gRNA sequence
ttgggaagggctgatggcag

SEQ ID NO: 324486 - DNA, 20 bp, Artificial
  CRISPR gRNA sequence
tgggaagggctgatggcaga

SEQ ID NO: 324487 - DNA, 20 bp, Artificial
  CRISPR gRNA sequence
tgtattatgatgtgttctgt

SEQ ID NO: 324488 - DNA, 20 bp, Artificial
  CRISPR gRNA sequence
gtattatgatgtgttctgtg

SEQ ID NO: 324489 - DNA, 20 bp, Artificial
  CRISPR gRNA sequence
ttatgatgtgttctgtgagg

SEQ ID NO: 324490 - DNA, 20 bp, Artificial
  CRISPR gRNA sequence
gatgtgttctgtgaggaagc

SEQ ID NO: 324491 - DNA, 20 bp, Artificial
  CRISPR gRNA sequence
atgtgttctgtgaggaagct

SEQ ID NO: 324492 - DNA, 20 bp, Artificial
  CRISPR gRNA sequence
gtgttctgtgaggaagctgg

SEQ ID NO: 324493 - DNA, 20 bp, Artificial
  CRISPR gRNA sequence
tgttctgtgaggaagctggg

SEQ ID NO: 324494 - DNA, 20 bp, Artificial
  CRISPR gRNA sequence
ctgtgaggaagctgggagga

SEQ ID NO: 324495 - DNA, 20 bp, Artificial
  CRISPR gRNA sequence
aagctgggaggatagccctc

SEQ ID NO: 324496 - DNA, 20 bp, Artificial
  CRISPR gRNA sequence
agctgggaggatagccctca

SEQ ID NO: 324497 - DNA, 20 bp, Artificial
  CRISPR gRNA sequence
atagccctcaaggccacttt

SEQ ID NO: 324498 - DNA, 20 bp, Artificial
  CRISPR gRNA sequence
ttgagccttcctttgtcact

SEQ ID NO: 324499 - DNA, 20 bp, Artificial
  CRISPR gRNA sequence
tgagccttcctttgtcactg

SEQ ID NO: 324500 - DNA, 20 bp, Artificial
  CRISPR gRNA sequence
ttgtcactgaggcattccat

SEQ ID NO: 324501 - DNA, 20 bp, Artificial
  CRISPR gRNA sequence
agtgactcctgaattccact

SEQ ID NO: 324502 - DNA, 20 bp, Artificial
  CRISPR gRNA sequence
gtgactcctgaattccactt

SEQ ID NO: 324503 - DNA, 20 bp, Artificial
  CRISPR gRNA sequence
tcctgaattccacttgggaa

SEQ ID NO: 324504 - DNA, 20 bp, Artificial
  CRISPR gRNA sequence
ctgaattccacttgggaaaa

SEQ ID NO: 324505 - DNA, 20 bp, Artificial
  CRISPR gRNA sequence
cacttgggaaaagagcccct

SEQ ID NO: 324506 - DNA, 20 bp, Artificial
  CRISPR gRNA sequence
aaagagcccctcagtgtctc

SEQ ID NO: 324507 - DNA, 20 bp, Artificial
  CRISPR gRNA sequence
cctcagtgtctccagcgtct

SEQ ID NO: 324508 - DNA, 20 bp, Artificial
  CRISPR gRNA sequence
tcagtgtctccagcgtctga

SEQ ID NO: 324509 - DNA, 20 bp, Artificial
  CRISPR gRNA sequence
gtgtctccagcgtctgagag

SEQ ID NO: 324510 - DNA, 20 bp, Artificial
  CRISPR gRNA sequence
gcgtctgagagaagtctgtg

SEQ ID NO: 324511 - DNA, 20 bp, Artificial
  CRISPR gRNA sequence
tctgtgaagatgactgacct

SEQ ID NO: 324512 - DNA, 20 bp, Artificial
  CRISPR gRNA sequence
tgtgaagatgactgaccttg

SEQ ID NO: 324513 - DNA, 20 bp, Artificial
  CRISPR gRNA sequence
actgaccttggagcccctct

SEQ ID NO: 324514 - DNA, 20 bp, Artificial
  CRISPR gRNA sequence
ctcttagcctctccacgact

SEQ ID NO: 324515 - DNA, 20 bp, Artificial
  CRISPR gRNA sequence
gagtaaatgtcatctcctga

SEQ ID NO: 324516 - DNA, 20 bp, Artificial
  CRISPR gRNA sequence
ctcctgacagcacccccttc

SEQ ID NO: 324517 - DNA, 20 bp, Artificial
  CRISPR gRNA sequence
cctgacagcacccccttcca

SEQ ID NO: 324518 - DNA, 20 bp, Artificial
  CRISPR gRNA sequence
cccttccagagtgttcttgt

SEQ ID NO: 324519 - DNA, 20 bp, Artificial
  CRISPR gRNA sequence
gttagatttaacaaaaatcc

SEQ ID NO: 324520 - DNA, 20 bp, Artificial
  CRISPR gRNA sequence
ttgtcaattttttcttttga

SEQ ID NO: 324521 - DNA, 20 bp, Artificial
  CRISPR gRNA sequence
tttcttttgatagatgaatt

SEQ ID NO: 324522 - DNA, 20 bp, Artificial
  CRISPR gRNA sequence
ttcttttgatagatgaattc

SEQ ID NO: 324523 - DNA, 20 bp, Artificial
  CRISPR gRNA sequence
agatgaattcaggccattcc

SEQ ID NO: 324524 - DNA, 20 bp, Artificial
  CRISPR gRNA sequence
gaattcaggccattcccagt

SEQ ID NO: 324525 - DNA, 20 bp, Artificial
  CRISPR gRNA sequence
aggccattcccagtcagcat

SEQ ID NO: 324526 - DNA, 20 bp, Artificial
  CRISPR gRNA sequence
tttttctcttttatttttgt

SEQ ID NO: 324527 - DNA, 20 bp, Artificial
  CRISPR gRNA sequence
ttgactctcctctttgcctc

SEQ ID NO: 324528 - DNA, 20 bp, Artificial
  CRISPR gRNA sequence
ctctttgcctccggttaatt

SEQ ID NO: 324529 - DNA, 20 bp, Artificial
  CRISPR gRNA sequence
tttgcctccggttaatttgg

SEQ ID NO: 324530 - DNA, 20 bp, Artificial
  CRISPR gRNA sequence
ttgcctccggttaatttgga

SEQ ID NO: 324531 - DNA, 20 bp, Artificial
  CRISPR gRNA sequence
ttaatttggaaggtcgacta

SEQ ID NO: 324532 - DNA, 20 bp, Artificial
  CRISPR gRNA sequence
actacagttcttaatttact

SEQ ID NO: 324533 - DNA, 20 bp, Artificial
  CRISPR gRNA sequence
ctaagtaattgacatgttca

SEQ ID NO: 324534 - DNA, 20 bp, Artificial
  CRISPR gRNA sequence
atgcctttgtctgatgtgcc

SEQ ID NO: 324535 - DNA, 20 bp, Artificial
  CRISPR gRNA sequence
cccatcccctgcactgatat

SEQ ID NO: 324536 - DNA, 20 bp, Artificial
  CRISPR gRNA sequence
ctgcactgatatgagaactt

SEQ ID NO: 324537 - DNA, 20 bp, Artificial
  CRISPR gRNA sequence
tcccactctcacacttcccc

SEQ ID NO: 324538 - DNA, 20 bp, Artificial
  CRISPR gRNA sequence
actctcacacttcccccaga

SEQ ID NO: 324539 - DNA, 20 bp, Artificial
  CRISPR gRNA sequence
agtgcaccctgctccatacg

SEQ ID NO: 324540 - DNA, 20 bp, Artificial
  CRISPR gRNA sequence
gtgcaccctgctccatacgt

SEQ ID NO: 324541 - DNA, 20 bp, Artificial
  CRISPR gRNA sequence
tgctccatacgtgggttttg

SEQ ID NO: 324542 - DNA, 20 bp, Artificial
  CRISPR gRNA sequence
tggaaataatttaaaactta

SEQ ID NO: 324543 - DNA, 20 bp, Artificial
  CRISPR gRNA sequence
taatttaaaacttacagttg

SEQ ID NO: 324544 - DNA, 20 bp, Artificial
  CRISPR gRNA sequence
ttacagttgcagatcattgc

SEQ ID NO: 324545 - DNA, 20 bp, Artificial
  CRISPR gRNA sequence
tacagttgcagatcattgct

SEQ ID NO: 324546 - DNA, 20 bp, Artificial
  CRISPR gRNA sequence
cattgctaggtttcctctta

SEQ ID NO: 324547 - DNA, 20 bp, Artificial
  CRISPR gRNA sequence
cagtatttctcttctgtttc

SEQ ID NO: 324548 - DNA, 20 bp, Artificial
  CRISPR gRNA sequence
gttcaatgacaacatcattc

SEQ ID NO: 324549 - DNA, 20 bp, Artificial
  CRISPR gRNA sequence
ctctgttctaatctaatgat

SEQ ID NO: 324550 - DNA, 20 bp, Artificial
  CRISPR gRNA sequence
tgttctaatctaatgatcag

SEQ ID NO: 324551 - DNA, 20 bp, Artificial
  CRISPR gRNA sequence
acccccaactctctgaattc

SEQ ID NO: 324552 - DNA, 20 bp, Artificial
  CRISPR gRNA sequence
caactctctgaattccagta

SEQ ID NO: 324553 - DNA, 20 bp, Artificial
  CRISPR gRNA sequence
aactctctgaattccagtac

SEQ ID NO: 324554 - DNA, 20 bp, Artificial
  CRISPR gRNA sequence
ctctgaattccagtacaggt

SEQ ID NO: 324555 - DNA, 20 bp, Artificial
  CRISPR gRNA sequence
tctgaattccagtacaggta

SEQ ID NO: 324556 - DNA, 20 bp, Artificial
  CRISPR gRNA sequence
ctgaattccagtacaggtaa

SEQ ID NO: 324557 - DNA, 20 bp, Artificial
  CRISPR gRNA sequence
tgtcttccttttaccttgat

SEQ ID NO: 324558 - DNA, 20 bp, Artificial
  CRISPR gRNA sequence
tgagtgactgatatctttcc

SEQ ID NO: 324559 - DNA, 20 bp, Artificial
  CRISPR gRNA sequence
gagtgactgatatctttcct

SEQ ID NO: 324560 - DNA, 20 bp, Artificial
  CRISPR gRNA sequence
actgatatctttcctgggaa

SEQ ID NO: 324561 - DNA, 20 bp, Artificial
  CRISPR gRNA sequence
ctgatatctttcctgggaat

SEQ ID NO: 324562 - DNA, 20 bp, Artificial
  CRISPR gRNA sequence
gatatctttcctgggaatag

SEQ ID NO: 324563 - DNA, 20 bp, Artificial
  CRISPR gRNA sequence
tttcctgggaataggagtcc

SEQ ID NO: 324564 - DNA, 20 bp, Artificial
  CRISPR gRNA sequence
ctgggaataggagtcctgga

SEQ ID NO: 324565 - DNA, 20 bp, Artificial
  CRISPR gRNA sequence
ggaataggagtcctggatgg

SEQ ID NO: 324566 - DNA, 20 bp, Artificial
  CRISPR gRNA sequence
tggatggcagcctttcttct

SEQ ID NO: 324567 - DNA, 20 bp, Artificial
  CRISPR gRNA sequence
atggcagcctttcttcttag

SEQ ID NO: 324568 - DNA, 20 bp, Artificial
  CRISPR gRNA sequence
gcctttcttcttagtggttg

SEQ ID NO: 324569 - DNA, 20 bp, Artificial
  CRISPR gRNA sequence
gatattcctccactgtctgc

SEQ ID NO: 324570 - DNA, 20 bp, Artificial
  CRISPR gRNA sequence
ctccactgtctgctggcttc

SEQ ID NO: 324571 - DNA, 20 bp, Artificial
  CRISPR gRNA sequence
tccactgtctgctggcttct

SEQ ID NO: 324572 - DNA, 20 bp, Artificial
  CRISPR gRNA sequence
ccactgtctgctggcttcta

SEQ ID NO: 324573 - DNA, 20 bp, Artificial
  CRISPR gRNA sequence
tctgctggcttctagggttg

SEQ ID NO: 324574 - DNA, 20 bp, Artificial
  CRISPR gRNA sequence
ctgctggcttctagggttgt

SEQ ID NO: 324575 - DNA, 20 bp, Artificial
  CRISPR gRNA sequence
ggcttctagggttgtgggtg

SEQ ID NO: 324576 - DNA, 20 bp, Artificial
  CRISPR gRNA sequence
cttctagggttgtgggtgaa

SEQ ID NO: 324577 - DNA, 20 bp, Artificial
  CRISPR gRNA sequence
gttgtgggtgaagagtttga

SEQ ID NO: 324578 - DNA, 20 bp, Artificial
  CRISPR gRNA sequence
gtgggtgaagagtttgatgg

SEQ ID NO: 324579 - DNA, 20 bp, Artificial
  CRISPR gRNA sequence
tgtaaaaaaaaaaaaaactc

SEQ ID NO: 324580 - DNA, 20 bp, Artificial
  CRISPR gRNA sequence
ctagaatttcataatcttga

SEQ ID NO: 324581 - DNA, 20 bp, Artificial
  CRISPR gRNA sequence
atcttgaaagctatttactt

SEQ ID NO: 324582 - DNA, 20 bp, Artificial
  CRISPR gRNA sequence
aaagctatttacttcagtat

SEQ ID NO: 324583 - DNA, 20 bp, Artificial
  CRISPR gRNA sequence
tttacttcagtattggaatt

SEQ ID NO: 324584 - DNA, 20 bp, Artificial
  CRISPR gRNA sequence
ttacttcagtattggaattc

SEQ ID NO: 324585 - DNA, 20 bp, Artificial
  CRISPR gRNA sequence
ttggaattcaggaattcctc

SEQ ID NO: 324586 - DNA, 20 bp, Artificial
  CRISPR gRNA sequence
tggaattcaggaattcctcc

SEQ ID NO: 324587 - DNA, 20 bp, Artificial
  CRISPR gRNA sequence
tttctattaatttttttttt

SEQ ID NO: 324588 - DNA, 20 bp, Artificial
  CRISPR gRNA sequence
ttctattaattttttttttg

SEQ ID NO: 324589 - DNA, 20 bp, Artificial
  CRISPR gRNA sequence
tattaattttttttttgagg

SEQ ID NO: 324590 - DNA, 20 bp, Artificial
  CRISPR gRNA sequence
ttaattttttttttgaggcg

SEQ ID NO: 324591 - DNA, 20 bp, Artificial
  CRISPR gRNA sequence
cggagtctcactctgtcgcc

SEQ ID NO: 324592 - DNA, 20 bp, Artificial
  CRISPR gRNA sequence
ggagtctcactctgtcgccc

SEQ ID NO: 324593 - DNA, 20 bp, Artificial
  CRISPR gRNA sequence
tctcactctgtcgcccaggc

SEQ ID NO: 324594 - DNA, 20 bp, Artificial
  CRISPR gRNA sequence
tcactctgtcgcccaggctg

SEQ ID NO: 324595 - DNA, 20 bp, Artificial
  CRISPR gRNA sequence
ctgtcgcccaggctggagtg

SEQ ID NO: 324596 - DNA, 20 bp, Artificial
  CRISPR gRNA sequence
tcgcccaggctggagtgcag

SEQ ID NO: 324597 - DNA, 20 bp, Artificial
  CRISPR gRNA sequence
ggagtgcagtggcgcaatct

SEQ ID NO: 324598 - DNA, 20 bp, Artificial
  CRISPR gRNA sequence
ttactgcaacctccacctcc

SEQ ID NO: 324599 - DNA, 20 bp, Artificial
  CRISPR gRNA sequence
tactgcaacctccacctccc

SEQ ID NO: 324600 - DNA, 20 bp, Artificial
  CRISPR gRNA sequence
aacctccacctcccgggttg

SEQ ID NO: 324601 - DNA, 20 bp, Artificial
  CRISPR gRNA sequence
ttgaagcgattctcctgcct

SEQ ID NO: 324602 - DNA, 20 bp, Artificial
  CRISPR gRNA sequence
ttctcctgcctcagcctccc

SEQ ID NO: 324603 - DNA, 20 bp, Artificial
  CRISPR gRNA sequence
tcctgcctcagcctcccaag

SEQ ID NO: 324604 - DNA, 20 bp, Artificial
  CRISPR gRNA sequence
cctgcctcagcctcccaagt

SEQ ID NO: 324605 - DNA, 20 bp, Artificial
  CRISPR gRNA sequence
cctcagcctcccaagtaggt

SEQ ID NO: 324606 - DNA, 20 bp, Artificial
  CRISPR gRNA sequence
ctcccaagtaggtgagacta

SEQ ID NO: 324607 - DNA, 20 bp, Artificial
  CRISPR gRNA sequence
tcccaagtaggtgagactac

SEQ ID NO: 324608 - DNA, 20 bp, Artificial
  CRISPR gRNA sequence
caggcacccgccaccacgcc

SEQ ID NO: 324609 - DNA, 20 bp, Artificial
  CRISPR gRNA sequence
taatttttttgtatttttcg

SEQ ID NO: 324610 - DNA, 20 bp, Artificial
  CRISPR gRNA sequence
atttttttgtatttttcgta

SEQ ID NO: 324611 - DNA, 20 bp, Artificial
  CRISPR gRNA sequence
ttttgtatttttcgtagaga

SEQ ID NO: 324612 - DNA, 20 bp, Artificial
  CRISPR gRNA sequence
tttgtatttttcgtagagac

SEQ ID NO: 324613 - DNA, 20 bp, Artificial
  CRISPR gRNA sequence
ttgtatttttcgtagagacg

SEQ ID NO: 324614 - DNA, 20 bp, Artificial
  CRISPR gRNA sequence
gagacggggtttcaccgtgt

SEQ ID NO: 324615 - DNA, 20 bp, Artificial
  CRISPR gRNA sequence
cggggtttcaccgtgttagc

SEQ ID NO: 324616 - DNA, 20 bp, Artificial
  CRISPR gRNA sequence
ggggtttcaccgtgttagcc

SEQ ID NO: 324617 - DNA, 20 bp, Artificial
  CRISPR gRNA sequence
tttcaccgtgttagccagga

SEQ ID NO: 324618 - DNA, 20 bp, Artificial
  CRISPR gRNA sequence
gcctccgcctccgcctccca

SEQ ID NO: 324619 - DNA, 20 bp, Artificial
  CRISPR gRNA sequence
gcctccgcctcccaaagtgc

SEQ ID NO: 324620 - DNA, 20 bp, Artificial
  CRISPR gRNA sequence
cctccgcctcccaaagtgct

SEQ ID NO: 324621 - DNA, 20 bp, Artificial
  CRISPR gRNA sequence
ctcccaaagtgctgggatta

SEQ ID NO: 324622 - DNA, 20 bp, Artificial
  CRISPR gRNA sequence
tcccaaagtgctgggattac

SEQ ID NO: 324623 - DNA, 20 bp, Artificial
  CRISPR gRNA sequence
agtgctgggattacaggcgt

SEQ ID NO: 324624 - DNA, 20 bp, Artificial
  CRISPR gRNA sequence
aatttattattatttttttt

SEQ ID NO: 324625 - DNA, 20 bp, Artificial
  CRISPR gRNA sequence
attattattttttttaagac

SEQ ID NO: 324626 - DNA, 20 bp, Artificial
  CRISPR gRNA sequence
ttattattttttttaagact

SEQ ID NO: 324627 - DNA, 20 bp, Artificial
  CRISPR gRNA sequence
ttttttttaagactgggtga

SEQ ID NO: 324628 - DNA, 20 bp, Artificial
  CRISPR gRNA sequence
gggtgaaagttttcaatctc

SEQ ID NO: 324629 - DNA, 20 bp, Artificial
  CRISPR gRNA sequence
agttttcaatctctagactc

SEQ ID NO: 324630 - DNA, 20 bp, Artificial
  CRISPR gRNA sequence
tcaagctttattcttcattt

SEQ ID NO: 324631 - DNA, 20 bp, Artificial
  CRISPR gRNA sequence
catttcagtcatttttttcc

SEQ ID NO: 324632 - DNA, 20 bp, Artificial
  CRISPR gRNA sequence
ctgtttttccccactctttc

SEQ ID NO: 324633 - DNA, 20 bp, Artificial
  CRISPR gRNA sequence
aatgtctcttattcttatgt

SEQ ID NO: 324634 - DNA, 20 bp, Artificial
  CRISPR gRNA sequence
ttattcttatgtaagatctt

SEQ ID NO: 324635 - DNA, 20 bp, Artificial
  CRISPR gRNA sequence
ttcatcatttgtgaacaaaa

SEQ ID NO: 324636 - DNA, 20 bp, Artificial
  CRISPR gRNA sequence
cttgttaaccacaactcctt

SEQ ID NO: 324637 - DNA, 20 bp, Artificial
  CRISPR gRNA sequence
cacaactccttcagatgaaa

SEQ ID NO: 324638 - DNA, 20 bp, Artificial
  CRISPR gRNA sequence
ttcagatgaaatggatattt

SEQ ID NO: 324639 - DNA, 20 bp, Artificial
  CRISPR gRNA sequence
gaaatggatatttcagtttt

SEQ ID NO: 324640 - DNA, 20 bp, Artificial
  CRISPR gRNA sequence
atatttcagttttaagttac

SEQ ID NO: 324641 - DNA, 20 bp, Artificial
  CRISPR gRNA sequence
tttcagttttaagttactag

SEQ ID NO: 324642 - DNA, 20 bp, Artificial
  CRISPR gRNA sequence
agtagcatattcccatttct

SEQ ID NO: 324643 - DNA, 20 bp, Artificial
  CRISPR gRNA sequence
agcatattcccatttcttgg

SEQ ID NO: 324644 - DNA, 20 bp, Artificial
  CRISPR gRNA sequence
ttcttggtagaaacaaaatg

SEQ ID NO: 324645 - DNA, 20 bp, Artificial
  CRISPR gRNA sequence
tcttggtagaaacaaaatgc

SEQ ID NO: 324646 - DNA, 20 bp, Artificial
  CRISPR gRNA sequence
agaaacaaaatgcaggcatg

SEQ ID NO: 324647 - DNA, 20 bp, Artificial
  CRISPR gRNA sequence
gaaacaaaatgcaggcatgt

SEQ ID NO: 324648 - DNA, 20 bp, Artificial
  CRISPR gRNA sequence
aaacaaaatgcaggcatgta

SEQ ID NO: 324649 - DNA, 20 bp, Artificial
  CRISPR gRNA sequence
aacaaaatgcaggcatgtag

SEQ ID NO: 324650 - DNA, 20 bp, Artificial
  CRISPR gRNA sequence
acaaaatgcaggcatgtagg

SEQ ID NO: 324651 - DNA, 20 bp, Artificial
  CRISPR gRNA sequence
caaaatgcaggcatgtaggg

SEQ ID NO: 324652 - DNA, 20 bp, Artificial
  CRISPR gRNA sequence
ttcttatatttactcactgt

SEQ ID NO: 324653 - DNA, 20 bp, Artificial
  CRISPR gRNA sequence
tttactcactgtaagattca

SEQ ID NO: 324654 - DNA, 20 bp, Artificial
  CRISPR gRNA sequence
gtaagattcatagcattatt

SEQ ID NO: 324655 - DNA, 20 bp, Artificial
  CRISPR gRNA sequence
tggcttaaaaaaattcatcc

SEQ ID NO: 324656 - DNA, 20 bp, Artificial
  CRISPR gRNA sequence
aaaattcatcccagtattca

SEQ ID NO: 324657 - DNA, 20 bp, Artificial
  CRISPR gRNA sequence
ccagtattcacagttgtaaa

SEQ ID NO: 324658 - DNA, 20 bp, Artificial
  CRISPR gRNA sequence
atatactgcttccctactct

SEQ ID NO: 324659 - DNA, 20 bp, Artificial
  CRISPR gRNA sequence
ttccctactctaagaatatt

SEQ ID NO: 324660 - DNA, 20 bp, Artificial
  CRISPR gRNA sequence
ttatatgcaaaatgacttac

SEQ ID NO: 324661 - DNA, 20 bp, Artificial
  CRISPR gRNA sequence
tatatgcaaaatgacttact

SEQ ID NO: 324662 - DNA, 20 bp, Artificial
  CRISPR gRNA sequence
ctttgcaaatttttaaaaat

SEQ ID NO: 324663 - DNA, 20 bp, Artificial
  CRISPR gRNA sequence
atgagttttaaaatcatttg

SEQ ID NO: 324664 - DNA, 20 bp, Artificial
  CRISPR gRNA sequence
tttgtagcttgcaataactg

SEQ ID NO: 324665 - DNA, 20 bp, Artificial
  CRISPR gRNA sequence
agcttgcaataactgaagaa

SEQ ID NO: 324666 - DNA, 20 bp, Artificial
  CRISPR gRNA sequence
gatcacaatttctctgtaaa

SEQ ID NO: 324667 - DNA, 20 bp, Artificial
  CRISPR gRNA sequence
tttctctgtaaatggcatct

SEQ ID NO: 324668 - DNA, 20 bp, Artificial
  CRISPR gRNA sequence
ctactgctgttctaataaac

SEQ ID NO: 324669 - DNA, 20 bp, Artificial
  CRISPR gRNA sequence
tactgctgttctaataaact

SEQ ID NO: 324670 - DNA, 20 bp, Artificial
  CRISPR gRNA sequence
aataaactaggtctgtcaaa

SEQ ID NO: 324671 - DNA, 20 bp, Artificial
  CRISPR gRNA sequence
gtctgtcaaatggcactttt

SEQ ID NO: 324672 - DNA, 20 bp, Artificial
  CRISPR gRNA sequence
tggcactttttggtcattca

SEQ ID NO: 324673 - DNA, 20 bp, Artificial
  CRISPR gRNA sequence
cattcaaagtgaaaaaaaca

SEQ ID NO: 324674 - DNA, 20 bp, Artificial
  CRISPR gRNA sequence
aaaaattcacaattatattt

SEQ ID NO: 324675 - DNA, 20 bp, Artificial
  CRISPR gRNA sequence
attcacaattatattttgga

SEQ ID NO: 324676 - DNA, 20 bp, Artificial
  CRISPR gRNA sequence
cacaattatattttggaaag

SEQ ID NO: 324677 - DNA, 20 bp, Artificial
  CRISPR gRNA sequence
tattttggaaagtggaactt

SEQ ID NO: 324678 - DNA, 20 bp, Artificial
  CRISPR gRNA sequence
gaaagtggaacttaagtatg

SEQ ID NO: 324679 - DNA, 20 bp, Artificial
  CRISPR gRNA sequence
aaagtggaacttaagtatgt

SEQ ID NO: 324680 - DNA, 20 bp, Artificial
  CRISPR gRNA sequence
aagtggaacttaagtatgta

SEQ ID NO: 324681 - DNA, 20 bp, Artificial
  CRISPR gRNA sequence
agtggaacttaagtatgtag

SEQ ID NO: 324682 - DNA, 20 bp, Artificial
  CRISPR gRNA sequence
ggatatgtcacacaaattga

SEQ ID NO: 324683 - DNA, 20 bp, Artificial
  CRISPR gRNA sequence
gtcacacaaattgaaagtgt

SEQ ID NO: 324684 - DNA, 20 bp, Artificial
  CRISPR gRNA sequence
acaaattgaaagtgttagtc

SEQ ID NO: 324685 - DNA, 20 bp, Artificial
  CRISPR gRNA sequence
gaaatgattttttttttcaa

SEQ ID NO: 324686 - DNA, 20 bp, Artificial
  CRISPR gRNA sequence
gattttttttttcaatagtt

SEQ ID NO: 324687 - DNA, 20 bp, Artificial
  CRISPR gRNA sequence
ttttcaatagtttggcctgt

SEQ ID NO: 324688 - DNA, 20 bp, Artificial
  CRISPR gRNA sequence
tttcaatagtttggcctgta

SEQ ID NO: 324689 - DNA, 20 bp, Artificial
  CRISPR gRNA sequence
gcctgtaaggttgaccaaaa

SEQ ID NO: 324690 - DNA, 20 bp, Artificial
  CRISPR gRNA sequence
cctgtaaggttgaccaaaac

SEQ ID NO: 324691 - DNA, 20 bp, Artificial
  CRISPR gRNA sequence
aaggttgaccaaaacaggta

SEQ ID NO: 324692 - DNA, 20 bp, Artificial
  CRISPR gRNA sequence
caaaacaggtaaagatttgc

SEQ ID NO: 324693 - DNA, 20 bp, Artificial
  CRISPR gRNA sequence
caggtaaagatttgcaagtt

SEQ ID NO: 324694 - DNA, 20 bp, Artificial
  CRISPR gRNA sequence
ggtaaagatttgcaagttta

SEQ ID NO: 324695 - DNA, 20 bp, Artificial
  CRISPR gRNA sequence
taaagatttgcaagtttaga

SEQ ID NO: 324696 - DNA, 20 bp, Artificial
  CRISPR gRNA sequence
gatttgcaagtttagagagt

SEQ ID NO: 324697 - DNA, 20 bp, Artificial
  CRISPR gRNA sequence
aagtttagagagtcagaaac

SEQ ID NO: 324698 - DNA, 20 bp, Artificial
  CRISPR gRNA sequence
agtttagagagtcagaaact

SEQ ID NO: 324699 - DNA, 20 bp, Artificial
  CRISPR gRNA sequence
gtttagagagtcagaaactg

SEQ ID NO: 324700 - DNA, 20 bp, Artificial
  CRISPR gRNA sequence
tggggatatgaacttccttc

SEQ ID NO: 324701 - DNA, 20 bp, Artificial
  CRISPR gRNA sequence
tgcttgtatctactttgctt

SEQ ID NO: 324702 - DNA, 20 bp, Artificial
  CRISPR gRNA sequence
gcttgtatctactttgcttg

SEQ ID NO: 324703 - DNA, 20 bp, Artificial
  CRISPR gRNA sequence
tactttgcttgaggaaaaaa

SEQ ID NO: 324704 - DNA, 20 bp, Artificial
  CRISPR gRNA sequence
agaaacacgttgtccccaaa

SEQ ID NO: 324705 - DNA, 20 bp, Artificial
  CRISPR gRNA sequence
gaaacacgttgtccccaaat

SEQ ID NO: 324706 - DNA, 20 bp, Artificial
  CRISPR gRNA sequence
aaacacgttgtccccaaata

SEQ ID NO: 324707 - DNA, 20 bp, Artificial
  CRISPR gRNA sequence
gttgtccccaaatagggtga

SEQ ID NO: 324708 - DNA, 20 bp, Artificial
  CRISPR gRNA sequence
ccccaaatagggtgatagac

SEQ ID NO: 324709 - DNA, 20 bp, Artificial
  CRISPR gRNA sequence
cccaaatagggtgatagacc

SEQ ID NO: 324710 - DNA, 20 bp, Artificial
  CRISPR gRNA sequence
caaatagggtgatagaccag

SEQ ID NO: 324711 - DNA, 20 bp, Artificial
  CRISPR gRNA sequence
atagaccaggagtttccatc

SEQ ID NO: 324712 - DNA, 20 bp, Artificial
  CRISPR gRNA sequence
gtttccatccagttgaccac

SEQ ID NO: 324713 - DNA, 20 bp, Artificial
  CRISPR gRNA sequence
cagttgaccacgagtgttgt

SEQ ID NO: 324714 - DNA, 20 bp, Artificial
  CRISPR gRNA sequence
agttgaccacgagtgttgtt

SEQ ID NO: 324715 - DNA, 20 bp, Artificial
  CRISPR gRNA sequence
ttgttaggatctgtttattt

SEQ ID NO: 324716 - DNA, 20 bp, Artificial
  CRISPR gRNA sequence
ttatttgagtcatgttgaca

SEQ ID NO: 324717 - DNA, 20 bp, Artificial
  CRISPR gRNA sequence
gagtcatgttgacacagaca

SEQ ID NO: 324718 - DNA, 20 bp, Artificial
  CRISPR gRNA sequence
acagacacagcactttcaat

SEQ ID NO: 324719 - DNA, 20 bp, Artificial
  CRISPR gRNA sequence
aagcaattaatgatcattta

SEQ ID NO: 324720 - DNA, 20 bp, Artificial
  CRISPR gRNA sequence
agcaattaatgatcatttaa

SEQ ID NO: 324721 - DNA, 20 bp, Artificial
  CRISPR gRNA sequence
acttttttgaatttgataaa

SEQ ID NO: 324722 - DNA, 20 bp, Artificial
  CRISPR gRNA sequence
tgataaatagatttttttta

SEQ ID NO: 324723 - DNA, 20 bp, Artificial
  CRISPR gRNA sequence
agcctgtatttgtgttcttc

SEQ ID NO: 324724 - DNA, 20 bp, Artificial
  CRISPR gRNA sequence
gcctgtatttgtgttcttct

SEQ ID NO: 324725 - DNA, 20 bp, Artificial
  CRISPR gRNA sequence
tcttctaggactttgcaaca

SEQ ID NO: 324726 - DNA, 20 bp, Artificial
  CRISPR gRNA sequence
aaaacaacaataacaacaac

SEQ ID NO: 324727 - DNA, 20 bp, Artificial
  CRISPR gRNA sequence
caagctgtctactgcactca

SEQ ID NO: 324728 - DNA, 20 bp, Artificial
  CRISPR gRNA sequence
gtctactgcactcacagtta

SEQ ID NO: 324729 - DNA, 20 bp, Artificial
  CRISPR gRNA sequence
tctgtttactttgcactatc

SEQ ID NO: 324730 - DNA, 20 bp, Artificial
  CRISPR gRNA sequence
ctgtttactttgcactatct

SEQ ID NO: 324731 - DNA, 20 bp, Artificial
  CRISPR gRNA sequence
ggactaatgcaaaaatctca

SEQ ID NO: 324732 - DNA, 20 bp, Artificial
  CRISPR gRNA sequence
tccatttctgtacatttcta

SEQ ID NO: 324733 - DNA, 20 bp, Artificial
  CRISPR gRNA sequence
ccatttctgtacatttctac

SEQ ID NO: 324734 - DNA, 20 bp, Artificial
  CRISPR gRNA sequence
tttctgtacatttctacagg

SEQ ID NO: 324735 - DNA, 20 bp, Artificial
  CRISPR gRNA sequence
gtacatttctacaggcagat

SEQ ID NO: 324736 - DNA, 20 bp, Artificial
  CRISPR gRNA sequence
ttctacaggcagataagtga

SEQ ID NO: 324737 - DNA, 20 bp, Artificial
  CRISPR gRNA sequence
tctacaggcagataagtgat

SEQ ID NO: 324738 - DNA, 20 bp, Artificial
  CRISPR gRNA sequence
taagtgatgggaaaatcatt

SEQ ID NO: 324739 - DNA, 20 bp, Artificial
  CRISPR gRNA sequence
tgggaaaatcattaagaatt

SEQ ID NO: 324740 - DNA, 20 bp, Artificial
  CRISPR gRNA sequence
attaagaatttagacttcat

SEQ ID NO: 324741 - DNA, 20 bp, Artificial
  CRISPR gRNA sequence
taagaatttagacttcatca

SEQ ID NO: 324742 - DNA, 20 bp, Artificial
  CRISPR gRNA sequence
gaatttagacttcatcagag

SEQ ID NO: 324743 - DNA, 20 bp, Artificial
  CRISPR gRNA sequence
gacttcatcagagaagaacc

SEQ ID NO: 324744 - DNA, 20 bp, Artificial
  CRISPR gRNA sequence
acttcatcagagaagaaccc

SEQ ID NO: 324745 - DNA, 20 bp, Artificial
  CRISPR gRNA sequence
gaagaacccaggtacaatga

SEQ ID NO: 324746 - DNA, 20 bp, Artificial
  CRISPR gRNA sequence
acccaggtacaatgacagcc

SEQ ID NO: 324747 - DNA, 20 bp, Artificial
  CRISPR gRNA sequence
cagcccagcttaatacatga

SEQ ID NO: 324748 - DNA, 20 bp, Artificial
  CRISPR gRNA sequence
ggctgatgaatgaaaatgtc

SEQ ID NO: 324749 - DNA, 20 bp, Artificial
  CRISPR gRNA sequence
gctgatgaatgaaaatgtct

SEQ ID NO: 324750 - DNA, 20 bp, Artificial
  CRISPR gRNA sequence
ctgatgaatgaaaatgtcta

SEQ ID NO: 324751 - DNA, 20 bp, Artificial
  CRISPR gRNA sequence
atgaaaatgtctagggaaat

SEQ ID NO: 324752 - DNA, 20 bp, Artificial
  CRISPR gRNA sequence
tacaatgtaatttcatatct

SEQ ID NO: 324753 - DNA, 20 bp, Artificial
  CRISPR gRNA sequence
tataataaccctttcaatca

SEQ ID NO: 324754 - DNA, 20 bp, Artificial
  CRISPR gRNA sequence
tcaatcacagaacacatatg

SEQ ID NO: 324755 - DNA, 20 bp, Artificial
  CRISPR gRNA sequence
accaatgtgaatactacttt

SEQ ID NO: 324756 - DNA, 20 bp, Artificial
  CRISPR gRNA sequence
tgaatactactttaagtatt

SEQ ID NO: 324757 - DNA, 20 bp, Artificial
  CRISPR gRNA sequence
gaatactactttaagtatta

SEQ ID NO: 324758 - DNA, 20 bp, Artificial
  CRISPR gRNA sequence
gataatatatccaatatacc

SEQ ID NO: 324759 - DNA, 20 bp, Artificial
  CRISPR gRNA sequence
aatatatccaatatacctag

SEQ ID NO: 324760 - DNA, 20 bp, Artificial
  CRISPR gRNA sequence
atatatccaatatacctaga

SEQ ID NO: 324761 - DNA, 20 bp, Artificial
  CRISPR gRNA sequence
ctgaaattcattttcatatc

SEQ ID NO: 324762 - DNA, 20 bp, Artificial
  CRISPR gRNA sequence
catatctagcttaatgttaa

SEQ ID NO: 324763 - DNA, 20 bp, Artificial
  CRISPR gRNA sequence
ctttttgtttttttatttcg

SEQ ID NO: 324764 - DNA, 20 bp, Artificial
  CRISPR gRNA sequence
tatttcgtagcaaatctctt

SEQ ID NO: 324765 - DNA, 20 bp, Artificial
  CRISPR gRNA sequence
tctctttagctctgatgctt

SEQ ID NO: 324766 - DNA, 20 bp, Artificial
  CRISPR gRNA sequence
tgctttagtttctgtacaat

SEQ ID NO: 324767 - DNA, 20 bp, Artificial
  CRISPR gRNA sequence
ctttagtttctgtacaatga

SEQ ID NO: 324768 - DNA, 20 bp, Artificial
  CRISPR gRNA sequence
tttagtttctgtacaatgag

SEQ ID NO: 324769 - DNA, 20 bp, Artificial
  CRISPR gRNA sequence
tttctgtacaatgagaggat

SEQ ID NO: 324770 - DNA, 20 bp, Artificial
  CRISPR gRNA sequence
gtacaatgagaggattggac

SEQ ID NO: 324771 - DNA, 20 bp, Artificial
  CRISPR gRNA sequence
agaggattggactagattat

SEQ ID NO: 324772 - DNA, 20 bp, Artificial
  CRISPR gRNA sequence
gaggattggactagattatt

SEQ ID NO: 324773 - DNA, 20 bp, Artificial
  CRISPR gRNA sequence
ttggactagattattaggtg

SEQ ID NO: 324774 - DNA, 20 bp, Artificial
  CRISPR gRNA sequence
ggactagattattaggtgaa

SEQ ID NO: 324775 - DNA, 20 bp, Artificial
  CRISPR gRNA sequence
gattattaggtgaagagatt

SEQ ID NO: 324776 - DNA, 20 bp, Artificial
  CRISPR gRNA sequence
attaggtgaagagattaagt

SEQ ID NO: 324777 - DNA, 20 bp, Artificial
  CRISPR gRNA sequence
ttaagtaagtgtgtgtaccc

SEQ ID NO: 324778 - DNA, 20 bp, Artificial
  CRISPR gRNA sequence
tcttttttctttgtttttgt

SEQ ID NO: 324779 - DNA, 20 bp, Artificial
  CRISPR gRNA sequence
tttctttgtttttgttggac

SEQ ID NO: 324780 - DNA, 20 bp, Artificial
  CRISPR gRNA sequence
ttctttgtttttgttggact

SEQ ID NO: 324781 - DNA, 20 bp, Artificial
  CRISPR gRNA sequence
tgttggactgggttaattcg

SEQ ID NO: 324782 - DNA, 20 bp, Artificial
  CRISPR gRNA sequence
aattcgaagaccttgtcttc

SEQ ID NO: 324783 - DNA, 20 bp, Artificial
  CRISPR gRNA sequence
agctctgaatttctttcttc

SEQ ID NO: 324784 - DNA, 20 bp, Artificial
  CRISPR gRNA sequence
agttgttcaattctattgct

SEQ ID NO: 324785 - DNA, 20 bp, Artificial
  CRISPR gRNA sequence
attctattgctgagactttc

SEQ ID NO: 324786 - DNA, 20 bp, Artificial
  CRISPR gRNA sequence
tctattgctgagactttcca

SEQ ID NO: 324787 - DNA, 20 bp, Artificial
  CRISPR gRNA sequence
cctttctaaaattgtgtcca

SEQ ID NO: 324788 - DNA, 20 bp, Artificial
  CRISPR gRNA sequence
atttttattgttttttcttt

SEQ ID NO: 324789 - DNA, 20 bp, Artificial
  CRISPR gRNA sequence
ttttttgcatttccttgcat

SEQ ID NO: 324790 - DNA, 20 bp, Artificial
  CRISPR gRNA sequence
tttttgcatttccttgcatt

SEQ ID NO: 324791 - DNA, 20 bp, Artificial
  CRISPR gRNA sequence
cattgggcttcacctttctc

SEQ ID NO: 324792 - DNA, 20 bp, Artificial
  CRISPR gRNA sequence
ttctctggtccctccccgat

SEQ ID NO: 324793 - DNA, 20 bp, Artificial
  CRISPR gRNA sequence
taacctcctgaattcttttt

SEQ ID NO: 324794 - DNA, 20 bp, Artificial
  CRISPR gRNA sequence
aacctcctgaattctttttc

SEQ ID NO: 324795 - DNA, 20 bp, Artificial
  CRISPR gRNA sequence
ctcctgaattctttttcagg

SEQ ID NO: 324796 - DNA, 20 bp, Artificial
  CRISPR gRNA sequence
aattctttttcaggtagatg

SEQ ID NO: 324797 - DNA, 20 bp, Artificial
  CRISPR gRNA sequence
gtagatgaagaatttcttct

SEQ ID NO: 324798 - DNA, 20 bp, Artificial
  CRISPR gRNA sequence
tgaagaatttcttcttggtt

SEQ ID NO: 324799 - DNA, 20 bp, Artificial
  CRISPR gRNA sequence
tcttggtttggatccattgc

SEQ ID NO: 324800 - DNA, 20 bp, Artificial
  CRISPR gRNA sequence
tggatccattgctggtgaac

SEQ ID NO: 324801 - DNA, 20 bp, Artificial
  CRISPR gRNA sequence
ggtgaactagtgtgattttt

SEQ ID NO: 324802 - DNA, 20 bp, Artificial
  CRISPR gRNA sequence
gtgaactagtgtgatttttt

SEQ ID NO: 324803 - DNA, 20 bp, Artificial
  CRISPR gRNA sequence
tgaactagtgtgattttttg

SEQ ID NO: 324804 - DNA, 20 bp, Artificial
  CRISPR gRNA sequence
gaactagtgtgattttttgg

SEQ ID NO: 324805 - DNA, 20 bp, Artificial
  CRISPR gRNA sequence
gtgattttttgggggtgttg

SEQ ID NO: 324806 - DNA, 20 bp, Artificial
  CRISPR gRNA sequence
gattttttgggggtgttgaa

SEQ ID NO: 324807 - DNA, 20 bp, Artificial
  CRISPR gRNA sequence
gccttgttttgtcatattac

SEQ ID NO: 324808 - DNA, 20 bp, Artificial
  CRISPR gRNA sequence
cttgttttgtcatattacca

SEQ ID NO: 324809 - DNA, 20 bp, Artificial
  CRISPR gRNA sequence
ttttgtcatattaccagagt

SEQ ID NO: 324810 - DNA, 20 bp, Artificial
  CRISPR gRNA sequence
tattaccagagttggttttc

SEQ ID NO: 324811 - DNA, 20 bp, Artificial
  CRISPR gRNA sequence
ttttctggttccttctcatt

SEQ ID NO: 324812 - DNA, 20 bp, Artificial
  CRISPR gRNA sequence
tttctggttccttctcattt

SEQ ID NO: 324813 - DNA, 20 bp, Artificial
  CRISPR gRNA sequence
ctggttccttctcatttggg

SEQ ID NO: 324814 - DNA, 20 bp, Artificial
  CRISPR gRNA sequence
tggttccttctcatttgggt

SEQ ID NO: 324815 - DNA, 20 bp, Artificial
  CRISPR gRNA sequence
ctcatttgggtaggtgctgt

SEQ ID NO: 324816 - DNA, 20 bp, Artificial
  CRISPR gRNA sequence
catttgggtaggtgctgtca

SEQ ID NO: 324817 - DNA, 20 bp, Artificial
  CRISPR gRNA sequence
atttgggtaggtgctgtcag

SEQ ID NO: 324818 - DNA, 20 bp, Artificial
  CRISPR gRNA sequence
tttgggtaggtgctgtcaga

SEQ ID NO: 324819 - DNA, 20 bp, Artificial
  CRISPR gRNA sequence
ttgggtaggtgctgtcagag

SEQ ID NO: 324820 - DNA, 20 bp, Artificial
  CRISPR gRNA sequence
gggtaggtgctgtcagaggg

SEQ ID NO: 324821 - DNA, 20 bp, Artificial
  CRISPR gRNA sequence
ggtaggtgctgtcagagggg

SEQ ID NO: 324822 - DNA, 20 bp, Artificial
  CRISPR gRNA sequence
gtgctgtcagaggggaggtc

SEQ ID NO: 324823 - DNA, 20 bp, Artificial
  CRISPR gRNA sequence
tgctgtcagaggggaggtct

SEQ ID NO: 324824 - DNA, 20 bp, Artificial
  CRISPR gRNA sequence
gctgtcagaggggaggtcta

SEQ ID NO: 324825 - DNA, 20 bp, Artificial
  CRISPR gRNA sequence
agaggggaggtctagggctg

SEQ ID NO: 324826 - DNA, 20 bp, Artificial
  CRISPR gRNA sequence
gaggggaggtctagggctga

SEQ ID NO: 324827 - DNA, 20 bp, Artificial
  CRISPR gRNA sequence
tagggctgaaggctgttctt

SEQ ID NO: 324828 - DNA, 20 bp, Artificial
  CRISPR gRNA sequence
cagattttttttttgtccca

SEQ ID NO: 324829 - DNA, 20 bp, Artificial
  CRISPR gRNA sequence
gattttttttttgtcccatg

SEQ ID NO: 324830 - DNA, 20 bp, Artificial
  CRISPR gRNA sequence
ttccccttttcctatgtatg

SEQ ID NO: 324831 - DNA, 20 bp, Artificial
  CRISPR gRNA sequence
tttcctatgtatgtggcttc

SEQ ID NO: 324832 - DNA, 20 bp, Artificial
  CRISPR gRNA sequence
ctatgtatgtggcttccagt

SEQ ID NO: 324833 - DNA, 20 bp, Artificial
  CRISPR gRNA sequence
gcttccagtgagccaaactg

SEQ ID NO: 324834 - DNA, 20 bp, Artificial
  CRISPR gRNA sequence
agtgattgttgtctctcttc

SEQ ID NO: 324835 - DNA, 20 bp, Artificial
  CRISPR gRNA sequence
gtgattgttgtctctcttct

SEQ ID NO: 324836 - DNA, 20 bp, Artificial
  CRISPR gRNA sequence
tgttgtctctcttctgggtc

SEQ ID NO: 324837 - DNA, 20 bp, Artificial
  CRISPR gRNA sequence
ctcttctgggtctagccacc

SEQ ID NO: 324838 - DNA, 20 bp, Artificial
  CRISPR gRNA sequence
agccacccagcaaatctacc

SEQ ID NO: 324839 - DNA, 20 bp, Artificial
  CRISPR gRNA sequence
ccagcaaatctacccggctc

SEQ ID NO: 324840 - DNA, 20 bp, Artificial
  CRISPR gRNA sequence
cagcaaatctacccggctct

SEQ ID NO: 324841 - DNA, 20 bp, Artificial
  CRISPR gRNA sequence
aaatctacccggctctgggc

SEQ ID NO: 324842 - DNA, 20 bp, Artificial
  CRISPR gRNA sequence
acccggctctgggctggtat

SEQ ID NO: 324843 - DNA, 20 bp, Artificial
  CRISPR gRNA sequence
cccggctctgggctggtatt

SEQ ID NO: 324844 - DNA, 20 bp, Artificial
  CRISPR gRNA sequence
ccggctctgggctggtattg

SEQ ID NO: 324845 - DNA, 20 bp, Artificial
  CRISPR gRNA sequence
cggctctgggctggtattgg

SEQ ID NO: 324846 - DNA, 20 bp, Artificial
  CRISPR gRNA sequence
ggtattgggggttgtctgca

SEQ ID NO: 324847 - DNA, 20 bp, Artificial
  CRISPR gRNA sequence
cctgtgatgtgaaccatcta

SEQ ID NO: 324848 - DNA, 20 bp, Artificial
  CRISPR gRNA sequence
ctgtgatgtgaaccatctat

SEQ ID NO: 324849 - DNA, 20 bp, Artificial
  CRISPR gRNA sequence
tgaaccatctatgggtctct

SEQ ID NO: 324850 - DNA, 20 bp, Artificial
  CRISPR gRNA sequence
atctatgggtctctcagcca

SEQ ID NO: 324851 - DNA, 20 bp, Artificial
  CRISPR gRNA sequence
ggtctctcagccatggatac

SEQ ID NO: 324852 - DNA, 20 bp, Artificial
  CRISPR gRNA sequence
catggataccagtgctgttc

SEQ ID NO: 324853 - DNA, 20 bp, Artificial
  CRISPR gRNA sequence
ggataccagtgctgttctgg

SEQ ID NO: 324854 - DNA, 20 bp, Artificial
  CRISPR gRNA sequence
ataccagtgctgttctggtg

SEQ ID NO: 324855 - DNA, 20 bp, Artificial
  CRISPR gRNA sequence
taccagtgctgttctggtgg

SEQ ID NO: 324856 - DNA, 20 bp, Artificial
  CRISPR gRNA sequence
cagtgctgttctggtggagg

SEQ ID NO: 324857 - DNA, 20 bp, Artificial
  CRISPR gRNA sequence
ctgttctggtggaggtggcg

SEQ ID NO: 324858 - DNA, 20 bp, Artificial
  CRISPR gRNA sequence
tgttctggtggaggtggcga

SEQ ID NO: 324859 - DNA, 20 bp, Artificial
  CRISPR gRNA sequence
gttctggtggaggtggcgaa

SEQ ID NO: 324860 - DNA, 20 bp, Artificial
  CRISPR gRNA sequence
ggaggtggcgaagggtgcaa

SEQ ID NO: 324861 - DNA, 20 bp, Artificial
  CRISPR gRNA sequence
aagggtgcaatggactccat

SEQ ID NO: 324862 - DNA, 20 bp, Artificial
  CRISPR gRNA sequence
agggtgcaatggactccatg

SEQ ID NO: 324863 - DNA, 20 bp, Artificial
  CRISPR gRNA sequence
gggtgcaatggactccatga

SEQ ID NO: 324864 - DNA, 20 bp, Artificial
  CRISPR gRNA sequence
atggactccatgagggcctt

SEQ ID NO: 324865 - DNA, 20 bp, Artificial
  CRISPR gRNA sequence
tccatgagggcctttagctt

SEQ ID NO: 324866 - DNA, 20 bp, Artificial
  CRISPR gRNA sequence
atgagggcctttagctttgg

SEQ ID NO: 324867 - DNA, 20 bp, Artificial
  CRISPR gRNA sequence
ttaatgctctatttttgtgc

SEQ ID NO: 324868 - DNA, 20 bp, Artificial
  CRISPR gRNA sequence
tgctctatttttgtgctggt

SEQ ID NO: 324869 - DNA, 20 bp, Artificial
  CRISPR gRNA sequence
tgtgctggttggcctcctgc

SEQ ID NO: 324870 - DNA, 20 bp, Artificial
  CRISPR gRNA sequence
gtgctggttggcctcctgcc

SEQ ID NO: 324871 - DNA, 20 bp, Artificial
  CRISPR gRNA sequence
gctggttggcctcctgccag

SEQ ID NO: 324872 - DNA, 20 bp, Artificial
  CRISPR gRNA sequence
ctggttggcctcctgccagg

SEQ ID NO: 324873 - DNA, 20 bp, Artificial
  CRISPR gRNA sequence
gttggcctcctgccaggagg

SEQ ID NO: 324874 - DNA, 20 bp, Artificial
  CRISPR gRNA sequence
tgccaggaggtggcgctttc

SEQ ID NO: 324875 - DNA, 20 bp, Artificial
  CRISPR gRNA sequence
aggaggtggcgctttccaga

SEQ ID NO: 324876 - DNA, 20 bp, Artificial
  CRISPR gRNA sequence
tggcgctttccagaaagcat

SEQ ID NO: 324877 - DNA, 20 bp, Artificial
  CRISPR gRNA sequence
ccagaaagcatcagctgtaa

SEQ ID NO: 324878 - DNA, 20 bp, Artificial
  CRISPR gRNA sequence
aagcatcagctgtaatagta

SEQ ID NO: 324879 - DNA, 20 bp, Artificial
  CRISPR gRNA sequence
gcatcagctgtaatagtata

SEQ ID NO: 324880 - DNA, 20 bp, Artificial
  CRISPR gRNA sequence
atcagctgtaatagtataga

SEQ ID NO: 324881 - DNA, 20 bp, Artificial
  CRISPR gRNA sequence
tcagctgtaatagtatagag

SEQ ID NO: 324882 - DNA, 20 bp, Artificial
  CRISPR gRNA sequence
cagctgtaatagtatagaga

SEQ ID NO: 324883 - DNA, 20 bp, Artificial
  CRISPR gRNA sequence
gtaatagtatagagagggtc

SEQ ID NO: 324884 - DNA, 20 bp, Artificial
  CRISPR gRNA sequence
atagtatagagagggtctgg

SEQ ID NO: 324885 - DNA, 20 bp, Artificial
  CRISPR gRNA sequence
gtatagagagggtctggtgg

SEQ ID NO: 324886 - DNA, 20 bp, Artificial
  CRISPR gRNA sequence
tatagagagggtctggtggt

SEQ ID NO: 324887 - DNA, 20 bp, Artificial
  CRISPR gRNA sequence
agagagggtctggtggtggg

SEQ ID NO: 324888 - DNA, 20 bp, Artificial
  CRISPR gRNA sequence
gagagggtctggtggtgggt

SEQ ID NO: 324889 - DNA, 20 bp, Artificial
  CRISPR gRNA sequence
agagggtctggtggtgggtg

SEQ ID NO: 324890 - DNA, 20 bp, Artificial
  CRISPR gRNA sequence
tctggtggtgggtggggccc

SEQ ID NO: 324891 - DNA, 20 bp, Artificial
  CRISPR gRNA sequence
gggtggggccctagaactcc

SEQ ID NO: 324892 - DNA, 20 bp, Artificial
  CRISPR gRNA sequence
ggtggggccctagaactccc

SEQ ID NO: 324893 - DNA, 20 bp, Artificial
  CRISPR gRNA sequence
gccctttgtgttctgctaac

SEQ ID NO: 324894 - DNA, 20 bp, Artificial
  CRISPR gRNA sequence
ccctttgtgttctgctaacc

SEQ ID NO: 324895 - DNA, 20 bp, Artificial
  CRISPR gRNA sequence
cctttgtgttctgctaacca

SEQ ID NO: 324896 - DNA, 20 bp, Artificial
  CRISPR gRNA sequence
ttgtgttctgctaaccaggg

SEQ ID NO: 324897 - DNA, 20 bp, Artificial
  CRISPR gRNA sequence
tgtgttctgctaaccagggt

SEQ ID NO: 324898 - DNA, 20 bp, Artificial
  CRISPR gRNA sequence
gttctgctaaccagggtggg

SEQ ID NO: 324899 - DNA, 20 bp, Artificial
  CRISPR gRNA sequence
ttctgctaaccagggtgggt

SEQ ID NO: 324900 - DNA, 20 bp, Artificial
  CRISPR gRNA sequence
tctgctaaccagggtgggta

SEQ ID NO: 324901 - DNA, 20 bp, Artificial
  CRISPR gRNA sequence
gctaaccagggtgggtaggg

SEQ ID NO: 324902 - DNA, 20 bp, Artificial
  CRISPR gRNA sequence
ctaaccagggtgggtaggga

SEQ ID NO: 324903 - DNA, 20 bp, Artificial
  CRISPR gRNA sequence
taaccagggtgggtagggaa

SEQ ID NO: 324904 - DNA, 20 bp, Artificial
  CRISPR gRNA sequence
ccagggtgggtagggaaggg

SEQ ID NO: 324905 - DNA, 20 bp, Artificial
  CRISPR gRNA sequence
cagggtgggtagggaagggc

SEQ ID NO: 324906 - DNA, 20 bp, Artificial
  CRISPR gRNA sequence
agggtgggtagggaagggca

SEQ ID NO: 324907 - DNA, 20 bp, Artificial
  CRISPR gRNA sequence
tgggtagggaagggcagggc

SEQ ID NO: 324908 - DNA, 20 bp, Artificial
  CRISPR gRNA sequence
gggtagggaagggcagggct

SEQ ID NO: 324909 - DNA, 20 bp, Artificial
  CRISPR gRNA sequence
gggcagggctaggcatgtct

SEQ ID NO: 324910 - DNA, 20 bp, Artificial
  CRISPR gRNA sequence
gggctaggcatgtctgagct

SEQ ID NO: 324911 - DNA, 20 bp, Artificial
  CRISPR gRNA sequence
gtctgagctcagactctcct

SEQ ID NO: 324912 - DNA, 20 bp, Artificial
  CRISPR gRNA sequence
tctgagctcagactctcctt

SEQ ID NO: 324913 - DNA, 20 bp, Artificial
  CRISPR gRNA sequence
gagctcagactctccttggg

SEQ ID NO: 324914 - DNA, 20 bp, Artificial
  CRISPR gRNA sequence
agctcagactctccttgggc

SEQ ID NO: 324915 - DNA, 20 bp, Artificial
  CRISPR gRNA sequence
tccttgggcaggtcttgctg

SEQ ID NO: 324916 - DNA, 20 bp, Artificial
  CRISPR gRNA sequence
aggtcttgctgtggctgctg

SEQ ID NO: 324917 - DNA, 20 bp, Artificial
  CRISPR gRNA sequence
ggtcttgctgtggctgctgt

SEQ ID NO: 324918 - DNA, 20 bp, Artificial
  CRISPR gRNA sequence
gtcttgctgtggctgctgtg

SEQ ID NO: 324919 - DNA, 20 bp, Artificial
  CRISPR gRNA sequence
tcttgctgtggctgctgtgg

SEQ ID NO: 324920 - DNA, 20 bp, Artificial
  CRISPR gRNA sequence
tgtggctgctgtgggggatg

SEQ ID NO: 324921 - DNA, 20 bp, Artificial
  CRISPR gRNA sequence
gtggctgctgtgggggatgt

SEQ ID NO: 324922 - DNA, 20 bp, Artificial
  CRISPR gRNA sequence
ctgctgtgggggatgtgggt

SEQ ID NO: 324923 - DNA, 20 bp, Artificial
  CRISPR gRNA sequence
ggggatgtgggtgagattcc

SEQ ID NO: 324924 - DNA, 20 bp, Artificial
  CRISPR gRNA sequence
gggatgtgggtgagattccc

SEQ ID NO: 324925 - DNA, 20 bp, Artificial
  CRISPR gRNA sequence
gggtgagattcccaggtcac

SEQ ID NO: 324926 - DNA, 20 bp, Artificial
  CRISPR gRNA sequence
gtgagattcccaggtcactg

SEQ ID NO: 324927 - DNA, 20 bp, Artificial
  CRISPR gRNA sequence
ggtcactggagttgtgtacc

SEQ ID NO: 324928 - DNA, 20 bp, Artificial
  CRISPR gRNA sequence
gtcactggagttgtgtacct

SEQ ID NO: 324929 - DNA, 20 bp, Artificial
  CRISPR gRNA sequence
cactggagttgtgtacctag

SEQ ID NO: 324930 - DNA, 20 bp, Artificial
  CRISPR gRNA sequence
actggagttgtgtacctagg

SEQ ID NO: 324931 - DNA, 20 bp, Artificial
  CRISPR gRNA sequence
ttgtgtacctaggaggatta

SEQ ID NO: 324932 - DNA, 20 bp, Artificial
  CRISPR gRNA sequence
ggattatggctgcctctgct

SEQ ID NO: 324933 - DNA, 20 bp, Artificial
  CRISPR gRNA sequence
gctgcctctgctgagtcatg

SEQ ID NO: 324934 - DNA, 20 bp, Artificial
  CRISPR gRNA sequence
ctgcctctgctgagtcatgc

SEQ ID NO: 324935 - DNA, 20 bp, Artificial
  CRISPR gRNA sequence
tgctgagtcatgcaggttgt

SEQ ID NO: 324936 - DNA, 20 bp, Artificial
  CRISPR gRNA sequence
gctgagtcatgcaggttgtc

SEQ ID NO: 324937 - DNA, 20 bp, Artificial
  CRISPR gRNA sequence
ctgagtcatgcaggttgtca

SEQ ID NO: 324938 - DNA, 20 bp, Artificial
  CRISPR gRNA sequence
agtcatgcaggttgtcaggg

SEQ ID NO: 324939 - DNA, 20 bp, Artificial
  CRISPR gRNA sequence
catgcaggttgtcagggaag

SEQ ID NO: 324940 - DNA, 20 bp, Artificial
  CRISPR gRNA sequence
atgcaggttgtcagggaagt

SEQ ID NO: 324941 - DNA, 20 bp, Artificial
  CRISPR gRNA sequence
tgcaggttgtcagggaagtg

SEQ ID NO: 324942 - DNA, 20 bp, Artificial
  CRISPR gRNA sequence
gcaggttgtcagggaagtgg

SEQ ID NO: 324943 - DNA, 20 bp, Artificial
  CRISPR gRNA sequence
tcagggaagtgggggaaaac

SEQ ID NO: 324944 - DNA, 20 bp, Artificial
  CRISPR gRNA sequence
gggaagtgggggaaaaccgg

SEQ ID NO: 324945 - DNA, 20 bp, Artificial
  CRISPR gRNA sequence
tgggggaaaaccggcagtca

SEQ ID NO: 324946 - DNA, 20 bp, Artificial
  CRISPR gRNA sequence
gggggaaaaccggcagtcac

SEQ ID NO: 324947 - DNA, 20 bp, Artificial
  CRISPR gRNA sequence
cggcagtcacaggtctcatc

SEQ ID NO: 324948 - DNA, 20 bp, Artificial
  CRISPR gRNA sequence
tcatccagatcccatgcaaa

SEQ ID NO: 324949 - DNA, 20 bp, Artificial
  CRISPR gRNA sequence
tccagatcccatgcaaacgg

SEQ ID NO: 324950 - DNA, 20 bp, Artificial
  CRISPR gRNA sequence
ccagatcccatgcaaacgga

SEQ ID NO: 324951 - DNA, 20 bp, Artificial
  CRISPR gRNA sequence
cagatcccatgcaaacggaa

SEQ ID NO: 324952 - DNA, 20 bp, Artificial
  CRISPR gRNA sequence
tcccatgcaaacggaagggc

SEQ ID NO: 324953 - DNA, 20 bp, Artificial
  CRISPR gRNA sequence
atgcctcctctaaccgcccc

SEQ ID NO: 324954 - DNA, 20 bp, Artificial
  CRISPR gRNA sequence
aaccgccccaagtctgtttc

SEQ ID NO: 324955 - DNA, 20 bp, Artificial
  CRISPR gRNA sequence
accgccccaagtctgtttcc

SEQ ID NO: 324956 - DNA, 20 bp, Artificial
  CRISPR gRNA sequence
cccaagtctgtttccaggca

SEQ ID NO: 324957 - DNA, 20 bp, Artificial
  CRISPR gRNA sequence
ccaagtctgtttccaggcaa

SEQ ID NO: 324958 - DNA, 20 bp, Artificial
  CRISPR gRNA sequence
caagtctgtttccaggcaaa

SEQ ID NO: 324959 - DNA, 20 bp, Artificial
  CRISPR gRNA sequence
tctgtttccaggcaaagggc

SEQ ID NO: 324960 - DNA, 20 bp, Artificial
  CRISPR gRNA sequence
ttccaggcaaagggcaagac

SEQ ID NO: 324961 - DNA, 20 bp, Artificial
  CRISPR gRNA sequence
actggcttgaaaacttgcct

SEQ ID NO: 324962 - DNA, 20 bp, Artificial
  CRISPR gRNA sequence
ctggcttgaaaacttgcctg

SEQ ID NO: 324963 - DNA, 20 bp, Artificial
  CRISPR gRNA sequence
gcctgaggctttctgcctcc

SEQ ID NO: 324964 - DNA, 20 bp, Artificial
  CRISPR gRNA sequence
tttctgcctcccagctgtga

SEQ ID NO: 324965 - DNA, 20 bp, Artificial
  CRISPR gRNA sequence
gcctcccagctgtgaaagaa

SEQ ID NO: 324966 - DNA, 20 bp, Artificial
  CRISPR gRNA sequence
cctcccagctgtgaaagaaa

SEQ ID NO: 324967 - DNA, 20 bp, Artificial
  CRISPR gRNA sequence
ctcccagctgtgaaagaaaa

SEQ ID NO: 324968 - DNA, 20 bp, Artificial
  CRISPR gRNA sequence
gctgtgaaagaaaagggctt

SEQ ID NO: 324969 - DNA, 20 bp, Artificial
  CRISPR gRNA sequence
tgcatgtgaaatctgcatgc

SEQ ID NO: 324970 - DNA, 20 bp, Artificial
  CRISPR gRNA sequence
aaatctgcatgctggattca

SEQ ID NO: 324971 - DNA, 20 bp, Artificial
  CRISPR gRNA sequence
ctggattcacggcctccccc

SEQ ID NO: 324972 - DNA, 20 bp, Artificial
  CRISPR gRNA sequence
ttcacggcctccccccagtt

SEQ ID NO: 324973 - DNA, 20 bp, Artificial
  CRISPR gRNA sequence
tcacggcctccccccagttc

SEQ ID NO: 324974 - DNA, 20 bp, Artificial
  CRISPR gRNA sequence
ggcctccccccagttcaggc

SEQ ID NO: 324975 - DNA, 20 bp, Artificial
  CRISPR gRNA sequence
gcctccccccagttcaggcc

SEQ ID NO: 324976 - DNA, 20 bp, Artificial
  CRISPR gRNA sequence
ctccccccagttcaggccag

SEQ ID NO: 324977 - DNA, 20 bp, Artificial
  CRISPR gRNA sequence
gacttcttgccctgttcaaa

SEQ ID NO: 324978 - DNA, 20 bp, Artificial
  CRISPR gRNA sequence
gccctgttcaaatagttaca

SEQ ID NO: 324979 - DNA, 20 bp, Artificial
  CRISPR gRNA sequence
gttcaaatagttacaaagtt

SEQ ID NO: 324980 - DNA, 20 bp, Artificial
  CRISPR gRNA sequence
aaatagttacaaagttcagc

SEQ ID NO: 324981 - DNA, 20 bp, Artificial
  CRISPR gRNA sequence
atagttacaaagttcagcta

SEQ ID NO: 324982 - DNA, 20 bp, Artificial
  CRISPR gRNA sequence
tagagaattccttctccctg

SEQ ID NO: 324983 - DNA, 20 bp, Artificial
  CRISPR gRNA sequence
gagaattccttctccctgtg

SEQ ID NO: 324984 - DNA, 20 bp, Artificial
  CRISPR gRNA sequence
agttttataccctgctcctc

SEQ ID NO: 324985 - DNA, 20 bp, Artificial
  CRISPR gRNA sequence
ctgctcctctggccaccctc

SEQ ID NO: 324986 - DNA, 20 bp, Artificial
  CRISPR gRNA sequence
tcctctggccaccctccaga

SEQ ID NO: 324987 - DNA, 20 bp, Artificial
  CRISPR gRNA sequence
accctccagatggatccctg

SEQ ID NO: 324988 - DNA, 20 bp, Artificial
  CRISPR gRNA sequence
agatggatccctgtggtgcc

SEQ ID NO: 324989 - DNA, 20 bp, Artificial
  CRISPR gRNA sequence
ggatccctgtggtgcctggc

SEQ ID NO: 324990 - DNA, 20 bp, Artificial
  CRISPR gRNA sequence
cctgtggtgcctggcaagaa

SEQ ID NO: 324991 - DNA, 20 bp, Artificial
  CRISPR gRNA sequence
ctgtggtgcctggcaagaat

SEQ ID NO: 324992 - DNA, 20 bp, Artificial
  CRISPR gRNA sequence
cctggcaagaatgggctgct

SEQ ID NO: 324993 - DNA, 20 bp, Artificial
  CRISPR gRNA sequence
ctggcaagaatgggctgctt

SEQ ID NO: 324994 - DNA, 20 bp, Artificial
  CRISPR gRNA sequence
tggcaagaatgggctgcttg

SEQ ID NO: 324995 - DNA, 20 bp, Artificial
  CRISPR gRNA sequence
gggctgcttggggacccatt

SEQ ID NO: 324996 - DNA, 20 bp, Artificial
  CRISPR gRNA sequence
ttggggacccattgagctcc

SEQ ID NO: 324997 - DNA, 20 bp, Artificial
  CRISPR gRNA sequence
ggggacccattgagctccca

SEQ ID NO: 324998 - DNA, 20 bp, Artificial
  CRISPR gRNA sequence
gagctcccagagcctttctg

SEQ ID NO: 324999 - DNA, 20 bp, Artificial
  CRISPR gRNA sequence
cccctgtattttgctccgtt

SEQ ID NO: 325000 - DNA, 20 bp, Artificial
  CRISPR gRNA sequence
tctctaacttgactcacctc

SEQ ID NO: 325001 - DNA, 20 bp, Artificial
  CRISPR gRNA sequence
acttgactcacctccagata

SEQ ID NO: 325002 - DNA, 20 bp, Artificial
  CRISPR gRNA sequence
gactcacctccagataaagt

SEQ ID NO: 325003 - DNA, 20 bp, Artificial
  CRISPR gRNA sequence
gtcggaaacttctccacaaa

SEQ ID NO: 325004 - DNA, 20 bp, Artificial
  CRISPR gRNA sequence
cttctccacaaacagacgct

SEQ ID NO: 325005 - DNA, 20 bp, Artificial
  CRISPR gRNA sequence
aaacagacgctcagcttctc

SEQ ID NO: 325006 - DNA, 20 bp, Artificial
  CRISPR gRNA sequence
agacgctcagcttctccggt

SEQ ID NO: 325007 - DNA, 20 bp, Artificial
  CRISPR gRNA sequence
acgctcagcttctccggtca

SEQ ID NO: 325008 - DNA, 20 bp, Artificial
  CRISPR gRNA sequence
ctccggtcagagtgtgtgtt

SEQ ID NO: 325009 - DNA, 20 bp, Artificial
  CRISPR gRNA sequence
tccggtcagagtgtgtgttt

SEQ ID NO: 325010 - DNA, 20 bp, Artificial
  CRISPR gRNA sequence
cggtcagagtgtgtgtttgg

SEQ ID NO: 325011 - DNA, 20 bp, Artificial
  CRISPR gRNA sequence
gtcagagtgtgtgtttggga

SEQ ID NO: 325012 - DNA, 20 bp, Artificial
  CRISPR gRNA sequence
tcagagtgtgtgtttgggag

SEQ ID NO: 325013 - DNA, 20 bp, Artificial
  CRISPR gRNA sequence
agagtgtgtgtttgggagag

SEQ ID NO: 325014 - DNA, 20 bp, Artificial
  CRISPR gRNA sequence
gagtgtgtgtttgggagagg

SEQ ID NO: 325015 - DNA, 20 bp, Artificial
  CRISPR gRNA sequence
agtgtgtgtttgggagagga

SEQ ID NO: 325016 - DNA, 20 bp, Artificial
  CRISPR gRNA sequence
ggagggtctccctttcccgt

SEQ ID NO: 325017 - DNA, 20 bp, Artificial
  CRISPR gRNA sequence
gtgagtcttttctttttgac

SEQ ID NO: 325018 - DNA, 20 bp, Artificial
  CRISPR gRNA sequence
tgagtcttttctttttgact

SEQ ID NO: 325019 - DNA, 20 bp, Artificial
  CRISPR gRNA sequence
tttctttttgactgggaaat

SEQ ID NO: 325020 - DNA, 20 bp, Artificial
  CRISPR gRNA sequence
aataagtatctcccaatctt

SEQ ID NO: 325021 - DNA, 20 bp, Artificial
  CRISPR gRNA sequence
atctcccaatcttcagtaaa

SEQ ID NO: 325022 - DNA, 20 bp, Artificial
  CRISPR gRNA sequence
tctcccaatcttcagtaaat

SEQ ID NO: 325023 - DNA, 20 bp, Artificial
  CRISPR gRNA sequence
ccttttcccactcctcttct

SEQ ID NO: 325024 - DNA, 20 bp, Artificial
  CRISPR gRNA sequence
cctcttcttggcccattaca

SEQ ID NO: 325025 - DNA, 20 bp, Artificial
  CRISPR gRNA sequence
agatatttaccaaacatgct

SEQ ID NO: 325026 - DNA, 20 bp, Artificial
  CRISPR gRNA sequence
ttcttttatttaatatgatt

SEQ ID NO: 325027 - DNA, 20 bp, Artificial
  CRISPR gRNA sequence
attgagcttccactatgttc

SEQ ID NO: 325028 - DNA, 20 bp, Artificial
  CRISPR gRNA sequence
ttgagcttccactatgttca

SEQ ID NO: 325029 - DNA, 20 bp, Artificial
  CRISPR gRNA sequence
ttccactatgttcaaggtcc

SEQ ID NO: 325030 - DNA, 20 bp, Artificial
  CRISPR gRNA sequence
tccactatgttcaaggtcct

SEQ ID NO: 325031 - DNA, 20 bp, Artificial
  CRISPR gRNA sequence
ttcaaggtcctgggattttt

SEQ ID NO: 325032 - DNA, 20 bp, Artificial
  CRISPR gRNA sequence
tcaaggtcctgggatttttt

SEQ ID NO: 325033 - DNA, 20 bp, Artificial
  CRISPR gRNA sequence
ttttttaggcaactgtaatg

SEQ ID NO: 325034 - DNA, 20 bp, Artificial
  CRISPR gRNA sequence
taatgcagtccttatctttg

SEQ ID NO: 325035 - DNA, 20 bp, Artificial
  CRISPR gRNA sequence
atgcagtccttatctttgtg

SEQ ID NO: 325036 - DNA, 20 bp, Artificial
  CRISPR gRNA sequence
ccttatctttgtggagctca

SEQ ID NO: 325037 - DNA, 20 bp, Artificial
  CRISPR gRNA sequence
tgtggagctcatggttaaat

SEQ ID NO: 325038 - DNA, 20 bp, Artificial
  CRISPR gRNA sequence
gtggagctcatggttaaatg

SEQ ID NO: 325039 - DNA, 20 bp, Artificial
  CRISPR gRNA sequence
gagctcatggttaaatgagg

SEQ ID NO: 325040 - DNA, 20 bp, Artificial
  CRISPR gRNA sequence
tcatggttaaatgaggaaga

SEQ ID NO: 325041 - DNA, 20 bp, Artificial
  CRISPR gRNA sequence
gacaaaaataattatgatcc

SEQ ID NO: 325042 - DNA, 20 bp, Artificial
  CRISPR gRNA sequence
tgctatgtgctaaaatatac

SEQ ID NO: 325043 - DNA, 20 bp, Artificial
  CRISPR gRNA sequence
aaaatatactggcctaaaca

SEQ ID NO: 325044 - DNA, 20 bp, Artificial
  CRISPR gRNA sequence
tggcctaaacaaagtattat

SEQ ID NO: 325045 - DNA, 20 bp, Artificial
  CRISPR gRNA sequence
ggcctaaacaaagtattatt

SEQ ID NO: 325046 - DNA, 20 bp, Artificial
  CRISPR gRNA sequence
cctaaacaaagtattattgg

SEQ ID NO: 325047 - DNA, 20 bp, Artificial
  CRISPR gRNA sequence
acaaagtattattgggagca

SEQ ID NO: 325048 - DNA, 20 bp, Artificial
  CRISPR gRNA sequence
attattgggagcatagaaat

SEQ ID NO: 325049 - DNA, 20 bp, Artificial
  CRISPR gRNA sequence
tattgggagcatagaaataa

SEQ ID NO: 325050 - DNA, 20 bp, Artificial
  CRISPR gRNA sequence
tagaaataagagtctttgtc

SEQ ID NO: 325051 - DNA, 20 bp, Artificial
  CRISPR gRNA sequence
aaataagagtctttgtctgg

SEQ ID NO: 325052 - DNA, 20 bp, Artificial
  CRISPR gRNA sequence
gagtctttgtctggtggtct

SEQ ID NO: 325053 - DNA, 20 bp, Artificial
  CRISPR gRNA sequence
gtcttggaaataaatatctc

SEQ ID NO: 325054 - DNA, 20 bp, Artificial
  CRISPR gRNA sequence
cttggaaataaatatctcaa

SEQ ID NO: 325055 - DNA, 20 bp, Artificial
  CRISPR gRNA sequence
tggaaataaatatctcaaga

SEQ ID NO: 325056 - DNA, 20 bp, Artificial
  CRISPR gRNA sequence
aaataaatatctcaagagag

SEQ ID NO: 325057 - DNA, 20 bp, Artificial
  CRISPR gRNA sequence
agagaagttgacatttaaaa

SEQ ID NO: 325058 - DNA, 20 bp, Artificial
  CRISPR gRNA sequence
gacatttaaaatggttcttg

SEQ ID NO: 325059 - DNA, 20 bp, Artificial
  CRISPR gRNA sequence
catttaaaatggttcttgaa

SEQ ID NO: 325060 - DNA, 20 bp, Artificial
  CRISPR gRNA sequence
atggttcttgaagagtgaat

SEQ ID NO: 325061 - DNA, 20 bp, Artificial
  CRISPR gRNA sequence
agtgaatgagaatttcttct

SEQ ID NO: 325062 - DNA, 20 bp, Artificial
  CRISPR gRNA sequence
tgagaatttcttctcagatt

SEQ ID NO: 325063 - DNA, 20 bp, Artificial
  CRISPR gRNA sequence
gagaatttcttctcagatta

SEQ ID NO: 325064 - DNA, 20 bp, Artificial
  CRISPR gRNA sequence
agaatttcttctcagattaa

SEQ ID NO: 325065 - DNA, 20 bp, Artificial
  CRISPR gRNA sequence
gaatttcttctcagattaag

SEQ ID NO: 325066 - DNA, 20 bp, Artificial
  CRISPR gRNA sequence
taaggggtaatcaaatattt

SEQ ID NO: 325067 - DNA, 20 bp, Artificial
  CRISPR gRNA sequence
taatcaaatattttagttca

SEQ ID NO: 325068 - DNA, 20 bp, Artificial
  CRISPR gRNA sequence
aatattttagttcatggtaa

SEQ ID NO: 325069 - DNA, 20 bp, Artificial
  CRISPR gRNA sequence
aacagaaataatgaaatgtg

SEQ ID NO: 325070 - DNA, 20 bp, Artificial
  CRISPR gRNA sequence
atgaaatgtgaagcatattc

SEQ ID NO: 325071 - DNA, 20 bp, Artificial
  CRISPR gRNA sequence
aaatgtgaagcatattctag

SEQ ID NO: 325072 - DNA, 20 bp, Artificial
  CRISPR gRNA sequence
tgaagcatattctagtagta

SEQ ID NO: 325073 - DNA, 20 bp, Artificial
  CRISPR gRNA sequence
catattctagtagtaaagaa

SEQ ID NO: 325074 - DNA, 20 bp, Artificial
  CRISPR gRNA sequence
attctagtagtaaagaacag

SEQ ID NO: 325075 - DNA, 20 bp, Artificial
  CRISPR gRNA sequence
agtaaagaacagaagtgtga

SEQ ID NO: 325076 - DNA, 20 bp, Artificial
  CRISPR gRNA sequence
gaacagaagtgtgaaagaaa

SEQ ID NO: 325077 - DNA, 20 bp, Artificial
  CRISPR gRNA sequence
gtgtgaaagaaatggccaaa

SEQ ID NO: 325078 - DNA, 20 bp, Artificial
  CRISPR gRNA sequence
aaagaaatggccaaaaagtt

SEQ ID NO: 325079 - DNA, 20 bp, Artificial
  CRISPR gRNA sequence
aatggccaaaaagttcagtg

SEQ ID NO: 325080 - DNA, 20 bp, Artificial
  CRISPR gRNA sequence
aaagttcagtgtggcttcaa

SEQ ID NO: 325081 - DNA, 20 bp, Artificial
  CRISPR gRNA sequence
ttcagtgtggcttcaataga

SEQ ID NO: 325082 - DNA, 20 bp, Artificial
  CRISPR gRNA sequence
ggcttcaatagatggcctat

SEQ ID NO: 325083 - DNA, 20 bp, Artificial
  CRISPR gRNA sequence
gatggcctatgagattgtga

SEQ ID NO: 325084 - DNA, 20 bp, Artificial
  CRISPR gRNA sequence
ttgtgaaagcattttgtgtc

SEQ ID NO: 325085 - DNA, 20 bp, Artificial
  CRISPR gRNA sequence
gaaagcattttgtgtcaagc

SEQ ID NO: 325086 - DNA, 20 bp, Artificial
  CRISPR gRNA sequence
tatattttaaaacaccttat

SEQ ID NO: 325087 - DNA, 20 bp, Artificial
  CRISPR gRNA sequence
ttaaaacaccttataagcaa

SEQ ID NO: 325088 - DNA, 20 bp, Artificial
  CRISPR gRNA sequence
tataagcaatagaacactaa

SEQ ID NO: 325089 - DNA, 20 bp, Artificial
  CRISPR gRNA sequence
taagcaatagaacactaata

SEQ ID NO: 325090 - DNA, 20 bp, Artificial
  CRISPR gRNA sequence
actaatagagacttttaaac

SEQ ID NO: 325091 - DNA, 20 bp, Artificial
  CRISPR gRNA sequence
ctaatagagacttttaaact

SEQ ID NO: 325092 - DNA, 20 bp, Artificial
  CRISPR gRNA sequence
taatagagacttttaaactg

SEQ ID NO: 325093 - DNA, 20 bp, Artificial
  CRISPR gRNA sequence
atagagacttttaaactggg

SEQ ID NO: 325094 - DNA, 20 bp, Artificial
  CRISPR gRNA sequence
gcttttctgaaacataattt

SEQ ID NO: 325095 - DNA, 20 bp, Artificial
  CRISPR gRNA sequence
cttttctgaaacataatttt

SEQ ID NO: 325096 - DNA, 20 bp, Artificial
  CRISPR gRNA sequence
tttctgaaacataattttgg

SEQ ID NO: 325097 - DNA, 20 bp, Artificial
  CRISPR gRNA sequence
ctgaaacataattttgggag

SEQ ID NO: 325098 - DNA, 20 bp, Artificial
  CRISPR gRNA sequence
acataattttgggagcagca

SEQ ID NO: 325099 - DNA, 20 bp, Artificial
  CRISPR gRNA sequence
ataattttgggagcagcatg

SEQ ID NO: 325100 - DNA, 20 bp, Artificial
  CRISPR gRNA sequence
taattttgggagcagcatgg

SEQ ID NO: 325101 - DNA, 20 bp, Artificial
  CRISPR gRNA sequence
attttgggagcagcatggag

SEQ ID NO: 325102 - DNA, 20 bp, Artificial
  CRISPR gRNA sequence
ttttgggagcagcatggagg

SEQ ID NO: 325103 - DNA, 20 bp, Artificial
  CRISPR gRNA sequence
tttgggagcagcatggagga

SEQ ID NO: 325104 - DNA, 20 bp, Artificial
  CRISPR gRNA sequence
ggagcagcatggaggaggga

SEQ ID NO: 325105 - DNA, 20 bp, Artificial
  CRISPR gRNA sequence
gagcagcatggaggagggat

SEQ ID NO: 325106 - DNA, 20 bp, Artificial
  CRISPR gRNA sequence
agcagcatggaggagggatg

SEQ ID NO: 325107 - DNA, 20 bp, Artificial
  CRISPR gRNA sequence
cagcatggaggagggatggg

SEQ ID NO: 325108 - DNA, 20 bp, Artificial
  CRISPR gRNA sequence
agcatggaggagggatgggg

SEQ ID NO: 325109 - DNA, 20 bp, Artificial
  CRISPR gRNA sequence
catggaggagggatggggag

SEQ ID NO: 325110 - DNA, 20 bp, Artificial
  CRISPR gRNA sequence
tggaggagggatggggagga

SEQ ID NO: 325111 - DNA, 20 bp, Artificial
  CRISPR gRNA sequence
gaggagggatggggaggaga

SEQ ID NO: 325112 - DNA, 20 bp, Artificial
  CRISPR gRNA sequence
gggatggggaggagagagat

SEQ ID NO: 325113 - DNA, 20 bp, Artificial
  CRISPR gRNA sequence
ggaggagagagatcagtatt

SEQ ID NO: 325114 - DNA, 20 bp, Artificial
  CRISPR gRNA sequence
ggagagagatcagtattgag

SEQ ID NO: 325115 - DNA, 20 bp, Artificial
  CRISPR gRNA sequence
gagagagatcagtattgaga

SEQ ID NO: 325116 - DNA, 20 bp, Artificial
  CRISPR gRNA sequence
gagatcagtattgagaaggc

SEQ ID NO: 325117 - DNA, 20 bp, Artificial
  CRISPR gRNA sequence
cagtattgagaaggccagtc

SEQ ID NO: 325118 - DNA, 20 bp, Artificial
  CRISPR gRNA sequence
gtattgagaaggccagtcaa

SEQ ID NO: 325119 - DNA, 20 bp, Artificial
  CRISPR gRNA sequence
tattgagaaggccagtcaag

SEQ ID NO: 325120 - DNA, 20 bp, Artificial
  CRISPR gRNA sequence
cagtcaagaggatgcttcca

SEQ ID NO: 325121 - DNA, 20 bp, Artificial
  CRISPR gRNA sequence
aagaggatgcttccacagat

SEQ ID NO: 325122 - DNA, 20 bp, Artificial
  CRISPR gRNA sequence
agaggatgcttccacagata

SEQ ID NO: 325123 - DNA, 20 bp, Artificial
  CRISPR gRNA sequence
gaggatgcttccacagataa

SEQ ID NO: 325124 - DNA, 20 bp, Artificial
  CRISPR gRNA sequence
gatgcttccacagataaggg

SEQ ID NO: 325125 - DNA, 20 bp, Artificial
  CRISPR gRNA sequence
agataagggaagacatgaaa

SEQ ID NO: 325126 - DNA, 20 bp, Artificial
  CRISPR gRNA sequence
gataagggaagacatgaaaa

SEQ ID NO: 325127 - DNA, 20 bp, Artificial
  CRISPR gRNA sequence
gggaagacatgaaaaaggtg

SEQ ID NO: 325128 - DNA, 20 bp, Artificial
  CRISPR gRNA sequence
gacatgaaaaaggtgtggat

SEQ ID NO: 325129 - DNA, 20 bp, Artificial
  CRISPR gRNA sequence
aaaaaggtgtggattggcaa

SEQ ID NO: 325130 - DNA, 20 bp, Artificial
  CRISPR gRNA sequence
aaaaggtgtggattggcaat

SEQ ID NO: 325131 - DNA, 20 bp, Artificial
  CRISPR gRNA sequence
gtgtggattggcaatgggaa

SEQ ID NO: 325132 - DNA, 20 bp, Artificial
  CRISPR gRNA sequence
gtggattggcaatgggaatg

SEQ ID NO: 325133 - DNA, 20 bp, Artificial
  CRISPR gRNA sequence
tggcaatgggaatggagaaa

SEQ ID NO: 325134 - DNA, 20 bp, Artificial
  CRISPR gRNA sequence
ggagaaaaagaattgaattt

SEQ ID NO: 325135 - DNA, 20 bp, Artificial
  CRISPR gRNA sequence
agaaaaagaattgaatttaa

SEQ ID NO: 325136 - DNA, 20 bp, Artificial
  CRISPR gRNA sequence
tgaatttaagagatattcat

SEQ ID NO: 325137 - DNA, 20 bp, Artificial
  CRISPR gRNA sequence
tttaagagatattcatgagc

SEQ ID NO: 325138 - DNA, 20 bp, Artificial
  CRISPR gRNA sequence
taagagatattcatgagctg

SEQ ID NO: 325139 - DNA, 20 bp, Artificial
  CRISPR gRNA sequence
attcatgagctggagtcaac

SEQ ID NO: 325140 - DNA, 20 bp, Artificial
  CRISPR gRNA sequence
gagctggagtcaactggact

SEQ ID NO: 325141 - DNA, 20 bp, Artificial
  CRISPR gRNA sequence
aactggacttggtgaccaat

SEQ ID NO: 325142 - DNA, 20 bp, Artificial
  CRISPR gRNA sequence
accaattggatgatgaaaat

SEQ ID NO: 325143 - DNA, 20 bp, Artificial
  CRISPR gRNA sequence
caattggatgatgaaaatca

SEQ ID NO: 325144 - DNA, 20 bp, Artificial
  CRISPR gRNA sequence
attggatgatgaaaatcaga

SEQ ID NO: 325145 - DNA, 20 bp, Artificial
  CRISPR gRNA sequence
tggatgatgaaaatcagaga

SEQ ID NO: 325146 - DNA, 20 bp, Artificial
  CRISPR gRNA sequence
ggatgatgaaaatcagagag

SEQ ID NO: 325147 - DNA, 20 bp, Artificial
  CRISPR gRNA sequence
tgatgaaaatcagagagagg

SEQ ID NO: 325148 - DNA, 20 bp, Artificial
  CRISPR gRNA sequence
aatcagagagaggaagaaat

SEQ ID NO: 325149 - DNA, 20 bp, Artificial
  CRISPR gRNA sequence
atcagagagaggaagaaatg

SEQ ID NO: 325150 - DNA, 20 bp, Artificial
  CRISPR gRNA sequence
agagagaggaagaaatgagg

SEQ ID NO: 325151 - DNA, 20 bp, Artificial
  CRISPR gRNA sequence
gaagaaatgaggaagactct

SEQ ID NO: 325152 - DNA, 20 bp, Artificial
  CRISPR gRNA sequence
aagaaatgaggaagactctg

SEQ ID NO: 325153 - DNA, 20 bp, Artificial
  CRISPR gRNA sequence
gaggaagactctgaggttcc

SEQ ID NO: 325154 - DNA, 20 bp, Artificial
  CRISPR gRNA sequence
aggaagactctgaggttcct

SEQ ID NO: 325155 - DNA, 20 bp, Artificial
  CRISPR gRNA sequence
ggaagactctgaggttccta

SEQ ID NO: 325156 - DNA, 20 bp, Artificial
  CRISPR gRNA sequence
gactctgaggttcctagggt

SEQ ID NO: 325157 - DNA, 20 bp, Artificial
  CRISPR gRNA sequence
tgaggttcctagggtcagac

SEQ ID NO: 325158 - DNA, 20 bp, Artificial
  CRISPR gRNA sequence
cagactagtgactccctgaa

SEQ ID NO: 325159 - DNA, 20 bp, Artificial
  CRISPR gRNA sequence
ctagtgactccctgaaaaga

SEQ ID NO: 325160 - DNA, 20 bp, Artificial
  CRISPR gRNA sequence
tagtgactccctgaaaagac

SEQ ID NO: 325161 - DNA, 20 bp, Artificial
  CRISPR gRNA sequence
agtgactccctgaaaagaca

SEQ ID NO: 325162 - DNA, 20 bp, Artificial
  CRISPR gRNA sequence
ctccctgaaaagacagggtt

SEQ ID NO: 325163 - DNA, 20 bp, Artificial
  CRISPR gRNA sequence
gaaaagacagggtttggatt

SEQ ID NO: 325164 - DNA, 20 bp, Artificial
  CRISPR gRNA sequence
ttggatttggtgaatgaata

SEQ ID NO: 325165 - DNA, 20 bp, Artificial
  CRISPR gRNA sequence
agtcacgtgccacttgacga

SEQ ID NO: 325166 - DNA, 20 bp, Artificial
  CRISPR gRNA sequence
gtcacgtgccacttgacgat

SEQ ID NO: 325167 - DNA, 20 bp, Artificial
  CRISPR gRNA sequence
tgacgatgggaatacattct

SEQ ID NO: 325168 - DNA, 20 bp, Artificial
  CRISPR gRNA sequence
cattctgagaaatgtgtcct

SEQ ID NO: 325169 - DNA, 20 bp, Artificial
  CRISPR gRNA sequence
tttgttgtgtgaacatcatc

SEQ ID NO: 325170 - DNA, 20 bp, Artificial
  CRISPR gRNA sequence
actgacgcaatgatgtctac

SEQ ID NO: 325171 - DNA, 20 bp, Artificial
  CRISPR gRNA sequence
acgcaatgatgtctactaga

SEQ ID NO: 325172 - DNA, 20 bp, Artificial
  CRISPR gRNA sequence
caatgatgtctactagatgg

SEQ ID NO: 325173 - DNA, 20 bp, Artificial
  CRISPR gRNA sequence
atgatgtctactagatggca

SEQ ID NO: 325174 - DNA, 20 bp, Artificial
  CRISPR gRNA sequence
gcagagcctactgcactacc

SEQ ID NO: 325175 - DNA, 20 bp, Artificial
  CRISPR gRNA sequence
cagagcctactgcactacct

SEQ ID NO: 325176 - DNA, 20 bp, Artificial
  CRISPR gRNA sequence
actgcactacctaggctatg

SEQ ID NO: 325177 - DNA, 20 bp, Artificial
  CRISPR gRNA sequence
tgcactacctaggctatgtg

SEQ ID NO: 325178 - DNA, 20 bp, Artificial
  CRISPR gRNA sequence
actacctaggctatgtggag

SEQ ID NO: 325179 - DNA, 20 bp, Artificial
  CRISPR gRNA sequence
gtggagtagcctattgcttc

SEQ ID NO: 325180 - DNA, 20 bp, Artificial
  CRISPR gRNA sequence
tggagtagcctattgcttct

SEQ ID NO: 325181 - DNA, 20 bp, Artificial
  CRISPR gRNA sequence
ttctaggctacaaacctgta

SEQ ID NO: 325182 - DNA, 20 bp, Artificial
  CRISPR gRNA sequence
tgttactgtactgaatactg

SEQ ID NO: 325183 - DNA, 20 bp, Artificial
  CRISPR gRNA sequence
gttactgtactgaatactgc

SEQ ID NO: 325184 - DNA, 20 bp, Artificial
  CRISPR gRNA sequence
gtactgaatactgcaggcca

SEQ ID NO: 325185 - DNA, 20 bp, Artificial
  CRISPR gRNA sequence
ctgaatactgcaggccatgg

SEQ ID NO: 325186 - DNA, 20 bp, Artificial
  CRISPR gRNA sequence
tgcaggccatggtagcacaa

SEQ ID NO: 325187 - DNA, 20 bp, Artificial
  CRISPR gRNA sequence
ttgtgtaactaaacacataa

SEQ ID NO: 325188 - DNA, 20 bp, Artificial
  CRISPR gRNA sequence
tgtgtaactaaacacataaa

SEQ ID NO: 325189 - DNA, 20 bp, Artificial
  CRISPR gRNA sequence
gtgtaactaaacacataaaa

SEQ ID NO: 325190 - DNA, 20 bp, Artificial
  CRISPR gRNA sequence
atttctgtattataatctta

SEQ ID NO: 325191 - DNA, 20 bp, Artificial
  CRISPR gRNA sequence
tttctgtattataatcttat

SEQ ID NO: 325192 - DNA, 20 bp, Artificial
  CRISPR gRNA sequence
tgggaccgccaccatatata

SEQ ID NO: 325193 - DNA, 20 bp, Artificial
  CRISPR gRNA sequence
tgaccaacatgtcatttatg

SEQ ID NO: 325194 - DNA, 20 bp, Artificial
  CRISPR gRNA sequence
atgcagcgcatgactgtact

SEQ ID NO: 325195 - DNA, 20 bp, Artificial
  CRISPR gRNA sequence
gcgcatgactgtactgagct

SEQ ID NO: 325196 - DNA, 20 bp, Artificial
  CRISPR gRNA sequence
tgactgtactgagctcagtt

SEQ ID NO: 325197 - DNA, 20 bp, Artificial
  CRISPR gRNA sequence
tgtactgagctcagtttgga

SEQ ID NO: 325198 - DNA, 20 bp, Artificial
  CRISPR gRNA sequence
gtactgagctcagtttggaa

SEQ ID NO: 325199 - DNA, 20 bp, Artificial
  CRISPR gRNA sequence
aaaggctatacatgatgtgt

SEQ ID NO: 325200 - DNA, 20 bp, Artificial
  CRISPR gRNA sequence
aaggctatacatgatgtgtt

SEQ ID NO: 325201 - DNA, 20 bp, Artificial
  CRISPR gRNA sequence
aggctatacatgatgtgtta

SEQ ID NO: 325202 - DNA, 20 bp, Artificial
  CRISPR gRNA sequence
atgatgtgttagggtaaaac

SEQ ID NO: 325203 - DNA, 20 bp, Artificial
  CRISPR gRNA sequence
tgtgttagggtaaaaccaga

SEQ ID NO: 325204 - DNA, 20 bp, Artificial
  CRISPR gRNA sequence
aaaccagatagtgatgttga

SEQ ID NO: 325205 - DNA, 20 bp, Artificial
  CRISPR gRNA sequence
aaccagatagtgatgttgaa

SEQ ID NO: 325206 - DNA, 20 bp, Artificial
  CRISPR gRNA sequence
tagtgatgttgaaaggaatt

SEQ ID NO: 325207 - DNA, 20 bp, Artificial
  CRISPR gRNA sequence
gttgaaaggaatttggaaac

SEQ ID NO: 325208 - DNA, 20 bp, Artificial
  CRISPR gRNA sequence
ttgaaaggaatttggaaaca

SEQ ID NO: 325209 - DNA, 20 bp, Artificial
  CRISPR gRNA sequence
ggaatttggaaacaaggaac

SEQ ID NO: 325210 - DNA, 20 bp, Artificial
  CRISPR gRNA sequence
atttggaaacaaggaactag

SEQ ID NO: 325211 - DNA, 20 bp, Artificial
  CRISPR gRNA sequence
gaaacaaggaactagaagtt

SEQ ID NO: 325212 - DNA, 20 bp, Artificial
  CRISPR gRNA sequence
aaacaaggaactagaagttt

SEQ ID NO: 325213 - DNA, 20 bp, Artificial
  CRISPR gRNA sequence
aaggaactagaagtttgggc

SEQ ID NO: 325214 - DNA, 20 bp, Artificial
  CRISPR gRNA sequence
ggaactagaagtttgggctg

SEQ ID NO: 325215 - DNA, 20 bp, Artificial
  CRISPR gRNA sequence
aactagaagtttgggctgga

SEQ ID NO: 325216 - DNA, 20 bp, Artificial
  CRISPR gRNA sequence
tttgggctggagagaaaatg

SEQ ID NO: 325217 - DNA, 20 bp, Artificial
  CRISPR gRNA sequence
ttgggctggagagaaaatgt

SEQ ID NO: 325218 - DNA, 20 bp, Artificial
  CRISPR gRNA sequence
ggagagaaaatgtgggctcc

SEQ ID NO: 325219 - DNA, 20 bp, Artificial
  CRISPR gRNA sequence
gagagaaaatgtgggctcct

SEQ ID NO: 325220 - DNA, 20 bp, Artificial
  CRISPR gRNA sequence
agagaaaatgtgggctcctg

SEQ ID NO: 325221 - DNA, 20 bp, Artificial
  CRISPR gRNA sequence
gagaaaatgtgggctcctgg

SEQ ID NO: 325222 - DNA, 20 bp, Artificial
  CRISPR gRNA sequence
aaaatgtgggctcctggggg

SEQ ID NO: 325223 - DNA, 20 bp, Artificial
  CRISPR gRNA sequence
gggctcctgggggtagacat

SEQ ID NO: 325224 - DNA, 20 bp, Artificial
  CRISPR gRNA sequence
gctcctgggggtagacatga

SEQ ID NO: 325225 - DNA, 20 bp, Artificial
  CRISPR gRNA sequence
ctgggggtagacatgagagc

SEQ ID NO: 325226 - DNA, 20 bp, Artificial
  CRISPR gRNA sequence
gggggtagacatgagagctg

SEQ ID NO: 325227 - DNA, 20 bp, Artificial
  CRISPR gRNA sequence
agacatgagagctggagcca

SEQ ID NO: 325228 - DNA, 20 bp, Artificial
  CRISPR gRNA sequence
gacatgagagctggagccat

SEQ ID NO: 325229 - DNA, 20 bp, Artificial
  CRISPR gRNA sequence
ctggagccataggtgcaaat

SEQ ID NO: 325230 - DNA, 20 bp, Artificial
  CRISPR gRNA sequence
gccataggtgcaaatgagtt

SEQ ID NO: 325231 - DNA, 20 bp, Artificial
  CRISPR gRNA sequence
ccataggtgcaaatgagttc

SEQ ID NO: 325232 - DNA, 20 bp, Artificial
  CRISPR gRNA sequence
taggtgcaaatgagttcagg

SEQ ID NO: 325233 - DNA, 20 bp, Artificial
  CRISPR gRNA sequence
aacaccctgtccatgtgccc

SEQ ID NO: 325234 - DNA, 20 bp, Artificial
  CRISPR gRNA sequence
acaccctgtccatgtgccca

SEQ ID NO: 325235 - DNA, 20 bp, Artificial
  CRISPR gRNA sequence
accctgtccatgtgcccaag

SEQ ID NO: 325236 - DNA, 20 bp, Artificial
  CRISPR gRNA sequence
tgtgcccaaggagttttgca

SEQ ID NO: 325237 - DNA, 20 bp, Artificial
  CRISPR gRNA sequence
gcccaaggagttttgcacag

SEQ ID NO: 325238 - DNA, 20 bp, Artificial
  CRISPR gRNA sequence
aggagttttgcacagtagct

SEQ ID NO: 325239 - DNA, 20 bp, Artificial
  CRISPR gRNA sequence
tttgcacagtagctgagcaa

SEQ ID NO: 325240 - DNA, 20 bp, Artificial
  CRISPR gRNA sequence
cacagtagctgagcaatggc

SEQ ID NO: 325241 - DNA, 20 bp, Artificial
  CRISPR gRNA sequence
ctgagcaatggcaagcaatg

SEQ ID NO: 325242 - DNA, 20 bp, Artificial
  CRISPR gRNA sequence
tgagcaatggcaagcaatgt

SEQ ID NO: 325243 - DNA, 20 bp, Artificial
  CRISPR gRNA sequence
tggcaagcaatgtgggtatt

SEQ ID NO: 325244 - DNA, 20 bp, Artificial
  CRISPR gRNA sequence
gcaagcaatgtgggtattca

SEQ ID NO: 325245 - DNA, 20 bp, Artificial
  CRISPR gRNA sequence
caagcaatgtgggtattcag

SEQ ID NO: 325246 - DNA, 20 bp, Artificial
  CRISPR gRNA sequence
aatgtgggtattcagaggtg

SEQ ID NO: 325247 - DNA, 20 bp, Artificial
  CRISPR gRNA sequence
cctctctccctcccactctg

SEQ ID NO: 325248 - DNA, 20 bp, Artificial
  CRISPR gRNA sequence
ctctccctcccactctgtgg

SEQ ID NO: 325249 - DNA, 20 bp, Artificial
  CRISPR gRNA sequence
ctccctcccactctgtggaa

SEQ ID NO: 325250 - DNA, 20 bp, Artificial
  CRISPR gRNA sequence
ccctcccactctgtggaaga

SEQ ID NO: 325251 - DNA, 20 bp, Artificial
  CRISPR gRNA sequence
cccactctgtggaagagagt

SEQ ID NO: 325252 - DNA, 20 bp, Artificial
  CRISPR gRNA sequence
ccactctgtggaagagagtt

SEQ ID NO: 325253 - DNA, 20 bp, Artificial
  CRISPR gRNA sequence
ttaatctcatatgatttccc

SEQ ID NO: 325254 - DNA, 20 bp, Artificial
  CRISPR gRNA sequence
atatgatttccctagtacaa

SEQ ID NO: 325255 - DNA, 20 bp, Artificial
  CRISPR gRNA sequence
agtacaatagtttcaaatca

SEQ ID NO: 325256 - DNA, 20 bp, Artificial
  CRISPR gRNA sequence
gtacaatagtttcaaatcaa

SEQ ID NO: 325257 - DNA, 20 bp, Artificial
  CRISPR gRNA sequence
gtttcaaatcaaaggcaatg

SEQ ID NO: 325258 - DNA, 20 bp, Artificial
  CRISPR gRNA sequence
gctttgtgaatattgataca

SEQ ID NO: 325259 - DNA, 20 bp, Artificial
  CRISPR gRNA sequence
acaaagttttataataccac

SEQ ID NO: 325260 - DNA, 20 bp, Artificial
  CRISPR gRNA sequence
caaagttttataataccact

SEQ ID NO: 325261 - DNA, 20 bp, Artificial
  CRISPR gRNA sequence
ggattttttcatttttcatg

SEQ ID NO: 325262 - DNA, 20 bp, Artificial
  CRISPR gRNA sequence
ttcatttttcatgaagaaat

SEQ ID NO: 325263 - DNA, 20 bp, Artificial
  CRISPR gRNA sequence
atgaagaaatcagttttaac

SEQ ID NO: 325264 - DNA, 20 bp, Artificial
  CRISPR gRNA sequence
tgaagaaatcagttttaact

SEQ ID NO: 325265 - DNA, 20 bp, Artificial
  CRISPR gRNA sequence
aagaaatcagttttaactag

SEQ ID NO: 325266 - DNA, 20 bp, Artificial
  CRISPR gRNA sequence
tttttcttattatacacact

SEQ ID NO: 325267 - DNA, 20 bp, Artificial
  CRISPR gRNA sequence
tttcttattatacacactta

SEQ ID NO: 325268 - DNA, 20 bp, Artificial
  CRISPR gRNA sequence
tatacacacttagagaacca

SEQ ID NO: 325269 - DNA, 20 bp, Artificial
  CRISPR gRNA sequence
atacacacttagagaaccaa

SEQ ID NO: 325270 - DNA, 20 bp, Artificial
  CRISPR gRNA sequence
tacacacttagagaaccaaa

SEQ ID NO: 325271 - DNA, 20 bp, Artificial
  CRISPR gRNA sequence
gggttgttttgtacccccta

SEQ ID NO: 325272 - DNA, 20 bp, Artificial
  CRISPR gRNA sequence
gttgttttgtaccccctatg

SEQ ID NO: 325273 - DNA, 20 bp, Artificial
  CRISPR gRNA sequence
gtaccccctatggagttcct

SEQ ID NO: 325274 - DNA, 20 bp, Artificial
  CRISPR gRNA sequence
accccctatggagttccttg

SEQ ID NO: 325275 - DNA, 20 bp, Artificial
  CRISPR gRNA sequence
cccctatggagttccttgga

SEQ ID NO: 325276 - DNA, 20 bp, Artificial
  CRISPR gRNA sequence
cacattgtgtgtgtgttcat

SEQ ID NO: 325277 - DNA, 20 bp, Artificial
  CRISPR gRNA sequence
tgtgttcatgagcactcttt

SEQ ID NO: 325278 - DNA, 20 bp, Artificial
  CRISPR gRNA sequence
ttttttttttctccaaatgt

SEQ ID NO: 325279 - DNA, 20 bp, Artificial
  CRISPR gRNA sequence
tttttttttctccaaatgtt

SEQ ID NO: 325280 - DNA, 20 bp, Artificial
  CRISPR gRNA sequence
ttctccaaatgttaggcatt

SEQ ID NO: 325281 - DNA, 20 bp, Artificial
  CRISPR gRNA sequence
tctccaaatgttaggcattt

SEQ ID NO: 325282 - DNA, 20 bp, Artificial
  CRISPR gRNA sequence
caaatgttaggcatttaggt

SEQ ID NO: 325283 - DNA, 20 bp, Artificial
  CRISPR gRNA sequence
gttaggcatttaggttagat

SEQ ID NO: 325284 - DNA, 20 bp, Artificial
  CRISPR gRNA sequence
ttaggcatttaggttagatt

SEQ ID NO: 325285 - DNA, 20 bp, Artificial
  CRISPR gRNA sequence
ccttgcctcaattacttctt

SEQ ID NO: 325286 - DNA, 20 bp, Artificial
  CRISPR gRNA sequence
tcaattacttctttagatta

SEQ ID NO: 325287 - DNA, 20 bp, Artificial
  CRISPR gRNA sequence
caattacttctttagattat

SEQ ID NO: 325288 - DNA, 20 bp, Artificial
  CRISPR gRNA sequence
agattatgggtgcctttgaa

SEQ ID NO: 325289 - DNA, 20 bp, Artificial
  CRISPR gRNA sequence
gtgcctttgaatagcaatgt

SEQ ID NO: 325290 - DNA, 20 bp, Artificial
  CRISPR gRNA sequence
tttgaatagcaatgtaagtt

SEQ ID NO: 325291 - DNA, 20 bp, Artificial
  CRISPR gRNA sequence
atatataaaaatctactaac

SEQ ID NO: 325292 - DNA, 20 bp, Artificial
  CRISPR gRNA sequence
tatataaaaatctactaacc

SEQ ID NO: 325293 - DNA, 20 bp, Artificial
  CRISPR gRNA sequence
atataaaaatctactaacca

SEQ ID NO: 325294 - DNA, 20 bp, Artificial
  CRISPR gRNA sequence
atctactaaccagggatcta

SEQ ID NO: 325295 - DNA, 20 bp, Artificial
  CRISPR gRNA sequence
tctactaaccagggatctaa

SEQ ID NO: 325296 - DNA, 20 bp, Artificial
  CRISPR gRNA sequence
aaccagggatctaaaggttt

SEQ ID NO: 325297 - DNA, 20 bp, Artificial
  CRISPR gRNA sequence
agggatctaaaggttttagc

SEQ ID NO: 325298 - DNA, 20 bp, Artificial
  CRISPR gRNA sequence
gatctaaaggttttagctgg

SEQ ID NO: 325299 - DNA, 20 bp, Artificial
  CRISPR gRNA sequence
gttttagctggtagactcat

SEQ ID NO: 325300 - DNA, 20 bp, Artificial
  CRISPR gRNA sequence
acatgacattgcttttatga

SEQ ID NO: 325301 - DNA, 20 bp, Artificial
  CRISPR gRNA sequence
catgacattgcttttatgaa

SEQ ID NO: 325302 - DNA, 20 bp, Artificial
  CRISPR gRNA sequence
acattgcttttatgaaaggt

SEQ ID NO: 325303 - DNA, 20 bp, Artificial
  CRISPR gRNA sequence
gcttttatgaaaggtgagaa

SEQ ID NO: 325304 - DNA, 20 bp, Artificial
  CRISPR gRNA sequence
tttatgaaaggtgagaaaag

SEQ ID NO: 325305 - DNA, 20 bp, Artificial
  CRISPR gRNA sequence
atgaaaggtgagaaaagtgg

SEQ ID NO: 325306 - DNA, 20 bp, Artificial
  CRISPR gRNA sequence
tgaaaggtgagaaaagtggt

SEQ ID NO: 325307 - DNA, 20 bp, Artificial
  CRISPR gRNA sequence
aaggtgagaaaagtggtagg

SEQ ID NO: 325308 - DNA, 20 bp, Artificial
  CRISPR gRNA sequence
agtacttttttttttaatgc

SEQ ID NO: 325309 - DNA, 20 bp, Artificial
  CRISPR gRNA sequence
tttttaatgccagaatttct

SEQ ID NO: 325310 - DNA, 20 bp, Artificial
  CRISPR gRNA sequence
aatataaacattgcaatttt

SEQ ID NO: 325311 - DNA, 20 bp, Artificial
  CRISPR gRNA sequence
tcacattcatgtgctgtgct

SEQ ID NO: 325312 - DNA, 20 bp, Artificial
  CRISPR gRNA sequence
cacttatcattgtttgatta

SEQ ID NO: 325313 - DNA, 20 bp, Artificial
  CRISPR gRNA sequence
ttacagaaaatgtgtttaat

SEQ ID NO: 325314 - DNA, 20 bp, Artificial
  CRISPR gRNA sequence
actatcaatgattacaaact

SEQ ID NO: 325315 - DNA, 20 bp, Artificial
  CRISPR gRNA sequence
ctatcaatgattacaaactc

SEQ ID NO: 325316 - DNA, 20 bp, Artificial
  CRISPR gRNA sequence
tcttatctttccatcactct

SEQ ID NO: 325317 - DNA, 20 bp, Artificial
  CRISPR gRNA sequence
ccatcactctgagacctttg

SEQ ID NO: 325318 - DNA, 20 bp, Artificial
  CRISPR gRNA sequence
atcactctgagacctttgtg

SEQ ID NO: 325319 - DNA, 20 bp, Artificial
  CRISPR gRNA sequence
tcactctgagacctttgtgg

SEQ ID NO: 325320 - DNA, 20 bp, Artificial
  CRISPR gRNA sequence
gagacctttgtggaggtttg

SEQ ID NO: 325321 - DNA, 20 bp, Artificial
  CRISPR gRNA sequence
cctttgtggaggtttgtggt

SEQ ID NO: 325322 - DNA, 20 bp, Artificial
  CRISPR gRNA sequence
ttgtggaggtttgtggttag

SEQ ID NO: 325323 - DNA, 20 bp, Artificial
  CRISPR gRNA sequence
aggtttgtggttagaagtct

SEQ ID NO: 325324 - DNA, 20 bp, Artificial
  CRISPR gRNA sequence
gtggttagaagtctgagtta

SEQ ID NO: 325325 - DNA, 20 bp, Artificial
  CRISPR gRNA sequence
tatcttgcacgctctgcact

SEQ ID NO: 325326 - DNA, 20 bp, Artificial
  CRISPR gRNA sequence
cttgcacgctctgcactgag

SEQ ID NO: 325327 - DNA, 20 bp, Artificial
  CRISPR gRNA sequence
ttgcacgctctgcactgagt

SEQ ID NO: 325328 - DNA, 20 bp, Artificial
  CRISPR gRNA sequence
ggttctttaaatgtttcctc

SEQ ID NO: 325329 - DNA, 20 bp, Artificial
  CRISPR gRNA sequence
ttctttaaatgtttcctcca

SEQ ID NO: 325330 - DNA, 20 bp, Artificial
  CRISPR gRNA sequence
tctttaaatgtttcctccag

SEQ ID NO: 325331 - DNA, 20 bp, Artificial
  CRISPR gRNA sequence
tcctccagaggattttcaac

SEQ ID NO: 325332 - DNA, 20 bp, Artificial
  CRISPR gRNA sequence
cctccagaggattttcaacc

SEQ ID NO: 325333 - DNA, 20 bp, Artificial
  CRISPR gRNA sequence
gaacaatacaactgcttgca

SEQ ID NO: 325334 - DNA, 20 bp, Artificial
  CRISPR gRNA sequence
acaatacaactgcttgcaaa

SEQ ID NO: 325335 - DNA, 20 bp, Artificial
  CRISPR gRNA sequence
caactgcttgcaaagagtcc

SEQ ID NO: 325336 - DNA, 20 bp, Artificial
  CRISPR gRNA sequence
ctgcttgcaaagagtcccag

SEQ ID NO: 325337 - DNA, 20 bp, Artificial
  CRISPR gRNA sequence
tgcttgcaaagagtcccagc

SEQ ID NO: 325338 - DNA, 20 bp, Artificial
  CRISPR gRNA sequence
tgcaaagagtcccagcagga

SEQ ID NO: 325339 - DNA, 20 bp, Artificial
  CRISPR gRNA sequence
gcaaagagtcccagcaggat

SEQ ID NO: 325340 - DNA, 20 bp, Artificial
  CRISPR gRNA sequence
gagtcccagcaggatgggtc

SEQ ID NO: 325341 - DNA, 20 bp, Artificial
  CRISPR gRNA sequence
agtcccagcaggatgggtct

SEQ ID NO: 325342 - DNA, 20 bp, Artificial
  CRISPR gRNA sequence
agcaggatgggtctgggcat

SEQ ID NO: 325343 - DNA, 20 bp, Artificial
  CRISPR gRNA sequence
tgggcatgagcatcttatac

SEQ ID NO: 325344 - DNA, 20 bp, Artificial
  CRISPR gRNA sequence
catcttatactggtgaaatg

SEQ ID NO: 325345 - DNA, 20 bp, Artificial
  CRISPR gRNA sequence
cttatactggtgaaatgaag

SEQ ID NO: 325346 - DNA, 20 bp, Artificial
  CRISPR gRNA sequence
actggtgaaatgaagtagtc

SEQ ID NO: 325347 - DNA, 20 bp, Artificial
  CRISPR gRNA sequence
tgaagtagtccagatattaa

SEQ ID NO: 325348 - DNA, 20 bp, Artificial
  CRISPR gRNA sequence
aaatgaactcatctgcacta

SEQ ID NO: 325349 - DNA, 20 bp, Artificial
  CRISPR gRNA sequence
ctgcactatagtgcaattct

SEQ ID NO: 325350 - DNA, 20 bp, Artificial
  CRISPR gRNA sequence
tgcactatagtgcaattctc

SEQ ID NO: 325351 - DNA, 20 bp, Artificial
  CRISPR gRNA sequence
caggtgaatgaccttttctt

SEQ ID NO: 325352 - DNA, 20 bp, Artificial
  CRISPR gRNA sequence
ttcttcagaaattttcttaa

SEQ ID NO: 325353 - DNA, 20 bp, Artificial
  CRISPR gRNA sequence
ttttcttaatagtcccccaa

SEQ ID NO: 325354 - DNA, 20 bp, Artificial
  CRISPR gRNA sequence
tcttaatagtcccccaaaag

SEQ ID NO: 325355 - DNA, 20 bp, Artificial
  CRISPR gRNA sequence
taatagtcccccaaaagaag

SEQ ID NO: 325356 - DNA, 20 bp, Artificial
  CRISPR gRNA sequence
ttataaattttgaaaaccta

SEQ ID NO: 325357 - DNA, 20 bp, Artificial
  CRISPR gRNA sequence
ataaattttgaaaacctaaa

SEQ ID NO: 325358 - DNA, 20 bp, Artificial
  CRISPR gRNA sequence
taaagagatcacttaatata

SEQ ID NO: 325359 - DNA, 20 bp, Artificial
  CRISPR gRNA sequence
tattttactcttgaaaacat

SEQ ID NO: 325360 - DNA, 20 bp, Artificial
  CRISPR gRNA sequence
cattagtctattgatatcaa

SEQ ID NO: 325361 - DNA, 20 bp, Artificial
  CRISPR gRNA sequence
tattattattattatttttt

SEQ ID NO: 325362 - DNA, 20 bp, Artificial
  CRISPR gRNA sequence
attattattattttttgaga

SEQ ID NO: 325363 - DNA, 20 bp, Artificial
  CRISPR gRNA sequence
tattattattttttgagacg

SEQ ID NO: 325364 - DNA, 20 bp, Artificial
  CRISPR gRNA sequence
acggagtcttgctctgttgc

SEQ ID NO: 325365 - DNA, 20 bp, Artificial
  CRISPR gRNA sequence
cggagtcttgctctgttgcc

SEQ ID NO: 325366 - DNA, 20 bp, Artificial
  CRISPR gRNA sequence
gtcttgctctgttgccaggc

SEQ ID NO: 325367 - DNA, 20 bp, Artificial
  CRISPR gRNA sequence
cttgctctgttgccaggctg

SEQ ID NO: 325368 - DNA, 20 bp, Artificial
  CRISPR gRNA sequence
tctgttgccaggctggagtg

SEQ ID NO: 325369 - DNA, 20 bp, Artificial
  CRISPR gRNA sequence
gttgccaggctggagtgcag

SEQ ID NO: 325370 - DNA, 20 bp, Artificial
  CRISPR gRNA sequence
ggagtgcagtggtgcaatct

SEQ ID NO: 325371 - DNA, 20 bp, Artificial
  CRISPR gRNA sequence
cactgcaacctctgactccc

SEQ ID NO: 325372 - DNA, 20 bp, Artificial
  CRISPR gRNA sequence
aacctctgactccctggttc

SEQ ID NO: 325373 - DNA, 20 bp, Artificial
  CRISPR gRNA sequence
ttcaagcgattctcctgcct

SEQ ID NO: 325374 - DNA, 20 bp, Artificial
  CRISPR gRNA sequence
ttctcctgcctcagcctcct

SEQ ID NO: 325375 - DNA, 20 bp, Artificial
  CRISPR gRNA sequence
tcctgcctcagcctcctgag

SEQ ID NO: 325376 - DNA, 20 bp, Artificial
  CRISPR gRNA sequence
gcctcagcctcctgagtagc

SEQ ID NO: 325377 - DNA, 20 bp, Artificial
  CRISPR gRNA sequence
cctcagcctcctgagtagct

SEQ ID NO: 325378 - DNA, 20 bp, Artificial
  CRISPR gRNA sequence
ctcctgagtagctgggatta

SEQ ID NO: 325379 - DNA, 20 bp, Artificial
  CRISPR gRNA sequence
tcctgagtagctgggattac

SEQ ID NO: 325380 - DNA, 20 bp, Artificial
  CRISPR gRNA sequence
caggcacacaccaccacgcc

SEQ ID NO: 325381 - DNA, 20 bp, Artificial
  CRISPR gRNA sequence
ccagctaatttttatattat

SEQ ID NO: 325382 - DNA, 20 bp, Artificial
  CRISPR gRNA sequence
gctaatttttatattattag

SEQ ID NO: 325383 - DNA, 20 bp, Artificial
  CRISPR gRNA sequence
taatttttatattattagta

SEQ ID NO: 325384 - DNA, 20 bp, Artificial
  CRISPR gRNA sequence
ttttatattattagtagaga

SEQ ID NO: 325385 - DNA, 20 bp, Artificial
  CRISPR gRNA sequence
ttatattattagtagagacg

SEQ ID NO: 325386 - DNA, 20 bp, Artificial
  CRISPR gRNA sequence
gagacggagtttcaccatgt

SEQ ID NO: 325387 - DNA, 20 bp, Artificial
  CRISPR gRNA sequence
cggagtttcaccatgttggc

SEQ ID NO: 325388 - DNA, 20 bp, Artificial
  CRISPR gRNA sequence
ggagtttcaccatgttggcc

SEQ ID NO: 325389 - DNA, 20 bp, Artificial
  CRISPR gRNA sequence
tttcaccatgttggccagga

SEQ ID NO: 325390 - DNA, 20 bp, Artificial
  CRISPR gRNA sequence
acctcgtgatcctcctgcct

SEQ ID NO: 325391 - DNA, 20 bp, Artificial
  CRISPR gRNA sequence
cctcctgcctcggcctccca

SEQ ID NO: 325392 - DNA, 20 bp, Artificial
  CRISPR gRNA sequence
gcctcggcctcccaaagtgc

SEQ ID NO: 325393 - DNA, 20 bp, Artificial
  CRISPR gRNA sequence
cctcggcctcccaaagtgct

SEQ ID NO: 325394 - DNA, 20 bp, Artificial
  CRISPR gRNA sequence
ctcccaaagtgctgggatta

SEQ ID NO: 325395 - DNA, 20 bp, Artificial
  CRISPR gRNA sequence
tcccaaagtgctgggattac

SEQ ID NO: 325396 - DNA, 20 bp, Artificial
  CRISPR gRNA sequence
cccaaagtgctgggattaca

SEQ ID NO: 325397 - DNA, 20 bp, Artificial
  CRISPR gRNA sequence
aagtgctgggattacagggc

SEQ ID NO: 325398 - DNA, 20 bp, Artificial
  CRISPR gRNA sequence
acagggcgagtcactgcgcc

SEQ ID NO: 325399 - DNA, 20 bp, Artificial
  CRISPR gRNA sequence
cggcctataaaaattattgt

SEQ ID NO: 325400 - DNA, 20 bp, Artificial
  CRISPR gRNA sequence
cctataaaaattattgttag

SEQ ID NO: 325401 - DNA, 20 bp, Artificial
  CRISPR gRNA sequence
ataaaaattattgttagcag

SEQ ID NO: 325402 - DNA, 20 bp, Artificial
  CRISPR gRNA sequence
ttattgttagcagcagttaa

SEQ ID NO: 325403 - DNA, 20 bp, Artificial
  CRISPR gRNA sequence
tagcagcagttaacagtctt

SEQ ID NO: 325404 - DNA, 20 bp, Artificial
  CRISPR gRNA sequence
taacagtcttgagcctctac

SEQ ID NO: 325405 - DNA, 20 bp, Artificial
  CRISPR gRNA sequence
aacagtcttgagcctctact

SEQ ID NO: 325406 - DNA, 20 bp, Artificial
  CRISPR gRNA sequence
agtcttgagcctctactggg

SEQ ID NO: 325407 - DNA, 20 bp, Artificial
  CRISPR gRNA sequence
ctgggaagaatatgccctgt

SEQ ID NO: 325408 - DNA, 20 bp, Artificial
  CRISPR gRNA sequence
agaatatgccctgttagaca

SEQ ID NO: 325409 - DNA, 20 bp, Artificial
  CRISPR gRNA sequence
acacagtattctatgtgatg

SEQ ID NO: 325410 - DNA, 20 bp, Artificial
  CRISPR gRNA sequence
tctatgtgatgaagaaaata

SEQ ID NO: 325411 - DNA, 20 bp, Artificial
  CRISPR gRNA sequence
aaaatatagtacctgttctc

SEQ ID NO: 325412 - DNA, 20 bp, Artificial
  CRISPR gRNA sequence
tctccagactgattataatc

SEQ ID NO: 325413 - DNA, 20 bp, Artificial
  CRISPR gRNA sequence
ctccagactgattataatct

SEQ ID NO: 325414 - DNA, 20 bp, Artificial
  CRISPR gRNA sequence
tccagactgattataatcta

SEQ ID NO: 325415 - DNA, 20 bp, Artificial
  CRISPR gRNA sequence
aatctagggtttccaataaa

SEQ ID NO: 325416 - DNA, 20 bp, Artificial
  CRISPR gRNA sequence
ggtttccaataaaaagtaaa

SEQ ID NO: 325417 - DNA, 20 bp, Artificial
  CRISPR gRNA sequence
caataaaaagtaaacagata

SEQ ID NO: 325418 - DNA, 20 bp, Artificial
  CRISPR gRNA sequence
taaaaagtaaacagatatgg

SEQ ID NO: 325419 - DNA, 20 bp, Artificial
  CRISPR gRNA sequence
aaaacctcatgtttaatatt

SEQ ID NO: 325420 - DNA, 20 bp, Artificial
  CRISPR gRNA sequence
atgtttaatattcagatttt

SEQ ID NO: 325421 - DNA, 20 bp, Artificial
  CRISPR gRNA sequence
cagattttaagactcatcac

SEQ ID NO: 325422 - DNA, 20 bp, Artificial
  CRISPR gRNA sequence
agattttaagactcatcacc

SEQ ID NO: 325423 - DNA, 20 bp, Artificial
  CRISPR gRNA sequence
aagactcatcaccaggatcc

SEQ ID NO: 325424 - DNA, 20 bp, Artificial
  CRISPR gRNA sequence
catattcctttttgtgattt

SEQ ID NO: 325425 - DNA, 20 bp, Artificial
  CRISPR gRNA sequence
tgtgattttagtaacatatt

SEQ ID NO: 325426 - DNA, 20 bp, Artificial
  CRISPR gRNA sequence
agtaacatattaagtgctaa

SEQ ID NO: 325427 - DNA, 20 bp, Artificial
  CRISPR gRNA sequence
tattaagtgctaaaagatat

SEQ ID NO: 325428 - DNA, 20 bp, Artificial
  CRISPR gRNA sequence
gctgtgtttataaaacatct

SEQ ID NO: 325429 - DNA, 20 bp, Artificial
  CRISPR gRNA sequence
tataaaacatcttggtatat

SEQ ID NO: 325430 - DNA, 20 bp, Artificial
  CRISPR gRNA sequence
tggtatattagaacaaccat

SEQ ID NO: 325431 - DNA, 20 bp, Artificial
  CRISPR gRNA sequence
tattagaacaaccattggtc

SEQ ID NO: 325432 - DNA, 20 bp, Artificial
  CRISPR gRNA sequence
attagaacaaccattggtcc

SEQ ID NO: 325433 - DNA, 20 bp, Artificial
  CRISPR gRNA sequence
ttagaacaaccattggtcca

SEQ ID NO: 325434 - DNA, 20 bp, Artificial
  CRISPR gRNA sequence
tagaacaaccattggtccag

SEQ ID NO: 325435 - DNA, 20 bp, Artificial
  CRISPR gRNA sequence
tggtccaggggttcttgtcc

SEQ ID NO: 325436 - DNA, 20 bp, Artificial
  CRISPR gRNA sequence
ttcttgtcctggtcatatat

SEQ ID NO: 325437 - DNA, 20 bp, Artificial
  CRISPR gRNA sequence
tcttgtcctggtcatatatt

SEQ ID NO: 325438 - DNA, 20 bp, Artificial
  CRISPR gRNA sequence
catatattgggcaaatgtaa

SEQ ID NO: 325439 - DNA, 20 bp, Artificial
  CRISPR gRNA sequence
caaatgtaatggctgcgctt

SEQ ID NO: 325440 - DNA, 20 bp, Artificial
  CRISPR gRNA sequence
aaatgtaatggctgcgcttt

SEQ ID NO: 325441 - DNA, 20 bp, Artificial
  CRISPR gRNA sequence
ggctgcgctttgggacatcc

SEQ ID NO: 325442 - DNA, 20 bp, Artificial
  CRISPR gRNA sequence
gcgctttgggacatccaagt

SEQ ID NO: 325443 - DNA, 20 bp, Artificial
  CRISPR gRNA sequence
gggacatccaagtgagcaac

SEQ ID NO: 325444 - DNA, 20 bp, Artificial
  CRISPR gRNA sequence
ggacatccaagtgagcaacc

SEQ ID NO: 325445 - DNA, 20 bp, Artificial
  CRISPR gRNA sequence
aaccaggtttgttgctcact

SEQ ID NO: 325446 - DNA, 20 bp, Artificial
  CRISPR gRNA sequence
aggtttgttgctcacttgga

SEQ ID NO: 325447 - DNA, 20 bp, Artificial
  CRISPR gRNA sequence
ttgctcacttggatggaaca

SEQ ID NO: 325448 - DNA, 20 bp, Artificial
  CRISPR gRNA sequence
caaagttgtcctgccctcca

SEQ ID NO: 325449 - DNA, 20 bp, Artificial
  CRISPR gRNA sequence
cctgccctccacagacatat

SEQ ID NO: 325450 - DNA, 20 bp, Artificial
  CRISPR gRNA sequence
tgccctccacagacatataa

SEQ ID NO: 325451 - DNA, 20 bp, Artificial
  CRISPR gRNA sequence
tccacagacatataagagcc

SEQ ID NO: 325452 - DNA, 20 bp, Artificial
  CRISPR gRNA sequence
cacagacatataagagccaa

SEQ ID NO: 325453 - DNA, 20 bp, Artificial
  CRISPR gRNA sequence
gaattatcaactgtctaaat

SEQ ID NO: 325454 - DNA, 20 bp, Artificial
  CRISPR gRNA sequence
taaataagtatttatgaacc

SEQ ID NO: 325455 - DNA, 20 bp, Artificial
  CRISPR gRNA sequence
ataagtatttatgaacccag

SEQ ID NO: 325456 - DNA, 20 bp, Artificial
  CRISPR gRNA sequence
atgaacccagtggatatttg

SEQ ID NO: 325457 - DNA, 20 bp, Artificial
  CRISPR gRNA sequence
tgaacccagtggatatttga

SEQ ID NO: 325458 - DNA, 20 bp, Artificial
  CRISPR gRNA sequence
ccagtggatatttgaaggta

SEQ ID NO: 325459 - DNA, 20 bp, Artificial
  CRISPR gRNA sequence
tggatatttgaaggtaaaga

SEQ ID NO: 325460 - DNA, 20 bp, Artificial
  CRISPR gRNA sequence
gtaaagaaagtttttcttta

SEQ ID NO: 325461 - DNA, 20 bp, Artificial
  CRISPR gRNA sequence
gaaagtttttctttaaagct

SEQ ID NO: 325462 - DNA, 20 bp, Artificial
  CRISPR gRNA sequence
gtttttctttaaagctcaga

SEQ ID NO: 325463 - DNA, 20 bp, Artificial
  CRISPR gRNA sequence
ctcagacagataatttccat

SEQ ID NO: 325464 - DNA, 20 bp, Artificial
  CRISPR gRNA sequence
tccattagaacatgacatct

SEQ ID NO: 325465 - DNA, 20 bp, Artificial
  CRISPR gRNA sequence
ttagaacatgacatctcagt

SEQ ID NO: 325466 - DNA, 20 bp, Artificial
  CRISPR gRNA sequence
tagaacatgacatctcagtt

SEQ ID NO: 325467 - DNA, 20 bp, Artificial
  CRISPR gRNA sequence
agaacatgacatctcagttg

SEQ ID NO: 325468 - DNA, 20 bp, Artificial
  CRISPR gRNA sequence
acatgacatctcagttgggg

SEQ ID NO: 325469 - DNA, 20 bp, Artificial
  CRISPR gRNA sequence
tatcttcatacacttgtttc

SEQ ID NO: 325470 - DNA, 20 bp, Artificial
  CRISPR gRNA sequence
cttcatacacttgtttccag

SEQ ID NO: 325471 - DNA, 20 bp, Artificial
  CRISPR gRNA sequence
tacacttgtttccagaagaa

SEQ ID NO: 325472 - DNA, 20 bp, Artificial
  CRISPR gRNA sequence
ccagaagaaaagcaataata

SEQ ID NO: 325473 - DNA, 20 bp, Artificial
  CRISPR gRNA sequence
agaaaagcaataatatggca

SEQ ID NO: 325474 - DNA, 20 bp, Artificial
  CRISPR gRNA sequence
taatatggcatagctaactc

SEQ ID NO: 325475 - DNA, 20 bp, Artificial
  CRISPR gRNA sequence
aatatggcatagctaactct

SEQ ID NO: 325476 - DNA, 20 bp, Artificial
  CRISPR gRNA sequence
ctaactctgggatcatgccc

SEQ ID NO: 325477 - DNA, 20 bp, Artificial
  CRISPR gRNA sequence
tgggatcatgccccagctat

SEQ ID NO: 325478 - DNA, 20 bp, Artificial
  CRISPR gRNA sequence
agctatgagctatgtaatcc

SEQ ID NO: 325479 - DNA, 20 bp, Artificial
  CRISPR gRNA sequence
gctatgagctatgtaatcct

SEQ ID NO: 325480 - DNA, 20 bp, Artificial
  CRISPR gRNA sequence
tgagctatgtaatcctgggc

SEQ ID NO: 325481 - DNA, 20 bp, Artificial
  CRISPR gRNA sequence
ctatgtaatcctgggcaaga

SEQ ID NO: 325482 - DNA, 20 bp, Artificial
  CRISPR gRNA sequence
ggcaagatagtcaccttttc

SEQ ID NO: 325483 - DNA, 20 bp, Artificial
  CRISPR gRNA sequence
atagtcaccttttctggctc

SEQ ID NO: 325484 - DNA, 20 bp, Artificial
  CRISPR gRNA sequence
tttaatttgataaatgcaaa

SEQ ID NO: 325485 - DNA, 20 bp, Artificial
  CRISPR gRNA sequence
aaatggaaaatgcaaaatga

SEQ ID NO: 325486 - DNA, 20 bp, Artificial
  CRISPR gRNA sequence
aatggaaaatgcaaaatgaa

SEQ ID NO: 325487 - DNA, 20 bp, Artificial
  CRISPR gRNA sequence
aaggtttaacttgtcatttc

SEQ ID NO: 325488 - DNA, 20 bp, Artificial
  CRISPR gRNA sequence
gtttaacttgtcatttctag

SEQ ID NO: 325489 - DNA, 20 bp, Artificial
  CRISPR gRNA sequence
gtcatttctagaagcccttt

SEQ ID NO: 325490 - DNA, 20 bp, Artificial
  CRISPR gRNA sequence
aatcctgtgcttcatctcct

SEQ ID NO: 325491 - DNA, 20 bp, Artificial
  CRISPR gRNA sequence
catccaataaatactgattg

SEQ ID NO: 325492 - DNA, 20 bp, Artificial
  CRISPR gRNA sequence
gattgcagcttacaacacac

SEQ ID NO: 325493 - DNA, 20 bp, Artificial
  CRISPR gRNA sequence
attgcagcttacaacacacc

SEQ ID NO: 325494 - DNA, 20 bp, Artificial
  CRISPR gRNA sequence
caacacaccaggtattattg

SEQ ID NO: 325495 - DNA, 20 bp, Artificial
  CRISPR gRNA sequence
caggtattattgtagatact

SEQ ID NO: 325496 - DNA, 20 bp, Artificial
  CRISPR gRNA sequence
aggtattattgtagatactt

SEQ ID NO: 325497 - DNA, 20 bp, Artificial
  CRISPR gRNA sequence
attattgtagatacttggga

SEQ ID NO: 325498 - DNA, 20 bp, Artificial
  CRISPR gRNA sequence
cttgggatggatttgtgaat

SEQ ID NO: 325499 - DNA, 20 bp, Artificial
  CRISPR gRNA sequence
gatttgtgaataagaccaac

SEQ ID NO: 325500 - DNA, 20 bp, Artificial
  CRISPR gRNA sequence
atttgtgaataagaccaaca

SEQ ID NO: 325501 - DNA, 20 bp, Artificial
  CRISPR gRNA sequence
aataagaccaacaaggtccc

SEQ ID NO: 325502 - DNA, 20 bp, Artificial
  CRISPR gRNA sequence
caacaaggtccctggtttta

SEQ ID NO: 325503 - DNA, 20 bp, Artificial
  CRISPR gRNA sequence
aggtccctggttttaaagct

SEQ ID NO: 325504 - DNA, 20 bp, Artificial
  CRISPR gRNA sequence
gtccctggttttaaagctta

SEQ ID NO: 325505 - DNA, 20 bp, Artificial
  CRISPR gRNA sequence
cctggttttaaagcttagag

SEQ ID NO: 325506 - DNA, 20 bp, Artificial
  CRISPR gRNA sequence
tggttttaaagcttagagtg

SEQ ID NO: 325507 - DNA, 20 bp, Artificial
  CRISPR gRNA sequence
ttttaaagcttagagtggag

SEQ ID NO: 325508 - DNA, 20 bp, Artificial
  CRISPR gRNA sequence
aaagcttagagtggagtagc

SEQ ID NO: 325509 - DNA, 20 bp, Artificial
  CRISPR gRNA sequence
agtggagtagccagacaata

SEQ ID NO: 325510 - DNA, 20 bp, Artificial
  CRISPR gRNA sequence
ggagtagccagacaataaag

SEQ ID NO: 325511 - DNA, 20 bp, Artificial
  CRISPR gRNA sequence
acaataaagaagaaaacaat

SEQ ID NO: 325512 - DNA, 20 bp, Artificial
  CRISPR gRNA sequence
aagaaaacaatcagataaac

SEQ ID NO: 325513 - DNA, 20 bp, Artificial
  CRISPR gRNA sequence
tcagataaaccagataattt

SEQ ID NO: 325514 - DNA, 20 bp, Artificial
  CRISPR gRNA sequence
ataaaccagataatttcaga

SEQ ID NO: 325515 - DNA, 20 bp, Artificial
  CRISPR gRNA sequence
cagtgataaatgctttatgt

SEQ ID NO: 325516 - DNA, 20 bp, Artificial
  CRISPR gRNA sequence
ctttatgtcagttaatgtac

SEQ ID NO: 325517 - DNA, 20 bp, Artificial
  CRISPR gRNA sequence
taatgtactagataatgacc

SEQ ID NO: 325518 - DNA, 20 bp, Artificial
  CRISPR gRNA sequence
aatgacctggatatattctt

SEQ ID NO: 325519 - DNA, 20 bp, Artificial
  CRISPR gRNA sequence
cctggatatattctttagat

SEQ ID NO: 325520 - DNA, 20 bp, Artificial
  CRISPR gRNA sequence
ctggatatattctttagatt

SEQ ID NO: 325521 - DNA, 20 bp, Artificial
  CRISPR gRNA sequence
gatatattctttagattggg

SEQ ID NO: 325522 - DNA, 20 bp, Artificial
  CRISPR gRNA sequence
tattctttagattgggtggc

SEQ ID NO: 325523 - DNA, 20 bp, Artificial
  CRISPR gRNA sequence
tctttagattgggtggccag

SEQ ID NO: 325524 - DNA, 20 bp, Artificial
  CRISPR gRNA sequence
tgggtggccagtggtcactg

SEQ ID NO: 325525 - DNA, 20 bp, Artificial
  CRISPR gRNA sequence
gtggccagtggtcactgaag

SEQ ID NO: 325526 - DNA, 20 bp, Artificial
  CRISPR gRNA sequence
attactcttgaacgatgaca

SEQ ID NO: 325527 - DNA, 20 bp, Artificial
  CRISPR gRNA sequence
actcttgaacgatgacaaag

SEQ ID NO: 325528 - DNA, 20 bp, Artificial
  CRISPR gRNA sequence
cttgaacgatgacaaagaag

SEQ ID NO: 325529 - DNA, 20 bp, Artificial
  CRISPR gRNA sequence
agaagcagccatgtgaaaat

SEQ ID NO: 325530 - DNA, 20 bp, Artificial
  CRISPR gRNA sequence
aagcagccatgtgaaaatca

SEQ ID NO: 325531 - DNA, 20 bp, Artificial
  CRISPR gRNA sequence
gcagccatgtgaaaatcaga

SEQ ID NO: 325532 - DNA, 20 bp, Artificial
  CRISPR gRNA sequence
gaaaatcagagagaatgttc

SEQ ID NO: 325533 - DNA, 20 bp, Artificial
  CRISPR gRNA sequence
aaaatcagagagaatgttct

SEQ ID NO: 325534 - DNA, 20 bp, Artificial
  CRISPR gRNA sequence
atcagagagaatgttctagg

SEQ ID NO: 325535 - DNA, 20 bp, Artificial
  CRISPR gRNA sequence
cagagagaatgttctaggtg

SEQ ID NO: 325536 - DNA, 20 bp, Artificial
  CRISPR gRNA sequence
aatgttctaggtggagaaat

SEQ ID NO: 325537 - DNA, 20 bp, Artificial
  CRISPR gRNA sequence
gtggagaaatgagaaattaa

SEQ ID NO: 325538 - DNA, 20 bp, Artificial
  CRISPR gRNA sequence
aaatgagaaattaaaagccc

SEQ ID NO: 325539 - DNA, 20 bp, Artificial
  CRISPR gRNA sequence
aatgagaaattaaaagccct

SEQ ID NO: 325540 - DNA, 20 bp, Artificial
  CRISPR gRNA sequence
ggaacctgctttgtgtgttt

SEQ ID NO: 325541 - DNA, 20 bp, Artificial
  CRISPR gRNA sequence
gaacctgctttgtgtgtttg

SEQ ID NO: 325542 - DNA, 20 bp, Artificial
  CRISPR gRNA sequence
tgctttgtgtgtttgaggaa

SEQ ID NO: 325543 - DNA, 20 bp, Artificial
  CRISPR gRNA sequence
ttgtgtgtttgaggaacaga

SEQ ID NO: 325544 - DNA, 20 bp, Artificial
  CRISPR gRNA sequence
tgtgtttgaggaacagaaag

SEQ ID NO: 325545 - DNA, 20 bp, Artificial
  CRISPR gRNA sequence
gtgtttgaggaacagaaaga

SEQ ID NO: 325546 - DNA, 20 bp, Artificial
  CRISPR gRNA sequence
tgtttgaggaacagaaagaa

SEQ ID NO: 325547 - DNA, 20 bp, Artificial
  CRISPR gRNA sequence
ttgaggaacagaaagaaggg

SEQ ID NO: 325548 - DNA, 20 bp, Artificial
  CRISPR gRNA sequence
aaagaagggcagtgtgactg

SEQ ID NO: 325549 - DNA, 20 bp, Artificial
  CRISPR gRNA sequence
agggcagtgtgactgtggtg

SEQ ID NO: 325550 - DNA, 20 bp, Artificial
  CRISPR gRNA sequence
actgtggtgtagtgtgtgac

SEQ ID NO: 325551 - DNA, 20 bp, Artificial
  CRISPR gRNA sequence
agtgtgtgactggtataaaa

SEQ ID NO: 325552 - DNA, 20 bp, Artificial
  CRISPR gRNA sequence
gtgtgtgactggtataaaat

SEQ ID NO: 325553 - DNA, 20 bp, Artificial
  CRISPR gRNA sequence
tgtgtgactggtataaaatg

SEQ ID NO: 325554 - DNA, 20 bp, Artificial
  CRISPR gRNA sequence
tgtgactggtataaaatggg

SEQ ID NO: 325555 - DNA, 20 bp, Artificial
  CRISPR gRNA sequence
tgactggtataaaatgggga

SEQ ID NO: 325556 - DNA, 20 bp, Artificial
  CRISPR gRNA sequence
gactggtataaaatggggag

SEQ ID NO: 325557 - DNA, 20 bp, Artificial
  CRISPR gRNA sequence
tggtataaaatggggagagg

SEQ ID NO: 325558 - DNA, 20 bp, Artificial
  CRISPR gRNA sequence
ggtataaaatggggagaggt

SEQ ID NO: 325559 - DNA, 20 bp, Artificial
  CRISPR gRNA sequence
tataaaatggggagaggtag

SEQ ID NO: 325560 - DNA, 20 bp, Artificial
  CRISPR gRNA sequence
taaaatggggagaggtagga

SEQ ID NO: 325561 - DNA, 20 bp, Artificial
  CRISPR gRNA sequence
aaaatggggagaggtaggag

SEQ ID NO: 325562 - DNA, 20 bp, Artificial
  CRISPR gRNA sequence
agaggtaggagaggtcatgc

SEQ ID NO: 325563 - DNA, 20 bp, Artificial
  CRISPR gRNA sequence
aggagaggtcatgcaagtca

SEQ ID NO: 325564 - DNA, 20 bp, Artificial
  CRISPR gRNA sequence
ggagaggtcatgcaagtcat

SEQ ID NO: 325565 - DNA, 20 bp, Artificial
  CRISPR gRNA sequence
tcatgcaagtcatgggaaac

SEQ ID NO: 325566 - DNA, 20 bp, Artificial
  CRISPR gRNA sequence
catgcaagtcatgggaaacc

SEQ ID NO: 325567 - DNA, 20 bp, Artificial
  CRISPR gRNA sequence
atgcaagtcatgggaaacca

SEQ ID NO: 325568 - DNA, 20 bp, Artificial
  CRISPR gRNA sequence
aagtcatgggaaaccagggt

SEQ ID NO: 325569 - DNA, 20 bp, Artificial
  CRISPR gRNA sequence
gggaaaccagggtaagaact

SEQ ID NO: 325570 - DNA, 20 bp, Artificial
  CRISPR gRNA sequence
aagaacttagattttactgt

SEQ ID NO: 325571 - DNA, 20 bp, Artificial
  CRISPR gRNA sequence
aacttagattttactgtaag

SEQ ID NO: 325572 - DNA, 20 bp, Artificial
  CRISPR gRNA sequence
gattttactgtaagtggaat

SEQ ID NO: 325573 - DNA, 20 bp, Artificial
  CRISPR gRNA sequence
tttactgtaagtggaatgag

SEQ ID NO: 325574 - DNA, 20 bp, Artificial
  CRISPR gRNA sequence
taagtggaatgagaagcacc

SEQ ID NO: 325575 - DNA, 20 bp, Artificial
  CRISPR gRNA sequence
agtggaatgagaagcacctg

SEQ ID NO: 325576 - DNA, 20 bp, Artificial
  CRISPR gRNA sequence
gtggaatgagaagcacctgg

SEQ ID NO: 325577 - DNA, 20 bp, Artificial
  CRISPR gRNA sequence
gaagcacctggaggttttat

SEQ ID NO: 325578 - DNA, 20 bp, Artificial
  CRISPR gRNA sequence
gcacctggaggttttataag

SEQ ID NO: 325579 - DNA, 20 bp, Artificial
  CRISPR gRNA sequence
aagcagaacaatgactctat

SEQ ID NO: 325580 - DNA, 20 bp, Artificial
  CRISPR gRNA sequence
ctctattggattatgcatgt

SEQ ID NO: 325581 - DNA, 20 bp, Artificial
  CRISPR gRNA sequence
tattggattatgcatgtaag

SEQ ID NO: 325582 - DNA, 20 bp, Artificial
  CRISPR gRNA sequence
attggattatgcatgtaaga

SEQ ID NO: 325583 - DNA, 20 bp, Artificial
  CRISPR gRNA sequence
tgcatgtaagaaggtcattc

SEQ ID NO: 325584 - DNA, 20 bp, Artificial
  CRISPR gRNA sequence
aggtcattctggtttctctg

SEQ ID NO: 325585 - DNA, 20 bp, Artificial
  CRISPR gRNA sequence
gtcattctggtttctctgtg

SEQ ID NO: 325586 - DNA, 20 bp, Artificial
  CRISPR gRNA sequence
tctggtttctctgtggagaa

SEQ ID NO: 325587 - DNA, 20 bp, Artificial
  CRISPR gRNA sequence
tgtggagaatggattgtaaa

SEQ ID NO: 325588 - DNA, 20 bp, Artificial
  CRISPR gRNA sequence
gtggagaatggattgtaaat

SEQ ID NO: 325589 - DNA, 20 bp, Artificial
  CRISPR gRNA sequence
gagaatggattgtaaatggg

SEQ ID NO: 325590 - DNA, 20 bp, Artificial
  CRISPR gRNA sequence
agaatggattgtaaatgggc

SEQ ID NO: 325591 - DNA, 20 bp, Artificial
  CRISPR gRNA sequence
aatggattgtaaatgggcag

SEQ ID NO: 325592 - DNA, 20 bp, Artificial
  CRISPR gRNA sequence
ttgtaaatgggcaggagtaa

SEQ ID NO: 325593 - DNA, 20 bp, Artificial
  CRISPR gRNA sequence
taaatgggcaggagtaaaag

SEQ ID NO: 325594 - DNA, 20 bp, Artificial
  CRISPR gRNA sequence
atgggcaggagtaaaagcag

SEQ ID NO: 325595 - DNA, 20 bp, Artificial
  CRISPR gRNA sequence
agtaaaagcagaagctcttg

SEQ ID NO: 325596 - DNA, 20 bp, Artificial
  CRISPR gRNA sequence
agcagaagctcttgtagtcc

SEQ ID NO: 325597 - DNA, 20 bp, Artificial
  CRISPR gRNA sequence
cagaagctcttgtagtccca

SEQ ID NO: 325598 - DNA, 20 bp, Artificial
  CRISPR gRNA sequence
gaagctcttgtagtcccaga

SEQ ID NO: 325599 - DNA, 20 bp, Artificial
  CRISPR gRNA sequence
agctcttgtagtcccagaga

SEQ ID NO: 325600 - DNA, 20 bp, Artificial
  CRISPR gRNA sequence
gtcccagagagagatgacaa

SEQ ID NO: 325601 - DNA, 20 bp, Artificial
  CRISPR gRNA sequence
agagagagatgacaatggtt

SEQ ID NO: 325602 - DNA, 20 bp, Artificial
  CRISPR gRNA sequence
gagatgacaatggtttggac

SEQ ID NO: 325603 - DNA, 20 bp, Artificial
  CRISPR gRNA sequence
acaatggtttggaccagttg

SEQ ID NO: 325604 - DNA, 20 bp, Artificial
  CRISPR gRNA sequence
ggtttggaccagttgaagct

SEQ ID NO: 325605 - DNA, 20 bp, Artificial
  CRISPR gRNA sequence
tggaccagttgaagctgaga

SEQ ID NO: 325606 - DNA, 20 bp, Artificial
  CRISPR gRNA sequence
gaccagttgaagctgagatg

SEQ ID NO: 325607 - DNA, 20 bp, Artificial
  CRISPR gRNA sequence
accagttgaagctgagatgg

SEQ ID NO: 325608 - DNA, 20 bp, Artificial
  CRISPR gRNA sequence
cagttgaagctgagatggag

SEQ ID NO: 325609 - DNA, 20 bp, Artificial
  CRISPR gRNA sequence
ttgaagctgagatggaggag

SEQ ID NO: 325610 - DNA, 20 bp, Artificial
  CRISPR gRNA sequence
aagctgagatggaggagaag

SEQ ID NO: 325611 - DNA, 20 bp, Artificial
  CRISPR gRNA sequence
tgagatggaggagaagtgga

SEQ ID NO: 325612 - DNA, 20 bp, Artificial
  CRISPR gRNA sequence
gagaagtggatagattctgt

SEQ ID NO: 325613 - DNA, 20 bp, Artificial
  CRISPR gRNA sequence
agattctgttggacataaaa

SEQ ID NO: 325614 - DNA, 20 bp, Artificial
  CRISPR gRNA sequence
attctgttggacataaaaca

SEQ ID NO: 325615 - DNA, 20 bp, Artificial
  CRISPR gRNA sequence
ttctgttggacataaaacag

SEQ ID NO: 325616 - DNA, 20 bp, Artificial
  CRISPR gRNA sequence
tggacataaaacagaggtgc

SEQ ID NO: 325617 - DNA, 20 bp, Artificial
  CRISPR gRNA sequence
aaaacagaggtgctggaaat

SEQ ID NO: 325618 - DNA, 20 bp, Artificial
  CRISPR gRNA sequence
aaacagaggtgctggaaatt

SEQ ID NO: 325619 - DNA, 20 bp, Artificial
  CRISPR gRNA sequence
ttaggcgttcttcctgctca

SEQ ID NO: 325620 - DNA, 20 bp, Artificial
  CRISPR gRNA sequence
tcttcctgctcacagatttt

SEQ ID NO: 325621 - DNA, 20 bp, Artificial
  CRISPR gRNA sequence
tgctcacagatttttagcac

SEQ ID NO: 325622 - DNA, 20 bp, Artificial
  CRISPR gRNA sequence
agcactggtcctgtaacact

SEQ ID NO: 325623 - DNA, 20 bp, Artificial
  CRISPR gRNA sequence
gtcctgtaacactcagttgt

SEQ ID NO: 325624 - DNA, 20 bp, Artificial
  CRISPR gRNA sequence
agttgttagtgaccactgtc

SEQ ID NO: 325625 - DNA, 20 bp, Artificial
  CRISPR gRNA sequence
gaccactgtctagcttcctg

SEQ ID NO: 325626 - DNA, 20 bp, Artificial
  CRISPR gRNA sequence
atacttctgttgattgttgc

SEQ ID NO: 325627 - DNA, 20 bp, Artificial
  CRISPR gRNA sequence
tgctagtgacactttgactg

SEQ ID NO: 325628 - DNA, 20 bp, Artificial
  CRISPR gRNA sequence
ccaaaaatctttcatgcacc

SEQ ID NO: 325629 - DNA, 20 bp, Artificial
  CRISPR gRNA sequence
caaaaatctttcatgcaccc

SEQ ID NO: 325630 - DNA, 20 bp, Artificial
  CRISPR gRNA sequence
aaatctttcatgcacccagg

SEQ ID NO: 325631 - DNA, 20 bp, Artificial
  CRISPR gRNA sequence
cccaggaagctgtgtgacct

SEQ ID NO: 325632 - DNA, 20 bp, Artificial
  CRISPR gRNA sequence
ccaggaagctgtgtgacctc

SEQ ID NO: 325633 - DNA, 20 bp, Artificial
  CRISPR gRNA sequence
ggcaaataatttaatctgtc

SEQ ID NO: 325634 - DNA, 20 bp, Artificial
  CRISPR gRNA sequence
gcaaataatttaatctgtct

SEQ ID NO: 325635 - DNA, 20 bp, Artificial
  CRISPR gRNA sequence
atttaatctgtctgggcctt

SEQ ID NO: 325636 - DNA, 20 bp, Artificial
  CRISPR gRNA sequence
agttgtctgtatgtacacaa

SEQ ID NO: 325637 - DNA, 20 bp, Artificial
  CRISPR gRNA sequence
ttgtctgtatgtacacaaaa

SEQ ID NO: 325638 - DNA, 20 bp, Artificial
  CRISPR gRNA sequence
tgtctgtatgtacacaaaag

SEQ ID NO: 325639 - DNA, 20 bp, Artificial
  CRISPR gRNA sequence
atgtacacaaaagaggtcac

SEQ ID NO: 325640 - DNA, 20 bp, Artificial
  CRISPR gRNA sequence
atctgactgtgtatgatgct

SEQ ID NO: 325641 - DNA, 20 bp, Artificial
  CRISPR gRNA sequence
tgactgtgtatgatgctgag

SEQ ID NO: 325642 - DNA, 20 bp, Artificial
  CRISPR gRNA sequence
actgtgtatgatgctgagaa

SEQ ID NO: 325643 - DNA, 20 bp, Artificial
  CRISPR gRNA sequence
ctgtgtatgatgctgagaag

SEQ ID NO: 325644 - DNA, 20 bp, Artificial
  CRISPR gRNA sequence
gaagaggttgaatcatgtta

SEQ ID NO: 325645 - DNA, 20 bp, Artificial
  CRISPR gRNA sequence
aagaggttgaatcatgttac

SEQ ID NO: 325646 - DNA, 20 bp, Artificial
  CRISPR gRNA sequence
atcatgttacaggaaacaaa

SEQ ID NO: 325647 - DNA, 20 bp, Artificial
  CRISPR gRNA sequence
tacaggaaacaaaaagtgta

SEQ ID NO: 325648 - DNA, 20 bp, Artificial
  CRISPR gRNA sequence
gaaacaaaaagtgtaaagct

SEQ ID NO: 325649 - DNA, 20 bp, Artificial
  CRISPR gRNA sequence
aaacaaaaagtgtaaagctg

SEQ ID NO: 325650 - DNA, 20 bp, Artificial
  CRISPR gRNA sequence
aacaaaaagtgtaaagctga

SEQ ID NO: 325651 - DNA, 20 bp, Artificial
  CRISPR gRNA sequence
tgtaaagctgagggtattta

SEQ ID NO: 325652 - DNA, 20 bp, Artificial
  CRISPR gRNA sequence
gtaaagctgagggtatttat

SEQ ID NO: 325653 - DNA, 20 bp, Artificial
  CRISPR gRNA sequence
tataggatgcctgaaacatg

SEQ ID NO: 325654 - DNA, 20 bp, Artificial
  CRISPR gRNA sequence
gaagtgttgatgaaatttat

SEQ ID NO: 325655 - DNA, 20 bp, Artificial
  CRISPR gRNA sequence
ttgatgaaatttattagcaa

SEQ ID NO: 325656 - DNA, 20 bp, Artificial
  CRISPR gRNA sequence
aaatttattagcaatggaaa

SEQ ID NO: 325657 - DNA, 20 bp, Artificial
  CRISPR gRNA sequence
tagcaatggaaatggtatgt

SEQ ID NO: 325658 - DNA, 20 bp, Artificial
  CRISPR gRNA sequence
agcaatggaaatggtatgtt

SEQ ID NO: 325659 - DNA, 20 bp, Artificial
  CRISPR gRNA sequence
aatggaaatggtatgttagg

SEQ ID NO: 325660 - DNA, 20 bp, Artificial
  CRISPR gRNA sequence
aatggtatgttaggaagcat

SEQ ID NO: 325661 - DNA, 20 bp, Artificial
  CRISPR gRNA sequence
atggtatgttaggaagcatg

SEQ ID NO: 325662 - DNA, 20 bp, Artificial
  CRISPR gRNA sequence
ggtatgttaggaagcatgag

SEQ ID NO: 325663 - DNA, 20 bp, Artificial
  CRISPR gRNA sequence
gaagcatgaggagcatatca

SEQ ID NO: 325664 - DNA, 20 bp, Artificial
  CRISPR gRNA sequence
catgaggagcatatcaaaga

SEQ ID NO: 325665 - DNA, 20 bp, Artificial
  CRISPR gRNA sequence
gagcatatcaaagatagtat

SEQ ID NO: 325666 - DNA, 20 bp, Artificial
  CRISPR gRNA sequence
gcatatcaaagatagtatga

SEQ ID NO: 325667 - DNA, 20 bp, Artificial
  CRISPR gRNA sequence
atatcaaagatagtatgaga

SEQ ID NO: 325668 - DNA, 20 bp, Artificial
  CRISPR gRNA sequence
tatcaaagatagtatgagag

SEQ ID NO: 325669 - DNA, 20 bp, Artificial
  CRISPR gRNA sequence
tagtatgagagaggatgttt

SEQ ID NO: 325670 - DNA, 20 bp, Artificial
  CRISPR gRNA sequence
gtatgagagaggatgttttg

SEQ ID NO: 325671 - DNA, 20 bp, Artificial
  CRISPR gRNA sequence
tgagagaggatgttttggag

SEQ ID NO: 325672 - DNA, 20 bp, Artificial
  CRISPR gRNA sequence
ttggagaagattttatatta

SEQ ID NO: 325673 - DNA, 20 bp, Artificial
  CRISPR gRNA sequence
tggagaagattttatattaa

SEQ ID NO: 325674 - DNA, 20 bp, Artificial
  CRISPR gRNA sequence
agaagattttatattaaagg

SEQ ID NO: 325675 - DNA, 20 bp, Artificial
  CRISPR gRNA sequence
attttatattaaaggtggta

SEQ ID NO: 325676 - DNA, 20 bp, Artificial
  CRISPR gRNA sequence
ttttatattaaaggtggtat

SEQ ID NO: 325677 - DNA, 20 bp, Artificial
  CRISPR gRNA sequence
tatattaaaggtggtatggg

SEQ ID NO: 325678 - DNA, 20 bp, Artificial
  CRISPR gRNA sequence
taaaggtggtatgggaagaa

SEQ ID NO: 325679 - DNA, 20 bp, Artificial
  CRISPR gRNA sequence
aaaggtggtatgggaagaaa

SEQ ID NO: 325680 - DNA, 20 bp, Artificial
  CRISPR gRNA sequence
tgggaagaaaaggcaaacat

SEQ ID NO: 325681 - DNA, 20 bp, Artificial
  CRISPR gRNA sequence
gaaaaggcaaacatgagaaa

SEQ ID NO: 325682 - DNA, 20 bp, Artificial
  CRISPR gRNA sequence
aaaaggcaaacatgagaaaa

SEQ ID NO: 325683 - DNA, 20 bp, Artificial
  CRISPR gRNA sequence
aggcaaacatgagaaaaagg

SEQ ID NO: 325684 - DNA, 20 bp, Artificial
  CRISPR gRNA sequence
aaacatgagaaaaaggaaga

SEQ ID NO: 325685 - DNA, 20 bp, Artificial
  CRISPR gRNA sequence
gagaaaaaggaagaaagaac

SEQ ID NO: 325686 - DNA, 20 bp, Artificial
  CRISPR gRNA sequence
aaaaaggaagaaagaacaag

SEQ ID NO: 325687 - DNA, 20 bp, Artificial
  CRISPR gRNA sequence
aaaggaagaaagaacaagaa

SEQ ID NO: 325688 - DNA, 20 bp, Artificial
  CRISPR gRNA sequence
aggaagaaagaacaagaaga

SEQ ID NO: 325689 - DNA, 20 bp, Artificial
  CRISPR gRNA sequence
gaagaaagaacaagaagaga

SEQ ID NO: 325690 - DNA, 20 bp, Artificial
  CRISPR gRNA sequence
aagaacaagaagagagagat

SEQ ID NO: 325691 - DNA, 20 bp, Artificial
  CRISPR gRNA sequence
acaagaagagagagattggt

SEQ ID NO: 325692 - DNA, 20 bp, Artificial
  CRISPR gRNA sequence
caagaagagagagattggta

SEQ ID NO: 325693 - DNA, 20 bp, Artificial
  CRISPR gRNA sequence
aagaagagagagattggtaa

SEQ ID NO: 325694 - DNA, 20 bp, Artificial
  CRISPR gRNA sequence
agaagagagagattggtaag

SEQ ID NO: 325695 - DNA, 20 bp, Artificial
  CRISPR gRNA sequence
cactgacaatttttaactac

SEQ ID NO: 325696 - DNA, 20 bp, Artificial
  CRISPR gRNA sequence
acaatttttaactactggta

SEQ ID NO: 325697 - DNA, 20 bp, Artificial
  CRISPR gRNA sequence
tttaactactggtatggcaa

SEQ ID NO: 325698 - DNA, 20 bp, Artificial
  CRISPR gRNA sequence
tggcaacagaattgaccaaa

SEQ ID NO: 325699 - DNA, 20 bp, Artificial
  CRISPR gRNA sequence
agatttgacaccttaccaat

SEQ ID NO: 325700 - DNA, 20 bp, Artificial
  CRISPR gRNA sequence
atttgacaccttaccaatca

SEQ ID NO: 325701 - DNA, 20 bp, Artificial
  CRISPR gRNA sequence
tgacaccttaccaatcagag

SEQ ID NO: 325702 - DNA, 20 bp, Artificial
  CRISPR gRNA sequence
agagcagacactatctataa

SEQ ID NO: 325703 - DNA, 20 bp, Artificial
  CRISPR gRNA sequence
gcagacactatctataaaag

SEQ ID NO: 325704 - DNA, 20 bp, Artificial
  CRISPR gRNA sequence
agtggtgctatctatcatac

SEQ ID NO: 325705 - DNA, 20 bp, Artificial
  CRISPR gRNA sequence
tatctatcataccagcattc

SEQ ID NO: 325706 - DNA, 20 bp, Artificial
  CRISPR gRNA sequence
atctatcataccagcattcc

SEQ ID NO: 325707 - DNA, 20 bp, Artificial
  CRISPR gRNA sequence
tcataccagcattccaggct

SEQ ID NO: 325708 - DNA, 20 bp, Artificial
  CRISPR gRNA sequence
cagcattccaggctgagtat

SEQ ID NO: 325709 - DNA, 20 bp, Artificial
  CRISPR gRNA sequence
tccaggctgagtattagact

SEQ ID NO: 325710 - DNA, 20 bp, Artificial
  CRISPR gRNA sequence
caggctgagtattagacttg

SEQ ID NO: 325711 - DNA, 20 bp, Artificial
  CRISPR gRNA sequence
tgagtattagacttggagat

SEQ ID NO: 325712 - DNA, 20 bp, Artificial
  CRISPR gRNA sequence
acttggagataagaacatcc

SEQ ID NO: 325713 - DNA, 20 bp, Artificial
  CRISPR gRNA sequence
tggagataagaacatccaag

SEQ ID NO: 325714 - DNA, 20 bp, Artificial
  CRISPR gRNA sequence
ggagataagaacatccaaga

SEQ ID NO: 325715 - DNA, 20 bp, Artificial
  CRISPR gRNA sequence
ataagaacatccaagaagga

SEQ ID NO: 325716 - DNA, 20 bp, Artificial
  CRISPR gRNA sequence
aagaacatccaagaaggatg

SEQ ID NO: 325717 - DNA, 20 bp, Artificial
  CRISPR gRNA sequence
catccaagaaggatggagaa

SEQ ID NO: 325718 - DNA, 20 bp, Artificial
  CRISPR gRNA sequence
gaaggatggagaaaagatcc

SEQ ID NO: 325719 - DNA, 20 bp, Artificial
  CRISPR gRNA sequence
aaagatcctagatgcttttg

SEQ ID NO: 325720 - DNA, 20 bp, Artificial
  CRISPR gRNA sequence
ctagatgcttttgcagttat

SEQ ID NO: 325721 - DNA, 20 bp, Artificial
  CRISPR gRNA sequence
ttataagaaactaacgtatt

SEQ ID NO: 325722 - DNA, 20 bp, Artificial
  CRISPR gRNA sequence
tgtctatccattaaatgctt

SEQ ID NO: 325723 - DNA, 20 bp, Artificial
  CRISPR gRNA sequence
tccattaaatgctttagtca

SEQ ID NO: 325724 - DNA, 20 bp, Artificial
  CRISPR gRNA sequence
aatgctttagtcatggttat

SEQ ID NO: 325725 - DNA, 20 bp, Artificial
  CRISPR gRNA sequence
atgctttagtcatggttata

SEQ ID NO: 325726 - DNA, 20 bp, Artificial
  CRISPR gRNA sequence
tgctttagtcatggttataa

SEQ ID NO: 325727 - DNA, 20 bp, Artificial
  CRISPR gRNA sequence
gctttagtcatggttataag

SEQ ID NO: 325728 - DNA, 20 bp, Artificial
  CRISPR gRNA sequence
ttagtcatggttataagggg

SEQ ID NO: 325729 - DNA, 20 bp, Artificial
  CRISPR gRNA sequence
actattttcaaatgttacca

SEQ ID NO: 325730 - DNA, 20 bp, Artificial
  CRISPR gRNA sequence
ctattttcaaatgttaccaa

SEQ ID NO: 325731 - DNA, 20 bp, Artificial
  CRISPR gRNA sequence
ttcaaatgttaccaaaggct

SEQ ID NO: 325732 - DNA, 20 bp, Artificial
  CRISPR gRNA sequence
aaatgttaccaaaggctaag

SEQ ID NO: 325733 - DNA, 20 bp, Artificial
  CRISPR gRNA sequence
gaatttgtaatttgtcattt

SEQ ID NO: 325734 - DNA, 20 bp, Artificial
  CRISPR gRNA sequence
ttgtcatttgagcattgtct

SEQ ID NO: 325735 - DNA, 20 bp, Artificial
  CRISPR gRNA sequence
ctgttgctatcactgaatac

SEQ ID NO: 325736 - DNA, 20 bp, Artificial
  CRISPR gRNA sequence
gttgctatcactgaataccg

SEQ ID NO: 325737 - DNA, 20 bp, Artificial
  CRISPR gRNA sequence
tatcactgaataccggagac

SEQ ID NO: 325738 - DNA, 20 bp, Artificial
  CRISPR gRNA sequence
atcactgaataccggagact

SEQ ID NO: 325739 - DNA, 20 bp, Artificial
  CRISPR gRNA sequence
cggagactgggtaatttata

SEQ ID NO: 325740 - DNA, 20 bp, Artificial
  CRISPR gRNA sequence
actgggtaatttataaagaa

SEQ ID NO: 325741 - DNA, 20 bp, Artificial
  CRISPR gRNA sequence
gaaaagaaatgtatttctta

SEQ ID NO: 325742 - DNA, 20 bp, Artificial
  CRISPR gRNA sequence
aaatgtatttcttacagttc

SEQ ID NO: 325743 - DNA, 20 bp, Artificial
  CRISPR gRNA sequence
atgtatttcttacagttctg

SEQ ID NO: 325744 - DNA, 20 bp, Artificial
  CRISPR gRNA sequence
tgtatttcttacagttctgg

SEQ ID NO: 325745 - DNA, 20 bp, Artificial
  CRISPR gRNA sequence
tttcttacagttctggaggc

SEQ ID NO: 325746 - DNA, 20 bp, Artificial
  CRISPR gRNA sequence
ttcttacagttctggaggct

SEQ ID NO: 325747 - DNA, 20 bp, Artificial
  CRISPR gRNA sequence
tcttacagttctggaggctg

SEQ ID NO: 325748 - DNA, 20 bp, Artificial
  CRISPR gRNA sequence
agttctggaggctggggcct

SEQ ID NO: 325749 - DNA, 20 bp, Artificial
  CRISPR gRNA sequence
tggaggctggggcctaagtc

SEQ ID NO: 325750 - DNA, 20 bp, Artificial
  CRISPR gRNA sequence
ggaggctggggcctaagtct

SEQ ID NO: 325751 - DNA, 20 bp, Artificial
  CRISPR gRNA sequence
gaggctggggcctaagtcta

SEQ ID NO: 325752 - DNA, 20 bp, Artificial
  CRISPR gRNA sequence
aggctggggcctaagtctag

SEQ ID NO: 325753 - DNA, 20 bp, Artificial
  CRISPR gRNA sequence
ggggcctaagtctaggggtc

SEQ ID NO: 325754 - DNA, 20 bp, Artificial
  CRISPR gRNA sequence
gggcctaagtctaggggtct

SEQ ID NO: 325755 - DNA, 20 bp, Artificial
  CRISPR gRNA sequence
ggcctaagtctaggggtcta

SEQ ID NO: 325756 - DNA, 20 bp, Artificial
  CRISPR gRNA sequence
gcctaagtctaggggtctag

SEQ ID NO: 325757 - DNA, 20 bp, Artificial
  CRISPR gRNA sequence
agtctaggggtctaggggcc

SEQ ID NO: 325758 - DNA, 20 bp, Artificial
  CRISPR gRNA sequence
gtctaggggtctaggggcct

SEQ ID NO: 325759 - DNA, 20 bp, Artificial
  CRISPR gRNA sequence
ggggtctaggggcctaggtc

SEQ ID NO: 325760 - DNA, 20 bp, Artificial
  CRISPR gRNA sequence
gggtctaggggcctaggtct

SEQ ID NO: 325761 - DNA, 20 bp, Artificial
  CRISPR gRNA sequence
taggggcctaggtctaggct

SEQ ID NO: 325762 - DNA, 20 bp, Artificial
  CRISPR gRNA sequence
aggggcctaggtctaggctg

SEQ ID NO: 325763 - DNA, 20 bp, Artificial
  CRISPR gRNA sequence
cctaggtctaggctgaggcc

SEQ ID NO: 325764 - DNA, 20 bp, Artificial
  CRISPR gRNA sequence
ctaggtctaggctgaggcct

SEQ ID NO: 325765 - DNA, 20 bp, Artificial
  CRISPR gRNA sequence
taggtctaggctgaggccta

SEQ ID NO: 325766 - DNA, 20 bp, Artificial
  CRISPR gRNA sequence
aggtctaggctgaggcctag

SEQ ID NO: 325767 - DNA, 20 bp, Artificial
  CRISPR gRNA sequence
tgaggcctaggggcgaaatc

SEQ ID NO: 325768 - DNA, 20 bp, Artificial
  CRISPR gRNA sequence
gcctaggggcgaaatctggt

SEQ ID NO: 325769 - DNA, 20 bp, Artificial
  CRISPR gRNA sequence
cctaggggcgaaatctggtg

SEQ ID NO: 325770 - DNA, 20 bp, Artificial
  CRISPR gRNA sequence
ctaggggcgaaatctggtga

SEQ ID NO: 325771 - DNA, 20 bp, Artificial
  CRISPR gRNA sequence
tctggtgagggccttctttc

SEQ ID NO: 325772 - DNA, 20 bp, Artificial
  CRISPR gRNA sequence
ggtgagggccttctttctgg

SEQ ID NO: 325773 - DNA, 20 bp, Artificial
  CRISPR gRNA sequence
gtgagggccttctttctggt

SEQ ID NO: 325774 - DNA, 20 bp, Artificial
  CRISPR gRNA sequence
tgagggccttctttctggtg

SEQ ID NO: 325775 - DNA, 20 bp, Artificial
  CRISPR gRNA sequence
tttctggtggggacactcat

SEQ ID NO: 325776 - DNA, 20 bp, Artificial
  CRISPR gRNA sequence
tctggtggggacactcatca

SEQ ID NO: 325777 - DNA, 20 bp, Artificial
  CRISPR gRNA sequence
ctggtggggacactcatcag

SEQ ID NO: 325778 - DNA, 20 bp, Artificial
  CRISPR gRNA sequence
gggacactcatcagaggccc

SEQ ID NO: 325779 - DNA, 20 bp, Artificial
  CRISPR gRNA sequence
ggacactcatcagaggccca

SEQ ID NO: 325780 - DNA, 20 bp, Artificial
  CRISPR gRNA sequence
cactcatcagaggcccaagg

SEQ ID NO: 325781 - DNA, 20 bp, Artificial
  CRISPR gRNA sequence
atcagaggcccaaggcagta

SEQ ID NO: 325782 - DNA, 20 bp, Artificial
  CRISPR gRNA sequence
cagaggcccaaggcagtaca

SEQ ID NO: 325783 - DNA, 20 bp, Artificial
  CRISPR gRNA sequence
agaggcccaaggcagtacag

SEQ ID NO: 325784 - DNA, 20 bp, Artificial
  CRISPR gRNA sequence
agtacagaggattacatgat

SEQ ID NO: 325785 - DNA, 20 bp, Artificial
  CRISPR gRNA sequence
gtacagaggattacatgatg

SEQ ID NO: 325786 - DNA, 20 bp, Artificial
  CRISPR gRNA sequence
acagaggattacatgatgag

SEQ ID NO: 325787 - DNA, 20 bp, Artificial
  CRISPR gRNA sequence
cagaggattacatgatgagg

SEQ ID NO: 325788 - DNA, 20 bp, Artificial
  CRISPR gRNA sequence
tacatgatgaggaggttctt

SEQ ID NO: 325789 - DNA, 20 bp, Artificial
  CRISPR gRNA sequence
catgatgaggaggttcttga

SEQ ID NO: 325790 - DNA, 20 bp, Artificial
  CRISPR gRNA sequence
atgaggaggttcttgagaga

SEQ ID NO: 325791 - DNA, 20 bp, Artificial
  CRISPR gRNA sequence
ttcttgagagacagccaatc

SEQ ID NO: 325792 - DNA, 20 bp, Artificial
  CRISPR gRNA sequence
taacccattaacccatgaat

SEQ ID NO: 325793 - DNA, 20 bp, Artificial
  CRISPR gRNA sequence
attaacccatgaattggatt

SEQ ID NO: 325794 - DNA, 20 bp, Artificial
  CRISPR gRNA sequence
gaattggattaagctattca

SEQ ID NO: 325795 - DNA, 20 bp, Artificial
  CRISPR gRNA sequence
aattggattaagctattcat

SEQ ID NO: 325796 - DNA, 20 bp, Artificial
  CRISPR gRNA sequence
attggattaagctattcatg

SEQ ID NO: 325797 - DNA, 20 bp, Artificial
  CRISPR gRNA sequence
ttggattaagctattcatgg

SEQ ID NO: 325798 - DNA, 20 bp, Artificial
  CRISPR gRNA sequence
gttctgccaatcatctctta

SEQ ID NO: 325799 - DNA, 20 bp, Artificial
  CRISPR gRNA sequence
ttctgccaatcatctcttaa

SEQ ID NO: 325800 - DNA, 20 bp, Artificial
  CRISPR gRNA sequence
acctcccaattctattacac

SEQ ID NO: 325801 - DNA, 20 bp, Artificial
  CRISPR gRNA sequence
cctcccaattctattacact

SEQ ID NO: 325802 - DNA, 20 bp, Artificial
  CRISPR gRNA sequence
ctcccaattctattacactg

SEQ ID NO: 325803 - DNA, 20 bp, Artificial
  CRISPR gRNA sequence
tggggattaattttcaatat

SEQ ID NO: 325804 - DNA, 20 bp, Artificial
  CRISPR gRNA sequence
ttaattttcaatatgagtgt

SEQ ID NO: 325805 - DNA, 20 bp, Artificial
  CRISPR gRNA sequence
ttttcaatatgagtgtcagt

SEQ ID NO: 325806 - DNA, 20 bp, Artificial
  CRISPR gRNA sequence
ttcaatatgagtgtcagtca

SEQ ID NO: 325807 - DNA, 20 bp, Artificial
  CRISPR gRNA sequence
tcaatatgagtgtcagtcag

SEQ ID NO: 325808 - DNA, 20 bp, Artificial
  CRISPR gRNA sequence
caatatgagtgtcagtcaga

SEQ ID NO: 325809 - DNA, 20 bp, Artificial
  CRISPR gRNA sequence
aatatgagtgtcagtcagag

SEQ ID NO: 325810 - DNA, 20 bp, Artificial
  CRISPR gRNA sequence
atatgagtgtcagtcagagg

SEQ ID NO: 325811 - DNA, 20 bp, Artificial
  CRISPR gRNA sequence
tcagagggggacaaacattc

SEQ ID NO: 325812 - DNA, 20 bp, Artificial
  CRISPR gRNA sequence
ggggacaaacattcaagcta

SEQ ID NO: 325813 - DNA, 20 bp, Artificial
  CRISPR gRNA sequence
acaaacattcaagctatagc

SEQ ID NO: 325814 - DNA, 20 bp, Artificial
  CRISPR gRNA sequence
ctgttctatatctgccaaaa

SEQ ID NO: 325815 - DNA, 20 bp, Artificial
  CRISPR gRNA sequence
aaataattaattaaatgcta

SEQ ID NO: 325816 - DNA, 20 bp, Artificial
  CRISPR gRNA sequence
agttaaaaacattcgaactg

SEQ ID NO: 325817 - DNA, 20 bp, Artificial
  CRISPR gRNA sequence
aaacattcgaactgcagact

SEQ ID NO: 325818 - DNA, 20 bp, Artificial
  CRISPR gRNA sequence
acattcgaactgcagactta

SEQ ID NO: 325819 - DNA, 20 bp, Artificial
  CRISPR gRNA sequence
actgcagacttagagctgtc

SEQ ID NO: 325820 - DNA, 20 bp, Artificial
  CRISPR gRNA sequence
gcagacttagagctgtcaag

SEQ ID NO: 325821 - DNA, 20 bp, Artificial
  CRISPR gRNA sequence
agagctgtcaagcggttttc

SEQ ID NO: 325822 - DNA, 20 bp, Artificial
  CRISPR gRNA sequence
ctgtcaagcggttttccaga

SEQ ID NO: 325823 - DNA, 20 bp, Artificial
  CRISPR gRNA sequence
caagcggttttccagatgga

SEQ ID NO: 325824 - DNA, 20 bp, Artificial
  CRISPR gRNA sequence
cagatggaaagtttaaacac

SEQ ID NO: 325825 - DNA, 20 bp, Artificial
  CRISPR gRNA sequence
aagtttaaacactggatatg

SEQ ID NO: 325826 - DNA, 20 bp, Artificial
  CRISPR gRNA sequence
cactggatatgtggaaacct

SEQ ID NO: 325827 - DNA, 20 bp, Artificial
  CRISPR gRNA sequence
ggatatgtggaaacctaagt

SEQ ID NO: 325828 - DNA, 20 bp, Artificial
  CRISPR gRNA sequence
tcactacatttcataataaa

SEQ ID NO: 325829 - DNA, 20 bp, Artificial
  CRISPR gRNA sequence
cactacatttcataataaat

SEQ ID NO: 325830 - DNA, 20 bp, Artificial
  CRISPR gRNA sequence
ttcataataaataggcgatc

SEQ ID NO: 325831 - DNA, 20 bp, Artificial
  CRISPR gRNA sequence
tcataataaataggcgatcc

SEQ ID NO: 325832 - DNA, 20 bp, Artificial
  CRISPR gRNA sequence
taataaataggcgatccagg

SEQ ID NO: 325833 - DNA, 20 bp, Artificial
  CRISPR gRNA sequence
aggcgatccaggtagttttt

SEQ ID NO: 325834 - DNA, 20 bp, Artificial
  CRISPR gRNA sequence
tccaggtagtttttaagtta

SEQ ID NO: 325835 - DNA, 20 bp, Artificial
  CRISPR gRNA sequence
taagttaaagataaaaaaat

SEQ ID NO: 325836 - DNA, 20 bp, Artificial
  CRISPR gRNA sequence
agataaaaaaatgagtaatt

SEQ ID NO: 325837 - DNA, 20 bp, Artificial
  CRISPR gRNA sequence
ataaaaaaatgagtaattaa

SEQ ID NO: 325838 - DNA, 20 bp, Artificial
  CRISPR gRNA sequence
aatgagtaattaagagcgtc

SEQ ID NO: 325839 - DNA, 20 bp, Artificial
  CRISPR gRNA sequence
atgagtaattaagagcgtcc

SEQ ID NO: 325840 - DNA, 20 bp, Artificial
  CRISPR gRNA sequence
gtaattaagagcgtccaggc

SEQ ID NO: 325841 - DNA, 20 bp, Artificial
  CRISPR gRNA sequence
taattaagagcgtccaggcc

SEQ ID NO: 325842 - DNA, 20 bp, Artificial
  CRISPR gRNA sequence
aagagcgtccaggccaggtg

SEQ ID NO: 325843 - DNA, 20 bp, Artificial
  CRISPR gRNA sequence
agcgtccaggccaggtgcgg

SEQ ID NO: 325844 - DNA, 20 bp, Artificial
  CRISPR gRNA sequence
gtggctcacgcttataatcc

SEQ ID NO: 325845 - DNA, 20 bp, Artificial
  CRISPR gRNA sequence
cgcttataatcccagcactt

SEQ ID NO: 325846 - DNA, 20 bp, Artificial
  CRISPR gRNA sequence
gcttataatcccagcacttt

SEQ ID NO: 325847 - DNA, 20 bp, Artificial
  CRISPR gRNA sequence
ttataatcccagcactttgg

SEQ ID NO: 325848 - DNA, 20 bp, Artificial
  CRISPR gRNA sequence
tataatcccagcactttggg

SEQ ID NO: 325849 - DNA, 20 bp, Artificial
  CRISPR gRNA sequence
tcccagcactttgggaggcc

SEQ ID NO: 325850 - DNA, 20 bp, Artificial
  CRISPR gRNA sequence
cccagcactttgggaggcca

SEQ ID NO: 325851 - DNA, 20 bp, Artificial
  CRISPR gRNA sequence
agcactttgggaggccaagg

SEQ ID NO: 325852 - DNA, 20 bp, Artificial
  CRISPR gRNA sequence
gcactttgggaggccaaggt

SEQ ID NO: 325853 - DNA, 20 bp, Artificial
  CRISPR gRNA sequence
ctttgggaggccaaggtggg

SEQ ID NO: 325854 - DNA, 20 bp, Artificial
  CRISPR gRNA sequence
ggccaaggtgggcggatcgt

SEQ ID NO: 325855 - DNA, 20 bp, Artificial
  CRISPR gRNA sequence
gccaaggtgggcggatcgtg

SEQ ID NO: 325856 - DNA, 20 bp, Artificial
  CRISPR gRNA sequence
ggtgggcggatcgtgaggta

SEQ ID NO: 325857 - DNA, 20 bp, Artificial
  CRISPR gRNA sequence
tgggcggatcgtgaggtaaa

SEQ ID NO: 325858 - DNA, 20 bp, Artificial
  CRISPR gRNA sequence
cggatcgtgaggtaaagaga

SEQ ID NO: 325859 - DNA, 20 bp, Artificial
  CRISPR gRNA sequence
gatcgtgaggtaaagagatg

SEQ ID NO: 325860 - DNA, 20 bp, Artificial
  CRISPR gRNA sequence
taaagagatggagaccatcc

SEQ ID NO: 325861 - DNA, 20 bp, Artificial
  CRISPR gRNA sequence
ggagaccatcctggccaaca

SEQ ID NO: 325862 - DNA, 20 bp, Artificial
  CRISPR gRNA sequence
tctactaaaaatacaaaaat

SEQ ID NO: 325863 - DNA, 20 bp, Artificial
  CRISPR gRNA sequence
taaaaatacaaaaattagct

SEQ ID NO: 325864 - DNA, 20 bp, Artificial
  CRISPR gRNA sequence
atacaaaaattagctgagca

SEQ ID NO: 325865 - DNA, 20 bp, Artificial
  CRISPR gRNA sequence
caaaaattagctgagcatgg

SEQ ID NO: 325866 - DNA, 20 bp, Artificial
  CRISPR gRNA sequence
agcatggtggcatgtgactg

SEQ ID NO: 325867 - DNA, 20 bp, Artificial
  CRISPR gRNA sequence
gtggcatgtgactgtagtcc

SEQ ID NO: 325868 - DNA, 20 bp, Artificial
  CRISPR gRNA sequence
tgactgtagtcccagctact

SEQ ID NO: 325869 - DNA, 20 bp, Artificial
  CRISPR gRNA sequence
gactgtagtcccagctactt

SEQ ID NO: 325870 - DNA, 20 bp, Artificial
  CRISPR gRNA sequence
tgtagtcccagctacttggg

SEQ ID NO: 325871 - DNA, 20 bp, Artificial
  CRISPR gRNA sequence
tcccagctacttgggaagct

SEQ ID NO: 325872 - DNA, 20 bp, Artificial
  CRISPR gRNA sequence
cccagctacttgggaagctg

SEQ ID NO: 325873 - DNA, 20 bp, Artificial
  CRISPR gRNA sequence
agctacttgggaagctgagg

SEQ ID NO: 325874 - DNA, 20 bp, Artificial
  CRISPR gRNA sequence
tacttgggaagctgaggcag

SEQ ID NO: 325875 - DNA, 20 bp, Artificial
  CRISPR gRNA sequence
gcagcagaatcgcttgaacc

SEQ ID NO: 325876 - DNA, 20 bp, Artificial
  CRISPR gRNA sequence
cagcagaatcgcttgaacct

SEQ ID NO: 325877 - DNA, 20 bp, Artificial
  CRISPR gRNA sequence
gcagaatcgcttgaacctag

SEQ ID NO: 325878 - DNA, 20 bp, Artificial
  CRISPR gRNA sequence
cagaatcgcttgaacctagg

SEQ ID NO: 325879 - DNA, 20 bp, Artificial
  CRISPR gRNA sequence
aatcgcttgaacctaggagg

SEQ ID NO: 325880 - DNA, 20 bp, Artificial
  CRISPR gRNA sequence
tcgcttgaacctaggaggca

SEQ ID NO: 325881 - DNA, 20 bp, Artificial
  CRISPR gRNA sequence
cgcttgaacctaggaggcag

SEQ ID NO: 325882 - DNA, 20 bp, Artificial
  CRISPR gRNA sequence
aacctaggaggcagaggttg

SEQ ID NO: 325883 - DNA, 20 bp, Artificial
  CRISPR gRNA sequence
taggaggcagaggttgcagt

SEQ ID NO: 325884 - DNA, 20 bp, Artificial
  CRISPR gRNA sequence
ggcagaggttgcagtgagct

SEQ ID NO: 325885 - DNA, 20 bp, Artificial
  CRISPR gRNA sequence
gagattgcaccactgcactc

SEQ ID NO: 325886 - DNA, 20 bp, Artificial
  CRISPR gRNA sequence
accactgcactctagcctgc

SEQ ID NO: 325887 - DNA, 20 bp, Artificial
  CRISPR gRNA sequence
gcactctagcctgctggtga

SEQ ID NO: 325888 - DNA, 20 bp, Artificial
  CRISPR gRNA sequence
tagcctgctggtgacagaac

SEQ ID NO: 325889 - DNA, 20 bp, Artificial
  CRISPR gRNA sequence
tccatctcaaaaaaaaaaaa

SEQ ID NO: 325890 - DNA, 20 bp, Artificial
  CRISPR gRNA sequence
catctcaaaaaaaaaaaaaa

SEQ ID NO: 325891 - DNA, 20 bp, Artificial
  CRISPR gRNA sequence
aaaaaaaaaagagtgtccaa

SEQ ID NO: 325892 - DNA, 20 bp, Artificial
  CRISPR gRNA sequence
aaatgacactctgaaatctt

SEQ ID NO: 325893 - DNA, 20 bp, Artificial
  CRISPR gRNA sequence
ctgaaatcttcagctgatgt

SEQ ID NO: 325894 - DNA, 20 bp, Artificial
  CRISPR gRNA sequence
aaatcttcagctgatgtcag

SEQ ID NO: 325895 - DNA, 20 bp, Artificial
  CRISPR gRNA sequence
acactctcaacatgccattc

SEQ ID NO: 325896 - DNA, 20 bp, Artificial
  CRISPR gRNA sequence
catgccattcaagaaaaatt

SEQ ID NO: 325897 - DNA, 20 bp, Artificial
  CRISPR gRNA sequence
atgccattcaagaaaaattg

SEQ ID NO: 325898 - DNA, 20 bp, Artificial
  CRISPR gRNA sequence
attcaagaaaaattgaggca

SEQ ID NO: 325899 - DNA, 20 bp, Artificial
  CRISPR gRNA sequence
aaattgaggcacggcattcc

SEQ ID NO: 325900 - DNA, 20 bp, Artificial
  CRISPR gRNA sequence
gtcctacctaaatacttttg

SEQ ID NO: 325901 - DNA, 20 bp, Artificial
  CRISPR gRNA sequence
tcctacctaaatacttttgt

SEQ ID NO: 325902 - DNA, 20 bp, Artificial
  CRISPR gRNA sequence
acctaaatacttttgtgggc

SEQ ID NO: 325903 - DNA, 20 bp, Artificial
  CRISPR gRNA sequence
aaatacttttgtgggcaaga

SEQ ID NO: 325904 - DNA, 20 bp, Artificial
  CRISPR gRNA sequence
acttttgtgggcaagaaaga

SEQ ID NO: 325905 - DNA, 20 bp, Artificial
  CRISPR gRNA sequence
tttaatttattctgactttc

SEQ ID NO: 325906 - DNA, 20 bp, Artificial
  CRISPR gRNA sequence
tttattctgactttctggaa

SEQ ID NO: 325907 - DNA, 20 bp, Artificial
  CRISPR gRNA sequence
gaatagcccattatgatatt

SEQ ID NO: 325908 - DNA, 20 bp, Artificial
  CRISPR gRNA sequence
agcccattatgatattgaga

SEQ ID NO: 325909 - DNA, 20 bp, Artificial
  CRISPR gRNA sequence
cattatgatattgagacaga

SEQ ID NO: 325910 - DNA, 20 bp, Artificial
  CRISPR gRNA sequence
tatgatattgagacagaaag

SEQ ID NO: 325911 - DNA, 20 bp, Artificial
  CRISPR gRNA sequence
ttgagacagaaagtggttaa

SEQ ID NO: 325912 - DNA, 20 bp, Artificial
  CRISPR gRNA sequence
tgagacagaaagtggttaac

SEQ ID NO: 325913 - DNA, 20 bp, Artificial
  CRISPR gRNA sequence
caggaacattgttttccctt

SEQ ID NO: 325914 - DNA, 20 bp, Artificial
  CRISPR gRNA sequence
gaacattgttttccctttgg

SEQ ID NO: 325915 - DNA, 20 bp, Artificial
  CRISPR gRNA sequence
cctttggaagacttacccaa

SEQ ID NO: 325916 - DNA, 20 bp, Artificial
  CRISPR gRNA sequence
ggaagacttacccaacagca

SEQ ID NO: 325917 - DNA, 20 bp, Artificial
  CRISPR gRNA sequence
cttacccaacagcaaagaat

SEQ ID NO: 325918 - DNA, 20 bp, Artificial
  CRISPR gRNA sequence
cagcaaagaattagctctct

SEQ ID NO: 325919 - DNA, 20 bp, Artificial
  CRISPR gRNA sequence
ttagctctctcagttgtttg

SEQ ID NO: 325920 - DNA, 20 bp, Artificial
  CRISPR gRNA sequence
cagttgtttgcagtcttatc

SEQ ID NO: 325921 - DNA, 20 bp, Artificial
  CRISPR gRNA sequence
atatattctgatgctgaatc

SEQ ID NO: 325922 - DNA, 20 bp, Artificial
  CRISPR gRNA sequence
atattctgatgctgaatcca

SEQ ID NO: 325923 - DNA, 20 bp, Artificial
  CRISPR gRNA sequence
tctgatgctgaatccagaga

SEQ ID NO: 325924 - DNA, 20 bp, Artificial
  CRISPR gRNA sequence
gatgctgaatccagagaaag

SEQ ID NO: 325925 - DNA, 20 bp, Artificial
  CRISPR gRNA sequence
atgctgaatccagagaaagc

SEQ ID NO: 325926 - DNA, 20 bp, Artificial
  CRISPR gRNA sequence
aatccagagaaagcaggtgt

SEQ ID NO: 325927 - DNA, 20 bp, Artificial
  CRISPR gRNA sequence
caggtgttagaaataacatt

SEQ ID NO: 325928 - DNA, 20 bp, Artificial
  CRISPR gRNA sequence
tgtttcacttcttcatttca

SEQ ID NO: 325929 - DNA, 20 bp, Artificial
  CRISPR gRNA sequence
cacttcttcatttcacggat

SEQ ID NO: 325930 - DNA, 20 bp, Artificial
  CRISPR gRNA sequence
acttcttcatttcacggatg

SEQ ID NO: 325931 - DNA, 20 bp, Artificial
  CRISPR gRNA sequence
ttcttcatttcacggatgag

SEQ ID NO: 325932 - DNA, 20 bp, Artificial
  CRISPR gRNA sequence
tcttcatttcacggatgagg

SEQ ID NO: 325933 - DNA, 20 bp, Artificial
  CRISPR gRNA sequence
gatgaggaggctgaattcca

SEQ ID NO: 325934 - DNA, 20 bp, Artificial
  CRISPR gRNA sequence
atgaggaggctgaattccac

SEQ ID NO: 325935 - DNA, 20 bp, Artificial
  CRISPR gRNA sequence
tgaggaggctgaattccaca

SEQ ID NO: 325936 - DNA, 20 bp, Artificial
  CRISPR gRNA sequence
gaggaggctgaattccacag

SEQ ID NO: 325937 - DNA, 20 bp, Artificial
  CRISPR gRNA sequence
tgaattccacaggggtaccc

SEQ ID NO: 325938 - DNA, 20 bp, Artificial
  CRISPR gRNA sequence
ccacaggggtaccctagcca

SEQ ID NO: 325939 - DNA, 20 bp, Artificial
  CRISPR gRNA sequence
acaggggtaccctagccaca

SEQ ID NO: 325940 - DNA, 20 bp, Artificial
  CRISPR gRNA sequence
ccctagccacagagccttgc

SEQ ID NO: 325941 - DNA, 20 bp, Artificial
  CRISPR gRNA sequence
tagccacagagccttgctag

SEQ ID NO: 325942 - DNA, 20 bp, Artificial
  CRISPR gRNA sequence
ccacagagccttgctagtgg

SEQ ID NO: 325943 - DNA, 20 bp, Artificial
  CRISPR gRNA sequence
acagagccttgctagtggca

SEQ ID NO: 325944 - DNA, 20 bp, Artificial
  CRISPR gRNA sequence
agccttgctagtggcagagc

SEQ ID NO: 325945 - DNA, 20 bp, Artificial
  CRISPR gRNA sequence
gcagagccagaatttgcctc

SEQ ID NO: 325946 - DNA, 20 bp, Artificial
  CRISPR gRNA sequence
gaatttgcctctggtttcct

SEQ ID NO: 325947 - DNA, 20 bp, Artificial
  CRISPR gRNA sequence
aatttgcctctggtttcctt

SEQ ID NO: 325948 - DNA, 20 bp, Artificial
  CRISPR gRNA sequence
atgtcctcttgtgtttgcca

SEQ ID NO: 325949 - DNA, 20 bp, Artificial
  CRISPR gRNA sequence
ctcttgtgtttgccacagtg

SEQ ID NO: 325950 - DNA, 20 bp, Artificial
  CRISPR gRNA sequence
tcttgtgtttgccacagtgc

SEQ ID NO: 325951 - DNA, 20 bp, Artificial
  CRISPR gRNA sequence
ttgccacagtgcgggcacaa

SEQ ID NO: 325952 - DNA, 20 bp, Artificial
  CRISPR gRNA sequence
tgccacagtgcgggcacaat

SEQ ID NO: 325953 - DNA, 20 bp, Artificial
  CRISPR gRNA sequence
gccacagtgcgggcacaatg

SEQ ID NO: 325954 - DNA, 20 bp, Artificial
  CRISPR gRNA sequence
ccacagtgcgggcacaatgg

SEQ ID NO: 325955 - DNA, 20 bp, Artificial
  CRISPR gRNA sequence
caatgggggaaaaatctgct

SEQ ID NO: 325956 - DNA, 20 bp, Artificial
  CRISPR gRNA sequence
tctgctgagaaaatcatctt

SEQ ID NO: 325957 - DNA, 20 bp, Artificial
  CRISPR gRNA sequence
gctgagaaaatcatcttcgg

SEQ ID NO: 325958 - DNA, 20 bp, Artificial
  CRISPR gRNA sequence
gagaaaatcatcttcggaag

SEQ ID NO: 325959 - DNA, 20 bp, Artificial
  CRISPR gRNA sequence
aaaatcatcttcggaagtag

SEQ ID NO: 325960 - DNA, 20 bp, Artificial
  CRISPR gRNA sequence
cgtctatgtctgtgtataca

SEQ ID NO: 325961 - DNA, 20 bp, Artificial
  CRISPR gRNA sequence
ctgtgtatacatggtgacca

SEQ ID NO: 325962 - DNA, 20 bp, Artificial
  CRISPR gRNA sequence
catggtgaccacagacgctt

SEQ ID NO: 325963 - DNA, 20 bp, Artificial
  CRISPR gRNA sequence
accacagacgctttggctcc

SEQ ID NO: 325964 - DNA, 20 bp, Artificial
  CRISPR gRNA sequence
ctttggctccaagatcattg

SEQ ID NO: 325965 - DNA, 20 bp, Artificial
  CRISPR gRNA sequence
gtttacttgctgccattcta

SEQ ID NO: 325966 - DNA, 20 bp, Artificial
  CRISPR gRNA sequence
tgctgccattctaaagtctc

SEQ ID NO: 325967 - DNA, 20 bp, Artificial
  CRISPR gRNA sequence
gctgccattctaaagtctct

SEQ ID NO: 325968 - DNA, 20 bp, Artificial
  CRISPR gRNA sequence
attttttgtgaacatttcta

SEQ ID NO: 325969 - DNA, 20 bp, Artificial
  CRISPR gRNA sequence
ttttttgtgaacatttctaa

SEQ ID NO: 325970 - DNA, 20 bp, Artificial
  CRISPR gRNA sequence
tgaacatttctaaaggaact

SEQ ID NO: 325971 - DNA, 20 bp, Artificial
  CRISPR gRNA sequence
tccactgattttatcttctg

SEQ ID NO: 325972 - DNA, 20 bp, Artificial
  CRISPR gRNA sequence
actgattttatcttctgcag

SEQ ID NO: 325973 - DNA, 20 bp, Artificial
  CRISPR gRNA sequence
attttatcttctgcagcaga

SEQ ID NO: 325974 - DNA, 20 bp, Artificial
  CRISPR gRNA sequence
ttatcttctgcagcagacgg

SEQ ID NO: 325975 - DNA, 20 bp, Artificial
  CRISPR gRNA sequence
atcttctgcagcagacggta

SEQ ID NO: 325976 - DNA, 20 bp, Artificial
  CRISPR gRNA sequence
cggtagagacatacgcatca

SEQ ID NO: 325977 - DNA, 20 bp, Artificial
  CRISPR gRNA sequence
agacatacgcatcaaagcaa

SEQ ID NO: 325978 - DNA, 20 bp, Artificial
  CRISPR gRNA sequence
catacgcatcaaagcaacag

SEQ ID NO: 325979 - DNA, 20 bp, Artificial
  CRISPR gRNA sequence
atacgcatcaaagcaacagt

SEQ ID NO: 325980 - DNA, 20 bp, Artificial
  CRISPR gRNA sequence
tacgcatcaaagcaacagtg

SEQ ID NO: 325981 - DNA, 20 bp, Artificial
  CRISPR gRNA sequence
ggggcaacatattttactgt

SEQ ID NO: 325982 - DNA, 20 bp, Artificial
  CRISPR gRNA sequence
attttactgtcagacaaata

SEQ ID NO: 325983 - DNA, 20 bp, Artificial
  CRISPR gRNA sequence
tgtcagacaaataaagcccc

SEQ ID NO: 325984 - DNA, 20 bp, Artificial
  CRISPR gRNA sequence
ccctacgttttaatctaatg

SEQ ID NO: 325985 - DNA, 20 bp, Artificial
  CRISPR gRNA sequence
tgcacctgttctcatgccaa

SEQ ID NO: 325986 - DNA, 20 bp, Artificial
  CRISPR gRNA sequence
agtttttttttctttgcctc

SEQ ID NO: 325987 - DNA, 20 bp, Artificial
  CRISPR gRNA sequence
ctggataatattgttccttc

SEQ ID NO: 325988 - DNA, 20 bp, Artificial
  CRISPR gRNA sequence
tccttccagtttttaaaacg

SEQ ID NO: 325989 - DNA, 20 bp, Artificial
  CRISPR gRNA sequence
tccagtttttaaaacgaagc

SEQ ID NO: 325990 - DNA, 20 bp, Artificial
  CRISPR gRNA sequence
tataaaacaaaacatacata

SEQ ID NO: 325991 - DNA, 20 bp, Artificial
  CRISPR gRNA sequence
aacaaaacatacatatagaa

SEQ ID NO: 325992 - DNA, 20 bp, Artificial
  CRISPR gRNA sequence
taatttaatgaataatgcta

SEQ ID NO: 325993 - DNA, 20 bp, Artificial
  CRISPR gRNA sequence
tcttaccctcataatcacca

SEQ ID NO: 325994 - DNA, 20 bp, Artificial
  CRISPR gRNA sequence
cttaccctcataatcaccac

SEQ ID NO: 325995 - DNA, 20 bp, Artificial
  CRISPR gRNA sequence
cctcataatcaccacaggtc

SEQ ID NO: 325996 - DNA, 20 bp, Artificial
  CRISPR gRNA sequence
caccacaggtcaagaaatac

SEQ ID NO: 325997 - DNA, 20 bp, Artificial
  CRISPR gRNA sequence
gtcaagaaatacaagactgt

SEQ ID NO: 325998 - DNA, 20 bp, Artificial
  CRISPR gRNA sequence
tccaactctttctccctctt

SEQ ID NO: 325999 - DNA, 20 bp, Artificial
  CRISPR gRNA sequence
ccctctttagacaaaaccat

SEQ ID NO: 326000 - DNA, 20 bp, Artificial
  CRISPR gRNA sequence
cctctttagacaaaaccatt

SEQ ID NO: 326001 - DNA, 20 bp, Artificial
  CRISPR gRNA sequence
tgaattttgtgatactaatt

SEQ ID NO: 326002 - DNA, 20 bp, Artificial
  CRISPR gRNA sequence
tattaactatttctattttt

SEQ ID NO: 326003 - DNA, 20 bp, Artificial
  CRISPR gRNA sequence
tttctattttttagtaatta

SEQ ID NO: 326004 - DNA, 20 bp, Artificial
  CRISPR gRNA sequence
ctattttttagtaattatgg

SEQ ID NO: 326005 - DNA, 20 bp, Artificial
  CRISPR gRNA sequence
caaaacatgtatacttcact

SEQ ID NO: 326006 - DNA, 20 bp, Artificial
  CRISPR gRNA sequence
catgtatacttcacttagaa

SEQ ID NO: 326007 - DNA, 20 bp, Artificial
  CRISPR gRNA sequence
atataccttcactatctttc

SEQ ID NO: 326008 - DNA, 20 bp, Artificial
  CRISPR gRNA sequence
gacaatgtgctctatattga

SEQ ID NO: 326009 - DNA, 20 bp, Artificial
  CRISPR gRNA sequence
atattgacagatgtttcttt

SEQ ID NO: 326010 - DNA, 20 bp, Artificial
  CRISPR gRNA sequence
agatgtttcttttagcacat

SEQ ID NO: 326011 - DNA, 20 bp, Artificial
  CRISPR gRNA sequence
atgtttcttttagcacattg

SEQ ID NO: 326012 - DNA, 20 bp, Artificial
  CRISPR gRNA sequence
tgtttcttttagcacattgg

SEQ ID NO: 326013 - DNA, 20 bp, Artificial
  CRISPR gRNA sequence
atgttataattccactgtat

SEQ ID NO: 326014 - DNA, 20 bp, Artificial
  CRISPR gRNA sequence
tgttataattccactgtatc

SEQ ID NO: 326015 - DNA, 20 bp, Artificial
  CRISPR gRNA sequence
gttataattccactgtatca

SEQ ID NO: 326016 - DNA, 20 bp, Artificial
  CRISPR gRNA sequence
ttttattgttgatgttgaaa

SEQ ID NO: 326017 - DNA, 20 bp, Artificial
  CRISPR gRNA sequence
ttgatgttgaaacagtctaa

SEQ ID NO: 326018 - DNA, 20 bp, Artificial
  CRISPR gRNA sequence
acagtctaatagttgctcct

SEQ ID NO: 326019 - DNA, 20 bp, Artificial
  CRISPR gRNA sequence
gtctaatagttgctccttgg

SEQ ID NO: 326020 - DNA, 20 bp, Artificial
  CRISPR gRNA sequence
tctaatagttgctccttgga

SEQ ID NO: 326021 - DNA, 20 bp, Artificial
  CRISPR gRNA sequence
gttgctccttggaaggtaat

SEQ ID NO: 326022 - DNA, 20 bp, Artificial
  CRISPR gRNA sequence
ggtaatcagtctcttttctc

SEQ ID NO: 326023 - DNA, 20 bp, Artificial
  CRISPR gRNA sequence
ctcttttctctggctgcttt

SEQ ID NO: 326024 - DNA, 20 bp, Artificial
  CRISPR gRNA sequence
tcttttctctggctgctttt

SEQ ID NO: 326025 - DNA, 20 bp, Artificial
  CRISPR gRNA sequence
ctgcttttaggattttcact

SEQ ID NO: 326026 - DNA, 20 bp, Artificial
  CRISPR gRNA sequence
gattttcactaagatacatc

SEQ ID NO: 326027 - DNA, 20 bp, Artificial
  CRISPR gRNA sequence
attttcactaagatacatct

SEQ ID NO: 326028 - DNA, 20 bp, Artificial
  CRISPR gRNA sequence
aaaatatgcttgtgaattgt

SEQ ID NO: 326029 - DNA, 20 bp, Artificial
  CRISPR gRNA sequence
aaatatgcttgtgaattgtt

SEQ ID NO: 326030 - DNA, 20 bp, Artificial
  CRISPR gRNA sequence
tgttgggattcttgaatctg

SEQ ID NO: 326031 - DNA, 20 bp, Artificial
  CRISPR gRNA sequence
ttgggattcttgaatctgtg

SEQ ID NO: 326032 - DNA, 20 bp, Artificial
  CRISPR gRNA sequence
ttgaatctgtggagtgtgac

SEQ ID NO: 326033 - DNA, 20 bp, Artificial
  CRISPR gRNA sequence
tgaatctgtggagtgtgact

SEQ ID NO: 326034 - DNA, 20 bp, Artificial
  CRISPR gRNA sequence
aatttttccaacctatctgc

SEQ ID NO: 326035 - DNA, 20 bp, Artificial
  CRISPR gRNA sequence
atatattaaacttatctatt

SEQ ID NO: 326036 - DNA, 20 bp, Artificial
  CRISPR gRNA sequence
atctattgagttttaaatct

SEQ ID NO: 326037 - DNA, 20 bp, Artificial
  CRISPR gRNA sequence
taaatctcagtgcatttttt

SEQ ID NO: 326038 - DNA, 20 bp, Artificial
  CRISPR gRNA sequence
atttttttggccgattcttg

SEQ ID NO: 326039 - DNA, 20 bp, Artificial
  CRISPR gRNA sequence
tttttttggccgattcttgt

SEQ ID NO: 326040 - DNA, 20 bp, Artificial
  CRISPR gRNA sequence
ttgtaggttctttttcaaat

SEQ ID NO: 326041 - DNA, 20 bp, Artificial
  CRISPR gRNA sequence
ttaaattttcctgtgtacta

SEQ ID NO: 326042 - DNA, 20 bp, Artificial
  CRISPR gRNA sequence
tgtactacagatattattac

SEQ ID NO: 326043 - DNA, 20 bp, Artificial
  CRISPR gRNA sequence
cttatttgcttaaacataat

SEQ ID NO: 326044 - DNA, 20 bp, Artificial
  CRISPR gRNA sequence
taagcttaattactttattt

SEQ ID NO: 326045 - DNA, 20 bp, Artificial
  CRISPR gRNA sequence
aagcttaattactttatttt

SEQ ID NO: 326046 - DNA, 20 bp, Artificial
  CRISPR gRNA sequence
agcttaattactttattttg

SEQ ID NO: 326047 - DNA, 20 bp, Artificial
  CRISPR gRNA sequence
attttggggacctgataatt

SEQ ID NO: 326048 - DNA, 20 bp, Artificial
  CRISPR gRNA sequence
ttttggggacctgataattc

SEQ ID NO: 326049 - DNA, 20 bp, Artificial
  CRISPR gRNA sequence
aattcaggtatataaatcat

SEQ ID NO: 326050 - DNA, 20 bp, Artificial
  CRISPR gRNA sequence
aaatcatgagtttgtttttg

SEQ ID NO: 326051 - DNA, 20 bp, Artificial
  CRISPR gRNA sequence
ttatttgtatgaaatttttt

SEQ ID NO: 326052 - DNA, 20 bp, Artificial
  CRISPR gRNA sequence
tatttgtatgaaattttttg

SEQ ID NO: 326053 - DNA, 20 bp, Artificial
  CRISPR gRNA sequence
gtatgaaattttttgaggcc

SEQ ID NO: 326054 - DNA, 20 bp, Artificial
  CRISPR gRNA sequence
tatgaaattttttgaggcct

SEQ ID NO: 326055 - DNA, 20 bp, Artificial
  CRISPR gRNA sequence
taaaccttttcttcttgtaa

SEQ ID NO: 326056 - DNA, 20 bp, Artificial
  CRISPR gRNA sequence
gtttgcatttttactttcaa

SEQ ID NO: 326057 - DNA, 20 bp, Artificial
  CRISPR gRNA sequence
atttttactttcaaaagctg

SEQ ID NO: 326058 - DNA, 20 bp, Artificial
  CRISPR gRNA sequence
tttttactttcaaaagctga

SEQ ID NO: 326059 - DNA, 20 bp, Artificial
  CRISPR gRNA sequence
ttttactttcaaaagctgaa

SEQ ID NO: 326060 - DNA, 20 bp, Artificial
  CRISPR gRNA sequence
taataatgcaaatctcctta

SEQ ID NO: 326061 - DNA, 20 bp, Artificial
  CRISPR gRNA sequence
aatctccttaaagaaaattc

SEQ ID NO: 326062 - DNA, 20 bp, Artificial
  CRISPR gRNA sequence
atctccttaaagaaaattca

SEQ ID NO: 326063 - DNA, 20 bp, Artificial
  CRISPR gRNA sequence
ttaaagaaaattcaaggatt

SEQ ID NO: 326064 - DNA, 20 bp, Artificial
  CRISPR gRNA sequence
taaagaaaattcaaggattg

SEQ ID NO: 326065 - DNA, 20 bp, Artificial
  CRISPR gRNA sequence
ttgaggttttctaaccattg

SEQ ID NO: 326066 - DNA, 20 bp, Artificial
  CRISPR gRNA sequence
gttttctaaccattgaagtc

SEQ ID NO: 326067 - DNA, 20 bp, Artificial
  CRISPR gRNA sequence
ttctaaccattgaagtccag

SEQ ID NO: 326068 - DNA, 20 bp, Artificial
  CRISPR gRNA sequence
tgaagtccagaagatttttc

SEQ ID NO: 326069 - DNA, 20 bp, Artificial
  CRISPR gRNA sequence
ctggaccatctaatctgaat

SEQ ID NO: 326070 - DNA, 20 bp, Artificial
  CRISPR gRNA sequence
tggaccatctaatctgaatg

SEQ ID NO: 326071 - DNA, 20 bp, Artificial
  CRISPR gRNA sequence
catctaatctgaatgaggtc

SEQ ID NO: 326072 - DNA, 20 bp, Artificial
  CRISPR gRNA sequence
tatttctttacctgtgctcc

SEQ ID NO: 326073 - DNA, 20 bp, Artificial
  CRISPR gRNA sequence
gctccaagaatgtaactctt

SEQ ID NO: 326074 - DNA, 20 bp, Artificial
  CRISPR gRNA sequence
ctccaagaatgtaactcttt

SEQ ID NO: 326075 - DNA, 20 bp, Artificial
  CRISPR gRNA sequence
tccaagaatgtaactctttg

SEQ ID NO: 326076 - DNA, 20 bp, Artificial
  CRISPR gRNA sequence
tctttggggtcccaatttat

SEQ ID NO: 326077 - DNA, 20 bp, Artificial
  CRISPR gRNA sequence
ctttggggtcccaatttatt

SEQ ID NO: 326078 - DNA, 20 bp, Artificial
  CRISPR gRNA sequence
tttggggtcccaatttattg

SEQ ID NO: 326079 - DNA, 20 bp, Artificial
  CRISPR gRNA sequence
tggggtcccaatttattggg

SEQ ID NO: 326080 - DNA, 20 bp, Artificial
  CRISPR gRNA sequence
gggtcccaatttattgggga

SEQ ID NO: 326081 - DNA, 20 bp, Artificial
  CRISPR gRNA sequence
ggtcccaatttattggggag

SEQ ID NO: 326082 - DNA, 20 bp, Artificial
  CRISPR gRNA sequence
gtcccaatttattggggaga

SEQ ID NO: 326083 - DNA, 20 bp, Artificial
  CRISPR gRNA sequence
ttggggagagggttttctgc

SEQ ID NO: 326084 - DNA, 20 bp, Artificial
  CRISPR gRNA sequence
ctgctagatcactcactctg

SEQ ID NO: 326085 - DNA, 20 bp, Artificial
  CRISPR gRNA sequence
atcactcactctgcagattc

SEQ ID NO: 326086 - DNA, 20 bp, Artificial
  CRISPR gRNA sequence
tcactcactctgcagattct

SEQ ID NO: 326087 - DNA, 20 bp, Artificial
  CRISPR gRNA sequence
actcactctgcagattctgg

SEQ ID NO: 326088 - DNA, 20 bp, Artificial
  CRISPR gRNA sequence
ctctgcagattctgggagtt

SEQ ID NO: 326089 - DNA, 20 bp, Artificial
  CRISPR gRNA sequence
gagttgagacataaaaacaa

SEQ ID NO: 326090 - DNA, 20 bp, Artificial
  CRISPR gRNA sequence
aaacaaaagtttgaatttga

SEQ ID NO: 326091 - DNA, 20 bp, Artificial
  CRISPR gRNA sequence
aaagtttgaatttgaaagaa

SEQ ID NO: 326092 - DNA, 20 bp, Artificial
  CRISPR gRNA sequence
aaagaacagcaatgctttcc

SEQ ID NO: 326093 - DNA, 20 bp, Artificial
  CRISPR gRNA sequence
cagcaatgctttccgagtaa

SEQ ID NO: 326094 - DNA, 20 bp, Artificial
  CRISPR gRNA sequence
caatgctttccgagtaaaag

SEQ ID NO: 326095 - DNA, 20 bp, Artificial
  CRISPR gRNA sequence
tccgagtaaaagcagcttcc

SEQ ID NO: 326096 - DNA, 20 bp, Artificial
  CRISPR gRNA sequence
tccaagctttgcctgtctct

SEQ ID NO: 326097 - DNA, 20 bp, Artificial
  CRISPR gRNA sequence
ccaagctttgcctgtctctc

SEQ ID NO: 326098 - DNA, 20 bp, Artificial
  CRISPR gRNA sequence
caagctttgcctgtctctcg

SEQ ID NO: 326099 - DNA, 20 bp, Artificial
  CRISPR gRNA sequence
ttgcctgtctctcggggttc

SEQ ID NO: 326100 - DNA, 20 bp, Artificial
  CRISPR gRNA sequence
tctggttctctcttcaaatt

SEQ ID NO: 326101 - DNA, 20 bp, Artificial
  CRISPR gRNA sequence
ttctctcttcaaatttagcc

SEQ ID NO: 326102 - DNA, 20 bp, Artificial
  CRISPR gRNA sequence
aatgcttttaataatatttt

SEQ ID NO: 326103 - DNA, 20 bp, Artificial
  CRISPR gRNA sequence
ggacatttgttcaacatttt

SEQ ID NO: 326104 - DNA, 20 bp, Artificial
  CRISPR gRNA sequence
ttcaacatttttggttgttt

SEQ ID NO: 326105 - DNA, 20 bp, Artificial
  CRISPR gRNA sequence
atttttggttgttttggcgt

SEQ ID NO: 326106 - DNA, 20 bp, Artificial
  CRISPR gRNA sequence
ggttgttttggcgtgagaat

SEQ ID NO: 326107 - DNA, 20 bp, Artificial
  CRISPR gRNA sequence
gtgagaattagtttgaataa

SEQ ID NO: 326108 - DNA, 20 bp, Artificial
  CRISPR gRNA sequence
tgagaattagtttgaataat

SEQ ID NO: 326109 - DNA, 20 bp, Artificial
  CRISPR gRNA sequence
gagaattagtttgaataata

SEQ ID NO: 326110 - DNA, 20 bp, Artificial
  CRISPR gRNA sequence
aatagggactgctataactg

SEQ ID NO: 326111 - DNA, 20 bp, Artificial
  CRISPR gRNA sequence
ggactgctataactgaagac

SEQ ID NO: 326112 - DNA, 20 bp, Artificial
  CRISPR gRNA sequence
caatcaaatcacccaaattg

SEQ ID NO: 326113 - DNA, 20 bp, Artificial
  CRISPR gRNA sequence
tcacccaaattgaagatata

SEQ ID NO: 326114 - DNA, 20 bp, Artificial
  CRISPR gRNA sequence
cacccaaattgaagatatat

SEQ ID NO: 326115 - DNA, 20 bp, Artificial
  CRISPR gRNA sequence
acccaaattgaagatatata

SEQ ID NO: 326116 - DNA, 20 bp, Artificial
  CRISPR gRNA sequence
tatagggaaaatataaattg

SEQ ID NO: 326117 - DNA, 20 bp, Artificial
  CRISPR gRNA sequence
ggaaaatataaattgaagcc

SEQ ID NO: 326118 - DNA, 20 bp, Artificial
  CRISPR gRNA sequence
gaaaatataaattgaagccc

SEQ ID NO: 326119 - DNA, 20 bp, Artificial
  CRISPR gRNA sequence
aaaatataaattgaagccca

SEQ ID NO: 326120 - DNA, 20 bp, Artificial
  CRISPR gRNA sequence
aattgaagcccagggtcatt

SEQ ID NO: 326121 - DNA, 20 bp, Artificial
  CRISPR gRNA sequence
cccagggtcattaagaaaat

SEQ ID NO: 326122 - DNA, 20 bp, Artificial
  CRISPR gRNA sequence
tgtgtatcttaaataaaatt

SEQ ID NO: 326123 - DNA, 20 bp, Artificial
  CRISPR gRNA sequence
gtgtatcttaaataaaatta

SEQ ID NO: 326124 - DNA, 20 bp, Artificial
  CRISPR gRNA sequence
ttaaataaaattaaggcaac

SEQ ID NO: 326125 - DNA, 20 bp, Artificial
  CRISPR gRNA sequence
aaaattaaggcaactagtgt

SEQ ID NO: 326126 - DNA, 20 bp, Artificial
  CRISPR gRNA sequence
attaaggcaactagtgtaag

SEQ ID NO: 326127 - DNA, 20 bp, Artificial
  CRISPR gRNA sequence
taaggcaactagtgtaagta

SEQ ID NO: 326128 - DNA, 20 bp, Artificial
  CRISPR gRNA sequence
aaggcaactagtgtaagtag

SEQ ID NO: 326129 - DNA, 20 bp, Artificial
  CRISPR gRNA sequence
gtaagtagaggtgtgacaaa

SEQ ID NO: 326130 - DNA, 20 bp, Artificial
  CRISPR gRNA sequence
gctaatcctgttacaaattt

SEQ ID NO: 326131 - DNA, 20 bp, Artificial
  CRISPR gRNA sequence
atcctgttacaaatttcaga

SEQ ID NO: 326132 - DNA, 20 bp, Artificial
  CRISPR gRNA sequence
acaaatttcagaaagcaaaa

SEQ ID NO: 326133 - DNA, 20 bp, Artificial
  CRISPR gRNA sequence
gaaagcaaaatggcaataca

SEQ ID NO: 326134 - DNA, 20 bp, Artificial
  CRISPR gRNA sequence
atgtcataatatttacataa

SEQ ID NO: 326135 - DNA, 20 bp, Artificial
  CRISPR gRNA sequence
ataatcccaatatccaacgt

SEQ ID NO: 326136 - DNA, 20 bp, Artificial
  CRISPR gRNA sequence
aatatccaacgttagtattt

SEQ ID NO: 326137 - DNA, 20 bp, Artificial
  CRISPR gRNA sequence
ttagttttaacaaattatga

SEQ ID NO: 326138 - DNA, 20 bp, Artificial
  CRISPR gRNA sequence
attatgatagattaacattt

SEQ ID NO: 326139 - DNA, 20 bp, Artificial
  CRISPR gRNA sequence
taacattttggccaataata

SEQ ID NO: 326140 - DNA, 20 bp, Artificial
  CRISPR gRNA sequence
ccaataatatagtcattaaa

SEQ ID NO: 326141 - DNA, 20 bp, Artificial
  CRISPR gRNA sequence
caataatatagtcattaaaa

SEQ ID NO: 326142 - DNA, 20 bp, Artificial
  CRISPR gRNA sequence
tttatgacataaaataacaa

SEQ ID NO: 326143 - DNA, 20 bp, Artificial
  CRISPR gRNA sequence
atgacataaaataacaatag

SEQ ID NO: 326144 - DNA, 20 bp, Artificial
  CRISPR gRNA sequence
acatgtttgctataaataat

SEQ ID NO: 326145 - DNA, 20 bp, Artificial
  CRISPR gRNA sequence
aataataagtatgtttttgc

SEQ ID NO: 326146 - DNA, 20 bp, Artificial
  CRISPR gRNA sequence
aagtatgtttttgcaagata

SEQ ID NO: 326147 - DNA, 20 bp, Artificial
  CRISPR gRNA sequence
gtatgtttttgcaagataaa

SEQ ID NO: 326148 - DNA, 20 bp, Artificial
  CRISPR gRNA sequence
aaagagcaaaaatatacaaa

SEQ ID NO: 326149 - DNA, 20 bp, Artificial
  CRISPR gRNA sequence
atagtatttctatttcactg

SEQ ID NO: 326150 - DNA, 20 bp, Artificial
  CRISPR gRNA sequence
tttctatttcactgtagaac

SEQ ID NO: 326151 - DNA, 20 bp, Artificial
  CRISPR gRNA sequence
ttctatttcactgtagaact

SEQ ID NO: 326152 - DNA, 20 bp, Artificial
  CRISPR gRNA sequence
aaaatttttttacacttaca

SEQ ID NO: 326153 - DNA, 20 bp, Artificial
  CRISPR gRNA sequence
acatagttttctcaaaaaca

SEQ ID NO: 326154 - DNA, 20 bp, Artificial
  CRISPR gRNA sequence
ttttctcaaaaacaaagacc

SEQ ID NO: 326155 - DNA, 20 bp, Artificial
  CRISPR gRNA sequence
aagaccaagatttcaaaact

SEQ ID NO: 326156 - DNA, 20 bp, Artificial
  CRISPR gRNA sequence
agaccaagatttcaaaactt

SEQ ID NO: 326157 - DNA, 20 bp, Artificial
  CRISPR gRNA sequence
ttcaaaacttaggaaaaaac

SEQ ID NO: 326158 - DNA, 20 bp, Artificial
  CRISPR gRNA sequence
ataattttcccaaacaattt

SEQ ID NO: 326159 - DNA, 20 bp, Artificial
  CRISPR gRNA sequence
tgaaaatttgtcatattaaa

SEQ ID NO: 326160 - DNA, 20 bp, Artificial
  CRISPR gRNA sequence
gaaaatttgtcatattaaaa

SEQ ID NO: 326161 - DNA, 20 bp, Artificial
  CRISPR gRNA sequence
aaaaaggaaaataaaacaaa

SEQ ID NO: 326162 - DNA, 20 bp, Artificial
  CRISPR gRNA sequence
aggaaaataaaacaaaaaga

SEQ ID NO: 326163 - DNA, 20 bp, Artificial
  CRISPR gRNA sequence
gaaaataaaacaaaaagaaa

SEQ ID NO: 326164 - DNA, 20 bp, Artificial
  CRISPR gRNA sequence
aataaaacaaaaagaaagag

SEQ ID NO: 326165 - DNA, 20 bp, Artificial
  CRISPR gRNA sequence
ataaaacaaaaagaaagaga

SEQ ID NO: 326166 - DNA, 20 bp, Artificial
  CRISPR gRNA sequence
aaaaagaaagagaaggcaat

SEQ ID NO: 326167 - DNA, 20 bp, Artificial
  CRISPR gRNA sequence
aagaaagagaaggcaatgag

SEQ ID NO: 326168 - DNA, 20 bp, Artificial
  CRISPR gRNA sequence
caatgagcagtttgaattta

SEQ ID NO: 326169 - DNA, 20 bp, Artificial
  CRISPR gRNA sequence
gaatttatagtctaataact

SEQ ID NO: 326170 - DNA, 20 bp, Artificial
  CRISPR gRNA sequence
aactcagaatctgcaaccac

SEQ ID NO: 326171 - DNA, 20 bp, Artificial
  CRISPR gRNA sequence
actcagaatctgcaaccacc

SEQ ID NO: 326172 - DNA, 20 bp, Artificial
  CRISPR gRNA sequence
gaatctgcaaccaccaggcc

SEQ ID NO: 326173 - DNA, 20 bp, Artificial
  CRISPR gRNA sequence
aatctgcaaccaccaggcca

SEQ ID NO: 326174 - DNA, 20 bp, Artificial
  CRISPR gRNA sequence
ccaccaggccaaggtgattt

SEQ ID NO: 326175 - DNA, 20 bp, Artificial
  CRISPR gRNA sequence
ttccttctgtgattcccatg

SEQ ID NO: 326176 - DNA, 20 bp, Artificial
  CRISPR gRNA sequence
gtagcttgcaaaaacaacct

SEQ ID NO: 326177 - DNA, 20 bp, Artificial
  CRISPR gRNA sequence
aaacaaccttggcttcctat

SEQ ID NO: 326178 - DNA, 20 bp, Artificial
  CRISPR gRNA sequence
ctataagcataaatttattt

SEQ ID NO: 326179 - DNA, 20 bp, Artificial
  CRISPR gRNA sequence
atttatttcagaaaatgaaa

SEQ ID NO: 326180 - DNA, 20 bp, Artificial
  CRISPR gRNA sequence
tatttcagaaaatgaaaaag

SEQ ID NO: 326181 - DNA, 20 bp, Artificial
  CRISPR gRNA sequence
atttcagaaaatgaaaaagt

SEQ ID NO: 326182 - DNA, 20 bp, Artificial
  CRISPR gRNA sequence
tttcagaaaatgaaaaagtg

SEQ ID NO: 326183 - DNA, 20 bp, Artificial
  CRISPR gRNA sequence
agaaaatgaaaaagtggggc

SEQ ID NO: 326184 - DNA, 20 bp, Artificial
  CRISPR gRNA sequence
gaaaatgaaaaagtggggct

SEQ ID NO: 326185 - DNA, 20 bp, Artificial
  CRISPR gRNA sequence
tgaaaaagtggggctgggca

SEQ ID NO: 326186 - DNA, 20 bp, Artificial
  CRISPR gRNA sequence
aaaagtggggctgggcatgg

SEQ ID NO: 326187 - DNA, 20 bp, Artificial
  CRISPR gRNA sequence
gtggttcacgtctgtaatcc

SEQ ID NO: 326188 - DNA, 20 bp, Artificial
  CRISPR gRNA sequence
gtctgtaatcctagcacttt

SEQ ID NO: 326189 - DNA, 20 bp, Artificial
  CRISPR gRNA sequence
ctgtaatcctagcactttaa

SEQ ID NO: 326190 - DNA, 20 bp, Artificial
  CRISPR gRNA sequence
tgtaatcctagcactttaag

SEQ ID NO: 326191 - DNA, 20 bp, Artificial
  CRISPR gRNA sequence
tcctagcactttaagaggct

SEQ ID NO: 326192 - DNA, 20 bp, Artificial
  CRISPR gRNA sequence
cctagcactttaagaggctg

SEQ ID NO: 326193 - DNA, 20 bp, Artificial
  CRISPR gRNA sequence
agcactttaagaggctgagg

SEQ ID NO: 326194 - DNA, 20 bp, Artificial
  CRISPR gRNA sequence
gcactttaagaggctgaggc

SEQ ID NO: 326195 - DNA, 20 bp, Artificial
  CRISPR gRNA sequence
actttaagaggctgaggcag

SEQ ID NO: 326196 - DNA, 20 bp, Artificial
  CRISPR gRNA sequence
ctttaagaggctgaggcagg

SEQ ID NO: 326197 - DNA, 20 bp, Artificial
  CRISPR gRNA sequence
ctgaggcaggaggattgctt

SEQ ID NO: 326198 - DNA, 20 bp, Artificial
  CRISPR gRNA sequence
tgaggcaggaggattgcttg

SEQ ID NO: 326199 - DNA, 20 bp, Artificial
  CRISPR gRNA sequence
gcaggaggattgcttgaggc

SEQ ID NO: 326200 - DNA, 20 bp, Artificial
  CRISPR gRNA sequence
caggaggattgcttgaggcc

SEQ ID NO: 326201 - DNA, 20 bp, Artificial
  CRISPR gRNA sequence
ggaggattgcttgaggccag

SEQ ID NO: 326202 - DNA, 20 bp, Artificial
  CRISPR gRNA sequence
ttgcttgaggccaggagttc

SEQ ID NO: 326203 - DNA, 20 bp, Artificial
  CRISPR gRNA sequence
tgaggccaggagttcaagac

SEQ ID NO: 326204 - DNA, 20 bp, Artificial
  CRISPR gRNA sequence
ccaggagttcaagaccagcc

SEQ ID NO: 326205 - DNA, 20 bp, Artificial
  CRISPR gRNA sequence
caggagttcaagaccagcct

SEQ ID NO: 326206 - DNA, 20 bp, Artificial
  CRISPR gRNA sequence
caagaccagcctgggcaaca

SEQ ID NO: 326207 - DNA, 20 bp, Artificial
  CRISPR gRNA sequence
accagcctgggcaacatagc

SEQ ID NO: 326208 - DNA, 20 bp, Artificial
  CRISPR gRNA sequence
tctacaaaatttctttttca

SEQ ID NO: 326209 - DNA, 20 bp, Artificial
  CRISPR gRNA sequence
caaaatttctttttcaaagt

SEQ ID NO: 326210 - DNA, 20 bp, Artificial
  CRISPR gRNA sequence
atttctttttcaaagttagc

SEQ ID NO: 326211 - DNA, 20 bp, Artificial
  CRISPR gRNA sequence
ttttcaaagttagccagata

SEQ ID NO: 326212 - DNA, 20 bp, Artificial
  CRISPR gRNA sequence
tcaaagttagccagatatgg

SEQ ID NO: 326213 - DNA, 20 bp, Artificial
  CRISPR gRNA sequence
gtggtgtgtgcctgtattcc

SEQ ID NO: 326214 - DNA, 20 bp, Artificial
  CRISPR gRNA sequence
tgcctgtattcccagcttct

SEQ ID NO: 326215 - DNA, 20 bp, Artificial
  CRISPR gRNA sequence
gcctgtattcccagcttctt

SEQ ID NO: 326216 - DNA, 20 bp, Artificial
  CRISPR gRNA sequence
ctgtattcccagcttcttgg

SEQ ID NO: 326217 - DNA, 20 bp, Artificial
  CRISPR gRNA sequence
tgtattcccagcttcttggg

SEQ ID NO: 326218 - DNA, 20 bp, Artificial
  CRISPR gRNA sequence
tcccagcttcttgggaggct

SEQ ID NO: 326219 - DNA, 20 bp, Artificial
  CRISPR gRNA sequence
cccagcttcttgggaggctg

SEQ ID NO: 326220 - DNA, 20 bp, Artificial
  CRISPR gRNA sequence
agcttcttgggaggctgagg

SEQ ID NO: 326221 - DNA, 20 bp, Artificial
  CRISPR gRNA sequence
gcttcttgggaggctgaggc

SEQ ID NO: 326222 - DNA, 20 bp, Artificial
  CRISPR gRNA sequence
ttcttgggaggctgaggcag

SEQ ID NO: 326223 - DNA, 20 bp, Artificial
  CRISPR gRNA sequence
tcttgggaggctgaggcagg

SEQ ID NO: 326224 - DNA, 20 bp, Artificial
  CRISPR gRNA sequence
cttgggaggctgaggcagga

SEQ ID NO: 326225 - DNA, 20 bp, Artificial
  CRISPR gRNA sequence
ctgaggcaggagggaccctt

SEQ ID NO: 326226 - DNA, 20 bp, Artificial
  CRISPR gRNA sequence
gcaggagggacccttgagtc

SEQ ID NO: 326227 - DNA, 20 bp, Artificial
  CRISPR gRNA sequence
caggagggacccttgagtca

SEQ ID NO: 326228 - DNA, 20 bp, Artificial
  CRISPR gRNA sequence
gagggacccttgagtcaagg

SEQ ID NO: 326229 - DNA, 20 bp, Artificial
  CRISPR gRNA sequence
ggacccttgagtcaaggaag

SEQ ID NO: 326230 - DNA, 20 bp, Artificial
  CRISPR gRNA sequence
acccttgagtcaaggaagtg

SEQ ID NO: 326231 - DNA, 20 bp, Artificial
  CRISPR gRNA sequence
cccttgagtcaaggaagtgg

SEQ ID NO: 326232 - DNA, 20 bp, Artificial
  CRISPR gRNA sequence
aaggaagtggaggctacaac

SEQ ID NO: 326233 - DNA, 20 bp, Artificial
  CRISPR gRNA sequence
aagtggaggctacaacgagc

SEQ ID NO: 326234 - DNA, 20 bp, Artificial
  CRISPR gRNA sequence
agtggaggctacaacgagct

SEQ ID NO: 326235 - DNA, 20 bp, Artificial
  CRISPR gRNA sequence
aggatcatgccactgcactg

SEQ ID NO: 326236 - DNA, 20 bp, Artificial
  CRISPR gRNA sequence
catgccactgcactgtagcc

SEQ ID NO: 326237 - DNA, 20 bp, Artificial
  CRISPR gRNA sequence
atgccactgcactgtagcct

SEQ ID NO: 326238 - DNA, 20 bp, Artificial
  CRISPR gRNA sequence
tgccactgcactgtagcctg

SEQ ID NO: 326239 - DNA, 20 bp, Artificial
  CRISPR gRNA sequence
ctgcactgtagcctggggaa

SEQ ID NO: 326240 - DNA, 20 bp, Artificial
  CRISPR gRNA sequence
gcactgtagcctggggaaca

SEQ ID NO: 326241 - DNA, 20 bp, Artificial
  CRISPR gRNA sequence
agtaaacccttttctctgaa

SEQ ID NO: 326242 - DNA, 20 bp, Artificial
  CRISPR gRNA sequence
acccttttctctgaaaagaa

SEQ ID NO: 326243 - DNA, 20 bp, Artificial
  CRISPR gRNA sequence
tttctctgaaaagaaaagaa

SEQ ID NO: 326244 - DNA, 20 bp, Artificial
  CRISPR gRNA sequence
ctgaaaagaaaagaaaagaa

SEQ ID NO: 326245 - DNA, 20 bp, Artificial
  CRISPR gRNA sequence
aaagaaaagaaaagaaaaga

SEQ ID NO: 326246 - DNA, 20 bp, Artificial
  CRISPR gRNA sequence
agaaaagaaaagaaaagaaa

SEQ ID NO: 326247 - DNA, 20 bp, Artificial
  CRISPR gRNA sequence
aaaagaaaagaaaagaaaga

SEQ ID NO: 326248 - DNA, 20 bp, Artificial
  CRISPR gRNA sequence
aagaaaagaaaagaaagaga

SEQ ID NO: 326249 - DNA, 20 bp, Artificial
  CRISPR gRNA sequence
agaaaagaaagagagagaaa

SEQ ID NO: 326250 - DNA, 20 bp, Artificial
  CRISPR gRNA sequence
agaaaaagtaaacaaaaatc

SEQ ID NO: 326251 - DNA, 20 bp, Artificial
  CRISPR gRNA sequence
gaaaaagtaaacaaaaatct

SEQ ID NO: 326252 - DNA, 20 bp, Artificial
  CRISPR gRNA sequence
aaaaagtaaacaaaaatctg

SEQ ID NO: 326253 - DNA, 20 bp, Artificial
  CRISPR gRNA sequence
tggggctttatctttattat

SEQ ID NO: 326254 - DNA, 20 bp, Artificial
  CRISPR gRNA sequence
ggggctttatctttattatc

SEQ ID NO: 326255 - DNA, 20 bp, Artificial
  CRISPR gRNA sequence
tttattatcaggccttgatt

SEQ ID NO: 326256 - DNA, 20 bp, Artificial
  CRISPR gRNA sequence
tcaggccttgattcagttct

SEQ ID NO: 326257 - DNA, 20 bp, Artificial
  CRISPR gRNA sequence
ggccttgattcagttctcag

SEQ ID NO: 326258 - DNA, 20 bp, Artificial
  CRISPR gRNA sequence
tgattcagttctcagtggat

SEQ ID NO: 326259 - DNA, 20 bp, Artificial
  CRISPR gRNA sequence
gattcagttctcagtggatg

SEQ ID NO: 326260 - DNA, 20 bp, Artificial
  CRISPR gRNA sequence
agttctcagtggatgaggtt

SEQ ID NO: 326261 - DNA, 20 bp, Artificial
  CRISPR gRNA sequence
ttctcagtggatgaggtttg

SEQ ID NO: 326262 - DNA, 20 bp, Artificial
  CRISPR gRNA sequence
ttctgtcatttgaaaatgat

SEQ ID NO: 326263 - DNA, 20 bp, Artificial
  CRISPR gRNA sequence
tagtctgttcttttactctt

SEQ ID NO: 326264 - DNA, 20 bp, Artificial
  CRISPR gRNA sequence
tctgttcttttactctttag

SEQ ID NO: 326265 - DNA, 20 bp, Artificial
  CRISPR gRNA sequence
ctgttcttttactctttagc

SEQ ID NO: 326266 - DNA, 20 bp, Artificial
  CRISPR gRNA sequence
gttcttttactctttagcag

SEQ ID NO: 326267 - DNA, 20 bp, Artificial
  CRISPR gRNA sequence
ttcttttactctttagcagg

SEQ ID NO: 326268 - DNA, 20 bp, Artificial
  CRISPR gRNA sequence
tttgtatatatacacacaca

SEQ ID NO: 326269 - DNA, 20 bp, Artificial
  CRISPR gRNA sequence
aactacttcgtacttttaca

SEQ ID NO: 326270 - DNA, 20 bp, Artificial
  CRISPR gRNA sequence
acttcgtacttttacaaagt

SEQ ID NO: 326271 - DNA, 20 bp, Artificial
  CRISPR gRNA sequence
tctgctttactgatgtacat

SEQ ID NO: 326272 - DNA, 20 bp, Artificial
  CRISPR gRNA sequence
atcagtgattatttactcat

SEQ ID NO: 326273 - DNA, 20 bp, Artificial
  CRISPR gRNA sequence
agtgattatttactcatcag

SEQ ID NO: 326274 - DNA, 20 bp, Artificial
  CRISPR gRNA sequence
ttactcatcagaagtacaca

SEQ ID NO: 326275 - DNA, 20 bp, Artificial
  CRISPR gRNA sequence
gaagtacacatggttcttgt

SEQ ID NO: 326276 - DNA, 20 bp, Artificial
  CRISPR gRNA sequence
agtacacatggttcttgtca

SEQ ID NO: 326277 - DNA, 20 bp, Artificial
  CRISPR gRNA sequence
acacatggttcttgtcagag

SEQ ID NO: 326278 - DNA, 20 bp, Artificial
  CRISPR gRNA sequence
tgtcagagtagtttgatcaa

SEQ ID NO: 326279 - DNA, 20 bp, Artificial
  CRISPR gRNA sequence
gtcagagtagtttgatcaac

SEQ ID NO: 326280 - DNA, 20 bp, Artificial
  CRISPR gRNA sequence
agagtagtttgatcaacagg

SEQ ID NO: 326281 - DNA, 20 bp, Artificial
  CRISPR gRNA sequence
gtagacaattccttctcccc

SEQ ID NO: 326282 - DNA, 20 bp, Artificial
  CRISPR gRNA sequence
gatatacctactaataaatg

SEQ ID NO: 326283 - DNA, 20 bp, Artificial
  CRISPR gRNA sequence
ttttcccatatctctctgtt

SEQ ID NO: 326284 - DNA, 20 bp, Artificial
  CRISPR gRNA sequence
ccatatctctctgtttagct

SEQ ID NO: 326285 - DNA, 20 bp, Artificial
  CRISPR gRNA sequence
attttaaaactcacttcctc

SEQ ID NO: 326286 - DNA, 20 bp, Artificial
  CRISPR gRNA sequence
ttttaaaactcacttcctca

SEQ ID NO: 326287 - DNA, 20 bp, Artificial
  CRISPR gRNA sequence
taaaactcacttcctcaagg

SEQ ID NO: 326288 - DNA, 20 bp, Artificial
  CRISPR gRNA sequence
ctctaccaccttcatttaaa

SEQ ID NO: 326289 - DNA, 20 bp, Artificial
  CRISPR gRNA sequence
accatctgcctccaatatga

SEQ ID NO: 326290 - DNA, 20 bp, Artificial
  CRISPR gRNA sequence
ctccaatatgaaagctacca

SEQ ID NO: 326291 - DNA, 20 bp, Artificial
  CRISPR gRNA sequence
tccaatatgaaagctaccaa

SEQ ID NO: 326292 - DNA, 20 bp, Artificial
  CRISPR gRNA sequence
atatgaaagctaccaaagga

SEQ ID NO: 326293 - DNA, 20 bp, Artificial
  CRISPR gRNA sequence
atgaaagctaccaaaggaca

SEQ ID NO: 326294 - DNA, 20 bp, Artificial
  CRISPR gRNA sequence
tgaaagctaccaaaggacag

SEQ ID NO: 326295 - DNA, 20 bp, Artificial
  CRISPR gRNA sequence
ccaaaggacagaggccatac

SEQ ID NO: 326296 - DNA, 20 bp, Artificial
  CRISPR gRNA sequence
taaatatattatttaatatt

SEQ ID NO: 326297 - DNA, 20 bp, Artificial
  CRISPR gRNA sequence
attctatattcacatatgac

SEQ ID NO: 326298 - DNA, 20 bp, Artificial
  CRISPR gRNA sequence
tatattcacatatgacaagc

SEQ ID NO: 326299 - DNA, 20 bp, Artificial
  CRISPR gRNA sequence
acatatgacaagcaagtttc

SEQ ID NO: 326300 - DNA, 20 bp, Artificial
  CRISPR gRNA sequence
atgacaagcaagtttctggt

SEQ ID NO: 326301 - DNA, 20 bp, Artificial
  CRISPR gRNA sequence
tgacaagcaagtttctggtt

SEQ ID NO: 326302 - DNA, 20 bp, Artificial
  CRISPR gRNA sequence
ggttaggatttttttttctc

SEQ ID NO: 326303 - DNA, 20 bp, Artificial
  CRISPR gRNA sequence
gttaggatttttttttctct

SEQ ID NO: 326304 - DNA, 20 bp, Artificial
  CRISPR gRNA sequence
atttttttttctctaggaca

SEQ ID NO: 326305 - DNA, 20 bp, Artificial
  CRISPR gRNA sequence
tttatcttatgttcttcctt

SEQ ID NO: 326306 - DNA, 20 bp, Artificial
  CRISPR gRNA sequence
ttatcttatgttcttccttg

SEQ ID NO: 326307 - DNA, 20 bp, Artificial
  CRISPR gRNA sequence
tatcttatgttcttccttga

SEQ ID NO: 326308 - DNA, 20 bp, Artificial
  CRISPR gRNA sequence
atcttatgttcttccttgag

SEQ ID NO: 326309 - DNA, 20 bp, Artificial
  CRISPR gRNA sequence
ttatgttcttccttgagggg

SEQ ID NO: 326310 - DNA, 20 bp, Artificial
  CRISPR gRNA sequence
atgttcttccttgaggggtg

SEQ ID NO: 326311 - DNA, 20 bp, Artificial
  CRISPR gRNA sequence
tgttcttccttgaggggtgg

SEQ ID NO: 326312 - DNA, 20 bp, Artificial
  CRISPR gRNA sequence
gttcttccttgaggggtgga

SEQ ID NO: 326313 - DNA, 20 bp, Artificial
  CRISPR gRNA sequence
tcttccttgaggggtggagg

SEQ ID NO: 326314 - DNA, 20 bp, Artificial
  CRISPR gRNA sequence
aggggtggagggagaatgtg

SEQ ID NO: 326315 - DNA, 20 bp, Artificial
  CRISPR gRNA sequence
aatgtgaagctgtttcattt

SEQ ID NO: 326316 - DNA, 20 bp, Artificial
  CRISPR gRNA sequence
gctgtttcattttggtgcaa

SEQ ID NO: 326317 - DNA, 20 bp, Artificial
  CRISPR gRNA sequence
tgtttcattttggtgcaaca

SEQ ID NO: 326318 - DNA, 20 bp, Artificial
  CRISPR gRNA sequence
ttatgttaaaatataattat

SEQ ID NO: 326319 - DNA, 20 bp, Artificial
  CRISPR gRNA sequence
tatgttaaaatataattatt

SEQ ID NO: 326320 - DNA, 20 bp, Artificial
  CRISPR gRNA sequence
atgttaaaatataattatta

SEQ ID NO: 326321 - DNA, 20 bp, Artificial
  CRISPR gRNA sequence
ttgttttctttctttttatg

SEQ ID NO: 326322 - DNA, 20 bp, Artificial
  CRISPR gRNA sequence
tgttttctttctttttatgc

SEQ ID NO: 326323 - DNA, 20 bp, Artificial
  CRISPR gRNA sequence
ttttctttctttttatgcag

SEQ ID NO: 326324 - DNA, 20 bp, Artificial
  CRISPR gRNA sequence
ttttatgcaggagaaatcaa

SEQ ID NO: 326325 - DNA, 20 bp, Artificial
  CRISPR gRNA sequence
tcaatggttctgccaattat

SEQ ID NO: 326326 - DNA, 20 bp, Artificial
  CRISPR gRNA sequence
gagatgtttatatttcacaa

SEQ ID NO: 326327 - DNA, 20 bp, Artificial
  CRISPR gRNA sequence
gatgtttatatttcacaacg

SEQ ID NO: 326328 - DNA, 20 bp, Artificial
  CRISPR gRNA sequence
atgtttatatttcacaacgg

SEQ ID NO: 326329 - DNA, 20 bp, Artificial
  CRISPR gRNA sequence
gcaaatatcctgacattgtc

SEQ ID NO: 326330 - DNA, 20 bp, Artificial
  CRISPR gRNA sequence
ttgtccagcaatttaaaatg

SEQ ID NO: 326331 - DNA, 20 bp, Artificial
  CRISPR gRNA sequence
atttaaaatgcagttgctga

SEQ ID NO: 326332 - DNA, 20 bp, Artificial
  CRISPR gRNA sequence
tttaaaatgcagttgctgaa

SEQ ID NO: 326333 - DNA, 20 bp, Artificial
  CRISPR gRNA sequence
ttaaaatgcagttgctgaaa

SEQ ID NO: 326334 - DNA, 20 bp, Artificial
  CRISPR gRNA sequence
taaaatgcagttgctgaaag

SEQ ID NO: 326335 - DNA, 20 bp, Artificial
  CRISPR gRNA sequence
aaaatgcagttgctgaaagg

SEQ ID NO: 326336 - DNA, 20 bp, Artificial
  CRISPR gRNA sequence
aaatgcagttgctgaaaggg

SEQ ID NO: 326337 - DNA, 20 bp, Artificial
  CRISPR gRNA sequence
aaatactctgcgatctcact

SEQ ID NO: 326338 - DNA, 20 bp, Artificial
  CRISPR gRNA sequence
ctgcgatctcactaagacaa

SEQ ID NO: 326339 - DNA, 20 bp, Artificial
  CRISPR gRNA sequence
tgcgatctcactaagacaaa

SEQ ID NO: 326340 - DNA, 20 bp, Artificial
  CRISPR gRNA sequence
gatctcactaagacaaaagg

SEQ ID NO: 326341 - DNA, 20 bp, Artificial
  CRISPR gRNA sequence
ctcactaagacaaaaggaag

SEQ ID NO: 326342 - DNA, 20 bp, Artificial
  CRISPR gRNA sequence
gacaaaaggaagtggaaaca

SEQ ID NO: 326343 - DNA, 20 bp, Artificial
  CRISPR gRNA sequence
gtggaaacacagtgtccatt

SEQ ID NO: 326344 - DNA, 20 bp, Artificial
  CRISPR gRNA sequence
ggaaacacagtgtccattaa

SEQ ID NO: 326345 - DNA, 20 bp, Artificial
  CRISPR gRNA sequence
gtctgaaattctgccattct

SEQ ID NO: 326346 - DNA, 20 bp, Artificial
  CRISPR gRNA sequence
cattctcagttatccaacaa

SEQ ID NO: 326347 - DNA, 20 bp, Artificial
  CRISPR gRNA sequence
ctctttttttctatacaact

SEQ ID NO: 326348 - DNA, 20 bp, Artificial
  CRISPR gRNA sequence
ttttgatcctcctcctttta

SEQ ID NO: 326349 - DNA, 20 bp, Artificial
  CRISPR gRNA sequence
tccttttaaagtaactctta

SEQ ID NO: 326350 - DNA, 20 bp, Artificial
  CRISPR gRNA sequence
ccttttaaagtaactcttac

SEQ ID NO: 326351 - DNA, 20 bp, Artificial
  CRISPR gRNA sequence
ttttaaagtaactcttacag

SEQ ID NO: 326352 - DNA, 20 bp, Artificial
  CRISPR gRNA sequence
tttaaagtaactcttacagg

SEQ ID NO: 326353 - DNA, 20 bp, Artificial
  CRISPR gRNA sequence
ggaggatatttgcatattta

SEQ ID NO: 326354 - DNA, 20 bp, Artificial
  CRISPR gRNA sequence
gatatttgcatatttatggt

SEQ ID NO: 326355 - DNA, 20 bp, Artificial
  CRISPR gRNA sequence
tgctttcatcttccaaactt

SEQ ID NO: 326356 - DNA, 20 bp, Artificial
  CRISPR gRNA sequence
ctttcatcttccaaacttaa

SEQ ID NO: 326357 - DNA, 20 bp, Artificial
  CRISPR gRNA sequence
ttctcactaataaaatcaat

SEQ ID NO: 326358 - DNA, 20 bp, Artificial
  CRISPR gRNA sequence
caaataaatatcttttgtgt

SEQ ID NO: 326359 - DNA, 20 bp, Artificial
  CRISPR gRNA sequence
aataaatatcttttgtgttg

SEQ ID NO: 326360 - DNA, 20 bp, Artificial
  CRISPR gRNA sequence
cttttgtgttggagttcact

SEQ ID NO: 326361 - DNA, 20 bp, Artificial
  CRISPR gRNA sequence
tgttggagttcacttagatg

SEQ ID NO: 326362 - DNA, 20 bp, Artificial
  CRISPR gRNA sequence
gttcacttagatgcagttga

SEQ ID NO: 326363 - DNA, 20 bp, Artificial
  CRISPR gRNA sequence
gatggtaatcatttataatg

SEQ ID NO: 326364 - DNA, 20 bp, Artificial
  CRISPR gRNA sequence
tcatttataatgaagatata

SEQ ID NO: 326365 - DNA, 20 bp, Artificial
  CRISPR gRNA sequence
catttataatgaagatatac

SEQ ID NO: 326366 - DNA, 20 bp, Artificial
  CRISPR gRNA sequence
gatttactattaatcataat

SEQ ID NO: 326367 - DNA, 20 bp, Artificial
  CRISPR gRNA sequence
taatcataattagtattatt

SEQ ID NO: 326368 - DNA, 20 bp, Artificial
  CRISPR gRNA sequence
caatatgcaatgtaatccca

SEQ ID NO: 326369 - DNA, 20 bp, Artificial
  CRISPR gRNA sequence
atgtaatcccatagactgct

SEQ ID NO: 326370 - DNA, 20 bp, Artificial
  CRISPR gRNA sequence
aatcccatagactgctaagt

SEQ ID NO: 326371 - DNA, 20 bp, Artificial
  CRISPR gRNA sequence
atagactgctaagtcagaaa

SEQ ID NO: 326372 - DNA, 20 bp, Artificial
  CRISPR gRNA sequence
acacatatgctattaaaaat

SEQ ID NO: 326373 - DNA, 20 bp, Artificial
  CRISPR gRNA sequence
cacatatgctattaaaaatc

SEQ ID NO: 326374 - DNA, 20 bp, Artificial
  CRISPR gRNA sequence
taaaaatcaggaaaaacatt

SEQ ID NO: 326375 - DNA, 20 bp, Artificial
  CRISPR gRNA sequence
aagacaaatacttaaactta

SEQ ID NO: 326376 - DNA, 20 bp, Artificial
  CRISPR gRNA sequence
ttaaacttatggcttaataa

SEQ ID NO: 326377 - DNA, 20 bp, Artificial
  CRISPR gRNA sequence
taaacttatggcttaataat

SEQ ID NO: 326378 - DNA, 20 bp, Artificial
  CRISPR gRNA sequence
ggtattatctctattcacct

SEQ ID NO: 326379 - DNA, 20 bp, Artificial
  CRISPR gRNA sequence
tctctattcacctaagattt

SEQ ID NO: 326380 - DNA, 20 bp, Artificial
  CRISPR gRNA sequence
ctctattcacctaagattta

SEQ ID NO: 326381 - DNA, 20 bp, Artificial
  CRISPR gRNA sequence
ttcacctaagatttaaggtt

SEQ ID NO: 326382 - DNA, 20 bp, Artificial
  CRISPR gRNA sequence
ttggttttgcactgtgtttg

SEQ ID NO: 326383 - DNA, 20 bp, Artificial
  CRISPR gRNA sequence
tgcactgtgtttgtggaatg

SEQ ID NO: 326384 - DNA, 20 bp, Artificial
  CRISPR gRNA sequence
agtatgatgattgaaaatca

SEQ ID NO: 326385 - DNA, 20 bp, Artificial
  CRISPR gRNA sequence
ttacctcttttataaaaata

SEQ ID NO: 326386 - DNA, 20 bp, Artificial
  CRISPR gRNA sequence
tacctcttttataaaaatat

SEQ ID NO: 326387 - DNA, 20 bp, Artificial
  CRISPR gRNA sequence
ctcttttataaaaatatagg

SEQ ID NO: 326388 - DNA, 20 bp, Artificial
  CRISPR gRNA sequence
ttataaaaatataggcagaa

SEQ ID NO: 326389 - DNA, 20 bp, Artificial
  CRISPR gRNA sequence
cattatatgcataatctttt

SEQ ID NO: 326390 - DNA, 20 bp, Artificial
  CRISPR gRNA sequence
atgcataatcttttaagttt

SEQ ID NO: 326391 - DNA, 20 bp, Artificial
  CRISPR gRNA sequence
atcttttaagttttagttcc

SEQ ID NO: 326392 - DNA, 20 bp, Artificial
  CRISPR gRNA sequence
tggatccttgccataatact

SEQ ID NO: 326393 - DNA, 20 bp, Artificial
  CRISPR gRNA sequence
ccataatactgagatgatgt

SEQ ID NO: 326394 - DNA, 20 bp, Artificial
  CRISPR gRNA sequence
ctaataacttgcccacttac

SEQ ID NO: 326395 - DNA, 20 bp, Artificial
  CRISPR gRNA sequence
tggatttcatgactataata

SEQ ID NO: 326396 - DNA, 20 bp, Artificial
  CRISPR gRNA sequence
ttcatgactataataaagaa

SEQ ID NO: 326397 - DNA, 20 bp, Artificial
  CRISPR gRNA sequence
aaaagcttcatttgattaaa

SEQ ID NO: 326398 - DNA, 20 bp, Artificial
  CRISPR gRNA sequence
ttaaatagctcttttaaatt

SEQ ID NO: 326399 - DNA, 20 bp, Artificial
  CRISPR gRNA sequence
atagctcttttaaatttggt

SEQ ID NO: 326400 - DNA, 20 bp, Artificial
  CRISPR gRNA sequence
agctcttttaaatttggtaa

SEQ ID NO: 326401 - DNA, 20 bp, Artificial
  CRISPR gRNA sequence
aaatttggtaagagaacttg

SEQ ID NO: 326402 - DNA, 20 bp, Artificial
  CRISPR gRNA sequence
tggtaagagaacttgtggtt

SEQ ID NO: 326403 - DNA, 20 bp, Artificial
  CRISPR gRNA sequence
taagagaacttgtggttcag

SEQ ID NO: 326404 - DNA, 20 bp, Artificial
  CRISPR gRNA sequence
acatacctttttttccaatc

SEQ ID NO: 326405 - DNA, 20 bp, Artificial
  CRISPR gRNA sequence
cagaatcacaactttgttgc

SEQ ID NO: 326406 - DNA, 20 bp, Artificial
  CRISPR gRNA sequence
cacaactttgttgccagctg

SEQ ID NO: 326407 - DNA, 20 bp, Artificial
  CRISPR gRNA sequence
tttgttgccagctgaagttc

SEQ ID NO: 326408 - DNA, 20 bp, Artificial
  CRISPR gRNA sequence
gctgaagttctggttaccca

SEQ ID NO: 326409 - DNA, 20 bp, Artificial
  CRISPR gRNA sequence
ctgaagttctggttacccat

SEQ ID NO: 326410 - DNA, 20 bp, Artificial
  CRISPR gRNA sequence
ctggttacccataggatgtg

SEQ ID NO: 326411 - DNA, 20 bp, Artificial
  CRISPR gRNA sequence
aggatgtgcagcctttgttg

SEQ ID NO: 326412 - DNA, 20 bp, Artificial
  CRISPR gRNA sequence
ctttgttgtagtctgcattt

SEQ ID NO: 326413 - DNA, 20 bp, Artificial
  CRISPR gRNA sequence
tttgttgtagtctgcatttt

SEQ ID NO: 326414 - DNA, 20 bp, Artificial
  CRISPR gRNA sequence
tgggatgcatacttatttgt

SEQ ID NO: 326415 - DNA, 20 bp, Artificial
  CRISPR gRNA sequence
ttatttgttggcttacaaaa

SEQ ID NO: 326416 - DNA, 20 bp, Artificial
  CRISPR gRNA sequence
tatttgttggcttacaaaaa

SEQ ID NO: 326417 - DNA, 20 bp, Artificial
  CRISPR gRNA sequence
tgttggcttacaaaaaaggt

SEQ ID NO: 326418 - DNA, 20 bp, Artificial
  CRISPR gRNA sequence
ctttccttgtatctgcttta

SEQ ID NO: 326419 - DNA, 20 bp, Artificial
  CRISPR gRNA sequence
tctgctttacagatgcacat

SEQ ID NO: 326420 - DNA, 20 bp, Artificial
  CRISPR gRNA sequence
agtgattatttcctcatcaa

SEQ ID NO: 326421 - DNA, 20 bp, Artificial
  CRISPR gRNA sequence
ttcctcatcaaaagtacaca

SEQ ID NO: 326422 - DNA, 20 bp, Artificial
  CRISPR gRNA sequence
aaagtacacatggctcttgt

SEQ ID NO: 326423 - DNA, 20 bp, Artificial
  CRISPR gRNA sequence
agtacacatggctcttgtca

SEQ ID NO: 326424 - DNA, 20 bp, Artificial
  CRISPR gRNA sequence
tgtcagagtaatttgaccaa

SEQ ID NO: 326425 - DNA, 20 bp, Artificial
  CRISPR gRNA sequence
gtcagagtaatttgaccaac

SEQ ID NO: 326426 - DNA, 20 bp, Artificial
  CRISPR gRNA sequence
tcagagtaatttgaccaaca

SEQ ID NO: 326427 - DNA, 20 bp, Artificial
  CRISPR gRNA sequence
agagtaatttgaccaacagg

SEQ ID NO: 326428 - DNA, 20 bp, Artificial
  CRISPR gRNA sequence
ggagacaattccttcccccc

SEQ ID NO: 326429 - DNA, 20 bp, Artificial
  CRISPR gRNA sequence
tactaattaaactaatcact

SEQ ID NO: 326430 - DNA, 20 bp, Artificial
  CRISPR gRNA sequence
attaaactaatcacttggaa

SEQ ID NO: 326431 - DNA, 20 bp, Artificial
  CRISPR gRNA sequence
aaatttatgtatttgtttta

SEQ ID NO: 326432 - DNA, 20 bp, Artificial
  CRISPR gRNA sequence
tttatagcccacacattcca

SEQ ID NO: 326433 - DNA, 20 bp, Artificial
  CRISPR gRNA sequence
tatagcccacacattccaaa

SEQ ID NO: 326434 - DNA, 20 bp, Artificial
  CRISPR gRNA sequence
atagcccacacattccaaag

SEQ ID NO: 326435 - DNA, 20 bp, Artificial
  CRISPR gRNA sequence
ccaaagaggacttgacttga

SEQ ID NO: 326436 - DNA, 20 bp, Artificial
  CRISPR gRNA sequence
ggacttgacttgatggctta

SEQ ID NO: 326437 - DNA, 20 bp, Artificial
  CRISPR gRNA sequence
acttgacttgatggcttaca

SEQ ID NO: 326438 - DNA, 20 bp, Artificial
  CRISPR gRNA sequence
ttgacttgatggcttacaga

SEQ ID NO: 326439 - DNA, 20 bp, Artificial
  CRISPR gRNA sequence
attattattattgttcaaac

SEQ ID NO: 326440 - DNA, 20 bp, Artificial
  CRISPR gRNA sequence
tattattgttcaaactagat

SEQ ID NO: 326441 - DNA, 20 bp, Artificial
  CRISPR gRNA sequence
attattgttcaaactagatg

SEQ ID NO: 326442 - DNA, 20 bp, Artificial
  CRISPR gRNA sequence
tcaaactagatgaggaaatt

SEQ ID NO: 326443 - DNA, 20 bp, Artificial
  CRISPR gRNA sequence
caaactagatgaggaaattg

SEQ ID NO: 326444 - DNA, 20 bp, Artificial
  CRISPR gRNA sequence
tagatgaggaaattgaggtc

SEQ ID NO: 326445 - DNA, 20 bp, Artificial
  CRISPR gRNA sequence
gatgaggaaattgaggtcaa

SEQ ID NO: 326446 - DNA, 20 bp, Artificial
  CRISPR gRNA sequence
gaggaaattgaggtcaagag

SEQ ID NO: 326447 - DNA, 20 bp, Artificial
  CRISPR gRNA sequence
ttgaggtcaagagaagacta

SEQ ID NO: 326448 - DNA, 20 bp, Artificial
  CRISPR gRNA sequence
tgaggtcaagagaagactaa

SEQ ID NO: 326449 - DNA, 20 bp, Artificial
  CRISPR gRNA sequence
gtcaagagaagactaaaggt

SEQ ID NO: 326450 - DNA, 20 bp, Artificial
  CRISPR gRNA sequence
tcaagagaagactaaaggtc

SEQ ID NO: 326451 - DNA, 20 bp, Artificial
  CRISPR gRNA sequence
aagagaagactaaaggtcag

SEQ ID NO: 326452 - DNA, 20 bp, Artificial
  CRISPR gRNA sequence
agagaagactaaaggtcagg

SEQ ID NO: 326453 - DNA, 20 bp, Artificial
  CRISPR gRNA sequence
gaagactaaaggtcaggagg

SEQ ID NO: 326454 - DNA, 20 bp, Artificial
  CRISPR gRNA sequence
aagactaaaggtcaggagga

SEQ ID NO: 326455 - DNA, 20 bp, Artificial
  CRISPR gRNA sequence
ggaaggttaaaacatcaaaa

SEQ ID NO: 326456 - DNA, 20 bp, Artificial
  CRISPR gRNA sequence
ttttaaaaaattattatgca

SEQ ID NO: 326457 - DNA, 20 bp, Artificial
  CRISPR gRNA sequence
tttaaaaaattattatgcat

SEQ ID NO: 326458 - DNA, 20 bp, Artificial
  CRISPR gRNA sequence
tgggctgcgaatttgaatcc

SEQ ID NO: 326459 - DNA, 20 bp, Artificial
  CRISPR gRNA sequence
gggctgcgaatttgaatcca

SEQ ID NO: 326460 - DNA, 20 bp, Artificial
  CRISPR gRNA sequence
aatttgaatccaaggttcct

SEQ ID NO: 326461 - DNA, 20 bp, Artificial
  CRISPR gRNA sequence
tttgaatccaaggttcctga

SEQ ID NO: 326462 - DNA, 20 bp, Artificial
  CRISPR gRNA sequence
ttgaatccaaggttcctgag

SEQ ID NO: 326463 - DNA, 20 bp, Artificial
  CRISPR gRNA sequence
aatccaaggttcctgagagg

SEQ ID NO: 326464 - DNA, 20 bp, Artificial
  CRISPR gRNA sequence
atccaaggttcctgagaggc

SEQ ID NO: 326465 - DNA, 20 bp, Artificial
  CRISPR gRNA sequence
tccaaggttcctgagaggca

SEQ ID NO: 326466 - DNA, 20 bp, Artificial
  CRISPR gRNA sequence
aaggttcctgagaggcaggg

SEQ ID NO: 326467 - DNA, 20 bp, Artificial
  CRISPR gRNA sequence
ggttcctgagaggcagggca

SEQ ID NO: 326468 - DNA, 20 bp, Artificial
  CRISPR gRNA sequence
cagggcagagatgaaacaat

SEQ ID NO: 326469 - DNA, 20 bp, Artificial
  CRISPR gRNA sequence
gagatgaaacaattagttat

SEQ ID NO: 326470 - DNA, 20 bp, Artificial
  CRISPR gRNA sequence
aattagttataagttttgct

SEQ ID NO: 326471 - DNA, 20 bp, Artificial
  CRISPR gRNA sequence
agttataagttttgcttagc

SEQ ID NO: 326472 - DNA, 20 bp, Artificial
  CRISPR gRNA sequence
ataagttttgcttagctggt

SEQ ID NO: 326473 - DNA, 20 bp, Artificial
  CRISPR gRNA sequence
cttagctggtaagttaaaaa

SEQ ID NO: 326474 - DNA, 20 bp, Artificial
  CRISPR gRNA sequence
gctggtaagttaaaaacagt

SEQ ID NO: 326475 - DNA, 20 bp, Artificial
  CRISPR gRNA sequence
gtaagttaaaaacagtcagc

SEQ ID NO: 326476 - DNA, 20 bp, Artificial
  CRISPR gRNA sequence
gttaaaaacagtcagcaaga

SEQ ID NO: 326477 - DNA, 20 bp, Artificial
  CRISPR gRNA sequence
agtcagcaagaaagccttct

SEQ ID NO: 326478 - DNA, 20 bp, Artificial
  CRISPR gRNA sequence
gtcagcaagaaagccttcta

SEQ ID NO: 326479 - DNA, 20 bp, Artificial
  CRISPR gRNA sequence
gccttctaaggtgtcaattg

SEQ ID NO: 326480 - DNA, 20 bp, Artificial
  CRISPR gRNA sequence
ctaaggtgtcaattgtagct

SEQ ID NO: 326481 - DNA, 20 bp, Artificial
  CRISPR gRNA sequence
aggtgtcaattgtagctgag

SEQ ID NO: 326482 - DNA, 20 bp, Artificial
  CRISPR gRNA sequence
ggtgtcaattgtagctgaga

SEQ ID NO: 326483 - DNA, 20 bp, Artificial
  CRISPR gRNA sequence
aaattgacaacttttttaca

SEQ ID NO: 326484 - DNA, 20 bp, Artificial
  CRISPR gRNA sequence
ttgacaacttttttacatgg

SEQ ID NO: 326485 - DNA, 20 bp, Artificial
  CRISPR gRNA sequence
tgacaacttttttacatggt

SEQ ID NO: 326486 - DNA, 20 bp, Artificial
  CRISPR gRNA sequence
ttttttacatggtaggttat

SEQ ID NO: 326487 - DNA, 20 bp, Artificial
  CRISPR gRNA sequence
tattagactccttgctttta

SEQ ID NO: 326488 - DNA, 20 bp, Artificial
  CRISPR gRNA sequence
tgcttttaaagaaaaccact

SEQ ID NO: 326489 - DNA, 20 bp, Artificial
  CRISPR gRNA sequence
gcttttaaagaaaaccactg

SEQ ID NO: 326490 - DNA, 20 bp, Artificial
  CRISPR gRNA sequence
ttttaaagaaaaccactgag

SEQ ID NO: 326491 - DNA, 20 bp, Artificial
  CRISPR gRNA sequence
aaaaccactgaggagctatt

SEQ ID NO: 326492 - DNA, 20 bp, Artificial
  CRISPR gRNA sequence
ccactgaggagctatttaga

SEQ ID NO: 326493 - DNA, 20 bp, Artificial
  CRISPR gRNA sequence
caacaaaaatctccctgtgc

SEQ ID NO: 326494 - DNA, 20 bp, Artificial
  CRISPR gRNA sequence
aacaaaaatctccctgtgct

SEQ ID NO: 326495 - DNA, 20 bp, Artificial
  CRISPR gRNA sequence
acaaaaatctccctgtgctg

SEQ ID NO: 326496 - DNA, 20 bp, Artificial
  CRISPR gRNA sequence
caaaaatctccctgtgctgg

SEQ ID NO: 326497 - DNA, 20 bp, Artificial
  CRISPR gRNA sequence
gtgctgggggatattctttt

SEQ ID NO: 326498 - DNA, 20 bp, Artificial
  CRISPR gRNA sequence
ctttttggtctcttgcatta

SEQ ID NO: 326499 - DNA, 20 bp, Artificial
  CRISPR gRNA sequence
tttttggtctcttgcattac

SEQ ID NO: 326500 - DNA, 20 bp, Artificial
  CRISPR gRNA sequence
gcattacaggttctcaatca

SEQ ID NO: 326501 - DNA, 20 bp, Artificial
  CRISPR gRNA sequence
caccactctgcatattacgc

SEQ ID NO: 326502 - DNA, 20 bp, Artificial
  CRISPR gRNA sequence
tgcatattacgcgagtatgc

SEQ ID NO: 326503 - DNA, 20 bp, Artificial
  CRISPR gRNA sequence
acgcgagtatgctagtactc

SEQ ID NO: 326504 - DNA, 20 bp, Artificial
  CRISPR gRNA sequence
ctagtactcaagtatatcca

SEQ ID NO: 326505 - DNA, 20 bp, Artificial
  CRISPR gRNA sequence
actcaagtatatccacagtg

SEQ ID NO: 326506 - DNA, 20 bp, Artificial
  CRISPR gRNA sequence
tatatccacagtgtggtcat

SEQ ID NO: 326507 - DNA, 20 bp, Artificial
  CRISPR gRNA sequence
tccacagtgtggtcattggc

SEQ ID NO: 326508 - DNA, 20 bp, Artificial
  CRISPR gRNA sequence
cattggccagtgtatatctg

SEQ ID NO: 326509 - DNA, 20 bp, Artificial
  CRISPR gRNA sequence
attggccagtgtatatctgt

SEQ ID NO: 326510 - DNA, 20 bp, Artificial
  CRISPR gRNA sequence
tggccagtgtatatctgtgg

SEQ ID NO: 326511 - DNA, 20 bp, Artificial
  CRISPR gRNA sequence
gccagtgtatatctgtggga

SEQ ID NO: 326512 - DNA, 20 bp, Artificial
  CRISPR gRNA sequence
agtgtatatctgtgggagag

SEQ ID NO: 326513 - DNA, 20 bp, Artificial
  CRISPR gRNA sequence
atctgtgggagagtggaatt

SEQ ID NO: 326514 - DNA, 20 bp, Artificial
  CRISPR gRNA sequence
gtgggagagtggaatttgga

SEQ ID NO: 326515 - DNA, 20 bp, Artificial
  CRISPR gRNA sequence
gggagagtggaatttggaaa

SEQ ID NO: 326516 - DNA, 20 bp, Artificial
  CRISPR gRNA sequence
ggaatttggaaagagacata

SEQ ID NO: 326517 - DNA, 20 bp, Artificial
  CRISPR gRNA sequence
atttggaaagagacataaag

SEQ ID NO: 326518 - DNA, 20 bp, Artificial
  CRISPR gRNA sequence
tttggaaagagacataaaga

SEQ ID NO: 326519 - DNA, 20 bp, Artificial
  CRISPR gRNA sequence
ggaaagagacataaagaagg

SEQ ID NO: 326520 - DNA, 20 bp, Artificial
  CRISPR gRNA sequence
aaagagacataaagaaggaa

SEQ ID NO: 326521 - DNA, 20 bp, Artificial
  CRISPR gRNA sequence
acataaagaaggaagagaat

SEQ ID NO: 326522 - DNA, 20 bp, Artificial
  CRISPR gRNA sequence
aaagaaggaagagaatgaga

SEQ ID NO: 326523 - DNA, 20 bp, Artificial
  CRISPR gRNA sequence
agagaatgagatagcgccca

SEQ ID NO: 326524 - DNA, 20 bp, Artificial
  CRISPR gRNA sequence
tgagatagcgcccatggtct

SEQ ID NO: 326525 - DNA, 20 bp, Artificial
  CRISPR gRNA sequence
cgcccatggtctaagtctgc

SEQ ID NO: 326526 - DNA, 20 bp, Artificial
  CRISPR gRNA sequence
gcccatggtctaagtctgct

SEQ ID NO: 326527 - DNA, 20 bp, Artificial
  CRISPR gRNA sequence
atggtctaagtctgctggga

SEQ ID NO: 326528 - DNA, 20 bp, Artificial
  CRISPR gRNA sequence
ctgctgggaaagaaacaata

SEQ ID NO: 326529 - DNA, 20 bp, Artificial
  CRISPR gRNA sequence
tgctgggaaagaaacaataa

SEQ ID NO: 326530 - DNA, 20 bp, Artificial
  CRISPR gRNA sequence
gaaacaataaaggcaaaaac

SEQ ID NO: 326531 - DNA, 20 bp, Artificial
  CRISPR gRNA sequence
aaacaataaaggcaaaaacg

SEQ ID NO: 326532 - DNA, 20 bp, Artificial
  CRISPR gRNA sequence
caataaaggcaaaaacgagg

SEQ ID NO: 326533 - DNA, 20 bp, Artificial
  CRISPR gRNA sequence
aaaggcaaaaacgaggaaga

SEQ ID NO: 326534 - DNA, 20 bp, Artificial
  CRISPR gRNA sequence
caaaaacgaggaagaaagtt

SEQ ID NO: 326535 - DNA, 20 bp, Artificial
  CRISPR gRNA sequence
aaacgaggaagaaagttcag

SEQ ID NO: 326536 - DNA, 20 bp, Artificial
  CRISPR gRNA sequence
gaggaagaaagttcagtaga

SEQ ID NO: 326537 - DNA, 20 bp, Artificial
  CRISPR gRNA sequence
tagaaagctctttttatgta

SEQ ID NO: 326538 - DNA, 20 bp, Artificial
  CRISPR gRNA sequence
tttcatattgtttttctact

SEQ ID NO: 326539 - DNA, 20 bp, Artificial
  CRISPR gRNA sequence
ttgtttttctacttagccta

SEQ ID NO: 326540 - DNA, 20 bp, Artificial
  CRISPR gRNA sequence
ttttctacttagcctaaagc

SEQ ID NO: 326541 - DNA, 20 bp, Artificial
  CRISPR gRNA sequence
tttctacttagcctaaagcc

SEQ ID NO: 326542 - DNA, 20 bp, Artificial
  CRISPR gRNA sequence
tagcctaaagccaggaacct

SEQ ID NO: 326543 - DNA, 20 bp, Artificial
  CRISPR gRNA sequence
tgtcacataccacttcaaca

SEQ ID NO: 326544 - DNA, 20 bp, Artificial
  CRISPR gRNA sequence
cataccacttcaacaaagaa

SEQ ID NO: 326545 - DNA, 20 bp, Artificial
  CRISPR gRNA sequence
cttcaacaaagaatagaaaa

SEQ ID NO: 326546 - DNA, 20 bp, Artificial
  CRISPR gRNA sequence
tagaaaacagtcaaaaaaca

SEQ ID NO: 326547 - DNA, 20 bp, Artificial
  CRISPR gRNA sequence
gaaaacagtcaaaaaacaaa

SEQ ID NO: 326548 - DNA, 20 bp, Artificial
  CRISPR gRNA sequence
acagtcaaaaaacaaagaga

SEQ ID NO: 326549 - DNA, 20 bp, Artificial
  CRISPR gRNA sequence
agtcaaaaaacaaagagatg

SEQ ID NO: 326550 - DNA, 20 bp, Artificial
  CRISPR gRNA sequence
caaaaaacaaagagatggag

SEQ ID NO: 326551 - DNA, 20 bp, Artificial
  CRISPR gRNA sequence
aacaaagagatggagaagaa

SEQ ID NO: 326552 - DNA, 20 bp, Artificial
  CRISPR gRNA sequence
atggagaagaaaagatgacc

SEQ ID NO: 326553 - DNA, 20 bp, Artificial
  CRISPR gRNA sequence
aagatgaccaagcatgtttc

SEQ ID NO: 326554 - DNA, 20 bp, Artificial
  CRISPR gRNA sequence
atgtttctggctttttcttt

SEQ ID NO: 326555 - DNA, 20 bp, Artificial
  CRISPR gRNA sequence
tttctggctttttctttcag

SEQ ID NO: 326556 - DNA, 20 bp, Artificial
  CRISPR gRNA sequence
ttctttcagaagtattcatc

SEQ ID NO: 326557 - DNA, 20 bp, Artificial
  CRISPR gRNA sequence
tccagtgtgcacgaccctaa

SEQ ID NO: 326558 - DNA, 20 bp, Artificial
  CRISPR gRNA sequence
aacggtgaatacatgttcat

SEQ ID NO: 326559 - DNA, 20 bp, Artificial
  CRISPR gRNA sequence
cggtgaatacatgttcatga

SEQ ID NO: 326560 - DNA, 20 bp, Artificial
  CRISPR gRNA sequence
tgaatacatgttcatgagag

SEQ ID NO: 326561 - DNA, 20 bp, Artificial
  CRISPR gRNA sequence
gttcatgagagcagtgaaca

SEQ ID NO: 326562 - DNA, 20 bp, Artificial
  CRISPR gRNA sequence
gtgaacacagccaaaaaatc

SEQ ID NO: 326563 - DNA, 20 bp, Artificial
  CRISPR gRNA sequence
agccaaaaaatctagactca

SEQ ID NO: 326564 - DNA, 20 bp, Artificial
  CRISPR gRNA sequence
gccaaaaaatctagactcac

SEQ ID NO: 326565 - DNA, 20 bp, Artificial
  CRISPR gRNA sequence
ctcacaggtatgactccatt

SEQ ID NO: 326566 - DNA, 20 bp, Artificial
  CRISPR gRNA sequence
tcacaggtatgactccattt

SEQ ID NO: 326567 - DNA, 20 bp, Artificial
  CRISPR gRNA sequence
cacaggtatgactccatttg

SEQ ID NO: 326568 - DNA, 20 bp, Artificial
  CRISPR gRNA sequence
acaggtatgactccatttgg

SEQ ID NO: 326569 - DNA, 20 bp, Artificial
  CRISPR gRNA sequence
tatgactccatttgggggtt

SEQ ID NO: 326570 - DNA, 20 bp, Artificial
  CRISPR gRNA sequence
atgactccatttgggggttt

SEQ ID NO: 326571 - DNA, 20 bp, Artificial
  CRISPR gRNA sequence
actccatttgggggtttggg

SEQ ID NO: 326572 - DNA, 20 bp, Artificial
  CRISPR gRNA sequence
ctccatttgggggtttggga

SEQ ID NO: 326573 - DNA, 20 bp, Artificial
  CRISPR gRNA sequence
tccatttgggggtttgggaa

SEQ ID NO: 326574 - DNA, 20 bp, Artificial
  CRISPR gRNA sequence
atttgggggtttgggaaggg

SEQ ID NO: 326575 - DNA, 20 bp, Artificial
  CRISPR gRNA sequence
ttgggggtttgggaagggaa

SEQ ID NO: 326576 - DNA, 20 bp, Artificial
  CRISPR gRNA sequence
tgggggtttgggaagggaag

SEQ ID NO: 326577 - DNA, 20 bp, Artificial
  CRISPR gRNA sequence
gaagggaagaggtttcttca

SEQ ID NO: 326578 - DNA, 20 bp, Artificial
  CRISPR gRNA sequence
ggaagaggtttcttcacagt

SEQ ID NO: 326579 - DNA, 20 bp, Artificial
  CRISPR gRNA sequence
aggtttcttcacagtaagcc

SEQ ID NO: 326580 - DNA, 20 bp, Artificial
  CRISPR gRNA sequence
tttttttttttttaatttta

SEQ ID NO: 326581 - DNA, 20 bp, Artificial
  CRISPR gRNA sequence
ttttttttttttaattttaa

SEQ ID NO: 326582 - DNA, 20 bp, Artificial
  CRISPR gRNA sequence
ttttttttaattttaaagga

SEQ ID NO: 326583 - DNA, 20 bp, Artificial
  CRISPR gRNA sequence
tttttttaattttaaaggaa

SEQ ID NO: 326584 - DNA, 20 bp, Artificial
  CRISPR gRNA sequence
aaggaaaggaaaacatctcc

SEQ ID NO: 326585 - DNA, 20 bp, Artificial
  CRISPR gRNA sequence
aggaaaggaaaacatctcca

SEQ ID NO: 326586 - DNA, 20 bp, Artificial
  CRISPR gRNA sequence
acatctccaaggcctaattc

SEQ ID NO: 326587 - DNA, 20 bp, Artificial
  CRISPR gRNA sequence
tagaattttctgtgaaaatc

SEQ ID NO: 326588 - DNA, 20 bp, Artificial
  CRISPR gRNA sequence
ctggatttctcacttttaac

SEQ ID NO: 326589 - DNA, 20 bp, Artificial
  CRISPR gRNA sequence
aactagatttatattttctg

SEQ ID NO: 326590 - DNA, 20 bp, Artificial
  CRISPR gRNA sequence
gcagtatattgaaaacaaac

SEQ ID NO: 326591 - DNA, 20 bp, Artificial
  CRISPR gRNA sequence
tattgaaaacaaacaagcaa

SEQ ID NO: 326592 - DNA, 20 bp, Artificial
  CRISPR gRNA sequence
attgaaaacaaacaagcaat

SEQ ID NO: 326593 - DNA, 20 bp, Artificial
  CRISPR gRNA sequence
caaacaagcaataggtttgt

SEQ ID NO: 326594 - DNA, 20 bp, Artificial
  CRISPR gRNA sequence
attgaaactaaacacacaaa

SEQ ID NO: 326595 - DNA, 20 bp, Artificial
  CRISPR gRNA sequence
aaacagctcataaaccacca

SEQ ID NO: 326596 - DNA, 20 bp, Artificial
  CRISPR gRNA sequence
tcataaaccaccatagtatc

SEQ ID NO: 326597 - DNA, 20 bp, Artificial
  CRISPR gRNA sequence
cataaaccaccatagtatca

SEQ ID NO: 326598 - DNA, 20 bp, Artificial
  CRISPR gRNA sequence
ttttcccattgatgtttcaa

SEQ ID NO: 326599 - DNA, 20 bp, Artificial
  CRISPR gRNA sequence
cccattgatgtttcaaaagt

SEQ ID NO: 326600 - DNA, 20 bp, Artificial
  CRISPR gRNA sequence
ccattgatgtttcaaaagtt

SEQ ID NO: 326601 - DNA, 20 bp, Artificial
  CRISPR gRNA sequence
tcaaaagttgggatgattct

SEQ ID NO: 326602 - DNA, 20 bp, Artificial
  CRISPR gRNA sequence
attctaagtgttttttgttg

SEQ ID NO: 326603 - DNA, 20 bp, Artificial
  CRISPR gRNA sequence
ttctaagtgttttttgttga

SEQ ID NO: 326604 - DNA, 20 bp, Artificial
  CRISPR gRNA sequence
tctaagtgttttttgttgaa

SEQ ID NO: 326605 - DNA, 20 bp, Artificial
  CRISPR gRNA sequence
tttttgttgaagggttcatt

SEQ ID NO: 326606 - DNA, 20 bp, Artificial
  CRISPR gRNA sequence
ggttcattcagtcattcaat

SEQ ID NO: 326607 - DNA, 20 bp, Artificial
  CRISPR gRNA sequence
tcattcaatgagcgtttatt

SEQ ID NO: 326608 - DNA, 20 bp, Artificial
  CRISPR gRNA sequence
aatgagcgtttattgagcat

SEQ ID NO: 326609 - DNA, 20 bp, Artificial
  CRISPR gRNA sequence
gcgtttattgagcatcagtt

SEQ ID NO: 326610 - DNA, 20 bp, Artificial
  CRISPR gRNA sequence
attgagcatcagttaagtgt

SEQ ID NO: 326611 - DNA, 20 bp, Artificial
  CRISPR gRNA sequence
tcagttaagtgtgagttact

SEQ ID NO: 326612 - DNA, 20 bp, Artificial
  CRISPR gRNA sequence
ttaagtgtgagttactgagt

SEQ ID NO: 326613 - DNA, 20 bp, Artificial
  CRISPR gRNA sequence
taagtgtgagttactgagtg

SEQ ID NO: 326614 - DNA, 20 bp, Artificial
  CRISPR gRNA sequence
agttactgagtgaggcactc

SEQ ID NO: 326615 - DNA, 20 bp, Artificial
  CRISPR gRNA sequence
gttactgagtgaggcactct

SEQ ID NO: 326616 - DNA, 20 bp, Artificial
  CRISPR gRNA sequence
ttactgagtgaggcactctg

SEQ ID NO: 326617 - DNA, 20 bp, Artificial
  CRISPR gRNA sequence
gtgaggcactctggggaatt

SEQ ID NO: 326618 - DNA, 20 bp, Artificial
  CRISPR gRNA sequence
ggcactctggggaatttgga

SEQ ID NO: 326619 - DNA, 20 bp, Artificial
  CRISPR gRNA sequence
ggacagatatatgctaattt

SEQ ID NO: 326620 - DNA, 20 bp, Artificial
  CRISPR gRNA sequence
atatatgctaattttggact

SEQ ID NO: 326621 - DNA, 20 bp, Artificial
  CRISPR gRNA sequence
tgctaattttggactgagat

SEQ ID NO: 326622 - DNA, 20 bp, Artificial
  CRISPR gRNA sequence
gctaattttggactgagatt

SEQ ID NO: 326623 - DNA, 20 bp, Artificial
  CRISPR gRNA sequence
aattttggactgagattagg

SEQ ID NO: 326624 - DNA, 20 bp, Artificial
  CRISPR gRNA sequence
ttttggactgagattaggaa

SEQ ID NO: 326625 - DNA, 20 bp, Artificial
  CRISPR gRNA sequence
ttggactgagattaggaaga

SEQ ID NO: 326626 - DNA, 20 bp, Artificial
  CRISPR gRNA sequence
ttaggaagagagatctgtgc

SEQ ID NO: 326627 - DNA, 20 bp, Artificial
  CRISPR gRNA sequence
gagatctgtgctggtactgc

SEQ ID NO: 326628 - DNA, 20 bp, Artificial
  CRISPR gRNA sequence
gatctgtgctggtactgcta

SEQ ID NO: 326629 - DNA, 20 bp, Artificial
  CRISPR gRNA sequence
atctgtgctggtactgctag

SEQ ID NO: 326630 - DNA, 20 bp, Artificial
  CRISPR gRNA sequence
tctgtgctggtactgctaga

SEQ ID NO: 326631 - DNA, 20 bp, Artificial
  CRISPR gRNA sequence
gtgctggtactgctagaggg

SEQ ID NO: 326632 - DNA, 20 bp, Artificial
  CRISPR gRNA sequence
ctggtactgctagagggaag

SEQ ID NO: 326633 - DNA, 20 bp, Artificial
  CRISPR gRNA sequence
tggtactgctagagggaaga

SEQ ID NO: 326634 - DNA, 20 bp, Artificial
  CRISPR gRNA sequence
gtactgctagagggaagaag

SEQ ID NO: 326635 - DNA, 20 bp, Artificial
  CRISPR gRNA sequence
ggaagaaggagaaattgatg

SEQ ID NO: 326636 - DNA, 20 bp, Artificial
  CRISPR gRNA sequence
gagaaattgatgaagatatc

SEQ ID NO: 326637 - DNA, 20 bp, Artificial
  CRISPR gRNA sequence
tgaagatatctggttatttt

SEQ ID NO: 326638 - DNA, 20 bp, Artificial
  CRISPR gRNA sequence
gaagatatctggttattttg

SEQ ID NO: 326639 - DNA, 20 bp, Artificial
  CRISPR gRNA sequence
tatctggttattttgaggta

SEQ ID NO: 326640 - DNA, 20 bp, Artificial
  CRISPR gRNA sequence
tctggttattttgaggtaaa

SEQ ID NO: 326641 - DNA, 20 bp, Artificial
  CRISPR gRNA sequence
ttttgaggtaaagagtgtgc

SEQ ID NO: 326642 - DNA, 20 bp, Artificial
  CRISPR gRNA sequence
aggtaaagagtgtgcaagtt

SEQ ID NO: 326643 - DNA, 20 bp, Artificial
  CRISPR gRNA sequence
gtaaagagtgtgcaagttta

SEQ ID NO: 326644 - DNA, 20 bp, Artificial
  CRISPR gRNA sequence
gtgtgcaagtttagagaact

SEQ ID NO: 326645 - DNA, 20 bp, Artificial
  CRISPR gRNA sequence
gcaagtttagagaacttgga

SEQ ID NO: 326646 - DNA, 20 bp, Artificial
  CRISPR gRNA sequence
ttagagaacttggatggctt

SEQ ID NO: 326647 - DNA, 20 bp, Artificial
  CRISPR gRNA sequence
gagaacttggatggctttag

SEQ ID NO: 326648 - DNA, 20 bp, Artificial
  CRISPR gRNA sequence
ttggatggctttagaagtct

SEQ ID NO: 326649 - DNA, 20 bp, Artificial
  CRISPR gRNA sequence
ctttagaagtctcagtaaca

SEQ ID NO: 326650 - DNA, 20 bp, Artificial
  CRISPR gRNA sequence
gaaatttgaccttttctgtt

SEQ ID NO: 326651 - DNA, 20 bp, Artificial
  CRISPR gRNA sequence
aatttgaccttttctgttaa

SEQ ID NO: 326652 - DNA, 20 bp, Artificial
  CRISPR gRNA sequence
tgaccttttctgttaagagt

SEQ ID NO: 326653 - DNA, 20 bp, Artificial
  CRISPR gRNA sequence
gttaagagtcagaaaactga

SEQ ID NO: 326654 - DNA, 20 bp, Artificial
  CRISPR gRNA sequence
tcagaaaactgaaagttgcc

SEQ ID NO: 326655 - DNA, 20 bp, Artificial
  CRISPR gRNA sequence
aactgaaagttgccaagttt

SEQ ID NO: 326656 - DNA, 20 bp, Artificial
  CRISPR gRNA sequence
actgaaagttgccaagtttg

SEQ ID NO: 326657 - DNA, 20 bp, Artificial
  CRISPR gRNA sequence
tgaaagttgccaagtttgag

SEQ ID NO: 326658 - DNA, 20 bp, Artificial
  CRISPR gRNA sequence
tgccaagtttgaggagcacc

SEQ ID NO: 326659 - DNA, 20 bp, Artificial
  CRISPR gRNA sequence
aagtttgaggagcacccaga

SEQ ID NO: 326660 - DNA, 20 bp, Artificial
  CRISPR gRNA sequence
aggagcacccagaaagtttg

SEQ ID NO: 326661 - DNA, 20 bp, Artificial
  CRISPR gRNA sequence
aaagtttgaagcttccattg

SEQ ID NO: 326662 - DNA, 20 bp, Artificial
  CRISPR gRNA sequence
aattcatgtcttatgccctt

SEQ ID NO: 326663 - DNA, 20 bp, Artificial
  CRISPR gRNA sequence
attcatgtcttatgcccttg

SEQ ID NO: 326664 - DNA, 20 bp, Artificial
  CRISPR gRNA sequence
aatgatgtgcgatgtgtaat

SEQ ID NO: 326665 - DNA, 20 bp, Artificial
  CRISPR gRNA sequence
atgtgcgatgtgtaatgaga

SEQ ID NO: 326666 - DNA, 20 bp, Artificial
  CRISPR gRNA sequence
tgcgatgtgtaatgagacag

SEQ ID NO: 326667 - DNA, 20 bp, Artificial
  CRISPR gRNA sequence
cactgcatttttccacccct

SEQ ID NO: 326668 - DNA, 20 bp, Artificial
  CRISPR gRNA sequence
tgcatttttccacccctcag

SEQ ID NO: 326669 - DNA, 20 bp, Artificial
  CRISPR gRNA sequence
tttccacccctcagtggcta

SEQ ID NO: 326670 - DNA, 20 bp, Artificial
  CRISPR gRNA sequence
cagtggctacagattatcta

SEQ ID NO: 326671 - DNA, 20 bp, Artificial
  CRISPR gRNA sequence
agtggctacagattatctaa

SEQ ID NO: 326672 - DNA, 20 bp, Artificial
  CRISPR gRNA sequence
gtggctacagattatctaaa

SEQ ID NO: 326673 - DNA, 20 bp, Artificial
  CRISPR gRNA sequence
tggctacagattatctaaag

SEQ ID NO: 326674 - DNA, 20 bp, Artificial
  CRISPR gRNA sequence
ttatctaaaggggacacaca

SEQ ID NO: 326675 - DNA, 20 bp, Artificial
  CRISPR gRNA sequence
acacatagcttgcgttgtca

SEQ ID NO: 326676 - DNA, 20 bp, Artificial
  CRISPR gRNA sequence
cttgcgttgtcatggaatta

SEQ ID NO: 326677 - DNA, 20 bp, Artificial
  CRISPR gRNA sequence
gttgtcatggaattatagca

SEQ ID NO: 326678 - DNA, 20 bp, Artificial
  CRISPR gRNA sequence
ttgtcatggaattatagcat

SEQ ID NO: 326679 - DNA, 20 bp, Artificial
  CRISPR gRNA sequence
catggaattatagcatggga

SEQ ID NO: 326680 - DNA, 20 bp, Artificial
  CRISPR gRNA sequence
atggaattatagcatgggat

SEQ ID NO: 326681 - DNA, 20 bp, Artificial
  CRISPR gRNA sequence
ggaattatagcatgggatgg

SEQ ID NO: 326682 - DNA, 20 bp, Artificial
  CRISPR gRNA sequence
agcatgggatgggagctaaa

SEQ ID NO: 326683 - DNA, 20 bp, Artificial
  CRISPR gRNA sequence
gcatgggatgggagctaaaa

SEQ ID NO: 326684 - DNA, 20 bp, Artificial
  CRISPR gRNA sequence
gggagctaaaaaggatcctt

SEQ ID NO: 326685 - DNA, 20 bp, Artificial
  CRISPR gRNA sequence
tgagttcacatttcatgttt

SEQ ID NO: 326686 - DNA, 20 bp, Artificial
  CRISPR gRNA sequence
acatttcatgttttagatga

SEQ ID NO: 326687 - DNA, 20 bp, Artificial
  CRISPR gRNA sequence
atgacagaaattgatgctca

SEQ ID NO: 326688 - DNA, 20 bp, Artificial
  CRISPR gRNA sequence
aaattgatgctcaaagtgtt

SEQ ID NO: 326689 - DNA, 20 bp, Artificial
  CRISPR gRNA sequence
aaagtgttcagtgactcttt

SEQ ID NO: 326690 - DNA, 20 bp, Artificial
  CRISPR gRNA sequence
cagtgactcttttggttccc

SEQ ID NO: 326691 - DNA, 20 bp, Artificial
  CRISPR gRNA sequence
gactcttttggttccctaga

SEQ ID NO: 326692 - DNA, 20 bp, Artificial
  CRISPR gRNA sequence
ttccctagacagttaatacc

SEQ ID NO: 326693 - DNA, 20 bp, Artificial
  CRISPR gRNA sequence
acctagctttgacacttgca

SEQ ID NO: 326694 - DNA, 20 bp, Artificial
  CRISPR gRNA sequence
ctagctttgacacttgcaaa

SEQ ID NO: 326695 - DNA, 20 bp, Artificial
  CRISPR gRNA sequence
tctctttgcttaatgtgttc

SEQ ID NO: 326696 - DNA, 20 bp, Artificial
  CRISPR gRNA sequence
cttaatgtgttctggctgtt

SEQ ID NO: 326697 - DNA, 20 bp, Artificial
  CRISPR gRNA sequence
ctggctgtttggatccccac

SEQ ID NO: 326698 - DNA, 20 bp, Artificial
  CRISPR gRNA sequence
gctgtttggatccccacaag

SEQ ID NO: 326699 - DNA, 20 bp, Artificial
  CRISPR gRNA sequence
ccacaagcagaacctgacat

SEQ ID NO: 326700 - DNA, 20 bp, Artificial
  CRISPR gRNA sequence
cacaagcagaacctgacata

SEQ ID NO: 326701 - DNA, 20 bp, Artificial
  CRISPR gRNA sequence
cagaacctgacataaggact

SEQ ID NO: 326702 - DNA, 20 bp, Artificial
  CRISPR gRNA sequence
agaacctgacataaggactt

SEQ ID NO: 326703 - DNA, 20 bp, Artificial
  CRISPR gRNA sequence
tgacataaggacttgggtgc

SEQ ID NO: 326704 - DNA, 20 bp, Artificial
  CRISPR gRNA sequence
cataaggacttgggtgcaag

SEQ ID NO: 326705 - DNA, 20 bp, Artificial
  CRISPR gRNA sequence
ttgggtgcaagtagtttatt

SEQ ID NO: 326706 - DNA, 20 bp, Artificial
  CRISPR gRNA sequence
tgggtgcaagtagtttattt

SEQ ID NO: 326707 - DNA, 20 bp, Artificial
  CRISPR gRNA sequence
ggtgcaagtagtttatttgg

SEQ ID NO: 326708 - DNA, 20 bp, Artificial
  CRISPR gRNA sequence
gtgcaagtagtttatttggg

SEQ ID NO: 326709 - DNA, 20 bp, Artificial
  CRISPR gRNA sequence
gtttatttgggaggtgatcc

SEQ ID NO: 326710 - DNA, 20 bp, Artificial
  CRISPR gRNA sequence
tttatttgggaggtgatccc

SEQ ID NO: 326711 - DNA, 20 bp, Artificial
  CRISPR gRNA sequence
atttgggaggtgatcccagg

SEQ ID NO: 326712 - DNA, 20 bp, Artificial
  CRISPR gRNA sequence
tgggaggtgatcccaggaag

SEQ ID NO: 326713 - DNA, 20 bp, Artificial
  CRISPR gRNA sequence
gggaggtgatcccaggaaga

SEQ ID NO: 326714 - DNA, 20 bp, Artificial
  CRISPR gRNA sequence
ggaggtgatcccaggaagaa

SEQ ID NO: 326715 - DNA, 20 bp, Artificial
  CRISPR gRNA sequence
gaggtgatcccaggaagaag

SEQ ID NO: 326716 - DNA, 20 bp, Artificial
  CRISPR gRNA sequence
tgatcccaggaagaaggggt

SEQ ID NO: 326717 - DNA, 20 bp, Artificial
  CRISPR gRNA sequence
gatcccaggaagaaggggtg

SEQ ID NO: 326718 - DNA, 20 bp, Artificial
  CRISPR gRNA sequence
atcccaggaagaaggggtga

SEQ ID NO: 326719 - DNA, 20 bp, Artificial
  CRISPR gRNA sequence
tcccaggaagaaggggtgag

SEQ ID NO: 326720 - DNA, 20 bp, Artificial
  CRISPR gRNA sequence
cccaggaagaaggggtgagg

SEQ ID NO: 326721 - DNA, 20 bp, Artificial
  CRISPR gRNA sequence
aggaagaaggggtgaggggg

SEQ ID NO: 326722 - DNA, 20 bp, Artificial
  CRISPR gRNA sequence
ggaagaaggggtgagggggc

SEQ ID NO: 326723 - DNA, 20 bp, Artificial
  CRISPR gRNA sequence
gaagaaggggtgagggggca

SEQ ID NO: 326724 - DNA, 20 bp, Artificial
  CRISPR gRNA sequence
agaaggggtgagggggcagg

SEQ ID NO: 326725 - DNA, 20 bp, Artificial
  CRISPR gRNA sequence
aaggggtgagggggcaggga

SEQ ID NO: 326726 - DNA, 20 bp, Artificial
  CRISPR gRNA sequence
ggtgagggggcagggagagt

SEQ ID NO: 326727 - DNA, 20 bp, Artificial
  CRISPR gRNA sequence
agggggcagggagagtgaga

SEQ ID NO: 326728 - DNA, 20 bp, Artificial
  CRISPR gRNA sequence
gggagagtgagacagccaac

SEQ ID NO: 326729 - DNA, 20 bp, Artificial
  CRISPR gRNA sequence
ggagagtgagacagccaaca

SEQ ID NO: 326730 - DNA, 20 bp, Artificial
  CRISPR gRNA sequence
agagtgagacagccaacaag

SEQ ID NO: 326731 - DNA, 20 bp, Artificial
  CRISPR gRNA sequence
gtgagacagccaacaaggag

SEQ ID NO: 326732 - DNA, 20 bp, Artificial
  CRISPR gRNA sequence
ccaacaaggagaagcaaatg

SEQ ID NO: 326733 - DNA, 20 bp, Artificial
  CRISPR gRNA sequence
caacaaggagaagcaaatga

SEQ ID NO: 326734 - DNA, 20 bp, Artificial
  CRISPR gRNA sequence
aacaaggagaagcaaatgaa

SEQ ID NO: 326735 - DNA, 20 bp, Artificial
  CRISPR gRNA sequence
atgaagggcgcattattatc

SEQ ID NO: 326736 - DNA, 20 bp, Artificial
  CRISPR gRNA sequence
tgaagggcgcattattatca

SEQ ID NO: 326737 - DNA, 20 bp, Artificial
  CRISPR gRNA sequence
gcgcattattatcaaggtct

SEQ ID NO: 326738 - DNA, 20 bp, Artificial
  CRISPR gRNA sequence
tattatcaaggtctcagctc

SEQ ID NO: 326739 - DNA, 20 bp, Artificial
  CRISPR gRNA sequence
attatcaaggtctcagctcc

SEQ ID NO: 326740 - DNA, 20 bp, Artificial
  CRISPR gRNA sequence
aaggtctcagctccaggcca

SEQ ID NO: 326741 - DNA, 20 bp, Artificial
  CRISPR gRNA sequence
ggtctcagctccaggccaca

SEQ ID NO: 326742 - DNA, 20 bp, Artificial
  CRISPR gRNA sequence
gtctcagctccaggccacag

SEQ ID NO: 326743 - DNA, 20 bp, Artificial
  CRISPR gRNA sequence
ccacagaggcctgacttcat

SEQ ID NO: 326744 - DNA, 20 bp, Artificial
  CRISPR gRNA sequence
cctgacttcattggacctct

SEQ ID NO: 326745 - DNA, 20 bp, Artificial
  CRISPR gRNA sequence
gacttcattggacctctgag

SEQ ID NO: 326746 - DNA, 20 bp, Artificial
  CRISPR gRNA sequence
ttggacctctgagaagtgta

SEQ ID NO: 326747 - DNA, 20 bp, Artificial
  CRISPR gRNA sequence
agaagtgtacagatgcctcc

SEQ ID NO: 326748 - DNA, 20 bp, Artificial
  CRISPR gRNA sequence
ctcccagaatcattctcttg

SEQ ID NO: 326749 - DNA, 20 bp, Artificial
  CRISPR gRNA sequence
tcccagaatcattctcttga

SEQ ID NO: 326750 - DNA, 20 bp, Artificial
  CRISPR gRNA sequence
agaatcattctcttgaagga

SEQ ID NO: 326751 - DNA, 20 bp, Artificial
  CRISPR gRNA sequence
tcttgaaggatggcaaccac

SEQ ID NO: 326752 - DNA, 20 bp, Artificial
  CRISPR gRNA sequence
tggctccatcctcactgatt

SEQ ID NO: 326753 - DNA, 20 bp, Artificial
  CRISPR gRNA sequence
ggctccatcctcactgattt

SEQ ID NO: 326754 - DNA, 20 bp, Artificial
  CRISPR gRNA sequence
gctccatcctcactgatttg

SEQ ID NO: 326755 - DNA, 20 bp, Artificial
  CRISPR gRNA sequence
cactgatttggggttgcctg

SEQ ID NO: 326756 - DNA, 20 bp, Artificial
  CRISPR gRNA sequence
ctgatttggggttgcctgcg

SEQ ID NO: 326757 - DNA, 20 bp, Artificial
  CRISPR gRNA sequence
tgatttggggttgcctgcgg

SEQ ID NO: 326758 - DNA, 20 bp, Artificial
  CRISPR gRNA sequence
gatttggggttgcctgcgga

SEQ ID NO: 326759 - DNA, 20 bp, Artificial
  CRISPR gRNA sequence
gggttgcctgcggagggcat

SEQ ID NO: 326760 - DNA, 20 bp, Artificial
  CRISPR gRNA sequence
attagctttccctcatctct

SEQ ID NO: 326761 - DNA, 20 bp, Artificial
  CRISPR gRNA sequence
ctctgagctgtgcctctact

SEQ ID NO: 326762 - DNA, 20 bp, Artificial
  CRISPR gRNA sequence
tctgagctgtgcctctactt

SEQ ID NO: 326763 - DNA, 20 bp, Artificial
  CRISPR gRNA sequence
gctgtgcctctacttgggat

SEQ ID NO: 326764 - DNA, 20 bp, Artificial
  CRISPR gRNA sequence
ctacttgggatgagcctact

SEQ ID NO: 326765 - DNA, 20 bp, Artificial
  CRISPR gRNA sequence
tacttgggatgagcctactt

SEQ ID NO: 326766 - DNA, 20 bp, Artificial
  CRISPR gRNA sequence
gggatgagcctacttgggat

SEQ ID NO: 326767 - DNA, 20 bp, Artificial
  CRISPR gRNA sequence
gcctacttgggatgagtctt

SEQ ID NO: 326768 - DNA, 20 bp, Artificial
  CRISPR gRNA sequence
ctacttgggatgagtcttca

SEQ ID NO: 326769 - DNA, 20 bp, Artificial
  CRISPR gRNA sequence
ttgggatgagtcttcagaga

SEQ ID NO: 326770 - DNA, 20 bp, Artificial
  CRISPR gRNA sequence
atgagtcttcagagaaagtc

SEQ ID NO: 326771 - DNA, 20 bp, Artificial
  CRISPR gRNA sequence
gagtcttcagagaaagtctg

SEQ ID NO: 326772 - DNA, 20 bp, Artificial
  CRISPR gRNA sequence
agtcttcagagaaagtctgg

SEQ ID NO: 326773 - DNA, 20 bp, Artificial
  CRISPR gRNA sequence
cttcagagaaagtctggagg

SEQ ID NO: 326774 - DNA, 20 bp, Artificial
  CRISPR gRNA sequence
gagaaagtctggaggcagaa

SEQ ID NO: 326775 - DNA, 20 bp, Artificial
  CRISPR gRNA sequence
aaagtctggaggcagaaaag

SEQ ID NO: 326776 - DNA, 20 bp, Artificial
  CRISPR gRNA sequence
ggcagaaaagcagtgaaatg

SEQ ID NO: 326777 - DNA, 20 bp, Artificial
  CRISPR gRNA sequence
agaaaagcagtgaaatgcag

SEQ ID NO: 326778 - DNA, 20 bp, Artificial
  CRISPR gRNA sequence
gaaaagcagtgaaatgcagt

SEQ ID NO: 326779 - DNA, 20 bp, Artificial
  CRISPR gRNA sequence
aaaagcagtgaaatgcagtg

SEQ ID NO: 326780 - DNA, 20 bp, Artificial
  CRISPR gRNA sequence
atgcagtggggctgttgtgc

SEQ ID NO: 326781 - DNA, 20 bp, Artificial
  CRISPR gRNA sequence
gtggggctgttgtgctagaa

SEQ ID NO: 326782 - DNA, 20 bp, Artificial
  CRISPR gRNA sequence
ggctgttgtgctagaacagt

SEQ ID NO: 326783 - DNA, 20 bp, Artificial
  CRISPR gRNA sequence
gctagaacagtcagcccatg

SEQ ID NO: 326784 - DNA, 20 bp, Artificial
  CRISPR gRNA sequence
ccatgcagcgctttctgccc

SEQ ID NO: 326785 - DNA, 20 bp, Artificial
  CRISPR gRNA sequence
tgcagcgctttctgccccag

SEQ ID NO: 326786 - DNA, 20 bp, Artificial
  CRISPR gRNA sequence
agcgctttctgccccagcag

SEQ ID NO: 326787 - DNA, 20 bp, Artificial
  CRISPR gRNA sequence
gccccagcagcagctgcaat

SEQ ID NO: 326788 - DNA, 20 bp, Artificial
  CRISPR gRNA sequence
cccagcagcagctgcaatca

SEQ ID NO: 326789 - DNA, 20 bp, Artificial
  CRISPR gRNA sequence
ccagcagcagctgcaatcag

SEQ ID NO: 326790 - DNA, 20 bp, Artificial
  CRISPR gRNA sequence
gcagcagctgcaatcagagg

SEQ ID NO: 326791 - DNA, 20 bp, Artificial
  CRISPR gRNA sequence
cagctgcaatcagaggtgga

SEQ ID NO: 326792 - DNA, 20 bp, Artificial
  CRISPR gRNA sequence
atcagaggtggacagtttca

SEQ ID NO: 326793 - DNA, 20 bp, Artificial
  CRISPR gRNA sequence
gtggacagtttcaaagtgat

SEQ ID NO: 326794 - DNA, 20 bp, Artificial
  CRISPR gRNA sequence
cagtttcaaagtgatgagtt

SEQ ID NO: 326795 - DNA, 20 bp, Artificial
  CRISPR gRNA sequence
agtttagataatgtctgtta

SEQ ID NO: 326796 - DNA, 20 bp, Artificial
  CRISPR gRNA sequence
gtttagataatgtctgttat

SEQ ID NO: 326797 - DNA, 20 bp, Artificial
  CRISPR gRNA sequence
ttagataatgtctgttatag

SEQ ID NO: 326798 - DNA, 20 bp, Artificial
  CRISPR gRNA sequence
taatgtctgttataggagtc

SEQ ID NO: 326799 - DNA, 20 bp, Artificial
  CRISPR gRNA sequence
atgtctgttataggagtcga

SEQ ID NO: 326800 - DNA, 20 bp, Artificial
  CRISPR gRNA sequence
agtcgagagctaaacttctc

SEQ ID NO: 326801 - DNA, 20 bp, Artificial
  CRISPR gRNA sequence
gagctaaacttctctggaaa

SEQ ID NO: 326802 - DNA, 20 bp, Artificial
  CRISPR gRNA sequence
agctaaacttctctggaaat

SEQ ID NO: 326803 - DNA, 20 bp, Artificial
  CRISPR gRNA sequence
gctaaacttctctggaaatg

SEQ ID NO: 326804 - DNA, 20 bp, Artificial
  CRISPR gRNA sequence
cttctctggaaatggggaac

SEQ ID NO: 326805 - DNA, 20 bp, Artificial
  CRISPR gRNA sequence
tggaaatggggaactggtgc

SEQ ID NO: 326806 - DNA, 20 bp, Artificial
  CRISPR gRNA sequence
ggaaatggggaactggtgct

SEQ ID NO: 326807 - DNA, 20 bp, Artificial
  CRISPR gRNA sequence
ggaactggtgctgggtgttg

SEQ ID NO: 326808 - DNA, 20 bp, Artificial
  CRISPR gRNA sequence
gtgctgggtgttgaagcata

SEQ ID NO: 326809 - DNA, 20 bp, Artificial
  CRISPR gRNA sequence
gggtgttgaagcataaagat

SEQ ID NO: 326810 - DNA, 20 bp, Artificial
  CRISPR gRNA sequence
agcataaagatgagtttgca

SEQ ID NO: 326811 - DNA, 20 bp, Artificial
  CRISPR gRNA sequence
agtttgcatggtgtgtgtgt

SEQ ID NO: 326812 - DNA, 20 bp, Artificial
  CRISPR gRNA sequence
gtgtgtgtttgtgtgtatga

SEQ ID NO: 326813 - DNA, 20 bp, Artificial
  CRISPR gRNA sequence
tgtgtgtttgtgtgtatgaa

SEQ ID NO: 326814 - DNA, 20 bp, Artificial
  CRISPR gRNA sequence
tttgtgtgtatgaaaggcaa

SEQ ID NO: 326815 - DNA, 20 bp, Artificial
  CRISPR gRNA sequence
tgtgtgtatgaaaggcaatg

SEQ ID NO: 326816 - DNA, 20 bp, Artificial
  CRISPR gRNA sequence
tgtgtatgaaaggcaatgga

SEQ ID NO: 326817 - DNA, 20 bp, Artificial
  CRISPR gRNA sequence
gtgtatgaaaggcaatggag

SEQ ID NO: 326818 - DNA, 20 bp, Artificial
  CRISPR gRNA sequence
tgtatgaaaggcaatggaga

SEQ ID NO: 326819 - DNA, 20 bp, Artificial
  CRISPR gRNA sequence
gtatgaaaggcaatggagag

SEQ ID NO: 326820 - DNA, 20 bp, Artificial
  CRISPR gRNA sequence
gaaaggcaatggagagggga

SEQ ID NO: 326821 - DNA, 20 bp, Artificial
  CRISPR gRNA sequence
ggagaggggaaagcttcttg

SEQ ID NO: 326822 - DNA, 20 bp, Artificial
  CRISPR gRNA sequence
gagaggggaaagcttcttgt

SEQ ID NO: 326823 - DNA, 20 bp, Artificial
  CRISPR gRNA sequence
agaggggaaagcttcttgta

SEQ ID NO: 326824 - DNA, 20 bp, Artificial
  CRISPR gRNA sequence
gaaagcttcttgtagggaac

SEQ ID NO: 326825 - DNA, 20 bp, Artificial
  CRISPR gRNA sequence
tcttgtagggaactggcaca

SEQ ID NO: 326826 - DNA, 20 bp, Artificial
  CRISPR gRNA sequence
ttgtagggaactggcacatg

SEQ ID NO: 326827 - DNA, 20 bp, Artificial
  CRISPR gRNA sequence
gtagggaactggcacatgga

SEQ ID NO: 326828 - DNA, 20 bp, Artificial
  CRISPR gRNA sequence
actggcacatggagagcatt

SEQ ID NO: 326829 - DNA, 20 bp, Artificial
  CRISPR gRNA sequence
tttatgctgaatttttgtta

SEQ ID NO: 326830 - DNA, 20 bp, Artificial
  CRISPR gRNA sequence
acagatgtgaccctataata

SEQ ID NO: 326831 - DNA, 20 bp, Artificial
  CRISPR gRNA sequence
gaccctataatatggaactc

SEQ ID NO: 326832 - DNA, 20 bp, Artificial
  CRISPR gRNA sequence
taatatggaactctggcacc

SEQ ID NO: 326833 - DNA, 20 bp, Artificial
  CRISPR gRNA sequence
aatatggaactctggcaccc

SEQ ID NO: 326834 - DNA, 20 bp, Artificial
  CRISPR gRNA sequence
aactctggcacccaggcatg

SEQ ID NO: 326835 - DNA, 20 bp, Artificial
  CRISPR gRNA sequence
cacccaggcatgaagcacgt

SEQ ID NO: 326836 - DNA, 20 bp, Artificial
  CRISPR gRNA sequence
caggcatgaagcacgttggc

SEQ ID NO: 326837 - DNA, 20 bp, Artificial
  CRISPR gRNA sequence
ggccagttttcctcaacttg

SEQ ID NO: 326838 - DNA, 20 bp, Artificial
  CRISPR gRNA sequence
ttttcctcaacttgaagtgc

SEQ ID NO: 326839 - DNA, 20 bp, Artificial
  CRISPR gRNA sequence
gtgcaagattctcttatttc

SEQ ID NO: 326840 - DNA, 20 bp, Artificial
  CRISPR gRNA sequence
tgcaagattctcttatttcc

SEQ ID NO: 326841 - DNA, 20 bp, Artificial
  CRISPR gRNA sequence
ttctcttatttccgggacca

SEQ ID NO: 326842 - DNA, 20 bp, Artificial
  CRISPR gRNA sequence
ctcttatttccgggaccacg

SEQ ID NO: 326843 - DNA, 20 bp, Artificial
  CRISPR gRNA sequence
cttatttccgggaccacgga

SEQ ID NO: 326844 - DNA, 20 bp, Artificial
  CRISPR gRNA sequence
taactacatacatcttctgc

SEQ ID NO: 326845 - DNA, 20 bp, Artificial
  CRISPR gRNA sequence
tgctggtgttttgttcaatc

SEQ ID NO: 326846 - DNA, 20 bp, Artificial
  CRISPR gRNA sequence
tggtgttttgttcaatctgg

SEQ ID NO: 326847 - DNA, 20 bp, Artificial
  CRISPR gRNA sequence
atctggaagaatgactgtat

SEQ ID NO: 326848 - DNA, 20 bp, Artificial
  CRISPR gRNA sequence
agaatgactgtatcagtcaa

SEQ ID NO: 326849 - DNA, 20 bp, Artificial
  CRISPR gRNA sequence
gaatgactgtatcagtcaat

SEQ ID NO: 326850 - DNA, 20 bp, Artificial
  CRISPR gRNA sequence
aatgactgtatcagtcaatg

SEQ ID NO: 326851 - DNA, 20 bp, Artificial
  CRISPR gRNA sequence
tcagtcaatggggattttaa

SEQ ID NO: 326852 - DNA, 20 bp, Artificial
  CRISPR gRNA sequence
gggattttaacagactgcct

SEQ ID NO: 326853 - DNA, 20 bp, Artificial
  CRISPR gRNA sequence
cagactgccttggtactgcc

SEQ ID NO: 326854 - DNA, 20 bp, Artificial
  CRISPR gRNA sequence
aacaaacaccctcttgcaac

SEQ ID NO: 326855 - DNA, 20 bp, Artificial
  CRISPR gRNA sequence
caccctcttgcaaccagctt

SEQ ID NO: 326856 - DNA, 20 bp, Artificial
  CRISPR gRNA sequence
ccctcttgcaaccagctttg

SEQ ID NO: 326857 - DNA, 20 bp, Artificial
  CRISPR gRNA sequence
cttgcaaccagctttggaga

SEQ ID NO: 326858 - DNA, 20 bp, Artificial
  CRISPR gRNA sequence
aaccagctttggagaaagcc

SEQ ID NO: 326859 - DNA, 20 bp, Artificial
  CRISPR gRNA sequence
cccagctcctgtgtgctcac

SEQ ID NO: 326860 - DNA, 20 bp, Artificial
  CRISPR gRNA sequence
ccagctcctgtgtgctcact

SEQ ID NO: 326861 - DNA, 20 bp, Artificial
  CRISPR gRNA sequence
agctcctgtgtgctcactgg

SEQ ID NO: 326862 - DNA, 20 bp, Artificial
  CRISPR gRNA sequence
tcctgtgtgctcactgggag

SEQ ID NO: 326863 - DNA, 20 bp, Artificial
  CRISPR gRNA sequence
cctgtctccacatctgctcc

SEQ ID NO: 326864 - DNA, 20 bp, Artificial
  CRISPR gRNA sequence
gtctccacatctgctcctag

SEQ ID NO: 326865 - DNA, 20 bp, Artificial
  CRISPR gRNA sequence
atctgctcctagcagtgcat

SEQ ID NO: 326866 - DNA, 20 bp, Artificial
  CRISPR gRNA sequence
gctcctagcagtgcatcagc

SEQ ID NO: 326867 - DNA, 20 bp, Artificial
  CRISPR gRNA sequence
agtaaaacaaacacatttac

SEQ ID NO: 326868 - DNA, 20 bp, Artificial
  CRISPR gRNA sequence
tttacaagaaaaatgtttta

SEQ ID NO: 326869 - DNA, 20 bp, Artificial
  CRISPR gRNA sequence
gaaaaatgttttaaagatgc

SEQ ID NO: 326870 - DNA, 20 bp, Artificial
  CRISPR gRNA sequence
aaaaatgttttaaagatgcc

SEQ ID NO: 326871 - DNA, 20 bp, Artificial
  CRISPR gRNA sequence
aaaatgttttaaagatgcca

SEQ ID NO: 326872 - DNA, 20 bp, Artificial
  CRISPR gRNA sequence
aaatgttttaaagatgccag

SEQ ID NO: 326873 - DNA, 20 bp, Artificial
  CRISPR gRNA sequence
ccaggggtactgaatctgca

SEQ ID NO: 326874 - DNA, 20 bp, Artificial
  CRISPR gRNA sequence
actgaatctgcaaagcaaat

SEQ ID NO: 326875 - DNA, 20 bp, Artificial
  CRISPR gRNA sequence
gaatctgcaaagcaaatgag

SEQ ID NO: 326876 - DNA, 20 bp, Artificial
  CRISPR gRNA sequence
tgcaaagcaaatgagcagcc

SEQ ID NO: 326877 - DNA, 20 bp, Artificial
  CRISPR gRNA sequence
gcaaagcaaatgagcagcca

SEQ ID NO: 326878 - DNA, 20 bp, Artificial
  CRISPR gRNA sequence
gcaaatgagcagccaaggac

SEQ ID NO: 326879 - DNA, 20 bp, Artificial
  CRISPR gRNA sequence
catactacctcttctttctg

SEQ ID NO: 326880 - DNA, 20 bp, Artificial
  CRISPR gRNA sequence
atactacctcttctttctgt

SEQ ID NO: 326881 - DNA, 20 bp, Artificial
  CRISPR gRNA sequence
tactacctcttctttctgta

SEQ ID NO: 326882 - DNA, 20 bp, Artificial
  CRISPR gRNA sequence
cctcttctttctgtagggat

SEQ ID NO: 326883 - DNA, 20 bp, Artificial
  CRISPR gRNA sequence
atgagaattcctcttttaat

SEQ ID NO: 326884 - DNA, 20 bp, Artificial
  CRISPR gRNA sequence
aattcctcttttaatcagtc

SEQ ID NO: 326885 - DNA, 20 bp, Artificial
  CRISPR gRNA sequence
attcctcttttaatcagtca

SEQ ID NO: 326886 - DNA, 20 bp, Artificial
  CRISPR gRNA sequence
ttcctcttttaatcagtcaa

SEQ ID NO: 326887 - DNA, 20 bp, Artificial
  CRISPR gRNA sequence
cctcttttaatcagtcaagg

SEQ ID NO: 326888 - DNA, 20 bp, Artificial
  CRISPR gRNA sequence
cagtcaagggagatgcttca

SEQ ID NO: 326889 - DNA, 20 bp, Artificial
  CRISPR gRNA sequence
caagggagatgcttcaaagc

SEQ ID NO: 326890 - DNA, 20 bp, Artificial
  CRISPR gRNA sequence
agggagatgcttcaaagctg

SEQ ID NO: 326891 - DNA, 20 bp, Artificial
  CRISPR gRNA sequence
gctggagctattttatttct

SEQ ID NO: 326892 - DNA, 20 bp, Artificial
  CRISPR gRNA sequence
tgttgatgtgaactgtacat

SEQ ID NO: 326893 - DNA, 20 bp, Artificial
  CRISPR gRNA sequence
actgtacattagtacatact

SEQ ID NO: 326894 - DNA, 20 bp, Artificial
  CRISPR gRNA sequence
ctccttcaattgctgaaccc

SEQ ID NO: 326895 - DNA, 20 bp, Artificial
  CRISPR gRNA sequence
ccccagttgaccattttacc

SEQ ID NO: 326896 - DNA, 20 bp, Artificial
  CRISPR gRNA sequence
tgaccattttaccaagactt

SEQ ID NO: 326897 - DNA, 20 bp, Artificial
  CRISPR gRNA sequence
acttctacatgactgcttga

SEQ ID NO: 326898 - DNA, 20 bp, Artificial
  CRISPR gRNA sequence
atgactgcttgacagcccaa

SEQ ID NO: 326899 - DNA, 20 bp, Artificial
  CRISPR gRNA sequence
agcccaacagccactctcaa

SEQ ID NO: 326900 - DNA, 20 bp, Artificial
  CRISPR gRNA sequence
cccaacagccactctcaata

SEQ ID NO: 326901 - DNA, 20 bp, Artificial
  CRISPR gRNA sequence
caacagccactctcaataga

SEQ ID NO: 326902 - DNA, 20 bp, Artificial
  CRISPR gRNA sequence
ttctttcctctgctgctcaa

SEQ ID NO: 326903 - DNA, 20 bp, Artificial
  CRISPR gRNA sequence
tttgcctatattctccctac

SEQ ID NO: 326904 - DNA, 20 bp, Artificial
  CRISPR gRNA sequence
ctacaagaatatttttgctc

SEQ ID NO: 326905 - DNA, 20 bp, Artificial
  CRISPR gRNA sequence
aagaatatttttgctccaga

SEQ ID NO: 326906 - DNA, 20 bp, Artificial
  CRISPR gRNA sequence
acatgttcttttctcaaatt

SEQ ID NO: 326907 - DNA, 20 bp, Artificial
  CRISPR gRNA sequence
tttctcaaattcagttaaaa

SEQ ID NO: 326908 - DNA, 20 bp, Artificial
  CRISPR gRNA sequence
taaaatggtttactttgttc

SEQ ID NO: 326909 - DNA, 20 bp, Artificial
  CRISPR gRNA sequence
atggtttactttgttcaagt

SEQ ID NO: 326910 - DNA, 20 bp, Artificial
  CRISPR gRNA sequence
gtttactttgttcaagttag

SEQ ID NO: 326911 - DNA, 20 bp, Artificial
  CRISPR gRNA sequence
tactttgttcaagttagtgg

SEQ ID NO: 326912 - DNA, 20 bp, Artificial
  CRISPR gRNA sequence
actttgttcaagttagtggt

SEQ ID NO: 326913 - DNA, 20 bp, Artificial
  CRISPR gRNA sequence
tagtggtaggaaacattgcc

SEQ ID NO: 326914 - DNA, 20 bp, Artificial
  CRISPR gRNA sequence
gaaacattgcccggaattga

SEQ ID NO: 326915 - DNA, 20 bp, Artificial
  CRISPR gRNA sequence
taccattatctatgttttca

SEQ ID NO: 326916 - DNA, 20 bp, Artificial
  CRISPR gRNA sequence
ttcatggtgctattaattac

SEQ ID NO: 326917 - DNA, 20 bp, Artificial
  CRISPR gRNA sequence
ggtgctattaattacaagtt

SEQ ID NO: 326918 - DNA, 20 bp, Artificial
  CRISPR gRNA sequence
tacaagtttagttctttttg

SEQ ID NO: 326919 - DNA, 20 bp, Artificial
  CRISPR gRNA sequence
gcaaacaaaatcatctttaa

SEQ ID NO: 326920 - DNA, 20 bp, Artificial
  CRISPR gRNA sequence
caaacaaaatcatctttaat

SEQ ID NO: 326921 - DNA, 20 bp, Artificial
  CRISPR gRNA sequence
caaaatcatctttaatgggc

SEQ ID NO: 326922 - DNA, 20 bp, Artificial
  CRISPR gRNA sequence
ttaatgggccagcattctca

SEQ ID NO: 326923 - DNA, 20 bp, Artificial
  CRISPR gRNA sequence
taatgggccagcattctcat

SEQ ID NO: 326924 - DNA, 20 bp, Artificial
  CRISPR gRNA sequence
aatgggccagcattctcatg

SEQ ID NO: 326925 - DNA, 20 bp, Artificial
  CRISPR gRNA sequence
gggccagcattctcatgggg

SEQ ID NO: 326926 - DNA, 20 bp, Artificial
  CRISPR gRNA sequence
gccagcattctcatggggta

SEQ ID NO: 326927 - DNA, 20 bp, Artificial
  CRISPR gRNA sequence
agcattctcatggggtagag

SEQ ID NO: 326928 - DNA, 20 bp, Artificial
  CRISPR gRNA sequence
ggtagagcagaatattcatt

SEQ ID NO: 326929 - DNA, 20 bp, Artificial
  CRISPR gRNA sequence
agaatattcatttagcctga

SEQ ID NO: 326930 - DNA, 20 bp, Artificial
  CRISPR gRNA sequence
ttcatttagcctgaaagctg

SEQ ID NO: 326931 - DNA, 20 bp, Artificial
  CRISPR gRNA sequence
cctgaaagctgcagttacta

SEQ ID NO: 326932 - DNA, 20 bp, Artificial
  CRISPR gRNA sequence
ctgaaagctgcagttactat

SEQ ID NO: 326933 - DNA, 20 bp, Artificial
  CRISPR gRNA sequence
cagttactataggttgctgt

SEQ ID NO: 326934 - DNA, 20 bp, Artificial
  CRISPR gRNA sequence
ttgctgtcagactataccca

SEQ ID NO: 326935 - DNA, 20 bp, Artificial
  CRISPR gRNA sequence
gactatacccatggtgcctc

SEQ ID NO: 326936 - DNA, 20 bp, Artificial
  CRISPR gRNA sequence
actatacccatggtgcctct

SEQ ID NO: 326937 - DNA, 20 bp, Artificial
  CRISPR gRNA sequence
catggtgcctctgggcttga

SEQ ID NO: 326938 - DNA, 20 bp, Artificial
  CRISPR gRNA sequence
atggtgcctctgggcttgac

SEQ ID NO: 326939 - DNA, 20 bp, Artificial
  CRISPR gRNA sequence
ctgggcttgacaggtcaaaa

SEQ ID NO: 326940 - DNA, 20 bp, Artificial
  CRISPR gRNA sequence
caggtcaaaatggtccccat

SEQ ID NO: 326941 - DNA, 20 bp, Artificial
  CRISPR gRNA sequence
caaaatggtccccatcagcc

SEQ ID NO: 326942 - DNA, 20 bp, Artificial
  CRISPR gRNA sequence
aaatggtccccatcagcctg

SEQ ID NO: 326943 - DNA, 20 bp, Artificial
  CRISPR gRNA sequence
tggtccccatcagcctggag

SEQ ID NO: 326944 - DNA, 20 bp, Artificial
  CRISPR gRNA sequence
atcagcctggagcagccctc

SEQ ID NO: 326945 - DNA, 20 bp, Artificial
  CRISPR gRNA sequence
ctggagcagccctccagacc

SEQ ID NO: 326946 - DNA, 20 bp, Artificial
  CRISPR gRNA sequence
tggagcagccctccagacct

SEQ ID NO: 326947 - DNA, 20 bp, Artificial
  CRISPR gRNA sequence
agcagccctccagacctggg

SEQ ID NO: 326948 - DNA, 20 bp, Artificial
  CRISPR gRNA sequence
tccagacctgggtggaattc

SEQ ID NO: 326949 - DNA, 20 bp, Artificial
  CRISPR gRNA sequence
ccagacctgggtggaattcc

SEQ ID NO: 326950 - DNA, 20 bp, Artificial
  CRISPR gRNA sequence
cagacctgggtggaattcca

SEQ ID NO: 326951 - DNA, 20 bp, Artificial
  CRISPR gRNA sequence
ctgggtggaattccagggtt

SEQ ID NO: 326952 - DNA, 20 bp, Artificial
  CRISPR gRNA sequence
gggtggaattccagggttga

SEQ ID NO: 326953 - DNA, 20 bp, Artificial
  CRISPR gRNA sequence
cagggttgagagactcccct

SEQ ID NO: 326954 - DNA, 20 bp, Artificial
  CRISPR gRNA sequence
gttgagagactcccctgagc

SEQ ID NO: 326955 - DNA, 20 bp, Artificial
  CRISPR gRNA sequence
tgagagactcccctgagcca

SEQ ID NO: 326956 - DNA, 20 bp, Artificial
  CRISPR gRNA sequence
gagagactcccctgagccag

SEQ ID NO: 326957 - DNA, 20 bp, Artificial
  CRISPR gRNA sequence
tcccctgagccagaggccac

SEQ ID NO: 326958 - DNA, 20 bp, Artificial
  CRISPR gRNA sequence
cccctgagccagaggccact

SEQ ID NO: 326959 - DNA, 20 bp, Artificial
  CRISPR gRNA sequence
ccactaggtattcttgctcc

SEQ ID NO: 326960 - DNA, 20 bp, Artificial
  CRISPR gRNA sequence
actaggtattcttgctccca

SEQ ID NO: 326961 - DNA, 20 bp, Artificial
  CRISPR gRNA sequence
ctaggtattcttgctcccag

SEQ ID NO: 326962 - DNA, 20 bp, Artificial
  CRISPR gRNA sequence
attcttgctcccagaggctg

SEQ ID NO: 326963 - DNA, 20 bp, Artificial
  CRISPR gRNA sequence
cccagaggctgaagtcaccc

SEQ ID NO: 326964 - DNA, 20 bp, Artificial
  CRISPR gRNA sequence
ccagaggctgaagtcaccct

SEQ ID NO: 326965 - DNA, 20 bp, Artificial
  CRISPR gRNA sequence
tgaagtcaccctgggaatca

SEQ ID NO: 326966 - DNA, 20 bp, Artificial
  CRISPR gRNA sequence
agtcaccctgggaatcacag

SEQ ID NO: 326967 - DNA, 20 bp, Artificial
  CRISPR gRNA sequence
tctacctgcattcataattc

SEQ ID NO: 326968 - DNA, 20 bp, Artificial
  CRISPR gRNA sequence
ctacctgcattcataattcc

SEQ ID NO: 326969 - DNA, 20 bp, Artificial
  CRISPR gRNA sequence
tcataattccaggatctgtg

SEQ ID NO: 326970 - DNA, 20 bp, Artificial
  CRISPR gRNA sequence
ataattccaggatctgtgaa

SEQ ID NO: 326971 - DNA, 20 bp, Artificial
  CRISPR gRNA sequence
tgtgaagagcacatatgtgt

SEQ ID NO: 326972 - DNA, 20 bp, Artificial
  CRISPR gRNA sequence
gtgaagagcacatatgtgtc

SEQ ID NO: 326973 - DNA, 20 bp, Artificial
  CRISPR gRNA sequence
tgaagagcacatatgtgtca

SEQ ID NO: 326974 - DNA, 20 bp, Artificial
  CRISPR gRNA sequence
tccctctcataaaaaccaca

SEQ ID NO: 326975 - DNA, 20 bp, Artificial
  CRISPR gRNA sequence
ctcataaaaaccacacagcc

SEQ ID NO: 326976 - DNA, 20 bp, Artificial
  CRISPR gRNA sequence
aaaccacacagcctggaaat

SEQ ID NO: 326977 - DNA, 20 bp, Artificial
  CRISPR gRNA sequence
cacagcctggaaattggccc

SEQ ID NO: 326978 - DNA, 20 bp, Artificial
  CRISPR gRNA sequence
gaaattggccctggcccttc

SEQ ID NO: 326979 - DNA, 20 bp, Artificial
  CRISPR gRNA sequence
ttggccctggcccttcaaga

SEQ ID NO: 326980 - DNA, 20 bp, Artificial
  CRISPR gRNA sequence
cccttcaagatagccttctt

SEQ ID NO: 326981 - DNA, 20 bp, Artificial
  CRISPR gRNA sequence
gccttctttagaatatgatt

SEQ ID NO: 326982 - DNA, 20 bp, Artificial
  CRISPR gRNA sequence
tctttagaatatgatttggc

SEQ ID NO: 326983 - DNA, 20 bp, Artificial
  CRISPR gRNA sequence
tagaatatgatttggctaga

SEQ ID NO: 326984 - DNA, 20 bp, Artificial
  CRISPR gRNA sequence
tagaaagattcttaaatatg

SEQ ID NO: 326985 - DNA, 20 bp, Artificial
  CRISPR gRNA sequence
atgtggaatatgattattct

SEQ ID NO: 326986 - DNA, 20 bp, Artificial
  CRISPR gRNA sequence
ggaatatgattattcttagc

SEQ ID NO: 326987 - DNA, 20 bp, Artificial
  CRISPR gRNA sequence
tacttcctgtctgcatgccc

SEQ ID NO: 326988 - DNA, 20 bp, Artificial
  CRISPR gRNA sequence
acttcctgtctgcatgccca

SEQ ID NO: 326989 - DNA, 20 bp, Artificial
  CRISPR gRNA sequence
ctgcatgcccaaggcttctg

SEQ ID NO: 326990 - DNA, 20 bp, Artificial
  CRISPR gRNA sequence
catgcccaaggcttctgaag

SEQ ID NO: 326991 - DNA, 20 bp, Artificial
  CRISPR gRNA sequence
tgcaacaacatttgtaactt

SEQ ID NO: 326992 - DNA, 20 bp, Artificial
  CRISPR gRNA sequence
gcaacaacatttgtaacttt

SEQ ID NO: 326993 - DNA, 20 bp, Artificial
  CRISPR gRNA sequence
atttgtaactttaggtaaac

SEQ ID NO: 326994 - DNA, 20 bp, Artificial
  CRISPR gRNA sequence
tttgtaactttaggtaaact

SEQ ID NO: 326995 - DNA, 20 bp, Artificial
  CRISPR gRNA sequence
ggtaaactgggattatgttg

SEQ ID NO: 326996 - DNA, 20 bp, Artificial
  CRISPR gRNA sequence
attttgtaactgtgtgctta

SEQ ID NO: 326997 - DNA, 20 bp, Artificial
  CRISPR gRNA sequence
actgtgtgcttatagtttac

SEQ ID NO: 326998 - DNA, 20 bp, Artificial
  CRISPR gRNA sequence
tgtgcttatagtttacaagt

SEQ ID NO: 326999 - DNA, 20 bp, Artificial
  CRISPR gRNA sequence
atgcatacttatattatctt

SEQ ID NO: 327000 - DNA, 20 bp, Artificial
  CRISPR gRNA sequence
atcttaagcatgtgtaatgc

SEQ ID NO: 327001 - DNA, 20 bp, Artificial
  CRISPR gRNA sequence
tgtgtaatgctggatgtgta

SEQ ID NO: 327002 - DNA, 20 bp, Artificial
  CRISPR gRNA sequence
aatgctggatgtgtacagta

SEQ ID NO: 327003 - DNA, 20 bp, Artificial
  CRISPR gRNA sequence
ctgaacttgtaatttgaatc

SEQ ID NO: 327004 - DNA, 20 bp, Artificial
  CRISPR gRNA sequence
cttgtaatttgaatctagta

SEQ ID NO: 327005 - DNA, 20 bp, Artificial
  CRISPR gRNA sequence
ctagtatggtgttctgtttt

SEQ ID NO: 327006 - DNA, 20 bp, Artificial
  CRISPR gRNA sequence
tgttctgttttcagctgact

SEQ ID NO: 327007 - DNA, 20 bp, Artificial
  CRISPR gRNA sequence
gctgacttggacaacctgac

SEQ ID NO: 327008 - DNA, 20 bp, Artificial
  CRISPR gRNA sequence
acaacctgactggctttgca

SEQ ID NO: 327009 - DNA, 20 bp, Artificial
  CRISPR gRNA sequence
caacctgactggctttgcac

SEQ ID NO: 327010 - DNA, 20 bp, Artificial
  CRISPR gRNA sequence
gctttgcacaggtgttccct

SEQ ID NO: 327011 - DNA, 20 bp, Artificial
  CRISPR gRNA sequence
ggtgttccctgagttgtttg

SEQ ID NO: 327012 - DNA, 20 bp, Artificial
  CRISPR gRNA sequence
gtgttccctgagttgtttgc

SEQ ID NO: 327013 - DNA, 20 bp, Artificial
  CRISPR gRNA sequence
tgtttgcaggtttctgtgtg

SEQ ID NO: 327014 - DNA, 20 bp, Artificial
  CRISPR gRNA sequence
gtttgcaggtttctgtgtgt

SEQ ID NO: 327015 - DNA, 20 bp, Artificial
  CRISPR gRNA sequence
tttgcaggtttctgtgtgtg

SEQ ID NO: 327016 - DNA, 20 bp, Artificial
  CRISPR gRNA sequence
gcaggtttctgtgtgtgggg

SEQ ID NO: 327017 - DNA, 20 bp, Artificial
  CRISPR gRNA sequence
caggtttctgtgtgtggggt

SEQ ID NO: 327018 - DNA, 20 bp, Artificial
  CRISPR gRNA sequence
aggtttctgtgtgtggggtg

SEQ ID NO: 327019 - DNA, 20 bp, Artificial
  CRISPR gRNA sequence
tctgtgtgtggggtggggta

SEQ ID NO: 327020 - DNA, 20 bp, Artificial
  CRISPR gRNA sequence
ctgtgtgtggggtggggtat

SEQ ID NO: 327021 - DNA, 20 bp, Artificial
  CRISPR gRNA sequence
tgtgtgtggggtggggtatg

SEQ ID NO: 327022 - DNA, 20 bp, Artificial
  CRISPR gRNA sequence
tgtgtggggtggggtatggg

SEQ ID NO: 327023 - DNA, 20 bp, Artificial
  CRISPR gRNA sequence
gtgtggggtggggtatgggg

SEQ ID NO: 327024 - DNA, 20 bp, Artificial
  CRISPR gRNA sequence
gtggggtggggtatggggag

SEQ ID NO: 327025 - DNA, 20 bp, Artificial
  CRISPR gRNA sequence
tatggggaggagaaccttca

SEQ ID NO: 327026 - DNA, 20 bp, Artificial
  CRISPR gRNA sequence
ggggaggagaaccttcatgg

SEQ ID NO: 327027 - DNA, 20 bp, Artificial
  CRISPR gRNA sequence
aaccttcatggtggcccacc

SEQ ID NO: 327028 - DNA, 20 bp, Artificial
  CRISPR gRNA sequence
tcatggtggcccacctggcc

SEQ ID NO: 327029 - DNA, 20 bp, Artificial
  CRISPR gRNA sequence
cccacctggcctggttgtcc

SEQ ID NO: 327030 - DNA, 20 bp, Artificial
  CRISPR gRNA sequence
cctcgacacatcctcatccc

SEQ ID NO: 327031 - DNA, 20 bp, Artificial
  CRISPR gRNA sequence
acacatcctcatccccagca

SEQ ID NO: 327032 - DNA, 20 bp, Artificial
  CRISPR gRNA sequence
cacatcctcatccccagcat

SEQ ID NO: 327033 - DNA, 20 bp, Artificial
  CRISPR gRNA sequence
tccccagcatgggacacctc

SEQ ID NO: 327034 - DNA, 20 bp, Artificial
  CRISPR gRNA sequence
aatttctgtgaaatcaaatc

SEQ ID NO: 327035 - DNA, 20 bp, Artificial
  CRISPR gRNA sequence
gtgaaatcaaatccagtttt

SEQ ID NO: 327036 - DNA, 20 bp, Artificial
  CRISPR gRNA sequence
gaaatcaaatccagttttaa

SEQ ID NO: 327037 - DNA, 20 bp, Artificial
  CRISPR gRNA sequence
aaatcaaatccagttttaag

SEQ ID NO: 327038 - DNA, 20 bp, Artificial
  CRISPR gRNA sequence
atcaaatccagttttaagag

SEQ ID NO: 327039 - DNA, 20 bp, Artificial
  CRISPR gRNA sequence
ttaagaggagccacttatca

SEQ ID NO: 327040 - DNA, 20 bp, Artificial
  CRISPR gRNA sequence
aagaggagccacttatcaaa

SEQ ID NO: 327041 - DNA, 20 bp, Artificial
  CRISPR gRNA sequence
acttatcaaagagattttaa

SEQ ID NO: 327042 - DNA, 20 bp, Artificial
  CRISPR gRNA sequence
tatcaaagagattttaacag

SEQ ID NO: 327043 - DNA, 20 bp, Artificial
  CRISPR gRNA sequence
aaagagattttaacagtagt

SEQ ID NO: 327044 - DNA, 20 bp, Artificial
  CRISPR gRNA sequence
gagattttaacagtagtaag

SEQ ID NO: 327045 - DNA, 20 bp, Artificial
  CRISPR gRNA sequence
agattttaacagtagtaaga

SEQ ID NO: 327046 - DNA, 20 bp, Artificial
  CRISPR gRNA sequence
ttaacagtagtaagaaggca

SEQ ID NO: 327047 - DNA, 20 bp, Artificial
  CRISPR gRNA sequence
aagaataaacatttgatatt

SEQ ID NO: 327048 - DNA, 20 bp, Artificial
  CRISPR gRNA sequence
aatacctcactgtgttttct

SEQ ID NO: 327049 - DNA, 20 bp, Artificial
  CRISPR gRNA sequence
atacctcactgtgttttctt

SEQ ID NO: 327050 - DNA, 20 bp, Artificial
  CRISPR gRNA sequence
tacctcactgtgttttcttg

SEQ ID NO: 327051 - DNA, 20 bp, Artificial
  CRISPR gRNA sequence
acctcactgtgttttcttgg

SEQ ID NO: 327052 - DNA, 20 bp, Artificial
  CRISPR gRNA sequence
cctcactgtgttttcttggg

SEQ ID NO: 327053 - DNA, 20 bp, Artificial
  CRISPR gRNA sequence
tcactgtgttttcttggggg

SEQ ID NO: 327054 - DNA, 20 bp, Artificial
  CRISPR gRNA sequence
ctgtgttttcttggggggag

SEQ ID NO: 327055 - DNA, 20 bp, Artificial
  CRISPR gRNA sequence
tgtgttttcttggggggagc

SEQ ID NO: 327056 - DNA, 20 bp, Artificial
  CRISPR gRNA sequence
gtgttttcttggggggagca

SEQ ID NO: 327057 - DNA, 20 bp, Artificial
  CRISPR gRNA sequence
gagcagggaattgattacct

SEQ ID NO: 327058 - DNA, 20 bp, Artificial
  CRISPR gRNA sequence
agggaattgattaccttagc

SEQ ID NO: 327059 - DNA, 20 bp, Artificial
  CRISPR gRNA sequence
caaatttgacattgtacttg

SEQ ID NO: 327060 - DNA, 20 bp, Artificial
  CRISPR gRNA sequence
tttgacattgtacttgaaga

SEQ ID NO: 327061 - DNA, 20 bp, Artificial
  CRISPR gRNA sequence
ttgaagatagttacattgct

SEQ ID NO: 327062 - DNA, 20 bp, Artificial
  CRISPR gRNA sequence
gatagttacattgcttggaa

SEQ ID NO: 327063 - DNA, 20 bp, Artificial
  CRISPR gRNA sequence
caagcaatgtaactatcttc

SEQ ID NO: 327064 - DNA, 20 bp, Artificial
  CRISPR gRNA sequence
aatgtcaaatttgtacatgc

SEQ ID NO: 327065 - DNA, 20 bp, Artificial
  CRISPR gRNA sequence
caaatttgtacatgctagct

SEQ ID NO: 327066 - DNA, 20 bp, Artificial
  CRISPR gRNA sequence
aaatttgtacatgctagcta

SEQ ID NO: 327067 - DNA, 20 bp, Artificial
  CRISPR gRNA sequence
atcaattccctgctcccccc

SEQ ID NO: 327068 - DNA, 20 bp, Artificial
  CRISPR gRNA sequence
ctgctccccccaagaaaaca

SEQ ID NO: 327069 - DNA, 20 bp, Artificial
  CRISPR gRNA sequence
tccccccaagaaaacacagt

SEQ ID NO: 327070 - DNA, 20 bp, Artificial
  CRISPR gRNA sequence
ccccccaagaaaacacagtg

SEQ ID NO: 327071 - DNA, 20 bp, Artificial
  CRISPR gRNA sequence
aaaacacagtgaggtatttt

SEQ ID NO: 327072 - DNA, 20 bp, Artificial
  CRISPR gRNA sequence
actgttaaaatctctttgat

SEQ ID NO: 327073 - DNA, 20 bp, Artificial
  CRISPR gRNA sequence
gttaaaatctctttgataag

SEQ ID NO: 327074 - DNA, 20 bp, Artificial
  CRISPR gRNA sequence
taagtggctcctcttaaaac

SEQ ID NO: 327075 - DNA, 20 bp, Artificial
  CRISPR gRNA sequence
taaaactggatttgatttca

SEQ ID NO: 327076 - DNA, 20 bp, Artificial
  CRISPR gRNA sequence
tgtgaattattattcatctt

SEQ ID NO: 327077 - DNA, 20 bp, Artificial
  CRISPR gRNA sequence
gtgaattattattcatcttg

SEQ ID NO: 327078 - DNA, 20 bp, Artificial
  CRISPR gRNA sequence
catcttgaggtgtcccatgc

SEQ ID NO: 327079 - DNA, 20 bp, Artificial
  CRISPR gRNA sequence
atcttgaggtgtcccatgct

SEQ ID NO: 327080 - DNA, 20 bp, Artificial
  CRISPR gRNA sequence
tcttgaggtgtcccatgctg

SEQ ID NO: 327081 - DNA, 20 bp, Artificial
  CRISPR gRNA sequence
aggtgtcccatgctggggat

SEQ ID NO: 327082 - DNA, 20 bp, Artificial
  CRISPR gRNA sequence
ggtgtcccatgctggggatg

SEQ ID NO: 327083 - DNA, 20 bp, Artificial
  CRISPR gRNA sequence
gctggggatgaggatgtgtc

SEQ ID NO: 327084 - DNA, 20 bp, Artificial
  CRISPR gRNA sequence
ctggggatgaggatgtgtcg

SEQ ID NO: 327085 - DNA, 20 bp, Artificial
  CRISPR gRNA sequence
gatgaggatgtgtcgaggca

SEQ ID NO: 327086 - DNA, 20 bp, Artificial
  CRISPR gRNA sequence
ggatgtgtcgaggcacagct

SEQ ID NO: 327087 - DNA, 20 bp, Artificial
  CRISPR gRNA sequence
cgaggcacagcttggacaac

SEQ ID NO: 327088 - DNA, 20 bp, Artificial
  CRISPR gRNA sequence
gaggcacagcttggacaacc

SEQ ID NO: 327089 - DNA, 20 bp, Artificial
  CRISPR gRNA sequence
cacagcttggacaaccaggc

SEQ ID NO: 327090 - DNA, 20 bp, Artificial
  CRISPR gRNA sequence
acagcttggacaaccaggcc

SEQ ID NO: 327091 - DNA, 20 bp, Artificial
  CRISPR gRNA sequence
gcttggacaaccaggccagg

SEQ ID NO: 327092 - DNA, 20 bp, Artificial
  CRISPR gRNA sequence
cttggacaaccaggccaggt

SEQ ID NO: 327093 - DNA, 20 bp, Artificial
  CRISPR gRNA sequence
aggccaggtgggccaccatg

SEQ ID NO: 327094 - DNA, 20 bp, Artificial
  CRISPR gRNA sequence
ggccaggtgggccaccatga

SEQ ID NO: 327095 - DNA, 20 bp, Artificial
  CRISPR gRNA sequence
cccataccccaccccacaca

SEQ ID NO: 327096 - DNA, 20 bp, Artificial
  CRISPR gRNA sequence
acagaaacctgcaaacaact

SEQ ID NO: 327097 - DNA, 20 bp, Artificial
  CRISPR gRNA sequence
cagaaacctgcaaacaactc

SEQ ID NO: 327098 - DNA, 20 bp, Artificial
  CRISPR gRNA sequence
agaaacctgcaaacaactca

SEQ ID NO: 327099 - DNA, 20 bp, Artificial
  CRISPR gRNA sequence
actcagggaacacctgtgca

SEQ ID NO: 327100 - DNA, 20 bp, Artificial
  CRISPR gRNA sequence
agggaacacctgtgcaaagc

SEQ ID NO: 327101 - DNA, 20 bp, Artificial
  CRISPR gRNA sequence
aacacctgtgcaaagccagt

SEQ ID NO: 327102 - DNA, 20 bp, Artificial
  CRISPR gRNA sequence
acacctgtgcaaagccagtc

SEQ ID NO: 327103 - DNA, 20 bp, Artificial
  CRISPR gRNA sequence
caaagccagtcaggttgtcc

SEQ ID NO: 327104 - DNA, 20 bp, Artificial
  CRISPR gRNA sequence
gccagtcaggttgtccaagt

SEQ ID NO: 327105 - DNA, 20 bp, Artificial
  CRISPR gRNA sequence
ttgtccaagtcagctgaaaa

SEQ ID NO: 327106 - DNA, 20 bp, Artificial
  CRISPR gRNA sequence
ctgaaaacagaacaccatac

SEQ ID NO: 327107 - DNA, 20 bp, Artificial
  CRISPR gRNA sequence
ccatactagattcaaattac

SEQ ID NO: 327108 - DNA, 20 bp, Artificial
  CRISPR gRNA sequence
ctagattcaaattacaagtt

SEQ ID NO: 327109 - DNA, 20 bp, Artificial
  CRISPR gRNA sequence
agtactgtactgtacacatc

SEQ ID NO: 327110 - DNA, 20 bp, Artificial
  CRISPR gRNA sequence
atccagcattacacatgctt

SEQ ID NO: 327111 - DNA, 20 bp, Artificial
  CRISPR gRNA sequence
acacatgcttaagataatat

SEQ ID NO: 327112 - DNA, 20 bp, Artificial
  CRISPR gRNA sequence
aagtatgcataatgacatat

SEQ ID NO: 327113 - DNA, 20 bp, Artificial
  CRISPR gRNA sequence
agtatgcataatgacatatc

SEQ ID NO: 327114 - DNA, 20 bp, Artificial
  CRISPR gRNA sequence
gggtctcacttgtaaactat

SEQ ID NO: 327115 - DNA, 20 bp, Artificial
  CRISPR gRNA sequence
acttgtaaactataagcaca

SEQ ID NO: 327116 - DNA, 20 bp, Artificial
  CRISPR gRNA sequence
gttaaactacaacataatcc

SEQ ID NO: 327117 - DNA, 20 bp, Artificial
  CRISPR gRNA sequence
acataatcccagtttaccta

SEQ ID NO: 327118 - DNA, 20 bp, Artificial
  CRISPR gRNA sequence
aaatgttgttgcatcgacat

SEQ ID NO: 327119 - DNA, 20 bp, Artificial
  CRISPR gRNA sequence
tgcatcgacattggctgctt

SEQ ID NO: 327120 - DNA, 20 bp, Artificial
  CRISPR gRNA sequence
atcgacattggctgcttcag

SEQ ID NO: 327121 - DNA, 20 bp, Artificial
  CRISPR gRNA sequence
attggctgcttcagaagcct

SEQ ID NO: 327122 - DNA, 20 bp, Artificial
  CRISPR gRNA sequence
ttggctgcttcagaagcctt

SEQ ID NO: 327123 - DNA, 20 bp, Artificial
  CRISPR gRNA sequence
cttcagaagccttgggcatg

SEQ ID NO: 327124 - DNA, 20 bp, Artificial
  CRISPR gRNA sequence
agaagccttgggcatgcaga

SEQ ID NO: 327125 - DNA, 20 bp, Artificial
  CRISPR gRNA sequence
gaagccttgggcatgcagac

SEQ ID NO: 327126 - DNA, 20 bp, Artificial
  CRISPR gRNA sequence
gccttgggcatgcagacagg

SEQ ID NO: 327127 - DNA, 20 bp, Artificial
  CRISPR gRNA sequence
ttgggcatgcagacaggaag

SEQ ID NO: 327128 - DNA, 20 bp, Artificial
  CRISPR gRNA sequence
gggcatgcagacaggaagta

SEQ ID NO: 327129 - DNA, 20 bp, Artificial
  CRISPR gRNA sequence
aggaagtagagaaaatattc

SEQ ID NO: 327130 - DNA, 20 bp, Artificial
  CRISPR gRNA sequence
gtagagaaaatattccagct

SEQ ID NO: 327131 - DNA, 20 bp, Artificial
  CRISPR gRNA sequence
taatcatattccacatattt

SEQ ID NO: 327132 - DNA, 20 bp, Artificial
  CRISPR gRNA sequence
cacatatttaagaatctttc

SEQ ID NO: 327133 - DNA, 20 bp, Artificial
  CRISPR gRNA sequence
tctagccaaatcatattcta

SEQ ID NO: 327134 - DNA, 20 bp, Artificial
  CRISPR gRNA sequence
agccaaatcatattctaaag

SEQ ID NO: 327135 - DNA, 20 bp, Artificial
  CRISPR gRNA sequence
gccaaatcatattctaaaga

SEQ ID NO: 327136 - DNA, 20 bp, Artificial
  CRISPR gRNA sequence
ttctaaagaaggctatcttg

SEQ ID NO: 327137 - DNA, 20 bp, Artificial
  CRISPR gRNA sequence
tctaaagaaggctatcttga

SEQ ID NO: 327138 - DNA, 20 bp, Artificial
  CRISPR gRNA sequence
ctaaagaaggctatcttgaa

SEQ ID NO: 327139 - DNA, 20 bp, Artificial
  CRISPR gRNA sequence
agaaggctatcttgaagggc

SEQ ID NO: 327140 - DNA, 20 bp, Artificial
  CRISPR gRNA sequence
gaaggctatcttgaagggcc

SEQ ID NO: 327141 - DNA, 20 bp, Artificial
  CRISPR gRNA sequence
aaggctatcttgaagggcca

SEQ ID NO: 327142 - DNA, 20 bp, Artificial
  CRISPR gRNA sequence
gaagggccagggccaatttc

SEQ ID NO: 327143 - DNA, 20 bp, Artificial
  CRISPR gRNA sequence
aagggccagggccaatttcc

SEQ ID NO: 327144 - DNA, 20 bp, Artificial
  CRISPR gRNA sequence
gggccaatttccaggctgtg

SEQ ID NO: 327145 - DNA, 20 bp, Artificial
  CRISPR gRNA sequence
ccaggctgtgtggtttttat

SEQ ID NO: 327146 - DNA, 20 bp, Artificial
  CRISPR gRNA sequence
aggctgtgtggtttttatga

SEQ ID NO: 327147 - DNA, 20 bp, Artificial
  CRISPR gRNA sequence
ggctgtgtggtttttatgag

SEQ ID NO: 327148 - DNA, 20 bp, Artificial
  CRISPR gRNA sequence
gctgtgtggtttttatgaga

SEQ ID NO: 327149 - DNA, 20 bp, Artificial
  CRISPR gRNA sequence
tgacacatatgtgctcttca

SEQ ID NO: 327150 - DNA, 20 bp, Artificial
  CRISPR gRNA sequence
tatgtgctcttcacagatcc

SEQ ID NO: 327151 - DNA, 20 bp, Artificial
  CRISPR gRNA sequence
agatcctggaattatgaatg

SEQ ID NO: 327152 - DNA, 20 bp, Artificial
  CRISPR gRNA sequence
gatcctggaattatgaatgc

SEQ ID NO: 327153 - DNA, 20 bp, Artificial
  CRISPR gRNA sequence
cctggaattatgaatgcagg

SEQ ID NO: 327154 - DNA, 20 bp, Artificial
  CRISPR gRNA sequence
aggtagaccactgtgattcc

SEQ ID NO: 327155 - DNA, 20 bp, Artificial
  CRISPR gRNA sequence
ggtagaccactgtgattccc

SEQ ID NO: 327156 - DNA, 20 bp, Artificial
  CRISPR gRNA sequence
gtagaccactgtgattccca

SEQ ID NO: 327157 - DNA, 20 bp, Artificial
  CRISPR gRNA sequence
tgtgattcccagggtgactt

SEQ ID NO: 327158 - DNA, 20 bp, Artificial
  CRISPR gRNA sequence
cccagggtgacttcagcctc

SEQ ID NO: 327159 - DNA, 20 bp, Artificial
  CRISPR gRNA sequence
ccagggtgacttcagcctct

SEQ ID NO: 327160 - DNA, 20 bp, Artificial
  CRISPR gRNA sequence
agggtgacttcagcctctgg

SEQ ID NO: 327161 - DNA, 20 bp, Artificial
  CRISPR gRNA sequence
tgacttcagcctctgggagc

SEQ ID NO: 327162 - DNA, 20 bp, Artificial
  CRISPR gRNA sequence
cctctgggagcaagaatacc

SEQ ID NO: 327163 - DNA, 20 bp, Artificial
  CRISPR gRNA sequence
ctgggagcaagaatacctag

SEQ ID NO: 327164 - DNA, 20 bp, Artificial
  CRISPR gRNA sequence
caagaatacctagtggcctc

SEQ ID NO: 327165 - DNA, 20 bp, Artificial
  CRISPR gRNA sequence
atacctagtggcctctggct

SEQ ID NO: 327166 - DNA, 20 bp, Artificial
  CRISPR gRNA sequence
tacctagtggcctctggctc

SEQ ID NO: 327167 - DNA, 20 bp, Artificial
  CRISPR gRNA sequence
acctagtggcctctggctca

SEQ ID NO: 327168 - DNA, 20 bp, Artificial
  CRISPR gRNA sequence
cctagtggcctctggctcag

SEQ ID NO: 327169 - DNA, 20 bp, Artificial
  CRISPR gRNA sequence
tagtggcctctggctcaggg

SEQ ID NO: 327170 - DNA, 20 bp, Artificial
  CRISPR gRNA sequence
tcaggggagtctctcaaccc

SEQ ID NO: 327171 - DNA, 20 bp, Artificial
  CRISPR gRNA sequence
ctcaaccctggaattccacc

SEQ ID NO: 327172 - DNA, 20 bp, Artificial
  CRISPR gRNA sequence
tcaaccctggaattccaccc

SEQ ID NO: 327173 - DNA, 20 bp, Artificial
  CRISPR gRNA sequence
cctggaattccacccaggtc

SEQ ID NO: 327174 - DNA, 20 bp, Artificial
  CRISPR gRNA sequence
tggaattccacccaggtctg

SEQ ID NO: 327175 - DNA, 20 bp, Artificial
  CRISPR gRNA sequence
ggaattccacccaggtctgg

SEQ ID NO: 327176 - DNA, 20 bp, Artificial
  CRISPR gRNA sequence
gaattccacccaggtctgga

SEQ ID NO: 327177 - DNA, 20 bp, Artificial
  CRISPR gRNA sequence
ccaggtctggagggctgctc

SEQ ID NO: 327178 - DNA, 20 bp, Artificial
  CRISPR gRNA sequence
caggtctggagggctgctcc

SEQ ID NO: 327179 - DNA, 20 bp, Artificial
  CRISPR gRNA sequence
ggagggctgctccaggctga

SEQ ID NO: 327180 - DNA, 20 bp, Artificial
  CRISPR gRNA sequence
gagggctgctccaggctgat

SEQ ID NO: 327181 - DNA, 20 bp, Artificial
  CRISPR gRNA sequence
agggctgctccaggctgatg

SEQ ID NO: 327182 - DNA, 20 bp, Artificial
  CRISPR gRNA sequence
ggggaccattttgacctgtc

SEQ ID NO: 327183 - DNA, 20 bp, Artificial
  CRISPR gRNA sequence
ccattttgacctgtcaagcc

SEQ ID NO: 327184 - DNA, 20 bp, Artificial
  CRISPR gRNA sequence
attttgacctgtcaagccca

SEQ ID NO: 327185 - DNA, 20 bp, Artificial
  CRISPR gRNA sequence
ttttgacctgtcaagcccag

SEQ ID NO: 327186 - DNA, 20 bp, Artificial
  CRISPR gRNA sequence
tgtcaagcccagaggcacca

SEQ ID NO: 327187 - DNA, 20 bp, Artificial
  CRISPR gRNA sequence
gtcaagcccagaggcaccat

SEQ ID NO: 327188 - DNA, 20 bp, Artificial
  CRISPR gRNA sequence
gcccagaggcaccatgggta

SEQ ID NO: 327189 - DNA, 20 bp, Artificial
  CRISPR gRNA sequence
gcaccatgggtatagtctga

SEQ ID NO: 327190 - DNA, 20 bp, Artificial
  CRISPR gRNA sequence
tatagtctgacagcaaccta

SEQ ID NO: 327191 - DNA, 20 bp, Artificial
  CRISPR gRNA sequence
acagcaacctatagtaactg

SEQ ID NO: 327192 - DNA, 20 bp, Artificial
  CRISPR gRNA sequence
cctatagtaactgcagcttt

SEQ ID NO: 327193 - DNA, 20 bp, Artificial
  CRISPR gRNA sequence
ctatagtaactgcagctttc

SEQ ID NO: 327194 - DNA, 20 bp, Artificial
  CRISPR gRNA sequence
aatattctgctctaccccat

SEQ ID NO: 327195 - DNA, 20 bp, Artificial
  CRISPR gRNA sequence
gctctaccccatgagaatgc

SEQ ID NO: 327196 - DNA, 20 bp, Artificial
  CRISPR gRNA sequence
atgagaatgctggcccatta

SEQ ID NO: 327197 - DNA, 20 bp, Artificial
  CRISPR gRNA sequence
attttaatatgatctacaaa

SEQ ID NO: 327198 - DNA, 20 bp, Artificial
  CRISPR gRNA sequence
agaactaaacttgtaattaa

SEQ ID NO: 327199 - DNA, 20 bp, Artificial
  CRISPR gRNA sequence
ttaatagcaccatgaaaaca

SEQ ID NO: 327200 - DNA, 20 bp, Artificial
  CRISPR gRNA sequence
caccatgaaaacatagataa

SEQ ID NO: 327201 - DNA, 20 bp, Artificial
  CRISPR gRNA sequence
catgaaaacatagataatgg

SEQ ID NO: 327202 - DNA, 20 bp, Artificial
  CRISPR gRNA sequence
acatagataatggtagaaaa

SEQ ID NO: 327203 - DNA, 20 bp, Artificial
  CRISPR gRNA sequence
catagataatggtagaaaat

SEQ ID NO: 327204 - DNA, 20 bp, Artificial
  CRISPR gRNA sequence
aataaatttgctttcaattc

SEQ ID NO: 327205 - DNA, 20 bp, Artificial
  CRISPR gRNA sequence
ataaatttgctttcaattcc

SEQ ID NO: 327206 - DNA, 20 bp, Artificial
  CRISPR gRNA sequence
tcctaccactaacttgaaca

SEQ ID NO: 327207 - DNA, 20 bp, Artificial
  CRISPR gRNA sequence
aaaccattttaactgaattt

SEQ ID NO: 327208 - DNA, 20 bp, Artificial
  CRISPR gRNA sequence
attttaactgaatttgagaa

SEQ ID NO: 327209 - DNA, 20 bp, Artificial
  CRISPR gRNA sequence
gagaaaagaacatgtctttc

SEQ ID NO: 327210 - DNA, 20 bp, Artificial
  CRISPR gRNA sequence
gaaaagaacatgtctttctg

SEQ ID NO: 327211 - DNA, 20 bp, Artificial
  CRISPR gRNA sequence
ctggagcaaaaatattcttg

SEQ ID NO: 327212 - DNA, 20 bp, Artificial
  CRISPR gRNA sequence
tggagcaaaaatattcttgt

SEQ ID NO: 327213 - DNA, 20 bp, Artificial
  CRISPR gRNA sequence
ggagcaaaaatattcttgta

SEQ ID NO: 327214 - DNA, 20 bp, Artificial
  CRISPR gRNA sequence
agcaaaaatattcttgtagg

SEQ ID NO: 327215 - DNA, 20 bp, Artificial
  CRISPR gRNA sequence
atattcttgtagggagaata

SEQ ID NO: 327216 - DNA, 20 bp, Artificial
  CRISPR gRNA sequence
tattcttgtagggagaatat

SEQ ID NO: 327217 - DNA, 20 bp, Artificial
  CRISPR gRNA sequence
tgtgtgtatatatgtatgca

SEQ ID NO: 327218 - DNA, 20 bp, Artificial
  CRISPR gRNA sequence
catagatatataaaactatt

SEQ ID NO: 327219 - DNA, 20 bp, Artificial
  CRISPR gRNA sequence
agatatataaaactattgag

SEQ ID NO: 327220 - DNA, 20 bp, Artificial
  CRISPR gRNA sequence
tatataaaactattgagcag

SEQ ID NO: 327221 - DNA, 20 bp, Artificial
  CRISPR gRNA sequence
tataaaactattgagcagca

SEQ ID NO: 327222 - DNA, 20 bp, Artificial
  CRISPR gRNA sequence
ataaaactattgagcagcag

SEQ ID NO: 327223 - DNA, 20 bp, Artificial
  CRISPR gRNA sequence
aactattgagcagcagagga

SEQ ID NO: 327224 - DNA, 20 bp, Artificial
  CRISPR gRNA sequence
agcagcagaggaaagaatgt

SEQ ID NO: 327225 - DNA, 20 bp, Artificial
  CRISPR gRNA sequence
agaggaaagaatgtaagaca

SEQ ID NO: 327226 - DNA, 20 bp, Artificial
  CRISPR gRNA sequence
gtaagacatagctctctatt

SEQ ID NO: 327227 - DNA, 20 bp, Artificial
  CRISPR gRNA sequence
aagacatagctctctattga

SEQ ID NO: 327228 - DNA, 20 bp, Artificial
  CRISPR gRNA sequence
acatagctctctattgagag

SEQ ID NO: 327229 - DNA, 20 bp, Artificial
  CRISPR gRNA sequence
tctctattgagagtggctgt

SEQ ID NO: 327230 - DNA, 20 bp, Artificial
  CRISPR gRNA sequence
ctctattgagagtggctgtt

SEQ ID NO: 327231 - DNA, 20 bp, Artificial
  CRISPR gRNA sequence
agagtggctgttgggctgtc

SEQ ID NO: 327232 - DNA, 20 bp, Artificial
  CRISPR gRNA sequence
gtggctgttgggctgtcaag

SEQ ID NO: 327233 - DNA, 20 bp, Artificial
  CRISPR gRNA sequence
tgggctgtcaagcagtcatg

SEQ ID NO: 327234 - DNA, 20 bp, Artificial
  CRISPR gRNA sequence
gctgtcaagcagtcatgtag

SEQ ID NO: 327235 - DNA, 20 bp, Artificial
  CRISPR gRNA sequence
catgtagaagtatttttaaa

SEQ ID NO: 327236 - DNA, 20 bp, Artificial
  CRISPR gRNA sequence
gtatttttaaaaagaaaatt

SEQ ID NO: 327237 - DNA, 20 bp, Artificial
  CRISPR gRNA sequence
tatttttaaaaagaaaattg

SEQ ID NO: 327238 - DNA, 20 bp, Artificial
  CRISPR gRNA sequence
atttttaaaaagaaaattga

SEQ ID NO: 327239 - DNA, 20 bp, Artificial
  CRISPR gRNA sequence
aaaaagaaaattgagggcac

SEQ ID NO: 327240 - DNA, 20 bp, Artificial
  CRISPR gRNA sequence
agaaaattgagggcacaaga

SEQ ID NO: 327241 - DNA, 20 bp, Artificial
  CRISPR gRNA sequence
agggcacaagaaagcatcta

SEQ ID NO: 327242 - DNA, 20 bp, Artificial
  CRISPR gRNA sequence
caagaaagcatctaaagtct

SEQ ID NO: 327243 - DNA, 20 bp, Artificial
  CRISPR gRNA sequence
catctaaagtcttggtaaaa

SEQ ID NO: 327244 - DNA, 20 bp, Artificial
  CRISPR gRNA sequence
gtcttggtaaaatggtcaac

SEQ ID NO: 327245 - DNA, 20 bp, Artificial
  CRISPR gRNA sequence
tcttggtaaaatggtcaact

SEQ ID NO: 327246 - DNA, 20 bp, Artificial
  CRISPR gRNA sequence
cttggtaaaatggtcaactg

SEQ ID NO: 327247 - DNA, 20 bp, Artificial
  CRISPR gRNA sequence
taaaatggtcaactggggtt

SEQ ID NO: 327248 - DNA, 20 bp, Artificial
  CRISPR gRNA sequence
caactggggttcagcaattg

SEQ ID NO: 327249 - DNA, 20 bp, Artificial
  CRISPR gRNA sequence
aactggggttcagcaattga

SEQ ID NO: 327250 - DNA, 20 bp, Artificial
  CRISPR gRNA sequence
ctggggttcagcaattgaag

SEQ ID NO: 327251 - DNA, 20 bp, Artificial
  CRISPR gRNA sequence
ggggttcagcaattgaagga

SEQ ID NO: 327252 - DNA, 20 bp, Artificial
  CRISPR gRNA sequence
agcaattgaaggagagtact

SEQ ID NO: 327253 - DNA, 20 bp, Artificial
  CRISPR gRNA sequence
actgagtatgtactaatgta

SEQ ID NO: 327254 - DNA, 20 bp, Artificial
  CRISPR gRNA sequence
tacagttcacatcaacatct

SEQ ID NO: 327255 - DNA, 20 bp, Artificial
  CRISPR gRNA sequence
tcaacatctcagaaataaaa

SEQ ID NO: 327256 - DNA, 20 bp, Artificial
  CRISPR gRNA sequence
tctcagaaataaaatagctc

SEQ ID NO: 327257 - DNA, 20 bp, Artificial
  CRISPR gRNA sequence
ataaaatagctccagctttg

SEQ ID NO: 327258 - DNA, 20 bp, Artificial
  CRISPR gRNA sequence
catctcccttgactgattaa

SEQ ID NO: 327259 - DNA, 20 bp, Artificial
  CRISPR gRNA sequence
tctcccttgactgattaaaa

SEQ ID NO: 327260 - DNA, 20 bp, Artificial
  CRISPR gRNA sequence
ctcccttgactgattaaaag

SEQ ID NO: 327261 - DNA, 20 bp, Artificial
  CRISPR gRNA sequence
aagaggaattctcatcccta

SEQ ID NO: 327262 - DNA, 20 bp, Artificial
  CRISPR gRNA sequence
ggaattctcatccctacaga

SEQ ID NO: 327263 - DNA, 20 bp, Artificial
  CRISPR gRNA sequence
attctcatccctacagaaag

SEQ ID NO: 327264 - DNA, 20 bp, Artificial
  CRISPR gRNA sequence
tctcatccctacagaaagaa

SEQ ID NO: 327265 - DNA, 20 bp, Artificial
  CRISPR gRNA sequence
ctcatccctacagaaagaag

SEQ ID NO: 327266 - DNA, 20 bp, Artificial
  CRISPR gRNA sequence
atccctacagaaagaagagg

SEQ ID NO: 327267 - DNA, 20 bp, Artificial
  CRISPR gRNA sequence
agaaagaagaggtagtatga

SEQ ID NO: 327268 - DNA, 20 bp, Artificial
  CRISPR gRNA sequence
ggtagtatgatagtgaaatg

SEQ ID NO: 327269 - DNA, 20 bp, Artificial
  CRISPR gRNA sequence
gtatgatagtgaaatgcgga

SEQ ID NO: 327270 - DNA, 20 bp, Artificial
  CRISPR gRNA sequence
agtgaaatgcggacagatgc

SEQ ID NO: 327271 - DNA, 20 bp, Artificial
  CRISPR gRNA sequence
tgcggacagatgctggtcct

SEQ ID NO: 327272 - DNA, 20 bp, Artificial
  CRISPR gRNA sequence
ttggctgctcatttgctttg

SEQ ID NO: 327273 - DNA, 20 bp, Artificial
  CRISPR gRNA sequence
gctcatttgctttgcagatt

SEQ ID NO: 327274 - DNA, 20 bp, Artificial
  CRISPR gRNA sequence
ctttgcagattcagtacccc

SEQ ID NO: 327275 - DNA, 20 bp, Artificial
  CRISPR gRNA sequence
tgtaaatgtgtttgttttac

SEQ ID NO: 327276 - DNA, 20 bp, Artificial
  CRISPR gRNA sequence
tttactggctgatgcactgc

SEQ ID NO: 327277 - DNA, 20 bp, Artificial
  CRISPR gRNA sequence
ttactggctgatgcactgct

SEQ ID NO: 327278 - DNA, 20 bp, Artificial
  CRISPR gRNA sequence
actggctgatgcactgctag

SEQ ID NO: 327279 - DNA, 20 bp, Artificial
  CRISPR gRNA sequence
ggctgatgcactgctaggag

SEQ ID NO: 327280 - DNA, 20 bp, Artificial
  CRISPR gRNA sequence
tgcactgctaggagcagatg

SEQ ID NO: 327281 - DNA, 20 bp, Artificial
  CRISPR gRNA sequence
cactgctaggagcagatgtg

SEQ ID NO: 327282 - DNA, 20 bp, Artificial
  CRISPR gRNA sequence
gctaggagcagatgtggaga

SEQ ID NO: 327283 - DNA, 20 bp, Artificial
  CRISPR gRNA sequence
ctaggagcagatgtggagac

SEQ ID NO: 327284 - DNA, 20 bp, Artificial
  CRISPR gRNA sequence
taggagcagatgtggagaca

SEQ ID NO: 327285 - DNA, 20 bp, Artificial
  CRISPR gRNA sequence
ggagacagggattccactcc

SEQ ID NO: 327286 - DNA, 20 bp, Artificial
  CRISPR gRNA sequence
acagggattccactcccagt

SEQ ID NO: 327287 - DNA, 20 bp, Artificial
  CRISPR gRNA sequence
ttccactcccagtgagcaca

SEQ ID NO: 327288 - DNA, 20 bp, Artificial
  CRISPR gRNA sequence
tccactcccagtgagcacac

SEQ ID NO: 327289 - DNA, 20 bp, Artificial
  CRISPR gRNA sequence
cactcccagtgagcacacag

SEQ ID NO: 327290 - DNA, 20 bp, Artificial
  CRISPR gRNA sequence
cccagtgagcacacaggagc

SEQ ID NO: 327291 - DNA, 20 bp, Artificial
  CRISPR gRNA sequence
ccagtgagcacacaggagct

SEQ ID NO: 327292 - DNA, 20 bp, Artificial
  CRISPR gRNA sequence
caggagctgggctttctcca

SEQ ID NO: 327293 - DNA, 20 bp, Artificial
  CRISPR gRNA sequence
agctgggctttctccaaagc

SEQ ID NO: 327294 - DNA, 20 bp, Artificial
  CRISPR gRNA sequence
ctttctccaaagctggttgc

SEQ ID NO: 327295 - DNA, 20 bp, Artificial
  CRISPR gRNA sequence
ttctccaaagctggttgcaa

SEQ ID NO: 327296 - DNA, 20 bp, Artificial
  CRISPR gRNA sequence
tctccaaagctggttgcaag

SEQ ID NO: 327297 - DNA, 20 bp, Artificial
  CRISPR gRNA sequence
ctccaaagctggttgcaaga

SEQ ID NO: 327298 - DNA, 20 bp, Artificial
  CRISPR gRNA sequence
tgcaagagggtgtttgtttt

SEQ ID NO: 327299 - DNA, 20 bp, Artificial
  CRISPR gRNA sequence
caagagggtgtttgttttga

SEQ ID NO: 327300 - DNA, 20 bp, Artificial
  CRISPR gRNA sequence
aagagggtgtttgttttgag

SEQ ID NO: 327301 - DNA, 20 bp, Artificial
  CRISPR gRNA sequence
gtgtttgttttgagaggact

SEQ ID NO: 327302 - DNA, 20 bp, Artificial
  CRISPR gRNA sequence
tttgttttgagaggactcgg

SEQ ID NO: 327303 - DNA, 20 bp, Artificial
  CRISPR gRNA sequence
tgagaggactcggcagtacc

SEQ ID NO: 327304 - DNA, 20 bp, Artificial
  CRISPR gRNA sequence
gagaggactcggcagtacca

SEQ ID NO: 327305 - DNA, 20 bp, Artificial
  CRISPR gRNA sequence
aggactcggcagtaccaagg

SEQ ID NO: 327306 - DNA, 20 bp, Artificial
  CRISPR gRNA sequence
aaaatccccattgactgata

SEQ ID NO: 327307 - DNA, 20 bp, Artificial
  CRISPR gRNA sequence
gactgatacagtcattcttc

SEQ ID NO: 327308 - DNA, 20 bp, Artificial
  CRISPR gRNA sequence
ttccagattgaacaaaacac

SEQ ID NO: 327309 - DNA, 20 bp, Artificial
  CRISPR gRNA sequence
cagattgaacaaaacaccag

SEQ ID NO: 327310 - DNA, 20 bp, Artificial
  CRISPR gRNA sequence
attgaacaaaacaccagcag

SEQ ID NO: 327311 - DNA, 20 bp, Artificial
  CRISPR gRNA sequence
acaccagcagaagatgtatg

SEQ ID NO: 327312 - DNA, 20 bp, Artificial
  CRISPR gRNA sequence
agcagaagatgtatgtagtt

SEQ ID NO: 327313 - DNA, 20 bp, Artificial
  CRISPR gRNA sequence
gaagatgtatgtagttaagt

SEQ ID NO: 327314 - DNA, 20 bp, Artificial
  CRISPR gRNA sequence
tagttaagtcagactctccg

SEQ ID NO: 327315 - DNA, 20 bp, Artificial
  CRISPR gRNA sequence
agtcagactctccgtggtcc

SEQ ID NO: 327316 - DNA, 20 bp, Artificial
  CRISPR gRNA sequence
ctctccgtggtcccggaaat

SEQ ID NO: 327317 - DNA, 20 bp, Artificial
  CRISPR gRNA sequence
ctccgtggtcccggaaataa

SEQ ID NO: 327318 - DNA, 20 bp, Artificial
  CRISPR gRNA sequence
ataagagaatcttgcacttc

SEQ ID NO: 327319 - DNA, 20 bp, Artificial
  CRISPR gRNA sequence
agaatcttgcacttcaagtt

SEQ ID NO: 327320 - DNA, 20 bp, Artificial
  CRISPR gRNA sequence
gaatcttgcacttcaagttg

SEQ ID NO: 327321 - DNA, 20 bp, Artificial
  CRISPR gRNA sequence
cacttcaagttgaggaaaac

SEQ ID NO: 327322 - DNA, 20 bp, Artificial
  CRISPR gRNA sequence
tggccaacgtgcttcatgcc

SEQ ID NO: 327323 - DNA, 20 bp, Artificial
  CRISPR gRNA sequence
ggccaacgtgcttcatgcct

SEQ ID NO: 327324 - DNA, 20 bp, Artificial
  CRISPR gRNA sequence
cgtgcttcatgcctgggtgc

SEQ ID NO: 327325 - DNA, 20 bp, Artificial
  CRISPR gRNA sequence
tgcttcatgcctgggtgcca

SEQ ID NO: 327326 - DNA, 20 bp, Artificial
  CRISPR gRNA sequence
ggtgccagagttccatatta

SEQ ID NO: 327327 - DNA, 20 bp, Artificial
  CRISPR gRNA sequence
gtgccagagttccatattat

SEQ ID NO: 327328 - DNA, 20 bp, Artificial
  CRISPR gRNA sequence
tgccagagttccatattata

SEQ ID NO: 327329 - DNA, 20 bp, Artificial
  CRISPR gRNA sequence
tcacatctgtaacaaaaatt

SEQ ID NO: 327330 - DNA, 20 bp, Artificial
  CRISPR gRNA sequence
tctaaatgctctccatgtgc

SEQ ID NO: 327331 - DNA, 20 bp, Artificial
  CRISPR gRNA sequence
tccatgtgccagttccctac

SEQ ID NO: 327332 - DNA, 20 bp, Artificial
  CRISPR gRNA sequence
atgtgccagttccctacaag

SEQ ID NO: 327333 - DNA, 20 bp, Artificial
  CRISPR gRNA sequence
catctttatgcttcaacacc

SEQ ID NO: 327334 - DNA, 20 bp, Artificial
  CRISPR gRNA sequence
tatgcttcaacacccagcac

SEQ ID NO: 327335 - DNA, 20 bp, Artificial
  CRISPR gRNA sequence
cagcaccagttccccatttc

SEQ ID NO: 327336 - DNA, 20 bp, Artificial
  CRISPR gRNA sequence
gcaccagttccccatttcca

SEQ ID NO: 327337 - DNA, 20 bp, Artificial
  CRISPR gRNA sequence
ccagttccccatttccagag

SEQ ID NO: 327338 - DNA, 20 bp, Artificial
  CRISPR gRNA sequence
tccccatttccagagaagtt

SEQ ID NO: 327339 - DNA, 20 bp, Artificial
  CRISPR gRNA sequence
ttagctctcgactcctataa

SEQ ID NO: 327340 - DNA, 20 bp, Artificial
  CRISPR gRNA sequence
aaactgtccacctctgattg

SEQ ID NO: 327341 - DNA, 20 bp, Artificial
  CRISPR gRNA sequence
cctctgattgcagctgctgc

SEQ ID NO: 327342 - DNA, 20 bp, Artificial
  CRISPR gRNA sequence
ctctgattgcagctgctgct

SEQ ID NO: 327343 - DNA, 20 bp, Artificial
  CRISPR gRNA sequence
tctgattgcagctgctgctg

SEQ ID NO: 327344 - DNA, 20 bp, Artificial
  CRISPR gRNA sequence
gattgcagctgctgctgggg

SEQ ID NO: 327345 - DNA, 20 bp, Artificial
  CRISPR gRNA sequence
gcagctgctgctggggcaga

SEQ ID NO: 327346 - DNA, 20 bp, Artificial
  CRISPR gRNA sequence
ctggggcagaaagcgctgca

SEQ ID NO: 327347 - DNA, 20 bp, Artificial
  CRISPR gRNA sequence
tggggcagaaagcgctgcat

SEQ ID NO: 327348 - DNA, 20 bp, Artificial
  CRISPR gRNA sequence
gctgcatgggctgactgttc

SEQ ID NO: 327349 - DNA, 20 bp, Artificial
  CRISPR gRNA sequence
ggctgactgttctagcacaa

SEQ ID NO: 327350 - DNA, 20 bp, Artificial
  CRISPR gRNA sequence
tttcactgcttttctgcctc

SEQ ID NO: 327351 - DNA, 20 bp, Artificial
  CRISPR gRNA sequence
ctgcctccagactttctctg

SEQ ID NO: 327352 - DNA, 20 bp, Artificial
  CRISPR gRNA sequence
tttctctgaagactcatccc

SEQ ID NO: 327353 - DNA, 20 bp, Artificial
  CRISPR gRNA sequence
ctctgaagactcatcccaag

SEQ ID NO: 327354 - DNA, 20 bp, Artificial
  CRISPR gRNA sequence
tctgaagactcatcccaagt

SEQ ID NO: 327355 - DNA, 20 bp, Artificial
  CRISPR gRNA sequence
atcccaagtaggctcatccc

SEQ ID NO: 327356 - DNA, 20 bp, Artificial
  CRISPR gRNA sequence
ccaagtaggctcatcccaag

SEQ ID NO: 327357 - DNA, 20 bp, Artificial
  CRISPR gRNA sequence
aagtaggctcatcccaagta

SEQ ID NO: 327358 - DNA, 20 bp, Artificial
  CRISPR gRNA sequence
agtaggctcatcccaagtag

SEQ ID NO: 327359 - DNA, 20 bp, Artificial
  CRISPR gRNA sequence
gctcatcccaagtagaggca

SEQ ID NO: 327360 - DNA, 20 bp, Artificial
  CRISPR gRNA sequence
tcccaagtagaggcacagct

SEQ ID NO: 327361 - DNA, 20 bp, Artificial
  CRISPR gRNA sequence
ccaagtagaggcacagctca

SEQ ID NO: 327362 - DNA, 20 bp, Artificial
  CRISPR gRNA sequence
tagaggcacagctcagagat

SEQ ID NO: 327363 - DNA, 20 bp, Artificial
  CRISPR gRNA sequence
agaggcacagctcagagatg

SEQ ID NO: 327364 - DNA, 20 bp, Artificial
  CRISPR gRNA sequence
gaggcacagctcagagatga

SEQ ID NO: 327365 - DNA, 20 bp, Artificial
  CRISPR gRNA sequence
cacagctcagagatgaggga

SEQ ID NO: 327366 - DNA, 20 bp, Artificial
  CRISPR gRNA sequence
gggaaagctaatgccctccg

SEQ ID NO: 327367 - DNA, 20 bp, Artificial
  CRISPR gRNA sequence
ggaaagctaatgccctccgc

SEQ ID NO: 327368 - DNA, 20 bp, Artificial
  CRISPR gRNA sequence
ctccgcaggcaaccccaaat

SEQ ID NO: 327369 - DNA, 20 bp, Artificial
  CRISPR gRNA sequence
gcaggcaaccccaaatcagt

SEQ ID NO: 327370 - DNA, 20 bp, Artificial
  CRISPR gRNA sequence
caggcaaccccaaatcagtg

SEQ ID NO: 327371 - DNA, 20 bp, Artificial
  CRISPR gRNA sequence
caaccccaaatcagtgagga

SEQ ID NO: 327372 - DNA, 20 bp, Artificial
  CRISPR gRNA sequence
accccaaatcagtgaggatg

SEQ ID NO: 327373 - DNA, 20 bp, Artificial
  CRISPR gRNA sequence
caaatcagtgaggatggagc

SEQ ID NO: 327374 - DNA, 20 bp, Artificial
  CRISPR gRNA sequence
atcagtgaggatggagccag

SEQ ID NO: 327375 - DNA, 20 bp, Artificial
  CRISPR gRNA sequence
gccagtggttgccatccttc

SEQ ID NO: 327376 - DNA, 20 bp, Artificial
  CRISPR gRNA sequence
cagtggttgccatccttcaa

SEQ ID NO: 327377 - DNA, 20 bp, Artificial
  CRISPR gRNA sequence
atccttcaagagaatgattc

SEQ ID NO: 327378 - DNA, 20 bp, Artificial
  CRISPR gRNA sequence
tccttcaagagaatgattct

SEQ ID NO: 327379 - DNA, 20 bp, Artificial
  CRISPR gRNA sequence
cttcaagagaatgattctgg

SEQ ID NO: 327380 - DNA, 20 bp, Artificial
  CRISPR gRNA sequence
ttcaagagaatgattctggg

SEQ ID NO: 327381 - DNA, 20 bp, Artificial
  CRISPR gRNA sequence
ggaggcatctgtacacttct

SEQ ID NO: 327382 - DNA, 20 bp, Artificial
  CRISPR gRNA sequence
aggcatctgtacacttctca

SEQ ID NO: 327383 - DNA, 20 bp, Artificial
  CRISPR gRNA sequence
ggcatctgtacacttctcag

SEQ ID NO: 327384 - DNA, 20 bp, Artificial
  CRISPR gRNA sequence
cacttctcagaggtccaatg

SEQ ID NO: 327385 - DNA, 20 bp, Artificial
  CRISPR gRNA sequence
tctcagaggtccaatgaagt

SEQ ID NO: 327386 - DNA, 20 bp, Artificial
  CRISPR gRNA sequence
ctcagaggtccaatgaagtc

SEQ ID NO: 327387 - DNA, 20 bp, Artificial
  CRISPR gRNA sequence
ccaatgaagtcaggcctctg

SEQ ID NO: 327388 - DNA, 20 bp, Artificial
  CRISPR gRNA sequence
gaagtcaggcctctgtggcc

SEQ ID NO: 327389 - DNA, 20 bp, Artificial
  CRISPR gRNA sequence
agtcaggcctctgtggcctg

SEQ ID NO: 327390 - DNA, 20 bp, Artificial
  CRISPR gRNA sequence
ggcctctgtggcctggagct

SEQ ID NO: 327391 - DNA, 20 bp, Artificial
  CRISPR gRNA sequence
cttcatttgcttctccttgt

SEQ ID NO: 327392 - DNA, 20 bp, Artificial
  CRISPR gRNA sequence
gccccctcaccccttcttcc

SEQ ID NO: 327393 - DNA, 20 bp, Artificial
  CRISPR gRNA sequence
ccccctcaccccttcttcct

SEQ ID NO: 327394 - DNA, 20 bp, Artificial
  CRISPR gRNA sequence
caaataaactacttgcaccc

SEQ ID NO: 327395 - DNA, 20 bp, Artificial
  CRISPR gRNA sequence
ttgcacccaagtccttatgt

SEQ ID NO: 327396 - DNA, 20 bp, Artificial
  CRISPR gRNA sequence
tgcacccaagtccttatgtc

SEQ ID NO: 327397 - DNA, 20 bp, Artificial
  CRISPR gRNA sequence
cttatgtcaggttctgcttg

SEQ ID NO: 327398 - DNA, 20 bp, Artificial
  CRISPR gRNA sequence
ttatgtcaggttctgcttgt

SEQ ID NO: 327399 - DNA, 20 bp, Artificial
  CRISPR gRNA sequence
tatgtcaggttctgcttgtg

SEQ ID NO: 327400 - DNA, 20 bp, Artificial
  CRISPR gRNA sequence
tctgcttgtggggatccaaa

SEQ ID NO: 327401 - DNA, 20 bp, Artificial
  CRISPR gRNA sequence
cttgtggggatccaaacagc

SEQ ID NO: 327402 - DNA, 20 bp, Artificial
  CRISPR gRNA sequence
ccaaacagccagaacacatt

SEQ ID NO: 327403 - DNA, 20 bp, Artificial
  CRISPR gRNA sequence
cagccagaacacattaagca

SEQ ID NO: 327404 - DNA, 20 bp, Artificial
  CRISPR gRNA sequence
gccagaacacattaagcaaa

SEQ ID NO: 327405 - DNA, 20 bp, Artificial
  CRISPR gRNA sequence
acacattaagcaaagagatt

SEQ ID NO: 327406 - DNA, 20 bp, Artificial
  CRISPR gRNA sequence
acattaagcaaagagattga

SEQ ID NO: 327407 - DNA, 20 bp, Artificial
  CRISPR gRNA sequence
gagatcatatattttttaaa

SEQ ID NO: 327408 - DNA, 20 bp, Artificial
  CRISPR gRNA sequence
catatattttttaaacagca

SEQ ID NO: 327409 - DNA, 20 bp, Artificial
  CRISPR gRNA sequence
acagcaaagtaatgaaacat

SEQ ID NO: 327410 - DNA, 20 bp, Artificial
  CRISPR gRNA sequence
atgaaacataagctctttgc

SEQ ID NO: 327411 - DNA, 20 bp, Artificial
  CRISPR gRNA sequence
taagctctttgcaagtgtca

SEQ ID NO: 327412 - DNA, 20 bp, Artificial
  CRISPR gRNA sequence
ctctttgcaagtgtcaaagc

SEQ ID NO: 327413 - DNA, 20 bp, Artificial
  CRISPR gRNA sequence
tctttgcaagtgtcaaagct

SEQ ID NO: 327414 - DNA, 20 bp, Artificial
  CRISPR gRNA sequence
aaagctaggtattaactgtc

SEQ ID NO: 327415 - DNA, 20 bp, Artificial
  CRISPR gRNA sequence
aagctaggtattaactgtct

SEQ ID NO: 327416 - DNA, 20 bp, Artificial
  CRISPR gRNA sequence
agctaggtattaactgtcta

SEQ ID NO: 327417 - DNA, 20 bp, Artificial
  CRISPR gRNA sequence
ttaactgtctagggaaccaa

SEQ ID NO: 327418 - DNA, 20 bp, Artificial
  CRISPR gRNA sequence
aactgtctagggaaccaaaa

SEQ ID NO: 327419 - DNA, 20 bp, Artificial
  CRISPR gRNA sequence
aaagagtcactgaacacttt

SEQ ID NO: 327420 - DNA, 20 bp, Artificial
  CRISPR gRNA sequence
aaaacatgaaatgtgaactc

SEQ ID NO: 327421 - DNA, 20 bp, Artificial
  CRISPR gRNA sequence
aaacatgaaatgtgaactca

SEQ ID NO: 327422 - DNA, 20 bp, Artificial
  CRISPR gRNA sequence
gtgaactcaaggatcctttt

SEQ ID NO: 327423 - DNA, 20 bp, Artificial
  CRISPR gRNA sequence
ctataattccatgacaacgc

SEQ ID NO: 327424 - DNA, 20 bp, Artificial
  CRISPR gRNA sequence
caagctatgtgtgtcccctt

SEQ ID NO: 327425 - DNA, 20 bp, Artificial
  CRISPR gRNA sequence
tgtcccctttagataatctg

SEQ ID NO: 327426 - DNA, 20 bp, Artificial
  CRISPR gRNA sequence
ttagataatctgtagccact

SEQ ID NO: 327427 - DNA, 20 bp, Artificial
  CRISPR gRNA sequence
tagataatctgtagccactg

SEQ ID NO: 327428 - DNA, 20 bp, Artificial
  CRISPR gRNA sequence
agataatctgtagccactga

SEQ ID NO: 327429 - DNA, 20 bp, Artificial
  CRISPR gRNA sequence
gataatctgtagccactgag

SEQ ID NO: 327430 - DNA, 20 bp, Artificial
  CRISPR gRNA sequence
aatctgtagccactgagggg

SEQ ID NO: 327431 - DNA, 20 bp, Artificial
  CRISPR gRNA sequence
cactgaggggtggaaaaatg

SEQ ID NO: 327432 - DNA, 20 bp, Artificial
  CRISPR gRNA sequence
tgaggggtggaaaaatgcag

SEQ ID NO: 327433 - DNA, 20 bp, Artificial
  CRISPR gRNA sequence
tcgcacatcattcgaacctc

SEQ ID NO: 327434 - DNA, 20 bp, Artificial
  CRISPR gRNA sequence
cgcacatcattcgaacctca

SEQ ID NO: 327435 - DNA, 20 bp, Artificial
  CRISPR gRNA sequence
gcacatcattcgaacctcaa

SEQ ID NO: 327436 - DNA, 20 bp, Artificial
  CRISPR gRNA sequence
cattcgaacctcaagggcat

SEQ ID NO: 327437 - DNA, 20 bp, Artificial
  CRISPR gRNA sequence
aagacatgaattttccacaa

SEQ ID NO: 327438 - DNA, 20 bp, Artificial
  CRISPR gRNA sequence
acatgaattttccacaatgg

SEQ ID NO: 327439 - DNA, 20 bp, Artificial
  CRISPR gRNA sequence
aatggaagcttcaaactttc

SEQ ID NO: 327440 - DNA, 20 bp, Artificial
  CRISPR gRNA sequence
atggaagcttcaaactttct

SEQ ID NO: 327441 - DNA, 20 bp, Artificial
  CRISPR gRNA sequence
ttctgggtgctcctcaaact

SEQ ID NO: 327442 - DNA, 20 bp, Artificial
  CRISPR gRNA sequence
tcctcaaacttggcaacttt

SEQ ID NO: 327443 - DNA, 20 bp, Artificial
  CRISPR gRNA sequence
ttcagttttctgactcttaa

SEQ ID NO: 327444 - DNA, 20 bp, Artificial
  CRISPR gRNA sequence
ttttctgactcttaacagaa

SEQ ID NO: 327445 - DNA, 20 bp, Artificial
  CRISPR gRNA sequence
tttctgactcttaacagaaa

SEQ ID NO: 327446 - DNA, 20 bp, Artificial
  CRISPR gRNA sequence
ggtcaaatttccatgttact

SEQ ID NO: 327447 - DNA, 20 bp, Artificial
  CRISPR gRNA sequence
ccatgttactgagacttcta

SEQ ID NO: 327448 - DNA, 20 bp, Artificial
  CRISPR gRNA sequence
tgagacttctaaagccatcc

SEQ ID NO: 327449 - DNA, 20 bp, Artificial
  CRISPR gRNA sequence
actctttacctcaaaataac

SEQ ID NO: 327450 - DNA, 20 bp, Artificial
  CRISPR gRNA sequence
caatttctccttcttccctc

SEQ ID NO: 327451 - DNA, 20 bp, Artificial
  CRISPR gRNA sequence
tttctccttcttccctctag

SEQ ID NO: 327452 - DNA, 20 bp, Artificial
  CRISPR gRNA sequence
cttcttccctctagcagtac

SEQ ID NO: 327453 - DNA, 20 bp, Artificial
  CRISPR gRNA sequence
tccctctagcagtaccagca

SEQ ID NO: 327454 - DNA, 20 bp, Artificial
  CRISPR gRNA sequence
cagatctctcttcctaatct

SEQ ID NO: 327455 - DNA, 20 bp, Artificial
  CRISPR gRNA sequence
tcctaatctcagtccaaaat

SEQ ID NO: 327456 - DNA, 20 bp, Artificial
  CRISPR gRNA sequence
atatatctgtccaaattccc

SEQ ID NO: 327457 - DNA, 20 bp, Artificial
  CRISPR gRNA sequence
atatctgtccaaattcccca

SEQ ID NO: 327458 - DNA, 20 bp, Artificial
  CRISPR gRNA sequence
attccccagagtgcctcact

SEQ ID NO: 327459 - DNA, 20 bp, Artificial
  CRISPR gRNA sequence
acccttcaacaaaaaacact

SEQ ID NO: 327460 - DNA, 20 bp, Artificial
  CRISPR gRNA sequence
cccaacttttgaaacatcaa

SEQ ID NO: 327461 - DNA, 20 bp, Artificial
  CRISPR gRNA sequence
ccaacttttgaaacatcaat

SEQ ID NO: 327462 - DNA, 20 bp, Artificial
  CRISPR gRNA sequence
ggaaaattgccttgatacta

SEQ ID NO: 327463 - DNA, 20 bp, Artificial
  CRISPR gRNA sequence
aaattgccttgatactatgg

SEQ ID NO: 327464 - DNA, 20 bp, Artificial
  CRISPR gRNA sequence
ttgatactatggtggtttat

SEQ ID NO: 327465 - DNA, 20 bp, Artificial
  CRISPR gRNA sequence
ttatgagctgtttgtgtgtt

SEQ ID NO: 327466 - DNA, 20 bp, Artificial
  CRISPR gRNA sequence
gtttgtgtgtttagtttcaa

SEQ ID NO: 327467 - DNA, 20 bp, Artificial
  CRISPR gRNA sequence
tgtgtgtttagtttcaatag

SEQ ID NO: 327468 - DNA, 20 bp, Artificial
  CRISPR gRNA sequence
tgtttgttttcaatatactg

SEQ ID NO: 327469 - DNA, 20 bp, Artificial
  CRISPR gRNA sequence
tactgcagaaaatataaatc

SEQ ID NO: 327470 - DNA, 20 bp, Artificial
  CRISPR gRNA sequence
gaaaatataaatctagttaa

SEQ ID NO: 327471 - DNA, 20 bp, Artificial
  CRISPR gRNA sequence
atataaatctagttaaaagt

SEQ ID NO: 327472 - DNA, 20 bp, Artificial
  CRISPR gRNA sequence
ctagttaaaagtgagaaatc

SEQ ID NO: 327473 - DNA, 20 bp, Artificial
  CRISPR gRNA sequence
gtgagaaatccagattttca

SEQ ID NO: 327474 - DNA, 20 bp, Artificial
  CRISPR gRNA sequence
cagattttcacagaaaattc

SEQ ID NO: 327475 - DNA, 20 bp, Artificial
  CRISPR gRNA sequence
ttcacagaaaattctagaat

SEQ ID NO: 327476 - DNA, 20 bp, Artificial
  CRISPR gRNA sequence
tcacagaaaattctagaatt

SEQ ID NO: 327477 - DNA, 20 bp, Artificial
  CRISPR gRNA sequence
aaaattctagaattaggcct

SEQ ID NO: 327478 - DNA, 20 bp, Artificial
  CRISPR gRNA sequence
aattctagaattaggccttg

SEQ ID NO: 327479 - DNA, 20 bp, Artificial
  CRISPR gRNA sequence
aaaaaaaaaaattaacattc

SEQ ID NO: 327480 - DNA, 20 bp, Artificial
  CRISPR gRNA sequence
aaaaaaaaaattaacattcc

SEQ ID NO: 327481 - DNA, 20 bp, Artificial
  CRISPR gRNA sequence
aacattccaggcttactgtg

SEQ ID NO: 327482 - DNA, 20 bp, Artificial
  CRISPR gRNA sequence
tcccttcccaaacccccaaa

SEQ ID NO: 327483 - DNA, 20 bp, Artificial
  CRISPR gRNA sequence
ccttcccaaacccccaaatg

SEQ ID NO: 327484 - DNA, 20 bp, Artificial
  CRISPR gRNA sequence
ccaaatggagtcatacctgt

SEQ ID NO: 327485 - DNA, 20 bp, Artificial
  CRISPR gRNA sequence
tggagtcatacctgtgagtc

SEQ ID NO: 327486 - DNA, 20 bp, Artificial
  CRISPR gRNA sequence
acctgtgagtctagattttt

SEQ ID NO: 327487 - DNA, 20 bp, Artificial
  CRISPR gRNA sequence
catgaacatgtattcaccgt

SEQ ID NO: 327488 - DNA, 20 bp, Artificial
  CRISPR gRNA sequence
atgaacatgtattcaccgtt

SEQ ID NO: 327489 - DNA, 20 bp, Artificial
  CRISPR gRNA sequence
tgaacatgtattcaccgtta

SEQ ID NO: 327490 - DNA, 20 bp, Artificial
  CRISPR gRNA sequence
accgttagggtcgtgcacac

SEQ ID NO: 327491 - DNA, 20 bp, Artificial
  CRISPR gRNA sequence
cactggatgaatacttctga

SEQ ID NO: 327492 - DNA, 20 bp, Artificial
  CRISPR gRNA sequence
atgaatacttctgaaagaaa

SEQ ID NO: 327493 - DNA, 20 bp, Artificial
  CRISPR gRNA sequence
atacttctgaaagaaaaagc

SEQ ID NO: 327494 - DNA, 20 bp, Artificial
  CRISPR gRNA sequence
gaaaaagccagaaacatgct

SEQ ID NO: 327495 - DNA, 20 bp, Artificial
  CRISPR gRNA sequence
ctgttttctattctttgttg

SEQ ID NO: 327496 - DNA, 20 bp, Artificial
  CRISPR gRNA sequence
ttttctattctttgttgaag

SEQ ID NO: 327497 - DNA, 20 bp, Artificial
  CRISPR gRNA sequence
aaaaacatgataatgtgact

SEQ ID NO: 327498 - DNA, 20 bp, Artificial
  CRISPR gRNA sequence
aaaacatgataatgtgactt

SEQ ID NO: 327499 - DNA, 20 bp, Artificial
  CRISPR gRNA sequence
gataatgtgacttaggttcc

SEQ ID NO: 327500 - DNA, 20 bp, Artificial
  CRISPR gRNA sequence
gtgacttaggttcctggctt

SEQ ID NO: 327501 - DNA, 20 bp, Artificial
  CRISPR gRNA sequence
tgacttaggttcctggcttt

SEQ ID NO: 327502 - DNA, 20 bp, Artificial
  CRISPR gRNA sequence
taggttcctggctttaggct

SEQ ID NO: 327503 - DNA, 20 bp, Artificial
  CRISPR gRNA sequence
gttcctggctttaggctaag

SEQ ID NO: 327504 - DNA, 20 bp, Artificial
  CRISPR gRNA sequence
aagtagaaaaacaatatgaa

SEQ ID NO: 327505 - DNA, 20 bp, Artificial
  CRISPR gRNA sequence
agtagaaaaacaatatgaaa

SEQ ID NO: 327506 - DNA, 20 bp, Artificial
  CRISPR gRNA sequence
gtagaaaaacaatatgaaaa

SEQ ID NO: 327507 - DNA, 20 bp, Artificial
  CRISPR gRNA sequence
tgaaaagggctttacataaa

SEQ ID NO: 327508 - DNA, 20 bp, Artificial
  CRISPR gRNA sequence
aaaagggctttacataaaaa

SEQ ID NO: 327509 - DNA, 20 bp, Artificial
  CRISPR gRNA sequence
tgcctttattgtttctttcc

SEQ ID NO: 327510 - DNA, 20 bp, Artificial
  CRISPR gRNA sequence
ctttattgtttctttcccag

SEQ ID NO: 327511 - DNA, 20 bp, Artificial
  CRISPR gRNA sequence
tgtttctttcccagcagact

SEQ ID NO: 327512 - DNA, 20 bp, Artificial
  CRISPR gRNA sequence
ttcccagcagacttagacca

SEQ ID NO: 327513 - DNA, 20 bp, Artificial
  CRISPR gRNA sequence
tcccagcagacttagaccat

SEQ ID NO: 327514 - DNA, 20 bp, Artificial
  CRISPR gRNA sequence
ttccaaattccactctccca

SEQ ID NO: 327515 - DNA, 20 bp, Artificial
  CRISPR gRNA sequence
actctcccacagatatacac

SEQ ID NO: 327516 - DNA, 20 bp, Artificial
  CRISPR gRNA sequence
actggccaatgaccacactg

SEQ ID NO: 327517 - DNA, 20 bp, Artificial
  CRISPR gRNA sequence
accacactgtggatatactt

SEQ ID NO: 327518 - DNA, 20 bp, Artificial
  CRISPR gRNA sequence
ctgtggatatacttgagtac

SEQ ID NO: 327519 - DNA, 20 bp, Artificial
  CRISPR gRNA sequence
tagcatactcgcgtaatatg

SEQ ID NO: 327520 - DNA, 20 bp, Artificial
  CRISPR gRNA sequence
gcatactcgcgtaatatgca

SEQ ID NO: 327521 - DNA, 20 bp, Artificial
  CRISPR gRNA sequence
tactcgcgtaatatgcagag

SEQ ID NO: 327522 - DNA, 20 bp, Artificial
  CRISPR gRNA sequence
cgtaatatgcagagtggtgt

SEQ ID NO: 327523 - DNA, 20 bp, Artificial
  CRISPR gRNA sequence
gtggtgtcagttctttgatt

SEQ ID NO: 327524 - DNA, 20 bp, Artificial
  CRISPR gRNA sequence
tgattgagaacctgtaatgc

SEQ ID NO: 327525 - DNA, 20 bp, Artificial
  CRISPR gRNA sequence
attgagaacctgtaatgcaa

SEQ ID NO: 327526 - DNA, 20 bp, Artificial
  CRISPR gRNA sequence
ctgtaatgcaagagaccaaa

SEQ ID NO: 327527 - DNA, 20 bp, Artificial
  CRISPR gRNA sequence
agaccaaaaagaatatcccc

SEQ ID NO: 327528 - DNA, 20 bp, Artificial
  CRISPR gRNA sequence
aaaaagaatatcccccagca

SEQ ID NO: 327529 - DNA, 20 bp, Artificial
  CRISPR gRNA sequence
aaaagaatatcccccagcac

SEQ ID NO: 327530 - DNA, 20 bp, Artificial
  CRISPR gRNA sequence
aaagaatatcccccagcaca

SEQ ID NO: 327531 - DNA, 20 bp, Artificial
  CRISPR gRNA sequence
agaatatcccccagcacagg

SEQ ID NO: 327532 - DNA, 20 bp, Artificial
  CRISPR gRNA sequence
ttgttgtttatctttctaaa

SEQ ID NO: 327533 - DNA, 20 bp, Artificial
  CRISPR gRNA sequence
tatctttctaaatagctcct

SEQ ID NO: 327534 - DNA, 20 bp, Artificial
  CRISPR gRNA sequence
ctttctaaatagctcctcag

SEQ ID NO: 327535 - DNA, 20 bp, Artificial
  CRISPR gRNA sequence
tcctcagtggttttctttaa

SEQ ID NO: 327536 - DNA, 20 bp, Artificial
  CRISPR gRNA sequence
cagtggttttctttaaaagc

SEQ ID NO: 327537 - DNA, 20 bp, Artificial
  CRISPR gRNA sequence
agtggttttctttaaaagca

SEQ ID NO: 327538 - DNA, 20 bp, Artificial
  CRISPR gRNA sequence
tggttttctttaaaagcaag

SEQ ID NO: 327539 - DNA, 20 bp, Artificial
  CRISPR gRNA sequence
taataacctaccatgtaaaa

SEQ ID NO: 327540 - DNA, 20 bp, Artificial
  CRISPR gRNA sequence
aaagttgtcaatttccttct

SEQ ID NO: 327541 - DNA, 20 bp, Artificial
  CRISPR gRNA sequence
ctcagctacaattgacacct

SEQ ID NO: 327542 - DNA, 20 bp, Artificial
  CRISPR gRNA sequence
agctacaattgacaccttag

SEQ ID NO: 327543 - DNA, 20 bp, Artificial
  CRISPR gRNA sequence
gctacaattgacaccttaga

SEQ ID NO: 327544 - DNA, 20 bp, Artificial
  CRISPR gRNA sequence
gctgactgtttttaacttac

SEQ ID NO: 327545 - DNA, 20 bp, Artificial
  CRISPR gRNA sequence
ctgtttttaacttaccagct

SEQ ID NO: 327546 - DNA, 20 bp, Artificial
  CRISPR gRNA sequence
ttcatctctgccctgcctct

SEQ ID NO: 327547 - DNA, 20 bp, Artificial
  CRISPR gRNA sequence
tcatctctgccctgcctctc

SEQ ID NO: 327548 - DNA, 20 bp, Artificial
  CRISPR gRNA sequence
gccctgcctctcaggaacct

SEQ ID NO: 327549 - DNA, 20 bp, Artificial
  CRISPR gRNA sequence
gaaccttggattcaaattcg

SEQ ID NO: 327550 - DNA, 20 bp, Artificial
  CRISPR gRNA sequence
cataataattttttaaaaat

SEQ ID NO: 327551 - DNA, 20 bp, Artificial
  CRISPR gRNA sequence
taataattttttaaaaatca

SEQ ID NO: 327552 - DNA, 20 bp, Artificial
  CRISPR gRNA sequence
ttaaccttcctcctgacctt

SEQ ID NO: 327553 - DNA, 20 bp, Artificial
  CRISPR gRNA sequence
ttgacctcaatttcctcatc

SEQ ID NO: 327554 - DNA, 20 bp, Artificial
  CRISPR gRNA sequence
ataataatgtaactctctgt

SEQ ID NO: 327555 - DNA, 20 bp, Artificial
  CRISPR gRNA sequence
gtaactctctgtaagccatc

SEQ ID NO: 327556 - DNA, 20 bp, Artificial
  CRISPR gRNA sequence
tctctgtaagccatcaagtc

SEQ ID NO: 327557 - DNA, 20 bp, Artificial
  CRISPR gRNA sequence
ccatcaagtcaagtcctctt

SEQ ID NO: 327558 - DNA, 20 bp, Artificial
  CRISPR gRNA sequence
caagtcctctttggaatgtg

SEQ ID NO: 327559 - DNA, 20 bp, Artificial
  CRISPR gRNA sequence
aagtcctctttggaatgtgt

SEQ ID NO: 327560 - DNA, 20 bp, Artificial
  CRISPR gRNA sequence
aatacataaatttctgttcc

SEQ ID NO: 327561 - DNA, 20 bp, Artificial
  CRISPR gRNA sequence
aaatttctgttccaagtgat

SEQ ID NO: 327562 - DNA, 20 bp, Artificial
  CRISPR gRNA sequence
ttccaagtgattagtttaat

SEQ ID NO: 327563 - DNA, 20 bp, Artificial
  CRISPR gRNA sequence
caagtgattagtttaattag

SEQ ID NO: 327564 - DNA, 20 bp, Artificial
  CRISPR gRNA sequence
aagtgattagtttaattagt

SEQ ID NO: 327565 - DNA, 20 bp, Artificial
  CRISPR gRNA sequence
tttaattagtaggtatgtct

SEQ ID NO: 327566 - DNA, 20 bp, Artificial
  CRISPR gRNA sequence
ttaattagtaggtatgtctt

SEQ ID NO: 327567 - DNA, 20 bp, Artificial
  CRISPR gRNA sequence
taattagtaggtatgtcttg

SEQ ID NO: 327568 - DNA, 20 bp, Artificial
  CRISPR gRNA sequence
aattagtaggtatgtcttgg

SEQ ID NO: 327569 - DNA, 20 bp, Artificial
  CRISPR gRNA sequence
attagtaggtatgtcttggg

SEQ ID NO: 327570 - DNA, 20 bp, Artificial
  CRISPR gRNA sequence
agtaggtatgtcttgggggg

SEQ ID NO: 327571 - DNA, 20 bp, Artificial
  CRISPR gRNA sequence
gtaggtatgtcttgggggga

SEQ ID NO: 327572 - DNA, 20 bp, Artificial
  CRISPR gRNA sequence
ggaaggaattgtctccctgt

SEQ ID NO: 327573 - DNA, 20 bp, Artificial
  CRISPR gRNA sequence
gttggtcaaattactctgac

SEQ ID NO: 327574 - DNA, 20 bp, Artificial
  CRISPR gRNA sequence
tggtcaaattactctgacaa

SEQ ID NO: 327575 - DNA, 20 bp, Artificial
  CRISPR gRNA sequence
gagccatgtgtacttttgat

SEQ ID NO: 327576 - DNA, 20 bp, Artificial
  CRISPR gRNA sequence
agccatgtgtacttttgatg

SEQ ID NO: 327577 - DNA, 20 bp, Artificial
  CRISPR gRNA sequence
atcactgatgtgcatctgta

SEQ ID NO: 327578 - DNA, 20 bp, Artificial
  CRISPR gRNA sequence
actgatgtgcatctgtaaag

SEQ ID NO: 327579 - DNA, 20 bp, Artificial
  CRISPR gRNA sequence
tgcatctgtaaagcagatac

SEQ ID NO: 327580 - DNA, 20 bp, Artificial
  CRISPR gRNA sequence
gcatctgtaaagcagataca

SEQ ID NO: 327581 - DNA, 20 bp, Artificial
  CRISPR gRNA sequence
ctgtaaagcagatacaagga

SEQ ID NO: 327582 - DNA, 20 bp, Artificial
  CRISPR gRNA sequence
aaagcagatacaaggaaaga

SEQ ID NO: 327583 - DNA, 20 bp, Artificial
  CRISPR gRNA sequence
aaatcgcttaccttttttgt

SEQ ID NO: 327584 - DNA, 20 bp, Artificial
  CRISPR gRNA sequence
ttttttgtaagccaacaaat

SEQ ID NO: 327585 - DNA, 20 bp, Artificial
  CRISPR gRNA sequence
taagtatgcatcccaaaatg

SEQ ID NO: 327586 - DNA, 20 bp, Artificial
  CRISPR gRNA sequence
ccaaaatgcagactacaaca

SEQ ID NO: 327587 - DNA, 20 bp, Artificial
  CRISPR gRNA sequence
caaaatgcagactacaacaa

SEQ ID NO: 327588 - DNA, 20 bp, Artificial
  CRISPR gRNA sequence
aacaaaggctgcacatccta

SEQ ID NO: 327589 - DNA, 20 bp, Artificial
  CRISPR gRNA sequence
acaaaggctgcacatcctat

SEQ ID NO: 327590 - DNA, 20 bp, Artificial
  CRISPR gRNA sequence
ctgcacatcctatgggtaac

SEQ ID NO: 327591 - DNA, 20 bp, Artificial
  CRISPR gRNA sequence
cctatgggtaaccagaactt

SEQ ID NO: 327592 - DNA, 20 bp, Artificial
  CRISPR gRNA sequence
tgggtaaccagaacttcagc

SEQ ID NO: 327593 - DNA, 20 bp, Artificial
  CRISPR gRNA sequence
cagaacttcagctggcaaca

SEQ ID NO: 327594 - DNA, 20 bp, Artificial
  CRISPR gRNA sequence
tggcaacaaagttgtgattc

SEQ ID NO: 327595 - DNA, 20 bp, Artificial
  CRISPR gRNA sequence
acaaagttgtgattctggat

SEQ ID NO: 327596 - DNA, 20 bp, Artificial
  CRISPR gRNA sequence
gtgattctggattggaaaaa

SEQ ID NO: 327597 - DNA, 20 bp, Artificial
  CRISPR gRNA sequence
tgattctggattggaaaaaa

SEQ ID NO: 327598 - DNA, 20 bp, Artificial
  CRISPR gRNA sequence
gaaaaattctgctgaaccac

SEQ ID NO: 327599 - DNA, 20 bp, Artificial
  CRISPR gRNA sequence
agttctcttaccaaatttaa

SEQ ID NO: 327600 - DNA, 20 bp, Artificial
  CRISPR gRNA sequence
ttctcttaccaaatttaaaa

SEQ ID NO: 327601 - DNA, 20 bp, Artificial
  CRISPR gRNA sequence
aagagctatttaatcaaatg

SEQ ID NO: 327602 - DNA, 20 bp, Artificial
  CRISPR gRNA sequence
aatgaagcttttctttatta

SEQ ID NO: 327603 - DNA, 20 bp, Artificial
  CRISPR gRNA sequence
tttattatagtcatgaaatc

SEQ ID NO: 327604 - DNA, 20 bp, Artificial
  CRISPR gRNA sequence
ttatagtcatgaaatccagt

SEQ ID NO: 327605 - DNA, 20 bp, Artificial
  CRISPR gRNA sequence
tagtcatgaaatccagtaag

SEQ ID NO: 327606 - DNA, 20 bp, Artificial
  CRISPR gRNA sequence
agtcatgaaatccagtaagt

SEQ ID NO: 327607 - DNA, 20 bp, Artificial
  CRISPR gRNA sequence
atgaaatccagtaagtgggc

SEQ ID NO: 327608 - DNA, 20 bp, Artificial
  CRISPR gRNA sequence
ccagtaagtgggcaagttat

SEQ ID NO: 327609 - DNA, 20 bp, Artificial
  CRISPR gRNA sequence
ttattagactaacatcatct

SEQ ID NO: 327610 - DNA, 20 bp, Artificial
  CRISPR gRNA sequence
ctaacatcatctcagtatta

SEQ ID NO: 327611 - DNA, 20 bp, Artificial
  CRISPR gRNA sequence
catcatctcagtattatggc

SEQ ID NO: 327612 - DNA, 20 bp, Artificial
  CRISPR gRNA sequence
atcatctcagtattatggca

SEQ ID NO: 327613 - DNA, 20 bp, Artificial
  CRISPR gRNA sequence
tcagtattatggcaaggatc

SEQ ID NO: 327614 - DNA, 20 bp, Artificial
  CRISPR gRNA sequence
cagtattatggcaaggatcc

SEQ ID NO: 327615 - DNA, 20 bp, Artificial
  CRISPR gRNA sequence
atccaggaactaaaacttaa

SEQ ID NO: 327616 - DNA, 20 bp, Artificial
  CRISPR gRNA sequence
atataatgtatttacaaatg

SEQ ID NO: 327617 - DNA, 20 bp, Artificial
  CRISPR gRNA sequence
gtatttacaaatgtggttaa

SEQ ID NO: 327618 - DNA, 20 bp, Artificial
  CRISPR gRNA sequence
ttacaaatgtggttaataga

SEQ ID NO: 327619 - DNA, 20 bp, Artificial
  CRISPR gRNA sequence
tacaaatgtggttaatagaa

SEQ ID NO: 327620 - DNA, 20 bp, Artificial
  CRISPR gRNA sequence
acaaatgtggttaatagaaa

SEQ ID NO: 327621 - DNA, 20 bp, Artificial
  CRISPR gRNA sequence
ttctgcctatatttttataa

SEQ ID NO: 327622 - DNA, 20 bp, Artificial
  CRISPR gRNA sequence
ctgcctatatttttataaaa

SEQ ID NO: 327623 - DNA, 20 bp, Artificial
  CRISPR gRNA sequence
tgcctatatttttataaaag

SEQ ID NO: 327624 - DNA, 20 bp, Artificial
  CRISPR gRNA sequence
tatttttataaaagaggtaa

SEQ ID NO: 327625 - DNA, 20 bp, Artificial
  CRISPR gRNA sequence
tataaaagaggtaatagtaa

SEQ ID NO: 327626 - DNA, 20 bp, Artificial
  CRISPR gRNA sequence
catacttcattccacaaaca

SEQ ID NO: 327627 - DNA, 20 bp, Artificial
  CRISPR gRNA sequence
caaaaccaaaccttaaatct

SEQ ID NO: 327628 - DNA, 20 bp, Artificial
  CRISPR gRNA sequence
aaaaccaaaccttaaatctt

SEQ ID NO: 327629 - DNA, 20 bp, Artificial
  CRISPR gRNA sequence
aaccttaaatcttaggtgaa

SEQ ID NO: 327630 - DNA, 20 bp, Artificial
  CRISPR gRNA sequence
ccttaaatcttaggtgaata

SEQ ID NO: 327631 - DNA, 20 bp, Artificial
  CRISPR gRNA sequence
tagagataatacccattatt

SEQ ID NO: 327632 - DNA, 20 bp, Artificial
  CRISPR gRNA sequence
aatacccattattaagccat

SEQ ID NO: 327633 - DNA, 20 bp, Artificial
  CRISPR gRNA sequence
cattattaagccataagttt

SEQ ID NO: 327634 - DNA, 20 bp, Artificial
  CRISPR gRNA sequence
atgtttttcctgatttttaa

SEQ ID NO: 327635 - DNA, 20 bp, Artificial
  CRISPR gRNA sequence
ttaatagcatatgtgtttaa

SEQ ID NO: 327636 - DNA, 20 bp, Artificial
  CRISPR gRNA sequence
taatagcatatgtgtttaaa

SEQ ID NO: 327637 - DNA, 20 bp, Artificial
  CRISPR gRNA sequence
aatatgatctatttctgact

SEQ ID NO: 327638 - DNA, 20 bp, Artificial
  CRISPR gRNA sequence
atgatctatttctgacttag

SEQ ID NO: 327639 - DNA, 20 bp, Artificial
  CRISPR gRNA sequence
atttctgacttagcagtcta

SEQ ID NO: 327640 - DNA, 20 bp, Artificial
  CRISPR gRNA sequence
tttctgacttagcagtctat

SEQ ID NO: 327641 - DNA, 20 bp, Artificial
  CRISPR gRNA sequence
ataatactaattatgattaa

SEQ ID NO: 327642 - DNA, 20 bp, Artificial
  CRISPR gRNA sequence
gattaccatcaactgcatct

SEQ ID NO: 327643 - DNA, 20 bp, Artificial
  CRISPR gRNA sequence
ctaagtgaactccaacacaa

SEQ ID NO: 327644 - DNA, 20 bp, Artificial
  CRISPR gRNA sequence
atttgtctaattgattttat

SEQ ID NO: 327645 - DNA, 20 bp, Artificial
  CRISPR gRNA sequence
gtctaattgattttattagt

SEQ ID NO: 327646 - DNA, 20 bp, Artificial
  CRISPR gRNA sequence
attgattttattagtgagaa

SEQ ID NO: 327647 - DNA, 20 bp, Artificial
  CRISPR gRNA sequence
caaaacatatatatactctt

SEQ ID NO: 327648 - DNA, 20 bp, Artificial
  CRISPR gRNA sequence
catatatatactcttaagtt

SEQ ID NO: 327649 - DNA, 20 bp, Artificial
  CRISPR gRNA sequence
atatatactcttaagtttgg

SEQ ID NO: 327650 - DNA, 20 bp, Artificial
  CRISPR gRNA sequence
ctcttaagtttggaagatga

SEQ ID NO: 327651 - DNA, 20 bp, Artificial
  CRISPR gRNA sequence
atatgcaaatatcctcctgt

SEQ ID NO: 327652 - DNA, 20 bp, Artificial
  CRISPR gRNA sequence
atgcaaatatcctcctgtaa

SEQ ID NO: 327653 - DNA, 20 bp, Artificial
  CRISPR gRNA sequence
tcctgtaagagttactttaa

SEQ ID NO: 327654 - DNA, 20 bp, Artificial
  CRISPR gRNA sequence
cctgtaagagttactttaaa

SEQ ID NO: 327655 - DNA, 20 bp, Artificial
  CRISPR gRNA sequence
tgtaagagttactttaaaag

SEQ ID NO: 327656 - DNA, 20 bp, Artificial
  CRISPR gRNA sequence
gtaagagttactttaaaagg

SEQ ID NO: 327657 - DNA, 20 bp, Artificial
  CRISPR gRNA sequence
aagagttactttaaaaggag

SEQ ID NO: 327658 - DNA, 20 bp, Artificial
  CRISPR gRNA sequence
agagttactttaaaaggagg

SEQ ID NO: 327659 - DNA, 20 bp, Artificial
  CRISPR gRNA sequence
ggaggaggatcaaaaattga

SEQ ID NO: 327660 - DNA, 20 bp, Artificial
  CRISPR gRNA sequence
gaggaggatcaaaaattgat

SEQ ID NO: 327661 - DNA, 20 bp, Artificial
  CRISPR gRNA sequence
gatcaaaaattgataggttg

SEQ ID NO: 327662 - DNA, 20 bp, Artificial
  CRISPR gRNA sequence
caaaaattgataggttgcag

SEQ ID NO: 327663 - DNA, 20 bp, Artificial
  CRISPR gRNA sequence
ttgataggttgcagaagtaa

SEQ ID NO: 327664 - DNA, 20 bp, Artificial
  CRISPR gRNA sequence
taggttgcagaagtaatagt

SEQ ID NO: 327665 - DNA, 20 bp, Artificial
  CRISPR gRNA sequence
gcagaagtaatagttggcat

SEQ ID NO: 327666 - DNA, 20 bp, Artificial
  CRISPR gRNA sequence
agtaatagttggcatgagaa

SEQ ID NO: 327667 - DNA, 20 bp, Artificial
  CRISPR gRNA sequence
agttggcatgagaatggtcc

SEQ ID NO: 327668 - DNA, 20 bp, Artificial
  CRISPR gRNA sequence
tgagaatggtccaagttgta

SEQ ID NO: 327669 - DNA, 20 bp, Artificial
  CRISPR gRNA sequence
gtccaagttgtatagaaaaa

SEQ ID NO: 327670 - DNA, 20 bp, Artificial
  CRISPR gRNA sequence
ccaagttgtatagaaaaaaa

SEQ ID NO: 327671 - DNA, 20 bp, Artificial
  CRISPR gRNA sequence
aaaaaaagagacactgttgt

SEQ ID NO: 327672 - DNA, 20 bp, Artificial
  CRISPR gRNA sequence
gacactgttgttggataact

SEQ ID NO: 327673 - DNA, 20 bp, Artificial
  CRISPR gRNA sequence
tgttgttggataactgagaa

SEQ ID NO: 327674 - DNA, 20 bp, Artificial
  CRISPR gRNA sequence
tgttggataactgagaatgg

SEQ ID NO: 327675 - DNA, 20 bp, Artificial
  CRISPR gRNA sequence
aactgagaatggcagaattt

SEQ ID NO: 327676 - DNA, 20 bp, Artificial
  CRISPR gRNA sequence
gcagaatttcagactcttaa

SEQ ID NO: 327677 - DNA, 20 bp, Artificial
  CRISPR gRNA sequence
gtttccacttccttttgtct

SEQ ID NO: 327678 - DNA, 20 bp, Artificial
  CRISPR gRNA sequence
ccacttccttttgtcttagt

SEQ ID NO: 327679 - DNA, 20 bp, Artificial
  CRISPR gRNA sequence
cttttgtcttagtgagatcg

SEQ ID NO: 327680 - DNA, 20 bp, Artificial
  CRISPR gRNA sequence
tttgtcttagtgagatcgca

SEQ ID NO: 327681 - DNA, 20 bp, Artificial
  CRISPR gRNA sequence
cagagtatttgccccccttt

SEQ ID NO: 327682 - DNA, 20 bp, Artificial
  CRISPR gRNA sequence
gcaactgcattttaaattgc

SEQ ID NO: 327683 - DNA, 20 bp, Artificial
  CRISPR gRNA sequence
tttaaattgctggacaatgt

SEQ ID NO: 327684 - DNA, 20 bp, Artificial
  CRISPR gRNA sequence
ttaaattgctggacaatgtc

SEQ ID NO: 327685 - DNA, 20 bp, Artificial
  CRISPR gRNA sequence
aaatataaacatctcataat

SEQ ID NO: 327686 - DNA, 20 bp, Artificial
  CRISPR gRNA sequence
tataaacatctcataattgg

SEQ ID NO: 327687 - DNA, 20 bp, Artificial
  CRISPR gRNA sequence
attgatttctcctgcataaa

SEQ ID NO: 327688 - DNA, 20 bp, Artificial
  CRISPR gRNA sequence
atttctcctgcataaaaaga

SEQ ID NO: 327689 - DNA, 20 bp, Artificial
  CRISPR gRNA sequence
gcataaaaagaaagaaaaca

SEQ ID NO: 327690 - DNA, 20 bp, Artificial
  CRISPR gRNA sequence
aaagaaagaaaacaaagcaa

SEQ ID NO: 327691 - DNA, 20 bp, Artificial
  CRISPR gRNA sequence
ataattatattttaacataa

SEQ ID NO: 327692 - DNA, 20 bp, Artificial
  CRISPR gRNA sequence
agcaatttattcaatgcata

SEQ ID NO: 327693 - DNA, 20 bp, Artificial
  CRISPR gRNA sequence
tctgttgcaccaaaatgaaa

SEQ ID NO: 327694 - DNA, 20 bp, Artificial
  CRISPR gRNA sequence
acattctccctccacccctc

SEQ ID NO: 327695 - DNA, 20 bp, Artificial
  CRISPR gRNA sequence
cattctccctccacccctca

SEQ ID NO: 327696 - DNA, 20 bp, Artificial
  CRISPR gRNA sequence
tctccctccacccctcaagg

SEQ ID NO: 327697 - DNA, 20 bp, Artificial
  CRISPR gRNA sequence
cacccctcaaggaagaacat

SEQ ID NO: 327698 - DNA, 20 bp, Artificial
  CRISPR gRNA sequence
cataagataaaactatgtcc

SEQ ID NO: 327699 - DNA, 20 bp, Artificial
  CRISPR gRNA sequence
taagataaaactatgtccta

SEQ ID NO: 327700 - DNA, 20 bp, Artificial
  CRISPR gRNA sequence
agagaaaaaaaaatcctaac

SEQ ID NO: 327701 - DNA, 20 bp, Artificial
  CRISPR gRNA sequence
ttgcttgtcatatgtgaata

SEQ ID NO: 327702 - DNA, 20 bp, Artificial
  CRISPR gRNA sequence
tattaaataatatatttaca

SEQ ID NO: 327703 - DNA, 20 bp, Artificial
  CRISPR gRNA sequence
atagtgtgtatgaatcaaac

SEQ ID NO: 327704 - DNA, 20 bp, Artificial
  CRISPR gRNA sequence
gtgtatgaatcaaactggta

SEQ ID NO: 327705 - DNA, 20 bp, Artificial
  CRISPR gRNA sequence
ctggtatggcctctgtcctt

SEQ ID NO: 327706 - DNA, 20 bp, Artificial
  CRISPR gRNA sequence
gtatggcctctgtcctttgg

SEQ ID NO: 327707 - DNA, 20 bp, Artificial
  CRISPR gRNA sequence
tcctttggtagctttcatat

SEQ ID NO: 327708 - DNA, 20 bp, Artificial
  CRISPR gRNA sequence
ctttggtagctttcatattg

SEQ ID NO: 327709 - DNA, 20 bp, Artificial
  CRISPR gRNA sequence
tttggtagctttcatattgg

SEQ ID NO: 327710 - DNA, 20 bp, Artificial
  CRISPR gRNA sequence
ggtagctttcatattggagg

SEQ ID NO: 327711 - DNA, 20 bp, Artificial
  CRISPR gRNA sequence
gctttcatattggaggcaga

SEQ ID NO: 327712 - DNA, 20 bp, Artificial
  CRISPR gRNA sequence
catattggaggcagatggta

SEQ ID NO: 327713 - DNA, 20 bp, Artificial
  CRISPR gRNA sequence
atattggaggcagatggtaa

SEQ ID NO: 327714 - DNA, 20 bp, Artificial
  CRISPR gRNA sequence
atggtaaaggaataaatatg

SEQ ID NO: 327715 - DNA, 20 bp, Artificial
  CRISPR gRNA sequence
taatgcaacataatttgtga

SEQ ID NO: 327716 - DNA, 20 bp, Artificial
  CRISPR gRNA sequence
aatgcaacataatttgtgat

SEQ ID NO: 327717 - DNA, 20 bp, Artificial
  CRISPR gRNA sequence
aacataatttgtgataggaa

SEQ ID NO: 327718 - DNA, 20 bp, Artificial
  CRISPR gRNA sequence
cataatttgtgataggaatg

SEQ ID NO: 327719 - DNA, 20 bp, Artificial
  CRISPR gRNA sequence
aatggagtactatttaaatg

SEQ ID NO: 327720 - DNA, 20 bp, Artificial
  CRISPR gRNA sequence
atggagtactatttaaatga

SEQ ID NO: 327721 - DNA, 20 bp, Artificial
  CRISPR gRNA sequence
gagtactatttaaatgaagg

SEQ ID NO: 327722 - DNA, 20 bp, Artificial
  CRISPR gRNA sequence
tactatttaaatgaaggtgg

SEQ ID NO: 327723 - DNA, 20 bp, Artificial
  CRISPR gRNA sequence
ctatttaaatgaaggtggta

SEQ ID NO: 327724 - DNA, 20 bp, Artificial
  CRISPR gRNA sequence
ttaaatgaaggtggtagagt

SEQ ID NO: 327725 - DNA, 20 bp, Artificial
  CRISPR gRNA sequence
taaatgaaggtggtagagtc

SEQ ID NO: 327726 - DNA, 20 bp, Artificial
  CRISPR gRNA sequence
atgaaggtggtagagtcagg

SEQ ID NO: 327727 - DNA, 20 bp, Artificial
  CRISPR gRNA sequence
tgaaggtggtagagtcaggt

SEQ ID NO: 327728 - DNA, 20 bp, Artificial
  CRISPR gRNA sequence
gtgggttataattttgatta

SEQ ID NO: 327729 - DNA, 20 bp, Artificial
  CRISPR gRNA sequence
tataattttgattatagaat

SEQ ID NO: 327730 - DNA, 20 bp, Artificial
  CRISPR gRNA sequence
gaatcagaaaatgccgcctt

SEQ ID NO: 327731 - DNA, 20 bp, Artificial
  CRISPR gRNA sequence
aatcagaaaatgccgccttg

SEQ ID NO: 327732 - DNA, 20 bp, Artificial
  CRISPR gRNA sequence
cagaaaatgccgccttgagg

SEQ ID NO: 327733 - DNA, 20 bp, Artificial
  CRISPR gRNA sequence
aaatgccgccttgaggaagt

SEQ ID NO: 327734 - DNA, 20 bp, Artificial
  CRISPR gRNA sequence
gaggaagtgagttttaaaat

SEQ ID NO: 327735 - DNA, 20 bp, Artificial
  CRISPR gRNA sequence
gagttttaaaattggaatta

SEQ ID NO: 327736 - DNA, 20 bp, Artificial
  CRISPR gRNA sequence
agttttaaaattggaattaa

SEQ ID NO: 327737 - DNA, 20 bp, Artificial
  CRISPR gRNA sequence
taaaattggaattaaaggat

SEQ ID NO: 327738 - DNA, 20 bp, Artificial
  CRISPR gRNA sequence
aattggaattaaaggattag

SEQ ID NO: 327739 - DNA, 20 bp, Artificial
  CRISPR gRNA sequence
attaaaggattagtagcact

SEQ ID NO: 327740 - DNA, 20 bp, Artificial
  CRISPR gRNA sequence
attagtagcacttagctaaa

SEQ ID NO: 327741 - DNA, 20 bp, Artificial
  CRISPR gRNA sequence
tagtagcacttagctaaaca

SEQ ID NO: 327742 - DNA, 20 bp, Artificial
  CRISPR gRNA sequence
gtagcacttagctaaacaga

SEQ ID NO: 327743 - DNA, 20 bp, Artificial
  CRISPR gRNA sequence
cttagctaaacagagagata

SEQ ID NO: 327744 - DNA, 20 bp, Artificial
  CRISPR gRNA sequence
ttagctaaacagagagatat

SEQ ID NO: 327745 - DNA, 20 bp, Artificial
  CRISPR gRNA sequence
taaacagagagatatgggaa

SEQ ID NO: 327746 - DNA, 20 bp, Artificial
  CRISPR gRNA sequence
gagagatatgggaaaagttg

SEQ ID NO: 327747 - DNA, 20 bp, Artificial
  CRISPR gRNA sequence
atatgggaaaagttgaagtt

SEQ ID NO: 327748 - DNA, 20 bp, Artificial
  CRISPR gRNA sequence
tatgggaaaagttgaagttt

SEQ ID NO: 327749 - DNA, 20 bp, Artificial
  CRISPR gRNA sequence
ttaggaaaaacttcatttat

SEQ ID NO: 327750 - DNA, 20 bp, Artificial
  CRISPR gRNA sequence
ggaaaaacttcatttattag

SEQ ID NO: 327751 - DNA, 20 bp, Artificial
  CRISPR gRNA sequence
gaaaaacttcatttattagt

SEQ ID NO: 327752 - DNA, 20 bp, Artificial
  CRISPR gRNA sequence
atttattagtaggtatatct

SEQ ID NO: 327753 - DNA, 20 bp, Artificial
  CRISPR gRNA sequence
tttattagtaggtatatctt

SEQ ID NO: 327754 - DNA, 20 bp, Artificial
  CRISPR gRNA sequence
ttattagtaggtatatcttg

SEQ ID NO: 327755 - DNA, 20 bp, Artificial
  CRISPR gRNA sequence
attagtaggtatatcttggg

SEQ ID NO: 327756 - DNA, 20 bp, Artificial
  CRISPR gRNA sequence
agtaggtatatcttggggag

SEQ ID NO: 327757 - DNA, 20 bp, Artificial
  CRISPR gRNA sequence
gtaggtatatcttggggaga

SEQ ID NO: 327758 - DNA, 20 bp, Artificial
  CRISPR gRNA sequence
gttgatcaaactactctgac

SEQ ID NO: 327759 - DNA, 20 bp, Artificial
  CRISPR gRNA sequence
gaaccatgtgtacttctgat

SEQ ID NO: 327760 - DNA, 20 bp, Artificial
  CRISPR gRNA sequence
aaataatcactgatgtacat

SEQ ID NO: 327761 - DNA, 20 bp, Artificial
  CRISPR gRNA sequence
atcactgatgtacatcagta

SEQ ID NO: 327762 - DNA, 20 bp, Artificial
  CRISPR gRNA sequence
actgatgtacatcagtaaag

SEQ ID NO: 327763 - DNA, 20 bp, Artificial
  CRISPR gRNA sequence
tacatcagtaaagcagataa

SEQ ID NO: 327764 - DNA, 20 bp, Artificial
  CRISPR gRNA sequence
acatcagtaaagcagataaa

SEQ ID NO: 327765 - DNA, 20 bp, Artificial
  CRISPR gRNA sequence
cagtaaagcagataaaagga

SEQ ID NO: 327766 - DNA, 20 bp, Artificial
  CRISPR gRNA sequence
aaagcagataaaaggaaaga

SEQ ID NO: 327767 - DNA, 20 bp, Artificial
  CRISPR gRNA sequence
agaaattgctcactttgtaa

SEQ ID NO: 327768 - DNA, 20 bp, Artificial
  CRISPR gRNA sequence
gctcactttgtaaaagtacg

SEQ ID NO: 327769 - DNA, 20 bp, Artificial
  CRISPR gRNA sequence
cactttgtaaaagtacgaag

SEQ ID NO: 327770 - DNA, 20 bp, Artificial
  CRISPR gRNA sequence
tatatgtatattacaatata

SEQ ID NO: 327771 - DNA, 20 bp, Artificial
  CRISPR gRNA sequence
tatgtatattacaatatata

SEQ ID NO: 327772 - DNA, 20 bp, Artificial
  CRISPR gRNA sequence
tacattatgtcctcctgcta

SEQ ID NO: 327773 - DNA, 20 bp, Artificial
  CRISPR gRNA sequence
cattatgtcctcctgctaaa

SEQ ID NO: 327774 - DNA, 20 bp, Artificial
  CRISPR gRNA sequence
gtcctcctgctaaagagtaa

SEQ ID NO: 327775 - DNA, 20 bp, Artificial
  CRISPR gRNA sequence
cctgctaaagagtaaaagaa

SEQ ID NO: 327776 - DNA, 20 bp, Artificial
  CRISPR gRNA sequence
gactaatcattttcaaatga

SEQ ID NO: 327777 - DNA, 20 bp, Artificial
  CRISPR gRNA sequence
ttctccaaacctcatccact

SEQ ID NO: 327778 - DNA, 20 bp, Artificial
  CRISPR gRNA sequence
catccactgagaactgaatc

SEQ ID NO: 327779 - DNA, 20 bp, Artificial
  CRISPR gRNA sequence
atccactgagaactgaatca

SEQ ID NO: 327780 - DNA, 20 bp, Artificial
  CRISPR gRNA sequence
tgaatcaaggcctgataata

SEQ ID NO: 327781 - DNA, 20 bp, Artificial
  CRISPR gRNA sequence
aaggcctgataataaagata

SEQ ID NO: 327782 - DNA, 20 bp, Artificial
  CRISPR gRNA sequence
tgataataaagataaagccc

SEQ ID NO: 327783 - DNA, 20 bp, Artificial
  CRISPR gRNA sequence
cttttcttttcttttctttt

SEQ ID NO: 327784 - DNA, 20 bp, Artificial
  CRISPR gRNA sequence
tttcttttcttttcttttca

SEQ ID NO: 327785 - DNA, 20 bp, Artificial
  CRISPR gRNA sequence
tttcttttcttttcagagaa

SEQ ID NO: 327786 - DNA, 20 bp, Artificial
  CRISPR gRNA sequence
ttcttttcttttcagagaaa

SEQ ID NO: 327787 - DNA, 20 bp, Artificial
  CRISPR gRNA sequence
tcttttcttttcagagaaaa

SEQ ID NO: 327788 - DNA, 20 bp, Artificial
  CRISPR gRNA sequence
aaagggtttactctgttccc

SEQ ID NO: 327789 - DNA, 20 bp, Artificial
  CRISPR gRNA sequence
aagggtttactctgttcccc

SEQ ID NO: 327790 - DNA, 20 bp, Artificial
  CRISPR gRNA sequence
ttactctgttccccaggcta

SEQ ID NO: 327791 - DNA, 20 bp, Artificial
  CRISPR gRNA sequence
ctgttccccaggctacagtg

SEQ ID NO: 327792 - DNA, 20 bp, Artificial
  CRISPR gRNA sequence
ttccccaggctacagtgcag

SEQ ID NO: 327793 - DNA, 20 bp, Artificial
  CRISPR gRNA sequence
acagtgcagtggcatgatcc

SEQ ID NO: 327794 - DNA, 20 bp, Artificial
  CRISPR gRNA sequence
ggcatgatcctagctcgttg

SEQ ID NO: 327795 - DNA, 20 bp, Artificial
  CRISPR gRNA sequence
agcctccacttccttgactc

SEQ ID NO: 327796 - DNA, 20 bp, Artificial
  CRISPR gRNA sequence
gcctccacttccttgactca

SEQ ID NO: 327797 - DNA, 20 bp, Artificial
  CRISPR gRNA sequence
cctccacttccttgactcaa

SEQ ID NO: 327798 - DNA, 20 bp, Artificial
  CRISPR gRNA sequence
ctcaagggtccctcctgcct

SEQ ID NO: 327799 - DNA, 20 bp, Artificial
  CRISPR gRNA sequence
ccctcctgcctcagcctccc

SEQ ID NO: 327800 - DNA, 20 bp, Artificial
  CRISPR gRNA sequence
tcctgcctcagcctcccaag

SEQ ID NO: 327801 - DNA, 20 bp, Artificial
  CRISPR gRNA sequence
gcctcagcctcccaagaagc

SEQ ID NO: 327802 - DNA, 20 bp, Artificial
  CRISPR gRNA sequence
cctcagcctcccaagaagct

SEQ ID NO: 327803 - DNA, 20 bp, Artificial
  CRISPR gRNA sequence
ctcccaagaagctgggaata

SEQ ID NO: 327804 - DNA, 20 bp, Artificial
  CRISPR gRNA sequence
tcccaagaagctgggaatac

SEQ ID NO: 327805 - DNA, 20 bp, Artificial
  CRISPR gRNA sequence
caggcacacaccaccatatc

SEQ ID NO: 327806 - DNA, 20 bp, Artificial
  CRISPR gRNA sequence
atatctggctaactttgaaa

SEQ ID NO: 327807 - DNA, 20 bp, Artificial
  CRISPR gRNA sequence
actttgaaaaagaaattttg

SEQ ID NO: 327808 - DNA, 20 bp, Artificial
  CRISPR gRNA sequence
tttgaaaaagaaattttgta

SEQ ID NO: 327809 - DNA, 20 bp, Artificial
  CRISPR gRNA sequence
aaaaagaaattttgtagaga

SEQ ID NO: 327810 - DNA, 20 bp, Artificial
  CRISPR gRNA sequence
aaaagaaattttgtagagac

SEQ ID NO: 327811 - DNA, 20 bp, Artificial
  CRISPR gRNA sequence
acaggtcttgctatgttgcc

SEQ ID NO: 327812 - DNA, 20 bp, Artificial
  CRISPR gRNA sequence
caggtcttgctatgttgccc

SEQ ID NO: 327813 - DNA, 20 bp, Artificial
  CRISPR gRNA sequence
tcttgctatgttgcccaggc

SEQ ID NO: 327814 - DNA, 20 bp, Artificial
  CRISPR gRNA sequence
ccaggctggtcttgaactcc

SEQ ID NO: 327815 - DNA, 20 bp, Artificial
  CRISPR gRNA sequence
ggtcttgaactcctggcctc

SEQ ID NO: 327816 - DNA, 20 bp, Artificial
  CRISPR gRNA sequence
ctcaagcaatcctcctgcct

SEQ ID NO: 327817 - DNA, 20 bp, Artificial
  CRISPR gRNA sequence
cctcctgcctcagcctctta

SEQ ID NO: 327818 - DNA, 20 bp, Artificial
  CRISPR gRNA sequence
gcctcagcctcttaaagtgc

SEQ ID NO: 327819 - DNA, 20 bp, Artificial
  CRISPR gRNA sequence
cctcagcctcttaaagtgct

SEQ ID NO: 327820 - DNA, 20 bp, Artificial
  CRISPR gRNA sequence
ctcttaaagtgctaggatta

SEQ ID NO: 327821 - DNA, 20 bp, Artificial
  CRISPR gRNA sequence
cagacgtgaaccaccatgcc

SEQ ID NO: 327822 - DNA, 20 bp, Artificial
  CRISPR gRNA sequence
ctgaaataaatttatgctta

SEQ ID NO: 327823 - DNA, 20 bp, Artificial
  CRISPR gRNA sequence
tgaaataaatttatgcttat

SEQ ID NO: 327824 - DNA, 20 bp, Artificial
  CRISPR gRNA sequence
aataaatttatgcttatagg

SEQ ID NO: 327825 - DNA, 20 bp, Artificial
  CRISPR gRNA sequence
atttatgcttataggaagcc

SEQ ID NO: 327826 - DNA, 20 bp, Artificial
  CRISPR gRNA sequence
tttatgcttataggaagcca

SEQ ID NO: 327827 - DNA, 20 bp, Artificial
  CRISPR gRNA sequence
gaagccaaggttgtttttgc

SEQ ID NO: 327828 - DNA, 20 bp, Artificial
  CRISPR gRNA sequence
ggttgtttttgcaagctaca

SEQ ID NO: 327829 - DNA, 20 bp, Artificial
  CRISPR gRNA sequence
gttgtttttgcaagctacat

SEQ ID NO: 327830 - DNA, 20 bp, Artificial
  CRISPR gRNA sequence
tgcaagctacatgggaatca

SEQ ID NO: 327831 - DNA, 20 bp, Artificial
  CRISPR gRNA sequence
aagctacatgggaatcacag

SEQ ID NO: 327832 - DNA, 20 bp, Artificial
  CRISPR gRNA sequence
agctacatgggaatcacaga

SEQ ID NO: 327833 - DNA, 20 bp, Artificial
  CRISPR gRNA sequence
ggaaaaaactgaaatcacct

SEQ ID NO: 327834 - DNA, 20 bp, Artificial
  CRISPR gRNA sequence
aaactgaaatcaccttggcc

SEQ ID NO: 327835 - DNA, 20 bp, Artificial
  CRISPR gRNA sequence
ctgaaatcaccttggcctgg

SEQ ID NO: 327836 - DNA, 20 bp, Artificial
  CRISPR gRNA sequence
tcaccttggcctggtggttg

SEQ ID NO: 327837 - DNA, 20 bp, Artificial
  CRISPR gRNA sequence
gcctggtggttgcagattct

SEQ ID NO: 327838 - DNA, 20 bp, Artificial
  CRISPR gRNA sequence
ggttgcagattctgagttat

SEQ ID NO: 327839 - DNA, 20 bp, Artificial
  CRISPR gRNA sequence
attttcatgctgaaattgtt

SEQ ID NO: 327840 - DNA, 20 bp, Artificial
  CRISPR gRNA sequence
ttttcatgctgaaattgttt

SEQ ID NO: 327841 - DNA, 20 bp, Artificial
  CRISPR gRNA sequence
aaattgtttgggaaaattat

SEQ ID NO: 327842 - DNA, 20 bp, Artificial
  CRISPR gRNA sequence
tgggaaaattattagtatgc

SEQ ID NO: 327843 - DNA, 20 bp, Artificial
  CRISPR gRNA sequence
tagtatgctggttttttcct

SEQ ID NO: 327844 - DNA, 20 bp, Artificial
  CRISPR gRNA sequence
tttcctaagttttgaaatct

SEQ ID NO: 327845 - DNA, 20 bp, Artificial
  CRISPR gRNA sequence
aaatcttggtctttgttttt

SEQ ID NO: 327846 - DNA, 20 bp, Artificial
  CRISPR gRNA sequence
tgtttttgagaaaactatgt

SEQ ID NO: 327847 - DNA, 20 bp, Artificial
  CRISPR gRNA sequence
tgtaagtgtaaaaaaatttt

SEQ ID NO: 327848 - DNA, 20 bp, Artificial
  CRISPR gRNA sequence
gtaagtgtaaaaaaatttta

SEQ ID NO: 327849 - DNA, 20 bp, Artificial
  CRISPR gRNA sequence
ttttaaggaaaaaaattacc

SEQ ID NO: 327850 - DNA, 20 bp, Artificial
  CRISPR gRNA sequence
aaaaaaattacctagttcta

SEQ ID NO: 327851 - DNA, 20 bp, Artificial
  CRISPR gRNA sequence
tacctagttctacagtgaaa

SEQ ID NO: 327852 - DNA, 20 bp, Artificial
  CRISPR gRNA sequence
aaaaacatacttattattta

SEQ ID NO: 327853 - DNA, 20 bp, Artificial
  CRISPR gRNA sequence
tgtcataaacatttcatttt

SEQ ID NO: 327854 - DNA, 20 bp, Artificial
  CRISPR gRNA sequence
ctttttaatgactatattat

SEQ ID NO: 327855 - DNA, 20 bp, Artificial
  CRISPR gRNA sequence
taaaactaaaatactaacgt

SEQ ID NO: 327856 - DNA, 20 bp, Artificial
  CRISPR gRNA sequence
aaaatactaacgttggatat

SEQ ID NO: 327857 - DNA, 20 bp, Artificial
  CRISPR gRNA sequence
aaatactaacgttggatatt

SEQ ID NO: 327858 - DNA, 20 bp, Artificial
  CRISPR gRNA sequence
ttggatattgggattatttt

SEQ ID NO: 327859 - DNA, 20 bp, Artificial
  CRISPR gRNA sequence
tatgtaaatattatgacatt

SEQ ID NO: 327860 - DNA, 20 bp, Artificial
  CRISPR gRNA sequence
catttggtcaaaatgtttaa

SEQ ID NO: 327861 - DNA, 20 bp, Artificial
  CRISPR gRNA sequence
ttgctttctgaaatttgtaa

SEQ ID NO: 327862 - DNA, 20 bp, Artificial
  CRISPR gRNA sequence
tgctttctgaaatttgtaac

SEQ ID NO: 327863 - DNA, 20 bp, Artificial
  CRISPR gRNA sequence
tctgaaatttgtaacaggat

SEQ ID NO: 327864 - DNA, 20 bp, Artificial
  CRISPR gRNA sequence
gtaacaggattagcattatg

SEQ ID NO: 327865 - DNA, 20 bp, Artificial
  CRISPR gRNA sequence
taacaggattagcattatgc

SEQ ID NO: 327866 - DNA, 20 bp, Artificial
  CRISPR gRNA sequence
acaggattagcattatgcag

SEQ ID NO: 327867 - DNA, 20 bp, Artificial
  CRISPR gRNA sequence
caggattagcattatgcagg

SEQ ID NO: 327868 - DNA, 20 bp, Artificial
  CRISPR gRNA sequence
aggattagcattatgcagga

SEQ ID NO: 327869 - DNA, 20 bp, Artificial
  CRISPR gRNA sequence
ggattagcattatgcaggag

SEQ ID NO: 327870 - DNA, 20 bp, Artificial
  CRISPR gRNA sequence
tgtcacacctctacttacac

SEQ ID NO: 327871 - DNA, 20 bp, Artificial
  CRISPR gRNA sequence
tagttgccttaattttattt

SEQ ID NO: 327872 - DNA, 20 bp, Artificial
  CRISPR gRNA sequence
acttattttcttaatgaccc

SEQ ID NO: 327873 - DNA, 20 bp, Artificial
  CRISPR gRNA sequence
cttattttcttaatgaccct

SEQ ID NO: 327874 - DNA, 20 bp, Artificial
  CRISPR gRNA sequence
ttccctatatatcttcaatt

SEQ ID NO: 327875 - DNA, 20 bp, Artificial
  CRISPR gRNA sequence
tccctatatatcttcaattt

SEQ ID NO: 327876 - DNA, 20 bp, Artificial
  CRISPR gRNA sequence
ggtgatttgattgtgaaaat

SEQ ID NO: 327877 - DNA, 20 bp, Artificial
  CRISPR gRNA sequence
ttgattgtgaaaataagcac

SEQ ID NO: 327878 - DNA, 20 bp, Artificial
  CRISPR gRNA sequence
gaaaataagcacaagtgttc

SEQ ID NO: 327879 - DNA, 20 bp, Artificial
  CRISPR gRNA sequence
agcacaagtgttctagtctt

SEQ ID NO: 327880 - DNA, 20 bp, Artificial
  CRISPR gRNA sequence
agtgttctagtcttcagtta

SEQ ID NO: 327881 - DNA, 20 bp, Artificial
  CRISPR gRNA sequence
gttctagtcttcagttatag

SEQ ID NO: 327882 - DNA, 20 bp, Artificial
  CRISPR gRNA sequence
atgtccaaaaatattattaa

SEQ ID NO: 327883 - DNA, 20 bp, Artificial
  CRISPR gRNA sequence
aaatattattaaaagcatta

SEQ ID NO: 327884 - DNA, 20 bp, Artificial
  CRISPR gRNA sequence
aagcattaaagaatgacaca

SEQ ID NO: 327885 - DNA, 20 bp, Artificial
  CRISPR gRNA sequence
agcattaaagaatgacacaa

SEQ ID NO: 327886 - DNA, 20 bp, Artificial
  CRISPR gRNA sequence
cattaaagaatgacacaaag

SEQ ID NO: 327887 - DNA, 20 bp, Artificial
  CRISPR gRNA sequence
attaaagaatgacacaaagg

SEQ ID NO: 327888 - DNA, 20 bp, Artificial
  CRISPR gRNA sequence
taaagaatgacacaaaggag

SEQ ID NO: 327889 - DNA, 20 bp, Artificial
  CRISPR gRNA sequence
cacaaaggaggagaaattac

SEQ ID NO: 327890 - DNA, 20 bp, Artificial
  CRISPR gRNA sequence
acaaaggaggagaaattacc

SEQ ID NO: 327891 - DNA, 20 bp, Artificial
  CRISPR gRNA sequence
aaattaccaggctaaatttg

SEQ ID NO: 327892 - DNA, 20 bp, Artificial
  CRISPR gRNA sequence
attaccaggctaaatttgaa

SEQ ID NO: 327893 - DNA, 20 bp, Artificial
  CRISPR gRNA sequence
taccaggctaaatttgaaga

SEQ ID NO: 327894 - DNA, 20 bp, Artificial
  CRISPR gRNA sequence
gctaaatttgaagagagaac

SEQ ID NO: 327895 - DNA, 20 bp, Artificial
  CRISPR gRNA sequence
gaagagagaaccagaacccc

SEQ ID NO: 327896 - DNA, 20 bp, Artificial
  CRISPR gRNA sequence
agagagaaccagaaccccga

SEQ ID NO: 327897 - DNA, 20 bp, Artificial
  CRISPR gRNA sequence
agaaccagaaccccgagaga

SEQ ID NO: 327898 - DNA, 20 bp, Artificial
  CRISPR gRNA sequence
gaaccagaaccccgagagac

SEQ ID NO: 327899 - DNA, 20 bp, Artificial
  CRISPR gRNA sequence
agaaccccgagagacaggca

SEQ ID NO: 327900 - DNA, 20 bp, Artificial
  CRISPR gRNA sequence
cccgagagacaggcaaagct

SEQ ID NO: 327901 - DNA, 20 bp, Artificial
  CRISPR gRNA sequence
gagagacaggcaaagcttgg

SEQ ID NO: 327902 - DNA, 20 bp, Artificial
  CRISPR gRNA sequence
gcttggaagctgcttttact

SEQ ID NO: 327903 - DNA, 20 bp, Artificial
  CRISPR gRNA sequence
ggaagctgcttttactcgga

SEQ ID NO: 327904 - DNA, 20 bp, Artificial
  CRISPR gRNA sequence
tgtttttatgtctcaactcc

SEQ ID NO: 327905 - DNA, 20 bp, Artificial
  CRISPR gRNA sequence
gtctcaactcccagaatctg

SEQ ID NO: 327906 - DNA, 20 bp, Artificial
  CRISPR gRNA sequence
ctcaactcccagaatctgca

SEQ ID NO: 327907 - DNA, 20 bp, Artificial
  CRISPR gRNA sequence
actcccagaatctgcagagt

SEQ ID NO: 327908 - DNA, 20 bp, Artificial
  CRISPR gRNA sequence
aatctgcagagtgagtgatc

SEQ ID NO: 327909 - DNA, 20 bp, Artificial
  CRISPR gRNA sequence
ctgcagagtgagtgatctag

SEQ ID NO: 327910 - DNA, 20 bp, Artificial
  CRISPR gRNA sequence
aaaccctctccccaataaat

SEQ ID NO: 327911 - DNA, 20 bp, Artificial
  CRISPR gRNA sequence
aaccctctccccaataaatt

SEQ ID NO: 327912 - DNA, 20 bp, Artificial
  CRISPR gRNA sequence
cccaataaattgggacccca

SEQ ID NO: 327913 - DNA, 20 bp, Artificial
  CRISPR gRNA sequence
caataaattgggaccccaaa

SEQ ID NO: 327914 - DNA, 20 bp, Artificial
  CRISPR gRNA sequence
accccaaagagttacattct

SEQ ID NO: 327915 - DNA, 20 bp, Artificial
  CRISPR gRNA sequence
cccaaagagttacattcttg

SEQ ID NO: 327916 - DNA, 20 bp, Artificial
  CRISPR gRNA sequence
agagttacattcttggagca

SEQ ID NO: 327917 - DNA, 20 bp, Artificial
  CRISPR gRNA sequence
gagttacattcttggagcac

SEQ ID NO: 327918 - DNA, 20 bp, Artificial
  CRISPR gRNA sequence
acattcttggagcacaggta

SEQ ID NO: 327919 - DNA, 20 bp, Artificial
  CRISPR gRNA sequence
gcacaggtaaagaaataaac

SEQ ID NO: 327920 - DNA, 20 bp, Artificial
  CRISPR gRNA sequence
gaaataaaccagacctcatt

SEQ ID NO: 327921 - DNA, 20 bp, Artificial
  CRISPR gRNA sequence
aaaccagacctcattcagat

SEQ ID NO: 327922 - DNA, 20 bp, Artificial
  CRISPR gRNA sequence
cagacctcattcagattaga

SEQ ID NO: 327923 - DNA, 20 bp, Artificial
  CRISPR gRNA sequence
ctcattcagattagatggtc

SEQ ID NO: 327924 - DNA, 20 bp, Artificial
  CRISPR gRNA sequence
gatggtccagaaaaatcttc

SEQ ID NO: 327925 - DNA, 20 bp, Artificial
  CRISPR gRNA sequence
aaaaatcttctggacttcaa

SEQ ID NO: 327926 - DNA, 20 bp, Artificial
  CRISPR gRNA sequence
atcttctggacttcaatggt

SEQ ID NO: 327927 - DNA, 20 bp, Artificial
  CRISPR gRNA sequence
tcaatccttgaattttcttt

SEQ ID NO: 327928 - DNA, 20 bp, Artificial
  CRISPR gRNA sequence
caatccttgaattttcttta

SEQ ID NO: 327929 - DNA, 20 bp, Artificial
  CRISPR gRNA sequence
atccttgaattttctttaag

SEQ ID NO: 327930 - DNA, 20 bp, Artificial
  CRISPR gRNA sequence
tttgcattattattaccctt

SEQ ID NO: 327931 - DNA, 20 bp, Artificial
  CRISPR gRNA sequence
tattacccttcagcttttga

SEQ ID NO: 327932 - DNA, 20 bp, Artificial
  CRISPR gRNA sequence
gtaaaaatgcaaactattac

SEQ ID NO: 327933 - DNA, 20 bp, Artificial
  CRISPR gRNA sequence
aaaatgcaaactattacaag

SEQ ID NO: 327934 - DNA, 20 bp, Artificial
  CRISPR gRNA sequence
gcaaactattacaagaagaa

SEQ ID NO: 327935 - DNA, 20 bp, Artificial
  CRISPR gRNA sequence
caaactattacaagaagaaa

SEQ ID NO: 327936 - DNA, 20 bp, Artificial
  CRISPR gRNA sequence
agaagaaaaggtttacatcc

SEQ ID NO: 327937 - DNA, 20 bp, Artificial
  CRISPR gRNA sequence
gaagaaaaggtttacatcct

SEQ ID NO: 327938 - DNA, 20 bp, Artificial
  CRISPR gRNA sequence
caaataatattcacattcaa

SEQ ID NO: 327939 - DNA, 20 bp, Artificial
  CRISPR gRNA sequence
aaacacatcacaaaaataat

SEQ ID NO: 327940 - DNA, 20 bp, Artificial
  CRISPR gRNA sequence
acaaaaataatgagacatac

SEQ ID NO: 327941 - DNA, 20 bp, Artificial
  CRISPR gRNA sequence
aatgagacatacaagaaaac

SEQ ID NO: 327942 - DNA, 20 bp, Artificial
  CRISPR gRNA sequence
atgagacatacaagaaaaca

SEQ ID NO: 327943 - DNA, 20 bp, Artificial
  CRISPR gRNA sequence
tgagacatacaagaaaacaa

SEQ ID NO: 327944 - DNA, 20 bp, Artificial
  CRISPR gRNA sequence
acaagaaaacaagggaacaa

SEQ ID NO: 327945 - DNA, 20 bp, Artificial
  CRISPR gRNA sequence
gatttatatacctgaattat

SEQ ID NO: 327946 - DNA, 20 bp, Artificial
  CRISPR gRNA sequence
atttatatacctgaattatc

SEQ ID NO: 327947 - DNA, 20 bp, Artificial
  CRISPR gRNA sequence
attatcaggtccccaaaata

SEQ ID NO: 327948 - DNA, 20 bp, Artificial
  CRISPR gRNA sequence
gtccccaaaataaagtaatt

SEQ ID NO: 327949 - DNA, 20 bp, Artificial
  CRISPR gRNA sequence
taattaagcttattatgttt

SEQ ID NO: 327950 - DNA, 20 bp, Artificial
  CRISPR gRNA sequence
cttattatgtttaagcaaat

SEQ ID NO: 327951 - DNA, 20 bp, Artificial
  CRISPR gRNA sequence
tattatgtttaagcaaataa

SEQ ID NO: 327952 - DNA, 20 bp, Artificial
  CRISPR gRNA sequence
aaaacttgtaataatatctg

SEQ ID NO: 327953 - DNA, 20 bp, Artificial
  CRISPR gRNA sequence
gtaataatatctgtagtaca

SEQ ID NO: 327954 - DNA, 20 bp, Artificial
  CRISPR gRNA sequence
taataatatctgtagtacac

SEQ ID NO: 327955 - DNA, 20 bp, Artificial
  CRISPR gRNA sequence
tgtagtacacaggaaaattt

SEQ ID NO: 327956 - DNA, 20 bp, Artificial
  CRISPR gRNA sequence
ttaagtcaactaatttgaaa

SEQ ID NO: 327957 - DNA, 20 bp, Artificial
  CRISPR gRNA sequence
taatttgaaaaagaacctac

SEQ ID NO: 327958 - DNA, 20 bp, Artificial
  CRISPR gRNA sequence
gaaaaagaacctacaagaat

SEQ ID NO: 327959 - DNA, 20 bp, Artificial
  CRISPR gRNA sequence
atcggccaaaaaaatgcact

SEQ ID NO: 327960 - DNA, 20 bp, Artificial
  CRISPR gRNA sequence
cactgagatttaaaactcaa

SEQ ID NO: 327961 - DNA, 20 bp, Artificial
  CRISPR gRNA sequence
agatttaaaactcaatagat

SEQ ID NO: 327962 - DNA, 20 bp, Artificial
  CRISPR gRNA sequence
tagataagtttaatatatat

SEQ ID NO: 327963 - DNA, 20 bp, Artificial
  CRISPR gRNA sequence
taagtttaatatatattaga

SEQ ID NO: 327964 - DNA, 20 bp, Artificial
  CRISPR gRNA sequence
agtttaatatatattagaca

SEQ ID NO: 327965 - DNA, 20 bp, Artificial
  CRISPR gRNA sequence
atatatattagacagagtta

SEQ ID NO: 327966 - DNA, 20 bp, Artificial
  CRISPR gRNA sequence
atatattagacagagttaaa

SEQ ID NO: 327967 - DNA, 20 bp, Artificial
  CRISPR gRNA sequence
gacagagttaaagagaaaat

SEQ ID NO: 327968 - DNA, 20 bp, Artificial
  CRISPR gRNA sequence
taaagagaaaattggtgaac

SEQ ID NO: 327969 - DNA, 20 bp, Artificial
  CRISPR gRNA sequence
agagaaaattggtgaaccag

SEQ ID NO: 327970 - DNA, 20 bp, Artificial
  CRISPR gRNA sequence
aaaattggtgaaccagcaga

SEQ ID NO: 327971 - DNA, 20 bp, Artificial
  CRISPR gRNA sequence
aaattggtgaaccagcagat

SEQ ID NO: 327972 - DNA, 20 bp, Artificial
  CRISPR gRNA sequence
tggtgaaccagcagataggt

SEQ ID NO: 327973 - DNA, 20 bp, Artificial
  CRISPR gRNA sequence
agcagataggttggaaaaat

SEQ ID NO: 327974 - DNA, 20 bp, Artificial
  CRISPR gRNA sequence
gataggttggaaaaattagt

SEQ ID NO: 327975 - DNA, 20 bp, Artificial
  CRISPR gRNA sequence
tggaaaaattagttagaacc

SEQ ID NO: 327976 - DNA, 20 bp, Artificial
  CRISPR gRNA sequence
tagaacccagtcacactcca

SEQ ID NO: 327977 - DNA, 20 bp, Artificial
  CRISPR gRNA sequence
cagtcacactccacagattc

SEQ ID NO: 327978 - DNA, 20 bp, Artificial
  CRISPR gRNA sequence
caagaatcccaacaattcac

SEQ ID NO: 327979 - DNA, 20 bp, Artificial
  CRISPR gRNA sequence
ttcacaagcatattttttaa

SEQ ID NO: 327980 - DNA, 20 bp, Artificial
  CRISPR gRNA sequence
tttttaaaagtatgcacacc

SEQ ID NO: 327981 - DNA, 20 bp, Artificial
  CRISPR gRNA sequence
atgcacacctagatgtatct

SEQ ID NO: 327982 - DNA, 20 bp, Artificial
  CRISPR gRNA sequence
tatcttagtgaaaatcctaa

SEQ ID NO: 327983 - DNA, 20 bp, Artificial
  CRISPR gRNA sequence
cttagtgaaaatcctaaaag

SEQ ID NO: 327984 - DNA, 20 bp, Artificial
  CRISPR gRNA sequence
gtgaaaatcctaaaagcagc

SEQ ID NO: 327985 - DNA, 20 bp, Artificial
  CRISPR gRNA sequence
gaaaatcctaaaagcagcca

SEQ ID NO: 327986 - DNA, 20 bp, Artificial
  CRISPR gRNA sequence
tcctaaaagcagccagagaa

SEQ ID NO: 327987 - DNA, 20 bp, Artificial
  CRISPR gRNA sequence
ctaaaagcagccagagaaaa

SEQ ID NO: 327988 - DNA, 20 bp, Artificial
  CRISPR gRNA sequence
aaagagactgattaccttcc

SEQ ID NO: 327989 - DNA, 20 bp, Artificial
  CRISPR gRNA sequence
aagagactgattaccttcca

SEQ ID NO: 327990 - DNA, 20 bp, Artificial
  CRISPR gRNA sequence
gagactgattaccttccaag

SEQ ID NO: 327991 - DNA, 20 bp, Artificial
  CRISPR gRNA sequence
accttccaaggagcaactat

SEQ ID NO: 327992 - DNA, 20 bp, Artificial
  CRISPR gRNA sequence
tgtttcaacatcaacaataa

SEQ ID NO: 327993 - DNA, 20 bp, Artificial
  CRISPR gRNA sequence
caacaataaaagccctgata

SEQ ID NO: 327994 - DNA, 20 bp, Artificial
  CRISPR gRNA sequence
caataaaagccctgatacag

SEQ ID NO: 327995 - DNA, 20 bp, Artificial
  CRISPR gRNA sequence
atatacctccaatgtgctaa

SEQ ID NO: 327996 - DNA, 20 bp, Artificial
  CRISPR gRNA sequence
aaaagaaacatctgtcaata

SEQ ID NO: 327997 - DNA, 20 bp, Artificial
  CRISPR gRNA sequence
aagaaacatctgtcaatata

SEQ ID NO: 327998 - DNA, 20 bp, Artificial
  CRISPR gRNA sequence
tcaatatagagcacattgtc

SEQ ID NO: 327999 - DNA, 20 bp, Artificial
  CRISPR gRNA sequence
tatagagcacattgtctaga

SEQ ID NO: 328000 - DNA, 20 bp, Artificial
  CRISPR gRNA sequence
gagcacattgtctagaaaga

SEQ ID NO: 328001 - DNA, 20 bp, Artificial
  CRISPR gRNA sequence
cattgtctagaaagatagtg

SEQ ID NO: 328002 - DNA, 20 bp, Artificial
  CRISPR gRNA sequence
attgtctagaaagatagtga

SEQ ID NO: 328003 - DNA, 20 bp, Artificial
  CRISPR gRNA sequence
atgtaatttgaaacttttct

SEQ ID NO: 328004 - DNA, 20 bp, Artificial
  CRISPR gRNA sequence
atttgaaacttttctaagtg

SEQ ID NO: 328005 - DNA, 20 bp, Artificial
  CRISPR gRNA sequence
cttccataattactaaaaaa

SEQ ID NO: 328006 - DNA, 20 bp, Artificial
  CRISPR gRNA sequence
taattactaaaaaatagaaa

SEQ ID NO: 328007 - DNA, 20 bp, Artificial
  CRISPR gRNA sequence
atagttaatataatctgaat

SEQ ID NO: 328008 - DNA, 20 bp, Artificial
  CRISPR gRNA sequence
tgaattagtatcacaaaatt

SEQ ID NO: 328009 - DNA, 20 bp, Artificial
  CRISPR gRNA sequence
tatcacaaaattcagcctaa

SEQ ID NO: 328010 - DNA, 20 bp, Artificial
  CRISPR gRNA sequence
cagcctaatggttttgtcta

SEQ ID NO: 328011 - DNA, 20 bp, Artificial
  CRISPR gRNA sequence
gcctaatggttttgtctaaa

SEQ ID NO: 328012 - DNA, 20 bp, Artificial
  CRISPR gRNA sequence
cctaatggttttgtctaaag

SEQ ID NO: 328013 - DNA, 20 bp, Artificial
  CRISPR gRNA sequence
ctaatggttttgtctaaaga

SEQ ID NO: 328014 - DNA, 20 bp, Artificial
  CRISPR gRNA sequence
aatggttttgtctaaagagg

SEQ ID NO: 328015 - DNA, 20 bp, Artificial
  CRISPR gRNA sequence
gttttgtctaaagagggaga

SEQ ID NO: 328016 - DNA, 20 bp, Artificial
  CRISPR gRNA sequence
tttgtctaaagagggagaaa

SEQ ID NO: 328017 - DNA, 20 bp, Artificial
  CRISPR gRNA sequence
tctaaagagggagaaagagt

SEQ ID NO: 328018 - DNA, 20 bp, Artificial
  CRISPR gRNA sequence
gagggagaaagagttggaat

SEQ ID NO: 328019 - DNA, 20 bp, Artificial
  CRISPR gRNA sequence
ggagaaagagttggaatcag

SEQ ID NO: 328020 - DNA, 20 bp, Artificial
  CRISPR gRNA sequence
gagaaagagttggaatcaga

SEQ ID NO: 328021 - DNA, 20 bp, Artificial
  CRISPR gRNA sequence
gagttggaatcagaaggaaa

SEQ ID NO: 328022 - DNA, 20 bp, Artificial
  CRISPR gRNA sequence
agttggaatcagaaggaaat

SEQ ID NO: 328023 - DNA, 20 bp, Artificial
  CRISPR gRNA sequence
gttggaatcagaaggaaata

SEQ ID NO: 328024 - DNA, 20 bp, Artificial
  CRISPR gRNA sequence
ttggaatcagaaggaaatag

SEQ ID NO: 328025 - DNA, 20 bp, Artificial
  CRISPR gRNA sequence
gaaggaaataggggtgctga

SEQ ID NO: 328026 - DNA, 20 bp, Artificial
  CRISPR gRNA sequence
gtcttgtatttcttgacctg

SEQ ID NO: 328027 - DNA, 20 bp, Artificial
  CRISPR gRNA sequence
tcttgacctgtggtgattat

SEQ ID NO: 328028 - DNA, 20 bp, Artificial
  CRISPR gRNA sequence
cttgacctgtggtgattatg

SEQ ID NO: 328029 - DNA, 20 bp, Artificial
  CRISPR gRNA sequence
ttgacctgtggtgattatga

SEQ ID NO: 328030 - DNA, 20 bp, Artificial
  CRISPR gRNA sequence
cctgtggtgattatgagggt

SEQ ID NO: 328031 - DNA, 20 bp, Artificial
  CRISPR gRNA sequence
tggtgattatgagggtaaga

SEQ ID NO: 328032 - DNA, 20 bp, Artificial
  CRISPR gRNA sequence
gagggtaagatagtatgctt

SEQ ID NO: 328033 - DNA, 20 bp, Artificial
  CRISPR gRNA sequence
atgttttgttttataataac

SEQ ID NO: 328034 - DNA, 20 bp, Artificial
  CRISPR gRNA sequence
ataataacaagtatgtttaa

SEQ ID NO: 328035 - DNA, 20 bp, Artificial
  CRISPR gRNA sequence
caagtatgtttaaaagcata

SEQ ID NO: 328036 - DNA, 20 bp, Artificial
  CRISPR gRNA sequence
gtatgtttaaaagcatacag

SEQ ID NO: 328037 - DNA, 20 bp, Artificial
  CRISPR gRNA sequence
tatgtttaaaagcatacaga

SEQ ID NO: 328038 - DNA, 20 bp, Artificial
  CRISPR gRNA sequence
acttgcttcgttttaaaaac

SEQ ID NO: 328039 - DNA, 20 bp, Artificial
  CRISPR gRNA sequence
tgcttcgttttaaaaactgg

SEQ ID NO: 328040 - DNA, 20 bp, Artificial
  CRISPR gRNA sequence
gcttcgttttaaaaactgga

SEQ ID NO: 328041 - DNA, 20 bp, Artificial
  CRISPR gRNA sequence
ctggaaggaacaatattatc

SEQ ID NO: 328042 - DNA, 20 bp, Artificial
  CRISPR gRNA sequence
ggaaggaacaatattatcca

SEQ ID NO: 328043 - DNA, 20 bp, Artificial
  CRISPR gRNA sequence
gaaggaacaatattatccag

SEQ ID NO: 328044 - DNA, 20 bp, Artificial
  CRISPR gRNA sequence
aacaatattatccagaggca

SEQ ID NO: 328045 - DNA, 20 bp, Artificial
  CRISPR gRNA sequence
ggcaaagaaaaaaaaactgt

SEQ ID NO: 328046 - DNA, 20 bp, Artificial
  CRISPR gRNA sequence
gaaaaaaaaactgttggcat

SEQ ID NO: 328047 - DNA, 20 bp, Artificial
  CRISPR gRNA sequence
aaaaactgttggcatgagaa

SEQ ID NO: 328048 - DNA, 20 bp, Artificial
  CRISPR gRNA sequence
aaaactgttggcatgagaac

SEQ ID NO: 328049 - DNA, 20 bp, Artificial
  CRISPR gRNA sequence
tgttggcatgagaacaggtg

SEQ ID NO: 328050 - DNA, 20 bp, Artificial
  CRISPR gRNA sequence
agaacaggtgcagtctacat

SEQ ID NO: 328051 - DNA, 20 bp, Artificial
  CRISPR gRNA sequence
gtctacattagattaaaacg

SEQ ID NO: 328052 - DNA, 20 bp, Artificial
  CRISPR gRNA sequence
tctacattagattaaaacgt

SEQ ID NO: 328053 - DNA, 20 bp, Artificial
  CRISPR gRNA sequence
ctacattagattaaaacgta

SEQ ID NO: 328054 - DNA, 20 bp, Artificial
  CRISPR gRNA sequence
aaaacgtagggtattttgct

SEQ ID NO: 328055 - DNA, 20 bp, Artificial
  CRISPR gRNA sequence
aaacgtagggtattttgctt

SEQ ID NO: 328056 - DNA, 20 bp, Artificial
  CRISPR gRNA sequence
aacgtagggtattttgcttg

SEQ ID NO: 328057 - DNA, 20 bp, Artificial
  CRISPR gRNA sequence
ttggggctttatttgtctga

SEQ ID NO: 328058 - DNA, 20 bp, Artificial
  CRISPR gRNA sequence
tatgtctctaccgtctgctg

SEQ ID NO: 328059 - DNA, 20 bp, Artificial
  CRISPR gRNA sequence
gtctctaccgtctgctgcag

SEQ ID NO: 328060 - DNA, 20 bp, Artificial
  CRISPR gRNA sequence
tctgctgcagaagataaaat

SEQ ID NO: 328061 - DNA, 20 bp, Artificial
  CRISPR gRNA sequence
gctgcagaagataaaatcag

SEQ ID NO: 328062 - DNA, 20 bp, Artificial
  CRISPR gRNA sequence
cagaagataaaatcagtgga

SEQ ID NO: 328063 - DNA, 20 bp, Artificial
  CRISPR gRNA sequence
agaagataaaatcagtggac

SEQ ID NO: 328064 - DNA, 20 bp, Artificial
  CRISPR gRNA sequence
aaaatcagtggacgggttct

SEQ ID NO: 328065 - DNA, 20 bp, Artificial
  CRISPR gRNA sequence
ggacgggttctcagttcctt

SEQ ID NO: 328066 - DNA, 20 bp, Artificial
  CRISPR gRNA sequence
aatgttcacaaaaaatttcc

SEQ ID NO: 328067 - DNA, 20 bp, Artificial
  CRISPR gRNA sequence
tgttcacaaaaaatttccca

SEQ ID NO: 328068 - DNA, 20 bp, Artificial
  CRISPR gRNA sequence
aaaaaatttcccagagactt

SEQ ID NO: 328069 - DNA, 20 bp, Artificial
  CRISPR gRNA sequence
atttcccagagactttagaa

SEQ ID NO: 328070 - DNA, 20 bp, Artificial
  CRISPR gRNA sequence
tcccagagactttagaatgg

SEQ ID NO: 328071 - DNA, 20 bp, Artificial
  CRISPR gRNA sequence
agagactttagaatggcagc

SEQ ID NO: 328072 - DNA, 20 bp, Artificial
  CRISPR gRNA sequence
caagtaaaccacaatgatct

SEQ ID NO: 328073 - DNA, 20 bp, Artificial
  CRISPR gRNA sequence
agtaaaccacaatgatcttg

SEQ ID NO: 328074 - DNA, 20 bp, Artificial
  CRISPR gRNA sequence
ccacaatgatcttggagcca

SEQ ID NO: 328075 - DNA, 20 bp, Artificial
  CRISPR gRNA sequence
tcttggagccaaagcgtctg

SEQ ID NO: 328076 - DNA, 20 bp, Artificial
  CRISPR gRNA sequence
ctgtggtcaccatgtataca

SEQ ID NO: 328077 - DNA, 20 bp, Artificial
  CRISPR gRNA sequence
tcaccatgtatacacagaca

SEQ ID NO: 328078 - DNA, 20 bp, Artificial
  CRISPR gRNA sequence
cgcattgtcttctacttccg

SEQ ID NO: 328079 - DNA, 20 bp, Artificial
  CRISPR gRNA sequence
acttccgaagatgattttct

SEQ ID NO: 328080 - DNA, 20 bp, Artificial
  CRISPR gRNA sequence
tccgaagatgattttctcag

SEQ ID NO: 328081 - DNA, 20 bp, Artificial
  CRISPR gRNA sequence
cccccattgtgcccgcactg

SEQ ID NO: 328082 - DNA, 20 bp, Artificial
  CRISPR gRNA sequence
gcccgcactgtggcaaacac

SEQ ID NO: 328083 - DNA, 20 bp, Artificial
  CRISPR gRNA sequence
ccgcactgtggcaaacacaa

SEQ ID NO: 328084 - DNA, 20 bp, Artificial
  CRISPR gRNA sequence
cgcactgtggcaaacacaag

SEQ ID NO: 328085 - DNA, 20 bp, Artificial
  CRISPR gRNA sequence
caaacacaagaggacatgaa

SEQ ID NO: 328086 - DNA, 20 bp, Artificial
  CRISPR gRNA sequence
cacaagaggacatgaatggt

SEQ ID NO: 328087 - DNA, 20 bp, Artificial
  CRISPR gRNA sequence
aagaggacatgaatggttgg

SEQ ID NO: 328088 - DNA, 20 bp, Artificial
  CRISPR gRNA sequence
gacatgaatggttggcggtg

SEQ ID NO: 328089 - DNA, 20 bp, Artificial
  CRISPR gRNA sequence
gaatggttggcggtgcagtg

SEQ ID NO: 328090 - DNA, 20 bp, Artificial
  CRISPR gRNA sequence
tggttggcggtgcagtgtgg

SEQ ID NO: 328091 - DNA, 20 bp, Artificial
  CRISPR gRNA sequence
ttggcggtgcagtgtggtgg

SEQ ID NO: 328092 - DNA, 20 bp, Artificial
  CRISPR gRNA sequence
agtgtggtggaagtgcattg

SEQ ID NO: 328093 - DNA, 20 bp, Artificial
  CRISPR gRNA sequence
gtggtggaagtgcattgcag

SEQ ID NO: 328094 - DNA, 20 bp, Artificial
  CRISPR gRNA sequence
agtgcattgcagtggatccc

SEQ ID NO: 328095 - DNA, 20 bp, Artificial
  CRISPR gRNA sequence
gtgcattgcagtggatccca

SEQ ID NO: 328096 - DNA, 20 bp, Artificial
  CRISPR gRNA sequence
gcagtggatcccaaggaaac

SEQ ID NO: 328097 - DNA, 20 bp, Artificial
  CRISPR gRNA sequence
agtggatcccaaggaaacca

SEQ ID NO: 328098 - DNA, 20 bp, Artificial
  CRISPR gRNA sequence
gtggatcccaaggaaaccag

SEQ ID NO: 328099 - DNA, 20 bp, Artificial
  CRISPR gRNA sequence
aggaaaccagaggcaaattc

SEQ ID NO: 328100 - DNA, 20 bp, Artificial
  CRISPR gRNA sequence
gcaaattctggctctgccac

SEQ ID NO: 328101 - DNA, 20 bp, Artificial
  CRISPR gRNA sequence
attctggctctgccactagc

SEQ ID NO: 328102 - DNA, 20 bp, Artificial
  CRISPR gRNA sequence
ttctggctctgccactagca

SEQ ID NO: 328103 - DNA, 20 bp, Artificial
  CRISPR gRNA sequence
ctgccactagcaaggctctg

SEQ ID NO: 328104 - DNA, 20 bp, Artificial
  CRISPR gRNA sequence
cactagcaaggctctgtggc

SEQ ID NO: 328105 - DNA, 20 bp, Artificial
  CRISPR gRNA sequence
actagcaaggctctgtggct

SEQ ID NO: 328106 - DNA, 20 bp, Artificial
  CRISPR gRNA sequence
ctagcaaggctctgtggcta

SEQ ID NO: 328107 - DNA, 20 bp, Artificial
  CRISPR gRNA sequence
ctgtggctagggtacccctg

SEQ ID NO: 328108 - DNA, 20 bp, Artificial
  CRISPR gRNA sequence
tagggtacccctgtggaatt

SEQ ID NO: 328109 - DNA, 20 bp, Artificial
  CRISPR gRNA sequence
gcctcctcatccgtgaaatg

SEQ ID NO: 328110 - DNA, 20 bp, Artificial
  CRISPR gRNA sequence
tcctcatccgtgaaatgaag

SEQ ID NO: 328111 - DNA, 20 bp, Artificial
  CRISPR gRNA sequence
tttctaacacctgctttctc

SEQ ID NO: 328112 - DNA, 20 bp, Artificial
  CRISPR gRNA sequence
acacctgctttctctggatt

SEQ ID NO: 328113 - DNA, 20 bp, Artificial
  CRISPR gRNA sequence
gctttctctggattcagcat

SEQ ID NO: 328114 - DNA, 20 bp, Artificial
  CRISPR gRNA sequence
attcagcatcagaatatatc

SEQ ID NO: 328115 - DNA, 20 bp, Artificial
  CRISPR gRNA sequence
gcatcagaatatatccagat

SEQ ID NO: 328116 - DNA, 20 bp, Artificial
  CRISPR gRNA sequence
agataagactgcaaacaact

SEQ ID NO: 328117 - DNA, 20 bp, Artificial
  CRISPR gRNA sequence
ataagactgcaaacaactga

SEQ ID NO: 328118 - DNA, 20 bp, Artificial
  CRISPR gRNA sequence
aagactgcaaacaactgaga

SEQ ID NO: 328119 - DNA, 20 bp, Artificial
  CRISPR gRNA sequence
gagagctaattctttgctgt

SEQ ID NO: 328120 - DNA, 20 bp, Artificial
  CRISPR gRNA sequence
agagctaattctttgctgtt

SEQ ID NO: 328121 - DNA, 20 bp, Artificial
  CRISPR gRNA sequence
ctaattctttgctgttgggt

SEQ ID NO: 328122 - DNA, 20 bp, Artificial
  CRISPR gRNA sequence
gctgttgggtaagtcttcca

SEQ ID NO: 328123 - DNA, 20 bp, Artificial
  CRISPR gRNA sequence
ctgttgggtaagtcttccaa

SEQ ID NO: 328124 - DNA, 20 bp, Artificial
  CRISPR gRNA sequence
tgttgggtaagtcttccaaa

SEQ ID NO: 328125 - DNA, 20 bp, Artificial
  CRISPR gRNA sequence
tttctgtctcaatatcataa

SEQ ID NO: 328126 - DNA, 20 bp, Artificial
  CRISPR gRNA sequence
ttctgtctcaatatcataat

SEQ ID NO: 328127 - DNA, 20 bp, Artificial
  CRISPR gRNA sequence
aatatcataatgggctattc

SEQ ID NO: 328128 - DNA, 20 bp, Artificial
  CRISPR gRNA sequence
tcataatgggctattccaga

SEQ ID NO: 328129 - DNA, 20 bp, Artificial
  CRISPR gRNA sequence
aatgggctattccagaaagt

SEQ ID NO: 328130 - DNA, 20 bp, Artificial
  CRISPR gRNA sequence
agtcagaataaattaaaata

SEQ ID NO: 328131 - DNA, 20 bp, Artificial
  CRISPR gRNA sequence
gtcagaataaattaaaataa

SEQ ID NO: 328132 - DNA, 20 bp, Artificial
  CRISPR gRNA sequence
cagaataaattaaaataaag

SEQ ID NO: 328133 - DNA, 20 bp, Artificial
  CRISPR gRNA sequence
actgtctttcttgcccacaa

SEQ ID NO: 328134 - DNA, 20 bp, Artificial
  CRISPR gRNA sequence
ttcttgcccacaaaagtatt

SEQ ID NO: 328135 - DNA, 20 bp, Artificial
  CRISPR gRNA sequence
tcttgcccacaaaagtattt

SEQ ID NO: 328136 - DNA, 20 bp, Artificial
  CRISPR gRNA sequence
tgcccacaaaagtatttagg

SEQ ID NO: 328137 - DNA, 20 bp, Artificial
  CRISPR gRNA sequence
gcccacaaaagtatttaggt

SEQ ID NO: 328138 - DNA, 20 bp, Artificial
  CRISPR gRNA sequence
caaaagtatttaggtaggac

SEQ ID NO: 328139 - DNA, 20 bp, Artificial
  CRISPR gRNA sequence
aaaagtatttaggtaggacc

SEQ ID NO: 328140 - DNA, 20 bp, Artificial
  CRISPR gRNA sequence
gtgcctcaatttttcttgaa

SEQ ID NO: 328141 - DNA, 20 bp, Artificial
  CRISPR gRNA sequence
tttttcttgaatggcatgtt

SEQ ID NO: 328142 - DNA, 20 bp, Artificial
  CRISPR gRNA sequence
tttcttgaatggcatgttga

SEQ ID NO: 328143 - DNA, 20 bp, Artificial
  CRISPR gRNA sequence
agagtgtgtgccactgacat

SEQ ID NO: 328144 - DNA, 20 bp, Artificial
  CRISPR gRNA sequence
tgtgccactgacatcagctg

SEQ ID NO: 328145 - DNA, 20 bp, Artificial
  CRISPR gRNA sequence
ctgacatcagctgaagattt

SEQ ID NO: 328146 - DNA, 20 bp, Artificial
  CRISPR gRNA sequence
gacatcagctgaagatttca

SEQ ID NO: 328147 - DNA, 20 bp, Artificial
  CRISPR gRNA sequence
tttcagagtgtcatttctat

SEQ ID NO: 328148 - DNA, 20 bp, Artificial
  CRISPR gRNA sequence
acactctttttttttttttt

SEQ ID NO: 328149 - DNA, 20 bp, Artificial
  CRISPR gRNA sequence
tcttttttttttttttgaga

SEQ ID NO: 328150 - DNA, 20 bp, Artificial
  CRISPR gRNA sequence
ttttttttttttttgagatg

SEQ ID NO: 328151 - DNA, 20 bp, Artificial
  CRISPR gRNA sequence
atggagtcttgttctgtcac

SEQ ID NO: 328152 - DNA, 20 bp, Artificial
  CRISPR gRNA sequence
gagtcttgttctgtcaccag

SEQ ID NO: 328153 - DNA, 20 bp, Artificial
  CRISPR gRNA sequence
agtcttgttctgtcaccagc

SEQ ID NO: 328154 - DNA, 20 bp, Artificial
  CRISPR gRNA sequence
ttgttctgtcaccagcaggc

SEQ ID NO: 328155 - DNA, 20 bp, Artificial
  CRISPR gRNA sequence
gttctgtcaccagcaggcta

SEQ ID NO: 328156 - DNA, 20 bp, Artificial
  CRISPR gRNA sequence
gtcaccagcaggctagagtg

SEQ ID NO: 328157 - DNA, 20 bp, Artificial
  CRISPR gRNA sequence
accagcaggctagagtgcag

SEQ ID NO: 328158 - DNA, 20 bp, Artificial
  CRISPR gRNA sequence
agagtgcagtggtgcaatct

SEQ ID NO: 328159 - DNA, 20 bp, Artificial
  CRISPR gRNA sequence
tcactgcaacctctgcctcc

SEQ ID NO: 328160 - DNA, 20 bp, Artificial
  CRISPR gRNA sequence
cactgcaacctctgcctcct

SEQ ID NO: 328161 - DNA, 20 bp, Artificial
  CRISPR gRNA sequence
aacctctgcctcctaggttc

SEQ ID NO: 328162 - DNA, 20 bp, Artificial
  CRISPR gRNA sequence
ttcaagcgattctgctgcct

SEQ ID NO: 328163 - DNA, 20 bp, Artificial
  CRISPR gRNA sequence
ttctgctgcctcagcttccc

SEQ ID NO: 328164 - DNA, 20 bp, Artificial
  CRISPR gRNA sequence
tgctgcctcagcttcccaag

SEQ ID NO: 328165 - DNA, 20 bp, Artificial
  CRISPR gRNA sequence
gcctcagcttcccaagtagc

SEQ ID NO: 328166 - DNA, 20 bp, Artificial
  CRISPR gRNA sequence
cctcagcttcccaagtagct

SEQ ID NO: 328167 - DNA, 20 bp, Artificial
  CRISPR gRNA sequence
ttcccaagtagctgggacta

SEQ ID NO: 328168 - DNA, 20 bp, Artificial
  CRISPR gRNA sequence
cagtcacatgccaccatgct

SEQ ID NO: 328169 - DNA, 20 bp, Artificial
  CRISPR gRNA sequence
tcagctaatttttgtatttt

SEQ ID NO: 328170 - DNA, 20 bp, Artificial
  CRISPR gRNA sequence
gctaatttttgtatttttag

SEQ ID NO: 328171 - DNA, 20 bp, Artificial
  CRISPR gRNA sequence
taatttttgtatttttagta

SEQ ID NO: 328172 - DNA, 20 bp, Artificial
  CRISPR gRNA sequence
ttttgtatttttagtagaga

SEQ ID NO: 328173 - DNA, 20 bp, Artificial
  CRISPR gRNA sequence
tttgtatttttagtagagac

SEQ ID NO: 328174 - DNA, 20 bp, Artificial
  CRISPR gRNA sequence
ttgtatttttagtagagaca

SEQ ID NO: 328175 - DNA, 20 bp, Artificial
  CRISPR gRNA sequence
gagacagggtttcaccgtgt

SEQ ID NO: 328176 - DNA, 20 bp, Artificial
  CRISPR gRNA sequence
cagggtttcaccgtgttggc

SEQ ID NO: 328177 - DNA, 20 bp, Artificial
  CRISPR gRNA sequence
agggtttcaccgtgttggcc

SEQ ID NO: 328178 - DNA, 20 bp, Artificial
  CRISPR gRNA sequence
tttcaccgtgttggccagga

SEQ ID NO: 328179 - DNA, 20 bp, Artificial
  CRISPR gRNA sequence
acctcacgatccgcccacct

SEQ ID NO: 328180 - DNA, 20 bp, Artificial
  CRISPR gRNA sequence
ccgcccaccttggcctccca

SEQ ID NO: 328181 - DNA, 20 bp, Artificial
  CRISPR gRNA sequence
accttggcctcccaaagtgc

SEQ ID NO: 328182 - DNA, 20 bp, Artificial
  CRISPR gRNA sequence
ccttggcctcccaaagtgct

SEQ ID NO: 328183 - DNA, 20 bp, Artificial
  CRISPR gRNA sequence
tcccaaagtgctgggattat

SEQ ID NO: 328184 - DNA, 20 bp, Artificial
  CRISPR gRNA sequence
agtgctgggattataagcgt

SEQ ID NO: 328185 - DNA, 20 bp, Artificial
  CRISPR gRNA sequence
taagcgtgagccaccgcacc

SEQ ID NO: 328186 - DNA, 20 bp, Artificial
  CRISPR gRNA sequence
gtgagccaccgcacctggcc

SEQ ID NO: 328187 - DNA, 20 bp, Artificial
  CRISPR gRNA sequence
tctttaacttaaaaactacc

SEQ ID NO: 328188 - DNA, 20 bp, Artificial
  CRISPR gRNA sequence
cgcctatttattatgaaatg

SEQ ID NO: 328189 - DNA, 20 bp, Artificial
  CRISPR gRNA sequence
ttattatgaaatgtagtgat

SEQ ID NO: 328190 - DNA, 20 bp, Artificial
  CRISPR gRNA sequence
ttatgaaatgtagtgatcag

SEQ ID NO: 328191 - DNA, 20 bp, Artificial
  CRISPR gRNA sequence
tatgaaatgtagtgatcaga

SEQ ID NO: 328192 - DNA, 20 bp, Artificial
  CRISPR gRNA sequence
tagtgatcagaaggctgact

SEQ ID NO: 328193 - DNA, 20 bp, Artificial
  CRISPR gRNA sequence
agtgatcagaaggctgactt

SEQ ID NO: 328194 - DNA, 20 bp, Artificial
  CRISPR gRNA sequence
gacttaggtttccacatatc

SEQ ID NO: 328195 - DNA, 20 bp, Artificial
  CRISPR gRNA sequence
cagtgtttaaactttccatc

SEQ ID NO: 328196 - DNA, 20 bp, Artificial
  CRISPR gRNA sequence
ccatctggaaaaccgcttga

SEQ ID NO: 328197 - DNA, 20 bp, Artificial
  CRISPR gRNA sequence
gaaaaccgcttgacagctct

SEQ ID NO: 328198 - DNA, 20 bp, Artificial
  CRISPR gRNA sequence
gcttgacagctctaagtctg

SEQ ID NO: 328199 - DNA, 20 bp, Artificial
  CRISPR gRNA sequence
agttcgaatgtttttaacta

SEQ ID NO: 328200 - DNA, 20 bp, Artificial
  CRISPR gRNA sequence
taattatttcataactattt

SEQ ID NO: 328201 - DNA, 20 bp, Artificial
  CRISPR gRNA sequence
ttatttcataactattttgg

SEQ ID NO: 328202 - DNA, 20 bp, Artificial
  CRISPR gRNA sequence
cataactattttggcagata

SEQ ID NO: 328203 - DNA, 20 bp, Artificial
  CRISPR gRNA sequence
ctattttggcagatatagaa

SEQ ID NO: 328204 - DNA, 20 bp, Artificial
  CRISPR gRNA sequence
tagaacagatatgcttgcta

SEQ ID NO: 328205 - DNA, 20 bp, Artificial
  CRISPR gRNA sequence
tcatattgaaaattaatccc

SEQ ID NO: 328206 - DNA, 20 bp, Artificial
  CRISPR gRNA sequence
aaaattaatccccagtgtaa

SEQ ID NO: 328207 - DNA, 20 bp, Artificial
  CRISPR gRNA sequence
aatccccagtgtaatagaat

SEQ ID NO: 328208 - DNA, 20 bp, Artificial
  CRISPR gRNA sequence
atccccagtgtaatagaatt

SEQ ID NO: 328209 - DNA, 20 bp, Artificial
  CRISPR gRNA sequence
ccccagtgtaatagaattgg

SEQ ID NO: 328210 - DNA, 20 bp, Artificial
  CRISPR gRNA sequence
cccagtgtaatagaattggg

SEQ ID NO: 328211 - DNA, 20 bp, Artificial
  CRISPR gRNA sequence
agtgtaatagaattgggagg

SEQ ID NO: 328212 - DNA, 20 bp, Artificial
  CRISPR gRNA sequence
gtgtaatagaattgggaggt

SEQ ID NO: 328213 - DNA, 20 bp, Artificial
  CRISPR gRNA sequence
tgtaatagaattgggaggtg

SEQ ID NO: 328214 - DNA, 20 bp, Artificial
  CRISPR gRNA sequence
aattgggaggtggggccttt

SEQ ID NO: 328215 - DNA, 20 bp, Artificial
  CRISPR gRNA sequence
ttgggaggtggggcctttaa

SEQ ID NO: 328216 - DNA, 20 bp, Artificial
  CRISPR gRNA sequence
tggggcctttaagagatgat

SEQ ID NO: 328217 - DNA, 20 bp, Artificial
  CRISPR gRNA sequence
ggcctttaagagatgattgg

SEQ ID NO: 328218 - DNA, 20 bp, Artificial
  CRISPR gRNA sequence
attggcagaacccccatgaa

SEQ ID NO: 328219 - DNA, 20 bp, Artificial
  CRISPR gRNA sequence
gaatagcttaatccaattca

SEQ ID NO: 328220 - DNA, 20 bp, Artificial
  CRISPR gRNA sequence
aatagcttaatccaattcat

SEQ ID NO: 328221 - DNA, 20 bp, Artificial
  CRISPR gRNA sequence
taatccaattcatgggttaa

SEQ ID NO: 328222 - DNA, 20 bp, Artificial
  CRISPR gRNA sequence
aatccaattcatgggttaat

SEQ ID NO: 328223 - DNA, 20 bp, Artificial
  CRISPR gRNA sequence
ttcatgggttaatgggttaa

SEQ ID NO: 328224 - DNA, 20 bp, Artificial
  CRISPR gRNA sequence
ttaatgggttaacagattaa

SEQ ID NO: 328225 - DNA, 20 bp, Artificial
  CRISPR gRNA sequence
taatgggttaacagattaat

SEQ ID NO: 328226 - DNA, 20 bp, Artificial
  CRISPR gRNA sequence
aacagattaataggttatca

SEQ ID NO: 328227 - DNA, 20 bp, Artificial
  CRISPR gRNA sequence
acagattaataggttatcac

SEQ ID NO: 328228 - DNA, 20 bp, Artificial
  CRISPR gRNA sequence
agattaataggttatcacag

SEQ ID NO: 328229 - DNA, 20 bp, Artificial
  CRISPR gRNA sequence
ttaataggttatcacaggag

SEQ ID NO: 328230 - DNA, 20 bp, Artificial
  CRISPR gRNA sequence
taataggttatcacaggagt

SEQ ID NO: 328231 - DNA, 20 bp, Artificial
  CRISPR gRNA sequence
aggagtgggttaattatcat

SEQ ID NO: 328232 - DNA, 20 bp, Artificial
  CRISPR gRNA sequence
gagtgggttaattatcatga

SEQ ID NO: 328233 - DNA, 20 bp, Artificial
  CRISPR gRNA sequence
gggttaattatcatgagagt

SEQ ID NO: 328234 - DNA, 20 bp, Artificial
  CRISPR gRNA sequence
gagagttagtatgttataaa

SEQ ID NO: 328235 - DNA, 20 bp, Artificial
  CRISPR gRNA sequence
gttagtatgttataaacagc

SEQ ID NO: 328236 - DNA, 20 bp, Artificial
  CRISPR gRNA sequence
tatgttataaacagccagat

SEQ ID NO: 328237 - DNA, 20 bp, Artificial
  CRISPR gRNA sequence
agccagattggctgtctctc

SEQ ID NO: 328238 - DNA, 20 bp, Artificial
  CRISPR gRNA sequence
tgtaatcctctgtactgcct

SEQ ID NO: 328239 - DNA, 20 bp, Artificial
  CRISPR gRNA sequence
gtaatcctctgtactgcctt

SEQ ID NO: 328240 - DNA, 20 bp, Artificial
  CRISPR gRNA sequence
tactgccttgggcctctgat

SEQ ID NO: 328241 - DNA, 20 bp, Artificial
  CRISPR gRNA sequence
cctctgatgagtgtccccac

SEQ ID NO: 328242 - DNA, 20 bp, Artificial
  CRISPR gRNA sequence
tgatgagtgtccccaccaga

SEQ ID NO: 328243 - DNA, 20 bp, Artificial
  CRISPR gRNA sequence
tgagtgtccccaccagaaag

SEQ ID NO: 328244 - DNA, 20 bp, Artificial
  CRISPR gRNA sequence
gagtgtccccaccagaaaga

SEQ ID NO: 328245 - DNA, 20 bp, Artificial
  CRISPR gRNA sequence
accagaaagaaggccctcac

SEQ ID NO: 328246 - DNA, 20 bp, Artificial
  CRISPR gRNA sequence
ccctcaccagatttcgcccc

SEQ ID NO: 328247 - DNA, 20 bp, Artificial
  CRISPR gRNA sequence
cctcaccagatttcgcccct

SEQ ID NO: 328248 - DNA, 20 bp, Artificial
  CRISPR gRNA sequence
cagatttcgcccctaggcct

SEQ ID NO: 328249 - DNA, 20 bp, Artificial
  CRISPR gRNA sequence
ttcgcccctaggcctcagcc

SEQ ID NO: 328250 - DNA, 20 bp, Artificial
  CRISPR gRNA sequence
cctaggcctcagcctagacc

SEQ ID NO: 328251 - DNA, 20 bp, Artificial
  CRISPR gRNA sequence
ctaggcctcagcctagacct

SEQ ID NO: 328252 - DNA, 20 bp, Artificial
  CRISPR gRNA sequence
tcagcctagacctaggcccc

SEQ ID NO: 328253 - DNA, 20 bp, Artificial
  CRISPR gRNA sequence
gacctaggcccctagacccc

SEQ ID NO: 328254 - DNA, 20 bp, Artificial
  CRISPR gRNA sequence
ggcccctagacccctagact

SEQ ID NO: 328255 - DNA, 20 bp, Artificial
  CRISPR gRNA sequence
gcccctagacccctagactt

SEQ ID NO: 328256 - DNA, 20 bp, Artificial
  CRISPR gRNA sequence
agacccctagacttaggccc

SEQ ID NO: 328257 - DNA, 20 bp, Artificial
  CRISPR gRNA sequence
tagacttaggccccagcctc

SEQ ID NO: 328258 - DNA, 20 bp, Artificial
  CRISPR gRNA sequence
gccccagcctccagaactgt

SEQ ID NO: 328259 - DNA, 20 bp, Artificial
  CRISPR gRNA sequence
tcttttctttataaattacc

SEQ ID NO: 328260 - DNA, 20 bp, Artificial
  CRISPR gRNA sequence
tttataaattacccagtctc

SEQ ID NO: 328261 - DNA, 20 bp, Artificial
  CRISPR gRNA sequence
attacccagtctccggtatt

SEQ ID NO: 328262 - DNA, 20 bp, Artificial
  CRISPR gRNA sequence
cagtctccggtattcagtga

SEQ ID NO: 328263 - DNA, 20 bp, Artificial
  CRISPR gRNA sequence
ccggtattcagtgatagcaa

SEQ ID NO: 328264 - DNA, 20 bp, Artificial
  CRISPR gRNA sequence
tcagtgatagcaacagaaaa

SEQ ID NO: 328265 - DNA, 20 bp, Artificial
  CRISPR gRNA sequence
atagcaacagaaaatggact

SEQ ID NO: 328266 - DNA, 20 bp, Artificial
  CRISPR gRNA sequence
gacaaattacaaattcttct

SEQ ID NO: 328267 - DNA, 20 bp, Artificial
  CRISPR gRNA sequence
tacaaattcttcttagcctt

SEQ ID NO: 328268 - DNA, 20 bp, Artificial
  CRISPR gRNA sequence
cctttggtaacatttgaaaa

SEQ ID NO: 328269 - DNA, 20 bp, Artificial
  CRISPR gRNA sequence
aacatttgaaaatagtatta

SEQ ID NO: 328270 - DNA, 20 bp, Artificial
  CRISPR gRNA sequence
acatttgaaaatagtattaa

SEQ ID NO: 328271 - DNA, 20 bp, Artificial
  CRISPR gRNA sequence
atttgaaaatagtattaaag

SEQ ID NO: 328272 - DNA, 20 bp, Artificial
  CRISPR gRNA sequence
gccccttataaccatgacta

SEQ ID NO: 328273 - DNA, 20 bp, Artificial
  CRISPR gRNA sequence
accatgactaaagcatttaa

SEQ ID NO: 328274 - DNA, 20 bp, Artificial
  CRISPR gRNA sequence
tgactaaagcatttaatgga

SEQ ID NO: 328275 - DNA, 20 bp, Artificial
  CRISPR gRNA sequence
atttaatggatagacaattt

SEQ ID NO: 328276 - DNA, 20 bp, Artificial
  CRISPR gRNA sequence
tttaatggatagacaattta

SEQ ID NO: 328277 - DNA, 20 bp, Artificial
  CRISPR gRNA sequence
aatggatagacaatttaagg

SEQ ID NO: 328278 - DNA, 20 bp, Artificial
  CRISPR gRNA sequence
taaggaagatctgaatacgt

SEQ ID NO: 328279 - DNA, 20 bp, Artificial
  CRISPR gRNA sequence
ttagtttcttataactgcaa

SEQ ID NO: 328280 - DNA, 20 bp, Artificial
  CRISPR gRNA sequence
cttataactgcaaaagcatc

SEQ ID NO: 328281 - DNA, 20 bp, Artificial
  CRISPR gRNA sequence
ttataactgcaaaagcatct

SEQ ID NO: 328282 - DNA, 20 bp, Artificial
  CRISPR gRNA sequence
gatcttttctccatccttct

SEQ ID NO: 328283 - DNA, 20 bp, Artificial
  CRISPR gRNA sequence
tcttggatgttcttatctcc

SEQ ID NO: 328284 - DNA, 20 bp, Artificial
  CRISPR gRNA sequence
ttatctccaagtctaatact

SEQ ID NO: 328285 - DNA, 20 bp, Artificial
  CRISPR gRNA sequence
tccaagtctaatactcagcc

SEQ ID NO: 328286 - DNA, 20 bp, Artificial
  CRISPR gRNA sequence
taatactcagcctggaatgc

SEQ ID NO: 328287 - DNA, 20 bp, Artificial
  CRISPR gRNA sequence
agcctggaatgctggtatga

SEQ ID NO: 328288 - DNA, 20 bp, Artificial
  CRISPR gRNA sequence
tggaatgctggtatgataga

SEQ ID NO: 328289 - DNA, 20 bp, Artificial
  CRISPR gRNA sequence
gatagatagcaccactttta

SEQ ID NO: 328290 - DNA, 20 bp, Artificial
  CRISPR gRNA sequence
gatagcaccacttttataga

SEQ ID NO: 328291 - DNA, 20 bp, Artificial
  CRISPR gRNA sequence
tagatagtgtctgctctgat

SEQ ID NO: 328292 - DNA, 20 bp, Artificial
  CRISPR gRNA sequence
tagtgtctgctctgattggt

SEQ ID NO: 328293 - DNA, 20 bp, Artificial
  CRISPR gRNA sequence
agtgtctgctctgattggta

SEQ ID NO: 328294 - DNA, 20 bp, Artificial
  CRISPR gRNA sequence
ggtaaggtgtcaaatctatt

SEQ ID NO: 328295 - DNA, 20 bp, Artificial
  CRISPR gRNA sequence
ggtcaattctgttgccatac

SEQ ID NO: 328296 - DNA, 20 bp, Artificial
  CRISPR gRNA sequence
caattctgttgccataccag

SEQ ID NO: 328297 - DNA, 20 bp, Artificial
  CRISPR gRNA sequence
taccagtagttaaaaattgt

SEQ ID NO: 328298 - DNA, 20 bp, Artificial
  CRISPR gRNA sequence
ttcatcaacacttcatgttt

SEQ ID NO: 328299 - DNA, 20 bp, Artificial
  CRISPR gRNA sequence
tcatcaacacttcatgtttc

SEQ ID NO: 328300 - DNA, 20 bp, Artificial
  CRISPR gRNA sequence
aggcatcctataaataccct

SEQ ID NO: 328301 - DNA, 20 bp, Artificial
  CRISPR gRNA sequence
aacatgattcaacctcttct

SEQ ID NO: 328302 - DNA, 20 bp, Artificial
  CRISPR gRNA sequence
cctcttctcagcatcataca

SEQ ID NO: 328303 - DNA, 20 bp, Artificial
  CRISPR gRNA sequence
ttctcagcatcatacacagt

SEQ ID NO: 328304 - DNA, 20 bp, Artificial
  CRISPR gRNA sequence
gcatcatacacagtcagatc

SEQ ID NO: 328305 - DNA, 20 bp, Artificial
  CRISPR gRNA sequence
tgacctcttttgtgtacata

SEQ ID NO: 328306 - DNA, 20 bp, Artificial
  CRISPR gRNA sequence
tgtgtacatacagacaactg

SEQ ID NO: 328307 - DNA, 20 bp, Artificial
  CRISPR gRNA sequence
gtgtacatacagacaactga

SEQ ID NO: 328308 - DNA, 20 bp, Artificial
  CRISPR gRNA sequence
catacagacaactgaaggcc

SEQ ID NO: 328309 - DNA, 20 bp, Artificial
  CRISPR gRNA sequence
cagacaactgaaggcccaga

SEQ ID NO: 328310 - DNA, 20 bp, Artificial
  CRISPR gRNA sequence
acagattaaattatttgccc

SEQ ID NO: 328311 - DNA, 20 bp, Artificial
  CRISPR gRNA sequence
cagattaaattatttgcccg

SEQ ID NO: 328312 - DNA, 20 bp, Artificial
  CRISPR gRNA sequence
attatttgcccgaggtcaca

SEQ ID NO: 328313 - DNA, 20 bp, Artificial
  CRISPR gRNA sequence
cccgaggtcacacagcttcc

SEQ ID NO: 328314 - DNA, 20 bp, Artificial
  CRISPR gRNA sequence
ccgaggtcacacagcttcct

SEQ ID NO: 328315 - DNA, 20 bp, Artificial
  CRISPR gRNA sequence
acagcttcctgggtgcatga

SEQ ID NO: 328316 - DNA, 20 bp, Artificial
  CRISPR gRNA sequence
ctgggtgcatgaaagatttt

SEQ ID NO: 328317 - DNA, 20 bp, Artificial
  CRISPR gRNA sequence
aagatttttggttcaatcca

SEQ ID NO: 328318 - DNA, 20 bp, Artificial
  CRISPR gRNA sequence
tttggttcaatccacagtca

SEQ ID NO: 328319 - DNA, 20 bp, Artificial
  CRISPR gRNA sequence
atccacagtcaaagtgtcac

SEQ ID NO: 328320 - DNA, 20 bp, Artificial
  CRISPR gRNA sequence
gtgtcactagcaacaatcaa

SEQ ID NO: 328321 - DNA, 20 bp, Artificial
  CRISPR gRNA sequence
tcactagcaacaatcaacag

SEQ ID NO: 328322 - DNA, 20 bp, Artificial
  CRISPR gRNA sequence
aacaatcaacagaagtataa

SEQ ID NO: 328323 - DNA, 20 bp, Artificial
  CRISPR gRNA sequence
aatcaacagaagtataatag

SEQ ID NO: 328324 - DNA, 20 bp, Artificial
  CRISPR gRNA sequence
caacagaagtataatagaag

SEQ ID NO: 328325 - DNA, 20 bp, Artificial
  CRISPR gRNA sequence
aacagaagtataatagaagc

SEQ ID NO: 328326 - DNA, 20 bp, Artificial
  CRISPR gRNA sequence
ataatagaagcaggcaacca

SEQ ID NO: 328327 - DNA, 20 bp, Artificial
  CRISPR gRNA sequence
taatagaagcaggcaaccac

SEQ ID NO: 328328 - DNA, 20 bp, Artificial
  CRISPR gRNA sequence
tagaagcaggcaaccacagg

SEQ ID NO: 328329 - DNA, 20 bp, Artificial
  CRISPR gRNA sequence
agcaggcaaccacaggaagc

SEQ ID NO: 328330 - DNA, 20 bp, Artificial
  CRISPR gRNA sequence
ggcaaccacaggaagctaga

SEQ ID NO: 328331 - DNA, 20 bp, Artificial
  CRISPR gRNA sequence
aaccacaggaagctagacag

SEQ ID NO: 328332 - DNA, 20 bp, Artificial
  CRISPR gRNA sequence
gacagtggtcactaacaact

SEQ ID NO: 328333 - DNA, 20 bp, Artificial
  CRISPR gRNA sequence
tcactaacaactgagtgtta

SEQ ID NO: 328334 - DNA, 20 bp, Artificial
  CRISPR gRNA sequence
cactaacaactgagtgttac

SEQ ID NO: 328335 - DNA, 20 bp, Artificial
  CRISPR gRNA sequence
acaactgagtgttacaggac

SEQ ID NO: 328336 - DNA, 20 bp, Artificial
  CRISPR gRNA sequence
gaccagtgctaaaaatctgt

SEQ ID NO: 328337 - DNA, 20 bp, Artificial
  CRISPR gRNA sequence
cagtgctaaaaatctgtgag

SEQ ID NO: 328338 - DNA, 20 bp, Artificial
  CRISPR gRNA sequence
agtgctaaaaatctgtgagc

SEQ ID NO: 328339 - DNA, 20 bp, Artificial
  CRISPR gRNA sequence
gctaaaaatctgtgagcagg

SEQ ID NO: 328340 - DNA, 20 bp, Artificial
  CRISPR gRNA sequence
caggaagaacgcctaatttc

SEQ ID NO: 328341 - DNA, 20 bp, Artificial
  CRISPR gRNA sequence
cacctctgttttatgtccaa

SEQ ID NO: 328342 - DNA, 20 bp, Artificial
  CRISPR gRNA sequence
tatccacttctcctccatct

SEQ ID NO: 328343 - DNA, 20 bp, Artificial
  CRISPR gRNA sequence
tcctccatctcagcttcaac

SEQ ID NO: 328344 - DNA, 20 bp, Artificial
  CRISPR gRNA sequence
aaaccattgtcatctctctc

SEQ ID NO: 328345 - DNA, 20 bp, Artificial
  CRISPR gRNA sequence
aaccattgtcatctctctct

SEQ ID NO: 328346 - DNA, 20 bp, Artificial
  CRISPR gRNA sequence
tcatctctctctgggactac

SEQ ID NO: 328347 - DNA, 20 bp, Artificial
  CRISPR gRNA sequence
atctctctctgggactacaa

SEQ ID NO: 328348 - DNA, 20 bp, Artificial
  CRISPR gRNA sequence
catttacaatccattctcca

SEQ ID NO: 328349 - DNA, 20 bp, Artificial
  CRISPR gRNA sequence
tttacaatccattctccaca

SEQ ID NO: 328350 - DNA, 20 bp, Artificial
  CRISPR gRNA sequence
tccattctccacagagaaac

SEQ ID NO: 328351 - DNA, 20 bp, Artificial
  CRISPR gRNA sequence
ttcttacatgcataatccaa

SEQ ID NO: 328352 - DNA, 20 bp, Artificial
  CRISPR gRNA sequence
cttacatgcataatccaata

SEQ ID NO: 328353 - DNA, 20 bp, Artificial
  CRISPR gRNA sequence
tgttctgcttataaaacctc

SEQ ID NO: 328354 - DNA, 20 bp, Artificial
  CRISPR gRNA sequence
gttctgcttataaaacctcc

SEQ ID NO: 328355 - DNA, 20 bp, Artificial
  CRISPR gRNA sequence
ggtgcttctcattccactta

SEQ ID NO: 328356 - DNA, 20 bp, Artificial
  CRISPR gRNA sequence
ttccacttacagtaaaatct

SEQ ID NO: 328357 - DNA, 20 bp, Artificial
  CRISPR gRNA sequence
taaaatctaagttcttaccc

SEQ ID NO: 328358 - DNA, 20 bp, Artificial
  CRISPR gRNA sequence
tacctctccccattttatac

SEQ ID NO: 328359 - DNA, 20 bp, Artificial
  CRISPR gRNA sequence
accagtcacacactacacca

SEQ ID NO: 328360 - DNA, 20 bp, Artificial
  CRISPR gRNA sequence
ttctgttcctcaaacacaca

SEQ ID NO: 328361 - DNA, 20 bp, Artificial
  CRISPR gRNA sequence
tgttcctcaaacacacaaag

SEQ ID NO: 328362 - DNA, 20 bp, Artificial
  CRISPR gRNA sequence
gttcctcaaacacacaaagc

SEQ ID NO: 328363 - DNA, 20 bp, Artificial
  CRISPR gRNA sequence
aaacacacaaagcaggttcc

SEQ ID NO: 328364 - DNA, 20 bp, Artificial
  CRISPR gRNA sequence
aacacacaaagcaggttccc

SEQ ID NO: 328365 - DNA, 20 bp, Artificial
  CRISPR gRNA sequence
acacacaaagcaggttccca

SEQ ID NO: 328366 - DNA, 20 bp, Artificial
  CRISPR gRNA sequence
taatttctcatttctccacc

SEQ ID NO: 328367 - DNA, 20 bp, Artificial
  CRISPR gRNA sequence
cattctctctgattttcaca

SEQ ID NO: 328368 - DNA, 20 bp, Artificial
  CRISPR gRNA sequence
ctgcttctttgtcatcgttc

SEQ ID NO: 328369 - DNA, 20 bp, Artificial
  CRISPR gRNA sequence
gcttctttgtcatcgttcaa

SEQ ID NO: 328370 - DNA, 20 bp, Artificial
  CRISPR gRNA sequence
caagagtaatgacacttctt

SEQ ID NO: 328371 - DNA, 20 bp, Artificial
  CRISPR gRNA sequence
gacacttcttcagtgaccac

SEQ ID NO: 328372 - DNA, 20 bp, Artificial
  CRISPR gRNA sequence
accactggccacccaatcta

SEQ ID NO: 328373 - DNA, 20 bp, Artificial
  CRISPR gRNA sequence
cccaatctaaagaatatatc

SEQ ID NO: 328374 - DNA, 20 bp, Artificial
  CRISPR gRNA sequence
ccaatctaaagaatatatcc

SEQ ID NO: 328375 - DNA, 20 bp, Artificial
  CRISPR gRNA sequence
aatatatccaggtcattatc

SEQ ID NO: 328376 - DNA, 20 bp, Artificial
  CRISPR gRNA sequence
ctagtacattaactgacata

SEQ ID NO: 328377 - DNA, 20 bp, Artificial
  CRISPR gRNA sequence
tatcactgtctgaaattatc

SEQ ID NO: 328378 - DNA, 20 bp, Artificial
  CRISPR gRNA sequence
ttgttttcttctttattgtc

SEQ ID NO: 328379 - DNA, 20 bp, Artificial
  CRISPR gRNA sequence
ttgtctggctactccactct

SEQ ID NO: 328380 - DNA, 20 bp, Artificial
  CRISPR gRNA sequence
tccactctaagctttaaaac

SEQ ID NO: 328381 - DNA, 20 bp, Artificial
  CRISPR gRNA sequence
ccactctaagctttaaaacc

SEQ ID NO: 328382 - DNA, 20 bp, Artificial
  CRISPR gRNA sequence
cactctaagctttaaaacca

SEQ ID NO: 328383 - DNA, 20 bp, Artificial
  CRISPR gRNA sequence
tttaaaaccagggaccttgt

SEQ ID NO: 328384 - DNA, 20 bp, Artificial
  CRISPR gRNA sequence
cttattcacaaatccatccc

SEQ ID NO: 328385 - DNA, 20 bp, Artificial
  CRISPR gRNA sequence
caagtatctacaataatacc

SEQ ID NO: 328386 - DNA, 20 bp, Artificial
  CRISPR gRNA sequence
aataatacctggtgtgttgt

SEQ ID NO: 328387 - DNA, 20 bp, Artificial
  CRISPR gRNA sequence
ggtgtgttgtaagctgcaat

SEQ ID NO: 328388 - DNA, 20 bp, Artificial
  CRISPR gRNA sequence
aagctgcaatcagtatttat

SEQ ID NO: 328389 - DNA, 20 bp, Artificial
  CRISPR gRNA sequence
tgcaatcagtatttattgga

SEQ ID NO: 328390 - DNA, 20 bp, Artificial
  CRISPR gRNA sequence
agtatttattggatggatga

SEQ ID NO: 328391 - DNA, 20 bp, Artificial
  CRISPR gRNA sequence
ttattggatggatgaaagca

SEQ ID NO: 328392 - DNA, 20 bp, Artificial
  CRISPR gRNA sequence
tggatggatgaaagcatggt

SEQ ID NO: 328393 - DNA, 20 bp, Artificial
  CRISPR gRNA sequence
tggatgaaagcatggttgga

SEQ ID NO: 328394 - DNA, 20 bp, Artificial
  CRISPR gRNA sequence
ggatgaaagcatggttggat

SEQ ID NO: 328395 - DNA, 20 bp, Artificial
  CRISPR gRNA sequence
tgggcgaacaaatgaatata

SEQ ID NO: 328396 - DNA, 20 bp, Artificial
  CRISPR gRNA sequence
cgaacaaatgaatatataga

SEQ ID NO: 328397 - DNA, 20 bp, Artificial
  CRISPR gRNA sequence
gacggtgacattttaaatct

SEQ ID NO: 328398 - DNA, 20 bp, Artificial
  CRISPR gRNA sequence
acggtgacattttaaatctg

SEQ ID NO: 328399 - DNA, 20 bp, Artificial
  CRISPR gRNA sequence
ggtgacattttaaatctgag

SEQ ID NO: 328400 - DNA, 20 bp, Artificial
  CRISPR gRNA sequence
attttaaatctgaggagatg

SEQ ID NO: 328401 - DNA, 20 bp, Artificial
  CRISPR gRNA sequence
aaatctgaggagatgaagca

SEQ ID NO: 328402 - DNA, 20 bp, Artificial
  CRISPR gRNA sequence
aatctgaggagatgaagcac

SEQ ID NO: 328403 - DNA, 20 bp, Artificial
  CRISPR gRNA sequence
aagcacaggatttataatat

SEQ ID NO: 328404 - DNA, 20 bp, Artificial
  CRISPR gRNA sequence
gcacaggatttataatataa

SEQ ID NO: 328405 - DNA, 20 bp, Artificial
  CRISPR gRNA sequence
atttataatataagagccaa

SEQ ID NO: 328406 - DNA, 20 bp, Artificial
  CRISPR gRNA sequence
tttataatataagagccaaa

SEQ ID NO: 328407 - DNA, 20 bp, Artificial
  CRISPR gRNA sequence
ttataatataagagccaaaa

SEQ ID NO: 328408 - DNA, 20 bp, Artificial
  CRISPR gRNA sequence
ataagagccaaaagggcttc

SEQ ID NO: 328409 - DNA, 20 bp, Artificial
  CRISPR gRNA sequence
aaagggcttctagaaatgac

SEQ ID NO: 328410 - DNA, 20 bp, Artificial
  CRISPR gRNA sequence
ttgcatttatcaaattaaac

SEQ ID NO: 328411 - DNA, 20 bp, Artificial
  CRISPR gRNA sequence
gcatttatcaaattaaacta

SEQ ID NO: 328412 - DNA, 20 bp, Artificial
  CRISPR gRNA sequence
ttatcaaattaaactagagc

SEQ ID NO: 328413 - DNA, 20 bp, Artificial
  CRISPR gRNA sequence
aaattaaactagagccagaa

SEQ ID NO: 328414 - DNA, 20 bp, Artificial
  CRISPR gRNA sequence
aattaaactagagccagaaa

SEQ ID NO: 328415 - DNA, 20 bp, Artificial
  CRISPR gRNA sequence
gaaaaggtgactatcttgcc

SEQ ID NO: 328416 - DNA, 20 bp, Artificial
  CRISPR gRNA sequence
aaaaggtgactatcttgccc

SEQ ID NO: 328417 - DNA, 20 bp, Artificial
  CRISPR gRNA sequence
ctatcttgcccaggattaca

SEQ ID NO: 328418 - DNA, 20 bp, Artificial
  CRISPR gRNA sequence
gcccaggattacatagctca

SEQ ID NO: 328419 - DNA, 20 bp, Artificial
  CRISPR gRNA sequence
aggattacatagctcatagc

SEQ ID NO: 328420 - DNA, 20 bp, Artificial
  CRISPR gRNA sequence
ggattacatagctcatagct

SEQ ID NO: 328421 - DNA, 20 bp, Artificial
  CRISPR gRNA sequence
gattacatagctcatagctg

SEQ ID NO: 328422 - DNA, 20 bp, Artificial
  CRISPR gRNA sequence
tcatagctggggcatgatcc

SEQ ID NO: 328423 - DNA, 20 bp, Artificial
  CRISPR gRNA sequence
atagctggggcatgatccca

SEQ ID NO: 328424 - DNA, 20 bp, Artificial
  CRISPR gRNA sequence
ctggggcatgatcccagagt

SEQ ID NO: 328425 - DNA, 20 bp, Artificial
  CRISPR gRNA sequence
ccatattattgcttttcttc

SEQ ID NO: 328426 - DNA, 20 bp, Artificial
  CRISPR gRNA sequence
attgcttttcttctggaaac

SEQ ID NO: 328427 - DNA, 20 bp, Artificial
  CRISPR gRNA sequence
cttctggaaacaagtgtatg

SEQ ID NO: 328428 - DNA, 20 bp, Artificial
  CRISPR gRNA sequence
agatacacaatcatgcatac

SEQ ID NO: 328429 - DNA, 20 bp, Artificial
  CRISPR gRNA sequence
tacaagacactaccccaact

SEQ ID NO: 328430 - DNA, 20 bp, Artificial
  CRISPR gRNA sequence
actgagatgtcatgttctaa

SEQ ID NO: 328431 - DNA, 20 bp, Artificial
  CRISPR gRNA sequence
ctaatggaaattatctgtct

SEQ ID NO: 328432 - DNA, 20 bp, Artificial
  CRISPR gRNA sequence
aattatctgtctgagcttta

SEQ ID NO: 328433 - DNA, 20 bp, Artificial
  CRISPR gRNA sequence
ctttaccttcaaatatccac

SEQ ID NO: 328434 - DNA, 20 bp, Artificial
  CRISPR gRNA sequence
tttaccttcaaatatccact

SEQ ID NO: 328435 - DNA, 20 bp, Artificial
  CRISPR gRNA sequence
tgggttcataaatacttatt

SEQ ID NO: 328436 - DNA, 20 bp, Artificial
  CRISPR gRNA sequence
ttcataaatacttatttaga

SEQ ID NO: 328437 - DNA, 20 bp, Artificial
  CRISPR gRNA sequence
tagacagttgataattctct

SEQ ID NO: 328438 - DNA, 20 bp, Artificial
  CRISPR gRNA sequence
tcttggctcttatatgtctg

SEQ ID NO: 328439 - DNA, 20 bp, Artificial
  CRISPR gRNA sequence
ttggctcttatatgtctgtg

SEQ ID NO: 328440 - DNA, 20 bp, Artificial
  CRISPR gRNA sequence
tggctcttatatgtctgtgg

SEQ ID NO: 328441 - DNA, 20 bp, Artificial
  CRISPR gRNA sequence
ggctcttatatgtctgtgga

SEQ ID NO: 328442 - DNA, 20 bp, Artificial
  CRISPR gRNA sequence
tcttatatgtctgtggaggg

SEQ ID NO: 328443 - DNA, 20 bp, Artificial
  CRISPR gRNA sequence
cttatatgtctgtggagggc

SEQ ID NO: 328444 - DNA, 20 bp, Artificial
  CRISPR gRNA sequence
aggacaactttgttccatcc

SEQ ID NO: 328445 - DNA, 20 bp, Artificial
  CRISPR gRNA sequence
caactttgttccatccaagt

SEQ ID NO: 328446 - DNA, 20 bp, Artificial
  CRISPR gRNA sequence
atccaagtgagcaacaaacc

SEQ ID NO: 328447 - DNA, 20 bp, Artificial
  CRISPR gRNA sequence
aacaaacctggttgctcact

SEQ ID NO: 328448 - DNA, 20 bp, Artificial
  CRISPR gRNA sequence
ttgctcacttggatgtccca

SEQ ID NO: 328449 - DNA, 20 bp, Artificial
  CRISPR gRNA sequence
cacttggatgtcccaaagcg

SEQ ID NO: 328450 - DNA, 20 bp, Artificial
  CRISPR gRNA sequence
acatttgcccaatatatgac

SEQ ID NO: 328451 - DNA, 20 bp, Artificial
  CRISPR gRNA sequence
catttgcccaatatatgacc

SEQ ID NO: 328452 - DNA, 20 bp, Artificial
  CRISPR gRNA sequence
gcccaatatatgaccaggac

SEQ ID NO: 328453 - DNA, 20 bp, Artificial
  CRISPR gRNA sequence
atgaccaggacaagaacccc

SEQ ID NO: 328454 - DNA, 20 bp, Artificial
  CRISPR gRNA sequence
gacaagaacccctggaccaa

SEQ ID NO: 328455 - DNA, 20 bp, Artificial
  CRISPR gRNA sequence
aatggttgttctaatatacc

SEQ ID NO: 328456 - DNA, 20 bp, Artificial
  CRISPR gRNA sequence
accaagatgttttataaaca

SEQ ID NO: 328457 - DNA, 20 bp, Artificial
  CRISPR gRNA sequence
gttttataaacacagcatgt

SEQ ID NO: 328458 - DNA, 20 bp, Artificial
  CRISPR gRNA sequence
ttataaacacagcatgttag

SEQ ID NO: 328459 - DNA, 20 bp, Artificial
  CRISPR gRNA sequence
aaacatcatcttatatcttt

SEQ ID NO: 328460 - DNA, 20 bp, Artificial
  CRISPR gRNA sequence
tatgttactaaaatcacaaa

SEQ ID NO: 328461 - DNA, 20 bp, Artificial
  CRISPR gRNA sequence
atgttactaaaatcacaaaa

SEQ ID NO: 328462 - DNA, 20 bp, Artificial
  CRISPR gRNA sequence
aaatcacaaaaaggaatatg

SEQ ID NO: 328463 - DNA, 20 bp, Artificial
  CRISPR gRNA sequence
caaaaaggaatatgtggtct

SEQ ID NO: 328464 - DNA, 20 bp, Artificial
  CRISPR gRNA sequence
gaatatgtggtcttggatcc

SEQ ID NO: 328465 - DNA, 20 bp, Artificial
  CRISPR gRNA sequence
tggtcttggatcctggtgat

SEQ ID NO: 328466 - DNA, 20 bp, Artificial
  CRISPR gRNA sequence
aaaatctgaatattaaacat

SEQ ID NO: 328467 - DNA, 20 bp, Artificial
  CRISPR gRNA sequence
aaatctgaatattaaacatg

SEQ ID NO: 328468 - DNA, 20 bp, Artificial
  CRISPR gRNA sequence
catatctgtttactttttat

SEQ ID NO: 328469 - DNA, 20 bp, Artificial
  CRISPR gRNA sequence
ttactttttattggaaaccc

SEQ ID NO: 328470 - DNA, 20 bp, Artificial
  CRISPR gRNA sequence
tggaaaccctagattataat

SEQ ID NO: 328471 - DNA, 20 bp, Artificial
  CRISPR gRNA sequence
accctagattataatcagtc

SEQ ID NO: 328472 - DNA, 20 bp, Artificial
  CRISPR gRNA sequence
cctagattataatcagtctg

SEQ ID NO: 328473 - DNA, 20 bp, Artificial
  CRISPR gRNA sequence
attataatcagtctggagaa

SEQ ID NO: 328474 - DNA, 20 bp, Artificial
  CRISPR gRNA sequence
ttataatcagtctggagaac

SEQ ID NO: 328475 - DNA, 20 bp, Artificial
  CRISPR gRNA sequence
actatattttcttcatcaca

SEQ ID NO: 328476 - DNA, 20 bp, Artificial
  CRISPR gRNA sequence
acatagaatactgtgtctaa

SEQ ID NO: 328477 - DNA, 20 bp, Artificial
  CRISPR gRNA sequence
catagaatactgtgtctaac

SEQ ID NO: 328478 - DNA, 20 bp, Artificial
  CRISPR gRNA sequence
atagaatactgtgtctaaca

SEQ ID NO: 328479 - DNA, 20 bp, Artificial
  CRISPR gRNA sequence
ctaacagggcatattcttcc

SEQ ID NO: 328480 - DNA, 20 bp, Artificial
  CRISPR gRNA sequence
acagggcatattcttcccag

SEQ ID NO: 328481 - DNA, 20 bp, Artificial
  CRISPR gRNA sequence
agggcatattcttcccagta

SEQ ID NO: 328482 - DNA, 20 bp, Artificial
  CRISPR gRNA sequence
gggcatattcttcccagtag

SEQ ID NO: 328483 - DNA, 20 bp, Artificial
  CRISPR gRNA sequence
attcttcccagtagaggctc

SEQ ID NO: 328484 - DNA, 20 bp, Artificial
  CRISPR gRNA sequence
gctgctaacaataattttta

SEQ ID NO: 328485 - DNA, 20 bp, Artificial
  CRISPR gRNA sequence
ctgctaacaataatttttat

SEQ ID NO: 328486 - DNA, 20 bp, Artificial
  CRISPR gRNA sequence
taacaataatttttataggc

SEQ ID NO: 328487 - DNA, 20 bp, Artificial
  CRISPR gRNA sequence
aacaataatttttataggcc

SEQ ID NO: 328488 - DNA, 20 bp, Artificial
  CRISPR gRNA sequence
taatttttataggccgggcg

SEQ ID NO: 328489 - DNA, 20 bp, Artificial
  CRISPR gRNA sequence
agtgactcgccctgtaatcc

SEQ ID NO: 328490 - DNA, 20 bp, Artificial
  CRISPR gRNA sequence
gccctgtaatcccagcactt

SEQ ID NO: 328491 - DNA, 20 bp, Artificial
  CRISPR gRNA sequence
ccctgtaatcccagcacttt

SEQ ID NO: 328492 - DNA, 20 bp, Artificial
  CRISPR gRNA sequence
ctgtaatcccagcactttgg

SEQ ID NO: 328493 - DNA, 20 bp, Artificial
  CRISPR gRNA sequence
tgtaatcccagcactttggg

SEQ ID NO: 328494 - DNA, 20 bp, Artificial
  CRISPR gRNA sequence
tcccagcactttgggaggcc

SEQ ID NO: 328495 - DNA, 20 bp, Artificial
  CRISPR gRNA sequence
cccagcactttgggaggccg

SEQ ID NO: 328496 - DNA, 20 bp, Artificial
  CRISPR gRNA sequence
agcactttgggaggccgagg

SEQ ID NO: 328497 - DNA, 20 bp, Artificial
  CRISPR gRNA sequence
gcactttgggaggccgaggc

SEQ ID NO: 328498 - DNA, 20 bp, Artificial
  CRISPR gRNA sequence
actttgggaggccgaggcag

SEQ ID NO: 328499 - DNA, 20 bp, Artificial
  CRISPR gRNA sequence
ctttgggaggccgaggcagg

SEQ ID NO: 328500 - DNA, 20 bp, Artificial
  CRISPR gRNA sequence
ggccgaggcaggaggatcac

SEQ ID NO: 328501 - DNA, 20 bp, Artificial
  CRISPR gRNA sequence
gccgaggcaggaggatcacg

SEQ ID NO: 328502 - DNA, 20 bp, Artificial
  CRISPR gRNA sequence
ggcaggaggatcacgaggtc

SEQ ID NO: 328503 - DNA, 20 bp, Artificial
  CRISPR gRNA sequence
caggaggatcacgaggtcaa

SEQ ID NO: 328504 - DNA, 20 bp, Artificial
  CRISPR gRNA sequence
gatcacgaggtcaagagatt

SEQ ID NO: 328505 - DNA, 20 bp, Artificial
  CRISPR gRNA sequence
tcaagagattgagaccatcc

SEQ ID NO: 328506 - DNA, 20 bp, Artificial
  CRISPR gRNA sequence
tgagaccatcctggccaaca

SEQ ID NO: 328507 - DNA, 20 bp, Artificial
  CRISPR gRNA sequence
tctactaataatataaaaat

SEQ ID NO: 328508 - DNA, 20 bp, Artificial
  CRISPR gRNA sequence
ctaataatataaaaattagc

SEQ ID NO: 328509 - DNA, 20 bp, Artificial
  CRISPR gRNA sequence
taataatataaaaattagct

SEQ ID NO: 328510 - DNA, 20 bp, Artificial
  CRISPR gRNA sequence
atataaaaattagctgggcg

SEQ ID NO: 328511 - DNA, 20 bp, Artificial
  CRISPR gRNA sequence
taaaaattagctgggcgtgg

SEQ ID NO: 328512 - DNA, 20 bp, Artificial
  CRISPR gRNA sequence
gtggtgtgtgcctgtaatcc

SEQ ID NO: 328513 - DNA, 20 bp, Artificial
  CRISPR gRNA sequence
tgcctgtaatcccagctact

SEQ ID NO: 328514 - DNA, 20 bp, Artificial
  CRISPR gRNA sequence
gcctgtaatcccagctactc

SEQ ID NO: 328515 - DNA, 20 bp, Artificial
  CRISPR gRNA sequence
ctgtaatcccagctactcag

SEQ ID NO: 328516 - DNA, 20 bp, Artificial
  CRISPR gRNA sequence
tgtaatcccagctactcagg

SEQ ID NO: 328517 - DNA, 20 bp, Artificial
  CRISPR gRNA sequence
tcccagctactcaggaggct

SEQ ID NO: 328518 - DNA, 20 bp, Artificial
  CRISPR gRNA sequence
cccagctactcaggaggctg

SEQ ID NO: 328519 - DNA, 20 bp, Artificial
  CRISPR gRNA sequence
agctactcaggaggctgagg

SEQ ID NO: 328520 - DNA, 20 bp, Artificial
  CRISPR gRNA sequence
gctactcaggaggctgaggc

SEQ ID NO: 328521 - DNA, 20 bp, Artificial
  CRISPR gRNA sequence
tactcaggaggctgaggcag

SEQ ID NO: 328522 - DNA, 20 bp, Artificial
  CRISPR gRNA sequence
ggcaggagaatcgcttgaac

SEQ ID NO: 328523 - DNA, 20 bp, Artificial
  CRISPR gRNA sequence
gcaggagaatcgcttgaacc

SEQ ID NO: 328524 - DNA, 20 bp, Artificial
  CRISPR gRNA sequence
caggagaatcgcttgaacca

SEQ ID NO: 328525 - DNA, 20 bp, Artificial
  CRISPR gRNA sequence
ggagaatcgcttgaaccagg

SEQ ID NO: 328526 - DNA, 20 bp, Artificial
  CRISPR gRNA sequence
aatcgcttgaaccagggagt

SEQ ID NO: 328527 - DNA, 20 bp, Artificial
  CRISPR gRNA sequence
tcgcttgaaccagggagtca

SEQ ID NO: 328528 - DNA, 20 bp, Artificial
  CRISPR gRNA sequence
cgcttgaaccagggagtcag

SEQ ID NO: 328529 - DNA, 20 bp, Artificial
  CRISPR gRNA sequence
aaccagggagtcagaggttg

SEQ ID NO: 328530 - DNA, 20 bp, Artificial
  CRISPR gRNA sequence
agggagtcagaggttgcagt

SEQ ID NO: 328531 - DNA, 20 bp, Artificial
  CRISPR gRNA sequence
gtcagaggttgcagtgagcc

SEQ ID NO: 328532 - DNA, 20 bp, Artificial
  CRISPR gRNA sequence
gagattgcaccactgcactc

SEQ ID NO: 328533 - DNA, 20 bp, Artificial
  CRISPR gRNA sequence
tgcaccactgcactccagcc

SEQ ID NO: 328534 - DNA, 20 bp, Artificial
  CRISPR gRNA sequence
actgcactccagcctggcaa

SEQ ID NO: 328535 - DNA, 20 bp, Artificial
  CRISPR gRNA sequence
tgcactccagcctggcaaca

SEQ ID NO: 328536 - DNA, 20 bp, Artificial
  CRISPR gRNA sequence
ctccagcctggcaacagagc

SEQ ID NO: 328537 - DNA, 20 bp, Artificial
  CRISPR gRNA sequence
aatattactgttgatatcaa

SEQ ID NO: 328538 - DNA, 20 bp, Artificial
  CRISPR gRNA sequence
atcaatagactaatgttttc

SEQ ID NO: 328539 - DNA, 20 bp, Artificial
  CRISPR gRNA sequence
caatagactaatgttttcaa

SEQ ID NO: 328540 - DNA, 20 bp, Artificial
  CRISPR gRNA sequence
aaaataaaaatctttatatt

SEQ ID NO: 328541 - DNA, 20 bp, Artificial
  CRISPR gRNA sequence
tttatattaagtgatctctt

SEQ ID NO: 328542 - DNA, 20 bp, Artificial
  CRISPR gRNA sequence
ttatattaagtgatctcttt

SEQ ID NO: 328543 - DNA, 20 bp, Artificial
  CRISPR gRNA sequence
ttaggttttcaaaatttata

SEQ ID NO: 328544 - DNA, 20 bp, Artificial
  CRISPR gRNA sequence
tttcaaaatttataaagcac

SEQ ID NO: 328545 - DNA, 20 bp, Artificial
  CRISPR gRNA sequence
agaacattttcttcttcttt

SEQ ID NO: 328546 - DNA, 20 bp, Artificial
  CRISPR gRNA sequence
gaacattttcttcttctttt

SEQ ID NO: 328547 - DNA, 20 bp, Artificial
  CRISPR gRNA sequence
aacattttcttcttcttttg

SEQ ID NO: 328548 - DNA, 20 bp, Artificial
  CRISPR gRNA sequence
acattttcttcttcttttgg

SEQ ID NO: 328549 - DNA, 20 bp, Artificial
  CRISPR gRNA sequence
tcttcttttgggggactatt

SEQ ID NO: 328550 - DNA, 20 bp, Artificial
  CRISPR gRNA sequence
gactattaagaaaatttctg

SEQ ID NO: 328551 - DNA, 20 bp, Artificial
  CRISPR gRNA sequence
ttaagaaaatttctgaagaa

SEQ ID NO: 328552 - DNA, 20 bp, Artificial
  CRISPR gRNA sequence
taagaaaatttctgaagaaa

SEQ ID NO: 328553 - DNA, 20 bp, Artificial
  CRISPR gRNA sequence
gaagaaaaggtcattcacct

SEQ ID NO: 328554 - DNA, 20 bp, Artificial
  CRISPR gRNA sequence
ttcacctgagaattgcacta

SEQ ID NO: 328555 - DNA, 20 bp, Artificial
  CRISPR gRNA sequence
ctgagaattgcactatagtg

SEQ ID NO: 328556 - DNA, 20 bp, Artificial
  CRISPR gRNA sequence
aattgcactatagtgcagat

SEQ ID NO: 328557 - DNA, 20 bp, Artificial
  CRISPR gRNA sequence
gtgcagatgagttcatttgc

SEQ ID NO: 328558 - DNA, 20 bp, Artificial
  CRISPR gRNA sequence
aagttgatgcttttaatatc

SEQ ID NO: 328559 - DNA, 20 bp, Artificial
  CRISPR gRNA sequence
tctggactacttcatttcac

SEQ ID NO: 328560 - DNA, 20 bp, Artificial
  CRISPR gRNA sequence
ctacttcatttcaccagtat

SEQ ID NO: 328561 - DNA, 20 bp, Artificial
  CRISPR gRNA sequence
cagtataagatgctcatgcc

SEQ ID NO: 328562 - DNA, 20 bp, Artificial
  CRISPR gRNA sequence
catgcccagacccatcctgc

SEQ ID NO: 328563 - DNA, 20 bp, Artificial
  CRISPR gRNA sequence
atgcccagacccatcctgct

SEQ ID NO: 328564 - DNA, 20 bp, Artificial
  CRISPR gRNA sequence
atcctgctgggactctttgc

SEQ ID NO: 328565 - DNA, 20 bp, Artificial
  CRISPR gRNA sequence
ctgctgggactctttgcaag

SEQ ID NO: 328566 - DNA, 20 bp, Artificial
  CRISPR gRNA sequence
gcaagcagttgtattgttcc

SEQ ID NO: 328567 - DNA, 20 bp, Artificial
  CRISPR gRNA sequence
gttcctggttgaaaatcctc

SEQ ID NO: 328568 - DNA, 20 bp, Artificial
  CRISPR gRNA sequence
tcctggttgaaaatcctctg

SEQ ID NO: 328569 - DNA, 20 bp, Artificial
  CRISPR gRNA sequence
cctggttgaaaatcctctgg

SEQ ID NO: 328570 - DNA, 20 bp, Artificial
  CRISPR gRNA sequence
tcctctggaggaaacattta

SEQ ID NO: 328571 - DNA, 20 bp, Artificial
  CRISPR gRNA sequence
aaacatttaaagaacccact

SEQ ID NO: 328572 - DNA, 20 bp, Artificial
  CRISPR gRNA sequence
tttaaagaacccactcagtg

SEQ ID NO: 328573 - DNA, 20 bp, Artificial
  CRISPR gRNA sequence
taaagaacccactcagtgca

SEQ ID NO: 328574 - DNA, 20 bp, Artificial
  CRISPR gRNA sequence
ccactcagtgcagagcgtgc

SEQ ID NO: 328575 - DNA, 20 bp, Artificial
  CRISPR gRNA sequence
gtgcagagcgtgcaagatat

SEQ ID NO: 328576 - DNA, 20 bp, Artificial
  CRISPR gRNA sequence
taattttattttctttaact

SEQ ID NO: 328577 - DNA, 20 bp, Artificial
  CRISPR gRNA sequence
tctaaccacaaacctccaca

SEQ ID NO: 328578 - DNA, 20 bp, Artificial
  CRISPR gRNA sequence
ctaaccacaaacctccacaa

SEQ ID NO: 328579 - DNA, 20 bp, Artificial
  CRISPR gRNA sequence
acaaacctccacaaaggtct

SEQ ID NO: 328580 - DNA, 20 bp, Artificial
  CRISPR gRNA sequence
aaacctccacaaaggtctca

SEQ ID NO: 328581 - DNA, 20 bp, Artificial
  CRISPR gRNA sequence
ccacaaaggtctcagagtga

SEQ ID NO: 328582 - DNA, 20 bp, Artificial
  CRISPR gRNA sequence
aaaggtctcagagtgatgga

SEQ ID NO: 328583 - DNA, 20 bp, Artificial
  CRISPR gRNA sequence
tctcagagtgatggaaagat

SEQ ID NO: 328584 - DNA, 20 bp, Artificial
  CRISPR gRNA sequence
atggaaagataagatgtcct

SEQ ID NO: 328585 - DNA, 20 bp, Artificial
  CRISPR gRNA sequence
cctgagtttgtaatcattga

SEQ ID NO: 328586 - DNA, 20 bp, Artificial
  CRISPR gRNA sequence
ttctgtaatcaaacaatgat

SEQ ID NO: 328587 - DNA, 20 bp, Artificial
  CRISPR gRNA sequence
aatcaaacaatgataagtgt

SEQ ID NO: 328588 - DNA, 20 bp, Artificial
  CRISPR gRNA sequence
aacaatgataagtgttagct

SEQ ID NO: 328589 - DNA, 20 bp, Artificial
  CRISPR gRNA sequence
tgataagtgttagcttagca

SEQ ID NO: 328590 - DNA, 20 bp, Artificial
  CRISPR gRNA sequence
acagcacatgaatgtgacac

SEQ ID NO: 328591 - DNA, 20 bp, Artificial
  CRISPR gRNA sequence
agcacatgaatgtgacacaa

SEQ ID NO: 328592 - DNA, 20 bp, Artificial
  CRISPR gRNA sequence
gcacatgaatgtgacacaag

SEQ ID NO: 328593 - DNA, 20 bp, Artificial
  CRISPR gRNA sequence
gaatgtgacacaagaggcaa

SEQ ID NO: 328594 - DNA, 20 bp, Artificial
  CRISPR gRNA sequence
aaaaattgcaatgtttatat

SEQ ID NO: 328595 - DNA, 20 bp, Artificial
  CRISPR gRNA sequence
aaaattgcaatgtttatatt

SEQ ID NO: 328596 - DNA, 20 bp, Artificial
  CRISPR gRNA sequence
gcaatgtttatattaggttt

SEQ ID NO: 328597 - DNA, 20 bp, Artificial
  CRISPR gRNA sequence
gttatatttgatgttttact

SEQ ID NO: 328598 - DNA, 20 bp, Artificial
  CRISPR gRNA sequence
gatgttttactaagaaattc

SEQ ID NO: 328599 - DNA, 20 bp, Artificial
  CRISPR gRNA sequence
aattctggcattaaaaaaaa

SEQ ID NO: 328600 - DNA, 20 bp, Artificial
  CRISPR gRNA sequence
acttttctcacctttcataa

SEQ ID NO: 328601 - DNA, 20 bp, Artificial
  CRISPR gRNA sequence
aaagcaatgtcatgtcttat

SEQ ID NO: 328602 - DNA, 20 bp, Artificial
  CRISPR gRNA sequence
gtcatgtcttatgagtctac

SEQ ID NO: 328603 - DNA, 20 bp, Artificial
  CRISPR gRNA sequence
agtctaccagctaaaacctt

SEQ ID NO: 328604 - DNA, 20 bp, Artificial
  CRISPR gRNA sequence
agctaaaacctttagatccc

SEQ ID NO: 328605 - DNA, 20 bp, Artificial
  CRISPR gRNA sequence
aaaacctttagatccctggt

SEQ ID NO: 328606 - DNA, 20 bp, Artificial
  CRISPR gRNA sequence
acctttagatccctggttag

SEQ ID NO: 328607 - DNA, 20 bp, Artificial
  CRISPR gRNA sequence
taaacttacattgctattca

SEQ ID NO: 328608 - DNA, 20 bp, Artificial
  CRISPR gRNA sequence
aaacttacattgctattcaa

SEQ ID NO: 328609 - DNA, 20 bp, Artificial
  CRISPR gRNA sequence
tcaaaggcacccataatcta

SEQ ID NO: 328610 - DNA, 20 bp, Artificial
  CRISPR gRNA sequence
aaggcacccataatctaaag

SEQ ID NO: 328611 - DNA, 20 bp, Artificial
  CRISPR gRNA sequence
cataatctaaagaagtaatt

SEQ ID NO: 328612 - DNA, 20 bp, Artificial
  CRISPR gRNA sequence
ataatctaaagaagtaattg

SEQ ID NO: 328613 - DNA, 20 bp, Artificial
  CRISPR gRNA sequence
tctaaagaagtaattgaggc

SEQ ID NO: 328614 - DNA, 20 bp, Artificial
  CRISPR gRNA sequence
ctaaagaagtaattgaggca

SEQ ID NO: 328615 - DNA, 20 bp, Artificial
  CRISPR gRNA sequence
aagaagtaattgaggcaagg

SEQ ID NO: 328616 - DNA, 20 bp, Artificial
  CRISPR gRNA sequence
agaagtaattgaggcaagga

SEQ ID NO: 328617 - DNA, 20 bp, Artificial
  CRISPR gRNA sequence
gaagtaattgaggcaaggaa

SEQ ID NO: 328618 - DNA, 20 bp, Artificial
  CRISPR gRNA sequence
agtaattgaggcaaggaagg

SEQ ID NO: 328619 - DNA, 20 bp, Artificial
  CRISPR gRNA sequence
gtaattgaggcaaggaaggg

SEQ ID NO: 328620 - DNA, 20 bp, Artificial
  CRISPR gRNA sequence
taattgaggcaaggaaggga

SEQ ID NO: 328621 - DNA, 20 bp, Artificial
  CRISPR gRNA sequence
attgaggcaaggaagggagg

SEQ ID NO: 328622 - DNA, 20 bp, Artificial
  CRISPR gRNA sequence
ttgaggcaaggaagggaggg

SEQ ID NO: 328623 - DNA, 20 bp, Artificial
  CRISPR gRNA sequence
ggcaaggaagggagggagga

SEQ ID NO: 328624 - DNA, 20 bp, Artificial
  CRISPR gRNA sequence
ggaagggagggaggatagac

SEQ ID NO: 328625 - DNA, 20 bp, Artificial
  CRISPR gRNA sequence
taacctaaatgcctaacatt

SEQ ID NO: 328626 - DNA, 20 bp, Artificial
  CRISPR gRNA sequence
acctaaatgcctaacatttg

SEQ ID NO: 328627 - DNA, 20 bp, Artificial
  CRISPR gRNA sequence
taacatttggagaaaaaaaa

SEQ ID NO: 328628 - DNA, 20 bp, Artificial
  CRISPR gRNA sequence
atttggagaaaaaaaaaaga

SEQ ID NO: 328629 - DNA, 20 bp, Artificial
  CRISPR gRNA sequence
agaaagcaaaaaaaaaaaaa

SEQ ID NO: 328630 - DNA, 20 bp, Artificial
  CRISPR gRNA sequence
gaaagcaaaaaaaaaaaaat

SEQ ID NO: 328631 - DNA, 20 bp, Artificial
  CRISPR gRNA sequence
agcaaaaaaaaaaaaatggg

SEQ ID NO: 328632 - DNA, 20 bp, Artificial
  CRISPR gRNA sequence
aaaaaaaaaaaaatgggaag

SEQ ID NO: 328633 - DNA, 20 bp, Artificial
  CRISPR gRNA sequence
aaaaaaaatgggaagaagaa

SEQ ID NO: 328634 - DNA, 20 bp, Artificial
  CRISPR gRNA sequence
aaaatgggaagaagaaaagt

SEQ ID NO: 328635 - DNA, 20 bp, Artificial
  CRISPR gRNA sequence
aaatgggaagaagaaaagtg

SEQ ID NO: 328636 - DNA, 20 bp, Artificial
  CRISPR gRNA sequence
atgggaagaagaaaagtgag

SEQ ID NO: 328637 - DNA, 20 bp, Artificial
  CRISPR gRNA sequence
agaagaaaagtgaggagaaa

SEQ ID NO: 328638 - DNA, 20 bp, Artificial
  CRISPR gRNA sequence
aagtgaggagaaaaagccaa

SEQ ID NO: 328639 - DNA, 20 bp, Artificial
  CRISPR gRNA sequence
gtgaggagaaaaagccaaaa

SEQ ID NO: 328640 - DNA, 20 bp, Artificial
  CRISPR gRNA sequence
tgtgcattgttttactctcc

SEQ ID NO: 328641 - DNA, 20 bp, Artificial
  CRISPR gRNA sequence
gtgcattgttttactctcca

SEQ ID NO: 328642 - DNA, 20 bp, Artificial
  CRISPR gRNA sequence
ttactctccaaggaactcca

SEQ ID NO: 328643 - DNA, 20 bp, Artificial
  CRISPR gRNA sequence
tactctccaaggaactccat

SEQ ID NO: 328644 - DNA, 20 bp, Artificial
  CRISPR gRNA sequence
actctccaaggaactccata

SEQ ID NO: 328645 - DNA, 20 bp, Artificial
  CRISPR gRNA sequence
ctctccaaggaactccatag

SEQ ID NO: 328646 - DNA, 20 bp, Artificial
  CRISPR gRNA sequence
tctccaaggaactccatagg

SEQ ID NO: 328647 - DNA, 20 bp, Artificial
  CRISPR gRNA sequence
gggggtacaaaacaaccctt

SEQ ID NO: 328648 - DNA, 20 bp, Artificial
  CRISPR gRNA sequence
aaacaaccctttggttctct

SEQ ID NO: 328649 - DNA, 20 bp, Artificial
  CRISPR gRNA sequence
gttctctaagtgtgtataat

SEQ ID NO: 328650 - DNA, 20 bp, Artificial
  CRISPR gRNA sequence
gtgtataataagaaaaatga

SEQ ID NO: 328651 - DNA, 20 bp, Artificial
  CRISPR gRNA sequence
atgaaagattgattttctcc

SEQ ID NO: 328652 - DNA, 20 bp, Artificial
  CRISPR gRNA sequence
catgaaaaatgaaaaaatcc

SEQ ID NO: 328653 - DNA, 20 bp, Artificial
  CRISPR gRNA sequence
gaaaaatgaaaaaatcccag

SEQ ID NO: 328654 - DNA, 20 bp, Artificial
  CRISPR gRNA sequence
actttgtatcaatattcaca

SEQ ID NO: 328655 - DNA, 20 bp, Artificial
  CRISPR gRNA sequence
aaagcaattaatttacaaac

SEQ ID NO: 328656 - DNA, 20 bp, Artificial
  CRISPR gRNA sequence
ttacaaacaagttattttgt

SEQ ID NO: 328657 - DNA, 20 bp, Artificial
  CRISPR gRNA sequence
ttgatttgaaactattgtac

SEQ ID NO: 328658 - DNA, 20 bp, Artificial
  CRISPR gRNA sequence
tgatttgaaactattgtact

SEQ ID NO: 328659 - DNA, 20 bp, Artificial
  CRISPR gRNA sequence
gatttgaaactattgtacta

SEQ ID NO: 328660 - DNA, 20 bp, Artificial
  CRISPR gRNA sequence
ttgtactagggaaatcatat

SEQ ID NO: 328661 - DNA, 20 bp, Artificial
  CRISPR gRNA sequence
atgaacccaactctcttcca

SEQ ID NO: 328662 - DNA, 20 bp, Artificial
  CRISPR gRNA sequence
gaacccaactctcttccaca

SEQ ID NO: 328663 - DNA, 20 bp, Artificial
  CRISPR gRNA sequence
cccaactctcttccacagag

SEQ ID NO: 328664 - DNA, 20 bp, Artificial
  CRISPR gRNA sequence
ccaactctcttccacagagt

SEQ ID NO: 328665 - DNA, 20 bp, Artificial
  CRISPR gRNA sequence
aactctcttccacagagtgg

SEQ ID NO: 328666 - DNA, 20 bp, Artificial
  CRISPR gRNA sequence
actctcttccacagagtggg

SEQ ID NO: 328667 - DNA, 20 bp, Artificial
  CRISPR gRNA sequence
ctctcttccacagagtggga

SEQ ID NO: 328668 - DNA, 20 bp, Artificial
  CRISPR gRNA sequence
ctcttccacagagtgggagg

SEQ ID NO: 328669 - DNA, 20 bp, Artificial
  CRISPR gRNA sequence
cttccacagagtgggaggga

SEQ ID NO: 328670 - DNA, 20 bp, Artificial
  CRISPR gRNA sequence
tccacagagtgggagggaga

SEQ ID NO: 328671 - DNA, 20 bp, Artificial
  CRISPR gRNA sequence
ccacagagtgggagggagag

SEQ ID NO: 328672 - DNA, 20 bp, Artificial
  CRISPR gRNA sequence
ccacattgcttgccattgct

SEQ ID NO: 328673 - DNA, 20 bp, Artificial
  CRISPR gRNA sequence
agctactgtgcaaaactcct

SEQ ID NO: 328674 - DNA, 20 bp, Artificial
  CRISPR gRNA sequence
gctactgtgcaaaactcctt

SEQ ID NO: 328675 - DNA, 20 bp, Artificial
  CRISPR gRNA sequence
tgcaaaactccttgggcaca

SEQ ID NO: 328676 - DNA, 20 bp, Artificial
  CRISPR gRNA sequence
aaactccttgggcacatgga

SEQ ID NO: 328677 - DNA, 20 bp, Artificial
  CRISPR gRNA sequence
aactccttgggcacatggac

SEQ ID NO: 328678 - DNA, 20 bp, Artificial
  CRISPR gRNA sequence
actccttgggcacatggaca

SEQ ID NO: 328679 - DNA, 20 bp, Artificial
  CRISPR gRNA sequence
cctgaactcatttgcaccta

SEQ ID NO: 328680 - DNA, 20 bp, Artificial
  CRISPR gRNA sequence
ctcatttgcacctatggctc

SEQ ID NO: 328681 - DNA, 20 bp, Artificial
  CRISPR gRNA sequence
ccagctctcatgtctacccc

SEQ ID NO: 328682 - DNA, 20 bp, Artificial
  CRISPR gRNA sequence
cagctctcatgtctaccccc

SEQ ID NO: 328683 - DNA, 20 bp, Artificial
  CRISPR gRNA sequence
gctctcatgtctacccccag

SEQ ID NO: 328684 - DNA, 20 bp, Artificial
  CRISPR gRNA sequence
aggagcccacattttctctc

SEQ ID NO: 328685 - DNA, 20 bp, Artificial
  CRISPR gRNA sequence
ttctctccagcccaaacttc

SEQ ID NO: 328686 - DNA, 20 bp, Artificial
  CRISPR gRNA sequence
ttcctttcaacatcactatc

SEQ ID NO: 328687 - DNA, 20 bp, Artificial
  CRISPR gRNA sequence
ttaccctaacacatcatgta

SEQ ID NO: 328688 - DNA, 20 bp, Artificial
  CRISPR gRNA sequence
atgtatagcctttccaaact

SEQ ID NO: 328689 - DNA, 20 bp, Artificial
  CRISPR gRNA sequence
tagcctttccaaactgagct

SEQ ID NO: 328690 - DNA, 20 bp, Artificial
  CRISPR gRNA sequence
tttccaaactgagctcagta

SEQ ID NO: 328691 - DNA, 20 bp, Artificial
  CRISPR gRNA sequence
gcgctgcataaatgacatgt

SEQ ID NO: 328692 - DNA, 20 bp, Artificial
  CRISPR gRNA sequence
aatgacatgttggtcaacga

SEQ ID NO: 328693 - DNA, 20 bp, Artificial
  CRISPR gRNA sequence
tcaacgatggactgtatata

SEQ ID NO: 328694 - DNA, 20 bp, Artificial
  CRISPR gRNA sequence
acgatggactgtatatatgg

SEQ ID NO: 328695 - DNA, 20 bp, Artificial
  CRISPR gRNA sequence
atggactgtatatatggtgg

SEQ ID NO: 328696 - DNA, 20 bp, Artificial
  CRISPR gRNA sequence
atatatggtggcggtcccat

SEQ ID NO: 328697 - DNA, 20 bp, Artificial
  CRISPR gRNA sequence
ggtcccataagattataata

SEQ ID NO: 328698 - DNA, 20 bp, Artificial
  CRISPR gRNA sequence
taatgtcccttttatgtgtt

SEQ ID NO: 328699 - DNA, 20 bp, Artificial
  CRISPR gRNA sequence
tatttaccattgtgctacca

SEQ ID NO: 328700 - DNA, 20 bp, Artificial
  CRISPR gRNA sequence
cattgtgctaccatggcctg

SEQ ID NO: 328701 - DNA, 20 bp, Artificial
  CRISPR gRNA sequence
ctaccatggcctgcagtatt

SEQ ID NO: 328702 - DNA, 20 bp, Artificial
  CRISPR gRNA sequence
atggcctgcagtattcagta

SEQ ID NO: 328703 - DNA, 20 bp, Artificial
  CRISPR gRNA sequence
cagtacagtaacatgctgta

SEQ ID NO: 328704 - DNA, 20 bp, Artificial
  CRISPR gRNA sequence
agtacagtaacatgctgtac

SEQ ID NO: 328705 - DNA, 20 bp, Artificial
  CRISPR gRNA sequence
taacatgctgtacaggtttg

SEQ ID NO: 328706 - DNA, 20 bp, Artificial
  CRISPR gRNA sequence
tgctgtacaggtttgtagcc

SEQ ID NO: 328707 - DNA, 20 bp, Artificial
  CRISPR gRNA sequence
tgtacaggtttgtagcctag

SEQ ID NO: 328708 - DNA, 20 bp, Artificial
  CRISPR gRNA sequence
ggtttgtagcctagaagcaa

SEQ ID NO: 328709 - DNA, 20 bp, Artificial
  CRISPR gRNA sequence
gtttgtagcctagaagcaat

SEQ ID NO: 328710 - DNA, 20 bp, Artificial
  CRISPR gRNA sequence
aagcaataggctactccaca

SEQ ID NO: 328711 - DNA, 20 bp, Artificial
  CRISPR gRNA sequence
ataggctactccacatagcc

SEQ ID NO: 328712 - DNA, 20 bp, Artificial
  CRISPR gRNA sequence
taggctactccacatagcct

SEQ ID NO: 328713 - DNA, 20 bp, Artificial
  CRISPR gRNA sequence
gctactccacatagcctagg

SEQ ID NO: 328714 - DNA, 20 bp, Artificial
  CRISPR gRNA sequence
tccacatagcctaggtagtg

SEQ ID NO: 328715 - DNA, 20 bp, Artificial
  CRISPR gRNA sequence
acatagcctaggtagtgcag

SEQ ID NO: 328716 - DNA, 20 bp, Artificial
  CRISPR gRNA sequence
catagcctaggtagtgcagt

SEQ ID NO: 328717 - DNA, 20 bp, Artificial
  CRISPR gRNA sequence
gtgcagtaggctctgccatc

SEQ ID NO: 328718 - DNA, 20 bp, Artificial
  CRISPR gRNA sequence
cagtaggctctgccatctag

SEQ ID NO: 328719 - DNA, 20 bp, Artificial
  CRISPR gRNA sequence
tctagtagacatcattgcgt

SEQ ID NO: 328720 - DNA, 20 bp, Artificial
  CRISPR gRNA sequence
gttcacacaacaaaatcact

SEQ ID NO: 328721 - DNA, 20 bp, Artificial
  CRISPR gRNA sequence
ttcacacaacaaaatcacta

SEQ ID NO: 328722 - DNA, 20 bp, Artificial
  CRISPR gRNA sequence
atcactaaggacacatttct

SEQ ID NO: 328723 - DNA, 20 bp, Artificial
  CRISPR gRNA sequence
cagaatgtattcccatcgtc

SEQ ID NO: 328724 - DNA, 20 bp, Artificial
  CRISPR gRNA sequence
aatgtattcccatcgtcaag

SEQ ID NO: 328725 - DNA, 20 bp, Artificial
  CRISPR gRNA sequence
aaatccaaaccctgtctttt

SEQ ID NO: 328726 - DNA, 20 bp, Artificial
  CRISPR gRNA sequence
aatccaaaccctgtcttttc

SEQ ID NO: 328727 - DNA, 20 bp, Artificial
  CRISPR gRNA sequence
atccaaaccctgtcttttca

SEQ ID NO: 328728 - DNA, 20 bp, Artificial
  CRISPR gRNA sequence
ccaaaccctgtcttttcagg

SEQ ID NO: 328729 - DNA, 20 bp, Artificial
  CRISPR gRNA sequence
ctgtcttttcagggagtcac

SEQ ID NO: 328730 - DNA, 20 bp, Artificial
  CRISPR gRNA sequence
gggagtcactagtctgaccc

SEQ ID NO: 328731 - DNA, 20 bp, Artificial
  CRISPR gRNA sequence
ggagtcactagtctgaccct

SEQ ID NO: 328732 - DNA, 20 bp, Artificial
  CRISPR gRNA sequence
tagtctgaccctaggaacct

SEQ ID NO: 328733 - DNA, 20 bp, Artificial
  CRISPR gRNA sequence
gtctgaccctaggaacctca

SEQ ID NO: 328734 - DNA, 20 bp, Artificial
  CRISPR gRNA sequence
tctgattttcatcatccaat

SEQ ID NO: 328735 - DNA, 20 bp, Artificial
  CRISPR gRNA sequence
tcatcatccaattggtcacc

SEQ ID NO: 328736 - DNA, 20 bp, Artificial
  CRISPR gRNA sequence
atccaattggtcaccaagtc

SEQ ID NO: 328737 - DNA, 20 bp, Artificial
  CRISPR gRNA sequence
tcaccaagtccagttgactc

SEQ ID NO: 328738 - DNA, 20 bp, Artificial
  CRISPR gRNA sequence
ttcatgtcttcccttatctg

SEQ ID NO: 328739 - DNA, 20 bp, Artificial
  CRISPR gRNA sequence
atgtcttcccttatctgtgg

SEQ ID NO: 328740 - DNA, 20 bp, Artificial
  CRISPR gRNA sequence
tgtggaagcatcctcttgac

SEQ ID NO: 328741 - DNA, 20 bp, Artificial
  CRISPR gRNA sequence
ctgctcccaaaattatgttt

SEQ ID NO: 328742 - DNA, 20 bp, Artificial
  CRISPR gRNA sequence
cccaaaattatgtttcagaa

SEQ ID NO: 328743 - DNA, 20 bp, Artificial
  CRISPR gRNA sequence
cagaaaagcatttcactccc

SEQ ID NO: 328744 - DNA, 20 bp, Artificial
  CRISPR gRNA sequence
catttcactccccagtttaa

SEQ ID NO: 328745 - DNA, 20 bp, Artificial
  CRISPR gRNA sequence
cccagtttaaaagtctctat

SEQ ID NO: 328746 - DNA, 20 bp, Artificial
  CRISPR gRNA sequence
attagtgttctattgcttat

SEQ ID NO: 328747 - DNA, 20 bp, Artificial
  CRISPR gRNA sequence
ttagtgttctattgcttata

SEQ ID NO: 328748 - DNA, 20 bp, Artificial
  CRISPR gRNA sequence
tgttttaaaatatatatatc

SEQ ID NO: 328749 - DNA, 20 bp, Artificial
  CRISPR gRNA sequence
aaaatgctttcacaatctca

SEQ ID NO: 328750 - DNA, 20 bp, Artificial
  CRISPR gRNA sequence
aaatgctttcacaatctcat

SEQ ID NO: 328751 - DNA, 20 bp, Artificial
  CRISPR gRNA sequence
atctcataggccatctattg

SEQ ID NO: 328752 - DNA, 20 bp, Artificial
  CRISPR gRNA sequence
tgaagccacactgaactttt

SEQ ID NO: 328753 - DNA, 20 bp, Artificial
  CRISPR gRNA sequence
acacttctgttctttactac

SEQ ID NO: 328754 - DNA, 20 bp, Artificial
  CRISPR gRNA sequence
atttgattaccccttaatct

SEQ ID NO: 328755 - DNA, 20 bp, Artificial
  CRISPR gRNA sequence
tgattaccccttaatctgag

SEQ ID NO: 328756 - DNA, 20 bp, Artificial
  CRISPR gRNA sequence
gaaattctcattcactcttc

SEQ ID NO: 328757 - DNA, 20 bp, Artificial
  CRISPR gRNA sequence
taaatgtcaacttctctctt

SEQ ID NO: 328758 - DNA, 20 bp, Artificial
  CRISPR gRNA sequence
ctcttgagatatttatttcc

SEQ ID NO: 328759 - DNA, 20 bp, Artificial
  CRISPR gRNA sequence
atatttatttccaagaccac

SEQ ID NO: 328760 - DNA, 20 bp, Artificial
  CRISPR gRNA sequence
atttccaagaccaccagaca

SEQ ID NO: 328761 - DNA, 20 bp, Artificial
  CRISPR gRNA sequence
gctcccaataatactttgtt

SEQ ID NO: 328762 - DNA, 20 bp, Artificial
  CRISPR gRNA sequence
ctcccaataatactttgttt

SEQ ID NO: 328763 - DNA, 20 bp, Artificial
  CRISPR gRNA sequence
caataatactttgtttaggc

SEQ ID NO: 328764 - DNA, 20 bp, Artificial
  CRISPR gRNA sequence
ttgtttaggccagtatattt

SEQ ID NO: 328765 - DNA, 20 bp, Artificial
  CRISPR gRNA sequence
ggccagtatattttagcaca

SEQ ID NO: 328766 - DNA, 20 bp, Artificial
  CRISPR gRNA sequence
tattttagcacatagcatct

SEQ ID NO: 328767 - DNA, 20 bp, Artificial
  CRISPR gRNA sequence
tgtcttcctcatttaaccat

SEQ ID NO: 328768 - DNA, 20 bp, Artificial
  CRISPR gRNA sequence
atttaaccatgagctccaca

SEQ ID NO: 328769 - DNA, 20 bp, Artificial
  CRISPR gRNA sequence
accatgagctccacaaagat

SEQ ID NO: 328770 - DNA, 20 bp, Artificial
  CRISPR gRNA sequence
ccatgagctccacaaagata

SEQ ID NO: 328771 - DNA, 20 bp, Artificial
  CRISPR gRNA sequence
caaagataaggactgcatta

SEQ ID NO: 328772 - DNA, 20 bp, Artificial
  CRISPR gRNA sequence
tacagttgcctaaaaaatcc

SEQ ID NO: 328773 - DNA, 20 bp, Artificial
  CRISPR gRNA sequence
acagttgcctaaaaaatccc

SEQ ID NO: 328774 - DNA, 20 bp, Artificial
  CRISPR gRNA sequence
aaatcccaggaccttgaaca

SEQ ID NO: 328775 - DNA, 20 bp, Artificial
  CRISPR gRNA sequence
tcccaggaccttgaacatag

SEQ ID NO: 328776 - DNA, 20 bp, Artificial
  CRISPR gRNA sequence
caggaccttgaacatagtgg

SEQ ID NO: 328777 - DNA, 20 bp, Artificial
  CRISPR gRNA sequence
agctcaatcatattaaataa

SEQ ID NO: 328778 - DNA, 20 bp, Artificial
  CRISPR gRNA sequence
aataaaagaattaatattaa

SEQ ID NO: 328779 - DNA, 20 bp, Artificial
  CRISPR gRNA sequence
aaaagaattaatattaacag

SEQ ID NO: 328780 - DNA, 20 bp, Artificial
  CRISPR gRNA sequence
aatattaacagaagaatata

SEQ ID NO: 328781 - DNA, 20 bp, Artificial
  CRISPR gRNA sequence
atattaacagaagaatataa

SEQ ID NO: 328782 - DNA, 20 bp, Artificial
  CRISPR gRNA sequence
aacagaagaatataaaggct

SEQ ID NO: 328783 - DNA, 20 bp, Artificial
  CRISPR gRNA sequence
atataaaggctaagcatgtt

SEQ ID NO: 328784 - DNA, 20 bp, Artificial
  CRISPR gRNA sequence
tttggtaaatatctttgtaa

SEQ ID NO: 328785 - DNA, 20 bp, Artificial
  CRISPR gRNA sequence
ttggtaaatatctttgtaat

SEQ ID NO: 328786 - DNA, 20 bp, Artificial
  CRISPR gRNA sequence
aaatatctttgtaatgggcc

SEQ ID NO: 328787 - DNA, 20 bp, Artificial
  CRISPR gRNA sequence
tatctttgtaatgggccaag

SEQ ID NO: 328788 - DNA, 20 bp, Artificial
  CRISPR gRNA sequence
tctttgtaatgggccaagaa

SEQ ID NO: 328789 - DNA, 20 bp, Artificial
  CRISPR gRNA sequence
ctttgtaatgggccaagaag

SEQ ID NO: 328790 - DNA, 20 bp, Artificial
  CRISPR gRNA sequence
ttgtaatgggccaagaagag

SEQ ID NO: 328791 - DNA, 20 bp, Artificial
  CRISPR gRNA sequence
taatgggccaagaagaggag

SEQ ID NO: 328792 - DNA, 20 bp, Artificial
  CRISPR gRNA sequence
aatgggccaagaagaggagt

SEQ ID NO: 328793 - DNA, 20 bp, Artificial
  CRISPR gRNA sequence
gccaagaagaggagtgggaa

SEQ ID NO: 328794 - DNA, 20 bp, Artificial
  CRISPR gRNA sequence
ccaagaagaggagtgggaaa

SEQ ID NO: 328795 - DNA, 20 bp, Artificial
  CRISPR gRNA sequence
aagaagaggagtgggaaaag

SEQ ID NO: 328796 - DNA, 20 bp, Artificial
  CRISPR gRNA sequence
gaagaggagtgggaaaagga

SEQ ID NO: 328797 - DNA, 20 bp, Artificial
  CRISPR gRNA sequence
ggagtgggaaaaggagagca

SEQ ID NO: 328798 - DNA, 20 bp, Artificial
  CRISPR gRNA sequence
agcaaagatcctatttactg

SEQ ID NO: 328799 - DNA, 20 bp, Artificial
  CRISPR gRNA sequence
agatcctatttactgaagat

SEQ ID NO: 328800 - DNA, 20 bp, Artificial
  CRISPR gRNA sequence
gatcctatttactgaagatt

SEQ ID NO: 328801 - DNA, 20 bp, Artificial
  CRISPR gRNA sequence
tcctatttactgaagattgg

SEQ ID NO: 328802 - DNA, 20 bp, Artificial
  CRISPR gRNA sequence
attgggagatacttatttcc

SEQ ID NO: 328803 - DNA, 20 bp, Artificial
  CRISPR gRNA sequence
atacttatttcccagtcaaa

SEQ ID NO: 328804 - DNA, 20 bp, Artificial
  CRISPR gRNA sequence
tatttcccagtcaaaaagaa

SEQ ID NO: 328805 - DNA, 20 bp, Artificial
  CRISPR gRNA sequence
agtcaaaaagaaaagactca

SEQ ID NO: 328806 - DNA, 20 bp, Artificial
  CRISPR gRNA sequence
gtcaaaaagaaaagactcac

SEQ ID NO: 328807 - DNA, 20 bp, Artificial
  CRISPR gRNA sequence
aaaagaaaagactcacggga

SEQ ID NO: 328808 - DNA, 20 bp, Artificial
  CRISPR gRNA sequence
aaagaaaagactcacgggaa

SEQ ID NO: 328809 - DNA, 20 bp, Artificial
  CRISPR gRNA sequence
aagaaaagactcacgggaaa

SEQ ID NO: 328810 - DNA, 20 bp, Artificial
  CRISPR gRNA sequence
gaaaagactcacgggaaagg

SEQ ID NO: 328811 - DNA, 20 bp, Artificial
  CRISPR gRNA sequence
tcccaaacacacactctgac

SEQ ID NO: 328812 - DNA, 20 bp, Artificial
  CRISPR gRNA sequence
ccaaacacacactctgaccg

SEQ ID NO: 328813 - DNA, 20 bp, Artificial
  CRISPR gRNA sequence
aacacacactctgaccggag

SEQ ID NO: 328814 - DNA, 20 bp, Artificial
  CRISPR gRNA sequence
acactctgaccggagaagct

SEQ ID NO: 328815 - DNA, 20 bp, Artificial
  CRISPR gRNA sequence
agaagctgagcgtctgtttg

SEQ ID NO: 328816 - DNA, 20 bp, Artificial
  CRISPR gRNA sequence
aagctgagcgtctgtttgtg

SEQ ID NO: 328817 - DNA, 20 bp, Artificial
  CRISPR gRNA sequence
ctgagcgtctgtttgtggag

SEQ ID NO: 328818 - DNA, 20 bp, Artificial
  CRISPR gRNA sequence
gagaagtttccgactttatc

SEQ ID NO: 328819 - DNA, 20 bp, Artificial
  CRISPR gRNA sequence
gaagtttccgactttatctg

SEQ ID NO: 328820 - DNA, 20 bp, Artificial
  CRISPR gRNA sequence
aagtttccgactttatctgg

SEQ ID NO: 328821 - DNA, 20 bp, Artificial
  CRISPR gRNA sequence
ttccgactttatctggaggt

SEQ ID NO: 328822 - DNA, 20 bp, Artificial
  CRISPR gRNA sequence
actttatctggaggtgagtc

SEQ ID NO: 328823 - DNA, 20 bp, Artificial
  CRISPR gRNA sequence
tatctggaggtgagtcaagt

SEQ ID NO: 328824 - DNA, 20 bp, Artificial
  CRISPR gRNA sequence
tctggaggtgagtcaagtta

SEQ ID NO: 328825 - DNA, 20 bp, Artificial
  CRISPR gRNA sequence
tggaggtgagtcaagttaga

SEQ ID NO: 328826 - DNA, 20 bp, Artificial
  CRISPR gRNA sequence
agtcaagttagagagccaaa

SEQ ID NO: 328827 - DNA, 20 bp, Artificial
  CRISPR gRNA sequence
tcaagttagagagccaaacg

SEQ ID NO: 328828 - DNA, 20 bp, Artificial
  CRISPR gRNA sequence
gagccaaacggagcaaaata

SEQ ID NO: 328829 - DNA, 20 bp, Artificial
  CRISPR gRNA sequence
agccaaacggagcaaaatac

SEQ ID NO: 328830 - DNA, 20 bp, Artificial
  CRISPR gRNA sequence
gccaaacggagcaaaataca

SEQ ID NO: 328831 - DNA, 20 bp, Artificial
  CRISPR gRNA sequence
ccaaacggagcaaaatacag

SEQ ID NO: 328832 - DNA, 20 bp, Artificial
  CRISPR gRNA sequence
aacggagcaaaatacagggg

SEQ ID NO: 328833 - DNA, 20 bp, Artificial
  CRISPR gRNA sequence
cggagcaaaatacaggggta

SEQ ID NO: 328834 - DNA, 20 bp, Artificial
  CRISPR gRNA sequence
ggagcaaaatacaggggtag

SEQ ID NO: 328835 - DNA, 20 bp, Artificial
  CRISPR gRNA sequence
gcaaaatacaggggtagagg

SEQ ID NO: 328836 - DNA, 20 bp, Artificial
  CRISPR gRNA sequence
tacaggggtagaggaagctg

SEQ ID NO: 328837 - DNA, 20 bp, Artificial
  CRISPR gRNA sequence
ggggtagaggaagctgcaga

SEQ ID NO: 328838 - DNA, 20 bp, Artificial
  CRISPR gRNA sequence
gggtagaggaagctgcagaa

SEQ ID NO: 328839 - DNA, 20 bp, Artificial
  CRISPR gRNA sequence
aggaagctgcagaaaggctc

SEQ ID NO: 328840 - DNA, 20 bp, Artificial
  CRISPR gRNA sequence
ggaagctgcagaaaggctct

SEQ ID NO: 328841 - DNA, 20 bp, Artificial
  CRISPR gRNA sequence
aagctgcagaaaggctctgg

SEQ ID NO: 328842 - DNA, 20 bp, Artificial
  CRISPR gRNA sequence
gaaaggctctgggagctcaa

SEQ ID NO: 328843 - DNA, 20 bp, Artificial
  CRISPR gRNA sequence
aaaggctctgggagctcaat

SEQ ID NO: 328844 - DNA, 20 bp, Artificial
  CRISPR gRNA sequence
tgggagctcaatgggtcccc

SEQ ID NO: 328845 - DNA, 20 bp, Artificial
  CRISPR gRNA sequence
gagctcaatgggtccccaag

SEQ ID NO: 328846 - DNA, 20 bp, Artificial
  CRISPR gRNA sequence
cccaagcagcccattcttgc

SEQ ID NO: 328847 - DNA, 20 bp, Artificial
  CRISPR gRNA sequence
ccaagcagcccattcttgcc

SEQ ID NO: 328848 - DNA, 20 bp, Artificial
  CRISPR gRNA sequence
cccattcttgccaggcacca

SEQ ID NO: 328849 - DNA, 20 bp, Artificial
  CRISPR gRNA sequence
ccattcttgccaggcaccac

SEQ ID NO: 328850 - DNA, 20 bp, Artificial
  CRISPR gRNA sequence
cattcttgccaggcaccaca

SEQ ID NO: 328851 - DNA, 20 bp, Artificial
  CRISPR gRNA sequence
aggcaccacagggatccatc

SEQ ID NO: 328852 - DNA, 20 bp, Artificial
  CRISPR gRNA sequence
gcaccacagggatccatctg

SEQ ID NO: 328853 - DNA, 20 bp, Artificial
  CRISPR gRNA sequence
caccacagggatccatctgg

SEQ ID NO: 328854 - DNA, 20 bp, Artificial
  CRISPR gRNA sequence
accacagggatccatctgga

SEQ ID NO: 328855 - DNA, 20 bp, Artificial
  CRISPR gRNA sequence
acagggatccatctggaggg

SEQ ID NO: 328856 - DNA, 20 bp, Artificial
  CRISPR gRNA sequence
ggatccatctggagggtggc

SEQ ID NO: 328857 - DNA, 20 bp, Artificial
  CRISPR gRNA sequence
atccatctggagggtggcca

SEQ ID NO: 328858 - DNA, 20 bp, Artificial
  CRISPR gRNA sequence
tccatctggagggtggccag

SEQ ID NO: 328859 - DNA, 20 bp, Artificial
  CRISPR gRNA sequence
catctggagggtggccagag

SEQ ID NO: 328860 - DNA, 20 bp, Artificial
  CRISPR gRNA sequence
ctggagggtggccagaggag

SEQ ID NO: 328861 - DNA, 20 bp, Artificial
  CRISPR gRNA sequence
tggagggtggccagaggagc

SEQ ID NO: 328862 - DNA, 20 bp, Artificial
  CRISPR gRNA sequence
ggagggtggccagaggagca

SEQ ID NO: 328863 - DNA, 20 bp, Artificial
  CRISPR gRNA sequence
gagcagggtataaaactcca

SEQ ID NO: 328864 - DNA, 20 bp, Artificial
  CRISPR gRNA sequence
agcagggtataaaactccac

SEQ ID NO: 328865 - DNA, 20 bp, Artificial
  CRISPR gRNA sequence
gcagggtataaaactccaca

SEQ ID NO: 328866 - DNA, 20 bp, Artificial
  CRISPR gRNA sequence
agggtataaaactccacagg

SEQ ID NO: 328867 - DNA, 20 bp, Artificial
  CRISPR gRNA sequence
gtataaaactccacagggag

SEQ ID NO: 328868 - DNA, 20 bp, Artificial
  CRISPR gRNA sequence
tataaaactccacagggaga

SEQ ID NO: 328869 - DNA, 20 bp, Artificial
  CRISPR gRNA sequence
cacagggagaaggaattctc

SEQ ID NO: 328870 - DNA, 20 bp, Artificial
  CRISPR gRNA sequence
gaactttgtaactatttgaa

SEQ ID NO: 328871 - DNA, 20 bp, Artificial
  CRISPR gRNA sequence
aactttgtaactatttgaac

SEQ ID NO: 328872 - DNA, 20 bp, Artificial
  CRISPR gRNA sequence
actttgtaactatttgaaca

SEQ ID NO: 328873 - DNA, 20 bp, Artificial
  CRISPR gRNA sequence
tgtaactatttgaacagggc

SEQ ID NO: 328874 - DNA, 20 bp, Artificial
  CRISPR gRNA sequence
aactatttgaacagggcaag

SEQ ID NO: 328875 - DNA, 20 bp, Artificial
  CRISPR gRNA sequence
gaacagggcaagaagtctcc

SEQ ID NO: 328876 - DNA, 20 bp, Artificial
  CRISPR gRNA sequence
agaagtctcctggcctgaac

SEQ ID NO: 328877 - DNA, 20 bp, Artificial
  CRISPR gRNA sequence
gaagtctcctggcctgaact

SEQ ID NO: 328878 - DNA, 20 bp, Artificial
  CRISPR gRNA sequence
aagtctcctggcctgaactg

SEQ ID NO: 328879 - DNA, 20 bp, Artificial
  CRISPR gRNA sequence
agtctcctggcctgaactgg

SEQ ID NO: 328880 - DNA, 20 bp, Artificial
  CRISPR gRNA sequence
gtctcctggcctgaactggg

SEQ ID NO: 328881 - DNA, 20 bp, Artificial
  CRISPR gRNA sequence
ctcctggcctgaactggggg

SEQ ID NO: 328882 - DNA, 20 bp, Artificial
  CRISPR gRNA sequence
tcctggcctgaactgggggg

SEQ ID NO: 328883 - DNA, 20 bp, Artificial
  CRISPR gRNA sequence
ctggggggaggccgtgaatc

SEQ ID NO: 328884 - DNA, 20 bp, Artificial
  CRISPR gRNA sequence
gaggccgtgaatccagcatg

SEQ ID NO: 328885 - DNA, 20 bp, Artificial
  CRISPR gRNA sequence
cagcatgcagatttcacatg

SEQ ID NO: 328886 - DNA, 20 bp, Artificial
  CRISPR gRNA sequence
agcatgcagatttcacatgc

SEQ ID NO: 328887 - DNA, 20 bp, Artificial
  CRISPR gRNA sequence
gcatgcagatttcacatgca

SEQ ID NO: 328888 - DNA, 20 bp, Artificial
  CRISPR gRNA sequence
catgcagatttcacatgcag

SEQ ID NO: 328889 - DNA, 20 bp, Artificial
  CRISPR gRNA sequence
cacatgcaggggaaaaacta

SEQ ID NO: 328890 - DNA, 20 bp, Artificial
  CRISPR gRNA sequence
actaaagcccttttctttca

SEQ ID NO: 328891 - DNA, 20 bp, Artificial
  CRISPR gRNA sequence
aagcccttttctttcacagc

SEQ ID NO: 328892 - DNA, 20 bp, Artificial
  CRISPR gRNA sequence
agcccttttctttcacagct

SEQ ID NO: 328893 - DNA, 20 bp, Artificial
  CRISPR gRNA sequence
cccttttctttcacagctgg

SEQ ID NO: 328894 - DNA, 20 bp, Artificial
  CRISPR gRNA sequence
ccttttctttcacagctggg

SEQ ID NO: 328895 - DNA, 20 bp, Artificial
  CRISPR gRNA sequence
tttctttcacagctgggagg

SEQ ID NO: 328896 - DNA, 20 bp, Artificial
  CRISPR gRNA sequence
tttcacagctgggaggcaga

SEQ ID NO: 328897 - DNA, 20 bp, Artificial
  CRISPR gRNA sequence
agctgggaggcagaaagcct

SEQ ID NO: 328898 - DNA, 20 bp, Artificial
  CRISPR gRNA sequence
gctgggaggcagaaagcctc

SEQ ID NO: 328899 - DNA, 20 bp, Artificial
  CRISPR gRNA sequence
ggaggcagaaagcctcaggc

SEQ ID NO: 328900 - DNA, 20 bp, Artificial
  CRISPR gRNA sequence
aaagcctcaggcaagttttc

SEQ ID NO: 328901 - DNA, 20 bp, Artificial
  CRISPR gRNA sequence
cctcaggcaagttttcaagc

SEQ ID NO: 328902 - DNA, 20 bp, Artificial
  CRISPR gRNA sequence
agccagtcttgccctttgcc

SEQ ID NO: 328903 - DNA, 20 bp, Artificial
  CRISPR gRNA sequence
tcttgccctttgcctggaaa

SEQ ID NO: 328904 - DNA, 20 bp, Artificial
  CRISPR gRNA sequence
cctttgcctggaaacagact

SEQ ID NO: 328905 - DNA, 20 bp, Artificial
  CRISPR gRNA sequence
ctttgcctggaaacagactt

SEQ ID NO: 328906 - DNA, 20 bp, Artificial
  CRISPR gRNA sequence
tttgcctggaaacagacttg

SEQ ID NO: 328907 - DNA, 20 bp, Artificial
  CRISPR gRNA sequence
gcctggaaacagacttgggg

SEQ ID NO: 328908 - DNA, 20 bp, Artificial
  CRISPR gRNA sequence
ggaaacagacttggggcggt

SEQ ID NO: 328909 - DNA, 20 bp, Artificial
  CRISPR gRNA sequence
aaacagacttggggcggtta

SEQ ID NO: 328910 - DNA, 20 bp, Artificial
  CRISPR gRNA sequence
aacagacttggggcggttag

SEQ ID NO: 328911 - DNA, 20 bp, Artificial
  CRISPR gRNA sequence
cagacttggggcggttagag

SEQ ID NO: 328912 - DNA, 20 bp, Artificial
  CRISPR gRNA sequence
agacttggggcggttagagg

SEQ ID NO: 328913 - DNA, 20 bp, Artificial
  CRISPR gRNA sequence
gcggttagaggaggcatgat

SEQ ID NO: 328914 - DNA, 20 bp, Artificial
  CRISPR gRNA sequence
ggttagaggaggcatgatta

SEQ ID NO: 328915 - DNA, 20 bp, Artificial
  CRISPR gRNA sequence
agaggaggcatgattagagt

SEQ ID NO: 328916 - DNA, 20 bp, Artificial
  CRISPR gRNA sequence
aggcatgattagagtgagac

SEQ ID NO: 328917 - DNA, 20 bp, Artificial
  CRISPR gRNA sequence
gaccagcccttccgtttgca

SEQ ID NO: 328918 - DNA, 20 bp, Artificial
  CRISPR gRNA sequence
accagcccttccgtttgcat

SEQ ID NO: 328919 - DNA, 20 bp, Artificial
  CRISPR gRNA sequence
ccttccgtttgcatgggatc

SEQ ID NO: 328920 - DNA, 20 bp, Artificial
  CRISPR gRNA sequence
cgtttgcatgggatctggat

SEQ ID NO: 328921 - DNA, 20 bp, Artificial
  CRISPR gRNA sequence
tggatgagacctgtgactgc

SEQ ID NO: 328922 - DNA, 20 bp, Artificial
  CRISPR gRNA sequence
ccctgacaacctgcatgact

SEQ ID NO: 328923 - DNA, 20 bp, Artificial
  CRISPR gRNA sequence
tgacaacctgcatgactcag

SEQ ID NO: 328924 - DNA, 20 bp, Artificial
  CRISPR gRNA sequence
acaacctgcatgactcagca

SEQ ID NO: 328925 - DNA, 20 bp, Artificial
  CRISPR gRNA sequence
caacctgcatgactcagcag

SEQ ID NO: 328926 - DNA, 20 bp, Artificial
  CRISPR gRNA sequence
cctgcatgactcagcagagg

SEQ ID NO: 328927 - DNA, 20 bp, Artificial
  CRISPR gRNA sequence
agaggcagccataatcctcc

SEQ ID NO: 328928 - DNA, 20 bp, Artificial
  CRISPR gRNA sequence
gaggcagccataatcctcct

SEQ ID NO: 328929 - DNA, 20 bp, Artificial
  CRISPR gRNA sequence
tcctcctaggtacacaactc

SEQ ID NO: 328930 - DNA, 20 bp, Artificial
  CRISPR gRNA sequence
ggtacacaactccagtgacc

SEQ ID NO: 328931 - DNA, 20 bp, Artificial
  CRISPR gRNA sequence
gtacacaactccagtgacct

SEQ ID NO: 328932 - DNA, 20 bp, Artificial
  CRISPR gRNA sequence
aatctcacccacatccccca

SEQ ID NO: 328933 - DNA, 20 bp, Artificial
  CRISPR gRNA sequence
ctcacccacatcccccacag

SEQ ID NO: 328934 - DNA, 20 bp, Artificial
  CRISPR gRNA sequence
cacatcccccacagcagcca

SEQ ID NO: 328935 - DNA, 20 bp, Artificial
  CRISPR gRNA sequence
tcccccacagcagccacagc

SEQ ID NO: 328936 - DNA, 20 bp, Artificial
  CRISPR gRNA sequence
agccacagcaagacctgccc

SEQ ID NO: 328937 - DNA, 20 bp, Artificial
  CRISPR gRNA sequence
gccacagcaagacctgccca

SEQ ID NO: 328938 - DNA, 20 bp, Artificial
  CRISPR gRNA sequence
cacagcaagacctgcccaag

SEQ ID NO: 328939 - DNA, 20 bp, Artificial
  CRISPR gRNA sequence
cagcaagacctgcccaagga

SEQ ID NO: 328940 - DNA, 20 bp, Artificial
  CRISPR gRNA sequence
gacctgcccaaggagagtct

SEQ ID NO: 328941 - DNA, 20 bp, Artificial
  CRISPR gRNA sequence
gcccaaggagagtctgagct

SEQ ID NO: 328942 - DNA, 20 bp, Artificial
  CRISPR gRNA sequence
agtctgagctcagacatgcc

SEQ ID NO: 328943 - DNA, 20 bp, Artificial
  CRISPR gRNA sequence
ctgcccttccctacccaccc

SEQ ID NO: 328944 - DNA, 20 bp, Artificial
  CRISPR gRNA sequence
ccttccctacccaccctggt

SEQ ID NO: 328945 - DNA, 20 bp, Artificial
  CRISPR gRNA sequence
tccctacccaccctggttag

SEQ ID NO: 328946 - DNA, 20 bp, Artificial
  CRISPR gRNA sequence
accctggttagcagaacaca

SEQ ID NO: 328947 - DNA, 20 bp, Artificial
  CRISPR gRNA sequence
ccctggttagcagaacacaa

SEQ ID NO: 328948 - DNA, 20 bp, Artificial
  CRISPR gRNA sequence
cctggttagcagaacacaaa

SEQ ID NO: 328949 - DNA, 20 bp, Artificial
  CRISPR gRNA sequence
acacaaagggcatataatcc

SEQ ID NO: 328950 - DNA, 20 bp, Artificial
  CRISPR gRNA sequence
cacaaagggcatataatcct

SEQ ID NO: 328951 - DNA, 20 bp, Artificial
  CRISPR gRNA sequence
caaagggcatataatcctgg

SEQ ID NO: 328952 - DNA, 20 bp, Artificial
  CRISPR gRNA sequence
gcatataatcctgggagttc

SEQ ID NO: 328953 - DNA, 20 bp, Artificial
  CRISPR gRNA sequence
catataatcctgggagttct

SEQ ID NO: 328954 - DNA, 20 bp, Artificial
  CRISPR gRNA sequence
atataatcctgggagttcta

SEQ ID NO: 328955 - DNA, 20 bp, Artificial
  CRISPR gRNA sequence
tctagggccccacccaccac

SEQ ID NO: 328956 - DNA, 20 bp, Artificial
  CRISPR gRNA sequence
agaccctctctatactatta

SEQ ID NO: 328957 - DNA, 20 bp, Artificial
  CRISPR gRNA sequence
ctattacagctgatgctttc

SEQ ID NO: 328958 - DNA, 20 bp, Artificial
  CRISPR gRNA sequence
tacagctgatgctttctgga

SEQ ID NO: 328959 - DNA, 20 bp, Artificial
  CRISPR gRNA sequence
ttctggaaagcgccacctcc

SEQ ID NO: 328960 - DNA, 20 bp, Artificial
  CRISPR gRNA sequence
tggaaagcgccacctcctgg

SEQ ID NO: 328961 - DNA, 20 bp, Artificial
  CRISPR gRNA sequence
ggaaagcgccacctcctggc

SEQ ID NO: 328962 - DNA, 20 bp, Artificial
  CRISPR gRNA sequence
aaagcgccacctcctggcag

SEQ ID NO: 328963 - DNA, 20 bp, Artificial
  CRISPR gRNA sequence
aagcgccacctcctggcagg

SEQ ID NO: 328964 - DNA, 20 bp, Artificial
  CRISPR gRNA sequence
cctcctggcaggaggccaac

SEQ ID NO: 328965 - DNA, 20 bp, Artificial
  CRISPR gRNA sequence
gaggccaaccagcacaaaaa

SEQ ID NO: 328966 - DNA, 20 bp, Artificial
  CRISPR gRNA sequence
ggccaaccagcacaaaaata

SEQ ID NO: 328967 - DNA, 20 bp, Artificial
  CRISPR gRNA sequence
aatagagcattaaaccacca

SEQ ID NO: 328968 - DNA, 20 bp, Artificial
  CRISPR gRNA sequence
gcattaaaccaccaaagcta

SEQ ID NO: 328969 - DNA, 20 bp, Artificial
  CRISPR gRNA sequence
cattaaaccaccaaagctaa

SEQ ID NO: 328970 - DNA, 20 bp, Artificial
  CRISPR gRNA sequence
accaaagctaaaggccctca

SEQ ID NO: 328971 - DNA, 20 bp, Artificial
  CRISPR gRNA sequence
caaagctaaaggccctcatg

SEQ ID NO: 328972 - DNA, 20 bp, Artificial
  CRISPR gRNA sequence
gcacccttcgccacctccac

SEQ ID NO: 328973 - DNA, 20 bp, Artificial
  CRISPR gRNA sequence
cttcgccacctccaccagaa

SEQ ID NO: 328974 - DNA, 20 bp, Artificial
  CRISPR gRNA sequence
cacctccaccagaacagcac

SEQ ID NO: 328975 - DNA, 20 bp, Artificial
  CRISPR gRNA sequence
cagaacagcactggtatcca

SEQ ID NO: 328976 - DNA, 20 bp, Artificial
  CRISPR gRNA sequence
cagcactggtatccatggct

SEQ ID NO: 328977 - DNA, 20 bp, Artificial
  CRISPR gRNA sequence
gcactggtatccatggctga

SEQ ID NO: 328978 - DNA, 20 bp, Artificial
  CRISPR gRNA sequence
atccatggctgagagaccca

SEQ ID NO: 328979 - DNA, 20 bp, Artificial
  CRISPR gRNA sequence
atggctgagagacccataga

SEQ ID NO: 328980 - DNA, 20 bp, Artificial
  CRISPR gRNA sequence
cccatagatggttcacatca

SEQ ID NO: 328981 - DNA, 20 bp, Artificial
  CRISPR gRNA sequence
ccatagatggttcacatcac

SEQ ID NO: 328982 - DNA, 20 bp, Artificial
  CRISPR gRNA sequence
tcacatcacaggaatctgtg

SEQ ID NO: 328983 - DNA, 20 bp, Artificial
  CRISPR gRNA sequence
gtgcagacaacccccaatac

SEQ ID NO: 328984 - DNA, 20 bp, Artificial
  CRISPR gRNA sequence
gacaacccccaataccagcc

SEQ ID NO: 328985 - DNA, 20 bp, Artificial
  CRISPR gRNA sequence
caacccccaataccagccca

SEQ ID NO: 328986 - DNA, 20 bp, Artificial
  CRISPR gRNA sequence
ccccaataccagcccagagc

SEQ ID NO: 328987 - DNA, 20 bp, Artificial
  CRISPR gRNA sequence
cccaataccagcccagagcc

SEQ ID NO: 328988 - DNA, 20 bp, Artificial
  CRISPR gRNA sequence
aataccagcccagagccggg

SEQ ID NO: 328989 - DNA, 20 bp, Artificial
  CRISPR gRNA sequence
ccagagccgggtagatttgc

SEQ ID NO: 328990 - DNA, 20 bp, Artificial
  CRISPR gRNA sequence
cagagccgggtagatttgct

SEQ ID NO: 328991 - DNA, 20 bp, Artificial
  CRISPR gRNA sequence
agccgggtagatttgctggg

SEQ ID NO: 328992 - DNA, 20 bp, Artificial
  CRISPR gRNA sequence
gggtagatttgctgggtggc

SEQ ID NO: 328993 - DNA, 20 bp, Artificial
  CRISPR gRNA sequence
atttgctgggtggctagacc

SEQ ID NO: 328994 - DNA, 20 bp, Artificial
  CRISPR gRNA sequence
tgctgggtggctagacccag

SEQ ID NO: 328995 - DNA, 20 bp, Artificial
  CRISPR gRNA sequence
ctgggtggctagacccagaa

SEQ ID NO: 328996 - DNA, 20 bp, Artificial
  CRISPR gRNA sequence
gggtggctagacccagaaga

SEQ ID NO: 328997 - DNA, 20 bp, Artificial
  CRISPR gRNA sequence
aagagagacaacaatcactg

SEQ ID NO: 328998 - DNA, 20 bp, Artificial
  CRISPR gRNA sequence
agacaacaatcactgcagtt

SEQ ID NO: 328999 - DNA, 20 bp, Artificial
  CRISPR gRNA sequence
atcactgcagtttggctcac

SEQ ID NO: 329000 - DNA, 20 bp, Artificial
  CRISPR gRNA sequence
actgcagtttggctcactgg

SEQ ID NO: 329001 - DNA, 20 bp, Artificial
  CRISPR gRNA sequence
ctcactggaagccacataca

SEQ ID NO: 329002 - DNA, 20 bp, Artificial
  CRISPR gRNA sequence
tcactggaagccacatacat

SEQ ID NO: 329003 - DNA, 20 bp, Artificial
  CRISPR gRNA sequence
ggaagccacatacataggaa

SEQ ID NO: 329004 - DNA, 20 bp, Artificial
  CRISPR gRNA sequence
gaagccacatacataggaaa

SEQ ID NO: 329005 - DNA, 20 bp, Artificial
  CRISPR gRNA sequence
aagccacatacataggaaaa

SEQ ID NO: 329006 - DNA, 20 bp, Artificial
  CRISPR gRNA sequence
agccacatacataggaaaag

SEQ ID NO: 329007 - DNA, 20 bp, Artificial
  CRISPR gRNA sequence
acatacataggaaaagggga

SEQ ID NO: 329008 - DNA, 20 bp, Artificial
  CRISPR gRNA sequence
aaaggggaaagtatgatatc

SEQ ID NO: 329009 - DNA, 20 bp, Artificial
  CRISPR gRNA sequence
aaggggaaagtatgatatca

SEQ ID NO: 329010 - DNA, 20 bp, Artificial
  CRISPR gRNA sequence
aggggaaagtatgatatcaa

SEQ ID NO: 329011 - DNA, 20 bp, Artificial
  CRISPR gRNA sequence
gatatcaagggaacactcca

SEQ ID NO: 329012 - DNA, 20 bp, Artificial
  CRISPR gRNA sequence
atatcaagggaacactccat

SEQ ID NO: 329013 - DNA, 20 bp, Artificial
  CRISPR gRNA sequence
tgggacaaaaaaaaaatctg

SEQ ID NO: 329014 - DNA, 20 bp, Artificial
  CRISPR gRNA sequence
caaaaaaaaaatctgaagaa

SEQ ID NO: 329015 - DNA, 20 bp, Artificial
  CRISPR gRNA sequence
aaaatctgaagaacagcctt

SEQ ID NO: 329016 - DNA, 20 bp, Artificial
  CRISPR gRNA sequence
tgaagaacagccttcagccc

SEQ ID NO: 329017 - DNA, 20 bp, Artificial
  CRISPR gRNA sequence
gccctagacctcccctctga

SEQ ID NO: 329018 - DNA, 20 bp, Artificial
  CRISPR gRNA sequence
ctgacagcacctacccaaat

SEQ ID NO: 329019 - DNA, 20 bp, Artificial
  CRISPR gRNA sequence
acagcacctacccaaatgag

SEQ ID NO: 329020 - DNA, 20 bp, Artificial
  CRISPR gRNA sequence
cagcacctacccaaatgaga

SEQ ID NO: 329021 - DNA, 20 bp, Artificial
  CRISPR gRNA sequence
ctacccaaatgagaaggaac

SEQ ID NO: 329022 - DNA, 20 bp, Artificial
  CRISPR gRNA sequence
aggaaccagaaaaccaactc

SEQ ID NO: 329023 - DNA, 20 bp, Artificial
  CRISPR gRNA sequence
ctctggtaatatgacaaaac

SEQ ID NO: 329024 - DNA, 20 bp, Artificial
  CRISPR gRNA sequence
tctggtaatatgacaaaaca

SEQ ID NO: 329025 - DNA, 20 bp, Artificial
  CRISPR gRNA sequence
acacccccaaaaaatcacac

SEQ ID NO: 329026 - DNA, 20 bp, Artificial
  CRISPR gRNA sequence
aaaaaatcacactagttcac

SEQ ID NO: 329027 - DNA, 20 bp, Artificial
  CRISPR gRNA sequence
tcacactagttcaccagcaa

SEQ ID NO: 329028 - DNA, 20 bp, Artificial
  CRISPR gRNA sequence
accagcaatggatccaaacc

SEQ ID NO: 329029 - DNA, 20 bp, Artificial
  CRISPR gRNA sequence
agcaatggatccaaaccaag

SEQ ID NO: 329030 - DNA, 20 bp, Artificial
  CRISPR gRNA sequence
aattcttcatctacctgaaa

SEQ ID NO: 329031 - DNA, 20 bp, Artificial
  CRISPR gRNA sequence
catctacctgaaaaagaatt

SEQ ID NO: 329032 - DNA, 20 bp, Artificial
  CRISPR gRNA sequence
atctacctgaaaaagaattc

SEQ ID NO: 329033 - DNA, 20 bp, Artificial
  CRISPR gRNA sequence
ctacctgaaaaagaattcag

SEQ ID NO: 329034 - DNA, 20 bp, Artificial
  CRISPR gRNA sequence
tacctgaaaaagaattcagg

SEQ ID NO: 329035 - DNA, 20 bp, Artificial
  CRISPR gRNA sequence
tgaaaaagaattcaggaggt

SEQ ID NO: 329036 - DNA, 20 bp, Artificial
  CRISPR gRNA sequence
aattcaggaggttagttatt

SEQ ID NO: 329037 - DNA, 20 bp, Artificial
  CRISPR gRNA sequence
aggttagttattaagctaat

SEQ ID NO: 329038 - DNA, 20 bp, Artificial
  CRISPR gRNA sequence
ggttagttattaagctaatc

SEQ ID NO: 329039 - DNA, 20 bp, Artificial
  CRISPR gRNA sequence
gttagttattaagctaatcg

SEQ ID NO: 329040 - DNA, 20 bp, Artificial
  CRISPR gRNA sequence
tagttattaagctaatcggg

SEQ ID NO: 329041 - DNA, 20 bp, Artificial
  CRISPR gRNA sequence
agttattaagctaatcgggg

SEQ ID NO: 329042 - DNA, 20 bp, Artificial
  CRISPR gRNA sequence
gttattaagctaatcgggga

SEQ ID NO: 329043 - DNA, 20 bp, Artificial
  CRISPR gRNA sequence
taagctaatcggggagggac

SEQ ID NO: 329044 - DNA, 20 bp, Artificial
  CRISPR gRNA sequence
agctaatcggggagggacca

SEQ ID NO: 329045 - DNA, 20 bp, Artificial
  CRISPR gRNA sequence
aatcggggagggaccagaga

SEQ ID NO: 329046 - DNA, 20 bp, Artificial
  CRISPR gRNA sequence
atcggggagggaccagagaa

SEQ ID NO: 329047 - DNA, 20 bp, Artificial
  CRISPR gRNA sequence
ggagggaccagagaaaggtg

SEQ ID NO: 329048 - DNA, 20 bp, Artificial
  CRISPR gRNA sequence
agaaaggtgaagcccaatgc

SEQ ID NO: 329049 - DNA, 20 bp, Artificial
  CRISPR gRNA sequence
gaaaggtgaagcccaatgca

SEQ ID NO: 329050 - DNA, 20 bp, Artificial
  CRISPR gRNA sequence
ggaaatgcaaaaaatgatac

SEQ ID NO: 329051 - DNA, 20 bp, Artificial
  CRISPR gRNA sequence
aatgcaaaaaatgatacaag

SEQ ID NO: 329052 - DNA, 20 bp, Artificial
  CRISPR gRNA sequence
aaaaaatgatacaagaagtg

SEQ ID NO: 329053 - DNA, 20 bp, Artificial
  CRISPR gRNA sequence
aaaaatgatacaagaagtga

SEQ ID NO: 329054 - DNA, 20 bp, Artificial
  CRISPR gRNA sequence
aatgatacaagaagtgaagg

SEQ ID NO: 329055 - DNA, 20 bp, Artificial
  CRISPR gRNA sequence
aagtgaaggcagaaatattc

SEQ ID NO: 329056 - DNA, 20 bp, Artificial
  CRISPR gRNA sequence
agtgaaggcagaaatattca

SEQ ID NO: 329057 - DNA, 20 bp, Artificial
  CRISPR gRNA sequence
ggcagaaatattcaaggaaa

SEQ ID NO: 329058 - DNA, 20 bp, Artificial
  CRISPR gRNA sequence
gaaatattcaaggaaataga

SEQ ID NO: 329059 - DNA, 20 bp, Artificial
  CRISPR gRNA sequence
tcaaggaaatagatagctta

SEQ ID NO: 329060 - DNA, 20 bp, Artificial
  CRISPR gRNA sequence
agaaaaaacaataaaaattt

SEQ ID NO: 329061 - DNA, 20 bp, Artificial
  CRISPR gRNA sequence
gaaaaaacaataaaaatttc

SEQ ID NO: 329062 - DNA, 20 bp, Artificial
  CRISPR gRNA sequence
ataaaaatttcaggaaactt

SEQ ID NO: 329063 - DNA, 20 bp, Artificial
  CRISPR gRNA sequence
ggaaactttggacacaattt

SEQ ID NO: 329064 - DNA, 20 bp, Artificial
  CRISPR gRNA sequence
actttggacacaattttaga

SEQ ID NO: 329065 - DNA, 20 bp, Artificial
  CRISPR gRNA sequence
ctttggacacaattttagaa

SEQ ID NO: 329066 - DNA, 20 bp, Artificial
  CRISPR gRNA sequence
tttagaaaggtgaaatgctc

SEQ ID NO: 329067 - DNA, 20 bp, Artificial
  CRISPR gRNA sequence
gaaaggtgaaatgctctgga

SEQ ID NO: 329068 - DNA, 20 bp, Artificial
  CRISPR gRNA sequence
tgaaatgctctggaaagtct

SEQ ID NO: 329069 - DNA, 20 bp, Artificial
  CRISPR gRNA sequence
gctctggaaagtctcagcaa

SEQ ID NO: 329070 - DNA, 20 bp, Artificial
  CRISPR gRNA sequence
cagcaatagaattgaacaac

SEQ ID NO: 329071 - DNA, 20 bp, Artificial
  CRISPR gRNA sequence
caatagaattgaacaactag

SEQ ID NO: 329072 - DNA, 20 bp, Artificial
  CRISPR gRNA sequence
agaattgaacaactagaaga

SEQ ID NO: 329073 - DNA, 20 bp, Artificial
  CRISPR gRNA sequence
acaactagaagaaagaaatt

SEQ ID NO: 329074 - DNA, 20 bp, Artificial
  CRISPR gRNA sequence
aactagaagaaagaaattca

SEQ ID NO: 329075 - DNA, 20 bp, Artificial
  CRISPR gRNA sequence
agaaagaaattcagagcttg

SEQ ID NO: 329076 - DNA, 20 bp, Artificial
  CRISPR gRNA sequence
gaaattcagagcttgaagac

SEQ ID NO: 329077 - DNA, 20 bp, Artificial
  CRISPR gRNA sequence
aaattcagagcttgaagaca

SEQ ID NO: 329078 - DNA, 20 bp, Artificial
  CRISPR gRNA sequence
acaaggtcttcgaattaacc

SEQ ID NO: 329079 - DNA, 20 bp, Artificial
  CRISPR gRNA sequence
aacccagtccaacaaaaaca

SEQ ID NO: 329080 - DNA, 20 bp, Artificial
  CRISPR gRNA sequence
tccaacaaaaacaaagaaaa

SEQ ID NO: 329081 - DNA, 20 bp, Artificial
  CRISPR gRNA sequence
aaaaacaaagaaaaaagaat

SEQ ID NO: 329082 - DNA, 20 bp, Artificial
  CRISPR gRNA sequence
agaataagataatttgacac

SEQ ID NO: 329083 - DNA, 20 bp, Artificial
  CRISPR gRNA sequence
gaataagataatttgacacc

SEQ ID NO: 329084 - DNA, 20 bp, Artificial
  CRISPR gRNA sequence
aataagataatttgacacca

SEQ ID NO: 329085 - DNA, 20 bp, Artificial
  CRISPR gRNA sequence
aatctcttcacctaataatc

SEQ ID NO: 329086 - DNA, 20 bp, Artificial
  CRISPR gRNA sequence
agtccaatcctctcattgta

SEQ ID NO: 329087 - DNA, 20 bp, Artificial
  CRISPR gRNA sequence
ctctcattgtacagaaacta

SEQ ID NO: 329088 - DNA, 20 bp, Artificial
  CRISPR gRNA sequence
ttgtacagaaactaaagcat

SEQ ID NO: 329089 - DNA, 20 bp, Artificial
  CRISPR gRNA sequence
gtacagaaactaaagcatca

SEQ ID NO: 329090 - DNA, 20 bp, Artificial
  CRISPR gRNA sequence
aaactaaagcatcagagcta

SEQ ID NO: 329091 - DNA, 20 bp, Artificial
  CRISPR gRNA sequence
actaaagcatcagagctaaa

SEQ ID NO: 329092 - DNA, 20 bp, Artificial
  CRISPR gRNA sequence
ctacgaaataaaaaaacaaa

SEQ ID NO: 329093 - DNA, 20 bp, Artificial
  CRISPR gRNA sequence
cgaaataaaaaaacaaaaag

SEQ ID NO: 329094 - DNA, 20 bp, Artificial
  CRISPR gRNA sequence
aaaaagaagcttttaacatt

SEQ ID NO: 329095 - DNA, 20 bp, Artificial
  CRISPR gRNA sequence
agaagcttttaacattaagc

SEQ ID NO: 329096 - DNA, 20 bp, Artificial
  CRISPR gRNA sequence
ctagatatgaaaatgaattt

SEQ ID NO: 329097 - DNA, 20 bp, Artificial
  CRISPR gRNA sequence
tagatatgaaaatgaatttc

SEQ ID NO: 329098 - DNA, 20 bp, Artificial
  CRISPR gRNA sequence
tcaggtatttattttccttc

SEQ ID NO: 329099 - DNA, 20 bp, Artificial
  CRISPR gRNA sequence
caggtatttattttccttct

SEQ ID NO: 329100 - DNA, 20 bp, Artificial
  CRISPR gRNA sequence
tattttccttctaggtatat

SEQ ID NO: 329101 - DNA, 20 bp, Artificial
  CRISPR gRNA sequence
tattatcaccttaatactta

SEQ ID NO: 329102 - DNA, 20 bp, Artificial
  CRISPR gRNA sequence
tatcaccttaatacttaaag

SEQ ID NO: 329103 - DNA, 20 bp, Artificial
  CRISPR gRNA sequence
acttaaagtagtattcacat

SEQ ID NO: 329104 - DNA, 20 bp, Artificial
  CRISPR gRNA sequence
catatgtgttctgtgattga

SEQ ID NO: 329105 - DNA, 20 bp, Artificial
  CRISPR gRNA sequence
atatgtgttctgtgattgaa

SEQ ID NO: 329106 - DNA, 20 bp, Artificial
  CRISPR gRNA sequence
tatgtgttctgtgattgaaa

SEQ ID NO: 329107 - DNA, 20 bp, Artificial
  CRISPR gRNA sequence
tatatcaaaaaattatttta

SEQ ID NO: 329108 - DNA, 20 bp, Artificial
  CRISPR gRNA sequence
aaaattattttaaagtgact

SEQ ID NO: 329109 - DNA, 20 bp, Artificial
  CRISPR gRNA sequence
acataacacactcatttccc

SEQ ID NO: 329110 - DNA, 20 bp, Artificial
  CRISPR gRNA sequence
ccctagacattttcattcat

SEQ ID NO: 329111 - DNA, 20 bp, Artificial
  CRISPR gRNA sequence
ttcatcagccatcatgtatt

SEQ ID NO: 329112 - DNA, 20 bp, Artificial
  CRISPR gRNA sequence
tcagccatcatgtattaagc

SEQ ID NO: 329113 - DNA, 20 bp, Artificial
  CRISPR gRNA sequence
cagccatcatgtattaagct

SEQ ID NO: 329114 - DNA, 20 bp, Artificial
  CRISPR gRNA sequence
agctgggctgtcattgtacc

SEQ ID NO: 329115 - DNA, 20 bp, Artificial
  CRISPR gRNA sequence
gctgggctgtcattgtacct

SEQ ID NO: 329116 - DNA, 20 bp, Artificial
  CRISPR gRNA sequence
acctgggttcttctctgatg

SEQ ID NO: 329117 - DNA, 20 bp, Artificial
  CRISPR gRNA sequence
tcccatcacttatctgcctg

SEQ ID NO: 329118 - DNA, 20 bp, Artificial
  CRISPR gRNA sequence
tatctgcctgtagaaatgta

SEQ ID NO: 329119 - DNA, 20 bp, Artificial
  CRISPR gRNA sequence
cctgtagaaatgtacagaaa

SEQ ID NO: 329120 - DNA, 20 bp, Artificial
  CRISPR gRNA sequence
tacagaaatggattcacata

SEQ ID NO: 329121 - DNA, 20 bp, Artificial
  CRISPR gRNA sequence
agaaatggattcacatatag

SEQ ID NO: 329122 - DNA, 20 bp, Artificial
  CRISPR gRNA sequence
aaatttcatcataattaaat

SEQ ID NO: 329123 - DNA, 20 bp, Artificial
  CRISPR gRNA sequence
cataattaaataagtgcaaa

SEQ ID NO: 329124 - DNA, 20 bp, Artificial
  CRISPR gRNA sequence
ataattaaataagtgcaaat

SEQ ID NO: 329125 - DNA, 20 bp, Artificial
  CRISPR gRNA sequence
gtgcaaataggcacatctat

SEQ ID NO: 329126 - DNA, 20 bp, Artificial
  CRISPR gRNA sequence
catctatgagatttttgcat

SEQ ID NO: 329127 - DNA, 20 bp, Artificial
  CRISPR gRNA sequence
tgagatttttgcattagtcc

SEQ ID NO: 329128 - DNA, 20 bp, Artificial
  CRISPR gRNA sequence
atttttgcattagtcctaga

SEQ ID NO: 329129 - DNA, 20 bp, Artificial
  CRISPR gRNA sequence
cattagtcctagatagtgca

SEQ ID NO: 329130 - DNA, 20 bp, Artificial
  CRISPR gRNA sequence
cctagatagtgcaaagtaaa

SEQ ID NO: 329131 - DNA, 20 bp, Artificial
  CRISPR gRNA sequence
gtaaacagaactttaactgt

SEQ ID NO: 329132 - DNA, 20 bp, Artificial
  CRISPR gRNA sequence
cagaactttaactgtgagtg

SEQ ID NO: 329133 - DNA, 20 bp, Artificial
  CRISPR gRNA sequence
aactttaactgtgagtgcag

SEQ ID NO: 329134 - DNA, 20 bp, Artificial
  CRISPR gRNA sequence
ttaactgtgagtgcagtaga

SEQ ID NO: 329135 - DNA, 20 bp, Artificial
  CRISPR gRNA sequence
tattgttgtttttgcatgta

SEQ ID NO: 329136 - DNA, 20 bp, Artificial
  CRISPR gRNA sequence
tgtacagattctttgttgca

SEQ ID NO: 329137 - DNA, 20 bp, Artificial
  CRISPR gRNA sequence
gattctttgttgcaaagtcc

SEQ ID NO: 329138 - DNA, 20 bp, Artificial
  CRISPR gRNA sequence
tctttgttgcaaagtcctag

SEQ ID NO: 329139 - DNA, 20 bp, Artificial
  CRISPR gRNA sequence
gtcctagaagaacacaaata

SEQ ID NO: 329140 - DNA, 20 bp, Artificial
  CRISPR gRNA sequence
tcctagaagaacacaaatac

SEQ ID NO: 329141 - DNA, 20 bp, Artificial
  CRISPR gRNA sequence
tctatttatcaaattcaaaa

SEQ ID NO: 329142 - DNA, 20 bp, Artificial
  CRISPR gRNA sequence
gatcattaattgcttattga

SEQ ID NO: 329143 - DNA, 20 bp, Artificial
  CRISPR gRNA sequence
gtcaacatgactcaaataaa

SEQ ID NO: 329144 - DNA, 20 bp, Artificial
  CRISPR gRNA sequence
acagatcctaacaacactcg

SEQ ID NO: 329145 - DNA, 20 bp, Artificial
  CRISPR gRNA sequence
taacaacactcgtggtcaac

SEQ ID NO: 329146 - DNA, 20 bp, Artificial
  CRISPR gRNA sequence
aacactcgtggtcaactgga

SEQ ID NO: 329147 - DNA, 20 bp, Artificial
  CRISPR gRNA sequence
gtcaactggatggaaactcc

SEQ ID NO: 329148 - DNA, 20 bp, Artificial
  CRISPR gRNA sequence
tcctggtctatcaccctatt

SEQ ID NO: 329149 - DNA, 20 bp, Artificial
  CRISPR gRNA sequence
cctggtctatcaccctattt

SEQ ID NO: 329150 - DNA, 20 bp, Artificial
  CRISPR gRNA sequence
ctggtctatcaccctatttg

SEQ ID NO: 329151 - DNA, 20 bp, Artificial
  CRISPR gRNA sequence
cgtgtttcttttttttcctc

SEQ ID NO: 329152 - DNA, 20 bp, Artificial
  CRISPR gRNA sequence
ttcttttttttcctcaagca

SEQ ID NO: 329153 - DNA, 20 bp, Artificial
  CRISPR gRNA sequence
ttttttttcctcaagcaaag

SEQ ID NO: 329154 - DNA, 20 bp, Artificial
  CRISPR gRNA sequence
tcctcaagcaaagtagatac

SEQ ID NO: 329155 - DNA, 20 bp, Artificial
  CRISPR gRNA sequence
tcattatgttatacatgaac

SEQ ID NO: 329156 - DNA, 20 bp, Artificial
  CRISPR gRNA sequence
ttatgttatacatgaaccag

SEQ ID NO: 329157 - DNA, 20 bp, Artificial
  CRISPR gRNA sequence
tatgttatacatgaaccaga

SEQ ID NO: 329158 - DNA, 20 bp, Artificial
  CRISPR gRNA sequence
gttatacatgaaccagaagg

SEQ ID NO: 329159 - DNA, 20 bp, Artificial
  CRISPR gRNA sequence
cagaaggaagttcatatccc

SEQ ID NO: 329160 - DNA, 20 bp, Artificial
  CRISPR gRNA sequence
ttgcaaatctttacctgttt

SEQ ID NO: 329161 - DNA, 20 bp, Artificial
  CRISPR gRNA sequence
acctgttttggtcaacctta

SEQ ID NO: 329162 - DNA, 20 bp, Artificial
  CRISPR gRNA sequence
cctgttttggtcaaccttac

SEQ ID NO: 329163 - DNA, 20 bp, Artificial
  CRISPR gRNA sequence
gacatatcccctacatactt

SEQ ID NO: 329164 - DNA, 20 bp, Artificial
  CRISPR gRNA sequence
atataattgtgaatttttat

SEQ ID NO: 329165 - DNA, 20 bp, Artificial
  CRISPR gRNA sequence
tataattgtgaatttttata

SEQ ID NO: 329166 - DNA, 20 bp, Artificial
  CRISPR gRNA sequence
tttcactttgaatgaccaaa

SEQ ID NO: 329167 - DNA, 20 bp, Artificial
  CRISPR gRNA sequence
gaccaaaaagtgccatttga

SEQ ID NO: 329168 - DNA, 20 bp, Artificial
  CRISPR gRNA sequence
aaagtgccatttgacagacc

SEQ ID NO: 329169 - DNA, 20 bp, Artificial
  CRISPR gRNA sequence
atttgacagacctagtttat

SEQ ID NO: 329170 - DNA, 20 bp, Artificial
  CRISPR gRNA sequence
acagacctagtttattagaa

SEQ ID NO: 329171 - DNA, 20 bp, Artificial
  CRISPR gRNA sequence
gacctagtttattagaacag

SEQ ID NO: 329172 - DNA, 20 bp, Artificial
  CRISPR gRNA sequence
ctagtttattagaacagcag

SEQ ID NO: 329173 - DNA, 20 bp, Artificial
  CRISPR gRNA sequence
attagaacagcagtagtact

SEQ ID NO: 329174 - DNA, 20 bp, Artificial
  CRISPR gRNA sequence
tagtactgagatgccattta

SEQ ID NO: 329175 - DNA, 20 bp, Artificial
  CRISPR gRNA sequence
gtactgagatgccatttaca

SEQ ID NO: 329176 - DNA, 20 bp, Artificial
  CRISPR gRNA sequence
agaaattgtgatcttttctt

SEQ ID NO: 329177 - DNA, 20 bp, Artificial
  CRISPR gRNA sequence
atcttttcttcagttattgc

SEQ ID NO: 329178 - DNA, 20 bp, Artificial
  CRISPR gRNA sequence
ctcatttttaaaaatttgca

SEQ ID NO: 329179 - DNA, 20 bp, Artificial
  CRISPR gRNA sequence
ttttaaaaatttgcaaagcc

SEQ ID NO: 329180 - DNA, 20 bp, Artificial
  CRISPR gRNA sequence
aaaaatttgcaaagcccagt

SEQ ID NO: 329181 - DNA, 20 bp, Artificial
  CRISPR gRNA sequence
catataaaactcaatattct

SEQ ID NO: 329182 - DNA, 20 bp, Artificial
  CRISPR gRNA sequence
tataaaactcaatattctta

SEQ ID NO: 329183 - DNA, 20 bp, Artificial
  CRISPR gRNA sequence
aaaactcaatattcttagag

SEQ ID NO: 329184 - DNA, 20 bp, Artificial
  CRISPR gRNA sequence
aaactcaatattcttagagt

SEQ ID NO: 329185 - DNA, 20 bp, Artificial
  CRISPR gRNA sequence
aactcaatattcttagagta

SEQ ID NO: 329186 - DNA, 20 bp, Artificial
  CRISPR gRNA sequence
tcaatattcttagagtaggg

SEQ ID NO: 329187 - DNA, 20 bp, Artificial
  CRISPR gRNA sequence
atattcttagagtagggaag

SEQ ID NO: 329188 - DNA, 20 bp, Artificial
  CRISPR gRNA sequence
tagggaagcagtatatgttg

SEQ ID NO: 329189 - DNA, 20 bp, Artificial
  CRISPR gRNA sequence
ctgtttacaactgtgaatac

SEQ ID NO: 329190 - DNA, 20 bp, Artificial
  CRISPR gRNA sequence
tgtttacaactgtgaatact

SEQ ID NO: 329191 - DNA, 20 bp, Artificial
  CRISPR gRNA sequence
atactgggatgaattttttt

SEQ ID NO: 329192 - DNA, 20 bp, Artificial
  CRISPR gRNA sequence
aaataatgctatgaatctta

SEQ ID NO: 329193 - DNA, 20 bp, Artificial
  CRISPR gRNA sequence
aatgctatgaatcttacagt

SEQ ID NO: 329194 - DNA, 20 bp, Artificial
  CRISPR gRNA sequence
atcttacagtgagtaaatat

SEQ ID NO: 329195 - DNA, 20 bp, Artificial
  CRISPR gRNA sequence
gtgagtaaatataagaattt

SEQ ID NO: 329196 - DNA, 20 bp, Artificial
  CRISPR gRNA sequence
gcctgcattttgtttctacc

SEQ ID NO: 329197 - DNA, 20 bp, Artificial
  CRISPR gRNA sequence
attttgtttctaccaagaaa

SEQ ID NO: 329198 - DNA, 20 bp, Artificial
  CRISPR gRNA sequence
ttttgtttctaccaagaaat

SEQ ID NO: 329199 - DNA, 20 bp, Artificial
  CRISPR gRNA sequence
aagaaatgggaatatgctac

SEQ ID NO: 329200 - DNA, 20 bp, Artificial
  CRISPR gRNA sequence
tgaaatatccatttcatctg

SEQ ID NO: 329201 - DNA, 20 bp, Artificial
  CRISPR gRNA sequence
gaaatatccatttcatctga

SEQ ID NO: 329202 - DNA, 20 bp, Artificial
  CRISPR gRNA sequence
aatatccatttcatctgaag

SEQ ID NO: 329203 - DNA, 20 bp, Artificial
  CRISPR gRNA sequence
catttcatctgaaggagttg

SEQ ID NO: 329204 - DNA, 20 bp, Artificial
  CRISPR gRNA sequence
ctgaaggagttgtggttaac

SEQ ID NO: 329205 - DNA, 20 bp, Artificial
  CRISPR gRNA sequence
gagttgtggttaacaagcaa

SEQ ID NO: 329206 - DNA, 20 bp, Artificial
  CRISPR gRNA sequence
tgtggttaacaagcaacagc

SEQ ID NO: 329207 - DNA, 20 bp, Artificial
  CRISPR gRNA sequence
caagcaacagcaagttgtga

SEQ ID NO: 329208 - DNA, 20 bp, Artificial
  CRISPR gRNA sequence
ttcacaaatgatgaaaaaat

SEQ ID NO: 329209 - DNA, 20 bp, Artificial
  CRISPR gRNA sequence
tcacaaatgatgaaaaaata

SEQ ID NO: 329210 - DNA, 20 bp, Artificial
  CRISPR gRNA sequence
cacaaatgatgaaaaaataa

SEQ ID NO: 329211 - DNA, 20 bp, Artificial
  CRISPR gRNA sequence
gatgaaaaaataagggactc

SEQ ID NO: 329212 - DNA, 20 bp, Artificial
  CRISPR gRNA sequence
agggactcaagatcttacat

SEQ ID NO: 329213 - DNA, 20 bp, Artificial
  CRISPR gRNA sequence
tcaagatcttacataagaat

SEQ ID NO: 329214 - DNA, 20 bp, Artificial
  CRISPR gRNA sequence
aagatcttacataagaataa

SEQ ID NO: 329215 - DNA, 20 bp, Artificial
  CRISPR gRNA sequence
ataagaataagagacatttc

SEQ ID NO: 329216 - DNA, 20 bp, Artificial
  CRISPR gRNA sequence
gaataagagacatttctaga

SEQ ID NO: 329217 - DNA, 20 bp, Artificial
  CRISPR gRNA sequence
ataagagacatttctagaaa

SEQ ID NO: 329218 - DNA, 20 bp, Artificial
  CRISPR gRNA sequence
agagacatttctagaaagag

SEQ ID NO: 329219 - DNA, 20 bp, Artificial
  CRISPR gRNA sequence
gagacatttctagaaagagt

SEQ ID NO: 329220 - DNA, 20 bp, Artificial
  CRISPR gRNA sequence
agacatttctagaaagagtg

SEQ ID NO: 329221 - DNA, 20 bp, Artificial
  CRISPR gRNA sequence
ctagaaagagtggggaaaaa

SEQ ID NO: 329222 - DNA, 20 bp, Artificial
  CRISPR gRNA sequence
agagtggggaaaaacagcat

SEQ ID NO: 329223 - DNA, 20 bp, Artificial
  CRISPR gRNA sequence
gagtggggaaaaacagcata

SEQ ID NO: 329224 - DNA, 20 bp, Artificial
  CRISPR gRNA sequence
aggtatgattaaacaaatac

SEQ ID NO: 329225 - DNA, 20 bp, Artificial
  CRISPR gRNA sequence
ggtatgattaaacaaatact

SEQ ID NO: 329226 - DNA, 20 bp, Artificial
  CRISPR gRNA sequence
ggaaaaaaatgactgaaatg

SEQ ID NO: 329227 - DNA, 20 bp, Artificial
  CRISPR gRNA sequence
aatgactgaaatgaagaata

SEQ ID NO: 329228 - DNA, 20 bp, Artificial
  CRISPR gRNA sequence
tgaaatgaagaataaagctt

SEQ ID NO: 329229 - DNA, 20 bp, Artificial
  CRISPR gRNA sequence
tgaagaataaagcttgagtc

SEQ ID NO: 329230 - DNA, 20 bp, Artificial
  CRISPR gRNA sequence
aagaataaagcttgagtcta

SEQ ID NO: 329231 - DNA, 20 bp, Artificial
  CRISPR gRNA sequence
agagattgaaaactttcacc

SEQ ID NO: 329232 - DNA, 20 bp, Artificial
  CRISPR gRNA sequence
aaaaaataataataaattaa

SEQ ID NO: 329233 - DNA, 20 bp, Artificial
  CRISPR gRNA sequence
ataataataaattaatagaa

SEQ ID NO: 329234 - DNA, 20 bp, Artificial
  CRISPR gRNA sequence
ataataaattaatagaacag

SEQ ID NO: 329235 - DNA, 20 bp, Artificial
  CRISPR gRNA sequence
taataaattaatagaacagc

SEQ ID NO: 329236 - DNA, 20 bp, Artificial
  CRISPR gRNA sequence
aataaattaatagaacagcg

SEQ ID NO: 329237 - DNA, 20 bp, Artificial
  CRISPR gRNA sequence
attaatagaacagcggggcg

SEQ ID NO: 329238 - DNA, 20 bp, Artificial
  CRISPR gRNA sequence
aatagaacagcggggcgcgg

SEQ ID NO: 329239 - DNA, 20 bp, Artificial
  CRISPR gRNA sequence
gtggctcacgcctgtaatcc

SEQ ID NO: 329240 - DNA, 20 bp, Artificial
  CRISPR gRNA sequence
cgcctgtaatcccagcactt

SEQ ID NO: 329241 - DNA, 20 bp, Artificial
  CRISPR gRNA sequence
gcctgtaatcccagcacttt

SEQ ID NO: 329242 - DNA, 20 bp, Artificial
  CRISPR gRNA sequence
ctgtaatcccagcactttgg

SEQ ID NO: 329243 - DNA, 20 bp, Artificial
  CRISPR gRNA sequence
tgtaatcccagcactttggg

SEQ ID NO: 329244 - DNA, 20 bp, Artificial
  CRISPR gRNA sequence
aatcccagcactttgggagg

SEQ ID NO: 329245 - DNA, 20 bp, Artificial
  CRISPR gRNA sequence
tcccagcactttgggaggcg

SEQ ID NO: 329246 - DNA, 20 bp, Artificial
  CRISPR gRNA sequence
cccagcactttgggaggcgg

SEQ ID NO: 329247 - DNA, 20 bp, Artificial
  CRISPR gRNA sequence
agcactttgggaggcggagg

SEQ ID NO: 329248 - DNA, 20 bp, Artificial
  CRISPR gRNA sequence
cactttgggaggcggaggcg

SEQ ID NO: 329249 - DNA, 20 bp, Artificial
  CRISPR gRNA sequence
actttgggaggcggaggcgg

SEQ ID NO: 329250 - DNA, 20 bp, Artificial
  CRISPR gRNA sequence
ttgggaggcggaggcggagg

SEQ ID NO: 329251 - DNA, 20 bp, Artificial
  CRISPR gRNA sequence
gggaggcggaggcggaggcg

SEQ ID NO: 329252 - DNA, 20 bp, Artificial
  CRISPR gRNA sequence
ggaggcggaggcggaggcgg

SEQ ID NO: 329253 - DNA, 20 bp, Artificial
  CRISPR gRNA sequence
ggcggaggcggaggcggagg

SEQ ID NO: 329254 - DNA, 20 bp, Artificial
  CRISPR gRNA sequence
gcggaggcggaggcggaggt

SEQ ID NO: 329255 - DNA, 20 bp, Artificial
  CRISPR gRNA sequence
gaggcggaggcggaggtggg

SEQ ID NO: 329256 - DNA, 20 bp, Artificial
  CRISPR gRNA sequence
ggcggaggtgggcggatcac

SEQ ID NO: 329257 - DNA, 20 bp, Artificial
  CRISPR gRNA sequence
gcggaggtgggcggatcacg

SEQ ID NO: 329258 - DNA, 20 bp, Artificial
  CRISPR gRNA sequence
aggtgggcggatcacgaggt

SEQ ID NO: 329259 - DNA, 20 bp, Artificial
  CRISPR gRNA sequence
ggtgggcggatcacgaggtc

SEQ ID NO: 329260 - DNA, 20 bp, Artificial
  CRISPR gRNA sequence
gatcacgaggtcaggaaatt

SEQ ID NO: 329261 - DNA, 20 bp, Artificial
  CRISPR gRNA sequence
tcaggaaattgagaccatcc

SEQ ID NO: 329262 - DNA, 20 bp, Artificial
  CRISPR gRNA sequence
tgagaccatcctggctaaca

SEQ ID NO: 329263 - DNA, 20 bp, Artificial
  CRISPR gRNA sequence
tacgaaaaatacaaaaaaat

SEQ ID NO: 329264 - DNA, 20 bp, Artificial
  CRISPR gRNA sequence
aaaaatacaaaaaaattagc

SEQ ID NO: 329265 - DNA, 20 bp, Artificial
  CRISPR gRNA sequence
aaaatacaaaaaaattagcc

SEQ ID NO: 329266 - DNA, 20 bp, Artificial
  CRISPR gRNA sequence
acaaaaaaattagccaggcg

SEQ ID NO: 329267 - DNA, 20 bp, Artificial
  CRISPR gRNA sequence
aaaaaattagccaggcgtgg

SEQ ID NO: 329268 - DNA, 20 bp, Artificial
  CRISPR gRNA sequence
aaattagccaggcgtggtgg

SEQ ID NO: 329269 - DNA, 20 bp, Artificial
  CRISPR gRNA sequence
aattagccaggcgtggtggc

SEQ ID NO: 329270 - DNA, 20 bp, Artificial
  CRISPR gRNA sequence
ggcgtggtggcgggtgcctg

SEQ ID NO: 329271 - DNA, 20 bp, Artificial
  CRISPR gRNA sequence
tgcctgtagtctcacctact

SEQ ID NO: 329272 - DNA, 20 bp, Artificial
  CRISPR gRNA sequence
gcctgtagtctcacctactt

SEQ ID NO: 329273 - DNA, 20 bp, Artificial
  CRISPR gRNA sequence
ctgtagtctcacctacttgg

SEQ ID NO: 329274 - DNA, 20 bp, Artificial
  CRISPR gRNA sequence
tgtagtctcacctacttggg

SEQ ID NO: 329275 - DNA, 20 bp, Artificial
  CRISPR gRNA sequence
tctcacctacttgggaggct

SEQ ID NO: 329276 - DNA, 20 bp, Artificial
  CRISPR gRNA sequence
ctcacctacttgggaggctg

SEQ ID NO: 329277 - DNA, 20 bp, Artificial
  CRISPR gRNA sequence
acctacttgggaggctgagg

SEQ ID NO: 329278 - DNA, 20 bp, Artificial
  CRISPR gRNA sequence
cctacttgggaggctgaggc

SEQ ID NO: 329279 - DNA, 20 bp, Artificial
  CRISPR gRNA sequence
tacttgggaggctgaggcag

SEQ ID NO: 329280 - DNA, 20 bp, Artificial
  CRISPR gRNA sequence
gcaggagaatcgcttcaacc

SEQ ID NO: 329281 - DNA, 20 bp, Artificial
  CRISPR gRNA sequence
caggagaatcgcttcaaccc

SEQ ID NO: 329282 - DNA, 20 bp, Artificial
  CRISPR gRNA sequence
ggagaatcgcttcaacccgg

SEQ ID NO: 329283 - DNA, 20 bp, Artificial
  CRISPR gRNA sequence
gagaatcgcttcaacccggg

SEQ ID NO: 329284 - DNA, 20 bp, Artificial
  CRISPR gRNA sequence
aatcgcttcaacccgggagg

SEQ ID NO: 329285 - DNA, 20 bp, Artificial
  CRISPR gRNA sequence
tcgcttcaacccgggaggtg

SEQ ID NO: 329286 - DNA, 20 bp, Artificial
  CRISPR gRNA sequence
cgcttcaacccgggaggtgg

SEQ ID NO: 329287 - DNA, 20 bp, Artificial
  CRISPR gRNA sequence
aacccgggaggtggaggttg

SEQ ID NO: 329288 - DNA, 20 bp, Artificial
  CRISPR gRNA sequence
cgggaggtggaggttgcagt

SEQ ID NO: 329289 - DNA, 20 bp, Artificial
  CRISPR gRNA sequence
ggtggaggttgcagtaagcc

SEQ ID NO: 329290 - DNA, 20 bp, Artificial
  CRISPR gRNA sequence
gagattgcgccactgcactc

SEQ ID NO: 329291 - DNA, 20 bp, Artificial
  CRISPR gRNA sequence
tgcgccactgcactccagcc

SEQ ID NO: 329292 - DNA, 20 bp, Artificial
  CRISPR gRNA sequence
gcgccactgcactccagcct

SEQ ID NO: 329293 - DNA, 20 bp, Artificial
  CRISPR gRNA sequence
ctgcactccagcctgggcga

SEQ ID NO: 329294 - DNA, 20 bp, Artificial
  CRISPR gRNA sequence
gcactccagcctgggcgaca

SEQ ID NO: 329295 - DNA, 20 bp, Artificial
  CRISPR gRNA sequence
tccagcctgggcgacagagt

SEQ ID NO: 329296 - DNA, 20 bp, Artificial
  CRISPR gRNA sequence
cgcctcaaaaaaaaaattaa

SEQ ID NO: 329297 - DNA, 20 bp, Artificial
  CRISPR gRNA sequence
aaaaaattaatagaaacaca

SEQ ID NO: 329298 - DNA, 20 bp, Artificial
  CRISPR gRNA sequence
aattaatagaaacacacaga

SEQ ID NO: 329299 - DNA, 20 bp, Artificial
  CRISPR gRNA sequence
ttaatagaaacacacagaaa

SEQ ID NO: 329300 - DNA, 20 bp, Artificial
  CRISPR gRNA sequence
gaaacacacagaaagagaaa

SEQ ID NO: 329301 - DNA, 20 bp, Artificial
  CRISPR gRNA sequence
aacacacagaaagagaaaca

SEQ ID NO: 329302 - DNA, 20 bp, Artificial
  CRISPR gRNA sequence
acacacagaaagagaaacag

SEQ ID NO: 329303 - DNA, 20 bp, Artificial
  CRISPR gRNA sequence
cacacagaaagagaaacaga

SEQ ID NO: 329304 - DNA, 20 bp, Artificial
  CRISPR gRNA sequence
cacagaaagagaaacagagg

SEQ ID NO: 329305 - DNA, 20 bp, Artificial
  CRISPR gRNA sequence
cagaaagagaaacagaggga

SEQ ID NO: 329306 - DNA, 20 bp, Artificial
  CRISPR gRNA sequence
gaaagagaaacagagggaga

SEQ ID NO: 329307 - DNA, 20 bp, Artificial
  CRISPR gRNA sequence
ggagagagttacacatatcc

SEQ ID NO: 329308 - DNA, 20 bp, Artificial
  CRISPR gRNA sequence
agagagttacacatatcctg

SEQ ID NO: 329309 - DNA, 20 bp, Artificial
  CRISPR gRNA sequence
gagagttacacatatcctgg

SEQ ID NO: 329310 - DNA, 20 bp, Artificial
  CRISPR gRNA sequence
attcctgaattccaatactg

SEQ ID NO: 329311 - DNA, 20 bp, Artificial
  CRISPR gRNA sequence
aattccaatactgaagtaaa

SEQ ID NO: 329312 - DNA, 20 bp, Artificial
  CRISPR gRNA sequence
tactgaagtaaatagctttc

SEQ ID NO: 329313 - DNA, 20 bp, Artificial
  CRISPR gRNA sequence
ctttcaagattatgaaattc

SEQ ID NO: 329314 - DNA, 20 bp, Artificial
  CRISPR gRNA sequence
ttcaagattatgaaattcta

SEQ ID NO: 329315 - DNA, 20 bp, Artificial
  CRISPR gRNA sequence
gagttttttttttttttaca

SEQ ID NO: 329316 - DNA, 20 bp, Artificial
  CRISPR gRNA sequence
agttttttttttttttacaa

SEQ ID NO: 329317 - DNA, 20 bp, Artificial
  CRISPR gRNA sequence
ttttttttttacaaaggaat

SEQ ID NO: 329318 - DNA, 20 bp, Artificial
  CRISPR gRNA sequence
ttttttttacaaaggaatga

SEQ ID NO: 329319 - DNA, 20 bp, Artificial
  CRISPR gRNA sequence
ttttacaaaggaatgagagt

SEQ ID NO: 329320 - DNA, 20 bp, Artificial
  CRISPR gRNA sequence
aaactcttcacccacaaccc

SEQ ID NO: 329321 - DNA, 20 bp, Artificial
  CRISPR gRNA sequence
ctcttcacccacaaccctag

SEQ ID NO: 329322 - DNA, 20 bp, Artificial
  CRISPR gRNA sequence
tcacccacaaccctagaagc

SEQ ID NO: 329323 - DNA, 20 bp, Artificial
  CRISPR gRNA sequence
cccacaaccctagaagccag

SEQ ID NO: 329324 - DNA, 20 bp, Artificial
  CRISPR gRNA sequence
caaccctagaagccagcaga

SEQ ID NO: 329325 - DNA, 20 bp, Artificial
  CRISPR gRNA sequence
ccctagaagccagcagacag

SEQ ID NO: 329326 - DNA, 20 bp, Artificial
  CRISPR gRNA sequence
ctagaagccagcagacagtg

SEQ ID NO: 329327 - DNA, 20 bp, Artificial
  CRISPR gRNA sequence
tagaagccagcagacagtgg

SEQ ID NO: 329328 - DNA, 20 bp, Artificial
  CRISPR gRNA sequence
gaggaatatctgcaaccact

SEQ ID NO: 329329 - DNA, 20 bp, Artificial
  CRISPR gRNA sequence
gaatatctgcaaccactaag

SEQ ID NO: 329330 - DNA, 20 bp, Artificial
  CRISPR gRNA sequence
atctgcaaccactaagaaga

SEQ ID NO: 329331 - DNA, 20 bp, Artificial
  CRISPR gRNA sequence
tctgcaaccactaagaagaa

SEQ ID NO: 329332 - DNA, 20 bp, Artificial
  CRISPR gRNA sequence
taagaagaaaggctgccatc

SEQ ID NO: 329333 - DNA, 20 bp, Artificial
  CRISPR gRNA sequence
aagaagaaaggctgccatcc

SEQ ID NO: 329334 - DNA, 20 bp, Artificial
  CRISPR gRNA sequence
ccatccaggactcctattcc

SEQ ID NO: 329335 - DNA, 20 bp, Artificial
  CRISPR gRNA sequence
catccaggactcctattccc

SEQ ID NO: 329336 - DNA, 20 bp, Artificial
  CRISPR gRNA sequence
caggactcctattcccagga

SEQ ID NO: 329337 - DNA, 20 bp, Artificial
  CRISPR gRNA sequence
cctattcccaggaaagatat

SEQ ID NO: 329338 - DNA, 20 bp, Artificial
  CRISPR gRNA sequence
aaagatatcagtcactcatc

SEQ ID NO: 329339 - DNA, 20 bp, Artificial
  CRISPR gRNA sequence
aagatatcagtcactcatca

SEQ ID NO: 329340 - DNA, 20 bp, Artificial
  CRISPR gRNA sequence
tcagtcactcatcaaggtaa

SEQ ID NO: 329341 - DNA, 20 bp, Artificial
  CRISPR gRNA sequence
cagtcactcatcaaggtaaa

SEQ ID NO: 329342 - DNA, 20 bp, Artificial
  CRISPR gRNA sequence
tcactcatcaaggtaaaagg

SEQ ID NO: 329343 - DNA, 20 bp, Artificial
  CRISPR gRNA sequence
gaagacacccttacctgtac

SEQ ID NO: 329344 - DNA, 20 bp, Artificial
  CRISPR gRNA sequence
cccttacctgtactggaatt

SEQ ID NO: 329345 - DNA, 20 bp, Artificial
  CRISPR gRNA sequence
cttacctgtactggaattca

SEQ ID NO: 329346 - DNA, 20 bp, Artificial
  CRISPR gRNA sequence
tacctgtactggaattcaga

SEQ ID NO: 329347 - DNA, 20 bp, Artificial
  CRISPR gRNA sequence
tgtactggaattcagagagt

SEQ ID NO: 329348 - DNA, 20 bp, Artificial
  CRISPR gRNA sequence
gtactggaattcagagagtt

SEQ ID NO: 329349 - DNA, 20 bp, Artificial
  CRISPR gRNA sequence
tactggaattcagagagttg

SEQ ID NO: 329350 - DNA, 20 bp, Artificial
  CRISPR gRNA sequence
actggaattcagagagttgg

SEQ ID NO: 329351 - DNA, 20 bp, Artificial
  CRISPR gRNA sequence
tgggggtatttaacgaaaat

SEQ ID NO: 329352 - DNA, 20 bp, Artificial
  CRISPR gRNA sequence
ggggtatttaacgaaaataa

SEQ ID NO: 329353 - DNA, 20 bp, Artificial
  CRISPR gRNA sequence
gtatttaacgaaaataagag

SEQ ID NO: 329354 - DNA, 20 bp, Artificial
  CRISPR gRNA sequence
aagagaagtcttctgatcat

SEQ ID NO: 329355 - DNA, 20 bp, Artificial
  CRISPR gRNA sequence
aagtcttctgatcattagat

SEQ ID NO: 329356 - DNA, 20 bp, Artificial
  CRISPR gRNA sequence
ttctgatcattagattagaa

SEQ ID NO: 329357 - DNA, 20 bp, Artificial
  CRISPR gRNA sequence
ctgatcattagattagaaca

SEQ ID NO: 329358 - DNA, 20 bp, Artificial
  CRISPR gRNA sequence
tagattagaacagagatcac

SEQ ID NO: 329359 - DNA, 20 bp, Artificial
  CRISPR gRNA sequence
ttagaacagagatcacaaga

SEQ ID NO: 329360 - DNA, 20 bp, Artificial
  CRISPR gRNA sequence
tagaacagagatcacaagac

SEQ ID NO: 329361 - DNA, 20 bp, Artificial
  CRISPR gRNA sequence
gaacagagatcacaagacag

SEQ ID NO: 329362 - DNA, 20 bp, Artificial
  CRISPR gRNA sequence
cagagatcacaagacaggag

SEQ ID NO: 329363 - DNA, 20 bp, Artificial
  CRISPR gRNA sequence
acaagacaggagcagatgtc

SEQ ID NO: 329364 - DNA, 20 bp, Artificial
  CRISPR gRNA sequence
tcattgaacgtatgtgatgt

SEQ ID NO: 329365 - DNA, 20 bp, Artificial
  CRISPR gRNA sequence
acgtatgtgatgtaagtgtt

SEQ ID NO: 329366 - DNA, 20 bp, Artificial
  CRISPR gRNA sequence
atgtgatgtaagtgttaaga

SEQ ID NO: 329367 - DNA, 20 bp, Artificial
  CRISPR gRNA sequence
tgtgatgtaagtgttaagaa

SEQ ID NO: 329368 - DNA, 20 bp, Artificial
  CRISPR gRNA sequence
ttaagaaaggattcttgaaa

SEQ ID NO: 329369 - DNA, 20 bp, Artificial
  CRISPR gRNA sequence
agaaaggattcttgaaacag

SEQ ID NO: 329370 - DNA, 20 bp, Artificial
  CRISPR gRNA sequence
aaaggattcttgaaacagaa

SEQ ID NO: 329371 - DNA, 20 bp, Artificial
  CRISPR gRNA sequence
aaacagaagagaaatactgt

SEQ ID NO: 329372 - DNA, 20 bp, Artificial
  CRISPR gRNA sequence
acagaagagaaatactgtaa

SEQ ID NO: 329373 - DNA, 20 bp, Artificial
  CRISPR gRNA sequence
cagaagagaaatactgtaag

SEQ ID NO: 329374 - DNA, 20 bp, Artificial
  CRISPR gRNA sequence
aaatactgtaagaggaaacc

SEQ ID NO: 329375 - DNA, 20 bp, Artificial
  CRISPR gRNA sequence
tagcaatgatctgcaactgt

SEQ ID NO: 329376 - DNA, 20 bp, Artificial
  CRISPR gRNA sequence
atttccacaaaacccacgta

SEQ ID NO: 329377 - DNA, 20 bp, Artificial
  CRISPR gRNA sequence
ttccacaaaacccacgtatg

SEQ ID NO: 329378 - DNA, 20 bp, Artificial
  CRISPR gRNA sequence
cacaaaacccacgtatggag

SEQ ID NO: 329379 - DNA, 20 bp, Artificial
  CRISPR gRNA sequence
acaaaacccacgtatggagc

SEQ ID NO: 329380 - DNA, 20 bp, Artificial
  CRISPR gRNA sequence
caaaacccacgtatggagca

SEQ ID NO: 329381 - DNA, 20 bp, Artificial
  CRISPR gRNA sequence
atggagcagggtgcactgtc

SEQ ID NO: 329382 - DNA, 20 bp, Artificial
  CRISPR gRNA sequence
tggagcagggtgcactgtct

SEQ ID NO: 329383 - DNA, 20 bp, Artificial
  CRISPR gRNA sequence
ggagcagggtgcactgtctg

SEQ ID NO: 329384 - DNA, 20 bp, Artificial
  CRISPR gRNA sequence
gagcagggtgcactgtctgg

SEQ ID NO: 329385 - DNA, 20 bp, Artificial
  CRISPR gRNA sequence
cagggtgcactgtctggggg

SEQ ID NO: 329386 - DNA, 20 bp, Artificial
  CRISPR gRNA sequence
gcactgtctgggggaagtgt

SEQ ID NO: 329387 - DNA, 20 bp, Artificial
  CRISPR gRNA sequence
actgtctgggggaagtgtga

SEQ ID NO: 329388 - DNA, 20 bp, Artificial
  CRISPR gRNA sequence
gtctgggggaagtgtgagag

SEQ ID NO: 329389 - DNA, 20 bp, Artificial
  CRISPR gRNA sequence
tctgggggaagtgtgagagt

SEQ ID NO: 329390 - DNA, 20 bp, Artificial
  CRISPR gRNA sequence
ggggaagtgtgagagtggga

SEQ ID NO: 329391 - DNA, 20 bp, Artificial
  CRISPR gRNA sequence
gggaagtgtgagagtgggaa

SEQ ID NO: 329392 - DNA, 20 bp, Artificial
  CRISPR gRNA sequence
aagtgtgagagtgggaaagg

SEQ ID NO: 329393 - DNA, 20 bp, Artificial
  CRISPR gRNA sequence
gggaaaggaagaacattctt

SEQ ID NO: 329394 - DNA, 20 bp, Artificial
  CRISPR gRNA sequence
acattcttaagttctcatat

SEQ ID NO: 329395 - DNA, 20 bp, Artificial
  CRISPR gRNA sequence
cttaagttctcatatcagtg

SEQ ID NO: 329396 - DNA, 20 bp, Artificial
  CRISPR gRNA sequence
ttaagttctcatatcagtgc

SEQ ID NO: 329397 - DNA, 20 bp, Artificial
  CRISPR gRNA sequence
taagttctcatatcagtgca

SEQ ID NO: 329398 - DNA, 20 bp, Artificial
  CRISPR gRNA sequence
aagttctcatatcagtgcag

SEQ ID NO: 329399 - DNA, 20 bp, Artificial
  CRISPR gRNA sequence
tctcatatcagtgcagggga

SEQ ID NO: 329400 - DNA, 20 bp, Artificial
  CRISPR gRNA sequence
ctcatatcagtgcaggggat

SEQ ID NO: 329401 - DNA, 20 bp, Artificial
  CRISPR gRNA sequence
tcatatcagtgcaggggatg

SEQ ID NO: 329402 - DNA, 20 bp, Artificial
  CRISPR gRNA sequence
tcagtgcaggggatggggac

SEQ ID NO: 329403 - DNA, 20 bp, Artificial
  CRISPR gRNA sequence
cagtgcaggggatggggact

SEQ ID NO: 329404 - DNA, 20 bp, Artificial
  CRISPR gRNA sequence
gggatggggactaggcacat

SEQ ID NO: 329405 - DNA, 20 bp, Artificial
  CRISPR gRNA sequence
gggactaggcacatcagaca

SEQ ID NO: 329406 - DNA, 20 bp, Artificial
  CRISPR gRNA sequence
ggactaggcacatcagacaa

SEQ ID NO: 329407 - DNA, 20 bp, Artificial
  CRISPR gRNA sequence
attttcatacaatgataaac

SEQ ID NO: 329408 - DNA, 20 bp, Artificial
  CRISPR gRNA sequence
ttcatacaatgataaacaag

SEQ ID NO: 329409 - DNA, 20 bp, Artificial
  CRISPR gRNA sequence
aaacaagtagacattcaatt

SEQ ID NO: 329410 - DNA, 20 bp, Artificial
  CRISPR gRNA sequence
ctttgaacatgtcaattact

SEQ ID NO: 329411 - DNA, 20 bp, Artificial
  CRISPR gRNA sequence
tgtcaattacttagtaaatt

SEQ ID NO: 329412 - DNA, 20 bp, Artificial
  CRISPR gRNA sequence
acttagtaaattaagaactg

SEQ ID NO: 329413 - DNA, 20 bp, Artificial
  CRISPR gRNA sequence
agtcgaccttccaaattaac

SEQ ID NO: 329414 - DNA, 20 bp, Artificial
  CRISPR gRNA sequence
tcgaccttccaaattaaccg

SEQ ID NO: 329415 - DNA, 20 bp, Artificial
  CRISPR gRNA sequence
cgaccttccaaattaaccgg

SEQ ID NO: 329416 - DNA, 20 bp, Artificial
  CRISPR gRNA sequence
ttccaaattaaccggaggca

SEQ ID NO: 329417 - DNA, 20 bp, Artificial
  CRISPR gRNA sequence
ccaaattaaccggaggcaaa

SEQ ID NO: 329418 - DNA, 20 bp, Artificial
  CRISPR gRNA sequence
caaattaaccggaggcaaag

SEQ ID NO: 329419 - DNA, 20 bp, Artificial
  CRISPR gRNA sequence
aattaaccggaggcaaagag

SEQ ID NO: 329420 - DNA, 20 bp, Artificial
  CRISPR gRNA sequence
ttaaccggaggcaaagagga

SEQ ID NO: 329421 - DNA, 20 bp, Artificial
  CRISPR gRNA sequence
gaggcaaagaggagagtcaa

SEQ ID NO: 329422 - DNA, 20 bp, Artificial
  CRISPR gRNA sequence
catcacaccaacaaaaataa

SEQ ID NO: 329423 - DNA, 20 bp, Artificial
  CRISPR gRNA sequence
tcacaccaacaaaaataaaa

SEQ ID NO: 329424 - DNA, 20 bp, Artificial
  CRISPR gRNA sequence
caacaaaaataaaagagaaa

SEQ ID NO: 329425 - DNA, 20 bp, Artificial
  CRISPR gRNA sequence
acaaaaataaaagagaaaaa

SEQ ID NO: 329426 - DNA, 20 bp, Artificial
  CRISPR gRNA sequence
caaaaataaaagagaaaaag

SEQ ID NO: 329427 - DNA, 20 bp, Artificial
  CRISPR gRNA sequence
gagaaaaagaggatacaaca

SEQ ID NO: 329428 - DNA, 20 bp, Artificial
  CRISPR gRNA sequence
aggatacaacaaagaaaaat

SEQ ID NO: 329429 - DNA, 20 bp, Artificial
  CRISPR gRNA sequence
atacaacaaagaaaaataag

SEQ ID NO: 329430 - DNA, 20 bp, Artificial
  CRISPR gRNA sequence
aaataagtagtaaataaaca

SEQ ID NO: 329431 - DNA, 20 bp, Artificial
  CRISPR gRNA sequence
ataaacatagaaataaaatc

SEQ ID NO: 329432 - DNA, 20 bp, Artificial
  CRISPR gRNA sequence
aacatagaaataaaatcaag

SEQ ID NO: 329433 - DNA, 20 bp, Artificial
  CRISPR gRNA sequence
catagaaataaaatcaagta

SEQ ID NO: 329434 - DNA, 20 bp, Artificial
  CRISPR gRNA sequence
atagaaataaaatcaagtag

SEQ ID NO: 329435 - DNA, 20 bp, Artificial
  CRISPR gRNA sequence
aagtagaggcttatgctgac

SEQ ID NO: 329436 - DNA, 20 bp, Artificial
  CRISPR gRNA sequence
agtagaggcttatgctgact

SEQ ID NO: 329437 - DNA, 20 bp, Artificial
  CRISPR gRNA sequence
aggcttatgctgactgggaa

SEQ ID NO: 329438 - DNA, 20 bp, Artificial
  CRISPR gRNA sequence
ggcctgaattcatctatcaa

SEQ ID NO: 329439 - DNA, 20 bp, Artificial
  CRISPR gRNA sequence
caaaagaaaaaattgacaac

SEQ ID NO: 329440 - DNA, 20 bp, Artificial
  CRISPR gRNA sequence
aaaagaaaaaattgacaact

SEQ ID NO: 329441 - DNA, 20 bp, Artificial
  CRISPR gRNA sequence
ggatttttgttaaatctaac

SEQ ID NO: 329442 - DNA, 20 bp, Artificial
  CRISPR gRNA sequence
taaatctaacaagaacactc

SEQ ID NO: 329443 - DNA, 20 bp, Artificial
  CRISPR gRNA sequence
atctaacaagaacactctgg

SEQ ID NO: 329444 - DNA, 20 bp, Artificial
  CRISPR gRNA sequence
tctaacaagaacactctgga

SEQ ID NO: 329445 - DNA, 20 bp, Artificial
  CRISPR gRNA sequence
ctaacaagaacactctggaa

SEQ ID NO: 329446 - DNA, 20 bp, Artificial
  CRISPR gRNA sequence
taacaagaacactctggaag

SEQ ID NO: 329447 - DNA, 20 bp, Artificial
  CRISPR gRNA sequence
aacaagaacactctggaagg

SEQ ID NO: 329448 - DNA, 20 bp, Artificial
  CRISPR gRNA sequence
actctggaagggggtgctgt

SEQ ID NO: 329449 - DNA, 20 bp, Artificial
  CRISPR gRNA sequence
ctctggaagggggtgctgtc

SEQ ID NO: 329450 - DNA, 20 bp, Artificial
  CRISPR gRNA sequence
ctggaagggggtgctgtcag

SEQ ID NO: 329451 - DNA, 20 bp, Artificial
  CRISPR gRNA sequence
gtcaggagatgacatttact

SEQ ID NO: 329452 - DNA, 20 bp, Artificial
  CRISPR gRNA sequence
agatgacatttactcagtcg

SEQ ID NO: 329453 - DNA, 20 bp, Artificial
  CRISPR gRNA sequence
atgacatttactcagtcgtg

SEQ ID NO: 329454 - DNA, 20 bp, Artificial
  CRISPR gRNA sequence
gacatttactcagtcgtgga

SEQ ID NO: 329455 - DNA, 20 bp, Artificial
  CRISPR gRNA sequence
acatttactcagtcgtggag

SEQ ID NO: 329456 - DNA, 20 bp, Artificial
  CRISPR gRNA sequence
tactcagtcgtggagaggct

SEQ ID NO: 329457 - DNA, 20 bp, Artificial
  CRISPR gRNA sequence
ctcagtcgtggagaggctaa

SEQ ID NO: 329458 - DNA, 20 bp, Artificial
  CRISPR gRNA sequence
tcagtcgtggagaggctaag

SEQ ID NO: 329459 - DNA, 20 bp, Artificial
  CRISPR gRNA sequence
cagtcgtggagaggctaaga

SEQ ID NO: 329460 - DNA, 20 bp, Artificial
  CRISPR gRNA sequence
agtcgtggagaggctaagag

SEQ ID NO: 329461 - DNA, 20 bp, Artificial
  CRISPR gRNA sequence
gagaggctaagaggggctcc

SEQ ID NO: 329462 - DNA, 20 bp, Artificial
  CRISPR gRNA sequence
agaggctaagaggggctcca

SEQ ID NO: 329463 - DNA, 20 bp, Artificial
  CRISPR gRNA sequence
gctaagaggggctccaaggt

SEQ ID NO: 329464 - DNA, 20 bp, Artificial
  CRISPR gRNA sequence
tccaaggtcagtcatcttca

SEQ ID NO: 329465 - DNA, 20 bp, Artificial
  CRISPR gRNA sequence
tcatcttcacagacttctct

SEQ ID NO: 329466 - DNA, 20 bp, Artificial
  CRISPR gRNA sequence
cacagacttctctcagacgc

SEQ ID NO: 329467 - DNA, 20 bp, Artificial
  CRISPR gRNA sequence
cagacttctctcagacgctg

SEQ ID NO: 329468 - DNA, 20 bp, Artificial
  CRISPR gRNA sequence
tctcagacgctggagacact

SEQ ID NO: 329469 - DNA, 20 bp, Artificial
  CRISPR gRNA sequence
ctcagacgctggagacactg

SEQ ID NO: 329470 - DNA, 20 bp, Artificial
  CRISPR gRNA sequence
tcagacgctggagacactga

SEQ ID NO: 329471 - DNA, 20 bp, Artificial
  CRISPR gRNA sequence
cagacgctggagacactgag

SEQ ID NO: 329472 - DNA, 20 bp, Artificial
  CRISPR gRNA sequence
cactgaggggctcttttccc

SEQ ID NO: 329473 - DNA, 20 bp, Artificial
  CRISPR gRNA sequence
tgaggggctcttttcccaag

SEQ ID NO: 329474 - DNA, 20 bp, Artificial
  CRISPR gRNA sequence
ctcttttcccaagtggaatt

SEQ ID NO: 329475 - DNA, 20 bp, Artificial
  CRISPR gRNA sequence
tcttttcccaagtggaattc

SEQ ID NO: 329476 - DNA, 20 bp, Artificial
  CRISPR gRNA sequence
ttttcccaagtggaattcag

SEQ ID NO: 329477 - DNA, 20 bp, Artificial
  CRISPR gRNA sequence
tggaattcaggagtcactaa

SEQ ID NO: 329478 - DNA, 20 bp, Artificial
  CRISPR gRNA sequence
gagtcactaatggaatgcct

SEQ ID NO: 329479 - DNA, 20 bp, Artificial
  CRISPR gRNA sequence
aatggaatgcctcagtgaca

SEQ ID NO: 329480 - DNA, 20 bp, Artificial
  CRISPR gRNA sequence
atggaatgcctcagtgacaa

SEQ ID NO: 329481 - DNA, 20 bp, Artificial
  CRISPR gRNA sequence
gaatgcctcagtgacaaagg

SEQ ID NO: 329482 - DNA, 20 bp, Artificial
  CRISPR gRNA sequence
aatgcctcagtgacaaagga

SEQ ID NO: 329483 - DNA, 20 bp, Artificial
  CRISPR gRNA sequence
cagtgacaaaggaaggctca

SEQ ID NO: 329484 - DNA, 20 bp, Artificial
  CRISPR gRNA sequence
tgacaaaggaaggctcaaag

SEQ ID NO: 329485 - DNA, 20 bp, Artificial
  CRISPR gRNA sequence
ggaaggctcaaagtggcctt

SEQ ID NO: 329486 - DNA, 20 bp, Artificial
  CRISPR gRNA sequence
gaaggctcaaagtggccttg

SEQ ID NO: 329487 - DNA, 20 bp, Artificial
  CRISPR gRNA sequence
aaggctcaaagtggccttga

SEQ ID NO: 329488 - DNA, 20 bp, Artificial
  CRISPR gRNA sequence
ggccttgagggctatcctcc

SEQ ID NO: 329489 - DNA, 20 bp, Artificial
  CRISPR gRNA sequence
ctatcctcccagcttcctca

SEQ ID NO: 329490 - DNA, 20 bp, Artificial
  CRISPR gRNA sequence
cataatacatgcacgtttat

SEQ ID NO: 329491 - DNA, 20 bp, Artificial
  CRISPR gRNA sequence
tattagacaccctctgccat

SEQ ID NO: 329492 - DNA, 20 bp, Artificial
  CRISPR gRNA sequence
gccatcagcccttcccaatc

SEQ ID NO: 329493 - DNA, 20 bp, Artificial
  CRISPR gRNA sequence
tattatccacactgctttta

SEQ ID NO: 329494 - DNA, 20 bp, Artificial
  CRISPR gRNA sequence
tatccacactgcttttaaag

SEQ ID NO: 329495 - DNA, 20 bp, Artificial
  CRISPR gRNA sequence
taaagtagtctttctaaaac

SEQ ID NO: 329496 - DNA, 20 bp, Artificial
  CRISPR gRNA sequence
aatttgtcccatcactcata

SEQ ID NO: 329497 - DNA, 20 bp, Artificial
  CRISPR gRNA sequence
atatggtccctgttgcctat

SEQ ID NO: 329498 - DNA, 20 bp, Artificial
  CRISPR gRNA sequence
tatggtccctgttgcctata

SEQ ID NO: 329499 - DNA, 20 bp, Artificial
  CRISPR gRNA sequence
tgttgcctataaggtctaca

SEQ ID NO: 329500 - DNA, 20 bp, Artificial
  CRISPR gRNA sequence
ttgcctataaggtctacaaa

SEQ ID NO: 329501 - DNA, 20 bp, Artificial
  CRISPR gRNA sequence
tgcctataaggtctacaaag

SEQ ID NO: 329502 - DNA, 20 bp, Artificial
  CRISPR gRNA sequence
gcctataaggtctacaaaga

SEQ ID NO: 329503 - DNA, 20 bp, Artificial
  CRISPR gRNA sequence
caaagagggtcttcaaaatg

SEQ ID NO: 329504 - DNA, 20 bp, Artificial
  CRISPR gRNA sequence
gagggtcttcaaaatgtagt

SEQ ID NO: 329505 - DNA, 20 bp, Artificial
  CRISPR gRNA sequence
ttagacattcacatttttcg

SEQ ID NO: 329506 - DNA, 20 bp, Artificial
  CRISPR gRNA sequence
gtagatatttttataattaa

SEQ ID NO: 329507 - DNA, 20 bp, Artificial
  CRISPR gRNA sequence
taaaagtgtcctattgctcc

SEQ ID NO: 329508 - DNA, 20 bp, Artificial
  CRISPR gRNA sequence
caagttcattaaaaaaaaac

SEQ ID NO: 329509 - DNA, 20 bp, Artificial
  CRISPR gRNA sequence
actttgttaaattctacatt

SEQ ID NO: 329510 - DNA, 20 bp, Artificial
  CRISPR gRNA sequence
ttctacattgagatccatca

SEQ ID NO: 329511 - DNA, 20 bp, Artificial
  CRISPR gRNA sequence
cattgagatccatcaaagac

SEQ ID NO: 329512 - DNA, 20 bp, Artificial
  CRISPR gRNA sequence
atccatcaaagactagaaat

SEQ ID NO: 329513 - DNA, 20 bp, Artificial
  CRISPR gRNA sequence
atcaaagactagaaatcagc

SEQ ID NO: 329514 - DNA, 20 bp, Artificial
  CRISPR gRNA sequence
taattcacaaccaaataaca

SEQ ID NO: 329515 - DNA, 20 bp, Artificial
  CRISPR gRNA sequence
aattcacaaccaaataacaa

SEQ ID NO: 329516 - DNA, 20 bp, Artificial
  CRISPR gRNA sequence
aaccaaataacaaaggtgat

SEQ ID NO: 329517 - DNA, 20 bp, Artificial
  CRISPR gRNA sequence
caaaggtgatcagaatcatt

SEQ ID NO: 329518 - DNA, 20 bp, Artificial
  CRISPR gRNA sequence
cattgagatttacgttcctt

SEQ ID NO: 329519 - DNA, 20 bp, Artificial
  CRISPR gRNA sequence
acacctccactacttcaaca

SEQ ID NO: 329520 - DNA, 20 bp, Artificial
  CRISPR gRNA sequence
tccactacttcaacacagtt

SEQ ID NO: 329521 - DNA, 20 bp, Artificial
  CRISPR gRNA sequence
ctacttcaacacagtttaga

SEQ ID NO: 329522 - DNA, 20 bp, Artificial
  CRISPR gRNA sequence
aacacagtttagaaagaatg

SEQ ID NO: 329523 - DNA, 20 bp, Artificial
  CRISPR gRNA sequence
tttagaaagaatgtagatgt

SEQ ID NO: 329524 - DNA, 20 bp, Artificial
  CRISPR gRNA sequence
tagaaagaatgtagatgttg

SEQ ID NO: 329525 - DNA, 20 bp, Artificial
  CRISPR gRNA sequence
tgtagatgttggagtcacat

SEQ ID NO: 329526 - DNA, 20 bp, Artificial
  CRISPR gRNA sequence
tagatgttggagtcacatta

SEQ ID NO: 329527 - DNA, 20 bp, Artificial
  CRISPR gRNA sequence
tcacattagagttctaactt

SEQ ID NO: 329528 - DNA, 20 bp, Artificial
  CRISPR gRNA sequence
acaaatcacttaacctttcc

SEQ ID NO: 329529 - DNA, 20 bp, Artificial
  CRISPR gRNA sequence
atcacttaacctttcctggt

SEQ ID NO: 329530 - DNA, 20 bp, Artificial
  CRISPR gRNA sequence
aattcttcaaacactgacta

SEQ ID NO: 329531 - DNA, 20 bp, Artificial
  CRISPR gRNA sequence
attcttcaaacactgactaa

SEQ ID NO: 329532 - DNA, 20 bp, Artificial
  CRISPR gRNA sequence
ttcaaacactgactaaaggt

SEQ ID NO: 329533 - DNA, 20 bp, Artificial
  CRISPR gRNA sequence
taagaatgcctacatcttca

SEQ ID NO: 329534 - DNA, 20 bp, Artificial
  CRISPR gRNA sequence
tgcctacatcttcatggcat

SEQ ID NO: 329535 - DNA, 20 bp, Artificial
  CRISPR gRNA sequence
tacatcttcatggcatgaga

SEQ ID NO: 329536 - DNA, 20 bp, Artificial
  CRISPR gRNA sequence
atgagaaagcctatgtaaat

SEQ ID NO: 329537 - DNA, 20 bp, Artificial
  CRISPR gRNA sequence
tgagaaagcctatgtaaatt

SEQ ID NO: 329538 - DNA, 20 bp, Artificial
  CRISPR gRNA sequence
agaaagcctatgtaaattgg

SEQ ID NO: 329539 - DNA, 20 bp, Artificial
  CRISPR gRNA sequence
gaaagcctatgtaaattggg

SEQ ID NO: 329540 - DNA, 20 bp, Artificial
  CRISPR gRNA sequence
tgggaggattgaaaatacaa

SEQ ID NO: 329541 - DNA, 20 bp, Artificial
  CRISPR gRNA sequence
ggaggattgaaaatacaaca

SEQ ID NO: 329542 - DNA, 20 bp, Artificial
  CRISPR gRNA sequence
gaggattgaaaatacaacag

SEQ ID NO: 329543 - DNA, 20 bp, Artificial
  CRISPR gRNA sequence
ttgaaaatacaacagaggac

SEQ ID NO: 329544 - DNA, 20 bp, Artificial
  CRISPR gRNA sequence
aaatacaacagaggacaagc

SEQ ID NO: 329545 - DNA, 20 bp, Artificial
  CRISPR gRNA sequence
acagaggacaagcaagtact

SEQ ID NO: 329546 - DNA, 20 bp, Artificial
  CRISPR gRNA sequence
agcaagtacttagtttactt

SEQ ID NO: 329547 - DNA, 20 bp, Artificial
  CRISPR gRNA sequence
gtacttagtttacttgagtt

SEQ ID NO: 329548 - DNA, 20 bp, Artificial
  CRISPR gRNA sequence
tgagtttggctctttttctt

SEQ ID NO: 329549 - DNA, 20 bp, Artificial
  CRISPR gRNA sequence
agtttggctctttttcttta

SEQ ID NO: 329550 - DNA, 20 bp, Artificial
  CRISPR gRNA sequence
ttttctttagagcttttaca

SEQ ID NO: 329551 - DNA, 20 bp, Artificial
  CRISPR gRNA sequence
tctttagagcttttacatgg

SEQ ID NO: 329552 - DNA, 20 bp, Artificial
  CRISPR gRNA sequence
agcttttacatggcagtttc

SEQ ID NO: 329553 - DNA, 20 bp, Artificial
  CRISPR gRNA sequence
gtttctggatacatgcattg

SEQ ID NO: 329554 - DNA, 20 bp, Artificial
  CRISPR gRNA sequence
ttctggatacatgcattgtg

SEQ ID NO: 329555 - DNA, 20 bp, Artificial
  CRISPR gRNA sequence
cattgtggagatattttaaa

SEQ ID NO: 329556 - DNA, 20 bp, Artificial
  CRISPR gRNA sequence
attgtggagatattttaaat

SEQ ID NO: 329557 - DNA, 20 bp, Artificial
  CRISPR gRNA sequence
attttaaataggatcattgc

SEQ ID NO: 329558 - DNA, 20 bp, Artificial
  CRISPR gRNA sequence
ttaaataggatcattgctag

SEQ ID NO: 329559 - DNA, 20 bp, Artificial
  CRISPR gRNA sequence
gcagatttattgttaccatt

SEQ ID NO: 329560 - DNA, 20 bp, Artificial
  CRISPR gRNA sequence
ccatttagccactcgtgcct

SEQ ID NO: 329561 - DNA, 20 bp, Artificial
  CRISPR gRNA sequence
catttagccactcgtgcctc

SEQ ID NO: 329562 - DNA, 20 bp, Artificial
  CRISPR gRNA sequence
caggtttgccacatgccaaa

SEQ ID NO: 329563 - DNA, 20 bp, Artificial
  CRISPR gRNA sequence
aaacagcatgccacatctca

SEQ ID NO: 329564 - DNA, 20 bp, Artificial
  CRISPR gRNA sequence
ctcatggctttctttataat

SEQ ID NO: 329565 - DNA, 20 bp, Artificial
  CRISPR gRNA sequence
catggctttctttataatga

SEQ ID NO: 329566 - DNA, 20 bp, Artificial
  CRISPR gRNA sequence
tttataatgagagtgaacat

SEQ ID NO: 329567 - DNA, 20 bp, Artificial
  CRISPR gRNA sequence
gaacattggttgtattcatt

SEQ ID NO: 329568 - DNA, 20 bp, Artificial
  CRISPR gRNA sequence
atctacgatgaatattgttc

SEQ ID NO: 329569 - DNA, 20 bp, Artificial
  CRISPR gRNA sequence
ccagaatacaaattattcgt

SEQ ID NO: 329570 - DNA, 20 bp, Artificial
  CRISPR gRNA sequence
aattattcgtcagcttaatc

SEQ ID NO: 329571 - DNA, 20 bp, Artificial
  CRISPR gRNA sequence
aacttaaaacaatcctacct

SEQ ID NO: 329572 - DNA, 20 bp, Artificial
  CRISPR gRNA sequence
acttaaaacaatcctaccta

SEQ ID NO: 329573 - DNA, 20 bp, Artificial
  CRISPR gRNA sequence
aaaacaatcctacctaaggc

SEQ ID NO: 329574 - DNA, 20 bp, Artificial
  CRISPR gRNA sequence
aggctggatctcaccttcca

SEQ ID NO: 329575 - DNA, 20 bp, Artificial
  CRISPR gRNA sequence
gatgctactttaattctcct

SEQ ID NO: 329576 - DNA, 20 bp, Artificial
  CRISPR gRNA sequence
cctgagcataataccacaac

SEQ ID NO: 329577 - DNA, 20 bp, Artificial
  CRISPR gRNA sequence
acaaccagaactgcccaaat

SEQ ID NO: 329578 - DNA, 20 bp, Artificial
  CRISPR gRNA sequence
cagaactgcccaaattggtt

SEQ ID NO: 329579 - DNA, 20 bp, Artificial
  CRISPR gRNA sequence
ctgcccaaattggtttggcc

SEQ ID NO: 329580 - DNA, 20 bp, Artificial
  CRISPR gRNA sequence
caaacaaacccttccacgaa

SEQ ID NO: 329581 - DNA, 20 bp, Artificial
  CRISPR gRNA sequence
acgaatggtaccaacgttct

SEQ ID NO: 329582 - DNA, 20 bp, Artificial
  CRISPR gRNA sequence
aatggtaccaacgttcttgg

SEQ ID NO: 329583 - DNA, 20 bp, Artificial
  CRISPR gRNA sequence
ttggaagaatatccaaaatc

SEQ ID NO: 329584 - DNA, 20 bp, Artificial
  CRISPR gRNA sequence
aatatccaaaatctggaaca

SEQ ID NO: 329585 - DNA, 20 bp, Artificial
  CRISPR gRNA sequence
aatctggaacatagactata

SEQ ID NO: 329586 - DNA, 20 bp, Artificial
  CRISPR gRNA sequence
catagactatatggtctgaa

SEQ ID NO: 329587 - DNA, 20 bp, Artificial
  CRISPR gRNA sequence
actatatggtctgaatggtc

SEQ ID NO: 329588 - DNA, 20 bp, Artificial
  CRISPR gRNA sequence
ctggcctctactttcctttc

SEQ ID NO: 329589 - DNA, 20 bp, Artificial
  CRISPR gRNA sequence
tttcctttccagcctcacct

SEQ ID NO: 329590 - DNA, 20 bp, Artificial
  CRISPR gRNA sequence
agcctcaccttggaccaact

SEQ ID NO: 329591 - DNA, 20 bp, Artificial
  CRISPR gRNA sequence
caccttggaccaacttggac

SEQ ID NO: 329592 - DNA, 20 bp, Artificial
  CRISPR gRNA sequence
ttggaccaacttggaccagt

SEQ ID NO: 329593 - DNA, 20 bp, Artificial
  CRISPR gRNA sequence
cttggaccagttggtcatct

SEQ ID NO: 329594 - DNA, 20 bp, Artificial
  CRISPR gRNA sequence
ccagttggtcatcttggacc

SEQ ID NO: 329595 - DNA, 20 bp, Artificial
  CRISPR gRNA sequence
tggtcatcttggaccaagct

SEQ ID NO: 329596 - DNA, 20 bp, Artificial
  CRISPR gRNA sequence
gcctcttccctctttgtgct

SEQ ID NO: 329597 - DNA, 20 bp, Artificial
  CRISPR gRNA sequence
cctcttccctctttgtgctc

SEQ ID NO: 329598 - DNA, 20 bp, Artificial
  CRISPR gRNA sequence
cacatctgtctgctttcttc

SEQ ID NO: 329599 - DNA, 20 bp, Artificial
  CRISPR gRNA sequence
tacctcattccttcctgcca

SEQ ID NO: 329600 - DNA, 20 bp, Artificial
  CRISPR gRNA sequence
acctcattccttcctgccac

SEQ ID NO: 329601 - DNA, 20 bp, Artificial
  CRISPR gRNA sequence
ctttgcacttgttccttcca

SEQ ID NO: 329602 - DNA, 20 bp, Artificial
  CRISPR gRNA sequence
cacttgttccttccatggta

SEQ ID NO: 329603 - DNA, 20 bp, Artificial
  CRISPR gRNA sequence
tgtccttgaaatctccgctc

SEQ ID NO: 329604 - DNA, 20 bp, Artificial
  CRISPR gRNA sequence
ccgctcaagtgccacttgca

SEQ ID NO: 329605 - DNA, 20 bp, Artificial
  CRISPR gRNA sequence
cgctcaagtgccacttgcac

SEQ ID NO: 329606 - DNA, 20 bp, Artificial
  CRISPR gRNA sequence
caagtgccacttgcacagga

SEQ ID NO: 329607 - DNA, 20 bp, Artificial
  CRISPR gRNA sequence
cttcaatgaaccctgctcct

SEQ ID NO: 329608 - DNA, 20 bp, Artificial
  CRISPR gRNA sequence
gctacacctccacacccacc

SEQ ID NO: 329609 - DNA, 20 bp, Artificial
  CRISPR gRNA sequence
acctccacacccacccagtc

SEQ ID NO: 329610 - DNA, 20 bp, Artificial
  CRISPR gRNA sequence
cacacccacccagtctagtc

SEQ ID NO: 329611 - DNA, 20 bp, Artificial
  CRISPR gRNA sequence
ttacattccctcatataatt

SEQ ID NO: 329612 - DNA, 20 bp, Artificial
  CRISPR gRNA sequence
ctgtaattatcattaatcaa

SEQ ID NO: 329613 - DNA, 20 bp, Artificial
  CRISPR gRNA sequence
tgtaattatcattaatcaat

SEQ ID NO: 329614 - DNA, 20 bp, Artificial
  CRISPR gRNA sequence
atatatctctctctaccatg

SEQ ID NO: 329615 - DNA, 20 bp, Artificial
  CRISPR gRNA sequence
taccatgcagttaccttcca

SEQ ID NO: 329616 - DNA, 20 bp, Artificial
  CRISPR gRNA sequence
tgcagttaccttccaaagaa

SEQ ID NO: 329617 - DNA, 20 bp, Artificial
  CRISPR gRNA sequence
gcagttaccttccaaagaac

SEQ ID NO: 329618 - DNA, 20 bp, Artificial
  CRISPR gRNA sequence
cagttaccttccaaagaaca

SEQ ID NO: 329619 - DNA, 20 bp, Artificial
  CRISPR gRNA sequence
agttaccttccaaagaacag

SEQ ID NO: 329620 - DNA, 20 bp, Artificial
  CRISPR gRNA sequence
ccaaagaacaggggttgacc

SEQ ID NO: 329621 - DNA, 20 bp, Artificial
  CRISPR gRNA sequence
atccttgtacatacaccatc

SEQ ID NO: 329622 - DNA, 20 bp, Artificial
  CRISPR gRNA sequence
tgtacatacaccatctggca

SEQ ID NO: 329623 - DNA, 20 bp, Artificial
  CRISPR gRNA sequence
tctggcacagtacctgctac

SEQ ID NO: 329624 - DNA, 20 bp, Artificial
  CRISPR gRNA sequence
ctggcacagtacctgctacc

SEQ ID NO: 329625 - DNA, 20 bp, Artificial
  CRISPR gRNA sequence
gcacagtacctgctaccagg

SEQ ID NO: 329626 - DNA, 20 bp, Artificial
  CRISPR gRNA sequence
cacagtacctgctaccaggc

SEQ ID NO: 329627 - DNA, 20 bp, Artificial
  CRISPR gRNA sequence
gcaggtgctcaatgctacat

SEQ ID NO: 329628 - DNA, 20 bp, Artificial
  CRISPR gRNA sequence
ctcaatgctacatgagtaaa

SEQ ID NO: 329629 - DNA, 20 bp, Artificial
  CRISPR gRNA sequence
catgagtaaatggatgaatg

SEQ ID NO: 329630 - DNA, 20 bp, Artificial
  CRISPR gRNA sequence
aagaatgaatataaattcca

SEQ ID NO: 329631 - DNA, 20 bp, Artificial
  CRISPR gRNA sequence
tcatgtcattcatgccgcta

SEQ ID NO: 329632 - DNA, 20 bp, Artificial
  CRISPR gRNA sequence
catgtcattcatgccgctaa

SEQ ID NO: 329633 - DNA, 20 bp, Artificial
  CRISPR gRNA sequence
atgccgctaaaggacttcat

SEQ ID NO: 329634 - DNA, 20 bp, Artificial
  CRISPR gRNA sequence
taaaggacttcatgagattc

SEQ ID NO: 329635 - DNA, 20 bp, Artificial
  CRISPR gRNA sequence
gacttcatgagattctagaa

SEQ ID NO: 329636 - DNA, 20 bp, Artificial
  CRISPR gRNA sequence
acttcatgagattctagaaa

SEQ ID NO: 329637 - DNA, 20 bp, Artificial
  CRISPR gRNA sequence
attctagaaaaggcataaac

SEQ ID NO: 329638 - DNA, 20 bp, Artificial
  CRISPR gRNA sequence
tagaaaaggcataaaccagc

SEQ ID NO: 329639 - DNA, 20 bp, Artificial
  CRISPR gRNA sequence
aaaaggcataaaccagcaag

SEQ ID NO: 329640 - DNA, 20 bp, Artificial
  CRISPR gRNA sequence
aactgcacttaactcacttt

SEQ ID NO: 329641 - DNA, 20 bp, Artificial
  CRISPR gRNA sequence
gcacttaactcactttgagc

SEQ ID NO: 329642 - DNA, 20 bp, Artificial
  CRISPR gRNA sequence
aactcactttgagccagcac

SEQ ID NO: 329643 - DNA, 20 bp, Artificial
  CRISPR gRNA sequence
atttttttttcattttttgt

SEQ ID NO: 329644 - DNA, 20 bp, Artificial
  CRISPR gRNA sequence
tttttcattttttgtaagaa

SEQ ID NO: 329645 - DNA, 20 bp, Artificial
  CRISPR gRNA sequence
tcattttttgtaagaacagt

SEQ ID NO: 329646 - DNA, 20 bp, Artificial
  CRISPR gRNA sequence
cattttttgtaagaacagta

SEQ ID NO: 329647 - DNA, 20 bp, Artificial
  CRISPR gRNA sequence
ccactgaaaaaatgtatccc

SEQ ID NO: 329648 - DNA, 20 bp, Artificial
  CRISPR gRNA sequence
tgaaaaaatgtatccctaga

SEQ ID NO: 329649 - DNA, 20 bp, Artificial
  CRISPR gRNA sequence
gaaaaaatgtatccctagat

SEQ ID NO: 329650 - DNA, 20 bp, Artificial
  CRISPR gRNA sequence
gataggatcatacctactaa

SEQ ID NO: 329651 - DNA, 20 bp, Artificial
  CRISPR gRNA sequence
aaaagttctgccttcacttt

SEQ ID NO: 329652 - DNA, 20 bp, Artificial
  CRISPR gRNA sequence
tttagtttatttgattattt

SEQ ID NO: 329653 - DNA, 20 bp, Artificial
  CRISPR gRNA sequence
actttccttttttcaacctc

SEQ ID NO: 329654 - DNA, 20 bp, Artificial
  CRISPR gRNA sequence
ccttttttcaacctcaagaa

SEQ ID NO: 329655 - DNA, 20 bp, Artificial
  CRISPR gRNA sequence
cttttttcaacctcaagaat

SEQ ID NO: 329656 - DNA, 20 bp, Artificial
  CRISPR gRNA sequence
ttttttcaacctcaagaata

SEQ ID NO: 329657 - DNA, 20 bp, Artificial
  CRISPR gRNA sequence
tcaacctcaagaatagggct

SEQ ID NO: 329658 - DNA, 20 bp, Artificial
  CRISPR gRNA sequence
aagaatagggctcagtgtga

SEQ ID NO: 329659 - DNA, 20 bp, Artificial
  CRISPR gRNA sequence
gaatagggctcagtgtgaaa

SEQ ID NO: 329660 - DNA, 20 bp, Artificial
  CRISPR gRNA sequence
cagtgtgaaagagaaaacaa

SEQ ID NO: 329661 - DNA, 20 bp, Artificial
  CRISPR gRNA sequence
tgtgaaagagaaaacaaaag

SEQ ID NO: 329662 - DNA, 20 bp, Artificial
  CRISPR gRNA sequence
aaagtagtacaaattatata

SEQ ID NO: 329663 - DNA, 20 bp, Artificial
  CRISPR gRNA sequence
tacaaattatatacagtaaa

SEQ ID NO: 329664 - DNA, 20 bp, Artificial
  CRISPR gRNA sequence
aaattatatacagtaaaaag

SEQ ID NO: 329665 - DNA, 20 bp, Artificial
  CRISPR gRNA sequence
ttatatacagtaaaaagcag

SEQ ID NO: 329666 - DNA, 20 bp, Artificial
  CRISPR gRNA sequence
gtattaacttacattgtatg

SEQ ID NO: 329667 - DNA, 20 bp, Artificial
  CRISPR gRNA sequence
cattatttaaattgtccata

SEQ ID NO: 329668 - DNA, 20 bp, Artificial
  CRISPR gRNA sequence
ttatttaaattgtccatata

SEQ ID NO: 329669 - DNA, 20 bp, Artificial
  CRISPR gRNA sequence
gagtctgctatatgccattc

SEQ ID NO: 329670 - DNA, 20 bp, Artificial
  CRISPR gRNA sequence
gtctgctatatgccattcaa

SEQ ID NO: 329671 - DNA, 20 bp, Artificial
  CRISPR gRNA sequence
tgctatatgccattcaagag

SEQ ID NO: 329672 - DNA, 20 bp, Artificial
  CRISPR gRNA sequence
gctatatgccattcaagaga

SEQ ID NO: 329673 - DNA, 20 bp, Artificial
  CRISPR gRNA sequence
tgccattcaagagaaggaat

SEQ ID NO: 329674 - DNA, 20 bp, Artificial
  CRISPR gRNA sequence
gccattcaagagaaggaatc

SEQ ID NO: 329675 - DNA, 20 bp, Artificial
  CRISPR gRNA sequence
ccattcaagagaaggaatca

SEQ ID NO: 329676 - DNA, 20 bp, Artificial
  CRISPR gRNA sequence
agagaaggaatcagggactc

SEQ ID NO: 329677 - DNA, 20 bp, Artificial
  CRISPR gRNA sequence
tccagaatgatcttttttgt

SEQ ID NO: 329678 - DNA, 20 bp, Artificial
  CRISPR gRNA sequence
ccagaatgatcttttttgta

SEQ ID NO: 329679 - DNA, 20 bp, Artificial
  CRISPR gRNA sequence
gatcttttttgtaaggtcta

SEQ ID NO: 329680 - DNA, 20 bp, Artificial
  CRISPR gRNA sequence
atcttttttgtaaggtctac

SEQ ID NO: 329681 - DNA, 20 bp, Artificial
  CRISPR gRNA sequence
tcttttttgtaaggtctaca

SEQ ID NO: 329682 - DNA, 20 bp, Artificial
  CRISPR gRNA sequence
cttttttgtaaggtctacag

SEQ ID NO: 329683 - DNA, 20 bp, Artificial
  CRISPR gRNA sequence
tttgtaaggtctacaggggc

SEQ ID NO: 329684 - DNA, 20 bp, Artificial
  CRISPR gRNA sequence
ttgtaaggtctacaggggct

SEQ ID NO: 329685 - DNA, 20 bp, Artificial
  CRISPR gRNA sequence
taaggtctacaggggctagg

SEQ ID NO: 329686 - DNA, 20 bp, Artificial
  CRISPR gRNA sequence
ttacattatcctttcctcct

SEQ ID NO: 329687 - DNA, 20 bp, Artificial
  CRISPR gRNA sequence
tcctttcctccttggctttt

SEQ ID NO: 329688 - DNA, 20 bp, Artificial
  CRISPR gRNA sequence
cctttcctccttggcttttt

SEQ ID NO: 329689 - DNA, 20 bp, Artificial
  CRISPR gRNA sequence
ctttcctccttggcttttta

SEQ ID NO: 329690 - DNA, 20 bp, Artificial
  CRISPR gRNA sequence
ttagggtgaactctgatact

SEQ ID NO: 329691 - DNA, 20 bp, Artificial
  CRISPR gRNA sequence
tagtgtcaataaaaactcta

SEQ ID NO: 329692 - DNA, 20 bp, Artificial
  CRISPR gRNA sequence
ataaaaactctatggtgccc

SEQ ID NO: 329693 - DNA, 20 bp, Artificial
  CRISPR gRNA sequence
ctatggtgccctggacattt

SEQ ID NO: 329694 - DNA, 20 bp, Artificial
  CRISPR gRNA sequence
gccctggacatttcagataa

SEQ ID NO: 329695 - DNA, 20 bp, Artificial
  CRISPR gRNA sequence
atttcagataacagatcatc

SEQ ID NO: 329696 - DNA, 20 bp, Artificial
  CRISPR gRNA sequence
tttcagataacagatcatcc

SEQ ID NO: 329697 - DNA, 20 bp, Artificial
  CRISPR gRNA sequence
agataacagatcatccaggt

SEQ ID NO: 329698 - DNA, 20 bp, Artificial
  CRISPR gRNA sequence
ctgaaatgtccagggcacca

SEQ ID NO: 329699 - DNA, 20 bp, Artificial
  CRISPR gRNA sequence
tttttattgacactaagtat

SEQ ID NO: 329700 - DNA, 20 bp, Artificial
  CRISPR gRNA sequence
ccctaaaaagccaaggagga

SEQ ID NO: 329701 - DNA, 20 bp, Artificial
  CRISPR gRNA sequence
ccttacaaaaaagatcattc

SEQ ID NO: 329702 - DNA, 20 bp, Artificial
  CRISPR gRNA sequence
ggagtccctgattccttctc

SEQ ID NO: 329703 - DNA, 20 bp, Artificial
  CRISPR gRNA sequence
tagtaggtatgatcctatct

SEQ ID NO: 329704 - DNA, 20 bp, Artificial
  CRISPR gRNA sequence
tcatcttgtgctggctcaaa

SEQ ID NO: 329705 - DNA, 20 bp, Artificial
  CRISPR gRNA sequence
agtgagttaagtgcagttaa

SEQ ID NO: 329706 - DNA, 20 bp, Artificial
  CRISPR gRNA sequence
aagtgcagttaagaggattg

SEQ ID NO: 329707 - DNA, 20 bp, Artificial
  CRISPR gRNA sequence
gttaagaggattgaggaatg

SEQ ID NO: 329708 - DNA, 20 bp, Artificial
  CRISPR gRNA sequence
ttgctggtttatgccttttc

SEQ ID NO: 329709 - DNA, 20 bp, Artificial
  CRISPR gRNA sequence
tcatgaagtcctttagcggc

SEQ ID NO: 329710 - DNA, 20 bp, Artificial
  CRISPR gRNA sequence
atgaatgacatgagcagctt

SEQ ID NO: 329711 - DNA, 20 bp, Artificial
  CRISPR gRNA sequence
gtgccagatggtgtatgtac

SEQ ID NO: 329712 - DNA, 20 bp, Artificial
  CRISPR gRNA sequence
ggcaaaactcaattatatga

SEQ ID NO: 329713 - DNA, 20 bp, Artificial
  CRISPR gRNA sequence
taacaaggagcttgactaga

SEQ ID NO: 329714 - DNA, 20 bp, Artificial
  CRISPR gRNA sequence
aaggagcttgactagactgg

SEQ ID NO: 329715 - DNA, 20 bp, Artificial
  CRISPR gRNA sequence
gtggaggtgtagctgaggag

SEQ ID NO: 329716 - DNA, 20 bp, Artificial
  CRISPR gRNA sequence
gcaaagagcctgtggcagga

SEQ ID NO: 329717 - DNA, 20 bp, Artificial
  CRISPR gRNA sequence
tatagtctatgttccagatt

SEQ ID NO: 329718 - DNA, 20 bp, Artificial
  CRISPR gRNA sequence
aacgttggtaccattcgtgg

SEQ ID NO: 329719 - DNA, 20 bp, Artificial
  CRISPR gRNA sequence
ggttgtggtattatgctcag

SEQ ID NO: 329720 - DNA, 20 bp, Artificial
  CRISPR gRNA sequence
aggtgagatccagccttagg

SEQ ID NO: 329721 - DNA, 20 bp, Artificial
  CRISPR gRNA sequence
taagtttccagattaagctg

SEQ ID NO: 329722 - DNA, 20 bp, Artificial
  CRISPR gRNA sequence
atattcatcgtagattctaa

SEQ ID NO: 329723 - DNA, 20 bp, Artificial
  CRISPR gRNA sequence
gcatgtggcaaacctgaggc

SEQ ID NO: 329724 - DNA, 20 bp, Artificial
  CRISPR gRNA sequence
ttacctttagtcagtgtttg

SEQ ID NO: 329725 - DNA, 20 bp, Artificial
  CRISPR gRNA sequence
atcacctttgttatttggtt

SEQ ID NO: 329726 - DNA, 20 bp, Artificial
  CRISPR gRNA sequence
ttatttggttgtgaattaag

SEQ ID NO: 329727 - DNA, 20 bp, Artificial
  CRISPR gRNA sequence
ggttgtgaattaagaaggat

SEQ ID NO: 329728 - DNA, 20 bp, Artificial
  CRISPR gRNA sequence
ttgctgatttctagtctttg

SEQ ID NO: 329729 - DNA, 20 bp, Artificial
  CRISPR gRNA sequence
gtctttgatggatctcaatg

SEQ ID NO: 329730 - DNA, 20 bp, Artificial
  CRISPR gRNA sequence
taaaaatatctacgaaaaat

SEQ ID NO: 329731 - DNA, 20 bp, Artificial
  CRISPR gRNA sequence
ttataggcaacagggaccat

SEQ ID NO: 329732 - DNA, 20 bp, Artificial
  CRISPR gRNA sequence
aagactactttaaaagcagt

SEQ ID NO: 329733 - DNA, 20 bp, Artificial
  CRISPR gRNA sequence
attgggaagggctgatggca

SEQ ID NO: 329734 - DNA, 20 bp, Artificial
  CRISPR gRNA sequence
gtgttctgtgaggaagctgg

SEQ ID NO: 329735 - DNA, 20 bp, Artificial
  CRISPR gRNA sequence
aggcattccattagtgactc

SEQ ID NO: 329736 - DNA, 20 bp, Artificial
  CRISPR gRNA sequence
ccctcttagcctctccacga

SEQ ID NO: 329737 - DNA, 20 bp, Artificial
  CRISPR gRNA sequence
ctcctgacagcacccccttc

SEQ ID NO: 329738 - DNA, 20 bp, Artificial
  CRISPR gRNA sequence
tcaattttttcttttgatag

SEQ ID NO: 329739 - DNA, 20 bp, Artificial
  CRISPR gRNA sequence
ctaagtaattgacatgttca

SEQ ID NO: 329740 - DNA, 20 bp, Artificial
  CRISPR gRNA sequence
acatgttcaaagaatcttaa

SEQ ID NO: 329741 - DNA, 20 bp, Artificial
  CRISPR gRNA sequence
ctgcactgatatgagaactt

SEQ ID NO: 329742 - DNA, 20 bp, Artificial
  CRISPR gRNA sequence
cagtgcaccctgctccatac

SEQ ID NO: 329743 - DNA, 20 bp, Artificial
  CRISPR gRNA sequence
cagtatttctcttctgtttc

SEQ ID NO: 329744 - DNA, 20 bp, Artificial
  CRISPR gRNA sequence
cgttaaatacccccaactct

SEQ ID NO: 329745 - DNA, 20 bp, Artificial
  CRISPR gRNA sequence
ctctgaattccagtacaggt

SEQ ID NO: 329746 - DNA, 20 bp, Artificial
  CRISPR gRNA sequence
ggtgtcttccttttaccttg

SEQ ID NO: 329747 - DNA, 20 bp, Artificial
  CRISPR gRNA sequence
gagtgactgatatctttcct

SEQ ID NO: 329748 - DNA, 20 bp, Artificial
  CRISPR gRNA sequence
ctgatatctttcctgggaat

SEQ ID NO: 329749 - DNA, 20 bp, Artificial
  CRISPR gRNA sequence
ctttcctgggaataggagtc

SEQ ID NO: 329750 - DNA, 20 bp, Artificial
  CRISPR gRNA sequence
ctccactgtctgctggcttc

SEQ ID NO: 329751 - DNA, 20 bp, Artificial
  CRISPR gRNA sequence
gtctgctggcttctagggtt

SEQ ID NO: 329752 - DNA, 20 bp, Artificial
  CRISPR gRNA sequence
ggcttctagggttgtgggtg

SEQ ID NO: 329753 - DNA, 20 bp, Artificial
  CRISPR gRNA sequence
tgtaaaaaaaaaaaaaactc

SEQ ID NO: 329754 - DNA, 20 bp, Artificial
  CRISPR gRNA sequence
aaagctatttacttcagtat

SEQ ID NO: 329755 - DNA, 20 bp, Artificial
  CRISPR gRNA sequence
ttacttcagtattggaattc

SEQ ID NO: 329756 - DNA, 20 bp, Artificial
  CRISPR gRNA sequence
ttggaattcaggaattcctc

SEQ ID NO: 329757 - DNA, 20 bp, Artificial
  CRISPR gRNA sequence
tattaattttttttttgagg

SEQ ID NO: 329758 - DNA, 20 bp, Artificial
  CRISPR gRNA sequence
tctcactctgtcgcccaggc

SEQ ID NO: 329759 - DNA, 20 bp, Artificial
  CRISPR gRNA sequence
cttactgcaacctccacctc

SEQ ID NO: 329760 - DNA, 20 bp, Artificial
  CRISPR gRNA sequence
ttttgtatttttcgtagaga

SEQ ID NO: 329761 - DNA, 20 bp, Artificial
  CRISPR gRNA sequence
cggggtttcaccgtgttagc

SEQ ID NO: 329762 - DNA, 20 bp, Artificial
  CRISPR gRNA sequence
gcctccgcctcccaaagtgc

SEQ ID NO: 329763 - DNA, 20 bp, Artificial
  CRISPR gRNA sequence
tattattattttttttaaga

SEQ ID NO: 329764 - DNA, 20 bp, Artificial
  CRISPR gRNA sequence
tcttattcttatgtaagatc

SEQ ID NO: 329765 - DNA, 20 bp, Artificial
  CRISPR gRNA sequence
ccacaactccttcagatgaa

SEQ ID NO: 329766 - DNA, 20 bp, Artificial
  CRISPR gRNA sequence
atatactgcttccctactct

SEQ ID NO: 329767 - DNA, 20 bp, Artificial
  CRISPR gRNA sequence
gcttccctactctaagaata

SEQ ID NO: 329768 - DNA, 20 bp, Artificial
  CRISPR gRNA sequence
ggctttgcaaatttttaaaa

SEQ ID NO: 329769 - DNA, 20 bp, Artificial
  CRISPR gRNA sequence
aagtggaacttaagtatgta

SEQ ID NO: 329770 - DNA, 20 bp, Artificial
  CRISPR gRNA sequence
ggtaaagatttgcaagttta

SEQ ID NO: 329771 - DNA, 20 bp, Artificial
  CRISPR gRNA sequence
agtttagagagtcagaaact

SEQ ID NO: 329772 - DNA, 20 bp, Artificial
  CRISPR gRNA sequence
agaaacacgttgtccccaaa

SEQ ID NO: 329773 - DNA, 20 bp, Artificial
  CRISPR gRNA sequence
cccaaatagggtgatagacc

SEQ ID NO: 329774 - DNA, 20 bp, Artificial
  CRISPR gRNA sequence
gagtttccatccagttgacc

SEQ ID NO: 329775 - DNA, 20 bp, Artificial
  CRISPR gRNA sequence
cagttgaccacgagtgttgt

SEQ ID NO: 329776 - DNA, 20 bp, Artificial
  CRISPR gRNA sequence
tgttgttaggatctgtttat

SEQ ID NO: 329777 - DNA, 20 bp, Artificial
  CRISPR gRNA sequence
atcatttaaaggtaactttt

SEQ ID NO: 329778 - DNA, 20 bp, Artificial
  CRISPR gRNA sequence
tcttctaggactttgcaaca

SEQ ID NO: 329779 - DNA, 20 bp, Artificial
  CRISPR gRNA sequence
gatgaaatttacttctatat

SEQ ID NO: 329780 - DNA, 20 bp, Artificial
  CRISPR gRNA sequence
taagtgatgggaaaatcatt

SEQ ID NO: 329781 - DNA, 20 bp, Artificial
  CRISPR gRNA sequence
agcttaatacatgatggctg

SEQ ID NO: 329782 - DNA, 20 bp, Artificial
  CRISPR gRNA sequence
gaatgaaaatgtctagggaa

SEQ ID NO: 329783 - DNA, 20 bp, Artificial
  CRISPR gRNA sequence
aacacatatgtggcaccaat

SEQ ID NO: 329784 - DNA, 20 bp, Artificial
  CRISPR gRNA sequence
ctttagtttctgtacaatga

SEQ ID NO: 329785 - DNA, 20 bp, Artificial
  CRISPR gRNA sequence
ttttctttgtttttgttgga

SEQ ID NO: 329786 - DNA, 20 bp, Artificial
  CRISPR gRNA sequence
gaagaccttgtcttcaagct

SEQ ID NO: 329787 - DNA, 20 bp, Artificial
  CRISPR gRNA sequence
tctttaagctatctatttcc

SEQ ID NO: 329788 - DNA, 20 bp, Artificial
  CRISPR gRNA sequence
ttagcttaataactaacctc

SEQ ID NO: 329789 - DNA, 20 bp, Artificial
  CRISPR gRNA sequence
aattctttttcaggtagatg

SEQ ID NO: 329790 - DNA, 20 bp, Artificial
  CRISPR gRNA sequence
atgaagaatttcttcttggt

SEQ ID NO: 329791 - DNA, 20 bp, Artificial
  CRISPR gRNA sequence
gtgaactagtgtgatttttt

SEQ ID NO: 329792 - DNA, 20 bp, Artificial
  CRISPR gRNA sequence
gccttgttttgtcatattac

SEQ ID NO: 329793 - DNA, 20 bp, Artificial
  CRISPR gRNA sequence
gttttctggttccttctcat

SEQ ID NO: 329794 - DNA, 20 bp, Artificial
  CRISPR gRNA sequence
cagattttttttttgtccca

SEQ ID NO: 329795 - DNA, 20 bp, Artificial
  CRISPR gRNA sequence
cagtgattgttgtctctctt

SEQ ID NO: 329796 - DNA, 20 bp, Artificial
  CRISPR gRNA sequence
cccggctctgggctggtatt

SEQ ID NO: 329797 - DNA, 20 bp, Artificial
  CRISPR gRNA sequence
tcctgtgatgtgaaccatct

SEQ ID NO: 329798 - DNA, 20 bp, Artificial
  CRISPR gRNA sequence
catctatgggtctctcagcc

SEQ ID NO: 329799 - DNA, 20 bp, Artificial
  CRISPR gRNA sequence
ctgttctggtggaggtggcg

SEQ ID NO: 329800 - DNA, 20 bp, Artificial
  CRISPR gRNA sequence
atcagctgtaatagtataga

SEQ ID NO: 329801 - DNA, 20 bp, Artificial
  CRISPR gRNA sequence
agtatagagagggtctggtg

SEQ ID NO: 329802 - DNA, 20 bp, Artificial
  CRISPR gRNA sequence
gggtggggccctagaactcc

SEQ ID NO: 329803 - DNA, 20 bp, Artificial
  CRISPR gRNA sequence
gccctttgtgttctgctaac

SEQ ID NO: 329804 - DNA, 20 bp, Artificial
  CRISPR gRNA sequence
tttgtgttctgctaaccagg

SEQ ID NO: 329805 - DNA, 20 bp, Artificial
  CRISPR gRNA sequence
gtcttgctgtggctgctgtg

SEQ ID NO: 329806 - DNA, 20 bp, Artificial
  CRISPR gRNA sequence
ctgtggctgctgtgggggat

SEQ ID NO: 329807 - DNA, 20 bp, Artificial
  CRISPR gRNA sequence
gggtgagattcccaggtcac

SEQ ID NO: 329808 - DNA, 20 bp, Artificial
  CRISPR gRNA sequence
cactggagttgtgtacctag

SEQ ID NO: 329809 - DNA, 20 bp, Artificial
  CRISPR gRNA sequence
gaggattatggctgcctctg

SEQ ID NO: 329810 - DNA, 20 bp, Artificial
  CRISPR gRNA sequence
ctgcatgtgaaatctgcatg

SEQ ID NO: 329811 - DNA, 20 bp, Artificial
  CRISPR gRNA sequence
atagttacaaagttcagcta

SEQ ID NO: 329812 - DNA, 20 bp, Artificial
  CRISPR gRNA sequence
tagagaattccttctccctg

SEQ ID NO: 329813 - DNA, 20 bp, Artificial
  CRISPR gRNA sequence
ctcctctggccaccctccag

SEQ ID NO: 329814 - DNA, 20 bp, Artificial
  CRISPR gRNA sequence
ggatccctgtggtgcctggc

SEQ ID NO: 329815 - DNA, 20 bp, Artificial
  CRISPR gRNA sequence
agacgctcagcttctccggt

SEQ ID NO: 329816 - DNA, 20 bp, Artificial
  CRISPR gRNA sequence
agagtgtgtgtttgggagag

SEQ ID NO: 329817 - DNA, 20 bp, Artificial
  CRISPR gRNA sequence
gaggagggtctccctttccc

SEQ ID NO: 329818 - DNA, 20 bp, Artificial
  CRISPR gRNA sequence
atctcccaatcttcagtaaa

SEQ ID NO: 329819 - DNA, 20 bp, Artificial
  CRISPR gRNA sequence
ttccactatgttcaaggtcc

SEQ ID NO: 329820 - DNA, 20 bp, Artificial
  CRISPR gRNA sequence
attattgggagcatagaaat

SEQ ID NO: 329821 - DNA, 20 bp, Artificial
  CRISPR gRNA sequence
gacatttaaaatggttcttg

SEQ ID NO: 329822 - DNA, 20 bp, Artificial
  CRISPR gRNA sequence
tttaaaatggttcttgaaga

SEQ ID NO: 329823 - DNA, 20 bp, Artificial
  CRISPR gRNA sequence
atggttcttgaagagtgaat

SEQ ID NO: 329824 - DNA, 20 bp, Artificial
  CRISPR gRNA sequence
gagaatttcttctcagatta

SEQ ID NO: 329825 - DNA, 20 bp, Artificial
  CRISPR gRNA sequence
taatagagacttttaaactg

SEQ ID NO: 329826 - DNA, 20 bp, Artificial
  CRISPR gRNA sequence
ttttgggagcagcatggagg

SEQ ID NO: 329827 - DNA, 20 bp, Artificial
  CRISPR gRNA sequence
gtattgagaaggccagtcaa

SEQ ID NO: 329828 - DNA, 20 bp, Artificial
  CRISPR gRNA sequence
agggaagacatgaaaaaggt

SEQ ID NO: 329829 - DNA, 20 bp, Artificial
  CRISPR gRNA sequence
aaaaggtgtggattggcaat

SEQ ID NO: 329830 - DNA, 20 bp, Artificial
  CRISPR gRNA sequence
tggcaatgggaatggagaaa

SEQ ID NO: 329831 - DNA, 20 bp, Artificial
  CRISPR gRNA sequence
atgggaatggagaaaaagaa

SEQ ID NO: 329832 - DNA, 20 bp, Artificial
  CRISPR gRNA sequence
tttaagagatattcatgagc

SEQ ID NO: 329833 - DNA, 20 bp, Artificial
  CRISPR gRNA sequence
caactggacttggtgaccaa

SEQ ID NO: 329834 - DNA, 20 bp, Artificial
  CRISPR gRNA sequence
gaggaagactctgaggttcc

SEQ ID NO: 329835 - DNA, 20 bp, Artificial
  CRISPR gRNA sequence
ctagtgactccctgaaaaga

SEQ ID NO: 329836 - DNA, 20 bp, Artificial
  CRISPR gRNA sequence
actccctgaaaagacagggt

SEQ ID NO: 329837 - DNA, 20 bp, Artificial
  CRISPR gRNA sequence
aaagacagggtttggatttg

SEQ ID NO: 329838 - DNA, 20 bp, Artificial
  CRISPR gRNA sequence
acagggtttggatttggtga

SEQ ID NO: 329839 - DNA, 20 bp, Artificial
  CRISPR gRNA sequence
gtcacgtgccacttgacgat

SEQ ID NO: 329840 - DNA, 20 bp, Artificial
  CRISPR gRNA sequence
actgcactacctaggctatg

SEQ ID NO: 329841 - DNA, 20 bp, Artificial
  CRISPR gRNA sequence
ctgtacagcatgttactgta

SEQ ID NO: 329842 - DNA, 20 bp, Artificial
  CRISPR gRNA sequence
aaaggctatacatgatgtgt

SEQ ID NO: 329843 - DNA, 20 bp, Artificial
  CRISPR gRNA sequence
aaccagatagtgatgttgaa

SEQ ID NO: 329844 - DNA, 20 bp, Artificial
  CRISPR gRNA sequence
gagagaaaatgtgggctcct

SEQ ID NO: 329845 - DNA, 20 bp, Artificial
  CRISPR gRNA sequence
agctggagccataggtgcaa

SEQ ID NO: 329846 - DNA, 20 bp, Artificial
  CRISPR gRNA sequence
acaccctgtccatgtgccca

SEQ ID NO: 329847 - DNA, 20 bp, Artificial
  CRISPR gRNA sequence
gctgagcaatggcaagcaat

SEQ ID NO: 329848 - DNA, 20 bp, Artificial
  CRISPR gRNA sequence
caatgtgggtattcagaggt

SEQ ID NO: 329849 - DNA, 20 bp, Artificial
  CRISPR gRNA sequence
ctccctcccactctgtggaa

SEQ ID NO: 329850 - DNA, 20 bp, Artificial
  CRISPR gRNA sequence
tcccactctgtggaagagag

SEQ ID NO: 329851 - DNA, 20 bp, Artificial
  CRISPR gRNA sequence
gtttgtaaattaattgcttt

SEQ ID NO: 329852 - DNA, 20 bp, Artificial
  CRISPR gRNA sequence
acaaagttttataataccac

SEQ ID NO: 329853 - DNA, 20 bp, Artificial
  CRISPR gRNA sequence
tatacacacttagagaacca

SEQ ID NO: 329854 - DNA, 20 bp, Artificial
  CRISPR gRNA sequence
gggttgttttgtacccccta

SEQ ID NO: 329855 - DNA, 20 bp, Artificial
  CRISPR gRNA sequence
accccctatggagttccttg

SEQ ID NO: 329856 - DNA, 20 bp, Artificial
  CRISPR gRNA sequence
tgttaggcatttaggttaga

SEQ ID NO: 329857 - DNA, 20 bp, Artificial
  CRISPR gRNA sequence
ctcaattacttctttagatt

SEQ ID NO: 329858 - DNA, 20 bp, Artificial
  CRISPR gRNA sequence
tctttagattatgggtgcct

SEQ ID NO: 329859 - DNA, 20 bp, Artificial
  CRISPR gRNA sequence
tatataaaaatctactaacc

SEQ ID NO: 329860 - DNA, 20 bp, Artificial
  CRISPR gRNA sequence
agtacttttttttttaatgc

SEQ ID NO: 329861 - DNA, 20 bp, Artificial
  CRISPR gRNA sequence
ggaggtttgtggttagaagt

SEQ ID NO: 329862 - DNA, 20 bp, Artificial
  CRISPR gRNA sequence
gatatcttgcacgctctgca

SEQ ID NO: 329863 - DNA, 20 bp, Artificial
  CRISPR gRNA sequence
tcttgcacgctctgcactga

SEQ ID NO: 329864 - DNA, 20 bp, Artificial
  CRISPR gRNA sequence
ttctttaaatgtttcctcca

SEQ ID NO: 329865 - DNA, 20 bp, Artificial
  CRISPR gRNA sequence
gaacaatacaactgcttgca

SEQ ID NO: 329866 - DNA, 20 bp, Artificial
  CRISPR gRNA sequence
ctgcttgcaaagagtcccag

SEQ ID NO: 329867 - DNA, 20 bp, Artificial
  CRISPR gRNA sequence
ttgcaaagagtcccagcagg

SEQ ID NO: 329868 - DNA, 20 bp, Artificial
  CRISPR gRNA sequence
cactatagtgcaattctcag

SEQ ID NO: 329869 - DNA, 20 bp, Artificial
  CRISPR gRNA sequence
attattattattttttgaga

SEQ ID NO: 329870 - DNA, 20 bp, Artificial
  CRISPR gRNA sequence
gtcttgctctgttgccaggc

SEQ ID NO: 329871 - DNA, 20 bp, Artificial
  CRISPR gRNA sequence
gattctcctgcctcagcctc

SEQ ID NO: 329872 - DNA, 20 bp, Artificial
  CRISPR gRNA sequence
gcctcagcctcctgagtagc

SEQ ID NO: 329873 - DNA, 20 bp, Artificial
  CRISPR gRNA sequence
ttttatattattagtagaga

SEQ ID NO: 329874 - DNA, 20 bp, Artificial
  CRISPR gRNA sequence
cggagtttcaccatgttggc

SEQ ID NO: 329875 - DNA, 20 bp, Artificial
  CRISPR gRNA sequence
gcctcggcctcccaaagtgc

SEQ ID NO: 329876 - DNA, 20 bp, Artificial
  CRISPR gRNA sequence
caaagtgctgggattacagg

SEQ ID NO: 329877 - DNA, 20 bp, Artificial
  CRISPR gRNA sequence
agtcttgagcctctactggg

SEQ ID NO: 329878 - DNA, 20 bp, Artificial
  CRISPR gRNA sequence
tctccagactgattataatc

SEQ ID NO: 329879 - DNA, 20 bp, Artificial
  CRISPR gRNA sequence
cagattttaagactcatcac

SEQ ID NO: 329880 - DNA, 20 bp, Artificial
  CRISPR gRNA sequence
attagaacaaccattggtcc

SEQ ID NO: 329881 - DNA, 20 bp, Artificial
  CRISPR gRNA sequence
caaccaggtttgttgctcac

SEQ ID NO: 329882 - DNA, 20 bp, Artificial
  CRISPR gRNA sequence
cacagacatataagagccaa

SEQ ID NO: 329883 - DNA, 20 bp, Artificial
  CRISPR gRNA sequence
aataagtatttatgaaccca

SEQ ID NO: 329884 - DNA, 20 bp, Artificial
  CRISPR gRNA sequence
ttagaacatgacatctcagt

SEQ ID NO: 329885 - DNA, 20 bp, Artificial
  CRISPR gRNA sequence
taatatggcatagctaactc

SEQ ID NO: 329886 - DNA, 20 bp, Artificial
  CRISPR gRNA sequence
caggtattattgtagatact

SEQ ID NO: 329887 - DNA, 20 bp, Artificial
  CRISPR gRNA sequence
tattattgtagatacttggg

SEQ ID NO: 329888 - DNA, 20 bp, Artificial
  CRISPR gRNA sequence
tagatacttgggatggattt

SEQ ID NO: 329889 - DNA, 20 bp, Artificial
  CRISPR gRNA sequence
aggtccctggttttaaagct

SEQ ID NO: 329890 - DNA, 20 bp, Artificial
  CRISPR gRNA sequence
cctggttttaaagcttagag

SEQ ID NO: 329891 - DNA, 20 bp, Artificial
  CRISPR gRNA sequence
ttaatgtactagataatgac

SEQ ID NO: 329892 - DNA, 20 bp, Artificial
  CRISPR gRNA sequence
acctggatatattctttaga

SEQ ID NO: 329893 - DNA, 20 bp, Artificial
  CRISPR gRNA sequence
gcagccatgtgaaaatcaga

SEQ ID NO: 329894 - DNA, 20 bp, Artificial
  CRISPR gRNA sequence
tcatgcaagtcatgggaaac

SEQ ID NO: 329895 - DNA, 20 bp, Artificial
  CRISPR gRNA sequence
aacttagattttactgtaag

SEQ ID NO: 329896 - DNA, 20 bp, Artificial
  CRISPR gRNA sequence
taagcagaacaatgactcta

SEQ ID NO: 329897 - DNA, 20 bp, Artificial
  CRISPR gRNA sequence
gtcattctggtttctctgtg

SEQ ID NO: 329898 - DNA, 20 bp, Artificial
  CRISPR gRNA sequence
ttctggtttctctgtggaga

SEQ ID NO: 329899 - DNA, 20 bp, Artificial
  CRISPR gRNA sequence
agaatggattgtaaatgggc

SEQ ID NO: 329900 - DNA, 20 bp, Artificial
  CRISPR gRNA sequence
gaagctgagatggaggagaa

SEQ ID NO: 329901 - DNA, 20 bp, Artificial
  CRISPR gRNA sequence
ttgctagtgacactttgact

SEQ ID NO: 329902 - DNA, 20 bp, Artificial
  CRISPR gRNA sequence
tgtatgatgctgagaagagg

SEQ ID NO: 329903 - DNA, 20 bp, Artificial
  CRISPR gRNA sequence
gaaacaaaaagtgtaaagct

SEQ ID NO: 329904 - DNA, 20 bp, Artificial
  CRISPR gRNA sequence
tgtaaagctgagggtattta

SEQ ID NO: 329905 - DNA, 20 bp, Artificial
  CRISPR gRNA sequence
atatcaaagatagtatgaga

SEQ ID NO: 329906 - DNA, 20 bp, Artificial
  CRISPR gRNA sequence
tttaactactggtatggcaa

SEQ ID NO: 329907 - DNA, 20 bp, Artificial
  CRISPR gRNA sequence
tatcataccagcattccagg

SEQ ID NO: 329908 - DNA, 20 bp, Artificial
  CRISPR gRNA sequence
tggagataagaacatccaag

SEQ ID NO: 329909 - DNA, 20 bp, Artificial
  CRISPR gRNA sequence
aaatgttaccaaaggctaag

SEQ ID NO: 329910 - DNA, 20 bp, Artificial
  CRISPR gRNA sequence
tccattttctgttgctatca

SEQ ID NO: 329911 - DNA, 20 bp, Artificial
  CRISPR gRNA sequence
ctatcactgaataccggaga

SEQ ID NO: 329912 - DNA, 20 bp, Artificial
  CRISPR gRNA sequence
ggaggctggggcctaagtct

SEQ ID NO: 329913 - DNA, 20 bp, Artificial
  CRISPR gRNA sequence
cagaggcccaaggcagtaca

SEQ ID NO: 329914 - DNA, 20 bp, Artificial
  CRISPR gRNA sequence
atctgttaacccattaaccc

SEQ ID NO: 329915 - DNA, 20 bp, Artificial
  CRISPR gRNA sequence
ttaacccattaacccatgaa

SEQ ID NO: 329916 - DNA, 20 bp, Artificial
  CRISPR gRNA sequence
aattggattaagctattcat

SEQ ID NO: 329917 - DNA, 20 bp, Artificial
  CRISPR gRNA sequence
cctcccaattctattacact

SEQ ID NO: 329918 - DNA, 20 bp, Artificial
  CRISPR gRNA sequence
actggggattaattttcaat

SEQ ID NO: 329919 - DNA, 20 bp, Artificial
  CRISPR gRNA sequence
ccagatggaaagtttaaaca

SEQ ID NO: 329920 - DNA, 20 bp, Artificial
  CRISPR gRNA sequence
tttaagttaaagataaaaaa

SEQ ID NO: 329921 - DNA, 20 bp, Artificial
  CRISPR gRNA sequence
actttgggaggccaaggtgg

SEQ ID NO: 329922 - DNA, 20 bp, Artificial
  CRISPR gRNA sequence
tacttgggaagctgaggcag

SEQ ID NO: 329923 - DNA, 20 bp, Artificial
  CRISPR gRNA sequence
tccatctcaaaaaaaaaaaa

SEQ ID NO: 329924 - DNA, 20 bp, Artificial
  CRISPR gRNA sequence
tttaatttattctgactttc

SEQ ID NO: 329925 - DNA, 20 bp, Artificial
  CRISPR gRNA sequence
ggaagacttacccaacagca

SEQ ID NO: 329926 - DNA, 20 bp, Artificial
  CRISPR gRNA sequence
tcagttgtttgcagtcttat

SEQ ID NO: 329927 - DNA, 20 bp, Artificial
  CRISPR gRNA sequence
tatctggatatattctgatg

SEQ ID NO: 329928 - DNA, 20 bp, Artificial
  CRISPR gRNA sequence
ttgtttcacttcttcatttc

SEQ ID NO: 329929 - DNA, 20 bp, Artificial
  CRISPR gRNA sequence
tcatttcacggatgaggagg

SEQ ID NO: 329930 - DNA, 20 bp, Artificial
  CRISPR gRNA sequence
atgaggaggctgaattccac

SEQ ID NO: 329931 - DNA, 20 bp, Artificial
  CRISPR gRNA sequence
agccttgctagtggcagagc

SEQ ID NO: 329932 - DNA, 20 bp, Artificial
  CRISPR gRNA sequence
gaatttgcctctggtttcct

SEQ ID NO: 329933 - DNA, 20 bp, Artificial
  CRISPR gRNA sequence
cagtttttttttctttgcct

SEQ ID NO: 329934 - DNA, 20 bp, Artificial
  CRISPR gRNA sequence
tgaaaaaaatgtataattta

SEQ ID NO: 329935 - DNA, 20 bp, Artificial
  CRISPR gRNA sequence
ctttagacaaaaccattagg

SEQ ID NO: 329936 - DNA, 20 bp, Artificial
  CRISPR gRNA sequence
ctcttttctctggctgcttt

SEQ ID NO: 329937 - DNA, 20 bp, Artificial
  CRISPR gRNA sequence
tacttttaaaaaatatgctt

SEQ ID NO: 329938 - DNA, 20 bp, Artificial
  CRISPR gRNA sequence
aaaatatgcttgtgaattgt

SEQ ID NO: 329939 - DNA, 20 bp, Artificial
  CRISPR gRNA sequence
cttgtgaattgttgggattc

SEQ ID NO: 329940 - DNA, 20 bp, Artificial
  CRISPR gRNA sequence
tgttgggattcttgaatctg

SEQ ID NO: 329941 - DNA, 20 bp, Artificial
  CRISPR gRNA sequence
cttgaatctgtggagtgtga

SEQ ID NO: 329942 - DNA, 20 bp, Artificial
  CRISPR gRNA sequence
atatatattaaacttatcta

SEQ ID NO: 329943 - DNA, 20 bp, Artificial
  CRISPR gRNA sequence
ataattcaggtatataaatc

SEQ ID NO: 329944 - DNA, 20 bp, Artificial
  CRISPR gRNA sequence
tttttgtgatgtgtttgcca

SEQ ID NO: 329945 - DNA, 20 bp, Artificial
  CRISPR gRNA sequence
tgatgtgtttgccattgaat

SEQ ID NO: 329946 - DNA, 20 bp, Artificial
  CRISPR gRNA sequence
gtatgaaattttttgaggcc

SEQ ID NO: 329947 - DNA, 20 bp, Artificial
  CRISPR gRNA sequence
atttttactttcaaaagctg

SEQ ID NO: 329948 - DNA, 20 bp, Artificial
  CRISPR gRNA sequence
aatctccttaaagaaaattc

SEQ ID NO: 329949 - DNA, 20 bp, Artificial
  CRISPR gRNA sequence
atttttctggaccatctaat

SEQ ID NO: 329950 - DNA, 20 bp, Artificial
  CRISPR gRNA sequence
tatttctttacctgtgctcc

SEQ ID NO: 329951 - DNA, 20 bp, Artificial
  CRISPR gRNA sequence
gctccaagaatgtaactctt

SEQ ID NO: 329952 - DNA, 20 bp, Artificial
  CRISPR gRNA sequence
gggtcccaatttattgggga

SEQ ID NO: 329953 - DNA, 20 bp, Artificial
  CRISPR gRNA sequence
tcactcactctgcagattct

SEQ ID NO: 329954 - DNA, 20 bp, Artificial
  CRISPR gRNA sequence
tgagacataaaaacaaaagt

SEQ ID NO: 329955 - DNA, 20 bp, Artificial
  CRISPR gRNA sequence
tgaaagaacagcaatgcttt

SEQ ID NO: 329956 - DNA, 20 bp, Artificial
  CRISPR gRNA sequence
tccaagctttgcctgtctct

SEQ ID NO: 329957 - DNA, 20 bp, Artificial
  CRISPR gRNA sequence
atttttggttgttttggcgt

SEQ ID NO: 329958 - DNA, 20 bp, Artificial
  CRISPR gRNA sequence
gttttggcgtgagaattagt

SEQ ID NO: 329959 - DNA, 20 bp, Artificial
  CRISPR gRNA sequence
ggaaaatataaattgaagcc

SEQ ID NO: 329960 - DNA, 20 bp, Artificial
  CRISPR gRNA sequence
ccaataatatagtcattaaa

SEQ ID NO: 329961 - DNA, 20 bp, Artificial
  CRISPR gRNA sequence
aagagaaggcaatgagcagt

SEQ ID NO: 329962 - DNA, 20 bp, Artificial
  CRISPR gRNA sequence
gaatttatagtctaataact

SEQ ID NO: 329963 - DNA, 20 bp, Artificial
  CRISPR gRNA sequence
actttaagaggctgaggcag

SEQ ID NO: 329964 - DNA, 20 bp, Artificial
  CRISPR gRNA sequence
caggaggattgcttgaggcc

SEQ ID NO: 329965 - DNA, 20 bp, Artificial
  CRISPR gRNA sequence
ggctgaggcaggagggaccc

SEQ ID NO: 329966 - DNA, 20 bp, Artificial
  CRISPR gRNA sequence
aagtggaggctacaacgagc

SEQ ID NO: 329967 - DNA, 20 bp, Artificial
  CRISPR gRNA sequence
ctgcactgtagcctggggaa

SEQ ID NO: 329968 - DNA, 20 bp, Artificial
  CRISPR gRNA sequence
aggccttgattcagttctca

SEQ ID NO: 329969 - DNA, 20 bp, Artificial
  CRISPR gRNA sequence
gaagtacacatggttcttgt

SEQ ID NO: 329970 - DNA, 20 bp, Artificial
  CRISPR gRNA sequence
atgacaagcaagtttctggt

SEQ ID NO: 329971 - DNA, 20 bp, Artificial
  CRISPR gRNA sequence
ttatcttatgttcttccttg

SEQ ID NO: 329972 - DNA, 20 bp, Artificial
  CRISPR gRNA sequence
tcttccttgaggggtggagg

SEQ ID NO: 329973 - DNA, 20 bp, Artificial
  CRISPR gRNA sequence
aacagagatgactttatgca

SEQ ID NO: 329974 - DNA, 20 bp, Artificial
  CRISPR gRNA sequence
gtggaaacacagtgtccatt

SEQ ID NO: 329975 - DNA, 20 bp, Artificial
  CRISPR gRNA sequence
ttttaaagtaactcttacag

SEQ ID NO: 329976 - DNA, 20 bp, Artificial
  CRISPR gRNA sequence
tgctttcatcttccaaactt

SEQ ID NO: 329977 - DNA, 20 bp, Artificial
  CRISPR gRNA sequence
caaataaatatcttttgtgt

SEQ ID NO: 329978 - DNA, 20 bp, Artificial
  CRISPR gRNA sequence
cttaaacttatggcttaata

SEQ ID NO: 329979 - DNA, 20 bp, Artificial
  CRISPR gRNA sequence
ttggttttgcactgtgtttg

SEQ ID NO: 329980 - DNA, 20 bp, Artificial
  CRISPR gRNA sequence
aatcttttaagttttagttc

SEQ ID NO: 329981 - DNA, 20 bp, Artificial
  CRISPR gRNA sequence
tctaataacttgcccactta

SEQ ID NO: 329982 - DNA, 20 bp, Artificial
  CRISPR gRNA sequence
taagagaacttgtggttcag

SEQ ID NO: 329983 - DNA, 20 bp, Artificial
  CRISPR gRNA sequence
acatacctttttttccaatc

SEQ ID NO: 329984 - DNA, 20 bp, Artificial
  CRISPR gRNA sequence
gctgaagttctggttaccca

SEQ ID NO: 329985 - DNA, 20 bp, Artificial
  CRISPR gRNA sequence
ctttgttgtagtctgcattt

SEQ ID NO: 329986 - DNA, 20 bp, Artificial
  CRISPR gRNA sequence
aaagtacacatggctcttgt

SEQ ID NO: 329987 - DNA, 20 bp, Artificial
  CRISPR gRNA sequence
acttgacttgatggcttaca

SEQ ID NO: 329988 - DNA, 20 bp, Artificial
  CRISPR gRNA sequence
aaaattattatgcatgggct

SEQ ID NO: 329989 - DNA, 20 bp, Artificial
  CRISPR gRNA sequence
attatgcatgggctgcgaat

SEQ ID NO: 329990 - DNA, 20 bp, Artificial
  CRISPR gRNA sequence
acaaaaatctccctgtgctg

SEQ ID NO: 329991 - DNA, 20 bp, Artificial
  CRISPR gRNA sequence
gacaccactctgcatattac

SEQ ID NO: 329992 - DNA, 20 bp, Artificial
  CRISPR gRNA sequence
tggccagtgtatatctgtgg

SEQ ID NO: 329993 - DNA, 20 bp, Artificial
  CRISPR gRNA sequence
agtgtatatctgtgggagag

SEQ ID NO: 329994 - DNA, 20 bp, Artificial
  CRISPR gRNA sequence
aaagagacataaagaaggaa

SEQ ID NO: 329995 - DNA, 20 bp, Artificial
  CRISPR gRNA sequence
tgtcacataccacttcaaca

SEQ ID NO: 329996 - DNA, 20 bp, Artificial
  CRISPR gRNA sequence
cagtgtgcacgaccctaacg

SEQ ID NO: 329997 - DNA, 20 bp, Artificial
  CRISPR gRNA sequence
tcacaggtatgactccattt

SEQ ID NO: 329998 - DNA, 20 bp, Artificial
  CRISPR gRNA sequence
aggtttcttcacagtaagcc

SEQ ID NO: 329999 - DNA, 20 bp, Artificial
  CRISPR gRNA sequence
acatctccaaggcctaattc

SEQ ID NO: 330000 - DNA, 20 bp, Artificial
  CRISPR gRNA sequence
ctagaattttctgtgaaaat

SEQ ID NO: 330001 - DNA, 20 bp, Artificial
  CRISPR gRNA sequence
cccattgatgtttcaaaagt

SEQ ID NO: 330002 - DNA, 20 bp, Artificial
  CRISPR gRNA sequence
attctaagtgttttttgttg

SEQ ID NO: 330003 - DNA, 20 bp, Artificial
  CRISPR gRNA sequence
ttattgagcatcagttaagt

SEQ ID NO: 330004 - DNA, 20 bp, Artificial
  CRISPR gRNA sequence
catcagttaagtgtgagtta

SEQ ID NO: 330005 - DNA, 20 bp, Artificial
  CRISPR gRNA sequence
ttactgagtgaggcactctg

SEQ ID NO: 330006 - DNA, 20 bp, Artificial
  CRISPR gRNA sequence
tatctggttattttgaggta

SEQ ID NO: 330007 - DNA, 20 bp, Artificial
  CRISPR gRNA sequence
agtgtgcaagtttagagaac

SEQ ID NO: 330008 - DNA, 20 bp, Artificial
  CRISPR gRNA sequence
gaaatttgaccttttctgtt

SEQ ID NO: 330009 - DNA, 20 bp, Artificial
  CRISPR gRNA sequence
atgtcttatgcccttgaggt

SEQ ID NO: 330010 - DNA, 20 bp, Artificial
  CRISPR gRNA sequence
acacatagcttgcgttgtca

SEQ ID NO: 330011 - DNA, 20 bp, Artificial
  CRISPR gRNA sequence
gttgtcatggaattatagca

SEQ ID NO: 330012 - DNA, 20 bp, Artificial
  CRISPR gRNA sequence
agcatgggatgggagctaaa

SEQ ID NO: 330013 - DNA, 20 bp, Artificial
  CRISPR gRNA sequence
atgggagctaaaaaggatcc

SEQ ID NO: 330014 - DNA, 20 bp, Artificial
  CRISPR gRNA sequence
gcttaatgtgttctggctgt

SEQ ID NO: 330015 - DNA, 20 bp, Artificial
  CRISPR gRNA sequence
gcagaacctgacataaggac

SEQ ID NO: 330016 - DNA, 20 bp, Artificial
  CRISPR gRNA sequence
gggaggtgatcccaggaaga

SEQ ID NO: 330017 - DNA, 20 bp, Artificial
  CRISPR gRNA sequence
agaaggggtgagggggcagg

SEQ ID NO: 330018 - DNA, 20 bp, Artificial
  CRISPR gRNA sequence
agaagtgtacagatgcctcc

SEQ ID NO: 330019 - DNA, 20 bp, Artificial
  CRISPR gRNA sequence
ctcccagaatcattctcttg

SEQ ID NO: 330020 - DNA, 20 bp, Artificial
  CRISPR gRNA sequence
tggctccatcctcactgatt

SEQ ID NO: 330021 - DNA, 20 bp, Artificial
  CRISPR gRNA sequence
ctctgagctgtgcctctact

SEQ ID NO: 330022 - DNA, 20 bp, Artificial
  CRISPR gRNA sequence
ctacttgggatgagcctact

SEQ ID NO: 330023 - DNA, 20 bp, Artificial
  CRISPR gRNA sequence
ttgggatgagcctacttggg

SEQ ID NO: 330024 - DNA, 20 bp, Artificial
  CRISPR gRNA sequence
aggtggacagtttcaaagtg

SEQ ID NO: 330025 - DNA, 20 bp, Artificial
  CRISPR gRNA sequence
gtttagataatgtctgttat

SEQ ID NO: 330026 - DNA, 20 bp, Artificial
  CRISPR gRNA sequence
ctggaaatggggaactggtg

SEQ ID NO: 330027 - DNA, 20 bp, Artificial
  CRISPR gRNA sequence
ctgggtgttgaagcataaag

SEQ ID NO: 330028 - DNA, 20 bp, Artificial
  CRISPR gRNA sequence
tgagtttgcatggtgtgtgt

SEQ ID NO: 330029 - DNA, 20 bp, Artificial
  CRISPR gRNA sequence
gagcatttagataatttatg

SEQ ID NO: 330030 - DNA, 20 bp, Artificial
  CRISPR gRNA sequence
ctcttatttccgggaccacg

SEQ ID NO: 330031 - DNA, 20 bp, Artificial
  CRISPR gRNA sequence
tggtgttttgttcaatctgg

SEQ ID NO: 330032 - DNA, 20 bp, Artificial
  CRISPR gRNA sequence
gaatgactgtatcagtcaat

SEQ ID NO: 330033 - DNA, 20 bp, Artificial
  CRISPR gRNA sequence
aacagactgccttggtactg

SEQ ID NO: 330034 - DNA, 20 bp, Artificial
  CRISPR gRNA sequence
ccagctcctgtgtgctcact

SEQ ID NO: 330035 - DNA, 20 bp, Artificial
  CRISPR gRNA sequence
tcctgtgtgctcactgggag

SEQ ID NO: 330036 - DNA, 20 bp, Artificial
  CRISPR gRNA sequence
aaaaatgttttaaagatgcc

SEQ ID NO: 330037 - DNA, 20 bp, Artificial
  CRISPR gRNA sequence
ttttaaagatgccaggggta

SEQ ID NO: 330038 - DNA, 20 bp, Artificial
  CRISPR gRNA sequence
atactacctcttctttctgt

SEQ ID NO: 330039 - DNA, 20 bp, Artificial
  CRISPR gRNA sequence
cctcttctttctgtagggat

SEQ ID NO: 330040 - DNA, 20 bp, Artificial
  CRISPR gRNA sequence
atatgtatataaaattcata

SEQ ID NO: 330041 - DNA, 20 bp, Artificial
  CRISPR gRNA sequence
tttgcctatattctccctac

SEQ ID NO: 330042 - DNA, 20 bp, Artificial
  CRISPR gRNA sequence
tagtggtaggaaacattgcc

SEQ ID NO: 330043 - DNA, 20 bp, Artificial
  CRISPR gRNA sequence
ttaatgggccagcattctca

SEQ ID NO: 330044 - DNA, 20 bp, Artificial
  CRISPR gRNA sequence
agcattctcatggggtagag

SEQ ID NO: 330045 - DNA, 20 bp, Artificial
  CRISPR gRNA sequence
cctggagcagccctccagac

SEQ ID NO: 330046 - DNA, 20 bp, Artificial
  CRISPR gRNA sequence
agcagccctccagacctggg

SEQ ID NO: 330047 - DNA, 20 bp, Artificial
  CRISPR gRNA sequence
tccagacctgggtggaattc

SEQ ID NO: 330048 - DNA, 20 bp, Artificial
  CRISPR gRNA sequence
ccagaggctgaagtcaccct

SEQ ID NO: 330049 - DNA, 20 bp, Artificial
  CRISPR gRNA sequence
tctacctgcattcataattc

SEQ ID NO: 330050 - DNA, 20 bp, Artificial
  CRISPR gRNA sequence
cccttcaagatagccttctt

SEQ ID NO: 330051 - DNA, 20 bp, Artificial
  CRISPR gRNA sequence
tagaaagattcttaaatatg

SEQ ID NO: 330052 - DNA, 20 bp, Artificial
  CRISPR gRNA sequence
ggaatatgattattcttagc

SEQ ID NO: 330053 - DNA, 20 bp, Artificial
  CRISPR gRNA sequence
atttgtaactttaggtaaac

SEQ ID NO: 330054 - DNA, 20 bp, Artificial
  CRISPR gRNA sequence
tatcttaagcatgtgtaatg

SEQ ID NO: 330055 - DNA, 20 bp, Artificial
  CRISPR gRNA sequence
tacagtactgaacttgtaat

SEQ ID NO: 330056 - DNA, 20 bp, Artificial
  CRISPR gRNA sequence
tggctttgcacaggtgttcc

SEQ ID NO: 330057 - DNA, 20 bp, Artificial
  CRISPR gRNA sequence
tgtttgcaggtttctgtgtg

SEQ ID NO: 330058 - DNA, 20 bp, Artificial
  CRISPR gRNA sequence
gcaggtttctgtgtgtgggg

SEQ ID NO: 330059 - DNA, 20 bp, Artificial
  CRISPR gRNA sequence
ccagcatgggacacctcaag

SEQ ID NO: 330060 - DNA, 20 bp, Artificial
  CRISPR gRNA sequence
ttaacagtagtaagaaggca

SEQ ID NO: 330061 - DNA, 20 bp, Artificial
  CRISPR gRNA sequence
gtgttttcttggggggagca

SEQ ID NO: 330062 - DNA, 20 bp, Artificial
  CRISPR gRNA sequence
cagtgaggtattttcagttg

SEQ ID NO: 330063 - DNA, 20 bp, Artificial
  CRISPR gRNA sequence
ataagtggctcctcttaaaa

SEQ ID NO: 330064 - DNA, 20 bp, Artificial
  CRISPR gRNA sequence
tttgatttcacagaaatttt

SEQ ID NO: 330065 - DNA, 20 bp, Artificial
  CRISPR gRNA sequence
atcttgaggtgtcccatgct

SEQ ID NO: 330066 - DNA, 20 bp, Artificial
  CRISPR gRNA sequence
aggtgtcccatgctggggat

SEQ ID NO: 330067 - DNA, 20 bp, Artificial
  CRISPR gRNA sequence
taagtatgcataatgacata

SEQ ID NO: 330068 - DNA, 20 bp, Artificial
  CRISPR gRNA sequence
gtagagaaaatattccagct

SEQ ID NO: 330069 - DNA, 20 bp, Artificial
  CRISPR gRNA sequence
taatcatattccacatattt

SEQ ID NO: 330070 - DNA, 20 bp, Artificial
  CRISPR gRNA sequence
gctgtgtggtttttatgaga

SEQ ID NO: 330071 - DNA, 20 bp, Artificial
  CRISPR gRNA sequence
tatgtgctcttcacagatcc

SEQ ID NO: 330072 - DNA, 20 bp, Artificial
  CRISPR gRNA sequence
tcttcacagatcctggaatt

SEQ ID NO: 330073 - DNA, 20 bp, Artificial
  CRISPR gRNA sequence
aggtagaccactgtgattcc

SEQ ID NO: 330074 - DNA, 20 bp, Artificial
  CRISPR gRNA sequence
tgacttcagcctctgggagc

SEQ ID NO: 330075 - DNA, 20 bp, Artificial
  CRISPR gRNA sequence
cctagtggcctctggctcag

SEQ ID NO: 330076 - DNA, 20 bp, Artificial
  CRISPR gRNA sequence
tcaggggagtctctcaaccc

SEQ ID NO: 330077 - DNA, 20 bp, Artificial
  CRISPR gRNA sequence
ctgtcaagcccagaggcacc

SEQ ID NO: 330078 - DNA, 20 bp, Artificial
  CRISPR gRNA sequence
aactgcagctttcaggctaa

SEQ ID NO: 330079 - DNA, 20 bp, Artificial
  CRISPR gRNA sequence
aatattctgctctaccccat

SEQ ID NO: 330080 - DNA, 20 bp, Artificial
  CRISPR gRNA sequence
acatagataatggtagaaaa

SEQ ID NO: 330081 - DNA, 20 bp, Artificial
  CRISPR gRNA sequence
aacaaagtaaaccattttaa

SEQ ID NO: 330082 - DNA, 20 bp, Artificial
  CRISPR gRNA sequence
agcaaaaatattcttgtagg

SEQ ID NO: 330083 - DNA, 20 bp, Artificial
  CRISPR gRNA sequence
tataggcaaatatattcatt

SEQ ID NO: 330084 - DNA, 20 bp, Artificial
  CRISPR gRNA sequence
aactattgagcagcagagga

SEQ ID NO: 330085 - DNA, 20 bp, Artificial
  CRISPR gRNA sequence
gtaagacatagctctctatt

SEQ ID NO: 330086 - DNA, 20 bp, Artificial
  CRISPR gRNA sequence
gtcttggtaaaatggtcaac

SEQ ID NO: 330087 - DNA, 20 bp, Artificial
  CRISPR gRNA sequence
ctggggttcagcaattgaag

SEQ ID NO: 330088 - DNA, 20 bp, Artificial
  CRISPR gRNA sequence
tcagcaattgaaggagagta

SEQ ID NO: 330089 - DNA, 20 bp, Artificial
  CRISPR gRNA sequence
ctcccttgactgattaaaag

SEQ ID NO: 330090 - DNA, 20 bp, Artificial
  CRISPR gRNA sequence
ctaggagcagatgtggagac

SEQ ID NO: 330091 - DNA, 20 bp, Artificial
  CRISPR gRNA sequence
ttctccaaagctggttgcaa

SEQ ID NO: 330092 - DNA, 20 bp, Artificial
  CRISPR gRNA sequence
ctccgtggtcccggaaataa

SEQ ID NO: 330093 - DNA, 20 bp, Artificial
  CRISPR gRNA sequence
ctggccaacgtgcttcatgc

SEQ ID NO: 330094 - DNA, 20 bp, Artificial
  CRISPR gRNA sequence
cgtgcttcatgcctgggtgc

SEQ ID NO: 330095 - DNA, 20 bp, Artificial
  CRISPR gRNA sequence
ggtgccagagttccatatta

SEQ ID NO: 330096 - DNA, 20 bp, Artificial
  CRISPR gRNA sequence
gcaggcaaccccaaatcagt

SEQ ID NO: 330097 - DNA, 20 bp, Artificial
  CRISPR gRNA sequence
cagtggttgccatccttcaa

SEQ ID NO: 330098 - DNA, 20 bp, Artificial
  CRISPR gRNA sequence
gccccctcaccccttcttcc

SEQ ID NO: 330099 - DNA, 20 bp, Artificial
  CRISPR gRNA sequence
ttatgtcaggttctgcttgt

SEQ ID NO: 330100 - DNA, 20 bp, Artificial
  CRISPR gRNA sequence
ttaactgtctagggaaccaa

SEQ ID NO: 330101 - DNA, 20 bp, Artificial
  CRISPR gRNA sequence
aaaacatgaaatgtgaactc

SEQ ID NO: 330102 - DNA, 20 bp, Artificial
  CRISPR gRNA sequence
tagataatctgtagccactg

SEQ ID NO: 330103 - DNA, 20 bp, Artificial
  CRISPR gRNA sequence
gaacctcaagggcataagac

SEQ ID NO: 330104 - DNA, 20 bp, Artificial
  CRISPR gRNA sequence
caatggaagcttcaaacttt

SEQ ID NO: 330105 - DNA, 20 bp, Artificial
  CRISPR gRNA sequence
atatatctgtccaaattccc

SEQ ID NO: 330106 - DNA, 20 bp, Artificial
  CRISPR gRNA sequence
tgatgctcaataaacgctca

SEQ ID NO: 330107 - DNA, 20 bp, Artificial
  CRISPR gRNA sequence
aataaacgctcattgaatga

SEQ ID NO: 330108 - DNA, 20 bp, Artificial
  CRISPR gRNA sequence
acccttcaacaaaaaacact

SEQ ID NO: 330109 - DNA, 20 bp, Artificial
  CRISPR gRNA sequence
cagattttcacagaaaattc

SEQ ID NO: 330110 - DNA, 20 bp, Artificial
  CRISPR gRNA sequence
tcccttcccaaacccccaaa

SEQ ID NO: 330111 - DNA, 20 bp, Artificial
  CRISPR gRNA sequence
ccccaaatggagtcatacct

SEQ ID NO: 330112 - DNA, 20 bp, Artificial
  CRISPR gRNA sequence
catgaacatgtattcaccgt

SEQ ID NO: 330113 - DNA, 20 bp, Artificial
  CRISPR gRNA sequence
caccgttagggtcgtgcaca

SEQ ID NO: 330114 - DNA, 20 bp, Artificial
  CRISPR gRNA sequence
gttagggtcgtgcacactgg

SEQ ID NO: 330115 - DNA, 20 bp, Artificial
  CRISPR gRNA sequence
cactggccaatgaccacact

SEQ ID NO: 330116 - DNA, 20 bp, Artificial
  CRISPR gRNA sequence
tgaccacactgtggatatac

SEQ ID NO: 330117 - DNA, 20 bp, Artificial
  CRISPR gRNA sequence
tagcatactcgcgtaatatg

SEQ ID NO: 330118 - DNA, 20 bp, Artificial
  CRISPR gRNA sequence
ctgtaatgcaagagaccaaa

SEQ ID NO: 330119 - DNA, 20 bp, Artificial
  CRISPR gRNA sequence
agtggttttctttaaaagca

SEQ ID NO: 330120 - DNA, 20 bp, Artificial
  CRISPR gRNA sequence
tgccctgcctctcaggaacc

SEQ ID NO: 330121 - DNA, 20 bp, Artificial
  CRISPR gRNA sequence
cataataattttttaaaaat

SEQ ID NO: 330122 - DNA, 20 bp, Artificial
  CRISPR gRNA sequence
ccatcaagtcaagtcctctt

SEQ ID NO: 330123 - DNA, 20 bp, Artificial
  CRISPR gRNA sequence
gtaggtatgtcttgggggga

SEQ ID NO: 330124 - DNA, 20 bp, Artificial
  CRISPR gRNA sequence
caacaaaggctgcacatcct

SEQ ID NO: 330125 - DNA, 20 bp, Artificial
  CRISPR gRNA sequence
ctggcaacaaagttgtgatt

SEQ ID NO: 330126 - DNA, 20 bp, Artificial
  CRISPR gRNA sequence
catcatctcagtattatggc

SEQ ID NO: 330127 - DNA, 20 bp, Artificial
  CRISPR gRNA sequence
aaccaaaccttaaatcttag

SEQ ID NO: 330128 - DNA, 20 bp, Artificial
  CRISPR gRNA sequence
atttctgacttagcagtcta

SEQ ID NO: 330129 - DNA, 20 bp, Artificial
  CRISPR gRNA sequence
tgggattacattgcatattg

SEQ ID NO: 330130 - DNA, 20 bp, Artificial
  CRISPR gRNA sequence
atatgcaaatatcctcctgt

SEQ ID NO: 330131 - DNA, 20 bp, Artificial
  CRISPR gRNA sequence
aagagttactttaaaaggag

SEQ ID NO: 330132 - DNA, 20 bp, Artificial
  CRISPR gRNA sequence
gcagaagtaatagttggcat

SEQ ID NO: 330133 - DNA, 20 bp, Artificial
  CRISPR gRNA sequence
gaaaaaaagagacactgttg

SEQ ID NO: 330134 - DNA, 20 bp, Artificial
  CRISPR gRNA sequence
gacactgttgttggataact

SEQ ID NO: 330135 - DNA, 20 bp, Artificial
  CRISPR gRNA sequence
tgttggataactgagaatgg

SEQ ID NO: 330136 - DNA, 20 bp, Artificial
  CRISPR gRNA sequence
cttttgtcttagtgagatcg

SEQ ID NO: 330137 - DNA, 20 bp, Artificial
  CRISPR gRNA sequence
tttaaattgctggacaatgt

SEQ ID NO: 330138 - DNA, 20 bp, Artificial
  CRISPR gRNA sequence
cagaaacttgcttgtcatat

SEQ ID NO: 330139 - DNA, 20 bp, Artificial
  CRISPR gRNA sequence
ttgcttgtcatatgtgaata

SEQ ID NO: 330140 - DNA, 20 bp, Artificial
  CRISPR gRNA sequence
aatatatttacatagtgtgt

SEQ ID NO: 330141 - DNA, 20 bp, Artificial
  CRISPR gRNA sequence
atattggaggcagatggtaa

SEQ ID NO: 330142 - DNA, 20 bp, Artificial
  CRISPR gRNA sequence
aatgcaacataatttgtgat

SEQ ID NO: 330143 - DNA, 20 bp, Artificial
  CRISPR gRNA sequence
aacataatttgtgataggaa

SEQ ID NO: 330144 - DNA, 20 bp, Artificial
  CRISPR gRNA sequence
tactatttaaatgaaggtgg

SEQ ID NO: 330145 - DNA, 20 bp, Artificial
  CRISPR gRNA sequence
aatgaaggtggtagagtcag

SEQ ID NO: 330146 - DNA, 20 bp, Artificial
  CRISPR gRNA sequence
gtgggttataattttgatta

SEQ ID NO: 330147 - DNA, 20 bp, Artificial
  CRISPR gRNA sequence
gaaaatgccgccttgaggaa

SEQ ID NO: 330148 - DNA, 20 bp, Artificial
  CRISPR gRNA sequence
gaggaagtgagttttaaaat

SEQ ID NO: 330149 - DNA, 20 bp, Artificial
  CRISPR gRNA sequence
gagttttaaaattggaatta

SEQ ID NO: 330150 - DNA, 20 bp, Artificial
  CRISPR gRNA sequence
gtaggtatatcttggggaga

SEQ ID NO: 330151 - DNA, 20 bp, Artificial
  CRISPR gRNA sequence
aagaaccatgtgtacttctg

SEQ ID NO: 330152 - DNA, 20 bp, Artificial
  CRISPR gRNA sequence
aagtacgaagtagtttaaaa

SEQ ID NO: 330153 - DNA, 20 bp, Artificial
  CRISPR gRNA sequence
tacattatgtcctcctgcta

SEQ ID NO: 330154 - DNA, 20 bp, Artificial
  CRISPR gRNA sequence
caaacctcatccactgagaa

SEQ ID NO: 330155 - DNA, 20 bp, Artificial
  CRISPR gRNA sequence
tttcttttcttttcagagaa

SEQ ID NO: 330156 - DNA, 20 bp, Artificial
  CRISPR gRNA sequence
agcctccacttccttgactc

SEQ ID NO: 330157 - DNA, 20 bp, Artificial
  CRISPR gRNA sequence
cctcagcctcccaagaagct

SEQ ID NO: 330158 - DNA, 20 bp, Artificial
  CRISPR gRNA sequence
gcctcagcctcttaaagtgc

SEQ ID NO: 330159 - DNA, 20 bp, Artificial
  CRISPR gRNA sequence
gttgtttttgcaagctacat

SEQ ID NO: 330160 - DNA, 20 bp, Artificial
  CRISPR gRNA sequence
tggcctggtggttgcagatt

SEQ ID NO: 330161 - DNA, 20 bp, Artificial
  CRISPR gRNA sequence
ttaaaactaaaatactaacg

SEQ ID NO: 330162 - DNA, 20 bp, Artificial
  CRISPR gRNA sequence
aaaatactaacgttggatat

SEQ ID NO: 330163 - DNA, 20 bp, Artificial
  CRISPR gRNA sequence
ttgctttctgaaatttgtaa

SEQ ID NO: 330164 - DNA, 20 bp, Artificial
  CRISPR gRNA sequence
tttccctatatatcttcaat

SEQ ID NO: 330165 - DNA, 20 bp, Artificial
  CRISPR gRNA sequence
aaatattattaaaagcatta

SEQ ID NO: 330166 - DNA, 20 bp, Artificial
  CRISPR gRNA sequence
tgtttttatgtctcaactcc

SEQ ID NO: 330167 - DNA, 20 bp, Artificial
  CRISPR gRNA sequence
gtctcaactcccagaatctg

SEQ ID NO: 330168 - DNA, 20 bp, Artificial
  CRISPR gRNA sequence
caactcccagaatctgcaga

SEQ ID NO: 330169 - DNA, 20 bp, Artificial
  CRISPR gRNA sequence
cccaataaattgggacccca

SEQ ID NO: 330170 - DNA, 20 bp, Artificial
  CRISPR gRNA sequence
tggttagaaaacctcaatcc

SEQ ID NO: 330171 - DNA, 20 bp, Artificial
  CRISPR gRNA sequence
caaactcatgatttatatac

SEQ ID NO: 330172 - DNA, 20 bp, Artificial
  CRISPR gRNA sequence
taatttgaaaaagaacctac

SEQ ID NO: 330173 - DNA, 20 bp, Artificial
  CRISPR gRNA sequence
taagtttaatatatattaga

SEQ ID NO: 330174 - DNA, 20 bp, Artificial
  CRISPR gRNA sequence
cagtcacactccacagattc

SEQ ID NO: 330175 - DNA, 20 bp, Artificial
  CRISPR gRNA sequence
caataaaagccctgatacag

SEQ ID NO: 330176 - DNA, 20 bp, Artificial
  CRISPR gRNA sequence
atagaaatagttaatataat

SEQ ID NO: 330177 - DNA, 20 bp, Artificial
  CRISPR gRNA sequence
gttttgtctaaagagggaga

SEQ ID NO: 330178 - DNA, 20 bp, Artificial
  CRISPR gRNA sequence
tctaaagagggagaaagagt

SEQ ID NO: 330179 - DNA, 20 bp, Artificial
  CRISPR gRNA sequence
agttggaatcagaaggaaat

SEQ ID NO: 330180 - DNA, 20 bp, Artificial
  CRISPR gRNA sequence
tcttgacctgtggtgattat

SEQ ID NO: 330181 - DNA, 20 bp, Artificial
  CRISPR gRNA sequence
gtctacattagattaaaacg

SEQ ID NO: 330182 - DNA, 20 bp, Artificial
  CRISPR gRNA sequence
gcagaagataaaatcagtgg

SEQ ID NO: 330183 - DNA, 20 bp, Artificial
  CRISPR gRNA sequence
aaaaaatttcccagagactt

SEQ ID NO: 330184 - DNA, 20 bp, Artificial
  CRISPR gRNA sequence
tgtggcaaacacaagaggac

SEQ ID NO: 330185 - DNA, 20 bp, Artificial
  CRISPR gRNA sequence
tgtggtggaagtgcattgca

SEQ ID NO: 330186 - DNA, 20 bp, Artificial
  CRISPR gRNA sequence
cactagcaaggctctgtggc

SEQ ID NO: 330187 - DNA, 20 bp, Artificial
  CRISPR gRNA sequence
ctgtggctagggtacccctg

SEQ ID NO: 330188 - DNA, 20 bp, Artificial
  CRISPR gRNA sequence
atttctaacacctgctttct

SEQ ID NO: 330189 - DNA, 20 bp, Artificial
  CRISPR gRNA sequence
gctttctctggattcagcat

SEQ ID NO: 330190 - DNA, 20 bp, Artificial
  CRISPR gRNA sequence
agagagctaattctttgctg

SEQ ID NO: 330191 - DNA, 20 bp, Artificial
  CRISPR gRNA sequence
aatgggctattccagaaagt

SEQ ID NO: 330192 - DNA, 20 bp, Artificial
  CRISPR gRNA sequence
aaaagtatttaggtaggacc

SEQ ID NO: 330193 - DNA, 20 bp, Artificial
  CRISPR gRNA sequence
atgccgtgcctcaatttttc

SEQ ID NO: 330194 - DNA, 20 bp, Artificial
  CRISPR gRNA sequence
tttttcttgaatggcatgtt

SEQ ID NO: 330195 - DNA, 20 bp, Artificial
  CRISPR gRNA sequence
ctgacatcagctgaagattt

SEQ ID NO: 330196 - DNA, 20 bp, Artificial
  CRISPR gRNA sequence
tcttttttttttttttgaga

SEQ ID NO: 330197 - DNA, 20 bp, Artificial
  CRISPR gRNA sequence
ttgttctgtcaccagcaggc

SEQ ID NO: 330198 - DNA, 20 bp, Artificial
  CRISPR gRNA sequence
ttttgtatttttagtagaga

SEQ ID NO: 330199 - DNA, 20 bp, Artificial
  CRISPR gRNA sequence
cagggtttcaccgtgttggc

SEQ ID NO: 330200 - DNA, 20 bp, Artificial
  CRISPR gRNA sequence
accttggcctcccaaagtgc

SEQ ID NO: 330201 - DNA, 20 bp, Artificial
  CRISPR gRNA sequence
atctttaacttaaaaactac

SEQ ID NO: 330202 - DNA, 20 bp, Artificial
  CRISPR gRNA sequence
gacagctctaagtctgcagt

SEQ ID NO: 330203 - DNA, 20 bp, Artificial
  CRISPR gRNA sequence
acagatatgcttgctatagc

SEQ ID NO: 330204 - DNA, 20 bp, Artificial
  CRISPR gRNA sequence
aaaattaatccccagtgtaa

SEQ ID NO: 330205 - DNA, 20 bp, Artificial
  CRISPR gRNA sequence
agatgattggcagaaccccc

SEQ ID NO: 330206 - DNA, 20 bp, Artificial
  CRISPR gRNA sequence
tgaatagcttaatccaattc

SEQ ID NO: 330207 - DNA, 20 bp, Artificial
  CRISPR gRNA sequence
ttaatccaattcatgggtta

SEQ ID NO: 330208 - DNA, 20 bp, Artificial
  CRISPR gRNA sequence
acagattaataggttatcac

SEQ ID NO: 330209 - DNA, 20 bp, Artificial
  CRISPR gRNA sequence
attaataggttatcacagga

SEQ ID NO: 330210 - DNA, 20 bp, Artificial
  CRISPR gRNA sequence
aggagtgggttaattatcat

SEQ ID NO: 330211 - DNA, 20 bp, Artificial
  CRISPR gRNA sequence
tgtactgccttgggcctctg

SEQ ID NO: 330212 - DNA, 20 bp, Artificial
  CRISPR gRNA sequence
aaccatgactaaagcattta

SEQ ID NO: 330213 - DNA, 20 bp, Artificial
  CRISPR gRNA sequence
atagacaatttaaggaagat

SEQ ID NO: 330214 - DNA, 20 bp, Artificial
  CRISPR gRNA sequence
cttataactgcaaaagcatc

SEQ ID NO: 330215 - DNA, 20 bp, Artificial
  CRISPR gRNA sequence
ggatcttttctccatccttc

SEQ ID NO: 330216 - DNA, 20 bp, Artificial
  CRISPR gRNA sequence
tccaagtctaatactcagcc

SEQ ID NO: 330217 - DNA, 20 bp, Artificial
  CRISPR gRNA sequence
gcccgaggtcacacagcttc

SEQ ID NO: 330218 - DNA, 20 bp, Artificial
  CRISPR gRNA sequence
tagacagtggtcactaacaa

SEQ ID NO: 330219 - DNA, 20 bp, Artificial
  CRISPR gRNA sequence
cacctctgttttatgtccaa

SEQ ID NO: 330220 - DNA, 20 bp, Artificial
  CRISPR gRNA sequence
tccattctccacagagaaac

SEQ ID NO: 330221 - DNA, 20 bp, Artificial
  CRISPR gRNA sequence
ttcttacatgcataatccaa

SEQ ID NO: 330222 - DNA, 20 bp, Artificial
  CRISPR gRNA sequence
ctgcttctttgtcatcgttc

SEQ ID NO: 330223 - DNA, 20 bp, Artificial
  CRISPR gRNA sequence
accactggccacccaatcta

SEQ ID NO: 330224 - DNA, 20 bp, Artificial
  CRISPR gRNA sequence
taagctgcaatcagtattta

SEQ ID NO: 330225 - DNA, 20 bp, Artificial
  CRISPR gRNA sequence
ctgcaatcagtatttattgg

SEQ ID NO: 330226 - DNA, 20 bp, Artificial
  CRISPR gRNA sequence
ttggatggatgaaagcatgg

SEQ ID NO: 330227 - DNA, 20 bp, Artificial
  CRISPR gRNA sequence
atggttggatgggcgaacaa

SEQ ID NO: 330228 - DNA, 20 bp, Artificial
  CRISPR gRNA sequence
aaatctgaggagatgaagca

SEQ ID NO: 330229 - DNA, 20 bp, Artificial
  CRISPR gRNA sequence
gaaaaggtgactatcttgcc

SEQ ID NO: 330230 - DNA, 20 bp, Artificial
  CRISPR gRNA sequence
tcatagctggggcatgatcc

SEQ ID NO: 330231 - DNA, 20 bp, Artificial
  CRISPR gRNA sequence
tctttaccttcaaatatcca

SEQ ID NO: 330232 - DNA, 20 bp, Artificial
  CRISPR gRNA sequence
caacaaacctggttgctcac

SEQ ID NO: 330233 - DNA, 20 bp, Artificial
  CRISPR gRNA sequence
atgttactaaaatcacaaaa

SEQ ID NO: 330234 - DNA, 20 bp, Artificial
  CRISPR gRNA sequence
acaaaaaggaatatgtggtc

SEQ ID NO: 330235 - DNA, 20 bp, Artificial
  CRISPR gRNA sequence
tgtggtcttggatcctggtg

SEQ ID NO: 330236 - DNA, 20 bp, Artificial
  CRISPR gRNA sequence
ctggtgatgagtcttaaaat

SEQ ID NO: 330237 - DNA, 20 bp, Artificial
  CRISPR gRNA sequence
actatattttcttcatcaca

SEQ ID NO: 330238 - DNA, 20 bp, Artificial
  CRISPR gRNA sequence
actttgggaggccgaggcag

SEQ ID NO: 330239 - DNA, 20 bp, Artificial
  CRISPR gRNA sequence
tactcaggaggctgaggcag

SEQ ID NO: 330240 - DNA, 20 bp, Artificial
  CRISPR gRNA sequence
caggagaatcgcttgaacca

SEQ ID NO: 330241 - DNA, 20 bp, Artificial
  CRISPR gRNA sequence
atcaatagactaatgttttc

SEQ ID NO: 330242 - DNA, 20 bp, Artificial
  CRISPR gRNA sequence
gaagaaaaggtcattcacct

SEQ ID NO: 330243 - DNA, 20 bp, Artificial
  CRISPR gRNA sequence
agaattgcactatagtgcag

SEQ ID NO: 330244 - DNA, 20 bp, Artificial
  CRISPR gRNA sequence
acaaacctccacaaaggtct

SEQ ID NO: 330245 - DNA, 20 bp, Artificial
  CRISPR gRNA sequence
tgatggaaagataagatgtc

SEQ ID NO: 330246 - DNA, 20 bp, Artificial
  CRISPR gRNA sequence
gtgttagcttagcacagcac

SEQ ID NO: 330247 - DNA, 20 bp, Artificial
  CRISPR gRNA sequence
taaaagcaatgtcatgtctt

SEQ ID NO: 330248 - DNA, 20 bp, Artificial
  CRISPR gRNA sequence
attgaggcaaggaagggagg

SEQ ID NO: 330249 - DNA, 20 bp, Artificial
  CRISPR gRNA sequence
aagtgaggagaaaaagccaa

SEQ ID NO: 330250 - DNA, 20 bp, Artificial
  CRISPR gRNA sequence
actctccaaggaactccata

SEQ ID NO: 330251 - DNA, 20 bp, Artificial
  CRISPR gRNA sequence
atgaacccaactctcttcca

SEQ ID NO: 330252 - DNA, 20 bp, Artificial
  CRISPR gRNA sequence
tccacagagtgggagggaga

SEQ ID NO: 330253 - DNA, 20 bp, Artificial
  CRISPR gRNA sequence
agaggattttatccacacct

SEQ ID NO: 330254 - DNA, 20 bp, Artificial
  CRISPR gRNA sequence
aaactccttgggcacatgga

SEQ ID NO: 330255 - DNA, 20 bp, Artificial
  CRISPR gRNA sequence
atcactaaggacacatttct

SEQ ID NO: 330256 - DNA, 20 bp, Artificial
  CRISPR gRNA sequence
atccaaaccctgtcttttca

SEQ ID NO: 330257 - DNA, 20 bp, Artificial
  CRISPR gRNA sequence
tagtctgaccctaggaacct

SEQ ID NO: 330258 - DNA, 20 bp, Artificial
  CRISPR gRNA sequence
agtccagttgactccagctc

SEQ ID NO: 330259 - DNA, 20 bp, Artificial
  CRISPR gRNA sequence
acacttctgttctttactac

SEQ ID NO: 330260 - DNA, 20 bp, Artificial
  CRISPR gRNA sequence
atattttagcacatagcatc

SEQ ID NO: 330261 - DNA, 20 bp, Artificial
  CRISPR gRNA sequence
agctcaatcatattaaataa

SEQ ID NO: 330262 - DNA, 20 bp, Artificial
  CRISPR gRNA sequence
aaaagaattaatattaacag

SEQ ID NO: 330263 - DNA, 20 bp, Artificial
  CRISPR gRNA sequence
ctttgtaatgggccaagaag

SEQ ID NO: 330264 - DNA, 20 bp, Artificial
  CRISPR gRNA sequence
gtttccgactttatctggag

SEQ ID NO: 330265 - DNA, 20 bp, Artificial
  CRISPR gRNA sequence
agccaaacggagcaaaatac

SEQ ID NO: 330266 - DNA, 20 bp, Artificial
  CRISPR gRNA sequence
agaaaggctctgggagctca

SEQ ID NO: 330267 - DNA, 20 bp, Artificial
  CRISPR gRNA sequence
ccattcttgccaggcaccac

SEQ ID NO: 330268 - DNA, 20 bp, Artificial
  CRISPR gRNA sequence
gcaccacagggatccatctg

SEQ ID NO: 330269 - DNA, 20 bp, Artificial
  CRISPR gRNA sequence
ctggagggtggccagaggag

SEQ ID NO: 330270 - DNA, 20 bp, Artificial
  CRISPR gRNA sequence
tataaaactccacagggaga

SEQ ID NO: 330271 - DNA, 20 bp, Artificial
  CRISPR gRNA sequence
gcctgaactggggggaggcc

SEQ ID NO: 330272 - DNA, 20 bp, Artificial
  CRISPR gRNA sequence
gcggttagaggaggcatgat

SEQ ID NO: 330273 - DNA, 20 bp, Artificial
  CRISPR gRNA sequence
gaccagcccttccgtttgca

SEQ ID NO: 330274 - DNA, 20 bp, Artificial
  CRISPR gRNA sequence
cccttccgtttgcatgggat

SEQ ID NO: 330275 - DNA, 20 bp, Artificial
  CRISPR gRNA sequence
gtacacaactccagtgacct

SEQ ID NO: 330276 - DNA, 20 bp, Artificial
  CRISPR gRNA sequence
cacagcaagacctgcccaag

SEQ ID NO: 330277 - DNA, 20 bp, Artificial
  CRISPR gRNA sequence
cacaaagggcatataatcct

SEQ ID NO: 330278 - DNA, 20 bp, Artificial
  CRISPR gRNA sequence
accaaagctaaaggccctca

SEQ ID NO: 330279 - DNA, 20 bp, Artificial
  CRISPR gRNA sequence
ccatagatggttcacatcac

SEQ ID NO: 330280 - DNA, 20 bp, Artificial
  CRISPR gRNA sequence
cccccaataccagcccagag

SEQ ID NO: 330281 - DNA, 20 bp, Artificial
  CRISPR gRNA sequence
cccagagccgggtagatttg

SEQ ID NO: 330282 - DNA, 20 bp, Artificial
  CRISPR gRNA sequence
atcacactagttcaccagca

SEQ ID NO: 330283 - DNA, 20 bp, Artificial
  CRISPR gRNA sequence
aattcttcatctacctgaaa

SEQ ID NO: 330284 - DNA, 20 bp, Artificial
  CRISPR gRNA sequence
gctctggaaagtctcagcaa

SEQ ID NO: 330285 - DNA, 20 bp, Artificial
  CRISPR gRNA sequence
agagcttgaagacaaggtct

SEQ ID NO: 330286 - DNA, 20 bp, Artificial
  CRISPR gRNA sequence
tccaacaaaaacaaagaaaa

SEQ ID NO: 330287 - DNA, 20 bp, Artificial
  CRISPR gRNA sequence
agaataagataatttgacac

SEQ ID NO: 330288 - DNA, 20 bp, Artificial
  CRISPR gRNA sequence
acattaagctagatatgaaa

SEQ ID NO: 330289 - DNA, 20 bp, Artificial
  CRISPR gRNA sequence
ttattttccttctaggtata

SEQ ID NO: 330290 - DNA, 20 bp, Artificial
  CRISPR gRNA sequence
catatgtgttctgtgattga

SEQ ID NO: 330291 - DNA, 20 bp, Artificial
  CRISPR gRNA sequence
aagctgggctgtcattgtac

SEQ ID NO: 330292 - DNA, 20 bp, Artificial
  CRISPR gRNA sequence
gcctgtagaaatgtacagaa

SEQ ID NO: 330293 - DNA, 20 bp, Artificial
  CRISPR gRNA sequence
aagtaaacagaactttaact

SEQ ID NO: 330294 - DNA, 20 bp, Artificial
  CRISPR gRNA sequence
ctaacaacactcgtggtcaa

SEQ ID NO: 330295 - DNA, 20 bp, Artificial
  CRISPR gRNA sequence
ccactttccaaaatataatt

SEQ ID NO: 330296 - DNA, 20 bp, Artificial
  CRISPR gRNA sequence
aatgccatgtttttttcact

SEQ ID NO: 330297 - DNA, 20 bp, Artificial
  CRISPR gRNA sequence
catataaaactcaatattct

SEQ ID NO: 330298 - DNA, 20 bp, Artificial
  CRISPR gRNA sequence
agattttgctgtttacaact

SEQ ID NO: 330299 - DNA, 20 bp, Artificial
  CRISPR gRNA sequence
ctgtttacaactgtgaatac

SEQ ID NO: 330300 - DNA, 20 bp, Artificial
  CRISPR gRNA sequence
ttacaactgtgaatactggg

SEQ ID NO: 330301 - DNA, 20 bp, Artificial
  CRISPR gRNA sequence
tttttaagccaaataatgct

SEQ ID NO: 330302 - DNA, 20 bp, Artificial
  CRISPR gRNA sequence
ataatgctatgaatcttaca

SEQ ID NO: 330303 - DNA, 20 bp, Artificial
  CRISPR gRNA sequence
atcttacagtgagtaaatat

SEQ ID NO: 330304 - DNA, 20 bp, Artificial
  CRISPR gRNA sequence
ttttgtttctaccaagaaat

SEQ ID NO: 330305 - DNA, 20 bp, Artificial
  CRISPR gRNA sequence
gaaatatccatttcatctga

SEQ ID NO: 330306 - DNA, 20 bp, Artificial
  CRISPR gRNA sequence
agggactcaagatcttacat

SEQ ID NO: 330307 - DNA, 20 bp, Artificial
  CRISPR gRNA sequence
gaataagagacatttctaga

SEQ ID NO: 330308 - DNA, 20 bp, Artificial
  CRISPR gRNA sequence
ggaaaaaaatgactgaaatg

SEQ ID NO: 330309 - DNA, 20 bp, Artificial
  CRISPR gRNA sequence
actgaaatgaagaataaagc

SEQ ID NO: 330310 - DNA, 20 bp, Artificial
  CRISPR gRNA sequence
ggaggcggaggcggaggtgg

SEQ ID NO: 330311 - DNA, 20 bp, Artificial
  CRISPR gRNA sequence
aaaattagccaggcgtggtg

SEQ ID NO: 330312 - DNA, 20 bp, Artificial
  CRISPR gRNA sequence
tacttgggaggctgaggcag

SEQ ID NO: 330313 - DNA, 20 bp, Artificial
  CRISPR gRNA sequence
ctgcactccagcctgggcga

SEQ ID NO: 330314 - DNA, 20 bp, Artificial
  CRISPR gRNA sequence
cagaaagagaaacagaggga

SEQ ID NO: 330315 - DNA, 20 bp, Artificial
  CRISPR gRNA sequence
gagagttacacatatcctgg

SEQ ID NO: 330316 - DNA, 20 bp, Artificial
  CRISPR gRNA sequence
cacatatcctggaggaattc

SEQ ID NO: 330317 - DNA, 20 bp, Artificial
  CRISPR gRNA sequence
ctttcaagattatgaaattc

SEQ ID NO: 330318 - DNA, 20 bp, Artificial
  CRISPR gRNA sequence
agttttttttttttttacaa

SEQ ID NO: 330319 - DNA, 20 bp, Artificial
  CRISPR gRNA sequence
ttttttttttacaaaggaat

SEQ ID NO: 330320 - DNA, 20 bp, Artificial
  CRISPR gRNA sequence
tagaagccagcagacagtgg

SEQ ID NO: 330321 - DNA, 20 bp, Artificial
  CRISPR gRNA sequence
gaagacacccttacctgtac

SEQ ID NO: 330322 - DNA, 20 bp, Artificial
  CRISPR gRNA sequence
cttacctgtactggaattca

SEQ ID NO: 330323 - DNA, 20 bp, Artificial
  CRISPR gRNA sequence
gtactggaattcagagagtt

SEQ ID NO: 330324 - DNA, 20 bp, Artificial
  CRISPR gRNA sequence
acaagacaggagcagatgtc

SEQ ID NO: 330325 - DNA, 20 bp, Artificial
  CRISPR gRNA sequence
atgtgatgtaagtgttaaga

SEQ ID NO: 330326 - DNA, 20 bp, Artificial
  CRISPR gRNA sequence
cacaaaacccacgtatggag

SEQ ID NO: 330327 - DNA, 20 bp, Artificial
  CRISPR gRNA sequence
gcactgtctgggggaagtgt

SEQ ID NO: 330328 - DNA, 20 bp, Artificial
  CRISPR gRNA sequence
taagttctcatatcagtgca

SEQ ID NO: 330329 - DNA, 20 bp, Artificial
  CRISPR gRNA sequence
aattaaccggaggcaaagag

SEQ ID NO: 330330 - DNA, 20 bp, Artificial
  CRISPR gRNA sequence
acaaaaataaaagagaaaaa

SEQ ID NO: 330331 - DNA, 20 bp, Artificial
  CRISPR gRNA sequence
agtagaggcttatgctgact

SEQ ID NO: 330332 - DNA, 20 bp, Artificial
  CRISPR gRNA sequence
ttatgctgactgggaatggc

SEQ ID NO: 330333 - DNA, 20 bp, Artificial
  CRISPR gRNA sequence
caaaagaaaaaattgacaac

SEQ ID NO: 330334 - DNA, 20 bp, Artificial
  CRISPR gRNA sequence
ctaacaagaacactctggaa

SEQ ID NO: 330335 - DNA, 20 bp, Artificial
  CRISPR gRNA sequence
tgaggggctcttttcccaag

SEQ ID NO: 330336 - DNA, 20 bp, Artificial
  CRISPR gRNA sequence
tcttttcccaagtggaattc

SEQ ID NO: 330337 - DNA, 20 bp, Artificial
  CRISPR gRNA sequence
tggaattcaggagtcactaa

SEQ ID NO: 330338 - DNA, 20 bp, Artificial
  CRISPR gRNA sequence
taaagtagtctttctaaaac

SEQ ID NO: 330339 - DNA, 20 bp, Artificial
  CRISPR gRNA sequence
ttgcctataaggtctacaaa

SEQ ID NO: 330340 - DNA, 20 bp, Artificial
  CRISPR gRNA sequence
aaccaaataacaaaggtgat

SEQ ID NO: 330341 - DNA, 20 bp, Artificial
  CRISPR gRNA sequence
ctacttcaacacagtttaga

SEQ ID NO: 330342 - DNA, 20 bp, Artificial
  CRISPR gRNA sequence
tttagaaagaatgtagatgt

SEQ ID NO: 330343 - DNA, 20 bp, Artificial
  CRISPR gRNA sequence
tgtagatgttggagtcacat

SEQ ID NO: 330344 - DNA, 20 bp, Artificial
  CRISPR gRNA sequence
ttcaaacactgactaaaggt

SEQ ID NO: 330345 - DNA, 20 bp, Artificial
  CRISPR gRNA sequence
agaaagcctatgtaaattgg

SEQ ID NO: 330346 - DNA, 20 bp, Artificial
  CRISPR gRNA sequence
caagcaagtacttagtttac

SEQ ID NO: 330347 - DNA, 20 bp, Artificial
  CRISPR gRNA sequence
gagcttttacatggcagttt

SEQ ID NO: 330348 - DNA, 20 bp, Artificial
  CRISPR gRNA sequence
cattgtggagatattttaaa

SEQ ID NO: 330349 - DNA, 20 bp, Artificial
  CRISPR gRNA sequence
ctcatggctttctttataat

SEQ ID NO: 330350 - DNA, 20 bp, Artificial
  CRISPR gRNA sequence
gaacattggttgtattcatt

SEQ ID NO: 330351 - DNA, 20 bp, Artificial
  CRISPR gRNA sequence
gtattcatttagaatctacg

SEQ ID NO: 330352 - DNA, 20 bp, Artificial
  CRISPR gRNA sequence
atctacgatgaatattgttc

SEQ ID NO: 330353 - DNA, 20 bp, Artificial
  CRISPR gRNA sequence
taaaacaatcctacctaagg

SEQ ID NO: 330354 - DNA, 20 bp, Artificial
  CRISPR gRNA sequence
aggctggatctcaccttcca

SEQ ID NO: 330355 - DNA, 20 bp, Artificial
  CRISPR gRNA sequence
cccaaattggtttggcctag

SEQ ID NO: 330356 - DNA, 20 bp, Artificial
  CRISPR gRNA sequence
caatacaaacaaacccttcc

SEQ ID NO: 330357 - DNA, 20 bp, Artificial
  CRISPR gRNA sequence
aatggtaccaacgttcttgg

SEQ ID NO: 330358 - DNA, 20 bp, Artificial
  CRISPR gRNA sequence
tggaacatagactatatggt

SEQ ID NO: 330359 - DNA, 20 bp, Artificial
  CRISPR gRNA sequence
tgttacattccctcatataa

SEQ ID NO: 330360 - DNA, 20 bp, Artificial
  CRISPR gRNA sequence
ctgtaattatcattaatcaa

SEQ ID NO: 330361 - DNA, 20 bp, Artificial
  CRISPR gRNA sequence
gcagttaccttccaaagaac

SEQ ID NO: 330362 - DNA, 20 bp, Artificial
  CRISPR gRNA sequence
aggcaggtgctcaatgctac

SEQ ID NO: 330363 - DNA, 20 bp, Artificial
  CRISPR gRNA sequence
gctcaatgctacatgagtaa

SEQ ID NO: 330364 - DNA, 20 bp, Artificial
  CRISPR gRNA sequence
aatgctacatgagtaaatgg

SEQ ID NO: 330365 - DNA, 20 bp, Artificial
  CRISPR gRNA sequence
catgagtaaatggatgaatg

SEQ ID NO: 330366 - DNA, 20 bp, Artificial
  CRISPR gRNA sequence
agtaaatggatgaatgaaga

SEQ ID NO: 330367 - DNA, 20 bp, Artificial
  CRISPR gRNA sequence
tgaaaaaatgtatccctaga

SEQ ID NO: 330368 - DNA, 20 bp, Artificial
  CRISPR gRNA sequence
actttccttttttcaacctc

SEQ ID NO: 330369 - DNA, 20 bp, Artificial
  CRISPR gRNA sequence
cattatttaaattgtccata

SEQ ID NO: 330370 - DNA, 20 bp, Artificial
  CRISPR gRNA sequence
gctatatgccattcaagaga

SEQ ID NO: 330371 - DNA, 20 bp, Artificial
  CRISPR gRNA sequence
agagaaggaatcagggactc

SEQ ID NO: 330372 - DNA, 20 bp, Artificial
  CRISPR gRNA sequence
tcctttcctccttggctttt

SEQ ID NO: 330373 - DNA, 20 bp, Artificial
  CRISPR gRNA sequence
ctgaaatgtccagggcacca

SEQ ID NO: 330374 - DNA, 20 bp, Artificial
  CRISPR gRNA sequence
aaaaaagatcattctggagt

SEQ ID NO: 330375 - DNA, 20 bp, Artificial
  CRISPR gRNA sequence
catacaatgtaagttaatac

SEQ ID NO: 330376 - DNA, 20 bp, Artificial
  CRISPR gRNA sequence
taagttaatacacgtgtttc

SEQ ID NO: 330377 - DNA, 20 bp, Artificial
  CRISPR gRNA sequence
ctgtatataatttgtactac

SEQ ID NO: 330378 - DNA, 20 bp, Artificial
  CRISPR gRNA sequence
aaaatgaaatcaaattgatc

SEQ ID NO: 330379 - DNA, 20 bp, Artificial
  CRISPR gRNA sequence
aagtgagttaagtgcagtta

SEQ ID NO: 330380 - DNA, 20 bp, Artificial
  CRISPR gRNA sequence
gaatgtagaatgagcacaag

SEQ ID NO: 330381 - DNA, 20 bp, Artificial
  CRISPR gRNA sequence
aggacagttttgggctactt

SEQ ID NO: 330382 - DNA, 20 bp, Artificial
  CRISPR gRNA sequence
ttagcggcatgaatgacatg

SEQ ID NO: 330383 - DNA, 20 bp, Artificial
  CRISPR gRNA sequence
atatattaatcaaataatcc

SEQ ID NO: 330384 - DNA, 20 bp, Artificial
  CRISPR gRNA sequence
ttatatgagggaatgtaaca

SEQ ID NO: 330385 - DNA, 20 bp, Artificial
  CRISPR gRNA sequence
ctgtgcaagtggcacttgag

SEQ ID NO: 330386 - DNA, 20 bp, Artificial
  CRISPR gRNA sequence
gagcacaaagagggaagagg

SEQ ID NO: 330387 - DNA, 20 bp, Artificial
  CRISPR gRNA sequence
tcagaccatatagtctatgt

SEQ ID NO: 330388 - DNA, 20 bp, Artificial
  CRISPR gRNA sequence
aacgttggtaccattcgtgg

SEQ ID NO: 330389 - DNA, 20 bp, Artificial
  CRISPR gRNA sequence
ttggtaccattcgtggaagg

SEQ ID NO: 330390 - DNA, 20 bp, Artificial
  CRISPR gRNA sequence
aaggtgagatccagccttag

SEQ ID NO: 330391 - DNA, 20 bp, Artificial
  CRISPR gRNA sequence
tgagatccagccttaggtag

SEQ ID NO: 330392 - DNA, 20 bp, Artificial
  CRISPR gRNA sequence
cagccttaggtaggattgtt

SEQ ID NO: 330393 - DNA, 20 bp, Artificial
  CRISPR gRNA sequence
aggtaggattgttttaagtt

SEQ ID NO: 330394 - DNA, 20 bp, Artificial
  CRISPR gRNA sequence
tattctggaacaatattcat

SEQ ID NO: 330395 - DNA, 20 bp, Artificial
  CRISPR gRNA sequence
gaaagccatgagatgtggca

SEQ ID NO: 330396 - DNA, 20 bp, Artificial
  CRISPR gRNA sequence
caaactcaagtaaactaagt

SEQ ID NO: 330397 - DNA, 20 bp, Artificial
  CRISPR gRNA sequence
tttcaatcctcccaatttac

SEQ ID NO: 330398 - DNA, 20 bp, Artificial
  CRISPR gRNA sequence
taggcattcttacctttagt

SEQ ID NO: 330399 - DNA, 20 bp, Artificial
  CRISPR gRNA sequence
atttccaaccaggaaaggtt

SEQ ID NO: 330400 - DNA, 20 bp, Artificial
  CRISPR gRNA sequence
atctaaaggaacgtaaatct

SEQ ID NO: 330401 - DNA, 20 bp, Artificial
  CRISPR gRNA sequence
attaagaaggatgggaatct

SEQ ID NO: 330402 - DNA, 20 bp, Artificial
  CRISPR gRNA sequence
caatgtagaatttaacaaag

SEQ ID NO: 330403 - DNA, 20 bp, Artificial
  CRISPR gRNA sequence
atatgagtgatgggacaaat

SEQ ID NO: 330404 - DNA, 20 bp, Artificial
  CRISPR gRNA sequence
aaaagcagtgtggataatac

SEQ ID NO: 330405 - DNA, 20 bp, Artificial
  CRISPR gRNA sequence
cccccttccagagtgttctt

SEQ ID NO: 330406 - DNA, 20 bp, Artificial
  CRISPR gRNA sequence
cccagtcagcataagcctct

SEQ ID NO: 330407 - DNA, 20 bp, Artificial
  CRISPR gRNA sequence
gcctctacttgattttattt

SEQ ID NO: 330408 - DNA, 20 bp, Artificial
  CRISPR gRNA sequence
agaatcttaattgaatgtct

SEQ ID NO: 330409 - DNA, 20 bp, Artificial
  CRISPR gRNA sequence
cagtgcaccctgctccatac

SEQ ID NO: 330410 - DNA, 20 bp, Artificial
  CRISPR gRNA sequence
cttacagttgcagatcattg

SEQ ID NO: 330411 - DNA, 20 bp, Artificial
  CRISPR gRNA sequence
ttcctcttacagtatttctc

SEQ ID NO: 330412 - DNA, 20 bp, Artificial
  CRISPR gRNA sequence
cagatattcctccactgtct

SEQ ID NO: 330413 - DNA, 20 bp, Artificial
  CRISPR gRNA sequence
ggcttctagggttgtgggtg

SEQ ID NO: 330414 - DNA, 20 bp, Artificial
  CRISPR gRNA sequence
ggatatgtgtaactctctcc

SEQ ID NO: 330415 - DNA, 20 bp, Artificial
  CRISPR gRNA sequence
ctccctctgtttctctttct

SEQ ID NO: 330416 - DNA, 20 bp, Artificial
  CRISPR gRNA sequence
ctggagtgcagtggcgcaat

SEQ ID NO: 330417 - DNA, 20 bp, Artificial
  CRISPR gRNA sequence
aacctccacctcccgggttg

SEQ ID NO: 330418 - DNA, 20 bp, Artificial
  CRISPR gRNA sequence
ttttgtatttttcgtagaga

SEQ ID NO: 330419 - DNA, 20 bp, Artificial
  CRISPR gRNA sequence
cgcctccgcctcccaaagtg

SEQ ID NO: 330420 - DNA, 20 bp, Artificial
  CRISPR gRNA sequence
tattttttttaagactgggt

SEQ ID NO: 330421 - DNA, 20 bp, Artificial
  CRISPR gRNA sequence
aaagttttcaatctctagac

SEQ ID NO: 330422 - DNA, 20 bp, Artificial
  CRISPR gRNA sequence
tcagtcatttttttcctagt

SEQ ID NO: 330423 - DNA, 20 bp, Artificial
  CRISPR gRNA sequence
atttgtttaatcatacctta

SEQ ID NO: 330424 - DNA, 20 bp, Artificial
  CRISPR gRNA sequence
ttttcatcatttgtgaacaa

SEQ ID NO: 330425 - DNA, 20 bp, Artificial
  CRISPR gRNA sequence
aaatggctttcacaacttgc

SEQ ID NO: 330426 - DNA, 20 bp, Artificial
  CRISPR gRNA sequence
ccttcagatgaaatggatat

SEQ ID NO: 330427 - DNA, 20 bp, Artificial
  CRISPR gRNA sequence
aattcttatatttactcact

SEQ ID NO: 330428 - DNA, 20 bp, Artificial
  CRISPR gRNA sequence
ctgtaagattcatagcatta

SEQ ID NO: 330429 - DNA, 20 bp, Artificial
  CRISPR gRNA sequence
acagcaaaatctacaacata

SEQ ID NO: 330430 - DNA, 20 bp, Artificial
  CRISPR gRNA sequence
gcttccctactctaagaata

SEQ ID NO: 330431 - DNA, 20 bp, Artificial
  CRISPR gRNA sequence
tttatatgcaaaatgactta

SEQ ID NO: 330432 - DNA, 20 bp, Artificial
  CRISPR gRNA sequence
ggctttgcaaatttttaaaa

SEQ ID NO: 330433 - DNA, 20 bp, Artificial
  CRISPR gRNA sequence
aaatgagttttaaaatcatt

SEQ ID NO: 330434 - DNA, 20 bp, Artificial
  CRISPR gRNA sequence
aattgaaagtgttagtcaag

SEQ ID NO: 330435 - DNA, 20 bp, Artificial
  CRISPR gRNA sequence
aagaaatgattttttttttc

SEQ ID NO: 330436 - DNA, 20 bp, Artificial
  CRISPR gRNA sequence
gtaaggttgaccaaaacagg

SEQ ID NO: 330437 - DNA, 20 bp, Artificial
  CRISPR gRNA sequence
accaaaacaggtaaagattt

SEQ ID NO: 330438 - DNA, 20 bp, Artificial
  CRISPR gRNA sequence
ctggttcatgtataacataa

SEQ ID NO: 330439 - DNA, 20 bp, Artificial
  CRISPR gRNA sequence
cataatgatgcttgtatcta

SEQ ID NO: 330440 - DNA, 20 bp, Artificial
  CRISPR gRNA sequence
cccaaatagggtgatagacc

SEQ ID NO: 330441 - DNA, 20 bp, Artificial
  CRISPR gRNA sequence
tgaccacgagtgttgttagg

SEQ ID NO: 330442 - DNA, 20 bp, Artificial
  CRISPR gRNA sequence
taacttttttgaatttgata

SEQ ID NO: 330443 - DNA, 20 bp, Artificial
  CRISPR gRNA sequence
tactgcactcacagttaaag

SEQ ID NO: 330444 - DNA, 20 bp, Artificial
  CRISPR gRNA sequence
gaacccaggtacaatgacag

SEQ ID NO: 330445 - DNA, 20 bp, Artificial
  CRISPR gRNA sequence
acctgaaattcattttcata

SEQ ID NO: 330446 - DNA, 20 bp, Artificial
  CRISPR gRNA sequence
ttcatatctagcttaatgtt

SEQ ID NO: 330447 - DNA, 20 bp, Artificial
  CRISPR gRNA sequence
gcttaatgttaaaagcttct

SEQ ID NO: 330448 - DNA, 20 bp, Artificial
  CRISPR gRNA sequence
gtagcaaatctctttagctc

SEQ ID NO: 330449 - DNA, 20 bp, Artificial
  CRISPR gRNA sequence
aatctctttagctctgatgc

SEQ ID NO: 330450 - DNA, 20 bp, Artificial
  CRISPR gRNA sequence
gctttagtttctgtacaatg

SEQ ID NO: 330451 - DNA, 20 bp, Artificial
  CRISPR gRNA sequence
ctgtacaatgagaggattgg

SEQ ID NO: 330452 - DNA, 20 bp, Artificial
  CRISPR gRNA sequence
ttggactagattattaggtg

SEQ ID NO: 330453 - DNA, 20 bp, Artificial
  CRISPR gRNA sequence
aaattatcttattctttttt

SEQ ID NO: 330454 - DNA, 20 bp, Artificial
  CRISPR gRNA sequence
cacctttctaaaattgtgtc

SEQ ID NO: 330455 - DNA, 20 bp, Artificial
  CRISPR gRNA sequence
ccaaagtttcctgaaatttt

SEQ ID NO: 330456 - DNA, 20 bp, Artificial
  CRISPR gRNA sequence
attttttgcatttccttgca

SEQ ID NO: 330457 - DNA, 20 bp, Artificial
  CRISPR gRNA sequence
ttcacctttctctggtccct

SEQ ID NO: 330458 - DNA, 20 bp, Artificial
  CRISPR gRNA sequence
ctttctctggtccctccccg

SEQ ID NO: 330459 - DNA, 20 bp, Artificial
  CRISPR gRNA sequence
aggtagatgaagaatttctt

SEQ ID NO: 330460 - DNA, 20 bp, Artificial
  CRISPR gRNA sequence
gatccattgctggtgaacta

SEQ ID NO: 330461 - DNA, 20 bp, Artificial
  CRISPR gRNA sequence
tttttgggggtgttgaagag

SEQ ID NO: 330462 - DNA, 20 bp, Artificial
  CRISPR gRNA sequence
tgttttgtcatattaccaga

SEQ ID NO: 330463 - DNA, 20 bp, Artificial
  CRISPR gRNA sequence
tctagggctgaaggctgttc

SEQ ID NO: 330464 - DNA, 20 bp, Artificial
  CRISPR gRNA sequence
ctttccccttttcctatgta

SEQ ID NO: 330465 - DNA, 20 bp, Artificial
  CRISPR gRNA sequence
gcttccagtgagccaaactg

SEQ ID NO: 330466 - DNA, 20 bp, Artificial
  CRISPR gRNA sequence
ctggtattgggggttgtctg

SEQ ID NO: 330467 - DNA, 20 bp, Artificial
  CRISPR gRNA sequence
caatggactccatgagggcc

SEQ ID NO: 330468 - DNA, 20 bp, Artificial
  CRISPR gRNA sequence
ccatgagggcctttagcttt

SEQ ID NO: 330469 - DNA, 20 bp, Artificial
  CRISPR gRNA sequence
gttggcctcctgccaggagg

SEQ ID NO: 330470 - DNA, 20 bp, Artificial
  CRISPR gRNA sequence
tgggtggggccctagaactc

SEQ ID NO: 330471 - DNA, 20 bp, Artificial
  CRISPR gRNA sequence
ggctgctgtgggggatgtgg

SEQ ID NO: 330472 - DNA, 20 bp, Artificial
  CRISPR gRNA sequence
tcactggagttgtgtaccta

SEQ ID NO: 330473 - DNA, 20 bp, Artificial
  CRISPR gRNA sequence
gcctcctctaaccgccccaa

SEQ ID NO: 330474 - DNA, 20 bp, Artificial
  CRISPR gRNA sequence
gtttccaggcaaagggcaag

SEQ ID NO: 330475 - DNA, 20 bp, Artificial
  CRISPR gRNA sequence
gactggcttgaaaacttgcc

SEQ ID NO: 330476 - DNA, 20 bp, Artificial
  CRISPR gRNA sequence
gcctcccagctgtgaaagaa

SEQ ID NO: 330477 - DNA, 20 bp, Artificial
  CRISPR gRNA sequence
cagctgtgaaagaaaagggc

SEQ ID NO: 330478 - DNA, 20 bp, Artificial
  CRISPR gRNA sequence
cctgcatgtgaaatctgcat

SEQ ID NO: 330479 - DNA, 20 bp, Artificial
  CRISPR gRNA sequence
tagagaattccttctccctg

SEQ ID NO: 330480 - DNA, 20 bp, Artificial
  CRISPR gRNA sequence
tgtggtgcctggcaagaatg

SEQ ID NO: 330481 - DNA, 20 bp, Artificial
  CRISPR gRNA sequence
ttgagctcccagagcctttc

SEQ ID NO: 330482 - DNA, 20 bp, Artificial
  CRISPR gRNA sequence
tcctctacccctgtattttg

SEQ ID NO: 330483 - DNA, 20 bp, Artificial
  CRISPR gRNA sequence
aacttctccacaaacagacg

SEQ ID NO: 330484 - DNA, 20 bp, Artificial
  CRISPR gRNA sequence
tcagcttctccggtcagagt

SEQ ID NO: 330485 - DNA, 20 bp, Artificial
  CRISPR gRNA sequence
attacaaagatatttaccaa

SEQ ID NO: 330486 - DNA, 20 bp, Artificial
  CRISPR gRNA sequence
aatattaattcttttattta

SEQ ID NO: 330487 - DNA, 20 bp, Artificial
  CRISPR gRNA sequence
aattcttttatttaatatga

SEQ ID NO: 330488 - DNA, 20 bp, Artificial
  CRISPR gRNA sequence
cttccactatgttcaaggtc

SEQ ID NO: 330489 - DNA, 20 bp, Artificial
  CRISPR gRNA sequence
agagtgaatgagaatttctt

SEQ ID NO: 330490 - DNA, 20 bp, Artificial
  CRISPR gRNA sequence
gaaatggccaaaaagttcag

SEQ ID NO: 330491 - DNA, 20 bp, Artificial
  CRISPR gRNA sequence
gtggcttcaatagatggcct

SEQ ID NO: 330492 - DNA, 20 bp, Artificial
  CRISPR gRNA sequence
gacttttaaactggggagtg

SEQ ID NO: 330493 - DNA, 20 bp, Artificial
  CRISPR gRNA sequence
attgagaaggccagtcaaga

SEQ ID NO: 330494 - DNA, 20 bp, Artificial
  CRISPR gRNA sequence
aagggaagacatgaaaaagg

SEQ ID NO: 330495 - DNA, 20 bp, Artificial
  CRISPR gRNA sequence
ctagtgactccctgaaaaga

SEQ ID NO: 330496 - DNA, 20 bp, Artificial
  CRISPR gRNA sequence
gactccctgaaaagacaggg

SEQ ID NO: 330497 - DNA, 20 bp, Artificial
  CRISPR gRNA sequence
cattctgagaaatgtgtcct

SEQ ID NO: 330498 - DNA, 20 bp, Artificial
  CRISPR gRNA sequence
ctaggctatgtggagtagcc

SEQ ID NO: 330499 - DNA, 20 bp, Artificial
  CRISPR gRNA sequence
cagcgcatgactgtactgag

SEQ ID NO: 330500 - DNA, 20 bp, Artificial
  CRISPR gRNA sequence
gaatttggaaacaaggaact

SEQ ID NO: 330501 - DNA, 20 bp, Artificial
  CRISPR gRNA sequence
acaccctgtccatgtgccca

SEQ ID NO: 330502 - DNA, 20 bp, Artificial
  CRISPR gRNA sequence
agttgggttcatttaatctc

SEQ ID NO: 330503 - DNA, 20 bp, Artificial
  CRISPR gRNA sequence
tcatatgatttccctagtac

SEQ ID NO: 330504 - DNA, 20 bp, Artificial
  CRISPR gRNA sequence
atgaagtaactaacaaaata

SEQ ID NO: 330505 - DNA, 20 bp, Artificial
  CRISPR gRNA sequence
aaataacttgtttgtaaatt

SEQ ID NO: 330506 - DNA, 20 bp, Artificial
  CRISPR gRNA sequence
ttgctttgtgaatattgata

SEQ ID NO: 330507 - DNA, 20 bp, Artificial
  CRISPR gRNA sequence
tacaaagttttataatacca

SEQ ID NO: 330508 - DNA, 20 bp, Artificial
  CRISPR gRNA sequence
ttttcatttttcatgaagaa

SEQ ID NO: 330509 - DNA, 20 bp, Artificial
  CRISPR gRNA sequence
acacacttagagaaccaaag

SEQ ID NO: 330510 - DNA, 20 bp, Artificial
  CRISPR gRNA sequence
tgtgtgttcatgagcactct

SEQ ID NO: 330511 - DNA, 20 bp, Artificial
  CRISPR gRNA sequence
tcttcttcccattttttttt

SEQ ID NO: 330512 - DNA, 20 bp, Artificial
  CRISPR gRNA sequence
tccaaatgttaggcatttag

SEQ ID NO: 330513 - DNA, 20 bp, Artificial
  CRISPR gRNA sequence
tgttaggcatttaggttaga

SEQ ID NO: 330514 - DNA, 20 bp, Artificial
  CRISPR gRNA sequence
ttccttgcctcaattacttc

SEQ ID NO: 330515 - DNA, 20 bp, Artificial
  CRISPR gRNA sequence
gggtgcctttgaatagcaat

SEQ ID NO: 330516 - DNA, 20 bp, Artificial
  CRISPR gRNA sequence
aatctactaaccagggatct

SEQ ID NO: 330517 - DNA, 20 bp, Artificial
  CRISPR gRNA sequence
ggtagactcataagacatga

SEQ ID NO: 330518 - DNA, 20 bp, Artificial
  CRISPR gRNA sequence
tgtgctaagctaacacttat

SEQ ID NO: 330519 - DNA, 20 bp, Artificial
  CRISPR gRNA sequence
ctaagctaacacttatcatt

SEQ ID NO: 330520 - DNA, 20 bp, Artificial
  CRISPR gRNA sequence
tcattgtttgattacagaaa

SEQ ID NO: 330521 - DNA, 20 bp, Artificial
  CRISPR gRNA sequence
atgtgtttaataagcactat

SEQ ID NO: 330522 - DNA, 20 bp, Artificial
  CRISPR gRNA sequence
catcactctgagacctttgt

SEQ ID NO: 330523 - DNA, 20 bp, Artificial
  CRISPR gRNA sequence
ctgcactgagtgggttcttt

SEQ ID NO: 330524 - DNA, 20 bp, Artificial
  CRISPR gRNA sequence
gttctttaaatgtttcctcc

SEQ ID NO: 330525 - DNA, 20 bp, Artificial
  CRISPR gRNA sequence
ttttcaaccaggaacaatac

SEQ ID NO: 330526 - DNA, 20 bp, Artificial
  CRISPR gRNA sequence
aaaagaagaagaaaatgttc

SEQ ID NO: 330527 - DNA, 20 bp, Artificial
  CRISPR gRNA sequence
cctaaagagatcacttaata

SEQ ID NO: 330528 - DNA, 20 bp, Artificial
  CRISPR gRNA sequence
aacctctgactccctggttc

SEQ ID NO: 330529 - DNA, 20 bp, Artificial
  CRISPR gRNA sequence
tgcctcagcctcctgagtag

SEQ ID NO: 330530 - DNA, 20 bp, Artificial
  CRISPR gRNA sequence
ttttatattattagtagaga

SEQ ID NO: 330531 - DNA, 20 bp, Artificial
  CRISPR gRNA sequence
tgcctcggcctcccaaagtg

SEQ ID NO: 330532 - DNA, 20 bp, Artificial
  CRISPR gRNA sequence
aatatagtacctgttctcca

SEQ ID NO: 330533 - DNA, 20 bp, Artificial
  CRISPR gRNA sequence
tctccagactgattataatc

SEQ ID NO: 330534 - DNA, 20 bp, Artificial
  CRISPR gRNA sequence
tatggtagcaaaacaaaacc

SEQ ID NO: 330535 - DNA, 20 bp, Artificial
  CRISPR gRNA sequence
acaaaacctcatgtttaata

SEQ ID NO: 330536 - DNA, 20 bp, Artificial
  CRISPR gRNA sequence
ccaagaccacatattccttt

SEQ ID NO: 330537 - DNA, 20 bp, Artificial
  CRISPR gRNA sequence
aagtgctaaaagatataaga

SEQ ID NO: 330538 - DNA, 20 bp, Artificial
  CRISPR gRNA sequence
tatcacaaaccactaacatg

SEQ ID NO: 330539 - DNA, 20 bp, Artificial
  CRISPR gRNA sequence
atattgggcaaatgtaatgg

SEQ ID NO: 330540 - DNA, 20 bp, Artificial
  CRISPR gRNA sequence
tgggacatccaagtgagcaa

SEQ ID NO: 330541 - DNA, 20 bp, Artificial
  CRISPR gRNA sequence
agtggatatttgaaggtaaa

SEQ ID NO: 330542 - DNA, 20 bp, Artificial
  CRISPR gRNA sequence
gttggggtagtgtcttgtat

SEQ ID NO: 330543 - DNA, 20 bp, Artificial
  CRISPR gRNA sequence
atgattgtgtatcttcatac

SEQ ID NO: 330544 - DNA, 20 bp, Artificial
  CRISPR gRNA sequence
agatagtcaccttttctggc

SEQ ID NO: 330545 - DNA, 20 bp, Artificial
  CRISPR gRNA sequence
caaatggaaaatgcaaaatg

SEQ ID NO: 330546 - DNA, 20 bp, Artificial
  CRISPR gRNA sequence
tggctcttatattataaatc

SEQ ID NO: 330547 - DNA, 20 bp, Artificial
  CRISPR gRNA sequence
taaatcctgtgcttcatctc

SEQ ID NO: 330548 - DNA, 20 bp, Artificial
  CRISPR gRNA sequence
tcatttgttcgcccatccaa

SEQ ID NO: 330549 - DNA, 20 bp, Artificial
  CRISPR gRNA sequence
gctttcatccatccaataaa

SEQ ID NO: 330550 - DNA, 20 bp, Artificial
  CRISPR gRNA sequence
tccatccaataaatactgat

SEQ ID NO: 330551 - DNA, 20 bp, Artificial
  CRISPR gRNA sequence
gtattattgtagatacttgg

SEQ ID NO: 330552 - DNA, 20 bp, Artificial
  CRISPR gRNA sequence
tgaataagaccaacaaggtc

SEQ ID NO: 330553 - DNA, 20 bp, Artificial
  CRISPR gRNA sequence
accaacaaggtccctggttt

SEQ ID NO: 330554 - DNA, 20 bp, Artificial
  CRISPR gRNA sequence
agataatttcagacagtgat

SEQ ID NO: 330555 - DNA, 20 bp, Artificial
  CRISPR gRNA sequence
ataatgacctggatatattc

SEQ ID NO: 330556 - DNA, 20 bp, Artificial
  CRISPR gRNA sequence
agaaattaaaagccctggga

SEQ ID NO: 330557 - DNA, 20 bp, Artificial
  CRISPR gRNA sequence
aagccctgggaacctgcttt

SEQ ID NO: 330558 - DNA, 20 bp, Artificial
  CRISPR gRNA sequence
atgggaaaccagggtaagaa

SEQ ID NO: 330559 - DNA, 20 bp, Artificial
  CRISPR gRNA sequence
aagtggaatgagaagcacct

SEQ ID NO: 330560 - DNA, 20 bp, Artificial
  CRISPR gRNA sequence
ataagcagaacaatgactct

SEQ ID NO: 330561 - DNA, 20 bp, Artificial
  CRISPR gRNA sequence
tatgcatgtaagaaggtcat

SEQ ID NO: 330562 - DNA, 20 bp, Artificial
  CRISPR gRNA sequence
attctggtttctctgtggag

SEQ ID NO: 330563 - DNA, 20 bp, Artificial
  CRISPR gRNA sequence
tagtcccagagagagatgac

SEQ ID NO: 330564 - DNA, 20 bp, Artificial
  CRISPR gRNA sequence
gctgagatggaggagaagtg

SEQ ID NO: 330565 - DNA, 20 bp, Artificial
  CRISPR gRNA sequence
aattaggcgttcttcctgct

SEQ ID NO: 330566 - DNA, 20 bp, Artificial
  CRISPR gRNA sequence
tcagttgttagtgaccactg

SEQ ID NO: 330567 - DNA, 20 bp, Artificial
  CRISPR gRNA sequence
ctgtctagcttcctgtggtt

SEQ ID NO: 330568 - DNA, 20 bp, Artificial
  CRISPR gRNA sequence
gcctgcttctattatacttc

SEQ ID NO: 330569 - DNA, 20 bp, Artificial
  CRISPR gRNA sequence
gttgctagtgacactttgac

SEQ ID NO: 330570 - DNA, 20 bp, Artificial
  CRISPR gRNA sequence
atcaaagatagtatgagaga

SEQ ID NO: 330571 - DNA, 20 bp, Artificial
  CRISPR gRNA sequence
tatgagagaggatgttttgg

SEQ ID NO: 330572 - DNA, 20 bp, Artificial
  CRISPR gRNA sequence
aggaagaaagaacaagaaga

SEQ ID NO: 330573 - DNA, 20 bp, Artificial
  CRISPR gRNA sequence
tatggcaacagaattgacca

SEQ ID NO: 330574 - DNA, 20 bp, Artificial
  CRISPR gRNA sequence
aaggatggagaaaagatcct

SEQ ID NO: 330575 - DNA, 20 bp, Artificial
  CRISPR gRNA sequence
ccttaaattgtctatccatt

SEQ ID NO: 330576 - DNA, 20 bp, Artificial
  CRISPR gRNA sequence
tcagaggcccaaggcagtac

SEQ ID NO: 330577 - DNA, 20 bp, Artificial
  CRISPR gRNA sequence
tcttgagagacagccaatct

SEQ ID NO: 330578 - DNA, 20 bp, Artificial
  CRISPR gRNA sequence
gttaacccattaacccatga

SEQ ID NO: 330579 - DNA, 20 bp, Artificial
  CRISPR gRNA sequence
acctcccaattctattacac

SEQ ID NO: 330580 - DNA, 20 bp, Artificial
  CRISPR gRNA sequence
ctgcagacttagagctgtca

SEQ ID NO: 330581 - DNA, 20 bp, Artificial
  CRISPR gRNA sequence
gtcaagcggttttccagatg

SEQ ID NO: 330582 - DNA, 20 bp, Artificial
  CRISPR gRNA sequence
cataataaataggcgatcca

SEQ ID NO: 330583 - DNA, 20 bp, Artificial
  CRISPR gRNA sequence
tccaggccaggtgcggtggc

SEQ ID NO: 330584 - DNA, 20 bp, Artificial
  CRISPR gRNA sequence
ttgggaagctgaggcagcag

SEQ ID NO: 330585 - DNA, 20 bp, Artificial
  CRISPR gRNA sequence
gaggcagaggttgcagtgag

SEQ ID NO: 330586 - DNA, 20 bp, Artificial
  CRISPR gRNA sequence
cagaaagtggttaacaggaa

SEQ ID NO: 330587 - DNA, 20 bp, Artificial
  CRISPR gRNA sequence
agcaaagaattagctctctc

SEQ ID NO: 330588 - DNA, 20 bp, Artificial
  CRISPR gRNA sequence
aggtgttagaaataacatta

SEQ ID NO: 330589 - DNA, 20 bp, Artificial
  CRISPR gRNA sequence
tagaaataacattaagatgt

SEQ ID NO: 330590 - DNA, 20 bp, Artificial
  CRISPR gRNA sequence
tggcagagccagaatttgcc

SEQ ID NO: 330591 - DNA, 20 bp, Artificial
  CRISPR gRNA sequence
cgccaaccattcatgtcctc

SEQ ID NO: 330592 - DNA, 20 bp, Artificial
  CRISPR gRNA sequence
tgtgtatacatggtgaccac

SEQ ID NO: 330593 - DNA, 20 bp, Artificial
  CRISPR gRNA sequence
cgctttggctccaagatcat

SEQ ID NO: 330594 - DNA, 20 bp, Artificial
  CRISPR gRNA sequence
aaaggaactgagaacccgtc

SEQ ID NO: 330595 - DNA, 20 bp, Artificial
  CRISPR gRNA sequence
aaagccccaagcaaaatacc

SEQ ID NO: 330596 - DNA, 20 bp, Artificial
  CRISPR gRNA sequence
actgcacctgttctcatgcc

SEQ ID NO: 330597 - DNA, 20 bp, Artificial
  CRISPR gRNA sequence
ctctggataatattgttcct

SEQ ID NO: 330598 - DNA, 20 bp, Artificial
  CRISPR gRNA sequence
gcaagtattattttccttct

SEQ ID NO: 330599 - DNA, 20 bp, Artificial
  CRISPR gRNA sequence
ctgtcagcacccctatttcc

SEQ ID NO: 330600 - DNA, 20 bp, Artificial
  CRISPR gRNA sequence
gctgaattttgtgatactaa

SEQ ID NO: 330601 - DNA, 20 bp, Artificial
  CRISPR gRNA sequence
aacatgtatacttcacttag

SEQ ID NO: 330602 - DNA, 20 bp, Artificial
  CRISPR gRNA sequence
acaatgtgctctatattgac

SEQ ID NO: 330603 - DNA, 20 bp, Artificial
  CRISPR gRNA sequence
atgttataattccactgtat

SEQ ID NO: 330604 - DNA, 20 bp, Artificial
  CRISPR gRNA sequence
gtaatcagtctcttttctct

SEQ ID NO: 330605 - DNA, 20 bp, Artificial
  CRISPR gRNA sequence
tctcttttctctggctgctt

SEQ ID NO: 330606 - DNA, 20 bp, Artificial
  CRISPR gRNA sequence
ggtgtgcatacttttaaaaa

SEQ ID NO: 330607 - DNA, 20 bp, Artificial
  CRISPR gRNA sequence
aaaaatatgcttgtgaattg

SEQ ID NO: 330608 - DNA, 20 bp, Artificial
  CRISPR gRNA sequence
atatatattaaacttatcta

SEQ ID NO: 330609 - DNA, 20 bp, Artificial
  CRISPR gRNA sequence
aaatctcagtgcattttttt

SEQ ID NO: 330610 - DNA, 20 bp, Artificial
  CRISPR gRNA sequence
tgtgtactacagatattatt

SEQ ID NO: 330611 - DNA, 20 bp, Artificial
  CRISPR gRNA sequence
ttattacaagtttttctctt

SEQ ID NO: 330612 - DNA, 20 bp, Artificial
  CRISPR gRNA sequence
ctcttatttgcttaaacata

SEQ ID NO: 330613 - DNA, 20 bp, Artificial
  CRISPR gRNA sequence
ataattcaggtatataaatc

SEQ ID NO: 330614 - DNA, 20 bp, Artificial
  CRISPR gRNA sequence
ttcaggtatataaatcatga

SEQ ID NO: 330615 - DNA, 20 bp, Artificial
  CRISPR gRNA sequence
ataaatcatgagtttgtttt

SEQ ID NO: 330616 - DNA, 20 bp, Artificial
  CRISPR gRNA sequence
atgagtttgtttttgtagtt

SEQ ID NO: 330617 - DNA, 20 bp, Artificial
  CRISPR gRNA sequence
gtttgttgtttctgttgttc

SEQ ID NO: 330618 - DNA, 20 bp, Artificial
  CRISPR gRNA sequence
tatgtctcattatttttgtg

SEQ ID NO: 330619 - DNA, 20 bp, Artificial
  CRISPR gRNA sequence
tgtaaaccttttcttcttgt

SEQ ID NO: 330620 - DNA, 20 bp, Artificial
  CRISPR gRNA sequence
aaatctccttaaagaaaatt

SEQ ID NO: 330621 - DNA, 20 bp, Artificial
  CRISPR gRNA sequence
cttaaagaaaattcaaggat

SEQ ID NO: 330622 - DNA, 20 bp, Artificial
  CRISPR gRNA sequence
ttttctaaccattgaagtcc

SEQ ID NO: 330623 - DNA, 20 bp, Artificial
  CRISPR gRNA sequence
accatctaatctgaatgagg

SEQ ID NO: 330624 - DNA, 20 bp, Artificial
  CRISPR gRNA sequence
gggtcccaatttattgggga

SEQ ID NO: 330625 - DNA, 20 bp, Artificial
  CRISPR gRNA sequence
ttctgctagatcactcactc

SEQ ID NO: 330626 - DNA, 20 bp, Artificial
  CRISPR gRNA sequence
gggagttgagacataaaaac

SEQ ID NO: 330627 - DNA, 20 bp, Artificial
  CRISPR gRNA sequence
gtttgaatttgaaagaacag

SEQ ID NO: 330628 - DNA, 20 bp, Artificial
  CRISPR gRNA sequence
agcaatgctttccgagtaaa

SEQ ID NO: 330629 - DNA, 20 bp, Artificial
  CRISPR gRNA sequence
tttccgagtaaaagcagctt

SEQ ID NO: 330630 - DNA, 20 bp, Artificial
  CRISPR gRNA sequence
tcctcctttgtgtcattctt

SEQ ID NO: 330631 - DNA, 20 bp, Artificial
  CRISPR gRNA sequence
gacatttgttcaacattttt

SEQ ID NO: 330632 - DNA, 20 bp, Artificial
  CRISPR gRNA sequence
ttggttgttttggcgtgaga

SEQ ID NO: 330633 - DNA, 20 bp, Artificial
  CRISPR gRNA sequence
ataactgaagactagaacac

SEQ ID NO: 330634 - DNA, 20 bp, Artificial
  CRISPR gRNA sequence
ccaatatccaacgttagtat

SEQ ID NO: 330635 - DNA, 20 bp, Artificial
  CRISPR gRNA sequence
ttttagttttaacaaattat

SEQ ID NO: 330636 - DNA, 20 bp, Artificial
  CRISPR gRNA sequence
aattatgatgactaaaaatg

SEQ ID NO: 330637 - DNA, 20 bp, Artificial
  CRISPR gRNA sequence
caatagcagaacacaaaata

SEQ ID NO: 330638 - DNA, 20 bp, Artificial
  CRISPR gRNA sequence
atgtttgctataaataataa

SEQ ID NO: 330639 - DNA, 20 bp, Artificial
  CRISPR gRNA sequence
ttaaaatttttttacactta

SEQ ID NO: 330640 - DNA, 20 bp, Artificial
  CRISPR gRNA sequence
agttttctcaaaaacaaaga

SEQ ID NO: 330641 - DNA, 20 bp, Artificial
  CRISPR gRNA sequence
aaaagaaagagaaggcaatg

SEQ ID NO: 330642 - DNA, 20 bp, Artificial
  CRISPR gRNA sequence
aatctgcaaccaccaggcca

SEQ ID NO: 330643 - DNA, 20 bp, Artificial
  CRISPR gRNA sequence
aaccaccaggccaaggtgat

SEQ ID NO: 330644 - DNA, 20 bp, Artificial
  CRISPR gRNA sequence
gtgatttcagttttttcctt

SEQ ID NO: 330645 - DNA, 20 bp, Artificial
  CRISPR gRNA sequence
ttttccttctgtgattccca

SEQ ID NO: 330646 - DNA, 20 bp, Artificial
  CRISPR gRNA sequence
atgtagcttgcaaaaacaac

SEQ ID NO: 330647 - DNA, 20 bp, Artificial
  CRISPR gRNA sequence
cactttaagaggctgaggca

SEQ ID NO: 330648 - DNA, 20 bp, Artificial
  CRISPR gRNA sequence
ttaagaggctgaggcaggag

SEQ ID NO: 330649 - DNA, 20 bp, Artificial
  CRISPR gRNA sequence
tggtggtgtgtgcctgtatt

SEQ ID NO: 330650 - DNA, 20 bp, Artificial
  CRISPR gRNA sequence
agaaaaagtaaacaaaaatc

SEQ ID NO: 330651 - DNA, 20 bp, Artificial
  CRISPR gRNA sequence
gctttatctttattatcagg

SEQ ID NO: 330652 - DNA, 20 bp, Artificial
  CRISPR gRNA sequence
ttgattcagttctcagtgga

SEQ ID NO: 330653 - DNA, 20 bp, Artificial
  CRISPR gRNA sequence
aatacatttctgtcatttga

SEQ ID NO: 330654 - DNA, 20 bp, Artificial
  CRISPR gRNA sequence
caatttctatctttcctttt

SEQ ID NO: 330655 - DNA, 20 bp, Artificial
  CRISPR gRNA sequence
tctgctttactgatgtacat

SEQ ID NO: 330656 - DNA, 20 bp, Artificial
  CRISPR gRNA sequence
gtacacatggttcttgtcag

SEQ ID NO: 330657 - DNA, 20 bp, Artificial
  CRISPR gRNA sequence
aagatatacctactaataaa

SEQ ID NO: 330658 - DNA, 20 bp, Artificial
  CRISPR gRNA sequence
cttcaacttttcccatatct

SEQ ID NO: 330659 - DNA, 20 bp, Artificial
  CRISPR gRNA sequence
cacttcctcaaggcggcatt

SEQ ID NO: 330660 - DNA, 20 bp, Artificial
  CRISPR gRNA sequence
taccaaaggacagaggccat

SEQ ID NO: 330661 - DNA, 20 bp, Artificial
  CRISPR gRNA sequence
aaaggacagaggccatacca

SEQ ID NO: 330662 - DNA, 20 bp, Artificial
  CRISPR gRNA sequence
tctatattcacatatgacaa

SEQ ID NO: 330663 - DNA, 20 bp, Artificial
  CRISPR gRNA sequence
tatgacaagcaagtttctgg

SEQ ID NO: 330664 - DNA, 20 bp, Artificial
  CRISPR gRNA sequence
ggatttttttttctctagga

SEQ ID NO: 330665 - DNA, 20 bp, Artificial
  CRISPR gRNA sequence
ggggtggagggagaatgtga

SEQ ID NO: 330666 - DNA, 20 bp, Artificial
  CRISPR gRNA sequence
atgactttatgcattgaata

SEQ ID NO: 330667 - DNA, 20 bp, Artificial
  CRISPR gRNA sequence
gcaacattataaaatgtcac

SEQ ID NO: 330668 - DNA, 20 bp, Artificial
  CRISPR gRNA sequence
attataaaatgtcacttttg

SEQ ID NO: 330669 - DNA, 20 bp, Artificial
  CRISPR gRNA sequence
caatggttctgccaattatg

SEQ ID NO: 330670 - DNA, 20 bp, Artificial
  CRISPR gRNA sequence
tttgcatatttatggtaaga

SEQ ID NO: 330671 - DNA, 20 bp, Artificial
  CRISPR gRNA sequence
ttccaaacttaagagtatat

SEQ ID NO: 330672 - DNA, 20 bp, Artificial
  CRISPR gRNA sequence
ttataatgaagatatacagg

SEQ ID NO: 330673 - DNA, 20 bp, Artificial
  CRISPR gRNA sequence
ttaagacaaatacttaaact

SEQ ID NO: 330674 - DNA, 20 bp, Artificial
  CRISPR gRNA sequence
tgggtattatctctattcac

SEQ ID NO: 330675 - DNA, 20 bp, Artificial
  CRISPR gRNA sequence
atctctattcacctaagatt

SEQ ID NO: 330676 - DNA, 20 bp, Artificial
  CRISPR gRNA sequence
tattcacctaagatttaagg

SEQ ID NO: 330677 - DNA, 20 bp, Artificial
  CRISPR gRNA sequence
atttaaggtttggttttgca

SEQ ID NO: 330678 - DNA, 20 bp, Artificial
  CRISPR gRNA sequence
tgtgtttgtggaatgaagta

SEQ ID NO: 330679 - DNA, 20 bp, Artificial
  CRISPR gRNA sequence
gaagtatgatgattgaaaat

SEQ ID NO: 330680 - DNA, 20 bp, Artificial
  CRISPR gRNA sequence
tacattatatgcataatctt

SEQ ID NO: 330681 - DNA, 20 bp, Artificial
  CRISPR gRNA sequence
gtctaataacttgcccactt

SEQ ID NO: 330682 - DNA, 20 bp, Artificial
  CRISPR gRNA sequence
atttcatgactataataaag

SEQ ID NO: 330683 - DNA, 20 bp, Artificial
  CRISPR gRNA sequence
ctataataaagaaaagcttc

SEQ ID NO: 330684 - DNA, 20 bp, Artificial
  CRISPR gRNA sequence
tttgggatgcatacttattt

SEQ ID NO: 330685 - DNA, 20 bp, Artificial
  CRISPR gRNA sequence
tgttggcttacaaaaaaggt

SEQ ID NO: 330686 - DNA, 20 bp, Artificial
  CRISPR gRNA sequence
cgatttctatctttccttgt

SEQ ID NO: 330687 - DNA, 20 bp, Artificial
  CRISPR gRNA sequence
tctgctttacagatgcacat

SEQ ID NO: 330688 - DNA, 20 bp, Artificial
  CRISPR gRNA sequence
cttggaacagaaatttatgt

SEQ ID NO: 330689 - DNA, 20 bp, Artificial
  CRISPR gRNA sequence
ttccaaagaggacttgactt

SEQ ID NO: 330690 - DNA, 20 bp, Artificial
  CRISPR gRNA sequence
taaaacatcaaaatagatga

SEQ ID NO: 330691 - DNA, 20 bp, Artificial
  CRISPR gRNA sequence
cagagatgaaacaattagtt

SEQ ID NO: 330692 - DNA, 20 bp, Artificial
  CRISPR gRNA sequence
atgaaacaattagttataag

SEQ ID NO: 330693 - DNA, 20 bp, Artificial
  CRISPR gRNA sequence
acatggtaggttattagact

SEQ ID NO: 330694 - DNA, 20 bp, Artificial
  CRISPR gRNA sequence
tttatgtaaagcccttttca

SEQ ID NO: 330695 - DNA, 20 bp, Artificial
  CRISPR gRNA sequence
caggaacctaagtcacatta

SEQ ID NO: 330696 - DNA, 20 bp, Artificial
  CRISPR gRNA sequence
ggagaagaaaagatgaccaa

SEQ ID NO: 330697 - DNA, 20 bp, Artificial
  CRISPR gRNA sequence
aaaagatgaccaagcatgtt

SEQ ID NO: 330698 - DNA, 20 bp, Artificial
  CRISPR gRNA sequence
tcacaggtatgactccattt

SEQ ID NO: 330699 - DNA, 20 bp, Artificial
  CRISPR gRNA sequence
tttgggggtttgggaaggga

SEQ ID NO: 330700 - DNA, 20 bp, Artificial
  CRISPR gRNA sequence
tctagaattttctgtgaaaa

SEQ ID NO: 330701 - DNA, 20 bp, Artificial
  CRISPR gRNA sequence
atctggatttctcactttta

SEQ ID NO: 330702 - DNA, 20 bp, Artificial
  CRISPR gRNA sequence
atattgaaaacaaacaagca

SEQ ID NO: 330703 - DNA, 20 bp, Artificial
  CRISPR gRNA sequence
tatcaaggcaattttcccat

SEQ ID NO: 330704 - DNA, 20 bp, Artificial
  CRISPR gRNA sequence
cattgatgtttcaaaagttg

SEQ ID NO: 330705 - DNA, 20 bp, Artificial
  CRISPR gRNA sequence
tcaaaagttgggatgattct

SEQ ID NO: 330706 - DNA, 20 bp, Artificial
  CRISPR gRNA sequence
ggttcattcagtcattcaat

SEQ ID NO: 330707 - DNA, 20 bp, Artificial
  CRISPR gRNA sequence
agatatatgctaattttgga

SEQ ID NO: 330708 - DNA, 20 bp, Artificial
  CRISPR gRNA sequence
tattttgaggtaaagagtgt

SEQ ID NO: 330709 - DNA, 20 bp, Artificial
  CRISPR gRNA sequence
gtgcaagtttagagaacttg

SEQ ID NO: 330710 - DNA, 20 bp, Artificial
  CRISPR gRNA sequence
agtcagaaaactgaaagttg

SEQ ID NO: 330711 - DNA, 20 bp, Artificial
  CRISPR gRNA sequence
ccaagtttgaggagcaccca

SEQ ID NO: 330712 - DNA, 20 bp, Artificial
  CRISPR gRNA sequence
tgaggagcacccagaaagtt

SEQ ID NO: 330713 - DNA, 20 bp, Artificial
  CRISPR gRNA sequence
tttttccacccctcagtggc

SEQ ID NO: 330714 - DNA, 20 bp, Artificial
  CRISPR gRNA sequence
gattatctaaaggggacaca

SEQ ID NO: 330715 - DNA, 20 bp, Artificial
  CRISPR gRNA sequence
aggatccttgagttcacatt

SEQ ID NO: 330716 - DNA, 20 bp, Artificial
  CRISPR gRNA sequence
ggttccctagacagttaata

SEQ ID NO: 330717 - DNA, 20 bp, Artificial
  CRISPR gRNA sequence
acctagctttgacacttgca

SEQ ID NO: 330718 - DNA, 20 bp, Artificial
  CRISPR gRNA sequence
ctttgacacttgcaaagagc

SEQ ID NO: 330719 - DNA, 20 bp, Artificial
  CRISPR gRNA sequence
gagcttatgtttcattactt

SEQ ID NO: 330720 - DNA, 20 bp, Artificial
  CRISPR gRNA sequence
aatatatgatctctcaatct

SEQ ID NO: 330721 - DNA, 20 bp, Artificial
  CRISPR gRNA sequence
ctctttgcttaatgtgttct

SEQ ID NO: 330722 - DNA, 20 bp, Artificial
  CRISPR gRNA sequence
gacataaggacttgggtgca

SEQ ID NO: 330723 - DNA, 20 bp, Artificial
  CRISPR gRNA sequence
gcaaccactggctccatcct

SEQ ID NO: 330724 - DNA, 20 bp, Artificial
  CRISPR gRNA sequence
tggggttgcctgcggagggc

SEQ ID NO: 330725 - DNA, 20 bp, Artificial
  CRISPR gRNA sequence
gctagaacagtcagcccatg

SEQ ID NO: 330726 - DNA, 20 bp, Artificial
  CRISPR gRNA sequence
agcagctgcaatcagaggtg

SEQ ID NO: 330727 - DNA, 20 bp, Artificial
  CRISPR gRNA sequence
aggtggacagtttcaaagtg

SEQ ID NO: 330728 - DNA, 20 bp, Artificial
  CRISPR gRNA sequence
ctgggtgttgaagcataaag

SEQ ID NO: 330729 - DNA, 20 bp, Artificial
  CRISPR gRNA sequence
gtgtgtgtgtgtgtgcacgt

SEQ ID NO: 330730 - DNA, 20 bp, Artificial
  CRISPR gRNA sequence
atgaaaggcaatggagaggg

SEQ ID NO: 330731 - DNA, 20 bp, Artificial
  CRISPR gRNA sequence
cccaggcatgaagcacgttg

SEQ ID NO: 330732 - DNA, 20 bp, Artificial
  CRISPR gRNA sequence
agttttcctcaacttgaagt

SEQ ID NO: 330733 - DNA, 20 bp, Artificial
  CRISPR gRNA sequence
taactacatacatcttctgc

SEQ ID NO: 330734 - DNA, 20 bp, Artificial
  CRISPR gRNA sequence
agaatgactgtatcagtcaa

SEQ ID NO: 330735 - DNA, 20 bp, Artificial
  CRISPR gRNA sequence
aaaacaaacaccctcttgca

SEQ ID NO: 330736 - DNA, 20 bp, Artificial
  CRISPR gRNA sequence
aacaaacacatttacaagaa

SEQ ID NO: 330737 - DNA, 20 bp, Artificial
  CRISPR gRNA sequence
ctcttttaatcagtcaaggg

SEQ ID NO: 330738 - DNA, 20 bp, Artificial
  CRISPR gRNA sequence
gaccattttaccaagacttt

SEQ ID NO: 330739 - DNA, 20 bp, Artificial
  CRISPR gRNA sequence
ttttaaaaatacttctacat

SEQ ID NO: 330740 - DNA, 20 bp, Artificial
  CRISPR gRNA sequence
cattctttcctctgctgctc

SEQ ID NO: 330741 - DNA, 20 bp, Artificial
  CRISPR gRNA sequence
cttttctcaaattcagttaa

SEQ ID NO: 330742 - DNA, 20 bp, Artificial
  CRISPR gRNA sequence
atcctattttctaccattat

SEQ ID NO: 330743 - DNA, 20 bp, Artificial
  CRISPR gRNA sequence
ttttcatggtgctattaatt

SEQ ID NO: 330744 - DNA, 20 bp, Artificial
  CRISPR gRNA sequence
agactatacccatggtgcct

SEQ ID NO: 330745 - DNA, 20 bp, Artificial
  CRISPR gRNA sequence
tcaagatagccttctttaga

SEQ ID NO: 330746 - DNA, 20 bp, Artificial
  CRISPR gRNA sequence
tttagaatatgatttggcta

SEQ ID NO: 330747 - DNA, 20 bp, Artificial
  CRISPR gRNA sequence
aagattcttaaatatgtgga

SEQ ID NO: 330748 - DNA, 20 bp, Artificial
  CRISPR gRNA sequence
ctacttcctgtctgcatgcc

SEQ ID NO: 330749 - DNA, 20 bp, Artificial
  CRISPR gRNA sequence
catttgtaactttaggtaaa

SEQ ID NO: 330750 - DNA, 20 bp, Artificial
  CRISPR gRNA sequence
taggtaaactgggattatgt

SEQ ID NO: 330751 - DNA, 20 bp, Artificial
  CRISPR gRNA sequence
tagtttaacattttgtaact

SEQ ID NO: 330752 - DNA, 20 bp, Artificial
  CRISPR gRNA sequence
acattttgtaactgtgtgct

SEQ ID NO: 330753 - DNA, 20 bp, Artificial
  CRISPR gRNA sequence
aatttgaatctagtatggtg

SEQ ID NO: 330754 - DNA, 20 bp, Artificial
  CRISPR gRNA sequence
cagctgacttggacaacctg

SEQ ID NO: 330755 - DNA, 20 bp, Artificial
  CRISPR gRNA sequence
ctttgcacaggtgttccctg

SEQ ID NO: 330756 - DNA, 20 bp, Artificial
  CRISPR gRNA sequence
aggtgttccctgagttgttt

SEQ ID NO: 330757 - DNA, 20 bp, Artificial
  CRISPR gRNA sequence
aaaatttctgtgaaatcaaa

SEQ ID NO: 330758 - DNA, 20 bp, Artificial
  CRISPR gRNA sequence
ttaagaggagccacttatca

SEQ ID NO: 330759 - DNA, 20 bp, Artificial
  CRISPR gRNA sequence
cagcaactgaaaatacctca

SEQ ID NO: 330760 - DNA, 20 bp, Artificial
  CRISPR gRNA sequence
ttttcttggggggagcaggg

SEQ ID NO: 330761 - DNA, 20 bp, Artificial
  CRISPR gRNA sequence
attgtacttgaagatagtta

SEQ ID NO: 330762 - DNA, 20 bp, Artificial
  CRISPR gRNA sequence
attttcagttgctgaatatc

SEQ ID NO: 330763 - DNA, 20 bp, Artificial
  CRISPR gRNA sequence
gataagtggctcctcttaaa

SEQ ID NO: 330764 - DNA, 20 bp, Artificial
  CRISPR gRNA sequence
gtggctcctcttaaaactgg

SEQ ID NO: 330765 - DNA, 20 bp, Artificial
  CRISPR gRNA sequence
gggatgaggatgtgtcgagg

SEQ ID NO: 330766 - DNA, 20 bp, Artificial
  CRISPR gRNA sequence
agctgaaaacagaacaccat

SEQ ID NO: 330767 - DNA, 20 bp, Artificial
  CRISPR gRNA sequence
ctgtacacatccagcattac

SEQ ID NO: 330768 - DNA, 20 bp, Artificial
  CRISPR gRNA sequence
atgttaaactacaacataat

SEQ ID NO: 330769 - DNA, 20 bp, Artificial
  CRISPR gRNA sequence
aatgttgttgcatcgacatt

SEQ ID NO: 330770 - DNA, 20 bp, Artificial
  CRISPR gRNA sequence
cagggccaatttccaggctg

SEQ ID NO: 330771 - DNA, 20 bp, Artificial
  CRISPR gRNA sequence
ttatgaatgcaggtagacca

SEQ ID NO: 330772 - DNA, 20 bp, Artificial
  CRISPR gRNA sequence
tgacagcaacctatagtaac

SEQ ID NO: 330773 - DNA, 20 bp, Artificial
  CRISPR gRNA sequence
tgagaatgctggcccattaa

SEQ ID NO: 330774 - DNA, 20 bp, Artificial
  CRISPR gRNA sequence
tgctggcccattaaagatga

SEQ ID NO: 330775 - DNA, 20 bp, Artificial
  CRISPR gRNA sequence
aaaataggataataaaataa

SEQ ID NO: 330776 - DNA, 20 bp, Artificial
  CRISPR gRNA sequence
aatttgctttcaattccggg

SEQ ID NO: 330777 - DNA, 20 bp, Artificial
  CRISPR gRNA sequence
catctcagaaataaaatagc

SEQ ID NO: 330778 - DNA, 20 bp, Artificial
  CRISPR gRNA sequence
agctttgaagcatctccctt

SEQ ID NO: 330779 - DNA, 20 bp, Artificial
  CRISPR gRNA sequence
atgctggtccttggctgctc

SEQ ID NO: 330780 - DNA, 20 bp, Artificial
  CRISPR gRNA sequence
ccttggctgctcatttgctt

SEQ ID NO: 330781 - DNA, 20 bp, Artificial
  CRISPR gRNA sequence
ttaaaacatttttcttgtaa

SEQ ID NO: 330782 - DNA, 20 bp, Artificial
  CRISPR gRNA sequence
aacatttttcttgtaaatgt

SEQ ID NO: 330783 - DNA, 20 bp, Artificial
  CRISPR gRNA sequence
gctaggagcagatgtggaga

SEQ ID NO: 330784 - DNA, 20 bp, Artificial
  CRISPR gRNA sequence
tcccagtgagcacacaggag

SEQ ID NO: 330785 - DNA, 20 bp, Artificial
  CRISPR gRNA sequence
ctccaaagctggttgcaaga

SEQ ID NO: 330786 - DNA, 20 bp, Artificial
  CRISPR gRNA sequence
aaagctggttgcaagagggt

SEQ ID NO: 330787 - DNA, 20 bp, Artificial
  CRISPR gRNA sequence
ttgactgatacagtcattct

SEQ ID NO: 330788 - DNA, 20 bp, Artificial
  CRISPR gRNA sequence
aagttgaggaaaactggcca

SEQ ID NO: 330789 - DNA, 20 bp, Artificial
  CRISPR gRNA sequence
ccatgtgccagttccctaca

SEQ ID NO: 330790 - DNA, 20 bp, Artificial
  CRISPR gRNA sequence
cacaccatgcaaactcatct

SEQ ID NO: 330791 - DNA, 20 bp, Artificial
  CRISPR gRNA sequence
caccagttccccatttccag

SEQ ID NO: 330792 - DNA, 20 bp, Artificial
  CRISPR gRNA sequence
atcactttgaaactgtccac

SEQ ID NO: 330793 - DNA, 20 bp, Artificial
  CRISPR gRNA sequence
acaacagccccactgcattt

SEQ ID NO: 330794 - DNA, 20 bp, Artificial
  CRISPR gRNA sequence
gtggttgccatccttcaaga

SEQ ID NO: 330795 - DNA, 20 bp, Artificial
  CRISPR gRNA sequence
ttgataataatgcgcccttc

SEQ ID NO: 330796 - DNA, 20 bp, Artificial
  CRISPR gRNA sequence
acccaagtccttatgtcagg

SEQ ID NO: 330797 - DNA, 20 bp, Artificial
  CRISPR gRNA sequence
cagccagaacacattaagca

SEQ ID NO: 330798 - DNA, 20 bp, Artificial
  CRISPR gRNA sequence
actgaggggtggaaaaatgc

SEQ ID NO: 330799 - DNA, 20 bp, Artificial
  CRISPR gRNA sequence
agacatgaattttccacaat

SEQ ID NO: 330800 - DNA, 20 bp, Artificial
  CRISPR gRNA sequence
gctcctcaaacttggcaact

SEQ ID NO: 330801 - DNA, 20 bp, Artificial
  CRISPR gRNA sequence
gaaaattgccttgatactat

SEQ ID NO: 330802 - DNA, 20 bp, Artificial
  CRISPR gRNA sequence
tgatactatggtggtttatg

SEQ ID NO: 330803 - DNA, 20 bp, Artificial
  CRISPR gRNA sequence
tggtggtttatgagctgttt

SEQ ID NO: 330804 - DNA, 20 bp, Artificial
  CRISPR gRNA sequence
gtttatgagctgtttgtgtg

SEQ ID NO: 330805 - DNA, 20 bp, Artificial
  CRISPR gRNA sequence
tttgtgtgtttagtttcaat

SEQ ID NO: 330806 - DNA, 20 bp, Artificial
  CRISPR gRNA sequence
tcaatagtggcttacaaacc

SEQ ID NO: 330807 - DNA, 20 bp, Artificial
  CRISPR gRNA sequence
tagtggcttacaaacctatt

SEQ ID NO: 330808 - DNA, 20 bp, Artificial
  CRISPR gRNA sequence
ggcttacaaacctattgctt

SEQ ID NO: 330809 - DNA, 20 bp, Artificial
  CRISPR gRNA sequence
atctagttaaaagtgagaaa

SEQ ID NO: 330810 - DNA, 20 bp, Artificial
  CRISPR gRNA sequence
attctagaattaggccttgg

SEQ ID NO: 330811 - DNA, 20 bp, Artificial
  CRISPR gRNA sequence
aaaaaaaaaaaattaacatt

SEQ ID NO: 330812 - DNA, 20 bp, Artificial
  CRISPR gRNA sequence
aatggagtcatacctgtgag

SEQ ID NO: 330813 - DNA, 20 bp, Artificial
  CRISPR gRNA sequence
tctgaaagaaaaagccagaa

SEQ ID NO: 330814 - DNA, 20 bp, Artificial
  CRISPR gRNA sequence
tcatcttttcttctccatct

SEQ ID NO: 330815 - DNA, 20 bp, Artificial
  CRISPR gRNA sequence
tctccatctctttgtttttt

SEQ ID NO: 330816 - DNA, 20 bp, Artificial
  CRISPR gRNA sequence
atgataatgtgacttaggtt

SEQ ID NO: 330817 - DNA, 20 bp, Artificial
  CRISPR gRNA sequence
aagtagaaaaacaatatgaa

SEQ ID NO: 330818 - DNA, 20 bp, Artificial
  CRISPR gRNA sequence
tgaaaagggctttacataaa

SEQ ID NO: 330819 - DNA, 20 bp, Artificial
  CRISPR gRNA sequence
gctttctactgaactttctt

SEQ ID NO: 330820 - DNA, 20 bp, Artificial
  CRISPR gRNA sequence
ttcttcctcgtttttgcctt

SEQ ID NO: 330821 - DNA, 20 bp, Artificial
  CRISPR gRNA sequence
tatgcagagtggtgtcagtt

SEQ ID NO: 330822 - DNA, 20 bp, Artificial
  CRISPR gRNA sequence
aaagaatatcccccagcaca

SEQ ID NO: 330823 - DNA, 20 bp, Artificial
  CRISPR gRNA sequence
gagatttttgttgttgtcat

SEQ ID NO: 330824 - DNA, 20 bp, Artificial
  CRISPR gRNA sequence
atctttctaaatagctcctc

SEQ ID NO: 330825 - DNA, 20 bp, Artificial
  CRISPR gRNA sequence
cagctacaattgacacctta

SEQ ID NO: 330826 - DNA, 20 bp, Artificial
  CRISPR gRNA sequence
ccttagaaggctttcttgct

SEQ ID NO: 330827 - DNA, 20 bp, Artificial
  CRISPR gRNA sequence
gctaagcaaaacttataact

SEQ ID NO: 330828 - DNA, 20 bp, Artificial
  CRISPR gRNA sequence
ctgccctgcctctcaggaac

SEQ ID NO: 330829 - DNA, 20 bp, Artificial
  CRISPR gRNA sequence
aaaatcagagtcatctattt

SEQ ID NO: 330830 - DNA, 20 bp, Artificial
  CRISPR gRNA sequence
tcttgacctcaatttcctca

SEQ ID NO: 330831 - DNA, 20 bp, Artificial
  CRISPR gRNA sequence
aatacataaatttctgttcc

SEQ ID NO: 330832 - DNA, 20 bp, Artificial
  CRISPR gRNA sequence
ataaatttctgttccaagtg

SEQ ID NO: 330833 - DNA, 20 bp, Artificial
  CRISPR gRNA sequence
cagatacaaggaaagataga

SEQ ID NO: 330834 - DNA, 20 bp, Artificial
  CRISPR gRNA sequence
aacttcagctggcaacaaag

SEQ ID NO: 330835 - DNA, 20 bp, Artificial
  CRISPR gRNA sequence
gctggcaacaaagttgtgat

SEQ ID NO: 330836 - DNA, 20 bp, Artificial
  CRISPR gRNA sequence
aaaagagctatttaatcaaa

SEQ ID NO: 330837 - DNA, 20 bp, Artificial
  CRISPR gRNA sequence
ggatccaggaactaaaactt

SEQ ID NO: 330838 - DNA, 20 bp, Artificial
  CRISPR gRNA sequence
ttacaaatgtggttaataga

SEQ ID NO: 330839 - DNA, 20 bp, Artificial
  CRISPR gRNA sequence
gtaaaagtaatgttataaaa

SEQ ID NO: 330840 - DNA, 20 bp, Artificial
  CRISPR gRNA sequence
ataatacccattattaagcc

SEQ ID NO: 330841 - DNA, 20 bp, Artificial
  CRISPR gRNA sequence
ataagtttaagtatttgtct

SEQ ID NO: 330842 - DNA, 20 bp, Artificial
  CRISPR gRNA sequence
agtatttgtcttaatgtttt

SEQ ID NO: 330843 - DNA, 20 bp, Artificial
  CRISPR gRNA sequence
ttcctgatttttaatagcat

SEQ ID NO: 330844 - DNA, 20 bp, Artificial
  CRISPR gRNA sequence
tatttctgacttagcagtct

SEQ ID NO: 330845 - DNA, 20 bp, Artificial
  CRISPR gRNA sequence
atattgctgaataatactaa

SEQ ID NO: 330846 - DNA, 20 bp, Artificial
  CRISPR gRNA sequence
cacctgtatatcttcattat

SEQ ID NO: 330847 - DNA, 20 bp, Artificial
  CRISPR gRNA sequence
caaaagatatttatttgtct

SEQ ID NO: 330848 - DNA, 20 bp, Artificial
  CRISPR gRNA sequence
gtcaaaacatatatatactc

SEQ ID NO: 330849 - DNA, 20 bp, Artificial
  CRISPR gRNA sequence
tttcagactcttaatggaca

SEQ ID NO: 330850 - DNA, 20 bp, Artificial
  CRISPR gRNA sequence
catctcataattggcagaac

SEQ ID NO: 330851 - DNA, 20 bp, Artificial
  CRISPR gRNA sequence
tctctgttgcaccaaaatga

SEQ ID NO: 330852 - DNA, 20 bp, Artificial
  CRISPR gRNA sequence
aaaaaaaatcctaaccagaa

SEQ ID NO: 330853 - DNA, 20 bp, Artificial
  CRISPR gRNA sequence
tggtatggcctctgtccttt

SEQ ID NO: 330854 - DNA, 20 bp, Artificial
  CRISPR gRNA sequence
tagagtcaggtgggttataa

SEQ ID NO: 330855 - DNA, 20 bp, Artificial
  CRISPR gRNA sequence
gaaaatgccgccttgaggaa

SEQ ID NO: 330856 - DNA, 20 bp, Artificial
  CRISPR gRNA sequence
tgagttttaaaattggaatt

SEQ ID NO: 330857 - DNA, 20 bp, Artificial
  CRISPR gRNA sequence
cagagagatatgggaaaagt

SEQ ID NO: 330858 - DNA, 20 bp, Artificial
  CRISPR gRNA sequence
ctcactttgtaaaagtacga

SEQ ID NO: 330859 - DNA, 20 bp, Artificial
  CRISPR gRNA sequence
cctgataataaagataaagc

SEQ ID NO: 330860 - DNA, 20 bp, Artificial
  CRISPR gRNA sequence
ataaagataaagccccagat

SEQ ID NO: 330861 - DNA, 20 bp, Artificial
  CRISPR gRNA sequence
tttcttttcttttcagagaa

SEQ ID NO: 330862 - DNA, 20 bp, Artificial
  CRISPR gRNA sequence
tgcctcagcctcttaaagtg

SEQ ID NO: 330863 - DNA, 20 bp, Artificial
  CRISPR gRNA sequence
tttcattttctgaaataaat

SEQ ID NO: 330864 - DNA, 20 bp, Artificial
  CRISPR gRNA sequence
ttatgcttataggaagccaa

SEQ ID NO: 330865 - DNA, 20 bp, Artificial
  CRISPR gRNA sequence
aatcaccttggcctggtggt

SEQ ID NO: 330866 - DNA, 20 bp, Artificial
  CRISPR gRNA sequence
gctcattgccttctctttct

SEQ ID NO: 330867 - DNA, 20 bp, Artificial
  CRISPR gRNA sequence
atgacaaattttcatgctga

SEQ ID NO: 330868 - DNA, 20 bp, Artificial
  CRISPR gRNA sequence
tttgggaaaattattagtat

SEQ ID NO: 330869 - DNA, 20 bp, Artificial
  CRISPR gRNA sequence
attagtatgctggttttttc

SEQ ID NO: 330870 - DNA, 20 bp, Artificial
  CRISPR gRNA sequence
ctaagttttgaaatcttggt

SEQ ID NO: 330871 - DNA, 20 bp, Artificial
  CRISPR gRNA sequence
taaaatactaacgttggata

SEQ ID NO: 330872 - DNA, 20 bp, Artificial
  CRISPR gRNA sequence
tattgggattattttcagca

SEQ ID NO: 330873 - DNA, 20 bp, Artificial
  CRISPR gRNA sequence
aatattatgacatttggtca

SEQ ID NO: 330874 - DNA, 20 bp, Artificial
  CRISPR gRNA sequence
tataatactatgtattgcca

SEQ ID NO: 330875 - DNA, 20 bp, Artificial
  CRISPR gRNA sequence
tttgctttctgaaatttgta

SEQ ID NO: 330876 - DNA, 20 bp, Artificial
  CRISPR gRNA sequence
tacttattttcttaatgacc

SEQ ID NO: 330877 - DNA, 20 bp, Artificial
  CRISPR gRNA sequence
tccctatatatcttcaattt

SEQ ID NO: 330878 - DNA, 20 bp, Artificial
  CRISPR gRNA sequence
atatatcttcaatttgggtg

SEQ ID NO: 330879 - DNA, 20 bp, Artificial
  CRISPR gRNA sequence
ccagaaccccgagagacagg

SEQ ID NO: 330880 - DNA, 20 bp, Artificial
  CRISPR gRNA sequence
agagacaggcaaagcttgga

SEQ ID NO: 330881 - DNA, 20 bp, Artificial
  CRISPR gRNA sequence
ctgttctttcaaattcaaac

SEQ ID NO: 330882 - DNA, 20 bp, Artificial
  CRISPR gRNA sequence
aagaaataaaccagacctca

SEQ ID NO: 330883 - DNA, 20 bp, Artificial
  CRISPR gRNA sequence
caatccttgaattttcttta

SEQ ID NO: 330884 - DNA, 20 bp, Artificial
  CRISPR gRNA sequence
gatttgcattattattaccc

SEQ ID NO: 330885 - DNA, 20 bp, Artificial
  CRISPR gRNA sequence
tgcaaactattacaagaaga

SEQ ID NO: 330886 - DNA, 20 bp, Artificial
  CRISPR gRNA sequence
aacaaactacaaaaacaaac

SEQ ID NO: 330887 - DNA, 20 bp, Artificial
  CRISPR gRNA sequence
aggtccccaaaataaagtaa

SEQ ID NO: 330888 - DNA, 20 bp, Artificial
  CRISPR gRNA sequence
aaataaagtaattaagctta

SEQ ID NO: 330889 - DNA, 20 bp, Artificial
  CRISPR gRNA sequence
gaatcggccaaaaaaatgca

SEQ ID NO: 330890 - DNA, 20 bp, Artificial
  CRISPR gRNA sequence
tgagatttaaaactcaatag

SEQ ID NO: 330891 - DNA, 20 bp, Artificial
  CRISPR gRNA sequence
gttagaacccagtcacactc

SEQ ID NO: 330892 - DNA, 20 bp, Artificial
  CRISPR gRNA sequence
aaaagcagccagagaaaaga

SEQ ID NO: 330893 - DNA, 20 bp, Artificial
  CRISPR gRNA sequence
cttccaaggagcaactatta

SEQ ID NO: 330894 - DNA, 20 bp, Artificial
  CRISPR gRNA sequence
aacttttctaagtgaagtat

SEQ ID NO: 330895 - DNA, 20 bp, Artificial
  CRISPR gRNA sequence
ttctaagtgaagtatacatg

SEQ ID NO: 330896 - DNA, 20 bp, Artificial
  CRISPR gRNA sequence
agtatcacaaaattcagcct

SEQ ID NO: 330897 - DNA, 20 bp, Artificial
  CRISPR gRNA sequence
gtcttgtatttcttgacctg

SEQ ID NO: 330898 - DNA, 20 bp, Artificial
  CRISPR gRNA sequence
gtgattatgagggtaagata

SEQ ID NO: 330899 - DNA, 20 bp, Artificial
  CRISPR gRNA sequence
tttttttcacttttctatat

SEQ ID NO: 330900 - DNA, 20 bp, Artificial
  CRISPR gRNA sequence
ttcacttttctatatgtatg

SEQ ID NO: 330901 - DNA, 20 bp, Artificial
  CRISPR gRNA sequence
gttttgttttataataacaa

SEQ ID NO: 330902 - DNA, 20 bp, Artificial
  CRISPR gRNA sequence
gcatacagaaggaaaataat

SEQ ID NO: 330903 - DNA, 20 bp, Artificial
  CRISPR gRNA sequence
cagaaggaaaataatacttg

SEQ ID NO: 330904 - DNA, 20 bp, Artificial
  CRISPR gRNA sequence
tgagaacaggtgcagtctac

SEQ ID NO: 330905 - DNA, 20 bp, Artificial
  CRISPR gRNA sequence
ttagattaaaacgtagggta

SEQ ID NO: 330906 - DNA, 20 bp, Artificial
  CRISPR gRNA sequence
aaaacgtagggtattttgct

SEQ ID NO: 330907 - DNA, 20 bp, Artificial
  CRISPR gRNA sequence
agtaaaatatgttgccccac

SEQ ID NO: 330908 - DNA, 20 bp, Artificial
  CRISPR gRNA sequence
gcattgtcttctacttccga

SEQ ID NO: 330909 - DNA, 20 bp, Artificial
  CRISPR gRNA sequence
cttccgaagatgattttctc

SEQ ID NO: 330910 - DNA, 20 bp, Artificial
  CRISPR gRNA sequence
atcttaatgttatttctaac

SEQ ID NO: 330911 - DNA, 20 bp, Artificial
  CRISPR gRNA sequence
tatttctaacacctgctttc

SEQ ID NO: 330912 - DNA, 20 bp, Artificial
  CRISPR gRNA sequence
tgtgtgccactgacatcagc

SEQ ID NO: 330913 - DNA, 20 bp, Artificial
  CRISPR gRNA sequence
aacctctgcctcctaggttc

SEQ ID NO: 330914 - DNA, 20 bp, Artificial
  CRISPR gRNA sequence
ggttcaagcgattctgctgc

SEQ ID NO: 330915 - DNA, 20 bp, Artificial
  CRISPR gRNA sequence
ttttgtatttttagtagaga

SEQ ID NO: 330916 - DNA, 20 bp, Artificial
  CRISPR gRNA sequence
caccttggcctcccaaagtg

SEQ ID NO: 330917 - DNA, 20 bp, Artificial
  CRISPR gRNA sequence
gtagtgatcagaaggctgac

SEQ ID NO: 330918 - DNA, 20 bp, Artificial
  CRISPR gRNA sequence
gacttaggtttccacatatc

SEQ ID NO: 330919 - DNA, 20 bp, Artificial
  CRISPR gRNA sequence
tttaaactttccatctggaa

SEQ ID NO: 330920 - DNA, 20 bp, Artificial
  CRISPR gRNA sequence
cagctctaagtctgcagttc

SEQ ID NO: 330921 - DNA, 20 bp, Artificial
  CRISPR gRNA sequence
ttttggcagatatagaacag

SEQ ID NO: 330922 - DNA, 20 bp, Artificial
  CRISPR gRNA sequence
tatagaacagatatgcttgc

SEQ ID NO: 330923 - DNA, 20 bp, Artificial
  CRISPR gRNA sequence
agatatgcttgctatagctt

SEQ ID NO: 330924 - DNA, 20 bp, Artificial
  CRISPR gRNA sequence
tgggaggtggggcctttaag

SEQ ID NO: 330925 - DNA, 20 bp, Artificial
  CRISPR gRNA sequence
tgattggcagaacccccatg

SEQ ID NO: 330926 - DNA, 20 bp, Artificial
  CRISPR gRNA sequence
aattcatgggttaatgggtt

SEQ ID NO: 330927 - DNA, 20 bp, Artificial
  CRISPR gRNA sequence
gagttagtatgttataaaca

SEQ ID NO: 330928 - DNA, 20 bp, Artificial
  CRISPR gRNA sequence
ccaccagaaagaaggccctc

SEQ ID NO: 330929 - DNA, 20 bp, Artificial
  CRISPR gRNA sequence
tttaaggaagatctgaatac

SEQ ID NO: 330930 - DNA, 20 bp, Artificial
  CRISPR gRNA sequence
acttttatagatagtgtctg

SEQ ID NO: 330931 - DNA, 20 bp, Artificial
  CRISPR gRNA sequence
ttgttctttcttcctttttc

SEQ ID NO: 330932 - DNA, 20 bp, Artificial
  CRISPR gRNA sequence
tactatctttgatatgctcc

SEQ ID NO: 330933 - DNA, 20 bp, Artificial
  CRISPR gRNA sequence
taataaatttcatcaacact

SEQ ID NO: 330934 - DNA, 20 bp, Artificial
  CRISPR gRNA sequence
tcaggcatcctataaatacc

SEQ ID NO: 330935 - DNA, 20 bp, Artificial
  CRISPR gRNA sequence
aataccctcagctttacact

SEQ ID NO: 330936 - DNA, 20 bp, Artificial
  CRISPR gRNA sequence
tacactttttgtttcctgta

SEQ ID NO: 330937 - DNA, 20 bp, Artificial
  CRISPR gRNA sequence
tacagacaactgaaggccca

SEQ ID NO: 330938 - DNA, 20 bp, Artificial
  CRISPR gRNA sequence
aaattatttgcccgaggtca

SEQ ID NO: 330939 - DNA, 20 bp, Artificial
  CRISPR gRNA sequence
acacagcttcctgggtgcat

SEQ ID NO: 330940 - DNA, 20 bp, Artificial
  CRISPR gRNA sequence
gaacgcctaatttccagcac

SEQ ID NO: 330941 - DNA, 20 bp, Artificial
  CRISPR gRNA sequence
tctatccacttctcctccat

SEQ ID NO: 330942 - DNA, 20 bp, Artificial
  CRISPR gRNA sequence
tcatctctctctgggactac

SEQ ID NO: 330943 - DNA, 20 bp, Artificial
  CRISPR gRNA sequence
ctctctgggactacaagagc

SEQ ID NO: 330944 - DNA, 20 bp, Artificial
  CRISPR gRNA sequence
ataatccaatagagtcattg

SEQ ID NO: 330945 - DNA, 20 bp, Artificial
  CRISPR gRNA sequence
gttctgcttataaaacctcc

SEQ ID NO: 330946 - DNA, 20 bp, Artificial
  CRISPR gRNA sequence
agtaaaatctaagttcttac

SEQ ID NO: 330947 - DNA, 20 bp, Artificial
  CRISPR gRNA sequence
aaacacacaaagcaggttcc

SEQ ID NO: 330948 - DNA, 20 bp, Artificial
  CRISPR gRNA sequence
ttctccacctagaacattct

SEQ ID NO: 330949 - DNA, 20 bp, Artificial
  CRISPR gRNA sequence
attctctctgattttcacat

SEQ ID NO: 330950 - DNA, 20 bp, Artificial
  CRISPR gRNA sequence
tttatcactgtctgaaatta

SEQ ID NO: 330951 - DNA, 20 bp, Artificial
  CRISPR gRNA sequence
tgtctgaaattatctggttt

SEQ ID NO: 330952 - DNA, 20 bp, Artificial
  CRISPR gRNA sequence
tgaaattatctggtttatct

SEQ ID NO: 330953 - DNA, 20 bp, Artificial
  CRISPR gRNA sequence
tattgtctggctactccact

SEQ ID NO: 330954 - DNA, 20 bp, Artificial
  CRISPR gRNA sequence
taaatctgaggagatgaagc

SEQ ID NO: 330955 - DNA, 20 bp, Artificial
  CRISPR gRNA sequence
atttataatataagagccaa

SEQ ID NO: 330956 - DNA, 20 bp, Artificial
  CRISPR gRNA sequence
agaaaaggtgactatcttgc

SEQ ID NO: 330957 - DNA, 20 bp, Artificial
  CRISPR gRNA sequence
cagagttagctatgccatat

SEQ ID NO: 330958 - DNA, 20 bp, Artificial
  CRISPR gRNA sequence
ttctaatggaaattatctgt

SEQ ID NO: 330959 - DNA, 20 bp, Artificial
  CRISPR gRNA sequence
atggttgttctaatatacca

SEQ ID NO: 330960 - DNA, 20 bp, Artificial
  CRISPR gRNA sequence
ttttataaacacagcatgtt

SEQ ID NO: 330961 - DNA, 20 bp, Artificial
  CRISPR gRNA sequence
taaaatctgaatattaaaca

SEQ ID NO: 330962 - DNA, 20 bp, Artificial
  CRISPR gRNA sequence
tctgaatattaaacatgagg

SEQ ID NO: 330963 - DNA, 20 bp, Artificial
  CRISPR gRNA sequence
aggttttgttttgctaccat

SEQ ID NO: 330964 - DNA, 20 bp, Artificial
  CRISPR gRNA sequence
gtttactttttattggaaac

SEQ ID NO: 330965 - DNA, 20 bp, Artificial
  CRISPR gRNA sequence
ggcaggaggatcacgaggtc

SEQ ID NO: 330966 - DNA, 20 bp, Artificial
  CRISPR gRNA sequence
tcaggaggctgaggcaggag

SEQ ID NO: 330967 - DNA, 20 bp, Artificial
  CRISPR gRNA sequence
gagtcagaggttgcagtgag

SEQ ID NO: 330968 - DNA, 20 bp, Artificial
  CRISPR gRNA sequence
tactgttgatatcaatagac

SEQ ID NO: 330969 - DNA, 20 bp, Artificial
  CRISPR gRNA sequence
ctttatattaagtgatctct

SEQ ID NO: 330970 - DNA, 20 bp, Artificial
  CRISPR gRNA sequence
agatgagttcatttgcaagt

SEQ ID NO: 330971 - DNA, 20 bp, Artificial
  CRISPR gRNA sequence
tgatggaaagataagatgtc

SEQ ID NO: 330972 - DNA, 20 bp, Artificial
  CRISPR gRNA sequence
cctgagtttgtaatcattga

SEQ ID NO: 330973 - DNA, 20 bp, Artificial
  CRISPR gRNA sequence
gtaatcaaacaatgataagt

SEQ ID NO: 330974 - DNA, 20 bp, Artificial
  CRISPR gRNA sequence
aggcaaaagtctaaaaattg

SEQ ID NO: 330975 - DNA, 20 bp, Artificial
  CRISPR gRNA sequence
taaaaattgcaatgtttata

SEQ ID NO: 330976 - DNA, 20 bp, Artificial
  CRISPR gRNA sequence
tattaggttttagttatatt

SEQ ID NO: 330977 - DNA, 20 bp, Artificial
  CRISPR gRNA sequence
aaacctttagatccctggtt

SEQ ID NO: 330978 - DNA, 20 bp, Artificial
  CRISPR gRNA sequence
gaacacacacacaatgtgtg

SEQ ID NO: 330979 - DNA, 20 bp, Artificial
  CRISPR gRNA sequence
gtgtgtataataagaaaaat

SEQ ID NO: 330980 - DNA, 20 bp, Artificial
  CRISPR gRNA sequence
gtataataagaaaaatgaaa

SEQ ID NO: 330981 - DNA, 20 bp, Artificial
  CRISPR gRNA sequence
attgattttctcctagttaa

SEQ ID NO: 330982 - DNA, 20 bp, Artificial
  CRISPR gRNA sequence
tttgttagttacttcattgc

SEQ ID NO: 330983 - DNA, 20 bp, Artificial
  CRISPR gRNA sequence
tattgtactagggaaatcat

SEQ ID NO: 330984 - DNA, 20 bp, Artificial
  CRISPR gRNA sequence
ttccacagagtgggagggag

SEQ ID NO: 330985 - DNA, 20 bp, Artificial
  CRISPR gRNA sequence
tccacacctctgaataccca

SEQ ID NO: 330986 - DNA, 20 bp, Artificial
  CRISPR gRNA sequence
tccagcccaaacttctagtt

SEQ ID NO: 330987 - DNA, 20 bp, Artificial
  CRISPR gRNA sequence
aattcctttcaacatcacta

SEQ ID NO: 330988 - DNA, 20 bp, Artificial
  CRISPR gRNA sequence
gtatatatggtggcggtccc

SEQ ID NO: 330989 - DNA, 20 bp, Artificial
  CRISPR gRNA sequence
aaatttttaatgtccctttt

SEQ ID NO: 330990 - DNA, 20 bp, Artificial
  CRISPR gRNA sequence
tcagtacagtaacatgctgt

SEQ ID NO: 330991 - DNA, 20 bp, Artificial
  CRISPR gRNA sequence
tcttcctcatttcttcctct

SEQ ID NO: 330992 - DNA, 20 bp, Artificial
  CRISPR gRNA sequence
cctccatgctgctcccaaaa

SEQ ID NO: 330993 - DNA, 20 bp, Artificial
  CRISPR gRNA sequence
ttcagaaaagcatttcactc

SEQ ID NO: 330994 - DNA, 20 bp, Artificial
  CRISPR gRNA sequence
aaaagtctctattagtgttc

SEQ ID NO: 330995 - DNA, 20 bp, Artificial
  CRISPR gRNA sequence
ttagtgttctattgcttata

SEQ ID NO: 330996 - DNA, 20 bp, Artificial
  CRISPR gRNA sequence
ggtgttttaaaatatatata

SEQ ID NO: 330997 - DNA, 20 bp, Artificial
  CRISPR gRNA sequence
tatatatctggcttgacaca

SEQ ID NO: 330998 - DNA, 20 bp, Artificial
  CRISPR gRNA sequence
ttctgttctttactactaga

SEQ ID NO: 330999 - DNA, 20 bp, Artificial
  CRISPR gRNA sequence
ctgttaccatgaactaaaat

SEQ ID NO: 331000 - DNA, 20 bp, Artificial
  CRISPR gRNA sequence
tttctatgctcccaataata

SEQ ID NO: 331001 - DNA, 20 bp, Artificial
  CRISPR gRNA sequence
cagaagaatataaaggctaa

SEQ ID NO: 331002 - DNA, 20 bp, Artificial
  CRISPR gRNA sequence
agagcaaagatcctatttac

SEQ ID NO: 331003 - DNA, 20 bp, Artificial
  CRISPR gRNA sequence
tctgaccggagaagctgagc

SEQ ID NO: 331004 - DNA, 20 bp, Artificial
  CRISPR gRNA sequence
agctgagcgtctgtttgtgg

SEQ ID NO: 331005 - DNA, 20 bp, Artificial
  CRISPR gRNA sequence
gggaggccgtgaatccagca

SEQ ID NO: 331006 - DNA, 20 bp, Artificial
  CRISPR gRNA sequence
tgggaggcagaaagcctcag

SEQ ID NO: 331007 - DNA, 20 bp, Artificial
  CRISPR gRNA sequence
acttggggcggttagaggag

SEQ ID NO: 331008 - DNA, 20 bp, Artificial
  CRISPR gRNA sequence
gattagagtgagaccagccc

SEQ ID NO: 331009 - DNA, 20 bp, Artificial
  CRISPR gRNA sequence
tctggatgagacctgtgact

SEQ ID NO: 331010 - DNA, 20 bp, Artificial
  CRISPR gRNA sequence
cctctctatactattacagc

SEQ ID NO: 331011 - DNA, 20 bp, Artificial
  CRISPR gRNA sequence
ccaataccagcccagagccg

SEQ ID NO: 331012 - DNA, 20 bp, Artificial
  CRISPR gRNA sequence
agaagagagacaacaatcac

SEQ ID NO: 331013 - DNA, 20 bp, Artificial
  CRISPR gRNA sequence
cagaaatattcaaggaaata

SEQ ID NO: 331014 - DNA, 20 bp, Artificial
  CRISPR gRNA sequence
acaactagaagaaagaaatt

SEQ ID NO: 331015 - DNA, 20 bp, Artificial
  CRISPR gRNA sequence
aaactaaagcatcagagcta

SEQ ID NO: 331016 - DNA, 20 bp, Artificial
  CRISPR gRNA sequence
tacgaaataaaaaaacaaaa

SEQ ID NO: 331017 - DNA, 20 bp, Artificial
  CRISPR gRNA sequence
attggtgccacatatgtgtt

SEQ ID NO: 331018 - DNA, 20 bp, Artificial
  CRISPR gRNA sequence
tctgatgaagtctaaattct

SEQ ID NO: 331019 - DNA, 20 bp, Artificial
  CRISPR gRNA sequence
tgcctgtagaaatgtacaga

SEQ ID NO: 331020 - DNA, 20 bp, Artificial
  CRISPR gRNA sequence
aagtgcaaataggcacatct

SEQ ID NO: 331021 - DNA, 20 bp, Artificial
  CRISPR gRNA sequence
ctttaactgtgagtgcagta

SEQ ID NO: 331022 - DNA, 20 bp, Artificial
  CRISPR gRNA sequence
agacagcttgttgttgttat

SEQ ID NO: 331023 - DNA, 20 bp, Artificial
  CRISPR gRNA sequence
gttattgttgtttttgcatg

SEQ ID NO: 331024 - DNA, 20 bp, Artificial
  CRISPR gRNA sequence
gttacctttaaatgatcatt

SEQ ID NO: 331025 - DNA, 20 bp, Artificial
  CRISPR gRNA sequence
tatcaccctatttggggaca

SEQ ID NO: 331026 - DNA, 20 bp, Artificial
  CRISPR gRNA sequence
accagaaggaagttcatatc

SEQ ID NO: 331027 - DNA, 20 bp, Artificial
  CRISPR gRNA sequence
ctctaaacttgcaaatcttt

SEQ ID NO: 331028 - DNA, 20 bp, Artificial
  CRISPR gRNA sequence
aatataattgtgaattttta

SEQ ID NO: 331029 - DNA, 20 bp, Artificial
  CRISPR gRNA sequence
tttttataaggtttcaaatg

SEQ ID NO: 331030 - DNA, 20 bp, Artificial
  CRISPR gRNA sequence
aaaaagtgccatttgacaga

SEQ ID NO: 331031 - DNA, 20 bp, Artificial
  CRISPR gRNA sequence
cttcagttattgcaagctac

SEQ ID NO: 331032 - DNA, 20 bp, Artificial
  CRISPR gRNA sequence
agtagggaagcagtatatgt

SEQ ID NO: 331033 - DNA, 20 bp, Artificial
  CRISPR gRNA sequence
gcagtatatgttgtagattt

SEQ ID NO: 331034 - DNA, 20 bp, Artificial
  CRISPR gRNA sequence
gtcccccctacatgcctgca

SEQ ID NO: 331035 - DNA, 20 bp, Artificial
  CRISPR gRNA sequence
gtggggaaaaacagcataag

SEQ ID NO: 331036 - DNA, 20 bp, Artificial
  CRISPR gRNA sequence
aaaatgactgaaatgaagaa

SEQ ID NO: 331037 - DNA, 20 bp, Artificial
  CRISPR gRNA sequence
tgaagaataaagcttgagtc

SEQ ID NO: 331038 - DNA, 20 bp, Artificial
  CRISPR gRNA sequence
ttgggaggctgaggcaggag

SEQ ID NO: 331039 - DNA, 20 bp, Artificial
  CRISPR gRNA sequence
gaggtggaggttgcagtaag

SEQ ID NO: 331040 - DNA, 20 bp, Artificial
  CRISPR gRNA sequence
tgaattccaatactgaagta

SEQ ID NO: 331041 - DNA, 20 bp, Artificial
  CRISPR gRNA sequence
aatactgaagtaaatagctt

SEQ ID NO: 331042 - DNA, 20 bp, Artificial
  CRISPR gRNA sequence
ctttcaagattatgaaattc

SEQ ID NO: 331043 - DNA, 20 bp, Artificial
  CRISPR gRNA sequence
ataagagaagtcttctgatc

SEQ ID NO: 331044 - DNA, 20 bp, Artificial
  CRISPR gRNA sequence
tatgtgatgtaagtgttaag

SEQ ID NO: 331045 - DNA, 20 bp, Artificial
  CRISPR gRNA sequence
cctagcaatgatctgcaact

SEQ ID NO: 331046 - DNA, 20 bp, Artificial
  CRISPR gRNA sequence
ataaacaagtagacattcaa

SEQ ID NO: 331047 - DNA, 20 bp, Artificial
  CRISPR gRNA sequence
acatagaaataaaatcaagt

SEQ ID NO: 331048 - DNA, 20 bp, Artificial
  CRISPR gRNA sequence
tcaaaagaaaaaattgacaa

SEQ ID NO: 331049 - DNA, 20 bp, Artificial
  CRISPR gRNA sequence
gtggccttgagggctatcct

SEQ ID NO: 331050 - DNA, 20 bp, Artificial
  CRISPR gRNA sequence
cagaacacatcataatacat

SEQ ID NO: 331051 - DNA, 20 bp, Artificial
  CRISPR gRNA sequence
ccaatctggtgtattatcca

SEQ ID NO: 331052 - DNA, 20 bp, Artificial
  CRISPR gRNA sequence
ccatcaaagactagaaatca

SEQ ID NO: 331053 - DNA, 20 bp, Artificial
  CRISPR gRNA sequence
aacaaaggtgatcagaatca

SEQ ID NO: 331054 - DNA, 20 bp, Artificial
  CRISPR gRNA sequence
atcattgagatttacgttcc

SEQ ID NO: 331055 - DNA, 20 bp, Artificial
  CRISPR gRNA sequence
ttacacctccactacttcaa

SEQ ID NO: 331056 - DNA, 20 bp, Artificial
  CRISPR gRNA sequence
gagaaagcctatgtaaattg

SEQ ID NO: 331057 - DNA, 20 bp, Artificial
  CRISPR gRNA sequence
caacagaggacaagcaagta

SEQ ID NO: 331058 - DNA, 20 bp, Artificial
  CRISPR gRNA sequence
caagcaagtacttagtttac

SEQ ID NO: 331059 - DNA, 20 bp, Artificial
  CRISPR gRNA sequence
tgagtttggctctttttctt

SEQ ID NO: 331060 - DNA, 20 bp, Artificial
  CRISPR gRNA sequence
tttctttagagcttttacat

SEQ ID NO: 331061 - DNA, 20 bp, Artificial
  CRISPR gRNA sequence
ttttaaataggatcattgct

SEQ ID NO: 331062 - DNA, 20 bp, Artificial
  CRISPR gRNA sequence
accatttagccactcgtgcc

SEQ ID NO: 331063 - DNA, 20 bp, Artificial
  CRISPR gRNA sequence
ccaaacagcatgccacatct

SEQ ID NO: 331064 - DNA, 20 bp, Artificial
  CRISPR gRNA sequence
ttccagaatacaaattattc

SEQ ID NO: 331065 - DNA, 20 bp, Artificial
  CRISPR gRNA sequence
ccacaaccagaactgcccaa

SEQ ID NO: 331066 - DNA, 20 bp, Artificial
  CRISPR gRNA sequence
caaattggtttggcctagtt

SEQ ID NO: 331067 - DNA, 20 bp, Artificial
  CRISPR gRNA sequence
ctttgtgctcaggcacatct

SEQ ID NO: 331068 - DNA, 20 bp, Artificial
  CRISPR gRNA sequence
taccttcataccgttctccc

SEQ ID NO: 331069 - DNA, 20 bp, Artificial
  CRISPR gRNA sequence
tgttacattccctcatataa

SEQ ID NO: 331070 - DNA, 20 bp, Artificial
  CRISPR gRNA sequence
cctgtaattatcattaatca

SEQ ID NO: 331071 - DNA, 20 bp, Artificial
  CRISPR gRNA sequence
tatcattaatcaatgggatt

SEQ ID NO: 331072 - DNA, 20 bp, Artificial
  CRISPR gRNA sequence
ttccaaagaacaggggttga

SEQ ID NO: 331073 - DNA, 20 bp, Artificial
  CRISPR gRNA sequence
tcatgccgctaaaggacttc

SEQ ID NO: 331074 - DNA, 20 bp, Artificial
  CRISPR gRNA sequence
caagatgaaacatttgatca

SEQ ID NO: 331075 - DNA, 20 bp, Artificial
  CRISPR gRNA sequence
ctaaaagttctgccttcact

SEQ ID NO: 331076 - DNA, 20 bp, Artificial
  CRISPR gRNA sequence
tctgccttcacttttagttt

SEQ ID NO: 331077 - DNA, 20 bp, Artificial
  CRISPR gRNA sequence
ttttacattatcctttcctc

SEQ ID NO: 331078 - DNA, 20 bp, Artificial
  CRISPR gRNA sequence
tcagataacagatcatccag

SEQ ID NO: 331079 - DNA, 20 bp, Artificial
  CRISPR gRNA sequence
agttaagaggattgaggaat

SEQ ID NO: 331080 - DNA, 20 bp, Artificial
  CRISPR gRNA sequence
cttgctggtttatgcctttt

SEQ ID NO: 331081 - DNA, 20 bp, Artificial
  CRISPR gRNA sequence
gaggtaaggttagggaacta

SEQ ID NO: 331082 - DNA, 20 bp, Artificial
  CRISPR gRNA sequence
tggttgtggtattatgctca

SEQ ID NO: 331083 - DNA, 20 bp, Artificial
  CRISPR gRNA sequence
ccaatgttcactctcattat

SEQ ID NO: 331084 - DNA, 20 bp, Artificial
  CRISPR gRNA sequence
tatctccacaatgcatgtat

SEQ ID NO: 331085 - DNA, 20 bp, Artificial
  CRISPR gRNA sequence
aactgccatgtaaaagctct

SEQ ID NO: 331086 - DNA, 20 bp, Artificial
  CRISPR gRNA sequence
cttacctttagtcagtgttt

SEQ ID NO: 331087 - DNA, 20 bp, Artificial
  CRISPR gRNA sequence
agtctttgatggatctcaat

SEQ ID NO: 331088 - DNA, 20 bp, Artificial
  CRISPR gRNA sequence
tgatgggacaaattctggtt

SEQ ID NO: 331089 - DNA, 20 bp, Artificial
  CRISPR gRNA sequence
actaagtaattgacatgttc

SEQ ID NO: 331090 - DNA, 20 bp, Artificial
  CRISPR gRNA sequence
cctgcactgatatgagaact

SEQ ID NO: 331091 - DNA, 20 bp, Artificial
  CRISPR gRNA sequence
acagtatttctcttctgttt

SEQ ID NO: 331092 - DNA, 20 bp, Artificial
  CRISPR gRNA sequence
ttgtaaaaaaaaaaaaaact

SEQ ID NO: 331093 - DNA, 20 bp, Artificial
  CRISPR gRNA sequence
gctgtttttccccactcttt

SEQ ID NO: 331094 - DNA, 20 bp, Artificial
  CRISPR gRNA sequence
tagcatattcccatttcttg

SEQ ID NO: 331095 - DNA, 20 bp, Artificial
  CRISPR gRNA sequence
catatactgcttccctactc

SEQ ID NO: 331096 - DNA, 20 bp, Artificial
  CRISPR gRNA sequence
atttgtagcttgcaataact

SEQ ID NO: 331097 - DNA, 20 bp, Artificial
  CRISPR gRNA sequence
cacaaattgaaagtgttagt

SEQ ID NO: 331098 - DNA, 20 bp, Artificial
  CRISPR gRNA sequence
agatttgcaagtttagagag

SEQ ID NO: 331099 - DNA, 20 bp, Artificial
  CRISPR gRNA sequence
ctactttgcttgaggaaaaa

SEQ ID NO: 331100 - DNA, 20 bp, Artificial
  CRISPR gRNA sequence
ttcttctaggactttgcaac

SEQ ID NO: 331101 - DNA, 20 bp, Artificial
  CRISPR gRNA sequence
ataagtgatgggaaaatcat

SEQ ID NO: 331102 - DNA, 20 bp, Artificial
  CRISPR gRNA sequence
gaattctttttcaggtagat

SEQ ID NO: 331103 - DNA, 20 bp, Artificial
  CRISPR gRNA sequence
ctgccaggaggtggcgcttt

SEQ ID NO: 331104 - DNA, 20 bp, Artificial
  CRISPR gRNA sequence
ctttctgcctcccagctgtg

SEQ ID NO: 331105 - DNA, 20 bp, Artificial
  CRISPR gRNA sequence
aatagttacaaagttcagct

SEQ ID NO: 331106 - DNA, 20 bp, Artificial
  CRISPR gRNA sequence
tggatccctgtggtgcctgg

SEQ ID NO: 331107 - DNA, 20 bp, Artificial
  CRISPR gRNA sequence
aacaaagtattattgggagc

SEQ ID NO: 331108 - DNA, 20 bp, Artificial
  CRISPR gRNA sequence
aatggttcttgaagagtgaa

SEQ ID NO: 331109 - DNA, 20 bp, Artificial
  CRISPR gRNA sequence
aaatattttagttcatggta

SEQ ID NO: 331110 - DNA, 20 bp, Artificial
  CRISPR gRNA sequence
tagtaaagaacagaagtgtg

SEQ ID NO: 331111 - DNA, 20 bp, Artificial
  CRISPR gRNA sequence
tgtggattggcaatgggaat

SEQ ID NO: 331112 - DNA, 20 bp, Artificial
  CRISPR gRNA sequence
ttggcaatgggaatggagaa

SEQ ID NO: 331113 - DNA, 20 bp, Artificial
  CRISPR gRNA sequence
atgatgaaaatcagagagag

SEQ ID NO: 331114 - DNA, 20 bp, Artificial
  CRISPR gRNA sequence
ttgacgatgggaatacattc

SEQ ID NO: 331115 - DNA, 20 bp, Artificial
  CRISPR gRNA sequence
gaactagaagtttgggctgg

SEQ ID NO: 331116 - DNA, 20 bp, Artificial
  CRISPR gRNA sequence
gggattttttcatttttcat

SEQ ID NO: 331117 - DNA, 20 bp, Artificial
  CRISPR gRNA sequence
gaagaaatcagttttaacta

SEQ ID NO: 331118 - DNA, 20 bp, Artificial
  CRISPR gRNA sequence
ctttgaatagcaatgtaagt

SEQ ID NO: 331119 - DNA, 20 bp, Artificial
  CRISPR gRNA sequence
gacattgcttttatgaaagg

SEQ ID NO: 331120 - DNA, 20 bp, Artificial
  CRISPR gRNA sequence
aagtacttttttttttaatg

SEQ ID NO: 331121 - DNA, 20 bp, Artificial
  CRISPR gRNA sequence
acacttatcattgtttgatt

SEQ ID NO: 331122 - DNA, 20 bp, Artificial
  CRISPR gRNA sequence
tgtggttagaagtctgagtt

SEQ ID NO: 331123 - DNA, 20 bp, Artificial
  CRISPR gRNA sequence
tcaggtgaatgaccttttct

SEQ ID NO: 331124 - DNA, 20 bp, Artificial
  CRISPR gRNA sequence
ttaatagtcccccaaaagaa

SEQ ID NO: 331125 - DNA, 20 bp, Artificial
  CRISPR gRNA sequence
cagtcttgagcctctactgg

SEQ ID NO: 331126 - DNA, 20 bp, Artificial
  CRISPR gRNA sequence
gacacagtattctatgtgat

SEQ ID NO: 331127 - DNA, 20 bp, Artificial
  CRISPR gRNA sequence
ccacagacatataagagcca

SEQ ID NO: 331128 - DNA, 20 bp, Artificial
  CRISPR gRNA sequence
cccagtggatatttgaaggt

SEQ ID NO: 331129 - DNA, 20 bp, Artificial
  CRISPR gRNA sequence
tcttcatacacttgtttcca

SEQ ID NO: 331130 - DNA, 20 bp, Artificial
  CRISPR gRNA sequence
tggagtagccagacaataaa

SEQ ID NO: 331131 - DNA, 20 bp, Artificial
  CRISPR gRNA sequence
agcagccatgtgaaaatcag

SEQ ID NO: 331132 - DNA, 20 bp, Artificial
  CRISPR gRNA sequence
tcagagagaatgttctaggt

SEQ ID NO: 331133 - DNA, 20 bp, Artificial
  CRISPR gRNA sequence
gaatgttctaggtggagaaa

SEQ ID NO: 331134 - DNA, 20 bp, Artificial
  CRISPR gRNA sequence
ctgctttgtgtgtttgagga

SEQ ID NO: 331135 - DNA, 20 bp, Artificial
  CRISPR gRNA sequence
ggtcattctggtttctctgt

SEQ ID NO: 331136 - DNA, 20 bp, Artificial
  CRISPR gRNA sequence
ttatattaaaggtggtatgg

SEQ ID NO: 331137 - DNA, 20 bp, Artificial
  CRISPR gRNA sequence
atgggaagaaaaggcaaaca

SEQ ID NO: 331138 - DNA, 20 bp, Artificial
  CRISPR gRNA sequence
aaggcaaacatgagaaaaag

SEQ ID NO: 331139 - DNA, 20 bp, Artificial
  CRISPR gRNA sequence
ttttaactactggtatggca

SEQ ID NO: 331140 - DNA, 20 bp, Artificial
  CRISPR gRNA sequence
taagaacatccaagaaggat

SEQ ID NO: 331141 - DNA, 20 bp, Artificial
  CRISPR gRNA sequence
cctagatgcttttgcagtta

SEQ ID NO: 331142 - DNA, 20 bp, Artificial
  CRISPR gRNA sequence
caaatgttaccaaaggctaa

SEQ ID NO: 331143 - DNA, 20 bp, Artificial
  CRISPR gRNA sequence
ccggagactgggtaatttat

SEQ ID NO: 331144 - DNA, 20 bp, Artificial
  CRISPR gRNA sequence
gactgggtaatttataaaga

SEQ ID NO: 331145 - DNA, 20 bp, Artificial
  CRISPR gRNA sequence
ctacttgggaagctgaggca

SEQ ID NO: 331146 - DNA, 20 bp, Artificial
  CRISPR gRNA sequence
aaaaaaaaaaagagtgtcca

SEQ ID NO: 331147 - DNA, 20 bp, Artificial
  CRISPR gRNA sequence
cacactctcaacatgccatt

SEQ ID NO: 331148 - DNA, 20 bp, Artificial
  CRISPR gRNA sequence
tacctaaatacttttgtggg

SEQ ID NO: 331149 - DNA, 20 bp, Artificial
  CRISPR gRNA sequence
tagcccattatgatattgag

SEQ ID NO: 331150 - DNA, 20 bp, Artificial
  CRISPR gRNA sequence
tggaagacttacccaacagc

SEQ ID NO: 331151 - DNA, 20 bp, Artificial
  CRISPR gRNA sequence
tatattctgatgctgaatcc

SEQ ID NO: 331152 - DNA, 20 bp, Artificial
  CRISPR gRNA sequence
gaatccagagaaagcaggtg

SEQ ID NO: 331153 - DNA, 20 bp, Artificial
  CRISPR gRNA sequence
gagccttgctagtggcagag

SEQ ID NO: 331154 - DNA, 20 bp, Artificial
  CRISPR gRNA sequence
acaatgggggaaaaatctgc

SEQ ID NO: 331155 - DNA, 20 bp, Artificial
  CRISPR gRNA sequence
ttataaaacaaaacatacat

SEQ ID NO: 331156 - DNA, 20 bp, Artificial
  CRISPR gRNA sequence
ccctcataatcaccacaggt

SEQ ID NO: 331157 - DNA, 20 bp, Artificial
  CRISPR gRNA sequence
tctattttttagtaattatg

SEQ ID NO: 331158 - DNA, 20 bp, Artificial
  CRISPR gRNA sequence
tcaaaacatgtatacttcac

SEQ ID NO: 331159 - DNA, 20 bp, Artificial
  CRISPR gRNA sequence
ataataatgcaaatctcctt

SEQ ID NO: 331160 - DNA, 20 bp, Artificial
  CRISPR gRNA sequence
ttatttctttacctgtgctc

SEQ ID NO: 331161 - DNA, 20 bp, Artificial
  CRISPR gRNA sequence
catttttggttgttttggcg

SEQ ID NO: 331162 - DNA, 20 bp, Artificial
  CRISPR gRNA sequence
aaattgaagcccagggtcat

SEQ ID NO: 331163 - DNA, 20 bp, Artificial
  CRISPR gRNA sequence
tgctaatcctgttacaaatt

SEQ ID NO: 331164 - DNA, 20 bp, Artificial
  CRISPR gRNA sequence
taaaaaggaaaataaaacaa

SEQ ID NO: 331165 - DNA, 20 bp, Artificial
  CRISPR gRNA sequence
tgaatttatagtctaataac

SEQ ID NO: 331166 - DNA, 20 bp, Artificial
  CRISPR gRNA sequence
cctataagcataaatttatt

SEQ ID NO: 331167 - DNA, 20 bp, Artificial
  CRISPR gRNA sequence
gagtaaacccttttctctga

SEQ ID NO: 331168 - DNA, 20 bp, Artificial
  CRISPR gRNA sequence
aacccttttctctgaaaaga

SEQ ID NO: 331169 - DNA, 20 bp, Artificial
  CRISPR gRNA sequence
ttttctctgaaaagaaaaga

SEQ ID NO: 331170 - DNA, 20 bp, Artificial
  CRISPR gRNA sequence
tctgaaaagaaaagaaaaga

SEQ ID NO: 331171 - DNA, 20 bp, Artificial
  CRISPR gRNA sequence
aaagaaaagaaaagaaagag

SEQ ID NO: 331172 - DNA, 20 bp, Artificial
  CRISPR gRNA sequence
gttctcagtggatgaggttt

SEQ ID NO: 331173 - DNA, 20 bp, Artificial
  CRISPR gRNA sequence
ttcttccttgaggggtggag

SEQ ID NO: 331174 - DNA, 20 bp, Artificial
  CRISPR gRNA sequence
gttttctttctttttatgca

SEQ ID NO: 331175 - DNA, 20 bp, Artificial
  CRISPR gRNA sequence
taatcccatagactgctaag

SEQ ID NO: 331176 - DNA, 20 bp, Artificial
  CRISPR gRNA sequence
cctcttttataaaaatatag

SEQ ID NO: 331177 - DNA, 20 bp, Artificial
  CRISPR gRNA sequence
ctggatttcatgactataat

SEQ ID NO: 331178 - DNA, 20 bp, Artificial
  CRISPR gRNA sequence
gtaagagaacttgtggttca

SEQ ID NO: 331179 - DNA, 20 bp, Artificial
  CRISPR gRNA sequence
aacatacctttttttccaat

SEQ ID NO: 331180 - DNA, 20 bp, Artificial
  CRISPR gRNA sequence
aattaaactaatcacttgga

SEQ ID NO: 331181 - DNA, 20 bp, Artificial
  CRISPR gRNA sequence
ggtaagttaaaaacagtcag

SEQ ID NO: 331182 - DNA, 20 bp, Artificial
  CRISPR gRNA sequence
ttattagactccttgctttt

SEQ ID NO: 331183 - DNA, 20 bp, Artificial
  CRISPR gRNA sequence
gaaaaccactgaggagctat

SEQ ID NO: 331184 - DNA, 20 bp, Artificial
  CRISPR gRNA sequence
gaaagagacataaagaagga

SEQ ID NO: 331185 - DNA, 20 bp, Artificial
  CRISPR gRNA sequence
catggtctaagtctgctggg

SEQ ID NO: 331186 - DNA, 20 bp, Artificial
  CRISPR gRNA sequence
acaataaaggcaaaaacgag

SEQ ID NO: 331187 - DNA, 20 bp, Artificial
  CRISPR gRNA sequence
aaaacgaggaagaaagttca

SEQ ID NO: 331188 - DNA, 20 bp, Artificial
  CRISPR gRNA sequence
ttgtcacataccacttcaac

SEQ ID NO: 331189 - DNA, 20 bp, Artificial
  CRISPR gRNA sequence
acataccacttcaacaaaga

SEQ ID NO: 331190 - DNA, 20 bp, Artificial
  CRISPR gRNA sequence
tcaaaaaacaaagagatgga

SEQ ID NO: 331191 - DNA, 20 bp, Artificial
  CRISPR gRNA sequence
aacatctccaaggcctaatt

SEQ ID NO: 331192 - DNA, 20 bp, Artificial
  CRISPR gRNA sequence
ggtactgctagagggaagaa

SEQ ID NO: 331193 - DNA, 20 bp, Artificial
  CRISPR gRNA sequence
ttgaccttttctgttaagag

SEQ ID NO: 331194 - DNA, 20 bp, Artificial
  CRISPR gRNA sequence
ttgccaagtttgaggagcac

SEQ ID NO: 331195 - DNA, 20 bp, Artificial
  CRISPR gRNA sequence
cacatttcatgttttagatg

SEQ ID NO: 331196 - DNA, 20 bp, Artificial
  CRISPR gRNA sequence
gagaagtgtacagatgcctc

SEQ ID NO: 331197 - DNA, 20 bp, Artificial
  CRISPR gRNA sequence
cctacttgggatgagtcttc

SEQ ID NO: 331198 - DNA, 20 bp, Artificial
  CRISPR gRNA sequence
tcttcagagaaagtctggag

SEQ ID NO: 331199 - DNA, 20 bp, Artificial
  CRISPR gRNA sequence
ctggtgttttgttcaatctg

SEQ ID NO: 331200 - DNA, 20 bp, Artificial
  CRISPR gRNA sequence
accctcttgcaaccagcttt

SEQ ID NO: 331201 - DNA, 20 bp, Artificial
  CRISPR gRNA sequence
cagtaaaacaaacacattta

SEQ ID NO: 331202 - DNA, 20 bp, Artificial
  CRISPR gRNA sequence
acctcttctttctgtaggga

SEQ ID NO: 331203 - DNA, 20 bp, Artificial
  CRISPR gRNA sequence
atttgcctatattctcccta

SEQ ID NO: 331204 - DNA, 20 bp, Artificial
  CRISPR gRNA sequence
cctacaagaatatttttgct

SEQ ID NO: 331205 - DNA, 20 bp, Artificial
  CRISPR gRNA sequence
cagcattctcatggggtaga

SEQ ID NO: 331206 - DNA, 20 bp, Artificial
  CRISPR gRNA sequence
gcccttcaagatagccttct

SEQ ID NO: 331207 - DNA, 20 bp, Artificial
  CRISPR gRNA sequence
ttctttagaatatgatttgg

SEQ ID NO: 331208 - DNA, 20 bp, Artificial
  CRISPR gRNA sequence
tttaacagtagtaagaaggc

SEQ ID NO: 331209 - DNA, 20 bp, Artificial
  CRISPR gRNA sequence
aatcaattccctgctccccc

SEQ ID NO: 331210 - DNA, 20 bp, Artificial
  CRISPR gRNA sequence
ttaaaactggatttgatttc

SEQ ID NO: 331211 - DNA, 20 bp, Artificial
  CRISPR gRNA sequence
ccccataccccaccccacac

SEQ ID NO: 331212 - DNA, 20 bp, Artificial
  CRISPR gRNA sequence
tgggcatgcagacaggaagt

SEQ ID NO: 331213 - DNA, 20 bp, Artificial
  CRISPR gRNA sequence
agtagagaaaatattccagc

SEQ ID NO: 331214 - DNA, 20 bp, Artificial
  CRISPR gRNA sequence
ataatcatattccacatatt

SEQ ID NO: 331215 - DNA, 20 bp, Artificial
  CRISPR gRNA sequence
gtgacttcagcctctgggag

SEQ ID NO: 331216 - DNA, 20 bp, Artificial
  CRISPR gRNA sequence
gaatattctgctctacccca

SEQ ID NO: 331217 - DNA, 20 bp, Artificial
  CRISPR gRNA sequence
ccatgaaaacatagataatg

SEQ ID NO: 331218 - DNA, 20 bp, Artificial
  CRISPR gRNA sequence
taaaccattttaactgaatt

SEQ ID NO: 331219 - DNA, 20 bp, Artificial
  CRISPR gRNA sequence
gagcaaaaatattcttgtag

SEQ ID NO: 331220 - DNA, 20 bp, Artificial
  CRISPR gRNA sequence
aaactattgagcagcagagg

SEQ ID NO: 331221 - DNA, 20 bp, Artificial
  CRISPR gRNA sequence
tcatgtagaagtatttttaa

SEQ ID NO: 331222 - DNA, 20 bp, Artificial
  CRISPR gRNA sequence
taaaaagaaaattgagggca

SEQ ID NO: 331223 - DNA, 20 bp, Artificial
  CRISPR gRNA sequence
gtacagttcacatcaacatc

SEQ ID NO: 331224 - DNA, 20 bp, Artificial
  CRISPR gRNA sequence
aaagaggaattctcatccct

SEQ ID NO: 331225 - DNA, 20 bp, Artificial
  CRISPR gRNA sequence
tctccgtggtcccggaaata

SEQ ID NO: 331226 - DNA, 20 bp, Artificial
  CRISPR gRNA sequence
tgattgcagctgctgctggg

SEQ ID NO: 331227 - DNA, 20 bp, Artificial
  CRISPR gRNA sequence
ccagtggttgccatccttca

SEQ ID NO: 331228 - DNA, 20 bp, Artificial
  CRISPR gRNA sequence
tttcagttttctgactctta

SEQ ID NO: 331229 - DNA, 20 bp, Artificial
  CRISPR gRNA sequence
aacccttcaacaaaaaacac

SEQ ID NO: 331230 - DNA, 20 bp, Artificial
  CRISPR gRNA sequence
ttgtttgttttcaatatact

SEQ ID NO: 331231 - DNA, 20 bp, Artificial
  CRISPR gRNA sequence
aatataaatctagttaaaag

SEQ ID NO: 331232 - DNA, 20 bp, Artificial
  CRISPR gRNA sequence
agtgagaaatccagattttc

SEQ ID NO: 331233 - DNA, 20 bp, Artificial
  CRISPR gRNA sequence
ccagattttcacagaaaatt

SEQ ID NO: 331234 - DNA, 20 bp, Artificial
  CRISPR gRNA sequence
taacattccaggcttactgt

SEQ ID NO: 331235 - DNA, 20 bp, Artificial
  CRISPR gRNA sequence
acactggatgaatacttctg

SEQ ID NO: 331236 - DNA, 20 bp, Artificial
  CRISPR gRNA sequence
aatacttctgaaagaaaaag

SEQ ID NO: 331237 - DNA, 20 bp, Artificial
  CRISPR gRNA sequence
ggttcctggctttaggctaa

SEQ ID NO: 331238 - DNA, 20 bp, Artificial
  CRISPR gRNA sequence
cctgtaatgcaagagaccaa

SEQ ID NO: 331239 - DNA, 20 bp, Artificial
  CRISPR gRNA sequence
taaagcagatacaaggaaag

SEQ ID NO: 331240 - DNA, 20 bp, Artificial
  CRISPR gRNA sequence
tgtatttacaaatgtggtta

SEQ ID NO: 331241 - DNA, 20 bp, Artificial
  CRISPR gRNA sequence
tgtctaattgattttattag

SEQ ID NO: 331242 - DNA, 20 bp, Artificial
  CRISPR gRNA sequence
tgcagaagtaatagttggca

SEQ ID NO: 331243 - DNA, 20 bp, Artificial
  CRISPR gRNA sequence
atgagaatggtccaagttgt

SEQ ID NO: 331244 - DNA, 20 bp, Artificial
  CRISPR gRNA sequence
agacactgttgttggataac

SEQ ID NO: 331245 - DNA, 20 bp, Artificial
  CRISPR gRNA sequence
ttgttggataactgagaatg

SEQ ID NO: 331246 - DNA, 20 bp, Artificial
  CRISPR gRNA sequence
cattgatttctcctgcataa

SEQ ID NO: 331247 - DNA, 20 bp, Artificial
  CRISPR gRNA sequence
gatttctcctgcataaaaag

SEQ ID NO: 331248 - DNA, 20 bp, Artificial
  CRISPR gRNA sequence
ataagataaaactatgtcct

SEQ ID NO: 331249 - DNA, 20 bp, Artificial
  CRISPR gRNA sequence
tagagaaaaaaaaatcctaa

SEQ ID NO: 331250 - DNA, 20 bp, Artificial
  CRISPR gRNA sequence
cttgcttgtcatatgtgaat

SEQ ID NO: 331251 - DNA, 20 bp, Artificial
  CRISPR gRNA sequence
ggtgggttataattttgatt

SEQ ID NO: 331252 - DNA, 20 bp, Artificial
  CRISPR gRNA sequence
ttataattttgattatagaa

SEQ ID NO: 331253 - DNA, 20 bp, Artificial
  CRISPR gRNA sequence
taaagcagataaaaggaaag

SEQ ID NO: 331254 - DNA, 20 bp, Artificial
  CRISPR gRNA sequence
agactaatcattttcaaatg

SEQ ID NO: 331255 - DNA, 20 bp, Artificial
  CRISPR gRNA sequence
ttttcttttcttttcttttc

SEQ ID NO: 331256 - DNA, 20 bp, Artificial
  CRISPR gRNA sequence
catatctggctaactttgaa

SEQ ID NO: 331257 - DNA, 20 bp, Artificial
  CRISPR gRNA sequence
gaaatcttggtctttgtttt

SEQ ID NO: 331258 - DNA, 20 bp, Artificial
  CRISPR gRNA sequence
ttacctagttctacagtgaa

SEQ ID NO: 331259 - DNA, 20 bp, Artificial
  CRISPR gRNA sequence
aaaatattattaaaagcatt

SEQ ID NO: 331260 - DNA, 20 bp, Artificial
  CRISPR gRNA sequence
ttaaagaatgacacaaagga

SEQ ID NO: 331261 - DNA, 20 bp, Artificial
  CRISPR gRNA sequence
ttgtttttatgtctcaactc

SEQ ID NO: 331262 - DNA, 20 bp, Artificial
  CRISPR gRNA sequence
tctgcagagtgagtgatcta

SEQ ID NO: 331263 - DNA, 20 bp, Artificial
  CRISPR gRNA sequence
tacattcttggagcacaggt

SEQ ID NO: 331264 - DNA, 20 bp, Artificial
  CRISPR gRNA sequence
cctcattcagattagatggt

SEQ ID NO: 331265 - DNA, 20 bp, Artificial
  CRISPR gRNA sequence
aatcttctggacttcaatgg

SEQ ID NO: 331266 - DNA, 20 bp, Artificial
  CRISPR gRNA sequence
aaaaatgcaaactattacaa

SEQ ID NO: 331267 - DNA, 20 bp, Artificial
  CRISPR gRNA sequence
cacaaaaataatgagacata

SEQ ID NO: 331268 - DNA, 20 bp, Artificial
  CRISPR gRNA sequence
tacaagaaaacaagggaaca

SEQ ID NO: 331269 - DNA, 20 bp, Artificial
  CRISPR gRNA sequence
ttattatgtttaagcaaata

SEQ ID NO: 331270 - DNA, 20 bp, Artificial
  CRISPR gRNA sequence
ctaatttgaaaaagaaccta

SEQ ID NO: 331271 - DNA, 20 bp, Artificial
  CRISPR gRNA sequence
tatatattagacagagttaa

SEQ ID NO: 331272 - DNA, 20 bp, Artificial
  CRISPR gRNA sequence
ccagtcacactccacagatt

SEQ ID NO: 331273 - DNA, 20 bp, Artificial
  CRISPR gRNA sequence
tgaaaatcctaaaagcagcc

SEQ ID NO: 331274 - DNA, 20 bp, Artificial
  CRISPR gRNA sequence
catatacctccaatgtgcta

SEQ ID NO: 331275 - DNA, 20 bp, Artificial
  CRISPR gRNA sequence
gtcaatatagagcacattgt

SEQ ID NO: 331276 - DNA, 20 bp, Artificial
  CRISPR gRNA sequence
tcttccataattactaaaaa

SEQ ID NO: 331277 - DNA, 20 bp, Artificial
  CRISPR gRNA sequence
taatggttttgtctaaagag

SEQ ID NO: 331278 - DNA, 20 bp, Artificial
  CRISPR gRNA sequence
gaacaatattatccagaggc

SEQ ID NO: 331279 - DNA, 20 bp, Artificial
  CRISPR gRNA sequence
tggacgggttctcagttcct

SEQ ID NO: 331280 - DNA, 20 bp, Artificial
  CRISPR gRNA sequence
caaaaaatttcccagagact

SEQ ID NO: 331281 - DNA, 20 bp, Artificial
  CRISPR gRNA sequence
tgctttctctggattcagca

SEQ ID NO: 331282 - DNA, 20 bp, Artificial
  CRISPR gRNA sequence
caatatcataatgggctatt

SEQ ID NO: 331283 - DNA, 20 bp, Artificial
  CRISPR gRNA sequence
taatgggctattccagaaag

SEQ ID NO: 331284 - DNA, 20 bp, Artificial
  CRISPR gRNA sequence
gaaaattaatccccagtgta

SEQ ID NO: 331285 - DNA, 20 bp, Artificial
  CRISPR gRNA sequence
gcctctgatgagtgtcccca

SEQ ID NO: 331286 - DNA, 20 bp, Artificial
  CRISPR gRNA sequence
ggccccagcctccagaactg

SEQ ID NO: 331287 - DNA, 20 bp, Artificial
  CRISPR gRNA sequence
tccggtattcagtgatagca

SEQ ID NO: 331288 - DNA, 20 bp, Artificial
  CRISPR gRNA sequence
gcacctctgttttatgtcca

SEQ ID NO: 331289 - DNA, 20 bp, Artificial
  CRISPR gRNA sequence
atttacaatccattctccac

SEQ ID NO: 331290 - DNA, 20 bp, Artificial
  CRISPR gRNA sequence
atccattctccacagagaaa

SEQ ID NO: 331291 - DNA, 20 bp, Artificial
  CRISPR gRNA sequence
gaccactggccacccaatct

SEQ ID NO: 331292 - DNA, 20 bp, Artificial
  CRISPR gRNA sequence
tataagagccaaaagggctt

SEQ ID NO: 331293 - DNA, 20 bp, Artificial
  CRISPR gRNA sequence
tttatcaaattaaactagag

SEQ ID NO: 331294 - DNA, 20 bp, Artificial
  CRISPR gRNA sequence
aaattatctgtctgagcttt

SEQ ID NO: 331295 - DNA, 20 bp, Artificial
  CRISPR gRNA sequence
tactatattttcttcatcac

SEQ ID NO: 331296 - DNA, 20 bp, Artificial
  CRISPR gRNA sequence
ctactcaggaggctgaggca

SEQ ID NO: 331297 - DNA, 20 bp, Artificial
  CRISPR gRNA sequence
ttcttcttttgggggactat

SEQ ID NO: 331298 - DNA, 20 bp, Artificial
  CRISPR gRNA sequence
ggactattaagaaaatttct

SEQ ID NO: 331299 - DNA, 20 bp, Artificial
  CRISPR gRNA sequence
tgaagaaaaggtcattcacc

SEQ ID NO: 331300 - DNA, 20 bp, Artificial
  CRISPR gRNA sequence
agtgcagagcgtgcaagata

SEQ ID NO: 331301 - DNA, 20 bp, Artificial
  CRISPR gRNA sequence
agttatatttgatgttttac

SEQ ID NO: 331302 - DNA, 20 bp, Artificial
  CRISPR gRNA sequence
aacctaaatgcctaacattt

SEQ ID NO: 331303 - DNA, 20 bp, Artificial
  CRISPR gRNA sequence
ctaacatttggagaaaaaaa

SEQ ID NO: 331304 - DNA, 20 bp, Artificial
  CRISPR gRNA sequence
caaaaaaaaaaaaatgggaa

SEQ ID NO: 331305 - DNA, 20 bp, Artificial
  CRISPR gRNA sequence
aatgggaagaagaaaagtga

SEQ ID NO: 331306 - DNA, 20 bp, Artificial
  CRISPR gRNA sequence
ggttctctaagtgtgtataa

SEQ ID NO: 331307 - DNA, 20 bp, Artificial
  CRISPR gRNA sequence
cggtcccataagattataat

SEQ ID NO: 331308 - DNA, 20 bp, Artificial
  CRISPR gRNA sequence
aatcactaaggacacatttc

SEQ ID NO: 331309 - DNA, 20 bp, Artificial
  CRISPR gRNA sequence
gctgctcccaaaattatgtt

SEQ ID NO: 331310 - DNA, 20 bp, Artificial
  CRISPR gRNA sequence
cacacttctgttctttacta

SEQ ID NO: 331311 - DNA, 20 bp, Artificial
  CRISPR gRNA sequence
ttgattaccccttaatctga

SEQ ID NO: 331312 - DNA, 20 bp, Artificial
  CRISPR gRNA sequence
aagctcaatcatattaaata

SEQ ID NO: 331313 - DNA, 20 bp, Artificial
  CRISPR gRNA sequence
taaaagaattaatattaaca

SEQ ID NO: 331314 - DNA, 20 bp, Artificial
  CRISPR gRNA sequence
gatacttatttcccagtcaa

SEQ ID NO: 331315 - DNA, 20 bp, Artificial
  CRISPR gRNA sequence
atacaggggtagaggaagct

SEQ ID NO: 331316 - DNA, 20 bp, Artificial
  CRISPR gRNA sequence
ttttctttcacagctgggag

SEQ ID NO: 331317 - DNA, 20 bp, Artificial
  CRISPR gRNA sequence
cctacccaaatgagaaggaa

SEQ ID NO: 331318 - DNA, 20 bp, Artificial
  CRISPR gRNA sequence
cagcaatggatccaaaccaa

SEQ ID NO: 331319 - DNA, 20 bp, Artificial
  CRISPR gRNA sequence
aaattcttcatctacctgaa

SEQ ID NO: 331320 - DNA, 20 bp, Artificial
  CRISPR gRNA sequence
aagctaatcggggagggacc

SEQ ID NO: 331321 - DNA, 20 bp, Artificial
  CRISPR gRNA sequence
aaatgatacaagaagtgaag

SEQ ID NO: 331322 - DNA, 20 bp, Artificial
  CRISPR gRNA sequence
ttcaaggaaatagatagctt

SEQ ID NO: 331323 - DNA, 20 bp, Artificial
  CRISPR gRNA sequence
aggaaactttggacacaatt

SEQ ID NO: 331324 - DNA, 20 bp, Artificial
  CRISPR gRNA sequence
tgctctggaaagtctcagca

SEQ ID NO: 331325 - DNA, 20 bp, Artificial
  CRISPR gRNA sequence
gcaatagaattgaacaacta

SEQ ID NO: 331326 - DNA, 20 bp, Artificial
  CRISPR gRNA sequence
tagaattgaacaactagaag

SEQ ID NO: 331327 - DNA, 20 bp, Artificial
  CRISPR gRNA sequence
taacccagtccaacaaaaac

SEQ ID NO: 331328 - DNA, 20 bp, Artificial
  CRISPR gRNA sequence
gtccaacaaaaacaaagaaa

SEQ ID NO: 331329 - DNA, 20 bp, Artificial
  CRISPR gRNA sequence
tagtccaatcctctcattgt

SEQ ID NO: 331330 - DNA, 20 bp, Artificial
  CRISPR gRNA sequence
ttcccatcacttatctgcct

SEQ ID NO: 331331 - DNA, 20 bp, Artificial
  CRISPR gRNA sequence
ttatctgcctgtagaaatgt

SEQ ID NO: 331332 - DNA, 20 bp, Artificial
  CRISPR gRNA sequence
agtactgagatgccatttac

SEQ ID NO: 331333 - DNA, 20 bp, Artificial
  CRISPR gRNA sequence
aatcttacagtgagtaaata

SEQ ID NO: 331334 - DNA, 20 bp, Artificial
  CRISPR gRNA sequence
tgcctgcattttgtttctac

SEQ ID NO: 331335 - DNA, 20 bp, Artificial
  CRISPR gRNA sequence
aagggactcaagatcttaca

SEQ ID NO: 331336 - DNA, 20 bp, Artificial
  CRISPR gRNA sequence
cataagaataagagacattt

SEQ ID NO: 331337 - DNA, 20 bp, Artificial
  CRISPR gRNA sequence
aggaaaaaaatgactgaaat

SEQ ID NO: 331338 - DNA, 20 bp, Artificial
  CRISPR gRNA sequence
ctacttgggaggctgaggca

SEQ ID NO: 331339 - DNA, 20 bp, Artificial
  CRISPR gRNA sequence
ccgcctcaaaaaaaaaatta

SEQ ID NO: 331340 - DNA, 20 bp, Artificial
  CRISPR gRNA sequence
aaaaaaattaatagaaacac

SEQ ID NO: 331341 - DNA, 20 bp, Artificial
  CRISPR gRNA sequence
attaatagaaacacacagaa

SEQ ID NO: 331342 - DNA, 20 bp, Artificial
  CRISPR gRNA sequence
ggaatatctgcaaccactaa

SEQ ID NO: 331343 - DNA, 20 bp, Artificial
  CRISPR gRNA sequence
cacaagacaggagcagatgt

SEQ ID NO: 331344 - DNA, 20 bp, Artificial
  CRISPR gRNA sequence
aacgtatgtgatgtaagtgt

SEQ ID NO: 331345 - DNA, 20 bp, Artificial
  CRISPR gRNA sequence
gaaaggattcttgaaacaga

SEQ ID NO: 331346 - DNA, 20 bp, Artificial
  CRISPR gRNA sequence
ggaggcaaagaggagagtca

SEQ ID NO: 331347 - DNA, 20 bp, Artificial
  CRISPR gRNA sequence
atcacaccaacaaaaataaa

SEQ ID NO: 331348 - DNA, 20 bp, Artificial
  CRISPR gRNA sequence
agagaaaaagaggatacaac

SEQ ID NO: 331349 - DNA, 20 bp, Artificial
  CRISPR gRNA sequence
aaaataagtagtaaataaac

SEQ ID NO: 331350 - DNA, 20 bp, Artificial
  CRISPR gRNA sequence
tggcctgaattcatctatca

SEQ ID NO: 331351 - DNA, 20 bp, Artificial
  CRISPR gRNA sequence
ttaaagtagtctttctaaaa

SEQ ID NO: 331352 - DNA, 20 bp, Artificial
  CRISPR gRNA sequence
acattgagatccatcaaaga

SEQ ID NO: 331353 - DNA, 20 bp, Artificial
  CRISPR gRNA sequence
caaccaaataacaaaggtga

SEQ ID NO: 331354 - DNA, 20 bp, Artificial
  CRISPR gRNA sequence
ctccactacttcaacacagt

SEQ ID NO: 331355 - DNA, 20 bp, Artificial
  CRISPR gRNA sequence
actacttcaacacagtttag

SEQ ID NO: 331356 - DNA, 20 bp, Artificial
  CRISPR gRNA sequence
cttcaaacactgactaaagg

SEQ ID NO: 331357 - DNA, 20 bp, Artificial
  CRISPR gRNA sequence
atgcctacatcttcatggca

SEQ ID NO: 331358 - DNA, 20 bp, Artificial
  CRISPR gRNA sequence
tgaacattggttgtattcat

SEQ ID NO: 331359 - DNA, 20 bp, Artificial
  CRISPR gRNA sequence
aatctacgatgaatattgtt

SEQ ID NO: 331360 - DNA, 20 bp, Artificial
  CRISPR gRNA sequence
aaggctggatctcaccttcc

SEQ ID NO: 331361 - DNA, 20 bp, Artificial
  CRISPR gRNA sequence
gaatggtaccaacgttcttg

SEQ ID NO: 331362 - DNA, 20 bp, Artificial
  CRISPR gRNA sequence
acatgagtaaatggatgaat

SEQ ID NO: 331363 - DNA, 20 bp, Artificial
  CRISPR gRNA sequence
ctaaaggacttcatgagatt

SEQ ID NO: 331364 - DNA, 20 bp, Artificial
  CRISPR gRNA sequence
aactttccttttttcaacct

SEQ ID NO: 331365 - DNA, 20 bp, Artificial
  CRISPR gRNA sequence
agaatagggctcagtgtgaa

SEQ ID NO: 331366 - DNA, 20 bp, Artificial
  CRISPR gRNA sequence
attatatacagtaaaaagca

SEQ ID NO: 331367 - DNA, 20 bp, Artificial
  CRISPR gRNA sequence
aagagaaggaatcagggact

SEQ ID NO: 331368 - DNA, 20 bp, Artificial
  CRISPR gRNA sequence
ggtgtatgtacaaggatgag

SEQ ID NO: 331369 - DNA, 20 bp, Artificial
  CRISPR gRNA sequence
tgattaatgataattacagg

SEQ ID NO: 331370 - DNA, 20 bp, Artificial
  CRISPR gRNA sequence
tgggttttgtggaaataatt

SEQ ID NO: 331371 - DNA, 20 bp, Artificial
  CRISPR gRNA sequence
cattcctttgtaaaaaaaaa

SEQ ID NO: 331372 - DNA, 20 bp, Artificial
  CRISPR gRNA sequence
ttttggtcattcaaagtgaa

SEQ ID NO: 331373 - DNA, 20 bp, Artificial
  CRISPR gRNA sequence
gtttggcctgtaaggttgac

SEQ ID NO: 331374 - DNA, 20 bp, Artificial
  CRISPR gRNA sequence
aacaaagaatctgtacatgc

SEQ ID NO: 331375 - DNA, 20 bp, Artificial
  CRISPR gRNA sequence
aggttgtcagggaagtgggg

SEQ ID NO: 331376 - DNA, 20 bp, Artificial
  CRISPR gRNA sequence
gcaaagggcaagactggctt

SEQ ID NO: 331377 - DNA, 20 bp, Artificial
  CRISPR gRNA sequence
caagccagatatatatattt

SEQ ID NO: 331378 - DNA, 20 bp, Artificial
  CRISPR gRNA sequence
ctatacatgatgtgttaggg

SEQ ID NO: 331379 - DNA, 20 bp, Artificial
  CRISPR gRNA sequence
ctatggagttccttggagag

SEQ ID NO: 331380 - DNA, 20 bp, Artificial
  CRISPR gRNA sequence
ttaatgccagaatttcttag

SEQ ID NO: 331381 - DNA, 20 bp, Artificial
  CRISPR gRNA sequence
agtaaaacatcaaatataac

SEQ ID NO: 331382 - DNA, 20 bp, Artificial
  CRISPR gRNA sequence
tcttgtgctttataaatttt

SEQ ID NO: 331383 - DNA, 20 bp, Artificial
  CRISPR gRNA sequence
aagatttttattttactctt

SEQ ID NO: 331384 - DNA, 20 bp, Artificial
  CRISPR gRNA sequence
aaagtaaacagatatggtag

SEQ ID NO: 331385 - DNA, 20 bp, Artificial
  CRISPR gRNA sequence
aaacagatatggtagcaaaa

SEQ ID NO: 331386 - DNA, 20 bp, Artificial
  CRISPR gRNA sequence
ccactaacatgctgtgttta

SEQ ID NO: 331387 - DNA, 20 bp, Artificial
  CRISPR gRNA sequence
agtagccagacaataaagaa

SEQ ID NO: 331388 - DNA, 20 bp, Artificial
  CRISPR gRNA sequence
tggatagattctgttggaca

SEQ ID NO: 331389 - DNA, 20 bp, Artificial
  CRISPR gRNA sequence
attaattaaatgctatagtt

SEQ ID NO: 331390 - DNA, 20 bp, Artificial
  CRISPR gRNA sequence
atattgttccttccagtttt

SEQ ID NO: 331391 - DNA, 20 bp, Artificial
  CRISPR gRNA sequence
tttaaacatacttgttatta

SEQ ID NO: 331392 - DNA, 20 bp, Artificial
  CRISPR gRNA sequence
acatacttgttattataaaa

SEQ ID NO: 331393 - DNA, 20 bp, Artificial
  CRISPR gRNA sequence
actctttctccctctttaga

SEQ ID NO: 331394 - DNA, 20 bp, Artificial
  CRISPR gRNA sequence
ttagtaattatggaagaaat

SEQ ID NO: 331395 - DNA, 20 bp, Artificial
  CRISPR gRNA sequence
gattctgggagttgagacat

SEQ ID NO: 331396 - DNA, 20 bp, Artificial
  CRISPR gRNA sequence
tacacttacatagttttctc

SEQ ID NO: 331397 - DNA, 20 bp, Artificial
  CRISPR gRNA sequence
aaaaacaaagaccaagattt

SEQ ID NO: 331398 - DNA, 20 bp, Artificial
  CRISPR gRNA sequence
caagatttcaaaacttagga

SEQ ID NO: 331399 - DNA, 20 bp, Artificial
  CRISPR gRNA sequence
tgtcatattaaaaaggaaaa

SEQ ID NO: 331400 - DNA, 20 bp, Artificial
  CRISPR gRNA sequence
gtgattcccatgtagcttgc

SEQ ID NO: 331401 - DNA, 20 bp, Artificial
  CRISPR gRNA sequence
taatcctttaattccaattt

SEQ ID NO: 331402 - DNA, 20 bp, Artificial
  CRISPR gRNA sequence
atatgctattaaaaatcagg

SEQ ID NO: 331403 - DNA, 20 bp, Artificial
  CRISPR gRNA sequence
ctaaaggtcaggaggaaggt

SEQ ID NO: 331404 - DNA, 20 bp, Artificial
  CRISPR gRNA sequence
ttttgcttagctggtaagtt

SEQ ID NO: 331405 - DNA, 20 bp, Artificial
  CRISPR gRNA sequence
ttagactccttgcttttaaa

SEQ ID NO: 331406 - DNA, 20 bp, Artificial
  CRISPR gRNA sequence
gggaaagaaacaataaaggc

SEQ ID NO: 331407 - DNA, 20 bp, Artificial
  CRISPR gRNA sequence
taccacttcaacaaagaata

SEQ ID NO: 331408 - DNA, 20 bp, Artificial
  CRISPR gRNA sequence
caaagaatagaaaacagtca

SEQ ID NO: 331409 - DNA, 20 bp, Artificial
  CRISPR gRNA sequence
tttttaattttaaaggaaag

SEQ ID NO: 331410 - DNA, 20 bp, Artificial
  CRISPR gRNA sequence
tatattttctgcagtatatt

SEQ ID NO: 331411 - DNA, 20 bp, Artificial
  CRISPR gRNA sequence
accttttctgttaagagtca

SEQ ID NO: 331412 - DNA, 20 bp, Artificial
  CRISPR gRNA sequence
ttggtactgccgagtcctct

SEQ ID NO: 331413 - DNA, 20 bp, Artificial
  CRISPR gRNA sequence
cctagcagtgcatcagccag

SEQ ID NO: 331414 - DNA, 20 bp, Artificial
  CRISPR gRNA sequence
agggcacaattccctctcat

SEQ ID NO: 331415 - DNA, 20 bp, Artificial
  CRISPR gRNA sequence
caattccctgctccccccaa

SEQ ID NO: 331416 - DNA, 20 bp, Artificial
  CRISPR gRNA sequence
ctttgataagtggctcctct

SEQ ID NO: 331417 - DNA, 20 bp, Artificial
  CRISPR gRNA sequence
tcaggttgtccaagtcagct

SEQ ID NO: 331418 - DNA, 20 bp, Artificial
  CRISPR gRNA sequence
cttgtaattaatagcaccat

SEQ ID NO: 331419 - DNA, 20 bp, Artificial
  CRISPR gRNA sequence
tatatgtatgcatagatata

SEQ ID NO: 331420 - DNA, 20 bp, Artificial
  CRISPR gRNA sequence
ttcagtacccctggcatctt

SEQ ID NO: 331421 - DNA, 20 bp, Artificial
  CRISPR gRNA sequence
agtcattcttccagattgaa

SEQ ID NO: 331422 - DNA, 20 bp, Artificial
  CRISPR gRNA sequence
atcttgcacttcaagttgag

SEQ ID NO: 331423 - DNA, 20 bp, Artificial
  CRISPR gRNA sequence
gagcatcaatttctgtcatc

SEQ ID NO: 331424 - DNA, 20 bp, Artificial
  CRISPR gRNA sequence
actgaatgaacccttcaaca

SEQ ID NO: 331425 - DNA, 20 bp, Artificial
  CRISPR gRNA sequence
ttgttgaagtggtatgtgac

SEQ ID NO: 331426 - DNA, 20 bp, Artificial
  CRISPR gRNA sequence
cctggctttaggctaagtag

SEQ ID NO: 331427 - DNA, 20 bp, Artificial
  CRISPR gRNA sequence
tttttaacttaccagctaag

SEQ ID NO: 331428 - DNA, 20 bp, Artificial
  CRISPR gRNA sequence
tctttggaatgtgtgggcta

SEQ ID NO: 331429 - DNA, 20 bp, Artificial
  CRISPR gRNA sequence
tatggcaaggatccaggaac

SEQ ID NO: 331430 - DNA, 20 bp, Artificial
  CRISPR gRNA sequence
taatagtaaaagtaatgtta

SEQ ID NO: 331431 - DNA, 20 bp, Artificial
  CRISPR gRNA sequence
ttcattccacaaacacagtg

SEQ ID NO: 331432 - DNA, 20 bp, Artificial
  CRISPR gRNA sequence
ttattagtgagaaaagttgt

SEQ ID NO: 331433 - DNA, 20 bp, Artificial
  CRISPR gRNA sequence
ttctcctgcataaaaagaaa

SEQ ID NO: 331434 - DNA, 20 bp, Artificial
  CRISPR gRNA sequence
cctcaaggaagaacataaga

SEQ ID NO: 331435 - DNA, 20 bp, Artificial
  CRISPR gRNA sequence
gggaaaagttgaagtttagg

SEQ ID NO: 331436 - DNA, 20 bp, Artificial
  CRISPR gRNA sequence
acatgggaatcacagaagga

SEQ ID NO: 331437 - DNA, 20 bp, Artificial
  CRISPR gRNA sequence
atcttggtctttgtttttga

SEQ ID NO: 331438 - DNA, 20 bp, Artificial
  CRISPR gRNA sequence
atttttgctctttatcttgc

SEQ ID NO: 331439 - DNA, 20 bp, Artificial
  CRISPR gRNA sequence
gttaatctatcataatttgt

SEQ ID NO: 331440 - DNA, 20 bp, Artificial
  CRISPR gRNA sequence
attcaaactaattctcacgc

SEQ ID NO: 331441 - DNA, 20 bp, Artificial
  CRISPR gRNA sequence
gcagagtgagtgatctagca

SEQ ID NO: 331442 - DNA, 20 bp, Artificial
  CRISPR gRNA sequence
cttctggacttcaatggtta

SEQ ID NO: 331443 - DNA, 20 bp, Artificial
  CRISPR gRNA sequence
aaaaataatgagacatacaa

SEQ ID NO: 331444 - DNA, 20 bp, Artificial
  CRISPR gRNA sequence
caacagaaacaacaaactac

SEQ ID NO: 331445 - DNA, 20 bp, Artificial
  CRISPR gRNA sequence
tatgtttaagcaaataagag

SEQ ID NO: 331446 - DNA, 20 bp, Artificial
  CRISPR gRNA sequence
caaaaaaatgcactgagatt

SEQ ID NO: 331447 - DNA, 20 bp, Artificial
  CRISPR gRNA sequence
aataatacttgcttcgtttt

SEQ ID NO: 331448 - DNA, 20 bp, Artificial
  CRISPR gRNA sequence
ttatccagaggcaaagaaaa

SEQ ID NO: 331449 - DNA, 20 bp, Artificial
  CRISPR gRNA sequence
aggtgcagtctacattagat

SEQ ID NO: 331450 - DNA, 20 bp, Artificial
  CRISPR gRNA sequence
gtgaaatgaagaagtgaaac

SEQ ID NO: 331451 - DNA, 20 bp, Artificial
  CRISPR gRNA sequence
ttgggtaagtcttccaaagg

SEQ ID NO: 331452 - DNA, 20 bp, Artificial
  CRISPR gRNA sequence
catttttttatctttaactt

SEQ ID NO: 331453 - DNA, 20 bp, Artificial
  CRISPR gRNA sequence
gtgtttaaactttccatctg

SEQ ID NO: 331454 - DNA, 20 bp, Artificial
  CRISPR gRNA sequence
ctttaatataaaatcttctc

SEQ ID NO: 331455 - DNA, 20 bp, Artificial
  CRISPR gRNA sequence
tagagtcattgttctgctta

SEQ ID NO: 331456 - DNA, 20 bp, Artificial
  CRISPR gRNA sequence
ggctactccactctaagctt

SEQ ID NO: 331457 - DNA, 20 bp, Artificial
  CRISPR gRNA sequence
tatctgtctgagctttaaag

SEQ ID NO: 331458 - DNA, 20 bp, Artificial
  CRISPR gRNA sequence
tgtcttatgagtctaccagc

SEQ ID NO: 331459 - DNA, 20 bp, Artificial
  CRISPR gRNA sequence
aaggaactccatagggggta

SEQ ID NO: 331460 - DNA, 20 bp, Artificial
  CRISPR gRNA sequence
aagattgattttctcctagt

SEQ ID NO: 331461 - DNA, 20 bp, Artificial
  CRISPR gRNA sequence
aaaaaatcccagtggtatta

SEQ ID NO: 331462 - DNA, 20 bp, Artificial
  CRISPR gRNA sequence
gccattgctcagctactgtg

SEQ ID NO: 331463 - DNA, 20 bp, Artificial
  CRISPR gRNA sequence
gtggccagaggagcagggta

SEQ ID NO: 331464 - DNA, 20 bp, Artificial
  CRISPR gRNA sequence
gcagatttcacatgcagggg

SEQ ID NO: 331465 - DNA, 20 bp, Artificial
  CRISPR gRNA sequence
acccaaatgagaaggaacca

SEQ ID NO: 331466 - DNA, 20 bp, Artificial
  CRISPR gRNA sequence
aaccaactctggtaatatga

SEQ ID NO: 331467 - DNA, 20 bp, Artificial
  CRISPR gRNA sequence
ggaaatagatagcttaaaga

SEQ ID NO: 331468 - DNA, 20 bp, Artificial
  CRISPR gRNA sequence
tcgaattaacccagtccaac

SEQ ID NO: 331469 - DNA, 20 bp, Artificial
  CRISPR gRNA sequence
agagatttgctacgaaataa

SEQ ID NO: 331470 - DNA, 20 bp, Artificial
  CRISPR gRNA sequence
ttgcaagctacaaatgattt

SEQ ID NO: 331471 - DNA, 20 bp, Artificial
  CRISPR gRNA sequence
ccagtaagtcattttgcata

SEQ ID NO: 331472 - DNA, 20 bp, Artificial
  CRISPR gRNA sequence
ggaatatgctactagtaact

SEQ ID NO: 331473 - DNA, 20 bp, Artificial
  CRISPR gRNA sequence
catttctagaaagagtgggg

SEQ ID NO: 331474 - DNA, 20 bp, Artificial
  CRISPR gRNA sequence
aaagcttgagtctagagatt

SEQ ID NO: 331475 - DNA, 20 bp, Artificial
  CRISPR gRNA sequence
taagttttaaattatttcca

SEQ ID NO: 331476 - DNA, 20 bp, Artificial
  CRISPR gRNA sequence
tgcttttaaagtagtctttc

SEQ ID NO: 331477 - DNA, 20 bp, Artificial
  CRISPR gRNA sequence
ttgctccaagttcattaaaa

SEQ ID NO: 331478 - DNA, 20 bp, Artificial
  CRISPR gRNA sequence
gtcagcttaatctggaaact

SEQ ID NO: 331479 - DNA, 20 bp, Artificial
  CRISPR gRNA sequence
gcataaaccagcaagtagcc

SEQ ID NO: 331480 - DNA, 20 bp, Artificial
  CRISPR gRNA sequence
atagggctcagtgtgaaaga

SEQ ID NO: 331481 - DNA, 20 bp, Artificial
  CRISPR gRNA sequence
ctctgatacttagtgtcaat

SEQ ID NO: 331482 - DNA, 20 bp, Artificial
  CRISPR gRNA sequence
tgattttaatcttacctgga

SEQ ID NO: 331483 - DNA, 20 bp, Artificial
  CRISPR gRNA sequence
gattttaatcttacctggat

SEQ ID NO: 331484 - DNA, 20 bp, Artificial
  CRISPR gRNA sequence
attttaatcttacctggatg

SEQ ID NO: 331485 - DNA, 20 bp, Artificial
  CRISPR gRNA sequence
taatcttacctggatgatct

SEQ ID NO: 331486 - DNA, 20 bp, Artificial
  CRISPR gRNA sequence
aatcttacctggatgatctg

SEQ ID NO: 331487 - DNA, 20 bp, Artificial
  CRISPR gRNA sequence
atcttacctggatgatctgt

SEQ ID NO: 331488 - DNA, 20 bp, Artificial
  CRISPR gRNA sequence
acctggatgatctgttatct

SEQ ID NO: 331489 - DNA, 20 bp, Artificial
  CRISPR gRNA sequence
cctggatgatctgttatctg

SEQ ID NO: 331490 - DNA, 20 bp, Artificial
  CRISPR gRNA sequence
gatgatctgttatctgaaat

SEQ ID NO: 331491 - DNA, 20 bp, Artificial
  CRISPR gRNA sequence
ttatctgaaatgtccagggc

SEQ ID NO: 331492 - DNA, 20 bp, Artificial
  CRISPR gRNA sequence
tctgaaatgtccagggcacc

SEQ ID NO: 331493 - DNA, 20 bp, Artificial
  CRISPR gRNA sequence
aaatgtccagggcaccatag

SEQ ID NO: 331494 - DNA, 20 bp, Artificial
  CRISPR gRNA sequence
ttattgacactaagtatcag

SEQ ID NO: 331495 - DNA, 20 bp, Artificial
  CRISPR gRNA sequence
tattgacactaagtatcaga

SEQ ID NO: 331496 - DNA, 20 bp, Artificial
  CRISPR gRNA sequence
attgacactaagtatcagag

SEQ ID NO: 331497 - DNA, 20 bp, Artificial
  CRISPR gRNA sequence
ttgacactaagtatcagagt

SEQ ID NO: 331498 - DNA, 20 bp, Artificial
  CRISPR gRNA sequence
acactaagtatcagagttca

SEQ ID NO: 331499 - DNA, 20 bp, Artificial
  CRISPR gRNA sequence
agtatcagagttcaccctaa

SEQ ID NO: 331500 - DNA, 20 bp, Artificial
  CRISPR gRNA sequence
accctaaaaagccaaggagg

SEQ ID NO: 331501 - DNA, 20 bp, Artificial
  CRISPR gRNA sequence
aaaagccaaggaggaaagga

SEQ ID NO: 331502 - DNA, 20 bp, Artificial
  CRISPR gRNA sequence
cctagcccctgtagacctta

SEQ ID NO: 331503 - DNA, 20 bp, Artificial
  CRISPR gRNA sequence
ctagcccctgtagaccttac

SEQ ID NO: 331504 - DNA, 20 bp, Artificial
  CRISPR gRNA sequence
gcccctgtagaccttacaaa

SEQ ID NO: 331505 - DNA, 20 bp, Artificial
  CRISPR gRNA sequence
tagaccttacaaaaaagatc

SEQ ID NO: 331506 - DNA, 20 bp, Artificial
  CRISPR gRNA sequence
acaaaaaagatcattctgga

SEQ ID NO: 331507 - DNA, 20 bp, Artificial
  CRISPR gRNA sequence
caaaaaagatcattctggag

SEQ ID NO: 331508 - DNA, 20 bp, Artificial
  CRISPR gRNA sequence
tggagtccctgattccttct

SEQ ID NO: 331509 - DNA, 20 bp, Artificial
  CRISPR gRNA sequence
gagtccctgattccttctct

SEQ ID NO: 331510 - DNA, 20 bp, Artificial
  CRISPR gRNA sequence
attccttctcttgaatggca

SEQ ID NO: 331511 - DNA, 20 bp, Artificial
  CRISPR gRNA sequence
cttctcttgaatggcatata

SEQ ID NO: 331512 - DNA, 20 bp, Artificial
  CRISPR gRNA sequence
ctcttgaatggcatatagca

SEQ ID NO: 331513 - DNA, 20 bp, Artificial
  CRISPR gRNA sequence
tcttgaatggcatatagcag

SEQ ID NO: 331514 - DNA, 20 bp, Artificial
  CRISPR gRNA sequence
ttgaatggcatatagcagac

SEQ ID NO: 331515 - DNA, 20 bp, Artificial
  CRISPR gRNA sequence
gaatggcatatagcagactc

SEQ ID NO: 331516 - DNA, 20 bp, Artificial
  CRISPR gRNA sequence
aatggcatatagcagactct

SEQ ID NO: 331517 - DNA, 20 bp, Artificial
  CRISPR gRNA sequence
tatatggacaatttaaataa

SEQ ID NO: 331518 - DNA, 20 bp, Artificial
  CRISPR gRNA sequence
tatggacaatttaaataatg

SEQ ID NO: 331519 - DNA, 20 bp, Artificial
  CRISPR gRNA sequence
aaataatgctacatacaatg

SEQ ID NO: 331520 - DNA, 20 bp, Artificial
  CRISPR gRNA sequence
aataatgctacatacaatgt

SEQ ID NO: 331521 - DNA, 20 bp, Artificial
  CRISPR gRNA sequence
catacaatgtaagttaatac

SEQ ID NO: 331522 - DNA, 20 bp, Artificial
  CRISPR gRNA sequence
atacacgtgtttctgctgct

SEQ ID NO: 331523 - DNA, 20 bp, Artificial
  CRISPR gRNA sequence
ctgctgctttttactgtata

SEQ ID NO: 331524 - DNA, 20 bp, Artificial
  CRISPR gRNA sequence
tgctgctttttactgtatat

SEQ ID NO: 331525 - DNA, 20 bp, Artificial
  CRISPR gRNA sequence
ctgctttttactgtatataa

SEQ ID NO: 331526 - DNA, 20 bp, Artificial
  CRISPR gRNA sequence
ctttttactgtatataattt

SEQ ID NO: 331527 - DNA, 20 bp, Artificial
  CRISPR gRNA sequence
tttactgtatataatttgta

SEQ ID NO: 331528 - DNA, 20 bp, Artificial
  CRISPR gRNA sequence
ttactgtatataatttgtac

SEQ ID NO: 331529 - DNA, 20 bp, Artificial
  CRISPR gRNA sequence
tactgtatataatttgtact

SEQ ID NO: 331530 - DNA, 20 bp, Artificial
  CRISPR gRNA sequence
actgtatataatttgtacta

SEQ ID NO: 331531 - DNA, 20 bp, Artificial
  CRISPR gRNA sequence
ctgtatataatttgtactac

SEQ ID NO: 331532 - DNA, 20 bp, Artificial
  CRISPR gRNA sequence
tatataatttgtactacttt

SEQ ID NO: 331533 - DNA, 20 bp, Artificial
  CRISPR gRNA sequence
gtactacttttgttttctct

SEQ ID NO: 331534 - DNA, 20 bp, Artificial
  CRISPR gRNA sequence
tactacttttgttttctctt

SEQ ID NO: 331535 - DNA, 20 bp, Artificial
  CRISPR gRNA sequence
cttttgttttctctttcaca

SEQ ID NO: 331536 - DNA, 20 bp, Artificial
  CRISPR gRNA sequence
ttgttttctctttcacactg

SEQ ID NO: 331537 - DNA, 20 bp, Artificial
  CRISPR gRNA sequence
tgttttctctttcacactga

SEQ ID NO: 331538 - DNA, 20 bp, Artificial
  CRISPR gRNA sequence
gttttctctttcacactgag

SEQ ID NO: 331539 - DNA, 20 bp, Artificial
  CRISPR gRNA sequence
ttttctctttcacactgagc

SEQ ID NO: 331540 - DNA, 20 bp, Artificial
  CRISPR gRNA sequence
tctctttcacactgagccct

SEQ ID NO: 331541 - DNA, 20 bp, Artificial
  CRISPR gRNA sequence
ctctttcacactgagcccta

SEQ ID NO: 331542 - DNA, 20 bp, Artificial
  CRISPR gRNA sequence
tctttcacactgagccctat

SEQ ID NO: 331543 - DNA, 20 bp, Artificial
  CRISPR gRNA sequence
tttcacactgagccctattc

SEQ ID NO: 331544 - DNA, 20 bp, Artificial
  CRISPR gRNA sequence
tcacactgagccctattctt

SEQ ID NO: 331545 - DNA, 20 bp, Artificial
  CRISPR gRNA sequence
cacactgagccctattcttg

SEQ ID NO: 331546 - DNA, 20 bp, Artificial
  CRISPR gRNA sequence
acactgagccctattcttga

SEQ ID NO: 331547 - DNA, 20 bp, Artificial
  CRISPR gRNA sequence
agccctattcttgaggttga

SEQ ID NO: 331548 - DNA, 20 bp, Artificial
  CRISPR gRNA sequence
ttcttgaggttgaaaaaagg

SEQ ID NO: 331549 - DNA, 20 bp, Artificial
  CRISPR gRNA sequence
ttgaggttgaaaaaaggaaa

SEQ ID NO: 331550 - DNA, 20 bp, Artificial
  CRISPR gRNA sequence
gaggttgaaaaaaggaaagt

SEQ ID NO: 331551 - DNA, 20 bp, Artificial
  CRISPR gRNA sequence
aggttgaaaaaaggaaagtt

SEQ ID NO: 331552 - DNA, 20 bp, Artificial
  CRISPR gRNA sequence
aaaaaaggaaagttaagtaa

SEQ ID NO: 331553 - DNA, 20 bp, Artificial
  CRISPR gRNA sequence
agtaatattaaataacttaa

SEQ ID NO: 331554 - DNA, 20 bp, Artificial
  CRISPR gRNA sequence
aataacttaaataatcaaat

SEQ ID NO: 331555 - DNA, 20 bp, Artificial
  CRISPR gRNA sequence
aaataatcaaataaactaaa

SEQ ID NO: 331556 - DNA, 20 bp, Artificial
  CRISPR gRNA sequence
aataatcaaataaactaaaa

SEQ ID NO: 331557 - DNA, 20 bp, Artificial
  CRISPR gRNA sequence
aaagtgaaggcagaactttt

SEQ ID NO: 331558 - DNA, 20 bp, Artificial
  CRISPR gRNA sequence
ttagtaggtatgatcctatc

SEQ ID NO: 331559 - DNA, 20 bp, Artificial
  CRISPR gRNA sequence
tagtaggtatgatcctatct

SEQ ID NO: 331560 - DNA, 20 bp, Artificial
  CRISPR gRNA sequence
agtaggtatgatcctatcta

SEQ ID NO: 331561 - DNA, 20 bp, Artificial
  CRISPR gRNA sequence
gtaggtatgatcctatctag

SEQ ID NO: 331562 - DNA, 20 bp, Artificial
  CRISPR gRNA sequence
tctagggatacattttttca

SEQ ID NO: 331563 - DNA, 20 bp, Artificial
  CRISPR gRNA sequence
gggatacattttttcagtgg

SEQ ID NO: 331564 - DNA, 20 bp, Artificial
  CRISPR gRNA sequence
tttcagtggcaaaaaaatag

SEQ ID NO: 331565 - DNA, 20 bp, Artificial
  CRISPR gRNA sequence
ttcagtggcaaaaaaataga

SEQ ID NO: 331566 - DNA, 20 bp, Artificial
  CRISPR gRNA sequence
tcagtggcaaaaaaatagac

SEQ ID NO: 331567 - DNA, 20 bp, Artificial
  CRISPR gRNA sequence
cagtggcaaaaaaatagacc

SEQ ID NO: 331568 - DNA, 20 bp, Artificial
  CRISPR gRNA sequence
agtggcaaaaaaatagacct

SEQ ID NO: 331569 - DNA, 20 bp, Artificial
  CRISPR gRNA sequence
actgttcttacaaaaaatga

SEQ ID NO: 331570 - DNA, 20 bp, Artificial
  CRISPR gRNA sequence
ctgttcttacaaaaaatgaa

SEQ ID NO: 331571 - DNA, 20 bp, Artificial
  CRISPR gRNA sequence
ttcttacaaaaaatgaaaaa

SEQ ID NO: 331572 - DNA, 20 bp, Artificial
  CRISPR gRNA sequence
ttacaaaaaatgaaaaaaaa

SEQ ID NO: 331573 - DNA, 20 bp, Artificial
  CRISPR gRNA sequence
acaaaaaatgaaaaaaaaat

SEQ ID NO: 331574 - DNA, 20 bp, Artificial
  CRISPR gRNA sequence
caaaaaatgaaaaaaaaatg

SEQ ID NO: 331575 - DNA, 20 bp, Artificial
  CRISPR gRNA sequence
atcaaatgtttcatcttgtg

SEQ ID NO: 331576 - DNA, 20 bp, Artificial
  CRISPR gRNA sequence
catcttgtgctggctcaaag

SEQ ID NO: 331577 - DNA, 20 bp, Artificial
  CRISPR gRNA sequence
atcttgtgctggctcaaagt

SEQ ID NO: 331578 - DNA, 20 bp, Artificial
  CRISPR gRNA sequence
gtgctggctcaaagtgagtt

SEQ ID NO: 331579 - DNA, 20 bp, Artificial
  CRISPR gRNA sequence
tgctggctcaaagtgagtta

SEQ ID NO: 331580 - DNA, 20 bp, Artificial
  CRISPR gRNA sequence
gctcaaagtgagttaagtgc

SEQ ID NO: 331581 - DNA, 20 bp, Artificial
  CRISPR gRNA sequence
aaagtgagttaagtgcagtt

SEQ ID NO: 331582 - DNA, 20 bp, Artificial
  CRISPR gRNA sequence
agtgcagttaagaggattga

SEQ ID NO: 331583 - DNA, 20 bp, Artificial
  CRISPR gRNA sequence
agaggattgaggaatgtaga

SEQ ID NO: 331584 - DNA, 20 bp, Artificial
  CRISPR gRNA sequence
aggaatgtagaatgagcaca

SEQ ID NO: 331585 - DNA, 20 bp, Artificial
  CRISPR gRNA sequence
tgggctacttgctggtttat

SEQ ID NO: 331586 - DNA, 20 bp, Artificial
  CRISPR gRNA sequence
gggctacttgctggtttatg

SEQ ID NO: 331587 - DNA, 20 bp, Artificial
  CRISPR gRNA sequence
ggctacttgctggtttatgc

SEQ ID NO: 331588 - DNA, 20 bp, Artificial
  CRISPR gRNA sequence
cttgctggtttatgcctttt

SEQ ID NO: 331589 - DNA, 20 bp, Artificial
  CRISPR gRNA sequence
gctggtttatgccttttcta

SEQ ID NO: 331590 - DNA, 20 bp, Artificial
  CRISPR gRNA sequence
ctggtttatgccttttctag

SEQ ID NO: 331591 - DNA, 20 bp, Artificial
  CRISPR gRNA sequence
gtttatgccttttctagaat

SEQ ID NO: 331592 - DNA, 20 bp, Artificial
  CRISPR gRNA sequence
atgccttttctagaatctca

SEQ ID NO: 331593 - DNA, 20 bp, Artificial
  CRISPR gRNA sequence
tgccttttctagaatctcat

SEQ ID NO: 331594 - DNA, 20 bp, Artificial
  CRISPR gRNA sequence
ttctagaatctcatgaagtc

SEQ ID NO: 331595 - DNA, 20 bp, Artificial
  CRISPR gRNA sequence
tctagaatctcatgaagtcc

SEQ ID NO: 331596 - DNA, 20 bp, Artificial
  CRISPR gRNA sequence
ctagaatctcatgaagtcct

SEQ ID NO: 331597 - DNA, 20 bp, Artificial
  CRISPR gRNA sequence
tagaatctcatgaagtcctt

SEQ ID NO: 331598 - DNA, 20 bp, Artificial
  CRISPR gRNA sequence
gaatctcatgaagtccttta

SEQ ID NO: 331599 - DNA, 20 bp, Artificial
  CRISPR gRNA sequence
atgaagtcctttagcggcat

SEQ ID NO: 331600 - DNA, 20 bp, Artificial
  CRISPR gRNA sequence
tagcggcatgaatgacatga

SEQ ID NO: 331601 - DNA, 20 bp, Artificial
  CRISPR gRNA sequence
agcggcatgaatgacatgag

SEQ ID NO: 331602 - DNA, 20 bp, Artificial
  CRISPR gRNA sequence
gcggcatgaatgacatgagc

SEQ ID NO: 331603 - DNA, 20 bp, Artificial
  CRISPR gRNA sequence
tggaatttatattcattctt

SEQ ID NO: 331604 - DNA, 20 bp, Artificial
  CRISPR gRNA sequence
ggaatttatattcattcttc

SEQ ID NO: 331605 - DNA, 20 bp, Artificial
  CRISPR gRNA sequence
gaatttatattcattcttca

SEQ ID NO: 331606 - DNA, 20 bp, Artificial
  CRISPR gRNA sequence
atattcattcttcattcatc

SEQ ID NO: 331607 - DNA, 20 bp, Artificial
  CRISPR gRNA sequence
tattcattcttcattcatcc

SEQ ID NO: 331608 - DNA, 20 bp, Artificial
  CRISPR gRNA sequence
attcttcattcatccattta

SEQ ID NO: 331609 - DNA, 20 bp, Artificial
  CRISPR gRNA sequence
ttcattcatccatttactca

SEQ ID NO: 331610 - DNA, 20 bp, Artificial
  CRISPR gRNA sequence
cattcatccatttactcatg

SEQ ID NO: 331611 - DNA, 20 bp, Artificial
  CRISPR gRNA sequence
attcatccatttactcatgt

SEQ ID NO: 331612 - DNA, 20 bp, Artificial
  CRISPR gRNA sequence
atccatttactcatgtagca

SEQ ID NO: 331613 - DNA, 20 bp, Artificial
  CRISPR gRNA sequence
actcatgtagcattgagcac

SEQ ID NO: 331614 - DNA, 20 bp, Artificial
  CRISPR gRNA sequence
ctcatgtagcattgagcacc

SEQ ID NO: 331615 - DNA, 20 bp, Artificial
  CRISPR gRNA sequence
atgtagcattgagcacctgc

SEQ ID NO: 331616 - DNA, 20 bp, Artificial
  CRISPR gRNA sequence
agcacctgcctggtagcagg

SEQ ID NO: 331617 - DNA, 20 bp, Artificial
  CRISPR gRNA sequence
cctggtagcaggtactgtgc

SEQ ID NO: 331618 - DNA, 20 bp, Artificial
  CRISPR gRNA sequence
gtagcaggtactgtgccaga

SEQ ID NO: 331619 - DNA, 20 bp, Artificial
  CRISPR gRNA sequence
tgccagatggtgtatgtaca

SEQ ID NO: 331620 - DNA, 20 bp, Artificial
  CRISPR gRNA sequence
ttctttggaaggtaactgca

SEQ ID NO: 331621 - DNA, 20 bp, Artificial
  CRISPR gRNA sequence
tttggaaggtaactgcatgg

SEQ ID NO: 331622 - DNA, 20 bp, Artificial
  CRISPR gRNA sequence
tggaaggtaactgcatggta

SEQ ID NO: 331623 - DNA, 20 bp, Artificial
  CRISPR gRNA sequence
ggaaggtaactgcatggtag

SEQ ID NO: 331624 - DNA, 20 bp, Artificial
  CRISPR gRNA sequence
gaaggtaactgcatggtaga

SEQ ID NO: 331625 - DNA, 20 bp, Artificial
  CRISPR gRNA sequence
catggtagagagagatatat

SEQ ID NO: 331626 - DNA, 20 bp, Artificial
  CRISPR gRNA sequence
atcaaataatcccattgatt

SEQ ID NO: 331627 - DNA, 20 bp, Artificial
  CRISPR gRNA sequence
attaatgataattacaggca

SEQ ID NO: 331628 - DNA, 20 bp, Artificial
  CRISPR gRNA sequence
atgataattacaggcaaaac

SEQ ID NO: 331629 - DNA, 20 bp, Artificial
  CRISPR gRNA sequence
caggcaaaactcaattatat

SEQ ID NO: 331630 - DNA, 20 bp, Artificial
  CRISPR gRNA sequence
aattatatgagggaatgtaa

SEQ ID NO: 331631 - DNA, 20 bp, Artificial
  CRISPR gRNA sequence
tatgagggaatgtaacaagg

SEQ ID NO: 331632 - DNA, 20 bp, Artificial
  CRISPR gRNA sequence
gactagactgggtgggtgtg

SEQ ID NO: 331633 - DNA, 20 bp, Artificial
  CRISPR gRNA sequence
actagactgggtgggtgtgg

SEQ ID NO: 331634 - DNA, 20 bp, Artificial
  CRISPR gRNA sequence
gactgggtgggtgtggaggt

SEQ ID NO: 331635 - DNA, 20 bp, Artificial
  CRISPR gRNA sequence
ggtgggtgtggaggtgtagc

SEQ ID NO: 331636 - DNA, 20 bp, Artificial
  CRISPR gRNA sequence
aggagcagggttcattgaag

SEQ ID NO: 331637 - DNA, 20 bp, Artificial
  CRISPR gRNA sequence
attgaagtctttcctgtgca

SEQ ID NO: 331638 - DNA, 20 bp, Artificial
  CRISPR gRNA sequence
aagtctttcctgtgcaagtg

SEQ ID NO: 331639 - DNA, 20 bp, Artificial
  CRISPR gRNA sequence
tcctgtgcaagtggcacttg

SEQ ID NO: 331640 - DNA, 20 bp, Artificial
  CRISPR gRNA sequence
cctgtgcaagtggcacttga

SEQ ID NO: 331641 - DNA, 20 bp, Artificial
  CRISPR gRNA sequence
ctgtgcaagtggcacttgag

SEQ ID NO: 331642 - DNA, 20 bp, Artificial
  CRISPR gRNA sequence
tgcaagtggcacttgagcgg

SEQ ID NO: 331643 - DNA, 20 bp, Artificial
  CRISPR gRNA sequence
gagcggagatttcaaggaca

SEQ ID NO: 331644 - DNA, 20 bp, Artificial
  CRISPR gRNA sequence
agcggagatttcaaggacaa

SEQ ID NO: 331645 - DNA, 20 bp, Artificial
  CRISPR gRNA sequence
caaggacaaggtagcaatca

SEQ ID NO: 331646 - DNA, 20 bp, Artificial
  CRISPR gRNA sequence
aaggacaaggtagcaatcaa

SEQ ID NO: 331647 - DNA, 20 bp, Artificial
  CRISPR gRNA sequence
cataccatggaaggaacaag

SEQ ID NO: 331648 - DNA, 20 bp, Artificial
  CRISPR gRNA sequence
tggcaggaaggaatgaggta

SEQ ID NO: 331649 - DNA, 20 bp, Artificial
  CRISPR gRNA sequence
gggaactagaagaaagcaga

SEQ ID NO: 331650 - DNA, 20 bp, Artificial
  CRISPR gRNA sequence
gaagaaagcagacagatgtg

SEQ ID NO: 331651 - DNA, 20 bp, Artificial
  CRISPR gRNA sequence
agcacaaagagggaagaggc

SEQ ID NO: 331652 - DNA, 20 bp, Artificial
  CRISPR gRNA sequence
agcttggtccaagatgacca

SEQ ID NO: 331653 - DNA, 20 bp, Artificial
  CRISPR gRNA sequence
ggtccaagatgaccaactgg

SEQ ID NO: 331654 - DNA, 20 bp, Artificial
  CRISPR gRNA sequence
gtccaagatgaccaactggt

SEQ ID NO: 331655 - DNA, 20 bp, Artificial
  CRISPR gRNA sequence
gtccaagttggtccaaggtg

SEQ ID NO: 331656 - DNA, 20 bp, Artificial
  CRISPR gRNA sequence
gtccaaggtgaggctggaaa

SEQ ID NO: 331657 - DNA, 20 bp, Artificial
  CRISPR gRNA sequence
gaaaggaaagtagaggccag

SEQ ID NO: 331658 - DNA, 20 bp, Artificial
  CRISPR gRNA sequence
agaccatatagtctatgttc

SEQ ID NO: 331659 - DNA, 20 bp, Artificial
  CRISPR gRNA sequence
tgttccagattttggatatt

SEQ ID NO: 331660 - DNA, 20 bp, Artificial
  CRISPR gRNA sequence
cagattttggatattcttcc

SEQ ID NO: 331661 - DNA, 20 bp, Artificial
  CRISPR gRNA sequence
tggatattcttccaagaacg

SEQ ID NO: 331662 - DNA, 20 bp, Artificial
  CRISPR gRNA sequence
ggatattcttccaagaacgt

SEQ ID NO: 331663 - DNA, 20 bp, Artificial
  CRISPR gRNA sequence
gatattcttccaagaacgtt

SEQ ID NO: 331664 - DNA, 20 bp, Artificial
  CRISPR gRNA sequence
ttccaagaacgttggtacca

SEQ ID NO: 331665 - DNA, 20 bp, Artificial
  CRISPR gRNA sequence
ccaagaacgttggtaccatt

SEQ ID NO: 331666 - DNA, 20 bp, Artificial
  CRISPR gRNA sequence
caagaacgttggtaccattc

SEQ ID NO: 331667 - DNA, 20 bp, Artificial
  CRISPR gRNA sequence
gtaccattcgtggaagggtt

SEQ ID NO: 331668 - DNA, 20 bp, Artificial
  CRISPR gRNA sequence
gtggaagggtttgtttgtat

SEQ ID NO: 331669 - DNA, 20 bp, Artificial
  CRISPR gRNA sequence
gtttgtattgataaaaatca

SEQ ID NO: 331670 - DNA, 20 bp, Artificial
  CRISPR gRNA sequence
tttgtattgataaaaatcat

SEQ ID NO: 331671 - DNA, 20 bp, Artificial
  CRISPR gRNA sequence
gtattgataaaaatcattca

SEQ ID NO: 331672 - DNA, 20 bp, Artificial
  CRISPR gRNA sequence
tattgataaaaatcattcaa

SEQ ID NO: 331673 - DNA, 20 bp, Artificial
  CRISPR gRNA sequence
ataaaaatcattcaactagg

SEQ ID NO: 331674 - DNA, 20 bp, Artificial
  CRISPR gRNA sequence
aactaggccaaaccaatttg

SEQ ID NO: 331675 - DNA, 20 bp, Artificial
  CRISPR gRNA sequence
ggccaaaccaatttgggcag

SEQ ID NO: 331676 - DNA, 20 bp, Artificial
  CRISPR gRNA sequence
gggcagttctggttgtggta

SEQ ID NO: 331677 - DNA, 20 bp, Artificial
  CRISPR gRNA sequence
ggcagttctggttgtggtat

SEQ ID NO: 331678 - DNA, 20 bp, Artificial
  CRISPR gRNA sequence
tggttgtggtattatgctca

SEQ ID NO: 331679 - DNA, 20 bp, Artificial
  CRISPR gRNA sequence
gttgtggtattatgctcagg

SEQ ID NO: 331680 - DNA, 20 bp, Artificial
  CRISPR gRNA sequence
tggtattatgctcaggagaa

SEQ ID NO: 331681 - DNA, 20 bp, Artificial
  CRISPR gRNA sequence
tgctcaggagaattaaagta

SEQ ID NO: 331682 - DNA, 20 bp, Artificial
  CRISPR gRNA sequence
aggagaattaaagtagcatc

SEQ ID NO: 331683 - DNA, 20 bp, Artificial
  CRISPR gRNA sequence
aagtagcatcggtgtcaatt

SEQ ID NO: 331684 - DNA, 20 bp, Artificial
  CRISPR gRNA sequence
tgtggaaggtgagatccagc

SEQ ID NO: 331685 - DNA, 20 bp, Artificial
  CRISPR gRNA sequence
tggaaggtgagatccagcct

SEQ ID NO: 331686 - DNA, 20 bp, Artificial
  CRISPR gRNA sequence
aggtaggattgttttaagtt

SEQ ID NO: 331687 - DNA, 20 bp, Artificial
  CRISPR gRNA sequence
ggtaggattgttttaagttt

SEQ ID NO: 331688 - DNA, 20 bp, Artificial
  CRISPR gRNA sequence
ttttaagtttccagattaag

SEQ ID NO: 331689 - DNA, 20 bp, Artificial
  CRISPR gRNA sequence
taagtttccagattaagctg

SEQ ID NO: 331690 - DNA, 20 bp, Artificial
  CRISPR gRNA sequence
aagtttccagattaagctga

SEQ ID NO: 331691 - DNA, 20 bp, Artificial
  CRISPR gRNA sequence
agtttccagattaagctgac

SEQ ID NO: 331692 - DNA, 20 bp, Artificial
  CRISPR gRNA sequence
ccagattaagctgacgaata

SEQ ID NO: 331693 - DNA, 20 bp, Artificial
  CRISPR gRNA sequence
cagattaagctgacgaataa

SEQ ID NO: 331694 - DNA, 20 bp, Artificial
  CRISPR gRNA sequence
agctgacgaataatttgtat

SEQ ID NO: 331695 - DNA, 20 bp, Artificial
  CRISPR gRNA sequence
acgaataatttgtattctgg

SEQ ID NO: 331696 - DNA, 20 bp, Artificial
  CRISPR gRNA sequence
gtattctggaacaatattca

SEQ ID NO: 331697 - DNA, 20 bp, Artificial
  CRISPR gRNA sequence
tattctggaacaatattcat

SEQ ID NO: 331698 - DNA, 20 bp, Artificial
  CRISPR gRNA sequence
tggaacaatattcatcgtag

SEQ ID NO: 331699 - DNA, 20 bp, Artificial
  CRISPR gRNA sequence
gaacaatattcatcgtagat

SEQ ID NO: 331700 - DNA, 20 bp, Artificial
  CRISPR gRNA sequence
atcgtagattctaaatgaat

SEQ ID NO: 331701 - DNA, 20 bp, Artificial
  CRISPR gRNA sequence
taaatgaatacaaccaatgt

SEQ ID NO: 331702 - DNA, 20 bp, Artificial
  CRISPR gRNA sequence
aatgaatacaaccaatgttc

SEQ ID NO: 331703 - DNA, 20 bp, Artificial
  CRISPR gRNA sequence
actctcattataaagaaagc

SEQ ID NO: 331704 - DNA, 20 bp, Artificial
  CRISPR gRNA sequence
tcattataaagaaagccatg

SEQ ID NO: 331705 - DNA, 20 bp, Artificial
  CRISPR gRNA sequence
attataaagaaagccatgag

SEQ ID NO: 331706 - DNA, 20 bp, Artificial
  CRISPR gRNA sequence
taaagaaagccatgagatgt

SEQ ID NO: 331707 - DNA, 20 bp, Artificial
  CRISPR gRNA sequence
tttggcatgtggcaaacctg

SEQ ID NO: 331708 - DNA, 20 bp, Artificial
  CRISPR gRNA sequence
ggcatgtggcaaacctgagg

SEQ ID NO: 331709 - DNA, 20 bp, Artificial
  CRISPR gRNA sequence
gcatgtggcaaacctgaggc

SEQ ID NO: 331710 - DNA, 20 bp, Artificial
  CRISPR gRNA sequence
aggcacgagtggctaaatgg

SEQ ID NO: 331711 - DNA, 20 bp, Artificial
  CRISPR gRNA sequence
aatggtaacaataaatctgc

SEQ ID NO: 331712 - DNA, 20 bp, Artificial
  CRISPR gRNA sequence
ctagcaatgatcctatttaa

SEQ ID NO: 331713 - DNA, 20 bp, Artificial
  CRISPR gRNA sequence
gcaatgatcctatttaaaat

SEQ ID NO: 331714 - DNA, 20 bp, Artificial
  CRISPR gRNA sequence
tttaaaatatctccacaatg

SEQ ID NO: 331715 - DNA, 20 bp, Artificial
  CRISPR gRNA sequence
aaaatatctccacaatgcat

SEQ ID NO: 331716 - DNA, 20 bp, Artificial
  CRISPR gRNA sequence
aaatatctccacaatgcatg

SEQ ID NO: 331717 - DNA, 20 bp, Artificial
  CRISPR gRNA sequence
cacaatgcatgtatccagaa

SEQ ID NO: 331718 - DNA, 20 bp, Artificial
  CRISPR gRNA sequence
ccatgtaaaagctctaaaga

SEQ ID NO: 331719 - DNA, 20 bp, Artificial
  CRISPR gRNA sequence
taaagaaaaagagccaaact

SEQ ID NO: 331720 - DNA, 20 bp, Artificial
  CRISPR gRNA sequence
aagaaaaagagccaaactca

SEQ ID NO: 331721 - DNA, 20 bp, Artificial
  CRISPR gRNA sequence
aagtaaactaagtacttgct

SEQ ID NO: 331722 - DNA, 20 bp, Artificial
  CRISPR gRNA sequence
agtacttgcttgtcctctgt

SEQ ID NO: 331723 - DNA, 20 bp, Artificial
  CRISPR gRNA sequence
gcttgtcctctgttgtattt

SEQ ID NO: 331724 - DNA, 20 bp, Artificial
  CRISPR gRNA sequence
cttgtcctctgttgtatttt

SEQ ID NO: 331725 - DNA, 20 bp, Artificial
  CRISPR gRNA sequence
gtcctctgttgtattttcaa

SEQ ID NO: 331726 - DNA, 20 bp, Artificial
  CRISPR gRNA sequence
tcctctgttgtattttcaat

SEQ ID NO: 331727 - DNA, 20 bp, Artificial
  CRISPR gRNA sequence
tgttgtattttcaatcctcc

SEQ ID NO: 331728 - DNA, 20 bp, Artificial
  CRISPR gRNA sequence
ttgtattttcaatcctccca

SEQ ID NO: 331729 - DNA, 20 bp, Artificial
  CRISPR gRNA sequence
tattttcaatcctcccaatt

SEQ ID NO: 331730 - DNA, 20 bp, Artificial
  CRISPR gRNA sequence
tcaatcctcccaatttacat

SEQ ID NO: 331731 - DNA, 20 bp, Artificial
  CRISPR gRNA sequence
caatcctcccaatttacata

SEQ ID NO: 331732 - DNA, 20 bp, Artificial
  CRISPR gRNA sequence
aatcctcccaatttacatag

SEQ ID NO: 331733 - DNA, 20 bp, Artificial
  CRISPR gRNA sequence
ccaatttacataggctttct

SEQ ID NO: 331734 - DNA, 20 bp, Artificial
  CRISPR gRNA sequence
acataggctttctcatgcca

SEQ ID NO: 331735 - DNA, 20 bp, Artificial
  CRISPR gRNA sequence
cataggctttctcatgccat

SEQ ID NO: 331736 - DNA, 20 bp, Artificial
  CRISPR gRNA sequence
tctcatgccatgaagatgta

SEQ ID NO: 331737 - DNA, 20 bp, Artificial
  CRISPR gRNA sequence
ctcatgccatgaagatgtag

SEQ ID NO: 331738 - DNA, 20 bp, Artificial
  CRISPR gRNA sequence
tcatgccatgaagatgtagg

SEQ ID NO: 331739 - DNA, 20 bp, Artificial
  CRISPR gRNA sequence
atgccatgaagatgtaggca

SEQ ID NO: 331740 - DNA, 20 bp, Artificial
  CRISPR gRNA sequence
ttacctttagtcagtgtttg

SEQ ID NO: 331741 - DNA, 20 bp, Artificial
  CRISPR gRNA sequence
acctttagtcagtgtttgaa

SEQ ID NO: 331742 - DNA, 20 bp, Artificial
  CRISPR gRNA sequence
cctttagtcagtgtttgaag

SEQ ID NO: 331743 - DNA, 20 bp, Artificial
  CRISPR gRNA sequence
tagtcagtgtttgaagaatt

SEQ ID NO: 331744 - DNA, 20 bp, Artificial
  CRISPR gRNA sequence
agtcagtgtttgaagaattt

SEQ ID NO: 331745 - DNA, 20 bp, Artificial
  CRISPR gRNA sequence
gtcagtgtttgaagaatttc

SEQ ID NO: 331746 - DNA, 20 bp, Artificial
  CRISPR gRNA sequence
gaagaatttccaaccaggaa

SEQ ID NO: 331747 - DNA, 20 bp, Artificial
  CRISPR gRNA sequence
aagaatttccaaccaggaaa

SEQ ID NO: 331748 - DNA, 20 bp, Artificial
  CRISPR gRNA sequence
ccaaccaggaaaggttaagt

SEQ ID NO: 331749 - DNA, 20 bp, Artificial
  CRISPR gRNA sequence
caaccaggaaaggttaagtg

SEQ ID NO: 331750 - DNA, 20 bp, Artificial
  CRISPR gRNA sequence
agtgatttgttacacagtag

SEQ ID NO: 331751 - DNA, 20 bp, Artificial
  CRISPR gRNA sequence
gttacacagtagttggtggc

SEQ ID NO: 331752 - DNA, 20 bp, Artificial
  CRISPR gRNA sequence
ttacacagtagttggtggca

SEQ ID NO: 331753 - DNA, 20 bp, Artificial
  CRISPR gRNA sequence
cacagtagttggtggcagaa

SEQ ID NO: 331754 - DNA, 20 bp, Artificial
  CRISPR gRNA sequence
gtggcagaaccaaagttaga

SEQ ID NO: 331755 - DNA, 20 bp, Artificial
  CRISPR gRNA sequence
gaactctaatgtgactccaa

SEQ ID NO: 331756 - DNA, 20 bp, Artificial
  CRISPR gRNA sequence
taatgtgactccaacatcta

SEQ ID NO: 331757 - DNA, 20 bp, Artificial
  CRISPR gRNA sequence
atgtgactccaacatctaca

SEQ ID NO: 331758 - DNA, 20 bp, Artificial
  CRISPR gRNA sequence
caacatctacattctttcta

SEQ ID NO: 331759 - DNA, 20 bp, Artificial
  CRISPR gRNA sequence
cattctttctaaactgtgtt

SEQ ID NO: 331760 - DNA, 20 bp, Artificial
  CRISPR gRNA sequence
tttctaaactgtgttgaagt

SEQ ID NO: 331761 - DNA, 20 bp, Artificial
  CRISPR gRNA sequence
tctaaactgtgttgaagtag

SEQ ID NO: 331762 - DNA, 20 bp, Artificial
  CRISPR gRNA sequence
ctaaactgtgttgaagtagt

SEQ ID NO: 331763 - DNA, 20 bp, Artificial
  CRISPR gRNA sequence
taaactgtgttgaagtagtg

SEQ ID NO: 331764 - DNA, 20 bp, Artificial
  CRISPR gRNA sequence
aactgtgttgaagtagtgga

SEQ ID NO: 331765 - DNA, 20 bp, Artificial
  CRISPR gRNA sequence
tgttgaagtagtggaggtgt

SEQ ID NO: 331766 - DNA, 20 bp, Artificial
  CRISPR gRNA sequence
aagtagtggaggtgtaacat

SEQ ID NO: 331767 - DNA, 20 bp, Artificial
  CRISPR gRNA sequence
aaggaacgtaaatctcaatg

SEQ ID NO: 331768 - DNA, 20 bp, Artificial
  CRISPR gRNA sequence
aatgattctgatcacctttg

SEQ ID NO: 331769 - DNA, 20 bp, Artificial
  CRISPR gRNA sequence
tgatcacctttgttatttgg

SEQ ID NO: 331770 - DNA, 20 bp, Artificial
  CRISPR gRNA sequence
atcacctttgttatttggtt

SEQ ID NO: 331771 - DNA, 20 bp, Artificial
  CRISPR gRNA sequence
tgttatttggttgtgaatta

SEQ ID NO: 331772 - DNA, 20 bp, Artificial
  CRISPR gRNA sequence
gttatttggttgtgaattaa

SEQ ID NO: 331773 - DNA, 20 bp, Artificial
  CRISPR gRNA sequence
ttatttggttgtgaattaag

SEQ ID NO: 331774 - DNA, 20 bp, Artificial
  CRISPR gRNA sequence
tttggttgtgaattaagaag

SEQ ID NO: 331775 - DNA, 20 bp, Artificial
  CRISPR gRNA sequence
ggttgtgaattaagaaggat

SEQ ID NO: 331776 - DNA, 20 bp, Artificial
  CRISPR gRNA sequence
gttgtgaattaagaaggatg

SEQ ID NO: 331777 - DNA, 20 bp, Artificial
  CRISPR gRNA sequence
tgaattaagaaggatgggaa

SEQ ID NO: 331778 - DNA, 20 bp, Artificial
  CRISPR gRNA sequence
agaaggatgggaatcttgct

SEQ ID NO: 331779 - DNA, 20 bp, Artificial
  CRISPR gRNA sequence
gctgatttctagtctttgat

SEQ ID NO: 331780 - DNA, 20 bp, Artificial
  CRISPR gRNA sequence
ctgatttctagtctttgatg

SEQ ID NO: 331781 - DNA, 20 bp, Artificial
  CRISPR gRNA sequence
atttctagtctttgatggat

SEQ ID NO: 331782 - DNA, 20 bp, Artificial
  CRISPR gRNA sequence
ctagtctttgatggatctca

SEQ ID NO: 331783 - DNA, 20 bp, Artificial
  CRISPR gRNA sequence
tagtctttgatggatctcaa

SEQ ID NO: 331784 - DNA, 20 bp, Artificial
  CRISPR gRNA sequence
gtctttgatggatctcaatg

SEQ ID NO: 331785 - DNA, 20 bp, Artificial
  CRISPR gRNA sequence
tgatggatctcaatgtagaa

SEQ ID NO: 331786 - DNA, 20 bp, Artificial
  CRISPR gRNA sequence
gatggatctcaatgtagaat

SEQ ID NO: 331787 - DNA, 20 bp, Artificial
  CRISPR gRNA sequence
atggatctcaatgtagaatt

SEQ ID NO: 331788 - DNA, 20 bp, Artificial
  CRISPR gRNA sequence
aatgtagaatttaacaaagt

SEQ ID NO: 331789 - DNA, 20 bp, Artificial
  CRISPR gRNA sequence
aacaaagtcttgtttttttt

SEQ ID NO: 331790 - DNA, 20 bp, Artificial
  CRISPR gRNA sequence
acaaagtcttgttttttttt

SEQ ID NO: 331791 - DNA, 20 bp, Artificial
  CRISPR gRNA sequence
gtttttttttaatgaacttg

SEQ ID NO: 331792 - DNA, 20 bp, Artificial
  CRISPR gRNA sequence
tttttttttaatgaacttgg

SEQ ID NO: 331793 - DNA, 20 bp, Artificial
  CRISPR gRNA sequence
ttttttaatgaacttggagc

SEQ ID NO: 331794 - DNA, 20 bp, Artificial
  CRISPR gRNA sequence
tttttaatgaacttggagca

SEQ ID NO: 331795 - DNA, 20 bp, Artificial
  CRISPR gRNA sequence
ttttaatgaacttggagcaa

SEQ ID NO: 331796 - DNA, 20 bp, Artificial
  CRISPR gRNA sequence
tttaatgaacttggagcaat

SEQ ID NO: 331797 - DNA, 20 bp, Artificial
  CRISPR gRNA sequence
ttaatgaacttggagcaata

SEQ ID NO: 331798 - DNA, 20 bp, Artificial
  CRISPR gRNA sequence
taatgaacttggagcaatag

SEQ ID NO: 331799 - DNA, 20 bp, Artificial
  CRISPR gRNA sequence
aatgaacttggagcaatagg

SEQ ID NO: 331800 - DNA, 20 bp, Artificial
  CRISPR gRNA sequence
atgaacttggagcaatagga

SEQ ID NO: 331801 - DNA, 20 bp, Artificial
  CRISPR gRNA sequence
ggagcaataggacactttta

SEQ ID NO: 331802 - DNA, 20 bp, Artificial
  CRISPR gRNA sequence
gagcaataggacacttttaa

SEQ ID NO: 331803 - DNA, 20 bp, Artificial
  CRISPR gRNA sequence
ttaattataaaaatatctac

SEQ ID NO: 331804 - DNA, 20 bp, Artificial
  CRISPR gRNA sequence
taattataaaaatatctacg

SEQ ID NO: 331805 - DNA, 20 bp, Artificial
  CRISPR gRNA sequence
aattataaaaatatctacga

SEQ ID NO: 331806 - DNA, 20 bp, Artificial
  CRISPR gRNA sequence
attataaaaatatctacgaa

SEQ ID NO: 331807 - DNA, 20 bp, Artificial
  CRISPR gRNA sequence
taaaaatatctacgaaaaat

SEQ ID NO: 331808 - DNA, 20 bp, Artificial
  CRISPR gRNA sequence
cgaaaaatgtgaatgtctaa

SEQ ID NO: 331809 - DNA, 20 bp, Artificial
  CRISPR gRNA sequence
actacattttgaagaccctc

SEQ ID NO: 331810 - DNA, 20 bp, Artificial
  CRISPR gRNA sequence
cattttgaagaccctctttg

SEQ ID NO: 331811 - DNA, 20 bp, Artificial
  CRISPR gRNA sequence
tgaagaccctctttgtagac

SEQ ID NO: 331812 - DNA, 20 bp, Artificial
  CRISPR gRNA sequence
gaagaccctctttgtagacc

SEQ ID NO: 331813 - DNA, 20 bp, Artificial
  CRISPR gRNA sequence
aagaccctctttgtagacct

SEQ ID NO: 331814 - DNA, 20 bp, Artificial
  CRISPR gRNA sequence
tttgtagaccttataggcaa

SEQ ID NO: 331815 - DNA, 20 bp, Artificial
  CRISPR gRNA sequence
tgtagaccttataggcaaca

SEQ ID NO: 331816 - DNA, 20 bp, Artificial
  CRISPR gRNA sequence
gtagaccttataggcaacag

SEQ ID NO: 331817 - DNA, 20 bp, Artificial
  CRISPR gRNA sequence
tagaccttataggcaacagg

SEQ ID NO: 331818 - DNA, 20 bp, Artificial
  CRISPR gRNA sequence
ataggcaacagggaccatat

SEQ ID NO: 331819 - DNA, 20 bp, Artificial
  CRISPR gRNA sequence
taggcaacagggaccatatg

SEQ ID NO: 331820 - DNA, 20 bp, Artificial
  CRISPR gRNA sequence
tggttttagaaagactactt

SEQ ID NO: 331821 - DNA, 20 bp, Artificial
  CRISPR gRNA sequence
gttttagaaagactacttta

SEQ ID NO: 331822 - DNA, 20 bp, Artificial
  CRISPR gRNA sequence
tagaaagactactttaaaag

SEQ ID NO: 331823 - DNA, 20 bp, Artificial
  CRISPR gRNA sequence
agaaagactactttaaaagc

SEQ ID NO: 331824 - DNA, 20 bp, Artificial
  CRISPR gRNA sequence
gaaagactactttaaaagca

SEQ ID NO: 331825 - DNA, 20 bp, Artificial
  CRISPR gRNA sequence
ctttaaaagcagtgtggata

SEQ ID NO: 331826 - DNA, 20 bp, Artificial
  CRISPR gRNA sequence
taaaagcagtgtggataata

SEQ ID NO: 331827 - DNA, 20 bp, Artificial
  CRISPR gRNA sequence
aaaagcagtgtggataatac

SEQ ID NO: 331828 - DNA, 20 bp, Artificial
  CRISPR gRNA sequence
aaagcagtgtggataataca

SEQ ID NO: 331829 - DNA, 20 bp, Artificial
  CRISPR gRNA sequence
ggaagggctgatggcagagg

SEQ ID NO: 331830 - DNA, 20 bp, Artificial
  CRISPR gRNA sequence
atggcagagggtgtctaata

SEQ ID NO: 331831 - DNA, 20 bp, Artificial
  CRISPR gRNA sequence
ataaacgtgcatgtattatg

SEQ ID NO: 331832 - DNA, 20 bp, Artificial
  CRISPR gRNA sequence
tgatgtgttctgtgaggaag

SEQ ID NO: 331833 - DNA, 20 bp, Artificial
  CRISPR gRNA sequence
tgtgaggaagctgggaggat

SEQ ID NO: 331834 - DNA, 20 bp, Artificial
  CRISPR gRNA sequence
tgaggaagctgggaggatag

SEQ ID NO: 331835 - DNA, 20 bp, Artificial
  CRISPR gRNA sequence
ggaggatagccctcaaggcc

SEQ ID NO: 331836 - DNA, 20 bp, Artificial
  CRISPR gRNA sequence
aaggccactttgagccttcc

SEQ ID NO: 331837 - DNA, 20 bp, Artificial
  CRISPR gRNA sequence
tgagccttcctttgtcactg

SEQ ID NO: 331838 - DNA, 20 bp, Artificial
  CRISPR gRNA sequence
gagccttcctttgtcactga

SEQ ID NO: 331839 - DNA, 20 bp, Artificial
  CRISPR gRNA sequence
agccttcctttgtcactgag

SEQ ID NO: 331840 - DNA, 20 bp, Artificial
  CRISPR gRNA sequence
cctttgtcactgaggcattc

SEQ ID NO: 331841 - DNA, 20 bp, Artificial
  CRISPR gRNA sequence
ctttgtcactgaggcattcc

SEQ ID NO: 331842 - DNA, 20 bp, Artificial
  CRISPR gRNA sequence
tgtcactgaggcattccatt

SEQ ID NO: 331843 - DNA, 20 bp, Artificial
  CRISPR gRNA sequence
gtcactgaggcattccatta

SEQ ID NO: 331844 - DNA, 20 bp, Artificial
  CRISPR gRNA sequence
tcactgaggcattccattag

SEQ ID NO: 331845 - DNA, 20 bp, Artificial
  CRISPR gRNA sequence
aggcattccattagtgactc

SEQ ID NO: 331846 - DNA, 20 bp, Artificial
  CRISPR gRNA sequence
cattagtgactcctgaattc

SEQ ID NO: 331847 - DNA, 20 bp, Artificial
  CRISPR gRNA sequence
gtgactcctgaattccactt

SEQ ID NO: 331848 - DNA, 20 bp, Artificial
  CRISPR gRNA sequence
ctgaattccacttgggaaaa

SEQ ID NO: 331849 - DNA, 20 bp, Artificial
  CRISPR gRNA sequence
aattccacttgggaaaagag

SEQ ID NO: 331850 - DNA, 20 bp, Artificial
  CRISPR gRNA sequence
cacttgggaaaagagcccct

SEQ ID NO: 331851 - DNA, 20 bp, Artificial
  CRISPR gRNA sequence
gggaaaagagcccctcagtg

SEQ ID NO: 331852 - DNA, 20 bp, Artificial
  CRISPR gRNA sequence
ggaaaagagcccctcagtgt

SEQ ID NO: 331853 - DNA, 20 bp, Artificial
  CRISPR gRNA sequence
agtgtctccagcgtctgaga

SEQ ID NO: 331854 - DNA, 20 bp, Artificial
  CRISPR gRNA sequence
cagcgtctgagagaagtctg

SEQ ID NO: 331855 - DNA, 20 bp, Artificial
  CRISPR gRNA sequence
agagaagtctgtgaagatga

SEQ ID NO: 331856 - DNA, 20 bp, Artificial
  CRISPR gRNA sequence
tgaagatgactgaccttgga

SEQ ID NO: 331857 - DNA, 20 bp, Artificial
  CRISPR gRNA sequence
accttggagcccctcttagc

SEQ ID NO: 331858 - DNA, 20 bp, Artificial
  CRISPR gRNA sequence
ggagcccctcttagcctctc

SEQ ID NO: 331859 - DNA, 20 bp, Artificial
  CRISPR gRNA sequence
gagcccctcttagcctctcc

SEQ ID NO: 331860 - DNA, 20 bp, Artificial
  CRISPR gRNA sequence
ttagcctctccacgactgag

SEQ ID NO: 331861 - DNA, 20 bp, Artificial
  CRISPR gRNA sequence
agcctctccacgactgagta

SEQ ID NO: 331862 - DNA, 20 bp, Artificial
  CRISPR gRNA sequence
gcctctccacgactgagtaa

SEQ ID NO: 331863 - DNA, 20 bp, Artificial
  CRISPR gRNA sequence
tccacgactgagtaaatgtc

SEQ ID NO: 331864 - DNA, 20 bp, Artificial
  CRISPR gRNA sequence
cacgactgagtaaatgtcat

SEQ ID NO: 331865 - DNA, 20 bp, Artificial
  CRISPR gRNA sequence
agtaaatgtcatctcctgac

SEQ ID NO: 331866 - DNA, 20 bp, Artificial
  CRISPR gRNA sequence
ctgacagcacccccttccag

SEQ ID NO: 331867 - DNA, 20 bp, Artificial
  CRISPR gRNA sequence
acagcacccccttccagagt

SEQ ID NO: 331868 - DNA, 20 bp, Artificial
  CRISPR gRNA sequence
ccagagtgttcttgttagat

SEQ ID NO: 331869 - DNA, 20 bp, Artificial
  CRISPR gRNA sequence
cagagtgttcttgttagatt

SEQ ID NO: 331870 - DNA, 20 bp, Artificial
  CRISPR gRNA sequence
ttgttagatttaacaaaaat

SEQ ID NO: 331871 - DNA, 20 bp, Artificial
  CRISPR gRNA sequence
gttagatttaacaaaaatcc

SEQ ID NO: 331872 - DNA, 20 bp, Artificial
  CRISPR gRNA sequence
ttagatttaacaaaaatccc

SEQ ID NO: 331873 - DNA, 20 bp, Artificial
  CRISPR gRNA sequence
gatttaacaaaaatcccagt

SEQ ID NO: 331874 - DNA, 20 bp, Artificial
  CRISPR gRNA sequence
aacaaaaatcccagttgtca

SEQ ID NO: 331875 - DNA, 20 bp, Artificial
  CRISPR gRNA sequence
acaaaaatcccagttgtcaa

SEQ ID NO: 331876 - DNA, 20 bp, Artificial
  CRISPR gRNA sequence
tcaattttttcttttgatag

SEQ ID NO: 331877 - DNA, 20 bp, Artificial
  CRISPR gRNA sequence
tttcttttgatagatgaatt

SEQ ID NO: 331878 - DNA, 20 bp, Artificial
  CRISPR gRNA sequence
ttcttttgatagatgaattc

SEQ ID NO: 331879 - DNA, 20 bp, Artificial
  CRISPR gRNA sequence
tcttttgatagatgaattca

SEQ ID NO: 331880 - DNA, 20 bp, Artificial
  CRISPR gRNA sequence
cttttgatagatgaattcag

SEQ ID NO: 331881 - DNA, 20 bp, Artificial
  CRISPR gRNA sequence
ttttgatagatgaattcagg

SEQ ID NO: 331882 - DNA, 20 bp, Artificial
  CRISPR gRNA sequence
ttgatagatgaattcaggcc

SEQ ID NO: 331883 - DNA, 20 bp, Artificial
  CRISPR gRNA sequence
tgatagatgaattcaggcca

SEQ ID NO: 331884 - DNA, 20 bp, Artificial
  CRISPR gRNA sequence
gatagatgaattcaggccat

SEQ ID NO: 331885 - DNA, 20 bp, Artificial
  CRISPR gRNA sequence
atagatgaattcaggccatt

SEQ ID NO: 331886 - DNA, 20 bp, Artificial
  CRISPR gRNA sequence
aggccattcccagtcagcat

SEQ ID NO: 331887 - DNA, 20 bp, Artificial
  CRISPR gRNA sequence
ccagtcagcataagcctcta

SEQ ID NO: 331888 - DNA, 20 bp, Artificial
  CRISPR gRNA sequence
tacttgattttatttctatg

SEQ ID NO: 331889 - DNA, 20 bp, Artificial
  CRISPR gRNA sequence
cttgattttatttctatgtt

SEQ ID NO: 331890 - DNA, 20 bp, Artificial
  CRISPR gRNA sequence
gattttatttctatgtttat

SEQ ID NO: 331891 - DNA, 20 bp, Artificial
  CRISPR gRNA sequence
attttatttctatgtttatt

SEQ ID NO: 331892 - DNA, 20 bp, Artificial
  CRISPR gRNA sequence
tatttctatgtttatttact

SEQ ID NO: 331893 - DNA, 20 bp, Artificial
  CRISPR gRNA sequence
atttctatgtttatttacta

SEQ ID NO: 331894 - DNA, 20 bp, Artificial
  CRISPR gRNA sequence
tttctatgtttatttactac

SEQ ID NO: 331895 - DNA, 20 bp, Artificial
  CRISPR gRNA sequence
ctatgtttatttactactta

SEQ ID NO: 331896 - DNA, 20 bp, Artificial
  CRISPR gRNA sequence
tatgtttatttactacttat

SEQ ID NO: 331897 - DNA, 20 bp, Artificial
  CRISPR gRNA sequence
tgtttatttactacttattt

SEQ ID NO: 331898 - DNA, 20 bp, Artificial
  CRISPR gRNA sequence
atttactacttatttttctt

SEQ ID NO: 331899 - DNA, 20 bp, Artificial
  CRISPR gRNA sequence
tttactacttatttttcttt

SEQ ID NO: 331900 - DNA, 20 bp, Artificial
  CRISPR gRNA sequence
actacttatttttctttgtt

SEQ ID NO: 331901 - DNA, 20 bp, Artificial
  CRISPR gRNA sequence
ctacttatttttctttgttg

SEQ ID NO: 331902 - DNA, 20 bp, Artificial
  CRISPR gRNA sequence
cttatttttctttgttgtat

SEQ ID NO: 331903 - DNA, 20 bp, Artificial
  CRISPR gRNA sequence
atttttctttgttgtatcct

SEQ ID NO: 331904 - DNA, 20 bp, Artificial
  CRISPR gRNA sequence
tttttctttgttgtatcctc

SEQ ID NO: 331905 - DNA, 20 bp, Artificial
  CRISPR gRNA sequence
ttctttgttgtatcctcttt

SEQ ID NO: 331906 - DNA, 20 bp, Artificial
  CRISPR gRNA sequence
tctttgttgtatcctctttt

SEQ ID NO: 331907 - DNA, 20 bp, Artificial
  CRISPR gRNA sequence
ctttgttgtatcctcttttt

SEQ ID NO: 331908 - DNA, 20 bp, Artificial
  CRISPR gRNA sequence
tttgttgtatcctctttttc

SEQ ID NO: 331909 - DNA, 20 bp, Artificial
  CRISPR gRNA sequence
tgttgtatcctctttttctc

SEQ ID NO: 331910 - DNA, 20 bp, Artificial
  CRISPR gRNA sequence
gttgtatcctctttttctct

SEQ ID NO: 331911 - DNA, 20 bp, Artificial
  CRISPR gRNA sequence
ttgtatcctctttttctctt

SEQ ID NO: 331912 - DNA, 20 bp, Artificial
  CRISPR gRNA sequence
tatcctctttttctctttta

SEQ ID NO: 331913 - DNA, 20 bp, Artificial
  CRISPR gRNA sequence
tttttctcttttatttttgt

SEQ ID NO: 331914 - DNA, 20 bp, Artificial
  CRISPR gRNA sequence
tttctcttttatttttgttg

SEQ ID NO: 331915 - DNA, 20 bp, Artificial
  CRISPR gRNA sequence
ttctcttttatttttgttgg

SEQ ID NO: 331916 - DNA, 20 bp, Artificial
  CRISPR gRNA sequence
tctcttttatttttgttggt

SEQ ID NO: 331917 - DNA, 20 bp, Artificial
  CRISPR gRNA sequence
ctcttttatttttgttggtg

SEQ ID NO: 331918 - DNA, 20 bp, Artificial
  CRISPR gRNA sequence
tcttttatttttgttggtgt

SEQ ID NO: 331919 - DNA, 20 bp, Artificial
  CRISPR gRNA sequence
ttttatttttgttggtgtga

SEQ ID NO: 331920 - DNA, 20 bp, Artificial
  CRISPR gRNA sequence
ttatttttgttggtgtgatg

SEQ ID NO: 331921 - DNA, 20 bp, Artificial
  CRISPR gRNA sequence
tatttttgttggtgtgatga

SEQ ID NO: 331922 - DNA, 20 bp, Artificial
  CRISPR gRNA sequence
atttttgttggtgtgatgaa

SEQ ID NO: 331923 - DNA, 20 bp, Artificial
  CRISPR gRNA sequence
tttttgttggtgtgatgaaa

SEQ ID NO: 331924 - DNA, 20 bp, Artificial
  CRISPR gRNA sequence
ttgttggtgtgatgaaattt

SEQ ID NO: 331925 - DNA, 20 bp, Artificial
  CRISPR gRNA sequence
tgttggtgtgatgaaatttc

SEQ ID NO: 331926 - DNA, 20 bp, Artificial
  CRISPR gRNA sequence
gttggtgtgatgaaatttct

SEQ ID NO: 331927 - DNA, 20 bp, Artificial
  CRISPR gRNA sequence
ttggtgtgatgaaatttctt

SEQ ID NO: 331928 - DNA, 20 bp, Artificial
  CRISPR gRNA sequence
gtgtgatgaaatttcttttg

SEQ ID NO: 331929 - DNA, 20 bp, Artificial
  CRISPR gRNA sequence
cttttgactctcctctttgc

SEQ ID NO: 331930 - DNA, 20 bp, Artificial
  CRISPR gRNA sequence
ttttgactctcctctttgcc

SEQ ID NO: 331931 - DNA, 20 bp, Artificial
  CRISPR gRNA sequence
ttgactctcctctttgcctc

SEQ ID NO: 331932 - DNA, 20 bp, Artificial
  CRISPR gRNA sequence
tgactctcctctttgcctcc

SEQ ID NO: 331933 - DNA, 20 bp, Artificial
  CRISPR gRNA sequence
gactctcctctttgcctccg

SEQ ID NO: 331934 - DNA, 20 bp, Artificial
  CRISPR gRNA sequence
actctcctctttgcctccgg

SEQ ID NO: 331935 - DNA, 20 bp, Artificial
  CRISPR gRNA sequence
tcctctttgcctccggttaa

SEQ ID NO: 331936 - DNA, 20 bp, Artificial
  CRISPR gRNA sequence
ctctttgcctccggttaatt

SEQ ID NO: 331937 - DNA, 20 bp, Artificial
  CRISPR gRNA sequence
tttgcctccggttaatttgg

SEQ ID NO: 331938 - DNA, 20 bp, Artificial
  CRISPR gRNA sequence
tgcctccggttaatttggaa

SEQ ID NO: 331939 - DNA, 20 bp, Artificial
  CRISPR gRNA sequence
gcctccggttaatttggaag

SEQ ID NO: 331940 - DNA, 20 bp, Artificial
  CRISPR gRNA sequence
cctccggttaatttggaagg

SEQ ID NO: 331941 - DNA, 20 bp, Artificial
  CRISPR gRNA sequence
cggttaatttggaaggtcga

SEQ ID NO: 331942 - DNA, 20 bp, Artificial
  CRISPR gRNA sequence
atttggaaggtcgactacag

SEQ ID NO: 331943 - DNA, 20 bp, Artificial
  CRISPR gRNA sequence
ggaaggtcgactacagttct

SEQ ID NO: 331944 - DNA, 20 bp, Artificial
  CRISPR gRNA sequence
gaaggtcgactacagttctt

SEQ ID NO: 331945 - DNA, 20 bp, Artificial
  CRISPR gRNA sequence
cagttcttaatttactaagt

SEQ ID NO: 331946 - DNA, 20 bp, Artificial
  CRISPR gRNA sequence
ttaatttactaagtaattga

SEQ ID NO: 331947 - DNA, 20 bp, Artificial
  CRISPR gRNA sequence
aatttactaagtaattgaca

SEQ ID NO: 331948 - DNA, 20 bp, Artificial
  CRISPR gRNA sequence
atttactaagtaattgacat

SEQ ID NO: 331949 - DNA, 20 bp, Artificial
  CRISPR gRNA sequence
actaagtaattgacatgttc

SEQ ID NO: 331950 - DNA, 20 bp, Artificial
  CRISPR gRNA sequence
ctaagtaattgacatgttca

SEQ ID NO: 331951 - DNA, 20 bp, Artificial
  CRISPR gRNA sequence
agtaattgacatgttcaaag

SEQ ID NO: 331952 - DNA, 20 bp, Artificial
  CRISPR gRNA sequence
acatgttcaaagaatcttaa

SEQ ID NO: 331953 - DNA, 20 bp, Artificial
  CRISPR gRNA sequence
aaagaatcttaattgaatgt

SEQ ID NO: 331954 - DNA, 20 bp, Artificial
  CRISPR gRNA sequence
aattgaatgtctacttgttt

SEQ ID NO: 331955 - DNA, 20 bp, Artificial
  CRISPR gRNA sequence
attgaatgtctacttgttta

SEQ ID NO: 331956 - DNA, 20 bp, Artificial
  CRISPR gRNA sequence
aatgtctacttgtttatcat

SEQ ID NO: 331957 - DNA, 20 bp, Artificial
  CRISPR gRNA sequence
cttgtttatcattgtatgaa

SEQ ID NO: 331958 - DNA, 20 bp, Artificial
  CRISPR gRNA sequence
gtttatcattgtatgaaaat

SEQ ID NO: 331959 - DNA, 20 bp, Artificial
  CRISPR gRNA sequence
tttatcattgtatgaaaata

SEQ ID NO: 331960 - DNA, 20 bp, Artificial
  CRISPR gRNA sequence
atcattgtatgaaaataatg

SEQ ID NO: 331961 - DNA, 20 bp, Artificial
  CRISPR gRNA sequence
tcattgtatgaaaataatga

SEQ ID NO: 331962 - DNA, 20 bp, Artificial
  CRISPR gRNA sequence
tatgaaaataatgaaaatgc

SEQ ID NO: 331963 - DNA, 20 bp, Artificial
  CRISPR gRNA sequence
tgtctgatgtgcctagtccc

SEQ ID NO: 331964 - DNA, 20 bp, Artificial
  CRISPR gRNA sequence
gtctgatgtgcctagtcccc

SEQ ID NO: 331965 - DNA, 20 bp, Artificial
  CRISPR gRNA sequence
tctgatgtgcctagtcccca

SEQ ID NO: 331966 - DNA, 20 bp, Artificial
  CRISPR gRNA sequence
atgtgcctagtccccatccc

SEQ ID NO: 331967 - DNA, 20 bp, Artificial
  CRISPR gRNA sequence
gtccccatcccctgcactga

SEQ ID NO: 331968 - DNA, 20 bp, Artificial
  CRISPR gRNA sequence
cactgatatgagaacttaag

SEQ ID NO: 331969 - DNA, 20 bp, Artificial
  CRISPR gRNA sequence
atatgagaacttaagaatgt

SEQ ID NO: 331970 - DNA, 20 bp, Artificial
  CRISPR gRNA sequence
aagaatgttcttcctttccc

SEQ ID NO: 331971 - DNA, 20 bp, Artificial
  CRISPR gRNA sequence
agaatgttcttcctttccca

SEQ ID NO: 331972 - DNA, 20 bp, Artificial
  CRISPR gRNA sequence
ttcctttcccactctcacac

SEQ ID NO: 331973 - DNA, 20 bp, Artificial
  CRISPR gRNA sequence
cctttcccactctcacactt

SEQ ID NO: 331974 - DNA, 20 bp, Artificial
  CRISPR gRNA sequence
ctttcccactctcacacttc

SEQ ID NO: 331975 - DNA, 20 bp, Artificial
  CRISPR gRNA sequence
tcccactctcacacttcccc

SEQ ID NO: 331976 - DNA, 20 bp, Artificial
  CRISPR gRNA sequence
cccactctcacacttccccc

SEQ ID NO: 331977 - DNA, 20 bp, Artificial
  CRISPR gRNA sequence
ccactctcacacttccccca

SEQ ID NO: 331978 - DNA, 20 bp, Artificial
  CRISPR gRNA sequence
tcacacttcccccagacagt

SEQ ID NO: 331979 - DNA, 20 bp, Artificial
  CRISPR gRNA sequence
acacttcccccagacagtgc

SEQ ID NO: 331980 - DNA, 20 bp, Artificial
  CRISPR gRNA sequence
cccccagacagtgcaccctg

SEQ ID NO: 331981 - DNA, 20 bp, Artificial
  CRISPR gRNA sequence
ccccagacagtgcaccctgc

SEQ ID NO: 331982 - DNA, 20 bp, Artificial
  CRISPR gRNA sequence
ctccatacgtgggttttgtg

SEQ ID NO: 331983 - DNA, 20 bp, Artificial
  CRISPR gRNA sequence
catacgtgggttttgtggaa

SEQ ID NO: 331984 - DNA, 20 bp, Artificial
  CRISPR gRNA sequence
tgtggaaataatttaaaact

SEQ ID NO: 331985 - DNA, 20 bp, Artificial
  CRISPR gRNA sequence
gtggaaataatttaaaactt

SEQ ID NO: 331986 - DNA, 20 bp, Artificial
  CRISPR gRNA sequence
tggaaataatttaaaactta

SEQ ID NO: 331987 - DNA, 20 bp, Artificial
  CRISPR gRNA sequence
aaaacttacagttgcagatc

SEQ ID NO: 331988 - DNA, 20 bp, Artificial
  CRISPR gRNA sequence
aaacttacagttgcagatca

SEQ ID NO: 331989 - DNA, 20 bp, Artificial
  CRISPR gRNA sequence
acagttgcagatcattgcta

SEQ ID NO: 331990 - DNA, 20 bp, Artificial
  CRISPR gRNA sequence
cagttgcagatcattgctag

SEQ ID NO: 331991 - DNA, 20 bp, Artificial
  CRISPR gRNA sequence
cagatcattgctaggtttcc

SEQ ID NO: 331992 - DNA, 20 bp, Artificial
  CRISPR gRNA sequence
ctaggtttcctcttacagta

SEQ ID NO: 331993 - DNA, 20 bp, Artificial
  CRISPR gRNA sequence
ggtttcctcttacagtattt

SEQ ID NO: 331994 - DNA, 20 bp, Artificial
  CRISPR gRNA sequence
cctcttacagtatttctctt

SEQ ID NO: 331995 - DNA, 20 bp, Artificial
  CRISPR gRNA sequence
ctcttacagtatttctcttc

SEQ ID NO: 331996 - DNA, 20 bp, Artificial
  CRISPR gRNA sequence
ttacagtatttctcttctgt

SEQ ID NO: 331997 - DNA, 20 bp, Artificial
  CRISPR gRNA sequence
acagtatttctcttctgttt

SEQ ID NO: 331998 - DNA, 20 bp, Artificial
  CRISPR gRNA sequence
cagtatttctcttctgtttc

SEQ ID NO: 331999 - DNA, 20 bp, Artificial
  CRISPR gRNA sequence
ctcttctgtttcaagaatcc

SEQ ID NO: 332000 - DNA, 20 bp, Artificial
  CRISPR gRNA sequence
tcttctgtttcaagaatcct

SEQ ID NO: 332001 - DNA, 20 bp, Artificial
  CRISPR gRNA sequence
ttctgtttcaagaatccttt

SEQ ID NO: 332002 - DNA, 20 bp, Artificial
  CRISPR gRNA sequence
ctgtttcaagaatcctttct

SEQ ID NO: 332003 - DNA, 20 bp, Artificial
  CRISPR gRNA sequence
tgtttcaagaatcctttctt

SEQ ID NO: 332004 - DNA, 20 bp, Artificial
  CRISPR gRNA sequence
tttcaagaatcctttcttaa

SEQ ID NO: 332005 - DNA, 20 bp, Artificial
  CRISPR gRNA sequence
caagaatcctttcttaacac

SEQ ID NO: 332006 - DNA, 20 bp, Artificial
  CRISPR gRNA sequence
aagaatcctttcttaacact

SEQ ID NO: 332007 - DNA, 20 bp, Artificial
  CRISPR gRNA sequence
tcttaacacttacatcacat

SEQ ID NO: 332008 - DNA, 20 bp, Artificial
  CRISPR gRNA sequence
cttaacacttacatcacata

SEQ ID NO: 332009 - DNA, 20 bp, Artificial
  CRISPR gRNA sequence
ttaacacttacatcacatac

SEQ ID NO: 332010 - DNA, 20 bp, Artificial
  CRISPR gRNA sequence
aacacttacatcacatacgt

SEQ ID NO: 332011 - DNA, 20 bp, Artificial
  CRISPR gRNA sequence
acacttacatcacatacgtt

SEQ ID NO: 332012 - DNA, 20 bp, Artificial
  CRISPR gRNA sequence
acatcacatacgttcaatga

SEQ ID NO: 332013 - DNA, 20 bp, Artificial
  CRISPR gRNA sequence
catcacatacgttcaatgac

SEQ ID NO: 332014 - DNA, 20 bp, Artificial
  CRISPR gRNA sequence
aatgacaacatcattctgga

SEQ ID NO: 332015 - DNA, 20 bp, Artificial
  CRISPR gRNA sequence
tggacatctgctcctgtctt

SEQ ID NO: 332016 - DNA, 20 bp, Artificial
  CRISPR gRNA sequence
gacatctgctcctgtcttgt

SEQ ID NO: 332017 - DNA, 20 bp, Artificial
  CRISPR gRNA sequence
ctcctgtcttgtgatctctg

SEQ ID NO: 332018 - DNA, 20 bp, Artificial
  CRISPR gRNA sequence
ctgtcttgtgatctctgttc

SEQ ID NO: 332019 - DNA, 20 bp, Artificial
  CRISPR gRNA sequence
tcttgtgatctctgttctaa

SEQ ID NO: 332020 - DNA, 20 bp, Artificial
  CRISPR gRNA sequence
gtgatctctgttctaatcta

SEQ ID NO: 332021 - DNA, 20 bp, Artificial
  CRISPR gRNA sequence
tgatctctgttctaatctaa

SEQ ID NO: 332022 - DNA, 20 bp, Artificial
  CRISPR gRNA sequence
tgttctaatctaatgatcag

SEQ ID NO: 332023 - DNA, 20 bp, Artificial
  CRISPR gRNA sequence
ttctaatctaatgatcagaa

SEQ ID NO: 332024 - DNA, 20 bp, Artificial
  CRISPR gRNA sequence
taatctaatgatcagaagac

SEQ ID NO: 332025 - DNA, 20 bp, Artificial
  CRISPR gRNA sequence
atctaatgatcagaagactt

SEQ ID NO: 332026 - DNA, 20 bp, Artificial
  CRISPR gRNA sequence
atgatcagaagacttctctt

SEQ ID NO: 332027 - DNA, 20 bp, Artificial
  CRISPR gRNA sequence
ctcttattttcgttaaatac

SEQ ID NO: 332028 - DNA, 20 bp, Artificial
  CRISPR gRNA sequence
tcttattttcgttaaatacc

SEQ ID NO: 332029 - DNA, 20 bp, Artificial
  CRISPR gRNA sequence
ttattttcgttaaatacccc

SEQ ID NO: 332030 - DNA, 20 bp, Artificial
  CRISPR gRNA sequence
attttcgttaaataccccca

SEQ ID NO: 332031 - DNA, 20 bp, Artificial
  CRISPR gRNA sequence
ttttcgttaaatacccccaa

SEQ ID NO: 332032 - DNA, 20 bp, Artificial
  CRISPR gRNA sequence
tcgttaaatacccccaactc

SEQ ID NO: 332033 - DNA, 20 bp, Artificial
  CRISPR gRNA sequence
cgttaaatacccccaactct

SEQ ID NO: 332034 - DNA, 20 bp, Artificial
  CRISPR gRNA sequence
gttaaatacccccaactctc

SEQ ID NO: 332035 - DNA, 20 bp, Artificial
  CRISPR gRNA sequence
aatacccccaactctctgaa

SEQ ID NO: 332036 - DNA, 20 bp, Artificial
  CRISPR gRNA sequence
tctgaattccagtacaggta

SEQ ID NO: 332037 - DNA, 20 bp, Artificial
  CRISPR gRNA sequence
tgaattccagtacaggtaag

SEQ ID NO: 332038 - DNA, 20 bp, Artificial
  CRISPR gRNA sequence
aattccagtacaggtaaggg

SEQ ID NO: 332039 - DNA, 20 bp, Artificial
  CRISPR gRNA sequence
cagtacaggtaagggtgtct

SEQ ID NO: 332040 - DNA, 20 bp, Artificial
  CRISPR gRNA sequence
ccttttaccttgatgagtga

SEQ ID NO: 332041 - DNA, 20 bp, Artificial
  CRISPR gRNA sequence
cttttaccttgatgagtgac

SEQ ID NO: 332042 - DNA, 20 bp, Artificial
  CRISPR gRNA sequence
ttaccttgatgagtgactga

SEQ ID NO: 332043 - DNA, 20 bp, Artificial
  CRISPR gRNA sequence
taccttgatgagtgactgat

SEQ ID NO: 332044 - DNA, 20 bp, Artificial
  CRISPR gRNA sequence
accttgatgagtgactgata

SEQ ID NO: 332045 - DNA, 20 bp, Artificial
  CRISPR gRNA sequence
ccttgatgagtgactgatat

SEQ ID NO: 332046 - DNA, 20 bp, Artificial
  CRISPR gRNA sequence
gatgagtgactgatatcttt

SEQ ID NO: 332047 - DNA, 20 bp, Artificial
  CRISPR gRNA sequence
atgagtgactgatatctttc

SEQ ID NO: 332048 - DNA, 20 bp, Artificial
  CRISPR gRNA sequence
atatctttcctgggaatagg

SEQ ID NO: 332049 - DNA, 20 bp, Artificial
  CRISPR gRNA sequence
tcctgggaataggagtcctg

SEQ ID NO: 332050 - DNA, 20 bp, Artificial
  CRISPR gRNA sequence
cctgggaataggagtcctgg

SEQ ID NO: 332051 - DNA, 20 bp, Artificial
  CRISPR gRNA sequence
ctgggaataggagtcctgga

SEQ ID NO: 332052 - DNA, 20 bp, Artificial
  CRISPR gRNA sequence
ggaataggagtcctggatgg

SEQ ID NO: 332053 - DNA, 20 bp, Artificial
  CRISPR gRNA sequence
gatggcagcctttcttctta

SEQ ID NO: 332054 - DNA, 20 bp, Artificial
  CRISPR gRNA sequence
tcttcttagtggttgcagat

SEQ ID NO: 332055 - DNA, 20 bp, Artificial
  CRISPR gRNA sequence
cttcttagtggttgcagata

SEQ ID NO: 332056 - DNA, 20 bp, Artificial
  CRISPR gRNA sequence
ttcttagtggttgcagatat

SEQ ID NO: 332057 - DNA, 20 bp, Artificial
  CRISPR gRNA sequence
cttagtggttgcagatattc

SEQ ID NO: 332058 - DNA, 20 bp, Artificial
  CRISPR gRNA sequence
ttagtggttgcagatattcc

SEQ ID NO: 332059 - DNA, 20 bp, Artificial
  CRISPR gRNA sequence
agtggttgcagatattcctc

SEQ ID NO: 332060 - DNA, 20 bp, Artificial
  CRISPR gRNA sequence
gtggttgcagatattcctcc

SEQ ID NO: 332061 - DNA, 20 bp, Artificial
  CRISPR gRNA sequence
cagatattcctccactgtct

SEQ ID NO: 332062 - DNA, 20 bp, Artificial
  CRISPR gRNA sequence
ctccactgtctgctggcttc

SEQ ID NO: 332063 - DNA, 20 bp, Artificial
  CRISPR gRNA sequence
cactgtctgctggcttctag

SEQ ID NO: 332064 - DNA, 20 bp, Artificial
  CRISPR gRNA sequence
tctgctggcttctagggttg

SEQ ID NO: 332065 - DNA, 20 bp, Artificial
  CRISPR gRNA sequence
ctggcttctagggttgtggg

SEQ ID NO: 332066 - DNA, 20 bp, Artificial
  CRISPR gRNA sequence
gcttctagggttgtgggtga

SEQ ID NO: 332067 - DNA, 20 bp, Artificial
  CRISPR gRNA sequence
ctagggttgtgggtgaagag

SEQ ID NO: 332068 - DNA, 20 bp, Artificial
  CRISPR gRNA sequence
tagggttgtgggtgaagagt

SEQ ID NO: 332069 - DNA, 20 bp, Artificial
  CRISPR gRNA sequence
gggttgtgggtgaagagttt

SEQ ID NO: 332070 - DNA, 20 bp, Artificial
  CRISPR gRNA sequence
tgggtgaagagtttgatggt

SEQ ID NO: 332071 - DNA, 20 bp, Artificial
  CRISPR gRNA sequence
gatggtagtctaactctcat

SEQ ID NO: 332072 - DNA, 20 bp, Artificial
  CRISPR gRNA sequence
atggtagtctaactctcatt

SEQ ID NO: 332073 - DNA, 20 bp, Artificial
  CRISPR gRNA sequence
actctcattcctttgtaaaa

SEQ ID NO: 332074 - DNA, 20 bp, Artificial
  CRISPR gRNA sequence
tcattcctttgtaaaaaaaa

SEQ ID NO: 332075 - DNA, 20 bp, Artificial
  CRISPR gRNA sequence
attcctttgtaaaaaaaaaa

SEQ ID NO: 332076 - DNA, 20 bp, Artificial
  CRISPR gRNA sequence
ctttgtaaaaaaaaaaaaaa

SEQ ID NO: 332077 - DNA, 20 bp, Artificial
  CRISPR gRNA sequence
tgtaaaaaaaaaaaaaactc

SEQ ID NO: 332078 - DNA, 20 bp, Artificial
  CRISPR gRNA sequence
gtaaaaaaaaaaaaaactct

SEQ ID NO: 332079 - DNA, 20 bp, Artificial
  CRISPR gRNA sequence
taaaaaaaaaaaaaactcta

SEQ ID NO: 332080 - DNA, 20 bp, Artificial
  CRISPR gRNA sequence
tagaatttcataatcttgaa

SEQ ID NO: 332081 - DNA, 20 bp, Artificial
  CRISPR gRNA sequence
gaatttcataatcttgaaag

SEQ ID NO: 332082 - DNA, 20 bp, Artificial
  CRISPR gRNA sequence
cataatcttgaaagctattt

SEQ ID NO: 332083 - DNA, 20 bp, Artificial
  CRISPR gRNA sequence
ataatcttgaaagctattta

SEQ ID NO: 332084 - DNA, 20 bp, Artificial
  CRISPR gRNA sequence
gaaagctatttacttcagta

SEQ ID NO: 332085 - DNA, 20 bp, Artificial
  CRISPR gRNA sequence
aaagctatttacttcagtat

SEQ ID NO: 332086 - DNA, 20 bp, Artificial
  CRISPR gRNA sequence
tttacttcagtattggaatt

SEQ ID NO: 332087 - DNA, 20 bp, Artificial
  CRISPR gRNA sequence
acttcagtattggaattcag

SEQ ID NO: 332088 - DNA, 20 bp, Artificial
  CRISPR gRNA sequence
cttcagtattggaattcagg

SEQ ID NO: 332089 - DNA, 20 bp, Artificial
  CRISPR gRNA sequence
cagtattggaattcaggaat

SEQ ID NO: 332090 - DNA, 20 bp, Artificial
  CRISPR gRNA sequence
agtattggaattcaggaatt

SEQ ID NO: 332091 - DNA, 20 bp, Artificial
  CRISPR gRNA sequence
gaattcaggaattcctccag

SEQ ID NO: 332092 - DNA, 20 bp, Artificial
  CRISPR gRNA sequence
aggaattcctccaggatatg

SEQ ID NO: 332093 - DNA, 20 bp, Artificial
  CRISPR gRNA sequence
ctccaggatatgtgtaactc

SEQ ID NO: 332094 - DNA, 20 bp, Artificial
  CRISPR gRNA sequence
caggatatgtgtaactctct

SEQ ID NO: 332095 - DNA, 20 bp, Artificial
  CRISPR gRNA sequence
tctccctctgtttctctttc

SEQ ID NO: 332096 - DNA, 20 bp, Artificial
  CRISPR gRNA sequence
tccctctgtttctctttctg

SEQ ID NO: 332097 - DNA, 20 bp, Artificial
  CRISPR gRNA sequence
cctctgtttctctttctgtg

SEQ ID NO: 332098 - DNA, 20 bp, Artificial
  CRISPR gRNA sequence
tgtttctctttctgtgtgtt

SEQ ID NO: 332099 - DNA, 20 bp, Artificial
  CRISPR gRNA sequence
tttctctttctgtgtgtttc

SEQ ID NO: 332100 - DNA, 20 bp, Artificial
  CRISPR gRNA sequence
ctctttctgtgtgtttctat

SEQ ID NO: 332101 - DNA, 20 bp, Artificial
  CRISPR gRNA sequence
tctttctgtgtgtttctatt

SEQ ID NO: 332102 - DNA, 20 bp, Artificial
  CRISPR gRNA sequence
tttctgtgtgtttctattaa

SEQ ID NO: 332103 - DNA, 20 bp, Artificial
  CRISPR gRNA sequence
tctgtgtgtttctattaatt

SEQ ID NO: 332104 - DNA, 20 bp, Artificial
  CRISPR gRNA sequence
ctgtgtgtttctattaattt

SEQ ID NO: 332105 - DNA, 20 bp, Artificial
  CRISPR gRNA sequence
tgtgtgtttctattaatttt

SEQ ID NO: 332106 - DNA, 20 bp, Artificial
  CRISPR gRNA sequence
tgtgtttctattaatttttt

SEQ ID NO: 332107 - DNA, 20 bp, Artificial
  CRISPR gRNA sequence
ctattaattttttttttgag

SEQ ID NO: 332108 - DNA, 20 bp, Artificial
  CRISPR gRNA sequence
tattaattttttttttgagg

SEQ ID NO: 332109 - DNA, 20 bp, Artificial
  CRISPR gRNA sequence
ttaattttttttttgaggcg

SEQ ID NO: 332110 - DNA, 20 bp, Artificial
  CRISPR gRNA sequence
attttttttttgaggcggag

SEQ ID NO: 332111 - DNA, 20 bp, Artificial
  CRISPR gRNA sequence
tttttttgaggcggagtctc

SEQ ID NO: 332112 - DNA, 20 bp, Artificial
  CRISPR gRNA sequence
ttttttgaggcggagtctca

SEQ ID NO: 332113 - DNA, 20 bp, Artificial
  CRISPR gRNA sequence
tttttgaggcggagtctcac

SEQ ID NO: 332114 - DNA, 20 bp, Artificial
  CRISPR gRNA sequence
ttttgaggcggagtctcact

SEQ ID NO: 332115 - DNA, 20 bp, Artificial
  CRISPR gRNA sequence
tttgaggcggagtctcactc

SEQ ID NO: 332116 - DNA, 20 bp, Artificial
  CRISPR gRNA sequence
ttgaggcggagtctcactct

SEQ ID NO: 332117 - DNA, 20 bp, Artificial
  CRISPR gRNA sequence
tgaggcggagtctcactctg

SEQ ID NO: 332118 - DNA, 20 bp, Artificial
  CRISPR gRNA sequence
gaggcggagtctcactctgt

SEQ ID NO: 332119 - DNA, 20 bp, Artificial
  CRISPR gRNA sequence
aggcggagtctcactctgtc

SEQ ID NO: 332120 - DNA, 20 bp, Artificial
  CRISPR gRNA sequence
actctgtcgcccaggctgga

SEQ ID NO: 332121 - DNA, 20 bp, Artificial
  CRISPR gRNA sequence
tgtcgcccaggctggagtgc

SEQ ID NO: 332122 - DNA, 20 bp, Artificial
  CRISPR gRNA sequence
tcgcccaggctggagtgcag

SEQ ID NO: 332123 - DNA, 20 bp, Artificial
  CRISPR gRNA sequence
gagtgcagtggcgcaatctc

SEQ ID NO: 332124 - DNA, 20 bp, Artificial
  CRISPR gRNA sequence
ggcttactgcaacctccacc

SEQ ID NO: 332125 - DNA, 20 bp, Artificial
  CRISPR gRNA sequence
actgcaacctccacctcccg

SEQ ID NO: 332126 - DNA, 20 bp, Artificial
  CRISPR gRNA sequence
ctgcaacctccacctcccgg

SEQ ID NO: 332127 - DNA, 20 bp, Artificial
  CRISPR gRNA sequence
caacctccacctcccgggtt

SEQ ID NO: 332128 - DNA, 20 bp, Artificial
  CRISPR gRNA sequence
cacctcccgggttgaagcga

SEQ ID NO: 332129 - DNA, 20 bp, Artificial
  CRISPR gRNA sequence
ccgggttgaagcgattctcc

SEQ ID NO: 332130 - DNA, 20 bp, Artificial
  CRISPR gRNA sequence
aagcgattctcctgcctcag

SEQ ID NO: 332131 - DNA, 20 bp, Artificial
  CRISPR gRNA sequence
tcctgcctcagcctcccaag

SEQ ID NO: 332132 - DNA, 20 bp, Artificial
  CRISPR gRNA sequence
ctgcctcagcctcccaagta

SEQ ID NO: 332133 - DNA, 20 bp, Artificial
  CRISPR gRNA sequence
cctcagcctcccaagtaggt

SEQ ID NO: 332134 - DNA, 20 bp, Artificial
  CRISPR gRNA sequence
agcctcccaagtaggtgaga

SEQ ID NO: 332135 - DNA, 20 bp, Artificial
  CRISPR gRNA sequence
ccaagtaggtgagactacag

SEQ ID NO: 332136 - DNA, 20 bp, Artificial
  CRISPR gRNA sequence
caggcacccgccaccacgcc

SEQ ID NO: 332137 - DNA, 20 bp, Artificial
  CRISPR gRNA sequence
gctaatttttttgtattttt

SEQ ID NO: 332138 - DNA, 20 bp, Artificial
  CRISPR gRNA sequence
atttttttgtatttttcgta

SEQ ID NO: 332139 - DNA, 20 bp, Artificial
  CRISPR gRNA sequence
ttttgtatttttcgtagaga

SEQ ID NO: 332140 - DNA, 20 bp, Artificial
  CRISPR gRNA sequence
tttgtatttttcgtagagac

SEQ ID NO: 332141 - DNA, 20 bp, Artificial
  CRISPR gRNA sequence
ttgtatttttcgtagagacg

SEQ ID NO: 332142 - DNA, 20 bp, Artificial
  CRISPR gRNA sequence
tgtatttttcgtagagacgg

SEQ ID NO: 332143 - DNA, 20 bp, Artificial
  CRISPR gRNA sequence
gtatttttcgtagagacggg

SEQ ID NO: 332144 - DNA, 20 bp, Artificial
  CRISPR gRNA sequence
tatttttcgtagagacgggg

SEQ ID NO: 332145 - DNA, 20 bp, Artificial
  CRISPR gRNA sequence
ttcgtagagacggggtttca

SEQ ID NO: 332146 - DNA, 20 bp, Artificial
  CRISPR gRNA sequence
tcgtagagacggggtttcac

SEQ ID NO: 332147 - DNA, 20 bp, Artificial
  CRISPR gRNA sequence
cgtagagacggggtttcacc

SEQ ID NO: 332148 - DNA, 20 bp, Artificial
  CRISPR gRNA sequence
gtagagacggggtttcaccg

SEQ ID NO: 332149 - DNA, 20 bp, Artificial
  CRISPR gRNA sequence
caccgtgttagccaggatgg

SEQ ID NO: 332150 - DNA, 20 bp, Artificial
  CRISPR gRNA sequence
accgtgttagccaggatggt

SEQ ID NO: 332151 - DNA, 20 bp, Artificial
  CRISPR gRNA sequence
gccaggatggtctcaatttc

SEQ ID NO: 332152 - DNA, 20 bp, Artificial
  CRISPR gRNA sequence
aatttcctgacctcgtgatc

SEQ ID NO: 332153 - DNA, 20 bp, Artificial
  CRISPR gRNA sequence
cctgacctcgtgatccgccc

SEQ ID NO: 332154 - DNA, 20 bp, Artificial
  CRISPR gRNA sequence
ctgacctcgtgatccgccca

SEQ ID NO: 332155 - DNA, 20 bp, Artificial
  CRISPR gRNA sequence
acctcgtgatccgcccacct

SEQ ID NO: 332156 - DNA, 20 bp, Artificial
  CRISPR gRNA sequence
gtgatccgcccacctccgcc

SEQ ID NO: 332157 - DNA, 20 bp, Artificial
  CRISPR gRNA sequence
cgcctccgcctccgcctccc

SEQ ID NO: 332158 - DNA, 20 bp, Artificial
  CRISPR gRNA sequence
cgcctccgcctcccaaagtg

SEQ ID NO: 332159 - DNA, 20 bp, Artificial
  CRISPR gRNA sequence
cgcctcccaaagtgctggga

SEQ ID NO: 332160 - DNA, 20 bp, Artificial
  CRISPR gRNA sequence
ccaaagtgctgggattacag

SEQ ID NO: 332161 - DNA, 20 bp, Artificial
  CRISPR gRNA sequence
ggattacaggcgtgagccac

SEQ ID NO: 332162 - DNA, 20 bp, Artificial
  CRISPR gRNA sequence
caggcgtgagccaccgcgcc

SEQ ID NO: 332163 - DNA, 20 bp, Artificial
  CRISPR gRNA sequence
ttctattaatttattattat

SEQ ID NO: 332164 - DNA, 20 bp, Artificial
  CRISPR gRNA sequence
tattaatttattattatttt

SEQ ID NO: 332165 - DNA, 20 bp, Artificial
  CRISPR gRNA sequence
ttaatttattattatttttt

SEQ ID NO: 332166 - DNA, 20 bp, Artificial
  CRISPR gRNA sequence
atttattattatttttttta

SEQ ID NO: 332167 - DNA, 20 bp, Artificial
  CRISPR gRNA sequence
attattattttttttaagac

SEQ ID NO: 332168 - DNA, 20 bp, Artificial
  CRISPR gRNA sequence
ttattattttttttaagact

SEQ ID NO: 332169 - DNA, 20 bp, Artificial
  CRISPR gRNA sequence
ttattttttttaagactggg

SEQ ID NO: 332170 - DNA, 20 bp, Artificial
  CRISPR gRNA sequence
ttttttttaagactgggtga

SEQ ID NO: 332171 - DNA, 20 bp, Artificial
  CRISPR gRNA sequence
tttttaagactgggtgaaag

SEQ ID NO: 332172 - DNA, 20 bp, Artificial
  CRISPR gRNA sequence
ttttaagactgggtgaaagt

SEQ ID NO: 332173 - DNA, 20 bp, Artificial
  CRISPR gRNA sequence
tttaagactgggtgaaagtt

SEQ ID NO: 332174 - DNA, 20 bp, Artificial
  CRISPR gRNA sequence
ttaagactgggtgaaagttt

SEQ ID NO: 332175 - DNA, 20 bp, Artificial
  CRISPR gRNA sequence
taagactgggtgaaagtttt

SEQ ID NO: 332176 - DNA, 20 bp, Artificial
  CRISPR gRNA sequence
aagactgggtgaaagttttc

SEQ ID NO: 332177 - DNA, 20 bp, Artificial
  CRISPR gRNA sequence
agactgggtgaaagttttca

SEQ ID NO: 332178 - DNA, 20 bp, Artificial
  CRISPR gRNA sequence
ggtgaaagttttcaatctct

SEQ ID NO: 332179 - DNA, 20 bp, Artificial
  CRISPR gRNA sequence
tcaatctctagactcaagct

SEQ ID NO: 332180 - DNA, 20 bp, Artificial
  CRISPR gRNA sequence
caatctctagactcaagctt

SEQ ID NO: 332181 - DNA, 20 bp, Artificial
  CRISPR gRNA sequence
aatctctagactcaagcttt

SEQ ID NO: 332182 - DNA, 20 bp, Artificial
  CRISPR gRNA sequence
tagactcaagctttattctt

SEQ ID NO: 332183 - DNA, 20 bp, Artificial
  CRISPR gRNA sequence
gactcaagctttattcttca

SEQ ID NO: 332184 - DNA, 20 bp, Artificial
  CRISPR gRNA sequence
aagctttattcttcatttca

SEQ ID NO: 332185 - DNA, 20 bp, Artificial
  CRISPR gRNA sequence
tattcttcatttcagtcatt

SEQ ID NO: 332186 - DNA, 20 bp, Artificial
  CRISPR gRNA sequence
attcttcatttcagtcattt

SEQ ID NO: 332187 - DNA, 20 bp, Artificial
  CRISPR gRNA sequence
ttcttcatttcagtcatttt

SEQ ID NO: 332188 - DNA, 20 bp, Artificial
  CRISPR gRNA sequence
ttcatttcagtcattttttt

SEQ ID NO: 332189 - DNA, 20 bp, Artificial
  CRISPR gRNA sequence
catttcagtcatttttttcc

SEQ ID NO: 332190 - DNA, 20 bp, Artificial
  CRISPR gRNA sequence
atttcagtcatttttttcct

SEQ ID NO: 332191 - DNA, 20 bp, Artificial
  CRISPR gRNA sequence
cagtcatttttttcctagta

SEQ ID NO: 332192 - DNA, 20 bp, Artificial
  CRISPR gRNA sequence
agtcatttttttcctagtat

SEQ ID NO: 332193 - DNA, 20 bp, Artificial
  CRISPR gRNA sequence
ttttcctagtatttgtttaa

SEQ ID NO: 332194 - DNA, 20 bp, Artificial
  CRISPR gRNA sequence
tttcctagtatttgtttaat

SEQ ID NO: 332195 - DNA, 20 bp, Artificial
  CRISPR gRNA sequence
ttcctagtatttgtttaatc

SEQ ID NO: 332196 - DNA, 20 bp, Artificial
  CRISPR gRNA sequence
tcctagtatttgtttaatca

SEQ ID NO: 332197 - DNA, 20 bp, Artificial
  CRISPR gRNA sequence
cctagtatttgtttaatcat

SEQ ID NO: 332198 - DNA, 20 bp, Artificial
  CRISPR gRNA sequence
ctagtatttgtttaatcata

SEQ ID NO: 332199 - DNA, 20 bp, Artificial
  CRISPR gRNA sequence
gtatttgtttaatcatacct

SEQ ID NO: 332200 - DNA, 20 bp, Artificial
  CRISPR gRNA sequence
gtttaatcataccttatgct

SEQ ID NO: 332201 - DNA, 20 bp, Artificial
  CRISPR gRNA sequence
tttaatcataccttatgctg

SEQ ID NO: 332202 - DNA, 20 bp, Artificial
  CRISPR gRNA sequence
aatcataccttatgctgttt

SEQ ID NO: 332203 - DNA, 20 bp, Artificial
  CRISPR gRNA sequence
atcataccttatgctgtttt

SEQ ID NO: 332204 - DNA, 20 bp, Artificial
  CRISPR gRNA sequence
atgctgtttttccccactct

SEQ ID NO: 332205 - DNA, 20 bp, Artificial
  CRISPR gRNA sequence
tgctgtttttccccactctt

SEQ ID NO: 332206 - DNA, 20 bp, Artificial
  CRISPR gRNA sequence
tttttccccactctttctag

SEQ ID NO: 332207 - DNA, 20 bp, Artificial
  CRISPR gRNA sequence
ttccccactctttctagaaa

SEQ ID NO: 332208 - DNA, 20 bp, Artificial
  CRISPR gRNA sequence
tccccactctttctagaaat

SEQ ID NO: 332209 - DNA, 20 bp, Artificial
  CRISPR gRNA sequence
ccccactctttctagaaatg

SEQ ID NO: 332210 - DNA, 20 bp, Artificial
  CRISPR gRNA sequence
cccactctttctagaaatgt

SEQ ID NO: 332211 - DNA, 20 bp, Artificial
  CRISPR gRNA sequence
tttctagaaatgtctcttat

SEQ ID NO: 332212 - DNA, 20 bp, Artificial
  CRISPR gRNA sequence
tctagaaatgtctcttattc

SEQ ID NO: 332213 - DNA, 20 bp, Artificial
  CRISPR gRNA sequence
ctagaaatgtctcttattct

SEQ ID NO: 332214 - DNA, 20 bp, Artificial
  CRISPR gRNA sequence
tagaaatgtctcttattctt

SEQ ID NO: 332215 - DNA, 20 bp, Artificial
  CRISPR gRNA sequence
gaaatgtctcttattcttat

SEQ ID NO: 332216 - DNA, 20 bp, Artificial
  CRISPR gRNA sequence
ttattcttatgtaagatctt

SEQ ID NO: 332217 - DNA, 20 bp, Artificial
  CRISPR gRNA sequence
attcttatgtaagatcttga

SEQ ID NO: 332218 - DNA, 20 bp, Artificial
  CRISPR gRNA sequence
ttcttatgtaagatcttgag

SEQ ID NO: 332219 - DNA, 20 bp, Artificial
  CRISPR gRNA sequence
ttatgtaagatcttgagtcc

SEQ ID NO: 332220 - DNA, 20 bp, Artificial
  CRISPR gRNA sequence
atgtaagatcttgagtccct

SEQ ID NO: 332221 - DNA, 20 bp, Artificial
  CRISPR gRNA sequence
tgtaagatcttgagtccctt

SEQ ID NO: 332222 - DNA, 20 bp, Artificial
  CRISPR gRNA sequence
gagtcccttattttttcatc

SEQ ID NO: 332223 - DNA, 20 bp, Artificial
  CRISPR gRNA sequence
agtcccttattttttcatca

SEQ ID NO: 332224 - DNA, 20 bp, Artificial
  CRISPR gRNA sequence
attttttcatcatttgtgaa

SEQ ID NO: 332225 - DNA, 20 bp, Artificial
  CRISPR gRNA sequence
ttttttcatcatttgtgaac

SEQ ID NO: 332226 - DNA, 20 bp, Artificial
  CRISPR gRNA sequence
tttcatcatttgtgaacaaa

SEQ ID NO: 332227 - DNA, 20 bp, Artificial
  CRISPR gRNA sequence
ttcatcatttgtgaacaaaa

SEQ ID NO: 332228 - DNA, 20 bp, Artificial
  CRISPR gRNA sequence
tcatcatttgtgaacaaaat

SEQ ID NO: 332229 - DNA, 20 bp, Artificial
  CRISPR gRNA sequence
catcatttgtgaacaaaatg

SEQ ID NO: 332230 - DNA, 20 bp, Artificial
  CRISPR gRNA sequence
atcatttgtgaacaaaatgg

SEQ ID NO: 332231 - DNA, 20 bp, Artificial
  CRISPR gRNA sequence
gtgaacaaaatggctttcac

SEQ ID NO: 332232 - DNA, 20 bp, Artificial
  CRISPR gRNA sequence
tgaacaaaatggctttcaca

SEQ ID NO: 332233 - DNA, 20 bp, Artificial
  CRISPR gRNA sequence
tcacaacttgctgttgcttg

SEQ ID NO: 332234 - DNA, 20 bp, Artificial
  CRISPR gRNA sequence
cacaacttgctgttgcttgt

SEQ ID NO: 332235 - DNA, 20 bp, Artificial
  CRISPR gRNA sequence
acaacttgctgttgcttgtt

SEQ ID NO: 332236 - DNA, 20 bp, Artificial
  CRISPR gRNA sequence
gctgttgcttgttaaccaca

SEQ ID NO: 332237 - DNA, 20 bp, Artificial
  CRISPR gRNA sequence
ctgttgcttgttaaccacaa

SEQ ID NO: 332238 - DNA, 20 bp, Artificial
  CRISPR gRNA sequence
ttgcttgttaaccacaactc

SEQ ID NO: 332239 - DNA, 20 bp, Artificial
  CRISPR gRNA sequence
cttgttaaccacaactcctt

SEQ ID NO: 332240 - DNA, 20 bp, Artificial
  CRISPR gRNA sequence
gttaaccacaactccttcag

SEQ ID NO: 332241 - DNA, 20 bp, Artificial
  CRISPR gRNA sequence
ttaaccacaactccttcaga

SEQ ID NO: 332242 - DNA, 20 bp, Artificial
  CRISPR gRNA sequence
accacaactccttcagatga

SEQ ID NO: 332243 - DNA, 20 bp, Artificial
  CRISPR gRNA sequence
cttcagatgaaatggatatt

SEQ ID NO: 332244 - DNA, 20 bp, Artificial
  CRISPR gRNA sequence
cagatgaaatggatatttca

SEQ ID NO: 332245 - DNA, 20 bp, Artificial
  CRISPR gRNA sequence
agatgaaatggatatttcag

SEQ ID NO: 332246 - DNA, 20 bp, Artificial
  CRISPR gRNA sequence
cagttttaagttactagtag

SEQ ID NO: 332247 - DNA, 20 bp, Artificial
  CRISPR gRNA sequence
agttttaagttactagtagc

SEQ ID NO: 332248 - DNA, 20 bp, Artificial
  CRISPR gRNA sequence
taagttactagtagcatatt

SEQ ID NO: 332249 - DNA, 20 bp, Artificial
  CRISPR gRNA sequence
aagttactagtagcatattc

SEQ ID NO: 332250 - DNA, 20 bp, Artificial
  CRISPR gRNA sequence
agttactagtagcatattcc

SEQ ID NO: 332251 - DNA, 20 bp, Artificial
  CRISPR gRNA sequence
ctagtagcatattcccattt

SEQ ID NO: 332252 - DNA, 20 bp, Artificial
  CRISPR gRNA sequence
gtagcatattcccatttctt

SEQ ID NO: 332253 - DNA, 20 bp, Artificial
  CRISPR gRNA sequence
ccatttcttggtagaaacaa

SEQ ID NO: 332254 - DNA, 20 bp, Artificial
  CRISPR gRNA sequence
cttggtagaaacaaaatgca

SEQ ID NO: 332255 - DNA, 20 bp, Artificial
  CRISPR gRNA sequence
ttggtagaaacaaaatgcag

SEQ ID NO: 332256 - DNA, 20 bp, Artificial
  CRISPR gRNA sequence
ggtagaaacaaaatgcaggc

SEQ ID NO: 332257 - DNA, 20 bp, Artificial
  CRISPR gRNA sequence
gtagaaacaaaatgcaggca

SEQ ID NO: 332258 - DNA, 20 bp, Artificial
  CRISPR gRNA sequence
aaattcttatatttactcac

SEQ ID NO: 332259 - DNA, 20 bp, Artificial
  CRISPR gRNA sequence
ttatatttactcactgtaag

SEQ ID NO: 332260 - DNA, 20 bp, Artificial
  CRISPR gRNA sequence
atatttactcactgtaagat

SEQ ID NO: 332261 - DNA, 20 bp, Artificial
  CRISPR gRNA sequence
tatttactcactgtaagatt

SEQ ID NO: 332262 - DNA, 20 bp, Artificial
  CRISPR gRNA sequence
actcactgtaagattcatag

SEQ ID NO: 332263 - DNA, 20 bp, Artificial
  CRISPR gRNA sequence
ctcactgtaagattcatagc

SEQ ID NO: 332264 - DNA, 20 bp, Artificial
  CRISPR gRNA sequence
actgtaagattcatagcatt

SEQ ID NO: 332265 - DNA, 20 bp, Artificial
  CRISPR gRNA sequence
taagattcatagcattattt

SEQ ID NO: 332266 - DNA, 20 bp, Artificial
  CRISPR gRNA sequence
atagcattatttggcttaaa

SEQ ID NO: 332267 - DNA, 20 bp, Artificial
  CRISPR gRNA sequence
tttggcttaaaaaaattcat

SEQ ID NO: 332268 - DNA, 20 bp, Artificial
  CRISPR gRNA sequence
ggcttaaaaaaattcatccc

SEQ ID NO: 332269 - DNA, 20 bp, Artificial
  CRISPR gRNA sequence
gcttaaaaaaattcatccca

SEQ ID NO: 332270 - DNA, 20 bp, Artificial
  CRISPR gRNA sequence
aaaaaaattcatcccagtat

SEQ ID NO: 332271 - DNA, 20 bp, Artificial
  CRISPR gRNA sequence
aaaaaattcatcccagtatt

SEQ ID NO: 332272 - DNA, 20 bp, Artificial
  CRISPR gRNA sequence
atcccagtattcacagttgt

SEQ ID NO: 332273 - DNA, 20 bp, Artificial
  CRISPR gRNA sequence
acagttgtaaacagcaaaat

SEQ ID NO: 332274 - DNA, 20 bp, Artificial
  CRISPR gRNA sequence
taaacagcaaaatctacaac

SEQ ID NO: 332275 - DNA, 20 bp, Artificial
  CRISPR gRNA sequence
caacatatactgcttcccta

SEQ ID NO: 332276 - DNA, 20 bp, Artificial
  CRISPR gRNA sequence
cttccctactctaagaatat

SEQ ID NO: 332277 - DNA, 20 bp, Artificial
  CRISPR gRNA sequence
ccctactctaagaatattga

SEQ ID NO: 332278 - DNA, 20 bp, Artificial
  CRISPR gRNA sequence
cctactctaagaatattgag

SEQ ID NO: 332279 - DNA, 20 bp, Artificial
  CRISPR gRNA sequence
ctctaagaatattgagtttt

SEQ ID NO: 332280 - DNA, 20 bp, Artificial
  CRISPR gRNA sequence
taagaatattgagttttata

SEQ ID NO: 332281 - DNA, 20 bp, Artificial
  CRISPR gRNA sequence
agaatattgagttttatatg

SEQ ID NO: 332282 - DNA, 20 bp, Artificial
  CRISPR gRNA sequence
agttttatatgcaaaatgac

SEQ ID NO: 332283 - DNA, 20 bp, Artificial
  CRISPR gRNA sequence
tatatgcaaaatgacttact

SEQ ID NO: 332284 - DNA, 20 bp, Artificial
  CRISPR gRNA sequence
atatgcaaaatgacttactg

SEQ ID NO: 332285 - DNA, 20 bp, Artificial
  CRISPR gRNA sequence
tatgcaaaatgacttactgg

SEQ ID NO: 332286 - DNA, 20 bp, Artificial
  CRISPR gRNA sequence
actgggctttgcaaattttt

SEQ ID NO: 332287 - DNA, 20 bp, Artificial
  CRISPR gRNA sequence
ctgggctttgcaaattttta

SEQ ID NO: 332288 - DNA, 20 bp, Artificial
  CRISPR gRNA sequence
ggctttgcaaatttttaaaa

SEQ ID NO: 332289 - DNA, 20 bp, Artificial
  CRISPR gRNA sequence
tgcaaatttttaaaaatgag

SEQ ID NO: 332290 - DNA, 20 bp, Artificial
  CRISPR gRNA sequence
gcaaatttttaaaaatgagt

SEQ ID NO: 332291 - DNA, 20 bp, Artificial
  CRISPR gRNA sequence
caaatttttaaaaatgagtt

SEQ ID NO: 332292 - DNA, 20 bp, Artificial
  CRISPR gRNA sequence
ttaaaaatgagttttaaaat

SEQ ID NO: 332293 - DNA, 20 bp, Artificial
  CRISPR gRNA sequence
taaaaatgagttttaaaatc

SEQ ID NO: 332294 - DNA, 20 bp, Artificial
  CRISPR gRNA sequence
aaaaatgagttttaaaatca

SEQ ID NO: 332295 - DNA, 20 bp, Artificial
  CRISPR gRNA sequence
aaaatgagttttaaaatcat

SEQ ID NO: 332296 - DNA, 20 bp, Artificial
  CRISPR gRNA sequence
taaaatcatttgtagcttgc

SEQ ID NO: 332297 - DNA, 20 bp, Artificial
  CRISPR gRNA sequence
aaaatcatttgtagcttgca

SEQ ID NO: 332298 - DNA, 20 bp, Artificial
  CRISPR gRNA sequence
aaatcatttgtagcttgcaa

SEQ ID NO: 332299 - DNA, 20 bp, Artificial
  CRISPR gRNA sequence
gtagcttgcaataactgaag

SEQ ID NO: 332300 - DNA, 20 bp, Artificial
  CRISPR gRNA sequence
tagcttgcaataactgaaga

SEQ ID NO: 332301 - DNA, 20 bp, Artificial
  CRISPR gRNA sequence
gcaataactgaagaaaagat

SEQ ID NO: 332302 - DNA, 20 bp, Artificial
  CRISPR gRNA sequence
caataactgaagaaaagatc

SEQ ID NO: 332303 - DNA, 20 bp, Artificial
  CRISPR gRNA sequence
aagaaaagatcacaatttct

SEQ ID NO: 332304 - DNA, 20 bp, Artificial
  CRISPR gRNA sequence
ctctgtaaatggcatctcag

SEQ ID NO: 332305 - DNA, 20 bp, Artificial
  CRISPR gRNA sequence
tctgtaaatggcatctcagt

SEQ ID NO: 332306 - DNA, 20 bp, Artificial
  CRISPR gRNA sequence
tgtaaatggcatctcagtac

SEQ ID NO: 332307 - DNA, 20 bp, Artificial
  CRISPR gRNA sequence
taaatggcatctcagtacta

SEQ ID NO: 332308 - DNA, 20 bp, Artificial
  CRISPR gRNA sequence
agtactactgctgttctaat

SEQ ID NO: 332309 - DNA, 20 bp, Artificial
  CRISPR gRNA sequence
ctgctgttctaataaactag

SEQ ID NO: 332310 - DNA, 20 bp, Artificial
  CRISPR gRNA sequence
ctgttctaataaactaggtc

SEQ ID NO: 332311 - DNA, 20 bp, Artificial
  CRISPR gRNA sequence
ttctaataaactaggtctgt

SEQ ID NO: 332312 - DNA, 20 bp, Artificial
  CRISPR gRNA sequence
taataaactaggtctgtcaa

SEQ ID NO: 332313 - DNA, 20 bp, Artificial
  CRISPR gRNA sequence
ataaactaggtctgtcaaat

SEQ ID NO: 332314 - DNA, 20 bp, Artificial
  CRISPR gRNA sequence
ggtctgtcaaatggcacttt

SEQ ID NO: 332315 - DNA, 20 bp, Artificial
  CRISPR gRNA sequence
tcaaatggcactttttggtc

SEQ ID NO: 332316 - DNA, 20 bp, Artificial
  CRISPR gRNA sequence
tttggtcattcaaagtgaaa

SEQ ID NO: 332317 - DNA, 20 bp, Artificial
  CRISPR gRNA sequence
ttggtcattcaaagtgaaaa

SEQ ID NO: 332318 - DNA, 20 bp, Artificial
  CRISPR gRNA sequence
tggtcattcaaagtgaaaaa

SEQ ID NO: 332319 - DNA, 20 bp, Artificial
  CRISPR gRNA sequence
ggtcattcaaagtgaaaaaa

SEQ ID NO: 332320 - DNA, 20 bp, Artificial
  CRISPR gRNA sequence
gtcattcaaagtgaaaaaaa

SEQ ID NO: 332321 - DNA, 20 bp, Artificial
  CRISPR gRNA sequence
aaagtgaaaaaaacatggca

SEQ ID NO: 332322 - DNA, 20 bp, Artificial
  CRISPR gRNA sequence
gaaaccttataaaaattcac

SEQ ID NO: 332323 - DNA, 20 bp, Artificial
  CRISPR gRNA sequence
aaaccttataaaaattcaca

SEQ ID NO: 332324 - DNA, 20 bp, Artificial
  CRISPR gRNA sequence
ataaaaattcacaattatat

SEQ ID NO: 332325 - DNA, 20 bp, Artificial
  CRISPR gRNA sequence
taaaaattcacaattatatt

SEQ ID NO: 332326 - DNA, 20 bp, Artificial
  CRISPR gRNA sequence
acaattatattttggaaagt

SEQ ID NO: 332327 - DNA, 20 bp, Artificial
  CRISPR gRNA sequence
tattttggaaagtggaactt

SEQ ID NO: 332328 - DNA, 20 bp, Artificial
  CRISPR gRNA sequence
tggaaagtggaacttaagta

SEQ ID NO: 332329 - DNA, 20 bp, Artificial
  CRISPR gRNA sequence
ggaaagtggaacttaagtat

SEQ ID NO: 332330 - DNA, 20 bp, Artificial
  CRISPR gRNA sequence
gaaagtggaacttaagtatg

SEQ ID NO: 332331 - DNA, 20 bp, Artificial
  CRISPR gRNA sequence
aagtatgtaggggatatgtc

SEQ ID NO: 332332 - DNA, 20 bp, Artificial
  CRISPR gRNA sequence
agtatgtaggggatatgtca

SEQ ID NO: 332333 - DNA, 20 bp, Artificial
  CRISPR gRNA sequence
aaagtgttagtcaagaaatg

SEQ ID NO: 332334 - DNA, 20 bp, Artificial
  CRISPR gRNA sequence
gtcaagaaatgatttttttt

SEQ ID NO: 332335 - DNA, 20 bp, Artificial
  CRISPR gRNA sequence
tttttttcaatagtttggcc

SEQ ID NO: 332336 - DNA, 20 bp, Artificial
  CRISPR gRNA sequence
ttttttcaatagtttggcct

SEQ ID NO: 332337 - DNA, 20 bp, Artificial
  CRISPR gRNA sequence
tttttcaatagtttggcctg

SEQ ID NO: 332338 - DNA, 20 bp, Artificial
  CRISPR gRNA sequence
ttttcaatagtttggcctgt

SEQ ID NO: 332339 - DNA, 20 bp, Artificial
  CRISPR gRNA sequence
tttcaatagtttggcctgta

SEQ ID NO: 332340 - DNA, 20 bp, Artificial
  CRISPR gRNA sequence
ttcaatagtttggcctgtaa

SEQ ID NO: 332341 - DNA, 20 bp, Artificial
  CRISPR gRNA sequence
tcaatagtttggcctgtaag

SEQ ID NO: 332342 - DNA, 20 bp, Artificial
  CRISPR gRNA sequence
caatagtttggcctgtaagg

SEQ ID NO: 332343 - DNA, 20 bp, Artificial
  CRISPR gRNA sequence
aatagtttggcctgtaaggt

SEQ ID NO: 332344 - DNA, 20 bp, Artificial
  CRISPR gRNA sequence
ggcctgtaaggttgaccaaa

SEQ ID NO: 332345 - DNA, 20 bp, Artificial
  CRISPR gRNA sequence
gcctgtaaggttgaccaaaa

SEQ ID NO: 332346 - DNA, 20 bp, Artificial
  CRISPR gRNA sequence
taaggttgaccaaaacaggt

SEQ ID NO: 332347 - DNA, 20 bp, Artificial
  CRISPR gRNA sequence
accaaaacaggtaaagattt

SEQ ID NO: 332348 - DNA, 20 bp, Artificial
  CRISPR gRNA sequence
gcaagtttagagagtcagaa

SEQ ID NO: 332349 - DNA, 20 bp, Artificial
  CRISPR gRNA sequence
caagtttagagagtcagaaa

SEQ ID NO: 332350 - DNA, 20 bp, Artificial
  CRISPR gRNA sequence
agagagtcagaaactgggga

SEQ ID NO: 332351 - DNA, 20 bp, Artificial
  CRISPR gRNA sequence
gagagtcagaaactggggat

SEQ ID NO: 332352 - DNA, 20 bp, Artificial
  CRISPR gRNA sequence
gggatatgaacttccttctg

SEQ ID NO: 332353 - DNA, 20 bp, Artificial
  CRISPR gRNA sequence
ccttctggttcatgtataac

SEQ ID NO: 332354 - DNA, 20 bp, Artificial
  CRISPR gRNA sequence
cttctggttcatgtataaca

SEQ ID NO: 332355 - DNA, 20 bp, Artificial
  CRISPR gRNA sequence
ctggttcatgtataacataa

SEQ ID NO: 332356 - DNA, 20 bp, Artificial
  CRISPR gRNA sequence
tggttcatgtataacataat

SEQ ID NO: 332357 - DNA, 20 bp, Artificial
  CRISPR gRNA sequence
gttcatgtataacataatga

SEQ ID NO: 332358 - DNA, 20 bp, Artificial
  CRISPR gRNA sequence
atgtataacataatgatgct

SEQ ID NO: 332359 - DNA, 20 bp, Artificial
  CRISPR gRNA sequence
gtatctactttgcttgagga

SEQ ID NO: 332360 - DNA, 20 bp, Artificial
  CRISPR gRNA sequence
tatctactttgcttgaggaa

SEQ ID NO: 332361 - DNA, 20 bp, Artificial
  CRISPR gRNA sequence
ctttgcttgaggaaaaaaaa

SEQ ID NO: 332362 - DNA, 20 bp, Artificial
  CRISPR gRNA sequence
tgcttgaggaaaaaaaagaa

SEQ ID NO: 332363 - DNA, 20 bp, Artificial
  CRISPR gRNA sequence
gcttgaggaaaaaaaagaaa

SEQ ID NO: 332364 - DNA, 20 bp, Artificial
  CRISPR gRNA sequence
cttgaggaaaaaaaagaaac

SEQ ID NO: 332365 - DNA, 20 bp, Artificial
  CRISPR gRNA sequence
gaggaaaaaaaagaaacacg

SEQ ID NO: 332366 - DNA, 20 bp, Artificial
  CRISPR gRNA sequence
aggaaaaaaaagaaacacgt

SEQ ID NO: 332367 - DNA, 20 bp, Artificial
  CRISPR gRNA sequence
tccccaaatagggtgataga

SEQ ID NO: 332368 - DNA, 20 bp, Artificial
  CRISPR gRNA sequence
ccatccagttgaccacgagt

SEQ ID NO: 332369 - DNA, 20 bp, Artificial
  CRISPR gRNA sequence
catccagttgaccacgagtg

SEQ ID NO: 332370 - DNA, 20 bp, Artificial
  CRISPR gRNA sequence
accacgagtgttgttaggat

SEQ ID NO: 332371 - DNA, 20 bp, Artificial
  CRISPR gRNA sequence
ttaggatctgtttatttgag

SEQ ID NO: 332372 - DNA, 20 bp, Artificial
  CRISPR gRNA sequence
ggatctgtttatttgagtca

SEQ ID NO: 332373 - DNA, 20 bp, Artificial
  CRISPR gRNA sequence
tttatttgagtcatgttgac

SEQ ID NO: 332374 - DNA, 20 bp, Artificial
  CRISPR gRNA sequence
atttgagtcatgttgacaca

SEQ ID NO: 332375 - DNA, 20 bp, Artificial
  CRISPR gRNA sequence
tttgagtcatgttgacacag

SEQ ID NO: 332376 - DNA, 20 bp, Artificial
  CRISPR gRNA sequence
gagtcatgttgacacagaca

SEQ ID NO: 332377 - DNA, 20 bp, Artificial
  CRISPR gRNA sequence
agtcatgttgacacagacac

SEQ ID NO: 332378 - DNA, 20 bp, Artificial
  CRISPR gRNA sequence
acacagacacagcactttca

SEQ ID NO: 332379 - DNA, 20 bp, Artificial
  CRISPR gRNA sequence
tcaataagcaattaatgatc

SEQ ID NO: 332380 - DNA, 20 bp, Artificial
  CRISPR gRNA sequence
caataagcaattaatgatca

SEQ ID NO: 332381 - DNA, 20 bp, Artificial
  CRISPR gRNA sequence
aataagcaattaatgatcat

SEQ ID NO: 332382 - DNA, 20 bp, Artificial
  CRISPR gRNA sequence
atgatcatttaaaggtaact

SEQ ID NO: 332383 - DNA, 20 bp, Artificial
  CRISPR gRNA sequence
aaaggtaacttttttgaatt

SEQ ID NO: 332384 - DNA, 20 bp, Artificial
  CRISPR gRNA sequence
aaggtaacttttttgaattt

SEQ ID NO: 332385 - DNA, 20 bp, Artificial
  CRISPR gRNA sequence
ttttgaatttgataaataga

SEQ ID NO: 332386 - DNA, 20 bp, Artificial
  CRISPR gRNA sequence
tttgaatttgataaatagat

SEQ ID NO: 332387 - DNA, 20 bp, Artificial
  CRISPR gRNA sequence
ttgaatttgataaatagatt

SEQ ID NO: 332388 - DNA, 20 bp, Artificial
  CRISPR gRNA sequence
tgaatttgataaatagattt

SEQ ID NO: 332389 - DNA, 20 bp, Artificial
  CRISPR gRNA sequence
gaatttgataaatagatttt

SEQ ID NO: 332390 - DNA, 20 bp, Artificial
  CRISPR gRNA sequence
aatttgataaatagattttt

SEQ ID NO: 332391 - DNA, 20 bp, Artificial
  CRISPR gRNA sequence
gataaatagattttttttac

SEQ ID NO: 332392 - DNA, 20 bp, Artificial
  CRISPR gRNA sequence
ataaatagattttttttaca

SEQ ID NO: 332393 - DNA, 20 bp, Artificial
  CRISPR gRNA sequence
tttttacagcctgtatttgt

SEQ ID NO: 332394 - DNA, 20 bp, Artificial
  CRISPR gRNA sequence
ttttacagcctgtatttgtg

SEQ ID NO: 332395 - DNA, 20 bp, Artificial
  CRISPR gRNA sequence
tttacagcctgtatttgtgt

SEQ ID NO: 332396 - DNA, 20 bp, Artificial
  CRISPR gRNA sequence
ttacagcctgtatttgtgtt

SEQ ID NO: 332397 - DNA, 20 bp, Artificial
  CRISPR gRNA sequence
tacagcctgtatttgtgttc

SEQ ID NO: 332398 - DNA, 20 bp, Artificial
  CRISPR gRNA sequence
acagcctgtatttgtgttct

SEQ ID NO: 332399 - DNA, 20 bp, Artificial
  CRISPR gRNA sequence
cagcctgtatttgtgttctt

SEQ ID NO: 332400 - DNA, 20 bp, Artificial
  CRISPR gRNA sequence
tatttgtgttcttctaggac

SEQ ID NO: 332401 - DNA, 20 bp, Artificial
  CRISPR gRNA sequence
gtgttcttctaggactttgc

SEQ ID NO: 332402 - DNA, 20 bp, Artificial
  CRISPR gRNA sequence
tgttcttctaggactttgca

SEQ ID NO: 332403 - DNA, 20 bp, Artificial
  CRISPR gRNA sequence
ttctaggactttgcaacaaa

SEQ ID NO: 332404 - DNA, 20 bp, Artificial
  CRISPR gRNA sequence
ctaggactttgcaacaaaga

SEQ ID NO: 332405 - DNA, 20 bp, Artificial
  CRISPR gRNA sequence
taggactttgcaacaaagaa

SEQ ID NO: 332406 - DNA, 20 bp, Artificial
  CRISPR gRNA sequence
ggactttgcaacaaagaatc

SEQ ID NO: 332407 - DNA, 20 bp, Artificial
  CRISPR gRNA sequence
tgcaacaaagaatctgtaca

SEQ ID NO: 332408 - DNA, 20 bp, Artificial
  CRISPR gRNA sequence
gcaacaaagaatctgtacat

SEQ ID NO: 332409 - DNA, 20 bp, Artificial
  CRISPR gRNA sequence
caacaaagaatctgtacatg

SEQ ID NO: 332410 - DNA, 20 bp, Artificial
  CRISPR gRNA sequence
tacatgcaaaaacaacaata

SEQ ID NO: 332411 - DNA, 20 bp, Artificial
  CRISPR gRNA sequence
tctactgcactcacagttaa

SEQ ID NO: 332412 - DNA, 20 bp, Artificial
  CRISPR gRNA sequence
ctgcactcacagttaaagtt

SEQ ID NO: 332413 - DNA, 20 bp, Artificial
  CRISPR gRNA sequence
cactcacagttaaagttctg

SEQ ID NO: 332414 - DNA, 20 bp, Artificial
  CRISPR gRNA sequence
acagttaaagttctgtttac

SEQ ID NO: 332415 - DNA, 20 bp, Artificial
  CRISPR gRNA sequence
aagttctgtttactttgcac

SEQ ID NO: 332416 - DNA, 20 bp, Artificial
  CRISPR gRNA sequence
tgtttactttgcactatcta

SEQ ID NO: 332417 - DNA, 20 bp, Artificial
  CRISPR gRNA sequence
tttactttgcactatctagg

SEQ ID NO: 332418 - DNA, 20 bp, Artificial
  CRISPR gRNA sequence
actttgcactatctaggact

SEQ ID NO: 332419 - DNA, 20 bp, Artificial
  CRISPR gRNA sequence
ctttgcactatctaggacta

SEQ ID NO: 332420 - DNA, 20 bp, Artificial
  CRISPR gRNA sequence
tgcactatctaggactaatg

SEQ ID NO: 332421 - DNA, 20 bp, Artificial
  CRISPR gRNA sequence
gcactatctaggactaatgc

SEQ ID NO: 332422 - DNA, 20 bp, Artificial
  CRISPR gRNA sequence
cactatctaggactaatgca

SEQ ID NO: 332423 - DNA, 20 bp, Artificial
  CRISPR gRNA sequence
tctaggactaatgcaaaaat

SEQ ID NO: 332424 - DNA, 20 bp, Artificial
  CRISPR gRNA sequence
ggactaatgcaaaaatctca

SEQ ID NO: 332425 - DNA, 20 bp, Artificial
  CRISPR gRNA sequence
atgcaaaaatctcatagatg

SEQ ID NO: 332426 - DNA, 20 bp, Artificial
  CRISPR gRNA sequence
atagatgtgcctatttgcac

SEQ ID NO: 332427 - DNA, 20 bp, Artificial
  CRISPR gRNA sequence
tttgcacttatttaattatg

SEQ ID NO: 332428 - DNA, 20 bp, Artificial
  CRISPR gRNA sequence
gcacttatttaattatgatg

SEQ ID NO: 332429 - DNA, 20 bp, Artificial
  CRISPR gRNA sequence
cacttatttaattatgatga

SEQ ID NO: 332430 - DNA, 20 bp, Artificial
  CRISPR gRNA sequence
atttaattatgatgaaattt

SEQ ID NO: 332431 - DNA, 20 bp, Artificial
  CRISPR gRNA sequence
tttaattatgatgaaattta

SEQ ID NO: 332432 - DNA, 20 bp, Artificial
  CRISPR gRNA sequence
aattatgatgaaatttactt

SEQ ID NO: 332433 - DNA, 20 bp, Artificial
  CRISPR gRNA sequence
attatgatgaaatttacttc

SEQ ID NO: 332434 - DNA, 20 bp, Artificial
  CRISPR gRNA sequence
tgatgaaatttacttctata

SEQ ID NO: 332435 - DNA, 20 bp, Artificial
  CRISPR gRNA sequence
acttctatatgtgaatccat

SEQ ID NO: 332436 - DNA, 20 bp, Artificial
  CRISPR gRNA sequence
cttctatatgtgaatccatt

SEQ ID NO: 332437 - DNA, 20 bp, Artificial
  CRISPR gRNA sequence
ctatatgtgaatccatttct

SEQ ID NO: 332438 - DNA, 20 bp, Artificial
  CRISPR gRNA sequence
tatatgtgaatccatttctg

SEQ ID NO: 332439 - DNA, 20 bp, Artificial
  CRISPR gRNA sequence
tatgtgaatccatttctgta

SEQ ID NO: 332440 - DNA, 20 bp, Artificial
  CRISPR gRNA sequence
ctgtacatttctacaggcag

SEQ ID NO: 332441 - DNA, 20 bp, Artificial
  CRISPR gRNA sequence
tgtacatttctacaggcaga

SEQ ID NO: 332442 - DNA, 20 bp, Artificial
  CRISPR gRNA sequence
tacatttctacaggcagata

SEQ ID NO: 332443 - DNA, 20 bp, Artificial
  CRISPR gRNA sequence
ctacaggcagataagtgatg

SEQ ID NO: 332444 - DNA, 20 bp, Artificial
  CRISPR gRNA sequence
tacaggcagataagtgatgg

SEQ ID NO: 332445 - DNA, 20 bp, Artificial
  CRISPR gRNA sequence
caggcagataagtgatggga

SEQ ID NO: 332446 - DNA, 20 bp, Artificial
  CRISPR gRNA sequence
agaatttagacttcatcaga

SEQ ID NO: 332447 - DNA, 20 bp, Artificial
  CRISPR gRNA sequence
agacttcatcagagaagaac

SEQ ID NO: 332448 - DNA, 20 bp, Artificial
  CRISPR gRNA sequence
gacttcatcagagaagaacc

SEQ ID NO: 332449 - DNA, 20 bp, Artificial
  CRISPR gRNA sequence
catcagagaagaacccaggt

SEQ ID NO: 332450 - DNA, 20 bp, Artificial
  CRISPR gRNA sequence
atcagagaagaacccaggta

SEQ ID NO: 332451 - DNA, 20 bp, Artificial
  CRISPR gRNA sequence
aatacatgatggctgatgaa

SEQ ID NO: 332452 - DNA, 20 bp, Artificial
  CRISPR gRNA sequence
atacatgatggctgatgaat

SEQ ID NO: 332453 - DNA, 20 bp, Artificial
  CRISPR gRNA sequence
atgaatgaaaatgtctaggg

SEQ ID NO: 332454 - DNA, 20 bp, Artificial
  CRISPR gRNA sequence
gggaaatgagtgtgttatgt

SEQ ID NO: 332455 - DNA, 20 bp, Artificial
  CRISPR gRNA sequence
tgtacaatgtaatttcatat

SEQ ID NO: 332456 - DNA, 20 bp, Artificial
  CRISPR gRNA sequence
catatctaagtcactttaaa

SEQ ID NO: 332457 - DNA, 20 bp, Artificial
  CRISPR gRNA sequence
atatctaagtcactttaaaa

SEQ ID NO: 332458 - DNA, 20 bp, Artificial
  CRISPR gRNA sequence
agtcactttaaaataatttt

SEQ ID NO: 332459 - DNA, 20 bp, Artificial
  CRISPR gRNA sequence
taaaataattttttgatata

SEQ ID NO: 332460 - DNA, 20 bp, Artificial
  CRISPR gRNA sequence
aaaataattttttgatatat

SEQ ID NO: 332461 - DNA, 20 bp, Artificial
  CRISPR gRNA sequence
aaataattttttgatatata

SEQ ID NO: 332462 - DNA, 20 bp, Artificial
  CRISPR gRNA sequence
tttgatatataataaccctt

SEQ ID NO: 332463 - DNA, 20 bp, Artificial
  CRISPR gRNA sequence
ttgatatataataacccttt

SEQ ID NO: 332464 - DNA, 20 bp, Artificial
  CRISPR gRNA sequence
tgatatataataaccctttc

SEQ ID NO: 332465 - DNA, 20 bp, Artificial
  CRISPR gRNA sequence
gatatataataaccctttca

SEQ ID NO: 332466 - DNA, 20 bp, Artificial
  CRISPR gRNA sequence
atatataataaccctttcaa

SEQ ID NO: 332467 - DNA, 20 bp, Artificial
  CRISPR gRNA sequence
tcaatcacagaacacatatg

SEQ ID NO: 332468 - DNA, 20 bp, Artificial
  CRISPR gRNA sequence
caatcacagaacacatatgt

SEQ ID NO: 332469 - DNA, 20 bp, Artificial
  CRISPR gRNA sequence
aatcacagaacacatatgtg

SEQ ID NO: 332470 - DNA, 20 bp, Artificial
  CRISPR gRNA sequence
ctttaagtattaaggtgata

SEQ ID NO: 332471 - DNA, 20 bp, Artificial
  CRISPR gRNA sequence
taagtattaaggtgataata

SEQ ID NO: 332472 - DNA, 20 bp, Artificial
  CRISPR gRNA sequence
aagtattaaggtgataatat

SEQ ID NO: 332473 - DNA, 20 bp, Artificial
  CRISPR gRNA sequence
agtattaaggtgataatata

SEQ ID NO: 332474 - DNA, 20 bp, Artificial
  CRISPR gRNA sequence
aggtgataatatatccaata

SEQ ID NO: 332475 - DNA, 20 bp, Artificial
  CRISPR gRNA sequence
gaaggaaaataaatacctga

SEQ ID NO: 332476 - DNA, 20 bp, Artificial
  CRISPR gRNA sequence
aaattcattttcatatctag

SEQ ID NO: 332477 - DNA, 20 bp, Artificial
  CRISPR gRNA sequence
attttcatatctagcttaat

SEQ ID NO: 332478 - DNA, 20 bp, Artificial
  CRISPR gRNA sequence
tcatatctagcttaatgtta

SEQ ID NO: 332479 - DNA, 20 bp, Artificial
  CRISPR gRNA sequence
catatctagcttaatgttaa

SEQ ID NO: 332480 - DNA, 20 bp, Artificial
  CRISPR gRNA sequence
atatctagcttaatgttaaa

SEQ ID NO: 332481 - DNA, 20 bp, Artificial
  CRISPR gRNA sequence
gcttaatgttaaaagcttct

SEQ ID NO: 332482 - DNA, 20 bp, Artificial
  CRISPR gRNA sequence
aatgttaaaagcttcttttt

SEQ ID NO: 332483 - DNA, 20 bp, Artificial
  CRISPR gRNA sequence
atgttaaaagcttctttttg

SEQ ID NO: 332484 - DNA, 20 bp, Artificial
  CRISPR gRNA sequence
aaagcttctttttgtttttt

SEQ ID NO: 332485 - DNA, 20 bp, Artificial
  CRISPR gRNA sequence
ctttttgtttttttatttcg

SEQ ID NO: 332486 - DNA, 20 bp, Artificial
  CRISPR gRNA sequence
tttttgtttttttatttcgt

SEQ ID NO: 332487 - DNA, 20 bp, Artificial
  CRISPR gRNA sequence
tttgtttttttatttcgtag

SEQ ID NO: 332488 - DNA, 20 bp, Artificial
  CRISPR gRNA sequence
ttgtttttttatttcgtagc

SEQ ID NO: 332489 - DNA, 20 bp, Artificial
  CRISPR gRNA sequence
tgtttttttatttcgtagca

SEQ ID NO: 332490 - DNA, 20 bp, Artificial
  CRISPR gRNA sequence
gtttttttatttcgtagcaa

SEQ ID NO: 332491 - DNA, 20 bp, Artificial
  CRISPR gRNA sequence
tttttttatttcgtagcaaa

SEQ ID NO: 332492 - DNA, 20 bp, Artificial
  CRISPR gRNA sequence
ttttatttcgtagcaaatct

SEQ ID NO: 332493 - DNA, 20 bp, Artificial
  CRISPR gRNA sequence
tttatttcgtagcaaatctc

SEQ ID NO: 332494 - DNA, 20 bp, Artificial
  CRISPR gRNA sequence
ttatttcgtagcaaatctct

SEQ ID NO: 332495 - DNA, 20 bp, Artificial
  CRISPR gRNA sequence
tatttcgtagcaaatctctt

SEQ ID NO: 332496 - DNA, 20 bp, Artificial
  CRISPR gRNA sequence
atttcgtagcaaatctcttt

SEQ ID NO: 332497 - DNA, 20 bp, Artificial
  CRISPR gRNA sequence
tttcgtagcaaatctcttta

SEQ ID NO: 332498 - DNA, 20 bp, Artificial
  CRISPR gRNA sequence
cgtagcaaatctctttagct

SEQ ID NO: 332499 - DNA, 20 bp, Artificial
  CRISPR gRNA sequence
gtagcaaatctctttagctc

SEQ ID NO: 332500 - DNA, 20 bp, Artificial
  CRISPR gRNA sequence
tttagctctgatgctttagt

SEQ ID NO: 332501 - DNA, 20 bp, Artificial
  CRISPR gRNA sequence
tagctctgatgctttagttt

SEQ ID NO: 332502 - DNA, 20 bp, Artificial
  CRISPR gRNA sequence
agctctgatgctttagtttc

SEQ ID NO: 332503 - DNA, 20 bp, Artificial
  CRISPR gRNA sequence
gctctgatgctttagtttct

SEQ ID NO: 332504 - DNA, 20 bp, Artificial
  CRISPR gRNA sequence
tgatgctttagtttctgtac

SEQ ID NO: 332505 - DNA, 20 bp, Artificial
  CRISPR gRNA sequence
atgctttagtttctgtacaa

SEQ ID NO: 332506 - DNA, 20 bp, Artificial
  CRISPR gRNA sequence
tagtttctgtacaatgagag

SEQ ID NO: 332507 - DNA, 20 bp, Artificial
  CRISPR gRNA sequence
agtttctgtacaatgagagg

SEQ ID NO: 332508 - DNA, 20 bp, Artificial
  CRISPR gRNA sequence
gtttctgtacaatgagagga

SEQ ID NO: 332509 - DNA, 20 bp, Artificial
  CRISPR gRNA sequence
ctgtacaatgagaggattgg

SEQ ID NO: 332510 - DNA, 20 bp, Artificial
  CRISPR gRNA sequence
tgtacaatgagaggattgga

SEQ ID NO: 332511 - DNA, 20 bp, Artificial
  CRISPR gRNA sequence
tacaatgagaggattggact

SEQ ID NO: 332512 - DNA, 20 bp, Artificial
  CRISPR gRNA sequence
gactagattattaggtgaag

SEQ ID NO: 332513 - DNA, 20 bp, Artificial
  CRISPR gRNA sequence
gattattaggtgaagagatt

SEQ ID NO: 332514 - DNA, 20 bp, Artificial
  CRISPR gRNA sequence
ttaggtgaagagattaagta

SEQ ID NO: 332515 - DNA, 20 bp, Artificial
  CRISPR gRNA sequence
ggtgaagagattaagtaagt

SEQ ID NO: 332516 - DNA, 20 bp, Artificial
  CRISPR gRNA sequence
agtaagtgtgtgtaccctgg

SEQ ID NO: 332517 - DNA, 20 bp, Artificial
  CRISPR gRNA sequence
gtgtcaaattatcttattct

SEQ ID NO: 332518 - DNA, 20 bp, Artificial
  CRISPR gRNA sequence
tcttattcttttttctttgt

SEQ ID NO: 332519 - DNA, 20 bp, Artificial
  CRISPR gRNA sequence
attcttttttctttgttttt

SEQ ID NO: 332520 - DNA, 20 bp, Artificial
  CRISPR gRNA sequence
ttcttttttctttgtttttg

SEQ ID NO: 332521 - DNA, 20 bp, Artificial
  CRISPR gRNA sequence
ttttttctttgtttttgttg

SEQ ID NO: 332522 - DNA, 20 bp, Artificial
  CRISPR gRNA sequence
ttttctttgtttttgttgga

SEQ ID NO: 332523 - DNA, 20 bp, Artificial
  CRISPR gRNA sequence
tttctttgtttttgttggac

SEQ ID NO: 332524 - DNA, 20 bp, Artificial
  CRISPR gRNA sequence
ttctttgtttttgttggact

SEQ ID NO: 332525 - DNA, 20 bp, Artificial
  CRISPR gRNA sequence
tctttgtttttgttggactg

SEQ ID NO: 332526 - DNA, 20 bp, Artificial
  CRISPR gRNA sequence
ctttgtttttgttggactgg

SEQ ID NO: 332527 - DNA, 20 bp, Artificial
  CRISPR gRNA sequence
tttgtttttgttggactggg

SEQ ID NO: 332528 - DNA, 20 bp, Artificial
  CRISPR gRNA sequence
tgtttttgttggactgggtt

SEQ ID NO: 332529 - DNA, 20 bp, Artificial
  CRISPR gRNA sequence
gtttttgttggactgggtta

SEQ ID NO: 332530 - DNA, 20 bp, Artificial
  CRISPR gRNA sequence
tttttgttggactgggttaa

SEQ ID NO: 332531 - DNA, 20 bp, Artificial
  CRISPR gRNA sequence
ttgttggactgggttaattc

SEQ ID NO: 332532 - DNA, 20 bp, Artificial
  CRISPR gRNA sequence
tgttggactgggttaattcg

SEQ ID NO: 332533 - DNA, 20 bp, Artificial
  CRISPR gRNA sequence
gttggactgggttaattcga

SEQ ID NO: 332534 - DNA, 20 bp, Artificial
  CRISPR gRNA sequence
ttggactgggttaattcgaa

SEQ ID NO: 332535 - DNA, 20 bp, Artificial
  CRISPR gRNA sequence
gactgggttaattcgaagac

SEQ ID NO: 332536 - DNA, 20 bp, Artificial
  CRISPR gRNA sequence
ggttaattcgaagaccttgt

SEQ ID NO: 332537 - DNA, 20 bp, Artificial
  CRISPR gRNA sequence
attcgaagaccttgtcttca

SEQ ID NO: 332538 - DNA, 20 bp, Artificial
  CRISPR gRNA sequence
gaagaccttgtcttcaagct

SEQ ID NO: 332539 - DNA, 20 bp, Artificial
  CRISPR gRNA sequence
gtcttcaagctctgaatttc

SEQ ID NO: 332540 - DNA, 20 bp, Artificial
  CRISPR gRNA sequence
tcttcaagctctgaatttct

SEQ ID NO: 332541 - DNA, 20 bp, Artificial
  CRISPR gRNA sequence
caagctctgaatttctttct

SEQ ID NO: 332542 - DNA, 20 bp, Artificial
  CRISPR gRNA sequence
aagctctgaatttctttctt

SEQ ID NO: 332543 - DNA, 20 bp, Artificial
  CRISPR gRNA sequence
tgaatttctttcttctagtt

SEQ ID NO: 332544 - DNA, 20 bp, Artificial
  CRISPR gRNA sequence
aatttctttcttctagttgt

SEQ ID NO: 332545 - DNA, 20 bp, Artificial
  CRISPR gRNA sequence
ctttcttctagttgttcaat

SEQ ID NO: 332546 - DNA, 20 bp, Artificial
  CRISPR gRNA sequence
tttcttctagttgttcaatt

SEQ ID NO: 332547 - DNA, 20 bp, Artificial
  CRISPR gRNA sequence
tcttctagttgttcaattct

SEQ ID NO: 332548 - DNA, 20 bp, Artificial
  CRISPR gRNA sequence
cttctagttgttcaattcta

SEQ ID NO: 332549 - DNA, 20 bp, Artificial
  CRISPR gRNA sequence
ttctagttgttcaattctat

SEQ ID NO: 332550 - DNA, 20 bp, Artificial
  CRISPR gRNA sequence
ctagttgttcaattctattg

SEQ ID NO: 332551 - DNA, 20 bp, Artificial
  CRISPR gRNA sequence
tagttgttcaattctattgc

SEQ ID NO: 332552 - DNA, 20 bp, Artificial
  CRISPR gRNA sequence
gttgttcaattctattgctg

SEQ ID NO: 332553 - DNA, 20 bp, Artificial
  CRISPR gRNA sequence
ttcaattctattgctgagac

SEQ ID NO: 332554 - DNA, 20 bp, Artificial
  CRISPR gRNA sequence
aattctattgctgagacttt

SEQ ID NO: 332555 - DNA, 20 bp, Artificial
  CRISPR gRNA sequence
tattgctgagactttccaga

SEQ ID NO: 332556 - DNA, 20 bp, Artificial
  CRISPR gRNA sequence
ttgctgagactttccagagc

SEQ ID NO: 332557 - DNA, 20 bp, Artificial
  CRISPR gRNA sequence
ctgagactttccagagcatt

SEQ ID NO: 332558 - DNA, 20 bp, Artificial
  CRISPR gRNA sequence
agactttccagagcatttca

SEQ ID NO: 332559 - DNA, 20 bp, Artificial
  CRISPR gRNA sequence
tccagagcatttcacctttc

SEQ ID NO: 332560 - DNA, 20 bp, Artificial
  CRISPR gRNA sequence
ccagagcatttcacctttct

SEQ ID NO: 332561 - DNA, 20 bp, Artificial
  CRISPR gRNA sequence
cagagcatttcacctttcta

SEQ ID NO: 332562 - DNA, 20 bp, Artificial
  CRISPR gRNA sequence
cacctttctaaaattgtgtc

SEQ ID NO: 332563 - DNA, 20 bp, Artificial
  CRISPR gRNA sequence
acctttctaaaattgtgtcc

SEQ ID NO: 332564 - DNA, 20 bp, Artificial
  CRISPR gRNA sequence
tctaaaattgtgtccaaagt

SEQ ID NO: 332565 - DNA, 20 bp, Artificial
  CRISPR gRNA sequence
ctaaaattgtgtccaaagtt

SEQ ID NO: 332566 - DNA, 20 bp, Artificial
  CRISPR gRNA sequence
taaaattgtgtccaaagttt

SEQ ID NO: 332567 - DNA, 20 bp, Artificial
  CRISPR gRNA sequence
aaattgtgtccaaagtttcc

SEQ ID NO: 332568 - DNA, 20 bp, Artificial
  CRISPR gRNA sequence
tgtccaaagtttcctgaaat

SEQ ID NO: 332569 - DNA, 20 bp, Artificial
  CRISPR gRNA sequence
cctgaaatttttattgtttt

SEQ ID NO: 332570 - DNA, 20 bp, Artificial
  CRISPR gRNA sequence
ctgaaatttttattgttttt

SEQ ID NO: 332571 - DNA, 20 bp, Artificial
  CRISPR gRNA sequence
aaatttttattgttttttct

SEQ ID NO: 332572 - DNA, 20 bp, Artificial
  CRISPR gRNA sequence
ttattgttttttctttaagc

SEQ ID NO: 332573 - DNA, 20 bp, Artificial
  CRISPR gRNA sequence
tattgttttttctttaagct

SEQ ID NO: 332574 - DNA, 20 bp, Artificial
  CRISPR gRNA sequence
attgttttttctttaagcta

SEQ ID NO: 332575 - DNA, 20 bp, Artificial
  CRISPR gRNA sequence
ttgttttttctttaagctat

SEQ ID NO: 332576 - DNA, 20 bp, Artificial
  CRISPR gRNA sequence
ttttttctttaagctatcta

SEQ ID NO: 332577 - DNA, 20 bp, Artificial
  CRISPR gRNA sequence
tttctttaagctatctattt

SEQ ID NO: 332578 - DNA, 20 bp, Artificial
  CRISPR gRNA sequence
ttctttaagctatctatttc

SEQ ID NO: 332579 - DNA, 20 bp, Artificial
  CRISPR gRNA sequence
tctttaagctatctatttcc

SEQ ID NO: 332580 - DNA, 20 bp, Artificial
  CRISPR gRNA sequence
ctttaagctatctatttcct

SEQ ID NO: 332581 - DNA, 20 bp, Artificial
  CRISPR gRNA sequence
tttaagctatctatttcctt

SEQ ID NO: 332582 - DNA, 20 bp, Artificial
  CRISPR gRNA sequence
taagctatctatttccttga

SEQ ID NO: 332583 - DNA, 20 bp, Artificial
  CRISPR gRNA sequence
aagctatctatttccttgaa

SEQ ID NO: 332584 - DNA, 20 bp, Artificial
  CRISPR gRNA sequence
agctatctatttccttgaat

SEQ ID NO: 332585 - DNA, 20 bp, Artificial
  CRISPR gRNA sequence
tctatttccttgaatatttc

SEQ ID NO: 332586 - DNA, 20 bp, Artificial
  CRISPR gRNA sequence
tttccttgaatatttctgcc

SEQ ID NO: 332587 - DNA, 20 bp, Artificial
  CRISPR gRNA sequence
ccttgaatatttctgccttc

SEQ ID NO: 332588 - DNA, 20 bp, Artificial
  CRISPR gRNA sequence
cttgaatatttctgccttca

SEQ ID NO: 332589 - DNA, 20 bp, Artificial
  CRISPR gRNA sequence
gaatatttctgccttcactt

SEQ ID NO: 332590 - DNA, 20 bp, Artificial
  CRISPR gRNA sequence
aatatttctgccttcacttc

SEQ ID NO: 332591 - DNA, 20 bp, Artificial
  CRISPR gRNA sequence
ctgccttcacttcttgtatc

SEQ ID NO: 332592 - DNA, 20 bp, Artificial
  CRISPR gRNA sequence
tgccttcacttcttgtatca

SEQ ID NO: 332593 - DNA, 20 bp, Artificial
  CRISPR gRNA sequence
ccttcacttcttgtatcatt

SEQ ID NO: 332594 - DNA, 20 bp, Artificial
  CRISPR gRNA sequence
cacttcttgtatcatttttt

SEQ ID NO: 332595 - DNA, 20 bp, Artificial
  CRISPR gRNA sequence
acttcttgtatcattttttg

SEQ ID NO: 332596 - DNA, 20 bp, Artificial
  CRISPR gRNA sequence
cttgtatcattttttgcatt

SEQ ID NO: 332597 - DNA, 20 bp, Artificial
  CRISPR gRNA sequence
ttgtatcattttttgcattt

SEQ ID NO: 332598 - DNA, 20 bp, Artificial
  CRISPR gRNA sequence
gtatcattttttgcatttcc

SEQ ID NO: 332599 - DNA, 20 bp, Artificial
  CRISPR gRNA sequence
tatcattttttgcatttcct

SEQ ID NO: 332600 - DNA, 20 bp, Artificial
  CRISPR gRNA sequence
tttgcatttccttgcattgg

SEQ ID NO: 332601 - DNA, 20 bp, Artificial
  CRISPR gRNA sequence
ttgcatttccttgcattggg

SEQ ID NO: 332602 - DNA, 20 bp, Artificial
  CRISPR gRNA sequence
tgcatttccttgcattgggc

SEQ ID NO: 332603 - DNA, 20 bp, Artificial
  CRISPR gRNA sequence
gcatttccttgcattgggct

SEQ ID NO: 332604 - DNA, 20 bp, Artificial
  CRISPR gRNA sequence
catttccttgcattgggctt

SEQ ID NO: 332605 - DNA, 20 bp, Artificial
  CRISPR gRNA sequence
ccttgcattgggcttcacct

SEQ ID NO: 332606 - DNA, 20 bp, Artificial
  CRISPR gRNA sequence
cttgcattgggcttcacctt

SEQ ID NO: 332607 - DNA, 20 bp, Artificial
  CRISPR gRNA sequence
gcattgggcttcacctttct

SEQ ID NO: 332608 - DNA, 20 bp, Artificial
  CRISPR gRNA sequence
cattgggcttcacctttctc

SEQ ID NO: 332609 - DNA, 20 bp, Artificial
  CRISPR gRNA sequence
ggcttcacctttctctggtc

SEQ ID NO: 332610 - DNA, 20 bp, Artificial
  CRISPR gRNA sequence
cacctttctctggtccctcc

SEQ ID NO: 332611 - DNA, 20 bp, Artificial
  CRISPR gRNA sequence
acctttctctggtccctccc

SEQ ID NO: 332612 - DNA, 20 bp, Artificial
  CRISPR gRNA sequence
tctctggtccctccccgatt

SEQ ID NO: 332613 - DNA, 20 bp, Artificial
  CRISPR gRNA sequence
ctctggtccctccccgatta

SEQ ID NO: 332614 - DNA, 20 bp, Artificial
  CRISPR gRNA sequence
tctggtccctccccgattag

SEQ ID NO: 332615 - DNA, 20 bp, Artificial
  CRISPR gRNA sequence
tggtccctccccgattagct

SEQ ID NO: 332616 - DNA, 20 bp, Artificial
  CRISPR gRNA sequence
gtccctccccgattagctta

SEQ ID NO: 332617 - DNA, 20 bp, Artificial
  CRISPR gRNA sequence
cccgattagcttaataacta

SEQ ID NO: 332618 - DNA, 20 bp, Artificial
  CRISPR gRNA sequence
gcttaataactaacctcctg

SEQ ID NO: 332619 - DNA, 20 bp, Artificial
  CRISPR gRNA sequence
aataactaacctcctgaatt

SEQ ID NO: 332620 - DNA, 20 bp, Artificial
  CRISPR gRNA sequence
ataactaacctcctgaattc

SEQ ID NO: 332621 - DNA, 20 bp, Artificial
  CRISPR gRNA sequence
acctcctgaattctttttca

SEQ ID NO: 332622 - DNA, 20 bp, Artificial
  CRISPR gRNA sequence
ctgaattctttttcaggtag

SEQ ID NO: 332623 - DNA, 20 bp, Artificial
  CRISPR gRNA sequence
aattctttttcaggtagatg

SEQ ID NO: 332624 - DNA, 20 bp, Artificial
  CRISPR gRNA sequence
tttttcaggtagatgaagaa

SEQ ID NO: 332625 - DNA, 20 bp, Artificial
  CRISPR gRNA sequence
tttcaggtagatgaagaatt

SEQ ID NO: 332626 - DNA, 20 bp, Artificial
  CRISPR gRNA sequence
ttcaggtagatgaagaattt

SEQ ID NO: 332627 - DNA, 20 bp, Artificial
  CRISPR gRNA sequence
tcaggtagatgaagaatttc

SEQ ID NO: 332628 - DNA, 20 bp, Artificial
  CRISPR gRNA sequence
caggtagatgaagaatttct

SEQ ID NO: 332629 - DNA, 20 bp, Artificial
  CRISPR gRNA sequence
aggtagatgaagaatttctt

SEQ ID NO: 332630 - DNA, 20 bp, Artificial
  CRISPR gRNA sequence
cttcttggtttggatccatt

SEQ ID NO: 332631 - DNA, 20 bp, Artificial
  CRISPR gRNA sequence
ttcttggtttggatccattg

SEQ ID NO: 332632 - DNA, 20 bp, Artificial
  CRISPR gRNA sequence
cttggtttggatccattgct

SEQ ID NO: 332633 - DNA, 20 bp, Artificial
  CRISPR gRNA sequence
ttggtttggatccattgctg

SEQ ID NO: 332634 - DNA, 20 bp, Artificial
  CRISPR gRNA sequence
ggtttggatccattgctggt

SEQ ID NO: 332635 - DNA, 20 bp, Artificial
  CRISPR gRNA sequence
gtttggatccattgctggtg

SEQ ID NO: 332636 - DNA, 20 bp, Artificial
  CRISPR gRNA sequence
ggatccattgctggtgaact

SEQ ID NO: 332637 - DNA, 20 bp, Artificial
  CRISPR gRNA sequence
gatccattgctggtgaacta

SEQ ID NO: 332638 - DNA, 20 bp, Artificial
  CRISPR gRNA sequence
ctggtgaactagtgtgattt

SEQ ID NO: 332639 - DNA, 20 bp, Artificial
  CRISPR gRNA sequence
gtgaactagtgtgatttttt

SEQ ID NO: 332640 - DNA, 20 bp, Artificial
  CRISPR gRNA sequence
gtgtgattttttgggggtgt

SEQ ID NO: 332641 - DNA, 20 bp, Artificial
  CRISPR gRNA sequence
tttgggggtgttgaagagcc

SEQ ID NO: 332642 - DNA, 20 bp, Artificial
  CRISPR gRNA sequence
ttgggggtgttgaagagcct

SEQ ID NO: 332643 - DNA, 20 bp, Artificial
  CRISPR gRNA sequence
tgggggtgttgaagagcctt

SEQ ID NO: 332644 - DNA, 20 bp, Artificial
  CRISPR gRNA sequence
gggggtgttgaagagccttg

SEQ ID NO: 332645 - DNA, 20 bp, Artificial
  CRISPR gRNA sequence
ggggtgttgaagagccttgt

SEQ ID NO: 332646 - DNA, 20 bp, Artificial
  CRISPR gRNA sequence
aagagccttgttttgtcata

SEQ ID NO: 332647 - DNA, 20 bp, Artificial
  CRISPR gRNA sequence
gttttgtcatattaccagag

SEQ ID NO: 332648 - DNA, 20 bp, Artificial
  CRISPR gRNA sequence
ttttgtcatattaccagagt

SEQ ID NO: 332649 - DNA, 20 bp, Artificial
  CRISPR gRNA sequence
tgtcatattaccagagttgg

SEQ ID NO: 332650 - DNA, 20 bp, Artificial
  CRISPR gRNA sequence
gtcatattaccagagttggt

SEQ ID NO: 332651 - DNA, 20 bp, Artificial
  CRISPR gRNA sequence
tcatattaccagagttggtt

SEQ ID NO: 332652 - DNA, 20 bp, Artificial
  CRISPR gRNA sequence
ccagagttggttttctggtt

SEQ ID NO: 332653 - DNA, 20 bp, Artificial
  CRISPR gRNA sequence
gttttctggttccttctcat

SEQ ID NO: 332654 - DNA, 20 bp, Artificial
  CRISPR gRNA sequence
tctggttccttctcatttgg

SEQ ID NO: 332655 - DNA, 20 bp, Artificial
  CRISPR gRNA sequence
ctggttccttctcatttggg

SEQ ID NO: 332656 - DNA, 20 bp, Artificial
  CRISPR gRNA sequence
tggttccttctcatttgggt

SEQ ID NO: 332657 - DNA, 20 bp, Artificial
  CRISPR gRNA sequence
gttccttctcatttgggtag

SEQ ID NO: 332658 - DNA, 20 bp, Artificial
  CRISPR gRNA sequence
cttctcatttgggtaggtgc

SEQ ID NO: 332659 - DNA, 20 bp, Artificial
  CRISPR gRNA sequence
ctcatttgggtaggtgctgt

SEQ ID NO: 332660 - DNA, 20 bp, Artificial
  CRISPR gRNA sequence
tcatttgggtaggtgctgtc

SEQ ID NO: 332661 - DNA, 20 bp, Artificial
  CRISPR gRNA sequence
atttgggtaggtgctgtcag

SEQ ID NO: 332662 - DNA, 20 bp, Artificial
  CRISPR gRNA sequence
gggtaggtgctgtcagaggg

SEQ ID NO: 332663 - DNA, 20 bp, Artificial
  CRISPR gRNA sequence
ggtaggtgctgtcagagggg

SEQ ID NO: 332664 - DNA, 20 bp, Artificial
  CRISPR gRNA sequence
tcagaggggaggtctagggc

SEQ ID NO: 332665 - DNA, 20 bp, Artificial
  CRISPR gRNA sequence
gggctgaaggctgttcttca

SEQ ID NO: 332666 - DNA, 20 bp, Artificial
  CRISPR gRNA sequence
aaggctgttcttcagatttt

SEQ ID NO: 332667 - DNA, 20 bp, Artificial
  CRISPR gRNA sequence
ttcttcagattttttttttg

SEQ ID NO: 332668 - DNA, 20 bp, Artificial
  CRISPR gRNA sequence
ttcagattttttttttgtcc

SEQ ID NO: 332669 - DNA, 20 bp, Artificial
  CRISPR gRNA sequence
cagattttttttttgtccca

SEQ ID NO: 332670 - DNA, 20 bp, Artificial
  CRISPR gRNA sequence
agattttttttttgtcccat

SEQ ID NO: 332671 - DNA, 20 bp, Artificial
  CRISPR gRNA sequence
tttttttgtcccatggagtg

SEQ ID NO: 332672 - DNA, 20 bp, Artificial
  CRISPR gRNA sequence
ttttttgtcccatggagtgt

SEQ ID NO: 332673 - DNA, 20 bp, Artificial
  CRISPR gRNA sequence
tttttgtcccatggagtgtt

SEQ ID NO: 332674 - DNA, 20 bp, Artificial
  CRISPR gRNA sequence
ttttgtcccatggagtgttc

SEQ ID NO: 332675 - DNA, 20 bp, Artificial
  CRISPR gRNA sequence
tttgtcccatggagtgttcc

SEQ ID NO: 332676 - DNA, 20 bp, Artificial
  CRISPR gRNA sequence
ttgtcccatggagtgttccc

SEQ ID NO: 332677 - DNA, 20 bp, Artificial
  CRISPR gRNA sequence
tgtcccatggagtgttccct

SEQ ID NO: 332678 - DNA, 20 bp, Artificial
  CRISPR gRNA sequence
gtcccatggagtgttccctt

SEQ ID NO: 332679 - DNA, 20 bp, Artificial
  CRISPR gRNA sequence
tcccatggagtgttcccttg

SEQ ID NO: 332680 - DNA, 20 bp, Artificial
  CRISPR gRNA sequence
ccttgatatcatactttccc

SEQ ID NO: 332681 - DNA, 20 bp, Artificial
  CRISPR gRNA sequence
gatatcatactttccccttt

SEQ ID NO: 332682 - DNA, 20 bp, Artificial
  CRISPR gRNA sequence
atatcatactttcccctttt

SEQ ID NO: 332683 - DNA, 20 bp, Artificial
  CRISPR gRNA sequence
tccccttttcctatgtatgt

SEQ ID NO: 332684 - DNA, 20 bp, Artificial
  CRISPR gRNA sequence
ccccttttcctatgtatgtg

SEQ ID NO: 332685 - DNA, 20 bp, Artificial
  CRISPR gRNA sequence
cccttttcctatgtatgtgg

SEQ ID NO: 332686 - DNA, 20 bp, Artificial
  CRISPR gRNA sequence
ttcctatgtatgtggcttcc

SEQ ID NO: 332687 - DNA, 20 bp, Artificial
  CRISPR gRNA sequence
tcctatgtatgtggcttcca

SEQ ID NO: 332688 - DNA, 20 bp, Artificial
  CRISPR gRNA sequence
cctatgtatgtggcttccag

SEQ ID NO: 332689 - DNA, 20 bp, Artificial
  CRISPR gRNA sequence
ctatgtatgtggcttccagt

SEQ ID NO: 332690 - DNA, 20 bp, Artificial
  CRISPR gRNA sequence
tgtatgtggcttccagtgag

SEQ ID NO: 332691 - DNA, 20 bp, Artificial
  CRISPR gRNA sequence
ccagtgagccaaactgcagt

SEQ ID NO: 332692 - DNA, 20 bp, Artificial
  CRISPR gRNA sequence
cagtgagccaaactgcagtg

SEQ ID NO: 332693 - DNA, 20 bp, Artificial
  CRISPR gRNA sequence
cagtgattgttgtctctctt

SEQ ID NO: 332694 - DNA, 20 bp, Artificial
  CRISPR gRNA sequence
ttgtctctcttctgggtcta

SEQ ID NO: 332695 - DNA, 20 bp, Artificial
  CRISPR gRNA sequence
tctctcttctgggtctagcc

SEQ ID NO: 332696 - DNA, 20 bp, Artificial
  CRISPR gRNA sequence
tcttctgggtctagccaccc

SEQ ID NO: 332697 - DNA, 20 bp, Artificial
  CRISPR gRNA sequence
ttctgggtctagccacccag

SEQ ID NO: 332698 - DNA, 20 bp, Artificial
  CRISPR gRNA sequence
ctgggtctagccacccagca

SEQ ID NO: 332699 - DNA, 20 bp, Artificial
  CRISPR gRNA sequence
tgggtctagccacccagcaa

SEQ ID NO: 332700 - DNA, 20 bp, Artificial
  CRISPR gRNA sequence
ggtctagccacccagcaaat

SEQ ID NO: 332701 - DNA, 20 bp, Artificial
  CRISPR gRNA sequence
gccacccagcaaatctaccc

SEQ ID NO: 332702 - DNA, 20 bp, Artificial
  CRISPR gRNA sequence
cccggctctgggctggtatt

SEQ ID NO: 332703 - DNA, 20 bp, Artificial
  CRISPR gRNA sequence
tgggctggtattgggggttg

SEQ ID NO: 332704 - DNA, 20 bp, Artificial
  CRISPR gRNA sequence
ggctggtattgggggttgtc

SEQ ID NO: 332705 - DNA, 20 bp, Artificial
  CRISPR gRNA sequence
gtattgggggttgtctgcac

SEQ ID NO: 332706 - DNA, 20 bp, Artificial
  CRISPR gRNA sequence
ggggttgtctgcacagattc

SEQ ID NO: 332707 - DNA, 20 bp, Artificial
  CRISPR gRNA sequence
tctgcacagattcctgtgat

SEQ ID NO: 332708 - DNA, 20 bp, Artificial
  CRISPR gRNA sequence
cacagattcctgtgatgtga

SEQ ID NO: 332709 - DNA, 20 bp, Artificial
  CRISPR gRNA sequence
ctgtgatgtgaaccatctat

SEQ ID NO: 332710 - DNA, 20 bp, Artificial
  CRISPR gRNA sequence
tgatgtgaaccatctatggg

SEQ ID NO: 332711 - DNA, 20 bp, Artificial
  CRISPR gRNA sequence
tgggtctctcagccatggat

SEQ ID NO: 332712 - DNA, 20 bp, Artificial
  CRISPR gRNA sequence
tcagccatggataccagtgc

SEQ ID NO: 332713 - DNA, 20 bp, Artificial
  CRISPR gRNA sequence
agccatggataccagtgctg

SEQ ID NO: 332714 - DNA, 20 bp, Artificial
  CRISPR gRNA sequence
ttctggtggaggtggcgaag

SEQ ID NO: 332715 - DNA, 20 bp, Artificial
  CRISPR gRNA sequence
tggtggaggtggcgaagggt

SEQ ID NO: 332716 - DNA, 20 bp, Artificial
  CRISPR gRNA sequence
gtggaggtggcgaagggtgc

SEQ ID NO: 332717 - DNA, 20 bp, Artificial
  CRISPR gRNA sequence
catgagggcctttagctttg

SEQ ID NO: 332718 - DNA, 20 bp, Artificial
  CRISPR gRNA sequence
tagctttggtggtttaatgc

SEQ ID NO: 332719 - DNA, 20 bp, Artificial
  CRISPR gRNA sequence
agctttggtggtttaatgct

SEQ ID NO: 332720 - DNA, 20 bp, Artificial
  CRISPR gRNA sequence
gctttggtggtttaatgctc

SEQ ID NO: 332721 - DNA, 20 bp, Artificial
  CRISPR gRNA sequence
tggtggtttaatgctctatt

SEQ ID NO: 332722 - DNA, 20 bp, Artificial
  CRISPR gRNA sequence
ggtggtttaatgctctattt

SEQ ID NO: 332723 - DNA, 20 bp, Artificial
  CRISPR gRNA sequence
gtggtttaatgctctatttt

SEQ ID NO: 332724 - DNA, 20 bp, Artificial
  CRISPR gRNA sequence
aatgctctatttttgtgctg

SEQ ID NO: 332725 - DNA, 20 bp, Artificial
  CRISPR gRNA sequence
atgctctatttttgtgctgg

SEQ ID NO: 332726 - DNA, 20 bp, Artificial
  CRISPR gRNA sequence
tatttttgtgctggttggcc

SEQ ID NO: 332727 - DNA, 20 bp, Artificial
  CRISPR gRNA sequence
tttttgtgctggttggcctc

SEQ ID NO: 332728 - DNA, 20 bp, Artificial
  CRISPR gRNA sequence
ttgtgctggttggcctcctg

SEQ ID NO: 332729 - DNA, 20 bp, Artificial
  CRISPR gRNA sequence
tgtgctggttggcctcctgc

SEQ ID NO: 332730 - DNA, 20 bp, Artificial
  CRISPR gRNA sequence
gtgctggttggcctcctgcc

SEQ ID NO: 332731 - DNA, 20 bp, Artificial
  CRISPR gRNA sequence
tgctggttggcctcctgcca

SEQ ID NO: 332732 - DNA, 20 bp, Artificial
  CRISPR gRNA sequence
gttggcctcctgccaggagg

SEQ ID NO: 332733 - DNA, 20 bp, Artificial
  CRISPR gRNA sequence
gcctcctgccaggaggtggc

SEQ ID NO: 332734 - DNA, 20 bp, Artificial
  CRISPR gRNA sequence
ctgccaggaggtggcgcttt

SEQ ID NO: 332735 - DNA, 20 bp, Artificial
  CRISPR gRNA sequence
ccaggaggtggcgctttcca

SEQ ID NO: 332736 - DNA, 20 bp, Artificial
  CRISPR gRNA sequence
tccagaaagcatcagctgta

SEQ ID NO: 332737 - DNA, 20 bp, Artificial
  CRISPR gRNA sequence
ccagaaagcatcagctgtaa

SEQ ID NO: 332738 - DNA, 20 bp, Artificial
  CRISPR gRNA sequence
cagaaagcatcagctgtaat

SEQ ID NO: 332739 - DNA, 20 bp, Artificial
  CRISPR gRNA sequence
taatagtatagagagggtct

SEQ ID NO: 332740 - DNA, 20 bp, Artificial
  CRISPR gRNA sequence
gtggtgggtggggccctaga

SEQ ID NO: 332741 - DNA, 20 bp, Artificial
  CRISPR gRNA sequence
gaactcccaggattatatgc

SEQ ID NO: 332742 - DNA, 20 bp, Artificial
  CRISPR gRNA sequence
ccaggattatatgccctttg

SEQ ID NO: 332743 - DNA, 20 bp, Artificial
  CRISPR gRNA sequence
tatgccctttgtgttctgct

SEQ ID NO: 332744 - DNA, 20 bp, Artificial
  CRISPR gRNA sequence
tgtgttctgctaaccagggt

SEQ ID NO: 332745 - DNA, 20 bp, Artificial
  CRISPR gRNA sequence
gtgttctgctaaccagggtg

SEQ ID NO: 332746 - DNA, 20 bp, Artificial
  CRISPR gRNA sequence
tgttctgctaaccagggtgg

SEQ ID NO: 332747 - DNA, 20 bp, Artificial
  CRISPR gRNA sequence
tgctaaccagggtgggtagg

SEQ ID NO: 332748 - DNA, 20 bp, Artificial
  CRISPR gRNA sequence
ctaaccagggtgggtaggga

SEQ ID NO: 332749 - DNA, 20 bp, Artificial
  CRISPR gRNA sequence
accagggtgggtagggaagg

SEQ ID NO: 332750 - DNA, 20 bp, Artificial
  CRISPR gRNA sequence
ggcatgtctgagctcagact

SEQ ID NO: 332751 - DNA, 20 bp, Artificial
  CRISPR gRNA sequence
agctcagactctccttgggc

SEQ ID NO: 332752 - DNA, 20 bp, Artificial
  CRISPR gRNA sequence
agactctccttgggcaggtc

SEQ ID NO: 332753 - DNA, 20 bp, Artificial
  CRISPR gRNA sequence
tccttgggcaggtcttgctg

SEQ ID NO: 332754 - DNA, 20 bp, Artificial
  CRISPR gRNA sequence
cttgggcaggtcttgctgtg

SEQ ID NO: 332755 - DNA, 20 bp, Artificial
  CRISPR gRNA sequence
gggcaggtcttgctgtggct

SEQ ID NO: 332756 - DNA, 20 bp, Artificial
  CRISPR gRNA sequence
ggcaggtcttgctgtggctg

SEQ ID NO: 332757 - DNA, 20 bp, Artificial
  CRISPR gRNA sequence
gctgtggctgctgtggggga

SEQ ID NO: 332758 - DNA, 20 bp, Artificial
  CRISPR gRNA sequence
ctgtggctgctgtgggggat

SEQ ID NO: 332759 - DNA, 20 bp, Artificial
  CRISPR gRNA sequence
tggctgctgtgggggatgtg

SEQ ID NO: 332760 - DNA, 20 bp, Artificial
  CRISPR gRNA sequence
ctgtgggggatgtgggtgag

SEQ ID NO: 332761 - DNA, 20 bp, Artificial
  CRISPR gRNA sequence
tgggggatgtgggtgagatt

SEQ ID NO: 332762 - DNA, 20 bp, Artificial
  CRISPR gRNA sequence
ccaggtcactggagttgtgt

SEQ ID NO: 332763 - DNA, 20 bp, Artificial
  CRISPR gRNA sequence
gagttgtgtacctaggagga

SEQ ID NO: 332764 - DNA, 20 bp, Artificial
  CRISPR gRNA sequence
tgtacctaggaggattatgg

SEQ ID NO: 332765 - DNA, 20 bp, Artificial
  CRISPR gRNA sequence
ggaggattatggctgcctct

SEQ ID NO: 332766 - DNA, 20 bp, Artificial
  CRISPR gRNA sequence
tggctgcctctgctgagtca

SEQ ID NO: 332767 - DNA, 20 bp, Artificial
  CRISPR gRNA sequence
cctctgctgagtcatgcagg

SEQ ID NO: 332768 - DNA, 20 bp, Artificial
  CRISPR gRNA sequence
tgctgagtcatgcaggttgt

SEQ ID NO: 332769 - DNA, 20 bp, Artificial
  CRISPR gRNA sequence
ctgagtcatgcaggttgtca

SEQ ID NO: 332770 - DNA, 20 bp, Artificial
  CRISPR gRNA sequence
agtcatgcaggttgtcaggg

SEQ ID NO: 332771 - DNA, 20 bp, Artificial
  CRISPR gRNA sequence
tcagggaagtgggggaaaac

SEQ ID NO: 332772 - DNA, 20 bp, Artificial
  CRISPR gRNA sequence
atccagatcccatgcaaacg

SEQ ID NO: 332773 - DNA, 20 bp, Artificial
  CRISPR gRNA sequence
gtctcactctaatcatgcct

SEQ ID NO: 332774 - DNA, 20 bp, Artificial
  CRISPR gRNA sequence
actctaatcatgcctcctct

SEQ ID NO: 332775 - DNA, 20 bp, Artificial
  CRISPR gRNA sequence
taatcatgcctcctctaacc

SEQ ID NO: 332776 - DNA, 20 bp, Artificial
  CRISPR gRNA sequence
atcatgcctcctctaaccgc

SEQ ID NO: 332777 - DNA, 20 bp, Artificial
  CRISPR gRNA sequence
ctctaaccgccccaagtctg

SEQ ID NO: 332778 - DNA, 20 bp, Artificial
  CRISPR gRNA sequence
taaccgccccaagtctgttt

SEQ ID NO: 332779 - DNA, 20 bp, Artificial
  CRISPR gRNA sequence
accgccccaagtctgtttcc

SEQ ID NO: 332780 - DNA, 20 bp, Artificial
  CRISPR gRNA sequence
tttccaggcaaagggcaaga

SEQ ID NO: 332781 - DNA, 20 bp, Artificial
  CRISPR gRNA sequence
ccaggcaaagggcaagactg

SEQ ID NO: 332782 - DNA, 20 bp, Artificial
  CRISPR gRNA sequence
caggcaaagggcaagactgg

SEQ ID NO: 332783 - DNA, 20 bp, Artificial
  CRISPR gRNA sequence
gcttgaaaacttgcctgagg

SEQ ID NO: 332784 - DNA, 20 bp, Artificial
  CRISPR gRNA sequence
gaaaacttgcctgaggcttt

SEQ ID NO: 332785 - DNA, 20 bp, Artificial
  CRISPR gRNA sequence
aaaacttgcctgaggctttc

SEQ ID NO: 332786 - DNA, 20 bp, Artificial
  CRISPR gRNA sequence
gcctgaggctttctgcctcc

SEQ ID NO: 332787 - DNA, 20 bp, Artificial
  CRISPR gRNA sequence
cctgaggctttctgcctccc

SEQ ID NO: 332788 - DNA, 20 bp, Artificial
  CRISPR gRNA sequence
aggctttctgcctcccagct

SEQ ID NO: 332789 - DNA, 20 bp, Artificial
  CRISPR gRNA sequence
tctgcctcccagctgtgaaa

SEQ ID NO: 332790 - DNA, 20 bp, Artificial
  CRISPR gRNA sequence
ctgcctcccagctgtgaaag

SEQ ID NO: 332791 - DNA, 20 bp, Artificial
  CRISPR gRNA sequence
tgcctcccagctgtgaaaga

SEQ ID NO: 332792 - DNA, 20 bp, Artificial
  CRISPR gRNA sequence
cctcccagctgtgaaagaaa

SEQ ID NO: 332793 - DNA, 20 bp, Artificial
  CRISPR gRNA sequence
ccagctgtgaaagaaaaggg

SEQ ID NO: 332794 - DNA, 20 bp, Artificial
  CRISPR gRNA sequence
tgaaagaaaagggctttagt

SEQ ID NO: 332795 - DNA, 20 bp, Artificial
  CRISPR gRNA sequence
tagtttttcccctgcatgtg

SEQ ID NO: 332796 - DNA, 20 bp, Artificial
  CRISPR gRNA sequence
agtttttcccctgcatgtga

SEQ ID NO: 332797 - DNA, 20 bp, Artificial
  CRISPR gRNA sequence
gtttttcccctgcatgtgaa

SEQ ID NO: 332798 - DNA, 20 bp, Artificial
  CRISPR gRNA sequence
ttcccctgcatgtgaaatct

SEQ ID NO: 332799 - DNA, 20 bp, Artificial
  CRISPR gRNA sequence
tcccctgcatgtgaaatctg

SEQ ID NO: 332800 - DNA, 20 bp, Artificial
  CRISPR gRNA sequence
cccctgcatgtgaaatctgc

SEQ ID NO: 332801 - DNA, 20 bp, Artificial
  CRISPR gRNA sequence
ccctgcatgtgaaatctgca

SEQ ID NO: 332802 - DNA, 20 bp, Artificial
  CRISPR gRNA sequence
catgtgaaatctgcatgctg

SEQ ID NO: 332803 - DNA, 20 bp, Artificial
  CRISPR gRNA sequence
catgctggattcacggcctc

SEQ ID NO: 332804 - DNA, 20 bp, Artificial
  CRISPR gRNA sequence
gattcacggcctccccccag

SEQ ID NO: 332805 - DNA, 20 bp, Artificial
  CRISPR gRNA sequence
acggcctccccccagttcag

SEQ ID NO: 332806 - DNA, 20 bp, Artificial
  CRISPR gRNA sequence
cccccagttcaggccaggag

SEQ ID NO: 332807 - DNA, 20 bp, Artificial
  CRISPR gRNA sequence
aggccaggagacttcttgcc

SEQ ID NO: 332808 - DNA, 20 bp, Artificial
  CRISPR gRNA sequence
cttgccctgttcaaatagtt

SEQ ID NO: 332809 - DNA, 20 bp, Artificial
  CRISPR gRNA sequence
ttgccctgttcaaatagtta

SEQ ID NO: 332810 - DNA, 20 bp, Artificial
  CRISPR gRNA sequence
gccctgttcaaatagttaca

SEQ ID NO: 332811 - DNA, 20 bp, Artificial
  CRISPR gRNA sequence
ccctgttcaaatagttacaa

SEQ ID NO: 332812 - DNA, 20 bp, Artificial
  CRISPR gRNA sequence
ttcaaatagttacaaagttc

SEQ ID NO: 332813 - DNA, 20 bp, Artificial
  CRISPR gRNA sequence
aaatagttacaaagttcagc

SEQ ID NO: 332814 - DNA, 20 bp, Artificial
  CRISPR gRNA sequence
caaagttcagctagagaatt

SEQ ID NO: 332815 - DNA, 20 bp, Artificial
  CRISPR gRNA sequence
agctagagaattccttctcc

SEQ ID NO: 332816 - DNA, 20 bp, Artificial
  CRISPR gRNA sequence
gagaattccttctccctgtg

SEQ ID NO: 332817 - DNA, 20 bp, Artificial
  CRISPR gRNA sequence
cttctccctgtggagtttta

SEQ ID NO: 332818 - DNA, 20 bp, Artificial
  CRISPR gRNA sequence
ctccctgtggagttttatac

SEQ ID NO: 332819 - DNA, 20 bp, Artificial
  CRISPR gRNA sequence
tccctgtggagttttatacc

SEQ ID NO: 332820 - DNA, 20 bp, Artificial
  CRISPR gRNA sequence
cctgtggagttttataccct

SEQ ID NO: 332821 - DNA, 20 bp, Artificial
  CRISPR gRNA sequence
tggagttttataccctgctc

SEQ ID NO: 332822 - DNA, 20 bp, Artificial
  CRISPR gRNA sequence
tataccctgctcctctggcc

SEQ ID NO: 332823 - DNA, 20 bp, Artificial
  CRISPR gRNA sequence
ataccctgctcctctggcca

SEQ ID NO: 332824 - DNA, 20 bp, Artificial
  CRISPR gRNA sequence
taccctgctcctctggccac

SEQ ID NO: 332825 - DNA, 20 bp, Artificial
  CRISPR gRNA sequence
ctcctctggccaccctccag

SEQ ID NO: 332826 - DNA, 20 bp, Artificial
  CRISPR gRNA sequence
ctctggccaccctccagatg

SEQ ID NO: 332827 - DNA, 20 bp, Artificial
  CRISPR gRNA sequence
tggccaccctccagatggat

SEQ ID NO: 332828 - DNA, 20 bp, Artificial
  CRISPR gRNA sequence
gccaccctccagatggatcc

SEQ ID NO: 332829 - DNA, 20 bp, Artificial
  CRISPR gRNA sequence
cagatggatccctgtggtgc

SEQ ID NO: 332830 - DNA, 20 bp, Artificial
  CRISPR gRNA sequence
tggtgcctggcaagaatggg

SEQ ID NO: 332831 - DNA, 20 bp, Artificial
  CRISPR gRNA sequence
gcaagaatgggctgcttggg

SEQ ID NO: 332832 - DNA, 20 bp, Artificial
  CRISPR gRNA sequence
cttggggacccattgagctc

SEQ ID NO: 332833 - DNA, 20 bp, Artificial
  CRISPR gRNA sequence
ggggacccattgagctccca

SEQ ID NO: 332834 - DNA, 20 bp, Artificial
  CRISPR gRNA sequence
gggacccattgagctcccag

SEQ ID NO: 332835 - DNA, 20 bp, Artificial
  CRISPR gRNA sequence
agctcccagagcctttctgc

SEQ ID NO: 332836 - DNA, 20 bp, Artificial
  CRISPR gRNA sequence
ccagagcctttctgcagctt

SEQ ID NO: 332837 - DNA, 20 bp, Artificial
  CRISPR gRNA sequence
tctgcagcttcctctacccc

SEQ ID NO: 332838 - DNA, 20 bp, Artificial
  CRISPR gRNA sequence
ctgcagcttcctctacccct

SEQ ID NO: 332839 - DNA, 20 bp, Artificial
  CRISPR gRNA sequence
tgcagcttcctctacccctg

SEQ ID NO: 332840 - DNA, 20 bp, Artificial
  CRISPR gRNA sequence
cagcttcctctacccctgta

SEQ ID NO: 332841 - DNA, 20 bp, Artificial
  CRISPR gRNA sequence
cctctacccctgtattttgc

SEQ ID NO: 332842 - DNA, 20 bp, Artificial
  CRISPR gRNA sequence
ctctacccctgtattttgct

SEQ ID NO: 332843 - DNA, 20 bp, Artificial
  CRISPR gRNA sequence
tacccctgtattttgctccg

SEQ ID NO: 332844 - DNA, 20 bp, Artificial
  CRISPR gRNA sequence
cccctgtattttgctccgtt

SEQ ID NO: 332845 - DNA, 20 bp, Artificial
  CRISPR gRNA sequence
tattttgctccgtttggctc

SEQ ID NO: 332846 - DNA, 20 bp, Artificial
  CRISPR gRNA sequence
tgctccgtttggctctctaa

SEQ ID NO: 332847 - DNA, 20 bp, Artificial
  CRISPR gRNA sequence
gctccgtttggctctctaac

SEQ ID NO: 332848 - DNA, 20 bp, Artificial
  CRISPR gRNA sequence
ctccgtttggctctctaact

SEQ ID NO: 332849 - DNA, 20 bp, Artificial
  CRISPR gRNA sequence
cgtttggctctctaacttga

SEQ ID NO: 332850 - DNA, 20 bp, Artificial
  CRISPR gRNA sequence
ggctctctaacttgactcac

SEQ ID NO: 332851 - DNA, 20 bp, Artificial
  CRISPR gRNA sequence
gctctctaacttgactcacc

SEQ ID NO: 332852 - DNA, 20 bp, Artificial
  CRISPR gRNA sequence
tctaacttgactcacctcca

SEQ ID NO: 332853 - DNA, 20 bp, Artificial
  CRISPR gRNA sequence
taacttgactcacctccaga

SEQ ID NO: 332854 - DNA, 20 bp, Artificial
  CRISPR gRNA sequence
acttgactcacctccagata

SEQ ID NO: 332855 - DNA, 20 bp, Artificial
  CRISPR gRNA sequence
gactcacctccagataaagt

SEQ ID NO: 332856 - DNA, 20 bp, Artificial
  CRISPR gRNA sequence
actcacctccagataaagtc

SEQ ID NO: 332857 - DNA, 20 bp, Artificial
  CRISPR gRNA sequence
acctccagataaagtcggaa

SEQ ID NO: 332858 - DNA, 20 bp, Artificial
  CRISPR gRNA sequence
cagataaagtcggaaacttc

SEQ ID NO: 332859 - DNA, 20 bp, Artificial
  CRISPR gRNA sequence
ctccacaaacagacgctcag

SEQ ID NO: 332860 - DNA, 20 bp, Artificial
  CRISPR gRNA sequence
tccacaaacagacgctcagc

SEQ ID NO: 332861 - DNA, 20 bp, Artificial
  CRISPR gRNA sequence
cacaaacagacgctcagctt

SEQ ID NO: 332862 - DNA, 20 bp, Artificial
  CRISPR gRNA sequence
agcttctccggtcagagtgt

SEQ ID NO: 332863 - DNA, 20 bp, Artificial
  CRISPR gRNA sequence
ctccggtcagagtgtgtgtt

SEQ ID NO: 332864 - DNA, 20 bp, Artificial
  CRISPR gRNA sequence
tccggtcagagtgtgtgttt

SEQ ID NO: 332865 - DNA, 20 bp, Artificial
  CRISPR gRNA sequence
cggtcagagtgtgtgtttgg

SEQ ID NO: 332866 - DNA, 20 bp, Artificial
  CRISPR gRNA sequence
gggagaggagggtctccctt

SEQ ID NO: 332867 - DNA, 20 bp, Artificial
  CRISPR gRNA sequence
ggagaggagggtctcccttt

SEQ ID NO: 332868 - DNA, 20 bp, Artificial
  CRISPR gRNA sequence
cctttcccgtgagtcttttc

SEQ ID NO: 332869 - DNA, 20 bp, Artificial
  CRISPR gRNA sequence
tcccgtgagtcttttctttt

SEQ ID NO: 332870 - DNA, 20 bp, Artificial
  CRISPR gRNA sequence
cccgtgagtcttttcttttt

SEQ ID NO: 332871 - DNA, 20 bp, Artificial
  CRISPR gRNA sequence
ccgtgagtcttttctttttg

SEQ ID NO: 332872 - DNA, 20 bp, Artificial
  CRISPR gRNA sequence
ttctttttgactgggaaata

SEQ ID NO: 332873 - DNA, 20 bp, Artificial
  CRISPR gRNA sequence
tctttttgactgggaaataa

SEQ ID NO: 332874 - DNA, 20 bp, Artificial
  CRISPR gRNA sequence
ctttttgactgggaaataag

SEQ ID NO: 332875 - DNA, 20 bp, Artificial
  CRISPR gRNA sequence
tttttgactgggaaataagt

SEQ ID NO: 332876 - DNA, 20 bp, Artificial
  CRISPR gRNA sequence
tttgactgggaaataagtat

SEQ ID NO: 332877 - DNA, 20 bp, Artificial
  CRISPR gRNA sequence
ttgactgggaaataagtatc

SEQ ID NO: 332878 - DNA, 20 bp, Artificial
  CRISPR gRNA sequence
tgactgggaaataagtatct

SEQ ID NO: 332879 - DNA, 20 bp, Artificial
  CRISPR gRNA sequence
gactgggaaataagtatctc

SEQ ID NO: 332880 - DNA, 20 bp, Artificial
  CRISPR gRNA sequence
actgggaaataagtatctcc

SEQ ID NO: 332881 - DNA, 20 bp, Artificial
  CRISPR gRNA sequence
ggaaataagtatctcccaat

SEQ ID NO: 332882 - DNA, 20 bp, Artificial
  CRISPR gRNA sequence
ccaatcttcagtaaatagga

SEQ ID NO: 332883 - DNA, 20 bp, Artificial
  CRISPR gRNA sequence
cagtaaataggatctttgct

SEQ ID NO: 332884 - DNA, 20 bp, Artificial
  CRISPR gRNA sequence
agtaaataggatctttgctc

SEQ ID NO: 332885 - DNA, 20 bp, Artificial
  CRISPR gRNA sequence
tgctctccttttcccactcc

SEQ ID NO: 332886 - DNA, 20 bp, Artificial
  CRISPR gRNA sequence
gctctccttttcccactcct

SEQ ID NO: 332887 - DNA, 20 bp, Artificial
  CRISPR gRNA sequence
ctctccttttcccactcctc

SEQ ID NO: 332888 - DNA, 20 bp, Artificial
  CRISPR gRNA sequence
tccttttcccactcctcttc

SEQ ID NO: 332889 - DNA, 20 bp, Artificial
  CRISPR gRNA sequence
cttttcccactcctcttctt

SEQ ID NO: 332890 - DNA, 20 bp, Artificial
  CRISPR gRNA sequence
ttcccactcctcttcttggc

SEQ ID NO: 332891 - DNA, 20 bp, Artificial
  CRISPR gRNA sequence
tcccactcctcttcttggcc

SEQ ID NO: 332892 - DNA, 20 bp, Artificial
  CRISPR gRNA sequence
cccactcctcttcttggccc

SEQ ID NO: 332893 - DNA, 20 bp, Artificial
  CRISPR gRNA sequence
ccactcctcttcttggccca

SEQ ID NO: 332894 - DNA, 20 bp, Artificial
  CRISPR gRNA sequence
ctcttcttggcccattacaa

SEQ ID NO: 332895 - DNA, 20 bp, Artificial
  CRISPR gRNA sequence
ttcttggcccattacaaaga

SEQ ID NO: 332896 - DNA, 20 bp, Artificial
  CRISPR gRNA sequence
cttggcccattacaaagata

SEQ ID NO: 332897 - DNA, 20 bp, Artificial
  CRISPR gRNA sequence
ttggcccattacaaagatat

SEQ ID NO: 332898 - DNA, 20 bp, Artificial
  CRISPR gRNA sequence
ggcccattacaaagatattt

SEQ ID NO: 332899 - DNA, 20 bp, Artificial
  CRISPR gRNA sequence
gcccattacaaagatattta

SEQ ID NO: 332900 - DNA, 20 bp, Artificial
  CRISPR gRNA sequence
caaagatatttaccaaacat

SEQ ID NO: 332901 - DNA, 20 bp, Artificial
  CRISPR gRNA sequence
accaaacatgcttagccttt

SEQ ID NO: 332902 - DNA, 20 bp, Artificial
  CRISPR gRNA sequence
ccaaacatgcttagccttta

SEQ ID NO: 332903 - DNA, 20 bp, Artificial
  CRISPR gRNA sequence
agcctttatattcttctgtt

SEQ ID NO: 332904 - DNA, 20 bp, Artificial
  CRISPR gRNA sequence
gcctttatattcttctgtta

SEQ ID NO: 332905 - DNA, 20 bp, Artificial
  CRISPR gRNA sequence
tatattcttctgttaatatt

SEQ ID NO: 332906 - DNA, 20 bp, Artificial
  CRISPR gRNA sequence
atattcttctgttaatatta

SEQ ID NO: 332907 - DNA, 20 bp, Artificial
  CRISPR gRNA sequence
tattcttctgttaatattaa

SEQ ID NO: 332908 - DNA, 20 bp, Artificial
  CRISPR gRNA sequence
ttctgttaatattaattctt

SEQ ID NO: 332909 - DNA, 20 bp, Artificial
  CRISPR gRNA sequence
ctgttaatattaattctttt

SEQ ID NO: 332910 - DNA, 20 bp, Artificial
  CRISPR gRNA sequence
tgttaatattaattctttta

SEQ ID NO: 332911 - DNA, 20 bp, Artificial
  CRISPR gRNA sequence
ttaatattaattcttttatt

SEQ ID NO: 332912 - DNA, 20 bp, Artificial
  CRISPR gRNA sequence
atattaattcttttatttaa

SEQ ID NO: 332913 - DNA, 20 bp, Artificial
  CRISPR gRNA sequence
attcttttatttaatatgat

SEQ ID NO: 332914 - DNA, 20 bp, Artificial
  CRISPR gRNA sequence
ttttatttaatatgattgag

SEQ ID NO: 332915 - DNA, 20 bp, Artificial
  CRISPR gRNA sequence
ttatttaatatgattgagct

SEQ ID NO: 332916 - DNA, 20 bp, Artificial
  CRISPR gRNA sequence
tatttaatatgattgagctt

SEQ ID NO: 332917 - DNA, 20 bp, Artificial
  CRISPR gRNA sequence
atttaatatgattgagcttc

SEQ ID NO: 332918 - DNA, 20 bp, Artificial
  CRISPR gRNA sequence
tttaatatgattgagcttcc

SEQ ID NO: 332919 - DNA, 20 bp, Artificial
  CRISPR gRNA sequence
aatatgattgagcttccact

SEQ ID NO: 332920 - DNA, 20 bp, Artificial
  CRISPR gRNA sequence
atatgattgagcttccacta

SEQ ID NO: 332921 - DNA, 20 bp, Artificial
  CRISPR gRNA sequence
agcttccactatgttcaagg

SEQ ID NO: 332922 - DNA, 20 bp, Artificial
  CRISPR gRNA sequence
ccactatgttcaaggtcctg

SEQ ID NO: 332923 - DNA, 20 bp, Artificial
  CRISPR gRNA sequence
cactatgttcaaggtcctgg

SEQ ID NO: 332924 - DNA, 20 bp, Artificial
  CRISPR gRNA sequence
tgttcaaggtcctgggattt

SEQ ID NO: 332925 - DNA, 20 bp, Artificial
  CRISPR gRNA sequence
aaggtcctgggattttttag

SEQ ID NO: 332926 - DNA, 20 bp, Artificial
  CRISPR gRNA sequence
ggattttttaggcaactgta

SEQ ID NO: 332927 - DNA, 20 bp, Artificial
  CRISPR gRNA sequence
tttaggcaactgtaatgcag

SEQ ID NO: 332928 - DNA, 20 bp, Artificial
  CRISPR gRNA sequence
ttaggcaactgtaatgcagt

SEQ ID NO: 332929 - DNA, 20 bp, Artificial
  CRISPR gRNA sequence
taggcaactgtaatgcagtc

SEQ ID NO: 332930 - DNA, 20 bp, Artificial
  CRISPR gRNA sequence
aggcaactgtaatgcagtcc

SEQ ID NO: 332931 - DNA, 20 bp, Artificial
  CRISPR gRNA sequence
ggcaactgtaatgcagtcct

SEQ ID NO: 332932 - DNA, 20 bp, Artificial
  CRISPR gRNA sequence
taatgcagtccttatctttg

SEQ ID NO: 332933 - DNA, 20 bp, Artificial
  CRISPR gRNA sequence
atctttgtggagctcatggt

SEQ ID NO: 332934 - DNA, 20 bp, Artificial
  CRISPR gRNA sequence
tctttgtggagctcatggtt

SEQ ID NO: 332935 - DNA, 20 bp, Artificial
  CRISPR gRNA sequence
tgtggagctcatggttaaat

SEQ ID NO: 332936 - DNA, 20 bp, Artificial
  CRISPR gRNA sequence
gtggagctcatggttaaatg

SEQ ID NO: 332937 - DNA, 20 bp, Artificial
  CRISPR gRNA sequence
tggagctcatggttaaatga

SEQ ID NO: 332938 - DNA, 20 bp, Artificial
  CRISPR gRNA sequence
atggttaaatgaggaagaca

SEQ ID NO: 332939 - DNA, 20 bp, Artificial
  CRISPR gRNA sequence
aatgaggaagacagacaaaa

SEQ ID NO: 332940 - DNA, 20 bp, Artificial
  CRISPR gRNA sequence
tgatccaagatgctatgtgc

SEQ ID NO: 332941 - DNA, 20 bp, Artificial
  CRISPR gRNA sequence
tgtgctaaaatatactggcc

SEQ ID NO: 332942 - DNA, 20 bp, Artificial
  CRISPR gRNA sequence
aaatatactggcctaaacaa

SEQ ID NO: 332943 - DNA, 20 bp, Artificial
  CRISPR gRNA sequence
gcctaaacaaagtattattg

SEQ ID NO: 332944 - DNA, 20 bp, Artificial
  CRISPR gRNA sequence
aacaaagtattattgggagc

SEQ ID NO: 332945 - DNA, 20 bp, Artificial
  CRISPR gRNA sequence
ttgggagcatagaaataaga

SEQ ID NO: 332946 - DNA, 20 bp, Artificial
  CRISPR gRNA sequence
ggagcatagaaataagagtc

SEQ ID NO: 332947 - DNA, 20 bp, Artificial
  CRISPR gRNA sequence
tgtctggtggtcttggaaat

SEQ ID NO: 332948 - DNA, 20 bp, Artificial
  CRISPR gRNA sequence
gtctggtggtcttggaaata

SEQ ID NO: 332949 - DNA, 20 bp, Artificial
  CRISPR gRNA sequence
tctggtggtcttggaaataa

SEQ ID NO: 332950 - DNA, 20 bp, Artificial
  CRISPR gRNA sequence
gtggtcttggaaataaatat

SEQ ID NO: 332951 - DNA, 20 bp, Artificial
  CRISPR gRNA sequence
ggaaataaatatctcaagag

SEQ ID NO: 332952 - DNA, 20 bp, Artificial
  CRISPR gRNA sequence
gaaataaatatctcaagaga

SEQ ID NO: 332953 - DNA, 20 bp, Artificial
  CRISPR gRNA sequence
aagagagaagttgacattta

SEQ ID NO: 332954 - DNA, 20 bp, Artificial
  CRISPR gRNA sequence
acatttaaaatggttcttga

SEQ ID NO: 332955 - DNA, 20 bp, Artificial
  CRISPR gRNA sequence
aaaatggttcttgaagagtg

SEQ ID NO: 332956 - DNA, 20 bp, Artificial
  CRISPR gRNA sequence
aaatggttcttgaagagtga

SEQ ID NO: 332957 - DNA, 20 bp, Artificial
  CRISPR gRNA sequence
ttgaagagtgaatgagaatt

SEQ ID NO: 332958 - DNA, 20 bp, Artificial
  CRISPR gRNA sequence
gaagagtgaatgagaatttc

SEQ ID NO: 332959 - DNA, 20 bp, Artificial
  CRISPR gRNA sequence
aagagtgaatgagaatttct

SEQ ID NO: 332960 - DNA, 20 bp, Artificial
  CRISPR gRNA sequence
cttctcagattaaggggtaa

SEQ ID NO: 332961 - DNA, 20 bp, Artificial
  CRISPR gRNA sequence
ttctcagattaaggggtaat

SEQ ID NO: 332962 - DNA, 20 bp, Artificial
  CRISPR gRNA sequence
ctcagattaaggggtaatca

SEQ ID NO: 332963 - DNA, 20 bp, Artificial
  CRISPR gRNA sequence
tcagattaaggggtaatcaa

SEQ ID NO: 332964 - DNA, 20 bp, Artificial
  CRISPR gRNA sequence
agattaaggggtaatcaaat

SEQ ID NO: 332965 - DNA, 20 bp, Artificial
  CRISPR gRNA sequence
aggggtaatcaaatatttta

SEQ ID NO: 332966 - DNA, 20 bp, Artificial
  CRISPR gRNA sequence
tagttcatggtaacagaaat

SEQ ID NO: 332967 - DNA, 20 bp, Artificial
  CRISPR gRNA sequence
agttcatggtaacagaaata

SEQ ID NO: 332968 - DNA, 20 bp, Artificial
  CRISPR gRNA sequence
gttcatggtaacagaaataa

SEQ ID NO: 332969 - DNA, 20 bp, Artificial
  CRISPR gRNA sequence
atggtaacagaaataatgaa

SEQ ID NO: 332970 - DNA, 20 bp, Artificial
  CRISPR gRNA sequence
tagtagtaaagaacagaagt

SEQ ID NO: 332971 - DNA, 20 bp, Artificial
  CRISPR gRNA sequence
gtagtaaagaacagaagtgt

SEQ ID NO: 332972 - DNA, 20 bp, Artificial
  CRISPR gRNA sequence
agtgtggcttcaatagatgg

SEQ ID NO: 332973 - DNA, 20 bp, Artificial
  CRISPR gRNA sequence
caatagatggcctatgagat

SEQ ID NO: 332974 - DNA, 20 bp, Artificial
  CRISPR gRNA sequence
aatagatggcctatgagatt

SEQ ID NO: 332975 - DNA, 20 bp, Artificial
  CRISPR gRNA sequence
tgagattgtgaaagcatttt

SEQ ID NO: 332976 - DNA, 20 bp, Artificial
  CRISPR gRNA sequence
tgaaagcattttgtgtcaag

SEQ ID NO: 332977 - DNA, 20 bp, Artificial
  CRISPR gRNA sequence
tgtgtcaagccagatatata

SEQ ID NO: 332978 - DNA, 20 bp, Artificial
  CRISPR gRNA sequence
gtgtcaagccagatatatat

SEQ ID NO: 332979 - DNA, 20 bp, Artificial
  CRISPR gRNA sequence
tgtcaagccagatatatata

SEQ ID NO: 332980 - DNA, 20 bp, Artificial
  CRISPR gRNA sequence
taaaacaccttataagcaat

SEQ ID NO: 332981 - DNA, 20 bp, Artificial
  CRISPR gRNA sequence
aaaacaccttataagcaata

SEQ ID NO: 332982 - DNA, 20 bp, Artificial
  CRISPR gRNA sequence
aaacaccttataagcaatag

SEQ ID NO: 332983 - DNA, 20 bp, Artificial
  CRISPR gRNA sequence
ataagcaatagaacactaat

SEQ ID NO: 332984 - DNA, 20 bp, Artificial
  CRISPR gRNA sequence
taagcaatagaacactaata

SEQ ID NO: 332985 - DNA, 20 bp, Artificial
  CRISPR gRNA sequence
atagagacttttaaactggg

SEQ ID NO: 332986 - DNA, 20 bp, Artificial
  CRISPR gRNA sequence
ttaaactggggagtgaaatg

SEQ ID NO: 332987 - DNA, 20 bp, Artificial
  CRISPR gRNA sequence
taaactggggagtgaaatgc

SEQ ID NO: 332988 - DNA, 20 bp, Artificial
  CRISPR gRNA sequence
aaactggggagtgaaatgct

SEQ ID NO: 332989 - DNA, 20 bp, Artificial
  CRISPR gRNA sequence
aactggggagtgaaatgctt

SEQ ID NO: 332990 - DNA, 20 bp, Artificial
  CRISPR gRNA sequence
gggagtgaaatgcttttctg

SEQ ID NO: 332991 - DNA, 20 bp, Artificial
  CRISPR gRNA sequence
ttctgaaacataattttggg

SEQ ID NO: 332992 - DNA, 20 bp, Artificial
  CRISPR gRNA sequence
tctgaaacataattttggga

SEQ ID NO: 332993 - DNA, 20 bp, Artificial
  CRISPR gRNA sequence
ctgaaacataattttgggag

SEQ ID NO: 332994 - DNA, 20 bp, Artificial
  CRISPR gRNA sequence
tgaaacataattttgggagc

SEQ ID NO: 332995 - DNA, 20 bp, Artificial
  CRISPR gRNA sequence
aaacataattttgggagcag

SEQ ID NO: 332996 - DNA, 20 bp, Artificial
  CRISPR gRNA sequence
tgggagcagcatggaggagg

SEQ ID NO: 332997 - DNA, 20 bp, Artificial
  CRISPR gRNA sequence
gggagcagcatggaggaggg

SEQ ID NO: 332998 - DNA, 20 bp, Artificial
  CRISPR gRNA sequence
ggagcagcatggaggaggga

SEQ ID NO: 332999 - DNA, 20 bp, Artificial
  CRISPR gRNA sequence
agaaggccagtcaagaggat

SEQ ID NO: 333000 - DNA, 20 bp, Artificial
  CRISPR gRNA sequence
ccacagataagggaagacat

SEQ ID NO: 333001 - DNA, 20 bp, Artificial
  CRISPR gRNA sequence
cacagataagggaagacatg

SEQ ID NO: 333002 - DNA, 20 bp, Artificial
  CRISPR gRNA sequence
gcaatgggaatggagaaaaa

SEQ ID NO: 333003 - DNA, 20 bp, Artificial
  CRISPR gRNA sequence
aatttaagagatattcatga

SEQ ID NO: 333004 - DNA, 20 bp, Artificial
  CRISPR gRNA sequence
aagagatattcatgagctgg

SEQ ID NO: 333005 - DNA, 20 bp, Artificial
  CRISPR gRNA sequence
agagatattcatgagctgga

SEQ ID NO: 333006 - DNA, 20 bp, Artificial
  CRISPR gRNA sequence
atgagctggagtcaactgga

SEQ ID NO: 333007 - DNA, 20 bp, Artificial
  CRISPR gRNA sequence
gagtcaactggacttggtga

SEQ ID NO: 333008 - DNA, 20 bp, Artificial
  CRISPR gRNA sequence
gacttggtgaccaattggat

SEQ ID NO: 333009 - DNA, 20 bp, Artificial
  CRISPR gRNA sequence
ggtgaccaattggatgatga

SEQ ID NO: 333010 - DNA, 20 bp, Artificial
  CRISPR gRNA sequence
gtgaccaattggatgatgaa

SEQ ID NO: 333011 - DNA, 20 bp, Artificial
  CRISPR gRNA sequence
gatgatgaaaatcagagaga

SEQ ID NO: 333012 - DNA, 20 bp, Artificial
  CRISPR gRNA sequence
tgaggttcctagggtcagac

SEQ ID NO: 333013 - DNA, 20 bp, Artificial
  CRISPR gRNA sequence
aggttcctagggtcagacta

SEQ ID NO: 333014 - DNA, 20 bp, Artificial
  CRISPR gRNA sequence
ctagggtcagactagtgact

SEQ ID NO: 333015 - DNA, 20 bp, Artificial
  CRISPR gRNA sequence
gggtcagactagtgactccc

SEQ ID NO: 333016 - DNA, 20 bp, Artificial
  CRISPR gRNA sequence
gtgactccctgaaaagacag

SEQ ID NO: 333017 - DNA, 20 bp, Artificial
  CRISPR gRNA sequence
cctgaaaagacagggtttgg

SEQ ID NO: 333018 - DNA, 20 bp, Artificial
  CRISPR gRNA sequence
aaaagacagggtttggattt

SEQ ID NO: 333019 - DNA, 20 bp, Artificial
  CRISPR gRNA sequence
ggatttggtgaatgaataca

SEQ ID NO: 333020 - DNA, 20 bp, Artificial
  CRISPR gRNA sequence
gatttggtgaatgaatacag

SEQ ID NO: 333021 - DNA, 20 bp, Artificial
  CRISPR gRNA sequence
ggtgaatgaatacagtcacg

SEQ ID NO: 333022 - DNA, 20 bp, Artificial
  CRISPR gRNA sequence
gtgaatgaatacagtcacgt

SEQ ID NO: 333023 - DNA, 20 bp, Artificial
  CRISPR gRNA sequence
gacgatgggaatacattctg

SEQ ID NO: 333024 - DNA, 20 bp, Artificial
  CRISPR gRNA sequence
acgatgggaatacattctga

SEQ ID NO: 333025 - DNA, 20 bp, Artificial
  CRISPR gRNA sequence
tgagaaatgtgtccttagtg

SEQ ID NO: 333026 - DNA, 20 bp, Artificial
  CRISPR gRNA sequence
agaaatgtgtccttagtgat

SEQ ID NO: 333027 - DNA, 20 bp, Artificial
  CRISPR gRNA sequence
agtgattttgttgtgtgaac

SEQ ID NO: 333028 - DNA, 20 bp, Artificial
  CRISPR gRNA sequence
gtgattttgttgtgtgaaca

SEQ ID NO: 333029 - DNA, 20 bp, Artificial
  CRISPR gRNA sequence
tgttgtgtgaacatcatcga

SEQ ID NO: 333030 - DNA, 20 bp, Artificial
  CRISPR gRNA sequence
gttgtgtgaacatcatcgag

SEQ ID NO: 333031 - DNA, 20 bp, Artificial
  CRISPR gRNA sequence
ttgtgtgaacatcatcgagc

SEQ ID NO: 333032 - DNA, 20 bp, Artificial
  CRISPR gRNA sequence
tgtgaacatcatcgagcgta

SEQ ID NO: 333033 - DNA, 20 bp, Artificial
  CRISPR gRNA sequence
acgcaatgatgtctactaga

SEQ ID NO: 333034 - DNA, 20 bp, Artificial
  CRISPR gRNA sequence
ctagatggcagagcctactg

SEQ ID NO: 333035 - DNA, 20 bp, Artificial
  CRISPR gRNA sequence
gatggcagagcctactgcac

SEQ ID NO: 333036 - DNA, 20 bp, Artificial
  CRISPR gRNA sequence
ctgcactacctaggctatgt

SEQ ID NO: 333037 - DNA, 20 bp, Artificial
  CRISPR gRNA sequence
cactacctaggctatgtgga

SEQ ID NO: 333038 - DNA, 20 bp, Artificial
  CRISPR gRNA sequence
cctaggctatgtggagtagc

SEQ ID NO: 333039 - DNA, 20 bp, Artificial
  CRISPR gRNA sequence
ggctatgtggagtagcctat

SEQ ID NO: 333040 - DNA, 20 bp, Artificial
  CRISPR gRNA sequence
tgtggagtagcctattgctt

SEQ ID NO: 333041 - DNA, 20 bp, Artificial
  CRISPR gRNA sequence
ttgcttctaggctacaaacc

SEQ ID NO: 333042 - DNA, 20 bp, Artificial
  CRISPR gRNA sequence
cttctaggctacaaacctgt

SEQ ID NO: 333043 - DNA, 20 bp, Artificial
  CRISPR gRNA sequence
ctaggctacaaacctgtaca

SEQ ID NO: 333044 - DNA, 20 bp, Artificial
  CRISPR gRNA sequence
taggctacaaacctgtacag

SEQ ID NO: 333045 - DNA, 20 bp, Artificial
  CRISPR gRNA sequence
ggctacaaacctgtacagca

SEQ ID NO: 333046 - DNA, 20 bp, Artificial
  CRISPR gRNA sequence
caaacctgtacagcatgtta

SEQ ID NO: 333047 - DNA, 20 bp, Artificial
  CRISPR gRNA sequence
tacagcatgttactgtactg

SEQ ID NO: 333048 - DNA, 20 bp, Artificial
  CRISPR gRNA sequence
ctgtactgaatactgcaggc

SEQ ID NO: 333049 - DNA, 20 bp, Artificial
  CRISPR gRNA sequence
tactgaatactgcaggccat

SEQ ID NO: 333050 - DNA, 20 bp, Artificial
  CRISPR gRNA sequence
aatactgcaggccatggtag

SEQ ID NO: 333051 - DNA, 20 bp, Artificial
  CRISPR gRNA sequence
caggccatggtagcacaatg

SEQ ID NO: 333052 - DNA, 20 bp, Artificial
  CRISPR gRNA sequence
gtgtaactaaacacataaaa

SEQ ID NO: 333053 - DNA, 20 bp, Artificial
  CRISPR gRNA sequence
tgtaactaaacacataaaag

SEQ ID NO: 333054 - DNA, 20 bp, Artificial
  CRISPR gRNA sequence
aacacataaaagggacatta

SEQ ID NO: 333055 - DNA, 20 bp, Artificial
  CRISPR gRNA sequence
aaaatttctgtattataatc

SEQ ID NO: 333056 - DNA, 20 bp, Artificial
  CRISPR gRNA sequence
ctgtattataatcttatggg

SEQ ID NO: 333057 - DNA, 20 bp, Artificial
  CRISPR gRNA sequence
tgtattataatcttatggga

SEQ ID NO: 333058 - DNA, 20 bp, Artificial
  CRISPR gRNA sequence
tattataatcttatgggacc

SEQ ID NO: 333059 - DNA, 20 bp, Artificial
  CRISPR gRNA sequence
taatcttatgggaccgccac

SEQ ID NO: 333060 - DNA, 20 bp, Artificial
  CRISPR gRNA sequence
atgggaccgccaccatatat

SEQ ID NO: 333061 - DNA, 20 bp, Artificial
  CRISPR gRNA sequence
tgggaccgccaccatatata

SEQ ID NO: 333062 - DNA, 20 bp, Artificial
  CRISPR gRNA sequence
accaacatgtcatttatgca

SEQ ID NO: 333063 - DNA, 20 bp, Artificial
  CRISPR gRNA sequence
atgcagcgcatgactgtact

SEQ ID NO: 333064 - DNA, 20 bp, Artificial
  CRISPR gRNA sequence
tgcagcgcatgactgtactg

SEQ ID NO: 333065 - DNA, 20 bp, Artificial
  CRISPR gRNA sequence
tactgagctcagtttggaaa

SEQ ID NO: 333066 - DNA, 20 bp, Artificial
  CRISPR gRNA sequence
agctcagtttggaaaggcta

SEQ ID NO: 333067 - DNA, 20 bp, Artificial
  CRISPR gRNA sequence
agtttggaaaggctatacat

SEQ ID NO: 333068 - DNA, 20 bp, Artificial
  CRISPR gRNA sequence
ggaaaggctatacatgatgt

SEQ ID NO: 333069 - DNA, 20 bp, Artificial
  CRISPR gRNA sequence
gaaaggctatacatgatgtg

SEQ ID NO: 333070 - DNA, 20 bp, Artificial
  CRISPR gRNA sequence
tacatgatgtgttagggtaa

SEQ ID NO: 333071 - DNA, 20 bp, Artificial
  CRISPR gRNA sequence
gggtaaaaccagatagtgat

SEQ ID NO: 333072 - DNA, 20 bp, Artificial
  CRISPR gRNA sequence
aaaggaatttggaaacaagg

SEQ ID NO: 333073 - DNA, 20 bp, Artificial
  CRISPR gRNA sequence
ggaaacaaggaactagaagt

SEQ ID NO: 333074 - DNA, 20 bp, Artificial
  CRISPR gRNA sequence
gaaacaaggaactagaagtt

SEQ ID NO: 333075 - DNA, 20 bp, Artificial
  CRISPR gRNA sequence
gaagtttgggctggagagaa

SEQ ID NO: 333076 - DNA, 20 bp, Artificial
  CRISPR gRNA sequence
gggctggagagaaaatgtgg

SEQ ID NO: 333077 - DNA, 20 bp, Artificial
  CRISPR gRNA sequence
ggctggagagaaaatgtggg

SEQ ID NO: 333078 - DNA, 20 bp, Artificial
  CRISPR gRNA sequence
gagagaaaatgtgggctcct

SEQ ID NO: 333079 - DNA, 20 bp, Artificial
  CRISPR gRNA sequence
ctgggggtagacatgagagc

SEQ ID NO: 333080 - DNA, 20 bp, Artificial
  CRISPR gRNA sequence
ggggtagacatgagagctgg

SEQ ID NO: 333081 - DNA, 20 bp, Artificial
  CRISPR gRNA sequence
gagccataggtgcaaatgag

SEQ ID NO: 333082 - DNA, 20 bp, Artificial
  CRISPR gRNA sequence
aggcagtgaacaccctgtcc

SEQ ID NO: 333083 - DNA, 20 bp, Artificial
  CRISPR gRNA sequence
tccatgtgcccaaggagttt

SEQ ID NO: 333084 - DNA, 20 bp, Artificial
  CRISPR gRNA sequence
tgcacagtagctgagcaatg

SEQ ID NO: 333085 - DNA, 20 bp, Artificial
  CRISPR gRNA sequence
gcacagtagctgagcaatgg

SEQ ID NO: 333086 - DNA, 20 bp, Artificial
  CRISPR gRNA sequence
cacagtagctgagcaatggc

SEQ ID NO: 333087 - DNA, 20 bp, Artificial
  CRISPR gRNA sequence
agcaatggcaagcaatgtgg

SEQ ID NO: 333088 - DNA, 20 bp, Artificial
  CRISPR gRNA sequence
agaggtgtggataaaatcct

SEQ ID NO: 333089 - DNA, 20 bp, Artificial
  CRISPR gRNA sequence
tctccctcccactctgtgga

SEQ ID NO: 333090 - DNA, 20 bp, Artificial
  CRISPR gRNA sequence
tccctcccactctgtggaag

SEQ ID NO: 333091 - DNA, 20 bp, Artificial
  CRISPR gRNA sequence
cctcccactctgtggaagag

SEQ ID NO: 333092 - DNA, 20 bp, Artificial
  CRISPR gRNA sequence
ccactctgtggaagagagtt

SEQ ID NO: 333093 - DNA, 20 bp, Artificial
  CRISPR gRNA sequence
tgtggaagagagttgggttc

SEQ ID NO: 333094 - DNA, 20 bp, Artificial
  CRISPR gRNA sequence
tggaagagagttgggttcat

SEQ ID NO: 333095 - DNA, 20 bp, Artificial
  CRISPR gRNA sequence
ggttcatttaatctcatatg

SEQ ID NO: 333096 - DNA, 20 bp, Artificial
  CRISPR gRNA sequence
atttaatctcatatgatttc

SEQ ID NO: 333097 - DNA, 20 bp, Artificial
  CRISPR gRNA sequence
aatctcatatgatttcccta

SEQ ID NO: 333098 - DNA, 20 bp, Artificial
  CRISPR gRNA sequence
atctcatatgatttccctag

SEQ ID NO: 333099 - DNA, 20 bp, Artificial
  CRISPR gRNA sequence
atatgatttccctagtacaa

SEQ ID NO: 333100 - DNA, 20 bp, Artificial
  CRISPR gRNA sequence
ccctagtacaatagtttcaa

SEQ ID NO: 333101 - DNA, 20 bp, Artificial
  CRISPR gRNA sequence
cctagtacaatagtttcaaa

SEQ ID NO: 333102 - DNA, 20 bp, Artificial
  CRISPR gRNA sequence
gtacaatagtttcaaatcaa

SEQ ID NO: 333103 - DNA, 20 bp, Artificial
  CRISPR gRNA sequence
caaatcaaaggcaatgaagt

SEQ ID NO: 333104 - DNA, 20 bp, Artificial
  CRISPR gRNA sequence
aaatcaaaggcaatgaagta

SEQ ID NO: 333105 - DNA, 20 bp, Artificial
  CRISPR gRNA sequence
acaaaataacttgtttgtaa

SEQ ID NO: 333106 - DNA, 20 bp, Artificial
  CRISPR gRNA sequence
gtttgtaaattaattgcttt

SEQ ID NO: 333107 - DNA, 20 bp, Artificial
  CRISPR gRNA sequence
tttgtaaattaattgctttg

SEQ ID NO: 333108 - DNA, 20 bp, Artificial
  CRISPR gRNA sequence
gtaaattaattgctttgtga

SEQ ID NO: 333109 - DNA, 20 bp, Artificial
  CRISPR gRNA sequence
taaattaattgctttgtgaa

SEQ ID NO: 333110 - DNA, 20 bp, Artificial
  CRISPR gRNA sequence
attgctttgtgaatattgat

SEQ ID NO: 333111 - DNA, 20 bp, Artificial
  CRISPR gRNA sequence
ctttgtgaatattgatacaa

SEQ ID NO: 333112 - DNA, 20 bp, Artificial
  CRISPR gRNA sequence
tgtgaatattgatacaaagt

SEQ ID NO: 333113 - DNA, 20 bp, Artificial
  CRISPR gRNA sequence
gtgaatattgatacaaagtt

SEQ ID NO: 333114 - DNA, 20 bp, Artificial
  CRISPR gRNA sequence
tgaatattgatacaaagttt

SEQ ID NO: 333115 - DNA, 20 bp, Artificial
  CRISPR gRNA sequence
atacaaagttttataatacc

SEQ ID NO: 333116 - DNA, 20 bp, Artificial
  CRISPR gRNA sequence
tataataccactgggatttt

SEQ ID NO: 333117 - DNA, 20 bp, Artificial
  CRISPR gRNA sequence
ataataccactgggattttt

SEQ ID NO: 333118 - DNA, 20 bp, Artificial
  CRISPR gRNA sequence
taataccactgggatttttt

SEQ ID NO: 333119 - DNA, 20 bp, Artificial
  CRISPR gRNA sequence
ggattttttcatttttcatg

SEQ ID NO: 333120 - DNA, 20 bp, Artificial
  CRISPR gRNA sequence
tttcatttttcatgaagaaa

SEQ ID NO: 333121 - DNA, 20 bp, Artificial
  CRISPR gRNA sequence
ttcatttttcatgaagaaat

SEQ ID NO: 333122 - DNA, 20 bp, Artificial
  CRISPR gRNA sequence
tcatttttcatgaagaaatc

SEQ ID NO: 333123 - DNA, 20 bp, Artificial
  CRISPR gRNA sequence
catttttcatgaagaaatca

SEQ ID NO: 333124 - DNA, 20 bp, Artificial
  CRISPR gRNA sequence
atttttcatgaagaaatcag

SEQ ID NO: 333125 - DNA, 20 bp, Artificial
  CRISPR gRNA sequence
ttcatgaagaaatcagtttt

SEQ ID NO: 333126 - DNA, 20 bp, Artificial
  CRISPR gRNA sequence
tcatgaagaaatcagtttta

SEQ ID NO: 333127 - DNA, 20 bp, Artificial
  CRISPR gRNA sequence
catgaagaaatcagttttaa

SEQ ID NO: 333128 - DNA, 20 bp, Artificial
  CRISPR gRNA sequence
atgaagaaatcagttttaac

SEQ ID NO: 333129 - DNA, 20 bp, Artificial
  CRISPR gRNA sequence
taactaggagaaaatcaatc

SEQ ID NO: 333130 - DNA, 20 bp, Artificial
  CRISPR gRNA sequence
aactaggagaaaatcaatct

SEQ ID NO: 333131 - DNA, 20 bp, Artificial
  CRISPR gRNA sequence
actaggagaaaatcaatctt

SEQ ID NO: 333132 - DNA, 20 bp, Artificial
  CRISPR gRNA sequence
ggagaaaatcaatctttcat

SEQ ID NO: 333133 - DNA, 20 bp, Artificial
  CRISPR gRNA sequence
tcatttttcttattatacac

SEQ ID NO: 333134 - DNA, 20 bp, Artificial
  CRISPR gRNA sequence
catttttcttattatacaca

SEQ ID NO: 333135 - DNA, 20 bp, Artificial
  CRISPR gRNA sequence
atttttcttattatacacac

SEQ ID NO: 333136 - DNA, 20 bp, Artificial
  CRISPR gRNA sequence
ttcttattatacacacttag

SEQ ID NO: 333137 - DNA, 20 bp, Artificial
  CRISPR gRNA sequence
tcttattatacacacttaga

SEQ ID NO: 333138 - DNA, 20 bp, Artificial
  CRISPR gRNA sequence
cttattatacacacttagag

SEQ ID NO: 333139 - DNA, 20 bp, Artificial
  CRISPR gRNA sequence
ttattatacacacttagaga

SEQ ID NO: 333140 - DNA, 20 bp, Artificial
  CRISPR gRNA sequence
attatacacacttagagaac

SEQ ID NO: 333141 - DNA, 20 bp, Artificial
  CRISPR gRNA sequence
ttatacacacttagagaacc

SEQ ID NO: 333142 - DNA, 20 bp, Artificial
  CRISPR gRNA sequence
tacacacttagagaaccaaa

SEQ ID NO: 333143 - DNA, 20 bp, Artificial
  CRISPR gRNA sequence
agagaaccaaagggttgttt

SEQ ID NO: 333144 - DNA, 20 bp, Artificial
  CRISPR gRNA sequence
gagaaccaaagggttgtttt

SEQ ID NO: 333145 - DNA, 20 bp, Artificial
  CRISPR gRNA sequence
ttttgtaccccctatggagt

SEQ ID NO: 333146 - DNA, 20 bp, Artificial
  CRISPR gRNA sequence
tgtaccccctatggagttcc

SEQ ID NO: 333147 - DNA, 20 bp, Artificial
  CRISPR gRNA sequence
gtaccccctatggagttcct

SEQ ID NO: 333148 - DNA, 20 bp, Artificial
  CRISPR gRNA sequence
taccccctatggagttcctt

SEQ ID NO: 333149 - DNA, 20 bp, Artificial
  CRISPR gRNA sequence
tggagttccttggagagtaa

SEQ ID NO: 333150 - DNA, 20 bp, Artificial
  CRISPR gRNA sequence
cttggagagtaaaacaatgc

SEQ ID NO: 333151 - DNA, 20 bp, Artificial
  CRISPR gRNA sequence
ggagagtaaaacaatgcaca

SEQ ID NO: 333152 - DNA, 20 bp, Artificial
  CRISPR gRNA sequence
gagagtaaaacaatgcacac

SEQ ID NO: 333153 - DNA, 20 bp, Artificial
  CRISPR gRNA sequence
tgtgtgtgttcatgagcact

SEQ ID NO: 333154 - DNA, 20 bp, Artificial
  CRISPR gRNA sequence
atgagcactcttttggcttt

SEQ ID NO: 333155 - DNA, 20 bp, Artificial
  CRISPR gRNA sequence
ttttggctttttctcctcac

SEQ ID NO: 333156 - DNA, 20 bp, Artificial
  CRISPR gRNA sequence
ttggctttttctcctcactt

SEQ ID NO: 333157 - DNA, 20 bp, Artificial
  CRISPR gRNA sequence
tggctttttctcctcacttt

SEQ ID NO: 333158 - DNA, 20 bp, Artificial
  CRISPR gRNA sequence
ggctttttctcctcactttt

SEQ ID NO: 333159 - DNA, 20 bp, Artificial
  CRISPR gRNA sequence
gctttttctcctcacttttc

SEQ ID NO: 333160 - DNA, 20 bp, Artificial
  CRISPR gRNA sequence
tttctcctcacttttcttct

SEQ ID NO: 333161 - DNA, 20 bp, Artificial
  CRISPR gRNA sequence
ttctcctcacttttcttctt

SEQ ID NO: 333162 - DNA, 20 bp, Artificial
  CRISPR gRNA sequence
tctcctcacttttcttcttc

SEQ ID NO: 333163 - DNA, 20 bp, Artificial
  CRISPR gRNA sequence
ctcctcacttttcttcttcc

SEQ ID NO: 333164 - DNA, 20 bp, Artificial
  CRISPR gRNA sequence
tcctcacttttcttcttccc

SEQ ID NO: 333165 - DNA, 20 bp, Artificial
  CRISPR gRNA sequence
ctcacttttcttcttcccat

SEQ ID NO: 333166 - DNA, 20 bp, Artificial
  CRISPR gRNA sequence
acttttcttcttcccatttt

SEQ ID NO: 333167 - DNA, 20 bp, Artificial
  CRISPR gRNA sequence
ttcttcttcccatttttttt

SEQ ID NO: 333168 - DNA, 20 bp, Artificial
  CRISPR gRNA sequence
tcttcttcccattttttttt

SEQ ID NO: 333169 - DNA, 20 bp, Artificial
  CRISPR gRNA sequence
cttcttcccatttttttttt

SEQ ID NO: 333170 - DNA, 20 bp, Artificial
  CRISPR gRNA sequence
ttcttcccattttttttttt

SEQ ID NO: 333171 - DNA, 20 bp, Artificial
  CRISPR gRNA sequence
cttcccattttttttttttt

SEQ ID NO: 333172 - DNA, 20 bp, Artificial
  CRISPR gRNA sequence
ttcccatttttttttttttg

SEQ ID NO: 333173 - DNA, 20 bp, Artificial
  CRISPR gRNA sequence
cccatttttttttttttgct

SEQ ID NO: 333174 - DNA, 20 bp, Artificial
  CRISPR gRNA sequence
ccatttttttttttttgctt

SEQ ID NO: 333175 - DNA, 20 bp, Artificial
  CRISPR gRNA sequence
ttttttttttgctttctttt

SEQ ID NO: 333176 - DNA, 20 bp, Artificial
  CRISPR gRNA sequence
tttttttttgctttcttttt

SEQ ID NO: 333177 - DNA, 20 bp, Artificial
  CRISPR gRNA sequence
ttttttttgctttctttttt

SEQ ID NO: 333178 - DNA, 20 bp, Artificial
  CRISPR gRNA sequence
tttttttgctttcttttttt

SEQ ID NO: 333179 - DNA, 20 bp, Artificial
  CRISPR gRNA sequence
ttttttgctttctttttttt

SEQ ID NO: 333180 - DNA, 20 bp, Artificial
  CRISPR gRNA sequence
tttttgctttcttttttttt

SEQ ID NO: 333181 - DNA, 20 bp, Artificial
  CRISPR gRNA sequence
ttttgctttctttttttttt

SEQ ID NO: 333182 - DNA, 20 bp, Artificial
  CRISPR gRNA sequence
tttgctttcttttttttttc

SEQ ID NO: 333183 - DNA, 20 bp, Artificial
  CRISPR gRNA sequence
ttgctttcttttttttttct

SEQ ID NO: 333184 - DNA, 20 bp, Artificial
  CRISPR gRNA sequence
tgctttcttttttttttctc

SEQ ID NO: 333185 - DNA, 20 bp, Artificial
  CRISPR gRNA sequence
gctttcttttttttttctcc

SEQ ID NO: 333186 - DNA, 20 bp, Artificial
  CRISPR gRNA sequence
ctttcttttttttttctcca

SEQ ID NO: 333187 - DNA, 20 bp, Artificial
  CRISPR gRNA sequence
tcttttttttttctccaaat

SEQ ID NO: 333188 - DNA, 20 bp, Artificial
  CRISPR gRNA sequence
cttttttttttctccaaatg

SEQ ID NO: 333189 - DNA, 20 bp, Artificial
  CRISPR gRNA sequence
ttttttttttctccaaatgt

SEQ ID NO: 333190 - DNA, 20 bp, Artificial
  CRISPR gRNA sequence
ttttttttctccaaatgtta

SEQ ID NO: 333191 - DNA, 20 bp, Artificial
  CRISPR gRNA sequence
tttttttctccaaatgttag

SEQ ID NO: 333192 - DNA, 20 bp, Artificial
  CRISPR gRNA sequence
ttttttctccaaatgttagg

SEQ ID NO: 333193 - DNA, 20 bp, Artificial
  CRISPR gRNA sequence
tttttctccaaatgttaggc

SEQ ID NO: 333194 - DNA, 20 bp, Artificial
  CRISPR gRNA sequence
ttttctccaaatgttaggca

SEQ ID NO: 333195 - DNA, 20 bp, Artificial
  CRISPR gRNA sequence
tttctccaaatgttaggcat

SEQ ID NO: 333196 - DNA, 20 bp, Artificial
  CRISPR gRNA sequence
ttctccaaatgttaggcatt

SEQ ID NO: 333197 - DNA, 20 bp, Artificial
  CRISPR gRNA sequence
tctccaaatgttaggcattt

SEQ ID NO: 333198 - DNA, 20 bp, Artificial
  CRISPR gRNA sequence
ctccaaatgttaggcattta

SEQ ID NO: 333199 - DNA, 20 bp, Artificial
  CRISPR gRNA sequence
tccaaatgttaggcatttag

SEQ ID NO: 333200 - DNA, 20 bp, Artificial
  CRISPR gRNA sequence
caaatgttaggcatttaggt

SEQ ID NO: 333201 - DNA, 20 bp, Artificial
  CRISPR gRNA sequence
ggcatttaggttagattggg

SEQ ID NO: 333202 - DNA, 20 bp, Artificial
  CRISPR gRNA sequence
aggttagattgggtttatct

SEQ ID NO: 333203 - DNA, 20 bp, Artificial
  CRISPR gRNA sequence
ggttagattgggtttatctt

SEQ ID NO: 333204 - DNA, 20 bp, Artificial
  CRISPR gRNA sequence
gattgggtttatcttgtcta

SEQ ID NO: 333205 - DNA, 20 bp, Artificial
  CRISPR gRNA sequence
ggtttatcttgtctatcctc

SEQ ID NO: 333206 - DNA, 20 bp, Artificial
  CRISPR gRNA sequence
atcttgtctatcctccctcc

SEQ ID NO: 333207 - DNA, 20 bp, Artificial
  CRISPR gRNA sequence
tcttgtctatcctccctccc

SEQ ID NO: 333208 - DNA, 20 bp, Artificial
  CRISPR gRNA sequence
gtctatcctccctcccttcc

SEQ ID NO: 333209 - DNA, 20 bp, Artificial
  CRISPR gRNA sequence
tctatcctccctcccttcct

SEQ ID NO: 333210 - DNA, 20 bp, Artificial
  CRISPR gRNA sequence
tcctccctcccttccttgcc

SEQ ID NO: 333211 - DNA, 20 bp, Artificial
  CRISPR gRNA sequence
cctcccttccttgcctcaat

SEQ ID NO: 333212 - DNA, 20 bp, Artificial
  CRISPR gRNA sequence
ccttccttgcctcaattact

SEQ ID NO: 333213 - DNA, 20 bp, Artificial
  CRISPR gRNA sequence
ccttgcctcaattacttctt

SEQ ID NO: 333214 - DNA, 20 bp, Artificial
  CRISPR gRNA sequence
cttgcctcaattacttcttt

SEQ ID NO: 333215 - DNA, 20 bp, Artificial
  CRISPR gRNA sequence
gcctcaattacttctttaga

SEQ ID NO: 333216 - DNA, 20 bp, Artificial
  CRISPR gRNA sequence
cctcaattacttctttagat

SEQ ID NO: 333217 - DNA, 20 bp, Artificial
  CRISPR gRNA sequence
aattacttctttagattatg

SEQ ID NO: 333218 - DNA, 20 bp, Artificial
  CRISPR gRNA sequence
cttctttagattatgggtgc

SEQ ID NO: 333219 - DNA, 20 bp, Artificial
  CRISPR gRNA sequence
ctttagattatgggtgcctt

SEQ ID NO: 333220 - DNA, 20 bp, Artificial
  CRISPR gRNA sequence
tttagattatgggtgccttt

SEQ ID NO: 333221 - DNA, 20 bp, Artificial
  CRISPR gRNA sequence
tagattatgggtgcctttga

SEQ ID NO: 333222 - DNA, 20 bp, Artificial
  CRISPR gRNA sequence
agattatgggtgcctttgaa

SEQ ID NO: 333223 - DNA, 20 bp, Artificial
  CRISPR gRNA sequence
gattatgggtgcctttgaat

SEQ ID NO: 333224 - DNA, 20 bp, Artificial
  CRISPR gRNA sequence
tgggtgcctttgaatagcaa

SEQ ID NO: 333225 - DNA, 20 bp, Artificial
  CRISPR gRNA sequence
tgaatagcaatgtaagttta

SEQ ID NO: 333226 - DNA, 20 bp, Artificial
  CRISPR gRNA sequence
gaatagcaatgtaagtttag

SEQ ID NO: 333227 - DNA, 20 bp, Artificial
  CRISPR gRNA sequence
aatagcaatgtaagtttaga

SEQ ID NO: 333228 - DNA, 20 bp, Artificial
  CRISPR gRNA sequence
agaaatgatgcatatataaa

SEQ ID NO: 333229 - DNA, 20 bp, Artificial
  CRISPR gRNA sequence
gaaatgatgcatatataaaa

SEQ ID NO: 333230 - DNA, 20 bp, Artificial
  CRISPR gRNA sequence
ctaaccagggatctaaaggt

SEQ ID NO: 333231 - DNA, 20 bp, Artificial
  CRISPR gRNA sequence
accagggatctaaaggtttt

SEQ ID NO: 333232 - DNA, 20 bp, Artificial
  CRISPR gRNA sequence
aaggttttagctggtagact

SEQ ID NO: 333233 - DNA, 20 bp, Artificial
  CRISPR gRNA sequence
tagctggtagactcataaga

SEQ ID NO: 333234 - DNA, 20 bp, Artificial
  CRISPR gRNA sequence
agctggtagactcataagac

SEQ ID NO: 333235 - DNA, 20 bp, Artificial
  CRISPR gRNA sequence
gctggtagactcataagaca

SEQ ID NO: 333236 - DNA, 20 bp, Artificial
  CRISPR gRNA sequence
gtagactcataagacatgac

SEQ ID NO: 333237 - DNA, 20 bp, Artificial
  CRISPR gRNA sequence
ataagacatgacattgcttt

SEQ ID NO: 333238 - DNA, 20 bp, Artificial
  CRISPR gRNA sequence
cttttatgaaaggtgagaaa

SEQ ID NO: 333239 - DNA, 20 bp, Artificial
  CRISPR gRNA sequence
ttatgaaaggtgagaaaagt

SEQ ID NO: 333240 - DNA, 20 bp, Artificial
  CRISPR gRNA sequence
tatgaaaggtgagaaaagtg

SEQ ID NO: 333241 - DNA, 20 bp, Artificial
  CRISPR gRNA sequence
atgaaaggtgagaaaagtgg

SEQ ID NO: 333242 - DNA, 20 bp, Artificial
  CRISPR gRNA sequence
tgaaaggtgagaaaagtggt

SEQ ID NO: 333243 - DNA, 20 bp, Artificial
  CRISPR gRNA sequence
ttttttttaatgccagaatt

SEQ ID NO: 333244 - DNA, 20 bp, Artificial
  CRISPR gRNA sequence
tttttttaatgccagaattt

SEQ ID NO: 333245 - DNA, 20 bp, Artificial
  CRISPR gRNA sequence
ttttttaatgccagaatttc

SEQ ID NO: 333246 - DNA, 20 bp, Artificial
  CRISPR gRNA sequence
tttttaatgccagaatttct

SEQ ID NO: 333247 - DNA, 20 bp, Artificial
  CRISPR gRNA sequence
ttttaatgccagaatttctt

SEQ ID NO: 333248 - DNA, 20 bp, Artificial
  CRISPR gRNA sequence
tttaatgccagaatttctta

SEQ ID NO: 333249 - DNA, 20 bp, Artificial
  CRISPR gRNA sequence
ttaatgccagaatttcttag

SEQ ID NO: 333250 - DNA, 20 bp, Artificial
  CRISPR gRNA sequence
taatgccagaatttcttagt

SEQ ID NO: 333251 - DNA, 20 bp, Artificial
  CRISPR gRNA sequence
aatgccagaatttcttagta

SEQ ID NO: 333252 - DNA, 20 bp, Artificial
  CRISPR gRNA sequence
atgccagaatttcttagtaa

SEQ ID NO: 333253 - DNA, 20 bp, Artificial
  CRISPR gRNA sequence
cttagtaaaacatcaaatat

SEQ ID NO: 333254 - DNA, 20 bp, Artificial
  CRISPR gRNA sequence
ttagtaaaacatcaaatata

SEQ ID NO: 333255 - DNA, 20 bp, Artificial
  CRISPR gRNA sequence
agtaaaacatcaaatataac

SEQ ID NO: 333256 - DNA, 20 bp, Artificial
  CRISPR gRNA sequence
gtaaaacatcaaatataact

SEQ ID NO: 333257 - DNA, 20 bp, Artificial
  CRISPR gRNA sequence
aaacctaatataaacattgc

SEQ ID NO: 333258 - DNA, 20 bp, Artificial
  CRISPR gRNA sequence
atataaacattgcaattttt

SEQ ID NO: 333259 - DNA, 20 bp, Artificial
  CRISPR gRNA sequence
caatttttagacttttgcct

SEQ ID NO: 333260 - DNA, 20 bp, Artificial
  CRISPR gRNA sequence
ttagacttttgcctcttgtg

SEQ ID NO: 333261 - DNA, 20 bp, Artificial
  CRISPR gRNA sequence
tagacttttgcctcttgtgt

SEQ ID NO: 333262 - DNA, 20 bp, Artificial
  CRISPR gRNA sequence
agacttttgcctcttgtgtc

SEQ ID NO: 333263 - DNA, 20 bp, Artificial
  CRISPR gRNA sequence
gacttttgcctcttgtgtca

SEQ ID NO: 333264 - DNA, 20 bp, Artificial
  CRISPR gRNA sequence
ttgcctcttgtgtcacattc

SEQ ID NO: 333265 - DNA, 20 bp, Artificial
  CRISPR gRNA sequence
tgcctcttgtgtcacattca

SEQ ID NO: 333266 - DNA, 20 bp, Artificial
  CRISPR gRNA sequence
gcctcttgtgtcacattcat

SEQ ID NO: 333267 - DNA, 20 bp, Artificial
  CRISPR gRNA sequence
cctcttgtgtcacattcatg

SEQ ID NO: 333268 - DNA, 20 bp, Artificial
  CRISPR gRNA sequence
ttgtgtcacattcatgtgct

SEQ ID NO: 333269 - DNA, 20 bp, Artificial
  CRISPR gRNA sequence
gtgtcacattcatgtgctgt

SEQ ID NO: 333270 - DNA, 20 bp, Artificial
  CRISPR gRNA sequence
tgtcacattcatgtgctgtg

SEQ ID NO: 333271 - DNA, 20 bp, Artificial
  CRISPR gRNA sequence
atgtgctgtgctaagctaac

SEQ ID NO: 333272 - DNA, 20 bp, Artificial
  CRISPR gRNA sequence
tgctaagctaacacttatca

SEQ ID NO: 333273 - DNA, 20 bp, Artificial
  CRISPR gRNA sequence
agctaacacttatcattgtt

SEQ ID NO: 333274 - DNA, 20 bp, Artificial
  CRISPR gRNA sequence
acacttatcattgtttgatt

SEQ ID NO: 333275 - DNA, 20 bp, Artificial
  CRISPR gRNA sequence
atcattgtttgattacagaa

SEQ ID NO: 333276 - DNA, 20 bp, Artificial
  CRISPR gRNA sequence
tcattgtttgattacagaaa

SEQ ID NO: 333277 - DNA, 20 bp, Artificial
  CRISPR gRNA sequence
tttgattacagaaaatgtgt

SEQ ID NO: 333278 - DNA, 20 bp, Artificial
  CRISPR gRNA sequence
gattacagaaaatgtgttta

SEQ ID NO: 333279 - DNA, 20 bp, Artificial
  CRISPR gRNA sequence
attacagaaaatgtgtttaa

SEQ ID NO: 333280 - DNA, 20 bp, Artificial
  CRISPR gRNA sequence
cagaaaatgtgtttaataag

SEQ ID NO: 333281 - DNA, 20 bp, Artificial
  CRISPR gRNA sequence
aataagcactatcaatgatt

SEQ ID NO: 333282 - DNA, 20 bp, Artificial
  CRISPR gRNA sequence
ataagcactatcaatgatta

SEQ ID NO: 333283 - DNA, 20 bp, Artificial
  CRISPR gRNA sequence
tcaatgattacaaactcagg

SEQ ID NO: 333284 - DNA, 20 bp, Artificial
  CRISPR gRNA sequence
caaactcaggacatcttatc

SEQ ID NO: 333285 - DNA, 20 bp, Artificial
  CRISPR gRNA sequence
aggacatcttatctttccat

SEQ ID NO: 333286 - DNA, 20 bp, Artificial
  CRISPR gRNA sequence
atctttccatcactctgaga

SEQ ID NO: 333287 - DNA, 20 bp, Artificial
  CRISPR gRNA sequence
tctttccatcactctgagac

SEQ ID NO: 333288 - DNA, 20 bp, Artificial
  CRISPR gRNA sequence
tccatcactctgagaccttt

SEQ ID NO: 333289 - DNA, 20 bp, Artificial
  CRISPR gRNA sequence
ccatcactctgagacctttg

SEQ ID NO: 333290 - DNA, 20 bp, Artificial
  CRISPR gRNA sequence
catcactctgagacctttgt

SEQ ID NO: 333291 - DNA, 20 bp, Artificial
  CRISPR gRNA sequence
tgagacctttgtggaggttt

SEQ ID NO: 333292 - DNA, 20 bp, Artificial
  CRISPR gRNA sequence
agacctttgtggaggtttgt

SEQ ID NO: 333293 - DNA, 20 bp, Artificial
  CRISPR gRNA sequence
tgtggaggtttgtggttaga

SEQ ID NO: 333294 - DNA, 20 bp, Artificial
  CRISPR gRNA sequence
gtggaggtttgtggttagaa

SEQ ID NO: 333295 - DNA, 20 bp, Artificial
  CRISPR gRNA sequence
tggaggtttgtggttagaag

SEQ ID NO: 333296 - DNA, 20 bp, Artificial
  CRISPR gRNA sequence
gtggttagaagtctgagtta

SEQ ID NO: 333297 - DNA, 20 bp, Artificial
  CRISPR gRNA sequence
tggttagaagtctgagttaa

SEQ ID NO: 333298 - DNA, 20 bp, Artificial
  CRISPR gRNA sequence
gaagtctgagttaaagaaaa

SEQ ID NO: 333299 - DNA, 20 bp, Artificial
  CRISPR gRNA sequence
agttaaagaaaataaaatta

SEQ ID NO: 333300 - DNA, 20 bp, Artificial
  CRISPR gRNA sequence
aagaaaataaaattacattt

SEQ ID NO: 333301 - DNA, 20 bp, Artificial
  CRISPR gRNA sequence
catttctgatatcttgcacg

SEQ ID NO: 333302 - DNA, 20 bp, Artificial
  CRISPR gRNA sequence
ctgatatcttgcacgctctg

SEQ ID NO: 333303 - DNA, 20 bp, Artificial
  CRISPR gRNA sequence
tgatatcttgcacgctctgc

SEQ ID NO: 333304 - DNA, 20 bp, Artificial
  CRISPR gRNA sequence
atatcttgcacgctctgcac

SEQ ID NO: 333305 - DNA, 20 bp, Artificial
  CRISPR gRNA sequence
gcacgctctgcactgagtgg

SEQ ID NO: 333306 - DNA, 20 bp, Artificial
  CRISPR gRNA sequence
cacgctctgcactgagtggg

SEQ ID NO: 333307 - DNA, 20 bp, Artificial
  CRISPR gRNA sequence
tgcactgagtgggttcttta

SEQ ID NO: 333308 - DNA, 20 bp, Artificial
  CRISPR gRNA sequence
cactgagtgggttctttaaa

SEQ ID NO: 333309 - DNA, 20 bp, Artificial
  CRISPR gRNA sequence
agtgggttctttaaatgttt

SEQ ID NO: 333310 - DNA, 20 bp, Artificial
  CRISPR gRNA sequence
tttaaatgtttcctccagag

SEQ ID NO: 333311 - DNA, 20 bp, Artificial
  CRISPR gRNA sequence
taaatgtttcctccagagga

SEQ ID NO: 333312 - DNA, 20 bp, Artificial
  CRISPR gRNA sequence
aaatgtttcctccagaggat

SEQ ID NO: 333313 - DNA, 20 bp, Artificial
  CRISPR gRNA sequence
aatgtttcctccagaggatt

SEQ ID NO: 333314 - DNA, 20 bp, Artificial
  CRISPR gRNA sequence
cctccagaggattttcaacc

SEQ ID NO: 333315 - DNA, 20 bp, Artificial
  CRISPR gRNA sequence
ctccagaggattttcaacca

SEQ ID NO: 333316 - DNA, 20 bp, Artificial
  CRISPR gRNA sequence
cagaggattttcaaccagga

SEQ ID NO: 333317 - DNA, 20 bp, Artificial
  CRISPR gRNA sequence
tcaaccaggaacaatacaac

SEQ ID NO: 333318 - DNA, 20 bp, Artificial
  CRISPR gRNA sequence
caaccaggaacaatacaact

SEQ ID NO: 333319 - DNA, 20 bp, Artificial
  CRISPR gRNA sequence
aaccaggaacaatacaactg

SEQ ID NO: 333320 - DNA, 20 bp, Artificial
  CRISPR gRNA sequence
cttgcaaagagtcccagcag

SEQ ID NO: 333321 - DNA, 20 bp, Artificial
  CRISPR gRNA sequence
gcaaagagtcccagcaggat

SEQ ID NO: 333322 - DNA, 20 bp, Artificial
  CRISPR gRNA sequence
caaagagtcccagcaggatg

SEQ ID NO: 333323 - DNA, 20 bp, Artificial
  CRISPR gRNA sequence
ggcatgagcatcttatactg

SEQ ID NO: 333324 - DNA, 20 bp, Artificial
  CRISPR gRNA sequence
atactggtgaaatgaagtag

SEQ ID NO: 333325 - DNA, 20 bp, Artificial
  CRISPR gRNA sequence
tactggtgaaatgaagtagt

SEQ ID NO: 333326 - DNA, 20 bp, Artificial
  CRISPR gRNA sequence
gtgaaatgaagtagtccaga

SEQ ID NO: 333327 - DNA, 20 bp, Artificial
  CRISPR gRNA sequence
aaagcatcaacttgcaaatg

SEQ ID NO: 333328 - DNA, 20 bp, Artificial
  CRISPR gRNA sequence
gcaaatgaactcatctgcac

SEQ ID NO: 333329 - DNA, 20 bp, Artificial
  CRISPR gRNA sequence
caaatgaactcatctgcact

SEQ ID NO: 333330 - DNA, 20 bp, Artificial
  CRISPR gRNA sequence
atctgcactatagtgcaatt

SEQ ID NO: 333331 - DNA, 20 bp, Artificial
  CRISPR gRNA sequence
cactatagtgcaattctcag

SEQ ID NO: 333332 - DNA, 20 bp, Artificial
  CRISPR gRNA sequence
tagtgcaattctcaggtgaa

SEQ ID NO: 333333 - DNA, 20 bp, Artificial
  CRISPR gRNA sequence
tcaggtgaatgaccttttct

SEQ ID NO: 333334 - DNA, 20 bp, Artificial
  CRISPR gRNA sequence
aggtgaatgaccttttcttc

SEQ ID NO: 333335 - DNA, 20 bp, Artificial
  CRISPR gRNA sequence
ttcttcagaaattttcttaa

SEQ ID NO: 333336 - DNA, 20 bp, Artificial
  CRISPR gRNA sequence
tcttcagaaattttcttaat

SEQ ID NO: 333337 - DNA, 20 bp, Artificial
  CRISPR gRNA sequence
cttcagaaattttcttaata

SEQ ID NO: 333338 - DNA, 20 bp, Artificial
  CRISPR gRNA sequence
ttcagaaattttcttaatag

SEQ ID NO: 333339 - DNA, 20 bp, Artificial
  CRISPR gRNA sequence
cagaaattttcttaatagtc

SEQ ID NO: 333340 - DNA, 20 bp, Artificial
  CRISPR gRNA sequence
agaaattttcttaatagtcc

SEQ ID NO: 333341 - DNA, 20 bp, Artificial
  CRISPR gRNA sequence
tcttaatagtcccccaaaag

SEQ ID NO: 333342 - DNA, 20 bp, Artificial
  CRISPR gRNA sequence
cttaatagtcccccaaaaga

SEQ ID NO: 333343 - DNA, 20 bp, Artificial
  CRISPR gRNA sequence
ttaatagtcccccaaaagaa

SEQ ID NO: 333344 - DNA, 20 bp, Artificial
  CRISPR gRNA sequence
aatagtcccccaaaagaaga

SEQ ID NO: 333345 - DNA, 20 bp, Artificial
  CRISPR gRNA sequence
atagtcccccaaaagaagaa

SEQ ID NO: 333346 - DNA, 20 bp, Artificial
  CRISPR gRNA sequence
ttgtgctttataaattttga

SEQ ID NO: 333347 - DNA, 20 bp, Artificial
  CRISPR gRNA sequence
gtgctttataaattttgaaa

SEQ ID NO: 333348 - DNA, 20 bp, Artificial
  CRISPR gRNA sequence
tgctttataaattttgaaaa

SEQ ID NO: 333349 - DNA, 20 bp, Artificial
  CRISPR gRNA sequence
tataaattttgaaaacctaa

SEQ ID NO: 333350 - DNA, 20 bp, Artificial
  CRISPR gRNA sequence
ataaattttgaaaacctaaa

SEQ ID NO: 333351 - DNA, 20 bp, Artificial
  CRISPR gRNA sequence
taaattttgaaaacctaaag

SEQ ID NO: 333352 - DNA, 20 bp, Artificial
  CRISPR gRNA sequence
tgaaaacctaaagagatcac

SEQ ID NO: 333353 - DNA, 20 bp, Artificial
  CRISPR gRNA sequence
gaaaacctaaagagatcact

SEQ ID NO: 333354 - DNA, 20 bp, Artificial
  CRISPR gRNA sequence
aaaacctaaagagatcactt

SEQ ID NO: 333355 - DNA, 20 bp, Artificial
  CRISPR gRNA sequence
aagagatcacttaatataaa

SEQ ID NO: 333356 - DNA, 20 bp, Artificial
  CRISPR gRNA sequence
aatataaagatttttatttt

SEQ ID NO: 333357 - DNA, 20 bp, Artificial
  CRISPR gRNA sequence
atataaagatttttatttta

SEQ ID NO: 333358 - DNA, 20 bp, Artificial
  CRISPR gRNA sequence
ttattttactcttgaaaaca

SEQ ID NO: 333359 - DNA, 20 bp, Artificial
  CRISPR gRNA sequence
tattttactcttgaaaacat

SEQ ID NO: 333360 - DNA, 20 bp, Artificial
  CRISPR gRNA sequence
attttactcttgaaaacatt

SEQ ID NO: 333361 - DNA, 20 bp, Artificial
  CRISPR gRNA sequence
ttttactcttgaaaacatta

SEQ ID NO: 333362 - DNA, 20 bp, Artificial
  CRISPR gRNA sequence
tactcttgaaaacattagtc

SEQ ID NO: 333363 - DNA, 20 bp, Artificial
  CRISPR gRNA sequence
actcttgaaaacattagtct

SEQ ID NO: 333364 - DNA, 20 bp, Artificial
  CRISPR gRNA sequence
ctcttgaaaacattagtcta

SEQ ID NO: 333365 - DNA, 20 bp, Artificial
  CRISPR gRNA sequence
ttgaaaacattagtctattg

SEQ ID NO: 333366 - DNA, 20 bp, Artificial
  CRISPR gRNA sequence
gaaaacattagtctattgat

SEQ ID NO: 333367 - DNA, 20 bp, Artificial
  CRISPR gRNA sequence
aaaacattagtctattgata

SEQ ID NO: 333368 - DNA, 20 bp, Artificial
  CRISPR gRNA sequence
gtctattgatatcaacagta

SEQ ID NO: 333369 - DNA, 20 bp, Artificial
  CRISPR gRNA sequence
ttgatatcaacagtaatatt

SEQ ID NO: 333370 - DNA, 20 bp, Artificial
  CRISPR gRNA sequence
atatcaacagtaatattata

SEQ ID NO: 333371 - DNA, 20 bp, Artificial
  CRISPR gRNA sequence
taaaaattattattattatt

SEQ ID NO: 333372 - DNA, 20 bp, Artificial
  CRISPR gRNA sequence
ttattattattattttttga

SEQ ID NO: 333373 - DNA, 20 bp, Artificial
  CRISPR gRNA sequence
ttattattattttttgagac

SEQ ID NO: 333374 - DNA, 20 bp, Artificial
  CRISPR gRNA sequence
ttattattttttgagacgga

SEQ ID NO: 333375 - DNA, 20 bp, Artificial
  CRISPR gRNA sequence
ttattttttgagacggagtc

SEQ ID NO: 333376 - DNA, 20 bp, Artificial
  CRISPR gRNA sequence
ttttttgagacggagtcttg

SEQ ID NO: 333377 - DNA, 20 bp, Artificial
  CRISPR gRNA sequence
tttgagacggagtcttgctc

SEQ ID NO: 333378 - DNA, 20 bp, Artificial
  CRISPR gRNA sequence
ttgagacggagtcttgctct

SEQ ID NO: 333379 - DNA, 20 bp, Artificial
  CRISPR gRNA sequence
tgagacggagtcttgctctg

SEQ ID NO: 333380 - DNA, 20 bp, Artificial
  CRISPR gRNA sequence
gagacggagtcttgctctgt

SEQ ID NO: 333381 - DNA, 20 bp, Artificial
  CRISPR gRNA sequence
agacggagtcttgctctgtt

SEQ ID NO: 333382 - DNA, 20 bp, Artificial
  CRISPR gRNA sequence
gctctgttgccaggctggag

SEQ ID NO: 333383 - DNA, 20 bp, Artificial
  CRISPR gRNA sequence
ctctgttgccaggctggagt

SEQ ID NO: 333384 - DNA, 20 bp, Artificial
  CRISPR gRNA sequence
tgttgccaggctggagtgca

SEQ ID NO: 333385 - DNA, 20 bp, Artificial
  CRISPR gRNA sequence
ttgccaggctggagtgcagt

SEQ ID NO: 333386 - DNA, 20 bp, Artificial
  CRISPR gRNA sequence
ccaggctggagtgcagtggt

SEQ ID NO: 333387 - DNA, 20 bp, Artificial
  CRISPR gRNA sequence
gagtgcagtggtgcaatctc

SEQ ID NO: 333388 - DNA, 20 bp, Artificial
  CRISPR gRNA sequence
ggctcactgcaacctctgac

SEQ ID NO: 333389 - DNA, 20 bp, Artificial
  CRISPR gRNA sequence
actgcaacctctgactccct

SEQ ID NO: 333390 - DNA, 20 bp, Artificial
  CRISPR gRNA sequence
caacctctgactccctggtt

SEQ ID NO: 333391 - DNA, 20 bp, Artificial
  CRISPR gRNA sequence
tgactccctggttcaagcga

SEQ ID NO: 333392 - DNA, 20 bp, Artificial
  CRISPR gRNA sequence
actccctggttcaagcgatt

SEQ ID NO: 333393 - DNA, 20 bp, Artificial
  CRISPR gRNA sequence
cctggttcaagcgattctcc

SEQ ID NO: 333394 - DNA, 20 bp, Artificial
  CRISPR gRNA sequence
gttcaagcgattctcctgcc

SEQ ID NO: 333395 - DNA, 20 bp, Artificial
  CRISPR gRNA sequence
aagcgattctcctgcctcag

SEQ ID NO: 333396 - DNA, 20 bp, Artificial
  CRISPR gRNA sequence
tcctgcctcagcctcctgag

SEQ ID NO: 333397 - DNA, 20 bp, Artificial
  CRISPR gRNA sequence
ctgcctcagcctcctgagta

SEQ ID NO: 333398 - DNA, 20 bp, Artificial
  CRISPR gRNA sequence
cctcagcctcctgagtagct

SEQ ID NO: 333399 - DNA, 20 bp, Artificial
  CRISPR gRNA sequence
agcctcctgagtagctggga

SEQ ID NO: 333400 - DNA, 20 bp, Artificial
  CRISPR gRNA sequence
ctgagtagctgggattacag

SEQ ID NO: 333401 - DNA, 20 bp, Artificial
  CRISPR gRNA sequence
agtagctgggattacaggca

SEQ ID NO: 333402 - DNA, 20 bp, Artificial
  CRISPR gRNA sequence
ggattacaggcacacaccac

SEQ ID NO: 333403 - DNA, 20 bp, Artificial
  CRISPR gRNA sequence
caggcacacaccaccacgcc

SEQ ID NO: 333404 - DNA, 20 bp, Artificial
  CRISPR gRNA sequence
atttttatattattagtaga

SEQ ID NO: 333405 - DNA, 20 bp, Artificial
  CRISPR gRNA sequence
ttatattattagtagagacg

SEQ ID NO: 333406 - DNA, 20 bp, Artificial
  CRISPR gRNA sequence
tatattattagtagagacgg

SEQ ID NO: 333407 - DNA, 20 bp, Artificial
  CRISPR gRNA sequence
atattattagtagagacgga

SEQ ID NO: 333408 - DNA, 20 bp, Artificial
  CRISPR gRNA sequence
tattattagtagagacggag

SEQ ID NO: 333409 - DNA, 20 bp, Artificial
  CRISPR gRNA sequence
ttagtagagacggagtttca

SEQ ID NO: 333410 - DNA, 20 bp, Artificial
  CRISPR gRNA sequence
gtagagacggagtttcacca

SEQ ID NO: 333411 - DNA, 20 bp, Artificial
  CRISPR gRNA sequence
caccatgttggccaggatgg

SEQ ID NO: 333412 - DNA, 20 bp, Artificial
  CRISPR gRNA sequence
accatgttggccaggatggt

SEQ ID NO: 333413 - DNA, 20 bp, Artificial
  CRISPR gRNA sequence
gccaggatggtctcaatctc

SEQ ID NO: 333414 - DNA, 20 bp, Artificial
  CRISPR gRNA sequence
aatctcttgacctcgtgatc

SEQ ID NO: 333415 - DNA, 20 bp, Artificial
  CRISPR gRNA sequence
ttgacctcgtgatcctcctg

SEQ ID NO: 333416 - DNA, 20 bp, Artificial
  CRISPR gRNA sequence
gacctcgtgatcctcctgcc

SEQ ID NO: 333417 - DNA, 20 bp, Artificial
  CRISPR gRNA sequence
acctcgtgatcctcctgcct

SEQ ID NO: 333418 - DNA, 20 bp, Artificial
  CRISPR gRNA sequence
gtgatcctcctgcctcggcc

SEQ ID NO: 333419 - DNA, 20 bp, Artificial
  CRISPR gRNA sequence
ctgcctcggcctcccaaagt

SEQ ID NO: 333420 - DNA, 20 bp, Artificial
  CRISPR gRNA sequence
cctcggcctcccaaagtgct

SEQ ID NO: 333421 - DNA, 20 bp, Artificial
  CRISPR gRNA sequence
ggcctcccaaagtgctggga

SEQ ID NO: 333422 - DNA, 20 bp, Artificial
  CRISPR gRNA sequence
ccaaagtgctgggattacag

SEQ ID NO: 333423 - DNA, 20 bp, Artificial
  CRISPR gRNA sequence
ggattacagggcgagtcact

SEQ ID NO: 333424 - DNA, 20 bp, Artificial
  CRISPR gRNA sequence
cagggcgagtcactgcgccc

SEQ ID NO: 333425 - DNA, 20 bp, Artificial
  CRISPR gRNA sequence
cgcccggcctataaaaatta

SEQ ID NO: 333426 - DNA, 20 bp, Artificial
  CRISPR gRNA sequence
taaaaattattgttagcagc

SEQ ID NO: 333427 - DNA, 20 bp, Artificial
  CRISPR gRNA sequence
ttgttagcagcagttaacag

SEQ ID NO: 333428 - DNA, 20 bp, Artificial
  CRISPR gRNA sequence
ttagcagcagttaacagtct

SEQ ID NO: 333429 - DNA, 20 bp, Artificial
  CRISPR gRNA sequence
gcagcagttaacagtcttga

SEQ ID NO: 333430 - DNA, 20 bp, Artificial
  CRISPR gRNA sequence
acagtcttgagcctctactg

SEQ ID NO: 333431 - DNA, 20 bp, Artificial
  CRISPR gRNA sequence
gagcctctactgggaagaat

SEQ ID NO: 333432 - DNA, 20 bp, Artificial
  CRISPR gRNA sequence
agcctctactgggaagaata

SEQ ID NO: 333433 - DNA, 20 bp, Artificial
  CRISPR gRNA sequence
tactgggaagaatatgccct

SEQ ID NO: 333434 - DNA, 20 bp, Artificial
  CRISPR gRNA sequence
ctgggaagaatatgccctgt

SEQ ID NO: 333435 - DNA, 20 bp, Artificial
  CRISPR gRNA sequence
ggaagaatatgccctgttag

SEQ ID NO: 333436 - DNA, 20 bp, Artificial
  CRISPR gRNA sequence
ttagacacagtattctatgt

SEQ ID NO: 333437 - DNA, 20 bp, Artificial
  CRISPR gRNA sequence
gacacagtattctatgtgat

SEQ ID NO: 333438 - DNA, 20 bp, Artificial
  CRISPR gRNA sequence
tatgtgatgaagaaaatata

SEQ ID NO: 333439 - DNA, 20 bp, Artificial
  CRISPR gRNA sequence
tgtgatgaagaaaatatagt

SEQ ID NO: 333440 - DNA, 20 bp, Artificial
  CRISPR gRNA sequence
ttctccagactgattataat

SEQ ID NO: 333441 - DNA, 20 bp, Artificial
  CRISPR gRNA sequence
tccagactgattataatcta

SEQ ID NO: 333442 - DNA, 20 bp, Artificial
  CRISPR gRNA sequence
cagactgattataatctagg

SEQ ID NO: 333443 - DNA, 20 bp, Artificial
  CRISPR gRNA sequence
attataatctagggtttcca

SEQ ID NO: 333444 - DNA, 20 bp, Artificial
  CRISPR gRNA sequence
taatctagggtttccaataa

SEQ ID NO: 333445 - DNA, 20 bp, Artificial
  CRISPR gRNA sequence
gggtttccaataaaaagtaa

SEQ ID NO: 333446 - DNA, 20 bp, Artificial
  CRISPR gRNA sequence
ccaataaaaagtaaacagat

SEQ ID NO: 333447 - DNA, 20 bp, Artificial
  CRISPR gRNA sequence
caataaaaagtaaacagata

SEQ ID NO: 333448 - DNA, 20 bp, Artificial
  CRISPR gRNA sequence
atgtttaatattcagatttt

SEQ ID NO: 333449 - DNA, 20 bp, Artificial
  CRISPR gRNA sequence
aatattcagattttaagact

SEQ ID NO: 333450 - DNA, 20 bp, Artificial
  CRISPR gRNA sequence
atattcagattttaagactc

SEQ ID NO: 333451 - DNA, 20 bp, Artificial
  CRISPR gRNA sequence
agattttaagactcatcacc

SEQ ID NO: 333452 - DNA, 20 bp, Artificial
  CRISPR gRNA sequence
taagactcatcaccaggatc

SEQ ID NO: 333453 - DNA, 20 bp, Artificial
  CRISPR gRNA sequence
aagactcatcaccaggatcc

SEQ ID NO: 333454 - DNA, 20 bp, Artificial
  CRISPR gRNA sequence
agactcatcaccaggatcca

SEQ ID NO: 333455 - DNA, 20 bp, Artificial
  CRISPR gRNA sequence
atcaccaggatccaagacca

SEQ ID NO: 333456 - DNA, 20 bp, Artificial
  CRISPR gRNA sequence
ctttttgtgattttagtaac

SEQ ID NO: 333457 - DNA, 20 bp, Artificial
  CRISPR gRNA sequence
tttgtgattttagtaacata

SEQ ID NO: 333458 - DNA, 20 bp, Artificial
  CRISPR gRNA sequence
ttgtgattttagtaacatat

SEQ ID NO: 333459 - DNA, 20 bp, Artificial
  CRISPR gRNA sequence
tgtgattttagtaacatatt

SEQ ID NO: 333460 - DNA, 20 bp, Artificial
  CRISPR gRNA sequence
gtgattttagtaacatatta

SEQ ID NO: 333461 - DNA, 20 bp, Artificial
  CRISPR gRNA sequence
tgattttagtaacatattaa

SEQ ID NO: 333462 - DNA, 20 bp, Artificial
  CRISPR gRNA sequence
tagtaacatattaagtgcta

SEQ ID NO: 333463 - DNA, 20 bp, Artificial
  CRISPR gRNA sequence
agtaacatattaagtgctaa

SEQ ID NO: 333464 - DNA, 20 bp, Artificial
  CRISPR gRNA sequence
gtaacatattaagtgctaaa

SEQ ID NO: 333465 - DNA, 20 bp, Artificial
  CRISPR gRNA sequence
agtgctaaaagatataagat

SEQ ID NO: 333466 - DNA, 20 bp, Artificial
  CRISPR gRNA sequence
aaagatataagatgatgttt

SEQ ID NO: 333467 - DNA, 20 bp, Artificial
  CRISPR gRNA sequence
atatcacaaaccactaacat

SEQ ID NO: 333468 - DNA, 20 bp, Artificial
  CRISPR gRNA sequence
tatcacaaaccactaacatg

SEQ ID NO: 333469 - DNA, 20 bp, Artificial
  CRISPR gRNA sequence
acatgctgtgtttataaaac

SEQ ID NO: 333470 - DNA, 20 bp, Artificial
  CRISPR gRNA sequence
tgtttataaaacatcttggt

SEQ ID NO: 333471 - DNA, 20 bp, Artificial
  CRISPR gRNA sequence
ataaaacatcttggtatatt

SEQ ID NO: 333472 - DNA, 20 bp, Artificial
  CRISPR gRNA sequence
taaaacatcttggtatatta

SEQ ID NO: 333473 - DNA, 20 bp, Artificial
  CRISPR gRNA sequence
ggtatattagaacaaccatt

SEQ ID NO: 333474 - DNA, 20 bp, Artificial
  CRISPR gRNA sequence
gtatattagaacaaccattg

SEQ ID NO: 333475 - DNA, 20 bp, Artificial
  CRISPR gRNA sequence
gaacaaccattggtccaggg

SEQ ID NO: 333476 - DNA, 20 bp, Artificial
  CRISPR gRNA sequence
gtccaggggttcttgtcctg

SEQ ID NO: 333477 - DNA, 20 bp, Artificial
  CRISPR gRNA sequence
ttgtcctggtcatatattgg

SEQ ID NO: 333478 - DNA, 20 bp, Artificial
  CRISPR gRNA sequence
gtcctggtcatatattgggc

SEQ ID NO: 333479 - DNA, 20 bp, Artificial
  CRISPR gRNA sequence
tcctggtcatatattgggca

SEQ ID NO: 333480 - DNA, 20 bp, Artificial
  CRISPR gRNA sequence
gtcatatattgggcaaatgt

SEQ ID NO: 333481 - DNA, 20 bp, Artificial
  CRISPR gRNA sequence
ggcaaatgtaatggctgcgc

SEQ ID NO: 333482 - DNA, 20 bp, Artificial
  CRISPR gRNA sequence
cgctttgggacatccaagtg

SEQ ID NO: 333483 - DNA, 20 bp, Artificial
  CRISPR gRNA sequence
tgggacatccaagtgagcaa

SEQ ID NO: 333484 - DNA, 20 bp, Artificial
  CRISPR gRNA sequence
gggacatccaagtgagcaac

SEQ ID NO: 333485 - DNA, 20 bp, Artificial
  CRISPR gRNA sequence
ggacatccaagtgagcaacc

SEQ ID NO: 333486 - DNA, 20 bp, Artificial
  CRISPR gRNA sequence
gttgctcacttggatggaac

SEQ ID NO: 333487 - DNA, 20 bp, Artificial
  CRISPR gRNA sequence
ttgctcacttggatggaaca

SEQ ID NO: 333488 - DNA, 20 bp, Artificial
  CRISPR gRNA sequence
ctcacttggatggaacaaag

SEQ ID NO: 333489 - DNA, 20 bp, Artificial
  CRISPR gRNA sequence
acttggatggaacaaagttg

SEQ ID NO: 333490 - DNA, 20 bp, Artificial
  CRISPR gRNA sequence
ggatggaacaaagttgtcct

SEQ ID NO: 333491 - DNA, 20 bp, Artificial
  CRISPR gRNA sequence
gatggaacaaagttgtcctg

SEQ ID NO: 333492 - DNA, 20 bp, Artificial
  CRISPR gRNA sequence
tcctgccctccacagacata

SEQ ID NO: 333493 - DNA, 20 bp, Artificial
  CRISPR gRNA sequence
ccctccacagacatataaga

SEQ ID NO: 333494 - DNA, 20 bp, Artificial
  CRISPR gRNA sequence
cacagacatataagagccaa

SEQ ID NO: 333495 - DNA, 20 bp, Artificial
  CRISPR gRNA sequence
tcaactgtctaaataagtat

SEQ ID NO: 333496 - DNA, 20 bp, Artificial
  CRISPR gRNA sequence
tctaaataagtatttatgaa

SEQ ID NO: 333497 - DNA, 20 bp, Artificial
  CRISPR gRNA sequence
aataagtatttatgaaccca

SEQ ID NO: 333498 - DNA, 20 bp, Artificial
  CRISPR gRNA sequence
atgaacccagtggatatttg

SEQ ID NO: 333499 - DNA, 20 bp, Artificial
  CRISPR gRNA sequence
tgaacccagtggatatttga

SEQ ID NO: 333500 - DNA, 20 bp, Artificial
  CRISPR gRNA sequence
gaaggtaaagaaagtttttc

SEQ ID NO: 333501 - DNA, 20 bp, Artificial
  CRISPR gRNA sequence
aaggtaaagaaagtttttct

SEQ ID NO: 333502 - DNA, 20 bp, Artificial
  CRISPR gRNA sequence
ttctttaaagctcagacaga

SEQ ID NO: 333503 - DNA, 20 bp, Artificial
  CRISPR gRNA sequence
tctttaaagctcagacagat

SEQ ID NO: 333504 - DNA, 20 bp, Artificial
  CRISPR gRNA sequence
ctttaaagctcagacagata

SEQ ID NO: 333505 - DNA, 20 bp, Artificial
  CRISPR gRNA sequence
tttaaagctcagacagataa

SEQ ID NO: 333506 - DNA, 20 bp, Artificial
  CRISPR gRNA sequence
taaagctcagacagataatt

SEQ ID NO: 333507 - DNA, 20 bp, Artificial
  CRISPR gRNA sequence
aaagctcagacagataattt

SEQ ID NO: 333508 - DNA, 20 bp, Artificial
  CRISPR gRNA sequence
aagctcagacagataatttc

SEQ ID NO: 333509 - DNA, 20 bp, Artificial
  CRISPR gRNA sequence
agacagataatttccattag

SEQ ID NO: 333510 - DNA, 20 bp, Artificial
  CRISPR gRNA sequence
ccattagaacatgacatctc

SEQ ID NO: 333511 - DNA, 20 bp, Artificial
  CRISPR gRNA sequence
cattagaacatgacatctca

SEQ ID NO: 333512 - DNA, 20 bp, Artificial
  CRISPR gRNA sequence
gaacatgacatctcagttgg

SEQ ID NO: 333513 - DNA, 20 bp, Artificial
  CRISPR gRNA sequence
agttggggtagtgtcttgta

SEQ ID NO: 333514 - DNA, 20 bp, Artificial
  CRISPR gRNA sequence
gggtagtgtcttgtatgcat

SEQ ID NO: 333515 - DNA, 20 bp, Artificial
  CRISPR gRNA sequence
gtatgcatgattgtgtatct

SEQ ID NO: 333516 - DNA, 20 bp, Artificial
  CRISPR gRNA sequence
tatgcatgattgtgtatctt

SEQ ID NO: 333517 - DNA, 20 bp, Artificial
  CRISPR gRNA sequence
tgtatcttcatacacttgtt

SEQ ID NO: 333518 - DNA, 20 bp, Artificial
  CRISPR gRNA sequence
catacacttgtttccagaag

SEQ ID NO: 333519 - DNA, 20 bp, Artificial
  CRISPR gRNA sequence
atacacttgtttccagaaga

SEQ ID NO: 333520 - DNA, 20 bp, Artificial
  CRISPR gRNA sequence
gtttccagaagaaaagcaat

SEQ ID NO: 333521 - DNA, 20 bp, Artificial
  CRISPR gRNA sequence
tttccagaagaaaagcaata

SEQ ID NO: 333522 - DNA, 20 bp, Artificial
  CRISPR gRNA sequence
ccagaagaaaagcaataata

SEQ ID NO: 333523 - DNA, 20 bp, Artificial
  CRISPR gRNA sequence
cagaagaaaagcaataatat

SEQ ID NO: 333524 - DNA, 20 bp, Artificial
  CRISPR gRNA sequence
actctgggatcatgccccag

SEQ ID NO: 333525 - DNA, 20 bp, Artificial
  CRISPR gRNA sequence
tgggatcatgccccagctat

SEQ ID NO: 333526 - DNA, 20 bp, Artificial
  CRISPR gRNA sequence
ggatcatgccccagctatga

SEQ ID NO: 333527 - DNA, 20 bp, Artificial
  CRISPR gRNA sequence
tgagctatgtaatcctgggc

SEQ ID NO: 333528 - DNA, 20 bp, Artificial
  CRISPR gRNA sequence
tgtaatcctgggcaagatag

SEQ ID NO: 333529 - DNA, 20 bp, Artificial
  CRISPR gRNA sequence
ggcaagatagtcaccttttc

SEQ ID NO: 333530 - DNA, 20 bp, Artificial
  CRISPR gRNA sequence
ttctggctctagtttaattt

SEQ ID NO: 333531 - DNA, 20 bp, Artificial
  CRISPR gRNA sequence
tctggctctagtttaatttg

SEQ ID NO: 333532 - DNA, 20 bp, Artificial
  CRISPR gRNA sequence
ctggctctagtttaatttga

SEQ ID NO: 333533 - DNA, 20 bp, Artificial
  CRISPR gRNA sequence
tggctctagtttaatttgat

SEQ ID NO: 333534 - DNA, 20 bp, Artificial
  CRISPR gRNA sequence
gctctagtttaatttgataa

SEQ ID NO: 333535 - DNA, 20 bp, Artificial
  CRISPR gRNA sequence
tagtttaatttgataaatgc

SEQ ID NO: 333536 - DNA, 20 bp, Artificial
  CRISPR gRNA sequence
gtttaatttgataaatgcaa

SEQ ID NO: 333537 - DNA, 20 bp, Artificial
  CRISPR gRNA sequence
aatttgataaatgcaaatgg

SEQ ID NO: 333538 - DNA, 20 bp, Artificial
  CRISPR gRNA sequence
atttgataaatgcaaatgga

SEQ ID NO: 333539 - DNA, 20 bp, Artificial
  CRISPR gRNA sequence
gataaatgcaaatggaaaat

SEQ ID NO: 333540 - DNA, 20 bp, Artificial
  CRISPR gRNA sequence
ataaatgcaaatggaaaatg

SEQ ID NO: 333541 - DNA, 20 bp, Artificial
  CRISPR gRNA sequence
aacttgtcatttctagaagc

SEQ ID NO: 333542 - DNA, 20 bp, Artificial
  CRISPR gRNA sequence
acttgtcatttctagaagcc

SEQ ID NO: 333543 - DNA, 20 bp, Artificial
  CRISPR gRNA sequence
gtcatttctagaagcccttt

SEQ ID NO: 333544 - DNA, 20 bp, Artificial
  CRISPR gRNA sequence
tcatttctagaagccctttt

SEQ ID NO: 333545 - DNA, 20 bp, Artificial
  CRISPR gRNA sequence
ctagaagcccttttggctct

SEQ ID NO: 333546 - DNA, 20 bp, Artificial
  CRISPR gRNA sequence
tagaagcccttttggctctt

SEQ ID NO: 333547 - DNA, 20 bp, Artificial
  CRISPR gRNA sequence
gaagcccttttggctcttat

SEQ ID NO: 333548 - DNA, 20 bp, Artificial
  CRISPR gRNA sequence
ttggctcttatattataaat

SEQ ID NO: 333549 - DNA, 20 bp, Artificial
  CRISPR gRNA sequence
tggctcttatattataaatc

SEQ ID NO: 333550 - DNA, 20 bp, Artificial
  CRISPR gRNA sequence
ggctcttatattataaatcc

SEQ ID NO: 333551 - DNA, 20 bp, Artificial
  CRISPR gRNA sequence
gctcttatattataaatcct

SEQ ID NO: 333552 - DNA, 20 bp, Artificial
  CRISPR gRNA sequence
ttatattataaatcctgtgc

SEQ ID NO: 333553 - DNA, 20 bp, Artificial
  CRISPR gRNA sequence
atattataaatcctgtgctt

SEQ ID NO: 333554 - DNA, 20 bp, Artificial
  CRISPR gRNA sequence
tattataaatcctgtgcttc

SEQ ID NO: 333555 - DNA, 20 bp, Artificial
  CRISPR gRNA sequence
taaatcctgtgcttcatctc

SEQ ID NO: 333556 - DNA, 20 bp, Artificial
  CRISPR gRNA sequence
tgcttcatctcctcagattt

SEQ ID NO: 333557 - DNA, 20 bp, Artificial
  CRISPR gRNA sequence
catctcctcagatttaaaat

SEQ ID NO: 333558 - DNA, 20 bp, Artificial
  CRISPR gRNA sequence
atctcctcagatttaaaatg

SEQ ID NO: 333559 - DNA, 20 bp, Artificial
  CRISPR gRNA sequence
ctcagatttaaaatgtcacc

SEQ ID NO: 333560 - DNA, 20 bp, Artificial
  CRISPR gRNA sequence
agatttaaaatgtcaccgtc

SEQ ID NO: 333561 - DNA, 20 bp, Artificial
  CRISPR gRNA sequence
aaaatgtcaccgtctatata

SEQ ID NO: 333562 - DNA, 20 bp, Artificial
  CRISPR gRNA sequence
aaatgtcaccgtctatatat

SEQ ID NO: 333563 - DNA, 20 bp, Artificial
  CRISPR gRNA sequence
tatattcatttgttcgccca

SEQ ID NO: 333564 - DNA, 20 bp, Artificial
  CRISPR gRNA sequence
atttgttcgcccatccaacc

SEQ ID NO: 333565 - DNA, 20 bp, Artificial
  CRISPR gRNA sequence
gttcgcccatccaaccatgc

SEQ ID NO: 333566 - DNA, 20 bp, Artificial
  CRISPR gRNA sequence
ttcgcccatccaaccatgct

SEQ ID NO: 333567 - DNA, 20 bp, Artificial
  CRISPR gRNA sequence
gcccatccaaccatgctttc

SEQ ID NO: 333568 - DNA, 20 bp, Artificial
  CRISPR gRNA sequence
tcatccatccaataaatact

SEQ ID NO: 333569 - DNA, 20 bp, Artificial
  CRISPR gRNA sequence
catccatccaataaatactg

SEQ ID NO: 333570 - DNA, 20 bp, Artificial
  CRISPR gRNA sequence
atccatccaataaatactga

SEQ ID NO: 333571 - DNA, 20 bp, Artificial
  CRISPR gRNA sequence
attgcagcttacaacacacc

SEQ ID NO: 333572 - DNA, 20 bp, Artificial
  CRISPR gRNA sequence
cagcttacaacacaccaggt

SEQ ID NO: 333573 - DNA, 20 bp, Artificial
  CRISPR gRNA sequence
acaacacaccaggtattatt

SEQ ID NO: 333574 - DNA, 20 bp, Artificial
  CRISPR gRNA sequence
caacacaccaggtattattg

SEQ ID NO: 333575 - DNA, 20 bp, Artificial
  CRISPR gRNA sequence
ttgtagatacttgggatgga

SEQ ID NO: 333576 - DNA, 20 bp, Artificial
  CRISPR gRNA sequence
tagatacttgggatggattt

SEQ ID NO: 333577 - DNA, 20 bp, Artificial
  CRISPR gRNA sequence
gggatggatttgtgaataag

SEQ ID NO: 333578 - DNA, 20 bp, Artificial
  CRISPR gRNA sequence
ggatggatttgtgaataaga

SEQ ID NO: 333579 - DNA, 20 bp, Artificial
  CRISPR gRNA sequence
gtgaataagaccaacaaggt

SEQ ID NO: 333580 - DNA, 20 bp, Artificial
  CRISPR gRNA sequence
tgaataagaccaacaaggtc

SEQ ID NO: 333581 - DNA, 20 bp, Artificial
  CRISPR gRNA sequence
gttttaaagcttagagtgga

SEQ ID NO: 333582 - DNA, 20 bp, Artificial
  CRISPR gRNA sequence
taaagcttagagtggagtag

SEQ ID NO: 333583 - DNA, 20 bp, Artificial
  CRISPR gRNA sequence
aaagcttagagtggagtagc

SEQ ID NO: 333584 - DNA, 20 bp, Artificial
  CRISPR gRNA sequence
aagcttagagtggagtagcc

SEQ ID NO: 333585 - DNA, 20 bp, Artificial
  CRISPR gRNA sequence
agagtggagtagccagacaa

SEQ ID NO: 333586 - DNA, 20 bp, Artificial
  CRISPR gRNA sequence
gagtggagtagccagacaat

SEQ ID NO: 333587 - DNA, 20 bp, Artificial
  CRISPR gRNA sequence
cagacagtgataaatgcttt

SEQ ID NO: 333588 - DNA, 20 bp, Artificial
  CRISPR gRNA sequence
agacagtgataaatgcttta

SEQ ID NO: 333589 - DNA, 20 bp, Artificial
  CRISPR gRNA sequence
tatgtcagttaatgtactag

SEQ ID NO: 333590 - DNA, 20 bp, Artificial
  CRISPR gRNA sequence
atgtcagttaatgtactaga

SEQ ID NO: 333591 - DNA, 20 bp, Artificial
  CRISPR gRNA sequence
tgtcagttaatgtactagat

SEQ ID NO: 333592 - DNA, 20 bp, Artificial
  CRISPR gRNA sequence
atgtactagataatgacctg

SEQ ID NO: 333593 - DNA, 20 bp, Artificial
  CRISPR gRNA sequence
gataatgacctggatatatt

SEQ ID NO: 333594 - DNA, 20 bp, Artificial
  CRISPR gRNA sequence
gatatattctttagattggg

SEQ ID NO: 333595 - DNA, 20 bp, Artificial
  CRISPR gRNA sequence
tttagattgggtggccagtg

SEQ ID NO: 333596 - DNA, 20 bp, Artificial
  CRISPR gRNA sequence
tagattgggtggccagtggt

SEQ ID NO: 333597 - DNA, 20 bp, Artificial
  CRISPR gRNA sequence
agattgggtggccagtggtc

SEQ ID NO: 333598 - DNA, 20 bp, Artificial
  CRISPR gRNA sequence
gattgggtggccagtggtca

SEQ ID NO: 333599 - DNA, 20 bp, Artificial
  CRISPR gRNA sequence
ggtggccagtggtcactgaa

SEQ ID NO: 333600 - DNA, 20 bp, Artificial
  CRISPR gRNA sequence
aagaagtgtcattactcttg

SEQ ID NO: 333601 - DNA, 20 bp, Artificial
  CRISPR gRNA sequence
ctcttgaacgatgacaaaga

SEQ ID NO: 333602 - DNA, 20 bp, Artificial
  CRISPR gRNA sequence
ttgaacgatgacaaagaagc

SEQ ID NO: 333603 - DNA, 20 bp, Artificial
  CRISPR gRNA sequence
gaacgatgacaaagaagcag

SEQ ID NO: 333604 - DNA, 20 bp, Artificial
  CRISPR gRNA sequence
aacgatgacaaagaagcagc

SEQ ID NO: 333605 - DNA, 20 bp, Artificial
  CRISPR gRNA sequence
taggtggagaaatgagaaat

SEQ ID NO: 333606 - DNA, 20 bp, Artificial
  CRISPR gRNA sequence
ggtggagaaatgagaaatta

SEQ ID NO: 333607 - DNA, 20 bp, Artificial
  CRISPR gRNA sequence
aaagccctgggaacctgctt

SEQ ID NO: 333608 - DNA, 20 bp, Artificial
  CRISPR gRNA sequence
ggaacctgctttgtgtgttt

SEQ ID NO: 333609 - DNA, 20 bp, Artificial
  CRISPR gRNA sequence
ctttgtgtgtttgaggaaca

SEQ ID NO: 333610 - DNA, 20 bp, Artificial
  CRISPR gRNA sequence
tgtgtgtttgaggaacagaa

SEQ ID NO: 333611 - DNA, 20 bp, Artificial
  CRISPR gRNA sequence
gtgtgtttgaggaacagaaa

SEQ ID NO: 333612 - DNA, 20 bp, Artificial
  CRISPR gRNA sequence
tgtgtttgaggaacagaaag

SEQ ID NO: 333613 - DNA, 20 bp, Artificial
  CRISPR gRNA sequence
gaggaacagaaagaagggca

SEQ ID NO: 333614 - DNA, 20 bp, Artificial
  CRISPR gRNA sequence
aggaacagaaagaagggcag

SEQ ID NO: 333615 - DNA, 20 bp, Artificial
  CRISPR gRNA sequence
tggtgtagtgtgtgactggt

SEQ ID NO: 333616 - DNA, 20 bp, Artificial
  CRISPR gRNA sequence
gtataaaatggggagaggta

SEQ ID NO: 333617 - DNA, 20 bp, Artificial
  CRISPR gRNA sequence
agattttactgtaagtggaa

SEQ ID NO: 333618 - DNA, 20 bp, Artificial
  CRISPR gRNA sequence
gattttactgtaagtggaat

SEQ ID NO: 333619 - DNA, 20 bp, Artificial
  CRISPR gRNA sequence
tactgtaagtggaatgagaa

SEQ ID NO: 333620 - DNA, 20 bp, Artificial
  CRISPR gRNA sequence
actgtaagtggaatgagaag

SEQ ID NO: 333621 - DNA, 20 bp, Artificial
  CRISPR gRNA sequence
ctgtaagtggaatgagaagc

SEQ ID NO: 333622 - DNA, 20 bp, Artificial
  CRISPR gRNA sequence
taagtggaatgagaagcacc

SEQ ID NO: 333623 - DNA, 20 bp, Artificial
  CRISPR gRNA sequence
gaggttttataagcagaaca

SEQ ID NO: 333624 - DNA, 20 bp, Artificial
  CRISPR gRNA sequence
tataagcagaacaatgactc

SEQ ID NO: 333625 - DNA, 20 bp, Artificial
  CRISPR gRNA sequence
ataagcagaacaatgactct

SEQ ID NO: 333626 - DNA, 20 bp, Artificial
  CRISPR gRNA sequence
taagcagaacaatgactcta

SEQ ID NO: 333627 - DNA, 20 bp, Artificial
  CRISPR gRNA sequence
tattggattatgcatgtaag

SEQ ID NO: 333628 - DNA, 20 bp, Artificial
  CRISPR gRNA sequence
ttggattatgcatgtaagaa

SEQ ID NO: 333629 - DNA, 20 bp, Artificial
  CRISPR gRNA sequence
gattatgcatgtaagaaggt

SEQ ID NO: 333630 - DNA, 20 bp, Artificial
  CRISPR gRNA sequence
tgcatgtaagaaggtcattc

SEQ ID NO: 333631 - DNA, 20 bp, Artificial
  CRISPR gRNA sequence
tggtttctctgtggagaatg

SEQ ID NO: 333632 - DNA, 20 bp, Artificial
  CRISPR gRNA sequence
gtttctctgtggagaatgga

SEQ ID NO: 333633 - DNA, 20 bp, Artificial
  CRISPR gRNA sequence
ctctgtggagaatggattgt

SEQ ID NO: 333634 - DNA, 20 bp, Artificial
  CRISPR gRNA sequence
tctgtggagaatggattgta

SEQ ID NO: 333635 - DNA, 20 bp, Artificial
  CRISPR gRNA sequence
tgtggagaatggattgtaaa

SEQ ID NO: 333636 - DNA, 20 bp, Artificial
  CRISPR gRNA sequence
tggagaatggattgtaaatg

SEQ ID NO: 333637 - DNA, 20 bp, Artificial
  CRISPR gRNA sequence
taaatgggcaggagtaaaag

SEQ ID NO: 333638 - DNA, 20 bp, Artificial
  CRISPR gRNA sequence
ttgtagtcccagagagagat

SEQ ID NO: 333639 - DNA, 20 bp, Artificial
  CRISPR gRNA sequence
gtagtcccagagagagatga

SEQ ID NO: 333640 - DNA, 20 bp, Artificial
  CRISPR gRNA sequence
tagtcccagagagagatgac

SEQ ID NO: 333641 - DNA, 20 bp, Artificial
  CRISPR gRNA sequence
ggaccagttgaagctgagat

SEQ ID NO: 333642 - DNA, 20 bp, Artificial
  CRISPR gRNA sequence
gaccagttgaagctgagatg

SEQ ID NO: 333643 - DNA, 20 bp, Artificial
  CRISPR gRNA sequence
aagctgagatggaggagaag

SEQ ID NO: 333644 - DNA, 20 bp, Artificial
  CRISPR gRNA sequence
agatggaggagaagtggata

SEQ ID NO: 333645 - DNA, 20 bp, Artificial
  CRISPR gRNA sequence
tgttggacataaaacagagg

SEQ ID NO: 333646 - DNA, 20 bp, Artificial
  CRISPR gRNA sequence
ttggacataaaacagaggtg

SEQ ID NO: 333647 - DNA, 20 bp, Artificial
  CRISPR gRNA sequence
gacataaaacagaggtgctg

SEQ ID NO: 333648 - DNA, 20 bp, Artificial
  CRISPR gRNA sequence
gaaattaggcgttcttcctg

SEQ ID NO: 333649 - DNA, 20 bp, Artificial
  CRISPR gRNA sequence
ggcgttcttcctgctcacag

SEQ ID NO: 333650 - DNA, 20 bp, Artificial
  CRISPR gRNA sequence
ttcctgctcacagattttta

SEQ ID NO: 333651 - DNA, 20 bp, Artificial
  CRISPR gRNA sequence
cctgctcacagatttttagc

SEQ ID NO: 333652 - DNA, 20 bp, Artificial
  CRISPR gRNA sequence
ctgctcacagatttttagca

SEQ ID NO: 333653 - DNA, 20 bp, Artificial
  CRISPR gRNA sequence
ctcacagatttttagcactg

SEQ ID NO: 333654 - DNA, 20 bp, Artificial
  CRISPR gRNA sequence
acagatttttagcactggtc

SEQ ID NO: 333655 - DNA, 20 bp, Artificial
  CRISPR gRNA sequence
ttagcactggtcctgtaaca

SEQ ID NO: 333656 - DNA, 20 bp, Artificial
  CRISPR gRNA sequence
tagcactggtcctgtaacac

SEQ ID NO: 333657 - DNA, 20 bp, Artificial
  CRISPR gRNA sequence
agcactggtcctgtaacact

SEQ ID NO: 333658 - DNA, 20 bp, Artificial
  CRISPR gRNA sequence
gcactggtcctgtaacactc

SEQ ID NO: 333659 - DNA, 20 bp, Artificial
  CRISPR gRNA sequence
gtcctgtaacactcagttgt

SEQ ID NO: 333660 - DNA, 20 bp, Artificial
  CRISPR gRNA sequence
taacactcagttgttagtga

SEQ ID NO: 333661 - DNA, 20 bp, Artificial
  CRISPR gRNA sequence
agttgttagtgaccactgtc

SEQ ID NO: 333662 - DNA, 20 bp, Artificial
  CRISPR gRNA sequence
ttagtgaccactgtctagct

SEQ ID NO: 333663 - DNA, 20 bp, Artificial
  CRISPR gRNA sequence
gtgaccactgtctagcttcc

SEQ ID NO: 333664 - DNA, 20 bp, Artificial
  CRISPR gRNA sequence
tctagcttcctgtggttgcc

SEQ ID NO: 333665 - DNA, 20 bp, Artificial
  CRISPR gRNA sequence
gcttcctgtggttgcctgct

SEQ ID NO: 333666 - DNA, 20 bp, Artificial
  CRISPR gRNA sequence
cctgtggttgcctgcttcta

SEQ ID NO: 333667 - DNA, 20 bp, Artificial
  CRISPR gRNA sequence
ctgtggttgcctgcttctat

SEQ ID NO: 333668 - DNA, 20 bp, Artificial
  CRISPR gRNA sequence
tggttgcctgcttctattat

SEQ ID NO: 333669 - DNA, 20 bp, Artificial
  CRISPR gRNA sequence
cctgcttctattatacttct

SEQ ID NO: 333670 - DNA, 20 bp, Artificial
  CRISPR gRNA sequence
cttctattatacttctgttg

SEQ ID NO: 333671 - DNA, 20 bp, Artificial
  CRISPR gRNA sequence
ctattatacttctgttgatt

SEQ ID NO: 333672 - DNA, 20 bp, Artificial
  CRISPR gRNA sequence
tattatacttctgttgattg

SEQ ID NO: 333673 - DNA, 20 bp, Artificial
  CRISPR gRNA sequence
ttatacttctgttgattgtt

SEQ ID NO: 333674 - DNA, 20 bp, Artificial
  CRISPR gRNA sequence
tacttctgttgattgttgct

SEQ ID NO: 333675 - DNA, 20 bp, Artificial
  CRISPR gRNA sequence
ctgttgattgttgctagtga

SEQ ID NO: 333676 - DNA, 20 bp, Artificial
  CRISPR gRNA sequence
tgttgattgttgctagtgac

SEQ ID NO: 333677 - DNA, 20 bp, Artificial
  CRISPR gRNA sequence
ttgattgttgctagtgacac

SEQ ID NO: 333678 - DNA, 20 bp, Artificial
  CRISPR gRNA sequence
attgttgctagtgacacttt

SEQ ID NO: 333679 - DNA, 20 bp, Artificial
  CRISPR gRNA sequence
ttgctagtgacactttgact

SEQ ID NO: 333680 - DNA, 20 bp, Artificial
  CRISPR gRNA sequence
ctagtgacactttgactgtg

SEQ ID NO: 333681 - DNA, 20 bp, Artificial
  CRISPR gRNA sequence
gtgacactttgactgtggat
